United States Patent 7,250,496 (BIOINFORMATICALLY DETECTABLE GROUP OF NOVEL REGULATORY GENES AND USES THEREOF) - sequence listing, part 19

SEQ ID NO: 788438 - RNA, 25 nt, Human
ccucaugggcagccagagaccuagg

SEQ ID NO: 788439 - RNA, 19 nt, Human
ccucccagccucagguggg

SEQ ID NO: 788440 - RNA, 20 nt, Human
ccucccagccucaggugggc

SEQ ID NO: 788441 - RNA, 18 nt, Human
ccucuggggccccagccc

SEQ ID NO: 788442 - RNA, 19 nt, Human
ccucuggggccccagcccc

SEQ ID NO: 788443 - RNA, 18 nt, Human
ccuggguuccaugucuuu

SEQ ID NO: 788444 - RNA, 21 nt, Human
ccuguggccacaggaaggaac

SEQ ID NO: 788445 - RNA, 22 nt, Human
cucacucccgaggucucagaac

SEQ ID NO: 788446 - RNA, 19 nt, Human
cucccagccucaggugggc

SEQ ID NO: 788447 - RNA, 22 nt, Human
cugaugccuuacaccuagccca

SEQ ID NO: 788448 - RNA, 20 nt, Human
cugcccucccaguccccagg

SEQ ID NO: 788449 - RNA, 22 nt, Human
cuggggccccagccccaccaug

SEQ ID NO: 788450 - RNA, 24 nt, Human
cuggggcugugccccaagccccug

SEQ ID NO: 788451 - RNA, 23 nt, Human
cuggguugagcugacuggggcug

SEQ ID NO: 788452 - RNA, 19 nt, Human
cugugccccaagccccuga

SEQ ID NO: 788453 - RNA, 24 nt, Human
cugugccccaagccccugacgcuu

SEQ ID NO: 788454 - RNA, 24 nt, Human
cuugacuuccagccuggcuccagu

SEQ ID NO: 788455 - RNA, 22 nt, Human
gaagaggggcuggucagacagc

SEQ ID NO: 788456 - RNA, 22 nt, Human
gaccagccccucccuguggcca

SEQ ID NO: 788457 - RNA, 20 nt, Human
gaggcauugugacagagagc

SEQ ID NO: 788458 - RNA, 19 nt, Human
gcaacccacuuccagguuc

SEQ ID NO: 788459 - RNA, 19 nt, Human
gcagggagaagccacuuga

SEQ ID NO: 788460 - RNA, 20 nt, Human
gccccaagacccacccugca

SEQ ID NO: 788461 - RNA, 18 nt, Human
gccccaccaugagccucc

SEQ ID NO: 788462 - RNA, 23 nt, Human
gccccagccccaccaugagccuc

SEQ ID NO: 788463 - RNA, 19 nt, Human
gcccuuggugcaaggcagc

SEQ ID NO: 788464 - RNA, 20 nt, Human
gcccuuggugcaaggcagcu

SEQ ID NO: 788465 - RNA, 21 nt, Human
gcuagagcagacggagagggc

SEQ ID NO: 788466 - RNA, 24 nt, Human
ggaaauaaggggggugcugauggc

SEQ ID NO: 788467 - RNA, 20 nt, Human
ggaagggagggaggagagga

SEQ ID NO: 788468 - RNA, 22 nt, Human
ggaagggagggaggagaggagc

SEQ ID NO: 788469 - RNA, 19 nt, Human
ggacgguuguaggccuggg

SEQ ID NO: 788470 - RNA, 19 nt, Human
ggcagccagagaccuaggg

SEQ ID NO: 788471 - RNA, 19 nt, Human
ggcccuuggugugcccacu

SEQ ID NO: 788472 - RNA, 22 nt, Human
gggaaggugggcuucucugagc

SEQ ID NO: 788473 - RNA, 20 nt, Human
gggggguccccacccuggcc

SEQ ID NO: 788474 - RNA, 19 nt, Human
ggguggggcuggaagaggg

SEQ ID NO: 788475 - RNA, 21 nt, Human
guccugcuuccucccagccuc

SEQ ID NO: 788476 - RNA, 19 nt, Human
uaaccaagcggacagacua

SEQ ID NO: 788477 - RNA, 21 nt, Human
uaacccacuugcucuuucugc

SEQ ID NO: 788478 - RNA, 18 nt, Human
uaacugcucugccaaaga

SEQ ID NO: 788479 - RNA, 21 nt, Human
uaaggagggccguagccaccc

SEQ ID NO: 788480 - RNA, 19 nt, Human
uagcaguugggacgguugu

SEQ ID NO: 788481 - RNA, 26 nt, Human
uauaacaaacugcuuucagaaagcaa

SEQ ID NO: 788482 - RNA, 21 nt, Human
ucaaugucuuuacuucuaaag

SEQ ID NO: 788483 - RNA, 23 nt, Human
uccaggcagacccagccccaaga

SEQ ID NO: 788484 - RNA, 18 nt, Human
uccaggccagcagccaca

SEQ ID NO: 788485 - RNA, 23 nt, Human
uccccaggccuacgucuuaaagc

SEQ ID NO: 788486 - RNA, 18 nt, Human
uccccagugauccguuca

SEQ ID NO: 788487 - RNA, 20 nt, Human
ucccccuucccccugggccc

SEQ ID NO: 788488 - RNA, 20 nt, Human
ucuaaagcauacauuggacu

SEQ ID NO: 788489 - RNA, 20 nt, Human
ucuccaggcagacccagccc

SEQ ID NO: 788490 - RNA, 18 nt, Human
ucucccccacacggcaac

SEQ ID NO: 788491 - RNA, 21 nt, Human
ucucugagcgccuguaggucc

SEQ ID NO: 788492 - RNA, 23 nt, Human
ucucugagcgccuguagguccgc

SEQ ID NO: 788493 - RNA, 22 nt, Human
ucugccuacaggacaugggggc

SEQ ID NO: 788494 - RNA, 19 nt, Human
ucuuggcuguaccagaccc

SEQ ID NO: 788495 - RNA, 23 nt, Human
ucuuucugcucccuaugacuggg

SEQ ID NO: 788496 - RNA, 22 nt, Human
ugacagagaagcaugguggcau

SEQ ID NO: 788497 - RNA, 18 nt, Human
ugacuuccagccuggcuc

SEQ ID NO: 788498 - RNA, 19 nt, Human
ugaggcauugugacagaga

SEQ ID NO: 788499 - RNA, 20 nt, Human
ugcacaucuccccugccaga

SEQ ID NO: 788500 - RNA, 19 nt, Human
ugccccaagccccugacgc

SEQ ID NO: 788501 - RNA, 22 nt, Human
ugccccaagccccugacgcuuu

SEQ ID NO: 788502 - RNA, 18 nt, Human
ugccuacaggacaugggg

SEQ ID NO: 788503 - RNA, 19 nt, Human
uggcuguaccagaccccug

SEQ ID NO: 788504 - RNA, 25 nt, Human
uggggcccuuggugcaaggcagcug

SEQ ID NO: 788505 - RNA, 23 nt, Human
uggggcuggaagagggcagggga

SEQ ID NO: 788506 - RNA, 20 nt, Human
uggguugagcugacuggggc

SEQ ID NO: 788507 - RNA, 18 nt, Human
uguagggaggguacuggg

SEQ ID NO: 788508 - RNA, 22 nt, Human
uuguccagaacaucuuggcugu

SEQ ID NO: 788509 - RNA, 21 nt, Human
uuguuugcaucugcuggggag

SEQ ID NO: 788510 - RNA, 20 nt, Human
uuuguaaguuuucuccugag

SEQ ID NO: 788511 - RNA, 22 nt, Human
uuuguaaguuuucuccugagcc

SEQ ID NO: 788512 - RNA, 18 nt, Human
uuuuccuccuguccccaa

SEQ ID NO: 788513 - RNA, 22 nt, Human
uuuuccuccuguccccaaggau

SEQ ID NO: 788514 - RNA, 21 nt, Human
aaaaaugguaaagcaauacaa

SEQ ID NO: 788515 - RNA, 18 nt, Human
aaaagaaaaaggucucaa

SEQ ID NO: 788516 - RNA, 21 nt, Human
aaagcuuuuccaacuauguac

SEQ ID NO: 788517 - RNA, 22 nt, Human
aacagugcuuuuuuuuuuuuuu

SEQ ID NO: 788518 - RNA, 19 nt, Human
aacucaacuaucuucccuc

SEQ ID NO: 788519 - RNA, 18 nt, Human
aagcaauacaaacaaugu

SEQ ID NO: 788520 - RNA, 22 nt, Human
aagcacacagaaaaaccacaug

SEQ ID NO: 788521 - RNA, 18 nt, Human
aauugcuuuacaucucua

SEQ ID NO: 788522 - RNA, 23 nt, Human
acacagaaaaaccacauguuugu

SEQ ID NO: 788523 - RNA, 18 nt, Human
acauuuauuaaaaaagca

SEQ ID NO: 788524 - RNA, 25 nt, Human
accuuuaacauuaaaguauaugucu

SEQ ID NO: 788525 - RNA, 18 nt, Human
acuacuguacauccaaaa

SEQ ID NO: 788526 - RNA, 23 nt, Human
auagagcaccuuuaacauuaaag

SEQ ID NO: 788527 - RNA, 21 nt, Human
auggaacagcaaaaacaucua

SEQ ID NO: 788528 - RNA, 21 nt, Human
cagaauggaacagcaaaaaca

SEQ ID NO: 788529 - RNA, 23 nt, Human
cagagcaacuauacaaaagugaa

SEQ ID NO: 788530 - RNA, 21 nt, Human
cagcagagcaacuauacaaaa

SEQ ID NO: 788531 - RNA, 22 nt, Human
caggcaccauuuguuccugcaa

SEQ ID NO: 788532 - RNA, 23 nt, Human
ccacaaagcuuuuccaacuaugu

SEQ ID NO: 788533 - RNA, 20 nt, Human
ccccccacaaagcuuuucca

SEQ ID NO: 788534 - RNA, 19 nt, Human
ccugcagcuaccuccaucc

SEQ ID NO: 788535 - RNA, 22 nt, Human
cuauguacuaugccuccuuucu

SEQ ID NO: 788536 - RNA, 22 nt, Human
cucaucguagugcaggccaaac

SEQ ID NO: 788537 - RNA, 19 nt, Human
gaggcucccuauccugcug

SEQ ID NO: 788538 - RNA, 18 nt, Human
gcagagcaacuauacaaa

SEQ ID NO: 788539 - RNA, 24 nt, Human
gccgugguuaccgagaaagagucg

SEQ ID NO: 788540 - RNA, 21 nt, Human
uacaaaagugaacuaagaguu

SEQ ID NO: 788541 - RNA, 19 nt, Human
uacauucaucuucacacca

SEQ ID NO: 788542 - RNA, 23 nt, Human
uaccgagaaagagucgaggcucc

SEQ ID NO: 788543 - RNA, 21 nt, Human
uagaaucucucacccugcuuc

SEQ ID NO: 788544 - RNA, 21 nt, Human
uagagcaccuuuaacauuaaa

SEQ ID NO: 788545 - RNA, 20 nt, Human
uagcagagucuaaaagaaaa

SEQ ID NO: 788546 - RNA, 26 nt, Human
uauacaaaagugaacuaagaguugaa

SEQ ID NO: 788547 - RNA, 23 nt, Human
uauacaggaaauaaaacucaacu

SEQ ID NO: 788548 - RNA, 25 nt, Human
uaucuucccucuugagguaagccca

SEQ ID NO: 788549 - RNA, 23 nt, Human
uccaaaaaaauagagcaccuuua

SEQ ID NO: 788550 - RNA, 20 nt, Human
ucugauuauuuguucucaug

SEQ ID NO: 788551 - RNA, 23 nt, Human
ugaaagcacacagaaaaaccaca

SEQ ID NO: 788552 - RNA, 28 nt, Human
ugaaagcacacagaaaaacuggagaccc

SEQ ID NO: 788553 - RNA, 24 nt, Human
ugagguaagcccaagccagagcac

SEQ ID NO: 788554 - RNA, 25 nt, Human
ugcaaauaaauaagucucuaaggua

SEQ ID NO: 788555 - RNA, 20 nt, Human
ugcagcuaccuccaucccuc

SEQ ID NO: 788556 - RNA, 23 nt, Human
ugcaggccaaaccaaauuuuaua

SEQ ID NO: 788557 - RNA, 18 nt, Human
ugcuuuacaucucuacca

SEQ ID NO: 788558 - RNA, 26 nt, Human
uggaaauaaaacuacuguacauccaa

SEQ ID NO: 788559 - RNA, 23 nt, Human
uggaacagcaaaaacaucuacga

SEQ ID NO: 788560 - RNA, 19 nt, Human
uguacaagugguuccgcug

SEQ ID NO: 788561 - RNA, 22 nt, Human
uguggacuucuuuuaaacauuu

SEQ ID NO: 788562 - RNA, 23 nt, Human
uuaauauucaggcaccauuuguu

SEQ ID NO: 788563 - RNA, 19 nt, Human
uuaauccccccacaaagcu

SEQ ID NO: 788564 - RNA, 18 nt, Human
uuacauucaucuucacac

SEQ ID NO: 788565 - RNA, 23 nt, Human
uuccugcaaauaaauaagucucu

SEQ ID NO: 788566 - RNA, 19 nt, Human
uucugagccugcagcuacc

SEQ ID NO: 788567 - RNA, 22 nt, Human
uuuuccaacuauguacuaugcc

SEQ ID NO: 788568 - RNA, 24 nt, Human
aaaaaaaggcaauuucuuccagaa

SEQ ID NO: 788569 - RNA, 24 nt, Human
aaacaaaccgacaaauacaaccgg

SEQ ID NO: 788570 - RNA, 21 nt, Human
aaaccacaugacaggaccaau

SEQ ID NO: 788571 - RNA, 21 nt, Human
aaagcagagaaagaaaggucc

SEQ ID NO: 788572 - RNA, 20 nt, Human
aaauacaaccaacaaaacug

SEQ ID NO: 788573 - RNA, 23 nt, Human
aacuacaaaaaucagaaaaggga

SEQ ID NO: 788574 - RNA, 20 nt, Human
aagaaagcagagaaagaaag

SEQ ID NO: 788575 - RNA, 19 nt, Human
aagcaaaacccaaagcaaa

SEQ ID NO: 788576 - RNA, 26 nt, Human
aagcacuucaacaugaaugaaaaaac

SEQ ID NO: 788577 - RNA, 20 nt, Human
aagcagagaaagaaaggucc

SEQ ID NO: 788578 - RNA, 24 nt, Human
aauaagaaaaagccucccaaacac

SEQ ID NO: 788579 - RNA, 23 nt, Human
aauggcauuuuauuuaacagaca

SEQ ID NO: 788580 - RNA, 25 nt, Human
acaaaccgacaaauacaaccaacaa

SEQ ID NO: 788581 - RNA, 21 nt, Human
acaaauacaaccaacaaaacu

SEQ ID NO: 788582 - RNA, 22 nt, Human
acaucugugacucagauggcca

SEQ ID NO: 788583 - RNA, 20 nt, Human
acccuuccccucucuccuca

SEQ ID NO: 788584 - RNA, 18 nt, Human
acucuguuuuucuccacu

SEQ ID NO: 788585 - RNA, 23 nt, Human
acugcugcaaccuuuaagucaag

SEQ ID NO: 788586 - RNA, 23 nt, Human
agaagaugcuuucucuagcccuc

SEQ ID NO: 788587 - RNA, 26 nt, Human
agacaaauaauuuggaauaagcuagc

SEQ ID NO: 788588 - RNA, 19 nt, Human
agagaaagguccaucugau

SEQ ID NO: 788589 - RNA, 18 nt, Human
agcagcaguuucugcaag

SEQ ID NO: 788590 - RNA, 18 nt, Human
auaguaggaaugguuauu

SEQ ID NO: 788591 - RNA, 25 nt, Human
auauauuauacaaacucaaagcauu

SEQ ID NO: 788592 - RNA, 21 nt, Human
augaaaaaacaaaccgacaaa

SEQ ID NO: 788593 - RNA, 21 nt, Human
augaaugaaaaaacaaaccga

SEQ ID NO: 788594 - RNA, 24 nt, Human
augccaugguuugaucacauuuua

SEQ ID NO: 788595 - RNA, 19 nt, Human
caaaacccaaagcaaaugg

SEQ ID NO: 788596 - RNA, 23 nt, Human
caaaccgacaaauacaaccaaca

SEQ ID NO: 788597 - RNA, 27 nt, Human
caacaugaaugaaaaaacaaaccgaca

SEQ ID NO: 788598 - RNA, 28 nt, Human
caaccuuuagaacaaaaaagaaagaaca

SEQ ID NO: 788599 - RNA, 20 nt, Human
caagaaagcagagaaagaaa

SEQ ID NO: 788600 - RNA, 24 nt, Human
caauauaauacuuuacagcaauau

SEQ ID NO: 788601 - RNA, 23 nt, Human
caauauuaacaaacuauucacau

SEQ ID NO: 788602 - RNA, 23 nt, Human
caaugggcugguucuuggaauga

SEQ ID NO: 788603 - RNA, 25 nt, Human
cacaaaaauggccacuggcuuagau

SEQ ID NO: 788604 - RNA, 24 nt, Human
cacuucaacaugaaugaaaaaaca

SEQ ID NO: 788605 - RNA, 18 nt, Human
caggacaucaaucucaca

SEQ ID NO: 788606 - RNA, 18 nt, Human
cagggccauguccccaag

SEQ ID NO: 788607 - RNA, 27 nt, Human
ccaaaaaagaugcauauggacacuuag

SEQ ID NO: 788608 - RNA, 23 nt, Human
ccaaacuacaaaaaucagaaaag

SEQ ID NO: 788609 - RNA, 23 nt, Human
ccaaagcaaauggcugucugaga

SEQ ID NO: 788610 - RNA, 19 nt, Human
ccaagagguagguagcacc

SEQ ID NO: 788611 - RNA, 20 nt, Human
cccaagagguagguagcacc

SEQ ID NO: 788612 - RNA, 22 nt, Human
cccaauguccuuggcgaagauu

SEQ ID NO: 788613 - RNA, 20 nt, Human
ccccucucuccucaggcccc

SEQ ID NO: 788614 - RNA, 24 nt, Human
cccucuguuaguaucucuaaaacc

SEQ ID NO: 788615 - RNA, 20 nt, Human
ccuauaacugaaaaugcaac

SEQ ID NO: 788616 - RNA, 22 nt, Human
ccugaagccuugcaaagcacuu

SEQ ID NO: 788617 - RNA, 21 nt, Human
ccuuuucuuucucuagauuga

SEQ ID NO: 788618 - RNA, 23 nt, Human
cgcaaacagggccauguccccaa

SEQ ID NO: 788619 - RNA, 21 nt, Human
cgucuggaagcaaaacccaaa

SEQ ID NO: 788620 - RNA, 26 nt, Human
cuaaaaccacaugacaggaccaaucc

SEQ ID NO: 788621 - RNA, 21 nt, Human
cuaaaagaucauuguaauggu

SEQ ID NO: 788622 - RNA, 21 nt, Human
cuacaaaaaucagaaaaggga

SEQ ID NO: 788623 - RNA, 23 nt, Human
cuccaagccguuaagagcuucau

SEQ ID NO: 788624 - RNA, 24 nt, Human
cuccuuauaaccggccaaccucaa

SEQ ID NO: 788625 - RNA, 21 nt, Human
cuuagauuuagggaaagauuu

SEQ ID NO: 788626 - RNA, 23 nt, Human
cuuagauuuagggaaagauuuua

SEQ ID NO: 788627 - RNA, 19 nt, Human
gaaaaaaaaaaaaaaggca

SEQ ID NO: 788628 - RNA, 22 nt, Human
gaaagcagagaaagaaaggucc

SEQ ID NO: 788629 - RNA, 26 nt, Human
gaagaugcacauccauuuuuagugcc

SEQ ID NO: 788630 - RNA, 21 nt, Human
gcaaaacccaaagcaaauggc

SEQ ID NO: 788631 - RNA, 20 nt, Human
gcagagaaagaaagguccau

SEQ ID NO: 788632 - RNA, 19 nt, Human
ggaaaggggagucccugcu

SEQ ID NO: 788633 - RNA, 19 nt, Human
ggucuuuuccuccauauug

SEQ ID NO: 788634 - RNA, 21 nt, Human
guccuuuucuuucucuagauu

SEQ ID NO: 788635 - RNA, 23 nt, Human
guccuuuucuuucucuagauuga

SEQ ID NO: 788636 - RNA, 18 nt, Human
gugaaagaagaugcacau

SEQ ID NO: 788637 - RNA, 21 nt, Human
uaaaaccacaugacaggacca

SEQ ID NO: 788638 - RNA, 22 nt, Human
uaaaaccacaugacaggaccaa

SEQ ID NO: 788639 - RNA, 20 nt, Human
uaacaaacuauucacauuaa

SEQ ID NO: 788640 - RNA, 23 nt, Human
uaacccaguuccuguucuugugg

SEQ ID NO: 788641 - RNA, 25 nt, Human
uaacugaaaaugcaaccuuuagaac

SEQ ID NO: 788642 - RNA, 18 nt, Human
uaagaaaaagccucccaa

SEQ ID NO: 788643 - RNA, 22 nt, Human
uaagaaaaagccucccaaacac

SEQ ID NO: 788644 - RNA, 21 nt, Human
uaagagcuucauucacaucuu

SEQ ID NO: 788645 - RNA, 20 nt, Human
uacaaccaacaaaacugaua

SEQ ID NO: 788646 - RNA, 19 nt, Human
uacacauuuauuacauaac

SEQ ID NO: 788647 - RNA, 26 nt, Human
uaccaaaaaagaugcauauggacagu

SEQ ID NO: 788648 - RNA, 25 nt, Human
uaccaaaaaagaugcauauggacua

SEQ ID NO: 788649 - RNA, 21 nt, Human
uaccuuugaaaggguacugaa

SEQ ID NO: 788650 - RNA, 18 nt, Human
uagagaaaauauuuuuuc

SEQ ID NO: 788651 - RNA, 24 nt, Human
uagauugauguaucucugaaggag

SEQ ID NO: 788652 - RNA, 20 nt, Human
uagcauaaaguauuugucaa

SEQ ID NO: 788653 - RNA, 24 nt, Human
uaggcacaauucccaauguccuug

SEQ ID NO: 788654 - RNA, 19 nt, Human
uagugccaucccugcauac

SEQ ID NO: 788655 - RNA, 22 nt, Human
uagugccaucccugcauacuag

SEQ ID NO: 788656 - RNA, 19 nt, Human
uauaaagugaaaucgacuu

SEQ ID NO: 788657 - RNA, 26 nt, Human
uauaagccaugaaacauuuggggcaa

SEQ ID NO: 788658 - RNA, 20 nt, Human
uauuucguuguccuaaguau

SEQ ID NO: 788659 - RNA, 20 nt, Human
ucacaucuugcaguucugac

SEQ ID NO: 788660 - RNA, 24 nt, Human
uccuaggcagagauaccuuugaaa

SEQ ID NO: 788661 - RNA, 20 nt, Human
uccucacaacucuguuuccu

SEQ ID NO: 788662 - RNA, 22 nt, Human
ucucucaauugccaaacuacaa

SEQ ID NO: 788663 - RNA, 21 nt, Human
ucucugaaggagagagagcca

SEQ ID NO: 788664 - RNA, 20 nt, Human
ucuucauuacuggacacacu

SEQ ID NO: 788665 - RNA, 22 nt, Human
ucuugcaguucugacugacagu

SEQ ID NO: 788666 - RNA, 18 nt, Human
ugaaaaaaaaaaaaaagg

SEQ ID NO: 788667 - RNA, 19 nt, Human
ugaaaaaaaaaaaaaaggc

SEQ ID NO: 788668 - RNA, 24 nt, Human
ugaaaaaacaaaccgacaaauaca

SEQ ID NO: 788669 - RNA, 21 nt, Human
ugaaagaagaugcacauccau

SEQ ID NO: 788670 - RNA, 18 nt, Human
ugaaugaaaaaacaaacc

SEQ ID NO: 788671 - RNA, 22 nt, Human
ugauaaucuauuccuaggugac

SEQ ID NO: 788672 - RNA, 21 nt, Human
ugcccuaagggaaaggggagu

SEQ ID NO: 788673 - RNA, 19 nt, Human
ugcugacuuuauauauuau

SEQ ID NO: 788674 - RNA, 23 nt, Human
uggaauaagcuagcuugugagag

SEQ ID NO: 788675 - RNA, 18 nt, Human
uggacacuuagaagucuu

SEQ ID NO: 788676 - RNA, 19 nt, Human
ugggguauaagccaugaaa

SEQ ID NO: 788677 - RNA, 21 nt, Human
ugguuucucuguacccuuccc

SEQ ID NO: 788678 - RNA, 23 nt, Human
uguuauaguuuuagaguaggcac

SEQ ID NO: 788679 - RNA, 26 nt, Human
uguuguggucuuuuccuccauauuga

SEQ ID NO: 788680 - RNA, 26 nt, Human
uuaaaaguuagcagcaguuucugcaa

SEQ ID NO: 788681 - RNA, 22 nt, Human
uuagaacaaaaaagaaagaaca

SEQ ID NO: 788682 - RNA, 18 nt, Human
uuauuaaaaacauuccau

SEQ ID NO: 788683 - RNA, 23 nt, Human
uucaacaugaaugaaaaaacaaa

SEQ ID NO: 788684 - RNA, 22 nt, Human
uuccauggaauguagaugguuu

SEQ ID NO: 788685 - RNA, 23 nt, Human
uuccccuauaacugaaaaugcaa

SEQ ID NO: 788686 - RNA, 24 nt, Human
uugucuauuauuauuaacccaguu

SEQ ID NO: 788687 - RNA, 21 nt, Human
uuuagaacaaaaaagaaagaa

SEQ ID NO: 788688 - RNA, 21 nt, Human
uuucagcaaagugaugccaug

SEQ ID NO: 788689 - RNA, 21 nt, Human
uuuguccuuuuguucuggaga

SEQ ID NO: 788690 - RNA, 22 nt, Human
uuuguccuuuuguucuggagaa

SEQ ID NO: 788691 - RNA, 18 nt, Human
aaaaaacagcugcagaug

SEQ ID NO: 788692 - RNA, 18 nt, Human
aaaauucaaaauauagcc

SEQ ID NO: 788693 - RNA, 21 nt, Human
aaacaacaagaucucauaacu

SEQ ID NO: 788694 - RNA, 19 nt, Human
aaacuguacagucaccaga

SEQ ID NO: 788695 - RNA, 24 nt, Human
aaagaaccauccagaaucauuucc

SEQ ID NO: 788696 - RNA, 22 nt, Human
aaaugauugacuuagagacuua

SEQ ID NO: 788697 - RNA, 18 nt, Human
aaauggccuccauaagau

SEQ ID NO: 788698 - RNA, 19 nt, Human
aacaacuuuucacaagcca

SEQ ID NO: 788699 - RNA, 18 nt, Human
aaccucgcagaucuucuc

SEQ ID NO: 788700 - RNA, 22 nt, Human
aacucugcuauuguucaagaaa

SEQ ID NO: 788701 - RNA, 23 nt, Human
aagcaacuguucuugccaaaggc

SEQ ID NO: 788702 - RNA, 19 nt, Human
aagggcucacaccuguaac

SEQ ID NO: 788703 - RNA, 25 nt, Human
aauguccuuaacucuuuaagcaacu

SEQ ID NO: 788704 - RNA, 20 nt, Human
aauuuguuuuuccauaccac

SEQ ID NO: 788705 - RNA, 21 nt, Human
acacuccagccugggcaacag

SEQ ID NO: 788706 - RNA, 24 nt, Human
acagagcaagacccugucucuaag

SEQ ID NO: 788707 - RNA, 23 nt, Human
accccuucccccaaaaacaacaa

SEQ ID NO: 788708 - RNA, 18 nt, Human
accuucucucccuucuuu

SEQ ID NO: 788709 - RNA, 19 nt, Human
acgcagcagcgcgcgggcu

SEQ ID NO: 788710 - RNA, 24 nt, Human
acugugucucuacacuccagccug

SEQ ID NO: 788711 - RNA, 22 nt, Human
agaaagcagcugcaguccucac

SEQ ID NO: 788712 - RNA, 18 nt, Human
agaaucauuuccuuuuua

SEQ ID NO: 788713 - RNA, 23 nt, Human
agcuggauccgcgagccgacccc

SEQ ID NO: 788714 - RNA, 20 nt, Human
aggcaaaauaggagaaggca

SEQ ID NO: 788715 - RNA, 20 nt, Human
agggagauggagaaaacauu

SEQ ID NO: 788716 - RNA, 19 nt, Human
agggauguccaagcuacug

SEQ ID NO: 788717 - RNA, 19 nt, Human
auaaaacccaaugaagucc

SEQ ID NO: 788718 - RNA, 21 nt, Human
auaaaacccaaugaaguccuc

SEQ ID NO: 788719 - RNA, 22 nt, Human
auaccccuucccccaaaaacaa

SEQ ID NO: 788720 - RNA, 22 nt, Human
auccaaauggccuccauaagau

SEQ ID NO: 788721 - RNA, 18 nt, Human
auccaagcaccauuccaa

SEQ ID NO: 788722 - RNA, 20 nt, Human
auggcggcggcggcggcggc

SEQ ID NO: 788723 - RNA, 21 nt, Human
auuuugugaagaaauucugcu

SEQ ID NO: 788724 - RNA, 18 nt, Human
caaaaaacagcugcagau

SEQ ID NO: 788725 - RNA, 20 nt, Human
caaacuguauccagcuuuau

SEQ ID NO: 788726 - RNA, 24 nt, Human
caacaagaucucauaacucauuau

SEQ ID NO: 788727 - RNA, 22 nt, Human
caacagagcaagacccugucuc

SEQ ID NO: 788728 - RNA, 22 nt, Human
caagaaagcagcugcaguccuc

SEQ ID NO: 788729 - RNA, 19 nt, Human
caagaggaagucucucaaa

SEQ ID NO: 788730 - RNA, 19 nt, Human
caauaguaaaaaccaaacc

SEQ ID NO: 788731 - RNA, 24 nt, Human
cacacauugggaagccgagauggg

SEQ ID NO: 788732 - RNA, 20 nt, Human
cacauauaagggcucacacc

SEQ ID NO: 788733 - RNA, 23 nt, Human
caccagaaguacaguuauaaaaa

SEQ ID NO: 788734 - RNA, 27 nt, Human
cacucaaaaugcugucguuacaaccac

SEQ ID NO: 788735 - RNA, 23 nt, Human
cacuccagccugggcaacagagc

SEQ ID NO: 788736 - RNA, 25 nt, Human
cagaauggucccugcgcaaggauga

SEQ ID NO: 788737 - RNA, 27 nt, Human
cagauugccagacacacugguaaccaa

SEQ ID NO: 788738 - RNA, 27 nt, Human
cagcagcgcgcgggcuuuggucggucc

SEQ ID NO: 788739 - RNA, 24 nt, Human
cauaagauccaagcaccauuccaa

SEQ ID NO: 788740 - RNA, 19 nt, Human
cauaccccuucccccaaaa

SEQ ID NO: 788741 - RNA, 22 nt, Human
ccaaaaaucagccgcuauaaaa

SEQ ID NO: 788742 - RNA, 19 nt, Human
ccaaauggccuccauaaga

SEQ ID NO: 788743 - RNA, 21 nt, Human
ccaagguggccauguguguca

SEQ ID NO: 788744 - RNA, 20 nt, Human
ccauaaucuagaaauggaac

SEQ ID NO: 788745 - RNA, 19 nt, Human
ccauaccacaaggcuuuug

SEQ ID NO: 788746 - RNA, 26 nt, Human
cccuccuccugggagccaagaggaag

SEQ ID NO: 788747 - RNA, 20 nt, Human
ccuucccccaaaaacaacaa

SEQ ID NO: 788748 - RNA, 19 nt, Human
ccuuuagcauccccuucag

SEQ ID NO: 788749 - RNA, 21 nt, Human
cgaccccucaccucccgcucc

SEQ ID NO: 788750 - RNA, 18 nt, Human
cgagaugggaagaucuca

SEQ ID NO: 788751 - RNA, 20 nt, Human
cgagugccacauacuuugaa

SEQ ID NO: 788752 - RNA, 23 nt, Human
cgcgagccgaccccucaccuccc

SEQ ID NO: 788753 - RNA, 18 nt, Human
cgggaugugggcaccggg

SEQ ID NO: 788754 - RNA, 22 nt, Human
cuacacuccagccugggcaaca

SEQ ID NO: 788755 - RNA, 23 nt, Human
cuacacuccagccugggcaacag

SEQ ID NO: 788756 - RNA, 21 nt, Human
cuaggucccuaaaaaugcuga

SEQ ID NO: 788757 - RNA, 24 nt, Human
cucaaaaugcugucguuacaacca

SEQ ID NO: 788758 - RNA, 18 nt, Human
cucacaguucuccaggcu

SEQ ID NO: 788759 - RNA, 20 nt, Human
cuccauaagauccaagcacc

SEQ ID NO: 788760 - RNA, 20 nt, Human
cucccuucuuugcaggggcc

SEQ ID NO: 788761 - RNA, 24 nt, Human
cucucccuucuuugcaggggccuu

SEQ ID NO: 788762 - RNA, 24 nt, Human
cucuugggcauggcggcggcggcg

SEQ ID NO: 788763 - RNA, 19 nt, Human
cugcaguccucacuucagc

SEQ ID NO: 788764 - RNA, 23 nt, Human
cuggauccgcgagccgaccccuc

SEQ ID NO: 788765 - RNA, 22 nt, Human
cugguaauaaaaaauaaaaugg

SEQ ID NO: 788766 - RNA, 18 nt, Human
cuuuugugccaagguggc

SEQ ID NO: 788767 - RNA, 22 nt, Human
gaaauggaaccacugcucuuuu

SEQ ID NO: 788768 - RNA, 23 nt, Human
gaagacauaaaaacgaauuuguu

SEQ ID NO: 788769 - RNA, 21 nt, Human
gaagccucaggaagcuuuuac

SEQ ID NO: 788770 - RNA, 20 nt, Human
gagaauccaaauggccucca

SEQ ID NO: 788771 - RNA, 21 nt, Human
gagccgaccccucaccucccg

SEQ ID NO: 788772 - RNA, 20 nt, Human
gagugccacauacuuugaaa

SEQ ID NO: 788773 - RNA, 20 nt, Human
gauccgcgagccgaccccuc

SEQ ID NO: 788774 - RNA, 24 nt, Human
gaucucaagccuaggaguucaagg

SEQ ID NO: 788775 - RNA, 21 nt, Human
gcucuggcuuuggaggagcag

SEQ ID NO: 788776 - RNA, 19 nt, Human
ggacagauuuggccugcag

SEQ ID NO: 788777 - RNA, 21 nt, Human
ggcaucacuggaaaguccaga

SEQ ID NO: 788778 - RNA, 21 nt, Human
gggcagacagucauuaacagu

SEQ ID NO: 788779 - RNA, 18 nt, Human
gggcauggcggcggcggc

SEQ ID NO: 788780 - RNA, 26 nt, Human
gggcauggcggcggcggcggcggcgg

SEQ ID NO: 788781 - RNA, 23 nt, Human
gguuacauugagguguaacugug

SEQ ID NO: 788782 - RNA, 25 nt, Human
guaaaaauaaaaauagagucaaaga

SEQ ID NO: 788783 - RNA, 20 nt, Human
guccucacuucagcagcaca

SEQ ID NO: 788784 - RNA, 20 nt, Human
guugcuugccugugaguugg

SEQ ID NO: 788785 - RNA, 21 nt, Human
uaaaaaaugcacacacuucac

SEQ ID NO: 788786 - RNA, 21 nt, Human
uaaaaacaaaaaacagcugcc

SEQ ID NO: 788787 - RNA, 18 nt, Human
uaaauggcuuugcuuggc

SEQ ID NO: 788788 - RNA, 21 nt, Human
uaacaguugcuugccugugag

SEQ ID NO: 788789 - RNA, 20 nt, Human
uaaccuucacacauugggaa

SEQ ID NO: 788790 - RNA, 23 nt, Human
uaacucauuaucuuaaggacacc

SEQ ID NO: 788791 - RNA, 18 nt, Human
uaaggacaccaccaaggg

SEQ ID NO: 788792 - RNA, 23 nt, Human
uaauuggcucacaguucuccagg

SEQ ID NO: 788793 - RNA, 21 nt, Human
uaccccuucccccaaaaacaa

SEQ ID NO: 788794 - RNA, 19 nt, Human
uacucaaucacccuacuuu

SEQ ID NO: 788795 - RNA, 19 nt, Human
uacuguuguugcagccuca

SEQ ID NO: 788796 - RNA, 18 nt, Human
uagaggguuaacauuuca

SEQ ID NO: 788797 - RNA, 19 nt, Human
uagcaugucauuauuuuaa

SEQ ID NO: 788798 - RNA, 22 nt, Human
uauuaaaaacaaaaaacagcug

SEQ ID NO: 788799 - RNA, 20 nt, Human
ucaaaguuguuuugccuugu

SEQ ID NO: 788800 - RNA, 24 nt, Human
ucaaccaauggaaaacguaagaac

SEQ ID NO: 788801 - RNA, 21 nt, Human
ucaaucacccuacuuucaaaa

SEQ ID NO: 788802 - RNA, 23 nt, Human
ucacccuacuuucaaaaauuauu

SEQ ID NO: 788803 - RNA, 18 nt, Human
ucaggaaaucccuccucc

SEQ ID NO: 788804 - RNA, 22 nt, Human
ucaggcaggacaugggcagaca

SEQ ID NO: 788805 - RNA, 25 nt, Human
ucccaacagaugucugggcuuaagg

SEQ ID NO: 788806 - RNA, 22 nt, Human
ucccgcuccgguaccgaucgga

SEQ ID NO: 788807 - RNA, 19 nt, Human
ucccuucuuugcaggggcc

SEQ ID NO: 788808 - RNA, 22 nt, Human
uccgcgagccgaccccucaccu

SEQ ID NO: 788809 - RNA, 21 nt, Human
ucucaaaacuagaagggaaag

SEQ ID NO: 788810 - RNA, 24 nt, Human
ucucaagccuaggaguucaagguu

SEQ ID NO: 788811 - RNA, 20 nt, Human
ucucucccuucuuugcaggg

SEQ ID NO: 788812 - RNA, 21 nt, Human
ucugcagcuggauccgcgagc

SEQ ID NO: 788813 - RNA, 20 nt, Human
ugaaaauggcagaauuuauc

SEQ ID NO: 788814 - RNA, 21 nt, Human
ugaaaauggcagaauuuaucc

SEQ ID NO: 788815 - RNA, 19 nt, Human
ugaaacaacaagaucucau

SEQ ID NO: 788816 - RNA, 24 nt, Human
ugacacauaccccuucccccaaaa

SEQ ID NO: 788817 - RNA, 21 nt, Human
ugagaauaacauugccucuaa

SEQ ID NO: 788818 - RNA, 18 nt, Human
ugagcauauucaucacuu

SEQ ID NO: 788819 - RNA, 23 nt, Human
ugcacacacuucacuugggaucu

SEQ ID NO: 788820 - RNA, 24 nt, Human
ugcacuugcaccuaggucccuaaa

SEQ ID NO: 788821 - RNA, 22 nt, Human
ugccaaauacugcuaucaaucc

SEQ ID NO: 788822 - RNA, 18 nt, Human
ugccaagguggccaugug

SEQ ID NO: 788823 - RNA, 23 nt, Human
uggaaccacugcucuuuugacag

SEQ ID NO: 788824 - RNA, 19 nt, Human
uggauccgcgagccgaccc

SEQ ID NO: 788825 - RNA, 18 nt, Human
uggcaucacuggaaaguc

SEQ ID NO: 788826 - RNA, 18 nt, Human
uggcggcggcggcggcgg

SEQ ID NO: 788827 - RNA, 22 nt, Human
uggcggcggcggcggcggcggg

SEQ ID NO: 788828 - RNA, 20 nt, Human
ugggacagauuuggccugca

SEQ ID NO: 788829 - RNA, 24 nt, Human
ugucaaaaugacuguaccauauca

SEQ ID NO: 788830 - RNA, 19 nt, Human
ugucagggauguccaagcu

SEQ ID NO: 788831 - RNA, 24 nt, Human
ugucucuacacuccagccugggca

SEQ ID NO: 788832 - RNA, 19 nt, Human
uguucugugugcuaacaac

SEQ ID NO: 788833 - RNA, 23 nt, Human
uuaaaaauaacaacaaaguccac

SEQ ID NO: 788834 - RNA, 22 nt, Human
uuaacaguauacaacuuucaaa

SEQ ID NO: 788835 - RNA, 21 nt, Human
uuagugacacauaccccuucc

SEQ ID NO: 788836 - RNA, 20 nt, Human
uuauccgaagauccauaauc

SEQ ID NO: 788837 - RNA, 19 nt, Human
uucauccuucaccuuggcu

SEQ ID NO: 788838 - RNA, 20 nt, Human
uucauccuucaccuuggcuu

SEQ ID NO: 788839 - RNA, 24 nt, Human
uuccccguaucaauccagcuucag

SEQ ID NO: 788840 - RNA, 20 nt, Human
uucccuuuggguaccuucuc

SEQ ID NO: 788841 - RNA, 19 nt, Human
uucuccuucacacugcucc

SEQ ID NO: 788842 - RNA, 24 nt, Human
uugcaggggccuuuuuaggcuugg

SEQ ID NO: 788843 - RNA, 19 nt, Human
uugcauugcuauaaagaaa

SEQ ID NO: 788844 - RNA, 20 nt, Human
uuggugagaauaacauugcc

SEQ ID NO: 788845 - RNA, 18 nt, Human
uuuccauaccacaaggcu

SEQ ID NO: 788846 - RNA, 22 nt, Human
uuuuauggugauaguuaauugg

SEQ ID NO: 788847 - RNA, 19 nt, Human
acaguguggucaccccaca

SEQ ID NO: 788848 - RNA, 20 nt, Human
accccacagcccagugggca

SEQ ID NO: 788849 - RNA, 24 nt, Human
agauggggacacaggggcagaggg

SEQ ID NO: 788850 - RNA, 20 nt, Human
agcccagugggcaccagggc

SEQ ID NO: 788851 - RNA, 22 nt, Human
agcugaggcccgggugcugguu

SEQ ID NO: 788852 - RNA, 18 nt, Human
caccagggcagacucccc

SEQ ID NO: 788853 - RNA, 23 nt, Human
caccccacagcccagugggcacc

SEQ ID NO: 788854 - RNA, 26 nt, Human
cagcacagacagcugaggcccgggug

SEQ ID NO: 788855 - RNA, 21 nt, Human
ccacagcccagugggcaccag

SEQ ID NO: 788856 - RNA, 26 nt, Human
ccccucgcagcacagacagcugaggc

SEQ ID NO: 788857 - RNA, 22 nt, Human
ccucuagguacagcuuuggucc

SEQ ID NO: 788858 - RNA, 20 nt, Human
gggacacaggggcagagggc

SEQ ID NO: 788859 - RNA, 22 nt, Human
ucaccccacagcccagugggca

SEQ ID NO: 788860 - RNA, 22 nt, Human
uggggacacaggggcagagggc

SEQ ID NO: 788861 - RNA, 20 nt, Human
aaaccucccuucugauuccu

SEQ ID NO: 788862 - RNA, 22 nt, Human
aacagugucuugggagggcaag

SEQ ID NO: 788863 - RNA, 18 nt, Human
aagcugugcccacagcca

SEQ ID NO: 788864 - RNA, 18 nt, Human
aagcugugcccacagccc

SEQ ID NO: 788865 - RNA, 22 nt, Human
aauuaacacucaacaugaauuu

SEQ ID NO: 788866 - RNA, 22 nt, Human
acacuuuucaaauauaaaaaac

SEQ ID NO: 788867 - RNA, 21 nt, Human
accaacaagggaacacagccu

SEQ ID NO: 788868 - RNA, 18 nt, Human
acccagggccuugguggc

SEQ ID NO: 788869 - RNA, 24 nt, Human
acuacaugugcuaaucaccaucua

SEQ ID NO: 788870 - RNA, 18 nt, Human
agaugccagccagagcuc

SEQ ID NO: 788871 - RNA, 23 nt, Human
agcuuccuugcauuggguuagaa

SEQ ID NO: 788872 - RNA, 24 nt, Human
aggcagucugucccuuagcagagc

SEQ ID NO: 788873 - RNA, 23 nt, Human
aggcauucugguuuuuggaauuu

SEQ ID NO: 788874 - RNA, 22 nt, Human
agggcucugcucagcuggaacu

SEQ ID NO: 788875 - RNA, 24 nt, Human
agggucacuugagcacaggaguuu

SEQ ID NO: 788876 - RNA, 22 nt, Human
aguaugaauucuucccuguaaa

SEQ ID NO: 788877 - RNA, 24 nt, Human
aguuugagaccacccugggcaaca

SEQ ID NO: 788878 - RNA, 19 nt, Human
auccagagcuauauagcca

SEQ ID NO: 788879 - RNA, 19 nt, Human
auccgaaggacuccgugag

SEQ ID NO: 788880 - RNA, 18 nt, Human
auuccaggugccacuggg

SEQ ID NO: 788881 - RNA, 19 nt, Human
auuccuguuaguuuuccuu

SEQ ID NO: 788882 - RNA, 20 nt, Human
auuuaucuaccuuuggucuu

SEQ ID NO: 788883 - RNA, 20 nt, Human
auuucauuucuuuccccuug

SEQ ID NO: 788884 - RNA, 18 nt, Human
caagguucuuagcuuccu

SEQ ID NO: 788885 - RNA, 28 nt, Human
caccaacaagggaacacagccuuaauca

SEQ ID NO: 788886 - RNA, 28 nt, Human
caccccuuucccccacgugcuuuguccc

SEQ ID NO: 788887 - RNA, 20 nt, Human
cagaggcuuugcugagcugu

SEQ ID NO: 788888 - RNA, 19 nt, Human
cagcagaggcuaauaauuu

SEQ ID NO: 788889 - RNA, 23 nt, Human
cagucccucauggcuucccuugg

SEQ ID NO: 788890 - RNA, 19 nt, Human
ccacccugcuucagcucac

SEQ ID NO: 788891 - RNA, 24 nt, Human
ccagucccaaugagaugagccagg

SEQ ID NO: 788892 - RNA, 20 nt, Human
cccacauguugaaauagaac

SEQ ID NO: 788893 - RNA, 22 nt, Human
cccacgugcuuugucccaggga

SEQ ID NO: 788894 - RNA, 27 nt, Human
ccccaccaagcuugaucaucccagguu

SEQ ID NO: 788895 - RNA, 24 nt, Human
ccccccaccaagcuugaucauccc

SEQ ID NO: 788896 - RNA, 19 nt, Human
ccccgucaggaggcauggg

SEQ ID NO: 788897 - RNA, 26 nt, Human
ccccuuucccccacgugcuuuguccc

SEQ ID NO: 788898 - RNA, 20 nt, Human
cccgaauggccgcccaguuu

SEQ ID NO: 788899 - RNA, 21 nt, Human
cccggcuucagcccccuuaac

SEQ ID NO: 788900 - RNA, 20 nt, Human
ccucaugaaagaaguggaac

SEQ ID NO: 788901 - RNA, 23 nt, Human
ccugcugggaggugucuccccgu

SEQ ID NO: 788902 - RNA, 18 nt, Human
ccuguaauugcagccacu

SEQ ID NO: 788903 - RNA, 22 nt, Human
ccuuaaucaugagacagccgcu

SEQ ID NO: 788904 - RNA, 23 nt, Human
ccuuccucuggaagcuuuguccc

SEQ ID NO: 788905 - RNA, 21 nt, Human
cgaaagggacaaaagaggaug

SEQ ID NO: 788906 - RNA, 23 nt, Human
cgccccuccccccaccaagcuug

SEQ ID NO: 788907 - RNA, 18 nt, Human
cggagugcaccauuccuc

SEQ ID NO: 788908 - RNA, 19 nt, Human
cuagaguuuuaagaguaac

SEQ ID NO: 788909 - RNA, 18 nt, Human
cuccccggcuucagcccc

SEQ ID NO: 788910 - RNA, 20 nt, Human
cucucuucagagcuggcagg

SEQ ID NO: 788911 - RNA, 22 nt, Human
cucuguucuccaucagcagagg

SEQ ID NO: 788912 - RNA, 18 nt, Human
cucuucuggucuuucucu

SEQ ID NO: 788913 - RNA, 20 nt, Human
cugaagcugugcccacagcc

SEQ ID NO: 788914 - RNA, 19 nt, Human
cugcucucuucagagcugg

SEQ ID NO: 788915 - RNA, 20 nt, Human
cugcuggaguuugcuggagg

SEQ ID NO: 788916 - RNA, 18 nt, Human
cugugcuggaagaacugc

SEQ ID NO: 788917 - RNA, 28 nt, Human
cuguuccuuccucuggaagcuuuguccc

SEQ ID NO: 788918 - RNA, 20 nt, Human
cuugcugggcucagugggca

SEQ ID NO: 788919 - RNA, 23 nt, Human
gaaaacacuuuucaaauauaaaa

SEQ ID NO: 788920 - RNA, 21 nt, Human
gaaccaaaagaaguggauaaa

SEQ ID NO: 788921 - RNA, 19 nt, Human
gaccccugcugggaggugu

SEQ ID NO: 788922 - RNA, 19 nt, Human
gacuguguuuuggacuggg

SEQ ID NO: 788923 - RNA, 18 nt, Human
gagcuggcugccugaaau

SEQ ID NO: 788924 - RNA, 21 nt, Human
gaggugggagggucacuugag

SEQ ID NO: 788925 - RNA, 22 nt, Human
gaugagccagguaccucagcug

SEQ ID NO: 788926 - RNA, 19 nt, Human
gcagagcucaagcgcugug

SEQ ID NO: 788927 - RNA, 20 nt, Human
gcgccccuccccccaccaag

SEQ ID NO: 788928 - RNA, 22 nt, Human
gcuaucaaaaaaacuccuacag

SEQ ID NO: 788929 - RNA, 20 nt, Human
ggaaaaccaccuauucaagc

SEQ ID NO: 788930 - RNA, 20 nt, Human
gggaggugucuccccgucag

SEQ ID NO: 788931 - RNA, 22 nt, Human
gggucacuugagcacaggaguu

SEQ ID NO: 788932 - RNA, 24 nt, Human
ggucacuugagcacaggaguuuga

SEQ ID NO: 788933 - RNA, 18 nt, Human
uaacaagggaguaagcgg

SEQ ID NO: 788934 - RNA, 18 nt, Human
uaagaccgcucugcagua

SEQ ID NO: 788935 - RNA, 23 nt, Human
uacaggauuacaauauugaaaca

SEQ ID NO: 788936 - RNA, 23 nt, Human
uaccucagcuggaaauacagaaa

SEQ ID NO: 788937 - RNA, 23 nt, Human
uacugcuuucaagaaugcacugu

SEQ ID NO: 788938 - RNA, 22 nt, Human
uagaaagacaccauuuaaaacu

SEQ ID NO: 788939 - RNA, 19 nt, Human
uaguaucugugccggagug

SEQ ID NO: 788940 - RNA, 18 nt, Human
uauguucuucucuaaacu

SEQ ID NO: 788941 - RNA, 19 nt, Human
ucacuugagcacaggaguu

SEQ ID NO: 788942 - RNA, 18 nt, Human
ucaggcuuuuugcacugg

SEQ ID NO: 788943 - RNA, 19 nt, Human
uccaucaggucauuuaugu

SEQ ID NO: 788944 - RNA, 19 nt, Human
ucccaccuucugaagccua

SEQ ID NO: 788945 - RNA, 23 nt, Human
ucccagggagaugaggguuuuau

SEQ ID NO: 788946 - RNA, 18 nt, Human
ucccuucugauuccugcc

SEQ ID NO: 788947 - RNA, 20 nt, Human
ucccuuggcuaggggaggga

SEQ ID NO: 788948 - RNA, 21 nt, Human
uccuuuggaggagaagaggca

SEQ ID NO: 788949 - RNA, 19 nt, Human
ucuaaacugguuauucuag

SEQ ID NO: 788950 - RNA, 20 nt, Human
ucuacaaaaccucccuucug

SEQ ID NO: 788951 - RNA, 21 nt, Human
ucuacaaaaccucccuucuga

SEQ ID NO: 788952 - RNA, 20 nt, Human
ucucuugaagaacagugucu

SEQ ID NO: 788953 - RNA, 21 nt, Human
ucuggcacccagacgcucuca

SEQ ID NO: 788954 - RNA, 19 nt, Human
ucugugccggagugcacca

SEQ ID NO: 788955 - RNA, 21 nt, Human
ucuguggguugcgaagaccau

SEQ ID NO: 788956 - RNA, 22 nt, Human
ucuguggguugcgaagaccaug

SEQ ID NO: 788957 - RNA, 20 nt, Human
ucuuuuguucguuuuaucca

SEQ ID NO: 788958 - RNA, 23 nt, Human
ugaaauagaacuauauuauucaa

SEQ ID NO: 788959 - RNA, 23 nt, Human
ugaaaugacuguguuuuggacug

SEQ ID NO: 788960 - RNA, 26 nt, Human
ugacuuagccucaugaaagaaguggg

SEQ ID NO: 788961 - RNA, 21 nt, Human
ugaggccccucggcugcaggu

SEQ ID NO: 788962 - RNA, 21 nt, Human
ugaggugggagggucacuuga

SEQ ID NO: 788963 - RNA, 23 nt, Human
ugaggugggagggucacuugagc

SEQ ID NO: 788964 - RNA, 20 nt, Human
ugccuguuccuuccucugga

SEQ ID NO: 788965 - RNA, 20 nt, Human
ugcugagcuguggagggcuc

SEQ ID NO: 788966 - RNA, 21 nt, Human
ugcugccuguuccuuccucug

SEQ ID NO: 788967 - RNA, 22 nt, Human
uggaaauacagaaagcacccac

SEQ ID NO: 788968 - RNA, 21 nt, Human
uggacuggggaaccaaaagaa

SEQ ID NO: 788969 - RNA, 21 nt, Human
uggaggagaagaggcauucug

SEQ ID NO: 788970 - RNA, 22 nt, Human
uggaggcugcagaacagcaaag

SEQ ID NO: 788971 - RNA, 22 nt, Human
uggcuccccggcuucagccccc

SEQ ID NO: 788972 - RNA, 23 nt, Human
ugggaaccacuuggcuccccggc

SEQ ID NO: 788973 - RNA, 22 nt, Human
ugggaacugcagaucagagcug

SEQ ID NO: 788974 - RNA, 18 nt, Human
ugggacaucucugauuaa

SEQ ID NO: 788975 - RNA, 21 nt, Human
uggguugcgaagaccauggga

SEQ ID NO: 788976 - RNA, 25 nt, Human
uguaaaaguaacuuacaggauuaca

SEQ ID NO: 788977 - RNA, 18 nt, Human
uguaauguuaacucgaaa

SEQ ID NO: 788978 - RNA, 22 nt, Human
uguauauaacuaaguaaacuca

SEQ ID NO: 788979 - RNA, 19 nt, Human
uguuaagaccgcucugcag

SEQ ID NO: 788980 - RNA, 21 nt, Human
uguuuugguuccaaaauuuuu

SEQ ID NO: 788981 - RNA, 19 nt, Human
uuaaucaugagacagccgc

SEQ ID NO: 788982 - RNA, 21 nt, Human
uucauggguaugcaacccauu

SEQ ID NO: 788983 - RNA, 24 nt, Human
uuccaauguggcccagggaagaca

SEQ ID NO: 788984 - RNA, 19 nt, Human
uuccaggugccacugggcu

SEQ ID NO: 788985 - RNA, 22 nt, Human
uuccucaccaacaagggaacac

SEQ ID NO: 788986 - RNA, 20 nt, Human
uuccuucuaacagugaggcc

SEQ ID NO: 788987 - RNA, 22 nt, Human
uugagcacaggaguuugagacc

SEQ ID NO: 788988 - RNA, 22 nt, Human
uugcugccuguuccuuccucug

SEQ ID NO: 788989 - RNA, 24 nt, Human
uugcugccuguuccuuccucugga

SEQ ID NO: 788990 - RNA, 18 nt, Human
uugcugggcucagugggc

SEQ ID NO: 788991 - RNA, 24 nt, Human
uuuauccagagcuauauagccacu

SEQ ID NO: 788992 - RNA, 23 nt, Human
uuuauguucuucucuaaacuggu

SEQ ID NO: 788993 - RNA, 22 nt, Human
uuuuagcuuaaaaaaagauacu

SEQ ID NO: 788994 - RNA, 18 nt, Human
uuuucagcuccaucaggu

SEQ ID NO: 788995 - RNA, 20 nt, Human
uuuucaggcuuuuugcacug

SEQ ID NO: 788996 - RNA, 21 nt, Human
uuuucaggcuuuuugcacugg

SEQ ID NO: 788997 - RNA, 19 nt, Human
aaacagggugagagcaggg

SEQ ID NO: 788998 - RNA, 21 nt, Human
aaaggcagugugucccugcca

SEQ ID NO: 788999 - RNA, 19 nt, Human
aagcugaagccacagcagc

SEQ ID NO: 789000 - RNA, 22 nt, Human
acacagccccaggagaaacaaa

SEQ ID NO: 789001 - RNA, 23 nt, Human
acacagccccaggagaaacaaaa

SEQ ID NO: 789002 - RNA, 24 nt, Human
acaccagcauaucccucccugagc

SEQ ID NO: 789003 - RNA, 22 nt, Human
acagcuuccaaagcugaagcca

SEQ ID NO: 789004 - RNA, 22 nt, Human
accauccaccccaccaucccca

SEQ ID NO: 789005 - RNA, 25 nt, Human
acccgugccuccuccuuuucuggcu

SEQ ID NO: 789006 - RNA, 24 nt, Human
acccucugccugcucccucuguug

SEQ ID NO: 789007 - RNA, 24 nt, Human
acccugcuccgggcccucaguggu

SEQ ID NO: 789008 - RNA, 21 nt, Human
accugaaccuucucaaugacc

SEQ ID NO: 789009 - RNA, 22 nt, Human
agccacagcagcagaacugugc

SEQ ID NO: 789010 - RNA, 20 nt, Human
agcccaccugaaaucgggag

SEQ ID NO: 789011 - RNA, 28 nt, Human
agcggcaugggcucagcagcucccccuu

SEQ ID NO: 789012 - RNA, 22 nt, Human
agcucgcagcuccagcagcccc

SEQ ID NO: 789013 - RNA, 23 nt, Human
aggagggguccagggguagugcu

SEQ ID NO: 789014 - RNA, 21 nt, Human
aggcagugugucccugccagc

SEQ ID NO: 789015 - RNA, 24 nt, Human
agggcacagaaggacacccuuuuc

SEQ ID NO: 789016 - RNA, 27 nt, Human
aggggcugaaaguugaccagaugagcc

SEQ ID NO: 789017 - RNA, 23 nt, Human
aggguuccaaacagggaggguuc

SEQ ID NO: 789018 - RNA, 19 nt, Human
aggucccccacccucugcc

SEQ ID NO: 789019 - RNA, 19 nt, Human
aggucccccacccucugcc

SEQ ID NO: 789020 - RNA, 22 nt, Human
caaagcacugagcaucagccug

SEQ ID NO: 789021 - RNA, 19 nt, Human
caaccagaaacuuugcagg

SEQ ID NO: 789022 - RNA, 21 nt, Human
cacagccccaggagaaacaaa

SEQ ID NO: 789023 - RNA, 18 nt, Human
cacccgugccuccuccuu

SEQ ID NO: 789024 - RNA, 20 nt, Human
cacccucugccugcucccuc

SEQ ID NO: 789025 - RNA, 18 nt, Human
cacccuuuuccaaaccua

SEQ ID NO: 789026 - RNA, 18 nt, Human
cacuugaugaggcaaggc

SEQ ID NO: 789027 - RNA, 22 nt, Human
cagaaacuuugcaggugaacac

SEQ ID NO: 789028 - RNA, 25 nt, Human
cagaacacagccccaggagaaacaa

SEQ ID NO: 789029 - RNA, 18 nt, Human
cagccuguauugcacuuu

SEQ ID NO: 789030 - RNA, 18 nt, Human
cagcggcaugggcucagc

SEQ ID NO: 789031 - RNA, 20 nt, Human
caggagccccaaaggcagug

SEQ ID NO: 789032 - RNA, 22 nt, Human
caggagggguccagggguagug

SEQ ID NO: 789033 - RNA, 19 nt, Human
caggguuuuucuguugggc

SEQ ID NO: 789034 - RNA, 18 nt, Human
caggugcauuggggcagg

SEQ ID NO: 789035 - RNA, 21 nt, Human
cagugacaaccagaaacuuug

SEQ ID NO: 789036 - RNA, 18 nt, Human
caucacagcggcaugggc

SEQ ID NO: 789037 - RNA, 24 nt, Human
ccaaaccuaagcccucuuuuagcc

SEQ ID NO: 789038 - RNA, 20 nt, Human
ccacagaugcuuuuccucuu

SEQ ID NO: 789039 - RNA, 22 nt, Human
ccacagucacacaggcuuugcc

SEQ ID NO: 789040 - RNA, 19 nt, Human
ccaccuggcuacgcgggaa

SEQ ID NO: 789041 - RNA, 20 nt, Human
ccaggagaaacaaaaccaaa

SEQ ID NO: 789042 - RNA, 19 nt, Human
ccaggauggcggcugcaac

SEQ ID NO: 789043 - RNA, 20 nt, Human
ccaguggccuucccuggcag

SEQ ID NO: 789044 - RNA, 19 nt, Human
cccaccauccccacagcca

SEQ ID NO: 789045 - RNA, 21 nt, Human
cccaccauccccacagccauu

SEQ ID NO: 789046 - RNA, 18 nt, Human
cccaggagaaacaaaacc

SEQ ID NO: 789047 - RNA, 19 nt, Human
cccauggaugacgcgacca

SEQ ID NO: 789048 - RNA, 18 nt, Human
ccccaccauccccacagc

SEQ ID NO: 789049 - RNA, 18 nt, Human
ccccagggcucccgccag

SEQ ID NO: 789050 - RNA, 18 nt, Human
cccgccaggucccccacc

SEQ ID NO: 789051 - RNA, 18 nt, Human
cccuugggcccaccuggc

SEQ ID NO: 789052 - RNA, 23 nt, Human
ccuccuuuucuggcugccugcag

SEQ ID NO: 789053 - RNA, 18 nt, Human
ccucuuggcccccuuggc

SEQ ID NO: 789054 - RNA, 23 nt, Human
ccugccaggcacccuugggccca

SEQ ID NO: 789055 - RNA, 24 nt, Human
ccugccaggcacccuugggcccac

SEQ ID NO: 789056 - RNA, 23 nt, Human
ccuguaaacaucuuugaaccaaa

SEQ ID NO: 789057 - RNA, 19 nt, Human
cgcagcuccagcagccccg

SEQ ID NO: 789058 - RNA, 24 nt, Human
cuccagcagccccgcucgcugauc

SEQ ID NO: 789059 - RNA, 19 nt, Human
cucccugaccauccacccc

SEQ ID NO: 789060 - RNA, 23 nt, Human
cugaagccacagcagcagaacug

SEQ ID NO: 789061 - RNA, 19 nt, Human
cugccagcucacccgugcc

SEQ ID NO: 789062 - RNA, 20 nt, Human
cugcucccucuguuggcucc

SEQ ID NO: 789063 - RNA, 18 nt, Human
cuugaaauauccacugga

SEQ ID NO: 789064 - RNA, 24 nt, Human
gaaacaaaaccaaacagggugaga

SEQ ID NO: 789065 - RNA, 22 nt, Human
gaaccaaaucacuauaaaauaa

SEQ ID NO: 789066 - RNA, 22 nt, Human
gaaggggcuggcauugcacaug

SEQ ID NO: 789067 - RNA, 21 nt, Human
gagauggccugccacugcaga

SEQ ID NO: 789068 - RNA, 21 nt, Human
gagcaggagggguccaggggu

SEQ ID NO: 789069 - RNA, 19 nt, Human
gagcaucccucccugacca

SEQ ID NO: 789070 - RNA, 24 nt, Human
gagcgagcaggagggguccagggg

SEQ ID NO: 789071 - RNA, 24 nt, Human
gaggguuccaaacagggaggguuc

SEQ ID NO: 789072 - RNA, 21 nt, Human
gcauugcacauguccuggcca

SEQ ID NO: 789073 - RNA, 18 nt, Human
gcccauccaaaugagccc

SEQ ID NO: 789074 - RNA, 20 nt, Human
gccgaggggcugaaaguuga

SEQ ID NO: 789075 - RNA, 20 nt, Human
ggaguuccauuuggaaguuc

SEQ ID NO: 789076 - RNA, 25 nt, Human
gggaggguuccaagcagcaaggaaa

SEQ ID NO: 789077 - RNA, 24 nt, Human
gggcucccgccaggucccccaccc

SEQ ID NO: 789078 - RNA, 19 nt, Human
gggguuggguaguugggaa

SEQ ID NO: 789079 - RNA, 24 nt, Human
gguggucauggccuuccuuccggg

SEQ ID NO: 789080 - RNA, 21 nt, Human
ggugugugugugugugugugu

SEQ ID NO: 789081 - RNA, 24 nt, Human
gugcaugugccaagacaagaaggg

SEQ ID NO: 789082 - RNA, 24 nt, Human
gugcauuggggcaggguuuuucug

SEQ ID NO: 789083 - RNA, 23 nt, Human
gugccaagacaagaaggggcugg

SEQ ID NO: 789084 - RNA, 18 nt, Human
gugguacuuguaguagca

SEQ ID NO: 789085 - RNA, 22 nt, Human
gugguggucauggccuuccuuc

SEQ ID NO: 789086 - RNA, 24 nt, Human
guguguguguccuguaaacaucuu

SEQ ID NO: 789087 - RNA, 20 nt, Human
gugugugugugugugugugu

SEQ ID NO: 789088 - RNA, 21 nt, Human
gugugugugugugugugugug

SEQ ID NO: 789089 - RNA, 21 nt, Human
gugugugugugugugugugug

SEQ ID NO: 789090 - RNA, 19 nt, Human
guuguugaguugguguugg

SEQ ID NO: 789091 - RNA, 20 nt, Human
uaaaauaaauuaacaagggc

SEQ ID NO: 789092 - RNA, 21 nt, Human
uaaaauaaauuaacaagggca

SEQ ID NO: 789093 - RNA, 19 nt, Human
uaccccagggcucccgcca

SEQ ID NO: 789094 - RNA, 24 nt, Human
uagcccaccugaaaucgggaguuc

SEQ ID NO: 789095 - RNA, 25 nt, Human
uauaaaauaaauuaacaagggcaca

SEQ ID NO: 789096 - RNA, 18 nt, Human
uauggcgaugacguggua

SEQ ID NO: 789097 - RNA, 19 nt, Human
ucagccucugcuucuucgg

SEQ ID NO: 789098 - RNA, 18 nt, Human
ucccgccaggucccccac

SEQ ID NO: 789099 - RNA, 21 nt, Human
ucccucuguuggcuccggggg

SEQ ID NO: 789100 - RNA, 23 nt, Human
ucccugagcaucccucccugacc

SEQ ID NO: 789101 - RNA, 18 nt, Human
uccuggccaugguggggu

SEQ ID NO: 789102 - RNA, 20 nt, Human
ucgcagcuccagcagccccg

SEQ ID NO: 789103 - RNA, 27 nt, Human
ucugccugcucccucuguuggcuccgg

SEQ ID NO: 789104 - RNA, 22 nt, Human
ucuggcugccugcagaacacag

SEQ ID NO: 789105 - RNA, 22 nt, Human
ugaacacccaguggccuucccu

SEQ ID NO: 789106 - RNA, 20 nt, Human
ugagagcagggcagaccaca

SEQ ID NO: 789107 - RNA, 25 nt, Human
ugagagcagggcagaccacagaugc

SEQ ID NO: 789108 - RNA, 23 nt, Human
ugagcccaggagccccaaaggca

SEQ ID NO: 789109 - RNA, 20 nt, Human
ugaggaagagggagcccagg

SEQ ID NO: 789110 - RNA, 24 nt, Human
ugaggaagagggagcccaggaugg

SEQ ID NO: 789111 - RNA, 24 nt, Human
ugaugaggcaaggcuggugugugc

SEQ ID NO: 789112 - RNA, 24 nt, Human
ugccacagucacacaggcuuugcc

SEQ ID NO: 789113 - RNA, 19 nt, Human
uggaaguuccuucaggaag

SEQ ID NO: 789114 - RNA, 18 nt, Human
uggcaggguccccagagc

SEQ ID NO: 789115 - RNA, 23 nt, Human
uggcauugcacauguccuggcca

SEQ ID NO: 789116 - RNA, 26 nt, Human
uggcccccuuggccuccggggagguc

SEQ ID NO: 789117 - RNA, 22 nt, Human
ugggccagguucagccuguauu

SEQ ID NO: 789118 - RNA, 20 nt, Human
uggggaggguuccaaacagg

SEQ ID NO: 789119 - RNA, 21 nt, Human
ugucccugccagcucacccgu

SEQ ID NO: 789120 - RNA, 22 nt, Human
uguccuguaaacaucuuugaac

SEQ ID NO: 789121 - RNA, 27 nt, Human
ugugucccugccagcucacccgugccu

SEQ ID NO: 789122 - RNA, 21 nt, Human
uguguguguguguguguccug

SEQ ID NO: 789123 - RNA, 22 nt, Human
uguguguguguguguguccugu

SEQ ID NO: 789124 - RNA, 18 nt, Human
ugugugugugugugugug

SEQ ID NO: 789125 - RNA, 18 nt, Human
ugugugugugugugugug

SEQ ID NO: 789126 - RNA, 18 nt, Human
ugugugugugugugugug

SEQ ID NO: 789127 - RNA, 18 nt, Human
ugugugugugugugugug

SEQ ID NO: 789128 - RNA, 18 nt, Human
ugugugugugugugugug

SEQ ID NO: 789129 - RNA, 18 nt, Human
ugugugugugugugugug

SEQ ID NO: 789130 - RNA, 18 nt, Human
ugugugugugugugugug

SEQ ID NO: 789131 - RNA, 18 nt, Human
ugugugugugugugugug

SEQ ID NO: 789132 - RNA, 18 nt, Human
ugugugugugugugugug

SEQ ID NO: 789133 - RNA, 18 nt, Human
ugugugugugugugugug

SEQ ID NO: 789134 - RNA, 18 nt, Human
ugugugugugugugugug

SEQ ID NO: 789135 - RNA, 19 nt, Human
ugugugugugugugugugu

SEQ ID NO: 789136 - RNA, 21 nt, Human
ugugugugugugugugugugu

SEQ ID NO: 789137 - RNA, 21 nt, Human
ugugugugugugugugugugu

SEQ ID NO: 789138 - RNA, 21 nt, Human
ugugugugugugugugugugu

SEQ ID NO: 789139 - RNA, 21 nt, Human
ugugugugugugugugugugu

SEQ ID NO: 789140 - RNA, 21 nt, Human
ugugugugugugugugugugu

SEQ ID NO: 789141 - RNA, 21 nt, Human
ugugugugugugugugugugu

SEQ ID NO: 789142 - RNA, 21 nt, Human
ugugugugugugugugugugu

SEQ ID NO: 789143 - RNA, 21 nt, Human
ugugugugugugugugugugu

SEQ ID NO: 789144 - RNA, 21 nt, Human
ugugugugugugugugugugu

SEQ ID NO: 789145 - RNA, 21 nt, Human
ugugugugugugugugugugu

SEQ ID NO: 789146 - RNA, 21 nt, Human
ugugugugugugugugugugu

SEQ ID NO: 789147 - RNA, 21 nt, Human
ugugugugugugugugugugu

SEQ ID NO: 789148 - RNA, 21 nt, Human
ugugugugugugugugugugu

SEQ ID NO: 789149 - RNA, 21 nt, Human
ugugugugugugugugugugu

SEQ ID NO: 789150 - RNA, 21 nt, Human
ugugugugugugugugugugu

SEQ ID NO: 789151 - RNA, 21 nt, Human
ugugugugugugugugugugu

SEQ ID NO: 789152 - RNA, 21 nt, Human
ugugugugugugugugugugu

SEQ ID NO: 789153 - RNA, 21 nt, Human
ugugugugugugugugugugu

SEQ ID NO: 789154 - RNA, 21 nt, Human
ugugugugugugugugugugu

SEQ ID NO: 789155 - RNA, 22 nt, Human
ugugugugugugugugugugug

SEQ ID NO: 789156 - RNA, 22 nt, Human
ugugugugugugugugugugug

SEQ ID NO: 789157 - RNA, 22 nt, Human
ugugugugugugugugugugug

SEQ ID NO: 789158 - RNA, 22 nt, Human
ugugugugugugugugugugug

SEQ ID NO: 789159 - RNA, 22 nt, Human
ugugugugugugugugugugug

SEQ ID NO: 789160 - RNA, 22 nt, Human
ugugugugugugugugugugug

SEQ ID NO: 789161 - RNA, 22 nt, Human
ugugugugugugugugugugug

SEQ ID NO: 789162 - RNA, 23 nt, Human
ugugugugugugugugugugugu

SEQ ID NO: 789163 - RNA, 22 nt, Human
uuagcccaccugaaaucgggag

SEQ ID NO: 789164 - RNA, 22 nt, Human
uucagccuguauugcacuuugu

SEQ ID NO: 789165 - RNA, 33 nt, Human
uucucuagggguguguguguguguguguguggu

SEQ ID NO: 789166 - RNA, 23 nt, Human
aacaauucucuaucuguccacca

SEQ ID NO: 789167 - RNA, 18 nt, Human
accaucuugccuugcccu

SEQ ID NO: 789168 - RNA, 20 nt, Human
accaucuugccuugcccuuc

SEQ ID NO: 789169 - RNA, 21 nt, Human
agggggcggggcggaggcgug

SEQ ID NO: 789170 - RNA, 22 nt, Human
agggggcggggcggaggcgugg

SEQ ID NO: 789171 - RNA, 25 nt, Human
agggggcggggcggaggcgugggga

SEQ ID NO: 789172 - RNA, 21 nt, Human
agugcccgcugaggcgccggc

SEQ ID NO: 789173 - RNA, 19 nt, Human
cacagccccuguccgcagc

SEQ ID NO: 789174 - RNA, 18 nt, Human
cagaagacauguuuaaua

SEQ ID NO: 789175 - RNA, 26 nt, Human
cagccgcugccaccucacagccccug

SEQ ID NO: 789176 - RNA, 20 nt, Human
cagggagcagggacggggaa

SEQ ID NO: 789177 - RNA, 19 nt, Human
cccgggagggggcggggcg

SEQ ID NO: 789178 - RNA, 21 nt, Human
ccgcugcagccgcugccaccu

SEQ ID NO: 789179 - RNA, 18 nt, Human
ccgcugccaccucacagc

SEQ ID NO: 789180 - RNA, 21 nt, Human
ccggcuccgccgcugcagccg

SEQ ID NO: 789181 - RNA, 25 nt, Human
ccuggggcugaggcagaccgggguc

SEQ ID NO: 789182 - RNA, 22 nt, Human
cucacagccccuguccgcagcu

SEQ ID NO: 789183 - RNA, 19 nt, Human
gaagggggaacagacccca

SEQ ID NO: 789184 - RNA, 24 nt, Human
ggccggcggacaccggauaaagga

SEQ ID NO: 789185 - RNA, 19 nt, Human
gggcugaggcagacaaagg

SEQ ID NO: 789186 - RNA, 23 nt, Human
ucccgcacgcgccuggcagggag

SEQ ID NO: 789187 - RNA, 21 nt, Human
uccgccgcugcagccgcugcc

SEQ ID NO: 789188 - RNA, 24 nt, Human
ucuaucuguccaccaucuugccuu

SEQ ID NO: 789189 - RNA, 24 nt, Human
ugccaccucacagccccuguccgc

SEQ ID NO: 789190 - RNA, 23 nt, Human
uuccuggggcugaggcagacaaa

SEQ ID NO: 789191 - RNA, 21 nt, Human
aaaaaggaugauaauaaaaaa

SEQ ID NO: 789192 - RNA, 19 nt, Human
aaagugcugggauuacagg

SEQ ID NO: 789193 - RNA, 20 nt, Human
aaagugcugggauuacaggc

SEQ ID NO: 789194 - RNA, 23 nt, Human
aaagugcugggauuacaggcgua

SEQ ID NO: 789195 - RNA, 20 nt, Human
aagcaguucauaaacaacua

SEQ ID NO: 789196 - RNA, 20 nt, Human
aagcgauucuucugccucag

SEQ ID NO: 789197 - RNA, 21 nt, Human
aagcgauucuucugccucagc

SEQ ID NO: 789198 - RNA, 18 nt, Human
aaggagggcagggagggg

SEQ ID NO: 789199 - RNA, 19 nt, Human
aaguagcugggauuacagg

SEQ ID NO: 789200 - RNA, 25 nt, Human
aaguagcugggauuacaggcgcccg

SEQ ID NO: 789201 - RNA, 19 nt, Human
aagugcugggauuacaggc

SEQ ID NO: 789202 - RNA, 19 nt, Human
aagugcugggauuacaggc

SEQ ID NO: 789203 - RNA, 26 nt, Human
aagugcugggauuacaggcguaagcc

SEQ ID NO: 789204 - RNA, 23 nt, Human
acagcuccaagagggagggaacc

SEQ ID NO: 789205 - RNA, 21 nt, Human
acgggguuucgccauguuggu

SEQ ID NO: 789206 - RNA, 23 nt, Human
acgggguuucgccauguugguca

SEQ ID NO: 789207 - RNA, 24 nt, Human
acgggguuucgccauguuggucag

SEQ ID NO: 789208 - RNA, 19 nt, Human
acucuagcgcagggguaaa

SEQ ID NO: 789209 - RNA, 18 nt, Human
acucuguuccuggggaac

SEQ ID NO: 789210 - RNA, 26 nt, Human
agacaaaaaaaggaaaugcauacaua

SEQ ID NO: 789211 - RNA, 24 nt, Human
agcgauucuucugccucagccucc

SEQ ID NO: 789212 - RNA, 22 nt, Human
aggaaaggggucacuccuuaau

SEQ ID NO: 789213 - RNA, 19 nt, Human
aggcagcaggccugggucu

SEQ ID NO: 789214 - RNA, 22 nt, Human
aggcagcaggccugggucuggc

SEQ ID NO: 789215 - RNA, 22 nt, Human
aggcagcaggccugggucuggc

SEQ ID NO: 789216 - RNA, 22 nt, Human
aguagagacgggguuucgccau

SEQ ID NO: 789217 - RNA, 18 nt, Human
agugcugggauuacaggc

SEQ ID NO: 789218 - RNA, 24 nt, Human
auuuuuguauuuuuaguagagacg

SEQ ID NO: 789219 - RNA, 24 nt, Human
caaaccugucagcagguaaagaaa

SEQ ID NO: 789220 - RNA, 24 nt, Human
caaagugcugggauuacaggcgua

SEQ ID NO: 789221 - RNA, 20 nt, Human
caagagggaguguugggaug

SEQ ID NO: 789222 - RNA, 19 nt, Human
caaggagggcagggagggg

SEQ ID NO: 789223 - RNA, 21 nt, Human
caaguaaagacccagagauac

SEQ ID NO: 789224 - RNA, 21 nt, Human
cacugcaaccuccgccuccug

SEQ ID NO: 789225 - RNA, 23 nt, Human
cacugcaaccuccgccuccuggg

SEQ ID NO: 789226 - RNA, 24 nt, Human
cacuugggauaggugcugcuggua

SEQ ID NO: 789227 - RNA, 22 nt, Human
caggcagcaggccugggucugg

SEQ ID NO: 789228 - RNA, 21 nt, Human
caggcgcccgccauaacgccc

SEQ ID NO: 789229 - RNA, 20 nt, Human
cagggcccagggguaaccag

SEQ ID NO: 789230 - RNA, 20 nt, Human
caguuccuucauuagggagc

SEQ ID NO: 789231 - RNA, 22 nt, Human
cauaaggcccaucuuaugcagc

SEQ ID NO: 789232 - RNA, 22 nt, Human
ccaaagugcugggauuacaggc

SEQ ID NO: 789233 - RNA, 22 nt, Human
ccaaagugcugggauuacaggc

SEQ ID NO: 789234 - RNA, 24 nt, Human
ccaaagugcugggauuacaggcgu

SEQ ID NO: 789235 - RNA, 22 nt, Human
ccaaguaaagacccagagauac

SEQ ID NO: 789236 - RNA, 22 nt, Human
ccaaguagcugggauuacaggc

SEQ ID NO: 789237 - RNA, 19 nt, Human
ccacugcgcccagccuaaa

SEQ ID NO: 789238 - RNA, 19 nt, Human
ccacugcgcccagccuaaa

SEQ ID NO: 789239 - RNA, 24 nt, Human
ccacugcgcccagccuaaaaagga

SEQ ID NO: 789240 - RNA, 19 nt, Human
ccauguuggucaggcuggu

SEQ ID NO: 789241 - RNA, 22 nt, Human
ccauguuggucaggcuggucuc

SEQ ID NO: 789242 - RNA, 23 nt, Human
ccauguuggucaggcuggucucg

SEQ ID NO: 789243 - RNA, 21 nt, Human
cccaaacauguuccagggagu

SEQ ID NO: 789244 - RNA, 23 nt, Human
cccaaguagcugggauuacaggc

SEQ ID NO: 789245 - RNA, 24 nt, Human
cccaaguagcugggauuacaggcg

SEQ ID NO: 789246 - RNA, 24 nt, Human
ccgccuccuggguuuaagcgauuc

SEQ ID NO: 789247 - RNA, 21 nt, Human
ccuccaucuccuggaggcagg

SEQ ID NO: 789248 - RNA, 24 nt, Human
ccuccuggguuuaagcgauucuuc

SEQ ID NO: 789249 - RNA, 24 nt, Human
ccugccucggccucccaaagugcu

SEQ ID NO: 789250 - RNA, 18 nt, Human
ccugucgcccagacugga

SEQ ID NO: 789251 - RNA, 24 nt, Human
cgccauguuggucaggcuggucuc

SEQ ID NO: 789252 - RNA, 24 nt, Human
cgggguuucgccauguuggucagg

SEQ ID NO: 789253 - RNA, 24 nt, Human
cucacugcaaccuccgccuccugg

SEQ ID NO: 789254 - RNA, 24 nt, Human
cucagccucccaaguagcugggau

SEQ ID NO: 789255 - RNA, 24 nt, Human
cuccugaccucgugauccgccugc

SEQ ID NO: 789256 - RNA, 21 nt, Human
cuccuggguuuaagcgauucu

SEQ ID NO: 789257 - RNA, 23 nt, Human
cugcaaccuccgccuccuggguu

SEQ ID NO: 789258 - RNA, 24 nt, Human
cugcaaccuccgccuccuggguuu

SEQ ID NO: 789259 - RNA, 24 nt, Human
cuggagugcaauggcaugaucuca

SEQ ID NO: 789260 - RNA, 20 nt, Human
cuugcuccugucgcccagac

SEQ ID NO: 789261 - RNA, 24 nt, Human
cuugcuccugucgcccagacugga

SEQ ID NO: 789262 - RNA, 25 nt, Human
gaaacuucuaccaucccaaagugca

SEQ ID NO: 789263 - RNA, 21 nt, Human
gaaugcagaugcaggcagcag

SEQ ID NO: 789264 - RNA, 21 nt, Human
gaccaaguaaagacccagaga

SEQ ID NO: 789265 - RNA, 22 nt, Human
gaccucgugauccgccugccuc

SEQ ID NO: 789266 - RNA, 22 nt, Human
gaccucgugauccgccugccuc

SEQ ID NO: 789267 - RNA, 24 nt, Human
gaccucgugauccgccugccucgg

SEQ ID NO: 789268 - RNA, 22 nt, Human
gacuauguaacugugucagggu

SEQ ID NO: 789269 - RNA, 23 nt, Human
gagacgggguuucgccauguugg

SEQ ID NO: 789270 - RNA, 24 nt, Human
gagacgggguuucgccauguuggu

SEQ ID NO: 789271 - RNA, 18 nt, Human
gauuacaggcgcccgcca

SEQ ID NO: 789272 - RNA, 18 nt, Human
gauuacaggcguaagcca

SEQ ID NO: 789273 - RNA, 22 nt, Human
gauuacaggcguaagccacugc

SEQ ID NO: 789274 - RNA, 22 nt, Human
gauuacaggcguaagccacugc

SEQ ID NO: 789275 - RNA, 24 nt, Human
gcccagacuggagugcaauggcau

SEQ ID NO: 789276 - RNA, 18 nt, Human
gcccagcuaauuuuugua

SEQ ID NO: 789277 - RNA, 22 nt, Human
gcccagcuaauuuuuguauuuu

SEQ ID NO: 789278 - RNA, 18 nt, Human
gcccuagguggaagcccc

SEQ ID NO: 789279 - RNA, 18 nt, Human
gccugggucuggcuucug

SEQ ID NO: 789280 - RNA, 24 nt, Human
gcgauucuucugccucagccuccc

SEQ ID NO: 789281 - RNA, 21 nt, Human
gcuccugucgcccagacugga

SEQ ID NO: 789282 - RNA, 21 nt, Human
gcucucaguucuggagauaaa

SEQ ID NO: 789283 - RNA, 23 nt, Human
gcuggucucgaacuccugaccuc

SEQ ID NO: 789284 - RNA, 22 nt, Human
ggagauaaagugcuuacucuag

SEQ ID NO: 789285 - RNA, 22 nt, Human
ggaugauaauaaaaaacaaacu

SEQ ID NO: 789286 - RNA, 24 nt, Human
ggaugauaauaaaaaacaaacuuc

SEQ ID NO: 789287 - RNA, 22 nt, Human
ggauuacaggcguaagccacug

SEQ ID NO: 789288 - RNA, 20 nt, Human
ggccugggucuggcuucugg

SEQ ID NO: 789289 - RNA, 24 nt, Human
ggcuggucucgaacuccugaccuc

SEQ ID NO: 789290 - RNA, 19 nt, Human
ggcuucuggccuggguuug

SEQ ID NO: 789291 - RNA, 28 nt, Human
gggaacaauguagaauaaaccgguaccc

SEQ ID NO: 789292 - RNA, 19 nt, Human
gggaacagcuccaagaggg

SEQ ID NO: 789293 - RNA, 24 nt, Human
gggagggguucuugugcuccuuua

SEQ ID NO: 789294 - RNA, 19 nt, Human
gggcagggagggguucuug

SEQ ID NO: 789295 - RNA, 21 nt, Human
gggcccagggguaaccagcag

SEQ ID NO: 789296 - RNA, 23 nt, Human
gggguuucgccauguuggucagg

SEQ ID NO: 789297 - RNA, 19 nt, Human
ggucucgaacuccugaccu

SEQ ID NO: 789298 - RNA, 19 nt, Human
guaaagacccagagauacc

SEQ ID NO: 789299 - RNA, 23 nt, Human
guagagacgggguuucgccaugu

SEQ ID NO: 789300 - RNA, 18 nt, Human
guagcugggauuacaggc

SEQ ID NO: 789301 - RNA, 18 nt, Human
guucuugugcuccuuuaa

SEQ ID NO: 789302 - RNA, 27 nt, Human
uaagcgauucuucugccucagccuccc

SEQ ID NO: 789303 - RNA, 24 nt, Human
uaauuuuuguauuuuuaguagaga

SEQ ID NO: 789304 - RNA, 24 nt, Human
uacaggcguaagccacugcgccca

SEQ ID NO: 789305 - RNA, 20 nt, Human
uaccacuagguggcccuagg

SEQ ID NO: 789306 - RNA, 22 nt, Human
uagaaaggaccugagauaccua

SEQ ID NO: 789307 - RNA, 23 nt, Human
uagaauaaacaucugaccaagua

SEQ ID NO: 789308 - RNA, 22 nt, Human
uagagacgggguuucgccaugu

SEQ ID NO: 789309 - RNA, 23 nt, Human
uagcuccauucagggcccagggg

SEQ ID NO: 789310 - RNA, 27 nt, Human
uagcuccauucagggcccagggguaac

SEQ ID NO: 789311 - RNA, 22 nt, Human
uaguaaagacaaaaaaaggaaa

SEQ ID NO: 789312 - RNA, 24 nt, Human
uaguagagacgggguuucgccaug

SEQ ID NO: 789313 - RNA, 19 nt, Human
ucacuccuuaaugacgacc

SEQ ID NO: 789314 - RNA, 23 nt, Human
ucacugcaaccuccgccuccugg

SEQ ID NO: 789315 - RNA, 24 nt, Human
ucacugcaaccuccgccuccuggg

SEQ ID NO: 789316 - RNA, 25 nt, Human
ucacugcaaccuccgccuccugggu

SEQ ID NO: 789317 - RNA, 23 nt, Human
ucacugccgccggcgagugcugg

SEQ ID NO: 789318 - RNA, 20 nt, Human
ucagccucccaaguagcugg

SEQ ID NO: 789319 - RNA, 18 nt, Human
ucaguucuggagauaaag

SEQ ID NO: 789320 - RNA, 23 nt, Human
ucauuguuuuuaauuggcuuuau

SEQ ID NO: 789321 - RNA, 24 nt, Human
ucccaaagugcugggauuacaggc

SEQ ID NO: 789322 - RNA, 24 nt, Human
ucccaaguagcugggauuacaggc

SEQ ID NO: 789323 - RNA, 23 nt, Human
uccggcgcguccuuucacugccg

SEQ ID NO: 789324 - RNA, 21 nt, Human
uccuggguuuaagcgauucuu

SEQ ID NO: 789325 - RNA, 22 nt, Human
ucgccauguuggucaggcuggu

SEQ ID NO: 789326 - RNA, 24 nt, Human
ucgccauguuggucaggcuggucu

SEQ ID NO: 789327 - RNA, 18 nt, Human
ucgcccagacuggagugc

SEQ ID NO: 789328 - RNA, 18 nt, Human
ucggccucccaaagugcu

SEQ ID NO: 789329 - RNA, 19 nt, Human
ucuaccaucccaaagugca

SEQ ID NO: 789330 - RNA, 20 nt, Human
ucuccuggaggcagggugcu

SEQ ID NO: 789331 - RNA, 19 nt, Human
ucucgaacuccugaccucg

SEQ ID NO: 789332 - RNA, 24 nt, Human
ucugccucagccucccaaguagcu

SEQ ID NO: 789333 - RNA, 19 nt, Human
ucuggcuucuggccugggu

SEQ ID NO: 789334 - RNA, 25 nt, Human
ucuugcuccugucgcccagacugga

SEQ ID NO: 789335 - RNA, 19 nt, Human
ugagacagagucuugcucc

SEQ ID NO: 789336 - RNA, 23 nt, Human
ugagacagagucuugcuccuguc

SEQ ID NO: 789337 - RNA, 24 nt, Human
ugagcucauacucuguuccugggg

SEQ ID NO: 789338 - RNA, 21 nt, Human
ugaguuggugcagucuuuugu

SEQ ID NO: 789339 - RNA, 21 nt, Human
ugcauacauaggaaagggaca

SEQ ID NO: 789340 - RNA, 23 nt, Human
ugcauaguaaagacaaaaaaagg

SEQ ID NO: 789341 - RNA, 24 nt, Human
ugccucagccucccaaguagcugg

SEQ ID NO: 789342 - RNA, 21 nt, Human
ugccucggccucccaaagugc

SEQ ID NO: 789343 - RNA, 24 nt, Human
ugccucggccucccaaagugcugg

SEQ ID NO: 789344 - RNA, 24 nt, Human
ugcugcugguaccaaaugugauuu

SEQ ID NO: 789345 - RNA, 24 nt, Human
ugcugggauuacaggcguaagcca

SEQ ID NO: 789346 - RNA, 22 nt, Human
uggaagccccaaacauguucca

SEQ ID NO: 789347 - RNA, 20 nt, Human
uggagccugcagaagcugcu

SEQ ID NO: 789348 - RNA, 23 nt, Human
uggagccugcagaagcugcuggc

SEQ ID NO: 789349 - RNA, 19 nt, Human
uggaggcagggugcccaag

SEQ ID NO: 789350 - RNA, 19 nt, Human
uggagugcaauggcaugau

SEQ ID NO: 789351 - RNA, 24 nt, Human
uggagugcaauggcaugaucucag

SEQ ID NO: 789352 - RNA, 24 nt, Human
uggcaugaucucagcucacugcaa

SEQ ID NO: 789353 - RNA, 20 nt, Human
uggcccuagguggaagcccc

SEQ ID NO: 789354 - RNA, 20 nt, Human
uggccuggguuuggagccug

SEQ ID NO: 789355 - RNA, 26 nt, Human
uggcuucuggccuggguuuggagccu

SEQ ID NO: 789356 - RNA, 18 nt, Human
ugggauuacaggcgcccg

SEQ ID NO: 789357 - RNA, 19 nt, Human
ugggauuacaggcgcccgc

SEQ ID NO: 789358 - RNA, 21 nt, Human
ugggauuacaggcgcccgcca

SEQ ID NO: 789359 - RNA, 21 nt, Human
ugggauuacaggcgcccgcca

SEQ ID NO: 789360 - RNA, 22 nt, Human
ugggauuacaggcgcccgccau

SEQ ID NO: 789361 - RNA, 19 nt, Human
ugggauuacaggcguaagc

SEQ ID NO: 789362 - RNA, 21 nt, Human
ugggauuacaggcguaagcca

SEQ ID NO: 789363 - RNA, 22 nt, Human
ugggauuacaggcguaagccac

SEQ ID NO: 789364 - RNA, 22 nt, Human
ugggauuacaggcguaagccac

SEQ ID NO: 789365 - RNA, 24 nt, Human
ugggauuacaggcguaagccacug

SEQ ID NO: 789366 - RNA, 26 nt, Human
ugggauuacaggcguaagccacugcg

SEQ ID NO: 789367 - RNA, 24 nt, Human
uggucaggcuggucucgaacuccu

SEQ ID NO: 789368 - RNA, 22 nt, Human
ugucagggugaguuggugcagu

SEQ ID NO: 789369 - RNA, 21 nt, Human
ugucccaucuuccccacucuc

SEQ ID NO: 789370 - RNA, 20 nt, Human
ugucgcccagacuggagugc

SEQ ID NO: 789371 - RNA, 21 nt, Human
ugugggcugucccaucuuccc

SEQ ID NO: 789372 - RNA, 18 nt, Human
ugugucagggugaguugg

SEQ ID NO: 789373 - RNA, 19 nt, Human
uuagaaaggaccugagaua

SEQ ID NO: 789374 - RNA, 19 nt, Human
uuagaaucggucugcauca

SEQ ID NO: 789375 - RNA, 18 nt, Human
uuaguagagacgggguuu

SEQ ID NO: 789376 - RNA, 22 nt, Human
uuaguagagacgggguuucgcc

SEQ ID NO: 789377 - RNA, 24 nt, Human
uuaguagagacgggguuucgccau

SEQ ID NO: 789378 - RNA, 23 nt, Human
uuguauuuuuaguagagacgggg

SEQ ID NO: 789379 - RNA, 24 nt, Human
uuuaagcgauucuucugccucagc

SEQ ID NO: 789380 - RNA, 24 nt, Human
uuucgccauguuggucaggcuggu

SEQ ID NO: 789381 - RNA, 22 nt, Human
uuuuagcuccauucagggccca

SEQ ID NO: 789382 - RNA, 23 nt, Human
uuuuuaguagagacgggguuucg

SEQ ID NO: 789383 - RNA, 24 nt, Human
uuuuuaguagagacgggguuucgc

SEQ ID NO: 789384 - RNA, 20 nt, Human
uuuuuguauuuuuaguagag

SEQ ID NO: 789385 - RNA, 24 nt, Human
uuuuuuuuuuuugagacagagucu

SEQ ID NO: 789386 - RNA, 21 nt, Human
aacacuggugggcaugggugu

SEQ ID NO: 789387 - RNA, 20 nt, Human
aagaccaacacuggugggca

SEQ ID NO: 789388 - RNA, 19 nt, Human
aagcaggucucaggcuuug

SEQ ID NO: 789389 - RNA, 20 nt, Human
accagcgccgagaugacauu

SEQ ID NO: 789390 - RNA, 22 nt, Human
agccaggggugggcagugcagg

SEQ ID NO: 789391 - RNA, 24 nt, Human
agccuccgaggggcuccugcccag

SEQ ID NO: 789392 - RNA, 24 nt, Human
agcgccgagaugacauugcccagu

SEQ ID NO: 789393 - RNA, 30 nt, Human
agucagacagaggcacaguuccuucccagg

SEQ ID NO: 789394 - RNA, 18 nt, Human
caccccauggggcagggc

SEQ ID NO: 789395 - RNA, 20 nt, Human
ccccggagcgcuguguggca

SEQ ID NO: 789396 - RNA, 19 nt, Human
ccgcucgcccguggccccg

SEQ ID NO: 789397 - RNA, 25 nt, Human
ccuugagccgcucgcccguggcccc

SEQ ID NO: 789398 - RNA, 19 nt, Human
cggaaacacugauguggua

SEQ ID NO: 789399 - RNA, 23 nt, Human
cggagcgcuguguggcagguggg

SEQ ID NO: 789400 - RNA, 22 nt, Human
cucgcugcccgccagguccacc

SEQ ID NO: 789401 - RNA, 22 nt, Human
cugccgcucgcugcccgccagg

SEQ ID NO: 789402 - RNA, 25 nt, Human
cugcugugggaccccugugccaccc

SEQ ID NO: 789403 - RNA, 21 nt, Human
gaccagccaggggugggcagu

SEQ ID NO: 789404 - RNA, 18 nt, Human
gagcgacagguugaucuu

SEQ ID NO: 789405 - RNA, 18 nt, Human
gcagcuuaauguggagug

SEQ ID NO: 789406 - RNA, 23 nt, Human
gcaggcaauggcaagcagcugug

SEQ ID NO: 789407 - RNA, 21 nt, Human
gcuccugcccagggcggaggu

SEQ ID NO: 789408 - RNA, 26 nt, Human
ggaggugggcucucugggggggaucc

SEQ ID NO: 789409 - RNA, 21 nt, Human
gggcagggcagugcuuaggaa

SEQ ID NO: 789410 - RNA, 24 nt, Human
gggcagugcaggaagaccugcugu

SEQ ID NO: 789411 - RNA, 23 nt, Human
gugaagcaggucucaggcuuuga

SEQ ID NO: 789412 - RNA, 23 nt, Human
gugagcagacggaaacacugaug

SEQ ID NO: 789413 - RNA, 18 nt, Human
guggaguggccuuccuug

SEQ ID NO: 789414 - RNA, 23 nt, Human
uaaggaggacuauacagccuccg

SEQ ID NO: 789415 - RNA, 23 nt, Human
uaauguggaguggccuuccuugg

SEQ ID NO: 789416 - RNA, 23 nt, Human
uacagcgcccguccaccagcgcc

SEQ ID NO: 789417 - RNA, 23 nt, Human
uaggggacgugcuuacagcgccc

SEQ ID NO: 789418 - RNA, 19 nt, Human
ucccagggcugagggagcc

SEQ ID NO: 789419 - RNA, 22 nt, Human
ucccagggcugagggagcccuc

SEQ ID NO: 789420 - RNA, 23 nt, Human
uccuugagccgcucgcccguggc

SEQ ID NO: 789421 - RNA, 19 nt, Human
ucgcugcccgccaggucca

SEQ ID NO: 789422 - RNA, 19 nt, Human
ugaacagcuggagcaggcc

SEQ ID NO: 789423 - RNA, 24 nt, Human
ugccuauaaggcaggcaauggcaa

SEQ ID NO: 789424 - RNA, 24 nt, Human
uggccccggucuuggacugccgcu

SEQ ID NO: 789425 - RNA, 20 nt, Human
ugggaccccugugccacccc

SEQ ID NO: 789426 - RNA, 18 nt, Human
ugggagggccuggcaguc

SEQ ID NO: 789427 - RNA, 24 nt, Human
ugggcaugggugugggcucugugg

SEQ ID NO: 789428 - RNA, 19 nt, Human
uggggccagucagacagag

SEQ ID NO: 789429 - RNA, 20 nt, Human
uggugaaggccgugaagcag

SEQ ID NO: 789430 - RNA, 23 nt, Human
uguggcaggugggaggagaccug

SEQ ID NO: 789431 - RNA, 19 nt, Human
ugugucuucccagggcuga

SEQ ID NO: 789432 - RNA, 21 nt, Human
uuccuugggccacagaccagc

SEQ ID NO: 789433 - RNA, 18 nt, Human
ggcaggaaaaaaguagug

SEQ ID NO: 789434 - RNA, 22 nt, Human
uggggcucucugguguacucca

SEQ ID NO: 789435 - RNA, 22 nt, Human
uuugaugucagguucugccaag

SEQ ID NO: 789436 - RNA, 21 nt, Human
uuuuguguguguguuggcugg

SEQ ID NO: 789437 - RNA, 27 nt, Human
aaaaauaauguaaggaaaccgguaccc

SEQ ID NO: 789438 - RNA, 22 nt, Human
aaaaauagcaacagggggaccg

SEQ ID NO: 789439 - RNA, 21 nt, Human
aaaccagaguguugacacuga

SEQ ID NO: 789440 - RNA, 22 nt, Human
aaacuagaaagagaauguacag

SEQ ID NO: 789441 - RNA, 18 nt, Human
aagcuucauuuucggccc

SEQ ID NO: 789442 - RNA, 22 nt, Human
aauuguuuguuuuuaaacccau

SEQ ID NO: 789443 - RNA, 18 nt, Human
acacugagcgccgaggag

SEQ ID NO: 789444 - RNA, 21 nt, Human
accaauauguuccccaaccug

SEQ ID NO: 789445 - RNA, 22 nt, Human
acucccagcucagagcaggaau

SEQ ID NO: 789446 - RNA, 22 nt, Human
agacaaagacauagacccugca

SEQ ID NO: 789447 - RNA, 18 nt, Human
agcgagcucucuugaucu

SEQ ID NO: 789448 - RNA, 19 nt, Human
aggaauuuuggaggucagg

SEQ ID NO: 789449 - RNA, 20 nt, Human
aggcccuuucacgcuguccc

SEQ ID NO: 789450 - RNA, 19 nt, Human
aucagaaauauguguagca

SEQ ID NO: 789451 - RNA, 24 nt, Human
caaagaaagcgucucaaaucuauu

SEQ ID NO: 789452 - RNA, 23 nt, Human
caaagaacucccagcucagagca

SEQ ID NO: 789453 - RNA, 21 nt, Human
caaauguagcugggcuuccaa

SEQ ID NO: 789454 - RNA, 23 nt, Human
cagagcaggaauauccugcuuaa

SEQ ID NO: 789455 - RNA, 22 nt, Human
caggaauauccugcuuaagaaa

SEQ ID NO: 789456 - RNA, 26 nt, Human
cauagacccugcaaugcuggccucuu

SEQ ID NO: 789457 - RNA, 22 nt, Human
ccccaaccugcuuggaucaaau

SEQ ID NO: 789458 - RNA, 24 nt, Human
ccuauuuauucucuaucaucaaaa

SEQ ID NO: 789459 - RNA, 22 nt, Human
cuaaaccagaguguugacacug

SEQ ID NO: 789460 - RNA, 28 nt, Human
cucagagcaggaauauccugcuuaagaa

SEQ ID NO: 789461 - RNA, 21 nt, Human
gggaacguacacucuucuggc

SEQ ID NO: 789462 - RNA, 19 nt, Human
ggugucaagcaggagacca

SEQ ID NO: 789463 - RNA, 18 nt, Human
uaaaaaauaauguaagga

SEQ ID NO: 789464 - RNA, 23 nt, Human
uaagaaagugcaagaguaaaagc

SEQ ID NO: 789465 - RNA, 22 nt, Human
ucaucaaaaauagcaacagggg

SEQ ID NO: 789466 - RNA, 22 nt, Human
ucauuuucggcccucucuggcc

SEQ ID NO: 789467 - RNA, 21 nt, Human
uccucacagcagugaugguug

SEQ ID NO: 789468 - RNA, 22 nt, Human
ucugugaguacccaccagucua

SEQ ID NO: 789469 - RNA, 19 nt, Human
ucuuggauuccacaggccc

SEQ ID NO: 789470 - RNA, 21 nt, Human
ugagguuagcaacauuggucc

SEQ ID NO: 789471 - RNA, 19 nt, Human
ugcuaaaccagaguguuga

SEQ ID NO: 789472 - RNA, 21 nt, Human
ugggcuuccaaagaaagcguc

SEQ ID NO: 789473 - RNA, 19 nt, Human
uguaggaaaaggaaauucc

SEQ ID NO: 789474 - RNA, 18 nt, Human
uuaaacccauuauugcua

SEQ ID NO: 789475 - RNA, 19 nt, Human
uuccaaagaaagcgucuca

SEQ ID NO: 789476 - RNA, 21 nt, Human
uugacacugagcgccgaggag

SEQ ID NO: 789477 - RNA, 23 nt, Human
aaaaaccucucugaaacaaaucc

SEQ ID NO: 789478 - RNA, 22 nt, Human
aaaaccucucugaaacaaaucc

SEQ ID NO: 789479 - RNA, 25 nt, Human
aaacaaggugugagaacucauaugg

SEQ ID NO: 789480 - RNA, 23 nt, Human
aaaguccugcuacagagcuuucu

SEQ ID NO: 789481 - RNA, 27 nt, Human
aagaaaaaaagauucagguuuaaaaaa

SEQ ID NO: 789482 - RNA, 23 nt, Human
acagagcuuucuucagucucaua

SEQ ID NO: 789483 - RNA, 18 nt, Human
acucauaugauuaagacu

SEQ ID NO: 789484 - RNA, 19 nt, Human
aggaagaauauacugaaaa

SEQ ID NO: 789485 - RNA, 19 nt, Human
auaaaacuagagagggaaa

SEQ ID NO: 789486 - RNA, 24 nt, Human
auaaaacuagagagggaaaaaaac

SEQ ID NO: 789487 - RNA, 19 nt, Human
auucugaauucccauccag

SEQ ID NO: 789488 - RNA, 22 nt, Human
cagagcuuucuucagucucaua

SEQ ID NO: 789489 - RNA, 21 nt, Human
gaaacaaauccacauuguaga

SEQ ID NO: 789490 - RNA, 21 nt, Human
gagcuuucuucagucucauau

SEQ ID NO: 789491 - RNA, 24 nt, Human
gcaccagcaggucugacuuucaac

SEQ ID NO: 789492 - RNA, 24 nt, Human
uaaaaaccucucugaaacaaaucc

SEQ ID NO: 789493 - RNA, 19 nt, Human
uaaaacaaggugugagaac

SEQ ID NO: 789494 - RNA, 28 nt, Human
uaaccuuaacuuuggauuuauuugauuc

SEQ ID NO: 789495 - RNA, 24 nt, Human
ucugaagauucugaauucccaucc

SEQ ID NO: 789496 - RNA, 22 nt, Human
uggaggcaccagcaggucugac

SEQ ID NO: 789497 - RNA, 24 nt, Human
uuaaaacaaggugugagaacucau

SEQ ID NO: 789498 - RNA, 21 nt, Human
uuaggaagaauauacugaaaa

SEQ ID NO: 789499 - RNA, 18 nt, Human
uuagggaaugguuuuaug

SEQ ID NO: 789500 - RNA, 20 nt, Human
uuauccaaagaaaaaaagau

SEQ ID NO: 789501 - RNA, 21 nt, Human
uucccauccagggugcaucua

SEQ ID NO: 789502 - RNA, 22 nt, Human
uuugauucuucauucuuuccuu

SEQ ID NO: 789503 - RNA, 21 nt, Human
uuuuagagauuuuguuagcug

SEQ ID NO: 789504 - RNA, 18 nt, Human
uuuuuuuuuuuuuuuuug

SEQ ID NO: 789505 - RNA, 19 nt, Human
uuuuuuuuuuuuuuuuugu

SEQ ID NO: 789506 - RNA, 21 nt, Human
accacaugauaaaaaaaauca

SEQ ID NO: 789507 - RNA, 21 nt, Human
agaaacauuauuaggaggaaa

SEQ ID NO: 789508 - RNA, 25 nt, Human
auaaaacagaacccauagguagccu

SEQ ID NO: 789509 - RNA, 22 nt, Human
auaguauauacaccacaaaaca

SEQ ID NO: 789510 - RNA, 20 nt, Human
caccacaaaacagacacuuu

SEQ ID NO: 789511 - RNA, 23 nt, Human
caccacaaaacagacacuuucca

SEQ ID NO: 789512 - RNA, 24 nt, Human
cauuuuuuuccccugacaguauca

SEQ ID NO: 789513 - RNA, 22 nt, Human
ccacaugauaaaaaaaaucacu

SEQ ID NO: 789514 - RNA, 21 nt, Human
cccauuuuuuuccccugacag

SEQ ID NO: 789515 - RNA, 23 nt, Human
cugacagcuucuggugaggucuu

SEQ ID NO: 789516 - RNA, 21 nt, Human
cugacccauuuuuuuccccug

SEQ ID NO: 789517 - RNA, 24 nt, Human
gaguucugacccauuuuuuucccc

SEQ ID NO: 789518 - RNA, 21 nt, Human
uaaguuaacaaaagagaaaca

SEQ ID NO: 789519 - RNA, 23 nt, Human
uaaguuaacaaaagagaaacauu

SEQ ID NO: 789520 - RNA, 20 nt, Human
uacaccacaaaacagacacc

SEQ ID NO: 789521 - RNA, 23 nt, Human
uacaccacaaaacagacacuuuc

SEQ ID NO: 789522 - RNA, 18 nt, Human
uauacaaauaaaacagaa

SEQ ID NO: 789523 - RNA, 21 nt, Human
uauacaaauaaaacagaaccc

SEQ ID NO: 789524 - RNA, 22 nt, Human
ucaaguuguugagccguucugc

SEQ ID NO: 789525 - RNA, 21 nt, Human
uccacugacagcuucugguga

SEQ ID NO: 789526 - RNA, 22 nt, Human
ugaaaaauaaauaaguuaacaa

SEQ ID NO: 789527 - RNA, 22 nt, Human
ugacaacauaaauacaaauaaa

SEQ ID NO: 789528 - RNA, 18 nt, Human
ugacagaugcugaguucu

SEQ ID NO: 789529 - RNA, 19 nt, Human
ugacagaugcugaguucug

SEQ ID NO: 789530 - RNA, 21 nt, Human
uuagaaaaugcugugauuuua

SEQ ID NO: 789531 - RNA, 18 nt, Human
uuaggaggaaaaugaaaa

SEQ ID NO: 789532 - RNA, 25 nt, Human
uuccccugacaguaucaauaggcug

SEQ ID NO: 789533 - RNA, 33 nt, Human
aaaaaauaaaaggacaucacaacaaagaaaaag

SEQ ID NO: 789534 - RNA, 19 nt, Human
aaaagcaucauuacuacag

SEQ ID NO: 789535 - RNA, 23 nt, Human
aaacagcaucugugcuuuucuca

SEQ ID NO: 789536 - RNA, 22 nt, Human
aaagaaaaacaauacauuuaca

SEQ ID NO: 789537 - RNA, 19 nt, Human
aacacuugaacuggaacug

SEQ ID NO: 789538 - RNA, 21 nt, Human
aacacuugaacuggaacuggu

SEQ ID NO: 789539 - RNA, 20 nt, Human
aacuuggcauaucaacagug

SEQ ID NO: 789540 - RNA, 22 nt, Human
aagagaaaaaaaaaaagcagag

SEQ ID NO: 789541 - RNA, 21 nt, Human
aauaaauaaugcacugcacaa

SEQ ID NO: 789542 - RNA, 21 nt, Human
acagcagcaggguucuucgca

SEQ ID NO: 789543 - RNA, 21 nt, Human
agagaaaaaaaaaaagcagag

SEQ ID NO: 789544 - RNA, 18 nt, Human
agcaccaacagauccauu

SEQ ID NO: 789545 - RNA, 22 nt, Human
agcuugaccuucacagcaaaaa

SEQ ID NO: 789546 - RNA, 21 nt, Human
aggcuguucaccagcaaaggg

SEQ ID NO: 789547 - RNA, 19 nt, Human
auggauguguguguaugca

SEQ ID NO: 789548 - RNA, 22 nt, Human
auguguguguaugcacgagugu

SEQ ID NO: 789549 - RNA, 23 nt, Human
caaacaggcuguucaccagcaaa

SEQ ID NO: 789550 - RNA, 19 nt, Human
caacaaagaaaaacaauac

SEQ ID NO: 789551 - RNA, 20 nt, Human
caacaaagaaaaacaauaca

SEQ ID NO: 789552 - RNA, 22 nt, Human
caacagcccgcccaagccaaac

SEQ ID NO: 789553 - RNA, 20 nt, Human
caacaggcacccuuucuucu

SEQ ID NO: 789554 - RNA, 27 nt, Human
caccaacagauccauucgcagagucag

SEQ ID NO: 789555 - RNA, 22 nt, Human
cacccuuucuucuccugucaaa

SEQ ID NO: 789556 - RNA, 19 nt, Human
cagcacagcagcaggguuc

SEQ ID NO: 789557 - RNA, 21 nt, Human
cagcacaucugcauucuuugg

SEQ ID NO: 789558 - RNA, 22 nt, Human
cagcacaucugcauucuuuggu

SEQ ID NO: 789559 - RNA, 22 nt, Human
cagccgaaacagcaucugugcu

SEQ ID NO: 789560 - RNA, 21 nt, Human
cagccuuuucuucgcuggagc

SEQ ID NO: 789561 - RNA, 24 nt, Human
caggaacaaaaccagacugcuuaa

SEQ ID NO: 789562 - RNA, 25 nt, Human
caucugugcuuuucucagagucuuu

SEQ ID NO: 789563 - RNA, 21 nt, Human
caugucuguaaacuucaaggc

SEQ ID NO: 789564 - RNA, 20 nt, Human
cauuacaagaccacgagaca

SEQ ID NO: 789565 - RNA, 23 nt, Human
ccaaacacguugggcaggcccgc

SEQ ID NO: 789566 - RNA, 20 nt, Human
ccaagccaaacacguugggc

SEQ ID NO: 789567 - RNA, 19 nt, Human
cccgcacuacaggcccagu

SEQ ID NO: 789568 - RNA, 23 nt, Human
cccgcacuacaggcccagugaga

SEQ ID NO: 789569 - RNA, 20 nt, Human
cccugugcuauuucgucuuc

SEQ ID NO: 789570 - RNA, 19 nt, Human
ccgaaacagcaucugugcu

SEQ ID NO: 789571 - RNA, 19 nt, Human
ccucuccuuuugaagugcu

SEQ ID NO: 789572 - RNA, 20 nt, Human
cgcuggagcccacggcauuc

SEQ ID NO: 789573 - RNA, 21 nt, Human
cguggaggccacagcagcggc

SEQ ID NO: 789574 - RNA, 24 nt, Human
cuauuucgucuucuaagagggagg

SEQ ID NO: 789575 - RNA, 23 nt, Human
cucaaauuucaucucuccuaggg

SEQ ID NO: 789576 - RNA, 20 nt, Human
cuggguccagcuguccggga

SEQ ID NO: 789577 - RNA, 18 nt, Human
cuguaaacuucaaggcua

SEQ ID NO: 789578 - RNA, 21 nt, Human
cugucuggcaagaacccuccc

SEQ ID NO: 789579 - RNA, 20 nt, Human
gagcaacugcaaauucagga

SEQ ID NO: 789580 - RNA, 19 nt, Human
gaucaccucucaaauuuca

SEQ ID NO: 789581 - RNA, 24 nt, Human
gcaaacaggcuguucaccagcaaa

SEQ ID NO: 789582 - RNA, 24 nt, Human
gcagccgaaacagcaucugugcuu

SEQ ID NO: 789583 - RNA, 22 nt, Human
gcaucaggggcagcacagcagc

SEQ ID NO: 789584 - RNA, 21 nt, Human
gccaccuggguagauccuuca

SEQ ID NO: 789585 - RNA, 20 nt, Human
gcuccacccaucuucuuccc

SEQ ID NO: 789586 - RNA, 19 nt, Human
gggagaaggaauguuucuu

SEQ ID NO: 789587 - RNA, 20 nt, Human
gggagaaggaauguuucuug

SEQ ID NO: 789588 - RNA, 20 nt, Human
ggguagaagaggcccggggc

SEQ ID NO: 789589 - RNA, 20 nt, Human
guguauggauguguguguau

SEQ ID NO: 789590 - RNA, 24 nt, Human
guuauucaucauuuucauuguuuu

SEQ ID NO: 789591 - RNA, 23 nt, Human
uaaauuucagcuugaccuucaca

SEQ ID NO: 789592 - RNA, 18 nt, Human
uaacugugaguguaaaca

SEQ ID NO: 789593 - RNA, 18 nt, Human
uaacuuggcauaucaaca

SEQ ID NO: 789594 - RNA, 19 nt, Human
uaacuuggcauaucaacag

SEQ ID NO: 789595 - RNA, 19 nt, Human
uaaugcuguuuuagcuuug

SEQ ID NO: 789596 - RNA, 22 nt, Human
uacaagaccacgagacaaugga

SEQ ID NO: 789597 - RNA, 24 nt, Human
uaccaagagaaaaaaaaaaagcag

SEQ ID NO: 789598 - RNA, 33 nt, Human
uagaaacauggauggguagaagaggcccggggg

SEQ ID NO: 789599 - RNA, 22 nt, Human
uaucuuacaugauagcaguuuu

SEQ ID NO: 789600 - RNA, 23 nt, Human
ucaacagcccgcccaagccaaac

SEQ ID NO: 789601 - RNA, 19 nt, Human
ucaacaguguaaguagggu

SEQ ID NO: 789602 - RNA, 21 nt, Human
ucaaggcuaguuuagagcuga

SEQ ID NO: 789603 - RNA, 19 nt, Human
ucacaacaaagaaaaacaa

SEQ ID NO: 789604 - RNA, 23 nt, Human
ucacaacaaagaaaaacaauaca

SEQ ID NO: 789605 - RNA, 21 nt, Human
ucccugacguggaggccacag

SEQ ID NO: 789606 - RNA, 21 nt, Human
uccggcgguggcagcuguugc

SEQ ID NO: 789607 - RNA, 20 nt, Human
ucgggacagaggcguucaca

SEQ ID NO: 789608 - RNA, 21 nt, Human
ucgguuucugaaaugaggaaa

SEQ ID NO: 789609 - RNA, 19 nt, Human
ucucaaauuucaucucucc

SEQ ID NO: 789610 - RNA, 24 nt, Human
ucugcagucuuauccaggcucucc

SEQ ID NO: 789611 - RNA, 24 nt, Human
ucuuuauuuauucaucuauuuauu

SEQ ID NO: 789612 - RNA, 18 nt, Human
ugagaaggcggucaaaca

SEQ ID NO: 789613 - RNA, 18 nt, Human
ugaggaaaacagcacauc

SEQ ID NO: 789614 - RNA, 20 nt, Human
ugaguguaaacaguaggacu

SEQ ID NO: 789615 - RNA, 18 nt, Human
ugccuuauuauugcugcg

SEQ ID NO: 789616 - RNA, 25 nt, Human
uggagggaagcccaugaggccugcc

SEQ ID NO: 789617 - RNA, 18 nt, Human
uggcagcaucaggggcag

SEQ ID NO: 789618 - RNA, 23 nt, Human
uguaaacaguaggacuaccacuu

SEQ ID NO: 789619 - RNA, 19 nt, Human
uguaugcacgaguguggga

SEQ ID NO: 789620 - RNA, 21 nt, Human
uguaugcacgagugugggaac

SEQ ID NO: 789621 - RNA, 19 nt, Human
uguauggauguguguguau

SEQ ID NO: 789622 - RNA, 20 nt, Human
uguguguaugcacgagugug

SEQ ID NO: 789623 - RNA, 20 nt, Human
uuaaacacuugaacuggaac

SEQ ID NO: 789624 - RNA, 19 nt, Human
uucacagcaaaaaaauuaa

SEQ ID NO: 789625 - RNA, 25 nt, Human
uuccuuaaaaagacaugaucaccuc

SEQ ID NO: 789626 - RNA, 21 nt, Human
uuccuuugagcagcacuuucu

SEQ ID NO: 789627 - RNA, 23 nt, Human
uuccuuugagcagcacuuucuuc

SEQ ID NO: 789628 - RNA, 19 nt, Human
uucgucuucuaagagggag

SEQ ID NO: 789629 - RNA, 18 nt, Human
uucuaagagggaggacuc

SEQ ID NO: 789630 - RNA, 18 nt, Human
uucuauuucauccccccc

SEQ ID NO: 789631 - RNA, 23 nt, Human
uugggccuucuuccucuucugcu

SEQ ID NO: 789632 - RNA, 20 nt, Human
uuugaagugcugucuuccgg

SEQ ID NO: 789633 - RNA, 22 nt, Human
agagggaggagccggaaccgcc

SEQ ID NO: 789634 - RNA, 19 nt, Human
agccggaaccgcccggcgc

SEQ ID NO: 789635 - RNA, 18 nt, Human
cccggcgcagcugagggc

SEQ ID NO: 789636 - RNA, 22 nt, Human
ccuuccuuucuuuucugauuuu

SEQ ID NO: 789637 - RNA, 23 nt, Human
uaacuuuagcuuccauuccaagu

SEQ ID NO: 789638 - RNA, 27 nt, Human
ugaggcacaaggagagggaggagccgg

SEQ ID NO: 789639 - RNA, 22 nt, Human
aaacaaaugaacaggaaaucuc

SEQ ID NO: 789640 - RNA, 23 nt, Human
aaacaaaugugaauagaauccau

SEQ ID NO: 789641 - RNA, 30 nt, Human
aaacagcaucacaagaugucacagacuaaa

SEQ ID NO: 789642 - RNA, 23 nt, Human
aaacauucacuuuugccugauga

SEQ ID NO: 789643 - RNA, 20 nt, Human
aaacccuccucagaacucca

SEQ ID NO: 789644 - RNA, 24 nt, Human
aaacuuguuaucaaugccucuucu

SEQ ID NO: 789645 - RNA, 24 nt, Human
aaaguguugagauuacagauguga

SEQ ID NO: 789646 - RNA, 24 nt, Human
aacagcaucacaagaugucacaga

SEQ ID NO: 789647 - RNA, 26 nt, Human
aagauaaacagcaucacaagauguca

SEQ ID NO: 789648 - RNA, 25 nt, Human
aagcaauccucccaccucagccucc

SEQ ID NO: 789649 - RNA, 19 nt, Human
aaguagguacugcuugcgu

SEQ ID NO: 789650 - RNA, 25 nt, Human
aagugauccucccaccuuggccucc

SEQ ID NO: 789651 - RNA, 25 nt, Human
aagugauccucccaccuuggccucc

SEQ ID NO: 789652 - RNA, 19 nt, Human
aaucauggcucacugcagc

SEQ ID NO: 789653 - RNA, 22 nt, Human
aauuauguacauuaacaaccuu

SEQ ID NO: 789654 - RNA, 20 nt, Human
aauuuuuuucaauacacaga

SEQ ID NO: 789655 - RNA, 23 nt, Human
acacugcacaaaacgcaguccac

SEQ ID NO: 789656 - RNA, 19 nt, Human
acagaauugcagaaacugc

SEQ ID NO: 789657 - RNA, 21 nt, Human
acaggccccugaaaagcacca

SEQ ID NO: 789658 - RNA, 20 nt, Human
accaugacaauaaauuuggc

SEQ ID NO: 789659 - RNA, 23 nt, Human
acccaggcuggagugcaguggug

SEQ ID NO: 789660 - RNA, 19 nt, Human
acugcuauuuacuggaaug

SEQ ID NO: 789661 - RNA, 22 nt, Human
agaaaaaucugaauauaacagg

SEQ ID NO: 789662 - RNA, 24 nt, Human
agauuacagaugugagccacugca

SEQ ID NO: 789663 - RNA, 24 nt, Human
agcaucucccauucccgaugaguc

SEQ ID NO: 789664 - RNA, 23 nt, Human
agccauuaccaugaaggaacuaa

SEQ ID NO: 789665 - RNA, 19 nt, Human
aguagcagaaaauucuucu

SEQ ID NO: 789666 - RNA, 19 nt, Human
aguagcagaaaauucuucu

SEQ ID NO: 789667 - RNA, 19 nt, Human
aguagcugggacuaugggc

SEQ ID NO: 789668 - RNA, 21 nt, Human
aguagcugggacuaugggcau

SEQ ID NO: 789669 - RNA, 20 nt, Human
agugcaguggugcaaucaug

SEQ ID NO: 789670 - RNA, 23 nt, Human
agugcaguggugcaaucauggcu

SEQ ID NO: 789671 - RNA, 23 nt, Human
auaaacaaacauucacuuuugcc

SEQ ID NO: 789672 - RNA, 18 nt, Human
auagagacggggucuccc

SEQ ID NO: 789673 - RNA, 21 nt, Human
auagaugaagaaaaaaaguag

SEQ ID NO: 789674 - RNA, 21 nt, Human
aucaguuuacauaaaguuaua

SEQ ID NO: 789675 - RNA, 22 nt, Human
augauuacaggaaaaaaaagua

SEQ ID NO: 789676 - RNA, 24 nt, Human
auggcucacugcagccuugaccuc

SEQ ID NO: 789677 - RNA, 20 nt, Human
augggguggcacugugcccc

SEQ ID NO: 789678 - RNA, 23 nt, Human
caaaauacacaaauacacuuuca

SEQ ID NO: 789679 - RNA, 25 nt, Human
caaacuccugggcucaagugauccu

SEQ ID NO: 789680 - RNA, 24 nt, Human
caaaguguugagauuacagaugug

SEQ ID NO: 789681 - RNA, 25 nt, Human
caaccgguuucuaaaacccucaaaa

SEQ ID NO: 789682 - RNA, 24 nt, Human
caaguugaaaauacaugacuuagu

SEQ ID NO: 789683 - RNA, 21 nt, Human
caauaaauuuggcuaaacauu

SEQ ID NO: 789684 - RNA, 22 nt, Human
cacacaggccccugaaaagcac

SEQ ID NO: 789685 - RNA, 22 nt, Human
cacagauaaggcuucccuuuga

SEQ ID NO: 789686 - RNA, 24 nt, Human
cacccaggcuggagugcaguggug

SEQ ID NO: 789687 - RNA, 20 nt, Human
caccggggaaagcauccagg

SEQ ID NO: 789688 - RNA, 24 nt, Human
caccucagccuccugaguagcugg

SEQ ID NO: 789689 - RNA, 18 nt, Human
caccugguuacccagggc

SEQ ID NO: 789690 - RNA, 18 nt, Human
cacuucacugcuauaaug

SEQ ID NO: 789691 - RNA, 25 nt, Human
cagcaacacugugaugggguggcac

SEQ ID NO: 789692 - RNA, 20 nt, Human
cagccuccugaguagcuggg

SEQ ID NO: 789693 - RNA, 22 nt, Human
caggccccugaaaagcaccaug

SEQ ID NO: 789694 - RNA, 23 nt, Human
cagugccaaggacuuuacagaac

SEQ ID NO: 789695 - RNA, 24 nt, Human
cauaaaauacuugaggcuggugac

SEQ ID NO: 789696 - RNA, 19 nt, Human
cauccguuuuaauuauccc

SEQ ID NO: 789697 - RNA, 27 nt, Human
cauggcucacugcagccuugaccucca

SEQ ID NO: 789698 - RNA, 21 nt, Human
ccaaaguguugagauuacaga

SEQ ID NO: 789699 - RNA, 24 nt, Human
ccaaaguguugagauuacagaugu

SEQ ID NO: 789700 - RNA, 23 nt, Human
ccaccucagccuccugaguagcu

SEQ ID NO: 789701 - RNA, 20 nt, Human
ccagggcucaagcaauccuc

SEQ ID NO: 789702 - RNA, 23 nt, Human
cccaccucagccuccugaguagc

SEQ ID NO: 789703 - RNA, 21 nt, Human
cccacggacagguccacaacu

SEQ ID NO: 789704 - RNA, 25 nt, Human
cccauaccucccacaggcaaaucca

SEQ ID NO: 789705 - RNA, 20 nt, Human
ccccagcaucucccauuccc

SEQ ID NO: 789706 - RNA, 24 nt, Human
ccucccaccucagccuccugagua

SEQ ID NO: 789707 - RNA, 19 nt, Human
ccucccaccuuggccuccc

SEQ ID NO: 789708 - RNA, 19 nt, Human
ccugaguagcugggacuau

SEQ ID NO: 789709 - RNA, 24 nt, Human
ccugaguagcugggacuaugggca

SEQ ID NO: 789710 - RNA, 18 nt, Human
ccugggcucaagugaucc

SEQ ID NO: 789711 - RNA, 22 nt, Human
ccugggcucaagugauccuccc

SEQ ID NO: 789712 - RNA, 18 nt, Human
ccuguguugcccaggcug

SEQ ID NO: 789713 - RNA, 23 nt, Human
ccuguguugcccaggcuggucuc

SEQ ID NO: 789714 - RNA, 21 nt, Human
ccuuucaaauggggcuuaaga

SEQ ID NO: 789715 - RNA, 20 nt, Human
cgaguugccuucuacccaaa

SEQ ID NO: 789716 - RNA, 24 nt, Human
cgcucugacacccaggcuggagug

SEQ ID NO: 789717 - RNA, 24 nt, Human
cggggucucccuguguugcccagg

SEQ ID NO: 789718 - RNA, 21 nt, Human
cucaagcaauccucccaccuc

SEQ ID NO: 789719 - RNA, 24 nt, Human
cucaagcaauccucccaccucagc

SEQ ID NO: 789720 - RNA, 24 nt, Human
cucaagugauccucccaccuuggc

SEQ ID NO: 789721 - RNA, 21 nt, Human
cucacugcagccuugaccucc

SEQ ID NO: 789722 - RNA, 24 nt, Human
cucagaacuccacacuauuacuuc

SEQ ID NO: 789723 - RNA, 24 nt, Human
cucagccuccugaguagcugggac

SEQ ID NO: 789724 - RNA, 19 nt, Human
cucaguaaauaguucauaa

SEQ ID NO: 789725 - RNA, 23 nt, Human
cuccugggcucaagugauccucc

SEQ ID NO: 789726 - RNA, 19 nt, Human
cugacacccaggcuggagu

SEQ ID NO: 789727 - RNA, 22 nt, Human
cugauaaauaacagcauuccaa

SEQ ID NO: 789728 - RNA, 22 nt, Human
cugcagccuugaccuccagggc

SEQ ID NO: 789729 - RNA, 20 nt, Human
cuuaaguacuuucuaacuuu

SEQ ID NO: 789730 - RNA, 22 nt, Human
gaagacaaguugaaaauacaug

SEQ ID NO: 789731 - RNA, 23 nt, Human
gagacggggucucccuguguugc

SEQ ID NO: 789732 - RNA, 24 nt, Human
gaguagcugggacuaugggcaugc

SEQ ID NO: 789733 - RNA, 21 nt, Human
gagucccugacugaaaggaac

SEQ ID NO: 789734 - RNA, 18 nt, Human
gauuacagaugugagcca

SEQ ID NO: 789735 - RNA, 22 nt, Human
gauuacagaugugagccacugc

SEQ ID NO: 789736 - RNA, 18 nt, Human
gcagccuugaccuccagg

SEQ ID NO: 789737 - RNA, 20 nt, Human
gcaugccccagcaugcccag

SEQ ID NO: 789738 - RNA, 19 nt, Human
gccccugaaaagcaccaug

SEQ ID NO: 789739 - RNA, 18 nt, Human
gcucaagugauccuccca

SEQ ID NO: 789740 - RNA, 21 nt, Human
gcucacugcagccuugaccuc

SEQ ID NO: 789741 - RNA, 19 nt, Human
gcucauuuaguggguuggg

SEQ ID NO: 789742 - RNA, 21 nt, Human
gcucauuuaguggguugggaa

SEQ ID NO: 789743 - RNA, 26 nt, Human
gggaaaagaucuguaucuuuuuuuuu

SEQ ID NO: 789744 - RNA, 24 nt, Human
gggaagaaagagggugaugcuguu

SEQ ID NO: 789745 - RNA, 22 nt, Human
gggcucaagugauccucccacc

SEQ ID NO: 789746 - RNA, 22 nt, Human
gggucucccuguguugcccagg

SEQ ID NO: 789747 - RNA, 20 nt, Human
gucaaaccaagauaaacagc

SEQ ID NO: 789748 - RNA, 22 nt, Human
guccacauaacugaccaaucac

SEQ ID NO: 789749 - RNA, 21 nt, Human
guccacaugagacucuauaug

SEQ ID NO: 789750 - RNA, 24 nt, Human
gucuuguaaccugcucauuuagug

SEQ ID NO: 789751 - RNA, 23 nt, Human
gugaugggguggcacugugcccc

SEQ ID NO: 789752 - RNA, 26 nt, Human
uaaaaaaaacaucauugcaaauuuaa

SEQ ID NO: 789753 - RNA, 21 nt, Human
uaaaacccucaaaauacacaa

SEQ ID NO: 789754 - RNA, 21 nt, Human
uaaagucagcccuuuaaguuc

SEQ ID NO: 789755 - RNA, 23 nt, Human
uaaccucuaaggcaaccgguuuc

SEQ ID NO: 789756 - RNA, 24 nt, Human
uaacgaagcucucccuagggaaac

SEQ ID NO: 789757 - RNA, 25 nt, Human
uaauaaaucaagcagacuuaucauc

SEQ ID NO: 789758 - RNA, 22 nt, Human
uaaucuauuuaacauaacuacc

SEQ ID NO: 789759 - RNA, 19 nt, Human
uacaaaggaaagucauaac

SEQ ID NO: 789760 - RNA, 22 nt, Human
uacagaacaggucgucccuacc

SEQ ID NO: 789761 - RNA, 22 nt, Human
uacagaugugagccacugcacc

SEQ ID NO: 789762 - RNA, 24 nt, Human
uacccagggcacuggccacucaac

SEQ ID NO: 789763 - RNA, 22 nt, Human
uagaauccauauuaaaaguaca

SEQ ID NO: 789764 - RNA, 21 nt, Human
uaguagcagaaaauucuucug

SEQ ID NO: 789765 - RNA, 22 nt, Human
uauagagacggggucucccugu

SEQ ID NO: 789766 - RNA, 22 nt, Human
uauagagacggggucucccugu

SEQ ID NO: 789767 - RNA, 22 nt, Human
uaugagggucuguguuuuuccu

SEQ ID NO: 789768 - RNA, 24 nt, Human
ucaaaauacacaaauacacuuuca

SEQ ID NO: 789769 - RNA, 25 nt, Human
ucaaaccaagauaaacagcaucaca

SEQ ID NO: 789770 - RNA, 24 nt, Human
ucaacgaggaaggacugcccugaa

SEQ ID NO: 789771 - RNA, 26 nt, Human
ucaagcagacuuaucauccacaugga

SEQ ID NO: 789772 - RNA, 24 nt, Human
ucaagugauccucccaccuuggcc

SEQ ID NO: 789773 - RNA, 23 nt, Human
ucacugcagccuugaccuccagg

SEQ ID NO: 789774 - RNA, 24 nt, Human
ucacugcagccuugaccuccaggg

SEQ ID NO: 789775 - RNA, 23 nt, Human
ucagccuccugaguagcugggac

SEQ ID NO: 789776 - RNA, 22 nt, Human
uccaaugucaaaccaagauaaa

SEQ ID NO: 789777 - RNA, 24 nt, Human
uccacaugagacucuauauggagu

SEQ ID NO: 789778 - RNA, 19 nt, Human
uccacauggauaacgaagc

SEQ ID NO: 789779 - RNA, 23 nt, Human
uccauuuaaucauguguguacac

SEQ ID NO: 789780 - RNA, 23 nt, Human
ucccaaaguguugagauuacaga

SEQ ID NO: 789781 - RNA, 22 nt, Human
ucccacuuaguuacaaaaagua

SEQ ID NO: 789782 - RNA, 21 nt, Human
ucccuguguugcccaggcugg

SEQ ID NO: 789783 - RNA, 18 nt, Human
uccucuccugcccauacc

SEQ ID NO: 789784 - RNA, 24 nt, Human
uccugaguagcugggacuaugggc

SEQ ID NO: 789785 - RNA, 21 nt, Human
uccugggcucaagugauccuc

SEQ ID NO: 789786 - RNA, 24 nt, Human
uccugggcucaagugauccuccca

SEQ ID NO: 789787 - RNA, 25 nt, Human
ucuaaaauauucuaucaaucuuuca

SEQ ID NO: 789788 - RNA, 23 nt, Human
ucucaaacuccugggcucaagug

SEQ ID NO: 789789 - RNA, 19 nt, Human
ucucccuguguugcccagg

SEQ ID NO: 789790 - RNA, 23 nt, Human
ucucccuguguugcccaggcugg

SEQ ID NO: 789791 - RNA, 24 nt, Human
ucucccuguguugcccaggcuggu

SEQ ID NO: 789792 - RNA, 23 nt, Human
ucucgcucugacacccaggcugg

SEQ ID NO: 789793 - RNA, 24 nt, Human
ucucgcucugacacccaggcugga

SEQ ID NO: 789794 - RNA, 24 nt, Human
ucugacacccaggcuggagugcag

SEQ ID NO: 789795 - RNA, 23 nt, Human
ucuuccagguucuccuagacugg

SEQ ID NO: 789796 - RNA, 22 nt, Human
ugaaauaccucuggucaucuuc

SEQ ID NO: 789797 - RNA, 25 nt, Human
ugaccuccagggcucaagcaauccu

SEQ ID NO: 789798 - RNA, 21 nt, Human
ugagauuacagaugugagcca

SEQ ID NO: 789799 - RNA, 22 nt, Human
ugagauuacagaugugagccac

SEQ ID NO: 789800 - RNA, 22 nt, Human
ugagauuacagaugugagccac

SEQ ID NO: 789801 - RNA, 24 nt, Human
ugagauuacagaugugagccacug

SEQ ID NO: 789802 - RNA, 23 nt, Human
ugaggcuggugacauuugucuug

SEQ ID NO: 789803 - RNA, 22 nt, Human
ugcacaaaacgcaguccacaua

SEQ ID NO: 789804 - RNA, 22 nt, Human
ugcaguggugcaaucauggcuc

SEQ ID NO: 789805 - RNA, 23 nt, Human
ugcaguggugcaaucauggcuca

SEQ ID NO: 789806 - RNA, 31 nt, Human
ugccaaggacuuuacagaacaggucgucccu

SEQ ID NO: 789807 - RNA, 24 nt, Human
ugcccaggcuggucucaaacuccu

SEQ ID NO: 789808 - RNA, 28 nt, Human
ugcccaggcuggucucaaacuccugggc

SEQ ID NO: 789809 - RNA, 21 nt, Human
ugccccagcaugcccagccaa

SEQ ID NO: 789810 - RNA, 21 nt, Human
uggagugcaguggugcaauca

SEQ ID NO: 789811 - RNA, 24 nt, Human
uggagugcaguggugcaaucaugg

SEQ ID NO: 789812 - RNA, 20 nt, Human
uggcuaaaugccucaaauau

SEQ ID NO: 789813 - RNA, 24 nt, Human
uggcucacugcagccuugaccucc

SEQ ID NO: 789814 - RNA, 24 nt, Human
ugggcucaagugauccucccaccu

SEQ ID NO: 789815 - RNA, 26 nt, Human
uggggcuuaagagagagaaaauggcc

SEQ ID NO: 789816 - RNA, 21 nt, Human
uggguuuacaaaauguaucua

SEQ ID NO: 789817 - RNA, 24 nt, Human
uggugcaaucauggcucacugcag

SEQ ID NO: 789818 - RNA, 22 nt, Human
uguaaaauuugguaacagaaaa

SEQ ID NO: 789819 - RNA, 23 nt, Human
uguguugcccaggcuggucucaa

SEQ ID NO: 789820 - RNA, 24 nt, Human
uguguugcccaggcuggucucaaa

SEQ ID NO: 789821 - RNA, 22 nt, Human
uguugcccaggcuggucucaaa

SEQ ID NO: 789822 - RNA, 21 nt, Human
uuaaaacaaaugugaauagaa

SEQ ID NO: 789823 - RNA, 22 nt, Human
uuauagagacggggucucccug

SEQ ID NO: 789824 - RNA, 25 nt, Human
uugcagaaacugcuauucugugcgg

SEQ ID NO: 789825 - RNA, 20 nt, Human
uugcuuuucauuuugcuucc

SEQ ID NO: 789826 - RNA, 18 nt, Human
uuuaaaacauuuuacuug

SEQ ID NO: 789827 - RNA, 23 nt, Human
uuuauagagacggggucucccug

SEQ ID NO: 789828 - RNA, 19 nt, Human
uuucuugcuacugucaaaa

SEQ ID NO: 789829 - RNA, 23 nt, Human
uuugccugaugacagcaacacug

SEQ ID NO: 789830 - RNA, 21 nt, Human
aaaagacucuugcccuuucca

SEQ ID NO: 789831 - RNA, 27 nt, Human
aaaaggaggcaacauuaguuuaaaaaa

SEQ ID NO: 789832 - RNA, 23 nt, Human
aaacacaaaagggaagcuucuaa

SEQ ID NO: 789833 - RNA, 25 nt, Human
aaacccuaucugccauuaccaauuc

SEQ ID NO: 789834 - RNA, 23 nt, Human
aaaguaaaccaaaacaagaaaau

SEQ ID NO: 789835 - RNA, 21 nt, Human
aaaugaaaaacaaagccagcc

SEQ ID NO: 789836 - RNA, 18 nt, Human
aacaaagccagccaaauu

SEQ ID NO: 789837 - RNA, 18 nt, Human
aacacuuuuuacauuaaa

SEQ ID NO: 789838 - RNA, 21 nt, Human
aacagagcaucgaauaacauu

SEQ ID NO: 789839 - RNA, 18 nt, Human
aagaaaacagcuuuuuau

SEQ ID NO: 789840 - RNA, 21 nt, Human
aagcagaaccucaaagccagg

SEQ ID NO: 789841 - RNA, 23 nt, Human
aagcauucagcauacaugcuaca

SEQ ID NO: 789842 - RNA, 18 nt, Human
aagcuucuaaguugaacu

SEQ ID NO: 789843 - RNA, 21 nt, Human
aaggagcguggcgggcgcccc

SEQ ID NO: 789844 - RNA, 23 nt, Human
aauaaguguuaaaucucauacaa

SEQ ID NO: 789845 - RNA, 21 nt, Human
aaucugcucaucaaaucuaga

SEQ ID NO: 789846 - RNA, 19 nt, Human
aaugaaaauuauggccccc

SEQ ID NO: 789847 - RNA, 18 nt, Human
acaaaagggaagcuucua

SEQ ID NO: 789848 - RNA, 23 nt, Human
acagaaaagacuauauauaaaua

SEQ ID NO: 789849 - RNA, 25 nt, Human
accacauuuuccaaguccuauuugu

SEQ ID NO: 789850 - RNA, 22 nt, Human
aggaaaaaagcauucagcauac

SEQ ID NO: 789851 - RNA, 21 nt, Human
aggaaguauaagagcuacccc

SEQ ID NO: 789852 - RNA, 24 nt, Human
aguuagaagacuagcucuaaaacc

SEQ ID NO: 789853 - RNA, 18 nt, Human
aucugcuucucggcucuu

SEQ ID NO: 789854 - RNA, 24 nt, Human
aucugcuucucggcucuucaugcu

SEQ ID NO: 789855 - RNA, 21 nt, Human
auguucacaggccugauccuu

SEQ ID NO: 789856 - RNA, 23 nt, Human
caaaagcagaaccucaaagccag

SEQ ID NO: 789857 - RNA, 21 nt, Human
cacagccccacgcgcggcgcu

SEQ ID NO: 789858 - RNA, 21 nt, Human
caccacagccccacgcgcggc

SEQ ID NO: 789859 - RNA, 19 nt, Human
caccagaacagagcaucga

SEQ ID NO: 789860 - RNA, 21 nt, Human
caccucaggaucugcuucucg

SEQ ID NO: 789861 - RNA, 23 nt, Human
cagcagccucaacaaauguguga

SEQ ID NO: 789862 - RNA, 25 nt, Human
cagcagccucaacaaaugugugauu

SEQ ID NO: 789863 - RNA, 21 nt, Human
caugaaaacacaaaagggaag

SEQ ID NO: 789864 - RNA, 18 nt, Human
caugacaacagaauugaa

SEQ ID NO: 789865 - RNA, 25 nt, Human
caugcaaugauacuaucacuacuau

SEQ ID NO: 789866 - RNA, 26 nt, Human
cauugaaugaaaauuauggcccccaa

SEQ ID NO: 789867 - RNA, 26 nt, Human
ccaaaagcagaaccucaaagccaggu

SEQ ID NO: 789868 - RNA, 19 nt, Human
cccacgcgcggcgcuggcg

SEQ ID NO: 789869 - RNA, 19 nt, Human
cccacgcgcggcgcuggcg

SEQ ID NO: 789870 - RNA, 21 nt, Human
cccacgcgcggcgcuggcgca

SEQ ID NO: 789871 - RNA, 24 nt, Human
ccccaaaagcagaaccucaaagcc

SEQ ID NO: 789872 - RNA, 18 nt, Human
cccgcggcccugaacggg

SEQ ID NO: 789873 - RNA, 19 nt, Human
cccgcggcccugaacgggc

SEQ ID NO: 789874 - RNA, 21 nt, Human
ccgcucgcgcgccccucaccu

SEQ ID NO: 789875 - RNA, 21 nt, Human
ccugacauguggcaacaaaga

SEQ ID NO: 789876 - RNA, 26 nt, Human
cgccccgcgagcaggaagccaggagc

SEQ ID NO: 789877 - RNA, 22 nt, Human
cgcccgcgcuuccggaggcgga

SEQ ID NO: 789878 - RNA, 22 nt, Human
cgccgcgcgcccgcgcuuccgg

SEQ ID NO: 789879 - RNA, 24 nt, Human
cuaaagcaaaugaaaaacaaagcc

SEQ ID NO: 789880 - RNA, 23 nt, Human
cuacagagccugagcacugaaaa

SEQ ID NO: 789881 - RNA, 24 nt, Human
cucagagacuaaugccauuaugaa

SEQ ID NO: 789882 - RNA, 18 nt, Human
cucccggcgccgcgcgcc

SEQ ID NO: 789883 - RNA, 25 nt, Human
cuuaaacuauaacaacuucauagca

SEQ ID NO: 789884 - RNA, 20 nt, Human
cuugcuggaauuucuaaagc

SEQ ID NO: 789885 - RNA, 21 nt, Human
gaacacauacaucucauauaa

SEQ ID NO: 789886 - RNA, 19 nt, Human
gagccgcggccaccacagc

SEQ ID NO: 789887 - RNA, 19 nt, Human
gagcggaaagggaaaggag

SEQ ID NO: 789888 - RNA, 25 nt, Human
gagcguggcgggcgccccgcgagca

SEQ ID NO: 789889 - RNA, 19 nt, Human
gcuaagucuucucuaauaa

SEQ ID NO: 789890 - RNA, 25 nt, Human
ggaaaggagcguggcgggcgccccg

SEQ ID NO: 789891 - RNA, 22 nt, Human
gggcucccggcgccgcgcgccc

SEQ ID NO: 789892 - RNA, 23 nt, Human
guacaguaaguuaaaaaacaaaa

SEQ ID NO: 789893 - RNA, 20 nt, Human
guacucgccgccgccugggc

SEQ ID NO: 789894 - RNA, 19 nt, Human
guuaaaggugcuaaggaaa

SEQ ID NO: 789895 - RNA, 28 nt, Human
uaaaaaucaauuuuaaaaaaacugauua

SEQ ID NO: 789896 - RNA, 23 nt, Human
uaaaacacuguccgacacaccuc

SEQ ID NO: 789897 - RNA, 22 nt, Human
uaaaaccuaccucauuucuaag

SEQ ID NO: 789898 - RNA, 18 nt, Human
uaaaagacucuugcccuu

SEQ ID NO: 789899 - RNA, 18 nt, Human
uaaaauagugccagacca

SEQ ID NO: 789900 - RNA, 24 nt, Human
uaaagcaaaugaaaaacaaagcca

SEQ ID NO: 789901 - RNA, 24 nt, Human
uaaauacuugcuggaauuucuaaa

SEQ ID NO: 789902 - RNA, 25 nt, Human
uaaauuaguaccuaaaaucaaagua

SEQ ID NO: 789903 - RNA, 21 nt, Human
uaacaauacauuacaacucac

SEQ ID NO: 789904 - RNA, 23 nt, Human
uaacaauacauuacaacucacug

SEQ ID NO: 789905 - RNA, 19 nt, Human
uaacucagugcacuuauac

SEQ ID NO: 789906 - RNA, 24 nt, Human
uaacucagugcacuuauacaacaa

SEQ ID NO: 789907 - RNA, 23 nt, Human
uaaguucuaaagcaaaugaaaaa

SEQ ID NO: 789908 - RNA, 22 nt, Human
uacaaucgagcuaugucaugcc

SEQ ID NO: 789909 - RNA, 20 nt, Human
uacagaucaaaaauucauac

SEQ ID NO: 789910 - RNA, 20 nt, Human
uaccagugaaaacaaauuuc

SEQ ID NO: 789911 - RNA, 20 nt, Human
uaccuaaaaucaaaguacag

SEQ ID NO: 789912 - RNA, 23 nt, Human
uagaagauacacaugcauaccac

SEQ ID NO: 789913 - RNA, 23 nt, Human
uagcuaagaaaacagcuuuuuau

SEQ ID NO: 789914 - RNA, 18 nt, Human
uauaaacaguaaaaguac

SEQ ID NO: 789915 - RNA, 21 nt, Human
uauauaaaacauauauauaua

SEQ ID NO: 789916 - RNA, 24 nt, Human
uauccugacauguggcaacaaaga

SEQ ID NO: 789917 - RNA, 25 nt, Human
ucaaauaaaucaaaguaaaccaaaa

SEQ ID NO: 789918 - RNA, 22 nt, Human
ucaauuuuaaaaaaacugauua

SEQ ID NO: 789919 - RNA, 25 nt, Human
ucacaggccugauccuuaacaaaau

SEQ ID NO: 789920 - RNA, 23 nt, Human
ucaggaaacacuuuuuacauuaa

SEQ ID NO: 789921 - RNA, 19 nt, Human
ucauagcaucuugacuuag

SEQ ID NO: 789922 - RNA, 21 nt, Human
ucaucaaaucuagaucagcuc

SEQ ID NO: 789923 - RNA, 21 nt, Human
uccgacacaccucaggaucug

SEQ ID NO: 789924 - RNA, 21 nt, Human
ucgccgccgccugggcuccgg

SEQ ID NO: 789925 - RNA, 18 nt, Human
ugaaaaacaaagccagcc

SEQ ID NO: 789926 - RNA, 18 nt, Human
ugaaaaacaaagccagcc

SEQ ID NO: 789927 - RNA, 24 nt, Human
ugaauaauuagaagauacacaugc

SEQ ID NO: 789928 - RNA, 18 nt, Human
ugaaugcaugaaaacaca

SEQ ID NO: 789929 - RNA, 23 nt, Human
ugagagccgcggccaccacagcc

SEQ ID NO: 789930 - RNA, 24 nt, Human
ugcuacagagccugagcacugaaa

SEQ ID NO: 789931 - RNA, 24 nt, Human
uggcaaaaauauaucccgaguacu

SEQ ID NO: 789932 - RNA, 20 nt, Human
uggcccccaaaagcagaacc

SEQ ID NO: 789933 - RNA, 19 nt, Human
uggcuacagaucaaaaauu

SEQ ID NO: 789934 - RNA, 23 nt, Human
uggcuacagaucaaaaauucaua

SEQ ID NO: 789935 - RNA, 24 nt, Human
ugggacugguaaaaauaauacuuc

SEQ ID NO: 789936 - RNA, 19 nt, Human
uguacucagagacuaaugc

SEQ ID NO: 789937 - RNA, 23 nt, Human
uuaagaacacauacaucucauau

SEQ ID NO: 789938 - RNA, 20 nt, Human
uuauauacacagcagguaua

SEQ ID NO: 789939 - RNA, 20 nt, Human
uugaaaacuauagugaccau

SEQ ID NO: 789940 - RNA, 18 nt, Human
uuucguagaaucuuacua

SEQ ID NO: 789941 - RNA, 20 nt, Human
uuugacaauaauuuugcacu

SEQ ID NO: 789942 - RNA, 18 nt, Human
uuuuccaaguccuauuug

SEQ ID NO: 789943 - RNA, 25 nt, Human
uuuuuugacaauaauuuugcacuga

SEQ ID NO: 789944 - RNA, 22 nt, Human
aaaaccaacaaaggcaaaaccu

SEQ ID NO: 789945 - RNA, 26 nt, Human
aaacaagcagcagauaggagggaccc

SEQ ID NO: 789946 - RNA, 22 nt, Human
aaacagucagugagacuguggc

SEQ ID NO: 789947 - RNA, 22 nt, Human
aaccucugcuccauagcaggga

SEQ ID NO: 789948 - RNA, 22 nt, Human
aacuaauaagggacaaaaagaa

SEQ ID NO: 789949 - RNA, 21 nt, Human
aauucuguuccugauagaaaa

SEQ ID NO: 789950 - RNA, 21 nt, Human
acagacccacaccccuggcca

SEQ ID NO: 789951 - RNA, 28 nt, Human
acuacuguaacuuuucaauguucaaauu

SEQ ID NO: 789952 - RNA, 20 nt, Human
agaaucaaguuuuaaaacca

SEQ ID NO: 789953 - RNA, 22 nt, Human
auagaaaaugugcuuuuuccua

SEQ ID NO: 789954 - RNA, 23 nt, Human
aucaaguuuuaaaaccaacaaag

SEQ ID NO: 789955 - RNA, 19 nt, Human
auucauuugucccagcugg

SEQ ID NO: 789956 - RNA, 21 nt, Human
caaaaagaaaacaaaagggca

SEQ ID NO: 789957 - RNA, 25 nt, Human
caacaaaacuuuauuuacagacacc

SEQ ID NO: 789958 - RNA, 20 nt, Human
caacaaaggcaaaaccucac

SEQ ID NO: 789959 - RNA, 21 nt, Human
caacaaaggcaaaaccucacc

SEQ ID NO: 789960 - RNA, 20 nt, Human
caagaggagugaauaaguua

SEQ ID NO: 789961 - RNA, 19 nt, Human
cacaccccuggccacaccc

SEQ ID NO: 789962 - RNA, 25 nt, Human
cacagacccacaccccuggccacac

SEQ ID NO: 789963 - RNA, 22 nt, Human
cacccgaggccgcgcgacgccc

SEQ ID NO: 789964 - RNA, 27 nt, Human
cacuguguggcugaagccaacaaaacu

SEQ ID NO: 789965 - RNA, 23 nt, Human
cagacccacaccccuggccacac

SEQ ID NO: 789966 - RNA, 19 nt, Human
cagcagauaggauuugguc

SEQ ID NO: 789967 - RNA, 24 nt, Human
ccaacaaaacuuuauuuacagacc

SEQ ID NO: 789968 - RNA, 19 nt, Human
ccaauuuaaagaaacuaua

SEQ ID NO: 789969 - RNA, 18 nt, Human
cccucacagacccacacc

SEQ ID NO: 789970 - RNA, 20 nt, Human
cugaagccaacaaaacuuua

SEQ ID NO: 789971 - RNA, 19 nt, Human
gagaauucuguuccugaua

SEQ ID NO: 789972 - RNA, 24 nt, Human
gagcagagguuggcaaacuuucug

SEQ ID NO: 789973 - RNA, 24 nt, Human
ggcagggagaugggguuuuaaacu

SEQ ID NO: 789974 - RNA, 19 nt, Human
gggcagggagaugggguuu

SEQ ID NO: 789975 - RNA, 20 nt, Human
gggcucugcaggccacaugg

SEQ ID NO: 789976 - RNA, 20 nt, Human
gugcugagcacaucucacac

SEQ ID NO: 789977 - RNA, 21 nt, Human
guguggcugaagccaacaaaa

SEQ ID NO: 789978 - RNA, 22 nt, Human
uaaagcagccauagucaauagc

SEQ ID NO: 789979 - RNA, 23 nt, Human
uaaaggauaggaaauauuugcag

SEQ ID NO: 789980 - RNA, 23 nt, Human
uaaguuuacugagcacuuacuau

SEQ ID NO: 789981 - RNA, 24 nt, Human
uaauaagggacaaaaagaaaacaa

SEQ ID NO: 789982 - RNA, 21 nt, Human
uaauuuucucaccaacaaggu

SEQ ID NO: 789983 - RNA, 19 nt, Human
uacagacaccaaaacuuaa

SEQ ID NO: 789984 - RNA, 19 nt, Human
uagaaaaugugcuuuuucc

SEQ ID NO: 789985 - RNA, 23 nt, Human
uauagaaucaaguuuuaaaacca

SEQ ID NO: 789986 - RNA, 22 nt, Human
ucaacccuuuaaaauuuuuuua

SEQ ID NO: 789987 - RNA, 19 nt, Human
ucacacacauuuucugugu

SEQ ID NO: 789988 - RNA, 18 nt, Human
ucacaguugucuaaagca

SEQ ID NO: 789989 - RNA, 21 nt, Human
ucacauagggucagauggaaa

SEQ ID NO: 789990 - RNA, 18 nt, Human
ucacccgaggccgcgcga

SEQ ID NO: 789991 - RNA, 20 nt, Human
ucccucacagacccacaccc

SEQ ID NO: 789992 - RNA, 21 nt, Human
uccuuuaucauuuguuuucuu

SEQ ID NO: 789993 - RNA, 22 nt, Human
ucuauuuacaaaaacaagcagc

SEQ ID NO: 789994 - RNA, 23 nt, Human
ucuccugucacaacugcucaacu

SEQ ID NO: 789995 - RNA, 23 nt, Human
ucucuacucuagagcagagguug

SEQ ID NO: 789996 - RNA, 23 nt, Human
ugaauaaguuacauuuacacuua

SEQ ID NO: 789997 - RNA, 18 nt, Human
ugcugaccccuauucugg

SEQ ID NO: 789998 - RNA, 23 nt, Human
uggaaagccacaaaacuaacuug

SEQ ID NO: 789999 - RNA, 19 nt, Human
uggaccaggcacugugcug

SEQ ID NO: 790000 - RNA, 20 nt, Human
ugggcucugcaggccacaug

SEQ ID NO: 790001 - RNA, 21 nt, Human
ugucacaguugucuaaagcag

SEQ ID NO: 790002 - RNA, 21 nt, Human
ugucccagcuggccuauucau

SEQ ID NO: 790003 - RNA, 21 nt, Human
uguggcugaagccaacaaaac

SEQ ID NO: 790004 - RNA, 20 nt, Human
uuaaaaccaacaaaggcaaa

SEQ ID NO: 790005 - RNA, 25 nt, Human
uuaaaaccaacaaaggcaaaacccc

SEQ ID NO: 790006 - RNA, 24 nt, Human
uucauauaauuuucauguugaaaa

SEQ ID NO: 790007 - RNA, 21 nt, Human
uucauggucccuagacuuucu

SEQ ID NO: 790008 - RNA, 23 nt, Human
uuggcaaacuuucuguuaaagga

SEQ ID NO: 790009 - RNA, 21 nt, Human
uuuaaaaccaacaaaggcaaa

SEQ ID NO: 790010 - RNA, 21 nt, Human
uuuaauaauuuccuuucaccu

SEQ ID NO: 790011 - RNA, 20 nt, Human
uuuacaaaaacaagcagcag

SEQ ID NO: 790012 - RNA, 20 nt, Human
aaacaccacaauaaaaaugg

SEQ ID NO: 790013 - RNA, 20 nt, Human
aaacacuccauaaagaaagg

SEQ ID NO: 790014 - RNA, 21 nt, Human
aaagugcuuaaucccugagac

SEQ ID NO: 790015 - RNA, 19 nt, Human
aaauugcacaguacaaaca

SEQ ID NO: 790016 - RNA, 24 nt, Human
aagaacccccucagaccucugccc

SEQ ID NO: 790017 - RNA, 23 nt, Human
aagcaaaaucuccuccaagugua

SEQ ID NO: 790018 - RNA, 20 nt, Human
aagcaacaccugcucuuggu

SEQ ID NO: 790019 - RNA, 19 nt, Human
aagcaaggagagaggacca

SEQ ID NO: 790020 - RNA, 18 nt, Human
aagcacauuaacucacag

SEQ ID NO: 790021 - RNA, 22 nt, Human
aaguguggcacaguauuccaug

SEQ ID NO: 790022 - RNA, 19 nt, Human
acacuauugucaggagacc

SEQ ID NO: 790023 - RNA, 21 nt, Human
acagaaccacucacacagcca

SEQ ID NO: 790024 - RNA, 24 nt, Human
acauuggucuaaugggaaucaagc

SEQ ID NO: 790025 - RNA, 22 nt, Human
accaaacacaaaagcaaugcug

SEQ ID NO: 790026 - RNA, 21 nt, Human
acucuuaauaaacugaaauaa

SEQ ID NO: 790027 - RNA, 23 nt, Human
agaacccccucagaccucugccc

SEQ ID NO: 790028 - RNA, 19 nt, Human
agacaacuaaaucuagcca

SEQ ID NO: 790029 - RNA, 26 nt, Human
agacuauagcaagcaccuuagcauuu

SEQ ID NO: 790030 - RNA, 21 nt, Human
aggagaagagaguucaguuua

SEQ ID NO: 790031 - RNA, 25 nt, Human
aguaaaccucaaauaguuauacuga

SEQ ID NO: 790032 - RNA, 24 nt, Human
aguaaaugauaguaaauuacccaa

SEQ ID NO: 790033 - RNA, 21 nt, Human
auccaaacugaguagaugauu

SEQ ID NO: 790034 - RNA, 19 nt, Human
auccaguauuuuccucauc

SEQ ID NO: 790035 - RNA, 23 nt, Human
aucccugagacucuaaaccucca

SEQ ID NO: 790036 - RNA, 24 nt, Human
aucuagccauuuacuuuaaaaagc

SEQ ID NO: 790037 - RNA, 19 nt, Human
aucuggacauaaugcagaa

SEQ ID NO: 790038 - RNA, 21 nt, Human
auugagaagaacccccucaga

SEQ ID NO: 790039 - RNA, 20 nt, Human
caaacagguagcucaaguac

SEQ ID NO: 790040 - RNA, 25 nt, Human
caaauaauuuauuaauaaaugcauc

SEQ ID NO: 790041 - RNA, 19 nt, Human
caacaacaucuuguggcca

SEQ ID NO: 790042 - RNA, 20 nt, Human
caacaacaucuuguggccaa

SEQ ID NO: 790043 - RNA, 22 nt, Human
caacaacaucuuguggccaaac

SEQ ID NO: 790044 - RNA, 21 nt, Human
caacaugccaaugccgauguc

SEQ ID NO: 790045 - RNA, 22 nt, Human
caacaugccaaugccgaugucc

SEQ ID NO: 790046 - RNA, 23 nt, Human
caagcgauccucacccugaagca

SEQ ID NO: 790047 - RNA, 21 nt, Human
caauaaaccugucuuccucag

SEQ ID NO: 790048 - RNA, 21 nt, Human
caauuaacacacuaggucggc

SEQ ID NO: 790049 - RNA, 21 nt, Human
cacaguacaaacaagcugucu

SEQ ID NO: 790050 - RNA, 29 nt, Human
cacaguucaaguacaagcgauccucaccc

SEQ ID NO: 790051 - RNA, 18 nt, Human
cacauauugugccccagg

SEQ ID NO: 790052 - RNA, 22 nt, Human
caccccagcucauagaguugau

SEQ ID NO: 790053 - RNA, 20 nt, Human
cagaaccacucacacagcca

SEQ ID NO: 790054 - RNA, 21 nt, Human
cagcaaaauugagaagaaccc

SEQ ID NO: 790055 - RNA, 19 nt, Human
cagcacaguguuuuauuuc

SEQ ID NO: 790056 - RNA, 26 nt, Human
cagcuguauccaagggagcaaacagg

SEQ ID NO: 790057 - RNA, 19 nt, Human
cagcugugcuccaaaaaca

SEQ ID NO: 790058 - RNA, 21 nt, Human
caggucuacugaaaaggguac

SEQ ID NO: 790059 - RNA, 23 nt, Human
caguauuuuccucaucuccaaau

SEQ ID NO: 790060 - RNA, 26 nt, Human
cauaaaauacuuuaaguuuacaauga

SEQ ID NO: 790061 - RNA, 19 nt, Human
ccaaggagaauguuuccau

SEQ ID NO: 790062 - RNA, 23 nt, Human
ccagguaccaauaaucacauacu

SEQ ID NO: 790063 - RNA, 22 nt, Human
ccauuuacuuuaaaaagcaagg

SEQ ID NO: 790064 - RNA, 23 nt, Human
ccccagagggcacagcagccucu

SEQ ID NO: 790065 - RNA, 23 nt, Human
cccccaaugacuuguuuugguuu

SEQ ID NO: 790066 - RNA, 27 nt, Human
ccugagacucuaaaccuccaucugcaa

SEQ ID NO: 790067 - RNA, 24 nt, Human
ccugccaaacuucuugccuggggg

SEQ ID NO: 790068 - RNA, 19 nt, Human
ccuggcuaagacaacuaaa

SEQ ID NO: 790069 - RNA, 19 nt, Human
cuccugaggucagacucaa

SEQ ID NO: 790070 - RNA, 21 nt, Human
cuuuaagauucagggaaaggu

SEQ ID NO: 790071 - RNA, 22 nt, Human
cuuuccuuccauuugucauucc

SEQ ID NO: 790072 - RNA, 21 nt, Human
gaaaucuguacaacaugccaa

SEQ ID NO: 790073 - RNA, 24 nt, Human
gaagccucuccacaguucaaguac

SEQ ID NO: 790074 - RNA, 19 nt, Human
gacuuguuuugguuucagc

SEQ ID NO: 790075 - RNA, 25 nt, Human
gauuaaagaguccagcuguauccaa

SEQ ID NO: 790076 - RNA, 22 nt, Human
gcaaaaccaaacuugccaacca

SEQ ID NO: 790077 - RNA, 25 nt, Human
gcaaaaucuccuccaaguguacaaa

SEQ ID NO: 790078 - RNA, 19 nt, Human
gcaaaauugagaagaaccc

SEQ ID NO: 790079 - RNA, 19 nt, Human
gcggccagcacggcgaaga

SEQ ID NO: 790080 - RNA, 23 nt, Human
gcuaaaacaagcacauuaacuca

SEQ ID NO: 790081 - RNA, 18 nt, Human
guaaguagugaaaaagua

SEQ ID NO: 790082 - RNA, 22 nt, Human
guacaucuguacaauauuuacu

SEQ ID NO: 790083 - RNA, 23 nt, Human
guauguguagacaugcagaaucc

SEQ ID NO: 790084 - RNA, 22 nt, Human
gugcuccaaaaacacuccauaa

SEQ ID NO: 790085 - RNA, 23 nt, Human
uaaaaagcaaggagagaggacca

SEQ ID NO: 790086 - RNA, 24 nt, Human
uaaaaagcaaggagagaggaccaa

SEQ ID NO: 790087 - RNA, 19 nt, Human
uaaaaauagcaccagaagg

SEQ ID NO: 790088 - RNA, 21 nt, Human
uaagacaacuaaaucuagcca

SEQ ID NO: 790089 - RNA, 24 nt, Human
uaagcaaaaucuccuccaaguguu

SEQ ID NO: 790090 - RNA, 22 nt, Human
uaauaaauccaacuuuaccauc

SEQ ID NO: 790091 - RNA, 19 nt, Human
uaaugugcaaaaccaaacu

SEQ ID NO: 790092 - RNA, 19 nt, Human
uacaacagcaaacccauca

SEQ ID NO: 790093 - RNA, 23 nt, Human
uacaguuaacuuauacuggugcc

SEQ ID NO: 790094 - RNA, 21 nt, Human
uaccaauaaucacauacucca

SEQ ID NO: 790095 - RNA, 23 nt, Human
uacucuagaugacugcaggucua

SEQ ID NO: 790096 - RNA, 23 nt, Human
uagcugaaaaccguauaggccaa

SEQ ID NO: 790097 - RNA, 21 nt, Human
uaggauaggagaagagaguuc

SEQ ID NO: 790098 - RNA, 22 nt, Human
uaggugauagccuucugcaccc

SEQ ID NO: 790099 - RNA, 24 nt, Human
uaguaaauuacccaacucaguaau

SEQ ID NO: 790100 - RNA, 22 nt, Human
uauaagcaaaaucuccuccaag

SEQ ID NO: 790101 - RNA, 20 nt, Human
uauaauacaagcccuaaaau

SEQ ID NO: 790102 - RNA, 19 nt, Human
uauagcaagcaccuuagca

SEQ ID NO: 790103 - RNA, 18 nt, Human
ucacaccaaacacaaaag

SEQ ID NO: 790104 - RNA, 21 nt, Human
uccaaguaaagugcuuaaucc

SEQ ID NO: 790105 - RNA, 20 nt, Human
uccauaaagaaaggccuccg

SEQ ID NO: 790106 - RNA, 22 nt, Human
uccccagagggcacagcagccu

SEQ ID NO: 790107 - RNA, 25 nt, Human
uccgucaacaacaucuuguggccaa

SEQ ID NO: 790108 - RNA, 20 nt, Human
uccucaguuuugcagaggag

SEQ ID NO: 790109 - RNA, 19 nt, Human
ucuggacugggauuugacu

SEQ ID NO: 790110 - RNA, 25 nt, Human
ucuguaaaccugccaaacuucuugc

SEQ ID NO: 790111 - RNA, 23 nt, Human
ucuuuuuuggugccaucagaccu

SEQ ID NO: 790112 - RNA, 26 nt, Human
ugaagaaugcauucuuuacacacuaa

SEQ ID NO: 790113 - RNA, 23 nt, Human
ugagaaaagaggcuauuuuagau

SEQ ID NO: 790114 - RNA, 21 nt, Human
ugagauagcagcauggcuccc

SEQ ID NO: 790115 - RNA, 18 nt, Human
ugaguagaugauuuugca

SEQ ID NO: 790116 - RNA, 22 nt, Human
ugauagccuucugcaccccagc

SEQ ID NO: 790117 - RNA, 20 nt, Human
ugauaguaaauuacccaacu

SEQ ID NO: 790118 - RNA, 21 nt, Human
ugauaguaaauuacccaacuc

SEQ ID NO: 790119 - RNA, 21 nt, Human
ugauaguaaauuacccaacuc

SEQ ID NO: 790120 - RNA, 20 nt, Human
ugauuuuauucccacacccc

SEQ ID NO: 790121 - RNA, 20 nt, Human
ugcaaaaccaaacuugccaa

SEQ ID NO: 790122 - RNA, 25 nt, Human
ugcaaaaccaaacuugccaaccaca

SEQ ID NO: 790123 - RNA, 23 nt, Human
ugccaaacuucuugccugggggc

SEQ ID NO: 790124 - RNA, 21 nt, Human
ugccaaccacagcaauauucu

SEQ ID NO: 790125 - RNA, 21 nt, Human
ugcugggcuguuuaacuacac

SEQ ID NO: 790126 - RNA, 23 nt, Human
ugcuuguaggauccaaacugagu

SEQ ID NO: 790127 - RNA, 19 nt, Human
uggccaaacuccaugaagc

SEQ ID NO: 790128 - RNA, 19 nt, Human
ugggauucuggguuuguga

SEQ ID NO: 790129 - RNA, 24 nt, Human
ugggcuguuuaacuacacuccuga

SEQ ID NO: 790130 - RNA, 19 nt, Human
uggggcaaaacaauuccug

SEQ ID NO: 790131 - RNA, 22 nt, Human
uggguuuuuaaaaauuaaggua

SEQ ID NO: 790132 - RNA, 19 nt, Human
uguauaaaagaaaugauuc

SEQ ID NO: 790133 - RNA, 23 nt, Human
uguauaaaagaaaugauucauuc

SEQ ID NO: 790134 - RNA, 22 nt, Human
ugucaggagaccaucucaucaa

SEQ ID NO: 790135 - RNA, 18 nt, Human
ugucuuccucaguuuugc

SEQ ID NO: 790136 - RNA, 18 nt, Human
ugugccccaggguagcaa

SEQ ID NO: 790137 - RNA, 19 nt, Human
uguggcacaguauuccaug

SEQ ID NO: 790138 - RNA, 21 nt, Human
uguggccaaacuccaugaagc

SEQ ID NO: 790139 - RNA, 23 nt, Human
uguguugaagaacuccugggauu

SEQ ID NO: 790140 - RNA, 24 nt, Human
uguguugaagaacuccugggauuc

SEQ ID NO: 790141 - RNA, 24 nt, Human
uguguugaagaacuccugggauuu

SEQ ID NO: 790142 - RNA, 22 nt, Human
uguuuaacuacacuccugaggu

SEQ ID NO: 790143 - RNA, 18 nt, Human
uguuuugcuguuagcucu

SEQ ID NO: 790144 - RNA, 23 nt, Human
uuaccaucauuaaauacaacagc

SEQ ID NO: 790145 - RNA, 23 nt, Human
uuccucaguuuugcagaggagca

SEQ ID NO: 790146 - RNA, 20 nt, Human
uucuugcugggcugcaugua

SEQ ID NO: 790147 - RNA, 24 nt, Human
uugacuggcuaguaaagccaagga

SEQ ID NO: 790148 - RNA, 24 nt, Human
uugcugggcugcauguacucacau

SEQ ID NO: 790149 - RNA, 21 nt, Human
uuugagaugaacucagcagca

SEQ ID NO: 790150 - RNA, 23 nt, Human
uuuguaaaaaauaacauugcauu

SEQ ID NO: 790151 - RNA, 19 nt, Human
uuugugaagccucuccaca

SEQ ID NO: 790152 - RNA, 20 nt, Human
uuuucuguaaaccugccaaa

SEQ ID NO: 790153 - RNA, 21 nt, Human
uuuugaguuucucuucaaagg

SEQ ID NO: 790154 - RNA, 26 nt, Human
aaaaaugacuaugacaaggucccugc

SEQ ID NO: 790155 - RNA, 18 nt, Human
aaaacaaacccacaaagc

SEQ ID NO: 790156 - RNA, 28 nt, Human
aaaauacguccaguccuugacaucuucu

SEQ ID NO: 790157 - RNA, 19 nt, Human
aaacaaacccacaaagcaa

SEQ ID NO: 790158 - RNA, 18 nt, Human
aaagacgucccugcccuu

SEQ ID NO: 790159 - RNA, 18 nt, Human
aaggaagcaugagcuaac

SEQ ID NO: 790160 - RNA, 21 nt, Human
aauaccuauauacaagauggc

SEQ ID NO: 790161 - RNA, 23 nt, Human
aauagguagugagagacacacaa

SEQ ID NO: 790162 - RNA, 18 nt, Human
acaaaacaaacccacaaa

SEQ ID NO: 790163 - RNA, 21 nt, Human
acaaaacaaacccacaaagca

SEQ ID NO: 790164 - RNA, 23 nt, Human
acaaagaucaacucugccuaccu

SEQ ID NO: 790165 - RNA, 20 nt, Human
acaaagcaacaguguguaau

SEQ ID NO: 790166 - RNA, 22 nt, Human
acagacaagugucacaaggagc

SEQ ID NO: 790167 - RNA, 19 nt, Human
acauacaaaacaaacccac

SEQ ID NO: 790168 - RNA, 19 nt, Human
accuaacaguaaacaugua

SEQ ID NO: 790169 - RNA, 23 nt, Human
acuaauauuuuauacauuaaauu

SEQ ID NO: 790170 - RNA, 18 nt, Human
agaaagugagcaggaagg

SEQ ID NO: 790171 - RNA, 19 nt, Human
agaaagugagcaggaaggu

SEQ ID NO: 790172 - RNA, 24 nt, Human
agaaaugguaaccguauuggacaa

SEQ ID NO: 790173 - RNA, 24 nt, Human
agaagaaaugaguuuggcagagag

SEQ ID NO: 790174 - RNA, 19 nt, Human
agaagccacacuccccaug

SEQ ID NO: 790175 - RNA, 23 nt, Human
agacuucggaaggcagcguaguu

SEQ ID NO: 790176 - RNA, 20 nt, Human
agaggagcaaaggagcagga

SEQ ID NO: 790177 - RNA, 22 nt, Human
agaucaacaaugcucagugaug

SEQ ID NO: 790178 - RNA, 19 nt, Human
agccagcacugggaaggca

SEQ ID NO: 790179 - RNA, 26 nt, Human
aggaagagauaggacagaagggaccc

SEQ ID NO: 790180 - RNA, 19 nt, Human
aggacagaaagugagcagg

SEQ ID NO: 790181 - RNA, 26 nt, Human
aggacagaaagugagcaggaagguuc

SEQ ID NO: 790182 - RNA, 22 nt, Human
agggccaaugacagggacaggg

SEQ ID NO: 790183 - RNA, 18 nt, Human
agguagaugcaaauaagc

SEQ ID NO: 790184 - RNA, 18 nt, Human
agguggguggguggcagg

SEQ ID NO: 790185 - RNA, 22 nt, Human
auauuuaaaacgccuacaaaca

SEQ ID NO: 790186 - RNA, 20 nt, Human
aucaacucugccuaccuaga

SEQ ID NO: 790187 - RNA, 18 nt, Human
auuuauuuaucuaguuca

SEQ ID NO: 790188 - RNA, 18 nt, Human
caaaacaaacccacaaag

SEQ ID NO: 790189 - RNA, 22 nt, Human
caaaacccacauccuaguccca

SEQ ID NO: 790190 - RNA, 21 nt, Human
caaacagccuuuuuuuuuuag

SEQ ID NO: 790191 - RNA, 19 nt, Human
caaacccacaaagcaacag

SEQ ID NO: 790192 - RNA, 21 nt, Human
caaaggagcaggacuagaaac

SEQ ID NO: 790193 - RNA, 22 nt, Human
caacagcuagugauacgaagga

SEQ ID NO: 790194 - RNA, 22 nt, Human
caauucacaccaaaauuuugga

SEQ ID NO: 790195 - RNA, 19 nt, Human
cacaacacuuuccacacag

SEQ ID NO: 790196 - RNA, 19 nt, Human
cacacagggguggguggug

SEQ ID NO: 790197 - RNA, 21 nt, Human
caccacagaugcaaggaccua

SEQ ID NO: 790198 - RNA, 23 nt, Human
cagagaguagaaaauaccagagg

SEQ ID NO: 790199 - RNA, 21 nt, Human
caggaagagauaggacagaaa

SEQ ID NO: 790200 - RNA, 25 nt, Human
caggaagcgccacaacacuuuccac

SEQ ID NO: 790201 - RNA, 20 nt, Human
cagugcuagagaugcaaaga

SEQ ID NO: 790202 - RNA, 21 nt, Human
cauaacuaaaucucuuaauuc

SEQ ID NO: 790203 - RNA, 26 nt, Human
caucaauaaaccauccuaauuguuaa

SEQ ID NO: 790204 - RNA, 24 nt, Human
caugcacugaauugaauuuguaug

SEQ ID NO: 790205 - RNA, 19 nt, Human
ccacauccuagucccaacc

SEQ ID NO: 790206 - RNA, 26 nt, Human
cccagaacagcggugcacgcccccaa

SEQ ID NO: 790207 - RNA, 25 nt, Human
cccccaggcggccugccgcggcguc

SEQ ID NO: 790208 - RNA, 20 nt, Human
ccucgccagcgcucccccca

SEQ ID NO: 790209 - RNA, 22 nt, Human
ccugcagccuggcagaugagac

SEQ ID NO: 790210 - RNA, 19 nt, Human
ccuuccuucauccuuucuu

SEQ ID NO: 790211 - RNA, 19 nt, Human
ccuugagucuucaaaaugg

SEQ ID NO: 790212 - RNA, 19 nt, Human
cgcuccccccaggcggccu

SEQ ID NO: 790213 - RNA, 19 nt, Human
cggcagagagguggguggg

SEQ ID NO: 790214 - RNA, 20 nt, Human
cuaaguaugcaauacauacu

SEQ ID NO: 790215 - RNA, 19 nt, Human
cucagaagccacacucccc

SEQ ID NO: 790216 - RNA, 19 nt, Human
cucgccagcgcucccccca

SEQ ID NO: 790217 - RNA, 23 nt, Human
cugagguagcuguaagcuuggag

SEQ ID NO: 790218 - RNA, 18 nt, Human
cugucugcucuccccagc

SEQ ID NO: 790219 - RNA, 21 nt, Human
cuugcagaagacuccauuucc

SEQ ID NO: 790220 - RNA, 22 nt, Human
gaaacaaguuucgagguucacc

SEQ ID NO: 790221 - RNA, 23 nt, Human
gaacugagaagcccaaaaggcau

SEQ ID NO: 790222 - RNA, 19 nt, Human
gaagcgccacaacacuuuc

SEQ ID NO: 790223 - RNA, 21 nt, Human
gacacacgggcacagagagga

SEQ ID NO: 790224 - RNA, 25 nt, Human
gauucauccuuccugaaguuuccac

SEQ ID NO: 790225 - RNA, 21 nt, Human
gcaaauaagccaucccuuuag

SEQ ID NO: 790226 - RNA, 19 nt, Human
gcacauacaaaacaaaccc

SEQ ID NO: 790227 - RNA, 19 nt, Human
gcacugaauugaauuugua

SEQ ID NO: 790228 - RNA, 20 nt, Human
gcagaggacacacgggcaca

SEQ ID NO: 790229 - RNA, 21 nt, Human
gcaguuggaaucaccagugca

SEQ ID NO: 790230 - RNA, 18 nt, Human
gcauugcuuagcuuaaaa

SEQ ID NO: 790231 - RNA, 18 nt, Human
gcgcccgccguccgugcc

SEQ ID NO: 790232 - RNA, 23 nt, Human
gcgcccgccguccgugccucgcc

SEQ ID NO: 790233 - RNA, 21 nt, Human
gcugucugcauguuuccauca

SEQ ID NO: 790234 - RNA, 21 nt, Human
ggaaaaguauacagaacccuu

SEQ ID NO: 790235 - RNA, 22 nt, Human
ggacuuaguccugugaaaauaa

SEQ ID NO: 790236 - RNA, 19 nt, Human
ggagcaacggcagagaggu

SEQ ID NO: 790237 - RNA, 19 nt, Human
ggaggaggcugcaccugag

SEQ ID NO: 790238 - RNA, 18 nt, Human
ggaguuuuccaaaagugc

SEQ ID NO: 790239 - RNA, 19 nt, Human
gggcgcccgccguccgugc

SEQ ID NO: 790240 - RNA, 18 nt, Human
ggguggguggcaggaagc

SEQ ID NO: 790241 - RNA, 21 nt, Human
guaaaaaauaccuauauacaa

SEQ ID NO: 790242 - RNA, 22 nt, Human
guuacaguuaacacaaucugcu

SEQ ID NO: 790243 - RNA, 19 nt, Human
uaaaacgccuacaaacagc

SEQ ID NO: 790244 - RNA, 22 nt, Human
uaaagagacugacuggcaauua

SEQ ID NO: 790245 - RNA, 21 nt, Human
uaaagcaugcacugaauugaa

SEQ ID NO: 790246 - RNA, 24 nt, Human
uaaauuuucucacuauaaagagac

SEQ ID NO: 790247 - RNA, 22 nt, Human
uaacaaaugccagacuucggaa

SEQ ID NO: 790248 - RNA, 23 nt, Human
uacaaaacaaacccacaaagcaa

SEQ ID NO: 790249 - RNA, 24 nt, Human
uacaaucucaugcuuaacaccuaa

SEQ ID NO: 790250 - RNA, 20 nt, Human
uacagccgaucauuuacagc

SEQ ID NO: 790251 - RNA, 18 nt, Human
uagcaccacagaugcaaa

SEQ ID NO: 790252 - RNA, 24 nt, Human
uagcaccacagaugcaaggaccua

SEQ ID NO: 790253 - RNA, 25 nt, Human
uagcaccacagaugcaaggaccuaa

SEQ ID NO: 790254 - RNA, 22 nt, Human
uauggcuaaucgaguuacuaua

SEQ ID NO: 790255 - RNA, 19 nt, Human
ucauucagaucaaaagcug

SEQ ID NO: 790256 - RNA, 25 nt, Human
uccaaaagugcccaauucacaccaa

SEQ ID NO: 790257 - RNA, 20 nt, Human
ucucaugcuuaacaccuaaa

SEQ ID NO: 790258 - RNA, 23 nt, Human
ucugauggauuuauuuuaugaug

SEQ ID NO: 790259 - RNA, 22 nt, Human
ugaagaaaauaaaucuguauca

SEQ ID NO: 790260 - RNA, 18 nt, Human
ugaaggaaggcaaaggag

SEQ ID NO: 790261 - RNA, 21 nt, Human
ugaaggaaggcaaaggaggug

SEQ ID NO: 790262 - RNA, 18 nt, Human
ugacagggacaggguggc

SEQ ID NO: 790263 - RNA, 19 nt, Human
ugagcuuuagggaggaggc

SEQ ID NO: 790264 - RNA, 20 nt, Human
ugagguagcuguaagcuugg

SEQ ID NO: 790265 - RNA, 18 nt, Human
ugaucaagguacgagccg

SEQ ID NO: 790266 - RNA, 21 nt, Human
ugauguaaaacaacuuuugaa

SEQ ID NO: 790267 - RNA, 18 nt, Human
ugcaaagacgucccugcc

SEQ ID NO: 790268 - RNA, 21 nt, Human
ugcaguuggaaucaccagugc

SEQ ID NO: 790269 - RNA, 21 nt, Human
ugccaccaccauuuauuuauc

SEQ ID NO: 790270 - RNA, 24 nt, Human
ugccaccaccauuuauuuaucuag

SEQ ID NO: 790271 - RNA, 21 nt, Human
ugccucgccagcgcucccccc

SEQ ID NO: 790272 - RNA, 18 nt, Human
uggaaucaccagugcaaa

SEQ ID NO: 790273 - RNA, 19 nt, Human
ugggaggagagggcuccca

SEQ ID NO: 790274 - RNA, 21 nt, Human
ugggaggagagggcucccagg

SEQ ID NO: 790275 - RNA, 21 nt, Human
uguccuugagucuucaaaaug

SEQ ID NO: 790276 - RNA, 21 nt, Human
ugugaaaaacaugcaguaaaa

SEQ ID NO: 790277 - RNA, 20 nt, Human
ugugaaaauaaaaaugacua

SEQ ID NO: 790278 - RNA, 22 nt, Human
ugugugcaugucaacccaugua

SEQ ID NO: 790279 - RNA, 25 nt, Human
uuaacauugauguaaaacaacuuuu

SEQ ID NO: 790280 - RNA, 20 nt, Human
uucaaaaggacauuugauac

SEQ ID NO: 790281 - RNA, 24 nt, Human
uucaaaaggacauuugauacaaaa

SEQ ID NO: 790282 - RNA, 21 nt, Human
uucaaagugcuaugcuuuuaa

SEQ ID NO: 790283 - RNA, 24 nt, Human
uucagaccugaucaaaugaaaagc

SEQ ID NO: 790284 - RNA, 25 nt, Human
uucuugaaauuucauuuuguaauga

SEQ ID NO: 790285 - RNA, 24 nt, Human
uuggaguuuggaugggagacgaca

SEQ ID NO: 790286 - RNA, 26 nt, Human
uuucagacaagcaaagcaguacugag

SEQ ID NO: 790287 - RNA, 25 nt, Human
uuuuuaggcaacaaaauacguccag

SEQ ID NO: 790288 - RNA, 20 nt, Human
aaaaaaaaaaaaacaaaaaa

SEQ ID NO: 790289 - RNA, 20 nt, Human
aaaaaacccaaaaaacaaac

SEQ ID NO: 790290 - RNA, 22 nt, Human
aaaaaacuaaaacugccacaaa

SEQ ID NO: 790291 - RNA, 24 nt, Human
aaaaaacuaaaacugccacaaaua

SEQ ID NO: 790292 - RNA, 25 nt, Human
aaaaacccaaaaaacaaacaaaaaa

SEQ ID NO: 790293 - RNA, 21 nt, Human
aaaaauaaauaccaagaacua

SEQ ID NO: 790294 - RNA, 18 nt, Human
aaaacaaacaaaaaaacc

SEQ ID NO: 790295 - RNA, 23 nt, Human
aaacaaaaaaaccucccucccca

SEQ ID NO: 790296 - RNA, 26 nt, Human
aaacaaaaaaaccucccuccccagga

SEQ ID NO: 790297 - RNA, 26 nt, Human
aaacaaaaaacuaaaacugccacaaa

SEQ ID NO: 790298 - RNA, 25 nt, Human
aaacaaacaaaaaaaccucccuccc

SEQ ID NO: 790299 - RNA, 27 nt, Human
aaagaaaacaagacaccaaaaaaaccc

SEQ ID NO: 790300 - RNA, 20 nt, Human
aaauacugaagaggcaagcu

SEQ ID NO: 790301 - RNA, 20 nt, Human
aacaaaaaacuaaaacugcc

SEQ ID NO: 790302 - RNA, 23 nt, Human
aacccaaaaaacaaacaaaaaaa

SEQ ID NO: 790303 - RNA, 21 nt, Human
aaccggcuuggaaccaacgcc

SEQ ID NO: 790304 - RNA, 25 nt, Human
aagacacccugcacccugcgcccag

SEQ ID NO: 790305 - RNA, 18 nt, Human
aagcagcggaggccagcg

SEQ ID NO: 790306 - RNA, 21 nt, Human
aagcagcggaggccagcggug

SEQ ID NO: 790307 - RNA, 21 nt, Human
aaggggccagccccacagaua

SEQ ID NO: 790308 - RNA, 24 nt, Human
aaggggccagccccacagauacug

SEQ ID NO: 790309 - RNA, 21 nt, Human
acaaauagaacuccuggacca

SEQ ID NO: 790310 - RNA, 24 nt, Human
acaagacaccaaaaaaacccaaaa

SEQ ID NO: 790311 - RNA, 25 nt, Human
acaagacaccaaaaaaacccaaaaa

SEQ ID NO: 790312 - RNA, 20 nt, Human
acacaaauggacggacagac

SEQ ID NO: 790313 - RNA, 18 nt, Human
acaccaaaaaaacccaaa

SEQ ID NO: 790314 - RNA, 25 nt, Human
acaccaaaaaaacccaaaaaacaaa

SEQ ID NO: 790315 - RNA, 28 nt, Human
acaccaaaaaaacccaaaaaacaaacaa

SEQ ID NO: 790316 - RNA, 27 nt, Human
acaccaaauccacccaucaucuccgac

SEQ ID NO: 790317 - RNA, 20 nt, Human
acagccacagaaaugagugc

SEQ ID NO: 790318 - RNA, 21 nt, Human
acagugggguggcugggucag

SEQ ID NO: 790319 - RNA, 19 nt, Human
acccaaaaaacaaacaaaa

SEQ ID NO: 790320 - RNA, 20 nt, Human
acccaaaccauccauuuuca

SEQ ID NO: 790321 - RNA, 21 nt, Human
acccugcccugagacuccaac

SEQ ID NO: 790322 - RNA, 20 nt, Human
accgcaccgcagagcccagc

SEQ ID NO: 790323 - RNA, 26 nt, Human
accgcaccgcagagcccagcccggca

SEQ ID NO: 790324 - RNA, 18 nt, Human
acuaaagugaggguccca

SEQ ID NO: 790325 - RNA, 20 nt, Human
acuccaacucacuggccguu

SEQ ID NO: 790326 - RNA, 26 nt, Human
agaaagaaaacaagacaccaaaaaaa

SEQ ID NO: 790327 - RNA, 26 nt, Human
agacaccaaaaaaacccaaaaaacaa

SEQ ID NO: 790328 - RNA, 19 nt, Human
agaccagccagugcccaga

SEQ ID NO: 790329 - RNA, 21 nt, Human
agagccaaaggaucagcagga

SEQ ID NO: 790330 - RNA, 19 nt, Human
aggaccucugguggcagcu

SEQ ID NO: 790331 - RNA, 24 nt, Human
aggagaaagaaaacaagacaccaa

SEQ ID NO: 790332 - RNA, 19 nt, Human
aggcacgaggaggggaggu

SEQ ID NO: 790333 - RNA, 23 nt, Human
aggcagggcaggcacgaggaggg

SEQ ID NO: 790334 - RNA, 19 nt, Human
aggcgccagggacgggaac

SEQ ID NO: 790335 - RNA, 23 nt, Human
agucugggcgaaguggcuccucu

SEQ ID NO: 790336 - RNA, 22 nt, Human
auccauuuucaaagcuuuuuuu

SEQ ID NO: 790337 - RNA, 22 nt, Human
aucuaaagcaggguggcuucca

SEQ ID NO: 790338 - RNA, 20 nt, Human
aucuggagaaggcuugcggg

SEQ ID NO: 790339 - RNA, 19 nt, Human
aucuggaugaaggaggugg

SEQ ID NO: 790340 - RNA, 22 nt, Human
caaaaaaacccaaaaaacaaac

SEQ ID NO: 790341 - RNA, 25 nt, Human
caaaaaaacccaaaaaacaaacaaa

SEQ ID NO: 790342 - RNA, 24 nt, Human
caaaaaacuaaaacugccacaaau

SEQ ID NO: 790343 - RNA, 25 nt, Human
caagacaccaaaaaaacccaaaaaa

SEQ ID NO: 790344 - RNA, 28 nt, Human
caagacaccaaaaaaacccaaaaaacaa

SEQ ID NO: 790345 - RNA, 24 nt, Human
caagcuccaggccuggccuuucca

SEQ ID NO: 790346 - RNA, 25 nt, Human
caccaaaaaaacccaaaaaacaaac

SEQ ID NO: 790347 - RNA, 28 nt, Human
caccaaaaaaacccaaaaaacaaacaaa

SEQ ID NO: 790348 - RNA, 22 nt, Human
caccagauccggaagacacccu

SEQ ID NO: 790349 - RNA, 18 nt, Human
cacccugcacccugcgcc

SEQ ID NO: 790350 - RNA, 23 nt, Human
cacugugcguggagaggcagggc

SEQ ID NO: 790351 - RNA, 23 nt, Human
cagaaaacacaaauggacggaca

SEQ ID NO: 790352 - RNA, 21 nt, Human
cagagcccagcccggcacugc

SEQ ID NO: 790353 - RNA, 20 nt, Human
cagccagugcccagacucca

SEQ ID NO: 790354 - RNA, 20 nt, Human
cagcccggcacugcugggug

SEQ ID NO: 790355 - RNA, 20 nt, Human
caggagcugggagaguggcc

SEQ ID NO: 790356 - RNA, 21 nt, Human
cagggaaaggaaacacaguuc

SEQ ID NO: 790357 - RNA, 22 nt, Human
caggguagggaaagcugugauc

SEQ ID NO: 790358 - RNA, 27 nt, Human
ccaaaaaaacccaaaaaacaaacaaaa

SEQ ID NO: 790359 - RNA, 22 nt, Human
ccagaacauucccucuggccga

SEQ ID NO: 790360 - RNA, 21 nt, Human
ccagacuccaacuuaaacacc

SEQ ID NO: 790361 - RNA, 19 nt, Human
ccagagccagagaggggaa

SEQ ID NO: 790362 - RNA, 23 nt, Human
ccaggagcugggagaguggccca

SEQ ID NO: 790363 - RNA, 20 nt, Human
ccauaugcgccagacacugu

SEQ ID NO: 790364 - RNA, 23 nt, Human
cccaaaaaacaaacaaaaaaacc

SEQ ID NO: 790365 - RNA, 21 nt, Human
cccaugccgcaggcggugggg

SEQ ID NO: 790366 - RNA, 22 nt, Human
cccauggcugguucgccccgga

SEQ ID NO: 790367 - RNA, 21 nt, Human
ccccacagauacuguccucuc

SEQ ID NO: 790368 - RNA, 20 nt, Human
ccccuggggcagagcuggcc

SEQ ID NO: 790369 - RNA, 21 nt, Human
ccccuggggcagagcuggccu

SEQ ID NO: 790370 - RNA, 24 nt, Human
ccccuggggcagagcuggccucca

SEQ ID NO: 790371 - RNA, 20 nt, Human
ccgcagagcccagcccggca

SEQ ID NO: 790372 - RNA, 21 nt, Human
ccucugguggcagcucagccc

SEQ ID NO: 790373 - RNA, 21 nt, Human
ccugcacccugcgcccaggga

SEQ ID NO: 790374 - RNA, 24 nt, Human
cggacagacggauggacauaauca

SEQ ID NO: 790375 - RNA, 24 nt, Human
cggaccacucugcugaaguccuuu

SEQ ID NO: 790376 - RNA, 19 nt, Human
cucaagggaaacugccacc

SEQ ID NO: 790377 - RNA, 24 nt, Human
cuccugcccagccacgaggcuguc

SEQ ID NO: 790378 - RNA, 18 nt, Human
cucuuggcuccuuaacac

SEQ ID NO: 790379 - RNA, 24 nt, Human
cugaacaccuuccaucugggcuga

SEQ ID NO: 790380 - RNA, 19 nt, Human
cugaaguccaggugggugu

SEQ ID NO: 790381 - RNA, 23 nt, Human
cugaggcuggcccgcgucugccu

SEQ ID NO: 790382 - RNA, 18 nt, Human
cugcacccugcgcccagg

SEQ ID NO: 790383 - RNA, 23 nt, Human
cugcucuucaugaaggaccaggu

SEQ ID NO: 790384 - RNA, 18 nt, Human
cugcugaaguccaggugg

SEQ ID NO: 790385 - RNA, 20 nt, Human
cugcuuugcucaagggaaac

SEQ ID NO: 790386 - RNA, 23 nt, Human
cuggccgacagccacagaaauga

SEQ ID NO: 790387 - RNA, 20 nt, Human
cuguccgggaguucugggag

SEQ ID NO: 790388 - RNA, 19 nt, Human
cuugagacuugcucuccuc

SEQ ID NO: 790389 - RNA, 23 nt, Human
cuugcgggcucggcauggcgaga

SEQ ID NO: 790390 - RNA, 24 nt, Human
gaagacacccugcacccugcgccc

SEQ ID NO: 790391 - RNA, 20 nt, Human
gaccagguggugacagggcu

SEQ ID NO: 790392 - RNA, 18 nt, Human
gacgcagaaaacacaaau

SEQ ID NO: 790393 - RNA, 23 nt, Human
gacgcagaaaacacaaauggacg

SEQ ID NO: 790394 - RNA, 25 nt, Human
gacuugcucuccuccacaagcacuu

SEQ ID NO: 790395 - RNA, 24 nt, Human
gagaaagaaaacaagacaccaaaa

SEQ ID NO: 790396 - RNA, 25 nt, Human
gagaaagaaaacaagacaccaaaaa

SEQ ID NO: 790397 - RNA, 20 nt, Human
gagcaccguucauccgggga

SEQ ID NO: 790398 - RNA, 21 nt, Human
gagccaaaggaucagcaggag

SEQ ID NO: 790399 - RNA, 19 nt, Human
gaggcuguccuggcugucc

SEQ ID NO: 790400 - RNA, 18 nt, Human
gauggaagcagcggaggc

SEQ ID NO: 790401 - RNA, 26 nt, Human
gauuuuugcuucaugguugucagagg

SEQ ID NO: 790402 - RNA, 20 nt, Human
gcacuccaggcgccagggac

SEQ ID NO: 790403 - RNA, 19 nt, Human
gcacuggacacacccaugc

SEQ ID NO: 790404 - RNA, 18 nt, Human
gcagagcuggccuccagg

SEQ ID NO: 790405 - RNA, 24 nt, Human
gcccugggggacgugagucucaga

SEQ ID NO: 790406 - RNA, 19 nt, Human
gcgcgucggcugucggugc

SEQ ID NO: 790407 - RNA, 18 nt, Human
gcugauggaagcagcgga

SEQ ID NO: 790408 - RNA, 20 nt, Human
gcuguccgggaguucuggga

SEQ ID NO: 790409 - RNA, 21 nt, Human
gcuuggaaccaacgccugccc

SEQ ID NO: 790410 - RNA, 20 nt, Human
ggaaaggaaacacaguucaa

SEQ ID NO: 790411 - RNA, 19 nt, Human
ggaagcagcggaggccagc

SEQ ID NO: 790412 - RNA, 18 nt, Human
ggaggagggcggggguag

SEQ ID NO: 790413 - RNA, 19 nt, Human
ggcacugcugggugaccgu

SEQ ID NO: 790414 - RNA, 20 nt, Human
ggccccaggcuccugcccag

SEQ ID NO: 790415 - RNA, 21 nt, Human
ggccccaggcuccugcccagc

SEQ ID NO: 790416 - RNA, 20 nt, Human
ggcugcuuugcucaagggaa

SEQ ID NO: 790417 - RNA, 24 nt, Human
gggaaaggaaacacaguucaacgu

SEQ ID NO: 790418 - RNA, 19 nt, Human
gggguggcugggucaggca

SEQ ID NO: 790419 - RNA, 19 nt, Human
gggucaggcagagaccagc

SEQ ID NO: 790420 - RNA, 21 nt, Human
guccugcugcuugcugugcug

SEQ ID NO: 790421 - RNA, 18 nt, Human
gugcaugggaguggcagg

SEQ ID NO: 790422 - RNA, 21 nt, Human
guggaccgcaccgcagagccc

SEQ ID NO: 790423 - RNA, 25 nt, Human
guggcacuggacacacccaugccgc

SEQ ID NO: 790424 - RNA, 23 nt, Human
uaaauaccaagaacuaaagugag

SEQ ID NO: 790425 - RNA, 20 nt, Human
uaagacaagagacucuaaaa

SEQ ID NO: 790426 - RNA, 27 nt, Human
uaccaagaacuaaagugagggucccag

SEQ ID NO: 790427 - RNA, 21 nt, Human
uacccaggaaggaggagggcg

SEQ ID NO: 790428 - RNA, 25 nt, Human
uagaacuccuggaccaaggucacac

SEQ ID NO: 790429 - RNA, 20 nt, Human
uaggccugccccuccgggcc

SEQ ID NO: 790430 - RNA, 20 nt, Human
ucagccccuggggcagagcu

SEQ ID NO: 790431 - RNA, 21 nt, Human
uccacaagcacuugcccuggg

SEQ ID NO: 790432 - RNA, 18 nt, Human
uccagcuggaggccugcu

SEQ ID NO: 790433 - RNA, 22 nt, Human
uccagcuggaggccugcucucc

SEQ ID NO: 790434 - RNA, 24 nt, Human
uccauggacgcugccucccuggag

SEQ ID NO: 790435 - RNA, 18 nt, Human
ucccaggaccucuggugg

SEQ ID NO: 790436 - RNA, 25 nt, Human
uccccaggaacaaauagaacuccug

SEQ ID NO: 790437 - RNA, 19 nt, Human
ucccuccuuggcagcucca

SEQ ID NO: 790438 - RNA, 18 nt, Human
ucccucuggccgacagcc

SEQ ID NO: 790439 - RNA, 19 nt, Human
uccgacagucaaccagccu

SEQ ID NO: 790440 - RNA, 21 nt, Human
uccuccacaagcacuugcccu

SEQ ID NO: 790441 - RNA, 22 nt, Human
ucugggagaagcuaggccugcc

SEQ ID NO: 790442 - RNA, 23 nt, Human
ugaagaggcaagcuccaggccug

SEQ ID NO: 790443 - RNA, 19 nt, Human
ugacagggcugauggaagc

SEQ ID NO: 790444 - RNA, 22 nt, Human
ugaccgagucuacaaguucaga

SEQ ID NO: 790445 - RNA, 18 nt, Human
ugacucacaagcggcccc

SEQ ID NO: 790446 - RNA, 19 nt, Human
ugcagaacugugcauggga

SEQ ID NO: 790447 - RNA, 19 nt, Human
ugcaugggaguggcagggu

SEQ ID NO: 790448 - RNA, 21 nt, Human
ugccacccugcccugagacuc

SEQ ID NO: 790449 - RNA, 21 nt, Human
ugcccugagacuccaacucac

SEQ ID NO: 790450 - RNA, 21 nt, Human
ugcgggcucggcauggcgaga

SEQ ID NO: 790451 - RNA, 23 nt, Human
ugcuccauggacgcugccucccu

SEQ ID NO: 790452 - RNA, 21 nt, Human
uggaagcagcggaggccagcg

SEQ ID NO: 790453 - RNA, 21 nt, Human
uggaggagagaguacauggca

SEQ ID NO: 790454 - RNA, 20 nt, Human
uggaugaaggaggugggaga

SEQ ID NO: 790455 - RNA, 22 nt, Human
uggcaagagaugagccacagug

SEQ ID NO: 790456 - RNA, 22 nt, Human
uggccuccagggaggagacccu

SEQ ID NO: 790457 - RNA, 18 nt, Human
ugggagaagcuaggccug

SEQ ID NO: 790458 - RNA, 18 nt, Human
ugggagaagcuaggccug

SEQ ID NO: 790459 - RNA, 21 nt, Human
ugggcugaacuuucuugggaa

SEQ ID NO: 790460 - RNA, 22 nt, Human
ugggucaggcagagaccagcca

SEQ ID NO: 790461 - RNA, 18 nt, Human
uggugacagggcugaugg

SEQ ID NO: 790462 - RNA, 19 nt, Human
ugguggcagcucagccccu

SEQ ID NO: 790463 - RNA, 18 nt, Human
ugugcugggccggccucg

SEQ ID NO: 790464 - RNA, 25 nt, Human
uuaaaaaaaaaaaaacaaaaaacua

SEQ ID NO: 790465 - RNA, 26 nt, Human
uucccgaccagccucuaagugucugc

SEQ ID NO: 790466 - RNA, 23 nt, Human
uuggaaccaacgccugcccuccc

SEQ ID NO: 790467 - RNA, 24 nt, Human
uuuuuaauacccaaaccauccauu

SEQ ID NO: 790468 - RNA, 20 nt, Human
aagaagugaaaggcacugca

SEQ ID NO: 790469 - RNA, 23 nt, Human
aagaauaaaggauuccugagagc

SEQ ID NO: 790470 - RNA, 21 nt, Human
accccgcuccagccgcugcag

SEQ ID NO: 790471 - RNA, 21 nt, Human
acucaucccuaccaacccccc

SEQ ID NO: 790472 - RNA, 18 nt, Human
acuccccagccgagggau

SEQ ID NO: 790473 - RNA, 19 nt, Human
agaaaggaggaauggaggg

SEQ ID NO: 790474 - RNA, 21 nt, Human
agccuguccccuccucuccug

SEQ ID NO: 790475 - RNA, 23 nt, Human
aggcagcaguagggaaaaccagg

SEQ ID NO: 790476 - RNA, 19 nt, Human
aguguugggcucagaaagg

SEQ ID NO: 790477 - RNA, 22 nt, Human
caaccccccacccccccgcccc

SEQ ID NO: 790478 - RNA, 23 nt, Human
caaccccccacccccccgccccg

SEQ ID NO: 790479 - RNA, 18 nt, Human
cacccccaggcccacacu

SEQ ID NO: 790480 - RNA, 22 nt, Human
cagcaguagggaaaaccaggcu

SEQ ID NO: 790481 - RNA, 18 nt, Human
cagccaccgccgcccucc

SEQ ID NO: 790482 - RNA, 20 nt, Human
caucccuaccaaccccccac

SEQ ID NO: 790483 - RNA, 21 nt, Human
caucccuaccaaccccccacc

SEQ ID NO: 790484 - RNA, 19 nt, Human
ccaccgccgcccuccccgc

SEQ ID NO: 790485 - RNA, 18 nt, Human
ccagccgcugcagccacc

SEQ ID NO: 790486 - RNA, 24 nt, Human
ccaggcccacacuggggguucugc

SEQ ID NO: 790487 - RNA, 20 nt, Human
ccagggccaaacccaaaggg

SEQ ID NO: 790488 - RNA, 19 nt, Human
ccccacccccccgccccgg

SEQ ID NO: 790489 - RNA, 20 nt, Human
ccccacccccccgccccgga

SEQ ID NO: 790490 - RNA, 22 nt, Human
ccccacccccccgccccggauu

SEQ ID NO: 790491 - RNA, 18 nt, Human
cccccacccccccgcccc

SEQ ID NO: 790492 - RNA, 21 nt, Human
ccccccacccccccgccccgg

SEQ ID NO: 790493 - RNA, 20 nt, Human
ccccccgccccggauuucug

SEQ ID NO: 790494 - RNA, 23 nt, Human
cccccgccccggauuucugggga

SEQ ID NO: 790495 - RNA, 22 nt, Human
cccgcuccagccgcugcagcca

SEQ ID NO: 790496 - RNA, 22 nt, Human
cccuaccaaccccccacccccc

SEQ ID NO: 790497 - RNA, 21 nt, Human
ccgcggccgccgcuacuuccc

SEQ ID NO: 790498 - RNA, 21 nt, Human
ccgcugcagccaccgccgccc

SEQ ID NO: 790499 - RNA, 22 nt, Human
ccgcugcagccaccgccgcccu

SEQ ID NO: 790500 - RNA, 23 nt, Human
ccuaagucccauccucccacccc

SEQ ID NO: 790501 - RNA, 26 nt, Human
ccuaccaaccccccacccccccgccc

SEQ ID NO: 790502 - RNA, 21 nt, Human
ccucaaaugcucuucuucuuc

SEQ ID NO: 790503 - RNA, 18 nt, Human
cggccgccgcuacuuccu

SEQ ID NO: 790504 - RNA, 24 nt, Human
cuaccaaccccccacccccccgcc

SEQ ID NO: 790505 - RNA, 21 nt, Human
cucaucccuaccaacccccca

SEQ ID NO: 790506 - RNA, 20 nt, Human
cuccccgcggccgccgcuac

SEQ ID NO: 790507 - RNA, 20 nt, Human
cucuccuguggcccccuuga

SEQ ID NO: 790508 - RNA, 19 nt, Human
cuguggcccccuugacagg

SEQ ID NO: 790509 - RNA, 20 nt, Human
gcugcagccaccgccgcccu

SEQ ID NO: 790510 - RNA, 21 nt, Human
ggacucaucccuaccaacccc

SEQ ID NO: 790511 - RNA, 18 nt, Human
ggcgggggcgggggcggg

SEQ ID NO: 790512 - RNA, 21 nt, Human
ggcgggggugggcacuagggc

SEQ ID NO: 790513 - RNA, 23 nt, Human
gggccgagacccggcggucucua

SEQ ID NO: 790514 - RNA, 22 nt, Human
gggcgggggcgggggcgggggu

SEQ ID NO: 790515 - RNA, 21 nt, Human
ggguugggcgggggcgggggc

SEQ ID NO: 790516 - RNA, 20 nt, Human
gugaguugggguugggcggg

SEQ ID NO: 790517 - RNA, 21 nt, Human
guuccgcuccuggugcgggcc

SEQ ID NO: 790518 - RNA, 25 nt, Human
guugggcgggggcgggggcgggggu

SEQ ID NO: 790519 - RNA, 21 nt, Human
uaagucccauccucccacccc

SEQ ID NO: 790520 - RNA, 22 nt, Human
uaagucccauccucccaccccc

SEQ ID NO: 790521 - RNA, 20 nt, Human
uaccaaccccccaccccccc

SEQ ID NO: 790522 - RNA, 18 nt, Human
ucagaaaggaggaaugga

SEQ ID NO: 790523 - RNA, 20 nt, Human
ucccauccucccacccccag

SEQ ID NO: 790524 - RNA, 23 nt, Human
ucccauccucccacccccaggcc

SEQ ID NO: 790525 - RNA, 23 nt, Human
ucccuaccaaccccccacccccc

SEQ ID NO: 790526 - RNA, 24 nt, Human
ucccuaccaaccccccaccccccc

SEQ ID NO: 790527 - RNA, 26 nt, Human
ucccuaccaaccccccacccccccgc

SEQ ID NO: 790528 - RNA, 20 nt, Human
ucgaccacaaacaguuuuaa

SEQ ID NO: 790529 - RNA, 19 nt, Human
ucggccuccccacucccuc

SEQ ID NO: 790530 - RNA, 21 nt, Human
ucuacuaggacuccagggcca

SEQ ID NO: 790531 - RNA, 19 nt, Human
ugaaaggcacugcaggggu

SEQ ID NO: 790532 - RNA, 18 nt, Human
ugagagccuguccccucc

SEQ ID NO: 790533 - RNA, 20 nt, Human
uggggguucugcagcaggag

SEQ ID NO: 790534 - RNA, 21 nt, Human
ugggguugggcgggggcgggg

SEQ ID NO: 790535 - RNA, 23 nt, Human
aaacagcagacacgaggagagca

SEQ ID NO: 790536 - RNA, 24 nt, Human
aacagguuuguaaaaccaaaccug

SEQ ID NO: 790537 - RNA, 19 nt, Human
aacaugaugaaacccgucu

SEQ ID NO: 790538 - RNA, 20 nt, Human
aacaugaugaaacccgucuc

SEQ ID NO: 790539 - RNA, 23 nt, Human
aaggugggcggaucaugagguca

SEQ ID NO: 790540 - RNA, 24 nt, Human
aauggcaugaaccugggaggcgga

SEQ ID NO: 790541 - RNA, 18 nt, Human
acaaagcuuuuuaguucc

SEQ ID NO: 790542 - RNA, 22 nt, Human
acaccaagggaaaaaaacagca

SEQ ID NO: 790543 - RNA, 24 nt, Human
acagagcaagacuccaccucaaaa

SEQ ID NO: 790544 - RNA, 21 nt, Human
accaccuccaauaaauaucca

SEQ ID NO: 790545 - RNA, 22 nt, Human
acccaauuauuaaaguuuuuua

SEQ ID NO: 790546 - RNA, 23 nt, Human
acccucacuauaucccccugcca

SEQ ID NO: 790547 - RNA, 22 nt, Human
accucaaaaaaaaaaaaaagaa

SEQ ID NO: 790548 - RNA, 18 nt, Human
agaaaagggguacaaggc

SEQ ID NO: 790549 - RNA, 19 nt, Human
agacacgaggagagcaaga

SEQ ID NO: 790550 - RNA, 20 nt, Human
agagggaaaagucucuuuuc

SEQ ID NO: 790551 - RNA, 24 nt, Human
agcaagagcagcuucccagcccau

SEQ ID NO: 790552 - RNA, 24 nt, Human
agcacuuugggaggccaagguggg

SEQ ID NO: 790553 - RNA, 20 nt, Human
agcauuuuagggcuuccacu

SEQ ID NO: 790554 - RNA, 21 nt, Human
agccgggcacgguggcucaug

SEQ ID NO: 790555 - RNA, 23 nt, Human
agccgggcacgguggcucaugcc

SEQ ID NO: 790556 - RNA, 23 nt, Human
agccgggugugguggcaggugcc

SEQ ID NO: 790557 - RNA, 24 nt, Human
agccugggcgacagagcaagacuc

SEQ ID NO: 790558 - RNA, 22 nt, Human
aggcaggagaauggcaugaacc

SEQ ID NO: 790559 - RNA, 24 nt, Human
aggcaggagaauggcaugaaccug

SEQ ID NO: 790560 - RNA, 20 nt, Human
aggccaaggugggcggauca

SEQ ID NO: 790561 - RNA, 20 nt, Human
aggcggagcuugcagugagc

SEQ ID NO: 790562 - RNA, 24 nt, Human
aggcggagcuugcagugagcugag

SEQ ID NO: 790563 - RNA, 18 nt, Human
aggcugaggcaggagaau

SEQ ID NO: 790564 - RNA, 18 nt, Human
agguaauuuuaaaaaugu

SEQ ID NO: 790565 - RNA, 24 nt, Human
aggugggcggaucaugaggucagg

SEQ ID NO: 790566 - RNA, 19 nt, Human
aguaacagaccuccccucc

SEQ ID NO: 790567 - RNA, 20 nt, Human
aucaugaggucaggagaucc

SEQ ID NO: 790568 - RNA, 22 nt, Human
aucccagcacuuugggaggcca

SEQ ID NO: 790569 - RNA, 19 nt, Human
augccuauaaucccagcac

SEQ ID NO: 790570 - RNA, 24 nt, Human
auugcacuacagccugggcgacag

SEQ ID NO: 790571 - RNA, 24 nt, Human
caagaccauccuggcuaacaugau

SEQ ID NO: 790572 - RNA, 21 nt, Human
caagagcagcuucccagccca

SEQ ID NO: 790573 - RNA, 22 nt, Human
caccaagggaaaaaaacagcag

SEQ ID NO: 790574 - RNA, 23 nt, Human
cacccucacuauaucccccugcc

SEQ ID NO: 790575 - RNA, 28 nt, Human
caccucaaaaaaaaaaaaaagaacugaa

SEQ ID NO: 790576 - RNA, 20 nt, Human
cacuacagccugggcgacag

SEQ ID NO: 790577 - RNA, 23 nt, Human
cacuacagccugggcgacagagc

SEQ ID NO: 790578 - RNA, 24 nt, Human
cacucccuacccuaagguuagagg

SEQ ID NO: 790579 - RNA, 24 nt, Human
cacugcccuucaacaaggagaaac

SEQ ID NO: 790580 - RNA, 18 nt, Human
cagaauccuuuacuccuc

SEQ ID NO: 790581 - RNA, 23 nt, Human
cagacacgaggagagcaagagca

SEQ ID NO: 790582 - RNA, 23 nt, Human
cagaccuccccucccccagcucc

SEQ ID NO: 790583 - RNA, 22 nt, Human
cagcaaaaagaugaaaaauuag

SEQ ID NO: 790584 - RNA, 24 nt, Human
cagcacuuugggaggccaaggugg

SEQ ID NO: 790585 - RNA, 18 nt, Human
cagcauaagaacugaaaa

SEQ ID NO: 790586 - RNA, 20 nt, Human
cagcauaagaacugaaaaua

SEQ ID NO: 790587 - RNA, 24 nt, Human
cagcuacucgggaggcugaggcag

SEQ ID NO: 790588 - RNA, 21 nt, Human
caugaaccugggaggcggagc

SEQ ID NO: 790589 - RNA, 20 nt, Human
caugccuauaaucccagcac

SEQ ID NO: 790590 - RNA, 24 nt, Human
caugccuauaaucccagcacuuug

SEQ ID NO: 790591 - RNA, 19 nt, Human
cauugcacuacagccuggg

SEQ ID NO: 790592 - RNA, 22 nt, Human
cauugcacuacagccugggcga

SEQ ID NO: 790593 - RNA, 24 nt, Human
cauugcacuacagccugggcgaca

SEQ ID NO: 790594 - RNA, 22 nt, Human
ccacccaauuauuaaaguuuuu

SEQ ID NO: 790595 - RNA, 24 nt, Human
ccaccucaaaaaaaaaaaaaagaa

SEQ ID NO: 790596 - RNA, 20 nt, Human
ccauugcacuacagccuggg

SEQ ID NO: 790597 - RNA, 21 nt, Human
ccauugcacuacagccugggc

SEQ ID NO: 790598 - RNA, 24 nt, Human
ccauugcacuacagccugggcgac

SEQ ID NO: 790599 - RNA, 22 nt, Human
cccacccugaagaacacaaagc

SEQ ID NO: 790600 - RNA, 25 nt, Human
cccccugccacccacccugaagaac

SEQ ID NO: 790601 - RNA, 19 nt, Human
cccuaauuaccaccuccaa

SEQ ID NO: 790602 - RNA, 19 nt, Human
cccucucuuucaccccuuu

SEQ ID NO: 790603 - RNA, 22 nt, Human
ccuauaaucccagcacuuuggg

SEQ ID NO: 790604 - RNA, 18 nt, Human
ccucaaaaaaaaaaaaaa

SEQ ID NO: 790605 - RNA, 26 nt, Human
ccucacuauaucccccugccacccac

SEQ ID NO: 790606 - RNA, 22 nt, Human
ccuggcuaacaugaugaaaccc

SEQ ID NO: 790607 - RNA, 22 nt, Human
ccugggcgacagagcaagacuc

SEQ ID NO: 790608 - RNA, 19 nt, Human
ccuguagucccagcuacuc

SEQ ID NO: 790609 - RNA, 21 nt, Human
ccuguagucccagcuacucgg

SEQ ID NO: 790610 - RNA, 21 nt, Human
ccugugauuuagucaugaagc

SEQ ID NO: 790611 - RNA, 23 nt, Human
cuauuugccauauagcugauccc

SEQ ID NO: 790612 - RNA, 26 nt, Human
cucacuauaucccccugccacccacc

SEQ ID NO: 790613 - RNA, 24 nt, Human
cucaugccuauaaucccagcacuu

SEQ ID NO: 790614 - RNA, 20 nt, Human
cuccaccucaaaaaaaaaaa

SEQ ID NO: 790615 - RNA, 23 nt, Human
cuccaccucaaaaaaaaaaaaaa

SEQ ID NO: 790616 - RNA, 18 nt, Human
cuccccucccccagcucc

SEQ ID NO: 790617 - RNA, 24 nt, Human
cugcugauccaaucccagccuuac

SEQ ID NO: 790618 - RNA, 19 nt, Human
cuugcagugagcugagauu

SEQ ID NO: 790619 - RNA, 21 nt, Human
cuugcagugagcugagauugc

SEQ ID NO: 790620 - RNA, 19 nt, Human
cuugugcucagaaaagggg

SEQ ID NO: 790621 - RNA, 24 nt, Human
gaagauuuucccugagacaaacaa

SEQ ID NO: 790622 - RNA, 25 nt, Human
gaccuccccucccccagcuccccac

SEQ ID NO: 790623 - RNA, 25 nt, Human
gagcagcuucccagcccaugguuuc

SEQ ID NO: 790624 - RNA, 26 nt, Human
gagcagcuucccagcccaugguuucc

SEQ ID NO: 790625 - RNA, 23 nt, Human
gagcuugcagugagcugagauug

SEQ ID NO: 790626 - RNA, 21 nt, Human
gcaaaguggucacagcauaag

SEQ ID NO: 790627 - RNA, 19 nt, Human
gccaaggugggcggaucau

SEQ ID NO: 790628 - RNA, 24 nt, Human
gccauugcacuacagccugggcga

SEQ ID NO: 790629 - RNA, 23 nt, Human
gcuaacaugaugaaacccgucuc

SEQ ID NO: 790630 - RNA, 25 nt, Human
ggaagugggggagagggcagggggc

SEQ ID NO: 790631 - RNA, 24 nt, Human
ggagcuugcagugagcugagauug

SEQ ID NO: 790632 - RNA, 23 nt, Human
ggcacgguggcucaugccuauaa

SEQ ID NO: 790633 - RNA, 21 nt, Human
ggcucaugccuauaaucccag

SEQ ID NO: 790634 - RNA, 19 nt, Human
gggaagugggggagagggc

SEQ ID NO: 790635 - RNA, 24 nt, Human
gggcggaucaugaggucaggagau

SEQ ID NO: 790636 - RNA, 21 nt, Human
ggggggaagugggggagaggg

SEQ ID NO: 790637 - RNA, 23 nt, Human
gguggcucaugccuauaauccca

SEQ ID NO: 790638 - RNA, 23 nt, Human
ggugggcggaucaugaggucagg

SEQ ID NO: 790639 - RNA, 23 nt, Human
guacaaggcagccuuauauucca

SEQ ID NO: 790640 - RNA, 23 nt, Human
guggcucaugccuauaaucccag

SEQ ID NO: 790641 - RNA, 22 nt, Human
uaacagaccuccccucccccag

SEQ ID NO: 790642 - RNA, 23 nt, Human
uaacaugaugaaacccgucucua

SEQ ID NO: 790643 - RNA, 18 nt, Human
uaagaaaaaaguaagaga

SEQ ID NO: 790644 - RNA, 23 nt, Human
uaaguugguucaucuuucaguaa

SEQ ID NO: 790645 - RNA, 19 nt, Human
uagaaaaagcuacaaggca

SEQ ID NO: 790646 - RNA, 20 nt, Human
uagaaaaagcuacaaggcaa

SEQ ID NO: 790647 - RNA, 22 nt, Human
uagaggguuggauuucugcuga

SEQ ID NO: 790648 - RNA, 21 nt, Human
uagcauuuuagggcuuccacu

SEQ ID NO: 790649 - RNA, 24 nt, Human
uagccgggcacgguggcucaugcc

SEQ ID NO: 790650 - RNA, 24 nt, Human
uauaguacaccaagggaaaaaaac

SEQ ID NO: 790651 - RNA, 24 nt, Human
uauauuccagguaagaugguggga

SEQ ID NO: 790652 - RNA, 21 nt, Human
uaucaagagagggaaaagucu

SEQ ID NO: 790653 - RNA, 22 nt, Human
uaucaagagagggaaaagucuc

SEQ ID NO: 790654 - RNA, 20 nt, Human
uaugaggaaaaggaaauauu

SEQ ID NO: 790655 - RNA, 22 nt, Human
ucacuauaucccccugccaccc

SEQ ID NO: 790656 - RNA, 18 nt, Human
ucaugaggucaggagauc

SEQ ID NO: 790657 - RNA, 24 nt, Human
ucaugaggucaggagaucaagacc

SEQ ID NO: 790658 - RNA, 22 nt, Human
ucaugccuauaaucccagcacu

SEQ ID NO: 790659 - RNA, 23 nt, Human
uccaccucaaaaaaaaaaaaaag

SEQ ID NO: 790660 - RNA, 25 nt, Human
ucccagcccaugguuuccccagauc

SEQ ID NO: 790661 - RNA, 21 nt, Human
uccccagauccuuagcacucc

SEQ ID NO: 790662 - RNA, 24 nt, Human
uccccagauccuuagcacucccua

SEQ ID NO: 790663 - RNA, 20 nt, Human
ucccugagacaaacaaugaa

SEQ ID NO: 790664 - RNA, 22 nt, Human
ucucuacuaaaaauauaaaaaa

SEQ ID NO: 790665 - RNA, 22 nt, Human
ugaaaccuaccuucacugcccu

SEQ ID NO: 790666 - RNA, 20 nt, Human
ugaagcgggugaaacauagu

SEQ ID NO: 790667 - RNA, 22 nt, Human
ugaagcgggugaaacauaguca

SEQ ID NO: 790668 - RNA, 19 nt, Human
ugagacaaacaaugaacag

SEQ ID NO: 790669 - RNA, 23 nt, Human
ugaggcaggagaauggcaugaac

SEQ ID NO: 790670 - RNA, 24 nt, Human
ugaggcaggagaauggcaugaacc

SEQ ID NO: 790671 - RNA, 24 nt, Human
ugaggcaggagaauggcaugaacc

SEQ ID NO: 790672 - RNA, 24 nt, Human
ugcacuacagccugggcgacagag

SEQ ID NO: 790673 - RNA, 24 nt, Human
ugccacccacccugaagaacacaa

SEQ ID NO: 790674 - RNA, 21 nt, Human
ugcccuauggucauucucccu

SEQ ID NO: 790675 - RNA, 24 nt, Human
ugccuguagucccagcuacucggg

SEQ ID NO: 790676 - RNA, 22 nt, Human
ugcgccauugcacuacagccug

SEQ ID NO: 790677 - RNA, 23 nt, Human
ugcugauccaaucccagccuuac

SEQ ID NO: 790678 - RNA, 22 nt, Human
uggaaacaaauugacagcaaaa

SEQ ID NO: 790679 - RNA, 27 nt, Human
uggaaacaaauugacagcaaaaagaug

SEQ ID NO: 790680 - RNA, 18 nt, Human
uggaaagauagaaaaaga

SEQ ID NO: 790681 - RNA, 25 nt, Human
uggagagguggugccaacaucuggc

SEQ ID NO: 790682 - RNA, 22 nt, Human
uggauuucugcugauccaaucc

SEQ ID NO: 790683 - RNA, 21 nt, Human
uggcucaugccuauaauccca

SEQ ID NO: 790684 - RNA, 22 nt, Human
uggcucaugccuauaaucccag

SEQ ID NO: 790685 - RNA, 24 nt, Human
uggcucaugccuauaaucccagca

SEQ ID NO: 790686 - RNA, 19 nt, Human
ugggaggccaaggugggcg

SEQ ID NO: 790687 - RNA, 24 nt, Human
ugggaggccaaggugggcggauca

SEQ ID NO: 790688 - RNA, 29 nt, Human
ugggaggcggagcuugcagugacaacggu

SEQ ID NO: 790689 - RNA, 24 nt, Human
ugggaggcggagcuugcagugagc

SEQ ID NO: 790690 - RNA, 24 nt, Human
ugguggcaggugccuguaguccca

SEQ ID NO: 790691 - RNA, 20 nt, Human
ugguuaacucauugaugaua

SEQ ID NO: 790692 - RNA, 20 nt, Human
ugguuucuuuguuuaaacag

SEQ ID NO: 790693 - RNA, 23 nt, Human
ugugguggcaggugccuguaguc

SEQ ID NO: 790694 - RNA, 21 nt, Human
uuacuccuccuuuccaauccu

SEQ ID NO: 790695 - RNA, 23 nt, Human
uuagugcccuauggucauucucc

SEQ ID NO: 790696 - RNA, 22 nt, Human
uucccucucuuucaccccuuug

SEQ ID NO: 790697 - RNA, 23 nt, Human
uucucugccacaagguaauuuua

SEQ ID NO: 790698 - RNA, 19 nt, Human
uugcagugagcugagauug

SEQ ID NO: 790699 - RNA, 22 nt, Human
uugcagugagcugagauugcgc

SEQ ID NO: 790700 - RNA, 19 nt, Human
aaaaacguucccugccucc

SEQ ID NO: 790701 - RNA, 19 nt, Human
aaaaagccuucauaucuac

SEQ ID NO: 790702 - RNA, 21 nt, Human
aaaaugugcaccaaaagcaca

SEQ ID NO: 790703 - RNA, 21 nt, Human
aaacaaaaggaggaagcaaag

SEQ ID NO: 790704 - RNA, 22 nt, Human
aaacaaauauguauacuuccac

SEQ ID NO: 790705 - RNA, 18 nt, Human
aaaugaccuuggggagaa

SEQ ID NO: 790706 - RNA, 18 nt, Human
aacaaaaaccugcauaua

SEQ ID NO: 790707 - RNA, 19 nt, Human
aacguucccugccucccuc

SEQ ID NO: 790708 - RNA, 19 nt, Human
aacuuuggaaaaacaaaua

SEQ ID NO: 790709 - RNA, 21 nt, Human
aagaaaaaacguucccugccu

SEQ ID NO: 790710 - RNA, 21 nt, Human
aagaacacaucugagaugcaa

SEQ ID NO: 790711 - RNA, 20 nt, Human
aagcaaagucugcacuggcc

SEQ ID NO: 790712 - RNA, 23 nt, Human
aauucacaacuauugcuaaaaaa

SEQ ID NO: 790713 - RNA, 21 nt, Human
acagagugugugggcuuaaag

SEQ ID NO: 790714 - RNA, 20 nt, Human
acagguacaacaaaaaccug

SEQ ID NO: 790715 - RNA, 21 nt, Human
acagugaaaagaagaucugga

SEQ ID NO: 790716 - RNA, 21 nt, Human
acugcugcaccucccuggggu

SEQ ID NO: 790717 - RNA, 19 nt, Human
agaaauguggccacgucuu

SEQ ID NO: 790718 - RNA, 20 nt, Human
aggaggaagcaaagucugca

SEQ ID NO: 790719 - RNA, 20 nt, Human
aggagugaaacugcugcacc

SEQ ID NO: 790720 - RNA, 23 nt, Human
agggaacccugucucugcaguug

SEQ ID NO: 790721 - RNA, 19 nt, Human
agugagggaacccugucuc

SEQ ID NO: 790722 - RNA, 22 nt, Human
caaaagaagcugacuagcagug

SEQ ID NO: 790723 - RNA, 21 nt, Human
caagaacacaucugagaugca

SEQ ID NO: 790724 - RNA, 20 nt, Human
cagagugugugggcuuaaag

SEQ ID NO: 790725 - RNA, 24 nt, Human
cagcaucgcuaggcaugggcugca

SEQ ID NO: 790726 - RNA, 19 nt, Human
ccauuaauucacaacuauu

SEQ ID NO: 790727 - RNA, 22 nt, Human
ccuuuauucugacaccauaaau

SEQ ID NO: 790728 - RNA, 26 nt, Human
cguaaaugaauauccaggagcauuag

SEQ ID NO: 790729 - RNA, 18 nt, Human
cguuagaagucuugcucc

SEQ ID NO: 790730 - RNA, 22 nt, Human
cuaaaaaaugugcaccaaaagc

SEQ ID NO: 790731 - RNA, 19 nt, Human
cuccggcccaacaguccaa

SEQ ID NO: 790732 - RNA, 21 nt, Human
cuuccuacaagaacacaucug

SEQ ID NO: 790733 - RNA, 19 nt, Human
gaaacugcugcaccucccu

SEQ ID NO: 790734 - RNA, 19 nt, Human
gacacaguggaggaaggag

SEQ ID NO: 790735 - RNA, 24 nt, Human
gaccauuucaacuuauuagaaaug

SEQ ID NO: 790736 - RNA, 24 nt, Human
gacuagcagugagggaacccuguc

SEQ ID NO: 790737 - RNA, 20 nt, Human
gagcaagaaccuguggucuc

SEQ ID NO: 790738 - RNA, 22 nt, Human
gccacacacaagcuagggaggc

SEQ ID NO: 790739 - RNA, 24 nt, Human
ggcccaacaguccaagugcuauga

SEQ ID NO: 790740 - RNA, 19 nt, Human
uacaacaaaaaccugcaua

SEQ ID NO: 790741 - RNA, 24 nt, Human
uacaacaaaaaccugcauauaaaa

SEQ ID NO: 790742 - RNA, 27 nt, Human
uacaagauccaaaugauucuaugaaag

SEQ ID NO: 790743 - RNA, 26 nt, Human
uagaaaggacuuuuaaaaaaaaagaa

SEQ ID NO: 790744 - RNA, 21 nt, Human
uagaagucuugcucccguugg

SEQ ID NO: 790745 - RNA, 20 nt, Human
uaugaaaugggcugguucuc

SEQ ID NO: 790746 - RNA, 26 nt, Human
uauugcuaaaaaaugugcaccaaaag

SEQ ID NO: 790747 - RNA, 22 nt, Human
ucacaacuauugcuaaaaaaug

SEQ ID NO: 790748 - RNA, 19 nt, Human
uccaacagauagaaaggac

SEQ ID NO: 790749 - RNA, 19 nt, Human
uccagagcaagaaccugug

SEQ ID NO: 790750 - RNA, 19 nt, Human
ucccucccuagucccugcu

SEQ ID NO: 790751 - RNA, 23 nt, Human
ucccugccucccucccuaguccc

SEQ ID NO: 790752 - RNA, 21 nt, Human
ucccuggggacagcuuaaucu

SEQ ID NO: 790753 - RNA, 22 nt, Human
ucccuggggacagcuuaaucua

SEQ ID NO: 790754 - RNA, 22 nt, Human
ucccugggguugccacaaagcc

SEQ ID NO: 790755 - RNA, 22 nt, Human
ucucugaggaagggagaaagac

SEQ ID NO: 790756 - RNA, 22 nt, Human
ucugacaccauaaauuuuaggu

SEQ ID NO: 790757 - RNA, 19 nt, Human
ucuucuguacaucuugaaa

SEQ ID NO: 790758 - RNA, 24 nt, Human
ucuugaaagacauagucugcuugg

SEQ ID NO: 790759 - RNA, 19 nt, Human
ugaaacagagacaguugug

SEQ ID NO: 790760 - RNA, 23 nt, Human
ugauggugucaugcugcucaucc

SEQ ID NO: 790761 - RNA, 24 nt, Human
ugcaacagcaaauucccauuaaaa

SEQ ID NO: 790762 - RNA, 21 nt, Human
ugcaauauuaacaacaagccc

SEQ ID NO: 790763 - RNA, 19 nt, Human
ugcucucugaggaagggag

SEQ ID NO: 790764 - RNA, 23 nt, Human
ugcuuggggcucuucugcucuug

SEQ ID NO: 790765 - RNA, 21 nt, Human
uggaauguacuguuuuagaaa

SEQ ID NO: 790766 - RNA, 18 nt, Human
uggacuggaaucaacugc

SEQ ID NO: 790767 - RNA, 22 nt, Human
uggcaauggccuguccaguuuc

SEQ ID NO: 790768 - RNA, 27 nt, Human
uggggagaauccaaaguauuuucugcc

SEQ ID NO: 790769 - RNA, 20 nt, Human
ugguuucuauauuacaucuc

SEQ ID NO: 790770 - RNA, 25 nt, Human
uuaauucacaacuauugcuaaaaaa

SEQ ID NO: 790771 - RNA, 23 nt, Human
uucaucauggucuuaaauuuuga

SEQ ID NO: 790772 - RNA, 19 nt, Human
uugcucccguuggggauca

SEQ ID NO: 790773 - RNA, 22 nt, Human
uuucuauauuacaucucgauua

SEQ ID NO: 790774 - RNA, 21 nt, Human
uuuugauggugucaugcugcu

SEQ ID NO: 790775 - RNA, 22 nt, Human
uuuuuuuuuuuuuugccauuaa

SEQ ID NO: 790776 - RNA, 22 nt, Human
aaaaacacaaaacaaaaaggug

SEQ ID NO: 790777 - RNA, 23 nt, Human
aaaacacaaaacaaaaaggugga

SEQ ID NO: 790778 - RNA, 21 nt, Human
aaaacagugggucccuaaagc

SEQ ID NO: 790779 - RNA, 18 nt, Human
aaacagucacugcuaaag

SEQ ID NO: 790780 - RNA, 19 nt, Human
aaagguggaaugacuguuu

SEQ ID NO: 790781 - RNA, 24 nt, Human
aaaugcuauuaugucaaguaaacc

SEQ ID NO: 790782 - RNA, 26 nt, Human
aacagcacaaggcaaucuguugcaac

SEQ ID NO: 790783 - RNA, 20 nt, Human
aagaagaaaugaaaacagug

SEQ ID NO: 790784 - RNA, 22 nt, Human
aagaagaaaugaaaacaguggg

SEQ ID NO: 790785 - RNA, 24 nt, Human
aagcaaacugugaccuggaaucca

SEQ ID NO: 790786 - RNA, 24 nt, Human
aaguaaaccuaagucuucaaugaa

SEQ ID NO: 790787 - RNA, 22 nt, Human
aaguggccucucuuaaaaaggc

SEQ ID NO: 790788 - RNA, 19 nt, Human
acaaaacaaaaagguggaa

SEQ ID NO: 790789 - RNA, 21 nt, Human
acaauccaucucugaccuacc

SEQ ID NO: 790790 - RNA, 19 nt, Human
acagcaaaaacacaaaaca

SEQ ID NO: 790791 - RNA, 21 nt, Human
acagcaaaaacacaaaacaaa

SEQ ID NO: 790792 - RNA, 20 nt, Human
acgacaaucacaaaugcuau

SEQ ID NO: 790793 - RNA, 23 nt, Human
acugcugaccaccccgcucaagu

SEQ ID NO: 790794 - RNA, 21 nt, Human
agcugaagauggcacaaugug

SEQ ID NO: 790795 - RNA, 21 nt, Human
aggaauuagaaggcacagaaa

SEQ ID NO: 790796 - RNA, 19 nt, Human
agucauccugaacugcugc

SEQ ID NO: 790797 - RNA, 18 nt, Human
caagaagaaaugaaaaca

SEQ ID NO: 790798 - RNA, 20 nt, Human
caagaagaaaugaaaacagu

SEQ ID NO: 790799 - RNA, 23 nt, Human
caagguaaacuccaagaagaaau

SEQ ID NO: 790800 - RNA, 21 nt, Human
caccaacaauccaucucugac

SEQ ID NO: 790801 - RNA, 18 nt, Human
caccaggacagcugugcc

SEQ ID NO: 790802 - RNA, 20 nt, Human
caccaggacagcugugccuu

SEQ ID NO: 790803 - RNA, 21 nt, Human
cacucuucccaacaagcaauu

SEQ ID NO: 790804 - RNA, 23 nt, Human
cagcacaaggcaaucuguugcaa

SEQ ID NO: 790805 - RNA, 18 nt, Human
cagcgcgcagccgggggc

SEQ ID NO: 790806 - RNA, 20 nt, Human
cagcuugacagcaaaaacac

SEQ ID NO: 790807 - RNA, 18 nt, Human
cauccugaacugcugcag

SEQ ID NO: 790808 - RNA, 18 nt, Human
cccauggcugcaucugaa

SEQ ID NO: 790809 - RNA, 18 nt, Human
ccgccgcagcuccggccg

SEQ ID NO: 790810 - RNA, 21 nt, Human
ccuaaagcacucuucccaaca

SEQ ID NO: 790811 - RNA, 20 nt, Human
ccucucuuaaaaaggcugcu

SEQ ID NO: 790812 - RNA, 18 nt, Human
cgcagccgggggcggcgg

SEQ ID NO: 790813 - RNA, 24 nt, Human
cuccggccguggcgcucggggggc

SEQ ID NO: 790814 - RNA, 20 nt, Human
gaugcaggaauuagaaggca

SEQ ID NO: 790815 - RNA, 21 nt, Human
gcucuaaaauauaaggauaaa

SEQ ID NO: 790816 - RNA, 20 nt, Human
gcuuauuccuuucuccuuca

SEQ ID NO: 790817 - RNA, 21 nt, Human
uaaaaagcaaacugugaccug

SEQ ID NO: 790818 - RNA, 24 nt, Human
uaccuugucuaaaaagcaaacugu

SEQ ID NO: 790819 - RNA, 24 nt, Human
uauaugaauuuuuucuaaauguuc

SEQ ID NO: 790820 - RNA, 23 nt, Human
ucagcuggaagaacuuaccaacc

SEQ ID NO: 790821 - RNA, 18 nt, Human
uccaaggaagaacugucc

SEQ ID NO: 790822 - RNA, 22 nt, Human
ucugaaacaagguaaacuccaa

SEQ ID NO: 790823 - RNA, 21 nt, Human
ugaaacaagguaaacuccaag

SEQ ID NO: 790824 - RNA, 23 nt, Human
ugaaagcucuaaaauauaaggau

SEQ ID NO: 790825 - RNA, 24 nt, Human
ugaaagcucuaaaauauaaggaua

SEQ ID NO: 790826 - RNA, 19 nt, Human
ugaagcaucagcuugacag

SEQ ID NO: 790827 - RNA, 24 nt, Human
ugacagcaaaaacacaaaacaaaa

SEQ ID NO: 790828 - RNA, 19 nt, Human
ugccgccgccgcagcuccg

SEQ ID NO: 790829 - RNA, 23 nt, Human
uggguuuauugcaccaacaaucc

SEQ ID NO: 790830 - RNA, 20 nt, Human
ugucuggaaagauguuuuga

SEQ ID NO: 790831 - RNA, 18 nt, Human
uguuucuguuugcucuuc

SEQ ID NO: 790832 - RNA, 22 nt, Human
uuagugcuuauguuuccuccua

SEQ ID NO: 790833 - RNA, 20 nt, Human
uucccaccaggacagcugug

SEQ ID NO: 790834 - RNA, 24 nt, Human
uuucagacuguacacuuugcugcu

SEQ ID NO: 790835 - RNA, 19 nt, Human
aaacaccgaagccgcagag

SEQ ID NO: 790836 - RNA, 22 nt, Human
aaccauuuguaaucaaaaucaa

SEQ ID NO: 790837 - RNA, 19 nt, Human
aagccgcagagcgggcguc

SEQ ID NO: 790838 - RNA, 23 nt, Human
aaucugcuccacuuggcggcguu

SEQ ID NO: 790839 - RNA, 21 nt, Human
acgcagcccuggcgacuccuu

SEQ ID NO: 790840 - RNA, 20 nt, Human
agaaagccccaagcucugga

SEQ ID NO: 790841 - RNA, 24 nt, Human
agaccagaaguuccgucgagucug

SEQ ID NO: 790842 - RNA, 18 nt, Human
agagaugggccgcuccac

SEQ ID NO: 790843 - RNA, 22 nt, Human
agcgggcagcugugccuggccc

SEQ ID NO: 790844 - RNA, 21 nt, Human
aggauggugaggggggaggug

SEQ ID NO: 790845 - RNA, 20 nt, Human
agggacacaagguccucguu

SEQ ID NO: 790846 - RNA, 20 nt, Human
agugaaaaaagcagucagaa

SEQ ID NO: 790847 - RNA, 18 nt, Human
auggaggagcagcuccgu

SEQ ID NO: 790848 - RNA, 26 nt, Human
auguggggugggggcugaaggggggu

SEQ ID NO: 790849 - RNA, 22 nt, Human
caacagcaucuuggggcuuggc

SEQ ID NO: 790850 - RNA, 22 nt, Human
caccgucuuagaaucugcucca

SEQ ID NO: 790851 - RNA, 22 nt, Human
cagcaucuuggggcuuggcacu

SEQ ID NO: 790852 - RNA, 18 nt, Human
caguuccuggaccacauc

SEQ ID NO: 790853 - RNA, 25 nt, Human
caucuccuuccacaggggcacaguc

SEQ ID NO: 790854 - RNA, 20 nt, Human
caugcgguccccaggacacc

SEQ ID NO: 790855 - RNA, 20 nt, Human
ccacagggugcuggccuucu

SEQ ID NO: 790856 - RNA, 21 nt, Human
ccagcgcucucgucguucccc

SEQ ID NO: 790857 - RNA, 21 nt, Human
ccucugcggcucucccacaaa

SEQ ID NO: 790858 - RNA, 20 nt, Human
ccucuggaucaccaucaccc

SEQ ID NO: 790859 - RNA, 18 nt, Human
ccuggcucagccccaugc

SEQ ID NO: 790860 - RNA, 20 nt, Human
cgcagcugcuggacucgggg

SEQ ID NO: 790861 - RNA, 19 nt, Human
cggcauggaaccaggaucu

SEQ ID NO: 790862 - RNA, 21 nt, Human
cgggccaaguggaggcaacga

SEQ ID NO: 790863 - RNA, 23 nt, Human
cuauaagugaaaaaagcagucag

SEQ ID NO: 790864 - RNA, 21 nt, Human
cuccauuccaagacacaggag

SEQ ID NO: 790865 - RNA, 18 nt, Human
cuccugggggucuggggg

SEQ ID NO: 790866 - RNA, 18 nt, Human
cucugagcccagccucug

SEQ ID NO: 790867 - RNA, 23 nt, Human
cugcagggcgcuggcagcugugu

SEQ ID NO: 790868 - RNA, 18 nt, Human
cuggacagcaaugugggg

SEQ ID NO: 790869 - RNA, 19 nt, Human
cugggcuggagcugcugga

SEQ ID NO: 790870 - RNA, 18 nt, Human
cuuccucuuccucuuccc

SEQ ID NO: 790871 - RNA, 18 nt, Human
gagacucuuccauggccu

SEQ ID NO: 790872 - RNA, 23 nt, Human
gagcgggcgucagagccccggcc

SEQ ID NO: 790873 - RNA, 23 nt, Human
gagcgggcgucagagccccggcc

SEQ ID NO: 790874 - RNA, 21 nt, Human
gaggagcagcuccgugguucu

SEQ ID NO: 790875 - RNA, 20 nt, Human
gaugaguauuugagcaguuc

SEQ ID NO: 790876 - RNA, 18 nt, Human
gccauucaccuguggcug

SEQ ID NO: 790877 - RNA, 23 nt, Human
gccccaagcucuggaggcuucca

SEQ ID NO: 790878 - RNA, 22 nt, Human
gcucaggacaggggacuucagc

SEQ ID NO: 790879 - RNA, 24 nt, Human
gcuccacuccugggggucuggggg

SEQ ID NO: 790880 - RNA, 18 nt, Human
gcuccgggggggcucacu

SEQ ID NO: 790881 - RNA, 25 nt, Human
gcuguguccuccgggcgcuucuucu

SEQ ID NO: 790882 - RNA, 21 nt, Human
ggagccccuccugucgaggcc

SEQ ID NO: 790883 - RNA, 18 nt, Human
ggaggcaacgacggggug

SEQ ID NO: 790884 - RNA, 20 nt, Human
ggccuucuuggcagaaaggg

SEQ ID NO: 790885 - RNA, 19 nt, Human
ggcucaguggugguguugc

SEQ ID NO: 790886 - RNA, 18 nt, Human
gggcagcugugccuggcc

SEQ ID NO: 790887 - RNA, 18 nt, Human
gggcucccaggcugucuc

SEQ ID NO: 790888 - RNA, 20 nt, Human
ggggggagguggacggaggu

SEQ ID NO: 790889 - RNA, 19 nt, Human
ggggugggggcugaagggg

SEQ ID NO: 790890 - RNA, 25 nt, Human
gggugggggcugaagggggguugca

SEQ ID NO: 790891 - RNA, 19 nt, Human
gucaaugaagagcagccag

SEQ ID NO: 790892 - RNA, 18 nt, Human
guggaagggacacaaggu

SEQ ID NO: 790893 - RNA, 19 nt, Human
guuugguugggcaggugcu

SEQ ID NO: 790894 - RNA, 18 nt, Human
guuuucauggggugggug

SEQ ID NO: 790895 - RNA, 21 nt, Human
uaacacaucccaccugcuggc

SEQ ID NO: 790896 - RNA, 23 nt, Human
uaacacaucccaccugcuggcca

SEQ ID NO: 790897 - RNA, 24 nt, Human
uacuggacagcaaugugggguggg

SEQ ID NO: 790898 - RNA, 23 nt, Human
uagcugaggcuggcagccuuugc

SEQ ID NO: 790899 - RNA, 22 nt, Human
uauuaccaacagaagacaauuu

SEQ ID NO: 790900 - RNA, 19 nt, Human
ucacugggaugugcagacu

SEQ ID NO: 790901 - RNA, 21 nt, Human
ucagagccccggccucuccgc

SEQ ID NO: 790902 - RNA, 19 nt, Human
uccaagcuauaagugaaaa

SEQ ID NO: 790903 - RNA, 19 nt, Human
ucccaggucagaacuuuuc

SEQ ID NO: 790904 - RNA, 23 nt, Human
ucccugggggcuuggggguacug

SEQ ID NO: 790905 - RNA, 24 nt, Human
uccuacugcggcauggaaccagga

SEQ ID NO: 790906 - RNA, 20 nt, Human
uccuggaccacaucagacuc

SEQ ID NO: 790907 - RNA, 23 nt, Human
uccuggaccacaucagacucccg

SEQ ID NO: 790908 - RNA, 18 nt, Human
uccuggugcaggccgccu

SEQ ID NO: 790909 - RNA, 22 nt, Human
uccuggugcaggccgccuucuu

SEQ ID NO: 790910 - RNA, 25 nt, Human
ucggggacaacagcaucuuggggcu

SEQ ID NO: 790911 - RNA, 22 nt, Human
ucuccauuccaagacacaggag

SEQ ID NO: 790912 - RNA, 18 nt, Human
ucucugagcccagccucu

SEQ ID NO: 790913 - RNA, 18 nt, Human
ucugaaguuucuggaagg

SEQ ID NO: 790914 - RNA, 19 nt, Human
ucugcuccacuuggcggcg

SEQ ID NO: 790915 - RNA, 22 nt, Human
ucugggcuggagcugcuggagc

SEQ ID NO: 790916 - RNA, 20 nt, Human
ugaaaaaagcagucagaacg

SEQ ID NO: 790917 - RNA, 23 nt, Human
ugaagagcagccagaaagcccca

SEQ ID NO: 790918 - RNA, 21 nt, Human
ugaaguuucuggaaggcguug

SEQ ID NO: 790919 - RNA, 23 nt, Human
ugaggcuggcagccuuugcuggg

SEQ ID NO: 790920 - RNA, 21 nt, Human
ugagucacagaccagaaguuc

SEQ ID NO: 790921 - RNA, 19 nt, Human
ugcagacuugggccugcug

SEQ ID NO: 790922 - RNA, 18 nt, Human
ugcaucacugggaugugc

SEQ ID NO: 790923 - RNA, 21 nt, Human
ugccgaaguggguccuggugc

SEQ ID NO: 790924 - RNA, 24 nt, Human
ugcggcauggaaccaggaucuuaa

SEQ ID NO: 790925 - RNA, 19 nt, Human
ugcucgcgugguggccguc

SEQ ID NO: 790926 - RNA, 19 nt, Human
ugcucugggcuggagcugc

SEQ ID NO: 790927 - RNA, 24 nt, Human
ugcuugcaggcucagugguggugu

SEQ ID NO: 790928 - RNA, 26 nt, Human
uggaggagcagcuccgugggguccuc

SEQ ID NO: 790929 - RNA, 18 nt, Human
uggaugauuggggagcag

SEQ ID NO: 790930 - RNA, 25 nt, Human
uggaugauuggggagcaggugacac

SEQ ID NO: 790931 - RNA, 24 nt, Human
uggcagaaagggccaguuuuuugg

SEQ ID NO: 790932 - RNA, 23 nt, Human
uggcagccuuugcugggugaguc

SEQ ID NO: 790933 - RNA, 23 nt, Human
uggccucuggaucaccaucaccc

SEQ ID NO: 790934 - RNA, 20 nt, Human
ugggggcugaagggggguug

SEQ ID NO: 790935 - RNA, 24 nt, Human
uggggggcacgucucugagcccag

SEQ ID NO: 790936 - RNA, 24 nt, Human
ugggggucuggggggccuuggugg

SEQ ID NO: 790937 - RNA, 22 nt, Human
uggggugggggcugaagggggg

SEQ ID NO: 790938 - RNA, 24 nt, Human
uggggugggggcugaagggggguu

SEQ ID NO: 790939 - RNA, 23 nt, Human
uggggugggugaggucggaggau

SEQ ID NO: 790940 - RNA, 21 nt, Human
uggguccuggugcaggccgcc

SEQ ID NO: 790941 - RNA, 23 nt, Human
uggguccuggugcaggccgccuu

SEQ ID NO: 790942 - RNA, 21 nt, Human
ugguguugcucaggacagggg

SEQ ID NO: 790943 - RNA, 22 nt, Human
ugguugggcaggugcuacgcgg

SEQ ID NO: 790944 - RNA, 22 nt, Human
uguauacaugcuacucguuuac

SEQ ID NO: 790945 - RNA, 23 nt, Human
ugugccaucuuccugccgucuga

SEQ ID NO: 790946 - RNA, 20 nt, Human
ugugccuggcccucccuccu

SEQ ID NO: 790947 - RNA, 22 nt, Human
uguggggugggggcugaagggg

SEQ ID NO: 790948 - RNA, 20 nt, Human
ugugucugccccuccugcag

SEQ ID NO: 790949 - RNA, 22 nt, Human
uucaccaagaccuucugcuccu

SEQ ID NO: 790950 - RNA, 19 nt, Human
uucaccuguggcugugugc

SEQ ID NO: 790951 - RNA, 21 nt, Human
uuccauggccucuggaucacc

SEQ ID NO: 790952 - RNA, 22 nt, Human
uuccucuucucagaggggcucc

SEQ ID NO: 790953 - RNA, 22 nt, Human
uuccuuggagacucuuccaugg

SEQ ID NO: 790954 - RNA, 22 nt, Human
uucuccucuucucucucuuaaa

SEQ ID NO: 790955 - RNA, 19 nt, Human
uucuuccucuuccucuucc

SEQ ID NO: 790956 - RNA, 21 nt, Human
uugccggucgcccuccacagg

SEQ ID NO: 790957 - RNA, 22 nt, Human
uugcucaggacaggggacuuca

SEQ ID NO: 790958 - RNA, 27 nt, Human
uuguaaucaaaaucaauguauacaugc

SEQ ID NO: 790959 - RNA, 18 nt, Human
uuuaauuuucuuuuccuu

SEQ ID NO: 790960 - RNA, 22 nt, Human
aaaaaaacagccgggcgucgug

SEQ ID NO: 790961 - RNA, 19 nt, Human
aaaaagaaaaaagaaauag

SEQ ID NO: 790962 - RNA, 18 nt, Human
aaaaccugcguuacaugc

SEQ ID NO: 790963 - RNA, 21 nt, Human
aaaagacagaggaauuacugg

SEQ ID NO: 790964 - RNA, 25 nt, Human
aaacaaaaacaaccaaauaauuaau

SEQ ID NO: 790965 - RNA, 21 nt, Human
aaacagccgggcgucguggug

SEQ ID NO: 790966 - RNA, 20 nt, Human
aaacaugaaaacaaaaacaa

SEQ ID NO: 790967 - RNA, 24 nt, Human
aaacaugaaaacaaaaacaaccaa

SEQ ID NO: 790968 - RNA, 25 nt, Human
aaacaugaaaacaaaaacaaccaaa

SEQ ID NO: 790969 - RNA, 19 nt, Human
aaacuccaagacguuugug

SEQ ID NO: 790970 - RNA, 24 nt, Human
aaagaaauagaagaaaccaaauua

SEQ ID NO: 790971 - RNA, 19 nt, Human
aaagugcugggauuacagg

SEQ ID NO: 790972 - RNA, 19 nt, Human
aaagugcugggauuacagg

SEQ ID NO: 790973 - RNA, 24 nt, Human
aaagugcugggauuacaggcauga

SEQ ID NO: 790974 - RNA, 23 nt, Human
aaagugcugggauuacaggugca

SEQ ID NO: 790975 - RNA, 18 nt, Human
aaauacaaaaaaacagcc

SEQ ID NO: 790976 - RNA, 19 nt, Human
aaaucuaaacagugaccac

SEQ ID NO: 790977 - RNA, 20 nt, Human
aacacggugaaaccccgucu

SEQ ID NO: 790978 - RNA, 21 nt, Human
aacacggugaaaccccgucuc

SEQ ID NO: 790979 - RNA, 26 nt, Human
aacagccgggcgucguggugggugcc

SEQ ID NO: 790980 - RNA, 21 nt, Human
aacagugaccacacagugucc

SEQ ID NO: 790981 - RNA, 19 nt, Human
aaccuauaagagaaaaacc

SEQ ID NO: 790982 - RNA, 24 nt, Human
aaccucaggugauccgccugccuc

SEQ ID NO: 790983 - RNA, 21 nt, Human
aacuuauuucugcuucuccug

SEQ ID NO: 790984 - RNA, 23 nt, Human
aagaaaaaagaaauagaagaaac

SEQ ID NO: 790985 - RNA, 21 nt, Human
aagaagaaggaauaagaaaga

SEQ ID NO: 790986 - RNA, 21 nt, Human
aagcaaggccuuggcaacaag

SEQ ID NO: 790987 - RNA, 23 nt, Human
aagcaauaguaguaucaaucuug

SEQ ID NO: 790988 - RNA, 24 nt, Human
aagcaugauugauaacaaucuugc

SEQ ID NO: 790989 - RNA, 23 nt, Human
aaguagaagcaaggccuuggcaa

SEQ ID NO: 790990 - RNA, 24 nt, Human
aagugauccuucugccuuggccuc

SEQ ID NO: 790991 - RNA, 25 nt, Human
aagugauccuucugccuuggccucc

SEQ ID NO: 790992 - RNA, 18 nt, Human
aagugcugggaguacagg

SEQ ID NO: 790993 - RNA, 23 nt, Human
aagugcugggaguacagguguga

SEQ ID NO: 790994 - RNA, 18 nt, Human
aagugcugggauuacagg

SEQ ID NO: 790995 - RNA, 19 nt, Human
aagugcugggauuacaggc

SEQ ID NO: 790996 - RNA, 21 nt, Human
aagugcugggauuacaggcau

SEQ ID NO: 790997 - RNA, 19 nt, Human
aagugcugggauuacaggu

SEQ ID NO: 790998 - RNA, 26 nt, Human
aagugcugggauuacaggugcaagcc

SEQ ID NO: 790999 - RNA, 22 nt, Human
aaguggcugggauuacaggcau

SEQ ID NO: 791000 - RNA, 21 nt, Human
aauaaacccccaaacucuccc

SEQ ID NO: 791001 - RNA, 19 nt, Human
aaucauaguucacugcagc

SEQ ID NO: 791002 - RNA, 20 nt, Human
aaucucuaccaguggcccac

SEQ ID NO: 791003 - RNA, 24 nt, Human
aauuuuguauuuuuaguagagaug

SEQ ID NO: 791004 - RNA, 21 nt, Human
acacaaucuuauuuugaagcc

SEQ ID NO: 791005 - RNA, 22 nt, Human
acacugcucucaguuauaaccu

SEQ ID NO: 791006 - RNA, 23 nt, Human
acagagcgagacucugucucaaa

SEQ ID NO: 791007 - RNA, 24 nt, Human
acagagcgagacucugucucaaaa

SEQ ID NO: 791008 - RNA, 24 nt, Human
acagagucucccucagucacccag

SEQ ID NO: 791009 - RNA, 24 nt, Human
acaggccgggcgcgguggcucacg

SEQ ID NO: 791010 - RNA, 21 nt, Human
acauagauuuaaacagaccca

SEQ ID NO: 791011 - RNA, 21 nt, Human
acauugaaaaccuuauuauca

SEQ ID NO: 791012 - RNA, 23 nt, Human
accauguuggucaggcuggucuc

SEQ ID NO: 791013 - RNA, 24 nt, Human
accccgucucuccuaaaaauacaa

SEQ ID NO: 791014 - RNA, 18 nt, Human
accuuuuauuuauuuauu

SEQ ID NO: 791015 - RNA, 21 nt, Human
acgggguuucaccauguuggu

SEQ ID NO: 791016 - RNA, 23 nt, Human
acgggguuucaccauguugguca

SEQ ID NO: 791017 - RNA, 24 nt, Human
acgggguuucaccauguuggucag

SEQ ID NO: 791018 - RNA, 22 nt, Human
agaaaaaccugcguuacaugcu

SEQ ID NO: 791019 - RNA, 24 nt, Human
agaaaagaaugugguucaucuuuu

SEQ ID NO: 791020 - RNA, 18 nt, Human
agaaaagagaaccaaacc

SEQ ID NO: 791021 - RNA, 18 nt, Human
agaacauuuugacucuga

SEQ ID NO: 791022 - RNA, 20 nt, Human
agacaaccucaucuaccaaa

SEQ ID NO: 791023 - RNA, 18 nt, Human
agacagagucucccucag

SEQ ID NO: 791024 - RNA, 18 nt, Human
agacagagucuugcuaug

SEQ ID NO: 791025 - RNA, 24 nt, Human
agccugggcgacagagcgagacuc

SEQ ID NO: 791026 - RNA, 24 nt, Human
aggcaggaggauggcgugaacccg

SEQ ID NO: 791027 - RNA, 24 nt, Human
aggcggagcuuacagugagccgag

SEQ ID NO: 791028 - RNA, 24 nt, Human
aggcggguggaucacgacgucagg

SEQ ID NO: 791029 - RNA, 20 nt, Human
aggcuaccagcagaaagaga

SEQ ID NO: 791030 - RNA, 19 nt, Human
aggcugaggcaggaggaug

SEQ ID NO: 791031 - RNA, 25 nt, Human
aggcuggagugcaguggcgcaaucu

SEQ ID NO: 791032 - RNA, 24 nt, Human
aggugauccgccugccucggccuc

SEQ ID NO: 791033 - RNA, 18 nt, Human
aggugugagucaucguac

SEQ ID NO: 791034 - RNA, 20 nt, Human
aguaaguaaagaagaaggaa

SEQ ID NO: 791035 - RNA, 22 nt, Human
aguagucacagcccacgguaug

SEQ ID NO: 791036 - RNA, 24 nt, Human
agugcaauggcacaaucucggcuc

SEQ ID NO: 791037 - RNA, 24 nt, Human
agugcacuccagccugggcgacag

SEQ ID NO: 791038 - RNA, 21 nt, Human
agugcagugaugcaaucauag

SEQ ID NO: 791039 - RNA, 23 nt, Human
agugcagugaugcaaucauaguu

SEQ ID NO: 791040 - RNA, 20 nt, Human
agugcaguggcgcaaucucg

SEQ ID NO: 791041 - RNA, 24 nt, Human
agugcaguggcgcaaucucgguuc

SEQ ID NO: 791042 - RNA, 20 nt, Human
agugcugggaguacaggugu

SEQ ID NO: 791043 - RNA, 18 nt, Human
agugcugggauuacaggc

SEQ ID NO: 791044 - RNA, 23 nt, Human
aguggcugggauuacaggcaugc

SEQ ID NO: 791045 - RNA, 18 nt, Human
auaaaacaagauuuggau

SEQ ID NO: 791046 - RNA, 24 nt, Human
auaauuuuguauuuuuaguagaga

SEQ ID NO: 791047 - RNA, 18 nt, Human
auagagauggggucuugc

SEQ ID NO: 791048 - RNA, 18 nt, Human
auaguucacugcagccuu

SEQ ID NO: 791049 - RNA, 24 nt, Human
aucgcgccagugcacuccagccug

SEQ ID NO: 791050 - RNA, 20 nt, Human
auggauuaacaaauaacacu

SEQ ID NO: 791051 - RNA, 23 nt, Human
auggguuucuccauguuggucag

SEQ ID NO: 791052 - RNA, 19 nt, Human
auuacaggugcaagccacu

SEQ ID NO: 791053 - RNA, 20 nt, Human
caaaacugggggcucacagc

SEQ ID NO: 791054 - RNA, 21 nt, Human
caaacaugaaaacaaaaacaa

SEQ ID NO: 791055 - RNA, 24 nt, Human
caaacaugaaaacaaaaacaacca

SEQ ID NO: 791056 - RNA, 18 nt, Human
caaacuccugaccucagc

SEQ ID NO: 791057 - RNA, 24 nt, Human
caaagugcugggauuacaggugca

SEQ ID NO: 791058 - RNA, 23 nt, Human
caagauaacucaucacaugguuc

SEQ ID NO: 791059 - RNA, 22 nt, Human
caagcaauucucuugccuuagc

SEQ ID NO: 791060 - RNA, 22 nt, Human
caagcgauucuccugccucagc

SEQ ID NO: 791061 - RNA, 27 nt, Human
caagcgauucuccugccucagccuccc

SEQ ID NO: 791062 - RNA, 22 nt, Human
caagugauccuucugccuuggc

SEQ ID NO: 791063 - RNA, 19 nt, Human
caauaaacccccaaacucu

SEQ ID NO: 791064 - RNA, 26 nt, Human
caaucauuaaaggaaaaaagaacccc

SEQ ID NO: 791065 - RNA, 24 nt, Human
cacacugcucucaguuauaaccuu

SEQ ID NO: 791066 - RNA, 21 nt, Human
caccauguuggucaggcuggu

SEQ ID NO: 791067 - RNA, 24 nt, Human
caccauguuggucaggcuggucuc

SEQ ID NO: 791068 - RNA, 24 nt, Human
cacccaggcuggagugcaguggcg

SEQ ID NO: 791069 - RNA, 24 nt, Human
caccucagcuuccugaagugcugg

SEQ ID NO: 791070 - RNA, 22 nt, Human
cacgccuguaaucccagcacug

SEQ ID NO: 791071 - RNA, 24 nt, Human
cacuccagccugggcgacagagcg

SEQ ID NO: 791072 - RNA, 21 nt, Human
cacugcaaccuccgccuccca

SEQ ID NO: 791073 - RNA, 23 nt, Human
cacugcaaccucugccucacggg

SEQ ID NO: 791074 - RNA, 23 nt, Human
cagagucucccucagucacccag

SEQ ID NO: 791075 - RNA, 24 nt, Human
cagagucuugcuauguugcccagg

SEQ ID NO: 791076 - RNA, 24 nt, Human
cagcacuguggggggccgaggcgg

SEQ ID NO: 791077 - RNA, 22 nt, Human
cagcagaaagagaggacuucaa

SEQ ID NO: 791078 - RNA, 23 nt, Human
cagcauaaaguaaaaagacucuu

SEQ ID NO: 791079 - RNA, 18 nt, Human
cagccuaacagugccuuu

SEQ ID NO: 791080 - RNA, 24 nt, Human
cagcuacuugggaggcugaggcag

SEQ ID NO: 791081 - RNA, 19 nt, Human
cagcugauccacccaccuc

SEQ ID NO: 791082 - RNA, 22 nt, Human
caggugauccgccugccucggc

SEQ ID NO: 791083 - RNA, 19 nt, Human
cagugcacuccagccuggg

SEQ ID NO: 791084 - RNA, 22 nt, Human
cagugcacuccagccugggcga

SEQ ID NO: 791085 - RNA, 23 nt, Human
cagugcacuccagccugggcgac

SEQ ID NO: 791086 - RNA, 24 nt, Human
cagugcacuccagccugggcgaca

SEQ ID NO: 791087 - RNA, 23 nt, Human
cauacaaaguggugugugcacau

SEQ ID NO: 791088 - RNA, 21 nt, Human
ccaaagugcugggauuacagg

SEQ ID NO: 791089 - RNA, 21 nt, Human
ccaaagugcugggauuacagg

SEQ ID NO: 791090 - RNA, 23 nt, Human
ccaaagugcugggauuacaggca

SEQ ID NO: 791091 - RNA, 24 nt, Human
ccaaagugcugggauuacaggcau

SEQ ID NO: 791092 - RNA, 22 nt, Human
ccaaagugcugggauuacaggu

SEQ ID NO: 791093 - RNA, 23 nt, Human
ccaaguggcugggauuacaggca

SEQ ID NO: 791094 - RNA, 24 nt, Human
ccaaguggcugggauuacaggcau

SEQ ID NO: 791095 - RNA, 19 nt, Human
ccaccaugcucagccuaac

SEQ ID NO: 791096 - RNA, 20 nt, Human
ccaccucagcuuccugaagg

SEQ ID NO: 791097 - RNA, 18 nt, Human
ccaguagucccagcuacu

SEQ ID NO: 791098 - RNA, 21 nt, Human
ccaguagucccagcuacuugg

SEQ ID NO: 791099 - RNA, 22 nt, Human
ccaguagucccagcuacuuggg

SEQ ID NO: 791100 - RNA, 21 nt, Human
ccagugcacuccagccugggc

SEQ ID NO: 791101 - RNA, 22 nt, Human
ccagugcacuccagccugggcg

SEQ ID NO: 791102 - RNA, 23 nt, Human
ccagugcacuccagccugggcga

SEQ ID NO: 791103 - RNA, 24 nt, Human
ccagugcacuccagccugggcgac

SEQ ID NO: 791104 - RNA, 19 nt, Human
ccauguuggucagguuggu

SEQ ID NO: 791105 - RNA, 22 nt, Human
ccauuuccuccuuccuccaaaa

SEQ ID NO: 791106 - RNA, 22 nt, Human
cccaaacucucccuucuauuuc

SEQ ID NO: 791107 - RNA, 24 nt, Human
cccaaagugcugggauuacaggca

SEQ ID NO: 791108 - RNA, 20 nt, Human
cccaaccucaggugauccgc

SEQ ID NO: 791109 - RNA, 24 nt, Human
cccaaccucaggugauccgccugc

SEQ ID NO: 791110 - RNA, 23 nt, Human
cccaaguggcugggauuacaggc

SEQ ID NO: 791111 - RNA, 24 nt, Human
cccaaguggcugggauuacaggca

SEQ ID NO: 791112 - RNA, 20 nt, Human
cccaggcugcagugcaguga

SEQ ID NO: 791113 - RNA, 23 nt, Human
cccagguucaagcgauucuccug

SEQ ID NO: 791114 - RNA, 24 nt, Human
cccucagucacccaggcuggagug

SEQ ID NO: 791115 - RNA, 24 nt, Human
ccucacggguucaagcaauucucu

SEQ ID NO: 791116 - RNA, 21 nt, Human
ccucagcuuccugaagugcug

SEQ ID NO: 791117 - RNA, 19 nt, Human
ccucagucacccaggcugg

SEQ ID NO: 791118 - RNA, 21 nt, Human
ccuccaaaacugggggcucac

SEQ ID NO: 791119 - RNA, 24 nt, Human
ccucccagguucaagcgauucucc

SEQ ID NO: 791120 - RNA, 24 nt, Human
ccuccugccucagucucuugagua

SEQ ID NO: 791121 - RNA, 25 nt, Human
ccugaagugcugggaguacaggugu

SEQ ID NO: 791122 - RNA, 24 nt, Human
ccugaccucagcugauccacccac

SEQ ID NO: 791123 - RNA, 24 nt, Human
ccugccucagccucccaaguggcu

SEQ ID NO: 791124 - RNA, 24 nt, Human
ccugccucagucucuugaguagcu

SEQ ID NO: 791125 - RNA, 23 nt, Human
ccuggcuaacacggugaaacccc

SEQ ID NO: 791126 - RNA, 24 nt, Human
ccuggcuaacacggugaaaccccg

SEQ ID NO: 791127 - RNA, 22 nt, Human
ccugggcgacagagcgagacuc

SEQ ID NO: 791128 - RNA, 18 nt, Human
ccuggguucaagugaucc

SEQ ID NO: 791129 - RNA, 19 nt, Human
ccuggguucaagugauccu

SEQ ID NO: 791130 - RNA, 20 nt, Human
ccuggguucaagugauccuu

SEQ ID NO: 791131 - RNA, 22 nt, Human
ccuggguucaagugauccuucu

SEQ ID NO: 791132 - RNA, 21 nt, Human
ccuguaaucccagcacugugg

SEQ ID NO: 791133 - RNA, 24 nt, Human
cgagaccauccuggcuaacacggu

SEQ ID NO: 791134 - RNA, 22 nt, Human
cgaggcggguggaucacgacgu

SEQ ID NO: 791135 - RNA, 21 nt, Human
cgaguaggugggaucauaggc

SEQ ID NO: 791136 - RNA, 23 nt, Human
cgccuguaaucccagcacugugg

SEQ ID NO: 791137 - RNA, 24 nt, Human
cgccuguaaucccagcacuguggg

SEQ ID NO: 791138 - RNA, 26 nt, Human
cgcgccagugcacuccagccugggcg

SEQ ID NO: 791139 - RNA, 22 nt, Human
cggguggaucacgacgucagga

SEQ ID NO: 791140 - RNA, 18 nt, Human
cggguucaagcaauucuc

SEQ ID NO: 791141 - RNA, 24 nt, Human
cgugauccuccugccucagucucu

SEQ ID NO: 791142 - RNA, 21 nt, Human
cuaccuacauacuccacuccu

SEQ ID NO: 791143 - RNA, 18 nt, Human
cuauucuugaacuccugg

SEQ ID NO: 791144 - RNA, 22 nt, Human
cucacgccuguaaucccagcac

SEQ ID NO: 791145 - RNA, 23 nt, Human
cucacgccuguaaucccagcacu

SEQ ID NO: 791146 - RNA, 24 nt, Human
cucacugcaaccuccgccucccag

SEQ ID NO: 791147 - RNA, 24 nt, Human
cucagccucccaaguggcugggau

SEQ ID NO: 791148 - RNA, 18 nt, Human
cucagucacccaggcugg

SEQ ID NO: 791149 - RNA, 24 nt, Human
cuccauguuggucagguuggucuc

SEQ ID NO: 791150 - RNA, 22 nt, Human
cuccuccaauaaacccccaaac

SEQ ID NO: 791151 - RNA, 19 nt, Human
cucugucucaaaaaaaaaa

SEQ ID NO: 791152 - RNA, 18 nt, Human
cucuuguugcccagguug

SEQ ID NO: 791153 - RNA, 24 nt, Human
cugaagugcugggaguacaggugu

SEQ ID NO: 791154 - RNA, 18 nt, Human
cugagaaucuuuucuuuu

SEQ ID NO: 791155 - RNA, 23 nt, Human
cugauccacccaccucagcuucc

SEQ ID NO: 791156 - RNA, 23 nt, Human
cugcaaccuccgccucccagguu

SEQ ID NO: 791157 - RNA, 24 nt, Human
cugcaaccuccgccucccagguuc

SEQ ID NO: 791158 - RNA, 24 nt, Human
cugcaaccucugccucacggguuc

SEQ ID NO: 791159 - RNA, 23 nt, Human
cugcagccuugaauuccugggcu

SEQ ID NO: 791160 - RNA, 23 nt, Human
cugccucggccucccaaagugcu

SEQ ID NO: 791161 - RNA, 20 nt, Human
cugugcccucccccaccaag

SEQ ID NO: 791162 - RNA, 24 nt, Human
cuuauuaucacaugucaacuuauu

SEQ ID NO: 791163 - RNA, 20 nt, Human
cuugaacuccuggguucaag

SEQ ID NO: 791164 - RNA, 24 nt, Human
cuugccuuagccucccgaguaggu

SEQ ID NO: 791165 - RNA, 24 nt, Human
cuuguugcccagguuggagugcaa

SEQ ID NO: 791166 - RNA, 23 nt, Human
cuuuuauuuauuuauuuauuuug

SEQ ID NO: 791167 - RNA, 19 nt, Human
gaagugcugggaguacagg

SEQ ID NO: 791168 - RNA, 21 nt, Human
gaccucagcugauccacccac

SEQ ID NO: 791169 - RNA, 24 nt, Human
gaccucagcugauccacccaccuc

SEQ ID NO: 791170 - RNA, 23 nt, Human
gagaucgcgccagugcacuccag

SEQ ID NO: 791171 - RNA, 23 nt, Human
gagauggguuucuccauguuggu

SEQ ID NO: 791172 - RNA, 23 nt, Human
gaggcggguggaucacgacguca

SEQ ID NO: 791173 - RNA, 18 nt, Human
gauuacaggcaugagcca

SEQ ID NO: 791174 - RNA, 21 nt, Human
gauuacaggcaugagccacca

SEQ ID NO: 791175 - RNA, 24 nt, Human
gauuacaggcaugagccaccaugc

SEQ ID NO: 791176 - RNA, 18 nt, Human
gauuacaggcaugcgcca

SEQ ID NO: 791177 - RNA, 18 nt, Human
gauuacaggugcaagcca

SEQ ID NO: 791178 - RNA, 21 nt, Human
gauuacaggugcaagccacug

SEQ ID NO: 791179 - RNA, 24 nt, Human
gauuacaggugcaagccacugugc

SEQ ID NO: 791180 - RNA, 21 nt, Human
gauucuccugccucagccucc

SEQ ID NO: 791181 - RNA, 19 nt, Human
gcaaaucuaaacagugacc

SEQ ID NO: 791182 - RNA, 27 nt, Human
gcaaauucagguaaccauaucaaacca

SEQ ID NO: 791183 - RNA, 24 nt, Human
gcacuccagccugggcgacagagc

SEQ ID NO: 791184 - RNA, 22 nt, Human
gccagugcacuccagccugggc

SEQ ID NO: 791185 - RNA, 19 nt, Human
gcccagguuggagugcaau

SEQ ID NO: 791186 - RNA, 24 nt, Human
gccucagccucccaaguggcuggg

SEQ ID NO: 791187 - RNA, 18 nt, Human
gccucagucucuugagua

SEQ ID NO: 791188 - RNA, 22 nt, Human
gccuuggccucccaaagugcug

SEQ ID NO: 791189 - RNA, 24 nt, Human
gcgacagagcgagacucugucuca

SEQ ID NO: 791190 - RNA, 24 nt, Human
gcgauucuccugccucagccuccc

SEQ ID NO: 791191 - RNA, 19 nt, Human
gcgcuuucccccaaauccu

SEQ ID NO: 791192 - RNA, 24 nt, Human
gcuaacacggugaaaccccgucuc

SEQ ID NO: 791193 - RNA, 24 nt, Human
gcuacauugaaaaccuuauuauca

SEQ ID NO: 791194 - RNA, 19 nt, Human
gcuggagugcaguggcgca

SEQ ID NO: 791195 - RNA, 23 nt, Human
gcuggucucaaacuccugaccuc

SEQ ID NO: 791196 - RNA, 20 nt, Human
ggaacaggccgggcgcggug

SEQ ID NO: 791197 - RNA, 24 nt, Human
ggagcuuacagugagccgagaucg

SEQ ID NO: 791198 - RNA, 21 nt, Human
ggaggcggagcuuacagugag

SEQ ID NO: 791199 - RNA, 24 nt, Human
ggauuacaggcaugagccaccaug

SEQ ID NO: 791200 - RNA, 19 nt, Human
ggauuacaggcaugcgcca

SEQ ID NO: 791201 - RNA, 22 nt, Human
ggauuacaggugcaagccacug

SEQ ID NO: 791202 - RNA, 24 nt, Human
ggauuacaggugcaagccacugug

SEQ ID NO: 791203 - RNA, 23 nt, Human
ggcgcgguggcucacgccuguaa

SEQ ID NO: 791204 - RNA, 24 nt, Human
ggcuggucucaaacuccugaccuc

SEQ ID NO: 791205 - RNA, 21 nt, Human
gggccgaggcggguggaucac

SEQ ID NO: 791206 - RNA, 22 nt, Human
gggcgucguggugggugccagu

SEQ ID NO: 791207 - RNA, 22 nt, Human
gggcucacgugauccuccugcc

SEQ ID NO: 791208 - RNA, 23 nt, Human
gggguuucaccauguuggucagg

SEQ ID NO: 791209 - RNA, 21 nt, Human
ggguucaagugauccuucugc

SEQ ID NO: 791210 - RNA, 22 nt, Human
ggguuucaccauguuggucagg

SEQ ID NO: 791211 - RNA, 21 nt, Human
ggguuucuccauguuggucag

SEQ ID NO: 791212 - RNA, 23 nt, Human
gguggcucacgccuguaauccca

SEQ ID NO: 791213 - RNA, 24 nt, Human
gguggcucacgccuguaaucccag

SEQ ID NO: 791214 - RNA, 20 nt, Human
gucacccaggcuggagugca

SEQ ID NO: 791215 - RNA, 21 nt, Human
gucucaaaaaaaaaaaaaaag

SEQ ID NO: 791216 - RNA, 25 nt, Human
gugaggcaucaggaagccagcaaag

SEQ ID NO: 791217 - RNA, 18 nt, Human
gugauccuccugccucag

SEQ ID NO: 791218 - RNA, 21 nt, Human
gugcugggauuacaggugcaa

SEQ ID NO: 791219 - RNA, 23 nt, Human
guggcucacgccuguaaucccag

SEQ ID NO: 791220 - RNA, 25 nt, Human
uaaaagagcuuuccaugugacuacc

SEQ ID NO: 791221 - RNA, 22 nt, Human
uaaaauaaaugcccagauacua

SEQ ID NO: 791222 - RNA, 22 nt, Human
uaaagacgggguuucaccaugu

SEQ ID NO: 791223 - RNA, 22 nt, Human
uaaaggaaaaaagaacccaaga

SEQ ID NO: 791224 - RNA, 24 nt, Human
uaaaguccuuguaaaacuucuugg

SEQ ID NO: 791225 - RNA, 26 nt, Human
uaaauggauuaacaaauaacacugaa

SEQ ID NO: 791226 - RNA, 18 nt, Human
uaacacggugaaaccccg

SEQ ID NO: 791227 - RNA, 22 nt, Human
uaacacggugaaaccccgucuc

SEQ ID NO: 791228 - RNA, 24 nt, Human
uaacacggugaaaccccgucucuc

SEQ ID NO: 791229 - RNA, 20 nt, Human
uaagaacauuuugacucuga

SEQ ID NO: 791230 - RNA, 24 nt, Human
uaauaaagacgggguuucaccaug

SEQ ID NO: 791231 - RNA, 22 nt, Human
uacacugaacaguacaacucau

SEQ ID NO: 791232 - RNA, 18 nt, Human
uacaggcaugagccacca

SEQ ID NO: 791233 - RNA, 22 nt, Human
uacaggugcaagccacugugcc

SEQ ID NO: 791234 - RNA, 19 nt, Human
uaccaaggcuaacuaugcu

SEQ ID NO: 791235 - RNA, 18 nt, Human
uaccagcagaaagagagg

SEQ ID NO: 791236 - RNA, 22 nt, Human
uagagauggggucuugcuaugu

SEQ ID NO: 791237 - RNA, 22 nt, Human
uagaugaagaguaaaagacuua

SEQ ID NO: 791238 - RNA, 21 nt, Human
uaggcgcgugccaccaugacc

SEQ ID NO: 791239 - RNA, 23 nt, Human
uaguagagauggguuucuccaug

SEQ ID NO: 791240 - RNA, 24 nt, Human
uaguucacugcagccuugaauucc

SEQ ID NO: 791241 - RNA, 23 nt, Human
uaguuuugcucuucaauggcuuu

SEQ ID NO: 791242 - RNA, 22 nt, Human
uauaacuccuacuaccuacaua

SEQ ID NO: 791243 - RNA, 19 nt, Human
uauacuccacuuauauaug

SEQ ID NO: 791244 - RNA, 23 nt, Human
uauagagauggggucuugcuaug

SEQ ID NO: 791245 - RNA, 24 nt, Human
uauagagauggggucuugcuaugu

SEQ ID NO: 791246 - RNA, 20 nt, Human
uauguugcccaggcuauucu

SEQ ID NO: 791247 - RNA, 23 nt, Human
uauguugcccaggcuauucuuga

SEQ ID NO: 791248 - RNA, 24 nt, Human
uauguugcccaggcuauucuugaa

SEQ ID NO: 791249 - RNA, 19 nt, Human
uauguugcccaggcugcag

SEQ ID NO: 791250 - RNA, 24 nt, Human
uauguugcccaggcugcagugcag

SEQ ID NO: 791251 - RNA, 19 nt, Human
ucaaaaaaaaaaaaaaaga

SEQ ID NO: 791252 - RNA, 23 nt, Human
ucaacugucuacguuuauacuca

SEQ ID NO: 791253 - RNA, 18 nt, Human
ucaagcccgaguuguaag

SEQ ID NO: 791254 - RNA, 19 nt, Human
ucaagugauccuucugccu

SEQ ID NO: 791255 - RNA, 20 nt, Human
ucaaugccagaaucugugcu

SEQ ID NO: 791256 - RNA, 22 nt, Human
ucacaugucaacuuauuuugaa

SEQ ID NO: 791257 - RNA, 24 nt, Human
ucacccaggcuggagugcaguggc

SEQ ID NO: 791258 - RNA, 24 nt, Human
ucacgacgucaggagaucgagacc

SEQ ID NO: 791259 - RNA, 24 nt, Human
ucacggguucaagcaauucucuug

SEQ ID NO: 791260 - RNA, 22 nt, Human
ucacucuuguugcccagguugg

SEQ ID NO: 791261 - RNA, 23 nt, Human
ucacucuuguugcccagguugga

SEQ ID NO: 791262 - RNA, 19 nt, Human
ucacugcaaccuccgccuc

SEQ ID NO: 791263 - RNA, 24 nt, Human
ucacugcaaccuccgccucccagg

SEQ ID NO: 791264 - RNA, 25 nt, Human
ucacugcaaccuccgccucccaggu

SEQ ID NO: 791265 - RNA, 27 nt, Human
ucacugcaaccuccgccucccagguuc

SEQ ID NO: 791266 - RNA, 23 nt, Human
ucacugcaaccucugccucacgg

SEQ ID NO: 791267 - RNA, 23 nt, Human
ucacugcaaccucugccucacgg

SEQ ID NO: 791268 - RNA, 24 nt, Human
ucacugcaaccucugccucacggg

SEQ ID NO: 791269 - RNA, 20 nt, Human
ucacugcagccuugaauucc

SEQ ID NO: 791270 - RNA, 23 nt, Human
ucacugcagccuugaauuccugg

SEQ ID NO: 791271 - RNA, 24 nt, Human
ucacugcagccuugaauuccuggg

SEQ ID NO: 791272 - RNA, 22 nt, Human
ucagagagaggaacaauccauu

SEQ ID NO: 791273 - RNA, 18 nt, Human
ucagcugauccacccacc

SEQ ID NO: 791274 - RNA, 21 nt, Human
ucaggugauccgccugccucg

SEQ ID NO: 791275 - RNA, 23 nt, Human
ucauuuucaccagacaaccucau

SEQ ID NO: 791276 - RNA, 23 nt, Human
uccagccugggcgacagagcgag

SEQ ID NO: 791277 - RNA, 24 nt, Human
uccagccugggcgacagagcgaga

SEQ ID NO: 791278 - RNA, 24 nt, Human
uccauguuggucagguuggucucg

SEQ ID NO: 791279 - RNA, 23 nt, Human
ucccaaagugcugggauuacagg

SEQ ID NO: 791280 - RNA, 24 nt, Human
ucccaaagugcugggauuacaggc

SEQ ID NO: 791281 - RNA, 24 nt, Human
ucccaaguggcugggauuacaggc

SEQ ID NO: 791282 - RNA, 21 nt, Human
ucccagguucaagcgauucuc

SEQ ID NO: 791283 - RNA, 24 nt, Human
ucccagguucaagcgauucuccug

SEQ ID NO: 791284 - RNA, 24 nt, Human
ucccucagucacccaggcuggagu

SEQ ID NO: 791285 - RNA, 22 nt, Human
uccuccaauaaacccccaaacu

SEQ ID NO: 791286 - RNA, 24 nt, Human
uccugaagugcugggaguacaggu

SEQ ID NO: 791287 - RNA, 24 nt, Human
uccugggcucacgugauccuccug

SEQ ID NO: 791288 - RNA, 18 nt, Human
uccuggguucaagugauc

SEQ ID NO: 791289 - RNA, 21 nt, Human
uccuggguucaagugauccuu

SEQ ID NO: 791290 - RNA, 24 nt, Human
uccuggguucaagugauccuucug

SEQ ID NO: 791291 - RNA, 23 nt, Human
ucgcgccagugcacuccagccug

SEQ ID NO: 791292 - RNA, 18 nt, Human
ucggccucccaaagugcu

SEQ ID NO: 791293 - RNA, 19 nt, Human
ucuacaaagugacagaaau

SEQ ID NO: 791294 - RNA, 21 nt, Human
ucuccauguuggucagguugg

SEQ ID NO: 791295 - RNA, 24 nt, Human
ucucccucagucacccaggcugga

SEQ ID NO: 791296 - RNA, 26 nt, Human
ucuccugccucagccucccaaguggc

SEQ ID NO: 791297 - RNA, 21 nt, Human
ucucucugggguuaaaaaaaa

SEQ ID NO: 791298 - RNA, 19 nt, Human
ucugagaaucuuuucuuuu

SEQ ID NO: 791299 - RNA, 24 nt, Human
ucugccuuggccucccaaagugcu

SEQ ID NO: 791300 - RNA, 23 nt, Human
ucugucucaaaaaaaaaaaaaaa

SEQ ID NO: 791301 - RNA, 23 nt, Human
ucuugaacuccuggguucaagug

SEQ ID NO: 791302 - RNA, 24 nt, Human
ucuugaguagcuuggaugacaggc

SEQ ID NO: 791303 - RNA, 18 nt, Human
ucuugcuauguugcccag

SEQ ID NO: 791304 - RNA, 18 nt, Human
ucuugcuauguugcccag

SEQ ID NO: 791305 - RNA, 19 nt, Human
ucuugcuauguugcccagg

SEQ ID NO: 791306 - RNA, 19 nt, Human
ucuugcuauguugcccagg

SEQ ID NO: 791307 - RNA, 22 nt, Human
ucuuguugcccagguuggagug

SEQ ID NO: 791308 - RNA, 20 nt, Human
ugaaaacaaaaacaaccaaa

SEQ ID NO: 791309 - RNA, 21 nt, Human
ugaaaacaaaaacaaccaaau

SEQ ID NO: 791310 - RNA, 25 nt, Human
ugaaaaccuuauuaucacaugucaa

SEQ ID NO: 791311 - RNA, 23 nt, Human
ugaaaccccgucucuccuaaaaa

SEQ ID NO: 791312 - RNA, 25 nt, Human
ugaacuccuggguucaagugauccu

SEQ ID NO: 791313 - RNA, 19 nt, Human
ugagacagagucucccuca

SEQ ID NO: 791314 - RNA, 22 nt, Human
ugagacagagucuugcuauguu

SEQ ID NO: 791315 - RNA, 24 nt, Human
ugaggcaggaggauggcgugaacc

SEQ ID NO: 791316 - RNA, 25 nt, Human
ugaggcaggaggauggcgugaaccc

SEQ ID NO: 791317 - RNA, 19 nt, Human
ugaucagauuacuccagcu

SEQ ID NO: 791318 - RNA, 22 nt, Human
ugauccacccaccucagcuucc

SEQ ID NO: 791319 - RNA, 23 nt, Human
ugcaguggcgcaaucucgguuca

SEQ ID NO: 791320 - RNA, 20 nt, Human
ugcauauaacuccuacuacc

SEQ ID NO: 791321 - RNA, 24 nt, Human
ugcaucauuuucaccagacaaccu

SEQ ID NO: 791322 - RNA, 24 nt, Human
ugccaguagucccagcuacuuggg

SEQ ID NO: 791323 - RNA, 24 nt, Human
ugcccaggcuauucuugaacuccu

SEQ ID NO: 791324 - RNA, 24 nt, Human
ugcccaggcugcagugcagugaug

SEQ ID NO: 791325 - RNA, 18 nt, Human
ugcccagguuggagugca

SEQ ID NO: 791326 - RNA, 21 nt, Human
ugcccagguuggagugcaaug

SEQ ID NO: 791327 - RNA, 21 nt, Human
ugcccucccccaccaaguuca

SEQ ID NO: 791328 - RNA, 19 nt, Human
ugccuauugaauugauggu

SEQ ID NO: 791329 - RNA, 24 nt, Human
ugccucagccucccaaguggcugg

SEQ ID NO: 791330 - RNA, 21 nt, Human
ugccucggccucccaaagugc

SEQ ID NO: 791331 - RNA, 24 nt, Human
ugccucggccucccaaagugcugg

SEQ ID NO: 791332 - RNA, 20 nt, Human
ugccuuagccucccgaguag

SEQ ID NO: 791333 - RNA, 24 nt, Human
ugcuauguugcccaggcuauucuu

SEQ ID NO: 791334 - RNA, 25 nt, Human
ugcuauguugcccaggcuauucuug

SEQ ID NO: 791335 - RNA, 31 nt, Human
ugcuauguugcccaggcuauucuugaacucc

SEQ ID NO: 791336 - RNA, 20 nt, Human
ugcuauguugcccaggcugc

SEQ ID NO: 791337 - RNA, 24 nt, Human
ugcuauguugcccaggcugcagug

SEQ ID NO: 791338 - RNA, 24 nt, Human
ugcugggauuacaggugcaagcca

SEQ ID NO: 791339 - RNA, 21 nt, Human
uggaagaauaccacuugggua

SEQ ID NO: 791340 - RNA, 19 nt, Human
uggaauuccucaaauagac

SEQ ID NO: 791341 - RNA, 23 nt, Human
uggagugcaauggcacaaucucg

SEQ ID NO: 791342 - RNA, 24 nt, Human
uggagugcaauggcacaaucucgg

SEQ ID NO: 791343 - RNA, 23 nt, Human
uggagugcaguggcgcaaucucg

SEQ ID NO: 791344 - RNA, 24 nt, Human
uggagugcaguggcgcaaucucgg

SEQ ID NO: 791345 - RNA, 24 nt, Human
uggcacaaucucggcucacugcaa

SEQ ID NO: 791346 - RNA, 22 nt, Human
uggccaacuuuuuuuuuuuuuu

SEQ ID NO: 791347 - RNA, 23 nt, Human
uggccaacuuuuuuuuuuuuuuu

SEQ ID NO: 791348 - RNA, 21 nt, Human
uggcuaauuuuuuguauuuaa

SEQ ID NO: 791349 - RNA, 24 nt, Human
uggcucacgccuguaaucccagca

SEQ ID NO: 791350 - RNA, 20 nt, Human
ugggaggcugaggcaggagg

SEQ ID NO: 791351 - RNA, 22 nt, Human
ugggaggcugaggcaggaggau

SEQ ID NO: 791352 - RNA, 22 nt, Human
ugggaguacaggugugagucau

SEQ ID NO: 791353 - RNA, 21 nt, Human
ugggaucauaggcgcgugcca

SEQ ID NO: 791354 - RNA, 22 nt, Human
ugggaucauaggcgcgugccac

SEQ ID NO: 791355 - RNA, 24 nt, Human
ugggaucauaggcgcgugccacca

SEQ ID NO: 791356 - RNA, 25 nt, Human
ugggaucauaggcgcgugccaccau

SEQ ID NO: 791357 - RNA, 18 nt, Human
ugggauuacaggcaugag

SEQ ID NO: 791358 - RNA, 22 nt, Human
ugggauuacaggcaugagccac

SEQ ID NO: 791359 - RNA, 23 nt, Human
ugggauuacaggcaugagccacc

SEQ ID NO: 791360 - RNA, 24 nt, Human
ugggauuacaggcaugagccacca

SEQ ID NO: 791361 - RNA, 25 nt, Human
ugggauuacaggcaugagccaccau

SEQ ID NO: 791362 - RNA, 18 nt, Human
ugggauuacaggcaugcg

SEQ ID NO: 791363 - RNA, 21 nt, Human
ugggauuacaggcaugcgcca

SEQ ID NO: 791364 - RNA, 22 nt, Human
ugggauuacaggcaugcgccac

SEQ ID NO: 791365 - RNA, 24 nt, Human
ugggauuacaggcaugcgccacca

SEQ ID NO: 791366 - RNA, 21 nt, Human
ugggauuacaggugcaagcca

SEQ ID NO: 791367 - RNA, 22 nt, Human
ugggauuacaggugcaagccac

SEQ ID NO: 791368 - RNA, 22 nt, Human
ugggauuacaggugcaagccac

SEQ ID NO: 791369 - RNA, 22 nt, Human
ugggauuacaggugcaagccac

SEQ ID NO: 791370 - RNA, 24 nt, Human
ugggauuacaggugcaagccacug

SEQ ID NO: 791371 - RNA, 24 nt, Human
ugggcucacgugauccuccugccu

SEQ ID NO: 791372 - RNA, 23 nt, Human
uggggggccgaggcggguggauc

SEQ ID NO: 791373 - RNA, 24 nt, Human
uggggggccgaggcggguggauca

SEQ ID NO: 791374 - RNA, 24 nt, Human
uggggucuugcuauguugcccagg

SEQ ID NO: 791375 - RNA, 20 nt, Human
uggguucaagugauccuucu

SEQ ID NO: 791376 - RNA, 23 nt, Human
uggguucaagugauccuucugcc

SEQ ID NO: 791377 - RNA, 24 nt, Human
uggguucaagugauccuucugccu

SEQ ID NO: 791378 - RNA, 23 nt, Human
uggguuucuccauguuggucagg

SEQ ID NO: 791379 - RNA, 24 nt, Human
uggucaggcuggucucaaacuccu

SEQ ID NO: 791380 - RNA, 23 nt, Human
uggucagguuggucucgaacucc

SEQ ID NO: 791381 - RNA, 21 nt, Human
uggugggugccaguaguccca

SEQ ID NO: 791382 - RNA, 24 nt, Human
uggugggugccaguagucccagcu

SEQ ID NO: 791383 - RNA, 18 nt, Human
uguccauguuaaugcgcu

SEQ ID NO: 791384 - RNA, 23 nt, Human
uguccauguuaaugcgcuuuccc

SEQ ID NO: 791385 - RNA, 24 nt, Human
ugucucauaacaagaaauauaauu

SEQ ID NO: 791386 - RNA, 18 nt, Human
uguggggggccgaggcgg

SEQ ID NO: 791387 - RNA, 22 nt, Human
uuaaaggauacagcaaauccaa

SEQ ID NO: 791388 - RNA, 24 nt, Human
uuaauaaagacgggguuucaccau

SEQ ID NO: 791389 - RNA, 22 nt, Human
uuacagugagccgagaucgcgc

SEQ ID NO: 791390 - RNA, 21 nt, Human
uuaguagagauggguuucucc

SEQ ID NO: 791391 - RNA, 23 nt, Human
uuaguagagauggguuucuccau

SEQ ID NO: 791392 - RNA, 23 nt, Human
uuauagagauggggucuugcuau

SEQ ID NO: 791393 - RNA, 21 nt, Human
uucaagcgauucuccugccuc

SEQ ID NO: 791394 - RNA, 23 nt, Human
uucaagcgauucuccugccucag

SEQ ID NO: 791395 - RNA, 24 nt, Human
uucaagcgauucuccugccucagc

SEQ ID NO: 791396 - RNA, 23 nt, Human
uucaagugauccuucugccuugg

SEQ ID NO: 791397 - RNA, 24 nt, Human
uucaagugauccuucugccuuggc

SEQ ID NO: 791398 - RNA, 24 nt, Human
uucacucuuguugcccagguugga

SEQ ID NO: 791399 - RNA, 23 nt, Human
uucagcuagugggacucugugcu

SEQ ID NO: 791400 - RNA, 19 nt, Human
uucauaauucaaaggccgu

SEQ ID NO: 791401 - RNA, 23 nt, Human
uuccugggcucacgugauccucc

SEQ ID NO: 791402 - RNA, 18 nt, Human
uugaagauucuguggaau

SEQ ID NO: 791403 - RNA, 22 nt, Human
uugagacagagucuugcuaugu

SEQ ID NO: 791404 - RNA, 24 nt, Human
uugcccaggcugcagugcagugau

SEQ ID NO: 791405 - RNA, 18 nt, Human
uugcccagguuggagugc

SEQ ID NO: 791406 - RNA, 18 nt, Human
uuggccucccaaagugcu

SEQ ID NO: 791407 - RNA, 23 nt, Human
uuguucucagagauaaaaucagu

SEQ ID NO: 791408 - RNA, 23 nt, Human
uuuaacagcauaaucuuuuuaaa

SEQ ID NO: 791409 - RNA, 33 nt, Human
uuuaagacuccuccaauaaacccccaaacucuu

SEQ ID NO: 791410 - RNA, 22 nt, Human
uuuaagauauuuuccaguccca

SEQ ID NO: 791411 - RNA, 24 nt, Human
uuucaccauguuggucaggcuggu

SEQ ID NO: 791412 - RNA, 24 nt, Human
uuucacucuuguugcccagguugg

SEQ ID NO: 791413 - RNA, 21 nt, Human
uuucuagcagcaaggccagga

SEQ ID NO: 791414 - RNA, 19 nt, Human
uuucuccauguuggucagg

SEQ ID NO: 791415 - RNA, 20 nt, Human
uuucuccauguuggucaggu

SEQ ID NO: 791416 - RNA, 25 nt, Human
uuucucuggauuacuccaaauuuuu

SEQ ID NO: 791417 - RNA, 22 nt, Human
uuugagacagagucucccucag

SEQ ID NO: 791418 - RNA, 23 nt, Human
uuuggaggaguugucuaaaagga

SEQ ID NO: 791419 - RNA, 24 nt, Human
uuuuaagacuccuccaauaaaccc

SEQ ID NO: 791420 - RNA, 24 nt, Human
uuuuggccauuaauaaucaggggc

SEQ ID NO: 791421 - RNA, 19 nt, Human
uuuuguauuuuuaguagag

SEQ ID NO: 791422 - RNA, 20 nt, Human
uuuuguauuuuuaguagaga

SEQ ID NO: 791423 - RNA, 18 nt, Human
uuuuuaguagagaugggu

SEQ ID NO: 791424 - RNA, 18 nt, Human
uuuuuauagagauggggu

SEQ ID NO: 791425 - RNA, 23 nt, Human
aaaaaauaacauucaaacacuga

SEQ ID NO: 791426 - RNA, 25 nt, Human
aaaaaauaacauucaaacacugaga

SEQ ID NO: 791427 - RNA, 23 nt, Human
aaaaaguaucugacaauuaugaa

SEQ ID NO: 791428 - RNA, 25 nt, Human
aaaacaaaguuaaauaaccugaaua

SEQ ID NO: 791429 - RNA, 22 nt, Human
aaaggaccaugcuuaacgucaa

SEQ ID NO: 791430 - RNA, 21 nt, Human
aaaggccaucuuuccugagcc

SEQ ID NO: 791431 - RNA, 22 nt, Human
aacaagugaugaaauauuuuaa

SEQ ID NO: 791432 - RNA, 19 nt, Human
aaguuaaaaucauaggcac

SEQ ID NO: 791433 - RNA, 23 nt, Human
aaucucuagcccagguuucuuuc

SEQ ID NO: 791434 - RNA, 25 nt, Human
acaaaauaaucaacauucauaaaac

SEQ ID NO: 791435 - RNA, 24 nt, Human
accacauauacaaguucggcuaua

SEQ ID NO: 791436 - RNA, 21 nt, Human
acccaccccaucacccucaaa

SEQ ID NO: 791437 - RNA, 27 nt, Human
acccuuacuacuauauaucaaacauaa

SEQ ID NO: 791438 - RNA, 22 nt, Human
acugagaggaaaaaaggaaucu

SEQ ID NO: 791439 - RNA, 22 nt, Human
agaguuauacaaacaucugggg

SEQ ID NO: 791440 - RNA, 19 nt, Human
agcaggaccaggccccacc

SEQ ID NO: 791441 - RNA, 27 nt, Human
agcgacagggaaagagacggaggaaag

SEQ ID NO: 791442 - RNA, 20 nt, Human
aggaccaugcuuaacgucaa

SEQ ID NO: 791443 - RNA, 24 nt, Human
aggcaauuuuucucuuuaagaaaa

SEQ ID NO: 791444 - RNA, 19 nt, Human
auauagcaggaccaggccc

SEQ ID NO: 791445 - RNA, 24 nt, Human
auccaaccccaugaagacuaaauc

SEQ ID NO: 791446 - RNA, 20 nt, Human
caccaaauacauaguacugg

SEQ ID NO: 791447 - RNA, 22 nt, Human
caccccaucacccucaaauuca

SEQ ID NO: 791448 - RNA, 22 nt, Human
cagcagaguuucuauuacuuuc

SEQ ID NO: 791449 - RNA, 23 nt, Human
cagcgacagggaaagagacggag

SEQ ID NO: 791450 - RNA, 21 nt, Human
caggaccaggccccaccgcca

SEQ ID NO: 791451 - RNA, 21 nt, Human
caggaccaggccccaccgccg

SEQ ID NO: 791452 - RNA, 24 nt, Human
cauacaagaaaagaugcacgugau

SEQ ID NO: 791453 - RNA, 20 nt, Human
cauagucuagaucauucuag

SEQ ID NO: 791454 - RNA, 20 nt, Human
caucaaccuaucaaccuuaa

SEQ ID NO: 791455 - RNA, 18 nt, Human
cccacccccuaaucucaa

SEQ ID NO: 791456 - RNA, 20 nt, Human
cccaccgccagggucccccc

SEQ ID NO: 791457 - RNA, 23 nt, Human
cccaccgccaggguccccccacc

SEQ ID NO: 791458 - RNA, 24 nt, Human
cccaccgccaggguccccccaccu

SEQ ID NO: 791459 - RNA, 21 nt, Human
ccccaccgccagggucccccc

SEQ ID NO: 791460 - RNA, 20 nt, Human
ccccccgcgggccggcccag

SEQ ID NO: 791461 - RNA, 19 nt, Human
ccccgccgccgccgccgcc

SEQ ID NO: 791462 - RNA, 23 nt, Human
ccccgccgccgccgccgccuccg

SEQ ID NO: 791463 - RNA, 24 nt, Human
ccccgccgccgccgccgccuccgc

SEQ ID NO: 791464 - RNA, 25 nt, Human
ccccugccgccaucuucccuccguc

SEQ ID NO: 791465 - RNA, 24 nt, Human
ccgccgccgccgccgccuccgccg

SEQ ID NO: 791466 - RNA, 18 nt, Human
ccgccgccgccgccuccg

SEQ ID NO: 791467 - RNA, 24 nt, Human
ccgccgccgccgccuccgccgccc

SEQ ID NO: 791468 - RNA, 23 nt, Human
ccgccgccgccuccgccgcccgc

SEQ ID NO: 791469 - RNA, 23 nt, Human
ccgccgccgccuccgccgcccgc

SEQ ID NO: 791470 - RNA, 25 nt, Human
ccgccgccgccuccgccgcccgcuc

SEQ ID NO: 791471 - RNA, 25 nt, Human
ccgccuccgccgcccgcucgcucuc

SEQ ID NO: 791472 - RNA, 18 nt, Human
ccgcucacucuagccgag

SEQ ID NO: 791473 - RNA, 21 nt, Human
ccggccccgccgccgccgccg

SEQ ID NO: 791474 - RNA, 18 nt, Human
ccggccccugccgccauc

SEQ ID NO: 791475 - RNA, 24 nt, Human
ccuaccacauaauagaccguuaug

SEQ ID NO: 791476 - RNA, 21 nt, Human
ccucagagcgucgggggugga

SEQ ID NO: 791477 - RNA, 22 nt, Human
ccuugcauuauacaccaaauac

SEQ ID NO: 791478 - RNA, 21 nt, Human
cgccuccgccgcccgcucgcu

SEQ ID NO: 791479 - RNA, 20 nt, Human
cggaggaaagaggcgucgcc

SEQ ID NO: 791480 - RNA, 19 nt, Human
cuagcauucaguuaacaua

SEQ ID NO: 791481 - RNA, 19 nt, Human
cuccgucccuccgcccccc

SEQ ID NO: 791482 - RNA, 23 nt, Human
cugaaaacugagacuuguucugu

SEQ ID NO: 791483 - RNA, 25 nt, Human
cugaaaacugagacuuguucuguuu

SEQ ID NO: 791484 - RNA, 19 nt, Human
cugugguaguacaacagca

SEQ ID NO: 791485 - RNA, 18 nt, Human
cuuaacgucaaaaaugga

SEQ ID NO: 791486 - RNA, 20 nt, Human
cuuggaaacucauaauagcu

SEQ ID NO: 791487 - RNA, 24 nt, Human
cuugugcuaaaugaaugacucucc

SEQ ID NO: 791488 - RNA, 20 nt, Human
gaaacugauuaucuaacuua

SEQ ID NO: 791489 - RNA, 24 nt, Human
gauagccugaauucaccauuuucu

SEQ ID NO: 791490 - RNA, 21 nt, Human
gcccagguuucuuuccuccca

SEQ ID NO: 791491 - RNA, 18 nt, Human
gcccgcucgcucucgcag

SEQ ID NO: 791492 - RNA, 21 nt, Human
gccggcccagucggugaccuc

SEQ ID NO: 791493 - RNA, 27 nt, Human
gccucugucaaauauuuuuuaaaaauc

SEQ ID NO: 791494 - RNA, 23 nt, Human
gcuuucuaguaaaaaggcaauuu

SEQ ID NO: 791495 - RNA, 19 nt, Human
ggguuucugugguuaaaga

SEQ ID NO: 791496 - RNA, 28 nt, Human
guaaauccuuagauuuucccaaacagaa

SEQ ID NO: 791497 - RNA, 18 nt, Human
gugagcuacauccaaaac

SEQ ID NO: 791498 - RNA, 21 nt, Human
uaaaguggaucaacuuaagua

SEQ ID NO: 791499 - RNA, 23 nt, Human
uaaauaaccugaauacuccuuuu

SEQ ID NO: 791500 - RNA, 24 nt, Human
uaaauggcucuucaaguuuuuaga

SEQ ID NO: 791501 - RNA, 23 nt, Human
uaacaagugaugaaauauuuuaa

SEQ ID NO: 791502 - RNA, 24 nt, Human
uaagacauaauccaaccccaugaa

SEQ ID NO: 791503 - RNA, 20 nt, Human
uaagugacaauaucuuagag

SEQ ID NO: 791504 - RNA, 24 nt, Human
uaauccaaccccaugaagacuaaa

SEQ ID NO: 791505 - RNA, 25 nt, Human
uacaaacaaguuuuguagaaaaaug

SEQ ID NO: 791506 - RNA, 19 nt, Human
uacauagucuagaucauuc

SEQ ID NO: 791507 - RNA, 21 nt, Human
uaccaaacacaucugauguua

SEQ ID NO: 791508 - RNA, 24 nt, Human
uaugaaauaacucugacagagaaa

SEQ ID NO: 791509 - RNA, 21 nt, Human
ucaaaacaaacacacacaagu

SEQ ID NO: 791510 - RNA, 21 nt, Human
uccaaccccaugaagacuaaa

SEQ ID NO: 791511 - RNA, 25 nt, Human
uccagaauaucaagccuucuauuuc

SEQ ID NO: 791512 - RNA, 23 nt, Human
ucccaauuucuuuugccaacuua

SEQ ID NO: 791513 - RNA, 23 nt, Human
uccggccccugccgccaucuucc

SEQ ID NO: 791514 - RNA, 24 nt, Human
uccuaucaugaaaaccugcuaaua

SEQ ID NO: 791515 - RNA, 22 nt, Human
ucugcauucuugucuuugcugg

SEQ ID NO: 791516 - RNA, 22 nt, Human
ugaaauaacucugacagagaaa

SEQ ID NO: 791517 - RNA, 25 nt, Human
ugagaaaauuaaauaacuuuggaag

SEQ ID NO: 791518 - RNA, 19 nt, Human
ugagagaaaaaaacagaag

SEQ ID NO: 791519 - RNA, 23 nt, Human
ugcaaaaaucauuucugaaauuc

SEQ ID NO: 791520 - RNA, 22 nt, Human
ugcacugaaaacugagacuugu

SEQ ID NO: 791521 - RNA, 22 nt, Human
ugcagccauuuaaaaacaaagu

SEQ ID NO: 791522 - RNA, 24 nt, Human
ugcauuauacaccaaauacauagu

SEQ ID NO: 791523 - RNA, 22 nt, Human
ugcccagauauuggccucuguc

SEQ ID NO: 791524 - RNA, 19 nt, Human
uggcaaucaaaacaaacac

SEQ ID NO: 791525 - RNA, 21 nt, Human
uggcaaucaaaacaaacacac

SEQ ID NO: 791526 - RNA, 18 nt, Human
uggcaguuuaaaucucca

SEQ ID NO: 791527 - RNA, 22 nt, Human
uggugguggugacaugugagcu

SEQ ID NO: 791528 - RNA, 21 nt, Human
uguacaaacaaguuuuguaga

SEQ ID NO: 791529 - RNA, 22 nt, Human
uguagaaaaaugauccagcaaa

SEQ ID NO: 791530 - RNA, 19 nt, Human
uguaugauuaccaaacaca

SEQ ID NO: 791531 - RNA, 22 nt, Human
uguaugauuaccaaacacaucu

SEQ ID NO: 791532 - RNA, 20 nt, Human
ugucaaugcaacaugaugga

SEQ ID NO: 791533 - RNA, 31 nt, Human
uguuuuaaucucuagcccagguuucuuuccc

SEQ ID NO: 791534 - RNA, 22 nt, Human
uuaacaggaaaugaacuuaugu

SEQ ID NO: 791535 - RNA, 22 nt, Human
uucccaaacagaaaaauugcaa

SEQ ID NO: 791536 - RNA, 19 nt, Human
uuuaaaguggaucaacuua

SEQ ID NO: 791537 - RNA, 21 nt, Human
uuuaacaagugaugaaauauu

SEQ ID NO: 791538 - RNA, 22 nt, Human
uuuaggaucauucaaaauacau

SEQ ID NO: 791539 - RNA, 21 nt, Human
uuuccucccacccccuaaucu

SEQ ID NO: 791540 - RNA, 21 nt, Human
uuugaugaucucugucgguuu

SEQ ID NO: 791541 - RNA, 21 nt, Human
aaaaaauaaaagggaaaagga

SEQ ID NO: 791542 - RNA, 20 nt, Human
aaauguugaaaauuucaacu

SEQ ID NO: 791543 - RNA, 22 nt, Human
aacagccagugucccaaacucc

SEQ ID NO: 791544 - RNA, 22 nt, Human
aagaaggaaaaaaaugcaugag

SEQ ID NO: 791545 - RNA, 20 nt, Human
aagaccccacaaagaccucc

SEQ ID NO: 791546 - RNA, 18 nt, Human
aagggagggaggacagaa

SEQ ID NO: 791547 - RNA, 21 nt, Human
aaggggaaaaaauaaaaggga

SEQ ID NO: 791548 - RNA, 22 nt, Human
aauaaaaauagauaauacugag

SEQ ID NO: 791549 - RNA, 21 nt, Human
aauguuaucaggaugcuaaaa

SEQ ID NO: 791550 - RNA, 20 nt, Human
acaagagcauggacugcagg

SEQ ID NO: 791551 - RNA, 19 nt, Human
acacacauacaaagauaaa

SEQ ID NO: 791552 - RNA, 21 nt, Human
acacacauacaaagauaaaac

SEQ ID NO: 791553 - RNA, 24 nt, Human
accccacaaagaccuccaggcgcc

SEQ ID NO: 791554 - RNA, 23 nt, Human
agaagaacaaagacaaauacaaa

SEQ ID NO: 791555 - RNA, 20 nt, Human
agaagcgcaucacauuuugg

SEQ ID NO: 791556 - RNA, 20 nt, Human
agaaggggaaaaaauaaaag

SEQ ID NO: 791557 - RNA, 21 nt, Human
agaaggggaaaaaauaaaagg

SEQ ID NO: 791558 - RNA, 20 nt, Human
agacuaaaucuaccagcuaa

SEQ ID NO: 791559 - RNA, 22 nt, Human
aggaaaaaaaugcaugaaaaaa

SEQ ID NO: 791560 - RNA, 19 nt, Human
aggaacuuaaaagauauug

SEQ ID NO: 791561 - RNA, 19 nt, Human
aggaacuuaaaagauauug

SEQ ID NO: 791562 - RNA, 21 nt, Human
aggaaggaagaaaggaaggga

SEQ ID NO: 791563 - RNA, 21 nt, Human
aggaagggagggagggaggga

SEQ ID NO: 791564 - RNA, 23 nt, Human
aggaagggagggagggagggagg

SEQ ID NO: 791565 - RNA, 19 nt, Human
agggagggaggacagaagg

SEQ ID NO: 791566 - RNA, 21 nt, Human
agggcaagagguagcaaggga

SEQ ID NO: 791567 - RNA, 22 nt, Human
auaggcauuaaaucuucaugcu

SEQ ID NO: 791568 - RNA, 24 nt, Human
augugcacguauauaaauguauau

SEQ ID NO: 791569 - RNA, 25 nt, Human
augugcacguauauaaauguauaua

SEQ ID NO: 791570 - RNA, 25 nt, Human
caaaaaagauuuacauguaggcuua

SEQ ID NO: 791571 - RNA, 24 nt, Human
cacaaagaccuccaggcgccucag

SEQ ID NO: 791572 - RNA, 24 nt, Human
cacccagaaugagagcaacaccaa

SEQ ID NO: 791573 - RNA, 21 nt, Human
cagaaugagagcaacaccaaa

SEQ ID NO: 791574 - RNA, 26 nt, Human
cagcagcagaaggccaaauugauuag

SEQ ID NO: 791575 - RNA, 18 nt, Human
cagcuuccagcuucuaca

SEQ ID NO: 791576 - RNA, 18 nt, Human
caggccgggacagcccgg

SEQ ID NO: 791577 - RNA, 21 nt, Human
ccauucacaggccuuuccaaa

SEQ ID NO: 791578 - RNA, 19 nt, Human
cccacaaagaccuccaggc

SEQ ID NO: 791579 - RNA, 23 nt, Human
ccccacaaagaccuccaggcgcc

SEQ ID NO: 791580 - RNA, 24 nt, Human
ccccuaaacugaaagugcugaaac

SEQ ID NO: 791581 - RNA, 22 nt, Human
cgccucagcccuuauuugguac

SEQ ID NO: 791582 - RNA, 21 nt, Human
cugccgccuaacaauuguuua

SEQ ID NO: 791583 - RNA, 19 nt, Human
cuuccagccacaaaaaacg

SEQ ID NO: 791584 - RNA, 20 nt, Human
gaaaggaagggagggaggga

SEQ ID NO: 791585 - RNA, 18 nt, Human
gaagggagggagggaggg

SEQ ID NO: 791586 - RNA, 24 nt, Human
gaagggagggagggagggagggag

SEQ ID NO: 791587 - RNA, 19 nt, Human
gaccccacaaagaccucca

SEQ ID NO: 791588 - RNA, 23 nt, Human
gagaaauagaaacaauaacuaaa

SEQ ID NO: 791589 - RNA, 18 nt, Human
gagggagggagggaggga

SEQ ID NO: 791590 - RNA, 19 nt, Human
gagggagggagggagggag

SEQ ID NO: 791591 - RNA, 20 nt, Human
gagggagggagggagggagg

SEQ ID NO: 791592 - RNA, 22 nt, Human
gauaacaaaacagaagcgcauc

SEQ ID NO: 791593 - RNA, 20 nt, Human
gccagugucccaaacuccuu

SEQ ID NO: 791594 - RNA, 19 nt, Human
gccgggacagcccggccag

SEQ ID NO: 791595 - RNA, 19 nt, Human
gcugcugugaaaacuggag

SEQ ID NO: 791596 - RNA, 24 nt, Human
ggaaaaaaaugcaugaaaaaaugc

SEQ ID NO: 791597 - RNA, 18 nt, Human
ggaaaaaauaaaagggaa

SEQ ID NO: 791598 - RNA, 18 nt, Human
ggaacuuaaaagauauug

SEQ ID NO: 791599 - RNA, 24 nt, Human
ggagacacagaggggagcacacca

SEQ ID NO: 791600 - RNA, 19 nt, Human
ggagggagggagggaggga

SEQ ID NO: 791601 - RNA, 20 nt, Human
ggagggagggagggagggga

SEQ ID NO: 791602 - RNA, 21 nt, Human
ggagggagggagggaggggaa

SEQ ID NO: 791603 - RNA, 18 nt, Human
ggagugcacucucacuuu

SEQ ID NO: 791604 - RNA, 23 nt, Human
ggaguucauauacauguaugggu

SEQ ID NO: 791605 - RNA, 18 nt, Human
ggaugcuaaaaacucagc

SEQ ID NO: 791606 - RNA, 21 nt, Human
gugaaggaaggagggcaagag

SEQ ID NO: 791607 - RNA, 22 nt, Human
uaaaaauagauaauacugagug

SEQ ID NO: 791608 - RNA, 25 nt, Human
uaaaagaaaauaaaaugaaagagaa

SEQ ID NO: 791609 - RNA, 28 nt, Human
uaaaauaauacuuccuuaaaaaucugcc

SEQ ID NO: 791610 - RNA, 20 nt, Human
uaaagcaaaagugaacccuc

SEQ ID NO: 791611 - RNA, 21 nt, Human
uaaagcaaaagugaacccucu

SEQ ID NO: 791612 - RNA, 22 nt, Human
uaaaggggugggguggcagggu

SEQ ID NO: 791613 - RNA, 23 nt, Human
uaagauaaaauaaaaguagcaga

SEQ ID NO: 791614 - RNA, 23 nt, Human
uaauggcauauauauaauguccc

SEQ ID NO: 791615 - RNA, 24 nt, Human
uacacuuguacaaaaaucuuugug

SEQ ID NO: 791616 - RNA, 26 nt, Human
uacauguacgaguauacaugugcacg

SEQ ID NO: 791617 - RNA, 22 nt, Human
uagaaaaauagcauuuucguaa

SEQ ID NO: 791618 - RNA, 21 nt, Human
uagaaagaaggaaaaaaaugc

SEQ ID NO: 791619 - RNA, 23 nt, Human
uagauaauacugagugcaaagca

SEQ ID NO: 791620 - RNA, 22 nt, Human
uagcuacacuuguacaaaaauc

SEQ ID NO: 791621 - RNA, 20 nt, Human
uauauaaauguauauacaca

SEQ ID NO: 791622 - RNA, 21 nt, Human
uauggguaugugugcauacau

SEQ ID NO: 791623 - RNA, 19 nt, Human
uaugugugcauacauguac

SEQ ID NO: 791624 - RNA, 20 nt, Human
ucacaggccuuuccaaagca

SEQ ID NO: 791625 - RNA, 19 nt, Human
ucacccagaaugagagcaa

SEQ ID NO: 791626 - RNA, 25 nt, Human
ucauauacauguauggguaugugug

SEQ ID NO: 791627 - RNA, 21 nt, Human
ucccaaacuccuucacaagag

SEQ ID NO: 791628 - RNA, 19 nt, Human
uccccacacacauacaaag

SEQ ID NO: 791629 - RNA, 20 nt, Human
ucuacauggggaaguggggc

SEQ ID NO: 791630 - RNA, 22 nt, Human
ucugggaaagcuguuguugguu

SEQ ID NO: 791631 - RNA, 20 nt, Human
ucugugaaaacuccuucccc

SEQ ID NO: 791632 - RNA, 19 nt, Human
ugaaggaaggagggcaaga

SEQ ID NO: 791633 - RNA, 28 nt, Human
ugcaugaaaaaaugcauaaacuuugugc

SEQ ID NO: 791634 - RNA, 21 nt, Human
ugcuaaaaacucagcagcuuc

SEQ ID NO: 791635 - RNA, 21 nt, Human
uggcagggugggaagaaaagc

SEQ ID NO: 791636 - RNA, 23 nt, Human
uggcagggugggaagaaaagcau

SEQ ID NO: 791637 - RNA, 21 nt, Human
uggcauauauauaaugucccc

SEQ ID NO: 791638 - RNA, 19 nt, Human
ugggaagaggaucuuuuug

SEQ ID NO: 791639 - RNA, 19 nt, Human
ugggguggcagggugggaa

SEQ ID NO: 791640 - RNA, 26 nt, Human
uguauauacacauauaccuucuuacg

SEQ ID NO: 791641 - RNA, 21 nt, Human
ugugaaaacuccuuccuaauu

SEQ ID NO: 791642 - RNA, 24 nt, Human
ugugcacguauauaaauguauaua

SEQ ID NO: 791643 - RNA, 31 nt, Human
ugugcacguauauaaauguauauacacauaa

SEQ ID NO: 791644 - RNA, 19 nt, Human
ugugcauacauguacgagu

SEQ ID NO: 791645 - RNA, 20 nt, Human
ugugcauacauguacgagua

SEQ ID NO: 791646 - RNA, 24 nt, Human
ugugugcauacauguacgaguaua

SEQ ID NO: 791647 - RNA, 26 nt, Human
ugugugcauacauguacgaguauaca

SEQ ID NO: 791648 - RNA, 18 nt, Human
uuaaagcaaaagugaacc

SEQ ID NO: 791649 - RNA, 19 nt, Human
uucaagaucauucuagaua

SEQ ID NO: 791650 - RNA, 25 nt, Human
uuccuuggggauccuucucuuucuc

SEQ ID NO: 791651 - RNA, 19 nt, Human
uucucugauggcaaguuac

SEQ ID NO: 791652 - RNA, 24 nt, Human
uuuaagauaacaaaacagaagcgc

SEQ ID NO: 791653 - RNA, 20 nt, Human
uuuaugagcuccaaauuauu

SEQ ID NO: 791654 - RNA, 20 nt, Human
uuucuugguccgagucccag

SEQ ID NO: 791655 - RNA, 18 nt, Human
uuugcuagaucuuccaca

SEQ ID NO: 791656 - RNA, 23 nt, Human
uuuuucuuccuuggggauccuuc

SEQ ID NO: 791657 - RNA, 23 nt, Human
aaaaaaaugugguuacuagaaac

SEQ ID NO: 791658 - RNA, 20 nt, Human
aaaagaaacauaggcagcuu

SEQ ID NO: 791659 - RNA, 19 nt, Human
aaaauaacucauuaauaau

SEQ ID NO: 791660 - RNA, 19 nt, Human
aaaauacaccagccaacaa

SEQ ID NO: 791661 - RNA, 21 nt, Human
aaacagccugaggcaacacaa

SEQ ID NO: 791662 - RNA, 20 nt, Human
aaagagguucagaaaccuuc

SEQ ID NO: 791663 - RNA, 19 nt, Human
aaagaucaauaaagcagaa

SEQ ID NO: 791664 - RNA, 19 nt, Human
aaagcagacaacaaaaaca

SEQ ID NO: 791665 - RNA, 20 nt, Human
aaaguaaaauaacucauuaa

SEQ ID NO: 791666 - RNA, 19 nt, Human
aaauuacagauguggcucu

SEQ ID NO: 791667 - RNA, 24 nt, Human
aacaucuagcuacggcagaauggc

SEQ ID NO: 791668 - RNA, 23 nt, Human
aacuacauacaccuaaaccagaa

SEQ ID NO: 791669 - RNA, 18 nt, Human
aagcaaggauugcccagg

SEQ ID NO: 791670 - RNA, 18 nt, Human
aagcagacaacaaaaaca

SEQ ID NO: 791671 - RNA, 22 nt, Human
aagcagacaacaaaaacaacac

SEQ ID NO: 791672 - RNA, 25 nt, Human
aagcagacaacaaaaacaacacuaa

SEQ ID NO: 791673 - RNA, 27 nt, Human
aagcagacaacaaaaacaacacuaagg

SEQ ID NO: 791674 - RNA, 19 nt, Human
aaggaaaguaauuuauuug

SEQ ID NO: 791675 - RNA, 24 nt, Human
aaggagacagacucaugugaccaa

SEQ ID NO: 791676 - RNA, 25 nt, Human
aaggagacagacucaugugaccaag

SEQ ID NO: 791677 - RNA, 21 nt, Human
acaaagacauagaacaaugug

SEQ ID NO: 791678 - RNA, 27 nt, Human
acaacaaaaacaacacuaaggcauaga

SEQ ID NO: 791679 - RNA, 22 nt, Human
acaaugugccuggaaaagagga

SEQ ID NO: 791680 - RNA, 23 nt, Human
acacugaauuucaaaggccuaau

SEQ ID NO: 791681 - RNA, 20 nt, Human
acagaauauguuccagagga

SEQ ID NO: 791682 - RNA, 22 nt, Human
acagacauuaaaaacccagaca

SEQ ID NO: 791683 - RNA, 21 nt, Human
acauggcccaacuacauacac

SEQ ID NO: 791684 - RNA, 18 nt, Human
acccccugcccucgugaa

SEQ ID NO: 791685 - RNA, 19 nt, Human
accguguaauggcagcccu

SEQ ID NO: 791686 - RNA, 19 nt, Human
acugugucacucagacuac

SEQ ID NO: 791687 - RNA, 20 nt, Human
agaaagcaaaaaauaaauua

SEQ ID NO: 791688 - RNA, 23 nt, Human
agaauggcccacugcagucccca

SEQ ID NO: 791689 - RNA, 23 nt, Human
agacaacaaaaacaacacuaagg

SEQ ID NO: 791690 - RNA, 20 nt, Human
agcaccaugccuggggcaga

SEQ ID NO: 791691 - RNA, 25 nt, Human
agcagacaacaaaaacaacacuaag

SEQ ID NO: 791692 - RNA, 22 nt, Human
agcagauucuggcuuuggggga

SEQ ID NO: 791693 - RNA, 23 nt, Human
aggaguggggaggaaaagaggau

SEQ ID NO: 791694 - RNA, 23 nt, Human
aggcaggaaguaaagacugugga

SEQ ID NO: 791695 - RNA, 24 nt, Human
aggguaauuacaagucuuaaaaau

SEQ ID NO: 791696 - RNA, 18 nt, Human
aguuauauggccuuacag

SEQ ID NO: 791697 - RNA, 18 nt, Human
aucuagcuacggcagaau

SEQ ID NO: 791698 - RNA, 23 nt, Human
auguuaacaaaccccacagaaca

SEQ ID NO: 791699 - RNA, 23 nt, Human
caaaaaauaaauuagaggccuga

SEQ ID NO: 791700 - RNA, 20 nt, Human
caaaaccugccaacaauuug

SEQ ID NO: 791701 - RNA, 19 nt, Human
caaaccccacagaacaucu

SEQ ID NO: 791702 - RNA, 24 nt, Human
caaagcaacccacagaauagcauc

SEQ ID NO: 791703 - RNA, 25 nt, Human
caacaaagacauagaacaaugugca

SEQ ID NO: 791704 - RNA, 21 nt, Human
caagacaaaggaaacacauuc

SEQ ID NO: 791705 - RNA, 24 nt, Human
caagacaggcaauggucccuaaac

SEQ ID NO: 791706 - RNA, 22 nt, Human
cagacaacaaaaacaacacuaa

SEQ ID NO: 791707 - RNA, 23 nt, Human
cagaggauuggaaaggcuguguu

SEQ ID NO: 791708 - RNA, 19 nt, Human
cagaugaaaaaaaugcaac

SEQ ID NO: 791709 - RNA, 23 nt, Human
cagcauaagccuggcugcuuugg

SEQ ID NO: 791710 - RNA, 20 nt, Human
caggugaucccacaaacacc

SEQ ID NO: 791711 - RNA, 23 nt, Human
caucacaagaccguguaauggca

SEQ ID NO: 791712 - RNA, 25 nt, Human
caucucagcuuauuucacaucguuu

SEQ ID NO: 791713 - RNA, 23 nt, Human
cauucaaugaguuaauagaacac

SEQ ID NO: 791714 - RNA, 22 nt, Human
ccacagaauagcaucuaaccau

SEQ ID NO: 791715 - RNA, 24 nt, Human
ccacagaauagcaucuaaccauaa

SEQ ID NO: 791716 - RNA, 22 nt, Human
ccacagacauuaaaaacccaga

SEQ ID NO: 791717 - RNA, 25 nt, Human
ccagccaacaaagacauagaacaau

SEQ ID NO: 791718 - RNA, 24 nt, Human
cccacagaauagcaucuaaccauu

SEQ ID NO: 791719 - RNA, 21 nt, Human
ccccacugccuuccuggccua

SEQ ID NO: 791720 - RNA, 21 nt, Human
cggcagaauggcaaaauacag

SEQ ID NO: 791721 - RNA, 24 nt, Human
cuacugugguuguuauaacuauac

SEQ ID NO: 791722 - RNA, 18 nt, Human
cucuccucucccuccaca

SEQ ID NO: 791723 - RNA, 23 nt, Human
cugagcucugcccucuguggagg

SEQ ID NO: 791724 - RNA, 18 nt, Human
cuggccuaucauucuugu

SEQ ID NO: 791725 - RNA, 25 nt, Human
cuuccuggccuaucauucuuguuuu

SEQ ID NO: 791726 - RNA, 21 nt, Human
cuuguuuaguuuuuuuccaca

SEQ ID NO: 791727 - RNA, 19 nt, Human
cuuucaggccugccuuaag

SEQ ID NO: 791728 - RNA, 24 nt, Human
gacagaaaguaaacaaaagggacc

SEQ ID NO: 791729 - RNA, 19 nt, Human
gacuaaaguaaggagacag

SEQ ID NO: 791730 - RNA, 23 nt, Human
gaggaaaagaggauuacaugaag

SEQ ID NO: 791731 - RNA, 21 nt, Human
gaguuggccacacuuugagau

SEQ ID NO: 791732 - RNA, 20 nt, Human
gcaaauguccugagcucugc

SEQ ID NO: 791733 - RNA, 22 nt, Human
gcacaugucuaccaaauguuaa

SEQ ID NO: 791734 - RNA, 22 nt, Human
gcagccccuuccugaucuacuu

SEQ ID NO: 791735 - RNA, 20 nt, Human
gcccacugcaguccccacaa

SEQ ID NO: 791736 - RNA, 21 nt, Human
ggaggaguggggaggaaaaga

SEQ ID NO: 791737 - RNA, 22 nt, Human
ggaguuggccacacuuugagau

SEQ ID NO: 791738 - RNA, 20 nt, Human
ggaguuugaggaugagguga

SEQ ID NO: 791739 - RNA, 18 nt, Human
gggcucuccucucccucc

SEQ ID NO: 791740 - RNA, 23 nt, Human
ggucuucugucuuugugauucuu

SEQ ID NO: 791741 - RNA, 20 nt, Human
guaaaacacuggucaaaaug

SEQ ID NO: 791742 - RNA, 20 nt, Human
guccugagcucugcccucug

SEQ ID NO: 791743 - RNA, 23 nt, Human
guguaguuauauggccuuacagu

SEQ ID NO: 791744 - RNA, 24 nt, Human
uaaacagccugaggcaacacaacu

SEQ ID NO: 791745 - RNA, 22 nt, Human
uaaaccagaaaugucguaugaa

SEQ ID NO: 791746 - RNA, 23 nt, Human
uaaacuguagacacaguuuacaa

SEQ ID NO: 791747 - RNA, 22 nt, Human
uaaagcagaaagcaaaaaauaa

SEQ ID NO: 791748 - RNA, 25 nt, Human
uaacaaaccccacagaacaucuagc

SEQ ID NO: 791749 - RNA, 24 nt, Human
uaaggagacagacucaugugacca

SEQ ID NO: 791750 - RNA, 22 nt, Human
uaagugcuuuuuuucuauccau

SEQ ID NO: 791751 - RNA, 21 nt, Human
uaauuccaugaaaaugcugaa

SEQ ID NO: 791752 - RNA, 18 nt, Human
uacuucaguuacuucugc

SEQ ID NO: 791753 - RNA, 20 nt, Human
uacuucaguuacuucugcug

SEQ ID NO: 791754 - RNA, 19 nt, Human
uagaacaaugugcagcaaa

SEQ ID NO: 791755 - RNA, 20 nt, Human
uagaauagggugggcucuga

SEQ ID NO: 791756 - RNA, 23 nt, Human
uagacuaaaagauuccuggauau

SEQ ID NO: 791757 - RNA, 18 nt, Human
uagcaugcugguccuucc

SEQ ID NO: 791758 - RNA, 19 nt, Human
uaguauuuacaguggacag

SEQ ID NO: 791759 - RNA, 30 nt, Human
uauaaaauacaccagccaacaaagacauaa

SEQ ID NO: 791760 - RNA, 20 nt, Human
uauguuccagaggauuggaa

SEQ ID NO: 791761 - RNA, 21 nt, Human
ucaaagcacaugucuaccaaa

SEQ ID NO: 791762 - RNA, 19 nt, Human
ucaaaggccuaauaugaaa

SEQ ID NO: 791763 - RNA, 27 nt, Human
ucacugaauuccuaggaucuaggaauu

SEQ ID NO: 791764 - RNA, 20 nt, Human
ucaguggguuaucugauuug

SEQ ID NO: 791765 - RNA, 22 nt, Human
ucauuugccaucacagaauucc

SEQ ID NO: 791766 - RNA, 24 nt, Human
uccagccagauguuaaauuuaaaa

SEQ ID NO: 791767 - RNA, 25 nt, Human
ucucuagaugccuauacccuaaucu

SEQ ID NO: 791768 - RNA, 20 nt, Human
ucugcaaaccaaaccauugc

SEQ ID NO: 791769 - RNA, 21 nt, Human
ucugcaaaccaaaccauugcu

SEQ ID NO: 791770 - RNA, 21 nt, Human
ugaagccugcucuuagccaga

SEQ ID NO: 791771 - RNA, 22 nt, Human
ugaaggaaugaguauagaucug

SEQ ID NO: 791772 - RNA, 22 nt, Human
ugaagggagucacaaaguggcu

SEQ ID NO: 791773 - RNA, 23 nt, Human
ugaagggagucacaaaguggcuu

SEQ ID NO: 791774 - RNA, 18 nt, Human
ugacugaaagaaagcuga

SEQ ID NO: 791775 - RNA, 29 nt, Human
ugaggcaggaaguaaagacuguggauucc

SEQ ID NO: 791776 - RNA, 21 nt, Human
ugcaaaagaucaauaaagcag

SEQ ID NO: 791777 - RNA, 21 nt, Human
ugcagcaaaaccugccaacaa

SEQ ID NO: 791778 - RNA, 23 nt, Human
ugcgagcuuuaaaaagaaacaua

SEQ ID NO: 791779 - RNA, 20 nt, Human
ugcuccaaauacucuugcuu

SEQ ID NO: 791780 - RNA, 21 nt, Human
uggaacagacucaggaaggca

SEQ ID NO: 791781 - RNA, 24 nt, Human
uggcagaguaggcuuuaaaucugc

SEQ ID NO: 791782 - RNA, 22 nt, Human
ugggucaaagagaaccauucug

SEQ ID NO: 791783 - RNA, 24 nt, Human
uggguugacugaaagaaagcugag

SEQ ID NO: 791784 - RNA, 22 nt, Human
ugugcagcaaaaccugccaaca

SEQ ID NO: 791785 - RNA, 22 nt, Human
uguuggaguuugaggaugaggu

SEQ ID NO: 791786 - RNA, 21 nt, Human
uuacaucaaagcagacaacaa

SEQ ID NO: 791787 - RNA, 24 nt, Human
uuauggguugacugaaagaaagcu

SEQ ID NO: 791788 - RNA, 24 nt, Human
uuccugaggcagccccuuccugau

SEQ ID NO: 791789 - RNA, 19 nt, Human
uugcuccaaauacucuugc

SEQ ID NO: 791790 - RNA, 21 nt, Human
uuugggggacaugcaaaagau

SEQ ID NO: 791791 - RNA, 20 nt, Human
aaaaauaaaucacuuggcug

SEQ ID NO: 791792 - RNA, 20 nt, Human
aaaaauuuaaaaaccccacc

SEQ ID NO: 791793 - RNA, 21 nt, Human
aaaaccccaaccccuccucaa

SEQ ID NO: 791794 - RNA, 25 nt, Human
aaaccccccuuucaaaauagaaggc

SEQ ID NO: 791795 - RNA, 26 nt, Human
aaagcccagauucaggcagggacuga

SEQ ID NO: 791796 - RNA, 21 nt, Human
aaagggagagggggaaaggcc

SEQ ID NO: 791797 - RNA, 23 nt, Human
aacagaaagcauccauucucuca

SEQ ID NO: 791798 - RNA, 19 nt, Human
aaccccaaccccuccucaa

SEQ ID NO: 791799 - RNA, 25 nt, Human
aaccccaaccccuccucaaaacaaa

SEQ ID NO: 791800 - RNA, 22 nt, Human
aaccugccuccacaagguacug

SEQ ID NO: 791801 - RNA, 23 nt, Human
aagcagccccuguacucaagggc

SEQ ID NO: 791802 - RNA, 21 nt, Human
aagcauccauucucucagagc

SEQ ID NO: 791803 - RNA, 23 nt, Human
aagggagagggggaaaggccagg

SEQ ID NO: 791804 - RNA, 24 nt, Human
accagggcucccccaggugccuuu

SEQ ID NO: 791805 - RNA, 22 nt, Human
accauuuggugccgcaagggga

SEQ ID NO: 791806 - RNA, 23 nt, Human
acuaaauaguguugcccaaccca

SEQ ID NO: 791807 - RNA, 22 nt, Human
acugcuggagggcacaucagcc

SEQ ID NO: 791808 - RNA, 19 nt, Human
agaaagcagccccuguacu

SEQ ID NO: 791809 - RNA, 20 nt, Human
agacacccaaccccaugcag

SEQ ID NO: 791810 - RNA, 23 nt, Human
agagauggugaagaucuaggcag

SEQ ID NO: 791811 - RNA, 23 nt, Human
agagugggcucaagcagcuuggu

SEQ ID NO: 791812 - RNA, 18 nt, Human
agcauccauucucucaga

SEQ ID NO: 791813 - RNA, 19 nt, Human
agccagagccagccagcac

SEQ ID NO: 791814 - RNA, 23 nt, Human
agcccaagaaccugccuccacaa

SEQ ID NO: 791815 - RNA, 18 nt, Human
agcuagguagccccaggc

SEQ ID NO: 791816 - RNA, 20 nt, Human
aggaaaaugccugaggcagc

SEQ ID NO: 791817 - RNA, 18 nt, Human
aggaaggaaggaaaggga

SEQ ID NO: 791818 - RNA, 22 nt, Human
aggaaggaaggaaagggagagg

SEQ ID NO: 791819 - RNA, 23 nt, Human
aggaaggaaggaaagggagaggg

SEQ ID NO: 791820 - RNA, 21 nt, Human
aggaaggaaggaaggaaaggg

SEQ ID NO: 791821 - RNA, 21 nt, Human
aggcacccguccucaucccug

SEQ ID NO: 791822 - RNA, 23 nt, Human
aggcagaauucugacagcacagg

SEQ ID NO: 791823 - RNA, 18 nt, Human
aggcagacacccaacccc

SEQ ID NO: 791824 - RNA, 19 nt, Human
aggcagccagaggccacaa

SEQ ID NO: 791825 - RNA, 19 nt, Human
aggcaggaagaaagcagcc

SEQ ID NO: 791826 - RNA, 26 nt, Human
aggcaggcaggccuggacucucagca

SEQ ID NO: 791827 - RNA, 22 nt, Human
aggcaggcagugggaggugggg

SEQ ID NO: 791828 - RNA, 19 nt, Human
aggcagugggagguggggu

SEQ ID NO: 791829 - RNA, 20 nt, Human
agggagcugucuggcacagu

SEQ ID NO: 791830 - RNA, 23 nt, Human
aguguugcccaacccacagggau

SEQ ID NO: 791831 - RNA, 21 nt, Human
auaaaccaauguaaccaugcc

SEQ ID NO: 791832 - RNA, 22 nt, Human
auaaggcacagaaaauggggag

SEQ ID NO: 791833 - RNA, 21 nt, Human
aucaccagcaguugguccaau

SEQ ID NO: 791834 - RNA, 19 nt, Human
aucuaucugaaacagcugg

SEQ ID NO: 791835 - RNA, 24 nt, Human
auuuaaaaaccccaaccccuccuc

SEQ ID NO: 791836 - RNA, 22 nt, Human
auuuggguuuccuaggcugcag

SEQ ID NO: 791837 - RNA, 19 nt, Human
caaaauagaaggcgcuaca

SEQ ID NO: 791838 - RNA, 24 nt, Human
caaacccuauuuggguuuccuagg

SEQ ID NO: 791839 - RNA, 22 nt, Human
caacugggacagagagccccuc

SEQ ID NO: 791840 - RNA, 23 nt, Human
caagcgccggcucagcuccugcu

SEQ ID NO: 791841 - RNA, 18 nt, Human
caaggacccucuaccucu

SEQ ID NO: 791842 - RNA, 22 nt, Human
cacaaccuaagcucaggcaccc

SEQ ID NO: 791843 - RNA, 22 nt, Human
cacaccaaccauucccaugucc

SEQ ID NO: 791844 - RNA, 23 nt, Human
cacaggugggccaccccaagucc

SEQ ID NO: 791845 - RNA, 18 nt, Human
caccagggcucccccagg

SEQ ID NO: 791846 - RNA, 22 nt, Human
caccccaaguccuggcaaccau

SEQ ID NO: 791847 - RNA, 20 nt, Human
cagcacacagcugucccgag

SEQ ID NO: 791848 - RNA, 22 nt, Human
cagccugacacacagaagcucc

SEQ ID NO: 791849 - RNA, 22 nt, Human
cagcucagcacaaacucuccag

SEQ ID NO: 791850 - RNA, 20 nt, Human
cagcuccagcccuggggcca

SEQ ID NO: 791851 - RNA, 18 nt, Human
cagcugucccgagcccuc

SEQ ID NO: 791852 - RNA, 20 nt, Human
caggcgcugcaagcgccggc

SEQ ID NO: 791853 - RNA, 23 nt, Human
caggcugcggguucccagcuccc

SEQ ID NO: 791854 - RNA, 22 nt, Human
cauggguaccaagugcgagcca

SEQ ID NO: 791855 - RNA, 22 nt, Human
cauuccagcugcaaaagccugu

SEQ ID NO: 791856 - RNA, 22 nt, Human
ccaaggacccucuaccucugcu

SEQ ID NO: 791857 - RNA, 24 nt, Human
ccacacccacaaguuucaugcuaa

SEQ ID NO: 791858 - RNA, 24 nt, Human
ccagccacagacccaugaggaugg

SEQ ID NO: 791859 - RNA, 20 nt, Human
ccagcccuggggccagugga

SEQ ID NO: 791860 - RNA, 18 nt, Human
ccagcccuucaccagggc

SEQ ID NO: 791861 - RNA, 23 nt, Human
ccaggcagacacccaaccccaug

SEQ ID NO: 791862 - RNA, 20 nt, Human
ccaggugccuuucccacucu

SEQ ID NO: 791863 - RNA, 23 nt, Human
ccaguggagggccagccagagcc

SEQ ID NO: 791864 - RNA, 21 nt, Human
cccaaggcagaauucugacag

SEQ ID NO: 791865 - RNA, 18 nt, Human
cccagugaggccugguga

SEQ ID NO: 791866 - RNA, 20 nt, Human
cccagugaggccuggugagc

SEQ ID NO: 791867 - RNA, 21 nt, Human
ccccagggccggacaaaccaa

SEQ ID NO: 791868 - RNA, 23 nt, Human
ccccuccucaaaacaaaaccccc

SEQ ID NO: 791869 - RNA, 19 nt, Human
ccccugaagguagcagcuu

SEQ ID NO: 791870 - RNA, 28 nt, Human
cccgcccccagcgcccccgccggaggaa

SEQ ID NO: 791871 - RNA, 19 nt, Human
cccucuccacagcuugugg

SEQ ID NO: 791872 - RNA, 18 nt, Human
cccugacacaccccugaa

SEQ ID NO: 791873 - RNA, 21 nt, Human
cccuguacucaagggccuccu

SEQ ID NO: 791874 - RNA, 18 nt, Human
ccgcugccuggcugccac

SEQ ID NO: 791875 - RNA, 19 nt, Human
ccucaaaacaaaacccccc

SEQ ID NO: 791876 - RNA, 20 nt, Human
ccuccugggcccucucagcc

SEQ ID NO: 791877 - RNA, 23 nt, Human
ccugcacccagccacagacccau

SEQ ID NO: 791878 - RNA, 22 nt, Human
ccuggacucucagcaagagagu

SEQ ID NO: 791879 - RNA, 26 nt, Human
ccuuucccacucuaggcuccuggaag

SEQ ID NO: 791880 - RNA, 23 nt, Human
cgagccaggcagacacccaaccc

SEQ ID NO: 791881 - RNA, 21 nt, Human
cggacaaaccaagaaagccag

SEQ ID NO: 791882 - RNA, 22 nt, Human
cgggaccacuuuuacucugcca

SEQ ID NO: 791883 - RNA, 18 nt, Human
cuaucaccaacuuggaua

SEQ ID NO: 791884 - RNA, 22 nt, Human
cucaggcacccguccucauccc

SEQ ID NO: 791885 - RNA, 19 nt, Human
cucaggccacaccaaccau

SEQ ID NO: 791886 - RNA, 19 nt, Human
cucaggccacaccaaccau

SEQ ID NO: 791887 - RNA, 20 nt, Human
cuccagggcagccaguccuc

SEQ ID NO: 791888 - RNA, 22 nt, Human
cuccauccucccacacccacaa

SEQ ID NO: 791889 - RNA, 21 nt, Human
cucccacacccacaaguuuca

SEQ ID NO: 791890 - RNA, 19 nt, Human
cuccucaaaacaaaacccc

SEQ ID NO: 791891 - RNA, 18 nt, Human
cucuguguagacuuccuc

SEQ ID NO: 791892 - RNA, 21 nt, Human
cugacccuacucuuugcaugg

SEQ ID NO: 791893 - RNA, 24 nt, Human
cugaguugugagcaaccaaaggaa

SEQ ID NO: 791894 - RNA, 19 nt, Human
cuggccacaggucugggug

SEQ ID NO: 791895 - RNA, 19 nt, Human
cuuccuccugccuccaugg

SEQ ID NO: 791896 - RNA, 26 nt, Human
cuuuccuuuccugauuccccaauggu

SEQ ID NO: 791897 - RNA, 18 nt, Human
gaccacuuuuacucugcc

SEQ ID NO: 791898 - RNA, 20 nt, Human
gagcccuccugggcccucuc

SEQ ID NO: 791899 - RNA, 21 nt, Human
gaggaaaaugccugaggcagc

SEQ ID NO: 791900 - RNA, 19 nt, Human
gcagacacccaaccccaug

SEQ ID NO: 791901 - RNA, 19 nt, Human
gcagcccaagaaccugccu

SEQ ID NO: 791902 - RNA, 19 nt, Human
gccaagucacuuaaucucc

SEQ ID NO: 791903 - RNA, 23 nt, Human
gccagccagagccagccagcaca

SEQ ID NO: 791904 - RNA, 23 nt, Human
gccagccccaaggaccaagaaaa

SEQ ID NO: 791905 - RNA, 26 nt, Human
gccccaaggaccaagaaaaagcagca

SEQ ID NO: 791906 - RNA, 21 nt, Human
ggaaggagugaccauuuggug

SEQ ID NO: 791907 - RNA, 21 nt, Human
ggacucaaagaaaacauggug

SEQ ID NO: 791908 - RNA, 20 nt, Human
ggagagggggaaaggccagg

SEQ ID NO: 791909 - RNA, 19 nt, Human
ggaggaguccccaggcugc

SEQ ID NO: 791910 - RNA, 20 nt, Human
ggaggaguccccaggcugcg

SEQ ID NO: 791911 - RNA, 19 nt, Human
ggcaggaggaguggacucu

SEQ ID NO: 791912 - RNA, 18 nt, Human
ggccaguggagggccagc

SEQ ID NO: 791913 - RNA, 25 nt, Human
ggcccugggccaaguuaucacuucu

SEQ ID NO: 791914 - RNA, 20 nt, Human
ggcuggcaggcaggcaggcc

SEQ ID NO: 791915 - RNA, 22 nt, Human
gggagagagagagagacugagc

SEQ ID NO: 791916 - RNA, 21 nt, Human
gggagcuagguagccccaggc

SEQ ID NO: 791917 - RNA, 18 nt, Human
gggcccucucagccacuc

SEQ ID NO: 791918 - RNA, 21 nt, Human
gggcccuggccccaucaccag

SEQ ID NO: 791919 - RNA, 26 nt, Human
gggcucccccaggugccuuucccacu

SEQ ID NO: 791920 - RNA, 20 nt, Human
gggggagauguucacugaac

SEQ ID NO: 791921 - RNA, 25 nt, Human
ggugagcaauggguaucucaggcca

SEQ ID NO: 791922 - RNA, 21 nt, Human
guaguggacgcggagguugcc

SEQ ID NO: 791923 - RNA, 20 nt, Human
gugacuuuagccaagucacu

SEQ ID NO: 791924 - RNA, 19 nt, Human
uaaaaaccccaaccccucc

SEQ ID NO: 791925 - RNA, 20 nt, Human
uaaaaaccccaaccccuccu

SEQ ID NO: 791926 - RNA, 21 nt, Human
uaaauaguguugcccaaccca

SEQ ID NO: 791927 - RNA, 20 nt, Human
uaaauuagcagaaaccaggg

SEQ ID NO: 791928 - RNA, 20 nt, Human
uaagcuaucaccaacuugga

SEQ ID NO: 791929 - RNA, 19 nt, Human
uacagacaggacgccuccu

SEQ ID NO: 791930 - RNA, 19 nt, Human
uacuaaugcaggaaaaccc

SEQ ID NO: 791931 - RNA, 21 nt, Human
uacuguguuacaggccgcugc

SEQ ID NO: 791932 - RNA, 22 nt, Human
uagaaggcgcuacaugagagua

SEQ ID NO: 791933 - RNA, 21 nt, Human
uagggcuccgcugccuggcug

SEQ ID NO: 791934 - RNA, 23 nt, Human
uauauuuuuauauauauauauau

SEQ ID NO: 791935 - RNA, 18 nt, Human
uaucacuucucuggaccc

SEQ ID NO: 791936 - RNA, 19 nt, Human
ucaaagaaaacauggugcc

SEQ ID NO: 791937 - RNA, 19 nt, Human
ucagcuccugcuccccagg

SEQ ID NO: 791938 - RNA, 19 nt, Human
ucagguccagcccuucacc

SEQ ID NO: 791939 - RNA, 23 nt, Human
ucccaaaggugagcugcccaacu

SEQ ID NO: 791940 - RNA, 21 nt, Human
uccccaggcugcggguuccca

SEQ ID NO: 791941 - RNA, 25 nt, Human
uccccaggcugcggguucccagcuc

SEQ ID NO: 791942 - RNA, 20 nt, Human
uccccaggggacggcagccc

SEQ ID NO: 791943 - RNA, 21 nt, Human
uccccaggggacggcagcccg

SEQ ID NO: 791944 - RNA, 24 nt, Human
uccccaggggacggcagcccgccc

SEQ ID NO: 791945 - RNA, 20 nt, Human
ucccgagcccuccugggccc

SEQ ID NO: 791946 - RNA, 21 nt, Human
ucccgagcccuccugggcccu

SEQ ID NO: 791947 - RNA, 20 nt, Human
ucccuuuccuccuccagggc

SEQ ID NO: 791948 - RNA, 21 nt, Human
uccuaggcugcagcucggccu

SEQ ID NO: 791949 - RNA, 26 nt, Human
uccugggccuguuuccuuauuuguag

SEQ ID NO: 791950 - RNA, 18 nt, Human
ucgcugccgccaucuugg

SEQ ID NO: 791951 - RNA, 23 nt, Human
ucuaggcuccuggaagcaggcug

SEQ ID NO: 791952 - RNA, 18 nt, Human
ucuaguagggcuccgcug

SEQ ID NO: 791953 - RNA, 22 nt, Human
ucuccauccucccacacccaca

SEQ ID NO: 791954 - RNA, 19 nt, Human
ucucucagagcugugcaga

SEQ ID NO: 791955 - RNA, 18 nt, Human
ucucuccauccucccaca

SEQ ID NO: 791956 - RNA, 19 nt, Human
ucugccgucgcugccgcca

SEQ ID NO: 791957 - RNA, 23 nt, Human
ucugccgucgcugccgccaucuu

SEQ ID NO: 791958 - RNA, 22 nt, Human
ucuggccagcaaauacucccaa

SEQ ID NO: 791959 - RNA, 19 nt, Human
ucuucuuuuuuaaugaguu

SEQ ID NO: 791960 - RNA, 22 nt, Human
ugacacaccccugaagguagca

SEQ ID NO: 791961 - RNA, 20 nt, Human
ugaccgcgggauacaggcgc

SEQ ID NO: 791962 - RNA, 18 nt, Human
ugacucaaaaaaggggga

SEQ ID NO: 791963 - RNA, 23 nt, Human
ugacucaaaaaagggggagcaag

SEQ ID NO: 791964 - RNA, 21 nt, Human
ugagcgggguggugggcagag

SEQ ID NO: 791965 - RNA, 24 nt, Human
ugccgucgcugccgccaucuugga

SEQ ID NO: 791966 - RNA, 18 nt, Human
ugcgagccaggcagacac

SEQ ID NO: 791967 - RNA, 21 nt, Human
uggacucaaagaaaacauggu

SEQ ID NO: 791968 - RNA, 22 nt, Human
uggagggccagccagagccagc

SEQ ID NO: 791969 - RNA, 18 nt, Human
uggcacaguggcagugaa

SEQ ID NO: 791970 - RNA, 18 nt, Human
uggcacgcacugaggccg

SEQ ID NO: 791971 - RNA, 18 nt, Human
uggcaggcaggcaggccu

SEQ ID NO: 791972 - RNA, 20 nt, Human
uggccugcacccagccacag

SEQ ID NO: 791973 - RNA, 22 nt, Human
uggcuggcaggcaggcaggccu

SEQ ID NO: 791974 - RNA, 19 nt, Human
ugggaaggcgcuagguggc

SEQ ID NO: 791975 - RNA, 18 nt, Human
ugggacagagagccccuc

SEQ ID NO: 791976 - RNA, 21 nt, Human
ugggagagaccaauguaguug

SEQ ID NO: 791977 - RNA, 20 nt, Human
ugggaugcuauaaaccaaug

SEQ ID NO: 791978 - RNA, 21 nt, Human
ugggguggguggcacgcacug

SEQ ID NO: 791979 - RNA, 19 nt, Human
ugggugcaugagacuggca

SEQ ID NO: 791980 - RNA, 19 nt, Human
uggguuuccuaggcugcag

SEQ ID NO: 791981 - RNA, 22 nt, Human
ugguagcgggaccacuuuuacu

SEQ ID NO: 791982 - RNA, 21 nt, Human
ugucccgagcccuccugggcc

SEQ ID NO: 791983 - RNA, 18 nt, Human
uguguauuuuaauaaaaa

SEQ ID NO: 791984 - RNA, 21 nt, Human
uguugcccagcugugggccca

SEQ ID NO: 791985 - RNA, 24 nt, Human
uuagaguaaauguauuauuuggcc

SEQ ID NO: 791986 - RNA, 19 nt, Human
uucacugaaccccauucca

SEQ ID NO: 791987 - RNA, 22 nt, Human
uuccucccuuuccuccuccagg

SEQ ID NO: 791988 - RNA, 18 nt, Human
uugaaaagggaggaaagg

SEQ ID NO: 791989 - RNA, 19 nt, Human
uugcaugggcggcuugugc

SEQ ID NO: 791990 - RNA, 19 nt, Human
uuggcccucuccacagcuu

SEQ ID NO: 791991 - RNA, 26 nt, Human
uuuaaaaaccccaaccccuccucaaa

SEQ ID NO: 791992 - RNA, 21 nt, Human
uuucccaaggcagaauucuga

SEQ ID NO: 791993 - RNA, 22 nt, Human
uuugcugacaaucuucacuuca

SEQ ID NO: 791994 - RNA, 20 nt, Human
uuuggcccucuccacagcuu

SEQ ID NO: 791995 - RNA, 18 nt, Human
uuuuauauauauauauau

SEQ ID NO: 791996 - RNA, 24 nt, Human
aaaaaaaggaaagaaagaaaggga

SEQ ID NO: 791997 - RNA, 19 nt, Human
aaaacaggaaaaucugagc

SEQ ID NO: 791998 - RNA, 19 nt, Human
aaacuccccccaccccaac

SEQ ID NO: 791999 - RNA, 20 nt, Human
aaagggaggaggggccgggc

SEQ ID NO: 792000 - RNA, 19 nt, Human
aacauggugaaaccccguc

SEQ ID NO: 792001 - RNA, 20 nt, Human
aacauggugaaaccccgucu

SEQ ID NO: 792002 - RNA, 21 nt, Human
aacauggugaaaccccgucuc

SEQ ID NO: 792003 - RNA, 24 nt, Human
aaccaggaaagggguucaggcucc

SEQ ID NO: 792004 - RNA, 19 nt, Human
aaccccuucuccagacccg

SEQ ID NO: 792005 - RNA, 19 nt, Human
aacccgguuuccgcccccc

SEQ ID NO: 792006 - RNA, 24 nt, Human
aacgcauucccucccuaccccccg

SEQ ID NO: 792007 - RNA, 21 nt, Human
aacuccccccaccccaacccc

SEQ ID NO: 792008 - RNA, 20 nt, Human
aagcaagauacacgcaugug

SEQ ID NO: 792009 - RNA, 23 nt, Human
aagcagacacacggucaacccca

SEQ ID NO: 792010 - RNA, 24 nt, Human
aagcagacacacggucaaccccac

SEQ ID NO: 792011 - RNA, 19 nt, Human
aagcaggggcggguggggc

SEQ ID NO: 792012 - RNA, 24 nt, Human
aagcaggggcggguggggcggggc

SEQ ID NO: 792013 - RNA, 21 nt, Human
aagccccacagccaucacccc

SEQ ID NO: 792014 - RNA, 21 nt, Human
aaggaugguggcaaaacgucc

SEQ ID NO: 792015 - RNA, 18 nt, Human
aaggggguguuagcacca

SEQ ID NO: 792016 - RNA, 19 nt, Human
aauaaaaaaaaaggaaaga

SEQ ID NO: 792017 - RNA, 24 nt, Human
aaucgcuugaacccgggaggcgga

SEQ ID NO: 792018 - RNA, 20 nt, Human
acacggucaaccccacacgc

SEQ ID NO: 792019 - RNA, 22 nt, Human
acagaccaagacuccgucaaaa

SEQ ID NO: 792020 - RNA, 18 nt, Human
acagggcacgcuugucag

SEQ ID NO: 792021 - RNA, 20 nt, Human
accaaguccacaggcucagc

SEQ ID NO: 792022 - RNA, 22 nt, Human
accccacagcacuccacuggcu

SEQ ID NO: 792023 - RNA, 18 nt, Human
accccgucucuacuaaaa

SEQ ID NO: 792024 - RNA, 21 nt, Human
accggccauaaccaggaaagg

SEQ ID NO: 792025 - RNA, 20 nt, Human
acuccccccaccccaacccc

SEQ ID NO: 792026 - RNA, 23 nt, Human
acugcacuccagccuggcgacag

SEQ ID NO: 792027 - RNA, 19 nt, Human
agaaagaaagggaggagga

SEQ ID NO: 792028 - RNA, 22 nt, Human
agaaagggaggaggaggggucg

SEQ ID NO: 792029 - RNA, 24 nt, Human
agaaagggaggaggaggggucgag

SEQ ID NO: 792030 - RNA, 22 nt, Human
agaaucgcuugaacccgggagg

SEQ ID NO: 792031 - RNA, 22 nt, Human
agaccaagacuccgucaaaaaa

SEQ ID NO: 792032 - RNA, 19 nt, Human
agaccuccggaaagcccaa

SEQ ID NO: 792033 - RNA, 23 nt, Human
agagauccagaccauccuggcca

SEQ ID NO: 792034 - RNA, 19 nt, Human
agauacacgcauguguugu

SEQ ID NO: 792035 - RNA, 25 nt, Human
agccgcgguggccccucaccgcccc

SEQ ID NO: 792036 - RNA, 18 nt, Human
agccuggcgacagaccaa

SEQ ID NO: 792037 - RNA, 23 nt, Human
agccuggcgacagaccaagacuc

SEQ ID NO: 792038 - RNA, 21 nt, Human
agcuacuaggcaggcugaggc

SEQ ID NO: 792039 - RNA, 23 nt, Human
agcuggucgugguggcgcgcgcc

SEQ ID NO: 792040 - RNA, 23 nt, Human
aggaaaaucugagcgcggagcug

SEQ ID NO: 792041 - RNA, 18 nt, Human
aggaggaggggucgaggu

SEQ ID NO: 792042 - RNA, 21 nt, Human
aggcagauggaucaccugagg

SEQ ID NO: 792043 - RNA, 22 nt, Human
aggcagauggaucaccugaggu

SEQ ID NO: 792044 - RNA, 26 nt, Human
aggcagauggaucaccugaggucaag

SEQ ID NO: 792045 - RNA, 24 nt, Human
aggcaggagaaucgcuugaacccg

SEQ ID NO: 792046 - RNA, 21 nt, Human
aggccgaggcagauggaucac

SEQ ID NO: 792047 - RNA, 18 nt, Human
aggcgccccaggcaccgg

SEQ ID NO: 792048 - RNA, 21 nt, Human
aggcggaagaugcagugagcc

SEQ ID NO: 792049 - RNA, 24 nt, Human
aggcggaagaugcagugagccgag

SEQ ID NO: 792050 - RNA, 18 nt, Human
aggcggaggcgcggcgau

SEQ ID NO: 792051 - RNA, 19 nt, Human
aggcucagccgccaagggg

SEQ ID NO: 792052 - RNA, 20 nt, Human
aggcugaggcaggagaaucg

SEQ ID NO: 792053 - RNA, 24 nt, Human
aggcugaggcaggagaaucgcuug

SEQ ID NO: 792054 - RNA, 21 nt, Human
agggagaauggcagccguggg

SEQ ID NO: 792055 - RNA, 20 nt, Human
agggaggaggaggggucgag

SEQ ID NO: 792056 - RNA, 22 nt, Human
agggaggaggaggggucgaggu

SEQ ID NO: 792057 - RNA, 19 nt, Human
aggggauucagcccgcagg

SEQ ID NO: 792058 - RNA, 19 nt, Human
aggggcggguggggcgggg

SEQ ID NO: 792059 - RNA, 19 nt, Human
agucgccgcgccgcgcccc

SEQ ID NO: 792060 - RNA, 21 nt, Human
auccccacccauucuguagcc

SEQ ID NO: 792061 - RNA, 24 nt, Human
auccgcccccccgcccgccccccu

SEQ ID NO: 792062 - RNA, 21 nt, Human
auccuggccaacauggugaaa

SEQ ID NO: 792063 - RNA, 24 nt, Human
aucgcgccacugcacuccagccug

SEQ ID NO: 792064 - RNA, 22 nt, Human
augcagugagccgagaucgcgc

SEQ ID NO: 792065 - RNA, 18 nt, Human
caaaauggaaaaaagaac

SEQ ID NO: 792066 - RNA, 21 nt, Human
caaaauggaaaaaagaacccc

SEQ ID NO: 792067 - RNA, 24 nt, Human
caacauggugaaaccccgucucua

SEQ ID NO: 792068 - RNA, 21 nt, Human
caagcaagauacacgcaugug

SEQ ID NO: 792069 - RNA, 22 nt, Human
caagcagacacacggucaaccc

SEQ ID NO: 792070 - RNA, 21 nt, Human
caagccccacagccaucaccc

SEQ ID NO: 792071 - RNA, 20 nt, Human
cacacccucacacaacagcc

SEQ ID NO: 792072 - RNA, 22 nt, Human
cacagaccuccggaaagcccaa

SEQ ID NO: 792073 - RNA, 19 nt, Human
cacagacuuuucuccuaca

SEQ ID NO: 792074 - RNA, 25 nt, Human
caccaagccccacagccaucacccc

SEQ ID NO: 792075 - RNA, 22 nt, Human
caccgccccgccgucucacacc

SEQ ID NO: 792076 - RNA, 19 nt, Human
caccgcguuaccgcgaggu

SEQ ID NO: 792077 - RNA, 20 nt, Human
cacgcacuaucccccaagcc

SEQ ID NO: 792078 - RNA, 24 nt, Human
cacgccuguaaucccagcacuuug

SEQ ID NO: 792079 - RNA, 23 nt, Human
cacgcgccugucccgccagcgcc

SEQ ID NO: 792080 - RNA, 26 nt, Human
cacuacacggucacacuucacaggac

SEQ ID NO: 792081 - RNA, 20 nt, Human
cacuccacuggccuuggcug

SEQ ID NO: 792082 - RNA, 18 nt, Human
cacugagcucucugggag

SEQ ID NO: 792083 - RNA, 18 nt, Human
cacugcacuccagccugg

SEQ ID NO: 792084 - RNA, 18 nt, Human
cacugcacuccagccugg

SEQ ID NO: 792085 - RNA, 22 nt, Human
cacugcacuccagccuggcgac

SEQ ID NO: 792086 - RNA, 23 nt, Human
cacugcacuccagccuggcgaca

SEQ ID NO: 792087 - RNA, 23 nt, Human
cacugcacuccagccuggcgaca

SEQ ID NO: 792088 - RNA, 24 nt, Human
cagacacacggucaaccccacacg

SEQ ID NO: 792089 - RNA, 21 nt, Human
cagaccaagacuccgucaaaa

SEQ ID NO: 792090 - RNA, 25 nt, Human
cagaccuccggaaagcccaacacac

SEQ ID NO: 792091 - RNA, 24 nt, Human
cagauggaucaccugaggucaaga

SEQ ID NO: 792092 - RNA, 24 nt, Human
cagcacuuugagaggccgaggcag

SEQ ID NO: 792093 - RNA, 22 nt, Human
cagccguggguagcagggacug

SEQ ID NO: 792094 - RNA, 19 nt, Human
cagcuaccggccauaacca

SEQ ID NO: 792095 - RNA, 18 nt, Human
ccaacacacggacaacga

SEQ ID NO: 792096 - RNA, 18 nt, Human
ccacagcacuccacuggc

SEQ ID NO: 792097 - RNA, 19 nt, Human
ccacugcacuccagccugg

SEQ ID NO: 792098 - RNA, 19 nt, Human
ccacugcacuccagccugg

SEQ ID NO: 792099 - RNA, 20 nt, Human
ccacugcacuccagccuggc

SEQ ID NO: 792100 - RNA, 23 nt, Human
ccacugcacuccagccuggcgac

SEQ ID NO: 792101 - RNA, 18 nt, Human
ccagaagugggguggggg

SEQ ID NO: 792102 - RNA, 24 nt, Human
ccagaccauccuggccaacauggu

SEQ ID NO: 792103 - RNA, 22 nt, Human
ccagacccggcguggcagagca

SEQ ID NO: 792104 - RNA, 20 nt, Human
ccagaggcugggaagggggu

SEQ ID NO: 792105 - RNA, 20 nt, Human
ccauaucuucacagccucuc

SEQ ID NO: 792106 - RNA, 25 nt, Human
cccacacgcacuaucccccaagccg

SEQ ID NO: 792107 - RNA, 27 nt, Human
cccacacgcacuaucccccaagccgcg

SEQ ID NO: 792108 - RNA, 20 nt, Human
cccacagcacuccacuggcc

SEQ ID NO: 792109 - RNA, 25 nt, Human
cccauaucugccccccauaucuuca

SEQ ID NO: 792110 - RNA, 19 nt, Human
ccccaagccgcgguggccc

SEQ ID NO: 792111 - RNA, 22 nt, Human
ccccaagccgcgguggccccuc

SEQ ID NO: 792112 - RNA, 23 nt, Human
ccccaagccgcgguggccccuca

SEQ ID NO: 792113 - RNA, 21 nt, Human
ccccacagccaucaccccggg

SEQ ID NO: 792114 - RNA, 20 nt, Human
ccccaccccaaccccgacgc

SEQ ID NO: 792115 - RNA, 22 nt, Human
ccccaggcaccgggcuggacuc

SEQ ID NO: 792116 - RNA, 20 nt, Human
ccccccaccccaaccccgac

SEQ ID NO: 792117 - RNA, 24 nt, Human
ccccccgacacacacacucgauuu

SEQ ID NO: 792118 - RNA, 27 nt, Human
ccccccgacacacacacucgauuuucc

SEQ ID NO: 792119 - RNA, 20 nt, Human
ccccgcccauccgccccccc

SEQ ID NO: 792120 - RNA, 21 nt, Human
ccccgccgucucacacccuca

SEQ ID NO: 792121 - RNA, 18 nt, Human
ccccuucccucccucccc

SEQ ID NO: 792122 - RNA, 20 nt, Human
ccccuucccucccuccccgc

SEQ ID NO: 792123 - RNA, 26 nt, Human
cccgagucgccgcgccgcgccccucc

SEQ ID NO: 792124 - RNA, 23 nt, Human
cccgcccauccgcccccccgccc

SEQ ID NO: 792125 - RNA, 21 nt, Human
cccgcgaccaaguccacaggc

SEQ ID NO: 792126 - RNA, 21 nt, Human
cccuaccccccgacacacaca

SEQ ID NO: 792127 - RNA, 22 nt, Human
ccgagucgccgcgccgcgcccc

SEQ ID NO: 792128 - RNA, 23 nt, Human
ccgccccgccgucucacacccuc

SEQ ID NO: 792129 - RNA, 23 nt, Human
ccuagcucugaugaaaccccgac

SEQ ID NO: 792130 - RNA, 22 nt, Human
ccucacgcgccugucccgccag

SEQ ID NO: 792131 - RNA, 22 nt, Human
ccuggccaacauggugaaaccc

SEQ ID NO: 792132 - RNA, 23 nt, Human
ccuggccaacauggugaaacccc

SEQ ID NO: 792133 - RNA, 24 nt, Human
ccuggccaacauggugaaaccccg

SEQ ID NO: 792134 - RNA, 21 nt, Human
ccuguagucccagcuacuagg

SEQ ID NO: 792135 - RNA, 24 nt, Human
ccuguagucccagcuacuaggcag

SEQ ID NO: 792136 - RNA, 19 nt, Human
ccuuggcuggcccccgaaa

SEQ ID NO: 792137 - RNA, 19 nt, Human
cgagacgcgaggacggagg

SEQ ID NO: 792138 - RNA, 20 nt, Human
cgaggcagauggaucaccug

SEQ ID NO: 792139 - RNA, 24 nt, Human
cgaggcagauggaucaccugaggu

SEQ ID NO: 792140 - RNA, 26 nt, Human
cgaggcagauggaucaccugagguca

SEQ ID NO: 792141 - RNA, 27 nt, Human
cgaggugggaccccacagcacuccacu

SEQ ID NO: 792142 - RNA, 21 nt, Human
cgcacuaucccccaagccgcg

SEQ ID NO: 792143 - RNA, 20 nt, Human
cgcagaauccccacccauuc

SEQ ID NO: 792144 - RNA, 25 nt, Human
cgccacugcacuccagccuggcgac

SEQ ID NO: 792145 - RNA, 18 nt, Human
cgccuguaaucccagcac

SEQ ID NO: 792146 - RNA, 23 nt, Human
cgccuguagucccagcuacuagg

SEQ ID NO: 792147 - RNA, 18 nt, Human
cgcgacgggaauggaggg

SEQ ID NO: 792148 - RNA, 19 nt, Human
cgcgacgggaauggaggga

SEQ ID NO: 792149 - RNA, 21 nt, Human
cgcgccccuccccuucccucc

SEQ ID NO: 792150 - RNA, 23 nt, Human
cgcgccgcgccccuccccuuccc

SEQ ID NO: 792151 - RNA, 19 nt, Human
cgcuguugggcgcacagac

SEQ ID NO: 792152 - RNA, 23 nt, Human
cggcgcuguugggcgcacagacc

SEQ ID NO: 792153 - RNA, 24 nt, Human
cggcgcuuuaaguuaggagagaga

SEQ ID NO: 792154 - RNA, 18 nt, Human
cgggagcggcgcuguugg

SEQ ID NO: 792155 - RNA, 18 nt, Human
cuaaaacccgguuuccgc

SEQ ID NO: 792156 - RNA, 18 nt, Human
cuacacgccgggcaaaca

SEQ ID NO: 792157 - RNA, 22 nt, Human
cucacgccuguaaucccagcac

SEQ ID NO: 792158 - RNA, 24 nt, Human
cucacgccuguaaucccagcacuu

SEQ ID NO: 792159 - RNA, 21 nt, Human
cuccccgcccauccgcccccc

SEQ ID NO: 792160 - RNA, 24 nt, Human
cugaaacuccccccaccccaaccc

SEQ ID NO: 792161 - RNA, 19 nt, Human
cugcagcagacaguagcac

SEQ ID NO: 792162 - RNA, 23 nt, Human
cugcccacguuagcccuggagac

SEQ ID NO: 792163 - RNA, 22 nt, Human
cuggcccccgaaaccaccgcgu

SEQ ID NO: 792164 - RNA, 22 nt, Human
cuugugcugcgcuucgcggaga

SEQ ID NO: 792165 - RNA, 24 nt, Human
cuuucuuucaaaauggaaaaaaga

SEQ ID NO: 792166 - RNA, 22 nt, Human
gaaaacaacgaaaacaggaaaa

SEQ ID NO: 792167 - RNA, 25 nt, Human
gaaaacgcauucccucccuaccccc

SEQ ID NO: 792168 - RNA, 22 nt, Human
gaaacuccccccaccccaaccc

SEQ ID NO: 792169 - RNA, 21 nt, Human
gaaaugucgcugucuuugaaa

SEQ ID NO: 792170 - RNA, 23 nt, Human
gaaauuggcccgcgaccaagucc

SEQ ID NO: 792171 - RNA, 18 nt, Human
gaacccgggaggcggaag

SEQ ID NO: 792172 - RNA, 21 nt, Human
gaaggggguguuagcaccaga

SEQ ID NO: 792173 - RNA, 23 nt, Human
gacacacacacucgauuuuccca

SEQ ID NO: 792174 - RNA, 22 nt, Human
gacugcugcucccaggcacccu

SEQ ID NO: 792175 - RNA, 23 nt, Human
gagaucgcgccacugcacuccag

SEQ ID NO: 792176 - RNA, 23 nt, Human
gagcugaaaggcgccccaggcac

SEQ ID NO: 792177 - RNA, 18 nt, Human
gaggacagaaggauuugg

SEQ ID NO: 792178 - RNA, 23 nt, Human
gaggaggggccgggcgcggugcc

SEQ ID NO: 792179 - RNA, 20 nt, Human
gaucaccugaggucaagaga

SEQ ID NO: 792180 - RNA, 19 nt, Human
gcaagauacacgcaugugu

SEQ ID NO: 792181 - RNA, 27 nt, Human
gcagaauccccacccauucuguagcca

SEQ ID NO: 792182 - RNA, 20 nt, Human
gcagacaguagcacagacaa

SEQ ID NO: 792183 - RNA, 19 nt, Human
gcagcagacaguagcacag

SEQ ID NO: 792184 - RNA, 23 nt, Human
gcagcagacaguagcacagacaa

SEQ ID NO: 792185 - RNA, 24 nt, Human
gccaacauggugaaaccccgucuc

SEQ ID NO: 792186 - RNA, 19 nt, Human
gccccaggcaccgggcugg

SEQ ID NO: 792187 - RNA, 20 nt, Human
gccccgccgucucacacccu

SEQ ID NO: 792188 - RNA, 20 nt, Human
gccgagaucgcgccacugca

SEQ ID NO: 792189 - RNA, 21 nt, Human
gccucacgccuguaaucccag

SEQ ID NO: 792190 - RNA, 22 nt, Human
gccuguagucccagcuacuagg

SEQ ID NO: 792191 - RNA, 19 nt, Human
gcgccccuccccuucccuc

SEQ ID NO: 792192 - RNA, 20 nt, Human
gcgccugucccgccagcgcc

SEQ ID NO: 792193 - RNA, 22 nt, Human
gcugcgggguggauuucgcaga

SEQ ID NO: 792194 - RNA, 23 nt, Human
gcuugucagggacuacacgccgg

SEQ ID NO: 792195 - RNA, 19 nt, Human
ggaaagcccaacacacgga

SEQ ID NO: 792196 - RNA, 24 nt, Human
ggaagaugcagugagccgagaucg

SEQ ID NO: 792197 - RNA, 18 nt, Human
ggacaacgaaauuggccc

SEQ ID NO: 792198 - RNA, 24 nt, Human
ggacacagacuuuucuccuacagg

SEQ ID NO: 792199 - RNA, 22 nt, Human
ggagagggcugaucccgaggac

SEQ ID NO: 792200 - RNA, 21 nt, Human
ggaggaggaggggucgaggug

SEQ ID NO: 792201 - RNA, 22 nt, Human
ggaggaggggccgggcgcggug

SEQ ID NO: 792202 - RNA, 19 nt, Human
ggaggucgggaaugggcgg

SEQ ID NO: 792203 - RNA, 23 nt, Human
ggcgcggugccucacgccuguaa

SEQ ID NO: 792204 - RNA, 24 nt, Human
ggcgcuuuccagcuagggucuggg

SEQ ID NO: 792205 - RNA, 21 nt, Human
ggcggaagaugcagugagccg

SEQ ID NO: 792206 - RNA, 19 nt, Human
gggaggaggaggggucgag

SEQ ID NO: 792207 - RNA, 20 nt, Human
gggaggaggaggggucgagg

SEQ ID NO: 792208 - RNA, 20 nt, Human
gggcacgggcuccggggggc

SEQ ID NO: 792209 - RNA, 20 nt, Human
ggggaggaguaggugaaggu

SEQ ID NO: 792210 - RNA, 18 nt, Human
ggggccgggcgcggugcc

SEQ ID NO: 792211 - RNA, 18 nt, Human
ggggcggguggggcgggg

SEQ ID NO: 792212 - RNA, 23 nt, Human
gggucugggucggguggagccgc

SEQ ID NO: 792213 - RNA, 24 nt, Human
ggugccucacgccuguaaucccag

SEQ ID NO: 792214 - RNA, 19 nt, Human
gucacacuucacaggacac

SEQ ID NO: 792215 - RNA, 21 nt, Human
gucggguggagccgcgggagc

SEQ ID NO: 792216 - RNA, 23 nt, Human
guggcgcgcgccuguagucccag

SEQ ID NO: 792217 - RNA, 25 nt, Human
uaaaaaaaaaggaaagaaagaaaaa

SEQ ID NO: 792218 - RNA, 20 nt, Human
uaagauaaacacugugcuug

SEQ ID NO: 792219 - RNA, 22 nt, Human
uaagauaaacacugugcuuggc

SEQ ID NO: 792220 - RNA, 21 nt, Human
uaccgcgagguuuccaaaguc

SEQ ID NO: 792221 - RNA, 19 nt, Human
uacuaggcaggcugaggca

SEQ ID NO: 792222 - RNA, 26 nt, Human
uagaagaaauuagcuggucguggugg

SEQ ID NO: 792223 - RNA, 18 nt, Human
uagcucugaugaaacccc

SEQ ID NO: 792224 - RNA, 21 nt, Human
uaguaagggggaggaguaggu

SEQ ID NO: 792225 - RNA, 18 nt, Human
uaucgcccaccgucugcg

SEQ ID NO: 792226 - RNA, 20 nt, Human
ucaaccccacacgcacuauc

SEQ ID NO: 792227 - RNA, 23 nt, Human
ucaaccccacacgcacuaucccc

SEQ ID NO: 792228 - RNA, 23 nt, Human
ucaagguuggggaguaguaaggg

SEQ ID NO: 792229 - RNA, 18 nt, Human
ucacacccucacacaaca

SEQ ID NO: 792230 - RNA, 21 nt, Human
uccaaagucuucgcucguuuc

SEQ ID NO: 792231 - RNA, 18 nt, Human
uccacaggcucagccgcc

SEQ ID NO: 792232 - RNA, 18 nt, Human
uccacuggccuuggcugg

SEQ ID NO: 792233 - RNA, 21 nt, Human
ucccagaggcugggaaggggg

SEQ ID NO: 792234 - RNA, 21 nt, Human
ucccaggcccgcgcuugugcu

SEQ ID NO: 792235 - RNA, 19 nt, Human
ucccauaucugccccccau

SEQ ID NO: 792236 - RNA, 22 nt, Human
ucccccaagccgcgguggcccc

SEQ ID NO: 792237 - RNA, 24 nt, Human
ucccccaagccgcgguggccccuc

SEQ ID NO: 792238 - RNA, 18 nt, Human
uccccccaccccaacccc

SEQ ID NO: 792239 - RNA, 21 nt, Human
ucccgaggacugaaacucccc

SEQ ID NO: 792240 - RNA, 26 nt, Human
ucccgaggacugaaacuccccccacc

SEQ ID NO: 792241 - RNA, 23 nt, Human
ucgaggcauuuggcuaaaacccg

SEQ ID NO: 792242 - RNA, 23 nt, Human
ucgcgccacugcacuccagccug

SEQ ID NO: 792243 - RNA, 20 nt, Human
ucgcucccuagcucugauga

SEQ ID NO: 792244 - RNA, 18 nt, Human
ucgcuugaacccgggagg

SEQ ID NO: 792245 - RNA, 19 nt, Human
ucguuuccucuggcuccag

SEQ ID NO: 792246 - RNA, 24 nt, Human
ucucacacccucacacaacagccg

SEQ ID NO: 792247 - RNA, 24 nt, Human
ucucuacuaaaaauagaagaaauu

SEQ ID NO: 792248 - RNA, 24 nt, Human
ugaaacuccccccaccccaacccc

SEQ ID NO: 792249 - RNA, 26 nt, Human
ugaaacuccccccaccccaaccccga

SEQ ID NO: 792250 - RNA, 18 nt, Human
ugaaagggaggaggggcc

SEQ ID NO: 792251 - RNA, 20 nt, Human
ugaaagggaggaggggccgg

SEQ ID NO: 792252 - RNA, 18 nt, Human
ugagaggccgaggcagau

SEQ ID NO: 792253 - RNA, 24 nt, Human
ugagaggccgaggcagauggauca

SEQ ID NO: 792254 - RNA, 22 nt, Human
ugagccgagaucgcgccacugc

SEQ ID NO: 792255 - RNA, 20 nt, Human
ugaggcaggagaaucgcuug

SEQ ID NO: 792256 - RNA, 24 nt, Human
ugaggcaggagaaucgcuugaacc

SEQ ID NO: 792257 - RNA, 25 nt, Human
ugaggcaggagaaucgcuugaaccc

SEQ ID NO: 792258 - RNA, 21 nt, Human
ugccucacgccuguaauccca

SEQ ID NO: 792259 - RNA, 22 nt, Human
ugccucacgccuguaaucccag

SEQ ID NO: 792260 - RNA, 24 nt, Human
ugccucacgccuguaaucccagca

SEQ ID NO: 792261 - RNA, 24 nt, Human
uggaucaccugaggucaagagauc

SEQ ID NO: 792262 - RNA, 25 nt, Human
uggaucaccugaggucaagagaucc

SEQ ID NO: 792263 - RNA, 24 nt, Human
uggcaaaacguccgcuacucuuga

SEQ ID NO: 792264 - RNA, 18 nt, Human
uggcagccguggguagca

SEQ ID NO: 792265 - RNA, 24 nt, Human
uggccaacauggugaaaccccguc

SEQ ID NO: 792266 - RNA, 25 nt, Human
uggccagaagugggguggggguggg

SEQ ID NO: 792267 - RNA, 26 nt, Human
uggccagaagugggguggucgacacg

SEQ ID NO: 792268 - RNA, 21 nt, Human
uggcgcgcgccuguaguccca

SEQ ID NO: 792269 - RNA, 19 nt, Human
uggcuccagagcccacggu

SEQ ID NO: 792270 - RNA, 19 nt, Human
ugggaccccacagcacucc

SEQ ID NO: 792271 - RNA, 21 nt, Human
ugggaggacagaaggauuugg

SEQ ID NO: 792272 - RNA, 20 nt, Human
uggggaguaguaagggggag

SEQ ID NO: 792273 - RNA, 23 nt, Human
uggggcggggcgacgcgaggacc

SEQ ID NO: 792274 - RNA, 18 nt, Human
ugggguaagauaaacacu

SEQ ID NO: 792275 - RNA, 19 nt, Human
uggggugggggugggagga

SEQ ID NO: 792276 - RNA, 22 nt, Human
uggugaaaucggcccacucccu

SEQ ID NO: 792277 - RNA, 24 nt, Human
ugguggcgcgcgccuguaguccca

SEQ ID NO: 792278 - RNA, 19 nt, Human
ugucgaggcauuuggcuaa

SEQ ID NO: 792279 - RNA, 18 nt, Human
uuagcuggucgugguggc

SEQ ID NO: 792280 - RNA, 20 nt, Human
uuagcuggucgugguggcgc

SEQ ID NO: 792281 - RNA, 21 nt, Human
uucaaaauggaaaaaagaacc

SEQ ID NO: 792282 - RNA, 22 nt, Human
uucaaaauggaaaaaagaaccc

SEQ ID NO: 792283 - RNA, 28 nt, Human
uucccgacugucgcucccuagcucugau

SEQ ID NO: 792284 - RNA, 28 nt, Human
uugugcugcgcuucgcggagagggcuga

SEQ ID NO: 792285 - RNA, 24 nt, Human
uuucccagaggcugggaagggggu

SEQ ID NO: 792286 - RNA, 23 nt, Human
uuuccgccccccugcgcugccca

SEQ ID NO: 792287 - RNA, 21 nt, Human
uuuggaacuaaaaacuagggg

SEQ ID NO: 792288 - RNA, 25 nt, Human
aaagauagugggggaguuuuugaac

SEQ ID NO: 792289 - RNA, 20 nt, Human
aaaguccauuaauuaucuug

SEQ ID NO: 792290 - RNA, 19 nt, Human
aagaaaacacgagcuuaca

SEQ ID NO: 792291 - RNA, 23 nt, Human
aagcaggaagcaggcuuacagaa

SEQ ID NO: 792292 - RNA, 27 nt, Human
aagcaggaagcaggcuuacagaagcaa

SEQ ID NO: 792293 - RNA, 24 nt, Human
aagccugcugccccuaaaaacucc

SEQ ID NO: 792294 - RNA, 24 nt, Human
acagaccugagcuuuuuccuuaga

SEQ ID NO: 792295 - RNA, 21 nt, Human
acccggcucugcagaccccuu

SEQ ID NO: 792296 - RNA, 20 nt, Human
accugcaacuuuaacagcag

SEQ ID NO: 792297 - RNA, 18 nt, Human
acuuaaauucuuuuuagc

SEQ ID NO: 792298 - RNA, 19 nt, Human
acuucucaagcuucaguug

SEQ ID NO: 792299 - RNA, 21 nt, Human
agaaaaagaaaggcuuaguca

SEQ ID NO: 792300 - RNA, 24 nt, Human
agaaaaucuaagcauagaucaaag

SEQ ID NO: 792301 - RNA, 18 nt, Human
agauaugguuaauguuuc

SEQ ID NO: 792302 - RNA, 24 nt, Human
aggaauuacgugaagcaggaagca

SEQ ID NO: 792303 - RNA, 21 nt, Human
aggccuuuuccugaacaaaaa

SEQ ID NO: 792304 - RNA, 21 nt, Human
aggggggcuacuuaaauucuu

SEQ ID NO: 792305 - RNA, 18 nt, Human
auccagaaaaucuaagca

SEQ ID NO: 792306 - RNA, 25 nt, Human
auggacauagaaaaagaaaggcucc

SEQ ID NO: 792307 - RNA, 21 nt, Human
caaaagccugcugccccuaaa

SEQ ID NO: 792308 - RNA, 24 nt, Human
caaaauaccugaagggcagauaug

SEQ ID NO: 792309 - RNA, 20 nt, Human
caaagagagaaucuggagac

SEQ ID NO: 792310 - RNA, 20 nt, Human
caccugugauaagcaggaac

SEQ ID NO: 792311 - RNA, 18 nt, Human
cacgcugcccuugggcua

SEQ ID NO: 792312 - RNA, 25 nt, Human
cagcauggcaguggcagcuaaugcu

SEQ ID NO: 792313 - RNA, 19 nt, Human
caguggaauugcauccaga

SEQ ID NO: 792314 - RNA, 22 nt, Human
cagugugugacuacagcagggu

SEQ ID NO: 792315 - RNA, 20 nt, Human
cauagaaaaagaaaggcuua

SEQ ID NO: 792316 - RNA, 23 nt, Human
cauccagaaaaucuaagcauaga

SEQ ID NO: 792317 - RNA, 21 nt, Human
cauguuggauggucugagucu

SEQ ID NO: 792318 - RNA, 20 nt, Human
cauuuggugggacaaaagcc

SEQ ID NO: 792319 - RNA, 24 nt, Human
ccacugccgaguucacgcugccgc

SEQ ID NO: 792320 - RNA, 22 nt, Human
cccacuuuguggcuucauacaa

SEQ ID NO: 792321 - RNA, 21 nt, Human
ccccauuaccuauuuugugcc

SEQ ID NO: 792322 - RNA, 23 nt, Human
ccccauuaccuauuuugugccua

SEQ ID NO: 792323 - RNA, 25 nt, Human
ccccuugcuuuagaggaauuagaaa

SEQ ID NO: 792324 - RNA, 20 nt, Human
ccuggcaguaauucccauga

SEQ ID NO: 792325 - RNA, 21 nt, Human
ccuugggcuacuaggaaaccu

SEQ ID NO: 792326 - RNA, 24 nt, Human
cgaaugucuuuuaagcauuuuuuu

SEQ ID NO: 792327 - RNA, 21 nt, Human
cggcauuucuacaggcaacag

SEQ ID NO: 792328 - RNA, 22 nt, Human
cuacuguuugaacugaaacucc

SEQ ID NO: 792329 - RNA, 20 nt, Human
cuagguagcuggcccauacu

SEQ ID NO: 792330 - RNA, 19 nt, Human
cucuuuuucucccccacuu

SEQ ID NO: 792331 - RNA, 19 nt, Human
cugaacaaaaacaguaaca

SEQ ID NO: 792332 - RNA, 18 nt, Human
cugccccuaaaaacuccc

SEQ ID NO: 792333 - RNA, 19 nt, Human
cugccgaguucacgcugcc

SEQ ID NO: 792334 - RNA, 19 nt, Human
cuuacagaagcaagaacaa

SEQ ID NO: 792335 - RNA, 19 nt, Human
cuuccagugugugacuaca

SEQ ID NO: 792336 - RNA, 20 nt, Human
cuugcagcuguacaaggagg

SEQ ID NO: 792337 - RNA, 29 nt, Human
gaaaacacgagcuuacagagccuacaaag

SEQ ID NO: 792338 - RNA, 23 nt, Human
gaaaacgaaugucuuuuaagcau

SEQ ID NO: 792339 - RNA, 24 nt, Human
gaaggagaucuuuggugcccugga

SEQ ID NO: 792340 - RNA, 21 nt, Human
gaaggcgaaggagaucuuugg

SEQ ID NO: 792341 - RNA, 21 nt, Human
gacauagaaaaagaaaggcuu

SEQ ID NO: 792342 - RNA, 23 nt, Human
gagaacaccucaucuacuacguc

SEQ ID NO: 792343 - RNA, 19 nt, Human
gagaaucuggagaccaacc

SEQ ID NO: 792344 - RNA, 18 nt, Human
gcaaaagccugcugcccc

SEQ ID NO: 792345 - RNA, 19 nt, Human
gcaaacaaaagaucaccaa

SEQ ID NO: 792346 - RNA, 23 nt, Human
gcaaacaaaagaucaccaaugua

SEQ ID NO: 792347 - RNA, 18 nt, Human
gcacauauggcuuccuuc

SEQ ID NO: 792348 - RNA, 21 nt, Human
gcaggaagcaggcuuacagaa

SEQ ID NO: 792349 - RNA, 20 nt, Human
gcaggcaccugugauaagca

SEQ ID NO: 792350 - RNA, 20 nt, Human
gcaguggcagcuaaugcuuu

SEQ ID NO: 792351 - RNA, 23 nt, Human
gcauagaucaaagaaaacgaaug

SEQ ID NO: 792352 - RNA, 25 nt, Human
gcuccauuaaggugaucacuguggu

SEQ ID NO: 792353 - RNA, 22 nt, Human
gggcucuuuuucucccccacuu

SEQ ID NO: 792354 - RNA, 18 nt, Human
gugaagcaggaagcaggc

SEQ ID NO: 792355 - RNA, 21 nt, Human
uaaacuucccacauacuccuc

SEQ ID NO: 792356 - RNA, 22 nt, Human
uaaauaggcuacuggucaauac

SEQ ID NO: 792357 - RNA, 18 nt, Human
uaacagcagugggaguag

SEQ ID NO: 792358 - RNA, 22 nt, Human
uaaucaguauuacuaagaucac

SEQ ID NO: 792359 - RNA, 23 nt, Human
uaccuauuuugugccuagguagc

SEQ ID NO: 792360 - RNA, 23 nt, Human
uaggccuuuuccugaacaaaaac

SEQ ID NO: 792361 - RNA, 20 nt, Human
uaggcuacuggucaauacca

SEQ ID NO: 792362 - RNA, 22 nt, Human
uaucuagugaagacuccucaag

SEQ ID NO: 792363 - RNA, 18 nt, Human
ucaaagauagugggggag

SEQ ID NO: 792364 - RNA, 23 nt, Human
ucagucgacugugaugaauccaa

SEQ ID NO: 792365 - RNA, 22 nt, Human
ucaguggaauugcauccagaaa

SEQ ID NO: 792366 - RNA, 21 nt, Human
uccacagauccaauauaggcc

SEQ ID NO: 792367 - RNA, 23 nt, Human
uccagaaaaucuaagcauagauc

SEQ ID NO: 792368 - RNA, 22 nt, Human
uccagcauuuucugccagcaug

SEQ ID NO: 792369 - RNA, 22 nt, Human
ucccagggcucgagcuuggcuu

SEQ ID NO: 792370 - RNA, 19 nt, Human
uccuaagaguuccccuugc

SEQ ID NO: 792371 - RNA, 26 nt, Human
uccuguagucauuccuuuucuuucau

SEQ ID NO: 792372 - RNA, 23 nt, Human
uccuucuuuaacucuaacuucag

SEQ ID NO: 792373 - RNA, 19 nt, Human
ucuagugccagccuguuuu

SEQ ID NO: 792374 - RNA, 19 nt, Human
ucuuccucgguaggugccg

SEQ ID NO: 792375 - RNA, 23 nt, Human
ugaaacuccuguagucauuccuu

SEQ ID NO: 792376 - RNA, 18 nt, Human
ugaacuggaacuugggcc

SEQ ID NO: 792377 - RNA, 23 nt, Human
ugaaguacagcaaaagccugcug

SEQ ID NO: 792378 - RNA, 18 nt, Human
ugacugguucacuggucc

SEQ ID NO: 792379 - RNA, 20 nt, Human
ugagaacaccucaucuacua

SEQ ID NO: 792380 - RNA, 21 nt, Human
ugagaacaccucaucuacuac

SEQ ID NO: 792381 - RNA, 21 nt, Human
ugauacaaaccugcuucccuc

SEQ ID NO: 792382 - RNA, 18 nt, Human
uggaauugcauccagaaa

SEQ ID NO: 792383 - RNA, 19 nt, Human
uggauuuccacauaagagc

SEQ ID NO: 792384 - RNA, 19 nt, Human
ugggacaaaagccuugagg

SEQ ID NO: 792385 - RNA, 19 nt, Human
ugguuuugccacaggauua

SEQ ID NO: 792386 - RNA, 21 nt, Human
ugugauaccugcaacuuuaac

SEQ ID NO: 792387 - RNA, 20 nt, Human
uucuugagucgguacauauu

SEQ ID NO: 792388 - RNA, 26 nt, Human
uuuaacagcagugggaguagacaaga

SEQ ID NO: 792389 - RNA, 21 nt, Human
uuucucaguggugucgugguu

SEQ ID NO: 792390 - RNA, 21 nt, Human
uuugacuucucaagcuucagu

SEQ ID NO: 792391 - RNA, 21 nt, Human
uuuggcauugaaguacagcaa

SEQ ID NO: 792392 - RNA, 23 nt, Human
aaaaaaaaaagauacaagcccag

SEQ ID NO: 792393 - RNA, 29 nt, Human
aaaaaaaagauacaagcccagguaaagaa

SEQ ID NO: 792394 - RNA, 23 nt, Human
aaaaagauacaagcccagguaaa

SEQ ID NO: 792395 - RNA, 22 nt, Human
aaauauacacacacacagcaca

SEQ ID NO: 792396 - RNA, 18 nt, Human
aacaaaauguuuccuagu

SEQ ID NO: 792397 - RNA, 22 nt, Human
aacaugcaugcuuggaucuacu

SEQ ID NO: 792398 - RNA, 19 nt, Human
aacauggugaaaccccguc

SEQ ID NO: 792399 - RNA, 20 nt, Human
aacauggugaaaccccgucu

SEQ ID NO: 792400 - RNA, 21 nt, Human
aacauggugaaaccccgucuc

SEQ ID NO: 792401 - RNA, 22 nt, Human
aagaaaccagcacccacauugg

SEQ ID NO: 792402 - RNA, 20 nt, Human
aagaaacuggaucccugaag

SEQ ID NO: 792403 - RNA, 21 nt, Human
aagaagagaugcaggacaaaa

SEQ ID NO: 792404 - RNA, 23 nt, Human
aagagcaaaacucugucucaaaa

SEQ ID NO: 792405 - RNA, 26 nt, Human
aagcagguggauuaucugaggucagg

SEQ ID NO: 792406 - RNA, 23 nt, Human
aagguugcagugagccgagauug

SEQ ID NO: 792407 - RNA, 20 nt, Human
aaguagauucaaaucccaga

SEQ ID NO: 792408 - RNA, 23 nt, Human
aaguggcccucaacaucagaggu

SEQ ID NO: 792409 - RNA, 23 nt, Human
aaucgcuugaacccaggaggcga

SEQ ID NO: 792410 - RNA, 18 nt, Human
aauuagccaggcauggua

SEQ ID NO: 792411 - RNA, 20 nt, Human
acaaaauuugccuucaggag

SEQ ID NO: 792412 - RNA, 21 nt, Human
acacacacacagcacaaugua

SEQ ID NO: 792413 - RNA, 20 nt, Human
accagcacccacauugguca

SEQ ID NO: 792414 - RNA, 19 nt, Human
accaucagagccacauaua

SEQ ID NO: 792415 - RNA, 24 nt, Human
accccgucucuacuaaaaauacaa

SEQ ID NO: 792416 - RNA, 19 nt, Human
accugaggugcacucaggg

SEQ ID NO: 792417 - RNA, 23 nt, Human
accuguagucccagcuacuuggg

SEQ ID NO: 792418 - RNA, 28 nt, Human
acucugucucaaaaaaaaaaaaaaaaaa

SEQ ID NO: 792419 - RNA, 18 nt, Human
acugcacuccagccuggg

SEQ ID NO: 792420 - RNA, 19 nt, Human
acugcacuccagccugggc

SEQ ID NO: 792421 - RNA, 24 nt, Human
acugcacuccagccugggcgacaa

SEQ ID NO: 792422 - RNA, 21 nt, Human
agaaagccuuaacauaacaga

SEQ ID NO: 792423 - RNA, 24 nt, Human
agaaagccuuaacauaacagagaa

SEQ ID NO: 792424 - RNA, 24 nt, Human
agaagcagguggauuaucugaggu

SEQ ID NO: 792425 - RNA, 23 nt, Human
agacauggauggaaaaucuaagg

SEQ ID NO: 792426 - RNA, 21 nt, Human
agagaugcaggacaaaauggu

SEQ ID NO: 792427 - RNA, 25 nt, Human
agagaugggucacugagacuacauc

SEQ ID NO: 792428 - RNA, 20 nt, Human
agagauucaaacuuaccaua

SEQ ID NO: 792429 - RNA, 22 nt, Human
agauuuauacagaagaagggag

SEQ ID NO: 792430 - RNA, 19 nt, Human
agcaagacuucauaaauua

SEQ ID NO: 792431 - RNA, 20 nt, Human
agcacuuugggaggcagaag

SEQ ID NO: 792432 - RNA, 22 nt, Human
agccuggccaacauggugaaac

SEQ ID NO: 792433 - RNA, 24 nt, Human
agccuggccaacauggugaaaccc

SEQ ID NO: 792434 - RNA, 21 nt, Human
agcgggcaccuguagucccag

SEQ ID NO: 792435 - RNA, 18 nt, Human
agcuuccucuuaucuuuc

SEQ ID NO: 792436 - RNA, 22 nt, Human
aggagggugcccuauagaaaaa

SEQ ID NO: 792437 - RNA, 19 nt, Human
aggaugggauuagagaaag

SEQ ID NO: 792438 - RNA, 21 nt, Human
aggcacccagaaaccugauaa

SEQ ID NO: 792439 - RNA, 24 nt, Human
aggcacccagaaaccugauaagga

SEQ ID NO: 792440 - RNA, 24 nt, Human
aggcaugguagcgggcaccuguag

SEQ ID NO: 792441 - RNA, 21 nt, Human
aggcgaagguugcagugagcc

SEQ ID NO: 792442 - RNA, 24 nt, Human
aggcgaagguugcagugagccgag

SEQ ID NO: 792443 - RNA, 23 nt, Human
aggcuggagaaucgcuugaaccc

SEQ ID NO: 792444 - RNA, 24 nt, Human
aggguguuuaagggaaagaggagg

SEQ ID NO: 792445 - RNA, 20 nt, Human
aggugcacucagggaugacc

SEQ ID NO: 792446 - RNA, 22 nt, Human
agguggauuaucugaggucagg

SEQ ID NO: 792447 - RNA, 23 nt, Human
auaaacacaguccucugcccaaa

SEQ ID NO: 792448 - RNA, 19 nt, Human
auaauguuguuuggcaagg

SEQ ID NO: 792449 - RNA, 23 nt, Human
aucagagguagggcaucuggaag

SEQ ID NO: 792450 - RNA, 26 nt, Human
augacuuccaaacuguugaaacaaaa

SEQ ID NO: 792451 - RNA, 24 nt, Human
auugugccacugcacuccagccug

SEQ ID NO: 792452 - RNA, 22 nt, Human
caaagacuccaacaugccuucc

SEQ ID NO: 792453 - RNA, 24 nt, Human
caaauagaucaugcugccgucaaa

SEQ ID NO: 792454 - RNA, 24 nt, Human
caacauggugaaaccccgucucua

SEQ ID NO: 792455 - RNA, 18 nt, Human
caagaaaccagcacccac

SEQ ID NO: 792456 - RNA, 19 nt, Human
caagaaaccagcacccaca

SEQ ID NO: 792457 - RNA, 20 nt, Human
caagcuaaaagauacaagcc

SEQ ID NO: 792458 - RNA, 22 nt, Human
caaguagcagaagaaaaagucc

SEQ ID NO: 792459 - RNA, 18 nt, Human
cacaauguacaacaaaau

SEQ ID NO: 792460 - RNA, 23 nt, Human
caccuguagucccagcuacuugg

SEQ ID NO: 792461 - RNA, 24 nt, Human
caccuguagucccagcuacuuggg

SEQ ID NO: 792462 - RNA, 18 nt, Human
caccuuucuguaccggcu

SEQ ID NO: 792463 - RNA, 24 nt, Human
cacgccuguaaucccagcacuuug

SEQ ID NO: 792464 - RNA, 24 nt, Human
cacuccagccugggcgacaagagc

SEQ ID NO: 792465 - RNA, 19 nt, Human
cacugcacuccagccuggg

SEQ ID NO: 792466 - RNA, 20 nt, Human
cacugcacuccagccugggc

SEQ ID NO: 792467 - RNA, 22 nt, Human
cacugcacuccagccugggcga

SEQ ID NO: 792468 - RNA, 23 nt, Human
cacugcacuccagccugggcgac

SEQ ID NO: 792469 - RNA, 24 nt, Human
cacugcacuccagccugggcgaca

SEQ ID NO: 792470 - RNA, 27 nt, Human
cagaagcagguggauuaucugagguca

SEQ ID NO: 792471 - RNA, 26 nt, Human
cagaggcacccagaaaccugauaagg

SEQ ID NO: 792472 - RNA, 19 nt, Human
cagcacaauguacaacaaa

SEQ ID NO: 792473 - RNA, 19 nt, Human
cagcacaauguacaacaaa

SEQ ID NO: 792474 - RNA, 18 nt, Human
cagcacuuugggaggcag

SEQ ID NO: 792475 - RNA, 26 nt, Human
cagcacuuugggaggcagaagcaggu

SEQ ID NO: 792476 - RNA, 21 nt, Human
cagccaaaccacaggaccacc

SEQ ID NO: 792477 - RNA, 19 nt, Human
cagcuggcucuucuuuaau

SEQ ID NO: 792478 - RNA, 18 nt, Human
cagguggauuaucugagg

SEQ ID NO: 792479 - RNA, 24 nt, Human
cagguggauuaucugaggucagga

SEQ ID NO: 792480 - RNA, 23 nt, Human
caucuggaagucucaaaaugacc

SEQ ID NO: 792481 - RNA, 21 nt, Human
caugcaaacauacacuucuga

SEQ ID NO: 792482 - RNA, 23 nt, Human
caugcugccgucaaagacuccaa

SEQ ID NO: 792483 - RNA, 19 nt, Human
cauguuucacuccugcgca

SEQ ID NO: 792484 - RNA, 21 nt, Human
ccaaaacagguccucagaaaa

SEQ ID NO: 792485 - RNA, 26 nt, Human
ccaaacaaaccagauauauuucagaa

SEQ ID NO: 792486 - RNA, 23 nt, Human
ccaaucuacaggccaggcaacau

SEQ ID NO: 792487 - RNA, 21 nt, Human
ccacagaaaaaagaucaugac

SEQ ID NO: 792488 - RNA, 20 nt, Human
ccacugcacuccagccuggg

SEQ ID NO: 792489 - RNA, 21 nt, Human
ccacugcacuccagccugggc

SEQ ID NO: 792490 - RNA, 21 nt, Human
ccacugcacuccagccugggc

SEQ ID NO: 792491 - RNA, 24 nt, Human
ccacugcacuccagccugggcgac

SEQ ID NO: 792492 - RNA, 22 nt, Human
ccaggaggcgaagguugcagug

SEQ ID NO: 792493 - RNA, 23 nt, Human
ccuggccaacauggugaaacccc

SEQ ID NO: 792494 - RNA, 24 nt, Human
ccuggccaacauggugaaaccccg

SEQ ID NO: 792495 - RNA, 21 nt, Human
ccuguagucccagcuacuugg

SEQ ID NO: 792496 - RNA, 21 nt, Human
ccuucaggaucuuaaggcaga

SEQ ID NO: 792497 - RNA, 23 nt, Human
cgccuguaaucccagcacuuugg

SEQ ID NO: 792498 - RNA, 24 nt, Human
cgccuguaaucccagcacuuuggg

SEQ ID NO: 792499 - RNA, 21 nt, Human
cgggcaccuguagucccagcu

SEQ ID NO: 792500 - RNA, 24 nt, Human
cgugaccagccuggccaacauggu

SEQ ID NO: 792501 - RNA, 21 nt, Human
cuauagaaaaagaugcagaga

SEQ ID NO: 792502 - RNA, 24 nt, Human
cucaaaaugaccaaacaaaccaga

SEQ ID NO: 792503 - RNA, 22 nt, Human
cucacgccuguaaucccagcac

SEQ ID NO: 792504 - RNA, 24 nt, Human
cucacgccuguaaucccagcacuu

SEQ ID NO: 792505 - RNA, 22 nt, Human
cuccaacaugccuucccaagcc

SEQ ID NO: 792506 - RNA, 19 nt, Human
cucugucucaaaaaaaaaa

SEQ ID NO: 792507 - RNA, 24 nt, Human
cugcaagaggaagaagaaaacuaa

SEQ ID NO: 792508 - RNA, 21 nt, Human
cugcuauauaaacaaugaccu

SEQ ID NO: 792509 - RNA, 22 nt, Human
cuggaaaauaacuucaccacaa

SEQ ID NO: 792510 - RNA, 19 nt, Human
cuggaucccugaagcuuag

SEQ ID NO: 792511 - RNA, 24 nt, Human
cuuaaacucaaguagauucaaauc

SEQ ID NO: 792512 - RNA, 23 nt, Human
cuuccugacaauauaccagcugg

SEQ ID NO: 792513 - RNA, 20 nt, Human
cuucucuccauagaacugau

SEQ ID NO: 792514 - RNA, 24 nt, Human
gaaaaaguccagaaacauaucccu

SEQ ID NO: 792515 - RNA, 22 nt, Human
gaagguugcagugagccgagau

SEQ ID NO: 792516 - RNA, 24 nt, Human
gaagguugcagugagccgagauug

SEQ ID NO: 792517 - RNA, 20 nt, Human
gagaaaacagagugagggga

SEQ ID NO: 792518 - RNA, 21 nt, Human
gagaaagaaaggagcaugucc

SEQ ID NO: 792519 - RNA, 23 nt, Human
gagauugugccacugcacuccag

SEQ ID NO: 792520 - RNA, 19 nt, Human
gagugaggggagcuaagga

SEQ ID NO: 792521 - RNA, 23 nt, Human
gaucaugcugccgucaaagacuc

SEQ ID NO: 792522 - RNA, 18 nt, Human
gauuaucugaggucagga

SEQ ID NO: 792523 - RNA, 23 nt, Human
gauuaucugaggucaggaguucg

SEQ ID NO: 792524 - RNA, 19 nt, Human
gcagaguggcuggcuuccc

SEQ ID NO: 792525 - RNA, 24 nt, Human
gccaacauggugaaaccccgucuc

SEQ ID NO: 792526 - RNA, 24 nt, Human
gccaaucuacaggccaggcaacau

SEQ ID NO: 792527 - RNA, 18 nt, Human
gccacagaaaaaagauca

SEQ ID NO: 792528 - RNA, 22 nt, Human
gccacagaaaaaagaucaugac

SEQ ID NO: 792529 - RNA, 22 nt, Human
gccacugcacuccagccugggc

SEQ ID NO: 792530 - RNA, 24 nt, Human
gccacugcacuccagccugggcga

SEQ ID NO: 792531 - RNA, 21 nt, Human
ggacagcucagccaaaccaca

SEQ ID NO: 792532 - RNA, 22 nt, Human
ggaggcgaagguugcagugagc

SEQ ID NO: 792533 - RNA, 18 nt, Human
ggaggcuaaggcuggaga

SEQ ID NO: 792534 - RNA, 19 nt, Human
ggauagcaauucacauuca

SEQ ID NO: 792535 - RNA, 22 nt, Human
ggauuaucugaggucaggaguu

SEQ ID NO: 792536 - RNA, 24 nt, Human
ggcaccuguagucccagcuacuug

SEQ ID NO: 792537 - RNA, 23 nt, Human
ggcaugguggcucacgccuguaa

SEQ ID NO: 792538 - RNA, 19 nt, Human
gguaaagagagaaccugag

SEQ ID NO: 792539 - RNA, 24 nt, Human
gguagcgggcaccuguagucccag

SEQ ID NO: 792540 - RNA, 21 nt, Human
ggucauauuggcuuugccggc

SEQ ID NO: 792541 - RNA, 24 nt, Human
gguggcucacgccuguaaucccag

SEQ ID NO: 792542 - RNA, 24 nt, Human
guugcagugagccgagauugugcc

SEQ ID NO: 792543 - RNA, 23 nt, Human
uaaaacaagagagaugaaaaugc

SEQ ID NO: 792544 - RNA, 25 nt, Human
uaaaauauacacacacacagcacaa

SEQ ID NO: 792545 - RNA, 25 nt, Human
uaaacacaguccucugcccaaacaa

SEQ ID NO: 792546 - RNA, 18 nt, Human
uaaggaaaagggagggug

SEQ ID NO: 792547 - RNA, 23 nt, Human
uaaggaaaagggaggguguuuaa

SEQ ID NO: 792548 - RNA, 19 nt, Human
uaaggagagaaauaagugg

SEQ ID NO: 792549 - RNA, 22 nt, Human
uaaggcagaggcacccagaaac

SEQ ID NO: 792550 - RNA, 23 nt, Human
uaaggcagaggcacccagaaacc

SEQ ID NO: 792551 - RNA, 23 nt, Human
uaaggcagaggcacccagaaacc

SEQ ID NO: 792552 - RNA, 24 nt, Human
uaaggcagaggcacccagaaaccu

SEQ ID NO: 792553 - RNA, 24 nt, Human
uaaggcuggagaaucgcuugaacc

SEQ ID NO: 792554 - RNA, 21 nt, Human
uaagggaaagaggaggguaag

SEQ ID NO: 792555 - RNA, 31 nt, Human
uacaagcccagccgggcaugguggcucacgg

SEQ ID NO: 792556 - RNA, 19 nt, Human
uacaaugcuucaaaggcuc

SEQ ID NO: 792557 - RNA, 18 nt, Human
uacagcaggauaaggaca

SEQ ID NO: 792558 - RNA, 23 nt, Human
uagagaggguauccacucuguuc

SEQ ID NO: 792559 - RNA, 21 nt, Human
uagcagaagaaaaaguccaga

SEQ ID NO: 792560 - RNA, 20 nt, Human
uagcuuccucuuaucuuucu

SEQ ID NO: 792561 - RNA, 21 nt, Human
uaggucccaggcccuuaaacu

SEQ ID NO: 792562 - RNA, 22 nt, Human
uauagaaaaagaugcagagaag

SEQ ID NO: 792563 - RNA, 18 nt, Human
uaucuuagacaccugggu

SEQ ID NO: 792564 - RNA, 22 nt, Human
uauuucagaaggacaagaaacu

SEQ ID NO: 792565 - RNA, 22 nt, Human
ucaaaaaaaaaaaaaaaaaaaa

SEQ ID NO: 792566 - RNA, 23 nt, Human
ucaaaaaaaaaaaaaaaaaaaaa

SEQ ID NO: 792567 - RNA, 22 nt, Human
ucacaagaaaccagcacccaca

SEQ ID NO: 792568 - RNA, 25 nt, Human
ucagagccacauauaacacaacaug

SEQ ID NO: 792569 - RNA, 19 nt, Human
uccagccugggcgacaaga

SEQ ID NO: 792570 - RNA, 18 nt, Human
ucccaccaaaacaggucc

SEQ ID NO: 792571 - RNA, 20 nt, Human
ucccaccaaaacagguccuc

SEQ ID NO: 792572 - RNA, 20 nt, Human
ucccugaauagaagagaaaa

SEQ ID NO: 792573 - RNA, 23 nt, Human
uccucugcccaaacaaucccacc

SEQ ID NO: 792574 - RNA, 22 nt, Human
ucucuacuaaaaauacaaaaaa

SEQ ID NO: 792575 - RNA, 23 nt, Human
ucugaggucaggaguucgugacc

SEQ ID NO: 792576 - RNA, 23 nt, Human
ucugucucaaaaaaaaaaaaaaa

SEQ ID NO: 792577 - RNA, 19 nt, Human
ucuuucugggauuugcccu

SEQ ID NO: 792578 - RNA, 19 nt, Human
ugaaacaaaauuugccuuc

SEQ ID NO: 792579 - RNA, 18 nt, Human
ugacaauauaccagcugg

SEQ ID NO: 792580 - RNA, 19 nt, Human
ugaccaaacaaaccagaua

SEQ ID NO: 792581 - RNA, 18 nt, Human
ugacuuccaguucuccuc

SEQ ID NO: 792582 - RNA, 22 nt, Human
ugagccgagauugugccacugc

SEQ ID NO: 792583 - RNA, 20 nt, Human
ugaggggagcuaaggagggu

SEQ ID NO: 792584 - RNA, 21 nt, Human
ugaggggagcuaaggagggug

SEQ ID NO: 792585 - RNA, 22 nt, Human
ugaggggagcuaaggagggugc

SEQ ID NO: 792586 - RNA, 21 nt, Human
ugaggucaggaguucgugacc

SEQ ID NO: 792587 - RNA, 18 nt, Human
ugcccuauagaaaaagau

SEQ ID NO: 792588 - RNA, 27 nt, Human
ugccugcaaggagaaggaggcuuaggg

SEQ ID NO: 792589 - RNA, 19 nt, Human
ugccuucccaagccuuugc

SEQ ID NO: 792590 - RNA, 21 nt, Human
uggaagucucaaaaugaccaa

SEQ ID NO: 792591 - RNA, 23 nt, Human
uggaucccugaagcuuaggacau

SEQ ID NO: 792592 - RNA, 22 nt, Human
uggauggaaaaucuaaggaaau

SEQ ID NO: 792593 - RNA, 24 nt, Human
uggauuaucugaggucaggaguuc

SEQ ID NO: 792594 - RNA, 18 nt, Human
uggcaaaaacggggucua

SEQ ID NO: 792595 - RNA, 24 nt, Human
uggccaacauggugaaaccccguc

SEQ ID NO: 792596 - RNA, 22 nt, Human
uggcucacgccuguaaucccag

SEQ ID NO: 792597 - RNA, 24 nt, Human
uggcucacgccuguaaucccagca

SEQ ID NO: 792598 - RNA, 24 nt, Human
ugggaggcagaagcagguggauua

SEQ ID NO: 792599 - RNA, 23 nt, Human
ugggaggcuaaggcuggagaauc

SEQ ID NO: 792600 - RNA, 24 nt, Human
ugguagcgggcaccuguaguccca

SEQ ID NO: 792601 - RNA, 24 nt, Human
ugguggcucacgccuguaauccca

SEQ ID NO: 792602 - RNA, 21 nt, Human
uuaauagacauggauggaaaa

SEQ ID NO: 792603 - RNA, 21 nt, Human
uucacaagaaaccagcaccca

SEQ ID NO: 792604 - RNA, 23 nt, Human
uucaccacaacacuaaaauauac

SEQ ID NO: 792605 - RNA, 19 nt, Human
uucaccauaccacacauuu

SEQ ID NO: 792606 - RNA, 18 nt, Human
uucauguuucacuccugc

SEQ ID NO: 792607 - RNA, 21 nt, Human
uucugcaacugaagauuccau

SEQ ID NO: 792608 - RNA, 18 nt, Human
uugcagugagccgagauu

SEQ ID NO: 792609 - RNA, 22 nt, Human
uugcagugagccgagauugugc

SEQ ID NO: 792610 - RNA, 20 nt, Human
uugggaggcagaagcaggug

SEQ ID NO: 792611 - RNA, 24 nt, Human
uugggaggcuaaggcuggagaauc

SEQ ID NO: 792612 - RNA, 23 nt, Human
uugugccacugcacuccagccug

SEQ ID NO: 792613 - RNA, 21 nt, Human
aaacacaggaggucacugacu

SEQ ID NO: 792614 - RNA, 19 nt, Human
aaagaauauucaugagagu

SEQ ID NO: 792615 - RNA, 19 nt, Human
aacacacaaacugaugucc

SEQ ID NO: 792616 - RNA, 20 nt, Human
aaccaagcacccccuuccua

SEQ ID NO: 792617 - RNA, 20 nt, Human
aaccccucaaaccaagcacc

SEQ ID NO: 792618 - RNA, 24 nt, Human
aagggacuugguacagaccaucaa

SEQ ID NO: 792619 - RNA, 21 nt, Human
aaugaaaagguacucucuaaa

SEQ ID NO: 792620 - RNA, 19 nt, Human
accuugguuaccucucccc

SEQ ID NO: 792621 - RNA, 28 nt, Human
agaaacaauaaaaagucugccgguaccc

SEQ ID NO: 792622 - RNA, 22 nt, Human
agacaagaacauagacaaggga

SEQ ID NO: 792623 - RNA, 19 nt, Human
aggaaacaaaaaaggcaag

SEQ ID NO: 792624 - RNA, 23 nt, Human
aguuaagaaacaauaaaaagucu

SEQ ID NO: 792625 - RNA, 18 nt, Human
auacaccaguuuguaaaa

SEQ ID NO: 792626 - RNA, 27 nt, Human
auacagcaguaauuaaaagcagugcaa

SEQ ID NO: 792627 - RNA, 20 nt, Human
augaaagguagccacuuuca

SEQ ID NO: 792628 - RNA, 19 nt, Human
auucugaaagacaagaaca

SEQ ID NO: 792629 - RNA, 21 nt, Human
caagggacuugguacagacca

SEQ ID NO: 792630 - RNA, 27 nt, Human
caaguguccuuaacuuuucaguacuuc

SEQ ID NO: 792631 - RNA, 21 nt, Human
cacaauuccuacagaacacac

SEQ ID NO: 792632 - RNA, 21 nt, Human
cacacaauuccuacagaacac

SEQ ID NO: 792633 - RNA, 20 nt, Human
cacccccuuccuauguccag

SEQ ID NO: 792634 - RNA, 20 nt, Human
cagauauuugcgaauauccc

SEQ ID NO: 792635 - RNA, 19 nt, Human
caguaauuaaaagcagugc

SEQ ID NO: 792636 - RNA, 19 nt, Human
cagugcaaauaucuuugga

SEQ ID NO: 792637 - RNA, 23 nt, Human
ccccucaaaccaagcacccccuu

SEQ ID NO: 792638 - RNA, 26 nt, Human
ccuacagaacacacaaacugaugucc

SEQ ID NO: 792639 - RNA, 24 nt, Human
cuccacuuuauuauuuuauaacaa

SEQ ID NO: 792640 - RNA, 31 nt, Human
cuccccaugccuaugugcugucuuuccucaa

SEQ ID NO: 792641 - RNA, 18 nt, Human
cuccugaauuucaggacu

SEQ ID NO: 792642 - RNA, 22 nt, Human
gauuuguaauucaaaucaucac

SEQ ID NO: 792643 - RNA, 23 nt, Human
gcagugcaaauaucuuuggaggu

SEQ ID NO: 792644 - RNA, 22 nt, Human
gcgaauaucccauccaaaaauu

SEQ ID NO: 792645 - RNA, 24 nt, Human
uaaaaauuauucugaaagacaaga

SEQ ID NO: 792646 - RNA, 24 nt, Human
uaaaauucaccuugguuaccucuc

SEQ ID NO: 792647 - RNA, 24 nt, Human
uaaccccucaaaccaagcaccccc

SEQ ID NO: 792648 - RNA, 22 nt, Human
uaacuuuucaguacuucucugu

SEQ ID NO: 792649 - RNA, 21 nt, Human
uacaccaguuuguaaaauuca

SEQ ID NO: 792650 - RNA, 21 nt, Human
uagcccccaaguguccuuaac

SEQ ID NO: 792651 - RNA, 25 nt, Human
uagcuuucccaggaaaugaauguaa

SEQ ID NO: 792652 - RNA, 18 nt, Human
uauaauacagauauuugc

SEQ ID NO: 792653 - RNA, 26 nt, Human
uauucauuuuucaaaaaggccucaca

SEQ ID NO: 792654 - RNA, 18 nt, Human
uauucuuucauaauuuaa

SEQ ID NO: 792655 - RNA, 22 nt, Human
uccaaaaggcacagaguaaugc

SEQ ID NO: 792656 - RNA, 23 nt, Human
uccacuuuauuauuuuauaacaa

SEQ ID NO: 792657 - RNA, 21 nt, Human
uccagcacucuuuucuacuuc

SEQ ID NO: 792658 - RNA, 25 nt, Human
uccuacaucaucccauaauucaaaa

SEQ ID NO: 792659 - RNA, 18 nt, Human
ucuacaagaucuuuucca

SEQ ID NO: 792660 - RNA, 19 nt, Human
ucucugcaggcuggggagu

SEQ ID NO: 792661 - RNA, 18 nt, Human
ugaaaagguacucucuaa

SEQ ID NO: 792662 - RNA, 21 nt, Human
ugacuaagaaguuuagagcuc

SEQ ID NO: 792663 - RNA, 25 nt, Human
ugcaagaacauaaaacugaggaaac

SEQ ID NO: 792664 - RNA, 26 nt, Human
ugcaagaacauaaaacugaggaaaca

SEQ ID NO: 792665 - RNA, 21 nt, Human
ugcacacaauuccuacagaac

SEQ ID NO: 792666 - RNA, 22 nt, Human
ugcauuauucuuucauaauuua

SEQ ID NO: 792667 - RNA, 21 nt, Human
uggccacaucuacaagaucuu

SEQ ID NO: 792668 - RNA, 21 nt, Human
uggcuccugaauuucaggacu

SEQ ID NO: 792669 - RNA, 21 nt, Human
ugugugaauggaaugcacaca

SEQ ID NO: 792670 - RNA, 20 nt, Human
ugugugaauggaaugcacca

SEQ ID NO: 792671 - RNA, 21 nt, Human
uguuuacugggggcuucuuuc

SEQ ID NO: 792672 - RNA, 18 nt, Human
uguuuuauaaacuugaau

SEQ ID NO: 792673 - RNA, 21 nt, Human
uucacuguagguaaaugaaau

SEQ ID NO: 792674 - RNA, 24 nt, Human
uugauuuguaauuuuuucguuccu

SEQ ID NO: 792675 - RNA, 25 nt, Human
uuuagagggaaaaaaguagccccca

SEQ ID NO: 792676 - RNA, 19 nt, Human
aaaaaaaaaaaaaagaaga

SEQ ID NO: 792677 - RNA, 21 nt, Human
aaaaaaaaaaaaagaagaaga

SEQ ID NO: 792678 - RNA, 19 nt, Human
aaaaaaaaaaagaagaaga

SEQ ID NO: 792679 - RNA, 19 nt, Human
aaaaaaaagaagaagaaaa

SEQ ID NO: 792680 - RNA, 18 nt, Human
aaaaagaagaagaaaaag

SEQ ID NO: 792681 - RNA, 24 nt, Human
aaaaauacaaaauuuagccacgca

SEQ ID NO: 792682 - RNA, 22 nt, Human
aaaagaagaagaaaaagaaaaa

SEQ ID NO: 792683 - RNA, 23 nt, Human
aaacccuggcucuauuaaaaaua

SEQ ID NO: 792684 - RNA, 23 nt, Human
aaacuaaaaauuugucucucaau

SEQ ID NO: 792685 - RNA, 19 nt, Human
aaagaagaagaaaaagaaa

SEQ ID NO: 792686 - RNA, 24 nt, Human
aaagugcugggauuacaggcguga

SEQ ID NO: 792687 - RNA, 23 nt, Human
aaaugcuuauuuuuugaacucuu

SEQ ID NO: 792688 - RNA, 19 nt, Human
aacaaaaguaaauuuaaau

SEQ ID NO: 792689 - RNA, 20 nt, Human
aacaagaucuguguuacaag

SEQ ID NO: 792690 - RNA, 22 nt, Human
aacauggcaaaacccuggcucu

SEQ ID NO: 792691 - RNA, 18 nt, Human
aagaagaaaaagaaaaac

SEQ ID NO: 792692 - RNA, 21 nt, Human
aagaagaaaaagaaaaacuaa

SEQ ID NO: 792693 - RNA, 18 nt, Human
aagaagaagaaaaagaaa

SEQ ID NO: 792694 - RNA, 21 nt, Human
aagcugggcggaucaccuaaa

SEQ ID NO: 792695 - RNA, 19 nt, Human
aagugcugggauuacaggc

SEQ ID NO: 792696 - RNA, 19 nt, Human
aagugcugggauuacaggc

SEQ ID NO: 792697 - RNA, 26 nt, Human
aagugcugggauuacaggcgugagcc

SEQ ID NO: 792698 - RNA, 24 nt, Human
aaucacuugaacccuggagacgga

SEQ ID NO: 792699 - RNA, 24 nt, Human
aauuuuguauuuuuaguagagaug

SEQ ID NO: 792700 - RNA, 19 nt, Human
acauuccuuauuugcagga

SEQ ID NO: 792701 - RNA, 25 nt, Human
accuaaagucucgaguucgagacca

SEQ ID NO: 792702 - RNA, 25 nt, Human
accuuuuaccuacacccuugaguaa

SEQ ID NO: 792703 - RNA, 19 nt, Human
acgcauggugguuugcgcc

SEQ ID NO: 792704 - RNA, 19 nt, Human
acuccagccugggggggcg

SEQ ID NO: 792705 - RNA, 22 nt, Human
acuguacuccagccuggggggg

SEQ ID NO: 792706 - RNA, 26 nt, Human
acuguacuccagccugggggggcgau

SEQ ID NO: 792707 - RNA, 19 nt, Human
acuuugucacccaggacgg

SEQ ID NO: 792708 - RNA, 25 nt, Human
agaaccucuuuacuuagauuuucau

SEQ ID NO: 792709 - RNA, 20 nt, Human
agaagaaaaagaaaaacuaa

SEQ ID NO: 792710 - RNA, 20 nt, Human
agacggagguugcagugagc

SEQ ID NO: 792711 - RNA, 24 nt, Human
agacggagguugcagugagcugag

SEQ ID NO: 792712 - RNA, 19 nt, Human
agagaauucuauggccaca

SEQ ID NO: 792713 - RNA, 18 nt, Human
agccuggccaacauggca

SEQ ID NO: 792714 - RNA, 24 nt, Human
agccuggccaacauggcaaaaccc

SEQ ID NO: 792715 - RNA, 18 nt, Human
aggcaggagaaucacuug

SEQ ID NO: 792716 - RNA, 23 nt, Human
aggcaggagaaucacuugaaccc

SEQ ID NO: 792717 - RNA, 24 nt, Human
aggcgcaguggcuaacaccuguaa

SEQ ID NO: 792718 - RNA, 23 nt, Human
aggcgugagccaccgugcccggc

SEQ ID NO: 792719 - RNA, 24 nt, Human
aggcugaggcaggagaaucacuug

SEQ ID NO: 792720 - RNA, 24 nt, Human
aggugaucuacccaccuuugccuc

SEQ ID NO: 792721 - RNA, 22 nt, Human
aguagagauggcguuucuccau

SEQ ID NO: 792722 - RNA, 21 nt, Human
aguagcugggauuacaggcau

SEQ ID NO: 792723 - RNA, 24 nt, Human
agugauucuccugccucagccucc

SEQ ID NO: 792724 - RNA, 18 nt, Human
agugcugggauuacaggc

SEQ ID NO: 792725 - RNA, 25 nt, Human
auaaauucucugauguugaacaaag

SEQ ID NO: 792726 - RNA, 23 nt, Human
auagagcaagacuccaucuaaaa

SEQ ID NO: 792727 - RNA, 24 nt, Human
auaugccugaaaaaacuaacaaaa

SEQ ID NO: 792728 - RNA, 19 nt, Human
augaauuaccuuaccuaca

SEQ ID NO: 792729 - RNA, 24 nt, Human
auggcguuucuccauguuggucag

SEQ ID NO: 792730 - RNA, 24 nt, Human
caaagugcugggauuacaggcgug

SEQ ID NO: 792731 - RNA, 20 nt, Human
caagcugggcggaucaccua

SEQ ID NO: 792732 - RNA, 20 nt, Human
caagugauucuccugccuca

SEQ ID NO: 792733 - RNA, 22 nt, Human
caagugauucuccugccucagc

SEQ ID NO: 792734 - RNA, 24 nt, Human
caaucguauauuuuaaaaaaacua

SEQ ID NO: 792735 - RNA, 23 nt, Human
caccgcaaccucugcuucccggg

SEQ ID NO: 792736 - RNA, 22 nt, Human
caccuguaauugcagcauugcg

SEQ ID NO: 792737 - RNA, 24 nt, Human
caccuguaauugcagcauugcggg

SEQ ID NO: 792738 - RNA, 18 nt, Human
cacuguacuccagccugg

SEQ ID NO: 792739 - RNA, 19 nt, Human
cacuguacuccagccuggg

SEQ ID NO: 792740 - RNA, 19 nt, Human
cacuguacuccagccuggg

SEQ ID NO: 792741 - RNA, 20 nt, Human
cacuguacuccagccugggg

SEQ ID NO: 792742 - RNA, 25 nt, Human
cacuguacuccagccugggggggcg

SEQ ID NO: 792743 - RNA, 24 nt, Human
cacuuugucacccaggacggagug

SEQ ID NO: 792744 - RNA, 22 nt, Human
cagaauaugccauauauaacau

SEQ ID NO: 792745 - RNA, 22 nt, Human
cagaaugaauacaacaagaucu

SEQ ID NO: 792746 - RNA, 19 nt, Human
cagcacuuuaaaugcuuau

SEQ ID NO: 792747 - RNA, 24 nt, Human
cagccacuugggaggcugaggcag

SEQ ID NO: 792748 - RNA, 24 nt, Human
cauguuggucaggcuggucuugaa

SEQ ID NO: 792749 - RNA, 20 nt, Human
cauuuucauaaaaguaaaau

SEQ ID NO: 792750 - RNA, 21 nt, Human
cauuuucauaaaaguaaaauu

SEQ ID NO: 792751 - RNA, 22 nt, Human
ccaaagugcugggauuacaggc

SEQ ID NO: 792752 - RNA, 22 nt, Human
ccaaagugcugggauuacaggc

SEQ ID NO: 792753 - RNA, 24 nt, Human
ccaaagugcugggauuacaggcgu

SEQ ID NO: 792754 - RNA, 19 nt, Human
ccacuguacuccagccugg

SEQ ID NO: 792755 - RNA, 20 nt, Human
ccacuguacuccagccuggg

SEQ ID NO: 792756 - RNA, 20 nt, Human
ccacuguacuccagccuggg

SEQ ID NO: 792757 - RNA, 24 nt, Human
ccacuguacuccagccuggggggg

SEQ ID NO: 792758 - RNA, 25 nt, Human
ccacuguacuccagccugggggggc

SEQ ID NO: 792759 - RNA, 25 nt, Human
ccaucuaaaaaaaaaaaaaaaaaga

SEQ ID NO: 792760 - RNA, 19 nt, Human
ccauguuggucaggcuggu

SEQ ID NO: 792761 - RNA, 24 nt, Human
cccgaccucaggugaucuacccac

SEQ ID NO: 792762 - RNA, 23 nt, Human
cccgaguagcugggauuacaggc

SEQ ID NO: 792763 - RNA, 24 nt, Human
cccgaguagcugggauuacaggca

SEQ ID NO: 792764 - RNA, 23 nt, Human
cccggguucaagugauucuccuc

SEQ ID NO: 792765 - RNA, 23 nt, Human
cccggguucaagugauucuccug

SEQ ID NO: 792766 - RNA, 23 nt, Human
ccgaguagcugggauuacaggca

SEQ ID NO: 792767 - RNA, 24 nt, Human
ccgaguagcugggauuacaggcau

SEQ ID NO: 792768 - RNA, 23 nt, Human
ccgcaaccucugcuucccggguu

SEQ ID NO: 792769 - RNA, 24 nt, Human
ccgcaaccucugcuucccggguuc

SEQ ID NO: 792770 - RNA, 23 nt, Human
ccugccucagccucccgaguagc

SEQ ID NO: 792771 - RNA, 20 nt, Human
ccuggagacggagguugcag

SEQ ID NO: 792772 - RNA, 22 nt, Human
ccuggccaacauggcaaaaccc

SEQ ID NO: 792773 - RNA, 24 nt, Human
ccuggccaacauggcaaaacccug

SEQ ID NO: 792774 - RNA, 22 nt, Human
ccuguaaucccagccacuuggg

SEQ ID NO: 792775 - RNA, 26 nt, Human
ccuguaauugcagcauugcgggaggc

SEQ ID NO: 792776 - RNA, 22 nt, Human
ccuugaguaagguggacuaggu

SEQ ID NO: 792777 - RNA, 21 nt, Human
cgagaccagccuggccaacau

SEQ ID NO: 792778 - RNA, 21 nt, Human
cgccuguaaucccagccacuu

SEQ ID NO: 792779 - RNA, 23 nt, Human
cgccuguaaucccagccacuugg

SEQ ID NO: 792780 - RNA, 23 nt, Human
cggagugccauggcaugaucucg

SEQ ID NO: 792781 - RNA, 24 nt, Human
cggagugccauggcaugaucucgg

SEQ ID NO: 792782 - RNA, 24 nt, Human
cggaucaccuaaagucucgaguuc

SEQ ID NO: 792783 - RNA, 25 nt, Human
cgugagccaccgugcccggccuugu

SEQ ID NO: 792784 - RNA, 24 nt, Human
cuaauuuuguauuuuuaguagaga

SEQ ID NO: 792785 - RNA, 24 nt, Human
cucaccgcaaccucugcuucccgg

SEQ ID NO: 792786 - RNA, 24 nt, Human
cucagccucccgaguagcugggau

SEQ ID NO: 792787 - RNA, 24 nt, Human
cuccauguuggucaggcuggucuu

SEQ ID NO: 792788 - RNA, 23 nt, Human
cugccucagccucccgaguagcu

SEQ ID NO: 792789 - RNA, 23 nt, Human
cugggcggaucaccuaaagucuc

SEQ ID NO: 792790 - RNA, 19 nt, Human
cuuagauuuucaucaugca

SEQ ID NO: 792791 - RNA, 21 nt, Human
cuucccggguucaagugauuc

SEQ ID NO: 792792 - RNA, 24 nt, Human
cuucccggguucaagugauucucc

SEQ ID NO: 792793 - RNA, 20 nt, Human
gaauucuauggccacauccc

SEQ ID NO: 792794 - RNA, 24 nt, Human
gaccucaggugaucuacccaccuu

SEQ ID NO: 792795 - RNA, 21 nt, Human
gagagggagucucacuuuguc

SEQ ID NO: 792796 - RNA, 23 nt, Human
gagguugcagugagcugagaucg

SEQ ID NO: 792797 - RNA, 24 nt, Human
gaguagcugggauuacaggcaugc

SEQ ID NO: 792798 - RNA, 24 nt, Human
gaucaccuaaagucucgaguucga

SEQ ID NO: 792799 - RNA, 18 nt, Human
gauuacaggcaugcgcca

SEQ ID NO: 792800 - RNA, 24 nt, Human
gauuacaggcaugcgccaccaugc

SEQ ID NO: 792801 - RNA, 18 nt, Human
gauuacaggcgugagcca

SEQ ID NO: 792802 - RNA, 21 nt, Human
gauuacaggcgugagccaccg

SEQ ID NO: 792803 - RNA, 24 nt, Human
gauuacaggcgugagccaccgugc

SEQ ID NO: 792804 - RNA, 18 nt, Human
gcagaauauuacucagaa

SEQ ID NO: 792805 - RNA, 23 nt, Human
gcaggagaaucacuugaacccug

SEQ ID NO: 792806 - RNA, 22 nt, Human
gcauggugguuugcgccuguaa

SEQ ID NO: 792807 - RNA, 19 nt, Human
gccacuguacuccagccug

SEQ ID NO: 792808 - RNA, 22 nt, Human
gccacuguacuccagccugggg

SEQ ID NO: 792809 - RNA, 23 nt, Human
gcuggucuugaacucccgaccuc

SEQ ID NO: 792810 - RNA, 22 nt, Human
ggagguugcagugagcugagau

SEQ ID NO: 792811 - RNA, 24 nt, Human
ggagguugcagugagcugagaucg

SEQ ID NO: 792812 - RNA, 24 nt, Human
ggauuacaggcaugcgccaccaug

SEQ ID NO: 792813 - RNA, 22 nt, Human
ggcguuucuccauguuggucag

SEQ ID NO: 792814 - RNA, 24 nt, Human
ggcuggucuugaacucccgaccuc

SEQ ID NO: 792815 - RNA, 19 nt, Human
gggaaaaaauaaauaaaaa

SEQ ID NO: 792816 - RNA, 23 nt, Human
gggaggccaagcugggcggauca

SEQ ID NO: 792817 - RNA, 22 nt, Human
ggguucaagugauucuccugcc

SEQ ID NO: 792818 - RNA, 24 nt, Human
ggugguuugcgccuguaaucccag

SEQ ID NO: 792819 - RNA, 21 nt, Human
gguuugcgccuguaaucccag

SEQ ID NO: 792820 - RNA, 18 nt, Human
guagcugggauuacaggc

SEQ ID NO: 792821 - RNA, 20 nt, Human
guagcugggauuacaggcau

SEQ ID NO: 792822 - RNA, 24 nt, Human
gugaucuacccaccuuugccuccc

SEQ ID NO: 792823 - RNA, 24 nt, Human
gugauucuccugccucagccuccc

SEQ ID NO: 792824 - RNA, 24 nt, Human
guugcagugagcugagaucgugcc

SEQ ID NO: 792825 - RNA, 19 nt, Human
uaaaaaaacuaaaacugua

SEQ ID NO: 792826 - RNA, 25 nt, Human
uaaaaauaacccuguagucaauaac

SEQ ID NO: 792827 - RNA, 20 nt, Human
uaaaaauacaaaauuuagcc

SEQ ID NO: 792828 - RNA, 21 nt, Human
uaaaaauacaaaauuuagcca

SEQ ID NO: 792829 - RNA, 22 nt, Human
uaaaacuaaaaauuugucucuc

SEQ ID NO: 792830 - RNA, 19 nt, Human
uaaaguuaccacaacuucg

SEQ ID NO: 792831 - RNA, 25 nt, Human
uaaaugcucaccuaauaaaaaauaa

SEQ ID NO: 792832 - RNA, 24 nt, Human
uacaaaaaauaaauucuaaaggug

SEQ ID NO: 792833 - RNA, 22 nt, Human
uacaggcaugcgccaccaugcc

SEQ ID NO: 792834 - RNA, 23 nt, Human
uacaggcgugagccaccgugccc

SEQ ID NO: 792835 - RNA, 22 nt, Human
uacccaccuuugccucccaaag

SEQ ID NO: 792836 - RNA, 23 nt, Human
uacccaccuuugccucccaaagu

SEQ ID NO: 792837 - RNA, 22 nt, Human
uacugcauuuucauaaaaguaa

SEQ ID NO: 792838 - RNA, 18 nt, Human
uacuguauaugcaaaaau

SEQ ID NO: 792839 - RNA, 24 nt, Human
uaguagagauggcguuucuccaug

SEQ ID NO: 792840 - RNA, 19 nt, Human
uaucagaauaugccauaua

SEQ ID NO: 792841 - RNA, 24 nt, Human
uauuuauuuuuugagagggagucu

SEQ ID NO: 792842 - RNA, 19 nt, Human
ucaagugauucuccugccu

SEQ ID NO: 792843 - RNA, 24 nt, Human
ucaccgcaaccucugcuucccggg

SEQ ID NO: 792844 - RNA, 20 nt, Human
ucagccucccgaguagcugg

SEQ ID NO: 792845 - RNA, 23 nt, Human
ucaggcaggcgcaguggcuaaca

SEQ ID NO: 792846 - RNA, 22 nt, Human
uccaucuaaaaaaaaaaaaaaa

SEQ ID NO: 792847 - RNA, 24 nt, Human
uccauguuggucaggcuggucuug

SEQ ID NO: 792848 - RNA, 24 nt, Human
ucccaaagugcugggauuacaggc

SEQ ID NO: 792849 - RNA, 18 nt, Human
ucccagccacuugggagg

SEQ ID NO: 792850 - RNA, 24 nt, Human
ucccgaguagcugggauuacaggc

SEQ ID NO: 792851 - RNA, 21 nt, Human
ucccggguucaagugauucuc

SEQ ID NO: 792852 - RNA, 24 nt, Human
ucccggguucaagugauucuccug

SEQ ID NO: 792853 - RNA, 19 nt, Human
uccuccagagagaauucua

SEQ ID NO: 792854 - RNA, 23 nt, Human
ucgugccacuguacuccagccug

SEQ ID NO: 792855 - RNA, 19 nt, Human
ucuaacauaaauucucuga

SEQ ID NO: 792856 - RNA, 19 nt, Human
ucucacuuugucacccagg

SEQ ID NO: 792857 - RNA, 20 nt, Human
ucucacuuugucacccagga

SEQ ID NO: 792858 - RNA, 24 nt, Human
ucucacuuugucacccaggacgga

SEQ ID NO: 792859 - RNA, 24 nt, Human
ucuccugccucagccucccgagua

SEQ ID NO: 792860 - RNA, 18 nt, Human
ucugcugugcggugucca

SEQ ID NO: 792861 - RNA, 20 nt, Human
ugaagugucauugccuuaua

SEQ ID NO: 792862 - RNA, 22 nt, Human
ugagcugagaucgugccacugu

SEQ ID NO: 792863 - RNA, 20 nt, Human
ugaggcaggagaaucacuug

SEQ ID NO: 792864 - RNA, 24 nt, Human
ugaggcaggagaaucacuugaacc

SEQ ID NO: 792865 - RNA, 25 nt, Human
ugaggcaggagaaucacuugaaccc

SEQ ID NO: 792866 - RNA, 24 nt, Human
ugaucuacccaccuuugccuccca

SEQ ID NO: 792867 - RNA, 20 nt, Human
ugauucuccugccucagccu

SEQ ID NO: 792868 - RNA, 22 nt, Human
ugcacaauauuuaaacuguuaa

SEQ ID NO: 792869 - RNA, 19 nt, Human
ugcauucuuuuaccaaaua

SEQ ID NO: 792870 - RNA, 24 nt, Human
ugccucagccucccgaguagcugg

SEQ ID NO: 792871 - RNA, 21 nt, Human
ugcgccuguaaucccagccac

SEQ ID NO: 792872 - RNA, 24 nt, Human
ugcgccuguaaucccagccacuug

SEQ ID NO: 792873 - RNA, 24 nt, Human
ugcugggauuacaggcgugagcca

SEQ ID NO: 792874 - RNA, 18 nt, Human
uggaauaaugugacuuga

SEQ ID NO: 792875 - RNA, 23 nt, Human
uggagacggagguugcagugagc

SEQ ID NO: 792876 - RNA, 19 nt, Human
uggauuacuuucuaaacuc

SEQ ID NO: 792877 - RNA, 24 nt, Human
uggcguuucuccauguuggucagg

SEQ ID NO: 792878 - RNA, 22 nt, Human
uggcuaacaccuguaauugcag

SEQ ID NO: 792879 - RNA, 19 nt, Human
ugggaggcugaggcaggag

SEQ ID NO: 792880 - RNA, 24 nt, Human
ugggaggcugaggcaggagaauca

SEQ ID NO: 792881 - RNA, 18 nt, Human
ugggauuacaggcaugcg

SEQ ID NO: 792882 - RNA, 21 nt, Human
ugggauuacaggcaugcgcca

SEQ ID NO: 792883 - RNA, 22 nt, Human
ugggauuacaggcaugcgccac

SEQ ID NO: 792884 - RNA, 24 nt, Human
ugggauuacaggcaugcgccacca

SEQ ID NO: 792885 - RNA, 18 nt, Human
ugggauuacaggcgugag

SEQ ID NO: 792886 - RNA, 21 nt, Human
ugggauuacaggcgugagcca

SEQ ID NO: 792887 - RNA, 22 nt, Human
ugggauuacaggcgugagccac

SEQ ID NO: 792888 - RNA, 23 nt, Human
ugggauuacaggcgugagccacc

SEQ ID NO: 792889 - RNA, 23 nt, Human
ugggauuacaggcgugagccacc

SEQ ID NO: 792890 - RNA, 24 nt, Human
ugggauuacaggcgugagccaccg

SEQ ID NO: 792891 - RNA, 24 nt, Human
ugggcggaucaccuaaagucucga

SEQ ID NO: 792892 - RNA, 23 nt, Human
uggucaggcuggucuugaacucc

SEQ ID NO: 792893 - RNA, 24 nt, Human
uggugguuugcgccuguaauccca

SEQ ID NO: 792894 - RNA, 21 nt, Human
ugguuugcgccuguaauccca

SEQ ID NO: 792895 - RNA, 22 nt, Human
ugguuugcgccuguaaucccag

SEQ ID NO: 792896 - RNA, 21 nt, Human
uguacauuuguucucaaguau

SEQ ID NO: 792897 - RNA, 21 nt, Human
uguuacaaguaaaguuaccac

SEQ ID NO: 792898 - RNA, 23 nt, Human
uuaacacgaaguaauuugaguua

SEQ ID NO: 792899 - RNA, 29 nt, Human
uuacuuauuuauuuuuugagagggagucc

SEQ ID NO: 792900 - RNA, 18 nt, Human
uuaguagagauggcguuu

SEQ ID NO: 792901 - RNA, 24 nt, Human
uuaguagagauggcguuucuccau

SEQ ID NO: 792902 - RNA, 20 nt, Human
uuagugcauucuuuuaccaa

SEQ ID NO: 792903 - RNA, 21 nt, Human
uucaagugauucuccugccuc

SEQ ID NO: 792904 - RNA, 23 nt, Human
uucaagugauucuccugccucag

SEQ ID NO: 792905 - RNA, 24 nt, Human
uucaagugauucuccugccucagc

SEQ ID NO: 792906 - RNA, 19 nt, Human
uucauaauacaaaaaauaa

SEQ ID NO: 792907 - RNA, 22 nt, Human
uuccuauauaaauucugcugug

SEQ ID NO: 792908 - RNA, 18 nt, Human
uugcagugagcugagauc

SEQ ID NO: 792909 - RNA, 21 nt, Human
uugcagugagcugagaucgug

SEQ ID NO: 792910 - RNA, 22 nt, Human
uugcagugagcugagaucgugc

SEQ ID NO: 792911 - RNA, 21 nt, Human
uugcgggaggccaagcugggc

SEQ ID NO: 792912 - RNA, 25 nt, Human
uugggaggcugaggcaggagaauca

SEQ ID NO: 792913 - RNA, 22 nt, Human
uuuaaugcuauuaauauaaacu

SEQ ID NO: 792914 - RNA, 21 nt, Human
uuucuaaacucagaacucuga

SEQ ID NO: 792915 - RNA, 21 nt, Human
uuucuccauguuggucaggcu

SEQ ID NO: 792916 - RNA, 19 nt, Human
uuuuguauuuuuaguagag

SEQ ID NO: 792917 - RNA, 20 nt, Human
uuuuguauuuuuaguagaga

SEQ ID NO: 792918 - RNA, 19 nt, Human
uuuuuaguagagauggcgu

SEQ ID NO: 792919 - RNA, 18 nt, Human
uuuuugaacucuuuugac

SEQ ID NO: 792920 - RNA, 27 nt, Human
acugcauuuuaaccuuccuggcuaacc

SEQ ID NO: 792921 - RNA, 19 nt, Human
agaacaacaagucagaggg

SEQ ID NO: 792922 - RNA, 25 nt, Human
caagaacaacaagucagagggggcc

SEQ ID NO: 792923 - RNA, 22 nt, Human
caagucagagggggccugaagg

SEQ ID NO: 792924 - RNA, 24 nt, Human
cacaaaguuccaaacacuuaccac

SEQ ID NO: 792925 - RNA, 21 nt, Human
cacuguacaguuauacaaaac

SEQ ID NO: 792926 - RNA, 22 nt, Human
cagagggcuaaagaugaaaggg

SEQ ID NO: 792927 - RNA, 23 nt, Human
cagcccagagugauucucugcag

SEQ ID NO: 792928 - RNA, 19 nt, Human
ccaagaacaacaagucaga

SEQ ID NO: 792929 - RNA, 27 nt, Human
ccagagugauucucugcagucgaccuc

SEQ ID NO: 792930 - RNA, 21 nt, Human
ccagcacacucgagucucgug

SEQ ID NO: 792931 - RNA, 20 nt, Human
ccaucugccguaugcuccuc

SEQ ID NO: 792932 - RNA, 20 nt, Human
cuaaaccuucguccaccagg

SEQ ID NO: 792933 - RNA, 23 nt, Human
cugccguaugcuccucugggucu

SEQ ID NO: 792934 - RNA, 22 nt, Human
ggccugaaggugccuuccacag

SEQ ID NO: 792935 - RNA, 22 nt, Human
guuuacacaaaguuccaaacac

SEQ ID NO: 792936 - RNA, 19 nt, Human
uaaaauaagaacaugugcc

SEQ ID NO: 792937 - RNA, 25 nt, Human
uaaaauaagaacaugugccaagaac

SEQ ID NO: 792938 - RNA, 25 nt, Human
uaacaacagcugauuaugcaccucu

SEQ ID NO: 792939 - RNA, 21 nt, Human
uaagaacaugugccaagaaca

SEQ ID NO: 792940 - RNA, 22 nt, Human
uacaaaacaguccagcccagag

SEQ ID NO: 792941 - RNA, 18 nt, Human
ucaaagcaaacugcaguc

SEQ ID NO: 792942 - RNA, 20 nt, Human
ucccucaaagcaaacugcag

SEQ ID NO: 792943 - RNA, 22 nt, Human
ucucugcaguuaaaauaagaac

SEQ ID NO: 792944 - RNA, 28 nt, Human
ucugcaguuaaaauaagaaccggggucc

SEQ ID NO: 792945 - RNA, 24 nt, Human
ucugccguaugcuccucugggucu

SEQ ID NO: 792946 - RNA, 21 nt, Human
ugcaaaagugcuucaaaguac

SEQ ID NO: 792947 - RNA, 19 nt, Human
ugccaagaacaacaaguca

SEQ ID NO: 792948 - RNA, 20 nt, Human
ugccagcacacucgagucuc

SEQ ID NO: 792949 - RNA, 24 nt, Human
ugcucacaacuaaaucccguuuac

SEQ ID NO: 792950 - RNA, 21 nt, Human
ugugccaagaacaacaaguca

SEQ ID NO: 792951 - RNA, 24 nt, Human
uuaaacacuguacaguuauacaaa

SEQ ID NO: 792952 - RNA, 22 nt, Human
uucucugcaguuaaaauaagaa

SEQ ID NO: 792953 - RNA, 24 nt, Human
aaaaaaaacaaccaaaaaccugga

SEQ ID NO: 792954 - RNA, 22 nt, Human
aaaaacuuacaaauuugagaac

SEQ ID NO: 792955 - RNA, 23 nt, Human
aaacaaccaaaaaccuggagaau

SEQ ID NO: 792956 - RNA, 24 nt, Human
aacacacaaacucacagcuuguca

SEQ ID NO: 792957 - RNA, 18 nt, Human
aacaucaaaaucaaguuu

SEQ ID NO: 792958 - RNA, 22 nt, Human
aaccaaaaaccuggagaauaaa

SEQ ID NO: 792959 - RNA, 23 nt, Human
aaccaaaaaccuggagaauaaac

SEQ ID NO: 792960 - RNA, 24 nt, Human
aagaaaaaaaaacaaccaaaaacc

SEQ ID NO: 792961 - RNA, 18 nt, Human
aagaaaaaaaaacaaccc

SEQ ID NO: 792962 - RNA, 25 nt, Human
aagaaagaaaaaaaaacaaccaaaa

SEQ ID NO: 792963 - RNA, 21 nt, Human
aagaaagaagaaagaaaaaaa

SEQ ID NO: 792964 - RNA, 22 nt, Human
aagaagaaagaaaaaaaaacaa

SEQ ID NO: 792965 - RNA, 20 nt, Human
aagaagccagcaaugagaua

SEQ ID NO: 792966 - RNA, 26 nt, Human
aagaagccagcaaugagauaaggaug

SEQ ID NO: 792967 - RNA, 23 nt, Human
aaggaccuguuuguaucaugcca

SEQ ID NO: 792968 - RNA, 21 nt, Human
acccagggaaagucauaauuu

SEQ ID NO: 792969 - RNA, 22 nt, Human
acccagggaaagucauaauuuu

SEQ ID NO: 792970 - RNA, 23 nt, Human
agaaaaaaaaacaaccaaaaacc

SEQ ID NO: 792971 - RNA, 25 nt, Human
agaaagaaaaaaaaacaaccaaaaa

SEQ ID NO: 792972 - RNA, 20 nt, Human
agaaagaagaaagaaaaaaa

SEQ ID NO: 792973 - RNA, 21 nt, Human
agccguauuucuaagcagcac

SEQ ID NO: 792974 - RNA, 21 nt, Human
aguuuuuaacauauacauaua

SEQ ID NO: 792975 - RNA, 31 nt, Human
auaaugaccauuaucuuuccaauauccccuu

SEQ ID NO: 792976 - RNA, 21 nt, Human
caauuaauguugccaguaaac

SEQ ID NO: 792977 - RNA, 19 nt, Human
ccccgccgccgccgccucu

SEQ ID NO: 792978 - RNA, 18 nt, Human
ccccuucuccuucagucc

SEQ ID NO: 792979 - RNA, 22 nt, Human
cccgccgccgccgccucugccu

SEQ ID NO: 792980 - RNA, 19 nt, Human
ccuccccgccgccgccgcc

SEQ ID NO: 792981 - RNA, 24 nt, Human
ccuccccgccgccgccgccucugc

SEQ ID NO: 792982 - RNA, 19 nt, Human
ccucugggcagccucggcc

SEQ ID NO: 792983 - RNA, 21 nt, Human
ccucugggcagccucggccgu

SEQ ID NO: 792984 - RNA, 19 nt, Human
ccuuacuucuggcuccugu

SEQ ID NO: 792985 - RNA, 21 nt, Human
cuaucagcauugacuuucagu

SEQ ID NO: 792986 - RNA, 19 nt, Human
cuccccuucuccuucaguc

SEQ ID NO: 792987 - RNA, 22 nt, Human
cucucgcugcugcugcugcugc

SEQ ID NO: 792988 - RNA, 25 nt, Human
cucucgcugcugcugcugcugcugc

SEQ ID NO: 792989 - RNA, 23 nt, Human
cugccucucgcugcugcugcugc

SEQ ID NO: 792990 - RNA, 18 nt, Human
cuggcuccuguuuugucu

SEQ ID NO: 792991 - RNA, 20 nt, Human
gaagggagggaagauagucu

SEQ ID NO: 792992 - RNA, 24 nt, Human
gcaauuagauuuuuuguccugauu

SEQ ID NO: 792993 - RNA, 21 nt, Human
gccucucgcugcugcugcugc

SEQ ID NO: 792994 - RNA, 19 nt, Human
gcugcugcugcugccgccg

SEQ ID NO: 792995 - RNA, 22 nt, Human
gcuguccuccccgccgccgccg

SEQ ID NO: 792996 - RNA, 18 nt, Human
ggaaaaggggaagaggag

SEQ ID NO: 792997 - RNA, 21 nt, Human
ggaagauagucuuuguaaaaa

SEQ ID NO: 792998 - RNA, 22 nt, Human
ggaagggagggaagauagucuu

SEQ ID NO: 792999 - RNA, 22 nt, Human
guuuguaucaugccauggagaa

SEQ ID NO: 793000 - RNA, 24 nt, Human
uaaaacaaauuugucagaaacuca

SEQ ID NO: 793001 - RNA, 20 nt, Human
uaaaguuuccccacacuuuc

SEQ ID NO: 793002 - RNA, 19 nt, Human
uaagaaagaagaaagaaaa

SEQ ID NO: 793003 - RNA, 23 nt, Human
uaagaaagaagaaagaaaaaaaa

SEQ ID NO: 793004 - RNA, 20 nt, Human
uaaugaacaauuuuuacugc

SEQ ID NO: 793005 - RNA, 24 nt, Human
uacagcauuuuguuguugcucaac

SEQ ID NO: 793006 - RNA, 19 nt, Human
uagcuauucuccccuucuc

SEQ ID NO: 793007 - RNA, 19 nt, Human
uaguacagagcccagccgu

SEQ ID NO: 793008 - RNA, 23 nt, Human
uaucaugccauggagaacuacag

SEQ ID NO: 793009 - RNA, 20 nt, Human
uauucuccccuucuccuuca

SEQ ID NO: 793010 - RNA, 19 nt, Human
ucaguccuuacuucuggcu

SEQ ID NO: 793011 - RNA, 24 nt, Human
ucccaaacagcaauuagauuuuuu

SEQ ID NO: 793012 - RNA, 22 nt, Human
uccccgccgccgccgccucugc

SEQ ID NO: 793013 - RNA, 21 nt, Human
ucgcugcugcugcugcugcug

SEQ ID NO: 793014 - RNA, 25 nt, Human
ucgcugcugcugcugcugcugccgg

SEQ ID NO: 793015 - RNA, 19 nt, Human
ucggccgugcuguccuccc

SEQ ID NO: 793016 - RNA, 21 nt, Human
ucucgcugcugcugcugcugc

SEQ ID NO: 793017 - RNA, 21 nt, Human
ucugaaguaagacaccuggag

SEQ ID NO: 793018 - RNA, 21 nt, Human
ucugccucucgcugcugcugc

SEQ ID NO: 793019 - RNA, 20 nt, Human
ugaggcccuucuuuuauugg

SEQ ID NO: 793020 - RNA, 20 nt, Human
ugcauaguacagagcccagc

SEQ ID NO: 793021 - RNA, 25 nt, Human
ugccucucgcugcugcugcugcugc

SEQ ID NO: 793022 - RNA, 19 nt, Human
uggaaagaagccagcaaug

SEQ ID NO: 793023 - RNA, 23 nt, Human
ugucagaaacucaaauacagcau

SEQ ID NO: 793024 - RNA, 20 nt, Human
uguuuuauuauauacccuuc

SEQ ID NO: 793025 - RNA, 22 nt, Human
uguuuugucuugugaggcccuu

SEQ ID NO: 793026 - RNA, 27 nt, Human
uuaccaaauuggauuccaguuguuuua

SEQ ID NO: 793027 - RNA, 23 nt, Human
uuacuuuuucuccuuuuuguuuu

SEQ ID NO: 793028 - RNA, 22 nt, Human
uuagcuauucuccccuucuccu

SEQ ID NO: 793029 - RNA, 19 nt, Human
uucaggcauuaagaaagaa

SEQ ID NO: 793030 - RNA, 22 nt, Human
uuccuauauccuuuucccugca

SEQ ID NO: 793031 - RNA, 23 nt, Human
uuccuauauccuuuucccugcag

SEQ ID NO: 793032 - RNA, 21 nt, Human
uucugaaguaagacaccugga

SEQ ID NO: 793033 - RNA, 22 nt, Human
uucuggcuccuguuuugucuug

SEQ ID NO: 793034 - RNA, 25 nt, Human
uuuaaaacaaauuugucagaaacuc

SEQ ID NO: 793035 - RNA, 18 nt, Human
uuuguuguugcucaacuu

SEQ ID NO: 793036 - RNA, 22 nt, Human
uuuucugacauuguuuuucuga

SEQ ID NO: 793037 - RNA, 21 nt, Human
aaacagagaaagggggacccc

SEQ ID NO: 793038 - RNA, 18 nt, Human
aaccccgcccugggcacg

SEQ ID NO: 793039 - RNA, 19 nt, Human
aacgagggaaacagagaaa

SEQ ID NO: 793040 - RNA, 24 nt, Human
aagccagacccgaccggaccagga

SEQ ID NO: 793041 - RNA, 19 nt, Human
aaucuaggucacccucccc

SEQ ID NO: 793042 - RNA, 22 nt, Human
aaucuaggucacccucccccaa

SEQ ID NO: 793043 - RNA, 18 nt, Human
acaaacgagggaaacaga

SEQ ID NO: 793044 - RNA, 19 nt, Human
acaaacgagggaaacagag

SEQ ID NO: 793045 - RNA, 23 nt, Human
acacacacacacacacacacaca

SEQ ID NO: 793046 - RNA, 23 nt, Human
acacacacacacacacacacaca

SEQ ID NO: 793047 - RNA, 23 nt, Human
acacacacacacacacacacaca

SEQ ID NO: 793048 - RNA, 23 nt, Human
acacacacacacacacacacaca

SEQ ID NO: 793049 - RNA, 23 nt, Human
acacacacacacacacacacaca

SEQ ID NO: 793050 - RNA, 23 nt, Human
acacacacacacacacacacaca

SEQ ID NO: 793051 - RNA, 23 nt, Human
acacacacacacacacacacaca

SEQ ID NO: 793052 - RNA, 23 nt, Human
acacacacacacacacacacaca

SEQ ID NO: 793053 - RNA, 24 nt, Human
acacacacacacacacacacacag

SEQ ID NO: 793054 - RNA, 25 nt, Human
acacacacacacacacacacacagu

SEQ ID NO: 793055 - RNA, 22 nt, Human
acacacacacacacacacacag

SEQ ID NO: 793056 - RNA, 27 nt, Human
acacauacagacacacacacaggucag

SEQ ID NO: 793057 - RNA, 24 nt, Human
acauacagacacacacacagguca

SEQ ID NO: 793058 - RNA, 20 nt, Human
accccaagccagacccgacc

SEQ ID NO: 793059 - RNA, 22 nt, Human
acccucccccaacacacacaca

SEQ ID NO: 793060 - RNA, 21 nt, Human
acuacagagagacgacaagag

SEQ ID NO: 793061 - RNA, 18 nt, Human
agagaaaggagaggcaaa

SEQ ID NO: 793062 - RNA, 21 nt, Human
agccgcagcccgaggcugccc

SEQ ID NO: 793063 - RNA, 26 nt, Human
aggagagacagggagacuagacaaaa

SEQ ID NO: 793064 - RNA, 24 nt, Human
aggcuuuggaggccgccgcgggac

SEQ ID NO: 793065 - RNA, 22 nt, Human
agggagacuagacaaaaccagg

SEQ ID NO: 793066 - RNA, 18 nt, Human
agggccgagggacaagag

SEQ ID NO: 793067 - RNA, 24 nt, Human
augaguaaagagaagaaaucagga

SEQ ID NO: 793068 - RNA, 23 nt, Human
caaacgagggaaacagagaaagg

SEQ ID NO: 793069 - RNA, 26 nt, Human
caagaaaugggccccucgccccggcc

SEQ ID NO: 793070 - RNA, 20 nt, Human
cacacacacacacacacaca

SEQ ID NO: 793071 - RNA, 20 nt, Human
cacacacacacacacacaca

SEQ ID NO: 793072 - RNA, 20 nt, Human
cacacacacacacacacaca

SEQ ID NO: 793073 - RNA, 20 nt, Human
cacacacacacacacacaca

SEQ ID NO: 793074 - RNA, 20 nt, Human
cacacacacacacacacaca

SEQ ID NO: 793075 - RNA, 20 nt, Human
cacacacacacacacacaca

SEQ ID NO: 793076 - RNA, 20 nt, Human
cacacacacacacacacaca

SEQ ID NO: 793077 - RNA, 20 nt, Human
cacacacacacacacacaca

SEQ ID NO: 793078 - RNA, 20 nt, Human
cacacacacacacacacaca

SEQ ID NO: 793079 - RNA, 20 nt, Human
cacacacacacacacacaca

SEQ ID NO: 793080 - RNA, 20 nt, Human
cacacacacacacacacaca

SEQ ID NO: 793081 - RNA, 22 nt, Human
cacacacacacacacacacaca

SEQ ID NO: 793082 - RNA, 22 nt, Human
cacacacacacacacacacaca

SEQ ID NO: 793083 - RNA, 22 nt, Human
cacacacacacacacacacaca

SEQ ID NO: 793084 - RNA, 26 nt, Human
cacacacacacacacacacacacaca

SEQ ID NO: 793085 - RNA, 26 nt, Human
cacacacacacacacacacacacaca

SEQ ID NO: 793086 - RNA, 26 nt, Human
cacacacacacacacacacacacaca

SEQ ID NO: 793087 - RNA, 26 nt, Human
cacacacacacacacacacacacaca

SEQ ID NO: 793088 - RNA, 29 nt, Human
cacacacacacacacacacacacacuaca

SEQ ID NO: 793089 - RNA, 27 nt, Human
cacacacacacacacacacacacuaca

SEQ ID NO: 793090 - RNA, 27 nt, Human
cacacacacacacacacacacacuaca

SEQ ID NO: 793091 - RNA, 30 nt, Human
cacacacacacacacacacacuacacgcgg

SEQ ID NO: 793092 - RNA, 25 nt, Human
cacacacacacacacuacacgcgga

SEQ ID NO: 793093 - RNA, 25 nt, Human
cacacacacacacuacacgcggaca

SEQ ID NO: 793094 - RNA, 22 nt, Human
cacacauacagacacacacaca

SEQ ID NO: 793095 - RNA, 21 nt, Human
cagacccgaccggaccaggaa

SEQ ID NO: 793096 - RNA, 19 nt, Human
cagcagggccucagacaca

SEQ ID NO: 793097 - RNA, 24 nt, Human
cagcccgaggcugccccgcccccu

SEQ ID NO: 793098 - RNA, 18 nt, Human
cagggggcccugccccuc

SEQ ID NO: 793099 - RNA, 26 nt, Human
ccaacacacacacacacacacacaca

SEQ ID NO: 793100 - RNA, 22 nt, Human
ccaagccagacccgaccggacc

SEQ ID NO: 793101 - RNA, 19 nt, Human
ccagacccgaccggaccag

SEQ ID NO: 793102 - RNA, 21 nt, Human
cccaacacacacacacacaca

SEQ ID NO: 793103 - RNA, 26 nt, Human
ccccaagccagacccgaccggaccag

SEQ ID NO: 793104 - RNA, 18 nt, Human
ccccaguuagucaucuuc

SEQ ID NO: 793105 - RNA, 20 nt, Human
ccccaguuagucaucuuccc

SEQ ID NO: 793106 - RNA, 23 nt, Human
ccccgcccccucccggggacaag

SEQ ID NO: 793107 - RNA, 23 nt, Human
cccgaggcugccccgcccccucc

SEQ ID NO: 793108 - RNA, 22 nt, Human
cccgcccccucccggggacaag

SEQ ID NO: 793109 - RNA, 21 nt, Human
ccgaaccccgcccugggcacg

SEQ ID NO: 793110 - RNA, 23 nt, Human
ccgccgcgggacagaauaggauc

SEQ ID NO: 793111 - RNA, 24 nt, Human
ccggccccgggugacgggcugggg

SEQ ID NO: 793112 - RNA, 19 nt, Human
ccgguccccgaaccccgcc

SEQ ID NO: 793113 - RNA, 18 nt, Human
ccucccggggacaagggc

SEQ ID NO: 793114 - RNA, 22 nt, Human
ccucccggggacaagggcgcgu

SEQ ID NO: 793115 - RNA, 22 nt, Human
ccucgccccggccccgggugac

SEQ ID NO: 793116 - RNA, 24 nt, Human
ccucuaagucucucagaggauaaa

SEQ ID NO: 793117 - RNA, 18 nt, Human
cgggcugggggagggggc

SEQ ID NO: 793118 - RNA, 20 nt, Human
cuucccaucuuccuucaguc

SEQ ID NO: 793119 - RNA, 18 nt, Human
gaagggaggccggcagcc

SEQ ID NO: 793120 - RNA, 22 nt, Human
gacaggacagagagaaaggaga

SEQ ID NO: 793121 - RNA, 19 nt, Human
gacgacaggacagagagaa

SEQ ID NO: 793122 - RNA, 23 nt, Human
gacgacaggacagagagaaagga

SEQ ID NO: 793123 - RNA, 19 nt, Human
gaguccauaggggaaggga

SEQ ID NO: 793124 - RNA, 22 nt, Human
gccccagcguccgugcggcugg

SEQ ID NO: 793125 - RNA, 22 nt, Human
gccccgggugacgggcuggggg

SEQ ID NO: 793126 - RNA, 19 nt, Human
gccccucgccccggccccg

SEQ ID NO: 793127 - RNA, 23 nt, Human
gcgcugcgcuuucucccaguccc

SEQ ID NO: 793128 - RNA, 23 nt, Human
gcugcaaucuaggucacccuccc

SEQ ID NO: 793129 - RNA, 22 nt, Human
ggaaacagagaaagggggaccg

SEQ ID NO: 793130 - RNA, 20 nt, Human
ggacacacauacagacacac

SEQ ID NO: 793131 - RNA, 22 nt, Human
ggacacacauacagacacacac

SEQ ID NO: 793132 - RNA, 20 nt, Human
ggagacuagacaaaaccagg

SEQ ID NO: 793133 - RNA, 21 nt, Human
ggagacuagacaaaaccaggg

SEQ ID NO: 793134 - RNA, 23 nt, Human
ggcaaauagggaaagacaggcac

SEQ ID NO: 793135 - RNA, 23 nt, Human
gggaggcuuuggaggccgccgcg

SEQ ID NO: 793136 - RNA, 21 nt, Human
gggauagagacaaacgaggga

SEQ ID NO: 793137 - RNA, 22 nt, Human
gggcguggccucgagccgcagc

SEQ ID NO: 793138 - RNA, 23 nt, Human
gggcguggccucgagccgcagcc

SEQ ID NO: 793139 - RNA, 23 nt, Human
ggguggggugggaggcuuuggag

SEQ ID NO: 793140 - RNA, 23 nt, Human
uaaaagccugucugccagucucc

SEQ ID NO: 793141 - RNA, 19 nt, Human
ucaggagagacagggagac

SEQ ID NO: 793142 - RNA, 19 nt, Human
uccagugggaccugcccgg

SEQ ID NO: 793143 - RNA, 21 nt, Human
ucccaucuuccuucagucuca

SEQ ID NO: 793144 - RNA, 19 nt, Human
ucgagccgcagcccgaggc

SEQ ID NO: 793145 - RNA, 20 nt, Human
ucggcggcgcacggcggcga

SEQ ID NO: 793146 - RNA, 21 nt, Human
ucggcggcgcacggcggcgau

SEQ ID NO: 793147 - RNA, 18 nt, Human
ucucucagaggauaaaag

SEQ ID NO: 793148 - RNA, 18 nt, Human
ucugccagucuccuccgg

SEQ ID NO: 793149 - RNA, 23 nt, Human
ugaguaaagagaagaaaucagga

SEQ ID NO: 793150 - RNA, 28 nt, Human
ugcggcugggcguuuggucugcggcacc

SEQ ID NO: 793151 - RNA, 23 nt, Human
ugcugcagugucagggggcccug

SEQ ID NO: 793152 - RNA, 20 nt, Human
uggcgaagucucggcggcgc

SEQ ID NO: 793153 - RNA, 19 nt, Human
ugggaccugcccgggagaa

SEQ ID NO: 793154 - RNA, 21 nt, Human
ugggcacgggggcguggccuc

SEQ ID NO: 793155 - RNA, 21 nt, Human
uggggugggaggcuuuggagg

SEQ ID NO: 793156 - RNA, 22 nt, Human
uggggugggaggcuuuggaggc

SEQ ID NO: 793157 - RNA, 23 nt, Human
uggggugggaggcuuuggaggcc

SEQ ID NO: 793158 - RNA, 18 nt, Human
ugggguggggugggaggc

SEQ ID NO: 793159 - RNA, 21 nt, Human
ugggguggggugggaggcuuu

SEQ ID NO: 793160 - RNA, 20 nt, Human
uuaugaucauuuuauuuuug

SEQ ID NO: 793161 - RNA, 19 nt, Human
uucucccagucccgcccca

SEQ ID NO: 793162 - RNA, 22 nt, Human
uuggauuuuguucgugugggga

SEQ ID NO: 793163 - RNA, 20 nt, Human
aaccacagucaccgucccug

SEQ ID NO: 793164 - RNA, 21 nt, Human
aagcagaugguaagggucagg

SEQ ID NO: 793165 - RNA, 22 nt, Human
aagcagaugguaagggucaggg

SEQ ID NO: 793166 - RNA, 25 nt, Human
aaggagcuggggcugugauucaggg

SEQ ID NO: 793167 - RNA, 20 nt, Human
accccacccagcagugauua

SEQ ID NO: 793168 - RNA, 20 nt, Human
accgugugguuggagcuggg

SEQ ID NO: 793169 - RNA, 19 nt, Human
acucggggaagugggacuu

SEQ ID NO: 793170 - RNA, 20 nt, Human
agccuggcagccccgcccug

SEQ ID NO: 793171 - RNA, 18 nt, Human
aggacaaucccccuaccc

SEQ ID NO: 793172 - RNA, 19 nt, Human
agggcaggaaggguggccu

SEQ ID NO: 793173 - RNA, 20 nt, Human
aguuccugggccggcugcuc

SEQ ID NO: 793174 - RNA, 21 nt, Human
caaucccccuacccccacccc

SEQ ID NO: 793175 - RNA, 21 nt, Human
cacccugggugccugcagagc

SEQ ID NO: 793176 - RNA, 22 nt, Human
cacugaagucuuucaggaagca

SEQ ID NO: 793177 - RNA, 21 nt, Human
cagagccuggcagccccgccc

SEQ ID NO: 793178 - RNA, 20 nt, Human
caggauguucacagccgugg

SEQ ID NO: 793179 - RNA, 19 nt, Human
caggcugcugggcagggag

SEQ ID NO: 793180 - RNA, 24 nt, Human
ccaggacaaucccccuacccccac

SEQ ID NO: 793181 - RNA, 24 nt, Human
cccagcagugauuaaaaacccgua

SEQ ID NO: 793182 - RNA, 20 nt, Human
cccccuacccccaccccacc

SEQ ID NO: 793183 - RNA, 24 nt, Human
cccccuacccccaccccacccagc

SEQ ID NO: 793184 - RNA, 20 nt, Human
ccccuacccccaccccaccc

SEQ ID NO: 793185 - RNA, 24 nt, Human
ccuccccacccugggugccugcag

SEQ ID NO: 793186 - RNA, 23 nt, Human
cuccuuagaaugggaggcgaaca

SEQ ID NO: 793187 - RNA, 21 nt, Human
cugcuccacagccugcuccuc

SEQ ID NO: 793188 - RNA, 23 nt, Human
cugggcagggagggcaaaggaga

SEQ ID NO: 793189 - RNA, 23 nt, Human
cuucccacggagcaugcagaggu

SEQ ID NO: 793190 - RNA, 18 nt, Human
gaacauuuggcaccuaga

SEQ ID NO: 793191 - RNA, 19 nt, Human
gaagugggacuuugucgac

SEQ ID NO: 793192 - RNA, 21 nt, Human
gaauuuaccucacuugauacc

SEQ ID NO: 793193 - RNA, 21 nt, Human
gacugcauagcgguugcagau

SEQ ID NO: 793194 - RNA, 22 nt, Human
gagagcaccauucugcggguag

SEQ ID NO: 793195 - RNA, 20 nt, Human
gaugggggucaaggagcugg

SEQ ID NO: 793196 - RNA, 19 nt, Human
gccuccugcacguagacga

SEQ ID NO: 793197 - RNA, 18 nt, Human
gccugcuccuccacaggc

SEQ ID NO: 793198 - RNA, 19 nt, Human
ggacaccaccagguggugc

SEQ ID NO: 793199 - RNA, 19 nt, Human
ggcaguggcgucauggguc

SEQ ID NO: 793200 - RNA, 19 nt, Human
gggugugugucuaugcugg

SEQ ID NO: 793201 - RNA, 23 nt, Human
ggugccauggcaaccaccgaggc

SEQ ID NO: 793202 - RNA, 23 nt, Human
guagacgaugaacuccgaggccu

SEQ ID NO: 793203 - RNA, 18 nt, Human
uaaccacagucaccgucc

SEQ ID NO: 793204 - RNA, 23 nt, Human
uaggagaguccuaucaggcugcu

SEQ ID NO: 793205 - RNA, 22 nt, Human
ucacagccgugggguccagucg

SEQ ID NO: 793206 - RNA, 20 nt, Human
ucagggggugugugucuaug

SEQ ID NO: 793207 - RNA, 18 nt, Human
ucccccuacccccacccc

SEQ ID NO: 793208 - RNA, 20 nt, Human
ucggcaagcuccacggacgc

SEQ ID NO: 793209 - RNA, 18 nt, Human
ugaagucuuucaggaagc

SEQ ID NO: 793210 - RNA, 19 nt, Human
ugaggccaccgccucucca

SEQ ID NO: 793211 - RNA, 18 nt, Human
ugcguguagacagucacc

SEQ ID NO: 793212 - RNA, 24 nt, Human
ugggacuuugucgacaaagccagg

SEQ ID NO: 793213 - RNA, 23 nt, Human
ugggcagggagggcaaaggagag

SEQ ID NO: 793214 - RNA, 24 nt, Human
ugggccggcugcuccacagccugc

SEQ ID NO: 793215 - RNA, 18 nt, Human
ugggguguguguagggga

SEQ ID NO: 793216 - RNA, 19 nt, Human
ugggucucggcgcccagcu

SEQ ID NO: 793217 - RNA, 19 nt, Human
ugggugccugcagagccug

SEQ ID NO: 793218 - RNA, 24 nt, Human
ugugauggcugucucccucucacc

SEQ ID NO: 793219 - RNA, 18 nt, Human
ugugggguguguguaggg

SEQ ID NO: 793220 - RNA, 21 nt, Human
uguucacagccguggggucca

SEQ ID NO: 793221 - RNA, 24 nt, Human
uguuugaaucuugaagcaaggggu

SEQ ID NO: 793222 - RNA, 20 nt, Human
uuccugggccggcugcucca

SEQ ID NO: 793223 - RNA, 23 nt, Human
uugcuggugaugcugacugccuu

SEQ ID NO: 793224 - RNA, 25 nt, Human
uuucucguaaaccuccaccaagggc

SEQ ID NO: 793225 - RNA, 18 nt, Human
aaaacaaauaauacaaaa

SEQ ID NO: 793226 - RNA, 21 nt, Human
aaaagcaaaugcgaaaguugu

SEQ ID NO: 793227 - RNA, 23 nt, Human
aaacaaauaauacaaaacaucuc

SEQ ID NO: 793228 - RNA, 18 nt, Human
aaacaugaaagagagaaa

SEQ ID NO: 793229 - RNA, 21 nt, Human
aaaccaccagaaauauuacag

SEQ ID NO: 793230 - RNA, 18 nt, Human
aaaccagagacaaaaacg

SEQ ID NO: 793231 - RNA, 20 nt, Human
aaagaaccacuaagccaaua

SEQ ID NO: 793232 - RNA, 21 nt, Human
aaagaagaaagacuagcugcc

SEQ ID NO: 793233 - RNA, 22 nt, Human
aacuaggaaaaaagcaaaacaa

SEQ ID NO: 793234 - RNA, 19 nt, Human
aacucaucccccgcauccc

SEQ ID NO: 793235 - RNA, 22 nt, Human
aacucaucccccgcauccccua

SEQ ID NO: 793236 - RNA, 18 nt, Human
aagaaagaagaaagacua

SEQ ID NO: 793237 - RNA, 21 nt, Human
aagaaauagacuuguaguuca

SEQ ID NO: 793238 - RNA, 24 nt, Human
aagagagaaagaauuuaaaaaaga

SEQ ID NO: 793239 - RNA, 20 nt, Human
aagcaaaacaaaacaaauaa

SEQ ID NO: 793240 - RNA, 25 nt, Human
aagcaaaacaaaacaaauaauacaa

SEQ ID NO: 793241 - RNA, 22 nt, Human
aagcaaaugcgaaaguugucua

SEQ ID NO: 793242 - RNA, 22 nt, Human
aagcagagagaaaacauuccag

SEQ ID NO: 793243 - RNA, 18 nt, Human
aagccuagaggccagccu

SEQ ID NO: 793244 - RNA, 19 nt, Human
aagggucauaaacuugaaa

SEQ ID NO: 793245 - RNA, 19 nt, Human
aaguagcugggacuacagg

SEQ ID NO: 793246 - RNA, 20 nt, Human
aaguagcugggacuacaggc

SEQ ID NO: 793247 - RNA, 25 nt, Human
aaguagcugggacuacaggcgcccg

SEQ ID NO: 793248 - RNA, 19 nt, Human
aaguugcuauuucagaaga

SEQ ID NO: 793249 - RNA, 19 nt, Human
aauaauacaaaacaucucu

SEQ ID NO: 793250 - RNA, 26 nt, Human
aauagcuuuaauuagcuaaguuggca

SEQ ID NO: 793251 - RNA, 21 nt, Human
acaaaguagauaaauuuauca

SEQ ID NO: 793252 - RNA, 26 nt, Human
acaaggaagaaagauauucuuuuuca

SEQ ID NO: 793253 - RNA, 21 nt, Human
acacauagaaaaauaaaagca

SEQ ID NO: 793254 - RNA, 21 nt, Human
acaggcgcccgccaccacacc

SEQ ID NO: 793255 - RNA, 22 nt, Human
acagugucuuacagucaugcuc

SEQ ID NO: 793256 - RNA, 18 nt, Human
accaaucacaaggaagaa

SEQ ID NO: 793257 - RNA, 20 nt, Human
acccaccucugccucccaga

SEQ ID NO: 793258 - RNA, 19 nt, Human
acccaggcuggagugcagu

SEQ ID NO: 793259 - RNA, 23 nt, Human
acccaggcuggagugcaguggug

SEQ ID NO: 793260 - RNA, 18 nt, Human
acccauacacacauagaa

SEQ ID NO: 793261 - RNA, 25 nt, Human
accucccagguucaccacauucucc

SEQ ID NO: 793262 - RNA, 24 nt, Human
accuugugauccacccaccucugc

SEQ ID NO: 793263 - RNA, 24 nt, Human
acgauuugguaacaaacagcaaag

SEQ ID NO: 793264 - RNA, 20 nt, Human
acguacccaaacgaacauca

SEQ ID NO: 793265 - RNA, 18 nt, Human
acucaucccccgcauccc

SEQ ID NO: 793266 - RNA, 20 nt, Human
acugcaagcuccaccuccca

SEQ ID NO: 793267 - RNA, 25 nt, Human
agaaaaauaaaagcaaaugcgaaag

SEQ ID NO: 793268 - RNA, 21 nt, Human
agaacauuucugauauuguug

SEQ ID NO: 793269 - RNA, 19 nt, Human
agagagaaaacauuccaga

SEQ ID NO: 793270 - RNA, 19 nt, Human
agagauggggucucaccgu

SEQ ID NO: 793271 - RNA, 22 nt, Human
agauauugaagguaauauacuu

SEQ ID NO: 793272 - RNA, 23 nt, Human
agcaaagaaaguuucaccaccaa

SEQ ID NO: 793273 - RNA, 22 nt, Human
agcagagagaaaacauuccaga

SEQ ID NO: 793274 - RNA, 21 nt, Human
agcuaugcuuaccacuucauc

SEQ ID NO: 793275 - RNA, 19 nt, Human
aggaaaaaagcaaaacaaa

SEQ ID NO: 793276 - RNA, 25 nt, Human
aggcuggagugcaguggugcgaucu

SEQ ID NO: 793277 - RNA, 22 nt, Human
agguucaccacauucuccugcc

SEQ ID NO: 793278 - RNA, 20 nt, Human
aguagagauggggucucacc

SEQ ID NO: 793279 - RNA, 21 nt, Human
agugcaguggugcgaucucag

SEQ ID NO: 793280 - RNA, 23 nt, Human
agugcaguggugcgaucucagcu

SEQ ID NO: 793281 - RNA, 24 nt, Human
agugcaguggugcgaucucagcuc

SEQ ID NO: 793282 - RNA, 18 nt, Human
agugcugggauuacaggc

SEQ ID NO: 793283 - RNA, 18 nt, Human
agugcugggauuacaggc

SEQ ID NO: 793284 - RNA, 22 nt, Human
agugcugggauuacaggcguga

SEQ ID NO: 793285 - RNA, 24 nt, Human
aguggugcgaucucagcucacugc

SEQ ID NO: 793286 - RNA, 21 nt, Human
auucuccugccucagccuccc

SEQ ID NO: 793287 - RNA, 22 nt, Human
auucuggaaguuuaucccaaga

SEQ ID NO: 793288 - RNA, 20 nt, Human
auugaagcuaggaagcagag

SEQ ID NO: 793289 - RNA, 21 nt, Human
auugaagcuaggaagcagaga

SEQ ID NO: 793290 - RNA, 26 nt, Human
caaacgaacaucagagcaacauauua

SEQ ID NO: 793291 - RNA, 21 nt, Human
cacacauagaaaaauaaaagc

SEQ ID NO: 793292 - RNA, 27 nt, Human
caccaaucacaaggaagaaagauauuc

SEQ ID NO: 793293 - RNA, 22 nt, Human
caccacauucuccugccucagc

SEQ ID NO: 793294 - RNA, 23 nt, Human
cacccaccucugccucccagagu

SEQ ID NO: 793295 - RNA, 21 nt, Human
cacccaggcuggagugcagug

SEQ ID NO: 793296 - RNA, 18 nt, Human
caccguguuagccaggau

SEQ ID NO: 793297 - RNA, 24 nt, Human
caccguguuagccaggauggucuc

SEQ ID NO: 793298 - RNA, 19 nt, Human
caccucccagguucaccac

SEQ ID NO: 793299 - RNA, 24 nt, Human
caccucugccucccagagugcugg

SEQ ID NO: 793300 - RNA, 21 nt, Human
cacugcaagcuccaccuccca

SEQ ID NO: 793301 - RNA, 23 nt, Human
cagaacucaucccccgcaucccc

SEQ ID NO: 793302 - RNA, 23 nt, Human
cagacaaaaacacuaagaggcac

SEQ ID NO: 793303 - RNA, 24 nt, Human
cagagugcugggauuacaggcgug

SEQ ID NO: 793304 - RNA, 21 nt, Human
cagggagagcuaagugcaaua

SEQ ID NO: 793305 - RNA, 21 nt, Human
cauccacaaccacguacccaa

SEQ ID NO: 793306 - RNA, 22 nt, Human
ccagagugcugggauuacaggc

SEQ ID NO: 793307 - RNA, 22 nt, Human
ccagagugcugggauuacaggc

SEQ ID NO: 793308 - RNA, 24 nt, Human
ccagagugcugggauuacaggcgu

SEQ ID NO: 793309 - RNA, 23 nt, Human
cccaaguagcugggacuacaggc

SEQ ID NO: 793310 - RNA, 24 nt, Human
cccaaguagcugggacuacaggcg

SEQ ID NO: 793311 - RNA, 18 nt, Human
cccaccucugccucccag

SEQ ID NO: 793312 - RNA, 20 nt, Human
cccagguucaccacauucuc

SEQ ID NO: 793313 - RNA, 23 nt, Human
ccccauccacaaccacguaccca

SEQ ID NO: 793314 - RNA, 20 nt, Human
ccgcauccccuaacccauac

SEQ ID NO: 793315 - RNA, 18 nt, Human
ccuaacccauacacacau

SEQ ID NO: 793316 - RNA, 22 nt, Human
ccugaccuugugauccacccac

SEQ ID NO: 793317 - RNA, 23 nt, Human
ccugccucagccucccaaguagc

SEQ ID NO: 793318 - RNA, 24 nt, Human
ccugccucagccucccaaguagcu

SEQ ID NO: 793319 - RNA, 24 nt, Human
cgcucugucacccaggcuggagug

SEQ ID NO: 793320 - RNA, 23 nt, Human
cuaauuuuuuguauuuuuaguag

SEQ ID NO: 793321 - RNA, 24 nt, Human
cucacugcaagcuccaccucccag

SEQ ID NO: 793322 - RNA, 24 nt, Human
cucagccucccaaguagcugggac

SEQ ID NO: 793323 - RNA, 18 nt, Human
cuccugaccuugugaucc

SEQ ID NO: 793324 - RNA, 25 nt, Human
cuccugaccuugugauccacccacc

SEQ ID NO: 793325 - RNA, 24 nt, Human
cucgcucugucacccaggcuggag

SEQ ID NO: 793326 - RNA, 23 nt, Human
cucugucacccaggcuggagugc

SEQ ID NO: 793327 - RNA, 24 nt, Human
cugcaagcuccaccucccagguuc

SEQ ID NO: 793328 - RNA, 21 nt, Human
cuuacagucaugcuccaagcu

SEQ ID NO: 793329 - RNA, 19 nt, Human
gaaaacacagacugccaga

SEQ ID NO: 793330 - RNA, 20 nt, Human
gaacucaucccccgcauccc

SEQ ID NO: 793331 - RNA, 22 nt, Human
gacaauuaagccucacaaauua

SEQ ID NO: 793332 - RNA, 22 nt, Human
gaccuugugauccacccaccuc

SEQ ID NO: 793333 - RNA, 21 nt, Human
gagauggagucucgcucuguc

SEQ ID NO: 793334 - RNA, 18 nt, Human
gauuacaggcgugagcca

SEQ ID NO: 793335 - RNA, 21 nt, Human
gauuacaggcgugagccacca

SEQ ID NO: 793336 - RNA, 22 nt, Human
gauuacaggcgugagccaccac

SEQ ID NO: 793337 - RNA, 18 nt, Human
gcaagcuccaccucccag

SEQ ID NO: 793338 - RNA, 22 nt, Human
gcaagcuccaccucccagguuc

SEQ ID NO: 793339 - RNA, 19 nt, Human
gcuaggaagcagagagaaa

SEQ ID NO: 793340 - RNA, 19 nt, Human
ggaaaaaagcaaaacaaaa

SEQ ID NO: 793341 - RNA, 24 nt, Human
ggaaguuuaucccaagaaccugcu

SEQ ID NO: 793342 - RNA, 18 nt, Human
ggacagacagagguggga

SEQ ID NO: 793343 - RNA, 24 nt, Human
ggauggucucaaucuccugaccuu

SEQ ID NO: 793344 - RNA, 19 nt, Human
ggauuacaggcgugagcca

SEQ ID NO: 793345 - RNA, 18 nt, Human
ggggucucaccguguuag

SEQ ID NO: 793346 - RNA, 24 nt, Human
gugauccacccaccucugccuccc

SEQ ID NO: 793347 - RNA, 19 nt, Human
guugaucucagggcaguuc

SEQ ID NO: 793348 - RNA, 26 nt, Human
uaaaaaagaaccacuaagccaauaca

SEQ ID NO: 793349 - RNA, 23 nt, Human
uaaaagcaaaugcgaaaguuguc

SEQ ID NO: 793350 - RNA, 19 nt, Human
uaaaaguacacaaaacaug

SEQ ID NO: 793351 - RNA, 24 nt, Human
uaaagacaacuaggaaaaaagcaa

SEQ ID NO: 793352 - RNA, 23 nt, Human
uaaaugauauuucaguuuaugcc

SEQ ID NO: 793353 - RNA, 23 nt, Human
uaacaaacagcaaagaaaguuuc

SEQ ID NO: 793354 - RNA, 21 nt, Human
uaacagcauauaaaggcgucc

SEQ ID NO: 793355 - RNA, 19 nt, Human
uaacaguaacgacaauuaa

SEQ ID NO: 793356 - RNA, 22 nt, Human
uaaccagaaggugacuuguguc

SEQ ID NO: 793357 - RNA, 19 nt, Human
uaagaaagaagaaagacua

SEQ ID NO: 793358 - RNA, 19 nt, Human
uaagacacaagaaauucua

SEQ ID NO: 793359 - RNA, 18 nt, Human
uaaggacaucaauauuca

SEQ ID NO: 793360 - RNA, 21 nt, Human
uaaguacaauauuuuuggaau

SEQ ID NO: 793361 - RNA, 21 nt, Human
uaaguugcuauuucagaagag

SEQ ID NO: 793362 - RNA, 24 nt, Human
uaauuuuuuguauuuuuaguagag

SEQ ID NO: 793363 - RNA, 18 nt, Human
uacagcaacaggacagac

SEQ ID NO: 793364 - RNA, 22 nt, Human
uacaggcgcccgccaccacacc

SEQ ID NO: 793365 - RNA, 24 nt, Human
uacaggcgugagccaccacgccca

SEQ ID NO: 793366 - RNA, 19 nt, Human
uacaguauaauaggauaag

SEQ ID NO: 793367 - RNA, 21 nt, Human
uacccaaacgaacaucagagc

SEQ ID NO: 793368 - RNA, 18 nt, Human
uaccuugucucuauucug

SEQ ID NO: 793369 - RNA, 25 nt, Human
uaggaaaaaagcaaaacaaaacaaa

SEQ ID NO: 793370 - RNA, 21 nt, Human
uaguagagauggggucucacc

SEQ ID NO: 793371 - RNA, 24 nt, Human
uaguagagauggggucucaccgug

SEQ ID NO: 793372 - RNA, 25 nt, Human
uaguagagauggggucucaccgugu

SEQ ID NO: 793373 - RNA, 19 nt, Human
uagugauuuuuccccauac

SEQ ID NO: 793374 - RNA, 24 nt, Human
uauaaagacaacuaggaaaaaagc

SEQ ID NO: 793375 - RNA, 19 nt, Human
uauaagagagaaaagucau

SEQ ID NO: 793376 - RNA, 22 nt, Human
uauaaggacaucaauauucaac

SEQ ID NO: 793377 - RNA, 18 nt, Human
uauccaaaaaguguuuga

SEQ ID NO: 793378 - RNA, 19 nt, Human
uaucuagauuaucuggcca

SEQ ID NO: 793379 - RNA, 19 nt, Human
ucaaucuccugaccuugug

SEQ ID NO: 793380 - RNA, 20 nt, Human
ucaaucuccugaccuuguga

SEQ ID NO: 793381 - RNA, 24 nt, Human
ucacccaggcuggagugcaguggu

SEQ ID NO: 793382 - RNA, 24 nt, Human
ucaccguguuagccaggauggucu

SEQ ID NO: 793383 - RNA, 19 nt, Human
ucacugcaagcuccaccuc

SEQ ID NO: 793384 - RNA, 24 nt, Human
ucacugcaagcuccaccucccagg

SEQ ID NO: 793385 - RNA, 22 nt, Human
ucagacaaaaacacuaagaggc

SEQ ID NO: 793386 - RNA, 23 nt, Human
ucagacaaaaacacuaagaggca

SEQ ID NO: 793387 - RNA, 21 nt, Human
ucagagacaguauaaaaguac

SEQ ID NO: 793388 - RNA, 18 nt, Human
ucagccucccaaguagcu

SEQ ID NO: 793389 - RNA, 20 nt, Human
ucagccucccaaguagcugg

SEQ ID NO: 793390 - RNA, 25 nt, Human
ucagcucacugcaagcuccaccucc

SEQ ID NO: 793391 - RNA, 27 nt, Human
ucauuuaccaugcaugaacacuuacau

SEQ ID NO: 793392 - RNA, 21 nt, Human
uccacaaccacguacccaaac

SEQ ID NO: 793393 - RNA, 24 nt, Human
uccacaaccacguacccaaacgaa

SEQ ID NO: 793394 - RNA, 21 nt, Human
uccaccucccagguucaccac

SEQ ID NO: 793395 - RNA, 24 nt, Human
ucccaaguagcugggacuacaggc

SEQ ID NO: 793396 - RNA, 24 nt, Human
ucccagagugcugggauuacaggc

SEQ ID NO: 793397 - RNA, 21 nt, Human
ucccagguucaccacauucuc

SEQ ID NO: 793398 - RNA, 24 nt, Human
ucccagguucaccacauucuccug

SEQ ID NO: 793399 - RNA, 20 nt, Human
ucccccgcauccccuaaccc

SEQ ID NO: 793400 - RNA, 24 nt, Human
ucgcucugucacccaggcuggagu

SEQ ID NO: 793401 - RNA, 26 nt, Human
ucuccugccucagccucccaaguagc

SEQ ID NO: 793402 - RNA, 19 nt, Human
ucucgcucugucacccagg

SEQ ID NO: 793403 - RNA, 23 nt, Human
ucucgcucugucacccaggcugg

SEQ ID NO: 793404 - RNA, 24 nt, Human
ucucgcucugucacccaggcugga

SEQ ID NO: 793405 - RNA, 26 nt, Human
ucucgcucugucacccaggcuggagu

SEQ ID NO: 793406 - RNA, 27 nt, Human
ucucgcucugucacccaggcuggagug

SEQ ID NO: 793407 - RNA, 24 nt, Human
ucugucacccaggcuggagugcag

SEQ ID NO: 793408 - RNA, 18 nt, Human
ugaaaacacagacugcca

SEQ ID NO: 793409 - RNA, 24 nt, Human
ugaaaacacagacugccagaacuc

SEQ ID NO: 793410 - RNA, 19 nt, Human
ugacaacaucugugcgagu

SEQ ID NO: 793411 - RNA, 23 nt, Human
ugacaccacccuacuuaacaccu

SEQ ID NO: 793412 - RNA, 20 nt, Human
ugacaccacccuacuuaacu

SEQ ID NO: 793413 - RNA, 24 nt, Human
ugagaacauuucugauauuguugg

SEQ ID NO: 793414 - RNA, 20 nt, Human
ugagagaagccucucauuuc

SEQ ID NO: 793415 - RNA, 22 nt, Human
ugagauacccuugagagaagcc

SEQ ID NO: 793416 - RNA, 23 nt, Human
ugagauacccuugagagaagccu

SEQ ID NO: 793417 - RNA, 22 nt, Human
ugagcuaaagauaggacauuua

SEQ ID NO: 793418 - RNA, 24 nt, Human
ugauccacccaccucugccuccca

SEQ ID NO: 793419 - RNA, 20 nt, Human
ugcaauaaccagaaggugac

SEQ ID NO: 793420 - RNA, 22 nt, Human
ugcaguggugcgaucucagcuc

SEQ ID NO: 793421 - RNA, 18 nt, Human
ugccauacucaauccaaa

SEQ ID NO: 793422 - RNA, 24 nt, Human
ugccucagccucccaaguagcugg

SEQ ID NO: 793423 - RNA, 24 nt, Human
ugcugggauuacaggcgugagcca

SEQ ID NO: 793424 - RNA, 21 nt, Human
uggaaaccagagacaaaaacg

SEQ ID NO: 793425 - RNA, 23 nt, Human
uggagugcaguggugcgaucuca

SEQ ID NO: 793426 - RNA, 24 nt, Human
uggagugcaguggugcgaucucag

SEQ ID NO: 793427 - RNA, 21 nt, Human
ugggacuacaggcgcccgcca

SEQ ID NO: 793428 - RNA, 22 nt, Human
ugggacuacaggcgcccgccac

SEQ ID NO: 793429 - RNA, 24 nt, Human
ugggacuacaggcgcccgccacca

SEQ ID NO: 793430 - RNA, 18 nt, Human
ugggauuacaggcgugag

SEQ ID NO: 793431 - RNA, 19 nt, Human
ugggauuacaggcgugagc

SEQ ID NO: 793432 - RNA, 22 nt, Human
ugggauuacaggcgugagccac

SEQ ID NO: 793433 - RNA, 23 nt, Human
ugggauuacaggcgugagccacc

SEQ ID NO: 793434 - RNA, 24 nt, Human
ugggauuacaggcgugagccacca

SEQ ID NO: 793435 - RNA, 24 nt, Human
uggggucucaccguguuagccagg

SEQ ID NO: 793436 - RNA, 26 nt, Human
ugguaacaaacagcaaagaaaguuuc

SEQ ID NO: 793437 - RNA, 24 nt, Human
uggugcgaucucagcucacugcaa

SEQ ID NO: 793438 - RNA, 25 nt, Human
uguauauuacaacuggcuauaagcc

SEQ ID NO: 793439 - RNA, 21 nt, Human
uguauuuuuaguagagauggg

SEQ ID NO: 793440 - RNA, 21 nt, Human
ugucuuaggccagucaauagc

SEQ ID NO: 793441 - RNA, 24 nt, Human
ugugucugucagagcccucucuca

SEQ ID NO: 793442 - RNA, 19 nt, Human
uuaaauguugguaaguaca

SEQ ID NO: 793443 - RNA, 22 nt, Human
uuacagaaugauggaaaccaga

SEQ ID NO: 793444 - RNA, 18 nt, Human
uuaguagagauggggucu

SEQ ID NO: 793445 - RNA, 22 nt, Human
uuaguagagauggggucucacc

SEQ ID NO: 793446 - RNA, 24 nt, Human
uuaguagagauggggucucaccgu

SEQ ID NO: 793447 - RNA, 22 nt, Human
uucauugacaacaucugugcga

SEQ ID NO: 793448 - RNA, 18 nt, Human
uucuaaaugguacuugag

SEQ ID NO: 793449 - RNA, 20 nt, Human
uugaaugcuaagucagagga

SEQ ID NO: 793450 - RNA, 23 nt, Human
uuguauuuuuaguagagaugggg

SEQ ID NO: 793451 - RNA, 24 nt, Human
uuuaugccuuuauuucuugucucu

SEQ ID NO: 793452 - RNA, 21 nt, Human
uuugguaacaaacagcaaaga

SEQ ID NO: 793453 - RNA, 24 nt, Human
uuuuuaguagagauggggucucac

SEQ ID NO: 793454 - RNA, 21 nt, Human
uuuuuguauuuuuaguagaga

SEQ ID NO: 793455 - RNA, 24 nt, Human
uuuuuuguauuuuuaguagagaug

SEQ ID NO: 793456 - RNA, 21 nt, Human
aaaaacaauaccaaacacaaa

SEQ ID NO: 793457 - RNA, 22 nt, Human
aaaaagaccuaaaauggaucuu

SEQ ID NO: 793458 - RNA, 24 nt, Human
aaaagagcaaaauagcacucagug

SEQ ID NO: 793459 - RNA, 18 nt, Human
aaaauagcacucaguggc

SEQ ID NO: 793460 - RNA, 21 nt, Human
aaacaauaccaaacacaaccc

SEQ ID NO: 793461 - RNA, 22 nt, Human
aaacaauaccaaacacaaccca

SEQ ID NO: 793462 - RNA, 19 nt, Human
aaacaggagggugacugag

SEQ ID NO: 793463 - RNA, 21 nt, Human
aaacagggggauaacagaaga

SEQ ID NO: 793464 - RNA, 24 nt, Human
aaagcauccagggaaaaaguugaa

SEQ ID NO: 793465 - RNA, 20 nt, Human
aaauagaaacuggcaaauga

SEQ ID NO: 793466 - RNA, 19 nt, Human
aacaaagcauccauuauag

SEQ ID NO: 793467 - RNA, 18 nt, Human
aacagaugaauugggcag

SEQ ID NO: 793468 - RNA, 25 nt, Human
aaccacuaaaaacaauaccaaacac

SEQ ID NO: 793469 - RNA, 19 nt, Human
aaguaaaaggaccaagagu

SEQ ID NO: 793470 - RNA, 20 nt, Human
aauggaucuuucagaagaga

SEQ ID NO: 793471 - RNA, 27 nt, Human
acaacuuauuuuguuaaaaaauguguu

SEQ ID NO: 793472 - RNA, 23 nt, Human
acaauaccaaacacaacccaaac

SEQ ID NO: 793473 - RNA, 26 nt, Human
acagaacaaacagggggauaacagaa

SEQ ID NO: 793474 - RNA, 27 nt, Human
accagcagagcaauagcaauucccuuc

SEQ ID NO: 793475 - RNA, 20 nt, Human
acccaguggagcauggaaga

SEQ ID NO: 793476 - RNA, 28 nt, Human
acccaguggagcauggaagacacgauuc

SEQ ID NO: 793477 - RNA, 20 nt, Human
acccauuuaauaaugucuuu

SEQ ID NO: 793478 - RNA, 20 nt, Human
acuaaaaucaccagcagagc

SEQ ID NO: 793479 - RNA, 22 nt, Human
acuaauuucucccaggaaacca

SEQ ID NO: 793480 - RNA, 24 nt, Human
acuacaauauuacagucucuuugu

SEQ ID NO: 793481 - RNA, 21 nt, Human
agaaacuggcaaaugaaauaa

SEQ ID NO: 793482 - RNA, 23 nt, Human
agaaagaaguaaaaggaccaaga

SEQ ID NO: 793483 - RNA, 18 nt, Human
agcuuauuacagacuuuu

SEQ ID NO: 793484 - RNA, 21 nt, Human
agggacuguaggacagaugau

SEQ ID NO: 793485 - RNA, 21 nt, Human
agggggauaacagaagaaaac

SEQ ID NO: 793486 - RNA, 21 nt, Human
aguaucuaauuuacaugugac

SEQ ID NO: 793487 - RNA, 19 nt, Human
agucaccaaaguuaaaugu

SEQ ID NO: 793488 - RNA, 23 nt, Human
auggaucuuucagaagagaaagc

SEQ ID NO: 793489 - RNA, 25 nt, Human
caaaacuuuccuuuuaaaauuacaa

SEQ ID NO: 793490 - RNA, 22 nt, Human
caacccuuugaccucucucaua

SEQ ID NO: 793491 - RNA, 23 nt, Human
caauaaaaccacaccuuucagac

SEQ ID NO: 793492 - RNA, 21 nt, Human
cacaaaaaugcaguauccugc

SEQ ID NO: 793493 - RNA, 18 nt, Human
caccaaaguuaaauguuc

SEQ ID NO: 793494 - RNA, 20 nt, Human
cacuacuccuacuuuaaugc

SEQ ID NO: 793495 - RNA, 24 nt, Human
cagcagagcaauagcaauucccuu

SEQ ID NO: 793496 - RNA, 20 nt, Human
cauaauaauagacaaugaaa

SEQ ID NO: 793497 - RNA, 18 nt, Human
cauucaauaaaaccacac

SEQ ID NO: 793498 - RNA, 25 nt, Human
ccaggaaaccaacccuuugaccucc

SEQ ID NO: 793499 - RNA, 24 nt, Human
ccagugaaauuaaaaugagagcaa

SEQ ID NO: 793500 - RNA, 19 nt, Human
ccuucaacaaaacaggagg

SEQ ID NO: 793501 - RNA, 23 nt, Human
cucaaauagacauucaauaaaac

SEQ ID NO: 793502 - RNA, 19 nt, Human
cugcaagucaacacagcac

SEQ ID NO: 793503 - RNA, 24 nt, Human
cuggcugaacuuuggaaggugcug

SEQ ID NO: 793504 - RNA, 22 nt, Human
cuguccuaaggacuuuuuuaaa

SEQ ID NO: 793505 - RNA, 25 nt, Human
cuuaagcauaauaauagacaaugaa

SEQ ID NO: 793506 - RNA, 23 nt, Human
cuuuuagauaucuucuggaagau

SEQ ID NO: 793507 - RNA, 19 nt, Human
cuuuuuggccaaugaauaa

SEQ ID NO: 793508 - RNA, 21 nt, Human
gaaaacaugcacuacuccuac

SEQ ID NO: 793509 - RNA, 20 nt, Human
gagccucaauauucccuucg

SEQ ID NO: 793510 - RNA, 22 nt, Human
gcagagcaauagcaauucccuu

SEQ ID NO: 793511 - RNA, 26 nt, Human
ggacuguaggacagaugauagauugu

SEQ ID NO: 793512 - RNA, 22 nt, Human
ggagcauggaagacacgauucc

SEQ ID NO: 793513 - RNA, 23 nt, Human
guauaugcacacuuguguauaua

SEQ ID NO: 793514 - RNA, 23 nt, Human
gucuuuuuaaaaacagaaauuac

SEQ ID NO: 793515 - RNA, 24 nt, Human
guggagcauggaagacacgauucc

SEQ ID NO: 793516 - RNA, 21 nt, Human
guggagggcuguuacuuccca

SEQ ID NO: 793517 - RNA, 19 nt, Human
uaaaaaacucuagugguuc

SEQ ID NO: 793518 - RNA, 19 nt, Human
uaaaaacaauaccaaacac

SEQ ID NO: 793519 - RNA, 19 nt, Human
uaaaaucaccagcagagca

SEQ ID NO: 793520 - RNA, 26 nt, Human
uaaaaucaccagcagagcuggagacc

SEQ ID NO: 793521 - RNA, 23 nt, Human
uaacugaauauuuucuuaagcau

SEQ ID NO: 793522 - RNA, 19 nt, Human
uaauauuuaaguaucuaau

SEQ ID NO: 793523 - RNA, 18 nt, Human
uacuacugcaagucaaca

SEQ ID NO: 793524 - RNA, 22 nt, Human
uauaugcacacuuguguauaua

SEQ ID NO: 793525 - RNA, 24 nt, Human
uauaugcacacuuguguauauaua

SEQ ID NO: 793526 - RNA, 18 nt, Human
uaucugaacuucuaagcu

SEQ ID NO: 793527 - RNA, 22 nt, Human
uauuugcuuuuacgaugaaaau

SEQ ID NO: 793528 - RNA, 25 nt, Human
ucaaaguaaauagcaaacacugcug

SEQ ID NO: 793529 - RNA, 19 nt, Human
ucaaauagacauucaauaa

SEQ ID NO: 793530 - RNA, 19 nt, Human
ucaccagaagaauugaaau

SEQ ID NO: 793531 - RNA, 19 nt, Human
uccguaagcugcccuugac

SEQ ID NO: 793532 - RNA, 22 nt, Human
ucucuguggagggcuguuacuu

SEQ ID NO: 793533 - RNA, 23 nt, Human
ugaaaaaagccuucuccaccaaa

SEQ ID NO: 793534 - RNA, 24 nt, Human
ugaaaaaagccuucuccaccaaaa

SEQ ID NO: 793535 - RNA, 25 nt, Human
ugaaaaaagccuucuccaccaaaag

SEQ ID NO: 793536 - RNA, 21 nt, Human
ugaaaaauagauaaacauuga

SEQ ID NO: 793537 - RNA, 22 nt, Human
ugaauuggaaaaaauguuucaa

SEQ ID NO: 793538 - RNA, 20 nt, Human
ugagaagauauucugacuuu

SEQ ID NO: 793539 - RNA, 18 nt, Human
ugcaaagaugaugguggc

SEQ ID NO: 793540 - RNA, 21 nt, Human
ugcacacuuguguauauauau

SEQ ID NO: 793541 - RNA, 19 nt, Human
ugcaccccuagcaacacag

SEQ ID NO: 793542 - RNA, 21 nt, Human
uggaauacuaaauagaaacug

SEQ ID NO: 793543 - RNA, 24 nt, Human
uguguauauauauugugagacaua

SEQ ID NO: 793544 - RNA, 24 nt, Human
uuaaaaccacaaaaaugcaguauc

SEQ ID NO: 793545 - RNA, 21 nt, Human
uuagccuaaaaagaaauuucc

SEQ ID NO: 793546 - RNA, 24 nt, Human
uucaaaaaauuaaaugcaacugga

SEQ ID NO: 793547 - RNA, 21 nt, Human
uucaaaguaaauagcaaacac

SEQ ID NO: 793548 - RNA, 18 nt, Human
uucaauaaaaccacaccu

SEQ ID NO: 793549 - RNA, 19 nt, Human
uuccaguuucucuguggag

SEQ ID NO: 793550 - RNA, 21 nt, Human
uucuccaccaaaagagcaaaa

SEQ ID NO: 793551 - RNA, 22 nt, Human
uuguguauauauauugugagac

SEQ ID NO: 793552 - RNA, 20 nt, Human
uuuaaaguuuccuccugaug

SEQ ID NO: 793553 - RNA, 24 nt, Human
uuucauuaacuguauaugcacacu

SEQ ID NO: 793554 - RNA, 22 nt, Human
aaaaaagacucaauauuacaga

SEQ ID NO: 793555 - RNA, 24 nt, Human
aaaaauacagcagaaaauccgaug

SEQ ID NO: 793556 - RNA, 19 nt, Human
aaagcagauccucuauucc

SEQ ID NO: 793557 - RNA, 24 nt, Human
aaaguguaugagagagaaaaguca

SEQ ID NO: 793558 - RNA, 18 nt, Human
aaauaccauccagucaga

SEQ ID NO: 793559 - RNA, 22 nt, Human
aaaugcagcccuacuccugcca

SEQ ID NO: 793560 - RNA, 19 nt, Human
aacaaggugaaaccccauc

SEQ ID NO: 793561 - RNA, 20 nt, Human
aacaaggugaaaccccaucu

SEQ ID NO: 793562 - RNA, 21 nt, Human
aacaaggugaaaccccaucuc

SEQ ID NO: 793563 - RNA, 20 nt, Human
aacagagugagacuccaucu

SEQ ID NO: 793564 - RNA, 24 nt, Human
aacagagugagacuccaucucaaa

SEQ ID NO: 793565 - RNA, 23 nt, Human
aaggggagcuuguagugagcuga

SEQ ID NO: 793566 - RNA, 22 nt, Human
aaucaacaauagcaacaaugua

SEQ ID NO: 793567 - RNA, 24 nt, Human
aaugacaagaggagagaagguaag

SEQ ID NO: 793568 - RNA, 18 nt, Human
aauugcuugaaccuggga

SEQ ID NO: 793569 - RNA, 23 nt, Human
aauuuagagucuucagcgaugga

SEQ ID NO: 793570 - RNA, 18 nt, Human
acaacucacaacaaggca

SEQ ID NO: 793571 - RNA, 20 nt, Human
acagaaacgagacaaccaca

SEQ ID NO: 793572 - RNA, 24 nt, Human
acagagugagacuccaucucaaaa

SEQ ID NO: 793573 - RNA, 20 nt, Human
accagcuugaccaacaaggu

SEQ ID NO: 793574 - RNA, 24 nt, Human
accccaucucuacuaaaaauacaa

SEQ ID NO: 793575 - RNA, 24 nt, Human
accugaggucaggaguuugagacc

SEQ ID NO: 793576 - RNA, 21 nt, Human
acgccuguaaucccagcacuu

SEQ ID NO: 793577 - RNA, 24 nt, Human
acugaacuccagacugggcaacag

SEQ ID NO: 793578 - RNA, 20 nt, Human
acuggcauacaaaaugucua

SEQ ID NO: 793579 - RNA, 21 nt, Human
agaacugaaccucaugucccc

SEQ ID NO: 793580 - RNA, 22 nt, Human
agacaggagaauugcuugaacc

SEQ ID NO: 793581 - RNA, 24 nt, Human
agacaggagaauugcuugaaccug

SEQ ID NO: 793582 - RNA, 24 nt, Human
agacugggcaacagagugagacuc

SEQ ID NO: 793583 - RNA, 20 nt, Human
agaggcgaguggaucaccug

SEQ ID NO: 793584 - RNA, 24 nt, Human
agaggcgaguggaucaccugaggu

SEQ ID NO: 793585 - RNA, 19 nt, Human
agauuucacuggcauacaa

SEQ ID NO: 793586 - RNA, 27 nt, Human
agcagcugacugaaaggaaauucuaua

SEQ ID NO: 793587 - RNA, 23 nt, Human
agcugggugugguggcaggcgcc

SEQ ID NO: 793588 - RNA, 24 nt, Human
aggaguuugagaccagcuugacca

SEQ ID NO: 793589 - RNA, 19 nt, Human
aggauagucagagaggacc

SEQ ID NO: 793590 - RNA, 24 nt, Human
aggauuguaguuucugagcagcug

SEQ ID NO: 793591 - RNA, 24 nt, Human
aggcacuuaucauuuaguugggga

SEQ ID NO: 793592 - RNA, 23 nt, Human
aggcagaauggcaggggucaggg

SEQ ID NO: 793593 - RNA, 18 nt, Human
aggcagaggcgaguggau

SEQ ID NO: 793594 - RNA, 21 nt, Human
aggcccauugaaaaaacugag

SEQ ID NO: 793595 - RNA, 22 nt, Human
aggcgaguggaucaccugaggu

SEQ ID NO: 793596 - RNA, 26 nt, Human
aggcgaguggaucaccugaggucagg

SEQ ID NO: 793597 - RNA, 24 nt, Human
aggcugagacaggagaauugcuug

SEQ ID NO: 793598 - RNA, 24 nt, Human
aguaaauaaaaccaaggguguucc

SEQ ID NO: 793599 - RNA, 22 nt, Human
auacucacagauacacacagaa

SEQ ID NO: 793600 - RNA, 21 nt, Human
auaugacuucuguguguaaau

SEQ ID NO: 793601 - RNA, 20 nt, Human
aucaccugaggucaggaguu

SEQ ID NO: 793602 - RNA, 24 nt, Human
aucgcgccacugaacuccagacug

SEQ ID NO: 793603 - RNA, 18 nt, Human
auggcaggggucagggcu

SEQ ID NO: 793604 - RNA, 21 nt, Human
caaaagccuguucccccaaaa

SEQ ID NO: 793605 - RNA, 25 nt, Human
caaaaguaucuguguuguguuaccc

SEQ ID NO: 793606 - RNA, 23 nt, Human
caaagagaaaagaugcccagagc

SEQ ID NO: 793607 - RNA, 23 nt, Human
caacaauguaaagcuaaugaaaa

SEQ ID NO: 793608 - RNA, 23 nt, Human
caagacaucagauauuaaaccua

SEQ ID NO: 793609 - RNA, 23 nt, Human
caaggcaaagagaaaagaugccc

SEQ ID NO: 793610 - RNA, 26 nt, Human
caauauguauaaucaucaaagauaua

SEQ ID NO: 793611 - RNA, 21 nt, Human
cacacagaaacgagacaacca

SEQ ID NO: 793612 - RNA, 19 nt, Human
cacaucagcccuccaaauc

SEQ ID NO: 793613 - RNA, 20 nt, Human
caccaaagagaacuaaccuu

SEQ ID NO: 793614 - RNA, 23 nt, Human
caccugaggucaggaguuugaga

SEQ ID NO: 793615 - RNA, 24 nt, Human
cacugaacuccagacugggcaaca

SEQ ID NO: 793616 - RNA, 20 nt, Human
cagaggccuccacuuuuuau

SEQ ID NO: 793617 - RNA, 27 nt, Human
cagaggcgaguggaucaccugagguca

SEQ ID NO: 793618 - RNA, 18 nt, Human
cagcacuuugggaggcag

SEQ ID NO: 793619 - RNA, 21 nt, Human
caggggucagggcugggcaug

SEQ ID NO: 793620 - RNA, 22 nt, Human
ccaaaaugcaggugccaagucc

SEQ ID NO: 793621 - RNA, 20 nt, Human
ccacugaacuccagacuggg

SEQ ID NO: 793622 - RNA, 24 nt, Human
ccacugaacuccagacugggcaac

SEQ ID NO: 793623 - RNA, 19 nt, Human
ccagaaaaauacagcagaa

SEQ ID NO: 793624 - RNA, 22 nt, Human
ccagucagaagcaauuugauua

SEQ ID NO: 793625 - RNA, 19 nt, Human
cccacugugcaaauggagu

SEQ ID NO: 793626 - RNA, 27 nt, Human
cccccaaaaugcaggugccaaguccac

SEQ ID NO: 793627 - RNA, 21 nt, Human
cccugcugccuucggauucug

SEQ ID NO: 793628 - RNA, 22 nt, Human
ccugaggucaggaguuugagac

SEQ ID NO: 793629 - RNA, 19 nt, Human
ccuguagucccagcuacuc

SEQ ID NO: 793630 - RNA, 21 nt, Human
ccuguagucccagcuacucag

SEQ ID NO: 793631 - RNA, 22 nt, Human
ccuguagucccagcuacucagg

SEQ ID NO: 793632 - RNA, 23 nt, Human
cgccuguaaucccagcacuuugg

SEQ ID NO: 793633 - RNA, 24 nt, Human
cgccuguaaucccagcacuuuggg

SEQ ID NO: 793634 - RNA, 24 nt, Human
cgccuguagucccagcuacucagg

SEQ ID NO: 793635 - RNA, 23 nt, Human
cuacuccugccaaauaccaucca

SEQ ID NO: 793636 - RNA, 18 nt, Human
cuccaaaucaccaucaau

SEQ ID NO: 793637 - RNA, 25 nt, Human
cuccaucucaaaaaaaaaaaauugc

SEQ ID NO: 793638 - RNA, 21 nt, Human
cugcugccuucggauucuggc

SEQ ID NO: 793639 - RNA, 22 nt, Human
cuuacgccuguaaucccagcac

SEQ ID NO: 793640 - RNA, 21 nt, Human
cuuguagugagcugagaucgc

SEQ ID NO: 793641 - RNA, 19 nt, Human
cuuuccucugaaaagcaga

SEQ ID NO: 793642 - RNA, 18 nt, Human
cuuuucacccaguauuuu

SEQ ID NO: 793643 - RNA, 18 nt, Human
gaaacgagacaaccacag

SEQ ID NO: 793644 - RNA, 21 nt, Human
gacaaacauccacaguucugu

SEQ ID NO: 793645 - RNA, 23 nt, Human
gagcuuguagugagcugagaucg

SEQ ID NO: 793646 - RNA, 24 nt, Human
gaggagcagucuugcagcagcugc

SEQ ID NO: 793647 - RNA, 23 nt, Human
gaguggaucaccugaggucagga

SEQ ID NO: 793648 - RNA, 21 nt, Human
gauaaacuggaaaaauuuaga

SEQ ID NO: 793649 - RNA, 24 nt, Human
gaucaccugaggucaggaguuuga

SEQ ID NO: 793650 - RNA, 20 nt, Human
gauucuggcauaauuugcuc

SEQ ID NO: 793651 - RNA, 24 nt, Human
gccacugaacuccagacugggcaa

SEQ ID NO: 793652 - RNA, 21 nt, Human
gcugggugugguggcuuacgc

SEQ ID NO: 793653 - RNA, 24 nt, Human
ggagcuuguagugagcugagaucg

SEQ ID NO: 793654 - RNA, 22 nt, Human
ggaucaccugaggucaggaguu

SEQ ID NO: 793655 - RNA, 19 nt, Human
ggcagacuagguggagaag

SEQ ID NO: 793656 - RNA, 20 nt, Human
ggcaggggucagggcugggc

SEQ ID NO: 793657 - RNA, 20 nt, Human
ggccuucuugucacagucuu

SEQ ID NO: 793658 - RNA, 18 nt, Human
gggagacaaaacaugcag

SEQ ID NO: 793659 - RNA, 24 nt, Human
gggugugguggcuuacgccuguaa

SEQ ID NO: 793660 - RNA, 19 nt, Human
ggucaggaguuugagacca

SEQ ID NO: 793661 - RNA, 24 nt, Human
gguggcaggcgccuguagucccag

SEQ ID NO: 793662 - RNA, 24 nt, Human
gguggcuuacgccuguaaucccag

SEQ ID NO: 793663 - RNA, 22 nt, Human
ggugugguggcaggcgccugua

SEQ ID NO: 793664 - RNA, 20 nt, Human
guagaagaacugaaccucau

SEQ ID NO: 793665 - RNA, 18 nt, Human
guuguacucaucuguccc

SEQ ID NO: 793666 - RNA, 21 nt, Human
guuguguuaccccuaaauuca

SEQ ID NO: 793667 - RNA, 24 nt, Human
uaaaccuauacauuauugguguua

SEQ ID NO: 793668 - RNA, 18 nt, Human
uaaagagcuauauaaacc

SEQ ID NO: 793669 - RNA, 26 nt, Human
uaaauauacucacagauacacacaga

SEQ ID NO: 793670 - RNA, 20 nt, Human
uaaauucaaaaaauaugacu

SEQ ID NO: 793671 - RNA, 19 nt, Human
uaagaaagaaaaaagacuc

SEQ ID NO: 793672 - RNA, 25 nt, Human
uaauuuuuuuuaauaaacuaugcag

SEQ ID NO: 793673 - RNA, 21 nt, Human
uacaacucacaacaaggcaga

SEQ ID NO: 793674 - RNA, 25 nt, Human
uacauuauugguguuacuggagagg

SEQ ID NO: 793675 - RNA, 24 nt, Human
uacgccuguaaucccagcacuuug

SEQ ID NO: 793676 - RNA, 19 nt, Human
uagcaacaauguaaagcua

SEQ ID NO: 793677 - RNA, 22 nt, Human
uaggcccauugaaaaaacugag

SEQ ID NO: 793678 - RNA, 22 nt, Human
uagggcagacuagguggagaag

SEQ ID NO: 793679 - RNA, 19 nt, Human
uauaaguaauuucacauaa

SEQ ID NO: 793680 - RNA, 23 nt, Human
ucaacaauagcaacaauguaaag

SEQ ID NO: 793681 - RNA, 18 nt, Human
ucaacuugagaacugcuu

SEQ ID NO: 793682 - RNA, 22 nt, Human
ucaagugaggaugaagagagag

SEQ ID NO: 793683 - RNA, 19 nt, Human
ucaccaaagagaacuaacc

SEQ ID NO: 793684 - RNA, 19 nt, Human
ucaccugaggucaggaguu

SEQ ID NO: 793685 - RNA, 22 nt, Human
ucccccaaaaugcaggugccaa

SEQ ID NO: 793686 - RNA, 25 nt, Human
ucuccacuggggguguacagugcuc

SEQ ID NO: 793687 - RNA, 20 nt, Human
ucucuacuaaaaauacaaaa

SEQ ID NO: 793688 - RNA, 18 nt, Human
ucuggcauaauuugcucu

SEQ ID NO: 793689 - RNA, 19 nt, Human
ugaaaagcagagaggacua

SEQ ID NO: 793690 - RNA, 19 nt, Human
ugaaaccccaucucuacua

SEQ ID NO: 793691 - RNA, 21 nt, Human
ugaaaggaaauucuauaaagc

SEQ ID NO: 793692 - RNA, 22 nt, Human
ugaccaacaaggugaaacccca

SEQ ID NO: 793693 - RNA, 24 nt, Human
ugagacaggagaauugcuugaacc

SEQ ID NO: 793694 - RNA, 24 nt, Human
ugagacaggagaauugcuugaacc

SEQ ID NO: 793695 - RNA, 23 nt, Human
ugagaccagcuugaccaacaagg

SEQ ID NO: 793696 - RNA, 22 nt, Human
ugagaucgcgccacugaacucc

SEQ ID NO: 793697 - RNA, 24 nt, Human
ugagaucgcgccacugaacuccag

SEQ ID NO: 793698 - RNA, 24 nt, Human
ugagcugagaucgcgccacugaac

SEQ ID NO: 793699 - RNA, 18 nt, Human
ugaggucaggaguuugag

SEQ ID NO: 793700 - RNA, 22 nt, Human
ugauaacaguaauacugauuaa

SEQ ID NO: 793701 - RNA, 21 nt, Human
ugcagcagcugccuguauggc

SEQ ID NO: 793702 - RNA, 19 nt, Human
ugccauguugguuaaaugc

SEQ ID NO: 793703 - RNA, 23 nt, Human
uggaucaccugaggucaggaguu

SEQ ID NO: 793704 - RNA, 24 nt, Human
uggaucaccugaggucaggaguuu

SEQ ID NO: 793705 - RNA, 27 nt, Human
uggaucaccugaggucaggaguuugag

SEQ ID NO: 793706 - RNA, 19 nt, Human
uggcaggggucagggcugg

SEQ ID NO: 793707 - RNA, 24 nt, Human
uggcuuacgccuguaaucccagca

SEQ ID NO: 793708 - RNA, 20 nt, Human
ugggaggcagaggcgagugg

SEQ ID NO: 793709 - RNA, 24 nt, Human
ugggaggcagaggcgaguggauca

SEQ ID NO: 793710 - RNA, 20 nt, Human
ugggcugggugugguggcuu

SEQ ID NO: 793711 - RNA, 20 nt, Human
ugggcugggugugguggcuu

SEQ ID NO: 793712 - RNA, 24 nt, Human
uggguaaagaaaguuuucuuucca

SEQ ID NO: 793713 - RNA, 24 nt, Human
ugguggcaggcgccuguaguccca

SEQ ID NO: 793714 - RNA, 24 nt, Human
ugguggcuuacgccuguaauccca

SEQ ID NO: 793715 - RNA, 20 nt, Human
uguauaaucaucaaagauau

SEQ ID NO: 793716 - RNA, 22 nt, Human
ugucuagggucaccaaagagaa

SEQ ID NO: 793717 - RNA, 19 nt, Human
ugugacaaacauccacagu

SEQ ID NO: 793718 - RNA, 23 nt, Human
ugugcagguuuguuacauaugua

SEQ ID NO: 793719 - RNA, 23 nt, Human
ugugguggcaggcgccuguaguc

SEQ ID NO: 793720 - RNA, 18 nt, Human
uguuacauauguauacau

SEQ ID NO: 793721 - RNA, 19 nt, Human
uguuacauauguauacaug

SEQ ID NO: 793722 - RNA, 24 nt, Human
uguucauucuucaaaauaggccca

SEQ ID NO: 793723 - RNA, 18 nt, Human
uuagcugggugugguggc

SEQ ID NO: 793724 - RNA, 24 nt, Human
uuagcugggugugguggcaggcgc

SEQ ID NO: 793725 - RNA, 19 nt, Human
uucuguuuauaagugggua

SEQ ID NO: 793726 - RNA, 24 nt, Human
uugaugagaaaaauggagaacaaa

SEQ ID NO: 793727 - RNA, 20 nt, Human
uugcuugaaccugggaaggg

SEQ ID NO: 793728 - RNA, 21 nt, Human
uugcuugaaccugggaagggg

SEQ ID NO: 793729 - RNA, 20 nt, Human
uugggaggcagaggcgagug

SEQ ID NO: 793730 - RNA, 19 nt, Human
uuguagugagcugagaucg

SEQ ID NO: 793731 - RNA, 21 nt, Human
uuuaacucuuuugggguuuug

SEQ ID NO: 793732 - RNA, 23 nt, Human
uuuauaaguggguaaagaaaguu

SEQ ID NO: 793733 - RNA, 23 nt, Human
uuuccagaaaaauacagcagaaa

SEQ ID NO: 793734 - RNA, 21 nt, Human
uuuuuugggcugggugugggg

SEQ ID NO: 793735 - RNA, 20 nt, Human
aaaacauaaccccaaaauau

SEQ ID NO: 793736 - RNA, 18 nt, Human
aaaaccaauagaaaaccc

SEQ ID NO: 793737 - RNA, 23 nt, Human
aaaaccaauagaaaacccauaca

SEQ ID NO: 793738 - RNA, 18 nt, Human
aaaaucauaauccaaaga

SEQ ID NO: 793739 - RNA, 26 nt, Human
aaacauaaccccaaaauauaauggua

SEQ ID NO: 793740 - RNA, 24 nt, Human
aaagaagaaaaccaaauuagagaa

SEQ ID NO: 793741 - RNA, 25 nt, Human
aaagaagcaaaacauaaccccaaaa

SEQ ID NO: 793742 - RNA, 18 nt, Human
aaagacaggcucuucugg

SEQ ID NO: 793743 - RNA, 18 nt, Human
aaauauacacaccaugca

SEQ ID NO: 793744 - RNA, 18 nt, Human
aaaugacucauguaacau

SEQ ID NO: 793745 - RNA, 21 nt, Human
aacaucuucuucauucugcuc

SEQ ID NO: 793746 - RNA, 20 nt, Human
aacaugaaaaggagugauaa

SEQ ID NO: 793747 - RNA, 21 nt, Human
aacuagaaagagagggaauca

SEQ ID NO: 793748 - RNA, 23 nt, Human
aagaagaaaaccaaauuagagaa

SEQ ID NO: 793749 - RNA, 18 nt, Human
aagaagcaaaacauaacc

SEQ ID NO: 793750 - RNA, 18 nt, Human
aagcaaaacauaacccca

SEQ ID NO: 793751 - RNA, 23 nt, Human
aaguaucuuuuuaagaccaugaa

SEQ ID NO: 793752 - RNA, 20 nt, Human
aauucacucccaccaagccu

SEQ ID NO: 793753 - RNA, 20 nt, Human
accaagccuuccagagcucc

SEQ ID NO: 793754 - RNA, 19 nt, Human
accaugaaaccucuuguca

SEQ ID NO: 793755 - RNA, 19 nt, Human
agaagaaaaccaaauuaga

SEQ ID NO: 793756 - RNA, 22 nt, Human
agacagguaaaaaaauuaucuu

SEQ ID NO: 793757 - RNA, 22 nt, Human
aguggcuuugggguagagaaga

SEQ ID NO: 793758 - RNA, 21 nt, Human
aucuuaaagaagcaaaacaua

SEQ ID NO: 793759 - RNA, 23 nt, Human
caaaaaaccaauagaaaacccau

SEQ ID NO: 793760 - RNA, 21 nt, Human
caaaacccacacaaacaucuu

SEQ ID NO: 793761 - RNA, 19 nt, Human
caaccaaacaauugagcug

SEQ ID NO: 793762 - RNA, 19 nt, Human
caauuuuaucauuaccaua

SEQ ID NO: 793763 - RNA, 22 nt, Human
caccuccugaauuggucaauuc

SEQ ID NO: 793764 - RNA, 21 nt, Human
cacuguguaacaagcccuugu

SEQ ID NO: 793765 - RNA, 19 nt, Human
cagacaguacaaggcacac

SEQ ID NO: 793766 - RNA, 18 nt, Human
cagggugauuccuaccaa

SEQ ID NO: 793767 - RNA, 28 nt, Human
cauaaccccaaaauauaaugguagcagg

SEQ ID NO: 793768 - RNA, 18 nt, Human
ccaccgcgcucgccgcuc

SEQ ID NO: 793769 - RNA, 21 nt, Human
ccaggcccuaauugauacuga

SEQ ID NO: 793770 - RNA, 24 nt, Human
cccaccaagccuuccagagcucca

SEQ ID NO: 793771 - RNA, 20 nt, Human
ccccaccgcgcucgccgcuc

SEQ ID NO: 793772 - RNA, 19 nt, Human
ccucucugcugccccccuc

SEQ ID NO: 793773 - RNA, 18 nt, Human
ccucuuuguucgcggccc

SEQ ID NO: 793774 - RNA, 22 nt, Human
ccuuugacuuaacacgagugca

SEQ ID NO: 793775 - RNA, 18 nt, Human
cuaucuuaaagaagcaaa

SEQ ID NO: 793776 - RNA, 20 nt, Human
cucgcagugucucugacgcc

SEQ ID NO: 793777 - RNA, 24 nt, Human
cucgccgcucgcagugucucugac

SEQ ID NO: 793778 - RNA, 18 nt, Human
cucgcgccucggcuccuc

SEQ ID NO: 793779 - RNA, 24 nt, Human
cugccacaauuguaaggugugggc

SEQ ID NO: 793780 - RNA, 18 nt, Human
cugcugccccccucacgc

SEQ ID NO: 793781 - RNA, 20 nt, Human
cuuaaaaaaaaaaaaaaguu

SEQ ID NO: 793782 - RNA, 24 nt, Human
cuuaaaauauggagaaaagacagg

SEQ ID NO: 793783 - RNA, 18 nt, Human
cuucucucaaguuucugu

SEQ ID NO: 793784 - RNA, 19 nt, Human
cuucugcuauaaaacuaaa

SEQ ID NO: 793785 - RNA, 21 nt, Human
cuucuggauccugccacaauu

SEQ ID NO: 793786 - RNA, 22 nt, Human
gaaaagacagguaaaaaaauua

SEQ ID NO: 793787 - RNA, 22 nt, Human
gaagcaaaacauaaccccaaaa

SEQ ID NO: 793788 - RNA, 21 nt, Human
gacagugacuacaacuucaau

SEQ ID NO: 793789 - RNA, 18 nt, Human
gaccacuuucacuaauga

SEQ ID NO: 793790 - RNA, 21 nt, Human
gacuccucucugcugcccccc

SEQ ID NO: 793791 - RNA, 22 nt, Human
gcaaaaaaccaauagaaaaccc

SEQ ID NO: 793792 - RNA, 24 nt, Human
gcagggaggaggagaggggaaaau

SEQ ID NO: 793793 - RNA, 19 nt, Human
gccccccucacgcgcgcac

SEQ ID NO: 793794 - RNA, 18 nt, Human
gccgcggcggcaccggga

SEQ ID NO: 793795 - RNA, 24 nt, Human
gcucucaacaggagauaauccagc

SEQ ID NO: 793796 - RNA, 18 nt, Human
gcugaugcagaugcggcc

SEQ ID NO: 793797 - RNA, 20 nt, Human
ggccccaccgcgcucgccgc

SEQ ID NO: 793798 - RNA, 19 nt, Human
gggaggacauaaaagacca

SEQ ID NO: 793799 - RNA, 19 nt, Human
gguagagaagagaacacug

SEQ ID NO: 793800 - RNA, 21 nt, Human
guaacaagcccuuguuacaaa

SEQ ID NO: 793801 - RNA, 21 nt, Human
gugaaaugacgcuucauagcc

SEQ ID NO: 793802 - RNA, 23 nt, Human
guucauaguugugugcaucccuu

SEQ ID NO: 793803 - RNA, 22 nt, Human
uaaaguaucuuuuuaagaccau

SEQ ID NO: 793804 - RNA, 21 nt, Human
uaaaucagacaguacaaggca

SEQ ID NO: 793805 - RNA, 20 nt, Human
uaacacgagugcaucacuua

SEQ ID NO: 793806 - RNA, 22 nt, Human
uaaugacuuguguaguggcuaa

SEQ ID NO: 793807 - RNA, 22 nt, Human
uaauucuuaaaggaaaaaaaaa

SEQ ID NO: 793808 - RNA, 24 nt, Human
uacaaacucaucuuaacaggaaau

SEQ ID NO: 793809 - RNA, 19 nt, Human
uacauuauauuaccuaaug

SEQ ID NO: 793810 - RNA, 20 nt, Human
uaccaccacuaucucacaaa

SEQ ID NO: 793811 - RNA, 19 nt, Human
uagaaagagagggaaucac

SEQ ID NO: 793812 - RNA, 20 nt, Human
uagaaagagagggaaucacu

SEQ ID NO: 793813 - RNA, 19 nt, Human
uagucuccugguuaacuca

SEQ ID NO: 793814 - RNA, 24 nt, Human
uauacacaccaugcacagucuaua

SEQ ID NO: 793815 - RNA, 25 nt, Human
uauguuugguuucccaaagaagaaa

SEQ ID NO: 793816 - RNA, 24 nt, Human
ucaaaacgaaucucuugcucucaa

SEQ ID NO: 793817 - RNA, 22 nt, Human
ucacuguguaacaagcccuugu

SEQ ID NO: 793818 - RNA, 18 nt, Human
ucauguuucuauuuccca

SEQ ID NO: 793819 - RNA, 20 nt, Human
uccauuucagacuuugcucu

SEQ ID NO: 793820 - RNA, 18 nt, Human
ucccaaagaagaaaacca

SEQ ID NO: 793821 - RNA, 23 nt, Human
ucgcggccccgcagcggcugcgg

SEQ ID NO: 793822 - RNA, 24 nt, Human
ucuaucuuaaagaagcaaaacaua

SEQ ID NO: 793823 - RNA, 19 nt, Human
ucucgcgccucggcuccuc

SEQ ID NO: 793824 - RNA, 19 nt, Human
ucucucaaguuucugucuc

SEQ ID NO: 793825 - RNA, 18 nt, Human
ucugacgccgcggcggca

SEQ ID NO: 793826 - RNA, 21 nt, Human
ucuucagaaauguucauaguu

SEQ ID NO: 793827 - RNA, 23 nt, Human
ucuucagaaauguucauaguugu

SEQ ID NO: 793828 - RNA, 18 nt, Human
ugagaaaaaaucuucaga

SEQ ID NO: 793829 - RNA, 19 nt, Human
ugagaaaacugugguaagg

SEQ ID NO: 793830 - RNA, 23 nt, Human
ugcaucacuuaccaccacuaucu

SEQ ID NO: 793831 - RNA, 23 nt, Human
ugccccccucacgcgcgcacaca

SEQ ID NO: 793832 - RNA, 21 nt, Human
uggaaguccacaaaugugcuc

SEQ ID NO: 793833 - RNA, 23 nt, Human
ugguagcagggaggaggagaggg

SEQ ID NO: 793834 - RNA, 23 nt, Human
ugguagcagggaggaggagaggg

SEQ ID NO: 793835 - RNA, 19 nt, Human
uguaaggugugggcaaauu

SEQ ID NO: 793836 - RNA, 19 nt, Human
ugugcuggggcaucagagu

SEQ ID NO: 793837 - RNA, 18 nt, Human
uuaagaccaugaaaccuc

SEQ ID NO: 793838 - RNA, 21 nt, Human
uuacugagaaaaaaucuucag

SEQ ID NO: 793839 - RNA, 18 nt, Human
uuauuauguauuucccau

SEQ ID NO: 793840 - RNA, 24 nt, Human
uucaauuuccccuacuuuccaacc

SEQ ID NO: 793841 - RNA, 25 nt, Human
uucacaguguuucuuauagccuuug

SEQ ID NO: 793842 - RNA, 21 nt, Human
uucacucccaccaagccuucc

SEQ ID NO: 793843 - RNA, 23 nt, Human
uucacucuaugucaaaacgaauc

SEQ ID NO: 793844 - RNA, 19 nt, Human
uucauagccauucucagac

SEQ ID NO: 793845 - RNA, 20 nt, Human
uugaugucugucugcuggga

SEQ ID NO: 793846 - RNA, 18 nt, Human
uuguauguuugguuuccc

SEQ ID NO: 793847 - RNA, 27 nt, Human
uuguauguuugguuucccaaagaagaa

SEQ ID NO: 793848 - RNA, 20 nt, Human
uuuagucauauaucuuaaaa

SEQ ID NO: 793849 - RNA, 18 nt, Human
uuucugucucucuacccc

SEQ ID NO: 793850 - RNA, 23 nt, Human
aaaaaaccacaaaugucacaaug

SEQ ID NO: 793851 - RNA, 23 nt, Human
aaacuaagaccaaagauugaaga

SEQ ID NO: 793852 - RNA, 23 nt, Human
aacuacuaaaagaaauacaucag

SEQ ID NO: 793853 - RNA, 20 nt, Human
aacugaaaauauuuuggcac

SEQ ID NO: 793854 - RNA, 22 nt, Human
aaguaauugaagaucacaaggu

SEQ ID NO: 793855 - RNA, 22 nt, Human
aauaaccagacaucagaaggaa

SEQ ID NO: 793856 - RNA, 21 nt, Human
aaucacaaaucccacucaagu

SEQ ID NO: 793857 - RNA, 19 nt, Human
aauugcuaaaaaaaauuac

SEQ ID NO: 793858 - RNA, 20 nt, Human
acgugguguugccauuuggc

SEQ ID NO: 793859 - RNA, 27 nt, Human
agccagaauuguuuuuuugugguacua

SEQ ID NO: 793860 - RNA, 20 nt, Human
auaaaauacucuucaaauaa

SEQ ID NO: 793861 - RNA, 18 nt, Human
aucaauuacacaggcacu

SEQ ID NO: 793862 - RNA, 22 nt, Human
aucacaaaucccacucaaguaa

SEQ ID NO: 793863 - RNA, 24 nt, Human
aucccacucaaguaaugaaaauca

SEQ ID NO: 793864 - RNA, 24 nt, Human
caacuaaaaaauuaacaacuaaug

SEQ ID NO: 793865 - RNA, 22 nt, Human
caacugaucaaaaaaaguacag

SEQ ID NO: 793866 - RNA, 18 nt, Human
caacugcugcucucugag

SEQ ID NO: 793867 - RNA, 24 nt, Human
cacauauuacugacuuuacaaaau

SEQ ID NO: 793868 - RNA, 24 nt, Human
cacaucuguauucuaaagccaaaa

SEQ ID NO: 793869 - RNA, 19 nt, Human
caggauucacaaauggcca

SEQ ID NO: 793870 - RNA, 22 nt, Human
cugauagaaugcugcucaaagg

SEQ ID NO: 793871 - RNA, 20 nt, Human
gaccucagagaagcccaucu

SEQ ID NO: 793872 - RNA, 23 nt, Human
gcaauggacuaacuaaaaaacca

SEQ ID NO: 793873 - RNA, 24 nt, Human
uaaaaaaccacaaaugucacaaug

SEQ ID NO: 793874 - RNA, 27 nt, Human
uaaaauaauucauacuagauugauuaa

SEQ ID NO: 793875 - RNA, 21 nt, Human
uaaagaaugcuacagugaggu

SEQ ID NO: 793876 - RNA, 20 nt, Human
uaacagaaauagauaucuau

SEQ ID NO: 793877 - RNA, 18 nt, Human
uaacauuguaggggacca

SEQ ID NO: 793878 - RNA, 21 nt, Human
uaacugaaaaguaacugaaau

SEQ ID NO: 793879 - RNA, 24 nt, Human
uaagaaaauggccuacaauuucac

SEQ ID NO: 793880 - RNA, 21 nt, Human
uaauagccauaaaaacauuua

SEQ ID NO: 793881 - RNA, 30 nt, Human
uaaugaacacaucuguauucuaaagccaaa

SEQ ID NO: 793882 - RNA, 20 nt, Human
uaccauuuggcacacuaguu

SEQ ID NO: 793883 - RNA, 21 nt, Human
uaccuaaguuaaaacaaggac

SEQ ID NO: 793884 - RNA, 18 nt, Human
uagaaaacuaagaccaaa

SEQ ID NO: 793885 - RNA, 20 nt, Human
uauccagauguuuacuaaua

SEQ ID NO: 793886 - RNA, 26 nt, Human
uaugaaacaggacaacacuuguaaaa

SEQ ID NO: 793887 - RNA, 24 nt, Human
uauuuauuugccauuucuuacaua

SEQ ID NO: 793888 - RNA, 18 nt, Human
ucaaaguaauugaagauc

SEQ ID NO: 793889 - RNA, 23 nt, Human
ucaauaacugaugaaauagauaa

SEQ ID NO: 793890 - RNA, 18 nt, Human
ucuaaagccaaaauuuaa

SEQ ID NO: 793891 - RNA, 24 nt, Human
ucugugaccaauacaaaccggggc

SEQ ID NO: 793892 - RNA, 20 nt, Human
ugaaaaauuccugcaauacc

SEQ ID NO: 793893 - RNA, 23 nt, Human
ugaaaaauuccugcaauaccaac

SEQ ID NO: 793894 - RNA, 24 nt, Human
ugaaauacccaggccaacauuuuu

SEQ ID NO: 793895 - RNA, 22 nt, Human
ugaaauagauaauagccauaaa

SEQ ID NO: 793896 - RNA, 18 nt, Human
ugcaauggacuaacuaaa

SEQ ID NO: 793897 - RNA, 22 nt, Human
uggacuaacuaaaaaaccacaa

SEQ ID NO: 793898 - RNA, 23 nt, Human
uggcaguuuuaucaaaauguccu

SEQ ID NO: 793899 - RNA, 23 nt, Human
uguuauaagaaaauggccuacaa

SEQ ID NO: 793900 - RNA, 23 nt, Human
uuaaaaaagucauuaaacuagca

SEQ ID NO: 793901 - RNA, 22 nt, Human
uuacaguaauguuuuugaaaaa

SEQ ID NO: 793902 - RNA, 20 nt, Human
uucaaaaaauucaguuaaaa

SEQ ID NO: 793903 - RNA, 20 nt, Human
uucaaggggugcaaauaacc

SEQ ID NO: 793904 - RNA, 19 nt, Human
uugguauuuuugacaacau

SEQ ID NO: 793905 - RNA, 21 nt, Human
uuuaaaguuccauugacucua

SEQ ID NO: 793906 - RNA, 21 nt, Human
uuuaacaucaaaguaauugaa

SEQ ID NO: 793907 - RNA, 21 nt, Human
uuucaaggggugcaaauaacc

SEQ ID NO: 793908 - RNA, 21 nt, Human
uuugaaauacccaggccaaca

SEQ ID NO: 793909 - RNA, 18 nt, Human
uuuguguaacauuuucaa

SEQ ID NO: 793910 - RNA, 23 nt, Human
uuuuucuacuccuuuuuucuaga

SEQ ID NO: 793911 - RNA, 22 nt, Human
aaaaaaaaaaaaaaggaaagaa

SEQ ID NO: 793912 - RNA, 21 nt, Human
aaaagaaaacauaccacagag

SEQ ID NO: 793913 - RNA, 23 nt, Human
aaaagaaaacauaccacagagaa

SEQ ID NO: 793914 - RNA, 26 nt, Human
aaaagaaaagaaaacauaccacagag

SEQ ID NO: 793915 - RNA, 30 nt, Human
aaaauacaggccgggcgcgguggcucacgg

SEQ ID NO: 793916 - RNA, 20 nt, Human
aaacaaaagaaaagaaaaca

SEQ ID NO: 793917 - RNA, 18 nt, Human
aaacuaauuuauuauagu

SEQ ID NO: 793918 - RNA, 21 nt, Human
aacaaaaaaaaaaaaaaggaa

SEQ ID NO: 793919 - RNA, 21 nt, Human
aacacagacuggaagccuaga

SEQ ID NO: 793920 - RNA, 24 nt, Human
aacaugaccaacauggugaaaccc

SEQ ID NO: 793921 - RNA, 28 nt, Human
aacaugcacacacacacacacaaaugca

SEQ ID NO: 793922 - RNA, 20 nt, Human
aacauggugaaacccugucu

SEQ ID NO: 793923 - RNA, 21 nt, Human
aacauggugaaacccugucuc

SEQ ID NO: 793924 - RNA, 24 nt, Human
aaccaaacacagacuggaagccua

SEQ ID NO: 793925 - RNA, 26 nt, Human
aacuacauguauuuauagcuccaaaa

SEQ ID NO: 793926 - RNA, 19 nt, Human
aacuaguuuuagaacuccu

SEQ ID NO: 793927 - RNA, 19 nt, Human
aagcagaguuacauguuuc

SEQ ID NO: 793928 - RNA, 25 nt, Human
aagccugcagaugucuuuucuuuaa

SEQ ID NO: 793929 - RNA, 18 nt, Human
aaguaaaagaaggaaagc

SEQ ID NO: 793930 - RNA, 21 nt, Human
aaguuuggccaaugauggacc

SEQ ID NO: 793931 - RNA, 24 nt, Human
aauaucaaaaacaugcuugaaaga

SEQ ID NO: 793932 - RNA, 19 nt, Human
aauccucugaagucaggua

SEQ ID NO: 793933 - RNA, 18 nt, Human
aaucgcuugaaccuggga

SEQ ID NO: 793934 - RNA, 24 nt, Human
aaucgcuugaaccugggaggcaga

SEQ ID NO: 793935 - RNA, 23 nt, Human
aaugucacucacugcuuaauaac

SEQ ID NO: 793936 - RNA, 23 nt, Human
acaaaaaaaaaaaaaaggaaaga

SEQ ID NO: 793937 - RNA, 30 nt, Human
acaaaagaaaagaaaacauaccacagagaa

SEQ ID NO: 793938 - RNA, 22 nt, Human
acaacaaaaaaaaaaaaaagga

SEQ ID NO: 793939 - RNA, 23 nt, Human
acacacacacacaaaugcacaca

SEQ ID NO: 793940 - RNA, 24 nt, Human
acagagcaagacccugucuuaaaa

SEQ ID NO: 793941 - RNA, 29 nt, Human
acaugcacacacacacacacaaaugcaca

SEQ ID NO: 793942 - RNA, 25 nt, Human
accaacauggugaaacccugucucc

SEQ ID NO: 793943 - RNA, 24 nt, Human
acccugucucuacuaaaaauauaa

SEQ ID NO: 793944 - RNA, 20 nt, Human
accucauuugucuccuggaa

SEQ ID NO: 793945 - RNA, 24 nt, Human
acugcacuccagccugggcaacag

SEQ ID NO: 793946 - RNA, 24 nt, Human
acugcacuccagccugggcaacag

SEQ ID NO: 793947 - RNA, 19 nt, Human
acugugggaggcuggcagg

SEQ ID NO: 793948 - RNA, 25 nt, Human
agaaaagaaaacauaccacagagaa

SEQ ID NO: 793949 - RNA, 19 nt, Human
agaauaggacaaccugcag

SEQ ID NO: 793950 - RNA, 22 nt, Human
agaaucgcuugaaccugggagg

SEQ ID NO: 793951 - RNA, 18 nt, Human
agagguugcagugagcca

SEQ ID NO: 793952 - RNA, 20 nt, Human
agagguugcagugagccaag

SEQ ID NO: 793953 - RNA, 22 nt, Human
agagguugcagugagccaagau

SEQ ID NO: 793954 - RNA, 24 nt, Human
agagguugcagugagccaagaugg

SEQ ID NO: 793955 - RNA, 23 nt, Human
agaugacaaguaaaagaaggaaa

SEQ ID NO: 793956 - RNA, 22 nt, Human
agauggcgccacugcacuccag

SEQ ID NO: 793957 - RNA, 20 nt, Human
agcacaacaacuaaaauaaa

SEQ ID NO: 793958 - RNA, 23 nt, Human
agcuaggcguggugguacgugcc

SEQ ID NO: 793959 - RNA, 19 nt, Human
agcucaacuccugacaccc

SEQ ID NO: 793960 - RNA, 22 nt, Human
aggaaacauacauuuggcauuc

SEQ ID NO: 793961 - RNA, 23 nt, Human
aggaguucgagaccaacaugacc

SEQ ID NO: 793962 - RNA, 24 nt, Human
aggcagagguugcagugagccaag

SEQ ID NO: 793963 - RNA, 22 nt, Human
aggcaggagaaucgcuugaacc

SEQ ID NO: 793964 - RNA, 24 nt, Human
aggcaggagaaucgcuugaaccug

SEQ ID NO: 793965 - RNA, 24 nt, Human
aggcguggugguacgugccuguaa

SEQ ID NO: 793966 - RNA, 25 nt, Human
aggcuggagugcaguggugcgaucu

SEQ ID NO: 793967 - RNA, 21 nt, Human
agggggcagaucaugagguca

SEQ ID NO: 793968 - RNA, 31 nt, Human
agucacuaaacaugcacacacacacacagug

SEQ ID NO: 793969 - RNA, 20 nt, Human
agugcaguggugcgaucucg

SEQ ID NO: 793970 - RNA, 23 nt, Human
agugcaguggugcgaucucggcu

SEQ ID NO: 793971 - RNA, 24 nt, Human
agugcaguggugcgaucucggcuc

SEQ ID NO: 793972 - RNA, 21 nt, Human
auaaaaaccaaacacagacug

SEQ ID NO: 793973 - RNA, 18 nt, Human
auaaagcaaaaacgucuu

SEQ ID NO: 793974 - RNA, 22 nt, Human
auaauaaugauaagaauaaaaa

SEQ ID NO: 793975 - RNA, 19 nt, Human
auaauuguuauucaucauc

SEQ ID NO: 793976 - RNA, 18 nt, Human
auaggacaaccugcaggg

SEQ ID NO: 793977 - RNA, 22 nt, Human
augaacauguuuauauaaccuc

SEQ ID NO: 793978 - RNA, 25 nt, Human
augaccaacauggugaaacccuguc

SEQ ID NO: 793979 - RNA, 21 nt, Human
augcacacacucauacauagg

SEQ ID NO: 793980 - RNA, 24 nt, Human
auggcgccacugcacuccagccug

SEQ ID NO: 793981 - RNA, 24 nt, Human
auucauuguuuaaaggcaaacauu

SEQ ID NO: 793982 - RNA, 20 nt, Human
auuccauauacuuucuacau

SEQ ID NO: 793983 - RNA, 23 nt, Human
auuugcacaaugacggaaucacc

SEQ ID NO: 793984 - RNA, 21 nt, Human
caacagagcaagacccugucu

SEQ ID NO: 793985 - RNA, 24 nt, Human
caacauggugaaacccugucucua

SEQ ID NO: 793986 - RNA, 25 nt, Human
caacauggugaaacccugucucuaa

SEQ ID NO: 793987 - RNA, 30 nt, Human
caagcaaagucuugguugagcuguguagaa

SEQ ID NO: 793988 - RNA, 19 nt, Human
cacauccccaucauuaagu

SEQ ID NO: 793989 - RNA, 22 nt, Human
cacgccuguaaucccagcacug

SEQ ID NO: 793990 - RNA, 23 nt, Human
cacuaagaaaaagccugcagaug

SEQ ID NO: 793991 - RNA, 21 nt, Human
cacucuuguuucuguuuagag

SEQ ID NO: 793992 - RNA, 18 nt, Human
cacugcacuccagccugg

SEQ ID NO: 793993 - RNA, 19 nt, Human
cacugcacuccagccuggg

SEQ ID NO: 793994 - RNA, 21 nt, Human
cacugcacuccagccugggca

SEQ ID NO: 793995 - RNA, 23 nt, Human
cacugcacuccagccugggcaac

SEQ ID NO: 793996 - RNA, 24 nt, Human
cacugcacuccagccugggcaaca

SEQ ID NO: 793997 - RNA, 27 nt, Human
cacugcacuccagccugggcaacagag

SEQ ID NO: 793998 - RNA, 23 nt, Human
cagaaaauguaaacauucaagca

SEQ ID NO: 793999 - RNA, 21 nt, Human
cagaaagcaacuuggagucuu

SEQ ID NO: 794000 - RNA, 18 nt, Human
cagaagcaaaauauccuc

SEQ ID NO: 794001 - RNA, 23 nt, Human
cagaaggggucaugcuacuggua

SEQ ID NO: 794002 - RNA, 24 nt, Human
cagaucaugaggucaggaguucga

SEQ ID NO: 794003 - RNA, 26 nt, Human
cagauguuaugcuuauuccccugaag

SEQ ID NO: 794004 - RNA, 19 nt, Human
cagcacugugggaggcugg

SEQ ID NO: 794005 - RNA, 22 nt, Human
cagcacugugggaggcuggcag

SEQ ID NO: 794006 - RNA, 22 nt, Human
cagccuaggagcaauaggguau

SEQ ID NO: 794007 - RNA, 21 nt, Human
caggaguucgagaccaacaug

SEQ ID NO: 794008 - RNA, 25 nt, Human
ccacuagucauauaugacuguguac

SEQ ID NO: 794009 - RNA, 20 nt, Human
ccacugcacuccagccuggg

SEQ ID NO: 794010 - RNA, 21 nt, Human
ccacugcacuccagccugggc

SEQ ID NO: 794011 - RNA, 23 nt, Human
ccacugcacuccagccugggcaa

SEQ ID NO: 794012 - RNA, 24 nt, Human
ccacugcacuccagccugggcaac

SEQ ID NO: 794013 - RNA, 19 nt, Human
cccaggcuggagugcagug

SEQ ID NO: 794014 - RNA, 20 nt, Human
cccuccuccccaucuccaag

SEQ ID NO: 794015 - RNA, 19 nt, Human
ccguccucuccacucugcc

SEQ ID NO: 794016 - RNA, 25 nt, Human
ccugggaggcagagguugcagugag

SEQ ID NO: 794017 - RNA, 21 nt, Human
ccuguaaucccagcacugugg

SEQ ID NO: 794018 - RNA, 21 nt, Human
ccuguaaucccagcuacucag

SEQ ID NO: 794019 - RNA, 22 nt, Human
ccuguaaucccagcuacucagg

SEQ ID NO: 794020 - RNA, 24 nt, Human
cgagaccaacaugaccaacauggu

SEQ ID NO: 794021 - RNA, 24 nt, Human
cgccacugcacuccagccugggca

SEQ ID NO: 794022 - RNA, 23 nt, Human
cgccuguaaucccagcacugugg

SEQ ID NO: 794023 - RNA, 24 nt, Human
cgccuguaaucccagcacuguggg

SEQ ID NO: 794024 - RNA, 21 nt, Human
cuaaaaaaucagaacaaaacu

SEQ ID NO: 794025 - RNA, 19 nt, Human
cuacugguaaaagcacagg

SEQ ID NO: 794026 - RNA, 23 nt, Human
cuagcaaagucaaaaauacaaaa

SEQ ID NO: 794027 - RNA, 23 nt, Human
cuaguguauucuucacuuuccua

SEQ ID NO: 794028 - RNA, 23 nt, Human
cucacaaaaguuaauaauuguua

SEQ ID NO: 794029 - RNA, 22 nt, Human
cucacgccuguaaucccagcac

SEQ ID NO: 794030 - RNA, 23 nt, Human
cucacgccuguaaucccagcacu

SEQ ID NO: 794031 - RNA, 22 nt, Human
cuccaaaaaauuaaaaguucau

SEQ ID NO: 794032 - RNA, 21 nt, Human
cucccuccuccccaucuccaa

SEQ ID NO: 794033 - RNA, 22 nt, Human
cucccuccuccccaucuccaag

SEQ ID NO: 794034 - RNA, 24 nt, Human
cucgcucugucgcccaggcuggag

SEQ ID NO: 794035 - RNA, 20 nt, Human
cucugucgcccaggcuggag

SEQ ID NO: 794036 - RNA, 24 nt, Human
cugauauacauauuucuauugccu

SEQ ID NO: 794037 - RNA, 24 nt, Human
cugcauuacuggucuaacaauaaa

SEQ ID NO: 794038 - RNA, 18 nt, Human
cugccacaaacuagcaaa

SEQ ID NO: 794039 - RNA, 19 nt, Human
cugcuuaauaacuguugac

SEQ ID NO: 794040 - RNA, 18 nt, Human
cugucuuaaaaaaacaaa

SEQ ID NO: 794041 - RNA, 21 nt, Human
gaaaagaaaacauaccacaga

SEQ ID NO: 794042 - RNA, 18 nt, Human
gagguugcagugagccaa

SEQ ID NO: 794043 - RNA, 22 nt, Human
gaucaugaggucaggaguucga

SEQ ID NO: 794044 - RNA, 24 nt, Human
gaucaugaggucaggaguucgaga

SEQ ID NO: 794045 - RNA, 23 nt, Human
gcacaacaacuaaaauaaaauaa

SEQ ID NO: 794046 - RNA, 20 nt, Human
gcacaaugacggaaucaccu

SEQ ID NO: 794047 - RNA, 24 nt, Human
gcacuccagccugggcaacagagc

SEQ ID NO: 794048 - RNA, 22 nt, Human
gccacugcacuccagccugggc

SEQ ID NO: 794049 - RNA, 24 nt, Human
gccacugcacuccagccugggcaa

SEQ ID NO: 794050 - RNA, 20 nt, Human
gcccaggcuggagugcagug

SEQ ID NO: 794051 - RNA, 23 nt, Human
gcccaggcuggagugcaguggug

SEQ ID NO: 794052 - RNA, 21 nt, Human
gcuaaaguauucgaagcagag

SEQ ID NO: 794053 - RNA, 25 nt, Human
gcucugucgcccaggcuggagugca

SEQ ID NO: 794054 - RNA, 22 nt, Human
gcuuuuuggaggacaaaguacu

SEQ ID NO: 794055 - RNA, 21 nt, Human
ggaaacauacauuuggcauuc

SEQ ID NO: 794056 - RNA, 22 nt, Human
ggaggacaaaguacuuucuacg

SEQ ID NO: 794057 - RNA, 19 nt, Human
ggcaagugugagacaggag

SEQ ID NO: 794058 - RNA, 24 nt, Human
ggccugaggcaggagaaucgcuug

SEQ ID NO: 794059 - RNA, 24 nt, Human
gggcagaucaugaggucaggaguu

SEQ ID NO: 794060 - RNA, 24 nt, Human
gggcgcgguggcucacgccuguaa

SEQ ID NO: 794061 - RNA, 21 nt, Human
ggggcagaucaugaggucagg

SEQ ID NO: 794062 - RNA, 22 nt, Human
gggguugcucauacaaggacag

SEQ ID NO: 794063 - RNA, 18 nt, Human
ggguauggggggggguac

SEQ ID NO: 794064 - RNA, 19 nt, Human
ggguauggggggggguaca

SEQ ID NO: 794065 - RNA, 21 nt, Human
gggugcuaaaggcuacaaagu

SEQ ID NO: 794066 - RNA, 23 nt, Human
gguggcucacgccuguaauccca

SEQ ID NO: 794067 - RNA, 24 nt, Human
gguggcucacgccuguaaucccag

SEQ ID NO: 794068 - RNA, 24 nt, Human
ggugguacgugccuguaaucccag

SEQ ID NO: 794069 - RNA, 24 nt, Human
gguugcagugagccaagauggcgc

SEQ ID NO: 794070 - RNA, 19 nt, Human
gucuacuaaagauaaaaag

SEQ ID NO: 794071 - RNA, 21 nt, Human
gugaaacccugucucuacuaa

SEQ ID NO: 794072 - RNA, 19 nt, Human
guugcucauacaaggacag

SEQ ID NO: 794073 - RNA, 19 nt, Human
guugcucauacaaggacag

SEQ ID NO: 794074 - RNA, 22 nt, Human
uaaaaaaacaaaagaaaagaaa

SEQ ID NO: 794075 - RNA, 19 nt, Human
uaaaaacacaaacauacac

SEQ ID NO: 794076 - RNA, 24 nt, Human
uaaaaagccauuauggauccagug

SEQ ID NO: 794077 - RNA, 18 nt, Human
uaaaaguucauuccuagu

SEQ ID NO: 794078 - RNA, 28 nt, Human
uaaacaugcacacacacacacacaaaug

SEQ ID NO: 794079 - RNA, 19 nt, Human
uaaccucuugaagccucaa

SEQ ID NO: 794080 - RNA, 25 nt, Human
uaacuauuacaacaaaaaaaaaaaa

SEQ ID NO: 794081 - RNA, 19 nt, Human
uaagaaaaagccugcagau

SEQ ID NO: 794082 - RNA, 24 nt, Human
uacaaaauaugaaaacugcauuac

SEQ ID NO: 794083 - RNA, 23 nt, Human
uacauaccaccuagguuuaugua

SEQ ID NO: 794084 - RNA, 22 nt, Human
uacauguuuccugguguuuguc

SEQ ID NO: 794085 - RNA, 20 nt, Human
uacauuuguauguauacaca

SEQ ID NO: 794086 - RNA, 24 nt, Human
uaccacagagaauaacauuuuuau

SEQ ID NO: 794087 - RNA, 19 nt, Human
uaccagaagcaaaauaucc

SEQ ID NO: 794088 - RNA, 25 nt, Human
uagaacagcauuauugaguuuagca

SEQ ID NO: 794089 - RNA, 19 nt, Human
uagcugcuauuauuaaccu

SEQ ID NO: 794090 - RNA, 23 nt, Human
uagcugcuauuauuaaccuuucg

SEQ ID NO: 794091 - RNA, 19 nt, Human
uaguaguuagugguuccau

SEQ ID NO: 794092 - RNA, 21 nt, Human
uauaaaacuaguugacucuga

SEQ ID NO: 794093 - RNA, 28 nt, Human
uauaauaacaaucauaauaaugauaaga

SEQ ID NO: 794094 - RNA, 18 nt, Human
uauaucauauaggcuaca

SEQ ID NO: 794095 - RNA, 21 nt, Human
uaucauauaagccacauauau

SEQ ID NO: 794096 - RNA, 22 nt, Human
uauuauaaaacuaguugacucu

SEQ ID NO: 794097 - RNA, 18 nt, Human
uauuucacucuuguuucu

SEQ ID NO: 794098 - RNA, 26 nt, Human
ucaaaaacaugcuugaaagaugccag

SEQ ID NO: 794099 - RNA, 19 nt, Human
ucaacuaacaucauucaac

SEQ ID NO: 794100 - RNA, 21 nt, Human
ucaauuccaggcaugugcaca

SEQ ID NO: 794101 - RNA, 22 nt, Human
ucagaugacaaguaaaagaagg

SEQ ID NO: 794102 - RNA, 21 nt, Human
ucagccaaauugaagucugga

SEQ ID NO: 794103 - RNA, 24 nt, Human
ucaugaggucaggaguucgagacc

SEQ ID NO: 794104 - RNA, 23 nt, Human
ucauuccuagugaaagcaaaaca

SEQ ID NO: 794105 - RNA, 23 nt, Human
ucauuugucuccuggaagucuuu

SEQ ID NO: 794106 - RNA, 24 nt, Human
uccaaaaaauuaaaaguucauucc

SEQ ID NO: 794107 - RNA, 19 nt, Human
uccacaaauuuauuucacu

SEQ ID NO: 794108 - RNA, 22 nt, Human
ucgcccaggcuggagugcagug

SEQ ID NO: 794109 - RNA, 24 nt, Human
ucgcucugucgcccaggcuggagu

SEQ ID NO: 794110 - RNA, 18 nt, Human
ucgcuugaaccugggagg

SEQ ID NO: 794111 - RNA, 19 nt, Human
ucucgcucugucgcccagg

SEQ ID NO: 794112 - RNA, 22 nt, Human
ucucgcucugucgcccaggcug

SEQ ID NO: 794113 - RNA, 23 nt, Human
ucucgcucugucgcccaggcugg

SEQ ID NO: 794114 - RNA, 24 nt, Human
ucucgcucugucgcccaggcugga

SEQ ID NO: 794115 - RNA, 26 nt, Human
ucucgcucugucgcccaggcuggagu

SEQ ID NO: 794116 - RNA, 27 nt, Human
ucucgcucugucgcccaggcuggagug

SEQ ID NO: 794117 - RNA, 21 nt, Human
ucucuacuaaaaauauaaaaa

SEQ ID NO: 794118 - RNA, 18 nt, Human
ucugaauucaugcuagcu

SEQ ID NO: 794119 - RNA, 24 nt, Human
ucugucgcccaggcuggagugcag

SEQ ID NO: 794120 - RNA, 18 nt, Human
ucuucaacuuguucacuu

SEQ ID NO: 794121 - RNA, 20 nt, Human
ugaaauauccacccguccuc

SEQ ID NO: 794122 - RNA, 26 nt, Human
ugaaaugaaaaaauacaggccgggcg

SEQ ID NO: 794123 - RNA, 24 nt, Human
ugaaccugggaggcagagguugca

SEQ ID NO: 794124 - RNA, 19 nt, Human
ugacacauuucucagaaca

SEQ ID NO: 794125 - RNA, 24 nt, Human
ugacacauuucucagaacacaucc

SEQ ID NO: 794126 - RNA, 20 nt, Human
ugaccaacauggugaaaccc

SEQ ID NO: 794127 - RNA, 23 nt, Human
ugaccaacauggugaaacccugu

SEQ ID NO: 794128 - RNA, 25 nt, Human
ugaccaugaacauguuuauauaacc

SEQ ID NO: 794129 - RNA, 18 nt, Human
ugagaaugucacucacug

SEQ ID NO: 794130 - RNA, 24 nt, Human
ugagaugaugaaaauauucuaaag

SEQ ID NO: 794131 - RNA, 20 nt, Human
ugaggcaggagaaucgcuug

SEQ ID NO: 794132 - RNA, 24 nt, Human
ugaggcaggagaaucgcuugaacc

SEQ ID NO: 794133 - RNA, 25 nt, Human
ugaggcaggagaaucgcuugaaccu

SEQ ID NO: 794134 - RNA, 20 nt, Human
ugauaagaauaaaaaccaaa

SEQ ID NO: 794135 - RNA, 25 nt, Human
ugauaagaauaaaaaccaaacacag

SEQ ID NO: 794136 - RNA, 22 nt, Human
ugcacaauucugugaauauucu

SEQ ID NO: 794137 - RNA, 25 nt, Human
ugcacacacucauacauacuuaaua

SEQ ID NO: 794138 - RNA, 22 nt, Human
ugcaguggugcgaucucggcuc

SEQ ID NO: 794139 - RNA, 19 nt, Human
ugccaccauaaagaaaguu

SEQ ID NO: 794140 - RNA, 21 nt, Human
ugccugaaaauuagauuagga

SEQ ID NO: 794141 - RNA, 27 nt, Human
ugccugaaaauuagauuaggacagaug

SEQ ID NO: 794142 - RNA, 24 nt, Human
ugccuguaaucccagcuacucagg

SEQ ID NO: 794143 - RNA, 19 nt, Human
ugcgauacgcuauacuaaa

SEQ ID NO: 794144 - RNA, 18 nt, Human
uggaagucuuucuuuucu

SEQ ID NO: 794145 - RNA, 23 nt, Human
uggagugcaguggugcgaucucg

SEQ ID NO: 794146 - RNA, 24 nt, Human
uggagugcaguggugcgaucucgg

SEQ ID NO: 794147 - RNA, 22 nt, Human
uggcauucuucucccuccuccc

SEQ ID NO: 794148 - RNA, 22 nt, Human
uggcucacgccuguaaucccag

SEQ ID NO: 794149 - RNA, 24 nt, Human
uggcucacgccuguaaucccagca

SEQ ID NO: 794150 - RNA, 24 nt, Human
ugggaggcagagguugcagugagc

SEQ ID NO: 794151 - RNA, 21 nt, Human
ugggaggcuggcagggggcag

SEQ ID NO: 794152 - RNA, 25 nt, Human
ugggaggcuggcagggggcagauca

SEQ ID NO: 794153 - RNA, 21 nt, Human
ugguacgugccuguaauccca

SEQ ID NO: 794154 - RNA, 22 nt, Human
ugguacgugccuguaaucccag

SEQ ID NO: 794155 - RNA, 24 nt, Human
uggugguacgugccuguaauccca

SEQ ID NO: 794156 - RNA, 18 nt, Human
uguauguauacacaugua

SEQ ID NO: 794157 - RNA, 26 nt, Human
uguauguauacacauguaaagucacu

SEQ ID NO: 794158 - RNA, 27 nt, Human
ugucagaugacaaguaaaagaaggaaa

SEQ ID NO: 794159 - RNA, 20 nt, Human
uguguacauuuguauguaua

SEQ ID NO: 794160 - RNA, 21 nt, Human
uguuaugcuuauuccauauaa

SEQ ID NO: 794161 - RNA, 18 nt, Human
uguucuaaaaaaucagaa

SEQ ID NO: 794162 - RNA, 24 nt, Human
uguucuaaaaaaucagaacaaaac

SEQ ID NO: 794163 - RNA, 21 nt, Human
uguuuuuauuaaccaucaucu

SEQ ID NO: 794164 - RNA, 18 nt, Human
uuaaaggcaaacauucaa

SEQ ID NO: 794165 - RNA, 28 nt, Human
uuacuggucuaacaauaaaaaaaaaaaa

SEQ ID NO: 794166 - RNA, 26 nt, Human
uuacuuuaccauuuauuauguagucu

SEQ ID NO: 794167 - RNA, 20 nt, Human
uuagcuaggcguggugguac

SEQ ID NO: 794168 - RNA, 24 nt, Human
uuagcuaggcguggugguacgugc

SEQ ID NO: 794169 - RNA, 19 nt, Human
uuagugguuccauuuuuuc

SEQ ID NO: 794170 - RNA, 22 nt, Human
uuauaugcucacaaaaguuaau

SEQ ID NO: 794171 - RNA, 20 nt, Human
uucaaaaggcagaaagcaac

SEQ ID NO: 794172 - RNA, 19 nt, Human
uucaagcaaagucuugguu

SEQ ID NO: 794173 - RNA, 20 nt, Human
uucacucuuguuucuguuuu

SEQ ID NO: 794174 - RNA, 19 nt, Human
uucacuuuuacaauuaaau

SEQ ID NO: 794175 - RNA, 24 nt, Human
uuccacauauacaaaguauccaga

SEQ ID NO: 794176 - RNA, 21 nt, Human
uucuaagccucuuuaacuauu

SEQ ID NO: 794177 - RNA, 20 nt, Human
uucucagaacacauccccau

SEQ ID NO: 794178 - RNA, 19 nt, Human
uucuucucccuccucccca

SEQ ID NO: 794179 - RNA, 24 nt, Human
uugaaccugggaggcagagguugc

SEQ ID NO: 794180 - RNA, 22 nt, Human
uugcagugagccaagauggcgc

SEQ ID NO: 794181 - RNA, 24 nt, Human
uuuaguaguugccuauggccaggg

SEQ ID NO: 794182 - RNA, 20 nt, Human
uuuauauaaccucuugaagc

SEQ ID NO: 794183 - RNA, 20 nt, Human
uuucccaaacugggccauuc

SEQ ID NO: 794184 - RNA, 30 nt, Human
uuugaaauauccacccguccucuccacucu

SEQ ID NO: 794185 - RNA, 23 nt, Human
aaaagcaagcuguguguagccua

SEQ ID NO: 794186 - RNA, 26 nt, Human
aaaauaguuaagcugauacuugaaca

SEQ ID NO: 794187 - RNA, 19 nt, Human
aaagaaagggaggcagaaa

SEQ ID NO: 794188 - RNA, 22 nt, Human
aacaaauaccuauagcagacug

SEQ ID NO: 794189 - RNA, 26 nt, Human
aaccugacacucaucucagaaugcua

SEQ ID NO: 794190 - RNA, 23 nt, Human
aacuaguugggaacagacaccuc

SEQ ID NO: 794191 - RNA, 21 nt, Human
aagcagagcuuugacugaaau

SEQ ID NO: 794192 - RNA, 18 nt, Human
aagcuggggcugggggag

SEQ ID NO: 794193 - RNA, 19 nt, Human
aaucagguugacagcacca

SEQ ID NO: 794194 - RNA, 20 nt, Human
aaucauuugagagucaagaa

SEQ ID NO: 794195 - RNA, 21 nt, Human
aauucauaacacacaaauuca

SEQ ID NO: 794196 - RNA, 22 nt, Human
acacacagcaaggagaaccagc

SEQ ID NO: 794197 - RNA, 20 nt, Human
accaguggguagccugggga

SEQ ID NO: 794198 - RNA, 23 nt, Human
acuagagaaguacuggcauucaa

SEQ ID NO: 794199 - RNA, 18 nt, Human
acuugauuccuauaauga

SEQ ID NO: 794200 - RNA, 23 nt, Human
agaaaagaaccccucaaagagaa

SEQ ID NO: 794201 - RNA, 19 nt, Human
agaaagaaagggaggcaga

SEQ ID NO: 794202 - RNA, 20 nt, Human
agaaaucccugaaauacugc

SEQ ID NO: 794203 - RNA, 22 nt, Human
agaaaucccugaaauacugcac

SEQ ID NO: 794204 - RNA, 24 nt, Human
agcaaggagaaccagcauguaucu

SEQ ID NO: 794205 - RNA, 19 nt, Human
agcaaguaguaaccacuga

SEQ ID NO: 794206 - RNA, 20 nt, Human
agcagaauuuuuaauggaau

SEQ ID NO: 794207 - RNA, 18 nt, Human
agcccuguaggagaaagc

SEQ ID NO: 794208 - RNA, 19 nt, Human
aggagaaagcuggggcugg

SEQ ID NO: 794209 - RNA, 19 nt, Human
aggcacuguugaagaauga

SEQ ID NO: 794210 - RNA, 25 nt, Human
aggcagaaacagaagagaaacaaaa

SEQ ID NO: 794211 - RNA, 20 nt, Human
agugugcauccacuagagaa

SEQ ID NO: 794212 - RNA, 24 nt, Human
aucauucacccaugacaccauuca

SEQ ID NO: 794213 - RNA, 23 nt, Human
auccuguuucgcagcauccuugg

SEQ ID NO: 794214 - RNA, 18 nt, Human
aucucacucuugcccuug

SEQ ID NO: 794215 - RNA, 18 nt, Human
aucucaucuccacaucuc

SEQ ID NO: 794216 - RNA, 24 nt, Human
auuucagaccuuguacguggcggu

SEQ ID NO: 794217 - RNA, 22 nt, Human
caaagcagaaugguacagacca

SEQ ID NO: 794218 - RNA, 22 nt, Human
caacacuauuucccacccaaca

SEQ ID NO: 794219 - RNA, 24 nt, Human
caacucauucucuccugaaaaccu

SEQ ID NO: 794220 - RNA, 19 nt, Human
caagaaaagguuaucucau

SEQ ID NO: 794221 - RNA, 24 nt, Human
caagaauaacaaauaccuauagca

SEQ ID NO: 794222 - RNA, 18 nt, Human
caaggcacuguugaagaa

SEQ ID NO: 794223 - RNA, 19 nt, Human
cacacacagcaaggagaac

SEQ ID NO: 794224 - RNA, 24 nt, Human
cacacacagcaaggagaaccagca

SEQ ID NO: 794225 - RNA, 18 nt, Human
cacagagcugccuagaac

SEQ ID NO: 794226 - RNA, 21 nt, Human
cacccaacaauagaaucugca

SEQ ID NO: 794227 - RNA, 25 nt, Human
cagaaacagaagagaaacaaaagca

SEQ ID NO: 794228 - RNA, 19 nt, Human
cagaaagaaagggaggcag

SEQ ID NO: 794229 - RNA, 25 nt, Human
cagaauaaaaaaccauaccuaggac

SEQ ID NO: 794230 - RNA, 19 nt, Human
cagcaagugugaccacaau

SEQ ID NO: 794231 - RNA, 21 nt, Human
caggaaaagcccuguaggaga

SEQ ID NO: 794232 - RNA, 18 nt, Human
caggaguccucuaggagg

SEQ ID NO: 794233 - RNA, 19 nt, Human
ccccaagaacugcuuccac

SEQ ID NO: 794234 - RNA, 21 nt, Human
cccuguaggagaaagcugggg

SEQ ID NO: 794235 - RNA, 23 nt, Human
ccugagcuaccagaaaagaaccc

SEQ ID NO: 794236 - RNA, 22 nt, Human
cucaccccaacucauucucucc

SEQ ID NO: 794237 - RNA, 19 nt, Human
cuccaagaaaagguuaucu

SEQ ID NO: 794238 - RNA, 25 nt, Human
cuccaagaaaagguuaucucauaau

SEQ ID NO: 794239 - RNA, 26 nt, Human
cucccgugguuuucagaggauuuuac

SEQ ID NO: 794240 - RNA, 20 nt, Human
cugaaaaccugacacucauc

SEQ ID NO: 794241 - RNA, 20 nt, Human
cuggcaauaugaggcucccu

SEQ ID NO: 794242 - RNA, 21 nt, Human
cuggucuuaaguagcaccuga

SEQ ID NO: 794243 - RNA, 19 nt, Human
cugugucacacacagcaag

SEQ ID NO: 794244 - RNA, 19 nt, Human
gaaaagcccuguaggagaa

SEQ ID NO: 794245 - RNA, 18 nt, Human
gaaaggcagaaagaaagg

SEQ ID NO: 794246 - RNA, 18 nt, Human
gacucugggcucacccca

SEQ ID NO: 794247 - RNA, 22 nt, Human
gcaaagcagaaugguacagacc

SEQ ID NO: 794248 - RNA, 22 nt, Human
gcacuaacagaauaaaaaacca

SEQ ID NO: 794249 - RNA, 21 nt, Human
gccaugcaucagaagaggaca

SEQ ID NO: 794250 - RNA, 24 nt, Human
gcccguaccuacuucuucucucug

SEQ ID NO: 794251 - RNA, 19 nt, Human
ggacucaggaaaagcccug

SEQ ID NO: 794252 - RNA, 19 nt, Human
ggagucucacagagcugcc

SEQ ID NO: 794253 - RNA, 23 nt, Human
ggcagaaacagaagagaaacaaa

SEQ ID NO: 794254 - RNA, 26 nt, Human
ggcucuggaaaagcaaaguacaauua

SEQ ID NO: 794255 - RNA, 21 nt, Human
gggaggcagaaauacugcaag

SEQ ID NO: 794256 - RNA, 23 nt, Human
gggcaaagaccggaguaggagga

SEQ ID NO: 794257 - RNA, 19 nt, Human
gugaugugugcugucugcc

SEQ ID NO: 794258 - RNA, 20 nt, Human
uaaaaaaccauaccuaggac

SEQ ID NO: 794259 - RNA, 24 nt, Human
uaaaaauaccaguauuucccccca

SEQ ID NO: 794260 - RNA, 20 nt, Human
uaaaagcaaguaguaaccac

SEQ ID NO: 794261 - RNA, 26 nt, Human
uaacaaauaccuauagcagacugaga

SEQ ID NO: 794262 - RNA, 18 nt, Human
uaagaccagccuuacaga

SEQ ID NO: 794263 - RNA, 20 nt, Human
uaagcugauacuugaacacu

SEQ ID NO: 794264 - RNA, 24 nt, Human
uaaguagcaccugaccagucagga

SEQ ID NO: 794265 - RNA, 22 nt, Human
uaccaguauuuccccccauuuu

SEQ ID NO: 794266 - RNA, 19 nt, Human
uaccuacuucuucucucug

SEQ ID NO: 794267 - RNA, 19 nt, Human
uagagccauguguucaugg

SEQ ID NO: 794268 - RNA, 24 nt, Human
uagcaccugaccagucaggaguuu

SEQ ID NO: 794269 - RNA, 18 nt, Human
uaggaggaaaguguggug

SEQ ID NO: 794270 - RNA, 21 nt, Human
uaguaaaacacacacaaggca

SEQ ID NO: 794271 - RNA, 19 nt, Human
ucagcaagugugaccacaa

SEQ ID NO: 794272 - RNA, 19 nt, Human
ucagcaguaauggaagggg

SEQ ID NO: 794273 - RNA, 21 nt, Human
ucaggaguuucagacucuggg

SEQ ID NO: 794274 - RNA, 19 nt, Human
ucagugguucuuugcugaa

SEQ ID NO: 794275 - RNA, 18 nt, Human
ucauaacacacaaauuca

SEQ ID NO: 794276 - RNA, 18 nt, Human
uccaagaauaacaaauac

SEQ ID NO: 794277 - RNA, 19 nt, Human
uccaugaggcugauacagg

SEQ ID NO: 794278 - RNA, 18 nt, Human
uccccaagaacugcuucc

SEQ ID NO: 794279 - RNA, 20 nt, Human
uccccagguaaaaagggcuc

SEQ ID NO: 794280 - RNA, 18 nt, Human
uccccaucauucacccau

SEQ ID NO: 794281 - RNA, 19 nt, Human
ucccccuuuguaggaggga

SEQ ID NO: 794282 - RNA, 20 nt, Human
uccuuccuugguaacuucuu

SEQ ID NO: 794283 - RNA, 19 nt, Human
ucucaaagagcuugaguca

SEQ ID NO: 794284 - RNA, 22 nt, Human
ucugagaucugccaugguacuc

SEQ ID NO: 794285 - RNA, 24 nt, Human
ucugcgagauuauaaaaauaccag

SEQ ID NO: 794286 - RNA, 23 nt, Human
ucugcucaugcuuccuuaggacc

SEQ ID NO: 794287 - RNA, 19 nt, Human
ucuggagauucugugccug

SEQ ID NO: 794288 - RNA, 22 nt, Human
ucuggggacucaggaaaagccc

SEQ ID NO: 794289 - RNA, 23 nt, Human
ucuguggcugaggaggcagaggc

SEQ ID NO: 794290 - RNA, 26 nt, Human
ugaaaggcagaaagaaagggaggcag

SEQ ID NO: 794291 - RNA, 19 nt, Human
ugaaauacugcaccaggaa

SEQ ID NO: 794292 - RNA, 20 nt, Human
ugaaauacugcaccaggaau

SEQ ID NO: 794293 - RNA, 24 nt, Human
ugaggcucccugcugccuccuggu

SEQ ID NO: 794294 - RNA, 20 nt, Human
ugaguugaugcaugugaugu

SEQ ID NO: 794295 - RNA, 19 nt, Human
ugcaucagaagaggacaug

SEQ ID NO: 794296 - RNA, 22 nt, Human
ugccaggccccuccuuaacucg

SEQ ID NO: 794297 - RNA, 23 nt, Human
ugccugagcuaccagaaaagaac

SEQ ID NO: 794298 - RNA, 20 nt, Human
ugcugucuggggacucagga

SEQ ID NO: 794299 - RNA, 19 nt, Human
ugcuuggugacuauggugu

SEQ ID NO: 794300 - RNA, 22 nt, Human
uggaauguucucaaagagcuug

SEQ ID NO: 794301 - RNA, 23 nt, Human
ugggaacagacaccucccugggg

SEQ ID NO: 794302 - RNA, 21 nt, Human
ugggcaaauggaaaggugcug

SEQ ID NO: 794303 - RNA, 19 nt, Human
ugggggagggaaccaaagg

SEQ ID NO: 794304 - RNA, 18 nt, Human
uggggugaaaggcagaaa

SEQ ID NO: 794305 - RNA, 22 nt, Human
uggggugaaaggcagaaagaaa

SEQ ID NO: 794306 - RNA, 20 nt, Human
uggguggugcuggcaauaug

SEQ ID NO: 794307 - RNA, 19 nt, Human
uguacguggcgguugcugg

SEQ ID NO: 794308 - RNA, 22 nt, Human
uguggcugaggaggcagaggcu

SEQ ID NO: 794309 - RNA, 21 nt, Human
ugugggcaaauggaaaggugc

SEQ ID NO: 794310 - RNA, 24 nt, Human
uuaagcacacugaaauccccaggu

SEQ ID NO: 794311 - RNA, 20 nt, Human
uuacuccccaucauucaccc

SEQ ID NO: 794312 - RNA, 23 nt, Human
uuagagccauguguucauggccu

SEQ ID NO: 794313 - RNA, 22 nt, Human
uuagcagaauuuuuaauggaau

SEQ ID NO: 794314 - RNA, 18 nt, Human
uucauacucugcugucug

SEQ ID NO: 794315 - RNA, 18 nt, Human
uucccaugcaauguccua

SEQ ID NO: 794316 - RNA, 19 nt, Human
uugaugcaugugaugugug

SEQ ID NO: 794317 - RNA, 19 nt, Human
uuugcucuaaaucuccugu

SEQ ID NO: 794318 - RNA, 21 nt, Human
uuuguaggagggaguucucug

SEQ ID NO: 794319 - RNA, 23 nt, Human
aauugauuaauuacauuuuaaau

SEQ ID NO: 794320 - RNA, 19 nt, Human
acucugucgcccaggcugg

SEQ ID NO: 794321 - RNA, 24 nt, Human
acucugucgcccaggcuggagugu

SEQ ID NO: 794322 - RNA, 21 nt, Human
agaagaaggcauggucugaca

SEQ ID NO: 794323 - RNA, 18 nt, Human
agauaguggagugguuuu

SEQ ID NO: 794324 - RNA, 24 nt, Human
agucaggaaagggacaggguuugg

SEQ ID NO: 794325 - RNA, 24 nt, Human
aguggugugaucucagcucacugc

SEQ ID NO: 794326 - RNA, 19 nt, Human
aguguaguggugugaucuc

SEQ ID NO: 794327 - RNA, 24 nt, Human
aguguaguggugugaucucagcuc

SEQ ID NO: 794328 - RNA, 24 nt, Human
cacucugucgcccaggcuggagug

SEQ ID NO: 794329 - RNA, 23 nt, Human
cacugcagccucugccucccggg

SEQ ID NO: 794330 - RNA, 23 nt, Human
cagcucacugcagccucugccuc

SEQ ID NO: 794331 - RNA, 20 nt, Human
cccaggcuggaguguagugg

SEQ ID NO: 794332 - RNA, 24 nt, Human
cucacugcagccucugccucccgg

SEQ ID NO: 794333 - RNA, 24 nt, Human
cuggaguguaguggugugaucuca

SEQ ID NO: 794334 - RNA, 19 nt, Human
cugucgcccaggcuggagu

SEQ ID NO: 794335 - RNA, 20 nt, Human
gcccaggcuggaguguagug

SEQ ID NO: 794336 - RNA, 23 nt, Human
gcccaggcuggaguguaguggug

SEQ ID NO: 794337 - RNA, 22 nt, Human
ggcuggaguguaguggugugau

SEQ ID NO: 794338 - RNA, 24 nt, Human
ggucacucugucgcccaggcugga

SEQ ID NO: 794339 - RNA, 18 nt, Human
uagaagaaggcauggucu

SEQ ID NO: 794340 - RNA, 19 nt, Human
uagcugagccauuauggcc

SEQ ID NO: 794341 - RNA, 20 nt, Human
uagcugagccauuauggcca

SEQ ID NO: 794342 - RNA, 21 nt, Human
uauggccaucuaguggcagaa

SEQ ID NO: 794343 - RNA, 20 nt, Human
ucacucugucgcccaggcug

SEQ ID NO: 794344 - RNA, 22 nt, Human
ucacucugucgcccaggcugga

SEQ ID NO: 794345 - RNA, 24 nt, Human
ucacugcagccucugccucccggg

SEQ ID NO: 794346 - RNA, 25 nt, Human
ucacugcagccucugccucccgggc

SEQ ID NO: 794347 - RNA, 24 nt, Human
ucgcccaggcuggaguguaguggu

SEQ ID NO: 794348 - RNA, 24 nt, Human
ucugucgcccaggcuggaguguag

SEQ ID NO: 794349 - RNA, 19 nt, Human
ugaagcuguagaagaaggc

SEQ ID NO: 794350 - RNA, 20 nt, Human
ugaagcuguagaagaaggca

SEQ ID NO: 794351 - RNA, 24 nt, Human
ugacagccccaccaacagucagga

SEQ ID NO: 794352 - RNA, 22 nt, Human
ugacuuagcugagccauuaugg

SEQ ID NO: 794353 - RNA, 18 nt, Human
ugaggcagggucacucug

SEQ ID NO: 794354 - RNA, 19 nt, Human
ugaggcagggucacucugu

SEQ ID NO: 794355 - RNA, 24 nt, Human
uggaguguaguggugugaucucag

SEQ ID NO: 794356 - RNA, 21 nt, Human
ugggugacuuagcugagccau

SEQ ID NO: 794357 - RNA, 25 nt, Human
ugggugacuuagcugagccauuaug

SEQ ID NO: 794358 - RNA, 24 nt, Human
uggugugaucucagcucacugcag

SEQ ID NO: 794359 - RNA, 22 nt, Human
uguagaagaaggcauggucuga

SEQ ID NO: 794360 - RNA, 22 nt, Human
uguaguggugugaucucagcuc

SEQ ID NO: 794361 - RNA, 22 nt, Human
uucauaacaaugaagcuguaga

SEQ ID NO: 794362 - RNA, 21 nt, Human
uuucauaacaaugaagcugua

SEQ ID NO: 794363 - RNA, 24 nt, Human
uuugaggcagggucacucugucgc

SEQ ID NO: 794364 - RNA, 25 nt, Human
aaaaagaaaauauaagcgauucaaa

SEQ ID NO: 794365 - RNA, 25 nt, Human
aaacaaccuagacagggcccaaagc

SEQ ID NO: 794366 - RNA, 19 nt, Human
aaagaccacagaugggugg

SEQ ID NO: 794367 - RNA, 30 nt, Human
aaauauaagcgauucaaauauauacuuugg

SEQ ID NO: 794368 - RNA, 20 nt, Human
aacagacaccccccaccccc

SEQ ID NO: 794369 - RNA, 19 nt, Human
aagaaaauuaaauaugaga

SEQ ID NO: 794370 - RNA, 23 nt, Human
acacacacacacacacacacaca

SEQ ID NO: 794371 - RNA, 23 nt, Human
acacacacacacacacacacaca

SEQ ID NO: 794372 - RNA, 23 nt, Human
acacacacacacacacacacaca

SEQ ID NO: 794373 - RNA, 23 nt, Human
acacacacacacacacacacaca

SEQ ID NO: 794374 - RNA, 23 nt, Human
acacacacacacacacacacaca

SEQ ID NO: 794375 - RNA, 23 nt, Human
acacacacacacacacacacaca

SEQ ID NO: 794376 - RNA, 23 nt, Human
acacacacacacacacacacaca

SEQ ID NO: 794377 - RNA, 23 nt, Human
acacacacacacacacacacaca

SEQ ID NO: 794378 - RNA, 23 nt, Human
acacacacacacacacacacaca

SEQ ID NO: 794379 - RNA, 23 nt, Human
acacacacacacacacacacaca

SEQ ID NO: 794380 - RNA, 23 nt, Human
acacacacacacacacacacaca

SEQ ID NO: 794381 - RNA, 23 nt, Human
acacacacacacacacacacaca

SEQ ID NO: 794382 - RNA, 23 nt, Human
acacacacacacacacacacaca

SEQ ID NO: 794383 - RNA, 25 nt, Human
acagacaccccccacccccaccucu

SEQ ID NO: 794384 - RNA, 21 nt, Human
accuugccuacuacaaauuuc

SEQ ID NO: 794385 - RNA, 23 nt, Human
agaaaggaacuacaauauguaga

SEQ ID NO: 794386 - RNA, 21 nt, Human
agacaccccccacccccaccu

SEQ ID NO: 794387 - RNA, 20 nt, Human
agaccaaugacuaacugaug

SEQ ID NO: 794388 - RNA, 20 nt, Human
agacucaugcuacaagaagu

SEQ ID NO: 794389 - RNA, 20 nt, Human
agucuuuuccuugagaggcc

SEQ ID NO: 794390 - RNA, 21 nt, Human
aguucaccuaauacaaagcuu

SEQ ID NO: 794391 - RNA, 24 nt, Human
auacacacacacacacacacacag

SEQ ID NO: 794392 - RNA, 18 nt, Human
auaggauucuccuuagag

SEQ ID NO: 794393 - RNA, 23 nt, Human
auccugcuucccuccaucuccua

SEQ ID NO: 794394 - RNA, 21 nt, Human
auggagguacagaugcuccuc

SEQ ID NO: 794395 - RNA, 20 nt, Human
cacacacacacacacacaca

SEQ ID NO: 794396 - RNA, 20 nt, Human
cacacacacacacacacaca

SEQ ID NO: 794397 - RNA, 20 nt, Human
cacacacacacacacacaca

SEQ ID NO: 794398 - RNA, 20 nt, Human
cacacacacacacacacaca

SEQ ID NO: 794399 - RNA, 20 nt, Human
cacacacacacacacacaca

SEQ ID NO: 794400 - RNA, 20 nt, Human
cacacacacacacacacaca

SEQ ID NO: 794401 - RNA, 20 nt, Human
cacacacacacacacacaca

SEQ ID NO: 794402 - RNA, 20 nt, Human
cacacacacacacacacaca

SEQ ID NO: 794403 - RNA, 20 nt, Human
cacacacacacacacacaca

SEQ ID NO: 794404 - RNA, 20 nt, Human
cacacacacacacacacaca

SEQ ID NO: 794405 - RNA, 20 nt, Human
cacacacacacacacacaca

SEQ ID NO: 794406 - RNA, 20 nt, Human
cacacacacacacacacaca

SEQ ID NO: 794407 - RNA, 20 nt, Human
cacacacacacacacacaca

SEQ ID NO: 794408 - RNA, 20 nt, Human
cacacacacacacacacaca

SEQ ID NO: 794409 - RNA, 20 nt, Human
cacacacacacacacacaca

SEQ ID NO: 794410 - RNA, 20 nt, Human
cacacacacacacacacaca

SEQ ID NO: 794411 - RNA, 20 nt, Human
cacacacacacacacacaca

SEQ ID NO: 794412 - RNA, 20 nt, Human
cacacacacacacacacaca

SEQ ID NO: 794413 - RNA, 20 nt, Human
cacacacacacacacacaca

SEQ ID NO: 794414 - RNA, 22 nt, Human
cacacacacacacacacacaca

SEQ ID NO: 794415 - RNA, 22 nt, Human
cacacacacacacacacacaca

SEQ ID NO: 794416 - RNA, 22 nt, Human
cacacacacacacacacacaca

SEQ ID NO: 794417 - RNA, 22 nt, Human
cacacacacacacacacacaca

SEQ ID NO: 794418 - RNA, 22 nt, Human
cacacacacacacacacacaca

SEQ ID NO: 794419 - RNA, 26 nt, Human
cacacacacacacacacacacacaca

SEQ ID NO: 794420 - RNA, 26 nt, Human
cacacacacacacacacacacacaca

SEQ ID NO: 794421 - RNA, 26 nt, Human
cacacacacacacacacacacacaca

SEQ ID NO: 794422 - RNA, 26 nt, Human
cacacacacacacacacacacacaca

SEQ ID NO: 794423 - RNA, 26 nt, Human
cacacacacacacacacacacacaca

SEQ ID NO: 794424 - RNA, 26 nt, Human
cacacacacacacacacacacacaca

SEQ ID NO: 794425 - RNA, 26 nt, Human
cacacacacacacacacacacacaca

SEQ ID NO: 794426 - RNA, 26 nt, Human
cacacacacacacacacacacacaca

SEQ ID NO: 794427 - RNA, 26 nt, Human
cacacacacacacacacacacacaca

SEQ ID NO: 794428 - RNA, 26 nt, Human
cacacacacacacacacacacacaca

SEQ ID NO: 794429 - RNA, 26 nt, Human
cacacacacacacacacacacacaca

SEQ ID NO: 794430 - RNA, 26 nt, Human
cacacacacacacacacacacacaca

SEQ ID NO: 794431 - RNA, 28 nt, Human
cacacacacacacacacacacacacuug

SEQ ID NO: 794432 - RNA, 29 nt, Human
cacacacacacacacacacacuugccuua

SEQ ID NO: 794433 - RNA, 18 nt, Human
caccccccacccccaccu

SEQ ID NO: 794434 - RNA, 20 nt, Human
caccccccacccccaccucu

SEQ ID NO: 794435 - RNA, 18 nt, Human
caccucugggugcaacag

SEQ ID NO: 794436 - RNA, 18 nt, Human
cagacaccccccaccccc

SEQ ID NO: 794437 - RNA, 20 nt, Human
cagacaccccccacccccac

SEQ ID NO: 794438 - RNA, 19 nt, Human
cagccuccugaaacugacc

SEQ ID NO: 794439 - RNA, 24 nt, Human
cagggauucaaaguaaaaauauua

SEQ ID NO: 794440 - RNA, 18 nt, Human
ccaggggguggagggagg

SEQ ID NO: 794441 - RNA, 30 nt, Human
ccaucugcccugugugcuuuaauuaucccc

SEQ ID NO: 794442 - RNA, 18 nt, Human
ccccccacccccaccucu

SEQ ID NO: 794443 - RNA, 22 nt, Human
ccccccacccccaccucugggu

SEQ ID NO: 794444 - RNA, 24 nt, Human
cccuacuuucugugcagaucccaa

SEQ ID NO: 794445 - RNA, 23 nt, Human
ccuagccuacauucucaggacac

SEQ ID NO: 794446 - RNA, 21 nt, Human
ccuguggguacaaggaagccu

SEQ ID NO: 794447 - RNA, 21 nt, Human
ccuugccuacuacaaauuucu

SEQ ID NO: 794448 - RNA, 24 nt, Human
ccuugucagggaaugggagccagg

SEQ ID NO: 794449 - RNA, 21 nt, Human
cggcuagaagcaauuaagaca

SEQ ID NO: 794450 - RNA, 19 nt, Human
cguuguaaguugaaacuac

SEQ ID NO: 794451 - RNA, 26 nt, Human
cuaagacucaugcuacaagaaguuaa

SEQ ID NO: 794452 - RNA, 24 nt, Human
cucccaaucuacucugaauaucug

SEQ ID NO: 794453 - RNA, 31 nt, Human
cuguaggggauacacacacacacacacacag

SEQ ID NO: 794454 - RNA, 18 nt, Human
cuugacccauaauuaagc

SEQ ID NO: 794455 - RNA, 21 nt, Human
gaaggcaggaauuugcccagc

SEQ ID NO: 794456 - RNA, 24 nt, Human
gaauuuccucaaugaccucugccu

SEQ ID NO: 794457 - RNA, 24 nt, Human
gaccucugccucccaaucuacucu

SEQ ID NO: 794458 - RNA, 19 nt, Human
gagggaggaggggagcaag

SEQ ID NO: 794459 - RNA, 20 nt, Human
gauagucauaaauucaauga

SEQ ID NO: 794460 - RNA, 23 nt, Human
gcagcagaagagauagucauaaa

SEQ ID NO: 794461 - RNA, 22 nt, Human
gcagggauucaaaguaaaaaua

SEQ ID NO: 794462 - RNA, 22 nt, Human
gcucuauccugcuucccuccau

SEQ ID NO: 794463 - RNA, 22 nt, Human
ggaaggcaggaauuugcccagc

SEQ ID NO: 794464 - RNA, 18 nt, Human
ggacaguucuauguccca

SEQ ID NO: 794465 - RNA, 22 nt, Human
ggcccgucugcccacccauccc

SEQ ID NO: 794466 - RNA, 21 nt, Human
ggcuagaagcaauuaagacaa

SEQ ID NO: 794467 - RNA, 22 nt, Human
gggugggacuuggaggguaucu

SEQ ID NO: 794468 - RNA, 19 nt, Human
guagaaaaaucauaagcug

SEQ ID NO: 794469 - RNA, 20 nt, Human
gucacuggcugagcagagcu

SEQ ID NO: 794470 - RNA, 18 nt, Human
uaaagagugaaaaagaaa

SEQ ID NO: 794471 - RNA, 27 nt, Human
uaaaguagaaaaaucauaagcugaacc

SEQ ID NO: 794472 - RNA, 19 nt, Human
uaacagacaccccccaccc

SEQ ID NO: 794473 - RNA, 23 nt, Human
uaacagacaccccccacccccac

SEQ ID NO: 794474 - RNA, 21 nt, Human
uaaccuacugaaaucauagcu

SEQ ID NO: 794475 - RNA, 19 nt, Human
uaagccagggcccgucugc

SEQ ID NO: 794476 - RNA, 22 nt, Human
uaagcugaaccaucauaagcca

SEQ ID NO: 794477 - RNA, 20 nt, Human
uacacacacacacacacaca

SEQ ID NO: 794478 - RNA, 25 nt, Human
uacacacacacacacacacacacac

SEQ ID NO: 794479 - RNA, 25 nt, Human
uacacacacacacacacacacacag

SEQ ID NO: 794480 - RNA, 19 nt, Human
uacugcuuucacaccacug

SEQ ID NO: 794481 - RNA, 18 nt, Human
uacuggaaugguuugaug

SEQ ID NO: 794482 - RNA, 19 nt, Human
uacuucauugagaacagau

SEQ ID NO: 794483 - RNA, 22 nt, Human
uagccuacauucucaggacacu

SEQ ID NO: 794484 - RNA, 24 nt, Human
uaguaguugguggguaaauagaaa

SEQ ID NO: 794485 - RNA, 19 nt, Human
uauauuauuuuuccagaau

SEQ ID NO: 794486 - RNA, 20 nt, Human
ucacuggcugagcagagcug

SEQ ID NO: 794487 - RNA, 21 nt, Human
ucaugcuuaaucuccucucca

SEQ ID NO: 794488 - RNA, 21 nt, Human
ucccaauaaacccguuguaag

SEQ ID NO: 794489 - RNA, 21 nt, Human
ucccaauuugcuaccaucucc

SEQ ID NO: 794490 - RNA, 21 nt, Human
uccugaccagccuccugaaac

SEQ ID NO: 794491 - RNA, 21 nt, Human
uccuugagaggccuggauuug

SEQ ID NO: 794492 - RNA, 21 nt, Human
ucuaacagacaccccccaccc

SEQ ID NO: 794493 - RNA, 18 nt, Human
ucugcccacccaucccuc

SEQ ID NO: 794494 - RNA, 23 nt, Human
ucugcccacccaucccucaaaug

SEQ ID NO: 794495 - RNA, 24 nt, Human
ucuucggcuagaagcaauuaagac

SEQ ID NO: 794496 - RNA, 22 nt, Human
ugaccucugccucccaaucuac

SEQ ID NO: 794497 - RNA, 18 nt, Human
ugagagagaaaggaacua

SEQ ID NO: 794498 - RNA, 25 nt, Human
ugcauggguacuugaagcguggugu

SEQ ID NO: 794499 - RNA, 22 nt, Human
ugccacggaaggcaggaauuug

SEQ ID NO: 794500 - RNA, 18 nt, Human
ugccuugucagggaaugg

SEQ ID NO: 794501 - RNA, 26 nt, Human
uggagugacgucccaauaaacccguu

SEQ ID NO: 794502 - RNA, 19 nt, Human
uggcccagcuucuucccca

SEQ ID NO: 794503 - RNA, 22 nt, Human
ugggacuuggaggguaucucca

SEQ ID NO: 794504 - RNA, 21 nt, Human
ugggagccaggggguggaggg

SEQ ID NO: 794505 - RNA, 21 nt, Human
ugggugcaacagccucuguga

SEQ ID NO: 794506 - RNA, 23 nt, Human
ugggugcaacagccucugugaug

SEQ ID NO: 794507 - RNA, 25 nt, Human
uggguggcaaaguggggaguuacuu

SEQ ID NO: 794508 - RNA, 18 nt, Human
uguacuggaaugguuuga

SEQ ID NO: 794509 - RNA, 24 nt, Human
ugugcagaucccaauuugcuacca

SEQ ID NO: 794510 - RNA, 20 nt, Human
uuccccagcucuauccugcu

SEQ ID NO: 794511 - RNA, 20 nt, Human
uucuugaguucuccauggga

SEQ ID NO: 794512 - RNA, 24 nt, Human
uugaaacuaccuuaaguugaaaau

SEQ ID NO: 794513 - RNA, 20 nt, Human
uuuuugguuccuuaaacacu

SEQ ID NO: 794514 - RNA, 25 nt, Human
aaaaaaaaaaaaaagugacaaaaua

SEQ ID NO: 794515 - RNA, 22 nt, Human
aaaaaaaaaaaaagugacaaaa

SEQ ID NO: 794516 - RNA, 18 nt, Human
aaaaaaagagagaaauga

SEQ ID NO: 794517 - RNA, 23 nt, Human
aaaaaggcaauccucuggaagcu

SEQ ID NO: 794518 - RNA, 18 nt, Human
aaaauuagcugggcaugg

SEQ ID NO: 794519 - RNA, 22 nt, Human
aaacaaacuaacaagcaaaaac

SEQ ID NO: 794520 - RNA, 22 nt, Human
aaacaaugcgaaauaggccaaa

SEQ ID NO: 794521 - RNA, 20 nt, Human
aaagaaugagucuaagaaaa

SEQ ID NO: 794522 - RNA, 22 nt, Human
aaagacacaaagauggggcaca

SEQ ID NO: 794523 - RNA, 24 nt, Human
aaagugcuaggauuaaagguguga

SEQ ID NO: 794524 - RNA, 23 nt, Human
aacaaaauuugaauccccacaaa

SEQ ID NO: 794525 - RNA, 21 nt, Human
aacaccagccugaccaacaug

SEQ ID NO: 794526 - RNA, 24 nt, Human
aacaggugacacauggaggccaga

SEQ ID NO: 794527 - RNA, 18 nt, Human
aacaugaugauaccugca

SEQ ID NO: 794528 - RNA, 18 nt, Human
aacauggugaaaccuugu

SEQ ID NO: 794529 - RNA, 20 nt, Human
aacauggugaaaccuuguuu

SEQ ID NO: 794530 - RNA, 21 nt, Human
aacauggugaaaccuuguuuc

SEQ ID NO: 794531 - RNA, 25 nt, Human
aacucagagagaacagguagggucu

SEQ ID NO: 794532 - RNA, 23 nt, Human
aagaaaaaaaagagagaaaugaa

SEQ ID NO: 794533 - RNA, 22 nt, Human
aagauuaaagguacuuaaacaa

SEQ ID NO: 794534 - RNA, 21 nt, Human
aagcaaaaacacauucacagc

SEQ ID NO: 794535 - RNA, 25 nt, Human
aagcaaaaggcagaacauggaacaa

SEQ ID NO: 794536 - RNA, 23 nt, Human
aagcaaccagagccauccucgaa

SEQ ID NO: 794537 - RNA, 22 nt, Human
aagcagguggauuaccugaggu

SEQ ID NO: 794538 - RNA, 26 nt, Human
aagcagguggauuaccugaggucagg

SEQ ID NO: 794539 - RNA, 18 nt, Human
aaggacuauuuaaaaaca

SEQ ID NO: 794540 - RNA, 19 nt, Human
aaggcagaacauggaacaa

SEQ ID NO: 794541 - RNA, 26 nt, Human
aagugcuaggauuaaaggugugagcc

SEQ ID NO: 794542 - RNA, 24 nt, Human
aaucacuugaucccaggaggcgga

SEQ ID NO: 794543 - RNA, 19 nt, Human
aauuccugaaacaggcagc

SEQ ID NO: 794544 - RNA, 24 nt, Human
aauugcacuccagccugggugacg

SEQ ID NO: 794545 - RNA, 18 nt, Human
acaacauagcuacacaug

SEQ ID NO: 794546 - RNA, 21 nt, Human
acaagcaaaaacacauucaca

SEQ ID NO: 794547 - RNA, 24 nt, Human
acaagccggacaugguggcucacg

SEQ ID NO: 794548 - RNA, 21 nt, Human
accaacauggugaaaccuugu

SEQ ID NO: 794549 - RNA, 19 nt, Human
accagcaaccugaaagaag

SEQ ID NO: 794550 - RNA, 23 nt, Human
acccaggcuggagugcaguggug

SEQ ID NO: 794551 - RNA, 20 nt, Human
accugaggucaggaguucaa

SEQ ID NO: 794552 - RNA, 24 nt, Human
accuugugauccacccaccucagc

SEQ ID NO: 794553 - RNA, 19 nt, Human
agaaaagaaaaaaaagaga

SEQ ID NO: 794554 - RNA, 23 nt, Human
agaaacaauggaaguugccacaa

SEQ ID NO: 794555 - RNA, 24 nt, Human
agaaacaauggaaguugccacaac

SEQ ID NO: 794556 - RNA, 22 nt, Human
agagccagaaagcccugcagug

SEQ ID NO: 794557 - RNA, 18 nt, Human
agaggacuucgguacacu

SEQ ID NO: 794558 - RNA, 24 nt, Human
agcaauuaucugccucagccuucc

SEQ ID NO: 794559 - RNA, 20 nt, Human
agcacuuugguaggcugaag

SEQ ID NO: 794560 - RNA, 21 nt, Human
agccagcacuggcacagagca

SEQ ID NO: 794561 - RNA, 23 nt, Human
agccugaccaacauggugaaacc

SEQ ID NO: 794562 - RNA, 23 nt, Human
agccugggugacgagcaaaauuc

SEQ ID NO: 794563 - RNA, 22 nt, Human
agcucacugcaaccucugccuc

SEQ ID NO: 794564 - RNA, 18 nt, Human
agcugccagcagaacuca

SEQ ID NO: 794565 - RNA, 23 nt, Human
agcugggcaugguggugggugcc

SEQ ID NO: 794566 - RNA, 21 nt, Human
aggcaaaaaucagagccagaa

SEQ ID NO: 794567 - RNA, 23 nt, Human
aggcaaaaaucagagccagaaag

SEQ ID NO: 794568 - RNA, 18 nt, Human
aggcaaacaaaauuugaa

SEQ ID NO: 794569 - RNA, 27 nt, Human
aggccaaaaauggagcaaaagggaccc

SEQ ID NO: 794570 - RNA, 20 nt, Human
aggcggagguugcagugagc

SEQ ID NO: 794571 - RNA, 24 nt, Human
aggcggagguugcagugagcugag

SEQ ID NO: 794572 - RNA, 25 nt, Human
aggcuggagugcaguggugugaucu

SEQ ID NO: 794573 - RNA, 24 nt, Human
aggcuguggcaggagaaucacuug

SEQ ID NO: 794574 - RNA, 19 nt, Human
agggcuggaagucauggau

SEQ ID NO: 794575 - RNA, 22 nt, Human
agguggauuaccugaggucagg

SEQ ID NO: 794576 - RNA, 20 nt, Human
aggugugagccacugcgccc

SEQ ID NO: 794577 - RNA, 23 nt, Human
agugcaguggugugaucugagcu

SEQ ID NO: 794578 - RNA, 24 nt, Human
agugcaguggugugaucugagcuc

SEQ ID NO: 794579 - RNA, 21 nt, Human
aguucuuccacagaaacgcuc

SEQ ID NO: 794580 - RNA, 18 nt, Human
auaaaaaucagaacaugu

SEQ ID NO: 794581 - RNA, 22 nt, Human
auccuagaacuggagaaagcca

SEQ ID NO: 794582 - RNA, 20 nt, Human
aucugccucagccuuccagg

SEQ ID NO: 794583 - RNA, 24 nt, Human
auugcacaauugcacuccagccug

SEQ ID NO: 794584 - RNA, 19 nt, Human
auugcacuccagccugggu

SEQ ID NO: 794585 - RNA, 21 nt, Human
auugcacuccagccuggguga

SEQ ID NO: 794586 - RNA, 22 nt, Human
auugcacuccagccugggugac

SEQ ID NO: 794587 - RNA, 23 nt, Human
auugcacuccagccugggugacg

SEQ ID NO: 794588 - RNA, 19 nt, Human
caaaaggcagaacauggaa

SEQ ID NO: 794589 - RNA, 24 nt, Human
caaagagcauccuagaaccggggc

SEQ ID NO: 794590 - RNA, 24 nt, Human
caaagugcuaggauuaaaggugug

SEQ ID NO: 794591 - RNA, 24 nt, Human
caacaauguccucaaaaaaggcaa

SEQ ID NO: 794592 - RNA, 18 nt, Human
caacacaagccggacaug

SEQ ID NO: 794593 - RNA, 24 nt, Human
caacauggugaaaccuuguuucua

SEQ ID NO: 794594 - RNA, 21 nt, Human
caacucagagagaacagguag

SEQ ID NO: 794595 - RNA, 19 nt, Human
caacugcccccucugcaga

SEQ ID NO: 794596 - RNA, 26 nt, Human
caagggacacagcuccuucacaggac

SEQ ID NO: 794597 - RNA, 18 nt, Human
caaugcgaaauaggccaa

SEQ ID NO: 794598 - RNA, 21 nt, Human
caauugcacuccagccugggu

SEQ ID NO: 794599 - RNA, 24 nt, Human
caauugcacuccagccugggugac

SEQ ID NO: 794600 - RNA, 20 nt, Human
cacaacacaagccggacaug

SEQ ID NO: 794601 - RNA, 18 nt, Human
cacagaaacgcucucugc

SEQ ID NO: 794602 - RNA, 19 nt, Human
cacaugcuucccacauacc

SEQ ID NO: 794603 - RNA, 22 nt, Human
cacaugcuucccacauaccuca

SEQ ID NO: 794604 - RNA, 19 nt, Human
cacauucacagcauauaua

SEQ ID NO: 794605 - RNA, 24 nt, Human
caccagcaaccugaaagaagagaa

SEQ ID NO: 794606 - RNA, 22 nt, Human
cacccaaucacugagaacucag

SEQ ID NO: 794607 - RNA, 22 nt, Human
cacccaccucagccucccaaag

SEQ ID NO: 794608 - RNA, 23 nt, Human
cacccaccucagccucccaaagu

SEQ ID NO: 794609 - RNA, 24 nt, Human
cacccaggcuggagugcaguggug

SEQ ID NO: 794610 - RNA, 24 nt, Human
caccucagccucccaaagugcuag

SEQ ID NO: 794611 - RNA, 24 nt, Human
cacgccuguaaucccagcacuuug

SEQ ID NO: 794612 - RNA, 21 nt, Human
cacuauguagccacaggagga

SEQ ID NO: 794613 - RNA, 18 nt, Human
cacuccagccugggugac

SEQ ID NO: 794614 - RNA, 21 nt, Human
cacugcaaccucugccuccca

SEQ ID NO: 794615 - RNA, 23 nt, Human
cacugcaaccucugccucccaag

SEQ ID NO: 794616 - RNA, 20 nt, Human
cagaaugaccucugagccca

SEQ ID NO: 794617 - RNA, 21 nt, Human
cagcacaugacaaacuacagc

SEQ ID NO: 794618 - RNA, 24 nt, Human
cagcacuuugguaggcugaagcag

SEQ ID NO: 794619 - RNA, 26 nt, Human
cagcacuuugguaggcugaagcaggu

SEQ ID NO: 794620 - RNA, 24 nt, Human
caggaggcuguggcaggagaauca

SEQ ID NO: 794621 - RNA, 24 nt, Human
caggguuucaccaccuuggccagg

SEQ ID NO: 794622 - RNA, 20 nt, Human
caggugacacauggaggcca

SEQ ID NO: 794623 - RNA, 24 nt, Human
cagguggauuaccugaggucagga

SEQ ID NO: 794624 - RNA, 18 nt, Human
caucuacugcuccacacc

SEQ ID NO: 794625 - RNA, 22 nt, Human
caugguggugggugccuguaau

SEQ ID NO: 794626 - RNA, 24 nt, Human
ccaaagugcuaggauuaaaggugu

SEQ ID NO: 794627 - RNA, 26 nt, Human
ccacccaccucagccucccaaagugc

SEQ ID NO: 794628 - RNA, 19 nt, Human
ccacugcgcccggccggau

SEQ ID NO: 794629 - RNA, 23 nt, Human
ccagcagaacucagaucaggucc

SEQ ID NO: 794630 - RNA, 20 nt, Human
cccaggcuggagugcagugg

SEQ ID NO: 794631 - RNA, 22 nt, Human
cccgaccuugugauccacccac

SEQ ID NO: 794632 - RNA, 19 nt, Human
cccuauuauucaacccagc

SEQ ID NO: 794633 - RNA, 22 nt, Human
cccugugacaguucuuccacag

SEQ ID NO: 794634 - RNA, 22 nt, Human
ccuauaagauguaugcccuaaa

SEQ ID NO: 794635 - RNA, 21 nt, Human
ccucagccuuccaggguuuca

SEQ ID NO: 794636 - RNA, 22 nt, Human
ccucuacaagucacagaacaag

SEQ ID NO: 794637 - RNA, 20 nt, Human
ccucugagcccacaugcagg

SEQ ID NO: 794638 - RNA, 23 nt, Human
ccucuggaagcugccagcagaac

SEQ ID NO: 794639 - RNA, 21 nt, Human
ccugaccaacauggugaaacc

SEQ ID NO: 794640 - RNA, 24 nt, Human
ccugaccaacauggugaaaccuug

SEQ ID NO: 794641 - RNA, 22 nt, Human
ccuggggccaacacugggguag

SEQ ID NO: 794642 - RNA, 23 nt, Human
ccugggugacgagcaaaauucca

SEQ ID NO: 794643 - RNA, 23 nt, Human
cgaccuugugauccacccaccuc

SEQ ID NO: 794644 - RNA, 23 nt, Human
cgccuguaaucccagcacuuugg

SEQ ID NO: 794645 - RNA, 24 nt, Human
cgcucugucacccaggcuggagug

SEQ ID NO: 794646 - RNA, 18 nt, Human
cucaaaaaaaaaaaaaaa

SEQ ID NO: 794647 - RNA, 22 nt, Human
cucacgccuguaaucccagcac

SEQ ID NO: 794648 - RNA, 24 nt, Human
cucacgccuguaaucccagcacuu

SEQ ID NO: 794649 - RNA, 23 nt, Human
cucacugcaaccucugccuccca

SEQ ID NO: 794650 - RNA, 24 nt, Human
cucacugcaaccucugccucccaa

SEQ ID NO: 794651 - RNA, 21 nt, Human
cucaucuacugcuccacacca

SEQ ID NO: 794652 - RNA, 23 nt, Human
cuccccugaugagaagagaggac

SEQ ID NO: 794653 - RNA, 18 nt, Human
cucccgaccuugugaucc

SEQ ID NO: 794654 - RNA, 25 nt, Human
cucccgaccuugugauccacccacc

SEQ ID NO: 794655 - RNA, 18 nt, Human
cucgaaucccaguugugc

SEQ ID NO: 794656 - RNA, 24 nt, Human
cucgcucugucacccaggcuggag

SEQ ID NO: 794657 - RNA, 22 nt, Human
cucugccucccugagcauguug

SEQ ID NO: 794658 - RNA, 24 nt, Human
cugaccaacauggugaaaccuugu

SEQ ID NO: 794659 - RNA, 23 nt, Human
cugcaaccucugccucccaaguu

SEQ ID NO: 794660 - RNA, 24 nt, Human
cugcaaccucugccucccaaguuc

SEQ ID NO: 794661 - RNA, 18 nt, Human
cuucgguacacugcacag

SEQ ID NO: 794662 - RNA, 23 nt, Human
gaacauggaacaaagagcauccu

SEQ ID NO: 794663 - RNA, 21 nt, Human
gaaucagcacccaaucacuga

SEQ ID NO: 794664 - RNA, 19 nt, Human
gaaucccaguugugcaacu

SEQ ID NO: 794665 - RNA, 22 nt, Human
gaccuugugauccacccaccuc

SEQ ID NO: 794666 - RNA, 24 nt, Human
gaccuugugauccacccaccucag

SEQ ID NO: 794667 - RNA, 18 nt, Human
gagaaagccauccuguca

SEQ ID NO: 794668 - RNA, 23 nt, Human
gagaaucacuugaucccaggagg

SEQ ID NO: 794669 - RNA, 18 nt, Human
gagaucaacaauguccuc

SEQ ID NO: 794670 - RNA, 21 nt, Human
gagcauccuagaacuggagaa

SEQ ID NO: 794671 - RNA, 21 nt, Human
gaggcggagguugcagugagc

SEQ ID NO: 794672 - RNA, 21 nt, Human
gagguugcagugagcugagau

SEQ ID NO: 794673 - RNA, 23 nt, Human
gagguugcagugagcugagauug

SEQ ID NO: 794674 - RNA, 18 nt, Human
gauuaaaggugugagcca

SEQ ID NO: 794675 - RNA, 22 nt, Human
gauuaaaggugugagccacugc

SEQ ID NO: 794676 - RNA, 22 nt, Human
gauuaaaggugugagccacugc

SEQ ID NO: 794677 - RNA, 23 nt, Human
gauuaccugaggucaggaguuca

SEQ ID NO: 794678 - RNA, 24 nt, Human
gauuaccugaggucaggaguucaa

SEQ ID NO: 794679 - RNA, 22 nt, Human
gcaaccucugccucccaaguuc

SEQ ID NO: 794680 - RNA, 25 nt, Human
gcacaacucagagagaagggaacgc

SEQ ID NO: 794681 - RNA, 20 nt, Human
gcacagagcaacucagcaca

SEQ ID NO: 794682 - RNA, 19 nt, Human
gcagucuccuccauucccu

SEQ ID NO: 794683 - RNA, 25 nt, Human
gcucugucacccaggcuggagugca

SEQ ID NO: 794684 - RNA, 23 nt, Human
gcugcagucuccuccauucccua

SEQ ID NO: 794685 - RNA, 24 nt, Human
gcuggagugcaguggugugaucug

SEQ ID NO: 794686 - RNA, 18 nt, Human
ggaaaaaagccucuacaa

SEQ ID NO: 794687 - RNA, 26 nt, Human
ggaaaaaagccucuacaagucacaga

SEQ ID NO: 794688 - RNA, 18 nt, Human
ggaaguugccacaacugc

SEQ ID NO: 794689 - RNA, 24 nt, Human
ggacaugguggcucacgccuguaa

SEQ ID NO: 794690 - RNA, 22 nt, Human
ggagguugcagugagcugagau

SEQ ID NO: 794691 - RNA, 24 nt, Human
ggagguugcagugagcugagauug

SEQ ID NO: 794692 - RNA, 22 nt, Human
ggauuaaaggugugagccacug

SEQ ID NO: 794693 - RNA, 22 nt, Human
ggauuaccugaggucaggaguu

SEQ ID NO: 794694 - RNA, 23 nt, Human
ggcaugguggugggugccuguaa

SEQ ID NO: 794695 - RNA, 22 nt, Human
ggcguccccucaucuacugcuc

SEQ ID NO: 794696 - RNA, 21 nt, Human
ggcucacgccuguaaucccag

SEQ ID NO: 794697 - RNA, 22 nt, Human
ggcuggagugcaguggugugau

SEQ ID NO: 794698 - RNA, 18 nt, Human
gggucucccagcggguag

SEQ ID NO: 794699 - RNA, 24 nt, Human
gguggcucacgccuguaaucccag

SEQ ID NO: 794700 - RNA, 24 nt, Human
gguggugggugccuguaaucucag

SEQ ID NO: 794701 - RNA, 26 nt, Human
guaaagcaaccagagccauccucgaa

SEQ ID NO: 794702 - RNA, 24 nt, Human
gugauccacccaccucagccuccc

SEQ ID NO: 794703 - RNA, 19 nt, Human
guggaaaaaagccucuaca

SEQ ID NO: 794704 - RNA, 19 nt, Human
guugcagugagcugagauu

SEQ ID NO: 794705 - RNA, 21 nt, Human
guugcagugagcugagauugc

SEQ ID NO: 794706 - RNA, 18 nt, Human
uaaaaaaugcuucaucac

SEQ ID NO: 794707 - RNA, 22 nt, Human
uaaaacaaacuaacaagcaaaa

SEQ ID NO: 794708 - RNA, 18 nt, Human
uaagaaaauguuuuuagg

SEQ ID NO: 794709 - RNA, 20 nt, Human
uaauuugcugcagucuccuc

SEQ ID NO: 794710 - RNA, 22 nt, Human
uacacaugcuucccacauaccu

SEQ ID NO: 794711 - RNA, 24 nt, Human
uacagcagugaaaaauaauguuac

SEQ ID NO: 794712 - RNA, 21 nt, Human
uacugcuccacaccagcaacc

SEQ ID NO: 794713 - RNA, 19 nt, Human
uagaaaagaaaaaaaagag

SEQ ID NO: 794714 - RNA, 25 nt, Human
uagaaaagaaaaaaaagagagaaau

SEQ ID NO: 794715 - RNA, 20 nt, Human
uagaagcaaaaggcagaaca

SEQ ID NO: 794716 - RNA, 23 nt, Human
uagccuccagugccgucauacca

SEQ ID NO: 794717 - RNA, 22 nt, Human
uaggauuaaaggugugagccac

SEQ ID NO: 794718 - RNA, 22 nt, Human
uaggauuaaaggugugagccac

SEQ ID NO: 794719 - RNA, 24 nt, Human
uaggauuaaaggugugagccacug

SEQ ID NO: 794720 - RNA, 21 nt, Human
uagugucuugcccucccuuag

SEQ ID NO: 794721 - RNA, 20 nt, Human
uaguuagaagcaaaaggcag

SEQ ID NO: 794722 - RNA, 18 nt, Human
uaucaguggauguaucug

SEQ ID NO: 794723 - RNA, 25 nt, Human
uaugaaaagccuauggaccaguuaa

SEQ ID NO: 794724 - RNA, 24 nt, Human
ucacccaggcuggagugcaguggu

SEQ ID NO: 794725 - RNA, 18 nt, Human
ucacugcaaccucugccu

SEQ ID NO: 794726 - RNA, 19 nt, Human
ucacugcaaccucugccuc

SEQ ID NO: 794727 - RNA, 24 nt, Human
ucacugcaaccucugccucccaag

SEQ ID NO: 794728 - RNA, 20 nt, Human
ucagcacccaaucacugaga

SEQ ID NO: 794729 - RNA, 23 nt, Human
ucagccgcagaaacuggcaguga

SEQ ID NO: 794730 - RNA, 18 nt, Human
ucagccucccaaagugcu

SEQ ID NO: 794731 - RNA, 18 nt, Human
ucagguggaucuuuauga

SEQ ID NO: 794732 - RNA, 25 nt, Human
uccacagaaacgcucucugcagaag

SEQ ID NO: 794733 - RNA, 21 nt, Human
uccacccaccucagccuccca

SEQ ID NO: 794734 - RNA, 21 nt, Human
uccaggguuucaccaccuugg

SEQ ID NO: 794735 - RNA, 23 nt, Human
uccaucucaaaaaaaaaaaaaaa

SEQ ID NO: 794736 - RNA, 24 nt, Human
uccaucucaaaaaaaaaaaaaaaa

SEQ ID NO: 794737 - RNA, 23 nt, Human
ucccaaagugcuaggauuaaagg

SEQ ID NO: 794738 - RNA, 18 nt, Human
ucccaaguucaagcaauu

SEQ ID NO: 794739 - RNA, 21 nt, Human
ucccaaguucaagcaauuauc

SEQ ID NO: 794740 - RNA, 21 nt, Human
ucccugagcauguuggggugg

SEQ ID NO: 794741 - RNA, 18 nt, Human
ucccugggcagguuuaga

SEQ ID NO: 794742 - RNA, 19 nt, Human
ucccugggcagguuuagag

SEQ ID NO: 794743 - RNA, 23 nt, Human
uccucgaaucccaguugugcaac

SEQ ID NO: 794744 - RNA, 24 nt, Human
uccuggggccaacacugggguagu

SEQ ID NO: 794745 - RNA, 24 nt, Human
ucgcucugucacccaggcuggagu

SEQ ID NO: 794746 - RNA, 21 nt, Human
ucuacaagucacagaacaagg

SEQ ID NO: 794747 - RNA, 18 nt, Human
ucucaaaaaaaaaaaaaa

SEQ ID NO: 794748 - RNA, 23 nt, Human
ucuccagaaacaauggaaguugc

SEQ ID NO: 794749 - RNA, 19 nt, Human
ucucgcucugucacccagg

SEQ ID NO: 794750 - RNA, 23 nt, Human
ucucgcucugucacccaggcugg

SEQ ID NO: 794751 - RNA, 24 nt, Human
ucucgcucugucacccaggcugga

SEQ ID NO: 794752 - RNA, 26 nt, Human
ucucgcucugucacccaggcuggagu

SEQ ID NO: 794753 - RNA, 24 nt, Human
ucugucacccaggcuggagugcag

SEQ ID NO: 794754 - RNA, 24 nt, Human
ucugugggucucccagcggguagu

SEQ ID NO: 794755 - RNA, 18 nt, Human
ucuuugggaaaucuugug

SEQ ID NO: 794756 - RNA, 18 nt, Human
ucuuugggaaaucuugug

SEQ ID NO: 794757 - RNA, 19 nt, Human
ucuuugggaaaucuugugu

SEQ ID NO: 794758 - RNA, 22 nt, Human
ugaaagacacaaagauggggca

SEQ ID NO: 794759 - RNA, 24 nt, Human
ugaaagacacaaagauggggcacu

SEQ ID NO: 794760 - RNA, 20 nt, Human
ugaagcagguggauuaccug

SEQ ID NO: 794761 - RNA, 24 nt, Human
ugaagcagguggauuaccugaggu

SEQ ID NO: 794762 - RNA, 26 nt, Human
ugaagcagguggauuaccugagguca

SEQ ID NO: 794763 - RNA, 23 nt, Human
ugaccaacauggugaaaccuugu

SEQ ID NO: 794764 - RNA, 18 nt, Human
ugaccucugagcccacau

SEQ ID NO: 794765 - RNA, 24 nt, Human
ugagaaaacacagauuuacuaugg

SEQ ID NO: 794766 - RNA, 18 nt, Human
ugagaaaccccccuaaga

SEQ ID NO: 794767 - RNA, 23 nt, Human
ugagaaaccccccuaagagcuua

SEQ ID NO: 794768 - RNA, 22 nt, Human
ugagaagagaggacuucgguac

SEQ ID NO: 794769 - RNA, 24 nt, Human
ugagauugcacaauugcacuccag

SEQ ID NO: 794770 - RNA, 23 nt, Human
ugaggcaaacaaaauuugaaucc

SEQ ID NO: 794771 - RNA, 24 nt, Human
ugaggcaaacaaaauuugaauccc

SEQ ID NO: 794772 - RNA, 24 nt, Human
ugauccacccaccucagccuccca

SEQ ID NO: 794773 - RNA, 18 nt, Human
ugauuagaaacagcccua

SEQ ID NO: 794774 - RNA, 18 nt, Human
ugcacagccagcacuggc

SEQ ID NO: 794775 - RNA, 19 nt, Human
ugcacuccagccuggguga

SEQ ID NO: 794776 - RNA, 20 nt, Human
ugcacuccagccugggugac

SEQ ID NO: 794777 - RNA, 23 nt, Human
ugcacuccagccugggugacgag

SEQ ID NO: 794778 - RNA, 24 nt, Human
ugccuguaaucucagguacucagg

SEQ ID NO: 794779 - RNA, 24 nt, Human
uggaaauuuguggaaaaaagccuc

SEQ ID NO: 794780 - RNA, 19 nt, Human
uggagugcaguggugugau

SEQ ID NO: 794781 - RNA, 21 nt, Human
uggagugcaguggugugaucu

SEQ ID NO: 794782 - RNA, 22 nt, Human
uggagugcaguggugugaucug

SEQ ID NO: 794783 - RNA, 20 nt, Human
uggaugaaauaaaaaucaga

SEQ ID NO: 794784 - RNA, 21 nt, Human
uggaugaaauaaaaaucagaa

SEQ ID NO: 794785 - RNA, 24 nt, Human
uggauuaccugaggucaggaguuc

SEQ ID NO: 794786 - RNA, 18 nt, Human
uggcacagagcaacucag

SEQ ID NO: 794787 - RNA, 21 nt, Human
uggccaggcuguuauugaacu

SEQ ID NO: 794788 - RNA, 24 nt, Human
uggcucacgccuguaaucccagca

SEQ ID NO: 794789 - RNA, 20 nt, Human
ugguagcagcuaagggcugg

SEQ ID NO: 794790 - RNA, 24 nt, Human
ugguaggcugaagcagguggauua

SEQ ID NO: 794791 - RNA, 24 nt, Human
ugguggcucacgccuguaauccca

SEQ ID NO: 794792 - RNA, 22 nt, Human
uggugggugccuguaaucucag

SEQ ID NO: 794793 - RNA, 24 nt, Human
ugguggugggugccuguaaucuca

SEQ ID NO: 794794 - RNA, 24 nt, Human
uggugugaucugagcucacugcaa

SEQ ID NO: 794795 - RNA, 21 nt, Human
uguaaaaugucucucaggacu

SEQ ID NO: 794796 - RNA, 19 nt, Human
ugucaaagaaugagucuaa

SEQ ID NO: 794797 - RNA, 24 nt, Human
ugucuccuagaaggccuuggaaac

SEQ ID NO: 794798 - RNA, 18 nt, Human
ugucuugcccucccuuag

SEQ ID NO: 794799 - RNA, 24 nt, Human
ugugauccacccaccucagccucc

SEQ ID NO: 794800 - RNA, 24 nt, Human
uguggcaggagaaucacuugaucc

SEQ ID NO: 794801 - RNA, 19 nt, Human
uuaacaggcaguuccuggu

SEQ ID NO: 794802 - RNA, 24 nt, Human
uuagcugggcaugguggugggugc

SEQ ID NO: 794803 - RNA, 22 nt, Human
uuaguuagaagcaaaaggcaga

SEQ ID NO: 794804 - RNA, 21 nt, Human
uucaacaccagccugaccaac

SEQ ID NO: 794805 - RNA, 19 nt, Human
uugaauccccacaaauguu

SEQ ID NO: 794806 - RNA, 24 nt, Human
uugaucccaggaggcggagguugc

SEQ ID NO: 794807 - RNA, 19 nt, Human
uugcagugagcugagauug

SEQ ID NO: 794808 - RNA, 22 nt, Human
uugcagugagcugagauugcac

SEQ ID NO: 794809 - RNA, 20 nt, Human
uuggauacaugagucacauc

SEQ ID NO: 794810 - RNA, 20 nt, Human
uugguaggcugaagcaggug

SEQ ID NO: 794811 - RNA, 23 nt, Human
uuuaguuagaagcaaaaggcaga

SEQ ID NO: 794812 - RNA, 21 nt, Human
uuucuauuaaaaauacaaaaa

SEQ ID NO: 794813 - RNA, 23 nt, Human
uuugcugcagucuccuccauucc

SEQ ID NO: 794814 - RNA, 19 nt, Human
aaccccuuuccucauucca

SEQ ID NO: 794815 - RNA, 22 nt, Human
aagcaagagaaaaggccgugag

SEQ ID NO: 794816 - RNA, 21 nt, Human
aagcggcagacacagaaaaca

SEQ ID NO: 794817 - RNA, 22 nt, Human
aaggaaaaaaaaaucuuaaaaa

SEQ ID NO: 794818 - RNA, 25 nt, Human
aaggaaaaaaaaaucuuaaaaaaaa

SEQ ID NO: 794819 - RNA, 23 nt, Human
aauacacaaccccaaacacuccu

SEQ ID NO: 794820 - RNA, 24 nt, Human
aauugguccccaugcugacgugga

SEQ ID NO: 794821 - RNA, 24 nt, Human
acaaacagcagaaaugcgugggaa

SEQ ID NO: 794822 - RNA, 20 nt, Human
acacaaccccaaacacuccu

SEQ ID NO: 794823 - RNA, 19 nt, Human
accccaggaauggaacagc

SEQ ID NO: 794824 - RNA, 18 nt, Human
accccuuuccucauucca

SEQ ID NO: 794825 - RNA, 20 nt, Human
accccuuuccucauuccaaa

SEQ ID NO: 794826 - RNA, 20 nt, Human
agaacaaacagcagaaaugc

SEQ ID NO: 794827 - RNA, 24 nt, Human
aggaaaaaaaaaucuuaaaaaaaa

SEQ ID NO: 794828 - RNA, 18 nt, Human
agggaagugcuugggacc

SEQ ID NO: 794829 - RNA, 22 nt, Human
agggaagugcuugggaccccag

SEQ ID NO: 794830 - RNA, 23 nt, Human
agggggcuggaugggggccucuu

SEQ ID NO: 794831 - RNA, 18 nt, Human
aguaguuuucagguuugc

SEQ ID NO: 794832 - RNA, 23 nt, Human
aguaguuuucagguuugcgagcu

SEQ ID NO: 794833 - RNA, 24 nt, Human
aguauacauauuucacaugagugu

SEQ ID NO: 794834 - RNA, 18 nt, Human
auaaauagauccccccaa

SEQ ID NO: 794835 - RNA, 19 nt, Human
aucaaaaggaaaaaaaaau

SEQ ID NO: 794836 - RNA, 22 nt, Human
auuauuuguuccaaagauauca

SEQ ID NO: 794837 - RNA, 20 nt, Human
auucacagaacaaacagcag

SEQ ID NO: 794838 - RNA, 19 nt, Human
caaaaggaaaaaaaaaucc

SEQ ID NO: 794839 - RNA, 26 nt, Human
caauccccaggccuggcagauccagu

SEQ ID NO: 794840 - RNA, 18 nt, Human
cacaaagcagcagauaag

SEQ ID NO: 794841 - RNA, 21 nt, Human
cagcagcacucucacuuuuua

SEQ ID NO: 794842 - RNA, 22 nt, Human
cagcagcacucucacuuuuuaa

SEQ ID NO: 794843 - RNA, 19 nt, Human
cagcaggccugacucuggg

SEQ ID NO: 794844 - RNA, 20 nt, Human
cagcugcccugcaggcugcc

SEQ ID NO: 794845 - RNA, 19 nt, Human
cagcugcuggaagcggcag

SEQ ID NO: 794846 - RNA, 21 nt, Human
caguccuguccuugaguucca

SEQ ID NO: 794847 - RNA, 23 nt, Human
caguggccuugggagagggagug

SEQ ID NO: 794848 - RNA, 21 nt, Human
ccaaacccccuggugcagagc

SEQ ID NO: 794849 - RNA, 22 nt, Human
ccaccagccugcgcagcuccag

SEQ ID NO: 794850 - RNA, 25 nt, Human
ccccaaacccccuggugcagagcuc

SEQ ID NO: 794851 - RNA, 27 nt, Human
ccccuggugcagagcucaacccuuccg

SEQ ID NO: 794852 - RNA, 20 nt, Human
ccccuggugcagagcucagg

SEQ ID NO: 794853 - RNA, 21 nt, Human
ccuaaaauggaucuuguuaac

SEQ ID NO: 794854 - RNA, 22 nt, Human
ccuggagggggcuggauggggg

SEQ ID NO: 794855 - RNA, 23 nt, Human
ccuggagggggcuggaugggggc

SEQ ID NO: 794856 - RNA, 21 nt, Human
ccuggugcagagcucaggagc

SEQ ID NO: 794857 - RNA, 22 nt, Human
ccugugugguccccaaaccccc

SEQ ID NO: 794858 - RNA, 23 nt, Human
cggcagacacagaaaacacguua

SEQ ID NO: 794859 - RNA, 23 nt, Human
cgucaguaguuuucagguuugcg

SEQ ID NO: 794860 - RNA, 20 nt, Human
cuccugggauccaguggccu

SEQ ID NO: 794861 - RNA, 20 nt, Human
cucugugcggaugaccccuc

SEQ ID NO: 794862 - RNA, 19 nt, Human
cugaccaaagacacaaagc

SEQ ID NO: 794863 - RNA, 21 nt, Human
cugagccucguaagccuguug

SEQ ID NO: 794864 - RNA, 20 nt, Human
cugcgcagcuccagguucuc

SEQ ID NO: 794865 - RNA, 21 nt, Human
cugcgcagcuccagguucucu

SEQ ID NO: 794866 - RNA, 21 nt, Human
cuggguccugggguaaaggga

SEQ ID NO: 794867 - RNA, 18 nt, Human
gaaaugcgugggaacccc

SEQ ID NO: 794868 - RNA, 20 nt, Human
gagugugugugugcuuaacg

SEQ ID NO: 794869 - RNA, 24 nt, Human
gccaccgccagcugcccugcaggc

SEQ ID NO: 794870 - RNA, 24 nt, Human
gccagcugcccugcaggcugcccu

SEQ ID NO: 794871 - RNA, 20 nt, Human
gccagcuggaggcugggggc

SEQ ID NO: 794872 - RNA, 21 nt, Human
gcgcagcuccagguucucugc

SEQ ID NO: 794873 - RNA, 19 nt, Human
gcucaacacauugcaaaug

SEQ ID NO: 794874 - RNA, 21 nt, Human
gcuugggaccccaggaaugga

SEQ ID NO: 794875 - RNA, 18 nt, Human
ggaagucaguuugucauu

SEQ ID NO: 794876 - RNA, 21 nt, Human
ggagccagcuggaggcugggg

SEQ ID NO: 794877 - RNA, 19 nt, Human
ggccugagccucguaagcc

SEQ ID NO: 794878 - RNA, 20 nt, Human
gggauccaguggccuuggga

SEQ ID NO: 794879 - RNA, 21 nt, Human
ggggaugucgggugccgcagc

SEQ ID NO: 794880 - RNA, 19 nt, Human
ggggcuggaugggggccuc

SEQ ID NO: 794881 - RNA, 23 nt, Human
ggugcacugugcacacuggccug

SEQ ID NO: 794882 - RNA, 20 nt, Human
guacauauacaugucauaua

SEQ ID NO: 794883 - RNA, 20 nt, Human
uaaaucaacaccccgagacc

SEQ ID NO: 794884 - RNA, 23 nt, Human
uacacaaccccaaacacuccuaa

SEQ ID NO: 794885 - RNA, 18 nt, Human
uauauuaaaaaaaauugg

SEQ ID NO: 794886 - RNA, 22 nt, Human
ucaaaaggaaaaaaaaaucuua

SEQ ID NO: 794887 - RNA, 27 nt, Human
ucaaaagucucccauuucuuucucagg

SEQ ID NO: 794888 - RNA, 18 nt, Human
ucaacaccccgagaccgg

SEQ ID NO: 794889 - RNA, 19 nt, Human
ucacagaacaaacagcaga

SEQ ID NO: 794890 - RNA, 24 nt, Human
ucagaaauaaaucaacaccccgag

SEQ ID NO: 794891 - RNA, 20 nt, Human
ucggugcacugugcacacug

SEQ ID NO: 794892 - RNA, 20 nt, Human
ugaccaaagacacaaagcaa

SEQ ID NO: 794893 - RNA, 24 nt, Human
ugaccaaagacacaaagcagcaga

SEQ ID NO: 794894 - RNA, 25 nt, Human
ugaccaaagacacaaagcagcagau

SEQ ID NO: 794895 - RNA, 29 nt, Human
ugaguguguacauauacaugucauauauu

SEQ ID NO: 794896 - RNA, 21 nt, Human
ugccaggcccuggagaccuuu

SEQ ID NO: 794897 - RNA, 20 nt, Human
uggaagcggcagacacagaa

SEQ ID NO: 794898 - RNA, 18 nt, Human
uggccuugggagagggag

SEQ ID NO: 794899 - RNA, 23 nt, Human
uggggucugccaggcccuggaga

SEQ ID NO: 794900 - RNA, 23 nt, Human
uguguacauauacaugucauaua

SEQ ID NO: 794901 - RNA, 18 nt, Human
ugugugagugugugugug

SEQ ID NO: 794902 - RNA, 19 nt, Human
ugugugagugugugugugc

SEQ ID NO: 794903 - RNA, 24 nt, Human
uucaaaagucucccauuucuuucu

SEQ ID NO: 794904 - RNA, 22 nt, Human
uucuccugggauccaguggccu

SEQ ID NO: 794905 - RNA, 19 nt, Human
uugucaggaaucugaccaa

SEQ ID NO: 794906 - RNA, 18 nt, Human
aaccagggccuugcugcg

SEQ ID NO: 794907 - RNA, 18 nt, Human
aagccagaggcgggggcg

SEQ ID NO: 794908 - RNA, 18 nt, Human
acacagccucacuccugc

SEQ ID NO: 794909 - RNA, 23 nt, Human
agccaguaauggagcacgcggcc

SEQ ID NO: 794910 - RNA, 19 nt, Human
aggggaccccaggggcuca

SEQ ID NO: 794911 - RNA, 21 nt, Human
caggucaaacccugggaggga

SEQ ID NO: 794912 - RNA, 20 nt, Human
ccagaggcgggggcguaggu

SEQ ID NO: 794913 - RNA, 19 nt, Human
cccaagccagaggcggggg

SEQ ID NO: 794914 - RNA, 21 nt, Human
cgcccccauucuccaggaacc

SEQ ID NO: 794915 - RNA, 18 nt, Human
cuguacuucguggcugcc

SEQ ID NO: 794916 - RNA, 21 nt, Human
gcagugucacguggcuccugg

SEQ ID NO: 794917 - RNA, 25 nt, Human
ggcauggggggccugguguucucgu

SEQ ID NO: 794918 - RNA, 21 nt, Human
uaauggagcacgcggccaagc

SEQ ID NO: 794919 - RNA, 24 nt, Human
ucagugcccggcuccagcuucugc

SEQ ID NO: 794920 - RNA, 19 nt, Human
uccagcugaccugcaggcu

SEQ ID NO: 794921 - RNA, 21 nt, Human
uccaggaaccagggccuugcu

SEQ ID NO: 794922 - RNA, 19 nt, Human
ucuccaggaaccagggccu

SEQ ID NO: 794923 - RNA, 23 nt, Human
ugcauagauagcugagaccagga

SEQ ID NO: 794924 - RNA, 22 nt, Human
uggaaggagucgaacuuugaca

SEQ ID NO: 794925 - RNA, 21 nt, Human
ugggagggagccgucagggcg

SEQ ID NO: 794926 - RNA, 23 nt, Human
uucguggcugccugcaggucggg

SEQ ID NO: 794927 - RNA, 20 nt, Human
uuugacacgugugucugaau

SEQ ID NO: 794928 - RNA, 18 nt, Human
aaaaguaaagcagaugga

SEQ ID NO: 794929 - RNA, 23 nt, Human
aaacagguacacagccauagaac

SEQ ID NO: 794930 - RNA, 24 nt, Human
aaacagguacacagccauagaacu

SEQ ID NO: 794931 - RNA, 20 nt, Human
aaacaugcacaaacaugagu

SEQ ID NO: 794932 - RNA, 21 nt, Human
aaagagaaaucuggcaaaaag

SEQ ID NO: 794933 - RNA, 23 nt, Human
aaagagaaaucuggcaaaaagga

SEQ ID NO: 794934 - RNA, 23 nt, Human
aaagcagccaaucugauggcaga

SEQ ID NO: 794935 - RNA, 19 nt, Human
aaagggcaacugugauaca

SEQ ID NO: 794936 - RNA, 21 nt, Human
aacucaggaacuaagacauga

SEQ ID NO: 794937 - RNA, 18 nt, Human
aagacacugguuccaacu

SEQ ID NO: 794938 - RNA, 18 nt, Human
aaucccugagauggaaca

SEQ ID NO: 794939 - RNA, 19 nt, Human
acaaaauguguauauccuc

SEQ ID NO: 794940 - RNA, 26 nt, Human
acacacaauuauagaugaaaccacac

SEQ ID NO: 794941 - RNA, 19 nt, Human
acacagacaucccuacaug

SEQ ID NO: 794942 - RNA, 22 nt, Human
accacuggacuauaaaugcccu

SEQ ID NO: 794943 - RNA, 24 nt, Human
accagcccuagccuccaagucagc

SEQ ID NO: 794944 - RNA, 18 nt, Human
agauguaucuauguacau

SEQ ID NO: 794945 - RNA, 18 nt, Human
agccggcccgagugggga

SEQ ID NO: 794946 - RNA, 19 nt, Human
agcuauaccaccccuuccc

SEQ ID NO: 794947 - RNA, 20 nt, Human
aggacacgcaggauauaggg

SEQ ID NO: 794948 - RNA, 19 nt, Human
aggcaaaagucuaagucca

SEQ ID NO: 794949 - RNA, 22 nt, Human
aggcaggagcuucaauguccuc

SEQ ID NO: 794950 - RNA, 21 nt, Human
aggcauuaucgacuagagcug

SEQ ID NO: 794951 - RNA, 20 nt, Human
aggcgagaagagaacuaugg

SEQ ID NO: 794952 - RNA, 19 nt, Human
aggcggcggcggcugcucg

SEQ ID NO: 794953 - RNA, 24 nt, Human
aguguucuguguuugccaagggag

SEQ ID NO: 794954 - RNA, 18 nt, Human
aguucacauucuagcuau

SEQ ID NO: 794955 - RNA, 19 nt, Human
aguuugucgaagaaagaaa

SEQ ID NO: 794956 - RNA, 24 nt, Human
auaaagacacagaugcauggauaa

SEQ ID NO: 794957 - RNA, 19 nt, Human
auacacacacacaauuaua

SEQ ID NO: 794958 - RNA, 23 nt, Human
auacacauaaauauauaugugca

SEQ ID NO: 794959 - RNA, 18 nt, Human
aucaaaccccacccccaa

SEQ ID NO: 794960 - RNA, 23 nt, Human
augcagauccucaaacaugaaua

SEQ ID NO: 794961 - RNA, 20 nt, Human
auguacacaaaauguguaua

SEQ ID NO: 794962 - RNA, 20 nt, Human
auucauagaaaagcacugug

SEQ ID NO: 794963 - RNA, 21 nt, Human
caagacacugguuccaacuga

SEQ ID NO: 794964 - RNA, 22 nt, Human
caagugcccaucaaaucagaag

SEQ ID NO: 794965 - RNA, 23 nt, Human
caagugcccaucaaaucagaagc

SEQ ID NO: 794966 - RNA, 27 nt, Human
cacggccacgcgccccgcgcaagcgcc

SEQ ID NO: 794967 - RNA, 21 nt, Human
cacuauggaggucagccaggg

SEQ ID NO: 794968 - RNA, 22 nt, Human
cacucugcaagggaaaccugag

SEQ ID NO: 794969 - RNA, 19 nt, Human
cagcccuagccuccaaguc

SEQ ID NO: 794970 - RNA, 23 nt, Human
caggaacaugauacacuauggag

SEQ ID NO: 794971 - RNA, 20 nt, Human
caggaacuaagacaugaaac

SEQ ID NO: 794972 - RNA, 22 nt, Human
cauacacauggauacaaacaug

SEQ ID NO: 794973 - RNA, 20 nt, Human
caugaauacacagacauccc

SEQ ID NO: 794974 - RNA, 20 nt, Human
caugcacaaacaugagugca

SEQ ID NO: 794975 - RNA, 19 nt, Human
ccacacacuugcuaacaca

SEQ ID NO: 794976 - RNA, 22 nt, Human
ccccacccccaacucaggaacu

SEQ ID NO: 794977 - RNA, 19 nt, Human
cccugagauggaacagugu

SEQ ID NO: 794978 - RNA, 22 nt, Human
ccuaucaaaccccacccccaac

SEQ ID NO: 794979 - RNA, 25 nt, Human
ccuccaagucagcgagcaaugagac

SEQ ID NO: 794980 - RNA, 22 nt, Human
ccugagauggaacaguguucug

SEQ ID NO: 794981 - RNA, 20 nt, Human
ccuuggcacccccacucuuc

SEQ ID NO: 794982 - RNA, 25 nt, Human
cggccacgcgccccgcgcaagcgcc

SEQ ID NO: 794983 - RNA, 20 nt, Human
cguguacgcagauacacaua

SEQ ID NO: 794984 - RNA, 23 nt, Human
cuagcuauaccaccccuucccua

SEQ ID NO: 794985 - RNA, 21 nt, Human
cuaucaaaccccacccccaac

SEQ ID NO: 794986 - RNA, 29 nt, Human
cuauguacauacacacauguacuuagcca

SEQ ID NO: 794987 - RNA, 28 nt, Human
cucaccacuggacuauaaaagguuuucc

SEQ ID NO: 794988 - RNA, 22 nt, Human
cucgggcugcggcggagacccu

SEQ ID NO: 794989 - RNA, 22 nt, Human
cugaggcggcggcggcugcucu

SEQ ID NO: 794990 - RNA, 27 nt, Human
cuucaagugcccaucaaaucagaagca

SEQ ID NO: 794991 - RNA, 23 nt, Human
cuugcuaacacaaaggugaccac

SEQ ID NO: 794992 - RNA, 19 nt, Human
gaaaccacacacuugcuaa

SEQ ID NO: 794993 - RNA, 20 nt, Human
gaaaggcaggggaagaaagc

SEQ ID NO: 794994 - RNA, 21 nt, Human
gaaccgcggccgggcccggga

SEQ ID NO: 794995 - RNA, 21 nt, Human
gacuuggguugauccuaacug

SEQ ID NO: 794996 - RNA, 22 nt, Human
gagaacccgcgagccagccggc

SEQ ID NO: 794997 - RNA, 19 nt, Human
gagaaugaauagaggaggc

SEQ ID NO: 794998 - RNA, 18 nt, Human
gagggcagacgcgggcgg

SEQ ID NO: 794999 - RNA, 21 nt, Human
gaguggggaaccgcggccggg

SEQ ID NO: 795000 - RNA, 24 nt, Human
gaugugcauccucacauguacaca

SEQ ID NO: 795001 - RNA, 20 nt, Human
gcagacgcgggcggccugca

SEQ ID NO: 795002 - RNA, 21 nt, Human
gcauguugugggguuucuggu

SEQ ID NO: 795003 - RNA, 20 nt, Human
gccggcgaggaagcuugagg

SEQ ID NO: 795004 - RNA, 20 nt, Human
gcggcggcggcugcucgggc

SEQ ID NO: 795005 - RNA, 22 nt, Human
gcggcugcucgggcugcggcgg

SEQ ID NO: 795006 - RNA, 21 nt, Human
gcugcucgggcugcggcggag

SEQ ID NO: 795007 - RNA, 26 nt, Human
ggacuuuccccauccuuagggcacuc

SEQ ID NO: 795008 - RNA, 18 nt, Human
ggagacagggccaaugcu

SEQ ID NO: 795009 - RNA, 19 nt, Human
ggaggucagccagggcuaa

SEQ ID NO: 795010 - RNA, 22 nt, Human
ggcaaaaaggacacauugaugc

SEQ ID NO: 795011 - RNA, 18 nt, Human
ggcaacugugauacagaa

SEQ ID NO: 795012 - RNA, 21 nt, Human
ggcagacgcgggcggccugca

SEQ ID NO: 795013 - RNA, 22 nt, Human
ggccgggcccgggagcgcgccg

SEQ ID NO: 795014 - RNA, 22 nt, Human
ggcgagagagauuuaagaggaa

SEQ ID NO: 795015 - RNA, 18 nt, Human
gggaaagagaaaucuggc

SEQ ID NO: 795016 - RNA, 18 nt, Human
gggcagacgcgggcggcc

SEQ ID NO: 795017 - RNA, 20 nt, Human
ggucagccagggcuaagaca

SEQ ID NO: 795018 - RNA, 19 nt, Human
guccaguccuggccucugu

SEQ ID NO: 795019 - RNA, 20 nt, Human
guccuggccucugucccuca

SEQ ID NO: 795020 - RNA, 21 nt, Human
gugacaaaagccggcgaggaa

SEQ ID NO: 795021 - RNA, 22 nt, Human
gugcuuagaagcuuguuuggug

SEQ ID NO: 795022 - RNA, 19 nt, Human
uaaaugcccugucuguagg

SEQ ID NO: 795023 - RNA, 24 nt, Human
uaacaagcauacacauggauacaa

SEQ ID NO: 795024 - RNA, 23 nt, Human
uaagacuugaguagccacaaaug

SEQ ID NO: 795025 - RNA, 20 nt, Human
uaagcaaucccugagaugga

SEQ ID NO: 795026 - RNA, 19 nt, Human
uacaauaauuagcaacaca

SEQ ID NO: 795027 - RNA, 19 nt, Human
uacacagacaucccuacau

SEQ ID NO: 795028 - RNA, 24 nt, Human
uacccacagcuacuucaagugccc

SEQ ID NO: 795029 - RNA, 19 nt, Human
uaccugggaacccaggcug

SEQ ID NO: 795030 - RNA, 32 nt, Human
uacgcagauacacauacuaaacaugcacagug

SEQ ID NO: 795031 - RNA, 23 nt, Human
uagaaaagcacugugaauucaca

SEQ ID NO: 795032 - RNA, 21 nt, Human
uagaugaauauuaugaacuca

SEQ ID NO: 795033 - RNA, 19 nt, Human
uagcaggaacaugauacac

SEQ ID NO: 795034 - RNA, 24 nt, Human
uauacacaugcacucguguacgca

SEQ ID NO: 795035 - RNA, 24 nt, Human
uauagaugaaaccacacacuugcu

SEQ ID NO: 795036 - RNA, 20 nt, Human
uaucaaaccccacccccaac

SEQ ID NO: 795037 - RNA, 20 nt, Human
uauguacauacacacaugua

SEQ ID NO: 795038 - RNA, 22 nt, Human
uauguacauacacacauguagu

SEQ ID NO: 795039 - RNA, 24 nt, Human
uaugugcacaaacaggcaugcaca

SEQ ID NO: 795040 - RNA, 21 nt, Human
ucaaacagguacacagccaua

SEQ ID NO: 795041 - RNA, 24 nt, Human
ucacacacuugcuaaaaaagggca

SEQ ID NO: 795042 - RNA, 28 nt, Human
ucagcggcuucccagaccuucaucuucu

SEQ ID NO: 795043 - RNA, 20 nt, Human
ucaggaagguagcaggaaca

SEQ ID NO: 795044 - RNA, 22 nt, Human
uccaacugacuuuucugagugc

SEQ ID NO: 795045 - RNA, 21 nt, Human
uccacugcuaccagcaaacac

SEQ ID NO: 795046 - RNA, 18 nt, Human
ucccugagauggaacagu

SEQ ID NO: 795047 - RNA, 24 nt, Human
uccuccuacccacagcuacuucaa

SEQ ID NO: 795048 - RNA, 25 nt, Human
uccuggccucugucccucacucacc

SEQ ID NO: 795049 - RNA, 21 nt, Human
uccuuuggccucauccacagg

SEQ ID NO: 795050 - RNA, 21 nt, Human
ucugcauagacuagacuuggg

SEQ ID NO: 795051 - RNA, 18 nt, Human
ucuguguuugccaaggga

SEQ ID NO: 795052 - RNA, 19 nt, Human
ugaaacaguaaacaccaag

SEQ ID NO: 795053 - RNA, 24 nt, Human
ugaaacaguaaacaccaagacacu

SEQ ID NO: 795054 - RNA, 20 nt, Human
ugaacaguaggcuguaguca

SEQ ID NO: 795055 - RNA, 21 nt, Human
ugaacucagcggcuucccaga

SEQ ID NO: 795056 - RNA, 25 nt, Human
ugacacauacacauaaauauauaug

SEQ ID NO: 795057 - RNA, 26 nt, Human
ugaccugauacuaccugggaacccag

SEQ ID NO: 795058 - RNA, 21 nt, Human
ugagacugugacaaaagccgg

SEQ ID NO: 795059 - RNA, 20 nt, Human
ugagagaaugaauagaggag

SEQ ID NO: 795060 - RNA, 21 nt, Human
ugagaguggcuucucucuuuu

SEQ ID NO: 795061 - RNA, 19 nt, Human
ugaggcaaaagucuaaguc

SEQ ID NO: 795062 - RNA, 25 nt, Human
ugcacaaacaggcaugcacagaugu

SEQ ID NO: 795063 - RNA, 20 nt, Human
ugcacagauguaucuaugua

SEQ ID NO: 795064 - RNA, 19 nt, Human
ugcacauauucaaacaggu

SEQ ID NO: 795065 - RNA, 19 nt, Human
ugcagggcccagcuccucc

SEQ ID NO: 795066 - RNA, 27 nt, Human
ugcauggauaacaagcauacacauggu

SEQ ID NO: 795067 - RNA, 18 nt, Human
ugcggcggagacccuggc

SEQ ID NO: 795068 - RNA, 26 nt, Human
ugcuaccagcaaacacucugcaaggg

SEQ ID NO: 795069 - RNA, 20 nt, Human
ugcucagaguucucucaggg

SEQ ID NO: 795070 - RNA, 18 nt, Human
ugggaaagagaaaucugg

SEQ ID NO: 795071 - RNA, 23 nt, Human
uggucaguuuggaguaaaaaagg

SEQ ID NO: 795072 - RNA, 20 nt, Human
uguacauacacacauguacu

SEQ ID NO: 795073 - RNA, 23 nt, Human
uguacauacacacauguacuuag

SEQ ID NO: 795074 - RNA, 27 nt, Human
uguagucagaagcuugccaagguaggc

SEQ ID NO: 795075 - RNA, 20 nt, Human
ugugcacaaacaggcaugca

SEQ ID NO: 795076 - RNA, 24 nt, Human
ugugcauccucacauguacacaaa

SEQ ID NO: 795077 - RNA, 20 nt, Human
uucucccugcacuuguuucu

SEQ ID NO: 795078 - RNA, 22 nt, Human
uuuauacacaugcacucgugua

SEQ ID NO: 795079 - RNA, 20 nt, Human
uuucagugcccuuggccuga

SEQ ID NO: 795080 - RNA, 20 nt, Human
aaacuccugaacucuuuccc

SEQ ID NO: 795081 - RNA, 18 nt, Human
aacucuuucccuuucccu

SEQ ID NO: 795082 - RNA, 20 nt, Human
agacuaagaugacguuuuaa

SEQ ID NO: 795083 - RNA, 18 nt, Human
aucaacaguuacccguga

SEQ ID NO: 795084 - RNA, 22 nt, Human
aucuuccuucagacaucugcug

SEQ ID NO: 795085 - RNA, 19 nt, Human
caguuuuucccugccuggu

SEQ ID NO: 795086 - RNA, 21 nt, Human
cugugauuuucaguuuuuccc

SEQ ID NO: 795087 - RNA, 24 nt, Human
ucuugaccaagacaggccgggguc

SEQ ID NO: 795088 - RNA, 19 nt, Human
ugucauagcccaugugaag

SEQ ID NO: 795089 - RNA, 22 nt, Human
ugugaaggucauaaugagacua

SEQ ID NO: 795090 - RNA, 21 nt, Human
ugugauuuucaguuuuucccu

SEQ ID NO: 795091 - RNA, 18 nt, Human
aaaaaauaugcaggaaca

SEQ ID NO: 795092 - RNA, 18 nt, Human
aaccuaaucaucccacag

SEQ ID NO: 795093 - RNA, 18 nt, Human
aagucaauuccagcacag

SEQ ID NO: 795094 - RNA, 18 nt, Human
agagagagaagauaggcg

SEQ ID NO: 795095 - RNA, 22 nt, Human
agagcagcggcaguggguccag

SEQ ID NO: 795096 - RNA, 22 nt, Human
agagcagcggcaguggguccag

SEQ ID NO: 795097 - RNA, 20 nt, Human
agcggcaguggguccagggg

SEQ ID NO: 795098 - RNA, 19 nt, Human
aggaaggcgcuaagcaaau

SEQ ID NO: 795099 - RNA, 19 nt, Human
aggcaggggucaguugugg

SEQ ID NO: 795100 - RNA, 22 nt, Human
aggcaggggucaguuguggggg

SEQ ID NO: 795101 - RNA, 23 nt, Human
aggcaggggucaguugugggggg

SEQ ID NO: 795102 - RNA, 21 nt, Human
agggguccuggaggggcugga

SEQ ID NO: 795103 - RNA, 22 nt, Human
aucccacagugccaaggccagu

SEQ ID NO: 795104 - RNA, 21 nt, Human
auggagggaaggaggagcaga

SEQ ID NO: 795105 - RNA, 19 nt, Human
auuuacaccucugcucccc

SEQ ID NO: 795106 - RNA, 18 nt, Human
caccuccaccacggcugc

SEQ ID NO: 795107 - RNA, 19 nt, Human
caccuuuggccugacaggg

SEQ ID NO: 795108 - RNA, 19 nt, Human
cagaagcuuuuucuucccu

SEQ ID NO: 795109 - RNA, 18 nt, Human
cagcacagggaggcaggg

SEQ ID NO: 795110 - RNA, 19 nt, Human
cagcggcaguggguccagg

SEQ ID NO: 795111 - RNA, 24 nt, Human
cagcuggcuggacauccagaagcu

SEQ ID NO: 795112 - RNA, 21 nt, Human
caucccacagugccaaggcca

SEQ ID NO: 795113 - RNA, 21 nt, Human
ccacagugauggugcauggag

SEQ ID NO: 795114 - RNA, 24 nt, Human
ccaggccgcugaucugcaggcccc

SEQ ID NO: 795115 - RNA, 19 nt, Human
cuacccuugggcucucuuc

SEQ ID NO: 795116 - RNA, 18 nt, Human
gaagauaggcguggccuc

SEQ ID NO: 795117 - RNA, 23 nt, Human
gacagggcagggggucuggauga

SEQ ID NO: 795118 - RNA, 21 nt, Human
gagcagcggcaguggguccag

SEQ ID NO: 795119 - RNA, 23 nt, Human
gaggcaggggucaguuguggggg

SEQ ID NO: 795120 - RNA, 23 nt, Human
gcaguggguccagggguccugga

SEQ ID NO: 795121 - RNA, 20 nt, Human
gccacgccugccuggcggcc

SEQ ID NO: 795122 - RNA, 24 nt, Human
gccuuauuuacaccucugcucccc

SEQ ID NO: 795123 - RNA, 23 nt, Human
ggaaggaggagcagagagagaag

SEQ ID NO: 795124 - RNA, 19 nt, Human
ggagaaguugagcagggga

SEQ ID NO: 795125 - RNA, 21 nt, Human
ggcuggaagggggcagcuggc

SEQ ID NO: 795126 - RNA, 21 nt, Human
ggcuggaagggggcagcuggc

SEQ ID NO: 795127 - RNA, 24 nt, Human
ggcuggaagggggcagcuggcugg

SEQ ID NO: 795128 - RNA, 23 nt, Human
gggaugcccauucuuuuugcaga

SEQ ID NO: 795129 - RNA, 24 nt, Human
gguuucuccccuacccuugggcuu

SEQ ID NO: 795130 - RNA, 18 nt, Human
uaccaggugauggagggc

SEQ ID NO: 795131 - RNA, 18 nt, Human
uaccaggugauggagggc

SEQ ID NO: 795132 - RNA, 26 nt, Human
uaugcaggaacaaggaaggcgcuuua

SEQ ID NO: 795133 - RNA, 22 nt, Human
ucaguugugggggguuucuccc

SEQ ID NO: 795134 - RNA, 22 nt, Human
ucccucggccacgccugccugg

SEQ ID NO: 795135 - RNA, 21 nt, Human
ugcaggaacaaggaaggcgcu

SEQ ID NO: 795136 - RNA, 20 nt, Human
ugccaagacagggcaggggg

SEQ ID NO: 795137 - RNA, 18 nt, Human
uggaagggggcagcuggc

SEQ ID NO: 795138 - RNA, 20 nt, Human
uggaagggggcagcuggcug

SEQ ID NO: 795139 - RNA, 21 nt, Human
uggaagggggcagcuggcugg

SEQ ID NO: 795140 - RNA, 19 nt, Human
uggagaaguugagcagggg

SEQ ID NO: 795141 - RNA, 23 nt, Human
uggagggcggcggcacaccuuug

SEQ ID NO: 795142 - RNA, 19 nt, Human
uggaggggcuggaaggggg

SEQ ID NO: 795143 - RNA, 22 nt, Human
uuccagcacagggaggcagggg

SEQ ID NO: 795144 - RNA, 18 nt, Human
uucuccccuacccuuggg

SEQ ID NO: 795145 - RNA, 23 nt, Human
uuuaguuuuuuguuuuuuguuuu

SEQ ID NO: 795146 - RNA, 20 nt, Human
uuugcagagagcagcggcag

SEQ ID NO: 795147 - RNA, 21 nt, Human
uuuuuuuuuuuuuuuuucauu

SEQ ID NO: 795148 - RNA, 21 nt, Human
aacacaaugacuuggccaccu

SEQ ID NO: 795149 - RNA, 22 nt, Human
aacaucuuuaaaugaaacacag

SEQ ID NO: 795150 - RNA, 18 nt, Human
aacccagcacuaugggga

SEQ ID NO: 795151 - RNA, 18 nt, Human
aacucagugggcaggugc

SEQ ID NO: 795152 - RNA, 18 nt, Human
aaggggcaggugcuugac

SEQ ID NO: 795153 - RNA, 22 nt, Human
aauguuggaggagggagaggga

SEQ ID NO: 795154 - RNA, 19 nt, Human
acaaagaagggcugccucu

SEQ ID NO: 795155 - RNA, 21 nt, Human
acacugccaagugccccgaga

SEQ ID NO: 795156 - RNA, 21 nt, Human
acccagccugcccuagaagca

SEQ ID NO: 795157 - RNA, 22 nt, Human
accuaggggaccaccacccagc

SEQ ID NO: 795158 - RNA, 18 nt, Human
acucaaaaauuuaaagaa

SEQ ID NO: 795159 - RNA, 23 nt, Human
agacagguggcacaggccggacc

SEQ ID NO: 795160 - RNA, 24 nt, Human
agacagguggcacaggccggaccc

SEQ ID NO: 795161 - RNA, 20 nt, Human
agaguacaguaagagaggcu

SEQ ID NO: 795162 - RNA, 23 nt, Human
agcagggggcgcagccacccucu

SEQ ID NO: 795163 - RNA, 19 nt, Human
agcagugccagugaggugc

SEQ ID NO: 795164 - RNA, 19 nt, Human
agccacgcugcuguggacc

SEQ ID NO: 795165 - RNA, 18 nt, Human
agccucagggccagcagg

SEQ ID NO: 795166 - RNA, 21 nt, Human
agcggcaacugccagagguga

SEQ ID NO: 795167 - RNA, 21 nt, Human
agcgguggcccuggggggcag

SEQ ID NO: 795168 - RNA, 20 nt, Human
aggaggcaaggggcaggugc

SEQ ID NO: 795169 - RNA, 21 nt, Human
aggagggagagggaaagagaa

SEQ ID NO: 795170 - RNA, 19 nt, Human
aggcaggagggugguuggu

SEQ ID NO: 795171 - RNA, 23 nt, Human
agggugguuggugaguugaggca

SEQ ID NO: 795172 - RNA, 24 nt, Human
auauauguauauauauacuucuaa

SEQ ID NO: 795173 - RNA, 20 nt, Human
aucccacccugccucuccag

SEQ ID NO: 795174 - RNA, 21 nt, Human
auggagcaccuggcagaacug

SEQ ID NO: 795175 - RNA, 20 nt, Human
auguaaacaggcccuuggaa

SEQ ID NO: 795176 - RNA, 22 nt, Human
caagaugaggcuaaggccaaga

SEQ ID NO: 795177 - RNA, 22 nt, Human
caagcucagaagauccuaacag

SEQ ID NO: 795178 - RNA, 23 nt, Human
cacccagccugcccuagaagcac

SEQ ID NO: 795179 - RNA, 19 nt, Human
cacccugccucuccagagc

SEQ ID NO: 795180 - RNA, 19 nt, Human
cacccuggagagggccaga

SEQ ID NO: 795181 - RNA, 18 nt, Human
caccuccagccauuccca

SEQ ID NO: 795182 - RNA, 23 nt, Human
cacucgagacguucccuauccca

SEQ ID NO: 795183 - RNA, 18 nt, Human
cagccccacaccugcccc

SEQ ID NO: 795184 - RNA, 23 nt, Human
caggauagaguuccaguaauguu

SEQ ID NO: 795185 - RNA, 20 nt, Human
ccaaaggcuccugccucuga

SEQ ID NO: 795186 - RNA, 22 nt, Human
ccacccagccugcccuagaagc

SEQ ID NO: 795187 - RNA, 22 nt, Human
ccagcagcacucuccacugccc

SEQ ID NO: 795188 - RNA, 19 nt, Human
ccagccuuggugagggggc

SEQ ID NO: 795189 - RNA, 19 nt, Human
cccaccuccagccauuccc

SEQ ID NO: 795190 - RNA, 18 nt, Human
ccccacaccugcccccag

SEQ ID NO: 795191 - RNA, 22 nt, Human
ccccagaggacaaagaagggcu

SEQ ID NO: 795192 - RNA, 22 nt, Human
cccccagccuagagaagccugu

SEQ ID NO: 795193 - RNA, 22 nt, Human
ccccgagaugacucuacugcuc

SEQ ID NO: 795194 - RNA, 20 nt, Human
cccucccuucuccuuugucc

SEQ ID NO: 795195 - RNA, 19 nt, Human
ccuagaagcacugggugcc

SEQ ID NO: 795196 - RNA, 22 nt, Human
ccucuuuccccaacucaguggg

SEQ ID NO: 795197 - RNA, 24 nt, Human
cgaaaugaggagagagaaagguca

SEQ ID NO: 795198 - RNA, 19 nt, Human
cucauugacuagagaagac

SEQ ID NO: 795199 - RNA, 19 nt, Human
cucccaccuccagccauuc

SEQ ID NO: 795200 - RNA, 20 nt, Human
cucccuuccauccaccuccc

SEQ ID NO: 795201 - RNA, 22 nt, Human
cucccuuccauccaccuccuca

SEQ ID NO: 795202 - RNA, 19 nt, Human
cuccuuuguccucuguccc

SEQ ID NO: 795203 - RNA, 21 nt, Human
cucuaggucaagcucauuuac

SEQ ID NO: 795204 - RNA, 18 nt, Human
cugacugccggggaugga

SEQ ID NO: 795205 - RNA, 22 nt, Human
cugcccccaguggaaccaccug

SEQ ID NO: 795206 - RNA, 25 nt, Human
cuggcagucuccuacuuguccccag

SEQ ID NO: 795207 - RNA, 22 nt, Human
cuggucccaagcuaugggcuga

SEQ ID NO: 795208 - RNA, 27 nt, Human
cugguuucaugcagcuuuggggucccu

SEQ ID NO: 795209 - RNA, 20 nt, Human
cuucaagaugaggcuaaggc

SEQ ID NO: 795210 - RNA, 21 nt, Human
cuugacacugccaagugcccc

SEQ ID NO: 795211 - RNA, 20 nt, Human
gaaaacacccuggagagggc

SEQ ID NO: 795212 - RNA, 19 nt, Human
gagggagagggaaagagaa

SEQ ID NO: 795213 - RNA, 23 nt, Human
gagggagagggaaagagaaguca

SEQ ID NO: 795214 - RNA, 26 nt, Human
gauuguguuucugggaugggucagca

SEQ ID NO: 795215 - RNA, 22 nt, Human
gcacucuccacugcccacaggc

SEQ ID NO: 795216 - RNA, 23 nt, Human
gcccacccaccccagugugguca

SEQ ID NO: 795217 - RNA, 18 nt, Human
gcgcagccacccucuccc

SEQ ID NO: 795218 - RNA, 19 nt, Human
gcgguggcccuggggggca

SEQ ID NO: 795219 - RNA, 21 nt, Human
gcuaugggcugacugccgggg

SEQ ID NO: 795220 - RNA, 18 nt, Human
gcugccucuucuagaccc

SEQ ID NO: 795221 - RNA, 22 nt, Human
gcugcuguggacccacaggggc

SEQ ID NO: 795222 - RNA, 21 nt, Human
ggaaaacacccuggagagggc

SEQ ID NO: 795223 - RNA, 21 nt, Human
ggggaagccagcuugccuaga

SEQ ID NO: 795224 - RNA, 18 nt, Human
ggggcagccacgcugcug

SEQ ID NO: 795225 - RNA, 21 nt, Human
ggggugggguagaucaggagc

SEQ ID NO: 795226 - RNA, 19 nt, Human
gguugcugccagggccugg

SEQ ID NO: 795227 - RNA, 20 nt, Human
gucacuguuaaggaaagagg

SEQ ID NO: 795228 - RNA, 21 nt, Human
gugcugaaaggcagcugcaga

SEQ ID NO: 795229 - RNA, 24 nt, Human
guggcacaggcugaaaauagaaag

SEQ ID NO: 795230 - RNA, 18 nt, Human
gugguuggugaguugagg

SEQ ID NO: 795231 - RNA, 29 nt, Human
uaaaaugcaccuguggcuucccauccuuu

SEQ ID NO: 795232 - RNA, 23 nt, Human
uaacaggauagaguuccaguaau

SEQ ID NO: 795233 - RNA, 24 nt, Human
uaaguaucgaaggccguggagguu

SEQ ID NO: 795234 - RNA, 21 nt, Human
uacacccagcagcacucucca

SEQ ID NO: 795235 - RNA, 22 nt, Human
uacaguaagagaggcugauacc

SEQ ID NO: 795236 - RNA, 19 nt, Human
uagcugcccccaguggaac

SEQ ID NO: 795237 - RNA, 24 nt, Human
uagugacuaguggaaaacacccug

SEQ ID NO: 795238 - RNA, 18 nt, Human
uauauauauguauauaua

SEQ ID NO: 795239 - RNA, 18 nt, Human
uauauauguauauauaua

SEQ ID NO: 795240 - RNA, 24 nt, Human
uauauguauauauauacuucuaac

SEQ ID NO: 795241 - RNA, 23 nt, Human
ucaagcccaagucacuguuaagg

SEQ ID NO: 795242 - RNA, 20 nt, Human
ucagcccaaaggcuccugcc

SEQ ID NO: 795243 - RNA, 22 nt, Human
ucagcccaaaggcuccugccuc

SEQ ID NO: 795244 - RNA, 22 nt, Human
ucaggcuucagggcagagggaa

SEQ ID NO: 795245 - RNA, 21 nt, Human
ucaggugagguguccugcucc

SEQ ID NO: 795246 - RNA, 22 nt, Human
uccacagccccacaccugcccc

SEQ ID NO: 795247 - RNA, 20 nt, Human
ucccacccugccucuccaga

SEQ ID NO: 795248 - RNA, 20 nt, Human
ucccugagauuguguuucug

SEQ ID NO: 795249 - RNA, 19 nt, Human
uccugcucccaacucugca

SEQ ID NO: 795250 - RNA, 18 nt, Human
uccuuggagcugcucggg

SEQ ID NO: 795251 - RNA, 18 nt, Human
ucucaccacauccccucu

SEQ ID NO: 795252 - RNA, 21 nt, Human
ucugucccacccagcagggaa

SEQ ID NO: 795253 - RNA, 23 nt, Human
ucuucuagacccucccuucuccu

SEQ ID NO: 795254 - RNA, 20 nt, Human
ucuuugggcccuggcagucu

SEQ ID NO: 795255 - RNA, 23 nt, Human
ugaaaaaaaaugaaacucaggug

SEQ ID NO: 795256 - RNA, 21 nt, Human
ugaagcuaaaagcaagguucc

SEQ ID NO: 795257 - RNA, 19 nt, Human
ugacuaguggaaaacaccc

SEQ ID NO: 795258 - RNA, 20 nt, Human
ugacuaguggaaaacacccu

SEQ ID NO: 795259 - RNA, 22 nt, Human
ugagcagaacagugcucacuga

SEQ ID NO: 795260 - RNA, 21 nt, Human
ugagguguccugcucccaacu

SEQ ID NO: 795261 - RNA, 18 nt, Human
ugaguaaaaugcaccugu

SEQ ID NO: 795262 - RNA, 19 nt, Human
ugaguaaaaugcaccugug

SEQ ID NO: 795263 - RNA, 23 nt, Human
ugauaccuaggggaccaccaccc

SEQ ID NO: 795264 - RNA, 23 nt, Human
ugcagaaaggacaugcaccgaaa

SEQ ID NO: 795265 - RNA, 24 nt, Human
ugccaagugccccgagaugacucu

SEQ ID NO: 795266 - RNA, 26 nt, Human
ugccagggccugguuuccccccucag

SEQ ID NO: 795267 - RNA, 22 nt, Human
ugcucagcccaaaggcuccugc

SEQ ID NO: 795268 - RNA, 20 nt, Human
ugcuugacacugccaagugc

SEQ ID NO: 795269 - RNA, 18 nt, Human
uggaaggcaggagggugg

SEQ ID NO: 795270 - RNA, 18 nt, Human
uggaaggcaggagggugg

SEQ ID NO: 795271 - RNA, 20 nt, Human
uggaaggcaggagggugguu

SEQ ID NO: 795272 - RNA, 30 nt, Human
uggaauuccacagccccacaccugcccccc

SEQ ID NO: 795273 - RNA, 21 nt, Human
uggcacaggcugaaaauagaa

SEQ ID NO: 795274 - RNA, 21 nt, Human
uggcagaacuggaaggcagga

SEQ ID NO: 795275 - RNA, 19 nt, Human
ugggugccccucauugacu

SEQ ID NO: 795276 - RNA, 25 nt, Human
uguggucaaggaggcaaggggcagg

SEQ ID NO: 795277 - RNA, 21 nt, Human
uuccacagccccacaccugcc

SEQ ID NO: 795278 - RNA, 23 nt, Human
uugaggcacaggaaggccaaucc

SEQ ID NO: 795279 - RNA, 21 nt, Human
uugcucagcccaaaggcuccu

SEQ ID NO: 795280 - RNA, 21 nt, Human
uuggaggagggagagggaaag

SEQ ID NO: 795281 - RNA, 24 nt, Human
uuggugagggggcggggaggucau

SEQ ID NO: 795282 - RNA, 23 nt, Human
aaaaaagagaaaaaaacacuaaa

SEQ ID NO: 795283 - RNA, 25 nt, Human
aaaaauaaagauauuuaaccuaugc

SEQ ID NO: 795284 - RNA, 24 nt, Human
aaaaaugaagcccagaggguaguu

SEQ ID NO: 795285 - RNA, 18 nt, Human
aaaacaccgaaucagugu

SEQ ID NO: 795286 - RNA, 18 nt, Human
aaaagagaaacagaaugu

SEQ ID NO: 795287 - RNA, 20 nt, Human
aaaaggaaagaaccuuagaa

SEQ ID NO: 795288 - RNA, 19 nt, Human
aaaaguacagaaggacccu

SEQ ID NO: 795289 - RNA, 20 nt, Human
aaaaucauaccuucucucuu

SEQ ID NO: 795290 - RNA, 21 nt, Human
aaacagaauagaaagcaacua

SEQ ID NO: 795291 - RNA, 26 nt, Human
aaacgaucagccgaggaacaguuagc

SEQ ID NO: 795292 - RNA, 19 nt, Human
aaagugcaaacacaaccac

SEQ ID NO: 795293 - RNA, 24 nt, Human
aaauaucaugagauuacaaauucc

SEQ ID NO: 795294 - RNA, 18 nt, Human
aaaucauaagaaacuuau

SEQ ID NO: 795295 - RNA, 20 nt, Human
aacacaaccacaguuaaacu

SEQ ID NO: 795296 - RNA, 20 nt, Human
aagcacuuauguuggggucc

SEQ ID NO: 795297 - RNA, 21 nt, Human
aagccagaaacaaaaaguaaa

SEQ ID NO: 795298 - RNA, 20 nt, Human
aauccuuucacauuuuuuuc

SEQ ID NO: 795299 - RNA, 23 nt, Human
acuaugcaacauuugaaaaaaga

SEQ ID NO: 795300 - RNA, 23 nt, Human
acuccaaugcuaaaacagaacag

SEQ ID NO: 795301 - RNA, 18 nt, Human
acuccccuacccaccccc

SEQ ID NO: 795302 - RNA, 21 nt, Human
acuccccuacccacccccccu

SEQ ID NO: 795303 - RNA, 23 nt, Human
agaaacaaaaaguaaaacuuaga

SEQ ID NO: 795304 - RNA, 29 nt, Human
agacaauaggugagcucagaagggacccc

SEQ ID NO: 795305 - RNA, 20 nt, Human
agaguagaauccaaauuauc

SEQ ID NO: 795306 - RNA, 23 nt, Human
agccgaggaacaguuagcagcau

SEQ ID NO: 795307 - RNA, 25 nt, Human
aggugauaagaguucgauaaaaaga

SEQ ID NO: 795308 - RNA, 23 nt, Human
aguaggucaacugaauacuuucu

SEQ ID NO: 795309 - RNA, 19 nt, Human
auaagacaggcaaaacaga

SEQ ID NO: 795310 - RNA, 23 nt, Human
augucuacugcuaguugagacag

SEQ ID NO: 795311 - RNA, 24 nt, Human
auuaacuccccuacccaccccccc

SEQ ID NO: 795312 - RNA, 24 nt, Human
auuacaaauuccaaaaugccauaa

SEQ ID NO: 795313 - RNA, 19 nt, Human
auucacuuaaaucaaacag

SEQ ID NO: 795314 - RNA, 18 nt, Human
auuuccagaacuguacaa

SEQ ID NO: 795315 - RNA, 23 nt, Human
caaaaacaccgaaucaguguggc

SEQ ID NO: 795316 - RNA, 19 nt, Human
caaaagagaaacagaaugu

SEQ ID NO: 795317 - RNA, 21 nt, Human
caaaccacucccgccagcaca

SEQ ID NO: 795318 - RNA, 23 nt, Human
caacuaagaaaaaggaaagaacc

SEQ ID NO: 795319 - RNA, 24 nt, Human
caacuccaaugcuaaaacagaaca

SEQ ID NO: 795320 - RNA, 19 nt, Human
caauucauaucagaauuaa

SEQ ID NO: 795321 - RNA, 19 nt, Human
cacaaaugagaauaaauaa

SEQ ID NO: 795322 - RNA, 21 nt, Human
caccagaauagaaaauuuuga

SEQ ID NO: 795323 - RNA, 21 nt, Human
cacugcaaaaacaccgaauca

SEQ ID NO: 795324 - RNA, 19 nt, Human
ccaucaccguuuaugagaa

SEQ ID NO: 795325 - RNA, 21 nt, Human
cccagaguggcgcugccaggu

SEQ ID NO: 795326 - RNA, 20 nt, Human
ccccuacccacccccccucc

SEQ ID NO: 795327 - RNA, 21 nt, Human
ccccuacccacccccccucca

SEQ ID NO: 795328 - RNA, 21 nt, Human
cuaauguaagaaccaaagaaa

SEQ ID NO: 795329 - RNA, 19 nt, Human
cuacccacccccccuccaa

SEQ ID NO: 795330 - RNA, 20 nt, Human
cuacuaugggccaacaaggu

SEQ ID NO: 795331 - RNA, 26 nt, Human
cuccaaugcuaaaacagaacaguuuu

SEQ ID NO: 795332 - RNA, 22 nt, Human
cucugcauaauauuuuuuaaaa

SEQ ID NO: 795333 - RNA, 21 nt, Human
cuggaccacuaugcaacauuu

SEQ ID NO: 795334 - RNA, 21 nt, Human
cuguauugguauagcaauaaa

SEQ ID NO: 795335 - RNA, 21 nt, Human
cuuggcaauccuuucacauuu

SEQ ID NO: 795336 - RNA, 23 nt, Human
cuuguuaauaucugauuugaugu

SEQ ID NO: 795337 - RNA, 18 nt, Human
gaaaaccuuaagccauaa

SEQ ID NO: 795338 - RNA, 20 nt, Human
gaaacagaauguaucuccuc

SEQ ID NO: 795339 - RNA, 20 nt, Human
gaacaacuccaaugcuaaaa

SEQ ID NO: 795340 - RNA, 18 nt, Human
gaaugcacugcaaaaaca

SEQ ID NO: 795341 - RNA, 19 nt, Human
gaccacuaugcaacauuug

SEQ ID NO: 795342 - RNA, 18 nt, Human
gcagcagaagggucacaa

SEQ ID NO: 795343 - RNA, 20 nt, Human
gcgcagcugagucacugaac

SEQ ID NO: 795344 - RNA, 22 nt, Human
ggcaaaacagaauagaaagcaa

SEQ ID NO: 795345 - RNA, 24 nt, Human
guaggcagcagaagggucacaaaa

SEQ ID NO: 795346 - RNA, 19 nt, Human
gugaagcacuuauguuggg

SEQ ID NO: 795347 - RNA, 19 nt, Human
guggagacuguucaaacau

SEQ ID NO: 795348 - RNA, 21 nt, Human
uaaagauauuuaaccuaugcu

SEQ ID NO: 795349 - RNA, 22 nt, Human
uaaauguaauaguuuaacacaa

SEQ ID NO: 795350 - RNA, 21 nt, Human
uaacuccccuacccacccccc

SEQ ID NO: 795351 - RNA, 22 nt, Human
uaagaagaccuaauacuuggug

SEQ ID NO: 795352 - RNA, 18 nt, Human
uaagaucagugaagcacu

SEQ ID NO: 795353 - RNA, 19 nt, Human
uacugcuaguugagacagc

SEQ ID NO: 795354 - RNA, 25 nt, Human
uagaaagcaacuaagaaaaaggaaa

SEQ ID NO: 795355 - RNA, 24 nt, Human
uagaacaaauaguaauuuaaaaug

SEQ ID NO: 795356 - RNA, 18 nt, Human
uagcagcaucuaugacau

SEQ ID NO: 795357 - RNA, 23 nt, Human
uaucaaauaaaaaacaugcaaca

SEQ ID NO: 795358 - RNA, 20 nt, Human
uaugacauccucaaauauuu

SEQ ID NO: 795359 - RNA, 19 nt, Human
uaugauucaaaugaaaagu

SEQ ID NO: 795360 - RNA, 24 nt, Human
uaugcaacauuugaaaaaagagaa

SEQ ID NO: 795361 - RNA, 19 nt, Human
uauguuaacuucuguagaa

SEQ ID NO: 795362 - RNA, 19 nt, Human
ucaaacagacauaugguga

SEQ ID NO: 795363 - RNA, 19 nt, Human
ucaaguagcucuacaaggc

SEQ ID NO: 795364 - RNA, 18 nt, Human
ucacaaaacgaucagccg

SEQ ID NO: 795365 - RNA, 20 nt, Human
ucagggucuuuacuaaauua

SEQ ID NO: 795366 - RNA, 20 nt, Human
ucccagaguggcgcugccag

SEQ ID NO: 795367 - RNA, 26 nt, Human
ucccccaccucuucauuuaaugucaa

SEQ ID NO: 795368 - RNA, 22 nt, Human
uccccuacccacccccccucca

SEQ ID NO: 795369 - RNA, 24 nt, Human
uccccuacccacccccccuccaau

SEQ ID NO: 795370 - RNA, 19 nt, Human
ugaaaaaagagaaaaaaac

SEQ ID NO: 795371 - RNA, 21 nt, Human
ugaaaaaagagaaaaaaacac

SEQ ID NO: 795372 - RNA, 22 nt, Human
ugaaaaaugaagcccagagggu

SEQ ID NO: 795373 - RNA, 20 nt, Human
ugaaaaguacagaaggaccc

SEQ ID NO: 795374 - RNA, 24 nt, Human
ugaagaaaacaccaaguaaaauua

SEQ ID NO: 795375 - RNA, 20 nt, Human
ugaagaggaaucaggauccu

SEQ ID NO: 795376 - RNA, 21 nt, Human
ugaagaggaaucaggauccuu

SEQ ID NO: 795377 - RNA, 21 nt, Human
ugagaauaaauaagacaggca

SEQ ID NO: 795378 - RNA, 22 nt, Human
ugagaauaaauaagacaggcaa

SEQ ID NO: 795379 - RNA, 22 nt, Human
ugccgacaaagauuugccaaua

SEQ ID NO: 795380 - RNA, 20 nt, Human
ugcguuugaacagaaagauu

SEQ ID NO: 795381 - RNA, 20 nt, Human
uguaagaaccaaagaaaacc

SEQ ID NO: 795382 - RNA, 21 nt, Human
uuaacuccccuacccaccccc

SEQ ID NO: 795383 - RNA, 22 nt, Human
uuaugcuacagcaguauaaaaa

SEQ ID NO: 795384 - RNA, 18 nt, Human
uugaaaagucugaugaau

SEQ ID NO: 795385 - RNA, 19 nt, Human
uugaaaaugcaugcaauuu

SEQ ID NO: 795386 - RNA, 22 nt, Human
uugaaugcacugcaaaaacacc

SEQ ID NO: 795387 - RNA, 20 nt, Human
uugcauuuuuuucaaauuua

SEQ ID NO: 795388 - RNA, 26 nt, Human
uuggcaauccuuucacauuuuuuucu

SEQ ID NO: 795389 - RNA, 18 nt, Human
uuggucuuaagaucuaaa

SEQ ID NO: 795390 - RNA, 20 nt, Human
uuuauuuuguaaucuuuagg

SEQ ID NO: 795391 - RNA, 25 nt, Human
aaauugaaagcagggaucccacuca

SEQ ID NO: 795392 - RNA, 25 nt, Human
aacagaccaaaauguggaacagaua

SEQ ID NO: 795393 - RNA, 22 nt, Human
aagcagggaucccacucauaua

SEQ ID NO: 795394 - RNA, 19 nt, Human
aagcggcccagcaggaagg

SEQ ID NO: 795395 - RNA, 19 nt, Human
accuuuuaauccagucacu

SEQ ID NO: 795396 - RNA, 27 nt, Human
agaugacgugcccugcccccugaaagg

SEQ ID NO: 795397 - RNA, 19 nt, Human
aggcaaggcacagcagcga

SEQ ID NO: 795398 - RNA, 21 nt, Human
aggcacagcagcgagggccag

SEQ ID NO: 795399 - RNA, 21 nt, Human
agguagauggacagggaagga

SEQ ID NO: 795400 - RNA, 18 nt, Human
aucaucugguuucuguuc

SEQ ID NO: 795401 - RNA, 21 nt, Human
auccagucacugaaauuagca

SEQ ID NO: 795402 - RNA, 21 nt, Human
caagaugacgugcccugccca

SEQ ID NO: 795403 - RNA, 24 nt, Human
caaugaaaagauacaggcagauga

SEQ ID NO: 795404 - RNA, 23 nt, Human
cacaaacacgcagaacucgauga

SEQ ID NO: 795405 - RNA, 22 nt, Human
caccacaguaauucccaagaag

SEQ ID NO: 795406 - RNA, 19 nt, Human
cacccucccugcuaaccac

SEQ ID NO: 795407 - RNA, 19 nt, Human
cagccgccgccaucccucg

SEQ ID NO: 795408 - RNA, 24 nt, Human
cagcucuuucaccugcaggaugac

SEQ ID NO: 795409 - RNA, 20 nt, Human
caggaaggcaaggcacagca

SEQ ID NO: 795410 - RNA, 23 nt, Human
caguaaaacacgagggucucaua

SEQ ID NO: 795411 - RNA, 20 nt, Human
cauaauucuccacaaacacc

SEQ ID NO: 795412 - RNA, 23 nt, Human
caugcuugccuuccucaugggaa

SEQ ID NO: 795413 - RNA, 22 nt, Human
cauucugcuuggaaauugaaag

SEQ ID NO: 795414 - RNA, 20 nt, Human
ccacccagacuccuuuggug

SEQ ID NO: 795415 - RNA, 19 nt, Human
ccacguggaauuccccuuu

SEQ ID NO: 795416 - RNA, 24 nt, Human
cccaagaagaaugugacaauaagc

SEQ ID NO: 795417 - RNA, 25 nt, Human
cccauagccucuucaugugcuuucu

SEQ ID NO: 795418 - RNA, 21 nt, Human
cccucagagccuugacaaaca

SEQ ID NO: 795419 - RNA, 30 nt, Human
cccugcuaaccacguggaauuccccuuucu

SEQ ID NO: 795420 - RNA, 27 nt, Human
ccucaggagcugcuugacgugcucucc

SEQ ID NO: 795421 - RNA, 25 nt, Human
cgggcaaaauggucgccacccagac

SEQ ID NO: 795422 - RNA, 23 nt, Human
cucauauauccugguuuggaacc

SEQ ID NO: 795423 - RNA, 24 nt, Human
cucccuggugcacuuccaggacag

SEQ ID NO: 795424 - RNA, 21 nt, Human
gaaggugauguagcuuuccag

SEQ ID NO: 795425 - RNA, 19 nt, Human
gacagauuuuucuuccacc

SEQ ID NO: 795426 - RNA, 18 nt, Human
gacuggggucaggacccc

SEQ ID NO: 795427 - RNA, 21 nt, Human
gagggcuccacgugggcaggg

SEQ ID NO: 795428 - RNA, 21 nt, Human
gcaggaagcggcccagcagga

SEQ ID NO: 795429 - RNA, 19 nt, Human
gcccugcccagcaugcugu

SEQ ID NO: 795430 - RNA, 18 nt, Human
gccucuucaugugcuuuc

SEQ ID NO: 795431 - RNA, 19 nt, Human
gcuuggaaauugaaagcag

SEQ ID NO: 795432 - RNA, 24 nt, Human
ggagggaugaagggagggagggau

SEQ ID NO: 795433 - RNA, 18 nt, Human
ggcccagcaggaaggcaa

SEQ ID NO: 795434 - RNA, 20 nt, Human
gggaugaagggagggaggga

SEQ ID NO: 795435 - RNA, 24 nt, Human
gggguggagggaugaagggaggga

SEQ ID NO: 795436 - RNA, 19 nt, Human
ggguggagggaugaaggga

SEQ ID NO: 795437 - RNA, 21 nt, Human
gguauccucaggagcugcuug

SEQ ID NO: 795438 - RNA, 24 nt, Human
gguuauggaacuucaaaggaagaa

SEQ ID NO: 795439 - RNA, 19 nt, Human
gugcaucaucugguuucug

SEQ ID NO: 795440 - RNA, 20 nt, Human
guuauggaacuucaaaggaa

SEQ ID NO: 795441 - RNA, 22 nt, Human
uaaagcuacagugcccggcaca

SEQ ID NO: 795442 - RNA, 21 nt, Human
uaaccacguggaauuccccuu

SEQ ID NO: 795443 - RNA, 19 nt, Human
uaauucccaagaagaaugu

SEQ ID NO: 795444 - RNA, 19 nt, Human
uagcucacacacgugagau

SEQ ID NO: 795445 - RNA, 19 nt, Human
uauugugcaucaucugguu

SEQ ID NO: 795446 - RNA, 21 nt, Human
uauugugcaucaucugguuuc

SEQ ID NO: 795447 - RNA, 22 nt, Human
ucaggagcugcuugacgugcuc

SEQ ID NO: 795448 - RNA, 24 nt, Human
ucaugggaagagggcuccacgugg

SEQ ID NO: 795449 - RNA, 22 nt, Human
uccaaagccuuagucaguuccu

SEQ ID NO: 795450 - RNA, 22 nt, Human
ucccucgaagccaccguugcuu

SEQ ID NO: 795451 - RNA, 24 nt, Human
ucgaugacaaugaaaagauacagg

SEQ ID NO: 795452 - RNA, 26 nt, Human
ucuccacaaacaccucagauuccgag

SEQ ID NO: 795453 - RNA, 24 nt, Human
ucugcaccacaguaauucccaaga

SEQ ID NO: 795454 - RNA, 25 nt, Human
ucugcaccacaguaauucccaagaa

SEQ ID NO: 795455 - RNA, 26 nt, Human
ugacaaacauaugcaggaaggguuuc

SEQ ID NO: 795456 - RNA, 20 nt, Human
ugcagccgccgccaucccuc

SEQ ID NO: 795457 - RNA, 19 nt, Human
ugcaggaagcggcccagca

SEQ ID NO: 795458 - RNA, 19 nt, Human
ugcccggcacagagcaggg

SEQ ID NO: 795459 - RNA, 19 nt, Human
ugcuugacgugcucucccu

SEQ ID NO: 795460 - RNA, 20 nt, Human
ugggcagggaccaugcugug

SEQ ID NO: 795461 - RNA, 21 nt, Human
uucaaaggaagaaaauguuua

SEQ ID NO: 795462 - RNA, 23 nt, Human
uuccaaagccuuagucaguuccu

SEQ ID NO: 795463 - RNA, 24 nt, Human
uuccucaugggaagagggcuccac

SEQ ID NO: 795464 - RNA, 27 nt, Human
uucuccacaaacaccucagauuccgag

SEQ ID NO: 795465 - RNA, 19 nt, Human
uucugagcuucgacaccuu

SEQ ID NO: 795466 - RNA, 23 nt, Human
uugaagcucuggugccuauuuga

SEQ ID NO: 795467 - RNA, 20 nt, Human
uugcagccgccgccaucccu

SEQ ID NO: 795468 - RNA, 18 nt, Human
aaaauuagcugggcgugg

SEQ ID NO: 795469 - RNA, 21 nt, Human
aaaccuuaaaaacaacgccaa

SEQ ID NO: 795470 - RNA, 19 nt, Human
aaagaucuacacauaagag

SEQ ID NO: 795471 - RNA, 21 nt, Human
aaagcagcacugaucaaggca

SEQ ID NO: 795472 - RNA, 19 nt, Human
aacacagugaaaucccguc

SEQ ID NO: 795473 - RNA, 20 nt, Human
aacacagugaaaucccgucu

SEQ ID NO: 795474 - RNA, 21 nt, Human
aacacagugaaaucccgucuc

SEQ ID NO: 795475 - RNA, 19 nt, Human
aacacagugagaccucauc

SEQ ID NO: 795476 - RNA, 20 nt, Human
aacacagugagaccucaucu

SEQ ID NO: 795477 - RNA, 21 nt, Human
aacacagugagaccucaucuc

SEQ ID NO: 795478 - RNA, 18 nt, Human
aacuuuugugcuucagag

SEQ ID NO: 795479 - RNA, 23 nt, Human
aagaagccagggacaagaggaca

SEQ ID NO: 795480 - RNA, 20 nt, Human
aagcaacaaaagaaaaaaac

SEQ ID NO: 795481 - RNA, 21 nt, Human
aagcaacaaaagaaaaaaaca

SEQ ID NO: 795482 - RNA, 18 nt, Human
aagcaggaggaucgcuug

SEQ ID NO: 795483 - RNA, 22 nt, Human
aagcaggaggaucgcuugaggc

SEQ ID NO: 795484 - RNA, 27 nt, Human
aagcaugguuacugcccagacccacgc

SEQ ID NO: 795485 - RNA, 24 nt, Human
aagccagggacaagaggacacaug

SEQ ID NO: 795486 - RNA, 24 nt, Human
aagcgccaggcgaggccggggcgg

SEQ ID NO: 795487 - RNA, 21 nt, Human
aaggaaaaacaaaaaaaacaa

SEQ ID NO: 795488 - RNA, 20 nt, Human
aaggcugcagaggccaagag

SEQ ID NO: 795489 - RNA, 21 nt, Human
aaggcugcagaggccaagagg

SEQ ID NO: 795490 - RNA, 22 nt, Human
aagugcugauggccagugcacu

SEQ ID NO: 795491 - RNA, 24 nt, Human
aaucgcuugaacccaggagguggu

SEQ ID NO: 795492 - RNA, 23 nt, Human
acaaaaaaaacaacuguuacaac

SEQ ID NO: 795493 - RNA, 22 nt, Human
acaacaaagcagcacugaucaa

SEQ ID NO: 795494 - RNA, 21 nt, Human
acacauguaugaaaaggcaca

SEQ ID NO: 795495 - RNA, 24 nt, Human
acagagcaagauuccauuucaaaa

SEQ ID NO: 795496 - RNA, 18 nt, Human
acaguaauagacaaagca

SEQ ID NO: 795497 - RNA, 24 nt, Human
acccaggaggugguaguugcagug

SEQ ID NO: 795498 - RNA, 21 nt, Human
accccacaccacgacaagcac

SEQ ID NO: 795499 - RNA, 26 nt, Human
acgagaagauguucgguauccuucuc

SEQ ID NO: 795500 - RNA, 23 nt, Human
acugcacucagccuggguaagag

SEQ ID NO: 795501 - RNA, 28 nt, Human
agaaacagaaagcagaugaccgguaccc

SEQ ID NO: 795502 - RNA, 20 nt, Human
agaaagcagaugacugaacg

SEQ ID NO: 795503 - RNA, 24 nt, Human
agaccgaagcaggaggaucgcuug

SEQ ID NO: 795504 - RNA, 18 nt, Human
agauuccgcagggcagcc

SEQ ID NO: 795505 - RNA, 24 nt, Human
agcacuaugggaggccgagguggg

SEQ ID NO: 795506 - RNA, 25 nt, Human
agcccaucucuaaaaggaaaaacaa

SEQ ID NO: 795507 - RNA, 24 nt, Human
agccuggguaagagcaaaagccca

SEQ ID NO: 795508 - RNA, 23 nt, Human
agcugggcgugguggugcgcgcc

SEQ ID NO: 795509 - RNA, 19 nt, Human
aggaaaaacaaaaaaaaca

SEQ ID NO: 795510 - RNA, 24 nt, Human
aggagugguggcucaugccuguaa

SEQ ID NO: 795511 - RNA, 24 nt, Human
aggaguuugaggcugcacugagcu

SEQ ID NO: 795512 - RNA, 24 nt, Human
aggaucgcuugaggcuaggaguuc

SEQ ID NO: 795513 - RNA, 21 nt, Human
aggccgagguggguggaucac

SEQ ID NO: 795514 - RNA, 22 nt, Human
aggccggggcggaggcugggaa

SEQ ID NO: 795515 - RNA, 24 nt, Human
agguggguggaucacgaggucaag

SEQ ID NO: 795516 - RNA, 21 nt, Human
aggugguaguugcagugagcc

SEQ ID NO: 795517 - RNA, 24 nt, Human
aggugguaguugcagugagccgag

SEQ ID NO: 795518 - RNA, 18 nt, Human
agguguuguggugugugc

SEQ ID NO: 795519 - RNA, 21 nt, Human
auagacuccucuccaaaggag

SEQ ID NO: 795520 - RNA, 24 nt, Human
aucacgccauugcacuccagccug

SEQ ID NO: 795521 - RNA, 24 nt, Human
aucagcugagugcgguggcucaca

SEQ ID NO: 795522 - RNA, 23 nt, Human
aucucuacaaaaaauuuaaaaaa

SEQ ID NO: 795523 - RNA, 19 nt, Human
augccuguaaucccaacac

SEQ ID NO: 795524 - RNA, 30 nt, Human
augugacagcaaaagcauaagcaacaaaag

SEQ ID NO: 795525 - RNA, 23 nt, Human
auucugccacugcacucagccug

SEQ ID NO: 795526 - RNA, 20 nt, Human
auugcacuccagccuggcga

SEQ ID NO: 795527 - RNA, 23 nt, Human
auugcacuccagccuggcgacag

SEQ ID NO: 795528 - RNA, 18 nt, Human
caaaacagccuugaagca

SEQ ID NO: 795529 - RNA, 20 nt, Human
caaaagaaaaaaacagauaa

SEQ ID NO: 795530 - RNA, 26 nt, Human
caaaagaaaaaaacagauaaauugcu

SEQ ID NO: 795531 - RNA, 23 nt, Human
caaacacaguaauagacaaagca

SEQ ID NO: 795532 - RNA, 21 nt, Human
caaagcagcacugaucaaggc

SEQ ID NO: 795533 - RNA, 20 nt, Human
caacaaaagaaaaaaacaga

SEQ ID NO: 795534 - RNA, 19 nt, Human
caacaaagcagcacugauc

SEQ ID NO: 795535 - RNA, 24 nt, Human
caacacagugaaaucccgucucua

SEQ ID NO: 795536 - RNA, 19 nt, Human
caacugauuaucaauaaug

SEQ ID NO: 795537 - RNA, 21 nt, Human
caagaaauucugagaccaaug

SEQ ID NO: 795538 - RNA, 23 nt, Human
caagaggagccaagaaauucuga

SEQ ID NO: 795539 - RNA, 24 nt, Human
cacaacaaagcagcacugaucaag

SEQ ID NO: 795540 - RNA, 24 nt, Human
cacaccuguaaucccagcacuaug

SEQ ID NO: 795541 - RNA, 24 nt, Human
caccacgacaagcacuggucucac

SEQ ID NO: 795542 - RNA, 18 nt, Human
caccgcggcgugccuggu

SEQ ID NO: 795543 - RNA, 23 nt, Human
caccuguaaucccagcacuaugg

SEQ ID NO: 795544 - RNA, 24 nt, Human
caccuguaaucccagcacuauggg

SEQ ID NO: 795545 - RNA, 22 nt, Human
cacuaugggaggccgagguggg

SEQ ID NO: 795546 - RNA, 22 nt, Human
cacuccagccuggcgacagagc

SEQ ID NO: 795547 - RNA, 20 nt, Human
cacugcacucagccugggua

SEQ ID NO: 795548 - RNA, 22 nt, Human
cacugcacucagccuggguaag

SEQ ID NO: 795549 - RNA, 33 nt, Human
cagcaaaagcauaagcaacaaaagaaaaaaaag

SEQ ID NO: 795550 - RNA, 26 nt, Human
cagcaaggcugcagaggccaagagga

SEQ ID NO: 795551 - RNA, 24 nt, Human
cagcacuaugggaggccgaggugg

SEQ ID NO: 795552 - RNA, 20 nt, Human
cagcagagcggccguaccuu

SEQ ID NO: 795553 - RNA, 23 nt, Human
caggaggaucgcuugaggcuagg

SEQ ID NO: 795554 - RNA, 18 nt, Human
cagggacaagaggacaca

SEQ ID NO: 795555 - RNA, 24 nt, Human
cagggccgagcaccgcggcgugcc

SEQ ID NO: 795556 - RNA, 18 nt, Human
cauugcacuccagccugg

SEQ ID NO: 795557 - RNA, 20 nt, Human
cauugcacuccagccuggcg

SEQ ID NO: 795558 - RNA, 22 nt, Human
cauugcacuccagccuggcgac

SEQ ID NO: 795559 - RNA, 23 nt, Human
cauugcacuccagccuggcgaca

SEQ ID NO: 795560 - RNA, 23 nt, Human
cauugcacuccagccuggcgaca

SEQ ID NO: 795561 - RNA, 18 nt, Human
ccaaaggagauacacaaa

SEQ ID NO: 795562 - RNA, 19 nt, Human
ccacugcacucagccuggg

SEQ ID NO: 795563 - RNA, 20 nt, Human
ccacugcacucagccugggu

SEQ ID NO: 795564 - RNA, 23 nt, Human
ccacugcacucagccuggguaag

SEQ ID NO: 795565 - RNA, 21 nt, Human
ccagacccacgcccacucugc

SEQ ID NO: 795566 - RNA, 21 nt, Human
ccaucaccagacgaugccgaa

SEQ ID NO: 795567 - RNA, 19 nt, Human
ccaucucuaaaaggaaaaa

SEQ ID NO: 795568 - RNA, 19 nt, Human
ccauugcacuccagccugg

SEQ ID NO: 795569 - RNA, 20 nt, Human
ccauugcacuccagccuggc

SEQ ID NO: 795570 - RNA, 23 nt, Human
ccauugcacuccagccuggcgac

SEQ ID NO: 795571 - RNA, 19 nt, Human
cccacaccacgacaagcac

SEQ ID NO: 795572 - RNA, 19 nt, Human
ccccacaccacgacaagca

SEQ ID NO: 795573 - RNA, 21 nt, Human
cccggaaggaagcgccaggcg

SEQ ID NO: 795574 - RNA, 22 nt, Human
cccgucucuacuaaaaauacaa

SEQ ID NO: 795575 - RNA, 18 nt, Human
ccgaacccuguagcagca

SEQ ID NO: 795576 - RNA, 18 nt, Human
ccgccgccggcgcucucg

SEQ ID NO: 795577 - RNA, 22 nt, Human
ccuccagcaaggcugcagaggc

SEQ ID NO: 795578 - RNA, 23 nt, Human
ccucuggaacagggucgcugccu

SEQ ID NO: 795579 - RNA, 21 nt, Human
ccuggcgacagagcaagauuc

SEQ ID NO: 795580 - RNA, 20 nt, Human
ccuguaaucccaacacuuug

SEQ ID NO: 795581 - RNA, 21 nt, Human
ccuguagucccagcuaccugg

SEQ ID NO: 795582 - RNA, 22 nt, Human
ccuguagucccagcuaccuggg

SEQ ID NO: 795583 - RNA, 19 nt, Human
ccuguagucccagcuacuc

SEQ ID NO: 795584 - RNA, 21 nt, Human
ccuguagucccagcuacucag

SEQ ID NO: 795585 - RNA, 22 nt, Human
ccuguagucccagcuacucagg

SEQ ID NO: 795586 - RNA, 21 nt, Human
cgacggugcucggggggcugc

SEQ ID NO: 795587 - RNA, 23 nt, Human
cgaggcuuggaccgcggggucgc

SEQ ID NO: 795588 - RNA, 24 nt, Human
cgaugccgaacccuguagcagcag

SEQ ID NO: 795589 - RNA, 22 nt, Human
cgcaccgccagggaaaggccga

SEQ ID NO: 795590 - RNA, 24 nt, Human
cgcauggacagguuuucaccuccu

SEQ ID NO: 795591 - RNA, 25 nt, Human
cgccauugcacuccagccuggcgac

SEQ ID NO: 795592 - RNA, 23 nt, Human
cgggcacacgggacacgcccugg

SEQ ID NO: 795593 - RNA, 24 nt, Human
cuagccuuuguguuuguguuaaaa

SEQ ID NO: 795594 - RNA, 21 nt, Human
cucaagauaaaucauucaauu

SEQ ID NO: 795595 - RNA, 22 nt, Human
cucacaccuguaaucccagcac

SEQ ID NO: 795596 - RNA, 23 nt, Human
cucacaccuguaaucccagcacu

SEQ ID NO: 795597 - RNA, 24 nt, Human
cucaugccuguaaucccaacacuu

SEQ ID NO: 795598 - RNA, 22 nt, Human
cucggcccagggcccgcccucc

SEQ ID NO: 795599 - RNA, 18 nt, Human
cucuuacaccacacacaa

SEQ ID NO: 795600 - RNA, 23 nt, Human
cucuuacaccacacacaaaacuu

SEQ ID NO: 795601 - RNA, 19 nt, Human
cugcacacacauuccgucc

SEQ ID NO: 795602 - RNA, 33 nt, Human
cugcacacacauuccguccgugcugaaccccuc

SEQ ID NO: 795603 - RNA, 18 nt, Human
cuucagaggacacuaucc

SEQ ID NO: 795604 - RNA, 18 nt, Human
cuuggauuaggugauggc

SEQ ID NO: 795605 - RNA, 21 nt, Human
gaaaaacaaaaaaaacaacuu

SEQ ID NO: 795606 - RNA, 22 nt, Human
gaaagaaggggcccggcagggc

SEQ ID NO: 795607 - RNA, 22 nt, Human
gaaagugcugauggccagugca

SEQ ID NO: 795608 - RNA, 20 nt, Human
gaagcagaacaaaguaaaac

SEQ ID NO: 795609 - RNA, 24 nt, Human
gaagcaggaggaucgcuugaggcu

SEQ ID NO: 795610 - RNA, 19 nt, Human
gaaggacccggaaggaagc

SEQ ID NO: 795611 - RNA, 22 nt, Human
gaauagacuccucuccaaagga

SEQ ID NO: 795612 - RNA, 18 nt, Human
gacaagaggacacaugua

SEQ ID NO: 795613 - RNA, 23 nt, Human
gagaucacgccauugcacuccag

SEQ ID NO: 795614 - RNA, 18 nt, Human
gagcccaggaguuugagg

SEQ ID NO: 795615 - RNA, 22 nt, Human
gaggaucgcuugaggcuaggag

SEQ ID NO: 795616 - RNA, 18 nt, Human
gaggaucuaguauccaca

SEQ ID NO: 795617 - RNA, 22 nt, Human
gaggccagacccaucaccagac

SEQ ID NO: 795618 - RNA, 23 nt, Human
gagguggguggaucacgagguca

SEQ ID NO: 795619 - RNA, 24 nt, Human
gagugcgguggcucacaccuguaa

SEQ ID NO: 795620 - RNA, 24 nt, Human
gaucgcuugaggcuaggaguucga

SEQ ID NO: 795621 - RNA, 23 nt, Human
gcacuccagccuggcgacagagc

SEQ ID NO: 795622 - RNA, 18 nt, Human
gcacugagcuaugauucu

SEQ ID NO: 795623 - RNA, 23 nt, Human
gccacugcacucagccuggguaa

SEQ ID NO: 795624 - RNA, 22 nt, Human
gcccagggcccgcccuccggcc

SEQ ID NO: 795625 - RNA, 23 nt, Human
gccuguagucccagcuacucagg

SEQ ID NO: 795626 - RNA, 20 nt, Human
gcgacagagcaagauuccau

SEQ ID NO: 795627 - RNA, 20 nt, Human
gcgaggcuuggaccgcgggg

SEQ ID NO: 795628 - RNA, 20 nt, Human
gcggccugucacucggccca

SEQ ID NO: 795629 - RNA, 19 nt, Human
gcugcacugagcuaugauu

SEQ ID NO: 795630 - RNA, 19 nt, Human
gcugcggccugucacucgg

SEQ ID NO: 795631 - RNA, 22 nt, Human
gcuugagcccaggaguuugagg

SEQ ID NO: 795632 - RNA, 21 nt, Human
ggaaagaaggggcccggcagg

SEQ ID NO: 795633 - RNA, 21 nt, Human
ggaaaggccgaaggacccgga

SEQ ID NO: 795634 - RNA, 21 nt, Human
ggacucgcagaagcccucugg

SEQ ID NO: 795635 - RNA, 19 nt, Human
ggaguucgagaucaccgug

SEQ ID NO: 795636 - RNA, 23 nt, Human
ggaucgcuugaggcuaggaguuc

SEQ ID NO: 795637 - RNA, 21 nt, Human
ggccaggagugguggcucaug

SEQ ID NO: 795638 - RNA, 24 nt, Human
ggccggggcggaggcugggaagcu

SEQ ID NO: 795639 - RNA, 22 nt, Human
ggcgugguggugcgcgccugua

SEQ ID NO: 795640 - RNA, 20 nt, Human
ggggcccggcagggccacgc

SEQ ID NO: 795641 - RNA, 23 nt, Human
ggggggcugcggccugucacucg

SEQ ID NO: 795642 - RNA, 19 nt, Human
ggguggaucacgaggucaa

SEQ ID NO: 795643 - RNA, 23 nt, Human
gguggcucacaccuguaauccca

SEQ ID NO: 795644 - RNA, 24 nt, Human
gguggcucacaccuguaaucccag

SEQ ID NO: 795645 - RNA, 23 nt, Human
gguggcucaugccuguaauccca

SEQ ID NO: 795646 - RNA, 24 nt, Human
gguggugcgcgccuguagucccag

SEQ ID NO: 795647 - RNA, 18 nt, Human
gucaagagaucaagacca

SEQ ID NO: 795648 - RNA, 23 nt, Human
guccgugcugaaccccacaccac

SEQ ID NO: 795649 - RNA, 21 nt, Human
gugcacaagcuuccgcauggg

SEQ ID NO: 795650 - RNA, 22 nt, Human
guggcucaugccuguaauccca

SEQ ID NO: 795651 - RNA, 18 nt, Human
guggugcgcgccuguagu

SEQ ID NO: 795652 - RNA, 18 nt, Human
guggugugugccuguagu

SEQ ID NO: 795653 - RNA, 22 nt, Human
guggugugugccuguaguccca

SEQ ID NO: 795654 - RNA, 19 nt, Human
guugcagugagccgagauc

SEQ ID NO: 795655 - RNA, 26 nt, Human
uaaauaaauaaauaaaguuuuugcaa

SEQ ID NO: 795656 - RNA, 22 nt, Human
uaagcaacaaaagaaaaaaaca

SEQ ID NO: 795657 - RNA, 22 nt, Human
uacacaaauggccaguaagccc

SEQ ID NO: 795658 - RNA, 19 nt, Human
uaccugggaggcugacgug

SEQ ID NO: 795659 - RNA, 23 nt, Human
uagccagguguuguggugugugc

SEQ ID NO: 795660 - RNA, 18 nt, Human
uaggaguucgagaucacc

SEQ ID NO: 795661 - RNA, 24 nt, Human
ucacaacaaagcagcacugaucaa

SEQ ID NO: 795662 - RNA, 21 nt, Human
ucacaugaggaucuaguaucc

SEQ ID NO: 795663 - RNA, 24 nt, Human
ucacgaggucaagagaucaagacc

SEQ ID NO: 795664 - RNA, 23 nt, Human
ucacgccauugcacuccagccug

SEQ ID NO: 795665 - RNA, 21 nt, Human
uccacaugcaaaagaaugugg

SEQ ID NO: 795666 - RNA, 19 nt, Human
uccagaaacagaaagcaga

SEQ ID NO: 795667 - RNA, 20 nt, Human
uccuucuccaaugcugcugu

SEQ ID NO: 795668 - RNA, 23 nt, Human
ucgcuugaggcuaggaguucgag

SEQ ID NO: 795669 - RNA, 21 nt, Human
ucuccaggcccgagggccucu

SEQ ID NO: 795670 - RNA, 24 nt, Human
ucuccaggcccgagggccucuucu

SEQ ID NO: 795671 - RNA, 20 nt, Human
ucucgcacagcggcugcacc

SEQ ID NO: 795672 - RNA, 21 nt, Human
ucucuacuaaaaauacaaaaa

SEQ ID NO: 795673 - RNA, 19 nt, Human
ucuuggauuaggugauggc

SEQ ID NO: 795674 - RNA, 22 nt, Human
ugaaaaggcacauccagaaaca

SEQ ID NO: 795675 - RNA, 19 nt, Human
ugaaacaacaguauggaag

SEQ ID NO: 795676 - RNA, 25 nt, Human
ugaaccccacaccacgacaagcacu

SEQ ID NO: 795677 - RNA, 26 nt, Human
ugacagcaaaagcauaagcaacaaaa

SEQ ID NO: 795678 - RNA, 18 nt, Human
ugacgcaggcgaaucgcu

SEQ ID NO: 795679 - RNA, 24 nt, Human
ugagaccaaugaaaagucgcgucc

SEQ ID NO: 795680 - RNA, 22 nt, Human
ugagcccaggaguuugaggcug

SEQ ID NO: 795681 - RNA, 22 nt, Human
ugagccgagaucacgccauugc

SEQ ID NO: 795682 - RNA, 19 nt, Human
ugauggccagugcacuggg

SEQ ID NO: 795683 - RNA, 18 nt, Human
ugcacaagcuuccgcaug

SEQ ID NO: 795684 - RNA, 23 nt, Human
ugcacuccagccuggcgacagag

SEQ ID NO: 795685 - RNA, 22 nt, Human
ugcauggauaaaccuuaaaaac

SEQ ID NO: 795686 - RNA, 22 nt, Human
ugcccagaaauaagccuguaca

SEQ ID NO: 795687 - RNA, 19 nt, Human
ugccuggugggaugaggcg

SEQ ID NO: 795688 - RNA, 23 nt, Human
ugccuguaaucccaacacuuugg

SEQ ID NO: 795689 - RNA, 23 nt, Human
ugccuguaaucccaacacuuugg

SEQ ID NO: 795690 - RNA, 24 nt, Human
ugccuguaaucccaacacuuuggg

SEQ ID NO: 795691 - RNA, 23 nt, Human
ugccuguagucccagcuaccugg

SEQ ID NO: 795692 - RNA, 24 nt, Human
ugccuguagucccagcuaccuggg

SEQ ID NO: 795693 - RNA, 18 nt, Human
ugcuguacuucaucaaaa

SEQ ID NO: 795694 - RNA, 23 nt, Human
ugcuucagaggacacuauccaga

SEQ ID NO: 795695 - RNA, 24 nt, Human
uggaaggauggcuugagcccagga

SEQ ID NO: 795696 - RNA, 18 nt, Human
uggcagagggagaaagug

SEQ ID NO: 795697 - RNA, 23 nt, Human
uggccaggagugguggcucaugc

SEQ ID NO: 795698 - RNA, 24 nt, Human
uggccaggagugguggcucaugcc

SEQ ID NO: 795699 - RNA, 23 nt, Human
uggccaguaagcccacgagaaga

SEQ ID NO: 795700 - RNA, 21 nt, Human
uggcucacaccuguaauccca

SEQ ID NO: 795701 - RNA, 24 nt, Human
uggcucacaccuguaaucccagca

SEQ ID NO: 795702 - RNA, 21 nt, Human
uggcucaugccuguaauccca

SEQ ID NO: 795703 - RNA, 24 nt, Human
uggcucaugccuguaaucccaaca

SEQ ID NO: 795704 - RNA, 23 nt, Human
ugggaggccgagguggguggauc

SEQ ID NO: 795705 - RNA, 24 nt, Human
ugggaggccgagguggguggauca

SEQ ID NO: 795706 - RNA, 19 nt, Human
ugggaggcugacguggaag

SEQ ID NO: 795707 - RNA, 25 nt, Human
uggguaagagcaaaagcccaucucu

SEQ ID NO: 795708 - RNA, 18 nt, Human
uggugcgcgccuguaguc

SEQ ID NO: 795709 - RNA, 21 nt, Human
uggugcgcgccuguaguccca

SEQ ID NO: 795710 - RNA, 24 nt, Human
ugguggcucaugccuguaauccca

SEQ ID NO: 795711 - RNA, 24 nt, Human
uggugggaugaggcgagggccugc

SEQ ID NO: 795712 - RNA, 24 nt, Human
ugguggugcgcgccuguaguccca

SEQ ID NO: 795713 - RNA, 18 nt, Human
uggugugugccuguaguc

SEQ ID NO: 795714 - RNA, 21 nt, Human
uggugugugccuguaguccca

SEQ ID NO: 795715 - RNA, 24 nt, Human
uggugugugccuguagucccagcu

SEQ ID NO: 795716 - RNA, 19 nt, Human
uguccugagacacuggcag

SEQ ID NO: 795717 - RNA, 22 nt, Human
uguguuaaaaacagcauuugca

SEQ ID NO: 795718 - RNA, 21 nt, Human
uuaaaaacagcauuugcacaa

SEQ ID NO: 795719 - RNA, 20 nt, Human
uuagcugggcgugguggugc

SEQ ID NO: 795720 - RNA, 22 nt, Human
uuagcugggcgugguggugcgc

SEQ ID NO: 795721 - RNA, 24 nt, Human
uuagcugggcgugguggugcgcgc

SEQ ID NO: 795722 - RNA, 18 nt, Human
uucuccaaugcugcugug

SEQ ID NO: 795723 - RNA, 18 nt, Human
uugaagcagaacaaagua

SEQ ID NO: 795724 - RNA, 18 nt, Human
uugcagugagccgagauc

SEQ ID NO: 795725 - RNA, 20 nt, Human
uugcagugagccgagaucac

SEQ ID NO: 795726 - RNA, 21 nt, Human
uugcagugagccgagaucacg

SEQ ID NO: 795727 - RNA, 26 nt, Human
uugugcuucagaggacacuauccaga

SEQ ID NO: 795728 - RNA, 24 nt, Human
aggaggcgccccccacaaccucag

SEQ ID NO: 795729 - RNA, 23 nt, Human
agggcagggcagggcagggcugg

SEQ ID NO: 795730 - RNA, 20 nt, Human
agggcugggcugcgcggggc

SEQ ID NO: 795731 - RNA, 26 nt, Human
agggcugggcugcgcggggcugggcc

SEQ ID NO: 795732 - RNA, 22 nt, Human
augcggcgcggugggcgcgccc

SEQ ID NO: 795733 - RNA, 18 nt, Human
auggugccugguucuggc

SEQ ID NO: 795734 - RNA, 22 nt, Human
caggaggcgccccccacaaccu

SEQ ID NO: 795735 - RNA, 26 nt, Human
caggaggcgccccccacaaccucagc

SEQ ID NO: 795736 - RNA, 24 nt, Human
ccagcaguggccgccgaggcucuu

SEQ ID NO: 795737 - RNA, 21 nt, Human
cccaggaggcgccccccacaa

SEQ ID NO: 795738 - RNA, 19 nt, Human
ccccccacaaccucagccg

SEQ ID NO: 795739 - RNA, 20 nt, Human
ccggagcgauggggagcugc

SEQ ID NO: 795740 - RNA, 26 nt, Human
ccuuccgcggccgccgcccccacccg

SEQ ID NO: 795741 - RNA, 24 nt, Human
cucacaccgugccagcaguggccg

SEQ ID NO: 795742 - RNA, 20 nt, Human
cugggugcugggggucccag

SEQ ID NO: 795743 - RNA, 18 nt, Human
gcagggcugggcugcgcg

SEQ ID NO: 795744 - RNA, 19 nt, Human
ggagcugcuuggcgugcuc

SEQ ID NO: 795745 - RNA, 24 nt, Human
ggcagggcagggcagggcugggcc

SEQ ID NO: 795746 - RNA, 18 nt, Human
ggcucugggugcuggggg

SEQ ID NO: 795747 - RNA, 18 nt, Human
ggcugggcugcgcggggc

SEQ ID NO: 795748 - RNA, 23 nt, Human
ggcugggcugcgcggggcugggc

SEQ ID NO: 795749 - RNA, 21 nt, Human
gggagcugcuuggcgugcucc

SEQ ID NO: 795750 - RNA, 18 nt, Human
gggcaaaauaaguuagug

SEQ ID NO: 795751 - RNA, 19 nt, Human
gggcagggcagggcagggc

SEQ ID NO: 795752 - RNA, 19 nt, Human
gggcagggcagggcagggc

SEQ ID NO: 795753 - RNA, 20 nt, Human
gggcagggcagggcagggca

SEQ ID NO: 795754 - RNA, 23 nt, Human
gggcagggcagggcagggcaggg

SEQ ID NO: 795755 - RNA, 19 nt, Human
gggcagggcagggcugggc

SEQ ID NO: 795756 - RNA, 18 nt, Human
gggcugcgcggggcuggg

SEQ ID NO: 795757 - RNA, 19 nt, Human
ggggaacagcugcguggcc

SEQ ID NO: 795758 - RNA, 20 nt, Human
ggggccggcuugggggcagg

SEQ ID NO: 795759 - RNA, 20 nt, Human
ggggcugggcugcgcugggc

SEQ ID NO: 795760 - RNA, 18 nt, Human
gggggcaggagcugcagc

SEQ ID NO: 795761 - RNA, 23 nt, Human
gugggggccggcuugggggcagg

SEQ ID NO: 795762 - RNA, 19 nt, Human
uaaacccagagcugaggga

SEQ ID NO: 795763 - RNA, 22 nt, Human
ucucugaggagcuaucugaucc

SEQ ID NO: 795764 - RNA, 25 nt, Human
ugccagcaguggccgccgaggcucu

SEQ ID NO: 795765 - RNA, 18 nt, Human
ugccugguucuggcucag

SEQ ID NO: 795766 - RNA, 19 nt, Human
ugcugggggucccaggcac

SEQ ID NO: 795767 - RNA, 24 nt, Human
uggcucaggugggggccggcuugg

SEQ ID NO: 795768 - RNA, 21 nt, Human
ugggugcugggggucccaggc

SEQ ID NO: 795769 - RNA, 20 nt, Human
ugguucuggcucaggugggg

SEQ ID NO: 795770 - RNA, 20 nt, Human
uuaguggggggccugccaga

SEQ ID NO: 795771 - RNA, 24 nt, Human
uuccggagcgauggggagcugcuu

SEQ ID NO: 795772 - RNA, 21 nt, Human
aaaacuucucccacacaccaa

SEQ ID NO: 795773 - RNA, 19 nt, Human
aaacaaaacaaaacucuaa

SEQ ID NO: 795774 - RNA, 19 nt, Human
aaaggaggggagggaugga

SEQ ID NO: 795775 - RNA, 21 nt, Human
aaaugaauaaauaaacaagcg

SEQ ID NO: 795776 - RNA, 23 nt, Human
aaaugaauaaauacaauuaaaua

SEQ ID NO: 795777 - RNA, 28 nt, Human
aacaagcgaagaaaaaaauaucacacaa

SEQ ID NO: 795778 - RNA, 19 nt, Human
aacagcaaacucagaagga

SEQ ID NO: 795779 - RNA, 23 nt, Human
aagaaaaaaauaucacacaagga

SEQ ID NO: 795780 - RNA, 19 nt, Human
aagaacuaaggcuggaugu

SEQ ID NO: 795781 - RNA, 23 nt, Human
aagcaauuauaaaacuucuccca

SEQ ID NO: 795782 - RNA, 19 nt, Human
aagcgaagaaaaaaauauc

SEQ ID NO: 795783 - RNA, 25 nt, Human
aagcgaagaaaaaaauaucacacaa

SEQ ID NO: 795784 - RNA, 21 nt, Human
aaggagacuuaggguccuggu

SEQ ID NO: 795785 - RNA, 24 nt, Human
acaaaacaaaacucuaaagguaaa

SEQ ID NO: 795786 - RNA, 21 nt, Human
acacaccaagaaccccagaac

SEQ ID NO: 795787 - RNA, 23 nt, Human
acagaggcuggcauggagaggcc

SEQ ID NO: 795788 - RNA, 23 nt, Human
acaggaacaggaagauaaccaga

SEQ ID NO: 795789 - RNA, 18 nt, Human
acucagaaggaaaaaaca

SEQ ID NO: 795790 - RNA, 21 nt, Human
acuccuccugucuccuuaccu

SEQ ID NO: 795791 - RNA, 20 nt, Human
acuucuacuuggcaguggag

SEQ ID NO: 795792 - RNA, 21 nt, Human
agaaggaaaggagacuuaggg

SEQ ID NO: 795793 - RNA, 20 nt, Human
aggagaggggacaggcagag

SEQ ID NO: 795794 - RNA, 21 nt, Human
aggauucuugagcugaggaca

SEQ ID NO: 795795 - RNA, 18 nt, Human
agggggucacgacugggg

SEQ ID NO: 795796 - RNA, 21 nt, Human
aggguccuggucccacagucu

SEQ ID NO: 795797 - RNA, 18 nt, Human
aguaaaugaauaaauaca

SEQ ID NO: 795798 - RNA, 23 nt, Human
augggggcacaggugacuggcag

SEQ ID NO: 795799 - RNA, 24 nt, Human
caagcuacaggauucuugagcuga

SEQ ID NO: 795800 - RNA, 22 nt, Human
cacacaccaagaaccccagaac

SEQ ID NO: 795801 - RNA, 18 nt, Human
caccccaagaacuaaggc

SEQ ID NO: 795802 - RNA, 24 nt, Human
cagaacuccccacccagaaggaaa

SEQ ID NO: 795803 - RNA, 18 nt, Human
cagaaggaaaggagacuu

SEQ ID NO: 795804 - RNA, 23 nt, Human
cagaaggaaaggagacuuagggu

SEQ ID NO: 795805 - RNA, 18 nt, Human
cagaggguacagggaaga

SEQ ID NO: 795806 - RNA, 18 nt, Human
cagcaaugggggcacagg

SEQ ID NO: 795807 - RNA, 22 nt, Human
caggacccaagacaucugcuga

SEQ ID NO: 795808 - RNA, 20 nt, Human
cagggaacuuagaaguaugu

SEQ ID NO: 795809 - RNA, 18 nt, Human
caggucccaguaaaaccg

SEQ ID NO: 795810 - RNA, 22 nt, Human
caggucccaguaaaaccggaag

SEQ ID NO: 795811 - RNA, 20 nt, Human
ccaacagcaaacucagaagg

SEQ ID NO: 795812 - RNA, 21 nt, Human
ccaagacaucugcugacagca

SEQ ID NO: 795813 - RNA, 19 nt, Human
ccagaccgggcagaaccug

SEQ ID NO: 795814 - RNA, 27 nt, Human
cccacacaccaagaaccccagaacucc

SEQ ID NO: 795815 - RNA, 23 nt, Human
ccccagaacuccccacccagaag

SEQ ID NO: 795816 - RNA, 19 nt, Human
ccccauggccuuccccaag

SEQ ID NO: 795817 - RNA, 24 nt, Human
ccccgcugacuucacccgcuccug

SEQ ID NO: 795818 - RNA, 21 nt, Human
cccugccuccuccuacuccuc

SEQ ID NO: 795819 - RNA, 24 nt, Human
cccugccuccuccuacuccuccug

SEQ ID NO: 795820 - RNA, 18 nt, Human
ccuccuacuccuccuguc

SEQ ID NO: 795821 - RNA, 21 nt, Human
ccuccugccccuaccugggag

SEQ ID NO: 795822 - RNA, 18 nt, Human
ccugaaaaggaggggagg

SEQ ID NO: 795823 - RNA, 22 nt, Human
ccugaaaaggaggggagggaug

SEQ ID NO: 795824 - RNA, 18 nt, Human
ccugcaccaacagcaaac

SEQ ID NO: 795825 - RNA, 25 nt, Human
ccugcaccaacagcaaacucagaag

SEQ ID NO: 795826 - RNA, 18 nt, Human
ccugccuccuccuacucc

SEQ ID NO: 795827 - RNA, 21 nt, Human
cggaagucgcuguaggggugg

SEQ ID NO: 795828 - RNA, 20 nt, Human
cggaauguccgcacaggguc

SEQ ID NO: 795829 - RNA, 20 nt, Human
cuaugcuacaggaacaggaa

SEQ ID NO: 795830 - RNA, 22 nt, Human
cucagaaggaaaaaacaaaaca

SEQ ID NO: 795831 - RNA, 18 nt, Human
cugaaaaggaggggaggg

SEQ ID NO: 795832 - RNA, 19 nt, Human
cugaaaaggaggggaggga

SEQ ID NO: 795833 - RNA, 23 nt, Human
cugaaaaggaggggagggaugga

SEQ ID NO: 795834 - RNA, 21 nt, Human
cuuccccaggcuuggauaccu

SEQ ID NO: 795835 - RNA, 20 nt, Human
gacuacucuugucccugaga

SEQ ID NO: 795836 - RNA, 19 nt, Human
gaggguacagggaagagga

SEQ ID NO: 795837 - RNA, 19 nt, Human
gauaccuugggccuuuccc

SEQ ID NO: 795838 - RNA, 23 nt, Human
gccccuaccugggagaagguuca

SEQ ID NO: 795839 - RNA, 20 nt, Human
gcuacaggaacaggaagaua

SEQ ID NO: 795840 - RNA, 24 nt, Human
gcuggcauggagaggcccugccuc

SEQ ID NO: 795841 - RNA, 21 nt, Human
gcuggccugcccuuccccagg

SEQ ID NO: 795842 - RNA, 26 nt, Human
ggaaaaaacaaaacaaaacucuaaag

SEQ ID NO: 795843 - RNA, 22 nt, Human
ggaaacagagacaucuaguuac

SEQ ID NO: 795844 - RNA, 19 nt, Human
ggacaagcuacaggauucu

SEQ ID NO: 795845 - RNA, 18 nt, Human
ggaccacagaggcuggca

SEQ ID NO: 795846 - RNA, 23 nt, Human
ggacccaagacaucugcugacag

SEQ ID NO: 795847 - RNA, 19 nt, Human
ggaggugccaacuaccccu

SEQ ID NO: 795848 - RNA, 19 nt, Human
ggggagggauggauaaagg

SEQ ID NO: 795849 - RNA, 21 nt, Human
ggguccuggucccacagucuu

SEQ ID NO: 795850 - RNA, 20 nt, Human
gguacauacuacugcacccc

SEQ ID NO: 795851 - RNA, 24 nt, Human
gguuuugagucacuucuacuuggc

SEQ ID NO: 795852 - RNA, 19 nt, Human
guuacuuggcagugauggc

SEQ ID NO: 795853 - RNA, 24 nt, Human
uaaccagaccgggcagaaccugca

SEQ ID NO: 795854 - RNA, 22 nt, Human
uacaggaacaggaagauaacca

SEQ ID NO: 795855 - RNA, 23 nt, Human
uacaggauucuugagcugaggac

SEQ ID NO: 795856 - RNA, 23 nt, Human
uacauacuacugcaccccaagaa

SEQ ID NO: 795857 - RNA, 19 nt, Human
uaguaaagguggggucaug

SEQ ID NO: 795858 - RNA, 21 nt, Human
ucagaaggaaaaaacaaaaca

SEQ ID NO: 795859 - RNA, 23 nt, Human
ucagaaggaaaaaacaaaacaaa

SEQ ID NO: 795860 - RNA, 22 nt, Human
uccacagguggcagugagcggg

SEQ ID NO: 795861 - RNA, 18 nt, Human
ucccacacaccaagaacc

SEQ ID NO: 795862 - RNA, 19 nt, Human
ucccacacaccaagaaccc

SEQ ID NO: 795863 - RNA, 22 nt, Human
ucccacacaccaagaaccccag

SEQ ID NO: 795864 - RNA, 22 nt, Human
uccccaggcuuggauaccuugg

SEQ ID NO: 795865 - RNA, 20 nt, Human
ucccugagaaggcagagguu

SEQ ID NO: 795866 - RNA, 23 nt, Human
uccuccugucuccuuaccugaaa

SEQ ID NO: 795867 - RNA, 21 nt, Human
ucucccacacaccaagaaccc

SEQ ID NO: 795868 - RNA, 22 nt, Human
ugacagcaaugggggcacaggu

SEQ ID NO: 795869 - RNA, 19 nt, Human
uggauuaugaugggacaag

SEQ ID NO: 795870 - RNA, 23 nt, Human
uggcaggaccauagccaagggaa

SEQ ID NO: 795871 - RNA, 24 nt, Human
uggcagugagcggguaaaagugga

SEQ ID NO: 795872 - RNA, 22 nt, Human
uggcauggagaggcccugccuc

SEQ ID NO: 795873 - RNA, 24 nt, Human
uggcauggagaggcccugccuccu

SEQ ID NO: 795874 - RNA, 20 nt, Human
uggcuaugcuacaggaacag

SEQ ID NO: 795875 - RNA, 22 nt, Human
uggcuggccugcccuuccccag

SEQ ID NO: 795876 - RNA, 19 nt, Human
ugggcaaggaccacagagg

SEQ ID NO: 795877 - RNA, 22 nt, Human
uggggcaauguuucaggucccc

SEQ ID NO: 795878 - RNA, 18 nt, Human
ugugcuuaguaaaggugg

SEQ ID NO: 795879 - RNA, 21 nt, Human
ugugcuuaguaaagguggggu

SEQ ID NO: 795880 - RNA, 19 nt, Human
uuaguaaagguggggucau

SEQ ID NO: 795881 - RNA, 20 nt, Human
uuaguaaagguggggucaug

SEQ ID NO: 795882 - RNA, 23 nt, Human
uuaugaugggacaagcuacagga

SEQ ID NO: 795883 - RNA, 19 nt, Human
uucagguccccauggccuu

SEQ ID NO: 795884 - RNA, 22 nt, Human
uuccccaagaggcaucugcccu

SEQ ID NO: 795885 - RNA, 25 nt, Human
uucucccacacaccaagaaccccag

SEQ ID NO: 795886 - RNA, 23 nt, Human
uuuaaacccagcuguuuggaagc

SEQ ID NO: 795887 - RNA, 21 nt, Human
aagcaaccagggcuaggagug

SEQ ID NO: 795888 - RNA, 20 nt, Human
aagcaguucuuagggaacag

SEQ ID NO: 795889 - RNA, 19 nt, Human
aaggccuccuccaucccgg

SEQ ID NO: 795890 - RNA, 23 nt, Human
accaaaagggaccugagaggcca

SEQ ID NO: 795891 - RNA, 27 nt, Human
accaaugaaacugagaaccaaaaggga

SEQ ID NO: 795892 - RNA, 23 nt, Human
agaaaaugggcaugaaaccuaag

SEQ ID NO: 795893 - RNA, 18 nt, Human
agccacugcuuccgaaca

SEQ ID NO: 795894 - RNA, 22 nt, Human
aggaaccaaugaaacugagaac

SEQ ID NO: 795895 - RNA, 23 nt, Human
aggaccccucccugggacaaaag

SEQ ID NO: 795896 - RNA, 22 nt, Human
agggaccugagaggccaugaug

SEQ ID NO: 795897 - RNA, 19 nt, Human
agguaggagaggaugaagu

SEQ ID NO: 795898 - RNA, 21 nt, Human
augggggaacagaaagaggaa

SEQ ID NO: 795899 - RNA, 20 nt, Human
augugugugagugugugugu

SEQ ID NO: 795900 - RNA, 22 nt, Human
caugugugugagugugugugug

SEQ ID NO: 795901 - RNA, 22 nt, Human
ccaucccgguuccuccaaaacc

SEQ ID NO: 795902 - RNA, 23 nt, Human
cccuccaaacugaauaccuaagg

SEQ ID NO: 795903 - RNA, 25 nt, Human
ccucaaaaauacaaaaaaccccucc

SEQ ID NO: 795904 - RNA, 28 nt, Human
ccuccaaaaccacuuucaggggauaaag

SEQ ID NO: 795905 - RNA, 18 nt, Human
cuaaguguaugcaugugu

SEQ ID NO: 795906 - RNA, 18 nt, Human
cuccaaacugaauaccua

SEQ ID NO: 795907 - RNA, 25 nt, Human
cuccuccaucccgguuccuccaaaa

SEQ ID NO: 795908 - RNA, 24 nt, Human
gaaaacucagguaaaccaacggaa

SEQ ID NO: 795909 - RNA, 22 nt, Human
gaacagaaagaggaaccaauga

SEQ ID NO: 795910 - RNA, 22 nt, Human
gaacaggaccccucccugggac

SEQ ID NO: 795911 - RNA, 23 nt, Human
gacaaaagagccagguaggagag

SEQ ID NO: 795912 - RNA, 21 nt, Human
gaccuggagagggaggggggc

SEQ ID NO: 795913 - RNA, 24 nt, Human
gagugugugugugcaugagugugu

SEQ ID NO: 795914 - RNA, 18 nt, Human
gccccaggaauuggcuuu

SEQ ID NO: 795915 - RNA, 20 nt, Human
ggaaauggggauaccuggga

SEQ ID NO: 795916 - RNA, 24 nt, Human
ggaaauggggauaccugggaccac

SEQ ID NO: 795917 - RNA, 19 nt, Human
ggagagggaggggggccuu

SEQ ID NO: 795918 - RNA, 25 nt, Human
ggcacacagaagcaguucuuaggga

SEQ ID NO: 795919 - RNA, 24 nt, Human
gggaacagaaagaggaaccgguac

SEQ ID NO: 795920 - RNA, 19 nt, Human
gggaacagaauaucaugga

SEQ ID NO: 795921 - RNA, 20 nt, Human
gggaccuggagagggagggg

SEQ ID NO: 795922 - RNA, 28 nt, Human
gggggaccuggagagggaggggggccuu

SEQ ID NO: 795923 - RNA, 18 nt, Human
ggggggaccuggagaggg

SEQ ID NO: 795924 - RNA, 21 nt, Human
guaugcaugugugugagugug

SEQ ID NO: 795925 - RNA, 20 nt, Human
uaggguggggcacagaaguc

SEQ ID NO: 795926 - RNA, 18 nt, Human
uaucauggagcccagugu

SEQ ID NO: 795927 - RNA, 25 nt, Human
uaucauggagcccagugugauagaa

SEQ ID NO: 795928 - RNA, 26 nt, Human
ucaaaaauacaaaaaaccccuccaaa

SEQ ID NO: 795929 - RNA, 19 nt, Human
uccaugcugcugccucugu

SEQ ID NO: 795930 - RNA, 19 nt, Human
ugaggagaugcgaggagag

SEQ ID NO: 795931 - RNA, 20 nt, Human
ugagugugagugugugugug

SEQ ID NO: 795932 - RNA, 20 nt, Human
ugagugugugugugcagugg

SEQ ID NO: 795933 - RNA, 19 nt, Human
ugagugugugugugcauga

SEQ ID NO: 795934 - RNA, 24 nt, Human
ugagugugugugugcaugagugug

SEQ ID NO: 795935 - RNA, 21 nt, Human
ugcaugugugugagugugugu

SEQ ID NO: 795936 - RNA, 22 nt, Human
uggagagggaggggggccuugg

SEQ ID NO: 795937 - RNA, 22 nt, Human
uggggggaccuggagagggagg

SEQ ID NO: 795938 - RNA, 21 nt, Human
ugugagugugagugugugugu

SEQ ID NO: 795939 - RNA, 18 nt, Human
ugugagugugugugugca

SEQ ID NO: 795940 - RNA, 21 nt, Human
ugugagugugugugugcagug

SEQ ID NO: 795941 - RNA, 19 nt, Human
ugugugagugugugugugc

SEQ ID NO: 795942 - RNA, 18 nt, Human
ugugugcaugagugugua

SEQ ID NO: 795943 - RNA, 20 nt, Human
ugugugugagugugugugug

SEQ ID NO: 795944 - RNA, 19 nt, Human
ugugugugcaugagugugu

SEQ ID NO: 795945 - RNA, 21 nt, Human
ugugugugugcaugagugugu

SEQ ID NO: 795946 - RNA, 22 nt, Human
ugugugugugcaugagugugua

SEQ ID NO: 795947 - RNA, 22 nt, Human
uucaaacuacaaagggauggau

SEQ ID NO: 795948 - RNA, 20 nt, Human
uucaggggauaaauucagcc

SEQ ID NO: 795949 - RNA, 21 nt, Human
uuggggcaucagacaagggag

SEQ ID NO: 795950 - RNA, 18 nt, Human
uuuguucaaacuacaaag

SEQ ID NO: 795951 - RNA, 18 nt, Human
ccgcagccgcucgcgagc

SEQ ID NO: 795952 - RNA, 20 nt, Human
ccgccgccgccucugccgcc

SEQ ID NO: 795953 - RNA, 23 nt, Human
ccgccgccgccucugccgccgcc

SEQ ID NO: 795954 - RNA, 24 nt, Human
ccgccgccgccucugccgccgccg

SEQ ID NO: 795955 - RNA, 25 nt, Human
ccgccucugccgccgccgugcgcuc

SEQ ID NO: 795956 - RNA, 20 nt, Human
ccucugccgccgccgugcgc

SEQ ID NO: 795957 - RNA, 20 nt, Human
cgccucugccgccgccgugc

SEQ ID NO: 795958 - RNA, 19 nt, Human
cgcgagcgcucgccgccgc

SEQ ID NO: 795959 - RNA, 20 nt, Human
cgcugcacgaccgagagucg

SEQ ID NO: 795960 - RNA, 20 nt, Human
cuccggaaaccucgcguccc

SEQ ID NO: 795961 - RNA, 18 nt, Human
cuccuaggcccggccgcc

SEQ ID NO: 795962 - RNA, 18 nt, Human
cucgccgccgcugcacga

SEQ ID NO: 795963 - RNA, 20 nt, Human
ucgccgccgcugcacgaccg

SEQ ID NO: 795964 - RNA, 21 nt, Human
acagacaggacccaggaauac

SEQ ID NO: 795965 - RNA, 20 nt, Human
agcaggacuggacucaaagu

SEQ ID NO: 795966 - RNA, 23 nt, Human
agccuguggauccucggaguggg

SEQ ID NO: 795967 - RNA, 21 nt, Human
cacccagacacgguuggggac

SEQ ID NO: 795968 - RNA, 27 nt, Human
cagacaaggggacugagcugagcccug

SEQ ID NO: 795969 - RNA, 25 nt, Human
cagacaggacccaggaauaccgacu

SEQ ID NO: 795970 - RNA, 18 nt, Human
caggaauaccgacugacu

SEQ ID NO: 795971 - RNA, 18 nt, Human
cccacagcaggacuggac

SEQ ID NO: 795972 - RNA, 22 nt, Human
cccccacagcaggacuggacuc

SEQ ID NO: 795973 - RNA, 21 nt, Human
ccgcagcacacagggcccggc

SEQ ID NO: 795974 - RNA, 18 nt, Human
ccucccagcucagccccc

SEQ ID NO: 795975 - RNA, 28 nt, Human
ccucccagcucagcccccacagcaggac

SEQ ID NO: 795976 - RNA, 25 nt, Human
ccugagucccugaaccucccagcuc

SEQ ID NO: 795977 - RNA, 26 nt, Human
ccugagucccugaaccucccagcucc

SEQ ID NO: 795978 - RNA, 24 nt, Human
cuccagccccacccagacacgguu

SEQ ID NO: 795979 - RNA, 27 nt, Human
cugacuguccuccaggggauggcggcc

SEQ ID NO: 795980 - RNA, 20 nt, Human
gagacuccagccccacccag

SEQ ID NO: 795981 - RNA, 25 nt, Human
gccgcagcacacagggcccggcccg

SEQ ID NO: 795982 - RNA, 22 nt, Human
gccucagugccccggggggagg

SEQ ID NO: 795983 - RNA, 20 nt, Human
ggaggccucagugccccggg

SEQ ID NO: 795984 - RNA, 27 nt, Human
gggacugagcugagcccugagucccug

SEQ ID NO: 795985 - RNA, 19 nt, Human
gggaggacagacaagggga

SEQ ID NO: 795986 - RNA, 24 nt, Human
ucccagcucagcccccacagcagg

SEQ ID NO: 795987 - RNA, 25 nt, Human
ugagcccugagucccugaaccuccc

SEQ ID NO: 795988 - RNA, 23 nt, Human
ugagucccugaaccucccagcuc

SEQ ID NO: 795989 - RNA, 24 nt, Human
ugccgcuguuguucugaggugggg

SEQ ID NO: 795990 - RNA, 23 nt, Human
uggcggccgcagcacacagggcc

SEQ ID NO: 795991 - RNA, 18 nt, Human
aaaaacaaaccaaaaaag

SEQ ID NO: 795992 - RNA, 19 nt, Human
aaaacaaaagaucacccuc

SEQ ID NO: 795993 - RNA, 25 nt, Human
aaaacccaaacugagaggaggccag

SEQ ID NO: 795994 - RNA, 22 nt, Human
aaacaaaagaucacccucagaa

SEQ ID NO: 795995 - RNA, 21 nt, Human
aaacaggguccaccguggaaa

SEQ ID NO: 795996 - RNA, 22 nt, Human
aaagaucacccucagaaaagcc

SEQ ID NO: 795997 - RNA, 22 nt, Human
aacaaaccaaaaaagaaauuac

SEQ ID NO: 795998 - RNA, 20 nt, Human
aagccgacacccaagucccc

SEQ ID NO: 795999 - RNA, 18 nt, Human
aagggggggccagggcug

SEQ ID NO: 796000 - RNA, 21 nt, Human
aagggggggccagggcuggcc

SEQ ID NO: 796001 - RNA, 18 nt, Human
acaaacaaccagaggggu

SEQ ID NO: 796002 - RNA, 24 nt, Human
agaaaaauacaaauccauuacaaa

SEQ ID NO: 796003 - RNA, 20 nt, Human
agaaacccuggggaucugga

SEQ ID NO: 796004 - RNA, 24 nt, Human
agaagcaaaaguuucuuuuuuggu

SEQ ID NO: 796005 - RNA, 18 nt, Human
agaggcggcgccgcccca

SEQ ID NO: 796006 - RNA, 23 nt, Human
agcccagacaucggggaacacaa

SEQ ID NO: 796007 - RNA, 18 nt, Human
agccggccaguccugaag

SEQ ID NO: 796008 - RNA, 18 nt, Human
agcuggacucgcggcggc

SEQ ID NO: 796009 - RNA, 23 nt, Human
aggcaaaaaaacaaaguuuugua

SEQ ID NO: 796010 - RNA, 21 nt, Human
aggccaggccaagggccuggg

SEQ ID NO: 796011 - RNA, 20 nt, Human
aggcggaagaaaacacacag

SEQ ID NO: 796012 - RNA, 18 nt, Human
aggcgucugcggccccgg

SEQ ID NO: 796013 - RNA, 18 nt, Human
agggcaaaacccaaacug

SEQ ID NO: 796014 - RNA, 22 nt, Human
agggcaugggggggcucaugug

SEQ ID NO: 796015 - RNA, 21 nt, Human
agugaccgguuuuucuccaua

SEQ ID NO: 796016 - RNA, 28 nt, Human
agugauuuugugugugugugugugugug

SEQ ID NO: 796017 - RNA, 21 nt, Human
aguggcucgacggcugacccc

SEQ ID NO: 796018 - RNA, 19 nt, Human
auaagacaaagaaacccug

SEQ ID NO: 796019 - RNA, 23 nt, Human
auaagacaaagaaacccugggga

SEQ ID NO: 796020 - RNA, 18 nt, Human
auaaggcaaaaaaacaaa

SEQ ID NO: 796021 - RNA, 21 nt, Human
aucuggagaaggaucugaggc

SEQ ID NO: 796022 - RNA, 23 nt, Human
caaaagaucacccucagaaaagc

SEQ ID NO: 796023 - RNA, 18 nt, Human
caaacguccacagcaucg

SEQ ID NO: 796024 - RNA, 21 nt, Human
caaacguccacagcaucgccc

SEQ ID NO: 796025 - RNA, 21 nt, Human
caaagcaaguggcucgacggc

SEQ ID NO: 796026 - RNA, 24 nt, Human
caaaucccaaccgaaaacgaagaa

SEQ ID NO: 796027 - RNA, 23 nt, Human
cacaaacguccacagcaucgccc

SEQ ID NO: 796028 - RNA, 23 nt, Human
cacaccgaggugacgcugaugcc

SEQ ID NO: 796029 - RNA, 20 nt, Human
cacagugcgcuggacaaagu

SEQ ID NO: 796030 - RNA, 25 nt, Human
cacccucagaaaagccgacacccaa

SEQ ID NO: 796031 - RNA, 26 nt, Human
cagcagcgccuggguuucccgaaucg

SEQ ID NO: 796032 - RNA, 20 nt, Human
cagcagugauuuugugugug

SEQ ID NO: 796033 - RNA, 18 nt, Human
cagccagcagcgccuggg

SEQ ID NO: 796034 - RNA, 21 nt, Human
cagccuuuagacucuugcacu

SEQ ID NO: 796035 - RNA, 18 nt, Human
ccaacagccgaaucccaa

SEQ ID NO: 796036 - RNA, 21 nt, Human
ccaacagccgaaucccaaacu

SEQ ID NO: 796037 - RNA, 22 nt, Human
ccaaguccccgccuccgcaggc

SEQ ID NO: 796038 - RNA, 21 nt, Human
ccagggccuccagggugcuga

SEQ ID NO: 796039 - RNA, 24 nt, Human
ccaguccugaagcccacaggagcc

SEQ ID NO: 796040 - RNA, 23 nt, Human
cccaaacucggaaaacaaaagau

SEQ ID NO: 796041 - RNA, 21 nt, Human
cccaaccccuccacggaccca

SEQ ID NO: 796042 - RNA, 20 nt, Human
cccaaccgaaaacgaagaag

SEQ ID NO: 796043 - RNA, 19 nt, Human
cccacaggagccgcccagg

SEQ ID NO: 796044 - RNA, 18 nt, Human
cccaggggcucugcuggg

SEQ ID NO: 796045 - RNA, 25 nt, Human
cccaggggcucugcuggggggaccc

SEQ ID NO: 796046 - RNA, 24 nt, Human
cccucagaaaagccgacacccaag

SEQ ID NO: 796047 - RNA, 18 nt, Human
cccuggggaucuggagaa

SEQ ID NO: 796048 - RNA, 19 nt, Human
cccuugcggcuggagccgg

SEQ ID NO: 796049 - RNA, 31 nt, Human
ccgacacccaaguccccgccuccgcaggcuu

SEQ ID NO: 796050 - RNA, 19 nt, Human
ccgaggugacgcugaugcc

SEQ ID NO: 796051 - RNA, 19 nt, Human
ccgcaaggggggcagggca

SEQ ID NO: 796052 - RNA, 20 nt, Human
ccgcaggcugcggguggaga

SEQ ID NO: 796053 - RNA, 24 nt, Human
ccgguuuuucuccauaaauaagac

SEQ ID NO: 796054 - RNA, 20 nt, Human
ccgucgaugaccuccuccuc

SEQ ID NO: 796055 - RNA, 20 nt, Human
ccucccccaaccagcagagc

SEQ ID NO: 796056 - RNA, 24 nt, Human
ccuccugcgagcuggacucgcggc

SEQ ID NO: 796057 - RNA, 19 nt, Human
cgaccacaccgaggugacg

SEQ ID NO: 796058 - RNA, 20 nt, Human
cggggaacacaaaaggccgc

SEQ ID NO: 796059 - RNA, 21 nt, Human
cugaagcccacaggagccgcc

SEQ ID NO: 796060 - RNA, 22 nt, Human
cugaagcccacaggagccgccc

SEQ ID NO: 796061 - RNA, 23 nt, Human
cugaagcccacaggagccgccca

SEQ ID NO: 796062 - RNA, 20 nt, Human
gaccuccuccuccugcgagc

SEQ ID NO: 796063 - RNA, 20 nt, Human
gagaacacugcaccauccac

SEQ ID NO: 796064 - RNA, 18 nt, Human
gccuccagggugcugaag

SEQ ID NO: 796065 - RNA, 31 nt, Human
gcgauggcgaagccgucgaugaccuccuccu

SEQ ID NO: 796066 - RNA, 23 nt, Human
gcuggcggaaccuuccuccccca

SEQ ID NO: 796067 - RNA, 20 nt, Human
ggaaaacaaaagaucacccu

SEQ ID NO: 796068 - RNA, 20 nt, Human
gggcaugggggggcucaugu

SEQ ID NO: 796069 - RNA, 20 nt, Human
ggggaacacaaaaggccgca

SEQ ID NO: 796070 - RNA, 19 nt, Human
ggggcagggcauggggggg

SEQ ID NO: 796071 - RNA, 19 nt, Human
ggggggcagggcauggggg

SEQ ID NO: 796072 - RNA, 21 nt, Human
gugugugugugugugugugug

SEQ ID NO: 796073 - RNA, 21 nt, Human
gugugugugugugugugugug

SEQ ID NO: 796074 - RNA, 21 nt, Human
uaaacugcaaaucccaaccga

SEQ ID NO: 796075 - RNA, 18 nt, Human
uaaauaagacaaagaaac

SEQ ID NO: 796076 - RNA, 25 nt, Human
uaaauaagacaaagaaacccugggg

SEQ ID NO: 796077 - RNA, 22 nt, Human
uaauauaaucuguaacuucggu

SEQ ID NO: 796078 - RNA, 19 nt, Human
ucaggcggaagaaaacaca

SEQ ID NO: 796079 - RNA, 20 nt, Human
uccacagcaucgcccuugcg

SEQ ID NO: 796080 - RNA, 21 nt, Human
uccacagcaucgcccuugcgg

SEQ ID NO: 796081 - RNA, 22 nt, Human
uccauaaauaagacaaagaaac

SEQ ID NO: 796082 - RNA, 23 nt, Human
uccauaaauaagacaaagaaacc

SEQ ID NO: 796083 - RNA, 20 nt, Human
ucguuugcuuuuaaaaaaac

SEQ ID NO: 796084 - RNA, 23 nt, Human
ucugauaauguuuacagccagca

SEQ ID NO: 796085 - RNA, 23 nt, Human
ugaaacacagaacugagcaaagc

SEQ ID NO: 796086 - RNA, 25 nt, Human
ugaaacacagaacugagcaaagcaa

SEQ ID NO: 796087 - RNA, 19 nt, Human
ugaggccauuaaacugcaa

SEQ ID NO: 796088 - RNA, 21 nt, Human
ugauuuugugugugugugugu

SEQ ID NO: 796089 - RNA, 23 nt, Human
ugcuggggggacccaaccccucc

SEQ ID NO: 796090 - RNA, 21 nt, Human
uggacucgcggcggcggcggc

SEQ ID NO: 796091 - RNA, 18 nt, Human
uggcggaaccuuccuccc

SEQ ID NO: 796092 - RNA, 21 nt, Human
uggcggaaccuuccuccccca

SEQ ID NO: 796093 - RNA, 23 nt, Human
ugggggggcucaugugggugagg

SEQ ID NO: 796094 - RNA, 20 nt, Human
ugggugagggcaaaacccaa

SEQ ID NO: 796095 - RNA, 18 nt, Human
ugugugugugugugugug

SEQ ID NO: 796096 - RNA, 18 nt, Human
ugugugugugugugugug

SEQ ID NO: 796097 - RNA, 18 nt, Human
ugugugugugugugugug

SEQ ID NO: 796098 - RNA, 18 nt, Human
ugugugugugugugugug

SEQ ID NO: 796099 - RNA, 18 nt, Human
ugugugugugugugugug

SEQ ID NO: 796100 - RNA, 18 nt, Human
ugugugugugugugugug

SEQ ID NO: 796101 - RNA, 18 nt, Human
ugugugugugugugugug

SEQ ID NO: 796102 - RNA, 18 nt, Human
ugugugugugugugugug

SEQ ID NO: 796103 - RNA, 18 nt, Human
ugugugugugugugugug

SEQ ID NO: 796104 - RNA, 18 nt, Human
ugugugugugugugugug

SEQ ID NO: 796105 - RNA, 18 nt, Human
ugugugugugugugugug

SEQ ID NO: 796106 - RNA, 21 nt, Human
ugugugugugugugugugugu

SEQ ID NO: 796107 - RNA, 21 nt, Human
ugugugugugugugugugugu

SEQ ID NO: 796108 - RNA, 21 nt, Human
ugugugugugugugugugugu

SEQ ID NO: 796109 - RNA, 21 nt, Human
ugugugugugugugugugugu

SEQ ID NO: 796110 - RNA, 21 nt, Human
ugugugugugugugugugugu

SEQ ID NO: 796111 - RNA, 21 nt, Human
ugugugugugugugugugugu

SEQ ID NO: 796112 - RNA, 21 nt, Human
ugugugugugugugugugugu

SEQ ID NO: 796113 - RNA, 21 nt, Human
ugugugugugugugugugugu

SEQ ID NO: 796114 - RNA, 21 nt, Human
ugugugugugugugugugugu

SEQ ID NO: 796115 - RNA, 21 nt, Human
ugugugugugugugugugugu

SEQ ID NO: 796116 - RNA, 21 nt, Human
ugugugugugugugugugugu

SEQ ID NO: 796117 - RNA, 21 nt, Human
ugugugugugugugugugugu

SEQ ID NO: 796118 - RNA, 21 nt, Human
ugugugugugugugugugugu

SEQ ID NO: 796119 - RNA, 21 nt, Human
ugugugugugugugugugugu

SEQ ID NO: 796120 - RNA, 21 nt, Human
ugugugugugugugugugugu

SEQ ID NO: 796121 - RNA, 21 nt, Human
ugugugugugugugugugugu

SEQ ID NO: 796122 - RNA, 21 nt, Human
ugugugugugugugugugugu

SEQ ID NO: 796123 - RNA, 21 nt, Human
ugugugugugugugugugugu

SEQ ID NO: 796124 - RNA, 22 nt, Human
ugugugugugugugugugugua

SEQ ID NO: 796125 - RNA, 22 nt, Human
ugugugugugugugugugugug

SEQ ID NO: 796126 - RNA, 22 nt, Human
ugugugugugugugugugugug

SEQ ID NO: 796127 - RNA, 22 nt, Human
ugugugugugugugugugugug

SEQ ID NO: 796128 - RNA, 22 nt, Human
ugugugugugugugugugugug

SEQ ID NO: 796129 - RNA, 22 nt, Human
ugugugugugugugugugugug

SEQ ID NO: 796130 - RNA, 22 nt, Human
ugugugugugugugugugugug

SEQ ID NO: 796131 - RNA, 22 nt, Human
uguguguguguguguguguguu

SEQ ID NO: 796132 - RNA, 19 nt, Human
uguucugcuggcccagggg

SEQ ID NO: 796133 - RNA, 22 nt, Human
uuucccaacagccgaaucccaa

SEQ ID NO: 796134 - RNA, 24 nt, Human
uuugugugugugugugugugugug

SEQ ID NO: 796135 - RNA, 18 nt, Human
aaaaaacauuaaaaucau

SEQ ID NO: 796136 - RNA, 25 nt, Human
aaaaagacaaaagccagcuuacaaa

SEQ ID NO: 796137 - RNA, 21 nt, Human
aaaagcaaaaauauuuuaaaa

SEQ ID NO: 796138 - RNA, 23 nt, Human
aacacaaaggcagacugccauuc

SEQ ID NO: 796139 - RNA, 21 nt, Human
aacagccacuugccaaacucc

SEQ ID NO: 796140 - RNA, 24 nt, Human
aaccaccacagcaaaccagcugcc

SEQ ID NO: 796141 - RNA, 20 nt, Human
aagagccaacagauuuacaa

SEQ ID NO: 796142 - RNA, 21 nt, Human
aagcaaagcaaacauuuuugg

SEQ ID NO: 796143 - RNA, 19 nt, Human
aauucaguguuuuccugcu

SEQ ID NO: 796144 - RNA, 20 nt, Human
acaauuuuguauaaaacugu

SEQ ID NO: 796145 - RNA, 21 nt, Human
acacaaccacaaauucaagaa

SEQ ID NO: 796146 - RNA, 23 nt, Human
acagaaaucaaauauuaagaaug

SEQ ID NO: 796147 - RNA, 20 nt, Human
acaucucaugaaaaugaaau

SEQ ID NO: 796148 - RNA, 22 nt, Human
accacagcaaaccagcugccug

SEQ ID NO: 796149 - RNA, 23 nt, Human
accacagcaaaccagcugccugu

SEQ ID NO: 796150 - RNA, 21 nt, Human
acuauacuacugacagguugg

SEQ ID NO: 796151 - RNA, 19 nt, Human
acuuggaaaaaaaugaugg

SEQ ID NO: 796152 - RNA, 18 nt, Human
agaaaaaugcacacagaa

SEQ ID NO: 796153 - RNA, 22 nt, Human
agacaaaagccagcuuacaaag

SEQ ID NO: 796154 - RNA, 19 nt, Human
agauuacaguaaaaacugc

SEQ ID NO: 796155 - RNA, 19 nt, Human
agauuugaccaauaaaacc

SEQ ID NO: 796156 - RNA, 22 nt, Human
agcaaagcaaacauuuuuggaa

SEQ ID NO: 796157 - RNA, 23 nt, Human
agcaggcugaguagcaccaucau

SEQ ID NO: 796158 - RNA, 19 nt, Human
auauauauauauauauaua

SEQ ID NO: 796159 - RNA, 19 nt, Human
auauauauauauauauaua

SEQ ID NO: 796160 - RNA, 19 nt, Human
auauauauauauauauaua

SEQ ID NO: 796161 - RNA, 19 nt, Human
auauauauauauauauaua

SEQ ID NO: 796162 - RNA, 19 nt, Human
auauauauauauauauaua

SEQ ID NO: 796163 - RNA, 19 nt, Human
auauauauauauauauaua

SEQ ID NO: 796164 - RNA, 19 nt, Human
auauauauauauauauaua

SEQ ID NO: 796165 - RNA, 19 nt, Human
auauauauauauauauaua

SEQ ID NO: 796166 - RNA, 19 nt, Human
auauauauauauauauaua

SEQ ID NO: 796167 - RNA, 19 nt, Human
auauauauauauauauaua

SEQ ID NO: 796168 - RNA, 19 nt, Human
auauauauauauauauaua

SEQ ID NO: 796169 - RNA, 22 nt, Human
augaaaugaaacuaguuuuuaa

SEQ ID NO: 796170 - RNA, 20 nt, Human
augaugguacacaaugcuuu

SEQ ID NO: 796171 - RNA, 24 nt, Human
augugguuuguaagcaaagcaaac

SEQ ID NO: 796172 - RNA, 18 nt, Human
caaaaagccauaauucca

SEQ ID NO: 796173 - RNA, 22 nt, Human
cagcuuacaaagauuugaccaa

SEQ ID NO: 796174 - RNA, 18 nt, Human
cagugauuacaggaucaa

SEQ ID NO: 796175 - RNA, 18 nt, Human
caguucucugaagagccu

SEQ ID NO: 796176 - RNA, 20 nt, Human
cauauauauauauauauaua

SEQ ID NO: 796177 - RNA, 25 nt, Human
ccagaaaacauguuuuguggacuaa

SEQ ID NO: 796178 - RNA, 26 nt, Human
ccccaaccccccaaacuauacuuccu

SEQ ID NO: 796179 - RNA, 19 nt, Human
ccccccaaacuauacuucc

SEQ ID NO: 796180 - RNA, 21 nt, Human
cucauauauauauauauauau

SEQ ID NO: 796181 - RNA, 20 nt, Human
cucaugaaaaugaaaugaaa

SEQ ID NO: 796182 - RNA, 28 nt, Human
cuuagugucaaacugcaaaagguuuucc

SEQ ID NO: 796183 - RNA, 22 nt, Human
cuuucuuccccaccuucuuuuu

SEQ ID NO: 796184 - RNA, 22 nt, Human
gaaaaauucauucaaguaaagu

SEQ ID NO: 796185 - RNA, 20 nt, Human
gacuuggaaaaaaaugaugg

SEQ ID NO: 796186 - RNA, 18 nt, Human
gagaguuacaaguaaguc

SEQ ID NO: 796187 - RNA, 22 nt, Human
gaugaucaaaaucaccaaugca

SEQ ID NO: 796188 - RNA, 24 nt, Human
gcaaaccagcugccuguuuuuguu

SEQ ID NO: 796189 - RNA, 24 nt, Human
gccaaaauguaauuguacaaucug

SEQ ID NO: 796190 - RNA, 22 nt, Human
gcggaacacuuucuuccccacc

SEQ ID NO: 796191 - RNA, 18 nt, Human
gcgggggggggggaucac

SEQ ID NO: 796192 - RNA, 19 nt, Human
gcuucagugaacuagcuuu

SEQ ID NO: 796193 - RNA, 21 nt, Human
ggaacacuuucuuccccaccu

SEQ ID NO: 796194 - RNA, 21 nt, Human
guaaacucuccccaacccccc

SEQ ID NO: 796195 - RNA, 22 nt, Human
guacuuguuugauuuguguucc

SEQ ID NO: 796196 - RNA, 25 nt, Human
gugugcacauauacauguuugugua

SEQ ID NO: 796197 - RNA, 22 nt, Human
uaaaaagacaaaagccagcuua

SEQ ID NO: 796198 - RNA, 18 nt, Human
uaaaaccaccacagcaaa

SEQ ID NO: 796199 - RNA, 21 nt, Human
uaaaaccaccacagcaaacca

SEQ ID NO: 796200 - RNA, 25 nt, Human
uaaaaguuaagauuacaguaaaaac

SEQ ID NO: 796201 - RNA, 22 nt, Human
uaaaauagcauaggcuucagug

SEQ ID NO: 796202 - RNA, 18 nt, Human
uaaagacaccauuuucuu

SEQ ID NO: 796203 - RNA, 23 nt, Human
uaaaggcauuaaauuuuuagcua

SEQ ID NO: 796204 - RNA, 23 nt, Human
uaacaaaugacaguaggugacac

SEQ ID NO: 796205 - RNA, 21 nt, Human
uaagaaaucaaguauugaaaa

SEQ ID NO: 796206 - RNA, 22 nt, Human
uaagaauggaugaucaaaauca

SEQ ID NO: 796207 - RNA, 21 nt, Human
uaagccccaugguggauuuaa

SEQ ID NO: 796208 - RNA, 20 nt, Human
uagaaaaaugcacacagaag

SEQ ID NO: 796209 - RNA, 18 nt, Human
uagaaugcuuuggucuuu

SEQ ID NO: 796210 - RNA, 19 nt, Human
uaguaagcaaaaauguauu

SEQ ID NO: 796211 - RNA, 19 nt, Human
uauacauauacaugugugu

SEQ ID NO: 796212 - RNA, 27 nt, Human
uauacauguuuguguauauauguacau

SEQ ID NO: 796213 - RNA, 19 nt, Human
uauauauauauauauauau

SEQ ID NO: 796214 - RNA, 19 nt, Human
uauauauauauauauauau

SEQ ID NO: 796215 - RNA, 19 nt, Human
uauauauauauauauauau

SEQ ID NO: 796216 - RNA, 19 nt, Human
uauauauauauauauauau

SEQ ID NO: 796217 - RNA, 19 nt, Human
uauauauauauauauauau

SEQ ID NO: 796218 - RNA, 19 nt, Human
uauauauauauauauauau

SEQ ID NO: 796219 - RNA, 19 nt, Human
uauauauauauauauauau

SEQ ID NO: 796220 - RNA, 24 nt, Human
uauauauauauauauauauaugua

SEQ ID NO: 796221 - RNA, 19 nt, Human
uauauauguacauauauac

SEQ ID NO: 796222 - RNA, 20 nt, Human
uauauuuauuaaccuacaac

SEQ ID NO: 796223 - RNA, 21 nt, Human
uauguaaacucuccccaaccc

SEQ ID NO: 796224 - RNA, 24 nt, Human
uauuaaagacaccauuuucuuagc

SEQ ID NO: 796225 - RNA, 20 nt, Human
uauucauguuuccuguagcu

SEQ ID NO: 796226 - RNA, 24 nt, Human
uauuuauacauauacaugugugug

SEQ ID NO: 796227 - RNA, 21 nt, Human
ucaaucaagaugaaaaauuca

SEQ ID NO: 796228 - RNA, 26 nt, Human
ucacauuuacauaucaucucguccaa

SEQ ID NO: 796229 - RNA, 21 nt, Human
ucacugugcgucaaucaagau

SEQ ID NO: 796230 - RNA, 23 nt, Human
ucagugaacuagcuuuguugagu

SEQ ID NO: 796231 - RNA, 19 nt, Human
ucagugcauucuauuuuca

SEQ ID NO: 796232 - RNA, 25 nt, Human
uccccaaccccccaaacuauacuuc

SEQ ID NO: 796233 - RNA, 19 nt, Human
uccccaccuucuuuuugca

SEQ ID NO: 796234 - RNA, 19 nt, Human
ucccugaauuuuuagaaca

SEQ ID NO: 796235 - RNA, 22 nt, Human
uccuagaugccaucugugacca

SEQ ID NO: 796236 - RNA, 23 nt, Human
uccucagaucuuauaaaccaaac

SEQ ID NO: 796237 - RNA, 21 nt, Human
ucucugaagagccuaugaucc

SEQ ID NO: 796238 - RNA, 21 nt, Human
ugaaaaauucauucaaguaaa

SEQ ID NO: 796239 - RNA, 23 nt, Human
ugaaaagguaccccuauuauuca

SEQ ID NO: 796240 - RNA, 24 nt, Human
ugaacuguacaucacugugcguca

SEQ ID NO: 796241 - RNA, 25 nt, Human
ugaauucugcuucaaacucauauau

SEQ ID NO: 796242 - RNA, 19 nt, Human
ugacacagaaaucaaauau

SEQ ID NO: 796243 - RNA, 24 nt, Human
ugacaguaggugacacagaaauca

SEQ ID NO: 796244 - RNA, 24 nt, Human
ugaggcagguuuuauauuuacaaa

SEQ ID NO: 796245 - RNA, 23 nt, Human
uggaaaaaaaugaugguacacaa

SEQ ID NO: 796246 - RNA, 23 nt, Human
uggacagguuuugcaaaugagac

SEQ ID NO: 796247 - RNA, 19 nt, Human
uggcauagggagagcauga

SEQ ID NO: 796248 - RNA, 20 nt, Human
uggcauagggagagcaugag

SEQ ID NO: 796249 - RNA, 25 nt, Human
uguaaacucuccccaaccccccaaa

SEQ ID NO: 796250 - RNA, 21 nt, Human
uguacaaguaaaauagaaggg

SEQ ID NO: 796251 - RNA, 21 nt, Human
uguagaguuguaagcgggggg

SEQ ID NO: 796252 - RNA, 18 nt, Human
ugugaccuuuccccacug

SEQ ID NO: 796253 - RNA, 28 nt, Human
ugugcacauauacauguuuguguauaua

SEQ ID NO: 796254 - RNA, 22 nt, Human
uguggucuuuucaagugaggua

SEQ ID NO: 796255 - RNA, 18 nt, Human
uguguauauauguacaua

SEQ ID NO: 796256 - RNA, 22 nt, Human
uguguauauauguacauauaua

SEQ ID NO: 796257 - RNA, 23 nt, Human
uguguauauauguacauauauac

SEQ ID NO: 796258 - RNA, 19 nt, Human
uguuuguguauauauguac

SEQ ID NO: 796259 - RNA, 22 nt, Human
uuaaaaauggacacaauugcuc

SEQ ID NO: 796260 - RNA, 22 nt, Human
uuagcauuguucaaguugucaa

SEQ ID NO: 796261 - RNA, 25 nt, Human
uuauguaaacucuccccaacccccc

SEQ ID NO: 796262 - RNA, 20 nt, Human
uucaaaaagccauaauucca

SEQ ID NO: 796263 - RNA, 25 nt, Human
uucaaacucauauauauauauauau

SEQ ID NO: 796264 - RNA, 24 nt, Human
uucaagaaauuuuuuaaaaagaca

SEQ ID NO: 796265 - RNA, 23 nt, Human
uucaaguauggcuauauagucaa

SEQ ID NO: 796266 - RNA, 23 nt, Human
uucauguaauuuuuuuuuccugc

SEQ ID NO: 796267 - RNA, 18 nt, Human
uuccuagaugccaucugu

SEQ ID NO: 796268 - RNA, 22 nt, Human
uugucaugaauacugugaccuu

SEQ ID NO: 796269 - RNA, 23 nt, Human
uuuccugcuauucauguuuccug

SEQ ID NO: 796270 - RNA, 21 nt, Human
uuuguguauauauguacauaa

SEQ ID NO: 796271 - RNA, 19 nt, Human
uuuuugagcaaugaacuug

SEQ ID NO: 796272 - RNA, 19 nt, Human
aaaagaaauucccuucuuu

SEQ ID NO: 796273 - RNA, 20 nt, Human
aaaaguuggcccuaagucug

SEQ ID NO: 796274 - RNA, 22 nt, Human
aaaugccccagggucucuucaa

SEQ ID NO: 796275 - RNA, 23 nt, Human
aacaggcagccagaucaaggaug

SEQ ID NO: 796276 - RNA, 22 nt, Human
aacaguaacccaccccacugau

SEQ ID NO: 796277 - RNA, 18 nt, Human
aacccaccccacugauaa

SEQ ID NO: 796278 - RNA, 23 nt, Human
acaacgagcccaccggcucuaau

SEQ ID NO: 796279 - RNA, 20 nt, Human
aggaugcucucacccugaua

SEQ ID NO: 796280 - RNA, 21 nt, Human
agucaggaaaagugcaauuuc

SEQ ID NO: 796281 - RNA, 19 nt, Human
auaauuguaaaaaaaaaaa

SEQ ID NO: 796282 - RNA, 23 nt, Human
auuuacucagcuuauacugaaag

SEQ ID NO: 796283 - RNA, 23 nt, Human
caacauauucuagcugaaacgga

SEQ ID NO: 796284 - RNA, 18 nt, Human
caagcuccugaauccaac

SEQ ID NO: 796285 - RNA, 24 nt, Human
cagugugauucaacaauuccaguu

SEQ ID NO: 796286 - RNA, 21 nt, Human
ccacaacgagcccaccggcuc

SEQ ID NO: 796287 - RNA, 24 nt, Human
ccaccgggcucggaggagugcaga

SEQ ID NO: 796288 - RNA, 20 nt, Human
ccagagcggggaagagccga

SEQ ID NO: 796289 - RNA, 24 nt, Human
ccagggucucuucaacaguaaccc

SEQ ID NO: 796290 - RNA, 21 nt, Human
ccccagaaaaagaaauucccu

SEQ ID NO: 796291 - RNA, 24 nt, Human
ccggcgaccagagcggggaagagc

SEQ ID NO: 796292 - RNA, 20 nt, Human
ccugagguaaaugccccagg

SEQ ID NO: 796293 - RNA, 19 nt, Human
ccugcauucuccaccgggc

SEQ ID NO: 796294 - RNA, 24 nt, Human
cgcccacaacgagcccaccggcuc

SEQ ID NO: 796295 - RNA, 21 nt, Human
cgccgagaaauggcgcccaca

SEQ ID NO: 796296 - RNA, 21 nt, Human
cuacagcagccugcauucucc

SEQ ID NO: 796297 - RNA, 18 nt, Human
cucuaaauuuacucagcu

SEQ ID NO: 796298 - RNA, 22 nt, Human
gagcccaccggcucuaaucccc

SEQ ID NO: 796299 - RNA, 19 nt, Human
gagccgagcaaggcugaga

SEQ ID NO: 796300 - RNA, 18 nt, Human
gcagccugcauucuccac

SEQ ID NO: 796301 - RNA, 19 nt, Human
gcccacaacgagcccaccg

SEQ ID NO: 796302 - RNA, 20 nt, Human
gccgagaaauggcgcccaca

SEQ ID NO: 796303 - RNA, 23 nt, Human
guggaguacugcugugcugugcc

SEQ ID NO: 796304 - RNA, 24 nt, Human
guggaguacugcugugcugugccu

SEQ ID NO: 796305 - RNA, 25 nt, Human
uagaaccgcuagguggagccaagag

SEQ ID NO: 796306 - RNA, 20 nt, Human
uaguguccacauuaauuucc

SEQ ID NO: 796307 - RNA, 19 nt, Human
uauagaaaguucaagacca

SEQ ID NO: 796308 - RNA, 25 nt, Human
uaugaacaaauagaaccgcuaggug

SEQ ID NO: 796309 - RNA, 23 nt, Human
uccaccgggcucggaggagugca

SEQ ID NO: 796310 - RNA, 21 nt, Human
uccuguggaaaggcaggguga

SEQ ID NO: 796311 - RNA, 27 nt, Human
ucucuaacaggcagccagaucaaggau

SEQ ID NO: 796312 - RNA, 21 nt, Human
ucucuucaacaguaacccacc

SEQ ID NO: 796313 - RNA, 26 nt, Human
ugaaacggaucccaggacggaaugcu

SEQ ID NO: 796314 - RNA, 20 nt, Human
ugaaggaaaccccagaaaaa

SEQ ID NO: 796315 - RNA, 18 nt, Human
ugagaaaggggcggcucc

SEQ ID NO: 796316 - RNA, 25 nt, Human
ugcagaugccugagguaaaugcccc

SEQ ID NO: 796317 - RNA, 20 nt, Human
ugccccagggucucuucaac

SEQ ID NO: 796318 - RNA, 18 nt, Human
uguaaaaaaaaaaaaagu

SEQ ID NO: 796319 - RNA, 24 nt, Human
uguaaaaaaaaaaaaaguuggccc

SEQ ID NO: 796320 - RNA, 18 nt, Human
uguaaacuugaaauauua

SEQ ID NO: 796321 - RNA, 22 nt, Human
ugugagugcuuccuguggaaag

SEQ ID NO: 796322 - RNA, 20 nt, Human
uguguggugccugugagugc

SEQ ID NO: 796323 - RNA, 21 nt, Human
uucaagaccaaacacucucuu

SEQ ID NO: 796324 - RNA, 23 nt, Human
uucuagguaagucaggaaaagug

SEQ ID NO: 796325 - RNA, 21 nt, Human
aaaaagagacgaaugcaguca

SEQ ID NO: 796326 - RNA, 26 nt, Human
aaaaagccaaaguuccauuucagaca

SEQ ID NO: 796327 - RNA, 23 nt, Human
aacuugcucccucccuugggccg

SEQ ID NO: 796328 - RNA, 19 nt, Human
aaggugaagggcccuugga

SEQ ID NO: 796329 - RNA, 22 nt, Human
agaagaaggaggaagaaugcgg

SEQ ID NO: 796330 - RNA, 26 nt, Human
agaagaaggaggaagaaugcggggag

SEQ ID NO: 796331 - RNA, 23 nt, Human
agaucuaaacuuugaucuguauu

SEQ ID NO: 796332 - RNA, 26 nt, Human
aucguacacguaccagucucaauccc

SEQ ID NO: 796333 - RNA, 19 nt, Human
augcagucauuuuguuagc

SEQ ID NO: 796334 - RNA, 20 nt, Human
cauauauuucaacugaaccc

SEQ ID NO: 796335 - RNA, 19 nt, Human
ccacugaaaaagccaaagu

SEQ ID NO: 796336 - RNA, 24 nt, Human
ccgagaguugcuccuuccucuucc

SEQ ID NO: 796337 - RNA, 27 nt, Human
ccucccuugggcaggcugcccgagagu

SEQ ID NO: 796338 - RNA, 20 nt, Human
ccucuucucagaaaacaaaa

SEQ ID NO: 796339 - RNA, 22 nt, Human
cuaguagcuuuuuaaaauuccc

SEQ ID NO: 796340 - RNA, 19 nt, Human
cucuuccaaacacccacuc

SEQ ID NO: 796341 - RNA, 22 nt, Human
cuguagcaccagaagaaggagg

SEQ ID NO: 796342 - RNA, 21 nt, Human
cuuuuugccccacuuugggag

SEQ ID NO: 796343 - RNA, 21 nt, Human
gagggauuuuuuuuuucuaga

SEQ ID NO: 796344 - RNA, 19 nt, Human
ggcaaaucugcgaggcgag

SEQ ID NO: 796345 - RNA, 19 nt, Human
gguuuguguuuuguuuuug

SEQ ID NO: 796346 - RNA, 27 nt, Human
guugauuuccuuuuggucuugcuucca

SEQ ID NO: 796347 - RNA, 21 nt, Human
uaaaauucccaaacagucuua

SEQ ID NO: 796348 - RNA, 21 nt, Human
uacuuggcaaaucugcgaggc

SEQ ID NO: 796349 - RNA, 25 nt, Human
uagaacaaaaugaaaccuucaacau

SEQ ID NO: 796350 - RNA, 22 nt, Human
uauuucaacugaacccaagugu

SEQ ID NO: 796351 - RNA, 21 nt, Human
ucccacagaaacgcuugguuc

SEQ ID NO: 796352 - RNA, 19 nt, Human
ucccuugggcaggcugccc

SEQ ID NO: 796353 - RNA, 19 nt, Human
ucccuugggcaggcugccc

SEQ ID NO: 796354 - RNA, 18 nt, Human
ucuaaacuuugaucugua

SEQ ID NO: 796355 - RNA, 23 nt, Human
ugaagugcugcuggcuuuuggcc

SEQ ID NO: 796356 - RNA, 18 nt, Human
ugcucccucccuugggca

SEQ ID NO: 796357 - RNA, 20 nt, Human
uggaguaaaagagaaaaauu

SEQ ID NO: 796358 - RNA, 20 nt, Human
ugggagggauuuuuuuuuuc

SEQ ID NO: 796359 - RNA, 21 nt, Human
uuccaaacacccacucaguug

SEQ ID NO: 796360 - RNA, 18 nt, Human
uugcucccucccuugggc

SEQ ID NO: 796361 - RNA, 27 nt, Human
uugcucccucccuugggcaggcugccc

SEQ ID NO: 796362 - RNA, 21 nt, Human
uuggagcuguagcaccagaag

SEQ ID NO: 796363 - RNA, 18 nt, Human
uuggcaaaucugcgaggc

SEQ ID NO: 796364 - RNA, 23 nt, Human
uuggccaaaauacauauauuuca

SEQ ID NO: 796365 - RNA, 20 nt, Human
uuuuguuuuugugaagugcu

SEQ ID NO: 796366 - RNA, 25 nt, Human
aaaaaaaaaaaucaaaaugcacuca

SEQ ID NO: 796367 - RNA, 18 nt, Human
aaagaaccagcucagauc

SEQ ID NO: 796368 - RNA, 18 nt, Human
aaauuuccuucuuggauu

SEQ ID NO: 796369 - RNA, 18 nt, Human
aagaaccagcucagaucc

SEQ ID NO: 796370 - RNA, 18 nt, Human
aaucacuacaccuucaag

SEQ ID NO: 796371 - RNA, 19 nt, Human
aauuuuuuuaauacaagcu

SEQ ID NO: 796372 - RNA, 23 nt, Human
acacacacacacacacacacaca

SEQ ID NO: 796373 - RNA, 23 nt, Human
acacacacacacacacacacaca

SEQ ID NO: 796374 - RNA, 23 nt, Human
acacacacacacacacacacaca

SEQ ID NO: 796375 - RNA, 23 nt, Human
acacacacacacacacacacaca

SEQ ID NO: 796376 - RNA, 23 nt, Human
acacacacacacacacacacaca

SEQ ID NO: 796377 - RNA, 23 nt, Human
acacacacacacacacacacaca

SEQ ID NO: 796378 - RNA, 23 nt, Human
acacacacacacacacacacaca

SEQ ID NO: 796379 - RNA, 21 nt, Human
acacacacacacacacacggc

SEQ ID NO: 796380 - RNA, 21 nt, Human
acacacacacacgcgcacaca

SEQ ID NO: 796381 - RNA, 21 nt, Human
acacacacgugcacacacaca

SEQ ID NO: 796382 - RNA, 23 nt, Human
acacacaugcacacgcacacaca

SEQ ID NO: 796383 - RNA, 21 nt, Human
acacauacacacacacacaca

SEQ ID NO: 796384 - RNA, 21 nt, Human
acacauacacacacacacaca

SEQ ID NO: 796385 - RNA, 21 nt, Human
acacauacacauacacacaca

SEQ ID NO: 796386 - RNA, 21 nt, Human
acacauacacauacacacaca

SEQ ID NO: 796387 - RNA, 21 nt, Human
acacauacacauacacauaca

SEQ ID NO: 796388 - RNA, 21 nt, Human
acacauacacauacacauaua

SEQ ID NO: 796389 - RNA, 21 nt, Human
acacauauauacacacacaca

SEQ ID NO: 796390 - RNA, 20 nt, Human
acagacacauauacagccuc

SEQ ID NO: 796391 - RNA, 22 nt, Human
acagagccuccagcacugccca

SEQ ID NO: 796392 - RNA, 18 nt, Human
acgcacacagacacauau

SEQ ID NO: 796393 - RNA, 23 nt, Human
acgccugcaaguugagugcguga

SEQ ID NO: 796394 - RNA, 19 nt, Human
acuugucugaguguguaug

SEQ ID NO: 796395 - RNA, 20 nt, Human
agagccuccagcacugccca

SEQ ID NO: 796396 - RNA, 27 nt, Human
agcaaagaaccagcucagauccuccca

SEQ ID NO: 796397 - RNA, 19 nt, Human
agcacugcccacagcugcc

SEQ ID NO: 796398 - RNA, 19 nt, Human
agcacugcccacagcugcc

SEQ ID NO: 796399 - RNA, 19 nt, Human
agcacugcccacagcugcc

SEQ ID NO: 796400 - RNA, 19 nt, Human
agcacugcucacagcugcc

SEQ ID NO: 796401 - RNA, 19 nt, Human
agcacugcucacagcugcc

SEQ ID NO: 796402 - RNA, 18 nt, Human
aguagagugcaaaaccca

SEQ ID NO: 796403 - RNA, 20 nt, Human
auaaaaggcaguaauuaaca

SEQ ID NO: 796404 - RNA, 27 nt, Human
caaaacccacucaaccaggauuccagg

SEQ ID NO: 796405 - RNA, 25 nt, Human
caaaaugauauccuggggguuacaa

SEQ ID NO: 796406 - RNA, 18 nt, Human
caaccaggauuccaggua

SEQ ID NO: 796407 - RNA, 18 nt, Human
cacacacacacacacaca

SEQ ID NO: 796408 - RNA, 20 nt, Human
cacacacacacacacacaca

SEQ ID NO: 796409 - RNA, 20 nt, Human
cacacacacacacacacaca

SEQ ID NO: 796410 - RNA, 20 nt, Human
cacacacacacacacacaca

SEQ ID NO: 796411 - RNA, 20 nt, Human
cacacacacacacacacaca

SEQ ID NO: 796412 - RNA, 20 nt, Human
cacacacacacacacacaca

SEQ ID NO: 796413 - RNA, 20 nt, Human
cacacacacacacacacaca

SEQ ID NO: 796414 - RNA, 20 nt, Human
cacacacacacacacacaca

SEQ ID NO: 796415 - RNA, 20 nt, Human
cacacacacacacacacaca

SEQ ID NO: 796416 - RNA, 20 nt, Human
cacacacacacacacacaca

SEQ ID NO: 796417 - RNA, 20 nt, Human
cacacacacacacacacaca

SEQ ID NO: 796418 - RNA, 20 nt, Human
cacacacacacacacacaca

SEQ ID NO: 796419 - RNA, 20 nt, Human
cacacacacacacacacaca

SEQ ID NO: 796420 - RNA, 22 nt, Human
cacacacacacacacacacaca

SEQ ID NO: 796421 - RNA, 20 nt, Human
cacacagacacauauacagc

SEQ ID NO: 796422 - RNA, 21 nt, Human
cacacagccuccagcacugcc

SEQ ID NO: 796423 - RNA, 21 nt, Human
cacacagccuccagcacugcc

SEQ ID NO: 796424 - RNA, 21 nt, Human
cacacagccuccagcacugcc

SEQ ID NO: 796425 - RNA, 24 nt, Human
cacacagccuccagcacugcccac

SEQ ID NO: 796426 - RNA, 24 nt, Human
cacacagccuccagcacugcccac

SEQ ID NO: 796427 - RNA, 24 nt, Human
cacacagccuccagcacugcccac

SEQ ID NO: 796428 - RNA, 21 nt, Human
cacagcauagcucgccccuaa

SEQ ID NO: 796429 - RNA, 20 nt, Human
cacagccuccagcacugccc

SEQ ID NO: 796430 - RNA, 20 nt, Human
cacagccuccagcacugccc

SEQ ID NO: 796431 - RNA, 20 nt, Human
cacagccuccagcacugccc

SEQ ID NO: 796432 - RNA, 20 nt, Human
cacagccuccagcauugccc

SEQ ID NO: 796433 - RNA, 24 nt, Human
cacauacacauacauacacacaca

SEQ ID NO: 796434 - RNA, 23 nt, Human
cacgcacacacagagccuccagc

SEQ ID NO: 796435 - RNA, 26 nt, Human
cacucacucauacacacguucacaca

SEQ ID NO: 796436 - RNA, 19 nt, Human
cacugcugcccggccugcu

SEQ ID NO: 796437 - RNA, 25 nt, Human
cagaaggagggaguuggcuuuuuau

SEQ ID NO: 796438 - RNA, 25 nt, Human
cagaaggaggguguuggcuuuuuau

SEQ ID NO: 796439 - RNA, 20 nt, Human
cagcugccuggccugcuugc

SEQ ID NO: 796440 - RNA, 22 nt, Human
cagcugccuggccugcuugcuu

SEQ ID NO: 796441 - RNA, 22 nt, Human
cagcugccuggccugcuugcuu

SEQ ID NO: 796442 - RNA, 22 nt, Human
cagcugccuggccugcuugcuu

SEQ ID NO: 796443 - RNA, 22 nt, Human
cagcugccuggccugcuugcuu

SEQ ID NO: 796444 - RNA, 21 nt, Human
cagcugccugggcugcuugcu

SEQ ID NO: 796445 - RNA, 28 nt, Human
cauacacauacacgugcgugcucacaca

SEQ ID NO: 796446 - RNA, 24 nt, Human
cauauacacauacacagaugcgca

SEQ ID NO: 796447 - RNA, 21 nt, Human
cauauguguguugguguguau

SEQ ID NO: 796448 - RNA, 18 nt, Human
caugaagggcccagcugg

SEQ ID NO: 796449 - RNA, 19 nt, Human
caugugagugcauguguau

SEQ ID NO: 796450 - RNA, 25 nt, Human
caugugcaagugugaguguguaagu

SEQ ID NO: 796451 - RNA, 21 nt, Human
cauguguaugucuguguguau

SEQ ID NO: 796452 - RNA, 24 nt, Human
ccaagcgccuccaacauucaaagc

SEQ ID NO: 796453 - RNA, 24 nt, Human
ccaagcgccuccaacauucaaagc

SEQ ID NO: 796454 - RNA, 23 nt, Human
ccauguacaaaucuacagcaaag

SEQ ID NO: 796455 - RNA, 18 nt, Human
cccacagcugccuggccu

SEQ ID NO: 796456 - RNA, 18 nt, Human
cccacagcugccuggccu

SEQ ID NO: 796457 - RNA, 18 nt, Human
ccccuuggcuugggccag

SEQ ID NO: 796458 - RNA, 19 nt, Human
cccuaaagucugaagccaa

SEQ ID NO: 796459 - RNA, 22 nt, Human
ccuacagccuuaccuuccugcu

SEQ ID NO: 796460 - RNA, 24 nt, Human
ccucccaguuggggugcucggccc

SEQ ID NO: 796461 - RNA, 24 nt, Human
ccucccaguuggggugcucggccc

SEQ ID NO: 796462 - RNA, 21 nt, Human
ccugggugggagcuccccucg

SEQ ID NO: 796463 - RNA, 20 nt, Human
cgcacacacacacacacaca

SEQ ID NO: 796464 - RNA, 23 nt, Human
cuccagcacugcccacagcugcc

SEQ ID NO: 796465 - RNA, 23 nt, Human
cuccagcacugcccacagcugcc

SEQ ID NO: 796466 - RNA, 23 nt, Human
cuccagcacugcccacagcugcc

SEQ ID NO: 796467 - RNA, 23 nt, Human
cuccagcacugcccacugcugcc

SEQ ID NO: 796468 - RNA, 23 nt, Human
cuccagcacugcucacagcugcc

SEQ ID NO: 796469 - RNA, 23 nt, Human
cuccagcacugcucacagcugcc

SEQ ID NO: 796470 - RNA, 23 nt, Human
cuccagcacugcucacaguugcc

SEQ ID NO: 796471 - RNA, 23 nt, Human
cuccuuggaccgcucacaccgcu

SEQ ID NO: 796472 - RNA, 18 nt, Human
cugaaggauguagagagg

SEQ ID NO: 796473 - RNA, 19 nt, Human
cugaguguguaugucaggg

SEQ ID NO: 796474 - RNA, 20 nt, Human
cugcccggccugcuugcuug

SEQ ID NO: 796475 - RNA, 21 nt, Human
cugguacugcacuugccaaaa

SEQ ID NO: 796476 - RNA, 19 nt, Human
cuucuccaccugguacugc

SEQ ID NO: 796477 - RNA, 20 nt, Human
cuuugcuguaagaccccuuc

SEQ ID NO: 796478 - RNA, 19 nt, Human
gaagaaagcuggagauugc

SEQ ID NO: 796479 - RNA, 20 nt, Human
gaagggcccagcuggguguc

SEQ ID NO: 796480 - RNA, 22 nt, Human
gaccccuucuuccuacgugcac

SEQ ID NO: 796481 - RNA, 19 nt, Human
gagcaugucagggagugug

SEQ ID NO: 796482 - RNA, 19 nt, Human
gagcaugucagggagugug

SEQ ID NO: 796483 - RNA, 19 nt, Human
gagcucccaucggcugcuc

SEQ ID NO: 796484 - RNA, 22 nt, Human
gagggugugugggccugugugg

SEQ ID NO: 796485 - RNA, 18 nt, Human
gagugccugcgugggugu

SEQ ID NO: 796486 - RNA, 27 nt, Human
gagugugcauauguguguugguguguu

SEQ ID NO: 796487 - RNA, 21 nt, Human
gaguguguaaguauaugucag

SEQ ID NO: 796488 - RNA, 26 nt, Human
gcaaaaaaaaaaaaaaaaaaucaaaa

SEQ ID NO: 796489 - RNA, 19 nt, Human
gcaaaaauauuguagugac

SEQ ID NO: 796490 - RNA, 19 nt, Human
gcauauguguguuggugug

SEQ ID NO: 796491 - RNA, 19 nt, Human
gcaugugugugcacgccug

SEQ ID NO: 796492 - RNA, 18 nt, Human
gccacacauaaaagagau

SEQ ID NO: 796493 - RNA, 24 nt, Human
gccacacauaaaagagauucuaau

SEQ ID NO: 796494 - RNA, 24 nt, Human
gccacacauaaaagagauucuaau

SEQ ID NO: 796495 - RNA, 18 nt, Human
gcucacacacgugcgugc

SEQ ID NO: 796496 - RNA, 20 nt, Human
gcucugggcaagcugcaaag

SEQ ID NO: 796497 - RNA, 22 nt, Human
gcugcucccucccaguuggggu

SEQ ID NO: 796498 - RNA, 23 nt, Human
ggcugcucccucccaguuggggu

SEQ ID NO: 796499 - RNA, 28 nt, Human
ggguauggguguggucuggggcccgggc

SEQ ID NO: 796500 - RNA, 20 nt, Human
gucaagcuucuccaccuggu

SEQ ID NO: 796501 - RNA, 20 nt, Human
gucuguguguaugcaugugu

SEQ ID NO: 796502 - RNA, 19 nt, Human
gugaaugugagugcaugga

SEQ ID NO: 796503 - RNA, 18 nt, Human
guguguguguaugcuugu

SEQ ID NO: 796504 - RNA, 24 nt, Human
uaaauacacggguauguuuauaua

SEQ ID NO: 796505 - RNA, 19 nt, Human
uaagacacccccagaccuc

SEQ ID NO: 796506 - RNA, 26 nt, Human
uaagacacccccagaccuccccucga

SEQ ID NO: 796507 - RNA, 22 nt, Human
uaauacaagcuuugaaacaccc

SEQ ID NO: 796508 - RNA, 22 nt, Human
uacaagagucugacuccuaaau

SEQ ID NO: 796509 - RNA, 18 nt, Human
uacacacacacacacaca

SEQ ID NO: 796510 - RNA, 20 nt, Human
uacacacacacacacacaca

SEQ ID NO: 796511 - RNA, 20 nt, Human
uacacacacacacacacaca

SEQ ID NO: 796512 - RNA, 22 nt, Human
uacacacacgugcacacacaca

SEQ ID NO: 796513 - RNA, 19 nt, Human
uaggcccaugaagggccca

SEQ ID NO: 796514 - RNA, 20 nt, Human
uauaugucagugugugugua

SEQ ID NO: 796515 - RNA, 19 nt, Human
uaucagaagcuuaggccca

SEQ ID NO: 796516 - RNA, 18 nt, Human
uaugacagugugugagca

SEQ ID NO: 796517 - RNA, 19 nt, Human
uaugucaaugaguguguau

SEQ ID NO: 796518 - RNA, 18 nt, Human
uaugucagugagggugug

SEQ ID NO: 796519 - RNA, 18 nt, Human
uaugucagugagugugua

SEQ ID NO: 796520 - RNA, 19 nt, Human
uaugucuguguguaugcau

SEQ ID NO: 796521 - RNA, 23 nt, Human
uaugucuguguguaugcaugugu

SEQ ID NO: 796522 - RNA, 20 nt, Human
uaugugagugugugagugug

SEQ ID NO: 796523 - RNA, 18 nt, Human
uauguguguuggugugua

SEQ ID NO: 796524 - RNA, 18 nt, Human
ucaaggagaccccuuggc

SEQ ID NO: 796525 - RNA, 21 nt, Human
ucacaccgcuccuuccgggug

SEQ ID NO: 796526 - RNA, 25 nt, Human
ucacagaucagcccuacagccuuac

SEQ ID NO: 796527 - RNA, 21 nt, Human
ucagugaguguauguauguga

SEQ ID NO: 796528 - RNA, 18 nt, Human
ucagugaguguguaggca

SEQ ID NO: 796529 - RNA, 22 nt, Human
ucagugugagugugcauaugug

SEQ ID NO: 796530 - RNA, 20 nt, Human
ucaguguguaugcaugugug

SEQ ID NO: 796531 - RNA, 23 nt, Human
uccacuuccccaucaaaaagagc

SEQ ID NO: 796532 - RNA, 21 nt, Human
ucccaucggcugcucccuccc

SEQ ID NO: 796533 - RNA, 21 nt, Human
uccccaucaaaaagagccgug

SEQ ID NO: 796534 - RNA, 18 nt, Human
uccccucggcugcccccu

SEQ ID NO: 796535 - RNA, 23 nt, Human
uccuaaauuuccuucuuggauuu

SEQ ID NO: 796536 - RNA, 31 nt, Human
ucucuuaacugugcaaaaaaaaaaaaaaaaa

SEQ ID NO: 796537 - RNA, 26 nt, Human
ucugaagccaagguuuccuccugggg

SEQ ID NO: 796538 - RNA, 27 nt, Human
ucugaagccaagguuuccuccuggggc

SEQ ID NO: 796539 - RNA, 18 nt, Human
ucugcgaugucacaugau

SEQ ID NO: 796540 - RNA, 18 nt, Human
ucugguguugccagggug

SEQ ID NO: 796541 - RNA, 20 nt, Human
ucuguguuaaauacguuugu

SEQ ID NO: 796542 - RNA, 21 nt, Human
ucuuuuccaccaucuguccuc

SEQ ID NO: 796543 - RNA, 22 nt, Human
ucuuuuuuuuuucugcuuguuu

SEQ ID NO: 796544 - RNA, 28 nt, Human
ugaaaugcgucauguuaagacacccccc

SEQ ID NO: 796545 - RNA, 20 nt, Human
ugagaggcuuugcagguaug

SEQ ID NO: 796546 - RNA, 21 nt, Human
ugagugaggaacaugggugug

SEQ ID NO: 796547 - RNA, 22 nt, Human
ugagugcaugagugugugugua

SEQ ID NO: 796548 - RNA, 21 nt, Human
ugaguguguaugucagggagu

SEQ ID NO: 796549 - RNA, 19 nt, Human
ugcaugaguguguguguau

SEQ ID NO: 796550 - RNA, 20 nt, Human
ugcauggaugugaaugaaug

SEQ ID NO: 796551 - RNA, 21 nt, Human
ugcauggaugugaaugaaugu

SEQ ID NO: 796552 - RNA, 21 nt, Human
ugccugcgugggugugagugc

SEQ ID NO: 796553 - RNA, 19 nt, Human
ugccuggccugcuugcuug

SEQ ID NO: 796554 - RNA, 19 nt, Human
ugccuggccugcuugcuug

SEQ ID NO: 796555 - RNA, 19 nt, Human
ugccuggccugcuugcuug

SEQ ID NO: 796556 - RNA, 24 nt, Human
ugcgugcucacacacgugcgugcu

SEQ ID NO: 796557 - RNA, 19 nt, Human
uggaccgcucacaccgcuc

SEQ ID NO: 796558 - RNA, 20 nt, Human
uggcucugggcaagcugcaa

SEQ ID NO: 796559 - RNA, 24 nt, Human
uggcucugggcaagcugcaaagug

SEQ ID NO: 796560 - RNA, 19 nt, Human
uggcuugggccagugcagc

SEQ ID NO: 796561 - RNA, 23 nt, Human
uggcuugggccagugcagcccug

SEQ ID NO: 796562 - RNA, 24 nt, Human
uggcuugggccagugcagcccugu

SEQ ID NO: 796563 - RNA, 24 nt, Human
uggggugaaggugacaauccuggg

SEQ ID NO: 796564 - RNA, 21 nt, Human
uggggugcucggcccacaggg

SEQ ID NO: 796565 - RNA, 21 nt, Human
uggggugcucggcccacaggg

SEQ ID NO: 796566 - RNA, 24 nt, Human
uggggugcucggcccacagggagc

SEQ ID NO: 796567 - RNA, 24 nt, Human
uggggugcucggcccacagggagc

SEQ ID NO: 796568 - RNA, 25 nt, Human
ugggugcaugggcacuugucugagu

SEQ ID NO: 796569 - RNA, 24 nt, Human
ugggugugagugcaugagugugug

SEQ ID NO: 796570 - RNA, 19 nt, Human
uguaugacugcaugugugu

SEQ ID NO: 796571 - RNA, 24 nt, Human
uguaugacugcaugugugugugua

SEQ ID NO: 796572 - RNA, 19 nt, Human
uguaugucagugaguguau

SEQ ID NO: 796573 - RNA, 21 nt, Human
ugucucuuuccuccccaaccc

SEQ ID NO: 796574 - RNA, 21 nt, Human
ugugaaugugagugcaugagu

SEQ ID NO: 796575 - RNA, 19 nt, Human
ugugagcaugucagggagu

SEQ ID NO: 796576 - RNA, 19 nt, Human
ugugagcaugucagggagu

SEQ ID NO: 796577 - RNA, 20 nt, Human
ugugagugcaugagugugug

SEQ ID NO: 796578 - RNA, 21 nt, Human
ugugagugugcauaugugugu

SEQ ID NO: 796579 - RNA, 23 nt, Human
ugugagugugcaugcaugugugc

SEQ ID NO: 796580 - RNA, 19 nt, Human
ugugaguguguaaguauau

SEQ ID NO: 796581 - RNA, 21 nt, Human
ugugaguguguaaguauaugu

SEQ ID NO: 796582 - RNA, 20 nt, Human
ugugcaaaaaaaaaaaaaaa

SEQ ID NO: 796583 - RNA, 24 nt, Human
ugugcaaaaaaaaaaaaaaaaaau

SEQ ID NO: 796584 - RNA, 19 nt, Human
ugugcauauguguguuggu

SEQ ID NO: 796585 - RNA, 27 nt, Human
ugugcaugugagugcauguguaugcaa

SEQ ID NO: 796586 - RNA, 18 nt, Human
ugugggcauguaugugug

SEQ ID NO: 796587 - RNA, 20 nt, Human
uguguacgaaugugaguaca

SEQ ID NO: 796588 - RNA, 21 nt, Human
uguguaugacugcaugugugu

SEQ ID NO: 796589 - RNA, 19 nt, Human
uguguaugcaugugugaau

SEQ ID NO: 796590 - RNA, 22 nt, Human
uguguaugucuguguguaugca

SEQ ID NO: 796591 - RNA, 20 nt, Human
uguguaugugugugaaugug

SEQ ID NO: 796592 - RNA, 21 nt, Human
ugugugagugugacagugugu

SEQ ID NO: 796593 - RNA, 21 nt, Human
ugugugagugugacagugugu

SEQ ID NO: 796594 - RNA, 19 nt, Human
ugugugcaugugagugcau

SEQ ID NO: 796595 - RNA, 19 nt, Human
ugugugcaugugagugcau

SEQ ID NO: 796596 - RNA, 19 nt, Human
ugugugcaugugaguguau

SEQ ID NO: 796597 - RNA, 19 nt, Human
ugugugcaugugaguguau

SEQ ID NO: 796598 - RNA, 24 nt, Human
uguguguaugucagugagugugua

SEQ ID NO: 796599 - RNA, 20 nt, Human
uguguguguguaugucagug

SEQ ID NO: 796600 - RNA, 18 nt, Human
uguguugguguguaugca

SEQ ID NO: 796601 - RNA, 21 nt, Human
uguguugguguguaugcaagu

SEQ ID NO: 796602 - RNA, 24 nt, Human
uguguugguguguaugcaaguacg

SEQ ID NO: 796603 - RNA, 28 nt, Human
uguuggcuuuuuaucagucugcagcuuu

SEQ ID NO: 796604 - RNA, 28 nt, Human
uuaacugugcaaaaaaaaaaaaaaaaaa

SEQ ID NO: 796605 - RNA, 23 nt, Human
uuagaggaaagaguacauugcgg

SEQ ID NO: 796606 - RNA, 25 nt, Human
uuaggcccaugaagggcccagcugg

SEQ ID NO: 796607 - RNA, 23 nt, Human
uuccaaugcauuguuucccauuu

SEQ ID NO: 796608 - RNA, 18 nt, Human
uuccaccaucuguccucu

SEQ ID NO: 796609 - RNA, 21 nt, Human
uuucuggccuuccagguccug

SEQ ID NO: 796610 - RNA, 23 nt, Human
aaaaaaaaaaaaaaaaauccaaa

SEQ ID NO: 796611 - RNA, 26 nt, Human
aaaaaaauccaaaaaacaaacaacua

SEQ ID NO: 796612 - RNA, 20 nt, Human
aaaaaauccaaaaaacaaac

SEQ ID NO: 796613 - RNA, 22 nt, Human
aaaaauccaaaaaacaaacaac

SEQ ID NO: 796614 - RNA, 21 nt, Human
aaaagccccugcacuguuuuc

SEQ ID NO: 796615 - RNA, 23 nt, Human
aaaaucacugaaauacgguuucc

SEQ ID NO: 796616 - RNA, 22 nt, Human
aaaauggcccccaaagagccca

SEQ ID NO: 796617 - RNA, 23 nt, Human
aaacaacuaaaaaccaaagaauu

SEQ ID NO: 796618 - RNA, 18 nt, Human
aaacauguccacucccuc

SEQ ID NO: 796619 - RNA, 22 nt, Human
aaccagaacaaauuccauggga

SEQ ID NO: 796620 - RNA, 19 nt, Human
aagaagccaaaagccccug

SEQ ID NO: 796621 - RNA, 18 nt, Human
aagagaguugcuggguuu

SEQ ID NO: 796622 - RNA, 18 nt, Human
aaggaaagcgacugccaa

SEQ ID NO: 796623 - RNA, 21 nt, Human
aaggaccugcaggcguuuccu

SEQ ID NO: 796624 - RNA, 21 nt, Human
aaguugaacuuguuauucgug

SEQ ID NO: 796625 - RNA, 25 nt, Human
aaugaagaaaauccagauuguuucu

SEQ ID NO: 796626 - RNA, 21 nt, Human
acaaagcucccggaaccugga

SEQ ID NO: 796627 - RNA, 18 nt, Human
acaccauacagacagggc

SEQ ID NO: 796628 - RNA, 20 nt, Human
acagccaaggugaacugaag

SEQ ID NO: 796629 - RNA, 21 nt, Human
acgaagacaugugccccccaa

SEQ ID NO: 796630 - RNA, 19 nt, Human
acuaguuagaucagcaacu

SEQ ID NO: 796631 - RNA, 22 nt, Human
agaaaccagaacaaauuccaug

SEQ ID NO: 796632 - RNA, 24 nt, Human
agaagccaaaagccccugcacugu

SEQ ID NO: 796633 - RNA, 20 nt, Human
agacaugugccccccaaggc

SEQ ID NO: 796634 - RNA, 21 nt, Human
agaggggcccagaccugggcc

SEQ ID NO: 796635 - RNA, 23 nt, Human
agaguucccacguguguccacuu

SEQ ID NO: 796636 - RNA, 27 nt, Human
agccaacaccgaaaggggaggggcacg

SEQ ID NO: 796637 - RNA, 24 nt, Human
agcuugcucuccccacacucaggc

SEQ ID NO: 796638 - RNA, 23 nt, Human
aggaaacauguccacucccucca

SEQ ID NO: 796639 - RNA, 18 nt, Human
aggaaguagauguugggg

SEQ ID NO: 796640 - RNA, 19 nt, Human
aggcaggggguggccaggu

SEQ ID NO: 796641 - RNA, 20 nt, Human
aggcauagagaagggcccaa

SEQ ID NO: 796642 - RNA, 18 nt, Human
agggaaaacuugcaugug

SEQ ID NO: 796643 - RNA, 19 nt, Human
aggggcccagaccugggcc

SEQ ID NO: 796644 - RNA, 20 nt, Human
aggggcccagaccugggccc

SEQ ID NO: 796645 - RNA, 18 nt, Human
aggggguggccagguaua

SEQ ID NO: 796646 - RNA, 20 nt, Human
agguauaggacagcaggacc

SEQ ID NO: 796647 - RNA, 21 nt, Human
aguaauagccccuuggcccuc

SEQ ID NO: 796648 - RNA, 24 nt, Human
auaggacagcaggaccuucuagag

SEQ ID NO: 796649 - RNA, 25 nt, Human
aucaaugaagacuaccaccuacugu

SEQ ID NO: 796650 - RNA, 19 nt, Human
auccaaaaaacaaacaacu

SEQ ID NO: 796651 - RNA, 21 nt, Human
auccaaaaaacaaacaacuaa

SEQ ID NO: 796652 - RNA, 24 nt, Human
aucuauucaccacuaaguagaucc

SEQ ID NO: 796653 - RNA, 19 nt, Human
auuaugucauacagccacu

SEQ ID NO: 796654 - RNA, 21 nt, Human
auugcugcugaugugguuccc

SEQ ID NO: 796655 - RNA, 22 nt, Human
caaaaucagauguaaaaaacaa

SEQ ID NO: 796656 - RNA, 24 nt, Human
caaggaaacauguccacucccucc

SEQ ID NO: 796657 - RNA, 23 nt, Human
caccauacagacagggcaaggac

SEQ ID NO: 796658 - RNA, 22 nt, Human
caccugaagcuaugauuagccc

SEQ ID NO: 796659 - RNA, 21 nt, Human
cacucccuccaaccagcaacc

SEQ ID NO: 796660 - RNA, 20 nt, Human
cagcaguaauagccccuugg

SEQ ID NO: 796661 - RNA, 23 nt, Human
cagcaguaauagccccuuggccc

SEQ ID NO: 796662 - RNA, 24 nt, Human
cagccucuggugaccccgaaucuc

SEQ ID NO: 796663 - RNA, 20 nt, Human
cagcggugggaagggggagg

SEQ ID NO: 796664 - RNA, 19 nt, Human
caggagccgcagugacgag

SEQ ID NO: 796665 - RNA, 21 nt, Human
caggagccugacauucccagu

SEQ ID NO: 796666 - RNA, 23 nt, Human
cagggcaaggaccugcaggcggc

SEQ ID NO: 796667 - RNA, 19 nt, Human
cauggugagcucaaagagg

SEQ ID NO: 796668 - RNA, 26 nt, Human
cauucaguuuccuaaggaugcacucc

SEQ ID NO: 796669 - RNA, 23 nt, Human
ccacaaagcucccggaaccugga

SEQ ID NO: 796670 - RNA, 21 nt, Human
ccaggacucugguaugacaca

SEQ ID NO: 796671 - RNA, 22 nt, Human
ccaggcggggugcaagcucacg

SEQ ID NO: 796672 - RNA, 18 nt, Human
cccagaccugggcccgcc

SEQ ID NO: 796673 - RNA, 22 nt, Human
cccagaccugggcccgcccuga

SEQ ID NO: 796674 - RNA, 20 nt, Human
ccccacacucaggcugcccc

SEQ ID NO: 796675 - RNA, 22 nt, Human
cccccaaagagcccaaugauuu

SEQ ID NO: 796676 - RNA, 18 nt, Human
cccccuucaucucacuuc

SEQ ID NO: 796677 - RNA, 24 nt, Human
cccucuacugccauccaaggggca

SEQ ID NO: 796678 - RNA, 20 nt, Human
ccgcagugacgaggggcugu

SEQ ID NO: 796679 - RNA, 22 nt, Human
ccucccgccuccagcccccaac

SEQ ID NO: 796680 - RNA, 21 nt, Human
ccuuggcccucacccccacuu

SEQ ID NO: 796681 - RNA, 27 nt, Human
cggaaggacacggcucagauggagaca

SEQ ID NO: 796682 - RNA, 21 nt, Human
cuaaaugaacccaguggucau

SEQ ID NO: 796683 - RNA, 21 nt, Human
cuaacaagaagccaaaagccc

SEQ ID NO: 796684 - RNA, 18 nt, Human
cucuaacagggguagaug

SEQ ID NO: 796685 - RNA, 22 nt, Human
cugaagcuaugauuagccacug

SEQ ID NO: 796686 - RNA, 25 nt, Human
cuggagccaccuguauggauggaga

SEQ ID NO: 796687 - RNA, 20 nt, Human
gaaaucaaugaagacuacca

SEQ ID NO: 796688 - RNA, 21 nt, Human
gacagaaguuguaaguacaag

SEQ ID NO: 796689 - RNA, 20 nt, Human
gaggaccccuaaccucuggu

SEQ ID NO: 796690 - RNA, 21 nt, Human
gccaaaaaaaaaaaaaaaaaa

SEQ ID NO: 796691 - RNA, 24 nt, Human
gccaaaaaaaaaaaaaaaaaaauc

SEQ ID NO: 796692 - RNA, 18 nt, Human
gccacuccccacggacau

SEQ ID NO: 796693 - RNA, 19 nt, Human
gcccucacccccacuucau

SEQ ID NO: 796694 - RNA, 19 nt, Human
gccuaaagagugacacaac

SEQ ID NO: 796695 - RNA, 22 nt, Human
gccuccagcccccaacaaccag

SEQ ID NO: 796696 - RNA, 19 nt, Human
ggaaacauguccacucccu

SEQ ID NO: 796697 - RNA, 19 nt, Human
ggaacgaagacaugugccc

SEQ ID NO: 796698 - RNA, 20 nt, Human
ggaaggacacggcucagaug

SEQ ID NO: 796699 - RNA, 18 nt, Human
ggacauguguaccccauc

SEQ ID NO: 796700 - RNA, 22 nt, Human
ggcacgcuagcgcaaaugacac

SEQ ID NO: 796701 - RNA, 20 nt, Human
ggccaagcugaacggaagcc

SEQ ID NO: 796702 - RNA, 25 nt, Human
ggcuucuuucuugcgguuggguggg

SEQ ID NO: 796703 - RNA, 23 nt, Human
ggggcuggggagggcacaaccag

SEQ ID NO: 796704 - RNA, 21 nt, Human
gggggagguggugggagaggg

SEQ ID NO: 796705 - RNA, 21 nt, Human
ggugggaagggggagguggug

SEQ ID NO: 796706 - RNA, 19 nt, Human
guccacuucucuucacaga

SEQ ID NO: 796707 - RNA, 24 nt, Human
uaaaaaacaaggucaguaaaauca

SEQ ID NO: 796708 - RNA, 19 nt, Human
uaaaaaaugcuccugggua

SEQ ID NO: 796709 - RNA, 18 nt, Human
uaaaauggcccccaaaga

SEQ ID NO: 796710 - RNA, 24 nt, Human
uaaaauggcccccaaagagcccaa

SEQ ID NO: 796711 - RNA, 23 nt, Human
uaaaguagcaaaauauuaagcca

SEQ ID NO: 796712 - RNA, 20 nt, Human
uaaccucuggucccugcccu

SEQ ID NO: 796713 - RNA, 23 nt, Human
uaagacagagagucauucagucc

SEQ ID NO: 796714 - RNA, 19 nt, Human
uacacagccaggcggggug

SEQ ID NO: 796715 - RNA, 20 nt, Human
uacagagaaaucaaugaaga

SEQ ID NO: 796716 - RNA, 26 nt, Human
uacagagaaaucaaugaagacuacca

SEQ ID NO: 796717 - RNA, 24 nt, Human
uacagagaaaucaaugaagacuag

SEQ ID NO: 796718 - RNA, 22 nt, Human
uagaaaccagaacaaauuccau

SEQ ID NO: 796719 - RNA, 26 nt, Human
uagaaagcagggcaauucauggcuug

SEQ ID NO: 796720 - RNA, 22 nt, Human
uagacacagccaaggugaacug

SEQ ID NO: 796721 - RNA, 22 nt, Human
uagauguuggggucguugucag

SEQ ID NO: 796722 - RNA, 22 nt, Human
uagccccuuggcccucaccccc

SEQ ID NO: 796723 - RNA, 20 nt, Human
ucagauguaaaaaacaaggu

SEQ ID NO: 796724 - RNA, 22 nt, Human
uccaugggaccucccgccucca

SEQ ID NO: 796725 - RNA, 20 nt, Human
ucccaaguauugcucagucc

SEQ ID NO: 796726 - RNA, 28 nt, Human
ucuccuggcugcuccagucccuccuuuc

SEQ ID NO: 796727 - RNA, 19 nt, Human
ugaaauacgguuuccaaaa

SEQ ID NO: 796728 - RNA, 24 nt, Human
ugaacggaagccuucccuggcacc

SEQ ID NO: 796729 - RNA, 19 nt, Human
ugacgaggggcuguugcug

SEQ ID NO: 796730 - RNA, 20 nt, Human
ugacgaggggcuguugcugg

SEQ ID NO: 796731 - RNA, 22 nt, Human
ugacgaggggcuguugcuggcg

SEQ ID NO: 796732 - RNA, 23 nt, Human
ugacugggaaagaagcaaacauu

SEQ ID NO: 796733 - RNA, 24 nt, Human
ugaguggacccugggaagggacau

SEQ ID NO: 796734 - RNA, 22 nt, Human
ugcacgaacauggcacuuuuaa

SEQ ID NO: 796735 - RNA, 22 nt, Human
ugccaacagguuucauggaaca

SEQ ID NO: 796736 - RNA, 20 nt, Human
ugccacagucccgcuucugu

SEQ ID NO: 796737 - RNA, 21 nt, Human
ugcgugugugugcaugcugug

SEQ ID NO: 796738 - RNA, 22 nt, Human
ugcgugugugugcaugcugugu

SEQ ID NO: 796739 - RNA, 19 nt, Human
uggaaacggaggccaucuc

SEQ ID NO: 796740 - RNA, 23 nt, Human
uggaagauguaaaauaugggaag

SEQ ID NO: 796741 - RNA, 28 nt, Human
uggaagauguaaaauaugggaagagggg

SEQ ID NO: 796742 - RNA, 24 nt, Human
uggagaagugaggacaccauacag

SEQ ID NO: 796743 - RNA, 22 nt, Human
uggagagcaugcagcuggccug

SEQ ID NO: 796744 - RNA, 21 nt, Human
uggcacuuuuaaagagauuuu

SEQ ID NO: 796745 - RNA, 24 nt, Human
ugggaaagaagcaaacauuugugg

SEQ ID NO: 796746 - RNA, 19 nt, Human
ugggaagaggggcaagaga

SEQ ID NO: 796747 - RNA, 19 nt, Human
ugggaagggggagguggug

SEQ ID NO: 796748 - RNA, 18 nt, Human
ugggauacaaggccaaaa

SEQ ID NO: 796749 - RNA, 21 nt, Human
ugggggcagcggaaggacacg

SEQ ID NO: 796750 - RNA, 19 nt, Human
uggugaccccgaaucucug

SEQ ID NO: 796751 - RNA, 24 nt, Human
uguaaaugacacuuaggagcaaau

SEQ ID NO: 796752 - RNA, 21 nt, Human
ugucagaaaaacauuaaggcu

SEQ ID NO: 796753 - RNA, 22 nt, Human
ugucauacagccacuggaacug

SEQ ID NO: 796754 - RNA, 25 nt, Human
ugucugugcuaaucuuuuaguccuu

SEQ ID NO: 796755 - RNA, 20 nt, Human
ugugaggggcuggggagggc

SEQ ID NO: 796756 - RNA, 20 nt, Human
ugugugcaugcugugugcau

SEQ ID NO: 796757 - RNA, 20 nt, Human
ugugugcaugcugugugcau

SEQ ID NO: 796758 - RNA, 22 nt, Human
uuccaugggaccucccgccucc

SEQ ID NO: 796759 - RNA, 22 nt, Human
uucccaguuggugcuccuggag

SEQ ID NO: 796760 - RNA, 20 nt, Human
uuccccacuccccacaaaca

SEQ ID NO: 796761 - RNA, 24 nt, Human
uugcauguggucguaaaggacuuc

SEQ ID NO: 796762 - RNA, 22 nt, Human
uuggguggguguuuacgugugc

SEQ ID NO: 796763 - RNA, 22 nt, Human
uuugguaaaacuauucucauua

SEQ ID NO: 796764 - RNA, 23 nt, Human
uuuuuguuacauucaguuuccua

SEQ ID NO: 796765 - RNA, 22 nt, Human
aaaaaggcaacacgucagugag

SEQ ID NO: 796766 - RNA, 21 nt, Human
aaagaggggugggcagugcca

SEQ ID NO: 796767 - RNA, 21 nt, Human
aaaugcaguuuucccccugaa

SEQ ID NO: 796768 - RNA, 21 nt, Human
aaccacagaaaggacuagaua

SEQ ID NO: 796769 - RNA, 23 nt, Human
aacucccaggcucaagcaauccu

SEQ ID NO: 796770 - RNA, 21 nt, Human
aagcacagcacacaaaaugaa

SEQ ID NO: 796771 - RNA, 23 nt, Human
aagcacagcacacaaaaugaaac

SEQ ID NO: 796772 - RNA, 20 nt, Human
aagcagcacaagauccgggc

SEQ ID NO: 796773 - RNA, 24 nt, Human
aaguuucagaacauguauguacau

SEQ ID NO: 796774 - RNA, 19 nt, Human
aaucauagcucacugcagc

SEQ ID NO: 796775 - RNA, 21 nt, Human
acaaaaugcccugauuuuucu

SEQ ID NO: 796776 - RNA, 24 nt, Human
accaguccaugaucaaguccacgc

SEQ ID NO: 796777 - RNA, 23 nt, Human
acccagguuggagugcaguggug

SEQ ID NO: 796778 - RNA, 25 nt, Human
acucugucacccagguuggagugca

SEQ ID NO: 796779 - RNA, 19 nt, Human
agaagaaaaaaaaaaagag

SEQ ID NO: 796780 - RNA, 21 nt, Human
agaagaaaaaaaaaaagaggg

SEQ ID NO: 796781 - RNA, 21 nt, Human
agacuucagcaagccagcccc

SEQ ID NO: 796782 - RNA, 21 nt, Human
agcaagccagcccccggcccc

SEQ ID NO: 796783 - RNA, 24 nt, Human
agcacagcacacaaaaugaaacaa

SEQ ID NO: 796784 - RNA, 25 nt, Human
agccagcccccggcccccacacccg

SEQ ID NO: 796785 - RNA, 20 nt, Human
agcccccggcccccacaccc

SEQ ID NO: 796786 - RNA, 21 nt, Human
aggaaaaaaaaagccuucaca

SEQ ID NO: 796787 - RNA, 24 nt, Human
aggaaaaaaaaagccuucacagaa

SEQ ID NO: 796788 - RNA, 19 nt, Human
aggaagagaaauuagucca

SEQ ID NO: 796789 - RNA, 21 nt, Human
aggcagagccuguuuucugug

SEQ ID NO: 796790 - RNA, 24 nt, Human
aggcagugcacguggucgcagggc

SEQ ID NO: 796791 - RNA, 21 nt, Human
aggcuuugaagcacagcacac

SEQ ID NO: 796792 - RNA, 20 nt, Human
agggaacuguccagggaggc

SEQ ID NO: 796793 - RNA, 20 nt, Human
aggguuacuguuuaucucuu

SEQ ID NO: 796794 - RNA, 18 nt, Human
agguuggagugcaguggu

SEQ ID NO: 796795 - RNA, 21 nt, Human
agugcaguggugcaaucauag

SEQ ID NO: 796796 - RNA, 23 nt, Human
agugcaguggugcaaucauagcu

SEQ ID NO: 796797 - RNA, 24 nt, Human
agugcaguggugcaaucauagcuc

SEQ ID NO: 796798 - RNA, 18 nt, Human
auagcucacugcagccuc

SEQ ID NO: 796799 - RNA, 20 nt, Human
augaucaaguccacgccgca

SEQ ID NO: 796800 - RNA, 20 nt, Human
augcaagauuugacaguuaa

SEQ ID NO: 796801 - RNA, 19 nt, Human
augcagaucucgguggcag

SEQ ID NO: 796802 - RNA, 19 nt, Human
auggagcauggcugaaucc

SEQ ID NO: 796803 - RNA, 26 nt, Human
auuagaagaaaaaaaaaaagaggggu

SEQ ID NO: 796804 - RNA, 24 nt, Human
caaaaugaaacaauuuaaaacccc

SEQ ID NO: 796805 - RNA, 27 nt, Human
caagcaauccucauaccucagccuccc

SEQ ID NO: 796806 - RNA, 20 nt, Human
caagccagcccccggccccc

SEQ ID NO: 796807 - RNA, 20 nt, Human
cacaaacgauucccaaaagc

SEQ ID NO: 796808 - RNA, 22 nt, Human
cacaaacgauucccaaaagccu

SEQ ID NO: 796809 - RNA, 18 nt, Human
cacagcacacaaaaugaa

SEQ ID NO: 796810 - RNA, 18 nt, Human
cacaugugaaggcagagc

SEQ ID NO: 796811 - RNA, 24 nt, Human
cacccagguuggagugcaguggug

SEQ ID NO: 796812 - RNA, 24 nt, Human
cacucugucacccagguuggagug

SEQ ID NO: 796813 - RNA, 21 nt, Human
cacugugaggggagaggguca

SEQ ID NO: 796814 - RNA, 22 nt, Human
cagaaagagacugacacucgac

SEQ ID NO: 796815 - RNA, 19 nt, Human
cagaauuagaagaaaaaaa

SEQ ID NO: 796816 - RNA, 23 nt, Human
cagaggcgaacgggcacagguca

SEQ ID NO: 796817 - RNA, 26 nt, Human
cagcaaaacuccaguuuauuaagaca

SEQ ID NO: 796818 - RNA, 23 nt, Human
cagcaagccagcccccggccccc

SEQ ID NO: 796819 - RNA, 24 nt, Human
cagcaagccagcccccggccccca

SEQ ID NO: 796820 - RNA, 18 nt, Human
cagcacacaaaaugaaac

SEQ ID NO: 796821 - RNA, 24 nt, Human
cagccucaaacucccaggcucaag

SEQ ID NO: 796822 - RNA, 21 nt, Human
caggcccugaggcagcgcagg

SEQ ID NO: 796823 - RNA, 19 nt, Human
cagugcacguggucgcagg

SEQ ID NO: 796824 - RNA, 20 nt, Human
caucagacacugguggcacc

SEQ ID NO: 796825 - RNA, 22 nt, Human
caucgugggaacccagaaauau

SEQ ID NO: 796826 - RNA, 23 nt, Human
ccaaggcccugauggugucccug

SEQ ID NO: 796827 - RNA, 18 nt, Human
ccagggaggcggguauga

SEQ ID NO: 796828 - RNA, 21 nt, Human
ccagguagcugggauuacagg

SEQ ID NO: 796829 - RNA, 23 nt, Human
ccagguagcugggauuacaggug

SEQ ID NO: 796830 - RNA, 24 nt, Human
ccagguagcugggauuacaggugu

SEQ ID NO: 796831 - RNA, 25 nt, Human
ccagugccuuucacaaugaggcuuu

SEQ ID NO: 796832 - RNA, 21 nt, Human
cccaaaagccuagcugauguc

SEQ ID NO: 796833 - RNA, 22 nt, Human
cccaaaagccuagcugaugucu

SEQ ID NO: 796834 - RNA, 20 nt, Human
cccaggcucaagcaauccuc

SEQ ID NO: 796835 - RNA, 20 nt, Human
cccaggcucaagcaauccuc

SEQ ID NO: 796836 - RNA, 22 nt, Human
cccagguagcugggauuacagg

SEQ ID NO: 796837 - RNA, 23 nt, Human
cccagguagcugggauuacaggu

SEQ ID NO: 796838 - RNA, 25 nt, Human
ccucauaccucagccucccagguag

SEQ ID NO: 796839 - RNA, 24 nt, Human
ccucccagguagcugggauuacag

SEQ ID NO: 796840 - RNA, 19 nt, Human
cgcaggcagugcacguggu

SEQ ID NO: 796841 - RNA, 24 nt, Human
cucaagcaauccucauaccucagc

SEQ ID NO: 796842 - RNA, 20 nt, Human
cucacaugugaaggcagagc

SEQ ID NO: 796843 - RNA, 24 nt, Human
cucacucugucacccagguuggag

SEQ ID NO: 796844 - RNA, 21 nt, Human
cucacugcagccucaaacucc

SEQ ID NO: 796845 - RNA, 24 nt, Human
cucagccucccagguagcugggau

SEQ ID NO: 796846 - RNA, 18 nt, Human
cuccaaagucauccaaag

SEQ ID NO: 796847 - RNA, 18 nt, Human
cugagguguggccaguga

SEQ ID NO: 796848 - RNA, 23 nt, Human
cugaguccuggacaagcauuuug

SEQ ID NO: 796849 - RNA, 24 nt, Human
cugcagccccgcuguguccaguga

SEQ ID NO: 796850 - RNA, 23 nt, Human
cugcagccucaaacucccaggcu

SEQ ID NO: 796851 - RNA, 23 nt, Human
cugcuaggccaguauauuucugu

SEQ ID NO: 796852 - RNA, 26 nt, Human
cuguggagucgccaggaugcugucau

SEQ ID NO: 796853 - RNA, 24 nt, Human
gaaaaaaaaagccuucacagaaag

SEQ ID NO: 796854 - RNA, 20 nt, Human
gagacagggucucacucugu

SEQ ID NO: 796855 - RNA, 19 nt, Human
gagcacaguuccuuccgug

SEQ ID NO: 796856 - RNA, 21 nt, Human
gaggcaaaccaggcccugagg

SEQ ID NO: 796857 - RNA, 22 nt, Human
gcugugguucuagaccacaggu

SEQ ID NO: 796858 - RNA, 18 nt, Human
ggcaguggcucacuguga

SEQ ID NO: 796859 - RNA, 21 nt, Human
gguagcacgccuuggucuuga

SEQ ID NO: 796860 - RNA, 22 nt, Human
gguaugagugggagugaggaug

SEQ ID NO: 796861 - RNA, 24 nt, Human
gguugggagggggaaggucagggu

SEQ ID NO: 796862 - RNA, 24 nt, Human
gugggcuccuggaaggguuacugu

SEQ ID NO: 796863 - RNA, 23 nt, Human
guuagcugcagccccgcuguguc

SEQ ID NO: 796864 - RNA, 22 nt, Human
uaaaggacauuuccacaaagaa

SEQ ID NO: 796865 - RNA, 20 nt, Human
uaagggaauggaagaaagaa

SEQ ID NO: 796866 - RNA, 23 nt, Human
uaagucguuaacucauuuagaau

SEQ ID NO: 796867 - RNA, 21 nt, Human
uacaaacaagauaaugcaaga

SEQ ID NO: 796868 - RNA, 24 nt, Human
uaccucagccucccagguagcugg

SEQ ID NO: 796869 - RNA, 24 nt, Human
uagcucacugcagccucaaacucc

SEQ ID NO: 796870 - RNA, 19 nt, Human
uagcugcagccccgcugug

SEQ ID NO: 796871 - RNA, 22 nt, Human
uauuaaggauacugccucuaac

SEQ ID NO: 796872 - RNA, 24 nt, Human
uauuuuuuuuugagacagggucuc

SEQ ID NO: 796873 - RNA, 19 nt, Human
ucaaacucccaggcucaag

SEQ ID NO: 796874 - RNA, 21 nt, Human
ucacagaugacuaaaugccag

SEQ ID NO: 796875 - RNA, 24 nt, Human
ucacccagguuggagugcaguggu

SEQ ID NO: 796876 - RNA, 24 nt, Human
ucacucugucacccagguuggagu

SEQ ID NO: 796877 - RNA, 24 nt, Human
ucacugcagccucaaacucccagg

SEQ ID NO: 796878 - RNA, 23 nt, Human
ucagacacugguggcaccaugac

SEQ ID NO: 796879 - RNA, 23 nt, Human
ucagugggcuccuggaaggguua

SEQ ID NO: 796880 - RNA, 19 nt, Human
uccacgccgcagacgagga

SEQ ID NO: 796881 - RNA, 18 nt, Human
uccauggcggaaacggga

SEQ ID NO: 796882 - RNA, 18 nt, Human
ucccaaaagccuagcuga

SEQ ID NO: 796883 - RNA, 18 nt, Human
ucccaggcucaagcaauc

SEQ ID NO: 796884 - RNA, 23 nt, Human
ucccagguagcugggauuacagg

SEQ ID NO: 796885 - RNA, 24 nt, Human
ucccagguagcugggauuacaggu

SEQ ID NO: 796886 - RNA, 22 nt, Human
uccgcaaagaacugccagaacc

SEQ ID NO: 796887 - RNA, 23 nt, Human
ucucacucugucacccagguugg

SEQ ID NO: 796888 - RNA, 24 nt, Human
ucucacucugucacccagguugga

SEQ ID NO: 796889 - RNA, 24 nt, Human
ucugucacccagguuggagugcag

SEQ ID NO: 796890 - RNA, 24 nt, Human
ucuugcugugguucuagaccacag

SEQ ID NO: 796891 - RNA, 23 nt, Human
ugaaagcagaaagaacucugcag

SEQ ID NO: 796892 - RNA, 24 nt, Human
ugaagcacagcacacaaaaugaaa

SEQ ID NO: 796893 - RNA, 21 nt, Human
ugaagucaguuacugccugca

SEQ ID NO: 796894 - RNA, 23 nt, Human
ugaauaaaggguugggaggggga

SEQ ID NO: 796895 - RNA, 19 nt, Human
ugacagugaggagaacgga

SEQ ID NO: 796896 - RNA, 19 nt, Human
ugagaaaaccaaggcccug

SEQ ID NO: 796897 - RNA, 18 nt, Human
ugagaaaagcagcacaag

SEQ ID NO: 796898 - RNA, 22 nt, Human
ugagaaaagcagcacaagaucc

SEQ ID NO: 796899 - RNA, 23 nt, Human
ugagaagacaaaaaacagucugg

SEQ ID NO: 796900 - RNA, 20 nt, Human
ugagacagggucucacucug

SEQ ID NO: 796901 - RNA, 22 nt, Human
ugagacagggucucacucuguc

SEQ ID NO: 796902 - RNA, 23 nt, Human
ugaggggagagggucagaucuug

SEQ ID NO: 796903 - RNA, 19 nt, Human
ugaggugaggcuggcgcag

SEQ ID NO: 796904 - RNA, 19 nt, Human
ugaggugaggcuggcgcag

SEQ ID NO: 796905 - RNA, 21 nt, Human
ugagucugggugugagcugcc

SEQ ID NO: 796906 - RNA, 18 nt, Human
ugaucaaguccacgccgc

SEQ ID NO: 796907 - RNA, 20 nt, Human
ugccagaaccaggccuguga

SEQ ID NO: 796908 - RNA, 23 nt, Human
ugccagggacugugugaagucag

SEQ ID NO: 796909 - RNA, 24 nt, Human
ugccuuucacaaugaggcuuuugg

SEQ ID NO: 796910 - RNA, 19 nt, Human
uggagcauggcugaauccc

SEQ ID NO: 796911 - RNA, 18 nt, Human
uggagugcaguggugcaa

SEQ ID NO: 796912 - RNA, 19 nt, Human
uggagugcaguggugcaau

SEQ ID NO: 796913 - RNA, 21 nt, Human
uggagugcaguggugcaauca

SEQ ID NO: 796914 - RNA, 25 nt, Human
uggccagugagucugggugugagcu

SEQ ID NO: 796915 - RNA, 21 nt, Human
uggcucacugugaggggagag

SEQ ID NO: 796916 - RNA, 23 nt, Human
ugggagggggaaggucaggguug

SEQ ID NO: 796917 - RNA, 18 nt, Human
ugggauuacaggugugca

SEQ ID NO: 796918 - RNA, 20 nt, Human
ugggauuacaggugugcaac

SEQ ID NO: 796919 - RNA, 22 nt, Human
ugggauuacaggugugcacacc

SEQ ID NO: 796920 - RNA, 23 nt, Human
ugggauuacaggugugcacaccu

SEQ ID NO: 796921 - RNA, 24 nt, Human
uggugcaaucauagcucacugcag

SEQ ID NO: 796922 - RNA, 19 nt, Human
uguaugugcucugaguccu

SEQ ID NO: 796923 - RNA, 22 nt, Human
uguccagaggaaaaguccaccg

SEQ ID NO: 796924 - RNA, 21 nt, Human
ugucuaggaagagaaauuagu

SEQ ID NO: 796925 - RNA, 22 nt, Human
ugugcacaccuaauuuuuucag

SEQ ID NO: 796926 - RNA, 21 nt, Human
ugugcugagcugucuaggaag

SEQ ID NO: 796927 - RNA, 22 nt, Human
uuaguuagcuccuaccuguacc

SEQ ID NO: 796928 - RNA, 23 nt, Human
uucaaaaagcugucagcucaggu

SEQ ID NO: 796929 - RNA, 22 nt, Human
uucacagaaagagacugacacu

SEQ ID NO: 796930 - RNA, 22 nt, Human
uucuuuagcagcaaaacuccag

SEQ ID NO: 796931 - RNA, 25 nt, Human
uuuguaguucucacuccuuaggcca

SEQ ID NO: 796932 - RNA, 22 nt, Human
aaaaaaagaaaaaaaaaaagaa

SEQ ID NO: 796933 - RNA, 24 nt, Human
aaaaaaucacaguuccacaaaacu

SEQ ID NO: 796934 - RNA, 18 nt, Human
aaaaagaaaaaagaaaaa

SEQ ID NO: 796935 - RNA, 23 nt, Human
aaaagaaaaaaaaaaagaaaaaa

SEQ ID NO: 796936 - RNA, 20 nt, Human
aaaagaaaaaaaaaucacag

SEQ ID NO: 796937 - RNA, 20 nt, Human
aaaauucuguccaagcucuu

SEQ ID NO: 796938 - RNA, 25 nt, Human
aaacagucaccaaaguaaauaaagc

SEQ ID NO: 796939 - RNA, 22 nt, Human
aacaauaaaagcuuuuagccaa

SEQ ID NO: 796940 - RNA, 22 nt, Human
aacagagcacuaggcacauaua

SEQ ID NO: 796941 - RNA, 19 nt, Human
aagaaacacaacaucaaac

SEQ ID NO: 796942 - RNA, 19 nt, Human
aagcauaaauuccacaacc

SEQ ID NO: 796943 - RNA, 21 nt, Human
aagucuagaaaacuuuagaac

SEQ ID NO: 796944 - RNA, 22 nt, Human
aauaaacagucaagaaacacaa

SEQ ID NO: 796945 - RNA, 24 nt, Human
accaguuuccaucaggauuuauca

SEQ ID NO: 796946 - RNA, 20 nt, Human
acucuuucagccagcaaaau

SEQ ID NO: 796947 - RNA, 26 nt, Human
agaaaaaguagugaagaaaauaucau

SEQ ID NO: 796948 - RNA, 22 nt, Human
agaaaacuuuagaaccuaccaa

SEQ ID NO: 796949 - RNA, 24 nt, Human
agauagaaaaaguagugaagaaaa

SEQ ID NO: 796950 - RNA, 22 nt, Human
agcagaaaagcuagaacuacag

SEQ ID NO: 796951 - RNA, 25 nt, Human
agcaguucuuuuuuuuuuuuccuuu

SEQ ID NO: 796952 - RNA, 30 nt, Human
agcaguucuuuuuuuuuuuuccuuuuucuu

SEQ ID NO: 796953 - RNA, 19 nt, Human
agcaguuucugagcaggaa

SEQ ID NO: 796954 - RNA, 23 nt, Human
agcggugucuguugggcagugcc

SEQ ID NO: 796955 - RNA, 20 nt, Human
agcuacugauuucuaaacaa

SEQ ID NO: 796956 - RNA, 27 nt, Human
agguauucauucuauucacaaauauuu

SEQ ID NO: 796957 - RNA, 22 nt, Human
auaaagcuauaagaagaaaaac

SEQ ID NO: 796958 - RNA, 19 nt, Human
augcauauauaacacagga

SEQ ID NO: 796959 - RNA, 24 nt, Human
auguagguuuuacaauauuccaug

SEQ ID NO: 796960 - RNA, 22 nt, Human
auguggcugacuuugagucccc

SEQ ID NO: 796961 - RNA, 20 nt, Human
caagaaacacaacaucaaac

SEQ ID NO: 796962 - RNA, 21 nt, Human
caagaaacacaacaucaaaca

SEQ ID NO: 796963 - RNA, 24 nt, Human
cacaacaucaaacaauaaaagcuu

SEQ ID NO: 796964 - RNA, 22 nt, Human
cacagcaguucuuuuuuuuuuu

SEQ ID NO: 796965 - RNA, 18 nt, Human
cacauaaugcauauauaa

SEQ ID NO: 796966 - RNA, 22 nt, Human
cauauauaacacaggagaaaac

SEQ ID NO: 796967 - RNA, 22 nt, Human
cauccuaaggacacagcagaaa

SEQ ID NO: 796968 - RNA, 21 nt, Human
caugcaaauuugucauguaaa

SEQ ID NO: 796969 - RNA, 20 nt, Human
cauuacacagcaaguccaua

SEQ ID NO: 796970 - RNA, 23 nt, Human
ccaaauguacaguauccaguaaa

SEQ ID NO: 796971 - RNA, 19 nt, Human
ccacagcaguucuuuuuuu

SEQ ID NO: 796972 - RNA, 21 nt, Human
ccauuuuucuaaaccugcagu

SEQ ID NO: 796973 - RNA, 19 nt, Human
cccacuguguaaguggaau

SEQ ID NO: 796974 - RNA, 22 nt, Human
ccccauaugaugucaacuacca

SEQ ID NO: 796975 - RNA, 19 nt, Human
ccuaaggacacagcagaaa

SEQ ID NO: 796976 - RNA, 20 nt, Human
ccugacuugagcuuggaaga

SEQ ID NO: 796977 - RNA, 24 nt, Human
cuaccaggugcuuguaaguuugag

SEQ ID NO: 796978 - RNA, 22 nt, Human
cucagagaucagaauacgaagc

SEQ ID NO: 796979 - RNA, 24 nt, Human
cucagcaucaugggaggagauaaa

SEQ ID NO: 796980 - RNA, 22 nt, Human
cugcaguuuguucucuuuucua

SEQ ID NO: 796981 - RNA, 22 nt, Human
cuuaagcauacucagaaaugaa

SEQ ID NO: 796982 - RNA, 18 nt, Human
cuuggaaggugggccaag

SEQ ID NO: 796983 - RNA, 23 nt, Human
cuuguacacgacaaacguuuaca

SEQ ID NO: 796984 - RNA, 21 nt, Human
gaaaauuccccauaugauguc

SEQ ID NO: 796985 - RNA, 24 nt, Human
ggaggagauaaaauaauucauucu

SEQ ID NO: 796986 - RNA, 21 nt, Human
ggaggccuuccacauuuuugg

SEQ ID NO: 796987 - RNA, 25 nt, Human
gggaaaaaagacaauuuaaggaagu

SEQ ID NO: 796988 - RNA, 20 nt, Human
gugauggugaagaagaugga

SEQ ID NO: 796989 - RNA, 18 nt, Human
uaaacaaaacacacgauc

SEQ ID NO: 796990 - RNA, 21 nt, Human
uaacacaggagaaaaccugua

SEQ ID NO: 796991 - RNA, 22 nt, Human
uaacugcaucaaucauuugcug

SEQ ID NO: 796992 - RNA, 18 nt, Human
uaagacuuggugcuuucu

SEQ ID NO: 796993 - RNA, 20 nt, Human
uaagcugguugacaauccca

SEQ ID NO: 796994 - RNA, 26 nt, Human
uaauacaaaaaaaaaaagaaaaaaaa

SEQ ID NO: 796995 - RNA, 21 nt, Human
uaauauggaaacugaggcuuu

SEQ ID NO: 796996 - RNA, 26 nt, Human
uacaaaaaaaaaaagaaaaaaaaaaa

SEQ ID NO: 796997 - RNA, 26 nt, Human
uacagcaugcaauucaaugaggugga

SEQ ID NO: 796998 - RNA, 18 nt, Human
uacauagauuucucaaag

SEQ ID NO: 796999 - RNA, 21 nt, Human
uaccugcacauaaugcauaua

SEQ ID NO: 797000 - RNA, 19 nt, Human
uaccuuugcagaaguauuu

SEQ ID NO: 797001 - RNA, 26 nt, Human
uagaaccuaccaauaaugcuucuagg

SEQ ID NO: 797002 - RNA, 22 nt, Human
uagaacuacagcaugcaauuca

SEQ ID NO: 797003 - RNA, 23 nt, Human
uagauuucucaaagauaacauua

SEQ ID NO: 797004 - RNA, 20 nt, Human
uauauaacacaggagaaaac

SEQ ID NO: 797005 - RNA, 24 nt, Human
ucaaacgcauuuaggaaauucucu

SEQ ID NO: 797006 - RNA, 19 nt, Human
ucaaagauaacauuaaagc

SEQ ID NO: 797007 - RNA, 22 nt, Human
ucaggaagaaacuagauuuuac

SEQ ID NO: 797008 - RNA, 21 nt, Human
uccacaaccuuauaacuaaua

SEQ ID NO: 797009 - RNA, 19 nt, Human
uccacauuuuuggaugcua

SEQ ID NO: 797010 - RNA, 23 nt, Human
ucuaagaaucugccuccaaauuc

SEQ ID NO: 797011 - RNA, 21 nt, Human
ucucaaagauaacauuaaagc

SEQ ID NO: 797012 - RNA, 23 nt, Human
ucucugcugagacugaagcuuaa

SEQ ID NO: 797013 - RNA, 19 nt, Human
ugaagauuuggauacacug

SEQ ID NO: 797014 - RNA, 18 nt, Human
ugaaggacucaagaaaau

SEQ ID NO: 797015 - RNA, 26 nt, Human
ugaaguuucucaaacauuccuuugag

SEQ ID NO: 797016 - RNA, 24 nt, Human
ugaauaaacagucaagaaacacaa

SEQ ID NO: 797017 - RNA, 22 nt, Human
ugaauaugaaaaccauuuuucu

SEQ ID NO: 797018 - RNA, 21 nt, Human
ugagaucggggguauaggugu

SEQ ID NO: 797019 - RNA, 21 nt, Human
uggaugguacugaauucugau

SEQ ID NO: 797020 - RNA, 19 nt, Human
uggcaugaaagguauucau

SEQ ID NO: 797021 - RNA, 19 nt, Human
ugguacaguauuaagaaug

SEQ ID NO: 797022 - RNA, 21 nt, Human
ugguacaguauuaagaaugga

SEQ ID NO: 797023 - RNA, 23 nt, Human
ugguacaguauuaagaauggaag

SEQ ID NO: 797024 - RNA, 20 nt, Human
uggugaagaagauggaguua

SEQ ID NO: 797025 - RNA, 19 nt, Human
ugucauguaaaggaccucu

SEQ ID NO: 797026 - RNA, 22 nt, Human
ugugaaauguggcugacuuuga

SEQ ID NO: 797027 - RNA, 25 nt, Human
uuaaagaacauucauccacugcaua

SEQ ID NO: 797028 - RNA, 22 nt, Human
uuaaggaagugagcaguuucug

SEQ ID NO: 797029 - RNA, 20 nt, Human
uucagacugguaaauuuuua

SEQ ID NO: 797030 - RNA, 19 nt, Human
uuccauuacacagcaaguc

SEQ ID NO: 797031 - RNA, 20 nt, Human
uugagucccccacuguguaa

SEQ ID NO: 797032 - RNA, 21 nt, Human
uuugcuguucucuacauuugc

SEQ ID NO: 797033 - RNA, 25 nt, Human
aaaaaagaaaaacccauucaaaaaa

SEQ ID NO: 797034 - RNA, 24 nt, Human
aaagugcugggauuacaggcauga

SEQ ID NO: 797035 - RNA, 24 nt, Human
aaagugcugggauuacagguguga

SEQ ID NO: 797036 - RNA, 22 nt, Human
aaauacaguauaacaacuauuu

SEQ ID NO: 797037 - RNA, 20 nt, Human
aacauagugagacccuuucu

SEQ ID NO: 797038 - RNA, 23 nt, Human
aagaaucacuugagcccaggagg

SEQ ID NO: 797039 - RNA, 22 nt, Human
aaguagcugggauuacaggcau

SEQ ID NO: 797040 - RNA, 25 nt, Human
aagugauucuccugccuuagccucc

SEQ ID NO: 797041 - RNA, 18 nt, Human
aagugcugggauuacagg

SEQ ID NO: 797042 - RNA, 19 nt, Human
aagugcugggauuacaggc

SEQ ID NO: 797043 - RNA, 21 nt, Human
aagugcugggauuacaggcau

SEQ ID NO: 797044 - RNA, 19 nt, Human
aagugcugggauuacaggu

SEQ ID NO: 797045 - RNA, 20 nt, Human
aaucacuugagcccaggagg

SEQ ID NO: 797046 - RNA, 24 nt, Human
acaaagugacacccugucucaaaa

SEQ ID NO: 797047 - RNA, 26 nt, Human
acaagucagcaaaaugaggcacagaa

SEQ ID NO: 797048 - RNA, 19 nt, Human
acagacaggguuucaccau

SEQ ID NO: 797049 - RNA, 18 nt, Human
acaggguuucaccauguu

SEQ ID NO: 797050 - RNA, 19 nt, Human
acaggguuucaccauguua

SEQ ID NO: 797051 - RNA, 24 nt, Human
acaggguuucaccauguuaaccag

SEQ ID NO: 797052 - RNA, 22 nt, Human
acaguguggcaggcugacucua

SEQ ID NO: 797053 - RNA, 19 nt, Human
acccaggcuggagugcagu

SEQ ID NO: 797054 - RNA, 19 nt, Human
acccaggcuggagugcagu

SEQ ID NO: 797055 - RNA, 20 nt, Human
acccaggcuggagugcagug

SEQ ID NO: 797056 - RNA, 18 nt, Human
acccugaagcagaggacc

SEQ ID NO: 797057 - RNA, 19 nt, Human
acccugaagcagaggaccc

SEQ ID NO: 797058 - RNA, 24 nt, Human
acccugucucaaaaaaauuauaca

SEQ ID NO: 797059 - RNA, 21 nt, Human
accgcaccuggccacuuggcu

SEQ ID NO: 797060 - RNA, 18 nt, Human
accuguaaccccagcacc

SEQ ID NO: 797061 - RNA, 21 nt, Human
acuacaggugugugccaccau

SEQ ID NO: 797062 - RNA, 24 nt, Human
acucaaaaaaaaacaauaaaaaua

SEQ ID NO: 797063 - RNA, 24 nt, Human
acuccagccugggggacaaaguga

SEQ ID NO: 797064 - RNA, 18 nt, Human
acucugucacccaggcug

SEQ ID NO: 797065 - RNA, 25 nt, Human
acucugucacccaggcuggagugca

SEQ ID NO: 797066 - RNA, 20 nt, Human
acugacuuauagaaugaugu

SEQ ID NO: 797067 - RNA, 18 nt, Human
acugcacuccagccuggg

SEQ ID NO: 797068 - RNA, 18 nt, Human
acugcacuccagccuggg

SEQ ID NO: 797069 - RNA, 28 nt, Human
acuggucaguccuuuucaagauuucucu

SEQ ID NO: 797070 - RNA, 20 nt, Human
acuucuggugacccugaaau

SEQ ID NO: 797071 - RNA, 22 nt, Human
agaaaauacucaaaaaaaaaca

SEQ ID NO: 797072 - RNA, 23 nt, Human
agaaguucaagaccagccugggc

SEQ ID NO: 797073 - RNA, 21 nt, Human
agacaacagggauuguaagcc

SEQ ID NO: 797074 - RNA, 19 nt, Human
agcagcgaagccggaaaga

SEQ ID NO: 797075 - RNA, 20 nt, Human
agccagcccuccauaugugc

SEQ ID NO: 797076 - RNA, 20 nt, Human
agccagcuagaaacugagaa

SEQ ID NO: 797077 - RNA, 22 nt, Human
agccugggcaacauagugagac

SEQ ID NO: 797078 - RNA, 24 nt, Human
agccugggcaacauagugagaccc

SEQ ID NO: 797079 - RNA, 25 nt, Human
agccugggcaacauagugagacccu

SEQ ID NO: 797080 - RNA, 18 nt, Human
aggagggaggaucacuug

SEQ ID NO: 797081 - RNA, 24 nt, Human
aggaucacuugagcccagaaguuc

SEQ ID NO: 797082 - RNA, 25 nt, Human
aggcuggagugcaguggcacgaucu

SEQ ID NO: 797083 - RNA, 25 nt, Human
aggcuggagugcaguggcgcgaucu

SEQ ID NO: 797084 - RNA, 18 nt, Human
agguggaagaaucacuug

SEQ ID NO: 797085 - RNA, 23 nt, Human
agguggaagaaucacuugagccc

SEQ ID NO: 797086 - RNA, 23 nt, Human
aguagcugggauuacaggcaugc

SEQ ID NO: 797087 - RNA, 18 nt, Human
agucaugccuauacuccu

SEQ ID NO: 797088 - RNA, 21 nt, Human
agugcaguggcacgaucucag

SEQ ID NO: 797089 - RNA, 23 nt, Human
agugcaguggcacgaucucagcu

SEQ ID NO: 797090 - RNA, 24 nt, Human
agugcaguggcacgaucucagcuc

SEQ ID NO: 797091 - RNA, 19 nt, Human
agugcaguggcgcgaucuc

SEQ ID NO: 797092 - RNA, 24 nt, Human
agugcaguggcgcgaucucaacuc

SEQ ID NO: 797093 - RNA, 24 nt, Human
aguugggcugggugugguggcuca

SEQ ID NO: 797094 - RNA, 20 nt, Human
aucacaucaaaaacucaacu

SEQ ID NO: 797095 - RNA, 18 nt, Human
aucaguggaggauccugg

SEQ ID NO: 797096 - RNA, 19 nt, Human
augaggcacagaagcuuag

SEQ ID NO: 797097 - RNA, 23 nt, Human
augcagccacaaucaaguaaacu

SEQ ID NO: 797098 - RNA, 24 nt, Human
augggguuucucaguguuggucag

SEQ ID NO: 797099 - RNA, 26 nt, Human
auguuuuguuucuuucccacaggagu

SEQ ID NO: 797100 - RNA, 22 nt, Human
auuaauuugucacugaacagaa

SEQ ID NO: 797101 - RNA, 23 nt, Human
auuuuguauuuuuaguacagaca

SEQ ID NO: 797102 - RNA, 20 nt, Human
auuuuuuuuuugagacaggg

SEQ ID NO: 797103 - RNA, 24 nt, Human
caaccaaucucaaauagaaaauac

SEQ ID NO: 797104 - RNA, 21 nt, Human
caagaauaaugaguugggcug

SEQ ID NO: 797105 - RNA, 22 nt, Human
caagcagccauguugaugaggc

SEQ ID NO: 797106 - RNA, 19 nt, Human
caaguauuaacuacuuacu

SEQ ID NO: 797107 - RNA, 22 nt, Human
caagugauucuccugccuuagc

SEQ ID NO: 797108 - RNA, 22 nt, Human
caccaccaugccuggcuaauuu

SEQ ID NO: 797109 - RNA, 22 nt, Human
caccauguuaaccagguugguc

SEQ ID NO: 797110 - RNA, 24 nt, Human
caccauguuaaccagguuggucuc

SEQ ID NO: 797111 - RNA, 22 nt, Human
cacccaccuuguccucccaaag

SEQ ID NO: 797112 - RNA, 23 nt, Human
cacccaccuuguccucccaaagu

SEQ ID NO: 797113 - RNA, 23 nt, Human
caccugccauggccucccaaagu

SEQ ID NO: 797114 - RNA, 23 nt, Human
cacuccagccugggggacaaagu

SEQ ID NO: 797115 - RNA, 22 nt, Human
cacucugucacccaggcuggag

SEQ ID NO: 797116 - RNA, 23 nt, Human
cacucugucacccaggcuggagu

SEQ ID NO: 797117 - RNA, 23 nt, Human
cacugcaaacucugccucuuggg

SEQ ID NO: 797118 - RNA, 18 nt, Human
cacugcacuccagccugg

SEQ ID NO: 797119 - RNA, 19 nt, Human
cacugcacuccagccuggg

SEQ ID NO: 797120 - RNA, 22 nt, Human
cacugcacuccagccuggggga

SEQ ID NO: 797121 - RNA, 24 nt, Human
cacugcacuccagccugggggaca

SEQ ID NO: 797122 - RNA, 25 nt, Human
cacugcacuccagccugggggacaa

SEQ ID NO: 797123 - RNA, 23 nt, Human
cacuucccucacugucuccaaaa

SEQ ID NO: 797124 - RNA, 19 nt, Human
cagcaauaaauaacuaaua

SEQ ID NO: 797125 - RNA, 19 nt, Human
cagccugggacuacaggug

SEQ ID NO: 797126 - RNA, 20 nt, Human
cagccugggcaacauaguga

SEQ ID NO: 797127 - RNA, 24 nt, Human
caggguuucaccauguuaaccagg

SEQ ID NO: 797128 - RNA, 18 nt, Human
caggugauccaccugcca

SEQ ID NO: 797129 - RNA, 25 nt, Human
caggugugugccaccaugccuggcu

SEQ ID NO: 797130 - RNA, 22 nt, Human
caguguuggucaggcuggucuc

SEQ ID NO: 797131 - RNA, 25 nt, Human
cauaccuguaaccccagcaccuuug

SEQ ID NO: 797132 - RNA, 24 nt, Human
cauagugagacccuuucucuaaaa

SEQ ID NO: 797133 - RNA, 23 nt, Human
caugcaccaccaugccuggcuaa

SEQ ID NO: 797134 - RNA, 21 nt, Human
ccaaagugcugggauuacagg

SEQ ID NO: 797135 - RNA, 21 nt, Human
ccaaagugcugggauuacagg

SEQ ID NO: 797136 - RNA, 23 nt, Human
ccaaagugcugggauuacaggca

SEQ ID NO: 797137 - RNA, 24 nt, Human
ccaaagugcugggauuacaggcau

SEQ ID NO: 797138 - RNA, 24 nt, Human
ccaaagugcugggauuacaggugu

SEQ ID NO: 797139 - RNA, 23 nt, Human
ccaaguagcugggauuacaggca

SEQ ID NO: 797140 - RNA, 24 nt, Human
ccaaguagcugggauuacaggcau

SEQ ID NO: 797141 - RNA, 22 nt, Human
ccaccucagccugggacuacag

SEQ ID NO: 797142 - RNA, 19 nt, Human
ccacugcacuccagccugg

SEQ ID NO: 797143 - RNA, 20 nt, Human
ccacugcacuccagccuggg

SEQ ID NO: 797144 - RNA, 22 nt, Human
ccacugcacuccagccuggggg

SEQ ID NO: 797145 - RNA, 24 nt, Human
ccacugcacuccagccugggggac

SEQ ID NO: 797146 - RNA, 20 nt, Human
ccagagcucucggagccgac

SEQ ID NO: 797147 - RNA, 23 nt, Human
ccagcuagaaacugagaaucuca

SEQ ID NO: 797148 - RNA, 22 nt, Human
ccaugaacaaaacacuccacuu

SEQ ID NO: 797149 - RNA, 24 nt, Human
cccaaagugcugggauuacaggca

SEQ ID NO: 797150 - RNA, 23 nt, Human
cccaaguagcugggauuacaggc

SEQ ID NO: 797151 - RNA, 24 nt, Human
cccaaguagcugggauuacaggca

SEQ ID NO: 797152 - RNA, 20 nt, Human
ccccagcaccuuuggaggcc

SEQ ID NO: 797153 - RNA, 21 nt, Human
cccccagugguccugucucca

SEQ ID NO: 797154 - RNA, 18 nt, Human
ccccugugccaggccaaa

SEQ ID NO: 797155 - RNA, 21 nt, Human
cccgaccucaggugauccacc

SEQ ID NO: 797156 - RNA, 23 nt, Human
cccgaccucaggugauccaccug

SEQ ID NO: 797157 - RNA, 23 nt, Human
cccgaccucaggugauccaccug

SEQ ID NO: 797158 - RNA, 19 nt, Human
ccgacaccagcagcgaagc

SEQ ID NO: 797159 - RNA, 21 nt, Human
ccuauuccacaguguggcagg

SEQ ID NO: 797160 - RNA, 20 nt, Human
ccucagccugggacuacagg

SEQ ID NO: 797161 - RNA, 21 nt, Human
ccucccaccucagccugggac

SEQ ID NO: 797162 - RNA, 24 nt, Human
ccuccuggauucaagugauucucc

SEQ ID NO: 797163 - RNA, 24 nt, Human
ccucuuggguucaagugauccucc

SEQ ID NO: 797164 - RNA, 23 nt, Human
ccuggauucaagugauucuccuc

SEQ ID NO: 797165 - RNA, 23 nt, Human
ccuggauucaagugauucuccug

SEQ ID NO: 797166 - RNA, 18 nt, Human
ccuggccucaagugaucc

SEQ ID NO: 797167 - RNA, 24 nt, Human
ccuggccucaagugauccacccac

SEQ ID NO: 797168 - RNA, 18 nt, Human
ccuuuggaggccaaggag

SEQ ID NO: 797169 - RNA, 23 nt, Human
cgacaccagcagcgaagccggaa

SEQ ID NO: 797170 - RNA, 21 nt, Human
cggagccgacaccagcagcga

SEQ ID NO: 797171 - RNA, 24 nt, Human
cucaagugauccacccaccuuguc

SEQ ID NO: 797172 - RNA, 25 nt, Human
cucaccacaaacuccgccuccugga

SEQ ID NO: 797173 - RNA, 24 nt, Human
cucacucugucacccaggcuggag

SEQ ID NO: 797174 - RNA, 24 nt, Human
cucacugcaaacucugccucuugg

SEQ ID NO: 797175 - RNA, 20 nt, Human
cucagccugggacuacaggu

SEQ ID NO: 797176 - RNA, 19 nt, Human
cucccaccucagccuggga

SEQ ID NO: 797177 - RNA, 20 nt, Human
cuccuggauucaagugauuc

SEQ ID NO: 797178 - RNA, 23 nt, Human
cugccuuagccucccaaguagcu

SEQ ID NO: 797179 - RNA, 27 nt, Human
cuggucaguccuuuucaagauuucucu

SEQ ID NO: 797180 - RNA, 18 nt, Human
cugugcuuguaccacugc

SEQ ID NO: 797181 - RNA, 18 nt, Human
cuguuacccaggcuggag

SEQ ID NO: 797182 - RNA, 23 nt, Human
cuuagccucccaaguagcuggga

SEQ ID NO: 797183 - RNA, 21 nt, Human
cuugcucuguuacccaggcug

SEQ ID NO: 797184 - RNA, 22 nt, Human
cuuggguucaagugauccuccc

SEQ ID NO: 797185 - RNA, 24 nt, Human
cuuguaccacugcacuccagccug

SEQ ID NO: 797186 - RNA, 18 nt, Human
gaccucaggugauccacc

SEQ ID NO: 797187 - RNA, 22 nt, Human
gaccucaggugauccaccugcc

SEQ ID NO: 797188 - RNA, 22 nt, Human
gacuacaggugugugccaccau

SEQ ID NO: 797189 - RNA, 24 nt, Human
gagaugggguuucucaguguuggu

SEQ ID NO: 797190 - RNA, 24 nt, Human
gaucaaaggguucagagguggcca

SEQ ID NO: 797191 - RNA, 24 nt, Human
gaucacuugagcccagaaguucaa

SEQ ID NO: 797192 - RNA, 21 nt, Human
gaucuguuuggcuucuuccuu

SEQ ID NO: 797193 - RNA, 18 nt, Human
gauuacaggcaugagcca

SEQ ID NO: 797194 - RNA, 22 nt, Human
gauuacaggcaugagccaccgc

SEQ ID NO: 797195 - RNA, 23 nt, Human
gauuacaggcaugagccaccgca

SEQ ID NO: 797196 - RNA, 24 nt, Human
gauuacaggcaugcaccaccaugc

SEQ ID NO: 797197 - RNA, 18 nt, Human
gauuacaggugugacccc

SEQ ID NO: 797198 - RNA, 20 nt, Human
gauuacaggugugaccccug

SEQ ID NO: 797199 - RNA, 21 nt, Human
gccaaggagggaggaucacuu

SEQ ID NO: 797200 - RNA, 25 nt, Human
gcucuguuacccaggcuggagugca

SEQ ID NO: 797201 - RNA, 19 nt, Human
gcuggagugcaguggcacg

SEQ ID NO: 797202 - RNA, 19 nt, Human
gcuggagugcaguggcgcg

SEQ ID NO: 797203 - RNA, 19 nt, Human
gcugggugugguggcucau

SEQ ID NO: 797204 - RNA, 22 nt, Human
ggaaauacuuauucauucccuc

SEQ ID NO: 797205 - RNA, 24 nt, Human
ggacuacaggugugugccaccaug

SEQ ID NO: 797206 - RNA, 22 nt, Human
ggauuacaggcaugagccaccg

SEQ ID NO: 797207 - RNA, 24 nt, Human
ggauuacaggcaugcaccaccaug

SEQ ID NO: 797208 - RNA, 24 nt, Human
ggccucaagugauccacccaccuu

SEQ ID NO: 797209 - RNA, 18 nt, Human
ggccugguguugcugcug

SEQ ID NO: 797210 - RNA, 21 nt, Human
ggcucauaccuguaaccccag

SEQ ID NO: 797211 - RNA, 18 nt, Human
gggguuucucaguguugg

SEQ ID NO: 797212 - RNA, 24 nt, Human
gggugugguggcucauaccuguaa

SEQ ID NO: 797213 - RNA, 20 nt, Human
ggucucaaacuccuggccuc

SEQ ID NO: 797214 - RNA, 19 nt, Human
guccucccuuuuggcuugc

SEQ ID NO: 797215 - RNA, 24 nt, Human
gugauccacccaccuuguccuccc

SEQ ID NO: 797216 - RNA, 24 nt, Human
gugauccaccugccauggccuccc

SEQ ID NO: 797217 - RNA, 24 nt, Human
gugauucuccugccuuagccuccc

SEQ ID NO: 797218 - RNA, 24 nt, Human
guuuuguuucuuucccacaggagu

SEQ ID NO: 797219 - RNA, 24 nt, Human
uaaauuuuguauuuuuaguacaga

SEQ ID NO: 797220 - RNA, 23 nt, Human
uaagccagagcucucggagccga

SEQ ID NO: 797221 - RNA, 23 nt, Human
uaaggucuagaaaauggugauuu

SEQ ID NO: 797222 - RNA, 24 nt, Human
uaagucuccaugaacaaaacacuc

SEQ ID NO: 797223 - RNA, 24 nt, Human
uaauagagaugggguuucucagug

SEQ ID NO: 797224 - RNA, 23 nt, Human
uacaagucagcaaaaugaggcac

SEQ ID NO: 797225 - RNA, 25 nt, Human
uacacaacaauauuaaauuccuagg

SEQ ID NO: 797226 - RNA, 22 nt, Human
uacagacaggguuucaccaugu

SEQ ID NO: 797227 - RNA, 22 nt, Human
uacaggcaugagccaccgcacc

SEQ ID NO: 797228 - RNA, 22 nt, Human
uacaggcaugcaccaccaugcc

SEQ ID NO: 797229 - RNA, 22 nt, Human
uaccacugcacuccagccuggg

SEQ ID NO: 797230 - RNA, 21 nt, Human
uacccaggcuggagugcagug

SEQ ID NO: 797231 - RNA, 24 nt, Human
uacccaggcuggagugcaguggcg

SEQ ID NO: 797232 - RNA, 21 nt, Human
uaccuguaaccccagcaccuu

SEQ ID NO: 797233 - RNA, 19 nt, Human
uagaaacugagaaucucaa

SEQ ID NO: 797234 - RNA, 20 nt, Human
uagaacugcaaaaacugggg

SEQ ID NO: 797235 - RNA, 19 nt, Human
uagaaggugagggaauguu

SEQ ID NO: 797236 - RNA, 24 nt, Human
uaguacagacaggguuucaccaug

SEQ ID NO: 797237 - RNA, 21 nt, Human
uaguauguaucucauaucaua

SEQ ID NO: 797238 - RNA, 24 nt, Human
uauaaaauuuauuaugcuuggaau

SEQ ID NO: 797239 - RNA, 23 nt, Human
uauaaucacacugacauaauccc

SEQ ID NO: 797240 - RNA, 24 nt, Human
uaugacugugauuccuccaaguau

SEQ ID NO: 797241 - RNA, 21 nt, Human
ucaaaccagguccaaguaaug

SEQ ID NO: 797242 - RNA, 19 nt, Human
ucaagugauucuccugccu

SEQ ID NO: 797243 - RNA, 23 nt, Human
ucacaucaaaaacucaacuugaa

SEQ ID NO: 797244 - RNA, 27 nt, Human
ucaccacaaacuccgccuccuggauuc

SEQ ID NO: 797245 - RNA, 24 nt, Human
ucacccaggcuggagugcaguggc

SEQ ID NO: 797246 - RNA, 24 nt, Human
ucacucugucacccaggcuggagu

SEQ ID NO: 797247 - RNA, 23 nt, Human
ucacugcaaacucugccucuugg

SEQ ID NO: 797248 - RNA, 24 nt, Human
ucacugcaaacucugccucuuggg

SEQ ID NO: 797249 - RNA, 18 nt, Human
ucagcccuggcugaaauc

SEQ ID NO: 797250 - RNA, 21 nt, Human
ucaggcuggucucaaaauccc

SEQ ID NO: 797251 - RNA, 21 nt, Human
ucaguggaggauccuggaacc

SEQ ID NO: 797252 - RNA, 24 nt, Human
uccacacuucccucacugucucca

SEQ ID NO: 797253 - RNA, 24 nt, Human
uccaucuugcuagcagacuguccu

SEQ ID NO: 797254 - RNA, 23 nt, Human
ucccaaagugcugggauuacagg

SEQ ID NO: 797255 - RNA, 24 nt, Human
ucccaaagugcugggauuacaggc

SEQ ID NO: 797256 - RNA, 24 nt, Human
ucccaaguagcugggauuacaggc

SEQ ID NO: 797257 - RNA, 20 nt, Human
uccucugauuuauugauuuc

SEQ ID NO: 797258 - RNA, 21 nt, Human
uccuggauucaagugauucuc

SEQ ID NO: 797259 - RNA, 24 nt, Human
uccuggauucaagugauucuccug

SEQ ID NO: 797260 - RNA, 24 nt, Human
uccuuuuacgugaauucacuaaua

SEQ ID NO: 797261 - RNA, 23 nt, Human
ucucacucugucacccaggcugg

SEQ ID NO: 797262 - RNA, 24 nt, Human
ucucacucugucacccaggcugga

SEQ ID NO: 797263 - RNA, 26 nt, Human
ucucacucugucacccaggcuggagu

SEQ ID NO: 797264 - RNA, 27 nt, Human
ucucacucugucacccaggcuggagug

SEQ ID NO: 797265 - RNA, 26 nt, Human
ucuccugccuuagccucccaaguagc

SEQ ID NO: 797266 - RNA, 20 nt, Human
ucucuaaaaaaaaaaaaaaa

SEQ ID NO: 797267 - RNA, 24 nt, Human
ucugauagacccauuuuuauuaag

SEQ ID NO: 797268 - RNA, 19 nt, Human
ucugccucuuggguucaag

SEQ ID NO: 797269 - RNA, 24 nt, Human
ucugucacccaggcuggagugcag

SEQ ID NO: 797270 - RNA, 24 nt, Human
ucuguuacccaggcuggagugcag

SEQ ID NO: 797271 - RNA, 19 nt, Human
ucuguuuggcuucuuccuu

SEQ ID NO: 797272 - RNA, 22 nt, Human
ucuucaaaaaagaaaaacccau

SEQ ID NO: 797273 - RNA, 24 nt, Human
ucuucauuucauaguauguaucuc

SEQ ID NO: 797274 - RNA, 23 nt, Human
ucuugcucuguuacccaggcugg

SEQ ID NO: 797275 - RNA, 24 nt, Human
ucuugcucuguuacccaggcugga

SEQ ID NO: 797276 - RNA, 24 nt, Human
ucuuggguucaagugauccuccca

SEQ ID NO: 797277 - RNA, 22 nt, Human
ugaaacaacuccuacugguuga

SEQ ID NO: 797278 - RNA, 25 nt, Human
ugaagcagaggacccaacuaaguca

SEQ ID NO: 797279 - RNA, 18 nt, Human
ugacucuaaacaggcccc

SEQ ID NO: 797280 - RNA, 22 nt, Human
ugacugugauuccuccaaguau

SEQ ID NO: 797281 - RNA, 20 nt, Human
ugagacagggucucacucug

SEQ ID NO: 797282 - RNA, 19 nt, Human
ugagacccuuucucuaaaa

SEQ ID NO: 797283 - RNA, 23 nt, Human
ugagcccagaaguucaagaccag

SEQ ID NO: 797284 - RNA, 20 nt, Human
ugagcccaggaggaacaggg

SEQ ID NO: 797285 - RNA, 20 nt, Human
ugaguugggcuggguguggu

SEQ ID NO: 797286 - RNA, 20 nt, Human
ugauucuccugccuuagccu

SEQ ID NO: 797287 - RNA, 18 nt, Human
ugcagucagcguucagcc

SEQ ID NO: 797288 - RNA, 22 nt, Human
ugcccuuuauagccagcccucc

SEQ ID NO: 797289 - RNA, 24 nt, Human
ugccuuagccucccaaguagcugg

SEQ ID NO: 797290 - RNA, 24 nt, Human
ugcucuguuacccaggcuggagug

SEQ ID NO: 797291 - RNA, 20 nt, Human
ugcugggauuacagguguga

SEQ ID NO: 797292 - RNA, 23 nt, Human
uggagugcaguggcacgaucuca

SEQ ID NO: 797293 - RNA, 24 nt, Human
uggagugcaguggcacgaucucag

SEQ ID NO: 797294 - RNA, 23 nt, Human
uggagugcaguggcgcgaucuca

SEQ ID NO: 797295 - RNA, 23 nt, Human
uggauucaagugauucuccugcc

SEQ ID NO: 797296 - RNA, 24 nt, Human
uggauucaagugauucuccugccu

SEQ ID NO: 797297 - RNA, 24 nt, Human
uggcacgaucucagcucacugcaa

SEQ ID NO: 797298 - RNA, 21 nt, Human
uggccaggagcugcagucagc

SEQ ID NO: 797299 - RNA, 22 nt, Human
uggccucaagugauccacccac

SEQ ID NO: 797300 - RNA, 24 nt, Human
uggcgcgaucucaacucaccacaa

SEQ ID NO: 797301 - RNA, 21 nt, Human
uggcucauaccuguaacccca

SEQ ID NO: 797302 - RNA, 22 nt, Human
uggcucauaccuguaaccccag

SEQ ID NO: 797303 - RNA, 23 nt, Human
uggcucauaccuguaaccccagc

SEQ ID NO: 797304 - RNA, 24 nt, Human
uggcucauaccuguaaccccagca

SEQ ID NO: 797305 - RNA, 18 nt, Human
uggcuguucuuuacuugg

SEQ ID NO: 797306 - RNA, 18 nt, Human
ugggacuacaggugugug

SEQ ID NO: 797307 - RNA, 21 nt, Human
ugggacuacaggugugugcca

SEQ ID NO: 797308 - RNA, 22 nt, Human
ugggacuacaggugugugccac

SEQ ID NO: 797309 - RNA, 24 nt, Human
ugggacuacaggugugugccacca

SEQ ID NO: 797310 - RNA, 25 nt, Human
ugggacuacaggugugugccaccau

SEQ ID NO: 797311 - RNA, 19 nt, Human
ugggaucacaucaaaaacu

SEQ ID NO: 797312 - RNA, 21 nt, Human
ugggaucacaucaaaaacuca

SEQ ID NO: 797313 - RNA, 19 nt, Human
ugggauuacaggcaugagc

SEQ ID NO: 797314 - RNA, 21 nt, Human
ugggauuacaggcaugagcca

SEQ ID NO: 797315 - RNA, 22 nt, Human
ugggauuacaggcaugagccac

SEQ ID NO: 797316 - RNA, 23 nt, Human
ugggauuacaggcaugagccacc

SEQ ID NO: 797317 - RNA, 24 nt, Human
ugggauuacaggcaugagccaccg

SEQ ID NO: 797318 - RNA, 24 nt, Human
ugggauuacaggcaugagccaccg

SEQ ID NO: 797319 - RNA, 21 nt, Human
ugggauuacaggcaugcacca

SEQ ID NO: 797320 - RNA, 24 nt, Human
ugggauuacaggcaugcaccacca

SEQ ID NO: 797321 - RNA, 18 nt, Human
ugggauuacaggugugac

SEQ ID NO: 797322 - RNA, 21 nt, Human
ugggauuacaggugugacccc

SEQ ID NO: 797323 - RNA, 21 nt, Human
ugggauuacaggugugacccc

SEQ ID NO: 797324 - RNA, 22 nt, Human
ugggauuacaggugugaccccu

SEQ ID NO: 797325 - RNA, 23 nt, Human
ugggauuacaggugugaccccug

SEQ ID NO: 797326 - RNA, 23 nt, Human
uggguucaagugauccucccacc

SEQ ID NO: 797327 - RNA, 24 nt, Human
uggguucaagugauccucccaccu

SEQ ID NO: 797328 - RNA, 24 nt, Human
ugguggcucauaccuguaacccca

SEQ ID NO: 797329 - RNA, 18 nt, Human
ugguguggacuuccuauu

SEQ ID NO: 797330 - RNA, 24 nt, Human
uguggcaggcugacucuaaacagg

SEQ ID NO: 797331 - RNA, 18 nt, Human
uguguugucugauagacc

SEQ ID NO: 797332 - RNA, 18 nt, Human
uuaauagagaugggguuu

SEQ ID NO: 797333 - RNA, 20 nt, Human
uuacagauaauauuuacaga

SEQ ID NO: 797334 - RNA, 26 nt, Human
uuacgugaauucacuaauacuaauga

SEQ ID NO: 797335 - RNA, 24 nt, Human
uuaguacagacaggguuucaccau

SEQ ID NO: 797336 - RNA, 23 nt, Human
uucaagugauccucccaccucag

SEQ ID NO: 797337 - RNA, 24 nt, Human
uucaagugauccucccaccucagc

SEQ ID NO: 797338 - RNA, 20 nt, Human
uucaagugauucuccugccu

SEQ ID NO: 797339 - RNA, 24 nt, Human
uucaagugauucuccugccuuagc

SEQ ID NO: 797340 - RNA, 21 nt, Human
uugaaaaauacaguauaacaa

SEQ ID NO: 797341 - RNA, 22 nt, Human
uugagacagggucucacucugu

SEQ ID NO: 797342 - RNA, 24 nt, Human
uugcucuguuacccaggcuggagu

SEQ ID NO: 797343 - RNA, 23 nt, Human
uuguaccacugcacuccagccug

SEQ ID NO: 797344 - RNA, 24 nt, Human
uuuaaacuguggucagacaacagg

SEQ ID NO: 797345 - RNA, 23 nt, Human
uuucugagaggugacaggaggca

SEQ ID NO: 797346 - RNA, 20 nt, Human
uuugcuagaauauuuuaauc

SEQ ID NO: 797347 - RNA, 22 nt, Human
uuugcuagaauauuuuaaucca

SEQ ID NO: 797348 - RNA, 22 nt, Human
uuuggaggccaaggagggagga

SEQ ID NO: 797349 - RNA, 24 nt, Human
uuuuuaguacagacaggguuucac

SEQ ID NO: 797350 - RNA, 20 nt, Human
uuuuuuuugagacagggucu

SEQ ID NO: 797351 - RNA, 18 nt, Human
aaaaagccaggaucauug

SEQ ID NO: 797352 - RNA, 21 nt, Human
aaaaaucaaucagcauuucca

SEQ ID NO: 797353 - RNA, 19 nt, Human
aaaaauccauaaaugccuc

SEQ ID NO: 797354 - RNA, 24 nt, Human
aaaaauccauaaaugccucuaacc

SEQ ID NO: 797355 - RNA, 24 nt, Human
aaaaauucuuaauuccauaauauc

SEQ ID NO: 797356 - RNA, 24 nt, Human
aaaauaauuuauugagauuucauc

SEQ ID NO: 797357 - RNA, 20 nt, Human
aaacagacugcaguuucaug

SEQ ID NO: 797358 - RNA, 21 nt, Human
aacuugaccacagucuucccc

SEQ ID NO: 797359 - RNA, 23 nt, Human
aagauuuucaaagcaccaguuaa

SEQ ID NO: 797360 - RNA, 19 nt, Human
aaggaacucaucucaugac

SEQ ID NO: 797361 - RNA, 19 nt, Human
aaggaagcauuaaccacua

SEQ ID NO: 797362 - RNA, 19 nt, Human
aaguguuaucugcaggcug

SEQ ID NO: 797363 - RNA, 22 nt, Human
acagcccauaguaagucuuaga

SEQ ID NO: 797364 - RNA, 19 nt, Human
acauuucuuuguacaacag

SEQ ID NO: 797365 - RNA, 22 nt, Human
accuucaacucuugagccagaa

SEQ ID NO: 797366 - RNA, 20 nt, Human
acuaaguauaccauguaaga

SEQ ID NO: 797367 - RNA, 18 nt, Human
acucaauuauuuuuaaag

SEQ ID NO: 797368 - RNA, 21 nt, Human
acuguauucuaacagucuguc

SEQ ID NO: 797369 - RNA, 19 nt, Human
agaaggcacuugucuucca

SEQ ID NO: 797370 - RNA, 23 nt, Human
agacggcaagucucagguuucua

SEQ ID NO: 797371 - RNA, 20 nt, Human
agacugcaguuucauguugu

SEQ ID NO: 797372 - RNA, 18 nt, Human
agaggcagguauuaccug

SEQ ID NO: 797373 - RNA, 19 nt, Human
agaggcugaggucccccca

SEQ ID NO: 797374 - RNA, 23 nt, Human
auaaaacacugaugaacaucuca

SEQ ID NO: 797375 - RNA, 18 nt, Human
auggaaguacaaacuuaa

SEQ ID NO: 797376 - RNA, 22 nt, Human
auuaaaaccuuauuuaccccaa

SEQ ID NO: 797377 - RNA, 23 nt, Human
caaaaucgcaguuauuucacagu

SEQ ID NO: 797378 - RNA, 21 nt, Human
caacaaauuacccagcagcac

SEQ ID NO: 797379 - RNA, 19 nt, Human
cacuauguggcauaagggu

SEQ ID NO: 797380 - RNA, 22 nt, Human
cagaaggaagacucgaagccau

SEQ ID NO: 797381 - RNA, 23 nt, Human
cagcagcucuuugcagcaaugac

SEQ ID NO: 797382 - RNA, 19 nt, Human
ccaaaggagaaaaaggucc

SEQ ID NO: 797383 - RNA, 21 nt, Human
ccagccaaauuaacuuccuga

SEQ ID NO: 797384 - RNA, 20 nt, Human
cccaaaggagaaaaaggucc

SEQ ID NO: 797385 - RNA, 22 nt, Human
ccccaaagcaucugaacguacu

SEQ ID NO: 797386 - RNA, 19 nt, Human
cccucucccaaaacacaca

SEQ ID NO: 797387 - RNA, 21 nt, Human
ccucccucucccaaaacacac

SEQ ID NO: 797388 - RNA, 23 nt, Human
cgccacacuggacguuacaaaau

SEQ ID NO: 797389 - RNA, 25 nt, Human
cuaaacacuacaacuaucuguggau

SEQ ID NO: 797390 - RNA, 21 nt, Human
cuagucaguaaaauggaaugc

SEQ ID NO: 797391 - RNA, 21 nt, Human
cuguaccugugagaggcaggu

SEQ ID NO: 797392 - RNA, 21 nt, Human
cuguguugaugcagagcuggg

SEQ ID NO: 797393 - RNA, 22 nt, Human
cuuccccagauaaggaacaccc

SEQ ID NO: 797394 - RNA, 22 nt, Human
gaaagagcuccgaucaccuaca

SEQ ID NO: 797395 - RNA, 19 nt, Human
gaauaauggugagcuugag

SEQ ID NO: 797396 - RNA, 22 nt, Human
gacucccuggguauccuccaaa

SEQ ID NO: 797397 - RNA, 24 nt, Human
gagguacagacauaaaacaggaag

SEQ ID NO: 797398 - RNA, 22 nt, Human
gcaacaccauuucuauaaaaca

SEQ ID NO: 797399 - RNA, 21 nt, Human
gcaucccucccucucccaaaa

SEQ ID NO: 797400 - RNA, 27 nt, Human
gcccauaguaagucuuagaaaccucaa

SEQ ID NO: 797401 - RNA, 23 nt, Human
gccguauuuucuuugcuuagguu

SEQ ID NO: 797402 - RNA, 18 nt, Human
gcuaucuguucauuaccg

SEQ ID NO: 797403 - RNA, 19 nt, Human
guuaucugcaggcugcugu

SEQ ID NO: 797404 - RNA, 22 nt, Human
uaaaaaacagguuuacagccca

SEQ ID NO: 797405 - RNA, 22 nt, Human
uaaaaaagauuuucaaagcacc

SEQ ID NO: 797406 - RNA, 23 nt, Human
uaaaaaaucaccauaauuaccau

SEQ ID NO: 797407 - RNA, 25 nt, Human
uaaacuguuagaaaacguuuuaaca

SEQ ID NO: 797408 - RNA, 21 nt, Human
uaacauaaaacuucaggacuc

SEQ ID NO: 797409 - RNA, 19 nt, Human
uacauggagugcuauggga

SEQ ID NO: 797410 - RNA, 23 nt, Human
uagaaaacaaaccaaccaaaagg

SEQ ID NO: 797411 - RNA, 21 nt, Human
uagaaauaaggucaagaaucu

SEQ ID NO: 797412 - RNA, 22 nt, Human
uagcaaaucauacauugcauuc

SEQ ID NO: 797413 - RNA, 27 nt, Human
uaggaaaacugcuauuugguuggaggg

SEQ ID NO: 797414 - RNA, 25 nt, Human
uauaaagcacuuugggauaaaaggu

SEQ ID NO: 797415 - RNA, 23 nt, Human
ucaacaucagagcuacuacaacu

SEQ ID NO: 797416 - RNA, 23 nt, Human
ucaacucuugagccagaagcugg

SEQ ID NO: 797417 - RNA, 19 nt, Human
ucacuuaggacauucucau

SEQ ID NO: 797418 - RNA, 21 nt, Human
ucagucaugaggcacugaaga

SEQ ID NO: 797419 - RNA, 22 nt, Human
ucaugagauacuaucaguguuu

SEQ ID NO: 797420 - RNA, 18 nt, Human
uccaagaaacagcuguac

SEQ ID NO: 797421 - RNA, 19 nt, Human
uccaagaaacagcuguacc

SEQ ID NO: 797422 - RNA, 20 nt, Human
uccaggugcaaacuugguuu

SEQ ID NO: 797423 - RNA, 18 nt, Human
ucuaacagucugucagcu

SEQ ID NO: 797424 - RNA, 22 nt, Human
ucugugcuuauuuucugcaggg

SEQ ID NO: 797425 - RNA, 22 nt, Human
ugaaauaucaaucagcaucccu

SEQ ID NO: 797426 - RNA, 22 nt, Human
ugacagcaaaggacagcacagu

SEQ ID NO: 797427 - RNA, 18 nt, Human
ugagccagaagcugguac

SEQ ID NO: 797428 - RNA, 19 nt, Human
ugcaaacuugguuucccag

SEQ ID NO: 797429 - RNA, 19 nt, Human
ugcaguacacaaucugugu

SEQ ID NO: 797430 - RNA, 18 nt, Human
ugccccagugcuaucugu

SEQ ID NO: 797431 - RNA, 20 nt, Human
ugcuaucuggaagcuucauu

SEQ ID NO: 797432 - RNA, 19 nt, Human
ugcugaaauuaacucaaag

SEQ ID NO: 797433 - RNA, 19 nt, Human
uggcauaaggguuuaggca

SEQ ID NO: 797434 - RNA, 22 nt, Human
ugucgacugggaagcgaguccc

SEQ ID NO: 797435 - RNA, 23 nt, Human
ugugaaauuuaacagauuccaga

SEQ ID NO: 797436 - RNA, 26 nt, Human
uuaaaaaaucaccauaauuaccauaa

SEQ ID NO: 797437 - RNA, 21 nt, Human
uuaaaggaagcauuaaccacu

SEQ ID NO: 797438 - RNA, 22 nt, Human
uuaccccaauucauccauguau

SEQ ID NO: 797439 - RNA, 21 nt, Human
uucauaacauaaaacuucagg

SEQ ID NO: 797440 - RNA, 19 nt, Human
uucugcaggggaggaaaua

SEQ ID NO: 797441 - RNA, 18 nt, Human
uugaaacucaauggcacu

SEQ ID NO: 797442 - RNA, 18 nt, Human
uugagauuucaucuugua

SEQ ID NO: 797443 - RNA, 26 nt, Human
uugcagcaaugacaggcagggcagag

SEQ ID NO: 797444 - RNA, 19 nt, Human
uugcuggucauuugaaacu

SEQ ID NO: 797445 - RNA, 19 nt, Human
uuuguauuaaacuaaaaug

SEQ ID NO: 797446 - RNA, 20 nt, Human
uuuguuaaaagucaugguuu

SEQ ID NO: 797447 - RNA, 22 nt, Human
aagcaauggggcccaugcuggg

SEQ ID NO: 797448 - RNA, 21 nt, Human
aauacagcagccgcccaagca

SEQ ID NO: 797449 - RNA, 19 nt, Human
acuuccccacaucuccccu

SEQ ID NO: 797450 - RNA, 18 nt, Human
aucuccccugccccuccc

SEQ ID NO: 797451 - RNA, 19 nt, Human
cacaucuccccugccccuc

SEQ ID NO: 797452 - RNA, 22 nt, Human
caccucuucuucuucuucauca

SEQ ID NO: 797453 - RNA, 18 nt, Human
ccaagcaauggggcccau

SEQ ID NO: 797454 - RNA, 20 nt, Human
ccaccucuucuucuucuuca

SEQ ID NO: 797455 - RNA, 21 nt, Human
ccagaguaaaugaaaauacag

SEQ ID NO: 797456 - RNA, 22 nt, Human
cccacaucuccccugccccucc

SEQ ID NO: 797457 - RNA, 22 nt, Human
ccccacaucuccccugccccuc

SEQ ID NO: 797458 - RNA, 25 nt, Human
ccccacaucuccccugccccuccca

SEQ ID NO: 797459 - RNA, 18 nt, Human
ccccugccccucccacgu

SEQ ID NO: 797460 - RNA, 22 nt, Human
ccccugccccucccacguuucc

SEQ ID NO: 797461 - RNA, 21 nt, Human
cccugccccucccacguuucc

SEQ ID NO: 797462 - RNA, 24 nt, Human
ccucuucuucuucuucaucaucug

SEQ ID NO: 797463 - RNA, 23 nt, Human
cuccccugccccucccacguuuc

SEQ ID NO: 797464 - RNA, 18 nt, Human
cuccuggaguccuggacu

SEQ ID NO: 797465 - RNA, 25 nt, Human
gccccucccacguuuccauagucca

SEQ ID NO: 797466 - RNA, 25 nt, Human
ggacuuccccacaucuccccugccc

SEQ ID NO: 797467 - RNA, 20 nt, Human
uaaaugaaaauacagcagcc

SEQ ID NO: 797468 - RNA, 23 nt, Human
uccccacaucuccccugccccuc

SEQ ID NO: 797469 - RNA, 23 nt, Human
uccccugccccucccacguuucc

SEQ ID NO: 797470 - RNA, 19 nt, Human
ugaaaauacagcagccgcc

SEQ ID NO: 797471 - RNA, 21 nt, Human
aaaaaagacaccaauacccac

SEQ ID NO: 797472 - RNA, 21 nt, Human
aaaaagggggggaaugccuaa

SEQ ID NO: 797473 - RNA, 19 nt, Human
aaaagacaccaauacccac

SEQ ID NO: 797474 - RNA, 20 nt, Human
aaaagacaccaauacccaca

SEQ ID NO: 797475 - RNA, 24 nt, Human
aaaaugguaacauuuuuacaacuu

SEQ ID NO: 797476 - RNA, 23 nt, Human
aaacauaaaaauaaaaacugaua

SEQ ID NO: 797477 - RNA, 25 nt, Human
aaacugauaugguaaugccuaaaau

SEQ ID NO: 797478 - RNA, 20 nt, Human
aaagacaccaauacccacaa

SEQ ID NO: 797479 - RNA, 22 nt, Human
aaauaauauuuauagcaaaaua

SEQ ID NO: 797480 - RNA, 20 nt, Human
aaauauggcagucauacaau

SEQ ID NO: 797481 - RNA, 19 nt, Human
aaaugggccuccacaaaga

SEQ ID NO: 797482 - RNA, 26 nt, Human
aacaagaacaagauuaaaauacucau

SEQ ID NO: 797483 - RNA, 22 nt, Human
aacauagugaaacccccaacuc

SEQ ID NO: 797484 - RNA, 18 nt, Human
aaccuucucccugccccc

SEQ ID NO: 797485 - RNA, 19 nt, Human
aacucaaccagugucccug

SEQ ID NO: 797486 - RNA, 18 nt, Human
aacugcaucucguuaaca

SEQ ID NO: 797487 - RNA, 22 nt, Human
aagacaccaauacccacaaaua

SEQ ID NO: 797488 - RNA, 24 nt, Human
aagacagugagacucugucucaaa

SEQ ID NO: 797489 - RNA, 20 nt, Human
aaggugguuaaaaaaaaggg

SEQ ID NO: 797490 - RNA, 21 nt, Human
aagguucuggaucuauucuga

SEQ ID NO: 797491 - RNA, 18 nt, Human
aaugauuacaagaacuua

SEQ ID NO: 797492 - RNA, 24 nt, Human
aauugcuugaacccgggaggugga

SEQ ID NO: 797493 - RNA, 21 nt, Human
acaaagcuuuguuccuaaauu

SEQ ID NO: 797494 - RNA, 22 nt, Human
acaaaguaccaaauauauuuca

SEQ ID NO: 797495 - RNA, 24 nt, Human
acaaaguaccaaauauauuucaac

SEQ ID NO: 797496 - RNA, 18 nt, Human
acaaaugcaaaaacacac

SEQ ID NO: 797497 - RNA, 21 nt, Human
acaagaacaagauuaaaauac

SEQ ID NO: 797498 - RNA, 22 nt, Human
acagugagacucugucucaaaa

SEQ ID NO: 797499 - RNA, 20 nt, Human
acuaaagacaaaaacauuug

SEQ ID NO: 797500 - RNA, 21 nt, Human
acucuacuaaaaauacaaaaa

SEQ ID NO: 797501 - RNA, 22 nt, Human
acugcacuccagccugggcaag

SEQ ID NO: 797502 - RNA, 26 nt, Human
acugcacuccagccugggcaagacag

SEQ ID NO: 797503 - RNA, 24 nt, Human
agcacuuugggaggcugaggcggg

SEQ ID NO: 797504 - RNA, 23 nt, Human
agccgggcaugguggcgcacgcc

SEQ ID NO: 797505 - RNA, 22 nt, Human
agccuggccaacauagugaaac

SEQ ID NO: 797506 - RNA, 24 nt, Human
agccuggccaacauagugaaaccc

SEQ ID NO: 797507 - RNA, 24 nt, Human
agccugggcaagacagugagacuc

SEQ ID NO: 797508 - RNA, 20 nt, Human
aggaguuugagaccagccug

SEQ ID NO: 797509 - RNA, 23 nt, Human
aggcaagguugaaggaaaugaga

SEQ ID NO: 797510 - RNA, 24 nt, Human
aggcaggagaauugcuugaacccg

SEQ ID NO: 797511 - RNA, 24 nt, Human
aggcggguggaccacaaggucagg

SEQ ID NO: 797512 - RNA, 21 nt, Human
aggcugaggcggguggaccac

SEQ ID NO: 797513 - RNA, 22 nt, Human
aggcugggcaugguggcucaug

SEQ ID NO: 797514 - RNA, 24 nt, Human
aggcuuaggcaggagaauugcuug

SEQ ID NO: 797515 - RNA, 24 nt, Human
agguggagguugcggugagcuaag

SEQ ID NO: 797516 - RNA, 22 nt, Human
aucacgauaugacacaucauag

SEQ ID NO: 797517 - RNA, 18 nt, Human
aucucguuaacaucuuuc

SEQ ID NO: 797518 - RNA, 19 nt, Human
augcaucuguaccaacuca

SEQ ID NO: 797519 - RNA, 20 nt, Human
caaaagaacuccaucauagc

SEQ ID NO: 797520 - RNA, 22 nt, Human
caaaaugggccuccacaaagau

SEQ ID NO: 797521 - RNA, 19 nt, Human
caaaugcaaaaacacacuu

SEQ ID NO: 797522 - RNA, 19 nt, Human
caacauagugaaaccccca

SEQ ID NO: 797523 - RNA, 21 nt, Human
caaccagugucccugaauaaa

SEQ ID NO: 797524 - RNA, 19 nt, Human
caacucaaccagugucccu

SEQ ID NO: 797525 - RNA, 23 nt, Human
caagacagugagacucugucuca

SEQ ID NO: 797526 - RNA, 24 nt, Human
caaguaccaccuuuggaagguggg

SEQ ID NO: 797527 - RNA, 24 nt, Human
cacaaggucaggaguuugagacca

SEQ ID NO: 797528 - RNA, 24 nt, Human
cacacagguuaaauaauggccccu

SEQ ID NO: 797529 - RNA, 24 nt, Human
caccagauccacaaguaccaccuu

SEQ ID NO: 797530 - RNA, 20 nt, Human
cacgaaugaaugacaacuga

SEQ ID NO: 797531 - RNA, 18 nt, Human
cacgccuguagucccagc

SEQ ID NO: 797532 - RNA, 20 nt, Human
cacuccagccugggcaagac

SEQ ID NO: 797533 - RNA, 21 nt, Human
cacugcacuccagccugggca

SEQ ID NO: 797534 - RNA, 22 nt, Human
cacugcacuccagccugggcaa

SEQ ID NO: 797535 - RNA, 22 nt, Human
cacugcacuccagccugggcaa

SEQ ID NO: 797536 - RNA, 23 nt, Human
cacugcacuccagccugggcaag

SEQ ID NO: 797537 - RNA, 26 nt, Human
cacugcacuccagccugggcaagaca

SEQ ID NO: 797538 - RNA, 20 nt, Human
cacugcacuccagccugggg

SEQ ID NO: 797539 - RNA, 21 nt, Human
cagaaccaaaaaagucacagc

SEQ ID NO: 797540 - RNA, 22 nt, Human
cagcacuuugggaggcugaggc

SEQ ID NO: 797541 - RNA, 24 nt, Human
cagcacuuugggaggcugaggcgg

SEQ ID NO: 797542 - RNA, 20 nt, Human
cagucaacugagguggguca

SEQ ID NO: 797543 - RNA, 18 nt, Human
cauauuaagccaccaacu

SEQ ID NO: 797544 - RNA, 24 nt, Human
caugacuguaaucccagcacuuug

SEQ ID NO: 797545 - RNA, 20 nt, Human
ccacaaggucaggaguuuga

SEQ ID NO: 797546 - RNA, 24 nt, Human
ccacaaggucaggaguuugagacc

SEQ ID NO: 797547 - RNA, 21 nt, Human
ccacaaguaccaccuuuggaa

SEQ ID NO: 797548 - RNA, 20 nt, Human
ccacugcacuccagccuggg

SEQ ID NO: 797549 - RNA, 21 nt, Human
ccacugcacuccagccugggc

SEQ ID NO: 797550 - RNA, 24 nt, Human
ccacugcacuccagccugggcaag

SEQ ID NO: 797551 - RNA, 26 nt, Human
ccacugcacuccagccugggcaagac

SEQ ID NO: 797552 - RNA, 18 nt, Human
ccccaaugaaaaugguac

SEQ ID NO: 797553 - RNA, 19 nt, Human
cccgggagguggagguugc

SEQ ID NO: 797554 - RNA, 23 nt, Human
ccuggccaacauagugaaacccc

SEQ ID NO: 797555 - RNA, 23 nt, Human
ccuggccaacauagugaaacccc

SEQ ID NO: 797556 - RNA, 25 nt, Human
ccuggccaacauagugaaaccccca

SEQ ID NO: 797557 - RNA, 19 nt, Human
ccuguagucccagcuacuc

SEQ ID NO: 797558 - RNA, 22 nt, Human
ccuguagucccagcuacucgag

SEQ ID NO: 797559 - RNA, 22 nt, Human
cgauaugacacaucauagguac

SEQ ID NO: 797560 - RNA, 22 nt, Human
cgccuguagucccagcuacucg

SEQ ID NO: 797561 - RNA, 24 nt, Human
cgggagguggagguugcggugagc

SEQ ID NO: 797562 - RNA, 20 nt, Human
cuaauaaggcuaacccaaaa

SEQ ID NO: 797563 - RNA, 21 nt, Human
cuagccugaacacaaaaccaa

SEQ ID NO: 797564 - RNA, 24 nt, Human
cucaugacuguaaucccagcacuu

SEQ ID NO: 797565 - RNA, 21 nt, Human
cuguaaucccagcacuuuggg

SEQ ID NO: 797566 - RNA, 25 nt, Human
cuucauaaucacuaucaccgggcac

SEQ ID NO: 797567 - RNA, 18 nt, Human
gaaccaaaaaagucacag

SEQ ID NO: 797568 - RNA, 22 nt, Human
gaaucuuaaaaugaaaggacuc

SEQ ID NO: 797569 - RNA, 22 nt, Human
gaccacaaggucaggaguuuga

SEQ ID NO: 797570 - RNA, 24 nt, Human
gaccacaaggucaggaguuugaga

SEQ ID NO: 797571 - RNA, 20 nt, Human
gacuguaugugugcaugugu

SEQ ID NO: 797572 - RNA, 23 nt, Human
gagaauugcuugaacccgggagg

SEQ ID NO: 797573 - RNA, 23 nt, Human
gagaccagccuggccaacauagu

SEQ ID NO: 797574 - RNA, 19 nt, Human
gagguugcggugagcuaag

SEQ ID NO: 797575 - RNA, 25 nt, Human
gauuauggaaucucauuuucuggaa

SEQ ID NO: 797576 - RNA, 23 nt, Human
gcaaaaugggccuccacaaagau

SEQ ID NO: 797577 - RNA, 18 nt, Human
gccaacauagugaaaccc

SEQ ID NO: 797578 - RNA, 22 nt, Human
gccacugcacuccagccugggc

SEQ ID NO: 797579 - RNA, 24 nt, Human
gccacugcacuccagccugggcaa

SEQ ID NO: 797580 - RNA, 21 nt, Human
gcccaaauauuaccaagccaa

SEQ ID NO: 797581 - RNA, 19 nt, Human
gccuccacaaagauuacca

SEQ ID NO: 797582 - RNA, 20 nt, Human
gccuguagucccagcuacuc

SEQ ID NO: 797583 - RNA, 18 nt, Human
ggagguugcggugagcua

SEQ ID NO: 797584 - RNA, 20 nt, Human
ggagguugcggugagcuaag

SEQ ID NO: 797585 - RNA, 22 nt, Human
ggcaugguggcgcacgccugua

SEQ ID NO: 797586 - RNA, 23 nt, Human
ggcaugguggcucaugacuguaa

SEQ ID NO: 797587 - RNA, 24 nt, Human
ggccacugcacuccagccugggca

SEQ ID NO: 797588 - RNA, 21 nt, Human
ggcucaugacuguaaucccag

SEQ ID NO: 797589 - RNA, 20 nt, Human
gggaaaaaagacaccaauac

SEQ ID NO: 797590 - RNA, 22 nt, Human
gggaaagcugugugcacaaagu

SEQ ID NO: 797591 - RNA, 20 nt, Human
gggcaaaauuauuuuccccu

SEQ ID NO: 797592 - RNA, 23 nt, Human
gguaggcugggcaugguggcuca

SEQ ID NO: 797593 - RNA, 25 nt, Human
ggucagucacuaacugaaggggaau

SEQ ID NO: 797594 - RNA, 23 nt, Human
gguggaccacaaggucaggaguu

SEQ ID NO: 797595 - RNA, 19 nt, Human
gguggagguugcggugagc

SEQ ID NO: 797596 - RNA, 24 nt, Human
gguggcgcacgccuguagucccag

SEQ ID NO: 797597 - RNA, 24 nt, Human
gguggcucaugacuguaaucccag

SEQ ID NO: 797598 - RNA, 19 nt, Human
guacuuagaagggcuucca

SEQ ID NO: 797599 - RNA, 23 nt, Human
guggcucaugacuguaaucccag

SEQ ID NO: 797600 - RNA, 21 nt, Human
guuaaaaaaaagggggggaau

SEQ ID NO: 797601 - RNA, 21 nt, Human
guucaggccacugcacuccag

SEQ ID NO: 797602 - RNA, 22 nt, Human
uaaaaaaaaucaccaguuuuua

SEQ ID NO: 797603 - RNA, 22 nt, Human
uaaaaguuagagacuugcagau

SEQ ID NO: 797604 - RNA, 23 nt, Human
uaaacaaaaucaucaguacugca

SEQ ID NO: 797605 - RNA, 21 nt, Human
uaacccaaaaaaccuagagac

SEQ ID NO: 797606 - RNA, 19 nt, Human
uaagaucuaauaaggcuaa

SEQ ID NO: 797607 - RNA, 18 nt, Human
uaagggaacuaugugucu

SEQ ID NO: 797608 - RNA, 25 nt, Human
uaaucacuaucaccgggcaccagau

SEQ ID NO: 797609 - RNA, 22 nt, Human
uaauuugacuuuuuacuauuaa

SEQ ID NO: 797610 - RNA, 18 nt, Human
uacaucugacuucagaac

SEQ ID NO: 797611 - RNA, 20 nt, Human
uagaagagaguaaagguggu

SEQ ID NO: 797612 - RNA, 24 nt, Human
uaggcaggagaauugcuugaaccc

SEQ ID NO: 797613 - RNA, 22 nt, Human
uauaaaccuucucccugccccc

SEQ ID NO: 797614 - RNA, 23 nt, Human
uaucuugauaacaucaaaaacaa

SEQ ID NO: 797615 - RNA, 20 nt, Human
uauucugcaaauuaagccaa

SEQ ID NO: 797616 - RNA, 24 nt, Human
ucaacuagccugaacacaaaacca

SEQ ID NO: 797617 - RNA, 23 nt, Human
ucaggccacugcacuccagccug

SEQ ID NO: 797618 - RNA, 18 nt, Human
ucaucaguacugcacugu

SEQ ID NO: 797619 - RNA, 25 nt, Human
ucaucugaaauuacuucauaaucac

SEQ ID NO: 797620 - RNA, 21 nt, Human
ucauuauuucuaagguaacac

SEQ ID NO: 797621 - RNA, 19 nt, Human
uccuucuuuuuaauaaguu

SEQ ID NO: 797622 - RNA, 21 nt, Human
ucugcaaauuaagccaacauu

SEQ ID NO: 797623 - RNA, 18 nt, Human
ugaaacccccaacucuac

SEQ ID NO: 797624 - RNA, 21 nt, Human
ugaaacccccaacucuacuaa

SEQ ID NO: 797625 - RNA, 20 nt, Human
ugaaaguaauuuccaauuua

SEQ ID NO: 797626 - RNA, 21 nt, Human
ugaaggaaaugagauauaugc

SEQ ID NO: 797627 - RNA, 19 nt, Human
ugacagucaacugaggugg

SEQ ID NO: 797628 - RNA, 18 nt, Human
ugagaccagccuggccaa

SEQ ID NO: 797629 - RNA, 24 nt, Human
ugaggcggguggaccacaagguca

SEQ ID NO: 797630 - RNA, 25 nt, Human
ugaggcggguggaccacaaggucag

SEQ ID NO: 797631 - RNA, 19 nt, Human
ugcaacuaaagacaaaaac

SEQ ID NO: 797632 - RNA, 24 nt, Human
ugcacaaaugcaaaaacacacuuc

SEQ ID NO: 797633 - RNA, 21 nt, Human
uggaccacaaggucaggaguu

SEQ ID NO: 797634 - RNA, 21 nt, Human
uggcgcacgccuguaguccca

SEQ ID NO: 797635 - RNA, 24 nt, Human
uggcucaugacuguaaucccagca

SEQ ID NO: 797636 - RNA, 19 nt, Human
ugggaggcugaggcgggug

SEQ ID NO: 797637 - RNA, 20 nt, Human
ugggaggcugaggcgggugg

SEQ ID NO: 797638 - RNA, 24 nt, Human
ugggaggcugaggcggguggacca

SEQ ID NO: 797639 - RNA, 24 nt, Human
ugguggcgcacgccuguaguccca

SEQ ID NO: 797640 - RNA, 24 nt, Human
ugguggcucaugacuguaauccca

SEQ ID NO: 797641 - RNA, 19 nt, Human
ugugcauguguccaaauga

SEQ ID NO: 797642 - RNA, 19 nt, Human
ugugugcauguguccaaau

SEQ ID NO: 797643 - RNA, 19 nt, Human
uuaaaugaagcaggaggag

SEQ ID NO: 797644 - RNA, 18 nt, Human
uuaaaugcacaaaugcaa

SEQ ID NO: 797645 - RNA, 27 nt, Human
uuaaccaaaaaaaaaaaaaaaaagugu

SEQ ID NO: 797646 - RNA, 18 nt, Human
uuagccgggcaugguggc

SEQ ID NO: 797647 - RNA, 24 nt, Human
uuaggcaggagaauugcuugaacc

SEQ ID NO: 797648 - RNA, 22 nt, Human
uuccacuugcaaaaugggccuc

SEQ ID NO: 797649 - RNA, 23 nt, Human
uuccacuugcaaaaugggccucc

SEQ ID NO: 797650 - RNA, 21 nt, Human
uugaacacacaaaaacaucaa

SEQ ID NO: 797651 - RNA, 24 nt, Human
uugaacccgggagguggagguugc

SEQ ID NO: 797652 - RNA, 19 nt, Human
uugaauuacaggaacuguu

SEQ ID NO: 797653 - RNA, 20 nt, Human
uugcaacuaaagacaaaaac

SEQ ID NO: 797654 - RNA, 24 nt, Human
uugcuugaacccgggagguggagg

SEQ ID NO: 797655 - RNA, 20 nt, Human
uuuaaacuuacacugaaaga

SEQ ID NO: 797656 - RNA, 19 nt, Human
uuugaacuacuggcccagu

SEQ ID NO: 797657 - RNA, 22 nt, Human
uuuuaauaaguuugcuauauuc

SEQ ID NO: 797658 - RNA, 26 nt, Human
uuuugugacauaaauuaagaugaagu

SEQ ID NO: 797659 - RNA, 20 nt, Human
aaacaacucugcacaaagca

SEQ ID NO: 797660 - RNA, 23 nt, Human
aaaccucuuaaauuccucugccc

SEQ ID NO: 797661 - RNA, 21 nt, Human
aaagcacaaacacaagggagg

SEQ ID NO: 797662 - RNA, 24 nt, Human
aaagcacaaacacaagggaggucu

SEQ ID NO: 797663 - RNA, 18 nt, Human
aacugugguauccaggua

SEQ ID NO: 797664 - RNA, 22 nt, Human
aagcacaaacacaagggagguc

SEQ ID NO: 797665 - RNA, 20 nt, Human
aauaaauaguagaaaaauaa

SEQ ID NO: 797666 - RNA, 20 nt, Human
aauccuuuacuuagaaauuc

SEQ ID NO: 797667 - RNA, 22 nt, Human
acaaaacagcucggggcaacug

SEQ ID NO: 797668 - RNA, 21 nt, Human
acacaaaacagcucggggcaa

SEQ ID NO: 797669 - RNA, 25 nt, Human
acauaacauuucuuuuaaaaccucu

SEQ ID NO: 797670 - RNA, 18 nt, Human
accccuuuggccuugucu

SEQ ID NO: 797671 - RNA, 21 nt, Human
acugcauuacaaacaaagaug

SEQ ID NO: 797672 - RNA, 19 nt, Human
acugcugaaaacuucuccu

SEQ ID NO: 797673 - RNA, 22 nt, Human
acuugcuuguuccgauugacca

SEQ ID NO: 797674 - RNA, 21 nt, Human
agcaauuugguggauaauguc

SEQ ID NO: 797675 - RNA, 18 nt, Human
aggcaggaaaugacucaa

SEQ ID NO: 797676 - RNA, 24 nt, Human
aggugggauaguacagcagucuug

SEQ ID NO: 797677 - RNA, 22 nt, Human
auacagcaacugugguauccag

SEQ ID NO: 797678 - RNA, 20 nt, Human
caaaaaagacuagagaaaaa

SEQ ID NO: 797679 - RNA, 23 nt, Human
caaguaacgguugaacuucucuc

SEQ ID NO: 797680 - RNA, 25 nt, Human
caaugcacacauuuguaucugcaug

SEQ ID NO: 797681 - RNA, 26 nt, Human
cacuacuuuaaaguuacaaugcccca

SEQ ID NO: 797682 - RNA, 20 nt, Human
cagaaccagccucacaucuu

SEQ ID NO: 797683 - RNA, 22 nt, Human
cagagaaagaauacugcauuac

SEQ ID NO: 797684 - RNA, 18 nt, Human
cagguuccgucucugugu

SEQ ID NO: 797685 - RNA, 23 nt, Human
cauugcauacgguuuauuucacu

SEQ ID NO: 797686 - RNA, 19 nt, Human
ccacacacauucuuuacca

SEQ ID NO: 797687 - RNA, 21 nt, Human
ccacacacauucuuuaccaug

SEQ ID NO: 797688 - RNA, 19 nt, Human
ccagccucacaucuucaca

SEQ ID NO: 797689 - RNA, 18 nt, Human
ccccuccccaucucuguc

SEQ ID NO: 797690 - RNA, 23 nt, Human
cccuuacugaggcuguccaaaaa

SEQ ID NO: 797691 - RNA, 19 nt, Human
ccuucuguuaccuuccauu

SEQ ID NO: 797692 - RNA, 21 nt, Human
cucuuuggaacauuccucugg

SEQ ID NO: 797693 - RNA, 23 nt, Human
cucuuuggaacauuccucuggcu

SEQ ID NO: 797694 - RNA, 23 nt, Human
cugccccuccccaucucugucaa

SEQ ID NO: 797695 - RNA, 19 nt, Human
cugggugagcagauuuuuc

SEQ ID NO: 797696 - RNA, 18 nt, Human
cuguauaaaucacaaagc

SEQ ID NO: 797697 - RNA, 22 nt, Human
cuguuacaaaucaaacaguaaa

SEQ ID NO: 797698 - RNA, 21 nt, Human
cuuccauuaguguuauggcag

SEQ ID NO: 797699 - RNA, 20 nt, Human
cuuggcuaacuggcagcagc

SEQ ID NO: 797700 - RNA, 22 nt, Human
cuuuccagaacauucuguagcu

SEQ ID NO: 797701 - RNA, 23 nt, Human
gaaccagccucacaucuucacaa

SEQ ID NO: 797702 - RNA, 22 nt, Human
gagcauaacaugaguuccauac

SEQ ID NO: 797703 - RNA, 22 nt, Human
gauuucuucauuuuccuauuuu

SEQ ID NO: 797704 - RNA, 19 nt, Human
ggaaaauaaauccaacccu

SEQ ID NO: 797705 - RNA, 24 nt, Human
ggagagcugaaugcuucuggcucu

SEQ ID NO: 797706 - RNA, 18 nt, Human
guaccgcuaagaaacaaa

SEQ ID NO: 797707 - RNA, 26 nt, Human
uaaaacaaggaaaauaaauccaaccc

SEQ ID NO: 797708 - RNA, 22 nt, Human
uaaggagagcugaaugcuucug

SEQ ID NO: 797709 - RNA, 19 nt, Human
uacauuguaucauaauacc

SEQ ID NO: 797710 - RNA, 20 nt, Human
uacauuguaucauaauaccc

SEQ ID NO: 797711 - RNA, 23 nt, Human
uaccacacacauucuuuaccaug

SEQ ID NO: 797712 - RNA, 22 nt, Human
uagaaaccuaagaauagcauug

SEQ ID NO: 797713 - RNA, 19 nt, Human
uagaaauucugagaugcau

SEQ ID NO: 797714 - RNA, 19 nt, Human
uaguagaaaaauaauccuu

SEQ ID NO: 797715 - RNA, 21 nt, Human
uauaaacggagauuuaccaca

SEQ ID NO: 797716 - RNA, 21 nt, Human
ucaaacaacucugcacaaagc

SEQ ID NO: 797717 - RNA, 21 nt, Human
ucagucaaaaugggauauuua

SEQ ID NO: 797718 - RNA, 20 nt, Human
ucaguuaaauaagaaauaga

SEQ ID NO: 797719 - RNA, 21 nt, Human
ucaguuaaauaagaaauagag

SEQ ID NO: 797720 - RNA, 21 nt, Human
uccccaucucugucaaacaca

SEQ ID NO: 797721 - RNA, 20 nt, Human
ucugggugagcagauuuuuc

SEQ ID NO: 797722 - RNA, 22 nt, Human
ucuuuggaacauuccucuggcu

SEQ ID NO: 797723 - RNA, 20 nt, Human
ugaaugcuucuggcucuuug

SEQ ID NO: 797724 - RNA, 20 nt, Human
ugacucaaacaacucugcac

SEQ ID NO: 797725 - RNA, 20 nt, Human
ugacucaaacaacucugcac

SEQ ID NO: 797726 - RNA, 18 nt, Human
ugcacaaagcacaaacac

SEQ ID NO: 797727 - RNA, 22 nt, Human
ugcacaaagcacaaacacaagg

SEQ ID NO: 797728 - RNA, 19 nt, Human
ugcuguggguuuuaagccg

SEQ ID NO: 797729 - RNA, 20 nt, Human
uggcguggaggugaggagaa

SEQ ID NO: 797730 - RNA, 20 nt, Human
uggcguggaggugaggagau

SEQ ID NO: 797731 - RNA, 21 nt, Human
uggcguggaggugaggagauu

SEQ ID NO: 797732 - RNA, 23 nt, Human
ugggauaucaguuaaauaagaaa

SEQ ID NO: 797733 - RNA, 22 nt, Human
uguuccgauugaccacauccaa

SEQ ID NO: 797734 - RNA, 18 nt, Human
uuccucugccccucccca

SEQ ID NO: 797735 - RNA, 18 nt, Human
uuuguagucucuaaaaca

SEQ ID NO: 797736 - RNA, 19 nt, Human
uuuuguggaguggggcagu

SEQ ID NO: 797737 - RNA, 19 nt, Human
aaaaaacaaucaagagaca

SEQ ID NO: 797738 - RNA, 18 nt, Human
aaaagcucuaaagccaca

SEQ ID NO: 797739 - RNA, 19 nt, Human
aaaccaaaccaaacccaga

SEQ ID NO: 797740 - RNA, 20 nt, Human
aaagugucacuggccugagg

SEQ ID NO: 797741 - RNA, 24 nt, Human
aaauaaaaccaaaccaaacccaga

SEQ ID NO: 797742 - RNA, 21 nt, Human
aacagccaauaauauagcacu

SEQ ID NO: 797743 - RNA, 22 nt, Human
aacuugcgucccccgguucuuc

SEQ ID NO: 797744 - RNA, 18 nt, Human
aaggcagacugagacauu

SEQ ID NO: 797745 - RNA, 21 nt, Human
aagggcucuucacuccuucag

SEQ ID NO: 797746 - RNA, 22 nt, Human
acaaaagcucuaaagccacaaa

SEQ ID NO: 797747 - RNA, 20 nt, Human
acauucucccaccugggucc

SEQ ID NO: 797748 - RNA, 23 nt, Human
acccaacuuacuaggaaugccac

SEQ ID NO: 797749 - RNA, 20 nt, Human
acuacagcauuuguucacug

SEQ ID NO: 797750 - RNA, 20 nt, Human
acugcauggcaugggauugg

SEQ ID NO: 797751 - RNA, 22 nt, Human
agacaggaaagaaggugcuuaa

SEQ ID NO: 797752 - RNA, 25 nt, Human
agagagaaaaaguacuacuaggaga

SEQ ID NO: 797753 - RNA, 21 nt, Human
agcucuggaaaaugucauuuc

SEQ ID NO: 797754 - RNA, 21 nt, Human
aggaaggagaugcucauugac

SEQ ID NO: 797755 - RNA, 19 nt, Human
aggauagguaaaaagacca

SEQ ID NO: 797756 - RNA, 23 nt, Human
aggcacaauauaacaaaagcucu

SEQ ID NO: 797757 - RNA, 23 nt, Human
aguucacuucuaucaagcuuaaa

SEQ ID NO: 797758 - RNA, 23 nt, Human
caauauaacaaaagcucuaaagc

SEQ ID NO: 797759 - RNA, 22 nt, Human
cacaaugaggagaaacucuuca

SEQ ID NO: 797760 - RNA, 24 nt, Human
caccaggaauugaaauuuacagaa

SEQ ID NO: 797761 - RNA, 26 nt, Human
cagcaaugcucaggaaugacuucuga

SEQ ID NO: 797762 - RNA, 21 nt, Human
ccaaaccauccuucacauucu

SEQ ID NO: 797763 - RNA, 24 nt, Human
ccacuugcggaaaggguugggucc

SEQ ID NO: 797764 - RNA, 21 nt, Human
cccuaguauggccaagggcuc

SEQ ID NO: 797765 - RNA, 19 nt, Human
ccuagaguuuguuacaugu

SEQ ID NO: 797766 - RNA, 23 nt, Human
cucaccccuugguuccucagaug

SEQ ID NO: 797767 - RNA, 21 nt, Human
cucccuaagacccccuuuuca

SEQ ID NO: 797768 - RNA, 21 nt, Human
cugaaaaguugaacaaggugu

SEQ ID NO: 797769 - RNA, 22 nt, Human
cugcagacaaacacgacacgca

SEQ ID NO: 797770 - RNA, 23 nt, Human
cugcgguggcugcgguggcugcg

SEQ ID NO: 797771 - RNA, 19 nt, Human
cuggaguaauuugcgauua

SEQ ID NO: 797772 - RNA, 22 nt, Human
gaaaaaacaaucaagagacagg

SEQ ID NO: 797773 - RNA, 20 nt, Human
gaaauccauggucaaagugg

SEQ ID NO: 797774 - RNA, 24 nt, Human
gaacccacagauggaugguuuuga

SEQ ID NO: 797775 - RNA, 20 nt, Human
gaauucuaggagcuggacag

SEQ ID NO: 797776 - RNA, 24 nt, Human
gagagcccuaguauggccaagggc

SEQ ID NO: 797777 - RNA, 22 nt, Human
gagcagguggcuuguuccuugg

SEQ ID NO: 797778 - RNA, 18 nt, Human
gcaaagguaauaggggaa

SEQ ID NO: 797779 - RNA, 19 nt, Human
gcaaggaaggagaugcuca

SEQ ID NO: 797780 - RNA, 18 nt, Human
gcaagugugcaaacacca

SEQ ID NO: 797781 - RNA, 23 nt, Human
gcgguggcugcgguggcugcggc

SEQ ID NO: 797782 - RNA, 23 nt, Human
gcugacugcagacaaacacgaca

SEQ ID NO: 797783 - RNA, 22 nt, Human
gcugcagauucuacaccggggu

SEQ ID NO: 797784 - RNA, 23 nt, Human
gcugcgguggcugcgguggcugc

SEQ ID NO: 797785 - RNA, 19 nt, Human
ggacuggaaggacggggug

SEQ ID NO: 797786 - RNA, 19 nt, Human
ggacuuuggaaaucaggua

SEQ ID NO: 797787 - RNA, 21 nt, Human
ggagaaacugggcaauguaaa

SEQ ID NO: 797788 - RNA, 19 nt, Human
ggagcucccucuguuucuc

SEQ ID NO: 797789 - RNA, 20 nt, Human
ggccaagggcucuucacucc

SEQ ID NO: 797790 - RNA, 18 nt, Human
ggcgcucgagggcgcggg

SEQ ID NO: 797791 - RNA, 19 nt, Human
ggcugcggcgcugggggag

SEQ ID NO: 797792 - RNA, 21 nt, Human
ggggugggguuccuuaggagc

SEQ ID NO: 797793 - RNA, 20 nt, Human
guggcugaguucccacuccc

SEQ ID NO: 797794 - RNA, 18 nt, Human
guggcugcgguggcugcg

SEQ ID NO: 797795 - RNA, 24 nt, Human
guguaauacacagauaggagaggg

SEQ ID NO: 797796 - RNA, 21 nt, Human
uaaaaccaaaccaaacccaga

SEQ ID NO: 797797 - RNA, 21 nt, Human
uacauguugggacaugcuuug

SEQ ID NO: 797798 - RNA, 27 nt, Human
uaggcacaauauaacaaaagcucuaaa

SEQ ID NO: 797799 - RNA, 21 nt, Human
uauggagcaggaagaaucccc

SEQ ID NO: 797800 - RNA, 18 nt, Human
ucaagcacagucaaauug

SEQ ID NO: 797801 - RNA, 20 nt, Human
ucacaguuccuuuaaggcag

SEQ ID NO: 797802 - RNA, 22 nt, Human
ucagaaaaaacaaucaagagac

SEQ ID NO: 797803 - RNA, 23 nt, Human
ucagaaaaaacaaucaagagaca

SEQ ID NO: 797804 - RNA, 20 nt, Human
ucagaugcugaauauaaacc

SEQ ID NO: 797805 - RNA, 21 nt, Human
uccccgggggaaggagagccc

SEQ ID NO: 797806 - RNA, 23 nt, Human
uccucaucuuccaaaccauccuu

SEQ ID NO: 797807 - RNA, 20 nt, Human
ucuaaagccacaaagacauu

SEQ ID NO: 797808 - RNA, 20 nt, Human
ucucuaaaugacccagaacu

SEQ ID NO: 797809 - RNA, 21 nt, Human
ucucuuaggcauugggccugg

SEQ ID NO: 797810 - RNA, 18 nt, Human
ucugaaaggguuuucuuu

SEQ ID NO: 797811 - RNA, 19 nt, Human
ugaaaaguugaacaaggug

SEQ ID NO: 797812 - RNA, 26 nt, Human
ugaaacagauauggagcaggaagaau

SEQ ID NO: 797813 - RNA, 21 nt, Human
ugaaagcacccuuucuugucu

SEQ ID NO: 797814 - RNA, 20 nt, Human
ugacauuugcuacaaaagga

SEQ ID NO: 797815 - RNA, 20 nt, Human
ugaggaauucuaggagcugg

SEQ ID NO: 797816 - RNA, 23 nt, Human
ugaggagaaacucuucagauaag

SEQ ID NO: 797817 - RNA, 21 nt, Human
ugaggugacauuugcuacaaa

SEQ ID NO: 797818 - RNA, 18 nt, Human
ugaugcugguguccuccu

SEQ ID NO: 797819 - RNA, 19 nt, Human
ugaugcugguguccuccuu

SEQ ID NO: 797820 - RNA, 19 nt, Human
ugcggaaaggguugggucc

SEQ ID NO: 797821 - RNA, 21 nt, Human
ugcgguggcugcggcgcuggg

SEQ ID NO: 797822 - RNA, 20 nt, Human
ugcgguggcugcgguggcug

SEQ ID NO: 797823 - RNA, 19 nt, Human
uggaaggacggggugagga

SEQ ID NO: 797824 - RNA, 18 nt, Human
uggcaaggaaggagaugc

SEQ ID NO: 797825 - RNA, 23 nt, Human
uggcuuguuccuugguuggaagc

SEQ ID NO: 797826 - RNA, 24 nt, Human
ugggaggggaggaacuguacaucu

SEQ ID NO: 797827 - RNA, 24 nt, Human
ugggguaugaaucaaaugagcucc

SEQ ID NO: 797828 - RNA, 23 nt, Human
ugguagggguggugggggagagu

SEQ ID NO: 797829 - RNA, 18 nt, Human
uggugggggagagugccu

SEQ ID NO: 797830 - RNA, 18 nt, Human
ugguggguccuggaguac

SEQ ID NO: 797831 - RNA, 22 nt, Human
ugguuuugauacaggggagagg

SEQ ID NO: 797832 - RNA, 23 nt, Human
ugguuuugauacaggggagaggg

SEQ ID NO: 797833 - RNA, 23 nt, Human
uuaaauaaaaccaaaccaaaccc

SEQ ID NO: 797834 - RNA, 21 nt, Human
uuccucagaugaaagcacccu

SEQ ID NO: 797835 - RNA, 21 nt, Human
uuccuugguuuccgaagagca

SEQ ID NO: 797836 - RNA, 21 nt, Human
uucuaggagcuggacagggcu

SEQ ID NO: 797837 - RNA, 23 nt, Human
uucuguauucugaaaggguuuuc

SEQ ID NO: 797838 - RNA, 18 nt, Human
uugguagggguggugggg

SEQ ID NO: 797839 - RNA, 21 nt, Human
uuuacagaauugguaaugcag

SEQ ID NO: 797840 - RNA, 18 nt, Human
aaaaaggguacaaaggca

SEQ ID NO: 797841 - RNA, 19 nt, Human
aaacaaaccaucccuccca

SEQ ID NO: 797842 - RNA, 22 nt, Human
aaagaaagaaauagggaaaaaa

SEQ ID NO: 797843 - RNA, 21 nt, Human
aagaaagaaauagggaaaaaa

SEQ ID NO: 797844 - RNA, 23 nt, Human
aagguuacagaaccaucagcuaa

SEQ ID NO: 797845 - RNA, 18 nt, Human
aauaaaauaaaggaaaga

SEQ ID NO: 797846 - RNA, 20 nt, Human
acaaaaccagaaaaaaaaaa

SEQ ID NO: 797847 - RNA, 25 nt, Human
acaaaaccagaaaaaaaaaauuaaa

SEQ ID NO: 797848 - RNA, 26 nt, Human
acaaaaccagaaaaaaaaaauuaaaa

SEQ ID NO: 797849 - RNA, 19 nt, Human
accaugcaauccaaaaggu

SEQ ID NO: 797850 - RNA, 19 nt, Human
agcauguucucuagugaag

SEQ ID NO: 797851 - RNA, 25 nt, Human
aggaaagaaagaaauagggaaaaga

SEQ ID NO: 797852 - RNA, 21 nt, Human
aggaacauguucaugccagag

SEQ ID NO: 797853 - RNA, 22 nt, Human
aggaggcacgaaccccaauucc

SEQ ID NO: 797854 - RNA, 21 nt, Human
aggaguaaagcugaauccauu

SEQ ID NO: 797855 - RNA, 19 nt, Human
aggggccacccgcgggagu

SEQ ID NO: 797856 - RNA, 19 nt, Human
auccccaccccccacccca

SEQ ID NO: 797857 - RNA, 23 nt, Human
aucccucccauccccacccccca

SEQ ID NO: 797858 - RNA, 26 nt, Human
auuaaaaaaaaagaaaacugaaaagu

SEQ ID NO: 797859 - RNA, 18 nt, Human
caagagacacuggacaac

SEQ ID NO: 797860 - RNA, 23 nt, Human
caagcuacugcagcuucaaguau

SEQ ID NO: 797861 - RNA, 21 nt, Human
caaguggcuauccugccagug

SEQ ID NO: 797862 - RNA, 21 nt, Human
cacaugcacaagcaucgugug

SEQ ID NO: 797863 - RNA, 18 nt, Human
caccccccaccccauuca

SEQ ID NO: 797864 - RNA, 21 nt, Human
caccccccaccccauucauac

SEQ ID NO: 797865 - RNA, 20 nt, Human
cacuauacuguaaccaaagu

SEQ ID NO: 797866 - RNA, 23 nt, Human
cauacaaaaccagaaaaaaaaaa

SEQ ID NO: 797867 - RNA, 26 nt, Human
cauacaaaaccagaaaaaaaaaauua

SEQ ID NO: 797868 - RNA, 25 nt, Human
cauccccaccccccaccccauucau

SEQ ID NO: 797869 - RNA, 20 nt, Human
caucccucccauccccaccc

SEQ ID NO: 797870 - RNA, 20 nt, Human
caugagcauguuuacauggg

SEQ ID NO: 797871 - RNA, 23 nt, Human
ccaaccaugcaauccaaaaggug

SEQ ID NO: 797872 - RNA, 21 nt, Human
ccaacccugaagcaaggcgua

SEQ ID NO: 797873 - RNA, 23 nt, Human
cccauggacagacaucaacacua

SEQ ID NO: 797874 - RNA, 21 nt, Human
cccucccauccccacccccca

SEQ ID NO: 797875 - RNA, 20 nt, Human
ccuacacaacuuucuguccu

SEQ ID NO: 797876 - RNA, 19 nt, Human
ccucccauccccacccccc

SEQ ID NO: 797877 - RNA, 21 nt, Human
ccucccauccccaccccccac

SEQ ID NO: 797878 - RNA, 22 nt, Human
ccucccauccccaccccccacc

SEQ ID NO: 797879 - RNA, 20 nt, Human
ccuuuuuuuuucuuuuuacc

SEQ ID NO: 797880 - RNA, 19 nt, Human
cgauggcucgggugaacac

SEQ ID NO: 797881 - RNA, 22 nt, Human
cucuguucuuuaaguuaaaaag

SEQ ID NO: 797882 - RNA, 23 nt, Human
cugcugcugucgucuuaauguau

SEQ ID NO: 797883 - RNA, 21 nt, Human
cuguguguauacauauauaua

SEQ ID NO: 797884 - RNA, 20 nt, Human
cuuaauuacuuucaacuuca

SEQ ID NO: 797885 - RNA, 23 nt, Human
cuucuaaacaaaaauaccuacaa

SEQ ID NO: 797886 - RNA, 18 nt, Human
cuuuaaaaagcacaaggu

SEQ ID NO: 797887 - RNA, 24 nt, Human
cuuucaacuucaugagcauguuua

SEQ ID NO: 797888 - RNA, 22 nt, Human
gcgcaugaaauaguucuucuaa

SEQ ID NO: 797889 - RNA, 20 nt, Human
gcuugcugcucuggcugugu

SEQ ID NO: 797890 - RNA, 22 nt, Human
ggaaaaaauaaaaaacacacaa

SEQ ID NO: 797891 - RNA, 23 nt, Human
ggaaaaaauaaaaaacacacaaa

SEQ ID NO: 797892 - RNA, 22 nt, Human
ggcugcuuuuguuugaguaauu

SEQ ID NO: 797893 - RNA, 24 nt, Human
gggaaaaaauaaaaaacacacaag

SEQ ID NO: 797894 - RNA, 24 nt, Human
gugaagggaacaagagacacugga

SEQ ID NO: 797895 - RNA, 20 nt, Human
guggugugugugugugucug

SEQ ID NO: 797896 - RNA, 20 nt, Human
gugguuguugguggugugug

SEQ ID NO: 797897 - RNA, 21 nt, Human
gugugucuguguguauacauu

SEQ ID NO: 797898 - RNA, 18 nt, Human
uaaaaaaaaagaaaacug

SEQ ID NO: 797899 - RNA, 21 nt, Human
uaaaaaacacacaaacuuuca

SEQ ID NO: 797900 - RNA, 25 nt, Human
uaaaaagcacaagguuacagaacca

SEQ ID NO: 797901 - RNA, 28 nt, Human
uaaaaauugcuuuaaaaagcacaagguu

SEQ ID NO: 797902 - RNA, 20 nt, Human
uaaagacacuauacuguaac

SEQ ID NO: 797903 - RNA, 22 nt, Human
uaacaguaguugguguauaggu

SEQ ID NO: 797904 - RNA, 21 nt, Human
uaauuucucccaauagaucuc

SEQ ID NO: 797905 - RNA, 22 nt, Human
uacaaaaccagaaaaaaaaaau

SEQ ID NO: 797906 - RNA, 23 nt, Human
uacaaaaccagaaaaaaaaaauu

SEQ ID NO: 797907 - RNA, 18 nt, Human
uacaaacauaccucuaag

SEQ ID NO: 797908 - RNA, 18 nt, Human
uacaaccuuuuuuuuucu

SEQ ID NO: 797909 - RNA, 24 nt, Human
uacagaaccaucagcuaaaguaaa

SEQ ID NO: 797910 - RNA, 18 nt, Human
uaccuaugcagaauagau

SEQ ID NO: 797911 - RNA, 21 nt, Human
uaccuaugcagaauagauaua

SEQ ID NO: 797912 - RNA, 25 nt, Human
uaguggugguuguugguggugugug

SEQ ID NO: 797913 - RNA, 18 nt, Human
uauaaauauauauacaua

SEQ ID NO: 797914 - RNA, 23 nt, Human
uauacagaaaacaggagagcuuu

SEQ ID NO: 797915 - RNA, 22 nt, Human
uauacucaguguaaaccaaacc

SEQ ID NO: 797916 - RNA, 20 nt, Human
uauauacaguacaauaaaug

SEQ ID NO: 797917 - RNA, 18 nt, Human
uauauauauguauacaua

SEQ ID NO: 797918 - RNA, 23 nt, Human
uauauguauacauaaguuguaua

SEQ ID NO: 797919 - RNA, 24 nt, Human
uauuccauuucuucagcuguuuua

SEQ ID NO: 797920 - RNA, 23 nt, Human
uauucuagugccuguuauaagca

SEQ ID NO: 797921 - RNA, 22 nt, Human
ucaacacuauuccauuucuuca

SEQ ID NO: 797922 - RNA, 24 nt, Human
ucacaggauggagguguuuuguuu

SEQ ID NO: 797923 - RNA, 22 nt, Human
ucaccaccugagccaacccuga

SEQ ID NO: 797924 - RNA, 21 nt, Human
uccaaccaugcaauccaaaag

SEQ ID NO: 797925 - RNA, 20 nt, Human
uccacaugcacaagcaucgu

SEQ ID NO: 797926 - RNA, 22 nt, Human
ucccauccccaccccccacccc

SEQ ID NO: 797927 - RNA, 19 nt, Human
ucccauggacagacaucaa

SEQ ID NO: 797928 - RNA, 21 nt, Human
uccccaccccccaccccauuc

SEQ ID NO: 797929 - RNA, 25 nt, Human
uccuaggcuaggaggcacgaacccc

SEQ ID NO: 797930 - RNA, 23 nt, Human
ucuaaacaaaaauaccuacaaac

SEQ ID NO: 797931 - RNA, 18 nt, Human
ucuaagcauguucucuag

SEQ ID NO: 797932 - RNA, 20 nt, Human
ucuagugccuguuauaagca

SEQ ID NO: 797933 - RNA, 21 nt, Human
ucucccaauagaucucagucc

SEQ ID NO: 797934 - RNA, 20 nt, Human
ucugauagguuuucucucag

SEQ ID NO: 797935 - RNA, 19 nt, Human
ugaaaauguaaagaugagu

SEQ ID NO: 797936 - RNA, 18 nt, Human
ugcuucucugggguaccc

SEQ ID NO: 797937 - RNA, 24 nt, Human
uggacgaacagcacugcaaagcca

SEQ ID NO: 797938 - RNA, 25 nt, Human
uggacgaacagcacugcaaagccac

SEQ ID NO: 797939 - RNA, 22 nt, Human
uggagguguuuuguuugguucu

SEQ ID NO: 797940 - RNA, 23 nt, Human
uggcauuugcacccugaggcaga

SEQ ID NO: 797941 - RNA, 19 nt, Human
ugggugaugaauuacaacc

SEQ ID NO: 797942 - RNA, 18 nt, Human
ugguggugugugugugug

SEQ ID NO: 797943 - RNA, 20 nt, Human
uggugguguguguguguguc

SEQ ID NO: 797944 - RNA, 23 nt, Human
uggugugugugugugucugugug

SEQ ID NO: 797945 - RNA, 26 nt, Human
ugguuguugguggugugugugugugu

SEQ ID NO: 797946 - RNA, 18 nt, Human
uguauaaauauauauaca

SEQ ID NO: 797947 - RNA, 24 nt, Human
uguauacauaaguuguauaaauau

SEQ ID NO: 797948 - RNA, 18 nt, Human
uguauacauauauauaug

SEQ ID NO: 797949 - RNA, 23 nt, Human
uguauacauauauauauguauac

SEQ ID NO: 797950 - RNA, 24 nt, Human
uguauacauauauauauguauaca

SEQ ID NO: 797951 - RNA, 21 nt, Human
uguccugcacaaagucaaaau

SEQ ID NO: 797952 - RNA, 25 nt, Human
ugucuguguguauacauauauauag

SEQ ID NO: 797953 - RNA, 20 nt, Human
uguggcucuguucuuuaagu

SEQ ID NO: 797954 - RNA, 22 nt, Human
uguggcucuguucuuuaaguua

SEQ ID NO: 797955 - RNA, 19 nt, Human
uguguauacauauauauau

SEQ ID NO: 797956 - RNA, 21 nt, Human
uguguauacauauauauaugu

SEQ ID NO: 797957 - RNA, 18 nt, Human
ugugucuguguguauaca

SEQ ID NO: 797958 - RNA, 18 nt, Human
ugugucuguguguauaca

SEQ ID NO: 797959 - RNA, 18 nt, Human
uguguguauacauauaua

SEQ ID NO: 797960 - RNA, 24 nt, Human
uguguguauacauauauauaugua

SEQ ID NO: 797961 - RNA, 25 nt, Human
uguguguauacauauauauauguaa

SEQ ID NO: 797962 - RNA, 18 nt, Human
ugugugucuguguguaua

SEQ ID NO: 797963 - RNA, 19 nt, Human
ugugugugugucugugugu

SEQ ID NO: 797964 - RNA, 22 nt, Human
ugugugugugucuguguguaua

SEQ ID NO: 797965 - RNA, 21 nt, Human
ugugugugugugucugugugu

SEQ ID NO: 797966 - RNA, 22 nt, Human
ugugugugugugucugugugua

SEQ ID NO: 797967 - RNA, 24 nt, Human
uguuucugcugcugucgucuuaau

SEQ ID NO: 797968 - RNA, 22 nt, Human
uuacaaccuuuuuuuuucuuuu

SEQ ID NO: 797969 - RNA, 22 nt, Human
uuaguauuucauuuuguugguu

SEQ ID NO: 797970 - RNA, 25 nt, Human
uucucucaguuuuuuuuuuguuuuu

SEQ ID NO: 797971 - RNA, 24 nt, Human
uugcuagucucagugcuucucugg

SEQ ID NO: 797972 - RNA, 19 nt, Human
uugguggugugugugugug

SEQ ID NO: 797973 - RNA, 24 nt, Human
uuucagugucgucaugguaacagu

SEQ ID NO: 797974 - RNA, 24 nt, Human
uuugguaguuagaucuccaguuug

SEQ ID NO: 797975 - RNA, 22 nt, Human
uuuguugguuuguuuaaauaug

SEQ ID NO: 797976 - RNA, 20 nt, Human
aaaacacagguuuauggaca

SEQ ID NO: 797977 - RNA, 19 nt, Human
aaaccagagguuagcagca

SEQ ID NO: 797978 - RNA, 18 nt, Human
aaagaaacaaauuggaau

SEQ ID NO: 797979 - RNA, 24 nt, Human
aacacacuugccaaauucaaguau

SEQ ID NO: 797980 - RNA, 25 nt, Human
aagaaaaaggcaaauuuaaaaagaa

SEQ ID NO: 797981 - RNA, 28 nt, Human
aagaacacgagagagagaaccgguaccc

SEQ ID NO: 797982 - RNA, 21 nt, Human
aagacuccaacgaacaggaua

SEQ ID NO: 797983 - RNA, 19 nt, Human
aagcacacacugggcaaca

SEQ ID NO: 797984 - RNA, 20 nt, Human
aauuugugaucacuguucuc

SEQ ID NO: 797985 - RNA, 19 nt, Human
acaagcgugcgcuagaagc

SEQ ID NO: 797986 - RNA, 22 nt, Human
acacgagagagagaacaaaucc

SEQ ID NO: 797987 - RNA, 22 nt, Human
acaguaaugcaaaaggcauccu

SEQ ID NO: 797988 - RNA, 24 nt, Human
agaagacauacaguaaugcaaaag

SEQ ID NO: 797989 - RNA, 25 nt, Human
agacaagacuccaacgaaccgacgc

SEQ ID NO: 797990 - RNA, 18 nt, Human
agcacaguagugucugua

SEQ ID NO: 797991 - RNA, 23 nt, Human
agcuuacaccacuaagaguaagc

SEQ ID NO: 797992 - RNA, 22 nt, Human
agggaggauucauuuccccacc

SEQ ID NO: 797993 - RNA, 18 nt, Human
auggauuuuuacugagcc

SEQ ID NO: 797994 - RNA, 24 nt, Human
caaaagguggagaauaagcaaugc

SEQ ID NO: 797995 - RNA, 19 nt, Human
caaagccaccaacguaacu

SEQ ID NO: 797996 - RNA, 21 nt, Human
caaaggagacacugaacagug

SEQ ID NO: 797997 - RNA, 25 nt, Human
cacaguagugucuguaaauaugauc

SEQ ID NO: 797998 - RNA, 24 nt, Human
cagaacuugggcuguucucccugg

SEQ ID NO: 797999 - RNA, 23 nt, Human
cagcugcaccauuuuuacagaac

SEQ ID NO: 798000 - RNA, 19 nt, Human
caggauagaucugagaaga

SEQ ID NO: 798001 - RNA, 23 nt, Human
caggcaaacacaaagcugcucca

SEQ ID NO: 798002 - RNA, 22 nt, Human
cauccagaaugcugcuugcaau

SEQ ID NO: 798003 - RNA, 21 nt, Human
cucugggcaagcaagugugga

SEQ ID NO: 798004 - RNA, 19 nt, Human
cugugcaagcuggcaaaac

SEQ ID NO: 798005 - RNA, 21 nt, Human
cuugcaggggaugauaagcac

SEQ ID NO: 798006 - RNA, 23 nt, Human
gaaagaacacgagagagagaaca

SEQ ID NO: 798007 - RNA, 20 nt, Human
gcuagaagcagggacuguca

SEQ ID NO: 798008 - RNA, 18 nt, Human
gcuggaccucuucagccu

SEQ ID NO: 798009 - RNA, 23 nt, Human
gcuggcuguucuaggaaaguaag

SEQ ID NO: 798010 - RNA, 20 nt, Human
ggaagaaagaacacgagaga

SEQ ID NO: 798011 - RNA, 21 nt, Human
ggagacaagacuccaacgaac

SEQ ID NO: 798012 - RNA, 21 nt, Human
ggauagaucugagaagaagcu

SEQ ID NO: 798013 - RNA, 23 nt, Human
gggaggauucauuuccccaccau

SEQ ID NO: 798014 - RNA, 21 nt, Human
gugcaagcuggcaaaacacag

SEQ ID NO: 798015 - RNA, 24 nt, Human
uaaauaaugucuugaacacauucc

SEQ ID NO: 798016 - RNA, 22 nt, Human
uaaauaucuagugcaaaaugau

SEQ ID NO: 798017 - RNA, 23 nt, Human
uaagcugaagaagggccaaagca

SEQ ID NO: 798018 - RNA, 21 nt, Human
uaaggaagaaagaacacgaga

SEQ ID NO: 798019 - RNA, 20 nt, Human
uaaguauacaauaaaucaca

SEQ ID NO: 798020 - RNA, 18 nt, Human
uacaccacuaagaguaag

SEQ ID NO: 798021 - RNA, 22 nt, Human
uacaccacuaagaguaagcuga

SEQ ID NO: 798022 - RNA, 25 nt, Human
uacccaacccauauuuuuccgucuu

SEQ ID NO: 798023 - RNA, 25 nt, Human
uagcagcauuuuucuauaaagaacc

SEQ ID NO: 798024 - RNA, 18 nt, Human
uauuagggaugggucagg

SEQ ID NO: 798025 - RNA, 23 nt, Human
uauuagggaugggucaggcaaaa

SEQ ID NO: 798026 - RNA, 24 nt, Human
uauuuaaugaauuuuuaaaaaauu

SEQ ID NO: 798027 - RNA, 24 nt, Human
uccauaaucacacagggccggggc

SEQ ID NO: 798028 - RNA, 22 nt, Human
ucuacaaucaguggagaagaac

SEQ ID NO: 798029 - RNA, 22 nt, Human
ucuagugcaaaaugauacuaaa

SEQ ID NO: 798030 - RNA, 18 nt, Human
ucucugggcaagcaagug

SEQ ID NO: 798031 - RNA, 21 nt, Human
ugagaagaagcuggcuguucu

SEQ ID NO: 798032 - RNA, 23 nt, Human
ugagagguaaauaucuagugcaa

SEQ ID NO: 798033 - RNA, 19 nt, Human
ugcaaagccaccaacguaa

SEQ ID NO: 798034 - RNA, 20 nt, Human
ugggaauuauuuaccugugc

SEQ ID NO: 798035 - RNA, 19 nt, Human
uguucuaggaaaguaagag

SEQ ID NO: 798036 - RNA, 26 nt, Human
uuaaaaagaaauaaaaguucaaaaaa

SEQ ID NO: 798037 - RNA, 20 nt, Human
uucaaaugaugaguaagaaa

SEQ ID NO: 798038 - RNA, 18 nt, Human
uucuaaguuuauuaggga

SEQ ID NO: 798039 - RNA, 24 nt, Human
aaaaaaaacacacacgaaaaaaga

SEQ ID NO: 798040 - RNA, 25 nt, Human
aaaaaaaaggagguugaugaagaaa

SEQ ID NO: 798041 - RNA, 26 nt, Human
aaaaaaaaggagguugaugaagaaaa

SEQ ID NO: 798042 - RNA, 20 nt, Human
aaaaaaaauucccuaaucgc

SEQ ID NO: 798043 - RNA, 19 nt, Human
aaaaaaacacacacgaaaa

SEQ ID NO: 798044 - RNA, 22 nt, Human
aaaaaaagaaaaaggaagaaaa

SEQ ID NO: 798045 - RNA, 27 nt, Human
aaaaaggaagaaaacggguaaaaaaaa

SEQ ID NO: 798046 - RNA, 23 nt, Human
aaaaaggagguugaugaagaaaa

SEQ ID NO: 798047 - RNA, 23 nt, Human
aaaagaaagaaaaaaagaaaaag

SEQ ID NO: 798048 - RNA, 22 nt, Human
aaacaccaccacaccaguucuu

SEQ ID NO: 798049 - RNA, 22 nt, Human
aaacaccaccacaccaguucuu

SEQ ID NO: 798050 - RNA, 19 nt, Human
aaaccccaguccccuucca

SEQ ID NO: 798051 - RNA, 26 nt, Human
aaauaucuccuuggcucacuuucucc

SEQ ID NO: 798052 - RNA, 18 nt, Human
aacccauuccuccccccg

SEQ ID NO: 798053 - RNA, 25 nt, Human
aacccauuccuccccccgcuacuuu

SEQ ID NO: 798054 - RNA, 23 nt, Human
aaccccaguccccuuccauccac

SEQ ID NO: 798055 - RNA, 18 nt, Human
aacuucccccccacucuc

SEQ ID NO: 798056 - RNA, 19 nt, Human
aacuucccccccacucucc

SEQ ID NO: 798057 - RNA, 21 nt, Human
aagaaaaaaagaaaaagaaga

SEQ ID NO: 798058 - RNA, 22 nt, Human
aagaaaaaaagaaaaagaagaa

SEQ ID NO: 798059 - RNA, 21 nt, Human
aagaaaaagaagaaaaaaaga

SEQ ID NO: 798060 - RNA, 24 nt, Human
aagaaaacaccaccacaccaguuc

SEQ ID NO: 798061 - RNA, 22 nt, Human
aagaaacccauuccuccccccg

SEQ ID NO: 798062 - RNA, 20 nt, Human
aagaagaaaaaaagaaaaaa

SEQ ID NO: 798063 - RNA, 22 nt, Human
aagaagaaaaaaagaaaaagga

SEQ ID NO: 798064 - RNA, 19 nt, Human
aaggcucggggugccuuuc

SEQ ID NO: 798065 - RNA, 21 nt, Human
aaugcaacugcagcuuugauc

SEQ ID NO: 798066 - RNA, 19 nt, Human
aauuccucuccccagccuc

SEQ ID NO: 798067 - RNA, 20 nt, Human
acacacgaaaaaagaaagaa

SEQ ID NO: 798068 - RNA, 20 nt, Human
acacgaaaaaagaaagaaaa

SEQ ID NO: 798069 - RNA, 18 nt, Human
acauggucaauuccucuc

SEQ ID NO: 798070 - RNA, 18 nt, Human
acccauuccuccccccgc

SEQ ID NO: 798071 - RNA, 19 nt, Human
agaaaaaaagaaaaagaag

SEQ ID NO: 798072 - RNA, 21 nt, Human
agaaaaagaagaaaaaaagaa

SEQ ID NO: 798073 - RNA, 25 nt, Human
agaaaaagaagaaaaaaagaaaaag

SEQ ID NO: 798074 - RNA, 21 nt, Human
agaaagaaaaaaagaaaaaga

SEQ ID NO: 798075 - RNA, 22 nt, Human
agagaaaaaugaacauacuuuu

SEQ ID NO: 798076 - RNA, 23 nt, Human
agcgcagcugcuccgcgccgccc

SEQ ID NO: 798077 - RNA, 23 nt, Human
aggaagaaaacggguaaaaaaaa

SEQ ID NO: 798078 - RNA, 20 nt, Human
aggugauggaaguugagacu

SEQ ID NO: 798079 - RNA, 24 nt, Human
aucauccuuuuuuuuggggggggg

SEQ ID NO: 798080 - RNA, 19 nt, Human
auccugucuccuucccucc

SEQ ID NO: 798081 - RNA, 20 nt, Human
caaauuaaaaaaaacacaca

SEQ ID NO: 798082 - RNA, 28 nt, Human
caacauaggcacaaauccaacugugcuc

SEQ ID NO: 798083 - RNA, 19 nt, Human
caacuucccccccacucuc

SEQ ID NO: 798084 - RNA, 25 nt, Human
caagaagaaacccauuccucccccc

SEQ ID NO: 798085 - RNA, 20 nt, Human
cacccaacagccaccaccac

SEQ ID NO: 798086 - RNA, 24 nt, Human
cacccaacagccaccaccaccaaa

SEQ ID NO: 798087 - RNA, 24 nt, Human
caccggcggcagcucuugccagcc

SEQ ID NO: 798088 - RNA, 21 nt, Human
caccuuccccucuccccucca

SEQ ID NO: 798089 - RNA, 23 nt, Human
caccuuccccucuccccuccaaa

SEQ ID NO: 798090 - RNA, 22 nt, Human
cacucuccauccuuccggccgg

SEQ ID NO: 798091 - RNA, 21 nt, Human
cagacugaucacagcaacauc

SEQ ID NO: 798092 - RNA, 21 nt, Human
cagccgguaguggcuccggga

SEQ ID NO: 798093 - RNA, 23 nt, Human
ccaacagccaccaccaccaaaaa

SEQ ID NO: 798094 - RNA, 22 nt, Human
ccacccggccagccaccuuccc

SEQ ID NO: 798095 - RNA, 24 nt, Human
ccagcccccggguccccuucuccu

SEQ ID NO: 798096 - RNA, 23 nt, Human
cccccaaucaaugccucaaucug

SEQ ID NO: 798097 - RNA, 24 nt, Human
cccccaaucaaugccucaaucugc

SEQ ID NO: 798098 - RNA, 23 nt, Human
ccccccgcuacuuuuuuuuuuuc

SEQ ID NO: 798099 - RNA, 20 nt, Human
cccgcccccacccccagcac

SEQ ID NO: 798100 - RNA, 22 nt, Human
cccgcccccacccccagcaccc

SEQ ID NO: 798101 - RNA, 18 nt, Human
cccggccagccaccuucc

SEQ ID NO: 798102 - RNA, 18 nt, Human
cccuccaaacuccgguua

SEQ ID NO: 798103 - RNA, 21 nt, Human
cccucugcucucuccccucuu

SEQ ID NO: 798104 - RNA, 20 nt, Human
cccugccagcccccgggucc

SEQ ID NO: 798105 - RNA, 18 nt, Human
ccgcgccgcccuuagcgc

SEQ ID NO: 798106 - RNA, 23 nt, Human
ccucugcucucuccccucuuuuu

SEQ ID NO: 798107 - RNA, 21 nt, Human
ccuuccccucuccccuccaaa

SEQ ID NO: 798108 - RNA, 18 nt, Human
ccuuuccuuccucugucc

SEQ ID NO: 798109 - RNA, 21 nt, Human
cgcuacuuuuuuuuuuucuuu

SEQ ID NO: 798110 - RNA, 18 nt, Human
cgguggccccugccagcc

SEQ ID NO: 798111 - RNA, 19 nt, Human
cuagcuuccaaaagcuccu

SEQ ID NO: 798112 - RNA, 21 nt, Human
cucugcucucuccccucuuuu

SEQ ID NO: 798113 - RNA, 26 nt, Human
cucugcucucuccccucuuuuucucc

SEQ ID NO: 798114 - RNA, 20 nt, Human
cucuucucauccuucucaaa

SEQ ID NO: 798115 - RNA, 19 nt, Human
cuuagcgccaucgcccugg

SEQ ID NO: 798116 - RNA, 23 nt, Human
gagcaacuucccccccacucucc

SEQ ID NO: 798117 - RNA, 19 nt, Human
gaggaaaauuucaaggcuc

SEQ ID NO: 798118 - RNA, 20 nt, Human
gauggaaguugagacugggg

SEQ ID NO: 798119 - RNA, 20 nt, Human
gccaccaccaccaaaaaaaa

SEQ ID NO: 798120 - RNA, 22 nt, Human
gcccccacccccagcacccggu

SEQ ID NO: 798121 - RNA, 28 nt, Human
gcgggggcgggggcgggggcggagguag

SEQ ID NO: 798122 - RNA, 23 nt, Human
ggcagaaaccccaguccccuucc

SEQ ID NO: 798123 - RNA, 20 nt, Human
ggccccugccagcccccggg

SEQ ID NO: 798124 - RNA, 21 nt, Human
ggcgggggcgggggcgggggc

SEQ ID NO: 798125 - RNA, 18 nt, Human
gggccgggaucacggggg

SEQ ID NO: 798126 - RNA, 22 nt, Human
gggcgggggcgggggcggaggu

SEQ ID NO: 798127 - RNA, 22 nt, Human
gggcgggggcgggggcgggggc

SEQ ID NO: 798128 - RNA, 20 nt, Human
gggggcgggggcgggggcgg

SEQ ID NO: 798129 - RNA, 18 nt, Human
ggggggcgggggcggggg

SEQ ID NO: 798130 - RNA, 19 nt, Human
ggggggggaggggaacagc

SEQ ID NO: 798131 - RNA, 23 nt, Human
gggggggggaggggaacagcugc

SEQ ID NO: 798132 - RNA, 19 nt, Human
gguccuagcuuccaaaagc

SEQ ID NO: 798133 - RNA, 27 nt, Human
uaaauaaauuucuuuucuuuuuuguuu

SEQ ID NO: 798134 - RNA, 22 nt, Human
uacuuuuuuuuuuucuuuuuaa

SEQ ID NO: 798135 - RNA, 19 nt, Human
uagcuuccaaaagcuccuu

SEQ ID NO: 798136 - RNA, 18 nt, Human
uaggcacaaauccaacug

SEQ ID NO: 798137 - RNA, 21 nt, Human
uaggguccuagcuuccaaaag

SEQ ID NO: 798138 - RNA, 20 nt, Human
uauccugucuccuucccucc

SEQ ID NO: 798139 - RNA, 19 nt, Human
uaugucagaacacaccaac

SEQ ID NO: 798140 - RNA, 19 nt, Human
ucaaaaagaaaagaaaaca

SEQ ID NO: 798141 - RNA, 26 nt, Human
ucaaaaagaaaagaaaacaccaccac

SEQ ID NO: 798142 - RNA, 19 nt, Human
ucaauuccucuccccagcc

SEQ ID NO: 798143 - RNA, 23 nt, Human
ucagaacacaccaacccccgcgg

SEQ ID NO: 798144 - RNA, 23 nt, Human
uccaaaagcuccuuucggacugc

SEQ ID NO: 798145 - RNA, 24 nt, Human
uccccgcccccacccccagcaccc

SEQ ID NO: 798146 - RNA, 21 nt, Human
ucccucugcucucuccccucu

SEQ ID NO: 798147 - RNA, 25 nt, Human
ucccucugcucucuccccucuuccc

SEQ ID NO: 798148 - RNA, 19 nt, Human
uccgcggucggggccggga

SEQ ID NO: 798149 - RNA, 19 nt, Human
uccuagcuuccaaaagcuc

SEQ ID NO: 798150 - RNA, 20 nt, Human
ucgcccuggcucacggcucc

SEQ ID NO: 798151 - RNA, 19 nt, Human
ucgcuggcucuucucaucc

SEQ ID NO: 798152 - RNA, 18 nt, Human
ucuccccucuuuuucucc

SEQ ID NO: 798153 - RNA, 21 nt, Human
ucuccuuuauagagaaaaaug

SEQ ID NO: 798154 - RNA, 25 nt, Human
ucucucgaccaaugccacguccuga

SEQ ID NO: 798155 - RNA, 26 nt, Human
ucugcucucuccccucuuuuucuccc

SEQ ID NO: 798156 - RNA, 21 nt, Human
ugaacauacuuuuuucuuugu

SEQ ID NO: 798157 - RNA, 19 nt, Human
ugaggggacagacagggug

SEQ ID NO: 798158 - RNA, 20 nt, Human
ugauggaaguugagacuggg

SEQ ID NO: 798159 - RNA, 21 nt, Human
ugauggaaguugagacugggg

SEQ ID NO: 798160 - RNA, 22 nt, Human
ugcacauauacacauuuguguu

SEQ ID NO: 798161 - RNA, 22 nt, Human
ugcagucgccuucccuccucug

SEQ ID NO: 798162 - RNA, 19 nt, Human
ugcucucccagcaccggcg

SEQ ID NO: 798163 - RNA, 24 nt, Human
ugcucugcugguuucucuccccca

SEQ ID NO: 798164 - RNA, 23 nt, Human
ugggaaauucaaaaagaaaagaa

SEQ ID NO: 798165 - RNA, 18 nt, Human
uggggagggcgaagugag

SEQ ID NO: 798166 - RNA, 18 nt, Human
ugguuaagaacaagagaa

SEQ ID NO: 798167 - RNA, 20 nt, Human
ugguuuauuucauucuugaa

SEQ ID NO: 798168 - RNA, 23 nt, Human
uguaaagacacuuuuuugaaaca

SEQ ID NO: 798169 - RNA, 21 nt, Human
ugucaagaagaaacccauucc

SEQ ID NO: 798170 - RNA, 19 nt, Human
uguccccgcccccaccccc

SEQ ID NO: 798171 - RNA, 24 nt, Human
ugugugcacauauacacauuugug

SEQ ID NO: 798172 - RNA, 25 nt, Human
uguguuaagauccagggcucacaag

SEQ ID NO: 798173 - RNA, 24 nt, Human
uguugcagaacuccgcggucgggg

SEQ ID NO: 798174 - RNA, 23 nt, Human
uuaggguccuagcuuccaaaagc

SEQ ID NO: 798175 - RNA, 22 nt, Human
uucagccacccggccagccacc

SEQ ID NO: 798176 - RNA, 23 nt, Human
uucucucgaccaaugccacgucc

SEQ ID NO: 798177 - RNA, 21 nt, Human
uuucuuuucuuuuuuguuuuu

SEQ ID NO: 798178 - RNA, 19 nt, Human
uuuuuucuuuuuaaggcuc

SEQ ID NO: 798179 - RNA, 27 nt, Human
uuuuuuuuuucuuuuuaaggcucgggg

SEQ ID NO: 798180 - RNA, 21 nt, Human
uuuuuuuuuuucuuuuuaagg

SEQ ID NO: 798181 - RNA, 22 nt, Human
aaguuuccccaagcaccuaaag

SEQ ID NO: 798182 - RNA, 18 nt, Human
aaucucccccuccugcac

SEQ ID NO: 798183 - RNA, 19 nt, Human
acaggccaggcagcugggu

SEQ ID NO: 798184 - RNA, 25 nt, Human
agcccaguucuguugggggccaggu

SEQ ID NO: 798185 - RNA, 21 nt, Human
agcugcacaaccccaggccuc

SEQ ID NO: 798186 - RNA, 19 nt, Human
aggaccagcaggagguccu

SEQ ID NO: 798187 - RNA, 20 nt, Human
aggcagagucagugucugua

SEQ ID NO: 798188 - RNA, 19 nt, Human
aggccaggcagcuggguug

SEQ ID NO: 798189 - RNA, 20 nt, Human
agggcuuuggacgagugcgc

SEQ ID NO: 798190 - RNA, 20 nt, Human
aguucuguugggggccaggu

SEQ ID NO: 798191 - RNA, 21 nt, Human
aguuugaagccugaguagcug

SEQ ID NO: 798192 - RNA, 25 nt, Human
auccauuuuuuuucccaucccccaa

SEQ ID NO: 798193 - RNA, 22 nt, Human
aucucccccuccugcacuccag

SEQ ID NO: 798194 - RNA, 20 nt, Human
augucacuguuggaaugcug

SEQ ID NO: 798195 - RNA, 25 nt, Human
auuacugucagcaucccauccagau

SEQ ID NO: 798196 - RNA, 23 nt, Human
caaggacagacgaugaaucugcc

SEQ ID NO: 798197 - RNA, 23 nt, Human
cacaaccccaggccucuguccca

SEQ ID NO: 798198 - RNA, 22 nt, Human
cacuguuggaaugcugguuugg

SEQ ID NO: 798199 - RNA, 21 nt, Human
cacuugcuguaguuccagaag

SEQ ID NO: 798200 - RNA, 18 nt, Human
cagagcuggagccugugg

SEQ ID NO: 798201 - RNA, 19 nt, Human
cagagcuggagccuguggc

SEQ ID NO: 798202 - RNA, 20 nt, Human
cagcuggguuggcauuagga

SEQ ID NO: 798203 - RNA, 18 nt, Human
caucguucuuccccccug

SEQ ID NO: 798204 - RNA, 22 nt, Human
cauguccaaguacaggccaggc

SEQ ID NO: 798205 - RNA, 24 nt, Human
cauuccaaccagacccugaccuau

SEQ ID NO: 798206 - RNA, 24 nt, Human
cauuccuuggcaacuggaugugcc

SEQ ID NO: 798207 - RNA, 19 nt, Human
ccaacgccauuguugccac

SEQ ID NO: 798208 - RNA, 22 nt, Human
ccacuguucccagaucucgugg

SEQ ID NO: 798209 - RNA, 24 nt, Human
ccaggcgaguauuccaggaccagc

SEQ ID NO: 798210 - RNA, 19 nt, Human
ccaugccccaguuuggcag

SEQ ID NO: 798211 - RNA, 21 nt, Human
ccaugccccaguuuggcaguc

SEQ ID NO: 798212 - RNA, 25 nt, Human
cccaaacccccgggccacuuggcgc

SEQ ID NO: 798213 - RNA, 18 nt, Human
cccaagcauuuccuccac

SEQ ID NO: 798214 - RNA, 22 nt, Human
cccauaccaacagccaugcccc

SEQ ID NO: 798215 - RNA, 23 nt, Human
cccaucccccaaguguccaagga

SEQ ID NO: 798216 - RNA, 24 nt, Human
cccauugucauuuuuccuuucaga

SEQ ID NO: 798217 - RNA, 25 nt, Human
ccccaagcuccugaauggauauuac

SEQ ID NO: 798218 - RNA, 22 nt, Human
ccccagccacuguucccagauc

SEQ ID NO: 798219 - RNA, 21 nt, Human
ccccccaguuuguaccuggau

SEQ ID NO: 798220 - RNA, 21 nt, Human
cccccgggccacuuggcgcuu

SEQ ID NO: 798221 - RNA, 24 nt, Human
cccccgggccacuuggcgcuuugu

SEQ ID NO: 798222 - RNA, 24 nt, Human
cccccuccugcacuccaggcugga

SEQ ID NO: 798223 - RNA, 22 nt, Human
cccccugaguuugaagccugag

SEQ ID NO: 798224 - RNA, 22 nt, Human
ccugaccuauuacugucagcau

SEQ ID NO: 798225 - RNA, 22 nt, Human
ccugcacuccaggcuggauuug

SEQ ID NO: 798226 - RNA, 20 nt, Human
ccuguagccaugcuacuguu

SEQ ID NO: 798227 - RNA, 20 nt, Human
ccuucucccguuccuucccu

SEQ ID NO: 798228 - RNA, 24 nt, Human
cgaguccccccaaacccccgggcc

SEQ ID NO: 798229 - RNA, 24 nt, Human
cgcuuuguuguugcugucucccca

SEQ ID NO: 798230 - RNA, 21 nt, Human
cucaccccaggugggugacuu

SEQ ID NO: 798231 - RNA, 22 nt, Human
cucccacccuguugauccuuuc

SEQ ID NO: 798232 - RNA, 20 nt, Human
cugaugauccauuagcacca

SEQ ID NO: 798233 - RNA, 18 nt, Human
cuggaaggguugccuguc

SEQ ID NO: 798234 - RNA, 20 nt, Human
cuggagccuguggcuacacc

SEQ ID NO: 798235 - RNA, 23 nt, Human
cuguuggaaugcugguuuggggg

SEQ ID NO: 798236 - RNA, 19 nt, Human
cuucggcugggguggcccc

SEQ ID NO: 798237 - RNA, 19 nt, Human
cuuuguuguugcugucucc

SEQ ID NO: 798238 - RNA, 20 nt, Human
gagcuuaucgagucccccca

SEQ ID NO: 798239 - RNA, 20 nt, Human
gaguucauguguucaccacc

SEQ ID NO: 798240 - RNA, 18 nt, Human
gaguuggaagcaccccag

SEQ ID NO: 798241 - RNA, 24 nt, Human
gcaaguuuccccaagcaccuaaag

SEQ ID NO: 798242 - RNA, 22 nt, Human
gcaguacuaacagcaguagagc

SEQ ID NO: 798243 - RNA, 20 nt, Human
gccgcuuuggcccaggaguu

SEQ ID NO: 798244 - RNA, 18 nt, Human
gcucucuuguggcagcaa

SEQ ID NO: 798245 - RNA, 23 nt, Human
gcugggguggccccaagcuccug

SEQ ID NO: 798246 - RNA, 21 nt, Human
ggcagcaaguuuccccaagca

SEQ ID NO: 798247 - RNA, 21 nt, Human
gggcuuuccccauuccccauu

SEQ ID NO: 798248 - RNA, 22 nt, Human
ggguccccccaagcugagguac

SEQ ID NO: 798249 - RNA, 21 nt, Human
uaccaacgccauuguugccac

SEQ ID NO: 798250 - RNA, 25 nt, Human
uaccuggaccaagcaaccggggguc

SEQ ID NO: 798251 - RNA, 20 nt, Human
uaccuggaccaagcaacggu

SEQ ID NO: 798252 - RNA, 18 nt, Human
uacuggaaggguugccug

SEQ ID NO: 798253 - RNA, 21 nt, Human
uacuguucucugagccacagu

SEQ ID NO: 798254 - RNA, 18 nt, Human
uagcccaguucuguuggg

SEQ ID NO: 798255 - RNA, 22 nt, Human
uaucgaguccccccaaaccccc

SEQ ID NO: 798256 - RNA, 21 nt, Human
ucacauuguugucuugggguu

SEQ ID NO: 798257 - RNA, 21 nt, Human
ucagcacugcccccacugacu

SEQ ID NO: 798258 - RNA, 19 nt, Human
ucccagccaguugcuucac

SEQ ID NO: 798259 - RNA, 22 nt, Human
uccccaguuacucacauuguug

SEQ ID NO: 798260 - RNA, 18 nt, Human
ucccuguagccaugcuac

SEQ ID NO: 798261 - RNA, 23 nt, Human
uccugaaucccaagcauuuccuc

SEQ ID NO: 798262 - RNA, 20 nt, Human
uccuuccuuuugcacagcac

SEQ ID NO: 798263 - RNA, 22 nt, Human
uccuugucaguccuaucuauua

SEQ ID NO: 798264 - RNA, 21 nt, Human
ucucccguuccuucccuccca

SEQ ID NO: 798265 - RNA, 22 nt, Human
ucugcauugcauugauaggguu

SEQ ID NO: 798266 - RNA, 20 nt, Human
ucugcccaaucucccccucc

SEQ ID NO: 798267 - RNA, 22 nt, Human
ugaggcagauucagucucuguu

SEQ ID NO: 798268 - RNA, 20 nt, Human
ugaucuuuguccaucucccc

SEQ ID NO: 798269 - RNA, 20 nt, Human
ugaugaaacuuuccuaccug

SEQ ID NO: 798270 - RNA, 24 nt, Human
ugauggcccccauaccaacagcca

SEQ ID NO: 798271 - RNA, 19 nt, Human
ugcccugggcacucccugu

SEQ ID NO: 798272 - RNA, 21 nt, Human
ugcccugggcacucccuguag

SEQ ID NO: 798273 - RNA, 18 nt, Human
ugcggccccacuccaagc

SEQ ID NO: 798274 - RNA, 18 nt, Human
ugcucuggaugaccgggu

SEQ ID NO: 798275 - RNA, 24 nt, Human
uggaagcaccccagcaauucugac

SEQ ID NO: 798276 - RNA, 20 nt, Human
uggaaugcugguuugggggc

SEQ ID NO: 798277 - RNA, 24 nt, Human
uggaaugcugguuugggggcuuuc

SEQ ID NO: 798278 - RNA, 18 nt, Human
uggcauuaggauuaaggu

SEQ ID NO: 798279 - RNA, 20 nt, Human
uggcccccauaccaacagcc

SEQ ID NO: 798280 - RNA, 22 nt, Human
uggcuacaccccacacucuggc

SEQ ID NO: 798281 - RNA, 23 nt, Human
uggcuacaccccacacucuggcc

SEQ ID NO: 798282 - RNA, 18 nt, Human
ugggauuugggcuuugga

SEQ ID NO: 798283 - RNA, 23 nt, Human
ugggggccagguuuuaaagucuc

SEQ ID NO: 798284 - RNA, 21 nt, Human
ugggucaagaucauuccuugg

SEQ ID NO: 798285 - RNA, 23 nt, Human
uggguuggcauuaggauuaaggu

SEQ ID NO: 798286 - RNA, 20 nt, Human
ugguagugguggugguggug

SEQ ID NO: 798287 - RNA, 24 nt, Human
ugguccaucaguguuaagguucug

SEQ ID NO: 798288 - RNA, 23 nt, Human
uggugguggugguggugguauug

SEQ ID NO: 798289 - RNA, 20 nt, Human
uggugguggugguggugguc

SEQ ID NO: 798290 - RNA, 19 nt, Human
ugguuugggggcuuucccc

SEQ ID NO: 798291 - RNA, 19 nt, Human
ugucauuccaaccagaccc

SEQ ID NO: 798292 - RNA, 27 nt, Human
uguccaucuccccaguguugggauuug

SEQ ID NO: 798293 - RNA, 18 nt, Human
ugugcuguugccccagcc

SEQ ID NO: 798294 - RNA, 21 nt, Human
uguugggauuugggcuuugga

SEQ ID NO: 798295 - RNA, 20 nt, Human
uuaaugcugaguucacaguu

SEQ ID NO: 798296 - RNA, 24 nt, Human
uuacucacauuguugucuuggggu

SEQ ID NO: 798297 - RNA, 28 nt, Human
uuagcaccaggaaggccuugcaggugga

SEQ ID NO: 798298 - RNA, 22 nt, Human
uuccccaagcaccuaaagugcc

SEQ ID NO: 798299 - RNA, 22 nt, Human
uuccccauuccccauucacacc

SEQ ID NO: 798300 - RNA, 24 nt, Human
uucuugguauguccagugaaguug

SEQ ID NO: 798301 - RNA, 21 nt, Human
uuggaguuggaagcaccccag

SEQ ID NO: 798302 - RNA, 21 nt, Human
uuguauuugugcuguugcccc

SEQ ID NO: 798303 - RNA, 20 nt, Human
uuguuguugcugucucccca

SEQ ID NO: 798304 - RNA, 20 nt, Human
uuucacagaagcagcuccuc

SEQ ID NO: 798305 - RNA, 21 nt, Human
aaaauccucccaugcucaagu

SEQ ID NO: 798306 - RNA, 24 nt, Human
aaagugcugggauuacagguguga

SEQ ID NO: 798307 - RNA, 18 nt, Human
aacaugaaggguggauaa

SEQ ID NO: 798308 - RNA, 18 nt, Human
aaccuuugcauauccucc

SEQ ID NO: 798309 - RNA, 23 nt, Human
aagcaauucucaugucuccgccu

SEQ ID NO: 798310 - RNA, 25 nt, Human
aagcaauucucaugucuccgccucc

SEQ ID NO: 798311 - RNA, 24 nt, Human
aaguagcugaaauuacaggcacgu

SEQ ID NO: 798312 - RNA, 25 nt, Human
aaguagcugaaauuacaggcacgug

SEQ ID NO: 798313 - RNA, 24 nt, Human
aagugaucugccagccuuggccuc

SEQ ID NO: 798314 - RNA, 18 nt, Human
aagugcugggauuacagg

SEQ ID NO: 798315 - RNA, 19 nt, Human
aagugcugggauuacaggu

SEQ ID NO: 798316 - RNA, 26 nt, Human
aagugcugggauuacaggugugagcc

SEQ ID NO: 798317 - RNA, 18 nt, Human
acagaugacaaaaaacgu

SEQ ID NO: 798318 - RNA, 22 nt, Human
accaaaauccucccaugcucaa

SEQ ID NO: 798319 - RNA, 18 nt, Human
agauuuuuuuuuuuuuuu

SEQ ID NO: 798320 - RNA, 20 nt, Human
aggcaugcaccaccacgccc

SEQ ID NO: 798321 - RNA, 20 nt, Human
aggcaugcaccaccacgccc

SEQ ID NO: 798322 - RNA, 21 nt, Human
agugcaguggcgcgaucucag

SEQ ID NO: 798323 - RNA, 23 nt, Human
agugcaguggcgcgaucucagcu

SEQ ID NO: 798324 - RNA, 24 nt, Human
agugcaguggcgcgaucucagcuc

SEQ ID NO: 798325 - RNA, 23 nt, Human
auaccaaaauccucccaugcuca

SEQ ID NO: 798326 - RNA, 20 nt, Human
aucaaugccauaaaaguuuu

SEQ ID NO: 798327 - RNA, 20 nt, Human
augacccacucuagcaaaca

SEQ ID NO: 798328 - RNA, 20 nt, Human
augagguuucacuauacugg

SEQ ID NO: 798329 - RNA, 22 nt, Human
augucuccgccucccaaguagc

SEQ ID NO: 798330 - RNA, 20 nt, Human
auuuuuuuuuuuuuuuuugg

SEQ ID NO: 798331 - RNA, 18 nt, Human
caaaauccucccaugcuc

SEQ ID NO: 798332 - RNA, 24 nt, Human
caaagugcugggauuacaggugug

SEQ ID NO: 798333 - RNA, 24 nt, Human
caaauaaccucaagugcacagaua

SEQ ID NO: 798334 - RNA, 22 nt, Human
caacaugaaggguggauaauau

SEQ ID NO: 798335 - RNA, 24 nt, Human
caccacgcccggcuaguuuuugua

SEQ ID NO: 798336 - RNA, 24 nt, Human
cacccaagcuggagugcaguggcg

SEQ ID NO: 798337 - RNA, 21 nt, Human
caccuccccauaccaaaaucc

SEQ ID NO: 798338 - RNA, 20 nt, Human
cagcucaccguaaacuccac

SEQ ID NO: 798339 - RNA, 21 nt, Human
cauauccuccucuauacuuga

SEQ ID NO: 798340 - RNA, 21 nt, Human
ccaaagugcugggauuacagg

SEQ ID NO: 798341 - RNA, 21 nt, Human
ccaaagugcugggauuacagg

SEQ ID NO: 798342 - RNA, 24 nt, Human
ccaaagugcugggauuacaggugu

SEQ ID NO: 798343 - RNA, 20 nt, Human
ccaaucucuaaaaaacuaua

SEQ ID NO: 798344 - RNA, 24 nt, Human
ccaaucuucaagauuaucuucuua

SEQ ID NO: 798345 - RNA, 26 nt, Human
ccaccucccggguucaagcaauucuu

SEQ ID NO: 798346 - RNA, 24 nt, Human
cccaaguagcugaaauuacaggca

SEQ ID NO: 798347 - RNA, 23 nt, Human
cccggguucaagcaauucucaug

SEQ ID NO: 798348 - RNA, 23 nt, Human
ccgccucccaaguagcugaaauu

SEQ ID NO: 798349 - RNA, 18 nt, Human
ccguaaacuccaccuccc

SEQ ID NO: 798350 - RNA, 24 nt, Human
ccguaaacuccaccucccggguuc

SEQ ID NO: 798351 - RNA, 22 nt, Human
ccucccggguucaagcaauucu

SEQ ID NO: 798352 - RNA, 19 nt, Human
ccugaccucaagugaucug

SEQ ID NO: 798353 - RNA, 24 nt, Human
cgcucugucacccaagcuggagug

SEQ ID NO: 798354 - RNA, 25 nt, Human
cucacaaaauuccugaaaguuuaac

SEQ ID NO: 798355 - RNA, 24 nt, Human
cucaccguaaacuccaccucccgg

SEQ ID NO: 798356 - RNA, 21 nt, Human
cucccaaguagcugaaauuac

SEQ ID NO: 798357 - RNA, 24 nt, Human
cucgcucugucacccaagcuggag

SEQ ID NO: 798358 - RNA, 26 nt, Human
cuggcuuuccaaaaaaaaaaaagacc

SEQ ID NO: 798359 - RNA, 24 nt, Human
gaccucaagugaucugccagccuu

SEQ ID NO: 798360 - RNA, 24 nt, Human
gacuugcuauuucuugaaaaaccc

SEQ ID NO: 798361 - RNA, 18 nt, Human
gagguuucacuauacugg

SEQ ID NO: 798362 - RNA, 21 nt, Human
gagugcaguggcgcgaucuca

SEQ ID NO: 798363 - RNA, 18 nt, Human
gauuacaggugugagcca

SEQ ID NO: 798364 - RNA, 21 nt, Human
gauuacaggugugagccacca

SEQ ID NO: 798365 - RNA, 24 nt, Human
gauuacaggugugagccaccaugc

SEQ ID NO: 798366 - RNA, 22 nt, Human
gccuuggccucccaaagugcug

SEQ ID NO: 798367 - RNA, 23 nt, Human
gcuaauuaguugggacuauaggc

SEQ ID NO: 798368 - RNA, 23 nt, Human
gcuaguuuuuguaucuuugguag

SEQ ID NO: 798369 - RNA, 20 nt, Human
gcucauucaucaaugacauc

SEQ ID NO: 798370 - RNA, 25 nt, Human
gcucugucacccaagcuggagugca

SEQ ID NO: 798371 - RNA, 19 nt, Human
gcucuguugcccaggguag

SEQ ID NO: 798372 - RNA, 19 nt, Human
gcuggagugcaguggcgcg

SEQ ID NO: 798373 - RNA, 23 nt, Human
gcuggucucgaacuccugaccuc

SEQ ID NO: 798374 - RNA, 24 nt, Human
ggauuacaggugugagccaccaug

SEQ ID NO: 798375 - RNA, 24 nt, Human
ggcuggucucgaacuccugaccuc

SEQ ID NO: 798376 - RNA, 20 nt, Human
ggcuuuccaaaaaaaaaaaa

SEQ ID NO: 798377 - RNA, 19 nt, Human
ggucucgaacuccugaccu

SEQ ID NO: 798378 - RNA, 18 nt, Human
guagagaugagguuucac

SEQ ID NO: 798379 - RNA, 18 nt, Human
guagagaugagguuucac

SEQ ID NO: 798380 - RNA, 24 nt, Human
guagagcacaauggcaugaucucg

SEQ ID NO: 798381 - RNA, 23 nt, Human
guagcaacaugaaggguggauaa

SEQ ID NO: 798382 - RNA, 22 nt, Human
guuuguauuuuacugauuacaa

SEQ ID NO: 798383 - RNA, 24 nt, Human
guuuuuguaucuuugguagagaug

SEQ ID NO: 798384 - RNA, 25 nt, Human
uaaaaaacuauagcuucuaaaacca

SEQ ID NO: 798385 - RNA, 23 nt, Human
uaaccugauuuucaguuuauauc

SEQ ID NO: 798386 - RNA, 26 nt, Human
uaauaccuaauauaauaucaaugcca

SEQ ID NO: 798387 - RNA, 22 nt, Human
uacaggugugagccaccaugcc

SEQ ID NO: 798388 - RNA, 23 nt, Human
uacaggugugagccaccaugccu

SEQ ID NO: 798389 - RNA, 22 nt, Human
uacauuaaugaauaagaugaaa

SEQ ID NO: 798390 - RNA, 23 nt, Human
uaccaaaauccucccaugcucaa

SEQ ID NO: 798391 - RNA, 23 nt, Human
uaccaauagaugcaaauaaccuc

SEQ ID NO: 798392 - RNA, 24 nt, Human
uagagcacaauggcaugaucucgg

SEQ ID NO: 798393 - RNA, 19 nt, Human
uagcuucuaaaaccaaucu

SEQ ID NO: 798394 - RNA, 20 nt, Human
uagcuucuaaaaccaaucuu

SEQ ID NO: 798395 - RNA, 20 nt, Human
uaggaaaugauguauuaaau

SEQ ID NO: 798396 - RNA, 21 nt, Human
uaguauuucuaccaauagaug

SEQ ID NO: 798397 - RNA, 18 nt, Human
uaguugggacuauaggca

SEQ ID NO: 798398 - RNA, 24 nt, Human
uaguuuuuguaucuuugguagaga

SEQ ID NO: 798399 - RNA, 25 nt, Human
uauaaaaugaaguauuugcacucaa

SEQ ID NO: 798400 - RNA, 21 nt, Human
uaucaaugccauaaaaguuuu

SEQ ID NO: 798401 - RNA, 21 nt, Human
uaugaagggcugacuguagua

SEQ ID NO: 798402 - RNA, 22 nt, Human
uauguacuugugcauuuauaua

SEQ ID NO: 798403 - RNA, 25 nt, Human
ucaaugacaucaacaucuuuccgaa

SEQ ID NO: 798404 - RNA, 21 nt, Human
ucaccguaaacuccaccuccc

SEQ ID NO: 798405 - RNA, 24 nt, Human
ucaccguaaacuccaccucccggg

SEQ ID NO: 798406 - RNA, 23 nt, Human
ucccaaagugcugggauuacagg

SEQ ID NO: 798407 - RNA, 24 nt, Human
ucccaaguagcugaaauuacaggc

SEQ ID NO: 798408 - RNA, 24 nt, Human
uccccauaccaaaauccucccaug

SEQ ID NO: 798409 - RNA, 21 nt, Human
ucccggguucaagcaauucuc

SEQ ID NO: 798410 - RNA, 24 nt, Human
ucccggguucaagcaauucucaug

SEQ ID NO: 798411 - RNA, 20 nt, Human
ucccuuguauaaaaugaagu

SEQ ID NO: 798412 - RNA, 22 nt, Human
ucucaugucuccgccucccaag

SEQ ID NO: 798413 - RNA, 21 nt, Human
ucucgaacuccugaccucaag

SEQ ID NO: 798414 - RNA, 24 nt, Human
ucucgcucugucacccaagcugga

SEQ ID NO: 798415 - RNA, 26 nt, Human
ucucgcucugucacccaagcuggagu

SEQ ID NO: 798416 - RNA, 27 nt, Human
ucucgcucugucacccaagcuggagug

SEQ ID NO: 798417 - RNA, 20 nt, Human
ucucuaaaaaacuauagcuu

SEQ ID NO: 798418 - RNA, 24 nt, Human
ucugucacccaagcuggagugcag

SEQ ID NO: 798419 - RNA, 19 nt, Human
ucuugcucuguugcccagg

SEQ ID NO: 798420 - RNA, 20 nt, Human
ucuugcucuguugcccaggg

SEQ ID NO: 798421 - RNA, 24 nt, Human
ucuugcucuguugcccaggguaga

SEQ ID NO: 798422 - RNA, 24 nt, Human
ucuuugguagagaugagguuucac

SEQ ID NO: 798423 - RNA, 21 nt, Human
ugaaauuacaggcacgugcca

SEQ ID NO: 798424 - RNA, 24 nt, Human
ugaaauuacaggcacgugccacga

SEQ ID NO: 798425 - RNA, 25 nt, Human
ugaaauuacaggcacgugccacgac

SEQ ID NO: 798426 - RNA, 24 nt, Human
ugaauccacggauguggaacccac

SEQ ID NO: 798427 - RNA, 18 nt, Human
ugaccucaagugaucugc

SEQ ID NO: 798428 - RNA, 24 nt, Human
ugaccucaagugaucugccagccu

SEQ ID NO: 798429 - RNA, 22 nt, Human
ugagacggagucucgcucuguc

SEQ ID NO: 798430 - RNA, 20 nt, Human
ugagguuucacuauacuggg

SEQ ID NO: 798431 - RNA, 22 nt, Human
ugaucugccagccuuggccucc

SEQ ID NO: 798432 - RNA, 19 nt, Human
ugcaccuccccauaccagu

SEQ ID NO: 798433 - RNA, 22 nt, Human
ugcaguggcgcgaucucagcuc

SEQ ID NO: 798434 - RNA, 20 nt, Human
ugcuauuuuuugcauccuua

SEQ ID NO: 798435 - RNA, 24 nt, Human
ugcugggauuacaggugugagcca

SEQ ID NO: 798436 - RNA, 24 nt, Human
uggagugcaguggcgcgaucucag

SEQ ID NO: 798437 - RNA, 18 nt, Human
uggauaauauuuucaauu

SEQ ID NO: 798438 - RNA, 25 nt, Human
uggcaugaucucggcucacugcaaa

SEQ ID NO: 798439 - RNA, 24 nt, Human
uggcgcgaucucagcucaccguaa

SEQ ID NO: 798440 - RNA, 21 nt, Human
ugggacuauaggcaugcacca

SEQ ID NO: 798441 - RNA, 24 nt, Human
ugggacuauaggcaugcaccacca

SEQ ID NO: 798442 - RNA, 18 nt, Human
ugggauuacaggugugag

SEQ ID NO: 798443 - RNA, 22 nt, Human
ugggauuacaggugugagccac

SEQ ID NO: 798444 - RNA, 23 nt, Human
ugggauuacaggugugagccacc

SEQ ID NO: 798445 - RNA, 24 nt, Human
ugggauuacaggugugagccacca

SEQ ID NO: 798446 - RNA, 25 nt, Human
ugggauuacaggugugagccaccau

SEQ ID NO: 798447 - RNA, 24 nt, Human
ugggcaggcuggucucgaacuccu

SEQ ID NO: 798448 - RNA, 21 nt, Human
ugggccaaucucuaaaaaacu

SEQ ID NO: 798449 - RNA, 23 nt, Human
ugguagagaugagguuucacuau

SEQ ID NO: 798450 - RNA, 24 nt, Human
ugguagagaugagguuucacuaua

SEQ ID NO: 798451 - RNA, 21 nt, Human
uguggaacccacaguauauga

SEQ ID NO: 798452 - RNA, 24 nt, Human
uuaacauucuauccuucacuuucu

SEQ ID NO: 798453 - RNA, 30 nt, Human
uuaacgauuagauuuuuuuuuuuuuuuuuu

SEQ ID NO: 798454 - RNA, 21 nt, Human
uuagaacuuagcugaguccug

SEQ ID NO: 798455 - RNA, 24 nt, Human
uucaagcaauucucaugucuccgc

SEQ ID NO: 798456 - RNA, 23 nt, Human
uugcaccuccccauaccaaaauc

SEQ ID NO: 798457 - RNA, 18 nt, Human
uuggccucccaaagugcu

SEQ ID NO: 798458 - RNA, 24 nt, Human
uugguagagaugagguuucacuau

SEQ ID NO: 798459 - RNA, 23 nt, Human
uuuacaaucagcucacaaaauuc

SEQ ID NO: 798460 - RNA, 23 nt, Human
uuuacagaugacaaaaaacguau

SEQ ID NO: 798461 - RNA, 18 nt, Human
uuugagaaggagucuugc

SEQ ID NO: 798462 - RNA, 20 nt, Human
uuuuuguaucuuugguagag

SEQ ID NO: 798463 - RNA, 21 nt, Human
uuuuuguaucuuugguagaga

SEQ ID NO: 798464 - RNA, 24 nt, Human
uuuuuuuuuuuugagaaggagucu

SEQ ID NO: 798465 - RNA, 18 nt, Human
aaaaggcaggcacuggcc

SEQ ID NO: 798466 - RNA, 22 nt, Human
aaacauuuccagacaccacacc

SEQ ID NO: 798467 - RNA, 23 nt, Human
aagccagccacaauuuagagugc

SEQ ID NO: 798468 - RNA, 24 nt, Human
aauauguacccacccccacccccc

SEQ ID NO: 798469 - RNA, 26 nt, Human
acagaaagggaagccagccacaauuu

SEQ ID NO: 798470 - RNA, 23 nt, Human
accagaacuaaauaugaaaagac

SEQ ID NO: 798471 - RNA, 18 nt, Human
acccacccccacccccca

SEQ ID NO: 798472 - RNA, 22 nt, Human
acuggaacacaaauaccaaaua

SEQ ID NO: 798473 - RNA, 20 nt, Human
agacaccacaccagaacuaa

SEQ ID NO: 798474 - RNA, 23 nt, Human
agacaccacaccagaacuaaaua

SEQ ID NO: 798475 - RNA, 22 nt, Human
agacaccgacaggcccgcgauc

SEQ ID NO: 798476 - RNA, 19 nt, Human
agagugccuuuucaguugu

SEQ ID NO: 798477 - RNA, 22 nt, Human
agcagacaccgacaggcccgcg

SEQ ID NO: 798478 - RNA, 18 nt, Human
auaaugcaacaagaugga

SEQ ID NO: 798479 - RNA, 20 nt, Human
augauguugcugcugcugcc

SEQ ID NO: 798480 - RNA, 24 nt, Human
caaaacauuuuauagagcuaucaa

SEQ ID NO: 798481 - RNA, 23 nt, Human
caaagcaaauacagguaaacauc

SEQ ID NO: 798482 - RNA, 24 nt, Human
caaaggccccuccuugcaaggccc

SEQ ID NO: 798483 - RNA, 24 nt, Human
caacaagauggaaagauuuccaaa

SEQ ID NO: 798484 - RNA, 25 nt, Human
caccagaacuaaauaugaaaagaca

SEQ ID NO: 798485 - RNA, 21 nt, Human
cacccccaccccccaauacau

SEQ ID NO: 798486 - RNA, 28 nt, Human
cagaaccaaaguuccaagcaacugcuga

SEQ ID NO: 798487 - RNA, 21 nt, Human
cagacagaaagggaagccagg

SEQ ID NO: 798488 - RNA, 20 nt, Human
caucaguauucuucauacaa

SEQ ID NO: 798489 - RNA, 23 nt, Human
caucaguauucuucauacaauag

SEQ ID NO: 798490 - RNA, 19 nt, Human
ccaaaauacaacagagaca

SEQ ID NO: 798491 - RNA, 18 nt, Human
ccaagcaacugcugaagc

SEQ ID NO: 798492 - RNA, 19 nt, Human
cuaaauaugaaaagacaua

SEQ ID NO: 798493 - RNA, 20 nt, Human
cuagcgguaaugauguugcu

SEQ ID NO: 798494 - RNA, 23 nt, Human
cugaagcugaaauuagagguggu

SEQ ID NO: 798495 - RNA, 22 nt, Human
cuugcaaggccccucugacugc

SEQ ID NO: 798496 - RNA, 22 nt, Human
gaaacauuuccagacaccacac

SEQ ID NO: 798497 - RNA, 20 nt, Human
gagcagacaccgacaggccc

SEQ ID NO: 798498 - RNA, 19 nt, Human
gagguguguaggugccucg

SEQ ID NO: 798499 - RNA, 19 nt, Human
gccacaauuuagagugccu

SEQ ID NO: 798500 - RNA, 23 nt, Human
gccagaaccaaaguuccaagcaa

SEQ ID NO: 798501 - RNA, 24 nt, Human
ggaacacaaauaccaaauacaaag

SEQ ID NO: 798502 - RNA, 21 nt, Human
gguggugaaaaaggcaggcac

SEQ ID NO: 798503 - RNA, 23 nt, Human
uaaaacaguugaaacauuuccag

SEQ ID NO: 798504 - RNA, 21 nt, Human
uaacuggaacacaaauaccaa

SEQ ID NO: 798505 - RNA, 23 nt, Human
uaccaaauacaauauguacccac

SEQ ID NO: 798506 - RNA, 21 nt, Human
uagagguggugaaaaaggcag

SEQ ID NO: 798507 - RNA, 21 nt, Human
uaggagcagacaccgacaggc

SEQ ID NO: 798508 - RNA, 23 nt, Human
ucaaaacucauaccaaaauacaa

SEQ ID NO: 798509 - RNA, 22 nt, Human
ucaaggaaaagccuauaucuau

SEQ ID NO: 798510 - RNA, 27 nt, Human
ugaaaagacauaaauauaacuggaaca

SEQ ID NO: 798511 - RNA, 18 nt, Human
ugagaacugaggcucaaa

SEQ ID NO: 798512 - RNA, 22 nt, Human
ugcaacaagauggaaagauuuc

SEQ ID NO: 798513 - RNA, 22 nt, Human
ugccagaaccaaaguuccaagc

SEQ ID NO: 798514 - RNA, 24 nt, Human
ugccagaaccaaaguuccaagcaa

SEQ ID NO: 798515 - RNA, 19 nt, Human
uguacccacccccaccccc

SEQ ID NO: 798516 - RNA, 22 nt, Human
uuuauuuuucauuacauuuuag

SEQ ID NO: 798517 - RNA, 24 nt, Human
uuuuucaagcuuucaaggaaaagc

SEQ ID NO: 798518 - RNA, 24 nt, Human
aaagaaaaaacacgaaagaauaua

SEQ ID NO: 798519 - RNA, 23 nt, Human
aaagacaucacaaauucaugaaa

SEQ ID NO: 798520 - RNA, 19 nt, Human
aaagagaacaaacugucau

SEQ ID NO: 798521 - RNA, 25 nt, Human
aacaacaacaacaaaacagcuccuc

SEQ ID NO: 798522 - RNA, 19 nt, Human
aagacaaaagaagugccac

SEQ ID NO: 798523 - RNA, 24 nt, Human
aauaaaagaaaaaacacgaaagaa

SEQ ID NO: 798524 - RNA, 25 nt, Human
acaacaacaacaaaacagcuccuca

SEQ ID NO: 798525 - RNA, 19 nt, Human
acaacaacaacaacaaaac

SEQ ID NO: 798526 - RNA, 21 nt, Human
acaacaacaacaacaaaacag

SEQ ID NO: 798527 - RNA, 21 nt, Human
acagaauuccauccucaaaag

SEQ ID NO: 798528 - RNA, 21 nt, Human
acauauuccaaagcaccaaca

SEQ ID NO: 798529 - RNA, 18 nt, Human
acucugucacucagacug

SEQ ID NO: 798530 - RNA, 26 nt, Human
acucugucacucagacugcagugcaa

SEQ ID NO: 798531 - RNA, 20 nt, Human
acucuucuuauccucccuau

SEQ ID NO: 798532 - RNA, 30 nt, Human
acugcagugcaaugaugcgaucucagcucc

SEQ ID NO: 798533 - RNA, 22 nt, Human
agaauuccaaauucuccuucag

SEQ ID NO: 798534 - RNA, 20 nt, Human
agagaacaaacugucauuag

SEQ ID NO: 798535 - RNA, 19 nt, Human
agagcaccuaaaaaguaga

SEQ ID NO: 798536 - RNA, 22 nt, Human
agcaggcauauucugguggcuc

SEQ ID NO: 798537 - RNA, 21 nt, Human
agggcaaagccagacaguaaa

SEQ ID NO: 798538 - RNA, 19 nt, Human
aggugaggugggcagcagu

SEQ ID NO: 798539 - RNA, 27 nt, Human
caaaacagcuccucaagucaggugaag

SEQ ID NO: 798540 - RNA, 19 nt, Human
caaaagaagugccacucau

SEQ ID NO: 798541 - RNA, 23 nt, Human
caaagcaccaacaauccauuucu

SEQ ID NO: 798542 - RNA, 24 nt, Human
caaagcaccaacaauccauuucuu

SEQ ID NO: 798543 - RNA, 21 nt, Human
caacaaaacagcuccucaagu

SEQ ID NO: 798544 - RNA, 22 nt, Human
caacaacaacaaaacagcuccu

SEQ ID NO: 798545 - RNA, 28 nt, Human
caacaacaacaacaaaacagcuccucaa

SEQ ID NO: 798546 - RNA, 20 nt, Human
caaccucugccuccuggguu

SEQ ID NO: 798547 - RNA, 22 nt, Human
caagucaggugacaguaaugcc

SEQ ID NO: 798548 - RNA, 21 nt, Human
cacaaauucaugaaauuugca

SEQ ID NO: 798549 - RNA, 19 nt, Human
caccaacaauccauuucuu

SEQ ID NO: 798550 - RNA, 23 nt, Human
caccuaaaaaguagauaaauaaa

SEQ ID NO: 798551 - RNA, 23 nt, Human
cacucugucacucagacugcagu

SEQ ID NO: 798552 - RNA, 24 nt, Human
cacucugucacucagacugcagug

SEQ ID NO: 798553 - RNA, 21 nt, Human
cacugcaaccucugccuccug

SEQ ID NO: 798554 - RNA, 23 nt, Human
cacugcaaccucugccuccuggg

SEQ ID NO: 798555 - RNA, 18 nt, Human
cagaauuccauccucaaa

SEQ ID NO: 798556 - RNA, 21 nt, Human
cagacaacaacaacaacaaaa

SEQ ID NO: 798557 - RNA, 21 nt, Human
caggugaauggacucuuugac

SEQ ID NO: 798558 - RNA, 24 nt, Human
caugaaauuugcagacaacaacaa

SEQ ID NO: 798559 - RNA, 21 nt, Human
cauggcagaaugacaaaaaag

SEQ ID NO: 798560 - RNA, 21 nt, Human
ccuccuggguucaagugauuc

SEQ ID NO: 798561 - RNA, 22 nt, Human
ccucugccuccuggguucaagu

SEQ ID NO: 798562 - RNA, 21 nt, Human
ccuucagcagaggaaagguga

SEQ ID NO: 798563 - RNA, 18 nt, Human
cgugugugugugugugug

SEQ ID NO: 798564 - RNA, 19 nt, Human
cgugugugugugugugugu

SEQ ID NO: 798565 - RNA, 30 nt, Human
cucaaggaacauaaaagcuaaaagccccac

SEQ ID NO: 798566 - RNA, 29 nt, Human
cucaaggaacauaaaagcuaaaagccccc

SEQ ID NO: 798567 - RNA, 24 nt, Human
cucacugcaaccucugccuccugg

SEQ ID NO: 798568 - RNA, 21 nt, Human
cuccuggguucaagugauucu

SEQ ID NO: 798569 - RNA, 24 nt, Human
cuccuucagcagaggaaaggugag

SEQ ID NO: 798570 - RNA, 25 nt, Human
cugaaaaccugaugugguuuugucc

SEQ ID NO: 798571 - RNA, 24 nt, Human
cugcaaccucugccuccuggguuc

SEQ ID NO: 798572 - RNA, 23 nt, Human
cugccuccuggguucaagugauu

SEQ ID NO: 798573 - RNA, 20 nt, Human
gagcauucuacguuacucca

SEQ ID NO: 798574 - RNA, 18 nt, Human
gcagaaugacaaaaaaga

SEQ ID NO: 798575 - RNA, 22 nt, Human
gcagacaacaacaacaacaaaa

SEQ ID NO: 798576 - RNA, 20 nt, Human
gcagugcaugcugccaaccc

SEQ ID NO: 798577 - RNA, 20 nt, Human
gcgaucucagcucacugcaa

SEQ ID NO: 798578 - RNA, 19 nt, Human
gcugccaacccaggaguuu

SEQ ID NO: 798579 - RNA, 20 nt, Human
ggauuaccuaagccaaucac

SEQ ID NO: 798580 - RNA, 20 nt, Human
gugacaguaaugccccucuc

SEQ ID NO: 798581 - RNA, 19 nt, Human
uaaaaaguagauaaauaaa

SEQ ID NO: 798582 - RNA, 26 nt, Human
uaacaaauaugcagugcaugcugcca

SEQ ID NO: 798583 - RNA, 20 nt, Human
uaagacaaaagaagugccac

SEQ ID NO: 798584 - RNA, 18 nt, Human
uaaugauaucugggcuca

SEQ ID NO: 798585 - RNA, 26 nt, Human
uacacacauacacagauauauauuua

SEQ ID NO: 798586 - RNA, 24 nt, Human
ucacugcaaccucugccuccuggg

SEQ ID NO: 798587 - RNA, 25 nt, Human
ucacugcaaccucugccuccugggu

SEQ ID NO: 798588 - RNA, 27 nt, Human
ucacugcaaccucugccuccuggguuc

SEQ ID NO: 798589 - RNA, 20 nt, Human
uccagugaauuuuacuaaua

SEQ ID NO: 798590 - RNA, 21 nt, Human
uccuggguucaagugauucuc

SEQ ID NO: 798591 - RNA, 23 nt, Human
uccuggguucaagugauucucuc

SEQ ID NO: 798592 - RNA, 18 nt, Human
ucucacucugucacucag

SEQ ID NO: 798593 - RNA, 19 nt, Human
ucucacucugucacucaga

SEQ ID NO: 798594 - RNA, 26 nt, Human
ucucacucugucacucagacugcagu

SEQ ID NO: 798595 - RNA, 27 nt, Human
ucucacucugucacucagacugcagug

SEQ ID NO: 798596 - RNA, 19 nt, Human
ugacaaaaaagaaaaaaga

SEQ ID NO: 798597 - RNA, 22 nt, Human
ugacaaaaaagaaaaaagauuc

SEQ ID NO: 798598 - RNA, 23 nt, Human
ugacaaaaaagaaaaaagauucu

SEQ ID NO: 798599 - RNA, 20 nt, Human
ugacaguaaugccccucucu

SEQ ID NO: 798600 - RNA, 18 nt, Human
ugagaacuaaagaauaau

SEQ ID NO: 798601 - RNA, 22 nt, Human
ugagauggagucucacucuguc

SEQ ID NO: 798602 - RNA, 23 nt, Human
ugcaacccuauuuuaagggcaaa

SEQ ID NO: 798603 - RNA, 21 nt, Human
ugcaugcugccaacccaggag

SEQ ID NO: 798604 - RNA, 22 nt, Human
ugccacucauaggagaaaaaga

SEQ ID NO: 798605 - RNA, 22 nt, Human
ugccuccuggguucaagugauu

SEQ ID NO: 798606 - RNA, 22 nt, Human
ugcugugcuauuaauuuugagc

SEQ ID NO: 798607 - RNA, 19 nt, Human
uggcagaaugacaaaaaag

SEQ ID NO: 798608 - RNA, 23 nt, Human
uggcagaaugacaaaaaagaaaa

SEQ ID NO: 798609 - RNA, 20 nt, Human
uggguucaagugauucucuu

SEQ ID NO: 798610 - RNA, 19 nt, Human
ugguggcucauccuaacuc

SEQ ID NO: 798611 - RNA, 19 nt, Human
uguaaacagcaaagacauc

SEQ ID NO: 798612 - RNA, 22 nt, Human
uguaaacagcaaagacaucaca

SEQ ID NO: 798613 - RNA, 23 nt, Human
uguaaacagcaaagacaucacaa

SEQ ID NO: 798614 - RNA, 24 nt, Human
uguauacacacauacacagauaua

SEQ ID NO: 798615 - RNA, 26 nt, Human
uguauacacacauacacagauauaua

SEQ ID NO: 798616 - RNA, 20 nt, Human
ugucuguguguguguauaaa

SEQ ID NO: 798617 - RNA, 18 nt, Human
uguguauacacacauaca

SEQ ID NO: 798618 - RNA, 20 nt, Human
ugugucuguguguguguaua

SEQ ID NO: 798619 - RNA, 20 nt, Human
uguguguguauacacacaua

SEQ ID NO: 798620 - RNA, 21 nt, Human
ugugugugucugugugugugu

SEQ ID NO: 798621 - RNA, 23 nt, Human
ugugugugucuguguguguguaa

SEQ ID NO: 798622 - RNA, 21 nt, Human
uguguguguguauacacacau

SEQ ID NO: 798623 - RNA, 22 nt, Human
uguguguguguauacacacaua

SEQ ID NO: 798624 - RNA, 26 nt, Human
uguguguguguauacacacauaaugu

SEQ ID NO: 798625 - RNA, 21 nt, Human
ugugugugugugucugugugu

SEQ ID NO: 798626 - RNA, 21 nt, Human
ugugugugugugugucugugu

SEQ ID NO: 798627 - RNA, 23 nt, Human
ugugugugugugugucugugugu

SEQ ID NO: 798628 - RNA, 24 nt, Human
ugugugugugugugucugugugug

SEQ ID NO: 798629 - RNA, 23 nt, Human
uucagugguccagaauuuuagcu

SEQ ID NO: 798630 - RNA, 27 nt, Human
uucaucccguguguguguguguguggu

SEQ ID NO: 798631 - RNA, 21 nt, Human
uucauuucuucuccaaacugc

SEQ ID NO: 798632 - RNA, 19 nt, Human
uugcagacaacaacaacaa

SEQ ID NO: 798633 - RNA, 20 nt, Human
uuucuugggacugcauguaa

SEQ ID NO: 798634 - RNA, 25 nt, Human
acuucaggaauaucaauuccccggg

SEQ ID NO: 798635 - RNA, 19 nt, Human
agggcaaaaccuugcauug

SEQ ID NO: 798636 - RNA, 20 nt, Human
cauugcugggagggucauac

SEQ ID NO: 798637 - RNA, 24 nt, Human
cauugcugggagggucauacugca

SEQ ID NO: 798638 - RNA, 19 nt, Human
cgggcacaaaaucuggaaa

SEQ ID NO: 798639 - RNA, 21 nt, Human
cuccaggaguuucugccucug

SEQ ID NO: 798640 - RNA, 19 nt, Human
ggcacaaaaucuggaaacu

SEQ ID NO: 798641 - RNA, 18 nt, Human
ucauacugcaaaacccag

SEQ ID NO: 798642 - RNA, 21 nt, Human
uccacgggcacaaaaucugga

SEQ ID NO: 798643 - RNA, 20 nt, Human
uccaggaguuucugccucug

SEQ ID NO: 798644 - RNA, 18 nt, Human
ucucuucuuuguugcucc

SEQ ID NO: 798645 - RNA, 18 nt, Human
ucugccucugcuuuucuc

SEQ ID NO: 798646 - RNA, 27 nt, Human
ucuucucccuucauuuucuguuuucuc

SEQ ID NO: 798647 - RNA, 20 nt, Human
ucuucuuuguugcuccagga

SEQ ID NO: 798648 - RNA, 25 nt, Human
ugacuucaggaauaucaauuccccg

SEQ ID NO: 798649 - RNA, 22 nt, Human
ugccucugcuuuucucugauuu

SEQ ID NO: 798650 - RNA, 18 nt, Human
ugcuccaggaguuucugc

SEQ ID NO: 798651 - RNA, 18 nt, Human
uggaaucgugucgguauu

SEQ ID NO: 798652 - RNA, 22 nt, Human
aaacugacacucuguuaauaac

SEQ ID NO: 798653 - RNA, 24 nt, Human
aaacugacacucuguuaauaacac

SEQ ID NO: 798654 - RNA, 19 nt, Human
aacagaaaauaaaucccua

SEQ ID NO: 798655 - RNA, 24 nt, Human
aacagcaugggggaaccgccccca

SEQ ID NO: 798656 - RNA, 18 nt, Human
aauuuccaaauaccuucc

SEQ ID NO: 798657 - RNA, 22 nt, Human
acagaaaauaaaucccuagagc

SEQ ID NO: 798658 - RNA, 21 nt, Human
acaggguaagaaaagcaaauu

SEQ ID NO: 798659 - RNA, 24 nt, Human
acccuuagcaauuucauauuccaa

SEQ ID NO: 798660 - RNA, 20 nt, Human
agaaaauaaaucccuagagc

SEQ ID NO: 798661 - RNA, 23 nt, Human
agaacagcaugggggaaccgccc

SEQ ID NO: 798662 - RNA, 19 nt, Human
agaauucacagcugaaugu

SEQ ID NO: 798663 - RNA, 24 nt, Human
auaaaacagcaaugauuauugaag

SEQ ID NO: 798664 - RNA, 20 nt, Human
aucacagucacagagacuug

SEQ ID NO: 798665 - RNA, 20 nt, Human
auggcaguaggcaagagaac

SEQ ID NO: 798666 - RNA, 23 nt, Human
caaaaugaucacugaacaucaga

SEQ ID NO: 798667 - RNA, 24 nt, Human
caaaaugaucacugaacaucagau

SEQ ID NO: 798668 - RNA, 24 nt, Human
caacaaaaguucaucagaaauuaa

SEQ ID NO: 798669 - RNA, 19 nt, Human
caagucugagaguccacug

SEQ ID NO: 798670 - RNA, 20 nt, Human
cacagagacuuggcucauca

SEQ ID NO: 798671 - RNA, 19 nt, Human
cacccaucacccacaccuu

SEQ ID NO: 798672 - RNA, 21 nt, Human
cagcaaacaggugcauuuauc

SEQ ID NO: 798673 - RNA, 18 nt, Human
caucacccacaccuuacc

SEQ ID NO: 798674 - RNA, 23 nt, Human
caucagaaauuaagaacugagag

SEQ ID NO: 798675 - RNA, 23 nt, Human
ccagaaucuaaaacauuuccagc

SEQ ID NO: 798676 - RNA, 18 nt, Human
cccaucacccacaccuua

SEQ ID NO: 798677 - RNA, 20 nt, Human
ccccaugagcuaaucacguu

SEQ ID NO: 798678 - RNA, 23 nt, Human
ccuguacaccucucugaucacga

SEQ ID NO: 798679 - RNA, 22 nt, Human
cuaaauucuguugagaauucac

SEQ ID NO: 798680 - RNA, 25 nt, Human
cuagaacagcaugggggaaccgccc

SEQ ID NO: 798681 - RNA, 23 nt, Human
cucacaacccacccaucacccuu

SEQ ID NO: 798682 - RNA, 18 nt, Human
cugcacaggguaagaaaa

SEQ ID NO: 798683 - RNA, 21 nt, Human
cuuaaacuauccuuaguaaca

SEQ ID NO: 798684 - RNA, 18 nt, Human
gaaucuaaaacauuucca

SEQ ID NO: 798685 - RNA, 23 nt, Human
gaauucaauucuaaauucuguug

SEQ ID NO: 798686 - RNA, 22 nt, Human
gagacuuggcucaucagaaaua

SEQ ID NO: 798687 - RNA, 22 nt, Human
gaggucacuguuaucaacauca

SEQ ID NO: 798688 - RNA, 20 nt, Human
gcaguacccuuagcaauuuc

SEQ ID NO: 798689 - RNA, 23 nt, Human
ggaggagaauaagauaaaaaucu

SEQ ID NO: 798690 - RNA, 21 nt, Human
ggggaggccucgggaacuuac

SEQ ID NO: 798691 - RNA, 23 nt, Human
guaagaaaagcaaauucucaagu

SEQ ID NO: 798692 - RNA, 21 nt, Human
guaggcaagagaacugcagag

SEQ ID NO: 798693 - RNA, 23 nt, Human
gugcaguacccuuagcaauuuca

SEQ ID NO: 798694 - RNA, 23 nt, Human
uaaaucccuagagcaaucaaaaa

SEQ ID NO: 798695 - RNA, 23 nt, Human
uaagugaauucaauucuaaauuc

SEQ ID NO: 798696 - RNA, 22 nt, Human
uacacauagggaaaaucgacaa

SEQ ID NO: 798697 - RNA, 22 nt, Human
uaccaaguacauguauuuagaa

SEQ ID NO: 798698 - RNA, 23 nt, Human
uauaaaaccaucagauccucuga

SEQ ID NO: 798699 - RNA, 22 nt, Human
uauuucaucaucagaaucugga

SEQ ID NO: 798700 - RNA, 18 nt, Human
ucaguacacuuaaaagua

SEQ ID NO: 798701 - RNA, 22 nt, Human
ucaucagaaauuaagaacugag

SEQ ID NO: 798702 - RNA, 23 nt, Human
ucguaaaugcucugcacagggua

SEQ ID NO: 798703 - RNA, 22 nt, Human
ucucacaacccacccaucaccc

SEQ ID NO: 798704 - RNA, 24 nt, Human
ucucuugguauuagugcuugauuc

SEQ ID NO: 798705 - RNA, 18 nt, Human
ugacacucuguuaauaac

SEQ ID NO: 798706 - RNA, 23 nt, Human
ugacagcaaacaggugcauuuau

SEQ ID NO: 798707 - RNA, 23 nt, Human
ugagauuuugguuggggacacag

SEQ ID NO: 798708 - RNA, 18 nt, Human
uggauuuauuuguaaacu

SEQ ID NO: 798709 - RNA, 22 nt, Human
uggcuggggaggccucgggaac

SEQ ID NO: 798710 - RNA, 18 nt, Human
ugggauaauaacaguucc

SEQ ID NO: 798711 - RNA, 24 nt, Human
ugggggaaccgcccccaugagcua

SEQ ID NO: 798712 - RNA, 18 nt, Human
ugucugacacagguaaag

SEQ ID NO: 798713 - RNA, 19 nt, Human
ugugacagcaaacaggugc

SEQ ID NO: 798714 - RNA, 21 nt, Human
uucaucaucagaaucuggacu

SEQ ID NO: 798715 - RNA, 23 nt, Human
uuccaagucugagaguccaccgu

SEQ ID NO: 798716 - RNA, 25 nt, Human
uuccagcaagugaacuaggguaccc

SEQ ID NO: 798717 - RNA, 20 nt, Human
uuugguuggggacacagcca

SEQ ID NO: 798718 - RNA, 20 nt, Human
aaaccaaaaccuacuaggaa

SEQ ID NO: 798719 - RNA, 23 nt, Human
aauacaauacaacuacugcaauu

SEQ ID NO: 798720 - RNA, 19 nt, Human
acagagcacaugguuuacc

SEQ ID NO: 798721 - RNA, 25 nt, Human
accacacgugcaaaaauacaauaca

SEQ ID NO: 798722 - RNA, 20 nt, Human
accucuucaagccuaugcuu

SEQ ID NO: 798723 - RNA, 21 nt, Human
acugcaauuauuacuaucauu

SEQ ID NO: 798724 - RNA, 18 nt, Human
acugcuaucugcuucugc

SEQ ID NO: 798725 - RNA, 23 nt, Human
agccaugcuaacaaaacuaaacc

SEQ ID NO: 798726 - RNA, 23 nt, Human
auagaacagcagugaagcaagaa

SEQ ID NO: 798727 - RNA, 21 nt, Human
auauagcaguauuauccaguu

SEQ ID NO: 798728 - RNA, 22 nt, Human
aucaagaggaucagacccaaaa

SEQ ID NO: 798729 - RNA, 18 nt, Human
auuuauucacugugguag

SEQ ID NO: 798730 - RNA, 24 nt, Human
caacaaaccuguguaauauagaac

SEQ ID NO: 798731 - RNA, 20 nt, Human
caagaggaucagacccaaaa

SEQ ID NO: 798732 - RNA, 21 nt, Human
caagaggaucagacccaaaac

SEQ ID NO: 798733 - RNA, 21 nt, Human
caauacaauacaacuacugca

SEQ ID NO: 798734 - RNA, 21 nt, Human
caccagaaaagaaccuguauu

SEQ ID NO: 798735 - RNA, 24 nt, Human
caguacccaacaauuuccaugcug

SEQ ID NO: 798736 - RNA, 21 nt, Human
cagucuacuguagaaaauaac

SEQ ID NO: 798737 - RNA, 24 nt, Human
cauguaccugccuacccaccucuu

SEQ ID NO: 798738 - RNA, 24 nt, Human
ccuuaggugaaaaacaccugacag

SEQ ID NO: 798739 - RNA, 21 nt, Human
gaaaaacaccugacagcuaca

SEQ ID NO: 798740 - RNA, 24 nt, Human
gaacauggaaacagucaagcauaa

SEQ ID NO: 798741 - RNA, 24 nt, Human
gaacuuacagaaagauaauuaucu

SEQ ID NO: 798742 - RNA, 24 nt, Human
gaccagagcagaaugucuacagcc

SEQ ID NO: 798743 - RNA, 18 nt, Human
gcaagaaaaaugugugcu

SEQ ID NO: 798744 - RNA, 19 nt, Human
gcuaacaaaacuaaaccuu

SEQ ID NO: 798745 - RNA, 22 nt, Human
gcuaauaucccaguuggacuac

SEQ ID NO: 798746 - RNA, 19 nt, Human
ggaaaacauaauuaacuca

SEQ ID NO: 798747 - RNA, 18 nt, Human
ggaaacagucaagcauaa

SEQ ID NO: 798748 - RNA, 21 nt, Human
ggagguccucgggaggcuuug

SEQ ID NO: 798749 - RNA, 24 nt, Human
ggcuaauaucccaguuggacuacu

SEQ ID NO: 798750 - RNA, 18 nt, Human
ggggcuuuuaaaaucaca

SEQ ID NO: 798751 - RNA, 22 nt, Human
ggugaaaaacaccugacagcua

SEQ ID NO: 798752 - RNA, 24 nt, Human
guagaaaauaacuuguaugccaca

SEQ ID NO: 798753 - RNA, 23 nt, Human
gugaaaaacaccugacagcuaca

SEQ ID NO: 798754 - RNA, 23 nt, Human
uaaaaaaaacaacaacaaaccug

SEQ ID NO: 798755 - RNA, 27 nt, Human
uaaaagaagucauacuuaauacaguag

SEQ ID NO: 798756 - RNA, 18 nt, Human
uaaauaaacaccaauuuu

SEQ ID NO: 798757 - RNA, 19 nt, Human
uaacuaggaaaaaaaccuc

SEQ ID NO: 798758 - RNA, 20 nt, Human
uaccacacgugcaaaaauac

SEQ ID NO: 798759 - RNA, 23 nt, Human
uaccacuuauuuuaaauaaacac

SEQ ID NO: 798760 - RNA, 20 nt, Human
uacccaccucuucaagccua

SEQ ID NO: 798761 - RNA, 19 nt, Human
uacugcuaucugcuucugc

SEQ ID NO: 798762 - RNA, 24 nt, Human
uagaacagcagugaagcaagaaaa

SEQ ID NO: 798763 - RNA, 21 nt, Human
uagcaguauuauccaguuaaa

SEQ ID NO: 798764 - RNA, 18 nt, Human
uauaaagaucaaaaaacc

SEQ ID NO: 798765 - RNA, 25 nt, Human
ucaacaucugaauuuuuuuguaacc

SEQ ID NO: 798766 - RNA, 19 nt, Human
ucacuguuuucagggucaa

SEQ ID NO: 798767 - RNA, 20 nt, Human
ucauuauugggagaacaugg

SEQ ID NO: 798768 - RNA, 21 nt, Human
uccuuucuaacucaguuucac

SEQ ID NO: 798769 - RNA, 23 nt, Human
ucucuucaacugcuugccucuuu

SEQ ID NO: 798770 - RNA, 21 nt, Human
ucuuugggggcuuuuaaaauc

SEQ ID NO: 798771 - RNA, 23 nt, Human
ugaaaaacaccugacagcuacau

SEQ ID NO: 798772 - RNA, 23 nt, Human
ugaaacaaucaacuuugaaaagc

SEQ ID NO: 798773 - RNA, 22 nt, Human
ugacaccagaaaagaaccugua

SEQ ID NO: 798774 - RNA, 19 nt, Human
ugcaguuucuccaucaaga

SEQ ID NO: 798775 - RNA, 24 nt, Human
ugcugcaguuucuccaucaagagg

SEQ ID NO: 798776 - RNA, 20 nt, Human
uggacacaaucaauagcaug

SEQ ID NO: 798777 - RNA, 20 nt, Human
uggauuuguuaagugucccc

SEQ ID NO: 798778 - RNA, 21 nt, Human
uggcuaauaucccaguuggac

SEQ ID NO: 798779 - RNA, 25 nt, Human
ugggagaacauggaaacagucaagc

SEQ ID NO: 798780 - RNA, 21 nt, Human
uguauuuuucauccaauaguu

SEQ ID NO: 798781 - RNA, 23 nt, Human
uguccccaguauuccuuuuaguu

SEQ ID NO: 798782 - RNA, 21 nt, Human
ugucuacagcccuugccaaua

SEQ ID NO: 798783 - RNA, 23 nt, Human
ugugccacauuaguauuugggaa

SEQ ID NO: 798784 - RNA, 22 nt, Human
ugugguagccugaaacauugua

SEQ ID NO: 798785 - RNA, 22 nt, Human
uucacuguuuucagggucaagg

SEQ ID NO: 798786 - RNA, 21 nt, Human
uuggacucugagguggcuaau

SEQ ID NO: 798787 - RNA, 23 nt, Human
uuuauaaagaucaaaaaaccaaa

SEQ ID NO: 798788 - RNA, 22 nt, Human
uuuguaaccuucuaaaagaagu

SEQ ID NO: 798789 - RNA, 24 nt, Human
uuuuuuuuuuuuuuuuuuuauggg

SEQ ID NO: 798790 - RNA, 19 nt, Human
aaaaaaauguaaacaucga

SEQ ID NO: 798791 - RNA, 26 nt, Human
aaaaaaauguaaacaucgaggagcca

SEQ ID NO: 798792 - RNA, 18 nt, Human
aaaaacaaacaauagcuu

SEQ ID NO: 798793 - RNA, 24 nt, Human
aaaaacaaacaauagcuuaaaagc

SEQ ID NO: 798794 - RNA, 21 nt, Human
aaaacagaaacuuagaaacaa

SEQ ID NO: 798795 - RNA, 18 nt, Human
aaaaugagcagauaggug

SEQ ID NO: 798796 - RNA, 23 nt, Human
aaacaaacaauagcuuaaaagca

SEQ ID NO: 798797 - RNA, 19 nt, Human
aaacaauagcuuaaaagca

SEQ ID NO: 798798 - RNA, 18 nt, Human
aaacagaaacuuagaaac

SEQ ID NO: 798799 - RNA, 18 nt, Human
aaaccagaaaagcuaaca

SEQ ID NO: 798800 - RNA, 25 nt, Human
aaagcuuuucugagcuugguuucau

SEQ ID NO: 798801 - RNA, 18 nt, Human
aaauagcaagaacaaacu

SEQ ID NO: 798802 - RNA, 24 nt, Human
aaaugcuuauuuccugaaguuccu

SEQ ID NO: 798803 - RNA, 20 nt, Human
aaauugaacacugcugcgaa

SEQ ID NO: 798804 - RNA, 21 nt, Human
aacauggcuaugugcacaaaa

SEQ ID NO: 798805 - RNA, 23 nt, Human
aaccaaaaagcuaugaauccacu

SEQ ID NO: 798806 - RNA, 20 nt, Human
aaccauuaugauaaagccaa

SEQ ID NO: 798807 - RNA, 24 nt, Human
aagcaugcugugcccagcgcagcu

SEQ ID NO: 798808 - RNA, 20 nt, Human
aagcuuuucugagcuugguu

SEQ ID NO: 798809 - RNA, 24 nt, Human
aaggucccauaguggaaucaagga

SEQ ID NO: 798810 - RNA, 23 nt, Human
aaucauuuaaaacaaaagacuga

SEQ ID NO: 798811 - RNA, 21 nt, Human
aauguuuacacuagcaacagu

SEQ ID NO: 798812 - RNA, 23 nt, Human
acaaggcaggaggcaaaacagag

SEQ ID NO: 798813 - RNA, 27 nt, Human
acacaguaguucuguucccccaacccg

SEQ ID NO: 798814 - RNA, 20 nt, Human
acacgguggcagcccggcuc

SEQ ID NO: 798815 - RNA, 21 nt, Human
accaucugaagaguuucucca

SEQ ID NO: 798816 - RNA, 22 nt, Human
acuaaauauaaaagaaaaaaga

SEQ ID NO: 798817 - RNA, 19 nt, Human
acuacaccuauugagcacu

SEQ ID NO: 798818 - RNA, 26 nt, Human
agaaaagcuaacacaacaaaaugagc

SEQ ID NO: 798819 - RNA, 21 nt, Human
agagggagaggggggaaaaag

SEQ ID NO: 798820 - RNA, 26 nt, Human
agcaauacugcguuuaaaaaggcuuu

SEQ ID NO: 798821 - RNA, 19 nt, Human
aggcaggaggcaaaacaga

SEQ ID NO: 798822 - RNA, 23 nt, Human
aggcugaaauucacuuuggaacu

SEQ ID NO: 798823 - RNA, 18 nt, Human
agggagaggggggaaaaa

SEQ ID NO: 798824 - RNA, 21 nt, Human
agggagaggggggaaaaaggu

SEQ ID NO: 798825 - RNA, 21 nt, Human
auaaagcaauuuuauaaagca

SEQ ID NO: 798826 - RNA, 19 nt, Human
auacauauacacaaauaua

SEQ ID NO: 798827 - RNA, 18 nt, Human
auagaaccauuaugauaa

SEQ ID NO: 798828 - RNA, 25 nt, Human
auauauacauauauacauauauaca

SEQ ID NO: 798829 - RNA, 23 nt, Human
augcauuguuagcacaaaaaguu

SEQ ID NO: 798830 - RNA, 18 nt, Human
auguuacuuagcuuaaaa

SEQ ID NO: 798831 - RNA, 27 nt, Human
auuacgcacaaaauaacuaucucccac

SEQ ID NO: 798832 - RNA, 19 nt, Human
caaaaugagcagauaggug

SEQ ID NO: 798833 - RNA, 22 nt, Human
caaaaugccuugcuaccuaaaa

SEQ ID NO: 798834 - RNA, 25 nt, Human
caaacaauagcuuaaaagcauuauu

SEQ ID NO: 798835 - RNA, 22 nt, Human
cacaugaagaaaaucacuaaca

SEQ ID NO: 798836 - RNA, 23 nt, Human
cacccauucacauacauacccaa

SEQ ID NO: 798837 - RNA, 22 nt, Human
cacggagggaccaagaauucca

SEQ ID NO: 798838 - RNA, 19 nt, Human
cagccucucccgggacgac

SEQ ID NO: 798839 - RNA, 27 nt, Human
cauaacuaaaaacaaauccaaagacca

SEQ ID NO: 798840 - RNA, 24 nt, Human
cauuaccaugaauuuaugaaguaa

SEQ ID NO: 798841 - RNA, 22 nt, Human
ccacggagggaccaagaauucc

SEQ ID NO: 798842 - RNA, 18 nt, Human
cccacuucuguuuuuucu

SEQ ID NO: 798843 - RNA, 19 nt, Human
cccggccgcuucaggugug

SEQ ID NO: 798844 - RNA, 22 nt, Human
cccgggacgaccuggagagcuc

SEQ ID NO: 798845 - RNA, 24 nt, Human
cccgggacugcagcagccucuccc

SEQ ID NO: 798846 - RNA, 19 nt, Human
ccgccgccgccccugcugc

SEQ ID NO: 798847 - RNA, 22 nt, Human
ccgccgccgccccugcugcggc

SEQ ID NO: 798848 - RNA, 18 nt, Human
ccgccgccgccgccccug

SEQ ID NO: 798849 - RNA, 20 nt, Human
ccggagaagcuccggcggcg

SEQ ID NO: 798850 - RNA, 19 nt, Human
cgauccgccgccgccgccc

SEQ ID NO: 798851 - RNA, 20 nt, Human
cgauccgccgccgccgcccc

SEQ ID NO: 798852 - RNA, 23 nt, Human
cgcacaaaauaacuaucucccac

SEQ ID NO: 798853 - RNA, 21 nt, Human
cgggcggcgaggagggcguuc

SEQ ID NO: 798854 - RNA, 19 nt, Human
cggugcggggcggggagga

SEQ ID NO: 798855 - RNA, 21 nt, Human
cuaaaaacaaauccaaagacu

SEQ ID NO: 798856 - RNA, 22 nt, Human
cuacauaaaauaacuuccuaga

SEQ ID NO: 798857 - RNA, 21 nt, Human
cuagaggggguagugacaguu

SEQ ID NO: 798858 - RNA, 18 nt, Human
cugagagggagagggggg

SEQ ID NO: 798859 - RNA, 21 nt, Human
cuuuuuuggugaaauguacac

SEQ ID NO: 798860 - RNA, 19 nt, Human
gaaaaacagaaacuuagaa

SEQ ID NO: 798861 - RNA, 23 nt, Human
gacgcggcgggcggcgaggaggg

SEQ ID NO: 798862 - RNA, 22 nt, Human
gagaagcuccggcggcggcacc

SEQ ID NO: 798863 - RNA, 20 nt, Human
gagaaugucaaaaugccuug

SEQ ID NO: 798864 - RNA, 22 nt, Human
gagaggggggaaaaagguucuc

SEQ ID NO: 798865 - RNA, 28 nt, Human
gaguaaaagaacauuucuuuaaaaauau

SEQ ID NO: 798866 - RNA, 18 nt, Human
gcggcgggcggcgaggag

SEQ ID NO: 798867 - RNA, 20 nt, Human
gcggcgggcggcgaggaggg

SEQ ID NO: 798868 - RNA, 22 nt, Human
gcggggcggggaggacgagcug

SEQ ID NO: 798869 - RNA, 19 nt, Human
ggaucgaggcagggccugg

SEQ ID NO: 798870 - RNA, 20 nt, Human
ggcccggagaagcuccggcg

SEQ ID NO: 798871 - RNA, 22 nt, Human
gggcccggagaagcuccggcgg

SEQ ID NO: 798872 - RNA, 18 nt, Human
gugcauauuuauugauac

SEQ ID NO: 798873 - RNA, 19 nt, Human
guuacuuagcuuaaaaaaa

SEQ ID NO: 798874 - RNA, 20 nt, Human
uaaaacaagccucuaugcac

SEQ ID NO: 798875 - RNA, 18 nt, Human
uaacuaaaaacaaaucca

SEQ ID NO: 798876 - RNA, 23 nt, Human
uaacuaucucccacuucuguuuu

SEQ ID NO: 798877 - RNA, 18 nt, Human
uaagcgagcuaagaauuu

SEQ ID NO: 798878 - RNA, 20 nt, Human
uacaauuuuagcaaacacua

SEQ ID NO: 798879 - RNA, 24 nt, Human
uacacccauucacauacauaccca

SEQ ID NO: 798880 - RNA, 19 nt, Human
uacauauauacauauauac

SEQ ID NO: 798881 - RNA, 23 nt, Human
uacucauauaucaaaguagacug

SEQ ID NO: 798882 - RNA, 22 nt, Human
uagaaaguggacuggcaaacac

SEQ ID NO: 798883 - RNA, 18 nt, Human
uagaaaugcuuauuuccu

SEQ ID NO: 798884 - RNA, 18 nt, Human
uagaaauguaaaugucga

SEQ ID NO: 798885 - RNA, 22 nt, Human
uagcaagaacaaacuaugaaau

SEQ ID NO: 798886 - RNA, 26 nt, Human
uagcuuaaaaaaauacaauuuuagca

SEQ ID NO: 798887 - RNA, 18 nt, Human
uagugcauuuuaguuacu

SEQ ID NO: 798888 - RNA, 21 nt, Human
uagugcauuuuaguuacuguu

SEQ ID NO: 798889 - RNA, 19 nt, Human
uauaacagaaauaucauca

SEQ ID NO: 798890 - RNA, 24 nt, Human
uauacacacacaauaauguacaau

SEQ ID NO: 798891 - RNA, 22 nt, Human
uauauacacacacaauaaugua

SEQ ID NO: 798892 - RNA, 18 nt, Human
uauauauacauauauaca

SEQ ID NO: 798893 - RNA, 20 nt, Human
uauauauauacauauauaca

SEQ ID NO: 798894 - RNA, 24 nt, Human
uauauggcaauaggcuaagacaaa

SEQ ID NO: 798895 - RNA, 22 nt, Human
uaucuaauaucucuuaaugccu

SEQ ID NO: 798896 - RNA, 25 nt, Human
uaugcaaacaugcuacauaaaauaa

SEQ ID NO: 798897 - RNA, 24 nt, Human
uaugcacaugccacacaaugcgua

SEQ ID NO: 798898 - RNA, 18 nt, Human
ucaaguacaagcaugcug

SEQ ID NO: 798899 - RNA, 22 nt, Human
ucaaguacaagcaugcugugcc

SEQ ID NO: 798900 - RNA, 24 nt, Human
ucacaucauucaaaaugauuuaaa

SEQ ID NO: 798901 - RNA, 24 nt, Human
ucaguuccccaccuagacaccacc

SEQ ID NO: 798902 - RNA, 22 nt, Human
uccccccgcucugcccgccgcg

SEQ ID NO: 798903 - RNA, 23 nt, Human
ucccgggacgaccuggagagcuc

SEQ ID NO: 798904 - RNA, 20 nt, Human
ucccuucaagccggaaccuu

SEQ ID NO: 798905 - RNA, 20 nt, Human
ucgauccgccgccgccgccc

SEQ ID NO: 798906 - RNA, 24 nt, Human
ugaaaaacagaaacuuagaaacaa

SEQ ID NO: 798907 - RNA, 21 nt, Human
ugaaauaaaccagaaaagcua

SEQ ID NO: 798908 - RNA, 23 nt, Human
ugaaauaaaccagaaaagcuaac

SEQ ID NO: 798909 - RNA, 20 nt, Human
ugaaauguacacaguaguuc

SEQ ID NO: 798910 - RNA, 20 nt, Human
ugaaugccuucacaucauuc

SEQ ID NO: 798911 - RNA, 25 nt, Human
ugacaugcauauuugauuuacuaca

SEQ ID NO: 798912 - RNA, 21 nt, Human
ugagagcuucuacuggcucua

SEQ ID NO: 798913 - RNA, 22 nt, Human
ugagucccagagaaugucaaaa

SEQ ID NO: 798914 - RNA, 20 nt, Human
ugauagccuguucccccaaa

SEQ ID NO: 798915 - RNA, 18 nt, Human
ugaugcaguacaauguuu

SEQ ID NO: 798916 - RNA, 18 nt, Human
ugccggggccgcuccaga

SEQ ID NO: 798917 - RNA, 21 nt, Human
ugcggggcggggaggacgagc

SEQ ID NO: 798918 - RNA, 18 nt, Human
ugcugcggcugccggggc

SEQ ID NO: 798919 - RNA, 24 nt, Human
uggcuggguggaacugagucuuuu

SEQ ID NO: 798920 - RNA, 20 nt, Human
ugggacacgguggcagcccg

SEQ ID NO: 798921 - RNA, 19 nt, Human
ugucccgggacugcagcag

SEQ ID NO: 798922 - RNA, 22 nt, Human
uuaaauaaacugggacccacac

SEQ ID NO: 798923 - RNA, 22 nt, Human
uuaauucauucaaugguuucug

SEQ ID NO: 798924 - RNA, 20 nt, Human
uuagaaaugcuuauuuccug

SEQ ID NO: 798925 - RNA, 22 nt, Human
uuagaucaucccucuuaguccu

SEQ ID NO: 798926 - RNA, 22 nt, Human
uuauacaacauuucaccaagaa

SEQ ID NO: 798927 - RNA, 20 nt, Human
uuauauauauacauauauac

SEQ ID NO: 798928 - RNA, 19 nt, Human
uucagcugucaacagaagg

SEQ ID NO: 798929 - RNA, 21 nt, Human
uuuaaaacucuguuuucuuua

SEQ ID NO: 798930 - RNA, 22 nt, Human
uuuacacuagcaacaguguaag

SEQ ID NO: 798931 - RNA, 23 nt, Human
uuuauccucuuguggcugggugg

SEQ ID NO: 798932 - RNA, 21 nt, Human
uuugcaaguacugaguaacag

SEQ ID NO: 798933 - RNA, 21 nt, Human
uuuguuugauaagaauucuga

SEQ ID NO: 798934 - RNA, 23 nt, Human
uuuuugcaaguacugaguaacag

SEQ ID NO: 798935 - RNA, 19 nt, Human
aaaaaagacggacgaacag

SEQ ID NO: 798936 - RNA, 26 nt, Human
aaaaagacggacgaacagaccccaaa

SEQ ID NO: 798937 - RNA, 25 nt, Human
aaacaacaacaaaaaagacggacga

SEQ ID NO: 798938 - RNA, 19 nt, Human
aacccccagucccuuccag

SEQ ID NO: 798939 - RNA, 21 nt, Human
aacuugucccccuggccccca

SEQ ID NO: 798940 - RNA, 24 nt, Human
aagacggacgaacagaccccaaaa

SEQ ID NO: 798941 - RNA, 18 nt, Human
aagguucuggggagggac

SEQ ID NO: 798942 - RNA, 26 nt, Human
acaacaaaaaagacggacgaacagac

SEQ ID NO: 798943 - RNA, 21 nt, Human
acaagguucuggggagggaca

SEQ ID NO: 798944 - RNA, 19 nt, Human
acuccgaggucuccagccc

SEQ ID NO: 798945 - RNA, 20 nt, Human
acuuggggaggccuuuggac

SEQ ID NO: 798946 - RNA, 19 nt, Human
agaagggaccaagggcggg

SEQ ID NO: 798947 - RNA, 20 nt, Human
agagauggcacggcuggugg

SEQ ID NO: 798948 - RNA, 19 nt, Human
agcaccauccagacagcag

SEQ ID NO: 798949 - RNA, 20 nt, Human
agcccuggggggcccccgcu

SEQ ID NO: 798950 - RNA, 20 nt, Human
aggaggagcugcugccuggg

SEQ ID NO: 798951 - RNA, 19 nt, Human
aggaggaggagcugcugcc

SEQ ID NO: 798952 - RNA, 23 nt, Human
aggcaggaagcagaggggacccc

SEQ ID NO: 798953 - RNA, 18 nt, Human
aggcuggagguacaacug

SEQ ID NO: 798954 - RNA, 26 nt, Human
caacaaaaaagacggacgaacagacc

SEQ ID NO: 798955 - RNA, 28 nt, Human
caacaaaaaagacggacgaacagacccc

SEQ ID NO: 798956 - RNA, 19 nt, Human
caccacaagauggcucagc

SEQ ID NO: 798957 - RNA, 21 nt, Human
caccagcacgggggccuccag

SEQ ID NO: 798958 - RNA, 21 nt, Human
caccagcacgggggccuccag

SEQ ID NO: 798959 - RNA, 22 nt, Human
caccccaagcugacuuggggag

SEQ ID NO: 798960 - RNA, 26 nt, Human
caccugccuccuuggucccuucaggg

SEQ ID NO: 798961 - RNA, 25 nt, Human
cacgggggccuccaggagggccucg

SEQ ID NO: 798962 - RNA, 24 nt, Human
cagaccccaaaggcauggggcaga

SEQ ID NO: 798963 - RNA, 25 nt, Human
cagaccccaaaggcauggggcagag

SEQ ID NO: 798964 - RNA, 26 nt, Human
cagaccccaaaggcauggggcagagg

SEQ ID NO: 798965 - RNA, 24 nt, Human
cagcacugagacugugcgacacac

SEQ ID NO: 798966 - RNA, 22 nt, Human
cagccccucagcccugacuccc

SEQ ID NO: 798967 - RNA, 21 nt, Human
caggaagagccuuacucuggg

SEQ ID NO: 798968 - RNA, 20 nt, Human
caggcuggagguacaacuga

SEQ ID NO: 798969 - RNA, 21 nt, Human
cagggcaccgagcaggguguc

SEQ ID NO: 798970 - RNA, 20 nt, Human
caguggccuuuaacccccag

SEQ ID NO: 798971 - RNA, 21 nt, Human
cauccagacagcagggaggac

SEQ ID NO: 798972 - RNA, 24 nt, Human
caucccagggguccuccucccaga

SEQ ID NO: 798973 - RNA, 23 nt, Human
cccacaagaggacagcgagucgu

SEQ ID NO: 798974 - RNA, 20 nt, Human
cccccaaacuccaccagcac

SEQ ID NO: 798975 - RNA, 23 nt, Human
cccccaaacuccaccagcacggg

SEQ ID NO: 798976 - RNA, 26 nt, Human
ccccgcuggccacucugccuuccucg

SEQ ID NO: 798977 - RNA, 21 nt, Human
ccccuuuucaccuucuuaucc

SEQ ID NO: 798978 - RNA, 20 nt, Human
cccgaaaggugggcccuggg

SEQ ID NO: 798979 - RNA, 23 nt, Human
ccgaagcagugggugguggggug

SEQ ID NO: 798980 - RNA, 19 nt, Human
ccgaagugcugggggugcg

SEQ ID NO: 798981 - RNA, 20 nt, Human
ccgguccacgggcagggccu

SEQ ID NO: 798982 - RNA, 20 nt, Human
ccucagaggcacugagcucu

SEQ ID NO: 798983 - RNA, 28 nt, Human
ccucugagguagcaccgaagccuggccu

SEQ ID NO: 798984 - RNA, 22 nt, Human
ccugauggggggcugcuccaga

SEQ ID NO: 798985 - RNA, 21 nt, Human
ccuggccugugggccucuggg

SEQ ID NO: 798986 - RNA, 18 nt, Human
cgagcagggugucggggc

SEQ ID NO: 798987 - RNA, 23 nt, Human
cggacgaacagaccccaaaggca

SEQ ID NO: 798988 - RNA, 20 nt, Human
cgggccagggcaccgagcag

SEQ ID NO: 798989 - RNA, 18 nt, Human
cggggcagaggagcagcc

SEQ ID NO: 798990 - RNA, 21 nt, Human
cuccucuccaccuuucggccc

SEQ ID NO: 798991 - RNA, 21 nt, Human
cucgggaggaagcuccucucc

SEQ ID NO: 798992 - RNA, 24 nt, Human
cuggccugugggccucugggguac

SEQ ID NO: 798993 - RNA, 18 nt, Human
cugugcaccugauggggg

SEQ ID NO: 798994 - RNA, 25 nt, Human
cuguguccucaaggagcuggcccag

SEQ ID NO: 798995 - RNA, 19 nt, Human
gaaaggugggcccuggggc

SEQ ID NO: 798996 - RNA, 18 nt, Human
gaacagaccccaaaggca

SEQ ID NO: 798997 - RNA, 19 nt, Human
gaagaggaggaggagcugc

SEQ ID NO: 798998 - RNA, 22 nt, Human
gaccagggcagagagagaaggc

SEQ ID NO: 798999 - RNA, 22 nt, Human
gacucuguguccucaaggagcu

SEQ ID NO: 799000 - RNA, 19 nt, Human
gacugugcgacacacaggc

SEQ ID NO: 799001 - RNA, 25 nt, Human
gagagacuccgaggucuccagcccc

SEQ ID NO: 799002 - RNA, 20 nt, Human
gagcacggucaucucauccg

SEQ ID NO: 799003 - RNA, 19 nt, Human
gagccgguccagucugugg

SEQ ID NO: 799004 - RNA, 23 nt, Human
gaggaggaggagcugcugccugg

SEQ ID NO: 799005 - RNA, 21 nt, Human
gcaccgaagccuggccugugg

SEQ ID NO: 799006 - RNA, 22 nt, Human
gcacugagcucugaggggcguc

SEQ ID NO: 799007 - RNA, 25 nt, Human
gcagaagcagaggcaggaagcagag

SEQ ID NO: 799008 - RNA, 25 nt, Human
gcagaggagggcagcaccauccaga

SEQ ID NO: 799009 - RNA, 19 nt, Human
gcaguggggagggccgcuc

SEQ ID NO: 799010 - RNA, 24 nt, Human
gcccagccucagaggcacugagcu

SEQ ID NO: 799011 - RNA, 19 nt, Human
gcccccaaacuccaccagc

SEQ ID NO: 799012 - RNA, 19 nt, Human
gccuuuggacuuagacagc

SEQ ID NO: 799013 - RNA, 19 nt, Human
gcgcagccccucagcccug

SEQ ID NO: 799014 - RNA, 21 nt, Human
gcgccuggucuggggaggaug

SEQ ID NO: 799015 - RNA, 20 nt, Human
gcuccagagggggcccaagg

SEQ ID NO: 799016 - RNA, 20 nt, Human
gcugcuccagagggggccca

SEQ ID NO: 799017 - RNA, 21 nt, Human
gcuggugggcaggaagcccag

SEQ ID NO: 799018 - RNA, 29 nt, Human
ggaaaggaggggcagcucgggaggaaaag

SEQ ID NO: 799019 - RNA, 18 nt, Human
ggaccagggcagagagag

SEQ ID NO: 799020 - RNA, 22 nt, Human
ggaugacugcccaggaccuggg

SEQ ID NO: 799021 - RNA, 22 nt, Human
ggcaacuugucccccuggcccc

SEQ ID NO: 799022 - RNA, 23 nt, Human
ggcaacuugucccccuggccccc

SEQ ID NO: 799023 - RNA, 20 nt, Human
ggcagagagagaaggcaacu

SEQ ID NO: 799024 - RNA, 18 nt, Human
ggcagcucgggaggaagc

SEQ ID NO: 799025 - RNA, 18 nt, Human
ggccagggcaccgagcag

SEQ ID NO: 799026 - RNA, 18 nt, Human
ggccuuuaacccccaguc

SEQ ID NO: 799027 - RNA, 21 nt, Human
ggcggcugggcuccuggcuuc

SEQ ID NO: 799028 - RNA, 20 nt, Human
ggcugggggcugggccaggc

SEQ ID NO: 799029 - RNA, 18 nt, Human
ggcuggugggcaggaagc

SEQ ID NO: 799030 - RNA, 21 nt, Human
gggcagagagagaaggcaacu

SEQ ID NO: 799031 - RNA, 24 nt, Human
gggcagggccugggaaaggagggg

SEQ ID NO: 799032 - RNA, 19 nt, Human
gggccucugggguaccccc

SEQ ID NO: 799033 - RNA, 19 nt, Human
gguccccagcuccagcggg

SEQ ID NO: 799034 - RNA, 26 nt, Human
guagguaagacucuguguccucaagg

SEQ ID NO: 799035 - RNA, 21 nt, Human
gucuggggaggaugacugccc

SEQ ID NO: 799036 - RNA, 23 nt, Human
gugggguauacuucagaggaaac

SEQ ID NO: 799037 - RNA, 21 nt, Human
guggggugugccagggacccc

SEQ ID NO: 799038 - RNA, 18 nt, Human
uaacccccagucccuucc

SEQ ID NO: 799039 - RNA, 22 nt, Human
uacccccaccccaagcugacuu

SEQ ID NO: 799040 - RNA, 27 nt, Human
uacccccaccccaagcugacuugggga

SEQ ID NO: 799041 - RNA, 21 nt, Human
ucagccugaaguagggacugg

SEQ ID NO: 799042 - RNA, 21 nt, Human
ucagggagggguccccgucuc

SEQ ID NO: 799043 - RNA, 21 nt, Human
ucccagggguccuccuccccc

SEQ ID NO: 799044 - RNA, 23 nt, Human
ucggcccagccucagaggcacug

SEQ ID NO: 799045 - RNA, 25 nt, Human
ucugccuuccucggccauguccgaa

SEQ ID NO: 799046 - RNA, 19 nt, Human
ugaagagagccgguccagu

SEQ ID NO: 799047 - RNA, 22 nt, Human
ugaagagagccgguccagucug

SEQ ID NO: 799048 - RNA, 23 nt, Human
ugacugcccaggaccuggguggu

SEQ ID NO: 799049 - RNA, 22 nt, Human
ugagaacaguccuacaagguuc

SEQ ID NO: 799050 - RNA, 22 nt, Human
uggcacggcuggugggcaggaa

SEQ ID NO: 799051 - RNA, 20 nt, Human
ugggaaaggaggggcagcuc

SEQ ID NO: 799052 - RNA, 21 nt, Human
ugggccugcagccccggccag

SEQ ID NO: 799053 - RNA, 20 nt, Human
uggggggcugcgacacagug

SEQ ID NO: 799054 - RNA, 24 nt, Human
uggggggcugcgacacaguggccc

SEQ ID NO: 799055 - RNA, 24 nt, Human
ugggguauacuucagaggaaacag

SEQ ID NO: 799056 - RNA, 23 nt, Human
ugggugguggggugugccagggg

SEQ ID NO: 799057 - RNA, 19 nt, Human
ugguggggugugccaggga

SEQ ID NO: 799058 - RNA, 20 nt, Human
ugguggggugugccagggac

SEQ ID NO: 799059 - RNA, 19 nt, Human
ugucggggcugggugccuc

SEQ ID NO: 799060 - RNA, 27 nt, Human
uucaauauauaaaaacaacaacaaaaa

SEQ ID NO: 799061 - RNA, 26 nt, Human
uuccaggaagagccuuacucugggug

SEQ ID NO: 799062 - RNA, 18 nt, Human
uuccucggccauguccga

SEQ ID NO: 799063 - RNA, 24 nt, Human
uucggcccagccucagaggcacug

SEQ ID NO: 799064 - RNA, 19 nt, Human
acuuuuucugucugcaaac

SEQ ID NO: 799065 - RNA, 22 nt, Human
auccggcgacccgccaccccca

SEQ ID NO: 799066 - RNA, 24 nt, Human
caaagaugcuucaaacugguccaa

SEQ ID NO: 799067 - RNA, 23 nt, Human
cacccccacuccgcgucucugcc

SEQ ID NO: 799068 - RNA, 25 nt, Human
cacuccgcgucucugccugcgggga

SEQ ID NO: 799069 - RNA, 18 nt, Human
cccacgcacacuccaaug

SEQ ID NO: 799070 - RNA, 21 nt, Human
cccacgcacacuccaaugccg

SEQ ID NO: 799071 - RNA, 25 nt, Human
ccuagccgcucucacaccccucuug

SEQ ID NO: 799072 - RNA, 22 nt, Human
cgagcguagcgagaagacccac

SEQ ID NO: 799073 - RNA, 22 nt, Human
cguaucagugagcccgcaccca

SEQ ID NO: 799074 - RNA, 19 nt, Human
cuagccgcucucacacccc

SEQ ID NO: 799075 - RNA, 22 nt, Human
cugguccaaauaacaaguaccc

SEQ ID NO: 799076 - RNA, 20 nt, Human
cuuacaucccuuucugguga

SEQ ID NO: 799077 - RNA, 19 nt, Human
gagcccgcacccacuccug

SEQ ID NO: 799078 - RNA, 21 nt, Human
guagcgagaagacccacgcac

SEQ ID NO: 799079 - RNA, 24 nt, Human
guccaaauaacaaguacccaauug

SEQ ID NO: 799080 - RNA, 26 nt, Human
uaaauuuacaaauacaaaccaauacu

SEQ ID NO: 799081 - RNA, 21 nt, Human
uaagcgagacuuacaucccuu

SEQ ID NO: 799082 - RNA, 19 nt, Human
uacccaaugcucugaauuc

SEQ ID NO: 799083 - RNA, 23 nt, Human
uauaaggcauguccaguuuaugu

SEQ ID NO: 799084 - RNA, 19 nt, Human
ucuguugccaguuggucca

SEQ ID NO: 799085 - RNA, 19 nt, Human
ugagcccgcacccacuccu

SEQ ID NO: 799086 - RNA, 18 nt, Human
ugucugcaaacaucaccu

SEQ ID NO: 799087 - RNA, 23 nt, Human
uuucuguugccaguugguccaau

SEQ ID NO: 799088 - RNA, 27 nt, Human
uuuuuuaaauuuacaaauacaaaccaa

SEQ ID NO: 799089 - RNA, 25 nt, Human
aaccaggaguuuggugugguuucug

SEQ ID NO: 799090 - RNA, 19 nt, Human
acagacagcggccccaggc

SEQ ID NO: 799091 - RNA, 19 nt, Human
acggcgcacagacagcggc

SEQ ID NO: 799092 - RNA, 19 nt, Human
aggagcuggcuaugugaag

SEQ ID NO: 799093 - RNA, 21 nt, Human
aggaggcccuggggguuucuu

SEQ ID NO: 799094 - RNA, 21 nt, Human
aggcagcagcagguuauggcu

SEQ ID NO: 799095 - RNA, 21 nt, Human
aggcagccagguucucgaaug

SEQ ID NO: 799096 - RNA, 24 nt, Human
augcugggcccuccaucaggcagc

SEQ ID NO: 799097 - RNA, 22 nt, Human
augcugggcccuccaucaggcc

SEQ ID NO: 799098 - RNA, 20 nt, Human
augggcgggcaggcgggucc

SEQ ID NO: 799099 - RNA, 27 nt, Human
cacacaccacagugcuggucccagagg

SEQ ID NO: 799100 - RNA, 24 nt, Human
cacacggcgcacagacagcggccc

SEQ ID NO: 799101 - RNA, 20 nt, Human
caccacagugcuggucccag

SEQ ID NO: 799102 - RNA, 19 nt, Human
cacgugacagccugugugu

SEQ ID NO: 799103 - RNA, 19 nt, Human
cagaauauucucccccucu

SEQ ID NO: 799104 - RNA, 25 nt, Human
cagacaucuucacauccucagucuu

SEQ ID NO: 799105 - RNA, 20 nt, Human
cagagccucugcugccucuc

SEQ ID NO: 799106 - RNA, 23 nt, Human
cagagcucaggccccagucaccu

SEQ ID NO: 799107 - RNA, 18 nt, Human
cagcagaauauucucccc

SEQ ID NO: 799108 - RNA, 20 nt, Human
cagcagguuauggcuccuuc

SEQ ID NO: 799109 - RNA, 23 nt, Human
cagcggccccaggcagccagguu

SEQ ID NO: 799110 - RNA, 20 nt, Human
caggaggcugaaggugacug

SEQ ID NO: 799111 - RNA, 20 nt, Human
cauagaagucccaucggcca

SEQ ID NO: 799112 - RNA, 18 nt, Human
caucaccaaccaggaguu

SEQ ID NO: 799113 - RNA, 20 nt, Human
caucaccaaccaggaguuug

SEQ ID NO: 799114 - RNA, 24 nt, Human
caucaccaagucacaguuuccagc

SEQ ID NO: 799115 - RNA, 20 nt, Human
caucugcagaccagcagaau

SEQ ID NO: 799116 - RNA, 18 nt, Human
ccacaggauacaggugca

SEQ ID NO: 799117 - RNA, 21 nt, Human
ccagcucucgacucaaggcca

SEQ ID NO: 799118 - RNA, 20 nt, Human
ccauugacauuccacaggga

SEQ ID NO: 799119 - RNA, 20 nt, Human
ccccucgggcggccuuuggu

SEQ ID NO: 799120 - RNA, 24 nt, Human
ccucuccugcuggccguccaggaa

SEQ ID NO: 799121 - RNA, 18 nt, Human
ccucucucuuccuaccca

SEQ ID NO: 799122 - RNA, 24 nt, Human
ccucucucuuccuacccaucugca

SEQ ID NO: 799123 - RNA, 23 nt, Human
ccucugcugccucucucuuccua

SEQ ID NO: 799124 - RNA, 21 nt, Human
cggccagagcagucacugcgg

SEQ ID NO: 799125 - RNA, 19 nt, Human
cucccacacacacaccaca

SEQ ID NO: 799126 - RNA, 20 nt, Human
cucccccucucaucaccaac

SEQ ID NO: 799127 - RNA, 23 nt, Human
cucgacucaaggccagguucuuc

SEQ ID NO: 799128 - RNA, 23 nt, Human
cugggccccaggcuguggugaug

SEQ ID NO: 799129 - RNA, 23 nt, Human
cuucacauccucagucuuccaaa

SEQ ID NO: 799130 - RNA, 19 nt, Human
cuuguggccucuugggcuu

SEQ ID NO: 799131 - RNA, 22 nt, Human
gaacagacaucuucacauccuc

SEQ ID NO: 799132 - RNA, 22 nt, Human
gacgcugccaggcacgugacag

SEQ ID NO: 799133 - RNA, 21 nt, Human
gagaacuguggggaaggaggc

SEQ ID NO: 799134 - RNA, 19 nt, Human
gaggagcuggcuaugugaa

SEQ ID NO: 799135 - RNA, 21 nt, Human
gcacagacagcggccccaggc

SEQ ID NO: 799136 - RNA, 20 nt, Human
gcggccccaggcagccaggu

SEQ ID NO: 799137 - RNA, 23 nt, Human
ggaacagacaucuucacauccuc

SEQ ID NO: 799138 - RNA, 18 nt, Human
ggaccaugccgucuugac

SEQ ID NO: 799139 - RNA, 19 nt, Human
ggccagagcagucacugcg

SEQ ID NO: 799140 - RNA, 22 nt, Human
gguuuugcugggcuucccuguc

SEQ ID NO: 799141 - RNA, 22 nt, Human
gugcagcugggcaucaccaagu

SEQ ID NO: 799142 - RNA, 23 nt, Human
uaaagacaauacaauaauuucca

SEQ ID NO: 799143 - RNA, 24 nt, Human
uaagcgacccaucuuuuuuuuuuu

SEQ ID NO: 799144 - RNA, 20 nt, Human
ucaccaagucacaguuucca

SEQ ID NO: 799145 - RNA, 23 nt, Human
ucacugauggugauggcugagau

SEQ ID NO: 799146 - RNA, 18 nt, Human
uccaccucauuguaagcc

SEQ ID NO: 799147 - RNA, 21 nt, Human
ucccaugcugggcccuccauc

SEQ ID NO: 799148 - RNA, 23 nt, Human
ucuccugcuggccguccaggaac

SEQ ID NO: 799149 - RNA, 23 nt, Human
ucuucuguaggcagagcucaggc

SEQ ID NO: 799150 - RNA, 19 nt, Human
ugagaacuguggggaagga

SEQ ID NO: 799151 - RNA, 20 nt, Human
ugagacgucacugaugguga

SEQ ID NO: 799152 - RNA, 19 nt, Human
ugagaugccuucccgaugg

SEQ ID NO: 799153 - RNA, 21 nt, Human
ugccagagccucugcugccuc

SEQ ID NO: 799154 - RNA, 24 nt, Human
ugcucauccuuuucauagaagucc

SEQ ID NO: 799155 - RNA, 21 nt, Human
ugcugggcccuccaucaggca

SEQ ID NO: 799156 - RNA, 22 nt, Human
ugcugggcuucccugucaaagc

SEQ ID NO: 799157 - RNA, 21 nt, Human
uggagaggguugggcugcaga

SEQ ID NO: 799158 - RNA, 24 nt, Human
uggcacuguugugccagagccucu

SEQ ID NO: 799159 - RNA, 21 nt, Human
uggccucuugggcuuggaggc

SEQ ID NO: 799160 - RNA, 24 nt, Human
uguggggaaggaggcccugggggu

SEQ ID NO: 799161 - RNA, 20 nt, Human
uguggugaugcuggccaggg

SEQ ID NO: 799162 - RNA, 20 nt, Human
uguugugccagagccucugc

SEQ ID NO: 799163 - RNA, 20 nt, Human
uuggugugguuucuggacac

SEQ ID NO: 799164 - RNA, 19 nt, Human
aaaccaaccaaccaacaaa

SEQ ID NO: 799165 - RNA, 21 nt, Human
aacaaacaacaaaccaaccaa

SEQ ID NO: 799166 - RNA, 21 nt, Human
aacaaaccaaccaaccaacaa

SEQ ID NO: 799167 - RNA, 28 nt, Human
acaaacaacaaaccaaccaaccaacaaa

SEQ ID NO: 799168 - RNA, 19 nt, Human
acaaaccaaccaaccaaca

SEQ ID NO: 799169 - RNA, 23 nt, Human
acacacugcgaagucagccccuc

SEQ ID NO: 799170 - RNA, 25 nt, Human
acagggcauauuaaacaaacaacaa

SEQ ID NO: 799171 - RNA, 18 nt, Human
aggcuggggcccgcccgc

SEQ ID NO: 799172 - RNA, 22 nt, Human
caaacaacaaaccaaccaacca

SEQ ID NO: 799173 - RNA, 20 nt, Human
caacaaaccaaccaaccaac

SEQ ID NO: 799174 - RNA, 23 nt, Human
caacagaaguagaaaacagggca

SEQ ID NO: 799175 - RNA, 19 nt, Human
cagccccucugcccagucu

SEQ ID NO: 799176 - RNA, 22 nt, Human
caugggcccgcgggccccgcuc

SEQ ID NO: 799177 - RNA, 22 nt, Human
ccccaggccuccucaugggccc

SEQ ID NO: 799178 - RNA, 19 nt, Human
ccccgccccuuccucccuu

SEQ ID NO: 799179 - RNA, 20 nt, Human
ccccgccccuuccucccuuc

SEQ ID NO: 799180 - RNA, 23 nt, Human
cccgcggccgaccggccucccuc

SEQ ID NO: 799181 - RNA, 24 nt, Human
cccgcgggccccgcuccucgggag

SEQ ID NO: 799182 - RNA, 20 nt, Human
cccucgccgccgccgccgcc

SEQ ID NO: 799183 - RNA, 19 nt, Human
cccucuggcgcucuccccg

SEQ ID NO: 799184 - RNA, 24 nt, Human
ccucccuucccucaggcuggggcc

SEQ ID NO: 799185 - RNA, 19 nt, Human
ccucgccgccgccgccgcc

SEQ ID NO: 799186 - RNA, 20 nt, Human
cgaagucagccccucugccc

SEQ ID NO: 799187 - RNA, 20 nt, Human
cgaggcucgcucccucgccg

SEQ ID NO: 799188 - RNA, 19 nt, Human
cgccccuuccucccuuccc

SEQ ID NO: 799189 - RNA, 21 nt, Human
cucccucgccgccgccgccgc

SEQ ID NO: 799190 - RNA, 22 nt, Human
gcuccagcccggcgaacgccau

SEQ ID NO: 799191 - RNA, 18 nt, Human
uacucgcuccagcccggc

SEQ ID NO: 799192 - RNA, 19 nt, Human
ucagccccucugcccaguc

SEQ ID NO: 799193 - RNA, 18 nt, Human
ucaugggcccgcgggccc

SEQ ID NO: 799194 - RNA, 24 nt, Human
uccaacagaaguagaaaacagggc

SEQ ID NO: 799195 - RNA, 24 nt, Human
uccaugcucccacugguuuauuuc

SEQ ID NO: 799196 - RNA, 22 nt, Human
uccccaggccuccucaugggcc

SEQ ID NO: 799197 - RNA, 25 nt, Human
uccccaggccuccucaugggcccgc

SEQ ID NO: 799198 - RNA, 23 nt, Human
ucccucgccgccgccgccgccuc

SEQ ID NO: 799199 - RNA, 22 nt, Human
uccucccuucccucaggcuggg

SEQ ID NO: 799200 - RNA, 21 nt, Human
ucgccgccgccgccgccucca

SEQ ID NO: 799201 - RNA, 23 nt, Human
ucgcucccucgccgccgccgccg

SEQ ID NO: 799202 - RNA, 22 nt, Human
ucuggaaaagcaacggcguaag

SEQ ID NO: 799203 - RNA, 23 nt, Human
ucuggcgcucuccccgccccuuc

SEQ ID NO: 799204 - RNA, 19 nt, Human
uguacucgcuccagcccgg

SEQ ID NO: 799205 - RNA, 23 nt, Human
uuaaacaaacaacaaaccaacca

SEQ ID NO: 799206 - RNA, 23 nt, Human
uucaaccccaaauauuuuccaac

SEQ ID NO: 799207 - RNA, 20 nt, Human
uuuuuuuuuuuuuuuuccau

SEQ ID NO: 799208 - RNA, 24 nt, Human
uuuuuuuuuuuuuuuuuuuccaug

SEQ ID NO: 799209 - RNA, 21 nt, Human
agaauucucccugccgggcuu

SEQ ID NO: 799210 - RNA, 19 nt, Human
aucuggcagaauucucccu

SEQ ID NO: 799211 - RNA, 26 nt, Human
caaaugaccacacucaggaauauggc

SEQ ID NO: 799212 - RNA, 19 nt, Human
ccgggcuuccuggugcugu

SEQ ID NO: 799213 - RNA, 18 nt, Human
gcucagggaccaggguag

SEQ ID NO: 799214 - RNA, 19 nt, Human
gguccagcagcccacgggc

SEQ ID NO: 799215 - RNA, 19 nt, Human
gucagaucaagagacgagc

SEQ ID NO: 799216 - RNA, 20 nt, Human
aaaaacaagaccacagaagc

SEQ ID NO: 799217 - RNA, 23 nt, Human
aaaacaaacugcaaucuaagcau

SEQ ID NO: 799218 - RNA, 23 nt, Human
aaaauacaauuaaauauuucuuu

SEQ ID NO: 799219 - RNA, 21 nt, Human
aaacaaacugcaaucuaagca

SEQ ID NO: 799220 - RNA, 20 nt, Human
aaaugcaaaacaaacugcaa

SEQ ID NO: 799221 - RNA, 22 nt, Human
aacaaaaaacucauacuucuca

SEQ ID NO: 799222 - RNA, 22 nt, Human
aaccacugaaaaaguagugcaa

SEQ ID NO: 799223 - RNA, 18 nt, Human
aagaacaaauuauugugu

SEQ ID NO: 799224 - RNA, 18 nt, Human
aagaacuucacaaaccug

SEQ ID NO: 799225 - RNA, 21 nt, Human
aagcagaaauuuggacuugag

SEQ ID NO: 799226 - RNA, 23 nt, Human
aagcucaacaaacuuguguugaa

SEQ ID NO: 799227 - RNA, 21 nt, Human
aaggggaccaagaaccacuga

SEQ ID NO: 799228 - RNA, 23 nt, Human
acaaaacaaguuuuauuuugcaa

SEQ ID NO: 799229 - RNA, 24 nt, Human
acaaaccugcaaauaaaaugcauc

SEQ ID NO: 799230 - RNA, 23 nt, Human
acacugcaacaauucaaaaagua

SEQ ID NO: 799231 - RNA, 19 nt, Human
acauuaagaugaagucaag

SEQ ID NO: 799232 - RNA, 22 nt, Human
accuuguagugaaauuuuauga

SEQ ID NO: 799233 - RNA, 20 nt, Human
acuccaaagaaaguaaaaua

SEQ ID NO: 799234 - RNA, 22 nt, Human
acugccugccaacaguuguucc

SEQ ID NO: 799235 - RNA, 20 nt, Human
agaaaaacaagaauaauuaa

SEQ ID NO: 799236 - RNA, 23 nt, Human
agacaaaaauacaucacccaaga

SEQ ID NO: 799237 - RNA, 23 nt, Human
agccauuaaaaacaagaccacag

SEQ ID NO: 799238 - RNA, 19 nt, Human
agucacaccagaauuuacu

SEQ ID NO: 799239 - RNA, 18 nt, Human
aguggcugcauuaagaac

SEQ ID NO: 799240 - RNA, 19 nt, Human
auagaagaaacagacugug

SEQ ID NO: 799241 - RNA, 18 nt, Human
auggcagacaaggaaugg

SEQ ID NO: 799242 - RNA, 23 nt, Human
auuguaacuagaaaaguuugaaa

SEQ ID NO: 799243 - RNA, 23 nt, Human
auuucagaauucucaaauuacuu

SEQ ID NO: 799244 - RNA, 22 nt, Human
caaaacaaacugcaaucuaagc

SEQ ID NO: 799245 - RNA, 21 nt, Human
caaaauaaaaugaaagcugac

SEQ ID NO: 799246 - RNA, 18 nt, Human
caaaccuucacucaauua

SEQ ID NO: 799247 - RNA, 23 nt, Human
caacaaacuuguguugaacugaa

SEQ ID NO: 799248 - RNA, 19 nt, Human
caaguuaagaaaauuauac

SEQ ID NO: 799249 - RNA, 22 nt, Human
caccuggauaagaaauaugacu

SEQ ID NO: 799250 - RNA, 23 nt, Human
cacuuuggaaaagcauuaucaaa

SEQ ID NO: 799251 - RNA, 21 nt, Human
cagaauggcagacaaggaaug

SEQ ID NO: 799252 - RNA, 19 nt, Human
cagacaaggaaugggagaa

SEQ ID NO: 799253 - RNA, 24 nt, Human
cauuggcucuugaacugauggcug

SEQ ID NO: 799254 - RNA, 20 nt, Human
cauuucuacagaccaucuuu

SEQ ID NO: 799255 - RNA, 23 nt, Human
ccaaaauuaguaaaucugaauga

SEQ ID NO: 799256 - RNA, 24 nt, Human
ccaaaauuaguaaaucugaaugaa

SEQ ID NO: 799257 - RNA, 20 nt, Human
ccaacaguuguuccuugugu

SEQ ID NO: 799258 - RNA, 20 nt, Human
ccacuacaaaauacgggaac

SEQ ID NO: 799259 - RNA, 21 nt, Human
cccaagaugugguaaagggga

SEQ ID NO: 799260 - RNA, 22 nt, Human
ccgcugccgucucugccgcucc

SEQ ID NO: 799261 - RNA, 23 nt, Human
cgaacauauguuaacaguaauac

SEQ ID NO: 799262 - RNA, 23 nt, Human
cuaaagauauucaaaugagaagg

SEQ ID NO: 799263 - RNA, 20 nt, Human
cugccgcucccgccgccacu

SEQ ID NO: 799264 - RNA, 19 nt, Human
cugccgucucugccgcucc

SEQ ID NO: 799265 - RNA, 19 nt, Human
cuggaaaaauacagaaugu

SEQ ID NO: 799266 - RNA, 21 nt, Human
cuguguauauauauauauuug

SEQ ID NO: 799267 - RNA, 22 nt, Human
cuguuugggaaaaaaaguuguu

SEQ ID NO: 799268 - RNA, 18 nt, Human
gaauagaagaaacagacu

SEQ ID NO: 799269 - RNA, 21 nt, Human
gaaugucuuucauuaggugua

SEQ ID NO: 799270 - RNA, 19 nt, Human
gauucguaaggguuuccuu

SEQ ID NO: 799271 - RNA, 24 nt, Human
gcaagaacuucacaaaccugcaaa

SEQ ID NO: 799272 - RNA, 22 nt, Human
gcucaacaaacuuguguugaac

SEQ ID NO: 799273 - RNA, 25 nt, Human
ggaaaagcauuaucaaaucugaaaa

SEQ ID NO: 799274 - RNA, 20 nt, Human
ggaccaagaaccacugaaaa

SEQ ID NO: 799275 - RNA, 26 nt, Human
ggcaaaggggaagaagacaaaaauac

SEQ ID NO: 799276 - RNA, 21 nt, Human
gggggugggaaugaggcgggg

SEQ ID NO: 799277 - RNA, 23 nt, Human
guacagcaucccuaaucuuuaaa

SEQ ID NO: 799278 - RNA, 28 nt, Human
guagaaauuuaaaaaaaaaaaaaaaaaa

SEQ ID NO: 799279 - RNA, 20 nt, Human
uaaaaacauuucuacagacc

SEQ ID NO: 799280 - RNA, 25 nt, Human
uaaaacauuucuguaguaagaguuu

SEQ ID NO: 799281 - RNA, 21 nt, Human
uaaaaucgauacugccugcca

SEQ ID NO: 799282 - RNA, 20 nt, Human
uaaaaugaaagcugacagac

SEQ ID NO: 799283 - RNA, 23 nt, Human
uaaaaugaaagcugacagacuca

SEQ ID NO: 799284 - RNA, 23 nt, Human
uaacaagaauuuagcacuaaaaa

SEQ ID NO: 799285 - RNA, 24 nt, Human
uaagaugaagucaaguguugcaaa

SEQ ID NO: 799286 - RNA, 19 nt, Human
uaagcagaaauuuggacuu

SEQ ID NO: 799287 - RNA, 19 nt, Human
uaagguaacccaucaaccc

SEQ ID NO: 799288 - RNA, 22 nt, Human
uacaaaauacgggaacacauua

SEQ ID NO: 799289 - RNA, 23 nt, Human
uacaaguuaagaaaauuauacac

SEQ ID NO: 799290 - RNA, 22 nt, Human
uacacaaacacuuaaaaauuca

SEQ ID NO: 799291 - RNA, 23 nt, Human
uacaucacccaagaugugguaaa

SEQ ID NO: 799292 - RNA, 21 nt, Human
uagaaaacagauugugaccau

SEQ ID NO: 799293 - RNA, 19 nt, Human
uaugucuaggaauagaaga

SEQ ID NO: 799294 - RNA, 21 nt, Human
uauuaacagacuucuuuuucc

SEQ ID NO: 799295 - RNA, 18 nt, Human
uauuaagaaaggacagcu

SEQ ID NO: 799296 - RNA, 20 nt, Human
uauuaagaaaggacagcuca

SEQ ID NO: 799297 - RNA, 24 nt, Human
uauuuaagcacuuaagcugacauu

SEQ ID NO: 799298 - RNA, 24 nt, Human
uccgcggcggccgcagcuggguca

SEQ ID NO: 799299 - RNA, 18 nt, Human
ucuaaguaucacuugacc

SEQ ID NO: 799300 - RNA, 18 nt, Human
ucuacagaccaucuuuga

SEQ ID NO: 799301 - RNA, 22 nt, Human
ucuaggaauagaagaaacagac

SEQ ID NO: 799302 - RNA, 24 nt, Human
ucuguaaucacacagagccggggc

SEQ ID NO: 799303 - RNA, 24 nt, Human
ugaaaauggcaucuccaacacugc

SEQ ID NO: 799304 - RNA, 21 nt, Human
ugaacugaauugcagauccug

SEQ ID NO: 799305 - RNA, 24 nt, Human
ugaagggaagcaguccgaacauau

SEQ ID NO: 799306 - RNA, 24 nt, Human
ugaauguacauuaagaugaaguca

SEQ ID NO: 799307 - RNA, 19 nt, Human
ugacuuaauuacuacacaa

SEQ ID NO: 799308 - RNA, 18 nt, Human
ugagaaaaacaagaauaa

SEQ ID NO: 799309 - RNA, 21 nt, Human
ugaggcggggagacuaaauca

SEQ ID NO: 799310 - RNA, 22 nt, Human
ugcagaaaugggaaauuuuaug

SEQ ID NO: 799311 - RNA, 22 nt, Human
ugccugugugagaaaaacaaga

SEQ ID NO: 799312 - RNA, 23 nt, Human
uggaaaagcauuaucaaaucuga

SEQ ID NO: 799313 - RNA, 20 nt, Human
uggaaugucuuucauuaggu

SEQ ID NO: 799314 - RNA, 22 nt, Human
ugggucacggccagaacccgga

SEQ ID NO: 799315 - RNA, 18 nt, Human
uguauaaacacaaaauac

SEQ ID NO: 799316 - RNA, 20 nt, Human
uguauaaacacaaaauacaa

SEQ ID NO: 799317 - RNA, 20 nt, Human
uguauuuaaaacauuucugu

SEQ ID NO: 799318 - RNA, 20 nt, Human
uuaaaaaaaaaaaaaaaaaa

SEQ ID NO: 799319 - RNA, 25 nt, Human
uuaaaaaaaaaaaaaaaaaaaaaaa

SEQ ID NO: 799320 - RNA, 23 nt, Human
uuaaccaccuggauaagaaauau

SEQ ID NO: 799321 - RNA, 20 nt, Human
uuaaucuaaugaaaauauuc

SEQ ID NO: 799322 - RNA, 24 nt, Human
uuagcaaaauaaaaugaaagcuga

SEQ ID NO: 799323 - RNA, 19 nt, Human
uuuaaguaaaacaaaaaca

SEQ ID NO: 799324 - RNA, 22 nt, Human
uuuguugggggugggaaugagg

SEQ ID NO: 799325 - RNA, 18 nt, Human
aaaaaaguuuucaccuuc

SEQ ID NO: 799326 - RNA, 18 nt, Human
aaaacauagcauugucaa

SEQ ID NO: 799327 - RNA, 24 nt, Human
aaaacauagcauugucaagcauga

SEQ ID NO: 799328 - RNA, 19 nt, Human
aaaauggcuccugaaauga

SEQ ID NO: 799329 - RNA, 24 nt, Human
aaacauuugguaccaucagcucug

SEQ ID NO: 799330 - RNA, 23 nt, Human
aaacuaguuucaauucaucuuua

SEQ ID NO: 799331 - RNA, 23 nt, Human
aaaugaccucaggaaaccagagu

SEQ ID NO: 799332 - RNA, 22 nt, Human
aaauggcuccugaaaugagagu

SEQ ID NO: 799333 - RNA, 19 nt, Human
aagaacagagcuuuguccc

SEQ ID NO: 799334 - RNA, 23 nt, Human
aagagaaaacauagcauugucaa

SEQ ID NO: 799335 - RNA, 18 nt, Human
aagcaaaggccuaggaaa

SEQ ID NO: 799336 - RNA, 19 nt, Human
aaugaauacaaccccuccu

SEQ ID NO: 799337 - RNA, 23 nt, Human
aaugcccaucuacccacccugac

SEQ ID NO: 799338 - RNA, 18 nt, Human
accagcaaagcaaaggcc

SEQ ID NO: 799339 - RNA, 23 nt, Human
agaaagaacagacuugagugcua

SEQ ID NO: 799340 - RNA, 22 nt, Human
agaagaauaaaaaauaucuaga

SEQ ID NO: 799341 - RNA, 23 nt, Human
agaagaauaaaaaauaucuagaa

SEQ ID NO: 799342 - RNA, 18 nt, Human
agcaaagcaaaggccuag

SEQ ID NO: 799343 - RNA, 22 nt, Human
agccacaggaauucuuguaacc

SEQ ID NO: 799344 - RNA, 23 nt, Human
aggaaaaaaaaauacaccucuga

SEQ ID NO: 799345 - RNA, 19 nt, Human
aggcagauuuguugagucc

SEQ ID NO: 799346 - RNA, 20 nt, Human
aggcuggauuugugaaauga

SEQ ID NO: 799347 - RNA, 18 nt, Human
agggagcuaagcuuaaaa

SEQ ID NO: 799348 - RNA, 19 nt, Human
agggauugaauuuggggaa

SEQ ID NO: 799349 - RNA, 20 nt, Human
auaaaacaaacaaccuacuu

SEQ ID NO: 799350 - RNA, 18 nt, Human
auaauccuaaagcaugcc

SEQ ID NO: 799351 - RNA, 25 nt, Human
aucaccauuucuacccacuugugug

SEQ ID NO: 799352 - RNA, 20 nt, Human
auccauggacuguagccccc

SEQ ID NO: 799353 - RNA, 22 nt, Human
aucugauuauaaaacaaacaac

SEQ ID NO: 799354 - RNA, 21 nt, Human
augaauacaaccccuccucau

SEQ ID NO: 799355 - RNA, 23 nt, Human
auggcccaaauuuacaucuuacc

SEQ ID NO: 799356 - RNA, 24 nt, Human
auuucugccaaugcccuucuggcu

SEQ ID NO: 799357 - RNA, 19 nt, Human
caaagcaaaggccuaggaa

SEQ ID NO: 799358 - RNA, 24 nt, Human
caacagcaaugguguuaaccaaag

SEQ ID NO: 799359 - RNA, 22 nt, Human
caaccagcaaagcaaaggccua

SEQ ID NO: 799360 - RNA, 24 nt, Human
caagugguugccuaucucaaaaac

SEQ ID NO: 799361 - RNA, 19 nt, Human
cacaccaaucaagugguug

SEQ ID NO: 799362 - RNA, 19 nt, Human
cagaguucuaaacaaugac

SEQ ID NO: 799363 - RNA, 23 nt, Human
cagugcagccacaggaauucuug

SEQ ID NO: 799364 - RNA, 22 nt, Human
caguggcuggcucacuucuccu

SEQ ID NO: 799365 - RNA, 19 nt, Human
cauacugauacauccagga

SEQ ID NO: 799366 - RNA, 21 nt, Human
ccaaugcccaucuacccaccc

SEQ ID NO: 799367 - RNA, 22 nt, Human
ccaugaaaucaugcuccaccuu

SEQ ID NO: 799368 - RNA, 24 nt, Human
cccacccugaccucggggagcagc

SEQ ID NO: 799369 - RNA, 21 nt, Human
cccgcuuucaucauaucacca

SEQ ID NO: 799370 - RNA, 27 nt, Human
ccuauagccaauucaaaaccggggucc

SEQ ID NO: 799371 - RNA, 21 nt, Human
ccucugaaagugagcuagccc

SEQ ID NO: 799372 - RNA, 21 nt, Human
ccugaccucggggagcagcac

SEQ ID NO: 799373 - RNA, 22 nt, Human
cgauauguaauuuauuuaaagc

SEQ ID NO: 799374 - RNA, 26 nt, Human
cuagccccaaggaauaagguucagaa

SEQ ID NO: 799375 - RNA, 23 nt, Human
cucaggugacugaaauucugccu

SEQ ID NO: 799376 - RNA, 26 nt, Human
cucucaucuauucuauuucugagaaa

SEQ ID NO: 799377 - RNA, 24 nt, Human
cuugccauaauccuaaagcaugcc

SEQ ID NO: 799378 - RNA, 23 nt, Human
gaaagaacagacuugagugcuag

SEQ ID NO: 799379 - RNA, 18 nt, Human
gaaauucugccuucugcc

SEQ ID NO: 799380 - RNA, 23 nt, Human
gacaaaaugaccucaggaaacca

SEQ ID NO: 799381 - RNA, 22 nt, Human
gaggugauuuaucaacuuuaga

SEQ ID NO: 799382 - RNA, 21 nt, Human
gcugcagucugauauaagaga

SEQ ID NO: 799383 - RNA, 20 nt, Human
ggcauaucagugccaugaaa

SEQ ID NO: 799384 - RNA, 18 nt, Human
guaaaaggaagcucuuuc

SEQ ID NO: 799385 - RNA, 23 nt, Human
uaaaaggaagcucuuucacccac

SEQ ID NO: 799386 - RNA, 23 nt, Human
uaaagcaugccaagauggcauga

SEQ ID NO: 799387 - RNA, 24 nt, Human
uaaugaauacaaccccuccucauc

SEQ ID NO: 799388 - RNA, 19 nt, Human
uacuucagccuauuuuguu

SEQ ID NO: 799389 - RNA, 20 nt, Human
uagcauugucaagcaugaua

SEQ ID NO: 799390 - RNA, 24 nt, Human
ucaacagcaaugguguuaaccaaa

SEQ ID NO: 799391 - RNA, 20 nt, Human
ucacugggucugccugacug

SEQ ID NO: 799392 - RNA, 19 nt, Human
ucagaaagaacagacuuga

SEQ ID NO: 799393 - RNA, 19 nt, Human
ucaggaaauccucacagag

SEQ ID NO: 799394 - RNA, 23 nt, Human
uccaccuuugcccgcuuucauca

SEQ ID NO: 799395 - RNA, 24 nt, Human
uccagugcugcucauccauggacu

SEQ ID NO: 799396 - RNA, 21 nt, Human
ucuagauauguaucaagcuua

SEQ ID NO: 799397 - RNA, 25 nt, Human
ugaauuuggggaaggcuggauuugu

SEQ ID NO: 799398 - RNA, 25 nt, Human
ugacaaaaugaccucaggaaaccag

SEQ ID NO: 799399 - RNA, 18 nt, Human
ugagccucagccuuucag

SEQ ID NO: 799400 - RNA, 24 nt, Human
ugauggugcuucuuaccauaucac

SEQ ID NO: 799401 - RNA, 21 nt, Human
ugcauucaucugccaccaggc

SEQ ID NO: 799402 - RNA, 23 nt, Human
ugccaagaacagagcuuuguccc

SEQ ID NO: 799403 - RNA, 27 nt, Human
ugccaagaacagagcuuuguccccaug

SEQ ID NO: 799404 - RNA, 22 nt, Human
ugcccagagccccugcuugggc

SEQ ID NO: 799405 - RNA, 18 nt, Human
uggaaugcaacuaccuaa

SEQ ID NO: 799406 - RNA, 18 nt, Human
ugggaaaaugguccagag

SEQ ID NO: 799407 - RNA, 18 nt, Human
ugguaccaucagcucugg

SEQ ID NO: 799408 - RNA, 18 nt, Human
uguagcccccaagggcaa

SEQ ID NO: 799409 - RNA, 26 nt, Human
ugucucaggugacugaaauucugccu

SEQ ID NO: 799410 - RNA, 19 nt, Human
uuaaaaugacaaaaugacc

SEQ ID NO: 799411 - RNA, 22 nt, Human
uuaauacuuaaaccucacuagu

SEQ ID NO: 799412 - RNA, 18 nt, Human
uuaauagccccuuuuaug

SEQ ID NO: 799413 - RNA, 20 nt, Human
uucacagaguaggcacugua

SEQ ID NO: 799414 - RNA, 20 nt, Human
uucacagaguaggcacugua

SEQ ID NO: 799415 - RNA, 21 nt, Human
uuccaugaauuaauuuugggu

SEQ ID NO: 799416 - RNA, 24 nt, Human
uugcaguuauuuuaguuuaauggu

SEQ ID NO: 799417 - RNA, 22 nt, Human
uuuaauuuucuucugggcauuu

SEQ ID NO: 799418 - RNA, 23 nt, Human
uuuuuuccuuugcaaauucucuc

SEQ ID NO: 799419 - RNA, 24 nt, Human
aaaguucugggauuacaggcauga

SEQ ID NO: 799420 - RNA, 25 nt, Human
aagcaauucuccugccucagccucc

SEQ ID NO: 799421 - RNA, 22 nt, Human
aaguagcugggauuauaggcau

SEQ ID NO: 799422 - RNA, 22 nt, Human
aauuuuguauuuuuaguagaca

SEQ ID NO: 799423 - RNA, 22 nt, Human
accaacgcacucucagcugcag

SEQ ID NO: 799424 - RNA, 24 nt, Human
accaugugggccagacuggucucg

SEQ ID NO: 799425 - RNA, 23 nt, Human
acccccucccgcacacuccccac

SEQ ID NO: 799426 - RNA, 23 nt, Human
acuggucucgaacuccugaccuc

SEQ ID NO: 799427 - RNA, 18 nt, Human
agaugucaucagacagca

SEQ ID NO: 799428 - RNA, 21 nt, Human
aggcaugcgccaccacgccca

SEQ ID NO: 799429 - RNA, 22 nt, Human
aggugcagacuccuagagagcc

SEQ ID NO: 799430 - RNA, 23 nt, Human
aguagcugggauuauaggcaugc

SEQ ID NO: 799431 - RNA, 20 nt, Human
agugcaauggcgcaaucucg

SEQ ID NO: 799432 - RNA, 24 nt, Human
agugcaauggcgcaaucucggcuc

SEQ ID NO: 799433 - RNA, 18 nt, Human
augcgccaccacgcccag

SEQ ID NO: 799434 - RNA, 18 nt, Human
auggguuucaccaugugg

SEQ ID NO: 799435 - RNA, 23 nt, Human
caaaccugccaacucuacccccu

SEQ ID NO: 799436 - RNA, 24 nt, Human
caaaguucugggauuacaggcaug

SEQ ID NO: 799437 - RNA, 23 nt, Human
caaccucuaccucccggguucaa

SEQ ID NO: 799438 - RNA, 22 nt, Human
caagcaauucuccugccucagc

SEQ ID NO: 799439 - RNA, 21 nt, Human
caccaugugggccagacuggu

SEQ ID NO: 799440 - RNA, 24 nt, Human
caccaugugggccagacuggucuc

SEQ ID NO: 799441 - RNA, 21 nt, Human
cacugcaaccucuaccucccg

SEQ ID NO: 799442 - RNA, 23 nt, Human
cacugcaaccucuaccucccggg

SEQ ID NO: 799443 - RNA, 23 nt, Human
cagaaagagccccugaggggaga

SEQ ID NO: 799444 - RNA, 26 nt, Human
caggcgccucggccucccaaaguucu

SEQ ID NO: 799445 - RNA, 21 nt, Human
caugcgccaccacgcccagcu

SEQ ID NO: 799446 - RNA, 24 nt, Human
ccaaaguucugggauuacaggcau

SEQ ID NO: 799447 - RNA, 24 nt, Human
ccaacucuacccccucccgcacac

SEQ ID NO: 799448 - RNA, 24 nt, Human
ccaaguagcugggauuauaggcau

SEQ ID NO: 799449 - RNA, 22 nt, Human
ccaccaacgcacucucagcugc

SEQ ID NO: 799450 - RNA, 20 nt, Human
ccaccacgcccagcuaauuu

SEQ ID NO: 799451 - RNA, 19 nt, Human
ccacugcgcccggccuaag

SEQ ID NO: 799452 - RNA, 20 nt, Human
ccacugcgcccggccuaagc

SEQ ID NO: 799453 - RNA, 24 nt, Human
cccaaaguucugggauuacaggca

SEQ ID NO: 799454 - RNA, 23 nt, Human
cccaaguagcugggauuauaggc

SEQ ID NO: 799455 - RNA, 24 nt, Human
cccaaguagcugggauuauaggca

SEQ ID NO: 799456 - RNA, 19 nt, Human
ccccugaggggagaagccu

SEQ ID NO: 799457 - RNA, 24 nt, Human
ccccugaggggagaagccuagucc

SEQ ID NO: 799458 - RNA, 23 nt, Human
cccggguucaagcaauucuccug

SEQ ID NO: 799459 - RNA, 24 nt, Human
cccuggacaauucagaaagagccc

SEQ ID NO: 799460 - RNA, 20 nt, Human
cccuucucccucccaggcca

SEQ ID NO: 799461 - RNA, 18 nt, Human
ccgcacacuccccaccaa

SEQ ID NO: 799462 - RNA, 22 nt, Human
ccucccgcacacuccccaccaa

SEQ ID NO: 799463 - RNA, 24 nt, Human
ccucccggguucaagcaauucucc

SEQ ID NO: 799464 - RNA, 19 nt, Human
ccugaccucaggugaucca

SEQ ID NO: 799465 - RNA, 19 nt, Human
ccugaccucaggugaucca

SEQ ID NO: 799466 - RNA, 23 nt, Human
ccugccucagccucccaaguagc

SEQ ID NO: 799467 - RNA, 18 nt, Human
cgcccggccuaagcuucu

SEQ ID NO: 799468 - RNA, 24 nt, Human
cgccucggccucccaaaguucugg

SEQ ID NO: 799469 - RNA, 20 nt, Human
cuacccccucccgcacacuc

SEQ ID NO: 799470 - RNA, 24 nt, Human
cucacugcaaccucuaccucccgg

SEQ ID NO: 799471 - RNA, 24 nt, Human
cucagccucccaaguagcugggau

SEQ ID NO: 799472 - RNA, 26 nt, Human
cuccagccccuucucccucccaggcc

SEQ ID NO: 799473 - RNA, 20 nt, Human
cucuuguugcccaggcugga

SEQ ID NO: 799474 - RNA, 21 nt, Human
cucuuguugcccaggcuggag

SEQ ID NO: 799475 - RNA, 22 nt, Human
cucuuguugcccaggcuggagu

SEQ ID NO: 799476 - RNA, 20 nt, Human
cugaauucccagagcugcac

SEQ ID NO: 799477 - RNA, 23 nt, Human
cugcaaccucuaccucccggguu

SEQ ID NO: 799478 - RNA, 24 nt, Human
cugcaaccucuaccucccggguuc

SEQ ID NO: 799479 - RNA, 23 nt, Human
cugccucagccucccaaguagcu

SEQ ID NO: 799480 - RNA, 24 nt, Human
cuuguugcccaggcuggagugcaa

SEQ ID NO: 799481 - RNA, 23 nt, Human
cuuucugaauucccagagcugca

SEQ ID NO: 799482 - RNA, 24 nt, Human
gaccucaggugauccaggcgccuc

SEQ ID NO: 799483 - RNA, 18 nt, Human
gauuacaggcaugagcca

SEQ ID NO: 799484 - RNA, 22 nt, Human
gauuacaggcaugagccacugc

SEQ ID NO: 799485 - RNA, 22 nt, Human
gauuacaggcaugagccacugc

SEQ ID NO: 799486 - RNA, 18 nt, Human
gauuauaggcaugcgcca

SEQ ID NO: 799487 - RNA, 19 nt, Human
gcccaggcuggagugcaau

SEQ ID NO: 799488 - RNA, 18 nt, Human
gccucggccucccaaagu

SEQ ID NO: 799489 - RNA, 20 nt, Human
gcucuuguugcccaggcugg

SEQ ID NO: 799490 - RNA, 21 nt, Human
gcucuuguugcccaggcugga

SEQ ID NO: 799491 - RNA, 19 nt, Human
gcuggagugcaauggcgca

SEQ ID NO: 799492 - RNA, 22 nt, Human
ggauuacaggcaugagccacug

SEQ ID NO: 799493 - RNA, 19 nt, Human
ggauuauaggcaugcgcca

SEQ ID NO: 799494 - RNA, 24 nt, Human
gggccagacuggucucgaacuccu

SEQ ID NO: 799495 - RNA, 21 nt, Human
ggguuucaccaugugggccag

SEQ ID NO: 799496 - RNA, 19 nt, Human
ggucucgaacuccugaccu

SEQ ID NO: 799497 - RNA, 18 nt, Human
guagcugggauuauaggc

SEQ ID NO: 799498 - RNA, 24 nt, Human
gugauccaggcgccucggccuccc

SEQ ID NO: 799499 - RNA, 23 nt, Human
uacaggcaugagccacugcgccc

SEQ ID NO: 799500 - RNA, 25 nt, Human
uacccccucccgcacacuccccacc

SEQ ID NO: 799501 - RNA, 23 nt, Human
uaguagacauggguuucaccaug

SEQ ID NO: 799502 - RNA, 23 nt, Human
ucacugcaaccucuaccucccgg

SEQ ID NO: 799503 - RNA, 24 nt, Human
ucacugcaaccucuaccucccggg

SEQ ID NO: 799504 - RNA, 24 nt, Human
ucagaggcuuucugaauucccagg

SEQ ID NO: 799505 - RNA, 20 nt, Human
ucagccucccaaguagcugg

SEQ ID NO: 799506 - RNA, 24 nt, Human
ucccaaaguucugggauuacaggc

SEQ ID NO: 799507 - RNA, 24 nt, Human
ucccaaguagcugggauuauaggc

SEQ ID NO: 799508 - RNA, 20 nt, Human
ucccgcacacuccccaccaa

SEQ ID NO: 799509 - RNA, 21 nt, Human
ucccggguucaagcaauucuc

SEQ ID NO: 799510 - RNA, 24 nt, Human
ucccggguucaagcaauucuccug

SEQ ID NO: 799511 - RNA, 19 nt, Human
ucuccagccccuucucccu

SEQ ID NO: 799512 - RNA, 26 nt, Human
ucuccugccucagccucccaaguagc

SEQ ID NO: 799513 - RNA, 23 nt, Human
ucucgaacuccugaccucaggug

SEQ ID NO: 799514 - RNA, 22 nt, Human
ucuuguugcccaggcuggagug

SEQ ID NO: 799515 - RNA, 23 nt, Human
ugaccucaggugauccaggcgcc

SEQ ID NO: 799516 - RNA, 24 nt, Human
ugaccucaggugauccaggcgccu

SEQ ID NO: 799517 - RNA, 25 nt, Human
ugaccucaggugauccaggcgccuc

SEQ ID NO: 799518 - RNA, 23 nt, Human
ugcaauggcgcaaucucggcuca

SEQ ID NO: 799519 - RNA, 18 nt, Human
ugcccaggcuggagugca

SEQ ID NO: 799520 - RNA, 21 nt, Human
ugcccaggcuggagugcaaug

SEQ ID NO: 799521 - RNA, 21 nt, Human
ugcccaggcuggagugcaaug

SEQ ID NO: 799522 - RNA, 24 nt, Human
ugcccaggcuggagugcaauggcg

SEQ ID NO: 799523 - RNA, 24 nt, Human
ugccucagccucccaaguagcugg

SEQ ID NO: 799524 - RNA, 22 nt, Human
uggagucaaaccugccaacucc

SEQ ID NO: 799525 - RNA, 23 nt, Human
uggagugcaauggcgcaaucucg

SEQ ID NO: 799526 - RNA, 24 nt, Human
uggagugcaauggcgcaaucucgg

SEQ ID NO: 799527 - RNA, 18 nt, Human
ugggauuacaggcaugag

SEQ ID NO: 799528 - RNA, 19 nt, Human
ugggauuacaggcaugagc

SEQ ID NO: 799529 - RNA, 21 nt, Human
ugggauuacaggcaugagcca

SEQ ID NO: 799530 - RNA, 22 nt, Human
ugggauuacaggcaugagccac

SEQ ID NO: 799531 - RNA, 22 nt, Human
ugggauuacaggcaugagccac

SEQ ID NO: 799532 - RNA, 23 nt, Human
ugggauuacaggcaugagccacu

SEQ ID NO: 799533 - RNA, 24 nt, Human
ugggauuacaggcaugagccacug

SEQ ID NO: 799534 - RNA, 26 nt, Human
ugggauuacaggcaugagccacugcg

SEQ ID NO: 799535 - RNA, 18 nt, Human
ugggauuauaggcaugcg

SEQ ID NO: 799536 - RNA, 21 nt, Human
ugggauuauaggcaugcgcca

SEQ ID NO: 799537 - RNA, 22 nt, Human
ugggauuauaggcaugcgccac

SEQ ID NO: 799538 - RNA, 24 nt, Human
ugggauuauaggcaugcgccacca

SEQ ID NO: 799539 - RNA, 18 nt, Human
uggguuucaccauguggg

SEQ ID NO: 799540 - RNA, 21 nt, Human
uggucucgaacuccugaccuc

SEQ ID NO: 799541 - RNA, 25 nt, Human
ugucaucagacagcagggggacagu

SEQ ID NO: 799542 - RNA, 20 nt, Human
uguugcccaggcuggagugc

SEQ ID NO: 799543 - RNA, 23 nt, Human
uuaguagacauggguuucaccau

SEQ ID NO: 799544 - RNA, 24 nt, Human
uuaguagacauggguuucaccaug

SEQ ID NO: 799545 - RNA, 21 nt, Human
uucaagcaauucuccugccuc

SEQ ID NO: 799546 - RNA, 24 nt, Human
uucaagcaauucuccugccucagc

SEQ ID NO: 799547 - RNA, 19 nt, Human
uucagaaagagccccugag

SEQ ID NO: 799548 - RNA, 18 nt, Human
uugcccaggcuggagugc

SEQ ID NO: 799549 - RNA, 23 nt, Human
uugcucuuguugcccaggcugga

SEQ ID NO: 799550 - RNA, 21 nt, Human
uuucaccaugugggccagacu

SEQ ID NO: 799551 - RNA, 18 nt, Human
uuucugaauucccagagc

SEQ ID NO: 799552 - RNA, 24 nt, Human
uuugcucuuguugcccaggcugga

SEQ ID NO: 799553 - RNA, 23 nt, Human
uuuugcucuuguugcccaggcug

SEQ ID NO: 799554 - RNA, 24 nt, Human
uuuugcucuuguugcccaggcugg

SEQ ID NO: 799555 - RNA, 18 nt, Human
uuuuguauuuuuaguaga

SEQ ID NO: 799556 - RNA, 23 nt, Human
uuuuuaguagacauggguuucac

SEQ ID NO: 799557 - RNA, 25 nt, Human
aaaaaaacacacacaaagaaauaua

SEQ ID NO: 799558 - RNA, 21 nt, Human
aaaaaacacacacaaagaaau

SEQ ID NO: 799559 - RNA, 21 nt, Human
aaaaaacugaauagucaaaag

SEQ ID NO: 799560 - RNA, 24 nt, Human
aaaaagaaaaauaaugauaauaga

SEQ ID NO: 799561 - RNA, 21 nt, Human
aaaacaaaacaacauuacaca

SEQ ID NO: 799562 - RNA, 18 nt, Human
aaacaaaacaaaacaaca

SEQ ID NO: 799563 - RNA, 26 nt, Human
aaacaaaacaaaacaacauuacacaa

SEQ ID NO: 799564 - RNA, 21 nt, Human
aaacuacuugaauaagcaaua

SEQ ID NO: 799565 - RNA, 19 nt, Human
aaauaaauaaauccaauaa

SEQ ID NO: 799566 - RNA, 24 nt, Human
aaauaaauaaauccaauaaccagg

SEQ ID NO: 799567 - RNA, 22 nt, Human
aacaagagcaaaacucugucua

SEQ ID NO: 799568 - RNA, 21 nt, Human
aacacggagauaucccgucuc

SEQ ID NO: 799569 - RNA, 22 nt, Human
aaccaagucagcaguccuaaga

SEQ ID NO: 799570 - RNA, 21 nt, Human
aacguggugaaacuccauauc

SEQ ID NO: 799571 - RNA, 24 nt, Human
aaggaaaaaaacacacacaaagaa

SEQ ID NO: 799572 - RNA, 24 nt, Human
aaucgcuugaaccugggaggugga

SEQ ID NO: 799573 - RNA, 22 nt, Human
acaagcaaagaauuacaaugca

SEQ ID NO: 799574 - RNA, 23 nt, Human
acaaugcagaaaagauauugaag

SEQ ID NO: 799575 - RNA, 20 nt, Human
acacacauauacaucacaca

SEQ ID NO: 799576 - RNA, 24 nt, Human
acagagcaaggcucuaucucaaaa

SEQ ID NO: 799577 - RNA, 20 nt, Human
acauacacacuauauauaua

SEQ ID NO: 799578 - RNA, 22 nt, Human
acguggaccgaccucgcccggc

SEQ ID NO: 799579 - RNA, 24 nt, Human
acugcacuccagccuaggcaacaa

SEQ ID NO: 799580 - RNA, 25 nt, Human
acugcacuccagccuaggcaacaag

SEQ ID NO: 799581 - RNA, 27 nt, Human
acugcacuccagccuaggcaacaagag

SEQ ID NO: 799582 - RNA, 23 nt, Human
acugcacuccggccuggugacag

SEQ ID NO: 799583 - RNA, 25 nt, Human
acugcacuccggccuggugacagag

SEQ ID NO: 799584 - RNA, 19 nt, Human
acugcauaaccaagucagc

SEQ ID NO: 799585 - RNA, 20 nt, Human
acugcgccacugcacuccag

SEQ ID NO: 799586 - RNA, 23 nt, Human
acuuacugggugaguaguuuuau

SEQ ID NO: 799587 - RNA, 22 nt, Human
agaaguugaugaccacaucccu

SEQ ID NO: 799588 - RNA, 22 nt, Human
agacugcgccacugcacuccag

SEQ ID NO: 799589 - RNA, 21 nt, Human
agagcaaaacucugucuaaaa

SEQ ID NO: 799590 - RNA, 24 nt, Human
agagguugaggugagccaagacug

SEQ ID NO: 799591 - RNA, 24 nt, Human
agcacuuugggaggccgaggcagg

SEQ ID NO: 799592 - RNA, 24 nt, Human
agcacuuugggaggcugaggcggg

SEQ ID NO: 799593 - RNA, 21 nt, Human
agcaggagaauagccugaacc

SEQ ID NO: 799594 - RNA, 23 nt, Human
agccggucaugguggcgcaugcc

SEQ ID NO: 799595 - RNA, 18 nt, Human
agcuccucccgcagcccg

SEQ ID NO: 799596 - RNA, 23 nt, Human
agcugggcaugguggcgcaugcc

SEQ ID NO: 799597 - RNA, 27 nt, Human
aggaaaaaaacacacacaaagaaauau

SEQ ID NO: 799598 - RNA, 18 nt, Human
aggauaaaaagggagaau

SEQ ID NO: 799599 - RNA, 24 nt, Human
aggcagagguugaggugagccaag

SEQ ID NO: 799600 - RNA, 22 nt, Human
aggcaggggaaucgcuugaacc

SEQ ID NO: 799601 - RNA, 24 nt, Human
aggcaggggaaucgcuugaaccug

SEQ ID NO: 799602 - RNA, 20 nt, Human
aggcagggggaucacaaggu

SEQ ID NO: 799603 - RNA, 24 nt, Human
aggcagggggaucacaaggucagg

SEQ ID NO: 799604 - RNA, 19 nt, Human
aggccgaggcagggggauc

SEQ ID NO: 799605 - RNA, 22 nt, Human
aggcggguggaucaccugaggg

SEQ ID NO: 799606 - RNA, 22 nt, Human
aggcggguggaucaccugaggu

SEQ ID NO: 799607 - RNA, 24 nt, Human
aggcgugguggcucaugccuguaa

SEQ ID NO: 799608 - RNA, 20 nt, Human
aggcugaggcaggggaaucg

SEQ ID NO: 799609 - RNA, 24 nt, Human
aggcugaggcaggggaaucgcuug

SEQ ID NO: 799610 - RNA, 21 nt, Human
aggcugaggcggguggaucac

SEQ ID NO: 799611 - RNA, 24 nt, Human
aggcugaggcggguggaucaccug

SEQ ID NO: 799612 - RNA, 20 nt, Human
aggcugggugcgguggcuca

SEQ ID NO: 799613 - RNA, 22 nt, Human
agggagaaugagauccaagagu

SEQ ID NO: 799614 - RNA, 19 nt, Human
agggggaucacaaggucag

SEQ ID NO: 799615 - RNA, 18 nt, Human
agguggagguugcaguga

SEQ ID NO: 799616 - RNA, 24 nt, Human
agguggagguugcagugaucugag

SEQ ID NO: 799617 - RNA, 19 nt, Human
aguaaguauagauaucaca

SEQ ID NO: 799618 - RNA, 27 nt, Human
auacaucacacacauauacaucacaca

SEQ ID NO: 799619 - RNA, 25 nt, Human
auacaucacacacuauauacacaca

SEQ ID NO: 799620 - RNA, 23 nt, Human
auacugaauugccuugauuaccu

SEQ ID NO: 799621 - RNA, 21 nt, Human
auagaguacauaaauucuggg

SEQ ID NO: 799622 - RNA, 21 nt, Human
auauauaguauacaucacaca

SEQ ID NO: 799623 - RNA, 19 nt, Human
auauauauauauauauaua

SEQ ID NO: 799624 - RNA, 24 nt, Human
augacaccacugcacuccggccug

SEQ ID NO: 799625 - RNA, 19 nt, Human
augccuguaaucccagcac

SEQ ID NO: 799626 - RNA, 19 nt, Human
augccuguaaucccagcac

SEQ ID NO: 799627 - RNA, 31 nt, Human
auguauauagugugugugugugugugugugg

SEQ ID NO: 799628 - RNA, 22 nt, Human
caaaagcuauuguaaacaaaac

SEQ ID NO: 799629 - RNA, 27 nt, Human
caacaagagcaaaacucugucuaaaaa

SEQ ID NO: 799630 - RNA, 24 nt, Human
caacguggugaaacuccauaucua

SEQ ID NO: 799631 - RNA, 20 nt, Human
caaguuccucugagcagaau

SEQ ID NO: 799632 - RNA, 19 nt, Human
cacaaagaaauauaggaca

SEQ ID NO: 799633 - RNA, 22 nt, Human
caccgcgagcuccucccgcagc

SEQ ID NO: 799634 - RNA, 24 nt, Human
cacuccagccuaggcaacaagagc

SEQ ID NO: 799635 - RNA, 22 nt, Human
cacuccggccuggugacagagc

SEQ ID NO: 799636 - RNA, 19 nt, Human
cacugcacuccagccuagg

SEQ ID NO: 799637 - RNA, 21 nt, Human
cacugcacuccagccuaggca

SEQ ID NO: 799638 - RNA, 22 nt, Human
cacugcacuccagccuaggcaa

SEQ ID NO: 799639 - RNA, 23 nt, Human
cacugcacuccagccuaggcaac

SEQ ID NO: 799640 - RNA, 24 nt, Human
cacugcacuccagccuaggcaaca

SEQ ID NO: 799641 - RNA, 18 nt, Human
cacugcacuccggccugg

SEQ ID NO: 799642 - RNA, 18 nt, Human
cacugcacuccggccugg

SEQ ID NO: 799643 - RNA, 20 nt, Human
cacugcacuccggccuggug

SEQ ID NO: 799644 - RNA, 23 nt, Human
cacugcacuccggccuggugaca

SEQ ID NO: 799645 - RNA, 23 nt, Human
cacugcacuccggccuggugaca

SEQ ID NO: 799646 - RNA, 19 nt, Human
cagaacaccaucguccgca

SEQ ID NO: 799647 - RNA, 21 nt, Human
cagaacaccaucguccgcagc

SEQ ID NO: 799648 - RNA, 20 nt, Human
cagauaaaugcuuagucuca

SEQ ID NO: 799649 - RNA, 24 nt, Human
cagauaaaugcuuagucucauucc

SEQ ID NO: 799650 - RNA, 24 nt, Human
cagcacuuugggaggccgaggcag

SEQ ID NO: 799651 - RNA, 25 nt, Human
cagcacuuugggaggccgaggcagg

SEQ ID NO: 799652 - RNA, 24 nt, Human
cagcacuuugggaggcugaggcgg

SEQ ID NO: 799653 - RNA, 20 nt, Human
cagcaguccuaagagagaga

SEQ ID NO: 799654 - RNA, 26 nt, Human
cauacacuauauacacuauaugugua

SEQ ID NO: 799655 - RNA, 22 nt, Human
cauauacaucacacacuauaua

SEQ ID NO: 799656 - RNA, 26 nt, Human
cauauacaucacacacuauauacaca

SEQ ID NO: 799657 - RNA, 18 nt, Human
cauauauugugugugugu

SEQ ID NO: 799658 - RNA, 23 nt, Human
cauauauugugugugugugugug

SEQ ID NO: 799659 - RNA, 23 nt, Human
caucaucacaucccaguacaagu

SEQ ID NO: 799660 - RNA, 20 nt, Human
caugccuguaaucccagcac

SEQ ID NO: 799661 - RNA, 20 nt, Human
caugccuguaaucccagcac

SEQ ID NO: 799662 - RNA, 24 nt, Human
caugccuguaaucccagcacuuug

SEQ ID NO: 799663 - RNA, 24 nt, Human
caugccuguaaucccagcacuuug

SEQ ID NO: 799664 - RNA, 19 nt, Human
ccacugcacuccagccuag

SEQ ID NO: 799665 - RNA, 20 nt, Human
ccacugcacuccagccuagg

SEQ ID NO: 799666 - RNA, 20 nt, Human
ccacugcacuccagccuagg

SEQ ID NO: 799667 - RNA, 21 nt, Human
ccacugcacuccagccuaggc

SEQ ID NO: 799668 - RNA, 24 nt, Human
ccacugcacuccagccuaggcaac

SEQ ID NO: 799669 - RNA, 19 nt, Human
ccacugcacuccggccugg

SEQ ID NO: 799670 - RNA, 19 nt, Human
ccacugcacuccggccugg

SEQ ID NO: 799671 - RNA, 19 nt, Human
ccacugcacuccggccugg

SEQ ID NO: 799672 - RNA, 20 nt, Human
ccacugcacuccggccuggu

SEQ ID NO: 799673 - RNA, 23 nt, Human
ccacugcacuccggccuggugac

SEQ ID NO: 799674 - RNA, 24 nt, Human
ccaggcugggugcgguggcucaug

SEQ ID NO: 799675 - RNA, 21 nt, Human
cccggcccgggucaccucgac

SEQ ID NO: 799676 - RNA, 19 nt, Human
ccgaggcagggggaucaca

SEQ ID NO: 799677 - RNA, 18 nt, Human
ccgcgagcuccucccgca

SEQ ID NO: 799678 - RNA, 22 nt, Human
ccuacagauaaaugcuuagucu

SEQ ID NO: 799679 - RNA, 18 nt, Human
ccuauuaaauccauccac

SEQ ID NO: 799680 - RNA, 21 nt, Human
ccucaccgcgagcuccucccg

SEQ ID NO: 799681 - RNA, 22 nt, Human
ccucgcccggcagcgcggggcc

SEQ ID NO: 799682 - RNA, 22 nt, Human
ccugaggucgggaguuugagac

SEQ ID NO: 799683 - RNA, 21 nt, Human
ccugggagguggagguugcag

SEQ ID NO: 799684 - RNA, 21 nt, Human
ccuggugacagagcaaggcuc

SEQ ID NO: 799685 - RNA, 22 nt, Human
ccuguaaucccagcacuuuggg

SEQ ID NO: 799686 - RNA, 21 nt, Human
ccuguaaucccagcuaaucag

SEQ ID NO: 799687 - RNA, 19 nt, Human
ccuguaaucccagcuacuu

SEQ ID NO: 799688 - RNA, 21 nt, Human
ccuguaaucccagcuacuugg

SEQ ID NO: 799689 - RNA, 24 nt, Human
ccuguaaucccagcuacuuggcag

SEQ ID NO: 799690 - RNA, 24 nt, Human
cgagacugucuuggccaacguggu

SEQ ID NO: 799691 - RNA, 24 nt, Human
cgccacugcacuccagccuaggca

SEQ ID NO: 799692 - RNA, 24 nt, Human
cggguggaucaccugaggucggga

SEQ ID NO: 799693 - RNA, 24 nt, Human
cucaugccuguaaucccagcacuu

SEQ ID NO: 799694 - RNA, 24 nt, Human
cucaugccuguaaucccagcacuu

SEQ ID NO: 799695 - RNA, 24 nt, Human
cuccaucaucacaucccaguacaa

SEQ ID NO: 799696 - RNA, 22 nt, Human
cugcagguaaaaagacugcuua

SEQ ID NO: 799697 - RNA, 19 nt, Human
cuugaaccugggaggugga

SEQ ID NO: 799698 - RNA, 23 nt, Human
cuuggccaacguggugaaacucc

SEQ ID NO: 799699 - RNA, 24 nt, Human
cuuggccaacguggugaaacucca

SEQ ID NO: 799700 - RNA, 24 nt, Human
gaaaaaaacacacacaaagaaaua

SEQ ID NO: 799701 - RNA, 24 nt, Human
gagaaugagauccaagaguaaauu

SEQ ID NO: 799702 - RNA, 18 nt, Human
gagagaaguugaugacca

SEQ ID NO: 799703 - RNA, 23 nt, Human
gagcagaauccagauauucccau

SEQ ID NO: 799704 - RNA, 24 nt, Human
gagcaggagaauagccugaaccug

SEQ ID NO: 799705 - RNA, 23 nt, Human
gaggcagggggaucacaagguca

SEQ ID NO: 799706 - RNA, 23 nt, Human
gaggcggguggaucaccugaggu

SEQ ID NO: 799707 - RNA, 24 nt, Human
gaucacaaggucaggaaaucgaga

SEQ ID NO: 799708 - RNA, 24 nt, Human
gaucaccugaggucgggaguuuga

SEQ ID NO: 799709 - RNA, 23 nt, Human
gcacuccggccuggugacagagc

SEQ ID NO: 799710 - RNA, 20 nt, Human
gcccaaaccuaguaagucaa

SEQ ID NO: 799711 - RNA, 22 nt, Human
gccugcagguaaaaagacugcu

SEQ ID NO: 799712 - RNA, 20 nt, Human
gccuguaaucccagcuacuu

SEQ ID NO: 799713 - RNA, 20 nt, Human
gcgagcuccucccgcagccc

SEQ ID NO: 799714 - RNA, 22 nt, Human
gcugauuguugaaaugcccaaa

SEQ ID NO: 799715 - RNA, 18 nt, Human
ggagguugcagugaucug

SEQ ID NO: 799716 - RNA, 23 nt, Human
ggagguugcagugaucugagaug

SEQ ID NO: 799717 - RNA, 19 nt, Human
ggaguuugagaccagacug

SEQ ID NO: 799718 - RNA, 23 nt, Human
ggcaugguggcgcaugccuguaa

SEQ ID NO: 799719 - RNA, 21 nt, Human
ggcgcaugccuguaaucccag

SEQ ID NO: 799720 - RNA, 21 nt, Human
ggcgcaugccuguaaucccag

SEQ ID NO: 799721 - RNA, 23 nt, Human
ggcugggugcgguggcucaugcc

SEQ ID NO: 799722 - RNA, 24 nt, Human
gggugcgguggcucaugccuguaa

SEQ ID NO: 799723 - RNA, 24 nt, Human
ggucaugguggcgcaugccuguaa

SEQ ID NO: 799724 - RNA, 19 nt, Human
ggucgggaguuugagacca

SEQ ID NO: 799725 - RNA, 24 nt, Human
gguggcgcaugccuguaaucccag

SEQ ID NO: 799726 - RNA, 24 nt, Human
gguggcgcaugccuguaaucccag

SEQ ID NO: 799727 - RNA, 23 nt, Human
gguggcucaugccuguaauccca

SEQ ID NO: 799728 - RNA, 24 nt, Human
gguggcucaugccuguaaucccag

SEQ ID NO: 799729 - RNA, 24 nt, Human
gguggcucaugccuguaaucccag

SEQ ID NO: 799730 - RNA, 19 nt, Human
guauauauauauauauaua

SEQ ID NO: 799731 - RNA, 18 nt, Human
guauuggucuuggucacc

SEQ ID NO: 799732 - RNA, 19 nt, Human
gugcaugugugggcauaua

SEQ ID NO: 799733 - RNA, 20 nt, Human
guguauauacuauauauaca

SEQ ID NO: 799734 - RNA, 20 nt, Human
guguauauacuauauauaca

SEQ ID NO: 799735 - RNA, 19 nt, Human
guguauauauauauauaua

SEQ ID NO: 799736 - RNA, 20 nt, Human
guguguauauauauauauau

SEQ ID NO: 799737 - RNA, 20 nt, Human
gugugugugugugugugugu

SEQ ID NO: 799738 - RNA, 19 nt, Human
uaaaaaaccacuuuauaca

SEQ ID NO: 799739 - RNA, 19 nt, Human
uaaaaaacugaauagucaa

SEQ ID NO: 799740 - RNA, 22 nt, Human
uaaaacaaaacaaaacaacauu

SEQ ID NO: 799741 - RNA, 18 nt, Human
uaaacaaaacaugccagg

SEQ ID NO: 799742 - RNA, 23 nt, Human
uaaagagaagucaacaauuggau

SEQ ID NO: 799743 - RNA, 21 nt, Human
uaacauaaaaaggagaaauau

SEQ ID NO: 799744 - RNA, 26 nt, Human
uaaccggacaggcgugguggcucaug

SEQ ID NO: 799745 - RNA, 19 nt, Human
uaaucccagcuaaucagga

SEQ ID NO: 799746 - RNA, 20 nt, Human
uacauauauugugugugugu

SEQ ID NO: 799747 - RNA, 22 nt, Human
uacaucacacacauauacauca

SEQ ID NO: 799748 - RNA, 21 nt, Human
uacauuguaucugacuaggag

SEQ ID NO: 799749 - RNA, 24 nt, Human
uacccaaaagaggaacauuagcac

SEQ ID NO: 799750 - RNA, 20 nt, Human
uacuaaaauacaauuagcug

SEQ ID NO: 799751 - RNA, 23 nt, Human
uacuguguaggacaugaaacaac

SEQ ID NO: 799752 - RNA, 23 nt, Human
uaggagugcuaacucuguggagg

SEQ ID NO: 799753 - RNA, 20 nt, Human
uaguauacaucacacauaca

SEQ ID NO: 799754 - RNA, 21 nt, Human
uaguuagaaauagagcuacua

SEQ ID NO: 799755 - RNA, 28 nt, Human
uauaacacacauacacacuauauauaua

SEQ ID NO: 799756 - RNA, 20 nt, Human
uauacacuauauguguauau

SEQ ID NO: 799757 - RNA, 21 nt, Human
uauacacuauauguguauaua

SEQ ID NO: 799758 - RNA, 21 nt, Human
uauacaucacacauacacuau

SEQ ID NO: 799759 - RNA, 26 nt, Human
uauaguauacaucacacacauauaca

SEQ ID NO: 799760 - RNA, 20 nt, Human
uauagugugugugugugugu

SEQ ID NO: 799761 - RNA, 20 nt, Human
uauagugugugugugugugu

SEQ ID NO: 799762 - RNA, 20 nt, Human
uauagugugugugugugugu

SEQ ID NO: 799763 - RNA, 24 nt, Human
uauauacacacauauaguauaugu

SEQ ID NO: 799764 - RNA, 25 nt, Human
uauauacacacauauaguauaugug

SEQ ID NO: 799765 - RNA, 21 nt, Human
uauauacacuauauguauaua

SEQ ID NO: 799766 - RNA, 21 nt, Human
uauauacacuauauguguaua

SEQ ID NO: 799767 - RNA, 18 nt, Human
uauauacauauauugugu

SEQ ID NO: 799768 - RNA, 23 nt, Human
uauauacauauauugugugugug

SEQ ID NO: 799769 - RNA, 21 nt, Human
uauauacuauauauacauaua

SEQ ID NO: 799770 - RNA, 27 nt, Human
uauauaguguauauacuauauauacau

SEQ ID NO: 799771 - RNA, 24 nt, Human
uauauagugugugugugugugugu

SEQ ID NO: 799772 - RNA, 18 nt, Human
uauauaguguguuaugua

SEQ ID NO: 799773 - RNA, 19 nt, Human
uauauauauauauauauau

SEQ ID NO: 799774 - RNA, 20 nt, Human
uauauguauauagugugugu

SEQ ID NO: 799775 - RNA, 23 nt, Human
uauauugugugugugugugugua

SEQ ID NO: 799776 - RNA, 24 nt, Human
uaucugaaaauaauaguaaaauuu

SEQ ID NO: 799777 - RNA, 22 nt, Human
uaugaaauagcaaauauccuga

SEQ ID NO: 799778 - RNA, 18 nt, Human
uauguauauagugugugu

SEQ ID NO: 799779 - RNA, 24 nt, Human
uauguauauagugugugugugugu

SEQ ID NO: 799780 - RNA, 19 nt, Human
uaugucaauuccaugagag

SEQ ID NO: 799781 - RNA, 20 nt, Human
uauguguauauacacuauau

SEQ ID NO: 799782 - RNA, 23 nt, Human
uauguguauauacacuauaugua

SEQ ID NO: 799783 - RNA, 23 nt, Human
ucacaaggucaggaaaucgagac

SEQ ID NO: 799784 - RNA, 24 nt, Human
ucacaaggucaggaaaucgagacu

SEQ ID NO: 799785 - RNA, 24 nt, Human
ucacacacuauauacacacauaua

SEQ ID NO: 799786 - RNA, 25 nt, Human
ucacacauacacuauauacacuaua

SEQ ID NO: 799787 - RNA, 19 nt, Human
ucaccucgacucgccaggc

SEQ ID NO: 799788 - RNA, 20 nt, Human
ucaguggucauuuuuucucc

SEQ ID NO: 799789 - RNA, 22 nt, Human
ucaugccuguaaucccagcacu

SEQ ID NO: 799790 - RNA, 22 nt, Human
ucaugccuguaaucccagcacu

SEQ ID NO: 799791 - RNA, 19 nt, Human
uccaauauaacacacauac

SEQ ID NO: 799792 - RNA, 21 nt, Human
uccauaucuacuaaaauacaa

SEQ ID NO: 799793 - RNA, 24 nt, Human
uccauccacaguauuuuccuguga

SEQ ID NO: 799794 - RNA, 22 nt, Human
uccaugguuagaacuguaaaga

SEQ ID NO: 799795 - RNA, 21 nt, Human
ucccacugagaaccaguguuu

SEQ ID NO: 799796 - RNA, 24 nt, Human
ucgcuugaaccugggagguggagg

SEQ ID NO: 799797 - RNA, 18 nt, Human
ucucaaaauaaauaaaua

SEQ ID NO: 799798 - RNA, 20 nt, Human
ucucuacuaaaaauauaaaa

SEQ ID NO: 799799 - RNA, 25 nt, Human
ucugucuaaaaaaaaagaaaaaaaa

SEQ ID NO: 799800 - RNA, 21 nt, Human
ucugucucaauguagacccag

SEQ ID NO: 799801 - RNA, 24 nt, Human
ugaaauagcaaauauccugacaaa

SEQ ID NO: 799802 - RNA, 24 nt, Human
ugaaccugggagguggagguugca

SEQ ID NO: 799803 - RNA, 22 nt, Human
ugacaccacugcacuccggccu

SEQ ID NO: 799804 - RNA, 22 nt, Human
ugagagaaguugaugaccacau

SEQ ID NO: 799805 - RNA, 24 nt, Human
ugagaugacaccacugcacuccgg

SEQ ID NO: 799806 - RNA, 19 nt, Human
ugagcaggagaauagccug

SEQ ID NO: 799807 - RNA, 23 nt, Human
ugagcaggagaauagccugaacc

SEQ ID NO: 799808 - RNA, 24 nt, Human
ugaggcaggggaaucgcuugaacc

SEQ ID NO: 799809 - RNA, 25 nt, Human
ugaggcaggggaaucgcuugaaccu

SEQ ID NO: 799810 - RNA, 20 nt, Human
ugaggcggguggaucaccug

SEQ ID NO: 799811 - RNA, 21 nt, Human
ugaggcggguggaucaccuga

SEQ ID NO: 799812 - RNA, 22 nt, Human
ugaggcggguggaucaccugag

SEQ ID NO: 799813 - RNA, 24 nt, Human
ugaggcggguggaucaccugaggu

SEQ ID NO: 799814 - RNA, 18 nt, Human
ugaggucgggaguuugag

SEQ ID NO: 799815 - RNA, 23 nt, Human
ugaguuggccauuaguaccaaga

SEQ ID NO: 799816 - RNA, 23 nt, Human
ugauauguauaguauacaucaca

SEQ ID NO: 799817 - RNA, 22 nt, Human
ugauccccaaugaaacuugagu

SEQ ID NO: 799818 - RNA, 18 nt, Human
ugccaggaugagaaacuc

SEQ ID NO: 799819 - RNA, 23 nt, Human
ugccuguaaucccagcacuuugg

SEQ ID NO: 799820 - RNA, 23 nt, Human
ugccuguaaucccagcacuuugg

SEQ ID NO: 799821 - RNA, 23 nt, Human
ugccuguaaucccagcacuuugg

SEQ ID NO: 799822 - RNA, 23 nt, Human
ugccuguaaucccagcacuuugg

SEQ ID NO: 799823 - RNA, 24 nt, Human
ugccuguaaucccagcacuuuggg

SEQ ID NO: 799824 - RNA, 18 nt, Human
ugccuguaaucccagcua

SEQ ID NO: 799825 - RNA, 24 nt, Human
ugccuguaaucccagcuaaucagg

SEQ ID NO: 799826 - RNA, 23 nt, Human
ugccuguaaucccagcuacuugg

SEQ ID NO: 799827 - RNA, 19 nt, Human
uggaaaggagaucacacuu

SEQ ID NO: 799828 - RNA, 21 nt, Human
uggaccgaccucgcccggcag

SEQ ID NO: 799829 - RNA, 23 nt, Human
uggaucaccugaggucgggaguu

SEQ ID NO: 799830 - RNA, 24 nt, Human
uggaucaccugaggucgggaguuu

SEQ ID NO: 799831 - RNA, 18 nt, Human
uggcaacaucuaacaaag

SEQ ID NO: 799832 - RNA, 18 nt, Human
uggcaugacagcaugagg

SEQ ID NO: 799833 - RNA, 18 nt, Human
uggccaacguggugaaac

SEQ ID NO: 799834 - RNA, 20 nt, Human
uggccaacguggugaaacuc

SEQ ID NO: 799835 - RNA, 22 nt, Human
uggccaacguggugaaacucca

SEQ ID NO: 799836 - RNA, 21 nt, Human
uggcgcaugccuguaauccca

SEQ ID NO: 799837 - RNA, 21 nt, Human
uggcgcaugccuguaauccca

SEQ ID NO: 799838 - RNA, 22 nt, Human
uggcgcaugccuguaaucccag

SEQ ID NO: 799839 - RNA, 22 nt, Human
uggcucaugccuguaaucccag

SEQ ID NO: 799840 - RNA, 24 nt, Human
uggcucaugccuguaaucccagca

SEQ ID NO: 799841 - RNA, 24 nt, Human
uggcucaugccuguaaucccagca

SEQ ID NO: 799842 - RNA, 20 nt, Human
ugggaggcagagguugaggu

SEQ ID NO: 799843 - RNA, 18 nt, Human
ugggaggccgaggcaggg

SEQ ID NO: 799844 - RNA, 24 nt, Human
ugggaggccgaggcagggggauca

SEQ ID NO: 799845 - RNA, 20 nt, Human
ugggaggcugaggcgggugg

SEQ ID NO: 799846 - RNA, 23 nt, Human
ugggaggcugaggcggguggauc

SEQ ID NO: 799847 - RNA, 24 nt, Human
ugggaggcugaggcggguggauca

SEQ ID NO: 799848 - RNA, 18 nt, Human
ugggagguggagguugca

SEQ ID NO: 799849 - RNA, 29 nt, Human
ugggagguggagguugcagugacaacggu

SEQ ID NO: 799850 - RNA, 23 nt, Human
ugggagguggagguugcagugau

SEQ ID NO: 799851 - RNA, 25 nt, Human
ugggagguggagguugcagugaucu

SEQ ID NO: 799852 - RNA, 22 nt, Human
ugggugcgguggcucaugccug

SEQ ID NO: 799853 - RNA, 24 nt, Human
ugguggcgcaugccuguaauccca

SEQ ID NO: 799854 - RNA, 24 nt, Human
ugguggcgcaugccuguaauccca

SEQ ID NO: 799855 - RNA, 24 nt, Human
ugguggcucaugccuguaauccca

SEQ ID NO: 799856 - RNA, 19 nt, Human
ugguugguauagccugcag

SEQ ID NO: 799857 - RNA, 24 nt, Human
uguaaacaaaacaugccaggauga

SEQ ID NO: 799858 - RNA, 25 nt, Human
uguagugcaugugugggcauauaua

SEQ ID NO: 799859 - RNA, 22 nt, Human
uguauauagugugugugugugu

SEQ ID NO: 799860 - RNA, 18 nt, Human
uguauauauauauauaua

SEQ ID NO: 799861 - RNA, 22 nt, Human
uguauauauauauauauauaua

SEQ ID NO: 799862 - RNA, 22 nt, Human
ugucuuggccaacguggugaaa

SEQ ID NO: 799863 - RNA, 24 nt, Human
ugucuuggccaacguggugaaacu

SEQ ID NO: 799864 - RNA, 19 nt, Human
ugugggcauauauaguaua

SEQ ID NO: 799865 - RNA, 23 nt, Human
uguguauauacacuauauguaua

SEQ ID NO: 799866 - RNA, 25 nt, Human
uguguauauacacuauauguauaua

SEQ ID NO: 799867 - RNA, 18 nt, Human
uguguauauauauauaua

SEQ ID NO: 799868 - RNA, 20 nt, Human
uguguauauauauauauaua

SEQ ID NO: 799869 - RNA, 20 nt, Human
uguguauauauauauauaua

SEQ ID NO: 799870 - RNA, 22 nt, Human
uguguauauauauauauauaua

SEQ ID NO: 799871 - RNA, 24 nt, Human
uguguguauauauauauauauaac

SEQ ID NO: 799872 - RNA, 18 nt, Human
uguguguguauauauaua

SEQ ID NO: 799873 - RNA, 18 nt, Human
uguguguguauauauaua

SEQ ID NO: 799874 - RNA, 23 nt, Human
uguguguguguauauauauauau

SEQ ID NO: 799875 - RNA, 23 nt, Human
uguguguguguguauauauauau

SEQ ID NO: 799876 - RNA, 20 nt, Human
uguguguguguguguauaua

SEQ ID NO: 799877 - RNA, 22 nt, Human
uguguguguguguguguauaua

SEQ ID NO: 799878 - RNA, 18 nt, Human
ugugugugugugugugug

SEQ ID NO: 799879 - RNA, 18 nt, Human
ugugugugugugugugug

SEQ ID NO: 799880 - RNA, 18 nt, Human
ugugugugugugugugug

SEQ ID NO: 799881 - RNA, 21 nt, Human
ugugugugugugugugugugu

SEQ ID NO: 799882 - RNA, 21 nt, Human
ugugugugugugugugugugu

SEQ ID NO: 799883 - RNA, 21 nt, Human
ugugugugugugugugugugu

SEQ ID NO: 799884 - RNA, 22 nt, Human
ugugugugugugugugugugug

SEQ ID NO: 799885 - RNA, 22 nt, Human
uguguguguguguguguguguu

SEQ ID NO: 799886 - RNA, 21 nt, Human
uguguguguguguguguuaug

SEQ ID NO: 799887 - RNA, 21 nt, Human
uguguguguguguguuauggu

SEQ ID NO: 799888 - RNA, 23 nt, Human
uuaaaacaaaacaaaacaacauu

SEQ ID NO: 799889 - RNA, 18 nt, Human
uuagcugggcaugguggc

SEQ ID NO: 799890 - RNA, 20 nt, Human
uuagcugggcaugguggcgc

SEQ ID NO: 799891 - RNA, 24 nt, Human
uugaaccugggagguggagguugc

SEQ ID NO: 799892 - RNA, 22 nt, Human
uugaggugagccaagacugcgc

SEQ ID NO: 799893 - RNA, 18 nt, Human
uugcagugaucugagaug

SEQ ID NO: 799894 - RNA, 20 nt, Human
uuggaugaaaauggaaagga

SEQ ID NO: 799895 - RNA, 24 nt, Human
uuggcaggcugaggcaggggaauc

SEQ ID NO: 799896 - RNA, 25 nt, Human
uugggaggccgaggcagggggauca

SEQ ID NO: 799897 - RNA, 25 nt, Human
uugggaggcugaggcggguggauca

SEQ ID NO: 799898 - RNA, 22 nt, Human
aaacaaacaaacaaacaaacca

SEQ ID NO: 799899 - RNA, 24 nt, Human
aaacaaaccaucuaguugcaugga

SEQ ID NO: 799900 - RNA, 19 nt, Human
aaacacaacaaaaugaaca

SEQ ID NO: 799901 - RNA, 26 nt, Human
aaaggcaccucuaacagaggacagag

SEQ ID NO: 799902 - RNA, 23 nt, Human
aacaaacaaacaaacaaacaaac

SEQ ID NO: 799903 - RNA, 20 nt, Human
aacauggugaaacccugucu

SEQ ID NO: 799904 - RNA, 21 nt, Human
aacauggugaaacccugucuc

SEQ ID NO: 799905 - RNA, 21 nt, Human
aacccugucucuaccaaaaau

SEQ ID NO: 799906 - RNA, 19 nt, Human
aagugccacucaaccaggg

SEQ ID NO: 799907 - RNA, 24 nt, Human
aaucacuugaacccgggagagaga

SEQ ID NO: 799908 - RNA, 19 nt, Human
aaugaacaacaaacaaaca

SEQ ID NO: 799909 - RNA, 18 nt, Human
aauuagccaggcauggug

SEQ ID NO: 799910 - RNA, 22 nt, Human
acaaaaugaacaacaaacaaac

SEQ ID NO: 799911 - RNA, 18 nt, Human
acaaacaaacaaacaaac

SEQ ID NO: 799912 - RNA, 26 nt, Human
acaaacaaaccaucuaguugcaugga

SEQ ID NO: 799913 - RNA, 23 nt, Human
acaacaaaaugaacaacaaacaa

SEQ ID NO: 799914 - RNA, 22 nt, Human
acaacaaacaaacaaacaaaca

SEQ ID NO: 799915 - RNA, 24 nt, Human
acacaacaaaaugaacaacaaaca

SEQ ID NO: 799916 - RNA, 24 nt, Human
acagagcaagacccugucucaaaa

SEQ ID NO: 799917 - RNA, 24 nt, Human
accaacauggugaaacccugucuc

SEQ ID NO: 799918 - RNA, 24 nt, Human
acccugucucuaccaaaaauacaa

SEQ ID NO: 799919 - RNA, 21 nt, Human
accuuuaccaacaccgcaucc

SEQ ID NO: 799920 - RNA, 18 nt, Human
acgccuauccaugggaaa

SEQ ID NO: 799921 - RNA, 24 nt, Human
acugcauuacaaccugggcgacag

SEQ ID NO: 799922 - RNA, 24 nt, Human
acuugagguugggaguucaagacu

SEQ ID NO: 799923 - RNA, 21 nt, Human
agacagaagggacgcucagag

SEQ ID NO: 799924 - RNA, 24 nt, Human
agagagagguugcagugagcugag

SEQ ID NO: 799925 - RNA, 22 nt, Human
agagguugcagugagcugagau

SEQ ID NO: 799926 - RNA, 24 nt, Human
agagguugcagugagcugagauug

SEQ ID NO: 799927 - RNA, 23 nt, Human
agaucacuugagguugggaguuc

SEQ ID NO: 799928 - RNA, 23 nt, Human
agccaggcaugguggugggugcc

SEQ ID NO: 799929 - RNA, 24 nt, Human
agccugaccaacauggugaaaccc

SEQ ID NO: 799930 - RNA, 23 nt, Human
aggcaaaacgugggugagccaag

SEQ ID NO: 799931 - RNA, 24 nt, Human
aggcaaaacgugggugagccaaga

SEQ ID NO: 799932 - RNA, 18 nt, Human
aggcaggagaaucacuug

SEQ ID NO: 799933 - RNA, 24 nt, Human
aggcaggagaaucacuugaacccg

SEQ ID NO: 799934 - RNA, 24 nt, Human
aggcaugguggugggugccuguaa

SEQ ID NO: 799935 - RNA, 21 nt, Human
aggcgggcagaucacuugagg

SEQ ID NO: 799936 - RNA, 22 nt, Human
aggcgggcagaucacuugaggg

SEQ ID NO: 799937 - RNA, 22 nt, Human
aggcgggcagaucacuugaggu

SEQ ID NO: 799938 - RNA, 26 nt, Human
aggcgggcagaucacuugagguuggg

SEQ ID NO: 799939 - RNA, 24 nt, Human
aggcugaggcaggagaaucacuug

SEQ ID NO: 799940 - RNA, 27 nt, Human
agggacuccugcucggugaccugcugc

SEQ ID NO: 799941 - RNA, 20 nt, Human
agggucuagaaaagacuggg

SEQ ID NO: 799942 - RNA, 24 nt, Human
aguggcucacaccuguaaucccag

SEQ ID NO: 799943 - RNA, 23 nt, Human
aucacuugagguugggaguucaa

SEQ ID NO: 799944 - RNA, 22 nt, Human
auccugggcuucugguuuucug

SEQ ID NO: 799945 - RNA, 18 nt, Human
aucucuuucccuuccucc

SEQ ID NO: 799946 - RNA, 24 nt, Human
auugcgccacugcauuacaaccug

SEQ ID NO: 799947 - RNA, 21 nt, Human
caaaaauacaaaaauuagcca

SEQ ID NO: 799948 - RNA, 24 nt, Human
caacauggugaaacccugucucua

SEQ ID NO: 799949 - RNA, 24 nt, Human
caagaugaaaccgcaagugccacu

SEQ ID NO: 799950 - RNA, 23 nt, Human
cacaacaaaaugaacaacaaaca

SEQ ID NO: 799951 - RNA, 24 nt, Human
cacaccuguaaucccagcacguug

SEQ ID NO: 799952 - RNA, 19 nt, Human
cacccucaggguccacacc

SEQ ID NO: 799953 - RNA, 24 nt, Human
cacccucaggguccacaccuguca

SEQ ID NO: 799954 - RNA, 23 nt, Human
caccuguaaucccagcacguugg

SEQ ID NO: 799955 - RNA, 24 nt, Human
caccuguaaucccagcacguuggg

SEQ ID NO: 799956 - RNA, 22 nt, Human
cacguugggaggccgaggcggg

SEQ ID NO: 799957 - RNA, 18 nt, Human
cacucaaccagggucaca

SEQ ID NO: 799958 - RNA, 20 nt, Human
cacugcauuacaaccugggc

SEQ ID NO: 799959 - RNA, 23 nt, Human
cacugcauuacaaccugggcgac

SEQ ID NO: 799960 - RNA, 24 nt, Human
cacugcauuacaaccugggcgaca

SEQ ID NO: 799961 - RNA, 21 nt, Human
cacugcuccugcugcaucaug

SEQ ID NO: 799962 - RNA, 21 nt, Human
cacuugaacccgggagagaga

SEQ ID NO: 799963 - RNA, 23 nt, Human
cacuugagguugggaguucaaga

SEQ ID NO: 799964 - RNA, 19 nt, Human
cagaacgagacagaaggga

SEQ ID NO: 799965 - RNA, 20 nt, Human
cagaagauccugggcuucug

SEQ ID NO: 799966 - RNA, 23 nt, Human
cagcaauaaugggccaccucccu

SEQ ID NO: 799967 - RNA, 24 nt, Human
cagcacguugggaggccgaggcgg

SEQ ID NO: 799968 - RNA, 24 nt, Human
cagcuacuugggaggcugaggcag

SEQ ID NO: 799969 - RNA, 22 nt, Human
caggagacagugugcucaccac

SEQ ID NO: 799970 - RNA, 18 nt, Human
cauccaguugggccgggg

SEQ ID NO: 799971 - RNA, 19 nt, Human
caucugaggaaacccugcu

SEQ ID NO: 799972 - RNA, 21 nt, Human
caugaguggggugaaugccag

SEQ ID NO: 799973 - RNA, 22 nt, Human
caugguggugggugccuguaau

SEQ ID NO: 799974 - RNA, 21 nt, Human
ccacugcauuacaaccugggc

SEQ ID NO: 799975 - RNA, 23 nt, Human
ccagagugaugagaagucaccca

SEQ ID NO: 799976 - RNA, 26 nt, Human
ccagcaauaaugggccaccucccgag

SEQ ID NO: 799977 - RNA, 22 nt, Human
cccaagaucucagaguuuguuc

SEQ ID NO: 799978 - RNA, 20 nt, Human
cccagcacguugggaggccg

SEQ ID NO: 799979 - RNA, 19 nt, Human
ccccagaagcgacugcugc

SEQ ID NO: 799980 - RNA, 24 nt, Human
ccucaggguccacaccugucacuu

SEQ ID NO: 799981 - RNA, 22 nt, Human
ccugaccaacauggugaaaccc

SEQ ID NO: 799982 - RNA, 24 nt, Human
ccugaccaacauggugaaacccug

SEQ ID NO: 799983 - RNA, 19 nt, Human
ccuguaaucccagcuacuu

SEQ ID NO: 799984 - RNA, 21 nt, Human
ccuguaaucccagcuacuugg

SEQ ID NO: 799985 - RNA, 22 nt, Human
ccuguaaucccagcuacuuggg

SEQ ID NO: 799986 - RNA, 25 nt, Human
ccugucacuucacaggaauggaggu

SEQ ID NO: 799987 - RNA, 18 nt, Human
ccuucacuccccguauuc

SEQ ID NO: 799988 - RNA, 24 nt, Human
cgaggcgggcagaucacuugaggu

SEQ ID NO: 799989 - RNA, 18 nt, Human
cgcugccagcugcauugc

SEQ ID NO: 799990 - RNA, 24 nt, Human
cgggagagagagguugcagugagc

SEQ ID NO: 799991 - RNA, 22 nt, Human
cucacaccuguaaucccagcac

SEQ ID NO: 799992 - RNA, 22 nt, Human
cucacaccuguaaucccagcac

SEQ ID NO: 799993 - RNA, 23 nt, Human
cucacaucucuuucccuuccucc

SEQ ID NO: 799994 - RNA, 24 nt, Human
cugaccaacauggugaaacccugu

SEQ ID NO: 799995 - RNA, 22 nt, Human
cugaugagcaagugucucuucu

SEQ ID NO: 799996 - RNA, 21 nt, Human
cugcugcaucaugccugguuc

SEQ ID NO: 799997 - RNA, 22 nt, Human
gaaaccuuuaccaacaccgcau

SEQ ID NO: 799998 - RNA, 23 nt, Human
gaacaacaaacaaacaaacaaac

SEQ ID NO: 799999 - RNA, 21 nt, Human
gacagagcaagacccugucuc

SEQ ID NO: 800000 - RNA, 23 nt, Human
gagaaucacuugaacccgggaga

SEQ ID NO: 800001 - RNA, 24 nt, Human
gagcaagacccugucucaaaaaac

SEQ ID NO: 800002 - RNA, 23 nt, Human
gaucacuugagguugggaguuca

SEQ ID NO: 800003 - RNA, 24 nt, Human
gaucacuugagguugggaguucaa

SEQ ID NO: 800004 - RNA, 21 nt, Human
gauuuggggcaggagaaaggc

SEQ ID NO: 800005 - RNA, 23 nt, Human
gcaggagaaucacuugaacccgg

SEQ ID NO: 800006 - RNA, 24 nt, Human
gccacugcauuacaaccugggcga

SEQ ID NO: 800007 - RNA, 21 nt, Human
gccggggcguaguggcucaca

SEQ ID NO: 800008 - RNA, 19 nt, Human
gccugauuuggggcaggag

SEQ ID NO: 800009 - RNA, 23 nt, Human
gcgacagagcaagacccugucuc

SEQ ID NO: 800010 - RNA, 19 nt, Human
ggagaugccugccggccuu

SEQ ID NO: 800011 - RNA, 25 nt, Human
ggcagaucacuugagguugggaguu

SEQ ID NO: 800012 - RNA, 19 nt, Human
ggcuacgauuaaacaacaa

SEQ ID NO: 800013 - RNA, 24 nt, Human
gggcguaguggcucacaccuguaa

SEQ ID NO: 800014 - RNA, 24 nt, Human
gguggugggugccuguaaucccag

SEQ ID NO: 800015 - RNA, 19 nt, Human
guugcagugagcugagauu

SEQ ID NO: 800016 - RNA, 21 nt, Human
guugcagugagcugagauugc

SEQ ID NO: 800017 - RNA, 23 nt, Human
uaaaagacucacucccugauccg

SEQ ID NO: 800018 - RNA, 18 nt, Human
uaaacaacaacacuggag

SEQ ID NO: 800019 - RNA, 26 nt, Human
uaacagaggacagagcuuuagcacag

SEQ ID NO: 800020 - RNA, 26 nt, Human
uaaugggccaccucccgagggcagac

SEQ ID NO: 800021 - RNA, 25 nt, Human
uaccaaaaauacaaaaauuagccag

SEQ ID NO: 800022 - RNA, 24 nt, Human
uacgauuaaacaacaacacuggag

SEQ ID NO: 800023 - RNA, 23 nt, Human
uagggcagaacgagacagaaggg

SEQ ID NO: 800024 - RNA, 24 nt, Human
uaguggcucacaccuguaauccca

SEQ ID NO: 800025 - RNA, 18 nt, Human
uauaauccaacauuugcc

SEQ ID NO: 800026 - RNA, 23 nt, Human
ucacuugagguugggaguucaag

SEQ ID NO: 800027 - RNA, 22 nt, Human
ucagagggacuccugcucggug

SEQ ID NO: 800028 - RNA, 25 nt, Human
ugaaaccgcaagugccacucaacca

SEQ ID NO: 800029 - RNA, 23 nt, Human
ugaaaugcuucccucacaucucu

SEQ ID NO: 800030 - RNA, 24 nt, Human
ugaccaacauggugaaacccuguc

SEQ ID NO: 800031 - RNA, 22 nt, Human
ugacuccagauucacugcuccu

SEQ ID NO: 800032 - RNA, 19 nt, Human
ugagauugcgccacugcau

SEQ ID NO: 800033 - RNA, 21 nt, Human
ugagccaagaagcaggcccaa

SEQ ID NO: 800034 - RNA, 22 nt, Human
ugagcugagauugcgccacugc

SEQ ID NO: 800035 - RNA, 20 nt, Human
ugaggcaggagaaucacuug

SEQ ID NO: 800036 - RNA, 24 nt, Human
ugaggcaggagaaucacuugaacc

SEQ ID NO: 800037 - RNA, 25 nt, Human
ugaggcaggagaaucacuugaaccc

SEQ ID NO: 800038 - RNA, 19 nt, Human
ugaguggggugaaugccag

SEQ ID NO: 800039 - RNA, 24 nt, Human
ugaguggggugaaugccagcagga

SEQ ID NO: 800040 - RNA, 18 nt, Human
ugauuuggggcaggagaa

SEQ ID NO: 800041 - RNA, 24 nt, Human
ugcauauauaaaugugcucgugug

SEQ ID NO: 800042 - RNA, 22 nt, Human
ugcaucaugccugguucauaug

SEQ ID NO: 800043 - RNA, 23 nt, Human
ugccuguaaucccagcuacuugg

SEQ ID NO: 800044 - RNA, 24 nt, Human
ugccuguaaucccagcuacuuggg

SEQ ID NO: 800045 - RNA, 22 nt, Human
ugcgccacugcauuacaaccug

SEQ ID NO: 800046 - RNA, 27 nt, Human
ugcucggugaccugcugguccgagggg

SEQ ID NO: 800047 - RNA, 25 nt, Human
ugcuuugaaaacauggaaacagcuc

SEQ ID NO: 800048 - RNA, 23 nt, Human
uggcagggucugaugcaugacuu

SEQ ID NO: 800049 - RNA, 18 nt, Human
uggcggaggcagaagauc

SEQ ID NO: 800050 - RNA, 23 nt, Human
uggcgugagguuucuuccuuggc

SEQ ID NO: 800051 - RNA, 28 nt, Human
uggcgugagguuucuuccuuggcgacau

SEQ ID NO: 800052 - RNA, 21 nt, Human
uggcucacaccuguaauccca

SEQ ID NO: 800053 - RNA, 24 nt, Human
uggcucacaccuguaaucccagca

SEQ ID NO: 800054 - RNA, 20 nt, Human
ugggaggccgaggcgggcag

SEQ ID NO: 800055 - RNA, 24 nt, Human
ugggaggccgaggcgggcagauca

SEQ ID NO: 800056 - RNA, 19 nt, Human
ugggaggcugaggcaggag

SEQ ID NO: 800057 - RNA, 24 nt, Human
ugggaggcugaggcaggagaauca

SEQ ID NO: 800058 - RNA, 24 nt, Human
uggugggugccuguaaucccagcu

SEQ ID NO: 800059 - RNA, 24 nt, Human
ugguggugggugccuguaauccca

SEQ ID NO: 800060 - RNA, 24 nt, Human
uuagccaggcaugguggugggugc

SEQ ID NO: 800061 - RNA, 20 nt, Human
uucuuccuuggcgacauucu

SEQ ID NO: 800062 - RNA, 19 nt, Human
uugcagugagcugagauug

SEQ ID NO: 800063 - RNA, 22 nt, Human
uugcagugagcugagauugcgc

SEQ ID NO: 800064 - RNA, 25 nt, Human
uugggaggccgaggcgggcagauca

SEQ ID NO: 800065 - RNA, 25 nt, Human
uugggaggcugaggcaggagaauca

SEQ ID NO: 800066 - RNA, 20 nt, Human
aaaguuaccagaaaucuuug

SEQ ID NO: 800067 - RNA, 23 nt, Human
aaauaaagacaaguacaaucuaa

SEQ ID NO: 800068 - RNA, 22 nt, Human
aaauucucuaggaaauaaagaa

SEQ ID NO: 800069 - RNA, 22 nt, Human
acaacaacaaaaaaaaaaaccc

SEQ ID NO: 800070 - RNA, 26 nt, Human
acaacaacaaaaaaaaaaacccaaaa

SEQ ID NO: 800071 - RNA, 21 nt, Human
agaaauauauauuauaccucc

SEQ ID NO: 800072 - RNA, 21 nt, Human
agaagcucuccaacuucauau

SEQ ID NO: 800073 - RNA, 28 nt, Human
agacaaguacaaucuaaaaaggguuucc

SEQ ID NO: 800074 - RNA, 25 nt, Human
agacuagauucaucauuuuaaauaa

SEQ ID NO: 800075 - RNA, 23 nt, Human
cacaguaaguguucuccuccaca

SEQ ID NO: 800076 - RNA, 19 nt, Human
cacauuaucuccugcugcc

SEQ ID NO: 800077 - RNA, 18 nt, Human
cacucucgccgcccgggc

SEQ ID NO: 800078 - RNA, 19 nt, Human
cagcaacauuugccccaac

SEQ ID NO: 800079 - RNA, 19 nt, Human
caguaaguguucuccucca

SEQ ID NO: 800080 - RNA, 22 nt, Human
caguaaguguucuccuccacag

SEQ ID NO: 800081 - RNA, 24 nt, Human
cagugugacuuuucaagugggcuu

SEQ ID NO: 800082 - RNA, 20 nt, Human
cauuacacuucacuauaaca

SEQ ID NO: 800083 - RNA, 21 nt, Human
ccccgcggccgcccaccagca

SEQ ID NO: 800084 - RNA, 21 nt, Human
ccgcccgggccggagcggccc

SEQ ID NO: 800085 - RNA, 20 nt, Human
cgcccucagccccgcggccg

SEQ ID NO: 800086 - RNA, 19 nt, Human
cgggccggagcggccccgg

SEQ ID NO: 800087 - RNA, 20 nt, Human
cguacauuccaguucacaug

SEQ ID NO: 800088 - RNA, 22 nt, Human
cucaagaacugacaguuuaaaa

SEQ ID NO: 800089 - RNA, 30 nt, Human
cugcacaaauaaaugcagacuugucucuuu

SEQ ID NO: 800090 - RNA, 18 nt, Human
cuuguugugcugacuuca

SEQ ID NO: 800091 - RNA, 20 nt, Human
ggcggcgggagcaagagcac

SEQ ID NO: 800092 - RNA, 19 nt, Human
guaaccacacauacauaug

SEQ ID NO: 800093 - RNA, 19 nt, Human
uaaaaacaaagccccagcc

SEQ ID NO: 800094 - RNA, 23 nt, Human
uaaaauuaagaacuguauauauu

SEQ ID NO: 800095 - RNA, 27 nt, Human
uaacaacaacaaaaaaaaaaacccaaa

SEQ ID NO: 800096 - RNA, 18 nt, Human
uaacagcugauucagacu

SEQ ID NO: 800097 - RNA, 23 nt, Human
uaacuuccaagagaugcaauucu

SEQ ID NO: 800098 - RNA, 23 nt, Human
uagcucaaaguuaccagaaaucu

SEQ ID NO: 800099 - RNA, 25 nt, Human
uauagcucaaaguuaccagaaaucu

SEQ ID NO: 800100 - RNA, 19 nt, Human
ucaaaguuaccagaaaucu

SEQ ID NO: 800101 - RNA, 21 nt, Human
uccaagagaugcaauucugcc

SEQ ID NO: 800102 - RNA, 20 nt, Human
ucccgcagcaacauuugccc

SEQ ID NO: 800103 - RNA, 21 nt, Human
uccguaaccacauuauuacuc

SEQ ID NO: 800104 - RNA, 23 nt, Human
ucucuuguugugcugacuucaac

SEQ ID NO: 800105 - RNA, 19 nt, Human
ucucuuuugcagcaguggu

SEQ ID NO: 800106 - RNA, 22 nt, Human
ucuguuaacuuccaagagaugc

SEQ ID NO: 800107 - RNA, 22 nt, Human
ugagggccacaacguacauucc

SEQ ID NO: 800108 - RNA, 19 nt, Human
ugccggacgcccucagccc

SEQ ID NO: 800109 - RNA, 18 nt, Human
uuaaagcacauuccuaga

SEQ ID NO: 800110 - RNA, 26 nt, Human
uucucaccuuccaagucccccuccaa

SEQ ID NO: 800111 - RNA, 26 nt, Human
uuucugcucauuaacaacaacaaaaa

SEQ ID NO: 800112 - RNA, 18 nt, Human
uuuucucuuguugugcug

SEQ ID NO: 800113 - RNA, 21 nt, Human
uuuucucuuguugugcugacu

SEQ ID NO: 800114 - RNA, 21 nt, Human
uuuugcauuuaauuuucgaaa

SEQ ID NO: 800115 - RNA, 20 nt, Human
uuuuuuuuuucagaaggcac

SEQ ID NO: 800116 - RNA, 24 nt, Human
uuuuuuuuuuuuuuuuuuuuucag

SEQ ID NO: 800117 - RNA, 23 nt, Human
aaaaacaaauaaauaaucgccug

SEQ ID NO: 800118 - RNA, 18 nt, Human
agaaggcagggcggguag

SEQ ID NO: 800119 - RNA, 20 nt, Human
aggggcuacggacggcccgg

SEQ ID NO: 800120 - RNA, 19 nt, Human
cccgcccgcgccggccucg

SEQ ID NO: 800121 - RNA, 18 nt, Human
cgcucgcccgagcgcugc

SEQ ID NO: 800122 - RNA, 24 nt, Human
cggugcagccgcggagcgcgcggg

SEQ ID NO: 800123 - RNA, 18 nt, Human
gacaggucaggucagggg

SEQ ID NO: 800124 - RNA, 22 nt, Human
ggccgccccugugaaugacuga

SEQ ID NO: 800125 - RNA, 18 nt, Human
gugugugugugugugugu

SEQ ID NO: 800126 - RNA, 21 nt, Human
gugugugugugugugugugug

SEQ ID NO: 800127 - RNA, 21 nt, Human
gugugugugugugugugugug

SEQ ID NO: 800128 - RNA, 23 nt, Human
uaaaaacaaauaaauaaucgccu

SEQ ID NO: 800129 - RNA, 19 nt, Human
uacaaaaauaugacaaaau

SEQ ID NO: 800130 - RNA, 19 nt, Human
uacugggggcccucggggg

SEQ ID NO: 800131 - RNA, 22 nt, Human
ucauggggccggugcagccgcg

SEQ ID NO: 800132 - RNA, 24 nt, Human
ucugugugugugugugugugugug

SEQ ID NO: 800133 - RNA, 18 nt, Human
ugugugugugugugugug

SEQ ID NO: 800134 - RNA, 18 nt, Human
ugugugugugugugugug

SEQ ID NO: 800135 - RNA, 18 nt, Human
ugugugugugugugugug

SEQ ID NO: 800136 - RNA, 18 nt, Human
ugugugugugugugugug

SEQ ID NO: 800137 - RNA, 18 nt, Human
ugugugugugugugugug

SEQ ID NO: 800138 - RNA, 18 nt, Human
ugugugugugugugugug

SEQ ID NO: 800139 - RNA, 18 nt, Human
ugugugugugugugugug

SEQ ID NO: 800140 - RNA, 18 nt, Human
ugugugugugugugugug

SEQ ID NO: 800141 - RNA, 21 nt, Human
ugugugugugugugugugugu

SEQ ID NO: 800142 - RNA, 21 nt, Human
ugugugugugugugugugugu

SEQ ID NO: 800143 - RNA, 21 nt, Human
ugugugugugugugugugugu

SEQ ID NO: 800144 - RNA, 21 nt, Human
ugugugugugugugugugugu

SEQ ID NO: 800145 - RNA, 21 nt, Human
ugugugugugugugugugugu

SEQ ID NO: 800146 - RNA, 21 nt, Human
ugugugugugugugugugugu

SEQ ID NO: 800147 - RNA, 21 nt, Human
ugugugugugugugugugugu

SEQ ID NO: 800148 - RNA, 21 nt, Human
ugugugugugugugugugugu

SEQ ID NO: 800149 - RNA, 21 nt, Human
ugugugugugugugugugugu

SEQ ID NO: 800150 - RNA, 21 nt, Human
ugugugugugugugugugugu

SEQ ID NO: 800151 - RNA, 21 nt, Human
ugugugugugugugugugugu

SEQ ID NO: 800152 - RNA, 21 nt, Human
ugugugugugugugugugugu

SEQ ID NO: 800153 - RNA, 22 nt, Human
ugugugugugugugugugugug

SEQ ID NO: 800154 - RNA, 22 nt, Human
ugugugugugugugugugugug

SEQ ID NO: 800155 - RNA, 22 nt, Human
ugugugugugugugugugugug

SEQ ID NO: 800156 - RNA, 26 nt, Human
uguguguguguguguguguuuucugg

SEQ ID NO: 800157 - RNA, 22 nt, Human
uguguguguguguguguuuucu

SEQ ID NO: 800158 - RNA, 23 nt, Human
uguguguguguguuuucuguuuu

SEQ ID NO: 800159 - RNA, 25 nt, Human
uguucugugugugugugugugugug

SEQ ID NO: 800160 - RNA, 22 nt, Human
uuuuacaaaaauaugacaaaau

SEQ ID NO: 800161 - RNA, 27 nt, Human
aaaaaaccagacaguguggugggcacc

SEQ ID NO: 800162 - RNA, 23 nt, Human
aaacuuaaaaaaaaagaagaaaa

SEQ ID NO: 800163 - RNA, 25 nt, Human
aaauguuaaaacccugacaaaagcu

SEQ ID NO: 800164 - RNA, 20 nt, Human
aagaagaaaaaagcuuaccu

SEQ ID NO: 800165 - RNA, 21 nt, Human
acccaccccuggaaucuccac

SEQ ID NO: 800166 - RNA, 19 nt, Human
aucugaguuuauuuaaaac

SEQ ID NO: 800167 - RNA, 20 nt, Human
caagcuggaagugaguucua

SEQ ID NO: 800168 - RNA, 18 nt, Human
cacccaccccuggaaucu

SEQ ID NO: 800169 - RNA, 22 nt, Human
caccuccccuaucaaauuuaga

SEQ ID NO: 800170 - RNA, 24 nt, Human
cacgcacauaacaaaaggcagaau

SEQ ID NO: 800171 - RNA, 21 nt, Human
cagcucagagaaauuaaagca

SEQ ID NO: 800172 - RNA, 22 nt, Human
cagcucagagaaauuaaagcaa

SEQ ID NO: 800173 - RNA, 21 nt, Human
cccuggaaucuccaccucccc

SEQ ID NO: 800174 - RNA, 18 nt, Human
cgaacagaguauccucau

SEQ ID NO: 800175 - RNA, 22 nt, Human
cgcacauaacaaaaggcagaau

SEQ ID NO: 800176 - RNA, 20 nt, Human
cucgcuaagacauucuugca

SEQ ID NO: 800177 - RNA, 18 nt, Human
gaacaaaauucaccggga

SEQ ID NO: 800178 - RNA, 18 nt, Human
gcccugucagcacuagca

SEQ ID NO: 800179 - RNA, 21 nt, Human
uaaaaaaaaagaagaaaaaag

SEQ ID NO: 800180 - RNA, 24 nt, Human
uaaaacccugacaaaagcuuacca

SEQ ID NO: 800181 - RNA, 22 nt, Human
uaagucucccacuugaaauuua

SEQ ID NO: 800182 - RNA, 22 nt, Human
uaccaucuuuuccaacucuauu

SEQ ID NO: 800183 - RNA, 19 nt, Human
ucagcacuagcaugauacc

SEQ ID NO: 800184 - RNA, 23 nt, Human
uccaacuccggcuuuucacuauc

SEQ ID NO: 800185 - RNA, 22 nt, Human
ucuccagugaacucuuauccaa

SEQ ID NO: 800186 - RNA, 20 nt, Human
ugcaagcaaggcucgcuaag

SEQ ID NO: 800187 - RNA, 23 nt, Human
ugccugcuaaguucuaucucuuc

SEQ ID NO: 800188 - RNA, 21 nt, Human
uggaacaaaauucaccgggag

SEQ ID NO: 800189 - RNA, 20 nt, Human
uuaaaaaaaaagaagaaaaa

SEQ ID NO: 800190 - RNA, 22 nt, Human
uucacuaucccgaguacuuguc

SEQ ID NO: 800191 - RNA, 18 nt, Human
uuccauuauuuauuccca

SEQ ID NO: 800192 - RNA, 19 nt, Human
aaagugcugggauuacagg

SEQ ID NO: 800193 - RNA, 23 nt, Human
aaagugcugggauuacaggcaug

SEQ ID NO: 800194 - RNA, 25 nt, Human
aagcgauucucuugccucagccucc

SEQ ID NO: 800195 - RNA, 19 nt, Human
aagugcugggauuacaggc

SEQ ID NO: 800196 - RNA, 23 nt, Human
aagugcugggauuacaggcaugu

SEQ ID NO: 800197 - RNA, 23 nt, Human
acaggugcccaccaccacacccg

SEQ ID NO: 800198 - RNA, 24 nt, Human
accguguuggccaggcuggucucg

SEQ ID NO: 800199 - RNA, 24 nt, Human
agcgauucucuugccucagccucc

SEQ ID NO: 800200 - RNA, 24 nt, Human
aggugauccaccagccuuggccuc

SEQ ID NO: 800201 - RNA, 18 nt, Human
agugcugggauuacaggc

SEQ ID NO: 800202 - RNA, 22 nt, Human
auuuuuuguauuuuuaguagag

SEQ ID NO: 800203 - RNA, 24 nt, Human
caaagugcugggauuacaggcaug

SEQ ID NO: 800204 - RNA, 22 nt, Human
caagcgauucucuugccucagc

SEQ ID NO: 800205 - RNA, 23 nt, Human
cacaggugcccaccaccacaccc

SEQ ID NO: 800206 - RNA, 21 nt, Human
caccguguuggccaggcuggu

SEQ ID NO: 800207 - RNA, 24 nt, Human
caccguguuggccaggcuggucuc

SEQ ID NO: 800208 - RNA, 21 nt, Human
cacugcaaccuccgccuccca

SEQ ID NO: 800209 - RNA, 22 nt, Human
cagccucccaggaagcugggau

SEQ ID NO: 800210 - RNA, 21 nt, Human
caggugcccaccaccacaccc

SEQ ID NO: 800211 - RNA, 24 nt, Human
caggugcccaccaccacacccggc

SEQ ID NO: 800212 - RNA, 23 nt, Human
ccaaagugcugggauuacaggca

SEQ ID NO: 800213 - RNA, 24 nt, Human
ccaaagugcugggauuacaggcau

SEQ ID NO: 800214 - RNA, 24 nt, Human
ccaaagugcugggauuacaggcau

SEQ ID NO: 800215 - RNA, 24 nt, Human
cccaaagugcugggauuacaggca

SEQ ID NO: 800216 - RNA, 22 nt, Human
cccaccaccacacccggcuauu

SEQ ID NO: 800217 - RNA, 20 nt, Human
cccaggcuggacagcaaugg

SEQ ID NO: 800218 - RNA, 24 nt, Human
ccgccucccagauucaagcgauuc

SEQ ID NO: 800219 - RNA, 24 nt, Human
ccucccagauucaagcgauucucu

SEQ ID NO: 800220 - RNA, 19 nt, Human
ccucccaggaagcugggau

SEQ ID NO: 800221 - RNA, 20 nt, Human
ccugaccucaggugauccac

SEQ ID NO: 800222 - RNA, 23 nt, Human
ccugaccucaggugauccaccag

SEQ ID NO: 800223 - RNA, 21 nt, Human
cgggagcccgaggggauccca

SEQ ID NO: 800224 - RNA, 23 nt, Human
cgggguuucaccguguuggccag

SEQ ID NO: 800225 - RNA, 24 nt, Human
cucacugcaaccuccgccucccag

SEQ ID NO: 800226 - RNA, 20 nt, Human
cucuugccucagccucccag

SEQ ID NO: 800227 - RNA, 23 nt, Human
cugcaaccuccgccucccagauu

SEQ ID NO: 800228 - RNA, 24 nt, Human
cugcaaccuccgccucccagauuc

SEQ ID NO: 800229 - RNA, 24 nt, Human
cuugccucagccucccaggaagcu

SEQ ID NO: 800230 - RNA, 21 nt, Human
cuugcucugucacccaggcug

SEQ ID NO: 800231 - RNA, 24 nt, Human
gaccucaggugauccaccagccuu

SEQ ID NO: 800232 - RNA, 24 nt, Human
gaggcgggguuucaccguguuggc

SEQ ID NO: 800233 - RNA, 18 nt, Human
gauuacaggcaugugcca

SEQ ID NO: 800234 - RNA, 22 nt, Human
gccuuggccucccaaagugcug

SEQ ID NO: 800235 - RNA, 24 nt, Human
gcgauucucuugccucagccuccc

SEQ ID NO: 800236 - RNA, 18 nt, Human
gcgggguuucaccguguu

SEQ ID NO: 800237 - RNA, 23 nt, Human
gcgggguuucaccguguuggcca

SEQ ID NO: 800238 - RNA, 24 nt, Human
gcgggguuucaccguguuggccag

SEQ ID NO: 800239 - RNA, 30 nt, Human
gcucugucacccaggcuggacagcaauggg

SEQ ID NO: 800240 - RNA, 23 nt, Human
gcuggucucgaacuccugaccuc

SEQ ID NO: 800241 - RNA, 19 nt, Human
ggauuacaggcaugugcca

SEQ ID NO: 800242 - RNA, 24 nt, Human
ggcuggucucgaacuccugaccuc

SEQ ID NO: 800243 - RNA, 23 nt, Human
gggguuucaccguguuggccagg

SEQ ID NO: 800244 - RNA, 22 nt, Human
ggguuucaccguguuggccagg

SEQ ID NO: 800245 - RNA, 19 nt, Human
ggucucgaacuccugaccu

SEQ ID NO: 800246 - RNA, 24 nt, Human
gugauccaccagccuuggccuccc

SEQ ID NO: 800247 - RNA, 21 nt, Human
uaguagaggcgggguuucacc

SEQ ID NO: 800248 - RNA, 24 nt, Human
uaguagaggcgggguuucaccgug

SEQ ID NO: 800249 - RNA, 26 nt, Human
uaguagaggcgggguuucaccguguu

SEQ ID NO: 800250 - RNA, 24 nt, Human
uauuuuuuguauuuuuaguagagg

SEQ ID NO: 800251 - RNA, 24 nt, Human
ucaccguguuggccaggcuggucu

SEQ ID NO: 800252 - RNA, 18 nt, Human
ucacugcaaccuccgccu

SEQ ID NO: 800253 - RNA, 19 nt, Human
ucacugcaaccuccgccuc

SEQ ID NO: 800254 - RNA, 23 nt, Human
ucacugcaaccuccgccucccag

SEQ ID NO: 800255 - RNA, 26 nt, Human
ucacugcaaccuccgccucccagauu

SEQ ID NO: 800256 - RNA, 24 nt, Human
ucccaaagugcugggauuacaggc

SEQ ID NO: 800257 - RNA, 21 nt, Human
ucccagauucaagcgauucuc

SEQ ID NO: 800258 - RNA, 24 nt, Human
ucccagauucaagcgauucucuug

SEQ ID NO: 800259 - RNA, 20 nt, Human
ucccggccagcaugcuaagg

SEQ ID NO: 800260 - RNA, 23 nt, Human
ucucgaacuccugaccucaggug

SEQ ID NO: 800261 - RNA, 18 nt, Human
ucugucacccaggcugga

SEQ ID NO: 800262 - RNA, 24 nt, Human
ucugucacccaggcuggacagcaa

SEQ ID NO: 800263 - RNA, 23 nt, Human
ucuugcucugucacccaggcugg

SEQ ID NO: 800264 - RNA, 24 nt, Human
ucuugcucugucacccaggcugga

SEQ ID NO: 800265 - RNA, 20 nt, Human
ugaccucaggugauccacca

SEQ ID NO: 800266 - RNA, 24 nt, Human
ugaccucaggugauccaccagccu

SEQ ID NO: 800267 - RNA, 22 nt, Human
ugauccaccagccuuggccucc

SEQ ID NO: 800268 - RNA, 21 nt, Human
ugcccaccaccacacccggcu

SEQ ID NO: 800269 - RNA, 24 nt, Human
ugccucagccucccaggaagcugg

SEQ ID NO: 800270 - RNA, 24 nt, Human
ugcucugucacccaggcuggacag

SEQ ID NO: 800271 - RNA, 20 nt, Human
ugcugggauuacaggcaugu

SEQ ID NO: 800272 - RNA, 24 nt, Human
uggccaggcuggucucgaacuccu

SEQ ID NO: 800273 - RNA, 21 nt, Human
ugggaucacaggugcccacca

SEQ ID NO: 800274 - RNA, 24 nt, Human
ugggaucacaggugcccaccacca

SEQ ID NO: 800275 - RNA, 18 nt, Human
ugggauuacaggcaugug

SEQ ID NO: 800276 - RNA, 21 nt, Human
ugggauuacaggcaugugcca

SEQ ID NO: 800277 - RNA, 22 nt, Human
ugggauuacaggcaugugccac

SEQ ID NO: 800278 - RNA, 24 nt, Human
ugggauuacaggcaugugccaccc

SEQ ID NO: 800279 - RNA, 21 nt, Human
uguauuuuuaguagaggcggg

SEQ ID NO: 800280 - RNA, 18 nt, Human
uuaguagaggcgggguuu

SEQ ID NO: 800281 - RNA, 22 nt, Human
uuaguagaggcgggguuucacc

SEQ ID NO: 800282 - RNA, 24 nt, Human
uuaguagaggcgggguuucaccgu

SEQ ID NO: 800283 - RNA, 23 nt, Human
uucaagcgauucucuugccucag

SEQ ID NO: 800284 - RNA, 22 nt, Human
uucucuugccucagccucccag

SEQ ID NO: 800285 - RNA, 18 nt, Human
uuggccucccaaagugcu

SEQ ID NO: 800286 - RNA, 23 nt, Human
uuguauuuuuaguagaggcgggg

SEQ ID NO: 800287 - RNA, 24 nt, Human
uuucaccguguuggccaggcuggu

SEQ ID NO: 800288 - RNA, 24 nt, Human
uuuuuaguagaggcgggguuucac

SEQ ID NO: 800289 - RNA, 20 nt, Human
uuuuuguauuuuuaguagag

SEQ ID NO: 800290 - RNA, 24 nt, Human
uuuuuuguauuuuuaguagaggcg

SEQ ID NO: 800291 - RNA, 20 nt, Human
uuuuuuuuuugaaacgcagg

SEQ ID NO: 800292 - RNA, 20 nt, Human
uuuuuuuuuuuuuuuuuugg

SEQ ID NO: 800293 - RNA, 24 nt, Human
acauucagauaugcuaaaaaaaaa

SEQ ID NO: 800294 - RNA, 22 nt, Human
uaugcuaaaaaaaaaaaaaaaa

SEQ ID NO: 800295 - RNA, 20 nt, Human
ugcuaaaaaaaaaaaaaaaa

SEQ ID NO: 800296 - RNA, 31 nt, Human
uucagauaugcuaaaaaaaaaaaaaaaaaaa

SEQ ID NO: 800297 - RNA, 20 nt, Human
aaaaaaaaggcuuuuucugg

SEQ ID NO: 800298 - RNA, 22 nt, Human
aaaaaaaggcuuuuucuggaaa

SEQ ID NO: 800299 - RNA, 22 nt, Human
aaaaagccauaagaaagcauca

SEQ ID NO: 800300 - RNA, 22 nt, Human
aaacagacaugauacaguagau

SEQ ID NO: 800301 - RNA, 21 nt, Human
aaaggcccuucaugcagccuu

SEQ ID NO: 800302 - RNA, 26 nt, Human
aaucaccaagucuuuuuaaggagaac

SEQ ID NO: 800303 - RNA, 22 nt, Human
acagcugaacaaaaaggauaaa

SEQ ID NO: 800304 - RNA, 22 nt, Human
accccgcgaccacagcccgcug

SEQ ID NO: 800305 - RNA, 22 nt, Human
accccgcugcaccaugggggag

SEQ ID NO: 800306 - RNA, 21 nt, Human
acccucuaauaauuuggccuc

SEQ ID NO: 800307 - RNA, 23 nt, Human
acugaaauaaaaagggugaccug

SEQ ID NO: 800308 - RNA, 22 nt, Human
acugucuacacauuuguccuca

SEQ ID NO: 800309 - RNA, 18 nt, Human
agcauguggaugcagcuc

SEQ ID NO: 800310 - RNA, 20 nt, Human
agcccgggggcccugggcgg

SEQ ID NO: 800311 - RNA, 19 nt, Human
agccggccagggggacagu

SEQ ID NO: 800312 - RNA, 21 nt, Human
agccuagguaacuugaggcuc

SEQ ID NO: 800313 - RNA, 18 nt, Human
aggaagaaccacauagga

SEQ ID NO: 800314 - RNA, 20 nt, Human
aguacagaguuuacuuagga

SEQ ID NO: 800315 - RNA, 23 nt, Human
aguauacaucgagguuggauaac

SEQ ID NO: 800316 - RNA, 27 nt, Human
agucagacucccagagggaaggaccug

SEQ ID NO: 800317 - RNA, 23 nt, Human
auaaaaacagacaugauacagua

SEQ ID NO: 800318 - RNA, 19 nt, Human
augaagacgagcugggcag

SEQ ID NO: 800319 - RNA, 20 nt, Human
augcagccuagguaacuuga

SEQ ID NO: 800320 - RNA, 18 nt, Human
auggagcuuugcuuccuc

SEQ ID NO: 800321 - RNA, 21 nt, Human
auucugcuuugcaucuuuccu

SEQ ID NO: 800322 - RNA, 25 nt, Human
caacuuccaagccaaaccuaacuuu

SEQ ID NO: 800323 - RNA, 23 nt, Human
cacauaggacaacauaugacauc

SEQ ID NO: 800324 - RNA, 21 nt, Human
cacauuuugcucagcauucca

SEQ ID NO: 800325 - RNA, 18 nt, Human
cacccaagcuugugcacc

SEQ ID NO: 800326 - RNA, 19 nt, Human
cagagccugcccuggugcu

SEQ ID NO: 800327 - RNA, 20 nt, Human
cagccaaaauauccagaaau

SEQ ID NO: 800328 - RNA, 18 nt, Human
cagcccgggggcccuggg

SEQ ID NO: 800329 - RNA, 22 nt, Human
cagcugccucuaguucuuuccc

SEQ ID NO: 800330 - RNA, 23 nt, Human
caugcagccuagguaacuugagg

SEQ ID NO: 800331 - RNA, 21 nt, Human
ccagagccugcccuggugcug

SEQ ID NO: 800332 - RNA, 26 nt, Human
ccagccaaauuaaaauaaaaagccau

SEQ ID NO: 800333 - RNA, 23 nt, Human
cccccaccccgcgaccacagccc

SEQ ID NO: 800334 - RNA, 23 nt, Human
cccccaccccgcgaccacagccc

SEQ ID NO: 800335 - RNA, 25 nt, Human
cccgcgaccacagcccgcugggggc

SEQ ID NO: 800336 - RNA, 22 nt, Human
cccugggcggcccgcgcagccc

SEQ ID NO: 800337 - RNA, 24 nt, Human
cgcgagacgccccuuggacgcccc

SEQ ID NO: 800338 - RNA, 22 nt, Human
cgcuccggccccgucucagccc

SEQ ID NO: 800339 - RNA, 20 nt, Human
cggccggggcgccgcuccgg

SEQ ID NO: 800340 - RNA, 20 nt, Human
cgguaaggggggccucgccg

SEQ ID NO: 800341 - RNA, 26 nt, Human
cugcuggguggaucccucuuacucac

SEQ ID NO: 800342 - RNA, 18 nt, Human
cugugcccaugacugcug

SEQ ID NO: 800343 - RNA, 18 nt, Human
cuuuaugguuucauaauu

SEQ ID NO: 800344 - RNA, 23 nt, Human
gaacuuguuucuccugugguuac

SEQ ID NO: 800345 - RNA, 22 nt, Human
gaaucuuauccaaauguuccuc

SEQ ID NO: 800346 - RNA, 23 nt, Human
gaccaagaaaagcccugaaagcc

SEQ ID NO: 800347 - RNA, 18 nt, Human
gagaccccgcgcgggcgg

SEQ ID NO: 800348 - RNA, 18 nt, Human
gauaaaaacagacaugau

SEQ ID NO: 800349 - RNA, 23 nt, Human
gcaauccuaaaggcccuucaugc

SEQ ID NO: 800350 - RNA, 18 nt, Human
gcccaugacugcugggug

SEQ ID NO: 800351 - RNA, 18 nt, Human
ggagaagagacugaugcu

SEQ ID NO: 800352 - RNA, 21 nt, Human
gggaagcaugucuuaucuaca

SEQ ID NO: 800353 - RNA, 21 nt, Human
ggggcgccgcuccggccccgu

SEQ ID NO: 800354 - RNA, 19 nt, Human
ggucuucuuuugggguuau

SEQ ID NO: 800355 - RNA, 23 nt, Human
guugguucuuagcaauccuaaag

SEQ ID NO: 800356 - RNA, 20 nt, Human
uaaaguagugauguuugggg

SEQ ID NO: 800357 - RNA, 20 nt, Human
uaaagugggacaucaucaga

SEQ ID NO: 800358 - RNA, 24 nt, Human
uaacaaaaauaggauucguuauca

SEQ ID NO: 800359 - RNA, 21 nt, Human
uaagaaacaucuuuaacuaga

SEQ ID NO: 800360 - RNA, 20 nt, Human
uaagaaagcaucaauauugg

SEQ ID NO: 800361 - RNA, 18 nt, Human
uacauccacauuuugcuc

SEQ ID NO: 800362 - RNA, 20 nt, Human
uacugugcccaugacugcug

SEQ ID NO: 800363 - RNA, 21 nt, Human
uagguacagccaaaauaucca

SEQ ID NO: 800364 - RNA, 22 nt, Human
uaucacuaauuguggacuacag

SEQ ID NO: 800365 - RNA, 18 nt, Human
uauggaaguuguuaacag

SEQ ID NO: 800366 - RNA, 23 nt, Human
ucaaacauucaauuguaaguaau

SEQ ID NO: 800367 - RNA, 20 nt, Human
ucaacauaugucauuuguuc

SEQ ID NO: 800368 - RNA, 24 nt, Human
ucaacuuccaagccaaaccuaacu

SEQ ID NO: 800369 - RNA, 22 nt, Human
ucacauaucugaacucucaaaa

SEQ ID NO: 800370 - RNA, 20 nt, Human
ucagccucuuuucugauagc

SEQ ID NO: 800371 - RNA, 19 nt, Human
ucaugaagacgagcugggc

SEQ ID NO: 800372 - RNA, 18 nt, Human
uccacauuuugcucagca

SEQ ID NO: 800373 - RNA, 22 nt, Human
ucuaccucuucguguaacacca

SEQ ID NO: 800374 - RNA, 18 nt, Human
ucuaguucuuucccuuug

SEQ ID NO: 800375 - RNA, 20 nt, Human
ucugcuuuuuuccaacugau

SEQ ID NO: 800376 - RNA, 20 nt, Human
ucuggagaagagacugaugc

SEQ ID NO: 800377 - RNA, 24 nt, Human
ucuggagaagagacugaugcuuua

SEQ ID NO: 800378 - RNA, 23 nt, Human
ucuguaaacaugcaacaugcuau

SEQ ID NO: 800379 - RNA, 19 nt, Human
ugaaaaaaaaaaaaaggcu

SEQ ID NO: 800380 - RNA, 21 nt, Human
ugagacucuucaaauauggaa

SEQ ID NO: 800381 - RNA, 24 nt, Human
ugagacucuucaaauauggaagca

SEQ ID NO: 800382 - RNA, 23 nt, Human
ugagaucaucaacuuccaagcca

SEQ ID NO: 800383 - RNA, 21 nt, Human
ugaguugugaccacauuguua

SEQ ID NO: 800384 - RNA, 19 nt, Human
ugcccuggugcugaccuga

SEQ ID NO: 800385 - RNA, 21 nt, Human
uggaagagauuucucaaccau

SEQ ID NO: 800386 - RNA, 25 nt, Human
uggacgccccucccggcugcgcucc

SEQ ID NO: 800387 - RNA, 22 nt, Human
uggacugugaaacugguuucau

SEQ ID NO: 800388 - RNA, 22 nt, Human
ugguacuaaauucuuaguauuu

SEQ ID NO: 800389 - RNA, 21 nt, Human
uuaaauaagaaaguuaguuaa

SEQ ID NO: 800390 - RNA, 26 nt, Human
uuaaauaagauccaguaaguacuguc

SEQ ID NO: 800391 - RNA, 20 nt, Human
uuaucaguguuuucuuaacu

SEQ ID NO: 800392 - RNA, 20 nt, Human
uucaaauauggaagcaaaau

SEQ ID NO: 800393 - RNA, 23 nt, Human
uucacauaucugaacucucaaag

SEQ ID NO: 800394 - RNA, 19 nt, Human
uucagaauaucugaaaaaa

SEQ ID NO: 800395 - RNA, 18 nt, Human
uuccaagccaaaccuaac

SEQ ID NO: 800396 - RNA, 22 nt, Human
uuccagucucuuuguuuuuguc

SEQ ID NO: 800397 - RNA, 23 nt, Human
uugaguuguuggguuaaagaguu

SEQ ID NO: 800398 - RNA, 20 nt, Human
uugaucucugggucuucuuu

SEQ ID NO: 800399 - RNA, 20 nt, Human
uugauggagcuuugcuuccu

SEQ ID NO: 800400 - RNA, 19 nt, Human
uugauuuuuuucucuggag

SEQ ID NO: 800401 - RNA, 23 nt, Human
uuggacugugaaacugguuucau

SEQ ID NO: 800402 - RNA, 22 nt, Human
uuguccucauuugcugggcaua

SEQ ID NO: 800403 - RNA, 19 nt, Human
uuuaaggaaagaccaagaa

SEQ ID NO: 800404 - RNA, 20 nt, Human
uuuugcucuauuugaauagu

SEQ ID NO: 800405 - RNA, 22 nt, Human
uuuugcugcuuuuuugggcugg

SEQ ID NO: 800406 - RNA, 24 nt, Human
uuuuuccuucccaucugggaucug

SEQ ID NO: 800407 - RNA, 22 nt, Human
aaaaaaacaacgucaucauuaa

SEQ ID NO: 800408 - RNA, 22 nt, Human
aaaagagcaaauacuuaccaua

SEQ ID NO: 800409 - RNA, 21 nt, Human
aaacaaauuugaguacagcua

SEQ ID NO: 800410 - RNA, 21 nt, Human
aaagaugagcugaauguggug

SEQ ID NO: 800411 - RNA, 21 nt, Human
aaccagagccuucuggacuuu

SEQ ID NO: 800412 - RNA, 19 nt, Human
aagaucugacaugccuuuc

SEQ ID NO: 800413 - RNA, 21 nt, Human
aagcaacaaucuguuucagca

SEQ ID NO: 800414 - RNA, 20 nt, Human
aauaaacaggccauguuucu

SEQ ID NO: 800415 - RNA, 24 nt, Human
aaugucaaagaaaugaaaaaaagg

SEQ ID NO: 800416 - RNA, 18 nt, Human
acaaaagcaaagaagagu

SEQ ID NO: 800417 - RNA, 20 nt, Human
acacaaccaagacugacacu

SEQ ID NO: 800418 - RNA, 21 nt, Human
accacaacaaaagcaaagaag

SEQ ID NO: 800419 - RNA, 25 nt, Human
accacaacaaaagcaaagaagaguc

SEQ ID NO: 800420 - RNA, 28 nt, Human
accagagccuucuggacuuuggggccaa

SEQ ID NO: 800421 - RNA, 19 nt, Human
accauacaaaauaaacagc

SEQ ID NO: 800422 - RNA, 20 nt, Human
accuuuuuuuuuuuuuguga

SEQ ID NO: 800423 - RNA, 21 nt, Human
acugcaguucuuucaggccuu

SEQ ID NO: 800424 - RNA, 24 nt, Human
agaugagcugaauguggugagcca

SEQ ID NO: 800425 - RNA, 18 nt, Human
agcaaauuaccacauacu

SEQ ID NO: 800426 - RNA, 20 nt, Human
agcacaguuuggaaaauaaa

SEQ ID NO: 800427 - RNA, 20 nt, Human
agggagaugauaggauguuc

SEQ ID NO: 800428 - RNA, 24 nt, Human
auaaacaggccauguuucugucaa

SEQ ID NO: 800429 - RNA, 24 nt, Human
caaaaaaagcaccaauuucaaaag

SEQ ID NO: 800430 - RNA, 22 nt, Human
caaaagcaaagaagaguccuac

SEQ ID NO: 800431 - RNA, 24 nt, Human
caaaauaaacagcaaauacacccc

SEQ ID NO: 800432 - RNA, 24 nt, Human
caacaaaagcaaagaagaguccua

SEQ ID NO: 800433 - RNA, 25 nt, Human
caaccaagacugacacugacaguaa

SEQ ID NO: 800434 - RNA, 20 nt, Human
cacaacaaaagcaaagaaga

SEQ ID NO: 800435 - RNA, 23 nt, Human
cacaacaaaagcaaagaagaguc

SEQ ID NO: 800436 - RNA, 20 nt, Human
cauaaauaccuuagauccau

SEQ ID NO: 800437 - RNA, 22 nt, Human
ccaauuucaaaaggucugcuag

SEQ ID NO: 800438 - RNA, 21 nt, Human
ccagagccuucuggacuuugg

SEQ ID NO: 800439 - RNA, 22 nt, Human
ccagcacaguuuggaaaauaaa

SEQ ID NO: 800440 - RNA, 21 nt, Human
ccaguguuggaaaugucuccu

SEQ ID NO: 800441 - RNA, 19 nt, Human
ccauagagaaggauugugc

SEQ ID NO: 800442 - RNA, 22 nt, Human
cccugucucuguggugcucuuc

SEQ ID NO: 800443 - RNA, 24 nt, Human
ccuacauaaauaagaacaaaguuu

SEQ ID NO: 800444 - RNA, 21 nt, Human
ccuucguccccaaccccuguc

SEQ ID NO: 800445 - RNA, 21 nt, Human
ccuugcuucaucacgcucuuu

SEQ ID NO: 800446 - RNA, 18 nt, Human
cgucaugucuucuccucu

SEQ ID NO: 800447 - RNA, 23 nt, Human
cuccuuggcuuuuuguuuaaaca

SEQ ID NO: 800448 - RNA, 18 nt, Human
cuuccuggcuuuuugucc

SEQ ID NO: 800449 - RNA, 21 nt, Human
cuuccuggcuuuuuguccuuc

SEQ ID NO: 800450 - RNA, 23 nt, Human
gcuuuuuguccuucguccccaac

SEQ ID NO: 800451 - RNA, 22 nt, Human
ggagcaaauuaccacauacuug

SEQ ID NO: 800452 - RNA, 18 nt, Human
ggaguaggccugccugca

SEQ ID NO: 800453 - RNA, 25 nt, Human
uaaaaugucaaagaaaugaaaaaaa

SEQ ID NO: 800454 - RNA, 23 nt, Human
uaaaggugaauucaacaaaauca

SEQ ID NO: 800455 - RNA, 23 nt, Human
uaaguacgaagcaacaaucuguu

SEQ ID NO: 800456 - RNA, 24 nt, Human
uaaguacgaagcaacaaucuguuu

SEQ ID NO: 800457 - RNA, 23 nt, Human
uaauaggagcaaauuaccacaua

SEQ ID NO: 800458 - RNA, 18 nt, Human
uagaauuuucaggauauc

SEQ ID NO: 800459 - RNA, 19 nt, Human
uaggauguuccugacgcaa

SEQ ID NO: 800460 - RNA, 26 nt, Human
uauaguaaaaugucaaagaaaugaaa

SEQ ID NO: 800461 - RNA, 18 nt, Human
ucaggagaaccaaaacug

SEQ ID NO: 800462 - RNA, 27 nt, Human
uccauucuuucuagaaaugugagauuc

SEQ ID NO: 800463 - RNA, 19 nt, Human
uccccaaccccugucucug

SEQ ID NO: 800464 - RNA, 18 nt, Human
uccuucguccccaacccc

SEQ ID NO: 800465 - RNA, 24 nt, Human
uccuucguccccaaccccugucuc

SEQ ID NO: 800466 - RNA, 19 nt, Human
ucucaaagaaaccuugguu

SEQ ID NO: 800467 - RNA, 22 nt, Human
ugaaaggagcuggaguuuagug

SEQ ID NO: 800468 - RNA, 20 nt, Human
ugaccacaacaaaagcaaag

SEQ ID NO: 800469 - RNA, 24 nt, Human
ugaccacaacaaaagcaaagaaga

SEQ ID NO: 800470 - RNA, 25 nt, Human
ugagaugucacuugauguugaucaa

SEQ ID NO: 800471 - RNA, 18 nt, Human
ugagauucaaaaaaagca

SEQ ID NO: 800472 - RNA, 18 nt, Human
ugcuagcacacucuuccg

SEQ ID NO: 800473 - RNA, 18 nt, Human
uggcaauaaauaguugga

SEQ ID NO: 800474 - RNA, 24 nt, Human
ugucaaagaaaugaaaaaaaggga

SEQ ID NO: 800475 - RNA, 20 nt, Human
uguccuucguccccaacccc

SEQ ID NO: 800476 - RNA, 23 nt, Human
uuccgcacaucuuagggcggcuc

SEQ ID NO: 800477 - RNA, 24 nt, Human
uuccgcacaucuuagggcggcucu

SEQ ID NO: 800478 - RNA, 22 nt, Human
uuggggccagauucucuggaaa

SEQ ID NO: 800479 - RNA, 22 nt, Human
uuguaccuucacaaugacucuc

SEQ ID NO: 800480 - RNA, 24 nt, Human
uuguucuuccuggcuuuuuguccu

SEQ ID NO: 800481 - RNA, 24 nt, Human
uuuauaaagugcuuaugagauuac

SEQ ID NO: 800482 - RNA, 21 nt, Human
aaacagccuccuguggaaaau

SEQ ID NO: 800483 - RNA, 24 nt, Human
aaauacaaaaguuagcaaaaagcu

SEQ ID NO: 800484 - RNA, 18 nt, Human
aaaugcugucuucucagg

SEQ ID NO: 800485 - RNA, 19 nt, Human
aagaaagacuuugaagagg

SEQ ID NO: 800486 - RNA, 26 nt, Human
aauacaaaaguuagcaaaaagcugaa

SEQ ID NO: 800487 - RNA, 21 nt, Human
agaaaggaccgucucuuaaaa

SEQ ID NO: 800488 - RNA, 20 nt, Human
agcaugaucuucaauucuga

SEQ ID NO: 800489 - RNA, 24 nt, Human
aucacaguuccuccuccguucgca

SEQ ID NO: 800490 - RNA, 22 nt, Human
caucguuuugccaccguacaga

SEQ ID NO: 800491 - RNA, 24 nt, Human
ccuggagaggucaccguuguuuca

SEQ ID NO: 800492 - RNA, 23 nt, Human
gaggauagaguguguaagaaaga

SEQ ID NO: 800493 - RNA, 19 nt, Human
uacaaaguacaauaaacag

SEQ ID NO: 800494 - RNA, 19 nt, Human
uauccagaaaggaccgucu

SEQ ID NO: 800495 - RNA, 21 nt, Human
ucguuuugccaccguacagaa

SEQ ID NO: 800496 - RNA, 25 nt, Human
ucucuuaaauccaccaggggaggaa

SEQ ID NO: 800497 - RNA, 19 nt, Human
uguuucauuucucuguauc

SEQ ID NO: 800498 - RNA, 24 nt, Human
uuuacaauuaugucauagguuacu

SEQ ID NO: 800499 - RNA, 19 nt, Human
aaaacaaacaggcaauucc

SEQ ID NO: 800500 - RNA, 19 nt, Human
aaacaaacaggcaauuccc

SEQ ID NO: 800501 - RNA, 21 nt, Human
aaacaaacaggcaauucccau

SEQ ID NO: 800502 - RNA, 23 nt, Human
aaacaaacaggcaauucccauac

SEQ ID NO: 800503 - RNA, 24 nt, Human
aaagugcugagaauacaggcauga

SEQ ID NO: 800504 - RNA, 20 nt, Human
aagcacuggaauuacaagau

SEQ ID NO: 800505 - RNA, 21 nt, Human
aagcacuggaauuacaagaua

SEQ ID NO: 800506 - RNA, 24 nt, Human
aagugauccaccugcacuggccuc

SEQ ID NO: 800507 - RNA, 25 nt, Human
aagugauucucccaccucagccucc

SEQ ID NO: 800508 - RNA, 24 nt, Human
aauaagaaugaaaaauauguacaa

SEQ ID NO: 800509 - RNA, 25 nt, Human
aauacauaaugaaauaauuacacaa

SEQ ID NO: 800510 - RNA, 21 nt, Human
acagagucauacauacaauga

SEQ ID NO: 800511 - RNA, 22 nt, Human
accauauuggccaggcuggucu

SEQ ID NO: 800512 - RNA, 23 nt, Human
accucagccucccgaguagcuga

SEQ ID NO: 800513 - RNA, 18 nt, Human
acuacagugcucuuuugc

SEQ ID NO: 800514 - RNA, 19 nt, Human
acucuguugcucaggcugg

SEQ ID NO: 800515 - RNA, 25 nt, Human
acucuguugcucaggcuggagugca

SEQ ID NO: 800516 - RNA, 23 nt, Human
acuuugcacguguucaaaaacca

SEQ ID NO: 800517 - RNA, 21 nt, Human
agaagcuauagagcagcaguc

SEQ ID NO: 800518 - RNA, 22 nt, Human
agaauacaggcaugagccacug

SEQ ID NO: 800519 - RNA, 24 nt, Human
agaauacaggcaugagccacugca

SEQ ID NO: 800520 - RNA, 18 nt, Human
agacuacaggcaugcacc

SEQ ID NO: 800521 - RNA, 21 nt, Human
agccagacagcacauauucuu

SEQ ID NO: 800522 - RNA, 20 nt, Human
aggcaugcaccaccacaccc

SEQ ID NO: 800523 - RNA, 25 nt, Human
aggcuggagugcaguggcacgaucu

SEQ ID NO: 800524 - RNA, 24 nt, Human
agucacucuguugcucaggcugga

SEQ ID NO: 800525 - RNA, 20 nt, Human
agugcaguggcacgaucuug

SEQ ID NO: 800526 - RNA, 23 nt, Human
agugcaguggcacgaucuuggcu

SEQ ID NO: 800527 - RNA, 24 nt, Human
agugcaguggcacgaucuuggcuc

SEQ ID NO: 800528 - RNA, 23 nt, Human
auauuggccaggcuggucuugaa

SEQ ID NO: 800529 - RNA, 24 nt, Human
auggcuuugcugaucugacaggag

SEQ ID NO: 800530 - RNA, 18 nt, Human
auucucccaccucagccu

SEQ ID NO: 800531 - RNA, 19 nt, Human
caaaaaccaaagccuuuuc

SEQ ID NO: 800532 - RNA, 24 nt, Human
caaagugcugagaauacaggcaug

SEQ ID NO: 800533 - RNA, 19 nt, Human
caaauucuuagcaaucaca

SEQ ID NO: 800534 - RNA, 19 nt, Human
caagugauccaccugcacu

SEQ ID NO: 800535 - RNA, 20 nt, Human
caagugauucucccaccuca

SEQ ID NO: 800536 - RNA, 22 nt, Human
caagugauucucccaccucagc

SEQ ID NO: 800537 - RNA, 23 nt, Human
caaugacaagcauaagacagcac

SEQ ID NO: 800538 - RNA, 24 nt, Human
caccacacccagcuaauuuuugua

SEQ ID NO: 800539 - RNA, 21 nt, Human
caccauauuggccaggcuggu

SEQ ID NO: 800540 - RNA, 24 nt, Human
caccauauuggccaggcuggucuu

SEQ ID NO: 800541 - RNA, 27 nt, Human
caccauauuggccaggcuggucuugaa

SEQ ID NO: 800542 - RNA, 23 nt, Human
caccugcacuggccucccaaagu

SEQ ID NO: 800543 - RNA, 24 nt, Human
cacucuguugcucaggcuggagug

SEQ ID NO: 800544 - RNA, 23 nt, Human
cacugaaaccucugccucccggg

SEQ ID NO: 800545 - RNA, 22 nt, Human
cacuggaauuacaagauaaaga

SEQ ID NO: 800546 - RNA, 18 nt, Human
cagaagcuauagagcagc

SEQ ID NO: 800547 - RNA, 18 nt, Human
cagacagcacauauucuu

SEQ ID NO: 800548 - RNA, 19 nt, Human
cagcuggaggugaagacga

SEQ ID NO: 800549 - RNA, 24 nt, Human
caggauuucaccauauuggccagg

SEQ ID NO: 800550 - RNA, 19 nt, Human
caguggcacgaucuuggcu

SEQ ID NO: 800551 - RNA, 24 nt, Human
cauauuggccaggcuggucuugaa

SEQ ID NO: 800552 - RNA, 23 nt, Human
caugcaccaccacacccagcuaa

SEQ ID NO: 800553 - RNA, 24 nt, Human
ccaaagugcugagaauacaggcau

SEQ ID NO: 800554 - RNA, 22 nt, Human
ccaccugcacuggccucccaaa

SEQ ID NO: 800555 - RNA, 19 nt, Human
ccacucaccuccugcugug

SEQ ID NO: 800556 - RNA, 19 nt, Human
ccauacagagucauacaua

SEQ ID NO: 800557 - RNA, 23 nt, Human
cccaccucagccucccgaguagc

SEQ ID NO: 800558 - RNA, 24 nt, Human
cccaccucagccucccgaguagcu

SEQ ID NO: 800559 - RNA, 24 nt, Human
cccgaguagcugagacuacaggca

SEQ ID NO: 800560 - RNA, 22 nt, Human
cccggguucaagugauucuccc

SEQ ID NO: 800561 - RNA, 21 nt, Human
ccucccggguucaagugauuc

SEQ ID NO: 800562 - RNA, 24 nt, Human
ccucccggguucaagugauucucc

SEQ ID NO: 800563 - RNA, 19 nt, Human
ccuccugcugugcagccug

SEQ ID NO: 800564 - RNA, 21 nt, Human
ccugaccucaagugauccacc

SEQ ID NO: 800565 - RNA, 23 nt, Human
ccugaccucaagugauccaccug

SEQ ID NO: 800566 - RNA, 26 nt, Human
ccugaccucaagugauccaccugcac

SEQ ID NO: 800567 - RNA, 18 nt, Human
cgucagcauguauucuuu

SEQ ID NO: 800568 - RNA, 23 nt, Human
cuaauuuuuguauuuuuaguaga

SEQ ID NO: 800569 - RNA, 23 nt, Human
cuagcucucaaacaccugcagca

SEQ ID NO: 800570 - RNA, 22 nt, Human
cucaagccgcucaauuugguca

SEQ ID NO: 800571 - RNA, 18 nt, Human
cucaagugauccaccugc

SEQ ID NO: 800572 - RNA, 22 nt, Human
cucacugaaaccucugccuccc

SEQ ID NO: 800573 - RNA, 24 nt, Human
cucacugaaaccucugccucccgg

SEQ ID NO: 800574 - RNA, 23 nt, Human
cucaucaucacauguucuacuuc

SEQ ID NO: 800575 - RNA, 20 nt, Human
cugaaaaaacaaacaggcaa

SEQ ID NO: 800576 - RNA, 21 nt, Human
cugcacuggccucccaaagug

SEQ ID NO: 800577 - RNA, 27 nt, Human
cugcagccagacagcacagcgcgaguc

SEQ ID NO: 800578 - RNA, 23 nt, Human
cugccucccggguucaagugauu

SEQ ID NO: 800579 - RNA, 21 nt, Human
cuguguguggccugggaguug

SEQ ID NO: 800580 - RNA, 18 nt, Human
gaaaaaacaaacaggcaa

SEQ ID NO: 800581 - RNA, 22 nt, Human
gaauacaggcaugagccacugc

SEQ ID NO: 800582 - RNA, 23 nt, Human
gaccucaagugauccaccugcac

SEQ ID NO: 800583 - RNA, 23 nt, Human
gagcuuguuuuucuguaacuaga

SEQ ID NO: 800584 - RNA, 24 nt, Human
gagcuuguuuuucuguaacuagau

SEQ ID NO: 800585 - RNA, 21 nt, Human
gaggugaagacgaucacugug

SEQ ID NO: 800586 - RNA, 24 nt, Human
gaguagcugagacuacaggcaugc

SEQ ID NO: 800587 - RNA, 20 nt, Human
gauaaugugagcaacaggga

SEQ ID NO: 800588 - RNA, 21 nt, Human
gauucucccaccucagccucc

SEQ ID NO: 800589 - RNA, 19 nt, Human
gcagccugcuuccuaacag

SEQ ID NO: 800590 - RNA, 21 nt, Human
gcucacugaaaccucugccuc

SEQ ID NO: 800591 - RNA, 23 nt, Human
gcuggucuugaacuccugaccuc

SEQ ID NO: 800592 - RNA, 21 nt, Human
gcuuguuuuucuguaacuaga

SEQ ID NO: 800593 - RNA, 24 nt, Human
ggcuggucuugaacuccugaccuc

SEQ ID NO: 800594 - RNA, 18 nt, Human
gggaguccugagcuuguu

SEQ ID NO: 800595 - RNA, 24 nt, Human
gggaugguuucaggauggugauuc

SEQ ID NO: 800596 - RNA, 18 nt, Human
gguccgccccucaacaac

SEQ ID NO: 800597 - RNA, 19 nt, Human
ggucuugaacuccugaccu

SEQ ID NO: 800598 - RNA, 24 nt, Human
gugauccaccugcacuggccuccc

SEQ ID NO: 800599 - RNA, 24 nt, Human
gugauucucccaccucagccuccc

SEQ ID NO: 800600 - RNA, 24 nt, Human
uaaggagcaugugaccuagauccc

SEQ ID NO: 800601 - RNA, 24 nt, Human
uaauuuuuguauuuuuaguagaga

SEQ ID NO: 800602 - RNA, 21 nt, Human
uacaaugacaagcauaagaca

SEQ ID NO: 800603 - RNA, 22 nt, Human
uacaaugacaagcauaagacag

SEQ ID NO: 800604 - RNA, 24 nt, Human
uacaggcaugagccacugcagcca

SEQ ID NO: 800605 - RNA, 24 nt, Human
uacaggcaugcaccaccacaccca

SEQ ID NO: 800606 - RNA, 21 nt, Human
uacucucagcuuuagaaaguu

SEQ ID NO: 800607 - RNA, 20 nt, Human
uagagacaggauuucaccau

SEQ ID NO: 800608 - RNA, 21 nt, Human
uagauggucccaucgugaaga

SEQ ID NO: 800609 - RNA, 22 nt, Human
uaggagacaaugacauaucauc

SEQ ID NO: 800610 - RNA, 26 nt, Human
uaguagagacaggauuucaccauauu

SEQ ID NO: 800611 - RNA, 22 nt, Human
ucacucuguugcucaggcugga

SEQ ID NO: 800612 - RNA, 24 nt, Human
ucacucuguugcucaggcuggagu

SEQ ID NO: 800613 - RNA, 24 nt, Human
ucacugaaaccucugccucccggg

SEQ ID NO: 800614 - RNA, 25 nt, Human
ucacugaaaccucugccucccgggu

SEQ ID NO: 800615 - RNA, 24 nt, Human
ucccaaagugcugagaauacaggc

SEQ ID NO: 800616 - RNA, 24 nt, Human
ucccgaguagcugagacuacaggc

SEQ ID NO: 800617 - RNA, 21 nt, Human
ucccggguucaagugauucuc

SEQ ID NO: 800618 - RNA, 23 nt, Human
ucccggguucaagugauucuccc

SEQ ID NO: 800619 - RNA, 24 nt, Human
ucccuugaacgagcaguucacagu

SEQ ID NO: 800620 - RNA, 18 nt, Human
uccugcugugcagccugc

SEQ ID NO: 800621 - RNA, 27 nt, Human
uccugugagaaucuaauggcuuugcug

SEQ ID NO: 800622 - RNA, 28 nt, Human
ucuaauggcuuugcugauccucgacaga

SEQ ID NO: 800623 - RNA, 23 nt, Human
ucucaaacaccugcagcaucaaa

SEQ ID NO: 800624 - RNA, 24 nt, Human
ucucccaccucagccucccgagua

SEQ ID NO: 800625 - RNA, 26 nt, Human
ucugaaggggaaggaaaacacaugua

SEQ ID NO: 800626 - RNA, 18 nt, Human
ucugacaggaggcagagc

SEQ ID NO: 800627 - RNA, 24 nt, Human
ucuguugcucaggcuggagugcag

SEQ ID NO: 800628 - RNA, 21 nt, Human
ucuugaacuccugaccucaag

SEQ ID NO: 800629 - RNA, 18 nt, Human
ugaaaaaacaaacaggca

SEQ ID NO: 800630 - RNA, 21 nt, Human
ugacaggaggcagagcucagg

SEQ ID NO: 800631 - RNA, 19 nt, Human
ugaccucaagugauccacc

SEQ ID NO: 800632 - RNA, 20 nt, Human
ugaccucaagugauccaccu

SEQ ID NO: 800633 - RNA, 22 nt, Human
ugagaauacaggcaugagccac

SEQ ID NO: 800634 - RNA, 24 nt, Human
ugagaauacaggcaugagccacug

SEQ ID NO: 800635 - RNA, 26 nt, Human
ugagaauacaggcaugagccacugca

SEQ ID NO: 800636 - RNA, 21 nt, Human
ugagacuacaggcaugcacca

SEQ ID NO: 800637 - RNA, 24 nt, Human
ugagacuacaggcaugcaccacca

SEQ ID NO: 800638 - RNA, 19 nt, Human
ugagauggagucacucugu

SEQ ID NO: 800639 - RNA, 20 nt, Human
ugcacuggccucccaaaguu

SEQ ID NO: 800640 - RNA, 22 nt, Human
ugcaguggcacgaucuuggcuc

SEQ ID NO: 800641 - RNA, 23 nt, Human
ugccugccacucaccuccugcug

SEQ ID NO: 800642 - RNA, 20 nt, Human
ugcucaggcuggagugcagu

SEQ ID NO: 800643 - RNA, 21 nt, Human
ugcucaggcuggagugcagug

SEQ ID NO: 800644 - RNA, 22 nt, Human
ugcucaggcuggagugcagugg

SEQ ID NO: 800645 - RNA, 24 nt, Human
ugcucaggcuggagugcaguggca

SEQ ID NO: 800646 - RNA, 23 nt, Human
uggagugcaguggcacgaucuug

SEQ ID NO: 800647 - RNA, 24 nt, Human
uggagugcaguggcacgaucuugg

SEQ ID NO: 800648 - RNA, 25 nt, Human
uggcaccaggcagcaguuuugugaa

SEQ ID NO: 800649 - RNA, 24 nt, Human
uggccaggcuggucuugaacuccu

SEQ ID NO: 800650 - RNA, 19 nt, Human
uggcucacugaaaccucug

SEQ ID NO: 800651 - RNA, 20 nt, Human
uggcuucacaaagacauacu

SEQ ID NO: 800652 - RNA, 21 nt, Human
ugggggaugguuucaggaugg

SEQ ID NO: 800653 - RNA, 23 nt, Human
uguaauggagcucaguuuugagg

SEQ ID NO: 800654 - RNA, 21 nt, Human
uguauucagcaaccaugugcu

SEQ ID NO: 800655 - RNA, 21 nt, Human
ugugagcaacagggaguggcu

SEQ ID NO: 800656 - RNA, 23 nt, Human
uguguaauggagcucaguuuuga

SEQ ID NO: 800657 - RNA, 24 nt, Human
uuaguagagacaggauuucaccau

SEQ ID NO: 800658 - RNA, 21 nt, Human
uucaaaaaccaaagccuuuuc

SEQ ID NO: 800659 - RNA, 23 nt, Human
uucaagugauucucccaccucag

SEQ ID NO: 800660 - RNA, 24 nt, Human
uucaagugauucucccaccucagc

SEQ ID NO: 800661 - RNA, 23 nt, Human
uucacaaagacauacuaauuauc

SEQ ID NO: 800662 - RNA, 22 nt, Human
uugcacaccgaauucauuauca

SEQ ID NO: 800663 - RNA, 24 nt, Human
uugcucaggcuggagugcaguggc

SEQ ID NO: 800664 - RNA, 24 nt, Human
uuucaccauauuggccaggcuggu

SEQ ID NO: 800665 - RNA, 21 nt, Human
uuugcccauaguugcacaccg

SEQ ID NO: 800666 - RNA, 24 nt, Human
uuugugaaagauaauuuuuccaca

SEQ ID NO: 800667 - RNA, 22 nt, Human
uuuuguauuuuuaguagagaca

SEQ ID NO: 800668 - RNA, 24 nt, Human
uuuuuccacagauggggguuuggg

SEQ ID NO: 800669 - RNA, 20 nt, Human
uuuuuguauuuuuaguagag

SEQ ID NO: 800670 - RNA, 20 nt, Human
aaccccagccucuccuugca

SEQ ID NO: 800671 - RNA, 22 nt, Human
aagcugaccucuuguuggcccc

SEQ ID NO: 800672 - RNA, 19 nt, Human
aaggauggugaggggugag

SEQ ID NO: 800673 - RNA, 21 nt, Human
aaggauggugaggggugaggg

SEQ ID NO: 800674 - RNA, 20 nt, Human
acagugcacaguccuccaag

SEQ ID NO: 800675 - RNA, 28 nt, Human
acauaauauuuccuccauuauauacucu

SEQ ID NO: 800676 - RNA, 22 nt, Human
acgccgugcagaagccacaggc

SEQ ID NO: 800677 - RNA, 20 nt, Human
acucuccccccgacagaagc

SEQ ID NO: 800678 - RNA, 22 nt, Human
agaagccguuucuaugcauaug

SEQ ID NO: 800679 - RNA, 20 nt, Human
agacgaacaggcgguggaug

SEQ ID NO: 800680 - RNA, 18 nt, Human
agcagugggugcacacuc

SEQ ID NO: 800681 - RNA, 19 nt, Human
agcccggagcgccgagcgg

SEQ ID NO: 800682 - RNA, 26 nt, Human
aggaauugggccaggguuccagaggg

SEQ ID NO: 800683 - RNA, 24 nt, Human
aggacagaggcucuggaugcucug

SEQ ID NO: 800684 - RNA, 18 nt, Human
aggcaggcacuugucgga

SEQ ID NO: 800685 - RNA, 20 nt, Human
aggcaucuucugaggguggg

SEQ ID NO: 800686 - RNA, 19 nt, Human
aggcuugguggccaugacc

SEQ ID NO: 800687 - RNA, 23 nt, Human
agggaccagugggagggcccagg

SEQ ID NO: 800688 - RNA, 22 nt, Human
aggggugaggggugagggcugg

SEQ ID NO: 800689 - RNA, 25 nt, Human
augaccucaaacaguguuuuaagaa

SEQ ID NO: 800690 - RNA, 20 nt, Human
caaggccccgagcaaccucu

SEQ ID NO: 800691 - RNA, 22 nt, Human
cacaguccuccaaggccgcacu

SEQ ID NO: 800692 - RNA, 22 nt, Human
caccaggcuccuccgggucccc

SEQ ID NO: 800693 - RNA, 25 nt, Human
cacccugccugccuagaggaccacu

SEQ ID NO: 800694 - RNA, 22 nt, Human
caccgcaacagcagaggcgcag

SEQ ID NO: 800695 - RNA, 21 nt, Human
caccugcccguagcggggcag

SEQ ID NO: 800696 - RNA, 19 nt, Human
cacugacacccagcgcucc

SEQ ID NO: 800697 - RNA, 20 nt, Human
cagcaugcguggcugcuggg

SEQ ID NO: 800698 - RNA, 19 nt, Human
cagcgcgagcagaagaucu

SEQ ID NO: 800699 - RNA, 19 nt, Human
cagcuguggagcugcugga

SEQ ID NO: 800700 - RNA, 22 nt, Human
caguguuuuaagaauacuucuc

SEQ ID NO: 800701 - RNA, 25 nt, Human
ccaccuccaucacccgccccgauuc

SEQ ID NO: 800702 - RNA, 22 nt, Human
ccacugggucagcuucccgcau

SEQ ID NO: 800703 - RNA, 20 nt, Human
ccagagggugcagagggaag

SEQ ID NO: 800704 - RNA, 18 nt, Human
ccaggagcacccugccug

SEQ ID NO: 800705 - RNA, 22 nt, Human
ccaggcuccuccggguccccug

SEQ ID NO: 800706 - RNA, 19 nt, Human
ccaucgcgggucuuggcug

SEQ ID NO: 800707 - RNA, 21 nt, Human
cccaaggccccgagcaaccuc

SEQ ID NO: 800708 - RNA, 22 nt, Human
cccacagcugcggcaguggugc

SEQ ID NO: 800709 - RNA, 21 nt, Human
cccagcaugcagcucucuggc

SEQ ID NO: 800710 - RNA, 23 nt, Human
cccauagccccagcagaucuccg

SEQ ID NO: 800711 - RNA, 18 nt, Human
ccccagcagaucuccgag

SEQ ID NO: 800712 - RNA, 24 nt, Human
ccccugcagcagcggcagcggccu

SEQ ID NO: 800713 - RNA, 20 nt, Human
cccgagcaaccucugccugc

SEQ ID NO: 800714 - RNA, 19 nt, Human
cccggguggguuggggcug

SEQ ID NO: 800715 - RNA, 21 nt, Human
cccguagcggggcagcggugc

SEQ ID NO: 800716 - RNA, 22 nt, Human
ccgcaacagcagaggcgcagag

SEQ ID NO: 800717 - RNA, 19 nt, Human
ccgcaucuccccacuccaa

SEQ ID NO: 800718 - RNA, 20 nt, Human
ccgggcggcccucgcccucc

SEQ ID NO: 800719 - RNA, 20 nt, Human
ccuccaucacccgccccgag

SEQ ID NO: 800720 - RNA, 22 nt, Human
ccugaggcgccucgugagccgg

SEQ ID NO: 800721 - RNA, 26 nt, Human
ccugcaaccccagccucuccuugcag

SEQ ID NO: 800722 - RNA, 19 nt, Human
ccugcagcguggccccacc

SEQ ID NO: 800723 - RNA, 22 nt, Human
ccuggggguuccuggcccgggu

SEQ ID NO: 800724 - RNA, 20 nt, Human
cgacccaaggccccgagcaa

SEQ ID NO: 800725 - RNA, 22 nt, Human
cgacccaaggccccgagcaacc

SEQ ID NO: 800726 - RNA, 24 nt, Human
cgacccaaggccccgagcaaccuc

SEQ ID NO: 800727 - RNA, 21 nt, Human
cgagcagaagaucuucccaca

SEQ ID NO: 800728 - RNA, 27 nt, Human
cgagcgggcggcgggcaggugcgcggg

SEQ ID NO: 800729 - RNA, 22 nt, Human
cgccucuggccccaucuugucu

SEQ ID NO: 800730 - RNA, 24 nt, Human
cgcgagcagaagaucuucccacag

SEQ ID NO: 800731 - RNA, 21 nt, Human
cgcucgggcgcacggacagac

SEQ ID NO: 800732 - RNA, 19 nt, Human
cgggcggcccucgcccucc

SEQ ID NO: 800733 - RNA, 18 nt, Human
cuaugcauauguacucca

SEQ ID NO: 800734 - RNA, 20 nt, Human
cuaugcauauguacuccacc

SEQ ID NO: 800735 - RNA, 19 nt, Human
cuccaaaaauaaaacugca

SEQ ID NO: 800736 - RNA, 21 nt, Human
cuccugcugaccugcaacccc

SEQ ID NO: 800737 - RNA, 25 nt, Human
cugaggagcaggacccagcugugga

SEQ ID NO: 800738 - RNA, 20 nt, Human
cugauggggagaauggguag

SEQ ID NO: 800739 - RNA, 22 nt, Human
cugcuggggccgccucuggccc

SEQ ID NO: 800740 - RNA, 20 nt, Human
gaagugguagcugagcuggu

SEQ ID NO: 800741 - RNA, 22 nt, Human
gagaauggguagccugcauuug

SEQ ID NO: 800742 - RNA, 20 nt, Human
gagcccugcugugccaaaga

SEQ ID NO: 800743 - RNA, 18 nt, Human
gagccggggggcucccag

SEQ ID NO: 800744 - RNA, 18 nt, Human
gcagcagcggcagcggcc

SEQ ID NO: 800745 - RNA, 23 nt, Human
gcagcuggucagccacaccugaa

SEQ ID NO: 800746 - RNA, 18 nt, Human
gcccggcugaggcgcggg

SEQ ID NO: 800747 - RNA, 19 nt, Human
gcccggcugaggcgcgggg

SEQ ID NO: 800748 - RNA, 21 nt, Human
gccugcagcguggccccaccu

SEQ ID NO: 800749 - RNA, 21 nt, Human
gcgaagcccggagcgccgagc

SEQ ID NO: 800750 - RNA, 23 nt, Human
gcgcggcccugaguaugcucugc

SEQ ID NO: 800751 - RNA, 19 nt, Human
gcgcggggcggacgcggag

SEQ ID NO: 800752 - RNA, 24 nt, Human
gcggaggcacggccggagcccccg

SEQ ID NO: 800753 - RNA, 21 nt, Human
gcgugggcaggacagaggcuc

SEQ ID NO: 800754 - RNA, 20 nt, Human
gcugaccugcaaccccagcc

SEQ ID NO: 800755 - RNA, 22 nt, Human
gcugaccugcaaccccagccuc

SEQ ID NO: 800756 - RNA, 18 nt, Human
ggacccccaugccaucag

SEQ ID NO: 800757 - RNA, 24 nt, Human
ggccaugaccucaaacaguguuuu

SEQ ID NO: 800758 - RNA, 21 nt, Human
ggcccggguggguuggggcug

SEQ ID NO: 800759 - RNA, 20 nt, Human
ggcuuugggcucccgcccgu

SEQ ID NO: 800760 - RNA, 21 nt, Human
gggaagugguagcugagcugg

SEQ ID NO: 800761 - RNA, 23 nt, Human
gggcagcggugcugagugcgagg

SEQ ID NO: 800762 - RNA, 20 nt, Human
gggcucccagcaugcagcuc

SEQ ID NO: 800763 - RNA, 20 nt, Human
ggguuccagagggugcagag

SEQ ID NO: 800764 - RNA, 18 nt, Human
gugcagagggaaggggaa

SEQ ID NO: 800765 - RNA, 19 nt, Human
guggaguggcccuugcucc

SEQ ID NO: 800766 - RNA, 20 nt, Human
guggccccgggcguccuggc

SEQ ID NO: 800767 - RNA, 26 nt, Human
gugggcagacaccaggagcacccugc

SEQ ID NO: 800768 - RNA, 20 nt, Human
uagcagugggugcacacucc

SEQ ID NO: 800769 - RNA, 20 nt, Human
ucacaggccggccuugucgc

SEQ ID NO: 800770 - RNA, 24 nt, Human
ucagaggaugacagggucuccugg

SEQ ID NO: 800771 - RNA, 23 nt, Human
ucagcaaggggacaguggugggc

SEQ ID NO: 800772 - RNA, 21 nt, Human
ucagccacaccugaaaugcag

SEQ ID NO: 800773 - RNA, 18 nt, Human
uccaagaagaaaugagau

SEQ ID NO: 800774 - RNA, 19 nt, Human
uccaccaguaaacaguaau

SEQ ID NO: 800775 - RNA, 24 nt, Human
ucccacagcugcggcaguggugcu

SEQ ID NO: 800776 - RNA, 20 nt, Human
ucccaggccacucugggguc

SEQ ID NO: 800777 - RNA, 20 nt, Human
uccccugcugggcaaagcug

SEQ ID NO: 800778 - RNA, 21 nt, Human
ucccgcaucuccccacuccaa

SEQ ID NO: 800779 - RNA, 26 nt, Human
uccgcagagucugggugagcggaccc

SEQ ID NO: 800780 - RNA, 18 nt, Human
uccgccaggcacccugcc

SEQ ID NO: 800781 - RNA, 23 nt, Human
ucucaggggcccugucgcuggcc

SEQ ID NO: 800782 - RNA, 21 nt, Human
ucugagggugggggcgccucc

SEQ ID NO: 800783 - RNA, 18 nt, Human
ucugcaagcggcgcgccg

SEQ ID NO: 800784 - RNA, 25 nt, Human
ugaccugcaaccccagccucuccuu

SEQ ID NO: 800785 - RNA, 22 nt, Human
ugaccuuccuuaacuuuuccuu

SEQ ID NO: 800786 - RNA, 22 nt, Human
ugaggaaggauggugaggggug

SEQ ID NO: 800787 - RNA, 19 nt, Human
ugaggagcaggacccagcu

SEQ ID NO: 800788 - RNA, 20 nt, Human
ugaggagguguccgcugggg

SEQ ID NO: 800789 - RNA, 22 nt, Human
ugaggagguguccgcuggggcc

SEQ ID NO: 800790 - RNA, 21 nt, Human
ugaggcaggcacuugucggaa

SEQ ID NO: 800791 - RNA, 24 nt, Human
ugaggggugaggggugagggcugg

SEQ ID NO: 800792 - RNA, 22 nt, Human
ugagggugggggcgccuccucc

SEQ ID NO: 800793 - RNA, 21 nt, Human
ugcaagcggcgcgccgggcag

SEQ ID NO: 800794 - RNA, 23 nt, Human
ugcaagcggcgcgccgggcagac

SEQ ID NO: 800795 - RNA, 18 nt, Human
ugccaaagagccugugga

SEQ ID NO: 800796 - RNA, 21 nt, Human
ugcggugucagugccuggucg

SEQ ID NO: 800797 - RNA, 19 nt, Human
ugcuccggcuuccagauuc

SEQ ID NO: 800798 - RNA, 19 nt, Human
ugcucuggaggucugggug

SEQ ID NO: 800799 - RNA, 18 nt, Human
ugcuggagcccgacaggg

SEQ ID NO: 800800 - RNA, 21 nt, Human
ugcugggcaaagcugaccucu

SEQ ID NO: 800801 - RNA, 20 nt, Human
uggaggucugggugccccug

SEQ ID NO: 800802 - RNA, 18 nt, Human
uggcaccacgucacaggc

SEQ ID NO: 800803 - RNA, 18 nt, Human
uggccaugaccucaaaca

SEQ ID NO: 800804 - RNA, 19 nt, Human
uggccccugcagccggccc

SEQ ID NO: 800805 - RNA, 23 nt, Human
uggccucuggcuccugcugaccu

SEQ ID NO: 800806 - RNA, 19 nt, Human
ugggaaccugaggugugag

SEQ ID NO: 800807 - RNA, 23 nt, Human
ugggaaccugaggugugaggcag

SEQ ID NO: 800808 - RNA, 19 nt, Human
ugggggcgccuccuccugu

SEQ ID NO: 800809 - RNA, 18 nt, Human
ugggugcacacucggacc

SEQ ID NO: 800810 - RNA, 19 nt, Human
uggguuggggcugccccug

SEQ ID NO: 800811 - RNA, 19 nt, Human
uggucggacccccaugccu

SEQ ID NO: 800812 - RNA, 24 nt, Human
ugguggccccgggcguccuggcug

SEQ ID NO: 800813 - RNA, 20 nt, Human
ugugaagccugagauuuaag

SEQ ID NO: 800814 - RNA, 24 nt, Human
uuccuuaacuuuuccuugucgucu

SEQ ID NO: 800815 - RNA, 25 nt, Human
uugguggccaugaccucaaacagug

SEQ ID NO: 800816 - RNA, 24 nt, Human
uugucggaagugggggcuuugggc

SEQ ID NO: 800817 - RNA, 23 nt, Human
uuuuccuugucgucuguuucagg

SEQ ID NO: 800818 - RNA, 19 nt, Human
aaaacgggaaaugggaaaa

SEQ ID NO: 800819 - RNA, 24 nt, Human
aaaauauuuccaucccccuacccc

SEQ ID NO: 800820 - RNA, 22 nt, Human
aaacaguaucccugggagccca

SEQ ID NO: 800821 - RNA, 20 nt, Human
aaagaagccuguuaaccccu

SEQ ID NO: 800822 - RNA, 19 nt, Human
aagcagacacccucugaug

SEQ ID NO: 800823 - RNA, 23 nt, Human
aagcagacacccucugaugccca

SEQ ID NO: 800824 - RNA, 24 nt, Human
aaguaggcagcuuaaaaaaucagg

SEQ ID NO: 800825 - RNA, 22 nt, Human
acagucuacuccuugagggacc

SEQ ID NO: 800826 - RNA, 27 nt, Human
acucuguugcccaggcuggagugcacu

SEQ ID NO: 800827 - RNA, 21 nt, Human
agacaaaagcagagcaacagc

SEQ ID NO: 800828 - RNA, 20 nt, Human
agcaagagggaccagaucua

SEQ ID NO: 800829 - RNA, 18 nt, Human
agcacagccacacccaca

SEQ ID NO: 800830 - RNA, 24 nt, Human
agccaaguugaaaaauuaaaaaau

SEQ ID NO: 800831 - RNA, 24 nt, Human
aggggagaugccacucacccuggg

SEQ ID NO: 800832 - RNA, 21 nt, Human
agugcacuggugcgaucucag

SEQ ID NO: 800833 - RNA, 19 nt, Human
aguugcuaaaaaacaguaa

SEQ ID NO: 800834 - RNA, 20 nt, Human
aguugcuaaaaaacaguaac

SEQ ID NO: 800835 - RNA, 19 nt, Human
auggugauggacagaagcu

SEQ ID NO: 800836 - RNA, 23 nt, Human
augugcauguauguacuugugug

SEQ ID NO: 800837 - RNA, 19 nt, Human
auuuccaucccccuacccc

SEQ ID NO: 800838 - RNA, 21 nt, Human
cacaccugcuuuccacacuga

SEQ ID NO: 800839 - RNA, 24 nt, Human
cacucuguugcccaggcuggagug

SEQ ID NO: 800840 - RNA, 23 nt, Human
cacugcaagcucugccuucuggg

SEQ ID NO: 800841 - RNA, 21 nt, Human
cagacgaaaacaacccacgug

SEQ ID NO: 800842 - RNA, 24 nt, Human
cagagucucacucuguugcccagg

SEQ ID NO: 800843 - RNA, 19 nt, Human
cagccccggauuucagucu

SEQ ID NO: 800844 - RNA, 18 nt, Human
cagcggaggggccugccu

SEQ ID NO: 800845 - RNA, 22 nt, Human
cagcgugggacguguuggugcu

SEQ ID NO: 800846 - RNA, 24 nt, Human
caugugcauguauguacuugugug

SEQ ID NO: 800847 - RNA, 24 nt, Human
ccaagcacagccacacccacagcc

SEQ ID NO: 800848 - RNA, 18 nt, Human
ccaccacgugagcaggau

SEQ ID NO: 800849 - RNA, 21 nt, Human
ccagccacaaccacagcagga

SEQ ID NO: 800850 - RNA, 24 nt, Human
cccacaugcacacuguucucaccu

SEQ ID NO: 800851 - RNA, 18 nt, Human
ccucugugagacagcaag

SEQ ID NO: 800852 - RNA, 23 nt, Human
ccugcagcagccccggauuucag

SEQ ID NO: 800853 - RNA, 23 nt, Human
ccugcagcagccccggauuucag

SEQ ID NO: 800854 - RNA, 21 nt, Human
ccuggacagcggccugugggg

SEQ ID NO: 800855 - RNA, 19 nt, Human
cucacaguaaaaaguaaaa

SEQ ID NO: 800856 - RNA, 22 nt, Human
cucacaugaagucagaguuuac

SEQ ID NO: 800857 - RNA, 24 nt, Human
cucacucuguugcccaggcuggag

SEQ ID NO: 800858 - RNA, 19 nt, Human
cucacugcaagcucugccu

SEQ ID NO: 800859 - RNA, 25 nt, Human
cuccauccaggucuguucuuccuuc

SEQ ID NO: 800860 - RNA, 19 nt, Human
cugcaagcucugccuucug

SEQ ID NO: 800861 - RNA, 18 nt, Human
cugguacccuaccucaca

SEQ ID NO: 800862 - RNA, 20 nt, Human
cugugcucaggguuggcgcu

SEQ ID NO: 800863 - RNA, 19 nt, Human
cuguugcccaggcuggagu

SEQ ID NO: 800864 - RNA, 21 nt, Human
cuuccaugauuccaacccuag

SEQ ID NO: 800865 - RNA, 23 nt, Human
gaccccgucuccuugaauggcac

SEQ ID NO: 800866 - RNA, 22 nt, Human
gagccagcggaggggccugccu

SEQ ID NO: 800867 - RNA, 24 nt, Human
gagcccuugacaccauugggggau

SEQ ID NO: 800868 - RNA, 22 nt, Human
gcaugucuguuaggcacaacua

SEQ ID NO: 800869 - RNA, 18 nt, Human
gccacaaccaccaaaguu

SEQ ID NO: 800870 - RNA, 21 nt, Human
gccacaaccaccaaaguuguu

SEQ ID NO: 800871 - RNA, 18 nt, Human
gccacacccacagcccug

SEQ ID NO: 800872 - RNA, 20 nt, Human
gcccaggcuggagugcacug

SEQ ID NO: 800873 - RNA, 22 nt, Human
gcccaggcuggagugcacuggu

SEQ ID NO: 800874 - RNA, 18 nt, Human
gcugaccaaugugggauc

SEQ ID NO: 800875 - RNA, 24 nt, Human
gcugaccaaugugggauccugcac

SEQ ID NO: 800876 - RNA, 23 nt, Human
ggaaaugggaaaaauaggaagaa

SEQ ID NO: 800877 - RNA, 18 nt, Human
ggacuagaaacuggggug

SEQ ID NO: 800878 - RNA, 20 nt, Human
ggagagaaaauauuuccauc

SEQ ID NO: 800879 - RNA, 19 nt, Human
ggaggcugguuuaggguca

SEQ ID NO: 800880 - RNA, 21 nt, Human
ggccaagcagacacccucuga

SEQ ID NO: 800881 - RNA, 20 nt, Human
gggaaaugggaaaaauagga

SEQ ID NO: 800882 - RNA, 19 nt, Human
gggacauuguuauaaaaac

SEQ ID NO: 800883 - RNA, 25 nt, Human
gugagacagcaaguaccgugacuaa

SEQ ID NO: 800884 - RNA, 18 nt, Human
guggaugucucccuacag

SEQ ID NO: 800885 - RNA, 22 nt, Human
uaaaaccuagggacauuguuau

SEQ ID NO: 800886 - RNA, 25 nt, Human
uaaaaguaggcagcuuaaaaaauca

SEQ ID NO: 800887 - RNA, 23 nt, Human
uaaacaguaucccugggagccca

SEQ ID NO: 800888 - RNA, 24 nt, Human
uaaacaguaucccugggagcccau

SEQ ID NO: 800889 - RNA, 23 nt, Human
uaccgugacuaacugguacccua

SEQ ID NO: 800890 - RNA, 22 nt, Human
uaccuaccuaccuagacagagu

SEQ ID NO: 800891 - RNA, 18 nt, Human
uaccucacacacuugaca

SEQ ID NO: 800892 - RNA, 19 nt, Human
uagcaggaauggcucccag

SEQ ID NO: 800893 - RNA, 24 nt, Human
uaggcacaacuagccguuucacaa

SEQ ID NO: 800894 - RNA, 22 nt, Human
uauauaaagacaaaagcagagc

SEQ ID NO: 800895 - RNA, 19 nt, Human
uauugguuuugguuuuccc

SEQ ID NO: 800896 - RNA, 24 nt, Human
uauugguuuugguuuucccggucg

SEQ ID NO: 800897 - RNA, 19 nt, Human
ucacaaguggucccagcua

SEQ ID NO: 800898 - RNA, 23 nt, Human
ucacugcaagcucugccuucugg

SEQ ID NO: 800899 - RNA, 24 nt, Human
ucacugcaagcucugccuucuggg

SEQ ID NO: 800900 - RNA, 21 nt, Human
ucagccaaguugaaaaauuaa

SEQ ID NO: 800901 - RNA, 22 nt, Human
uccaaggucacuuucacgggug

SEQ ID NO: 800902 - RNA, 23 nt, Human
uccaugauuccaacccuagauuu

SEQ ID NO: 800903 - RNA, 23 nt, Human
ucccagugcugugggggccaagc

SEQ ID NO: 800904 - RNA, 19 nt, Human
ucccugggagcccauuacc

SEQ ID NO: 800905 - RNA, 23 nt, Human
ucucacucuguugcccaggcugg

SEQ ID NO: 800906 - RNA, 24 nt, Human
ucucacucuguugcccaggcugga

SEQ ID NO: 800907 - RNA, 26 nt, Human
ucucacucuguugcccaggcuggagu

SEQ ID NO: 800908 - RNA, 19 nt, Human
ucuccuggccaaagaagcc

SEQ ID NO: 800909 - RNA, 25 nt, Human
ucucugacugucccagugcuguggg

SEQ ID NO: 800910 - RNA, 21 nt, Human
ucucuugggccaccagcuugg

SEQ ID NO: 800911 - RNA, 21 nt, Human
ucugacugucccagugcugug

SEQ ID NO: 800912 - RNA, 19 nt, Human
ucugaugaugaggggagau

SEQ ID NO: 800913 - RNA, 18 nt, Human
ucuguugcccaggcugga

SEQ ID NO: 800914 - RNA, 19 nt, Human
ugaacccugcagcagcccc

SEQ ID NO: 800915 - RNA, 22 nt, Human
ugacaggugagaagcagaggcu

SEQ ID NO: 800916 - RNA, 21 nt, Human
ugacaugcaauuccaagaaga

SEQ ID NO: 800917 - RNA, 26 nt, Human
ugacugagccccucacccuugcagcc

SEQ ID NO: 800918 - RNA, 19 nt, Human
ugagccaaccuggacagcg

SEQ ID NO: 800919 - RNA, 20 nt, Human
ugagccccucacccuugcag

SEQ ID NO: 800920 - RNA, 20 nt, Human
ugaggagcccuugacaccau

SEQ ID NO: 800921 - RNA, 23 nt, Human
ugagguauuccuggacugcaaag

SEQ ID NO: 800922 - RNA, 25 nt, Human
ugagguauuccuggacugcaaaggg

SEQ ID NO: 800923 - RNA, 22 nt, Human
ugcacuggugcgaucucagcuc

SEQ ID NO: 800924 - RNA, 20 nt, Human
ugccaugaccugaagagagc

SEQ ID NO: 800925 - RNA, 19 nt, Human
ugcccaggcuggagugcac

SEQ ID NO: 800926 - RNA, 24 nt, Human
ugcccaggcuggagugcacuggug

SEQ ID NO: 800927 - RNA, 25 nt, Human
ugcucauucaucaagcaucuaucua

SEQ ID NO: 800928 - RNA, 20 nt, Human
uggaggugaacccugcagca

SEQ ID NO: 800929 - RNA, 18 nt, Human
uggagugcacuggugcga

SEQ ID NO: 800930 - RNA, 24 nt, Human
uggagugcacuggugcgaucucag

SEQ ID NO: 800931 - RNA, 22 nt, Human
uggcacauaguaagugcgcagg

SEQ ID NO: 800932 - RNA, 19 nt, Human
uggcaggcacucggcaagu

SEQ ID NO: 800933 - RNA, 20 nt, Human
uggcauuuugaggagcccuu

SEQ ID NO: 800934 - RNA, 20 nt, Human
uggccaggguggccauauca

SEQ ID NO: 800935 - RNA, 19 nt, Human
ugggaaaaauaggaagaaa

SEQ ID NO: 800936 - RNA, 27 nt, Human
uggggugguggggggcaaugacaccuc

SEQ ID NO: 800937 - RNA, 24 nt, Human
uggugcgaucucagcucacugcaa

SEQ ID NO: 800938 - RNA, 18 nt, Human
uguacaaaccuaaggguc

SEQ ID NO: 800939 - RNA, 23 nt, Human
ugucagcugccuacuugcugcuu

SEQ ID NO: 800940 - RNA, 19 nt, Human
ugucauguuuucccugaca

SEQ ID NO: 800941 - RNA, 25 nt, Human
ugugugcgcgcaugugcauguaugu

SEQ ID NO: 800942 - RNA, 22 nt, Human
ugugugugcgcgcaugugcaug

SEQ ID NO: 800943 - RNA, 20 nt, Human
ugugugugugcgcgcaugug

SEQ ID NO: 800944 - RNA, 20 nt, Human
uguucacacccacaugcaca

SEQ ID NO: 800945 - RNA, 18 nt, Human
uuaccauuuaugggacag

SEQ ID NO: 800946 - RNA, 22 nt, Human
uuaccauuuaugggacaguguc

SEQ ID NO: 800947 - RNA, 18 nt, Human
uuagggucauucaacagg

SEQ ID NO: 800948 - RNA, 20 nt, Human
uugaacucgucacuacccug

SEQ ID NO: 800949 - RNA, 24 nt, Human
uugacaggugagaagcagaggcuc

SEQ ID NO: 800950 - RNA, 18 nt, Human
uugcccaggcuggagugc

SEQ ID NO: 800951 - RNA, 23 nt, Human
uugcccaggcuggagugcacugg

SEQ ID NO: 800952 - RNA, 24 nt, Human
uugcccaggcuggagugcacuggu

SEQ ID NO: 800953 - RNA, 22 nt, Human
uugcuuccaugauuccaacccu

SEQ ID NO: 800954 - RNA, 20 nt, Human
uugguuccagcuguggccag

SEQ ID NO: 800955 - RNA, 20 nt, Human
uuuaagcaccagcgugggac

SEQ ID NO: 800956 - RNA, 22 nt, Human
uuugccaugaccugaagagagc

SEQ ID NO: 800957 - RNA, 22 nt, Human
uuuuccuguugauggggaccag

SEQ ID NO: 800958 - RNA, 24 nt, Human
aaaaaaaaaaagauaacucaaagg

SEQ ID NO: 800959 - RNA, 22 nt, Human
aaaaaaaaaagauaacucaaag

SEQ ID NO: 800960 - RNA, 21 nt, Human
aaaaacacaagccuaccuuuu

SEQ ID NO: 800961 - RNA, 21 nt, Human
aaaaacacaagccuaccuuuu

SEQ ID NO: 800962 - RNA, 22 nt, Human
aaaaagcaaaaaacaaacaaac

SEQ ID NO: 800963 - RNA, 21 nt, Human
aaaacaaacaaacaaacaaac

SEQ ID NO: 800964 - RNA, 22 nt, Human
aaaaccagggugugguuaagug

SEQ ID NO: 800965 - RNA, 23 nt, Human
aaacaaacaaacaaaaaaccuca

SEQ ID NO: 800966 - RNA, 26 nt, Human
aaacaaacaaacaaacaaaaaaccuc

SEQ ID NO: 800967 - RNA, 21 nt, Human
aaacaucccucaguccugggg

SEQ ID NO: 800968 - RNA, 23 nt, Human
aaacggccagcugccauuagaac

SEQ ID NO: 800969 - RNA, 24 nt, Human
aaagugccgggaucacaggcguga

SEQ ID NO: 800970 - RNA, 24 nt, Human
aaagugcugggacaagaggcauga

SEQ ID NO: 800971 - RNA, 23 nt, Human
aacacagaaaggcgggucccauc

SEQ ID NO: 800972 - RNA, 23 nt, Human
aacacagaaaggcgggucccauc

SEQ ID NO: 800973 - RNA, 22 nt, Human
aacacagcccccucccagcaaa

SEQ ID NO: 800974 - RNA, 19 nt, Human
aacacggugaaaccucauc

SEQ ID NO: 800975 - RNA, 20 nt, Human
aacacggugaaaccucaucu

SEQ ID NO: 800976 - RNA, 21 nt, Human
aacacggugaaaccucaucuc

SEQ ID NO: 800977 - RNA, 26 nt, Human
aacagagccacccuccucugcccccu

SEQ ID NO: 800978 - RNA, 24 nt, Human
aacagagugagacuuugucucaaa

SEQ ID NO: 800979 - RNA, 24 nt, Human
aaccugggcaacacagugagacuc

SEQ ID NO: 800980 - RNA, 26 nt, Human
aacuauuuuuuuuuuucuggggggcc

SEQ ID NO: 800981 - RNA, 19 nt, Human
aacuggcuccagcucugcc

SEQ ID NO: 800982 - RNA, 19 nt, Human
aacuggcuccagcucugcc

SEQ ID NO: 800983 - RNA, 23 nt, Human
aagaaagccacccagagaauuca

SEQ ID NO: 800984 - RNA, 23 nt, Human
aagacagaggagcggcacagcuc

SEQ ID NO: 800985 - RNA, 23 nt, Human
aagacagaggagcggcacagcuc

SEQ ID NO: 800986 - RNA, 18 nt, Human
aagagcacagggcagaac

SEQ ID NO: 800987 - RNA, 18 nt, Human
aagagcacagggcagaac

SEQ ID NO: 800988 - RNA, 19 nt, Human
aagaggcaugagccaccau

SEQ ID NO: 800989 - RNA, 18 nt, Human
aagaggccugagaccugc

SEQ ID NO: 800990 - RNA, 18 nt, Human
aagaggccugagaccugc

SEQ ID NO: 800991 - RNA, 19 nt, Human
aagcagccucccccuccaa

SEQ ID NO: 800992 - RNA, 18 nt, Human
aagcaggaggaucacuug

SEQ ID NO: 800993 - RNA, 24 nt, Human
aagcaggaggaucacuugugccca

SEQ ID NO: 800994 - RNA, 21 nt, Human
aagcaggguccuucagacagc

SEQ ID NO: 800995 - RNA, 21 nt, Human
aagcaggguccuucagacagc

SEQ ID NO: 800996 - RNA, 20 nt, Human
aagccacccagagaauucag

SEQ ID NO: 800997 - RNA, 20 nt, Human
aagccacccagagaauucag

SEQ ID NO: 800998 - RNA, 21 nt, Human
aagcccgccuccccggccccg

SEQ ID NO: 800999 - RNA, 21 nt, Human
aagcgcccaccaccgcgcccc

SEQ ID NO: 801000 - RNA, 25 nt, Human
aagcuggguucaaauccuggguccu

SEQ ID NO: 801001 - RNA, 25 nt, Human
aagcuggguucaaauccuggguccu

SEQ ID NO: 801002 - RNA, 26 nt, Human
aaguaacugggaccauaggugcaugc

SEQ ID NO: 801003 - RNA, 26 nt, Human
aagugccgggaucacaggcgugagcc

SEQ ID NO: 801004 - RNA, 25 nt, Human
aauaacugaaaaagcaaaaaacaaa

SEQ ID NO: 801005 - RNA, 24 nt, Human
acaaacaaacaaacaaacaaaaaa

SEQ ID NO: 801006 - RNA, 19 nt, Human
acaacacagcccccuccca

SEQ ID NO: 801007 - RNA, 21 nt, Human
acaagacagaggagcggcaca

SEQ ID NO: 801008 - RNA, 22 nt, Human
acaagacagaggagcggcacag

SEQ ID NO: 801009 - RNA, 22 nt, Human
acaagacagaggagcggcacag

SEQ ID NO: 801010 - RNA, 18 nt, Human
acaaugggaggcugagcc

SEQ ID NO: 801011 - RNA, 24 nt, Human
acagagugagacuuugucucaaaa

SEQ ID NO: 801012 - RNA, 20 nt, Human
acagcuaggagacccaagca

SEQ ID NO: 801013 - RNA, 24 nt, Human
acagcucacugcgaccucugccuc

SEQ ID NO: 801014 - RNA, 18 nt, Human
acaggguuuuaccacguu

SEQ ID NO: 801015 - RNA, 20 nt, Human
acaggguuuuaccacguugg

SEQ ID NO: 801016 - RNA, 24 nt, Human
acaggguuuuaccacguugguuag

SEQ ID NO: 801017 - RNA, 18 nt, Human
accacguugguuaggcug

SEQ ID NO: 801018 - RNA, 19 nt, Human
accauaggugcaugccacc

SEQ ID NO: 801019 - RNA, 24 nt, Human
acccaagcagccucccccuccaac

SEQ ID NO: 801020 - RNA, 19 nt, Human
accucugccuccugggcac

SEQ ID NO: 801021 - RNA, 22 nt, Human
accugcuccccacccaggcacc

SEQ ID NO: 801022 - RNA, 22 nt, Human
accugcuccccacccaggcacc

SEQ ID NO: 801023 - RNA, 23 nt, Human
accugcuuugggaugagagggag

SEQ ID NO: 801024 - RNA, 23 nt, Human
accugcuuugggaugagagggag

SEQ ID NO: 801025 - RNA, 20 nt, Human
accuugggaggccgaggcag

SEQ ID NO: 801026 - RNA, 24 nt, Human
acuauauugcccaagcuggucucg

SEQ ID NO: 801027 - RNA, 25 nt, Human
acuauauugcccaagcuggucucga

SEQ ID NO: 801028 - RNA, 19 nt, Human
acucaggggagaugucagg

SEQ ID NO: 801029 - RNA, 22 nt, Human
acucagugacaacacuggccug

SEQ ID NO: 801030 - RNA, 22 nt, Human
acucagugacaacacuggccug

SEQ ID NO: 801031 - RNA, 18 nt, Human
acucugucacccaggcug

SEQ ID NO: 801032 - RNA, 25 nt, Human
acucugucacccaggcugaagugca

SEQ ID NO: 801033 - RNA, 25 nt, Human
acugaaaaacacaagccuaccuugg

SEQ ID NO: 801034 - RNA, 25 nt, Human
acugaaaaacacaagccuaccuugg

SEQ ID NO: 801035 - RNA, 23 nt, Human
acugcaaguggagcaccaccagg

SEQ ID NO: 801036 - RNA, 23 nt, Human
acugcaaguggagcaccaccagg

SEQ ID NO: 801037 - RNA, 24 nt, Human
acugcacuccagccuuggcaacag

SEQ ID NO: 801038 - RNA, 24 nt, Human
acugcacuccagccuuggcaacag

SEQ ID NO: 801039 - RNA, 19 nt, Human
acugcacuccagccuuggg

SEQ ID NO: 801040 - RNA, 19 nt, Human
acuguguugcccaggaugg

SEQ ID NO: 801041 - RNA, 28 nt, Human
acuuugucucaaaaaaaaaaaaaaaaaa

SEQ ID NO: 801042 - RNA, 21 nt, Human
agaaagcugagaacgagauca

SEQ ID NO: 801043 - RNA, 20 nt, Human
agaaauggauaaguaauaca

SEQ ID NO: 801044 - RNA, 23 nt, Human
agaacaaaaagagauggacggag

SEQ ID NO: 801045 - RNA, 20 nt, Human
agaacacaacacagaaaggc

SEQ ID NO: 801046 - RNA, 20 nt, Human
agaacacaacacagaaaggc

SEQ ID NO: 801047 - RNA, 20 nt, Human
agaacacaacacagaaaggc

SEQ ID NO: 801048 - RNA, 20 nt, Human
agaacacaacacagaaaggc

SEQ ID NO: 801049 - RNA, 21 nt, Human
agacaacugaggccagaaaug

SEQ ID NO: 801050 - RNA, 23 nt, Human
agacagagccucgcucuguugca

SEQ ID NO: 801051 - RNA, 22 nt, Human
agacgacacgggacuccaagcc

SEQ ID NO: 801052 - RNA, 22 nt, Human
agacgacacgggacuccaagcc

SEQ ID NO: 801053 - RNA, 26 nt, Human
agagccacccuccucugcccccacuu

SEQ ID NO: 801054 - RNA, 26 nt, Human
agagccacccuccucugcccccacuu

SEQ ID NO: 801055 - RNA, 23 nt, Human
agagccacccuccucugcccccu

SEQ ID NO: 801056 - RNA, 21 nt, Human
agcaaagacacccagaaggga

SEQ ID NO: 801057 - RNA, 24 nt, Human
agcaguucuccugccacagccucc

SEQ ID NO: 801058 - RNA, 23 nt, Human
agccaggcauggugaugcacgcc

SEQ ID NO: 801059 - RNA, 18 nt, Human
agccuccugaauagcugg

SEQ ID NO: 801060 - RNA, 23 nt, Human
agccuuggcaacagagugagacu

SEQ ID NO: 801061 - RNA, 24 nt, Human
agccuuggcaacagagugagacuu

SEQ ID NO: 801062 - RNA, 24 nt, Human
agcggugcagccucauccugcccu

SEQ ID NO: 801063 - RNA, 24 nt, Human
agcggugcagccucauccugcccu

SEQ ID NO: 801064 - RNA, 24 nt, Human
agcuaauugggaggcugagguggg

SEQ ID NO: 801065 - RNA, 23 nt, Human
agcuaggagacccaagcagccuc

SEQ ID NO: 801066 - RNA, 23 nt, Human
agcugggcgugauggugugcgcc

SEQ ID NO: 801067 - RNA, 24 nt, Human
agcuggucucgaacuccugagcuc

SEQ ID NO: 801068 - RNA, 23 nt, Human
aggaggaucacuugugcccagga

SEQ ID NO: 801069 - RNA, 24 nt, Human
aggaucacuugugcccaggaguuc

SEQ ID NO: 801070 - RNA, 19 nt, Human
aggcagaguucacccugcg

SEQ ID NO: 801071 - RNA, 22 nt, Human
aggcaggaaaauaauccucugg

SEQ ID NO: 801072 - RNA, 22 nt, Human
aggcaggaaaauaauccucugg

SEQ ID NO: 801073 - RNA, 26 nt, Human
aggcaggcagaccacccgaggucagg

SEQ ID NO: 801074 - RNA, 23 nt, Human
aggcagugugagagaaauccagg

SEQ ID NO: 801075 - RNA, 20 nt, Human
aggcauguauacucagcugu

SEQ ID NO: 801076 - RNA, 23 nt, Human
aggccagaaauggagagccagga

SEQ ID NO: 801077 - RNA, 21 nt, Human
aggccgaggggagaggguugc

SEQ ID NO: 801078 - RNA, 23 nt, Human
aggccgaggggagaggguugcuu

SEQ ID NO: 801079 - RNA, 24 nt, Human
aggccgaggggagaggguugcuug

SEQ ID NO: 801080 - RNA, 24 nt, Human
aggcugaagcaggaggaucacuug

SEQ ID NO: 801081 - RNA, 22 nt, Human
aggcugagccuuucaaaggccc

SEQ ID NO: 801082 - RNA, 24 nt, Human
aggcugaggugggaggaucacuug

SEQ ID NO: 801083 - RNA, 18 nt, Human
aggcuggagugcaguggc

SEQ ID NO: 801084 - RNA, 19 nt, Human
agggacugccugggcucug

SEQ ID NO: 801085 - RNA, 19 nt, Human
agggacugccugggcucug

SEQ ID NO: 801086 - RNA, 27 nt, Human
agggggguuggaggaggaggcagagaa

SEQ ID NO: 801087 - RNA, 22 nt, Human
aggugauaacauucccauucau

SEQ ID NO: 801088 - RNA, 19 nt, Human
aggugcaugccaccacacc

SEQ ID NO: 801089 - RNA, 24 nt, Human
aggugggaggaucacuugagucug

SEQ ID NO: 801090 - RNA, 20 nt, Human
aguaaucuuccugccucagc

SEQ ID NO: 801091 - RNA, 23 nt, Human
aguauaguggcaugaucacagcu

SEQ ID NO: 801092 - RNA, 20 nt, Human
agugcaguggcaugaugaug

SEQ ID NO: 801093 - RNA, 23 nt, Human
agugcaguggcaugaugauggcu

SEQ ID NO: 801094 - RNA, 24 nt, Human
agugcaguggcaugaugauggcuc

SEQ ID NO: 801095 - RNA, 24 nt, Human
agugcaguggcgugauuucaccuc

SEQ ID NO: 801096 - RNA, 19 nt, Human
aguggcucaugccuguaac

SEQ ID NO: 801097 - RNA, 24 nt, Human
auaacugaaaaagcaaaaaacaaa

SEQ ID NO: 801098 - RNA, 25 nt, Human
auagugccacugcacuccagccuug

SEQ ID NO: 801099 - RNA, 18 nt, Human
aucucacucugucaccca

SEQ ID NO: 801100 - RNA, 18 nt, Human
augaaacggccagcugcc

SEQ ID NO: 801101 - RNA, 18 nt, Human
auggcucaaccuucaucc

SEQ ID NO: 801102 - RNA, 21 nt, Human
auggcucacuagucucgaucu

SEQ ID NO: 801103 - RNA, 21 nt, Human
auucauuacccaggguucaaa

SEQ ID NO: 801104 - RNA, 18 nt, Human
auucuccugccucagccu

SEQ ID NO: 801105 - RNA, 21 nt, Human
auuucaggcuccugaguagcu

SEQ ID NO: 801106 - RNA, 25 nt, Human
auuuuuaguagagacaggguuuuac

SEQ ID NO: 801107 - RNA, 23 nt, Human
caaaagccuucaauggcuuccca

SEQ ID NO: 801108 - RNA, 21 nt, Human
caaacaaaaaaccucacuggg

SEQ ID NO: 801109 - RNA, 20 nt, Human
caaagcaaaccauuuugguc

SEQ ID NO: 801110 - RNA, 20 nt, Human
caaaggaaaggcagccccuc

SEQ ID NO: 801111 - RNA, 20 nt, Human
caaaggaaaggcagccccuc

SEQ ID NO: 801112 - RNA, 24 nt, Human
caaagugccgggaucacaggcgug

SEQ ID NO: 801113 - RNA, 24 nt, Human
caaagugcugggacaagaggcaug

SEQ ID NO: 801114 - RNA, 21 nt, Human
caaagugggagugaaugucag

SEQ ID NO: 801115 - RNA, 18 nt, Human
caacacagcccccuccca

SEQ ID NO: 801116 - RNA, 19 nt, Human
caagacagaggagcggcac

SEQ ID NO: 801117 - RNA, 22 nt, Human
caagauuaaaacccuuggcugg

SEQ ID NO: 801118 - RNA, 18 nt, Human
caagccgaaagcagucga

SEQ ID NO: 801119 - RNA, 27 nt, Human
caagcgauccucccaccucggcccccc

SEQ ID NO: 801120 - RNA, 27 nt, Human
caagcgauccucccaccucggcccccc

SEQ ID NO: 801121 - RNA, 21 nt, Human
caagcgcccaccaccgcgccc

SEQ ID NO: 801122 - RNA, 22 nt, Human
caagcgcccaccaccgcgcccc

SEQ ID NO: 801123 - RNA, 22 nt, Human
caagugauucuccugccucagc

SEQ ID NO: 801124 - RNA, 18 nt, Human
caaugugagaagcccgaa

SEQ ID NO: 801125 - RNA, 22 nt, Human
cacaaaaccagggugugguuaa

SEQ ID NO: 801126 - RNA, 21 nt, Human
cacaacacagcccccucccag

SEQ ID NO: 801127 - RNA, 18 nt, Human
cacacagcuaggagaccc

SEQ ID NO: 801128 - RNA, 19 nt, Human
cacacuaucccacucaccc

SEQ ID NO: 801129 - RNA, 19 nt, Human
cacacuaucccacucaccc

SEQ ID NO: 801130 - RNA, 18 nt, Human
cacacugaagcuggguuc

SEQ ID NO: 801131 - RNA, 18 nt, Human
cacacugaagcuggguuc

SEQ ID NO: 801132 - RNA, 21 nt, Human
cacaguuuaagaacuuaucca

SEQ ID NO: 801133 - RNA, 21 nt, Human
caccagggcucuccauccccu

SEQ ID NO: 801134 - RNA, 19 nt, Human
caccaugccuggcucauuu

SEQ ID NO: 801135 - RNA, 22 nt, Human
caccaugcuggccccaauaggc

SEQ ID NO: 801136 - RNA, 23 nt, Human
cacccaggcugaagugcaguggc

SEQ ID NO: 801137 - RNA, 18 nt, Human
caccucacugcaaacucc

SEQ ID NO: 801138 - RNA, 21 nt, Human
caccucgcagcaaacucaauc

SEQ ID NO: 801139 - RNA, 21 nt, Human
caccucggccccccaaguaac

SEQ ID NO: 801140 - RNA, 24 nt, Human
caccucggccccccaaguaacugg

SEQ ID NO: 801141 - RNA, 23 nt, Human
caccuucuccucccggucuccca

SEQ ID NO: 801142 - RNA, 23 nt, Human
caccuucuccucccggucuccca

SEQ ID NO: 801143 - RNA, 22 nt, Human
cacgccuguuaauuccaaccuu

SEQ ID NO: 801144 - RNA, 27 nt, Human
cacuauauugcccaagcuggucucgaa

SEQ ID NO: 801145 - RNA, 21 nt, Human
cacucagugacaacacuggcc

SEQ ID NO: 801146 - RNA, 21 nt, Human
cacucagugacaacacuggcc

SEQ ID NO: 801147 - RNA, 22 nt, Human
cacuccagccuuggcaacagag

SEQ ID NO: 801148 - RNA, 23 nt, Human
cacucugucacccaggcugaagu

SEQ ID NO: 801149 - RNA, 24 nt, Human
cacucugucacccaggcugaagug

SEQ ID NO: 801150 - RNA, 19 nt, Human
cacugcacuccagccuugg

SEQ ID NO: 801151 - RNA, 21 nt, Human
cacugcacuccagccuuggca

SEQ ID NO: 801152 - RNA, 22 nt, Human
cacugcacuccagccuuggcaa

SEQ ID NO: 801153 - RNA, 23 nt, Human
cacugcacuccagccuuggcaac

SEQ ID NO: 801154 - RNA, 24 nt, Human
cacugcacuccagccuuggcaaca

SEQ ID NO: 801155 - RNA, 21 nt, Human
cacugcgaccucugccuccug

SEQ ID NO: 801156 - RNA, 23 nt, Human
cacugcgaccucugccuccuggg

SEQ ID NO: 801157 - RNA, 21 nt, Human
cacugggcuagccucaagcaa

SEQ ID NO: 801158 - RNA, 21 nt, Human
cacugggcuagccucaagcaa

SEQ ID NO: 801159 - RNA, 18 nt, Human
cacuguguugcccaggau

SEQ ID NO: 801160 - RNA, 21 nt, Human
cagaacacaacacagaaaggc

SEQ ID NO: 801161 - RNA, 21 nt, Human
cagaacacaacacagaaaggc

SEQ ID NO: 801162 - RNA, 25 nt, Human
cagacagcccccacgcugcauccca

SEQ ID NO: 801163 - RNA, 25 nt, Human
cagacagcccccacgcugcauccca

SEQ ID NO: 801164 - RNA, 23 nt, Human
cagaccacccgaggucaggauuu

SEQ ID NO: 801165 - RNA, 23 nt, Human
cagacugaccccuggaaacauga

SEQ ID NO: 801166 - RNA, 23 nt, Human
cagacugaccccuggaaacauga

SEQ ID NO: 801167 - RNA, 25 nt, Human
cagagcucccagaaccgugcucccc

SEQ ID NO: 801168 - RNA, 25 nt, Human
cagagcucccagaaccgugcucccc

SEQ ID NO: 801169 - RNA, 20 nt, Human
cagauggucaccuauagcac

SEQ ID NO: 801170 - RNA, 20 nt, Human
cagauggucaccuauagcac

SEQ ID NO: 801171 - RNA, 20 nt, Human
cagcccccacgcugcauccc

SEQ ID NO: 801172 - RNA, 20 nt, Human
cagcccccacgcugcauccc

SEQ ID NO: 801173 - RNA, 23 nt, Human
cagccuccaucuccuaggcucaa

SEQ ID NO: 801174 - RNA, 24 nt, Human
cagccuccaucuccuaggcucaag

SEQ ID NO: 801175 - RNA, 24 nt, Human
cagcuaauugggaggcugaggugg

SEQ ID NO: 801176 - RNA, 19 nt, Human
cagcuggacucaaugaaac

SEQ ID NO: 801177 - RNA, 19 nt, Human
cagcugugugcaacaaaag

SEQ ID NO: 801178 - RNA, 22 nt, Human
caggaaauggagaagugaccau

SEQ ID NO: 801179 - RNA, 22 nt, Human
caggaacaaacugaccucuucc

SEQ ID NO: 801180 - RNA, 24 nt, Human
caggaagggaaaagugugggagga

SEQ ID NO: 801181 - RNA, 24 nt, Human
caggaagggaaaagugugggagga

SEQ ID NO: 801182 - RNA, 23 nt, Human
caggacuagcccaccaccuucuc

SEQ ID NO: 801183 - RNA, 23 nt, Human
caggacuagcccaccaccuucuc

SEQ ID NO: 801184 - RNA, 20 nt, Human
caggaugggcuggucugagg

SEQ ID NO: 801185 - RNA, 22 nt, Human
caggauggugucaggguccacu

SEQ ID NO: 801186 - RNA, 24 nt, Human
caggcagaccacccgaggucagga

SEQ ID NO: 801187 - RNA, 23 nt, Human
caggcaucccugaccacuguccu

SEQ ID NO: 801188 - RNA, 21 nt, Human
caggcauguauacucagcugu

SEQ ID NO: 801189 - RNA, 19 nt, Human
cagggcucuccauccccuc

SEQ ID NO: 801190 - RNA, 21 nt, Human
caggguccuucagacagcccc

SEQ ID NO: 801191 - RNA, 21 nt, Human
caggguccuucagacagcccc

SEQ ID NO: 801192 - RNA, 22 nt, Human
cagggugugguuaagugccagg

SEQ ID NO: 801193 - RNA, 24 nt, Human
caggguuuuaccacguugguuagg

SEQ ID NO: 801194 - RNA, 21 nt, Human
cagguccucaggaggccgagg

SEQ ID NO: 801195 - RNA, 23 nt, Human
caggucuugcuauguggcccagg

SEQ ID NO: 801196 - RNA, 24 nt, Human
caguaccugaaaaaccagguccua

SEQ ID NO: 801197 - RNA, 20 nt, Human
caguucuccugccacagccu

SEQ ID NO: 801198 - RNA, 21 nt, Human
caugcagggaggauauuuacc

SEQ ID NO: 801199 - RNA, 21 nt, Human
caugcagggaggauauuuacc

SEQ ID NO: 801200 - RNA, 19 nt, Human
caugccaccacaccuggcu

SEQ ID NO: 801201 - RNA, 24 nt, Human
caugccuguaacuccaacacuuug

SEQ ID NO: 801202 - RNA, 20 nt, Human
caugcgaucugccugccucg

SEQ ID NO: 801203 - RNA, 23 nt, Human
cauggcucaaccuucauccgcuc

SEQ ID NO: 801204 - RNA, 21 nt, Human
cauuaggccacucaggggaga

SEQ ID NO: 801205 - RNA, 22 nt, Human
ccaaagugccgggaucacaggc

SEQ ID NO: 801206 - RNA, 22 nt, Human
ccaaagugccgggaucacaggc

SEQ ID NO: 801207 - RNA, 24 nt, Human
ccaaagugccgggaucacaggcgu

SEQ ID NO: 801208 - RNA, 24 nt, Human
ccaaagugcugggacaagaggcau

SEQ ID NO: 801209 - RNA, 18 nt, Human
ccaaguaacugggaccau

SEQ ID NO: 801210 - RNA, 20 nt, Human
ccacacuaucccacucaccc

SEQ ID NO: 801211 - RNA, 21 nt, Human
ccaccacaccuggcuaauugu

SEQ ID NO: 801212 - RNA, 22 nt, Human
ccaccaucuugccacccgggag

SEQ ID NO: 801213 - RNA, 19 nt, Human
ccaccaugccaaaccgaca

SEQ ID NO: 801214 - RNA, 19 nt, Human
ccacccaggcaccuccacu

SEQ ID NO: 801215 - RNA, 21 nt, Human
ccacccaggcaccuccacuuc

SEQ ID NO: 801216 - RNA, 20 nt, Human
ccacugcacuccagccuugg

SEQ ID NO: 801217 - RNA, 21 nt, Human
ccacugcacuccagccuuggc

SEQ ID NO: 801218 - RNA, 24 nt, Human
ccacugcacuccagccuuggcaac

SEQ ID NO: 801219 - RNA, 24 nt, Human
ccacuggggagaggacaagaggcc

SEQ ID NO: 801220 - RNA, 24 nt, Human
ccacuggggagaggacaagaggcc

SEQ ID NO: 801221 - RNA, 23 nt, Human
ccagaaccgugcuccccaacugg

SEQ ID NO: 801222 - RNA, 21 nt, Human
ccagaagggaaagagagcugg

SEQ ID NO: 801223 - RNA, 18 nt, Human
ccagauaagaaaucagcu

SEQ ID NO: 801224 - RNA, 19 nt, Human
ccaggcucaagcgauccuc

SEQ ID NO: 801225 - RNA, 22 nt, Human
ccaggcucaagcgauccuccca

SEQ ID NO: 801226 - RNA, 22 nt, Human
ccagggcucuccauccccucca

SEQ ID NO: 801227 - RNA, 19 nt, Human
ccaguaccugaaaaaccag

SEQ ID NO: 801228 - RNA, 19 nt, Human
ccaguaccugaaaaaccag

SEQ ID NO: 801229 - RNA, 24 nt, Human
ccauaccccuucaucucauuccac

SEQ ID NO: 801230 - RNA, 21 nt, Human
cccaaccagcaggggaccacu

SEQ ID NO: 801231 - RNA, 21 nt, Human
cccaaccagcaggggaccacu

SEQ ID NO: 801232 - RNA, 21 nt, Human
cccaagaugacugcuuauaga

SEQ ID NO: 801233 - RNA, 21 nt, Human
cccaagaugacugcuuauaga

SEQ ID NO: 801234 - RNA, 20 nt, Human
cccaccucggccccccaagu

SEQ ID NO: 801235 - RNA, 23 nt, Human
cccagagaauucaguguaccauu

SEQ ID NO: 801236 - RNA, 23 nt, Human
cccagagaauucaguguaccauu

SEQ ID NO: 801237 - RNA, 23 nt, Human
cccaggcugaagugcaguggcau

SEQ ID NO: 801238 - RNA, 20 nt, Human
ccccacccaggcaccuccac

SEQ ID NO: 801239 - RNA, 20 nt, Human
ccccacccaggcaccuccac

SEQ ID NO: 801240 - RNA, 27 nt, Human
cccccaaacaccucccggcgaugcugg

SEQ ID NO: 801241 - RNA, 20 nt, Human
cccccucgcuccaagcccgc

SEQ ID NO: 801242 - RNA, 20 nt, Human
ccccgcccccucgcuccaag

SEQ ID NO: 801243 - RNA, 24 nt, Human
ccccgcccccucgcuccaagcccg

SEQ ID NO: 801244 - RNA, 19 nt, Human
ccccuggaaaaagcagggu

SEQ ID NO: 801245 - RNA, 19 nt, Human
ccccuggaaaaagcagggu

SEQ ID NO: 801246 - RNA, 20 nt, Human
ccccuuccuuggacuuuccc

SEQ ID NO: 801247 - RNA, 20 nt, Human
ccccuuccuuggacuuuccc

SEQ ID NO: 801248 - RNA, 21 nt, Human
cccgccccuucggccgcuagg

SEQ ID NO: 801249 - RNA, 18 nt, Human
cccgccuccccggccccg

SEQ ID NO: 801250 - RNA, 21 nt, Human
cccggccccgcccgccauggc

SEQ ID NO: 801251 - RNA, 23 nt, Human
cccggguucaagugauucuccuc

SEQ ID NO: 801252 - RNA, 23 nt, Human
cccggguucaagugauucuccug

SEQ ID NO: 801253 - RNA, 18 nt, Human
cccugaggacuugaagag

SEQ ID NO: 801254 - RNA, 24 nt, Human
ccgccucccggguucaagugauuc

SEQ ID NO: 801255 - RNA, 19 nt, Human
ccuauagcaccagcuccag

SEQ ID NO: 801256 - RNA, 18 nt, Human
ccuauagcaccagcuccg

SEQ ID NO: 801257 - RNA, 19 nt, Human
ccucacuccccugcucaaa

SEQ ID NO: 801258 - RNA, 24 nt, Human
ccucacugcaaacuccgccucccg

SEQ ID NO: 801259 - RNA, 25 nt, Human
ccuccaacuuccacucagauauuuc

SEQ ID NO: 801260 - RNA, 21 nt, Human
ccuccauuucaggcuccugag

SEQ ID NO: 801261 - RNA, 24 nt, Human
ccuccauuucaggcuccugaguag

SEQ ID NO: 801262 - RNA, 25 nt, Human
ccucccaccucggccccccaaguaa

SEQ ID NO: 801263 - RNA, 20 nt, Human
ccuccccggccccgcccgcc

SEQ ID NO: 801264 - RNA, 20 nt, Human
ccuccgggucccgcgccgcg

SEQ ID NO: 801265 - RNA, 25 nt, Human
ccuccucugcccccaccacccgagg

SEQ ID NO: 801266 - RNA, 24 nt, Human
ccuccucugcccccaccacccggg

SEQ ID NO: 801267 - RNA, 23 nt, Human
ccucgcuccaagcccgccucccc

SEQ ID NO: 801268 - RNA, 24 nt, Human
ccucgcucuguugcacaggcugga

SEQ ID NO: 801269 - RNA, 21 nt, Human
ccucugccuccugggcacaaa

SEQ ID NO: 801270 - RNA, 19 nt, Human
ccugaauagcugggauuac

SEQ ID NO: 801271 - RNA, 21 nt, Human
ccugcagucccagcuaauugg

SEQ ID NO: 801272 - RNA, 19 nt, Human
ccugccacagccuccuaag

SEQ ID NO: 801273 - RNA, 20 nt, Human
ccugccccacacuaucccac

SEQ ID NO: 801274 - RNA, 27 nt, Human
ccugccccacacuaucccacucacccu

SEQ ID NO: 801275 - RNA, 24 nt, Human
ccugccucagccuccugaauagcu

SEQ ID NO: 801276 - RNA, 20 nt, Human
ccugcgcgccaccaucuugc

SEQ ID NO: 801277 - RNA, 20 nt, Human
ccugggcagccucagagccu

SEQ ID NO: 801278 - RNA, 20 nt, Human
ccugggcagccucagagccu

SEQ ID NO: 801279 - RNA, 22 nt, Human
ccuguagacaacugaggccaga

SEQ ID NO: 801280 - RNA, 19 nt, Human
ccuuagauggggaggggac

SEQ ID NO: 801281 - RNA, 24 nt, Human
cgaacuccugagcuccaguaaucu

SEQ ID NO: 801282 - RNA, 22 nt, Human
cgagaccccgcgagcccgcccc

SEQ ID NO: 801283 - RNA, 24 nt, Human
cgagaccccgcgagcccgccccuu

SEQ ID NO: 801284 - RNA, 26 nt, Human
cgaggcaggcagaccacccgagguca

SEQ ID NO: 801285 - RNA, 18 nt, Human
cgccgggaguugcgguuc

SEQ ID NO: 801286 - RNA, 24 nt, Human
cgccugcagucccagcuaauuggg

SEQ ID NO: 801287 - RNA, 21 nt, Human
cggaauggggggaugaagggg

SEQ ID NO: 801288 - RNA, 26 nt, Human
cggccccccaaguaacugggaccuuu

SEQ ID NO: 801289 - RNA, 22 nt, Human
cgggacuccaagccaagaacuu

SEQ ID NO: 801290 - RNA, 22 nt, Human
cgggacuccaagccaagagcuu

SEQ ID NO: 801291 - RNA, 24 nt, Human
cgggaucacaggcgugagccacca

SEQ ID NO: 801292 - RNA, 22 nt, Human
cgucccaacugucugcgccuau

SEQ ID NO: 801293 - RNA, 23 nt, Human
cguggugagaugcccauuaggcc

SEQ ID NO: 801294 - RNA, 23 nt, Human
cucaaaaaaaaaaaaaaaaaaaa

SEQ ID NO: 801295 - RNA, 20 nt, Human
cucaaagguaggaauaacaa

SEQ ID NO: 801296 - RNA, 18 nt, Human
cucaagcaaaucuuggga

SEQ ID NO: 801297 - RNA, 18 nt, Human
cucaagcaaaucuuggga

SEQ ID NO: 801298 - RNA, 21 nt, Human
cucaagcaguucuccugccac

SEQ ID NO: 801299 - RNA, 24 nt, Human
cucaagcgauccucccaccucggc

SEQ ID NO: 801300 - RNA, 21 nt, Human
cucaaugaaacucugugacaa

SEQ ID NO: 801301 - RNA, 21 nt, Human
cucaaugaaacucugugacaa

SEQ ID NO: 801302 - RNA, 24 nt, Human
cucacgccuguuaauuccaaccuu

SEQ ID NO: 801303 - RNA, 24 nt, Human
cucacugcgaccucugccuccugg

SEQ ID NO: 801304 - RNA, 24 nt, Human
cucaugccuguaacuccaacacuu

SEQ ID NO: 801305 - RNA, 20 nt, Human
cuccaaacccaagcacugca

SEQ ID NO: 801306 - RNA, 18 nt, Human
cuccaguaaucuuccugc

SEQ ID NO: 801307 - RNA, 22 nt, Human
cucccagaaccgugcuccccaa

SEQ ID NO: 801308 - RNA, 22 nt, Human
cucccagaaccgugcuccccaa

SEQ ID NO: 801309 - RNA, 22 nt, Human
cucccggcgaugcuggccgccu

SEQ ID NO: 801310 - RNA, 20 nt, Human
cucccggguucaagugauuc

SEQ ID NO: 801311 - RNA, 24 nt, Human
cuccuaaggagcuaggacuacagg

SEQ ID NO: 801312 - RNA, 25 nt, Human
cuccuaggcucaagcaguucuccug

SEQ ID NO: 801313 - RNA, 24 nt, Human
cuccugaauagcugggauuacaag

SEQ ID NO: 801314 - RNA, 24 nt, Human
cucgcucuguugcacaggcuggag

SEQ ID NO: 801315 - RNA, 22 nt, Human
cucggccccuggaaaaagcagg

SEQ ID NO: 801316 - RNA, 22 nt, Human
cucggccccuggaaaaagcagg

SEQ ID NO: 801317 - RNA, 24 nt, Human
cucucaaaauaacugaaaaagcaa

SEQ ID NO: 801318 - RNA, 19 nt, Human
cucucaggccgaccuggcu

SEQ ID NO: 801319 - RNA, 19 nt, Human
cucucaggccgaccuggcu

SEQ ID NO: 801320 - RNA, 24 nt, Human
cucuuccauucaaauaagcuccaa

SEQ ID NO: 801321 - RNA, 22 nt, Human
cugcagcuggacucaaugaaac

SEQ ID NO: 801322 - RNA, 22 nt, Human
cugcagcuggacucaaugaaac

SEQ ID NO: 801323 - RNA, 24 nt, Human
cugcggagguugcagugagcugag

SEQ ID NO: 801324 - RNA, 19 nt, Human
cugcuuauagaguggagga

SEQ ID NO: 801325 - RNA, 19 nt, Human
cugcuuauagaguggagga

SEQ ID NO: 801326 - RNA, 25 nt, Human
cuggauauaugccuccaggcauccc

SEQ ID NO: 801327 - RNA, 19 nt, Human
cuggcaacccuucccacaa

SEQ ID NO: 801328 - RNA, 19 nt, Human
cuggcaacccuucccacaa

SEQ ID NO: 801329 - RNA, 24 nt, Human
cuggcugcggagguugcagugagc

SEQ ID NO: 801330 - RNA, 22 nt, Human
cugggcuagccucaagcaaauc

SEQ ID NO: 801331 - RNA, 22 nt, Human
cugggcuagccucaagcaaauc

SEQ ID NO: 801332 - RNA, 23 nt, Human
cuggguccuuccugccugacaga

SEQ ID NO: 801333 - RNA, 23 nt, Human
cuggguccuuccugccugacaga

SEQ ID NO: 801334 - RNA, 21 nt, Human
cuuggcgaugagaugaagaaa

SEQ ID NO: 801335 - RNA, 21 nt, Human
cuuggcgaugagaugaagaaa

SEQ ID NO: 801336 - RNA, 23 nt, Human
cuugugcccaggaguucaagacc

SEQ ID NO: 801337 - RNA, 23 nt, Human
gaaaauaauccucuggucaugga

SEQ ID NO: 801338 - RNA, 23 nt, Human
gaaaauaauccucuggucaugga

SEQ ID NO: 801339 - RNA, 21 nt, Human
gaacaaacugaccucuuccau

SEQ ID NO: 801340 - RNA, 20 nt, Human
gaagagugccuucaggaugg

SEQ ID NO: 801341 - RNA, 25 nt, Human
gaauagcugggauuacaagcgccca

SEQ ID NO: 801342 - RNA, 22 nt, Human
gaccacccgaggucaggauuuc

SEQ ID NO: 801343 - RNA, 19 nt, Human
gacccaagcagccuccccc

SEQ ID NO: 801344 - RNA, 19 nt, Human
gaccccgcgagcccgcccc

SEQ ID NO: 801345 - RNA, 22 nt, Human
gacuacaggcguguaccaccau

SEQ ID NO: 801346 - RNA, 18 nt, Human
gacugcaggagaggggcc

SEQ ID NO: 801347 - RNA, 23 nt, Human
gagauagugccacugcacuccag

SEQ ID NO: 801348 - RNA, 24 nt, Human
gagcacacuuggguucaggagggg

SEQ ID NO: 801349 - RNA, 21 nt, Human
gagccaccaugcuggccccaa

SEQ ID NO: 801350 - RNA, 21 nt, Human
gagccugcacacugaagcugg

SEQ ID NO: 801351 - RNA, 20 nt, Human
gagcucccagaaccgugcuc

SEQ ID NO: 801352 - RNA, 20 nt, Human
gagcucccagaaccgugcuc

SEQ ID NO: 801353 - RNA, 20 nt, Human
gaggaaacggaaugggggga

SEQ ID NO: 801354 - RNA, 20 nt, Human
gaggaggcaaacaggucccc

SEQ ID NO: 801355 - RNA, 20 nt, Human
gaggaggcaaacaggucccc

SEQ ID NO: 801356 - RNA, 23 nt, Human
gaggcaugggaaguggaggagga

SEQ ID NO: 801357 - RNA, 23 nt, Human
gaggcaugggaaguggaggagga

SEQ ID NO: 801358 - RNA, 18 nt, Human
gaggccuggagccacugg

SEQ ID NO: 801359 - RNA, 21 nt, Human
gagguugcagugagcugagau

SEQ ID NO: 801360 - RNA, 20 nt, Human
gaguggaggaggcaaacagg

SEQ ID NO: 801361 - RNA, 20 nt, Human
gaguggaggaggcaaacagg

SEQ ID NO: 801362 - RNA, 18 nt, Human
gaucacaggcgugagcca

SEQ ID NO: 801363 - RNA, 24 nt, Human
gaucacaggcgugagccaccaugc

SEQ ID NO: 801364 - RNA, 18 nt, Human
gaucacuugugcccagga

SEQ ID NO: 801365 - RNA, 24 nt, Human
gaucacuugugcccaggaguucaa

SEQ ID NO: 801366 - RNA, 21 nt, Human
gauucuccugccucagccucc

SEQ ID NO: 801367 - RNA, 21 nt, Human
gcaaaaaacaaacaaacaaac

SEQ ID NO: 801368 - RNA, 22 nt, Human
gcaagccgaaagcagucgagac

SEQ ID NO: 801369 - RNA, 20 nt, Human
gcacaggcuggagugcagug

SEQ ID NO: 801370 - RNA, 24 nt, Human
gcacaggcuggagugcaguggcgu

SEQ ID NO: 801371 - RNA, 23 nt, Human
gcacuccagccuuggcaacagag

SEQ ID NO: 801372 - RNA, 21 nt, Human
gcagccucccccuccaacuuc

SEQ ID NO: 801373 - RNA, 21 nt, Human
gcccccaaacaccucccggcg

SEQ ID NO: 801374 - RNA, 18 nt, Human
gcccccucccagcaaaga

SEQ ID NO: 801375 - RNA, 21 nt, Human
gccucccccuccaacuuccac

SEQ ID NO: 801376 - RNA, 25 nt, Human
gccucccggguucaagugauucucc

SEQ ID NO: 801377 - RNA, 21 nt, Human
gcgaggcagcucgcucuccuu

SEQ ID NO: 801378 - RNA, 21 nt, Human
gcgaucugccugccucggccu

SEQ ID NO: 801379 - RNA, 18 nt, Human
gcggagguugcagugagc

SEQ ID NO: 801380 - RNA, 19 nt, Human
gcgguucggcgccggcgcg

SEQ ID NO: 801381 - RNA, 22 nt, Human
gcucaagcgauccucccaccuc

SEQ ID NO: 801382 - RNA, 19 nt, Human
gcugaagugcaguggcaug

SEQ ID NO: 801383 - RNA, 19 nt, Human
gcuggagugcaguggcgug

SEQ ID NO: 801384 - RNA, 18 nt, Human
gcugggcgugguggcuca

SEQ ID NO: 801385 - RNA, 21 nt, Human
gcugggcgugguggcucacgc

SEQ ID NO: 801386 - RNA, 23 nt, Human
ggaaacaugagucucugguuuuu

SEQ ID NO: 801387 - RNA, 23 nt, Human
ggaaacaugagucucugguuuuu

SEQ ID NO: 801388 - RNA, 24 nt, Human
ggaagcucuuuaucccuggcaacc

SEQ ID NO: 801389 - RNA, 24 nt, Human
ggaagcucuuuaucccuggcaacc

SEQ ID NO: 801390 - RNA, 22 nt, Human
ggacaagaggcaugagccacca

SEQ ID NO: 801391 - RNA, 20 nt, Human
ggacccccggccgccgccag

SEQ ID NO: 801392 - RNA, 22 nt, Human
ggacuacaggcguguaccacca

SEQ ID NO: 801393 - RNA, 24 nt, Human
ggacuacaggcguguaccaccaug

SEQ ID NO: 801394 - RNA, 21 nt, Human
ggagaacuuccucugggugga

SEQ ID NO: 801395 - RNA, 23 nt, Human
ggagcaguggcucaugccuguaa

SEQ ID NO: 801396 - RNA, 23 nt, Human
ggaggaggcaaacagguccccuc

SEQ ID NO: 801397 - RNA, 23 nt, Human
ggaggaggcaaacagguccccuc

SEQ ID NO: 801398 - RNA, 22 nt, Human
ggagguugcagugagcugagau

SEQ ID NO: 801399 - RNA, 23 nt, Human
ggagguugcagugagcugagaua

SEQ ID NO: 801400 - RNA, 24 nt, Human
ggagguugcagugagcugagauag

SEQ ID NO: 801401 - RNA, 24 nt, Human
ggaucacaggcgugagccaccaug

SEQ ID NO: 801402 - RNA, 18 nt, Human
ggaucacuugagucuggc

SEQ ID NO: 801403 - RNA, 23 nt, Human
ggaucacuugugcccaggaguuc

SEQ ID NO: 801404 - RNA, 19 nt, Human
ggcaacuucaaauguggug

SEQ ID NO: 801405 - RNA, 18 nt, Human
ggccgaggggagaggguu

SEQ ID NO: 801406 - RNA, 19 nt, Human
ggccgcuagggagcgacga

SEQ ID NO: 801407 - RNA, 22 nt, Human
ggccguggugagaugcccauua

SEQ ID NO: 801408 - RNA, 20 nt, Human
ggcggcuacacaaaaccagg

SEQ ID NO: 801409 - RNA, 19 nt, Human
ggcuacacaaaaccagggu

SEQ ID NO: 801410 - RNA, 22 nt, Human
ggcuggagugcaguggcgugau

SEQ ID NO: 801411 - RNA, 21 nt, Human
ggcugggcgugguggcucacg

SEQ ID NO: 801412 - RNA, 20 nt, Human
ggcuggucucaaacuccuga

SEQ ID NO: 801413 - RNA, 20 nt, Human
gggacccaccauuuacuggg

SEQ ID NO: 801414 - RNA, 22 nt, Human
gggagggcucacaacacagccc

SEQ ID NO: 801415 - RNA, 23 nt, Human
gggaucacaggcgugagccacca

SEQ ID NO: 801416 - RNA, 22 nt, Human
gggcacaggaccccaccuucug

SEQ ID NO: 801417 - RNA, 25 nt, Human
gggcgugguggcucacgccuguuaa

SEQ ID NO: 801418 - RNA, 22 nt, Human
ggguucaagugauucuccugcc

SEQ ID NO: 801419 - RNA, 23 nt, Human
ggguucaagugauucuccugccu

SEQ ID NO: 801420 - RNA, 22 nt, Human
gguagcaucuggcacugucucc

SEQ ID NO: 801421 - RNA, 18 nt, Human
gguggggagcaguggcuc

SEQ ID NO: 801422 - RNA, 21 nt, Human
ggugugcgccuauagucccag

SEQ ID NO: 801423 - RNA, 18 nt, Human
gguuggaggaggaggcag

SEQ ID NO: 801424 - RNA, 20 nt, Human
gucaguuuuuccuuagaugg

SEQ ID NO: 801425 - RNA, 20 nt, Human
guccacuucagcaggggggu

SEQ ID NO: 801426 - RNA, 22 nt, Human
gucucgaacuccugagcuccag

SEQ ID NO: 801427 - RNA, 24 nt, Human
gugauucuccugccucagccuccu

SEQ ID NO: 801428 - RNA, 21 nt, Human
gugggaggaaugucuuccagc

SEQ ID NO: 801429 - RNA, 21 nt, Human
gugggaggaaugucuuccagc

SEQ ID NO: 801430 - RNA, 22 nt, Human
guggugagaugcccauuaggcc

SEQ ID NO: 801431 - RNA, 24 nt, Human
guugcagugagcugagauagugcc

SEQ ID NO: 801432 - RNA, 20 nt, Human
uaaaaagcagcauucuuuaa

SEQ ID NO: 801433 - RNA, 20 nt, Human
uaaaaagcagcauucuuuaa

SEQ ID NO: 801434 - RNA, 23 nt, Human
uaaaaagcagcauucuuuaaaga

SEQ ID NO: 801435 - RNA, 23 nt, Human
uaaaaagcagcauucuuuaaaga

SEQ ID NO: 801436 - RNA, 20 nt, Human
uaaagaacugcaaguggagc

SEQ ID NO: 801437 - RNA, 20 nt, Human
uaaagaacugcaaguggagc

SEQ ID NO: 801438 - RNA, 19 nt, Human
uaaccuccucccugguauc

SEQ ID NO: 801439 - RNA, 20 nt, Human
uaagaacuuauccaaaucac

SEQ ID NO: 801440 - RNA, 21 nt, Human
uaagcuccaaacccaagcacu

SEQ ID NO: 801441 - RNA, 26 nt, Human
uaagcuccaaacccaagcacugcaca

SEQ ID NO: 801442 - RNA, 25 nt, Human
uaauuuuuguaauuuuuaguagaga

SEQ ID NO: 801443 - RNA, 27 nt, Human
uaauuuuuguaauuuuuaguagagaca

SEQ ID NO: 801444 - RNA, 21 nt, Human
uacacaaaaccaggguguggu

SEQ ID NO: 801445 - RNA, 20 nt, Human
uacacacaaaggaaaggcag

SEQ ID NO: 801446 - RNA, 20 nt, Human
uacacacaaaggaaaggcag

SEQ ID NO: 801447 - RNA, 22 nt, Human
uaccaccaugccuggcucauuu

SEQ ID NO: 801448 - RNA, 21 nt, Human
uaccacguugguuaggcuggu

SEQ ID NO: 801449 - RNA, 24 nt, Human
uaccacguugguuaggcuggucuc

SEQ ID NO: 801450 - RNA, 20 nt, Human
uacugggcaucugucaugag

SEQ ID NO: 801451 - RNA, 18 nt, Human
uagacaacugaggccaga

SEQ ID NO: 801452 - RNA, 22 nt, Human
uagagacaggguuuuaccacgu

SEQ ID NO: 801453 - RNA, 22 nt, Human
uagagaccaggucuugcuaugu

SEQ ID NO: 801454 - RNA, 25 nt, Human
uagaggcaugggaaguggaggagga

SEQ ID NO: 801455 - RNA, 25 nt, Human
uagaggcaugggaaguggaggagga

SEQ ID NO: 801456 - RNA, 21 nt, Human
uaggacuacaggcguguacca

SEQ ID NO: 801457 - RNA, 24 nt, Human
uaggacuacaggcguguaccacca

SEQ ID NO: 801458 - RNA, 22 nt, Human
uaggcaacuucaaauguggugu

SEQ ID NO: 801459 - RNA, 19 nt, Human
uaguagagacaggguuuua

SEQ ID NO: 801460 - RNA, 24 nt, Human
uaguagagacaggguuuuaccacg

SEQ ID NO: 801461 - RNA, 19 nt, Human
uauaguggcaugaucacag

SEQ ID NO: 801462 - RNA, 21 nt, Human
uauauugcccaagcuggucuc

SEQ ID NO: 801463 - RNA, 24 nt, Human
uauauugcccaagcuggucucgaa

SEQ ID NO: 801464 - RNA, 22 nt, Human
uaucccacucacccuggcaagu

SEQ ID NO: 801465 - RNA, 22 nt, Human
uaucccuggcaacccuucccac

SEQ ID NO: 801466 - RNA, 22 nt, Human
uaucccuggcaacccuucccac

SEQ ID NO: 801467 - RNA, 22 nt, Human
uaugcuggggaaacaccuugcc

SEQ ID NO: 801468 - RNA, 22 nt, Human
uaugcuggggaaacaccuugcc

SEQ ID NO: 801469 - RNA, 18 nt, Human
uauguggcccaggcugug

SEQ ID NO: 801470 - RNA, 20 nt, Human
uauuacacaaugugagaagc

SEQ ID NO: 801471 - RNA, 23 nt, Human
ucaaaaaaaaaaaaaaaaaaaaa

SEQ ID NO: 801472 - RNA, 23 nt, Human
ucaaacuccugauuucaugcgau

SEQ ID NO: 801473 - RNA, 23 nt, Human
ucaaagcuugauuuugaauucug

SEQ ID NO: 801474 - RNA, 19 nt, Human
ucaaauccuggguccuucc

SEQ ID NO: 801475 - RNA, 19 nt, Human
ucaaauccuggguccuucc

SEQ ID NO: 801476 - RNA, 19 nt, Human
ucaagugauucuccugccu

SEQ ID NO: 801477 - RNA, 22 nt, Human
ucacgccuguuaauuccaaccu

SEQ ID NO: 801478 - RNA, 18 nt, Human
ucacugcaaacuccgccu

SEQ ID NO: 801479 - RNA, 24 nt, Human
ucacugcaaacuccgccucccggg

SEQ ID NO: 801480 - RNA, 24 nt, Human
ucacugcgaccucugccuccuggg

SEQ ID NO: 801481 - RNA, 25 nt, Human
ucacugcgaccucugccuccugggc

SEQ ID NO: 801482 - RNA, 18 nt, Human
ucacugggcuagccucaa

SEQ ID NO: 801483 - RNA, 18 nt, Human
ucacugggcuagccucaa

SEQ ID NO: 801484 - RNA, 23 nt, Human
ucacuugugcccaggaguucaag

SEQ ID NO: 801485 - RNA, 23 nt, Human
ucagccaggcauggugaugcacg

SEQ ID NO: 801486 - RNA, 19 nt, Human
ucaucucauuccaccucgc

SEQ ID NO: 801487 - RNA, 22 nt, Human
uccaaacccaagcacugcacaa

SEQ ID NO: 801488 - RNA, 23 nt, Human
uccagauaagaaaucagcuuggg

SEQ ID NO: 801489 - RNA, 23 nt, Human
uccagauaagaaaucagcuuggg

SEQ ID NO: 801490 - RNA, 23 nt, Human
uccagccuuggcaacagagugag

SEQ ID NO: 801491 - RNA, 24 nt, Human
uccagccuuggcaacagagugaga

SEQ ID NO: 801492 - RNA, 19 nt, Human
uccagcucugccagccugg

SEQ ID NO: 801493 - RNA, 19 nt, Human
uccagcucugccagccugg

SEQ ID NO: 801494 - RNA, 19 nt, Human
uccagcugcuaacgagaag

SEQ ID NO: 801495 - RNA, 19 nt, Human
uccagcugcuaacgagaag

SEQ ID NO: 801496 - RNA, 20 nt, Human
uccaggcucaagcgauccuc

SEQ ID NO: 801497 - RNA, 24 nt, Human
ucccaaagugcugggacaagaggc

SEQ ID NO: 801498 - RNA, 23 nt, Human
ucccacaaucaggggucuccagu

SEQ ID NO: 801499 - RNA, 23 nt, Human
ucccacaaucaggggucuccagu

SEQ ID NO: 801500 - RNA, 23 nt, Human
ucccacuguacuuaaaagccaaa

SEQ ID NO: 801501 - RNA, 20 nt, Human
ucccagguccucaggaggcc

SEQ ID NO: 801502 - RNA, 19 nt, Human
ucccaguaccugaaaaacc

SEQ ID NO: 801503 - RNA, 21 nt, Human
uccccacccaggcaccuccac

SEQ ID NO: 801504 - RNA, 21 nt, Human
uccccacccaggcaccuccac

SEQ ID NO: 801505 - RNA, 18 nt, Human
uccccagcaccccgccuu

SEQ ID NO: 801506 - RNA, 21 nt, Human
ucccggguucaagugauucuc

SEQ ID NO: 801507 - RNA, 24 nt, Human
ucccggguucaagugauucuccug

SEQ ID NO: 801508 - RNA, 19 nt, Human
ucccucaguccugggccag

SEQ ID NO: 801509 - RNA, 18 nt, Human
ucccugcaagauuaaaac

SEQ ID NO: 801510 - RNA, 21 nt, Human
ucccuggcaacccuucccaca

SEQ ID NO: 801511 - RNA, 21 nt, Human
ucccuggcaacccuucccaca

SEQ ID NO: 801512 - RNA, 20 nt, Human
ucccugguaucugcuuccuu

SEQ ID NO: 801513 - RNA, 19 nt, Human
ucccuugacuccuccuccu

SEQ ID NO: 801514 - RNA, 19 nt, Human
ucccuugacuccuccuccu

SEQ ID NO: 801515 - RNA, 21 nt, Human
uccuaggcucaagcaguucuc

SEQ ID NO: 801516 - RNA, 24 nt, Human
uccuaggcucaagcaguucuccug

SEQ ID NO: 801517 - RNA, 18 nt, Human
uccucccaccucggcccc

SEQ ID NO: 801518 - RNA, 24 nt, Human
uccucugcccccacuucuggcugc

SEQ ID NO: 801519 - RNA, 23 nt, Human
uccugcgcgccaccaucuugcca

SEQ ID NO: 801520 - RNA, 19 nt, Human
uccuuagauggggagggga

SEQ ID NO: 801521 - RNA, 18 nt, Human
ucgagaccccgcgagccc

SEQ ID NO: 801522 - RNA, 24 nt, Human
ucgucccaacugucugcgccuauu

SEQ ID NO: 801523 - RNA, 20 nt, Human
ucuaaaucagaaagcugaga

SEQ ID NO: 801524 - RNA, 19 nt, Human
ucucaaaaaaaaaaaaaaa

SEQ ID NO: 801525 - RNA, 19 nt, Human
ucucacucugucacccagg

SEQ ID NO: 801526 - RNA, 24 nt, Human
ucucacucugucacccaggcugaa

SEQ ID NO: 801527 - RNA, 26 nt, Human
ucucacucugucacccaggcugaagu

SEQ ID NO: 801528 - RNA, 27 nt, Human
ucucacucugucacccaggcugaagug

SEQ ID NO: 801529 - RNA, 18 nt, Human
ucucacuguguugcccag

SEQ ID NO: 801530 - RNA, 24 nt, Human
ucucacuguguugcccaggaugga

SEQ ID NO: 801531 - RNA, 18 nt, Human
ucucaggccgaccuggcu

SEQ ID NO: 801532 - RNA, 18 nt, Human
ucucaggccgaccuggcu

SEQ ID NO: 801533 - RNA, 20 nt, Human
ucuccucccggucucccaag

SEQ ID NO: 801534 - RNA, 20 nt, Human
ucuccucccggucucccaag

SEQ ID NO: 801535 - RNA, 24 nt, Human
ucuccugccucagccuccugaaua

SEQ ID NO: 801536 - RNA, 22 nt, Human
ucucugugggccguggugagau

SEQ ID NO: 801537 - RNA, 21 nt, Human
ucuggagaacuuccucugggu

SEQ ID NO: 801538 - RNA, 20 nt, Human
ucuggcugcggagguugcag

SEQ ID NO: 801539 - RNA, 18 nt, Human
ucugggcggagacgacac

SEQ ID NO: 801540 - RNA, 18 nt, Human
ucuggguggagacgacac

SEQ ID NO: 801541 - RNA, 18 nt, Human
ucuggucauggauggaug

SEQ ID NO: 801542 - RNA, 18 nt, Human
ucuggucauggauggaug

SEQ ID NO: 801543 - RNA, 24 nt, Human
ucugucacccaggcugaagugcag

SEQ ID NO: 801544 - RNA, 24 nt, Human
ucuguugcacaggcuggagugcag

SEQ ID NO: 801545 - RNA, 18 nt, Human
ucuuaaugccccuuccuc

SEQ ID NO: 801546 - RNA, 18 nt, Human
ucuuaaugccccuuccuc

SEQ ID NO: 801547 - RNA, 19 nt, Human
ucuugcuauguggcccagg

SEQ ID NO: 801548 - RNA, 21 nt, Human
ugaaaagcuuaauacacacaa

SEQ ID NO: 801549 - RNA, 21 nt, Human
ugaaaagcuuaauacacacaa

SEQ ID NO: 801550 - RNA, 24 nt, Human
ugaaaagcuuaauacacacaaagg

SEQ ID NO: 801551 - RNA, 24 nt, Human
ugaaaagcuuaauacacacaaagg

SEQ ID NO: 801552 - RNA, 18 nt, Human
ugaaacagauguaacucu

SEQ ID NO: 801553 - RNA, 20 nt, Human
ugaagcaggaggaucacuug

SEQ ID NO: 801554 - RNA, 24 nt, Human
ugaagcaggaggaucacuugugcc

SEQ ID NO: 801555 - RNA, 26 nt, Human
ugaagcaggaggaucacuugugccca

SEQ ID NO: 801556 - RNA, 19 nt, Human
ugaagugcaguggcaugau

SEQ ID NO: 801557 - RNA, 24 nt, Human
ugaagugcaguggcaugaugaugg

SEQ ID NO: 801558 - RNA, 25 nt, Human
ugaauaggcagugugagagaaaucc

SEQ ID NO: 801559 - RNA, 22 nt, Human
ugaccccaggaguuugaaacca

SEQ ID NO: 801560 - RNA, 22 nt, Human
ugagacagaaucucacucuguc

SEQ ID NO: 801561 - RNA, 22 nt, Human
ugagacagagccucgcucuguu

SEQ ID NO: 801562 - RNA, 21 nt, Human
ugagacucucaaaauaacuga

SEQ ID NO: 801563 - RNA, 18 nt, Human
ugagagaaauccaggaug

SEQ ID NO: 801564 - RNA, 24 nt, Human
ugagagaaauccaggauggcugcu

SEQ ID NO: 801565 - RNA, 24 nt, Human
ugagaggcugaagcaggaggauca

SEQ ID NO: 801566 - RNA, 19 nt, Human
ugagagggaggauaaagcc

SEQ ID NO: 801567 - RNA, 18 nt, Human
ugagaugcccauuaggcc

SEQ ID NO: 801568 - RNA, 18 nt, Human
ugagcccccggcucccag

SEQ ID NO: 801569 - RNA, 18 nt, Human
ugagcccccggcucccag

SEQ ID NO: 801570 - RNA, 22 nt, Human
ugagcugagauagugccacugc

SEQ ID NO: 801571 - RNA, 19 nt, Human
ugaggacuugaagagugcc

SEQ ID NO: 801572 - RNA, 23 nt, Human
ugaggacuugaagagugccuuca

SEQ ID NO: 801573 - RNA, 20 nt, Human
ugaggccuggagccacuggg

SEQ ID NO: 801574 - RNA, 19 nt, Human
ugaggugggaggaucacuu

SEQ ID NO: 801575 - RNA, 20 nt, Human
ugaggugggaggaucacuug

SEQ ID NO: 801576 - RNA, 22 nt, Human
ugaggugggaggaucacuugag

SEQ ID NO: 801577 - RNA, 22 nt, Human
ugaggugggaggaucacuugag

SEQ ID NO: 801578 - RNA, 23 nt, Human
ugaggugggaggaucacuugagu

SEQ ID NO: 801579 - RNA, 19 nt, Human
ugagucucugguuuuuuuc

SEQ ID NO: 801580 - RNA, 23 nt, Human
ugcaaguggagcaccaccaggcc

SEQ ID NO: 801581 - RNA, 23 nt, Human
ugcaaguggagcaccaccaggcc

SEQ ID NO: 801582 - RNA, 24 nt, Human
ugcaaguggagcaccaccaggccc

SEQ ID NO: 801583 - RNA, 24 nt, Human
ugcaaguggagcaccaccaggccc

SEQ ID NO: 801584 - RNA, 24 nt, Human
ugcacaggcuggagugcaguggcg

SEQ ID NO: 801585 - RNA, 23 nt, Human
ugcaguggcaugaugauggcuca

SEQ ID NO: 801586 - RNA, 24 nt, Human
ugccacagccuccuaaggagcuag

SEQ ID NO: 801587 - RNA, 21 nt, Human
ugccacuagugaggccuggag

SEQ ID NO: 801588 - RNA, 21 nt, Human
ugccacuagugaggccuggag

SEQ ID NO: 801589 - RNA, 24 nt, Human
ugcccaagcuggucucgaacuccu

SEQ ID NO: 801590 - RNA, 20 nt, Human
ugccccacacuaucccacuc

SEQ ID NO: 801591 - RNA, 22 nt, Human
ugccccacacuaucccacucac

SEQ ID NO: 801592 - RNA, 19 nt, Human
ugccccgcccccucgcucc

SEQ ID NO: 801593 - RNA, 24 nt, Human
ugccgggaucacaggcgugagcca

SEQ ID NO: 801594 - RNA, 24 nt, Human
ugccgucucacuguguugcccagg

SEQ ID NO: 801595 - RNA, 18 nt, Human
ugccucacuccccugcuc

SEQ ID NO: 801596 - RNA, 24 nt, Human
ugccucagcaucccaaagugcugg

SEQ ID NO: 801597 - RNA, 27 nt, Human
ugccucagccuccugaauagcugggau

SEQ ID NO: 801598 - RNA, 23 nt, Human
ugccuccaggcaucccugaccac

SEQ ID NO: 801599 - RNA, 22 nt, Human
ugccucggccuuccaaagugcc

SEQ ID NO: 801600 - RNA, 21 nt, Human
ugcggagguugcagugagcug

SEQ ID NO: 801601 - RNA, 18 nt, Human
ugcuaacgagaagucugc

SEQ ID NO: 801602 - RNA, 18 nt, Human
ugcuaacgagaagucugc

SEQ ID NO: 801603 - RNA, 18 nt, Human
ugcuugaccccaggaguu

SEQ ID NO: 801604 - RNA, 22 nt, Human
uggaaacaugagucucugguuu

SEQ ID NO: 801605 - RNA, 22 nt, Human
uggaaacaugagucucugguuu

SEQ ID NO: 801606 - RNA, 18 nt, Human
uggagcaccaccaggccc

SEQ ID NO: 801607 - RNA, 18 nt, Human
uggagcaccaccaggccc

SEQ ID NO: 801608 - RNA, 22 nt, Human
uggagccacuggggagaggaca

SEQ ID NO: 801609 - RNA, 22 nt, Human
uggagccacuggggagaggaca

SEQ ID NO: 801610 - RNA, 19 nt, Human
uggaguauaguggcaugau

SEQ ID NO: 801611 - RNA, 23 nt, Human
uggagugcaguggcgugauuuca

SEQ ID NO: 801612 - RNA, 21 nt, Human
uggaguucucuguucccggga

SEQ ID NO: 801613 - RNA, 19 nt, Human
uggcagagucacaucuggu

SEQ ID NO: 801614 - RNA, 20 nt, Human
uggcaugaucacagcucacu

SEQ ID NO: 801615 - RNA, 21 nt, Human
uggcaugaugauggcucacua

SEQ ID NO: 801616 - RNA, 22 nt, Human
uggcaugaugauggcucacuag

SEQ ID NO: 801617 - RNA, 22 nt, Human
uggcucacgccuguuaauucca

SEQ ID NO: 801618 - RNA, 21 nt, Human
uggcucaugccuguaacucca

SEQ ID NO: 801619 - RNA, 23 nt, Human
uggcucaugccuguaacuccaac

SEQ ID NO: 801620 - RNA, 23 nt, Human
uggcugggcgugguggcucacgc

SEQ ID NO: 801621 - RNA, 24 nt, Human
ugggacaagaggcaugagccacca

SEQ ID NO: 801622 - RNA, 21 nt, Human
ugggaccauaggugcaugcca

SEQ ID NO: 801623 - RNA, 24 nt, Human
ugggaccauaggugcaugccacca

SEQ ID NO: 801624 - RNA, 20 nt, Human
ugggaggaaugucuuccagc

SEQ ID NO: 801625 - RNA, 20 nt, Human
ugggaggaaugucuuccagc

SEQ ID NO: 801626 - RNA, 20 nt, Human
ugggaggaaugucuuccagg

SEQ ID NO: 801627 - RNA, 20 nt, Human
ugggaggaaugucuuccagg

SEQ ID NO: 801628 - RNA, 19 nt, Human
ugggaggccgaggcaggca

SEQ ID NO: 801629 - RNA, 20 nt, Human
ugggaggccgaggcaggcag

SEQ ID NO: 801630 - RNA, 24 nt, Human
ugggaggccgaggcaggcagacca

SEQ ID NO: 801631 - RNA, 19 nt, Human
ugggaggcugaggugggag

SEQ ID NO: 801632 - RNA, 24 nt, Human
ugggaggcugaggugggaggauca

SEQ ID NO: 801633 - RNA, 21 nt, Human
ugggauuacaagcgcccacca

SEQ ID NO: 801634 - RNA, 24 nt, Human
ugggauuacaagcgcccaccaccg

SEQ ID NO: 801635 - RNA, 23 nt, Human
ugggcagccucagagccugcaca

SEQ ID NO: 801636 - RNA, 23 nt, Human
ugggcagccucagagccugcaca

SEQ ID NO: 801637 - RNA, 24 nt, Human
uggguaucauagcaagaaucuguc

SEQ ID NO: 801638 - RNA, 22 nt, Human
uggucaaaguaguaacagagca

SEQ ID NO: 801639 - RNA, 25 nt, Human
ugguggcucacgccuguuaauucca

SEQ ID NO: 801640 - RNA, 24 nt, Human
ugguuaggcuggucucaaacuccu

SEQ ID NO: 801641 - RNA, 19 nt, Human
uguagagaccaggucuugc

SEQ ID NO: 801642 - RNA, 24 nt, Human
uguagagaccaggucuugcuaugu

SEQ ID NO: 801643 - RNA, 19 nt, Human
uguauacucagcugugugc

SEQ ID NO: 801644 - RNA, 21 nt, Human
ugucaugagcuaggcacuggg

SEQ ID NO: 801645 - RNA, 20 nt, Human
ugucugcgccuaugcugggg

SEQ ID NO: 801646 - RNA, 20 nt, Human
ugucugcgccuaugcugggg

SEQ ID NO: 801647 - RNA, 24 nt, Human
uguuuagcccaguaguucccaaac

SEQ ID NO: 801648 - RNA, 18 nt, Human
uuaguagagacaggguuu

SEQ ID NO: 801649 - RNA, 21 nt, Human
uucaagugauucuccugccuc

SEQ ID NO: 801650 - RNA, 23 nt, Human
uucaagugauucuccugccucag

SEQ ID NO: 801651 - RNA, 24 nt, Human
uucaagugauucuccugccucagc

SEQ ID NO: 801652 - RNA, 22 nt, Human
uucaccucacugcaaacuccgc

SEQ ID NO: 801653 - RNA, 19 nt, Human
uucacugggcuagccucaa

SEQ ID NO: 801654 - RNA, 21 nt, Human
uucagggacugccugggcucu

SEQ ID NO: 801655 - RNA, 21 nt, Human
uucagggacugccugggcucu

SEQ ID NO: 801656 - RNA, 22 nt, Human
uucauuacccaggguucaaauc

SEQ ID NO: 801657 - RNA, 20 nt, Human
uuccagauaagaaaucagcu

SEQ ID NO: 801658 - RNA, 23 nt, Human
uuccuuagauggggaggggaccc

SEQ ID NO: 801659 - RNA, 22 nt, Human
uugagacagagccucgcucugu

SEQ ID NO: 801660 - RNA, 25 nt, Human
uugagaggcugaagcaggaggauca

SEQ ID NO: 801661 - RNA, 23 nt, Human
uugagucuggcugcggagguugc

SEQ ID NO: 801662 - RNA, 21 nt, Human
uugcagugagcugagauagug

SEQ ID NO: 801663 - RNA, 22 nt, Human
uugcagugagcugagauagugc

SEQ ID NO: 801664 - RNA, 21 nt, Human
uugcuugaccccaggaguuug

SEQ ID NO: 801665 - RNA, 18 nt, Human
uuggaggaggaggcagag

SEQ ID NO: 801666 - RNA, 22 nt, Human
uuggcugggcgugguggcucac

SEQ ID NO: 801667 - RNA, 25 nt, Human
uugggaggcugaggugggaggauca

SEQ ID NO: 801668 - RNA, 23 nt, Human
uugggccaggaagggaaaagugu

SEQ ID NO: 801669 - RNA, 23 nt, Human
uugggccaggaagggaaaagugu

SEQ ID NO: 801670 - RNA, 21 nt, Human
uuggucauaagcuuugccuug

SEQ ID NO: 801671 - RNA, 24 nt, Human
uuguaaagauagggcuucacuaua

SEQ ID NO: 801672 - RNA, 19 nt, Human
uuuacugggcaucugucaa

SEQ ID NO: 801673 - RNA, 21 nt, Human
uuuuuguaauuuuuaguagag

SEQ ID NO: 801674 - RNA, 20 nt, Human
uuuuuucuuuugagacagag

SEQ ID NO: 801675 - RNA, 20 nt, Human
aaaaaaaaaaaaaaugccag

SEQ ID NO: 801676 - RNA, 25 nt, Human
aaaaaaaaaaaaaaugccaggcgca

SEQ ID NO: 801677 - RNA, 24 nt, Human
aaaaaaccagcacagcaucucacg

SEQ ID NO: 801678 - RNA, 18 nt, Human
aaacggaggccugaguga

SEQ ID NO: 801679 - RNA, 20 nt, Human
aaagaagagaaaauggggag

SEQ ID NO: 801680 - RNA, 18 nt, Human
aaagagauaacugccccc

SEQ ID NO: 801681 - RNA, 23 nt, Human
aaauccagcaggccuaggagaga

SEQ ID NO: 801682 - RNA, 19 nt, Human
aacauggugaaaccugucu

SEQ ID NO: 801683 - RNA, 20 nt, Human
aacauggugaaaccugucuc

SEQ ID NO: 801684 - RNA, 18 nt, Human
aaccugcugacccuccuu

SEQ ID NO: 801685 - RNA, 24 nt, Human
aacuccucgauuucucaguuuugc

SEQ ID NO: 801686 - RNA, 19 nt, Human
aacuguguggccuuuccuc

SEQ ID NO: 801687 - RNA, 22 nt, Human
aagacuggcccacaccccuugg

SEQ ID NO: 801688 - RNA, 21 nt, Human
aagcaagggcacgcggaccug

SEQ ID NO: 801689 - RNA, 24 nt, Human
aaugaggcugggugcaguggcuca

SEQ ID NO: 801690 - RNA, 24 nt, Human
aauugcuugaacacgggaggugga

SEQ ID NO: 801691 - RNA, 24 nt, Human
aauugcuugaaccugggaggcgga

SEQ ID NO: 801692 - RNA, 19 nt, Human
acaacucccugaaacggag

SEQ ID NO: 801693 - RNA, 23 nt, Human
acagagugagacuccgucuaaaa

SEQ ID NO: 801694 - RNA, 20 nt, Human
acagcaggaugagagggagg

SEQ ID NO: 801695 - RNA, 20 nt, Human
acagcccagcaggaggugcu

SEQ ID NO: 801696 - RNA, 24 nt, Human
accacacuccagccugggcgacag

SEQ ID NO: 801697 - RNA, 22 nt, Human
accacugcacuccagccugggc

SEQ ID NO: 801698 - RNA, 23 nt, Human
accaugccucuaggagccucagc

SEQ ID NO: 801699 - RNA, 18 nt, Human
acccaggcuccugcugcc

SEQ ID NO: 801700 - RNA, 18 nt, Human
accccgggcucuccaagc

SEQ ID NO: 801701 - RNA, 20 nt, Human
accggcagcugcugccacac

SEQ ID NO: 801702 - RNA, 19 nt, Human
accuaauuucuccccacca

SEQ ID NO: 801703 - RNA, 24 nt, Human
accucgucucuacuaaaaauacaa

SEQ ID NO: 801704 - RNA, 21 nt, Human
accugguaccccucucccccu

SEQ ID NO: 801705 - RNA, 22 nt, Human
acgccaccacacuccagccugg

SEQ ID NO: 801706 - RNA, 24 nt, Human
acgccaccacacuccagccugggc

SEQ ID NO: 801707 - RNA, 19 nt, Human
acguggggaugccgccugc

SEQ ID NO: 801708 - RNA, 24 nt, Human
acuccagccugggcaacagaguga

SEQ ID NO: 801709 - RNA, 24 nt, Human
acuccagccugggcgacagaguga

SEQ ID NO: 801710 - RNA, 20 nt, Human
acucucggcucauuucccuc

SEQ ID NO: 801711 - RNA, 24 nt, Human
acugcacuccagccugggcaacag

SEQ ID NO: 801712 - RNA, 24 nt, Human
acugcacuccagccugggcaacag

SEQ ID NO: 801713 - RNA, 19 nt, Human
acugcugagacccucccug

SEQ ID NO: 801714 - RNA, 24 nt, Human
acuggaggucaggaguuugagacc

SEQ ID NO: 801715 - RNA, 18 nt, Human
agaaaggauucuagauca

SEQ ID NO: 801716 - RNA, 20 nt, Human
agaauccucccugccccacu

SEQ ID NO: 801717 - RNA, 22 nt, Human
agacaguggcugucaagucagg

SEQ ID NO: 801718 - RNA, 24 nt, Human
agacugaggcaggagaauugcuug

SEQ ID NO: 801719 - RNA, 20 nt, Human
agacuggcccacaccccuug

SEQ ID NO: 801720 - RNA, 21 nt, Human
agagagacuggcccugagggu

SEQ ID NO: 801721 - RNA, 21 nt, Human
agagcuccggagccccugccc

SEQ ID NO: 801722 - RNA, 21 nt, Human
agagggaccccaagucugggu

SEQ ID NO: 801723 - RNA, 23 nt, Human
agagggaggccugagaaaggucc

SEQ ID NO: 801724 - RNA, 21 nt, Human
agaggggugaagggaggccgg

SEQ ID NO: 801725 - RNA, 23 nt, Human
agcacagcaucucacgguuugca

SEQ ID NO: 801726 - RNA, 20 nt, Human
agcacuuugggaggcugagg

SEQ ID NO: 801727 - RNA, 21 nt, Human
agccauugggcaggagaaaga

SEQ ID NO: 801728 - RNA, 23 nt, Human
agccgggcgugguggcgggugcc

SEQ ID NO: 801729 - RNA, 22 nt, Human
agccuggccaacauggugaaac

SEQ ID NO: 801730 - RNA, 23 nt, Human
agccuggccaacauggugaaacc

SEQ ID NO: 801731 - RNA, 22 nt, Human
agccugggcaacagagugagac

SEQ ID NO: 801732 - RNA, 24 nt, Human
agccugggcgacagagugagacuc

SEQ ID NO: 801733 - RNA, 22 nt, Human
agccuggugucaggaggaacug

SEQ ID NO: 801734 - RNA, 20 nt, Human
agcuucaaaagcagucagca

SEQ ID NO: 801735 - RNA, 19 nt, Human
aggagacagccgugugugu

SEQ ID NO: 801736 - RNA, 19 nt, Human
aggaggaguuggagcccug

SEQ ID NO: 801737 - RNA, 20 nt, Human
aggaguuugagaccagccug

SEQ ID NO: 801738 - RNA, 21 nt, Human
aggcaaacacagggcccuuca

SEQ ID NO: 801739 - RNA, 27 nt, Human
aggcaaggaggaguuggagcccugggg

SEQ ID NO: 801740 - RNA, 20 nt, Human
aggcaaggucuacacgggcu

SEQ ID NO: 801741 - RNA, 23 nt, Human
aggcagagagugcuccagcaggg

SEQ ID NO: 801742 - RNA, 26 nt, Human
aggcagcuggaucacuggaggucagg

SEQ ID NO: 801743 - RNA, 24 nt, Human
aggcaggagaauugcuugaacacg

SEQ ID NO: 801744 - RNA, 22 nt, Human
aggcaggagaauugcuugaacc

SEQ ID NO: 801745 - RNA, 24 nt, Human
aggcaggagaauugcuugaaccug

SEQ ID NO: 801746 - RNA, 24 nt, Human
aggcccccuccuguaccccugccu

SEQ ID NO: 801747 - RNA, 19 nt, Human
aggcggagguugcaaugag

SEQ ID NO: 801748 - RNA, 22 nt, Human
aggcugggugcaguggcucacg

SEQ ID NO: 801749 - RNA, 18 nt, Human
agggaccccaagucuggg

SEQ ID NO: 801750 - RNA, 19 nt, Human
agggagggggacuuuucgg

SEQ ID NO: 801751 - RNA, 22 nt, Human
agggagucugggagcuggucag

SEQ ID NO: 801752 - RNA, 19 nt, Human
agggaugggguggggggca

SEQ ID NO: 801753 - RNA, 18 nt, Human
aggggccugagcccagag

SEQ ID NO: 801754 - RNA, 19 nt, Human
agguggagguuacagugag

SEQ ID NO: 801755 - RNA, 24 nt, Human
agguugaggcaggagaauugcuug

SEQ ID NO: 801756 - RNA, 25 nt, Human
agucaggagcccguccugcagcagc

SEQ ID NO: 801757 - RNA, 21 nt, Human
agugaagacaggaagaguggu

SEQ ID NO: 801758 - RNA, 24 nt, Human
aguggcucacgccuguaaucccag

SEQ ID NO: 801759 - RNA, 21 nt, Human
auaccauuuagaaagaggcag

SEQ ID NO: 801760 - RNA, 18 nt, Human
auagaaggcccucucccc

SEQ ID NO: 801761 - RNA, 24 nt, Human
aucacgccaccacacuccagccug

SEQ ID NO: 801762 - RNA, 20 nt, Human
aucacuggaggucaggaguu

SEQ ID NO: 801763 - RNA, 24 nt, Human
aucacuggaggucaggaguuugag

SEQ ID NO: 801764 - RNA, 21 nt, Human
aucaggagugccccuacgugg

SEQ ID NO: 801765 - RNA, 21 nt, Human
auccuucaacaacuguguggc

SEQ ID NO: 801766 - RNA, 25 nt, Human
auggcuuccccaaauccagcaggcc

SEQ ID NO: 801767 - RNA, 21 nt, Human
caaagcaagggcacgcggacc

SEQ ID NO: 801768 - RNA, 23 nt, Human
caaagcucugcaggugcucgccc

SEQ ID NO: 801769 - RNA, 23 nt, Human
caacauggugaaaccugucucua

SEQ ID NO: 801770 - RNA, 26 nt, Human
caagcaaacccacacccaguuccaga

SEQ ID NO: 801771 - RNA, 20 nt, Human
cacagucccugccgcuccuc

SEQ ID NO: 801772 - RNA, 18 nt, Human
cacaugaagugacaggag

SEQ ID NO: 801773 - RNA, 23 nt, Human
caccaaagcaagggcacgcggac

SEQ ID NO: 801774 - RNA, 24 nt, Human
caccacacuccagccugggcgaca

SEQ ID NO: 801775 - RNA, 24 nt, Human
caccacugcacuccagccugggca

SEQ ID NO: 801776 - RNA, 18 nt, Human
cacccagagucagagcag

SEQ ID NO: 801777 - RNA, 21 nt, Human
cacgccaccacacuccagccu

SEQ ID NO: 801778 - RNA, 24 nt, Human
cacgccuguaaucccagcacuuug

SEQ ID NO: 801779 - RNA, 24 nt, Human
cacucaggccaagcucaggagagc

SEQ ID NO: 801780 - RNA, 22 nt, Human
cacuccagccugggcaacagag

SEQ ID NO: 801781 - RNA, 22 nt, Human
cacuccagccugggcaacagag

SEQ ID NO: 801782 - RNA, 24 nt, Human
cacuccagccugggcaacagagug

SEQ ID NO: 801783 - RNA, 22 nt, Human
cacuccagccugggcgacagag

SEQ ID NO: 801784 - RNA, 22 nt, Human
cacuccagccugggcgacagag

SEQ ID NO: 801785 - RNA, 24 nt, Human
cacuccagccugggcgacagagug

SEQ ID NO: 801786 - RNA, 18 nt, Human
cacugcacuccagccugg

SEQ ID NO: 801787 - RNA, 19 nt, Human
cacugcacuccagccuggg

SEQ ID NO: 801788 - RNA, 21 nt, Human
cacugcacuccagccugggca

SEQ ID NO: 801789 - RNA, 23 nt, Human
cacugcacuccagccugggcaac

SEQ ID NO: 801790 - RNA, 24 nt, Human
cacugcacuccagccugggcaaca

SEQ ID NO: 801791 - RNA, 23 nt, Human
cacuggaggucaggaguuugaga

SEQ ID NO: 801792 - RNA, 20 nt, Human
cagaaaaaaccagcacagca

SEQ ID NO: 801793 - RNA, 22 nt, Human
cagaaaaaaccagcacagcauc

SEQ ID NO: 801794 - RNA, 22 nt, Human
cagaccagcugggagccagaga

SEQ ID NO: 801795 - RNA, 19 nt, Human
cagagcaguggcagaugga

SEQ ID NO: 801796 - RNA, 21 nt, Human
cagcacgagggagagggaccc

SEQ ID NO: 801797 - RNA, 24 nt, Human
cagcacuuugggaggcugaggcag

SEQ ID NO: 801798 - RNA, 21 nt, Human
cagccaaucaaugcaggucac

SEQ ID NO: 801799 - RNA, 20 nt, Human
cagcccaaagcaaaggccuu

SEQ ID NO: 801800 - RNA, 24 nt, Human
cagcuacucaggagguugaggcag

SEQ ID NO: 801801 - RNA, 24 nt, Human
cagcugggccccucuaaaggcaag

SEQ ID NO: 801802 - RNA, 22 nt, Human
caggcgcaccaaggaaagccuc

SEQ ID NO: 801803 - RNA, 20 nt, Human
cagggcccuucacucaggcc

SEQ ID NO: 801804 - RNA, 22 nt, Human
caguccaccaagaggaugacac

SEQ ID NO: 801805 - RNA, 19 nt, Human
cagugcuaggaggccacag

SEQ ID NO: 801806 - RNA, 21 nt, Human
cauccaaagagauaacugccc

SEQ ID NO: 801807 - RNA, 22 nt, Human
caugugugugcuggggggcauc

SEQ ID NO: 801808 - RNA, 20 nt, Human
ccaagacuggcccacacccc

SEQ ID NO: 801809 - RNA, 21 nt, Human
ccaagcaaacccacacccagu

SEQ ID NO: 801810 - RNA, 20 nt, Human
ccaagcauagcaaacgcucu

SEQ ID NO: 801811 - RNA, 23 nt, Human
ccaaggcccccuccuguaccccu

SEQ ID NO: 801812 - RNA, 27 nt, Human
ccacacaggccacucagagaugccaaa

SEQ ID NO: 801813 - RNA, 22 nt, Human
ccaccaagaggaugacaccaag

SEQ ID NO: 801814 - RNA, 23 nt, Human
ccaccacacuccagccugggcga

SEQ ID NO: 801815 - RNA, 23 nt, Human
ccaccacacuccagccugggcga

SEQ ID NO: 801816 - RNA, 20 nt, Human
ccacugcacuccagccuggg

SEQ ID NO: 801817 - RNA, 21 nt, Human
ccacugcacuccagccugggc

SEQ ID NO: 801818 - RNA, 23 nt, Human
ccacugcacuccagccugggcaa

SEQ ID NO: 801819 - RNA, 24 nt, Human
ccacugcacuccagccugggcaac

SEQ ID NO: 801820 - RNA, 18 nt, Human
ccagagucagagcagugg

SEQ ID NO: 801821 - RNA, 22 nt, Human
ccagagucagagcaguggcaga

SEQ ID NO: 801822 - RNA, 21 nt, Human
ccagcccaaagcaaaggccuu

SEQ ID NO: 801823 - RNA, 18 nt, Human
ccaggcuccugcugccca

SEQ ID NO: 801824 - RNA, 24 nt, Human
ccagugccucuuuguucauuuucu

SEQ ID NO: 801825 - RNA, 21 nt, Human
ccauugggcaggagaaagaag

SEQ ID NO: 801826 - RNA, 21 nt, Human
cccacagaccagcugggagcc

SEQ ID NO: 801827 - RNA, 20 nt, Human
cccagagucagagcaguggc

SEQ ID NO: 801828 - RNA, 21 nt, Human
cccagugcuaggaggccacag

SEQ ID NO: 801829 - RNA, 19 nt, Human
cccauccucgucccugaaa

SEQ ID NO: 801830 - RNA, 18 nt, Human
ccccacagaccagcuggg

SEQ ID NO: 801831 - RNA, 24 nt, Human
ccccacagaccagcugggagccag

SEQ ID NO: 801832 - RNA, 18 nt, Human
ccccaccagccacuuccc

SEQ ID NO: 801833 - RNA, 24 nt, Human
cccccucgcccccucgaguaccug

SEQ ID NO: 801834 - RNA, 21 nt, Human
ccccucuaaaggcaaggagga

SEQ ID NO: 801835 - RNA, 18 nt, Human
ccccuuggaccugcccag

SEQ ID NO: 801836 - RNA, 20 nt, Human
ccccuuggaccugcccagcc

SEQ ID NO: 801837 - RNA, 19 nt, Human
cccuccucucuccucccuc

SEQ ID NO: 801838 - RNA, 18 nt, Human
cccuggggaccugggggu

SEQ ID NO: 801839 - RNA, 19 nt, Human
ccgcuccucugccaccccc

SEQ ID NO: 801840 - RNA, 25 nt, Human
ccggagccccugcccuaagcuccca

SEQ ID NO: 801841 - RNA, 22 nt, Human
ccuacugagauccugccuguua

SEQ ID NO: 801842 - RNA, 19 nt, Human
ccucagcauguguuuccaa

SEQ ID NO: 801843 - RNA, 18 nt, Human
ccucuaaaggcaaggagg

SEQ ID NO: 801844 - RNA, 20 nt, Human
ccucucuccucccucgcgcg

SEQ ID NO: 801845 - RNA, 18 nt, Human
ccucugccccagcaaguc

SEQ ID NO: 801846 - RNA, 19 nt, Human
ccugcggggacaaccaggg

SEQ ID NO: 801847 - RNA, 20 nt, Human
ccuggaccaaggaggggacc

SEQ ID NO: 801848 - RNA, 21 nt, Human
ccuggccaacauggugaaacc

SEQ ID NO: 801849 - RNA, 23 nt, Human
ccuggccaacauggugaaaccug

SEQ ID NO: 801850 - RNA, 19 nt, Human
ccuggccaagauggugaca

SEQ ID NO: 801851 - RNA, 21 nt, Human
ccuggccaagauggugacacc

SEQ ID NO: 801852 - RNA, 19 nt, Human
ccugggaggcggagguugc

SEQ ID NO: 801853 - RNA, 22 nt, Human
ccugggcgacagagugagacuc

SEQ ID NO: 801854 - RNA, 21 nt, Human
ccuggugucaggaggaacugg

SEQ ID NO: 801855 - RNA, 22 nt, Human
ccuguaaucccagcacuuuggg

SEQ ID NO: 801856 - RNA, 19 nt, Human
ccuguaauccuagcuacuc

SEQ ID NO: 801857 - RNA, 22 nt, Human
ccugucucuacuaaaaauacaa

SEQ ID NO: 801858 - RNA, 22 nt, Human
ccuucaugugugugcugggggg

SEQ ID NO: 801859 - RNA, 20 nt, Human
ccuugcuugcuuucugcagc

SEQ ID NO: 801860 - RNA, 19 nt, Human
ccuugggggagccaggagg

SEQ ID NO: 801861 - RNA, 19 nt, Human
ccuuguucagccuuugagg

SEQ ID NO: 801862 - RNA, 19 nt, Human
ccuuucacagaaaaaacca

SEQ ID NO: 801863 - RNA, 19 nt, Human
cgccaccacacuccagccu

SEQ ID NO: 801864 - RNA, 24 nt, Human
cgcccauaaucccagcuacucagg

SEQ ID NO: 801865 - RNA, 19 nt, Human
cgcccccucgaguaccugg

SEQ ID NO: 801866 - RNA, 20 nt, Human
cgcucugcacaugaccuaaa

SEQ ID NO: 801867 - RNA, 29 nt, Human
cgggagguggagguuacagugacaacggu

SEQ ID NO: 801868 - RNA, 24 nt, Human
cgggagguggagguuacagugagc

SEQ ID NO: 801869 - RNA, 21 nt, Human
cucacccuccaggccuccagg

SEQ ID NO: 801870 - RNA, 24 nt, Human
cucaccugguaccccucucccccu

SEQ ID NO: 801871 - RNA, 22 nt, Human
cucacgccuguaaucccagcac

SEQ ID NO: 801872 - RNA, 24 nt, Human
cucacgccuguaaucccagcacuu

SEQ ID NO: 801873 - RNA, 22 nt, Human
cuccucucuccucccucgcgcg

SEQ ID NO: 801874 - RNA, 22 nt, Human
cuccuguaccccugccucugcc

SEQ ID NO: 801875 - RNA, 18 nt, Human
cucgaaccccucuccgca

SEQ ID NO: 801876 - RNA, 18 nt, Human
cucgaguaccugggcagc

SEQ ID NO: 801877 - RNA, 22 nt, Human
cucgcccccucgaguaccuggg

SEQ ID NO: 801878 - RNA, 23 nt, Human
cucuccagccucaccugguaccc

SEQ ID NO: 801879 - RNA, 28 nt, Human
cucugguuugggagugggccggaaagcc

SEQ ID NO: 801880 - RNA, 24 nt, Human
cugcccacccacacaggccacuca

SEQ ID NO: 801881 - RNA, 18 nt, Human
cuggaccaaggaggggac

SEQ ID NO: 801882 - RNA, 18 nt, Human
cuggagcaccuggccucu

SEQ ID NO: 801883 - RNA, 21 nt, Human
cuggaggugagauacgcucug

SEQ ID NO: 801884 - RNA, 22 nt, Human
cuggccaccaggucugccccuc

SEQ ID NO: 801885 - RNA, 22 nt, Human
cuggccaccaggucugccccuc

SEQ ID NO: 801886 - RNA, 20 nt, Human
cugggcgugguggugggcgc

SEQ ID NO: 801887 - RNA, 19 nt, Human
cuggggauaccuaauuucu

SEQ ID NO: 801888 - RNA, 21 nt, Human
cugguuugggagugggcugag

SEQ ID NO: 801889 - RNA, 23 nt, Human
cuuccucacccuccaggccucca

SEQ ID NO: 801890 - RNA, 18 nt, Human
cuuuccugucccaggaag

SEQ ID NO: 801891 - RNA, 23 nt, Human
gaaaauggggaguuuguaaacag

SEQ ID NO: 801892 - RNA, 21 nt, Human
gaaccccucuccgcacucugc

SEQ ID NO: 801893 - RNA, 24 nt, Human
gaaggcucugggcaccuagggugg

SEQ ID NO: 801894 - RNA, 18 nt, Human
gaauuaggauuuguggcc

SEQ ID NO: 801895 - RNA, 19 nt, Human
gacaccaccuggccuauag

SEQ ID NO: 801896 - RNA, 23 nt, Human
gacagagugagacuccgucuaaa

SEQ ID NO: 801897 - RNA, 24 nt, Human
gaccaccaccgccuccugccuaaa

SEQ ID NO: 801898 - RNA, 23 nt, Human
gagaaagaagagaaaauggggag

SEQ ID NO: 801899 - RNA, 23 nt, Human
gagaauugcuugaacacgggagg

SEQ ID NO: 801900 - RNA, 23 nt, Human
gagaauugcuugaaccugggagg

SEQ ID NO: 801901 - RNA, 23 nt, Human
gagaccagccuggccaacauggu

SEQ ID NO: 801902 - RNA, 24 nt, Human
gagaugccacaugaagugacagga

SEQ ID NO: 801903 - RNA, 18 nt, Human
gagaugccuguccugcca

SEQ ID NO: 801904 - RNA, 19 nt, Human
gagcaguggcagauggaag

SEQ ID NO: 801905 - RNA, 20 nt, Human
gagcaguggcagauggaagg

SEQ ID NO: 801906 - RNA, 20 nt, Human
gagcccagagcugcgugcga

SEQ ID NO: 801907 - RNA, 22 nt, Human
gaggaggugucucuaagcaugg

SEQ ID NO: 801908 - RNA, 19 nt, Human
gaggucaggaguuugagac

SEQ ID NO: 801909 - RNA, 23 nt, Human
gaggugggcuucucauggugagc

SEQ ID NO: 801910 - RNA, 19 nt, Human
gagguuacagugagcugac

SEQ ID NO: 801911 - RNA, 19 nt, Human
gagguugcaaugagccuag

SEQ ID NO: 801912 - RNA, 21 nt, Human
gagugagacacuggcucaaaa

SEQ ID NO: 801913 - RNA, 24 nt, Human
gaucacuggaggucaggaguuuga

SEQ ID NO: 801914 - RNA, 18 nt, Human
gcaagaaaaugggaggag

SEQ ID NO: 801915 - RNA, 24 nt, Human
gcacuccagccugggcaacagagu

SEQ ID NO: 801916 - RNA, 18 nt, Human
gcagacacuuucacaugg

SEQ ID NO: 801917 - RNA, 23 nt, Human
gcagcagccuagccaucuggaag

SEQ ID NO: 801918 - RNA, 19 nt, Human
gccaacauggugaaaccug

SEQ ID NO: 801919 - RNA, 22 nt, Human
gccaccacacuccagccugggc

SEQ ID NO: 801920 - RNA, 18 nt, Human
gcccaagcaaacccacac

SEQ ID NO: 801921 - RNA, 22 nt, Human
gcccaagcaaacccacacccag

SEQ ID NO: 801922 - RNA, 20 nt, Human
gccuagaucacgccaccaca

SEQ ID NO: 801923 - RNA, 24 nt, Human
gcucugguuugggagugggcugag

SEQ ID NO: 801924 - RNA, 21 nt, Human
gcugcagucauugugaguccu

SEQ ID NO: 801925 - RNA, 23 nt, Human
gcugugggaucugucuccuggcu

SEQ ID NO: 801926 - RNA, 21 nt, Human
ggaaugaggcugggugcagug

SEQ ID NO: 801927 - RNA, 23 nt, Human
ggacaaccagggccaccugguga

SEQ ID NO: 801928 - RNA, 21 nt, Human
ggacuugggagacaccuggug

SEQ ID NO: 801929 - RNA, 24 nt, Human
ggagaaagaagagaaaauggggag

SEQ ID NO: 801930 - RNA, 22 nt, Human
ggagauggagagagaggggggc

SEQ ID NO: 801931 - RNA, 22 nt, Human
ggagcugcagcaggcgcaccaa

SEQ ID NO: 801932 - RNA, 19 nt, Human
ggaggcugaggcagcugga

SEQ ID NO: 801933 - RNA, 21 nt, Human
ggagguggagguuacagugag

SEQ ID NO: 801934 - RNA, 18 nt, Human
ggagguuacagugagcug

SEQ ID NO: 801935 - RNA, 19 nt, Human
ggagguuacagugagcuga

SEQ ID NO: 801936 - RNA, 24 nt, Human
ggagguuacagugagcugacguug

SEQ ID NO: 801937 - RNA, 20 nt, Human
ggagguugcaaugagccuag

SEQ ID NO: 801938 - RNA, 24 nt, Human
ggagguugcaaugagccuagauca

SEQ ID NO: 801939 - RNA, 24 nt, Human
ggccaacauggugaaaccugucuc

SEQ ID NO: 801940 - RNA, 20 nt, Human
ggcuagaaccugcugacccu

SEQ ID NO: 801941 - RNA, 18 nt, Human
ggcuucgcugaggaggug

SEQ ID NO: 801942 - RNA, 20 nt, Human
gggaccugggggugaccucu

SEQ ID NO: 801943 - RNA, 22 nt, Human
gggcaacagagugagacacugg

SEQ ID NO: 801944 - RNA, 24 nt, Human
gggcgugguggcgggugccuguaa

SEQ ID NO: 801945 - RNA, 20 nt, Human
ggggggcagguagagaagaa

SEQ ID NO: 801946 - RNA, 20 nt, Human
gggugaagggaggccggggg

SEQ ID NO: 801947 - RNA, 22 nt, Human
ggucaccugugcuccuaccugu

SEQ ID NO: 801948 - RNA, 19 nt, Human
ggucaggaguuugagacca

SEQ ID NO: 801949 - RNA, 23 nt, Human
ggugcaguggcucacgccuguaa

SEQ ID NO: 801950 - RNA, 25 nt, Human
ggugcuggcacagcaggaugagagg

SEQ ID NO: 801951 - RNA, 19 nt, Human
gguggagguuacagugagc

SEQ ID NO: 801952 - RNA, 24 nt, Human
gguggcgggugccuguaauccuag

SEQ ID NO: 801953 - RNA, 18 nt, Human
guaaggcuucccaucaac

SEQ ID NO: 801954 - RNA, 19 nt, Human
guccuacugagauccugcc

SEQ ID NO: 801955 - RNA, 18 nt, Human
gugcaguggcucacgccu

SEQ ID NO: 801956 - RNA, 21 nt, Human
gugcauggaggcaaacacagg

SEQ ID NO: 801957 - RNA, 21 nt, Human
gugcucggucaaaguuaacuc

SEQ ID NO: 801958 - RNA, 20 nt, Human
guggggggcagguagagaag

SEQ ID NO: 801959 - RNA, 24 nt, Human
guugcaccacugcacuccagccug

SEQ ID NO: 801960 - RNA, 24 nt, Human
guuucauucaccccgggcucucca

SEQ ID NO: 801961 - RNA, 19 nt, Human
uaaacagucauccaaagag

SEQ ID NO: 801962 - RNA, 22 nt, Human
uaaacagucauccaaagagaua

SEQ ID NO: 801963 - RNA, 18 nt, Human
uaaaguaguccauucagg

SEQ ID NO: 801964 - RNA, 23 nt, Human
uaaucuggccaugggguucccag

SEQ ID NO: 801965 - RNA, 24 nt, Human
uacagggggagggagcuucaaaag

SEQ ID NO: 801966 - RNA, 21 nt, Human
uaccccugccucugccccagc

SEQ ID NO: 801967 - RNA, 18 nt, Human
uaccuguucucuucucug

SEQ ID NO: 801968 - RNA, 21 nt, Human
uagccgggcgugguggcgggu

SEQ ID NO: 801969 - RNA, 23 nt, Human
uagcuggcucuuccucacccucc

SEQ ID NO: 801970 - RNA, 21 nt, Human
uaggacaccaccuggccuaua

SEQ ID NO: 801971 - RNA, 20 nt, Human
uauagcauacaaaauauaug

SEQ ID NO: 801972 - RNA, 19 nt, Human
uauccuugggagacagguu

SEQ ID NO: 801973 - RNA, 22 nt, Human
uauccuugggagacagguuggg

SEQ ID NO: 801974 - RNA, 23 nt, Human
uauuagugguuaagcuuuugggg

SEQ ID NO: 801975 - RNA, 20 nt, Human
ucaaaaaaaaaaaaaaaaaa

SEQ ID NO: 801976 - RNA, 21 nt, Human
ucaccccgggcucuccaagca

SEQ ID NO: 801977 - RNA, 24 nt, Human
ucaguccacgcccuccucucuccu

SEQ ID NO: 801978 - RNA, 18 nt, Human
uccaaacaccaggggagc

SEQ ID NO: 801979 - RNA, 21 nt, Human
uccacagugagggagggggac

SEQ ID NO: 801980 - RNA, 23 nt, Human
uccacgcccuccucucuccuccc

SEQ ID NO: 801981 - RNA, 23 nt, Human
uccagaggggugaagggagggaa

SEQ ID NO: 801982 - RNA, 23 nt, Human
uccagccugggcaacagagugag

SEQ ID NO: 801983 - RNA, 24 nt, Human
uccagccugggcaacagagugaga

SEQ ID NO: 801984 - RNA, 23 nt, Human
uccagccugggcgacagagugag

SEQ ID NO: 801985 - RNA, 24 nt, Human
uccagccugggcgacagagugaga

SEQ ID NO: 801986 - RNA, 22 nt, Human
uccauggcaggggccacugaga

SEQ ID NO: 801987 - RNA, 20 nt, Human
ucccacaugagcacagcacc

SEQ ID NO: 801988 - RNA, 25 nt, Human
ucccagagccggugugacacaugcc

SEQ ID NO: 801989 - RNA, 19 nt, Human
uccccaaauccagcaggcc

SEQ ID NO: 801990 - RNA, 25 nt, Human
uccccucauuuuaucuagcaguugg

SEQ ID NO: 801991 - RNA, 22 nt, Human
ucccuccggcugaguugcagag

SEQ ID NO: 801992 - RNA, 21 nt, Human
ucccugaaacggaggccugag

SEQ ID NO: 801993 - RNA, 20 nt, Human
ucccugaaagcaaacuccuc

SEQ ID NO: 801994 - RNA, 19 nt, Human
ucccugggagaggcugguc

SEQ ID NO: 801995 - RNA, 20 nt, Human
ucccugggagaggcuggucc

SEQ ID NO: 801996 - RNA, 23 nt, Human
uccgucuaaaaaaaaaagaaaaa

SEQ ID NO: 801997 - RNA, 20 nt, Human
uccucacccuccaggccucc

SEQ ID NO: 801998 - RNA, 22 nt, Human
uccucacccuccaggccuccag

SEQ ID NO: 801999 - RNA, 19 nt, Human
uccucgucccugaaagcaa

SEQ ID NO: 802000 - RNA, 20 nt, Human
uccuguacacuucccuccca

SEQ ID NO: 802001 - RNA, 23 nt, Human
uccuguaccccugccucugcccc

SEQ ID NO: 802002 - RNA, 27 nt, Human
uccuugggagacagguugggagugaag

SEQ ID NO: 802003 - RNA, 26 nt, Human
ucgcugaggaggugggcuucucaugg

SEQ ID NO: 802004 - RNA, 19 nt, Human
ucguuggaagccaagggag

SEQ ID NO: 802005 - RNA, 20 nt, Human
ucucacacuccgcagacuuu

SEQ ID NO: 802006 - RNA, 22 nt, Human
ucuccaauucacacccagaguc

SEQ ID NO: 802007 - RNA, 23 nt, Human
ucuccagccucaccugguacccc

SEQ ID NO: 802008 - RNA, 21 nt, Human
ucucuacuaaaaauacaaaaa

SEQ ID NO: 802009 - RNA, 23 nt, Human
ucucuacuaaaaauacaaaaauu

SEQ ID NO: 802010 - RNA, 19 nt, Human
ucucuccagccucaccugg

SEQ ID NO: 802011 - RNA, 25 nt, Human
ucucuccagccucaccugguacccc

SEQ ID NO: 802012 - RNA, 24 nt, Human
ucucucuccccucuagaauccaaa

SEQ ID NO: 802013 - RNA, 20 nt, Human
ucugcagccaugguggccuu

SEQ ID NO: 802014 - RNA, 20 nt, Human
ucugcaggugcucgcccuuc

SEQ ID NO: 802015 - RNA, 22 nt, Human
ucugccccucaguccacgcccu

SEQ ID NO: 802016 - RNA, 20 nt, Human
ucuguaaucauucugugugg

SEQ ID NO: 802017 - RNA, 21 nt, Human
ucuguaccgugguguccgaag

SEQ ID NO: 802018 - RNA, 21 nt, Human
ucugucuccuggcucugguuu

SEQ ID NO: 802019 - RNA, 24 nt, Human
ugaaccugggaggcggagguugca

SEQ ID NO: 802020 - RNA, 18 nt, Human
ugaagacaggaagagugg

SEQ ID NO: 802021 - RNA, 22 nt, Human
ugaagggaugggguggggggca

SEQ ID NO: 802022 - RNA, 23 nt, Human
ugacaggaggugacccaagacug

SEQ ID NO: 802023 - RNA, 26 nt, Human
ugaccaccaccgccuccugccuaaac

SEQ ID NO: 802024 - RNA, 21 nt, Human
ugacccaagacuggcccacac

SEQ ID NO: 802025 - RNA, 26 nt, Human
ugagaaagguccccugagaggacacc

SEQ ID NO: 802026 - RNA, 21 nt, Human
ugagacacuggcucaaaaaaa

SEQ ID NO: 802027 - RNA, 23 nt, Human
ugagaccagccuggccaacaugg

SEQ ID NO: 802028 - RNA, 21 nt, Human
ugagcugacguugcaccacug

SEQ ID NO: 802029 - RNA, 25 nt, Human
ugaggaggugggcuucucaugguga

SEQ ID NO: 802030 - RNA, 26 nt, Human
ugaggcagcuggaucacuggagguca

SEQ ID NO: 802031 - RNA, 23 nt, Human
ugaggcaggagaauugcuugaac

SEQ ID NO: 802032 - RNA, 24 nt, Human
ugaggcaggagaauugcuugaacc

SEQ ID NO: 802033 - RNA, 25 nt, Human
ugaggcaggagaauugcuugaaccu

SEQ ID NO: 802034 - RNA, 19 nt, Human
ugaucauaagcccccugcu

SEQ ID NO: 802035 - RNA, 19 nt, Human
ugcacaugaccuaaaugug

SEQ ID NO: 802036 - RNA, 21 nt, Human
ugcaccacugcacuccagccu

SEQ ID NO: 802037 - RNA, 21 nt, Human
ugcagagggcuucgcugagga

SEQ ID NO: 802038 - RNA, 19 nt, Human
ugccacaugaagugacagg

SEQ ID NO: 802039 - RNA, 19 nt, Human
ugcccccuuccacuggacg

SEQ ID NO: 802040 - RNA, 18 nt, Human
ugcccuaagcucccagua

SEQ ID NO: 802041 - RNA, 24 nt, Human
ugccuguaauccuagcuacucagg

SEQ ID NO: 802042 - RNA, 20 nt, Human
ugccuguggcugcccccucg

SEQ ID NO: 802043 - RNA, 21 nt, Human
ugccugugguauccuaggaac

SEQ ID NO: 802044 - RNA, 19 nt, Human
ugcggggacaaccagggcc

SEQ ID NO: 802045 - RNA, 21 nt, Human
ugcucauccacagugagggag

SEQ ID NO: 802046 - RNA, 22 nt, Human
ugcugccacacuucaaaggccu

SEQ ID NO: 802047 - RNA, 22 nt, Human
ugcuucagacccaggcuccugc

SEQ ID NO: 802048 - RNA, 21 nt, Human
ugcuugaaccugggaggcgga

SEQ ID NO: 802049 - RNA, 20 nt, Human
uggaaggaaggaguccugcg

SEQ ID NO: 802050 - RNA, 20 nt, Human
uggagauggagagagagggg

SEQ ID NO: 802051 - RNA, 18 nt, Human
uggaggcaaacacagggc

SEQ ID NO: 802052 - RNA, 23 nt, Human
uggaucacuggaggucaggaguu

SEQ ID NO: 802053 - RNA, 24 nt, Human
uggaucacuggaggucaggaguuu

SEQ ID NO: 802054 - RNA, 23 nt, Human
uggccaacauggugaaaccuguc

SEQ ID NO: 802055 - RNA, 20 nt, Human
uggcuacagacccacccuuu

SEQ ID NO: 802056 - RNA, 18 nt, Human
uggcucaaaaaaaaaaaa

SEQ ID NO: 802057 - RNA, 20 nt, Human
uggcucaaaaaaaaaaaaaa

SEQ ID NO: 802058 - RNA, 24 nt, Human
uggcucacgccuguaaucccagca

SEQ ID NO: 802059 - RNA, 21 nt, Human
uggcucugguuugggaguggg

SEQ ID NO: 802060 - RNA, 23 nt, Human
uggcucugguuugggagugggcu

SEQ ID NO: 802061 - RNA, 18 nt, Human
uggcugggugacgaagag

SEQ ID NO: 802062 - RNA, 21 nt, Human
uggcugggugacgaagagcua

SEQ ID NO: 802063 - RNA, 21 nt, Human
uggcugucaagucaggagccc

SEQ ID NO: 802064 - RNA, 23 nt, Human
ugggaggaggugucucuaagcau

SEQ ID NO: 802065 - RNA, 29 nt, Human
ugggaggcggagguugcaaugacaacggu

SEQ ID NO: 802066 - RNA, 24 nt, Human
ugggaggcggagguugcaaugagc

SEQ ID NO: 802067 - RNA, 24 nt, Human
ugggaggcugaggcagcuggauca

SEQ ID NO: 802068 - RNA, 21 nt, Human
ugggcaggagaaagaagagaa

SEQ ID NO: 802069 - RNA, 23 nt, Human
ugggcugggaggcccaggggccg

SEQ ID NO: 802070 - RNA, 23 nt, Human
uggggauaccuaauuucucccca

SEQ ID NO: 802071 - RNA, 19 nt, Human
uggguguggacuccaaaug

SEQ ID NO: 802072 - RNA, 24 nt, Human
ugguauucaaggguuaacuguauu

SEQ ID NO: 802073 - RNA, 22 nt, Human
ugguggcgggugccuguaaucc

SEQ ID NO: 802074 - RNA, 18 nt, Human
ugguguccccagugcuag

SEQ ID NO: 802075 - RNA, 20 nt, Human
ugguguccccagugcuagga

SEQ ID NO: 802076 - RNA, 24 nt, Human
uguacacaccaacuuguaccaucc

SEQ ID NO: 802077 - RNA, 19 nt, Human
uguggaaggaaggaguccu

SEQ ID NO: 802078 - RNA, 20 nt, Human
uguguacacaccaacuugua

SEQ ID NO: 802079 - RNA, 21 nt, Human
uguguggccuuuccucucucu

SEQ ID NO: 802080 - RNA, 18 nt, Human
uguguguguguguacaca

SEQ ID NO: 802081 - RNA, 23 nt, Human
uuaagagcuggagugagcagucu

SEQ ID NO: 802082 - RNA, 22 nt, Human
uuacagugagcugacguugcac

SEQ ID NO: 802083 - RNA, 24 nt, Human
uuagccgggcgugguggcgggugc

SEQ ID NO: 802084 - RNA, 18 nt, Human
uucaacaaggucuauugc

SEQ ID NO: 802085 - RNA, 22 nt, Human
uucacagaaaaaaccagcacag

SEQ ID NO: 802086 - RNA, 24 nt, Human
uucaccccgggcucuccaagcaua

SEQ ID NO: 802087 - RNA, 24 nt, Human
uuccugcuuggguuguucugggga

SEQ ID NO: 802088 - RNA, 21 nt, Human
uuccuggaccaaggaggggac

SEQ ID NO: 802089 - RNA, 24 nt, Human
uugaaccugggaggcggagguugc

SEQ ID NO: 802090 - RNA, 23 nt, Human
uugcaccacugcacuccagccug

SEQ ID NO: 802091 - RNA, 19 nt, Human
uugcucauccacagugagg

SEQ ID NO: 802092 - RNA, 24 nt, Human
uugcuugaacacgggagguggagg

SEQ ID NO: 802093 - RNA, 24 nt, Human
uugcuugaaccugggaggcggagg

SEQ ID NO: 802094 - RNA, 27 nt, Human
uugcuuucugcagccaugguggccuuu

SEQ ID NO: 802095 - RNA, 18 nt, Human
uuggagcccuggggaccu

SEQ ID NO: 802096 - RNA, 25 nt, Human
uugggaggcugaggcagcuggauca

SEQ ID NO: 802097 - RNA, 22 nt, Human
uuuccaucccauccaugaguuc

SEQ ID NO: 802098 - RNA, 23 nt, Human
uuuccugucccaggaagggccuu

SEQ ID NO: 802099 - RNA, 24 nt, Human
uuucuggagcaccuggccucuguu

SEQ ID NO: 802100 - RNA, 20 nt, Human
uuugaacucauggccuagag

SEQ ID NO: 802101 - RNA, 23 nt, Human
uuugccuuucacagaaaaaacca

SEQ ID NO: 802102 - RNA, 19 nt, Human
uuugggagugggcugagag

SEQ ID NO: 802103 - RNA, 22 nt, Human
aaacagccuuauugagugaggu

SEQ ID NO: 802104 - RNA, 24 nt, Human
aaagugcugggauuacaggcguga

SEQ ID NO: 802105 - RNA, 25 nt, Human
aaccagucaccucccucucuacucu

SEQ ID NO: 802106 - RNA, 19 nt, Human
aacuuguggagagcccacc

SEQ ID NO: 802107 - RNA, 21 nt, Human
aagagcaggcagguccaguaa

SEQ ID NO: 802108 - RNA, 18 nt, Human
aagagcccaguaaccagc

SEQ ID NO: 802109 - RNA, 25 nt, Human
aagcaagagcccaguaaccagcagc

SEQ ID NO: 802110 - RNA, 21 nt, Human
aagcagcucacccugcagaag

SEQ ID NO: 802111 - RNA, 22 nt, Human
aaggcagccauucacccagaac

SEQ ID NO: 802112 - RNA, 22 nt, Human
aaggcugucacacugucacaga

SEQ ID NO: 802113 - RNA, 21 nt, Human
aagugaccuaaagacaaagau

SEQ ID NO: 802114 - RNA, 19 nt, Human
aagugcugggauuacaggc

SEQ ID NO: 802115 - RNA, 19 nt, Human
aagugcugggauuacaggc

SEQ ID NO: 802116 - RNA, 26 nt, Human
aagugcugggauuacaggcgugagcc

SEQ ID NO: 802117 - RNA, 19 nt, Human
aaguugaagggaaccagcc

SEQ ID NO: 802118 - RNA, 22 nt, Human
aaucaagcccuccuccccagug

SEQ ID NO: 802119 - RNA, 22 nt, Human
aaucucugcucacugcaaccuc

SEQ ID NO: 802120 - RNA, 20 nt, Human
acaaaagcaggggaagagca

SEQ ID NO: 802121 - RNA, 22 nt, Human
acaaucagaucaagccuggagc

SEQ ID NO: 802122 - RNA, 21 nt, Human
acacagcuccuuugugccucc

SEQ ID NO: 802123 - RNA, 20 nt, Human
acagaaaggggcaaaccaaa

SEQ ID NO: 802124 - RNA, 20 nt, Human
acagaacaucccccagggaa

SEQ ID NO: 802125 - RNA, 18 nt, Human
acagccugugcucuucac

SEQ ID NO: 802126 - RNA, 22 nt, Human
acaggagcagggggcacggcgg

SEQ ID NO: 802127 - RNA, 21 nt, Human
acaggucugugccccagaggc

SEQ ID NO: 802128 - RNA, 21 nt, Human
accagccugggccccagcaac

SEQ ID NO: 802129 - RNA, 24 nt, Human
accauguuggccaggauggucuug

SEQ ID NO: 802130 - RNA, 18 nt, Human
accauugagacggcccug

SEQ ID NO: 802131 - RNA, 24 nt, Human
acccaggagacacagaagaggcuc

SEQ ID NO: 802132 - RNA, 24 nt, Human
acccucaaaagcucagcaaggagc

SEQ ID NO: 802133 - RNA, 18 nt, Human
acgggguuucaccauguu

SEQ ID NO: 802134 - RNA, 23 nt, Human
acgggguuucaccauguuggcca

SEQ ID NO: 802135 - RNA, 24 nt, Human
acgggguuucaccauguuggccag

SEQ ID NO: 802136 - RNA, 23 nt, Human
acucccaccuccaagcccaccac

SEQ ID NO: 802137 - RNA, 24 nt, Human
acucuguugccaggcuggagugca

SEQ ID NO: 802138 - RNA, 18 nt, Human
acugcagcucccuagccu

SEQ ID NO: 802139 - RNA, 23 nt, Human
agaaacaagugaccuaaagacaa

SEQ ID NO: 802140 - RNA, 19 nt, Human
agaagcaaggccuggagca

SEQ ID NO: 802141 - RNA, 25 nt, Human
agaagucuccggccaacugagugcc

SEQ ID NO: 802142 - RNA, 21 nt, Human
agacucuccaagcucuugaug

SEQ ID NO: 802143 - RNA, 22 nt, Human
agaggcagggaagggagggcag

SEQ ID NO: 802144 - RNA, 21 nt, Human
agaucaagccuggagcuuggg

SEQ ID NO: 802145 - RNA, 21 nt, Human
agcaggucugcugggccagca

SEQ ID NO: 802146 - RNA, 18 nt, Human
agccaagcagagcagccu

SEQ ID NO: 802147 - RNA, 19 nt, Human
agccaggaguucaguugag

SEQ ID NO: 802148 - RNA, 19 nt, Human
agccagggcccggggcaua

SEQ ID NO: 802149 - RNA, 18 nt, Human
agccccauuuuguggcug

SEQ ID NO: 802150 - RNA, 20 nt, Human
agcuagaacgggagcuggag

SEQ ID NO: 802151 - RNA, 21 nt, Human
agcugcagagcgagcgggagc

SEQ ID NO: 802152 - RNA, 21 nt, Human
agcugggacuacgggggcccg

SEQ ID NO: 802153 - RNA, 19 nt, Human
aggaagcaggcgggcaagc

SEQ ID NO: 802154 - RNA, 25 nt, Human
aggaagccccuauccagcagcaggu

SEQ ID NO: 802155 - RNA, 27 nt, Human
aggagaagaaaaacuuaguucccagaa

SEQ ID NO: 802156 - RNA, 18 nt, Human
aggagcccugaauaucug

SEQ ID NO: 802157 - RNA, 19 nt, Human
aggagcgggagcggcugcu

SEQ ID NO: 802158 - RNA, 21 nt, Human
aggagcugcggggcagccugg

SEQ ID NO: 802159 - RNA, 22 nt, Human
aggaggaaggugagcgcagggc

SEQ ID NO: 802160 - RNA, 20 nt, Human
aggcaaaggcccagcagcug

SEQ ID NO: 802161 - RNA, 24 nt, Human
aggcacugggggaacagugaccca

SEQ ID NO: 802162 - RNA, 18 nt, Human
aggcagaagugccaccca

SEQ ID NO: 802163 - RNA, 21 nt, Human
aggcagaagugccacccagga

SEQ ID NO: 802164 - RNA, 20 nt, Human
aggcaggugcagcagcugga

SEQ ID NO: 802165 - RNA, 23 nt, Human
aggcaggugcagcagcuggagga

SEQ ID NO: 802166 - RNA, 18 nt, Human
aggccaguuccagcaacu

SEQ ID NO: 802167 - RNA, 18 nt, Human
aggcccaccgagacccag

SEQ ID NO: 802168 - RNA, 24 nt, Human
aggcccagcgggcccgcguggagg

SEQ ID NO: 802169 - RNA, 24 nt, Human
aggcuccugcugcugcuucaaagc

SEQ ID NO: 802170 - RNA, 25 nt, Human
aggcuggagugcaguggcacaaucu

SEQ ID NO: 802171 - RNA, 18 nt, Human
agggaagggggaauaagg

SEQ ID NO: 802172 - RNA, 19 nt, Human
agggaagggggaauaaggg

SEQ ID NO: 802173 - RNA, 22 nt, Human
agggagaagcaaggccuggagc

SEQ ID NO: 802174 - RNA, 21 nt, Human
agggagggcagcaaggaaggg

SEQ ID NO: 802175 - RNA, 19 nt, Human
aggugcagcagcuggagga

SEQ ID NO: 802176 - RNA, 19 nt, Human
aguacagcgcuccccugcc

SEQ ID NO: 802177 - RNA, 22 nt, Human
aguagagacgggguuucaccau

SEQ ID NO: 802178 - RNA, 18 nt, Human
aguagcugggacuacggg

SEQ ID NO: 802179 - RNA, 20 nt, Human
agucuuuuuuuuuuuuuuuu

SEQ ID NO: 802180 - RNA, 21 nt, Human
agugcaguggcacaaucucug

SEQ ID NO: 802181 - RNA, 18 nt, Human
agugcugggauuacaggc

SEQ ID NO: 802182 - RNA, 22 nt, Human
aguggcccagcaggguggccuc

SEQ ID NO: 802183 - RNA, 21 nt, Human
aucccguaauccacacaacca

SEQ ID NO: 802184 - RNA, 18 nt, Human
aucucugcccgcaggcuc

SEQ ID NO: 802185 - RNA, 22 nt, Human
aucugccaugggaauccagaau

SEQ ID NO: 802186 - RNA, 23 nt, Human
auggcugggccuagcccuguggg

SEQ ID NO: 802187 - RNA, 22 nt, Human
auuuuucuauuuuuaguagaga

SEQ ID NO: 802188 - RNA, 24 nt, Human
auuuuucuauuuuuaguagagacg

SEQ ID NO: 802189 - RNA, 19 nt, Human
caaacuggguugccaccuc

SEQ ID NO: 802190 - RNA, 24 nt, Human
caaagugcugggauuacaggcgug

SEQ ID NO: 802191 - RNA, 20 nt, Human
caaccuccaccuccuggguu

SEQ ID NO: 802192 - RNA, 23 nt, Human
caaccuccaccuccuggguucaa

SEQ ID NO: 802193 - RNA, 18 nt, Human
caagaggcagggaaggga

SEQ ID NO: 802194 - RNA, 20 nt, Human
caagugauucuccugccuca

SEQ ID NO: 802195 - RNA, 22 nt, Human
caagugauucuccugccucagc

SEQ ID NO: 802196 - RNA, 19 nt, Human
caauggggccucacaggag

SEQ ID NO: 802197 - RNA, 21 nt, Human
cacaaaagcaggggaagagca

SEQ ID NO: 802198 - RNA, 18 nt, Human
cacagaaaggggcaaacc

SEQ ID NO: 802199 - RNA, 23 nt, Human
cacagaucacauggagaggcaag

SEQ ID NO: 802200 - RNA, 19 nt, Human
cacaggcccaccgagaccc

SEQ ID NO: 802201 - RNA, 20 nt, Human
caccacacccagcucauuuu

SEQ ID NO: 802202 - RNA, 23 nt, Human
caccacagccuuuacuggcuccc

SEQ ID NO: 802203 - RNA, 18 nt, Human
caccauguuggccaggau

SEQ ID NO: 802204 - RNA, 22 nt, Human
caccauguuggccaggaugguc

SEQ ID NO: 802205 - RNA, 23 nt, Human
caccauguuggccaggauggucu

SEQ ID NO: 802206 - RNA, 24 nt, Human
caccauguuggccaggauggucuu

SEQ ID NO: 802207 - RNA, 20 nt, Human
cacccugcagaagccccuga

SEQ ID NO: 802208 - RNA, 22 nt, Human
caccucaucacaugaggccuua

SEQ ID NO: 802209 - RNA, 21 nt, Human
caccuccaagcccaccaccaa

SEQ ID NO: 802210 - RNA, 24 nt, Human
caccuccaagcccaccaccaaggg

SEQ ID NO: 802211 - RNA, 24 nt, Human
caccucccucucuaccaccacugg

SEQ ID NO: 802212 - RNA, 21 nt, Human
caccugcuuucccuugucuuu

SEQ ID NO: 802213 - RNA, 24 nt, Human
cacgcuccaccagcagccacuccc

SEQ ID NO: 802214 - RNA, 21 nt, Human
cacggggcacacugggcauga

SEQ ID NO: 802215 - RNA, 19 nt, Human
cacuaugugcaccacagcc

SEQ ID NO: 802216 - RNA, 24 nt, Human
cacucuggaagagcgccccacagg

SEQ ID NO: 802217 - RNA, 23 nt, Human
cacucuguugccaggcuggagug

SEQ ID NO: 802218 - RNA, 21 nt, Human
cacugcaaccuccaccuccug

SEQ ID NO: 802219 - RNA, 23 nt, Human
cacugcaaccuccaccuccuggg

SEQ ID NO: 802220 - RNA, 21 nt, Human
cagaagauggccagugcccac

SEQ ID NO: 802221 - RNA, 20 nt, Human
cagaauggcuucuaggagga

SEQ ID NO: 802222 - RNA, 26 nt, Human
cagagagucuacccugaaccaggcac

SEQ ID NO: 802223 - RNA, 18 nt, Human
cagagcucccugguccag

SEQ ID NO: 802224 - RNA, 19 nt, Human
cagcagcugcaggaggaag

SEQ ID NO: 802225 - RNA, 23 nt, Human
cagcagcugcucacaggucugug

SEQ ID NO: 802226 - RNA, 19 nt, Human
cagccucagccucuaucuc

SEQ ID NO: 802227 - RNA, 23 nt, Human
cagccucccuagagcuccuccca

SEQ ID NO: 802228 - RNA, 20 nt, Human
cagccuccugaguagcuggg

SEQ ID NO: 802229 - RNA, 21 nt, Human
cagccucugaugcuuacuccu

SEQ ID NO: 802230 - RNA, 19 nt, Human
cagccuuauugagugaggu

SEQ ID NO: 802231 - RNA, 24 nt, Human
cagcgagcccugcuaaagcagcug

SEQ ID NO: 802232 - RNA, 20 nt, Human
cagcguccagggaagccugc

SEQ ID NO: 802233 - RNA, 21 nt, Human
cagcguccagggaagccugca

SEQ ID NO: 802234 - RNA, 21 nt, Human
cagcucacccugcagaagccc

SEQ ID NO: 802235 - RNA, 18 nt, Human
cagcucagggcccagcag

SEQ ID NO: 802236 - RNA, 19 nt, Human
cagcuggacagccuggacc

SEQ ID NO: 802237 - RNA, 20 nt, Human
cagcuggacagccuggacca

SEQ ID NO: 802238 - RNA, 25 nt, Human
caggacacuggggacugcagcuccc

SEQ ID NO: 802239 - RNA, 23 nt, Human
caggaggaagccccuauccagca

SEQ ID NO: 802240 - RNA, 19 nt, Human
caggaguccucagaagugu

SEQ ID NO: 802241 - RNA, 19 nt, Human
caggcgaugggcugccucc

SEQ ID NO: 802242 - RNA, 22 nt, Human
cagggaaccagucaccucccuc

SEQ ID NO: 802243 - RNA, 19 nt, Human
cagggacgugaaagcccaa

SEQ ID NO: 802244 - RNA, 20 nt, Human
caggggaagagcagccuggc

SEQ ID NO: 802245 - RNA, 22 nt, Human
cagugaggccucacucuggaag

SEQ ID NO: 802246 - RNA, 22 nt, Human
caucuucccugcagguuggggg

SEQ ID NO: 802247 - RNA, 22 nt, Human
cauguggaggcccucagggccc

SEQ ID NO: 802248 - RNA, 18 nt, Human
ccaaacgcagacacaggu

SEQ ID NO: 802249 - RNA, 26 nt, Human
ccaaagggagacucccaccuccaagc

SEQ ID NO: 802250 - RNA, 22 nt, Human
ccaaagugcugggauuacaggc

SEQ ID NO: 802251 - RNA, 22 nt, Human
ccaaagugcugggauuacaggc

SEQ ID NO: 802252 - RNA, 24 nt, Human
ccaaagugcugggauuacaggcgu

SEQ ID NO: 802253 - RNA, 27 nt, Human
ccaacaccaugcauacaaucagaucaa

SEQ ID NO: 802254 - RNA, 23 nt, Human
ccaagagccagagagcaucccug

SEQ ID NO: 802255 - RNA, 20 nt, Human
ccaagcccaccaccaagggc

SEQ ID NO: 802256 - RNA, 24 nt, Human
ccaagcccaccaccaagggcgagc

SEQ ID NO: 802257 - RNA, 18 nt, Human
ccacacucuccugccaga

SEQ ID NO: 802258 - RNA, 22 nt, Human
ccacaucugccaugggaaucca

SEQ ID NO: 802259 - RNA, 25 nt, Human
ccaccagccucccuagagcuccucc

SEQ ID NO: 802260 - RNA, 24 nt, Human
ccaccuccuggguucaagugauuc

SEQ ID NO: 802261 - RNA, 22 nt, Human
ccacgaccuucaagaacaccag

SEQ ID NO: 802262 - RNA, 18 nt, Human
ccagauaacaugucccac

SEQ ID NO: 802263 - RNA, 20 nt, Human
ccagauaacaugucccacag

SEQ ID NO: 802264 - RNA, 21 nt, Human
ccagccaagcagagcagccuc

SEQ ID NO: 802265 - RNA, 22 nt, Human
ccaggagcccugaauaucugac

SEQ ID NO: 802266 - RNA, 18 nt, Human
ccaggccaccugcccaag

SEQ ID NO: 802267 - RNA, 20 nt, Human
ccaggggcucugccacagcc

SEQ ID NO: 802268 - RNA, 22 nt, Human
cccacagccugugcucuucacu

SEQ ID NO: 802269 - RNA, 24 nt, Human
cccagcaaccuagcaucucugccc

SEQ ID NO: 802270 - RNA, 19 nt, Human
cccagccacgaccuucaag

SEQ ID NO: 802271 - RNA, 21 nt, Human
cccagcucuggcuuccuagcc

SEQ ID NO: 802272 - RNA, 22 nt, Human
cccaggagcugcugcagagccu

SEQ ID NO: 802273 - RNA, 18 nt, Human
cccagggucagacauggg

SEQ ID NO: 802274 - RNA, 20 nt, Human
cccagugcuaggcuugcccc

SEQ ID NO: 802275 - RNA, 25 nt, Human
cccaugaugggaaggaaacuaaaac

SEQ ID NO: 802276 - RNA, 25 nt, Human
cccaugccacaucucaagccagggg

SEQ ID NO: 802277 - RNA, 20 nt, Human
ccccacaggcaaagaugagg

SEQ ID NO: 802278 - RNA, 25 nt, Human
ccccagaggccagacgccuggugcc

SEQ ID NO: 802279 - RNA, 24 nt, Human
ccccagggaaccagucaccucccu

SEQ ID NO: 802280 - RNA, 21 nt, Human
cccccaggugggucccagccu

SEQ ID NO: 802281 - RNA, 21 nt, Human
cccccgaccccuacccuucca

SEQ ID NO: 802282 - RNA, 23 nt, Human
ccccgggaacuuguggagagccc

SEQ ID NO: 802283 - RNA, 27 nt, Human
cccgcaggcuccugcugcugcuucaaa

SEQ ID NO: 802284 - RNA, 19 nt, Human
cccguaauccacacaacca

SEQ ID NO: 802285 - RNA, 23 nt, Human
cccguaauccacacaaccaccca

SEQ ID NO: 802286 - RNA, 21 nt, Human
cccucucuacucucucccuca

SEQ ID NO: 802287 - RNA, 20 nt, Human
cccugaauaucugacuacca

SEQ ID NO: 802288 - RNA, 20 nt, Human
cccugcccuaccccauccca

SEQ ID NO: 802289 - RNA, 19 nt, Human
cccuucuaagguccugucc

SEQ ID NO: 802290 - RNA, 22 nt, Human
cccuugucuuuuucugaacaca

SEQ ID NO: 802291 - RNA, 21 nt, Human
ccgaccccuacccuuccacgc

SEQ ID NO: 802292 - RNA, 23 nt, Human
ccgcuuccaccagccucccuaga

SEQ ID NO: 802293 - RNA, 20 nt, Human
ccgggccacuggauauaagg

SEQ ID NO: 802294 - RNA, 25 nt, Human
ccucaggagacugugcacacucccu

SEQ ID NO: 802295 - RNA, 22 nt, Human
ccuccaccuccuggguucaagu

SEQ ID NO: 802296 - RNA, 19 nt, Human
ccuccaggccaccugccca

SEQ ID NO: 802297 - RNA, 19 nt, Human
ccucccuagagcuccuccc

SEQ ID NO: 802298 - RNA, 21 nt, Human
ccucccugcaguucccagcca

SEQ ID NO: 802299 - RNA, 19 nt, Human
ccuccuccccagugcuagg

SEQ ID NO: 802300 - RNA, 24 nt, Human
ccuccuggguucaagugauucucc

SEQ ID NO: 802301 - RNA, 22 nt, Human
ccucuagucacaacagccaaac

SEQ ID NO: 802302 - RNA, 22 nt, Human
ccugagaugccuccaggugugg

SEQ ID NO: 802303 - RNA, 25 nt, Human
ccugagccuccgucugucccaggag

SEQ ID NO: 802304 - RNA, 23 nt, Human
ccugaguagcugggacuacgggg

SEQ ID NO: 802305 - RNA, 21 nt, Human
ccugcagaagccccugacuag

SEQ ID NO: 802306 - RNA, 22 nt, Human
ccugcagcaaggguguuaaagc

SEQ ID NO: 802307 - RNA, 23 nt, Human
ccugccucagccuccugaguagc

SEQ ID NO: 802308 - RNA, 23 nt, Human
ccugcggcuaaccauccuggagc

SEQ ID NO: 802309 - RNA, 19 nt, Human
ccuggagcuagaacgggag

SEQ ID NO: 802310 - RNA, 21 nt, Human
ccuggcaccagaagauggcca

SEQ ID NO: 802311 - RNA, 21 nt, Human
ccugggccccagcaaccuagc

SEQ ID NO: 802312 - RNA, 23 nt, Human
ccuggguucaagugauucuccuc

SEQ ID NO: 802313 - RNA, 23 nt, Human
ccuggguucaagugauucuccug

SEQ ID NO: 802314 - RNA, 21 nt, Human
ccuuaggccaguuccagcaac

SEQ ID NO: 802315 - RNA, 18 nt, Human
ccuuccacgcaugugacc

SEQ ID NO: 802316 - RNA, 22 nt, Human
cgcaugcgccagcguccaggga

SEQ ID NO: 802317 - RNA, 22 nt, Human
cgcgcccggccuugcuaagucu

SEQ ID NO: 802318 - RNA, 18 nt, Human
cggaccugcggcuaacca

SEQ ID NO: 802319 - RNA, 19 nt, Human
cguaauccacacaaccacc

SEQ ID NO: 802320 - RNA, 20 nt, Human
cuagccuaccacuaugugcc

SEQ ID NO: 802321 - RNA, 23 nt, Human
cuagugaaaggggcaggucuggg

SEQ ID NO: 802322 - RNA, 18 nt, Human
cucacucuguugccaggc

SEQ ID NO: 802323 - RNA, 23 nt, Human
cucacucuguugccaggcuggag

SEQ ID NO: 802324 - RNA, 24 nt, Human
cucacugcaaccuccaccuccugg

SEQ ID NO: 802325 - RNA, 26 nt, Human
cucacugcaaccuccaccuccugggu

SEQ ID NO: 802326 - RNA, 24 nt, Human
cucagccuccugaguagcugggac

SEQ ID NO: 802327 - RNA, 24 nt, Human
cuccaagcucuugaugccugggcc

SEQ ID NO: 802328 - RNA, 22 nt, Human
cuccaggccaccugcccaagcu

SEQ ID NO: 802329 - RNA, 19 nt, Human
cucccuggcucugacaucc

SEQ ID NO: 802330 - RNA, 21 nt, Human
cuccugcugcugcuucaaagc

SEQ ID NO: 802331 - RNA, 24 nt, Human
cuccugcugcugcuucaaagcugu

SEQ ID NO: 802332 - RNA, 20 nt, Human
cuccuggguucaagugauuc

SEQ ID NO: 802333 - RNA, 21 nt, Human
cuccuggguucaagugauucu

SEQ ID NO: 802334 - RNA, 20 nt, Human
cucuaggucccacccagcuc

SEQ ID NO: 802335 - RNA, 24 nt, Human
cugaggaagcaggcgggcaagcug

SEQ ID NO: 802336 - RNA, 19 nt, Human
cugagucagaguaacagag

SEQ ID NO: 802337 - RNA, 24 nt, Human
cugcaaccuccaccuccuggguuc

SEQ ID NO: 802338 - RNA, 20 nt, Human
cugcagagggagaagcaagg

SEQ ID NO: 802339 - RNA, 21 nt, Human
cugccaugggaauccagaaug

SEQ ID NO: 802340 - RNA, 23 nt, Human
cugccucagccuccugaguagcu

SEQ ID NO: 802341 - RNA, 25 nt, Human
cugccuccacuccacggggcacacu

SEQ ID NO: 802342 - RNA, 19 nt, Human
cugcucugcccuaucaaug

SEQ ID NO: 802343 - RNA, 19 nt, Human
cugcugcagagccugcaga

SEQ ID NO: 802344 - RNA, 23 nt, Human
cugcuuucccuugucuuuuucug

SEQ ID NO: 802345 - RNA, 19 nt, Human
cuggagcaggcgacuacgg

SEQ ID NO: 802346 - RNA, 23 nt, Human
cugggacacaggcaagaggcagg

SEQ ID NO: 802347 - RNA, 21 nt, Human
cugggccucccaaagugcugg

SEQ ID NO: 802348 - RNA, 19 nt, Human
cuguaguaagcugagucag

SEQ ID NO: 802349 - RNA, 21 nt, Human
cuguaguuuuaaacuuggagg

SEQ ID NO: 802350 - RNA, 25 nt, Human
cugucacagccgccauguaucaggu

SEQ ID NO: 802351 - RNA, 22 nt, Human
cugugcucugggcaauggggcc

SEQ ID NO: 802352 - RNA, 19 nt, Human
cuucccccgaccccuaccc

SEQ ID NO: 802353 - RNA, 21 nt, Human
cuugcaaacugucacagccgc

SEQ ID NO: 802354 - RNA, 19 nt, Human
cuuucccuugucuuuuucu

SEQ ID NO: 802355 - RNA, 19 nt, Human
gaacaucccccagggaacc

SEQ ID NO: 802356 - RNA, 18 nt, Human
gaagcuggcccagcagag

SEQ ID NO: 802357 - RNA, 21 nt, Human
gaaggugggcaagguggucau

SEQ ID NO: 802358 - RNA, 18 nt, Human
gacaaacagcagcugcuc

SEQ ID NO: 802359 - RNA, 24 nt, Human
gacagagucucacucuguugccag

SEQ ID NO: 802360 - RNA, 21 nt, Human
gaccagcauucccuagacaca

SEQ ID NO: 802361 - RNA, 24 nt, Human
gaccaggaacgugaggagcugcgg

SEQ ID NO: 802362 - RNA, 20 nt, Human
gaccauugagacggcccugg

SEQ ID NO: 802363 - RNA, 20 nt, Human
gaccugacgcgccucaguaa

SEQ ID NO: 802364 - RNA, 19 nt, Human
gacgcuugcccagacucgu

SEQ ID NO: 802365 - RNA, 21 nt, Human
gagaagcaggguggguaaggg

SEQ ID NO: 802366 - RNA, 24 nt, Human
gagacgggguuucaccauguuggc

SEQ ID NO: 802367 - RNA, 20 nt, Human
gagcagcugcagagcgagcg

SEQ ID NO: 802368 - RNA, 21 nt, Human
gagcaggugugccacacucuc

SEQ ID NO: 802369 - RNA, 19 nt, Human
gagcagugccugucugagu

SEQ ID NO: 802370 - RNA, 22 nt, Human
gagccccauuuuguggcugagg

SEQ ID NO: 802371 - RNA, 19 nt, Human
gagcgggagcggcugcugg

SEQ ID NO: 802372 - RNA, 20 nt, Human
gagcucuaggucccacccag

SEQ ID NO: 802373 - RNA, 23 nt, Human
gagcuuggggugcgggccgcaga

SEQ ID NO: 802374 - RNA, 19 nt, Human
gagggcucgugugggcagg

SEQ ID NO: 802375 - RNA, 22 nt, Human
gaguagcugggacuacgggggc

SEQ ID NO: 802376 - RNA, 23 nt, Human
gaguagcugggacuacgggggcc

SEQ ID NO: 802377 - RNA, 18 nt, Human
gaguaggugaccuguugc

SEQ ID NO: 802378 - RNA, 18 nt, Human
gagugucaggcaaggcug

SEQ ID NO: 802379 - RNA, 18 nt, Human
gauuacaggcgugagcca

SEQ ID NO: 802380 - RNA, 22 nt, Human
gauuacaggcgugagccaccgc

SEQ ID NO: 802381 - RNA, 22 nt, Human
gauuacaggcgugagccaccgc

SEQ ID NO: 802382 - RNA, 21 nt, Human
gauucuccugccucagccucc

SEQ ID NO: 802383 - RNA, 19 nt, Human
gcaaaggcccagcagcugc

SEQ ID NO: 802384 - RNA, 18 nt, Human
gcaaggccaggccuggcu

SEQ ID NO: 802385 - RNA, 18 nt, Human
gcaaggccuggagcaggc

SEQ ID NO: 802386 - RNA, 19 nt, Human
gcaagugcuucaugcguca

SEQ ID NO: 802387 - RNA, 18 nt, Human
gcagagggagaagcaagg

SEQ ID NO: 802388 - RNA, 24 nt, Human
gcagcugcucacaggucugugccc

SEQ ID NO: 802389 - RNA, 18 nt, Human
gccagcuucccccgaccc

SEQ ID NO: 802390 - RNA, 20 nt, Human
gcccagccgcuuccaccagc

SEQ ID NO: 802391 - RNA, 22 nt, Human
gcccaggggcucugccacagcc

SEQ ID NO: 802392 - RNA, 21 nt, Human
gcccgcguggaggagcagcug

SEQ ID NO: 802393 - RNA, 24 nt, Human
gccuagugaaaggggcaggucugg

SEQ ID NO: 802394 - RNA, 20 nt, Human
gccucaaggugggccugaga

SEQ ID NO: 802395 - RNA, 21 nt, Human
gccuccaggccaccugcccaa

SEQ ID NO: 802396 - RNA, 19 nt, Human
gccuucacaccucgcccca

SEQ ID NO: 802397 - RNA, 24 nt, Human
gccuuggggaucaugccuugcucc

SEQ ID NO: 802398 - RNA, 19 nt, Human
gcuaagucuuuugagagcu

SEQ ID NO: 802399 - RNA, 24 nt, Human
gcuaagucuuuuuuuuuuuuuuuu

SEQ ID NO: 802400 - RNA, 30 nt, Human
gcuaagucuuuuuuuuuuuuuuuuuuuuuu

SEQ ID NO: 802401 - RNA, 22 nt, Human
gcuccugcugcugcuucaaagc

SEQ ID NO: 802402 - RNA, 20 nt, Human
gcugagucagaguaacagag

SEQ ID NO: 802403 - RNA, 25 nt, Human
gcuggagugcaguggcacaaucucu

SEQ ID NO: 802404 - RNA, 19 nt, Human
ggaaggacagggcaggcag

SEQ ID NO: 802405 - RNA, 22 nt, Human
ggaccaggaacgugaggagcug

SEQ ID NO: 802406 - RNA, 23 nt, Human
ggaccugcggcuaaccauccugg

SEQ ID NO: 802407 - RNA, 18 nt, Human
ggagacacagaagaggcu

SEQ ID NO: 802408 - RNA, 21 nt, Human
ggagccccaucauaggcccuu

SEQ ID NO: 802409 - RNA, 21 nt, Human
ggagcuggauaaggagaaggc

SEQ ID NO: 802410 - RNA, 18 nt, Human
ggaggcuccgggccacug

SEQ ID NO: 802411 - RNA, 23 nt, Human
ggaguucaguugagaguccccag

SEQ ID NO: 802412 - RNA, 19 nt, Human
ggcacaggaggcagaucca

SEQ ID NO: 802413 - RNA, 21 nt, Human
ggccagcaggucugcugggcc

SEQ ID NO: 802414 - RNA, 18 nt, Human
ggcccgccaccacaccca

SEQ ID NO: 802415 - RNA, 18 nt, Human
ggcuguggccagggaggg

SEQ ID NO: 802416 - RNA, 30 nt, Human
gggaaugggggaucaucuauauugggggac

SEQ ID NO: 802417 - RNA, 23 nt, Human
gggagacucccaccuccaagccc

SEQ ID NO: 802418 - RNA, 20 nt, Human
gggagcacgacaaacagcag

SEQ ID NO: 802419 - RNA, 24 nt, Human
gggagggcagcaaggaagggggug

SEQ ID NO: 802420 - RNA, 25 nt, Human
gggcaagcucuuccccucucugggu

SEQ ID NO: 802421 - RNA, 21 nt, Human
gggcacaggaggcagauccag

SEQ ID NO: 802422 - RNA, 23 nt, Human
gggcaggcagagggugagccagg

SEQ ID NO: 802423 - RNA, 18 nt, Human
gggccagcagcugagggc

SEQ ID NO: 802424 - RNA, 22 nt, Human
gggcccagcaggugaggguggg

SEQ ID NO: 802425 - RNA, 19 nt, Human
gggcccugcauguccgugg

SEQ ID NO: 802426 - RNA, 20 nt, Human
ggggaauaaggccucgggag

SEQ ID NO: 802427 - RNA, 19 nt, Human
ggggcacacugggcaugaa

SEQ ID NO: 802428 - RNA, 23 nt, Human
gggguuucaccauguuggccagg

SEQ ID NO: 802429 - RNA, 23 nt, Human
ggguagggacggugccccagggc

SEQ ID NO: 802430 - RNA, 22 nt, Human
ggguguuaggaaaugugggcuu

SEQ ID NO: 802431 - RNA, 22 nt, Human
ggguuucaccauguuggccagg

SEQ ID NO: 802432 - RNA, 19 nt, Human
ggucggcuggagggcgcug

SEQ ID NO: 802433 - RNA, 20 nt, Human
ggugagccagggcccggggc

SEQ ID NO: 802434 - RNA, 24 nt, Human
gguuucaccauguuggccaggaug

SEQ ID NO: 802435 - RNA, 23 nt, Human
guagagacgggguuucaccaugu

SEQ ID NO: 802436 - RNA, 21 nt, Human
guccagggaagccugcagaag

SEQ ID NO: 802437 - RNA, 24 nt, Human
gucucacucuguugccaggcugga

SEQ ID NO: 802438 - RNA, 27 nt, Human
gucuuuuuuuuuuuuuuuuuuuuuuug

SEQ ID NO: 802439 - RNA, 22 nt, Human
gugaggccagggcccucgcuag

SEQ ID NO: 802440 - RNA, 24 nt, Human
gugauucuccugccucagccuccu

SEQ ID NO: 802441 - RNA, 20 nt, Human
guggaggcuccgggccacug

SEQ ID NO: 802442 - RNA, 24 nt, Human
guggccuucacaccucgccccagc

SEQ ID NO: 802443 - RNA, 23 nt, Human
uaaagcagcuggacagccuggac

SEQ ID NO: 802444 - RNA, 19 nt, Human
uaagcaagagcccaguaac

SEQ ID NO: 802445 - RNA, 21 nt, Human
uaaggaaguugcccaaggcca

SEQ ID NO: 802446 - RNA, 23 nt, Human
uaagucuuuuuuuuuuuuuuuuu

SEQ ID NO: 802447 - RNA, 23 nt, Human
uacaaucagaucaagccuggagc

SEQ ID NO: 802448 - RNA, 23 nt, Human
uacaggcgugagccaccgcgccc

SEQ ID NO: 802449 - RNA, 26 nt, Human
uaccccaagugggugcuguucucugu

SEQ ID NO: 802450 - RNA, 20 nt, Human
uacucucucccucaccugcu

SEQ ID NO: 802451 - RNA, 23 nt, Human
uagacacagacacacaccccagg

SEQ ID NO: 802452 - RNA, 22 nt, Human
uagagacgggguuucaccaugu

SEQ ID NO: 802453 - RNA, 22 nt, Human
uagccuaccacuaugugcacca

SEQ ID NO: 802454 - RNA, 21 nt, Human
uaggggacuggggauggugcc

SEQ ID NO: 802455 - RNA, 24 nt, Human
uaguagagacgggguuucaccaug

SEQ ID NO: 802456 - RNA, 26 nt, Human
uaguagagacgggguuucaccauguu

SEQ ID NO: 802457 - RNA, 22 nt, Human
uauaauacuccuuuuucuuaca

SEQ ID NO: 802458 - RNA, 19 nt, Human
uauacaacggaggucaugu

SEQ ID NO: 802459 - RNA, 21 nt, Human
ucaagccagggguguggcugg

SEQ ID NO: 802460 - RNA, 25 nt, Human
ucaagccagggguguugucucccga

SEQ ID NO: 802461 - RNA, 19 nt, Human
ucaagugauucuccugccu

SEQ ID NO: 802462 - RNA, 24 nt, Human
ucacagccgccauguaucaggugu

SEQ ID NO: 802463 - RNA, 24 nt, Human
ucaccauguuggccaggauggucu

SEQ ID NO: 802464 - RNA, 23 nt, Human
ucacugcaaccuccaccuccugg

SEQ ID NO: 802465 - RNA, 24 nt, Human
ucacugcaaccuccaccuccuggg

SEQ ID NO: 802466 - RNA, 25 nt, Human
ucacugcaaccuccaccuccugggu

SEQ ID NO: 802467 - RNA, 27 nt, Human
ucacugcaaccuccaccuccuggguuc

SEQ ID NO: 802468 - RNA, 22 nt, Human
ucagagccucccugcaguuccc

SEQ ID NO: 802469 - RNA, 26 nt, Human
ucagaucaagccuggagcuuggggug

SEQ ID NO: 802470 - RNA, 23 nt, Human
ucagccuccugaguagcugggac

SEQ ID NO: 802471 - RNA, 25 nt, Human
ucagccucuaucuccccacuguggu

SEQ ID NO: 802472 - RNA, 19 nt, Human
ucagggccagcagcugagg

SEQ ID NO: 802473 - RNA, 20 nt, Human
ucagggcccagcaggugagg

SEQ ID NO: 802474 - RNA, 23 nt, Human
ucaguggguguuaggaaaugugg

SEQ ID NO: 802475 - RNA, 24 nt, Human
ucauuuuucuauuuuuaguagaga

SEQ ID NO: 802476 - RNA, 18 nt, Human
uccaccagcagccacucc

SEQ ID NO: 802477 - RNA, 22 nt, Human
uccaccagcagccacuccccca

SEQ ID NO: 802478 - RNA, 18 nt, Human
uccagagaguuauucccc

SEQ ID NO: 802479 - RNA, 21 nt, Human
uccagagaguuauuccccugg

SEQ ID NO: 802480 - RNA, 19 nt, Human
uccauggacgacaccaagg

SEQ ID NO: 802481 - RNA, 23 nt, Human
uccauggacgacaccaaggccca

SEQ ID NO: 802482 - RNA, 24 nt, Human
ucccaaagugcugggauuacaggc

SEQ ID NO: 802483 - RNA, 18 nt, Human
ucccacagacucuggcaa

SEQ ID NO: 802484 - RNA, 22 nt, Human
ucccaccuccaagcccaccacc

SEQ ID NO: 802485 - RNA, 24 nt, Human
ucccagaccauugagacggcccug

SEQ ID NO: 802486 - RNA, 22 nt, Human
ucccagaccugcacaggcccac

SEQ ID NO: 802487 - RNA, 19 nt, Human
ucccagauaacauguccca

SEQ ID NO: 802488 - RNA, 25 nt, Human
ucccagccucugucucagguggguc

SEQ ID NO: 802489 - RNA, 20 nt, Human
ucccauggccgcaggcggcc

SEQ ID NO: 802490 - RNA, 23 nt, Human
ucccccagggaaccagucaccuc

SEQ ID NO: 802491 - RNA, 18 nt, Human
uccccugaccugggccuc

SEQ ID NO: 802492 - RNA, 19 nt, Human
uccccugaccugggccucc

SEQ ID NO: 802493 - RNA, 18 nt, Human
uccccuggcacuuccagc

SEQ ID NO: 802494 - RNA, 24 nt, Human
uccccuggcacuuccagccaagca

SEQ ID NO: 802495 - RNA, 24 nt, Human
ucccuagacacagacacacacccc

SEQ ID NO: 802496 - RNA, 20 nt, Human
ucccugagaugccuccaggu

SEQ ID NO: 802497 - RNA, 24 nt, Human
ucccugagaugccuccaggugugg

SEQ ID NO: 802498 - RNA, 22 nt, Human
ucccugaggaaguagccccugg

SEQ ID NO: 802499 - RNA, 18 nt, Human
ucccugcuuguccguucc

SEQ ID NO: 802500 - RNA, 19 nt, Human
ucccuugucuuuuucugaa

SEQ ID NO: 802501 - RNA, 23 nt, Human
ucccuugucuuuuucugaacaca

SEQ ID NO: 802502 - RNA, 21 nt, Human
uccucgcuacagcaacaggag

SEQ ID NO: 802503 - RNA, 26 nt, Human
uccugaguagcugggacuacgggggc

SEQ ID NO: 802504 - RNA, 21 nt, Human
uccuggguucaagugauucuc

SEQ ID NO: 802505 - RNA, 24 nt, Human
uccuggguucaagugauucuccug

SEQ ID NO: 802506 - RNA, 20 nt, Human
ucgccccagcucuggcuucc

SEQ ID NO: 802507 - RNA, 23 nt, Human
ucucacucuguugccaggcugga

SEQ ID NO: 802508 - RNA, 24 nt, Human
ucucaggugggucagccucagccu

SEQ ID NO: 802509 - RNA, 22 nt, Human
ucucccucaccugcuuucccuu

SEQ ID NO: 802510 - RNA, 24 nt, Human
ucuccugccucagccuccugagua

SEQ ID NO: 802511 - RNA, 24 nt, Human
ucugcugggccagcacggagcugg

SEQ ID NO: 802512 - RNA, 22 nt, Human
ucuggcuuccuagccuaccacu

SEQ ID NO: 802513 - RNA, 18 nt, Human
ucuguugccaggcuggag

SEQ ID NO: 802514 - RNA, 23 nt, Human
ucuguugccaggcuggagugcag

SEQ ID NO: 802515 - RNA, 19 nt, Human
ugaaacagcagcgggaguc

SEQ ID NO: 802516 - RNA, 21 nt, Human
ugaccagcauucccuagacac

SEQ ID NO: 802517 - RNA, 18 nt, Human
ugaccgucaccaucaccu

SEQ ID NO: 802518 - RNA, 18 nt, Human
ugagacagagucucacuc

SEQ ID NO: 802519 - RNA, 22 nt, Human
ugagacagagucucacucuguu

SEQ ID NO: 802520 - RNA, 20 nt, Human
ugagaugccuccaggugugg

SEQ ID NO: 802521 - RNA, 23 nt, Human
ugagcaucguccaucucuguccc

SEQ ID NO: 802522 - RNA, 20 nt, Human
ugagccuccgucugucccag

SEQ ID NO: 802523 - RNA, 19 nt, Human
ugagcuggacgcccaugac

SEQ ID NO: 802524 - RNA, 23 nt, Human
ugaggacucugaggcccagagau

SEQ ID NO: 802525 - RNA, 24 nt, Human
ugaggacucugaggcccagagaug

SEQ ID NO: 802526 - RNA, 23 nt, Human
ugaggagcugcggggcagccugg

SEQ ID NO: 802527 - RNA, 20 nt, Human
ugaggcaaggccaggccugg

SEQ ID NO: 802528 - RNA, 23 nt, Human
ugaggccagggcccucgcuagcc

SEQ ID NO: 802529 - RNA, 18 nt, Human
ugagggaaccgagguaug

SEQ ID NO: 802530 - RNA, 19 nt, Human
ugagguaguacagcgcucc

SEQ ID NO: 802531 - RNA, 24 nt, Human
ugaugccugggccaguuccccaga

SEQ ID NO: 802532 - RNA, 20 nt, Human
ugauucuccugccucagccu

SEQ ID NO: 802533 - RNA, 19 nt, Human
ugccaagggcaugcugggg

SEQ ID NO: 802534 - RNA, 20 nt, Human
ugccaagggcaugcuggggc

SEQ ID NO: 802535 - RNA, 20 nt, Human
ugccaagggcaugcuggggc

SEQ ID NO: 802536 - RNA, 18 nt, Human
ugccacccaggagacaca

SEQ ID NO: 802537 - RNA, 19 nt, Human
ugccagagaagucuccggc

SEQ ID NO: 802538 - RNA, 21 nt, Human
ugccaggcuggagugcagugg

SEQ ID NO: 802539 - RNA, 23 nt, Human
ugccaggcuggagugcaguggca

SEQ ID NO: 802540 - RNA, 18 nt, Human
ugccauagaaacaaguga

SEQ ID NO: 802541 - RNA, 24 nt, Human
ugccaugggaauccagaauggcuu

SEQ ID NO: 802542 - RNA, 24 nt, Human
ugccucagccuccugaguagcugg

SEQ ID NO: 802543 - RNA, 21 nt, Human
ugccugcugccagcuuccccc

SEQ ID NO: 802544 - RNA, 20 nt, Human
ugccugggccaguuccccag

SEQ ID NO: 802545 - RNA, 21 nt, Human
ugcuaagucuuuugagagcuc

SEQ ID NO: 802546 - RNA, 21 nt, Human
ugcugcagaggcaaaggccca

SEQ ID NO: 802547 - RNA, 24 nt, Human
ugcugggauuacaggcgugagcca

SEQ ID NO: 802548 - RNA, 23 nt, Human
ugcugugacccaggcuucaggcg

SEQ ID NO: 802549 - RNA, 19 nt, Human
uggaagaacccaggcuggg

SEQ ID NO: 802550 - RNA, 18 nt, Human
uggaaggaagugggggug

SEQ ID NO: 802551 - RNA, 20 nt, Human
uggaaggaagugggggugag

SEQ ID NO: 802552 - RNA, 20 nt, Human
uggagacccgaggagaagaa

SEQ ID NO: 802553 - RNA, 21 nt, Human
uggaggagcaggugcagcagu

SEQ ID NO: 802554 - RNA, 23 nt, Human
uggaggaggcugaagggcagaag

SEQ ID NO: 802555 - RNA, 18 nt, Human
uggagugcaguggcacaa

SEQ ID NO: 802556 - RNA, 22 nt, Human
uggagugcaguggcacaaucuc

SEQ ID NO: 802557 - RNA, 24 nt, Human
uggcacaaucucugcucacugcaa

SEQ ID NO: 802558 - RNA, 22 nt, Human
uggccaggauggucuugaucuc

SEQ ID NO: 802559 - RNA, 20 nt, Human
uggcucagagcagaugaugc

SEQ ID NO: 802560 - RNA, 21 nt, Human
uggcuucuaggaggagguggc

SEQ ID NO: 802561 - RNA, 22 nt, Human
ugggaaggaaacuaaaacugag

SEQ ID NO: 802562 - RNA, 21 nt, Human
ugggacuacgggggcccgcca

SEQ ID NO: 802563 - RNA, 22 nt, Human
ugggacuacgggggcccgccac

SEQ ID NO: 802564 - RNA, 24 nt, Human
ugggacuacgggggcccgccacca

SEQ ID NO: 802565 - RNA, 22 nt, Human
ugggaggccugagggauuugcc

SEQ ID NO: 802566 - RNA, 21 nt, Human
ugggauccuggccuugaccag

SEQ ID NO: 802567 - RNA, 22 nt, Human
ugggaugaugugacacuggaga

SEQ ID NO: 802568 - RNA, 18 nt, Human
ugggauuacaggcgugag

SEQ ID NO: 802569 - RNA, 19 nt, Human
ugggauuacaggcgugagc

SEQ ID NO: 802570 - RNA, 21 nt, Human
ugggauuacaggcgugagcca

SEQ ID NO: 802571 - RNA, 22 nt, Human
ugggauuacaggcgugagccac

SEQ ID NO: 802572 - RNA, 23 nt, Human
ugggauuacaggcgugagccacc

SEQ ID NO: 802573 - RNA, 24 nt, Human
ugggauuacaggcgugagccaccg

SEQ ID NO: 802574 - RNA, 18 nt, Human
uggggacugcagcucccc

SEQ ID NO: 802575 - RNA, 24 nt, Human
uggggauggugccaagggcaugcu

SEQ ID NO: 802576 - RNA, 24 nt, Human
uggguaagggcccagccgcuucca

SEQ ID NO: 802577 - RNA, 19 nt, Human
ugggugcuguucucugugc

SEQ ID NO: 802578 - RNA, 23 nt, Human
uggguucaagugauucuccugcc

SEQ ID NO: 802579 - RNA, 21 nt, Human
uggugccaagggcaugcuggg

SEQ ID NO: 802580 - RNA, 24 nt, Human
uggugugccucccuucuaaggucc

SEQ ID NO: 802581 - RNA, 25 nt, Human
uggugugccucccuucuaagguccc

SEQ ID NO: 802582 - RNA, 23 nt, Human
uguaucaggugucugcugugacc

SEQ ID NO: 802583 - RNA, 18 nt, Human
ugucacacugucacagaa

SEQ ID NO: 802584 - RNA, 19 nt, Human
uguccaaaacgggggggcc

SEQ ID NO: 802585 - RNA, 19 nt, Human
uguccaaaauccgggaagu

SEQ ID NO: 802586 - RNA, 18 nt, Human
uguccguggggcucacgg

SEQ ID NO: 802587 - RNA, 20 nt, Human
ugucugugggcaagcucuuc

SEQ ID NO: 802588 - RNA, 19 nt, Human
ugucuuuuucugaacacag

SEQ ID NO: 802589 - RNA, 24 nt, Human
ugugacugccucuagucacaacag

SEQ ID NO: 802590 - RNA, 19 nt, Human
uguggaagaacccaggcug

SEQ ID NO: 802591 - RNA, 24 nt, Human
uguggaagaacccaggcugggaca

SEQ ID NO: 802592 - RNA, 21 nt, Human
uguggaggcccucagggccca

SEQ ID NO: 802593 - RNA, 21 nt, Human
uguggcugaggacucugaggc

SEQ ID NO: 802594 - RNA, 22 nt, Human
uguguggaagaacccaggcugg

SEQ ID NO: 802595 - RNA, 27 nt, Human
uuaaugauccccugaccugggccuccc

SEQ ID NO: 802596 - RNA, 22 nt, Human
uuacuggcucccaccgcccucc

SEQ ID NO: 802597 - RNA, 18 nt, Human
uuaguagagacgggguuu

SEQ ID NO: 802598 - RNA, 22 nt, Human
uuaguagagacgggguuucacc

SEQ ID NO: 802599 - RNA, 24 nt, Human
uuaguagagacgggguuucaccau

SEQ ID NO: 802600 - RNA, 21 nt, Human
uucaagugauucuccugccuc

SEQ ID NO: 802601 - RNA, 23 nt, Human
uucaagugauucuccugccucag

SEQ ID NO: 802602 - RNA, 24 nt, Human
uucaagugauucuccugccucagc

SEQ ID NO: 802603 - RNA, 22 nt, Human
uucagcaacaugggaugaugug

SEQ ID NO: 802604 - RNA, 19 nt, Human
uucaggcgccgcagccucu

SEQ ID NO: 802605 - RNA, 19 nt, Human
uucaucuauacaacggagg

SEQ ID NO: 802606 - RNA, 18 nt, Human
uuccaccagccucccuag

SEQ ID NO: 802607 - RNA, 19 nt, Human
uucccagaauuccucucca

SEQ ID NO: 802608 - RNA, 18 nt, Human
uucccccgaccccuaccc

SEQ ID NO: 802609 - RNA, 24 nt, Human
uuccugcuuuccauucagugggug

SEQ ID NO: 802610 - RNA, 24 nt, Human
uucuaagguccugucccauugggc

SEQ ID NO: 802611 - RNA, 21 nt, Human
uugccaggcuggagugcagug

SEQ ID NO: 802612 - RNA, 18 nt, Human
uugcccaaggccacacag

SEQ ID NO: 802613 - RNA, 23 nt, Human
uugggcacaggaggcagauccag

SEQ ID NO: 802614 - RNA, 20 nt, Human
uugggggacagggaaggggg

SEQ ID NO: 802615 - RNA, 24 nt, Human
uuguguggaagaacccaggcuggg

SEQ ID NO: 802616 - RNA, 19 nt, Human
uuucaccauguuggccagg

SEQ ID NO: 802617 - RNA, 20 nt, Human
uuucaccauguuggccagga

SEQ ID NO: 802618 - RNA, 19 nt, Human
uuucuuacaauucaugccu

SEQ ID NO: 802619 - RNA, 24 nt, Human
uuuuuaguagagacgggguuucac

SEQ ID NO: 802620 - RNA, 20 nt, Human
uuuuucuauuuuuaguagag

SEQ ID NO: 802621 - RNA, 20 nt, Human
uuuuuuuuuuugagacagag

SEQ ID NO: 802622 - RNA, 26 nt, Human
uuuuuuuuuuuugagacagagucuca

SEQ ID NO: 802623 - RNA, 27 nt, Human
uuuuuuuuuuuuuuuuuuuuuuugggg

SEQ ID NO: 802624 - RNA, 23 nt, Human
aaacacacauuggccacagaaaa

SEQ ID NO: 802625 - RNA, 25 nt, Human
acacagcuucuggagggagggaacc

SEQ ID NO: 802626 - RNA, 23 nt, Human
acagaaaaaggcgcuucuccgua

SEQ ID NO: 802627 - RNA, 22 nt, Human
acagauaaccuuaaccucccag

SEQ ID NO: 802628 - RNA, 22 nt, Human
agacagaaaaauaacauucuga

SEQ ID NO: 802629 - RNA, 23 nt, Human
agagaaaacacacauuggccaca

SEQ ID NO: 802630 - RNA, 25 nt, Human
agcgcagcuacucuuaaccccuugg

SEQ ID NO: 802631 - RNA, 25 nt, Human
agggaggaaggggauacccgccuag

SEQ ID NO: 802632 - RNA, 20 nt, Human
aguggugagggaggaagggg

SEQ ID NO: 802633 - RNA, 23 nt, Human
augguggugaggaggggugcugg

SEQ ID NO: 802634 - RNA, 23 nt, Human
caaggcaauggacagauaaccuu

SEQ ID NO: 802635 - RNA, 22 nt, Human
cagagccuaggggacgcuuaag

SEQ ID NO: 802636 - RNA, 19 nt, Human
cagcugccgccgcucccgc

SEQ ID NO: 802637 - RNA, 22 nt, Human
ccacagaaaaaggcgcuucucc

SEQ ID NO: 802638 - RNA, 21 nt, Human
ccagaucagccgaaucaaccc

SEQ ID NO: 802639 - RNA, 25 nt, Human
cccagagaaaacacacauuggccac

SEQ ID NO: 802640 - RNA, 21 nt, Human
ccucacaucccaaaaauaaca

SEQ ID NO: 802641 - RNA, 20 nt, Human
ccucuugcagcugccgcaac

SEQ ID NO: 802642 - RNA, 18 nt, Human
cgcagccagaucacccuc

SEQ ID NO: 802643 - RNA, 22 nt, Human
cggcugcgcugugccucccacu

SEQ ID NO: 802644 - RNA, 24 nt, Human
cugccgccgcucccgcucggccuc

SEQ ID NO: 802645 - RNA, 19 nt, Human
cugcgcugugccucccacu

SEQ ID NO: 802646 - RNA, 21 nt, Human
gaaaaauaacauucugagagc

SEQ ID NO: 802647 - RNA, 19 nt, Human
gacagauaaccuuaaccuc

SEQ ID NO: 802648 - RNA, 23 nt, Human
gacagauaaccuuaaccucccag

SEQ ID NO: 802649 - RNA, 26 nt, Human
gccagaucacccucacaucccaaaaa

SEQ ID NO: 802650 - RNA, 20 nt, Human
gccgccgcucccgcucggcc

SEQ ID NO: 802651 - RNA, 25 nt, Human
gucgcagccagaucacccucacauc

SEQ ID NO: 802652 - RNA, 19 nt, Human
uaacacaguggcacuugga

SEQ ID NO: 802653 - RNA, 22 nt, Human
uaaccucccagagaaaacacac

SEQ ID NO: 802654 - RNA, 22 nt, Human
uaaccuuaaccucccagagaaa

SEQ ID NO: 802655 - RNA, 21 nt, Human
uaagacagaaaaauaacauuc

SEQ ID NO: 802656 - RNA, 23 nt, Human
uaucagcaacuuugaaauggcuu

SEQ ID NO: 802657 - RNA, 20 nt, Human
uaugguggugaggaggggug

SEQ ID NO: 802658 - RNA, 22 nt, Human
ucacgcagcuggcgcucccggg

SEQ ID NO: 802659 - RNA, 18 nt, Human
ucagccgaaucaacccug

SEQ ID NO: 802660 - RNA, 24 nt, Human
ucccaaaaauaacacucagauugc

SEQ ID NO: 802661 - RNA, 19 nt, Human
uccucuugcagcugccgca

SEQ ID NO: 802662 - RNA, 23 nt, Human
ugaggaggggugcuggugugagg

SEQ ID NO: 802663 - RNA, 19 nt, Human
ugccauaguuaucagcaac

SEQ ID NO: 802664 - RNA, 21 nt, Human
ugccgcaacucccggcugcgc

SEQ ID NO: 802665 - RNA, 20 nt, Human
uggcagggugugagcagcca

SEQ ID NO: 802666 - RNA, 19 nt, Human
uggugaggaggggugcugg

SEQ ID NO: 802667 - RNA, 20 nt, Human
ugguggugaggaggggugcu

SEQ ID NO: 802668 - RNA, 21 nt, Human
uguagacuuuucuugagacuu

SEQ ID NO: 802669 - RNA, 25 nt, Human
aaacaagagauucuuuggcccagag

SEQ ID NO: 802670 - RNA, 20 nt, Human
aaacagagcacagcccagga

SEQ ID NO: 802671 - RNA, 27 nt, Human
aaacaugaaaaggugggagcgaccuag

SEQ ID NO: 802672 - RNA, 20 nt, Human
aaaccagagaaccccccagg

SEQ ID NO: 802673 - RNA, 21 nt, Human
aaaccagagaaccccccagga

SEQ ID NO: 802674 - RNA, 23 nt, Human
aacaccgggcccacauucagccc

SEQ ID NO: 802675 - RNA, 19 nt, Human
aacacggugaaaccccguc

SEQ ID NO: 802676 - RNA, 20 nt, Human
aacacggugaaaccccgucu

SEQ ID NO: 802677 - RNA, 21 nt, Human
aacacggugaaaccccgucuc

SEQ ID NO: 802678 - RNA, 20 nt, Human
aaccagggaccagaacugca

SEQ ID NO: 802679 - RNA, 23 nt, Human
aaccagggaccagaacugcagcc

SEQ ID NO: 802680 - RNA, 23 nt, Human
aaccugagggcagagggugcaau

SEQ ID NO: 802681 - RNA, 20 nt, Human
aagaagccaguguggcccag

SEQ ID NO: 802682 - RNA, 18 nt, Human
aagacagagacucagagc

SEQ ID NO: 802683 - RNA, 23 nt, Human
aaggaaccgagaugagcaccugc

SEQ ID NO: 802684 - RNA, 20 nt, Human
aaucagguugggcagggcug

SEQ ID NO: 802685 - RNA, 19 nt, Human
aauccaguccacccuggac

SEQ ID NO: 802686 - RNA, 18 nt, Human
acaacagagcagacagac

SEQ ID NO: 802687 - RNA, 23 nt, Human
acacacccucaagaaccugaggg

SEQ ID NO: 802688 - RNA, 18 nt, Human
acacagcacaucuguccc

SEQ ID NO: 802689 - RNA, 20 nt, Human
acacagcacaucuguccccc

SEQ ID NO: 802690 - RNA, 20 nt, Human
acaccgggcccacauucagc

SEQ ID NO: 802691 - RNA, 22 nt, Human
acaccgggcccacauucagccc

SEQ ID NO: 802692 - RNA, 24 nt, Human
acagagcgagacucugucucaaaa

SEQ ID NO: 802693 - RNA, 23 nt, Human
accagagauguucagccaccagg

SEQ ID NO: 802694 - RNA, 19 nt, Human
accagcuccgugcuugugc

SEQ ID NO: 802695 - RNA, 24 nt, Human
accccgucucuacuaaaaauacaa

SEQ ID NO: 802696 - RNA, 25 nt, Human
acccuuccuaccugacaaccgacuc

SEQ ID NO: 802697 - RNA, 22 nt, Human
accuuguccuguacacagcaca

SEQ ID NO: 802698 - RNA, 19 nt, Human
acguuaaggaaccgagaug

SEQ ID NO: 802699 - RNA, 28 nt, Human
acucugucucaaaaaaaaaaaaaaaaaa

SEQ ID NO: 802700 - RNA, 24 nt, Human
acugcacuccagccugggcgacag

SEQ ID NO: 802701 - RNA, 26 nt, Human
acugcacuccagccugggcgacagag

SEQ ID NO: 802702 - RNA, 20 nt, Human
agaaagaaacaugaaaaggu

SEQ ID NO: 802703 - RNA, 18 nt, Human
agaaggagccugccaggg

SEQ ID NO: 802704 - RNA, 21 nt, Human
agacaacagagcagacagacc

SEQ ID NO: 802705 - RNA, 25 nt, Human
agacagaccagugaugaccaugggg

SEQ ID NO: 802706 - RNA, 22 nt, Human
agagcccuggccugggaguucc

SEQ ID NO: 802707 - RNA, 20 nt, Human
agaggaaagccuaagugagg

SEQ ID NO: 802708 - RNA, 24 nt, Human
agcacuuugggaggccaagguggg

SEQ ID NO: 802709 - RNA, 19 nt, Human
agcccagagcucauggcag

SEQ ID NO: 802710 - RNA, 23 nt, Human
agccuaagugaggggucagacua

SEQ ID NO: 802711 - RNA, 21 nt, Human
agccucuucccuggaccgggg

SEQ ID NO: 802712 - RNA, 24 nt, Human
agccugggcgacagagcgagacuc

SEQ ID NO: 802713 - RNA, 20 nt, Human
aggaaagggauccugcccag

SEQ ID NO: 802714 - RNA, 18 nt, Human
aggagcugcuccaggagg

SEQ ID NO: 802715 - RNA, 23 nt, Human
aggaggaagaggccaucacccag

SEQ ID NO: 802716 - RNA, 23 nt, Human
aggauuaaaaguuggcuuuagcu

SEQ ID NO: 802717 - RNA, 27 nt, Human
aggcaggaggauggcgugaacccagga

SEQ ID NO: 802718 - RNA, 20 nt, Human
aggcaggugggaaggcaaac

SEQ ID NO: 802719 - RNA, 23 nt, Human
aggcaggugggaaggcaaacaag

SEQ ID NO: 802720 - RNA, 18 nt, Human
aggcaucccagagauagc

SEQ ID NO: 802721 - RNA, 21 nt, Human
aggccaagguggguggaucac

SEQ ID NO: 802722 - RNA, 21 nt, Human
aggccccaaucaagggccggc

SEQ ID NO: 802723 - RNA, 19 nt, Human
aggccgaggcaggaggaug

SEQ ID NO: 802724 - RNA, 20 nt, Human
aggcggagcuugcagugagc

SEQ ID NO: 802725 - RNA, 24 nt, Human
aggcggagcuugcagugagcugag

SEQ ID NO: 802726 - RNA, 24 nt, Human
aggcgucguagcaugcgccuguag

SEQ ID NO: 802727 - RNA, 18 nt, Human
aggcugcagggcacuggc

SEQ ID NO: 802728 - RNA, 18 nt, Human
aggcugcagggcacuggc

SEQ ID NO: 802729 - RNA, 19 nt, Human
agggauggggcaggaagaa

SEQ ID NO: 802730 - RNA, 21 nt, Human
aggggcugggcagggugaggg

SEQ ID NO: 802731 - RNA, 22 nt, Human
aggggcugggcagggugagggg

SEQ ID NO: 802732 - RNA, 23 nt, Human
agggggccuagaggcaucccaga

SEQ ID NO: 802733 - RNA, 24 nt, Human
agguggguggaucacaaggucagg

SEQ ID NO: 802734 - RNA, 19 nt, Human
agucucaacaagauaccac

SEQ ID NO: 802735 - RNA, 22 nt, Human
aguguaaucuuuucccagaggu

SEQ ID NO: 802736 - RNA, 20 nt, Human
aucacaaggucaggagaucc

SEQ ID NO: 802737 - RNA, 23 nt, Human
aucagccaacccuugauugaaau

SEQ ID NO: 802738 - RNA, 22 nt, Human
aucccagcacuuugggaggcca

SEQ ID NO: 802739 - RNA, 24 nt, Human
aucgcgccacugcacuccagccug

SEQ ID NO: 802740 - RNA, 22 nt, Human
auggaaagccucuguguccaca

SEQ ID NO: 802741 - RNA, 18 nt, Human
caaaccagagaacccccc

SEQ ID NO: 802742 - RNA, 19 nt, Human
caaaccagagaacccccca

SEQ ID NO: 802743 - RNA, 23 nt, Human
caagagauucuuuggcccagagc

SEQ ID NO: 802744 - RNA, 21 nt, Human
caagauaccacaaccaagggc

SEQ ID NO: 802745 - RNA, 26 nt, Human
caagguggguggaucacaaggucagg

SEQ ID NO: 802746 - RNA, 21 nt, Human
cacacauaaaaucuggauuuc

SEQ ID NO: 802747 - RNA, 22 nt, Human
caccugccccagcauggccguc

SEQ ID NO: 802748 - RNA, 24 nt, Human
cacgccuguaaucccagcacuuug

SEQ ID NO: 802749 - RNA, 24 nt, Human
cacuccagccugggcgacagagcg

SEQ ID NO: 802750 - RNA, 19 nt, Human
cacugcacuccagccuggg

SEQ ID NO: 802751 - RNA, 21 nt, Human
cacugcacuccagccugggcg

SEQ ID NO: 802752 - RNA, 22 nt, Human
cacugcacuccagccugggcga

SEQ ID NO: 802753 - RNA, 23 nt, Human
cacugcacuccagccugggcgac

SEQ ID NO: 802754 - RNA, 24 nt, Human
cacugcacuccagccugggcgaca

SEQ ID NO: 802755 - RNA, 22 nt, Human
cagacagaccagugaugaccau

SEQ ID NO: 802756 - RNA, 23 nt, Human
cagagcacagcccaggagcugcu

SEQ ID NO: 802757 - RNA, 20 nt, Human
cagagguguguagagggaag

SEQ ID NO: 802758 - RNA, 21 nt, Human
cagcaaaccagagaacccccc

SEQ ID NO: 802759 - RNA, 24 nt, Human
cagcaaaccagagaaccccccucu

SEQ ID NO: 802760 - RNA, 18 nt, Human
cagcacaucugucccccu

SEQ ID NO: 802761 - RNA, 24 nt, Human
cagcacuuugggaggccaaggugg

SEQ ID NO: 802762 - RNA, 19 nt, Human
cagcauccgcagucaucag

SEQ ID NO: 802763 - RNA, 20 nt, Human
cagcccaggagcugcuccag

SEQ ID NO: 802764 - RNA, 24 nt, Human
cagcugcucaggaggccgaggcag

SEQ ID NO: 802765 - RNA, 23 nt, Human
ccacaggugacuugacuugccuc

SEQ ID NO: 802766 - RNA, 24 nt, Human
ccacuauacccauggccacagaaa

SEQ ID NO: 802767 - RNA, 20 nt, Human
ccacugcacuccagccuggg

SEQ ID NO: 802768 - RNA, 20 nt, Human
ccacugcacuccagccuggg

SEQ ID NO: 802769 - RNA, 21 nt, Human
ccacugcacuccagccugggc

SEQ ID NO: 802770 - RNA, 21 nt, Human
ccacugcacuccagccugggc

SEQ ID NO: 802771 - RNA, 24 nt, Human
ccacugcacuccagccugggcgac

SEQ ID NO: 802772 - RNA, 21 nt, Human
ccagaggaucccuccccuuaa

SEQ ID NO: 802773 - RNA, 19 nt, Human
ccagcuuugucuccugaca

SEQ ID NO: 802774 - RNA, 19 nt, Human
cccacaggccacaggugac

SEQ ID NO: 802775 - RNA, 18 nt, Human
cccacauucagccccaca

SEQ ID NO: 802776 - RNA, 18 nt, Human
cccagaggaucccucccc

SEQ ID NO: 802777 - RNA, 21 nt, Human
cccaggagcugcuccaggagg

SEQ ID NO: 802778 - RNA, 21 nt, Human
cccauggccacagaaagaaac

SEQ ID NO: 802779 - RNA, 22 nt, Human
ccccaggacaaauccaguccac

SEQ ID NO: 802780 - RNA, 19 nt, Human
ccccaucacuccuccucuc

SEQ ID NO: 802781 - RNA, 22 nt, Human
ccccaucacuccuccucuccca

SEQ ID NO: 802782 - RNA, 19 nt, Human
cccccuccccucuggcucc

SEQ ID NO: 802783 - RNA, 21 nt, Human
ccccugccagcuuugucuccu

SEQ ID NO: 802784 - RNA, 20 nt, Human
ccccuuggguccgucacagc

SEQ ID NO: 802785 - RNA, 18 nt, Human
cccuggacccugggaccc

SEQ ID NO: 802786 - RNA, 22 nt, Human
ccgggcccacauucagccccac

SEQ ID NO: 802787 - RNA, 20 nt, Human
ccgucgcagcccugguccug

SEQ ID NO: 802788 - RNA, 19 nt, Human
ccucaagaaccugagggca

SEQ ID NO: 802789 - RNA, 23 nt, Human
ccucugggcgaccagagauguuc

SEQ ID NO: 802790 - RNA, 18 nt, Human
ccuggaaaggcccuggag

SEQ ID NO: 802791 - RNA, 22 nt, Human
ccuggcaagggaggcucccugu

SEQ ID NO: 802792 - RNA, 19 nt, Human
ccugggacccuauuugccc

SEQ ID NO: 802793 - RNA, 22 nt, Human
ccugggcgacagagcgagacuc

SEQ ID NO: 802794 - RNA, 22 nt, Human
ccugguuaacacggugaaaccc

SEQ ID NO: 802795 - RNA, 23 nt, Human
ccugguuaacacggugaaacccc

SEQ ID NO: 802796 - RNA, 24 nt, Human
ccugguuaacacggugaaaccccg

SEQ ID NO: 802797 - RNA, 22 nt, Human
ccuguaaucccagcacuuuggg

SEQ ID NO: 802798 - RNA, 19 nt, Human
ccuguacacagcacaucug

SEQ ID NO: 802799 - RNA, 21 nt, Human
ccuguagucccagcugcucag

SEQ ID NO: 802800 - RNA, 24 nt, Human
cgagaccauccugguuaacacggu

SEQ ID NO: 802801 - RNA, 24 nt, Human
cgaggcaggaggauggcgugaacc

SEQ ID NO: 802802 - RNA, 26 nt, Human
cgccacugcacuccagccugggcgac

SEQ ID NO: 802803 - RNA, 23 nt, Human
cgccuguaaucccagcacuuugg

SEQ ID NO: 802804 - RNA, 24 nt, Human
cgccuguagucccagcugcucagg

SEQ ID NO: 802805 - RNA, 21 nt, Human
cggcccuguaaauggugaggc

SEQ ID NO: 802806 - RNA, 26 nt, Human
cggcuccggcucuggcuucggggccc

SEQ ID NO: 802807 - RNA, 26 nt, Human
cggcucuggcuucggggccccggcuu

SEQ ID NO: 802808 - RNA, 24 nt, Human
cguagcaugcgccuguagucccag

SEQ ID NO: 802809 - RNA, 22 nt, Human
cucacgccuguaaucccagcac

SEQ ID NO: 802810 - RNA, 24 nt, Human
cucacgccuguaaucccagcacuu

SEQ ID NO: 802811 - RNA, 23 nt, Human
cuccaggucaacaggcauguuua

SEQ ID NO: 802812 - RNA, 21 nt, Human
cuccugacaccgaaacagccc

SEQ ID NO: 802813 - RNA, 27 nt, Human
cucugucucaaaaaaaaaaaaaaaaaa

SEQ ID NO: 802814 - RNA, 21 nt, Human
cugacacccacgaucccugcc

SEQ ID NO: 802815 - RNA, 20 nt, Human
cugacaccgaaacagcccgu

SEQ ID NO: 802816 - RNA, 20 nt, Human
cuggccugccuggaagagca

SEQ ID NO: 802817 - RNA, 23 nt, Human
cugggcgaccagagauguucagc

SEQ ID NO: 802818 - RNA, 19 nt, Human
cuugcagugagcugagauc

SEQ ID NO: 802819 - RNA, 21 nt, Human
cuugcagugagcugagaucgc

SEQ ID NO: 802820 - RNA, 23 nt, Human
gaaagaacagacaacagagcaga

SEQ ID NO: 802821 - RNA, 21 nt, Human
gaagaagccaguguggcccag

SEQ ID NO: 802822 - RNA, 24 nt, Human
gacagagcgagacucugucucaaa

SEQ ID NO: 802823 - RNA, 20 nt, Human
gaccagugaugaccaugggc

SEQ ID NO: 802824 - RNA, 23 nt, Human
gagaucgcgccacugcacuccag

SEQ ID NO: 802825 - RNA, 22 nt, Human
gagcugcuccaggagggggcag

SEQ ID NO: 802826 - RNA, 23 nt, Human
gagcuugcagugagcugagaucg

SEQ ID NO: 802827 - RNA, 23 nt, Human
gaggcaggaggauggcgugaacc

SEQ ID NO: 802828 - RNA, 22 nt, Human
gaucucaauaaaccucugcaac

SEQ ID NO: 802829 - RNA, 23 nt, Human
gcaacaccgggcccacauucagc

SEQ ID NO: 802830 - RNA, 25 nt, Human
gcacagcccaggagcugcuccagga

SEQ ID NO: 802831 - RNA, 24 nt, Human
gcacuccagccugggcgacagagc

SEQ ID NO: 802832 - RNA, 20 nt, Human
gcaggggcugggcaggguga

SEQ ID NO: 802833 - RNA, 22 nt, Human
gccacugcacuccagccugggc

SEQ ID NO: 802834 - RNA, 24 nt, Human
gccacugcacuccagccugggcga

SEQ ID NO: 802835 - RNA, 18 nt, Human
gcccagcgccacuugcug

SEQ ID NO: 802836 - RNA, 18 nt, Human
gccgggcgugguggcuca

SEQ ID NO: 802837 - RNA, 21 nt, Human
gccgucgcagcccugguccug

SEQ ID NO: 802838 - RNA, 24 nt, Human
gcgacagagcgagacucugucuca

SEQ ID NO: 802839 - RNA, 19 nt, Human
gcgccacuugcuggccugc

SEQ ID NO: 802840 - RNA, 21 nt, Human
gcgccugcacaggacaggaag

SEQ ID NO: 802841 - RNA, 20 nt, Human
gcugagaucgcgccacugca

SEQ ID NO: 802842 - RNA, 18 nt, Human
ggagcuugcagugagcug

SEQ ID NO: 802843 - RNA, 24 nt, Human
ggagcuugcagugagcugagaucg

SEQ ID NO: 802844 - RNA, 21 nt, Human
ggccgggcgugguggcucacg

SEQ ID NO: 802845 - RNA, 23 nt, Human
ggcgugguggcucacgccuguaa

SEQ ID NO: 802846 - RNA, 21 nt, Human
ggcucacgccuguaaucccag

SEQ ID NO: 802847 - RNA, 20 nt, Human
ggcugggcagggugaggggc

SEQ ID NO: 802848 - RNA, 20 nt, Human
gggaaggcaaacaaggcugc

SEQ ID NO: 802849 - RNA, 18 nt, Human
gggaagggggccuagagg

SEQ ID NO: 802850 - RNA, 22 nt, Human
gggacaucccauggaaagccuc

SEQ ID NO: 802851 - RNA, 18 nt, Human
gggagucagggaaagaac

SEQ ID NO: 802852 - RNA, 21 nt, Human
gggcaaaacccaccagcuccg

SEQ ID NO: 802853 - RNA, 21 nt, Human
gggcagggugaggggcggaag

SEQ ID NO: 802854 - RNA, 21 nt, Human
gggcaguccccaacuggcuuc

SEQ ID NO: 802855 - RNA, 19 nt, Human
gggcucggagaagaaacaa

SEQ ID NO: 802856 - RNA, 19 nt, Human
ggugaggggcggaagugcu

SEQ ID NO: 802857 - RNA, 21 nt, Human
gguggaucacaaggucaggag

SEQ ID NO: 802858 - RNA, 24 nt, Human
gguggcucacgccuguaaucccag

SEQ ID NO: 802859 - RNA, 20 nt, Human
ggugggaaggcaaacaaggc

SEQ ID NO: 802860 - RNA, 25 nt, Human
gugguggcucacgccuguaauccca

SEQ ID NO: 802861 - RNA, 22 nt, Human
uaacacggugaaaccccgucuc

SEQ ID NO: 802862 - RNA, 24 nt, Human
uaacacggugaaaccccgucucua

SEQ ID NO: 802863 - RNA, 21 nt, Human
uaaggaaccgagaugagcacc

SEQ ID NO: 802864 - RNA, 18 nt, Human
uacaaauuacacacacau

SEQ ID NO: 802865 - RNA, 18 nt, Human
ucaaacagagcacagccc

SEQ ID NO: 802866 - RNA, 19 nt, Human
ucaaacagagcacagccca

SEQ ID NO: 802867 - RNA, 18 nt, Human
ucacaaggucaggagauc

SEQ ID NO: 802868 - RNA, 24 nt, Human
ucacaaggucaggagaucgagacc

SEQ ID NO: 802869 - RNA, 23 nt, Human
ucagaaucagguugggcagggcu

SEQ ID NO: 802870 - RNA, 21 nt, Human
ucagcaggcgccccucccugg

SEQ ID NO: 802871 - RNA, 23 nt, Human
uccacuauacccauggccacaga

SEQ ID NO: 802872 - RNA, 23 nt, Human
uccagccugggcgacagagcgag

SEQ ID NO: 802873 - RNA, 24 nt, Human
uccagccugggcgacagagcgaga

SEQ ID NO: 802874 - RNA, 21 nt, Human
ucccagagauagcuuauagca

SEQ ID NO: 802875 - RNA, 18 nt, Human
ucccauagccaucccaga

SEQ ID NO: 802876 - RNA, 20 nt, Human
ucccccuccccucuggcucc

SEQ ID NO: 802877 - RNA, 21 nt, Human
uccccuuagucaucuuccucc

SEQ ID NO: 802878 - RNA, 23 nt, Human
ucccuccccuuagucaucuuccu

SEQ ID NO: 802879 - RNA, 22 nt, Human
ucccucugugaaaacuaagucu

SEQ ID NO: 802880 - RNA, 19 nt, Human
ucccugaggaggaagaggc

SEQ ID NO: 802881 - RNA, 18 nt, Human
ucccuggaccgggguggc

SEQ ID NO: 802882 - RNA, 21 nt, Human
ucccuggaccgggguggcaga

SEQ ID NO: 802883 - RNA, 19 nt, Human
uccucgaccucgaaggccc

SEQ ID NO: 802884 - RNA, 22 nt, Human
uccucgaccucgaaggccccau

SEQ ID NO: 802885 - RNA, 23 nt, Human
ucgcgccacugcacuccagccug

SEQ ID NO: 802886 - RNA, 24 nt, Human
ucucuacuaaaaauacaaaaaauu

SEQ ID NO: 802887 - RNA, 23 nt, Human
ucugucucaaaaaaaaaaaaaaa

SEQ ID NO: 802888 - RNA, 20 nt, Human
ucuuaugacaaaggaucugg

SEQ ID NO: 802889 - RNA, 22 nt, Human
ugagcugagaucgcgccacugc

SEQ ID NO: 802890 - RNA, 19 nt, Human
ugaggaaacuccucgagag

SEQ ID NO: 802891 - RNA, 18 nt, Human
ugagggaaacugagaucc

SEQ ID NO: 802892 - RNA, 22 nt, Human
ugagggcagagaucccucuugg

SEQ ID NO: 802893 - RNA, 21 nt, Human
ugaggggcggaagugcucagc

SEQ ID NO: 802894 - RNA, 21 nt, Human
ugcagaaaagguggcgguccc

SEQ ID NO: 802895 - RNA, 19 nt, Human
ugccgcuguggcccgaggc

SEQ ID NO: 802896 - RNA, 27 nt, Human
ugccuggaagagcagaacccuggaggc

SEQ ID NO: 802897 - RNA, 23 nt, Human
ugcgccuguagucccagcugcuc

SEQ ID NO: 802898 - RNA, 19 nt, Human
uggaccgggguggcagagg

SEQ ID NO: 802899 - RNA, 19 nt, Human
uggaguugguggcgccagc

SEQ ID NO: 802900 - RNA, 22 nt, Human
uggcagaggaaagccuaaguga

SEQ ID NO: 802901 - RNA, 19 nt, Human
uggcaggcggugagggcag

SEQ ID NO: 802902 - RNA, 20 nt, Human
uggcaggcggugagggcaga

SEQ ID NO: 802903 - RNA, 19 nt, Human
uggcaggggcugggcaggg

SEQ ID NO: 802904 - RNA, 21 nt, Human
uggcaggggcugggcagggug

SEQ ID NO: 802905 - RNA, 20 nt, Human
uggcaguugagguugucugu

SEQ ID NO: 802906 - RNA, 23 nt, Human
uggccacagaaagaaacaugaaa

SEQ ID NO: 802907 - RNA, 18 nt, Human
uggcccagcgccacuugc

SEQ ID NO: 802908 - RNA, 19 nt, Human
uggccgaggagccaccucu

SEQ ID NO: 802909 - RNA, 19 nt, Human
uggccugccuggaagagca

SEQ ID NO: 802910 - RNA, 22 nt, Human
uggcucacgccuguaaucccag

SEQ ID NO: 802911 - RNA, 24 nt, Human
uggcucacgccuguaaucccagca

SEQ ID NO: 802912 - RNA, 23 nt, Human
uggcuccugacacccacgauccc

SEQ ID NO: 802913 - RNA, 23 nt, Human
ugggaggccaagguggguggauc

SEQ ID NO: 802914 - RNA, 24 nt, Human
ugggaggccaagguggguggauca

SEQ ID NO: 802915 - RNA, 22 nt, Human
ugggaguuccaaucccugcaug

SEQ ID NO: 802916 - RNA, 24 nt, Human
ugggaguuccaaucccugcaugug

SEQ ID NO: 802917 - RNA, 24 nt, Human
ugguccuggcaagggaggcucccc

SEQ ID NO: 802918 - RNA, 24 nt, Human
uucaaacagagcacagcccaggag

SEQ ID NO: 802919 - RNA, 21 nt, Human
uucaagugcacccuuccuacc

SEQ ID NO: 802920 - RNA, 23 nt, Human
uucagcauuuacaaauuacacac

SEQ ID NO: 802921 - RNA, 18 nt, Human
uugcagugagcugagauc

SEQ ID NO: 802922 - RNA, 22 nt, Human
uugcagugagcugagaucgcgc

SEQ ID NO: 802923 - RNA, 22 nt, Human
uugucucgggcaccuggaggga

SEQ ID NO: 802924 - RNA, 24 nt, Human
uuuccacuauacccauggccacag

SEQ ID NO: 802925 - RNA, 23 nt, Human
aaaaagcucaaauucagcugggc

SEQ ID NO: 802926 - RNA, 18 nt, Human
aaacaaaacaaaacaaaa

SEQ ID NO: 802927 - RNA, 23 nt, Human
aaacagauuuaaaagaucagcug

SEQ ID NO: 802928 - RNA, 22 nt, Human
aaacuagcauacaacgccuccu

SEQ ID NO: 802929 - RNA, 21 nt, Human
aaagaagacagauuuccaaag

SEQ ID NO: 802930 - RNA, 19 nt, Human
aaagcaaaaaguacccuuc

SEQ ID NO: 802931 - RNA, 22 nt, Human
aaauauauacuauacuugugug

SEQ ID NO: 802932 - RNA, 19 nt, Human
aaaugacauacaauaacau

SEQ ID NO: 802933 - RNA, 21 nt, Human
aacaugguaagacccuugucu

SEQ ID NO: 802934 - RNA, 22 nt, Human
aacccuuaaggccaaggggcaa

SEQ ID NO: 802935 - RNA, 21 nt, Human
aagaacaccgcaggcaggaag

SEQ ID NO: 802936 - RNA, 23 nt, Human
aagaagucaggaucaaaagacua

SEQ ID NO: 802937 - RNA, 18 nt, Human
aagaucagcugggcgugg

SEQ ID NO: 802938 - RNA, 18 nt, Human
aagcaaacaaaaaugaca

SEQ ID NO: 802939 - RNA, 18 nt, Human
aagcucaucgaacaggac

SEQ ID NO: 802940 - RNA, 18 nt, Human
aagcuuuauuugcuauuu

SEQ ID NO: 802941 - RNA, 19 nt, Human
aaggaaaaugaggugagca

SEQ ID NO: 802942 - RNA, 18 nt, Human
aaggugucuaaaauaggu

SEQ ID NO: 802943 - RNA, 22 nt, Human
aaucacuugagcccagguguua

SEQ ID NO: 802944 - RNA, 26 nt, Human
aaucacuugagcccagguguuaguga

SEQ ID NO: 802945 - RNA, 24 nt, Human
acaaaacaaaacaaaacacuagca

SEQ ID NO: 802946 - RNA, 21 nt, Human
acaaagcagcuaucagcacca

SEQ ID NO: 802947 - RNA, 22 nt, Human
acagagcaagaccgugucucaa

SEQ ID NO: 802948 - RNA, 18 nt, Human
acaggacacaaggugggc

SEQ ID NO: 802949 - RNA, 22 nt, Human
accaaagcucaucgaacaggac

SEQ ID NO: 802950 - RNA, 24 nt, Human
accagcuugggcaauauagugaga

SEQ ID NO: 802951 - RNA, 23 nt, Human
accuguagucccagcuacuuggg

SEQ ID NO: 802952 - RNA, 19 nt, Human
acgaugcacacagccccac

SEQ ID NO: 802953 - RNA, 18 nt, Human
acuccacuccagcuugag

SEQ ID NO: 802954 - RNA, 24 nt, Human
acuccacuccagcuugagcaacag

SEQ ID NO: 802955 - RNA, 24 nt, Human
acugcauuccagccuggccaacag

SEQ ID NO: 802956 - RNA, 24 nt, Human
acugcauuccagccuggccaacag

SEQ ID NO: 802957 - RNA, 23 nt, Human
agaaguucgagaccagccugggc

SEQ ID NO: 802958 - RNA, 22 nt, Human
agaaucacuugagaccaaguuu

SEQ ID NO: 802959 - RNA, 19 nt, Human
agagccuggcgaggacagg

SEQ ID NO: 802960 - RNA, 22 nt, Human
agcacaguacgguuuccagcuu

SEQ ID NO: 802961 - RNA, 20 nt, Human
agcacuuugggaggcugagg

SEQ ID NO: 802962 - RNA, 22 nt, Human
agcacuuugggaggcugaggag

SEQ ID NO: 802963 - RNA, 24 nt, Human
agcacuuugggaggcugaggaggg

SEQ ID NO: 802964 - RNA, 18 nt, Human
agcaggucucagagguca

SEQ ID NO: 802965 - RNA, 22 nt, Human
agccugggcaacaugguaagac

SEQ ID NO: 802966 - RNA, 24 nt, Human
agccugggcaacaugguaagaccc

SEQ ID NO: 802967 - RNA, 25 nt, Human
agccugggcaacaugguaagacccu

SEQ ID NO: 802968 - RNA, 24 nt, Human
agcuacuugggaggcugagguggg

SEQ ID NO: 802969 - RNA, 23 nt, Human
agcugggcguggugaugugcgcc

SEQ ID NO: 802970 - RNA, 23 nt, Human
agcuugggcaauauagugagauc

SEQ ID NO: 802971 - RNA, 25 nt, Human
agcuugggcaauauagugagauccu

SEQ ID NO: 802972 - RNA, 19 nt, Human
aggaaagagagacagcagc

SEQ ID NO: 802973 - RNA, 18 nt, Human
aggaagaaacggcagcag

SEQ ID NO: 802974 - RNA, 19 nt, Human
aggaagagaaaugaggggg

SEQ ID NO: 802975 - RNA, 22 nt, Human
aggaagaucuucagggcuugcc

SEQ ID NO: 802976 - RNA, 21 nt, Human
aggacacaaggugggcuccgg

SEQ ID NO: 802977 - RNA, 23 nt, Human
aggaggaagagaaaugaggggga

SEQ ID NO: 802978 - RNA, 23 nt, Human
aggcaaacacaauugucugaaac

SEQ ID NO: 802979 - RNA, 18 nt, Human
aggcaguagaaucacuug

SEQ ID NO: 802980 - RNA, 25 nt, Human
aggcggcauaaaucauucagaagcc

SEQ ID NO: 802981 - RNA, 24 nt, Human
aggcugaggagggacaauugcuug

SEQ ID NO: 802982 - RNA, 24 nt, Human
aggcugaggcaguagaaucacuug

SEQ ID NO: 802983 - RNA, 24 nt, Human
aggcugaggugggagaaucacuug

SEQ ID NO: 802984 - RNA, 19 nt, Human
agggagagccuggcgagga

SEQ ID NO: 802985 - RNA, 18 nt, Human
agggucuuucuaaauccu

SEQ ID NO: 802986 - RNA, 22 nt, Human
agguagccagggagaaggaaag

SEQ ID NO: 802987 - RNA, 25 nt, Human
aggucugaugauucauaagcaaagg

SEQ ID NO: 802988 - RNA, 24 nt, Human
aggugaggaggaagagaaaugagg

SEQ ID NO: 802989 - RNA, 24 nt, Human
aggugcaguggcucaugucuguaa

SEQ ID NO: 802990 - RNA, 18 nt, Human
aggugggagaaucacuug

SEQ ID NO: 802991 - RNA, 23 nt, Human
aggugggagaaucacuugagccc

SEQ ID NO: 802992 - RNA, 21 nt, Human
agguguaaaaggcuggguggg

SEQ ID NO: 802993 - RNA, 21 nt, Human
agguguaaaaggcuggguggg

SEQ ID NO: 802994 - RNA, 24 nt, Human
aguggcucaugucuguaauccgag

SEQ ID NO: 802995 - RNA, 22 nt, Human
auccugaggcuaucaggucagg

SEQ ID NO: 802996 - RNA, 24 nt, Human
aucgugccacuccacuccagcuug

SEQ ID NO: 802997 - RNA, 23 nt, Human
auugcuugagcccaggaguugga

SEQ ID NO: 802998 - RNA, 19 nt, Human
auuucugaggccuugucau

SEQ ID NO: 802999 - RNA, 26 nt, Human
caaaacaaaacaaaacacuagcaggg

SEQ ID NO: 803000 - RNA, 22 nt, Human
caaaaccacccacauggacguu

SEQ ID NO: 803001 - RNA, 23 nt, Human
caagaacaccgcaggcaggaagc

SEQ ID NO: 803002 - RNA, 21 nt, Human
caaggcggcauaaaucauuca

SEQ ID NO: 803003 - RNA, 22 nt, Human
cacaucuuuccuccuguccuuu

SEQ ID NO: 803004 - RNA, 18 nt, Human
caccgagacuacagcaga

SEQ ID NO: 803005 - RNA, 23 nt, Human
caccuguagucccagcuacuugg

SEQ ID NO: 803006 - RNA, 24 nt, Human
caccuguagucccagcuacuuggg

SEQ ID NO: 803007 - RNA, 24 nt, Human
cacuccacuccagcuugagcaaca

SEQ ID NO: 803008 - RNA, 22 nt, Human
cacuccagcuugagcaacagag

SEQ ID NO: 803009 - RNA, 18 nt, Human
cacugcauuccagccugg

SEQ ID NO: 803010 - RNA, 21 nt, Human
cacugcauuccagccuggcca

SEQ ID NO: 803011 - RNA, 24 nt, Human
cacugcauuccagccuggccaaca

SEQ ID NO: 803012 - RNA, 22 nt, Human
cagaaaaacaaaacaaaacaaa

SEQ ID NO: 803013 - RNA, 21 nt, Human
cagagguuauguggugagcac

SEQ ID NO: 803014 - RNA, 20 nt, Human
cagauuuccaacugcucuuc

SEQ ID NO: 803015 - RNA, 23 nt, Human
cagcacaguacaaaauuaucuuc

SEQ ID NO: 803016 - RNA, 24 nt, Human
cagcacuuugggaggcugaggcag

SEQ ID NO: 803017 - RNA, 24 nt, Human
cagcuacuugggaggcugaggugg

SEQ ID NO: 803018 - RNA, 24 nt, Human
caggccuguaaucccagcacuuug

SEQ ID NO: 803019 - RNA, 18 nt, Human
cauagaauuaauugauua

SEQ ID NO: 803020 - RNA, 19 nt, Human
caugcaucuguucugaggc

SEQ ID NO: 803021 - RNA, 23 nt, Human
cauuccagccuggccaacagagc

SEQ ID NO: 803022 - RNA, 22 nt, Human
ccaaagcuuuauuugcuauuuu

SEQ ID NO: 803023 - RNA, 22 nt, Human
ccaaauggccacggagaacuga

SEQ ID NO: 803024 - RNA, 19 nt, Human
ccacagaaugucuccccau

SEQ ID NO: 803025 - RNA, 20 nt, Human
ccacuccacuccagcuugag

SEQ ID NO: 803026 - RNA, 21 nt, Human
ccacuccacuccagcuugagc

SEQ ID NO: 803027 - RNA, 19 nt, Human
ccacugcauuccagccugg

SEQ ID NO: 803028 - RNA, 19 nt, Human
ccacugcauuccagccugg

SEQ ID NO: 803029 - RNA, 20 nt, Human
ccacugcauuccagccuggc

SEQ ID NO: 803030 - RNA, 21 nt, Human
ccagauuuccaacugcucuuc

SEQ ID NO: 803031 - RNA, 20 nt, Human
ccagcagcccacgucauguc

SEQ ID NO: 803032 - RNA, 20 nt, Human
ccagccuggccaacagagca

SEQ ID NO: 803033 - RNA, 24 nt, Human
ccagcgguaauacccugcaccgag

SEQ ID NO: 803034 - RNA, 19 nt, Human
cccaaagcagauccccuuu

SEQ ID NO: 803035 - RNA, 18 nt, Human
cccacucgcuaaugggac

SEQ ID NO: 803036 - RNA, 19 nt, Human
cccagguguuuauccuaac

SEQ ID NO: 803037 - RNA, 19 nt, Human
cccccuggaaaacaccgcc

SEQ ID NO: 803038 - RNA, 18 nt, Human
cccugaauccugaggcua

SEQ ID NO: 803039 - RNA, 21 nt, Human
cccugcaccgagacuacagca

SEQ ID NO: 803040 - RNA, 19 nt, Human
ccgagcccaaagcagaucc

SEQ ID NO: 803041 - RNA, 22 nt, Human
ccggccucacagcccugcaguu

SEQ ID NO: 803042 - RNA, 19 nt, Human
ccucaccagggcccaggug

SEQ ID NO: 803043 - RNA, 20 nt, Human
ccuccuguccuuuaacguaa

SEQ ID NO: 803044 - RNA, 21 nt, Human
ccugagagguagccagggaga

SEQ ID NO: 803045 - RNA, 22 nt, Human
ccuguaaucccagcacuuuggg

SEQ ID NO: 803046 - RNA, 21 nt, Human
ccuguagucccagcuacuugg

SEQ ID NO: 803047 - RNA, 23 nt, Human
ccugucaucuaggcuacucugga

SEQ ID NO: 803048 - RNA, 21 nt, Human
ccuguccuuuaacguaaacac

SEQ ID NO: 803049 - RNA, 22 nt, Human
cgacugaagcaguugcaggcau

SEQ ID NO: 803050 - RNA, 24 nt, Human
cgagaccagccugggcaacauggu

SEQ ID NO: 803051 - RNA, 22 nt, Human
cgugaaagagggucgcucuuga

SEQ ID NO: 803052 - RNA, 20 nt, Human
cgugucucaagaaaagaaaa

SEQ ID NO: 803053 - RNA, 23 nt, Human
cuaaagcaaacaaaaaugacaua

SEQ ID NO: 803054 - RNA, 21 nt, Human
cuagggcaggucugaugauuc

SEQ ID NO: 803055 - RNA, 19 nt, Human
cucacagcccugcaguugc

SEQ ID NO: 803056 - RNA, 21 nt, Human
cucacuccauuuagaaugggg

SEQ ID NO: 803057 - RNA, 24 nt, Human
cucaggccuguaaucccagcacuu

SEQ ID NO: 803058 - RNA, 24 nt, Human
cucaugucuguaauccgagcacuu

SEQ ID NO: 803059 - RNA, 21 nt, Human
cucuaaacuuccugagcccac

SEQ ID NO: 803060 - RNA, 19 nt, Human
cuguaauccgagcacuuug

SEQ ID NO: 803061 - RNA, 21 nt, Human
cuguaauccgagcacuuuggg

SEQ ID NO: 803062 - RNA, 18 nt, Human
cuuggagcugaugaaggu

SEQ ID NO: 803063 - RNA, 19 nt, Human
gaagaaacggcagcagcuc

SEQ ID NO: 803064 - RNA, 21 nt, Human
gaagaugagggaggaagcuga

SEQ ID NO: 803065 - RNA, 18 nt, Human
gaccuugucucagaaaaa

SEQ ID NO: 803066 - RNA, 21 nt, Human
gagaaaacaaacuaucaucag

SEQ ID NO: 803067 - RNA, 18 nt, Human
gagacaaaugaacuccug

SEQ ID NO: 803068 - RNA, 24 nt, Human
gagaugagaggauugcuugagccc

SEQ ID NO: 803069 - RNA, 18 nt, Human
gagcaaccacugaaggag

SEQ ID NO: 803070 - RNA, 24 nt, Human
gagcacuuugggaggcugaggagg

SEQ ID NO: 803071 - RNA, 24 nt, Human
gagcagcuaaggucucuuuuagga

SEQ ID NO: 803072 - RNA, 24 nt, Human
gagcccaaagcagauccccuuuag

SEQ ID NO: 803073 - RNA, 21 nt, Human
gaggugcuuucacaaaugcag

SEQ ID NO: 803074 - RNA, 18 nt, Human
gaugcacacagccccacu

SEQ ID NO: 803075 - RNA, 24 nt, Human
gauugcuugagcccaggaguugga

SEQ ID NO: 803076 - RNA, 21 nt, Human
gauugugccacugcauuccag

SEQ ID NO: 803077 - RNA, 24 nt, Human
gcauuccagccuggccaacagagc

SEQ ID NO: 803078 - RNA, 20 nt, Human
gccaaggggcaaaggucacc

SEQ ID NO: 803079 - RNA, 22 nt, Human
gccacuccacuccagcuugagc

SEQ ID NO: 803080 - RNA, 19 nt, Human
gccacugcauuccagccug

SEQ ID NO: 803081 - RNA, 22 nt, Human
gccugaagugcugucuggggag

SEQ ID NO: 803082 - RNA, 19 nt, Human
gccuguaaaguuuaaaacc

SEQ ID NO: 803083 - RNA, 25 nt, Human
gcgggagcggcucuucucacuccug

SEQ ID NO: 803084 - RNA, 20 nt, Human
gcugcaguuuaugaacccuu

SEQ ID NO: 803085 - RNA, 21 nt, Human
ggaagaucuucagggcuugcc

SEQ ID NO: 803086 - RNA, 20 nt, Human
ggacaauugcuugagcccag

SEQ ID NO: 803087 - RNA, 22 nt, Human
ggagggacaauugcuugagccc

SEQ ID NO: 803088 - RNA, 18 nt, Human
ggaguuggaggcuggagu

SEQ ID NO: 803089 - RNA, 23 nt, Human
ggcaugguggcucaggccuguaa

SEQ ID NO: 803090 - RNA, 23 nt, Human
ggccuguaaucccagcacuuugg

SEQ ID NO: 803091 - RNA, 23 nt, Human
gggaaggcacauucagagaccac

SEQ ID NO: 803092 - RNA, 18 nt, Human
ggggagacaauuccagcc

SEQ ID NO: 803093 - RNA, 24 nt, Human
gguagcauacaccuguagucccag

SEQ ID NO: 803094 - RNA, 23 nt, Human
ggucugaugauucauaagcaaag

SEQ ID NO: 803095 - RNA, 24 nt, Human
gguggcucaggccuguaaucccag

SEQ ID NO: 803096 - RNA, 19 nt, Human
guggaggugaggaggaaga

SEQ ID NO: 803097 - RNA, 22 nt, Human
guguauauauauauauuuccac

SEQ ID NO: 803098 - RNA, 22 nt, Human
gugugucucugugugugugugu

SEQ ID NO: 803099 - RNA, 25 nt, Human
guuauagaaaaauaaaaggagguga

SEQ ID NO: 803100 - RNA, 18 nt, Human
guucaaagaagacucugg

SEQ ID NO: 803101 - RNA, 23 nt, Human
guucaaggcggcauaaaucauuc

SEQ ID NO: 803102 - RNA, 18 nt, Human
guugggucuucccgucug

SEQ ID NO: 803103 - RNA, 19 nt, Human
uaaaaagcaaaaccaccca

SEQ ID NO: 803104 - RNA, 25 nt, Human
uaaaaagcaaaaccacccacaugga

SEQ ID NO: 803105 - RNA, 23 nt, Human
uaaaacauaaacuggaucuuuaa

SEQ ID NO: 803106 - RNA, 20 nt, Human
uaaaaccacaggcucaugcc

SEQ ID NO: 803107 - RNA, 24 nt, Human
uaaagugccucucgucugccuucc

SEQ ID NO: 803108 - RNA, 19 nt, Human
uaaauccuuugcccagccu

SEQ ID NO: 803109 - RNA, 23 nt, Human
uaacuucuaaacagcuuggauag

SEQ ID NO: 803110 - RNA, 25 nt, Human
uaacuugccggaaaccucaggccga

SEQ ID NO: 803111 - RNA, 19 nt, Human
uaagagcagguccuuuccu

SEQ ID NO: 803112 - RNA, 24 nt, Human
uaagcaaaggcaccaccacuuggg

SEQ ID NO: 803113 - RNA, 24 nt, Human
uacaccuguagucccagcuacuug

SEQ ID NO: 803114 - RNA, 18 nt, Human
uacauaaaaagcaaaacc

SEQ ID NO: 803115 - RNA, 19 nt, Human
uagaaaacagcauaauuug

SEQ ID NO: 803116 - RNA, 20 nt, Human
uagaaaacagcauaauuugu

SEQ ID NO: 803117 - RNA, 24 nt, Human
uagagauucuuucugggacuggau

SEQ ID NO: 803118 - RNA, 20 nt, Human
uagauguggaguggguccua

SEQ ID NO: 803119 - RNA, 23 nt, Human
uaggcaaaggaccaugaagaagg

SEQ ID NO: 803120 - RNA, 22 nt, Human
uagggauaagauaaccugaggu

SEQ ID NO: 803121 - RNA, 18 nt, Human
uagucugaaugcaacauc

SEQ ID NO: 803122 - RNA, 23 nt, Human
uaucaaguuucaaagaaaauuag

SEQ ID NO: 803123 - RNA, 21 nt, Human
uauuaaaaagcucaaauucag

SEQ ID NO: 803124 - RNA, 21 nt, Human
uauucgcacaucuuuccuccu

SEQ ID NO: 803125 - RNA, 21 nt, Human
ucaacccagcgguaauacccu

SEQ ID NO: 803126 - RNA, 22 nt, Human
ucacacugauguucuuggagcu

SEQ ID NO: 803127 - RNA, 24 nt, Human
ucaccaaaaaaaaagaauagaaaa

SEQ ID NO: 803128 - RNA, 19 nt, Human
ucagaagccggcucacggc

SEQ ID NO: 803129 - RNA, 18 nt, Human
ucagcugggcaugguggc

SEQ ID NO: 803130 - RNA, 22 nt, Human
ucagcugggcguggugaugugc

SEQ ID NO: 803131 - RNA, 24 nt, Human
ucagcugggcguggugaugugcgc

SEQ ID NO: 803132 - RNA, 20 nt, Human
uccagggagagccuggcgag

SEQ ID NO: 803133 - RNA, 21 nt, Human
uccauuuuaaggguuaacuug

SEQ ID NO: 803134 - RNA, 24 nt, Human
ucccaaacccagaugcaugaggcu

SEQ ID NO: 803135 - RNA, 25 nt, Human
ucccaaacccagaugcaugaggcuc

SEQ ID NO: 803136 - RNA, 23 nt, Human
uccggccucacagcccugcaguu

SEQ ID NO: 803137 - RNA, 26 nt, Human
uccuaucccuccagccccucggaauc

SEQ ID NO: 803138 - RNA, 23 nt, Human
uccuugcuuagccucaaagagag

SEQ ID NO: 803139 - RNA, 18 nt, Human
ucgaacaggacacaaggu

SEQ ID NO: 803140 - RNA, 25 nt, Human
ucuaaaauagguagaaaugcaaauu

SEQ ID NO: 803141 - RNA, 22 nt, Human
ucuagcgggagcggcucuucuc

SEQ ID NO: 803142 - RNA, 21 nt, Human
ucuauccaugcccauccaccc

SEQ ID NO: 803143 - RNA, 20 nt, Human
ucucacuccugucacgcugg

SEQ ID NO: 803144 - RNA, 21 nt, Human
ucucacuccugucacgcugga

SEQ ID NO: 803145 - RNA, 22 nt, Human
ucuccaggucaaucucauuuuc

SEQ ID NO: 803146 - RNA, 24 nt, Human
ucugggacuggauaaagugccucu

SEQ ID NO: 803147 - RNA, 19 nt, Human
ucuguucugaggccaguuu

SEQ ID NO: 803148 - RNA, 20 nt, Human
ucuucccgucuggauccagg

SEQ ID NO: 803149 - RNA, 18 nt, Human
ugaacccuuaaggccaag

SEQ ID NO: 803150 - RNA, 19 nt, Human
ugaauccccaaauggccac

SEQ ID NO: 803151 - RNA, 20 nt, Human
ugaaugcaacaucuuuguac

SEQ ID NO: 803152 - RNA, 24 nt, Human
ugacccacugugauugucuucccu

SEQ ID NO: 803153 - RNA, 24 nt, Human
ugagacagagagacaaaugaacuc

SEQ ID NO: 803154 - RNA, 23 nt, Human
ugagagguagccagggagaagga

SEQ ID NO: 803155 - RNA, 23 nt, Human
ugagaguuuugcaugaggaccau

SEQ ID NO: 803156 - RNA, 20 nt, Human
ugagcaaaagcaaaaaguac

SEQ ID NO: 803157 - RNA, 23 nt, Human
ugagcccagaaguucgagaccag

SEQ ID NO: 803158 - RNA, 20 nt, Human
ugaggcaguagaaucacuug

SEQ ID NO: 803159 - RNA, 25 nt, Human
ugaggcaguagaaucacuugagacc

SEQ ID NO: 803160 - RNA, 19 nt, Human
ugagggggagagagauugu

SEQ ID NO: 803161 - RNA, 19 nt, Human
ugagggggagagagauugu

SEQ ID NO: 803162 - RNA, 20 nt, Human
ugaggugggagaaucacuug

SEQ ID NO: 803163 - RNA, 24 nt, Human
ugaggugggagaaucacuugagcc

SEQ ID NO: 803164 - RNA, 19 nt, Human
ugauacccuuaguuggccu

SEQ ID NO: 803165 - RNA, 19 nt, Human
ugauuuggcgcgucccccu

SEQ ID NO: 803166 - RNA, 20 nt, Human
ugcaaaggcucccaaucauc

SEQ ID NO: 803167 - RNA, 20 nt, Human
ugcaugaggcucccaggugu

SEQ ID NO: 803168 - RNA, 18 nt, Human
ugcugucccuggugcuga

SEQ ID NO: 803169 - RNA, 23 nt, Human
uggaguggguccuaucccuccag

SEQ ID NO: 803170 - RNA, 24 nt, Human
uggauuuucaaaggccaaaagccu

SEQ ID NO: 803171 - RNA, 22 nt, Human
uggcucaggccuguaaucccag

SEQ ID NO: 803172 - RNA, 24 nt, Human
uggcucaggccuguaaucccagca

SEQ ID NO: 803173 - RNA, 24 nt, Human
uggcucaugucuguaauccgagca

SEQ ID NO: 803174 - RNA, 21 nt, Human
uggcuucuuggugauacccuu

SEQ ID NO: 803175 - RNA, 19 nt, Human
ugggaaggccaaaggggag

SEQ ID NO: 803176 - RNA, 23 nt, Human
ugggaaggccaaaggggagggcg

SEQ ID NO: 803177 - RNA, 19 nt, Human
ugggaggcugaggagggac

SEQ ID NO: 803178 - RNA, 23 nt, Human
ugggaggcugaggagggacaauu

SEQ ID NO: 803179 - RNA, 24 nt, Human
ugggaggcugaggcaguagaauca

SEQ ID NO: 803180 - RNA, 19 nt, Human
ugggaggcugaggugggag

SEQ ID NO: 803181 - RNA, 24 nt, Human
ugggaggcugaggugggagaauca

SEQ ID NO: 803182 - RNA, 19 nt, Human
ugguaagacccuugucucu

SEQ ID NO: 803183 - RNA, 23 nt, Human
ugguagcauacaccuguaguccc

SEQ ID NO: 803184 - RNA, 24 nt, Human
ugguagcauacaccuguaguccca

SEQ ID NO: 803185 - RNA, 22 nt, Human
ugguaugauuuaggaaacagca

SEQ ID NO: 803186 - RNA, 20 nt, Human
uggugcuggaggagacaagg

SEQ ID NO: 803187 - RNA, 18 nt, Human
ugguggaggugaggagga

SEQ ID NO: 803188 - RNA, 24 nt, Human
ugguggcucaggccuguaauccca

SEQ ID NO: 803189 - RNA, 18 nt, Human
ugucucaagaaaagaaaa

SEQ ID NO: 803190 - RNA, 23 nt, Human
ugucugaaaccacaugauuuggc

SEQ ID NO: 803191 - RNA, 18 nt, Human
ugugcaggaagaaacggc

SEQ ID NO: 803192 - RNA, 22 nt, Human
uguguauauauauauauuucca

SEQ ID NO: 803193 - RNA, 18 nt, Human
uguguguguauauauaua

SEQ ID NO: 803194 - RNA, 18 nt, Human
uguguguguauauauaua

SEQ ID NO: 803195 - RNA, 19 nt, Human
ugugugugucucugugugu

SEQ ID NO: 803196 - RNA, 19 nt, Human
ugugugugucucugugugu

SEQ ID NO: 803197 - RNA, 23 nt, Human
uguguguguguguauauauauau

SEQ ID NO: 803198 - RNA, 23 nt, Human
ugugugugugugucucugugugu

SEQ ID NO: 803199 - RNA, 21 nt, Human
ugugugugugugucucuguuu

SEQ ID NO: 803200 - RNA, 30 nt, Human
ugugugugugugugucucugugugugugug

SEQ ID NO: 803201 - RNA, 27 nt, Human
uuaacauagaauuaauugauuauuuuu

SEQ ID NO: 803202 - RNA, 21 nt, Human
uuaacuugccggaaaccucag

SEQ ID NO: 803203 - RNA, 21 nt, Human
uucaaggagggugaacuuugu

SEQ ID NO: 803204 - RNA, 20 nt, Human
uuccaaaaaaagaccugccc

SEQ ID NO: 803205 - RNA, 19 nt, Human
uucccuguggugcuggagg

SEQ ID NO: 803206 - RNA, 21 nt, Human
uugagcugagacaugacuaau

SEQ ID NO: 803207 - RNA, 21 nt, Human
uugcuugagcccagaaguucg

SEQ ID NO: 803208 - RNA, 24 nt, Human
uugcuugagcccaggaguuggagg

SEQ ID NO: 803209 - RNA, 24 nt, Human
uugcuuuaucgccuucuaaagcaa

SEQ ID NO: 803210 - RNA, 23 nt, Human
uuggauagggauaagauaaccug

SEQ ID NO: 803211 - RNA, 25 nt, Human
uugggaggcugaggcaguagaauca

SEQ ID NO: 803212 - RNA, 25 nt, Human
uugggaggcugaggugggagaauca

SEQ ID NO: 803213 - RNA, 22 nt, Human
uuggugauacccuuaguuggcc

SEQ ID NO: 803214 - RNA, 23 nt, Human
uugugccacugcauuccagccug

SEQ ID NO: 803215 - RNA, 24 nt, Human
uuguguuuuaacacacggugaggg

SEQ ID NO: 803216 - RNA, 28 nt, Human
uuuggcuucuuggugauacccuuaguug

SEQ ID NO: 803217 - RNA, 22 nt, Human
uuugggaggcugaggagggaca

SEQ ID NO: 803218 - RNA, 21 nt, Human
aaaaaaaaaagaaaggaaaag

SEQ ID NO: 803219 - RNA, 21 nt, Human
aaaaaagagagagacaaaaaa

SEQ ID NO: 803220 - RNA, 27 nt, Human
aaaaacuuaguaagaagcuguagacaa

SEQ ID NO: 803221 - RNA, 24 nt, Human
aaaacacuuugcaacuacuucacu

SEQ ID NO: 803222 - RNA, 24 nt, Human
aaaauacucuauuguuucauuucu

SEQ ID NO: 803223 - RNA, 20 nt, Human
aaagcagaauauaagaaaau

SEQ ID NO: 803224 - RNA, 20 nt, Human
aaauacucuauuguuucauu

SEQ ID NO: 803225 - RNA, 21 nt, Human
aacacacuugucacacaauca

SEQ ID NO: 803226 - RNA, 21 nt, Human
aacacugacuaugucccaugc

SEQ ID NO: 803227 - RNA, 21 nt, Human
aacccgauggcaauacgaaaa

SEQ ID NO: 803228 - RNA, 22 nt, Human
aacgugaaaaugacuuuaauaa

SEQ ID NO: 803229 - RNA, 18 nt, Human
aauuacacugcaaagauc

SEQ ID NO: 803230 - RNA, 18 nt, Human
acaugcuuucucuucucu

SEQ ID NO: 803231 - RNA, 19 nt, Human
accaaagcgcagggaccag

SEQ ID NO: 803232 - RNA, 23 nt, Human
accuccccauacacaguaaaaac

SEQ ID NO: 803233 - RNA, 22 nt, Human
agcacuucccugggggaaaaac

SEQ ID NO: 803234 - RNA, 23 nt, Human
agccaggugguuccacagcagug

SEQ ID NO: 803235 - RNA, 22 nt, Human
agcuacaaaaacacuguaccga

SEQ ID NO: 803236 - RNA, 18 nt, Human
agggauuaguaaaaacua

SEQ ID NO: 803237 - RNA, 24 nt, Human
auaaagcaaaugaccaaaaccucu

SEQ ID NO: 803238 - RNA, 21 nt, Human
auaguguuauuguugcauggu

SEQ ID NO: 803239 - RNA, 22 nt, Human
auuacacaccugucccaaggca

SEQ ID NO: 803240 - RNA, 20 nt, Human
caaaaacacuguaccgaaau

SEQ ID NO: 803241 - RNA, 19 nt, Human
caaaaagcuacucuuugca

SEQ ID NO: 803242 - RNA, 23 nt, Human
caaaacaagagaauaaaacuucc

SEQ ID NO: 803243 - RNA, 21 nt, Human
caaaugaccaaaaccucuuuu

SEQ ID NO: 803244 - RNA, 19 nt, Human
caacccgauggcaauacga

SEQ ID NO: 803245 - RNA, 22 nt, Human
caacccgauggcaauacgaaaa

SEQ ID NO: 803246 - RNA, 21 nt, Human
caacuaaauuacaggauaccc

SEQ ID NO: 803247 - RNA, 24 nt, Human
caagagaauaaaacuuccaugcaa

SEQ ID NO: 803248 - RNA, 21 nt, Human
caccccaagccaccuacaagc

SEQ ID NO: 803249 - RNA, 23 nt, Human
cacccuccauucgcaugacugcu

SEQ ID NO: 803250 - RNA, 21 nt, Human
caccuacaagcauuuaaaaga

SEQ ID NO: 803251 - RNA, 20 nt, Human
cacuguuggaaaaacaagag

SEQ ID NO: 803252 - RNA, 18 nt, Human
cagaaugaacagaagagu

SEQ ID NO: 803253 - RNA, 19 nt, Human
cagcacgauagcacacccc

SEQ ID NO: 803254 - RNA, 22 nt, Human
cagcacgauagcacaccccaag

SEQ ID NO: 803255 - RNA, 19 nt, Human
ccaaaaaugucugcauuuu

SEQ ID NO: 803256 - RNA, 20 nt, Human
ccacaauucaucacauucaa

SEQ ID NO: 803257 - RNA, 19 nt, Human
ccccugaagcauacuguuc

SEQ ID NO: 803258 - RNA, 23 nt, Human
ccuacaaucuguaaacuaauuac

SEQ ID NO: 803259 - RNA, 22 nt, Human
cuaacauuacacaccuguccca

SEQ ID NO: 803260 - RNA, 22 nt, Human
cuagacacccacuugcuaaaag

SEQ ID NO: 803261 - RNA, 19 nt, Human
gaagagguugaggaagggg

SEQ ID NO: 803262 - RNA, 21 nt, Human
gaaguauauauauuauaccaa

SEQ ID NO: 803263 - RNA, 20 nt, Human
gaauuacacugcaaagaucu

SEQ ID NO: 803264 - RNA, 21 nt, Human
gacugcuuucaguauuugcag

SEQ ID NO: 803265 - RNA, 19 nt, Human
gcccacugauaauaaaccu

SEQ ID NO: 803266 - RNA, 21 nt, Human
ggaaggauguuuaagcaacau

SEQ ID NO: 803267 - RNA, 25 nt, Human
gggcaagucuuugguuuugaaggau

SEQ ID NO: 803268 - RNA, 20 nt, Human
gucccgauucuuacaaugcu

SEQ ID NO: 803269 - RNA, 18 nt, Human
gugcaugacaaaauaagu

SEQ ID NO: 803270 - RNA, 18 nt, Human
uaaaaagcagaauauaag

SEQ ID NO: 803271 - RNA, 22 nt, Human
uaaaauaaagcaaaugaccaaa

SEQ ID NO: 803272 - RNA, 24 nt, Human
uaaauaaauaagugcacuccccuc

SEQ ID NO: 803273 - RNA, 18 nt, Human
uaacacaaaaucaaaaau

SEQ ID NO: 803274 - RNA, 18 nt, Human
uaacaguagaaaaugaca

SEQ ID NO: 803275 - RNA, 20 nt, Human
uaacucccaacuacaauccc

SEQ ID NO: 803276 - RNA, 24 nt, Human
uaacugacauacuuaaauaacuuu

SEQ ID NO: 803277 - RNA, 24 nt, Human
uaagauaaacauacguaccuuugc

SEQ ID NO: 803278 - RNA, 23 nt, Human
uaauaaauacuacaaccucccca

SEQ ID NO: 803279 - RNA, 21 nt, Human
uacaaaaacacuguaccgaaa

SEQ ID NO: 803280 - RNA, 18 nt, Human
uacaguguuaucugucau

SEQ ID NO: 803281 - RNA, 24 nt, Human
uagacacccacuugcuaaaaguuu

SEQ ID NO: 803282 - RNA, 21 nt, Human
uagcauugccagugcacgaca

SEQ ID NO: 803283 - RNA, 26 nt, Human
uauaacaaaaaucugaugaaaauuau

SEQ ID NO: 803284 - RNA, 20 nt, Human
uauuaaaaguaaagggcugc

SEQ ID NO: 803285 - RNA, 21 nt, Human
uauugcauaaagagauauccc

SEQ ID NO: 803286 - RNA, 18 nt, Human
uauuguugcaugguuauu

SEQ ID NO: 803287 - RNA, 22 nt, Human
uauuucucucucuccucuaaga

SEQ ID NO: 803288 - RNA, 24 nt, Human
uauuuugcauucugcagaggucug

SEQ ID NO: 803289 - RNA, 19 nt, Human
ucaaacacuuaacaucaau

SEQ ID NO: 803290 - RNA, 18 nt, Human
ucaaguuuuaaaucaccu

SEQ ID NO: 803291 - RNA, 21 nt, Human
ucacaaguaaauauuaguaga

SEQ ID NO: 803292 - RNA, 23 nt, Human
ucagcaggucauguacaaaggga

SEQ ID NO: 803293 - RNA, 26 nt, Human
ucagugaaaagugugccuaaaaaugu

SEQ ID NO: 803294 - RNA, 19 nt, Human
uccaugacuagggcuucaa

SEQ ID NO: 803295 - RNA, 21 nt, Human
ucugcagaggucuguguaugg

SEQ ID NO: 803296 - RNA, 26 nt, Human
ugaagaacauguaaucauaaaguuca

SEQ ID NO: 803297 - RNA, 21 nt, Human
ugaaguguaaccaauaaucug

SEQ ID NO: 803298 - RNA, 22 nt, Human
ugacacaagaaucuacaaaaca

SEQ ID NO: 803299 - RNA, 26 nt, Human
ugagguauugcauaaagagauauccc

SEQ ID NO: 803300 - RNA, 24 nt, Human
ugaugaaguuggcacuucaaacac

SEQ ID NO: 803301 - RNA, 19 nt, Human
uggaaauucagccaaguag

SEQ ID NO: 803302 - RNA, 24 nt, Human
uuaaaaugcuauaauaaauacuac

SEQ ID NO: 803303 - RNA, 19 nt, Human
uuaaugauggauagggcau

SEQ ID NO: 803304 - RNA, 25 nt, Human
uuaccccugaagcauacuguucaac

SEQ ID NO: 803305 - RNA, 23 nt, Human
uuaguaagaagcuguagacaauu

SEQ ID NO: 803306 - RNA, 25 nt, Human
uuccuggggcuuugaccagauaagu

SEQ ID NO: 803307 - RNA, 23 nt, Human
uugcaggaaguuuggauccucuu

SEQ ID NO: 803308 - RNA, 20 nt, Human
uugcauucugcagaggucug

SEQ ID NO: 803309 - RNA, 21 nt, Human
uuuaauauuucucucucuccu

SEQ ID NO: 803310 - RNA, 18 nt, Human
uuugaauauuagacagca

SEQ ID NO: 803311 - RNA, 22 nt, Human
uuuguuauuuuaauuucuaccu

SEQ ID NO: 803312 - RNA, 21 nt, Human
aaaagcugagagaacuuacgg

SEQ ID NO: 803313 - RNA, 19 nt, Human
aaacaauguacccaacaac

SEQ ID NO: 803314 - RNA, 25 nt, Human
aaacacaacaucugaaauuuaaaac

SEQ ID NO: 803315 - RNA, 25 nt, Human
aaacagcaaauccagugaagccaaa

SEQ ID NO: 803316 - RNA, 24 nt, Human
aaagugcugggauuacaggcguga

SEQ ID NO: 803317 - RNA, 18 nt, Human
aacaggcugcgcgaaauc

SEQ ID NO: 803318 - RNA, 22 nt, Human
aaccaaagauaaggagaaacaa

SEQ ID NO: 803319 - RNA, 21 nt, Human
aaccaggugagcaccuuggaa

SEQ ID NO: 803320 - RNA, 22 nt, Human
aaccugcaggaagaagggaagg

SEQ ID NO: 803321 - RNA, 24 nt, Human
aacuuggaugaaaugaggaaacuc

SEQ ID NO: 803322 - RNA, 21 nt, Human
aagaagaaaagagauauaaag

SEQ ID NO: 803323 - RNA, 20 nt, Human
aagcauaaccaugauacaaa

SEQ ID NO: 803324 - RNA, 23 nt, Human
aaggagaaacaauuuuaagacaa

SEQ ID NO: 803325 - RNA, 19 nt, Human
aagugcugggauuacaggc

SEQ ID NO: 803326 - RNA, 19 nt, Human
aagugcugggauuacaggc

SEQ ID NO: 803327 - RNA, 20 nt, Human
aaucucuaaggcaacaccca

SEQ ID NO: 803328 - RNA, 21 nt, Human
acacacaugugcacacacaca

SEQ ID NO: 803329 - RNA, 19 nt, Human
acagcacagacugcugaaa

SEQ ID NO: 803330 - RNA, 20 nt, Human
accaggugagcaccuuggaa

SEQ ID NO: 803331 - RNA, 18 nt, Human
accuguggaagggaggcg

SEQ ID NO: 803332 - RNA, 22 nt, Human
acgagaacacggaggugagagg

SEQ ID NO: 803333 - RNA, 20 nt, Human
acggaggugaccggaaacuc

SEQ ID NO: 803334 - RNA, 20 nt, Human
acggaggugagaggaaacuc

SEQ ID NO: 803335 - RNA, 20 nt, Human
acggaggugagaggaaacuc

SEQ ID NO: 803336 - RNA, 20 nt, Human
acggaggugagaggaaacuc

SEQ ID NO: 803337 - RNA, 21 nt, Human
acggaggugagaggaaacucu

SEQ ID NO: 803338 - RNA, 21 nt, Human
acggaggugagaggaaacucu

SEQ ID NO: 803339 - RNA, 21 nt, Human
acggaggugagaggaaacucu

SEQ ID NO: 803340 - RNA, 18 nt, Human
acgggguuucaccguguu

SEQ ID NO: 803341 - RNA, 19 nt, Human
acgggguuucaccguguua

SEQ ID NO: 803342 - RNA, 20 nt, Human
acgggguuucaccguguuag

SEQ ID NO: 803343 - RNA, 24 nt, Human
acgggguuucaccguguuagccag

SEQ ID NO: 803344 - RNA, 18 nt, Human
acuacagccaccacgccc

SEQ ID NO: 803345 - RNA, 19 nt, Human
agaaaaaagacccauuacc

SEQ ID NO: 803346 - RNA, 19 nt, Human
agaauuuuccaaaacugau

SEQ ID NO: 803347 - RNA, 20 nt, Human
agacaaaauccacagaaggc

SEQ ID NO: 803348 - RNA, 20 nt, Human
agacagaagacaaacagcaa

SEQ ID NO: 803349 - RNA, 29 nt, Human
agacagaagacaaacagcaaagggacccc

SEQ ID NO: 803350 - RNA, 24 nt, Human
agagacccaugagacagaagacaa

SEQ ID NO: 803351 - RNA, 19 nt, Human
agagcagcucaacccacgg

SEQ ID NO: 803352 - RNA, 23 nt, Human
agaggugagaggaaaugcuggag

SEQ ID NO: 803353 - RNA, 22 nt, Human
agcacagacugcugaaaaccaa

SEQ ID NO: 803354 - RNA, 20 nt, Human
agccaaaaccuggggcuuuu

SEQ ID NO: 803355 - RNA, 19 nt, Human
aggaaagacacgcugcuca

SEQ ID NO: 803356 - RNA, 20 nt, Human
aggaagauaaaacaauccua

SEQ ID NO: 803357 - RNA, 24 nt, Human
aggagaggcgaagagaaauaguuc

SEQ ID NO: 803358 - RNA, 22 nt, Human
aggcaagaagugaaaaggagag

SEQ ID NO: 803359 - RNA, 25 nt, Human
aggcuggagugcaguggcgcgaucu

SEQ ID NO: 803360 - RNA, 24 nt, Human
agggcccccaggggaaaggagggc

SEQ ID NO: 803361 - RNA, 23 nt, Human
aggugagaggaaacucuggagag

SEQ ID NO: 803362 - RNA, 23 nt, Human
aggugagaggaaacucuggagag

SEQ ID NO: 803363 - RNA, 23 nt, Human
aggugagaggaaacucuggagag

SEQ ID NO: 803364 - RNA, 21 nt, Human
aguagagacgggguuucaccg

SEQ ID NO: 803365 - RNA, 19 nt, Human
agucaaagcauaaccauga

SEQ ID NO: 803366 - RNA, 20 nt, Human
agugcaguggcgcgaucucg

SEQ ID NO: 803367 - RNA, 23 nt, Human
agugcaguggcgcgaucucggcu

SEQ ID NO: 803368 - RNA, 24 nt, Human
agugcaguggcgcgaucucggcuc

SEQ ID NO: 803369 - RNA, 18 nt, Human
agugcugggauuacaggc

SEQ ID NO: 803370 - RNA, 24 nt, Human
auacauucuucucaagugcacagu

SEQ ID NO: 803371 - RNA, 24 nt, Human
auagaacacaugacagaagagacg

SEQ ID NO: 803372 - RNA, 22 nt, Human
auagcaagaaugaugaagaaca

SEQ ID NO: 803373 - RNA, 19 nt, Human
auaguaaaaaaaaaaaaaa

SEQ ID NO: 803374 - RNA, 26 nt, Human
auccaagaccacgcacuaccauaggg

SEQ ID NO: 803375 - RNA, 26 nt, Human
auccaagaccacgcacuaccauaggg

SEQ ID NO: 803376 - RNA, 25 nt, Human
auccaagcaaacacucagcacaaga

SEQ ID NO: 803377 - RNA, 25 nt, Human
auccagugaagccaaaaccuggggc

SEQ ID NO: 803378 - RNA, 21 nt, Human
augcacucccugaggcucacc

SEQ ID NO: 803379 - RNA, 20 nt, Human
auucucccgccucagccucc

SEQ ID NO: 803380 - RNA, 18 nt, Human
caaaauagccccaaaaca

SEQ ID NO: 803381 - RNA, 24 nt, Human
caaagauaaggagaaacaauuuua

SEQ ID NO: 803382 - RNA, 25 nt, Human
caaagcauaaccaugauacaaagaa

SEQ ID NO: 803383 - RNA, 23 nt, Human
cacaacagaagacaggauucgua

SEQ ID NO: 803384 - RNA, 24 nt, Human
cacacaaaacaauguacccaacaa

SEQ ID NO: 803385 - RNA, 20 nt, Human
cacauaacuaagaagaaaac

SEQ ID NO: 803386 - RNA, 22 nt, Human
cacauaacuaagaagaaaacac

SEQ ID NO: 803387 - RNA, 24 nt, Human
caccguguuagccaggauggucuc

SEQ ID NO: 803388 - RNA, 21 nt, Human
caccugacacacacaaaacaa

SEQ ID NO: 803389 - RNA, 20 nt, Human
cacguauagcaaaaacucac

SEQ ID NO: 803390 - RNA, 19 nt, Human
cacugcaagcuccgucucc

SEQ ID NO: 803391 - RNA, 21 nt, Human
cagaagacaguggagcccauc

SEQ ID NO: 803392 - RNA, 20 nt, Human
cagaaggcaagaagugaaaa

SEQ ID NO: 803393 - RNA, 20 nt, Human
cagacaaacaaaagcugaga

SEQ ID NO: 803394 - RNA, 18 nt, Human
cagccuccugaguagcug

SEQ ID NO: 803395 - RNA, 24 nt, Human
caggaaaugcuaaugaacucaagg

SEQ ID NO: 803396 - RNA, 20 nt, Human
caggcacagcacagacugcu

SEQ ID NO: 803397 - RNA, 18 nt, Human
caguagaaggagggaaga

SEQ ID NO: 803398 - RNA, 23 nt, Human
ccaaaacacguauagcaaaaacu

SEQ ID NO: 803399 - RNA, 22 nt, Human
ccaaagugcugggauuacaggc

SEQ ID NO: 803400 - RNA, 22 nt, Human
ccaaagugcugggauuacaggc

SEQ ID NO: 803401 - RNA, 24 nt, Human
ccaaagugcugggauuacaggcgu

SEQ ID NO: 803402 - RNA, 28 nt, Human
ccacagccucaggagaggggggaacgcc

SEQ ID NO: 803403 - RNA, 20 nt, Human
ccaccacgcccggcuaauuu

SEQ ID NO: 803404 - RNA, 21 nt, Human
ccacgcacuccccaagaacac

SEQ ID NO: 803405 - RNA, 21 nt, Human
ccacgcacuccccgagaacac

SEQ ID NO: 803406 - RNA, 21 nt, Human
ccacgcacuccccgagaacac

SEQ ID NO: 803407 - RNA, 21 nt, Human
ccacgcacuccccgagaacac

SEQ ID NO: 803408 - RNA, 21 nt, Human
ccacgcacuccccgagaacac

SEQ ID NO: 803409 - RNA, 21 nt, Human
ccacgcacuccccgagaacac

SEQ ID NO: 803410 - RNA, 21 nt, Human
ccacgcacucccugagaacac

SEQ ID NO: 803411 - RNA, 21 nt, Human
ccacgcacucccugagaacac

SEQ ID NO: 803412 - RNA, 25 nt, Human
ccagggacagcagcucauccuccuu

SEQ ID NO: 803413 - RNA, 22 nt, Human
cccaggcuggagugcaguggcg

SEQ ID NO: 803414 - RNA, 18 nt, Human
cccaguuaaaccuucaga

SEQ ID NO: 803415 - RNA, 18 nt, Human
ccccaagcccaguuaaac

SEQ ID NO: 803416 - RNA, 20 nt, Human
cccugagaacacggagguga

SEQ ID NO: 803417 - RNA, 23 nt, Human
ccgccucagccuccugaguagcu

SEQ ID NO: 803418 - RNA, 18 nt, Human
ccugaccucgugauccac

SEQ ID NO: 803419 - RNA, 19 nt, Human
ccugagaacacggagguga

SEQ ID NO: 803420 - RNA, 18 nt, Human
ccugccgugucccugggg

SEQ ID NO: 803421 - RNA, 22 nt, Human
cgagaacacagaggugagagga

SEQ ID NO: 803422 - RNA, 22 nt, Human
cgagaacacggaggugagagga

SEQ ID NO: 803423 - RNA, 22 nt, Human
cgagaacacggaggugagagga

SEQ ID NO: 803424 - RNA, 22 nt, Human
cgagaacacggaggugagagga

SEQ ID NO: 803425 - RNA, 22 nt, Human
cgagaacacggaggugagagga

SEQ ID NO: 803426 - RNA, 22 nt, Human
cgagaacacggaggugagagga

SEQ ID NO: 803427 - RNA, 20 nt, Human
cgagucaagacaccguuggg

SEQ ID NO: 803428 - RNA, 19 nt, Human
cgccgcugagagcagcagc

SEQ ID NO: 803429 - RNA, 25 nt, Human
cgccucagccuccugaguagcugcg

SEQ ID NO: 803430 - RNA, 21 nt, Human
cgcugcucagggccugggaug

SEQ ID NO: 803431 - RNA, 18 nt, Human
cggcuuggcgggaaucgg

SEQ ID NO: 803432 - RNA, 21 nt, Human
cgggagacccugaccagcaac

SEQ ID NO: 803433 - RNA, 24 nt, Human
cuaaagauacugaaaauaagagga

SEQ ID NO: 803434 - RNA, 22 nt, Human
cuagccaaagguggugcugcag

SEQ ID NO: 803435 - RNA, 21 nt, Human
cucacugaaaccauauuuacc

SEQ ID NO: 803436 - RNA, 24 nt, Human
cuccugaccucgugauccacucgc

SEQ ID NO: 803437 - RNA, 21 nt, Human
cuccuggguucacgccauucu

SEQ ID NO: 803438 - RNA, 24 nt, Human
cucgcucugucgcccaggcuggag

SEQ ID NO: 803439 - RNA, 20 nt, Human
cucugucgcccaggcuggag

SEQ ID NO: 803440 - RNA, 21 nt, Human
cugaagcgcuggcgagccccg

SEQ ID NO: 803441 - RNA, 21 nt, Human
cugaauagucucaccucuguu

SEQ ID NO: 803442 - RNA, 19 nt, Human
cugacuccagccucacggg

SEQ ID NO: 803443 - RNA, 20 nt, Human
cuucacaguuucaaaggacu

SEQ ID NO: 803444 - RNA, 25 nt, Human
gaagagggagaacaggggaaaaaau

SEQ ID NO: 803445 - RNA, 20 nt, Human
gacacacacaaaacaaugua

SEQ ID NO: 803446 - RNA, 22 nt, Human
gaccucgugauccacucgccuc

SEQ ID NO: 803447 - RNA, 22 nt, Human
gaccucgugauccacucgccuc

SEQ ID NO: 803448 - RNA, 24 nt, Human
gaccucgugauccacucgccucgg

SEQ ID NO: 803449 - RNA, 19 nt, Human
gacuacagccaccacgccc

SEQ ID NO: 803450 - RNA, 21 nt, Human
gagaacacggaggugagagga

SEQ ID NO: 803451 - RNA, 24 nt, Human
gagacgggguuucaccguguuagc

SEQ ID NO: 803452 - RNA, 20 nt, Human
gagaggaaacucuggagagg

SEQ ID NO: 803453 - RNA, 20 nt, Human
gagaggaaacucuggagagg

SEQ ID NO: 803454 - RNA, 21 nt, Human
gagcaacaggauuagucaaug

SEQ ID NO: 803455 - RNA, 20 nt, Human
gagcaggguaaccacucccc

SEQ ID NO: 803456 - RNA, 21 nt, Human
gaggaacaaaauugauaaauc

SEQ ID NO: 803457 - RNA, 18 nt, Human
gauuacaggcgugagcca

SEQ ID NO: 803458 - RNA, 23 nt, Human
gauuacaggcgugagccacagca

SEQ ID NO: 803459 - RNA, 24 nt, Human
gcaacaggucacugacaccuuuuc

SEQ ID NO: 803460 - RNA, 19 nt, Human
gcccaggcuggagugcagu

SEQ ID NO: 803461 - RNA, 20 nt, Human
gcccaggcuggagugcagug

SEQ ID NO: 803462 - RNA, 23 nt, Human
gcccggcuaauuuuuuguauuuu

SEQ ID NO: 803463 - RNA, 23 nt, Human
gccucggccucccaaagugcugg

SEQ ID NO: 803464 - RNA, 19 nt, Human
gcuggagugcaguggcgcg

SEQ ID NO: 803465 - RNA, 23 nt, Human
ggaaaacaacaggcugcgcgaaa

SEQ ID NO: 803466 - RNA, 20 nt, Human
ggaacuggcagaugggaggg

SEQ ID NO: 803467 - RNA, 21 nt, Human
ggaagggaggcggacgagagc

SEQ ID NO: 803468 - RNA, 24 nt, Human
ggaauuccggcagagaugagaacg

SEQ ID NO: 803469 - RNA, 22 nt, Human
ggagcaacaaauaacaaugaac

SEQ ID NO: 803470 - RNA, 24 nt, Human
ggcagggagcaggggaaaggaggg

SEQ ID NO: 803471 - RNA, 21 nt, Human
ggcgcucuuccggcaccacac

SEQ ID NO: 803472 - RNA, 23 nt, Human
gggagacccugaccagcaacgcc

SEQ ID NO: 803473 - RNA, 22 nt, Human
gggcgaggcuucacaguuucaa

SEQ ID NO: 803474 - RNA, 20 nt, Human
ggggaaaggagggcccccag

SEQ ID NO: 803475 - RNA, 19 nt, Human
gggguggaguccacugagu

SEQ ID NO: 803476 - RNA, 23 nt, Human
gggguuucaccguguuagccagg

SEQ ID NO: 803477 - RNA, 22 nt, Human
ggguuucaccguguuagccagg

SEQ ID NO: 803478 - RNA, 20 nt, Human
ggucucgaucuccugaccuc

SEQ ID NO: 803479 - RNA, 22 nt, Human
guaaaaaaaaaaaaaauggcua

SEQ ID NO: 803480 - RNA, 23 nt, Human
guagagacgggguuucaccgugu

SEQ ID NO: 803481 - RNA, 18 nt, Human
gucaguaaggguacagga

SEQ ID NO: 803482 - RNA, 25 nt, Human
gucuccuggguucacgccauucucc

SEQ ID NO: 803483 - RNA, 18 nt, Human
gugagaggaaacucugga

SEQ ID NO: 803484 - RNA, 18 nt, Human
gugagaggaaacucugga

SEQ ID NO: 803485 - RNA, 26 nt, Human
gugagaggaaacucuggagaggagaa

SEQ ID NO: 803486 - RNA, 26 nt, Human
gugagaggaaacucuggagaggagaa

SEQ ID NO: 803487 - RNA, 26 nt, Human
gugagaggaaacucuggagaggagaa

SEQ ID NO: 803488 - RNA, 20 nt, Human
gugagaggaaaugcuggaga

SEQ ID NO: 803489 - RNA, 20 nt, Human
gugagaggaaaugcuggaga

SEQ ID NO: 803490 - RNA, 22 nt, Human
gugaguggaaaugcuggagaag

SEQ ID NO: 803491 - RNA, 24 nt, Human
gugauccacucgccucggccuccc

SEQ ID NO: 803492 - RNA, 25 nt, Human
uaaaaaaaaaaaaaauggcuaagaa

SEQ ID NO: 803493 - RNA, 18 nt, Human
uaaauccaguacaguaga

SEQ ID NO: 803494 - RNA, 21 nt, Human
uaagacaaagaaaaaagaccc

SEQ ID NO: 803495 - RNA, 22 nt, Human
uaagacaaagaaaaaagaccca

SEQ ID NO: 803496 - RNA, 20 nt, Human
uaaggagaaacaauuuuaag

SEQ ID NO: 803497 - RNA, 20 nt, Human
uaagugaaggaaagcuguga

SEQ ID NO: 803498 - RNA, 25 nt, Human
uaauuuuuuguauuuuuuaguagag

SEQ ID NO: 803499 - RNA, 26 nt, Human
uaauuuuuuguauuuuuuaguagaga

SEQ ID NO: 803500 - RNA, 22 nt, Human
uacacacaugugcacacacaca

SEQ ID NO: 803501 - RNA, 23 nt, Human
uacaggcgugagccacagcaccc

SEQ ID NO: 803502 - RNA, 23 nt, Human
uacauggguuuggaagugaugca

SEQ ID NO: 803503 - RNA, 28 nt, Human
uaccaaaauuaacacaaaaauaaacaaa

SEQ ID NO: 803504 - RNA, 19 nt, Human
uacguaaaaagaaaauuac

SEQ ID NO: 803505 - RNA, 25 nt, Human
uagcaagaaugaugaagaacaccag

SEQ ID NO: 803506 - RNA, 21 nt, Human
uaguagagacgggguuucacc

SEQ ID NO: 803507 - RNA, 24 nt, Human
uaguagagacgggguuucaccgug

SEQ ID NO: 803508 - RNA, 25 nt, Human
uauagaaaaaagaagaaaagagaua

SEQ ID NO: 803509 - RNA, 20 nt, Human
uaugaugucucuauaaggug

SEQ ID NO: 803510 - RNA, 24 nt, Human
ucaacagagaaucggcauccacaa

SEQ ID NO: 803511 - RNA, 22 nt, Human
ucaccccucccuccuagccaaa

SEQ ID NO: 803512 - RNA, 24 nt, Human
ucaccguguuagccaggauggucu

SEQ ID NO: 803513 - RNA, 19 nt, Human
ucacgccauucucccgccu

SEQ ID NO: 803514 - RNA, 23 nt, Human
ucacugcaagcuccgucuccugg

SEQ ID NO: 803515 - RNA, 24 nt, Human
ucacugcaagcuccgucuccuggg

SEQ ID NO: 803516 - RNA, 19 nt, Human
ucacugggcagggagcagg

SEQ ID NO: 803517 - RNA, 19 nt, Human
uccaagaaaaauacguaaa

SEQ ID NO: 803518 - RNA, 23 nt, Human
uccaagaccacgcacucccugag

SEQ ID NO: 803519 - RNA, 23 nt, Human
uccaagaccacgcacucccugag

SEQ ID NO: 803520 - RNA, 19 nt, Human
uccacagaaggcaagaagu

SEQ ID NO: 803521 - RNA, 19 nt, Human
uccacagccucaggagagg

SEQ ID NO: 803522 - RNA, 19 nt, Human
uccagggacagcagcucau

SEQ ID NO: 803523 - RNA, 24 nt, Human
ucccaaagugcugggauuacaggc

SEQ ID NO: 803524 - RNA, 18 nt, Human
ucccagauuugaguucug

SEQ ID NO: 803525 - RNA, 19 nt, Human
ucccugagaacacggaggu

SEQ ID NO: 803526 - RNA, 19 nt, Human
ucccugagaacacggaggu

SEQ ID NO: 803527 - RNA, 21 nt, Human
ucccugagaacacggagguga

SEQ ID NO: 803528 - RNA, 24 nt, Human
uccuggguucacgccauucucccg

SEQ ID NO: 803529 - RNA, 21 nt, Human
uccuuggucuggagucaccuu

SEQ ID NO: 803530 - RNA, 24 nt, Human
ucgcccaggcuggagugcaguggc

SEQ ID NO: 803531 - RNA, 24 nt, Human
ucgccucggccucccaaagugcug

SEQ ID NO: 803532 - RNA, 24 nt, Human
ucgcucugucgcccaggcuggagu

SEQ ID NO: 803533 - RNA, 24 nt, Human
ucuaaaaccacguagacaggaggc

SEQ ID NO: 803534 - RNA, 19 nt, Human
ucuaaggaaaacaacaggc

SEQ ID NO: 803535 - RNA, 19 nt, Human
ucuaaggcaacacccaaga

SEQ ID NO: 803536 - RNA, 19 nt, Human
ucucgcucugucgcccagg

SEQ ID NO: 803537 - RNA, 22 nt, Human
ucucgcucugucgcccaggcug

SEQ ID NO: 803538 - RNA, 23 nt, Human
ucucgcucugucgcccaggcugg

SEQ ID NO: 803539 - RNA, 24 nt, Human
ucucgcucugucgcccaggcugga

SEQ ID NO: 803540 - RNA, 26 nt, Human
ucucgcucugucgcccaggcuggagu

SEQ ID NO: 803541 - RNA, 27 nt, Human
ucucgcucugucgcccaggcuggagug

SEQ ID NO: 803542 - RNA, 24 nt, Human
ucugacaccacgcacuccccaaga

SEQ ID NO: 803543 - RNA, 24 nt, Human
ucugacaccacgcacuccccgaga

SEQ ID NO: 803544 - RNA, 24 nt, Human
ucugacaccacgcacuccccgaga

SEQ ID NO: 803545 - RNA, 24 nt, Human
ucugacaccacgcacuccccgaga

SEQ ID NO: 803546 - RNA, 24 nt, Human
ucugacaccacgcacuccccgaga

SEQ ID NO: 803547 - RNA, 24 nt, Human
ucugucgcccaggcuggagugcag

SEQ ID NO: 803548 - RNA, 20 nt, Human
ugaaaaauagaacacaugac

SEQ ID NO: 803549 - RNA, 24 nt, Human
ugaaaaucagcccucauuggagca

SEQ ID NO: 803550 - RNA, 20 nt, Human
ugaaacacagaacuggcagc

SEQ ID NO: 803551 - RNA, 26 nt, Human
ugaagcaaacacugaugucuaggaac

SEQ ID NO: 803552 - RNA, 23 nt, Human
ugaagcgcuggcgagccccgccg

SEQ ID NO: 803553 - RNA, 19 nt, Human
ugaauggaaagcuuaggug

SEQ ID NO: 803554 - RNA, 20 nt, Human
ugacaaaauagccccaaaac

SEQ ID NO: 803555 - RNA, 23 nt, Human
ugaccucgugauccacucgccuc

SEQ ID NO: 803556 - RNA, 19 nt, Human
ugaccuggucuccucuccc

SEQ ID NO: 803557 - RNA, 19 nt, Human
ugagaacacggaggugacc

SEQ ID NO: 803558 - RNA, 21 nt, Human
ugagaggaaacucuggagagg

SEQ ID NO: 803559 - RNA, 21 nt, Human
ugagaggaaaugcuggagagg

SEQ ID NO: 803560 - RNA, 21 nt, Human
ugagaggaaaugcuggagagg

SEQ ID NO: 803561 - RNA, 19 nt, Human
ugagugcaaugguacaauc

SEQ ID NO: 803562 - RNA, 23 nt, Human
ugaguucuguauauuccaagaaa

SEQ ID NO: 803563 - RNA, 22 nt, Human
ugcaguggcgcgaucucggcuc

SEQ ID NO: 803564 - RNA, 25 nt, Human
ugcugggauuacaggcgugagccac

SEQ ID NO: 803565 - RNA, 21 nt, Human
uggaagcugagccccaagccc

SEQ ID NO: 803566 - RNA, 18 nt, Human
uggagaggagcaggaugg

SEQ ID NO: 803567 - RNA, 18 nt, Human
uggagaggagcaggaugg

SEQ ID NO: 803568 - RNA, 18 nt, Human
uggagaggagcaggaugg

SEQ ID NO: 803569 - RNA, 18 nt, Human
uggagaggagcaggaugg

SEQ ID NO: 803570 - RNA, 18 nt, Human
uggagaggagcaggaugg

SEQ ID NO: 803571 - RNA, 24 nt, Human
uggaggccacccagccaacgcggu

SEQ ID NO: 803572 - RNA, 23 nt, Human
uggagugcaguggcgcgaucucg

SEQ ID NO: 803573 - RNA, 24 nt, Human
uggagugcaguggcgcgaucucgg

SEQ ID NO: 803574 - RNA, 22 nt, Human
uggcagaugggagggaccuucu

SEQ ID NO: 803575 - RNA, 25 nt, Human
ugggaauggcaaaaaucauccaccu

SEQ ID NO: 803576 - RNA, 20 nt, Human
ugggagccagaagacagugg

SEQ ID NO: 803577 - RNA, 20 nt, Human
ugggauguuucuucugagug

SEQ ID NO: 803578 - RNA, 22 nt, Human
ugggauguuucuucugagugca

SEQ ID NO: 803579 - RNA, 18 nt, Human
ugggauuacaggcgugag

SEQ ID NO: 803580 - RNA, 19 nt, Human
ugggauuacaggcgugagc

SEQ ID NO: 803581 - RNA, 21 nt, Human
ugggauuacaggcgugagcca

SEQ ID NO: 803582 - RNA, 22 nt, Human
ugggauuacaggcgugagccac

SEQ ID NO: 803583 - RNA, 22 nt, Human
ugggauuacaggcgugagccac

SEQ ID NO: 803584 - RNA, 22 nt, Human
ugggauuacaggcgugagccac

SEQ ID NO: 803585 - RNA, 23 nt, Human
ugggauuacaggcgugagccaca

SEQ ID NO: 803586 - RNA, 26 nt, Human
ugggauuacaggcgugagccacagca

SEQ ID NO: 803587 - RNA, 27 nt, Human
ugggauuacaggcgugagccacagcac

SEQ ID NO: 803588 - RNA, 24 nt, Human
ugggcagggagcaggggaaaggag

SEQ ID NO: 803589 - RNA, 24 nt, Human
uggguucacgccauucucccgccu

SEQ ID NO: 803590 - RNA, 24 nt, Human
uguacccaacaacucaaaauacau

SEQ ID NO: 803591 - RNA, 23 nt, Human
ugucaccccucccuccuagccaa

SEQ ID NO: 803592 - RNA, 20 nt, Human
uguugcaaauuuccaaaaau

SEQ ID NO: 803593 - RNA, 19 nt, Human
uuaaaacugaaagaaaaca

SEQ ID NO: 803594 - RNA, 18 nt, Human
uuaguagagacgggguuu

SEQ ID NO: 803595 - RNA, 22 nt, Human
uuaguagagacgggguuucacc

SEQ ID NO: 803596 - RNA, 24 nt, Human
uuaguagagacgggguuucaccgu

SEQ ID NO: 803597 - RNA, 27 nt, Human
uucaaaggagcaacaaauaacaaugaa

SEQ ID NO: 803598 - RNA, 19 nt, Human
uucguaaaucuaaaaccac

SEQ ID NO: 803599 - RNA, 24 nt, Human
uuggagcaugaagcugcaggaagg

SEQ ID NO: 803600 - RNA, 22 nt, Human
uugucacugggcagggagcagg

SEQ ID NO: 803601 - RNA, 19 nt, Human
uuucaccguguuagccagg

SEQ ID NO: 803602 - RNA, 19 nt, Human
uuugaguucuguauauucc

SEQ ID NO: 803603 - RNA, 18 nt, Human
uuuggaaaagaggaacaa

SEQ ID NO: 803604 - RNA, 22 nt, Human
uuuuggaaaagaggaacaaaau

SEQ ID NO: 803605 - RNA, 24 nt, Human
uuuuuaguagagacgggguuucac

SEQ ID NO: 803606 - RNA, 22 nt, Human
uuuuuguauuuuuuaguagaga

SEQ ID NO: 803607 - RNA, 23 nt, Human
uuuuuuaguagagacgggguuuc

SEQ ID NO: 803608 - RNA, 25 nt, Human
uuuuuuguauuuuuuaguagagacg

SEQ ID NO: 803609 - RNA, 18 nt, Human
aaaaaaaaucacagggca

SEQ ID NO: 803610 - RNA, 19 nt, Human
aaaauccucuaaaaaugac

SEQ ID NO: 803611 - RNA, 19 nt, Human
aaacaaaugaauuagcucu

SEQ ID NO: 803612 - RNA, 22 nt, Human
aaagagccauaaaacuuuaucc

SEQ ID NO: 803613 - RNA, 21 nt, Human
aacagacuuaauuuaaagcac

SEQ ID NO: 803614 - RNA, 18 nt, Human
aagcaccagaagcugugu

SEQ ID NO: 803615 - RNA, 24 nt, Human
aagcgucacaaaucccaauaguuc

SEQ ID NO: 803616 - RNA, 21 nt, Human
aaguguuagcgguugugggcu

SEQ ID NO: 803617 - RNA, 26 nt, Human
aauuagcucuuaauggacaaagccau

SEQ ID NO: 803618 - RNA, 20 nt, Human
aauuuaugaacagccuccaa

SEQ ID NO: 803619 - RNA, 25 nt, Human
acaaucccuucauauuccuuuacuu

SEQ ID NO: 803620 - RNA, 20 nt, Human
acacaaaccauauacaugau

SEQ ID NO: 803621 - RNA, 22 nt, Human
acacagcaaggauaaaugauuu

SEQ ID NO: 803622 - RNA, 21 nt, Human
agaaagagcauucuaaaagca

SEQ ID NO: 803623 - RNA, 21 nt, Human
agaaucuuuaguuauagacac

SEQ ID NO: 803624 - RNA, 23 nt, Human
agcuaaggccuaaaaucuaaaac

SEQ ID NO: 803625 - RNA, 21 nt, Human
aggaaucugacacuuugaaug

SEQ ID NO: 803626 - RNA, 21 nt, Human
aguaauaggaagaaaauggga

SEQ ID NO: 803627 - RNA, 22 nt, Human
auaagaaaccuuaggcacacaa

SEQ ID NO: 803628 - RNA, 18 nt, Human
auacuuagauuuugcagg

SEQ ID NO: 803629 - RNA, 23 nt, Human
auacuuauauguauauaagaaac

SEQ ID NO: 803630 - RNA, 19 nt, Human
aucuggugaagaaauaauu

SEQ ID NO: 803631 - RNA, 20 nt, Human
auggacauuuuguuuuuuac

SEQ ID NO: 803632 - RNA, 23 nt, Human
caaaauacuaaaacaagucaaug

SEQ ID NO: 803633 - RNA, 22 nt, Human
caaaucccaauaguuccaaaaa

SEQ ID NO: 803634 - RNA, 20 nt, Human
caacuucucauuaucuaacu

SEQ ID NO: 803635 - RNA, 22 nt, Human
caccaaaauuguaaguguuagc

SEQ ID NO: 803636 - RNA, 23 nt, Human
caccuucuaccaauugucaaaau

SEQ ID NO: 803637 - RNA, 18 nt, Human
cacugcacuagcaaaggc

SEQ ID NO: 803638 - RNA, 24 nt, Human
cagcaaggauaaaugauuucucuu

SEQ ID NO: 803639 - RNA, 21 nt, Human
cauguuguuuggguaauccuu

SEQ ID NO: 803640 - RNA, 18 nt, Human
cccaauaguuccaaaaau

SEQ ID NO: 803641 - RNA, 18 nt, Human
cgaucaagacagcugcag

SEQ ID NO: 803642 - RNA, 20 nt, Human
cucaaaacagauacuuugca

SEQ ID NO: 803643 - RNA, 23 nt, Human
cucagacuugaaaugggugagau

SEQ ID NO: 803644 - RNA, 22 nt, Human
cucuucugaaaccuauccuguu

SEQ ID NO: 803645 - RNA, 22 nt, Human
cugcaacaagcgucacaaaucc

SEQ ID NO: 803646 - RNA, 18 nt, Human
cuuggauuagucaaaagc

SEQ ID NO: 803647 - RNA, 19 nt, Human
cuuguugaagcagcugaag

SEQ ID NO: 803648 - RNA, 20 nt, Human
gaagcagcugaagcaauaaa

SEQ ID NO: 803649 - RNA, 21 nt, Human
gcaaaggcauuaagaggggga

SEQ ID NO: 803650 - RNA, 20 nt, Human
gccuaaaaucuaaaacauaa

SEQ ID NO: 803651 - RNA, 20 nt, Human
ggguuggggaggcaugugau

SEQ ID NO: 803652 - RNA, 21 nt, Human
ggguuggggaggcaugugaug

SEQ ID NO: 803653 - RNA, 21 nt, Human
gguaguuuuuauucuucaagu

SEQ ID NO: 803654 - RNA, 18 nt, Human
ggucuaucaauggacauu

SEQ ID NO: 803655 - RNA, 22 nt, Human
guaaacagacuuaauuuaaagc

SEQ ID NO: 803656 - RNA, 21 nt, Human
guaugcaaauaugcacaaaca

SEQ ID NO: 803657 - RNA, 22 nt, Human
uaaaaauagaaagugcuuuuaa

SEQ ID NO: 803658 - RNA, 25 nt, Human
uaaaacaagucaaugaauuaccccc

SEQ ID NO: 803659 - RNA, 23 nt, Human
uaaaagaacacaaaccauauaca

SEQ ID NO: 803660 - RNA, 24 nt, Human
uaaacagacuuaauuuaaagcacc

SEQ ID NO: 803661 - RNA, 23 nt, Human
uaaacugcaacaagcgucacaaa

SEQ ID NO: 803662 - RNA, 20 nt, Human
uaacagcaccuugaaaaaau

SEQ ID NO: 803663 - RNA, 26 nt, Human
uaauaggaagaaaaugggaagacuaa

SEQ ID NO: 803664 - RNA, 22 nt, Human
uacaaucacaaugcugcagaac

SEQ ID NO: 803665 - RNA, 18 nt, Human
uacaaugaguuuuucuuu

SEQ ID NO: 803666 - RNA, 22 nt, Human
uacaugauuagaauacauacug

SEQ ID NO: 803667 - RNA, 20 nt, Human
uauagucacaguuaagaaua

SEQ ID NO: 803668 - RNA, 18 nt, Human
uauuucauugaaaauucu

SEQ ID NO: 803669 - RNA, 21 nt, Human
uauuuuacacaggagaaauau

SEQ ID NO: 803670 - RNA, 19 nt, Human
uccauacucccaaggaauc

SEQ ID NO: 803671 - RNA, 21 nt, Human
ucccaaaucuaguaugcuaag

SEQ ID NO: 803672 - RNA, 24 nt, Human
ucccaaggaaucugacacuuugaa

SEQ ID NO: 803673 - RNA, 23 nt, Human
ucccucaucuccuuuuggaaaca

SEQ ID NO: 803674 - RNA, 22 nt, Human
ucuagcaaugauuggaagaugu

SEQ ID NO: 803675 - RNA, 18 nt, Human
ugaaaaaauacacugcac

SEQ ID NO: 803676 - RNA, 27 nt, Human
ugaaauaauaauucagcuuauuuuuaa

SEQ ID NO: 803677 - RNA, 23 nt, Human
ugaaccuguuaaaauccucuaaa

SEQ ID NO: 803678 - RNA, 21 nt, Human
ugagaaaggugggaugaaacu

SEQ ID NO: 803679 - RNA, 23 nt, Human
ugagaggacacaguaaaagaaca

SEQ ID NO: 803680 - RNA, 23 nt, Human
ugauguuaacuacaacaacggaa

SEQ ID NO: 803681 - RNA, 24 nt, Human
ugcacaaacaauagacaauaggaa

SEQ ID NO: 803682 - RNA, 21 nt, Human
uggaacaauggcaccaugaaa

SEQ ID NO: 803683 - RNA, 22 nt, Human
ugguaaauuguuaaaaucagga

SEQ ID NO: 803684 - RNA, 18 nt, Human
ugguuaagcaccagaagc

SEQ ID NO: 803685 - RNA, 23 nt, Human
uguaguaccauuccucuuguuuu

SEQ ID NO: 803686 - RNA, 23 nt, Human
uguaugcaaauaugcacaaacaa

SEQ ID NO: 803687 - RNA, 18 nt, Human
uguauuuuaucaccuuga

SEQ ID NO: 803688 - RNA, 21 nt, Human
uguuagcgguugugggcuucc

SEQ ID NO: 803689 - RNA, 20 nt, Human
uguuugcuuuugcaccaaaa

SEQ ID NO: 803690 - RNA, 20 nt, Human
uguuugcuuuugcaccaaaa

SEQ ID NO: 803691 - RNA, 23 nt, Human
uuaaaauccucuaaaaaugacuc

SEQ ID NO: 803692 - RNA, 20 nt, Human
uuaaugccuguuuuccuguu

SEQ ID NO: 803693 - RNA, 21 nt, Human
uuaauggacaaagccauguuu

SEQ ID NO: 803694 - RNA, 19 nt, Human
uuaggcacacaaaauacua

SEQ ID NO: 803695 - RNA, 23 nt, Human
uugaauaagcuuuuaaaaaaaau

SEQ ID NO: 803696 - RNA, 18 nt, Human
uuuccuugcuucaugaga

SEQ ID NO: 803697 - RNA, 21 nt, Human
uuugcuacuucuuuuaaaaau

SEQ ID NO: 803698 - RNA, 24 nt, Human
uuugcuacuucuuuuaaaaauauu

SEQ ID NO: 803699 - RNA, 23 nt, Human
uuuuguuaucauuauuauuuuuu

SEQ ID NO: 803700 - RNA, 22 nt, Human
aaaaaacccccaaaaaccaaag

SEQ ID NO: 803701 - RNA, 19 nt, Human
aaaaacaaaaaacaccaaa

SEQ ID NO: 803702 - RNA, 23 nt, Human
aaaaaccaguagcauuucuucca

SEQ ID NO: 803703 - RNA, 19 nt, Human
aaaaacccccaaaaaccaa

SEQ ID NO: 803704 - RNA, 22 nt, Human
aaaaagaaaagacauacaucga

SEQ ID NO: 803705 - RNA, 21 nt, Human
aaaaagacuuuuacccauauu

SEQ ID NO: 803706 - RNA, 26 nt, Human
aaaacaaacaaacaaacaaaaaaaca

SEQ ID NO: 803707 - RNA, 25 nt, Human
aaaagaaaagacauacaucgacaaa

SEQ ID NO: 803708 - RNA, 21 nt, Human
aaaauagcacacauacaaagc

SEQ ID NO: 803709 - RNA, 23 nt, Human
aaaauguaaaaagaaaaccaaag

SEQ ID NO: 803710 - RNA, 24 nt, Human
aaacaaacaaaaaaacaaaaaaca

SEQ ID NO: 803711 - RNA, 26 nt, Human
aaacaaacaaaaaaacaaaaaacacu

SEQ ID NO: 803712 - RNA, 19 nt, Human
aaacaagauaccaaauuuc

SEQ ID NO: 803713 - RNA, 23 nt, Human
aaacagaauggauagcauaaaca

SEQ ID NO: 803714 - RNA, 18 nt, Human
aaacauguuugaauagau

SEQ ID NO: 803715 - RNA, 18 nt, Human
aaagccacuaaacuaaug

SEQ ID NO: 803716 - RNA, 23 nt, Human
aacaaaaaaacaaaaaacaccaa

SEQ ID NO: 803717 - RNA, 24 nt, Human
aacaaaaaaacaaaaaacaccaaa

SEQ ID NO: 803718 - RNA, 23 nt, Human
aacaaacaaaaaaacaaaaaaca

SEQ ID NO: 803719 - RNA, 24 nt, Human
aacaaacaaacaaacaaaaaaaca

SEQ ID NO: 803720 - RNA, 18 nt, Human
aacucuggauaaacuaau

SEQ ID NO: 803721 - RNA, 18 nt, Human
aacugcccaaaaaacccc

SEQ ID NO: 803722 - RNA, 19 nt, Human
aacugcccaaaaaaccccc

SEQ ID NO: 803723 - RNA, 24 nt, Human
aagaaaaaaaggaugcuagcacag

SEQ ID NO: 803724 - RNA, 18 nt, Human
aagagaggcuucuguucu

SEQ ID NO: 803725 - RNA, 24 nt, Human
aagcaacagcaacuauccuuaaag

SEQ ID NO: 803726 - RNA, 28 nt, Human
aagcaacagcaacuauccuuaaagcuca

SEQ ID NO: 803727 - RNA, 23 nt, Human
aagcagaaaaucaauaucccaga

SEQ ID NO: 803728 - RNA, 20 nt, Human
aagcucaaaacugauuacag

SEQ ID NO: 803729 - RNA, 23 nt, Human
aagggaauguaaguuaaucaugg

SEQ ID NO: 803730 - RNA, 18 nt, Human
aagugcacuagcuuaaaa

SEQ ID NO: 803731 - RNA, 21 nt, Human
acaacacgcauaaaggucaua

SEQ ID NO: 803732 - RNA, 20 nt, Human
acacuauuaucuauguugca

SEQ ID NO: 803733 - RNA, 22 nt, Human
acagaauggauagcauaaacag

SEQ ID NO: 803734 - RNA, 23 nt, Human
accaaauuucauguuuggaaacu

SEQ ID NO: 803735 - RNA, 21 nt, Human
acugaaucaguauggacugaa

SEQ ID NO: 803736 - RNA, 18 nt, Human
acugcccaaaaaaccccc

SEQ ID NO: 803737 - RNA, 25 nt, Human
agaaaauaaccucucccaaucaccu

SEQ ID NO: 803738 - RNA, 21 nt, Human
agcaaaaaaacaaacaaacaa

SEQ ID NO: 803739 - RNA, 18 nt, Human
agcacuuagaauuaacuu

SEQ ID NO: 803740 - RNA, 23 nt, Human
agcauuucuuccaacacaaaacc

SEQ ID NO: 803741 - RNA, 21 nt, Human
agccauauagaaggcauugca

SEQ ID NO: 803742 - RNA, 21 nt, Human
agcuaacaucagguccgacgu

SEQ ID NO: 803743 - RNA, 18 nt, Human
agcuaauccuaaaacacu

SEQ ID NO: 803744 - RNA, 20 nt, Human
agucugcaucaggaagaacc

SEQ ID NO: 803745 - RNA, 22 nt, Human
aguuauuucaacuuucuaaaaa

SEQ ID NO: 803746 - RNA, 19 nt, Human
auagcacacauacaaagcc

SEQ ID NO: 803747 - RNA, 24 nt, Human
auaguuuaguauaacaaaaauaaa

SEQ ID NO: 803748 - RNA, 21 nt, Human
augaagcacacaaaaaauaaa

SEQ ID NO: 803749 - RNA, 23 nt, Human
augaagcacacaaaaaauaaacu

SEQ ID NO: 803750 - RNA, 23 nt, Human
augaucucucaaaauguucagaa

SEQ ID NO: 803751 - RNA, 22 nt, Human
caaaaaaacaaaaaacaccaaa

SEQ ID NO: 803752 - RNA, 18 nt, Human
caaaaaacaccaaacaaa

SEQ ID NO: 803753 - RNA, 20 nt, Human
caaaaaacccccaaaaacca

SEQ ID NO: 803754 - RNA, 24 nt, Human
caaaaagccaugcaaaaaggucaa

SEQ ID NO: 803755 - RNA, 22 nt, Human
caaaauagcacacauacaaagc

SEQ ID NO: 803756 - RNA, 24 nt, Human
caaaauagcacacauacaaagcca

SEQ ID NO: 803757 - RNA, 25 nt, Human
caaacaaacaaaaaaacaaaaaaca

SEQ ID NO: 803758 - RNA, 18 nt, Human
caaacaaagugaaacuag

SEQ ID NO: 803759 - RNA, 27 nt, Human
caaacaaauacuuuguuugccucuuuu

SEQ ID NO: 803760 - RNA, 23 nt, Human
caaagaaaaacauuuucaaaaag

SEQ ID NO: 803761 - RNA, 18 nt, Human
caaagaauuuaagggaga

SEQ ID NO: 803762 - RNA, 19 nt, Human
caaguagauaaaaccagua

SEQ ID NO: 803763 - RNA, 21 nt, Human
cacaugacuccuacgcuaaca

SEQ ID NO: 803764 - RNA, 24 nt, Human
cacuccgauucucacuaaaaacag

SEQ ID NO: 803765 - RNA, 18 nt, Human
cagaauacaaaaacaaaa

SEQ ID NO: 803766 - RNA, 29 nt, Human
cagaauggauagcauaaacauguuugaau

SEQ ID NO: 803767 - RNA, 26 nt, Human
cagcccccucuggauaaguccugucu

SEQ ID NO: 803768 - RNA, 19 nt, Human
cagcuuagaaauaguguuu

SEQ ID NO: 803769 - RNA, 21 nt, Human
cauaaccauacauguuucaga

SEQ ID NO: 803770 - RNA, 24 nt, Human
cauacauucagaacccaagcaaca

SEQ ID NO: 803771 - RNA, 21 nt, Human
caucaggaagaaccgggccag

SEQ ID NO: 803772 - RNA, 18 nt, Human
caugcgcaaauggcauca

SEQ ID NO: 803773 - RNA, 19 nt, Human
ccaaaaaacccccaaaaac

SEQ ID NO: 803774 - RNA, 27 nt, Human
ccaaaaaacccccaaaaaccaaagucu

SEQ ID NO: 803775 - RNA, 24 nt, Human
ccaaaauguaaaaagaaaaccaaa

SEQ ID NO: 803776 - RNA, 25 nt, Human
ccaaaugaagcacacaaaaaauaaa

SEQ ID NO: 803777 - RNA, 20 nt, Human
ccugcagcccccucuggaua

SEQ ID NO: 803778 - RNA, 22 nt, Human
cguguguccuuuacuaugacuc

SEQ ID NO: 803779 - RNA, 24 nt, Human
cuauagacaaaguaugcccaagag

SEQ ID NO: 803780 - RNA, 20 nt, Human
cucauaguaugucuaauaac

SEQ ID NO: 803781 - RNA, 19 nt, Human
cucgccugcagcccccucu

SEQ ID NO: 803782 - RNA, 18 nt, Human
cugaaaucacauccagug

SEQ ID NO: 803783 - RNA, 22 nt, Human
cugaaaucacauccagugacac

SEQ ID NO: 803784 - RNA, 20 nt, Human
cugcagggccagaacuuguc

SEQ ID NO: 803785 - RNA, 19 nt, Human
cugcccaaaaaacccccaa

SEQ ID NO: 803786 - RNA, 23 nt, Human
cugcccaaaaaacccccaaaaac

SEQ ID NO: 803787 - RNA, 19 nt, Human
cuugauccauucugaacuu

SEQ ID NO: 803788 - RNA, 22 nt, Human
cuuggccucugucuuuaaaaug

SEQ ID NO: 803789 - RNA, 23 nt, Human
gaaagcaaacaccuaauccuuac

SEQ ID NO: 803790 - RNA, 21 nt, Human
gaagaccaagaauacucaaau

SEQ ID NO: 803791 - RNA, 21 nt, Human
gaagauauuuauucccaaacc

SEQ ID NO: 803792 - RNA, 22 nt, Human
gaccuacacccacauauacaua

SEQ ID NO: 803793 - RNA, 18 nt, Human
gagaaggcagcuuagaaa

SEQ ID NO: 803794 - RNA, 19 nt, Human
gcaaacaccuaauccuuac

SEQ ID NO: 803795 - RNA, 18 nt, Human
gcagcaaaaaaacaaaca

SEQ ID NO: 803796 - RNA, 25 nt, Human
gcagcaaaaaaacaaacaaacaaac

SEQ ID NO: 803797 - RNA, 19 nt, Human
gcccccucuggauaagucc

SEQ ID NO: 803798 - RNA, 23 nt, Human
gccuuguguauuuauagguugua

SEQ ID NO: 803799 - RNA, 21 nt, Human
ggauaccuggccugauggcuc

SEQ ID NO: 803800 - RNA, 24 nt, Human
ggcauuugagauauaaagugaaaa

SEQ ID NO: 803801 - RNA, 20 nt, Human
ggggguccuguccagccucu

SEQ ID NO: 803802 - RNA, 18 nt, Human
gggguccuguccagccuc

SEQ ID NO: 803803 - RNA, 23 nt, Human
ggucgcuccggcggggcacgaga

SEQ ID NO: 803804 - RNA, 20 nt, Human
guagaaaauaaccucuccca

SEQ ID NO: 803805 - RNA, 18 nt, Human
guuucagaaauauaagga

SEQ ID NO: 803806 - RNA, 26 nt, Human
guuuuuuccucugcauuuaaagaguu

SEQ ID NO: 803807 - RNA, 24 nt, Human
uaaacaaaaacuccaaaugaagca

SEQ ID NO: 803808 - RNA, 19 nt, Human
uaaacaaguagauaaaacc

SEQ ID NO: 803809 - RNA, 27 nt, Human
uaaacaaguagauaaaaccaguaacau

SEQ ID NO: 803810 - RNA, 18 nt, Human
uaaaggcuuucaaaacag

SEQ ID NO: 803811 - RNA, 26 nt, Human
uaaauaaaacaaaaacugagggcugu

SEQ ID NO: 803812 - RNA, 22 nt, Human
uaacacucacacagagcagagu

SEQ ID NO: 803813 - RNA, 21 nt, Human
uaacaggcaaacaagaaaacu

SEQ ID NO: 803814 - RNA, 23 nt, Human
uaauccuuacuauauacugacua

SEQ ID NO: 803815 - RNA, 27 nt, Human
uacacugaaauaaaucuucaaaaaggu

SEQ ID NO: 803816 - RNA, 22 nt, Human
uaccacuucuccccacauaaag

SEQ ID NO: 803817 - RNA, 21 nt, Human
uagaaaaagacuuuuacccau

SEQ ID NO: 803818 - RNA, 25 nt, Human
uagaaaauuuauacaucagcagcca

SEQ ID NO: 803819 - RNA, 24 nt, Human
uagcacuuagaauuaacuuauugc

SEQ ID NO: 803820 - RNA, 22 nt, Human
uauacaucagcagccauauaga

SEQ ID NO: 803821 - RNA, 21 nt, Human
uauagacaaaguaugcccaag

SEQ ID NO: 803822 - RNA, 24 nt, Human
uauauaaacaaaaacuccaaauga

SEQ ID NO: 803823 - RNA, 21 nt, Human
ucaaaacuuagaaggucaaag

SEQ ID NO: 803824 - RNA, 21 nt, Human
ucaacuauguuuuuuccucug

SEQ ID NO: 803825 - RNA, 18 nt, Human
ucaaugguggcagcagca

SEQ ID NO: 803826 - RNA, 20 nt, Human
uccaacacaaaaccuucaaa

SEQ ID NO: 803827 - RNA, 21 nt, Human
uccaacacaaaaccuucaaag

SEQ ID NO: 803828 - RNA, 23 nt, Human
uccauuuuuaccacuucucccca

SEQ ID NO: 803829 - RNA, 22 nt, Human
uccuucagaaagcaaacaccua

SEQ ID NO: 803830 - RNA, 22 nt, Human
ucuaaagagaggcuucuguucu

SEQ ID NO: 803831 - RNA, 23 nt, Human
ucuaauaacugcccaaaaaaccc

SEQ ID NO: 803832 - RNA, 28 nt, Human
ugaagcacacaaaaaauaaacuugaaaa

SEQ ID NO: 803833 - RNA, 19 nt, Human
ugaagucauaucuaagcaa

SEQ ID NO: 803834 - RNA, 25 nt, Human
ugacaaaaauguaaaggcuuucaaa

SEQ ID NO: 803835 - RNA, 23 nt, Human
ugacuagggucaugaagucauau

SEQ ID NO: 803836 - RNA, 24 nt, Human
ugauuuaggagucugguauuaccu

SEQ ID NO: 803837 - RNA, 23 nt, Human
ugcaaacaaauacuuuguuugcc

SEQ ID NO: 803838 - RNA, 24 nt, Human
ugcaaacaaauacuuuguuugccu

SEQ ID NO: 803839 - RNA, 20 nt, Human
ugcagcaauaaaaccauaaa

SEQ ID NO: 803840 - RNA, 22 nt, Human
ugcccaaaaaacccccaaaaac

SEQ ID NO: 803841 - RNA, 21 nt, Human
uggcagcagcaaaaaaacaaa

SEQ ID NO: 803842 - RNA, 21 nt, Human
ugggaguugcacuuacuuuua

SEQ ID NO: 803843 - RNA, 23 nt, Human
uguagaaaaaaauuaaauggcua

SEQ ID NO: 803844 - RNA, 23 nt, Human
uguauaacaggcaaacaagaaaa

SEQ ID NO: 803845 - RNA, 23 nt, Human
uuaaaagugcuugcaugcugcag

SEQ ID NO: 803846 - RNA, 18 nt, Human
uuacugaauuuuucaaaa

SEQ ID NO: 803847 - RNA, 23 nt, Human
uucagaauacaaaaacaaaaauc

SEQ ID NO: 803848 - RNA, 24 nt, Human
uuccaacacaaaaccuucaaagug

SEQ ID NO: 803849 - RNA, 20 nt, Human
uucccaaaauguaaaaagaa

SEQ ID NO: 803850 - RNA, 20 nt, Human
uucccaaaccaacucuaaau

SEQ ID NO: 803851 - RNA, 19 nt, Human
uugcaugaguuugaggcca

SEQ ID NO: 803852 - RNA, 19 nt, Human
uuuauaaacucuggauaaa

SEQ ID NO: 803853 - RNA, 21 nt, Human
uuugauaguaaaacuggugag

SEQ ID NO: 803854 - RNA, 21 nt, Human
uuugaucuuggccucugucuu

SEQ ID NO: 803855 - RNA, 19 nt, Human
uuuguacaaaauaaacaag

SEQ ID NO: 803856 - RNA, 19 nt, Human
aaacaccucuuugaucaag

SEQ ID NO: 803857 - RNA, 18 nt, Human
aacaaaagucuacacaca

SEQ ID NO: 803858 - RNA, 18 nt, Human
aacuuccuacagaaacac

SEQ ID NO: 803859 - RNA, 18 nt, Human
aacuuccuacagaaacac

SEQ ID NO: 803860 - RNA, 24 nt, Human
aauacagugauggaaacaagacaa

SEQ ID NO: 803861 - RNA, 24 nt, Human
aauuuguagcauacuugccagugg

SEQ ID NO: 803862 - RNA, 20 nt, Human
acaagggagcuuucuuugca

SEQ ID NO: 803863 - RNA, 19 nt, Human
acagugauggaaacaagac

SEQ ID NO: 803864 - RNA, 22 nt, Human
accauuacccugcuucugucau

SEQ ID NO: 803865 - RNA, 23 nt, Human
acugacugcagauuccuggggua

SEQ ID NO: 803866 - RNA, 20 nt, Human
agaaggugaggccagcauuc

SEQ ID NO: 803867 - RNA, 19 nt, Human
aggaugggaguggggaagg

SEQ ID NO: 803868 - RNA, 21 nt, Human
aggaugggaguggggaaggaa

SEQ ID NO: 803869 - RNA, 22 nt, Human
caaacacaagaccauuacccug

SEQ ID NO: 803870 - RNA, 20 nt, Human
caacaaaagucuacacacag

SEQ ID NO: 803871 - RNA, 24 nt, Human
caagacaaucuuuuaucuuccucu

SEQ ID NO: 803872 - RNA, 20 nt, Human
caagcagauuuuaucugaaa

SEQ ID NO: 803873 - RNA, 19 nt, Human
cacaaagaagcacauuuca

SEQ ID NO: 803874 - RNA, 19 nt, Human
cacaugguuacaauccagu

SEQ ID NO: 803875 - RNA, 19 nt, Human
cagaaguccuuaauaaaca

SEQ ID NO: 803876 - RNA, 23 nt, Human
cagagaacuuccuacagaaacac

SEQ ID NO: 803877 - RNA, 18 nt, Human
cagcaucacugccaucug

SEQ ID NO: 803878 - RNA, 18 nt, Human
caguauucugggauuguu

SEQ ID NO: 803879 - RNA, 19 nt, Human
caucacugccaucuggacu

SEQ ID NO: 803880 - RNA, 24 nt, Human
cccccaauucaaggcuaauaucua

SEQ ID NO: 803881 - RNA, 19 nt, Human
cccuucuaauccaagcucu

SEQ ID NO: 803882 - RNA, 30 nt, Human
cucacccauaucuuaaguauuucuccgggg

SEQ ID NO: 803883 - RNA, 30 nt, Human
cuguucacauuuaaaauuacuuugugaucc

SEQ ID NO: 803884 - RNA, 18 nt, Human
cuugugucuucauggucu

SEQ ID NO: 803885 - RNA, 22 nt, Human
gaaaaguaaaauauagguuacg

SEQ ID NO: 803886 - RNA, 23 nt, Human
gaaaaguaaaauauagguuacgg

SEQ ID NO: 803887 - RNA, 24 nt, Human
gaaggaaagaagacuuauuaggga

SEQ ID NO: 803888 - RNA, 22 nt, Human
gaccuauauuuugcuuuuccuc

SEQ ID NO: 803889 - RNA, 20 nt, Human
gccaggaggagaugccuggc

SEQ ID NO: 803890 - RNA, 20 nt, Human
gccaucuggacucugaacaa

SEQ ID NO: 803891 - RNA, 20 nt, Human
ggaagcuugaagcuaacuca

SEQ ID NO: 803892 - RNA, 23 nt, Human
ggaaggaaguauggcuuacaagg

SEQ ID NO: 803893 - RNA, 23 nt, Human
gggaaggaaguauggcuuacaag

SEQ ID NO: 803894 - RNA, 25 nt, Human
gggaaggaaguauggcuuacaaggg

SEQ ID NO: 803895 - RNA, 23 nt, Human
gggaaggaaugaucuauacggca

SEQ ID NO: 803896 - RNA, 19 nt, Human
guuacaauccaguauuuga

SEQ ID NO: 803897 - RNA, 21 nt, Human
uaagaaaugccuaaugagcac

SEQ ID NO: 803898 - RNA, 21 nt, Human
uacaagggagcuuucuuugca

SEQ ID NO: 803899 - RNA, 23 nt, Human
uagguacaacauagauaacuuca

SEQ ID NO: 803900 - RNA, 23 nt, Human
uauaugauuaaacuuaugugagu

SEQ ID NO: 803901 - RNA, 20 nt, Human
uauucaagacacaagcagau

SEQ ID NO: 803902 - RNA, 21 nt, Human
ucuacacacaguauucuggga

SEQ ID NO: 803903 - RNA, 21 nt, Human
ucuauacggcagacugccuuu

SEQ ID NO: 803904 - RNA, 19 nt, Human
ucuauuccauuugauagca

SEQ ID NO: 803905 - RNA, 22 nt, Human
ucuucaguugaaugacaauagu

SEQ ID NO: 803906 - RNA, 18 nt, Human
ucuuuuaucuuccucuuc

SEQ ID NO: 803907 - RNA, 20 nt, Human
ugaccgagaaaccacuguau

SEQ ID NO: 803908 - RNA, 21 nt, Human
ugacuucuccaucuugucuag

SEQ ID NO: 803909 - RNA, 20 nt, Human
ugagaauguuuagagcauuu

SEQ ID NO: 803910 - RNA, 23 nt, Human
ugagcacaacaaaagucuacaca

SEQ ID NO: 803911 - RNA, 26 nt, Human
ugagcacaacaaaagucuacacacag

SEQ ID NO: 803912 - RNA, 23 nt, Human
ugaguagcagauuuuuuuuuaua

SEQ ID NO: 803913 - RNA, 19 nt, Human
ugccaguggugacuucucc

SEQ ID NO: 803914 - RNA, 19 nt, Human
uggggaaggaaguauggcu

SEQ ID NO: 803915 - RNA, 23 nt, Human
ugugauguuuugagaauguuuag

SEQ ID NO: 803916 - RNA, 20 nt, Human
uguggacugagauugagaua

SEQ ID NO: 803917 - RNA, 18 nt, Human
uguggaugauagagaagg

SEQ ID NO: 803918 - RNA, 27 nt, Human
uuaaaauaacuaaaaugugucaaaguc

SEQ ID NO: 803919 - RNA, 23 nt, Human
uucaagacacaagcagauuuuuu

SEQ ID NO: 803920 - RNA, 20 nt, Human
uucaguugaaugacaauagu

SEQ ID NO: 803921 - RNA, 19 nt, Human
uucaucuaauuagagacau

SEQ ID NO: 803922 - RNA, 24 nt, Human
uucuccaucuugucuaggagggag

SEQ ID NO: 803923 - RNA, 21 nt, Human
uuggggagcucauuccaugac

SEQ ID NO: 803924 - RNA, 23 nt, Human
uuugggagaagugagauauuuau

SEQ ID NO: 803925 - RNA, 19 nt, Human
aaacaaaauggcagaccua

SEQ ID NO: 803926 - RNA, 22 nt, Human
aaaccaaaaaaauaaaacacac

SEQ ID NO: 803927 - RNA, 22 nt, Human
aaacccaaauuuuuacucggcc

SEQ ID NO: 803928 - RNA, 22 nt, Human
aaacgccauaaacccaaauuuu

SEQ ID NO: 803929 - RNA, 21 nt, Human
aaauacaagucaauaccacaa

SEQ ID NO: 803930 - RNA, 22 nt, Human
aaccaaaaaaauaaaacacacc

SEQ ID NO: 803931 - RNA, 26 nt, Human
aacccaugaagcgccaucauccccuu

SEQ ID NO: 803932 - RNA, 22 nt, Human
aacuccuuccccacagucucca

SEQ ID NO: 803933 - RNA, 23 nt, Human
aacucuagaaaacucaguguuga

SEQ ID NO: 803934 - RNA, 19 nt, Human
aagcaagacuuuguacaaa

SEQ ID NO: 803935 - RNA, 18 nt, Human
aauggcagcaggacgggc

SEQ ID NO: 803936 - RNA, 24 nt, Human
acacacucauugggacacauaaga

SEQ ID NO: 803937 - RNA, 18 nt, Human
acccugagagcugacagu

SEQ ID NO: 803938 - RNA, 21 nt, Human
accgcgagcguaaggaacaag

SEQ ID NO: 803939 - RNA, 20 nt, Human
acuccauguccaaaugaagu

SEQ ID NO: 803940 - RNA, 21 nt, Human
acugugggcauuugcuccaaa

SEQ ID NO: 803941 - RNA, 21 nt, Human
aggaggcaaggcugcaccugu

SEQ ID NO: 803942 - RNA, 22 nt, Human
agguaggaaguaaauauuagga

SEQ ID NO: 803943 - RNA, 19 nt, Human
aggugugcuuugauguggu

SEQ ID NO: 803944 - RNA, 22 nt, Human
agucaauaccacaagauggcac

SEQ ID NO: 803945 - RNA, 21 nt, Human
aguguugaaguaugggaagaa

SEQ ID NO: 803946 - RNA, 21 nt, Human
auaaaacacacccacaaacaa

SEQ ID NO: 803947 - RNA, 24 nt, Human
augcaggaaaggcugcggaucuga

SEQ ID NO: 803948 - RNA, 22 nt, Human
augcucauucucuggggcuucu

SEQ ID NO: 803949 - RNA, 22 nt, Human
caaauuaugcugcucacauugg

SEQ ID NO: 803950 - RNA, 20 nt, Human
cacacaguggugccagucag

SEQ ID NO: 803951 - RNA, 19 nt, Human
cacagguugcuauccacug

SEQ ID NO: 803952 - RNA, 21 nt, Human
caccaagcagggaaugcucau

SEQ ID NO: 803953 - RNA, 21 nt, Human
cacccugagagcugacaguug

SEQ ID NO: 803954 - RNA, 24 nt, Human
caccugaaacgccauaaacccaaa

SEQ ID NO: 803955 - RNA, 18 nt, Human
cacugugccagucacaaa

SEQ ID NO: 803956 - RNA, 18 nt, Human
cacuguggaccaugcagg

SEQ ID NO: 803957 - RNA, 19 nt, Human
cauccgcaguauucacaca

SEQ ID NO: 803958 - RNA, 21 nt, Human
cauccgcaguauucacacauc

SEQ ID NO: 803959 - RNA, 18 nt, Human
cauucucuggggcuucuc

SEQ ID NO: 803960 - RNA, 18 nt, Human
cauuguguggggaucgca

SEQ ID NO: 803961 - RNA, 24 nt, Human
ccacagggugcguuuucacucagc

SEQ ID NO: 803962 - RNA, 24 nt, Human
ccacugcuccaccuucaccauccg

SEQ ID NO: 803963 - RNA, 24 nt, Human
ccaucauccccuggcuacaaaaca

SEQ ID NO: 803964 - RNA, 20 nt, Human
ccaucauguuuucuuccucc

SEQ ID NO: 803965 - RNA, 21 nt, Human
cccacagucuccacccuccaa

SEQ ID NO: 803966 - RNA, 18 nt, Human
ccgcaguauucacacauc

SEQ ID NO: 803967 - RNA, 19 nt, Human
ccuccaauuuacaugcaga

SEQ ID NO: 803968 - RNA, 19 nt, Human
ccuccacagcgcagggacc

SEQ ID NO: 803969 - RNA, 22 nt, Human
ccugaaacgccauaaacccaaa

SEQ ID NO: 803970 - RNA, 18 nt, Human
ccuucagaaaugaccuag

SEQ ID NO: 803971 - RNA, 20 nt, Human
ccuugaguucagugaugguc

SEQ ID NO: 803972 - RNA, 21 nt, Human
cucaaaagacugaauuauaaa

SEQ ID NO: 803973 - RNA, 24 nt, Human
cucauucucuggggcuucuccaaa

SEQ ID NO: 803974 - RNA, 25 nt, Human
cuccacucuguuagauuguacugga

SEQ ID NO: 803975 - RNA, 22 nt, Human
cucccaguuccaaacaggaaga

SEQ ID NO: 803976 - RNA, 21 nt, Human
cugcaccugugagucuucagc

SEQ ID NO: 803977 - RNA, 19 nt, Human
cugugggaauuccaucaug

SEQ ID NO: 803978 - RNA, 23 nt, Human
cuucaggaugcuguccugaaagg

SEQ ID NO: 803979 - RNA, 22 nt, Human
gaacaagcacacaguggugcca

SEQ ID NO: 803980 - RNA, 23 nt, Human
gaacuggaagcaauuuucauuca

SEQ ID NO: 803981 - RNA, 26 nt, Human
gcaaggcacagaacacagcugcuucu

SEQ ID NO: 803982 - RNA, 23 nt, Human
gcaggaaaggcugcggaucugaa

SEQ ID NO: 803983 - RNA, 19 nt, Human
gcauuucuccacacagugc

SEQ ID NO: 803984 - RNA, 21 nt, Human
ggaauuccaucauguuuucuu

SEQ ID NO: 803985 - RNA, 18 nt, Human
gucagaggcuucuguugg

SEQ ID NO: 803986 - RNA, 22 nt, Human
gucugagagcuacaaaagagaa

SEQ ID NO: 803987 - RNA, 22 nt, Human
gugcguuuucacucagcuggca

SEQ ID NO: 803988 - RNA, 18 nt, Human
guuguuuuagauauuauu

SEQ ID NO: 803989 - RNA, 22 nt, Human
uaaaacacacccacaaacaacu

SEQ ID NO: 803990 - RNA, 23 nt, Human
uaaaacacacccacaaacaacuu

SEQ ID NO: 803991 - RNA, 21 nt, Human
uacaaaacaaaauacaauauu

SEQ ID NO: 803992 - RNA, 25 nt, Human
uacaaacaauuaucuucauaaaaug

SEQ ID NO: 803993 - RNA, 20 nt, Human
uagcagguggcgaguucuuc

SEQ ID NO: 803994 - RNA, 24 nt, Human
ucacugggcagguuuucuccuggg

SEQ ID NO: 803995 - RNA, 24 nt, Human
ucagaaaccucccacugaaagagg

SEQ ID NO: 803996 - RNA, 22 nt, Human
ucagaggcuucuguuggggagg

SEQ ID NO: 803997 - RNA, 27 nt, Human
ucagauaauuaaauuugaaagaagaau

SEQ ID NO: 803998 - RNA, 21 nt, Human
uccaaaguccccacucagaca

SEQ ID NO: 803999 - RNA, 21 nt, Human
uccacagcgcagggaccucag

SEQ ID NO: 804000 - RNA, 20 nt, Human
uccacccuccaauuuacaug

SEQ ID NO: 804001 - RNA, 24 nt, Human
uccacucuguuagauuguacugga

SEQ ID NO: 804002 - RNA, 22 nt, Human
uccaugcugacuggcuugccau

SEQ ID NO: 804003 - RNA, 23 nt, Human
ucccuugggaaaaccaaaaaaau

SEQ ID NO: 804004 - RNA, 24 nt, Human
uccuuuggaggccuguugcucuca

SEQ ID NO: 804005 - RNA, 18 nt, Human
ucgcaugacugugggcau

SEQ ID NO: 804006 - RNA, 23 nt, Human
ucuccaauuuaaccacauauuuc

SEQ ID NO: 804007 - RNA, 19 nt, Human
ucuccaucguaggcuaagg

SEQ ID NO: 804008 - RNA, 23 nt, Human
ucuccaucguaggcuaaggucag

SEQ ID NO: 804009 - RNA, 18 nt, Human
ucugcaguccgaggcuug

SEQ ID NO: 804010 - RNA, 18 nt, Human
ucuguggggcauggccgu

SEQ ID NO: 804011 - RNA, 19 nt, Human
ugaaacgccauaaacccaa

SEQ ID NO: 804012 - RNA, 23 nt, Human
ugaaauuacaaaagcagaguuug

SEQ ID NO: 804013 - RNA, 26 nt, Human
ugaagcgccaucauccccuggcuaaa

SEQ ID NO: 804014 - RNA, 20 nt, Human
ugacuguauuuuccucugga

SEQ ID NO: 804015 - RNA, 21 nt, Human
ugagaaaagcgccaccugaaa

SEQ ID NO: 804016 - RNA, 20 nt, Human
ugaguucagugauggucuua

SEQ ID NO: 804017 - RNA, 21 nt, Human
ugcaggaaaggcugcggaucu

SEQ ID NO: 804018 - RNA, 24 nt, Human
ugcaguccaugcugagccgucaca

SEQ ID NO: 804019 - RNA, 18 nt, Human
ugccaaggacccagcugu

SEQ ID NO: 804020 - RNA, 20 nt, Human
ugccaaggacccagcuguag

SEQ ID NO: 804021 - RNA, 23 nt, Human
ugccaaggacccagcuguagcag

SEQ ID NO: 804022 - RNA, 20 nt, Human
ugccgaauggcagcaggacg

SEQ ID NO: 804023 - RNA, 22 nt, Human
ugcuccaaaguccccacucaga

SEQ ID NO: 804024 - RNA, 21 nt, Human
ugcuccaccuucaccauccgc

SEQ ID NO: 804025 - RNA, 19 nt, Human
ugcugcucacauuggucca

SEQ ID NO: 804026 - RNA, 19 nt, Human
uggaccaugcaggaaaggc

SEQ ID NO: 804027 - RNA, 18 nt, Human
uggcagucuccugggcaa

SEQ ID NO: 804028 - RNA, 25 nt, Human
uggcauaaugauaaaucgaguccgg

SEQ ID NO: 804029 - RNA, 24 nt, Human
uggccacaggucugugaacacucu

SEQ ID NO: 804030 - RNA, 22 nt, Human
ugggcauuugcuccaaaguccc

SEQ ID NO: 804031 - RNA, 18 nt, Human
ugggggcagcugucuugg

SEQ ID NO: 804032 - RNA, 25 nt, Human
uguccaagccguccacccugagagc

SEQ ID NO: 804033 - RNA, 18 nt, Human
ugugaacacucuguccaa

SEQ ID NO: 804034 - RNA, 24 nt, Human
ugugggcauuugcuccaaaguccc

SEQ ID NO: 804035 - RNA, 18 nt, Human
ugugguuuuggcuucuug

SEQ ID NO: 804036 - RNA, 20 nt, Human
uguguagugauaacauuugc

SEQ ID NO: 804037 - RNA, 18 nt, Human
uguuccaaagacuugcuu

SEQ ID NO: 804038 - RNA, 21 nt, Human
uuaugcugcugaagaucaagu

SEQ ID NO: 804039 - RNA, 24 nt, Human
uucucacaaccacagacuccaccc

SEQ ID NO: 804040 - RNA, 21 nt, Human
uucucucuguguucaugaaaa

SEQ ID NO: 804041 - RNA, 20 nt, Human
uugaaagucuuuaaaccaaa

SEQ ID NO: 804042 - RNA, 22 nt, Human
uuucaacaccuaugauuacaaa

SEQ ID NO: 804043 - RNA, 20 nt, Human
uuucugcaggcuggaaugca

SEQ ID NO: 804044 - RNA, 19 nt, Human
uuugauguauauuaaauga

SEQ ID NO: 804045 - RNA, 23 nt, Human
uuuggcuucuugcaaacaaggua

SEQ ID NO: 804046 - RNA, 21 nt, Human
uuuguacaaacaggaucggug

SEQ ID NO: 804047 - RNA, 20 nt, Human
aaaacaaacacaaaagccuu

SEQ ID NO: 804048 - RNA, 24 nt, Human
aaacugcacacgcauaaaacguaa

SEQ ID NO: 804049 - RNA, 21 nt, Human
aacacaaaagccuuauagaua

SEQ ID NO: 804050 - RNA, 24 nt, Human
aacacacauccccuucuaugccuc

SEQ ID NO: 804051 - RNA, 19 nt, Human
aacauuuccccauccugca

SEQ ID NO: 804052 - RNA, 22 nt, Human
aacuggggaaaaacaaacacaa

SEQ ID NO: 804053 - RNA, 21 nt, Human
aagacauacugggacagaaca

SEQ ID NO: 804054 - RNA, 22 nt, Human
aagcaauucuaacuucagccaa

SEQ ID NO: 804055 - RNA, 20 nt, Human
aaugcauuuuagaaaaugau

SEQ ID NO: 804056 - RNA, 25 nt, Human
acaacaugcacgaauaggcuacaca

SEQ ID NO: 804057 - RNA, 21 nt, Human
acacacacacauacacauaua

SEQ ID NO: 804058 - RNA, 21 nt, Human
acacacacauacacauauagc

SEQ ID NO: 804059 - RNA, 24 nt, Human
acacacauccccuucuaugccucu

SEQ ID NO: 804060 - RNA, 19 nt, Human
acacauacacauacauaua

SEQ ID NO: 804061 - RNA, 20 nt, Human
acacauacauauauguauac

SEQ ID NO: 804062 - RNA, 22 nt, Human
acauauuauaacccauauacaa

SEQ ID NO: 804063 - RNA, 23 nt, Human
accacauacagaugaugucugug

SEQ ID NO: 804064 - RNA, 21 nt, Human
accagauuaaugacaccugua

SEQ ID NO: 804065 - RNA, 19 nt, Human
accugaacuaaucacaacc

SEQ ID NO: 804066 - RNA, 21 nt, Human
acugcagcaguacugcagcua

SEQ ID NO: 804067 - RNA, 18 nt, Human
agcaauucuaacuucagc

SEQ ID NO: 804068 - RNA, 18 nt, Human
agcuuaucugucagcaca

SEQ ID NO: 804069 - RNA, 18 nt, Human
aguuacuggacuuggacu

SEQ ID NO: 804070 - RNA, 23 nt, Human
auaauacacaacaugcacgaaua

SEQ ID NO: 804071 - RNA, 23 nt, Human
auacacauacauauauguauaca

SEQ ID NO: 804072 - RNA, 23 nt, Human
auggacagacacuuauaaauacc

SEQ ID NO: 804073 - RNA, 18 nt, Human
auucuacaucuauuccuu

SEQ ID NO: 804074 - RNA, 23 nt, Human
caacacacauccccuucuaugcc

SEQ ID NO: 804075 - RNA, 25 nt, Human
caaguugauaaagcuucauaaaaca

SEQ ID NO: 804076 - RNA, 20 nt, Human
cacacacacauacacauaua

SEQ ID NO: 804077 - RNA, 21 nt, Human
caccauauuggggcacaggau

SEQ ID NO: 804078 - RNA, 22 nt, Human
cacccaaaauacagaacaccca

SEQ ID NO: 804079 - RNA, 21 nt, Human
cacuguacagcuguguguaca

SEQ ID NO: 804080 - RNA, 21 nt, Human
cagaacacccauuuucagauu

SEQ ID NO: 804081 - RNA, 21 nt, Human
cagaacaccuaguaaccugaa

SEQ ID NO: 804082 - RNA, 24 nt, Human
cagauaucaugaaaauaaaguccu

SEQ ID NO: 804083 - RNA, 23 nt, Human
cagcugaguuaauuacgccaugu

SEQ ID NO: 804084 - RNA, 21 nt, Human
caguuacuggacuuggacugu

SEQ ID NO: 804085 - RNA, 18 nt, Human
cauacauauauguauaca

SEQ ID NO: 804086 - RNA, 22 nt, Human
cauaccaggaggcucugaacac

SEQ ID NO: 804087 - RNA, 24 nt, Human
cauggacagacacuuauaaauacc

SEQ ID NO: 804088 - RNA, 25 nt, Human
ccacuccaucagaacaccuaguaac

SEQ ID NO: 804089 - RNA, 20 nt, Human
cccaaaauacagaacaccca

SEQ ID NO: 804090 - RNA, 19 nt, Human
ccuccgccuccuccccagg

SEQ ID NO: 804091 - RNA, 18 nt, Human
ccuccuccccaggcgcgg

SEQ ID NO: 804092 - RNA, 20 nt, Human
cgcgcuccuccagccgcugc

SEQ ID NO: 804093 - RNA, 25 nt, Human
cguguacacacacacauacacauau

SEQ ID NO: 804094 - RNA, 25 nt, Human
cguuauaccaaacugcacacgcaua

SEQ ID NO: 804095 - RNA, 19 nt, Human
cuaccugaauaacaucaua

SEQ ID NO: 804096 - RNA, 18 nt, Human
cuccuccagccgcugccu

SEQ ID NO: 804097 - RNA, 20 nt, Human
cuggugauuuuucucaaccg

SEQ ID NO: 804098 - RNA, 22 nt, Human
cuguucucucaucacccuuccc

SEQ ID NO: 804099 - RNA, 18 nt, Human
gacgcagcgacugccagc

SEQ ID NO: 804100 - RNA, 21 nt, Human
gagcuuaucugucagcacauc

SEQ ID NO: 804101 - RNA, 23 nt, Human
gagcuuaucugucagcacauccu

SEQ ID NO: 804102 - RNA, 21 nt, Human
gcugcagucagcaaggguccu

SEQ ID NO: 804103 - RNA, 19 nt, Human
gcugccuccgccuccuccc

SEQ ID NO: 804104 - RNA, 21 nt, Human
gcugccuccgccuccucccca

SEQ ID NO: 804105 - RNA, 18 nt, Human
ggcggcggcgggagcggg

SEQ ID NO: 804106 - RNA, 21 nt, Human
ggcgggcggcggcgggagcgg

SEQ ID NO: 804107 - RNA, 22 nt, Human
guggguggaucacugcagcagu

SEQ ID NO: 804108 - RNA, 24 nt, Human
guguacacacacacauacacauag

SEQ ID NO: 804109 - RNA, 23 nt, Human
uaaaaaggaacuauccagaauua

SEQ ID NO: 804110 - RNA, 21 nt, Human
uaaaacaguacuaaaaaggaa

SEQ ID NO: 804111 - RNA, 21 nt, Human
uaaaugaaacugucuucccuc

SEQ ID NO: 804112 - RNA, 21 nt, Human
uaacuggugacccaaagacau

SEQ ID NO: 804113 - RNA, 22 nt, Human
uaagaagguaacuggugaccca

SEQ ID NO: 804114 - RNA, 22 nt, Human
uacacacacacauacacauaua

SEQ ID NO: 804115 - RNA, 26 nt, Human
uacacacacacauacacauauagcug

SEQ ID NO: 804116 - RNA, 22 nt, Human
uacacauauagcuggacacuac

SEQ ID NO: 804117 - RNA, 18 nt, Human
uacauauauguauacaua

SEQ ID NO: 804118 - RNA, 24 nt, Human
uacauauauguauacauauauaca

SEQ ID NO: 804119 - RNA, 24 nt, Human
uagagcacugacuccacguuauac

SEQ ID NO: 804120 - RNA, 22 nt, Human
uauauaauacacaacaugcacg

SEQ ID NO: 804121 - RNA, 22 nt, Human
uauauacacauacacauacaua

SEQ ID NO: 804122 - RNA, 26 nt, Human
uauauacacauacacauacauauaug

SEQ ID NO: 804123 - RNA, 29 nt, Human
uauauacacauacacauacauauauguag

SEQ ID NO: 804124 - RNA, 22 nt, Human
uauauguauacauauauacaca

SEQ ID NO: 804125 - RNA, 21 nt, Human
uauuauaacccauauacaacc

SEQ ID NO: 804126 - RNA, 22 nt, Human
ucacugcagcaguacugcagcu

SEQ ID NO: 804127 - RNA, 21 nt, Human
ucagaacaccuaguaaccuga

SEQ ID NO: 804128 - RNA, 21 nt, Human
ucagucaagcaauucuaacuu

SEQ ID NO: 804129 - RNA, 24 nt, Human
ucauaccaggaggcucugaacacc

SEQ ID NO: 804130 - RNA, 19 nt, Human
uccacaugauauagaaauu

SEQ ID NO: 804131 - RNA, 22 nt, Human
uccauguagucccauacuuaau

SEQ ID NO: 804132 - RNA, 21 nt, Human
ucccgcgccgcgcgcucagug

SEQ ID NO: 804133 - RNA, 23 nt, Human
uccuccagccgcugccuccgccu

SEQ ID NO: 804134 - RNA, 21 nt, Human
ucgcgcuccuccagccgcugc

SEQ ID NO: 804135 - RNA, 26 nt, Human
ucuauauacacauacacauacauaua

SEQ ID NO: 804136 - RNA, 20 nt, Human
ucuggugauuuuucucaacc

SEQ ID NO: 804137 - RNA, 21 nt, Human
ugacaccuguacaggggccag

SEQ ID NO: 804138 - RNA, 24 nt, Human
ugacccaaagacauacugggacag

SEQ ID NO: 804139 - RNA, 23 nt, Human
ugaggaucaugaagccaaguuga

SEQ ID NO: 804140 - RNA, 22 nt, Human
ugcacguguacacacacacaua

SEQ ID NO: 804141 - RNA, 19 nt, Human
uguacagcuguguguacau

SEQ ID NO: 804142 - RNA, 20 nt, Human
uguauacauauauacacaac

SEQ ID NO: 804143 - RNA, 20 nt, Human
uguauacauauauacacaca

SEQ ID NO: 804144 - RNA, 27 nt, Human
uguauacauauauacacacacuguaca

SEQ ID NO: 804145 - RNA, 24 nt, Human
uguauuacauauuauaacccauau

SEQ ID NO: 804146 - RNA, 22 nt, Human
ugucugugaacauuuccccauc

SEQ ID NO: 804147 - RNA, 26 nt, Human
uguguacaugcacguguacacacaca

SEQ ID NO: 804148 - RNA, 23 nt, Human
uucagccaacuggggaaaaacaa

SEQ ID NO: 804149 - RNA, 19 nt, Human
uugguccaauccacaugau

SEQ ID NO: 804150 - RNA, 21 nt, Human
uuguagcagugauuacagaua

SEQ ID NO: 804151 - RNA, 26 nt, Human
uuuaaagugccccuucauguauagca

SEQ ID NO: 804152 - RNA, 23 nt, Human
uuuaagaagguaacuggugaccc

SEQ ID NO: 804153 - RNA, 20 nt, Human
uuuccugauuuaaagugccc

SEQ ID NO: 804154 - RNA, 21 nt, Human
aaaaaucagcccccaaaccca

SEQ ID NO: 804155 - RNA, 23 nt, Human
aaaaaucagcccccaaacccagu

SEQ ID NO: 804156 - RNA, 25 nt, Human
aaacacagcgacaguacauacagcc

SEQ ID NO: 804157 - RNA, 21 nt, Human
aaacucagaacaaaaauacaa

SEQ ID NO: 804158 - RNA, 20 nt, Human
aaacugcuggggcuggcggc

SEQ ID NO: 804159 - RNA, 22 nt, Human
aaagaaauaaaaaucagccccc

SEQ ID NO: 804160 - RNA, 18 nt, Human
aaauuacauugacgagau

SEQ ID NO: 804161 - RNA, 20 nt, Human
aaauuacauugacgagauuu

SEQ ID NO: 804162 - RNA, 18 nt, Human
aacaaaaaaacacagcga

SEQ ID NO: 804163 - RNA, 19 nt, Human
aacacaaaacaaagauccc

SEQ ID NO: 804164 - RNA, 21 nt, Human
aaccaauggcaggcgcucccc

SEQ ID NO: 804165 - RNA, 24 nt, Human
aaccaggcccauucacuaccaacc

SEQ ID NO: 804166 - RNA, 18 nt, Human
aagaaaaaaagcccccaa

SEQ ID NO: 804167 - RNA, 19 nt, Human
aagaaaaaaagcccccaaa

SEQ ID NO: 804168 - RNA, 22 nt, Human
aagaaaaaaagcccccaaagaa

SEQ ID NO: 804169 - RNA, 27 nt, Human
aagaaauaaaaaucagcccccaaaccc

SEQ ID NO: 804170 - RNA, 18 nt, Human
aagacccccugugcaggg

SEQ ID NO: 804171 - RNA, 20 nt, Human
aagcacagcaaacaucguac

SEQ ID NO: 804172 - RNA, 21 nt, Human
aauagaaaccacagaaauuac

SEQ ID NO: 804173 - RNA, 23 nt, Human
aaugucagccaggcggggccuga

SEQ ID NO: 804174 - RNA, 21 nt, Human
acacagguugggugcggccag

SEQ ID NO: 804175 - RNA, 22 nt, Human
acacuggggugggggaggucag

SEQ ID NO: 804176 - RNA, 25 nt, Human
acagacgggcacacacgcacaccac

SEQ ID NO: 804177 - RNA, 24 nt, Human
accaagaaggcggccagcacuggg

SEQ ID NO: 804178 - RNA, 22 nt, Human
accaagaagggagggaaggggg

SEQ ID NO: 804179 - RNA, 18 nt, Human
acgaggcugugggccugg

SEQ ID NO: 804180 - RNA, 22 nt, Human
acgcuauguccauucaccuggc

SEQ ID NO: 804181 - RNA, 19 nt, Human
acuaaagccaaaagcacca

SEQ ID NO: 804182 - RNA, 21 nt, Human
agaagggagggaaggggggug

SEQ ID NO: 804183 - RNA, 21 nt, Human
agaggaaggccagggcagagc

SEQ ID NO: 804184 - RNA, 21 nt, Human
agaggcccugcuggagggggc

SEQ ID NO: 804185 - RNA, 21 nt, Human
agaggcccuggucccccgccu

SEQ ID NO: 804186 - RNA, 18 nt, Human
agcaggggcugagggaug

SEQ ID NO: 804187 - RNA, 23 nt, Human
agcccgcagccccagccugcccu

SEQ ID NO: 804188 - RNA, 18 nt, Human
agcccuggccucaccgcc

SEQ ID NO: 804189 - RNA, 21 nt, Human
agccggcucggguccagcccc

SEQ ID NO: 804190 - RNA, 18 nt, Human
agccucgcucccacuuca

SEQ ID NO: 804191 - RNA, 19 nt, Human
agccuggccccagggaggg

SEQ ID NO: 804192 - RNA, 21 nt, Human
agcugaauagaaaccacagaa

SEQ ID NO: 804193 - RNA, 21 nt, Human
agcugccggcugcucugggag

SEQ ID NO: 804194 - RNA, 20 nt, Human
aggaaggagagcuguggagg

SEQ ID NO: 804195 - RNA, 22 nt, Human
aggccggggggguaaaccagga

SEQ ID NO: 804196 - RNA, 20 nt, Human
aggcuggaggagggggaaau

SEQ ID NO: 804197 - RNA, 24 nt, Human
agggaaggggggugccagcggucc

SEQ ID NO: 804198 - RNA, 18 nt, Human
agggcccagccuugaccc

SEQ ID NO: 804199 - RNA, 19 nt, Human
agggcugggcuggcugggc

SEQ ID NO: 804200 - RNA, 22 nt, Human
agggggaaaugcaaaaugguuc

SEQ ID NO: 804201 - RNA, 19 nt, Human
auacagccauggcccuaca

SEQ ID NO: 804202 - RNA, 24 nt, Human
augaagaaacgcuacugcagccuu

SEQ ID NO: 804203 - RNA, 24 nt, Human
auguccauucaccuggcaggcagc

SEQ ID NO: 804204 - RNA, 21 nt, Human
caaaacaaagaucccacagga

SEQ ID NO: 804205 - RNA, 25 nt, Human
caaaacaaagaucccacaggagagg

SEQ ID NO: 804206 - RNA, 26 nt, Human
caaagaaauaaaaaucagcccccaaa

SEQ ID NO: 804207 - RNA, 20 nt, Human
caagcccagaggaaagacug

SEQ ID NO: 804208 - RNA, 19 nt, Human
cacaccacggucaggaguc

SEQ ID NO: 804209 - RNA, 18 nt, Human
cacagaaauuacauugac

SEQ ID NO: 804210 - RNA, 21 nt, Human
cacagaggaaggccagggcag

SEQ ID NO: 804211 - RNA, 22 nt, Human
cacagcgacaguacauacagcc

SEQ ID NO: 804212 - RNA, 21 nt, Human
caccgccucucacgcuauguc

SEQ ID NO: 804213 - RNA, 21 nt, Human
cacggagggcuggggccucca

SEQ ID NO: 804214 - RNA, 20 nt, Human
cacggcaccgaaaacucaga

SEQ ID NO: 804215 - RNA, 22 nt, Human
cacggcaccgaaaacucagaac

SEQ ID NO: 804216 - RNA, 22 nt, Human
cagacaccagcacaaagaaagg

SEQ ID NO: 804217 - RNA, 23 nt, Human
cagacgggcacacacgcacacca

SEQ ID NO: 804218 - RNA, 24 nt, Human
cagcaggcaccagccagaugcccc

SEQ ID NO: 804219 - RNA, 22 nt, Human
cagcugcccucuggcugccccu

SEQ ID NO: 804220 - RNA, 20 nt, Human
caggcccuugggcugccugu

SEQ ID NO: 804221 - RNA, 18 nt, Human
cagugcuggcacggggag

SEQ ID NO: 804222 - RNA, 24 nt, Human
cauggauggaaauggaaccaagaa

SEQ ID NO: 804223 - RNA, 21 nt, Human
ccaaagaaauaaaaaucagcc

SEQ ID NO: 804224 - RNA, 22 nt, Human
ccacggucaggagucccgagac

SEQ ID NO: 804225 - RNA, 21 nt, Human
ccagcacuggguggcggguga

SEQ ID NO: 804226 - RNA, 19 nt, Human
ccagcagggcaggugcuga

SEQ ID NO: 804227 - RNA, 22 nt, Human
ccagcccggacuugggcucaca

SEQ ID NO: 804228 - RNA, 20 nt, Human
ccagcggucccccucagccc

SEQ ID NO: 804229 - RNA, 21 nt, Human
ccagggccgggaccgggaggg

SEQ ID NO: 804230 - RNA, 20 nt, Human
ccagggccucucuccuggcc

SEQ ID NO: 804231 - RNA, 22 nt, Human
ccagggccucucuccuggcccu

SEQ ID NO: 804232 - RNA, 22 nt, Human
cccaaagaaauaaaaaucagcc

SEQ ID NO: 804233 - RNA, 20 nt, Human
cccagccuugaccccugcac

SEQ ID NO: 804234 - RNA, 25 nt, Human
cccagccuugaccccugcacguggc

SEQ ID NO: 804235 - RNA, 21 nt, Human
cccagggccacccuguccucc

SEQ ID NO: 804236 - RNA, 18 nt, Human
ccccaggcccauggacuc

SEQ ID NO: 804237 - RNA, 22 nt, Human
ccccagggccacccuguccucc

SEQ ID NO: 804238 - RNA, 19 nt, Human
ccccucagcccgcagcccc

SEQ ID NO: 804239 - RNA, 24 nt, Human
cccgcagccccagccugcccuaga

SEQ ID NO: 804240 - RNA, 18 nt, Human
cccgccccacugcagggc

SEQ ID NO: 804241 - RNA, 22 nt, Human
cccggacuugggcucacacugc

SEQ ID NO: 804242 - RNA, 21 nt, Human
cccggcucggcugcgcucggc

SEQ ID NO: 804243 - RNA, 20 nt, Human
cccuccccacucugcccucc

SEQ ID NO: 804244 - RNA, 20 nt, Human
ccgcagccccagccugcccu

SEQ ID NO: 804245 - RNA, 22 nt, Human
ccgggcuccugggaugcuguac

SEQ ID NO: 804246 - RNA, 19 nt, Human
ccgguggguggcccaggug

SEQ ID NO: 804247 - RNA, 21 nt, Human
ccgguggguggcccaggugga

SEQ ID NO: 804248 - RNA, 26 nt, Human
ccucaccgccucucacgcuaugucca

SEQ ID NO: 804249 - RNA, 19 nt, Human
ccuccggaugcgcgcggcc

SEQ ID NO: 804250 - RNA, 27 nt, Human
ccucgagggcugggcuggcugggccag

SEQ ID NO: 804251 - RNA, 19 nt, Human
ccucuggcugccccuggcc

SEQ ID NO: 804252 - RNA, 19 nt, Human
ccuggagcaccccaugaag

SEQ ID NO: 804253 - RNA, 19 nt, Human
cgacccccgccuggccgcc

SEQ ID NO: 804254 - RNA, 18 nt, Human
cgcuccugggcccggccc

SEQ ID NO: 804255 - RNA, 22 nt, Human
cggagagaggcccugcuggagg

SEQ ID NO: 804256 - RNA, 23 nt, Human
cggaugcgcgcggccugcgcggg

SEQ ID NO: 804257 - RNA, 23 nt, Human
cggcaggaggggugagccugugg

SEQ ID NO: 804258 - RNA, 21 nt, Human
cggcucggcugcgcucggcuc

SEQ ID NO: 804259 - RNA, 27 nt, Human
cgggaggaaggagagcuguggagggaa

SEQ ID NO: 804260 - RNA, 25 nt, Human
cggguccagccccucaggccgggcu

SEQ ID NO: 804261 - RNA, 20 nt, Human
cgucuccacugugccccugc

SEQ ID NO: 804262 - RNA, 21 nt, Human
cgugcagggcuggggcaucgg

SEQ ID NO: 804263 - RNA, 22 nt, Human
cgugucccugucccucaguggc

SEQ ID NO: 804264 - RNA, 23 nt, Human
cguuuccuuucuucaaccuuggu

SEQ ID NO: 804265 - RNA, 19 nt, Human
cuaaaaaaacaaaaaaaca

SEQ ID NO: 804266 - RNA, 21 nt, Human
cucagaacaaaaauacaacca

SEQ ID NO: 804267 - RNA, 23 nt, Human
cucagcccgcagccccagccugc

SEQ ID NO: 804268 - RNA, 19 nt, Human
cuccagcccggacuugggc

SEQ ID NO: 804269 - RNA, 22 nt, Human
cucccagacagcugcuccggcc

SEQ ID NO: 804270 - RNA, 22 nt, Human
cucccucuuguccccagggcca

SEQ ID NO: 804271 - RNA, 23 nt, Human
cucuggcugccccuggccuuggc

SEQ ID NO: 804272 - RNA, 24 nt, Human
cugcccccuugucugggguucugg

SEQ ID NO: 804273 - RNA, 21 nt, Human
cugcuggggcuggcggcccgc

SEQ ID NO: 804274 - RNA, 19 nt, Human
cuggccccagggaggggau

SEQ ID NO: 804275 - RNA, 22 nt, Human
cuggccccagggcaggagcaaa

SEQ ID NO: 804276 - RNA, 20 nt, Human
cuggcccuaggccuggagaa

SEQ ID NO: 804277 - RNA, 21 nt, Human
cuggcugccccuggccuuggc

SEQ ID NO: 804278 - RNA, 19 nt, Human
cuggcugggccagggccgg

SEQ ID NO: 804279 - RNA, 23 nt, Human
cugggccagggccgggaccggga

SEQ ID NO: 804280 - RNA, 23 nt, Human
cugggcuggcugggccagggccg

SEQ ID NO: 804281 - RNA, 20 nt, Human
cuggggcagagcuggcccca

SEQ ID NO: 804282 - RNA, 22 nt, Human
cuucagggacccgucgaccccc

SEQ ID NO: 804283 - RNA, 22 nt, Human
cuuggggccccaggcccaugga

SEQ ID NO: 804284 - RNA, 21 nt, Human
gaacaaaaauacaaccaaugg

SEQ ID NO: 804285 - RNA, 27 nt, Human
gagcggucgcagggcguuuggcgggca

SEQ ID NO: 804286 - RNA, 18 nt, Human
gaggcuggaagcccuggc

SEQ ID NO: 804287 - RNA, 20 nt, Human
gagggaaggggggugccagc

SEQ ID NO: 804288 - RNA, 24 nt, Human
gagggguguccaggcccuugggcu

SEQ ID NO: 804289 - RNA, 18 nt, Human
gcaacaacacagguuggg

SEQ ID NO: 804290 - RNA, 18 nt, Human
gcacacacgcacaccacg

SEQ ID NO: 804291 - RNA, 24 nt, Human
gcacguggagggaccacgggguga

SEQ ID NO: 804292 - RNA, 20 nt, Human
gcaggcaccagccagaugcc

SEQ ID NO: 804293 - RNA, 20 nt, Human
gcagggcaggugcugaggga

SEQ ID NO: 804294 - RNA, 20 nt, Human
gccccacugcagggcccagc

SEQ ID NO: 804295 - RNA, 19 nt, Human
gcccccaaagaaauaaaaa

SEQ ID NO: 804296 - RNA, 20 nt, Human
gcccuaggccuggagaacuc

SEQ ID NO: 804297 - RNA, 21 nt, Human
gcccuggccucaccgccucuc

SEQ ID NO: 804298 - RNA, 22 nt, Human
gcccuggccucaccgccucuca

SEQ ID NO: 804299 - RNA, 24 nt, Human
gcgguacgggcccagagccccugc

SEQ ID NO: 804300 - RNA, 18 nt, Human
gcuccucccucuuguccc

SEQ ID NO: 804301 - RNA, 22 nt, Human
gcugcgcucggcuccgcucggc

SEQ ID NO: 804302 - RNA, 19 nt, Human
gcugggccagggccgggac

SEQ ID NO: 804303 - RNA, 18 nt, Human
ggaaagacugggcagguu

SEQ ID NO: 804304 - RNA, 21 nt, Human
ggaaagacugggcagguuggc

SEQ ID NO: 804305 - RNA, 21 nt, Human
ggaaauggaaccaagaaggga

SEQ ID NO: 804306 - RNA, 22 nt, Human
ggaccacggggugaccucaggg

SEQ ID NO: 804307 - RNA, 23 nt, Human
ggacuccccuccccacucugccc

SEQ ID NO: 804308 - RNA, 22 nt, Human
ggagagcuguggagggaagggc

SEQ ID NO: 804309 - RNA, 18 nt, Human
ggagccucgcucccacuu

SEQ ID NO: 804310 - RNA, 21 nt, Human
ggagggcaagcggccugcaga

SEQ ID NO: 804311 - RNA, 18 nt, Human
ggauggaaauggaaccaa

SEQ ID NO: 804312 - RNA, 20 nt, Human
ggcagagccuggccccaggg

SEQ ID NO: 804313 - RNA, 18 nt, Human
ggcagagcuggccccagg

SEQ ID NO: 804314 - RNA, 18 nt, Human
ggcaggcgcuccccucca

SEQ ID NO: 804315 - RNA, 23 nt, Human
ggccauggcagcaggcaccagcc

SEQ ID NO: 804316 - RNA, 20 nt, Human
ggcgggaggaaggagagcug

SEQ ID NO: 804317 - RNA, 18 nt, Human
ggcucugggccagcuagg

SEQ ID NO: 804318 - RNA, 22 nt, Human
gggaaaugcaaaaugguucagg

SEQ ID NO: 804319 - RNA, 20 nt, Human
gggaaguuggcacguggggu

SEQ ID NO: 804320 - RNA, 18 nt, Human
gggcaggugcugagggag

SEQ ID NO: 804321 - RNA, 21 nt, Human
gggccagggccgggaccggga

SEQ ID NO: 804322 - RNA, 22 nt, Human
gggcgggaggaaggagagcugu

SEQ ID NO: 804323 - RNA, 20 nt, Human
gggcuccacguggccccugc

SEQ ID NO: 804324 - RNA, 18 nt, Human
gggcugggcuggcugggc

SEQ ID NO: 804325 - RNA, 21 nt, Human
ggggaaguuggcacguggggu

SEQ ID NO: 804326 - RNA, 22 nt, Human
ggggcagagcuggccccagggc

SEQ ID NO: 804327 - RNA, 18 nt, Human
gggggaaaugcaaaaugg

SEQ ID NO: 804328 - RNA, 22 nt, Human
gggggcucagaaugucagccag

SEQ ID NO: 804329 - RNA, 23 nt, Human
gggguccacagaagugccgggcg

SEQ ID NO: 804330 - RNA, 24 nt, Human
ggggugagccugugggugggcggg

SEQ ID NO: 804331 - RNA, 19 nt, Human
gggugagagugggggcugg

SEQ ID NO: 804332 - RNA, 19 nt, Human
gguggcugccgggcgcggu

SEQ ID NO: 804333 - RNA, 23 nt, Human
gguugggugcggccagggcuugu

SEQ ID NO: 804334 - RNA, 18 nt, Human
gucaugggauggaguagu

SEQ ID NO: 804335 - RNA, 19 nt, Human
gugccagggccucucuccu

SEQ ID NO: 804336 - RNA, 19 nt, Human
gugggggaaggggguuugg

SEQ ID NO: 804337 - RNA, 18 nt, Human
gugggguuugaaccccuu

SEQ ID NO: 804338 - RNA, 21 nt, Human
uaaaaaaacaaaaaaacacag

SEQ ID NO: 804339 - RNA, 25 nt, Human
uaaaaaaacaaaaaaacacagcgac

SEQ ID NO: 804340 - RNA, 25 nt, Human
uaaacacaaaacaaagaucccacag

SEQ ID NO: 804341 - RNA, 19 nt, Human
uacaaccaauggcaggcgc

SEQ ID NO: 804342 - RNA, 24 nt, Human
uacacaaccauuaugguuaaacac

SEQ ID NO: 804343 - RNA, 20 nt, Human
uacacuaaagccaaaagcac

SEQ ID NO: 804344 - RNA, 21 nt, Human
uagaaagucacagacgggcac

SEQ ID NO: 804345 - RNA, 19 nt, Human
uagcugccggcugcucugg

SEQ ID NO: 804346 - RNA, 23 nt, Human
ucagcccgcagccccagccugcc

SEQ ID NO: 804347 - RNA, 22 nt, Human
ucauccgcgcgcuccugggccc

SEQ ID NO: 804348 - RNA, 22 nt, Human
uccauucaccuggcaggcagcc

SEQ ID NO: 804349 - RNA, 19 nt, Human
ucccaaccaggcccauuca

SEQ ID NO: 804350 - RNA, 21 nt, Human
ucccagacagcugcuccggcc

SEQ ID NO: 804351 - RNA, 22 nt, Human
ucccagacagcugcuccggccu

SEQ ID NO: 804352 - RNA, 23 nt, Human
ucccagacagcugcuccggccuc

SEQ ID NO: 804353 - RNA, 21 nt, Human
uccccacucugcccucccaua

SEQ ID NO: 804354 - RNA, 25 nt, Human
uccccagggccacccuguccuccca

SEQ ID NO: 804355 - RNA, 23 nt, Human
ucccccucagcccgcagccccag

SEQ ID NO: 804356 - RNA, 18 nt, Human
ucccucuuguccccaggg

SEQ ID NO: 804357 - RNA, 20 nt, Human
uccugggcccggcccggccc

SEQ ID NO: 804358 - RNA, 18 nt, Human
ucucuccuggcccuaggc

SEQ ID NO: 804359 - RNA, 18 nt, Human
ucucugggugggggaagg

SEQ ID NO: 804360 - RNA, 20 nt, Human
ucucugggugggggaagggg

SEQ ID NO: 804361 - RNA, 18 nt, Human
ucugcagagggagcgugc

SEQ ID NO: 804362 - RNA, 18 nt, Human
ucuggcagccggcaggag

SEQ ID NO: 804363 - RNA, 19 nt, Human
ucugggugggggaaggggg

SEQ ID NO: 804364 - RNA, 19 nt, Human
ucuguggcacccccuggag

SEQ ID NO: 804365 - RNA, 18 nt, Human
ugaacuaagaaggggucc

SEQ ID NO: 804366 - RNA, 20 nt, Human
ugacgagauuuuuaguauuu

SEQ ID NO: 804367 - RNA, 26 nt, Human
ugagcagguggcacguguuguaauga

SEQ ID NO: 804368 - RNA, 25 nt, Human
ugagccugugggugggcgggcugca

SEQ ID NO: 804369 - RNA, 18 nt, Human
ugaggacauuuccggucc

SEQ ID NO: 804370 - RNA, 23 nt, Human
ugaugugggguggcucugggagg

SEQ ID NO: 804371 - RNA, 19 nt, Human
ugauuuuccccguuuccuu

SEQ ID NO: 804372 - RNA, 24 nt, Human
ugcagagggagcgugccgggauag

SEQ ID NO: 804373 - RNA, 19 nt, Human
ugcagggugagaguggggg

SEQ ID NO: 804374 - RNA, 21 nt, Human
ugccaagaaaaaaagccccca

SEQ ID NO: 804375 - RNA, 18 nt, Human
ugcccaggccgggggggu

SEQ ID NO: 804376 - RNA, 18 nt, Human
ugccucaccaccccucuc

SEQ ID NO: 804377 - RNA, 19 nt, Human
ugcgcgcggccugcgcggg

SEQ ID NO: 804378 - RNA, 18 nt, Human
ugcggggaggggacagga

SEQ ID NO: 804379 - RNA, 23 nt, Human
ugcucccaaccaggcccauucac

SEQ ID NO: 804380 - RNA, 22 nt, Human
ugcuccggccucggcuccagcc

SEQ ID NO: 804381 - RNA, 19 nt, Human
ugcugagggagagagugaa

SEQ ID NO: 804382 - RNA, 20 nt, Human
ugcuggggcuggcggcccgc

SEQ ID NO: 804383 - RNA, 21 nt, Human
ugcuggggcuggcggcccgcc

SEQ ID NO: 804384 - RNA, 27 nt, Human
uggacuccccuccccacucugcccucc

SEQ ID NO: 804385 - RNA, 23 nt, Human
uggagcaccccaugaagagggag

SEQ ID NO: 804386 - RNA, 19 nt, Human
uggaguuugggggugaggu

SEQ ID NO: 804387 - RNA, 18 nt, Human
uggcacaggcaucgagcc

SEQ ID NO: 804388 - RNA, 19 nt, Human
uggcacggggaggggaagu

SEQ ID NO: 804389 - RNA, 22 nt, Human
uggcacggggaggggaaguugg

SEQ ID NO: 804390 - RNA, 24 nt, Human
uggcagcaggcaccagccagaugc

SEQ ID NO: 804391 - RNA, 21 nt, Human
uggcccagguggaagcggcag

SEQ ID NO: 804392 - RNA, 19 nt, Human
uggcccggggcgcgggcuu

SEQ ID NO: 804393 - RNA, 24 nt, Human
uggcccuaggccuggagaacuccc

SEQ ID NO: 804394 - RNA, 24 nt, Human
uggcugggccagggccgggaccgg

SEQ ID NO: 804395 - RNA, 25 nt, Human
uggcuguggcggggccuccgagggg

SEQ ID NO: 804396 - RNA, 21 nt, Human
uggggagggguguccaggccc

SEQ ID NO: 804397 - RNA, 23 nt, Human
uggggcaucggcuggcagcagcg

SEQ ID NO: 804398 - RNA, 23 nt, Human
ugggggaaggggguuuggcacca

SEQ ID NO: 804399 - RNA, 23 nt, Human
ugggggcuggccauggcagcagg

SEQ ID NO: 804400 - RNA, 21 nt, Human
ugggugggcaaugggccaggg

SEQ ID NO: 804401 - RNA, 24 nt, Human
ugggugggggaaggggguuuggca

SEQ ID NO: 804402 - RNA, 21 nt, Human
ugugcagggugagaguggggg

SEQ ID NO: 804403 - RNA, 22 nt, Human
uguggagggaagggccgggcgg

SEQ ID NO: 804404 - RNA, 24 nt, Human
uguggcggggccuccgaggggggc

SEQ ID NO: 804405 - RNA, 20 nt, Human
uguggggggcccugggguag

SEQ ID NO: 804406 - RNA, 24 nt, Human
uucccgaggacaguccuccugggg

SEQ ID NO: 804407 - RNA, 21 nt, Human
uugaccccugcacguggccau

SEQ ID NO: 804408 - RNA, 20 nt, Human
uuggcgggcacccacgccag

SEQ ID NO: 804409 - RNA, 22 nt, Human
uuuggcaccaagaaggcggcca

SEQ ID NO: 804410 - RNA, 18 nt, Human
aaacaugguguacaugua

SEQ ID NO: 804411 - RNA, 21 nt, Human
aacaugguguacauguaugua

SEQ ID NO: 804412 - RNA, 23 nt, Human
acaaugaucucuugccuuuuucc

SEQ ID NO: 804413 - RNA, 20 nt, Human
agacagacaguuccuuggau

SEQ ID NO: 804414 - RNA, 19 nt, Human
agagaaacacagcugacac

SEQ ID NO: 804415 - RNA, 21 nt, Human
aggcauacucaucaaaauuca

SEQ ID NO: 804416 - RNA, 24 nt, Human
agguaugugcaggggacuccugga

SEQ ID NO: 804417 - RNA, 20 nt, Human
auaucaagucuccccaaccc

SEQ ID NO: 804418 - RNA, 21 nt, Human
auaucaagucuccccaacccc

SEQ ID NO: 804419 - RNA, 18 nt, Human
auccagcaagagcuugcc

SEQ ID NO: 804420 - RNA, 25 nt, Human
caagagaaacacagcugacacgaug

SEQ ID NO: 804421 - RNA, 19 nt, Human
caggggacuccuggagauc

SEQ ID NO: 804422 - RNA, 26 nt, Human
ccaauauugauggcguuacuccucuu

SEQ ID NO: 804423 - RNA, 23 nt, Human
ccagaaaaggugucacacuuuug

SEQ ID NO: 804424 - RNA, 19 nt, Human
ccccaaccccaccuggagg

SEQ ID NO: 804425 - RNA, 18 nt, Human
cggaaucaagagaaacac

SEQ ID NO: 804426 - RNA, 21 nt, Human
cgggugucacggaaucaagag

SEQ ID NO: 804427 - RNA, 24 nt, Human
cugcagcaguuuucuuugagacag

SEQ ID NO: 804428 - RNA, 19 nt, Human
cuugccuucugcucagcac

SEQ ID NO: 804429 - RNA, 21 nt, Human
cuuggagggggcagcaccguc

SEQ ID NO: 804430 - RNA, 19 nt, Human
gacucagucugugaagcua

SEQ ID NO: 804431 - RNA, 21 nt, Human
gagaagguaugugcaggggac

SEQ ID NO: 804432 - RNA, 19 nt, Human
gcaagagcuugccuucugc

SEQ ID NO: 804433 - RNA, 19 nt, Human
gcagcaccgucagaccaau

SEQ ID NO: 804434 - RNA, 21 nt, Human
gcagcaguuuucuuugagaca

SEQ ID NO: 804435 - RNA, 20 nt, Human
gcucagcacacuccugggag

SEQ ID NO: 804436 - RNA, 19 nt, Human
ggagauccaagucaaugcg

SEQ ID NO: 804437 - RNA, 24 nt, Human
gguguacauguauguauuuguaua

SEQ ID NO: 804438 - RNA, 23 nt, Human
guguacauguauguauuuguaua

SEQ ID NO: 804439 - RNA, 21 nt, Human
uccuuggagggggcagcaccg

SEQ ID NO: 804440 - RNA, 22 nt, Human
ucuaaaauccacaacagguaaa

SEQ ID NO: 804441 - RNA, 25 nt, Human
ucuccccaaccccaccuggaggggu

SEQ ID NO: 804442 - RNA, 21 nt, Human
ugauuugcuccuuaaaggggc

SEQ ID NO: 804443 - RNA, 23 nt, Human
ugggaauugagcucucccuuuuc

SEQ ID NO: 804444 - RNA, 23 nt, Human
ugugcuuucuuuuguguacaagu

SEQ ID NO: 804445 - RNA, 24 nt, Human
uguggagacucagucugugaagcu

SEQ ID NO: 804446 - RNA, 22 nt, Human
uuccuugcccagaaaagguguc

SEQ ID NO: 804447 - RNA, 23 nt, Human
uuugaccacaggaauucucugca

SEQ ID NO: 804448 - RNA, 20 nt, Human
uuuuguguacaaguuugggg

SEQ ID NO: 804449 - RNA, 23 nt, Human
uuuuguguacaaguuugggguuu

SEQ ID NO: 804450 - RNA, 23 nt, Human
uuuuuuggcauuaaacucuauuu

SEQ ID NO: 804451 - RNA, 18 nt, Human
uuuuuuuuuuuuuuuuug

SEQ ID NO: 804452 - RNA, 22 nt, Human
uuuuuuuuuuuuuuuuuuuggc

SEQ ID NO: 804453 - RNA, 25 nt, Human
uuuuuuuuuuuuuuuuuuuuugggg

SEQ ID NO: 804454 - RNA, 19 nt, Human
aagagaaaccuccacccuu

SEQ ID NO: 804455 - RNA, 23 nt, Human
agaaaaaaaaaagugggagagaa

SEQ ID NO: 804456 - RNA, 24 nt, Human
cacugcucaaccucccugggcuuc

SEQ ID NO: 804457 - RNA, 22 nt, Human
ccuccacccuuccggagcacgu

SEQ ID NO: 804458 - RNA, 23 nt, Human
cgagcccgaggcgcgagcggcgg

SEQ ID NO: 804459 - RNA, 20 nt, Human
cgcucuuuagaccaaggacu

SEQ ID NO: 804460 - RNA, 20 nt, Human
cucccugggcuuccagagca

SEQ ID NO: 804461 - RNA, 21 nt, Human
gaagagaaaccuccacccuuc

SEQ ID NO: 804462 - RNA, 20 nt, Human
gagccgagcccgaggcgcga

SEQ ID NO: 804463 - RNA, 24 nt, Human
ucucacugcucaaccucccugggc

SEQ ID NO: 804464 - RNA, 19 nt, Human
uuagucccuucccucucuc

SEQ ID NO: 804465 - RNA, 24 nt, Human
uuuagaaaaaaaaaagugggagag

SEQ ID NO: 804466 - RNA, 26 nt, Human
aaaaaacuuguaaaauauggugccaa

SEQ ID NO: 804467 - RNA, 22 nt, Human
aaaaauaugccaaucuagacaa

SEQ ID NO: 804468 - RNA, 18 nt, Human
aaaacguuuccugccuuc

SEQ ID NO: 804469 - RNA, 23 nt, Human
aaacagccuaacaauuuaagagu

SEQ ID NO: 804470 - RNA, 26 nt, Human
aaacguuuccugccuucucuuuugug

SEQ ID NO: 804471 - RNA, 21 nt, Human
aaacuuguaaaauauggugcc

SEQ ID NO: 804472 - RNA, 27 nt, Human
aaagaaaaaauacaaauggauagaaaa

SEQ ID NO: 804473 - RNA, 20 nt, Human
aaagccaccacagccaccag

SEQ ID NO: 804474 - RNA, 25 nt, Human
aaauagucuagcucaaaccuagagc

SEQ ID NO: 804475 - RNA, 18 nt, Human
aaauggauagaaaaagau

SEQ ID NO: 804476 - RNA, 23 nt, Human
aacagcuacauacagaucucuac

SEQ ID NO: 804477 - RNA, 22 nt, Human
aaccauucaaaccagucucuga

SEQ ID NO: 804478 - RNA, 24 nt, Human
aauauucauuugauacccccaaaa

SEQ ID NO: 804479 - RNA, 23 nt, Human
aaucaaacauuuucagcccaagg

SEQ ID NO: 804480 - RNA, 21 nt, Human
aaugguaaaaaaaaaaaaaaa

SEQ ID NO: 804481 - RNA, 23 nt, Human
acagcaaccucuucuagcuuucc

SEQ ID NO: 804482 - RNA, 21 nt, Human
acccugagucuuagagaacuc

SEQ ID NO: 804483 - RNA, 22 nt, Human
acuggcagaaaaucucaaagca

SEQ ID NO: 804484 - RNA, 24 nt, Human
agacaagauaaaaaucaaacauuu

SEQ ID NO: 804485 - RNA, 26 nt, Human
agacacgcacacucacacacacucuc

SEQ ID NO: 804486 - RNA, 19 nt, Human
agaggcacgcucgggcugg

SEQ ID NO: 804487 - RNA, 23 nt, Human
agagggcagaggcacgcucggga

SEQ ID NO: 804488 - RNA, 24 nt, Human
agcauauaacuccauauuuucaca

SEQ ID NO: 804489 - RNA, 20 nt, Human
agcgugcacgugcacacaca

SEQ ID NO: 804490 - RNA, 20 nt, Human
agugcagaccugcugaaggu

SEQ ID NO: 804491 - RNA, 20 nt, Human
auaaaaaucaaacauuuuca

SEQ ID NO: 804492 - RNA, 21 nt, Human
augauacagagggcagaggca

SEQ ID NO: 804493 - RNA, 20 nt, Human
augccaaucuagacaagaua

SEQ ID NO: 804494 - RNA, 22 nt, Human
cacaaaguucucuuuccaaaca

SEQ ID NO: 804495 - RNA, 22 nt, Human
cacagccaccaguggagaugga

SEQ ID NO: 804496 - RNA, 21 nt, Human
cagaggcacgcucgggcuggg

SEQ ID NO: 804497 - RNA, 21 nt, Human
caggaagacuguaaagcagug

SEQ ID NO: 804498 - RNA, 18 nt, Human
ccccaccucaaaaugucc

SEQ ID NO: 804499 - RNA, 18 nt, Human
ccuaaauguccugggaau

SEQ ID NO: 804500 - RNA, 23 nt, Human
ccucaaaauguccuucaggaaga

SEQ ID NO: 804501 - RNA, 18 nt, Human
ccucugucaaugauacag

SEQ ID NO: 804502 - RNA, 18 nt, Human
ccuggcauggacaugauc

SEQ ID NO: 804503 - RNA, 21 nt, Human
ccuguccagucuuggccuugg

SEQ ID NO: 804504 - RNA, 22 nt, Human
ccuuuauguagagugcgcacau

SEQ ID NO: 804505 - RNA, 22 nt, Human
cgugcacacacagagacacgca

SEQ ID NO: 804506 - RNA, 31 nt, Human
cgugcacgugcacacacagagacacgcacag

SEQ ID NO: 804507 - RNA, 24 nt, Human
cuagaguuugaagauggcuuaaaa

SEQ ID NO: 804508 - RNA, 21 nt, Human
cuagcuuuccuguuuuguguu

SEQ ID NO: 804509 - RNA, 23 nt, Human
cuaucuuaaguaaaauguuaaaa

SEQ ID NO: 804510 - RNA, 21 nt, Human
cucuucuagcuuuccuguuuu

SEQ ID NO: 804511 - RNA, 19 nt, Human
gauacagcuggaacaggag

SEQ ID NO: 804512 - RNA, 24 nt, Human
gauguuuacaguauacaguggggg

SEQ ID NO: 804513 - RNA, 21 nt, Human
gauuucgcaaggaggaaaaaa

SEQ ID NO: 804514 - RNA, 18 nt, Human
gcuggcacaaaugcagaa

SEQ ID NO: 804515 - RNA, 25 nt, Human
ggaaaaaaacuuguaaaauauggug

SEQ ID NO: 804516 - RNA, 19 nt, Human
ggggaaaaacuugguagca

SEQ ID NO: 804517 - RNA, 23 nt, Human
ggugagauggguucuggugucag

SEQ ID NO: 804518 - RNA, 19 nt, Human
uaaagccccuuggccuuuc

SEQ ID NO: 804519 - RNA, 20 nt, Human
uaagaguuaugaauguagua

SEQ ID NO: 804520 - RNA, 18 nt, Human
uaauucccacccugaguc

SEQ ID NO: 804521 - RNA, 20 nt, Human
uacaaaggacaucuaacaag

SEQ ID NO: 804522 - RNA, 20 nt, Human
uacagaucucuacaggaacc

SEQ ID NO: 804523 - RNA, 18 nt, Human
uacagccucugucaauga

SEQ ID NO: 804524 - RNA, 26 nt, Human
uacaguauacaguggggggaagcaag

SEQ ID NO: 804525 - RNA, 19 nt, Human
uagagucaacugucaguuc

SEQ ID NO: 804526 - RNA, 23 nt, Human
uagaguuugaagauggcuuaaaa

SEQ ID NO: 804527 - RNA, 22 nt, Human
uagauuacaaacucaaggauau

SEQ ID NO: 804528 - RNA, 22 nt, Human
uaguaaaagauaaagccccuug

SEQ ID NO: 804529 - RNA, 22 nt, Human
uaguuuaacuggcagaaaaucc

SEQ ID NO: 804530 - RNA, 23 nt, Human
uauaauauucauuugauaccccc

SEQ ID NO: 804531 - RNA, 23 nt, Human
uaucugauacagcuggaacagga

SEQ ID NO: 804532 - RNA, 18 nt, Human
uaugccaccuuccugcug

SEQ ID NO: 804533 - RNA, 18 nt, Human
ucaaaccagucucugagc

SEQ ID NO: 804534 - RNA, 20 nt, Human
uccaacaauccaaagccacc

SEQ ID NO: 804535 - RNA, 22 nt, Human
uccagccagauguagccaaaug

SEQ ID NO: 804536 - RNA, 19 nt, Human
uccauaccaacuuccaaga

SEQ ID NO: 804537 - RNA, 20 nt, Human
ucucugagcuuugaaggccc

SEQ ID NO: 804538 - RNA, 26 nt, Human
ucuuagagaacucagccauagccuaa

SEQ ID NO: 804539 - RNA, 19 nt, Human
ucuucuagcuuuccuguuu

SEQ ID NO: 804540 - RNA, 18 nt, Human
ucuuucacugggucgggg

SEQ ID NO: 804541 - RNA, 23 nt, Human
ucuuucuuaauuaacuuccaagu

SEQ ID NO: 804542 - RNA, 22 nt, Human
ugaagcccaguuauauggcccu

SEQ ID NO: 804543 - RNA, 18 nt, Human
ugaaggugauggucuucc

SEQ ID NO: 804544 - RNA, 19 nt, Human
ugacacauaggagaauaaa

SEQ ID NO: 804545 - RNA, 19 nt, Human
ugcagaaaugcccaggcuu

SEQ ID NO: 804546 - RNA, 18 nt, Human
ugccauuuuaagccacag

SEQ ID NO: 804547 - RNA, 22 nt, Human
ugcuagaguuugaagauggcuu

SEQ ID NO: 804548 - RNA, 19 nt, Human
uggauagaaaaagauacaa

SEQ ID NO: 804549 - RNA, 23 nt, Human
uggcacaaaugcagaaaugcccc

SEQ ID NO: 804550 - RNA, 18 nt, Human
uguaacuagauuacaaac

SEQ ID NO: 804551 - RNA, 22 nt, Human
uguagccaaaugucuaauggac

SEQ ID NO: 804552 - RNA, 21 nt, Human
uguaugccuuacuucuguaac

SEQ ID NO: 804553 - RNA, 19 nt, Human
ugugagaagaggaaaaaaa

SEQ ID NO: 804554 - RNA, 25 nt, Human
uguggugagauggguucugguguca

SEQ ID NO: 804555 - RNA, 21 nt, Human
uguguguguaugccuuacuuc

SEQ ID NO: 804556 - RNA, 19 nt, Human
uuaaauagccuauaggaac

SEQ ID NO: 804557 - RNA, 22 nt, Human
uuaaauagccuauaggaacucc

SEQ ID NO: 804558 - RNA, 25 nt, Human
uuaacuggcagaaaaucucaaagca

SEQ ID NO: 804559 - RNA, 21 nt, Human
uuagagaacucagccauagcc

SEQ ID NO: 804560 - RNA, 19 nt, Human
uuccccugcugaugacucc

SEQ ID NO: 804561 - RNA, 27 nt, Human
uucgcaaggaggaaaaaagcaauuacc

SEQ ID NO: 804562 - RNA, 21 nt, Human
uucucuuuccaaacauacagc

SEQ ID NO: 804563 - RNA, 23 nt, Human
uugaaggcccccccaccucaaaa

SEQ ID NO: 804564 - RNA, 22 nt, Human
uugccuacuaguaaaagauaaa

SEQ ID NO: 804565 - RNA, 26 nt, Human
uuucuuaauuaacuuccaagugaaca

SEQ ID NO: 804566 - RNA, 21 nt, Human
uuuguguguguguaugccuua

SEQ ID NO: 804567 - RNA, 22 nt, Human
aaagauggaguucugagaaaaa

SEQ ID NO: 804568 - RNA, 25 nt, Human
aaagcaaacauuaaaacaguaaugu

SEQ ID NO: 804569 - RNA, 21 nt, Human
aaaugaaagccuucauagaaa

SEQ ID NO: 804570 - RNA, 22 nt, Human
aagcaaacauuaaaacagggaa

SEQ ID NO: 804571 - RNA, 21 nt, Human
acccugaaaucuccguaucuu

SEQ ID NO: 804572 - RNA, 21 nt, Human
acugaaaacuucuuuuuuuuu

SEQ ID NO: 804573 - RNA, 24 nt, Human
agcggcgaccgcuccgcccccacg

SEQ ID NO: 804574 - RNA, 21 nt, Human
auagaauaugcugaaccuuga

SEQ ID NO: 804575 - RNA, 18 nt, Human
augaaaaaaaauguaugc

SEQ ID NO: 804576 - RNA, 19 nt, Human
auucucuggagaagguuuu

SEQ ID NO: 804577 - RNA, 20 nt, Human
caaagcaaacauuaaaacag

SEQ ID NO: 804578 - RNA, 23 nt, Human
caucugaagaguacaaagaugga

SEQ ID NO: 804579 - RNA, 23 nt, Human
cauucaacgccgccgcccucucc

SEQ ID NO: 804580 - RNA, 21 nt, Human
cccacgagacccgcagccgcc

SEQ ID NO: 804581 - RNA, 21 nt, Human
cccccacgagacccgcagccg

SEQ ID NO: 804582 - RNA, 18 nt, Human
cccuaaagaaaacugaaa

SEQ ID NO: 804583 - RNA, 24 nt, Human
ccgcccccacgagacccgcagccg

SEQ ID NO: 804584 - RNA, 19 nt, Human
ccgccgcccucuccacccg

SEQ ID NO: 804585 - RNA, 22 nt, Human
cggcagcggcgaccgcuccgcc

SEQ ID NO: 804586 - RNA, 23 nt, Human
cggcggcagcggcgaccgcuccg

SEQ ID NO: 804587 - RNA, 20 nt, Human
cguaucuugacacacacauu

SEQ ID NO: 804588 - RNA, 19 nt, Human
cugaaauauacuuuaaccc

SEQ ID NO: 804589 - RNA, 21 nt, Human
cuucauauagaauaugcugaa

SEQ ID NO: 804590 - RNA, 19 nt, Human
gcccuaaagaaaacugaaa

SEQ ID NO: 804591 - RNA, 24 nt, Human
gcugaaccuugaccauuuuugauu

SEQ ID NO: 804592 - RNA, 23 nt, Human
gggauguacaaaugaaagccuuc

SEQ ID NO: 804593 - RNA, 18 nt, Human
guaucuugacacacacau

SEQ ID NO: 804594 - RNA, 26 nt, Human
uacacugaaauaaagcaauuagaggu

SEQ ID NO: 804595 - RNA, 21 nt, Human
uaccaccuugugaucuucaua

SEQ ID NO: 804596 - RNA, 18 nt, Human
uacccaaaccuucuucac

SEQ ID NO: 804597 - RNA, 19 nt, Human
uaugccacagugucuauau

SEQ ID NO: 804598 - RNA, 22 nt, Human
uauguugcccuaaagaaaacug

SEQ ID NO: 804599 - RNA, 21 nt, Human
ucaaaucccgacccgagcugc

SEQ ID NO: 804600 - RNA, 20 nt, Human
ucaacgccgccgcccucuca

SEQ ID NO: 804601 - RNA, 18 nt, Human
ucagaacugaaaacuucu

SEQ ID NO: 804602 - RNA, 19 nt, Human
uccaggucuugcuugauuc

SEQ ID NO: 804603 - RNA, 21 nt, Human
uccgccacacauucaacgccg

SEQ ID NO: 804604 - RNA, 24 nt, Human
ucuccguaucuugacacacacauu

SEQ ID NO: 804605 - RNA, 20 nt, Human
ugaaauauacuuuaacccuu

SEQ ID NO: 804606 - RNA, 26 nt, Human
ugacacacacauuuuaacggaaaaaa

SEQ ID NO: 804607 - RNA, 26 nt, Human
ugcaguuuacccaaaccuucuucaca

SEQ ID NO: 804608 - RNA, 22 nt, Human
uggagaagguuuugucagacuc

SEQ ID NO: 804609 - RNA, 23 nt, Human
uggaguucugagaaaaaaggguu

SEQ ID NO: 804610 - RNA, 19 nt, Human
ugggaggaaucagauugug

SEQ ID NO: 804611 - RNA, 20 nt, Human
uguaugccacagugucuaua

SEQ ID NO: 804612 - RNA, 19 nt, Human
uguccggcggcgcgcggag

SEQ ID NO: 804613 - RNA, 19 nt, Human
uguccggcggcgcgcggag

SEQ ID NO: 804614 - RNA, 23 nt, Human
uucaucugaagaguacaaagaug

SEQ ID NO: 804615 - RNA, 18 nt, Human
uugcuugauucucuggag

SEQ ID NO: 804616 - RNA, 25 nt, Human
uuuacccaaaccuucuucacaucca

SEQ ID NO: 804617 - RNA, 24 nt, Human
uuuuaaauucaaauauauguugcc

SEQ ID NO: 804618 - RNA, 19 nt, Human
aaaaaguccugcgcccaac

SEQ ID NO: 804619 - RNA, 21 nt, Human
aaaauacaaaacaacaacuaa

SEQ ID NO: 804620 - RNA, 18 nt, Human
aaacaaaacuaaaaaucg

SEQ ID NO: 804621 - RNA, 25 nt, Human
aaacaacaaaauacaaaacaacaac

SEQ ID NO: 804622 - RNA, 21 nt, Human
aaacaacaacuaaaaccaaaa

SEQ ID NO: 804623 - RNA, 20 nt, Human
aaacggaaggugcaggauuc

SEQ ID NO: 804624 - RNA, 22 nt, Human
aaagcaaaagggccagugaggu

SEQ ID NO: 804625 - RNA, 21 nt, Human
aacaaaauacaaaacaacaac

SEQ ID NO: 804626 - RNA, 24 nt, Human
aacaacaaaauacaaaacaacaac

SEQ ID NO: 804627 - RNA, 22 nt, Human
aacuaaaaccaaaaacagccaa

SEQ ID NO: 804628 - RNA, 22 nt, Human
aacuuccuauguauccugacac

SEQ ID NO: 804629 - RNA, 21 nt, Human
aagaagaggagggauauggga

SEQ ID NO: 804630 - RNA, 18 nt, Human
aagcaaaagggccaguga

SEQ ID NO: 804631 - RNA, 25 nt, Human
aaggcagcucugcccugaagcguca

SEQ ID NO: 804632 - RNA, 18 nt, Human
aaguacccuuagagcucc

SEQ ID NO: 804633 - RNA, 23 nt, Human
aauagugcuccaggcaaaagcca

SEQ ID NO: 804634 - RNA, 26 nt, Human
acaacuaaaaccaaaaacagccaaca

SEQ ID NO: 804635 - RNA, 23 nt, Human
acaccgaaucuuccaugccuggc

SEQ ID NO: 804636 - RNA, 22 nt, Human
accccuucuucuccucccucug

SEQ ID NO: 804637 - RNA, 23 nt, Human
accgaaucuuccaugccuggcgu

SEQ ID NO: 804638 - RNA, 24 nt, Human
accgaaucuuccaugccuggcgug

SEQ ID NO: 804639 - RNA, 22 nt, Human
acugucccuaccuccagccacu

SEQ ID NO: 804640 - RNA, 19 nt, Human
agaaaaacggaaggugcag

SEQ ID NO: 804641 - RNA, 23 nt, Human
agaaacuuagcaucgcucuccca

SEQ ID NO: 804642 - RNA, 27 nt, Human
agaauggacacaauugauucccaagua

SEQ ID NO: 804643 - RNA, 18 nt, Human
agagaauucuuguccugc

SEQ ID NO: 804644 - RNA, 20 nt, Human
agcauccugagcugccccuc

SEQ ID NO: 804645 - RNA, 28 nt, Human
agccagguggccccaaaaggauggccuu

SEQ ID NO: 804646 - RNA, 18 nt, Human
agccucuggcucaagccc

SEQ ID NO: 804647 - RNA, 18 nt, Human
aggcaaaagccaggcugg

SEQ ID NO: 804648 - RNA, 25 nt, Human
aggcaaaagccaggcuggugaagga

SEQ ID NO: 804649 - RNA, 19 nt, Human
aggcaggggaugaaggagg

SEQ ID NO: 804650 - RNA, 20 nt, Human
aggcaggggaugaaggaggg

SEQ ID NO: 804651 - RNA, 25 nt, Human
aggcaggggaugaaggaggggcugg

SEQ ID NO: 804652 - RNA, 20 nt, Human
aggcgcaggggaagugaagc

SEQ ID NO: 804653 - RNA, 19 nt, Human
aggcggcggcagcggcggc

SEQ ID NO: 804654 - RNA, 18 nt, Human
agggacaggagcugccgc

SEQ ID NO: 804655 - RNA, 20 nt, Human
auauugucuuugugcugcca

SEQ ID NO: 804656 - RNA, 20 nt, Human
augcaaagaagaggagggau

SEQ ID NO: 804657 - RNA, 19 nt, Human
caaaagccaggcuggugaa

SEQ ID NO: 804658 - RNA, 22 nt, Human
caaaauacaaaacaacaacuaa

SEQ ID NO: 804659 - RNA, 20 nt, Human
caaagugccaugcuaaugca

SEQ ID NO: 804660 - RNA, 21 nt, Human
caaagugccaugcuaaugcaa

SEQ ID NO: 804661 - RNA, 26 nt, Human
caacaacuaaaaccaaaaacagccaa

SEQ ID NO: 804662 - RNA, 21 nt, Human
caaccucucuccagccccaca

SEQ ID NO: 804663 - RNA, 25 nt, Human
cacaaccaacugucccuaccuccag

SEQ ID NO: 804664 - RNA, 18 nt, Human
cacagccugaacccaggg

SEQ ID NO: 804665 - RNA, 23 nt, Human
cacagccugaacccagggacagg

SEQ ID NO: 804666 - RNA, 22 nt, Human
caccccuucuucuccucccucu

SEQ ID NO: 804667 - RNA, 21 nt, Human
caccgaaucuuccaugccugg

SEQ ID NO: 804668 - RNA, 23 nt, Human
caccugcggcucggaagccugag

SEQ ID NO: 804669 - RNA, 24 nt, Human
cacugcguggggacaggaggguuc

SEQ ID NO: 804670 - RNA, 21 nt, Human
cacuggucaggcccuggaagc

SEQ ID NO: 804671 - RNA, 25 nt, Human
cagcccgggacagcacgggcccccu

SEQ ID NO: 804672 - RNA, 19 nt, Human
cagcggacagccagcccaa

SEQ ID NO: 804673 - RNA, 20 nt, Human
cagcucacuuaaggaggcuu

SEQ ID NO: 804674 - RNA, 21 nt, Human
caggaucaggcucccgggaag

SEQ ID NO: 804675 - RNA, 23 nt, Human
cagggcucauuccuuggcugugg

SEQ ID NO: 804676 - RNA, 22 nt, Human
cauaaaguugaaaugugagcac

SEQ ID NO: 804677 - RNA, 19 nt, Human
caugcuaaugcaacaugcu

SEQ ID NO: 804678 - RNA, 19 nt, Human
ccaaaaacagccaacaccc

SEQ ID NO: 804679 - RNA, 23 nt, Human
ccaacugucccuaccuccagcca

SEQ ID NO: 804680 - RNA, 24 nt, Human
ccaacugucccuaccuccagccac

SEQ ID NO: 804681 - RNA, 20 nt, Human
ccacagggcucauuccuugg

SEQ ID NO: 804682 - RNA, 21 nt, Human
ccacagggcucauuccuuggc

SEQ ID NO: 804683 - RNA, 20 nt, Human
ccacugagcccugggcguga

SEQ ID NO: 804684 - RNA, 23 nt, Human
ccacugcagaagagcucucuggc

SEQ ID NO: 804685 - RNA, 26 nt, Human
ccagacccagcaccagccgcacggcu

SEQ ID NO: 804686 - RNA, 21 nt, Human
ccagacccagcaccagccgcc

SEQ ID NO: 804687 - RNA, 23 nt, Human
ccagagccaguccagacccagca

SEQ ID NO: 804688 - RNA, 23 nt, Human
cccacaaccaacugucccuaccu

SEQ ID NO: 804689 - RNA, 18 nt, Human
cccacuggagagaccuca

SEQ ID NO: 804690 - RNA, 19 nt, Human
ccccacaaccucucuccag

SEQ ID NO: 804691 - RNA, 21 nt, Human
cccccugccuccagccuaggc

SEQ ID NO: 804692 - RNA, 26 nt, Human
cccccugccuccagccuaggcguccg

SEQ ID NO: 804693 - RNA, 22 nt, Human
ccccggcaaaaaguccugcgcc

SEQ ID NO: 804694 - RNA, 25 nt, Human
cccgccgccgaggcugcaccggggc

SEQ ID NO: 804695 - RNA, 21 nt, Human
cccuagcuccacacagaggca

SEQ ID NO: 804696 - RNA, 18 nt, Human
cccugggaugguguugcc

SEQ ID NO: 804697 - RNA, 18 nt, Human
ccucgcuuccuccccaca

SEQ ID NO: 804698 - RNA, 21 nt, Human
ccuggaagaggguucccuucc

SEQ ID NO: 804699 - RNA, 27 nt, Human
ccugguagcauccugagcugccccucu

SEQ ID NO: 804700 - RNA, 23 nt, Human
ccuucacggcccaucagcuccag

SEQ ID NO: 804701 - RNA, 22 nt, Human
ccuuuggagaaaaauaggcccc

SEQ ID NO: 804702 - RNA, 24 nt, Human
cgaugcuucuuggagccagguggc

SEQ ID NO: 804703 - RNA, 20 nt, Human
cgugaaaagcaaaagggccc

SEQ ID NO: 804704 - RNA, 21 nt, Human
cuaaaaccaaaaacagccaac

SEQ ID NO: 804705 - RNA, 23 nt, Human
cuaaacaaauagugcuccaggca

SEQ ID NO: 804706 - RNA, 19 nt, Human
cuacgccgcuucggucugc

SEQ ID NO: 804707 - RNA, 20 nt, Human
cuccccacaaccucucucca

SEQ ID NO: 804708 - RNA, 25 nt, Human
cucggaagccugagcccagcccggg

SEQ ID NO: 804709 - RNA, 24 nt, Human
cugcguggggacaggaggguucuu

SEQ ID NO: 804710 - RNA, 21 nt, Human
cugcuuugcccaccugguggg

SEQ ID NO: 804711 - RNA, 18 nt, Human
cuggcacgccacccccac

SEQ ID NO: 804712 - RNA, 20 nt, Human
cuggcgcugcuggacugugg

SEQ ID NO: 804713 - RNA, 21 nt, Human
cuggcgcugcuggacuguggc

SEQ ID NO: 804714 - RNA, 25 nt, Human
cuugacccuagcuccacacagaggc

SEQ ID NO: 804715 - RNA, 20 nt, Human
gaaaagcaaaagggccagug

SEQ ID NO: 804716 - RNA, 22 nt, Human
gaaggggagaugacagagaggc

SEQ ID NO: 804717 - RNA, 24 nt, Human
gagccaguccagacccagcaccag

SEQ ID NO: 804718 - RNA, 21 nt, Human
gaggcggcggcagcggcggcg

SEQ ID NO: 804719 - RNA, 24 nt, Human
gaucacaguuaaaagcuuucuggu

SEQ ID NO: 804720 - RNA, 23 nt, Human
gaugcuucuuggagccagguggc

SEQ ID NO: 804721 - RNA, 19 nt, Human
gcaaaaagcaaucuggcua

SEQ ID NO: 804722 - RNA, 18 nt, Human
gcaggggaugaaggaggg

SEQ ID NO: 804723 - RNA, 20 nt, Human
gcaggggaugaaggaggggc

SEQ ID NO: 804724 - RNA, 22 nt, Human
gcauccucgcuuccuccccaca

SEQ ID NO: 804725 - RNA, 18 nt, Human
gcccugaagcgucacccc

SEQ ID NO: 804726 - RNA, 18 nt, Human
gccuaauuuuucuguaaa

SEQ ID NO: 804727 - RNA, 24 nt, Human
gccuaguggcaggcacgcauccuc

SEQ ID NO: 804728 - RNA, 24 nt, Human
gccucugcaaggccucaagguggg

SEQ ID NO: 804729 - RNA, 20 nt, Human
gcggcagcggcggcgaaacc

SEQ ID NO: 804730 - RNA, 21 nt, Human
gcggcggcagcggcggcgaaa

SEQ ID NO: 804731 - RNA, 19 nt, Human
gcucaggucuguggcaucc

SEQ ID NO: 804732 - RNA, 21 nt, Human
gcuccaggcaaaagccaggcu

SEQ ID NO: 804733 - RNA, 25 nt, Human
ggacauccggcuggugaauguaggg

SEQ ID NO: 804734 - RNA, 19 nt, Human
ggaggcggcggcagcggcg

SEQ ID NO: 804735 - RNA, 19 nt, Human
ggaggcuuuucuguccaca

SEQ ID NO: 804736 - RNA, 22 nt, Human
ggauccgccagagccaguccag

SEQ ID NO: 804737 - RNA, 22 nt, Human
ggcagcggcggcgaaacccgcc

SEQ ID NO: 804738 - RNA, 20 nt, Human
ggccgccucucggccgcucu

SEQ ID NO: 804739 - RNA, 26 nt, Human
ggccguacaagcacagaaaaacggaa

SEQ ID NO: 804740 - RNA, 22 nt, Human
ggccuuuggagaaaaauaggcc

SEQ ID NO: 804741 - RNA, 21 nt, Human
ggcgagcugauggggccuuga

SEQ ID NO: 804742 - RNA, 21 nt, Human
ggcggcagcggcggcgaaacc

SEQ ID NO: 804743 - RNA, 22 nt, Human
gggaaauaugcaaagaagagga

SEQ ID NO: 804744 - RNA, 18 nt, Human
gggcugggaaggggagau

SEQ ID NO: 804745 - RNA, 21 nt, Human
gggcuugcggcggcgccgccg

SEQ ID NO: 804746 - RNA, 20 nt, Human
ggggcgggggaagggggcgg

SEQ ID NO: 804747 - RNA, 18 nt, Human
ggucccggcgagcugaug

SEQ ID NO: 804748 - RNA, 25 nt, Human
ggugaaggaggcaggggaugaagga

SEQ ID NO: 804749 - RNA, 19 nt, Human
gucccaugcucucacugca

SEQ ID NO: 804750 - RNA, 25 nt, Human
guccugaaugguccacagagaaggc

SEQ ID NO: 804751 - RNA, 20 nt, Human
guggugcaaauacacacugc

SEQ ID NO: 804752 - RNA, 22 nt, Human
uaaaacaacaaaauacaaaaca

SEQ ID NO: 804753 - RNA, 20 nt, Human
uaaaaccaaaaacagccaac

SEQ ID NO: 804754 - RNA, 24 nt, Human
uaaaaccaaaaacagccaacaccc

SEQ ID NO: 804755 - RNA, 25 nt, Human
uaaaaccaaaaacagccaacaccca

SEQ ID NO: 804756 - RNA, 20 nt, Human
uaaaaggcagcucugcccug

SEQ ID NO: 804757 - RNA, 25 nt, Human
uaaaaggcagcucugcccugaagcg

SEQ ID NO: 804758 - RNA, 24 nt, Human
uacacugcguggggacaggagggu

SEQ ID NO: 804759 - RNA, 22 nt, Human
uacugguccacauuuaguguuc

SEQ ID NO: 804760 - RNA, 18 nt, Human
uagaagccgcagggcugc

SEQ ID NO: 804761 - RNA, 22 nt, Human
uagcaaaaccugagucugcauc

SEQ ID NO: 804762 - RNA, 23 nt, Human
uagcaucgcucucccagagugaa

SEQ ID NO: 804763 - RNA, 23 nt, Human
uaggggagguuucaccuuuagau

SEQ ID NO: 804764 - RNA, 18 nt, Human
ucacugcagcgaggcagg

SEQ ID NO: 804765 - RNA, 23 nt, Human
ucacuuggccgccucucggccgc

SEQ ID NO: 804766 - RNA, 23 nt, Human
ucaggcucccgggaaggccgcac

SEQ ID NO: 804767 - RNA, 19 nt, Human
uccaaaauuaccuuucacu

SEQ ID NO: 804768 - RNA, 21 nt, Human
uccaaaauuaccuuucacuug

SEQ ID NO: 804769 - RNA, 22 nt, Human
uccagccccacaaccaacuguc

SEQ ID NO: 804770 - RNA, 19 nt, Human
ucccaaguacccuuagagc

SEQ ID NO: 804771 - RNA, 21 nt, Human
ucccaaguacccuuagagcuc

SEQ ID NO: 804772 - RNA, 18 nt, Human
ucccacuggagagaccuc

SEQ ID NO: 804773 - RNA, 18 nt, Human
ucccaugcucucacugca

SEQ ID NO: 804774 - RNA, 19 nt, Human
uccccaagaccagcgaugc

SEQ ID NO: 804775 - RNA, 19 nt, Human
uccccacaaccucucucca

SEQ ID NO: 804776 - RNA, 24 nt, Human
uccccacaaccucucuccagcccc

SEQ ID NO: 804777 - RNA, 21 nt, Human
ucccuaccuccagccacuagg

SEQ ID NO: 804778 - RNA, 23 nt, Human
ucccugggaugguguugccuaag

SEQ ID NO: 804779 - RNA, 21 nt, Human
uccgccaggaucaggcucccg

SEQ ID NO: 804780 - RNA, 21 nt, Human
uccgcuccccgcagguuucug

SEQ ID NO: 804781 - RNA, 18 nt, Human
uccugggccacugagccc

SEQ ID NO: 804782 - RNA, 18 nt, Human
uccugggccacugagccc

SEQ ID NO: 804783 - RNA, 20 nt, Human
uccugggucccaggguggac

SEQ ID NO: 804784 - RNA, 26 nt, Human
ucggaagccugagcccagcccgggac

SEQ ID NO: 804785 - RNA, 21 nt, Human
ucucccagagugaauagaagc

SEQ ID NO: 804786 - RNA, 22 nt, Human
ucucccugggaugguguugccu

SEQ ID NO: 804787 - RNA, 19 nt, Human
ucuguaaacauaaaacugc

SEQ ID NO: 804788 - RNA, 20 nt, Human
ucuguaaacauaaaacugcu

SEQ ID NO: 804789 - RNA, 24 nt, Human
ucuguaaacauaaaacugcucuua

SEQ ID NO: 804790 - RNA, 20 nt, Human
ugaaggaggcaggggaugaa

SEQ ID NO: 804791 - RNA, 21 nt, Human
ugacagagaggcuucacagag

SEQ ID NO: 804792 - RNA, 26 nt, Human
ugagcacauagcaaaaccugagucug

SEQ ID NO: 804793 - RNA, 21 nt, Human
ugagcagagugccugaucaca

SEQ ID NO: 804794 - RNA, 24 nt, Human
ugagcccugggcgugaaaagcaaa

SEQ ID NO: 804795 - RNA, 20 nt, Human
ugaguggggaggagggagga

SEQ ID NO: 804796 - RNA, 24 nt, Human
ugcaaaaagcaaucuggcuaaagg

SEQ ID NO: 804797 - RNA, 20 nt, Human
ugcaaagagaacuaaacaaa

SEQ ID NO: 804798 - RNA, 24 nt, Human
ugcaccggggcuugcggcggcgcc

SEQ ID NO: 804799 - RNA, 24 nt, Human
ugcagcgaggcagguuaaucuguu

SEQ ID NO: 804800 - RNA, 20 nt, Human
uggcacgccacccccacugg

SEQ ID NO: 804801 - RNA, 25 nt, Human
uggcaggcacgcauccucgcuuccu

SEQ ID NO: 804802 - RNA, 21 nt, Human
uggcauccagagauaaaaggc

SEQ ID NO: 804803 - RNA, 18 nt, Human
uggcuaaagggauuuggg

SEQ ID NO: 804804 - RNA, 20 nt, Human
uggcucaagcccgauuacga

SEQ ID NO: 804805 - RNA, 18 nt, Human
uggcugggacucagcucc

SEQ ID NO: 804806 - RNA, 20 nt, Human
ugggaaggggagaugacaga

SEQ ID NO: 804807 - RNA, 18 nt, Human
uggggaggagggaggagg

SEQ ID NO: 804808 - RNA, 19 nt, Human
uggggaggagggaggaggu

SEQ ID NO: 804809 - RNA, 23 nt, Human
uggggaggagggaggaggugaag

SEQ ID NO: 804810 - RNA, 19 nt, Human
uggggccuugagaggcgcc

SEQ ID NO: 804811 - RNA, 19 nt, Human
uggggggcgggggaagggg

SEQ ID NO: 804812 - RNA, 18 nt, Human
uggugaauguaggggagg

SEQ ID NO: 804813 - RNA, 22 nt, Human
uguggcccgcagccugagcacc

SEQ ID NO: 804814 - RNA, 20 nt, Human
uuauuuuuucaaaacaaaac

SEQ ID NO: 804815 - RNA, 21 nt, Human
uuccugauagucaaccacagg

SEQ ID NO: 804816 - RNA, 18 nt, Human
uugacccuagcuccacac

SEQ ID NO: 804817 - RNA, 22 nt, Human
uugauacugguccacauuuagu

SEQ ID NO: 804818 - RNA, 22 nt, Human
uuggcugggacucagcucccca

SEQ ID NO: 804819 - RNA, 24 nt, Human
aagaauacagaguauuaucacagc

SEQ ID NO: 804820 - RNA, 23 nt, Human
agacagaaauauuauacauccuu

SEQ ID NO: 804821 - RNA, 19 nt, Human
agucagcaguugaauucag

SEQ ID NO: 804822 - RNA, 19 nt, Human
auuuacauagcuuuuccca

SEQ ID NO: 804823 - RNA, 21 nt, Human
caacuccauaggaaaauagau

SEQ ID NO: 804824 - RNA, 24 nt, Human
caaguaaaugccaacauuuaacac

SEQ ID NO: 804825 - RNA, 22 nt, Human
cacuggaaaaaaaaaaaaaaau

SEQ ID NO: 804826 - RNA, 21 nt, Human
cagaauauaugcacagcacug

SEQ ID NO: 804827 - RNA, 25 nt, Human
cauaauagaaacaacuccauaggaa

SEQ ID NO: 804828 - RNA, 24 nt, Human
cgcaaacauaguauauuuaaaaua

SEQ ID NO: 804829 - RNA, 22 nt, Human
gucaauacaaguaaaugccaac

SEQ ID NO: 804830 - RNA, 21 nt, Human
guugaucuuaaaacuaagcac

SEQ ID NO: 804831 - RNA, 21 nt, Human
uacaagcaaauauuuucaggg

SEQ ID NO: 804832 - RNA, 24 nt, Human
uagauaggcacaaaaauucagcca

SEQ ID NO: 804833 - RNA, 27 nt, Human
uagauaggcacaaaaauucagccacug

SEQ ID NO: 804834 - RNA, 23 nt, Human
uaggacaucaacaauguuuccca

SEQ ID NO: 804835 - RNA, 23 nt, Human
uauaaauaccugacaagcaaacc

SEQ ID NO: 804836 - RNA, 24 nt, Human
ugcacagcacuggaaaaaaaaaaa

SEQ ID NO: 804837 - RNA, 18 nt, Human
ugccuaguaaguacagga

SEQ ID NO: 804838 - RNA, 18 nt, Human
uuaaaauauauuuagcag

SEQ ID NO: 804839 - RNA, 23 nt, Human
uuaucacagcauucaguuuacaa

SEQ ID NO: 804840 - RNA, 24 nt, Human
uucaggggaaaaaaucacauaaga

SEQ ID NO: 804841 - RNA, 18 nt, Human
uugaucuuaaaacuaagc

SEQ ID NO: 804842 - RNA, 23 nt, Human
uuggucaauacaaguaaaugcca

SEQ ID NO: 804843 - RNA, 21 nt, Human
uuuaaaauauauuuagcagca

SEQ ID NO: 804844 - RNA, 19 nt, Human
uuuauuagaauaccauuua

SEQ ID NO: 804845 - RNA, 24 nt, Human
aaaaauuauauuuuuaauuauaga

SEQ ID NO: 804846 - RNA, 18 nt, Human
aaacaagugcuuagcucu

SEQ ID NO: 804847 - RNA, 19 nt, Human
aacaaaaaaacaugcuccu

SEQ ID NO: 804848 - RNA, 22 nt, Human
aaccugugucucauuuuuccuu

SEQ ID NO: 804849 - RNA, 29 nt, Human
aagaagccaaaagcagcagcagugggcac

SEQ ID NO: 804850 - RNA, 26 nt, Human
aagaagccaaaagcagccguuaugaa

SEQ ID NO: 804851 - RNA, 22 nt, Human
aagccaaaagcagcagcaggaa

SEQ ID NO: 804852 - RNA, 23 nt, Human
aagcugauacccauaguggcuca

SEQ ID NO: 804853 - RNA, 18 nt, Human
aagcugcauucagcugga

SEQ ID NO: 804854 - RNA, 18 nt, Human
aagcugcauucagcugga

SEQ ID NO: 804855 - RNA, 22 nt, Human
aaggagcuaauuagaaacaaug

SEQ ID NO: 804856 - RNA, 19 nt, Human
acaaagacagaccuuacag

SEQ ID NO: 804857 - RNA, 20 nt, Human
accaucagcaacauauauga

SEQ ID NO: 804858 - RNA, 24 nt, Human
accuccaagaagccaaaagcagca

SEQ ID NO: 804859 - RNA, 18 nt, Human
acuccagucccauuuucu

SEQ ID NO: 804860 - RNA, 24 nt, Human
acucgcagcucucccuuuccccag

SEQ ID NO: 804861 - RNA, 24 nt, Human
agaaaacaggcacaaaguguucac

SEQ ID NO: 804862 - RNA, 20 nt, Human
agaaaagacauauuugaguu

SEQ ID NO: 804863 - RNA, 18 nt, Human
agaaagaggagacagcug

SEQ ID NO: 804864 - RNA, 21 nt, Human
agaaggagaaaaguuacaauc

SEQ ID NO: 804865 - RNA, 22 nt, Human
agaauaggacaaucgaccuauu

SEQ ID NO: 804866 - RNA, 22 nt, Human
agacaauggaagucgagcacuu

SEQ ID NO: 804867 - RNA, 21 nt, Human
agacucagauucccgaggccu

SEQ ID NO: 804868 - RNA, 19 nt, Human
agauacaaaugcaugagca

SEQ ID NO: 804869 - RNA, 20 nt, Human
agauauuccucacuccaguc

SEQ ID NO: 804870 - RNA, 23 nt, Human
agauuguucauguauggagauag

SEQ ID NO: 804871 - RNA, 24 nt, Human
agauuguucauguauggagauagc

SEQ ID NO: 804872 - RNA, 21 nt, Human
agcaauaaagcacaguagaaa

SEQ ID NO: 804873 - RNA, 19 nt, Human
agcagcagcaggaacuggu

SEQ ID NO: 804874 - RNA, 19 nt, Human
agcugggugcuuagaagcc

SEQ ID NO: 804875 - RNA, 22 nt, Human
aggagacagcugguguggcccu

SEQ ID NO: 804876 - RNA, 19 nt, Human
aggcagagucucuaguugc

SEQ ID NO: 804877 - RNA, 21 nt, Human
aggcagaucccugagaccaca

SEQ ID NO: 804878 - RNA, 21 nt, Human
aggcagccagggacuugggag

SEQ ID NO: 804879 - RNA, 22 nt, Human
aggcagccagggacuugggagc

SEQ ID NO: 804880 - RNA, 23 nt, Human
aggcagccagggacuugggagca

SEQ ID NO: 804881 - RNA, 20 nt, Human
agggacuugggagcagaagg

SEQ ID NO: 804882 - RNA, 22 nt, Human
aguuaccaagaacaugugucac

SEQ ID NO: 804883 - RNA, 19 nt, Human
auaaagcacaguagaaaua

SEQ ID NO: 804884 - RNA, 21 nt, Human
auaacaaaaaaacaugcuccu

SEQ ID NO: 804885 - RNA, 21 nt, Human
auaucguaggcugauccuaaa

SEQ ID NO: 804886 - RNA, 19 nt, Human
augaaggaaccccccugga

SEQ ID NO: 804887 - RNA, 23 nt, Human
auucagcuggaguuccucggaac

SEQ ID NO: 804888 - RNA, 24 nt, Human
auuuucugggcaccaauucccuuc

SEQ ID NO: 804889 - RNA, 21 nt, Human
caaaagaaaagauauuccuca

SEQ ID NO: 804890 - RNA, 19 nt, Human
caaaagcagcagcaggaac

SEQ ID NO: 804891 - RNA, 28 nt, Human
caaaagcagcagcaggaacuggagaccc

SEQ ID NO: 804892 - RNA, 20 nt, Human
caaacacuaggauaacugug

SEQ ID NO: 804893 - RNA, 18 nt, Human
caaagcagccauuaccac

SEQ ID NO: 804894 - RNA, 19 nt, Human
caacaggagaacuuugaca

SEQ ID NO: 804895 - RNA, 19 nt, Human
caacauucacaauaaagaa

SEQ ID NO: 804896 - RNA, 20 nt, Human
caagugcuuagcucuguaca

SEQ ID NO: 804897 - RNA, 21 nt, Human
cacaaagaugcaagcuuuaaa

SEQ ID NO: 804898 - RNA, 18 nt, Human
cacaaggguucgccucca

SEQ ID NO: 804899 - RNA, 22 nt, Human
cacaucacccaagaacaugcua

SEQ ID NO: 804900 - RNA, 20 nt, Human
caccagcaacuaagcugcau

SEQ ID NO: 804901 - RNA, 24 nt, Human
cacuccagucccauuuucugggca

SEQ ID NO: 804902 - RNA, 22 nt, Human
cagaauuucaaauggcuuguca

SEQ ID NO: 804903 - RNA, 22 nt, Human
cagaauuucaaauggcuuguca

SEQ ID NO: 804904 - RNA, 22 nt, Human
cagaucccugagaccacagagg

SEQ ID NO: 804905 - RNA, 19 nt, Human
cagcagcaggaacugguug

SEQ ID NO: 804906 - RNA, 20 nt, Human
cagcagcaggaacugguugg

SEQ ID NO: 804907 - RNA, 18 nt, Human
cagcauuuguccccuggu

SEQ ID NO: 804908 - RNA, 18 nt, Human
cagcuagauuguucaugu

SEQ ID NO: 804909 - RNA, 21 nt, Human
caggaaaagcagcuagcagac

SEQ ID NO: 804910 - RNA, 19 nt, Human
caggcgaagcccagauauc

SEQ ID NO: 804911 - RNA, 26 nt, Human
caguagaaauaaacuggggguaguac

SEQ ID NO: 804912 - RNA, 21 nt, Human
caguuucuauuagaaaaacca

SEQ ID NO: 804913 - RNA, 22 nt, Human
cauaaggaaaacuguucuacau

SEQ ID NO: 804914 - RNA, 22 nt, Human
caucuauggccacucccaagcu

SEQ ID NO: 804915 - RNA, 19 nt, Human
ccaaaaccugagagaccgc

SEQ ID NO: 804916 - RNA, 21 nt, Human
ccaagaagccaaaagcagcag

SEQ ID NO: 804917 - RNA, 20 nt, Human
ccaccccaacaugcuuggau

SEQ ID NO: 804918 - RNA, 19 nt, Human
ccacucccaagcugauacc

SEQ ID NO: 804919 - RNA, 24 nt, Human
ccagagccgcagcguucucucaga

SEQ ID NO: 804920 - RNA, 23 nt, Human
ccaggccuaggcauucaccagca

SEQ ID NO: 804921 - RNA, 19 nt, Human
ccaucagcaacauauauga

SEQ ID NO: 804922 - RNA, 19 nt, Human
cccagagagaccacuggcu

SEQ ID NO: 804923 - RNA, 18 nt, Human
cccagccaggaugaggga

SEQ ID NO: 804924 - RNA, 24 nt, Human
ccucagacucgcaggcagcucaga

SEQ ID NO: 804925 - RNA, 21 nt, Human
ccuccagggagagagagcagg

SEQ ID NO: 804926 - RNA, 22 nt, Human
cucagacccgcagguagaucuc

SEQ ID NO: 804927 - RNA, 23 nt, Human
cucagaccuggcguucaggaaga

SEQ ID NO: 804928 - RNA, 26 nt, Human
cucgcagcucucccuuuccccagcca

SEQ ID NO: 804929 - RNA, 19 nt, Human
cuuccaccccaacaugcuu

SEQ ID NO: 804930 - RNA, 19 nt, Human
gaaaagcagcuagcagaca

SEQ ID NO: 804931 - RNA, 18 nt, Human
gacaaacacauacaaaca

SEQ ID NO: 804932 - RNA, 19 nt, Human
gacaauggaagucgagcac

SEQ ID NO: 804933 - RNA, 23 nt, Human
gaccacagaggcuggccgagaaa

SEQ ID NO: 804934 - RNA, 21 nt, Human
gacuugcaggcgaagcccaga

SEQ ID NO: 804935 - RNA, 20 nt, Human
gagaaaagacauauuugagu

SEQ ID NO: 804936 - RNA, 18 nt, Human
gagaccacagaggcuggc

SEQ ID NO: 804937 - RNA, 21 nt, Human
gagaccacagaggcuggccga

SEQ ID NO: 804938 - RNA, 19 nt, Human
gagcacuggggaaagcagg

SEQ ID NO: 804939 - RNA, 20 nt, Human
gaggcagccagggacuuggg

SEQ ID NO: 804940 - RNA, 23 nt, Human
gagucugaugcaugaguucuaua

SEQ ID NO: 804941 - RNA, 20 nt, Human
gauacaaaugcaugagcaac

SEQ ID NO: 804942 - RNA, 22 nt, Human
gcagaucccugagaccacagag

SEQ ID NO: 804943 - RNA, 22 nt, Human
gccuuggagagggaagugaugg

SEQ ID NO: 804944 - RNA, 27 nt, Human
gcuaagauaaacacugggauguggccc

SEQ ID NO: 804945 - RNA, 20 nt, Human
ggaagggacucugugguucc

SEQ ID NO: 804946 - RNA, 20 nt, Human
ggaagggacucugugguucc

SEQ ID NO: 804947 - RNA, 22 nt, Human
ggacucaauuccacuugcuccu

SEQ ID NO: 804948 - RNA, 18 nt, Human
ggacucugugguuccuuc

SEQ ID NO: 804949 - RNA, 23 nt, Human
ggagauaacauucccaaagcuga

SEQ ID NO: 804950 - RNA, 21 nt, Human
ggcagccagggacuugggagc

SEQ ID NO: 804951 - RNA, 22 nt, Human
gguguggcaauuuaggcagagu

SEQ ID NO: 804952 - RNA, 22 nt, Human
guaaauaacaaaaaaacaugcu

SEQ ID NO: 804953 - RNA, 22 nt, Human
gugcagaggcagccagggacuu

SEQ ID NO: 804954 - RNA, 20 nt, Human
guggcucacagaagcaacag

SEQ ID NO: 804955 - RNA, 21 nt, Human
guguggcaauuuaggcagagu

SEQ ID NO: 804956 - RNA, 20 nt, Human
uaacauucccaaagcugagg

SEQ ID NO: 804957 - RNA, 18 nt, Human
uacaguuaggucauggaa

SEQ ID NO: 804958 - RNA, 19 nt, Human
uacccauaguggcucacag

SEQ ID NO: 804959 - RNA, 20 nt, Human
uaccuggacugagauuagga

SEQ ID NO: 804960 - RNA, 21 nt, Human
uaccuggacugagauuaggaa

SEQ ID NO: 804961 - RNA, 24 nt, Human
uagaaaacaggcacaaaguguuca

SEQ ID NO: 804962 - RNA, 24 nt, Human
uagaauaauacaaacacuaggaua

SEQ ID NO: 804963 - RNA, 19 nt, Human
uagcagacagcgcuccugu

SEQ ID NO: 804964 - RNA, 21 nt, Human
uagcaucaacacuugagauau

SEQ ID NO: 804965 - RNA, 19 nt, Human
uagcugggugcuuagaagc

SEQ ID NO: 804966 - RNA, 19 nt, Human
uagugaagggagucugaug

SEQ ID NO: 804967 - RNA, 23 nt, Human
uauuucuuaauuccuaccuggac

SEQ ID NO: 804968 - RNA, 23 nt, Human
ucaaaagaaaagauauuccucac

SEQ ID NO: 804969 - RNA, 22 nt, Human
ucaggaagauucuagagagcac

SEQ ID NO: 804970 - RNA, 21 nt, Human
uccaaaaccugagagaccgcg

SEQ ID NO: 804971 - RNA, 18 nt, Human
uccacaauugacaaacac

SEQ ID NO: 804972 - RNA, 21 nt, Human
uccacuagaucgucgucucca

SEQ ID NO: 804973 - RNA, 23 nt, Human
uccagggagagagagcaggaaaa

SEQ ID NO: 804974 - RNA, 21 nt, Human
uccccaaagaaaauucauaaa

SEQ ID NO: 804975 - RNA, 22 nt, Human
uccccuggucuucagauuucca

SEQ ID NO: 804976 - RNA, 18 nt, Human
ucccugaaggacucaauu

SEQ ID NO: 804977 - RNA, 19 nt, Human
ucccugagaccacagaggc

SEQ ID NO: 804978 - RNA, 21 nt, Human
uccuaaagacucagauucccg

SEQ ID NO: 804979 - RNA, 20 nt, Human
uccucggaacgggaggacuc

SEQ ID NO: 804980 - RNA, 18 nt, Human
uccuugggaagggacucu

SEQ ID NO: 804981 - RNA, 19 nt, Human
ucgcagcucucccuuuccc

SEQ ID NO: 804982 - RNA, 19 nt, Human
ucgcaggcagcucagaaac

SEQ ID NO: 804983 - RNA, 21 nt, Human
ucguaggcugauccuaaagac

SEQ ID NO: 804984 - RNA, 26 nt, Human
ucuccaaaaccugagagaccgcgaac

SEQ ID NO: 804985 - RNA, 20 nt, Human
ucucccuuuccccagccagg

SEQ ID NO: 804986 - RNA, 21 nt, Human
ucucucagaccuggcguucag

SEQ ID NO: 804987 - RNA, 21 nt, Human
ugaaaaaaggacauuucucac

SEQ ID NO: 804988 - RNA, 25 nt, Human
ugacaaacacauacaaaaggguuuc

SEQ ID NO: 804989 - RNA, 18 nt, Human
ugacauuuauuaaaacca

SEQ ID NO: 804990 - RNA, 22 nt, Human
ugaccaauaccauaaggaaaac

SEQ ID NO: 804991 - RNA, 20 nt, Human
ugagaaaagacauauuugag

SEQ ID NO: 804992 - RNA, 21 nt, Human
ugcaaaaagcauuagugaagg

SEQ ID NO: 804993 - RNA, 19 nt, Human
uggaagauggguuacuuua

SEQ ID NO: 804994 - RNA, 18 nt, Human
uggcagaaagaggagaca

SEQ ID NO: 804995 - RNA, 20 nt, Human
uggccgagaaaccaccagca

SEQ ID NO: 804996 - RNA, 19 nt, Human
ugggaagggacucuguggu

SEQ ID NO: 804997 - RNA, 23 nt, Human
uggggcaagaacaguagggaagg

SEQ ID NO: 804998 - RNA, 21 nt, Human
uggggguacucucaaaagaaa

SEQ ID NO: 804999 - RNA, 23 nt, Human
uguacauacacaugcccugaugc

SEQ ID NO: 805000 - RNA, 24 nt, Human
uguacauacacaugcccugaugca

SEQ ID NO: 805001 - RNA, 19 nt, Human
ugucacccgacaauuaaaa

SEQ ID NO: 805002 - RNA, 19 nt, Human
uuaaagauuagaagggaaa

SEQ ID NO: 805003 - RNA, 22 nt, Human
uuaacaccaaguccuaaaaagc

SEQ ID NO: 805004 - RNA, 19 nt, Human
uuagugaagggagucugau

SEQ ID NO: 805005 - RNA, 23 nt, Human
uucaguuucuauuagaaaaacca

SEQ ID NO: 805006 - RNA, 21 nt, Human
uucaucgugcaaaaucuugcc

SEQ ID NO: 805007 - RNA, 20 nt, Human
uucugcguggggaagagcuc

SEQ ID NO: 805008 - RNA, 23 nt, Human
uuguucauuaauucuccacaacc

SEQ ID NO: 805009 - RNA, 21 nt, Human
uuucuauuagaaaaaccacag

SEQ ID NO: 805010 - RNA, 24 nt, Human
aaaaaaaaaaaaagugacacaagg

SEQ ID NO: 805011 - RNA, 28 nt, Human
aaaaaaaaaaaaagugacacaagguaaa

SEQ ID NO: 805012 - RNA, 22 nt, Human
aaaaaaacaaaacacaacaccu

SEQ ID NO: 805013 - RNA, 23 nt, Human
aaaaaacauuacuuagcacacug

SEQ ID NO: 805014 - RNA, 20 nt, Human
aaaacaaaacacaacaccuc

SEQ ID NO: 805015 - RNA, 20 nt, Human
aaacaaaacacaacaccuca

SEQ ID NO: 805016 - RNA, 21 nt, Human
aaacaagcaaacaugauagaa

SEQ ID NO: 805017 - RNA, 18 nt, Human
aaagaaaaaaagaaaggg

SEQ ID NO: 805018 - RNA, 18 nt, Human
aaauauacaauauguaua

SEQ ID NO: 805019 - RNA, 24 nt, Human
aacaacagcgaaacuccauccccc

SEQ ID NO: 805020 - RNA, 21 nt, Human
aacagcgaaacuccauccccc

SEQ ID NO: 805021 - RNA, 20 nt, Human
aacauggugaaacccugucu

SEQ ID NO: 805022 - RNA, 21 nt, Human
aacauggugaaacccugucuc

SEQ ID NO: 805023 - RNA, 24 nt, Human
aacugaagcaagauagguucacaa

SEQ ID NO: 805024 - RNA, 23 nt, Human
aagaucgugcuauugcacuccag

SEQ ID NO: 805025 - RNA, 24 nt, Human
aagcacaagaaucgcuugaacucg

SEQ ID NO: 805026 - RNA, 24 nt, Human
aauagagugagacccuguuucaaa

SEQ ID NO: 805027 - RNA, 24 nt, Human
aaucacuugaacccgguaggcaga

SEQ ID NO: 805028 - RNA, 20 nt, Human
aaucgcuugaacucgguagg

SEQ ID NO: 805029 - RNA, 24 nt, Human
acaaacacaaaaaaaauuuaagug

SEQ ID NO: 805030 - RNA, 19 nt, Human
acaacagcgaaacuccauc

SEQ ID NO: 805031 - RNA, 20 nt, Human
acaacagcgaaacuccaucc

SEQ ID NO: 805032 - RNA, 20 nt, Human
acagcgaaacuccauccccc

SEQ ID NO: 805033 - RNA, 24 nt, Human
accaacacggagaaacccugucuc

SEQ ID NO: 805034 - RNA, 23 nt, Human
acccugucucuacaaaaauacaa

SEQ ID NO: 805035 - RNA, 24 nt, Human
accugaggucaggaguuugagacc

SEQ ID NO: 805036 - RNA, 24 nt, Human
acuccagccugggcaauagaguga

SEQ ID NO: 805037 - RNA, 23 nt, Human
agaaaaaaaaaaaaaacaaagga

SEQ ID NO: 805038 - RNA, 23 nt, Human
agaaaaaaaaaaaaaacaaagga

SEQ ID NO: 805039 - RNA, 25 nt, Human
agaaaaaaagaaaggguagaaagag

SEQ ID NO: 805040 - RNA, 26 nt, Human
agacaggcagaucaccugaggucagg

SEQ ID NO: 805041 - RNA, 22 nt, Human
agacugggcaacauggugaaac

SEQ ID NO: 805042 - RNA, 24 nt, Human
agacugggcaacauggugaaaccc

SEQ ID NO: 805043 - RNA, 24 nt, Human
agagguugcggugagccaagaucg

SEQ ID NO: 805044 - RNA, 22 nt, Human
agaucaccugaggucaggaguu

SEQ ID NO: 805045 - RNA, 21 nt, Human
agcacaagcaacugacaccuu

SEQ ID NO: 805046 - RNA, 24 nt, Human
agcacuuugggacauccagguggg

SEQ ID NO: 805047 - RNA, 18 nt, Human
agccugaccaacacggag

SEQ ID NO: 805048 - RNA, 22 nt, Human
agccugggcaauagagugagac

SEQ ID NO: 805049 - RNA, 25 nt, Human
agccugggcaauagagugagacccu

SEQ ID NO: 805050 - RNA, 23 nt, Human
agcugggcaugguggugcaugcc

SEQ ID NO: 805051 - RNA, 18 nt, Human
aggaggaaaccaacugaa

SEQ ID NO: 805052 - RNA, 20 nt, Human
aggaguuugagaccagccug

SEQ ID NO: 805053 - RNA, 24 nt, Human
aggcacaagaaucacuugaacccg

SEQ ID NO: 805054 - RNA, 21 nt, Human
aggcagaaggugcagugagcc

SEQ ID NO: 805055 - RNA, 24 nt, Human
aggcagaaggugcagugagccgag

SEQ ID NO: 805056 - RNA, 24 nt, Human
aggcagagguugcggugagccaag

SEQ ID NO: 805057 - RNA, 26 nt, Human
aggcagaucaccugaggucaggaguu

SEQ ID NO: 805058 - RNA, 24 nt, Human
aggcugaagcacaagaaucgcuug

SEQ ID NO: 805059 - RNA, 18 nt, Human
aguccucaagccugugcu

SEQ ID NO: 805060 - RNA, 24 nt, Human
agugcacuccagccugggcaauag

SEQ ID NO: 805061 - RNA, 24 nt, Human
auaaagaauucuuaaaauauacaa

SEQ ID NO: 805062 - RNA, 22 nt, Human
auaaagacucuuuguaagugua

SEQ ID NO: 805063 - RNA, 22 nt, Human
auacuaaaaauguggccaagca

SEQ ID NO: 805064 - RNA, 24 nt, Human
auagagugagacccuguuucaaaa

SEQ ID NO: 805065 - RNA, 20 nt, Human
aucaccugaggucaggaguu

SEQ ID NO: 805066 - RNA, 24 nt, Human
aucaccugaggucaggaguuugag

SEQ ID NO: 805067 - RNA, 24 nt, Human
aucacgccagugcacuccagccug

SEQ ID NO: 805068 - RNA, 24 nt, Human
aucauuaaaaaaacaaaacacaac

SEQ ID NO: 805069 - RNA, 24 nt, Human
aucgugcuauugcacuccagccug

SEQ ID NO: 805070 - RNA, 21 nt, Human
augguccauauaauauuaaaa

SEQ ID NO: 805071 - RNA, 18 nt, Human
auugcacuccagccuggg

SEQ ID NO: 805072 - RNA, 20 nt, Human
auugcacuccagccugggca

SEQ ID NO: 805073 - RNA, 24 nt, Human
auugcacuccagccugggcaacaa

SEQ ID NO: 805074 - RNA, 26 nt, Human
auugcacuccagccugggcaacaaca

SEQ ID NO: 805075 - RNA, 21 nt, Human
caaaaauacaaaaauuagcca

SEQ ID NO: 805076 - RNA, 19 nt, Human
caaaauuagcugggcaugg

SEQ ID NO: 805077 - RNA, 18 nt, Human
caacaacagcgaaacucc

SEQ ID NO: 805078 - RNA, 21 nt, Human
caacaacagcgaaacuccauc

SEQ ID NO: 805079 - RNA, 24 nt, Human
caacacggagaaacccugucucua

SEQ ID NO: 805080 - RNA, 27 nt, Human
caacacggagaaacccugucucuaaua

SEQ ID NO: 805081 - RNA, 22 nt, Human
caacagcgaaacuccauccccc

SEQ ID NO: 805082 - RNA, 22 nt, Human
caacauggugaaacccugucuc

SEQ ID NO: 805083 - RNA, 24 nt, Human
caacauggugaaacccugucucua

SEQ ID NO: 805084 - RNA, 24 nt, Human
caagacaggcagaucaccugaggu

SEQ ID NO: 805085 - RNA, 26 nt, Human
caagacaggcagaucaccugagguca

SEQ ID NO: 805086 - RNA, 20 nt, Human
caauaguacuuagcuuuacc

SEQ ID NO: 805087 - RNA, 21 nt, Human
caauggccaguccacuucuaa

SEQ ID NO: 805088 - RNA, 23 nt, Human
caccugaggucaggaguuugaga

SEQ ID NO: 805089 - RNA, 26 nt, Human
cacgccagugcacuccagccugggca

SEQ ID NO: 805090 - RNA, 19 nt, Human
cacuauauaaagaaaaaaa

SEQ ID NO: 805091 - RNA, 20 nt, Human
cacuauauaaagaaaaaaag

SEQ ID NO: 805092 - RNA, 22 nt, Human
cacuccagccugggcaauagag

SEQ ID NO: 805093 - RNA, 24 nt, Human
cacuccagccugggcaauagagug

SEQ ID NO: 805094 - RNA, 27 nt, Human
cacugccaacaaaugucaacacagaaa

SEQ ID NO: 805095 - RNA, 24 nt, Human
cacuggucuuaaaaaguguuacgc

SEQ ID NO: 805096 - RNA, 21 nt, Human
cagaacuccccugcuucaccu

SEQ ID NO: 805097 - RNA, 24 nt, Human
cagaucaccugaggucaggaguuu

SEQ ID NO: 805098 - RNA, 27 nt, Human
cagaucaccugaggucaggaguuugag

SEQ ID NO: 805099 - RNA, 19 nt, Human
cagccugaccaacacggag

SEQ ID NO: 805100 - RNA, 18 nt, Human
cagccugggcaacaacag

SEQ ID NO: 805101 - RNA, 21 nt, Human
cagcgaaacuccauccccccc

SEQ ID NO: 805102 - RNA, 27 nt, Human
caggaggcugaagcacaagaaucgcuu

SEQ ID NO: 805103 - RNA, 27 nt, Human
caggaggcugaggcacaagaaucacuu

SEQ ID NO: 805104 - RNA, 19 nt, Human
cagugcacuccagccuggg

SEQ ID NO: 805105 - RNA, 22 nt, Human
cagugcacuccagccugggcaa

SEQ ID NO: 805106 - RNA, 23 nt, Human
cagugcacuccagccugggcaau

SEQ ID NO: 805107 - RNA, 24 nt, Human
cagugcacuccagccugggcaaua

SEQ ID NO: 805108 - RNA, 19 nt, Human
caguugaugcuaacuucuu

SEQ ID NO: 805109 - RNA, 21 nt, Human
ccaaauggaauccaaauuguc

SEQ ID NO: 805110 - RNA, 20 nt, Human
ccaggauuccucgcugccga

SEQ ID NO: 805111 - RNA, 21 nt, Human
ccagugcacuccagccugggc

SEQ ID NO: 805112 - RNA, 23 nt, Human
ccagugcacuccagccugggcaa

SEQ ID NO: 805113 - RNA, 24 nt, Human
ccagugcacuccagccugggcaau

SEQ ID NO: 805114 - RNA, 24 nt, Human
ccauaguccuccagccuguuuccc

SEQ ID NO: 805115 - RNA, 23 nt, Human
cccaucugccuaauauuuaggag

SEQ ID NO: 805116 - RNA, 19 nt, Human
cccauggaaucuagcacuu

SEQ ID NO: 805117 - RNA, 19 nt, Human
cccgguaggcagagguugc

SEQ ID NO: 805118 - RNA, 24 nt, Human
ccggaggccaagacaggcagauca

SEQ ID NO: 805119 - RNA, 21 nt, Human
ccuauaaucccagcuacucag

SEQ ID NO: 805120 - RNA, 21 nt, Human
ccuauagucccagcuacucag

SEQ ID NO: 805121 - RNA, 22 nt, Human
ccugaccaacacggagaaaccc

SEQ ID NO: 805122 - RNA, 24 nt, Human
ccugaccaacacggagaaacccug

SEQ ID NO: 805123 - RNA, 22 nt, Human
ccugaggucaggaguuugagac

SEQ ID NO: 805124 - RNA, 24 nt, Human
cgagaucacgccagugcacuccag

SEQ ID NO: 805125 - RNA, 24 nt, Human
cgccagugcacuccagccugggca

SEQ ID NO: 805126 - RNA, 20 nt, Human
cgcugccgauuccacaccgc

SEQ ID NO: 805127 - RNA, 18 nt, Human
cuaaaaauguggccaagc

SEQ ID NO: 805128 - RNA, 19 nt, Human
cuaggagauuagaaauguu

SEQ ID NO: 805129 - RNA, 20 nt, Human
cuauugcacuccagccuggg

SEQ ID NO: 805130 - RNA, 24 nt, Human
cuauugcacuccagccugggcaac

SEQ ID NO: 805131 - RNA, 26 nt, Human
cucauauaacaauauuuuauauuuga

SEQ ID NO: 805132 - RNA, 19 nt, Human
cuccaucccccccuccaaa

SEQ ID NO: 805133 - RNA, 23 nt, Human
cuccgcugagagccuccucaaug

SEQ ID NO: 805134 - RNA, 21 nt, Human
cugggcaacauggugaaaccc

SEQ ID NO: 805135 - RNA, 23 nt, Human
cugggcaacauggugaaacccug

SEQ ID NO: 805136 - RNA, 24 nt, Human
cugggcaacauggugaaacccugu

SEQ ID NO: 805137 - RNA, 23 nt, Human
cuggucuuaaaaaguguuacgcc

SEQ ID NO: 805138 - RNA, 24 nt, Human
cuggucuuaaaaaguguuacgccg

SEQ ID NO: 805139 - RNA, 23 nt, Human
cuugaacucgguaggcagaaggu

SEQ ID NO: 805140 - RNA, 21 nt, Human
gaacucgguaggcagaaggug

SEQ ID NO: 805141 - RNA, 20 nt, Human
gaccauaguccuccagccug

SEQ ID NO: 805142 - RNA, 19 nt, Human
gacccuguuucaaaaagaa

SEQ ID NO: 805143 - RNA, 21 nt, Human
gagcauaacauagacagggca

SEQ ID NO: 805144 - RNA, 22 nt, Human
gaguugauuuuuagucccuauu

SEQ ID NO: 805145 - RNA, 25 nt, Human
gauaaagacucuuuguaaguguaaa

SEQ ID NO: 805146 - RNA, 24 nt, Human
gaucaccugaggucaggaguuuga

SEQ ID NO: 805147 - RNA, 23 nt, Human
gcacuccagccugggcaauagag

SEQ ID NO: 805148 - RNA, 24 nt, Human
gcacuccagccugggcaauagagu

SEQ ID NO: 805149 - RNA, 21 nt, Human
gcagaucaccugaggucagga

SEQ ID NO: 805150 - RNA, 22 nt, Human
gccagugcacuccagccugggc

SEQ ID NO: 805151 - RNA, 26 nt, Human
gccagugcacuccagccugggcaaua

SEQ ID NO: 805152 - RNA, 20 nt, Human
gccuguuucccaguacaaaa

SEQ ID NO: 805153 - RNA, 19 nt, Human
gcgaaacuccauccccccc

SEQ ID NO: 805154 - RNA, 22 nt, Human
gcuauugcacuccagccugggc

SEQ ID NO: 805155 - RNA, 24 nt, Human
gcuauugcacuccagccugggcaa

SEQ ID NO: 805156 - RNA, 23 nt, Human
gcugaagcacaagaaucgcuugg

SEQ ID NO: 805157 - RNA, 21 nt, Human
gcugaucuguccaauaacucc

SEQ ID NO: 805158 - RNA, 18 nt, Human
ggagcuucucugugcucc

SEQ ID NO: 805159 - RNA, 23 nt, Human
ggcaugguggugcaugccuauaa

SEQ ID NO: 805160 - RNA, 24 nt, Human
ggccuauagucccagcuacucagg

SEQ ID NO: 805161 - RNA, 19 nt, Human
ggucaggaguuugagacca

SEQ ID NO: 805162 - RNA, 24 nt, Human
gguggugcaugccuauaaucccag

SEQ ID NO: 805163 - RNA, 18 nt, Human
guauaucugcacuauaua

SEQ ID NO: 805164 - RNA, 23 nt, Human
gugacucacccauggaaucuagc

SEQ ID NO: 805165 - RNA, 20 nt, Human
gugcagugagccgagaucac

SEQ ID NO: 805166 - RNA, 22 nt, Human
guuucaaaaagaaaaaaaaaaa

SEQ ID NO: 805167 - RNA, 23 nt, Human
uaaaaaaacaaaacacaacaccu

SEQ ID NO: 805168 - RNA, 24 nt, Human
uaaaaaaacaaaacacaacaccuc

SEQ ID NO: 805169 - RNA, 21 nt, Human
uaaaaaguguuacgccggagg

SEQ ID NO: 805170 - RNA, 18 nt, Human
uaaaaauacaaaauuagc

SEQ ID NO: 805171 - RNA, 19 nt, Human
uaaaaauacaaaauuagcu

SEQ ID NO: 805172 - RNA, 18 nt, Human
uaaaauauaaucagaugg

SEQ ID NO: 805173 - RNA, 24 nt, Human
uaaagaaaaaaagaaaggguagaa

SEQ ID NO: 805174 - RNA, 20 nt, Human
uaacaaaagguaaaauacug

SEQ ID NO: 805175 - RNA, 22 nt, Human
uaacaaaagguaaaauacuggc

SEQ ID NO: 805176 - RNA, 26 nt, Human
uaacaauauuuuauauuugacagugu

SEQ ID NO: 805177 - RNA, 24 nt, Human
uaaccaaaguccuagaaaaaaguu

SEQ ID NO: 805178 - RNA, 18 nt, Human
uaacuuauucaucaguac

SEQ ID NO: 805179 - RNA, 19 nt, Human
uaagaaaacuucaaaaaug

SEQ ID NO: 805180 - RNA, 19 nt, Human
uacaauagagcauacuaaa

SEQ ID NO: 805181 - RNA, 20 nt, Human
uacaguugaugcuaacuucu

SEQ ID NO: 805182 - RNA, 21 nt, Human
uacauaccauaaauagaugaa

SEQ ID NO: 805183 - RNA, 19 nt, Human
uaggaggaaaccaacugaa

SEQ ID NO: 805184 - RNA, 22 nt, Human
uaggaggaaaccaacugaagca

SEQ ID NO: 805185 - RNA, 21 nt, Human
uaggcagagguugcggugagc

SEQ ID NO: 805186 - RNA, 22 nt, Human
uaggcuaccauuuuaaaguucu

SEQ ID NO: 805187 - RNA, 26 nt, Human
uaguaguaauauuaaaaauaaauuuc

SEQ ID NO: 805188 - RNA, 23 nt, Human
uaguccuccagccuguuucccag

SEQ ID NO: 805189 - RNA, 22 nt, Human
uauugcacuccagccugggcaa

SEQ ID NO: 805190 - RNA, 24 nt, Human
uauugcacuccagccugggcaaca

SEQ ID NO: 805191 - RNA, 22 nt, Human
uauuuugcacacuguauauaaa

SEQ ID NO: 805192 - RNA, 19 nt, Human
ucaaagcugggagcuucuc

SEQ ID NO: 805193 - RNA, 22 nt, Human
ucacaauugaaaaaauuaaagc

SEQ ID NO: 805194 - RNA, 23 nt, Human
ucacgccagugcacuccagccug

SEQ ID NO: 805195 - RNA, 21 nt, Human
ucacuugaacccgguaggcag

SEQ ID NO: 805196 - RNA, 22 nt, Human
ucagcuaagacuuuucucucca

SEQ ID NO: 805197 - RNA, 23 nt, Human
uccagccugggcaauagagugag

SEQ ID NO: 805198 - RNA, 24 nt, Human
uccagccugggcaauagagugaga

SEQ ID NO: 805199 - RNA, 18 nt, Human
uccaucccccccuccaaa

SEQ ID NO: 805200 - RNA, 21 nt, Human
ucccauuuggaauguuuccaa

SEQ ID NO: 805201 - RNA, 27 nt, Human
uccgcugagagccuccucaauggccaa

SEQ ID NO: 805202 - RNA, 26 nt, Human
uccuaaaaaaaaaaaaagugacacaa

SEQ ID NO: 805203 - RNA, 18 nt, Human
uccucgcugccgauucca

SEQ ID NO: 805204 - RNA, 21 nt, Human
ucgcuugaacucgguaggcag

SEQ ID NO: 805205 - RNA, 24 nt, Human
ucgugcuacgaagugagaaacaag

SEQ ID NO: 805206 - RNA, 21 nt, Human
ucuuccauaagaaaacuucaa

SEQ ID NO: 805207 - RNA, 21 nt, Human
ugaaaagaaugaaagugaaaa

SEQ ID NO: 805208 - RNA, 19 nt, Human
ugaagucaauuuucuugag

SEQ ID NO: 805209 - RNA, 21 nt, Human
ugacuaguauuuuaccuuaug

SEQ ID NO: 805210 - RNA, 24 nt, Human
ugagaccagccugaccaacacgga

SEQ ID NO: 805211 - RNA, 22 nt, Human
ugagccaagaucgugcuauugc

SEQ ID NO: 805212 - RNA, 20 nt, Human
ugaggcacaagaaucacuug

SEQ ID NO: 805213 - RNA, 24 nt, Human
ugaggcacaagaaucacuugaacc

SEQ ID NO: 805214 - RNA, 18 nt, Human
ugaggucaggaguuugag

SEQ ID NO: 805215 - RNA, 25 nt, Human
ugaguuuuuccuaaaaaaaaaaaaa

SEQ ID NO: 805216 - RNA, 18 nt, Human
ugcacuccagccugggca

SEQ ID NO: 805217 - RNA, 19 nt, Human
ugcacuccagccugggcaa

SEQ ID NO: 805218 - RNA, 19 nt, Human
ugcacuccagccugggcaa

SEQ ID NO: 805219 - RNA, 20 nt, Human
ugcacuccagccugggcaac

SEQ ID NO: 805220 - RNA, 23 nt, Human
ugccaacaaaugucaacacagaa

SEQ ID NO: 805221 - RNA, 18 nt, Human
ugccuauaaucccagcua

SEQ ID NO: 805222 - RNA, 24 nt, Human
ugccuauaaucccagcuacucagg

SEQ ID NO: 805223 - RNA, 19 nt, Human
uggaacacuuuuaucuaca

SEQ ID NO: 805224 - RNA, 23 nt, Human
uggaauguuuccaacaggaugua

SEQ ID NO: 805225 - RNA, 20 nt, Human
uggauucuaaauuuccaccu

SEQ ID NO: 805226 - RNA, 24 nt, Human
ugggcaacauggugaaacccuguc

SEQ ID NO: 805227 - RNA, 21 nt, Human
ugggcaauagagugagacccu

SEQ ID NO: 805228 - RNA, 22 nt, Human
uggguauaauacacaagucccc

SEQ ID NO: 805229 - RNA, 19 nt, Human
uggucagaguggcucgugc

SEQ ID NO: 805230 - RNA, 20 nt, Human
ugguccauauaauauuaaaa

SEQ ID NO: 805231 - RNA, 22 nt, Human
uggugcaugccuauaaucccag

SEQ ID NO: 805232 - RNA, 24 nt, Human
ugguggugcaugccuauaauccca

SEQ ID NO: 805233 - RNA, 21 nt, Human
uguguauaucugcacuauaua

SEQ ID NO: 805234 - RNA, 22 nt, Human
uuaaaauauauuacaacaucac

SEQ ID NO: 805235 - RNA, 23 nt, Human
uuagaauacuaaaaauguggcca

SEQ ID NO: 805236 - RNA, 24 nt, Human
uuagcugggcaugguggugcaugc

SEQ ID NO: 805237 - RNA, 22 nt, Human
uuaggaggaaaccaacugaagc

SEQ ID NO: 805238 - RNA, 18 nt, Human
uuauaaauguacuucucu

SEQ ID NO: 805239 - RNA, 22 nt, Human
uugauguuuuugaccaagcaug

SEQ ID NO: 805240 - RNA, 22 nt, Human
uugcggugagccaagaucgugc

SEQ ID NO: 805241 - RNA, 18 nt, Human
uuuaccgagaccuauuca

SEQ ID NO: 805242 - RNA, 23 nt, Human
uuuuaucuacaaguuuaaaaaaa

SEQ ID NO: 805243 - RNA, 20 nt, Human
uuuucuaucuuccauaagaa

SEQ ID NO: 805244 - RNA, 20 nt, Human
aaacaaaaauggggcauuga

SEQ ID NO: 805245 - RNA, 19 nt, Human
aagggaggcuggaguacau

SEQ ID NO: 805246 - RNA, 23 nt, Human
acugaacacauaaaagacaugcc

SEQ ID NO: 805247 - RNA, 22 nt, Human
agaagaaaaggacguuucagag

SEQ ID NO: 805248 - RNA, 20 nt, Human
agauaccucagaacaaaaug

SEQ ID NO: 805249 - RNA, 25 nt, Human
aggcaggcugguacaggccggaccc

SEQ ID NO: 805250 - RNA, 19 nt, Human
aggcaggcugguacaggcu

SEQ ID NO: 805251 - RNA, 21 nt, Human
aggugucaaaggccuagaacc

SEQ ID NO: 805252 - RNA, 24 nt, Human
caaaccugcucuuaaaagccacac

SEQ ID NO: 805253 - RNA, 19 nt, Human
caaaggccuagaaccagau

SEQ ID NO: 805254 - RNA, 27 nt, Human
caaauacaaggaaucacacauuuaaau

SEQ ID NO: 805255 - RNA, 24 nt, Human
caaggaagauccagauauucugcc

SEQ ID NO: 805256 - RNA, 20 nt, Human
caauuucagauguaggacac

SEQ ID NO: 805257 - RNA, 23 nt, Human
caccucgguuaaaagaaaaacaa

SEQ ID NO: 805258 - RNA, 20 nt, Human
caguggaauuucucugguug

SEQ ID NO: 805259 - RNA, 26 nt, Human
ccagugagccauucaguugggaugca

SEQ ID NO: 805260 - RNA, 19 nt, Human
ccccuuuaugagaaaugca

SEQ ID NO: 805261 - RNA, 22 nt, Human
cugaacacauaaaagacaugcc

SEQ ID NO: 805262 - RNA, 23 nt, Human
cugauguggacuguguuuccccu

SEQ ID NO: 805263 - RNA, 22 nt, Human
gaacacauaaaagacaugccag

SEQ ID NO: 805264 - RNA, 18 nt, Human
gcucuaaaauccucuggg

SEQ ID NO: 805265 - RNA, 22 nt, Human
gcuggaguacaugauucuucug

SEQ ID NO: 805266 - RNA, 21 nt, Human
gcugguacaggcucccucugg

SEQ ID NO: 805267 - RNA, 23 nt, Human
gugauaggagcaaauacaaggaa

SEQ ID NO: 805268 - RNA, 23 nt, Human
uaaaagaaaaacaaaaauggggc

SEQ ID NO: 805269 - RNA, 20 nt, Human
uaaauuagcaugauagaaac

SEQ ID NO: 805270 - RNA, 24 nt, Human
uaacucauuccucucauucuccuu

SEQ ID NO: 805271 - RNA, 24 nt, Human
uacaaaauccaaggaagauccaga

SEQ ID NO: 805272 - RNA, 19 nt, Human
uacugcaucuuucacucag

SEQ ID NO: 805273 - RNA, 19 nt, Human
uagaaaaaugcauaaccac

SEQ ID NO: 805274 - RNA, 23 nt, Human
uccuccccuuuaugagaaaugca

SEQ ID NO: 805275 - RNA, 19 nt, Human
uccucugggcuuauggcua

SEQ ID NO: 805276 - RNA, 19 nt, Human
uccuggagaaggcaggcug

SEQ ID NO: 805277 - RNA, 18 nt, Human
ugauaggagcaaauacaa

SEQ ID NO: 805278 - RNA, 18 nt, Human
ugcugggcaugaguccca

SEQ ID NO: 805279 - RNA, 21 nt, Human
uguaaaauuccuugcuguaau

SEQ ID NO: 805280 - RNA, 24 nt, Human
uuaacucauuccucucauucuccu

SEQ ID NO: 805281 - RNA, 22 nt, Human
uugcugggcaugagucccaugc

SEQ ID NO: 805282 - RNA, 23 nt, Human
uuucugaaagcuguucuucaggg

SEQ ID NO: 805283 - RNA, 18 nt, Human
uuuuccuaucuacaccuc

SEQ ID NO: 805284 - RNA, 21 nt, Human
aaaaaguaagugccaccgaaa

SEQ ID NO: 805285 - RNA, 19 nt, Human
aaacaaacacaauuagaga

SEQ ID NO: 805286 - RNA, 22 nt, Human
aaacaccuaaauagacauuucu

SEQ ID NO: 805287 - RNA, 20 nt, Human
aaauacauacucucucuaca

SEQ ID NO: 805288 - RNA, 19 nt, Human
aacaagagcacaaaauuca

SEQ ID NO: 805289 - RNA, 22 nt, Human
aaccuuccuccauauuucuuuc

SEQ ID NO: 805290 - RNA, 27 nt, Human
aacgguuugaauguucugaagguuuga

SEQ ID NO: 805291 - RNA, 21 nt, Human
aacuaccagcaacccacuacc

SEQ ID NO: 805292 - RNA, 18 nt, Human
aacuagaaaggaaacaag

SEQ ID NO: 805293 - RNA, 18 nt, Human
aacuuccaucucuugcuc

SEQ ID NO: 805294 - RNA, 20 nt, Human
aacuugcugggauuacaggc

SEQ ID NO: 805295 - RNA, 24 nt, Human
aacuugcugggauuacaggcguga

SEQ ID NO: 805296 - RNA, 19 nt, Human
aagaaacacugcaguugac

SEQ ID NO: 805297 - RNA, 23 nt, Human
aagaggccagagaaauaagagaa

SEQ ID NO: 805298 - RNA, 24 nt, Human
aaggaggccguaacagauaagcac

SEQ ID NO: 805299 - RNA, 22 nt, Human
aaucucugcucacugcaaccuc

SEQ ID NO: 805300 - RNA, 25 nt, Human
aaucugaggcaggaaagggcauggu

SEQ ID NO: 805301 - RNA, 22 nt, Human
aauggacaaaaaaguaucuaaa

SEQ ID NO: 805302 - RNA, 21 nt, Human
aauguaaacaccuaaauagac

SEQ ID NO: 805303 - RNA, 24 nt, Human
aauuuuguauuuuuaguagagaua

SEQ ID NO: 805304 - RNA, 24 nt, Human
acaaagcacaaaggcccucaccag

SEQ ID NO: 805305 - RNA, 21 nt, Human
acagaguuucaguuuccuauu

SEQ ID NO: 805306 - RNA, 18 nt, Human
accaccacaccuggcccc

SEQ ID NO: 805307 - RNA, 22 nt, Human
accauguuuguagaucaugcuc

SEQ ID NO: 805308 - RNA, 19 nt, Human
accgaaaaagcaauaacug

SEQ ID NO: 805309 - RNA, 26 nt, Human
acugcaguugacuguuucauugcauu

SEQ ID NO: 805310 - RNA, 21 nt, Human
agaauggacaaaaaaguaucu

SEQ ID NO: 805311 - RNA, 19 nt, Human
agacaggccaguaggcagg

SEQ ID NO: 805312 - RNA, 18 nt, Human
agacauuaauaagaacaa

SEQ ID NO: 805313 - RNA, 22 nt, Human
agaccugaaauuuaagcccaau

SEQ ID NO: 805314 - RNA, 24 nt, Human
agagauaaaaggaggccguaacag

SEQ ID NO: 805315 - RNA, 18 nt, Human
agauuagaaggcaguaca

SEQ ID NO: 805316 - RNA, 18 nt, Human
agcacaaaauucacuuau

SEQ ID NO: 805317 - RNA, 24 nt, Human
agcagagagugacaugauagggag

SEQ ID NO: 805318 - RNA, 22 nt, Human
agccgccacugacagagagaca

SEQ ID NO: 805319 - RNA, 22 nt, Human
agcuucagauggggaguuuggg

SEQ ID NO: 805320 - RNA, 18 nt, Human
aggaaacaagucugaaua

SEQ ID NO: 805321 - RNA, 22 nt, Human
aggaguuccauauggcuacagc

SEQ ID NO: 805322 - RNA, 19 nt, Human
aggcaggaaagggcauggu

SEQ ID NO: 805323 - RNA, 18 nt, Human
aggggcaaaaaaaguaag

SEQ ID NO: 805324 - RNA, 18 nt, Human
agguauauuuuucccuuc

SEQ ID NO: 805325 - RNA, 20 nt, Human
aguaaaaggcagaggccagc

SEQ ID NO: 805326 - RNA, 25 nt, Human
aguaaaggaaacagaucaaagcugg

SEQ ID NO: 805327 - RNA, 20 nt, Human
aguacaacagaaauuaagag

SEQ ID NO: 805328 - RNA, 21 nt, Human
aguagcuaggauuacaggcau

SEQ ID NO: 805329 - RNA, 23 nt, Human
aguuucaaccauuaacuguuuau

SEQ ID NO: 805330 - RNA, 27 nt, Human
auaauaaugaaaauaagcuuuuguauc

SEQ ID NO: 805331 - RNA, 19 nt, Human
aucaugccuuuggauuucc

SEQ ID NO: 805332 - RNA, 24 nt, Human
augaucugcccgccucagccuccc

SEQ ID NO: 805333 - RNA, 18 nt, Human
augguacuuaauagcuug

SEQ ID NO: 805334 - RNA, 23 nt, Human
auugagaauucguaccagugccu

SEQ ID NO: 805335 - RNA, 22 nt, Human
caaacaaaucaaauacacauug

SEQ ID NO: 805336 - RNA, 26 nt, Human
caacccacuaccuauucucacaaaau

SEQ ID NO: 805337 - RNA, 21 nt, Human
caacucagcuuucucuucuag

SEQ ID NO: 805338 - RNA, 22 nt, Human
caagauuagaaggcaguacaac

SEQ ID NO: 805339 - RNA, 21 nt, Human
cacaagcauacccuuagaggg

SEQ ID NO: 805340 - RNA, 22 nt, Human
cacacaauaugcaucaagcauu

SEQ ID NO: 805341 - RNA, 22 nt, Human
caccaccacgccuggcuaauuu

SEQ ID NO: 805342 - RNA, 19 nt, Human
caccgcccagccugccucc

SEQ ID NO: 805343 - RNA, 23 nt, Human
caccuggccccucauuuucuguu

SEQ ID NO: 805344 - RNA, 24 nt, Human
cacucuuguugcccaggcuggagu

SEQ ID NO: 805345 - RNA, 18 nt, Human
cacugcaaccucugccuc

SEQ ID NO: 805346 - RNA, 21 nt, Human
cacugcaaccucugccucccg

SEQ ID NO: 805347 - RNA, 24 nt, Human
cagaaaaaccuaacuucugauuaa

SEQ ID NO: 805348 - RNA, 24 nt, Human
cagcaacccacuaccuauucuccu

SEQ ID NO: 805349 - RNA, 26 nt, Human
caucacguuacccagucugugguauu

SEQ ID NO: 805350 - RNA, 18 nt, Human
caugcucaggacauagaa

SEQ ID NO: 805351 - RNA, 22 nt, Human
ccaacuugcugggauuacaggc

SEQ ID NO: 805352 - RNA, 22 nt, Human
ccaacuugcugggauuacaggc

SEQ ID NO: 805353 - RNA, 24 nt, Human
ccaacuugcugggauuacaggcgu

SEQ ID NO: 805354 - RNA, 19 nt, Human
ccaagcagugaaacaagaa

SEQ ID NO: 805355 - RNA, 23 nt, Human
ccaagcagugaaacaagaacuga

SEQ ID NO: 805356 - RNA, 21 nt, Human
ccaccgcccagccugccucca

SEQ ID NO: 805357 - RNA, 19 nt, Human
ccacguuggucaggcuggu

SEQ ID NO: 805358 - RNA, 22 nt, Human
ccacguuggucaggcuggucuc

SEQ ID NO: 805359 - RNA, 23 nt, Human
ccacguuggucaggcuggucucg

SEQ ID NO: 805360 - RNA, 18 nt, Human
ccagagcaggcagcagcc

SEQ ID NO: 805361 - RNA, 19 nt, Human
ccagccugccuccagagca

SEQ ID NO: 805362 - RNA, 23 nt, Human
cccguguucaagcaauucuccug

SEQ ID NO: 805363 - RNA, 20 nt, Human
cccuucaaaaauaaacauaa

SEQ ID NO: 805364 - RNA, 24 nt, Human
ccucccguguucaagcaauucucc

SEQ ID NO: 805365 - RNA, 22 nt, Human
ccugaccccagaugaucugccc

SEQ ID NO: 805366 - RNA, 23 nt, Human
ccugaguagcuaggauuacaggc

SEQ ID NO: 805367 - RNA, 24 nt, Human
ccugaguagcuaggauuacaggca

SEQ ID NO: 805368 - RNA, 19 nt, Human
ccuuagaggggcaaaaaaa

SEQ ID NO: 805369 - RNA, 19 nt, Human
cgccacugacagagagaca

SEQ ID NO: 805370 - RNA, 21 nt, Human
cgcccagccugccuccagagc

SEQ ID NO: 805371 - RNA, 22 nt, Human
cggagagacagaagcuagacca

SEQ ID NO: 805372 - RNA, 19 nt, Human
cggccgccaccgcccagcc

SEQ ID NO: 805373 - RNA, 22 nt, Human
cguaacagauaagcacacugua

SEQ ID NO: 805374 - RNA, 18 nt, Human
cuaacuguugcauuggaa

SEQ ID NO: 805375 - RNA, 24 nt, Human
cuaauuuuguauuuuuaguagaga

SEQ ID NO: 805376 - RNA, 19 nt, Human
cuagucuuaauaaucagaa

SEQ ID NO: 805377 - RNA, 23 nt, Human
cucacugcaaccucugccucccg

SEQ ID NO: 805378 - RNA, 26 nt, Human
cuccugaccccagaugaucugcccgc

SEQ ID NO: 805379 - RNA, 24 nt, Human
cuccugaguagcuaggauuacagg

SEQ ID NO: 805380 - RNA, 18 nt, Human
cucuuguugcccaggcug

SEQ ID NO: 805381 - RNA, 21 nt, Human
cugaaucagaaaaaccuaacu

SEQ ID NO: 805382 - RNA, 24 nt, Human
cugaguagcuaggauuacaggcau

SEQ ID NO: 805383 - RNA, 24 nt, Human
cugcaaccucugccucccguguuc

SEQ ID NO: 805384 - RNA, 23 nt, Human
cugccucaggcuccugaguagcu

SEQ ID NO: 805385 - RNA, 19 nt, Human
cuugcccucucuuacccuu

SEQ ID NO: 805386 - RNA, 18 nt, Human
gaacaccaacacuuacag

SEQ ID NO: 805387 - RNA, 20 nt, Human
gaacuuaaggaacaccaaca

SEQ ID NO: 805388 - RNA, 24 nt, Human
gacaaagaaaccaguuaagagaca

SEQ ID NO: 805389 - RNA, 24 nt, Human
gacaaagcacaaaggcccucacca

SEQ ID NO: 805390 - RNA, 24 nt, Human
gaccccagaugaucugcccgccuc

SEQ ID NO: 805391 - RNA, 22 nt, Human
gaguagcuaggauuacaggcau

SEQ ID NO: 805392 - RNA, 24 nt, Human
gaguagcuaggauuacaggcaugc

SEQ ID NO: 805393 - RNA, 22 nt, Human
gaucugagauucagagagacag

SEQ ID NO: 805394 - RNA, 18 nt, Human
gauuacaggcgugagcca

SEQ ID NO: 805395 - RNA, 21 nt, Human
gauuacaggcgugagccacca

SEQ ID NO: 805396 - RNA, 22 nt, Human
gauuacaggcgugagccaccac

SEQ ID NO: 805397 - RNA, 20 nt, Human
gcaccaccacgccuggcuaa

SEQ ID NO: 805398 - RNA, 22 nt, Human
gcaguacaacagaaauuaagag

SEQ ID NO: 805399 - RNA, 22 nt, Human
gcauucucacugagaauucgua

SEQ ID NO: 805400 - RNA, 19 nt, Human
gcccaggcuggaguacaau

SEQ ID NO: 805401 - RNA, 23 nt, Human
gccuaauggagauguuuagguca

SEQ ID NO: 805402 - RNA, 23 nt, Human
gccucagccucccaacuugcugg

SEQ ID NO: 805403 - RNA, 25 nt, Human
gcuggaguacaauggcgcaaucucu

SEQ ID NO: 805404 - RNA, 23 nt, Human
gcuggucucgaacuccugacccc

SEQ ID NO: 805405 - RNA, 19 nt, Human
ggauuacaggcaugcacca

SEQ ID NO: 805406 - RNA, 22 nt, Human
ggauuacaggcaugcaccacca

SEQ ID NO: 805407 - RNA, 19 nt, Human
ggauuacaggcgugagcca

SEQ ID NO: 805408 - RNA, 22 nt, Human
gggaagacggagagacagaagc

SEQ ID NO: 805409 - RNA, 26 nt, Human
gggaagacggagagacagaagcuuca

SEQ ID NO: 805410 - RNA, 19 nt, Human
ggucagagaacugaaagga

SEQ ID NO: 805411 - RNA, 24 nt, Human
guaaauaucucaggagcuaaaauu

SEQ ID NO: 805412 - RNA, 20 nt, Human
guagcuaggauuacaggcau

SEQ ID NO: 805413 - RNA, 26 nt, Human
uaaaacaaacacaauuagagaacuua

SEQ ID NO: 805414 - RNA, 23 nt, Human
uaaaauacaaacaagagcacaaa

SEQ ID NO: 805415 - RNA, 21 nt, Human
uaaaguaaaggaaacagauca

SEQ ID NO: 805416 - RNA, 23 nt, Human
uaaauccaauuaacuaccagcaa

SEQ ID NO: 805417 - RNA, 20 nt, Human
uaacuagaaaggaaacaagu

SEQ ID NO: 805418 - RNA, 23 nt, Human
uaagaacaaaugccaucguuuuc

SEQ ID NO: 805419 - RNA, 20 nt, Human
uaaggaacaccaacacuuac

SEQ ID NO: 805420 - RNA, 21 nt, Human
uaauggagauguuuaggucau

SEQ ID NO: 805421 - RNA, 19 nt, Human
uacaaacaagagcacaaaa

SEQ ID NO: 805422 - RNA, 18 nt, Human
uacaacucagcuuucucu

SEQ ID NO: 805423 - RNA, 18 nt, Human
uacacaagcauacccuua

SEQ ID NO: 805424 - RNA, 24 nt, Human
uacagaccugaaauuuaagcccaa

SEQ ID NO: 805425 - RNA, 22 nt, Human
uacaggcaugcaccaccacgcc

SEQ ID NO: 805426 - RNA, 21 nt, Human
uacaggcgugagccaccacca

SEQ ID NO: 805427 - RNA, 25 nt, Human
uacaggcgugagccaccaccacacc

SEQ ID NO: 805428 - RNA, 18 nt, Human
uacagguauauuuuuccc

SEQ ID NO: 805429 - RNA, 23 nt, Human
uacccuucaaaaauaaacauaac

SEQ ID NO: 805430 - RNA, 22 nt, Human
uacuaaaauccauaugggucag

SEQ ID NO: 805431 - RNA, 23 nt, Human
uagcaaaaugaaacugaugccag

SEQ ID NO: 805432 - RNA, 24 nt, Human
uagcaaaaugaaacugaugccaga

SEQ ID NO: 805433 - RNA, 24 nt, Human
uagcaaacaaaucaaauacacauu

SEQ ID NO: 805434 - RNA, 24 nt, Human
uagcacugagacacauuuuuucca

SEQ ID NO: 805435 - RNA, 18 nt, Human
uaggagacaaaaauugac

SEQ ID NO: 805436 - RNA, 24 nt, Human
uaggauuacaggcaugcaccacca

SEQ ID NO: 805437 - RNA, 22 nt, Human
uaggugacuugcccaagacuac

SEQ ID NO: 805438 - RNA, 23 nt, Human
uauaggugacuugcccaagacua

SEQ ID NO: 805439 - RNA, 21 nt, Human
uauugugagcuauuccuccua

SEQ ID NO: 805440 - RNA, 24 nt, Human
ucacccaccaagauacuguuugaa

SEQ ID NO: 805441 - RNA, 22 nt, Human
ucacucuuguugcccaggcugg

SEQ ID NO: 805442 - RNA, 23 nt, Human
ucacucuuguugcccaggcugga

SEQ ID NO: 805443 - RNA, 19 nt, Human
ucacugcaaccucugccuc

SEQ ID NO: 805444 - RNA, 22 nt, Human
ucacugcaaccucugccucccg

SEQ ID NO: 805445 - RNA, 23 nt, Human
ucacugcaaccucugccucccgu

SEQ ID NO: 805446 - RNA, 27 nt, Human
ucacugcaaccucugccucccguguuc

SEQ ID NO: 805447 - RNA, 18 nt, Human
ucacuggauuuggcaaca

SEQ ID NO: 805448 - RNA, 21 nt, Human
ucaugccuuuggauuucccag

SEQ ID NO: 805449 - RNA, 24 nt, Human
ucauugcauucucacugagaauuc

SEQ ID NO: 805450 - RNA, 23 nt, Human
ucauuugccuauauucaaauccc

SEQ ID NO: 805451 - RNA, 24 nt, Human
uccacagaguuucaguuuccuauu

SEQ ID NO: 805452 - RNA, 24 nt, Human
ucccaacuugcugggauuacaggc

SEQ ID NO: 805453 - RNA, 19 nt, Human
ucccagguuccagaacugu

SEQ ID NO: 805454 - RNA, 21 nt, Human
ucccguguucaagcaauucuc

SEQ ID NO: 805455 - RNA, 24 nt, Human
ucccguguucaagcaauucuccug

SEQ ID NO: 805456 - RNA, 23 nt, Human
uccugaaucagaaaaaccuaacu

SEQ ID NO: 805457 - RNA, 23 nt, Human
uccugaccccagaugaucugccc

SEQ ID NO: 805458 - RNA, 19 nt, Human
uccugaguagcuaggauua

SEQ ID NO: 805459 - RNA, 24 nt, Human
uccugaguagcuaggauuacaggc

SEQ ID NO: 805460 - RNA, 18 nt, Human
ucggccgccaccgcccag

SEQ ID NO: 805461 - RNA, 21 nt, Human
ucuaucaaauuucucugaggu

SEQ ID NO: 805462 - RNA, 21 nt, Human
ucucugagguacucacucauu

SEQ ID NO: 805463 - RNA, 21 nt, Human
ucugcccgccucagccuccca

SEQ ID NO: 805464 - RNA, 24 nt, Human
ucugccucccguguucaagcaauu

SEQ ID NO: 805465 - RNA, 20 nt, Human
ucuuuguacauucaaaagga

SEQ ID NO: 805466 - RNA, 24 nt, Human
ugaaaaaauaaucucagugaguuu

SEQ ID NO: 805467 - RNA, 20 nt, Human
ugaaaacuuaugcuaacugu

SEQ ID NO: 805468 - RNA, 26 nt, Human
ugaagaaaugaugacacuagguagaa

SEQ ID NO: 805469 - RNA, 21 nt, Human
ugaaucagaaaaaccuaacuu

SEQ ID NO: 805470 - RNA, 28 nt, Human
ugacaaagcacaaaggcccucaccagau

SEQ ID NO: 805471 - RNA, 19 nt, Human
ugacagagagacaagccgg

SEQ ID NO: 805472 - RNA, 19 nt, Human
ugagagcaagaggccagag

SEQ ID NO: 805473 - RNA, 21 nt, Human
ugagaguuuucacuggauuug

SEQ ID NO: 805474 - RNA, 21 nt, Human
ugaggaggcaaaauuuaagcu

SEQ ID NO: 805475 - RNA, 21 nt, Human
ugaguuccaaaaaaaaaaaaa

SEQ ID NO: 805476 - RNA, 22 nt, Human
ugauggaggccaagauuagaag

SEQ ID NO: 805477 - RNA, 21 nt, Human
ugcccaggcuggaguacaaug

SEQ ID NO: 805478 - RNA, 24 nt, Human
ugcccaggcuggaguacaauggcg

SEQ ID NO: 805479 - RNA, 21 nt, Human
ugccucaggcuccugaguagc

SEQ ID NO: 805480 - RNA, 24 nt, Human
ugccucaggcuccugaguagcuag

SEQ ID NO: 805481 - RNA, 24 nt, Human
ugcugggauuacaggcgugagcca

SEQ ID NO: 805482 - RNA, 24 nt, Human
uggacaaaaaaguaucuaaaagcu

SEQ ID NO: 805483 - RNA, 18 nt, Human
ugggauuacaggcgugag

SEQ ID NO: 805484 - RNA, 19 nt, Human
ugggauuacaggcgugagc

SEQ ID NO: 805485 - RNA, 22 nt, Human
ugggauuacaggcgugagccac

SEQ ID NO: 805486 - RNA, 23 nt, Human
ugggauuacaggcgugagccacc

SEQ ID NO: 805487 - RNA, 24 nt, Human
ugggauuacaggcgugagccacca

SEQ ID NO: 805488 - RNA, 19 nt, Human
uggggaguuugggaaggca

SEQ ID NO: 805489 - RNA, 20 nt, Human
ugguacuuaauagcuuggau

SEQ ID NO: 805490 - RNA, 24 nt, Human
uggucaggcuggucucgaacuccu

SEQ ID NO: 805491 - RNA, 18 nt, Human
ugugauaaggauggugag

SEQ ID NO: 805492 - RNA, 23 nt, Human
uuaacuaccagcaacccacuacc

SEQ ID NO: 805493 - RNA, 23 nt, Human
uuaauagcuuggauuuucucauu

SEQ ID NO: 805494 - RNA, 24 nt, Human
uuacagaugaaaaaauaaucucag

SEQ ID NO: 805495 - RNA, 21 nt, Human
uucaagcaauucuccugccuc

SEQ ID NO: 805496 - RNA, 25 nt, Human
uucaagcaauucuccugccucaggc

SEQ ID NO: 805497 - RNA, 24 nt, Human
uucacucuuguugcccaggcugga

SEQ ID NO: 805498 - RNA, 19 nt, Human
uucagguagccaagucacc

SEQ ID NO: 805499 - RNA, 23 nt, Human
uuccagaacugugagccaaauaa

SEQ ID NO: 805500 - RNA, 23 nt, Human
uucuccugccucaggcuccugag

SEQ ID NO: 805501 - RNA, 19 nt, Human
uugaaugcuacaaaaagca

SEQ ID NO: 805502 - RNA, 24 nt, Human
uuucacucuuguugcccaggcugg

SEQ ID NO: 805503 - RNA, 24 nt, Human
uuuccuuaauaaaauacaaacaag

SEQ ID NO: 805504 - RNA, 19 nt, Human
uuuuguauuuuuaguagag

SEQ ID NO: 805505 - RNA, 20 nt, Human
uuuuguauuuuuaguagaga

SEQ ID NO: 805506 - RNA, 19 nt, Human
aaaaaaacuugcugaagca

SEQ ID NO: 805507 - RNA, 23 nt, Human
aaaaaaauagaaaauacucaaga

SEQ ID NO: 805508 - RNA, 21 nt, Human
aaaaaagaaaacccagaucau

SEQ ID NO: 805509 - RNA, 23 nt, Human
aaaaaagacaaauccauaauaug

SEQ ID NO: 805510 - RNA, 20 nt, Human
aaaaaauacuauagaagaau

SEQ ID NO: 805511 - RNA, 22 nt, Human
aaaauacaccaaagaaauauga

SEQ ID NO: 805512 - RNA, 20 nt, Human
aaaauacucaagagcuguga

SEQ ID NO: 805513 - RNA, 18 nt, Human
aaacaagucacuuguccu

SEQ ID NO: 805514 - RNA, 18 nt, Human
aaacaugacuauuguaac

SEQ ID NO: 805515 - RNA, 23 nt, Human
aaacuguaaggcccuuaguuugg

SEQ ID NO: 805516 - RNA, 21 nt, Human
aaacuguugguacccaaccca

SEQ ID NO: 805517 - RNA, 23 nt, Human
aaacuuggaagaaucacugaaua

SEQ ID NO: 805518 - RNA, 18 nt, Human
aaagaaagagaagugaau

SEQ ID NO: 805519 - RNA, 21 nt, Human
aaagaaagagaagugaauuca

SEQ ID NO: 805520 - RNA, 24 nt, Human
aaagcgaagcuaauagcuuauaaa

SEQ ID NO: 805521 - RNA, 19 nt, Human
aaauagcuuuaaaaaaaga

SEQ ID NO: 805522 - RNA, 26 nt, Human
aacaaaaugagcaaaaaauacacuaa

SEQ ID NO: 805523 - RNA, 22 nt, Human
aacaagaagaacaguccccucg

SEQ ID NO: 805524 - RNA, 21 nt, Human
aagaaaaaccuaaagccaucu

SEQ ID NO: 805525 - RNA, 20 nt, Human
aagagacccuuuccaguuca

SEQ ID NO: 805526 - RNA, 20 nt, Human
aagcaaaguaucagaggccc

SEQ ID NO: 805527 - RNA, 22 nt, Human
aagcaaaguaucagaggcccca

SEQ ID NO: 805528 - RNA, 21 nt, Human
aagcccagguacucgcagcag

SEQ ID NO: 805529 - RNA, 23 nt, Human
aagucuuaagacacuagaagggg

SEQ ID NO: 805530 - RNA, 18 nt, Human
acaaaauaaauacuguac

SEQ ID NO: 805531 - RNA, 19 nt, Human
acaaauccauaauauggcc

SEQ ID NO: 805532 - RNA, 22 nt, Human
acaccaagucccuguaugacca

SEQ ID NO: 805533 - RNA, 18 nt, Human
acagacuuuuuucuucuu

SEQ ID NO: 805534 - RNA, 23 nt, Human
acaguagauguuugauaaauacc

SEQ ID NO: 805535 - RNA, 18 nt, Human
acaguaugcaccuuggau

SEQ ID NO: 805536 - RNA, 24 nt, Human
accaauacuaccccuccccaucac

SEQ ID NO: 805537 - RNA, 21 nt, Human
accccuccccaucacccccca

SEQ ID NO: 805538 - RNA, 23 nt, Human
accucccagccacaccccacgcc

SEQ ID NO: 805539 - RNA, 18 nt, Human
acuaccccuccccaucac

SEQ ID NO: 805540 - RNA, 20 nt, Human
acugaaaauacaucaagaca

SEQ ID NO: 805541 - RNA, 26 nt, Human
agaaaaaaauagaaaauacucaagag

SEQ ID NO: 805542 - RNA, 22 nt, Human
agaaaagcaaaaaucacaagaa

SEQ ID NO: 805543 - RNA, 22 nt, Human
agaaaggcuacuucauaaacua

SEQ ID NO: 805544 - RNA, 20 nt, Human
agacaggguuuacacggguu

SEQ ID NO: 805545 - RNA, 25 nt, Human
agagggaaggugggauauaaggucg

SEQ ID NO: 805546 - RNA, 19 nt, Human
agauaucaucagcagaaau

SEQ ID NO: 805547 - RNA, 22 nt, Human
aggaaaaaaauacuauagaaga

SEQ ID NO: 805548 - RNA, 23 nt, Human
aggaaaaaaauacuauagaagaa

SEQ ID NO: 805549 - RNA, 18 nt, Human
aggauacugaacuacuac

SEQ ID NO: 805550 - RNA, 19 nt, Human
aggcaaaagaugggaaaua

SEQ ID NO: 805551 - RNA, 25 nt, Human
agggaagaauggcugcaacagcagc

SEQ ID NO: 805552 - RNA, 22 nt, Human
agggggaaggggagaaccuaag

SEQ ID NO: 805553 - RNA, 21 nt, Human
aguaaauaccagagccaacaa

SEQ ID NO: 805554 - RNA, 21 nt, Human
aguagaaaagucuuuucugaa

SEQ ID NO: 805555 - RNA, 21 nt, Human
augauggggagugcagaggga

SEQ ID NO: 805556 - RNA, 20 nt, Human
auuaauuaccaaguugaagc

SEQ ID NO: 805557 - RNA, 19 nt, Human
auuacuguuaagcccaggu

SEQ ID NO: 805558 - RNA, 20 nt, Human
auucucaccuuucuaaccac

SEQ ID NO: 805559 - RNA, 22 nt, Human
auuuaaaaaccuucacauucuu

SEQ ID NO: 805560 - RNA, 30 nt, Human
caaaauaaaaacaugacuauuguaacaccu

SEQ ID NO: 805561 - RNA, 24 nt, Human
caaaauaaaauucaagcccugaca

SEQ ID NO: 805562 - RNA, 20 nt, Human
caacaagaagaacagucccc

SEQ ID NO: 805563 - RNA, 22 nt, Human
caacaagcucauugcuuuggaa

SEQ ID NO: 805564 - RNA, 20 nt, Human
caacagcaacagaaugagaa

SEQ ID NO: 805565 - RNA, 24 nt, Human
caagaagaacaguccccucggacc

SEQ ID NO: 805566 - RNA, 20 nt, Human
caagacacuaccaacaacaa

SEQ ID NO: 805567 - RNA, 20 nt, Human
caagggcagagaccacaacu

SEQ ID NO: 805568 - RNA, 22 nt, Human
cacacgggcuacuccaaauuag

SEQ ID NO: 805569 - RNA, 22 nt, Human
cacaguaccuucacuuuagaau

SEQ ID NO: 805570 - RNA, 20 nt, Human
caccaagucccuguaugacc

SEQ ID NO: 805571 - RNA, 20 nt, Human
cacccauuuuacuccaaauc

SEQ ID NO: 805572 - RNA, 22 nt, Human
cacccauuuuacuccaaaucca

SEQ ID NO: 805573 - RNA, 19 nt, Human
caccccaccucccagccac

SEQ ID NO: 805574 - RNA, 24 nt, Human
caccccaccucccagccacacccc

SEQ ID NO: 805575 - RNA, 19 nt, Human
caccucaggucccugacug

SEQ ID NO: 805576 - RNA, 18 nt, Human
cacgcaaaucacuguccc

SEQ ID NO: 805577 - RNA, 27 nt, Human
cagaaacaaaauaaauacuguacacuu

SEQ ID NO: 805578 - RNA, 22 nt, Human
cagcagaaaugaaaaugcaaaa

SEQ ID NO: 805579 - RNA, 22 nt, Human
cagcagcaguacgaagaaggcc

SEQ ID NO: 805580 - RNA, 21 nt, Human
cagguacucgcagcagcuacc

SEQ ID NO: 805581 - RNA, 24 nt, Human
cagguauggagcauaaaaguauca

SEQ ID NO: 805582 - RNA, 20 nt, Human
caguauuaagauuacauuac

SEQ ID NO: 805583 - RNA, 20 nt, Human
cagucacucugaaccagaaa

SEQ ID NO: 805584 - RNA, 23 nt, Human
caugaaaaagagggaagggcuuc

SEQ ID NO: 805585 - RNA, 21 nt, Human
ccaaaagcacccauuuuacuc

SEQ ID NO: 805586 - RNA, 23 nt, Human
ccaaagaaauaugagaguauguc

SEQ ID NO: 805587 - RNA, 22 nt, Human
ccacacacgggcuacuccaaau

SEQ ID NO: 805588 - RNA, 20 nt, Human
ccagauacuuaaccucaaua

SEQ ID NO: 805589 - RNA, 21 nt, Human
ccaugagauaaagggaugcau

SEQ ID NO: 805590 - RNA, 20 nt, Human
cccaacaagaagaacagucc

SEQ ID NO: 805591 - RNA, 21 nt, Human
cccaccucccagccacacccc

SEQ ID NO: 805592 - RNA, 20 nt, Human
cccacgcaaaucacugucca

SEQ ID NO: 805593 - RNA, 21 nt, Human
cccagauccacugugucuccc

SEQ ID NO: 805594 - RNA, 20 nt, Human
cccaucaccccccaaaaaaa

SEQ ID NO: 805595 - RNA, 21 nt, Human
cccauuuuacuccaaauccau

SEQ ID NO: 805596 - RNA, 21 nt, Human
ccccaacaagaagaacagucc

SEQ ID NO: 805597 - RNA, 18 nt, Human
ccccacaaguucccuggg

SEQ ID NO: 805598 - RNA, 20 nt, Human
ccccaccagguccaaaaugg

SEQ ID NO: 805599 - RNA, 21 nt, Human
ccccaucaccccccaaaaaaa

SEQ ID NO: 805600 - RNA, 22 nt, Human
ccccccaaaaaaacuugcugaa

SEQ ID NO: 805601 - RNA, 19 nt, Human
ccccuccccaucacccccc

SEQ ID NO: 805602 - RNA, 22 nt, Human
ccccuccccaucaccccccaaa

SEQ ID NO: 805603 - RNA, 19 nt, Human
ccccuuucuuuccaccugg

SEQ ID NO: 805604 - RNA, 22 nt, Human
cccuccuucuuccucuccccca

SEQ ID NO: 805605 - RNA, 18 nt, Human
ccuaaagccaucuuucag

SEQ ID NO: 805606 - RNA, 18 nt, Human
ccuacacugguuucuuuc

SEQ ID NO: 805607 - RNA, 18 nt, Human
ccucauucuccccacaag

SEQ ID NO: 805608 - RNA, 22 nt, Human
ccuucaccuuuaucuaguaccu

SEQ ID NO: 805609 - RNA, 22 nt, Human
cgcugaaaguuuucuaacuuag

SEQ ID NO: 805610 - RNA, 23 nt, Human
cuaaaaccaauacuaccccuccc

SEQ ID NO: 805611 - RNA, 23 nt, Human
cuaaauacaacuuuaaacaaguc

SEQ ID NO: 805612 - RNA, 23 nt, Human
cuaaauuagugagauauuucucc

SEQ ID NO: 805613 - RNA, 20 nt, Human
cuacuaaaaaugaauccaca

SEQ ID NO: 805614 - RNA, 19 nt, Human
cuaggacaccaccaagacu

SEQ ID NO: 805615 - RNA, 24 nt, Human
cucccagccacaccccacgccauu

SEQ ID NO: 805616 - RNA, 23 nt, Human
cuccccacaaguucccuggggag

SEQ ID NO: 805617 - RNA, 23 nt, Human
cugaaaauacaucaagacacuac

SEQ ID NO: 805618 - RNA, 19 nt, Human
cuucuaggaaggcuacagu

SEQ ID NO: 805619 - RNA, 24 nt, Human
gaacaucaucucauagggcaagcc

SEQ ID NO: 805620 - RNA, 22 nt, Human
gaagaacaguccccucggaccg

SEQ ID NO: 805621 - RNA, 22 nt, Human
gaagauaccuucaagggcagag

SEQ ID NO: 805622 - RNA, 21 nt, Human
gaagcaaaguaucagaggccc

SEQ ID NO: 805623 - RNA, 19 nt, Human
gacauuuugaaaaagaaau

SEQ ID NO: 805624 - RNA, 25 nt, Human
gagacccuuuccaguucaaggcacc

SEQ ID NO: 805625 - RNA, 19 nt, Human
gagugcagagggaaggugg

SEQ ID NO: 805626 - RNA, 23 nt, Human
gccacaccccacgccauugucac

SEQ ID NO: 805627 - RNA, 21 nt, Human
gcugaguaaaaaaaagacaaa

SEQ ID NO: 805628 - RNA, 19 nt, Human
gcuguuuuaggaagcaaag

SEQ ID NO: 805629 - RNA, 21 nt, Human
ggaccgugggcauaaaaacca

SEQ ID NO: 805630 - RNA, 20 nt, Human
gggaaaauagaagcuacuau

SEQ ID NO: 805631 - RNA, 23 nt, Human
gggaugguacuuuccuaauucuu

SEQ ID NO: 805632 - RNA, 18 nt, Human
gggcuuguuuccucugag

SEQ ID NO: 805633 - RNA, 23 nt, Human
ggggaugguacuuuccuaauucu

SEQ ID NO: 805634 - RNA, 24 nt, Human
gguaaacuacuuggagaucaaggg

SEQ ID NO: 805635 - RNA, 19 nt, Human
guaaaaaaaagacaaaucc

SEQ ID NO: 805636 - RNA, 22 nt, Human
guaaaggaaaaaagaaaaccca

SEQ ID NO: 805637 - RNA, 20 nt, Human
gugcuaaaaaaaucaaaaca

SEQ ID NO: 805638 - RNA, 23 nt, Human
uaaaacagaaacaaaauaaauac

SEQ ID NO: 805639 - RNA, 19 nt, Human
uaaagggaugcauuauggc

SEQ ID NO: 805640 - RNA, 20 nt, Human
uaaaguagcaugcccugggc

SEQ ID NO: 805641 - RNA, 22 nt, Human
uaaauacacacaaaagaucuau

SEQ ID NO: 805642 - RNA, 20 nt, Human
uaaccaccucauucucccca

SEQ ID NO: 805643 - RNA, 23 nt, Human
uaaccagauacuuaaccucaaua

SEQ ID NO: 805644 - RNA, 30 nt, Human
uaagaaauaaaaaaaguaaauacacacaaa

SEQ ID NO: 805645 - RNA, 19 nt, Human
uaagcuacuuaaagacuua

SEQ ID NO: 805646 - RNA, 21 nt, Human
uaagguauaaccucugcagca

SEQ ID NO: 805647 - RNA, 24 nt, Human
uaagugacuuauucaagguuacac

SEQ ID NO: 805648 - RNA, 22 nt, Human
uaauguggaaguuauacguagc

SEQ ID NO: 805649 - RNA, 20 nt, Human
uaauuccaugacuuccuuca

SEQ ID NO: 805650 - RNA, 26 nt, Human
uacaaaacuaguaaauaccagagcca

SEQ ID NO: 805651 - RNA, 18 nt, Human
uacaguuucgaaagguuu

SEQ ID NO: 805652 - RNA, 18 nt, Human
uaccacaaaguucagcca

SEQ ID NO: 805653 - RNA, 23 nt, Human
uaccacugaaaauacaucaagac

SEQ ID NO: 805654 - RNA, 25 nt, Human
uaccacugaaaauacaucaagacac

SEQ ID NO: 805655 - RNA, 20 nt, Human
uacccagauaagauucagac

SEQ ID NO: 805656 - RNA, 23 nt, Human
uacccaucuuuccacugguuuug

SEQ ID NO: 805657 - RNA, 24 nt, Human
uacccuaccacugaaaauacauca

SEQ ID NO: 805658 - RNA, 21 nt, Human
uagaagcuacuauaagcaaau

SEQ ID NO: 805659 - RNA, 25 nt, Human
uagcaaaacguuacuacaaaacuag

SEQ ID NO: 805660 - RNA, 22 nt, Human
uauacugugugggaagguaggg

SEQ ID NO: 805661 - RNA, 20 nt, Human
uaucaucagcagaaaugaaa

SEQ ID NO: 805662 - RNA, 21 nt, Human
uauuccaacaugcuugcuucu

SEQ ID NO: 805663 - RNA, 22 nt, Human
uauuccaaucaacucuaucuau

SEQ ID NO: 805664 - RNA, 19 nt, Human
ucaaaacagaaguaauaca

SEQ ID NO: 805665 - RNA, 18 nt, Human
ucaaggaagcacaugaac

SEQ ID NO: 805666 - RNA, 18 nt, Human
ucacagauuugaaaccuc

SEQ ID NO: 805667 - RNA, 21 nt, Human
ucacaguaaaugugaaaguuc

SEQ ID NO: 805668 - RNA, 21 nt, Human
ucagagugucacaggucuugc

SEQ ID NO: 805669 - RNA, 19 nt, Human
ucagcagaaaugaaaaugc

SEQ ID NO: 805670 - RNA, 21 nt, Human
ucagcagaaaugaaaaugcaa

SEQ ID NO: 805671 - RNA, 21 nt, Human
ucauagggcaagccgaaaacu

SEQ ID NO: 805672 - RNA, 22 nt, Human
uccaaauuuacaaaugagaaaa

SEQ ID NO: 805673 - RNA, 19 nt, Human
uccaauggaucccagcuga

SEQ ID NO: 805674 - RNA, 22 nt, Human
uccacacacgggcuacuccaaa

SEQ ID NO: 805675 - RNA, 22 nt, Human
uccacugugucuccccacgcaa

SEQ ID NO: 805676 - RNA, 22 nt, Human
uccccaucaccccccaaaaaaa

SEQ ID NO: 805677 - RNA, 25 nt, Human
uccccuuucuuuccaccugguuuca

SEQ ID NO: 805678 - RNA, 18 nt, Human
ucuccagaaaucuuccaa

SEQ ID NO: 805679 - RNA, 24 nt, Human
ucucuuaaaaugaaccuuuucacc

SEQ ID NO: 805680 - RNA, 21 nt, Human
ucuguaaaaauaaaagguuac

SEQ ID NO: 805681 - RNA, 22 nt, Human
ucuuccccuuucuuuccaccug

SEQ ID NO: 805682 - RNA, 19 nt, Human
ugaaaaagaaauggccaaa

SEQ ID NO: 805683 - RNA, 19 nt, Human
ugaaaaaggcagaaagaau

SEQ ID NO: 805684 - RNA, 20 nt, Human
ugaaaaaggcagaaagaauc

SEQ ID NO: 805685 - RNA, 24 nt, Human
ugaaaauacaucaagacacuacca

SEQ ID NO: 805686 - RNA, 21 nt, Human
ugaaccagaaaggcuacuuca

SEQ ID NO: 805687 - RNA, 23 nt, Human
ugaagcacuggcaaaguuagaca

SEQ ID NO: 805688 - RNA, 19 nt, Human
ugaagcauuucuuuaauug

SEQ ID NO: 805689 - RNA, 23 nt, Human
ugaauucagagugucacaggucu

SEQ ID NO: 805690 - RNA, 26 nt, Human
ugacaagagacccuuuccaguucaag

SEQ ID NO: 805691 - RNA, 22 nt, Human
ugacauuguaaauuauaaucca

SEQ ID NO: 805692 - RNA, 23 nt, Human
ugacuaaagaaaaaaauagaaaa

SEQ ID NO: 805693 - RNA, 20 nt, Human
ugagaagaaaaucacaaugu

SEQ ID NO: 805694 - RNA, 24 nt, Human
ugagauaagaugacucuacccauc

SEQ ID NO: 805695 - RNA, 18 nt, Human
ugccccacccccagaaau

SEQ ID NO: 805696 - RNA, 20 nt, Human
ugcuaaaaaaaucaaaacag

SEQ ID NO: 805697 - RNA, 23 nt, Human
ugcugaguggguguggcacagug

SEQ ID NO: 805698 - RNA, 22 nt, Human
ugcuuuggaaauagacauuugc

SEQ ID NO: 805699 - RNA, 18 nt, Human
uggaaaaacuauaaacau

SEQ ID NO: 805700 - RNA, 23 nt, Human
uggaaagaauacuaaauacaacu

SEQ ID NO: 805701 - RNA, 22 nt, Human
uggaaauagacauuugcuuccu

SEQ ID NO: 805702 - RNA, 18 nt, Human
uggaauggggacacaaga

SEQ ID NO: 805703 - RNA, 20 nt, Human
uggcacagugaaaaugcagc

SEQ ID NO: 805704 - RNA, 18 nt, Human
uggggagugcagagggaa

SEQ ID NO: 805705 - RNA, 22 nt, Human
uggggagugcagagggaaggug

SEQ ID NO: 805706 - RNA, 20 nt, Human
uguggcccuuccccacaugu

SEQ ID NO: 805707 - RNA, 22 nt, Human
ugugggaagguaggggaaucag

SEQ ID NO: 805708 - RNA, 19 nt, Human
uguggggaugguacuuucc

SEQ ID NO: 805709 - RNA, 23 nt, Human
uguugagaagaaaaucacaaugu

SEQ ID NO: 805710 - RNA, 23 nt, Human
uguuuuuggaaaaauugagguuu

SEQ ID NO: 805711 - RNA, 22 nt, Human
uuaccaaccaaaauacaccaaa

SEQ ID NO: 805712 - RNA, 18 nt, Human
uuagugaaauagugcaga

SEQ ID NO: 805713 - RNA, 21 nt, Human
uucacaguaaaugugaaaguu

SEQ ID NO: 805714 - RNA, 20 nt, Human
uuccacugguuuuggcauag

SEQ ID NO: 805715 - RNA, 20 nt, Human
uuccaguucaaggucucuuu

SEQ ID NO: 805716 - RNA, 24 nt, Human
uucgacaaaagcccaggucuucug

SEQ ID NO: 805717 - RNA, 20 nt, Human
uugaaaaaggcagaaagaaa

SEQ ID NO: 805718 - RNA, 20 nt, Human
uugggaacauuucugcccca

SEQ ID NO: 805719 - RNA, 27 nt, Human
uuuaaaaaccuucacauucuuacaucu

SEQ ID NO: 805720 - RNA, 27 nt, Human
uuuaagguucuacccuccuucuuccuc

SEQ ID NO: 805721 - RNA, 24 nt, Human
uuuccacagcaugaaacuguuaug

SEQ ID NO: 805722 - RNA, 18 nt, Human
uuugaaaaaggcagaaag

SEQ ID NO: 805723 - RNA, 23 nt, Human
uuugaaaccucuaaaaccaauac

SEQ ID NO: 805724 - RNA, 20 nt, Human
aacagguaacagacccaggg

SEQ ID NO: 805725 - RNA, 22 nt, Human
aacagguaacagacccagggug

SEQ ID NO: 805726 - RNA, 19 nt, Human
aaccacagucucaaguccc

SEQ ID NO: 805727 - RNA, 23 nt, Human
aagaaauauugcauaugaggagg

SEQ ID NO: 805728 - RNA, 23 nt, Human
aagaaucacccacuuucagaauc

SEQ ID NO: 805729 - RNA, 18 nt, Human
aagcagcauccuuccugg

SEQ ID NO: 805730 - RNA, 20 nt, Human
aagcagcuugcucacucagg

SEQ ID NO: 805731 - RNA, 23 nt, Human
aagcaggugagaugucaccagag

SEQ ID NO: 805732 - RNA, 28 nt, Human
aagcggguggcggagugggaggucgacc

SEQ ID NO: 805733 - RNA, 19 nt, Human
aagcuccagggucuuuugc

SEQ ID NO: 805734 - RNA, 21 nt, Human
aagcuuuuguguauaaauguu

SEQ ID NO: 805735 - RNA, 18 nt, Human
aagucccagaagcuucag

SEQ ID NO: 805736 - RNA, 18 nt, Human
aaucccaggacgcuccuc

SEQ ID NO: 805737 - RNA, 25 nt, Human
acacagcauguucgcuauugucucc

SEQ ID NO: 805738 - RNA, 23 nt, Human
acacuccagggcagcagccagac

SEQ ID NO: 805739 - RNA, 22 nt, Human
acacucuuccuccaggucucca

SEQ ID NO: 805740 - RNA, 18 nt, Human
acagaccgaauauaguca

SEQ ID NO: 805741 - RNA, 19 nt, Human
acagcgccccccacccuuu

SEQ ID NO: 805742 - RNA, 19 nt, Human
acagcuuugggggagaggg

SEQ ID NO: 805743 - RNA, 23 nt, Human
acaggcaggaucuccagccgcac

SEQ ID NO: 805744 - RNA, 19 nt, Human
acagucucaagucccagaa

SEQ ID NO: 805745 - RNA, 24 nt, Human
acagugaucccucggaacuccucu

SEQ ID NO: 805746 - RNA, 22 nt, Human
accacgcuggcuggcuugaugc

SEQ ID NO: 805747 - RNA, 18 nt, Human
accacucacuagaccacc

SEQ ID NO: 805748 - RNA, 18 nt, Human
acccgggcccaugagcuc

SEQ ID NO: 805749 - RNA, 19 nt, Human
acucagggguacacagcaa

SEQ ID NO: 805750 - RNA, 18 nt, Human
acuccaccuccagcacca

SEQ ID NO: 805751 - RNA, 22 nt, Human
acugggccaggcaaagcacauc

SEQ ID NO: 805752 - RNA, 23 nt, Human
agaagaagcaggagggcugagag

SEQ ID NO: 805753 - RNA, 23 nt, Human
agagaaaaauacagcuuuggggg

SEQ ID NO: 805754 - RNA, 21 nt, Human
agagaccugggacagccccca

SEQ ID NO: 805755 - RNA, 21 nt, Human
agaguguguccuguccagccc

SEQ ID NO: 805756 - RNA, 24 nt, Human
agaugguuccggcccugaccagga

SEQ ID NO: 805757 - RNA, 20 nt, Human
agcaaggccugcugccuccc

SEQ ID NO: 805758 - RNA, 19 nt, Human
agccaggaucugccugggu

SEQ ID NO: 805759 - RNA, 21 nt, Human
agcccuguacagcugggagau

SEQ ID NO: 805760 - RNA, 19 nt, Human
agccuggucagguggaucc

SEQ ID NO: 805761 - RNA, 21 nt, Human
agcuccugccugcucaccucc

SEQ ID NO: 805762 - RNA, 23 nt, Human
agcugggcucccauccgaagcag

SEQ ID NO: 805763 - RNA, 23 nt, Human
aggacuagcaagccccaaacccc

SEQ ID NO: 805764 - RNA, 21 nt, Human
aggaggccccacagagaccug

SEQ ID NO: 805765 - RNA, 23 nt, Human
aggcaggcagggcgcucacuggg

SEQ ID NO: 805766 - RNA, 21 nt, Human
aggcagggcgcucacugggga

SEQ ID NO: 805767 - RNA, 22 nt, Human
agggaugcuggugcuuccagau

SEQ ID NO: 805768 - RNA, 19 nt, Human
aggugguggugagcgagau

SEQ ID NO: 805769 - RNA, 24 nt, Human
agguuggagacagauggagguggg

SEQ ID NO: 805770 - RNA, 24 nt, Human
aguggaggggagggguaagggagg

SEQ ID NO: 805771 - RNA, 18 nt, Human
auagagcccaccuccaaa

SEQ ID NO: 805772 - RNA, 20 nt, Human
auagagcccaccuccaaagg

SEQ ID NO: 805773 - RNA, 22 nt, Human
auaugcaggcaccacugccugc

SEQ ID NO: 805774 - RNA, 24 nt, Human
aucagcuccaccacagugaucccu

SEQ ID NO: 805775 - RNA, 24 nt, Human
aucccaggcaccacucacuagacc

SEQ ID NO: 805776 - RNA, 22 nt, Human
augcaugacugcgcugggguug

SEQ ID NO: 805777 - RNA, 23 nt, Human
auggcugcuugcauccagaagcc

SEQ ID NO: 805778 - RNA, 18 nt, Human
auugcauaugaggaggcc

SEQ ID NO: 805779 - RNA, 22 nt, Human
caacagaugaaugagugggugg

SEQ ID NO: 805780 - RNA, 23 nt, Human
caagauagcagaggcgcugagca

SEQ ID NO: 805781 - RNA, 21 nt, Human
caagcccugguuccaucccuu

SEQ ID NO: 805782 - RNA, 22 nt, Human
caaggaauguguucuaaucuca

SEQ ID NO: 805783 - RNA, 18 nt, Human
caaggggcagagcccagc

SEQ ID NO: 805784 - RNA, 24 nt, Human
caagucccagaagcuucagacuga

SEQ ID NO: 805785 - RNA, 20 nt, Human
cacacagcaaacagguaaca

SEQ ID NO: 805786 - RNA, 22 nt, Human
cacagcaaacagguaacagacc

SEQ ID NO: 805787 - RNA, 23 nt, Human
cacagcaaacagguaacagaccc

SEQ ID NO: 805788 - RNA, 23 nt, Human
caccagacccauacagaagcuga

SEQ ID NO: 805789 - RNA, 18 nt, Human
caccccaggcacaagcau

SEQ ID NO: 805790 - RNA, 19 nt, Human
caccccagucaccacagac

SEQ ID NO: 805791 - RNA, 19 nt, Human
caccuccucuaaggacaaa

SEQ ID NO: 805792 - RNA, 25 nt, Human
caccuucagggagcccucccugucg

SEQ ID NO: 805793 - RNA, 24 nt, Human
cacugccugccucuggcuuucugc

SEQ ID NO: 805794 - RNA, 24 nt, Human
cagaaccacagucucaagucccag

SEQ ID NO: 805795 - RNA, 19 nt, Human
cagcagccagaccugaggc

SEQ ID NO: 805796 - RNA, 22 nt, Human
cagcagucaccugagccucagu

SEQ ID NO: 805797 - RNA, 21 nt, Human
cagcgggauuccaucgacacu

SEQ ID NO: 805798 - RNA, 18 nt, Human
cagcuccaccacagugau

SEQ ID NO: 805799 - RNA, 22 nt, Human
caggaauagagcccaccuccaa

SEQ ID NO: 805800 - RNA, 22 nt, Human
caggugagaugucaccagaccc

SEQ ID NO: 805801 - RNA, 18 nt, Human
caggugcaggcgcucauu

SEQ ID NO: 805802 - RNA, 24 nt, Human
caguaacucauuuauagacaaugu

SEQ ID NO: 805803 - RNA, 21 nt, Human
cagucaccugagccucaguuu

SEQ ID NO: 805804 - RNA, 21 nt, Human
caucaaaagcaggugagaugu

SEQ ID NO: 805805 - RNA, 21 nt, Human
caucuuugcuuuuuuuagagg

SEQ ID NO: 805806 - RNA, 21 nt, Human
caugggaaugccucauacccc

SEQ ID NO: 805807 - RNA, 20 nt, Human
ccaaagcuauugcccuccuu

SEQ ID NO: 805808 - RNA, 21 nt, Human
ccaacccccaagcgcgugugc

SEQ ID NO: 805809 - RNA, 18 nt, Human
ccacuccaucccaggcac

SEQ ID NO: 805810 - RNA, 21 nt, Human
ccacugcaaccccugguggga

SEQ ID NO: 805811 - RNA, 23 nt, Human
ccagcaccacgcgcucgcccaca

SEQ ID NO: 805812 - RNA, 22 nt, Human
ccagcuacgugucugggagcca

SEQ ID NO: 805813 - RNA, 21 nt, Human
ccaucccaggcaccacucacu

SEQ ID NO: 805814 - RNA, 24 nt, Human
ccauggcaccuacccccaagccac

SEQ ID NO: 805815 - RNA, 22 nt, Human
cccaagccgagaggcccugaga

SEQ ID NO: 805816 - RNA, 24 nt, Human
cccacagagaccugggacagcccc

SEQ ID NO: 805817 - RNA, 19 nt, Human
cccaggccucucuccucuc

SEQ ID NO: 805818 - RNA, 21 nt, Human
cccaguggggccuggcccugg

SEQ ID NO: 805819 - RNA, 18 nt, Human
cccaucucccucccucuu

SEQ ID NO: 805820 - RNA, 19 nt, Human
cccauggcaccuaccccca

SEQ ID NO: 805821 - RNA, 19 nt, Human
ccccaaacagaccauaagc

SEQ ID NO: 805822 - RNA, 24 nt, Human
ccccaggucucagguuggagaccc

SEQ ID NO: 805823 - RNA, 19 nt, Human
ccccauuccccucccaggc

SEQ ID NO: 805824 - RNA, 19 nt, Human
cccccaggccucucuccuc

SEQ ID NO: 805825 - RNA, 19 nt, Human
cccccugccuacaccacuc

SEQ ID NO: 805826 - RNA, 22 nt, Human
ccccucccaggccuucuuucuc

SEQ ID NO: 805827 - RNA, 22 nt, Human
ccccuugugcuucccgagagcc

SEQ ID NO: 805828 - RNA, 18 nt, Human
cccucccucuuucuccuc

SEQ ID NO: 805829 - RNA, 26 nt, Human
cccucccucuuucuccucuuccuccc

SEQ ID NO: 805830 - RNA, 24 nt, Human
cccuccugccacuaccuucccaac

SEQ ID NO: 805831 - RNA, 22 nt, Human
cccuggccucugggucccagac

SEQ ID NO: 805832 - RNA, 18 nt, Human
cccuuguuuucuuuguug

SEQ ID NO: 805833 - RNA, 24 nt, Human
ccggcccugaccaggaggccugug

SEQ ID NO: 805834 - RNA, 20 nt, Human
ccgggccgggggcuguggca

SEQ ID NO: 805835 - RNA, 24 nt, Human
ccuacaccacucccaagacagagu

SEQ ID NO: 805836 - RNA, 21 nt, Human
ccuacccccaagccacugcaa

SEQ ID NO: 805837 - RNA, 20 nt, Human
ccucaguggccgcugacucu

SEQ ID NO: 805838 - RNA, 21 nt, Human
ccuccaggucuccauggaggc

SEQ ID NO: 805839 - RNA, 19 nt, Human
ccucccaggccuucuuucu

SEQ ID NO: 805840 - RNA, 19 nt, Human
ccucccugucggcagggcc

SEQ ID NO: 805841 - RNA, 23 nt, Human
ccuccucuaaggacaaagccaaa

SEQ ID NO: 805842 - RNA, 22 nt, Human
ccucuccaaggaggccccacag

SEQ ID NO: 805843 - RNA, 21 nt, Human
ccucuugacuccucaucuguu

SEQ ID NO: 805844 - RNA, 19 nt, Human
ccugcccaaugggcccaga

SEQ ID NO: 805845 - RNA, 22 nt, Human
ccugccuacaccacucccaaga

SEQ ID NO: 805846 - RNA, 18 nt, Human
ccugucgcccaccuucag

SEQ ID NO: 805847 - RNA, 19 nt, Human
cguuccuaucucagggccu

SEQ ID NO: 805848 - RNA, 18 nt, Human
cucacagaacuguggccu

SEQ ID NO: 805849 - RNA, 22 nt, Human
cucaggacuagcaagccccaaa

SEQ ID NO: 805850 - RNA, 22 nt, Human
cucagggguacacagcaagucc

SEQ ID NO: 805851 - RNA, 19 nt, Human
cucaucuguucccucaaau

SEQ ID NO: 805852 - RNA, 18 nt, Human
cuccaaggaggccccaca

SEQ ID NO: 805853 - RNA, 25 nt, Human
cucccccaccgucaggugcaggcgc

SEQ ID NO: 805854 - RNA, 23 nt, Human
cuccuuguagagggagacgucca

SEQ ID NO: 805855 - RNA, 19 nt, Human
cucugcugugcugucccuc

SEQ ID NO: 805856 - RNA, 18 nt, Human
cucugggucccagacccu

SEQ ID NO: 805857 - RNA, 25 nt, Human
cucugggucccagacccuguagcuc

SEQ ID NO: 805858 - RNA, 23 nt, Human
cugagccucaguuuccccaucug

SEQ ID NO: 805859 - RNA, 21 nt, Human
cugauucuaccugcuacaugc

SEQ ID NO: 805860 - RNA, 18 nt, Human
cugauuuguggacacuga

SEQ ID NO: 805861 - RNA, 23 nt, Human
cugcccgcccacuccaucccagg

SEQ ID NO: 805862 - RNA, 26 nt, Human
cugccugccucucucuauguguacug

SEQ ID NO: 805863 - RNA, 21 nt, Human
cugccugccucuggcuuucug

SEQ ID NO: 805864 - RNA, 26 nt, Human
cuggagaagcgaaggagcugggcucc

SEQ ID NO: 805865 - RNA, 20 nt, Human
cuggcucuuucugacagccu

SEQ ID NO: 805866 - RNA, 21 nt, Human
cuggcuguaaagaggagcgcu

SEQ ID NO: 805867 - RNA, 21 nt, Human
cugugccuguuuccucaucug

SEQ ID NO: 805868 - RNA, 23 nt, Human
cugugcugucccucacccucaaa

SEQ ID NO: 805869 - RNA, 26 nt, Human
cuuauaacaugaaaauaaacauuucc

SEQ ID NO: 805870 - RNA, 22 nt, Human
cuuccugccaacagcgcccccc

SEQ ID NO: 805871 - RNA, 24 nt, Human
cuuccugggaucccagacgcccca

SEQ ID NO: 805872 - RNA, 25 nt, Human
cuuggcuuucacuugguggcgacuc

SEQ ID NO: 805873 - RNA, 21 nt, Human
cuuucugcugcgcagagaauc

SEQ ID NO: 805874 - RNA, 19 nt, Human
cuuugggggagagggcagg

SEQ ID NO: 805875 - RNA, 21 nt, Human
gacaggauguggucuccaggg

SEQ ID NO: 805876 - RNA, 20 nt, Human
gacaugucacaggggcuguu

SEQ ID NO: 805877 - RNA, 22 nt, Human
gacgagggccccaaacagacca

SEQ ID NO: 805878 - RNA, 22 nt, Human
gagagaccccagcugucacucc

SEQ ID NO: 805879 - RNA, 23 nt, Human
gagagcccaaggcccauagagcc

SEQ ID NO: 805880 - RNA, 25 nt, Human
gagcagccugucgcccaccuucagg

SEQ ID NO: 805881 - RNA, 24 nt, Human
gagugggggaaaggguagaggggg

SEQ ID NO: 805882 - RNA, 18 nt, Human
gaucccagacgccccaac

SEQ ID NO: 805883 - RNA, 18 nt, Human
gauugcccuucucccacu

SEQ ID NO: 805884 - RNA, 18 nt, Human
gcaccacugccugccucu

SEQ ID NO: 805885 - RNA, 23 nt, Human
gcaccacugccugccucuggcuu

SEQ ID NO: 805886 - RNA, 23 nt, Human
gccagggaaacgucggccccucc

SEQ ID NO: 805887 - RNA, 22 nt, Human
gccccgugcagcgggauuccau

SEQ ID NO: 805888 - RNA, 19 nt, Human
gcccuggccucuggguccc

SEQ ID NO: 805889 - RNA, 20 nt, Human
gcccuggccucuggguccca

SEQ ID NO: 805890 - RNA, 19 nt, Human
gcggagccuggucaggugg

SEQ ID NO: 805891 - RNA, 23 nt, Human
gcggugcagcugcucacuccucu

SEQ ID NO: 805892 - RNA, 22 nt, Human
gcugaaaucaaagaaucaccca

SEQ ID NO: 805893 - RNA, 19 nt, Human
gcugacucuggggcacagg

SEQ ID NO: 805894 - RNA, 21 nt, Human
gcuggugccaucgauggacag

SEQ ID NO: 805895 - RNA, 20 nt, Human
gcuuagcagagguccagaga

SEQ ID NO: 805896 - RNA, 24 nt, Human
gcuuugggggagagggcaggugga

SEQ ID NO: 805897 - RNA, 23 nt, Human
ggacacccuccacugggcaagag

SEQ ID NO: 805898 - RNA, 19 nt, Human
ggacaugucacaggggcug

SEQ ID NO: 805899 - RNA, 20 nt, Human
ggagacagauggagguggga

SEQ ID NO: 805900 - RNA, 25 nt, Human
ggagacagauggaggugggaguggg

SEQ ID NO: 805901 - RNA, 27 nt, Human
ggagagggcagguggaaggggacaugu

SEQ ID NO: 805902 - RNA, 18 nt, Human
ggaggggcuugggcugag

SEQ ID NO: 805903 - RNA, 18 nt, Human
ggcagguccccaaggggg

SEQ ID NO: 805904 - RNA, 21 nt, Human
ggccaggcaaagcacaucccc

SEQ ID NO: 805905 - RNA, 18 nt, Human
ggccuucuuucucuuccu

SEQ ID NO: 805906 - RNA, 18 nt, Human
ggcggagugggggaaagg

SEQ ID NO: 805907 - RNA, 26 nt, Human
ggcuaaagagacuccauaugcaggca

SEQ ID NO: 805908 - RNA, 18 nt, Human
ggcuggcuccugucuuca

SEQ ID NO: 805909 - RNA, 18 nt, Human
gggaaugccucauacccc

SEQ ID NO: 805910 - RNA, 22 nt, Human
gggcacaggcaggaucuccagc

SEQ ID NO: 805911 - RNA, 23 nt, Human
gggcgguggcauggcuggccccg

SEQ ID NO: 805912 - RNA, 21 nt, Human
gggcuguggcaggagggcacg

SEQ ID NO: 805913 - RNA, 21 nt, Human
ggggagagggcagguggaagg

SEQ ID NO: 805914 - RNA, 21 nt, Human
gggggagagggcagguggaag

SEQ ID NO: 805915 - RNA, 25 nt, Human
ggucacacagcuauggcugcuugca

SEQ ID NO: 805916 - RNA, 20 nt, Human
ggugccaucgauggacagga

SEQ ID NO: 805917 - RNA, 19 nt, Human
gguuguguucuggugaggu

SEQ ID NO: 805918 - RNA, 19 nt, Human
guacagcugggagaucugg

SEQ ID NO: 805919 - RNA, 19 nt, Human
gugaucguccagaggggcu

SEQ ID NO: 805920 - RNA, 21 nt, Human
gugcagggcuccgcuccuguc

SEQ ID NO: 805921 - RNA, 18 nt, Human
guggcugcacugccgcag

SEQ ID NO: 805922 - RNA, 24 nt, Human
guuggagacagauggaggugggag

SEQ ID NO: 805923 - RNA, 25 nt, Human
uaaaaagcaaacuucuacucuaggu

SEQ ID NO: 805924 - RNA, 21 nt, Human
uaaagccccucacccuggucc

SEQ ID NO: 805925 - RNA, 19 nt, Human
uaacauccaacaugugugg

SEQ ID NO: 805926 - RNA, 23 nt, Human
uaacaugaaaauaaacauuuccu

SEQ ID NO: 805927 - RNA, 19 nt, Human
uaaccagacaaaauucuca

SEQ ID NO: 805928 - RNA, 20 nt, Human
uaaccagacaaaauucucag

SEQ ID NO: 805929 - RNA, 24 nt, Human
uacaaggaauguguucuaaucuca

SEQ ID NO: 805930 - RNA, 20 nt, Human
uacaccacucccaagacaga

SEQ ID NO: 805931 - RNA, 20 nt, Human
uacaccacucccaagacaga

SEQ ID NO: 805932 - RNA, 21 nt, Human
uacaccacucccaagacagag

SEQ ID NO: 805933 - RNA, 22 nt, Human
uacaccacucccaagacagagu

SEQ ID NO: 805934 - RNA, 20 nt, Human
uacagccccuugugcuuccc

SEQ ID NO: 805935 - RNA, 22 nt, Human
uacaugcccagcccuguacagc

SEQ ID NO: 805936 - RNA, 18 nt, Human
uacccccauuuucuggcu

SEQ ID NO: 805937 - RNA, 21 nt, Human
uaggucaggacaagcgggcgg

SEQ ID NO: 805938 - RNA, 18 nt, Human
uaguucagucuugcagua

SEQ ID NO: 805939 - RNA, 19 nt, Human
uaguucagucuugcaguau

SEQ ID NO: 805940 - RNA, 19 nt, Human
ucaaaagugagggcucuuu

SEQ ID NO: 805941 - RNA, 22 nt, Human
ucaccagacccauacagaagcu

SEQ ID NO: 805942 - RNA, 23 nt, Human
ucacuccuggcugcaaguccccc

SEQ ID NO: 805943 - RNA, 20 nt, Human
ucacuggauggcaggugaau

SEQ ID NO: 805944 - RNA, 19 nt, Human
ucaggagcgggcgggggca

SEQ ID NO: 805945 - RNA, 20 nt, Human
ucagggagggcaccaagggg

SEQ ID NO: 805946 - RNA, 23 nt, Human
ucagggccuuugcacuagcugug

SEQ ID NO: 805947 - RNA, 18 nt, Human
ucauacuccaccuccagc

SEQ ID NO: 805948 - RNA, 25 nt, Human
ucauacuccaccuccagcaccacgc

SEQ ID NO: 805949 - RNA, 24 nt, Human
uccaacccagacaggguuggugac

SEQ ID NO: 805950 - RNA, 19 nt, Human
uccaccacgcuggcuggcu

SEQ ID NO: 805951 - RNA, 20 nt, Human
uccaccacgcuggcuggcuu

SEQ ID NO: 805952 - RNA, 23 nt, Human
uccaccaucaagggucccgaagc

SEQ ID NO: 805953 - RNA, 22 nt, Human
ucccagaagcuucagacugaga

SEQ ID NO: 805954 - RNA, 23 nt, Human
ucccaggccuucuuucucuuccu

SEQ ID NO: 805955 - RNA, 21 nt, Human
ucccaucucccucccucuuuc

SEQ ID NO: 805956 - RNA, 21 nt, Human
ucccccugccuacaccacucc

SEQ ID NO: 805957 - RNA, 19 nt, Human
ucccgaagcauuagccacc

SEQ ID NO: 805958 - RNA, 21 nt, Human
ucccgaagcauuagccaccgu

SEQ ID NO: 805959 - RNA, 19 nt, Human
ucccucggaacuccucugg

SEQ ID NO: 805960 - RNA, 23 nt, Human
ucccuuguuuucuuuguugcacu

SEQ ID NO: 805961 - RNA, 20 nt, Human
uccuccaggucuccauggag

SEQ ID NO: 805962 - RNA, 21 nt, Human
uccucuggaaugcucugucug

SEQ ID NO: 805963 - RNA, 23 nt, Human
uccugccaacagcgccccccacc

SEQ ID NO: 805964 - RNA, 24 nt, Human
uccugccaacagcgccccccaccc

SEQ ID NO: 805965 - RNA, 18 nt, Human
uccugugaccgagaacuc

SEQ ID NO: 805966 - RNA, 23 nt, Human
ucggcagagaugguuccggcccu

SEQ ID NO: 805967 - RNA, 21 nt, Human
ucucagguuggagacccuggg

SEQ ID NO: 805968 - RNA, 24 nt, Human
ucucagguuggagacccugggcuu

SEQ ID NO: 805969 - RNA, 27 nt, Human
ucuccagccccauuccccucccaggcc

SEQ ID NO: 805970 - RNA, 18 nt, Human
ucucccacucccccaccg

SEQ ID NO: 805971 - RNA, 18 nt, Human
ucucccaucucccucccu

SEQ ID NO: 805972 - RNA, 19 nt, Human
ucucccucccucuuucucc

SEQ ID NO: 805973 - RNA, 22 nt, Human
ucugucugcggcacgccaggga

SEQ ID NO: 805974 - RNA, 18 nt, Human
ugaaaauaaacauuuccu

SEQ ID NO: 805975 - RNA, 24 nt, Human
ugaaaauaaacauuuccuuuuuaa

SEQ ID NO: 805976 - RNA, 18 nt, Human
ugaaucaucaaaagcagg

SEQ ID NO: 805977 - RNA, 21 nt, Human
ugacuuguuccggagggaggu

SEQ ID NO: 805978 - RNA, 19 nt, Human
ugagauagucaggcccagc

SEQ ID NO: 805979 - RNA, 24 nt, Human
ugagaugcugaaaucaaagaauca

SEQ ID NO: 805980 - RNA, 21 nt, Human
ugagcggacgugcagaugggu

SEQ ID NO: 805981 - RNA, 22 nt, Human
ugagcucuuggcucuacuggcu

SEQ ID NO: 805982 - RNA, 23 nt, Human
ugcaggcaccacugccugccucu

SEQ ID NO: 805983 - RNA, 21 nt, Human
ugcccagcccuguacagcugg

SEQ ID NO: 805984 - RNA, 19 nt, Human
ugcccuagacacucucugg

SEQ ID NO: 805985 - RNA, 23 nt, Human
ugccucugaggccucaguggccg

SEQ ID NO: 805986 - RNA, 24 nt, Human
ugccuggguggccccuuaggaguu

SEQ ID NO: 805987 - RNA, 25 nt, Human
ugccuguuuccucaucuguaaugau

SEQ ID NO: 805988 - RNA, 22 nt, Human
ugcucacuccucugcacuuuca

SEQ ID NO: 805989 - RNA, 23 nt, Human
uggaguagggcccaucguccgcc

SEQ ID NO: 805990 - RNA, 19 nt, Human
uggcauggcuggccccgug

SEQ ID NO: 805991 - RNA, 22 nt, Human
uggcauggcuggccccgugcaa

SEQ ID NO: 805992 - RNA, 23 nt, Human
uggcgagagaccccagcugucac

SEQ ID NO: 805993 - RNA, 22 nt, Human
uggcgucuugacuauuuccacc

SEQ ID NO: 805994 - RNA, 21 nt, Human
uggcuuugcugggaggaagug

SEQ ID NO: 805995 - RNA, 21 nt, Human
ugggacaaagacuuagacgag

SEQ ID NO: 805996 - RNA, 24 nt, Human
ugggacaaagacuuagacgagggc

SEQ ID NO: 805997 - RNA, 22 nt, Human
ugggagccaggaucugccuggg

SEQ ID NO: 805998 - RNA, 19 nt, Human
ugggauggacaaacucggg

SEQ ID NO: 805999 - RNA, 21 nt, Human
ugggcccagaaccacagucuc

SEQ ID NO: 806000 - RNA, 23 nt, Human
ugggcccagaaccacagucucaa

SEQ ID NO: 806001 - RNA, 18 nt, Human
ugggggagagggcaggug

SEQ ID NO: 806002 - RNA, 19 nt, Human
uggguuguguucuggugag

SEQ ID NO: 806003 - RNA, 19 nt, Human
uguacagcugggagaucug

SEQ ID NO: 806004 - RNA, 19 nt, Human
uguagcucaccugcccuag

SEQ ID NO: 806005 - RNA, 20 nt, Human
uguggacuugggcaaauuac

SEQ ID NO: 806006 - RNA, 20 nt, Human
uguucgcuauugucuccccu

SEQ ID NO: 806007 - RNA, 18 nt, Human
uguuuggggcagccuucc

SEQ ID NO: 806008 - RNA, 24 nt, Human
uuaacauccaacauguguggguug

SEQ ID NO: 806009 - RNA, 19 nt, Human
uucccaagccgagaggccc

SEQ ID NO: 806010 - RNA, 24 nt, Human
uuccggagggaggugguggugagc

SEQ ID NO: 806011 - RNA, 21 nt, Human
uuccucaucuguaaugauggg

SEQ ID NO: 806012 - RNA, 21 nt, Human
uuccugguggccgagucucua

SEQ ID NO: 806013 - RNA, 22 nt, Human
uucuuaagggaggcuccucugg

SEQ ID NO: 806014 - RNA, 21 nt, Human
uugcccuucucccacuccccc

SEQ ID NO: 806015 - RNA, 23 nt, Human
uugggggagagggcagguggaag

SEQ ID NO: 806016 - RNA, 22 nt, Human
uuucaagucggggaugaaccau

SEQ ID NO: 806017 - RNA, 18 nt, Human
aaaaaaaaaaacacccag

SEQ ID NO: 806018 - RNA, 20 nt, Human
aaaaaaaaaaacacccagaa

SEQ ID NO: 806019 - RNA, 18 nt, Human
aaaaaaaaaacacccaga

SEQ ID NO: 806020 - RNA, 22 nt, Human
aaaaacacccagaaauuuagag

SEQ ID NO: 806021 - RNA, 23 nt, Human
aaaaaccuuaaaauaaauucuaa

SEQ ID NO: 806022 - RNA, 18 nt, Human
aaaaauaaaaacaaagca

SEQ ID NO: 806023 - RNA, 23 nt, Human
aaaaguuuucuucaaguggggaa

SEQ ID NO: 806024 - RNA, 19 nt, Human
aaacagacaugaaauaucc

SEQ ID NO: 806025 - RNA, 21 nt, Human
aaacagacaugaaauauccac

SEQ ID NO: 806026 - RNA, 19 nt, Human
aaacaugcacguaugcucc

SEQ ID NO: 806027 - RNA, 20 nt, Human
aaacuacucuuccucucccc

SEQ ID NO: 806028 - RNA, 21 nt, Human
aaagcagcagacugaaauuca

SEQ ID NO: 806029 - RNA, 19 nt, Human
aaagugcugggauuacagg

SEQ ID NO: 806030 - RNA, 21 nt, Human
aaaguuccaaauaugaaaaca

SEQ ID NO: 806031 - RNA, 24 nt, Human
aaauauccacaucaugaaaaaaua

SEQ ID NO: 806032 - RNA, 26 nt, Human
aacacaacccccucgcuuaagcuacc

SEQ ID NO: 806033 - RNA, 19 nt, Human
aacuggaagacagacagac

SEQ ID NO: 806034 - RNA, 25 nt, Human
aagaaagaaauacacuauaauuaaa

SEQ ID NO: 806035 - RNA, 22 nt, Human
aagacaaagaaauagaagaaaa

SEQ ID NO: 806036 - RNA, 24 nt, Human
aagcaauccaccugccuuggcuuc

SEQ ID NO: 806037 - RNA, 24 nt, Human
aagcagacugcauguauauaugaa

SEQ ID NO: 806038 - RNA, 20 nt, Human
aagcagcagacugaaauuca

SEQ ID NO: 806039 - RNA, 28 nt, Human
aagcccgcagcacaacugcucccagagc

SEQ ID NO: 806040 - RNA, 26 nt, Human
aagcccgcagcacaacugcucccagg

SEQ ID NO: 806041 - RNA, 19 nt, Human
aaguagccucugacucaaa

SEQ ID NO: 806042 - RNA, 18 nt, Human
aagugcugggauuacagg

SEQ ID NO: 806043 - RNA, 19 nt, Human
aagugcugggauuacaggc

SEQ ID NO: 806044 - RNA, 22 nt, Human
aaucucugcucacugcaaucuc

SEQ ID NO: 806045 - RNA, 25 nt, Human
aaugacacuguaaacuguggcaaug

SEQ ID NO: 806046 - RNA, 18 nt, Human
acaaaacaagaaaaagag

SEQ ID NO: 806047 - RNA, 21 nt, Human
acaaaacaagaaaaagaguca

SEQ ID NO: 806048 - RNA, 23 nt, Human
acaaaguuccaaauaugaaaaca

SEQ ID NO: 806049 - RNA, 19 nt, Human
acaacaaaauaaccuacaa

SEQ ID NO: 806050 - RNA, 20 nt, Human
acaaggucaacaaaacggua

SEQ ID NO: 806051 - RNA, 20 nt, Human
acaccauuuuacuuuuaaaa

SEQ ID NO: 806052 - RNA, 22 nt, Human
acacugcacgucccagacagac

SEQ ID NO: 806053 - RNA, 23 nt, Human
acagacaugaaauauccacagca

SEQ ID NO: 806054 - RNA, 18 nt, Human
acagcagcagaaacaaac

SEQ ID NO: 806055 - RNA, 22 nt, Human
acaggcauccacacaaccaaag

SEQ ID NO: 806056 - RNA, 18 nt, Human
acauacacuccccuccuc

SEQ ID NO: 806057 - RNA, 19 nt, Human
acccacaauaucaugcaua

SEQ ID NO: 806058 - RNA, 21 nt, Human
acccagaaauuuagaguucaa

SEQ ID NO: 806059 - RNA, 18 nt, Human
acccauagaaacuccuca

SEQ ID NO: 806060 - RNA, 22 nt, Human
acccugguggaagcagccaucu

SEQ ID NO: 806061 - RNA, 18 nt, Human
acgggguuucgccauguu

SEQ ID NO: 806062 - RNA, 19 nt, Human
acgggguuucgccauguug

SEQ ID NO: 806063 - RNA, 24 nt, Human
acgggguuucgccauguugcucag

SEQ ID NO: 806064 - RNA, 18 nt, Human
acuacacuacaauuaaag

SEQ ID NO: 806065 - RNA, 19 nt, Human
acuacucuuccucucccca

SEQ ID NO: 806066 - RNA, 25 nt, Human
acugccugccaaugucagucauuug

SEQ ID NO: 806067 - RNA, 21 nt, Human
acuuugggguuucacagcagc

SEQ ID NO: 806068 - RNA, 24 nt, Human
agaaaaagagucagcaguacacua

SEQ ID NO: 806069 - RNA, 22 nt, Human
agaagagagaacuucucucugu

SEQ ID NO: 806070 - RNA, 28 nt, Human
agacaaagaaauagaagaaaagggaccc

SEQ ID NO: 806071 - RNA, 21 nt, Human
agacaccucaugggacaaaga

SEQ ID NO: 806072 - RNA, 22 nt, Human
agacagacagacaaacugaauc

SEQ ID NO: 806073 - RNA, 25 nt, Human
agacagacagacaaacugaaucaaa

SEQ ID NO: 806074 - RNA, 22 nt, Human
agagggcagaaacacaccuuug

SEQ ID NO: 806075 - RNA, 25 nt, Human
agaggggaaggacagacagacagac

SEQ ID NO: 806076 - RNA, 23 nt, Human
agcacaacugcucccagagccac

SEQ ID NO: 806077 - RNA, 24 nt, Human
agcacaacugcucccagagccacc

SEQ ID NO: 806078 - RNA, 25 nt, Human
agcacaacugcucccagagccaccc

SEQ ID NO: 806079 - RNA, 19 nt, Human
agcacaugcaacacaaccc

SEQ ID NO: 806080 - RNA, 20 nt, Human
agcacaugcaacacaacccc

SEQ ID NO: 806081 - RNA, 22 nt, Human
aggcaagaccugagugggcagc

SEQ ID NO: 806082 - RNA, 22 nt, Human
aggcugugacacacaagcacca

SEQ ID NO: 806083 - RNA, 21 nt, Human
agguucaagugauucuccugc

SEQ ID NO: 806084 - RNA, 22 nt, Human
agguucaagugauucuccugcc

SEQ ID NO: 806085 - RNA, 23 nt, Human
agguucaagugauucuccugccu

SEQ ID NO: 806086 - RNA, 18 nt, Human
aguaaaagggcccccaaa

SEQ ID NO: 806087 - RNA, 21 nt, Human
agugcaguggcacaaucucug

SEQ ID NO: 806088 - RNA, 18 nt, Human
agugcugggauuacaggc

SEQ ID NO: 806089 - RNA, 21 nt, Human
auagaaacuccucaagagaag

SEQ ID NO: 806090 - RNA, 18 nt, Human
auagaacaacuacacuac

SEQ ID NO: 806091 - RNA, 19 nt, Human
auagaagaaaauauccaca

SEQ ID NO: 806092 - RNA, 25 nt, Human
augcacuuucaagaauggcagacaa

SEQ ID NO: 806093 - RNA, 20 nt, Human
augcaucggcauacucucuu

SEQ ID NO: 806094 - RNA, 23 nt, Human
auguacucaguaaggcauauaua

SEQ ID NO: 806095 - RNA, 24 nt, Human
auuaaaagaucugucuagauaggg

SEQ ID NO: 806096 - RNA, 21 nt, Human
auuuacaagcauuuauuuaca

SEQ ID NO: 806097 - RNA, 22 nt, Human
caaaaacaaugaaaugcaucgg

SEQ ID NO: 806098 - RNA, 23 nt, Human
caaaacaagaaaaagagucagca

SEQ ID NO: 806099 - RNA, 21 nt, Human
caaagaacaagguauacaaaa

SEQ ID NO: 806100 - RNA, 23 nt, Human
caaagacaccucaugggacaaag

SEQ ID NO: 806101 - RNA, 23 nt, Human
caaagugcugggauuacaggcac

SEQ ID NO: 806102 - RNA, 25 nt, Human
caaagugcugggauuacaggcaccu

SEQ ID NO: 806103 - RNA, 24 nt, Human
caacugcaacaggaccaagcuaaa

SEQ ID NO: 806104 - RNA, 21 nt, Human
caagagcaugcugacuuacaa

SEQ ID NO: 806105 - RNA, 22 nt, Human
caagcaagagcaugcugacuua

SEQ ID NO: 806106 - RNA, 19 nt, Human
caagcacaaacuucauuca

SEQ ID NO: 806107 - RNA, 20 nt, Human
caagcacaaacuucauucag

SEQ ID NO: 806108 - RNA, 21 nt, Human
caagcagacugcauguauaua

SEQ ID NO: 806109 - RNA, 22 nt, Human
caagugauucuccugccucagc

SEQ ID NO: 806110 - RNA, 18 nt, Human
cacaauaucaugcauaag

SEQ ID NO: 806111 - RNA, 19 nt, Human
cacacaagcaccacaccgg

SEQ ID NO: 806112 - RNA, 21 nt, Human
cacacaagcaccacaccggcu

SEQ ID NO: 806113 - RNA, 21 nt, Human
cacacacaucacacacaacca

SEQ ID NO: 806114 - RNA, 22 nt, Human
cacacaucacacacaaccagau

SEQ ID NO: 806115 - RNA, 19 nt, Human
cacagcagcagaaacaaac

SEQ ID NO: 806116 - RNA, 21 nt, Human
cacagcagcagaaacaaacau

SEQ ID NO: 806117 - RNA, 18 nt, Human
cacagcauuaagguaccc

SEQ ID NO: 806118 - RNA, 25 nt, Human
cacaugcaacacaacccccucgcuu

SEQ ID NO: 806119 - RNA, 18 nt, Human
caccaccaaauuaaauga

SEQ ID NO: 806120 - RNA, 19 nt, Human
caccaccaaauuaaaugaa

SEQ ID NO: 806121 - RNA, 22 nt, Human
caccaccaccaaauuaaaugaa

SEQ ID NO: 806122 - RNA, 19 nt, Human
cacccugaaaaaagaagag

SEQ ID NO: 806123 - RNA, 20 nt, Human
cacccugaaaaaagaagaga

SEQ ID NO: 806124 - RNA, 23 nt, Human
caccugccuuggcuucccaaagu

SEQ ID NO: 806125 - RNA, 24 nt, Human
caccugccuuggcuucccaaagug

SEQ ID NO: 806126 - RNA, 22 nt, Human
cacucuggcuggagugcagugg

SEQ ID NO: 806127 - RNA, 23 nt, Human
cacugauacagauaaugcaaaaa

SEQ ID NO: 806128 - RNA, 23 nt, Human
cacuguaugcuggggagaaaggc

SEQ ID NO: 806129 - RNA, 23 nt, Human
cacuuaggaaacuuucaaauuca

SEQ ID NO: 806130 - RNA, 21 nt, Human
cagacagaccaaugacuaaua

SEQ ID NO: 806131 - RNA, 18 nt, Human
cagacgggguuucgccau

SEQ ID NO: 806132 - RNA, 25 nt, Human
cagcaccucacccugaaaaaagaag

SEQ ID NO: 806133 - RNA, 19 nt, Human
cagcagaaacaaacauaaa

SEQ ID NO: 806134 - RNA, 24 nt, Human
cagcagaaacacaauacgagccuc

SEQ ID NO: 806135 - RNA, 18 nt, Human
cagcagcagaaacaaaca

SEQ ID NO: 806136 - RNA, 27 nt, Human
cagcagcagaaacaaacauaaauccag

SEQ ID NO: 806137 - RNA, 24 nt, Human
cagcauuaagguacccuauagcca

SEQ ID NO: 806138 - RNA, 18 nt, Human
cagcauuagcauucucua

SEQ ID NO: 806139 - RNA, 25 nt, Human
cagcuaacuuacuaaaguuauucac

SEQ ID NO: 806140 - RNA, 18 nt, Human
caggaaccugcagcugaa

SEQ ID NO: 806141 - RNA, 25 nt, Human
caguaacugggauuacaggcacaug

SEQ ID NO: 806142 - RNA, 24 nt, Human
cauaaucaauacucuuuugguacc

SEQ ID NO: 806143 - RNA, 23 nt, Human
cauacacacacaucacacacaac

SEQ ID NO: 806144 - RNA, 28 nt, Human
cauacacacacaucacacacaaccagau

SEQ ID NO: 806145 - RNA, 22 nt, Human
cauauacccuacaauaacugcc

SEQ ID NO: 806146 - RNA, 23 nt, Human
caugcagaugaacuccacaugaa

SEQ ID NO: 806147 - RNA, 23 nt, Human
cauguuaacauuaaagggggcau

SEQ ID NO: 806148 - RNA, 24 nt, Human
cauguugcucagguuggugucgaa

SEQ ID NO: 806149 - RNA, 22 nt, Human
cauuacauguagcuaggucuuu

SEQ ID NO: 806150 - RNA, 20 nt, Human
cauuccaaaugcauuuugac

SEQ ID NO: 806151 - RNA, 22 nt, Human
ccaaaagagggcagaaacacac

SEQ ID NO: 806152 - RNA, 19 nt, Human
ccaaagugcugggauuaca

SEQ ID NO: 806153 - RNA, 23 nt, Human
ccaaagugcugggauuacaggca

SEQ ID NO: 806154 - RNA, 22 nt, Human
ccaacaaauccaauucccacag

SEQ ID NO: 806155 - RNA, 24 nt, Human
ccagagccacccucuggccagaaa

SEQ ID NO: 806156 - RNA, 18 nt, Human
ccaggugaagaacgaaga

SEQ ID NO: 806157 - RNA, 22 nt, Human
ccaguaacugggauuacaggca

SEQ ID NO: 806158 - RNA, 19 nt, Human
cccaaagaaagauuauuac

SEQ ID NO: 806159 - RNA, 24 nt, Human
cccaaagugcugggauuacaggca

SEQ ID NO: 806160 - RNA, 23 nt, Human
cccagguucaagugauucuccuc

SEQ ID NO: 806161 - RNA, 23 nt, Human
cccagguucaagugauucuccug

SEQ ID NO: 806162 - RNA, 23 nt, Human
cccaguaacugggauuacaggca

SEQ ID NO: 806163 - RNA, 22 nt, Human
ccccaaaaggcagcucacugua

SEQ ID NO: 806164 - RNA, 18 nt, Human
ccccaaaauauucugcuu

SEQ ID NO: 806165 - RNA, 23 nt, Human
cccccaaacuauaggacgugacc

SEQ ID NO: 806166 - RNA, 21 nt, Human
ccccuggcacguucccagucc

SEQ ID NO: 806167 - RNA, 19 nt, Human
ccuaaaccacaaucagcau

SEQ ID NO: 806168 - RNA, 22 nt, Human
ccuacaaucagagcucacaggc

SEQ ID NO: 806169 - RNA, 22 nt, Human
ccucuggccagaaacgggcccc

SEQ ID NO: 806170 - RNA, 19 nt, Human
ccucuggccuagcuaaggc

SEQ ID NO: 806171 - RNA, 21 nt, Human
ccugggcucaagcaauccacc

SEQ ID NO: 806172 - RNA, 23 nt, Human
ccugggcucaagcaauccaccug

SEQ ID NO: 806173 - RNA, 24 nt, Human
cgggguuucgccauguugcucagg

SEQ ID NO: 806174 - RNA, 24 nt, Human
cgugauuaaccauauacccuacaa

SEQ ID NO: 806175 - RNA, 21 nt, Human
cguucccaguccuugacuagu

SEQ ID NO: 806176 - RNA, 19 nt, Human
cuaaaccacaaucagcauu

SEQ ID NO: 806177 - RNA, 20 nt, Human
cucaagcaauccaccugccu

SEQ ID NO: 806178 - RNA, 24 nt, Human
cucaagcaauccaccugccuuggc

SEQ ID NO: 806179 - RNA, 20 nt, Human
cucaugggacaaagaaaauu

SEQ ID NO: 806180 - RNA, 18 nt, Human
cucccagagccacccucu

SEQ ID NO: 806181 - RNA, 19 nt, Human
cucccagagccacccucug

SEQ ID NO: 806182 - RNA, 19 nt, Human
cucccagguucaagugauu

SEQ ID NO: 806183 - RNA, 19 nt, Human
cucccggcuacaaggcugu

SEQ ID NO: 806184 - RNA, 30 nt, Human
cucuacacaacaaaugggggcucucaagaa

SEQ ID NO: 806185 - RNA, 20 nt, Human
cucuggagagaaagaccaug

SEQ ID NO: 806186 - RNA, 22 nt, Human
cugaaaggcaacaguaauuuaa

SEQ ID NO: 806187 - RNA, 21 nt, Human
cugagugggcagccucugucc

SEQ ID NO: 806188 - RNA, 20 nt, Human
cugaguguuaucaguguucu

SEQ ID NO: 806189 - RNA, 21 nt, Human
cugcaacaguuagaguucucc

SEQ ID NO: 806190 - RNA, 22 nt, Human
cugccucagccuccccaguaac

SEQ ID NO: 806191 - RNA, 24 nt, Human
cugcucccagagccacccucuggc

SEQ ID NO: 806192 - RNA, 23 nt, Human
cuguaacauccuaaaccacaauc

SEQ ID NO: 806193 - RNA, 18 nt, Human
cugucacucuggcuggag

SEQ ID NO: 806194 - RNA, 24 nt, Human
cuuacaaagacaccucaugggacc

SEQ ID NO: 806195 - RNA, 22 nt, Human
cuuuaaaaaaaaaaacacccag

SEQ ID NO: 806196 - RNA, 22 nt, Human
cuuucuaagaaugauucucugg

SEQ ID NO: 806197 - RNA, 18 nt, Human
gaaacacugauacagaua

SEQ ID NO: 806198 - RNA, 18 nt, Human
gaagaggaagaauuacaa

SEQ ID NO: 806199 - RNA, 20 nt, Human
gacacuucuuacagguguau

SEQ ID NO: 806200 - RNA, 20 nt, Human
gaggggacugggggaaggcg

SEQ ID NO: 806201 - RNA, 24 nt, Human
gauuacaggcacaugccaccaugc

SEQ ID NO: 806202 - RNA, 21 nt, Human
gauucuccugccucagccucc

SEQ ID NO: 806203 - RNA, 24 nt, Human
gcaacaguuagaguucucccccag

SEQ ID NO: 806204 - RNA, 24 nt, Human
gcaauccaccugccuuggcuuccc

SEQ ID NO: 806205 - RNA, 22 nt, Human
gcaaucuccaucucccagguuc

SEQ ID NO: 806206 - RNA, 23 nt, Human
gccacaugcagaugaacuccaca

SEQ ID NO: 806207 - RNA, 21 nt, Human
gcccaaagaaagauuauuaca

SEQ ID NO: 806208 - RNA, 24 nt, Human
gcccagcuaauuuuuuuguauuuu

SEQ ID NO: 806209 - RNA, 19 nt, Human
gcccgcagcacaacugcuc

SEQ ID NO: 806210 - RNA, 22 nt, Human
gccuuggcuucccaaagugcug

SEQ ID NO: 806211 - RNA, 24 nt, Human
gccuuggcuucccaaagugcuggg

SEQ ID NO: 806212 - RNA, 25 nt, Human
gcuggagugcaguggcacaaucucu

SEQ ID NO: 806213 - RNA, 22 nt, Human
ggaaacaagucauaaaguacag

SEQ ID NO: 806214 - RNA, 23 nt, Human
ggaaggacagacagacagacaaa

SEQ ID NO: 806215 - RNA, 19 nt, Human
ggacugggggaaggcgggc

SEQ ID NO: 806216 - RNA, 23 nt, Human
gggaaacaagucauaaaguacag

SEQ ID NO: 806217 - RNA, 23 nt, Human
gggcaaggauggcaaagacuggg

SEQ ID NO: 806218 - RNA, 20 nt, Human
ggggacccaaagucaaaagu

SEQ ID NO: 806219 - RNA, 23 nt, Human
gggguuucgccauguugcucagg

SEQ ID NO: 806220 - RNA, 22 nt, Human
ggguuucgccauguugcucagg

SEQ ID NO: 806221 - RNA, 19 nt, Human
gguccaaaauuucccaagu

SEQ ID NO: 806222 - RNA, 23 nt, Human
ggugaaggugacuuauuuuuauc

SEQ ID NO: 806223 - RNA, 18 nt, Human
guaaaccucagaaauuac

SEQ ID NO: 806224 - RNA, 22 nt, Human
guauauaugaauauaucauaca

SEQ ID NO: 806225 - RNA, 24 nt, Human
gugauucuccugccucagccuccc

SEQ ID NO: 806226 - RNA, 20 nt, Human
guucccaguccuugacuagu

SEQ ID NO: 806227 - RNA, 19 nt, Human
uaaaacugacuauggcauc

SEQ ID NO: 806228 - RNA, 20 nt, Human
uaaaacugacuauggcauca

SEQ ID NO: 806229 - RNA, 24 nt, Human
uaaaagggcccccaaacuauagga

SEQ ID NO: 806230 - RNA, 24 nt, Human
uaaaaguauauguggcaccuucca

SEQ ID NO: 806231 - RNA, 18 nt, Human
uaaaaugaguauagaacc

SEQ ID NO: 806232 - RNA, 24 nt, Human
uaaaauguccagagcaucauacgu

SEQ ID NO: 806233 - RNA, 26 nt, Human
uaaacucuaucaauuaccuauucgug

SEQ ID NO: 806234 - RNA, 18 nt, Human
uaaaguacagcacaaaac

SEQ ID NO: 806235 - RNA, 23 nt, Human
uaaauucuaauuuuaauugcuac

SEQ ID NO: 806236 - RNA, 20 nt, Human
uaacaaacaugggaucacua

SEQ ID NO: 806237 - RNA, 18 nt, Human
uaacaggcuccuucuaca

SEQ ID NO: 806238 - RNA, 22 nt, Human
uaacaugaugguauuaguacug

SEQ ID NO: 806239 - RNA, 21 nt, Human
uaacucuagacauacacuccc

SEQ ID NO: 806240 - RNA, 19 nt, Human
uaagacuaagacccauaaa

SEQ ID NO: 806241 - RNA, 24 nt, Human
uaagguacccuauagccaucaucc

SEQ ID NO: 806242 - RNA, 18 nt, Human
uaauacagauuaaucuca

SEQ ID NO: 806243 - RNA, 25 nt, Human
uacaagguacuuuuaucugcauucc

SEQ ID NO: 806244 - RNA, 23 nt, Human
uacaaucagagcucacaggcacc

SEQ ID NO: 806245 - RNA, 22 nt, Human
uacacuaaagauccucaaguau

SEQ ID NO: 806246 - RNA, 22 nt, Human
uacagacgggguuucgccaugu

SEQ ID NO: 806247 - RNA, 24 nt, Human
uacaggcacaugccaccaugccca

SEQ ID NO: 806248 - RNA, 18 nt, Human
uaccauaaccuaaaaaga

SEQ ID NO: 806249 - RNA, 26 nt, Human
uaccauaaccuaaaaagacacuucuu

SEQ ID NO: 806250 - RNA, 18 nt, Human
uaccauaggacugggacu

SEQ ID NO: 806251 - RNA, 19 nt, Human
uacccauagaaacuccuca

SEQ ID NO: 806252 - RNA, 19 nt, Human
uacccuauagccaucaucc

SEQ ID NO: 806253 - RNA, 21 nt, Human
uacuccaagucauguuaacau

SEQ ID NO: 806254 - RNA, 22 nt, Human
uacuguacaaggucaagaaagc

SEQ ID NO: 806255 - RNA, 24 nt, Human
uacuuuuaaaacugucacuuuaaa

SEQ ID NO: 806256 - RNA, 21 nt, Human
uagaaccaugaguuagugccg

SEQ ID NO: 806257 - RNA, 18 nt, Human
uagcaugcaggcuuaaaa

SEQ ID NO: 806258 - RNA, 21 nt, Human
uagccucugacucaaacaccu

SEQ ID NO: 806259 - RNA, 19 nt, Human
uagcuaggucuuuaucucc

SEQ ID NO: 806260 - RNA, 24 nt, Human
uauaucauacauacauauguagug

SEQ ID NO: 806261 - RNA, 26 nt, Human
uauaucucuacacaacaaaugggggc

SEQ ID NO: 806262 - RNA, 25 nt, Human
uaucaaaaguuuucuucaagugggg

SEQ ID NO: 806263 - RNA, 21 nt, Human
uaucuaaacaacaaaauaacc

SEQ ID NO: 806264 - RNA, 25 nt, Human
uaucuaaacaacaaaauaaccuaca

SEQ ID NO: 806265 - RNA, 18 nt, Human
uaugcaaaucacgugggu

SEQ ID NO: 806266 - RNA, 24 nt, Human
uauguaucauuccugcuguccaag

SEQ ID NO: 806267 - RNA, 24 nt, Human
uauuacaaaguuccaaauaugaaa

SEQ ID NO: 806268 - RNA, 24 nt, Human
uauuacagacgggguuucgccaug

SEQ ID NO: 806269 - RNA, 26 nt, Human
uauuauuauuuuuugagauggagucu

SEQ ID NO: 806270 - RNA, 20 nt, Human
uauucugcauccauuucuca

SEQ ID NO: 806271 - RNA, 20 nt, Human
uauugugagcagucucaauu

SEQ ID NO: 806272 - RNA, 19 nt, Human
ucaaagucuaaugcugaaa

SEQ ID NO: 806273 - RNA, 20 nt, Human
ucaagauaaggccacucuga

SEQ ID NO: 806274 - RNA, 19 nt, Human
ucaagugauucuccugccu

SEQ ID NO: 806275 - RNA, 24 nt, Human
ucaauaaaggaaaaucagaaauuu

SEQ ID NO: 806276 - RNA, 24 nt, Human
ucacugcaaucuccaucucccagg

SEQ ID NO: 806277 - RNA, 25 nt, Human
ucacugcaaucuccaucucccaggg

SEQ ID NO: 806278 - RNA, 22 nt, Human
ucagaacacuacagaaagccaa

SEQ ID NO: 806279 - RNA, 23 nt, Human
ucagaacacuacagaaagccaac

SEQ ID NO: 806280 - RNA, 22 nt, Human
ucaggggaaagagaaaccagua

SEQ ID NO: 806281 - RNA, 20 nt, Human
ucagucauuuguaccacugu

SEQ ID NO: 806282 - RNA, 24 nt, Human
ucauuugagaacaaaagccauuuu

SEQ ID NO: 806283 - RNA, 23 nt, Human
uccaaguggauuuuccuagagac

SEQ ID NO: 806284 - RNA, 21 nt, Human
uccacacaaccaaagauuucu

SEQ ID NO: 806285 - RNA, 24 nt, Human
uccacaucaugaaaaaauaugguu

SEQ ID NO: 806286 - RNA, 21 nt, Human
uccauaauaaagagagcuaga

SEQ ID NO: 806287 - RNA, 19 nt, Human
ucccaaagcucaggcucca

SEQ ID NO: 806288 - RNA, 24 nt, Human
ucccaaagugcugggauuacaggc

SEQ ID NO: 806289 - RNA, 21 nt, Human
ucccagguucaagugauucuc

SEQ ID NO: 806290 - RNA, 24 nt, Human
ucccagguucaagugauucuccug

SEQ ID NO: 806291 - RNA, 24 nt, Human
uccccaguaacugggauuacaggc

SEQ ID NO: 806292 - RNA, 19 nt, Human
ucccuucuucccuuuaaag

SEQ ID NO: 806293 - RNA, 18 nt, Human
uccugggcucaagcaauc

SEQ ID NO: 806294 - RNA, 19 nt, Human
uccugggcucaagcaaucc

SEQ ID NO: 806295 - RNA, 24 nt, Human
uccugggcucaagcaauccaccug

SEQ ID NO: 806296 - RNA, 22 nt, Human
ucgccauguugcucagguuggu

SEQ ID NO: 806297 - RNA, 20 nt, Human
ucuaagcacaugcaacacaa

SEQ ID NO: 806298 - RNA, 21 nt, Human
ucuacacaacaaaugggggcu

SEQ ID NO: 806299 - RNA, 19 nt, Human
ucucccagguucaagugau

SEQ ID NO: 806300 - RNA, 24 nt, Human
ucucccagguucaagugauucucc

SEQ ID NO: 806301 - RNA, 25 nt, Human
ucuccugccucagccuccccaguaa

SEQ ID NO: 806302 - RNA, 22 nt, Human
ucucuggagagaaagaccaugu

SEQ ID NO: 806303 - RNA, 22 nt, Human
ucucuuaucauuugagaacaaa

SEQ ID NO: 806304 - RNA, 24 nt, Human
ucugucacucuggcuggagugcag

SEQ ID NO: 806305 - RNA, 19 nt, Human
ucuugcagaauuauaacag

SEQ ID NO: 806306 - RNA, 24 nt, Human
ucuugcucugucacucuggcugga

SEQ ID NO: 806307 - RNA, 23 nt, Human
ucuuuaucuccugaaugcuccuc

SEQ ID NO: 806308 - RNA, 18 nt, Human
ugaaaaaagaagagaggg

SEQ ID NO: 806309 - RNA, 21 nt, Human
ugaaaaaagaagagaggggaa

SEQ ID NO: 806310 - RNA, 24 nt, Human
ugaaaaauaaaagaaaaucagcaa

SEQ ID NO: 806311 - RNA, 19 nt, Human
ugaaagggcaaggcuucca

SEQ ID NO: 806312 - RNA, 26 nt, Human
ugaaauuccuaacuccaauuuauauu

SEQ ID NO: 806313 - RNA, 23 nt, Human
ugaacacaggcauccacacaacc

SEQ ID NO: 806314 - RNA, 19 nt, Human
ugaagaacgaagaggaagg

SEQ ID NO: 806315 - RNA, 24 nt, Human
ugaauggucuguggaagaccagaa

SEQ ID NO: 806316 - RNA, 20 nt, Human
ugacacuguaaacuguggca

SEQ ID NO: 806317 - RNA, 20 nt, Human
ugacaucaaguacuaacuau

SEQ ID NO: 806318 - RNA, 24 nt, Human
ugaccauuuugcugauaaucaagc

SEQ ID NO: 806319 - RNA, 22 nt, Human
ugagauggagucuugcucuguc

SEQ ID NO: 806320 - RNA, 20 nt, Human
ugauucuccugccucagccu

SEQ ID NO: 806321 - RNA, 20 nt, Human
ugauuuggccaugauuccuc

SEQ ID NO: 806322 - RNA, 22 nt, Human
ugcauuauucugcauccauuuc

SEQ ID NO: 806323 - RNA, 24 nt, Human
ugccucagccuccccaguaacugg

SEQ ID NO: 806324 - RNA, 19 nt, Human
ugccuuggcuucccaaagu

SEQ ID NO: 806325 - RNA, 20 nt, Human
ugcuauaucucuacacaaca

SEQ ID NO: 806326 - RNA, 24 nt, Human
ugcucagguuggugucgaacuccu

SEQ ID NO: 806327 - RNA, 24 nt, Human
ugcucugucacucuggcuggagug

SEQ ID NO: 806328 - RNA, 21 nt, Human
ugcugggauuacaggcaccug

SEQ ID NO: 806329 - RNA, 20 nt, Human
ugcuuccaauuucaacacag

SEQ ID NO: 806330 - RNA, 22 nt, Human
uggaagcaagguacauuccaaa

SEQ ID NO: 806331 - RNA, 26 nt, Human
uggaaugaaguccugcuucagcugcu

SEQ ID NO: 806332 - RNA, 22 nt, Human
uggaggggacugggggaaggcg

SEQ ID NO: 806333 - RNA, 19 nt, Human
uggagucuugcucugucac

SEQ ID NO: 806334 - RNA, 18 nt, Human
uggagugcaguggcacaa

SEQ ID NO: 806335 - RNA, 22 nt, Human
uggagugcaguggcacaaucuc

SEQ ID NO: 806336 - RNA, 19 nt, Human
uggcaacaucuaggggcaa

SEQ ID NO: 806337 - RNA, 24 nt, Human
uggcacaaucucugcucacugcaa

SEQ ID NO: 806338 - RNA, 22 nt, Human
uggcacauuuuugaaaugauca

SEQ ID NO: 806339 - RNA, 18 nt, Human
uggcaugacauaaaugca

SEQ ID NO: 806340 - RNA, 25 nt, Human
uggccuagcuaaggcacucuauucu

SEQ ID NO: 806341 - RNA, 23 nt, Human
uggcuggagugcaguggcacaau

SEQ ID NO: 806342 - RNA, 20 nt, Human
ugggauccuggccuuucuaa

SEQ ID NO: 806343 - RNA, 21 nt, Human
ugggauuacaggcacaugcca

SEQ ID NO: 806344 - RNA, 22 nt, Human
ugggauuacaggcacaugccac

SEQ ID NO: 806345 - RNA, 24 nt, Human
ugggauuacaggcacaugccacca

SEQ ID NO: 806346 - RNA, 25 nt, Human
ugggauuacaggcacaugccaccau

SEQ ID NO: 806347 - RNA, 19 nt, Human
ugggauuacaggcaccugc

SEQ ID NO: 806348 - RNA, 23 nt, Human
ugggauuacaggcaccugcccca

SEQ ID NO: 806349 - RNA, 21 nt, Human
uggggaaauggacaagcugga

SEQ ID NO: 806350 - RNA, 20 nt, Human
uggggacccaaagucaaaag

SEQ ID NO: 806351 - RNA, 23 nt, Human
uggggacccaaagucaaaaguuc

SEQ ID NO: 806352 - RNA, 22 nt, Human
uggggcaugaagucacccacaa

SEQ ID NO: 806353 - RNA, 20 nt, Human
ugguggaagcagccaucuuu

SEQ ID NO: 806354 - RNA, 24 nt, Human
uguacaucacauuaucugacacuu

SEQ ID NO: 806355 - RNA, 19 nt, Human
ugucaguaaaccucagaaa

SEQ ID NO: 806356 - RNA, 20 nt, Human
ugucaguaaaccucagaaau

SEQ ID NO: 806357 - RNA, 21 nt, Human
ugucgaacuccugggcucaag

SEQ ID NO: 806358 - RNA, 19 nt, Human
uguuuauuuuuauuauuau

SEQ ID NO: 806359 - RNA, 21 nt, Human
uuaaaaaaaaaaacacccaga

SEQ ID NO: 806360 - RNA, 22 nt, Human
uuaacaaacaugggaucacuau

SEQ ID NO: 806361 - RNA, 21 nt, Human
uuaagacuaagacccauaaac

SEQ ID NO: 806362 - RNA, 22 nt, Human
uuacauaaucaauaaaggaaaa

SEQ ID NO: 806363 - RNA, 23 nt, Human
uuacauaucaacacaguggugcc

SEQ ID NO: 806364 - RNA, 24 nt, Human
uuagaauuaaaaguauuucaauaa

SEQ ID NO: 806365 - RNA, 24 nt, Human
uuauuacagacgggguuucgccau

SEQ ID NO: 806366 - RNA, 21 nt, Human
uucaagugauucuccugccuc

SEQ ID NO: 806367 - RNA, 23 nt, Human
uucaagugauucuccugccucag

SEQ ID NO: 806368 - RNA, 24 nt, Human
uucaagugauucuccugccucagc

SEQ ID NO: 806369 - RNA, 18 nt, Human
uucagaguaagggccaca

SEQ ID NO: 806370 - RNA, 23 nt, Human
uucauucaagcacaaacuucauu

SEQ ID NO: 806371 - RNA, 21 nt, Human
uuccaaauaugaaaacacacu

SEQ ID NO: 806372 - RNA, 19 nt, Human
uuccaggucaagaacuuac

SEQ ID NO: 806373 - RNA, 21 nt, Human
uuccuggaagguucuaaugcu

SEQ ID NO: 806374 - RNA, 25 nt, Human
uucuauagaguacuuaaauccagaa

SEQ ID NO: 806375 - RNA, 18 nt, Human
uucucaaauucucaacug

SEQ ID NO: 806376 - RNA, 19 nt, Human
uucuucauaggucauagag

SEQ ID NO: 806377 - RNA, 20 nt, Human
uugaaagggcaaggcuucca

SEQ ID NO: 806378 - RNA, 22 nt, Human
uugacugacuauaaaauaaacc

SEQ ID NO: 806379 - RNA, 21 nt, Human
uugagauggagucuugcucug

SEQ ID NO: 806380 - RNA, 19 nt, Human
uuguuuacuaaagagcaaa

SEQ ID NO: 806381 - RNA, 25 nt, Human
uuuacuuuuauuacaauaaauaauu

SEQ ID NO: 806382 - RNA, 20 nt, Human
uuuaucccaugccccccuca

SEQ ID NO: 806383 - RNA, 24 nt, Human
uuuaucccaugccccccucaaaua

SEQ ID NO: 806384 - RNA, 19 nt, Human
uuucgccauguugcucagg

SEQ ID NO: 806385 - RNA, 20 nt, Human
uuucuaagaaugauucucug

SEQ ID NO: 806386 - RNA, 23 nt, Human
uuuuuauuacagacgggguuucg

SEQ ID NO: 806387 - RNA, 21 nt, Human
uuuuuuguauuuuuauuacag

SEQ ID NO: 806388 - RNA, 24 nt, Human
uuuuuuguauuuuuauuacagacg

SEQ ID NO: 806389 - RNA, 25 nt, Human
aaaaaacaauaaacauuguuaaaac

SEQ ID NO: 806390 - RNA, 22 nt, Human
aaaaagacagacauauuaaaaa

SEQ ID NO: 806391 - RNA, 28 nt, Human
aaaaagacagacauauuaaaaauacagg

SEQ ID NO: 806392 - RNA, 22 nt, Human
aaaaaggaaauguuaaaaaaaa

SEQ ID NO: 806393 - RNA, 20 nt, Human
aaaacaaaaagacagacaua

SEQ ID NO: 806394 - RNA, 24 nt, Human
aaaauuuggcgaauguucaaauaa

SEQ ID NO: 806395 - RNA, 23 nt, Human
aaacaaaaagacagacauauuaa

SEQ ID NO: 806396 - RNA, 19 nt, Human
aaacagguaagaaaacuca

SEQ ID NO: 806397 - RNA, 23 nt, Human
aaaccaaacauacuuuaaaguaa

SEQ ID NO: 806398 - RNA, 19 nt, Human
aaacuccaguuuuguuugg

SEQ ID NO: 806399 - RNA, 22 nt, Human
aaagaagcccacuuuccccaaa

SEQ ID NO: 806400 - RNA, 24 nt, Human
aaaggaaauguuaaaaaaaaaaag

SEQ ID NO: 806401 - RNA, 22 nt, Human
aaaugcagccaaaauguaucug

SEQ ID NO: 806402 - RNA, 25 nt, Human
aacaauuucacaugcgaguaggguu

SEQ ID NO: 806403 - RNA, 24 nt, Human
aacacauaaacccaccucaggcca

SEQ ID NO: 806404 - RNA, 19 nt, Human
aacaggcccccccaagaaa

SEQ ID NO: 806405 - RNA, 21 nt, Human
aacuccaguuuuguuugguau

SEQ ID NO: 806406 - RNA, 23 nt, Human
aagauuugguuagagagaaaguu

SEQ ID NO: 806407 - RNA, 19 nt, Human
aagcaaaaccuacauguau

SEQ ID NO: 806408 - RNA, 19 nt, Human
aagcucuaaccuguaacag

SEQ ID NO: 806409 - RNA, 20 nt, Human
aaggaggagauacuaagggc

SEQ ID NO: 806410 - RNA, 22 nt, Human
aauaccaagaauaaaaccagug

SEQ ID NO: 806411 - RNA, 19 nt, Human
aauaucccuuacuaauacu

SEQ ID NO: 806412 - RNA, 19 nt, Human
aaucauaguuacauacuug

SEQ ID NO: 806413 - RNA, 22 nt, Human
aauccuacuucgugcaacacac

SEQ ID NO: 806414 - RNA, 18 nt, Human
aauugauagacaaacacc

SEQ ID NO: 806415 - RNA, 19 nt, Human
acaaaacaaggauaaaaag

SEQ ID NO: 806416 - RNA, 20 nt, Human
acaaaacaaggauaaaaagu

SEQ ID NO: 806417 - RNA, 22 nt, Human
acaaagaagcccacuuucccca

SEQ ID NO: 806418 - RNA, 24 nt, Human
acaacugucugccacugacugcaa

SEQ ID NO: 806419 - RNA, 30 nt, Human
acaagacugaaaacgucuguaucccaugcc

SEQ ID NO: 806420 - RNA, 19 nt, Human
acaagcugaaccuguucuu

SEQ ID NO: 806421 - RNA, 23 nt, Human
acacacacacacacacacacaca

SEQ ID NO: 806422 - RNA, 23 nt, Human
acacacacacacacacacacaca

SEQ ID NO: 806423 - RNA, 23 nt, Human
acacacacacacacacacacaca

SEQ ID NO: 806424 - RNA, 23 nt, Human
acacacacacacacacacacaca

SEQ ID NO: 806425 - RNA, 23 nt, Human
acacacacacacacacacacaca

SEQ ID NO: 806426 - RNA, 23 nt, Human
acacacacacacacacacacaca

SEQ ID NO: 806427 - RNA, 24 nt, Human
acacacacacacacacacacccag

SEQ ID NO: 806428 - RNA, 24 nt, Human
acacacacacacacacacccagag

SEQ ID NO: 806429 - RNA, 24 nt, Human
acagaaaaaaaaauccaaacaaaa

SEQ ID NO: 806430 - RNA, 24 nt, Human
acagaauggccagaaaacuguaug

SEQ ID NO: 806431 - RNA, 23 nt, Human
acauaaacccaccucaggccagc

SEQ ID NO: 806432 - RNA, 18 nt, Human
acauaugaucauaugaag

SEQ ID NO: 806433 - RNA, 23 nt, Human
accauuuacaacuccuccaucac

SEQ ID NO: 806434 - RNA, 25 nt, Human
acuaagacacagagacaacagacug

SEQ ID NO: 806435 - RNA, 23 nt, Human
acuaguuuaucagaugguugcac

SEQ ID NO: 806436 - RNA, 23 nt, Human
agaaaaaaaaauccaaacaaaaa

SEQ ID NO: 806437 - RNA, 21 nt, Human
agaaaaacaaaccagcauaag

SEQ ID NO: 806438 - RNA, 23 nt, Human
agaauagccagggcaucuaagca

SEQ ID NO: 806439 - RNA, 22 nt, Human
agacaacagacuggcuaguuac

SEQ ID NO: 806440 - RNA, 18 nt, Human
agacaccacucagaaugg

SEQ ID NO: 806441 - RNA, 19 nt, Human
agagggaaaacagcuugag

SEQ ID NO: 806442 - RNA, 18 nt, Human
agaugagugccacacuca

SEQ ID NO: 806443 - RNA, 20 nt, Human
agccacugaaugcaggcaaa

SEQ ID NO: 806444 - RNA, 22 nt, Human
agcuaaagaguauguuaaauau

SEQ ID NO: 806445 - RNA, 20 nt, Human
agcuuuaaaaaggaaauguu

SEQ ID NO: 806446 - RNA, 25 nt, Human
aggaaaaacaaaguaaccacuuaaa

SEQ ID NO: 806447 - RNA, 21 nt, Human
aggaaaauggaaaauauacaa

SEQ ID NO: 806448 - RNA, 23 nt, Human
agggagaccugcagagcugucug

SEQ ID NO: 806449 - RNA, 24 nt, Human
agucaagugaugucaaucacacaa

SEQ ID NO: 806450 - RNA, 19 nt, Human
agugcaguaucaagaaaug

SEQ ID NO: 806451 - RNA, 19 nt, Human
auaaaauacucuucaguua

SEQ ID NO: 806452 - RNA, 19 nt, Human
auagcacaaagaagcccac

SEQ ID NO: 806453 - RNA, 18 nt, Human
auaguuaaaaagauacaa

SEQ ID NO: 806454 - RNA, 18 nt, Human
aucauucaccaaggacag

SEQ ID NO: 806455 - RNA, 27 nt, Human
augaaaaccaaacauacuuuaaaguaa

SEQ ID NO: 806456 - RNA, 20 nt, Human
augaugccauaugagaucaa

SEQ ID NO: 806457 - RNA, 22 nt, Human
auuacagaaauacacagaacag

SEQ ID NO: 806458 - RNA, 25 nt, Human
auuacagaaauacacagaacagagg

SEQ ID NO: 806459 - RNA, 19 nt, Human
auucaccacuagcaaaacc

SEQ ID NO: 806460 - RNA, 21 nt, Human
caaaaagacagacauauuaaa

SEQ ID NO: 806461 - RNA, 20 nt, Human
caaaacacacacacacacac

SEQ ID NO: 806462 - RNA, 23 nt, Human
caaaaccaauggaaaaauguaac

SEQ ID NO: 806463 - RNA, 21 nt, Human
caaaauaucauugauuaaagc

SEQ ID NO: 806464 - RNA, 24 nt, Human
caaaauguaucuguggcuaauuaa

SEQ ID NO: 806465 - RNA, 21 nt, Human
caaaguaaccacuuaaaaaac

SEQ ID NO: 806466 - RNA, 20 nt, Human
caaauacauauuuguguaua

SEQ ID NO: 806467 - RNA, 19 nt, Human
caacagcaauaauugugua

SEQ ID NO: 806468 - RNA, 20 nt, Human
caacaggaguaauaauuaag

SEQ ID NO: 806469 - RNA, 22 nt, Human
caacuccuccaucaccauuucu

SEQ ID NO: 806470 - RNA, 18 nt, Human
caagaaauguugcauaac

SEQ ID NO: 806471 - RNA, 22 nt, Human
caagaagcacaucauagcugga

SEQ ID NO: 806472 - RNA, 21 nt, Human
caauaaaaugggugcaccaca

SEQ ID NO: 806473 - RNA, 22 nt, Human
cacaaugcucauaauguuagcc

SEQ ID NO: 806474 - RNA, 20 nt, Human
cacacacacacacacacaca

SEQ ID NO: 806475 - RNA, 20 nt, Human
cacacacacacacacacaca

SEQ ID NO: 806476 - RNA, 20 nt, Human
cacacacacacacacacaca

SEQ ID NO: 806477 - RNA, 20 nt, Human
cacacacacacacacacaca

SEQ ID NO: 806478 - RNA, 20 nt, Human
cacacacacacacacacaca

SEQ ID NO: 806479 - RNA, 20 nt, Human
cacacacacacacacacaca

SEQ ID NO: 806480 - RNA, 20 nt, Human
cacacacacacacacacaca

SEQ ID NO: 806481 - RNA, 20 nt, Human
cacacacacacacacacaca

SEQ ID NO: 806482 - RNA, 20 nt, Human
cacacacacacacacacaca

SEQ ID NO: 806483 - RNA, 20 nt, Human
cacacacacacacacacaca

SEQ ID NO: 806484 - RNA, 20 nt, Human
cacacacacacacacacaca

SEQ ID NO: 806485 - RNA, 22 nt, Human
cacacacacacacacacacaca

SEQ ID NO: 806486 - RNA, 22 nt, Human
cacacacacacacacacacaca

SEQ ID NO: 806487 - RNA, 22 nt, Human
cacacacacacacacacacaca

SEQ ID NO: 806488 - RNA, 22 nt, Human
cacacacacacacacacacaca

SEQ ID NO: 806489 - RNA, 22 nt, Human
cacacacacacacacacacaca

SEQ ID NO: 806490 - RNA, 26 nt, Human
cacacacacacacacacacacacaca

SEQ ID NO: 806491 - RNA, 26 nt, Human
cacacacacacacacacacacacaca

SEQ ID NO: 806492 - RNA, 26 nt, Human
cacacacacacacacacacacacaca

SEQ ID NO: 806493 - RNA, 26 nt, Human
cacacacacacacacacacacacaca

SEQ ID NO: 806494 - RNA, 26 nt, Human
cacacacacacacacacacacacaca

SEQ ID NO: 806495 - RNA, 26 nt, Human
cacacacacacacacacacacacaca

SEQ ID NO: 806496 - RNA, 30 nt, Human; identical to SEQ ID NO: 326474

SEQ ID NO: 806497 - RNA, 28 nt, Human
cacacacacacacacacacacacaccca

SEQ ID NO: 806498 - RNA, 18 nt, Human
cacacacacacccagagc

SEQ ID NO: 806499 - RNA, 27 nt, Human
cacagaacagaggauaaauacaaucac

SEQ ID NO: 806500 - RNA, 23 nt, Human
cacagagacaacagacuggcuag

SEQ ID NO: 806501 - RNA, 31 nt, Human
cacaucgaaaagugccauauuguaaaucauu

SEQ ID NO: 806502 - RNA, 19 nt, Human
caccaaagauuaauaucaa

SEQ ID NO: 806503 - RNA, 22 nt, Human
caccuauucuucauaaaaacaa

SEQ ID NO: 806504 - RNA, 21 nt, Human
cagaaaaagaucugaaugcau

SEQ ID NO: 806505 - RNA, 22 nt, Human
cagaagcacuccccccaacccc

SEQ ID NO: 806506 - RNA, 22 nt, Human
cagacuacagaaaaagaucuga

SEQ ID NO: 806507 - RNA, 20 nt, Human
caggaucaaauaaaaaauuc

SEQ ID NO: 806508 - RNA, 26 nt, Human
caggaucaaauaaaaaauucuacuag

SEQ ID NO: 806509 - RNA, 21 nt, Human
cagguaagaaaacucaaauga

SEQ ID NO: 806510 - RNA, 23 nt, Human
caucaccauuucucuauagugca

SEQ ID NO: 806511 - RNA, 23 nt, Human
caugcaagaaaggaggagauacu

SEQ ID NO: 806512 - RNA, 24 nt, Human
cauuaaagaaaaacaaaccagcau

SEQ ID NO: 806513 - RNA, 19 nt, Human
cauucaccaaggacagucc

SEQ ID NO: 806514 - RNA, 20 nt, Human
cauucuacagcucugaacgc

SEQ ID NO: 806515 - RNA, 20 nt, Human
cauuugaaguccauaugauu

SEQ ID NO: 806516 - RNA, 19 nt, Human
cauuuuuaaaaaauggaaa

SEQ ID NO: 806517 - RNA, 23 nt, Human
ccaaaauaucauugauuaaagca

SEQ ID NO: 806518 - RNA, 24 nt, Human
ccacacaccaacagaauggccaga

SEQ ID NO: 806519 - RNA, 27 nt, Human
ccaugcaagaaaggaggagauacuaag

SEQ ID NO: 806520 - RNA, 21 nt, Human
cccaaaagucuaaucauaguu

SEQ ID NO: 806521 - RNA, 20 nt, Human
cccacaggcccaaucugacc

SEQ ID NO: 806522 - RNA, 19 nt, Human
cccagagccauccuccccc

SEQ ID NO: 806523 - RNA, 24 nt, Human
cccauaauuuaaaauccaugaggc

SEQ ID NO: 806524 - RNA, 22 nt, Human
ccccaaaacaaaaagacagaca

SEQ ID NO: 806525 - RNA, 26 nt, Human
ccccaagaaaacuaccuucaggaaaa

SEQ ID NO: 806526 - RNA, 19 nt, Human
ccccccaagaaaacuaccu

SEQ ID NO: 806527 - RNA, 22 nt, Human
ccccugaugcaccaaagauuaa

SEQ ID NO: 806528 - RNA, 22 nt, Human
ccucacccauauuauuucugga

SEQ ID NO: 806529 - RNA, 21 nt, Human
ccucugagauuccagggaaga

SEQ ID NO: 806530 - RNA, 19 nt, Human
cgugauacuuccaccaugu

SEQ ID NO: 806531 - RNA, 25 nt, Human
cuaauuucaaaaaaacugaaggaau

SEQ ID NO: 806532 - RNA, 26 nt, Human
cuaauuucaaaaaaacugaaggaauc

SEQ ID NO: 806533 - RNA, 20 nt, Human
cuacacuauuuucccauaau

SEQ ID NO: 806534 - RNA, 18 nt, Human
cuccuccaucaccauuuc

SEQ ID NO: 806535 - RNA, 22 nt, Human
cucgcaccacaucaggugguuu

SEQ ID NO: 806536 - RNA, 19 nt, Human
cucuaaaggcagagcugag

SEQ ID NO: 806537 - RNA, 21 nt, Human
cugaguuagccucuacauuua

SEQ ID NO: 806538 - RNA, 21 nt, Human
cugcaacagauuuuuuuuggu

SEQ ID NO: 806539 - RNA, 23 nt, Human
cuggacgcaacagucaagugaug

SEQ ID NO: 806540 - RNA, 19 nt, Human
cuggacuaagacacagaga

SEQ ID NO: 806541 - RNA, 22 nt, Human
cugggacucuucagguuuaaag

SEQ ID NO: 806542 - RNA, 18 nt, Human
cuguaccuaaagucugcc

SEQ ID NO: 806543 - RNA, 22 nt, Human
cugucacaaacuaagagcuaua

SEQ ID NO: 806544 - RNA, 20 nt, Human
cuuuuuuuugugguuaaaca

SEQ ID NO: 806545 - RNA, 22 nt, Human
gaaaaaaaaauccaaacaaaaa

SEQ ID NO: 806546 - RNA, 22 nt, Human
gaacacagccacacuaauuuac

SEQ ID NO: 806547 - RNA, 21 nt, Human
gaacagaccuuagucuguauc

SEQ ID NO: 806548 - RNA, 22 nt, Human
gaagugugcacguuugugaaua

SEQ ID NO: 806549 - RNA, 19 nt, Human
gagucuuaguuaucaagcc

SEQ ID NO: 806550 - RNA, 19 nt, Human
gcaacacccgguauaaagc

SEQ ID NO: 806551 - RNA, 21 nt, Human
gccaaaaccaauggaaaaaug

SEQ ID NO: 806552 - RNA, 22 nt, Human
ggaaaaacaaaguaaccacuua

SEQ ID NO: 806553 - RNA, 20 nt, Human
ggacagucccaaggcaucua

SEQ ID NO: 806554 - RNA, 23 nt, Human
ggauguagucugggacucuucag

SEQ ID NO: 806555 - RNA, 22 nt, Human
gugaaguacaauucaaaaccug

SEQ ID NO: 806556 - RNA, 20 nt, Human
gugaccaaaucaaggagaac

SEQ ID NO: 806557 - RNA, 20 nt, Human
uaaaaccagugaagaacugc

SEQ ID NO: 806558 - RNA, 25 nt, Human
uaaaagauacuacacauuuguaacu

SEQ ID NO: 806559 - RNA, 23 nt, Human
uaaaaugggugcaccacacacca

SEQ ID NO: 806560 - RNA, 19 nt, Human
uaaaccccugaugcaccaa

SEQ ID NO: 806561 - RNA, 22 nt, Human
uaacaaagcucuaaccuguaac

SEQ ID NO: 806562 - RNA, 21 nt, Human
uaacagaaaaaaaaauccaaa

SEQ ID NO: 806563 - RNA, 22 nt, Human
uaacaggcccccccaagaaaac

SEQ ID NO: 806564 - RNA, 21 nt, Human
uaacaugccacucacauuaua

SEQ ID NO: 806565 - RNA, 22 nt, Human
uaaccugguacacgugcaguga

SEQ ID NO: 806566 - RNA, 22 nt, Human
uaagaaaaguucgcaggaucaa

SEQ ID NO: 806567 - RNA, 20 nt, Human
uaagcauauguccagccaga

SEQ ID NO: 806568 - RNA, 23 nt, Human
uaagcauauguccagccagaauc

SEQ ID NO: 806569 - RNA, 23 nt, Human
uaauaaaacacaaaacaaggaua

SEQ ID NO: 806570 - RNA, 22 nt, Human
uaauauaacaggcccccccaag

SEQ ID NO: 806571 - RNA, 24 nt, Human
uacaacuccuccaucaccauuucu

SEQ ID NO: 806572 - RNA, 25 nt, Human
uacagaauaaagcuauagcauguga

SEQ ID NO: 806573 - RNA, 18 nt, Human
uaccaagaauaaaaccag

SEQ ID NO: 806574 - RNA, 26 nt, Human
uacccaaauccuacuucgugcaacac

SEQ ID NO: 806575 - RNA, 23 nt, Human
uacgugaaguacaauucaaaacc

SEQ ID NO: 806576 - RNA, 25 nt, Human
uacugaccauguguuuaucuuacac

SEQ ID NO: 806577 - RNA, 21 nt, Human
uacugccaaauggccaauacc

SEQ ID NO: 806578 - RNA, 24 nt, Human
uagaucuacaaaucaaaauaguuc

SEQ ID NO: 806579 - RNA, 20 nt, Human
uagccagggcaucuaagcag

SEQ ID NO: 806580 - RNA, 18 nt, Human
uaguguggguaguucaga

SEQ ID NO: 806581 - RNA, 25 nt, Human
uauaagaaaaguucgcaggaucaaa

SEQ ID NO: 806582 - RNA, 24 nt, Human
uauacaauaucuuacaaaaauuuu

SEQ ID NO: 806583 - RNA, 20 nt, Human
uauauauacuguaacacauu

SEQ ID NO: 806584 - RNA, 21 nt, Human
uaucaagaaauguugcauaac

SEQ ID NO: 806585 - RNA, 20 nt, Human
uaucauugauuaaagcauca

SEQ ID NO: 806586 - RNA, 24 nt, Human
uaucuaaaacuacacuauuugugg

SEQ ID NO: 806587 - RNA, 22 nt, Human
uauuaaggaaaaacaaaguaac

SEQ ID NO: 806588 - RNA, 18 nt, Human
uauuagaagccaaaacca

SEQ ID NO: 806589 - RNA, 23 nt, Human
uauuguugugccccaaaacaaaa

SEQ ID NO: 806590 - RNA, 21 nt, Human
uauuuuaucuugaauaaggaa

SEQ ID NO: 806591 - RNA, 19 nt, Human
ucaaaaacuaccagauuuu

SEQ ID NO: 806592 - RNA, 21 nt, Human
ucaaaacacacacacacacac

SEQ ID NO: 806593 - RNA, 31 nt, Human
ucaaaacacacacacacacacacacacacag

SEQ ID NO: 806594 - RNA, 22 nt, Human
ucaaacuguagcauguaggaua

SEQ ID NO: 806595 - RNA, 20 nt, Human
ucacaaacuaagagcuauaa

SEQ ID NO: 806596 - RNA, 18 nt, Human
ucacacaaguagugaaaa

SEQ ID NO: 806597 - RNA, 20 nt, Human
ucacuuuuauuuccaaguuu

SEQ ID NO: 806598 - RNA, 22 nt, Human
ucagaauaaccuaacuuaagug

SEQ ID NO: 806599 - RNA, 20 nt, Human
ucaggugguuucuuugcuuc

SEQ ID NO: 806600 - RNA, 24 nt, Human
uccacuucuacugucaagaagcac

SEQ ID NO: 806601 - RNA, 22 nt, Human
uccccaaauaaaaauaacuuaa

SEQ ID NO: 806602 - RNA, 27 nt, Human
uccccccaaccccuguuuuuaauaccu

SEQ ID NO: 806603 - RNA, 18 nt, Human
uccgcagaaauguauuca

SEQ ID NO: 806604 - RNA, 21 nt, Human
ucuaauacauaacaguaacac

SEQ ID NO: 806605 - RNA, 30 nt, Human
ucucauaaaugaauuuucauaaaaacacaa

SEQ ID NO: 806606 - RNA, 19 nt, Human
ucucugcagaagugugcac

SEQ ID NO: 806607 - RNA, 26 nt, Human
ucucugcagaagugugcacguuugug

SEQ ID NO: 806608 - RNA, 21 nt, Human
ucuggacuaagacacagagac

SEQ ID NO: 806609 - RNA, 25 nt, Human
ucuggacuaagacacagagacaacc

SEQ ID NO: 806610 - RNA, 18 nt, Human
ucuuugcuuccuuggaug

SEQ ID NO: 806611 - RNA, 26 nt, Human
ugaacaaaaaacuacuaaacaccaca

SEQ ID NO: 806612 - RNA, 22 nt, Human
ugaauaaggaaguuggagagca

SEQ ID NO: 806613 - RNA, 26 nt, Human
ugacuaaaauaaaagauacuacacau

SEQ ID NO: 806614 - RNA, 18 nt, Human
ugacucugguuugggagg

SEQ ID NO: 806615 - RNA, 21 nt, Human
ugagcugaacaaaaaacuacu

SEQ ID NO: 806616 - RNA, 18 nt, Human
ugaggcaaugacaaauag

SEQ ID NO: 806617 - RNA, 18 nt, Human
ugauagacaaacaccaag

SEQ ID NO: 806618 - RNA, 20 nt, Human
ugcaagaaaggaggagauac

SEQ ID NO: 806619 - RNA, 25 nt, Human
ugcauaaccucaacacauaaaccca

SEQ ID NO: 806620 - RNA, 23 nt, Human
ugcauguguguaauccaucucuu

SEQ ID NO: 806621 - RNA, 21 nt, Human
ugccccaaaacaaaaagacag

SEQ ID NO: 806622 - RNA, 23 nt, Human
ugcuaggucuagucaaauguccc

SEQ ID NO: 806623 - RNA, 20 nt, Human
ugcuuuaagaaagguggcga

SEQ ID NO: 806624 - RNA, 22 nt, Human
ugcuuuuuuuugugguuaaaca

SEQ ID NO: 806625 - RNA, 18 nt, Human
uggaagcaaaaccuacau

SEQ ID NO: 806626 - RNA, 24 nt, Human
uggaagcaaaaccuacauguauaa

SEQ ID NO: 806627 - RNA, 22 nt, Human
uggauaacaaagcucuaaccug

SEQ ID NO: 806628 - RNA, 18 nt, Human
uggcagaaucacauagcu

SEQ ID NO: 806629 - RNA, 21 nt, Human
uggcauuugaaguccauauga

SEQ ID NO: 806630 - RNA, 19 nt, Human
uggccagaaaacuguaugu

SEQ ID NO: 806631 - RNA, 18 nt, Human
uggcuaauuaaaugcugc

SEQ ID NO: 806632 - RNA, 20 nt, Human
uguaaacagguaagaaaacu

SEQ ID NO: 806633 - RNA, 20 nt, Human
uguauguuucuuuacuuuua

SEQ ID NO: 806634 - RNA, 18 nt, Human
ugucacaaacuaagagcu

SEQ ID NO: 806635 - RNA, 22 nt, Human
ugucugccacugacugcaaaau

SEQ ID NO: 806636 - RNA, 22 nt, Human
ugugaaauuacaauauauuuau

SEQ ID NO: 806637 - RNA, 18 nt, Human
uguguauauagauauaca

SEQ ID NO: 806638 - RNA, 18 nt, Human
uguguauauagauauaca

SEQ ID NO: 806639 - RNA, 20 nt, Human
uguguauauagauauacaua

SEQ ID NO: 806640 - RNA, 26 nt, Human
uguuuaguacaagcugaaccuguucu

SEQ ID NO: 806641 - RNA, 19 nt, Human
uuaaaagugauuucauacu

SEQ ID NO: 806642 - RNA, 27 nt, Human
uuaaaguaaauaccauuguaaauccug

SEQ ID NO: 806643 - RNA, 20 nt, Human
uuacagaaauacacagaaca

SEQ ID NO: 806644 - RNA, 18 nt, Human
uuacagaauaaagcuaua

SEQ ID NO: 806645 - RNA, 20 nt, Human
uuaggagaaagaaaaugcca

SEQ ID NO: 806646 - RNA, 20 nt, Human
uucaaacacaacagcaauaa

SEQ ID NO: 806647 - RNA, 23 nt, Human
uucaagaagugaaacauuacaga

SEQ ID NO: 806648 - RNA, 21 nt, Human
uucucuuauucuaaugcaugu

SEQ ID NO: 806649 - RNA, 19 nt, Human
uugaaaccagaaauauccc

SEQ ID NO: 806650 - RNA, 22 nt, Human
uugaaaccagaaauaucccuua

SEQ ID NO: 806651 - RNA, 24 nt, Human
uugaaaccagaaauaucccuuacu

SEQ ID NO: 806652 - RNA, 22 nt, Human
uugcauaaccucaacacauaaa

SEQ ID NO: 806653 - RNA, 21 nt, Human
uuggaacacagccacacuaau

SEQ ID NO: 806654 - RNA, 23 nt, Human
uuggcacugaguuagccucuaca

SEQ ID NO: 806655 - RNA, 23 nt, Human
uuguuugguauucucgcaccaca

SEQ ID NO: 806656 - RNA, 24 nt, Human
uuuaaacucauaauuaauuacacu

SEQ ID NO: 806657 - RNA, 23 nt, Human
uuucauaggaauuaaucauggcu

SEQ ID NO: 806658 - RNA, 18 nt, Human
uuugcuguaccuaaaguc

SEQ ID NO: 806659 - RNA, 33 nt, Human
uuuucaaaacacacacacacacacacacacagu

SEQ ID NO: 806660 - RNA, 22 nt, Human
aaacagcccugaugccuuucca

SEQ ID NO: 806661 - RNA, 18 nt, Human
aaagugcuggauuacagg

SEQ ID NO: 806662 - RNA, 23 nt, Human
aaagugcuggauuacaggcauga

SEQ ID NO: 806663 - RNA, 18 nt, Human
aacaaauuuacauagaua

SEQ ID NO: 806664 - RNA, 20 nt, Human
aacauagugagaucccaucu

SEQ ID NO: 806665 - RNA, 21 nt, Human
aacauagugagaucccaucuc

SEQ ID NO: 806666 - RNA, 18 nt, Human
aacaugggauuggaaaga

SEQ ID NO: 806667 - RNA, 24 nt, Human
aaccacguggauuccccacaaacg

SEQ ID NO: 806668 - RNA, 23 nt, Human
aaccaggcgugguggugcacgcc

SEQ ID NO: 806669 - RNA, 22 nt, Human
aagagcacgacccugucgcaaa

SEQ ID NO: 806670 - RNA, 19 nt, Human
aaggaaccaaaacuagaac

SEQ ID NO: 806671 - RNA, 22 nt, Human
aagugcugggagcacacaaaga

SEQ ID NO: 806672 - RNA, 24 nt, Human
aauuuuguauuucugauagagacg

SEQ ID NO: 806673 - RNA, 23 nt, Human
acagacacacgaauggaggaaca

SEQ ID NO: 806674 - RNA, 22 nt, Human
accacguggauuccccacaaac

SEQ ID NO: 806675 - RNA, 18 nt, Human
acgggguuucuccauguu

SEQ ID NO: 806676 - RNA, 21 nt, Human
acgggguuucuccauguugcc

SEQ ID NO: 806677 - RNA, 23 nt, Human
acgggguuucuccauguugccua

SEQ ID NO: 806678 - RNA, 24 nt, Human
acgggguuucuccauguugccuag

SEQ ID NO: 806679 - RNA, 25 nt, Human
acucaucuuagccucccaaagugcu

SEQ ID NO: 806680 - RNA, 23 nt, Human
acucaugcugaaggugcucucuu

SEQ ID NO: 806681 - RNA, 18 nt, Human
acucugucauccaggcug

SEQ ID NO: 806682 - RNA, 25 nt, Human
acucugucauccaggcuggagugca

SEQ ID NO: 806683 - RNA, 20 nt, Human
acugcaguccagucugggag

SEQ ID NO: 806684 - RNA, 24 nt, Human
acuggccaagugugguggcucaca

SEQ ID NO: 806685 - RNA, 19 nt, Human
agaaaagaaggaagugcug

SEQ ID NO: 806686 - RNA, 23 nt, Human
agaagaaaggcugggagacagaa

SEQ ID NO: 806687 - RNA, 26 nt, Human
agacacagcccaucacaggauaccca

SEQ ID NO: 806688 - RNA, 18 nt, Human
agagagaagaaaggcugg

SEQ ID NO: 806689 - RNA, 22 nt, Human
agaugcuggggguugguucuga

SEQ ID NO: 806690 - RNA, 21 nt, Human
agauggugaaaagcagcucag

SEQ ID NO: 806691 - RNA, 19 nt, Human
agcaauccacucaucuuag

SEQ ID NO: 806692 - RNA, 24 nt, Human
agcacuuugggaggcugagguggg

SEQ ID NO: 806693 - RNA, 21 nt, Human
agccugagcaacauagugaga

SEQ ID NO: 806694 - RNA, 24 nt, Human
agcucugagggaggcugagguggg

SEQ ID NO: 806695 - RNA, 18 nt, Human
aggagcugacccagggca

SEQ ID NO: 806696 - RNA, 19 nt, Human
aggcaugaaccacugcacc

SEQ ID NO: 806697 - RNA, 24 nt, Human
aggcgugguggugcacgccuguag

SEQ ID NO: 806698 - RNA, 24 nt, Human
aggcugaggugggaggaucacuug

SEQ ID NO: 806699 - RNA, 24 nt, Human
aggcugaggugggaggaucacuug

SEQ ID NO: 806700 - RNA, 18 nt, Human
aggugggaggaucacuug

SEQ ID NO: 806701 - RNA, 23 nt, Human
aggugggaggaucacuugagccc

SEQ ID NO: 806702 - RNA, 21 nt, Human
aggugggaggaucacuugggu

SEQ ID NO: 806703 - RNA, 24 nt, Human
aggugggaggaucacuugggucug

SEQ ID NO: 806704 - RNA, 20 nt, Human
agugcaguggugggguccug

SEQ ID NO: 806705 - RNA, 25 nt, Human
agugcaguggugggguccugggcuc

SEQ ID NO: 806706 - RNA, 23 nt, Human
aguggcuggggccacaggcaugu

SEQ ID NO: 806707 - RNA, 18 nt, Human
auaaaaacuggccugaaa

SEQ ID NO: 806708 - RNA, 23 nt, Human
auacuccacugcucacaaugcgc

SEQ ID NO: 806709 - RNA, 18 nt, Human
auagagaaguuguccaca

SEQ ID NO: 806710 - RNA, 22 nt, Human
auagagacgggguuucuccaug

SEQ ID NO: 806711 - RNA, 20 nt, Human
auccacaaacuuagaaucac

SEQ ID NO: 806712 - RNA, 22 nt, Human
auggguccuugcugauugaccu

SEQ ID NO: 806713 - RNA, 23 nt, Human
auggguccuugcugauugaccug

SEQ ID NO: 806714 - RNA, 24 nt, Human
auugugccacugcaguccagucug

SEQ ID NO: 806715 - RNA, 24 nt, Human
caaacuuagaaucacuugcaucca

SEQ ID NO: 806716 - RNA, 22 nt, Human
caaagucacccagcauccauga

SEQ ID NO: 806717 - RNA, 23 nt, Human
caaagugcuggauuacaggcaug

SEQ ID NO: 806718 - RNA, 24 nt, Human
caaccacguggauuccccacaaac

SEQ ID NO: 806719 - RNA, 19 nt, Human
caagaggucccgaucccuc

SEQ ID NO: 806720 - RNA, 24 nt, Human
caauccacucaucuuagccuccca

SEQ ID NO: 806721 - RNA, 27 nt, Human
cacaaauccacaaacuuagaaucacuu

SEQ ID NO: 806722 - RNA, 19 nt, Human
cacaaugcgcgcccugaau

SEQ ID NO: 806723 - RNA, 24 nt, Human
cacaccuguaaucccagcacuuug

SEQ ID NO: 806724 - RNA, 23 nt, Human
cacacgaauggaggaacauggga

SEQ ID NO: 806725 - RNA, 21 nt, Human
cacaggcaugugccaccacac

SEQ ID NO: 806726 - RNA, 19 nt, Human
cacagggcuaaguaaagca

SEQ ID NO: 806727 - RNA, 19 nt, Human
caccuguaaucccagcacu

SEQ ID NO: 806728 - RNA, 24 nt, Human
caccuguaaucccagcacuuuggg

SEQ ID NO: 806729 - RNA, 18 nt, Human
cacgccuguagucccagc

SEQ ID NO: 806730 - RNA, 18 nt, Human
cacucugcccccgaacuu

SEQ ID NO: 806731 - RNA, 23 nt, Human
cacucugucauccaggcuggagu

SEQ ID NO: 806732 - RNA, 24 nt, Human
cacucugucauccaggcuggagug

SEQ ID NO: 806733 - RNA, 23 nt, Human
cacugucaaacagcccugaugcc

SEQ ID NO: 806734 - RNA, 18 nt, Human
cagcaacaacucaugcug

SEQ ID NO: 806735 - RNA, 23 nt, Human
cagcaacaacucaugcugaaggu

SEQ ID NO: 806736 - RNA, 24 nt, Human
cagcacuuugggaggcugaggugg

SEQ ID NO: 806737 - RNA, 22 nt, Human
cagcauccaugauagaggaagg

SEQ ID NO: 806738 - RNA, 22 nt, Human
cagcccaucacaggauacccaa

SEQ ID NO: 806739 - RNA, 18 nt, Human
cagccuucacucaguuuu

SEQ ID NO: 806740 - RNA, 26 nt, Human
cagggcuguuuuuacaagagguuuug

SEQ ID NO: 806741 - RNA, 24 nt, Human
caguauuuaaaaaccacuguacca

SEQ ID NO: 806742 - RNA, 25 nt, Human
cauagugagaucccaucucuacaaa

SEQ ID NO: 806743 - RNA, 24 nt, Human
cauccaggcuggagugcaguggug

SEQ ID NO: 806744 - RNA, 21 nt, Human
cauguugccuaggcuggucuc

SEQ ID NO: 806745 - RNA, 24 nt, Human
cauguugccuaggcuggucucgaa

SEQ ID NO: 806746 - RNA, 18 nt, Human
ccaaagugcuggauuaca

SEQ ID NO: 806747 - RNA, 23 nt, Human
ccaaagugcuggauuacaggcau

SEQ ID NO: 806748 - RNA, 21 nt, Human
ccaccacacucggcuaaauuu

SEQ ID NO: 806749 - RNA, 20 nt, Human
ccacugcaguccagucuggg

SEQ ID NO: 806750 - RNA, 24 nt, Human
ccacugcaguccagucugggagac

SEQ ID NO: 806751 - RNA, 21 nt, Human
ccaggcuggagugcaguggug

SEQ ID NO: 806752 - RNA, 23 nt, Human
ccauguugccuaggcuggucucg

SEQ ID NO: 806753 - RNA, 24 nt, Human
cccaaagugcuggauuacaggcau

SEQ ID NO: 806754 - RNA, 20 nt, Human
cccaucucagcguucagagu

SEQ ID NO: 806755 - RNA, 18 nt, Human
ccccacucugcccccgaa

SEQ ID NO: 806756 - RNA, 21 nt, Human
ccgggcuuugggggagggugg

SEQ ID NO: 806757 - RNA, 18 nt, Human
ccuaggcucaagcaaucc

SEQ ID NO: 806758 - RNA, 19 nt, Human
ccuccaagaggucccgauc

SEQ ID NO: 806759 - RNA, 25 nt, Human
ccugcaaccaugaggcccucaaggc

SEQ ID NO: 806760 - RNA, 20 nt, Human
ccugggcucaagugaccuuc

SEQ ID NO: 806761 - RNA, 22 nt, Human
ccuguaaccagagugaacacag

SEQ ID NO: 806762 - RNA, 22 nt, Human
ccuguagucccagcucugaggg

SEQ ID NO: 806763 - RNA, 24 nt, Human
ccuguggagaccaucaucgaggcc

SEQ ID NO: 806764 - RNA, 24 nt, Human
cgagaucagccugagcaacauagu

SEQ ID NO: 806765 - RNA, 21 nt, Human
cgccuguagucccagcucuga

SEQ ID NO: 806766 - RNA, 24 nt, Human
cgggguuucuccauguugccuagg

SEQ ID NO: 806767 - RNA, 19 nt, Human
cuauccacaaauccacaaa

SEQ ID NO: 806768 - RNA, 24 nt, Human
cucaagugaccuucccaucucagc

SEQ ID NO: 806769 - RNA, 22 nt, Human
cucacaccuguaaucccagcac

SEQ ID NO: 806770 - RNA, 24 nt, Human
cucacaccuguaaucccagcacuu

SEQ ID NO: 806771 - RNA, 24 nt, Human
cucacucugucauccaggcuggag

SEQ ID NO: 806772 - RNA, 24 nt, Human
cuccauguugccuaggcuggucuc

SEQ ID NO: 806773 - RNA, 22 nt, Human
cucucauaaacaggaacuuuau

SEQ ID NO: 806774 - RNA, 22 nt, Human
cugcagugagcuaugauugugc

SEQ ID NO: 806775 - RNA, 20 nt, Human
gaacacaggucauagcagcc

SEQ ID NO: 806776 - RNA, 23 nt, Human
gaccuaaaauuaaaaaaaacaca

SEQ ID NO: 806777 - RNA, 23 nt, Human
gagacgggguuucuccauguugc

SEQ ID NO: 806778 - RNA, 22 nt, Human
gaggugggaggaucacuugggu

SEQ ID NO: 806779 - RNA, 23 nt, Human
gagugcaguggugggguccuggg

SEQ ID NO: 806780 - RNA, 24 nt, Human
gaucacuugagcccaggagcucga

SEQ ID NO: 806781 - RNA, 19 nt, Human
gaucuuccagcaacaacuc

SEQ ID NO: 806782 - RNA, 23 nt, Human
gauuacaggcaugaaccacugca

SEQ ID NO: 806783 - RNA, 19 nt, Human
gcaacaacucaugcugaag

SEQ ID NO: 806784 - RNA, 22 nt, Human
gcccaggagcucgagaucagcc

SEQ ID NO: 806785 - RNA, 22 nt, Human
gccuguagucccagcucugagg

SEQ ID NO: 806786 - RNA, 26 nt, Human
gcuggagugcaguggugggguccugg

SEQ ID NO: 806787 - RNA, 19 nt, Human
ggaggaacaugggauugga

SEQ ID NO: 806788 - RNA, 23 nt, Human
ggaucacuugagcccaggagcuc

SEQ ID NO: 806789 - RNA, 22 nt, Human
ggauuacaggcaugaaccacug

SEQ ID NO: 806790 - RNA, 20 nt, Human
ggcagagauggguccuugcu

SEQ ID NO: 806791 - RNA, 24 nt, Human
ggcaggugaaacucugaagccaga

SEQ ID NO: 806792 - RNA, 23 nt, Human
ggcucaagcaauccacucaucuu

SEQ ID NO: 806793 - RNA, 21 nt, Human
ggcucacaccuguaaucccag

SEQ ID NO: 806794 - RNA, 25 nt, Human
gggaagagguggugacuucccaaag

SEQ ID NO: 806795 - RNA, 23 nt, Human
gggaggcugaggugggaggauca

SEQ ID NO: 806796 - RNA, 22 nt, Human
gggaggucaaagcugcagugag

SEQ ID NO: 806797 - RNA, 21 nt, Human
ggggaggguggggugcauggg

SEQ ID NO: 806798 - RNA, 23 nt, Human
ggggccacaggcaugugccacca

SEQ ID NO: 806799 - RNA, 23 nt, Human
gggguuucuccauguugccuagg

SEQ ID NO: 806800 - RNA, 23 nt, Human
gguccugggcucaagugaccuuc

SEQ ID NO: 806801 - RNA, 24 nt, Human
gguggcucacaccuguaaucccag

SEQ ID NO: 806802 - RNA, 21 nt, Human
ggugggaggaucacuuggguc

SEQ ID NO: 806803 - RNA, 19 nt, Human
gucaaacagcccugaugcc

SEQ ID NO: 806804 - RNA, 19 nt, Human
guccugggcucaagugacc

SEQ ID NO: 806805 - RNA, 25 nt, Human
guccugggcucaagugaccuuccca

SEQ ID NO: 806806 - RNA, 24 nt, Human
gucugggaggucaaagcugcagug

SEQ ID NO: 806807 - RNA, 24 nt, Human
gugaacacaggucauagcagccuu

SEQ ID NO: 806808 - RNA, 22 nt, Human
gugggcaggugaaacucugaag

SEQ ID NO: 806809 - RNA, 23 nt, Human
guggugcacgccuguagucccag

SEQ ID NO: 806810 - RNA, 18 nt, Human
gugugguggcucacaccu

SEQ ID NO: 806811 - RNA, 24 nt, Human
guuuauuuuaaacaaauuuacaua

SEQ ID NO: 806812 - RNA, 24 nt, Human
uaaauuuuguauuucugauagaga

SEQ ID NO: 806813 - RNA, 22 nt, Human
uaacaaagacaugcugccucuu

SEQ ID NO: 806814 - RNA, 23 nt, Human
uaacagacacacgaauggaggaa

SEQ ID NO: 806815 - RNA, 19 nt, Human
uaaccagagugaacacagg

SEQ ID NO: 806816 - RNA, 18 nt, Human
uaagcaacuuuguggagc

SEQ ID NO: 806817 - RNA, 24 nt, Human
uaaguaaagcaccacuucccagga

SEQ ID NO: 806818 - RNA, 22 nt, Human
uacaggcaugaaccacugcacc

SEQ ID NO: 806819 - RNA, 22 nt, Human
uacucagggcuguuuuuacaag

SEQ ID NO: 806820 - RNA, 22 nt, Human
uagaugacaggcaacagucugc

SEQ ID NO: 806821 - RNA, 22 nt, Human
uagcaguggcaccaguggcugc

SEQ ID NO: 806822 - RNA, 21 nt, Human
uagugaacgugcauccaucug

SEQ ID NO: 806823 - RNA, 18 nt, Human
uauacuggccaagugugg

SEQ ID NO: 806824 - RNA, 23 nt, Human
uauuuaaaaaccacuguaccaag

SEQ ID NO: 806825 - RNA, 19 nt, Human
ucacacccagagucaugca

SEQ ID NO: 806826 - RNA, 23 nt, Human
ucacuagcaguggcaccaguggc

SEQ ID NO: 806827 - RNA, 23 nt, Human
ucacucugcaaaaggaaccaaaa

SEQ ID NO: 806828 - RNA, 24 nt, Human
ucacucugucauccaggcuggagu

SEQ ID NO: 806829 - RNA, 21 nt, Human
ucagcguucagaguggcuggg

SEQ ID NO: 806830 - RNA, 24 nt, Human
ucauccaggcuggagugcaguggu

SEQ ID NO: 806831 - RNA, 20 nt, Human
ucaucgaggccauggcccca

SEQ ID NO: 806832 - RNA, 24 nt, Human
ucaucuuagccucccaaagugcug

SEQ ID NO: 806833 - RNA, 20 nt, Human
uccacaaacuuagaaucacu

SEQ ID NO: 806834 - RNA, 20 nt, Human
uccacaggccuccuggacug

SEQ ID NO: 806835 - RNA, 24 nt, Human
uccacaggccuccuggacugugcc

SEQ ID NO: 806836 - RNA, 20 nt, Human
uccacagggcuaaguaaagc

SEQ ID NO: 806837 - RNA, 21 nt, Human
uccacucaucuuagccuccca

SEQ ID NO: 806838 - RNA, 23 nt, Human
uccaggugcuguggcaauauucc

SEQ ID NO: 806839 - RNA, 18 nt, Human
uccaugauagaggaaggg

SEQ ID NO: 806840 - RNA, 23 nt, Human
ucccaaagugcuggauuacaggc

SEQ ID NO: 806841 - RNA, 20 nt, Human
ucccagaagucagucuuccc

SEQ ID NO: 806842 - RNA, 18 nt, Human
uccuaggcucaagcaauc

SEQ ID NO: 806843 - RNA, 21 nt, Human
uccuaggcucaagcaauccac

SEQ ID NO: 806844 - RNA, 20 nt, Human
uccugggcucaagugaccuu

SEQ ID NO: 806845 - RNA, 23 nt, Human
ucucacucugucauccaggcugg

SEQ ID NO: 806846 - RNA, 24 nt, Human
ucucacucugucauccaggcugga

SEQ ID NO: 806847 - RNA, 23 nt, Human
ucucgaacuccuaggcucaagca

SEQ ID NO: 806848 - RNA, 24 nt, Human
ucugucauccaggcuggagugcag

SEQ ID NO: 806849 - RNA, 23 nt, Human
ucuuccagcaacaacucaugcug

SEQ ID NO: 806850 - RNA, 20 nt, Human
ugaacacaggucauagcagc

SEQ ID NO: 806851 - RNA, 19 nt, Human
ugacccagggcagagaugg

SEQ ID NO: 806852 - RNA, 20 nt, Human
ugacuuauggaagcucagca

SEQ ID NO: 806853 - RNA, 18 nt, Human
ugacuugguucuucucag

SEQ ID NO: 806854 - RNA, 22 nt, Human
ugagacaaggucucacucuguc

SEQ ID NO: 806855 - RNA, 23 nt, Human
ugagauggugaaaagcagcucag

SEQ ID NO: 806856 - RNA, 23 nt, Human
ugagcccaggagcucgagaucag

SEQ ID NO: 806857 - RNA, 20 nt, Human
ugagggaggcugagguggga

SEQ ID NO: 806858 - RNA, 22 nt, Human
ugagggaggcugaggugggagg

SEQ ID NO: 806859 - RNA, 19 nt, Human
ugaggugggaggaucacuu

SEQ ID NO: 806860 - RNA, 19 nt, Human
ugaggugggaggaucacuu

SEQ ID NO: 806861 - RNA, 20 nt, Human
ugaggugggaggaucacuug

SEQ ID NO: 806862 - RNA, 21 nt, Human
ugaggugggaggaucacuuga

SEQ ID NO: 806863 - RNA, 22 nt, Human
ugaggugggaggaucacuugag

SEQ ID NO: 806864 - RNA, 23 nt, Human
ugaggugggaggaucacuugagc

SEQ ID NO: 806865 - RNA, 24 nt, Human
ugaggugggaggaucacuugagcc

SEQ ID NO: 806866 - RNA, 23 nt, Human
ugaggugggaggaucacuugggu

SEQ ID NO: 806867 - RNA, 22 nt, Human
ugauagagacgggguuucucca

SEQ ID NO: 806868 - RNA, 24 nt, Human
ugauagagacgggguuucuccaug

SEQ ID NO: 806869 - RNA, 19 nt, Human
ugauagaggaagggccugg

SEQ ID NO: 806870 - RNA, 20 nt, Human
ugcaaaaggaaccaaaacua

SEQ ID NO: 806871 - RNA, 24 nt, Human
ugccuaggcuggucucgaacuccu

SEQ ID NO: 806872 - RNA, 23 nt, Human
ugcucucuucugagcagcccuug

SEQ ID NO: 806873 - RNA, 21 nt, Human
uggaaagaccuguggagacca

SEQ ID NO: 806874 - RNA, 20 nt, Human
uggagugcaguggugggguc

SEQ ID NO: 806875 - RNA, 24 nt, Human
uggagugcaguggugggguccugg

SEQ ID NO: 806876 - RNA, 20 nt, Human
uggauuacaggcaugaacca

SEQ ID NO: 806877 - RNA, 23 nt, Human
uggauuacaggcaugaaccacug

SEQ ID NO: 806878 - RNA, 24 nt, Human
uggccaagugugguggcucacacc

SEQ ID NO: 806879 - RNA, 21 nt, Human
uggcucacaccuguaauccca

SEQ ID NO: 806880 - RNA, 22 nt, Human
uggcucacaccuguaaucccag

SEQ ID NO: 806881 - RNA, 24 nt, Human
uggcucacaccuguaaucccagca

SEQ ID NO: 806882 - RNA, 19 nt, Human
ugggaggcugaggugggag

SEQ ID NO: 806883 - RNA, 24 nt, Human
ugggaggcugaggugggaggauca

SEQ ID NO: 806884 - RNA, 24 nt, Human
ugggcaggugaaacucugaagcca

SEQ ID NO: 806885 - RNA, 24 nt, Human
ugggcucaagugaccuucccaucu

SEQ ID NO: 806886 - RNA, 24 nt, Human
uggggccacaggcaugugccacca

SEQ ID NO: 806887 - RNA, 18 nt, Human
ugggggaggguggggugc

SEQ ID NO: 806888 - RNA, 22 nt, Human
ugggggaggguggggugcaugg

SEQ ID NO: 806889 - RNA, 21 nt, Human
uggggugcaugggggaggugc

SEQ ID NO: 806890 - RNA, 21 nt, Human
uggugaaaagcagcucaggau

SEQ ID NO: 806891 - RNA, 18 nt, Human
uggugcacgccuguaguc

SEQ ID NO: 806892 - RNA, 21 nt, Human
uggugcacgccuguaguccca

SEQ ID NO: 806893 - RNA, 24 nt, Human
ugguggcucacaccuguaauccca

SEQ ID NO: 806894 - RNA, 19 nt, Human
uggugggguccugggcuca

SEQ ID NO: 806895 - RNA, 24 nt, Human
ugguggugcacgccuguaguccca

SEQ ID NO: 806896 - RNA, 22 nt, Human
ugugccacugcaguccagucug

SEQ ID NO: 806897 - RNA, 28 nt, Human
uguggucaggugcuuuacuauuucagcc

SEQ ID NO: 806898 - RNA, 19 nt, Human
uuaaaaaaccugacuuggu

SEQ ID NO: 806899 - RNA, 24 nt, Human
uuaaccaggcgugguggugcacgc

SEQ ID NO: 806900 - RNA, 26 nt, Human
uugaauaaagccugauucccccacuc

SEQ ID NO: 806901 - RNA, 25 nt, Human
uugggaggcugaggugggaggauca

SEQ ID NO: 806902 - RNA, 20 nt, Human
uuuaaacaaauuuacauaga

SEQ ID NO: 806903 - RNA, 18 nt, Human
uuuguuuuguuuuguuug

SEQ ID NO: 806904 - RNA, 25 nt, Human
aaaaaugauaaagcuguucauacaa

SEQ ID NO: 806905 - RNA, 19 nt, Human
aaaacauucugcaaauaua

SEQ ID NO: 806906 - RNA, 21 nt, Human
aaaagcaguuuggaaaccagg

SEQ ID NO: 806907 - RNA, 22 nt, Human
aaacaaaaguaacaaccagucu

SEQ ID NO: 806908 - RNA, 20 nt, Human
aaacaccuucaagcacaaau

SEQ ID NO: 806909 - RNA, 26 nt, Human
aaacuaacaaaggaguaagacuuuca

SEQ ID NO: 806910 - RNA, 23 nt, Human
aaagaaaaaaaauggcuaaaaaa

SEQ ID NO: 806911 - RNA, 22 nt, Human
aacaucuuccaauaacacacca

SEQ ID NO: 806912 - RNA, 19 nt, Human
aaccagcauggaugaagcu

SEQ ID NO: 806913 - RNA, 22 nt, Human
aaccauaaugauguucacagga

SEQ ID NO: 806914 - RNA, 21 nt, Human
aagaaaguggcaaaagccaaa

SEQ ID NO: 806915 - RNA, 20 nt, Human
aauuguacaacaaaacaaaa

SEQ ID NO: 806916 - RNA, 18 nt, Human
acacuccuacuucucuca

SEQ ID NO: 806917 - RNA, 21 nt, Human
agaaacaaaacuaacaaagga

SEQ ID NO: 806918 - RNA, 23 nt, Human
agaaaguggcaaaagccaaacaa

SEQ ID NO: 806919 - RNA, 21 nt, Human
agaggagcuuggaaggauugu

SEQ ID NO: 806920 - RNA, 22 nt, Human
agcaaaacucauggaaagccua

SEQ ID NO: 806921 - RNA, 20 nt, Human
agcuagaacucacucagaac

SEQ ID NO: 806922 - RNA, 23 nt, Human
aggaagaaaguggcaaaagggac

SEQ ID NO: 806923 - RNA, 22 nt, Human
auaucaaaaacaccuucaagca

SEQ ID NO: 806924 - RNA, 21 nt, Human
caaaagccaaacaauuucaua

SEQ ID NO: 806925 - RNA, 24 nt, Human
caaauuagcauuuuaacaucuucc

SEQ ID NO: 806926 - RNA, 18 nt, Human
cacuaagaaugcuggucu

SEQ ID NO: 806927 - RNA, 19 nt, Human
cagaauacaucacuuggau

SEQ ID NO: 806928 - RNA, 23 nt, Human
cagauacacuccuacuucucuca

SEQ ID NO: 806929 - RNA, 25 nt, Human
cauauaaaaauaccuuuaaaccaag

SEQ ID NO: 806930 - RNA, 19 nt, Human
caucagagguuccuauuug

SEQ ID NO: 806931 - RNA, 23 nt, Human
ccaccccaaagaaaaaaaauggc

SEQ ID NO: 806932 - RNA, 19 nt, Human
ccagaauacaucacuugga

SEQ ID NO: 806933 - RNA, 28 nt, Human
cccaaagaaaaaaaauggcuaaaaaauu

SEQ ID NO: 806934 - RNA, 24 nt, Human
ccccaaagaaaaaaaauggcuaaa

SEQ ID NO: 806935 - RNA, 20 nt, Human
ccccuaaucuuagguuucca

SEQ ID NO: 806936 - RNA, 19 nt, Human
gaaaauaaauaagccauag

SEQ ID NO: 806937 - RNA, 19 nt, Human
gagcaguuaucugcccugc

SEQ ID NO: 806938 - RNA, 19 nt, Human
gcaaaggcaaggaagaaag

SEQ ID NO: 806939 - RNA, 19 nt, Human
gguggucuccucuucugcc

SEQ ID NO: 806940 - RNA, 25 nt, Human
guacaguaguugugcagaaacaaaa

SEQ ID NO: 806941 - RNA, 22 nt, Human
guacuaauuguacaacaaaaca

SEQ ID NO: 806942 - RNA, 23 nt, Human
gugcagaaacaaaacuaacaaag

SEQ ID NO: 806943 - RNA, 22 nt, Human
uaaaaauaccuuuaaaccaagg

SEQ ID NO: 806944 - RNA, 18 nt, Human
uaaaugagauaaagugcu

SEQ ID NO: 806945 - RNA, 21 nt, Human
uaacaaaggaguaagacuuuc

SEQ ID NO: 806946 - RNA, 21 nt, Human
uacaaaaccauaaugauguuc

SEQ ID NO: 806947 - RNA, 20 nt, Human
uacaacaaaacaaaaguaac

SEQ ID NO: 806948 - RNA, 23 nt, Human
uacaacaauucacuuuaaaacau

SEQ ID NO: 806949 - RNA, 22 nt, Human
uauaaaaugggauuugacucaa

SEQ ID NO: 806950 - RNA, 18 nt, Human
uauauacaacaugugacu

SEQ ID NO: 806951 - RNA, 25 nt, Human
ucaauggcaucagauccaccccaaa

SEQ ID NO: 806952 - RNA, 26 nt, Human
ucauauaaaaauaccuuuaaaccaag

SEQ ID NO: 806953 - RNA, 18 nt, Human
uccaaaagugcuauaaaa

SEQ ID NO: 806954 - RNA, 27 nt, Human
uccaaauaucaaaaacaccuucaagca

SEQ ID NO: 806955 - RNA, 18 nt, Human
uccaaauuccacaaaugg

SEQ ID NO: 806956 - RNA, 26 nt, Human
ucuaccauauagcaaaggcaaggaag

SEQ ID NO: 806957 - RNA, 21 nt, Human
ucuccagcugaggauucugcu

SEQ ID NO: 806958 - RNA, 24 nt, Human
ucugcugacccgguggucuccucu

SEQ ID NO: 806959 - RNA, 18 nt, Human
ucuugaacaauagacaua

SEQ ID NO: 806960 - RNA, 26 nt, Human
ugaauaagaaccauaacacagaaaua

SEQ ID NO: 806961 - RNA, 22 nt, Human
ugagauaaagugcuguuacugg

SEQ ID NO: 806962 - RNA, 23 nt, Human
uggaaaaguacaguaguugugca

SEQ ID NO: 806963 - RNA, 24 nt, Human
uggaaggauuguuccaggagcacu

SEQ ID NO: 806964 - RNA, 21 nt, Human
uggauguacaucacuugguca

SEQ ID NO: 806965 - RNA, 22 nt, Human
uguacaaaaccauaaugauguu

SEQ ID NO: 806966 - RNA, 24 nt, Human
uguacaaaaccauaaugauguuca

SEQ ID NO: 806967 - RNA, 18 nt, Human
ugugcagaaacaaaacua

SEQ ID NO: 806968 - RNA, 22 nt, Human
uuacucuugaacaauagacaua

SEQ ID NO: 806969 - RNA, 21 nt, Human
uuagaggagcuuggaaggauu

SEQ ID NO: 806970 - RNA, 19 nt, Human
uuccauuccaaacuggagc

SEQ ID NO: 806971 - RNA, 25 nt, Human
uugaauccacuugaccaccaaucau

SEQ ID NO: 806972 - RNA, 22 nt, Human
uuuaccaccaggagucaacacu

SEQ ID NO: 806973 - RNA, 22 nt, Human
aaaaaaaaaaaaaaaaucaaag

SEQ ID NO: 806974 - RNA, 26 nt, Human
aaaauauaauuuccauugugcaccaa

SEQ ID NO: 806975 - RNA, 22 nt, Human
aaacaaaaaaaaaccacagccc

SEQ ID NO: 806976 - RNA, 19 nt, Human
aaacaaaacaaaacaaaaa

SEQ ID NO: 806977 - RNA, 23 nt, Human
aaagaacacaaauguguagauaa

SEQ ID NO: 806978 - RNA, 22 nt, Human
aaaggcacagaaaggaagaaac

SEQ ID NO: 806979 - RNA, 20 nt, Human
aaauacauucugggguccaa

SEQ ID NO: 806980 - RNA, 18 nt, Human
aaauggccaguaaaagca

SEQ ID NO: 806981 - RNA, 23 nt, Human
aacaaaacaaaaaaaaaccacag

SEQ ID NO: 806982 - RNA, 21 nt, Human
aacuuuaugagccuaccuuga

SEQ ID NO: 806983 - RNA, 23 nt, Human
aagcaaaaacaaaauggagggac

SEQ ID NO: 806984 - RNA, 21 nt, Human
aagcuccaucaaaguaugcaa

SEQ ID NO: 806985 - RNA, 22 nt, Human
aaggaagaaacagugggcaagg

SEQ ID NO: 806986 - RNA, 19 nt, Human
acaaaaaaaaaccacagcc

SEQ ID NO: 806987 - RNA, 24 nt, Human
acaaaacaaaaaaaaaccacagcc

SEQ ID NO: 806988 - RNA, 26 nt, Human
acaaaacaaaaaaaaaccacagccuu

SEQ ID NO: 806989 - RNA, 23 nt, Human
acaaaacaaaacaaaaaaaaacc

SEQ ID NO: 806990 - RNA, 21 nt, Human
acacaaauuaaagcaaaaaca

SEQ ID NO: 806991 - RNA, 20 nt, Human
acaggcucucuccagaaaaa

SEQ ID NO: 806992 - RNA, 18 nt, Human
acagguuaagcuaucuuc

SEQ ID NO: 806993 - RNA, 21 nt, Human
accaaaacaaagguuuuucug

SEQ ID NO: 806994 - RNA, 21 nt, Human
accaaaugccucugaaacucu

SEQ ID NO: 806995 - RNA, 22 nt, Human
acugcaaaggauugcaauucca

SEQ ID NO: 806996 - RNA, 24 nt, Human
agaacacaaauuaaagcaaaaaca

SEQ ID NO: 806997 - RNA, 18 nt, Human
agcacugacccagccacc

SEQ ID NO: 806998 - RNA, 22 nt, Human
agcagacauacauaccguccuu

SEQ ID NO: 806999 - RNA, 20 nt, Human
agcuauuuuucaugccacag

SEQ ID NO: 807000 - RNA, 18 nt, Human
agcugcuguguaccauug

SEQ ID NO: 807001 - RNA, 20 nt, Human
aggaauagccccuggaggga

SEQ ID NO: 807002 - RNA, 21 nt, Human
aggcuuacaagauguucucga

SEQ ID NO: 807003 - RNA, 22 nt, Human
agggagggaaaugcaaguuggg

SEQ ID NO: 807004 - RNA, 18 nt, Human
aguaaauucaggcaagca

SEQ ID NO: 807005 - RNA, 22 nt, Human
auauacaaacauguuucaaaac

SEQ ID NO: 807006 - RNA, 24 nt, Human
auguacucagaaaacggggugcua

SEQ ID NO: 807007 - RNA, 19 nt, Human
auguguacacauacacaua

SEQ ID NO: 807008 - RNA, 22 nt, Human
auuuuaaagaaagcaaaagcua

SEQ ID NO: 807009 - RNA, 25 nt, Human
caaaacaaaacaaaaaaaaaccaca

SEQ ID NO: 807010 - RNA, 23 nt, Human
caaaacaaagguuuuucuguagc

SEQ ID NO: 807011 - RNA, 19 nt, Human
caaaaccagagcagcagac

SEQ ID NO: 807012 - RNA, 21 nt, Human
caaacauguuucaaaaccaga

SEQ ID NO: 807013 - RNA, 23 nt, Human
caaagaaaagucucagaucccac

SEQ ID NO: 807014 - RNA, 19 nt, Human
caaauacauucuggggucc

SEQ ID NO: 807015 - RNA, 25 nt, Human
caaauuagaaacagcguuacuauca

SEQ ID NO: 807016 - RNA, 21 nt, Human
caacagacagcagguggcccu

SEQ ID NO: 807017 - RNA, 22 nt, Human
caauauauaacauggauaaaac

SEQ ID NO: 807018 - RNA, 19 nt, Human
cacaaaucgccuaagacag

SEQ ID NO: 807019 - RNA, 21 nt, Human
cacaauacucacacugauaag

SEQ ID NO: 807020 - RNA, 22 nt, Human
cacaggucugccccuacucccu

SEQ ID NO: 807021 - RNA, 20 nt, Human
caccaaaguaagaaaaccua

SEQ ID NO: 807022 - RNA, 21 nt, Human
caccauagucacaauacucac

SEQ ID NO: 807023 - RNA, 26 nt, Human
caccauagucacaauacucacacuga

SEQ ID NO: 807024 - RNA, 20 nt, Human
caccccacaaaucgccuaag

SEQ ID NO: 807025 - RNA, 21 nt, Human
caccgaggcugcacuggaagc

SEQ ID NO: 807026 - RNA, 22 nt, Human
cagaacacaaauuaaagcaaaa

SEQ ID NO: 807027 - RNA, 25 nt, Human
caggaaaaagcacuauguggugagg

SEQ ID NO: 807028 - RNA, 18 nt, Human
caugaaucaaagggauca

SEQ ID NO: 807029 - RNA, 21 nt, Human
cauggagagagaaaccugaca

SEQ ID NO: 807030 - RNA, 20 nt, Human
cauguuucaaaaccagagca

SEQ ID NO: 807031 - RNA, 23 nt, Human
cauuuggcucagacagggucauu

SEQ ID NO: 807032 - RNA, 20 nt, Human
cauuuuuguucucaaauagg

SEQ ID NO: 807033 - RNA, 19 nt, Human
ccacaggagggccgguuca

SEQ ID NO: 807034 - RNA, 21 nt, Human
cccacacaaauacucaacaca

SEQ ID NO: 807035 - RNA, 21 nt, Human
cccagccaccuaucugcccaa

SEQ ID NO: 807036 - RNA, 24 nt, Human
cccagccaccuaucugcccaagag

SEQ ID NO: 807037 - RNA, 25 nt, Human
cccaugugaaaaaaaaaaaaaaaaa

SEQ ID NO: 807038 - RNA, 22 nt, Human
cccuucugcaaaucuugaagag

SEQ ID NO: 807039 - RNA, 24 nt, Human
cgguucagaagaaauggcaaaggg

SEQ ID NO: 807040 - RNA, 22 nt, Human
cguucuacauuuuuccagccca

SEQ ID NO: 807041 - RNA, 24 nt, Human
cuaaagaacacaaauguguagaua

SEQ ID NO: 807042 - RNA, 22 nt, Human
cuaaauauaacaaucucucacu

SEQ ID NO: 807043 - RNA, 18 nt, Human
cucaaaggcacagaaagg

SEQ ID NO: 807044 - RNA, 23 nt, Human
cuccauuaucccucccagcuuca

SEQ ID NO: 807045 - RNA, 20 nt, Human
cucccaauauuccuacaguu

SEQ ID NO: 807046 - RNA, 18 nt, Human
cuucccugagaaagcuga

SEQ ID NO: 807047 - RNA, 24 nt, Human
gaaaaaaaaaaaaaaaaaucaaag

SEQ ID NO: 807048 - RNA, 22 nt, Human
gaaaagucucagaucccacuga

SEQ ID NO: 807049 - RNA, 24 nt, Human
gaaaagucucagaucccacugaaa

SEQ ID NO: 807050 - RNA, 22 nt, Human
gaacccuucucuuucaccauac

SEQ ID NO: 807051 - RNA, 24 nt, Human
gaagcagacauacauaccguccuu

SEQ ID NO: 807052 - RNA, 19 nt, Human
gaaucuaagacuuucccau

SEQ ID NO: 807053 - RNA, 19 nt, Human
gaucaagaagagagaagac

SEQ ID NO: 807054 - RNA, 23 nt, Human
gaucguguuccuguaacuuuagc

SEQ ID NO: 807055 - RNA, 22 nt, Human
gcugcacuggaagcagacauac

SEQ ID NO: 807056 - RNA, 21 nt, Human
ggcaaacaaaacaaaacaaag

SEQ ID NO: 807057 - RNA, 22 nt, Human
ggcauaugaaacccuuuucaca

SEQ ID NO: 807058 - RNA, 20 nt, Human
gguaagggcaaagagaaaau

SEQ ID NO: 807059 - RNA, 23 nt, Human
gguagagaggggaguggaaggag

SEQ ID NO: 807060 - RNA, 28 nt, Human
gguucagaagaaauggcaaagggagucu

SEQ ID NO: 807061 - RNA, 23 nt, Human
guaaaacauucucaaucugcccc

SEQ ID NO: 807062 - RNA, 19 nt, Human
guaauaaaaugauccaaag

SEQ ID NO: 807063 - RNA, 19 nt, Human
gucuuuggaugaaucccaa

SEQ ID NO: 807064 - RNA, 23 nt, Human
guguguuucaccaaaugccucug

SEQ ID NO: 807065 - RNA, 23 nt, Human
guuucauucacugcaccccacaa

SEQ ID NO: 807066 - RNA, 19 nt, Human
guuucgcaccugcccuuuc

SEQ ID NO: 807067 - RNA, 20 nt, Human
guuucgcaccugcccuuuca

SEQ ID NO: 807068 - RNA, 24 nt, Human
uaaaacauucucaaucugccccuc

SEQ ID NO: 807069 - RNA, 20 nt, Human
uaaaauggccaguaaaagca

SEQ ID NO: 807070 - RNA, 18 nt, Human
uaaagaaagcaaaagcua

SEQ ID NO: 807071 - RNA, 20 nt, Human
uaaagcaaaaacaaaaugga

SEQ ID NO: 807072 - RNA, 22 nt, Human
uaaaguagaaaauauaauuucc

SEQ ID NO: 807073 - RNA, 22 nt, Human
uaaauuucuagaauauaaaaac

SEQ ID NO: 807074 - RNA, 21 nt, Human
uaacaaucucucacuucuggu

SEQ ID NO: 807075 - RNA, 23 nt, Human
uaacacaggaauuacaauaaugc

SEQ ID NO: 807076 - RNA, 23 nt, Human
uaacauggauaaaacuucgaaug

SEQ ID NO: 807077 - RNA, 19 nt, Human
uaaguugaaaaugauuuua

SEQ ID NO: 807078 - RNA, 19 nt, Human
uaauuuccauugugcacca

SEQ ID NO: 807079 - RNA, 20 nt, Human
uaccuccauuaucccuccca

SEQ ID NO: 807080 - RNA, 21 nt, Human
uacuuuuugcuuucccauuuu

SEQ ID NO: 807081 - RNA, 21 nt, Human
uagcaguccucucauuucuac

SEQ ID NO: 807082 - RNA, 21 nt, Human
uagcugcagugagaacaaaug

SEQ ID NO: 807083 - RNA, 23 nt, Human
uagggaucguguuccuguaacuu

SEQ ID NO: 807084 - RNA, 24 nt, Human
uauacaaaagaaauguugauuauc

SEQ ID NO: 807085 - RNA, 21 nt, Human
uaucaacugggcuaaacaguu

SEQ ID NO: 807086 - RNA, 20 nt, Human
uaugaaacccuuuucacaac

SEQ ID NO: 807087 - RNA, 27 nt, Human
uauuuucuuccagcggaaacaguuuca

SEQ ID NO: 807088 - RNA, 24 nt, Human
ucaaaauuaagaacccacacaaau

SEQ ID NO: 807089 - RNA, 18 nt, Human
ucaaagucuccaaucgac

SEQ ID NO: 807090 - RNA, 21 nt, Human
ucaaugaaaacuagggaucgu

SEQ ID NO: 807091 - RNA, 25 nt, Human
ucacuuguucacauaaaccagaccc

SEQ ID NO: 807092 - RNA, 19 nt, Human
ucagaacaagcugcugugu

SEQ ID NO: 807093 - RNA, 20 nt, Human
ucagaacacaaauuaaagca

SEQ ID NO: 807094 - RNA, 19 nt, Human
ucagacagggucauuuuau

SEQ ID NO: 807095 - RNA, 22 nt, Human
ucagaguauacuuugggucagg

SEQ ID NO: 807096 - RNA, 22 nt, Human
uccagaaaaaugcauauguacc

SEQ ID NO: 807097 - RNA, 18 nt, Human
uccagcuuggcaacagcu

SEQ ID NO: 807098 - RNA, 22 nt, Human
uccgguucuuuuuggcuccagc

SEQ ID NO: 807099 - RNA, 19 nt, Human
uccuuuuguaaucucuuuu

SEQ ID NO: 807100 - RNA, 19 nt, Human
ucuacagucuguauuucuu

SEQ ID NO: 807101 - RNA, 22 nt, Human
ucuccuuucguauacgaaaugu

SEQ ID NO: 807102 - RNA, 24 nt, Human
ucuguaaugagaacaaaccggggc

SEQ ID NO: 807103 - RNA, 29 nt, Human
ucuuguucauuugaacccuucucuuucaa

SEQ ID NO: 807104 - RNA, 25 nt, Human
ucuuuaguuucauucacugcacccc

SEQ ID NO: 807105 - RNA, 18 nt, Human
ugaaaaugauuuuauugg

SEQ ID NO: 807106 - RNA, 22 nt, Human
ugaaaauugggaggagcugcac

SEQ ID NO: 807107 - RNA, 19 nt, Human
ugaaacccuuuucacaacu

SEQ ID NO: 807108 - RNA, 21 nt, Human
ugaaucccaaaugaaaacuaa

SEQ ID NO: 807109 - RNA, 20 nt, Human
ugacaguuaacacucugacu

SEQ ID NO: 807110 - RNA, 24 nt, Human
ugacccagccaccuaucugcccaa

SEQ ID NO: 807111 - RNA, 25 nt, Human
ugagggaaaaccuuaaggggucuca

SEQ ID NO: 807112 - RNA, 23 nt, Human
ugaugcugcgaagugaaaauacu

SEQ ID NO: 807113 - RNA, 25 nt, Human
ugcaacaacucuuuaguuucauuca

SEQ ID NO: 807114 - RNA, 24 nt, Human
ugccacaggaguacaauauauaac

SEQ ID NO: 807115 - RNA, 23 nt, Human
ugcuaaacaaagaaaagucucag

SEQ ID NO: 807116 - RNA, 21 nt, Human
ugcuuucauuuuccaaaagug

SEQ ID NO: 807117 - RNA, 20 nt, Human
uggaagcagacauacauacc

SEQ ID NO: 807118 - RNA, 21 nt, Human
uggaaggaguguuccuggagu

SEQ ID NO: 807119 - RNA, 20 nt, Human
uggcaaacaaaacaaaacaa

SEQ ID NO: 807120 - RNA, 26 nt, Human
uggcaaacaaaacaaaacaaaaaaaa

SEQ ID NO: 807121 - RNA, 20 nt, Human
uggcaaagggagucuagugu

SEQ ID NO: 807122 - RNA, 19 nt, Human
uggccauuucucuauaacc

SEQ ID NO: 807123 - RNA, 23 nt, Human
uggcuccagcuuggcaacagcuu

SEQ ID NO: 807124 - RNA, 21 nt, Human
ugggaggagcugcaccgaggc

SEQ ID NO: 807125 - RNA, 25 nt, Human
ugguggagggacuccaaaccagaau

SEQ ID NO: 807126 - RNA, 22 nt, Human
uguguacacauacacauauaua

SEQ ID NO: 807127 - RNA, 21 nt, Human
uuaccuccauuaucccuccca

SEQ ID NO: 807128 - RNA, 24 nt, Human
uuagaagcucuggguuuuguuuug

SEQ ID NO: 807129 - RNA, 23 nt, Human
uuccagaaacacuuuuaauuccu

SEQ ID NO: 807130 - RNA, 18 nt, Human
uucccaugugaaaaaaaa

SEQ ID NO: 807131 - RNA, 25 nt, Human
uuccgguucuuuuuggcuccagcuu

SEQ ID NO: 807132 - RNA, 18 nt, Human
uucugcaaaucuugaaga

SEQ ID NO: 807133 - RNA, 23 nt, Human
uuggaagcuuuuagaagcucugg

SEQ ID NO: 807134 - RNA, 27 nt, Human
uuggaugaaucccaaaugaaaacuaaa

SEQ ID NO: 807135 - RNA, 20 nt, Human
uuucaggaaaaagcacuaug

SEQ ID NO: 807136 - RNA, 18 nt, Human
uuucauucacugcacccc

SEQ ID NO: 807137 - RNA, 22 nt, Human
uuucauucacugcaccccacaa

SEQ ID NO: 807138 - RNA, 22 nt, Human
uuucuacucacuuguucacaua

SEQ ID NO: 807139 - RNA, 21 nt, Human
uuuguaaucucuuuuugucuu

SEQ ID NO: 807140 - RNA, 19 nt, Human
uuuucaggaaaaagcacua

SEQ ID NO: 807141 - RNA, 29 nt, Human
aaaagaccagguaaacuuacagugggcac

SEQ ID NO: 807142 - RNA, 19 nt, Human
aaacagguagaauuggaac

SEQ ID NO: 807143 - RNA, 19 nt, Human
aaagcaaaugaguacaaaa

SEQ ID NO: 807144 - RNA, 19 nt, Human
aaaggacaagcugcagaac

SEQ ID NO: 807145 - RNA, 19 nt, Human
aaagugcuggaauuacagg

SEQ ID NO: 807146 - RNA, 24 nt, Human
aaagugcuggaauuacaggcauga

SEQ ID NO: 807147 - RNA, 23 nt, Human
aacacacaggaaugaugcaucca

SEQ ID NO: 807148 - RNA, 19 nt, Human
aaccauugaggccaauuaa

SEQ ID NO: 807149 - RNA, 22 nt, Human
aagaaacagaaaagcugguacc

SEQ ID NO: 807150 - RNA, 25 nt, Human
aagcaaucuucccaccucaaccucc

SEQ ID NO: 807151 - RNA, 24 nt, Human
aagcagccagggagugaccagguu

SEQ ID NO: 807152 - RNA, 25 nt, Human
aagcagucuuccugccucggccucc

SEQ ID NO: 807153 - RNA, 18 nt, Human
aagcauucugguuccuca

SEQ ID NO: 807154 - RNA, 21 nt, Human
aagcuaccccacaccaaugcc

SEQ ID NO: 807155 - RNA, 24 nt, Human
aagcuaccccacaccaaugccacc

SEQ ID NO: 807156 - RNA, 22 nt, Human
aagcugccuccccucgcaggcu

SEQ ID NO: 807157 - RNA, 26 nt, Human
aagugcuggaauuacaggcaugagcc

SEQ ID NO: 807158 - RNA, 21 nt, Human
aauuacaggcaugagccacca

SEQ ID NO: 807159 - RNA, 21 nt, Human
acaaaaagcaaaugaguacaa

SEQ ID NO: 807160 - RNA, 18 nt, Human
acaaaaucugccuucucu

SEQ ID NO: 807161 - RNA, 18 nt, Human
acacuguguucccacgga

SEQ ID NO: 807162 - RNA, 24 nt, Human
acagaaugugagaagauacagaac

SEQ ID NO: 807163 - RNA, 20 nt, Human
accucaaccuccugaguagc

SEQ ID NO: 807164 - RNA, 18 nt, Human
accuguggccaucaugcu

SEQ ID NO: 807165 - RNA, 19 nt, Human
acuacaggugugugccacc

SEQ ID NO: 807166 - RNA, 22 nt, Human
agacagaagaggcagcccaagg

SEQ ID NO: 807167 - RNA, 22 nt, Human
agacagacauucaagacaaacu

SEQ ID NO: 807168 - RNA, 22 nt, Human
agauaggucaagaacccagaac

SEQ ID NO: 807169 - RNA, 19 nt, Human
agauguguccuacucuugu

SEQ ID NO: 807170 - RNA, 18 nt, Human
agccaccacacucagccu

SEQ ID NO: 807171 - RNA, 20 nt, Human
agccaccacacucagccuua

SEQ ID NO: 807172 - RNA, 26 nt, Human
agcuacuuuuauaauaaaauuucuau

SEQ ID NO: 807173 - RNA, 21 nt, Human
aggaaacuguuccaaacagaa

SEQ ID NO: 807174 - RNA, 21 nt, Human
aggcucugaagcgcgcagucc

SEQ ID NO: 807175 - RNA, 23 nt, Human
aguagcugggacuacaggugugu

SEQ ID NO: 807176 - RNA, 19 nt, Human
agugcaguggcaugaucag

SEQ ID NO: 807177 - RNA, 27 nt, Human
auaaaacaacaagaugucaucucagag

SEQ ID NO: 807178 - RNA, 18 nt, Human
auacuguaacacacagga

SEQ ID NO: 807179 - RNA, 20 nt, Human
auugcugcaaccauugaggc

SEQ ID NO: 807180 - RNA, 21 nt, Human
caaaacuaccuucacaacuaa

SEQ ID NO: 807181 - RNA, 23 nt, Human
caaaagaauucuccaaacgugaa

SEQ ID NO: 807182 - RNA, 19 nt, Human
caaaaggacaagcugcaga

SEQ ID NO: 807183 - RNA, 24 nt, Human
caaagugcuggaauuacaggcaug

SEQ ID NO: 807184 - RNA, 20 nt, Human
caaccucaaacuccugggcu

SEQ ID NO: 807185 - RNA, 24 nt, Human
caaccucaaacuccugggcucaag

SEQ ID NO: 807186 - RNA, 27 nt, Human
caagcaaucuucccaccucaaccuccu

SEQ ID NO: 807187 - RNA, 22 nt, Human
caagcagucuuccugccucggc

SEQ ID NO: 807188 - RNA, 20 nt, Human
caaggaacuccagaugaacc

SEQ ID NO: 807189 - RNA, 24 nt, Human
caccucaaccuccugaguagcugg

SEQ ID NO: 807190 - RNA, 21 nt, Human
cacugcaaccucaaacuccug

SEQ ID NO: 807191 - RNA, 23 nt, Human
cacugcaaccucaaacuccuggg

SEQ ID NO: 807192 - RNA, 24 nt, Human
cagaaagaggacugaccuguggcc

SEQ ID NO: 807193 - RNA, 22 nt, Human
cagcccggccccggcggaagcu

SEQ ID NO: 807194 - RNA, 21 nt, Human
caggcacagaaagaggacuga

SEQ ID NO: 807195 - RNA, 24 nt, Human
caugguucucagacaaaaagcaaa

SEQ ID NO: 807196 - RNA, 19 nt, Human
ccaaagugcuggaauuaca

SEQ ID NO: 807197 - RNA, 24 nt, Human
ccaaagugcuggaauuacaggcau

SEQ ID NO: 807198 - RNA, 21 nt, Human
ccagagaaaacuaacaguaca

SEQ ID NO: 807199 - RNA, 24 nt, Human
ccaggcuggucuugaacuccuggg

SEQ ID NO: 807200 - RNA, 18 nt, Human
ccccagagaaaacuaaca

SEQ ID NO: 807201 - RNA, 24 nt, Human
ccccuggccgcugcaucuuggccu

SEQ ID NO: 807202 - RNA, 18 nt, Human
cccgcgcuggggcuggaa

SEQ ID NO: 807203 - RNA, 21 nt, Human
cccuccugucucgggcuucag

SEQ ID NO: 807204 - RNA, 19 nt, Human
ccggccccuggccgcugca

SEQ ID NO: 807205 - RNA, 22 nt, Human
ccuauguugcccaggcuggucu

SEQ ID NO: 807206 - RNA, 22 nt, Human
ccugaguagcugggacuacagg

SEQ ID NO: 807207 - RNA, 23 nt, Human
ccugaguagcugggacuacaggu

SEQ ID NO: 807208 - RNA, 19 nt, Human
ccugagugaagcagccagg

SEQ ID NO: 807209 - RNA, 20 nt, Human
ccugagugaagcagccaggg

SEQ ID NO: 807210 - RNA, 23 nt, Human
ccugggcucaagcagucuuccug

SEQ ID NO: 807211 - RNA, 24 nt, Human
cggagucuuccuauguugcccagg

SEQ ID NO: 807212 - RNA, 20 nt, Human
cggcucgcgggagaaagcgg

SEQ ID NO: 807213 - RNA, 23 nt, Human
cgggaauaaucacaaaaucugcc

SEQ ID NO: 807214 - RNA, 21 nt, Human
cgggagaaagcgggaacggcg

SEQ ID NO: 807215 - RNA, 23 nt, Human
cuaaaagggaaaaaaaacgaucu

SEQ ID NO: 807216 - RNA, 24 nt, Human
cucaagcaaucuucccaccucaac

SEQ ID NO: 807217 - RNA, 21 nt, Human
cucacugcaaccucaaacucc

SEQ ID NO: 807218 - RNA, 24 nt, Human
cucacugcaaccucaaacuccugg

SEQ ID NO: 807219 - RNA, 23 nt, Human
cuccagaugaacccauggucuac

SEQ ID NO: 807220 - RNA, 20 nt, Human
cuccugggcucaagcaaucu

SEQ ID NO: 807221 - RNA, 23 nt, Human
cuccugggcucaagcaaucuucc

SEQ ID NO: 807222 - RNA, 19 nt, Human
cuccugggcucaagcaguc

SEQ ID NO: 807223 - RNA, 23 nt, Human
cuccugggcucaagcagucuucc

SEQ ID NO: 807224 - RNA, 25 nt, Human
cuccugggcucaagcagucuuccug

SEQ ID NO: 807225 - RNA, 20 nt, Human
cuccuuuuacuacaaaggaa

SEQ ID NO: 807226 - RNA, 23 nt, Human
cugccucggccucccaaagugcu

SEQ ID NO: 807227 - RNA, 19 nt, Human
cuggucuugaacuccuggg

SEQ ID NO: 807228 - RNA, 24 nt, Human
cuucccaccucaaccuccugagua

SEQ ID NO: 807229 - RNA, 20 nt, Human
gaacagauguguccuacucu

SEQ ID NO: 807230 - RNA, 19 nt, Human
gaauuacaggcaugagcca

SEQ ID NO: 807231 - RNA, 21 nt, Human
gagaaucugucccuucuguuc

SEQ ID NO: 807232 - RNA, 22 nt, Human
gagacagauaggucaagaaccc

SEQ ID NO: 807233 - RNA, 26 nt, Human
gaguagcugggacuacaggugugugc

SEQ ID NO: 807234 - RNA, 21 nt, Human
gaguaguuuguugaaauggcc

SEQ ID NO: 807235 - RNA, 25 nt, Human
gcaacagagaaauuggugacaugag

SEQ ID NO: 807236 - RNA, 21 nt, Human
gccccaugguuucuauugugc

SEQ ID NO: 807237 - RNA, 24 nt, Human
gccuaggcuagagugcaguggcau

SEQ ID NO: 807238 - RNA, 19 nt, Human
gcuagagugcaguggcaug

SEQ ID NO: 807239 - RNA, 20 nt, Human
ggaacggcggcggcggcggc

SEQ ID NO: 807240 - RNA, 18 nt, Human
ggacaagcugcagaacca

SEQ ID NO: 807241 - RNA, 22 nt, Human
ggacugaccuguggccaucaug

SEQ ID NO: 807242 - RNA, 21 nt, Human
ggagaaagcgggaacggcggc

SEQ ID NO: 807243 - RNA, 23 nt, Human
ggagucuuccuauguugcccagg

SEQ ID NO: 807244 - RNA, 22 nt, Human
ggcagcccuuuuuccauccaag

SEQ ID NO: 807245 - RNA, 22 nt, Human
ggccgcugcaucuuggccuccg

SEQ ID NO: 807246 - RNA, 18 nt, Human
ggcuggucuugaacuccu

SEQ ID NO: 807247 - RNA, 23 nt, Human
gggaaaaaaaacgaucuuaaugu

SEQ ID NO: 807248 - RNA, 20 nt, Human
gggaacggcggcggcggcgg

SEQ ID NO: 807249 - RNA, 18 nt, Human
gggaugcuccaggcucug

SEQ ID NO: 807250 - RNA, 18 nt, Human
gggguccugcucuguagc

SEQ ID NO: 807251 - RNA, 19 nt, Human
ggugcuugauggaugaaug

SEQ ID NO: 807252 - RNA, 18 nt, Human
gugcccuaaaagaucagc

SEQ ID NO: 807253 - RNA, 20 nt, Human
gugugccaccauccccagcu

SEQ ID NO: 807254 - RNA, 21 nt, Human
guuuaagagacagacauucaa

SEQ ID NO: 807255 - RNA, 25 nt, Human
uaaaaauagacaugguucucagaca

SEQ ID NO: 807256 - RNA, 20 nt, Human
uaaaacagguagaauuggaa

SEQ ID NO: 807257 - RNA, 23 nt, Human
uaaaagcuacuggguucucuaga

SEQ ID NO: 807258 - RNA, 23 nt, Human
uaagagacagacauucaagacaa

SEQ ID NO: 807259 - RNA, 24 nt, Human
uaagcccucaaucugauacuuggc

SEQ ID NO: 807260 - RNA, 21 nt, Human
uacacaaaacuaccuucacaa

SEQ ID NO: 807261 - RNA, 23 nt, Human
uacagaaugugagaagauacaga

SEQ ID NO: 807262 - RNA, 24 nt, Human
uacaggcaugagccaccacacuca

SEQ ID NO: 807263 - RNA, 19 nt, Human
uacaguauacagaauguga

SEQ ID NO: 807264 - RNA, 22 nt, Human
uacccagaaugaucccugccau

SEQ ID NO: 807265 - RNA, 19 nt, Human
uaccgagcuaaaagggaaa

SEQ ID NO: 807266 - RNA, 25 nt, Human
uagaaugcagccaaauaggaaacug

SEQ ID NO: 807267 - RNA, 19 nt, Human
uagagugcaguggcaugau

SEQ ID NO: 807268 - RNA, 21 nt, Human
uagagugcaguggcaugauca

SEQ ID NO: 807269 - RNA, 23 nt, Human
uagcaaaacacuaaaauucaugc

SEQ ID NO: 807270 - RNA, 22 nt, Human
uaggaaaagaccagguaaacuu

SEQ ID NO: 807271 - RNA, 25 nt, Human
uauguagagacggagucuuccuaug

SEQ ID NO: 807272 - RNA, 23 nt, Human
uauguugcccaggcuggucuuga

SEQ ID NO: 807273 - RNA, 24 nt, Human
uauguugcccaggcuggucuugaa

SEQ ID NO: 807274 - RNA, 18 nt, Human
ucaaaagauuacugaagu

SEQ ID NO: 807275 - RNA, 24 nt, Human
ucacugcaaccucaaacuccuggg

SEQ ID NO: 807276 - RNA, 21 nt, Human
ucaggcaugucuccccgcgcu

SEQ ID NO: 807277 - RNA, 22 nt, Human
ucaucaguuugaagaaaaagaa

SEQ ID NO: 807278 - RNA, 19 nt, Human
uccagauaauagcagccau

SEQ ID NO: 807279 - RNA, 22 nt, Human
uccauacccgccuggauuuuca

SEQ ID NO: 807280 - RNA, 24 nt, Human
ucccaaagugcuggaauuacaggc

SEQ ID NO: 807281 - RNA, 19 nt, Human
uccccgcgcuggggcugga

SEQ ID NO: 807282 - RNA, 20 nt, Human
ucccggccgcucagacugug

SEQ ID NO: 807283 - RNA, 19 nt, Human
ucccuucuguucuguucuc

SEQ ID NO: 807284 - RNA, 24 nt, Human
uccuauguugcccaggcuggucuu

SEQ ID NO: 807285 - RNA, 18 nt, Human
uccucaguuuucucaaag

SEQ ID NO: 807286 - RNA, 24 nt, Human
uccugaguagcugggacuacaggu

SEQ ID NO: 807287 - RNA, 20 nt, Human
uccugggcucaagcaaucuu

SEQ ID NO: 807288 - RNA, 24 nt, Human
uccugggcucaagcaaucuuccca

SEQ ID NO: 807289 - RNA, 20 nt, Human
uccugggcucaagcagucuu

SEQ ID NO: 807290 - RNA, 24 nt, Human
uccugggcucaagcagucuuccug

SEQ ID NO: 807291 - RNA, 22 nt, Human
ucgagauaauggagaaucuguc

SEQ ID NO: 807292 - RNA, 21 nt, Human
ucgcucccaaauucaggcaug

SEQ ID NO: 807293 - RNA, 18 nt, Human
ucggccucccaaagugcu

SEQ ID NO: 807294 - RNA, 19 nt, Human
ucuccccgcgcuggggcug

SEQ ID NO: 807295 - RNA, 18 nt, Human
ucucgcuuuggaaacugg

SEQ ID NO: 807296 - RNA, 24 nt, Human
ucuggccuugaaaugaggggcaga

SEQ ID NO: 807297 - RNA, 24 nt, Human
ucuguagccuaggcuagagugcag

SEQ ID NO: 807298 - RNA, 19 nt, Human
ucuuccuauguugcccagg

SEQ ID NO: 807299 - RNA, 23 nt, Human
ucuuccuauguugcccaggcugg

SEQ ID NO: 807300 - RNA, 24 nt, Human
ucuuccuauguugcccaggcuggu

SEQ ID NO: 807301 - RNA, 24 nt, Human
ucuugaacuccugggcucaagcag

SEQ ID NO: 807302 - RNA, 22 nt, Human
ugaaaaguuaaauuccacauaa

SEQ ID NO: 807303 - RNA, 22 nt, Human
ugaaacaaagaaagucaaaaag

SEQ ID NO: 807304 - RNA, 25 nt, Human
ugaaacaaagaaagucaaaaagaua

SEQ ID NO: 807305 - RNA, 25 nt, Human
ugaagaaaaagaaauggcucuaaag

SEQ ID NO: 807306 - RNA, 18 nt, Human
ugaagcagccagggagug

SEQ ID NO: 807307 - RNA, 21 nt, Human
ugaccuguggccaucaugcuu

SEQ ID NO: 807308 - RNA, 18 nt, Human
ugagauggucauuuuguu

SEQ ID NO: 807309 - RNA, 19 nt, Human
ugaguacaaacgcugggac

SEQ ID NO: 807310 - RNA, 18 nt, Human
ugagugaagcagccaggg

SEQ ID NO: 807311 - RNA, 21 nt, Human
ugcaacagagaaauuggugac

SEQ ID NO: 807312 - RNA, 20 nt, Human
ugcagcuccuuuuccaaaag

SEQ ID NO: 807313 - RNA, 18 nt, Human
ugccaugaguuaaaguca

SEQ ID NO: 807314 - RNA, 23 nt, Human
ugccaugaguuaaagucaugaaa

SEQ ID NO: 807315 - RNA, 24 nt, Human
ugcccaggcuggucuugaacuccu

SEQ ID NO: 807316 - RNA, 28 nt, Human
ugcccaggcuggucuugaacuccugggc

SEQ ID NO: 807317 - RNA, 22 nt, Human
ugcccuaaaagaucagccuaga

SEQ ID NO: 807318 - RNA, 25 nt, Human
ugccuccccucgcaggcugccggcc

SEQ ID NO: 807319 - RNA, 21 nt, Human
ugccucggccucccaaagugc

SEQ ID NO: 807320 - RNA, 24 nt, Human
ugccucggccucccaaagugcugg

SEQ ID NO: 807321 - RNA, 24 nt, Human
ugcucuguagccuaggcuagagug

SEQ ID NO: 807322 - RNA, 18 nt, Human
uggaauuacaggcaugag

SEQ ID NO: 807323 - RNA, 22 nt, Human
uggaauuacaggcaugagccac

SEQ ID NO: 807324 - RNA, 24 nt, Human
uggaauuacaggcaugagccacca

SEQ ID NO: 807325 - RNA, 24 nt, Human
uggaauuacaggcaugagccacca

SEQ ID NO: 807326 - RNA, 20 nt, Human
uggacugggugaagucaggc

SEQ ID NO: 807327 - RNA, 19 nt, Human
uggcaguguacauuggagg

SEQ ID NO: 807328 - RNA, 22 nt, Human
uggcaugaucagcucacugcaa

SEQ ID NO: 807329 - RNA, 18 nt, Human
ugggacuacaggugugug

SEQ ID NO: 807330 - RNA, 21 nt, Human
ugggacuacaggugugugcca

SEQ ID NO: 807331 - RNA, 22 nt, Human
ugggacuacaggugugugccac

SEQ ID NO: 807332 - RNA, 24 nt, Human
ugggacuacaggugugugccacca

SEQ ID NO: 807333 - RNA, 25 nt, Human
ugggacuacaggugugugccaccau

SEQ ID NO: 807334 - RNA, 21 nt, Human
ugggaggcugagagucacauc

SEQ ID NO: 807335 - RNA, 19 nt, Human
ugggaugcuccaggcucug

SEQ ID NO: 807336 - RNA, 22 nt, Human
ugggcucaagcaaucuucccac

SEQ ID NO: 807337 - RNA, 24 nt, Human
ugggcucaagcagucuuccugccu

SEQ ID NO: 807338 - RNA, 24 nt, Human
uguagagacggagucuuccuaugu

SEQ ID NO: 807339 - RNA, 20 nt, Human
ugugagaagauacagaacuc

SEQ ID NO: 807340 - RNA, 20 nt, Human
ugugugccaccauccccagc

SEQ ID NO: 807341 - RNA, 22 nt, Human
uguucuguucucuauuccuuca

SEQ ID NO: 807342 - RNA, 22 nt, Human
uguucuucccaugaggucucca

SEQ ID NO: 807343 - RNA, 18 nt, Human
uguuguccucagaguaga

SEQ ID NO: 807344 - RNA, 21 nt, Human
uuaagacagaagaggcagccc

SEQ ID NO: 807345 - RNA, 27 nt, Human
uucaaagaaacagaaaagcugguaccc

SEQ ID NO: 807346 - RNA, 24 nt, Human
uucaggcaugucuccccgcgcugg

SEQ ID NO: 807347 - RNA, 23 nt, Human
uucaugcaacagagaaauuggug

SEQ ID NO: 807348 - RNA, 22 nt, Human
uucugcucagaaggcuccucuc

SEQ ID NO: 807349 - RNA, 23 nt, Human
uuggagaagcuucuguuuuggga

SEQ ID NO: 807350 - RNA, 24 nt, Human
uuggcaguguacauuggaggucac

SEQ ID NO: 807351 - RNA, 25 nt, Human
uuuuaaccuaacaugguuuagagau

SEQ ID NO: 807352 - RNA, 22 nt, Human
aaaaaaaaaacaagauggcagg

SEQ ID NO: 807353 - RNA, 27 nt, Human
aaaaaaacaagauggcagcagugggca

SEQ ID NO: 807354 - RNA, 21 nt, Human
aaaaaccaaugaguguaauaa

SEQ ID NO: 807355 - RNA, 20 nt, Human
aaaaccaucacuacuuacag

SEQ ID NO: 807356 - RNA, 18 nt, Human
aaaauuagcugggcaugg

SEQ ID NO: 807357 - RNA, 18 nt, Human
aaagcucuuacauaagcu

SEQ ID NO: 807358 - RNA, 20 nt, Human
aaagucccgguuugccccuc

SEQ ID NO: 807359 - RNA, 18 nt, Human
aacacgguaaaaccccau

SEQ ID NO: 807360 - RNA, 18 nt, Human
aacacgguaaaaccccau

SEQ ID NO: 807361 - RNA, 19 nt, Human
aacacgguaaaaccccauu

SEQ ID NO: 807362 - RNA, 21 nt, Human
aacacgguaaaaccccauuuc

SEQ ID NO: 807363 - RNA, 24 nt, Human
aacugaggucaggaguucgagacc

SEQ ID NO: 807364 - RNA, 21 nt, Human
aagaaaacaaagcguugagug

SEQ ID NO: 807365 - RNA, 23 nt, Human
aagaacaaagauuuucaagagga

SEQ ID NO: 807366 - RNA, 21 nt, Human
aagagaaaaauauuaaaagga

SEQ ID NO: 807367 - RNA, 19 nt, Human
aagcucucuccccgcccag

SEQ ID NO: 807368 - RNA, 20 nt, Human
aagggcacucccaaacugag

SEQ ID NO: 807369 - RNA, 21 nt, Human
aagggcacucccaaacugagg

SEQ ID NO: 807370 - RNA, 24 nt, Human
aaucacuugaacccaggaggcgga

SEQ ID NO: 807371 - RNA, 19 nt, Human
aaugcccaugguaauagcc

SEQ ID NO: 807372 - RNA, 22 nt, Human
acaacuaccuaggaaaugucau

SEQ ID NO: 807373 - RNA, 19 nt, Human
acaagagcgaaacuccauc

SEQ ID NO: 807374 - RNA, 20 nt, Human
acaagagcgaaacuccaucu

SEQ ID NO: 807375 - RNA, 21 nt, Human
acaagagcgaaacuccaucuc

SEQ ID NO: 807376 - RNA, 24 nt, Human
acacagauucaggggaagcaaaga

SEQ ID NO: 807377 - RNA, 19 nt, Human
acagucaauuucugcaaaa

SEQ ID NO: 807378 - RNA, 19 nt, Human
accaucacuacuuacagcc

SEQ ID NO: 807379 - RNA, 23 nt, Human
accauuguacuccgccugggcaa

SEQ ID NO: 807380 - RNA, 24 nt, Human
accauuguacuccgccugggcaac

SEQ ID NO: 807381 - RNA, 24 nt, Human
acccaggaggcggagguugcagug

SEQ ID NO: 807382 - RNA, 24 nt, Human
accccauuucuacuaaaaauacaa

SEQ ID NO: 807383 - RNA, 27 nt, Human
acccuaaagaauucauagcugaaaaac

SEQ ID NO: 807384 - RNA, 18 nt, Human
acuaugacauggaacaaa

SEQ ID NO: 807385 - RNA, 27 nt, Human
agagaaaaaaagccuaaguuaccagaa

SEQ ID NO: 807386 - RNA, 19 nt, Human
agagagugggaugauggga

SEQ ID NO: 807387 - RNA, 22 nt, Human
agauggcagcagaguuaacuua

SEQ ID NO: 807388 - RNA, 24 nt, Human
agcacuuugggaggcugaggcagg

SEQ ID NO: 807389 - RNA, 23 nt, Human
agcgugguggcucaggccuguaa

SEQ ID NO: 807390 - RNA, 20 nt, Human
agcugaccauauagaacuua

SEQ ID NO: 807391 - RNA, 21 nt, Human
agcuuugggaaacaggaguag

SEQ ID NO: 807392 - RNA, 22 nt, Human
aggcaggcggaucaacugaggu

SEQ ID NO: 807393 - RNA, 26 nt, Human
aggcaggcggaucaacugaggucagg

SEQ ID NO: 807394 - RNA, 21 nt, Human
aggcggagguugcagugagcc

SEQ ID NO: 807395 - RNA, 24 nt, Human
aggcggagguugcagugagccgag

SEQ ID NO: 807396 - RNA, 18 nt, Human
aggcugaggcaggcggau

SEQ ID NO: 807397 - RNA, 24 nt, Human
aggcugaggcaggcggaucaacug

SEQ ID NO: 807398 - RNA, 24 nt, Human
aggcuguggcaggagaaucacuug

SEQ ID NO: 807399 - RNA, 22 nt, Human
agucaauuucugcaaaacuuca

SEQ ID NO: 807400 - RNA, 23 nt, Human
agucccgguuugccccucuugcc

SEQ ID NO: 807401 - RNA, 19 nt, Human
auaaaacagguuacacugu

SEQ ID NO: 807402 - RNA, 22 nt, Human
auacuauaaucaauaaaaacca

SEQ ID NO: 807403 - RNA, 18 nt, Human
aucacacguuugugaaca

SEQ ID NO: 807404 - RNA, 20 nt, Human
aucucaaaaaaaaaaaaaag

SEQ ID NO: 807405 - RNA, 19 nt, Human
augaagcugaaaagaacgu

SEQ ID NO: 807406 - RNA, 19 nt, Human
augguacuacucuuucccu

SEQ ID NO: 807407 - RNA, 21 nt, Human
auuugcuaaauaaauuucuac

SEQ ID NO: 807408 - RNA, 19 nt, Human
caaagcccugcucccacca

SEQ ID NO: 807409 - RNA, 19 nt, Human
caacuaccuaggaaauguc

SEQ ID NO: 807410 - RNA, 19 nt, Human
cacacaagccuccucccca

SEQ ID NO: 807411 - RNA, 27 nt, Human
cacacaagccuccuccccacacgcagc

SEQ ID NO: 807412 - RNA, 30 nt, Human
cacacaagccuccuccccacacgcagcccu

SEQ ID NO: 807413 - RNA, 22 nt, Human
cacacgcagcccccuccucacc

SEQ ID NO: 807414 - RNA, 20 nt, Human
caccuguaaucccagcuacu

SEQ ID NO: 807415 - RNA, 24 nt, Human
caccuguaaucccagcuacuuggg

SEQ ID NO: 807416 - RNA, 23 nt, Human
cacgccccucacagcaaaccaaa

SEQ ID NO: 807417 - RNA, 22 nt, Human
cagaaaacagcagcucugccac

SEQ ID NO: 807418 - RNA, 23 nt, Human
cagaaucguccagcuccugacca

SEQ ID NO: 807419 - RNA, 24 nt, Human
cagcacuuugggaggcugaggcag

SEQ ID NO: 807420 - RNA, 26 nt, Human
cagcacuuugggaggcugaggcaggc

SEQ ID NO: 807421 - RNA, 18 nt, Human
cagcagccagguauuggc

SEQ ID NO: 807422 - RNA, 22 nt, Human
cagcagcucugccacaguacuu

SEQ ID NO: 807423 - RNA, 18 nt, Human
cagcccccuccucacccg

SEQ ID NO: 807424 - RNA, 24 nt, Human
caggccuguaagcccagcacuuug

SEQ ID NO: 807425 - RNA, 24 nt, Human
caggcggaucaacugaggucagga

SEQ ID NO: 807426 - RNA, 19 nt, Human
cagggcccaccugccccuc

SEQ ID NO: 807427 - RNA, 19 nt, Human
cagguauuggcacguggcu

SEQ ID NO: 807428 - RNA, 20 nt, Human
cagugagccgagaucccacc

SEQ ID NO: 807429 - RNA, 18 nt, Human
cauuguacuccgccuggg

SEQ ID NO: 807430 - RNA, 21 nt, Human
cauuguacuccgccugggcaa

SEQ ID NO: 807431 - RNA, 22 nt, Human
cauuguacuccgccugggcaac

SEQ ID NO: 807432 - RNA, 23 nt, Human
cauuguacuccgccugggcaaca

SEQ ID NO: 807433 - RNA, 21 nt, Human
ccaaacauauucugccaaaaa

SEQ ID NO: 807434 - RNA, 20 nt, Human
ccaacagagaacaaaugccc

SEQ ID NO: 807435 - RNA, 21 nt, Human
ccaauaucuaacacaugaagg

SEQ ID NO: 807436 - RNA, 22 nt, Human
ccacagaggguuuuuccaaugg

SEQ ID NO: 807437 - RNA, 19 nt, Human
ccauuguacuccgccuggg

SEQ ID NO: 807438 - RNA, 20 nt, Human
ccauuguacuccgccugggc

SEQ ID NO: 807439 - RNA, 24 nt, Human
ccauuguacuccgccugggcaaca

SEQ ID NO: 807440 - RNA, 23 nt, Human
cccagacuacgaguuaagacagc

SEQ ID NO: 807441 - RNA, 18 nt, Human
cccaugguaauagccugg

SEQ ID NO: 807442 - RNA, 23 nt, Human
ccccacacgcagcccccuccuca

SEQ ID NO: 807443 - RNA, 22 nt, Human
ccccuacuuccaccuccuuucc

SEQ ID NO: 807444 - RNA, 21 nt, Human
cccuacuuccaccuccuuucc

SEQ ID NO: 807445 - RNA, 22 nt, Human
cccuacuuccaccuccuuuccc

SEQ ID NO: 807446 - RNA, 24 nt, Human
cccuacuuccaccuccuuucccca

SEQ ID NO: 807447 - RNA, 21 nt, Human
cccuggcucaacagguguugc

SEQ ID NO: 807448 - RNA, 18 nt, Human
ccgcccagccggcuggcg

SEQ ID NO: 807449 - RNA, 22 nt, Human
ccuacucccuggcucaacaggu

SEQ ID NO: 807450 - RNA, 19 nt, Human
ccuacucgcuccucuuccu

SEQ ID NO: 807451 - RNA, 20 nt, Human
ccuacucgcuccucuuccuc

SEQ ID NO: 807452 - RNA, 20 nt, Human
ccuauuuaaugaagcugaaa

SEQ ID NO: 807453 - RNA, 21 nt, Human
ccucacacaagccuccucccc

SEQ ID NO: 807454 - RNA, 23 nt, Human
ccucacagcaaaccaaagcccug

SEQ ID NO: 807455 - RNA, 22 nt, Human
ccucacccgcgauucccucucc

SEQ ID NO: 807456 - RNA, 18 nt, Human
ccuccgaaagucccgguu

SEQ ID NO: 807457 - RNA, 20 nt, Human
ccuccgaaagucccgguuug

SEQ ID NO: 807458 - RNA, 21 nt, Human
ccucucccacgccccucacag

SEQ ID NO: 807459 - RNA, 18 nt, Human
ccucucuccccuacuucc

SEQ ID NO: 807460 - RNA, 21 nt, Human
ccucuugccuacucgcuccuc

SEQ ID NO: 807461 - RNA, 22 nt, Human
ccucuugccuacucgcuccucu

SEQ ID NO: 807462 - RNA, 23 nt, Human
ccugcaggcuaaggaaaaggggc

SEQ ID NO: 807463 - RNA, 24 nt, Human
ccuggccaacacgguaaaacccca

SEQ ID NO: 807464 - RNA, 21 nt, Human
ccuguaaucccagcuacuugg

SEQ ID NO: 807465 - RNA, 23 nt, Human
ccuugggcaaccgauggagaucu

SEQ ID NO: 807466 - RNA, 23 nt, Human
cgaaacuccaucucaaaaaaaaa

SEQ ID NO: 807467 - RNA, 24 nt, Human
cgagaccagccuggccaacacggu

SEQ ID NO: 807468 - RNA, 21 nt, Human
cgcagcccccuccucacccgc

SEQ ID NO: 807469 - RNA, 24 nt, Human
cggaucaacugaggucaggaguuc

SEQ ID NO: 807470 - RNA, 21 nt, Human
cucaagacaacuguauuuaau

SEQ ID NO: 807471 - RNA, 20 nt, Human
cucacacaagccuccucccc

SEQ ID NO: 807472 - RNA, 21 nt, Human
cucacacaagccuccucccca

SEQ ID NO: 807473 - RNA, 24 nt, Human
cucaggccuguaagcccagcacuu

SEQ ID NO: 807474 - RNA, 19 nt, Human
cuccaucucaaaaaaaaaa

SEQ ID NO: 807475 - RNA, 27 nt, Human
cucccaaacugagguccucagugggac

SEQ ID NO: 807476 - RNA, 19 nt, Human
cuccuccccacacgcagcc

SEQ ID NO: 807477 - RNA, 18 nt, Human
cuccucuuccucucuccc

SEQ ID NO: 807478 - RNA, 20 nt, Human
cugagguccucagugggacg

SEQ ID NO: 807479 - RNA, 19 nt, Human
cugccaaaaaggaagcuuc

SEQ ID NO: 807480 - RNA, 23 nt, Human
cuggccaacacgguaaaacccca

SEQ ID NO: 807481 - RNA, 21 nt, Human
cuguaaucccagcuacuuggg

SEQ ID NO: 807482 - RNA, 19 nt, Human
cuuauacuacaucccagga

SEQ ID NO: 807483 - RNA, 21 nt, Human
cuugccuacucgcuccucuuc

SEQ ID NO: 807484 - RNA, 22 nt, Human
cuugccuacucgcuccucuucc

SEQ ID NO: 807485 - RNA, 21 nt, Human
cuuggcccucagcucccagcc

SEQ ID NO: 807486 - RNA, 19 nt, Human
gaagagagaaaaaaagccu

SEQ ID NO: 807487 - RNA, 25 nt, Human
gacuuaucauacccucaagacaacu

SEQ ID NO: 807488 - RNA, 23 nt, Human
gagaaucacuugaacccaggagg

SEQ ID NO: 807489 - RNA, 18 nt, Human
gagguuccuccauuugcu

SEQ ID NO: 807490 - RNA, 22 nt, Human
gagguugcagugagccgagauc

SEQ ID NO: 807491 - RNA, 24 nt, Human
gaucaacugaggucaggaguucga

SEQ ID NO: 807492 - RNA, 19 nt, Human
gauccaugaagguuuccuu

SEQ ID NO: 807493 - RNA, 22 nt, Human
gcaggagaaucacuugaaccca

SEQ ID NO: 807494 - RNA, 22 nt, Human
gccaauaucuaacacaugaagg

SEQ ID NO: 807495 - RNA, 22 nt, Human
gcccccuccucacccgcgauuc

SEQ ID NO: 807496 - RNA, 23 nt, Human
gccccucuugccuacucgcuccu

SEQ ID NO: 807497 - RNA, 20 nt, Human
gcugcuucucccugccacuc

SEQ ID NO: 807498 - RNA, 18 nt, Human
ggaaaaaaaaaaaaaaca

SEQ ID NO: 807499 - RNA, 24 nt, Human
ggaagauccaugaagguuuccuug

SEQ ID NO: 807500 - RNA, 21 nt, Human
ggacauauguauccugugccc

SEQ ID NO: 807501 - RNA, 19 nt, Human
ggacugcccugcccauugc

SEQ ID NO: 807502 - RNA, 22 nt, Human
ggaggcggagguugcagugagc

SEQ ID NO: 807503 - RNA, 18 nt, Human
ggagguugcagugagccg

SEQ ID NO: 807504 - RNA, 20 nt, Human
ggagguugcagugagccgag

SEQ ID NO: 807505 - RNA, 22 nt, Human
ggagguugcagugagccgagau

SEQ ID NO: 807506 - RNA, 23 nt, Human
ggagguugcagugagccgagauc

SEQ ID NO: 807507 - RNA, 22 nt, Human
ggaucaacugaggucaggaguu

SEQ ID NO: 807508 - RNA, 23 nt, Human
ggaucaacugaggucaggaguuc

SEQ ID NO: 807509 - RNA, 18 nt, Human
ggaugcaaacaaccuccu

SEQ ID NO: 807510 - RNA, 24 nt, Human
ggcaccuguaaucccagcuacuug

SEQ ID NO: 807511 - RNA, 22 nt, Human
ggcaggagaaucacuugaaccc

SEQ ID NO: 807512 - RNA, 23 nt, Human
gggaagcaaagagagugggccaa

SEQ ID NO: 807513 - RNA, 24 nt, Human
gggcaugguggcaggcaccuguaa

SEQ ID NO: 807514 - RNA, 19 nt, Human
ggggaagcaaagagagugg

SEQ ID NO: 807515 - RNA, 24 nt, Human
gguggcaggcaccuguaaucccag

SEQ ID NO: 807516 - RNA, 19 nt, Human
guagagcugcuauaguacc

SEQ ID NO: 807517 - RNA, 26 nt, Human
guccaagaggcuuauagcuccacaga

SEQ ID NO: 807518 - RNA, 19 nt, Human
guguugcucuguaugcuca

SEQ ID NO: 807519 - RNA, 19 nt, Human
guugcagugagccgagauc

SEQ ID NO: 807520 - RNA, 22 nt, Human
uaaagaacaaagauuuucaaga

SEQ ID NO: 807521 - RNA, 21 nt, Human
uaaaggaaaaaaaaaaaaaac

SEQ ID NO: 807522 - RNA, 18 nt, Human
uaacacaugaaggaaaca

SEQ ID NO: 807523 - RNA, 20 nt, Human
uaacacaugaaggaaacacu

SEQ ID NO: 807524 - RNA, 22 nt, Human
uaagacaggcaagggaagaucc

SEQ ID NO: 807525 - RNA, 25 nt, Human
uaagcccagcacuuugggaggcuga

SEQ ID NO: 807526 - RNA, 20 nt, Human
uaagucaaaaaagcaauuca

SEQ ID NO: 807527 - RNA, 31 nt, Human
uaagucaaaaaagcaauucaucgacuacaaa

SEQ ID NO: 807528 - RNA, 18 nt, Human
uaauaaucacuuaucaaa

SEQ ID NO: 807529 - RNA, 21 nt, Human
uaauagccuggagagacuucu

SEQ ID NO: 807530 - RNA, 18 nt, Human
uaaugccaacaaaaucug

SEQ ID NO: 807531 - RNA, 22 nt, Human
uacagcuccaacagagaacaaa

SEQ ID NO: 807532 - RNA, 21 nt, Human
uacuguacccuugauccuggu

SEQ ID NO: 807533 - RNA, 25 nt, Human
uagcugaaaaaccacuucaauauau

SEQ ID NO: 807534 - RNA, 20 nt, Human
uaggaaaugucauauuuaac

SEQ ID NO: 807535 - RNA, 18 nt, Human
uaggcaaucugaagccac

SEQ ID NO: 807536 - RNA, 23 nt, Human
ucaaaaaaaaaaaaaaggaagau

SEQ ID NO: 807537 - RNA, 18 nt, Human
ucaaaagaagagagaaaa

SEQ ID NO: 807538 - RNA, 19 nt, Human
ucacacaagccuccucccc

SEQ ID NO: 807539 - RNA, 20 nt, Human
ucacagcaaaccaaagcccu

SEQ ID NO: 807540 - RNA, 22 nt, Human
ucacagcaaaccaaagcccugc

SEQ ID NO: 807541 - RNA, 24 nt, Human
ucacuacuuacagccuugggcaac

SEQ ID NO: 807542 - RNA, 22 nt, Human
ucaggccuguaagcccagcacu

SEQ ID NO: 807543 - RNA, 22 nt, Human
ucaucgcuaaaaccaucacuac

SEQ ID NO: 807544 - RNA, 22 nt, Human
uccaucucaaaaaaaaaaaaaa

SEQ ID NO: 807545 - RNA, 25 nt, Human
ucccaggaaccacugaaacuauccu

SEQ ID NO: 807546 - RNA, 21 nt, Human
ucccgguuugccccucuugcc

SEQ ID NO: 807547 - RNA, 23 nt, Human
uccucacccgcgauucccucucc

SEQ ID NO: 807548 - RNA, 23 nt, Human
ucuaggaagaagaguccaagagg

SEQ ID NO: 807549 - RNA, 18 nt, Human
ucucccugccacucagca

SEQ ID NO: 807550 - RNA, 19 nt, Human
ucuguaugcucauucgugu

SEQ ID NO: 807551 - RNA, 24 nt, Human
ucugugacuaagacaggccggggc

SEQ ID NO: 807552 - RNA, 23 nt, Human
ucuuuuacugaaacagggaggga

SEQ ID NO: 807553 - RNA, 21 nt, Human
ugaaggaaacacagaagacgc

SEQ ID NO: 807554 - RNA, 19 nt, Human
ugagagagugggaugaugg

SEQ ID NO: 807555 - RNA, 19 nt, Human
ugagccgagaucccaccau

SEQ ID NO: 807556 - RNA, 21 nt, Human
ugagcuaaaaauggcuucuca

SEQ ID NO: 807557 - RNA, 20 nt, Human
ugaggcaggcggaucaacug

SEQ ID NO: 807558 - RNA, 26 nt, Human
ugaggcaggcggaucaacugagguca

SEQ ID NO: 807559 - RNA, 23 nt, Human
ugagguccucagugggacgggga

SEQ ID NO: 807560 - RNA, 19 nt, Human
ugaguggagucuagggaug

SEQ ID NO: 807561 - RNA, 21 nt, Human
ugauuaagugcucacacccag

SEQ ID NO: 807562 - RNA, 20 nt, Human
ugccaaaaguucucuuaagg

SEQ ID NO: 807563 - RNA, 21 nt, Human
ugccaaaaguucucuuaaggg

SEQ ID NO: 807564 - RNA, 21 nt, Human
ugccaacaaaaucugccaaaa

SEQ ID NO: 807565 - RNA, 22 nt, Human
ugcccagacuacgaguuaagac

SEQ ID NO: 807566 - RNA, 27 nt, Human
ugcccugcccauugcuuggcccucagc

SEQ ID NO: 807567 - RNA, 20 nt, Human
ugccuacucgcuccucuucc

SEQ ID NO: 807568 - RNA, 18 nt, Human
ugcguucaugaguggagu

SEQ ID NO: 807569 - RNA, 18 nt, Human
ugcucuguaugcucauuc

SEQ ID NO: 807570 - RNA, 22 nt, Human
ugcuuggcccucagcucccagc

SEQ ID NO: 807571 - RNA, 23 nt, Human
uggaacaaauaaaaauuugggau

SEQ ID NO: 807572 - RNA, 20 nt, Human
uggacuccaagcucucuccc

SEQ ID NO: 807573 - RNA, 24 nt, Human
uggagucuagggauguuaccaaga

SEQ ID NO: 807574 - RNA, 18 nt, Human
uggcaggagaaucacuug

SEQ ID NO: 807575 - RNA, 22 nt, Human
uggcaggcaccuguaaucccag

SEQ ID NO: 807576 - RNA, 21 nt, Human
uggcucaggccuguaagccca

SEQ ID NO: 807577 - RNA, 24 nt, Human
uggcucaggccuguaagcccagca

SEQ ID NO: 807578 - RNA, 18 nt, Human
ugggaggcugaggcaggc

SEQ ID NO: 807579 - RNA, 20 nt, Human
ugggaggcugaggcaggcgg

SEQ ID NO: 807580 - RNA, 24 nt, Human
ugggaggcugaggcaggcggauca

SEQ ID NO: 807581 - RNA, 18 nt, Human
ugggaggcuguggcagga

SEQ ID NO: 807582 - RNA, 24 nt, Human
ugggaggcuguggcaggagaauca

SEQ ID NO: 807583 - RNA, 24 nt, Human
ugggaugaugggaggugacagcag

SEQ ID NO: 807584 - RNA, 21 nt, Human
ugggaugcaaacaaccuccuc

SEQ ID NO: 807585 - RNA, 21 nt, Human
uggugcccaggauguucugaa

SEQ ID NO: 807586 - RNA, 24 nt, Human
ugguggcaggcaccuguaauccca

SEQ ID NO: 807587 - RNA, 18 nt, Human
ugguggcucaggccugua

SEQ ID NO: 807588 - RNA, 20 nt, Human
uguaaagaacaaagauuuuc

SEQ ID NO: 807589 - RNA, 21 nt, Human
uguacuccgccugggcaacaa

SEQ ID NO: 807590 - RNA, 21 nt, Human
uguggacuuaucauacccuca

SEQ ID NO: 807591 - RNA, 24 nt, Human
uguggcaggagaaucacuugaacc

SEQ ID NO: 807592 - RNA, 24 nt, Human
ugugggaugcaaacaaccuccucu

SEQ ID NO: 807593 - RNA, 21 nt, Human
uguugccaauaucuaacacau

SEQ ID NO: 807594 - RNA, 22 nt, Human
uuacaacuaccuaggaaauguc

SEQ ID NO: 807595 - RNA, 24 nt, Human
uuaccaaguuguucacuucuacau

SEQ ID NO: 807596 - RNA, 18 nt, Human
uuagcugggcaugguggc

SEQ ID NO: 807597 - RNA, 22 nt, Human
uucagaaaacagcagcucugcc

SEQ ID NO: 807598 - RNA, 22 nt, Human
uucaucaucuuuuacugaaaca

SEQ ID NO: 807599 - RNA, 21 nt, Human
uucaugaguggagucuaggga

SEQ ID NO: 807600 - RNA, 24 nt, Human
uuccagauguacugcauucauucc

SEQ ID NO: 807601 - RNA, 24 nt, Human
uugaacccaggaggcggagguugc

SEQ ID NO: 807602 - RNA, 19 nt, Human
uugcagugagccgagaucc

SEQ ID NO: 807603 - RNA, 22 nt, Human
uugcagugagccgagaucccac

SEQ ID NO: 807604 - RNA, 21 nt, Human
uugcagugagccgagaucccc

SEQ ID NO: 807605 - RNA, 20 nt, Human
uugcagugagccgagauccg

SEQ ID NO: 807606 - RNA, 25 nt, Human
uugggaggcugaggcaggcggauca

SEQ ID NO: 807607 - RNA, 22 nt, Human
uuuaucaagcauaauaaucacu

SEQ ID NO: 807608 - RNA, 20 nt, Human
uuucagaaagcaaacagcag

SEQ ID NO: 807609 - RNA, 19 nt, Human
uuucagauuuuugacacag

SEQ ID NO: 807610 - RNA, 21 nt, Human
uuucuacuaaaaauacaaaaa

SEQ ID NO: 807611 - RNA, 18 nt, Human
aagagggacugucccgua

SEQ ID NO: 807612 - RNA, 26 nt, Human
acugaaguucuuguaacuugggaugg

SEQ ID NO: 807613 - RNA, 21 nt, Human
agacccaggaggcuguggaga

SEQ ID NO: 807614 - RNA, 27 nt, Human
agcuggagggugagaccucucccugug

SEQ ID NO: 807615 - RNA, 22 nt, Human
auccuccagaugugaggaguag

SEQ ID NO: 807616 - RNA, 23 nt, Human
caccgcuguccgggcgcuggugc

SEQ ID NO: 807617 - RNA, 20 nt, Human
caggagccugcuuccaaaga

SEQ ID NO: 807618 - RNA, 20 nt, Human
caggaggcuguggagauugc

SEQ ID NO: 807619 - RNA, 20 nt, Human
ccaaggcugaccauccuccu

SEQ ID NO: 807620 - RNA, 19 nt, Human
ccccuccaaaaccccuccu

SEQ ID NO: 807621 - RNA, 26 nt, Human
cccguaauugagagaugcuccaaggc

SEQ ID NO: 807622 - RNA, 20 nt, Human
cccuccugcuggaauccucc

SEQ ID NO: 807623 - RNA, 21 nt, Human
ccgcggcggcggcggcggcuu

SEQ ID NO: 807624 - RNA, 23 nt, Human
ccuccaaaaccccuccugcugga

SEQ ID NO: 807625 - RNA, 21 nt, Human
ccuccagaugugaggaguagg

SEQ ID NO: 807626 - RNA, 24 nt, Human
ccuccagaugugaggaguaggagc

SEQ ID NO: 807627 - RNA, 18 nt, Human
ccuccugcuggaauccuc

SEQ ID NO: 807628 - RNA, 22 nt, Human
ccuccugcuggaauccuccaga

SEQ ID NO: 807629 - RNA, 18 nt, Human
ccuuccccacuucuagag

SEQ ID NO: 807630 - RNA, 21 nt, Human
cgcaagcagguccccuccaaa

SEQ ID NO: 807631 - RNA, 24 nt, Human
cgcaagcagguccccuccaaaacc

SEQ ID NO: 807632 - RNA, 21 nt, Human
cgcggcggcggcggcggcggc

SEQ ID NO: 807633 - RNA, 18 nt, Human
cggcggcggcgguggcgg

SEQ ID NO: 807634 - RNA, 18 nt, Human
cuccugcugcacacccag

SEQ ID NO: 807635 - RNA, 19 nt, Human
cucucccuguggaucugga

SEQ ID NO: 807636 - RNA, 19 nt, Human
cugcugcacacccagcagc

SEQ ID NO: 807637 - RNA, 25 nt, Human
gaagccgcggcggcggcggcggcgg

SEQ ID NO: 807638 - RNA, 21 nt, Human
gaagcuacacaucuggccuuc

SEQ ID NO: 807639 - RNA, 23 nt, Human
gacaggguuccgcgcccuguccc

SEQ ID NO: 807640 - RNA, 24 nt, Human
gagaagcucccaaaagagagggaa

SEQ ID NO: 807641 - RNA, 23 nt, Human
gagccugcuuccaaagagggacu

SEQ ID NO: 807642 - RNA, 20 nt, Human
gcaagcagguccccuccaaa

SEQ ID NO: 807643 - RNA, 19 nt, Human
gcacaggagccugcuucca

SEQ ID NO: 807644 - RNA, 18 nt, Human
gcagacagaucaaggcug

SEQ ID NO: 807645 - RNA, 21 nt, Human
gcagguccccuccaaaacccc

SEQ ID NO: 807646 - RNA, 18 nt, Human
gcccuguccagccucccc

SEQ ID NO: 807647 - RNA, 20 nt, Human
gcggcggcggcggcggcggc

SEQ ID NO: 807648 - RNA, 20 nt, Human
gcggcggcggcggcggcggc

SEQ ID NO: 807649 - RNA, 24 nt, Human
gcggcggcggcggcggcggcggcg

SEQ ID NO: 807650 - RNA, 20 nt, Human
gcggcggcggcggcggcggu

SEQ ID NO: 807651 - RNA, 23 nt, Human
gcggcggcggcggcggcgguggc

SEQ ID NO: 807652 - RNA, 20 nt, Human
gcggcggcggcggcgguggc

SEQ ID NO: 807653 - RNA, 23 nt, Human
gcggcggcggcggcgguggcggc

SEQ ID NO: 807654 - RNA, 24 nt, Human
gcggcggcggcgguggcggcggca

SEQ ID NO: 807655 - RNA, 20 nt, Human
gcggcggcgguggcggcggc

SEQ ID NO: 807656 - RNA, 24 nt, Human
gcggcggcgguggcggcggcagcg

SEQ ID NO: 807657 - RNA, 20 nt, Human
gcggcgguggcggcggcagc

SEQ ID NO: 807658 - RNA, 20 nt, Human
ggcggcggcggcggcggcgg

SEQ ID NO: 807659 - RNA, 20 nt, Human
ggcggcggcggcggcggcgg

SEQ ID NO: 807660 - RNA, 23 nt, Human
ggcggcggcggcggcggcggcgg

SEQ ID NO: 807661 - RNA, 19 nt, Human
ggcggcggcggcggcggug

SEQ ID NO: 807662 - RNA, 23 nt, Human
ggcggcggcggcggcgguggcgg

SEQ ID NO: 807663 - RNA, 23 nt, Human
ggcggcggcggcgguggcggcgg

SEQ ID NO: 807664 - RNA, 21 nt, Human
gguccccuccaaaaccccucc

SEQ ID NO: 807665 - RNA, 18 nt, Human
ggugagaccucucccugu

SEQ ID NO: 807666 - RNA, 22 nt, Human
gguggcggcggcagcggcggcg

SEQ ID NO: 807667 - RNA, 22 nt, Human
gguuuaacauccacagcuggag

SEQ ID NO: 807668 - RNA, 20 nt, Human
guaggagcagacagaucaag

SEQ ID NO: 807669 - RNA, 25 nt, Human
guccccuccaaaaccccuccugcug

SEQ ID NO: 807670 - RNA, 32 nt, Human
gugcugaagccgcggcggcggcggcggcgacg

SEQ ID NO: 807671 - RNA, 20 nt, Human
guggcggcggcagcggcggg

SEQ ID NO: 807672 - RNA, 24 nt, Human
uagucucacugaaguucuuguaac

SEQ ID NO: 807673 - RNA, 24 nt, Human
uccaaaaccccuccugcuggaauc

SEQ ID NO: 807674 - RNA, 21 nt, Human
uccacagcuggagggugagac

SEQ ID NO: 807675 - RNA, 22 nt, Human
uccacagcuggagggugagacc

SEQ ID NO: 807676 - RNA, 21 nt, Human
ucccuaggaugggggucccuu

SEQ ID NO: 807677 - RNA, 18 nt, Human
ucccuuagucucacugaa

SEQ ID NO: 807678 - RNA, 25 nt, Human
uccucuggucaguaaggaacccuga

SEQ ID NO: 807679 - RNA, 18 nt, Human
uccugcuggaauccucca

SEQ ID NO: 807680 - RNA, 23 nt, Human
ucgcaagcagguccccuccaaaa

SEQ ID NO: 807681 - RNA, 26 nt, Human
ucgcaagcagguccccuccaaaaccc

SEQ ID NO: 807682 - RNA, 18 nt, Human
ucucccuguggaucugga

SEQ ID NO: 807683 - RNA, 22 nt, Human
ucuuguaacuugggaugggggc

SEQ ID NO: 807684 - RNA, 22 nt, Human
ugggaugggggccaggucagcc

SEQ ID NO: 807685 - RNA, 20 nt, Human
uggucaguaaggaacccuga

SEQ ID NO: 807686 - RNA, 23 nt, Human
uguccgggcgcuggugcugaagc

SEQ ID NO: 807687 - RNA, 23 nt, Human
uucugcccagagaagcucccaaa

SEQ ID NO: 807688 - RNA, 26 nt, Human
aaaaaaaaaaaauaauaacaaaaaag

SEQ ID NO: 807689 - RNA, 22 nt, Human
aaaaaacaaaaaagcagacuug

SEQ ID NO: 807690 - RNA, 23 nt, Human
aaaaaacaaaaaagcagacuugc

SEQ ID NO: 807691 - RNA, 22 nt, Human
aaacaaagucaaaacaagagua

SEQ ID NO: 807692 - RNA, 21 nt, Human
aaagacaaguaggaaaggcca

SEQ ID NO: 807693 - RNA, 20 nt, Human
aaaggccagagccaagaaca

SEQ ID NO: 807694 - RNA, 19 nt, Human
aaaugccauauucuuguaa

SEQ ID NO: 807695 - RNA, 24 nt, Human
aacaaaaaaauaaagcauccaaaa

SEQ ID NO: 807696 - RNA, 24 nt, Human
aacaaaaaaauaaagcauccaaag

SEQ ID NO: 807697 - RNA, 21 nt, Human
aacaaaaaacaaaaaagcaga

SEQ ID NO: 807698 - RNA, 20 nt, Human
aacaagguccaggcaaugua

SEQ ID NO: 807699 - RNA, 21 nt, Human
aacauuaaaagcaaaaagcag

SEQ ID NO: 807700 - RNA, 26 nt, Human
aagaagagacacaugaugguacagaa

SEQ ID NO: 807701 - RNA, 24 nt, Human
aagaaggaaggggaaggcagaaga

SEQ ID NO: 807702 - RNA, 20 nt, Human
aagagagagauacagaugaa

SEQ ID NO: 807703 - RNA, 19 nt, Human
aagcaaaaagcagaccuga

SEQ ID NO: 807704 - RNA, 30 nt, Human
aagcaaaauaagaaguauaagugaccugag

SEQ ID NO: 807705 - RNA, 20 nt, Human
aagcaaagagagcaaaggac

SEQ ID NO: 807706 - RNA, 22 nt, Human
aagcaaagagagcaaaggacug

SEQ ID NO: 807707 - RNA, 25 nt, Human
aagcaagaagagacacaugauggua

SEQ ID NO: 807708 - RNA, 18 nt, Human
aagcaagcagaggcccac

SEQ ID NO: 807709 - RNA, 23 nt, Human
aagccacaccuagaacaaaaaaa

SEQ ID NO: 807710 - RNA, 22 nt, Human
aaggaaggggaaggcagaagag

SEQ ID NO: 807711 - RNA, 24 nt, Human
aagggaaaggaagcaucccucuca

SEQ ID NO: 807712 - RNA, 19 nt, Human
aaguucucagcuaccuccc

SEQ ID NO: 807713 - RNA, 20 nt, Human
acaaagccacaccuagaaca

SEQ ID NO: 807714 - RNA, 18 nt, Human
acaaugcuaauggucaca

SEQ ID NO: 807715 - RNA, 19 nt, Human
acaaugguaucuggauucu

SEQ ID NO: 807716 - RNA, 20 nt, Human
acacauaccagcccgcccau

SEQ ID NO: 807717 - RNA, 20 nt, Human
acagagcaaaaaaaaaaaaa

SEQ ID NO: 807718 - RNA, 20 nt, Human
acagggagcacacaucuaaa

SEQ ID NO: 807719 - RNA, 18 nt, Human
acaggugaaaagagagag

SEQ ID NO: 807720 - RNA, 20 nt, Human
acagugaacacauguccaca

SEQ ID NO: 807721 - RNA, 21 nt, Human
accacaaaggaggaaacagca

SEQ ID NO: 807722 - RNA, 21 nt, Human
accaggaagccaacuggggcu

SEQ ID NO: 807723 - RNA, 20 nt, Human
acuaaaguccaaagggucua

SEQ ID NO: 807724 - RNA, 23 nt, Human
acuuaauggcuugauagugacac

SEQ ID NO: 807725 - RNA, 24 nt, Human
agaaccccuacuauggcacucugc

SEQ ID NO: 807726 - RNA, 21 nt, Human
agaaggaaggggaaggcagaa

SEQ ID NO: 807727 - RNA, 18 nt, Human
agaagguagggaagaaca

SEQ ID NO: 807728 - RNA, 25 nt, Human
agagcaaaggacugcugaaaguggg

SEQ ID NO: 807729 - RNA, 19 nt, Human
agagggaggaaaugaggga

SEQ ID NO: 807730 - RNA, 20 nt, Human
agauacagaugaaaccaggu

SEQ ID NO: 807731 - RNA, 22 nt, Human
agauucugcccaucccaauccc

SEQ ID NO: 807732 - RNA, 23 nt, Human
agcaaaaagcagaccugauguga

SEQ ID NO: 807733 - RNA, 18 nt, Human
agcagauccacuuggccu

SEQ ID NO: 807734 - RNA, 24 nt, Human
agccagaaauaaagcaggugacau

SEQ ID NO: 807735 - RNA, 18 nt, Human
agcccacuccuggggcua

SEQ ID NO: 807736 - RNA, 19 nt, Human
agcuggugaccccagaccc

SEQ ID NO: 807737 - RNA, 23 nt, Human
aggaagcauuaaaacaaagucaa

SEQ ID NO: 807738 - RNA, 24 nt, Human
aggaagcauuaaaacaaagucaaa

SEQ ID NO: 807739 - RNA, 23 nt, Human
aggaaggggaaggcagaagagga

SEQ ID NO: 807740 - RNA, 19 nt, Human
aggaggaaacagcaggagg

SEQ ID NO: 807741 - RNA, 18 nt, Human
aggcaaaagaacaugauc

SEQ ID NO: 807742 - RNA, 26 nt, Human
aggcaaaagaacaugaucauaaaugc

SEQ ID NO: 807743 - RNA, 23 nt, Human
aggcacuugggucuuaggaagca

SEQ ID NO: 807744 - RNA, 26 nt, Human
aggcagaagaggaggaaaggggaccc

SEQ ID NO: 807745 - RNA, 29 nt, Human
aggcaggcaagcaaaauaagagggacccc

SEQ ID NO: 807746 - RNA, 23 nt, Human
aggccagagccaagaacaagguc

SEQ ID NO: 807747 - RNA, 24 nt, Human
aggcuaccacaaaggaggaaacag

SEQ ID NO: 807748 - RNA, 18 nt, Human
agguagggaagaacaggu

SEQ ID NO: 807749 - RNA, 25 nt, Human
auaaccccuucaauucucauuuucc

SEQ ID NO: 807750 - RNA, 21 nt, Human
aucccaauccccaucccccag

SEQ ID NO: 807751 - RNA, 19 nt, Human
augcaugcaaacuuacaac

SEQ ID NO: 807752 - RNA, 22 nt, Human
auucugcccaucccaaucccca

SEQ ID NO: 807753 - RNA, 19 nt, Human
caaaaaacaaaaaagcaga

SEQ ID NO: 807754 - RNA, 23 nt, Human
caaaaccagaguuaugagaccag

SEQ ID NO: 807755 - RNA, 21 nt, Human
caaagccacaccuagaacaaa

SEQ ID NO: 807756 - RNA, 22 nt, Human
caaaucccccaccuagcacacc

SEQ ID NO: 807757 - RNA, 19 nt, Human
caacagaacagucucucuc

SEQ ID NO: 807758 - RNA, 21 nt, Human
caacuaggcauccuauuuguu

SEQ ID NO: 807759 - RNA, 18 nt, Human
caaggaccauccucucca

SEQ ID NO: 807760 - RNA, 19 nt, Human
caaugcuaauggucacaca

SEQ ID NO: 807761 - RNA, 23 nt, Human
cacaccuagaacaaaaaaauaaa

SEQ ID NO: 807762 - RNA, 21 nt, Human
cacagaccacaggccaaagcc

SEQ ID NO: 807763 - RNA, 23 nt, Human
cacagaccacaggccaaagccag

SEQ ID NO: 807764 - RNA, 23 nt, Human
cacagcauaaugacagugaacac

SEQ ID NO: 807765 - RNA, 18 nt, Human
cacauguccacacauacc

SEQ ID NO: 807766 - RNA, 24 nt, Human
cacauguccacacauaccagcccg

SEQ ID NO: 807767 - RNA, 23 nt, Human
caccuagaacaaaaaaauaaagc

SEQ ID NO: 807768 - RNA, 23 nt, Human
caccuagcacacccuugcuacag

SEQ ID NO: 807769 - RNA, 19 nt, Human
cacuaacguagaaaagcaa

SEQ ID NO: 807770 - RNA, 19 nt, Human
cacuggucguccuggagga

SEQ ID NO: 807771 - RNA, 21 nt, Human
cagaacacagcaacaauuucc

SEQ ID NO: 807772 - RNA, 21 nt, Human
cagaaccccuacuauggcacu

SEQ ID NO: 807773 - RNA, 24 nt, Human
cagaccacaggccaaagccagaaa

SEQ ID NO: 807774 - RNA, 21 nt, Human
cagagcuugaggaugcacugg

SEQ ID NO: 807775 - RNA, 23 nt, Human
caggagacagguucaggguuugc

SEQ ID NO: 807776 - RNA, 22 nt, Human
caggagcagcccagcaggaggu

SEQ ID NO: 807777 - RNA, 23 nt, Human
caucaaaagagacuaccaaucuc

SEQ ID NO: 807778 - RNA, 19 nt, Human
caugaugguacagaacaca

SEQ ID NO: 807779 - RNA, 20 nt, Human
caugcaugcaaacuuacaac

SEQ ID NO: 807780 - RNA, 19 nt, Human
ccaaauuauucuuccaaaa

SEQ ID NO: 807781 - RNA, 21 nt, Human
ccaaggaccauccucuccacu

SEQ ID NO: 807782 - RNA, 22 nt, Human
ccaaguucucagcuaccucccc

SEQ ID NO: 807783 - RNA, 20 nt, Human
ccacaccuagaacaaaaaaa

SEQ ID NO: 807784 - RNA, 23 nt, Human
cccacagaacaggaaguucuggc

SEQ ID NO: 807785 - RNA, 22 nt, Human
cccagaaccccuacuauggcac

SEQ ID NO: 807786 - RNA, 21 nt, Human
cccagaagcaagaagagacac

SEQ ID NO: 807787 - RNA, 23 nt, Human
cccagacccacagaacaggaagu

SEQ ID NO: 807788 - RNA, 18 nt, Human
cccauuagacuaaaaugg

SEQ ID NO: 807789 - RNA, 21 nt, Human
ccccaucacuaucaccaucaa

SEQ ID NO: 807790 - RNA, 19 nt, Human
cccucccauacucuaucac

SEQ ID NO: 807791 - RNA, 21 nt, Human
ccucccauacucuaucacuga

SEQ ID NO: 807792 - RNA, 20 nt, Human
cguagaaaagcaagaggcua

SEQ ID NO: 807793 - RNA, 23 nt, Human
cuaaagcccacuccuggggcuau

SEQ ID NO: 807794 - RNA, 22 nt, Human
cuagaacaaaaaaauaaagcau

SEQ ID NO: 807795 - RNA, 21 nt, Human
cucagggauaagagagggaaa

SEQ ID NO: 807796 - RNA, 25 nt, Human
cucucauuucuuuuugagacuccuu

SEQ ID NO: 807797 - RNA, 19 nt, Human
cuggcccugaaggagcaga

SEQ ID NO: 807798 - RNA, 21 nt, Human
cugguuuccucaacucucuuu

SEQ ID NO: 807799 - RNA, 22 nt, Human
cuuacccacccucagggggacc

SEQ ID NO: 807800 - RNA, 23 nt, Human
cuucaaagacacgcugugacccu

SEQ ID NO: 807801 - RNA, 20 nt, Human
cuugaggaugcacuggucgu

SEQ ID NO: 807802 - RNA, 21 nt, Human
gaaaagagagagauacagauc

SEQ ID NO: 807803 - RNA, 18 nt, Human
gaaagaagaaugagaggg

SEQ ID NO: 807804 - RNA, 24 nt, Human
gaacaaaaaaauaaagcauccaaa

SEQ ID NO: 807805 - RNA, 23 nt, Human
gaacagguguagauacaguccuu

SEQ ID NO: 807806 - RNA, 20 nt, Human
gaagcaagaagagacacaug

SEQ ID NO: 807807 - RNA, 23 nt, Human
gaccaguacaagcugauaacaau

SEQ ID NO: 807808 - RNA, 19 nt, Human
gagcaaaggacugcugaaa

SEQ ID NO: 807809 - RNA, 21 nt, Human
gauaagagagggaaaggccca

SEQ ID NO: 807810 - RNA, 22 nt, Human
gcaauggaaacgcuugcauaga

SEQ ID NO: 807811 - RNA, 19 nt, Human
gcacaucuguaucuuccca

SEQ ID NO: 807812 - RNA, 23 nt, Human
gcauguacaaagccacaccuaga

SEQ ID NO: 807813 - RNA, 23 nt, Human
gccagagccaagaacaaggucca

SEQ ID NO: 807814 - RNA, 19 nt, Human
gccaguaggguuccuggaa

SEQ ID NO: 807815 - RNA, 21 nt, Human
gcggaggcagcuucaaagaca

SEQ ID NO: 807816 - RNA, 21 nt, Human
gcuggugaccccagacccaca

SEQ ID NO: 807817 - RNA, 22 nt, Human
ggaaaggccagagccaagaaca

SEQ ID NO: 807818 - RNA, 22 nt, Human
ggaagaacagguguagauacag

SEQ ID NO: 807819 - RNA, 19 nt, Human
ggagcagcccagcaggagg

SEQ ID NO: 807820 - RNA, 24 nt, Human
ggcccagcucugcuuuuacaccca

SEQ ID NO: 807821 - RNA, 20 nt, Human
ggcccugaaggagcagagcu

SEQ ID NO: 807822 - RNA, 23 nt, Human
ggcggcggaggcagcuucaaaga

SEQ ID NO: 807823 - RNA, 19 nt, Human
gggaaggcagaagaggagg

SEQ ID NO: 807824 - RNA, 26 nt, Human
gggaaggcagaagaggaggaaaggag

SEQ ID NO: 807825 - RNA, 20 nt, Human
ggggcugacagcaacccaga

SEQ ID NO: 807826 - RNA, 20 nt, Human
ggucuuaggaagcauuaaaa

SEQ ID NO: 807827 - RNA, 23 nt, Human
ggugacaucucagcuggugaccc

SEQ ID NO: 807828 - RNA, 21 nt, Human
guagaaaaaugugguuuuuca

SEQ ID NO: 807829 - RNA, 19 nt, Human
gucaagugccauucugcag

SEQ ID NO: 807830 - RNA, 24 nt, Human
guuuuucaguuguuuucucugugg

SEQ ID NO: 807831 - RNA, 19 nt, Human
uaaaagcaaaaagcagacc

SEQ ID NO: 807832 - RNA, 26 nt, Human
uaaaagcaaaaagcagaccugauguu

SEQ ID NO: 807833 - RNA, 20 nt, Human
uaaagcaggugacaucucaa

SEQ ID NO: 807834 - RNA, 21 nt, Human
uaacagagauacagguuuuua

SEQ ID NO: 807835 - RNA, 20 nt, Human
uaacaugugacacuaacgua

SEQ ID NO: 807836 - RNA, 23 nt, Human
uaacauuaaaagcaaaaagcaga

SEQ ID NO: 807837 - RNA, 24 nt, Human
uaacauuaaaagcaaaaagcagac

SEQ ID NO: 807838 - RNA, 22 nt, Human
uaacccggagauccaaaacagg

SEQ ID NO: 807839 - RNA, 20 nt, Human
uaacuaaaguccaaaggguc

SEQ ID NO: 807840 - RNA, 20 nt, Human
uacaaagccacaccuagaac

SEQ ID NO: 807841 - RNA, 22 nt, Human
uacaaagccacaccuagaacaa

SEQ ID NO: 807842 - RNA, 22 nt, Human
uacaacuauuuauacuguuuaa

SEQ ID NO: 807843 - RNA, 24 nt, Human
uacacagaaaaaaagauugacauu

SEQ ID NO: 807844 - RNA, 21 nt, Human
uacagaugaaaccagguugac

SEQ ID NO: 807845 - RNA, 19 nt, Human
uaccacaaaggaggaaaca

SEQ ID NO: 807846 - RNA, 23 nt, Human
uagaaugaggccucccuaacaaa

SEQ ID NO: 807847 - RNA, 21 nt, Human
uagggaagaacagguguagau

SEQ ID NO: 807848 - RNA, 19 nt, Human
uauagcauucuucugcaug

SEQ ID NO: 807849 - RNA, 19 nt, Human
uaucacagaccacaggcca

SEQ ID NO: 807850 - RNA, 23 nt, Human
uaucacagaccacaggccaaagc

SEQ ID NO: 807851 - RNA, 24 nt, Human
uaucagaauuuuugaaagaguuuc

SEQ ID NO: 807852 - RNA, 18 nt, Human
ucaaaacaagaguaaaca

SEQ ID NO: 807853 - RNA, 18 nt, Human
ucaagcaagcagaggccc

SEQ ID NO: 807854 - RNA, 21 nt, Human
ucaagcaagcagaggcccaca

SEQ ID NO: 807855 - RNA, 22 nt, Human
ucagcuaccuccccagcuguau

SEQ ID NO: 807856 - RNA, 18 nt, Human
uccaaggaccauccucuc

SEQ ID NO: 807857 - RNA, 22 nt, Human
ucccccaggagaagcuugagau

SEQ ID NO: 807858 - RNA, 24 nt, Human
uccucaacuaggcauccuauuugu

SEQ ID NO: 807859 - RNA, 23 nt, Human
ucuauaguacacagaggccaaca

SEQ ID NO: 807860 - RNA, 19 nt, Human
ucugauuuugcaggcccac

SEQ ID NO: 807861 - RNA, 20 nt, Human
ucugugguacuauuuaaaca

SEQ ID NO: 807862 - RNA, 21 nt, Human
ucuuacccacccucagggagg

SEQ ID NO: 807863 - RNA, 20 nt, Human
ucuucccagaaccccuacua

SEQ ID NO: 807864 - RNA, 18 nt, Human
ugaaagugggaaagcugg

SEQ ID NO: 807865 - RNA, 20 nt, Human
ugaacacauguccacacaua

SEQ ID NO: 807866 - RNA, 20 nt, Human
ugacagcaacccagacaaaa

SEQ ID NO: 807867 - RNA, 22 nt, Human
ugagagggaggaaaugagggau

SEQ ID NO: 807868 - RNA, 24 nt, Human
ugagguagaagcaaagagagcaaa

SEQ ID NO: 807869 - RNA, 23 nt, Human
ugagguccagauggccagaggcu

SEQ ID NO: 807870 - RNA, 22 nt, Human
ugagguccuuguugaccaggaa

SEQ ID NO: 807871 - RNA, 20 nt, Human
ugcaccccaucacuaucacc

SEQ ID NO: 807872 - RNA, 18 nt, Human
ugcauggccagcaugaac

SEQ ID NO: 807873 - RNA, 19 nt, Human
ugcuacagcuuuaagccaa

SEQ ID NO: 807874 - RNA, 22 nt, Human
ugcuccaaaucccccaccuagc

SEQ ID NO: 807875 - RNA, 26 nt, Human
ugcuuaacauaugaacaguccgggug

SEQ ID NO: 807876 - RNA, 20 nt, Human
ugcuuuuacacccacuggaa

SEQ ID NO: 807877 - RNA, 22 nt, Human
ugggucuuaggaagcauuaaaa

SEQ ID NO: 807878 - RNA, 20 nt, Human
uuaaaagcaaaaagcagacc

SEQ ID NO: 807879 - RNA, 25 nt, Human
uuacacagaaaaaaagauugacauu

SEQ ID NO: 807880 - RNA, 20 nt, Human
uucacagaacacagcaacaa

SEQ ID NO: 807881 - RNA, 20 nt, Human
uucccagaaccccuacuaug

SEQ ID NO: 807882 - RNA, 21 nt, Human
uuggagacuaaagcccacucc

SEQ ID NO: 807883 - RNA, 21 nt, Human
uuugcuccaaaucccccaccu

SEQ ID NO: 807884 - RNA, 19 nt, Human
uuuguucauaaccccuuca

SEQ ID NO: 807885 - RNA, 22 nt, Human
uuuucaguuguuuucucugugg

SEQ ID NO: 807886 - RNA, 22 nt, Human
uuuuccaagcuagggagguccc

SEQ ID NO: 807887 - RNA, 25 nt, Human
aaacacgcaccaggggaaaugagcc

SEQ ID NO: 807888 - RNA, 24 nt, Human
aaaguucugggauuacaggcauga

SEQ ID NO: 807889 - RNA, 18 nt, Human
aacacaaaagcgaugucc

SEQ ID NO: 807890 - RNA, 21 nt, Human
aacauggcgaaacccuguguc

SEQ ID NO: 807891 - RNA, 22 nt, Human
aacauggcgaaacccugugucu

SEQ ID NO: 807892 - RNA, 19 nt, Human
aagcaaggcccucaagccc

SEQ ID NO: 807893 - RNA, 21 nt, Human
aagcaggagugaauuugaggu

SEQ ID NO: 807894 - RNA, 23 nt, Human
aagcgauucccgauggcggcggg

SEQ ID NO: 807895 - RNA, 19 nt, Human
aaguagcugggauuacagg

SEQ ID NO: 807896 - RNA, 25 nt, Human
aaguagcugggauuacaggcgcccg

SEQ ID NO: 807897 - RNA, 27 nt, Human
aagugauccuccugccucggccuccca

SEQ ID NO: 807898 - RNA, 22 nt, Human
acagacaaucccacagaagaac

SEQ ID NO: 807899 - RNA, 21 nt, Human
acagcacagucuuguacacug

SEQ ID NO: 807900 - RNA, 19 nt, Human
acaggcgcccgccaccacg

SEQ ID NO: 807901 - RNA, 21 nt, Human
accacugcacuccagccuagg

SEQ ID NO: 807902 - RNA, 22 nt, Human
accacugcacuccagccuaggc

SEQ ID NO: 807903 - RNA, 18 nt, Human
accauguuggccaggcug

SEQ ID NO: 807904 - RNA, 24 nt, Human
accgcagagccucuuccccgcccu

SEQ ID NO: 807905 - RNA, 20 nt, Human
acucuuauaggccaggcugg

SEQ ID NO: 807906 - RNA, 24 nt, Human
acugcacuccagccuaggcgacag

SEQ ID NO: 807907 - RNA, 26 nt, Human
acugcacuccagccuaggcgacagag

SEQ ID NO: 807908 - RNA, 18 nt, Human
agaacccgaggcucucuc

SEQ ID NO: 807909 - RNA, 20 nt, Human
agaagacagacaaucccaca

SEQ ID NO: 807910 - RNA, 22 nt, Human
agaagacagacaaucccacaga

SEQ ID NO: 807911 - RNA, 22 nt, Human
agaagcaaggaggagacgcaag

SEQ ID NO: 807912 - RNA, 25 nt, Human
agacagacaggaggaggacggaggu

SEQ ID NO: 807913 - RNA, 19 nt, Human
agagaagcaaggaggagac

SEQ ID NO: 807914 - RNA, 19 nt, Human
agagccucuuccccgcccu

SEQ ID NO: 807915 - RNA, 24 nt, Human
agcaccuugggaggcugagguggg

SEQ ID NO: 807916 - RNA, 23 nt, Human
agccacagacucggaggcagcac

SEQ ID NO: 807917 - RNA, 18 nt, Human
agccacgcuggacagcac

SEQ ID NO: 807918 - RNA, 23 nt, Human
agccaggugcgguggugcgugcc

SEQ ID NO: 807919 - RNA, 23 nt, Human
agcugaggcaggaggauugcuug

SEQ ID NO: 807920 - RNA, 20 nt, Human
agcugcagggcgugcggaac

SEQ ID NO: 807921 - RNA, 21 nt, Human
aggagaaaaaaauugccuaaa

SEQ ID NO: 807922 - RNA, 18 nt, Human
aggaggacggagguuucu

SEQ ID NO: 807923 - RNA, 20 nt, Human
aggaggacggagguuucugg

SEQ ID NO: 807924 - RNA, 21 nt, Human
aggaggacggagguuucuggg

SEQ ID NO: 807925 - RNA, 23 nt, Human
aggaggcauggggagggcagggc

SEQ ID NO: 807926 - RNA, 24 nt, Human
aggcaggaggauugcuugagcccg

SEQ ID NO: 807927 - RNA, 20 nt, Human
aggcauggggagggcagggc

SEQ ID NO: 807928 - RNA, 23 nt, Human
aggcauggggagggcagggcccg

SEQ ID NO: 807929 - RNA, 19 nt, Human
aggcgagguggcucaugcc

SEQ ID NO: 807930 - RNA, 24 nt, Human
aggcgagguggcucaugccuguaa

SEQ ID NO: 807931 - RNA, 23 nt, Human
aggcugaggugggcagaccacua

SEQ ID NO: 807932 - RNA, 18 nt, Human
agggcagggcccgcccgu

SEQ ID NO: 807933 - RNA, 22 nt, Human
aggucgaggcugcagugagcug

SEQ ID NO: 807934 - RNA, 21 nt, Human
agugcaauggcgcgaucucag

SEQ ID NO: 807935 - RNA, 24 nt, Human
auggagcaugugaaauguggcccu

SEQ ID NO: 807936 - RNA, 18 nt, Human
augggguuucaccauguu

SEQ ID NO: 807937 - RNA, 22 nt, Human
augggguuucaccauguuggcc

SEQ ID NO: 807938 - RNA, 24 nt, Human
augggguuucaccauguuggccag

SEQ ID NO: 807939 - RNA, 23 nt, Human
auugcuugagcccgggaggucga

SEQ ID NO: 807940 - RNA, 23 nt, Human
caaaaagcaacaucucaacagca

SEQ ID NO: 807941 - RNA, 24 nt, Human
caaaguucugggauuacaggcaug

SEQ ID NO: 807942 - RNA, 25 nt, Human
caacaguguguaccacgaacgcucc

SEQ ID NO: 807943 - RNA, 22 nt, Human
caaccacuuugaaaaagaacuc

SEQ ID NO: 807944 - RNA, 20 nt, Human
caaccuccgccucccggguu

SEQ ID NO: 807945 - RNA, 22 nt, Human
caagcaauucucuugccucagc

SEQ ID NO: 807946 - RNA, 27 nt, Human
caagcaauucucuugccucagccaccc

SEQ ID NO: 807947 - RNA, 20 nt, Human
caagucuucgguuagcguca

SEQ ID NO: 807948 - RNA, 22 nt, Human
caagugauccuccugccucggc

SEQ ID NO: 807949 - RNA, 27 nt, Human
caagugauccuccugccucggccuccc

SEQ ID NO: 807950 - RNA, 25 nt, Human
cacaggccaaggggcagugcagaac

SEQ ID NO: 807951 - RNA, 25 nt, Human
caccaaagaagauacaacuuguaaa

SEQ ID NO: 807952 - RNA, 27 nt, Human
caccaaagaagauacaacuuguaaaug

SEQ ID NO: 807953 - RNA, 26 nt, Human
caccacugcacuccagccuaggcgac

SEQ ID NO: 807954 - RNA, 19 nt, Human
caccaggggaaaugagccu

SEQ ID NO: 807955 - RNA, 21 nt, Human
caccauguuggccaggcuggu

SEQ ID NO: 807956 - RNA, 24 nt, Human
caccauguuggccaggcuggucuc

SEQ ID NO: 807957 - RNA, 27 nt, Human
caccauguuggccaggcuggucucaaa

SEQ ID NO: 807958 - RNA, 20 nt, Human
cacgcgaagacagacaggag

SEQ ID NO: 807959 - RNA, 21 nt, Human
cacugcaaccuccgccucccg

SEQ ID NO: 807960 - RNA, 23 nt, Human
cacugcaaccuccgccucccggg

SEQ ID NO: 807961 - RNA, 19 nt, Human
cacugcacuccagccuagg

SEQ ID NO: 807962 - RNA, 20 nt, Human
cacugcacuccagccuaggc

SEQ ID NO: 807963 - RNA, 20 nt, Human
cacugcacuccagccuaggc

SEQ ID NO: 807964 - RNA, 22 nt, Human
cacugcacuccagccuaggcga

SEQ ID NO: 807965 - RNA, 25 nt, Human
cacugcacuccagccuaggcgacaa

SEQ ID NO: 807966 - RNA, 25 nt, Human
cacugcacuccagccuaggcgacag

SEQ ID NO: 807967 - RNA, 24 nt, Human
cacuuugaaaaagaacucgguggg

SEQ ID NO: 807968 - RNA, 19 nt, Human
cagagacccugucucaaca

SEQ ID NO: 807969 - RNA, 18 nt, Human
cagcaccugcaacauucc

SEQ ID NO: 807970 - RNA, 23 nt, Human
cagcaccuugggaggcugaggug

SEQ ID NO: 807971 - RNA, 24 nt, Human
cagcaccuugggaggcugaggugg

SEQ ID NO: 807972 - RNA, 19 nt, Human
caggaguuccacaccagcc

SEQ ID NO: 807973 - RNA, 20 nt, Human
caggcagagcugggcuucug

SEQ ID NO: 807974 - RNA, 21 nt, Human
caggccaaggggcagugcaga

SEQ ID NO: 807975 - RNA, 18 nt, Human
caggccccccagacaagc

SEQ ID NO: 807976 - RNA, 21 nt, Human
caggcgcccgccaccacgccu

SEQ ID NO: 807977 - RNA, 24 nt, Human
cauguuggccaggcuggucucaaa

SEQ ID NO: 807978 - RNA, 24 nt, Human
ccaaaguucugggauuacaggcau

SEQ ID NO: 807979 - RNA, 22 nt, Human
ccaaguagcugggauuacaggc

SEQ ID NO: 807980 - RNA, 24 nt, Human
ccacccaaguagcugggauuacag

SEQ ID NO: 807981 - RNA, 19 nt, Human
ccacugcacuccagccuag

SEQ ID NO: 807982 - RNA, 21 nt, Human
ccacugcacuccagccuaggc

SEQ ID NO: 807983 - RNA, 24 nt, Human
ccacugcacuccagccuaggcgac

SEQ ID NO: 807984 - RNA, 24 nt, Human
cccaaaguucugggauuacaggca

SEQ ID NO: 807985 - RNA, 23 nt, Human
cccaaguagcugggauuacaggc

SEQ ID NO: 807986 - RNA, 23 nt, Human
cccaaguagcugggauuacaggc

SEQ ID NO: 807987 - RNA, 19 nt, Human
cccagggaaagacacgcaa

SEQ ID NO: 807988 - RNA, 20 nt, Human
ccccccagacaagcagcccc

SEQ ID NO: 807989 - RNA, 19 nt, Human
cccccgcagcccggccccu

SEQ ID NO: 807990 - RNA, 18 nt, Human
ccccgcuggugcgcgucu

SEQ ID NO: 807991 - RNA, 18 nt, Human
ccccgggccgugugaccu

SEQ ID NO: 807992 - RNA, 19 nt, Human
cccggccccuccagggggc

SEQ ID NO: 807993 - RNA, 20 nt, Human
cccggguucaagcaauucuc

SEQ ID NO: 807994 - RNA, 22 nt, Human
cccguaggacccucugugacca

SEQ ID NO: 807995 - RNA, 27 nt, Human
ccgccucccggguucaagcaauucuuu

SEQ ID NO: 807996 - RNA, 24 nt, Human
ccucccggguucaagcaauucucu

SEQ ID NO: 807997 - RNA, 19 nt, Human
ccuccugccucggccuccc

SEQ ID NO: 807998 - RNA, 22 nt, Human
ccuggaggagaaaaaaauugcc

SEQ ID NO: 807999 - RNA, 20 nt, Human
ccuggauggucaauugauuu

SEQ ID NO: 808000 - RNA, 19 nt, Human
ccuguaauccagcaccuug

SEQ ID NO: 808001 - RNA, 21 nt, Human
ccuguaguuccagcuacucag

SEQ ID NO: 808002 - RNA, 22 nt, Human
ccuguaguuccagcuacucagg

SEQ ID NO: 808003 - RNA, 23 nt, Human
cgaagacagacaggaggaggacg

SEQ ID NO: 808004 - RNA, 22 nt, Human
cgcccgugcugggccugcuggg

SEQ ID NO: 808005 - RNA, 24 nt, Human
cgcccgugcugggccugcugggcc

SEQ ID NO: 808006 - RNA, 22 nt, Human
cuaacaacagccacagcugcag

SEQ ID NO: 808007 - RNA, 22 nt, Human
cucaacacaaaagcgauguccu

SEQ ID NO: 808008 - RNA, 24 nt, Human
cucaagugauccuccugccucggc

SEQ ID NO: 808009 - RNA, 24 nt, Human
cucacugcaaccuccgccucccgg

SEQ ID NO: 808010 - RNA, 24 nt, Human
cucagccacccaaguagcugggau

SEQ ID NO: 808011 - RNA, 23 nt, Human
cucaugccuguaauccagcaccu

SEQ ID NO: 808012 - RNA, 25 nt, Human
cuccagggggcaccgcagagccucu

SEQ ID NO: 808013 - RNA, 21 nt, Human
cuccgcgcugagcugcagggc

SEQ ID NO: 808014 - RNA, 22 nt, Human
cucuuauaggccaggcuggagu

SEQ ID NO: 808015 - RNA, 24 nt, Human
cugcaaccuccgccucccggguuc

SEQ ID NO: 808016 - RNA, 22 nt, Human
cugcagugagcugugacugcac

SEQ ID NO: 808017 - RNA, 20 nt, Human
cugccucggccucccaaagu

SEQ ID NO: 808018 - RNA, 24 nt, Human
cugcugggccaaugcuggaggugc

SEQ ID NO: 808019 - RNA, 23 nt, Human
cuugaccucaagugauccuccug

SEQ ID NO: 808020 - RNA, 20 nt, Human
cuugugccguggaauacaca

SEQ ID NO: 808021 - RNA, 23 nt, Human
gaaggacggaucuagaacccgag

SEQ ID NO: 808022 - RNA, 22 nt, Human
gaccucaagugauccuccugcc

SEQ ID NO: 808023 - RNA, 24 nt, Human
gaccucaagugauccuccugccuc

SEQ ID NO: 808024 - RNA, 23 nt, Human
gagaagaagacagacaaucccac

SEQ ID NO: 808025 - RNA, 27 nt, Human
gagaagaagacagacaaucccacagaa

SEQ ID NO: 808026 - RNA, 21 nt, Human
gagugcaauggcgcgaucuca

SEQ ID NO: 808027 - RNA, 20 nt, Human
gaguguaaacuugcacaacc

SEQ ID NO: 808028 - RNA, 18 nt, Human
gauuacaggcaugagcca

SEQ ID NO: 808029 - RNA, 21 nt, Human
gauuacaggcaugagccacug

SEQ ID NO: 808030 - RNA, 24 nt, Human
gauuacaggcaugagccacugugc

SEQ ID NO: 808031 - RNA, 18 nt, Human
gauuacaggcgcccgcca

SEQ ID NO: 808032 - RNA, 24 nt, Human
gauugcuugagcccgggaggucga

SEQ ID NO: 808033 - RNA, 24 nt, Human
gcaauucucuugccucagccaccc

SEQ ID NO: 808034 - RNA, 25 nt, Human
gcaccacgcgaagacagaaguccac

SEQ ID NO: 808035 - RNA, 27 nt, Human
gcagccccgggccgugugaccucgugc

SEQ ID NO: 808036 - RNA, 24 nt, Human
gcccgggaggucgaggcugcagug

SEQ ID NO: 808037 - RNA, 18 nt, Human
gcccugugcggcuccgcc

SEQ ID NO: 808038 - RNA, 21 nt, Human
gccucagcccugacuuccacc

SEQ ID NO: 808039 - RNA, 23 nt, Human
gccuggcuaauuuuuuguauuuu

SEQ ID NO: 808040 - RNA, 23 nt, Human
gccuguaauccagcaccuuggga

SEQ ID NO: 808041 - RNA, 25 nt, Human
gccuucgcaacaguguguaccacca

SEQ ID NO: 808042 - RNA, 20 nt, Human
gcgugccuguaguuccagcu

SEQ ID NO: 808043 - RNA, 19 nt, Human
gcugcagugagcugugacu

SEQ ID NO: 808044 - RNA, 19 nt, Human
gcuggagugcaauggcgcg

SEQ ID NO: 808045 - RNA, 22 nt, Human
gcugggccugcugggccaaugc

SEQ ID NO: 808046 - RNA, 18 nt, Human
ggaaacauggcgaaaccc

SEQ ID NO: 808047 - RNA, 22 nt, Human
ggaauacacaaacacgcaccag

SEQ ID NO: 808048 - RNA, 21 nt, Human
ggagcaugugaaauguggccc

SEQ ID NO: 808049 - RNA, 24 nt, Human
ggauuacaggcaugagccacugug

SEQ ID NO: 808050 - RNA, 22 nt, Human
ggccccccagacaagcagcccc

SEQ ID NO: 808051 - RNA, 20 nt, Human
ggcgacagagacccugucuc

SEQ ID NO: 808052 - RNA, 18 nt, Human
ggcucaugccuguaaucc

SEQ ID NO: 808053 - RNA, 18 nt, Human
ggcugcagggcaggaggc

SEQ ID NO: 808054 - RNA, 21 nt, Human
gggaaagacacgcaaucucac

SEQ ID NO: 808055 - RNA, 25 nt, Human
gggcagccguugcccacaggucgcu

SEQ ID NO: 808056 - RNA, 18 nt, Human
gggcugcagggcaggagg

SEQ ID NO: 808057 - RNA, 22 nt, Human
gggguuucaccauguuggccag

SEQ ID NO: 808058 - RNA, 18 nt, Human
ggguuucaccauguuggc

SEQ ID NO: 808059 - RNA, 22 nt, Human
ggguuucaccauguuggccagg

SEQ ID NO: 808060 - RNA, 21 nt, Human
gguggcucaugccuguaaucc

SEQ ID NO: 808061 - RNA, 23 nt, Human
gguggcucaugccuguaauccag

SEQ ID NO: 808062 - RNA, 22 nt, Human
gguggugcgugccuguaguucc

SEQ ID NO: 808063 - RNA, 23 nt, Human
gguggugcgugccuguaguucca

SEQ ID NO: 808064 - RNA, 18 nt, Human
guagcugggauuacaggc

SEQ ID NO: 808065 - RNA, 26 nt, Human
gugaagcaaggcccucaagcccagug

SEQ ID NO: 808066 - RNA, 18 nt, Human
guggugcgugccuguagu

SEQ ID NO: 808067 - RNA, 23 nt, Human
uaacaacagccacagcugcagag

SEQ ID NO: 808068 - RNA, 22 nt, Human
uaauuuuuuguauuuuuaguag

SEQ ID NO: 808069 - RNA, 23 nt, Human
uaauuuuuuguauuuuuaguaga

SEQ ID NO: 808070 - RNA, 22 nt, Human
uacaggcaugagccacugugcc

SEQ ID NO: 808071 - RNA, 22 nt, Human
uacaggcgcccgccaccacgcc

SEQ ID NO: 808072 - RNA, 22 nt, Human
uagaaaugggguuucaccaugu

SEQ ID NO: 808073 - RNA, 24 nt, Human
uagaacccgaggcucucucaggaa

SEQ ID NO: 808074 - RNA, 19 nt, Human
uagcugaugccagugaggc

SEQ ID NO: 808075 - RNA, 20 nt, Human
uaggcgagguggcucaugcc

SEQ ID NO: 808076 - RNA, 24 nt, Human
uaguagaaaugggguuucaccaug

SEQ ID NO: 808077 - RNA, 26 nt, Human
uaguagaaaugggguuucaccauguu

SEQ ID NO: 808078 - RNA, 20 nt, Human
ucaagcccaguguggccccg

SEQ ID NO: 808079 - RNA, 20 nt, Human
ucacacacaggccaaggggc

SEQ ID NO: 808080 - RNA, 23 nt, Human
ucacaccggaagugcggcucaca

SEQ ID NO: 808081 - RNA, 23 nt, Human
ucacaccggaagugcggcucaca

SEQ ID NO: 808082 - RNA, 23 nt, Human
ucacaccggaagugcggcucaca

SEQ ID NO: 808083 - RNA, 23 nt, Human
ucacugcaaccuccgccucccgg

SEQ ID NO: 808084 - RNA, 24 nt, Human
ucacugcaaccuccgccucccggg

SEQ ID NO: 808085 - RNA, 25 nt, Human
ucacugcaaccuccgccucccgggu

SEQ ID NO: 808086 - RNA, 27 nt, Human
ucacugcaaccuccgccucccggguuc

SEQ ID NO: 808087 - RNA, 22 nt, Human
ucacuggugaucugggaaacca

SEQ ID NO: 808088 - RNA, 24 nt, Human
ucccaaaguucugggauuacaggc

SEQ ID NO: 808089 - RNA, 21 nt, Human
ucccggguucaagcaauucuc

SEQ ID NO: 808090 - RNA, 21 nt, Human
ucccggguucaagcaauucuc

SEQ ID NO: 808091 - RNA, 24 nt, Human
uccgccucccggguucaagcaauu

SEQ ID NO: 808092 - RNA, 18 nt, Human
ucggugggcuaggcgagg

SEQ ID NO: 808093 - RNA, 20 nt, Human
ucugggugcaugaagagcuc

SEQ ID NO: 808094 - RNA, 18 nt, Human
ucuguccucagcuguuuu

SEQ ID NO: 808095 - RNA, 19 nt, Human
ucuguccucagcuguuuuc

SEQ ID NO: 808096 - RNA, 23 nt, Human
ucugugaccaggcagagcugggc

SEQ ID NO: 808097 - RNA, 23 nt, Human
ugaaaugccugcguucuguccuc

SEQ ID NO: 808098 - RNA, 18 nt, Human
ugaccaggcagagcuggg

SEQ ID NO: 808099 - RNA, 18 nt, Human
ugaccucaagugauccuc

SEQ ID NO: 808100 - RNA, 21 nt, Human
ugaccucaagugauccuccug

SEQ ID NO: 808101 - RNA, 24 nt, Human
ugaccucaagugauccuccugccu

SEQ ID NO: 808102 - RNA, 23 nt, Human
ugacugcaccacugcacuccagc

SEQ ID NO: 808103 - RNA, 21 nt, Human
ugagaaaagacgucauaaagg

SEQ ID NO: 808104 - RNA, 19 nt, Human
ugagaagaagacagacaau

SEQ ID NO: 808105 - RNA, 24 nt, Human
ugagcccgggaggucgaggcugca

SEQ ID NO: 808106 - RNA, 24 nt, Human
ugaggcaggaggauugcuugagcc

SEQ ID NO: 808107 - RNA, 25 nt, Human
ugaggcaggaggauugcuugagccc

SEQ ID NO: 808108 - RNA, 18 nt, Human
ugaggugggcagacagcc

SEQ ID NO: 808109 - RNA, 21 nt, Human
ugcaccacugcacuccagccu

SEQ ID NO: 808110 - RNA, 20 nt, Human
ugcagggcaggaggcauggg

SEQ ID NO: 808111 - RNA, 24 nt, Human
ugccucagccacccaaguagcugg

SEQ ID NO: 808112 - RNA, 24 nt, Human
ugccucggccucccaaaguucugg

SEQ ID NO: 808113 - RNA, 21 nt, Human
ugccuguaauccagcaccuug

SEQ ID NO: 808114 - RNA, 23 nt, Human
ugccuguaauccagcaccuuggg

SEQ ID NO: 808115 - RNA, 24 nt, Human
ugccuguaguuccagcuacucagg

SEQ ID NO: 808116 - RNA, 18 nt, Human
ugcugggccugcugggcc

SEQ ID NO: 808117 - RNA, 22 nt, Human
uggaauacacaaacacgcacca

SEQ ID NO: 808118 - RNA, 24 nt, Human
uggagugcaauggcgcgaucucag

SEQ ID NO: 808119 - RNA, 22 nt, Human
uggaucauacaccucaacacaa

SEQ ID NO: 808120 - RNA, 24 nt, Human
uggccaggcuggucucaaacucuu

SEQ ID NO: 808121 - RNA, 24 nt, Human
uggcgcgaucucagcucacugcaa

SEQ ID NO: 808122 - RNA, 19 nt, Human
uggcucaugccuguaaucc

SEQ ID NO: 808123 - RNA, 23 nt, Human
uggcucaugccuguaauccagca

SEQ ID NO: 808124 - RNA, 19 nt, Human
ugggaggcugaggugggca

SEQ ID NO: 808125 - RNA, 20 nt, Human
ugggaggcugaggugggcag

SEQ ID NO: 808126 - RNA, 22 nt, Human
ugggaggcugaggugggcagac

SEQ ID NO: 808127 - RNA, 18 nt, Human
ugggauuacaggcaugag

SEQ ID NO: 808128 - RNA, 21 nt, Human
ugggauuacaggcaugagcca

SEQ ID NO: 808129 - RNA, 22 nt, Human
ugggauuacaggcaugagccac

SEQ ID NO: 808130 - RNA, 22 nt, Human
ugggauuacaggcaugagccac

SEQ ID NO: 808131 - RNA, 22 nt, Human
ugggauuacaggcaugagccac

SEQ ID NO: 808132 - RNA, 23 nt, Human
ugggauuacaggcaugagccacu

SEQ ID NO: 808133 - RNA, 24 nt, Human
ugggauuacaggcaugagccacug

SEQ ID NO: 808134 - RNA, 21 nt, Human
ugggauuacaggcgcccgcca

SEQ ID NO: 808135 - RNA, 22 nt, Human
ugggauuacaggcgcccgccac

SEQ ID NO: 808136 - RNA, 24 nt, Human
ugggauuacaggcgcccgccacca

SEQ ID NO: 808137 - RNA, 20 nt, Human
ugggccugcugggccaaugc

SEQ ID NO: 808138 - RNA, 21 nt, Human
ugggcuguccaguagggcagc

SEQ ID NO: 808139 - RNA, 24 nt, Human
ugggguuucaccauguuggccagg

SEQ ID NO: 808140 - RNA, 18 nt, Human
uggugcgugccuguaguu

SEQ ID NO: 808141 - RNA, 21 nt, Human
uguauuuuuaguagaaauggg

SEQ ID NO: 808142 - RNA, 23 nt, Human
uguccaguagggcagccguugcc

SEQ ID NO: 808143 - RNA, 20 nt, Human
ugugcacuggcagaaggacg

SEQ ID NO: 808144 - RNA, 25 nt, Human
uguggcccuuguggaggaggaccug

SEQ ID NO: 808145 - RNA, 18 nt, Human
uuaguagaaaugggguuu

SEQ ID NO: 808146 - RNA, 22 nt, Human
uuaguagaaaugggguuucacc

SEQ ID NO: 808147 - RNA, 24 nt, Human
uuaguagaaaugggguuucaccau

SEQ ID NO: 808148 - RNA, 25 nt, Human
uuaguggcacauaagaauauuuucu

SEQ ID NO: 808149 - RNA, 23 nt, Human
uuccagcuacucaggagcugagg

SEQ ID NO: 808150 - RNA, 22 nt, Human
uucuucaauuuaucagcaucag

SEQ ID NO: 808151 - RNA, 18 nt, Human
uugcuugagcccgggagg

SEQ ID NO: 808152 - RNA, 23 nt, Human
uugcuugagcccgggaggucgag

SEQ ID NO: 808153 - RNA, 24 nt, Human
uugcuugagcccgggaggucgagg

SEQ ID NO: 808154 - RNA, 22 nt, Human
uuuaaguuuaaauagccagaug

SEQ ID NO: 808155 - RNA, 24 nt, Human
uuucaccauguuggccaggcuggu

SEQ ID NO: 808156 - RNA, 25 nt, Human
uuucuggaucucgaugcguaugugg

SEQ ID NO: 808157 - RNA, 24 nt, Human
uuuuacucuuauaggccaggcugg

SEQ ID NO: 808158 - RNA, 24 nt, Human
uuuuuaguagaaaugggguuucac

SEQ ID NO: 808159 - RNA, 19 nt, Human
uuuuuguauuuuuaguaga

SEQ ID NO: 808160 - RNA, 18 nt, Human
uuuuuuguauuuuuagua

SEQ ID NO: 808161 - RNA, 22 nt, Human
aaacaccaagagccccacugcu

SEQ ID NO: 808162 - RNA, 20 nt, Human
aaagagagguggggggcugc

SEQ ID NO: 808163 - RNA, 21 nt, Human
aaagcccgccuuguccccaga

SEQ ID NO: 808164 - RNA, 27 nt, Human
aaauaacagcuuuaccagcagauccca

SEQ ID NO: 808165 - RNA, 18 nt, Human
aagaagugauagaguuuc

SEQ ID NO: 808166 - RNA, 22 nt, Human
aagcccgccuuguccccagaac

SEQ ID NO: 808167 - RNA, 23 nt, Human
aagggccagugaagccacaggug

SEQ ID NO: 808168 - RNA, 25 nt, Human
aaguggcuaauuguguuucucuaug

SEQ ID NO: 808169 - RNA, 18 nt, Human
aaugguaugaagcaaacc

SEQ ID NO: 808170 - RNA, 23 nt, Human
agagagguggggggcugcugagc

SEQ ID NO: 808171 - RNA, 21 nt, Human
agaggggcgcgggcggcgaug

SEQ ID NO: 808172 - RNA, 18 nt, Human
agauucccguuuccccac

SEQ ID NO: 808173 - RNA, 24 nt, Human
agcauucuuguagauccucugcuc

SEQ ID NO: 808174 - RNA, 19 nt, Human
agccugcagacuggagcua

SEQ ID NO: 808175 - RNA, 20 nt, Human
aggaugaagagggggaaagg

SEQ ID NO: 808176 - RNA, 24 nt, Human
aggcagcaugaaacaccaagagcc

SEQ ID NO: 808177 - RNA, 19 nt, Human
aggcaugguuuuggcuucu

SEQ ID NO: 808178 - RNA, 21 nt, Human
agggagaggcaggcccaagca

SEQ ID NO: 808179 - RNA, 19 nt, Human
agggaucagucccuaaacc

SEQ ID NO: 808180 - RNA, 19 nt, Human
agggcuggcagaugccacc

SEQ ID NO: 808181 - RNA, 22 nt, Human
agguggggggcugcugagcugg

SEQ ID NO: 808182 - RNA, 19 nt, Human
aguacccauuuccguguga

SEQ ID NO: 808183 - RNA, 25 nt, Human
auaaggcagcaugaaacaccaagag

SEQ ID NO: 808184 - RNA, 19 nt, Human
augaaacaccaagagcccc

SEQ ID NO: 808185 - RNA, 20 nt, Human
augaaacaccaagagcccca

SEQ ID NO: 808186 - RNA, 20 nt, Human
augaagcaaaccagcuuccc

SEQ ID NO: 808187 - RNA, 25 nt, Human
augcaucugauggaaugaggagggu

SEQ ID NO: 808188 - RNA, 18 nt, Human
auuugcauugucucuaac

SEQ ID NO: 808189 - RNA, 18 nt, Human
caaagcaaaacgggauca

SEQ ID NO: 808190 - RNA, 28 nt, Human
caaauaacagcuuuaccagcagauccca

SEQ ID NO: 808191 - RNA, 22 nt, Human
cacaaugauagucagaaagacc

SEQ ID NO: 808192 - RNA, 19 nt, Human
caccaaguacccauuuccg

SEQ ID NO: 808193 - RNA, 20 nt, Human
cagacaccaccaccccgggu

SEQ ID NO: 808194 - RNA, 18 nt, Human
cagagccugcagacugga

SEQ ID NO: 808195 - RNA, 19 nt, Human
cagagcuucugccaggcuc

SEQ ID NO: 808196 - RNA, 21 nt, Human
cagaucccaaugguaugaagg

SEQ ID NO: 808197 - RNA, 23 nt, Human
cagcaugaaacaccaagagcccc

SEQ ID NO: 808198 - RNA, 18 nt, Human
caggccagaagcuccugg

SEQ ID NO: 808199 - RNA, 20 nt, Human
cagguggaaaagagccuucc

SEQ ID NO: 808200 - RNA, 21 nt, Human
cagugagggagccccgcugga

SEQ ID NO: 808201 - RNA, 18 nt, Human
caugaaacaccaagagcc

SEQ ID NO: 808202 - RNA, 19 nt, Human
ccaacauuugcauugucuc

SEQ ID NO: 808203 - RNA, 18 nt, Human
ccaaccacagagcuucug

SEQ ID NO: 808204 - RNA, 21 nt, Human
ccaagagccccacugcuuucu

SEQ ID NO: 808205 - RNA, 22 nt, Human
cccacacagaagggguggguuc

SEQ ID NO: 808206 - RNA, 19 nt, Human
cccacgaaagcccgccuug

SEQ ID NO: 808207 - RNA, 21 nt, Human
cccccuaccacaaugauaguc

SEQ ID NO: 808208 - RNA, 25 nt, Human
ccccuaccacaaugauagucagaaa

SEQ ID NO: 808209 - RNA, 19 nt, Human
cccugaggacaaccugggg

SEQ ID NO: 808210 - RNA, 20 nt, Human
cccugaggacaaccuggggc

SEQ ID NO: 808211 - RNA, 18 nt, Human
ccgcuggcucccaccuuc

SEQ ID NO: 808212 - RNA, 22 nt, Human
ccuaggauugggacccugagga

SEQ ID NO: 808213 - RNA, 24 nt, Human
ccucaggugccuugugguugccaa

SEQ ID NO: 808214 - RNA, 20 nt, Human
ccugggaauaggggugcugg

SEQ ID NO: 808215 - RNA, 18 nt, Human
cucaagcuuucugaggcu

SEQ ID NO: 808216 - RNA, 18 nt, Human
cucccaccuucuggccug

SEQ ID NO: 808217 - RNA, 22 nt, Human
cuccugggaauaggggugcugg

SEQ ID NO: 808218 - RNA, 18 nt, Human
cucugaacugggccagac

SEQ ID NO: 808219 - RNA, 25 nt, Human
cugaggcugguugagagcacuccug

SEQ ID NO: 808220 - RNA, 22 nt, Human
cugccaccaucuuggccauuca

SEQ ID NO: 808221 - RNA, 21 nt, Human
cuggaaggcuuccuauagguu

SEQ ID NO: 808222 - RNA, 23 nt, Human
cuuccaugcacacccugcccuag

SEQ ID NO: 808223 - RNA, 20 nt, Human
gagagaauaaagagaggugg

SEQ ID NO: 808224 - RNA, 24 nt, Human
gagagaauaaagagaggugggggg

SEQ ID NO: 808225 - RNA, 22 nt, Human
gagagguggggggcugcugagc

SEQ ID NO: 808226 - RNA, 21 nt, Human
gagccugcagacuggagcuag

SEQ ID NO: 808227 - RNA, 18 nt, Human
gagcuugcggcccggcac

SEQ ID NO: 808228 - RNA, 18 nt, Human
gaucuccuuccuucaguu

SEQ ID NO: 808229 - RNA, 18 nt, Human
gauugggacccugaggac

SEQ ID NO: 808230 - RNA, 22 nt, Human
gcagcugagugagaaguguagc

SEQ ID NO: 808231 - RNA, 19 nt, Human
gccauucauggugauccag

SEQ ID NO: 808232 - RNA, 19 nt, Human
gccucaggugccuuguggu

SEQ ID NO: 808233 - RNA, 19 nt, Human
gcuaugacauccuuggccc

SEQ ID NO: 808234 - RNA, 23 nt, Human
gcucccacgaaagcccgccuugu

SEQ ID NO: 808235 - RNA, 25 nt, Human
gcuggagugaggaacuaggggcuca

SEQ ID NO: 808236 - RNA, 18 nt, Human
gcuggcagaugccaccag

SEQ ID NO: 808237 - RNA, 18 nt, Human
ggcaggcugagcacggcu

SEQ ID NO: 808238 - RNA, 22 nt, Human
ggcaugguuuuggcuucuggag

SEQ ID NO: 808239 - RNA, 18 nt, Human
ggggggcugcugagcugg

SEQ ID NO: 808240 - RNA, 24 nt, Human
gggugcugggucuuaacacgguuc

SEQ ID NO: 808241 - RNA, 23 nt, Human
ggucugggucaucugugugguca

SEQ ID NO: 808242 - RNA, 21 nt, Human
gguggggggcugcugagcugg

SEQ ID NO: 808243 - RNA, 21 nt, Human
gguugcccugaucacagccga

SEQ ID NO: 808244 - RNA, 22 nt, Human
guggggggcugcugagcuggca

SEQ ID NO: 808245 - RNA, 19 nt, Human
uaaacccuggaggaacacg

SEQ ID NO: 808246 - RNA, 24 nt, Human
uaacggugagauaggaaaucucaa

SEQ ID NO: 808247 - RNA, 23 nt, Human
uaacugggcaccccugucaaguu

SEQ ID NO: 808248 - RNA, 19 nt, Human
uacacacaagaagccagaa

SEQ ID NO: 808249 - RNA, 22 nt, Human
uacagcagagacuucgcugcag

SEQ ID NO: 808250 - RNA, 19 nt, Human
uagcugaaaaaguggcuaa

SEQ ID NO: 808251 - RNA, 18 nt, Human
ucaaagcaaaacgggauc

SEQ ID NO: 808252 - RNA, 24 nt, Human
uccaacauuugcauugucucuaac

SEQ ID NO: 808253 - RNA, 29 nt, Human
uccauaguucuugcuuccauggguccucc

SEQ ID NO: 808254 - RNA, 18 nt, Human
uccaugcacacccugccc

SEQ ID NO: 808255 - RNA, 19 nt, Human
uccaugcacacccugcccu

SEQ ID NO: 808256 - RNA, 23 nt, Human
ucucuucaaagcaaaacgggauc

SEQ ID NO: 808257 - RNA, 20 nt, Human
ucugucccuguuagugcuuu

SEQ ID NO: 808258 - RNA, 22 nt, Human
ugaaacaccaagagccccacug

SEQ ID NO: 808259 - RNA, 26 nt, Human
ugaagaagugauagaguuucuuuucc

SEQ ID NO: 808260 - RNA, 22 nt, Human
ugaagcaaaccagcuucccguu

SEQ ID NO: 808261 - RNA, 21 nt, Human
ugagaaguguagggugcagcu

SEQ ID NO: 808262 - RNA, 24 nt, Human
ugagauaggaaaucucaaagggcc

SEQ ID NO: 808263 - RNA, 22 nt, Human
ugagcacggcucccacgaaagc

SEQ ID NO: 808264 - RNA, 20 nt, Human
ugagcugguucauucccugg

SEQ ID NO: 808265 - RNA, 20 nt, Human
ugaggaacuaggggcucaga

SEQ ID NO: 808266 - RNA, 19 nt, Human
ugaucucugcaacuuucuc

SEQ ID NO: 808267 - RNA, 21 nt, Human
ugcagugagggagccccgcug

SEQ ID NO: 808268 - RNA, 22 nt, Human
ugccacagucaccccguguguc

SEQ ID NO: 808269 - RNA, 19 nt, Human
ugccccgauucuacaaaug

SEQ ID NO: 808270 - RNA, 26 nt, Human
ugcccuaggauugggacccugaggac

SEQ ID NO: 808271 - RNA, 22 nt, Human
uggcugcagauggucaggccag

SEQ ID NO: 808272 - RNA, 18 nt, Human
ugggagugccauggccuc

SEQ ID NO: 808273 - RNA, 22 nt, Human
ugggagugccauggccucaggu

SEQ ID NO: 808274 - RNA, 19 nt, Human
ugggucugggucaucugug

SEQ ID NO: 808275 - RNA, 20 nt, Human
ugguaugaagcaaaccagcu

SEQ ID NO: 808276 - RNA, 20 nt, Human
uguagggcuuggcuuccugg

SEQ ID NO: 808277 - RNA, 22 nt, Human
ugugcaggaugcggaucaaagg

SEQ ID NO: 808278 - RNA, 20 nt, Human
ugugcagugagggagccccg

SEQ ID NO: 808279 - RNA, 18 nt, Human
uguggcaaauacccacca

SEQ ID NO: 808280 - RNA, 19 nt, Human
uguggcaaauacccaccac

SEQ ID NO: 808281 - RNA, 20 nt, Human
uuagaggggcgcgggcggcg

SEQ ID NO: 808282 - RNA, 19 nt, Human
uuccagcucacacuggaag

SEQ ID NO: 808283 - RNA, 21 nt, Human
uuggcuucuggaggcuguuuu

SEQ ID NO: 808284 - RNA, 25 nt, Human
aaaaaaaagaaaauuugcuugacaa

SEQ ID NO: 808285 - RNA, 26 nt, Human
aaaauaaauaaauaauaagcugagca

SEQ ID NO: 808286 - RNA, 23 nt, Human
aaauccagaaggaagcucagccc

SEQ ID NO: 808287 - RNA, 21 nt, Human
aacauagcaagaccccauguc

SEQ ID NO: 808288 - RNA, 19 nt, Human
aagccagaguccaggagaa

SEQ ID NO: 808289 - RNA, 23 nt, Human
acaacuucaucccucagacagag

SEQ ID NO: 808290 - RNA, 20 nt, Human
acaaggaagcacucccgaau

SEQ ID NO: 808291 - RNA, 20 nt, Human
acaaugagagccuggaggga

SEQ ID NO: 808292 - RNA, 21 nt, Human
acagacugcuccuccuggggc

SEQ ID NO: 808293 - RNA, 21 nt, Human
accagagugagacccugucuc

SEQ ID NO: 808294 - RNA, 22 nt, Human
accugugcccgcuuugcccccc

SEQ ID NO: 808295 - RNA, 24 nt, Human
acuccagccuggacaccagaguga

SEQ ID NO: 808296 - RNA, 23 nt, Human
acugaccagagcucccagcuacc

SEQ ID NO: 808297 - RNA, 24 nt, Human
acugcacuccagccuggacaccag

SEQ ID NO: 808298 - RNA, 26 nt, Human
acugcacuccagccuggacaccagag

SEQ ID NO: 808299 - RNA, 18 nt, Human
agaaccccaaugguacug

SEQ ID NO: 808300 - RNA, 21 nt, Human
agaagucacccuggcgcaaua

SEQ ID NO: 808301 - RNA, 18 nt, Human
agagccuggagggaugga

SEQ ID NO: 808302 - RNA, 19 nt, Human
agcacuuugggaggcugag

SEQ ID NO: 808303 - RNA, 19 nt, Human
agccugggcaauguaguga

SEQ ID NO: 808304 - RNA, 20 nt, Human
agccugggcaauguagugag

SEQ ID NO: 808305 - RNA, 23 nt, Human
agccugggcaauguagugaggcc

SEQ ID NO: 808306 - RNA, 24 nt, Human
agcuacuuaggaggcugagguggg

SEQ ID NO: 808307 - RNA, 18 nt, Human
agcugagcaugguggugc

SEQ ID NO: 808308 - RNA, 20 nt, Human
aggaguuugagaccagccug

SEQ ID NO: 808309 - RNA, 24 nt, Human
aggaucacuugagcccaggaguuu

SEQ ID NO: 808310 - RNA, 20 nt, Human
aggcaacaggcauggaugga

SEQ ID NO: 808311 - RNA, 18 nt, Human
aggcaagaggaucacuug

SEQ ID NO: 808312 - RNA, 24 nt, Human
aggcaagaggaucacuugagccca

SEQ ID NO: 808313 - RNA, 19 nt, Human
aggcagggaggggaaugca

SEQ ID NO: 808314 - RNA, 18 nt, Human
aggcccgccagggcaugc

SEQ ID NO: 808315 - RNA, 24 nt, Human
aggcugaggugggaggauugguug

SEQ ID NO: 808316 - RNA, 21 nt, Human
agggaccucuaaggcggagag

SEQ ID NO: 808317 - RNA, 18 nt, Human
agggaggcuuggugggga

SEQ ID NO: 808318 - RNA, 23 nt, Human
aggggauagggcaggcccgggga

SEQ ID NO: 808319 - RNA, 23 nt, Human
aggggauagggcaggcccggggc

SEQ ID NO: 808320 - RNA, 26 nt, Human
aggggaugcagugaggggagagauug

SEQ ID NO: 808321 - RNA, 20 nt, Human
aggggccacucuggccagua

SEQ ID NO: 808322 - RNA, 23 nt, Human
aggugggaggauugguugaaccc

SEQ ID NO: 808323 - RNA, 18 nt, Human
aguagggagcacaggcug

SEQ ID NO: 808324 - RNA, 24 nt, Human
aguccagaggaucacuugagcuug

SEQ ID NO: 808325 - RNA, 24 nt, Human
aguggcucauacguauaaucccag

SEQ ID NO: 808326 - RNA, 22 nt, Human
auagcaagaccccaugucuaca

SEQ ID NO: 808327 - RNA, 19 nt, Human
augcagugaggggagagau

SEQ ID NO: 808328 - RNA, 18 nt, Human
auggaggguaccauggug

SEQ ID NO: 808329 - RNA, 24 nt, Human
auugcaccacugcacuccagccug

SEQ ID NO: 808330 - RNA, 18 nt, Human
caaccaccaggacccagc

SEQ ID NO: 808331 - RNA, 20 nt, Human
caagagucuauuuuaauguc

SEQ ID NO: 808332 - RNA, 22 nt, Human
caaggcaagaggaucacuugag

SEQ ID NO: 808333 - RNA, 24 nt, Human
caaggcaagaggaucacuugagcc

SEQ ID NO: 808334 - RNA, 21 nt, Human
caagguuccacaggguuccuu

SEQ ID NO: 808335 - RNA, 24 nt, Human
caccagagugagacccugucucuu

SEQ ID NO: 808336 - RNA, 23 nt, Human
cacuccagagaggcgcuggcagg

SEQ ID NO: 808337 - RNA, 22 nt, Human
cacuccagccuggacaccagag

SEQ ID NO: 808338 - RNA, 23 nt, Human
cacuccagccuggacaccagagu

SEQ ID NO: 808339 - RNA, 24 nt, Human
cacuccagccuggacaccagagug

SEQ ID NO: 808340 - RNA, 18 nt, Human
cacugcacuccagccugg

SEQ ID NO: 808341 - RNA, 19 nt, Human
cacugcacuccagccugga

SEQ ID NO: 808342 - RNA, 21 nt, Human
cacugcacuccagccuggaca

SEQ ID NO: 808343 - RNA, 19 nt, Human
cagaaccccaaugguacug

SEQ ID NO: 808344 - RNA, 20 nt, Human
cagaaggaagcucagcccau

SEQ ID NO: 808345 - RNA, 21 nt, Human
cagagcucccagcuaccccuc

SEQ ID NO: 808346 - RNA, 22 nt, Human
cagcaccaaacacacugauccc

SEQ ID NO: 808347 - RNA, 20 nt, Human
cagcacuuuggcaggccaag

SEQ ID NO: 808348 - RNA, 21 nt, Human
cagcacuuuggcaggccaagg

SEQ ID NO: 808349 - RNA, 18 nt, Human
cagcacuuugggaggcug

SEQ ID NO: 808350 - RNA, 25 nt, Human
cagcacuuugggaggcugaguccag

SEQ ID NO: 808351 - RNA, 22 nt, Human
cagcagaggcagaauguaaaac

SEQ ID NO: 808352 - RNA, 22 nt, Human
cagcccaucccccuggaagcca

SEQ ID NO: 808353 - RNA, 23 nt, Human
cagcuacaguugccaacauggaa

SEQ ID NO: 808354 - RNA, 24 nt, Human
cagcuacuuaggaggcugaggugg

SEQ ID NO: 808355 - RNA, 21 nt, Human
cagcugcccacagaaccccaa

SEQ ID NO: 808356 - RNA, 20 nt, Human
caggaauuuaaggcuaugau

SEQ ID NO: 808357 - RNA, 19 nt, Human
caggcccuagaccacaccu

SEQ ID NO: 808358 - RNA, 20 nt, Human
caggggcaggucgacaguuc

SEQ ID NO: 808359 - RNA, 19 nt, Human
caggggccacucuggccag

SEQ ID NO: 808360 - RNA, 24 nt, Human
cauaaaauacaaugaaguuuuaaa

SEQ ID NO: 808361 - RNA, 22 nt, Human
cauacguauaaucccagcacuu

SEQ ID NO: 808362 - RNA, 24 nt, Human
cauacguauaaucccagcacuuug

SEQ ID NO: 808363 - RNA, 25 nt, Human
cauagcaagaccccaugucuacaaa

SEQ ID NO: 808364 - RNA, 25 nt, Human
caucuaagauccgacagauaggccc

SEQ ID NO: 808365 - RNA, 24 nt, Human
caucucaggguccauuuuccugga

SEQ ID NO: 808366 - RNA, 21 nt, Human
cauggauggagaugggcugaa

SEQ ID NO: 808367 - RNA, 24 nt, Human
cauggauggagaugggcugaucaa

SEQ ID NO: 808368 - RNA, 22 nt, Human
ccaccugccagcaccaagaguc

SEQ ID NO: 808369 - RNA, 19 nt, Human
ccacugcacuccagccugg

SEQ ID NO: 808370 - RNA, 19 nt, Human
ccacugcacuccagccugg

SEQ ID NO: 808371 - RNA, 20 nt, Human
ccacugcacuccagccugga

SEQ ID NO: 808372 - RNA, 21 nt, Human
ccacugcacuccagccuggac

SEQ ID NO: 808373 - RNA, 22 nt, Human
ccacugcacuccagccuggaca

SEQ ID NO: 808374 - RNA, 25 nt, Human
ccacugcacuccagccuggacacca

SEQ ID NO: 808375 - RNA, 24 nt, Human
ccagcuaccccuccagcugggccc

SEQ ID NO: 808376 - RNA, 22 nt, Human
ccagcugcccacagaaccccaa

SEQ ID NO: 808377 - RNA, 24 nt, Human
cccaaccaccaggacccagcugcc

SEQ ID NO: 808378 - RNA, 24 nt, Human
cccacagaaccccaaugguacugg

SEQ ID NO: 808379 - RNA, 19 nt, Human
cccacgguccccaaccacc

SEQ ID NO: 808380 - RNA, 22 nt, Human
ccccaaugguacugggccacag

SEQ ID NO: 808381 - RNA, 20 nt, Human
ccccagccccggguguuccc

SEQ ID NO: 808382 - RNA, 19 nt, Human
cccgcuuugccccccuucc

SEQ ID NO: 808383 - RNA, 20 nt, Human
cccgcuuugccccccuuccu

SEQ ID NO: 808384 - RNA, 20 nt, Human
cccugguucugacgcccacu

SEQ ID NO: 808385 - RNA, 19 nt, Human
ccuagaccacaccugggga

SEQ ID NO: 808386 - RNA, 21 nt, Human
ccuccagcugggcccuggccc

SEQ ID NO: 808387 - RNA, 21 nt, Human
ccuccugugccuggcccaggc

SEQ ID NO: 808388 - RNA, 21 nt, Human
ccuggagccaggggauagggc

SEQ ID NO: 808389 - RNA, 18 nt, Human
ccuggaggcuggugcgac

SEQ ID NO: 808390 - RNA, 21 nt, Human
ccuggcccaggccugccucuc

SEQ ID NO: 808391 - RNA, 24 nt, Human
ccugggcaacauagcaagacccca

SEQ ID NO: 808392 - RNA, 19 nt, Human
ccugucuggauggaaggca

SEQ ID NO: 808393 - RNA, 29 nt, Human
cgacagauaggccccuucccacggucccc

SEQ ID NO: 808394 - RNA, 19 nt, Human
cgacaguucucauccuccc

SEQ ID NO: 808395 - RNA, 22 nt, Human
cgagcgagaccucuggaggggu

SEQ ID NO: 808396 - RNA, 20 nt, Human
cuagcccuggagccagggga

SEQ ID NO: 808397 - RNA, 19 nt, Human
cucaggccccagccccggg

SEQ ID NO: 808398 - RNA, 20 nt, Human
cuccagcugggcccuggccc

SEQ ID NO: 808399 - RNA, 18 nt, Human
cuccuccuggggcuccac

SEQ ID NO: 808400 - RNA, 31 nt, Human
cugccagcggcgggcggcgcggcuccucucu

SEQ ID NO: 808401 - RNA, 20 nt, Human
cugggguaggauucccuagg

SEQ ID NO: 808402 - RNA, 21 nt, Human
cuguagucccagcuacuuagg

SEQ ID NO: 808403 - RNA, 19 nt, Human
cuugagaaugaagguccca

SEQ ID NO: 808404 - RNA, 26 nt, Human
cuuggcuacaaacgcagauuccagcc

SEQ ID NO: 808405 - RNA, 21 nt, Human
cuuucagagaucuccagaaag

SEQ ID NO: 808406 - RNA, 22 nt, Human
cuuucuggagccaggaaaauuc

SEQ ID NO: 808407 - RNA, 23 nt, Human
cuuugggccugucuggauggaag

SEQ ID NO: 808408 - RNA, 20 nt, Human
gaaauuuguaugaggguggg

SEQ ID NO: 808409 - RNA, 22 nt, Human
gacaaggacaagguuccacagg

SEQ ID NO: 808410 - RNA, 21 nt, Human
gacaagguuccacaggguucc

SEQ ID NO: 808411 - RNA, 22 nt, Human
gacaccagagugagacccuguc

SEQ ID NO: 808412 - RNA, 25 nt, Human
gaccucuggaggggucugugccgac

SEQ ID NO: 808413 - RNA, 18 nt, Human
gagcgagaccucuggagg

SEQ ID NO: 808414 - RNA, 19 nt, Human
gagcucccagcuaccccuc

SEQ ID NO: 808415 - RNA, 21 nt, Human
gagcucccagcuaccccuccg

SEQ ID NO: 808416 - RNA, 24 nt, Human
gaucacuugagcccaggaguuuga

SEQ ID NO: 808417 - RNA, 24 nt, Human
gcacuccagccuggacaccagagu

SEQ ID NO: 808418 - RNA, 20 nt, Human
gcagagguaaggcaaacacu

SEQ ID NO: 808419 - RNA, 22 nt, Human
gcccaggaguuugagaccagcc

SEQ ID NO: 808420 - RNA, 24 nt, Human
gccccacagccucuuucuggagcc

SEQ ID NO: 808421 - RNA, 21 nt, Human
gcuccaggaggcaauucucuu

SEQ ID NO: 808422 - RNA, 21 nt, Human
gcuguggccucgaaaggagga

SEQ ID NO: 808423 - RNA, 24 nt, Human
gcuuugccccccuuccuucuagca

SEQ ID NO: 808424 - RNA, 23 nt, Human
ggaggguaccauggugacgggcu

SEQ ID NO: 808425 - RNA, 19 nt, Human
ggaggugagagagaggagg

SEQ ID NO: 808426 - RNA, 20 nt, Human
ggaggugagagagaggaggg

SEQ ID NO: 808427 - RNA, 22 nt, Human
ggaucacuugagcccaggaguu

SEQ ID NO: 808428 - RNA, 18 nt, Human
ggcaugcuggauggcugu

SEQ ID NO: 808429 - RNA, 18 nt, Human
ggcccagugcuccuggag

SEQ ID NO: 808430 - RNA, 18 nt, Human
ggccucgaaaggaggaua

SEQ ID NO: 808431 - RNA, 18 nt, Human
gggacuccucccgcccaa

SEQ ID NO: 808432 - RNA, 18 nt, Human
gggacugaccagagcucc

SEQ ID NO: 808433 - RNA, 22 nt, Human
gggcccuggcccagugcuccug

SEQ ID NO: 808434 - RNA, 23 nt, Human
ggggguguucaaggauuccaugc

SEQ ID NO: 808435 - RNA, 19 nt, Human
gggguacaguucuuucugg

SEQ ID NO: 808436 - RNA, 18 nt, Human
gggguguucaaggauucc

SEQ ID NO: 808437 - RNA, 18 nt, Human
gguacugggccacagagg

SEQ ID NO: 808438 - RNA, 19 nt, Human
ggugagagagaggagggac

SEQ ID NO: 808439 - RNA, 21 nt, Human
ggugcuguggccucgaaagga

SEQ ID NO: 808440 - RNA, 22 nt, Human
gguggaggacucaggccccagc

SEQ ID NO: 808441 - RNA, 19 nt, Human
gguugaggggugccaagug

SEQ ID NO: 808442 - RNA, 20 nt, Human
gucgagggauggaggguacc

SEQ ID NO: 808443 - RNA, 22 nt, Human
gucgagggauggaggguaccau

SEQ ID NO: 808444 - RNA, 24 nt, Human
guggcucauacguauaaucccagc

SEQ ID NO: 808445 - RNA, 22 nt, Human
uaaauccucaucucagggucca

SEQ ID NO: 808446 - RNA, 23 nt, Human
uaagagaggguugaggggugcca

SEQ ID NO: 808447 - RNA, 19 nt, Human
uagcaagaccccaugucua

SEQ ID NO: 808448 - RNA, 19 nt, Human
uagcaguagcuguggucuc

SEQ ID NO: 808449 - RNA, 22 nt, Human
uaggaggcugaggugggaggau

SEQ ID NO: 808450 - RNA, 24 nt, Human
uaggaggcugaggugggaggauug

SEQ ID NO: 808451 - RNA, 19 nt, Human
ucacuugagcccaggaguu

SEQ ID NO: 808452 - RNA, 18 nt, Human
ucaggccccagccccggg

SEQ ID NO: 808453 - RNA, 18 nt, Human
ucaggggguguucaagga

SEQ ID NO: 808454 - RNA, 23 nt, Human
uccagccuggacaccagagugag

SEQ ID NO: 808455 - RNA, 24 nt, Human
uccagccuggacaccagagugaga

SEQ ID NO: 808456 - RNA, 18 nt, Human
uccaucccagcaccccag

SEQ ID NO: 808457 - RNA, 22 nt, Human
uccccaggggaugcagugaggg

SEQ ID NO: 808458 - RNA, 20 nt, Human
ucccccagcagagguuccug

SEQ ID NO: 808459 - RNA, 19 nt, Human
ucccuucuuccccagggga

SEQ ID NO: 808460 - RNA, 22 nt, Human
uccugggcgcggggucuguggg

SEQ ID NO: 808461 - RNA, 19 nt, Human
ucgagggauggaggguacc

SEQ ID NO: 808462 - RNA, 19 nt, Human
ucucaggguccauuuuccu

SEQ ID NO: 808463 - RNA, 24 nt, Human
ucucugguggggucggggggggug

SEQ ID NO: 808464 - RNA, 22 nt, Human
ucugaggcaggcaggcccuaga

SEQ ID NO: 808465 - RNA, 20 nt, Human
ucuggggacagagggaugca

SEQ ID NO: 808466 - RNA, 27 nt, Human
ucuuggcugagacagcuccugagaagc

SEQ ID NO: 808467 - RNA, 22 nt, Human
ucuuuauucccuuugcagauuc

SEQ ID NO: 808468 - RNA, 26 nt, Human
ugaagaggccuugugagacagggagc

SEQ ID NO: 808469 - RNA, 19 nt, Human
ugaagaucgggucuuccag

SEQ ID NO: 808470 - RNA, 19 nt, Human
ugaaggucccaugccugcu

SEQ ID NO: 808471 - RNA, 21 nt, Human
ugaccagagcucccagcuacc

SEQ ID NO: 808472 - RNA, 26 nt, Human
ugagacagggagcacagaagacaugu

SEQ ID NO: 808473 - RNA, 23 nt, Human
ugagcccaggaguuugagaccag

SEQ ID NO: 808474 - RNA, 18 nt, Human
ugaggugggaggauuggu

SEQ ID NO: 808475 - RNA, 20 nt, Human
ugaggugggaggauugguug

SEQ ID NO: 808476 - RNA, 18 nt, Human
ugaguagggagcacaggc

SEQ ID NO: 808477 - RNA, 21 nt, Human
ugcaccacugcacuccagccu

SEQ ID NO: 808478 - RNA, 23 nt, Human
ugcagacagacugcuccuccugg

SEQ ID NO: 808479 - RNA, 21 nt, Human
ugcagagguaaggcaaacacu

SEQ ID NO: 808480 - RNA, 25 nt, Human
uggaauccaagacaaggaagcacuc

SEQ ID NO: 808481 - RNA, 22 nt, Human
uggaggcuggugcgacugaagg

SEQ ID NO: 808482 - RNA, 19 nt, Human
uggagguagaagucacccu

SEQ ID NO: 808483 - RNA, 22 nt, Human
uggcaggccaaggcaagaggau

SEQ ID NO: 808484 - RNA, 24 nt, Human
uggcaggccaaggcaagaggauca

SEQ ID NO: 808485 - RNA, 23 nt, Human
uggcaggggccacucuggccagu

SEQ ID NO: 808486 - RNA, 23 nt, Human
uggccagcccucguguaagaaga

SEQ ID NO: 808487 - RNA, 24 nt, Human
uggcuggaugcuguugcuauggca

SEQ ID NO: 808488 - RNA, 20 nt, Human
uggcugugucgagggaugga

SEQ ID NO: 808489 - RNA, 24 nt, Human
ugggaggcugaguccagaggauca

SEQ ID NO: 808490 - RNA, 22 nt, Human
ugggcaacauagcaagacccca

SEQ ID NO: 808491 - RNA, 24 nt, Human
ugggccacagaggcugggcauaga

SEQ ID NO: 808492 - RNA, 20 nt, Human
uggggacagagggaugcaca

SEQ ID NO: 808493 - RNA, 23 nt, Human
uggggaggugagagagaggaggg

SEQ ID NO: 808494 - RNA, 21 nt, Human
ugggggaccugugccccacag

SEQ ID NO: 808495 - RNA, 21 nt, Human
uggggucggggggggugggcg

SEQ ID NO: 808496 - RNA, 21 nt, Human
ugggugaagaucgggucuucc

SEQ ID NO: 808497 - RNA, 19 nt, Human
ugggugcuguggccucgaa

SEQ ID NO: 808498 - RNA, 24 nt, Human
ugguacccacuggcuggaugcugu

SEQ ID NO: 808499 - RNA, 20 nt, Human
ugguacugggccacagaggc

SEQ ID NO: 808500 - RNA, 18 nt, Human
uggugcauaacuguaguc

SEQ ID NO: 808501 - RNA, 25 nt, Human
ugguggggaggugagagagaggagg

SEQ ID NO: 808502 - RNA, 18 nt, Human
ugguggggucgggggggg

SEQ ID NO: 808503 - RNA, 20 nt, Human
ugguggggucggggggggug

SEQ ID NO: 808504 - RNA, 24 nt, Human
ugguggugcauaacuguaguccca

SEQ ID NO: 808505 - RNA, 23 nt, Human
uguagugaggccccaucucuaaa

SEQ ID NO: 808506 - RNA, 23 nt, Human
uguucaaggauuccaugcugucu

SEQ ID NO: 808507 - RNA, 19 nt, Human
uucacagccucauuguggg

SEQ ID NO: 808508 - RNA, 19 nt, Human
uuccuggaauccaagacaa

SEQ ID NO: 808509 - RNA, 19 nt, Human
uuccuggaucagcaccaaa

SEQ ID NO: 808510 - RNA, 22 nt, Human
uugagcccaggaguuugagacc

SEQ ID NO: 808511 - RNA, 18 nt, Human
uugagcuugagaucagcc

SEQ ID NO: 808512 - RNA, 23 nt, Human
uugcaccacugcacuccagccug

SEQ ID NO: 808513 - RNA, 25 nt, Human
uugggaggcugaguccagaggauca

SEQ ID NO: 808514 - RNA, 18 nt, Human
uuuccaucccagcacccc

SEQ ID NO: 808515 - RNA, 19 nt, Human
aagggcuacaucugcaagg

SEQ ID NO: 808516 - RNA, 18 nt, Human
acccucacguggcagggc

SEQ ID NO: 808517 - RNA, 19 nt, Human
agaggguuaggagggagag

SEQ ID NO: 808518 - RNA, 23 nt, Human
aggaggaucaaugugugugucug

SEQ ID NO: 808519 - RNA, 21 nt, Human
aggcaggacucugcuggaagu

SEQ ID NO: 808520 - RNA, 18 nt, Human
aggcccuccccucucccc

SEQ ID NO: 808521 - RNA, 20 nt, Human
aggugggcggggccaggggg

SEQ ID NO: 808522 - RNA, 18 nt, Human
agugaggaaaaggaagau

SEQ ID NO: 808523 - RNA, 22 nt, Human
cagggcuaggacaaggggcagg

SEQ ID NO: 808524 - RNA, 27 nt, Human
cccugaggcccuccccucuccccaucu

SEQ ID NO: 808525 - RNA, 21 nt, Human
ccucugguguccguuucucuc

SEQ ID NO: 808526 - RNA, 19 nt, Human
ccuucccccuucuuugccu

SEQ ID NO: 808527 - RNA, 19 nt, Human
ccuucuuugccuugggcuu

SEQ ID NO: 808528 - RNA, 18 nt, Human
cugagaggaucucugugu

SEQ ID NO: 808529 - RNA, 18 nt, Human
cuuugccuugggcuuucu

SEQ ID NO: 808530 - RNA, 19 nt, Human
cuuugggagccaacugagc

SEQ ID NO: 808531 - RNA, 23 nt, Human
gaaaaggaagauagaaccaagga

SEQ ID NO: 808532 - RNA, 21 nt, Human
gagccaacugagcauuuggaa

SEQ ID NO: 808533 - RNA, 22 nt, Human
gagccaacugagcauuuggaaa

SEQ ID NO: 808534 - RNA, 24 nt, Human
gagcucccaccgaacaccccuugg

SEQ ID NO: 808535 - RNA, 22 nt, Human
gaggugggcggggccagggggu

SEQ ID NO: 808536 - RNA, 20 nt, Human
gcauuuauggggauggggag

SEQ ID NO: 808537 - RNA, 27 nt, Human
gcccugaggcccuccccucuccccauc

SEQ ID NO: 808538 - RNA, 18 nt, Human
ggagaagagagaguggcg

SEQ ID NO: 808539 - RNA, 19 nt, Human
ggagauggggcuggagaag

SEQ ID NO: 808540 - RNA, 20 nt, Human
ggagauggggcuggagaagg

SEQ ID NO: 808541 - RNA, 19 nt, Human
ggagccaacugagcauuug

SEQ ID NO: 808542 - RNA, 22 nt, Human
ggauugggaggaggcaggacuc

SEQ ID NO: 808543 - RNA, 23 nt, Human
ggcaaggagaggguuaggaggga

SEQ ID NO: 808544 - RNA, 18 nt, Human
ggcggggccagggggugg

SEQ ID NO: 808545 - RNA, 20 nt, Human
ggcuggagaaggggguuggc

SEQ ID NO: 808546 - RNA, 24 nt, Human
ggguaaaagagggagcccugaggc

SEQ ID NO: 808547 - RNA, 22 nt, Human
gguguaugugucugugaagaug

SEQ ID NO: 808548 - RNA, 22 nt, Human
guggcagggcuaggacaagggg

SEQ ID NO: 808549 - RNA, 24 nt, Human
gugggcggggccaggggguggggu

SEQ ID NO: 808550 - RNA, 24 nt, Human
gugguaggcagacauguaugaaua

SEQ ID NO: 808551 - RNA, 21 nt, Human
gugugugcauguauguguaug

SEQ ID NO: 808552 - RNA, 21 nt, Human
gugugugugugcauguaugug

SEQ ID NO: 808553 - RNA, 21 nt, Human
guuuuuuuuuuugaaagaacu

SEQ ID NO: 808554 - RNA, 23 nt, Human
uaaaagagggagcccugaggccc

SEQ ID NO: 808555 - RNA, 24 nt, Human
uaacgugugugugugcauguaugu

SEQ ID NO: 808556 - RNA, 19 nt, Human
ucaaugugugugucugugg

SEQ ID NO: 808557 - RNA, 18 nt, Human
ucccaugccagccuccag

SEQ ID NO: 808558 - RNA, 20 nt, Human
ucccccuucuuugccuuggg

SEQ ID NO: 808559 - RNA, 21 nt, Human
ucugguguccguuucucucuu

SEQ ID NO: 808560 - RNA, 22 nt, Human
ucuugcuuuuuugguuguguuu

SEQ ID NO: 808561 - RNA, 19 nt, Human
ugaaagaacuuuggauuug

SEQ ID NO: 808562 - RNA, 20 nt, Human
ugaggugggcggggccaggg

SEQ ID NO: 808563 - RNA, 23 nt, Human
ugaggugggcggggccagggggu

SEQ ID NO: 808564 - RNA, 18 nt, Human
ugcaaggagcugaggagg

SEQ ID NO: 808565 - RNA, 24 nt, Human
ugcauuuauggggauggggagcug

SEQ ID NO: 808566 - RNA, 24 nt, Human
ugccugucccuggaggcuggaccc

SEQ ID NO: 808567 - RNA, 23 nt, Human
ugcuggaagugggguguguggug

SEQ ID NO: 808568 - RNA, 19 nt, Human
uggaaagaguuugugagcg

SEQ ID NO: 808569 - RNA, 22 nt, Human
uggaaagaguuugugagcggug

SEQ ID NO: 808570 - RNA, 18 nt, Human
uggaaguggggugugugg

SEQ ID NO: 808571 - RNA, 24 nt, Human
uggagauggggcuggagaaggggg

SEQ ID NO: 808572 - RNA, 19 nt, Human
uggcagagggguuucuggu

SEQ ID NO: 808573 - RNA, 23 nt, Human
ugggaggaggcaggacucugcug

SEQ ID NO: 808574 - RNA, 26 nt, Human
ugggaggaggcaggacucugcuggaa

SEQ ID NO: 808575 - RNA, 20 nt, Human
ugggcggggccagggggugg

SEQ ID NO: 808576 - RNA, 23 nt, Human
ugggcggggccaggggguggggu

SEQ ID NO: 808577 - RNA, 24 nt, Human
ugggcucccugcccaugccaggcu

SEQ ID NO: 808578 - RNA, 18 nt, Human
ugggguaaaagagggagc

SEQ ID NO: 808579 - RNA, 24 nt, Human
ugggguguguggugcccacugagg

SEQ ID NO: 808580 - RNA, 19 nt, Human
ugguuagaguuuugugggc

SEQ ID NO: 808581 - RNA, 24 nt, Human
ugguuguguuucaguuuuuuuuuu

SEQ ID NO: 808582 - RNA, 20 nt, Human
uguggggauugggaggaggc

SEQ ID NO: 808583 - RNA, 18 nt, Human
ugugucugugaagauggg

SEQ ID NO: 808584 - RNA, 19 nt, Human
ugugugcauguauguguau

SEQ ID NO: 808585 - RNA, 19 nt, Human
ugugugcauguauguguau

SEQ ID NO: 808586 - RNA, 22 nt, Human
ugugugcauguauguguaugca

SEQ ID NO: 808587 - RNA, 22 nt, Human
ugugugguaggcagacauguau

SEQ ID NO: 808588 - RNA, 18 nt, Human
uguuuucucaguggaaca

SEQ ID NO: 808589 - RNA, 22 nt, Human
uuaguucauuccucuggugucc

SEQ ID NO: 808590 - RNA, 24 nt, Human
uuaguucauuccucugguguccgu

SEQ ID NO: 808591 - RNA, 23 nt, Human
uuccuucccccuucuuugccuug

SEQ ID NO: 808592 - RNA, 18 nt, Human
uucucccaugccagccuc

SEQ ID NO: 808593 - RNA, 21 nt, Human
uugccuugggcuuucuuuuuc

SEQ ID NO: 808594 - RNA, 21 nt, Human
uuucugguggcggcauccccu

SEQ ID NO: 808595 - RNA, 25 nt, Human
aaacaagaaaaauauuguaagucua

SEQ ID NO: 808596 - RNA, 26 nt, Human
aaacaagaaaaauauuguaagucuag

SEQ ID NO: 808597 - RNA, 20 nt, Human
aaauagcuugcccaaauucu

SEQ ID NO: 808598 - RNA, 19 nt, Human
aacucaucucuucacucca

SEQ ID NO: 808599 - RNA, 22 nt, Human
aagcauuauaaaagaagggguc

SEQ ID NO: 808600 - RNA, 19 nt, Human
aaggggucauaaugaguga

SEQ ID NO: 808601 - RNA, 27 nt, Human
aauaacuguaaaggcuuuggaauguua

SEQ ID NO: 808602 - RNA, 19 nt, Human
acaaacaagaaaccgcuca

SEQ ID NO: 808603 - RNA, 24 nt, Human
acaaccugagccucaguuuucuua

SEQ ID NO: 808604 - RNA, 18 nt, Human
acacacaaugucacgggc

SEQ ID NO: 808605 - RNA, 22 nt, Human
acuacuauuacaauauuuaauc

SEQ ID NO: 808606 - RNA, 18 nt, Human
agaaugaaaucuuuccua

SEQ ID NO: 808607 - RNA, 18 nt, Human
aggaacacaaacuacagc

SEQ ID NO: 808608 - RNA, 23 nt, Human
aggaacacaaacuacagcauaca

SEQ ID NO: 808609 - RNA, 26 nt, Human
aggcaggcaagugacagugggcauuu

SEQ ID NO: 808610 - RNA, 22 nt, Human
auguggagauggcuacauauac

SEQ ID NO: 808611 - RNA, 23 nt, Human
caaaaacaaaccauguuauugca

SEQ ID NO: 808612 - RNA, 23 nt, Human
cacccaggaacacacaaugucac

SEQ ID NO: 808613 - RNA, 20 nt, Human
cagcuaacagagcauaugua

SEQ ID NO: 808614 - RNA, 19 nt, Human
cagugggcauuucuaacuc

SEQ ID NO: 808615 - RNA, 21 nt, Human
ccuguccucccuuguugaaag

SEQ ID NO: 808616 - RNA, 23 nt, Human
cuugcccaaauucuugcagcuaa

SEQ ID NO: 808617 - RNA, 18 nt, Human
cuuuuuggcuacauaagu

SEQ ID NO: 808618 - RNA, 19 nt, Human
gaaaaagucccuguccucc

SEQ ID NO: 808619 - RNA, 20 nt, Human
gaacucaucucuucacucca

SEQ ID NO: 808620 - RNA, 21 nt, Human
gggucauaaugagugaugugg

SEQ ID NO: 808621 - RNA, 20 nt, Human
guagauacuaaauaugugcu

SEQ ID NO: 808622 - RNA, 18 nt, Human
uaaacagaacucaucucu

SEQ ID NO: 808623 - RNA, 22 nt, Human
uaaccaaacagcacguagauac

SEQ ID NO: 808624 - RNA, 23 nt, Human
uaaugagugauguggagauggcu

SEQ ID NO: 808625 - RNA, 18 nt, Human
uaguuccaggaacacaaa

SEQ ID NO: 808626 - RNA, 21 nt, Human
uauaaaagaaggggucauaau

SEQ ID NO: 808627 - RNA, 22 nt, Human
uauaaaagaaggggucauaaug

SEQ ID NO: 808628 - RNA, 24 nt, Human
uauaacuuuauuuucuucuuugug

SEQ ID NO: 808629 - RNA, 21 nt, Human
uauaguacagaaacaagaaaa

SEQ ID NO: 808630 - RNA, 19 nt, Human
uaucuuacagcuguaggaa

SEQ ID NO: 808631 - RNA, 21 nt, Human
uauucauucuagaaugaaauc

SEQ ID NO: 808632 - RNA, 23 nt, Human
ucaaggcaggcaagugacagugg

SEQ ID NO: 808633 - RNA, 26 nt, Human
uccacagucuauugcauuuugcgugc

SEQ ID NO: 808634 - RNA, 23 nt, Human
ucuauucauucuagaaugaaauc

SEQ ID NO: 808635 - RNA, 21 nt, Human
ucuccccuaaacagaacucau

SEQ ID NO: 808636 - RNA, 21 nt, Human
ugucacgggcaucugcuguag

SEQ ID NO: 808637 - RNA, 25 nt, Human
uuaauggaucuccccuaaacagaac

SEQ ID NO: 808638 - RNA, 20 nt, Human
uucaaagucauagcaguuac

SEQ ID NO: 808639 - RNA, 22 nt, Human
uucuucaucaucacaauaagau

SEQ ID NO: 808640 - RNA, 20 nt, Human
uuugaaaugucucacaaaac

SEQ ID NO: 808641 - RNA, 22 nt, Human
aaaaugaacacgucccucuucc

SEQ ID NO: 808642 - RNA, 19 nt, Human
aaaauucucuuuuggauuu

SEQ ID NO: 808643 - RNA, 22 nt, Human
aacacggucacagccugagcgc

SEQ ID NO: 808644 - RNA, 20 nt, Human
aacaguucagccaacccccc

SEQ ID NO: 808645 - RNA, 23 nt, Human
aacugaauccagcuuccagccuc

SEQ ID NO: 808646 - RNA, 20 nt, Human
aacuucgcugcagcucuugg

SEQ ID NO: 808647 - RNA, 18 nt, Human
aacuucuauccuuuucuc

SEQ ID NO: 808648 - RNA, 20 nt, Human
aacuucuucccuugguucuc

SEQ ID NO: 808649 - RNA, 22 nt, Human
aagauuagugcauccuaaauaa

SEQ ID NO: 808650 - RNA, 23 nt, Human
aagcaguauaacgguauugcagg

SEQ ID NO: 808651 - RNA, 22 nt, Human
aaucucacagggggaguuuaga

SEQ ID NO: 808652 - RNA, 28 nt, Human
acacgccuccgcccagauggcuccaaaa

SEQ ID NO: 808653 - RNA, 18 nt, Human
acagaaagaccacaaugc

SEQ ID NO: 808654 - RNA, 28 nt, Human
accccaacuucuucccuugguucuccaa

SEQ ID NO: 808655 - RNA, 19 nt, Human
acuacagcuuuuagcaacu

SEQ ID NO: 808656 - RNA, 25 nt, Human
acugaaaugcaagagaccaagauua

SEQ ID NO: 808657 - RNA, 21 nt, Human
agaaaaaaaaaccagaaaaau

SEQ ID NO: 808658 - RNA, 23 nt, Human
agaaugagucccauuacacugcc

SEQ ID NO: 808659 - RNA, 21 nt, Human
agacugaaaugcaagagacca

SEQ ID NO: 808660 - RNA, 25 nt, Human
agacugaaucuauacaagagaucca

SEQ ID NO: 808661 - RNA, 23 nt, Human
agagcacauuuuauuaacacaga

SEQ ID NO: 808662 - RNA, 18 nt, Human
agcaacuggaagaagacu

SEQ ID NO: 808663 - RNA, 20 nt, Human
agcaagaaugauucaauggu

SEQ ID NO: 808664 - RNA, 18 nt, Human
agcagaacugggggcugg

SEQ ID NO: 808665 - RNA, 18 nt, Human
agcagcaauguacgggaa

SEQ ID NO: 808666 - RNA, 19 nt, Human
agccugagcgccugacuuc

SEQ ID NO: 808667 - RNA, 20 nt, Human
aggaaggucaauuugggaaa

SEQ ID NO: 808668 - RNA, 19 nt, Human
aggagaaaaaaaaaccaga

SEQ ID NO: 808669 - RNA, 22 nt, Human
aggagaaauuauucaaagagaa

SEQ ID NO: 808670 - RNA, 19 nt, Human
agggcugaaagcugagagc

SEQ ID NO: 808671 - RNA, 22 nt, Human
aucaccagcacaaagaaguaau

SEQ ID NO: 808672 - RNA, 18 nt, Human
auucaagauguuuccacu

SEQ ID NO: 808673 - RNA, 19 nt, Human
caacugaauccagcuucca

SEQ ID NO: 808674 - RNA, 20 nt, Human
caaggagcuuauucccuuca

SEQ ID NO: 808675 - RNA, 30 nt, Human
cacacgccuccgcccagauggcuccaaaac

SEQ ID NO: 808676 - RNA, 18 nt, Human
cacugccugcugggcagc

SEQ ID NO: 808677 - RNA, 19 nt, Human
cagacugcaccaaaacuga

SEQ ID NO: 808678 - RNA, 21 nt, Human
cagcaauguacgggaaguucc

SEQ ID NO: 808679 - RNA, 23 nt, Human
cagcacaaagaaguaaucagaau

SEQ ID NO: 808680 - RNA, 20 nt, Human
cagcacagaaaucuggaaug

SEQ ID NO: 808681 - RNA, 25 nt, Human
cagcucacacagacucccagaauca

SEQ ID NO: 808682 - RNA, 24 nt, Human
caggagauaugccugaacccugaa

SEQ ID NO: 808683 - RNA, 22 nt, Human
cagggggaguuuagacccuggu

SEQ ID NO: 808684 - RNA, 27 nt, Human
cauccuaaauaaacaggucuugucaac

SEQ ID NO: 808685 - RNA, 23 nt, Human
cauuacacugccugcugggcagc

SEQ ID NO: 808686 - RNA, 18 nt, Human
ccaaaggagaagucccau

SEQ ID NO: 808687 - RNA, 23 nt, Human
ccaacucuaaaauccagauuagc

SEQ ID NO: 808688 - RNA, 24 nt, Human
ccagagccuccuuugugcuucuuc

SEQ ID NO: 808689 - RNA, 24 nt, Human
ccagcugguacuucuuugaugugg

SEQ ID NO: 808690 - RNA, 18 nt, Human
ccaguggaggguaauucc

SEQ ID NO: 808691 - RNA, 21 nt, Human
cccacagcgguggucuccuuu

SEQ ID NO: 808692 - RNA, 22 nt, Human
ccccaaggagcuuauucccuuc

SEQ ID NO: 808693 - RNA, 23 nt, Human
ccccaaggagcuuauucccuuca

SEQ ID NO: 808694 - RNA, 23 nt, Human
cccuugcaauccuucugucccuc

SEQ ID NO: 808695 - RNA, 25 nt, Human
cgugaaaaagccacacucuugacua

SEQ ID NO: 808696 - RNA, 22 nt, Human
cuccucaggggucugagucccu

SEQ ID NO: 808697 - RNA, 23 nt, Human
cuccucuccccauuuccaucucc

SEQ ID NO: 808698 - RNA, 22 nt, Human
cucggucuccccacagcggugg

SEQ ID NO: 808699 - RNA, 25 nt, Human
cucuccccauuuccaucuccagcaa

SEQ ID NO: 808700 - RNA, 23 nt, Human
cucuguccuugagcagaacuggg

SEQ ID NO: 808701 - RNA, 21 nt, Human
cugagagccaucauccagcag

SEQ ID NO: 808702 - RNA, 25 nt, Human
cugaugacaaugcuuaccccccaaa

SEQ ID NO: 808703 - RNA, 22 nt, Human
cuugcaauccuucugucccucc

SEQ ID NO: 808704 - RNA, 18 nt, Human
cuuguauuuucuggaaua

SEQ ID NO: 808705 - RNA, 21 nt, Human
gaagcaggauugggcaaggga

SEQ ID NO: 808706 - RNA, 20 nt, Human
gacauauauacccccauaaa

SEQ ID NO: 808707 - RNA, 25 nt, Human
gagccccaguguaauccauuuacug

SEQ ID NO: 808708 - RNA, 19 nt, Human
gagccuugcuaaacagccu

SEQ ID NO: 808709 - RNA, 25 nt, Human
gaggaccugaguggcauacuacagu

SEQ ID NO: 808710 - RNA, 26 nt, Human
gaggaccugaguggcauacuacagug

SEQ ID NO: 808711 - RNA, 21 nt, Human
ggcaagggagaaagugggcua

SEQ ID NO: 808712 - RNA, 20 nt, Human
ggcagcacccacuccucagg

SEQ ID NO: 808713 - RNA, 18 nt, Human
gggcagcacccacuccuc

SEQ ID NO: 808714 - RNA, 25 nt, Human
gggcugaaaagcaguauaacgguau

SEQ ID NO: 808715 - RNA, 18 nt, Human
gggggaguuuagacccug

SEQ ID NO: 808716 - RNA, 20 nt, Human
gguaagacugaaaugcaaga

SEQ ID NO: 808717 - RNA, 22 nt, Human
ggugucaacgguuugguuuccc

SEQ ID NO: 808718 - RNA, 26 nt, Human
gucuccccacagcgguggucuccuuu

SEQ ID NO: 808719 - RNA, 27 nt, Human
gugaaaaagccacacucuugacuagaa

SEQ ID NO: 808720 - RNA, 18 nt, Human
gugauuuuaauuugcauu

SEQ ID NO: 808721 - RNA, 19 nt, Human
uaaagcaccagcugguacu

SEQ ID NO: 808722 - RNA, 18 nt, Human
uaacacacgccuccgccc

SEQ ID NO: 808723 - RNA, 27 nt, Human
uaacacagaaagaccacaaugcaccuu

SEQ ID NO: 808724 - RNA, 24 nt, Human
uaagacugaaaugcaagagaccaa

SEQ ID NO: 808725 - RNA, 24 nt, Human
uacaaaggggaagcaaaacacauc

SEQ ID NO: 808726 - RNA, 30 nt, Human
uacccccauaaauccauuauuacauucaaa

SEQ ID NO: 808727 - RNA, 25 nt, Human
uaccccccaaaaauguauuaaaggc

SEQ ID NO: 808728 - RNA, 19 nt, Human
uagcaacugaauccagcuu

SEQ ID NO: 808729 - RNA, 23 nt, Human
uaggaaugugcuugaacccugaa

SEQ ID NO: 808730 - RNA, 21 nt, Human
uaguacagaauaaacuugguu

SEQ ID NO: 808731 - RNA, 25 nt, Human
uaguacagaauaaacuugguuacaa

SEQ ID NO: 808732 - RNA, 24 nt, Human
uagugauauuucauugugauuuua

SEQ ID NO: 808733 - RNA, 24 nt, Human
uauuagggaguggucucaggaaac

SEQ ID NO: 808734 - RNA, 23 nt, Human
uauucagagcacauuuuauuaac

SEQ ID NO: 808735 - RNA, 21 nt, Human
ucaaaauauguucuaguagca

SEQ ID NO: 808736 - RNA, 28 nt, Human
ucacugaugacaaugcuuaccccccaaa

SEQ ID NO: 808737 - RNA, 24 nt, Human
ucagagccuugcuaaacagccugc

SEQ ID NO: 808738 - RNA, 22 nt, Human
ucagccaacccccaugggcagg

SEQ ID NO: 808739 - RNA, 20 nt, Human
uccagauuagcauccaaaaa

SEQ ID NO: 808740 - RNA, 22 nt, Human
uccagauuagcauccaaaaggc

SEQ ID NO: 808741 - RNA, 21 nt, Human
uccauuuuccaaaaccugauu

SEQ ID NO: 808742 - RNA, 24 nt, Human
ucccauuacacugccugcugggca

SEQ ID NO: 808743 - RNA, 19 nt, Human
uccugcaacuucgcugcag

SEQ ID NO: 808744 - RNA, 19 nt, Human
uccuucugucccuccucuc

SEQ ID NO: 808745 - RNA, 21 nt, Human
ucuauacaagagauccaaagg

SEQ ID NO: 808746 - RNA, 19 nt, Human
ucuauccuuuucucugucc

SEQ ID NO: 808747 - RNA, 19 nt, Human
ucuauccuuuucucugucc

SEQ ID NO: 808748 - RNA, 22 nt, Human
ucucaaacuucuauccuuuucu

SEQ ID NO: 808749 - RNA, 21 nt, Human
ucuccaaagaacaggagccac

SEQ ID NO: 808750 - RNA, 23 nt, Human
ucuccaagcuucugagguuaaag

SEQ ID NO: 808751 - RNA, 19 nt, Human
ucuguccuugagcagaacu

SEQ ID NO: 808752 - RNA, 25 nt, Human
ugaacucugagcuccuucgagcccc

SEQ ID NO: 808753 - RNA, 18 nt, Human
ugaauuuuugugcuguca

SEQ ID NO: 808754 - RNA, 19 nt, Human
ugacauauauacccccaua

SEQ ID NO: 808755 - RNA, 25 nt, Human
ugacauauauacccccauaaaucca

SEQ ID NO: 808756 - RNA, 18 nt, Human
ugagucccugcuccacag

SEQ ID NO: 808757 - RNA, 18 nt, Human
ugcagcucuugggggucu

SEQ ID NO: 808758 - RNA, 20 nt, Human
uggaauaguauguaaaugaa

SEQ ID NO: 808759 - RNA, 20 nt, Human
ugguacuucuuugauguggu

SEQ ID NO: 808760 - RNA, 19 nt, Human
ugguagguacauguuuaac

SEQ ID NO: 808761 - RNA, 23 nt, Human
uguaguacagaauaaacuugguu

SEQ ID NO: 808762 - RNA, 22 nt, Human
ugucccuccucuccccauuucc

SEQ ID NO: 808763 - RNA, 20 nt, Human
uguccuugagcagaacuggg

SEQ ID NO: 808764 - RNA, 22 nt, Human
ugucuuuaucaaaauauguucu

SEQ ID NO: 808765 - RNA, 26 nt, Human
uuauucauuguguggauauacaaucu

SEQ ID NO: 808766 - RNA, 25 nt, Human
uuccccaaaguuaccaaguguuccc

SEQ ID NO: 808767 - RNA, 22 nt, Human
uugacauauauacccccauaaa

SEQ ID NO: 808768 - RNA, 19 nt, Human
uuucccgagaagccaacuc

SEQ ID NO: 808769 - RNA, 24 nt, Human
uuuuagcaacuggaagaagacuga

SEQ ID NO: 808770 - RNA, 22 nt, Human
uuuuccuaacuaacacacgccu

SEQ ID NO: 808771 - RNA, 21 nt, Human
uuuuucuucuuucauucagcc

SEQ ID NO: 808772 - RNA, 27 nt, Human
aaaaacagugagagaugaccgguaccc

SEQ ID NO: 808773 - RNA, 18 nt, Human
aaaagaagcaaacuggga

SEQ ID NO: 808774 - RNA, 25 nt, Human
aaaaugccucuuuauuuacauccuu

SEQ ID NO: 808775 - RNA, 18 nt, Human
aaagcuuacaauuuacaa

SEQ ID NO: 808776 - RNA, 22 nt, Human
aaaugccucuuuauuuacaucc

SEQ ID NO: 808777 - RNA, 19 nt, Human
aacugggaagagaaagaca

SEQ ID NO: 808778 - RNA, 18 nt, Human
aagaaagccuugccuaca

SEQ ID NO: 808779 - RNA, 19 nt, Human
aagaagaaaggaaggaaga

SEQ ID NO: 808780 - RNA, 20 nt, Human
aagaagaaaggaaggaagac

SEQ ID NO: 808781 - RNA, 22 nt, Human
aagaagcaaacugggaagagaa

SEQ ID NO: 808782 - RNA, 23 nt, Human
aagacucaacauauuugaaaaac

SEQ ID NO: 808783 - RNA, 18 nt, Human
aauaagaagaaaggaagg

SEQ ID NO: 808784 - RNA, 22 nt, Human
aauagcugcaacaagagacucu

SEQ ID NO: 808785 - RNA, 22 nt, Human
aauauuuguaaacuuaaauugc

SEQ ID NO: 808786 - RNA, 23 nt, Human
aaugacggagaauuccagaaaaa

SEQ ID NO: 808787 - RNA, 21 nt, Human
accaacugacccuuuauagaa

SEQ ID NO: 808788 - RNA, 20 nt, Human
acccuuuauagaaagaguuu

SEQ ID NO: 808789 - RNA, 19 nt, Human
accucuuuuuggagcccac

SEQ ID NO: 808790 - RNA, 19 nt, Human
acucuauggcucauaaacu

SEQ ID NO: 808791 - RNA, 26 nt, Human
agaaaagaagcaaacugggaagagaa

SEQ ID NO: 808792 - RNA, 19 nt, Human
agagaugacaagaacugaa

SEQ ID NO: 808793 - RNA, 20 nt, Human
agcuguuuaagcaggaauuu

SEQ ID NO: 808794 - RNA, 18 nt, Human
augcaaaauguuuauuug

SEQ ID NO: 808795 - RNA, 24 nt, Human
caccccgacaacaugacucaucuu

SEQ ID NO: 808796 - RNA, 22 nt, Human
cagagugccaauuuuucagaac

SEQ ID NO: 808797 - RNA, 20 nt, Human
cagcaaauuauagccugugg

SEQ ID NO: 808798 - RNA, 20 nt, Human
caggacaucacaccccgaca

SEQ ID NO: 808799 - RNA, 20 nt, Human
caugcaaaauguuuauuugg

SEQ ID NO: 808800 - RNA, 22 nt, Human
caugcuagaaaagaagcaaacu

SEQ ID NO: 808801 - RNA, 26 nt, Human
cauggaauaagacucaacauauuuga

SEQ ID NO: 808802 - RNA, 18 nt, Human
cccggcccgggagggcuc

SEQ ID NO: 808803 - RNA, 18 nt, Human
cccucgccgccgccgccc

SEQ ID NO: 808804 - RNA, 18 nt, Human
cccuuuuuuuuccuuucu

SEQ ID NO: 808805 - RNA, 18 nt, Human
ccgccgccgccgcgcucg

SEQ ID NO: 808806 - RNA, 20 nt, Human
ccgucgccgcccucgccgcc

SEQ ID NO: 808807 - RNA, 23 nt, Human
ccgucgccgcccucgccgccgcc

SEQ ID NO: 808808 - RNA, 19 nt, Human
ccuuacugucuguggcugc

SEQ ID NO: 808809 - RNA, 22 nt, Human
ccuuucaccuucucaccuacua

SEQ ID NO: 808810 - RNA, 23 nt, Human
cgccgcccucgccgccgccgccc

SEQ ID NO: 808811 - RNA, 24 nt, Human
cgccgcgcucgggaagcggguccc

SEQ ID NO: 808812 - RNA, 23 nt, Human
cugugggccaaaacuggccaugc

SEQ ID NO: 808813 - RNA, 19 nt, Human
cuuaauggauauauauuac

SEQ ID NO: 808814 - RNA, 21 nt, Human
cuugcucguauccuggagacc

SEQ ID NO: 808815 - RNA, 18 nt, Human
cuuuuuggagcccacuga

SEQ ID NO: 808816 - RNA, 22 nt, Human
gaccucuuuuuggagcccacug

SEQ ID NO: 808817 - RNA, 23 nt, Human
gagaaagacaagagaaauucaua

SEQ ID NO: 808818 - RNA, 20 nt, Human
gaugacaagaacugaaaaaa

SEQ ID NO: 808819 - RNA, 18 nt, Human
gccgccgccgcccacccg

SEQ ID NO: 808820 - RNA, 20 nt, Human
gcggguccccgucgccgccc

SEQ ID NO: 808821 - RNA, 21 nt, Human
gcggguccccgucgccgcccu

SEQ ID NO: 808822 - RNA, 21 nt, Human
gcucagcauuuucccugcagc

SEQ ID NO: 808823 - RNA, 20 nt, Human
ggcucagcauuuucccugca

SEQ ID NO: 808824 - RNA, 21 nt, Human
uaaaugcaaagaaaaaucuua

SEQ ID NO: 808825 - RNA, 21 nt, Human
uaagaaagccuugccuacacc

SEQ ID NO: 808826 - RNA, 20 nt, Human
uacaaagcuuacaauuuaca

SEQ ID NO: 808827 - RNA, 25 nt, Human
uaccaucauaaaugcuuuauaacca

SEQ ID NO: 808828 - RNA, 20 nt, Human
uaccuggagaugaaaaugac

SEQ ID NO: 808829 - RNA, 21 nt, Human
uaccuggagaugaaaaugacu

SEQ ID NO: 808830 - RNA, 21 nt, Human
ucaacauauuugaaaaacagu

SEQ ID NO: 808831 - RNA, 18 nt, Human
uccccagccuacaaaaga

SEQ ID NO: 808832 - RNA, 18 nt, Human
uccccgucgccgcccucg

SEQ ID NO: 808833 - RNA, 21 nt, Human
ucgccgcccucgccgccgccg

SEQ ID NO: 808834 - RNA, 24 nt, Human
ucgccgcccucgccgccgccgccc

SEQ ID NO: 808835 - RNA, 18 nt, Human
ucgccgccgccgcccacc

SEQ ID NO: 808836 - RNA, 23 nt, Human
ucuguggcugcuuuugcggcaca

SEQ ID NO: 808837 - RNA, 23 nt, Human
ugaaaaacagugagagaugacaa

SEQ ID NO: 808838 - RNA, 28 nt, Human
ugaaaaugacuaaacuuguggauggugg

SEQ ID NO: 808839 - RNA, 20 nt, Human
ugacaagaacugaaaaaaga

SEQ ID NO: 808840 - RNA, 23 nt, Human
ugacaagaacugaaaaaagaaaa

SEQ ID NO: 808841 - RNA, 21 nt, Human
ugauaaaugagucuguuuucu

SEQ ID NO: 808842 - RNA, 18 nt, Human
uggaauaagacucaacau

SEQ ID NO: 808843 - RNA, 18 nt, Human
uggauggugaaaauguaa

SEQ ID NO: 808844 - RNA, 23 nt, Human
uggcauaauuuugauagcaaacu

SEQ ID NO: 808845 - RNA, 26 nt, Human
ugggcugggaaaauccuguucuucaa

SEQ ID NO: 808846 - RNA, 18 nt, Human
uguggcuccccagccuac

SEQ ID NO: 808847 - RNA, 25 nt, Human
uuaguuagaaugacggagaauucca

SEQ ID NO: 808848 - RNA, 21 nt, Human
uuaucuuuagucaugcuagaa

SEQ ID NO: 808849 - RNA, 19 nt, Human
uuccagaaaaauuacugca

SEQ ID NO: 808850 - RNA, 19 nt, Human
uuccauuuguucuaugucc

SEQ ID NO: 808851 - RNA, 19 nt, Human
acccucaaaucagggcccc

SEQ ID NO: 808852 - RNA, 19 nt, Human
agagacacguucuccugcc

SEQ ID NO: 808853 - RNA, 19 nt, Human
agccagagacacguucucc

SEQ ID NO: 808854 - RNA, 20 nt, Human
aggacccccagccaggcccc

SEQ ID NO: 808855 - RNA, 23 nt, Human
ccagagacacguucuccugccaa

SEQ ID NO: 808856 - RNA, 20 nt, Human
ccccaccgagacgauucccu

SEQ ID NO: 808857 - RNA, 24 nt, Human
ccccagccaggccccggcaccccc

SEQ ID NO: 808858 - RNA, 26 nt, Human
ccccagccaggccccggcacccccac

SEQ ID NO: 808859 - RNA, 25 nt, Human
cccuggggaaacggacgacucgugg

SEQ ID NO: 808860 - RNA, 21 nt, Human
ccugccaagaccggcccuggc

SEQ ID NO: 808861 - RNA, 20 nt, Human
gaaagggcuuuagaccacgu

SEQ ID NO: 808862 - RNA, 18 nt, Human
gacaggcugcacuccagg

SEQ ID NO: 808863 - RNA, 21 nt, Human
gagcccggcaggacccccagc

SEQ ID NO: 808864 - RNA, 21 nt, Human
gcacccccaccgagacgauuc

SEQ ID NO: 808865 - RNA, 19 nt, Human
ggacaggcugcacuccagg

SEQ ID NO: 808866 - RNA, 26 nt, Human
ggcccaggcuuccugcucgcugaggc

SEQ ID NO: 808867 - RNA, 18 nt, Human
uacagcauccaacagugg

SEQ ID NO: 808868 - RNA, 26 nt, Human
ucccuggggaaacggacgacucgugg

SEQ ID NO: 808869 - RNA, 18 nt, Human
ucguccugcuguucccug

SEQ ID NO: 808870 - RNA, 28 nt, Human
uggggaaacggacgacucguggcaggac

SEQ ID NO: 808871 - RNA, 24 nt, Human
uucuccugccaagaccggcccugg

SEQ ID NO: 808872 - RNA, 21 nt, Human
aaaaagaaaacuucuaaaagg

SEQ ID NO: 808873 - RNA, 20 nt, Human
aaaacugcaggaacagaggg

SEQ ID NO: 808874 - RNA, 26 nt, Human
aaaagaagagacacagaagauccaaa

SEQ ID NO: 808875 - RNA, 18 nt, Human
aaagaagagacacagaag

SEQ ID NO: 808876 - RNA, 21 nt, Human
aaaggaacucuggggcccagg

SEQ ID NO: 808877 - RNA, 24 nt, Human
aaagugcugagauuacaggcauga

SEQ ID NO: 808878 - RNA, 19 nt, Human
aaccaggucaaucgcagau

SEQ ID NO: 808879 - RNA, 24 nt, Human
aaccucuugggcucaagcaauccu

SEQ ID NO: 808880 - RNA, 25 nt, Human
aagcaauccucccaccucagccucu

SEQ ID NO: 808881 - RNA, 25 nt, Human
aagcaauccucccgucuuagccucu

SEQ ID NO: 808882 - RNA, 21 nt, Human
aaguagcugggaccacaggca

SEQ ID NO: 808883 - RNA, 27 nt, Human
aaguagcugggaccacaggcaugagcc

SEQ ID NO: 808884 - RNA, 26 nt, Human
aagugcugagauuacaggcaugagcc

SEQ ID NO: 808885 - RNA, 19 nt, Human
aaucauggcucacugcagc

SEQ ID NO: 808886 - RNA, 18 nt, Human
accccaaaacugcaggaa

SEQ ID NO: 808887 - RNA, 22 nt, Human
accccaaaacugcaggaacaga

SEQ ID NO: 808888 - RNA, 23 nt, Human
accucagccucucaaguagcugg

SEQ ID NO: 808889 - RNA, 19 nt, Human
acucuguuguccaggcugg

SEQ ID NO: 808890 - RNA, 20 nt, Human
acucuguuguccaggcugga

SEQ ID NO: 808891 - RNA, 25 nt, Human
acucuguuguccaggcuggagugca

SEQ ID NO: 808892 - RNA, 18 nt, Human
acugcagccucaaccucu

SEQ ID NO: 808893 - RNA, 24 nt, Human
agaaaaguagggucauaagccaga

SEQ ID NO: 808894 - RNA, 20 nt, Human
agaaauaucauucuucaguc

SEQ ID NO: 808895 - RNA, 19 nt, Human
agauuacaggcaugagcca

SEQ ID NO: 808896 - RNA, 22 nt, Human
agauuacaggcaugagccacca

SEQ ID NO: 808897 - RNA, 19 nt, Human
agccagagagaauaaauac

SEQ ID NO: 808898 - RNA, 21 nt, Human
aggaacagagggucauaugac

SEQ ID NO: 808899 - RNA, 27 nt, Human
augaaccccaaaacugcaggaacagag

SEQ ID NO: 808900 - RNA, 20 nt, Human
augaauacuuaaaaaaaucc

SEQ ID NO: 808901 - RNA, 18 nt, Human
augcuggucuugaacucc

SEQ ID NO: 808902 - RNA, 22 nt, Human
auggaguuuucaaaaugugccc

SEQ ID NO: 808903 - RNA, 24 nt, Human
auuugugcuuuuaaugaaccccaa

SEQ ID NO: 808904 - RNA, 24 nt, Human
caaaggaacucuggggcccaggac

SEQ ID NO: 808905 - RNA, 23 nt, Human
caaagugcugagauuacaggcau

SEQ ID NO: 808906 - RNA, 24 nt, Human
caaagugcugagauuacaggcaug

SEQ ID NO: 808907 - RNA, 22 nt, Human
caaccucuugggcucaagcaau

SEQ ID NO: 808908 - RNA, 22 nt, Human
cacaggcaugagccaccaugcc

SEQ ID NO: 808909 - RNA, 18 nt, Human
cacugcagccucaaccuc

SEQ ID NO: 808910 - RNA, 23 nt, Human
cagccucaaccucuugggcucaa

SEQ ID NO: 808911 - RNA, 24 nt, Human
cagccucaaccucuugggcucaag

SEQ ID NO: 808912 - RNA, 20 nt, Human
caggaggggcaaaaaagaaa

SEQ ID NO: 808913 - RNA, 24 nt, Human
caggguuuuacucuguuguccagg

SEQ ID NO: 808914 - RNA, 23 nt, Human
cccaugcuggucuugaacuccug

SEQ ID NO: 808915 - RNA, 19 nt, Human
ccucaaccucuugggcuca

SEQ ID NO: 808916 - RNA, 21 nt, Human
ccucaaccucuugggcucaag

SEQ ID NO: 808917 - RNA, 26 nt, Human
ccucccaccucagccucucaaguagc

SEQ ID NO: 808918 - RNA, 22 nt, Human
ccucccgucuuagccucucaaa

SEQ ID NO: 808919 - RNA, 26 nt, Human
ccucccgucuuagccucucaaagugc

SEQ ID NO: 808920 - RNA, 24 nt, Human
ccucuugggcucaagcaauccucc

SEQ ID NO: 808921 - RNA, 21 nt, Human
cucaagcaauccucccaccuc

SEQ ID NO: 808922 - RNA, 24 nt, Human
cucaagcaauccucccaccucagc

SEQ ID NO: 808923 - RNA, 20 nt, Human
cucacugcagccucaaccuc

SEQ ID NO: 808924 - RNA, 24 nt, Human
cucacugcagccucaaccucuugg

SEQ ID NO: 808925 - RNA, 24 nt, Human
cucagccucucaaguagcugggac

SEQ ID NO: 808926 - RNA, 21 nt, Human
cucucaaagugcugagauuac

SEQ ID NO: 808927 - RNA, 24 nt, Human
cucucaaguagcugggaccacagg

SEQ ID NO: 808928 - RNA, 25 nt, Human
cucuugggcucaagcaauccuccca

SEQ ID NO: 808929 - RNA, 22 nt, Human
cugcagccucaaccucuugggc

SEQ ID NO: 808930 - RNA, 23 nt, Human
cugcagccucaaccucuugggcu

SEQ ID NO: 808931 - RNA, 21 nt, Human
cuggggcccaggacaccaaga

SEQ ID NO: 808932 - RNA, 25 nt, Human
gaaaaagaaaacuucuaaaagguac

SEQ ID NO: 808933 - RNA, 23 nt, Human
gacaggguuuuacucuguugucc

SEQ ID NO: 808934 - RNA, 20 nt, Human
gagacaggguuuuacucugu

SEQ ID NO: 808935 - RNA, 18 nt, Human
gauuacaggcaugagcca

SEQ ID NO: 808936 - RNA, 24 nt, Human
gauuacaggcaugagccaccauac

SEQ ID NO: 808937 - RNA, 21 nt, Human
gcucacugcagccucaaccuc

SEQ ID NO: 808938 - RNA, 19 nt, Human
gcuggagugcagcagcaua

SEQ ID NO: 808939 - RNA, 24 nt, Human
ggaccacaggcaugagccaccaug

SEQ ID NO: 808940 - RNA, 23 nt, Human
ggcaaaaaagaaauacgccauau

SEQ ID NO: 808941 - RNA, 22 nt, Human
gguaugaaacugugggaaaaga

SEQ ID NO: 808942 - RNA, 25 nt, Human
ggucugguaacccuuggcaauucua

SEQ ID NO: 808943 - RNA, 22 nt, Human
guagagacgguaucucacuaug

SEQ ID NO: 808944 - RNA, 24 nt, Human
guccaggcuggagugcagcagcau

SEQ ID NO: 808945 - RNA, 19 nt, Human
guggggggggcaggagggg

SEQ ID NO: 808946 - RNA, 23 nt, Human
guuuuacucuguuguccaggcug

SEQ ID NO: 808947 - RNA, 24 nt, Human
guuuuacucuguuguccaggcugg

SEQ ID NO: 808948 - RNA, 24 nt, Human
uaaaagaagagacacagaagaucc

SEQ ID NO: 808949 - RNA, 24 nt, Human
uaacuguauugaaaaucagguaau

SEQ ID NO: 808950 - RNA, 22 nt, Human
uaaugaaccccaaaacugcagg

SEQ ID NO: 808951 - RNA, 24 nt, Human
uaaugaaccccaaaacugcaggaa

SEQ ID NO: 808952 - RNA, 22 nt, Human
uacacaugucauugauaauuag

SEQ ID NO: 808953 - RNA, 21 nt, Human
uacaggcaugagccaccauac

SEQ ID NO: 808954 - RNA, 22 nt, Human
uagagacgguaucucacuaugu

SEQ ID NO: 808955 - RNA, 24 nt, Human
uaugaaaaugucgcuaugcaggcc

SEQ ID NO: 808956 - RNA, 24 nt, Human
uauguuccccaugcuggucuugaa

SEQ ID NO: 808957 - RNA, 23 nt, Human
ucaaagugcugagauuacaggca

SEQ ID NO: 808958 - RNA, 24 nt, Human
ucaaagugcugagauuacaggcau

SEQ ID NO: 808959 - RNA, 19 nt, Human
ucaagcaauccucccgucu

SEQ ID NO: 808960 - RNA, 23 nt, Human
ucacugcagccucaaccucuugg

SEQ ID NO: 808961 - RNA, 23 nt, Human
ucacugcagccucaaccucuugg

SEQ ID NO: 808962 - RNA, 24 nt, Human
ucacugcagccucaaccucuuggg

SEQ ID NO: 808963 - RNA, 19 nt, Human
uccaaagaugccaccugga

SEQ ID NO: 808964 - RNA, 24 nt, Human
uccagaauaaauuaucuuuaaaga

SEQ ID NO: 808965 - RNA, 20 nt, Human
ucccaagcugggagggaguu

SEQ ID NO: 808966 - RNA, 18 nt, Human
uccuggauucaagcaauc

SEQ ID NO: 808967 - RNA, 24 nt, Human
ucucaaagugcugagauuacaggc

SEQ ID NO: 808968 - RNA, 24 nt, Human
ucucaaguagcugggaccacaggc

SEQ ID NO: 808969 - RNA, 18 nt, Human
ucuccauuaguaugugcu

SEQ ID NO: 808970 - RNA, 21 nt, Human
ucuggagaggucugguaaccc

SEQ ID NO: 808971 - RNA, 24 nt, Human
ucuggagaggucugguaacccuug

SEQ ID NO: 808972 - RNA, 24 nt, Human
ucuguuguccaggcuggagugcag

SEQ ID NO: 808973 - RNA, 23 nt, Human
ucuugaacuccuggauucaagca

SEQ ID NO: 808974 - RNA, 24 nt, Human
ugaaaagacugaguuuuacacuga

SEQ ID NO: 808975 - RNA, 18 nt, Human
ugaaccccaaaacugcag

SEQ ID NO: 808976 - RNA, 24 nt, Human
ugaacuccuggauucaagcaaucc

SEQ ID NO: 808977 - RNA, 25 nt, Human
ugaacuccuggauucaagcaauccu

SEQ ID NO: 808978 - RNA, 22 nt, Human
ugagauuacaggcaugagccac

SEQ ID NO: 808979 - RNA, 23 nt, Human
ugagauuacaggcaugagccacc

SEQ ID NO: 808980 - RNA, 24 nt, Human
ugagauuacaggcaugagccacca

SEQ ID NO: 808981 - RNA, 26 nt, Human
ugagauuacaggcaugagccaccaua

SEQ ID NO: 808982 - RNA, 18 nt, Human
uggaaaaagugcauuugg

SEQ ID NO: 808983 - RNA, 21 nt, Human
uggauucaagcaauccucccg

SEQ ID NO: 808984 - RNA, 22 nt, Human
uggccuauggaauggauaauau

SEQ ID NO: 808985 - RNA, 24 nt, Human
uggcucacugcagccucaaccucu

SEQ ID NO: 808986 - RNA, 24 nt, Human
ugggaccacaggcaugagccacca

SEQ ID NO: 808987 - RNA, 24 nt, Human
uggggcccaggacaccaagguguu

SEQ ID NO: 808988 - RNA, 18 nt, Human
uggggggggcaggagggg

SEQ ID NO: 808989 - RNA, 18 nt, Human
ugguggggggggcaggag

SEQ ID NO: 808990 - RNA, 19 nt, Human
uguccaggcuggagugcag

SEQ ID NO: 808991 - RNA, 20 nt, Human
uguccaggcuggagugcagc

SEQ ID NO: 808992 - RNA, 19 nt, Human
uguuguccaggcuggagug

SEQ ID NO: 808993 - RNA, 21 nt, Human
uuaaaguaguaugaaaauguc

SEQ ID NO: 808994 - RNA, 21 nt, Human
uuaagggaaaaaguauggaaa

SEQ ID NO: 808995 - RNA, 26 nt, Human
uuaagggaaaaaguauggaaauuuau

SEQ ID NO: 808996 - RNA, 22 nt, Human
uuaauacaauacgauuuaugga

SEQ ID NO: 808997 - RNA, 20 nt, Human
uuacucuguuguccaggcug

SEQ ID NO: 808998 - RNA, 22 nt, Human
uuacucuguuguccaggcugga

SEQ ID NO: 808999 - RNA, 24 nt, Human
uuacucuguuguccaggcuggagu

SEQ ID NO: 809000 - RNA, 24 nt, Human
uuagccucucaaagugcugagauu

SEQ ID NO: 809001 - RNA, 21 nt, Human
uuaguaugugcuucccaagcu

SEQ ID NO: 809002 - RNA, 21 nt, Human
uugauacugugcacaaccuac

SEQ ID NO: 809003 - RNA, 21 nt, Human
uugguggggggggcaggaggg

SEQ ID NO: 809004 - RNA, 24 nt, Human
uuguagagacgguaucucacuaug

SEQ ID NO: 809005 - RNA, 24 nt, Human
uuuguagagacgguaucucacuau

SEQ ID NO: 809006 - RNA, 23 nt, Human
uuuuacucuguuguccaggcugg

SEQ ID NO: 809007 - RNA, 24 nt, Human
uuuuacucuguuguccaggcugga

SEQ ID NO: 809008 - RNA, 21 nt, Human
aaaugcauccuggcacagucc

SEQ ID NO: 809009 - RNA, 18 nt, Human
aacacagacucagaaauc

SEQ ID NO: 809010 - RNA, 19 nt, Human
aacacagggacuuggcugg

SEQ ID NO: 809011 - RNA, 21 nt, Human
aacucauuuucuucaucuugg

SEQ ID NO: 809012 - RNA, 18 nt, Human
aacugggcugcagaaaaa

SEQ ID NO: 809013 - RNA, 18 nt, Human
aagcagccaggaggcaag

SEQ ID NO: 809014 - RNA, 22 nt, Human
aagcagccaggaggcaaguuga

SEQ ID NO: 809015 - RNA, 22 nt, Human
aagcccagcacagugccugcug

SEQ ID NO: 809016 - RNA, 19 nt, Human
aaggauggcugguggggca

SEQ ID NO: 809017 - RNA, 18 nt, Human
aagguugucacaagcuga

SEQ ID NO: 809018 - RNA, 23 nt, Human
aauugucucuucaaggauggcug

SEQ ID NO: 809019 - RNA, 18 nt, Human
acacagacucagaaauca

SEQ ID NO: 809020 - RNA, 26 nt, Human
acacagacucagaaaucaggaaagcc

SEQ ID NO: 809021 - RNA, 20 nt, Human
acagcccacgagguucgcug

SEQ ID NO: 809022 - RNA, 22 nt, Human
accaggguccacagucucugcc

SEQ ID NO: 809023 - RNA, 21 nt, Human
acccuaggccucccaauuccu

SEQ ID NO: 809024 - RNA, 21 nt, Human
agaaagacuggucuccacagg

SEQ ID NO: 809025 - RNA, 18 nt, Human
agacaaggccugcaaaug

SEQ ID NO: 809026 - RNA, 24 nt, Human
agaggaaggggagcauaguccgag

SEQ ID NO: 809027 - RNA, 20 nt, Human
agcagaggaaggggagcaua

SEQ ID NO: 809028 - RNA, 19 nt, Human
agcagcagggugguggggg

SEQ ID NO: 809029 - RNA, 22 nt, Human
aggaaagauggggggucauagg

SEQ ID NO: 809030 - RNA, 22 nt, Human
aggaugcuguauucccugugga

SEQ ID NO: 809031 - RNA, 21 nt, Human
aggccugcaaauguccugcug

SEQ ID NO: 809032 - RNA, 21 nt, Human
agggacugugaggucugggau

SEQ ID NO: 809033 - RNA, 18 nt, Human
agguggcgguagagauga

SEQ ID NO: 809034 - RNA, 24 nt, Human
aguugccuuuagggcuaccucuau

SEQ ID NO: 809035 - RNA, 22 nt, Human
auucucagcccugaagaaugga

SEQ ID NO: 809036 - RNA, 19 nt, Human
caaaacaggggucagugac

SEQ ID NO: 809037 - RNA, 22 nt, Human
cacacuggcacaucucaguaac

SEQ ID NO: 809038 - RNA, 18 nt, Human
cacagugccugcuggggc

SEQ ID NO: 809039 - RNA, 18 nt, Human
cacccuccuccucuuucc

SEQ ID NO: 809040 - RNA, 19 nt, Human
cacgugggcauaccagggu

SEQ ID NO: 809041 - RNA, 19 nt, Human
cacugugugucagaaagac

SEQ ID NO: 809042 - RNA, 25 nt, Human
cacuugcaagcccaagcuuccagcc

SEQ ID NO: 809043 - RNA, 19 nt, Human
cacuugguuaaagcccuca

SEQ ID NO: 809044 - RNA, 21 nt, Human
cagagagcagcccugaugcuc

SEQ ID NO: 809045 - RNA, 21 nt, Human
cagaggccuuguaugacuucu

SEQ ID NO: 809046 - RNA, 21 nt, Human
cagcaaacauaaaugaaagca

SEQ ID NO: 809047 - RNA, 26 nt, Human
cagccugagacagugcugagccuccu

SEQ ID NO: 809048 - RNA, 18 nt, Human
cagguuccauuccucucc

SEQ ID NO: 809049 - RNA, 18 nt, Human
caguccuggcuggagaca

SEQ ID NO: 809050 - RNA, 19 nt, Human
cagugaccuuaaggagcag

SEQ ID NO: 809051 - RNA, 21 nt, Human
cauccuugcucuccccuuacc

SEQ ID NO: 809052 - RNA, 24 nt, Human
caucucaguaacaccuccaaacac

SEQ ID NO: 809053 - RNA, 21 nt, Human
ccaccauucguaacacaggga

SEQ ID NO: 809054 - RNA, 22 nt, Human
ccacccuaggccucccaauucc

SEQ ID NO: 809055 - RNA, 21 nt, Human
ccagccugagacagugcugag

SEQ ID NO: 809056 - RNA, 20 nt, Human
ccaugaggcuacagcuccau

SEQ ID NO: 809057 - RNA, 20 nt, Human
ccauggugccagccuggagc

SEQ ID NO: 809058 - RNA, 18 nt, Human
cccaaugucuugcccaag

SEQ ID NO: 809059 - RNA, 19 nt, Human
cccacagaacugggcugca

SEQ ID NO: 809060 - RNA, 23 nt, Human
cccacagaacugggcugcagaaa

SEQ ID NO: 809061 - RNA, 18 nt, Human
cccuccuccucuuuccua

SEQ ID NO: 809062 - RNA, 24 nt, Human
cccugacuagagcccugucagagc

SEQ ID NO: 809063 - RNA, 18 nt, Human
cccugaugcucuucuagu

SEQ ID NO: 809064 - RNA, 18 nt, Human
cccugccugggcuugucc

SEQ ID NO: 809065 - RNA, 19 nt, Human
ccuagaccugcaugugagg

SEQ ID NO: 809066 - RNA, 20 nt, Human
ccuccagccugagacagugc

SEQ ID NO: 809067 - RNA, 20 nt, Human
ccugcaugugagguagacag

SEQ ID NO: 809068 - RNA, 23 nt, Human
ccugggcuuguccuguuugggag

SEQ ID NO: 809069 - RNA, 23 nt, Human
ccuuaccuacauuugcuuuccua

SEQ ID NO: 809070 - RNA, 19 nt, Human
ccuugguccaaguuccugg

SEQ ID NO: 809071 - RNA, 18 nt, Human
cgagcagcaggguggugg

SEQ ID NO: 809072 - RNA, 25 nt, Human
cguaacacagggacuuggcuggccu

SEQ ID NO: 809073 - RNA, 22 nt, Human
cucagcccugauauucaucaac

SEQ ID NO: 809074 - RNA, 22 nt, Human
cuccugaaacacaggcuggaaa

SEQ ID NO: 809075 - RNA, 18 nt, Human
cugcugaagcagccagga

SEQ ID NO: 809076 - RNA, 24 nt, Human
cuggauugcucgaguccaccucuu

SEQ ID NO: 809077 - RNA, 23 nt, Human
cuugcaagcccaagcuuccagcc

SEQ ID NO: 809078 - RNA, 21 nt, Human
gagaaaaguccaguagacaag

SEQ ID NO: 809079 - RNA, 22 nt, Human
gagcaaaagagcuggauaaaaa

SEQ ID NO: 809080 - RNA, 23 nt, Human
gagcucugguucucucugacggu

SEQ ID NO: 809081 - RNA, 18 nt, Human
gauaagggcugcccuggc

SEQ ID NO: 809082 - RNA, 20 nt, Human
gauucuagucaguguugcuc

SEQ ID NO: 809083 - RNA, 23 nt, Human
gcaaaacaggggucagugaccuu

SEQ ID NO: 809084 - RNA, 23 nt, Human
gccaaaugcaaagaacuguucua

SEQ ID NO: 809085 - RNA, 21 nt, Human
gccaggacgguagcggggaug

SEQ ID NO: 809086 - RNA, 18 nt, Human
gccccuaagcccagcaca

SEQ ID NO: 809087 - RNA, 27 nt, Human
gcccugaagaauggagggcauuguagu

SEQ ID NO: 809088 - RNA, 18 nt, Human
gccuuguaugacuucugu

SEQ ID NO: 809089 - RNA, 19 nt, Human
gcucagucugggcuccugg

SEQ ID NO: 809090 - RNA, 30 nt, Human
gcuguguggccucaagcaaagcauucccuu

SEQ ID NO: 809091 - RNA, 24 nt, Human
ggcaagcaugauccagcacagucc

SEQ ID NO: 809092 - RNA, 18 nt, Human
ggccuuguaugacuucug

SEQ ID NO: 809093 - RNA, 20 nt, Human
ggcggaggaaagaugggggg

SEQ ID NO: 809094 - RNA, 24 nt, Human
gggcggaggaaagaugggggguca

SEQ ID NO: 809095 - RNA, 18 nt, Human
ggggauggagugagggaa

SEQ ID NO: 809096 - RNA, 18 nt, Human
gguagccccuaagcccag

SEQ ID NO: 809097 - RNA, 23 nt, Human
gucccggauccacuugcaagccc

SEQ ID NO: 809098 - RNA, 22 nt, Human
uaaaaacggaagucucaccaca

SEQ ID NO: 809099 - RNA, 21 nt, Human
uaaagcagggcacaaccuauu

SEQ ID NO: 809100 - RNA, 24 nt, Human
uaagcccagcacagugccugcugg

SEQ ID NO: 809101 - RNA, 19 nt, Human
uaaguagagccaaaugcaa

SEQ ID NO: 809102 - RNA, 18 nt, Human
uaauucuagcuccagguu

SEQ ID NO: 809103 - RNA, 24 nt, Human
uacagcuccauucucagggccagg

SEQ ID NO: 809104 - RNA, 18 nt, Human
uagagaugaggacagugg

SEQ ID NO: 809105 - RNA, 21 nt, Human
uagcagacagccccuuggccc

SEQ ID NO: 809106 - RNA, 20 nt, Human
uagcuccagguuccauuccu

SEQ ID NO: 809107 - RNA, 21 nt, Human
ucagaaagacuggucuccaca

SEQ ID NO: 809108 - RNA, 23 nt, Human
ucagaaaucaggaaagccacaaa

SEQ ID NO: 809109 - RNA, 25 nt, Human
ucagcccugauauucaucaacugcc

SEQ ID NO: 809110 - RNA, 23 nt, Human
ucagcgacuuuaaacagcuuucc

SEQ ID NO: 809111 - RNA, 24 nt, Human
ucagcugcaggcgucaggauccag

SEQ ID NO: 809112 - RNA, 20 nt, Human
ucaggggcggaggaaagaug

SEQ ID NO: 809113 - RNA, 24 nt, Human
ucaugcccacccuaggccucccaa

SEQ ID NO: 809114 - RNA, 19 nt, Human
uccacagucucugcccaga

SEQ ID NO: 809115 - RNA, 19 nt, Human
uccacagucucugcccaga

SEQ ID NO: 809116 - RNA, 22 nt, Human
uccaccugcugaagcagccagg

SEQ ID NO: 809117 - RNA, 24 nt, Human
uccaugcagcccugccugggcuug

SEQ ID NO: 809118 - RNA, 18 nt, Human
ucccuguggagggcaagc

SEQ ID NO: 809119 - RNA, 23 nt, Human
uccucacccuagaccugcaugug

SEQ ID NO: 809120 - RNA, 23 nt, Human
uccugcuccugcucucagcugca

SEQ ID NO: 809121 - RNA, 19 nt, Human
uccugcucucagcugcagg

SEQ ID NO: 809122 - RNA, 18 nt, Human
ucgcugaccuccagccug

SEQ ID NO: 809123 - RNA, 18 nt, Human
ucuccaugcagcccugcc

SEQ ID NO: 809124 - RNA, 20 nt, Human
ucugugcauccuugcucucc

SEQ ID NO: 809125 - RNA, 24 nt, Human
ugacauuuugcggcucagggcagu

SEQ ID NO: 809126 - RNA, 19 nt, Human
ugacuucuguccuggggaa

SEQ ID NO: 809127 - RNA, 21 nt, Human
ugacuucuguccuggggaagg

SEQ ID NO: 809128 - RNA, 18 nt, Human
ugauaagggcugcccugg

SEQ ID NO: 809129 - RNA, 22 nt, Human
ugaucagcgacuuuaaacagcc

SEQ ID NO: 809130 - RNA, 20 nt, Human
ugccaauugcauccuagagc

SEQ ID NO: 809131 - RNA, 18 nt, Human
ugcccagacagaaugcuc

SEQ ID NO: 809132 - RNA, 21 nt, Human
ugcccuugccgggcugcacug

SEQ ID NO: 809133 - RNA, 21 nt, Human
ugccugcuggggcgcuuggca

SEQ ID NO: 809134 - RNA, 18 nt, Human
ugccugggcuuguccugu

SEQ ID NO: 809135 - RNA, 24 nt, Human
ugcuaccaaccugcuguguggccu

SEQ ID NO: 809136 - RNA, 18 nt, Human
ugcuggggcgcuuggcag

SEQ ID NO: 809137 - RNA, 19 nt, Human
uggaagagcugcacccaca

SEQ ID NO: 809138 - RNA, 18 nt, Human
uggccaggacgguagcgg

SEQ ID NO: 809139 - RNA, 20 nt, Human
uggccagggcccugcugcuu

SEQ ID NO: 809140 - RNA, 21 nt, Human
ugggcauaccaggguccacag

SEQ ID NO: 809141 - RNA, 20 nt, Human
ugguagccccuaagcccagc

SEQ ID NO: 809142 - RNA, 19 nt, Human
uggugccagccuggagcuc

SEQ ID NO: 809143 - RNA, 26 nt, Human
ugguggggcagcuccucaggguccuc

SEQ ID NO: 809144 - RNA, 21 nt, Human
ugucacauccauuuauugucc

SEQ ID NO: 809145 - RNA, 18 nt, Human
ugucagaaagacuggucu

SEQ ID NO: 809146 - RNA, 18 nt, Human
ugugagcaaaagagcugg

SEQ ID NO: 809147 - RNA, 24 nt, Human
ugugcacacauguagauuuccuga

SEQ ID NO: 809148 - RNA, 21 nt, Human
uguguccucugucccacgugg

SEQ ID NO: 809149 - RNA, 19 nt, Human
uguguggccucaagcaaag

SEQ ID NO: 809150 - RNA, 24 nt, Human
uguucuacuuuucucucucugugc

SEQ ID NO: 809151 - RNA, 18 nt, Human
uucaucaacugcccugaa

SEQ ID NO: 809152 - RNA, 21 nt, Human
uucaugccgcuuugcacuugg

SEQ ID NO: 809153 - RNA, 18 nt, Human
uuuccugcuccugcucuc

SEQ ID NO: 809154 - RNA, 20 nt, Human
uuugcucagucugggcuccu

SEQ ID NO: 809155 - RNA, 18 nt, Human
aaaagcauucuccaaaug

SEQ ID NO: 809156 - RNA, 22 nt, Human
caacccccugccccccgccagg

SEQ ID NO: 809157 - RNA, 22 nt, Human
cacagaggcccaggcagaggcc

SEQ ID NO: 809158 - RNA, 22 nt, Human
cagcuucuugcugucuccagga

SEQ ID NO: 809159 - RNA, 21 nt, Human
cauuucacucuuccugaguuu

SEQ ID NO: 809160 - RNA, 18 nt, Human
cccaggcagaggccgggc

SEQ ID NO: 809161 - RNA, 19 nt, Human
ccccaguugcccauugcca

SEQ ID NO: 809162 - RNA, 22 nt, Human
cccccgccagggcaagccacag

SEQ ID NO: 809163 - RNA, 26 nt, Human
cccccggggcuggcacagaggcccag

SEQ ID NO: 809164 - RNA, 26 nt, Human
cccccuguacacccuucuacuccgag

SEQ ID NO: 809165 - RNA, 19 nt, Human
cccugccccccgccagggc

SEQ ID NO: 809166 - RNA, 21 nt, Human
gaaagacugaguaacuggggg

SEQ ID NO: 809167 - RNA, 22 nt, Human
gaggcccaggcagaggccgggc

SEQ ID NO: 809168 - RNA, 24 nt, Human
gaggcccaggcagaggccgggcuu

SEQ ID NO: 809169 - RNA, 19 nt, Human
gcccauugccauguccugc

SEQ ID NO: 809170 - RNA, 25 nt, Human
gccugagguugucgugucgcgcucg

SEQ ID NO: 809171 - RNA, 19 nt, Human
uaaaagcauucuccaaaug

SEQ ID NO: 809172 - RNA, 22 nt, Human
uccugccaacccccugcccccc

SEQ ID NO: 809173 - RNA, 18 nt, Human
ugagauuggccagacacg

SEQ ID NO: 809174 - RNA, 21 nt, Human
ugaguaacuggggggcccccg

SEQ ID NO: 809175 - RNA, 19 nt, Human
ugccaacccccugcccccc

SEQ ID NO: 809176 - RNA, 20 nt, Human
uggcacagaggcccaggcag

SEQ ID NO: 809177 - RNA, 21 nt, Human
uucacucuuccugaguuucgg

SEQ ID NO: 809178 - RNA, 26 nt, Human
uuccugaccuuggcugugggggcagg

SEQ ID NO: 809179 - RNA, 18 nt, Human
uugcccauugccaugucc

SEQ ID NO: 809180 - RNA, 24 nt, Human
uuuauuaucgucuccacuuuugau

SEQ ID NO: 809181 - RNA, 24 nt, Human
aaaaaaaaaagaaaaccaaaaagg

SEQ ID NO: 809182 - RNA, 22 nt, Human
aaagaaaaccaaaaagggagac

SEQ ID NO: 809183 - RNA, 19 nt, Human
aacauggugaaaccccguu

SEQ ID NO: 809184 - RNA, 20 nt, Human
aacauggugaaaccccguuu

SEQ ID NO: 809185 - RNA, 21 nt, Human
aacauggugaaaccccguuuc

SEQ ID NO: 809186 - RNA, 21 nt, Human
aacauggugaaaccccguuuc

SEQ ID NO: 809187 - RNA, 24 nt, Human
aauugcuugaacccgggaggcgga

SEQ ID NO: 809188 - RNA, 22 nt, Human
acacagcacgacugucucaaaa

SEQ ID NO: 809189 - RNA, 19 nt, Human
acagacgaggacauucaca

SEQ ID NO: 809190 - RNA, 18 nt, Human
accccguuucuacuaaaa

SEQ ID NO: 809191 - RNA, 21 nt, Human
acgaggacauucacaaggaug

SEQ ID NO: 809192 - RNA, 27 nt, Human
acgcugggugucccagguccucccugc

SEQ ID NO: 809193 - RNA, 18 nt, Human
acugcacuccagccuagg

SEQ ID NO: 809194 - RNA, 26 nt, Human
acugcacuccagccuaggugacacag

SEQ ID NO: 809195 - RNA, 20 nt, Human
acugcuccugaggcuggagg

SEQ ID NO: 809196 - RNA, 21 nt, Human
acugcuccugaggcuggaggc

SEQ ID NO: 809197 - RNA, 24 nt, Human
agaaaaaaaaaaagaaaaccaaaa

SEQ ID NO: 809198 - RNA, 22 nt, Human
agaauugcuugaacccgggagg

SEQ ID NO: 809199 - RNA, 20 nt, Human
agcacuuugggaggccgcag

SEQ ID NO: 809200 - RNA, 24 nt, Human
agcccagaggaggaagcccuggau

SEQ ID NO: 809201 - RNA, 22 nt, Human
agccugagcaacauggugaaac

SEQ ID NO: 809202 - RNA, 24 nt, Human
agccugagcaacauggugaaaccc

SEQ ID NO: 809203 - RNA, 23 nt, Human
agcugggcguggcagcgugugcc

SEQ ID NO: 809204 - RNA, 19 nt, Human
aggaagcccuggauugggc

SEQ ID NO: 809205 - RNA, 20 nt, Human
aggaagcccuggauugggcu

SEQ ID NO: 809206 - RNA, 21 nt, Human
aggaggacgggcccgggcucc

SEQ ID NO: 809207 - RNA, 24 nt, Human
aggcaggagaauugcuugaacccg

SEQ ID NO: 809208 - RNA, 21 nt, Human
aggcggagguugcagugagcc

SEQ ID NO: 809209 - RNA, 24 nt, Human
aggcggagguugcagugagccgag

SEQ ID NO: 809210 - RNA, 21 nt, Human
aggcugaggcaggagaauugc

SEQ ID NO: 809211 - RNA, 24 nt, Human
aggcugaggcaggagaauugcuug

SEQ ID NO: 809212 - RNA, 26 nt, Human
aggcuggaggcagcuuuaacccaaag

SEQ ID NO: 809213 - RNA, 21 nt, Human
agggagccucaggacaccugg

SEQ ID NO: 809214 - RNA, 22 nt, Human
augccacccuagaaagcagagc

SEQ ID NO: 809215 - RNA, 23 nt, Human
auugugccacugcacuccagccu

SEQ ID NO: 809216 - RNA, 22 nt, Human
caaagucagcaaccagcagccc

SEQ ID NO: 809217 - RNA, 19 nt, Human
caacauggugaaaccccgu

SEQ ID NO: 809218 - RNA, 24 nt, Human
caacauggugaaaccccguuucua

SEQ ID NO: 809219 - RNA, 18 nt, Human
cacccuagaaagcagagc

SEQ ID NO: 809220 - RNA, 23 nt, Human
cacccuagaaagcagagcccaga

SEQ ID NO: 809221 - RNA, 23 nt, Human
cacuccagccuaggugacacagc

SEQ ID NO: 809222 - RNA, 19 nt, Human
cacugcacuccagccuagg

SEQ ID NO: 809223 - RNA, 21 nt, Human
cacugcacuccagccuaggug

SEQ ID NO: 809224 - RNA, 22 nt, Human
cacugcacuccagccuagguga

SEQ ID NO: 809225 - RNA, 23 nt, Human
cacugcacuccagccuaggugac

SEQ ID NO: 809226 - RNA, 24 nt, Human
cacugcacuccagccuaggugaca

SEQ ID NO: 809227 - RNA, 21 nt, Human
cagaggguggcaaauguggca

SEQ ID NO: 809228 - RNA, 24 nt, Human
cagcacuuugggaggccgcagcag

SEQ ID NO: 809229 - RNA, 28 nt, Human
cagcacuuugggaggccgcagcaggcgg

SEQ ID NO: 809230 - RNA, 18 nt, Human
cagcagcccgagggagag

SEQ ID NO: 809231 - RNA, 24 nt, Human
cagcgugugccuguagucccagcu

SEQ ID NO: 809232 - RNA, 24 nt, Human
cagcuaucugggaggcugaggcag

SEQ ID NO: 809233 - RNA, 21 nt, Human
caggacaccuggucucaggcu

SEQ ID NO: 809234 - RNA, 18 nt, Human
ccacacugcuccugaggc

SEQ ID NO: 809235 - RNA, 19 nt, Human
ccacugcacuccagccuag

SEQ ID NO: 809236 - RNA, 20 nt, Human
ccacugcacuccagccuagg

SEQ ID NO: 809237 - RNA, 20 nt, Human
ccacugcacuccagccuagg

SEQ ID NO: 809238 - RNA, 21 nt, Human
ccacugcacuccagccuaggu

SEQ ID NO: 809239 - RNA, 24 nt, Human
ccacugcacuccagccuaggugac

SEQ ID NO: 809240 - RNA, 18 nt, Human
ccagaggaggaagcccug

SEQ ID NO: 809241 - RNA, 19 nt, Human
ccccaggcccagaaaugcc

SEQ ID NO: 809242 - RNA, 18 nt, Human
ccccugggacagcugagg

SEQ ID NO: 809243 - RNA, 21 nt, Human
cccugggacagcugagggccc

SEQ ID NO: 809244 - RNA, 28 nt, Human
ccucccugcaaauggcgggggugggggc

SEQ ID NO: 809245 - RNA, 24 nt, Human
ccugagcaacauggugaaaccccg

SEQ ID NO: 809246 - RNA, 21 nt, Human
ccugcaaauggcggggguggg

SEQ ID NO: 809247 - RNA, 19 nt, Human
ccuguagucccagcuaucu

SEQ ID NO: 809248 - RNA, 21 nt, Human
ccuguagucccagcuaucugg

SEQ ID NO: 809249 - RNA, 20 nt, Human
cgccugugaucccagcacuu

SEQ ID NO: 809250 - RNA, 24 nt, Human
cgccugugaucccagcacuuuggg

SEQ ID NO: 809251 - RNA, 24 nt, Human
cgggaggcggagguugcagugagc

SEQ ID NO: 809252 - RNA, 22 nt, Human
cucaaaaagaaaaaaaaaaaga

SEQ ID NO: 809253 - RNA, 24 nt, Human
cucaaaaagaaaaaaaaaaagaaa

SEQ ID NO: 809254 - RNA, 26 nt, Human
cuccugaggcuggaggcaggguaccc

SEQ ID NO: 809255 - RNA, 19 nt, Human
cuggcccucaucuuccucc

SEQ ID NO: 809256 - RNA, 23 nt, Human
cugggaggcugaggcaggagaau

SEQ ID NO: 809257 - RNA, 23 nt, Human
cugucucaaaaagaaaaaaaaaa

SEQ ID NO: 809258 - RNA, 21 nt, Human
cugugcccaggacuggugggc

SEQ ID NO: 809259 - RNA, 19 nt, Human
gaauggaauccgcuaguga

SEQ ID NO: 809260 - RNA, 22 nt, Human
gacagcugagggcccucuuggg

SEQ ID NO: 809261 - RNA, 23 nt, Human
gagauugugccacugcacuccag

SEQ ID NO: 809262 - RNA, 25 nt, Human
gagcacggacagaggaaggggcugg

SEQ ID NO: 809263 - RNA, 23 nt, Human
gaggaggacgggcccgggcugcc

SEQ ID NO: 809264 - RNA, 23 nt, Human
gagguugcagugagccgagauug

SEQ ID NO: 809265 - RNA, 21 nt, Human
gagucuguaaauccagugggu

SEQ ID NO: 809266 - RNA, 19 nt, Human
gcagcaggcggauugccug

SEQ ID NO: 809267 - RNA, 21 nt, Human
gcccacugcccccugggacag

SEQ ID NO: 809268 - RNA, 24 nt, Human
gcgcagagcugaugugguccccag

SEQ ID NO: 809269 - RNA, 20 nt, Human
gcgcaguggcuggcgccugu

SEQ ID NO: 809270 - RNA, 20 nt, Human
gcuagugaacauguuuguuu

SEQ ID NO: 809271 - RNA, 22 nt, Human
ggagguugcagugagccgagau

SEQ ID NO: 809272 - RNA, 24 nt, Human
ggagguugcagugagccgagauug

SEQ ID NO: 809273 - RNA, 25 nt, Human
ggcccgggcugccggggcaggcugg

SEQ ID NO: 809274 - RNA, 24 nt, Human
ggcgccugugaucccagcacuuug

SEQ ID NO: 809275 - RNA, 20 nt, Human
ggcuggagucuguaaaucca

SEQ ID NO: 809276 - RNA, 18 nt, Human
gggcagcugugcccagga

SEQ ID NO: 809277 - RNA, 19 nt, Human
gggcagcugugcccaggac

SEQ ID NO: 809278 - RNA, 24 nt, Human
gggcgcaguggcuggcgccuguga

SEQ ID NO: 809279 - RNA, 18 nt, Human
gggcguggcagcgugugc

SEQ ID NO: 809280 - RNA, 21 nt, Human
ggggugggggcugcugauggc

SEQ ID NO: 809281 - RNA, 21 nt, Human
gguggcugggguuggccugag

SEQ ID NO: 809282 - RNA, 21 nt, Human
ggugggggcugcugauggcag

SEQ ID NO: 809283 - RNA, 21 nt, Human
guaaauccagugggugacaug

SEQ ID NO: 809284 - RNA, 22 nt, Human
gucucaaaaagaaaaaaaaaaa

SEQ ID NO: 809285 - RNA, 24 nt, Human
guggcaucagaguuguucugggcc

SEQ ID NO: 809286 - RNA, 24 nt, Human
guugcagugagccgagauugugcc

SEQ ID NO: 809287 - RNA, 19 nt, Human
uagcacggcugggucagga

SEQ ID NO: 809288 - RNA, 25 nt, Human
ucacaaggauggagaaaccaagguu

SEQ ID NO: 809289 - RNA, 19 nt, Human
ucagcugggcguggcagcg

SEQ ID NO: 809290 - RNA, 24 nt, Human
ucagcugggcguggcagcgugugc

SEQ ID NO: 809291 - RNA, 19 nt, Human
uccccaggcccagaaaugc

SEQ ID NO: 809292 - RNA, 20 nt, Human
ugaaacagacgaggacauuc

SEQ ID NO: 809293 - RNA, 26 nt, Human
ugagcacggacagaggaaggggcugg

SEQ ID NO: 809294 - RNA, 22 nt, Human
ugagccgagauugugccacugc

SEQ ID NO: 809295 - RNA, 24 nt, Human
ugaggcaggagaauugcuugaacc

SEQ ID NO: 809296 - RNA, 25 nt, Human
ugaggcaggagaauugcuugaaccc

SEQ ID NO: 809297 - RNA, 18 nt, Human
ugauggcagguuggggug

SEQ ID NO: 809298 - RNA, 25 nt, Human
ugcacuguccaguuuggagacugcu

SEQ ID NO: 809299 - RNA, 19 nt, Human
ugcccuggccagcugguga

SEQ ID NO: 809300 - RNA, 23 nt, Human
ugccuguagucccagcuaucugg

SEQ ID NO: 809301 - RNA, 24 nt, Human
ugccuguagucccagcuaucuggg

SEQ ID NO: 809302 - RNA, 24 nt, Human
uggcagcgugugccuguaguccca

SEQ ID NO: 809303 - RNA, 23 nt, Human
uggcaucagaguuguucugggcc

SEQ ID NO: 809304 - RNA, 25 nt, Human
uggcgggggugggggcugccgacuc

SEQ ID NO: 809305 - RNA, 21 nt, Human
uggcuggcgccugugauccca

SEQ ID NO: 809306 - RNA, 24 nt, Human
uggcuggcgccugugaucccagca

SEQ ID NO: 809307 - RNA, 24 nt, Human
ugggacagcugagggcccucuugg

SEQ ID NO: 809308 - RNA, 22 nt, Human
ugggaggccgcagcaggcggau

SEQ ID NO: 809309 - RNA, 19 nt, Human
ugggaggcugaggcaggag

SEQ ID NO: 809310 - RNA, 22 nt, Human
ugggaggcugaggcaggagaau

SEQ ID NO: 809311 - RNA, 25 nt, Human
ugggcccuugugcacuguccaguuu

SEQ ID NO: 809312 - RNA, 25 nt, Human
ugggccgggcgcaguggcuggcgcc

SEQ ID NO: 809313 - RNA, 22 nt, Human
ugggucaggagaacugcaucug

SEQ ID NO: 809314 - RNA, 22 nt, Human
uguagggcagcugugcccagga

SEQ ID NO: 809315 - RNA, 24 nt, Human
uguccggguagcacggcuggguca

SEQ ID NO: 809316 - RNA, 20 nt, Human
uguggcagugcagggagccu

SEQ ID NO: 809317 - RNA, 22 nt, Human
uguggcagugcagggagccuca

SEQ ID NO: 809318 - RNA, 20 nt, Human
uuaagggagacacacugggc

SEQ ID NO: 809319 - RNA, 24 nt, Human
uugaacccgggaggcggagguugc

SEQ ID NO: 809320 - RNA, 22 nt, Human
uugcagugagccgagauugugc

SEQ ID NO: 809321 - RNA, 24 nt, Human
uugcuugaacccgggaggcggagg

SEQ ID NO: 809322 - RNA, 19 nt, Human
uugugguggcaucagaguu

SEQ ID NO: 809323 - RNA, 22 nt, Human
aaaaagaccccuucagagagca

SEQ ID NO: 809324 - RNA, 21 nt, Human
aaaagugugaauacagcucug

SEQ ID NO: 809325 - RNA, 18 nt, Human
aaagaacucacuaccucu

SEQ ID NO: 809326 - RNA, 18 nt, Human
aaagggagugguggagac

SEQ ID NO: 809327 - RNA, 26 nt, Human
aaccacggaaagugaaaccacagaua

SEQ ID NO: 809328 - RNA, 25 nt, Human
aaccccucccagaccuuuucuacua

SEQ ID NO: 809329 - RNA, 18 nt, Human
aagccaguccaccuucca

SEQ ID NO: 809330 - RNA, 24 nt, Human
aaggaccaccaggaaccccaggca

SEQ ID NO: 809331 - RNA, 20 nt, Human
aagggagugguggagacuac

SEQ ID NO: 809332 - RNA, 19 nt, Human
aagguaucaucuuccaaaa

SEQ ID NO: 809333 - RNA, 23 nt, Human
aauauuuaaggccauauauuuaa

SEQ ID NO: 809334 - RNA, 23 nt, Human
acaaacauugacacugaagccau

SEQ ID NO: 809335 - RNA, 23 nt, Human
acacacacacacacacacacaca

SEQ ID NO: 809336 - RNA, 25 nt, Human
acacuuccuucaaucauuucuccug

SEQ ID NO: 809337 - RNA, 23 nt, Human
acagaauucuccaucagagugag

SEQ ID NO: 809338 - RNA, 21 nt, Human
accaggaaccccaggcagggc

SEQ ID NO: 809339 - RNA, 19 nt, Human
accccucccagaccuuuuc

SEQ ID NO: 809340 - RNA, 20 nt, Human
accucacgaauacaucaguc

SEQ ID NO: 809341 - RNA, 25 nt, Human
acugagcuaacuggcuacccgaaag

SEQ ID NO: 809342 - RNA, 25 nt, Human
acuggaguacaaaaaauaucucagu

SEQ ID NO: 809343 - RNA, 21 nt, Human
acuguaucauuaccaucccca

SEQ ID NO: 809344 - RNA, 23 nt, Human
agaacaguacacaauuuaaaaca

SEQ ID NO: 809345 - RNA, 22 nt, Human
agaauaaauucuuucugcugga

SEQ ID NO: 809346 - RNA, 27 nt, Human
agacaagaaggggaggagaagggaccc

SEQ ID NO: 809347 - RNA, 19 nt, Human
agacccuccccgcaccccc

SEQ ID NO: 809348 - RNA, 22 nt, Human
agacgaauccccauccuccuga

SEQ ID NO: 809349 - RNA, 22 nt, Human
agagugagagagugaagucuau

SEQ ID NO: 809350 - RNA, 24 nt, Human
agccauaguaaaugcaucacagcc

SEQ ID NO: 809351 - RNA, 25 nt, Human
agcccugcaagacucucccuaaaaa

SEQ ID NO: 809352 - RNA, 23 nt, Human
aggaaaucauggagacccaggac

SEQ ID NO: 809353 - RNA, 18 nt, Human
agggauuccccuuuccag

SEQ ID NO: 809354 - RNA, 21 nt, Human
aggggagacaagaaggggagg

SEQ ID NO: 809355 - RNA, 25 nt, Human
agugaaaugaaaccacggaaaguga

SEQ ID NO: 809356 - RNA, 21 nt, Human
aguuauuguauuuuucuaaaa

SEQ ID NO: 809357 - RNA, 19 nt, Human
auagggaaaccccuaaagg

SEQ ID NO: 809358 - RNA, 24 nt, Human
aucucaccuuccucugaaauccac

SEQ ID NO: 809359 - RNA, 23 nt, Human
augaaaccacggaaagugaaacc

SEQ ID NO: 809360 - RNA, 20 nt, Human
auuuaacguuuuuggacugu

SEQ ID NO: 809361 - RNA, 24 nt, Human
caaaaaauguaauacaccaagcuc

SEQ ID NO: 809362 - RNA, 26 nt, Human
caaaaagaccccuucagagagcauga

SEQ ID NO: 809363 - RNA, 23 nt, Human
caaaaagcugucaugucucccuc

SEQ ID NO: 809364 - RNA, 18 nt, Human
caacaagaagaaaucaac

SEQ ID NO: 809365 - RNA, 20 nt, Human
caacaagaagaaaucaaccc

SEQ ID NO: 809366 - RNA, 24 nt, Human
caagaguccucagccucucagaca

SEQ ID NO: 809367 - RNA, 20 nt, Human
cacacacacacacacacaca

SEQ ID NO: 809368 - RNA, 20 nt, Human
cacacacacacacacacaca

SEQ ID NO: 809369 - RNA, 20 nt, Human
cacacacacacacacacaca

SEQ ID NO: 809370 - RNA, 20 nt, Human
cacacacacacacacacaca

SEQ ID NO: 809371 - RNA, 22 nt, Human
cacacacacacacacacacaca

SEQ ID NO: 809372 - RNA, 19 nt, Human
cacacuguggccuuaacuu

SEQ ID NO: 809373 - RNA, 19 nt, Human
caccaggaaccccaggcag

SEQ ID NO: 809374 - RNA, 24 nt, Human
cacccgggcuggggugcaguggcg

SEQ ID NO: 809375 - RNA, 22 nt, Human
caccugcugcagccgccugcug

SEQ ID NO: 809376 - RNA, 24 nt, Human
cacuuccuucaaucauuucuccug

SEQ ID NO: 809377 - RNA, 26 nt, Human
cagaacaaguuucuguucaugucuuu

SEQ ID NO: 809378 - RNA, 21 nt, Human
cagacccuccccgcacccccc

SEQ ID NO: 809379 - RNA, 20 nt, Human
cagccgccugcugauuccag

SEQ ID NO: 809380 - RNA, 23 nt, Human
cagccgccugcugauuccaggga

SEQ ID NO: 809381 - RNA, 18 nt, Human
cagggcaagagaaggagg

SEQ ID NO: 809382 - RNA, 20 nt, Human
caucaccugcugcagccgcc

SEQ ID NO: 809383 - RNA, 20 nt, Human
cauguauguccucugauucu

SEQ ID NO: 809384 - RNA, 21 nt, Human
cauugucaauagcaaccaaca

SEQ ID NO: 809385 - RNA, 18 nt, Human
ccaauuuuuuauuguucu

SEQ ID NO: 809386 - RNA, 18 nt, Human
ccaccucaccccugagcc

SEQ ID NO: 809387 - RNA, 23 nt, Human
ccagcagaacaaguuucuguuca

SEQ ID NO: 809388 - RNA, 18 nt, Human
ccaguggaugccugaaac

SEQ ID NO: 809389 - RNA, 18 nt, Human
cccugaggucucugcugc

SEQ ID NO: 809390 - RNA, 23 nt, Human
cccuucagagagcaugaaaaaaa

SEQ ID NO: 809391 - RNA, 21 nt, Human
ccgcaaaagucauacaaucac

SEQ ID NO: 809392 - RNA, 26 nt, Human
ccgcaccccccacacacuucuggguc

SEQ ID NO: 809393 - RNA, 23 nt, Human
ccuccagcccuuuagagcauggg

SEQ ID NO: 809394 - RNA, 19 nt, Human
ccugcaagacucucccuaa

SEQ ID NO: 809395 - RNA, 18 nt, Human
ccuuucucccugaggucu

SEQ ID NO: 809396 - RNA, 20 nt, Human
cgcacacacacacacacaca

SEQ ID NO: 809397 - RNA, 23 nt, Human
cuacaaacauugacacugaagcc

SEQ ID NO: 809398 - RNA, 18 nt, Human
cuaugccaaacuugaguu

SEQ ID NO: 809399 - RNA, 22 nt, Human
cucaaccaaagaacucacuacc

SEQ ID NO: 809400 - RNA, 23 nt, Human
cucaccuuuucacuuaaaagaag

SEQ ID NO: 809401 - RNA, 24 nt, Human
cuccccgcaccccccacacacuuc

SEQ ID NO: 809402 - RNA, 24 nt, Human
cucgcucugucacccgggcugggg

SEQ ID NO: 809403 - RNA, 23 nt, Human
cucucaccuuuucacuuaaaaga

SEQ ID NO: 809404 - RNA, 19 nt, Human
cucucagacacuuuuuggc

SEQ ID NO: 809405 - RNA, 18 nt, Human
cugcagacugccugccug

SEQ ID NO: 809406 - RNA, 23 nt, Human
cugugaacuuggaccugccccuc

SEQ ID NO: 809407 - RNA, 19 nt, Human
cuugccaauuuuuacaugg

SEQ ID NO: 809408 - RNA, 19 nt, Human
cuuggaguuauaguaaaau

SEQ ID NO: 809409 - RNA, 23 nt, Human
gaaaccacagauagaacugaauc

SEQ ID NO: 809410 - RNA, 20 nt, Human
gaaaugaaaccacggaaagu

SEQ ID NO: 809411 - RNA, 22 nt, Human
gaacuuggaccugccccucuag

SEQ ID NO: 809412 - RNA, 21 nt, Human
gacaaauauccuucaaccucc

SEQ ID NO: 809413 - RNA, 21 nt, Human
gaccacagugaaaugaaaccc

SEQ ID NO: 809414 - RNA, 19 nt, Human
gacccuccccgcacccccc

SEQ ID NO: 809415 - RNA, 24 nt, Human
gagcaggaagacucaagauuucuu

SEQ ID NO: 809416 - RNA, 27 nt, Human
gagccuuuucuucucaucaauaggcuu

SEQ ID NO: 809417 - RNA, 23 nt, Human
gagugguggagacuacagugagc

SEQ ID NO: 809418 - RNA, 24 nt, Human
gcaaaagucauacaaucacaggcc

SEQ ID NO: 809419 - RNA, 22 nt, Human
gcucugaggcacacacccauuc

SEQ ID NO: 809420 - RNA, 22 nt, Human
gcugucaugucucccucuccac

SEQ ID NO: 809421 - RNA, 18 nt, Human
ggacugugauugaccaca

SEQ ID NO: 809422 - RNA, 18 nt, Human
ggucagcuguuuccuccu

SEQ ID NO: 809423 - RNA, 20 nt, Human
ggugcaguggcgcaauccug

SEQ ID NO: 809424 - RNA, 27 nt, Human
gugaacuuaauuuuauuccguauuuac

SEQ ID NO: 809425 - RNA, 22 nt, Human
gugaacuuggaccugccccucu

SEQ ID NO: 809426 - RNA, 18 nt, Human
uaaaaagcacaaagcuac

SEQ ID NO: 809427 - RNA, 23 nt, Human
uaaaauagcugaauagauuggac

SEQ ID NO: 809428 - RNA, 22 nt, Human
uaaaucgccucaauugacacaa

SEQ ID NO: 809429 - RNA, 24 nt, Human
uaacccacugagcuaacuggcuac

SEQ ID NO: 809430 - RNA, 23 nt, Human
uaaccucuaaacaagagcuugua

SEQ ID NO: 809431 - RNA, 20 nt, Human
uaagacacagcauccuguag

SEQ ID NO: 809432 - RNA, 21 nt, Human
uaagccaguccaccuuccaua

SEQ ID NO: 809433 - RNA, 19 nt, Human
uaaggaaacuaggcucaga

SEQ ID NO: 809434 - RNA, 21 nt, Human
uaauuuguuagacgaaucccc

SEQ ID NO: 809435 - RNA, 24 nt, Human
uacuaaaugacucagaggugggug

SEQ ID NO: 809436 - RNA, 18 nt, Human
uagaacugaaucagacug

SEQ ID NO: 809437 - RNA, 22 nt, Human
uagcaacaucacaugucuggaa

SEQ ID NO: 809438 - RNA, 22 nt, Human
uagcagaaaugucccauuuccu

SEQ ID NO: 809439 - RNA, 18 nt, Human
uagcagaauuuggaguca

SEQ ID NO: 809440 - RNA, 19 nt, Human
uagcagaauuuggagucag

SEQ ID NO: 809441 - RNA, 23 nt, Human
uagcagccuuaucaaacaguuga

SEQ ID NO: 809442 - RNA, 21 nt, Human
uagccgaauugccagcaucac

SEQ ID NO: 809443 - RNA, 22 nt, Human
uaggaaacuacagacugaauca

SEQ ID NO: 809444 - RNA, 22 nt, Human
uaggugacagcugagcaaaaag

SEQ ID NO: 809445 - RNA, 24 nt, Human
uaucuaaggacgaugagcauucca

SEQ ID NO: 809446 - RNA, 21 nt, Human
ucaaaaacuaggagcacaagu

SEQ ID NO: 809447 - RNA, 18 nt, Human
ucaaaaagaccccuucag

SEQ ID NO: 809448 - RNA, 20 nt, Human
ucaaaaucauguauguccuc

SEQ ID NO: 809449 - RNA, 22 nt, Human
ucacccgggcuggggugcagug

SEQ ID NO: 809450 - RNA, 23 nt, Human
ucagagagcaugaaaaaaauauu

SEQ ID NO: 809451 - RNA, 22 nt, Human
ucagaggaucucuccaaagggu

SEQ ID NO: 809452 - RNA, 20 nt, Human
ucagggcaagagaaggagga

SEQ ID NO: 809453 - RNA, 23 nt, Human
uccacuaucaaaaacuaggagca

SEQ ID NO: 809454 - RNA, 23 nt, Human
uccacuguaucauuaccaucccc

SEQ ID NO: 809455 - RNA, 20 nt, Human
uccaggaaagagucuaugcc

SEQ ID NO: 809456 - RNA, 22 nt, Human
ucccucuccaccucaccccuga

SEQ ID NO: 809457 - RNA, 24 nt, Human
ucgcucugucacccgggcuggggu

SEQ ID NO: 809458 - RNA, 25 nt, Human
ucuaaaaagcacaaagcuacuccau

SEQ ID NO: 809459 - RNA, 18 nt, Human
ucuaagacccccagugga

SEQ ID NO: 809460 - RNA, 24 nt, Human
ucuacagcauggauaugccagaca

SEQ ID NO: 809461 - RNA, 23 nt, Human
ucuccaccucaccccugagccuu

SEQ ID NO: 809462 - RNA, 22 nt, Human
ucucccugaggucucugcugca

SEQ ID NO: 809463 - RNA, 19 nt, Human
ucucgcucugucacccggg

SEQ ID NO: 809464 - RNA, 23 nt, Human
ucucgcucugucacccgggcugg

SEQ ID NO: 809465 - RNA, 23 nt, Human
ucucgcucugucacccgggcugg

SEQ ID NO: 809466 - RNA, 24 nt, Human
ucucgcucugucacccgggcuggg

SEQ ID NO: 809467 - RNA, 24 nt, Human
ucugucacccgggcuggggugcag

SEQ ID NO: 809468 - RNA, 25 nt, Human
ugaaaauuuucauuuaacguuuuug

SEQ ID NO: 809469 - RNA, 25 nt, Human
ugaaaccacagauaaggaaggacua

SEQ ID NO: 809470 - RNA, 18 nt, Human
ugaaaccacagauagaac

SEQ ID NO: 809471 - RNA, 20 nt, Human
ugaacuuggaccugccccuc

SEQ ID NO: 809472 - RNA, 21 nt, Human
ugacucacuggaucccaauac

SEQ ID NO: 809473 - RNA, 20 nt, Human
ugagcccugcaagacucucc

SEQ ID NO: 809474 - RNA, 21 nt, Human
ugagcuggagggcacagguuu

SEQ ID NO: 809475 - RNA, 22 nt, Human
ugaggucucugcugcaaaagca

SEQ ID NO: 809476 - RNA, 21 nt, Human
ugccaaggucauagcucugug

SEQ ID NO: 809477 - RNA, 19 nt, Human
ugccugccugugaccucug

SEQ ID NO: 809478 - RNA, 19 nt, Human
uggaugccugaaaccacag

SEQ ID NO: 809479 - RNA, 19 nt, Human
ugggauggagcaggaagac

SEQ ID NO: 809480 - RNA, 21 nt, Human
ugggauggagcaggaagacuc

SEQ ID NO: 809481 - RNA, 24 nt, Human
uggggugcaguggcgcaauccugg

SEQ ID NO: 809482 - RNA, 22 nt, Human
ugggugaacuuaauuuuauuug

SEQ ID NO: 809483 - RNA, 21 nt, Human
uguauguccucugauucuguc

SEQ ID NO: 809484 - RNA, 23 nt, Human
ugugaggaagggcagaacucuga

SEQ ID NO: 809485 - RNA, 18 nt, Human
ugugugugugcgcacaca

SEQ ID NO: 809486 - RNA, 23 nt, Human
uuagaacaaaucucuagaaaagu

SEQ ID NO: 809487 - RNA, 18 nt, Human
uuaguacauuugugugga

SEQ ID NO: 809488 - RNA, 24 nt, Human
uuauuguuaguucugccguuugcu

SEQ ID NO: 809489 - RNA, 18 nt, Human
uucacauuuuucccuuau

SEQ ID NO: 809490 - RNA, 20 nt, Human
uucacuuaaaagaagcacuu

SEQ ID NO: 809491 - RNA, 19 nt, Human
uuccaaaacaacgucuaug

SEQ ID NO: 809492 - RNA, 21 nt, Human
uucuagaaugacaugggaaua

SEQ ID NO: 809493 - RNA, 19 nt, Human
uugacacugaagccauagu

SEQ ID NO: 809494 - RNA, 18 nt, Human
uuggacuuuggggcucuc

SEQ ID NO: 809495 - RNA, 23 nt, Human
uuuaaacuaugcagacccucccc

SEQ ID NO: 809496 - RNA, 18 nt, Human
uuuaacguuuuuggacug

SEQ ID NO: 809497 - RNA, 19 nt, Human
uuuaaugucuuuucacauc

SEQ ID NO: 809498 - RNA, 19 nt, Human
uuucacuuuguuccucuga

SEQ ID NO: 809499 - RNA, 24 nt, Human
uuucugguuccuagcagaauuugg

SEQ ID NO: 809500 - RNA, 23 nt, Human
uuuggugagcccugcaagacucu

SEQ ID NO: 809501 - RNA, 18 nt, Human
uuuuaugcagaggagcaa

SEQ ID NO: 809502 - RNA, 25 nt, Human
aaaaauauagauucccaggcucucc

SEQ ID NO: 809503 - RNA, 21 nt, Human
aaaacacaaauguguaagucc

SEQ ID NO: 809504 - RNA, 20 nt, Human
aaaaguuggaaaaaaacugc

SEQ ID NO: 809505 - RNA, 19 nt, Human
aaaauuaugacaggacaaa

SEQ ID NO: 809506 - RNA, 22 nt, Human
aaacaggagacugcuugcaagg

SEQ ID NO: 809507 - RNA, 23 nt, Human
aaacucagcagguuaugucaaaa

SEQ ID NO: 809508 - RNA, 22 nt, Human
aacuuaaaauaaaaguuggaaa

SEQ ID NO: 809509 - RNA, 22 nt, Human
aagaaaaacagaaaauguccaa

SEQ ID NO: 809510 - RNA, 20 nt, Human
aagagaaaacaaaacacaaa

SEQ ID NO: 809511 - RNA, 22 nt, Human
aagagucaaaagcuauacacuu

SEQ ID NO: 809512 - RNA, 23 nt, Human
aaguuugggcuuuuuuuuuccuu

SEQ ID NO: 809513 - RNA, 19 nt, Human
aaucucaucauccuuccac

SEQ ID NO: 809514 - RNA, 18 nt, Human
acaaaacuaaaaaguuga

SEQ ID NO: 809515 - RNA, 21 nt, Human
acacaaauucacaaauguucu

SEQ ID NO: 809516 - RNA, 21 nt, Human
accaaaaagugaccuaaucau

SEQ ID NO: 809517 - RNA, 21 nt, Human
acccuaucucauaagucucug

SEQ ID NO: 809518 - RNA, 19 nt, Human
accuuggguaaacaaaacu

SEQ ID NO: 809519 - RNA, 23 nt, Human
acuaaaugcugaaaaaacaaaga

SEQ ID NO: 809520 - RNA, 18 nt, Human
acucaucccaaaucacug

SEQ ID NO: 809521 - RNA, 25 nt, Human
acuuugaaggaacaaaacuaaaaag

SEQ ID NO: 809522 - RNA, 22 nt, Human
agaauucuuuacaccacaccuu

SEQ ID NO: 809523 - RNA, 22 nt, Human
agagacuauuccgagguucugu

SEQ ID NO: 809524 - RNA, 20 nt, Human
agaguacauauucacaacaa

SEQ ID NO: 809525 - RNA, 19 nt, Human
agcagaaguagagacaacu

SEQ ID NO: 809526 - RNA, 18 nt, Human
aggaaaaggcauacugaa

SEQ ID NO: 809527 - RNA, 22 nt, Human
aggauaaaagcugaaagcaaaa

SEQ ID NO: 809528 - RNA, 19 nt, Human
aguaguaguguuagccucu

SEQ ID NO: 809529 - RNA, 20 nt, Human
agucacauuauuuucauuuu

SEQ ID NO: 809530 - RNA, 21 nt, Human
aguuggaaaaaaacugcaugu

SEQ ID NO: 809531 - RNA, 18 nt, Human
auaaaguauacuguauac

SEQ ID NO: 809532 - RNA, 21 nt, Human
auacugaauacuuuuacuuca

SEQ ID NO: 809533 - RNA, 22 nt, Human
augaauuuuauaaaaccaaacu

SEQ ID NO: 809534 - RNA, 18 nt, Human
auuggaggguuggccuga

SEQ ID NO: 809535 - RNA, 22 nt, Human
caaaaaaaaccuaaguguccug

SEQ ID NO: 809536 - RNA, 24 nt, Human
caaaacacaaauguguaaguccca

SEQ ID NO: 809537 - RNA, 21 nt, Human
caaaaccugaaacgucccaaa

SEQ ID NO: 809538 - RNA, 25 nt, Human
caaaaccugaaacgucccaaaacau

SEQ ID NO: 809539 - RNA, 22 nt, Human
caacuucauuuagggaaauuac

SEQ ID NO: 809540 - RNA, 18 nt, Human
caauaaagauggggccca

SEQ ID NO: 809541 - RNA, 21 nt, Human
cacaaauguguaagucccaga

SEQ ID NO: 809542 - RNA, 19 nt, Human
cacaacaaccucuuuuagg

SEQ ID NO: 809543 - RNA, 21 nt, Human
caccacacugcuucucuagcu

SEQ ID NO: 809544 - RNA, 18 nt, Human
cacccaaccaaaaccuga

SEQ ID NO: 809545 - RNA, 24 nt, Human
cacucucaggauaaaagcugaaag

SEQ ID NO: 809546 - RNA, 20 nt, Human
cacuucaaaagagucaaaag

SEQ ID NO: 809547 - RNA, 23 nt, Human
cacuuuguagguagaauuagaag

SEQ ID NO: 809548 - RNA, 22 nt, Human
cagaccaauuaaaucagaaucu

SEQ ID NO: 809549 - RNA, 19 nt, Human
caucagaaauaauauucua

SEQ ID NO: 809550 - RNA, 25 nt, Human
caugcaaagauuuuggggacaacca

SEQ ID NO: 809551 - RNA, 23 nt, Human
cauggcacacauuuacuuauaua

SEQ ID NO: 809552 - RNA, 18 nt, Human
cauuuagaaucacauaau

SEQ ID NO: 809553 - RNA, 25 nt, Human
ccaaccuuugccucugaaucucuua

SEQ ID NO: 809554 - RNA, 19 nt, Human
ccaggcucuccccuggaga

SEQ ID NO: 809555 - RNA, 24 nt, Human
cccaaaacauuaaaaacaaauaaa

SEQ ID NO: 809556 - RNA, 18 nt, Human
ccccuggagaacaugauu

SEQ ID NO: 809557 - RNA, 30 nt, Human
ccccuggagaacaugauucaauguuucuag

SEQ ID NO: 809558 - RNA, 19 nt, Human
ccucuauacaacacugacu

SEQ ID NO: 809559 - RNA, 19 nt, Human
ccucucagagcccacaccu

SEQ ID NO: 809560 - RNA, 23 nt, Human
ccucuugcuuuugucuaaagucc

SEQ ID NO: 809561 - RNA, 20 nt, Human
ccuugucugagcaaagacua

SEQ ID NO: 809562 - RNA, 26 nt, Human
cuaaaugcugaaaaaacaaagaguuc

SEQ ID NO: 809563 - RNA, 25 nt, Human
cuccucuuaccauaaaucaauacca

SEQ ID NO: 809564 - RNA, 21 nt, Human
cuccuggggccugccuccauu

SEQ ID NO: 809565 - RNA, 23 nt, Human
cucucagagcccacaccucuuaa

SEQ ID NO: 809566 - RNA, 26 nt, Human
cucuuaaccagccucuuuuuguuugc

SEQ ID NO: 809567 - RNA, 20 nt, Human
cugaaacuuguggggccuac

SEQ ID NO: 809568 - RNA, 18 nt, Human
cugacucugaagaaaaug

SEQ ID NO: 809569 - RNA, 19 nt, Human
cuguauacaguguucuccu

SEQ ID NO: 809570 - RNA, 21 nt, Human
cuguauacaguguucuccucc

SEQ ID NO: 809571 - RNA, 20 nt, Human
cugucucuucugucuuuucu

SEQ ID NO: 809572 - RNA, 26 nt, Human
cuucacaucugcacaugcacccauga

SEQ ID NO: 809573 - RNA, 18 nt, Human
cuugcagcccacaggcca

SEQ ID NO: 809574 - RNA, 19 nt, Human
cuuguggggccuacucuuc

SEQ ID NO: 809575 - RNA, 24 nt, Human
cuuuacaccacaccacacugcuuc

SEQ ID NO: 809576 - RNA, 20 nt, Human
cuuuaucgcuuguacccuuc

SEQ ID NO: 809577 - RNA, 24 nt, Human
gaaaaggauacccuggaugacaga

SEQ ID NO: 809578 - RNA, 23 nt, Human
gaaucacauaauguuagaacugg

SEQ ID NO: 809579 - RNA, 22 nt, Human
gaauuuuauaaaaccaaacuuu

SEQ ID NO: 809580 - RNA, 18 nt, Human
gagguuaaguuugggcuu

SEQ ID NO: 809581 - RNA, 20 nt, Human
gaucaagcuuguccaacuug

SEQ ID NO: 809582 - RNA, 21 nt, Human
gaugacagacaucaagaaaaa

SEQ ID NO: 809583 - RNA, 19 nt, Human
gccacauguggcccaaggu

SEQ ID NO: 809584 - RNA, 21 nt, Human
gccccaaggucagaauuccug

SEQ ID NO: 809585 - RNA, 19 nt, Human
gcugcacacuacuggcuau

SEQ ID NO: 809586 - RNA, 18 nt, Human
gcuuuuuuuuuccuucuu

SEQ ID NO: 809587 - RNA, 18 nt, Human
ggaaaagccaauugagag

SEQ ID NO: 809588 - RNA, 23 nt, Human
ggaaauauguaucuccucuuacc

SEQ ID NO: 809589 - RNA, 19 nt, Human
ggaaauggaaauauguauc

SEQ ID NO: 809590 - RNA, 19 nt, Human
ggccugagcaaugggaguu

SEQ ID NO: 809591 - RNA, 21 nt, Human
gggcccaggaaaacucagcag

SEQ ID NO: 809592 - RNA, 24 nt, Human
guggggccuacucuuccccuaauc

SEQ ID NO: 809593 - RNA, 18 nt, Human
uaaaaacaaauaaaggca

SEQ ID NO: 809594 - RNA, 21 nt, Human
uaaaacaaaacuacuaguuac

SEQ ID NO: 809595 - RNA, 18 nt, Human
uaacagguuuccuuuucu

SEQ ID NO: 809596 - RNA, 27 nt, Human
uaacagguuuccuuuucucuuauguuc

SEQ ID NO: 809597 - RNA, 19 nt, Human
uaacuagcacacuauucca

SEQ ID NO: 809598 - RNA, 25 nt, Human
uaacuagcacacuauuccacuuugu

SEQ ID NO: 809599 - RNA, 23 nt, Human
uacaacacugacucucaauaaac

SEQ ID NO: 809600 - RNA, 20 nt, Human
uacccuagauuauugagcua

SEQ ID NO: 809601 - RNA, 24 nt, Human
uacccugaaacuuguggggccuac

SEQ ID NO: 809602 - RNA, 24 nt, Human
uagaaucacauaauguuagaacug

SEQ ID NO: 809603 - RNA, 19 nt, Human
uaggaaauggaaauaugua

SEQ ID NO: 809604 - RNA, 27 nt, Human
uaggcacccuuacuuuuugaaagcuuu

SEQ ID NO: 809605 - RNA, 21 nt, Human
uauaaagaaaaacagaaaaug

SEQ ID NO: 809606 - RNA, 18 nt, Human
uaucacaggcuuugugag

SEQ ID NO: 809607 - RNA, 19 nt, Human
uaugacuauaaacucagau

SEQ ID NO: 809608 - RNA, 25 nt, Human
uauggccccaaggucagaauuccug

SEQ ID NO: 809609 - RNA, 20 nt, Human
uauuucagaguuuuuacaua

SEQ ID NO: 809610 - RNA, 24 nt, Human
ucaaaaaagagaaaacaaaacaca

SEQ ID NO: 809611 - RNA, 22 nt, Human
ucaaagcauaaauugggaaagu

SEQ ID NO: 809612 - RNA, 18 nt, Human
ucaaccuuggguaaacaa

SEQ ID NO: 809613 - RNA, 18 nt, Human
ucaauacccaagaauaga

SEQ ID NO: 809614 - RNA, 20 nt, Human
ucacuuagggagucaaaaaa

SEQ ID NO: 809615 - RNA, 18 nt, Human
ucaguauaaauacauuua

SEQ ID NO: 809616 - RNA, 19 nt, Human
ucauaagucucugaacuaa

SEQ ID NO: 809617 - RNA, 24 nt, Human
ucauaagucucugaacuaaggucu

SEQ ID NO: 809618 - RNA, 20 nt, Human
ucauagaaacaggagacugc

SEQ ID NO: 809619 - RNA, 22 nt, Human
uccaauaaagauggggcccaga

SEQ ID NO: 809620 - RNA, 22 nt, Human
uccacccaaccaaaaccugaaa

SEQ ID NO: 809621 - RNA, 25 nt, Human
ucccucuauacaacacugacucuca

SEQ ID NO: 809622 - RNA, 23 nt, Human
uccugauugaauccuccuggggc

SEQ ID NO: 809623 - RNA, 25 nt, Human
uccuuuaucgcuuguacccuucaga

SEQ ID NO: 809624 - RNA, 24 nt, Human
ucuaaaguccauuuucuuagcuga

SEQ ID NO: 809625 - RNA, 23 nt, Human
ucuuauacucuccacucuuuuau

SEQ ID NO: 809626 - RNA, 24 nt, Human
ucuuauguucuccuugaguucuua

SEQ ID NO: 809627 - RNA, 20 nt, Human
ucuucccuaagaaucugcua

SEQ ID NO: 809628 - RNA, 21 nt, Human
ucuuuacaccacaccacacug

SEQ ID NO: 809629 - RNA, 18 nt, Human
ugaaaaaacaaagaguuc

SEQ ID NO: 809630 - RNA, 21 nt, Human
ugaaaaaacaaagaguucaag

SEQ ID NO: 809631 - RNA, 23 nt, Human
ugaaaauccuagaguagacucau

SEQ ID NO: 809632 - RNA, 22 nt, Human
ugaaagcaaaauucuaaaacaa

SEQ ID NO: 809633 - RNA, 19 nt, Human
ugaaucucuuaaccagccu

SEQ ID NO: 809634 - RNA, 19 nt, Human
ugaccuaaucauuucaaag

SEQ ID NO: 809635 - RNA, 21 nt, Human
ugacucaacacaaauucacaa

SEQ ID NO: 809636 - RNA, 22 nt, Human
ugagauaugugagaaacauuua

SEQ ID NO: 809637 - RNA, 22 nt, Human
ugauggguacuauauauacuac

SEQ ID NO: 809638 - RNA, 20 nt, Human
ugauuugaggcugaucaucu

SEQ ID NO: 809639 - RNA, 18 nt, Human
ugcacauaaucaaaacug

SEQ ID NO: 809640 - RNA, 22 nt, Human
ugcccagaauucuuuacaccac

SEQ ID NO: 809641 - RNA, 24 nt, Human
ugcccagaauucuuuacaccacac

SEQ ID NO: 809642 - RNA, 19 nt, Human
ugcgggcccaggaaaacuc

SEQ ID NO: 809643 - RNA, 23 nt, Human
uggaaaaaaacugcaugugaaua

SEQ ID NO: 809644 - RNA, 18 nt, Human
uggauuagugguucucaa

SEQ ID NO: 809645 - RNA, 19 nt, Human
uggcccauggaagccgaaa

SEQ ID NO: 809646 - RNA, 23 nt, Human
ugggcuuuuuuuuuccuucuuuu

SEQ ID NO: 809647 - RNA, 18 nt, Human
uguccugaagugacacug

SEQ ID NO: 809648 - RNA, 23 nt, Human
ugucuacuuacuguugcuacaug

SEQ ID NO: 809649 - RNA, 19 nt, Human
uguuguuguuucuucuuuu

SEQ ID NO: 809650 - RNA, 25 nt, Human
uguuucuucuuucaauuaaauuuca

SEQ ID NO: 809651 - RNA, 21 nt, Human
uuaaaaacaaauaaaggcaaa

SEQ ID NO: 809652 - RNA, 24 nt, Human
uuaaaauaaaaguuggaaaaaaac

SEQ ID NO: 809653 - RNA, 26 nt, Human
uuaaaauaaaaguuggaaaaaaacug

SEQ ID NO: 809654 - RNA, 23 nt, Human
uuaaacggggaaaagccaauuga

SEQ ID NO: 809655 - RNA, 21 nt, Human
uuagcccuuggcuuuuucaca

SEQ ID NO: 809656 - RNA, 21 nt, Human
uucaauacccaagaauagacu

SEQ ID NO: 809657 - RNA, 22 nt, Human
uucacaacaaccucuuuuagga

SEQ ID NO: 809658 - RNA, 19 nt, Human
uucauagaaacaggagacu

SEQ ID NO: 809659 - RNA, 18 nt, Human
uucccaggcucuccccug

SEQ ID NO: 809660 - RNA, 18 nt, Human
uuccccuaaucauaaccc

SEQ ID NO: 809661 - RNA, 21 nt, Human
uucuaugaucacaaauauggc

SEQ ID NO: 809662 - RNA, 23 nt, Human
uucucagagguuaaguuugggcu

SEQ ID NO: 809663 - RNA, 22 nt, Human
uucuuugauaccaagaaaagga

SEQ ID NO: 809664 - RNA, 25 nt, Human
uugaccagaagaagcaaauuaauac

SEQ ID NO: 809665 - RNA, 19 nt, Human
uuggucaaagucacagagc

SEQ ID NO: 809666 - RNA, 23 nt, Human
uuuaaaaaucucaucauccuucc

SEQ ID NO: 809667 - RNA, 27 nt, Human
uuuaaaaaucucaucauccuuccacuu

SEQ ID NO: 809668 - RNA, 27 nt, Human
uuuccucaauuaauccuugggcaaaca

SEQ ID NO: 809669 - RNA, 22 nt, Human
uuucucagagguuaaguuuggg

SEQ ID NO: 809670 - RNA, 20 nt, Human
uuugaccagaagaagcaaau

SEQ ID NO: 809671 - RNA, 26 nt, Human
uuuuucaauucaaccuuggguaaaca

SEQ ID NO: 809672 - RNA, 21 nt, Human
uuuuucuuuuuuaagaaaaug

SEQ ID NO: 809673 - RNA, 25 nt, Human
uuuuuuguuguuguuucuucuuuca

SEQ ID NO: 809674 - RNA, 23 nt, Human
aaaaaaaacaaaaaagcaugcag

SEQ ID NO: 809675 - RNA, 19 nt, Human
aaaaaacaaaaaagcaugc

SEQ ID NO: 809676 - RNA, 18 nt, Human
aaaaaauucuaaccaaca

SEQ ID NO: 809677 - RNA, 22 nt, Human
aaaaaguaaaaacaaauauaac

SEQ ID NO: 809678 - RNA, 23 nt, Human
aaaaaguaaaaacaaauauaacu

SEQ ID NO: 809679 - RNA, 21 nt, Human
aaaagcaugcaggcucuacag

SEQ ID NO: 809680 - RNA, 21 nt, Human
aaaauaaccaaaacaagagga

SEQ ID NO: 809681 - RNA, 23 nt, Human
aaacaacaacaacaaaaaaaaac

SEQ ID NO: 809682 - RNA, 22 nt, Human
aaacaagaggaacccacaccca

SEQ ID NO: 809683 - RNA, 23 nt, Human
aaacaagaggaacccacacccaa

SEQ ID NO: 809684 - RNA, 18 nt, Human
aaacaugcaaaaggccaa

SEQ ID NO: 809685 - RNA, 22 nt, Human
aaagagagagaaagagagagac

SEQ ID NO: 809686 - RNA, 22 nt, Human
aaauuauaaaauguaacuauaa

SEQ ID NO: 809687 - RNA, 24 nt, Human
aaauucacuuucuaaccaaaacaa

SEQ ID NO: 809688 - RNA, 26 nt, Human
aacaacaacaacaaaaaaaaacaaaa

SEQ ID NO: 809689 - RNA, 22 nt, Human
aacagcaauggugugccuaacc

SEQ ID NO: 809690 - RNA, 22 nt, Human
aaccaaauuucucaaagucaaa

SEQ ID NO: 809691 - RNA, 24 nt, Human
aaccaugcuucacaaaacaauaau

SEQ ID NO: 809692 - RNA, 18 nt, Human
aacucuacaaaaguugaa

SEQ ID NO: 809693 - RNA, 18 nt, Human
aagaaaaaacaacaacaa

SEQ ID NO: 809694 - RNA, 18 nt, Human
aagaggaaacaggcucag

SEQ ID NO: 809695 - RNA, 22 nt, Human
aagcaacagaauaaacaguuuu

SEQ ID NO: 809696 - RNA, 19 nt, Human
aaggaccuuuuuguagcaa

SEQ ID NO: 809697 - RNA, 23 nt, Human
aaggaccuuuuuguagcaauccu

SEQ ID NO: 809698 - RNA, 23 nt, Human
aaggaggcauuccuucauaagcu

SEQ ID NO: 809699 - RNA, 23 nt, Human
aauugugugcugacaaauucuug

SEQ ID NO: 809700 - RNA, 23 nt, Human
acaaauauaacuuaagaaaaaac

SEQ ID NO: 809701 - RNA, 25 nt, Human
acaaauucuugaguguguaacaaag

SEQ ID NO: 809702 - RNA, 25 nt, Human
acaacaacaacaaaaaaaaacaaaa

SEQ ID NO: 809703 - RNA, 26 nt, Human
acaacaacaacaaaaaaaaacaaaaa

SEQ ID NO: 809704 - RNA, 25 nt, Human
accaugcuucacaaaacaauaaugg

SEQ ID NO: 809705 - RNA, 23 nt, Human
acccaacaccucucccucccccu

SEQ ID NO: 809706 - RNA, 22 nt, Human
accucucccucccccuucuacu

SEQ ID NO: 809707 - RNA, 20 nt, Human
acgcaaaaagguacuauggc

SEQ ID NO: 809708 - RNA, 19 nt, Human
acguaguuucuaaaagggg

SEQ ID NO: 809709 - RNA, 22 nt, Human
agaaaaaacaacaacaacaaaa

SEQ ID NO: 809710 - RNA, 24 nt, Human
agaaaaaacaacaacaacaaaaaa

SEQ ID NO: 809711 - RNA, 25 nt, Human
agaaagagagagaccuuuggaggaa

SEQ ID NO: 809712 - RNA, 22 nt, Human
agaaagcuaagaggaaacaggc

SEQ ID NO: 809713 - RNA, 23 nt, Human
agaauaaacaguuuucaucaaaa

SEQ ID NO: 809714 - RNA, 23 nt, Human
aggaaauaugcuuauucaaaagc

SEQ ID NO: 809715 - RNA, 21 nt, Human
aggaagugcagccgcugcccc

SEQ ID NO: 809716 - RNA, 20 nt, Human
agguugcugagggaaaacuu

SEQ ID NO: 809717 - RNA, 27 nt, Human
aguuaaaaaaggaauuccaaugagcuu

SEQ ID NO: 809718 - RNA, 26 nt, Human
auaaaauguaacuauaaaugaccccc

SEQ ID NO: 809719 - RNA, 22 nt, Human
aucuucaggucucaggacuuuu

SEQ ID NO: 809720 - RNA, 21 nt, Human
augauuuccuucaauuacaga

SEQ ID NO: 809721 - RNA, 20 nt, Human
augcagguccaaacagcccu

SEQ ID NO: 809722 - RNA, 22 nt, Human
auguacacuacaaugacaaaau

SEQ ID NO: 809723 - RNA, 18 nt, Human
caaaaaaagagagagaaa

SEQ ID NO: 809724 - RNA, 24 nt, Human
caaaaaccgcagaaaauaaacuuc

SEQ ID NO: 809725 - RNA, 18 nt, Human
caaaacaagaggaaccca

SEQ ID NO: 809726 - RNA, 22 nt, Human
caaaacaagaggaacccacacc

SEQ ID NO: 809727 - RNA, 23 nt, Human
caaaacaagaggaacccacaccc

SEQ ID NO: 809728 - RNA, 24 nt, Human
caaaauaaccaaaacaagaggaac

SEQ ID NO: 809729 - RNA, 26 nt, Human
caaaauaaccaaaacaagaggaaccc

SEQ ID NO: 809730 - RNA, 23 nt, Human
caacaaaaaaaaacaaaaaagca

SEQ ID NO: 809731 - RNA, 24 nt, Human
caacaaaaaaaaacaaaaaagcau

SEQ ID NO: 809732 - RNA, 24 nt, Human
caacaacaaaaaaaaacaaaaaag

SEQ ID NO: 809733 - RNA, 18 nt, Human
caaccaugcuucacaaaa

SEQ ID NO: 809734 - RNA, 18 nt, Human
caagaggaacccacaccc

SEQ ID NO: 809735 - RNA, 21 nt, Human
caagaggaacccacacccaag

SEQ ID NO: 809736 - RNA, 22 nt, Human
caagaggaacccacacccaagc

SEQ ID NO: 809737 - RNA, 25 nt, Human
cacauuucuuucccuauuucuccca

SEQ ID NO: 809738 - RNA, 19 nt, Human
caccucucccucccccuuc

SEQ ID NO: 809739 - RNA, 20 nt, Human
cagaaugcacauuucaucuc

SEQ ID NO: 809740 - RNA, 22 nt, Human
cagcauuaaaggguaggcacac

SEQ ID NO: 809741 - RNA, 20 nt, Human
caguaaaugaaauuacgugc

SEQ ID NO: 809742 - RNA, 24 nt, Human
caguuaaaaaaggaauuccaauga

SEQ ID NO: 809743 - RNA, 23 nt, Human
cauguacacuacaaugacaaaau

SEQ ID NO: 809744 - RNA, 31 nt, Human
cauguacacuacaaugacaaaauuuacauag

SEQ ID NO: 809745 - RNA, 21 nt, Human
cauucagaaugcacauuucau

SEQ ID NO: 809746 - RNA, 24 nt, Human
cauuucuuucccuauuucucccau

SEQ ID NO: 809747 - RNA, 21 nt, Human
ccacauaggauuaaaccucuc

SEQ ID NO: 809748 - RNA, 23 nt, Human
ccacuagcuaauuucaaccaugc

SEQ ID NO: 809749 - RNA, 23 nt, Human
cccaaacauuacgcaaaaaggua

SEQ ID NO: 809750 - RNA, 21 nt, Human
cccacacccaagcuaugucaa

SEQ ID NO: 809751 - RNA, 23 nt, Human
cccuuauuauaauuuuaaaagcc

SEQ ID NO: 809752 - RNA, 26 nt, Human
ccuacaaucugaaaugacacaauacu

SEQ ID NO: 809753 - RNA, 23 nt, Human
ccucacuuguuggugagaccaaa

SEQ ID NO: 809754 - RNA, 24 nt, Human
ccucugggugagcacuaauagcuu

SEQ ID NO: 809755 - RNA, 23 nt, Human
ccugaccaccuuucucagcagau

SEQ ID NO: 809756 - RNA, 22 nt, Human
ccuuauggucccgccggccgcc

SEQ ID NO: 809757 - RNA, 21 nt, Human
ccuucaauuacagaugaaaac

SEQ ID NO: 809758 - RNA, 21 nt, Human
cggccgccgcacagagggaaa

SEQ ID NO: 809759 - RNA, 24 nt, Human
cucucugaacaauaaacucuacaa

SEQ ID NO: 809760 - RNA, 22 nt, Human
cugaaaucaaucuaaccaaccc

SEQ ID NO: 809761 - RNA, 23 nt, Human
cuucucaagcaacagaauaaaca

SEQ ID NO: 809762 - RNA, 24 nt, Human
cuugcaaaaaccgcagaaaauaaa

SEQ ID NO: 809763 - RNA, 25 nt, Human
cuuucagguucacagucuuuaaaua

SEQ ID NO: 809764 - RNA, 19 nt, Human
cuuucccuauuucucccau

SEQ ID NO: 809765 - RNA, 18 nt, Human
gaguguguaacaaaggag

SEQ ID NO: 809766 - RNA, 18 nt, Human
gcagguccaaacagcccu

SEQ ID NO: 809767 - RNA, 24 nt, Human
gccuaaccuuugaacacacagguu

SEQ ID NO: 809768 - RNA, 22 nt, Human
gcuaauuaucagaaaaagucaa

SEQ ID NO: 809769 - RNA, 18 nt, Human
ggaauuuuuauugcaacu

SEQ ID NO: 809770 - RNA, 22 nt, Human
ggaugccaaaaacagaaaaaaa

SEQ ID NO: 809771 - RNA, 19 nt, Human
ggcauuccuucauaagcuu

SEQ ID NO: 809772 - RNA, 18 nt, Human
ggcuauuuuauauugcag

SEQ ID NO: 809773 - RNA, 18 nt, Human
ggcuuugcuuauucuugc

SEQ ID NO: 809774 - RNA, 21 nt, Human
guuaccuugggguuuuuuucu

SEQ ID NO: 809775 - RNA, 24 nt, Human
guugaacuuuuagggccagauuuu

SEQ ID NO: 809776 - RNA, 26 nt, Human
uaaaaaaaaaacccaacaccucuccc

SEQ ID NO: 809777 - RNA, 21 nt, Human
uaaaaugcuauugaacccaaa

SEQ ID NO: 809778 - RNA, 25 nt, Human
uaaauaaaaacuuaaaaaaaaaacc

SEQ ID NO: 809779 - RNA, 24 nt, Human
uaaccaaaacaagaggaacccaca

SEQ ID NO: 809780 - RNA, 23 nt, Human
uaagaaaaaacaacaacaacaaa

SEQ ID NO: 809781 - RNA, 24 nt, Human
uaagauggcuuuccaauuugcagu

SEQ ID NO: 809782 - RNA, 24 nt, Human
uaagcccuuauggucccgccggcc

SEQ ID NO: 809783 - RNA, 20 nt, Human
uaagcuuagcccuuugcuuu

SEQ ID NO: 809784 - RNA, 23 nt, Human
uaauugcuccaaaguuuccaggc

SEQ ID NO: 809785 - RNA, 20 nt, Human
uacaaucuucaggucucagg

SEQ ID NO: 809786 - RNA, 21 nt, Human
uacacaaaauaaccaaaacaa

SEQ ID NO: 809787 - RNA, 23 nt, Human
uacacaaaauaaccaaaacaaga

SEQ ID NO: 809788 - RNA, 20 nt, Human
uagcacaucaauucuguaaa

SEQ ID NO: 809789 - RNA, 23 nt, Human
uaggaugccaaaaacagaaaaaa

SEQ ID NO: 809790 - RNA, 25 nt, Human
uaggcacaccauucuucugcugcuc

SEQ ID NO: 809791 - RNA, 26 nt, Human
uauaaaauguaacuauaaaugaccca

SEQ ID NO: 809792 - RNA, 18 nt, Human
uaucuguucucugugagg

SEQ ID NO: 809793 - RNA, 18 nt, Human
ucaaaugaaauuacagca

SEQ ID NO: 809794 - RNA, 19 nt, Human
ucaaaugaaauuacagcaa

SEQ ID NO: 809795 - RNA, 23 nt, Human
ucagcaaacuuucuaugauuucc

SEQ ID NO: 809796 - RNA, 18 nt, Human
ucagcagauuagaauaua

SEQ ID NO: 809797 - RNA, 18 nt, Human
uccaaacagcccuucaag

SEQ ID NO: 809798 - RNA, 19 nt, Human
uccccggccaccgccgccc

SEQ ID NO: 809799 - RNA, 21 nt, Human
uccugggcuacugaauauccc

SEQ ID NO: 809800 - RNA, 23 nt, Human
ucggguuaccuugggguuuuuuu

SEQ ID NO: 809801 - RNA, 26 nt, Human
ucugagaaaguuuagaguuugguuug

SEQ ID NO: 809802 - RNA, 20 nt, Human
ugaaaaauuaaauuccaugg

SEQ ID NO: 809803 - RNA, 21 nt, Human
ugaaaucaaucuaaccaaccc

SEQ ID NO: 809804 - RNA, 19 nt, Human
ugaaauuacagcaaaggua

SEQ ID NO: 809805 - RNA, 19 nt, Human
ugaacccaaacuguuuuuu

SEQ ID NO: 809806 - RNA, 22 nt, Human
ugaacugugugcuaaacaacca

SEQ ID NO: 809807 - RNA, 23 nt, Human
ugacccaauaauuaugucaguga

SEQ ID NO: 809808 - RNA, 23 nt, Human
ugagguaacucaauucucuuuug

SEQ ID NO: 809809 - RNA, 22 nt, Human
ugauaugcauccuaaaucauaa

SEQ ID NO: 809810 - RNA, 19 nt, Human
ugauugaauuguuagaacu

SEQ ID NO: 809811 - RNA, 18 nt, Human
ugccaaaaacagaaaaaa

SEQ ID NO: 809812 - RNA, 19 nt, Human
ugccaaaaacagaaaaaaa

SEQ ID NO: 809813 - RNA, 22 nt, Human
ugccaaaaacagaaaaaaauuc

SEQ ID NO: 809814 - RNA, 22 nt, Human
ugcuaaacaaccaugaauauca

SEQ ID NO: 809815 - RNA, 19 nt, Human
ugcuccaaaguuuccaggc

SEQ ID NO: 809816 - RNA, 20 nt, Human
uggagggggguuaaauauau

SEQ ID NO: 809817 - RNA, 23 nt, Human
uggaucaguuaaaaaaggaauuc

SEQ ID NO: 809818 - RNA, 20 nt, Human
ugugaauaauuuuguauaau

SEQ ID NO: 809819 - RNA, 20 nt, Human
uuaacuccccggccaccgcc

SEQ ID NO: 809820 - RNA, 19 nt, Human
uuaauagugagaagaaaau

SEQ ID NO: 809821 - RNA, 22 nt, Human
uuagcacaucaauucuguaaaa

SEQ ID NO: 809822 - RNA, 19 nt, Human
uucauuaauguggacacug

SEQ ID NO: 809823 - RNA, 19 nt, Human
uuccaccaccuuccccucu

SEQ ID NO: 809824 - RNA, 25 nt, Human
uucucaagcaacagaauaaacaguu

SEQ ID NO: 809825 - RNA, 18 nt, Human
uucuucuuaguuuuuucu

SEQ ID NO: 809826 - RNA, 22 nt, Human
uuggaaauaucuggaccucccc

SEQ ID NO: 809827 - RNA, 18 nt, Human
uuuaaaagcccaucucag

SEQ ID NO: 809828 - RNA, 24 nt, Human
uuuacacugaaacuccaauaaugu

SEQ ID NO: 809829 - RNA, 21 nt, Human
uuugcuaaaaugaggcauccu

SEQ ID NO: 809830 - RNA, 22 nt, Human
aaaaaucaaucauaggaggaaa

SEQ ID NO: 809831 - RNA, 19 nt, Human
aaaaauggacaacagagga

SEQ ID NO: 809832 - RNA, 21 nt, Human
aaacaucuggugauaaaaaug

SEQ ID NO: 809833 - RNA, 19 nt, Human
aacaauacaaauaaaauau

SEQ ID NO: 809834 - RNA, 22 nt, Human
aacauaaauaacacugucaaac

SEQ ID NO: 809835 - RNA, 19 nt, Human
aacuagauuguguugcuau

SEQ ID NO: 809836 - RNA, 23 nt, Human
aagaagccagaauauuuauuugc

SEQ ID NO: 809837 - RNA, 18 nt, Human
aagagcgggaaagggagg

SEQ ID NO: 809838 - RNA, 20 nt, Human
aaggagaacuuaacuuaggg

SEQ ID NO: 809839 - RNA, 21 nt, Human
aaggaggccugggacgcggug

SEQ ID NO: 809840 - RNA, 21 nt, Human
aagggagggggaguggcagag

SEQ ID NO: 809841 - RNA, 19 nt, Human
aaguuuggaaauuguuugc

SEQ ID NO: 809842 - RNA, 18 nt, Human
aaucauaggaggaaaaga

SEQ ID NO: 809843 - RNA, 25 nt, Human
acaacaauacaaauaaaauauuuuu

SEQ ID NO: 809844 - RNA, 22 nt, Human
acauagcuaggacacuuguuag

SEQ ID NO: 809845 - RNA, 24 nt, Human
aggaaggaauacagcuagcaagaa

SEQ ID NO: 809846 - RNA, 22 nt, Human
aggcgacggcuguggcaggagc

SEQ ID NO: 809847 - RNA, 19 nt, Human
agggaggaaaaggggcuga

SEQ ID NO: 809848 - RNA, 21 nt, Human
caacagaggaccaaugcuccu

SEQ ID NO: 809849 - RNA, 21 nt, Human
caagcaagauguggccaaaac

SEQ ID NO: 809850 - RNA, 20 nt, Human
cacauaaaagccaaacugag

SEQ ID NO: 809851 - RNA, 18 nt, Human
cagagggagggaaggagg

SEQ ID NO: 809852 - RNA, 19 nt, Human
caggaaauguuaugaucac

SEQ ID NO: 809853 - RNA, 22 nt, Human
caucagcaagcaagauguggcc

SEQ ID NO: 809854 - RNA, 23 nt, Human
caucagcaagcaagauguggcca

SEQ ID NO: 809855 - RNA, 23 nt, Human
ccaugccaagcagaaaacucaua

SEQ ID NO: 809856 - RNA, 20 nt, Human
cccaugauauaaaguaaagu

SEQ ID NO: 809857 - RNA, 22 nt, Human
ccugcuucguauccaggcucuc

SEQ ID NO: 809858 - RNA, 21 nt, Human
cgcacagcugaauggccucca

SEQ ID NO: 809859 - RNA, 22 nt, Human
cgccgaggcugaggcgcggggc

SEQ ID NO: 809860 - RNA, 23 nt, Human
cucucaguacccuaaaauaaacu

SEQ ID NO: 809861 - RNA, 20 nt, Human
cugaauggccuccaggcuga

SEQ ID NO: 809862 - RNA, 24 nt, Human
gaagugcugacaauucuaggcuuc

SEQ ID NO: 809863 - RNA, 22 nt, Human
gagccgccgcgaaggcgacggc

SEQ ID NO: 809864 - RNA, 22 nt, Human
gaggaaaaggggcugaguaaga

SEQ ID NO: 809865 - RNA, 23 nt, Human
gaguggcagagggagggaaggag

SEQ ID NO: 809866 - RNA, 19 nt, Human
gauacacaacuauuugagg

SEQ ID NO: 809867 - RNA, 18 nt, Human
gcagagggagggaaggag

SEQ ID NO: 809868 - RNA, 20 nt, Human
gcaucuaggcaauaaagugu

SEQ ID NO: 809869 - RNA, 23 nt, Human
ggaaaacacuaaaaugguucuga

SEQ ID NO: 809870 - RNA, 21 nt, Human
ggcaauaaagugucaaaagga

SEQ ID NO: 809871 - RNA, 22 nt, Human
ggcuguugagggcaugauccag

SEQ ID NO: 809872 - RNA, 18 nt, Human
gggaaagggagggggagu

SEQ ID NO: 809873 - RNA, 18 nt, Human
gggaaagggagggggagu

SEQ ID NO: 809874 - RNA, 18 nt, Human
gggagggaaggaggccug

SEQ ID NO: 809875 - RNA, 19 nt, Human
gggagggaaggaggccugg

SEQ ID NO: 809876 - RNA, 18 nt, Human
ggggaguggcagagggag

SEQ ID NO: 809877 - RNA, 18 nt, Human
guggggcuguugagggca

SEQ ID NO: 809878 - RNA, 19 nt, Human
uaaaauagguauuuuggau

SEQ ID NO: 809879 - RNA, 23 nt, Human
uaaacaccauuuauaagccauua

SEQ ID NO: 809880 - RNA, 18 nt, Human
uaaauaacauagcuagga

SEQ ID NO: 809881 - RNA, 25 nt, Human
uaauauaaauaacauaaauaacacu

SEQ ID NO: 809882 - RNA, 25 nt, Human
uagauuaaaaugaaugcauauuuaa

SEQ ID NO: 809883 - RNA, 27 nt, Human
uaggaaggaauacagcuagccgaccuc

SEQ ID NO: 809884 - RNA, 21 nt, Human
uaugaucacuuucacccauga

SEQ ID NO: 809885 - RNA, 18 nt, Human
uaugugucuguaguauau

SEQ ID NO: 809886 - RNA, 21 nt, Human
ucaaaucuaaauaacauagcu

SEQ ID NO: 809887 - RNA, 24 nt, Human
ucagaaacagacuuauuucagagg

SEQ ID NO: 809888 - RNA, 22 nt, Human
ucaguagauuaaaaugaaugca

SEQ ID NO: 809889 - RNA, 20 nt, Human
uccucaucagcaagcaagau

SEQ ID NO: 809890 - RNA, 18 nt, Human
ucugaagcccgccugcuu

SEQ ID NO: 809891 - RNA, 19 nt, Human
ugacacaaugaaaauggaa

SEQ ID NO: 809892 - RNA, 21 nt, Human
ugacacaaugaaaauggaagc

SEQ ID NO: 809893 - RNA, 26 nt, Human
ugacacaaugaaaauggaagcacuuu

SEQ ID NO: 809894 - RNA, 18 nt, Human
ugacauguacacaguugc

SEQ ID NO: 809895 - RNA, 21 nt, Human
ugagggcaugauccaggcgcg

SEQ ID NO: 809896 - RNA, 20 nt, Human
ugccacugucuugugauuug

SEQ ID NO: 809897 - RNA, 22 nt, Human
ugcuccuaagggaggaaaaggg

SEQ ID NO: 809898 - RNA, 24 nt, Human
uggcagagggagggaaggaggccu

SEQ ID NO: 809899 - RNA, 22 nt, Human
uggcaggagcuccgcggagugu

SEQ ID NO: 809900 - RNA, 20 nt, Human
ugggacgcggugaugcggcg

SEQ ID NO: 809901 - RNA, 19 nt, Human
uggugacaguggcaugugc

SEQ ID NO: 809902 - RNA, 24 nt, Human
ugucaaaaggagaacuuaacuuag

SEQ ID NO: 809903 - RNA, 19 nt, Human
uguucccgucccggucgca

SEQ ID NO: 809904 - RNA, 22 nt, Human
uguugaagaaauucacauucuc

SEQ ID NO: 809905 - RNA, 22 nt, Human
uucauugggaauauacauuuuu

SEQ ID NO: 809906 - RNA, 19 nt, Human
uuugagguucaggaaaugu

SEQ ID NO: 809907 - RNA, 19 nt, Human
uuuuaagaaggaauagcaa

SEQ ID NO: 809908 - RNA, 24 nt, Human
aaaaaacagcaacaaaaaacuuau

SEQ ID NO: 809909 - RNA, 26 nt, Human
aaaaaagaaaaaacagcaacaaaaaa

SEQ ID NO: 809910 - RNA, 22 nt, Human
aaaaacgaaagcaacuaaagaa

SEQ ID NO: 809911 - RNA, 24 nt, Human
aaaaagaaaaaacagcaacaaaaa

SEQ ID NO: 809912 - RNA, 25 nt, Human
aaaaagaaaaaacagcaacaaaaaa

SEQ ID NO: 809913 - RNA, 24 nt, Human
aaaaaggaauccuuccaaaacgga

SEQ ID NO: 809914 - RNA, 18 nt, Human
aaaaggaaaaauacugau

SEQ ID NO: 809915 - RNA, 20 nt, Human
aaauauccaauccuggaauc

SEQ ID NO: 809916 - RNA, 23 nt, Human
aaccaccacaauuucaucaauga

SEQ ID NO: 809917 - RNA, 20 nt, Human
aagaaaaaacagcaacaaaa

SEQ ID NO: 809918 - RNA, 23 nt, Human
aagaaaagucauucuuacaacua

SEQ ID NO: 809919 - RNA, 26 nt, Human
aagaagagguggaacuuaccccagaa

SEQ ID NO: 809920 - RNA, 18 nt, Human
aaucaccucccugaucug

SEQ ID NO: 809921 - RNA, 22 nt, Human
aaucagaauacccaucaaagug

SEQ ID NO: 809922 - RNA, 23 nt, Human
aauggacuuccaacagggauauc

SEQ ID NO: 809923 - RNA, 19 nt, Human
acaaaacauaaaaaagaaa

SEQ ID NO: 809924 - RNA, 18 nt, Human
acaaaauuaacaauacag

SEQ ID NO: 809925 - RNA, 23 nt, Human
acagaaaaaggaauccuuccaaa

SEQ ID NO: 809926 - RNA, 25 nt, Human
accccagaauucagacagcaugcua

SEQ ID NO: 809927 - RNA, 24 nt, Human
agacaguaccugguuaaaagcuca

SEQ ID NO: 809928 - RNA, 18 nt, Human
agcaaucagaauacccau

SEQ ID NO: 809929 - RNA, 18 nt, Human
agcacaauucuggcugca

SEQ ID NO: 809930 - RNA, 22 nt, Human
agcacuuucauaagaauucaua

SEQ ID NO: 809931 - RNA, 23 nt, Human
aggaaaaauacugauucaaagaa

SEQ ID NO: 809932 - RNA, 24 nt, Human
aggaaaaauacugauucaaagaaa

SEQ ID NO: 809933 - RNA, 19 nt, Human
aggcaucccagucuucucu

SEQ ID NO: 809934 - RNA, 18 nt, Human
aguccauaacacugaaca

SEQ ID NO: 809935 - RNA, 27 nt, Human
auaaaaaagaaaaaacagcaacaaaaa

SEQ ID NO: 809936 - RNA, 20 nt, Human
augcauucuugcaaaagaaa

SEQ ID NO: 809937 - RNA, 22 nt, Human
auuucaucaucucucucuucuc

SEQ ID NO: 809938 - RNA, 26 nt, Human
caaaacauaaaaaagaaaaaacagca

SEQ ID NO: 809939 - RNA, 20 nt, Human
caaaacggagguucuugggc

SEQ ID NO: 809940 - RNA, 22 nt, Human
caaaagaugacuguuguuagac

SEQ ID NO: 809941 - RNA, 23 nt, Human
caacaauguuuacaaaaugccaa

SEQ ID NO: 809942 - RNA, 23 nt, Human
caagaugagugagacugaugcca

SEQ ID NO: 809943 - RNA, 25 nt, Human
cacaguacacagacugaugcucagg

SEQ ID NO: 809944 - RNA, 18 nt, Human
caccacaauuucaucaau

SEQ ID NO: 809945 - RNA, 20 nt, Human
caccgcuuucuccucuucca

SEQ ID NO: 809946 - RNA, 20 nt, Human
caccggggcaccaagaugag

SEQ ID NO: 809947 - RNA, 19 nt, Human
cacuccaucuuuccagucc

SEQ ID NO: 809948 - RNA, 25 nt, Human
cacugcagaugucacugacccuguu

SEQ ID NO: 809949 - RNA, 22 nt, Human
cacuuaggaguuauaaccgucc

SEQ ID NO: 809950 - RNA, 26 nt, Human
cagauauaacaaguacaacuugaaug

SEQ ID NO: 809951 - RNA, 20 nt, Human
cauaaaaaagaaaaaacagc

SEQ ID NO: 809952 - RNA, 22 nt, Human
caucauaaaaaacgaaagcaac

SEQ ID NO: 809953 - RNA, 18 nt, Human
caugccaacuuugaaucc

SEQ ID NO: 809954 - RNA, 19 nt, Human
cauuucaaauuuuguguca

SEQ ID NO: 809955 - RNA, 21 nt, Human
cauuucaucaucucucucuuc

SEQ ID NO: 809956 - RNA, 21 nt, Human
ccaaaaguucuuacucugccc

SEQ ID NO: 809957 - RNA, 22 nt, Human
ccaacccugaaaaaaaccuuug

SEQ ID NO: 809958 - RNA, 23 nt, Human
ccccagaauucagacagcaugcu

SEQ ID NO: 809959 - RNA, 26 nt, Human
ccccccaaccauaacugcauacaacu

SEQ ID NO: 809960 - RNA, 21 nt, Human
ccccccaccccccagacucaa

SEQ ID NO: 809961 - RNA, 22 nt, Human
ccccccaccccccagacucaaa

SEQ ID NO: 809962 - RNA, 23 nt, Human
ccccccaccccccagacucaaaa

SEQ ID NO: 809963 - RNA, 19 nt, Human
ccccccagacucaaaaaga

SEQ ID NO: 809964 - RNA, 19 nt, Human
ccccccuuccccccacccc

SEQ ID NO: 809965 - RNA, 22 nt, Human
ccccccuuccccccacccccca

SEQ ID NO: 809966 - RNA, 24 nt, Human
ccccccuuccccccaccccccaga

SEQ ID NO: 809967 - RNA, 25 nt, Human
ccccccuuccccccaccccccagac

SEQ ID NO: 809968 - RNA, 22 nt, Human
cccccuuccccccaccccccag

SEQ ID NO: 809969 - RNA, 18 nt, Human
ccccucgucuuuuccucc

SEQ ID NO: 809970 - RNA, 19 nt, Human
ccccuuccccccacccccc

SEQ ID NO: 809971 - RNA, 19 nt, Human
cccuuucuuccuucugauc

SEQ ID NO: 809972 - RNA, 26 nt, Human
ccgaaacuuuaagucacuuccuggua

SEQ ID NO: 809973 - RNA, 18 nt, Human
ccuccagaaagacacuca

SEQ ID NO: 809974 - RNA, 20 nt, Human
ccucuccgcgacggugagga

SEQ ID NO: 809975 - RNA, 21 nt, Human
ccugaaaggcaucccagucuu

SEQ ID NO: 809976 - RNA, 25 nt, Human
cggggcaccaagaugagugagacug

SEQ ID NO: 809977 - RNA, 24 nt, Human
cgucccuuucuuccuucugaucuu

SEQ ID NO: 809978 - RNA, 22 nt, Human
cgugcaaaaggaaaaauacuga

SEQ ID NO: 809979 - RNA, 19 nt, Human
cucacaaacauucccccca

SEQ ID NO: 809980 - RNA, 20 nt, Human
cucucucuucuccauccucc

SEQ ID NO: 809981 - RNA, 24 nt, Human
cugaagcccuucuacuuucacugg

SEQ ID NO: 809982 - RNA, 22 nt, Human
cugacaauuaugacaagcaguu

SEQ ID NO: 809983 - RNA, 22 nt, Human
cugacccuguuuuaccuugaau

SEQ ID NO: 809984 - RNA, 20 nt, Human
cugccaccgcuuucuccucu

SEQ ID NO: 809985 - RNA, 19 nt, Human
cuuaccccagaauucagac

SEQ ID NO: 809986 - RNA, 21 nt, Human
gaaagcaacuaaagaagaggu

SEQ ID NO: 809987 - RNA, 22 nt, Human
gaagccccccuuccccccaccc

SEQ ID NO: 809988 - RNA, 18 nt, Human
gaauccccucgucuuuuc

SEQ ID NO: 809989 - RNA, 23 nt, Human
gagguucuugggcaauuacuuug

SEQ ID NO: 809990 - RNA, 19 nt, Human
gaguuuuggagacuucuca

SEQ ID NO: 809991 - RNA, 21 nt, Human
gcaaaguauucuacagaaaaa

SEQ ID NO: 809992 - RNA, 24 nt, Human
gcaguugcuuuuuuaacauuuucc

SEQ ID NO: 809993 - RNA, 21 nt, Human
gcgacggugaggacacaguac

SEQ ID NO: 809994 - RNA, 20 nt, Human
gcucuuguaaacaccggggc

SEQ ID NO: 809995 - RNA, 24 nt, Human
ggaaauacgggccuggagcucggg

SEQ ID NO: 809996 - RNA, 18 nt, Human
ggauccuucaaccugaaa

SEQ ID NO: 809997 - RNA, 19 nt, Human
ggcuucuugagcaguuggu

SEQ ID NO: 809998 - RNA, 26 nt, Human
gguaacgugcccacuccccugaaagg

SEQ ID NO: 809999 - RNA, 24 nt, Human
gugaacagaaccaaaagaugacug

SEQ ID NO: 810000 - RNA, 23 nt, Human
gugcuuugaauaaaacaugagcu

SEQ ID NO: 810001 - RNA, 25 nt, Human
uaacaaguacaacuugaaaggguuc

SEQ ID NO: 810002 - RNA, 23 nt, Human
uaacaauacagauaacaguccua

SEQ ID NO: 810003 - RNA, 21 nt, Human
uaacuuccagggcuccaaacu

SEQ ID NO: 810004 - RNA, 21 nt, Human
uaagauaggucugccaauuga

SEQ ID NO: 810005 - RNA, 23 nt, Human
uaaugaagccccccuucccccca

SEQ ID NO: 810006 - RNA, 19 nt, Human
uaauuaaugaagccccccu

SEQ ID NO: 810007 - RNA, 20 nt, Human
uaauuaaugaagccccccuu

SEQ ID NO: 810008 - RNA, 20 nt, Human
uaauuuugguuuuuucuucc

SEQ ID NO: 810009 - RNA, 24 nt, Human
uacaaauucugaacaaaaggacau

SEQ ID NO: 810010 - RNA, 18 nt, Human
uacacuuaggaucuucuu

SEQ ID NO: 810011 - RNA, 23 nt, Human
uacaugaaagagaauucaacaau

SEQ ID NO: 810012 - RNA, 20 nt, Human
uaccccagaauucagacagc

SEQ ID NO: 810013 - RNA, 25 nt, Human
uaccuuuugccuuagaaaugcauuc

SEQ ID NO: 810014 - RNA, 22 nt, Human
uagccaacccugaaaaaaaccu

SEQ ID NO: 810015 - RNA, 22 nt, Human
ucaaaaagauuuacaaagauaa

SEQ ID NO: 810016 - RNA, 22 nt, Human
ucaaaauacacuaccuaauuua

SEQ ID NO: 810017 - RNA, 20 nt, Human
ucagcuuucagagauaauuu

SEQ ID NO: 810018 - RNA, 21 nt, Human
uccaucuuuccaguccauaac

SEQ ID NO: 810019 - RNA, 24 nt, Human
uccccccaccccccagacucaaaa

SEQ ID NO: 810020 - RNA, 23 nt, Human
uccgugcucucugcgaaccccuc

SEQ ID NO: 810021 - RNA, 24 nt, Human
uccucauugucuucuucuacgucc

SEQ ID NO: 810022 - RNA, 18 nt, Human
uccucugacaccaucugg

SEQ ID NO: 810023 - RNA, 19 nt, Human
uccuuggugucagcuuuca

SEQ ID NO: 810024 - RNA, 22 nt, Human
ucgcucucuagccaacccugaa

SEQ ID NO: 810025 - RNA, 21 nt, Human
ucucucucuucuccauccucc

SEQ ID NO: 810026 - RNA, 27 nt, Human
ucuggcugcaauaguuuccuccagaaa

SEQ ID NO: 810027 - RNA, 19 nt, Human
ucuguaauaacuuccaggg

SEQ ID NO: 810028 - RNA, 18 nt, Human
ucuucucugaaaagacug

SEQ ID NO: 810029 - RNA, 24 nt, Human
ucuucuucuacgucccuuucuucc

SEQ ID NO: 810030 - RNA, 25 nt, Human
ugaaaaagaaacaguguacaugaaa

SEQ ID NO: 810031 - RNA, 25 nt, Human
ugaaaagacugugggacauccaggu

SEQ ID NO: 810032 - RNA, 23 nt, Human
ugaacaaaacauaaaaaagaaaa

SEQ ID NO: 810033 - RNA, 24 nt, Human
ugaagccccccuuccccccacccc

SEQ ID NO: 810034 - RNA, 30 nt, Human
ugaauaaauauccaauccuggaaucagaaa

SEQ ID NO: 810035 - RNA, 21 nt, Human
ugacaagcaguuaggcaauau

SEQ ID NO: 810036 - RNA, 22 nt, Human
ugacuuaggagcagcuugagcc

SEQ ID NO: 810037 - RNA, 25 nt, Human
ugacuuaggagcagcuugagcuuua

SEQ ID NO: 810038 - RNA, 22 nt, Human
ugagcaguugguaccauccaag

SEQ ID NO: 810039 - RNA, 19 nt, Human
ugcaaaagaaacacuacca

SEQ ID NO: 810040 - RNA, 22 nt, Human
ugcaauaguuuccuccagaaag

SEQ ID NO: 810041 - RNA, 24 nt, Human
ugcucaggauccacgccuucuaau

SEQ ID NO: 810042 - RNA, 20 nt, Human
uggaaauacgggccuggagc

SEQ ID NO: 810043 - RNA, 20 nt, Human
uggaggauggaguuuguggc

SEQ ID NO: 810044 - RNA, 18 nt, Human
uggcacaaaauuaacaau

SEQ ID NO: 810045 - RNA, 30 nt, Human
uguccaguaggcagguggaaauacgggccc

SEQ ID NO: 810046 - RNA, 26 nt, Human
uuagaaaugcauucuugcaaaagaaa

SEQ ID NO: 810047 - RNA, 27 nt, Human
uuaggaucuucuuccucauugucuucu

SEQ ID NO: 810048 - RNA, 20 nt, Human
uuccccccaccccccagacu

SEQ ID NO: 810049 - RNA, 24 nt, Human
uucuacgucccuuucuuccuucug

SEQ ID NO: 810050 - RNA, 18 nt, Human
uugaauguacaaauucug

SEQ ID NO: 810051 - RNA, 26 nt, Human
uuucaucaucucucucuucuccaucc

SEQ ID NO: 810052 - RNA, 23 nt, Human
uuuugaguuuuggagacuucuca

SEQ ID NO: 810053 - RNA, 19 nt, Human
acauaccauggacauaaaa

SEQ ID NO: 810054 - RNA, 18 nt, Human
accauggcaacugcaccu

SEQ ID NO: 810055 - RNA, 20 nt, Human
cacaaacaaggaagcgcagc

SEQ ID NO: 810056 - RNA, 18 nt, Human
cacagagacagcuguguu

SEQ ID NO: 810057 - RNA, 19 nt, Human
caccauggcaacugcaccu

SEQ ID NO: 810058 - RNA, 21 nt, Human
caccauggcaacugcaccuca

SEQ ID NO: 810059 - RNA, 22 nt, Human
caccggaaauaagaugcagagc

SEQ ID NO: 810060 - RNA, 20 nt, Human
ccauggcaacugcaccucac

SEQ ID NO: 810061 - RNA, 24 nt, Human
cgccaccggaaauaagaugcagag

SEQ ID NO: 810062 - RNA, 23 nt, Human
cucacaaacaaggaagcgcagcc

SEQ ID NO: 810063 - RNA, 23 nt, Human
cuggacagaucucggccuuucuc

SEQ ID NO: 810064 - RNA, 20 nt, Human
gcaacugcaccucaccgcca

SEQ ID NO: 810065 - RNA, 19 nt, Human
gcagagcccuucuccaaac

SEQ ID NO: 810066 - RNA, 20 nt, Human
gcagagcccuucuccaaacg

SEQ ID NO: 810067 - RNA, 20 nt, Human
gccagaguagugagagaagg

SEQ ID NO: 810068 - RNA, 27 nt, Human
uaaauugaauagauuauuauuuaggua

SEQ ID NO: 810069 - RNA, 24 nt, Human
uacauaccauggacauaaaaugaa

SEQ ID NO: 810070 - RNA, 18 nt, Human
uagcucacaaacaaggaa

SEQ ID NO: 810071 - RNA, 23 nt, Human
uagcucacaaacaaggaagcgca

SEQ ID NO: 810072 - RNA, 18 nt, Human
ugagagaaggugcucugu

SEQ ID NO: 810073 - RNA, 22 nt, Human
ugauccggagcgcacagagaca

SEQ ID NO: 810074 - RNA, 24 nt, Human
uggacauaaaaugaaaaugcauau

SEQ ID NO: 810075 - RNA, 24 nt, Human
aaaaaaaacaagaaacaagacaag

SEQ ID NO: 810076 - RNA, 26 nt, Human
aaaaaaaaggaaggaaagaaacaaaa

SEQ ID NO: 810077 - RNA, 28 nt, Human
aaaaaaacaagaaacaagacaagaaaaa

SEQ ID NO: 810078 - RNA, 20 nt, Human
aaaaacaagaaacaagacaa

SEQ ID NO: 810079 - RNA, 24 nt, Human
aaaaaggaaagaaaggaaaaaaga

SEQ ID NO: 810080 - RNA, 23 nt, Human
aaaaauagugaagcucauuacaa

SEQ ID NO: 810081 - RNA, 21 nt, Human
aaaacacagcagcaugaaaca

SEQ ID NO: 810082 - RNA, 20 nt, Human
aaaaguucuacuggagaaug

SEQ ID NO: 810083 - RNA, 27 nt, Human
aaacaaacacccagaucacauacacuc

SEQ ID NO: 810084 - RNA, 28 nt, Human
aaacaaacacccagaucacauacacucc

SEQ ID NO: 810085 - RNA, 18 nt, Human
aaacaagaaacaagacaa

SEQ ID NO: 810086 - RNA, 22 nt, Human
aaacauauuuuucagucacaag

SEQ ID NO: 810087 - RNA, 19 nt, Human
aaaggcauaaaugagaaca

SEQ ID NO: 810088 - RNA, 20 nt, Human
aaccagauucugcuaaguuu

SEQ ID NO: 810089 - RNA, 21 nt, Human
aaggugcaauuuuaaaugaaa

SEQ ID NO: 810090 - RNA, 22 nt, Human
aaggugcaauuuuaaaugaaau

SEQ ID NO: 810091 - RNA, 23 nt, Human
aaguucuacuggagaaugaaaaa

SEQ ID NO: 810092 - RNA, 26 nt, Human
aauaauaacagagauaaacaaacacc

SEQ ID NO: 810093 - RNA, 20 nt, Human
aauuaagaaaagaaacuaca

SEQ ID NO: 810094 - RNA, 20 nt, Human
aauuucuguugugugcaaau

SEQ ID NO: 810095 - RNA, 22 nt, Human
acaagacaagaaaaaggaaaga

SEQ ID NO: 810096 - RNA, 23 nt, Human
acacacacacacgccaacauaca

SEQ ID NO: 810097 - RNA, 25 nt, Human
acacacacgccaacauacaugcaca

SEQ ID NO: 810098 - RNA, 33 nt, Human
acacacacgccaacauacaugcacacacauagu

SEQ ID NO: 810099 - RNA, 25 nt, Human
acacacaugcaaacacacauuuacu

SEQ ID NO: 810100 - RNA, 23 nt, Human
acagaaaauugcaaauguacaau

SEQ ID NO: 810101 - RNA, 25 nt, Human
acauacaugcacacacauacaggga

SEQ ID NO: 810102 - RNA, 19 nt, Human
acugauggaggaagaaugu

SEQ ID NO: 810103 - RNA, 26 nt, Human
acuuugaacaucuauuuuggaguucu

SEQ ID NO: 810104 - RNA, 22 nt, Human
agaaaaaaaaggaaggaaagaa

SEQ ID NO: 810105 - RNA, 24 nt, Human
agaaaagaaacuacaagaaaaaaa

SEQ ID NO: 810106 - RNA, 21 nt, Human
agaaaggaaaaaagaaaaaaa

SEQ ID NO: 810107 - RNA, 23 nt, Human
agacacaugacuguuuacaguac

SEQ ID NO: 810108 - RNA, 25 nt, Human
agacagaagggaagcacaauacauu

SEQ ID NO: 810109 - RNA, 23 nt, Human
agaguaccuuaauuuuuuacuaa

SEQ ID NO: 810110 - RNA, 23 nt, Human
agccucccgggcggccgcgggcg

SEQ ID NO: 810111 - RNA, 23 nt, Human
agcgguccccgaagccgcgggcg

SEQ ID NO: 810112 - RNA, 23 nt, Human
agcugcccaaaggguccagccuc

SEQ ID NO: 810113 - RNA, 21 nt, Human
aggaaaaaagaaaaaaaagga

SEQ ID NO: 810114 - RNA, 21 nt, Human
aggcggagcgggaagcugggc

SEQ ID NO: 810115 - RNA, 25 nt, Human
auaugcaugcacacacacacacggu

SEQ ID NO: 810116 - RNA, 21 nt, Human
auaugcaugcacacacacagu

SEQ ID NO: 810117 - RNA, 26 nt, Human
aucacauacacuccccaacacacaca

SEQ ID NO: 810118 - RNA, 20 nt, Human
auccauuucugaaaauaauu

SEQ ID NO: 810119 - RNA, 31 nt, Human
augcacacacacacacgccaacauacaugca

SEQ ID NO: 810120 - RNA, 29 nt, Human
augcaugcacacacacacacgccaacaua

SEQ ID NO: 810121 - RNA, 19 nt, Human
caaauagaccagcuauaaa

SEQ ID NO: 810122 - RNA, 23 nt, Human
caagaaaaaaaaacaagaaacaa

SEQ ID NO: 810123 - RNA, 24 nt, Human
caagaaaaaggaaagaaaggaaaa

SEQ ID NO: 810124 - RNA, 21 nt, Human
caaugcugcaaaauugccaaa

SEQ ID NO: 810125 - RNA, 19 nt, Human
cacaaaaauaaauaaccag

SEQ ID NO: 810126 - RNA, 20 nt, Human
cacacacaugcaaacacaca

SEQ ID NO: 810127 - RNA, 31 nt, Human
cacaugcaaacacacauuuacuaauaugcag

SEQ ID NO: 810128 - RNA, 20 nt, Human
caccauggucgugcccaggc

SEQ ID NO: 810129 - RNA, 22 nt, Human
caccauguggucucagucaaau

SEQ ID NO: 810130 - RNA, 18 nt, Human
cacccagaucacauacac

SEQ ID NO: 810131 - RNA, 20 nt, Human
cagaaaauugcaaauguaca

SEQ ID NO: 810132 - RNA, 25 nt, Human
cagagauaaacaaacacccagauca

SEQ ID NO: 810133 - RNA, 21 nt, Human
cagcugcgcggggaaggcgga

SEQ ID NO: 810134 - RNA, 22 nt, Human
cauacuguuucucaucugcuga

SEQ ID NO: 810135 - RNA, 20 nt, Human
cauuuugggaaaaccaaauc

SEQ ID NO: 810136 - RNA, 20 nt, Human
ccaaaaggacugaacacaaa

SEQ ID NO: 810137 - RNA, 18 nt, Human
ccaacacacacaugcaaa

SEQ ID NO: 810138 - RNA, 22 nt, Human
ccaacacacacaugcaaacaca

SEQ ID NO: 810139 - RNA, 23 nt, Human
cccagaucacauacacuccccaa

SEQ ID NO: 810140 - RNA, 24 nt, Human
ccgaagccgcgggcgacgucccac

SEQ ID NO: 810141 - RNA, 20 nt, Human
cguuccuggccagccgccuc

SEQ ID NO: 810142 - RNA, 21 nt, Human
cugcaagaauccagaaugcaa

SEQ ID NO: 810143 - RNA, 22 nt, Human
cugcaagaauccagaaugcaag

SEQ ID NO: 810144 - RNA, 25 nt, Human
gcaugcacacacacacacgccaaca

SEQ ID NO: 810145 - RNA, 18 nt, Human
gcccaaaggguccagccu

SEQ ID NO: 810146 - RNA, 18 nt, Human
gccgcagcgguccccgaa

SEQ ID NO: 810147 - RNA, 19 nt, Human
gcggagcgggaagcugggc

SEQ ID NO: 810148 - RNA, 22 nt, Human
gcggagcgggaagcugggcuca

SEQ ID NO: 810149 - RNA, 18 nt, Human
ggaaaaccaaaucucugu

SEQ ID NO: 810150 - RNA, 22 nt, Human
ggacauaguuuccauccuuuuu

SEQ ID NO: 810151 - RNA, 20 nt, Human
ggagaaugaaaaagcuuucc

SEQ ID NO: 810152 - RNA, 21 nt, Human
guacaauagauugcagcaaaa

SEQ ID NO: 810153 - RNA, 19 nt, Human
guauauauuucucuacccu

SEQ ID NO: 810154 - RNA, 18 nt, Human
gucggcgccgggggaagg

SEQ ID NO: 810155 - RNA, 18 nt, Human
guggccgucggcgccggg

SEQ ID NO: 810156 - RNA, 24 nt, Human
guguuccaaaaggacugaacacaa

SEQ ID NO: 810157 - RNA, 23 nt, Human
uaaacaaacacccagaucacaua

SEQ ID NO: 810158 - RNA, 22 nt, Human
uaacagagauaaacaaacaccc

SEQ ID NO: 810159 - RNA, 18 nt, Human
uaacuaucugcaguaaca

SEQ ID NO: 810160 - RNA, 18 nt, Human
uaagaaaagaauccagag

SEQ ID NO: 810161 - RNA, 19 nt, Human
uaagaaaagaauccagagg

SEQ ID NO: 810162 - RNA, 24 nt, Human
uaagaaaccaaggcaaauuuacca

SEQ ID NO: 810163 - RNA, 25 nt, Human
uaagcuggaagcuacguguuccaau

SEQ ID NO: 810164 - RNA, 28 nt, Human
uacaagaaaaaaaaacaagaaacaagac

SEQ ID NO: 810165 - RNA, 25 nt, Human
uacacaaaaauaaauaaccagauuc

SEQ ID NO: 810166 - RNA, 22 nt, Human
uacaguacaugauaucugugaa

SEQ ID NO: 810167 - RNA, 24 nt, Human
uacauaauucaauaaccacacaaa

SEQ ID NO: 810168 - RNA, 20 nt, Human
uacauuguguucauuuguuc

SEQ ID NO: 810169 - RNA, 19 nt, Human
uagaacagaugauaaaaca

SEQ ID NO: 810170 - RNA, 21 nt, Human
uagaaguaaaacugaggacau

SEQ ID NO: 810171 - RNA, 21 nt, Human
uagagacagaagggaagcaca

SEQ ID NO: 810172 - RNA, 21 nt, Human
uaggaaaaaccuaaagauuag

SEQ ID NO: 810173 - RNA, 18 nt, Human
uauaggaaaaaccuaaag

SEQ ID NO: 810174 - RNA, 22 nt, Human
uauuuuggaguucuaaugaaua

SEQ ID NO: 810175 - RNA, 32 nt, Human
ucacauacacuccccaacacacacaugcagug

SEQ ID NO: 810176 - RNA, 23 nt, Human
ucauauacauuuuuugagaagcu

SEQ ID NO: 810177 - RNA, 19 nt, Human
uccagaggaaaaacaauag

SEQ ID NO: 810178 - RNA, 21 nt, Human
uccagaggaaaaacaauagac

SEQ ID NO: 810179 - RNA, 25 nt, Human
uccagccucggcccgcguuccuggc

SEQ ID NO: 810180 - RNA, 20 nt, Human
uccuugaguugucagugucu

SEQ ID NO: 810181 - RNA, 25 nt, Human
ucuucugaagagccacauucuagag

SEQ ID NO: 810182 - RNA, 22 nt, Human
ugaaaacacagcagcaugaaac

SEQ ID NO: 810183 - RNA, 23 nt, Human
ugaaaacacagcagcaugaaaca

SEQ ID NO: 810184 - RNA, 23 nt, Human
ugaaauaacaacaacauacuuaa

SEQ ID NO: 810185 - RNA, 21 nt, Human
ugaagcucauuacaauuucug

SEQ ID NO: 810186 - RNA, 20 nt, Human
ugagcaaauagaccagcuau

SEQ ID NO: 810187 - RNA, 28 nt, Human
ugcaaacacacauuuacuaauaugcaug

SEQ ID NO: 810188 - RNA, 18 nt, Human
ugcacucaaauagagaaa

SEQ ID NO: 810189 - RNA, 19 nt, Human
ugccaagaaacuaaagcuc

SEQ ID NO: 810190 - RNA, 20 nt, Human
ugccaagaaacuaaagcucu

SEQ ID NO: 810191 - RNA, 20 nt, Human
ugccaagaaacuaaagcucu

SEQ ID NO: 810192 - RNA, 18 nt, Human
uggccagccgccucugcu

SEQ ID NO: 810193 - RNA, 18 nt, Human
uggccgucggcgccgggg

SEQ ID NO: 810194 - RNA, 21 nt, Human
ugggauuauuaggauaauuau

SEQ ID NO: 810195 - RNA, 22 nt, Human
ugugugcaaauggacaaaggca

SEQ ID NO: 810196 - RNA, 24 nt, Human
uguugugugcaaauggacaaaggc

SEQ ID NO: 810197 - RNA, 24 nt, Human
uuaggaacauggccacagcuuuug

SEQ ID NO: 810198 - RNA, 21 nt, Human
uuccuggccagccgccucugc

SEQ ID NO: 810199 - RNA, 21 nt, Human
uugcugcaagaauccagaaug

SEQ ID NO: 810200 - RNA, 21 nt, Human
aaaaaaacaagaggacuugac

SEQ ID NO: 810201 - RNA, 18 nt, Human
aaaaccaaagaagcaaaa

SEQ ID NO: 810202 - RNA, 19 nt, Human
aaaaccuacuaaaagggga

SEQ ID NO: 810203 - RNA, 26 nt, Human
aaaauaggcaagaauauauaagacca

SEQ ID NO: 810204 - RNA, 22 nt, Human
aaacacgacaacaaagcugcuc

SEQ ID NO: 810205 - RNA, 27 nt, Human
aaacacgacaacaaagcugcucuaacc

SEQ ID NO: 810206 - RNA, 22 nt, Human
aaacauuaccagauaggcauga

SEQ ID NO: 810207 - RNA, 18 nt, Human
aaaccaaagaagcaaaaa

SEQ ID NO: 810208 - RNA, 27 nt, Human
aaccauauugagaggacaaacagccuc

SEQ ID NO: 810209 - RNA, 20 nt, Human
aagccacccucaaagagaaa

SEQ ID NO: 810210 - RNA, 18 nt, Human
aagggcuccggccagacc

SEQ ID NO: 810211 - RNA, 18 nt, Human
aagugaucauagcuaugg

SEQ ID NO: 810212 - RNA, 18 nt, Human
aaguggucuucacaaaag

SEQ ID NO: 810213 - RNA, 22 nt, Human
acaaagcauuucccaguauaaa

SEQ ID NO: 810214 - RNA, 23 nt, Human
acagaaaaagaauuuuucuuucc

SEQ ID NO: 810215 - RNA, 24 nt, Human
acccaagggcuccggccagaccaa

SEQ ID NO: 810216 - RNA, 20 nt, Human
acccucaaagagaaauaacc

SEQ ID NO: 810217 - RNA, 22 nt, Human
acuugguacaaagcauuuccca

SEQ ID NO: 810218 - RNA, 18 nt, Human
agacagagguuggcuaag

SEQ ID NO: 810219 - RNA, 23 nt, Human
agcaaaaauaagcuucagagggc

SEQ ID NO: 810220 - RNA, 21 nt, Human
agcacagguccccgugacaac

SEQ ID NO: 810221 - RNA, 22 nt, Human
agcuauggaugaggccucgggc

SEQ ID NO: 810222 - RNA, 19 nt, Human
aggaggaaggagcugagaa

SEQ ID NO: 810223 - RNA, 18 nt, Human
agggcaagugaucauagc

SEQ ID NO: 810224 - RNA, 22 nt, Human
agugaaauuuacacaggaggaa

SEQ ID NO: 810225 - RNA, 20 nt, Human
aucuggugucaaagucucag

SEQ ID NO: 810226 - RNA, 19 nt, Human
caaacagccuccauaaagu

SEQ ID NO: 810227 - RNA, 18 nt, Human
caaagagaaauaacccau

SEQ ID NO: 810228 - RNA, 24 nt, Human
cacaaaauaggcaagaauauauaa

SEQ ID NO: 810229 - RNA, 21 nt, Human
cacaaacagcugaaagaaucu

SEQ ID NO: 810230 - RNA, 22 nt, Human
cagagguuggcuaaggggaugg

SEQ ID NO: 810231 - RNA, 18 nt, Human
caugagguacagaaaaag

SEQ ID NO: 810232 - RNA, 20 nt, Human
cauguccuuaacuuguuuca

SEQ ID NO: 810233 - RNA, 23 nt, Human
ccacccucaaagagaaauaaccc

SEQ ID NO: 810234 - RNA, 21 nt, Human
ccagauaggcaugagguacag

SEQ ID NO: 810235 - RNA, 20 nt, Human
ccaggucuuacucaccagaa

SEQ ID NO: 810236 - RNA, 20 nt, Human
ccccaggucuuacucaccag

SEQ ID NO: 810237 - RNA, 22 nt, Human
cccucaaagagaaauaacccau

SEQ ID NO: 810238 - RNA, 22 nt, Human
ccuauaguuggccuugagaggg

SEQ ID NO: 810239 - RNA, 18 nt, Human
ccucccugacaacccuca

SEQ ID NO: 810240 - RNA, 19 nt, Human
ccucccugacaacccucau

SEQ ID NO: 810241 - RNA, 18 nt, Human
cuccaggaaaguuggggc

SEQ ID NO: 810242 - RNA, 19 nt, Human
gaaagggcuuuaagggcac

SEQ ID NO: 810243 - RNA, 19 nt, Human
gacuaacaaguaagguaaa

SEQ ID NO: 810244 - RNA, 24 nt, Human
gagguuggcuaaggggaugggugg

SEQ ID NO: 810245 - RNA, 22 nt, Human
gccaaacauuccccaggucuua

SEQ ID NO: 810246 - RNA, 24 nt, Human
ggaaacaguggggcguagacuaac

SEQ ID NO: 810247 - RNA, 25 nt, Human
gggaagagaauccagaaacacgaca

SEQ ID NO: 810248 - RNA, 19 nt, Human
ggggauggguggaaacagu

SEQ ID NO: 810249 - RNA, 21 nt, Human
ggggauggguggaaacagugg

SEQ ID NO: 810250 - RNA, 22 nt, Human
ggggauggguggaaacaguggg

SEQ ID NO: 810251 - RNA, 22 nt, Human
guccccgugacaacagcaucac

SEQ ID NO: 810252 - RNA, 19 nt, Human
uaaauaucuacaucuggug

SEQ ID NO: 810253 - RNA, 24 nt, Human
uaaccaauguuccagagaaagcca

SEQ ID NO: 810254 - RNA, 19 nt, Human
uaagguaaaguccagggag

SEQ ID NO: 810255 - RNA, 19 nt, Human
uaauagccuuucagaauuu

SEQ ID NO: 810256 - RNA, 18 nt, Human
uacuugucuauaucaggu

SEQ ID NO: 810257 - RNA, 26 nt, Human
uagcaggaaaaccuacuaaaagggga

SEQ ID NO: 810258 - RNA, 19 nt, Human
uaggagacugucaaaacau

SEQ ID NO: 810259 - RNA, 26 nt, Human
uauaaacagcauaggguaguucuaga

SEQ ID NO: 810260 - RNA, 25 nt, Human
uauaccccaggaaggaaaggacaac

SEQ ID NO: 810261 - RNA, 24 nt, Human
uauugagaggacaaacagccucca

SEQ ID NO: 810262 - RNA, 19 nt, Human
uauuuggaggagcacaaag

SEQ ID NO: 810263 - RNA, 19 nt, Human
ucaccagaaauuaacauag

SEQ ID NO: 810264 - RNA, 23 nt, Human
uccagagaaagccacccucaaag

SEQ ID NO: 810265 - RNA, 20 nt, Human
ucccaguauaaacagcauag

SEQ ID NO: 810266 - RNA, 21 nt, Human
uccucccagcacagguccccg

SEQ ID NO: 810267 - RNA, 24 nt, Human
ucgggcuccaggaaaguuggggca

SEQ ID NO: 810268 - RNA, 22 nt, Human
ucuuuccagcuccagauaaaua

SEQ ID NO: 810269 - RNA, 21 nt, Human
ucuuugggcaagauaaaaaaa

SEQ ID NO: 810270 - RNA, 22 nt, Human
ugaaugacaacaguucuaacuu

SEQ ID NO: 810271 - RNA, 19 nt, Human
ugacaacccucaucuacug

SEQ ID NO: 810272 - RNA, 19 nt, Human
ugagagggagcucuuuggg

SEQ ID NO: 810273 - RNA, 21 nt, Human
ugagagggagcucuuugggca

SEQ ID NO: 810274 - RNA, 22 nt, Human
uggcaguauccaauucagguuu

SEQ ID NO: 810275 - RNA, 20 nt, Human
uguaagaagggaagacagug

SEQ ID NO: 810276 - RNA, 24 nt, Human
uuacgcaaaauggggaagagaauc

SEQ ID NO: 810277 - RNA, 21 nt, Human
uugcuuuucaugucugugggu

SEQ ID NO: 810278 - RNA, 18 nt, Human
aaaaagaaaaaagaaaaa

SEQ ID NO: 810279 - RNA, 25 nt, Human
aaaagaaaaaagaaaaagaaaagaa

SEQ ID NO: 810280 - RNA, 19 nt, Human
aaaagaaaaagaaaagaaa

SEQ ID NO: 810281 - RNA, 18 nt, Human
aaggcuggaggccgcucc

SEQ ID NO: 810282 - RNA, 19 nt, Human
aaguacuuguccugcaccc

SEQ ID NO: 810283 - RNA, 23 nt, Human
aauggcaggaagcauauuaggug

SEQ ID NO: 810284 - RNA, 18 nt, Human
acaaagcguucuuuagag

SEQ ID NO: 810285 - RNA, 22 nt, Human
acacacacaaagaggcaacacc

SEQ ID NO: 810286 - RNA, 21 nt, Human
acaccaagaacagacugaaac

SEQ ID NO: 810287 - RNA, 23 nt, Human
acaccaccucacccucaaugaac

SEQ ID NO: 810288 - RNA, 21 nt, Human
acagacgaagcacuugaugug

SEQ ID NO: 810289 - RNA, 18 nt, Human
acagauccgagcggugga

SEQ ID NO: 810290 - RNA, 22 nt, Human
acagcggggaaggguggcguga

SEQ ID NO: 810291 - RNA, 22 nt, Human
acccacugcggacggggaaaca

SEQ ID NO: 810292 - RNA, 18 nt, Human
accuaaugacagacacca

SEQ ID NO: 810293 - RNA, 22 nt, Human
accuaaugacagacaccaacgc

SEQ ID NO: 810294 - RNA, 21 nt, Human
accugugugacgagaaaaaga

SEQ ID NO: 810295 - RNA, 21 nt, Human
acgcugggaaggugggcuggg

SEQ ID NO: 810296 - RNA, 21 nt, Human
agaaaaagaaaaaagaaaaag

SEQ ID NO: 810297 - RNA, 23 nt, Human
agaaaaagaaaaaagaaaaagaa

SEQ ID NO: 810298 - RNA, 22 nt, Human
agacaccgccagccacagcaca

SEQ ID NO: 810299 - RNA, 25 nt, Human
agcaaggaaaacagugguggcuaua

SEQ ID NO: 810300 - RNA, 21 nt, Human
agcaaggugugugggaggggu

SEQ ID NO: 810301 - RNA, 26 nt, Human
agccggcagacggcacacacgaagca

SEQ ID NO: 810302 - RNA, 23 nt, Human
agggagcucuguguaugaggacc

SEQ ID NO: 810303 - RNA, 20 nt, Human
auauuguguaggcaucuagg

SEQ ID NO: 810304 - RNA, 22 nt, Human
aucuccauccuucucuccccaa

SEQ ID NO: 810305 - RNA, 22 nt, Human
auggacacagagaagccagagc

SEQ ID NO: 810306 - RNA, 19 nt, Human
caaccaucaucaacaagcc

SEQ ID NO: 810307 - RNA, 25 nt, Human
cacaccaagaacagacugaaaccac

SEQ ID NO: 810308 - RNA, 23 nt, Human
cacagcucacgucccggccaccu

SEQ ID NO: 810309 - RNA, 18 nt, Human
caccccauggacacagag

SEQ ID NO: 810310 - RNA, 25 nt, Human
cacccuaacacacaccuaaugacag

SEQ ID NO: 810311 - RNA, 25 nt, Human
caccgccagccacagcacaaggacg

SEQ ID NO: 810312 - RNA, 21 nt, Human
cagccucucccugacaccaag

SEQ ID NO: 810313 - RNA, 20 nt, Human
cagcucacgucccggccacc

SEQ ID NO: 810314 - RNA, 21 nt, Human
cauggaggggcgcuggcggaa

SEQ ID NO: 810315 - RNA, 27 nt, Human
ccaagaacagacugaaaccacacagau

SEQ ID NO: 810316 - RNA, 24 nt, Human
ccaagaacagacugaaaccacacc

SEQ ID NO: 810317 - RNA, 23 nt, Human
ccaccucugucccccacgugccc

SEQ ID NO: 810318 - RNA, 18 nt, Human
cccaagacuuggaaaaau

SEQ ID NO: 810319 - RNA, 24 nt, Human
cccacgugcccagcaccggggcca

SEQ ID NO: 810320 - RNA, 23 nt, Human
ccccaacagcgugugguugucug

SEQ ID NO: 810321 - RNA, 23 nt, Human
cccccucccuagccgagcugggc

SEQ ID NO: 810322 - RNA, 21 nt, Human
ccccgucugcgagucugccug

SEQ ID NO: 810323 - RNA, 19 nt, Human
cccuggccucggcgcccgg

SEQ ID NO: 810324 - RNA, 21 nt, Human
ccgaagggccgugugcccacc

SEQ ID NO: 810325 - RNA, 22 nt, Human
ccgacaccaccucacccucaau

SEQ ID NO: 810326 - RNA, 22 nt, Human
ccgcccaccccauggacacaga

SEQ ID NO: 810327 - RNA, 18 nt, Human
ccgucugcgagucugccu

SEQ ID NO: 810328 - RNA, 25 nt, Human
ccucacagcucacgucccggccacc

SEQ ID NO: 810329 - RNA, 20 nt, Human
ccucccgcccaccccauggg

SEQ ID NO: 810330 - RNA, 21 nt, Human
ccucccuagccgagcugggcg

SEQ ID NO: 810331 - RNA, 19 nt, Human
ccuggccucggcgcccggc

SEQ ID NO: 810332 - RNA, 19 nt, Human
ccugucuugucccuuguug

SEQ ID NO: 810333 - RNA, 22 nt, Human
cgacacagccacucuacagccu

SEQ ID NO: 810334 - RNA, 21 nt, Human
cgacaccaccucacccucaau

SEQ ID NO: 810335 - RNA, 21 nt, Human
cgcagcugaagcagcgggugc

SEQ ID NO: 810336 - RNA, 18 nt, Human
cggacggggaaacagacu

SEQ ID NO: 810337 - RNA, 21 nt, Human
cgggaugcccugcuggcuuca

SEQ ID NO: 810338 - RNA, 25 nt, Human
cuaaaaacucccccucccuagccga

SEQ ID NO: 810339 - RNA, 20 nt, Human
cuaucuccauccuaucucca

SEQ ID NO: 810340 - RNA, 20 nt, Human
cucacaggcaggaacaucgg

SEQ ID NO: 810341 - RNA, 19 nt, Human
cuggaggaggaacgcagcg

SEQ ID NO: 810342 - RNA, 21 nt, Human
gaaaaaagaaaaagaaaagaa

SEQ ID NO: 810343 - RNA, 21 nt, Human
gaaaaagaaaaaagaaaaaga

SEQ ID NO: 810344 - RNA, 22 nt, Human
gaagaagccgcccucggccagg

SEQ ID NO: 810345 - RNA, 18 nt, Human
gagccucugguaguccag

SEQ ID NO: 810346 - RNA, 19 nt, Human
gaggaccacaccaagaaca

SEQ ID NO: 810347 - RNA, 24 nt, Human
gaggaggauguuuucuccccaaga

SEQ ID NO: 810348 - RNA, 20 nt, Human
gaggcaacacccacugcgga

SEQ ID NO: 810349 - RNA, 23 nt, Human
gcagccaccugugugcuccaucu

SEQ ID NO: 810350 - RNA, 22 nt, Human
gccaggggccccuggccucggc

SEQ ID NO: 810351 - RNA, 19 nt, Human
gcccagcgccgacaccacc

SEQ ID NO: 810352 - RNA, 27 nt, Human
gccgacaccaccucacccucaaugaac

SEQ ID NO: 810353 - RNA, 21 nt, Human
gcgggugccguagagccucug

SEQ ID NO: 810354 - RNA, 19 nt, Human
ggacccccucccgcccacc

SEQ ID NO: 810355 - RNA, 20 nt, Human
gggaugcccugcuggcuuca

SEQ ID NO: 810356 - RNA, 24 nt, Human
gggugugugcgguucucgccaggg

SEQ ID NO: 810357 - RNA, 18 nt, Human
ggugcaucaagagcuacg

SEQ ID NO: 810358 - RNA, 23 nt, Human
gucccggccaccucuguccccca

SEQ ID NO: 810359 - RNA, 20 nt, Human
guggaaacccuugauuccag

SEQ ID NO: 810360 - RNA, 19 nt, Human
uaacagcaaggaaaacagu

SEQ ID NO: 810361 - RNA, 22 nt, Human
uacagccucucccugacaccaa

SEQ ID NO: 810362 - RNA, 21 nt, Human
uagagccucugguaguccagc

SEQ ID NO: 810363 - RNA, 18 nt, Human
uagccgagcugggcgggu

SEQ ID NO: 810364 - RNA, 24 nt, Human
uaucagcauccugugacggccggu

SEQ ID NO: 810365 - RNA, 22 nt, Human
uccccgggggggaagggcagcc

SEQ ID NO: 810366 - RNA, 20 nt, Human
ucgaucuggaggaggaacgc

SEQ ID NO: 810367 - RNA, 18 nt, Human
ucgcuccuggggcaugug

SEQ ID NO: 810368 - RNA, 20 nt, Human
ucuccauccuaucuccaucc

SEQ ID NO: 810369 - RNA, 20 nt, Human
ucuccauccuaucuccaucc

SEQ ID NO: 810370 - RNA, 22 nt, Human
ucucccugacaccaagccacag

SEQ ID NO: 810371 - RNA, 22 nt, Human
ucugaugcccgacacagccacu

SEQ ID NO: 810372 - RNA, 24 nt, Human
ugacgagaaaaagaaaaaagaaaa

SEQ ID NO: 810373 - RNA, 20 nt, Human
ugagaagagccacaucucca

SEQ ID NO: 810374 - RNA, 18 nt, Human
ugagacaccgccagccac

SEQ ID NO: 810375 - RNA, 20 nt, Human
ugagacaccgccagccacag

SEQ ID NO: 810376 - RNA, 22 nt, Human
ugccguagagccucugguaguc

SEQ ID NO: 810377 - RNA, 21 nt, Human
ugcuaaaaacucccccucccu

SEQ ID NO: 810378 - RNA, 23 nt, Human
uggaaaaauaacagcaaggaaaa

SEQ ID NO: 810379 - RNA, 18 nt, Human
ugggaaggugggcugggc

SEQ ID NO: 810380 - RNA, 24 nt, Human
ugggaucagauaugacauugcacu

SEQ ID NO: 810381 - RNA, 19 nt, Human
uggggcaggcuggcagccg

SEQ ID NO: 810382 - RNA, 21 nt, Human
ugucccagacgcucacugccc

SEQ ID NO: 810383 - RNA, 23 nt, Human
uguccugcacccgcagcaccucg

SEQ ID NO: 810384 - RNA, 18 nt, Human
ugugacggccggugcugc

SEQ ID NO: 810385 - RNA, 21 nt, Human
uucuuuagaggggucugucuc

SEQ ID NO: 810386 - RNA, 21 nt, Human
uugaaggucacucgguccccg

SEQ ID NO: 810387 - RNA, 24 nt, Human
uuugguguuucauccaccucucag

SEQ ID NO: 810388 - RNA, 24 nt, Human
uuuuccaggcuuccugggaucaga

SEQ ID NO: 810389 - RNA, 19 nt, Human
aaacagcucccccgccccc

SEQ ID NO: 810390 - RNA, 19 nt, Human
aaacagcucccccgccccc

SEQ ID NO: 810391 - RNA, 24 nt, Human
aaagugcugggauuacaggcguga

SEQ ID NO: 810392 - RNA, 21 nt, Human
aaccagcucccgucccucccc

SEQ ID NO: 810393 - RNA, 19 nt, Human
aagugcugggauuacaggc

SEQ ID NO: 810394 - RNA, 19 nt, Human
aagugcugggauuacaggc

SEQ ID NO: 810395 - RNA, 27 nt, Human
aauaaaauagaaacagcucccccgccc

SEQ ID NO: 810396 - RNA, 19 nt, Human
accagcucccgucccuccc

SEQ ID NO: 810397 - RNA, 21 nt, Human
accagcucccgucccuccccc

SEQ ID NO: 810398 - RNA, 23 nt, Human
accauguuggucaggcuggucuc

SEQ ID NO: 810399 - RNA, 24 nt, Human
accuugugauuugcccaccucagc

SEQ ID NO: 810400 - RNA, 19 nt, Human
agagauugaucaauaaaua

SEQ ID NO: 810401 - RNA, 23 nt, Human
aggcaggaucacgcgaaaccaga

SEQ ID NO: 810402 - RNA, 18 nt, Human
agugcugggauuacaggc

SEQ ID NO: 810403 - RNA, 21 nt, Human
augggguuucaccauguuggu

SEQ ID NO: 810404 - RNA, 23 nt, Human
augggguuucaccauguugguca

SEQ ID NO: 810405 - RNA, 24 nt, Human
augggguuucaccauguuggucag

SEQ ID NO: 810406 - RNA, 24 nt, Human
auuuuuguauuuuuaguagagaug

SEQ ID NO: 810407 - RNA, 24 nt, Human
caaagugcugggauuacaggcgug

SEQ ID NO: 810408 - RNA, 19 nt, Human
caaccagcucccgucccuc

SEQ ID NO: 810409 - RNA, 21 nt, Human
caccauguuggucaggcuggu

SEQ ID NO: 810410 - RNA, 24 nt, Human
caccauguuggucaggcuggucuc

SEQ ID NO: 810411 - RNA, 22 nt, Human
cacccccaguugggcacggccu

SEQ ID NO: 810412 - RNA, 24 nt, Human
caccucagcuucccaaagugcugg

SEQ ID NO: 810413 - RNA, 20 nt, Human
cagcucccccgcccccuguu

SEQ ID NO: 810414 - RNA, 24 nt, Human
cagcucccccgcccccuguucccc

SEQ ID NO: 810415 - RNA, 23 nt, Human
cagcucccgucccucccccaccc

SEQ ID NO: 810416 - RNA, 21 nt, Human
cagcucccgucccuccccccc

SEQ ID NO: 810417 - RNA, 20 nt, Human
caggaucacgcgaaaccaga

SEQ ID NO: 810418 - RNA, 22 nt, Human
ccaaagugcugggauuacaggc

SEQ ID NO: 810419 - RNA, 22 nt, Human
ccaaagugcugggauuacaggc

SEQ ID NO: 810420 - RNA, 24 nt, Human
ccaaagugcugggauuacaggcgu

SEQ ID NO: 810421 - RNA, 19 nt, Human
ccccaaccagcucccgucc

SEQ ID NO: 810422 - RNA, 26 nt, Human
ccccaaccagcucccgucccuccccc

SEQ ID NO: 810423 - RNA, 18 nt, Human
ccccaccccaccccgcag

SEQ ID NO: 810424 - RNA, 19 nt, Human
ccccaccccaccccgcaga

SEQ ID NO: 810425 - RNA, 22 nt, Human
ccccuagaaccacccccaguuu

SEQ ID NO: 810426 - RNA, 19 nt, Human
ccccucccuccccggcccc

SEQ ID NO: 810427 - RNA, 24 nt, Human
ccccuguuccccuagaaccacccc

SEQ ID NO: 810428 - RNA, 21 nt, Human
cccgucccucccccaccccac

SEQ ID NO: 810429 - RNA, 18 nt, Human
cccucccccaccccaccc

SEQ ID NO: 810430 - RNA, 25 nt, Human
cccuguuccccuagaaccaccccca

SEQ ID NO: 810431 - RNA, 23 nt, Human
ccgcccccuguuccccuagaacc

SEQ ID NO: 810432 - RNA, 20 nt, Human
ccucccccaccccaccccgc

SEQ ID NO: 810433 - RNA, 22 nt, Human
ccucccccaccccaccccgcag

SEQ ID NO: 810434 - RNA, 20 nt, Human
cgaaaccagaauuccuuccc

SEQ ID NO: 810435 - RNA, 21 nt, Human
cgaaaccagaauuccuuccgg

SEQ ID NO: 810436 - RNA, 19 nt, Human
cggccuguggagccccauc

SEQ ID NO: 810437 - RNA, 18 nt, Human
cgucccucccccacccca

SEQ ID NO: 810438 - RNA, 18 nt, Human
cucccccaccccaccccg

SEQ ID NO: 810439 - RNA, 21 nt, Human
cucccgucccucccccacccc

SEQ ID NO: 810440 - RNA, 22 nt, Human
cuccugaccuugugauuugccc

SEQ ID NO: 810441 - RNA, 28 nt, Human
cugcuaagccaccccaaccagcucccgu

SEQ ID NO: 810442 - RNA, 22 nt, Human
gaccuugugauuugcccaccuc

SEQ ID NO: 810443 - RNA, 24 nt, Human
gaccuugugauuugcccaccucag

SEQ ID NO: 810444 - RNA, 24 nt, Human
gagaugggguuucaccauguuggu

SEQ ID NO: 810445 - RNA, 18 nt, Human
gagccccaucccugcagg

SEQ ID NO: 810446 - RNA, 18 nt, Human
gaggaggggcccgggaag

SEQ ID NO: 810447 - RNA, 18 nt, Human
gcuaagccaccccaacca

SEQ ID NO: 810448 - RNA, 18 nt, Human
ggaaucagagacacggac

SEQ ID NO: 810449 - RNA, 19 nt, Human
ggcccgggaagaggggguu

SEQ ID NO: 810450 - RNA, 23 nt, Human
ggcuggucucaaacuccugaccu

SEQ ID NO: 810451 - RNA, 21 nt, Human
gggggcacggaaggggggugg

SEQ ID NO: 810452 - RNA, 21 nt, Human
gggggguggaggggggucccc

SEQ ID NO: 810453 - RNA, 22 nt, Human
gggguuucaccauguuggucag

SEQ ID NO: 810454 - RNA, 19 nt, Human
ggguccccucccuccccgg

SEQ ID NO: 810455 - RNA, 22 nt, Human
ggguuucaccauguuggucagg

SEQ ID NO: 810456 - RNA, 20 nt, Human
ggucucaaacuccugaccuu

SEQ ID NO: 810457 - RNA, 18 nt, Human
guacagaaggucgugggg

SEQ ID NO: 810458 - RNA, 23 nt, Human
guagagaugggguuucaccaugu

SEQ ID NO: 810459 - RNA, 24 nt, Human
gugauuugcccaccucagcuuccc

SEQ ID NO: 810460 - RNA, 22 nt, Human
uaagccaccccaaccagcuccc

SEQ ID NO: 810461 - RNA, 24 nt, Human
uaauuuuuguauuuuuaguagaga

SEQ ID NO: 810462 - RNA, 23 nt, Human
uagaaacagcucccccgcccccu

SEQ ID NO: 810463 - RNA, 22 nt, Human
uagagaugggguuucaccaugu

SEQ ID NO: 810464 - RNA, 24 nt, Human
uaguagagaugggguuucaccaug

SEQ ID NO: 810465 - RNA, 26 nt, Human
uaguagagaugggguuucaccauguu

SEQ ID NO: 810466 - RNA, 24 nt, Human
ucccaaagugcugggauuacaggc

SEQ ID NO: 810467 - RNA, 19 nt, Human
uccccuagaaccaccccca

SEQ ID NO: 810468 - RNA, 19 nt, Human
ucccgucccucccccaccc

SEQ ID NO: 810469 - RNA, 20 nt, Human
ucccgucccucccccacccc

SEQ ID NO: 810470 - RNA, 23 nt, Human
ugauuugcccaccucagcuuccc

SEQ ID NO: 810471 - RNA, 24 nt, Human
ugauuugcccaccucagcuuccca

SEQ ID NO: 810472 - RNA, 20 nt, Human
ugcugggauuacaggcguga

SEQ ID NO: 810473 - RNA, 18 nt, Human
ugggauuacaggcgugag

SEQ ID NO: 810474 - RNA, 19 nt, Human
ugggauuacaggcgugagc

SEQ ID NO: 810475 - RNA, 20 nt, Human
uggggggaggaccaggggag

SEQ ID NO: 810476 - RNA, 24 nt, Human
ugggguuucaccauguuggucagg

SEQ ID NO: 810477 - RNA, 24 nt, Human
uggucaggcuggucucaaacuccu

SEQ ID NO: 810478 - RNA, 21 nt, Human
uguauuuuuaguagagauggg

SEQ ID NO: 810479 - RNA, 18 nt, Human
uuaguagagaugggguuu

SEQ ID NO: 810480 - RNA, 22 nt, Human
uuaguagagaugggguuucacc

SEQ ID NO: 810481 - RNA, 24 nt, Human
uuaguagagaugggguuucaccau

SEQ ID NO: 810482 - RNA, 19 nt, Human
uuccggagagcaaauccgu

SEQ ID NO: 810483 - RNA, 20 nt, Human
uuggggggcacggaaggggg

SEQ ID NO: 810484 - RNA, 23 nt, Human
uuguauuuuuaguagagaugggg

SEQ ID NO: 810485 - RNA, 24 nt, Human
uuucaccauguuggucaggcuggu

SEQ ID NO: 810486 - RNA, 21 nt, Human
uuugcccaccucagcuuccca

SEQ ID NO: 810487 - RNA, 19 nt, Human
uuuguguccaccccccucc

SEQ ID NO: 810488 - RNA, 24 nt, Human
uuuuuaguagagaugggguuucac

SEQ ID NO: 810489 - RNA, 20 nt, Human
uuuuuguauuuuuaguagag

SEQ ID NO: 810490 - RNA, 20 nt, Human
aaacacaaauaaacaagaca

SEQ ID NO: 810491 - RNA, 20 nt, Human
aaagagacaaagacucgggg

SEQ ID NO: 810492 - RNA, 22 nt, Human
aacaagcccugauccccaccaa

SEQ ID NO: 810493 - RNA, 18 nt, Human
aaccaggaagaggugucc

SEQ ID NO: 810494 - RNA, 18 nt, Human
aaccgagcccaggcccgg

SEQ ID NO: 810495 - RNA, 21 nt, Human
aaccugggugaagggagaggc

SEQ ID NO: 810496 - RNA, 20 nt, Human
aagagccaaggccaggcagu

SEQ ID NO: 810497 - RNA, 24 nt, Human
aagagccaaggccaggcaguggga

SEQ ID NO: 810498 - RNA, 25 nt, Human
aagcccagaggccuggauccuagga

SEQ ID NO: 810499 - RNA, 19 nt, Human
aagcccugauccccaccaa

SEQ ID NO: 810500 - RNA, 23 nt, Human
aaggaggggcaaguggaggcucc

SEQ ID NO: 810501 - RNA, 18 nt, Human
aagggggcuggcaccucu

SEQ ID NO: 810502 - RNA, 20 nt, Human
aagucaucaugcagagcggg

SEQ ID NO: 810503 - RNA, 21 nt, Human
acaggcgcgccgcccggcccc

SEQ ID NO: 810504 - RNA, 19 nt, Human
accaaacaccuccuugaca

SEQ ID NO: 810505 - RNA, 18 nt, Human
acccagugagccagggcc

SEQ ID NO: 810506 - RNA, 23 nt, Human
accccacacaccccagcccccag

SEQ ID NO: 810507 - RNA, 24 nt, Human
accccacacaccccagcccccagc

SEQ ID NO: 810508 - RNA, 22 nt, Human
acccccuccccuccccucucug

SEQ ID NO: 810509 - RNA, 20 nt, Human
acccugaggggaggaagguc

SEQ ID NO: 810510 - RNA, 18 nt, Human
accgagcccaggcccggc

SEQ ID NO: 810511 - RNA, 22 nt, Human
accucacuuccacagagcccag

SEQ ID NO: 810512 - RNA, 26 nt, Human
accuggcagcaaagacccaggcccaa

SEQ ID NO: 810513 - RNA, 19 nt, Human
agaaagacagggacccaaa

SEQ ID NO: 810514 - RNA, 20 nt, Human
agacagaaaggcggcuaaac

SEQ ID NO: 810515 - RNA, 21 nt, Human
agaccaccccacacaccccag

SEQ ID NO: 810516 - RNA, 18 nt, Human
agaccccuccugacccac

SEQ ID NO: 810517 - RNA, 22 nt, Human
agagaaagacagggacccaaaa

SEQ ID NO: 810518 - RNA, 24 nt, Human
agagaaggaggggcaaguggaggc

SEQ ID NO: 810519 - RNA, 21 nt, Human
agagaggcugcagagcucaaa

SEQ ID NO: 810520 - RNA, 23 nt, Human
agagcagauagagaacccccucc

SEQ ID NO: 810521 - RNA, 21 nt, Human
agagcggggccaagaagugga

SEQ ID NO: 810522 - RNA, 28 nt, Human
agagcggggccaagaaguggacagagaa

SEQ ID NO: 810523 - RNA, 18 nt, Human
agaggccaggacucaggu

SEQ ID NO: 810524 - RNA, 20 nt, Human
agagucccuccaccuugaga

SEQ ID NO: 810525 - RNA, 19 nt, Human
agaugguaauuagggaaca

SEQ ID NO: 810526 - RNA, 20 nt, Human
agccccaggccgcccccagc

SEQ ID NO: 810527 - RNA, 19 nt, Human
agcgggacccagugagcca

SEQ ID NO: 810528 - RNA, 20 nt, Human
agcgguggggaaugaagugg

SEQ ID NO: 810529 - RNA, 18 nt, Human
agcugcccggcccagccc

SEQ ID NO: 810530 - RNA, 20 nt, Human
agcuggugccaucuggcuuu

SEQ ID NO: 810531 - RNA, 20 nt, Human
aggaagagguguccacgcug

SEQ ID NO: 810532 - RNA, 21 nt, Human
aggaaggagacaggcucagag

SEQ ID NO: 810533 - RNA, 23 nt, Human
aggaaggagacaggcucagagaa

SEQ ID NO: 810534 - RNA, 21 nt, Human
aggagagaggcugcagagcuc

SEQ ID NO: 810535 - RNA, 22 nt, Human
aggagcagggagugaccacagg

SEQ ID NO: 810536 - RNA, 25 nt, Human
aggagcugcggggagcugggggagg

SEQ ID NO: 810537 - RNA, 21 nt, Human
aggcagugcccugccucccuc

SEQ ID NO: 810538 - RNA, 22 nt, Human
aggccaggacucaggugaggga

SEQ ID NO: 810539 - RNA, 20 nt, Human
aggcccagccaggccggcuc

SEQ ID NO: 810540 - RNA, 23 nt, Human
aggccugaaggccugaaggagcc

SEQ ID NO: 810541 - RNA, 18 nt, Human
aggcucagagaaagacag

SEQ ID NO: 810542 - RNA, 20 nt, Human
aggcucagagaaagacaggg

SEQ ID NO: 810543 - RNA, 19 nt, Human
agggacccaaaagagacaa

SEQ ID NO: 810544 - RNA, 18 nt, Human
agggccacccugaguucu

SEQ ID NO: 810545 - RNA, 21 nt, Human
agggcccauugguggggggag

SEQ ID NO: 810546 - RNA, 24 nt, Human
agggggccaagggggcuggcaccu

SEQ ID NO: 810547 - RNA, 18 nt, Human
agguagaugcccugccuu

SEQ ID NO: 810548 - RNA, 23 nt, Human
aggucccugguccucucagccag

SEQ ID NO: 810549 - RNA, 21 nt, Human
agucaaaagacacugcgaacc

SEQ ID NO: 810550 - RNA, 24 nt, Human
aguggcacuggcagagucugcaca

SEQ ID NO: 810551 - RNA, 22 nt, Human
aguggggaagggacuucuuagg

SEQ ID NO: 810552 - RNA, 23 nt, Human
aguuauuuguugugugacuacau

SEQ ID NO: 810553 - RNA, 19 nt, Human
auaaguccaaagugccaca

SEQ ID NO: 810554 - RNA, 19 nt, Human
auacaagugaaaacgaggc

SEQ ID NO: 810555 - RNA, 25 nt, Human
auaccaguuuccaugacaacuccua

SEQ ID NO: 810556 - RNA, 18 nt, Human
auagagaacccccucccc

SEQ ID NO: 810557 - RNA, 19 nt, Human
auccggagcagcuggugcc

SEQ ID NO: 810558 - RNA, 24 nt, Human
aucucaauucccccugggccccaa

SEQ ID NO: 810559 - RNA, 19 nt, Human
aucuugcuccuccaaguca

SEQ ID NO: 810560 - RNA, 22 nt, Human
caaaaccucacuuccacagagc

SEQ ID NO: 810561 - RNA, 18 nt, Human
caaaagacacugcgaacc

SEQ ID NO: 810562 - RNA, 21 nt, Human
caaagacccaggcccaagccc

SEQ ID NO: 810563 - RNA, 24 nt, Human
caaagacccaggcccaagcccaau

SEQ ID NO: 810564 - RNA, 22 nt, Human
caaccccacggagccgagggcc

SEQ ID NO: 810565 - RNA, 23 nt, Human
caacuccuagccucugcacaccc

SEQ ID NO: 810566 - RNA, 22 nt, Human
caagcccaauccugcauccucc

SEQ ID NO: 810567 - RNA, 20 nt, Human
caagucaaaagacacugcga

SEQ ID NO: 810568 - RNA, 24 nt, Human
caaugcuggucugaacagggcuga

SEQ ID NO: 810569 - RNA, 21 nt, Human
cacaaacacaaauaaacaaga

SEQ ID NO: 810570 - RNA, 18 nt, Human
cacaccccagcccccagc

SEQ ID NO: 810571 - RNA, 22 nt, Human
cacauccggagcagcuggugcc

SEQ ID NO: 810572 - RNA, 20 nt, Human
caccaagacucccccuucaa

SEQ ID NO: 810573 - RNA, 25 nt, Human
cacccaaacuccaaggaccagucaa

SEQ ID NO: 810574 - RNA, 18 nt, Human
caccccacacaccccagc

SEQ ID NO: 810575 - RNA, 23 nt, Human
caccccacacaccccagccccca

SEQ ID NO: 810576 - RNA, 18 nt, Human
cacccggaacccccuccc

SEQ ID NO: 810577 - RNA, 18 nt, Human
caccgcgcaggggagggu

SEQ ID NO: 810578 - RNA, 21 nt, Human
caccgcgcauaaguugggggc

SEQ ID NO: 810579 - RNA, 25 nt, Human
cacgcgcaagcacccgcgucacgcg

SEQ ID NO: 810580 - RNA, 18 nt, Human
cagaaagugggggcgacu

SEQ ID NO: 810581 - RNA, 24 nt, Human
cagaagguccccaaacuaacccug

SEQ ID NO: 810582 - RNA, 21 nt, Human
cagcaaagacccaggcccaag

SEQ ID NO: 810583 - RNA, 21 nt, Human
cagcgguggggaaugaagugg

SEQ ID NO: 810584 - RNA, 19 nt, Human
caggagcaccccccuuuua

SEQ ID NO: 810585 - RNA, 20 nt, Human
caggagcagggagugaccac

SEQ ID NO: 810586 - RNA, 23 nt, Human
caggagccccugacccauucucc

SEQ ID NO: 810587 - RNA, 23 nt, Human
caggcaagagggcuccaccuccc

SEQ ID NO: 810588 - RNA, 25 nt, Human
caggcucagagaaagacagggaccc

SEQ ID NO: 810589 - RNA, 23 nt, Human
caggcucauaccaguuuccauga

SEQ ID NO: 810590 - RNA, 23 nt, Human
cagggacccaaaagagacaaaga

SEQ ID NO: 810591 - RNA, 19 nt, Human
caguggcagcuucaggagc

SEQ ID NO: 810592 - RNA, 24 nt, Human
caugaaaaugaacacguguguaug

SEQ ID NO: 810593 - RNA, 25 nt, Human
caugacaacuccuagccucugcaca

SEQ ID NO: 810594 - RNA, 26 nt, Human
cauucacauacauaugaguucaugug

SEQ ID NO: 810595 - RNA, 29 nt, Human
cauucacauacauaugaguucaugugugg

SEQ ID NO: 810596 - RNA, 21 nt, Human
ccaaaccacacugcccaaugc

SEQ ID NO: 810597 - RNA, 24 nt, Human
ccaaaccacacugcccaaugcugg

SEQ ID NO: 810598 - RNA, 27 nt, Human
ccaaaccacacugcccaaugcuggucu

SEQ ID NO: 810599 - RNA, 21 nt, Human
ccaaccccacggagccgaggg

SEQ ID NO: 810600 - RNA, 20 nt, Human
ccaagucaaaagacacugcg

SEQ ID NO: 810601 - RNA, 18 nt, Human
ccaccaagacucccccuu

SEQ ID NO: 810602 - RNA, 19 nt, Human
ccaccgcccuccuucccac

SEQ ID NO: 810603 - RNA, 20 nt, Human
ccagaaagugggggcgacug

SEQ ID NO: 810604 - RNA, 21 nt, Human
ccagccccgccuccgccuccg

SEQ ID NO: 810605 - RNA, 23 nt, Human
cccaaaccacacugcccaaugcu

SEQ ID NO: 810606 - RNA, 21 nt, Human
cccacugccaaccucucugaa

SEQ ID NO: 810607 - RNA, 19 nt, Human
cccaggccgccucccagac

SEQ ID NO: 810608 - RNA, 19 nt, Human
cccaggcucugcuccuucc

SEQ ID NO: 810609 - RNA, 19 nt, Human
cccagugagccagggcccc

SEQ ID NO: 810610 - RNA, 23 nt, Human
cccauucuccagaguccagcccc

SEQ ID NO: 810611 - RNA, 26 nt, Human
cccauucugcggcgggaagccaggag

SEQ ID NO: 810612 - RNA, 20 nt, Human
ccccaaccccacggagccga

SEQ ID NO: 810613 - RNA, 20 nt, Human
ccccacacaccccagccccc

SEQ ID NO: 810614 - RNA, 23 nt, Human
ccccacacaccccagcccccagc

SEQ ID NO: 810615 - RNA, 24 nt, Human
ccccacacaccccagcccccagca

SEQ ID NO: 810616 - RNA, 30 nt, Human
ccccacacaccccagcccccagcagagcaa

SEQ ID NO: 810617 - RNA, 19 nt, Human
ccccaccaagacucccccu

SEQ ID NO: 810618 - RNA, 20 nt, Human
ccccacggagccgagggccc

SEQ ID NO: 810619 - RNA, 19 nt, Human
ccccacugccaaccucucu

SEQ ID NO: 810620 - RNA, 18 nt, Human
ccccagcacucccugagc

SEQ ID NO: 810621 - RNA, 22 nt, Human
ccccagcacucccugagcaauc

SEQ ID NO: 810622 - RNA, 22 nt, Human
ccccaggccgccucccagaccc

SEQ ID NO: 810623 - RNA, 18 nt, Human
cccccaaccccacggagc

SEQ ID NO: 810624 - RNA, 25 nt, Human
cccccaaugugggcaggcacauccg

SEQ ID NO: 810625 - RNA, 20 nt, Human
ccccccaaccccacggagcc

SEQ ID NO: 810626 - RNA, 27 nt, Human
cccccggcuggauuccaacccuuccgg

SEQ ID NO: 810627 - RNA, 21 nt, Human
ccccggccccggccccggccc

SEQ ID NO: 810628 - RNA, 21 nt, Human
ccccggccccggcccuggccc

SEQ ID NO: 810629 - RNA, 25 nt, Human
ccccggccccggcccuggcccgcgc

SEQ ID NO: 810630 - RNA, 21 nt, Human
ccccuccugacccacugaucc

SEQ ID NO: 810631 - RNA, 21 nt, Human
ccccuucuuucucgcaugccc

SEQ ID NO: 810632 - RNA, 18 nt, Human
cccgcgcgccgccacucg

SEQ ID NO: 810633 - RNA, 18 nt, Human
cccggccccccucaccuc

SEQ ID NO: 810634 - RNA, 25 nt, Human
cccggccccggccccggcccuggcc

SEQ ID NO: 810635 - RNA, 25 nt, Human
cccggccccggccccggcccuggcc

SEQ ID NO: 810636 - RNA, 25 nt, Human
cccggccccggcccuggcccgcgcg

SEQ ID NO: 810637 - RNA, 31 nt, Human
cccggccccggcuccggcuccggccccggcc

SEQ ID NO: 810638 - RNA, 31 nt, Human
cccggcuccggcuccggccccggccccggcc

SEQ ID NO: 810639 - RNA, 21 nt, Human
cccucaaccccagccggggcc

SEQ ID NO: 810640 - RNA, 22 nt, Human
cccucaaccccagccggggccc

SEQ ID NO: 810641 - RNA, 18 nt, Human
cccuccuucccacccaag

SEQ ID NO: 810642 - RNA, 22 nt, Human
cccuggccagcccccgcccgga

SEQ ID NO: 810643 - RNA, 21 nt, Human
cccuucuucuucccugcuccc

SEQ ID NO: 810644 - RNA, 21 nt, Human
ccgccucccagacccggcccc

SEQ ID NO: 810645 - RNA, 24 nt, Human
ccgccuccgccuccgcggcgcccc

SEQ ID NO: 810646 - RNA, 18 nt, Human
ccggccccccucaccucc

SEQ ID NO: 810647 - RNA, 20 nt, Human
ccggcccuggcccgcgcgcc

SEQ ID NO: 810648 - RNA, 18 nt, Human
ccgggcccugagagccac

SEQ ID NO: 810649 - RNA, 23 nt, Human
ccuacagagcugguugcugaggg

SEQ ID NO: 810650 - RNA, 20 nt, Human
ccuccccucucugggcccac

SEQ ID NO: 810651 - RNA, 19 nt, Human
ccucuggaggcugcuccaa

SEQ ID NO: 810652 - RNA, 20 nt, Human
ccucuggguaacagugaaca

SEQ ID NO: 810653 - RNA, 23 nt, Human
ccugagagccacacauccaggga

SEQ ID NO: 810654 - RNA, 20 nt, Human
ccugguccucucagccaggu

SEQ ID NO: 810655 - RNA, 21 nt, Human
ccuguaagcagggcaguggug

SEQ ID NO: 810656 - RNA, 21 nt, Human
ccuucccacccaagucaaaag

SEQ ID NO: 810657 - RNA, 22 nt, Human
ccuuuggggucuccugccuccc

SEQ ID NO: 810658 - RNA, 21 nt, Human
cgccucccagacccggccccc

SEQ ID NO: 810659 - RNA, 21 nt, Human
cgcggcucuuagggaguccac

SEQ ID NO: 810660 - RNA, 23 nt, Human
cggagccgagggcccauaagucc

SEQ ID NO: 810661 - RNA, 19 nt, Human
cggcgggaagccaggagcc

SEQ ID NO: 810662 - RNA, 23 nt, Human
cggcuccggccccggccccggcc

SEQ ID NO: 810663 - RNA, 23 nt, Human
cggcuccggcuccggccccggcc

SEQ ID NO: 810664 - RNA, 19 nt, Human
cggcucgacgcggcggcgg

SEQ ID NO: 810665 - RNA, 19 nt, Human
cggggggaaugugaagagg

SEQ ID NO: 810666 - RNA, 21 nt, Human
cgguggggaaugaagugggua

SEQ ID NO: 810667 - RNA, 22 nt, Human
cguguguaugaaaaugugugug

SEQ ID NO: 810668 - RNA, 22 nt, Human
cucaauucccccugggccccaa

SEQ ID NO: 810669 - RNA, 23 nt, Human
cucagccccaggccgcccccagc

SEQ ID NO: 810670 - RNA, 23 nt, Human
cucauaccaguuuccaugacaac

SEQ ID NO: 810671 - RNA, 19 nt, Human
cuccagaguccagcccccc

SEQ ID NO: 810672 - RNA, 22 nt, Human
cuccaugcucagccccaggccc

SEQ ID NO: 810673 - RNA, 23 nt, Human
cucccacccaaacuccaaggacc

SEQ ID NO: 810674 - RNA, 21 nt, Human
cucccugagcaaucacucugg

SEQ ID NO: 810675 - RNA, 24 nt, Human
cuccgcggcgcccccggcccuggc

SEQ ID NO: 810676 - RNA, 21 nt, Human
cuccugacccacugauccuga

SEQ ID NO: 810677 - RNA, 19 nt, Human
cucgacgcggcggcggcgg

SEQ ID NO: 810678 - RNA, 21 nt, Human
cucucugaaacccuacagcuu

SEQ ID NO: 810679 - RNA, 21 nt, Human
cugaugaccaggacuuaggca

SEQ ID NO: 810680 - RNA, 18 nt, Human
cugccccucuggcagagc

SEQ ID NO: 810681 - RNA, 20 nt, Human
cugccccucuggcagagcuc

SEQ ID NO: 810682 - RNA, 21 nt, Human
cugccccucuggcagagcucc

SEQ ID NO: 810683 - RNA, 19 nt, Human
cugggccccaaaccacacu

SEQ ID NO: 810684 - RNA, 19 nt, Human
cugugacugcgugucuggg

SEQ ID NO: 810685 - RNA, 23 nt, Human
cuucagaagguccccaaacuaac

SEQ ID NO: 810686 - RNA, 20 nt, Human
cuucuucuucccugcucccc

SEQ ID NO: 810687 - RNA, 24 nt, Human
gaaggaggggcaaguggaggcucc

SEQ ID NO: 810688 - RNA, 22 nt, Human
gacaaggggacagccagcggga

SEQ ID NO: 810689 - RNA, 18 nt, Human
gagaaagacagggaccca

SEQ ID NO: 810690 - RNA, 20 nt, Human
gagaaagacagggacccaaa

SEQ ID NO: 810691 - RNA, 20 nt, Human
gagaggcaugggaggccugg

SEQ ID NO: 810692 - RNA, 22 nt, Human
gagcagauagagaacccccuuc

SEQ ID NO: 810693 - RNA, 20 nt, Human
gagccaaggccaggcagugc

SEQ ID NO: 810694 - RNA, 24 nt, Human
gagccagagccaggagucuggaaa

SEQ ID NO: 810695 - RNA, 22 nt, Human
gagccccugacccauucuccag

SEQ ID NO: 810696 - RNA, 19 nt, Human
gagcccgaaagagaaggag

SEQ ID NO: 810697 - RNA, 21 nt, Human
gaggagugaauucacucagca

SEQ ID NO: 810698 - RNA, 22 nt, Human
gaggcuccauuuugagaaaugc

SEQ ID NO: 810699 - RNA, 19 nt, Human
gcagagcggggccaagaag

SEQ ID NO: 810700 - RNA, 19 nt, Human
gccacacauccagggagcc

SEQ ID NO: 810701 - RNA, 18 nt, Human
gcccaggcaagagggcuc

SEQ ID NO: 810702 - RNA, 25 nt, Human
gccggggccccggggccagcggcag

SEQ ID NO: 810703 - RNA, 22 nt, Human
gccguccccccggcuggauucc

SEQ ID NO: 810704 - RNA, 21 nt, Human
gccuggguggcuugagggccc

SEQ ID NO: 810705 - RNA, 23 nt, Human
gcgcaggggaggguccgaggggc

SEQ ID NO: 810706 - RNA, 19 nt, Human
gcggcggcggcggugguca

SEQ ID NO: 810707 - RNA, 18 nt, Human
gcuuuggggcccucagcc

SEQ ID NO: 810708 - RNA, 19 nt, Human
ggaagcgccugugaacagg

SEQ ID NO: 810709 - RNA, 24 nt, Human
ggagccccuucuucuucccugcuc

SEQ ID NO: 810710 - RNA, 21 nt, Human
ggagcccucccuccgacgccc

SEQ ID NO: 810711 - RNA, 21 nt, Human
ggagccgagggcccauaaguc

SEQ ID NO: 810712 - RNA, 22 nt, Human
ggagccuccacaggcucugccc

SEQ ID NO: 810713 - RNA, 22 nt, Human
ggcaagagggcuccaccucccc

SEQ ID NO: 810714 - RNA, 22 nt, Human
ggcagaagcccagaggccugga

SEQ ID NO: 810715 - RNA, 23 nt, Human
ggcagagguaccucaggggugca

SEQ ID NO: 810716 - RNA, 20 nt, Human
ggcagcgguggggaaugaag

SEQ ID NO: 810717 - RNA, 23 nt, Human
ggccaccuggcagcaaagaccca

SEQ ID NO: 810718 - RNA, 19 nt, Human
ggccaggcagugcccugcc

SEQ ID NO: 810719 - RNA, 19 nt, Human
ggcccagccaggccggcuc

SEQ ID NO: 810720 - RNA, 21 nt, Human
ggcucgacgcggcggcggcgg

SEQ ID NO: 810721 - RNA, 22 nt, Human
gggccggagacggaucugaaga

SEQ ID NO: 810722 - RNA, 21 nt, Human
gggcuggagcugguucagggc

SEQ ID NO: 810723 - RNA, 19 nt, Human
ggggaagggacuucuuagg

SEQ ID NO: 810724 - RNA, 18 nt, Human
ggggggaaugugaagagg

SEQ ID NO: 810725 - RNA, 22 nt, Human
guggcuuuggggcccucagccc

SEQ ID NO: 810726 - RNA, 18 nt, Human
gugugacuaggaagguga

SEQ ID NO: 810727 - RNA, 19 nt, Human
guugcauuuccccacuuca

SEQ ID NO: 810728 - RNA, 19 nt, Human
uaaauaagaaacccgcggc

SEQ ID NO: 810729 - RNA, 21 nt, Human
uaaguccaaagugccacagag

SEQ ID NO: 810730 - RNA, 26 nt, Human
uagugggcugaggagagcagagggcu

SEQ ID NO: 810731 - RNA, 28 nt, Human
ucacaaacacaaauaaacaagacauugc

SEQ ID NO: 810732 - RNA, 18 nt, Human
ucagccuuuggggccauc

SEQ ID NO: 810733 - RNA, 22 nt, Human
ucaggccuggccagcggccucg

SEQ ID NO: 810734 - RNA, 24 nt, Human
ucauagggccacccugaguucuug

SEQ ID NO: 810735 - RNA, 18 nt, Human
ucauuguuccagcacaaa

SEQ ID NO: 810736 - RNA, 25 nt, Human
uccacagagcccaggcaagagggcu

SEQ ID NO: 810737 - RNA, 20 nt, Human
uccacagaggccaggacuca

SEQ ID NO: 810738 - RNA, 23 nt, Human
uccacaggcgcgccgcccggccc

SEQ ID NO: 810739 - RNA, 22 nt, Human
uccaugacaacuccuagccucu

SEQ ID NO: 810740 - RNA, 22 nt, Human
ucccagacccggccccccucac

SEQ ID NO: 810741 - RNA, 23 nt, Human
ucccagacccggccccccucacc

SEQ ID NO: 810742 - RNA, 22 nt, Human
uccccaggccgccucccagacc

SEQ ID NO: 810743 - RNA, 28 nt, Human
uccccaggccgccucccagacccggccc

SEQ ID NO: 810744 - RNA, 22 nt, Human
uccccaggcucugcuccuuccu

SEQ ID NO: 810745 - RNA, 21 nt, Human
uccccuggcuggagugggcug

SEQ ID NO: 810746 - RNA, 20 nt, Human
ucccuccaccuugagacccc

SEQ ID NO: 810747 - RNA, 23 nt, Human
ucccugagcaaucacucuggccc

SEQ ID NO: 810748 - RNA, 26 nt, Human
ucccugcuccccuggcuggagugggc

SEQ ID NO: 810749 - RNA, 22 nt, Human
uccgcggcgcccccggcccugg

SEQ ID NO: 810750 - RNA, 31 nt, Human
uccggcuccggccccggccccggccccggcc

SEQ ID NO: 810751 - RNA, 18 nt, Human
uccugccucccagaggug

SEQ ID NO: 810752 - RNA, 19 nt, Human
ucggagcugcccggcccag

SEQ ID NO: 810753 - RNA, 18 nt, Human
ucucaauucccccugggc

SEQ ID NO: 810754 - RNA, 18 nt, Human
ucugaaacccuacagcuu

SEQ ID NO: 810755 - RNA, 19 nt, Human
ucugaguucuuccuuuggu

SEQ ID NO: 810756 - RNA, 19 nt, Human
ucugcagcugcugccccuc

SEQ ID NO: 810757 - RNA, 22 nt, Human
ucugcggcgggaagccaggagc

SEQ ID NO: 810758 - RNA, 24 nt, Human
ucuuggagcccgaaagagaaggag

SEQ ID NO: 810759 - RNA, 20 nt, Human
ugaaaaauauacaagugaaa

SEQ ID NO: 810760 - RNA, 19 nt, Human
ugaaaacaucaugugaguc

SEQ ID NO: 810761 - RNA, 18 nt, Human
ugaaaacgaggccauaaa

SEQ ID NO: 810762 - RNA, 28 nt, Human
ugaaacccuacagcuucagaaggucccc

SEQ ID NO: 810763 - RNA, 22 nt, Human
ugaacaggguuggcaguggcac

SEQ ID NO: 810764 - RNA, 21 nt, Human
ugacaucaguaacaagcccug

SEQ ID NO: 810765 - RNA, 23 nt, Human
ugaccaaacaccuccuugacauc

SEQ ID NO: 810766 - RNA, 19 nt, Human
ugacuacaugcacaggagc

SEQ ID NO: 810767 - RNA, 21 nt, Human
ugagaggcaugggaggccugg

SEQ ID NO: 810768 - RNA, 21 nt, Human
ugagaguggugggagccuggg

SEQ ID NO: 810769 - RNA, 21 nt, Human
ugagcggucugaucuugcucc

SEQ ID NO: 810770 - RNA, 20 nt, Human
ugaguucaugugugaauuca

SEQ ID NO: 810771 - RNA, 18 nt, Human
ugaguucuuggcagaagc

SEQ ID NO: 810772 - RNA, 21 nt, Human
ugcaagccuccacccggaacc

SEQ ID NO: 810773 - RNA, 20 nt, Human
ugcacugggaguaggagugu

SEQ ID NO: 810774 - RNA, 21 nt, Human
ugcagcugcugccccucuggc

SEQ ID NO: 810775 - RNA, 23 nt, Human
ugccuggacagacuugucaguaa

SEQ ID NO: 810776 - RNA, 21 nt, Human
uggaggcugcuccaaaaccuc

SEQ ID NO: 810777 - RNA, 24 nt, Human
uggcagagcucccuacagagcugg

SEQ ID NO: 810778 - RNA, 19 nt, Human
uggcagcuucaggagcagg

SEQ ID NO: 810779 - RNA, 19 nt, Human
uggccucauuacagggcag

SEQ ID NO: 810780 - RNA, 23 nt, Human
uggcuugagggcccauugguggg

SEQ ID NO: 810781 - RNA, 19 nt, Human
uggcuuuggggcccucagc

SEQ ID NO: 810782 - RNA, 18 nt, Human
ugggagccuggguggcuu

SEQ ID NO: 810783 - RNA, 22 nt, Human
ugggagccuggguggcuugagg

SEQ ID NO: 810784 - RNA, 24 nt, Human
ugggccccaaaccacacugcccaa

SEQ ID NO: 810785 - RNA, 23 nt, Human
uggggcaguggcagcuucaggag

SEQ ID NO: 810786 - RNA, 19 nt, Human
uggguaguaacaagagccu

SEQ ID NO: 810787 - RNA, 19 nt, Human
ugggugaagggagaggcug

SEQ ID NO: 810788 - RNA, 25 nt, Human
uggucacaaacacaaauaaacaaga

SEQ ID NO: 810789 - RNA, 22 nt, Human
ugugaaaacaucaugugagucu

SEQ ID NO: 810790 - RNA, 23 nt, Human
ugugaagaggagggagccccuuc

SEQ ID NO: 810791 - RNA, 18 nt, Human
ugugacugcgugucuggg

SEQ ID NO: 810792 - RNA, 21 nt, Human
uguggaucaggggucauuaga

SEQ ID NO: 810793 - RNA, 22 nt, Human
ugugugaauucacauguguaua

SEQ ID NO: 810794 - RNA, 22 nt, Human
uguugcauuuccccacuucagc

SEQ ID NO: 810795 - RNA, 20 nt, Human
uguuugauauaucaguucaa

SEQ ID NO: 810796 - RNA, 18 nt, Human
uucagcgagcacggagaa

SEQ ID NO: 810797 - RNA, 21 nt, Human
uuccagcacaaagggccacgg

SEQ ID NO: 810798 - RNA, 23 nt, Human
uuccccuucuuucucgcaugccc

SEQ ID NO: 810799 - RNA, 21 nt, Human
uucccugcuccccuggcugga

SEQ ID NO: 810800 - RNA, 21 nt, Human
uugagaccccuccugacccac

SEQ ID NO: 810801 - RNA, 24 nt, Human
uuggcaguggcacuggcagcggug

SEQ ID NO: 810802 - RNA, 21 nt, Human
aacagacgacgggcgugcccc

SEQ ID NO: 810803 - RNA, 26 nt, Human
aacagcaccaagccacgccacccguc

SEQ ID NO: 810804 - RNA, 21 nt, Human
aacuggaccagucccagccuc

SEQ ID NO: 810805 - RNA, 23 nt, Human
acagacgacgggcgugccccgug

SEQ ID NO: 810806 - RNA, 21 nt, Human
acagccgaguccagcuaaagc

SEQ ID NO: 810807 - RNA, 22 nt, Human
acagccucuugggggaggagug

SEQ ID NO: 810808 - RNA, 18 nt, Human
accaugacaggcauagug

SEQ ID NO: 810809 - RNA, 19 nt, Human
acccaacacacucaggcca

SEQ ID NO: 810810 - RNA, 23 nt, Human
acccagcauagcuuguccagccc

SEQ ID NO: 810811 - RNA, 25 nt, Human
accgcaggaacccagcugcgggcag

SEQ ID NO: 810812 - RNA, 26 nt, Human
agaaggccaggggcaagcagugggca

SEQ ID NO: 810813 - RNA, 24 nt, Human
agacagccccgaccagaggcaucc

SEQ ID NO: 810814 - RNA, 18 nt, Human
agacccagcauagcuugu

SEQ ID NO: 810815 - RNA, 19 nt, Human
agcaccaagccacgccacc

SEQ ID NO: 810816 - RNA, 21 nt, Human
agcccccuggccuggcacccc

SEQ ID NO: 810817 - RNA, 18 nt, Human
agcccuggccacagccuc

SEQ ID NO: 810818 - RNA, 19 nt, Human
aggcaggcagggcacuugg

SEQ ID NO: 810819 - RNA, 23 nt, Human
aggcaggcagggcacuuggggcu

SEQ ID NO: 810820 - RNA, 21 nt, Human
aggcagggcacuuggggcuuc

SEQ ID NO: 810821 - RNA, 18 nt, Human
aggccaggggcaagcaga

SEQ ID NO: 810822 - RNA, 23 nt, Human
aggccaggggcaagcagagggca

SEQ ID NO: 810823 - RNA, 19 nt, Human
aggcuggggaccgaggccu

SEQ ID NO: 810824 - RNA, 18 nt, Human
agggcacagagcuugccu

SEQ ID NO: 810825 - RNA, 22 nt, Human
agggcacagagcuugccucucg

SEQ ID NO: 810826 - RNA, 22 nt, Human
aguucagugucuggagugagcc

SEQ ID NO: 810827 - RNA, 18 nt, Human
caaaaucacuccugcuuc

SEQ ID NO: 810828 - RNA, 22 nt, Human
caagcagagggcaccuuugcac

SEQ ID NO: 810829 - RNA, 24 nt, Human
caagcagagggcaccuuugcacua

SEQ ID NO: 810830 - RNA, 18 nt, Human
cacacacgccaccugggg

SEQ ID NO: 810831 - RNA, 22 nt, Human
cacccaggcuggggaccgaggc

SEQ ID NO: 810832 - RNA, 22 nt, Human
cacccuaccugcagcucaucuc

SEQ ID NO: 810833 - RNA, 21 nt, Human
cacuacgccgccaggcacgcc

SEQ ID NO: 810834 - RNA, 20 nt, Human
cacugcuagcuaagcaaggu

SEQ ID NO: 810835 - RNA, 22 nt, Human
cagccacccuggcucuccagga

SEQ ID NO: 810836 - RNA, 22 nt, Human
cagccgaguccagcuaaagcca

SEQ ID NO: 810837 - RNA, 19 nt, Human
cagcugcgggcagcuggaa

SEQ ID NO: 810838 - RNA, 22 nt, Human
cagcuggaacccaacacacuca

SEQ ID NO: 810839 - RNA, 23 nt, Human
ccaagccacgccacccgucauga

SEQ ID NO: 810840 - RNA, 18 nt, Human
ccacaccguccuugcaua

SEQ ID NO: 810841 - RNA, 18 nt, Human
ccagacagccccgaccag

SEQ ID NO: 810842 - RNA, 21 nt, Human
ccccagggcuggccucagucc

SEQ ID NO: 810843 - RNA, 23 nt, Human
ccccagggcuggccucaguccug

SEQ ID NO: 810844 - RNA, 20 nt, Human
ccccggaacuucugccgagc

SEQ ID NO: 810845 - RNA, 20 nt, Human
ccccgugacagaccagggag

SEQ ID NO: 810846 - RNA, 20 nt, Human
ccccuggccuggcaccccgu

SEQ ID NO: 810847 - RNA, 28 nt, Human
cccgcaggugcccgcauugacccgccag

SEQ ID NO: 810848 - RNA, 25 nt, Human
cccgccgggaacccaucagccccca

SEQ ID NO: 810849 - RNA, 22 nt, Human
cccucuucccuccucaggaccc

SEQ ID NO: 810850 - RNA, 18 nt, Human
ccgagcccuguggccguc

SEQ ID NO: 810851 - RNA, 23 nt, Human
ccgggaacccaucagcccccagg

SEQ ID NO: 810852 - RNA, 24 nt, Human
ccuccaaaggagacacacagccga

SEQ ID NO: 810853 - RNA, 19 nt, Human
ccucgggggagaagggcuc

SEQ ID NO: 810854 - RNA, 22 nt, Human
ccucuugggggaggagugaaca

SEQ ID NO: 810855 - RNA, 24 nt, Human
ccuggcaccccgugagccucgcca

SEQ ID NO: 810856 - RNA, 24 nt, Human
ccuggccacagccuccgccuuggc

SEQ ID NO: 810857 - RNA, 21 nt, Human
ccuuacacaauacgcacugcu

SEQ ID NO: 810858 - RNA, 19 nt, Human
cgccaggcacgccaugucc

SEQ ID NO: 810859 - RNA, 20 nt, Human
cgccaggcacgccauguccc

SEQ ID NO: 810860 - RNA, 18 nt, Human
cggccaagcuccagccuu

SEQ ID NO: 810861 - RNA, 20 nt, Human
cgggaacccaucagcccccc

SEQ ID NO: 810862 - RNA, 19 nt, Human
cucaggccacuccauggcu

SEQ ID NO: 810863 - RNA, 25 nt, Human
cuccaggaccucugcagccggcacc

SEQ ID NO: 810864 - RNA, 20 nt, Human
cuccgccuuggcuccuggcc

SEQ ID NO: 810865 - RNA, 18 nt, Human
cuccuggcucccaguccu

SEQ ID NO: 810866 - RNA, 21 nt, Human
cugaaggccucacaucaucaa

SEQ ID NO: 810867 - RNA, 24 nt, Human
cugcuacaugcugggcgccugggg

SEQ ID NO: 810868 - RNA, 18 nt, Human
cuuccaacuuccuucugg

SEQ ID NO: 810869 - RNA, 19 nt, Human
cuuggcuccuggcucccag

SEQ ID NO: 810870 - RNA, 22 nt, Human
gaaauccuaguuaccugcagaa

SEQ ID NO: 810871 - RNA, 20 nt, Human
gcaccgucuacacuaaccug

SEQ ID NO: 810872 - RNA, 18 nt, Human
gccaugucccuggagggc

SEQ ID NO: 810873 - RNA, 21 nt, Human
gcccaacacucacccaggcug

SEQ ID NO: 810874 - RNA, 19 nt, Human
gccuuggcuccuggcuccc

SEQ ID NO: 810875 - RNA, 20 nt, Human
gccuuggcuccuggcuccca

SEQ ID NO: 810876 - RNA, 19 nt, Human
gcggcgcgugccgccgauu

SEQ ID NO: 810877 - RNA, 19 nt, Human
ggaacagcaccaagccacg

SEQ ID NO: 810878 - RNA, 20 nt, Human
ggaacuucugccgagcccuu

SEQ ID NO: 810879 - RNA, 21 nt, Human
ggccagcaccaugacaggcau

SEQ ID NO: 810880 - RNA, 19 nt, Human
ggcuccuggcucccagucc

SEQ ID NO: 810881 - RNA, 18 nt, Human
gggcacagcgggaagagc

SEQ ID NO: 810882 - RNA, 21 nt, Human
gggcacagcgggaagagcggc

SEQ ID NO: 810883 - RNA, 28 nt, Human
gggcaguguggccaucagccgggccccc

SEQ ID NO: 810884 - RNA, 18 nt, Human
gggcuucacuggcucccu

SEQ ID NO: 810885 - RNA, 20 nt, Human
gucccuggagggcacgggug

SEQ ID NO: 810886 - RNA, 24 nt, Human
uacacaauacgcacugcuagcuaa

SEQ ID NO: 810887 - RNA, 21 nt, Human
uacgcacugcuagcuaagcaa

SEQ ID NO: 810888 - RNA, 19 nt, Human
ucccacgagcacacacgcc

SEQ ID NO: 810889 - RNA, 22 nt, Human
ucccacgagcacacacgccacc

SEQ ID NO: 810890 - RNA, 18 nt, Human
uccuggcucccaguccuc

SEQ ID NO: 810891 - RNA, 22 nt, Human
uccuugccucugccguccaggg

SEQ ID NO: 810892 - RNA, 23 nt, Human
uccuugccucugccguccagggg

SEQ ID NO: 810893 - RNA, 22 nt, Human
ucgcccaggaaggccugugucc

SEQ ID NO: 810894 - RNA, 23 nt, Human
ugacaccuggacacgccggccaa

SEQ ID NO: 810895 - RNA, 23 nt, Human
ugagccucgcccacaggggcugg

SEQ ID NO: 810896 - RNA, 18 nt, Human
ugaggcagaaggccaggg

SEQ ID NO: 810897 - RNA, 25 nt, Human
ugagggcauccgaggcuacuggcca

SEQ ID NO: 810898 - RNA, 23 nt, Human
ugccucugccguccagggguggg

SEQ ID NO: 810899 - RNA, 19 nt, Human
ugcggcgucaccgcaggaa

SEQ ID NO: 810900 - RNA, 18 nt, Human
ugcuacaugcugggcgcc

SEQ ID NO: 810901 - RNA, 21 nt, Human
ugcugggcgccuggggaacag

SEQ ID NO: 810902 - RNA, 23 nt, Human
ugcuuccaacuuccuucuggucu

SEQ ID NO: 810903 - RNA, 22 nt, Human
uggcgcaggaguccaguggacg

SEQ ID NO: 810904 - RNA, 24 nt, Human
uggcgcaggaguccaguggacggc

SEQ ID NO: 810905 - RNA, 22 nt, Human
uggcucccaguccuccucuccu

SEQ ID NO: 810906 - RNA, 24 nt, Human
uggcuccuggcucccaguccuccu

SEQ ID NO: 810907 - RNA, 22 nt, Human
uggcucucucccucuucccucc

SEQ ID NO: 810908 - RNA, 23 nt, Human
uggcuggugcccguccuguaguc

SEQ ID NO: 810909 - RNA, 22 nt, Human
ugggccaugaccacagggcagu

SEQ ID NO: 810910 - RNA, 20 nt, Human
uguagucccuccucucgcga

SEQ ID NO: 810911 - RNA, 19 nt, Human
ugucccuggagggcacggg

SEQ ID NO: 810912 - RNA, 21 nt, Human
uguggccaucagccgugucca

SEQ ID NO: 810913 - RNA, 23 nt, Human
uuccaacuuccuucuggucucaa

SEQ ID NO: 810914 - RNA, 20 nt, Human
uucugccgagcccuguggcc

SEQ ID NO: 810915 - RNA, 21 nt, Human
uugcauaggucucgcgguuga

SEQ ID NO: 810916 - RNA, 19 nt, Human
uugccucucgaccccgccg

SEQ ID NO: 810917 - RNA, 19 nt, Human
aaacagaggcagacacagg

SEQ ID NO: 810918 - RNA, 22 nt, Human
aagcucaaaccuggggccaugg

SEQ ID NO: 810919 - RNA, 21 nt, Human
aagcuguggggacagugcugg

SEQ ID NO: 810920 - RNA, 24 nt, Human
acacucaccacaagaugcaaggac

SEQ ID NO: 810921 - RNA, 23 nt, Human
accacaagaugcaaggaccacaa

SEQ ID NO: 810922 - RNA, 27 nt, Human
accccuaccccuuuccccccucccccc

SEQ ID NO: 810923 - RNA, 21 nt, Human
accccuuuccccccucccccc

SEQ ID NO: 810924 - RNA, 21 nt, Human
accccuuuccccccucccccc

SEQ ID NO: 810925 - RNA, 18 nt, Human
accuggaggugagggcuc

SEQ ID NO: 810926 - RNA, 23 nt, Human
acuggcccagcagacacacacac

SEQ ID NO: 810927 - RNA, 19 nt, Human
agaagaaacuccccuccuc

SEQ ID NO: 810928 - RNA, 18 nt, Human
agagagacaaauccacag

SEQ ID NO: 810929 - RNA, 18 nt, Human
agagugaagaggggccuu

SEQ ID NO: 810930 - RNA, 21 nt, Human
agauggcuccagagagggaga

SEQ ID NO: 810931 - RNA, 22 nt, Human
agauguugagagagaagccuca

SEQ ID NO: 810932 - RNA, 20 nt, Human
agcggugguggcgguggugg

SEQ ID NO: 810933 - RNA, 18 nt, Human
agcugggcugggccgggc

SEQ ID NO: 810934 - RNA, 22 nt, Human
aggcagacacagggcacaaggg

SEQ ID NO: 810935 - RNA, 26 nt, Human
aggcagacacagggcacaagggugug

SEQ ID NO: 810936 - RNA, 18 nt, Human
aggcccagaggccaggga

SEQ ID NO: 810937 - RNA, 23 nt, Human
aggggaaaaggauuccccacugg

SEQ ID NO: 810938 - RNA, 18 nt, Human
aggggggccaggacucug

SEQ ID NO: 810939 - RNA, 18 nt, Human
aggggugaggacacccag

SEQ ID NO: 810940 - RNA, 23 nt, Human
agggugugggaaauggggagaua

SEQ ID NO: 810941 - RNA, 26 nt, Human
aggguuggcagcggugguggcggugg

SEQ ID NO: 810942 - RNA, 20 nt, Human
agugugaauucccuuccaga

SEQ ID NO: 810943 - RNA, 25 nt, Human
aucaacaccccccaccccuaccccu

SEQ ID NO: 810944 - RNA, 23 nt, Human
augaggcugagggagaggugaag

SEQ ID NO: 810945 - RNA, 24 nt, Human
auugagcaggaagugagccugaug

SEQ ID NO: 810946 - RNA, 19 nt, Human
cacaagaugcaaggaccac

SEQ ID NO: 810947 - RNA, 22 nt, Human
cacaagaugcaaggaccacaaa

SEQ ID NO: 810948 - RNA, 20 nt, Human
cacacucaccacaagaugca

SEQ ID NO: 810949 - RNA, 18 nt, Human
caccccccaccccuaccc

SEQ ID NO: 810950 - RNA, 24 nt, Human
caccccccaccccuaccccuuucc

SEQ ID NO: 810951 - RNA, 21 nt, Human
caccccccuccccgauccaca

SEQ ID NO: 810952 - RNA, 22 nt, Human
caccccccuccccgauccacag

SEQ ID NO: 810953 - RNA, 21 nt, Human
cagaagaaacuccccuccucc

SEQ ID NO: 810954 - RNA, 21 nt, Human
cagacacacacacacucacca

SEQ ID NO: 810955 - RNA, 25 nt, Human
cagacacagggcacaaggguguggg

SEQ ID NO: 810956 - RNA, 23 nt, Human
cagcagacacacacacacucacc

SEQ ID NO: 810957 - RNA, 20 nt, Human
cagccccugagcugggcugg

SEQ ID NO: 810958 - RNA, 19 nt, Human
caggggggccaggacucug

SEQ ID NO: 810959 - RNA, 20 nt, Human
cagggucaauacacagccaa

SEQ ID NO: 810960 - RNA, 22 nt, Human
caucaacaccccccaccccuac

SEQ ID NO: 810961 - RNA, 24 nt, Human
caucucuggcccauucaacaacuu

SEQ ID NO: 810962 - RNA, 22 nt, Human
cauucuuguuugaaaaacaaga

SEQ ID NO: 810963 - RNA, 24 nt, Human
cauucuuguuugaaaaacaagaca

SEQ ID NO: 810964 - RNA, 18 nt, Human
ccaaaaugagugggguga

SEQ ID NO: 810965 - RNA, 18 nt, Human
ccaccccccuccccgauc

SEQ ID NO: 810966 - RNA, 22 nt, Human
ccagagaagagauaaaauacag

SEQ ID NO: 810967 - RNA, 22 nt, Human
ccaggugagugugagcccaagg

SEQ ID NO: 810968 - RNA, 21 nt, Human
ccaugguuggggaagggggac

SEQ ID NO: 810969 - RNA, 18 nt, Human
cccagcagacacacacac

SEQ ID NO: 810970 - RNA, 21 nt, Human
cccagcagacacacacacacu

SEQ ID NO: 810971 - RNA, 22 nt, Human
ccccaccccccuccccgaucca

SEQ ID NO: 810972 - RNA, 25 nt, Human
ccccaccccccuccccgauccacag

SEQ ID NO: 810973 - RNA, 18 nt, Human
ccccagcgcccaacacgg

SEQ ID NO: 810974 - RNA, 22 nt, Human
cccccaccccccuccccgaucc

SEQ ID NO: 810975 - RNA, 22 nt, Human
cccccuccccccaccccccucc

SEQ ID NO: 810976 - RNA, 24 nt, Human
ccccgauccacagcuaagucaaac

SEQ ID NO: 810977 - RNA, 22 nt, Human
ccccuaccccuuuccccccucc

SEQ ID NO: 810978 - RNA, 24 nt, Human
cccuuuguccucaggaacugggga

SEQ ID NO: 810979 - RNA, 18 nt, Human
ccgugucuucacucccag

SEQ ID NO: 810980 - RNA, 26 nt, Human
ccuacagugggacaguugguagggac

SEQ ID NO: 810981 - RNA, 18 nt, Human
ccuggcucccccagcgcc

SEQ ID NO: 810982 - RNA, 18 nt, Human
ccuggggccaugguuggg

SEQ ID NO: 810983 - RNA, 22 nt, Human
cgaggagcucaaagccugaggg

SEQ ID NO: 810984 - RNA, 21 nt, Human
cggacgagaagcaaucuauac

SEQ ID NO: 810985 - RNA, 19 nt, Human
cggccaguugggccgcugc

SEQ ID NO: 810986 - RNA, 20 nt, Human
cgggcuccuaggccugcacu

SEQ ID NO: 810987 - RNA, 22 nt, Human
cucaaucaagagaguuuccacu

SEQ ID NO: 810988 - RNA, 18 nt, Human
cuccccccaccccccucc

SEQ ID NO: 810989 - RNA, 22 nt, Human
cuccccccaccccccuccccga

SEQ ID NO: 810990 - RNA, 25 nt, Human
cuccccccaccccccuccccgaucc

SEQ ID NO: 810991 - RNA, 22 nt, Human
cucugacuggggcagcuuccuc

SEQ ID NO: 810992 - RNA, 18 nt, Human
cugcacagcucuggaucc

SEQ ID NO: 810993 - RNA, 19 nt, Human
cuggcccucugacuggggc

SEQ ID NO: 810994 - RNA, 19 nt, Human
cuggcugcaucucuggccc

SEQ ID NO: 810995 - RNA, 22 nt, Human
cuucacucccaggaagguugcg

SEQ ID NO: 810996 - RNA, 21 nt, Human
cuugcgggcaaggaggcuguc

SEQ ID NO: 810997 - RNA, 21 nt, Human
gagcaggaagugagccugaug

SEQ ID NO: 810998 - RNA, 24 nt, Human
gaggguuggcagcggugguggcgg

SEQ ID NO: 810999 - RNA, 19 nt, Human
gcacuuuggggauggcugg

SEQ ID NO: 811000 - RNA, 22 nt, Human
gcagaagaaacuccccuccucc

SEQ ID NO: 811001 - RNA, 20 nt, Human
gcccaagagaguaaggggcc

SEQ ID NO: 811002 - RNA, 20 nt, Human
gccugggcugcacagcucug

SEQ ID NO: 811003 - RNA, 19 nt, Human
gcgggcaaggaggcugucc

SEQ ID NO: 811004 - RNA, 21 nt, Human
ggaaaaggauuccccacuggc

SEQ ID NO: 811005 - RNA, 23 nt, Human
ggaaauggggagauauggagagg

SEQ ID NO: 811006 - RNA, 21 nt, Human
ggaagugaggggcuggauucu

SEQ ID NO: 811007 - RNA, 19 nt, Human
ggagcuacuggaccuggag

SEQ ID NO: 811008 - RNA, 23 nt, Human
ggaggguuggcagcggugguggc

SEQ ID NO: 811009 - RNA, 20 nt, Human
ggauggggacaucuggacug

SEQ ID NO: 811010 - RNA, 18 nt, Human
ggcccuggcucccccagc

SEQ ID NO: 811011 - RNA, 18 nt, Human
gggaaauggggagauaug

SEQ ID NO: 811012 - RNA, 22 nt, Human
gggacaguugguagggacuccg

SEQ ID NO: 811013 - RNA, 19 nt, Human
gggauggcugguguggagc

SEQ ID NO: 811014 - RNA, 22 nt, Human
gggccaugguuggggaaggggg

SEQ ID NO: 811015 - RNA, 25 nt, Human
gggccucugacacagugaugaaaca

SEQ ID NO: 811016 - RNA, 18 nt, Human
gggcugggccgggcuagg

SEQ ID NO: 811017 - RNA, 24 nt, Human
ggggguggggggcguggggggagg

SEQ ID NO: 811018 - RNA, 27 nt, Human
ggggguggggggcguggggggaggguu

SEQ ID NO: 811019 - RNA, 21 nt, Human
gggguggggggcgugggggga

SEQ ID NO: 811020 - RNA, 22 nt, Human
gggguggggggcguggggggag

SEQ ID NO: 811021 - RNA, 27 nt, Human
ggguuggcagcggugguggcgguggug

SEQ ID NO: 811022 - RNA, 19 nt, Human
ggugagugugagcccaagg

SEQ ID NO: 811023 - RNA, 18 nt, Human
gguggcagcggugguggc

SEQ ID NO: 811024 - RNA, 19 nt, Human
gguuggcagcggugguggc

SEQ ID NO: 811025 - RNA, 29 nt, Human
gguuggcagcggugguggcggugguggug

SEQ ID NO: 811026 - RNA, 18 nt, Human
gguugggauccgggcgcc

SEQ ID NO: 811027 - RNA, 24 nt, Human
gugcugggugcacugccaaggagu

SEQ ID NO: 811028 - RNA, 24 nt, Human
guggcgguggugguggcagcggug

SEQ ID NO: 811029 - RNA, 19 nt, Human
guggcuguuuucugcagac

SEQ ID NO: 811030 - RNA, 21 nt, Human
gugguggcagcggugguggca

SEQ ID NO: 811031 - RNA, 21 nt, Human
gugguggcgguggugguggca

SEQ ID NO: 811032 - RNA, 23 nt, Human
gugguggcgguggugguggcagc

SEQ ID NO: 811033 - RNA, 21 nt, Human
uaaaauacagcucugcuguga

SEQ ID NO: 811034 - RNA, 24 nt, Human
uaaaauacagcucugcugugagca

SEQ ID NO: 811035 - RNA, 19 nt, Human
uaacauaucacgcuagcuu

SEQ ID NO: 811036 - RNA, 21 nt, Human
uaagaugaauagauuuaauca

SEQ ID NO: 811037 - RNA, 23 nt, Human
uacacagccaaaagcauauacuc

SEQ ID NO: 811038 - RNA, 20 nt, Human
uaccaaggaugggcagggau

SEQ ID NO: 811039 - RNA, 22 nt, Human
uaccaaggaugggcagggauua

SEQ ID NO: 811040 - RNA, 18 nt, Human
uagagagacaaauccaca

SEQ ID NO: 811041 - RNA, 24 nt, Human
uauguaguauauauacuauauaca

SEQ ID NO: 811042 - RNA, 19 nt, Human
ucaaacucccaaggacagu

SEQ ID NO: 811043 - RNA, 18 nt, Human
ucaacaacuugguccugg

SEQ ID NO: 811044 - RNA, 18 nt, Human
ucaauacacagccaaaag

SEQ ID NO: 811045 - RNA, 20 nt, Human
ucacucccaggaagguugcg

SEQ ID NO: 811046 - RNA, 25 nt, Human
uccacagcuaagucaaaccgggguc

SEQ ID NO: 811047 - RNA, 21 nt, Human
uccagcuugcaguggcugagg

SEQ ID NO: 811048 - RNA, 19 nt, Human
uccccccuccccccacccc

SEQ ID NO: 811049 - RNA, 20 nt, Human
ucccuguaccuggcccucug

SEQ ID NO: 811050 - RNA, 18 nt, Human
uccuugccgggagaacuc

SEQ ID NO: 811051 - RNA, 20 nt, Human
ucucacccaggcacaggccc

SEQ ID NO: 811052 - RNA, 22 nt, Human
ucugacuggggcagcuuccucc

SEQ ID NO: 811053 - RNA, 19 nt, Human
ugaaaaacaagacauaaaa

SEQ ID NO: 811054 - RNA, 23 nt, Human
ugacuggggcagcuuccuccgag

SEQ ID NO: 811055 - RNA, 23 nt, Human
ugagcagagugaagaggggccuu

SEQ ID NO: 811056 - RNA, 24 nt, Human
ugaggacacccagggcggcagcua

SEQ ID NO: 811057 - RNA, 23 nt, Human
ugaggggcuggauucugcagaag

SEQ ID NO: 811058 - RNA, 18 nt, Human
ugaguggggugaucccag

SEQ ID NO: 811059 - RNA, 24 nt, Human
ugcaaggaccacaaagcucaaacc

SEQ ID NO: 811060 - RNA, 21 nt, Human
ugcggggguggggggcguggg

SEQ ID NO: 811061 - RNA, 27 nt, Human
uggaaugacacaggcaggggcugagug

SEQ ID NO: 811062 - RNA, 18 nt, Human
uggacccugacuggccca

SEQ ID NO: 811063 - RNA, 18 nt, Human
uggacugagcugcccugc

SEQ ID NO: 811064 - RNA, 19 nt, Human
uggauggggacaucuggac

SEQ ID NO: 811065 - RNA, 20 nt, Human
uggcagcggugguggcggug

SEQ ID NO: 811066 - RNA, 20 nt, Human
uggcccucugacuggggcag

SEQ ID NO: 811067 - RNA, 23 nt, Human
uggcccucugacuggggcagcuu

SEQ ID NO: 811068 - RNA, 19 nt, Human
uggcgguggaaugacacag

SEQ ID NO: 811069 - RNA, 20 nt, Human
uggcgguggugguggcagcc

SEQ ID NO: 811070 - RNA, 23 nt, Human
uggcgguggugguggcagcggug

SEQ ID NO: 811071 - RNA, 24 nt, Human
uggcgguggugguggcagcggugg

SEQ ID NO: 811072 - RNA, 23 nt, Human
uggcugguguggagcuacuggac

SEQ ID NO: 811073 - RNA, 20 nt, Human
ugggaaauggggagauaugg

SEQ ID NO: 811074 - RNA, 20 nt, Human
ugggcugggccgggcuaggc

SEQ ID NO: 811075 - RNA, 20 nt, Human
ugguggcgguggugguggcc

SEQ ID NO: 811076 - RNA, 20 nt, Human
uggugguggcagcgguggug

SEQ ID NO: 811077 - RNA, 22 nt, Human
uggugguggcagcggugguggc

SEQ ID NO: 811078 - RNA, 25 nt, Human
uguggccaggcccuuuguccucagg

SEQ ID NO: 811079 - RNA, 24 nt, Human
ugugggaaauggggagauauggag

SEQ ID NO: 811080 - RNA, 19 nt, Human
uucuuuguucccuacagug

SEQ ID NO: 811081 - RNA, 18 nt, Human
uuggcagcggugguggcg

SEQ ID NO: 811082 - RNA, 22 nt, Human
aaaaaaccaaaacaaaacaaaa

SEQ ID NO: 811083 - RNA, 25 nt, Human
aaaaagaaacuugggaaggcuauuu

SEQ ID NO: 811084 - RNA, 21 nt, Human
aaacaagaauuuggaccaaaa

SEQ ID NO: 811085 - RNA, 19 nt, Human
aaaccaaaacaaaacaaaa

SEQ ID NO: 811086 - RNA, 19 nt, Human
aaugaaaagacacaaugga

SEQ ID NO: 811087 - RNA, 23 nt, Human
aaugaaaagacacaauggaaaga

SEQ ID NO: 811088 - RNA, 21 nt, Human
acaaaacagugcuguuucaga

SEQ ID NO: 811089 - RNA, 19 nt, Human
acaaugugagcucaguguu

SEQ ID NO: 811090 - RNA, 23 nt, Human
acacagcaucccacugaaguaga

SEQ ID NO: 811091 - RNA, 20 nt, Human
acagcuuuucaacuguuaac

SEQ ID NO: 811092 - RNA, 24 nt, Human
acuagguacuuuguaaacacacga

SEQ ID NO: 811093 - RNA, 21 nt, Human
agacagcgauccgagcccgga

SEQ ID NO: 811094 - RNA, 19 nt, Human
agaggcccccccuagcccu

SEQ ID NO: 811095 - RNA, 19 nt, Human
agaggguggggagaaagaa

SEQ ID NO: 811096 - RNA, 19 nt, Human
agagguugugggggagccg

SEQ ID NO: 811097 - RNA, 22 nt, Human
agcaagagacagaaacacacag

SEQ ID NO: 811098 - RNA, 19 nt, Human
agcagggggcgguggaggg

SEQ ID NO: 811099 - RNA, 21 nt, Human
agcagggggcgguggaggggc

SEQ ID NO: 811100 - RNA, 20 nt, Human
agccauugggucgcuugcug

SEQ ID NO: 811101 - RNA, 23 nt, Human
agcccuccugcgggggccugcgg

SEQ ID NO: 811102 - RNA, 19 nt, Human
agcucaguguucagggcca

SEQ ID NO: 811103 - RNA, 21 nt, Human
agcucucggccuaccucguuc

SEQ ID NO: 811104 - RNA, 23 nt, Human
aggaggggcagcagggggcggug

SEQ ID NO: 811105 - RNA, 18 nt, Human
aggaguuuguugcuugga

SEQ ID NO: 811106 - RNA, 18 nt, Human
aggcccccccuagcccuc

SEQ ID NO: 811107 - RNA, 24 nt, Human
aggggcagcagggggcgguggagg

SEQ ID NO: 811108 - RNA, 21 nt, Human
aggugcugcugguggugaugg

SEQ ID NO: 811109 - RNA, 23 nt, Human
aguaaaaagaggguggggagaaa

SEQ ID NO: 811110 - RNA, 19 nt, Human
aguuuguugcuuggaacua

SEQ ID NO: 811111 - RNA, 22 nt, Human
aucaagaaaugaguuguccaca

SEQ ID NO: 811112 - RNA, 21 nt, Human
aucugagggucuggacucgca

SEQ ID NO: 811113 - RNA, 18 nt, Human
auuggacuuuuggaccau

SEQ ID NO: 811114 - RNA, 28 nt, Human
caaaacaaaacaaaacagugcuguuuca

SEQ ID NO: 811115 - RNA, 19 nt, Human
caaaacaaaacagugcugu

SEQ ID NO: 811116 - RNA, 19 nt, Human
caagagacagaaacacaca

SEQ ID NO: 811117 - RNA, 21 nt, Human
caagggagacugucuuuuggc

SEQ ID NO: 811118 - RNA, 20 nt, Human
cacagcucaggugguguugg

SEQ ID NO: 811119 - RNA, 19 nt, Human
cacugcaguuacuuucugc

SEQ ID NO: 811120 - RNA, 19 nt, Human
cacugcaguuacuuucugc

SEQ ID NO: 811121 - RNA, 27 nt, Human
cagcaagagacagaaacacacagcaaa

SEQ ID NO: 811122 - RNA, 19 nt, Human
cagccucuacagaguuucu

SEQ ID NO: 811123 - RNA, 24 nt, Human
cagcucaggugguguuggcggcag

SEQ ID NO: 811124 - RNA, 24 nt, Human
caggaggggcagcagggggcggug

SEQ ID NO: 811125 - RNA, 23 nt, Human
cagggccacaugaauagaggucu

SEQ ID NO: 811126 - RNA, 23 nt, Human
cauguccagccacuuuucugucc

SEQ ID NO: 811127 - RNA, 23 nt, Human
ccagaggcccccccuagcccucc

SEQ ID NO: 811128 - RNA, 19 nt, Human
ccagcaagagacagaaaca

SEQ ID NO: 811129 - RNA, 22 nt, Human
ccccagaggcccccccuagccc

SEQ ID NO: 811130 - RNA, 25 nt, Human
ccccagaggcccccccuagcccucc

SEQ ID NO: 811131 - RNA, 20 nt, Human
ccccgccccagaggcccccc

SEQ ID NO: 811132 - RNA, 23 nt, Human
ccccgccccagaggcccccccua

SEQ ID NO: 811133 - RNA, 20 nt, Human
ccccggcucuauucuaauac

SEQ ID NO: 811134 - RNA, 18 nt, Human
ccccuggccaugcuguac

SEQ ID NO: 811135 - RNA, 23 nt, Human
ccccugggguugaagcgggcggc

SEQ ID NO: 811136 - RNA, 21 nt, Human
cccgccccagaggcccccccu

SEQ ID NO: 811137 - RNA, 21 nt, Human
ccgguaaaauccucacucccu

SEQ ID NO: 811138 - RNA, 20 nt, Human
ccucuaagguuuccuagccu

SEQ ID NO: 811139 - RNA, 18 nt, Human
cgcccggagucacggcga

SEQ ID NO: 811140 - RNA, 22 nt, Human
cgcuccgguguuuucuccucuu

SEQ ID NO: 811141 - RNA, 21 nt, Human
cggccuaccucguucauaucg

SEQ ID NO: 811142 - RNA, 19 nt, Human
cgggggccugcgggggcgc

SEQ ID NO: 811143 - RNA, 19 nt, Human
cuccacgauagcacugugc

SEQ ID NO: 811144 - RNA, 21 nt, Human
cuccccaacacgaauucuuuu

SEQ ID NO: 811145 - RNA, 22 nt, Human
cuccgguguuuucuccucuuug

SEQ ID NO: 811146 - RNA, 19 nt, Human
cucugggauggugaggugg

SEQ ID NO: 811147 - RNA, 20 nt, Human
cugcagagagauucucccca

SEQ ID NO: 811148 - RNA, 20 nt, Human
cugccuuuuagugcuuggag

SEQ ID NO: 811149 - RNA, 23 nt, Human
cuuacaaacuuccagcaaauugc

SEQ ID NO: 811150 - RNA, 21 nt, Human
cuugcccccuggccaugcugu

SEQ ID NO: 811151 - RNA, 20 nt, Human
gaaaaagaaacuugggaagg

SEQ ID NO: 811152 - RNA, 23 nt, Human
gaaaugaguuguccacaaagcca

SEQ ID NO: 811153 - RNA, 20 nt, Human
gacucccccucaccuaguug

SEQ ID NO: 811154 - RNA, 19 nt, Human
gagacagcuuuucaacugu

SEQ ID NO: 811155 - RNA, 18 nt, Human
gagauucuccccaacacg

SEQ ID NO: 811156 - RNA, 21 nt, Human
gaggggaguuaguaaaaagag

SEQ ID NO: 811157 - RNA, 18 nt, Human
gaggggcagcagggggcg

SEQ ID NO: 811158 - RNA, 21 nt, Human
gcaaucuuaagucgcuagcca

SEQ ID NO: 811159 - RNA, 18 nt, Human
gcagcaguggcgguggcc

SEQ ID NO: 811160 - RNA, 20 nt, Human
gcaguggcgguggccuuggu

SEQ ID NO: 811161 - RNA, 24 nt, Human
gccccagaggcccccccuagcccu

SEQ ID NO: 811162 - RNA, 18 nt, Human
gcgggggcgcuguguccc

SEQ ID NO: 811163 - RNA, 21 nt, Human
gcugaguuccucugguccccu

SEQ ID NO: 811164 - RNA, 19 nt, Human
gcugcuguugcugcugcuu

SEQ ID NO: 811165 - RNA, 24 nt, Human
ggaggggaguuaguaaaaagaggg

SEQ ID NO: 811166 - RNA, 18 nt, Human
ggaggggcuguaguggug

SEQ ID NO: 811167 - RNA, 22 nt, Human
gggagccguggagaaguugugg

SEQ ID NO: 811168 - RNA, 19 nt, Human
gggauuguccagcaagaga

SEQ ID NO: 811169 - RNA, 18 nt, Human
gggcagcagggggcggug

SEQ ID NO: 811170 - RNA, 24 nt, Human
gggcagcagggggcgguggagggg

SEQ ID NO: 811171 - RNA, 21 nt, Human
ggggggaggauaaguuggaaa

SEQ ID NO: 811172 - RNA, 21 nt, Human
gucuucagagguuguggggga

SEQ ID NO: 811173 - RNA, 26 nt, Human
gugauagucuggugggggcggugggg

SEQ ID NO: 811174 - RNA, 19 nt, Human
gugguggcagcaguggcgg

SEQ ID NO: 811175 - RNA, 25 nt, Human
gugguggcagcaguggcgguggccu

SEQ ID NO: 811176 - RNA, 19 nt, Human
guguuggcggcagacagcg

SEQ ID NO: 811177 - RNA, 18 nt, Human
guugucuucucccaaaag

SEQ ID NO: 811178 - RNA, 24 nt, Human
uaaauaaaaaaccaaaacaaaaca

SEQ ID NO: 811179 - RNA, 19 nt, Human
uaaaugaaaagcaaucuua

SEQ ID NO: 811180 - RNA, 20 nt, Human
uaaccagcagccuugacuuu

SEQ ID NO: 811181 - RNA, 21 nt, Human
uacaguaucaagagagacaaa

SEQ ID NO: 811182 - RNA, 23 nt, Human
uaccucguucauaucguccuuca

SEQ ID NO: 811183 - RNA, 23 nt, Human
uacuuuguaaacacacgaucugg

SEQ ID NO: 811184 - RNA, 26 nt, Human
uauacugccuuuuagugcuuggaguu

SEQ ID NO: 811185 - RNA, 23 nt, Human
uaucaagaaaugaguuguccaca

SEQ ID NO: 811186 - RNA, 21 nt, Human
uauccuggaguuuagacaggg

SEQ ID NO: 811187 - RNA, 22 nt, Human
uauggggauguuucugcagaga

SEQ ID NO: 811188 - RNA, 21 nt, Human
ucaaggaacccuggagcgcaa

SEQ ID NO: 811189 - RNA, 28 nt, Human
ucagggccacaugaauagaggucuucag

SEQ ID NO: 811190 - RNA, 21 nt, Human
uccaaggagccccgccccaga

SEQ ID NO: 811191 - RNA, 19 nt, Human
uccaccaagcugacaagag

SEQ ID NO: 811192 - RNA, 21 nt, Human
uccagcaagagacagaaacac

SEQ ID NO: 811193 - RNA, 23 nt, Human
uccagggaaaaagaaacuuggga

SEQ ID NO: 811194 - RNA, 18 nt, Human
uccauuguuuauuuggag

SEQ ID NO: 811195 - RNA, 19 nt, Human
uccucccuuuccuuucgcu

SEQ ID NO: 811196 - RNA, 18 nt, Human
ucuaagguuuccuagccu

SEQ ID NO: 811197 - RNA, 21 nt, Human
ucuaauugcauuugacagcuc

SEQ ID NO: 811198 - RNA, 22 nt, Human
ucuauccugcaagcuucaggaa

SEQ ID NO: 811199 - RNA, 24 nt, Human
ucucccaaaagagggagacagcuu

SEQ ID NO: 811200 - RNA, 19 nt, Human
ucucggggugacugagccc

SEQ ID NO: 811201 - RNA, 19 nt, Human
ucuuuucaaggaacccugg

SEQ ID NO: 811202 - RNA, 19 nt, Human
ugaaaagacacaauggaaa

SEQ ID NO: 811203 - RNA, 19 nt, Human
ugaaaagacacaauggaaa

SEQ ID NO: 811204 - RNA, 24 nt, Human
ugaaaagacacaauggaaagauua

SEQ ID NO: 811205 - RNA, 19 nt, Human
ugacaagagccacuaggua

SEQ ID NO: 811206 - RNA, 24 nt, Human
ugacugagcccccuccaaggagcc

SEQ ID NO: 811207 - RNA, 22 nt, Human
ugagggucuggacucgcaauaa

SEQ ID NO: 811208 - RNA, 21 nt, Human
ugcaccgagucauguccagcc

SEQ ID NO: 811209 - RNA, 21 nt, Human
ugcagagaaacacauuucuaa

SEQ ID NO: 811210 - RNA, 24 nt, Human
ugccaccauuauugcuacuguuca

SEQ ID NO: 811211 - RNA, 25 nt, Human
ugccaccauuauugcuacuguucag

SEQ ID NO: 811212 - RNA, 24 nt, Human
ugccagcuuuccuugcccccuggc

SEQ ID NO: 811213 - RNA, 30 nt, Human
ugccagcuuuccuugcccccuggccauuac

SEQ ID NO: 811214 - RNA, 26 nt, Human
ugcuacuguucagcaggugcugcugg

SEQ ID NO: 811215 - RNA, 24 nt, Human
uggaaacaaacccugauuaacuua

SEQ ID NO: 811216 - RNA, 20 nt, Human
uggaacuaguaccuccucau

SEQ ID NO: 811217 - RNA, 19 nt, Human
uggagaaguugugggggag

SEQ ID NO: 811218 - RNA, 20 nt, Human
uggagcgcaaucagggcuga

SEQ ID NO: 811219 - RNA, 19 nt, Human
uggaggggcuguaguggug

SEQ ID NO: 811220 - RNA, 22 nt, Human
uggcggcagacagcgauccgag

SEQ ID NO: 811221 - RNA, 21 nt, Human
uggcgguggccuugguguguu

SEQ ID NO: 811222 - RNA, 26 nt, Human
ugggaggccgcaggaggggcagcagg

SEQ ID NO: 811223 - RNA, 21 nt, Human
uggggcugcuguugcugcugc

SEQ ID NO: 811224 - RNA, 19 nt, Human
ugggggagccguggagaag

SEQ ID NO: 811225 - RNA, 26 nt, Human
ugguggcagcaguggcgguggccuug

SEQ ID NO: 811226 - RNA, 18 nt, Human
uggugggggcgguggggc

SEQ ID NO: 811227 - RNA, 20 nt, Human
uggugggggcgguggggcug

SEQ ID NO: 811228 - RNA, 22 nt, Human
ugguguuggcggcagacagcga

SEQ ID NO: 811229 - RNA, 23 nt, Human
uguccugcagagagauucucccc

SEQ ID NO: 811230 - RNA, 21 nt, Human
ugugggggagccguggagaag

SEQ ID NO: 811231 - RNA, 19 nt, Human
uuaguaaaaagaggguggg

SEQ ID NO: 811232 - RNA, 21 nt, Human
uucuauuccucacccccggcu

SEQ ID NO: 811233 - RNA, 19 nt, Human
uuggaacuaguaccuccuc

SEQ ID NO: 811234 - RNA, 19 nt, Human
uuggaccaugcuuuuuucu

SEQ ID NO: 811235 - RNA, 25 nt, Human
uuggacuuuuggaccaugcuuuuuu

SEQ ID NO: 811236 - RNA, 20 nt, Human
uugugggggaggggaguuag

SEQ ID NO: 811237 - RNA, 20 nt, Human
uuugacagcucuggagaagu

SEQ ID NO: 811238 - RNA, 20 nt, Human
uuuuuccucccuuuccuuuc

SEQ ID NO: 811239 - RNA, 19 nt, Human
aaaaaacccaaguaggaca

SEQ ID NO: 811240 - RNA, 23 nt, Human
aaaacaaacaaaaaacccaagua

SEQ ID NO: 811241 - RNA, 27 nt, Human
aaaacaauaaaaacaaacaaaaaaccc

SEQ ID NO: 811242 - RNA, 23 nt, Human
aaacaaaaaacccaaguaggaca

SEQ ID NO: 811243 - RNA, 24 nt, Human
aaacauacaccaucuuuaaaagcc

SEQ ID NO: 811244 - RNA, 18 nt, Human
aaacccuccuucuccuuc

SEQ ID NO: 811245 - RNA, 19 nt, Human
aaacccucgccccaccccc

SEQ ID NO: 811246 - RNA, 19 nt, Human
aaaccuuccuucucauacu

SEQ ID NO: 811247 - RNA, 21 nt, Human
aaacugaaacagaaacgggga

SEQ ID NO: 811248 - RNA, 18 nt, Human
aaagagcuggcgaggaca

SEQ ID NO: 811249 - RNA, 20 nt, Human
aacacagugagacccugucu

SEQ ID NO: 811250 - RNA, 21 nt, Human
aacacagugagacccugucuc

SEQ ID NO: 811251 - RNA, 25 nt, Human
aagaaaaugaaucacaagccauaua

SEQ ID NO: 811252 - RNA, 25 nt, Human
aagaagccacgagauccaacaaaug

SEQ ID NO: 811253 - RNA, 24 nt, Human
aagcaagaaacugcagggggaaga

SEQ ID NO: 811254 - RNA, 23 nt, Human
aagguaucacuauguugcccagg

SEQ ID NO: 811255 - RNA, 18 nt, Human
aaguccccagauccccuc

SEQ ID NO: 811256 - RNA, 22 nt, Human
aagugcuaggauuacaggcgug

SEQ ID NO: 811257 - RNA, 23 nt, Human
aagugcuaggauuacaggcguga

SEQ ID NO: 811258 - RNA, 24 nt, Human
acacuccagccugggcaacagagc

SEQ ID NO: 811259 - RNA, 25 nt, Human
acagagcaagauccuaucucuaaaa

SEQ ID NO: 811260 - RNA, 22 nt, Human
acccugucucuacaaaaaauaa

SEQ ID NO: 811261 - RNA, 22 nt, Human
accugagcagcucuuuaaaaaa

SEQ ID NO: 811262 - RNA, 18 nt, Human
acguugugacucaggcug

SEQ ID NO: 811263 - RNA, 18 nt, Human
acuacacuccagccuggg

SEQ ID NO: 811264 - RNA, 24 nt, Human
acuacacuccagccugggcaacag

SEQ ID NO: 811265 - RNA, 24 nt, Human
acuauguugcccaggcugguuuag

SEQ ID NO: 811266 - RNA, 23 nt, Human
acucaccccucgcucgugugcac

SEQ ID NO: 811267 - RNA, 20 nt, Human
acugaacgcaagggcagcuc

SEQ ID NO: 811268 - RNA, 24 nt, Human
agaaaaaaacauuuuuacuagaag

SEQ ID NO: 811269 - RNA, 18 nt, Human
agaaagcaagaaacugca

SEQ ID NO: 811270 - RNA, 21 nt, Human
agaaagcaagaaacugcaggg

SEQ ID NO: 811271 - RNA, 18 nt, Human
agagcccaucguacuaga

SEQ ID NO: 811272 - RNA, 20 nt, Human
agcaaaaacaauaaaaacaa

SEQ ID NO: 811273 - RNA, 21 nt, Human
agcgagugcuccccuggcuga

SEQ ID NO: 811274 - RNA, 23 nt, Human
agcugggcgugguggugcaugcc

SEQ ID NO: 811275 - RNA, 24 nt, Human
aggaucacuugaggucagcagcuc

SEQ ID NO: 811276 - RNA, 24 nt, Human
aggcaugguggcucaugccuguaa

SEQ ID NO: 811277 - RNA, 24 nt, Human
aggcgggaggaucgcuugagccug

SEQ ID NO: 811278 - RNA, 24 nt, Human
aggcugaggugggaggaucacuug

SEQ ID NO: 811279 - RNA, 23 nt, Human
aggggucugggaucugccagggg

SEQ ID NO: 811280 - RNA, 18 nt, Human
aggugggaggaucacuug

SEQ ID NO: 811281 - RNA, 23 nt, Human
aggugggaggaucacuugagguc

SEQ ID NO: 811282 - RNA, 21 nt, Human
agucuacuacagaaacccucg

SEQ ID NO: 811283 - RNA, 24 nt, Human
agugcuuuggcaggcugagguggg

SEQ ID NO: 811284 - RNA, 23 nt, Human
aguuaaggcgggaggaucgcuug

SEQ ID NO: 811285 - RNA, 24 nt, Human
aucauaccacuacacuccagccug

SEQ ID NO: 811286 - RNA, 24 nt, Human
auccaaacccaggccugccaucac

SEQ ID NO: 811287 - RNA, 23 nt, Human
aucgcuugagccugggaguucaa

SEQ ID NO: 811288 - RNA, 22 nt, Human
augaagacagggagccaggcag

SEQ ID NO: 811289 - RNA, 21 nt, Human
augccugggcuacacccacaa

SEQ ID NO: 811290 - RNA, 20 nt, Human
caaacauacaccaucuuuaa

SEQ ID NO: 811291 - RNA, 18 nt, Human
caaagagcuggcgaggac

SEQ ID NO: 811292 - RNA, 19 nt, Human
caaagagcuggcgaggaca

SEQ ID NO: 811293 - RNA, 22 nt, Human
caacacagugagacccugucuc

SEQ ID NO: 811294 - RNA, 24 nt, Human
caacacagugagacccugucucua

SEQ ID NO: 811295 - RNA, 24 nt, Human
caagguaucacuauguugcccagg

SEQ ID NO: 811296 - RNA, 21 nt, Human
caaucaaaccagaacgucuga

SEQ ID NO: 811297 - RNA, 24 nt, Human
cacacacguuuauauauauuugga

SEQ ID NO: 811298 - RNA, 22 nt, Human
cacagcccugccucugucaagc

SEQ ID NO: 811299 - RNA, 20 nt, Human
caccaucuuuaaaagccaag

SEQ ID NO: 811300 - RNA, 19 nt, Human
cacccacaacaaucaaacc

SEQ ID NO: 811301 - RNA, 21 nt, Human
cacccccaaaacaccucuaaa

SEQ ID NO: 811302 - RNA, 24 nt, Human
caccgcccuucccaacaugcccaa

SEQ ID NO: 811303 - RNA, 25 nt, Human
caccgcccuucccaacaugcccaaa

SEQ ID NO: 811304 - RNA, 24 nt, Human
caccuaggcucugggaccugccaa

SEQ ID NO: 811305 - RNA, 26 nt, Human
cacuacacuccagccugggcaacaga

SEQ ID NO: 811306 - RNA, 19 nt, Human
cacuauguugcccaggcug

SEQ ID NO: 811307 - RNA, 23 nt, Human
cacuauguugcccaggcugguuu

SEQ ID NO: 811308 - RNA, 31 nt, Human
cacuauguugcccaggcugguuuaggacucc

SEQ ID NO: 811309 - RNA, 22 nt, Human
cacucugcacacacaucacaga

SEQ ID NO: 811310 - RNA, 22 nt, Human
cacugcagcaggucccgggggc

SEQ ID NO: 811311 - RNA, 19 nt, Human
cacugcccucucuuucugc

SEQ ID NO: 811312 - RNA, 20 nt, Human
cacuggggcuugaaaggugg

SEQ ID NO: 811313 - RNA, 18 nt, Human
cagaacccuugggggagc

SEQ ID NO: 811314 - RNA, 24 nt, Human
cagagcaagauccuaucucuaaaa

SEQ ID NO: 811315 - RNA, 19 nt, Human
cagauaaaauacucaaccc

SEQ ID NO: 811316 - RNA, 28 nt, Human
cagauaaaauacucaacccccugaaagg

SEQ ID NO: 811317 - RNA, 19 nt, Human
cagcaugaaacuaaucccc

SEQ ID NO: 811318 - RNA, 22 nt, Human
cagccacggccacucaccccuc

SEQ ID NO: 811319 - RNA, 19 nt, Human
caggugucacacccaaguc

SEQ ID NO: 811320 - RNA, 20 nt, Human
cagugcagcgagugcucccc

SEQ ID NO: 811321 - RNA, 23 nt, Human
cauggacccuccagaugccccuu

SEQ ID NO: 811322 - RNA, 20 nt, Human
cauuucaaauauguccuggc

SEQ ID NO: 811323 - RNA, 23 nt, Human
ccaagugcuaggauuacaggcgu

SEQ ID NO: 811324 - RNA, 24 nt, Human
ccaccgcccuucccaacaugccca

SEQ ID NO: 811325 - RNA, 21 nt, Human
ccacuacacuccagccugggc

SEQ ID NO: 811326 - RNA, 23 nt, Human
ccacuacacuccagccugggcaa

SEQ ID NO: 811327 - RNA, 24 nt, Human
ccacuacacuccagccugggcaac

SEQ ID NO: 811328 - RNA, 24 nt, Human
cccaaaacaccucuaaauuucaga

SEQ ID NO: 811329 - RNA, 24 nt, Human
cccaagugcuaggauuacaggcgu

SEQ ID NO: 811330 - RNA, 30 nt, Human
cccacagccacggccacucaccccucgcuu

SEQ ID NO: 811331 - RNA, 21 nt, Human
cccacgcaccaguacuccuuc

SEQ ID NO: 811332 - RNA, 19 nt, Human
cccauguauuagauagaac

SEQ ID NO: 811333 - RNA, 22 nt, Human
ccccaacaaaagauuaaaaaga

SEQ ID NO: 811334 - RNA, 24 nt, Human
ccccacccccaaaacaccucuaaa

SEQ ID NO: 811335 - RNA, 24 nt, Human
ccccagagguagaaucauuuuacc

SEQ ID NO: 811336 - RNA, 20 nt, Human
ccccaggcugccagcugcuu

SEQ ID NO: 811337 - RNA, 20 nt, Human
cccccaaaacaccucuaaau

SEQ ID NO: 811338 - RNA, 18 nt, Human
cccccucaagcuagcuuu

SEQ ID NO: 811339 - RNA, 21 nt, Human
ccccggcaaaaguccuugaag

SEQ ID NO: 811340 - RNA, 25 nt, Human
cccucaagcuagcuuuugagcccag

SEQ ID NO: 811341 - RNA, 25 nt, Human
ccgcccuucccaacaugcccaaacc

SEQ ID NO: 811342 - RNA, 25 nt, Human
ccucgccccacccccaaaacaccuc

SEQ ID NO: 811343 - RNA, 25 nt, Human
ccucgccccacccccaaaacaccuc

SEQ ID NO: 811344 - RNA, 26 nt, Human
ccucgccccacccccaaaacaccucu

SEQ ID NO: 811345 - RNA, 22 nt, Human
ccucugccccuugcaaaggggc

SEQ ID NO: 811346 - RNA, 21 nt, Human
ccugagcucaagugauccgcc

SEQ ID NO: 811347 - RNA, 22 nt, Human
ccugagcucaagugauccgccu

SEQ ID NO: 811348 - RNA, 23 nt, Human
ccugagcucaagugauccgccug

SEQ ID NO: 811349 - RNA, 20 nt, Human
ccugcauccuugggcagggu

SEQ ID NO: 811350 - RNA, 22 nt, Human
ccuggccaggcaugguggcuca

SEQ ID NO: 811351 - RNA, 19 nt, Human
ccuggggcaucugcccccu

SEQ ID NO: 811352 - RNA, 23 nt, Human
ccuggggcaucugcccccucaag

SEQ ID NO: 811353 - RNA, 20 nt, Human
ccuguaaucccagugcuuug

SEQ ID NO: 811354 - RNA, 19 nt, Human
ccuguagucccagcuacuc

SEQ ID NO: 811355 - RNA, 25 nt, Human
ccuguagucccagcuacucaggcag

SEQ ID NO: 811356 - RNA, 19 nt, Human
ccuuagacacccaucccaa

SEQ ID NO: 811357 - RNA, 24 nt, Human
ccuuagacacccaucccaaacccu

SEQ ID NO: 811358 - RNA, 23 nt, Human
ccuuggucccaggguccuaaggc

SEQ ID NO: 811359 - RNA, 23 nt, Human
cgaacaccccccggcaaaagucc

SEQ ID NO: 811360 - RNA, 24 nt, Human
cgaacaccccccggcaaaaguccu

SEQ ID NO: 811361 - RNA, 19 nt, Human
cgaggacacaaauaugggg

SEQ ID NO: 811362 - RNA, 19 nt, Human
cgccccacccccaaaacac

SEQ ID NO: 811363 - RNA, 20 nt, Human
cgccccacccccaaaacacc

SEQ ID NO: 811364 - RNA, 26 nt, Human
cgccccacccccaaaacaccucuaaa

SEQ ID NO: 811365 - RNA, 23 nt, Human
cgccugccacugccucccaaguu

SEQ ID NO: 811366 - RNA, 19 nt, Human
cggcucccuccggagccug

SEQ ID NO: 811367 - RNA, 21 nt, Human
cgguaggguugccagguuuag

SEQ ID NO: 811368 - RNA, 24 nt, Human
cgugagccaccaugccuggccugu

SEQ ID NO: 811369 - RNA, 23 nt, Human
cgugugcacagccuccccacaua

SEQ ID NO: 811370 - RNA, 20 nt, Human
cuaaacgcuggaacgaagca

SEQ ID NO: 811371 - RNA, 19 nt, Human
cuaagguuuuccugcaacu

SEQ ID NO: 811372 - RNA, 20 nt, Human
cuaauccccaacaaaagauu

SEQ ID NO: 811373 - RNA, 25 nt, Human
cuacagaaacccucgccccaccccc

SEQ ID NO: 811374 - RNA, 22 nt, Human
cuacuacagaaacccucgcccc

SEQ ID NO: 811375 - RNA, 19 nt, Human
cuagaagaccgacugccua

SEQ ID NO: 811376 - RNA, 21 nt, Human
cucaagugauccgccugccac

SEQ ID NO: 811377 - RNA, 24 nt, Human
cucaugccuguaaucccagugcuu

SEQ ID NO: 811378 - RNA, 21 nt, Human
cuccagaugccccuucauccu

SEQ ID NO: 811379 - RNA, 19 nt, Human
cucccacucccaaggggac

SEQ ID NO: 811380 - RNA, 21 nt, Human
cuccucccacuuccaguaccc

SEQ ID NO: 811381 - RNA, 21 nt, Human
cuuucugcaacucccccucca

SEQ ID NO: 811382 - RNA, 23 nt, Human
cuuucugcaacucccccuccacc

SEQ ID NO: 811383 - RNA, 22 nt, Human
gaagcacgccccaggcugccag

SEQ ID NO: 811384 - RNA, 18 nt, Human
gaccuugccuccucccac

SEQ ID NO: 811385 - RNA, 18 nt, Human
gaucacuugaggucagca

SEQ ID NO: 811386 - RNA, 19 nt, Human
gaucacuugaggucagcag

SEQ ID NO: 811387 - RNA, 24 nt, Human
gaucacuugaggucagcagcucga

SEQ ID NO: 811388 - RNA, 22 nt, Human
gauccccucuccucacccucac

SEQ ID NO: 811389 - RNA, 18 nt, Human
gaucgcuugagccuggga

SEQ ID NO: 811390 - RNA, 21 nt, Human
gauuaagaaaaugaaucacaa

SEQ ID NO: 811391 - RNA, 18 nt, Human
gauuacaggcgugagcca

SEQ ID NO: 811392 - RNA, 21 nt, Human
gauuacaggcgugagccacca

SEQ ID NO: 811393 - RNA, 22 nt, Human
gauuacaggcgugagccaccau

SEQ ID NO: 811394 - RNA, 19 nt, Human
gccaagcaacaagccaggu

SEQ ID NO: 811395 - RNA, 22 nt, Human
gccaggcaugguggcucaugcc

SEQ ID NO: 811396 - RNA, 23 nt, Human
gccagguuuagcaaaaacaauaa

SEQ ID NO: 811397 - RNA, 22 nt, Human
gccccaggcugccagcugcuuc

SEQ ID NO: 811398 - RNA, 20 nt, Human
gccugccacugccucccaag

SEQ ID NO: 811399 - RNA, 24 nt, Human
gcuccaaaguccugggucagacca

SEQ ID NO: 811400 - RNA, 22 nt, Human
ggaaagaucacaauuuugcucc

SEQ ID NO: 811401 - RNA, 20 nt, Human
ggagcugggacaccuggggc

SEQ ID NO: 811402 - RNA, 22 nt, Human
ggauuacaggcgugagccacca

SEQ ID NO: 811403 - RNA, 24 nt, Human
ggauuacaggcgugagccaccaug

SEQ ID NO: 811404 - RNA, 22 nt, Human
ggccaggcaugguggcucaugg

SEQ ID NO: 811405 - RNA, 22 nt, Human
ggguaaggcccccacgcaccag

SEQ ID NO: 811406 - RNA, 24 nt, Human
gguccuggccacagcccugccucu

SEQ ID NO: 811407 - RNA, 24 nt, Human
gguggcucaugccuguaaucccag

SEQ ID NO: 811408 - RNA, 18 nt, Human
guacaggaugaggaugcc

SEQ ID NO: 811409 - RNA, 18 nt, Human
guaccaugucuauuccca

SEQ ID NO: 811410 - RNA, 19 nt, Human
guggguggcuccaaagucc

SEQ ID NO: 811411 - RNA, 22 nt, Human
uaaaaaaucccaugccugggcu

SEQ ID NO: 811412 - RNA, 21 nt, Human
uaaauuggaauuaccugagca

SEQ ID NO: 811413 - RNA, 19 nt, Human
uaagggcagaaacaaagau

SEQ ID NO: 811414 - RNA, 18 nt, Human
uacacgaagcucacuccu

SEQ ID NO: 811415 - RNA, 22 nt, Human
uacagaaacccucgccccaccc

SEQ ID NO: 811416 - RNA, 22 nt, Human
uacaggcgugagccaccaugcc

SEQ ID NO: 811417 - RNA, 22 nt, Human
uacaggcgugagccaccaugcc

SEQ ID NO: 811418 - RNA, 23 nt, Human
uacaggcgugagccaccaugccu

SEQ ID NO: 811419 - RNA, 18 nt, Human
uacagugugagugugagg

SEQ ID NO: 811420 - RNA, 24 nt, Human
uaccacuacacuccagccugggca

SEQ ID NO: 811421 - RNA, 22 nt, Human
uacuccuucugaccuaacaccc

SEQ ID NO: 811422 - RNA, 21 nt, Human
uagacacccaucccaaacccu

SEQ ID NO: 811423 - RNA, 22 nt, Human
uagagacaagguaucacuaugu

SEQ ID NO: 811424 - RNA, 26 nt, Human
uagauaauguacacgaagcucacucc

SEQ ID NO: 811425 - RNA, 20 nt, Human
uagcaaaaacaauaaaaaca

SEQ ID NO: 811426 - RNA, 25 nt, Human
uagcaaaaacaauaaaaacaaacaa

SEQ ID NO: 811427 - RNA, 18 nt, Human
uaggauuacaggcgugag

SEQ ID NO: 811428 - RNA, 22 nt, Human
uaggauuacaggcgugagccac

SEQ ID NO: 811429 - RNA, 24 nt, Human
uaggauuacaggcgugagccacca

SEQ ID NO: 811430 - RNA, 25 nt, Human
uaggauuacaggcgugagccaccau

SEQ ID NO: 811431 - RNA, 24 nt, Human
uagucccagcuacucaggcaguua

SEQ ID NO: 811432 - RNA, 18 nt, Human
uauguugcccaggcuggu

SEQ ID NO: 811433 - RNA, 22 nt, Human
uauguugcccaggcugguuuag

SEQ ID NO: 811434 - RNA, 23 nt, Human
uauguugcccaggcugguuuagg

SEQ ID NO: 811435 - RNA, 21 nt, Human
ucaacuccugccuuagacacu

SEQ ID NO: 811436 - RNA, 18 nt, Human
ucaagagacccucuccuc

SEQ ID NO: 811437 - RNA, 24 nt, Human
ucacaauuuugcucccacucccaa

SEQ ID NO: 811438 - RNA, 22 nt, Human
ucacacccaaguccccagaucc

SEQ ID NO: 811439 - RNA, 20 nt, Human
ucagaccagugcaaccccau

SEQ ID NO: 811440 - RNA, 21 nt, Human
ucaugccuguaaucccagugc

SEQ ID NO: 811441 - RNA, 20 nt, Human
uccaguacccucugccccuu

SEQ ID NO: 811442 - RNA, 23 nt, Human
ucccaagugcuaggauuacaggc

SEQ ID NO: 811443 - RNA, 21 nt, Human
ucccuccggagccuguuccca

SEQ ID NO: 811444 - RNA, 18 nt, Human
uccuagaagaccgacugc

SEQ ID NO: 811445 - RNA, 22 nt, Human
uccucacccucacugcccucuc

SEQ ID NO: 811446 - RNA, 23 nt, Human
uccuggccacagcccugccucug

SEQ ID NO: 811447 - RNA, 18 nt, Human
ucgccccacccccaaaac

SEQ ID NO: 811448 - RNA, 23 nt, Human
ucgcuugagccugggaguucaag

SEQ ID NO: 811449 - RNA, 24 nt, Human
ucgcuugagccugggaguucaagg

SEQ ID NO: 811450 - RNA, 23 nt, Human
ucuaaaaauaacaucugucccau

SEQ ID NO: 811451 - RNA, 18 nt, Human
ucucauggacccuccaga

SEQ ID NO: 811452 - RNA, 21 nt, Human
ucugaccuaacacccaggcca

SEQ ID NO: 811453 - RNA, 23 nt, Human
ucugaccuaacacccaggccaaa

SEQ ID NO: 811454 - RNA, 21 nt, Human
ugaagaaaguaagguuggacu

SEQ ID NO: 811455 - RNA, 21 nt, Human
ugaccuaacacccaggccaaa

SEQ ID NO: 811456 - RNA, 27 nt, Human
ugaccuaacacccaggccaaagcuaug

SEQ ID NO: 811457 - RNA, 24 nt, Human
ugagccugggaguucaagguugug

SEQ ID NO: 811458 - RNA, 18 nt, Human
ugagcucaagugauccgc

SEQ ID NO: 811459 - RNA, 21 nt, Human
ugaggcaacacagugagaccc

SEQ ID NO: 811460 - RNA, 24 nt, Human
ugagggccccaucucauggacccu

SEQ ID NO: 811461 - RNA, 19 nt, Human
ugaggugggaggaucacuu

SEQ ID NO: 811462 - RNA, 24 nt, Human
ugaggugggaggaucacuugaggu

SEQ ID NO: 811463 - RNA, 26 nt, Human
ugaggugggaggaucacuugagguca

SEQ ID NO: 811464 - RNA, 21 nt, Human
ugauagcagaccuugccuccu

SEQ ID NO: 811465 - RNA, 18 nt, Human
ugcccacagccacggcca

SEQ ID NO: 811466 - RNA, 19 nt, Human
ugcccaggcugguuuagga

SEQ ID NO: 811467 - RNA, 24 nt, Human
ugcccaggcugguuuaggacuccu

SEQ ID NO: 811468 - RNA, 28 nt, Human
ugcccaggcugguuuaggacuccugagc

SEQ ID NO: 811469 - RNA, 22 nt, Human
ugccccgcacuagcugcuauga

SEQ ID NO: 811470 - RNA, 18 nt, Human
ugccccuucauccucucu

SEQ ID NO: 811471 - RNA, 24 nt, Human
ugccuguagucccagcuacucagg

SEQ ID NO: 811472 - RNA, 23 nt, Human
ugccuuagacacccaucccaaac

SEQ ID NO: 811473 - RNA, 24 nt, Human
ugccuuagacacccaucccaaacc

SEQ ID NO: 811474 - RNA, 24 nt, Human
ugcuaggauuacaggcgugagcca

SEQ ID NO: 811475 - RNA, 20 nt, Human
ugcuuccgcccaccuuuccc

SEQ ID NO: 811476 - RNA, 19 nt, Human
uggcacugcagcagguccc

SEQ ID NO: 811477 - RNA, 24 nt, Human
uggcaggcugaggugggaggauca

SEQ ID NO: 811478 - RNA, 24 nt, Human
uggccaaagagcuggcgaggacac

SEQ ID NO: 811479 - RNA, 24 nt, Human
uggccaggcaugguggcucaugcc

SEQ ID NO: 811480 - RNA, 18 nt, Human
uggcgaggacacaaauau

SEQ ID NO: 811481 - RNA, 22 nt, Human
uggcucaugccuguaaucccag

SEQ ID NO: 811482 - RNA, 24 nt, Human
uggcucaugccuguaaucccagug

SEQ ID NO: 811483 - RNA, 21 nt, Human
ugggacaccuggggcaucugc

SEQ ID NO: 811484 - RNA, 23 nt, Human
ugggaccugccaccaaggggucu

SEQ ID NO: 811485 - RNA, 18 nt, Human
uggugcaugccuguaguc

SEQ ID NO: 811486 - RNA, 24 nt, Human
ugguggcucaugccuguaauccca

SEQ ID NO: 811487 - RNA, 24 nt, Human
ugguggugcaugccuguaguccca

SEQ ID NO: 811488 - RNA, 19 nt, Human
uguaacccaggccucugca

SEQ ID NO: 811489 - RNA, 20 nt, Human
uguaacccaggccucugcag

SEQ ID NO: 811490 - RNA, 18 nt, Human
uguccuggccaggcaugg

SEQ ID NO: 811491 - RNA, 19 nt, Human
ugugacaguucgcaaagaa

SEQ ID NO: 811492 - RNA, 23 nt, Human
uguggguggcuccaaaguccugg

SEQ ID NO: 811493 - RNA, 21 nt, Human
uuaaaagccaagcaacaagcc

SEQ ID NO: 811494 - RNA, 22 nt, Human
uuagacacccaucccaaacccu

SEQ ID NO: 811495 - RNA, 19 nt, Human
uuagcugggcgugguggug

SEQ ID NO: 811496 - RNA, 24 nt, Human
uuagcugggcgugguggugcaugc

SEQ ID NO: 811497 - RNA, 22 nt, Human
uucaaacuuaacugggcauccu

SEQ ID NO: 811498 - RNA, 22 nt, Human
uucaaagcuaaaagaaaaaaac

SEQ ID NO: 811499 - RNA, 19 nt, Human
uucaaauauguccuggcca

SEQ ID NO: 811500 - RNA, 18 nt, Human
uucacucugcacacacau

SEQ ID NO: 811501 - RNA, 23 nt, Human
uuccugcaacuuucccaaccgcc

SEQ ID NO: 811502 - RNA, 24 nt, Human
uugagccugggaguucaagguugu

SEQ ID NO: 811503 - RNA, 25 nt, Human
uuggcaggcugaggugggaggauca

SEQ ID NO: 811504 - RNA, 24 nt, Human
uuguggugagcuaugaucauacca

SEQ ID NO: 811505 - RNA, 21 nt, Human
uuuaggacuccugagcucaag

SEQ ID NO: 811506 - RNA, 20 nt, Human
uuucaaauauguccuggcca

SEQ ID NO: 811507 - RNA, 23 nt, Human
aaaguaaaauugccuugcugaaa

SEQ ID NO: 811508 - RNA, 18 nt, Human
aagaaaggaacuccuccc

SEQ ID NO: 811509 - RNA, 20 nt, Human
acacacccgcacccccuuca

SEQ ID NO: 811510 - RNA, 19 nt, Human
acaccgcccccaacacaca

SEQ ID NO: 811511 - RNA, 18 nt, Human
acagaguaugaggagucc

SEQ ID NO: 811512 - RNA, 24 nt, Human
accaagauaucugugcuggacgug

SEQ ID NO: 811513 - RNA, 19 nt, Human
acccaccccccacccgugc

SEQ ID NO: 811514 - RNA, 19 nt, Human
accuccaggauuauccucu

SEQ ID NO: 811515 - RNA, 23 nt, Human
acgaacuuccuucaaaccuccuu

SEQ ID NO: 811516 - RNA, 22 nt, Human
acucuuauuacuaccuagggca

SEQ ID NO: 811517 - RNA, 24 nt, Human
acuuuaaggcaagaucggaguccc

SEQ ID NO: 811518 - RNA, 19 nt, Human
agagcugugguccacggcg

SEQ ID NO: 811519 - RNA, 22 nt, Human
agauccgcauaggaacaugaaa

SEQ ID NO: 811520 - RNA, 21 nt, Human
agcaucacccccucccaaagc

SEQ ID NO: 811521 - RNA, 22 nt, Human
agcccacaccgcccccaacaca

SEQ ID NO: 811522 - RNA, 19 nt, Human
agcuaguguggguggcuuc

SEQ ID NO: 811523 - RNA, 19 nt, Human
aggaagaugcccacucaac

SEQ ID NO: 811524 - RNA, 23 nt, Human
aggaagaugcccacucaaccucc

SEQ ID NO: 811525 - RNA, 22 nt, Human
aggacacacaugcacugcagcg

SEQ ID NO: 811526 - RNA, 21 nt, Human
aggacacaguagcagggacaa

SEQ ID NO: 811527 - RNA, 23 nt, Human
aggagacccuauacuagcagcua

SEQ ID NO: 811528 - RNA, 21 nt, Human
aggcaagaggagcccccaggg

SEQ ID NO: 811529 - RNA, 18 nt, Human
aggcaggaaaguggugug

SEQ ID NO: 811530 - RNA, 19 nt, Human
aggcaggagccccagcaca

SEQ ID NO: 811531 - RNA, 19 nt, Human
agggcagaggucuccaaac

SEQ ID NO: 811532 - RNA, 22 nt, Human
agggccugaggccgcacccaga

SEQ ID NO: 811533 - RNA, 18 nt, Human
agggggugggggggaugc

SEQ ID NO: 811534 - RNA, 21 nt, Human
agggugaaagcucugcccagc

SEQ ID NO: 811535 - RNA, 24 nt, Human
aggugaugaguuggaggcugggga

SEQ ID NO: 811536 - RNA, 22 nt, Human
agguggccccagggcccaaaca

SEQ ID NO: 811537 - RNA, 19 nt, Human
aggugguggagugaaagaa

SEQ ID NO: 811538 - RNA, 21 nt, Human
aggugguggagugaaagaagc

SEQ ID NO: 811539 - RNA, 18 nt, Human
aucacccccucccaaagc

SEQ ID NO: 811540 - RNA, 24 nt, Human
aucccaaaaccauccccccaaccc

SEQ ID NO: 811541 - RNA, 22 nt, Human
auuggcauagcccugggugaaa

SEQ ID NO: 811542 - RNA, 18 nt, Human
caaaacagcuucuggggc

SEQ ID NO: 811543 - RNA, 21 nt, Human
caaaaccauccccccaacccc

SEQ ID NO: 811544 - RNA, 20 nt, Human
caaacccugggccacggacc

SEQ ID NO: 811545 - RNA, 19 nt, Human
caagacagugaccuaaagc

SEQ ID NO: 811546 - RNA, 21 nt, Human
cacagaguaugaggaguccaa

SEQ ID NO: 811547 - RNA, 21 nt, Human
cacagccuauaccccuuccuu

SEQ ID NO: 811548 - RNA, 21 nt, Human
caccccccacccgugcuccca

SEQ ID NO: 811549 - RNA, 21 nt, Human
cacccccucccaaagcccccc

SEQ ID NO: 811550 - RNA, 22 nt, Human
caccccuuucuccugguuccca

SEQ ID NO: 811551 - RNA, 22 nt, Human
caccgcccccaacacacacucc

SEQ ID NO: 811552 - RNA, 22 nt, Human
caccugugaugcaggugggaag

SEQ ID NO: 811553 - RNA, 20 nt, Human
cagcacacacccgcaccccc

SEQ ID NO: 811554 - RNA, 21 nt, Human
cagcaguggcauuagauccgc

SEQ ID NO: 811555 - RNA, 20 nt, Human
cagcaucacccccucccaaa

SEQ ID NO: 811556 - RNA, 19 nt, Human
cagccugccccuccagugg

SEQ ID NO: 811557 - RNA, 23 nt, Human
cagccuggucagccccgagguag

SEQ ID NO: 811558 - RNA, 20 nt, Human
cagcgccucugacugccagg

SEQ ID NO: 811559 - RNA, 19 nt, Human
cagcuaggagacccugcca

SEQ ID NO: 811560 - RNA, 24 nt, Human
caggacagcacacacccgcacccc

SEQ ID NO: 811561 - RNA, 22 nt, Human
caggagccccagcacaccgcuc

SEQ ID NO: 811562 - RNA, 20 nt, Human
cauagguuggguuugggugc

SEQ ID NO: 811563 - RNA, 22 nt, Human
caucacccccucccaaagcccc

SEQ ID NO: 811564 - RNA, 26 nt, Human
caucacccccucccaaagccccccca

SEQ ID NO: 811565 - RNA, 22 nt, Human
caucccaaaaccauccccccaa

SEQ ID NO: 811566 - RNA, 23 nt, Human
caucccaggagcacccacaagga

SEQ ID NO: 811567 - RNA, 20 nt, Human
cauccccccaacccccaucc

SEQ ID NO: 811568 - RNA, 24 nt, Human
caugaaaccaguccaugaugccaa

SEQ ID NO: 811569 - RNA, 24 nt, Human
caugaugccaaaaagguuggggac

SEQ ID NO: 811570 - RNA, 27 nt, Human
ccaacccccauccauggaaaaauuguc

SEQ ID NO: 811571 - RNA, 21 nt, Human
ccacccagaccucuuccaacc

SEQ ID NO: 811572 - RNA, 22 nt, Human
ccaccccccacccgugcuccca

SEQ ID NO: 811573 - RNA, 20 nt, Human
ccagagcucccuuugccaac

SEQ ID NO: 811574 - RNA, 18 nt, Human
ccaggacagcacacaccc

SEQ ID NO: 811575 - RNA, 18 nt, Human
ccauuccagcugugggca

SEQ ID NO: 811576 - RNA, 18 nt, Human
cccaaacacagcuuugaa

SEQ ID NO: 811577 - RNA, 21 nt, Human
cccacagcagggucccagagc

SEQ ID NO: 811578 - RNA, 23 nt, Human
ccccaacccccauccauggaaaa

SEQ ID NO: 811579 - RNA, 20 nt, Human
ccccaagagcaagagagaau

SEQ ID NO: 811580 - RNA, 21 nt, Human
ccccacccagaccucuuccaa

SEQ ID NO: 811581 - RNA, 18 nt, Human
ccccaggacagcacacac

SEQ ID NO: 811582 - RNA, 24 nt, Human
ccccaggacagcacacacccgcac

SEQ ID NO: 811583 - RNA, 20 nt, Human
ccccauccauggaaaaauug

SEQ ID NO: 811584 - RNA, 18 nt, Human
ccccgaaaagcagcuggc

SEQ ID NO: 811585 - RNA, 22 nt, Human
cccgaaaagcagcuggcccccg

SEQ ID NO: 811586 - RNA, 19 nt, Human
cccggcugcuguuccugcu

SEQ ID NO: 811587 - RNA, 20 nt, Human
cccucagucugcaagcugug

SEQ ID NO: 811588 - RNA, 21 nt, Human
cccucccuccucaggguccca

SEQ ID NO: 811589 - RNA, 23 nt, Human
cccugcaucccaggaagaugccc

SEQ ID NO: 811590 - RNA, 20 nt, Human
cccugggccacuggaggccc

SEQ ID NO: 811591 - RNA, 23 nt, Human
ccuagcccaggccugguuugggg

SEQ ID NO: 811592 - RNA, 19 nt, Human
ccuauacuagcagcuagga

SEQ ID NO: 811593 - RNA, 20 nt, Human
ccucaggccacccuccggcu

SEQ ID NO: 811594 - RNA, 21 nt, Human
ccucccaaagcccccccauag

SEQ ID NO: 811595 - RNA, 23 nt, Human
ccucccaaagcccccccauaggu

SEQ ID NO: 811596 - RNA, 23 nt, Human
ccucggagacucugaacucgcug

SEQ ID NO: 811597 - RNA, 18 nt, Human
ccucugugugccucaguu

SEQ ID NO: 811598 - RNA, 18 nt, Human
ccuggcugcccucccucc

SEQ ID NO: 811599 - RNA, 24 nt, Human
ccugggccacuggaggcccgagag

SEQ ID NO: 811600 - RNA, 24 nt, Human
ccugguucccaccccggcucccac

SEQ ID NO: 811601 - RNA, 21 nt, Human
ccugguuuggggccugagagg

SEQ ID NO: 811602 - RNA, 24 nt, Human
cggcuguucuugcaccuuccauuc

SEQ ID NO: 811603 - RNA, 26 nt, Human
cucacagccuauaccccuuccuuauu

SEQ ID NO: 811604 - RNA, 22 nt, Human
cucaucugcuuacccacccccc

SEQ ID NO: 811605 - RNA, 21 nt, Human
cuccaaacccugggccacgga

SEQ ID NO: 811606 - RNA, 25 nt, Human
cucccuccucagggucccacagccc

SEQ ID NO: 811607 - RNA, 19 nt, Human
cuccucagggucccacagc

SEQ ID NO: 811608 - RNA, 23 nt, Human
cuccuccacgcagccugccccuc

SEQ ID NO: 811609 - RNA, 18 nt, Human
cuccugccuugggucugc

SEQ ID NO: 811610 - RNA, 21 nt, Human
cuccugguucccaccccggcu

SEQ ID NO: 811611 - RNA, 18 nt, Human
cugccaauggacauagga

SEQ ID NO: 811612 - RNA, 24 nt, Human
cugggacacucagccucccugagc

SEQ ID NO: 811613 - RNA, 22 nt, Human
cugggccacggaccaguacuga

SEQ ID NO: 811614 - RNA, 19 nt, Human
cuuccagagcccacaccgc

SEQ ID NO: 811615 - RNA, 25 nt, Human
cuucuggggccaggcaagcagggcc

SEQ ID NO: 811616 - RNA, 19 nt, Human
cuuugccaacccuccuaau

SEQ ID NO: 811617 - RNA, 20 nt, Human
gaaaggacagagguggcccc

SEQ ID NO: 811618 - RNA, 23 nt, Human
gaaaggacagagguggccccagg

SEQ ID NO: 811619 - RNA, 18 nt, Human
gaccuaaagcuuucugcu

SEQ ID NO: 811620 - RNA, 23 nt, Human
gacuaccugggcucaaauucaaa

SEQ ID NO: 811621 - RNA, 23 nt, Human
gagccugcgguugugcuggaagc

SEQ ID NO: 811622 - RNA, 22 nt, Human
gagcucccuuugccaacccucc

SEQ ID NO: 811623 - RNA, 20 nt, Human
gaggccgcacccagagcucc

SEQ ID NO: 811624 - RNA, 22 nt, Human
gcacagcaucacccccucccaa

SEQ ID NO: 811625 - RNA, 18 nt, Human
gcagcccaggauccuaua

SEQ ID NO: 811626 - RNA, 19 nt, Human
gcagcuaggagacccugcc

SEQ ID NO: 811627 - RNA, 18 nt, Human
gcauaguguagcugggga

SEQ ID NO: 811628 - RNA, 23 nt, Human
gcccaggccugguuuggggccug

SEQ ID NO: 811629 - RNA, 21 nt, Human
gccccagcacaccgcucucug

SEQ ID NO: 811630 - RNA, 18 nt, Human
gcccccccauagguuggg

SEQ ID NO: 811631 - RNA, 24 nt, Human
gccggcgggauggccuggggcagc

SEQ ID NO: 811632 - RNA, 19 nt, Human
gccugaugaucugaggugg

SEQ ID NO: 811633 - RNA, 18 nt, Human
gcgccucugacugccagg

SEQ ID NO: 811634 - RNA, 18 nt, Human
gcuaguguggguggcuuc

SEQ ID NO: 811635 - RNA, 21 nt, Human
gcucccucagcggccagcugu

SEQ ID NO: 811636 - RNA, 24 nt, Human
gcugugggcaggacaagccugguu

SEQ ID NO: 811637 - RNA, 22 nt, Human
ggaagaugcccacucaaccucc

SEQ ID NO: 811638 - RNA, 23 nt, Human
ggacagcacacacccgcaccccc

SEQ ID NO: 811639 - RNA, 22 nt, Human
ggagcaagcauucccaccugag

SEQ ID NO: 811640 - RNA, 19 nt, Human
ggaggaagagcgccuggcc

SEQ ID NO: 811641 - RNA, 19 nt, Human
ggcagaggucuccaaaccc

SEQ ID NO: 811642 - RNA, 26 nt, Human
ggcccuggcucggcugcauucuugag

SEQ ID NO: 811643 - RNA, 19 nt, Human
ggccuggaagacugaaggc

SEQ ID NO: 811644 - RNA, 21 nt, Human
ggccugguuuggggccugaga

SEQ ID NO: 811645 - RNA, 23 nt, Human
ggccugguuuggggccuggcuug

SEQ ID NO: 811646 - RNA, 21 nt, Human
gggauggucauuaacggccug

SEQ ID NO: 811647 - RNA, 18 nt, Human
ggggagggcagugguucc

SEQ ID NO: 811648 - RNA, 22 nt, Human
gggggugggggggaugcgggca

SEQ ID NO: 811649 - RNA, 23 nt, Human
ggucccaucccaggagcacccac

SEQ ID NO: 811650 - RNA, 18 nt, Human
gguggagugaaagaagca

SEQ ID NO: 811651 - RNA, 29 nt, Human
ggugggggggaugcgggcaccaggccaug

SEQ ID NO: 811652 - RNA, 19 nt, Human
gguuggaggaggcuggucc

SEQ ID NO: 811653 - RNA, 23 nt, Human
gguugugcuggaagcuggggugg

SEQ ID NO: 811654 - RNA, 18 nt, Human
gguuuggggccugagagg

SEQ ID NO: 811655 - RNA, 22 nt, Human
guaaaauugccuugcugaaaga

SEQ ID NO: 811656 - RNA, 24 nt, Human
gucuccaaacccugggccacggac

SEQ ID NO: 811657 - RNA, 22 nt, Human
gugcacccgcugggcgcacaca

SEQ ID NO: 811658 - RNA, 20 nt, Human
guggggcaggguaguguggg

SEQ ID NO: 811659 - RNA, 19 nt, Human
guugugcuggaagcugggg

SEQ ID NO: 811660 - RNA, 18 nt, Human
uaacggccugcuaucucc

SEQ ID NO: 811661 - RNA, 20 nt, Human
uaaggcaagaucggaguccc

SEQ ID NO: 811662 - RNA, 21 nt, Human
uaauaugaggauuacaugagu

SEQ ID NO: 811663 - RNA, 23 nt, Human
uacacugagcagggauggggaug

SEQ ID NO: 811664 - RNA, 21 nt, Human
uacccaccccccacccgugcu

SEQ ID NO: 811665 - RNA, 19 nt, Human
uacuaguggcuaggagacc

SEQ ID NO: 811666 - RNA, 21 nt, Human
uagaaaaauuuuaaacagcca

SEQ ID NO: 811667 - RNA, 22 nt, Human
uagggcagaggucuccaaaccc

SEQ ID NO: 811668 - RNA, 20 nt, Human
uaguggaggcccaccgacuc

SEQ ID NO: 811669 - RNA, 22 nt, Human
uaguguagcuggggagggcagu

SEQ ID NO: 811670 - RNA, 24 nt, Human
uaguguggguggcuucugccccaa

SEQ ID NO: 811671 - RNA, 22 nt, Human
ucacugccuggugacucaucug

SEQ ID NO: 811672 - RNA, 21 nt, Human
ucacuggacccccagccuggu

SEQ ID NO: 811673 - RNA, 20 nt, Human
ucagagcugugguccacggc

SEQ ID NO: 811674 - RNA, 24 nt, Human
ucagccccgagguagggcuggagg

SEQ ID NO: 811675 - RNA, 24 nt, Human
ucaucccaaaaccauccccccaac

SEQ ID NO: 811676 - RNA, 20 nt, Human
ucaucugcacagugaggaau

SEQ ID NO: 811677 - RNA, 24 nt, Human
uccaaacccugggccacggaccag

SEQ ID NO: 811678 - RNA, 19 nt, Human
uccaccugugaugcagggg

SEQ ID NO: 811679 - RNA, 21 nt, Human
uccacgcagccugccccucca

SEQ ID NO: 811680 - RNA, 21 nt, Human
uccaguggggccccaggccug

SEQ ID NO: 811681 - RNA, 18 nt, Human
ucccaaagcccccccaua

SEQ ID NO: 811682 - RNA, 19 nt, Human
ucccagagcuggacuaccu

SEQ ID NO: 811683 - RNA, 24 nt, Human
ucccagccaggcuggcacucccac

SEQ ID NO: 811684 - RNA, 23 nt, Human
ucccaggaagaugcccacucaac

SEQ ID NO: 811685 - RNA, 24 nt, Human
ucccagugggguggggcuggcuuu

SEQ ID NO: 811686 - RNA, 23 nt, Human
uccccaggacagcacacacccgc

SEQ ID NO: 811687 - RNA, 21 nt, Human
uccccgaaaagcagcuggccc

SEQ ID NO: 811688 - RNA, 24 nt, Human
uccccgaaaagcagcuggcccccg

SEQ ID NO: 811689 - RNA, 19 nt, Human
ucccugagcaggugcuggc

SEQ ID NO: 811690 - RNA, 21 nt, Human
ucccugagcaggugcuggcuc

SEQ ID NO: 811691 - RNA, 22 nt, Human
uccuccacgcagccugccccuc

SEQ ID NO: 811692 - RNA, 20 nt, Human
uccugguucccaccccggcu

SEQ ID NO: 811693 - RNA, 22 nt, Human
uccugguucccaccccggcucc

SEQ ID NO: 811694 - RNA, 23 nt, Human
ucuccaaacccugggccacggac

SEQ ID NO: 811695 - RNA, 22 nt, Human
ucuccagugaagauguagaggu

SEQ ID NO: 811696 - RNA, 20 nt, Human
ucuccugguucccaccccgg

SEQ ID NO: 811697 - RNA, 19 nt, Human
ucugcggccuggcacagag

SEQ ID NO: 811698 - RNA, 22 nt, Human
ucuggggccaggcaagcagggc

SEQ ID NO: 811699 - RNA, 18 nt, Human
ucugugcuggacgugcuc

SEQ ID NO: 811700 - RNA, 23 nt, Human
ucugugcuggacgugcucacagg

SEQ ID NO: 811701 - RNA, 21 nt, Human
ugaccuggggacuguggagug

SEQ ID NO: 811702 - RNA, 22 nt, Human
ugagaggugaugaguuggaggc

SEQ ID NO: 811703 - RNA, 18 nt, Human
ugaggccgcacccagagc

SEQ ID NO: 811704 - RNA, 21 nt, Human
ugaguaaaugugcauuaauau

SEQ ID NO: 811705 - RNA, 20 nt, Human
ugccaggcaagaggagcccc

SEQ ID NO: 811706 - RNA, 19 nt, Human
ugccaggggguggggggga

SEQ ID NO: 811707 - RNA, 18 nt, Human
ugcccagagaaguacugg

SEQ ID NO: 811708 - RNA, 20 nt, Human
ugccccaaggccugcccagc

SEQ ID NO: 811709 - RNA, 21 nt, Human
ugccccaaggccugcccagcc

SEQ ID NO: 811710 - RNA, 24 nt, Human
ugcccuaagauaucuaaccucugu

SEQ ID NO: 811711 - RNA, 20 nt, Human
ugccucaguuucccauucug

SEQ ID NO: 811712 - RNA, 21 nt, Human
ugccucaguuucccauucugu

SEQ ID NO: 811713 - RNA, 20 nt, Human
ugcugcggauacccacugag

SEQ ID NO: 811714 - RNA, 19 nt, Human
uggaaaggacagagguggc

SEQ ID NO: 811715 - RNA, 20 nt, Human
uggaaggcaaugcccaggaa

SEQ ID NO: 811716 - RNA, 20 nt, Human
uggacccccagccuggucag

SEQ ID NO: 811717 - RNA, 18 nt, Human
uggagggccagggugaaa

SEQ ID NO: 811718 - RNA, 19 nt, Human
uggcaacaggccugggaca

SEQ ID NO: 811719 - RNA, 18 nt, Human
uggcacagcaucaccccc

SEQ ID NO: 811720 - RNA, 24 nt, Human
uggcacagcaucacccccucccaa

SEQ ID NO: 811721 - RNA, 19 nt, Human
uggcauagcccugggugaa

SEQ ID NO: 811722 - RNA, 19 nt, Human
uggggaccacugaccuggg

SEQ ID NO: 811723 - RNA, 20 nt, Human
uggggaggaagagcgccugg

SEQ ID NO: 811724 - RNA, 23 nt, Human
uggggaggaagagcgccuggccu

SEQ ID NO: 811725 - RNA, 21 nt, Human
uggggagggcagugguuaggg

SEQ ID NO: 811726 - RNA, 18 nt, Human
uggggccaggcaagcagg

SEQ ID NO: 811727 - RNA, 23 nt, Human
ugguauguuaaacuuucagagca

SEQ ID NO: 811728 - RNA, 20 nt, Human
ugguucccaccccggcuccc

SEQ ID NO: 811729 - RNA, 19 nt, Human
uuacccaccccccacccgu

SEQ ID NO: 811730 - RNA, 24 nt, Human
uucccaccugagcucugccuccug

SEQ ID NO: 811731 - RNA, 18 nt, Human
uugugcuggaagcugggg

SEQ ID NO: 811732 - RNA, 18 nt, Human
uuucugcugcagcccagg

SEQ ID NO: 811733 - RNA, 21 nt, Human
aaaaaccagacggcaaguucc

SEQ ID NO: 811734 - RNA, 21 nt, Human
aaaaagcaccuucagagagcu

SEQ ID NO: 811735 - RNA, 21 nt, Human
aaaagcaucacaaaucuacaa

SEQ ID NO: 811736 - RNA, 26 nt, Human
aaaagccauuuccagaaauguuuguc

SEQ ID NO: 811737 - RNA, 20 nt, Human
aaacauagcuauagagguac

SEQ ID NO: 811738 - RNA, 18 nt, Human
aaagcuacguaucaaccu

SEQ ID NO: 811739 - RNA, 20 nt, Human
aaaguaucuuucaccucccu

SEQ ID NO: 811740 - RNA, 22 nt, Human
aaccacagcuaauccagcaacc

SEQ ID NO: 811741 - RNA, 20 nt, Human
aaccucaggacuaaugauau

SEQ ID NO: 811742 - RNA, 24 nt, Human
aacgacagauacaacucucaagaa

SEQ ID NO: 811743 - RNA, 18 nt, Human
aagaaaaggaacuaaagc

SEQ ID NO: 811744 - RNA, 20 nt, Human
aagaagaaaagcaucacaaa

SEQ ID NO: 811745 - RNA, 18 nt, Human
aagucugagaaaaaccag

SEQ ID NO: 811746 - RNA, 21 nt, Human
aagugacccauuuuagaaaau

SEQ ID NO: 811747 - RNA, 19 nt, Human
aaugacugaaagaaaagga

SEQ ID NO: 811748 - RNA, 24 nt, Human
aauucuuuacugaguguggggggg

SEQ ID NO: 811749 - RNA, 21 nt, Human
acaaaaaccagggauaauucu

SEQ ID NO: 811750 - RNA, 21 nt, Human
acaagaaaccacagcuaaucc

SEQ ID NO: 811751 - RNA, 24 nt, Human
acacugacauuagacaagaaacca

SEQ ID NO: 811752 - RNA, 21 nt, Human
acagagaacagccauuuucua

SEQ ID NO: 811753 - RNA, 24 nt, Human
acuaagacaaugacugaaagaaaa

SEQ ID NO: 811754 - RNA, 25 nt, Human
acuacaaguaccauuuuuauacugg

SEQ ID NO: 811755 - RNA, 20 nt, Human
acugaaagaaaaggaacuaa

SEQ ID NO: 811756 - RNA, 21 nt, Human
agaagucugagaaaaaccaga

SEQ ID NO: 811757 - RNA, 20 nt, Human
agacaagaaaccacagcuaa

SEQ ID NO: 811758 - RNA, 23 nt, Human
agacaaugacugaaagaaaagga

SEQ ID NO: 811759 - RNA, 20 nt, Human
agacggcaaguuccggauca

SEQ ID NO: 811760 - RNA, 22 nt, Human
agacugggcucccggaaggcca

SEQ ID NO: 811761 - RNA, 18 nt, Human
agggcacccacuggucac

SEQ ID NO: 811762 - RNA, 22 nt, Human
aguguggggggguguugaggag

SEQ ID NO: 811763 - RNA, 23 nt, Human
auccuugugaagaugauguacug

SEQ ID NO: 811764 - RNA, 22 nt, Human
aucuuucaccucccucccgcug

SEQ ID NO: 811765 - RNA, 25 nt, Human
caaaugucaacacacaguuuccagu

SEQ ID NO: 811766 - RNA, 22 nt, Human
caacaugucuccagacaucacc

SEQ ID NO: 811767 - RNA, 20 nt, Human
caaccuuuuccccaccccag

SEQ ID NO: 811768 - RNA, 19 nt, Human
caccuacccccuacuccca

SEQ ID NO: 811769 - RNA, 18 nt, Human
caccucccucccgcugcc

SEQ ID NO: 811770 - RNA, 21 nt, Human
caccugcgaccccggcggcac

SEQ ID NO: 811771 - RNA, 20 nt, Human
caccuucagagagcugaagg

SEQ ID NO: 811772 - RNA, 21 nt, Human
cagagagcugaaggaaaauca

SEQ ID NO: 811773 - RNA, 19 nt, Human
cagcugcagucucuaaaac

SEQ ID NO: 811774 - RNA, 19 nt, Human
caggguuucucaaccucag

SEQ ID NO: 811775 - RNA, 19 nt, Human
ccaauccauaauacauacc

SEQ ID NO: 811776 - RNA, 19 nt, Human
cccacauaaauaucugagg

SEQ ID NO: 811777 - RNA, 21 nt, Human
cccauccucaaaugucaacac

SEQ ID NO: 811778 - RNA, 22 nt, Human
ccccaccuacccccuacuccca

SEQ ID NO: 811779 - RNA, 19 nt, Human
cccccuacucccaaauggc

SEQ ID NO: 811780 - RNA, 18 nt, Human
cccgacugagugcccaga

SEQ ID NO: 811781 - RNA, 21 nt, Human
cccuccgggacccuacccacu

SEQ ID NO: 811782 - RNA, 18 nt, Human
ccgccgcuucccuggccg

SEQ ID NO: 811783 - RNA, 20 nt, Human
ccgccgcuucccuggccgcc

SEQ ID NO: 811784 - RNA, 19 nt, Human
ccgcucaccugcgaccccg

SEQ ID NO: 811785 - RNA, 21 nt, Human
ccgcucaccugcgaccccggc

SEQ ID NO: 811786 - RNA, 22 nt, Human
ccuccagcauagaaccgcucac

SEQ ID NO: 811787 - RNA, 24 nt, Human
ccucccgcugccuccuuugggacc

SEQ ID NO: 811788 - RNA, 20 nt, Human
ccuccgggacccuacccacu

SEQ ID NO: 811789 - RNA, 25 nt, Human
ccuccgggacccuacccacugcgag

SEQ ID NO: 811790 - RNA, 21 nt, Human
ccugggcccuccccagccucc

SEQ ID NO: 811791 - RNA, 26 nt, Human
cguaucaaccuugaaaaucagaaaac

SEQ ID NO: 811792 - RNA, 21 nt, Human
cguccaaaaagagccccuggg

SEQ ID NO: 811793 - RNA, 21 nt, Human
cguggccugggcccuccccag

SEQ ID NO: 811794 - RNA, 25 nt, Human
cuaauccagcaaccaucauuauauc

SEQ ID NO: 811795 - RNA, 18 nt, Human
cucaccugcgaccccggc

SEQ ID NO: 811796 - RNA, 23 nt, Human
cuccaauccauaauacauaccua

SEQ ID NO: 811797 - RNA, 21 nt, Human
cuccgggacccuacccacugc

SEQ ID NO: 811798 - RNA, 19 nt, Human
cucuaaaacucgugguagg

SEQ ID NO: 811799 - RNA, 22 nt, Human
cugccaauggcauaauauaacc

SEQ ID NO: 811800 - RNA, 21 nt, Human
cuucacauucagaaauaacga

SEQ ID NO: 811801 - RNA, 22 nt, Human
cuucaucacuuccuauauucaa

SEQ ID NO: 811802 - RNA, 19 nt, Human
cuuggauuguggaaaaagc

SEQ ID NO: 811803 - RNA, 22 nt, Human
cuugugaagaugauguacugcc

SEQ ID NO: 811804 - RNA, 20 nt, Human
cuuuaaaauugcgucuugcu

SEQ ID NO: 811805 - RNA, 18 nt, Human
cuuuguuccucagggaag

SEQ ID NO: 811806 - RNA, 20 nt, Human
gaaaaagaauucuuuucaaa

SEQ ID NO: 811807 - RNA, 20 nt, Human
gaaaaggaacuaaagcuuua

SEQ ID NO: 811808 - RNA, 19 nt, Human
gaaaauucuuuacugagug

SEQ ID NO: 811809 - RNA, 19 nt, Human
gaaggcuauuuauagaugg

SEQ ID NO: 811810 - RNA, 24 nt, Human
gaaugcugcaaagcacaaaaacca

SEQ ID NO: 811811 - RNA, 20 nt, Human
gaccccggcggcaccucccc

SEQ ID NO: 811812 - RNA, 22 nt, Human
gaugugaaaacaauuugaggaa

SEQ ID NO: 811813 - RNA, 19 nt, Human
gcaaagcacaaaaaccagg

SEQ ID NO: 811814 - RNA, 22 nt, Human
gcaaagcacaaaaaccagggau

SEQ ID NO: 811815 - RNA, 22 nt, Human
ggccugggcccuccccagccuc

SEQ ID NO: 811816 - RNA, 21 nt, Human
guggccugggcccuccccagc

SEQ ID NO: 811817 - RNA, 18 nt, Human
guggcuuuccccuccccu

SEQ ID NO: 811818 - RNA, 20 nt, Human
uaaaacuauaaaacauagcu

SEQ ID NO: 811819 - RNA, 27 nt, Human
uaaaaugugaaaauaugucauuuuaga

SEQ ID NO: 811820 - RNA, 18 nt, Human
uaaagcauuaauagugag

SEQ ID NO: 811821 - RNA, 21 nt, Human
uacacagacaauacaagacuc

SEQ ID NO: 811822 - RNA, 24 nt, Human
uacacaguaacauuucauaguuaa

SEQ ID NO: 811823 - RNA, 21 nt, Human
uacacaguuaggcuaggacag

SEQ ID NO: 811824 - RNA, 22 nt, Human
uacccaaacuaagacaaugacu

SEQ ID NO: 811825 - RNA, 18 nt, Human
uacucugugucacuucuc

SEQ ID NO: 811826 - RNA, 19 nt, Human
uacucugugucacuucucu

SEQ ID NO: 811827 - RNA, 21 nt, Human
uagacugggcucccggaaggc

SEQ ID NO: 811828 - RNA, 20 nt, Human
uaguguaauaagugcuucuc

SEQ ID NO: 811829 - RNA, 19 nt, Human
uauaaaacauagcuauaga

SEQ ID NO: 811830 - RNA, 18 nt, Human
uauacuacacaguaacau

SEQ ID NO: 811831 - RNA, 25 nt, Human
uauacugguaucauuuuuacuagcu

SEQ ID NO: 811832 - RNA, 24 nt, Human
uauagagguacacaguuaggcuag

SEQ ID NO: 811833 - RNA, 25 nt, Human
uauaucaccugauaugagaaaaauc

SEQ ID NO: 811834 - RNA, 22 nt, Human
uauucacuuauaagauuucagu

SEQ ID NO: 811835 - RNA, 23 nt, Human
uauuuauagauggaaacauggga

SEQ ID NO: 811836 - RNA, 19 nt, Human
ucaagaagaaaagcaucac

SEQ ID NO: 811837 - RNA, 19 nt, Human
ucaccaaauuggucuucug

SEQ ID NO: 811838 - RNA, 20 nt, Human
ucacggagccgccgcuuccc

SEQ ID NO: 811839 - RNA, 20 nt, Human
ucacuuggauuguggaaaaa

SEQ ID NO: 811840 - RNA, 18 nt, Human
ucauuggguucaagcuca

SEQ ID NO: 811841 - RNA, 18 nt, Human
uccagaaauguuuguccu

SEQ ID NO: 811842 - RNA, 19 nt, Human
uccagaaauguuugucuuc

SEQ ID NO: 811843 - RNA, 22 nt, Human
uccccagccuccccggucaggc

SEQ ID NO: 811844 - RNA, 19 nt, Human
ucccgacugagugcccaga

SEQ ID NO: 811845 - RNA, 24 nt, Human
ucccgcuacgucgcagcccuugga

SEQ ID NO: 811846 - RNA, 18 nt, Human
ucccucccgcugccuccu

SEQ ID NO: 811847 - RNA, 31 nt, Human
ucccugccaaaaaguauguucuucucuaaaa

SEQ ID NO: 811848 - RNA, 20 nt, Human
uccucaaaaaauacuuacug

SEQ ID NO: 811849 - RNA, 23 nt, Human
ucuacaauaucaaacccuaccca

SEQ ID NO: 811850 - RNA, 19 nt, Human
ucuaugcccaaucacagag

SEQ ID NO: 811851 - RNA, 24 nt, Human
ucucucuggguauuaaaugagagu

SEQ ID NO: 811852 - RNA, 18 nt, Human
ucuuuacugagugugggg

SEQ ID NO: 811853 - RNA, 22 nt, Human
ugacauuagacaagaaaccaca

SEQ ID NO: 811854 - RNA, 21 nt, Human
ugacugaaagaaaaggaacua

SEQ ID NO: 811855 - RNA, 20 nt, Human
ugagaaggcuauuuauagau

SEQ ID NO: 811856 - RNA, 23 nt, Human
ugagcuucacauucagaaauaac

SEQ ID NO: 811857 - RNA, 25 nt, Human
ugaggaaugcugcaaagcacaaaaa

SEQ ID NO: 811858 - RNA, 18 nt, Human
ugaugagguugcugcugg

SEQ ID NO: 811859 - RNA, 25 nt, Human
ugcaaagcacaaaaaccagggauaa

SEQ ID NO: 811860 - RNA, 19 nt, Human
ugcccagaaacuucugcag

SEQ ID NO: 811861 - RNA, 23 nt, Human
ugccgcugaccccuccgggaccc

SEQ ID NO: 811862 - RNA, 20 nt, Human
ugcugguaggagucccggug

SEQ ID NO: 811863 - RNA, 21 nt, Human
uggaaaaagcaccuucagaga

SEQ ID NO: 811864 - RNA, 25 nt, Human
uggcauaauauaaccaggcaacuuu

SEQ ID NO: 811865 - RNA, 22 nt, Human
ugggaagaaucgaguuagacug

SEQ ID NO: 811866 - RNA, 21 nt, Human
ugggaauaaaauaccuauaau

SEQ ID NO: 811867 - RNA, 19 nt, Human
ugggaccguccaaaaagag

SEQ ID NO: 811868 - RNA, 19 nt, Human
uggggggguguugaggagg

SEQ ID NO: 811869 - RNA, 19 nt, Human
uggguacacagacaauaca

SEQ ID NO: 811870 - RNA, 19 nt, Human
uguuugucuuccuguccuc

SEQ ID NO: 811871 - RNA, 20 nt, Human
uuaaagcuacguaucaaccu

SEQ ID NO: 811872 - RNA, 20 nt, Human
uuaaaguaauaacugucaac

SEQ ID NO: 811873 - RNA, 21 nt, Human
uuacaaaccuucuaugcccaa

SEQ ID NO: 811874 - RNA, 22 nt, Human
uuacuagcuucaacuauucacu

SEQ ID NO: 811875 - RNA, 23 nt, Human
uuacugaaaugacauuuuuguac

SEQ ID NO: 811876 - RNA, 23 nt, Human
uucaacaucauuauuauuugaua

SEQ ID NO: 811877 - RNA, 23 nt, Human
uucaauauacuacacaguaacau

SEQ ID NO: 811878 - RNA, 19 nt, Human
uucacuucccugccaaaaa

SEQ ID NO: 811879 - RNA, 24 nt, Human
uucaugauaagucagaauuaagaa

SEQ ID NO: 811880 - RNA, 24 nt, Human
uuccccaccuacccccuacuccca

SEQ ID NO: 811881 - RNA, 21 nt, Human
uuccuagauacuucaugauaa

SEQ ID NO: 811882 - RNA, 25 nt, Human
uucucugagcuucacauucagaaau

SEQ ID NO: 811883 - RNA, 20 nt, Human
uucucuguauuguuuucugg

SEQ ID NO: 811884 - RNA, 19 nt, Human
uugaaaaucagaaaacaca

SEQ ID NO: 811885 - RNA, 19 nt, Human
uuggaccaaacccggcagc

SEQ ID NO: 811886 - RNA, 24 nt, Human
uuuccagaaauguuugucuuccug

SEQ ID NO: 811887 - RNA, 22 nt, Human
uuuuccuugcauacccauccuc

SEQ ID NO: 811888 - RNA, 19 nt, Human
aaaagggaaagggauuuug

SEQ ID NO: 811889 - RNA, 20 nt, Human
aaagccccccauuggcccuc

SEQ ID NO: 811890 - RNA, 19 nt, Human
acagacaaggaggaagagg

SEQ ID NO: 811891 - RNA, 20 nt, Human
acagcggagggucccgaggg

SEQ ID NO: 811892 - RNA, 18 nt, Human
accaggggaagccaggac

SEQ ID NO: 811893 - RNA, 18 nt, Human
agagggagggagggaaag

SEQ ID NO: 811894 - RNA, 19 nt, Human
agaggugugcaggggcccu

SEQ ID NO: 811895 - RNA, 23 nt, Human
aggaagagggagggagggaaagc

SEQ ID NO: 811896 - RNA, 27 nt, Human
aggacuggagaccacaggacagaaacc

SEQ ID NO: 811897 - RNA, 18 nt, Human
aggaggaagagggaggga

SEQ ID NO: 811898 - RNA, 23 nt, Human
aggaggaagagggagggagggaa

SEQ ID NO: 811899 - RNA, 21 nt, Human
aguccagagcagcccccagca

SEQ ID NO: 811900 - RNA, 25 nt, Human
auaugcacauguguuugugugugug

SEQ ID NO: 811901 - RNA, 26 nt, Human
auggagacgagaaaaagggaaaggga

SEQ ID NO: 811902 - RNA, 24 nt, Human
auguguuugugugugugugugugg

SEQ ID NO: 811903 - RNA, 21 nt, Human
cacacgacagcggaggguccc

SEQ ID NO: 811904 - RNA, 19 nt, Human
cacauugaacacugggaaa

SEQ ID NO: 811905 - RNA, 18 nt, Human
cagcagggcaucucgggc

SEQ ID NO: 811906 - RNA, 21 nt, Human
cagccauccccaaaguccaga

SEQ ID NO: 811907 - RNA, 24 nt, Human
cagcccccuccugcgaucucggcc

SEQ ID NO: 811908 - RNA, 31 nt, Human
cagcccccuccugcgaucucggcccugcccc

SEQ ID NO: 811909 - RNA, 23 nt, Human
caguggguccuuugauggaaucc

SEQ ID NO: 811910 - RNA, 20 nt, Human
cauccccaaaguccagagca

SEQ ID NO: 811911 - RNA, 23 nt, Human
cauguguuugugugugugugugu

SEQ ID NO: 811912 - RNA, 18 nt, Human
ccagagcagcccccagca

SEQ ID NO: 811913 - RNA, 21 nt, Human
ccagagcgagaaugcugggga

SEQ ID NO: 811914 - RNA, 21 nt, Human
ccaggacuggagaccacagga

SEQ ID NO: 811915 - RNA, 20 nt, Human
ccagucccagcgguggcugg

SEQ ID NO: 811916 - RNA, 20 nt, Human
ccauccccaaaguccagagc

SEQ ID NO: 811917 - RNA, 23 nt, Human
cccaggacuggagaccacaggac

SEQ ID NO: 811918 - RNA, 20 nt, Human
ccccaaaguccagagcagcc

SEQ ID NO: 811919 - RNA, 23 nt, Human
ccccaaaguccagagcagccccc

SEQ ID NO: 811920 - RNA, 20 nt, Human
ccccauuggcccucugaggc

SEQ ID NO: 811921 - RNA, 19 nt, Human
cccccagcaucuguggugc

SEQ ID NO: 811922 - RNA, 22 nt, Human
ccccggaguagaacgcaagaca

SEQ ID NO: 811923 - RNA, 23 nt, Human
ccgugaaagccccccauuggccc

SEQ ID NO: 811924 - RNA, 19 nt, Human
ccucccaccuagggacggg

SEQ ID NO: 811925 - RNA, 18 nt, Human
ccugccgccgccaccccc

SEQ ID NO: 811926 - RNA, 21 nt, Human
ccugccgccgccacccccgga

SEQ ID NO: 811927 - RNA, 20 nt, Human
ccuugggcccgugaaagccc

SEQ ID NO: 811928 - RNA, 21 nt, Human
ccuugggcccgugaaagcccc

SEQ ID NO: 811929 - RNA, 24 nt, Human
cgugggcagcagggcaucucgggc

SEQ ID NO: 811930 - RNA, 21 nt, Human
cucagcccugcagggcugggg

SEQ ID NO: 811931 - RNA, 22 nt, Human
cucccucccaccuagggacggg

SEQ ID NO: 811932 - RNA, 18 nt, Human
cugccucuagggugcccc

SEQ ID NO: 811933 - RNA, 26 nt, Human
cugccucuagggugccccaggacugg

SEQ ID NO: 811934 - RNA, 20 nt, Human
cugugcacaguuucacaccc

SEQ ID NO: 811935 - RNA, 21 nt, Human
gacagccauccccaaagucca

SEQ ID NO: 811936 - RNA, 25 nt, Human
gacagccauccccaaaguccagagc

SEQ ID NO: 811937 - RNA, 21 nt, Human
gacgagaaaaagggaaaggga

SEQ ID NO: 811938 - RNA, 19 nt, Human
gcagggccaugcugggguc

SEQ ID NO: 811939 - RNA, 20 nt, Human
gcccggagcguuuccccgcu

SEQ ID NO: 811940 - RNA, 21 nt, Human
ggaugaccgugugcgggacca

SEQ ID NO: 811941 - RNA, 21 nt, Human
ggcaggggugugaucacaagg

SEQ ID NO: 811942 - RNA, 21 nt, Human
ggcaggggugugaucacaagg

SEQ ID NO: 811943 - RNA, 21 nt, Human
ggcaggggugugaucacaagg

SEQ ID NO: 811944 - RNA, 22 nt, Human
gggagugggcguggcccggagc

SEQ ID NO: 811945 - RNA, 22 nt, Human
gggcagcagggcaucucgggca

SEQ ID NO: 811946 - RNA, 21 nt, Human
guggacgguucugcaccuaca

SEQ ID NO: 811947 - RNA, 21 nt, Human
uacccagauguucauggagac

SEQ ID NO: 811948 - RNA, 19 nt, Human
uacuggaguggaauccagu

SEQ ID NO: 811949 - RNA, 20 nt, Human
uaugcacauguguuugugug

SEQ ID NO: 811950 - RNA, 20 nt, Human
ucacaaggaaggggcagggg

SEQ ID NO: 811951 - RNA, 20 nt, Human
ucacaaggaaggggcagggg

SEQ ID NO: 811952 - RNA, 20 nt, Human
ucacaaggaaggggcagggg

SEQ ID NO: 811953 - RNA, 20 nt, Human
ucacaaggaaggggcagggg

SEQ ID NO: 811954 - RNA, 21 nt, Human
ucagcccugcagggcuggggc

SEQ ID NO: 811955 - RNA, 22 nt, Human
uccccgcugaggucuuucacaa

SEQ ID NO: 811956 - RNA, 18 nt, Human
uccccugcucugccucua

SEQ ID NO: 811957 - RNA, 23 nt, Human
ucucccgucugucagccccuuuu

SEQ ID NO: 811958 - RNA, 24 nt, Human
ucugcaccuacagugcguacacag

SEQ ID NO: 811959 - RNA, 19 nt, Human
ucuggacucccucccaccu

SEQ ID NO: 811960 - RNA, 20 nt, Human
ugaagcugcagggguggcuc

SEQ ID NO: 811961 - RNA, 23 nt, Human
ugcacauguguuugugugugugu

SEQ ID NO: 811962 - RNA, 25 nt, Human
ugcccagagcgagaaugcuggggac

SEQ ID NO: 811963 - RNA, 20 nt, Human
ugcguacacagcacagcgug

SEQ ID NO: 811964 - RNA, 21 nt, Human
ugcguacacagcacagcgugg

SEQ ID NO: 811965 - RNA, 19 nt, Human
uggaauccccugcucugcc

SEQ ID NO: 811966 - RNA, 18 nt, Human
uggaguggaauccagucu

SEQ ID NO: 811967 - RNA, 22 nt, Human
uggcucagacacacgacagcgg

SEQ ID NO: 811968 - RNA, 18 nt, Human
ugggaaaggucagggcag

SEQ ID NO: 811969 - RNA, 21 nt, Human
ugggcagaggugugcaggggc

SEQ ID NO: 811970 - RNA, 19 nt, Human
ugggcauuuucccaagccu

SEQ ID NO: 811971 - RNA, 22 nt, Human
ugggcauuuucccaagccuugg

SEQ ID NO: 811972 - RNA, 21 nt, Human
uggguccuuugauggaauccc

SEQ ID NO: 811973 - RNA, 24 nt, Human
ugggugcacaugugucacagacaa

SEQ ID NO: 811974 - RNA, 19 nt, Human
ugugaucacaaggaagggg

SEQ ID NO: 811975 - RNA, 19 nt, Human
ugugaucacaaggaagggg

SEQ ID NO: 811976 - RNA, 19 nt, Human
ugugaucacaaggaagggg

SEQ ID NO: 811977 - RNA, 20 nt, Human
ugugcacaguuucacaccca

SEQ ID NO: 811978 - RNA, 22 nt, Human
ugugcaggggcccugugaagcu

SEQ ID NO: 811979 - RNA, 19 nt, Human
ugugugauaugcacaugug

SEQ ID NO: 811980 - RNA, 18 nt, Human
ugugugggugcacaugug

SEQ ID NO: 811981 - RNA, 19 nt, Human
ugugugugugggugcacau

SEQ ID NO: 811982 - RNA, 21 nt, Human
ugugugugugggugcacaugu

SEQ ID NO: 811983 - RNA, 23 nt, Human
ugugugugugugugggugcacau

SEQ ID NO: 811984 - RNA, 19 nt, Human
ugugugugugugugugggu

SEQ ID NO: 811985 - RNA, 20 nt, Human
ugugugugugugugugggug

SEQ ID NO: 811986 - RNA, 20 nt, Human
uguugcuaagugccuauacu

SEQ ID NO: 811987 - RNA, 21 nt, Human
uugugugugugugugugggug

SEQ ID NO: 811988 - RNA, 24 nt, Human
aaaaauaaauauccuuauaccucc

SEQ ID NO: 811989 - RNA, 28 nt, Human
aaaaauauaauccaaauuaagcaaaaaa

SEQ ID NO: 811990 - RNA, 22 nt, Human
aaagaaguuauccauacacuuc

SEQ ID NO: 811991 - RNA, 19 nt, Human
aaagugcucggauuacagg

SEQ ID NO: 811992 - RNA, 24 nt, Human
aaagugcucggauuacaggcguga

SEQ ID NO: 811993 - RNA, 25 nt, Human
aaaucacuucaggccaagaguugga

SEQ ID NO: 811994 - RNA, 19 nt, Human
aacagagugagacccuguc

SEQ ID NO: 811995 - RNA, 21 nt, Human
aacagagugagacccugucuc

SEQ ID NO: 811996 - RNA, 24 nt, Human
aacagagugagacccugucucaaa

SEQ ID NO: 811997 - RNA, 20 nt, Human
aaccuccacuucccagguuc

SEQ ID NO: 811998 - RNA, 20 nt, Human
aacucgcgaaaccccaucuc

SEQ ID NO: 811999 - RNA, 24 nt, Human
aagcaaaaaaaggaaauuuauugg

SEQ ID NO: 812000 - RNA, 20 nt, Human
aagcacgcaccaccacaccc

SEQ ID NO: 812001 - RNA, 18 nt, Human
aaucacuucaggccaaga

SEQ ID NO: 812002 - RNA, 22 nt, Human
aaucccuuaucacuagguuggg

SEQ ID NO: 812003 - RNA, 22 nt, Human
acacacacauaaacagaaaucu

SEQ ID NO: 812004 - RNA, 21 nt, Human
acaccacugcacuccagccug

SEQ ID NO: 812005 - RNA, 24 nt, Human
acaccacugcacuccagccugggc

SEQ ID NO: 812006 - RNA, 23 nt, Human
acagagcgagacucugucugaaa

SEQ ID NO: 812007 - RNA, 24 nt, Human
acagagugagacccugucucaaaa

SEQ ID NO: 812008 - RNA, 30 nt, Human
acagauguggccaggcgcgguggcucacgg

SEQ ID NO: 812009 - RNA, 24 nt, Human
accaauguggugaaaccccgucuc

SEQ ID NO: 812010 - RNA, 22 nt, Human
accacugcacuccagccugggc

SEQ ID NO: 812011 - RNA, 24 nt, Human
acccaggaggcagaggcugcagug

SEQ ID NO: 812012 - RNA, 24 nt, Human
accccgucucuacuaaaaauacaa

SEQ ID NO: 812013 - RNA, 24 nt, Human
accgcauuccagccuggauaacag

SEQ ID NO: 812014 - RNA, 26 nt, Human
accgcauuccagccuggauaacagag

SEQ ID NO: 812015 - RNA, 24 nt, Human
accucggccucccaaagugcucgg

SEQ ID NO: 812016 - RNA, 23 nt, Human
accuguagucccagcuacucagg

SEQ ID NO: 812017 - RNA, 20 nt, Human
acgggguuucuccauguugg

SEQ ID NO: 812018 - RNA, 21 nt, Human
acgggguuucuccauguuggu

SEQ ID NO: 812019 - RNA, 24 nt, Human
acgggguuucuccauguuggucag

SEQ ID NO: 812020 - RNA, 18 nt, Human
acuaaccaaaaagaacuc

SEQ ID NO: 812021 - RNA, 24 nt, Human
acuaagaaacacuaaaauaguuuu

SEQ ID NO: 812022 - RNA, 24 nt, Human
acugcacuccagccugggcaacag

SEQ ID NO: 812023 - RNA, 24 nt, Human
acugcacuccagccugggcaacag

SEQ ID NO: 812024 - RNA, 22 nt, Human
agaaaaacgcgaaacuuagcca

SEQ ID NO: 812025 - RNA, 19 nt, Human
agagccauucauuaaacaa

SEQ ID NO: 812026 - RNA, 20 nt, Human
agaggcugcagugagccaag

SEQ ID NO: 812027 - RNA, 22 nt, Human
agaguuggagaccagccugggc

SEQ ID NO: 812028 - RNA, 19 nt, Human
agcaauaucuuuguuugau

SEQ ID NO: 812029 - RNA, 20 nt, Human
agcacuuugggagucugagg

SEQ ID NO: 812030 - RNA, 20 nt, Human
agccaccgcacugggucuua

SEQ ID NO: 812031 - RNA, 24 nt, Human
agccugaccaauguggugaaaccc

SEQ ID NO: 812032 - RNA, 24 nt, Human
agccugggcaacagagcgagacuc

SEQ ID NO: 812033 - RNA, 19 nt, Human
agccugggcaacucgcgaa

SEQ ID NO: 812034 - RNA, 23 nt, Human
agccugggcaacucgcgaaaccc

SEQ ID NO: 812035 - RNA, 24 nt, Human
agcuacucaggaggcugagguggg

SEQ ID NO: 812036 - RNA, 21 nt, Human
agcugggauuacaagcacgca

SEQ ID NO: 812037 - RNA, 21 nt, Human
aggaggcagaggcugcaguga

SEQ ID NO: 812038 - RNA, 21 nt, Human
aggaggcugaggugggagggu

SEQ ID NO: 812039 - RNA, 19 nt, Human
aggcaaaaauauaauccaa

SEQ ID NO: 812040 - RNA, 24 nt, Human
aggcagaggcugcagugagccaag

SEQ ID NO: 812041 - RNA, 23 nt, Human
aggcaggaggauugcuugaaccc

SEQ ID NO: 812042 - RNA, 26 nt, Human
aggccaagaguuggagaccagccugg

SEQ ID NO: 812043 - RNA, 24 nt, Human
aggcgcgguggcucacgcccauaa

SEQ ID NO: 812044 - RNA, 21 nt, Human
aggcugaggcaggaggauugc

SEQ ID NO: 812045 - RNA, 24 nt, Human
aggcugaggcaggaggauugcuug

SEQ ID NO: 812046 - RNA, 24 nt, Human
aggcugaggugggagggucgcuug

SEQ ID NO: 812047 - RNA, 24 nt, Human
agguaugguggcaggcaccuguaa

SEQ ID NO: 812048 - RNA, 24 nt, Human
aggugaucugcccaccucggccuc

SEQ ID NO: 812049 - RNA, 24 nt, Human
aggugggagggucgcuugagccug

SEQ ID NO: 812050 - RNA, 21 nt, Human
agguucaagugauucuccugc

SEQ ID NO: 812051 - RNA, 22 nt, Human
agguucaagugauucuccugcc

SEQ ID NO: 812052 - RNA, 23 nt, Human
agguucaagugauucuccugccu

SEQ ID NO: 812053 - RNA, 19 nt, Human
agguugggggaaauaauug

SEQ ID NO: 812054 - RNA, 22 nt, Human
aguagagacgggguuucuccau

SEQ ID NO: 812055 - RNA, 19 nt, Human
aguagcugggauuacaagc

SEQ ID NO: 812056 - RNA, 24 nt, Human
agugacucaucccuauaaucucag

SEQ ID NO: 812057 - RNA, 24 nt, Human
aucaccuaaagucaggaguucgag

SEQ ID NO: 812058 - RNA, 19 nt, Human
auugcuugaacccaggagg

SEQ ID NO: 812059 - RNA, 24 nt, Human
auugugucaccgcauuccagccug

SEQ ID NO: 812060 - RNA, 18 nt, Human
auuucugucucucaucuc

SEQ ID NO: 812061 - RNA, 19 nt, Human
caaaggacuucauugaucc

SEQ ID NO: 812062 - RNA, 24 nt, Human
caaagugcucggauuacaggcgug

SEQ ID NO: 812063 - RNA, 21 nt, Human
caacauuacaagugaaguuua

SEQ ID NO: 812064 - RNA, 21 nt, Human
caagcacgcaccaccacaccc

SEQ ID NO: 812065 - RNA, 20 nt, Human
caagugauucuccugccuca

SEQ ID NO: 812066 - RNA, 24 nt, Human
caauguggugaaaccccgucucua

SEQ ID NO: 812067 - RNA, 19 nt, Human
cacaccuguagucccagcu

SEQ ID NO: 812068 - RNA, 18 nt, Human
caccgcauuccagccugg

SEQ ID NO: 812069 - RNA, 19 nt, Human
caccgcauuccagccugga

SEQ ID NO: 812070 - RNA, 19 nt, Human
caccgcauuccagccugga

SEQ ID NO: 812071 - RNA, 20 nt, Human
caccgcauuccagccuggau

SEQ ID NO: 812072 - RNA, 24 nt, Human
caccgcauuccagccuggauaaca

SEQ ID NO: 812073 - RNA, 23 nt, Human
caccuaaagucaggaguucgaga

SEQ ID NO: 812074 - RNA, 21 nt, Human
caccuguaaucccagcuacuc

SEQ ID NO: 812075 - RNA, 24 nt, Human
caccuguaaucccagcuacucagg

SEQ ID NO: 812076 - RNA, 24 nt, Human
caccuguagucccagcuacucagg

SEQ ID NO: 812077 - RNA, 23 nt, Human
cacgcaccaccacacccggcuaa

SEQ ID NO: 812078 - RNA, 24 nt, Human
cacgcccauaaucccagcacuuug

SEQ ID NO: 812079 - RNA, 23 nt, Human
cacuccagccugggcaacagagc

SEQ ID NO: 812080 - RNA, 24 nt, Human
cacuccagccugggcaacagagcg

SEQ ID NO: 812081 - RNA, 19 nt, Human
cacucuaugcacacauaua

SEQ ID NO: 812082 - RNA, 19 nt, Human
cacucuaugcacacauaua

SEQ ID NO: 812083 - RNA, 18 nt, Human
cacugcacuccagccugg

SEQ ID NO: 812084 - RNA, 19 nt, Human
cacugcacuccagccuggg

SEQ ID NO: 812085 - RNA, 21 nt, Human
cacugcacuccagccugggca

SEQ ID NO: 812086 - RNA, 23 nt, Human
cacugcacuccagccugggcaac

SEQ ID NO: 812087 - RNA, 24 nt, Human
cacugcacuccagccugggcaaca

SEQ ID NO: 812088 - RNA, 25 nt, Human
cacugcacuccagccugggcaacaa

SEQ ID NO: 812089 - RNA, 18 nt, Human
cagauuguaaaauacacu

SEQ ID NO: 812090 - RNA, 18 nt, Human
cagcacuuugggaagccg

SEQ ID NO: 812091 - RNA, 20 nt, Human
cagcacuuugggaagccgag

SEQ ID NO: 812092 - RNA, 18 nt, Human
cagcacuuugggagucug

SEQ ID NO: 812093 - RNA, 20 nt, Human
cagcacuuugggagucugag

SEQ ID NO: 812094 - RNA, 24 nt, Human
cagccauaaugugaaaaaaacuaa

SEQ ID NO: 812095 - RNA, 20 nt, Human
cagccuggauaacagaguga

SEQ ID NO: 812096 - RNA, 24 nt, Human
cagcuacucaggaggcugaggcag

SEQ ID NO: 812097 - RNA, 24 nt, Human
cagcuacucaggaggcugaggugg

SEQ ID NO: 812098 - RNA, 24 nt, Human
caucccuauaaucucagcacuuug

SEQ ID NO: 812099 - RNA, 22 nt, Human
cauuccagccuggauaacagag

SEQ ID NO: 812100 - RNA, 24 nt, Human
cauuccagccuggauaacagagug

SEQ ID NO: 812101 - RNA, 22 nt, Human
ccaaagugcucggauuacaggc

SEQ ID NO: 812102 - RNA, 24 nt, Human
ccaaagugcucggauuacaggcgu

SEQ ID NO: 812103 - RNA, 27 nt, Human
ccaaauuuauuuauuuauuuauuuauu

SEQ ID NO: 812104 - RNA, 20 nt, Human
ccacugcacuccagccuggg

SEQ ID NO: 812105 - RNA, 20 nt, Human
ccacugcacuccagccuggg

SEQ ID NO: 812106 - RNA, 21 nt, Human
ccacugcacuccagccugggc

SEQ ID NO: 812107 - RNA, 22 nt, Human
ccacugcacuccagccugggca

SEQ ID NO: 812108 - RNA, 23 nt, Human
ccacugcacuccagccugggcaa

SEQ ID NO: 812109 - RNA, 24 nt, Human
ccacugcacuccagccugggcaac

SEQ ID NO: 812110 - RNA, 21 nt, Human
ccaucucuacagaaaaacgcg

SEQ ID NO: 812111 - RNA, 19 nt, Human
ccauguuggucaggcuggu

SEQ ID NO: 812112 - RNA, 22 nt, Human
ccauguuggucaggcuggucuc

SEQ ID NO: 812113 - RNA, 23 nt, Human
ccauguuggucaggcuggucucg

SEQ ID NO: 812114 - RNA, 18 nt, Human
cccaggcuggaguacaau

SEQ ID NO: 812115 - RNA, 23 nt, Human
cccagguucaagugauucuccuc

SEQ ID NO: 812116 - RNA, 23 nt, Human
cccagguucaagugauucuccug

SEQ ID NO: 812117 - RNA, 23 nt, Human
cccgcaaaggacuucauugaucc

SEQ ID NO: 812118 - RNA, 23 nt, Human
ccuaaagucaggaguucgagauc

SEQ ID NO: 812119 - RNA, 23 nt, Human
ccugaccaauguggugaaacccc

SEQ ID NO: 812120 - RNA, 24 nt, Human
ccugaccaauguggugaaaccccg

SEQ ID NO: 812121 - RNA, 24 nt, Human
ccugaccucaggugaucugcccac

SEQ ID NO: 812122 - RNA, 19 nt, Human
ccugaguagcugggauuac

SEQ ID NO: 812123 - RNA, 22 nt, Human
ccugggcaacagagcgagacuc

SEQ ID NO: 812124 - RNA, 23 nt, Human
ccugggcaacucgcgaaacccca

SEQ ID NO: 812125 - RNA, 21 nt, Human
ccuguaaucccagcuacucag

SEQ ID NO: 812126 - RNA, 21 nt, Human
ccuguagucccagcuacucag

SEQ ID NO: 812127 - RNA, 18 nt, Human
cgagaucagccugaccaa

SEQ ID NO: 812128 - RNA, 24 nt, Human
cgcucuuguugcccaggcuggagu

SEQ ID NO: 812129 - RNA, 20 nt, Human
cggauuacaggcgugagcca

SEQ ID NO: 812130 - RNA, 23 nt, Human
cggauuacaggcgugagccaccg

SEQ ID NO: 812131 - RNA, 29 nt, Human
cggcuaauuuuguauuuuuaguagagacg

SEQ ID NO: 812132 - RNA, 24 nt, Human
cguguggaucaccuaaagucagga

SEQ ID NO: 812133 - RNA, 19 nt, Human
cuaagccagguauagaaca

SEQ ID NO: 812134 - RNA, 22 nt, Human
cucacgcccauaaucccagcac

SEQ ID NO: 812135 - RNA, 24 nt, Human
cucacgcccauaaucccagcacuu

SEQ ID NO: 812136 - RNA, 27 nt, Human
cucacuauucaagauggcccagcugcc

SEQ ID NO: 812137 - RNA, 24 nt, Human
cucacuguaaccuccacuucccag

SEQ ID NO: 812138 - RNA, 18 nt, Human
cucaggaggcugaggugg

SEQ ID NO: 812139 - RNA, 24 nt, Human
cucaucccuauaaucucagcacuu

SEQ ID NO: 812140 - RNA, 24 nt, Human
cuccauguuggucaggcuggucuc

SEQ ID NO: 812141 - RNA, 18 nt, Human
cucgcgaaaccccaucuc

SEQ ID NO: 812142 - RNA, 20 nt, Human
cucggauuacaggcgugagc

SEQ ID NO: 812143 - RNA, 22 nt, Human
cugcagugagccaugauugugu

SEQ ID NO: 812144 - RNA, 23 nt, Human
cugccucacccuccugaguagcu

SEQ ID NO: 812145 - RNA, 21 nt, Human
cuggauccaggagaucaagcu

SEQ ID NO: 812146 - RNA, 24 nt, Human
cuguaaccuccacuucccagguuc

SEQ ID NO: 812147 - RNA, 21 nt, Human
cuguaaucccagcuacucagg

SEQ ID NO: 812148 - RNA, 19 nt, Human
cuuaaaccaaauuuagagc

SEQ ID NO: 812149 - RNA, 24 nt, Human
cuucccagguucaagugauucucc

SEQ ID NO: 812150 - RNA, 22 nt, Human
cuugcaguuccagaauaaaacc

SEQ ID NO: 812151 - RNA, 24 nt, Human
gaaaaaaacuaagaaacacuaaaa

SEQ ID NO: 812152 - RNA, 20 nt, Human
gaagaugaagagccauucau

SEQ ID NO: 812153 - RNA, 24 nt, Human
gaccucaggugaucugcccaccuc

SEQ ID NO: 812154 - RNA, 23 nt, Human
gagacgggguuucuccauguugg

SEQ ID NO: 812155 - RNA, 24 nt, Human
gagacgggguuucuccauguuggu

SEQ ID NO: 812156 - RNA, 25 nt, Human
gagaugggcaaaucacuucaggcca

SEQ ID NO: 812157 - RNA, 21 nt, Human
gaggugggagggucgcuugag

SEQ ID NO: 812158 - RNA, 24 nt, Human
gaguagcugggauuacaagcacgc

SEQ ID NO: 812159 - RNA, 24 nt, Human
gaucaccuaaagucaggaguucga

SEQ ID NO: 812160 - RNA, 23 nt, Human
gauggugaugguguagcugucag

SEQ ID NO: 812161 - RNA, 18 nt, Human
gauuacaggcgugagcca

SEQ ID NO: 812162 - RNA, 22 nt, Human
gauuacaggcgugagccaccgc

SEQ ID NO: 812163 - RNA, 23 nt, Human
gauuacaggcgugagccaccgca

SEQ ID NO: 812164 - RNA, 24 nt, Human
gauugcuugaacccaggaggcaga

SEQ ID NO: 812165 - RNA, 24 nt, Human
gcacuccagccugggcaacagagc

SEQ ID NO: 812166 - RNA, 23 nt, Human
gcagaggcugcagugagccaaga

SEQ ID NO: 812167 - RNA, 22 nt, Human
gcaggaggauugcuugaaccca

SEQ ID NO: 812168 - RNA, 24 nt, Human
gcauuccagccuggauaacagagu

SEQ ID NO: 812169 - RNA, 24 nt, Human
gccugggaaguugaggcugcagug

SEQ ID NO: 812170 - RNA, 23 nt, Human
gcuggucucgaacuccugaccuc

SEQ ID NO: 812171 - RNA, 20 nt, Human
ggaucaccuaaagucaggaa

SEQ ID NO: 812172 - RNA, 21 nt, Human
ggauuacaggcgugagccacc

SEQ ID NO: 812173 - RNA, 22 nt, Human
ggauuacaggcgugagccaccg

SEQ ID NO: 812174 - RNA, 19 nt, Human
ggcaccuguaaucccagcu

SEQ ID NO: 812175 - RNA, 24 nt, Human
ggcuggucucgaacuccugaccuc

SEQ ID NO: 812176 - RNA, 23 nt, Human
gggguuucuccauguuggucagg

SEQ ID NO: 812177 - RNA, 22 nt, Human
ggguuucuccauguuggucagg

SEQ ID NO: 812178 - RNA, 19 nt, Human
ggucucgaacuccugaccu

SEQ ID NO: 812179 - RNA, 19 nt, Human
ggucuuaaaccaaauuuag

SEQ ID NO: 812180 - RNA, 24 nt, Human
gguggcaggcaccuguaaucccag

SEQ ID NO: 812181 - RNA, 24 nt, Human
gguggcucacgcccauaaucccag

SEQ ID NO: 812182 - RNA, 23 nt, Human
guaaccuucugaaacuuucugaa

SEQ ID NO: 812183 - RNA, 23 nt, Human
guagagacgggguuucuccaugu

SEQ ID NO: 812184 - RNA, 20 nt, Human
guagagcacaccuguagucc

SEQ ID NO: 812185 - RNA, 18 nt, Human
guagcugggauuacaagc

SEQ ID NO: 812186 - RNA, 24 nt, Human
gugaucugcccaccucggccuccc

SEQ ID NO: 812187 - RNA, 19 nt, Human
gugauucuccugccucacc

SEQ ID NO: 812188 - RNA, 21 nt, Human
uaaaaauacaaaaauuagcca

SEQ ID NO: 812189 - RNA, 18 nt, Human
uaaaguuuacuguaaccu

SEQ ID NO: 812190 - RNA, 20 nt, Human
uaaauccuugaaacuugcag

SEQ ID NO: 812191 - RNA, 23 nt, Human
uaaauccuugaaacuugcaguuc

SEQ ID NO: 812192 - RNA, 22 nt, Human
uaacagagugagacccugucuc

SEQ ID NO: 812193 - RNA, 24 nt, Human
uaaccaaaaagaacucacuaauau

SEQ ID NO: 812194 - RNA, 22 nt, Human
uaacggauacucaugaacugaa

SEQ ID NO: 812195 - RNA, 24 nt, Human
uaagaaacacuaaaauaguuuuau

SEQ ID NO: 812196 - RNA, 19 nt, Human
uaaguugaauauuucacuc

SEQ ID NO: 812197 - RNA, 23 nt, Human
uaaguugaauauuucacucuaug

SEQ ID NO: 812198 - RNA, 22 nt, Human
uaauccuaagagaucaggucaa

SEQ ID NO: 812199 - RNA, 21 nt, Human
uacaccacugcacuccagccu

SEQ ID NO: 812200 - RNA, 23 nt, Human
uacacugaagcuaaacacauggg

SEQ ID NO: 812201 - RNA, 21 nt, Human
uacaggcgugagccaccgcac

SEQ ID NO: 812202 - RNA, 22 nt, Human
uacaggcgugagccaccgcacu

SEQ ID NO: 812203 - RNA, 22 nt, Human
uagagcacaccuguagucccag

SEQ ID NO: 812204 - RNA, 24 nt, Human
uaguagagacgggguuucuccaug

SEQ ID NO: 812205 - RNA, 18 nt, Human
uauauaaacagagaauga

SEQ ID NO: 812206 - RNA, 20 nt, Human
uauucaagauggcccagcug

SEQ ID NO: 812207 - RNA, 19 nt, Human
ucaacauuacaagugaagu

SEQ ID NO: 812208 - RNA, 19 nt, Human
ucaagugauucuccugccu

SEQ ID NO: 812209 - RNA, 20 nt, Human
ucaccgcauuccagccugga

SEQ ID NO: 812210 - RNA, 21 nt, Human
ucaccgcauuccagccuggau

SEQ ID NO: 812211 - RNA, 24 nt, Human
ucacuguaaccuccacuucccagg

SEQ ID NO: 812212 - RNA, 25 nt, Human
ucacuguaaccuccacuucccaggu

SEQ ID NO: 812213 - RNA, 23 nt, Human
ucauuaaacaaaugaaaguauua

SEQ ID NO: 812214 - RNA, 20 nt, Human
uccaaauuaagcaaaaaaag

SEQ ID NO: 812215 - RNA, 19 nt, Human
uccagccuggauaacagag

SEQ ID NO: 812216 - RNA, 23 nt, Human
uccagccuggauaacagagugag

SEQ ID NO: 812217 - RNA, 24 nt, Human
uccagccuggauaacagagugaga

SEQ ID NO: 812218 - RNA, 23 nt, Human
uccagccugggcaacagagcgag

SEQ ID NO: 812219 - RNA, 24 nt, Human
uccagccugggcaacagagcgaga

SEQ ID NO: 812220 - RNA, 20 nt, Human
uccauacacuucuuaaacca

SEQ ID NO: 812221 - RNA, 20 nt, Human
uccaugaggcaaaaauauaa

SEQ ID NO: 812222 - RNA, 22 nt, Human
uccaugaggcaaaaauauaauc

SEQ ID NO: 812223 - RNA, 24 nt, Human
ucccaaagugcucggauuacaggc

SEQ ID NO: 812224 - RNA, 21 nt, Human
ucccagguucaagugauucuc

SEQ ID NO: 812225 - RNA, 24 nt, Human
ucccagguucaagugauucuccug

SEQ ID NO: 812226 - RNA, 18 nt, Human
uccugaguagcugggauu

SEQ ID NO: 812227 - RNA, 22 nt, Human
uccuucauucuuuccucuuuca

SEQ ID NO: 812228 - RNA, 21 nt, Human
ucgacaaauaaaauguaacaa

SEQ ID NO: 812229 - RNA, 21 nt, Human
ucgcucuuguugcccaggcug

SEQ ID NO: 812230 - RNA, 22 nt, Human
ucgcucuuguugcccaggcugg

SEQ ID NO: 812231 - RNA, 23 nt, Human
ucgcucuuguugcccaggcugga

SEQ ID NO: 812232 - RNA, 24 nt, Human
ucgcuugagccugggaaguugagg

SEQ ID NO: 812233 - RNA, 18 nt, Human
ucggauuacaggcgugag

SEQ ID NO: 812234 - RNA, 22 nt, Human
ucggauuacaggcgugagccac

SEQ ID NO: 812235 - RNA, 24 nt, Human
ucggauuacaggcgugagccaccg

SEQ ID NO: 812236 - RNA, 23 nt, Human
ucucgaacuccugaccucaggug

SEQ ID NO: 812237 - RNA, 21 nt, Human
ucucuacuaaaaauacaaaaa

SEQ ID NO: 812238 - RNA, 20 nt, Human
ucugucugaaaaaaaaaaaa

SEQ ID NO: 812239 - RNA, 19 nt, Human
ugaaaaaaacuaagaaaca

SEQ ID NO: 812240 - RNA, 21 nt, Human
ugaaaaaaacuaagaaacacu

SEQ ID NO: 812241 - RNA, 23 nt, Human
ugaaaaaaacuaagaaacacuaa

SEQ ID NO: 812242 - RNA, 24 nt, Human
ugaaaagaaacaaaauuuaguacu

SEQ ID NO: 812243 - RNA, 25 nt, Human
ugaaauaugaacuacauucaaagaa

SEQ ID NO: 812244 - RNA, 25 nt, Human
ugaacugaaauaugaacuacauuca

SEQ ID NO: 812245 - RNA, 24 nt, Human
ugaaggcuguguauucaacuuuca

SEQ ID NO: 812246 - RNA, 24 nt, Human
ugaccaauguggugaaaccccguc

SEQ ID NO: 812247 - RNA, 18 nt, Human
ugaccucaggugaucugc

SEQ ID NO: 812248 - RNA, 20 nt, Human
ugaccucaggugaucugccc

SEQ ID NO: 812249 - RNA, 21 nt, Human
ugaccucaggugaucugccca

SEQ ID NO: 812250 - RNA, 24 nt, Human
ugaccucaggugaucugcccaccu

SEQ ID NO: 812251 - RNA, 18 nt, Human
ugacucaucccuauaauc

SEQ ID NO: 812252 - RNA, 23 nt, Human
ugacucauucuuucugccagcaa

SEQ ID NO: 812253 - RNA, 20 nt, Human
ugagaaggaguuucgcucuu

SEQ ID NO: 812254 - RNA, 24 nt, Human
ugagccugggaaguugaggcugca

SEQ ID NO: 812255 - RNA, 24 nt, Human
ugaggcaggaggauugcuugaacc

SEQ ID NO: 812256 - RNA, 25 nt, Human
ugaggcaggaggauugcuugaaccc

SEQ ID NO: 812257 - RNA, 26 nt, Human
ugaggcguguggaucaccuaaaguca

SEQ ID NO: 812258 - RNA, 23 nt, Human
ugaggcugcagugagccaugauu

SEQ ID NO: 812259 - RNA, 18 nt, Human
ugaggugggagggucgcu

SEQ ID NO: 812260 - RNA, 20 nt, Human
ugaggugggagggucgcuug

SEQ ID NO: 812261 - RNA, 23 nt, Human
ugaggugggagggucgcuugagc

SEQ ID NO: 812262 - RNA, 24 nt, Human
ugaggugggagggucgcuugagcc

SEQ ID NO: 812263 - RNA, 21 nt, Human
ugagucauucuucuucaaguu

SEQ ID NO: 812264 - RNA, 24 nt, Human
ugaucugcccaccucggccuccca

SEQ ID NO: 812265 - RNA, 21 nt, Human
ugauuaacaguuucaucugaa

SEQ ID NO: 812266 - RNA, 25 nt, Human
ugcacacauauauucacucuaugca

SEQ ID NO: 812267 - RNA, 19 nt, Human
ugccauaucaccaguuuau

SEQ ID NO: 812268 - RNA, 21 nt, Human
ugcccaggcuggaguacaaug

SEQ ID NO: 812269 - RNA, 24 nt, Human
ugcccaggcuggaguacaauggcg

SEQ ID NO: 812270 - RNA, 24 nt, Human
ugcccuacaccuucaucuuccuca

SEQ ID NO: 812271 - RNA, 21 nt, Human
ugccucacccuccugaguagc

SEQ ID NO: 812272 - RNA, 24 nt, Human
ugccucacccuccugaguagcugg

SEQ ID NO: 812273 - RNA, 21 nt, Human
uggauaacagagugagacccu

SEQ ID NO: 812274 - RNA, 21 nt, Human
uggaucaccuaaagucaggag

SEQ ID NO: 812275 - RNA, 24 nt, Human
uggaucaccuaaagucaggaguuc

SEQ ID NO: 812276 - RNA, 27 nt, Human
uggaucaccuaaagucaggaguucgag

SEQ ID NO: 812277 - RNA, 24 nt, Human
uggcgcgaucuucgcucacuguaa

SEQ ID NO: 812278 - RNA, 22 nt, Human
uggcucacgcccauaaucccag

SEQ ID NO: 812279 - RNA, 24 nt, Human
uggcucacgcccauaaucccagca

SEQ ID NO: 812280 - RNA, 24 nt, Human
ugggaagccgagaugggcaaauca

SEQ ID NO: 812281 - RNA, 20 nt, Human
ugggaaguugaggcugcagg

SEQ ID NO: 812282 - RNA, 19 nt, Human
ugggagucugaggcgugug

SEQ ID NO: 812283 - RNA, 21 nt, Human
ugggauuacaagcacgcacca

SEQ ID NO: 812284 - RNA, 24 nt, Human
ugggauuacaagcacgcaccacca

SEQ ID NO: 812285 - RNA, 24 nt, Human
ugggcaaaucacuucaggccaaga

SEQ ID NO: 812286 - RNA, 24 nt, Human
uggucaggcuggucucgaacuccu

SEQ ID NO: 812287 - RNA, 19 nt, Human
uggugaaaccccgucucua

SEQ ID NO: 812288 - RNA, 24 nt, Human
ugguggcaggcaccuguaauccca

SEQ ID NO: 812289 - RNA, 21 nt, Human
uguauuuuuaguagagacggg

SEQ ID NO: 812290 - RNA, 23 nt, Human
uuacaccacugcacuccagccug

SEQ ID NO: 812291 - RNA, 18 nt, Human
uuaccauuuguuaaaaau

SEQ ID NO: 812292 - RNA, 22 nt, Human
uuacugcccauaggaauacccg

SEQ ID NO: 812293 - RNA, 21 nt, Human
uuacuguaaccuucugaaacu

SEQ ID NO: 812294 - RNA, 18 nt, Human
uuaguagagacgggguuu

SEQ ID NO: 812295 - RNA, 24 nt, Human
uuaguagagacgggguuucuccau

SEQ ID NO: 812296 - RNA, 18 nt, Human
uuauuuauuuauuuauuu

SEQ ID NO: 812297 - RNA, 25 nt, Human
uuauuuauuuauuuauuuauuuauu

SEQ ID NO: 812298 - RNA, 24 nt, Human
uuauuuauuuauuuauuuauuuuu

SEQ ID NO: 812299 - RNA, 21 nt, Human
uucaagugauucuccugccuc

SEQ ID NO: 812300 - RNA, 23 nt, Human
uucaagugauucuccugccucac

SEQ ID NO: 812301 - RNA, 19 nt, Human
uucacucuaugcacacaua

SEQ ID NO: 812302 - RNA, 19 nt, Human
uucacucuaugcacacaua

SEQ ID NO: 812303 - RNA, 21 nt, Human
uucacucuaugcacacauaua

SEQ ID NO: 812304 - RNA, 18 nt, Human
uucccagguucaagugau

SEQ ID NO: 812305 - RNA, 19 nt, Human
uucccagguucaagugauu

SEQ ID NO: 812306 - RNA, 24 nt, Human
uucgcucuuguugcccaggcugga

SEQ ID NO: 812307 - RNA, 24 nt, Human
uugcuugaacccaggaggcagagg

SEQ ID NO: 812308 - RNA, 19 nt, Human
uuguaaaauacacugaagc

SEQ ID NO: 812309 - RNA, 23 nt, Human
uuguauuuuuaguagagacgggg

SEQ ID NO: 812310 - RNA, 22 nt, Human
uuuagagcccacccacaaaaga

SEQ ID NO: 812311 - RNA, 22 nt, Human
uuucacucuaugcacacauaua

SEQ ID NO: 812312 - RNA, 23 nt, Human
uuucgcucuuguugcccaggcug

SEQ ID NO: 812313 - RNA, 24 nt, Human
uuucgcucuuguugcccaggcugg

SEQ ID NO: 812314 - RNA, 21 nt, Human
uuucuccauguuggucaggcu

SEQ ID NO: 812315 - RNA, 22 nt, Human
uuucugccagcaauaucuuugu

SEQ ID NO: 812316 - RNA, 20 nt, Human
uuugagaaggaguuucgcuc

SEQ ID NO: 812317 - RNA, 19 nt, Human
uuuuguauuuuuaguagag

SEQ ID NO: 812318 - RNA, 20 nt, Human
uuuuguauuuuuaguagaga

SEQ ID NO: 812319 - RNA, 22 nt, Human
uuuuuaguagagacgggguuuc

SEQ ID NO: 812320 - RNA, 19 nt, Human
aaaaaaacaaaggagcaca

SEQ ID NO: 812321 - RNA, 23 nt, Human
aaaaaagaagaggguaugugugg

SEQ ID NO: 812322 - RNA, 24 nt, Human
aaaaacaaaggagcacagaaaaga

SEQ ID NO: 812323 - RNA, 18 nt, Human
aaacagggcucuccaccc

SEQ ID NO: 812324 - RNA, 20 nt, Human
aaagaaagauaggagaaaac

SEQ ID NO: 812325 - RNA, 22 nt, Human
aaagaagaggguauguguggug

SEQ ID NO: 812326 - RNA, 21 nt, Human
aaagccagaaccaggccagga

SEQ ID NO: 812327 - RNA, 18 nt, Human
aaaggugggggaguccgg

SEQ ID NO: 812328 - RNA, 18 nt, Human
aaaugucuucuucaggcc

SEQ ID NO: 812329 - RNA, 28 nt, Human
aacccagagaggaaaggugggggagucc

SEQ ID NO: 812330 - RNA, 22 nt, Human
aagaaaaagcgagagaaaaaaa

SEQ ID NO: 812331 - RNA, 18 nt, Human
aagaaagauaggagaaaa

SEQ ID NO: 812332 - RNA, 26 nt, Human
aagaaaugagauaaucugaaagaaga

SEQ ID NO: 812333 - RNA, 24 nt, Human
aagaggcacgcaaccaaagccaga

SEQ ID NO: 812334 - RNA, 19 nt, Human
aagcagaaaaggaugggug

SEQ ID NO: 812335 - RNA, 23 nt, Human
aagcagaaaaggauggguguccg

SEQ ID NO: 812336 - RNA, 19 nt, Human
aagccaagcccccuccccu

SEQ ID NO: 812337 - RNA, 25 nt, Human
aauacagagacagauccagaagaaa

SEQ ID NO: 812338 - RNA, 18 nt, Human
acucccaccucgcccgga

SEQ ID NO: 812339 - RNA, 19 nt, Human
acugcauuggauauucucu

SEQ ID NO: 812340 - RNA, 18 nt, Human
acuggagagccugcuggg

SEQ ID NO: 812341 - RNA, 25 nt, Human
agaaaaagagggaaaugcuggggag

SEQ ID NO: 812342 - RNA, 22 nt, Human
agaaagaagggguugggauggg

SEQ ID NO: 812343 - RNA, 21 nt, Human
agaaggauacggugaagaaga

SEQ ID NO: 812344 - RNA, 23 nt, Human
agaccggggccgggcgggggggc

SEQ ID NO: 812345 - RNA, 24 nt, Human
agagaaaaaaggcaggucaaaggg

SEQ ID NO: 812346 - RNA, 23 nt, Human
agagaaggauacggugaagaaga

SEQ ID NO: 812347 - RNA, 20 nt, Human
agagaggaaaggugggggag

SEQ ID NO: 812348 - RNA, 21 nt, Human
agaggggaggaaggagggagg

SEQ ID NO: 812349 - RNA, 19 nt, Human
agcaggcuggguggggggg

SEQ ID NO: 812350 - RNA, 18 nt, Human
agccccccggcggcucag

SEQ ID NO: 812351 - RNA, 21 nt, Human
aggagaaaacacagccaggaa

SEQ ID NO: 812352 - RNA, 26 nt, Human
aggagaaaacacagccaggaagagga

SEQ ID NO: 812353 - RNA, 19 nt, Human
aggaggcaggcagagagga

SEQ ID NO: 812354 - RNA, 22 nt, Human
aggagggaggcaagccaaggaa

SEQ ID NO: 812355 - RNA, 21 nt, Human
aggcugccuccccggcacagc

SEQ ID NO: 812356 - RNA, 18 nt, Human
agggaagaagagcuggga

SEQ ID NO: 812357 - RNA, 22 nt, Human
aggggaggaaggagggaggcaa

SEQ ID NO: 812358 - RNA, 21 nt, Human
agggguugggauggggaaggg

SEQ ID NO: 812359 - RNA, 19 nt, Human
agguaguggcaaggguggg

SEQ ID NO: 812360 - RNA, 24 nt, Human
aggucuaaagaaaaggugggaggg

SEQ ID NO: 812361 - RNA, 18 nt, Human
auccagaagaaaugagau

SEQ ID NO: 812362 - RNA, 21 nt, Human
aucccaaauuccaugaaauag

SEQ ID NO: 812363 - RNA, 21 nt, Human
augccaccagagggggcugga

SEQ ID NO: 812364 - RNA, 23 nt, Human
augggggagacagaaggguggga

SEQ ID NO: 812365 - RNA, 22 nt, Human
caagugaguccagaccaaccaa

SEQ ID NO: 812366 - RNA, 18 nt, Human
cacagcauccauggcagg

SEQ ID NO: 812367 - RNA, 20 nt, Human
cacagcauccauggcaggau

SEQ ID NO: 812368 - RNA, 21 nt, Human
caccaaacccccacccgcagc

SEQ ID NO: 812369 - RNA, 23 nt, Human
caccaaacccccacccgcagcga

SEQ ID NO: 812370 - RNA, 27 nt, Human
caccaaacccccacccgcagcgaaguu

SEQ ID NO: 812371 - RNA, 20 nt, Human
caccucugcccugccuggga

SEQ ID NO: 812372 - RNA, 24 nt, Human
cacuucccuucucuccuucaggga

SEQ ID NO: 812373 - RNA, 19 nt, Human
cagagacagauccagaaga

SEQ ID NO: 812374 - RNA, 21 nt, Human
cagagggacagcaggccccuu

SEQ ID NO: 812375 - RNA, 20 nt, Human
cagcaacucugagagagaaa

SEQ ID NO: 812376 - RNA, 19 nt, Human
cagccacaaccucaaacag

SEQ ID NO: 812377 - RNA, 18 nt, Human
cagcggcaguguugcggg

SEQ ID NO: 812378 - RNA, 20 nt, Human
caucacgggggaggcugggc

SEQ ID NO: 812379 - RNA, 22 nt, Human
cauuuucuuccuccucuccauu

SEQ ID NO: 812380 - RNA, 20 nt, Human
ccaaagccagaaccaggccc

SEQ ID NO: 812381 - RNA, 23 nt, Human
ccagagagggaucagccacaacc

SEQ ID NO: 812382 - RNA, 22 nt, Human
cccacccgcagcgaaguugagg

SEQ ID NO: 812383 - RNA, 21 nt, Human
cccagaagugccuccucccac

SEQ ID NO: 812384 - RNA, 22 nt, Human
cccagaguugggaugugggggc

SEQ ID NO: 812385 - RNA, 18 nt, Human
ccccacccgcagcgaagu

SEQ ID NO: 812386 - RNA, 19 nt, Human
ccccagaagugccuccucc

SEQ ID NO: 812387 - RNA, 23 nt, Human
ccccagaagugccuccucccacc

SEQ ID NO: 812388 - RNA, 23 nt, Human
cccccagaagugccuccucccac

SEQ ID NO: 812389 - RNA, 23 nt, Human
ccccuccuucuguuguuuuccca

SEQ ID NO: 812390 - RNA, 21 nt, Human
ccccuggggacccugcagucc

SEQ ID NO: 812391 - RNA, 19 nt, Human
ccccuuaggcuagggagcc

SEQ ID NO: 812392 - RNA, 23 nt, Human
cccuccuucuguuguuuucccau

SEQ ID NO: 812393 - RNA, 23 nt, Human
ccggagaguccccucucucccca

SEQ ID NO: 812394 - RNA, 19 nt, Human
ccucagagggacagcaggc

SEQ ID NO: 812395 - RNA, 21 nt, Human
ccucagagggacagcaggccc

SEQ ID NO: 812396 - RNA, 21 nt, Human
ccuugagggaggggguuggca

SEQ ID NO: 812397 - RNA, 21 nt, Human
cgcaaccaaagccagaaccag

SEQ ID NO: 812398 - RNA, 19 nt, Human
cgggcgaggccucggggcg

SEQ ID NO: 812399 - RNA, 21 nt, Human
cgggggaggcugggccaggca

SEQ ID NO: 812400 - RNA, 22 nt, Human
cuaauaccagagagggaucagc

SEQ ID NO: 812401 - RNA, 19 nt, Human
cuagggcuuccugcuccca

SEQ ID NO: 812402 - RNA, 23 nt, Human
cucaagugccucuaacccucugc

SEQ ID NO: 812403 - RNA, 21 nt, Human
cucagccccccggcggcucag

SEQ ID NO: 812404 - RNA, 19 nt, Human
cuccucccaccacaacucc

SEQ ID NO: 812405 - RNA, 21 nt, Human
cuccucccaccacaacuccca

SEQ ID NO: 812406 - RNA, 19 nt, Human
cucugagagagaaaagccc

SEQ ID NO: 812407 - RNA, 24 nt, Human
cucugccucaugcaggggagggag

SEQ ID NO: 812408 - RNA, 27 nt, Human
cuuaggacaccaaacccccacccgcag

SEQ ID NO: 812409 - RNA, 24 nt, Human
gaaaaaaacaaaggagcacagaaa

SEQ ID NO: 812410 - RNA, 22 nt, Human
gaaagaagacagggaaagaaaa

SEQ ID NO: 812411 - RNA, 18 nt, Human
gaagaagagaaagaaaga

SEQ ID NO: 812412 - RNA, 18 nt, Human
gaagaagagcugggagcu

SEQ ID NO: 812413 - RNA, 22 nt, Human
gaauacagagacagauccagaa

SEQ ID NO: 812414 - RNA, 20 nt, Human
gacugcauuggauauucucu

SEQ ID NO: 812415 - RNA, 25 nt, Human
gagaaaaaaacaaaggagcacagaa

SEQ ID NO: 812416 - RNA, 23 nt, Human
gagaaggauacggugaagaagag

SEQ ID NO: 812417 - RNA, 23 nt, Human
gagacagcggcaguguugcggga

SEQ ID NO: 812418 - RNA, 21 nt, Human
gagagacugcuccaacccaga

SEQ ID NO: 812419 - RNA, 19 nt, Human
gaggaggggcuggccgaug

SEQ ID NO: 812420 - RNA, 21 nt, Human
gaggcacgcaaccaaagccag

SEQ ID NO: 812421 - RNA, 21 nt, Human
gaggggcuggccgaugaggag

SEQ ID NO: 812422 - RNA, 27 nt, Human
gauccccuccuucuguuguuuucccau

SEQ ID NO: 812423 - RNA, 19 nt, Human
gaugaggagaaaaagaggg

SEQ ID NO: 812424 - RNA, 21 nt, Human
gcaguaacccagcucagugcu

SEQ ID NO: 812425 - RNA, 19 nt, Human
gccugggaagcaugugaga

SEQ ID NO: 812426 - RNA, 18 nt, Human
gcgcggccucagcccccc

SEQ ID NO: 812427 - RNA, 21 nt, Human
gcuggggcucaggcugccucc

SEQ ID NO: 812428 - RNA, 21 nt, Human
ggaagaagagaaagaaagaua

SEQ ID NO: 812429 - RNA, 19 nt, Human
ggacuacuaaacuugucac

SEQ ID NO: 812430 - RNA, 19 nt, Human
ggagacagaagggugggag

SEQ ID NO: 812431 - RNA, 19 nt, Human
ggagaugcacugagacccc

SEQ ID NO: 812432 - RNA, 23 nt, Human
ggagcuggaugcaaagggggagg

SEQ ID NO: 812433 - RNA, 19 nt, Human
ggagggcguggagcaaugg

SEQ ID NO: 812434 - RNA, 21 nt, Human
ggcaagggugggggaagauga

SEQ ID NO: 812435 - RNA, 18 nt, Human
ggccacaagugaguccag

SEQ ID NO: 812436 - RNA, 19 nt, Human
ggccgaugaggagaaaaag

SEQ ID NO: 812437 - RNA, 18 nt, Human
ggcgggggcaguuagacc

SEQ ID NO: 812438 - RNA, 19 nt, Human
ggcuggaggaggggcuggc

SEQ ID NO: 812439 - RNA, 22 nt, Human
gggaagaagagcugggagcugg

SEQ ID NO: 812440 - RNA, 21 nt, Human
gggcaggcagggccggacccu

SEQ ID NO: 812441 - RNA, 21 nt, Human
gggccuuggagccgggcgagg

SEQ ID NO: 812442 - RNA, 22 nt, Human
ggggaaaaacuaauaccagaga

SEQ ID NO: 812443 - RNA, 19 nt, Human
ggggaggcugggccaggca

SEQ ID NO: 812444 - RNA, 20 nt, Human
gggggccuugcucaagugcc

SEQ ID NO: 812445 - RNA, 26 nt, Human
ggguauguguggugggcauuccuggg

SEQ ID NO: 812446 - RNA, 21 nt, Human
guauguguggugggcauuccu

SEQ ID NO: 812447 - RNA, 20 nt, Human
guccccucuuccuagggcuu

SEQ ID NO: 812448 - RNA, 19 nt, Human
guugggagaggaaaaauaa

SEQ ID NO: 812449 - RNA, 24 nt, Human
uaaacaagaguuugacuagaaaaa

SEQ ID NO: 812450 - RNA, 19 nt, Human
uaauagccuccaagauuag

SEQ ID NO: 812451 - RNA, 20 nt, Human
uagagaaggauacggugaag

SEQ ID NO: 812452 - RNA, 23 nt, Human
uagagguggaggaugcaccuccu

SEQ ID NO: 812453 - RNA, 23 nt, Human
uaguguaggggaaaaaaucugcc

SEQ ID NO: 812454 - RNA, 19 nt, Human
uauuuuuuucuucuuaugg

SEQ ID NO: 812455 - RNA, 18 nt, Human
ucacagcuucugcuucca

SEQ ID NO: 812456 - RNA, 23 nt, Human
ucacuucccuucucuccuucagg

SEQ ID NO: 812457 - RNA, 20 nt, Human
ucagccccccggcggcucag

SEQ ID NO: 812458 - RNA, 18 nt, Human
ucagggaaggauggaauu

SEQ ID NO: 812459 - RNA, 19 nt, Human
ucauauguaaacaaucuag

SEQ ID NO: 812460 - RNA, 21 nt, Human
ucauuuucuuccuccucucca

SEQ ID NO: 812461 - RNA, 18 nt, Human
uccaacccagagaggaaa

SEQ ID NO: 812462 - RNA, 24 nt, Human
uccaacccagagaggaaagguggg

SEQ ID NO: 812463 - RNA, 21 nt, Human
uccagaagaaaugagauaauc

SEQ ID NO: 812464 - RNA, 18 nt, Human
ucccaaauuccaugaaau

SEQ ID NO: 812465 - RNA, 26 nt, Human
ucccagaguugggaugugggggccuu

SEQ ID NO: 812466 - RNA, 22 nt, Human
ucccccagaagugccuccuccc

SEQ ID NO: 812467 - RNA, 18 nt, Human
uccggagagacugcucca

SEQ ID NO: 812468 - RNA, 18 nt, Human
uccucccaccacaacucc

SEQ ID NO: 812469 - RNA, 24 nt, Human
uccuucuucauuuucuuccuccuu

SEQ ID NO: 812470 - RNA, 18 nt, Human
uccuugagggaggggguu

SEQ ID NO: 812471 - RNA, 20 nt, Human
ucuccacccaccugucaccc

SEQ ID NO: 812472 - RNA, 18 nt, Human
ucuuccuccucuccauuc

SEQ ID NO: 812473 - RNA, 19 nt, Human
ugaaagaagacagggaaag

SEQ ID NO: 812474 - RNA, 23 nt, Human
ugaaagaagacagggaaagaaaa

SEQ ID NO: 812475 - RNA, 24 nt, Human
ugaagaggcacgcaaccaaagcca

SEQ ID NO: 812476 - RNA, 23 nt, Human
ugacucccaccucugcccugccu

SEQ ID NO: 812477 - RNA, 19 nt, Human
ugagaggggaggaaggagg

SEQ ID NO: 812478 - RNA, 18 nt, Human
ugagauaaucugaaagaa

SEQ ID NO: 812479 - RNA, 20 nt, Human
ugauguaaagggggaaggga

SEQ ID NO: 812480 - RNA, 23 nt, Human
uggauggagauagggaagaagag

SEQ ID NO: 812481 - RNA, 22 nt, Human
uggcgcggccucagccccccgg

SEQ ID NO: 812482 - RNA, 18 nt, Human
ugggagaagucaguggca

SEQ ID NO: 812483 - RNA, 24 nt, Human
ugggagaggaaaaauaaaucaaaa

SEQ ID NO: 812484 - RNA, 25 nt, Human
ugggagaggaaaaauaaaucaaaau

SEQ ID NO: 812485 - RNA, 23 nt, Human
ugggagcuggaugcaaaggggga

SEQ ID NO: 812486 - RNA, 28 nt, Human
ugggagcuggaugcaaagggggaggggg

SEQ ID NO: 812487 - RNA, 20 nt, Human
ugggagggcguggagcaaug

SEQ ID NO: 812488 - RNA, 21 nt, Human
ugggagggcguggagcaaugg

SEQ ID NO: 812489 - RNA, 23 nt, Human
ugggagggcguggagcaauggag

SEQ ID NO: 812490 - RNA, 18 nt, Human
ugggauggggaagggagu

SEQ ID NO: 812491 - RNA, 18 nt, Human
ugggggggcgagguagug

SEQ ID NO: 812492 - RNA, 21 nt, Human
uggguagagaaggauacggug

SEQ ID NO: 812493 - RNA, 26 nt, Human
ugugggggccuugcucaagugccucu

SEQ ID NO: 812494 - RNA, 19 nt, Human
uguggugggcauuccuggg

SEQ ID NO: 812495 - RNA, 22 nt, Human
uuauuuuuuucuucuuaugguu

SEQ ID NO: 812496 - RNA, 20 nt, Human
uuccuagggcuuccugcucc

SEQ ID NO: 812497 - RNA, 25 nt, Human
uuccugcaagacuugguguuggcgg

SEQ ID NO: 812498 - RNA, 20 nt, Human
uuccuugagggaggggguug

SEQ ID NO: 812499 - RNA, 25 nt, Human
uucggugagggaggaggcaggcaga

SEQ ID NO: 812500 - RNA, 23 nt, Human
uucugauguaaagggggaaggga

SEQ ID NO: 812501 - RNA, 21 nt, Human
uugcuccaucccagcaucacg

SEQ ID NO: 812502 - RNA, 21 nt, Human
uuggauggagauagggaagaa

SEQ ID NO: 812503 - RNA, 22 nt, Human
uuuaaaggggcagggagaagag

SEQ ID NO: 812504 - RNA, 18 nt, Human
uuuaaucaaaggccacaa

SEQ ID NO: 812505 - RNA, 21 nt, Human
uuucacuaggccucagaggga

SEQ ID NO: 812506 - RNA, 23 nt, Human
uuucacuucccuucucuccuuca

SEQ ID NO: 812507 - RNA, 18 nt, Human
aggcugugguccucagga

SEQ ID NO: 812508 - RNA, 18 nt, Human
caggccccuccagucgug

SEQ ID NO: 812509 - RNA, 19 nt, Human
cccaggcugugguccucag

SEQ ID NO: 812510 - RNA, 19 nt, Human
ccccuccagucgugugccc

SEQ ID NO: 812511 - RNA, 21 nt, Human
ccggggccuggcuucucaggc

SEQ ID NO: 812512 - RNA, 23 nt, Human
ccuugcugccggggccuggcuuc

SEQ ID NO: 812513 - RNA, 18 nt, Human
cgugugcccaggcugugg

SEQ ID NO: 812514 - RNA, 20 nt, Human
cugggugcauacuccucgcu

SEQ ID NO: 812515 - RNA, 21 nt, Human
ggcugugguccucaggaggcc

SEQ ID NO: 812516 - RNA, 21 nt, Human
gggcuuggguuugguccccag

SEQ ID NO: 812517 - RNA, 18 nt, Human
gguccucaggaggcccug

SEQ ID NO: 812518 - RNA, 27 nt, Human
uccacgguggugcugaccagguagagg

SEQ ID NO: 812519 - RNA, 26 nt, Human
ugcccaggcugugguccucaggaggc

SEQ ID NO: 812520 - RNA, 23 nt, Human
uggguuugguccccagcagugcc

SEQ ID NO: 812521 - RNA, 21 nt, Human
uggugcugaccagguagaggg

SEQ ID NO: 812522 - RNA, 18 nt, Human
uugcugccggggccuggc

SEQ ID NO: 812523 - RNA, 18 nt, Human
uugguccccagcagugcc

SEQ ID NO: 812524 - RNA, 19 nt, Human
uugguccccagcagugccu

SEQ ID NO: 812525 - RNA, 19 nt, Human
aacaccagccgcagacgcg

SEQ ID NO: 812526 - RNA, 19 nt, Human
acaagcucgggagagaagc

SEQ ID NO: 812527 - RNA, 18 nt, Human
agaauacaacagauuccc

SEQ ID NO: 812528 - RNA, 21 nt, Human
caagcucgggagagaagccaa

SEQ ID NO: 812529 - RNA, 19 nt, Human
caccagccgcagacgcgcc

SEQ ID NO: 812530 - RNA, 23 nt, Human
cagaauacaacagauucccauuu

SEQ ID NO: 812531 - RNA, 22 nt, Human
cagccaccgccacagccgccuc

SEQ ID NO: 812532 - RNA, 23 nt, Human
cagccaccgccacagccgccucg

SEQ ID NO: 812533 - RNA, 19 nt, Human
cagcugcaacagcagagga

SEQ ID NO: 812534 - RNA, 23 nt, Human
ccauugaaaaaggcaucguuccu

SEQ ID NO: 812535 - RNA, 23 nt, Human
cccgcugcacccuaggcccagcc

SEQ ID NO: 812536 - RNA, 18 nt, Human
cccuaggcccagccgccu

SEQ ID NO: 812537 - RNA, 24 nt, Human
ccgcagacgcgcccgcugcacccu

SEQ ID NO: 812538 - RNA, 24 nt, Human
ccgccucagccaccgccacagccg

SEQ ID NO: 812539 - RNA, 21 nt, Human
ccuaggcccagccgccucagc

SEQ ID NO: 812540 - RNA, 20 nt, Human
ccucauaaucuaguguugcu

SEQ ID NO: 812541 - RNA, 20 nt, Human
cgccucagccaccgccacag

SEQ ID NO: 812542 - RNA, 21 nt, Human
cuugcagcugcaacagcagag

SEQ ID NO: 812543 - RNA, 19 nt, Human
gagggcgcuggcagggcuc

SEQ ID NO: 812544 - RNA, 22 nt, Human
gccaacaccagccgcagacgcg

SEQ ID NO: 812545 - RNA, 22 nt, Human
uaaaaaaucagaauacaacaga

SEQ ID NO: 812546 - RNA, 26 nt, Human
uauauaugaaugaaagaucagaauga

SEQ ID NO: 812547 - RNA, 21 nt, Human
ucgggagagaagccaacaaaa

SEQ ID NO: 812548 - RNA, 22 nt, Human
ucuagagaugcgccaacaccag

SEQ ID NO: 812549 - RNA, 20 nt, Human
ucuuuuucucuccauacucu

SEQ ID NO: 812550 - RNA, 20 nt, Human
ugccucuuuuucucuccaua

SEQ ID NO: 812551 - RNA, 19 nt, Human
ugcuaauaaaaaaucagaa

SEQ ID NO: 812552 - RNA, 20 nt, Human
uguuuugggccacagaauca

SEQ ID NO: 812553 - RNA, 23 nt, Human
uuaaaaugaaauuagcuaggcau

SEQ ID NO: 812554 - RNA, 20 nt, Human
aaaaaacuuggcuaccugac

SEQ ID NO: 812555 - RNA, 18 nt, Human
aaaaaauagaaacagugc

SEQ ID NO: 812556 - RNA, 21 nt, Human
aaaaauuaacccuucugccca

SEQ ID NO: 812557 - RNA, 24 nt, Human
aaacaugaucucagcucacugcaa

SEQ ID NO: 812558 - RNA, 19 nt, Human
aaagugcugggauuacugg

SEQ ID NO: 812559 - RNA, 24 nt, Human
aaagugcugggauuacuggcguga

SEQ ID NO: 812560 - RNA, 22 nt, Human
aaauccaaauccuuuaaucaga

SEQ ID NO: 812561 - RNA, 23 nt, Human
aacaaaauuaaaaacacauucuu

SEQ ID NO: 812562 - RNA, 24 nt, Human
aacaauucuugugccucagccucc

SEQ ID NO: 812563 - RNA, 31 nt, Human
aacuacaaaaaaaacucugguauuuaacagg

SEQ ID NO: 812564 - RNA, 23 nt, Human
aacugaguguaacacuucaauau

SEQ ID NO: 812565 - RNA, 22 nt, Human
aagaagugagcaauuucagaug

SEQ ID NO: 812566 - RNA, 20 nt, Human
aagacuuaaaaaaauagaaa

SEQ ID NO: 812567 - RNA, 19 nt, Human
aagcauucugaagagaauc

SEQ ID NO: 812568 - RNA, 25 nt, Human
aagcauucugaagagaaucaaauuc

SEQ ID NO: 812569 - RNA, 26 nt, Human
aagugcugggauuacuggcgugagcc

SEQ ID NO: 812570 - RNA, 18 nt, Human
acaaucuuuauucuccuu

SEQ ID NO: 812571 - RNA, 24 nt, Human
acacaaccugcaguucucaaugcu

SEQ ID NO: 812572 - RNA, 22 nt, Human
acccggguucaaacaauucuug

SEQ ID NO: 812573 - RNA, 21 nt, Human
acuacagguguaugccaccau

SEQ ID NO: 812574 - RNA, 22 nt, Human
agaaaaauuuaaacaugauuua

SEQ ID NO: 812575 - RNA, 20 nt, Human
agaagaaaaucagauuuaaa

SEQ ID NO: 812576 - RNA, 19 nt, Human
agcacuguuuacauguaca

SEQ ID NO: 812577 - RNA, 21 nt, Human
agcaguucaaaaaccuuggca

SEQ ID NO: 812578 - RNA, 23 nt, Human
agcugggacuacagguguaugcc

SEQ ID NO: 812579 - RNA, 23 nt, Human
aggguuucaccacguuggccagg

SEQ ID NO: 812580 - RNA, 24 nt, Human
aggugaucugcccgccucggccuc

SEQ ID NO: 812581 - RNA, 18 nt, Human
aguagcugggacuacagg

SEQ ID NO: 812582 - RNA, 25 nt, Human
aguagcugggacuacagguguaugc

SEQ ID NO: 812583 - RNA, 22 nt, Human
agucucaacuaugcaaauuugu

SEQ ID NO: 812584 - RNA, 19 nt, Human
auaauuugaagaaauguca

SEQ ID NO: 812585 - RNA, 20 nt, Human
auaggguuucaccacguugg

SEQ ID NO: 812586 - RNA, 24 nt, Human
auaggguuucaccacguuggccag

SEQ ID NO: 812587 - RNA, 19 nt, Human
auccaggauuaauguaagg

SEQ ID NO: 812588 - RNA, 21 nt, Human
caaaagcauucugaagagaau

SEQ ID NO: 812589 - RNA, 28 nt, Human
caaacaauucuugugccucagccucccg

SEQ ID NO: 812590 - RNA, 24 nt, Human
caaagugcugggauuacuggcgug

SEQ ID NO: 812591 - RNA, 19 nt, Human
cacaaucuuuauucuccuu

SEQ ID NO: 812592 - RNA, 25 nt, Human
cacaguaucaaacaauugaaacaaa

SEQ ID NO: 812593 - RNA, 21 nt, Human
caccacguuggccaggcuggu

SEQ ID NO: 812594 - RNA, 24 nt, Human
caccacguuggccaggcuggucuc

SEQ ID NO: 812595 - RNA, 27 nt, Human
caccacguuggccaggcuggucucaaa

SEQ ID NO: 812596 - RNA, 24 nt, Human
cacguuggccaggcuggucucaaa

SEQ ID NO: 812597 - RNA, 23 nt, Human
cacugcaaccucugccacccggg

SEQ ID NO: 812598 - RNA, 24 nt, Human
cagacaaacauuaacaaaauuaaa

SEQ ID NO: 812599 - RNA, 21 nt, Human
cagcaguucaaaaaccuuggc

SEQ ID NO: 812600 - RNA, 23 nt, Human
cagugcuauguauaacagacaaa

SEQ ID NO: 812601 - RNA, 22 nt, Human
ccaaagugcugggauuacuggc

SEQ ID NO: 812602 - RNA, 24 nt, Human
ccaaagugcugggauuacuggcgu

SEQ ID NO: 812603 - RNA, 23 nt, Human
cccaacacaguacugaaauaccu

SEQ ID NO: 812604 - RNA, 23 nt, Human
cccgaguagcugggacuacaggu

SEQ ID NO: 812605 - RNA, 24 nt, Human
cccgaguagcugggacuacaggug

SEQ ID NO: 812606 - RNA, 19 nt, Human
cccggguucaaacaauucu

SEQ ID NO: 812607 - RNA, 19 nt, Human
cccggguucaaacaauucu

SEQ ID NO: 812608 - RNA, 22 nt, Human
ccugaccucaggugaucugccc

SEQ ID NO: 812609 - RNA, 23 nt, Human
ccugcaguucucaaugcuaucuc

SEQ ID NO: 812610 - RNA, 20 nt, Human
cgaaaauaaaagucuauuuc

SEQ ID NO: 812611 - RNA, 23 nt, Human
cgcagaaacaugaucucagcuca

SEQ ID NO: 812612 - RNA, 24 nt, Human
cgccucggccucccaaagugcugg

SEQ ID NO: 812613 - RNA, 22 nt, Human
cuauguauaacagacaaacauu

SEQ ID NO: 812614 - RNA, 19 nt, Human
cucaaugcuaucucaagau

SEQ ID NO: 812615 - RNA, 21 nt, Human
cucacugcaaccucugccacc

SEQ ID NO: 812616 - RNA, 24 nt, Human
cucacugcaaccucugccacccgg

SEQ ID NO: 812617 - RNA, 24 nt, Human
cucagccucccgaguagcugggac

SEQ ID NO: 812618 - RNA, 18 nt, Human
cuccaaagacauacuaca

SEQ ID NO: 812619 - RNA, 26 nt, Human
cuccugaccucaggugaucugcccgc

SEQ ID NO: 812620 - RNA, 22 nt, Human
cugaaagaaaaaaaaguuggau

SEQ ID NO: 812621 - RNA, 24 nt, Human
cugcaaccucugccacccggguuc

SEQ ID NO: 812622 - RNA, 19 nt, Human
cuuggcaaagccaguuauc

SEQ ID NO: 812623 - RNA, 25 nt, Human
cuugugccucagccucccgaguagc

SEQ ID NO: 812624 - RNA, 21 nt, Human
cuuuuuguauuuuuaguagag

SEQ ID NO: 812625 - RNA, 24 nt, Human
cuuuuuguauuuuuaguagagaua

SEQ ID NO: 812626 - RNA, 24 nt, Human
gaccucaggugaucugcccgccuc

SEQ ID NO: 812627 - RNA, 24 nt, Human
gacuacagguguaugccaccaugc

SEQ ID NO: 812628 - RNA, 18 nt, Human
gagcaauuucagaugucc

SEQ ID NO: 812629 - RNA, 18 nt, Human
gauuacuggcgugagcca

SEQ ID NO: 812630 - RNA, 21 nt, Human
gauuacuggcgugagccacua

SEQ ID NO: 812631 - RNA, 22 nt, Human
gauuacuggcgugagccacuac

SEQ ID NO: 812632 - RNA, 21 nt, Human
gcagaaacaugaucucagcuc

SEQ ID NO: 812633 - RNA, 28 nt, Human
gcccaacacaguacugaaauaccuuacc

SEQ ID NO: 812634 - RNA, 27 nt, Human
gcucugucacccaggcuaggagcgcag

SEQ ID NO: 812635 - RNA, 23 nt, Human
gcuggucucaaacuccugaccuc

SEQ ID NO: 812636 - RNA, 24 nt, Human
ggacuacagguguaugccaccaug

SEQ ID NO: 812637 - RNA, 24 nt, Human
ggagucucaacuaugcaaauuugu

SEQ ID NO: 812638 - RNA, 24 nt, Human
ggcuggucucaaacuccugaccuc

SEQ ID NO: 812639 - RNA, 21 nt, Human
ggguuucaccacguuggccag

SEQ ID NO: 812640 - RNA, 22 nt, Human
ggguuucaccacguuggccagg

SEQ ID NO: 812641 - RNA, 21 nt, Human
gguuauuuuaccaaauucaga

SEQ ID NO: 812642 - RNA, 24 nt, Human
gugaucugcccgccucggccuccc

SEQ ID NO: 812643 - RNA, 22 nt, Human
gugccucagccucccgaguagc

SEQ ID NO: 812644 - RNA, 19 nt, Human
guuaaaaaucaaaagagca

SEQ ID NO: 812645 - RNA, 20 nt, Human
uaaaguuuuucagagaccua

SEQ ID NO: 812646 - RNA, 24 nt, Human
uaacaaaauuaaaaacacauucuu

SEQ ID NO: 812647 - RNA, 22 nt, Human
uaacagacaaacauuaacaaaa

SEQ ID NO: 812648 - RNA, 20 nt, Human
uaacagaguacuuacauaua

SEQ ID NO: 812649 - RNA, 22 nt, Human
uaacauaaaacaguuggaaguc

SEQ ID NO: 812650 - RNA, 18 nt, Human
uaacuguuuuaaggaguu

SEQ ID NO: 812651 - RNA, 22 nt, Human
uaaggcaaauuaagacuuaaaa

SEQ ID NO: 812652 - RNA, 24 nt, Human
uaaucagaaaacacaguaaacuac

SEQ ID NO: 812653 - RNA, 26 nt, Human
uaaucuuuuuguauuuuuaguagaga

SEQ ID NO: 812654 - RNA, 21 nt, Human
uaccaguuguguuccccuaac

SEQ ID NO: 812655 - RNA, 18 nt, Human
uaccugacaguuuaggcc

SEQ ID NO: 812656 - RNA, 24 nt, Human
uacuggcgugagccacuacaccug

SEQ ID NO: 812657 - RNA, 22 nt, Human
uagagauaggguuucaccacgu

SEQ ID NO: 812658 - RNA, 19 nt, Human
uagcaucauugggaauuuc

SEQ ID NO: 812659 - RNA, 19 nt, Human
uaguagagauaggguuuca

SEQ ID NO: 812660 - RNA, 26 nt, Human
uaguagagauaggguuucaccacguu

SEQ ID NO: 812661 - RNA, 21 nt, Human
ucacaaucuuuauucuccuua

SEQ ID NO: 812662 - RNA, 23 nt, Human
ucacuccuuaauauucaugcaga

SEQ ID NO: 812663 - RNA, 24 nt, Human
ucacugcaaccucugccacccggg

SEQ ID NO: 812664 - RNA, 23 nt, Human
ucagccucccgaguagcugggac

SEQ ID NO: 812665 - RNA, 18 nt, Human
ucagugccaugcauggua

SEQ ID NO: 812666 - RNA, 18 nt, Human
ucauugggaauuucguca

SEQ ID NO: 812667 - RNA, 24 nt, Human
ucccaaagugcugggauuacuggc

SEQ ID NO: 812668 - RNA, 23 nt, Human
ucccgaguagcugggacuacagg

SEQ ID NO: 812669 - RNA, 24 nt, Human
ucccgaguagcugggacuacaggu

SEQ ID NO: 812670 - RNA, 18 nt, Human
ucccugagcacucuuucu

SEQ ID NO: 812671 - RNA, 18 nt, Human
ucggccucccaaagugcu

SEQ ID NO: 812672 - RNA, 24 nt, Human
ucucaagauuuacagcuccaaaga

SEQ ID NO: 812673 - RNA, 25 nt, Human
ucugucacccaggcuaggagcgcag

SEQ ID NO: 812674 - RNA, 19 nt, Human
ucuugcucugucacccagg

SEQ ID NO: 812675 - RNA, 23 nt, Human
ucuugcucugucacccaggcuag

SEQ ID NO: 812676 - RNA, 23 nt, Human
ucuugcucugucacccaggcuag

SEQ ID NO: 812677 - RNA, 25 nt, Human
ucuugcucugucacccaggcuagga

SEQ ID NO: 812678 - RNA, 18 nt, Human
ugaaauaccuuacccuga

SEQ ID NO: 812679 - RNA, 20 nt, Human
ugaaauaccuuacccugaaa

SEQ ID NO: 812680 - RNA, 18 nt, Human
ugaccucaggugaucugc

SEQ ID NO: 812681 - RNA, 20 nt, Human
ugaccucaggugaucugccc

SEQ ID NO: 812682 - RNA, 24 nt, Human
ugaccucaggugaucugcccgccu

SEQ ID NO: 812683 - RNA, 22 nt, Human
ugagauggagucuugcucuguc

SEQ ID NO: 812684 - RNA, 22 nt, Human
ugccucagccucccgaguagcu

SEQ ID NO: 812685 - RNA, 24 nt, Human
ugccucagccucccgaguagcugg

SEQ ID NO: 812686 - RNA, 19 nt, Human
ugcuaucucaagauuuaca

SEQ ID NO: 812687 - RNA, 25 nt, Human
ugcucugucacccaggcuaggagcg

SEQ ID NO: 812688 - RNA, 19 nt, Human
uggagucuugcucugucac

SEQ ID NO: 812689 - RNA, 24 nt, Human
uggccaggcuggucucaaacuccu

SEQ ID NO: 812690 - RNA, 21 nt, Human
ugggacuacagguguaugcca

SEQ ID NO: 812691 - RNA, 22 nt, Human
ugggacuacagguguaugccac

SEQ ID NO: 812692 - RNA, 24 nt, Human
ugggacuacagguguaugccacca

SEQ ID NO: 812693 - RNA, 25 nt, Human
ugggacuacagguguaugccaccau

SEQ ID NO: 812694 - RNA, 18 nt, Human
ugggauuacuggcgugag

SEQ ID NO: 812695 - RNA, 19 nt, Human
ugggauuacuggcgugagc

SEQ ID NO: 812696 - RNA, 22 nt, Human
ugggauuacuggcgugagccac

SEQ ID NO: 812697 - RNA, 22 nt, Human
ugggauuacuggcgugagccac

SEQ ID NO: 812698 - RNA, 24 nt, Human
ugggauuacuggcgugagccacua

SEQ ID NO: 812699 - RNA, 18 nt, Human
uguaaauaauugcuuucu

SEQ ID NO: 812700 - RNA, 21 nt, Human
uguaaauaauugcuuucuaca

SEQ ID NO: 812701 - RNA, 21 nt, Human
uguacagugggugucucauau

SEQ ID NO: 812702 - RNA, 18 nt, Human
uguucugaagaucuucaa

SEQ ID NO: 812703 - RNA, 18 nt, Human
uuaaagaaaugugaaucc

SEQ ID NO: 812704 - RNA, 18 nt, Human
uuaguagagauaggguuu

SEQ ID NO: 812705 - RNA, 22 nt, Human
uuaguagagauaggguuucacc

SEQ ID NO: 812706 - RNA, 18 nt, Human
uuaguguuccuuuuaaug

SEQ ID NO: 812707 - RNA, 23 nt, Human
uucaaacaauucuugugccucag

SEQ ID NO: 812708 - RNA, 23 nt, Human
uuggaacaaauuuucccugagca

SEQ ID NO: 812709 - RNA, 24 nt, Human
uuuaaucagaaaacacaguaaacu

SEQ ID NO: 812710 - RNA, 22 nt, Human
uuuaucaacuaaaagacucacu

SEQ ID NO: 812711 - RNA, 21 nt, Human
uuucaccacguuggccaggcu

SEQ ID NO: 812712 - RNA, 24 nt, Human
uuuuuaguagagauaggguuucac

SEQ ID NO: 812713 - RNA, 21 nt, Human
uuuuuguauuuuuaguagaga

SEQ ID NO: 812714 - RNA, 18 nt, Human
aaaagggauuaaagggua

SEQ ID NO: 812715 - RNA, 20 nt, Human
aaacuugaaauuuccgagua

SEQ ID NO: 812716 - RNA, 24 nt, Human
aaauaaauaaccuugaaauaaugu

SEQ ID NO: 812717 - RNA, 18 nt, Human
aagcuucugcuuggcgau

SEQ ID NO: 812718 - RNA, 24 nt, Human
acaccagacuaccacuaauuugau

SEQ ID NO: 812719 - RNA, 20 nt, Human
accaucauagaaaacugauc

SEQ ID NO: 812720 - RNA, 18 nt, Human
accugaaaaauucugaug

SEQ ID NO: 812721 - RNA, 22 nt, Human
acuaaucugaccccagcuacau

SEQ ID NO: 812722 - RNA, 26 nt, Human
acuacaguuuccaaacucggcucaca

SEQ ID NO: 812723 - RNA, 22 nt, Human
agaaaauaguuuauuuaaacaa

SEQ ID NO: 812724 - RNA, 19 nt, Human
agacaggaugugucucugg

SEQ ID NO: 812725 - RNA, 23 nt, Human
agacuaccaucauagaaaacuga

SEQ ID NO: 812726 - RNA, 19 nt, Human
agagaagucaauagcagag

SEQ ID NO: 812727 - RNA, 25 nt, Human
auaaaacuuuuccauuuguuuuuuu

SEQ ID NO: 812728 - RNA, 18 nt, Human
auaaggccaacccucccu

SEQ ID NO: 812729 - RNA, 18 nt, Human
caaaguagugcaugggaa

SEQ ID NO: 812730 - RNA, 20 nt, Human
caacuggcagcccucaacuc

SEQ ID NO: 812731 - RNA, 23 nt, Human
caacuggcagcccucaacucuca

SEQ ID NO: 812732 - RNA, 24 nt, Human
cacagagcauacugggaggggaag

SEQ ID NO: 812733 - RNA, 24 nt, Human
cacauaaauccuagacuggccaac

SEQ ID NO: 812734 - RNA, 19 nt, Human
cacauauaccaaagaaaac

SEQ ID NO: 812735 - RNA, 18 nt, Human
cagaaugauccaccaucu

SEQ ID NO: 812736 - RNA, 23 nt, Human
caggucagguucagucaacauuu

SEQ ID NO: 812737 - RNA, 22 nt, Human
caugggcagauaggggcacaaa

SEQ ID NO: 812738 - RNA, 22 nt, Human
cauuaagugcuauaaauucuug

SEQ ID NO: 812739 - RNA, 19 nt, Human
ccaaagaaaacuuucaagu

SEQ ID NO: 812740 - RNA, 24 nt, Human
ccaaagaaaacuuucaagucaucc

SEQ ID NO: 812741 - RNA, 22 nt, Human
ccaacccucccuuauuuuaaaa

SEQ ID NO: 812742 - RNA, 18 nt, Human
ccaccccagacuaccuca

SEQ ID NO: 812743 - RNA, 21 nt, Human
ccagacuaccacuaauuugau

SEQ ID NO: 812744 - RNA, 21 nt, Human
cccaaaauaaacagcuugggc

SEQ ID NO: 812745 - RNA, 22 nt, Human
ccccaccccagacuaccucaac

SEQ ID NO: 812746 - RNA, 24 nt, Human
ccccagacuaccucaacuucuagc

SEQ ID NO: 812747 - RNA, 18 nt, Human
ccgccaccccacucucca

SEQ ID NO: 812748 - RNA, 21 nt, Human
cucacuaucacuacaguuucc

SEQ ID NO: 812749 - RNA, 18 nt, Human
cuccaacuggcagcccuc

SEQ ID NO: 812750 - RNA, 21 nt, Human
cuccgccaccccacucuccaa

SEQ ID NO: 812751 - RNA, 21 nt, Human
cugaaaacguagcagaggcag

SEQ ID NO: 812752 - RNA, 21 nt, Human
cuuaacuuugacauuugugau

SEQ ID NO: 812753 - RNA, 22 nt, Human
cuuggcucccuucuggagaguc

SEQ ID NO: 812754 - RNA, 24 nt, Human
cuuggcucccuucuggagagucug

SEQ ID NO: 812755 - RNA, 19 nt, Human
gaaaaaacagagaugauga

SEQ ID NO: 812756 - RNA, 18 nt, Human
gaaaacguagcagaggca

SEQ ID NO: 812757 - RNA, 18 nt, Human
gaaaccuguuuaucagau

SEQ ID NO: 812758 - RNA, 20 nt, Human
gaagguaauaugcaggucag

SEQ ID NO: 812759 - RNA, 22 nt, Human
gagaaaauugccuauaacugac

SEQ ID NO: 812760 - RNA, 19 nt, Human
gaucaccuaaugaauuuaa

SEQ ID NO: 812761 - RNA, 19 nt, Human
gcagaggcaggccugcccc

SEQ ID NO: 812762 - RNA, 24 nt, Human
gcaggucagguucagucaacauuu

SEQ ID NO: 812763 - RNA, 20 nt, Human
gcuccgccaccccacucucc

SEQ ID NO: 812764 - RNA, 21 nt, Human
ggaauuucucuaaacugguac

SEQ ID NO: 812765 - RNA, 19 nt, Human
ggggaagaagauacugaaa

SEQ ID NO: 812766 - RNA, 23 nt, Human
ggggaagaagauacugaaaacgu

SEQ ID NO: 812767 - RNA, 23 nt, Human
guaaagcuuggaauuucucuaaa

SEQ ID NO: 812768 - RNA, 23 nt, Human
gucagguucagucaacauuucuu

SEQ ID NO: 812769 - RNA, 25 nt, Human
uaaauccuagacuggccaacucaua

SEQ ID NO: 812770 - RNA, 21 nt, Human
uaagcuucugcuuggcgauua

SEQ ID NO: 812771 - RNA, 18 nt, Human
uaccucacuauuuucagu

SEQ ID NO: 812772 - RNA, 22 nt, Human
uagaagaaaauaguuuauuuaa

SEQ ID NO: 812773 - RNA, 19 nt, Human
uagcgaaauggaaucugca

SEQ ID NO: 812774 - RNA, 22 nt, Human
uauaaaucuuugauaagccauu

SEQ ID NO: 812775 - RNA, 23 nt, Human
uauaaaucuuugauaagccauuu

SEQ ID NO: 812776 - RNA, 19 nt, Human
uauaacugaccaagccuau

SEQ ID NO: 812777 - RNA, 27 nt, Human
uauacauaacccaauuaaaugaauaug

SEQ ID NO: 812778 - RNA, 24 nt, Human
uauguacuaauccagaaaucuacu

SEQ ID NO: 812779 - RNA, 24 nt, Human
uauugaagaaaaaacagagaugau

SEQ ID NO: 812780 - RNA, 25 nt, Human
ucagucaacauuucuuguguugaac

SEQ ID NO: 812781 - RNA, 18 nt, Human
ucaucccuguggccccaa

SEQ ID NO: 812782 - RNA, 18 nt, Human
uccagaaugauccaccau

SEQ ID NO: 812783 - RNA, 21 nt, Human
ucccaauagaacuaaucugac

SEQ ID NO: 812784 - RNA, 20 nt, Human
ucccacucaaccugucgccu

SEQ ID NO: 812785 - RNA, 22 nt, Human
uccccaccccagacuaccucaa

SEQ ID NO: 812786 - RNA, 23 nt, Human
ucuagccaauugugcaggcuccg

SEQ ID NO: 812787 - RNA, 24 nt, Human
ucuccaacuggcagcccucaacuc

SEQ ID NO: 812788 - RNA, 22 nt, Human
ucugaagugucaaacaaacccc

SEQ ID NO: 812789 - RNA, 21 nt, Human
ucuuucuuggccucccaagac

SEQ ID NO: 812790 - RNA, 24 nt, Human
ugaaaacuagguguuuguuuucaa

SEQ ID NO: 812791 - RNA, 18 nt, Human
ugaacaaagaucaagcau

SEQ ID NO: 812792 - RNA, 19 nt, Human
ugacaaaucuuaacuuuga

SEQ ID NO: 812793 - RNA, 21 nt, Human
ugauagacacaaauguucuau

SEQ ID NO: 812794 - RNA, 24 nt, Human
ugcaugggaagcagcacaccaaaa

SEQ ID NO: 812795 - RNA, 24 nt, Human
ugccccacucgacuaaaucuauug

SEQ ID NO: 812796 - RNA, 21 nt, Human
ugcucacuaucacuacaguuu

SEQ ID NO: 812797 - RNA, 20 nt, Human
uggcaggcucccacucaacc

SEQ ID NO: 812798 - RNA, 22 nt, Human
uggcaggcucccacucaaccug

SEQ ID NO: 812799 - RNA, 24 nt, Human
uggccccaaaauaaacagcuuggg

SEQ ID NO: 812800 - RNA, 24 nt, Human
ugggcagauaggggcacaaagugg

SEQ ID NO: 812801 - RNA, 25 nt, Human
ugggcagauaggggcacaaaguggu

SEQ ID NO: 812802 - RNA, 20 nt, Human
uguaaagcuuggaauuucuc

SEQ ID NO: 812803 - RNA, 19 nt, Human
uguuccaaaagcacagagc

SEQ ID NO: 812804 - RNA, 19 nt, Human
uuauaugugucagaugagg

SEQ ID NO: 812805 - RNA, 25 nt, Human
uucaacuccagaaugauccaccauc

SEQ ID NO: 812806 - RNA, 18 nt, Human
uucaugggcagauagggg

SEQ ID NO: 812807 - RNA, 22 nt, Human
uuccuggaucuccccacacacc

SEQ ID NO: 812808 - RNA, 20 nt, Human
uuccuggcaauacuuucuaa

SEQ ID NO: 812809 - RNA, 22 nt, Human
uugcugauagacacaaauguuc

SEQ ID NO: 812810 - RNA, 24 nt, Human
uuuaaauccaagccaacuccauau

SEQ ID NO: 812811 - RNA, 21 nt, Human
uuuccuggcaauacuuucuaa

SEQ ID NO: 812812 - RNA, 18 nt, Human
aaaaaacagcagaaaaaa

SEQ ID NO: 812813 - RNA, 25 nt, Human
aaaaagcugcuucucgccuugcuga

SEQ ID NO: 812814 - RNA, 19 nt, Human
aaaaaggagaugcacagaa

SEQ ID NO: 812815 - RNA, 19 nt, Human
aaacagcaagagaucauag

SEQ ID NO: 812816 - RNA, 21 nt, Human
aaacagcaagagaucauagau

SEQ ID NO: 812817 - RNA, 21 nt, Human
aaauaaauagauaaauaaaua

SEQ ID NO: 812818 - RNA, 20 nt, Human
aacccaaaauauccaaaagc

SEQ ID NO: 812819 - RNA, 23 nt, Human
aaccccaagugcaauuccaguac

SEQ ID NO: 812820 - RNA, 22 nt, Human
aacuccuaucuccugacaccuc

SEQ ID NO: 812821 - RNA, 26 nt, Human
aagaaaaaggacuauuuuccaaaugu

SEQ ID NO: 812822 - RNA, 21 nt, Human
aagaaaccucagaagccagca

SEQ ID NO: 812823 - RNA, 19 nt, Human
aagccagcaggagcccaag

SEQ ID NO: 812824 - RNA, 18 nt, Human
aagcugacaagaaaccuc

SEQ ID NO: 812825 - RNA, 19 nt, Human
aauuccugccuccauucuc

SEQ ID NO: 812826 - RNA, 20 nt, Human
acacacacacacacacaaaa

SEQ ID NO: 812827 - RNA, 23 nt, Human
acacacacacacacacacacaca

SEQ ID NO: 812828 - RNA, 23 nt, Human
acacacacacacacacacacaca

SEQ ID NO: 812829 - RNA, 23 nt, Human
acacacacacacacacacacaca

SEQ ID NO: 812830 - RNA, 23 nt, Human
acacacacacacacacacacaca

SEQ ID NO: 812831 - RNA, 23 nt, Human
acacacacacacacacacacaca

SEQ ID NO: 812832 - RNA, 23 nt, Human
acacacacacacacacacacaca

SEQ ID NO: 812833 - RNA, 23 nt, Human
acacacacacacacacacacaca

SEQ ID NO: 812834 - RNA, 23 nt, Human
acacacacacacacacacacaca

SEQ ID NO: 812835 - RNA, 21 nt, Human
acauggcauauccaagccccu

SEQ ID NO: 812836 - RNA, 18 nt, Human
accacgggccuccuguga

SEQ ID NO: 812837 - RNA, 23 nt, Human
acccagagaggggugggguggga

SEQ ID NO: 812838 - RNA, 21 nt, Human
acuucugcccuuccucagggg

SEQ ID NO: 812839 - RNA, 25 nt, Human
agaaaaaaaaaggagaugcacagaa

SEQ ID NO: 812840 - RNA, 19 nt, Human
agacuggcuggcgcugggg

SEQ ID NO: 812841 - RNA, 23 nt, Human
agagagacagucaucaaauaaau

SEQ ID NO: 812842 - RNA, 22 nt, Human
agaguugucuugaugaaggcag

SEQ ID NO: 812843 - RNA, 18 nt, Human
agcccgggcaggcagcag

SEQ ID NO: 812844 - RNA, 22 nt, Human
agcccgggcaggcagcagagaa

SEQ ID NO: 812845 - RNA, 20 nt, Human
agccucugcgccccaagaag

SEQ ID NO: 812846 - RNA, 26 nt, Human
agccucugggcuguuuacaucuuuuu

SEQ ID NO: 812847 - RNA, 24 nt, Human
agcuuacccucucugcccagcccc

SEQ ID NO: 812848 - RNA, 19 nt, Human
aggcacuguguccucuggu

SEQ ID NO: 812849 - RNA, 23 nt, Human
aggcugcacuggguggcauccag

SEQ ID NO: 812850 - RNA, 22 nt, Human
aggguggguggguaggugccag

SEQ ID NO: 812851 - RNA, 24 nt, Human
agguggggagaauuaccacgggcc

SEQ ID NO: 812852 - RNA, 19 nt, Human
agucagcuggugaggggga

SEQ ID NO: 812853 - RNA, 18 nt, Human
auaggaugggaaagauug

SEQ ID NO: 812854 - RNA, 22 nt, Human
augcaguggccucuucacagcu

SEQ ID NO: 812855 - RNA, 23 nt, Human
auggcgguggcggugagacuuuc

SEQ ID NO: 812856 - RNA, 19 nt, Human
auggggaggcugggucguc

SEQ ID NO: 812857 - RNA, 27 nt, Human
caaaaugguccccuagaguugucuuga

SEQ ID NO: 812858 - RNA, 26 nt, Human
caaagugcugaaacguggauuccagu

SEQ ID NO: 812859 - RNA, 21 nt, Human
caaccuguccugacucuucca

SEQ ID NO: 812860 - RNA, 21 nt, Human
caacuccuaucuccugacacc

SEQ ID NO: 812861 - RNA, 24 nt, Human
caacuccuaucuccugacaccucc

SEQ ID NO: 812862 - RNA, 24 nt, Human
caagaaaaaggacuauuuuccaaa

SEQ ID NO: 812863 - RNA, 21 nt, Human
caagacauggcauauccaagc

SEQ ID NO: 812864 - RNA, 22 nt, Human
caagccccucuccccugcacuc

SEQ ID NO: 812865 - RNA, 23 nt, Human
caagccccucuccccugcacucc

SEQ ID NO: 812866 - RNA, 21 nt, Human
caagucaaacguccccaucug

SEQ ID NO: 812867 - RNA, 27 nt, Human
cacacacacacacaaaaccucuguaua

SEQ ID NO: 812868 - RNA, 20 nt, Human
cacacacacacacacacaca

SEQ ID NO: 812869 - RNA, 20 nt, Human
cacacacacacacacacaca

SEQ ID NO: 812870 - RNA, 20 nt, Human
cacacacacacacacacaca

SEQ ID NO: 812871 - RNA, 20 nt, Human
cacacacacacacacacaca

SEQ ID NO: 812872 - RNA, 20 nt, Human
cacacacacacacacacaca

SEQ ID NO: 812873 - RNA, 20 nt, Human
cacacacacacacacacaca

SEQ ID NO: 812874 - RNA, 20 nt, Human
cacacacacacacacacaca

SEQ ID NO: 812875 - RNA, 20 nt, Human
cacacacacacacacacaca

SEQ ID NO: 812876 - RNA, 20 nt, Human
cacacacacacacacacaca

SEQ ID NO: 812877 - RNA, 20 nt, Human
cacacacacacacacacaca

SEQ ID NO: 812878 - RNA, 20 nt, Human
cacacacacacacacacaca

SEQ ID NO: 812879 - RNA, 20 nt, Human
cacacacacacacacacaca

SEQ ID NO: 812880 - RNA, 20 nt, Human
cacacacacacacacacaca

SEQ ID NO: 812881 - RNA, 20 nt, Human
cacacacacacacacacaca

SEQ ID NO: 812882 - RNA, 20 nt, Human
cacacacacacacacacaca

SEQ ID NO: 812883 - RNA, 20 nt, Human
cacacacacacacacacaca

SEQ ID NO: 812884 - RNA, 22 nt, Human
cacacacacacacacacacaca

SEQ ID NO: 812885 - RNA, 22 nt, Human
cacacacacacacacacacaca

SEQ ID NO: 812886 - RNA, 22 nt, Human
cacacacacacacacacacaca

SEQ ID NO: 812887 - RNA, 22 nt, Human
cacacacacacacacacacaca

SEQ ID NO: 812888 - RNA, 22 nt, Human
cacacacacacacacacacaca

SEQ ID NO: 812889 - RNA, 22 nt, Human
cacacacacacacacacacaca

SEQ ID NO: 812890 - RNA, 22 nt, Human
cacacacacacacacacacaca

SEQ ID NO: 812891 - RNA, 18 nt, Human
caccaagaaggcggggag

SEQ ID NO: 812892 - RNA, 18 nt, Human
cacugcuuccaagaaaaa

SEQ ID NO: 812893 - RNA, 23 nt, Human
cacuguagcucauaagccucugg

SEQ ID NO: 812894 - RNA, 26 nt, Human
cagcagaaaaaaaaaggagaugcaca

SEQ ID NO: 812895 - RNA, 21 nt, Human
cagccugggcagaggggaggg

SEQ ID NO: 812896 - RNA, 18 nt, Human
cagcucccggcucugucc

SEQ ID NO: 812897 - RNA, 18 nt, Human
cagcugaacccuuccguu

SEQ ID NO: 812898 - RNA, 22 nt, Human
caggcaccugccaucuggccuu

SEQ ID NO: 812899 - RNA, 18 nt, Human
caguggccucuucacagc

SEQ ID NO: 812900 - RNA, 20 nt, Human
cauccuggcaaaauuccuga

SEQ ID NO: 812901 - RNA, 20 nt, Human
cauggcccucaaaauacaag

SEQ ID NO: 812902 - RNA, 25 nt, Human
ccaaaauauccaaaagcugggaccg

SEQ ID NO: 812903 - RNA, 26 nt, Human
ccaacacacacacacacacacacaca

SEQ ID NO: 812904 - RNA, 22 nt, Human
ccaacccccaccuaaguugcaa

SEQ ID NO: 812905 - RNA, 22 nt, Human
ccaagaaaaaggacuauuuucc

SEQ ID NO: 812906 - RNA, 19 nt, Human
ccacaagccuccggaaagc

SEQ ID NO: 812907 - RNA, 23 nt, Human
ccacgggccuccugugagcagug

SEQ ID NO: 812908 - RNA, 19 nt, Human
ccaggguguuccaggcuua

SEQ ID NO: 812909 - RNA, 19 nt, Human
ccauaacccaaaauaucca

SEQ ID NO: 812910 - RNA, 19 nt, Human
ccaucuggccuucugcagu

SEQ ID NO: 812911 - RNA, 24 nt, Human
ccauggguugauaggaugggaaag

SEQ ID NO: 812912 - RNA, 19 nt, Human
ccauuggucuccucuuuca

SEQ ID NO: 812913 - RNA, 18 nt, Human
cccaaaggggccggggcg

SEQ ID NO: 812914 - RNA, 21 nt, Human
cccaacacacacacacacaca

SEQ ID NO: 812915 - RNA, 22 nt, Human
cccaacuguuggugcccaaggg

SEQ ID NO: 812916 - RNA, 18 nt, Human
cccaccaagucaaacguc

SEQ ID NO: 812917 - RNA, 20 nt, Human
cccaccuaaguugcaacucc

SEQ ID NO: 812918 - RNA, 22 nt, Human
cccacucaccuuuggccucuca

SEQ ID NO: 812919 - RNA, 24 nt, Human
cccacucaccuuuggccucucaaa

SEQ ID NO: 812920 - RNA, 19 nt, Human
cccauaacccaaaauaucc

SEQ ID NO: 812921 - RNA, 24 nt, Human
cccauaacccaaaauauccaaaag

SEQ ID NO: 812922 - RNA, 26 nt, Human
ccccagccaggggggacuugggguga

SEQ ID NO: 812923 - RNA, 22 nt, Human
ccccauaacccaaaauauccaa

SEQ ID NO: 812924 - RNA, 23 nt, Human
ccccauggguugauaggauggga

SEQ ID NO: 812925 - RNA, 18 nt, Human
cccccuuacccucuucuc

SEQ ID NO: 812926 - RNA, 20 nt, Human
ccccguuaucuugaaccugg

SEQ ID NO: 812927 - RNA, 18 nt, Human
ccccuuacccucuucucc

SEQ ID NO: 812928 - RNA, 22 nt, Human
ccccuuacccucuucuccucuu

SEQ ID NO: 812929 - RNA, 18 nt, Human
cccugaugaaacagcaag

SEQ ID NO: 812930 - RNA, 20 nt, Human
cccugcacucuggauucggg

SEQ ID NO: 812931 - RNA, 21 nt, Human
ccgagcucugggaccgcgagg

SEQ ID NO: 812932 - RNA, 22 nt, Human
ccucagaagccagcaggagccc

SEQ ID NO: 812933 - RNA, 19 nt, Human
ccucugguggcacccaguu

SEQ ID NO: 812934 - RNA, 20 nt, Human
ccucugguggcacccaguuc

SEQ ID NO: 812935 - RNA, 19 nt, Human
ccugccaucuggccuucug

SEQ ID NO: 812936 - RNA, 19 nt, Human
ccuucggcgggacuucugc

SEQ ID NO: 812937 - RNA, 22 nt, Human
cgccccagcccgggcaggcagc

SEQ ID NO: 812938 - RNA, 19 nt, Human
cgcucgccaucgccaaccc

SEQ ID NO: 812939 - RNA, 21 nt, Human
cgggcaggcagcagagaaagg

SEQ ID NO: 812940 - RNA, 25 nt, Human
cgguccucucucccucgcucccucc

SEQ ID NO: 812941 - RNA, 23 nt, Human
cguccggggcgcuguccaaagug

SEQ ID NO: 812942 - RNA, 19 nt, Human
cuaggacccaaaugucuuc

SEQ ID NO: 812943 - RNA, 20 nt, Human
cuccaacccccaccuaaguu

SEQ ID NO: 812944 - RNA, 19 nt, Human
cucugagcuggcugagccu

SEQ ID NO: 812945 - RNA, 24 nt, Human
cucugggaccgcgaggggcagcgg

SEQ ID NO: 812946 - RNA, 23 nt, Human
cugaacgcucgccaucgccaacc

SEQ ID NO: 812947 - RNA, 18 nt, Human
cugacaccucccaccaag

SEQ ID NO: 812948 - RNA, 23 nt, Human
cugaugccucucacagcuguccu

SEQ ID NO: 812949 - RNA, 22 nt, Human
cugccccugucccaggcaccug

SEQ ID NO: 812950 - RNA, 18 nt, Human
cuggcaggcgccaaccgg

SEQ ID NO: 812951 - RNA, 21 nt, Human
cuggcuggcgcuggggccugg

SEQ ID NO: 812952 - RNA, 20 nt, Human
cugggccucagggcuguccu

SEQ ID NO: 812953 - RNA, 22 nt, Human
cugggcuuucuucgcccuucug

SEQ ID NO: 812954 - RNA, 23 nt, Human
cuucugggccaaccccagggugu

SEQ ID NO: 812955 - RNA, 22 nt, Human
cuugcagagggucuuggagcag

SEQ ID NO: 812956 - RNA, 18 nt, Human
cuugucucucucccaacu

SEQ ID NO: 812957 - RNA, 19 nt, Human
cuuuucuucuucuuuuucu

SEQ ID NO: 812958 - RNA, 20 nt, Human
gacccagcuuuucugagggu

SEQ ID NO: 812959 - RNA, 19 nt, Human
gagaaagagagacagucau

SEQ ID NO: 812960 - RNA, 22 nt, Human
gagagacagucaucaaauaaau

SEQ ID NO: 812961 - RNA, 21 nt, Human
gagcugcugugccccauccug

SEQ ID NO: 812962 - RNA, 21 nt, Human
gaggggcagcggugauggcgg

SEQ ID NO: 812963 - RNA, 18 nt, Human
gauucgggucuuuucccc

SEQ ID NO: 812964 - RNA, 19 nt, Human
gccagaacuucucaaaaag

SEQ ID NO: 812965 - RNA, 20 nt, Human
gcccgguauggggaggcugg

SEQ ID NO: 812966 - RNA, 21 nt, Human
gcggugauggcgguggcggug

SEQ ID NO: 812967 - RNA, 23 nt, Human
gcugaucuagagagugaagcccc

SEQ ID NO: 812968 - RNA, 27 nt, Human
gcugggcucuguccccuuaccaugcug

SEQ ID NO: 812969 - RNA, 21 nt, Human
ggaccgguccucucucccucg

SEQ ID NO: 812970 - RNA, 21 nt, Human
ggauuucuucuuuuucuucuu

SEQ ID NO: 812971 - RNA, 18 nt, Human
ggcaggcagcagagaaag

SEQ ID NO: 812972 - RNA, 20 nt, Human
gggacuucugcccuuccuca

SEQ ID NO: 812973 - RNA, 20 nt, Human
gggaggcuggcagcgcgaag

SEQ ID NO: 812974 - RNA, 21 nt, Human
gggcagaggggagggggcugg

SEQ ID NO: 812975 - RNA, 19 nt, Human
gggcagcggugauggcggu

SEQ ID NO: 812976 - RNA, 20 nt, Human
gggcagggcuuaggucuggg

SEQ ID NO: 812977 - RNA, 23 nt, Human
gggcauccggggagguggggaga

SEQ ID NO: 812978 - RNA, 18 nt, Human
ggggacaggaggcugggg

SEQ ID NO: 812979 - RNA, 20 nt, Human
ggggagggcaggugguuggg

SEQ ID NO: 812980 - RNA, 26 nt, Human
ggggagggcaggugguugggggaggg

SEQ ID NO: 812981 - RNA, 20 nt, Human
gggggcgacacccagcuccc

SEQ ID NO: 812982 - RNA, 20 nt, Human
ggguacaggccugacccucc

SEQ ID NO: 812983 - RNA, 18 nt, Human
ggguagggagacgucacu

SEQ ID NO: 812984 - RNA, 23 nt, Human
ggguggggugggagagaucggag

SEQ ID NO: 812985 - RNA, 20 nt, Human
gucuccauggagggagacug

SEQ ID NO: 812986 - RNA, 22 nt, Human
guuccaggcuuagagccuucag

SEQ ID NO: 812987 - RNA, 21 nt, Human
uaaaaaacagcagaaaaaaaa

SEQ ID NO: 812988 - RNA, 20 nt, Human
uaaaaagguuugcuaggagc

SEQ ID NO: 812989 - RNA, 22 nt, Human
uaacccaaaauauccaaaagcu

SEQ ID NO: 812990 - RNA, 24 nt, Human
uaacccaaaauauccaaaagcugg

SEQ ID NO: 812991 - RNA, 19 nt, Human
uaauuuaggagaucccccc

SEQ ID NO: 812992 - RNA, 21 nt, Human
uagggagugauccugcuaugu

SEQ ID NO: 812993 - RNA, 22 nt, Human
uagucuuugugggcagggcuua

SEQ ID NO: 812994 - RNA, 20 nt, Human
ucacugcuuccaagaaaaag

SEQ ID NO: 812995 - RNA, 19 nt, Human
ucagggagaaggccaauag

SEQ ID NO: 812996 - RNA, 25 nt, Human
uccaaacgggggcgacacccagcuc

SEQ ID NO: 812997 - RNA, 18 nt, Human
uccaaauguuuucccugg

SEQ ID NO: 812998 - RNA, 20 nt, Human
uccauuagucuuugugggca

SEQ ID NO: 812999 - RNA, 21 nt, Human
ucccaagcugacaagaaaccu

SEQ ID NO: 813000 - RNA, 22 nt, Human
ucccaagcugacaagaaaccuc

SEQ ID NO: 813001 - RNA, 22 nt, Human
ucccaccaagucaaacgucccc

SEQ ID NO: 813002 - RNA, 30 nt, Human
uccccauaacccaaaauauccaaaagcugg

SEQ ID NO: 813003 - RNA, 19 nt, Human
ucccucagucagcucaauu

SEQ ID NO: 813004 - RNA, 20 nt, Human
uccuucugggccaaccccag

SEQ ID NO: 813005 - RNA, 22 nt, Human
ucgcucccuccgugcccugucc

SEQ ID NO: 813006 - RNA, 23 nt, Human
ucucaaaucccauccauaaaaaa

SEQ ID NO: 813007 - RNA, 25 nt, Human
ucuugugccucuucucaucucuucu

SEQ ID NO: 813008 - RNA, 22 nt, Human
ucuuugugggcagggcuuaggu

SEQ ID NO: 813009 - RNA, 22 nt, Human
ugaaacucacccacaagccucc

SEQ ID NO: 813010 - RNA, 19 nt, Human
ugaaggguggguggguagg

SEQ ID NO: 813011 - RNA, 21 nt, Human
ugacaagaaaccucagaagcc

SEQ ID NO: 813012 - RNA, 23 nt, Human
ugacaagaaaccucagaagccag

SEQ ID NO: 813013 - RNA, 23 nt, Human
ugacaccucccaccaagucaaac

SEQ ID NO: 813014 - RNA, 18 nt, Human
ugagcugggacaacgggg

SEQ ID NO: 813015 - RNA, 23 nt, Human
ugagcugggacaacgggguuauu

SEQ ID NO: 813016 - RNA, 18 nt, Human
ugaggaccuccuucucuu

SEQ ID NO: 813017 - RNA, 18 nt, Human
ugagggugagaucaaggu

SEQ ID NO: 813018 - RNA, 20 nt, Human
ugagguugcagggccccugu

SEQ ID NO: 813019 - RNA, 21 nt, Human
ugagguugcagggccccugug

SEQ ID NO: 813020 - RNA, 19 nt, Human
ugauggcgguggcggugag

SEQ ID NO: 813021 - RNA, 24 nt, Human
ugcacagaaauaauuuaggagauc

SEQ ID NO: 813022 - RNA, 23 nt, Human
ugccaggcugcacuggguggcau

SEQ ID NO: 813023 - RNA, 20 nt, Human
ugccaucuggccuucugcag

SEQ ID NO: 813024 - RNA, 25 nt, Human
ugcccagccccagccaggggggacu

SEQ ID NO: 813025 - RNA, 23 nt, Human
ugcccuguccugcugcuguugcc

SEQ ID NO: 813026 - RNA, 23 nt, Human
ugcccuuccucaggggaccggcc

SEQ ID NO: 813027 - RNA, 18 nt, Human
ugcuguugccaccacaaa

SEQ ID NO: 813028 - RNA, 18 nt, Human
uggacugggccucagggc

SEQ ID NO: 813029 - RNA, 24 nt, Human
uggagggagacugaaguccagucu

SEQ ID NO: 813030 - RNA, 19 nt, Human
uggcacuggggaauguuca

SEQ ID NO: 813031 - RNA, 18 nt, Human
ugggaaguggggcuggag

SEQ ID NO: 813032 - RNA, 22 nt, Human
ugggaaguggggcuggagacca

SEQ ID NO: 813033 - RNA, 22 nt, Human
ugggagagaucggaguucaggg

SEQ ID NO: 813034 - RNA, 21 nt, Human
ugggagcagcagcugaacccu

SEQ ID NO: 813035 - RNA, 23 nt, Human
ugggagggauaaagaauguuugg

SEQ ID NO: 813036 - RNA, 22 nt, Human
uggggcuggagaccaaccuguc

SEQ ID NO: 813037 - RNA, 25 nt, Human
uggggugagggcaaaaauaaaggug

SEQ ID NO: 813038 - RNA, 21 nt, Human
uggggugggagagaucggagu

SEQ ID NO: 813039 - RNA, 23 nt, Human
uggggugggagggauaaagaaug

SEQ ID NO: 813040 - RNA, 21 nt, Human
ugguagaggcuccuagcaggc

SEQ ID NO: 813041 - RNA, 18 nt, Human
uggugccucccuaaggga

SEQ ID NO: 813042 - RNA, 19 nt, Human
uguccuugcagagggucuu

SEQ ID NO: 813043 - RNA, 21 nt, Human
ugucuccauggagggagacug

SEQ ID NO: 813044 - RNA, 21 nt, Human
ugugccccauccuggcaaaau

SEQ ID NO: 813045 - RNA, 21 nt, Human
uguggaugaagcagcuggugg

SEQ ID NO: 813046 - RNA, 22 nt, Human
uguggaugaagcagcugguggu

SEQ ID NO: 813047 - RNA, 18 nt, Human
uguuggugcccaagggcu

SEQ ID NO: 813048 - RNA, 21 nt, Human
uguuggugcccaagggcucgg

SEQ ID NO: 813049 - RNA, 19 nt, Human
uuccaguacuaaaccaggg

SEQ ID NO: 813050 - RNA, 30 nt, Human
uucccaagcugacaagaaaccucagaagcc

SEQ ID NO: 813051 - RNA, 22 nt, Human
uuccccauaacccaaaauaucc

SEQ ID NO: 813052 - RNA, 20 nt, Human
uuccgaguggauuucuucuu

SEQ ID NO: 813053 - RNA, 18 nt, Human
uuccucaggggaccggcc

SEQ ID NO: 813054 - RNA, 22 nt, Human
uuccucgccagaacuucucaaa

SEQ ID NO: 813055 - RNA, 19 nt, Human
uuccuggccagggcucaau

SEQ ID NO: 813056 - RNA, 21 nt, Human
uucgacuuugugcagccuugg

SEQ ID NO: 813057 - RNA, 26 nt, Human
uucuucgcccuucugggucggcucca

SEQ ID NO: 813058 - RNA, 21 nt, Human
uugauaggaugggaaagauug

SEQ ID NO: 813059 - RNA, 19 nt, Human
uuggacuaguggggcaucc

SEQ ID NO: 813060 - RNA, 21 nt, Human
uuugguggcucugggaagccu

SEQ ID NO: 813061 - RNA, 21 nt, Human
uuugugucagccaugcagugg

SEQ ID NO: 813062 - RNA, 24 nt, Human
uuugugucagccaugcaguggccu

SEQ ID NO: 813063 - RNA, 19 nt, Human
aaaaacaaaaacaaacccc

SEQ ID NO: 813064 - RNA, 20 nt, Human
aaaaacaaaaacaaaccccu

SEQ ID NO: 813065 - RNA, 25 nt, Human
aaaaacaaaccccuuuucucccuga

SEQ ID NO: 813066 - RNA, 21 nt, Human
aaaacaaaaacaaaccccuuu

SEQ ID NO: 813067 - RNA, 25 nt, Human
aaacaaaccccuuuucucccugagg

SEQ ID NO: 813068 - RNA, 22 nt, Human
aaacacacagauacaacaaacc

SEQ ID NO: 813069 - RNA, 21 nt, Human
aaccacuugagaacagaauga

SEQ ID NO: 813070 - RNA, 25 nt, Human
aagcacacuacugcuuaauaugaau

SEQ ID NO: 813071 - RNA, 23 nt, Human
aagcagaagguugucauucagga

SEQ ID NO: 813072 - RNA, 24 nt, Human
aagcgugugugugugugugugugg

SEQ ID NO: 813073 - RNA, 26 nt, Human
aaugccuauggagggcaggggugggg

SEQ ID NO: 813074 - RNA, 19 nt, Human
acauauuugccuggacucu

SEQ ID NO: 813075 - RNA, 22 nt, Human
acgacggagccugggcgcgcgu

SEQ ID NO: 813076 - RNA, 19 nt, Human
acuccaccuccaaccuggc

SEQ ID NO: 813077 - RNA, 23 nt, Human
acugaaucccucuccucugcagu

SEQ ID NO: 813078 - RNA, 22 nt, Human
agaaaagaagugggugucagaa

SEQ ID NO: 813079 - RNA, 21 nt, Human
agacaggagagagauucagag

SEQ ID NO: 813080 - RNA, 24 nt, Human
agagagaaagguggaggugguugg

SEQ ID NO: 813081 - RNA, 19 nt, Human
agcaggauucauuguaggu

SEQ ID NO: 813082 - RNA, 21 nt, Human
agcauugcuaauggccaggug

SEQ ID NO: 813083 - RNA, 19 nt, Human
agccgaacaagaccuuaga

SEQ ID NO: 813084 - RNA, 21 nt, Human
agccggcuggcccggucggcg

SEQ ID NO: 813085 - RNA, 26 nt, Human
aggaaaaaaaaaaaaagcgcaaaaag

SEQ ID NO: 813086 - RNA, 20 nt, Human
aggaagggggagauggguca

SEQ ID NO: 813087 - RNA, 18 nt, Human
aggaguucucuuagggga

SEQ ID NO: 813088 - RNA, 20 nt, Human
aggcaggagcggaagagaag

SEQ ID NO: 813089 - RNA, 26 nt, Human
aggcaggagcggaagagaagggaccc

SEQ ID NO: 813090 - RNA, 24 nt, Human
aggcagguagguagacuguauggg

SEQ ID NO: 813091 - RNA, 21 nt, Human
agggagaaugaggggguuagc

SEQ ID NO: 813092 - RNA, 21 nt, Human
agggagagcgggcuuuuaagg

SEQ ID NO: 813093 - RNA, 24 nt, Human
agggcagggguggggguggggggu

SEQ ID NO: 813094 - RNA, 20 nt, Human
agguggaggugguugggggc

SEQ ID NO: 813095 - RNA, 22 nt, Human
aggugggggcagggggaagaag

SEQ ID NO: 813096 - RNA, 19 nt, Human
auaaggaaaacgcucccuc

SEQ ID NO: 813097 - RNA, 23 nt, Human
auacaacaaaccacuugagaaca

SEQ ID NO: 813098 - RNA, 25 nt, Human
caaaccacuugagaacagaaugacc

SEQ ID NO: 813099 - RNA, 21 nt, Human
caaagcucaauucccggcugc

SEQ ID NO: 813100 - RNA, 22 nt, Human
caacucagguaccuacaggcaa

SEQ ID NO: 813101 - RNA, 21 nt, Human
caagaaacuacaaauagaaac

SEQ ID NO: 813102 - RNA, 21 nt, Human
cacacagauacaacaaaccac

SEQ ID NO: 813103 - RNA, 19 nt, Human
caccaaacauauuugccug

SEQ ID NO: 813104 - RNA, 21 nt, Human
cacgggggagggggcaggcag

SEQ ID NO: 813105 - RNA, 20 nt, Human
cacuccucccucuuucucuc

SEQ ID NO: 813106 - RNA, 25 nt, Human
cagccgccaagucauuaguaaccga

SEQ ID NO: 813107 - RNA, 25 nt, Human
cagcucaauguuagcuuauagacug

SEQ ID NO: 813108 - RNA, 21 nt, Human
cagcuccuagcucagaugcuc

SEQ ID NO: 813109 - RNA, 22 nt, Human
caggaugagcacuuugagcuug

SEQ ID NO: 813110 - RNA, 23 nt, Human
caggcagaggauccagggcgcgc

SEQ ID NO: 813111 - RNA, 18 nt, Human
caggcugagccucagcug

SEQ ID NO: 813112 - RNA, 22 nt, Human
cagggauuaugagucccagucc

SEQ ID NO: 813113 - RNA, 21 nt, Human
caugcuugcaccugauuuccc

SEQ ID NO: 813114 - RNA, 20 nt, Human
cauucaacaaacauguauua

SEQ ID NO: 813115 - RNA, 18 nt, Human
ccacccacacacgcgccc

SEQ ID NO: 813116 - RNA, 23 nt, Human
ccaggcucuccaggccuaggaag

SEQ ID NO: 813117 - RNA, 21 nt, Human
cccagccucgauggcacugau

SEQ ID NO: 813118 - RNA, 19 nt, Human
cccagcucugauauccaau

SEQ ID NO: 813119 - RNA, 19 nt, Human
cccccuuacccucuaauuc

SEQ ID NO: 813120 - RNA, 22 nt, Human
cccugcuaauggccuggcaccu

SEQ ID NO: 813121 - RNA, 21 nt, Human
ccggaggcuucuagcucgcgc

SEQ ID NO: 813122 - RNA, 24 nt, Human
ccuauggagggcaggggugggggu

SEQ ID NO: 813123 - RNA, 21 nt, Human
ccucccuggccgccugugcca

SEQ ID NO: 813124 - RNA, 21 nt, Human
ccuguggauggccucccaccc

SEQ ID NO: 813125 - RNA, 22 nt, Human
ccuucuucuucuucuaagagcc

SEQ ID NO: 813126 - RNA, 22 nt, Human
ccuuucucuccgggaagggcgg

SEQ ID NO: 813127 - RNA, 24 nt, Human
cgagcugccagggagggacugggg

SEQ ID NO: 813128 - RNA, 19 nt, Human
cgcucagcaucuuuaggca

SEQ ID NO: 813129 - RNA, 21 nt, Human
cggaggcuucuagcucgcgcc

SEQ ID NO: 813130 - RNA, 18 nt, Human
cgggaagggcggggguag

SEQ ID NO: 813131 - RNA, 23 nt, Human
cgggggagggggcaggcagagga

SEQ ID NO: 813132 - RNA, 20 nt, Human
cucacacaucaggagaagac

SEQ ID NO: 813133 - RNA, 20 nt, Human
cucacagacaaucucuccca

SEQ ID NO: 813134 - RNA, 22 nt, Human
cucccuggccgccugugccacc

SEQ ID NO: 813135 - RNA, 24 nt, Human
gaaaacgcucccucuccuugcuga

SEQ ID NO: 813136 - RNA, 23 nt, Human
gaaagccgggagcugauccagaa

SEQ ID NO: 813137 - RNA, 21 nt, Human
gacaggugagaggcacaggag

SEQ ID NO: 813138 - RNA, 20 nt, Human
gagaggcacaggagacuugg

SEQ ID NO: 813139 - RNA, 21 nt, Human
gagaguuuucaggccacugaa

SEQ ID NO: 813140 - RNA, 20 nt, Human
gagcauugcuaauggccagg

SEQ ID NO: 813141 - RNA, 19 nt, Human
gagcccgaccacgcccgcg

SEQ ID NO: 813142 - RNA, 21 nt, Human
gagcgggcuuuuaaggcugug

SEQ ID NO: 813143 - RNA, 21 nt, Human
gagggagaaugaggggguuag

SEQ ID NO: 813144 - RNA, 18 nt, Human
gaggugcagacacagcug

SEQ ID NO: 813145 - RNA, 23 nt, Human
gagugugugugugugugugugug

SEQ ID NO: 813146 - RNA, 21 nt, Human
gauucuguagggaggucggag

SEQ ID NO: 813147 - RNA, 21 nt, Human
gcaggagaagcuccugcagag

SEQ ID NO: 813148 - RNA, 18 nt, Human
gcaggagcggaagagaag

SEQ ID NO: 813149 - RNA, 20 nt, Human
gcaggggugggggugggggg

SEQ ID NO: 813150 - RNA, 21 nt, Human
gcagggguggggguggggggu

SEQ ID NO: 813151 - RNA, 19 nt, Human
gcaggucagagauauuagu

SEQ ID NO: 813152 - RNA, 23 nt, Human
gccacccacacacgcgccccggg

SEQ ID NO: 813153 - RNA, 19 nt, Human
gcggugggggaggguuggg

SEQ ID NO: 813154 - RNA, 18 nt, Human
gcugcgcgaggcgcggag

SEQ ID NO: 813155 - RNA, 18 nt, Human
gcugggucacgucuuucc

SEQ ID NO: 813156 - RNA, 26 nt, Human
ggaaucagggggcuggcggcaggugg

SEQ ID NO: 813157 - RNA, 27 nt, Human
ggacuggggugcgauucuguagggagg

SEQ ID NO: 813158 - RNA, 29 nt, Human
ggagaagcgugugugugugugugugugug

SEQ ID NO: 813159 - RNA, 22 nt, Human
ggagacuuggucugguacacca

SEQ ID NO: 813160 - RNA, 23 nt, Human
ggcagaugcuucccuuccuugca

SEQ ID NO: 813161 - RNA, 18 nt, Human
gggaagaagcgggugcag

SEQ ID NO: 813162 - RNA, 19 nt, Human
gggaggucggagagccggc

SEQ ID NO: 813163 - RNA, 20 nt, Human
gggggagggggcaggcagag

SEQ ID NO: 813164 - RNA, 19 nt, Human
ggggugggggugggggguu

SEQ ID NO: 813165 - RNA, 23 nt, Human
gggugaggaguucucuuagggga

SEQ ID NO: 813166 - RNA, 24 nt, Human
guacaccaugauggguccaaaacu

SEQ ID NO: 813167 - RNA, 18 nt, Human
guagaguuucuuuggacu

SEQ ID NO: 813168 - RNA, 20 nt, Human
guagaguuucuuuggacugg

SEQ ID NO: 813169 - RNA, 19 nt, Human
gugcagagaguggggugug

SEQ ID NO: 813170 - RNA, 20 nt, Human
gugcgugggcccucccuggc

SEQ ID NO: 813171 - RNA, 18 nt, Human
guggauggccucccaccc

SEQ ID NO: 813172 - RNA, 18 nt, Human
guguguggugugccucuu

SEQ ID NO: 813173 - RNA, 21 nt, Human
gugugugugugugugugugug

SEQ ID NO: 813174 - RNA, 21 nt, Human
gugugugugugugugugugug

SEQ ID NO: 813175 - RNA, 21 nt, Human
gugugugugugugugugugug

SEQ ID NO: 813176 - RNA, 18 nt, Human
guuuauaaacuuaggcac

SEQ ID NO: 813177 - RNA, 19 nt, Human
uaaaauaaggaaaacgcuc

SEQ ID NO: 813178 - RNA, 23 nt, Human
uaaacacacagauacaacaaacc

SEQ ID NO: 813179 - RNA, 25 nt, Human
uaaacacacagauacaacaaaccac

SEQ ID NO: 813180 - RNA, 21 nt, Human
uaaccgaguuguccuacuaaa

SEQ ID NO: 813181 - RNA, 21 nt, Human
uacaacaaaccacuugagaac

SEQ ID NO: 813182 - RNA, 22 nt, Human
uacaacaaaccacuugagaaca

SEQ ID NO: 813183 - RNA, 26 nt, Human
uacaacaaaccacuugagaacagaau

SEQ ID NO: 813184 - RNA, 28 nt, Human
uacaacaaaccacuugagaacagaauga

SEQ ID NO: 813185 - RNA, 19 nt, Human
uacaggacuggugccccac

SEQ ID NO: 813186 - RNA, 22 nt, Human
uacagucuugucaagagguuuc

SEQ ID NO: 813187 - RNA, 19 nt, Human
uaccuggguucugaucugg

SEQ ID NO: 813188 - RNA, 18 nt, Human
uacuaggaacaaaucagc

SEQ ID NO: 813189 - RNA, 20 nt, Human
uacuuuacauacagagcccu

SEQ ID NO: 813190 - RNA, 28 nt, Human
uagauaaacacacagauacaacaaacca

SEQ ID NO: 813191 - RNA, 21 nt, Human
uaggagaaaagaggaagcugg

SEQ ID NO: 813192 - RNA, 20 nt, Human
uaguuuauaaacuuaggcac

SEQ ID NO: 813193 - RNA, 21 nt, Human
ucaacucagguaccuacaggc

SEQ ID NO: 813194 - RNA, 19 nt, Human
ucacgggggagggggcagg

SEQ ID NO: 813195 - RNA, 21 nt, Human
ucagaccauugucugagcucu

SEQ ID NO: 813196 - RNA, 19 nt, Human
ucccaagcaagggagaagc

SEQ ID NO: 813197 - RNA, 21 nt, Human
ucccaagcaagggagaagcgu

SEQ ID NO: 813198 - RNA, 21 nt, Human
ucccacaaaacacuucagcuu

SEQ ID NO: 813199 - RNA, 18 nt, Human
ucccagggguucuccugc

SEQ ID NO: 813200 - RNA, 21 nt, Human
ucccggggugaggaaucucca

SEQ ID NO: 813201 - RNA, 18 nt, Human
ucccuauucccccauccc

SEQ ID NO: 813202 - RNA, 21 nt, Human
ucccuccaauauguucaagga

SEQ ID NO: 813203 - RNA, 21 nt, Human
ucccucuuucucucaccuaca

SEQ ID NO: 813204 - RNA, 24 nt, Human
uccuagcaaaggaggcauuuguuu

SEQ ID NO: 813205 - RNA, 20 nt, Human
ucgaagagaucucgggcagc

SEQ ID NO: 813206 - RNA, 18 nt, Human
ucucacagacaaucucuc

SEQ ID NO: 813207 - RNA, 19 nt, Human
ucucacagacaaucucucc

SEQ ID NO: 813208 - RNA, 20 nt, Human
ucucagauucagccugguua

SEQ ID NO: 813209 - RNA, 20 nt, Human
ucuccaggccuaggaaggug

SEQ ID NO: 813210 - RNA, 22 nt, Human
ucuccuguaacccguuguuacc

SEQ ID NO: 813211 - RNA, 20 nt, Human
ucuccuugcugaggcaaggg

SEQ ID NO: 813212 - RNA, 21 nt, Human
ucugcaguccaucaaacauag

SEQ ID NO: 813213 - RNA, 27 nt, Human
ucuggcucuguugcuagaaggucggac

SEQ ID NO: 813214 - RNA, 23 nt, Human
ucuguguguucucucucacuccu

SEQ ID NO: 813215 - RNA, 24 nt, Human
ucuuacagcuccuuggacccaaga

SEQ ID NO: 813216 - RNA, 25 nt, Human
ucuucaggaagugggagaacaaggu

SEQ ID NO: 813217 - RNA, 21 nt, Human
ucuucuucuucuaagagccuu

SEQ ID NO: 813218 - RNA, 20 nt, Human
ugaaaucauugcauuuucca

SEQ ID NO: 813219 - RNA, 18 nt, Human
ugacuggaaucacuggca

SEQ ID NO: 813220 - RNA, 23 nt, Human
ugagaaaaacaaaaacaaacccc

SEQ ID NO: 813221 - RNA, 23 nt, Human
ugagaacagaaugacccuugcuu

SEQ ID NO: 813222 - RNA, 21 nt, Human
ugagaggaaguaagucacaag

SEQ ID NO: 813223 - RNA, 21 nt, Human
ugagaggcacaggagacuugg

SEQ ID NO: 813224 - RNA, 24 nt, Human
ugagaggcuuugcaggcuccccgg

SEQ ID NO: 813225 - RNA, 18 nt, Human
ugagaggugcagacacag

SEQ ID NO: 813226 - RNA, 19 nt, Human
ugaggcagagggacagccc

SEQ ID NO: 813227 - RNA, 21 nt, Human
ugaggcagagggacagcccug

SEQ ID NO: 813228 - RNA, 18 nt, Human
ugaggggguuagcaacac

SEQ ID NO: 813229 - RNA, 20 nt, Human
ugaucugugcauuauuuucu

SEQ ID NO: 813230 - RNA, 20 nt, Human
ugcagagggguuucucaagg

SEQ ID NO: 813231 - RNA, 20 nt, Human
ugccagcuccuagcucagau

SEQ ID NO: 813232 - RNA, 23 nt, Human
ugccaggcugagccucagcuggg

SEQ ID NO: 813233 - RNA, 20 nt, Human
ugccagggagggacuggggu

SEQ ID NO: 813234 - RNA, 20 nt, Human
ugccuggaaaggccuugguu

SEQ ID NO: 813235 - RNA, 23 nt, Human
ugcuacaggacuggugccccacu

SEQ ID NO: 813236 - RNA, 19 nt, Human
ugcugacuuacucaagaaa

SEQ ID NO: 813237 - RNA, 23 nt, Human
uggaaucacuggcacuuuuucug

SEQ ID NO: 813238 - RNA, 21 nt, Human
uggaccaggcaucagaagccc

SEQ ID NO: 813239 - RNA, 22 nt, Human
uggacgugggugucagcauggc

SEQ ID NO: 813240 - RNA, 23 nt, Human
uggacgugggugucagcauggcu

SEQ ID NO: 813241 - RNA, 22 nt, Human
uggcggcagguguagaggagag

SEQ ID NO: 813242 - RNA, 19 nt, Human
uggcgguggcagcagugcg

SEQ ID NO: 813243 - RNA, 20 nt, Human
ugggaaagacagugcgaggu

SEQ ID NO: 813244 - RNA, 19 nt, Human
ugggagccaaaggaagggu

SEQ ID NO: 813245 - RNA, 19 nt, Human
ugggagcgagggagaauga

SEQ ID NO: 813246 - RNA, 21 nt, Human
ugggagcgagggagaaugagg

SEQ ID NO: 813247 - RNA, 24 nt, Human
ugggagugggagccaaaggaaggg

SEQ ID NO: 813248 - RNA, 19 nt, Human
ugggggcagggggaagaag

SEQ ID NO: 813249 - RNA, 24 nt, Human
ugguaggaagggggagauggguca

SEQ ID NO: 813250 - RNA, 18 nt, Human
uggugucuagccaggccu

SEQ ID NO: 813251 - RNA, 20 nt, Human
uggugugccucuuugcuaca

SEQ ID NO: 813252 - RNA, 25 nt, Human
ugguuguuucucagauucagccugg

SEQ ID NO: 813253 - RNA, 23 nt, Human
ugucacagguacagucccagggg

SEQ ID NO: 813254 - RNA, 25 nt, Human
ugucacagguacagucccagggguu

SEQ ID NO: 813255 - RNA, 21 nt, Human
ugucuguguaggagggugagg

SEQ ID NO: 813256 - RNA, 19 nt, Human
uguggaauagauaaacaca

SEQ ID NO: 813257 - RNA, 26 nt, Human
uguggauggccucccacccuucaaag

SEQ ID NO: 813258 - RNA, 27 nt, Human
uguggauggccucccacccuucaaagg

SEQ ID NO: 813259 - RNA, 24 nt, Human
uguguguguguguggugugccucu

SEQ ID NO: 813260 - RNA, 19 nt, Human
ugugugugugugugugagu

SEQ ID NO: 813261 - RNA, 18 nt, Human
ugugugugugugugugug

SEQ ID NO: 813262 - RNA, 18 nt, Human
ugugugugugugugugug

SEQ ID NO: 813263 - RNA, 18 nt, Human
ugugugugugugugugug

SEQ ID NO: 813264 - RNA, 18 nt, Human
ugugugugugugugugug

SEQ ID NO: 813265 - RNA, 18 nt, Human
ugugugugugugugugug

SEQ ID NO: 813266 - RNA, 18 nt, Human
ugugugugugugugugug

SEQ ID NO: 813267 - RNA, 18 nt, Human
ugugugugugugugugug

SEQ ID NO: 813268 - RNA, 18 nt, Human
ugugugugugugugugug

SEQ ID NO: 813269 - RNA, 18 nt, Human
ugugugugugugugugug

SEQ ID NO: 813270 - RNA, 18 nt, Human
ugugugugugugugugug

SEQ ID NO: 813271 - RNA, 18 nt, Human
ugugugugugugugugug

SEQ ID NO: 813272 - RNA, 22 nt, Human
uguguguguguguguguggugu

SEQ ID NO: 813273 - RNA, 26 nt, Human
ugugugugugugugugugugagugaa

SEQ ID NO: 813274 - RNA, 21 nt, Human
ugugugugugugugugugugu

SEQ ID NO: 813275 - RNA, 21 nt, Human
ugugugugugugugugugugu

SEQ ID NO: 813276 - RNA, 21 nt, Human
ugugugugugugugugugugu

SEQ ID NO: 813277 - RNA, 21 nt, Human
ugugugugugugugugugugu

SEQ ID NO: 813278 - RNA, 21 nt, Human
ugugugugugugugugugugu

SEQ ID NO: 813279 - RNA, 21 nt, Human
ugugugugugugugugugugu

SEQ ID NO: 813280 - RNA, 21 nt, Human
ugugugugugugugugugugu

SEQ ID NO: 813281 - RNA, 21 nt, Human
ugugugugugugugugugugu

SEQ ID NO: 813282 - RNA, 21 nt, Human
ugugugugugugugugugugu

SEQ ID NO: 813283 - RNA, 22 nt, Human
ugugugugugugugugugugug

SEQ ID NO: 813284 - RNA, 22 nt, Human
ugugugugugugugugugugug

SEQ ID NO: 813285 - RNA, 22 nt, Human
ugugugugugugugugugugug

SEQ ID NO: 813286 - RNA, 22 nt, Human
ugugugugugugugugugugug

SEQ ID NO: 813287 - RNA, 22 nt, Human
ugugugugugugugugugugug

SEQ ID NO: 813288 - RNA, 22 nt, Human
ugugugugugugugugugugug

SEQ ID NO: 813289 - RNA, 22 nt, Human
uguucucucucacuccucccuc

SEQ ID NO: 813290 - RNA, 21 nt, Human
uuaccuggguucugaucuggc

SEQ ID NO: 813291 - RNA, 23 nt, Human
uuaccuggguucugaucuggcuc

SEQ ID NO: 813292 - RNA, 20 nt, Human
uuccaggggggaugcccugc

SEQ ID NO: 813293 - RNA, 23 nt, Human
uuccugccuguccuugagagucc

SEQ ID NO: 813294 - RNA, 23 nt, Human
uucguuuggauacagucuuguca

SEQ ID NO: 813295 - RNA, 19 nt, Human
uugaaucugagaggcuuug

SEQ ID NO: 813296 - RNA, 19 nt, Human
uugaccaaaugaugugccu

SEQ ID NO: 813297 - RNA, 18 nt, Human
uugcuuucccggaguccc

SEQ ID NO: 813298 - RNA, 19 nt, Human
uuuggacgugggugucagc

SEQ ID NO: 813299 - RNA, 27 nt, Human
uuuucuugagcuuucucccuuucuccu

SEQ ID NO: 813300 - RNA, 19 nt, Human
aaccagccagucuccaccu

SEQ ID NO: 813301 - RNA, 23 nt, Human
aaggagcaggcccagggccuggg

SEQ ID NO: 813302 - RNA, 22 nt, Human
aaggcgccgcaggagguguagg

SEQ ID NO: 813303 - RNA, 22 nt, Human
aaggggaggcagacccuccccg

SEQ ID NO: 813304 - RNA, 23 nt, Human
aagugcugagggaggugguguga

SEQ ID NO: 813305 - RNA, 25 nt, Human
acagaggaagggcucaggaccugga

SEQ ID NO: 813306 - RNA, 23 nt, Human
acagccccucuccucuccugugc

SEQ ID NO: 813307 - RNA, 25 nt, Human
agagaagccaccacccuggccugga

SEQ ID NO: 813308 - RNA, 22 nt, Human
agagauugcugggggagcaugg

SEQ ID NO: 813309 - RNA, 23 nt, Human
agaggaagggcucaggaccugga

SEQ ID NO: 813310 - RNA, 23 nt, Human
agagguuucugcaccccagaggu

SEQ ID NO: 813311 - RNA, 20 nt, Human
agaucaggggaacaggggag

SEQ ID NO: 813312 - RNA, 21 nt, Human
agcaggcccagggccugggca

SEQ ID NO: 813313 - RNA, 23 nt, Human
agccagaacccaggaagaguccc

SEQ ID NO: 813314 - RNA, 23 nt, Human
agcugauugucauucggagaagc

SEQ ID NO: 813315 - RNA, 23 nt, Human
agcugggaaauggggagccuggg

SEQ ID NO: 813316 - RNA, 19 nt, Human
aggacagagaggcuaggcc

SEQ ID NO: 813317 - RNA, 20 nt, Human
aggagccagaacccaggaag

SEQ ID NO: 813318 - RNA, 22 nt, Human
aggagcugggaaauggggagcc

SEQ ID NO: 813319 - RNA, 25 nt, Human
aggccaggggacagaggcugcaggg

SEQ ID NO: 813320 - RNA, 23 nt, Human
aggccaugcagugacugggaagg

SEQ ID NO: 813321 - RNA, 19 nt, Human
aggcccccuucuuccuccc

SEQ ID NO: 813322 - RNA, 18 nt, Human
aggcugaagggugagcug

SEQ ID NO: 813323 - RNA, 18 nt, Human
aggcugugcugggagcug

SEQ ID NO: 813324 - RNA, 21 nt, Human
agggaagagugggcuugggaa

SEQ ID NO: 813325 - RNA, 18 nt, Human
agggaaggacagagaggc

SEQ ID NO: 813326 - RNA, 23 nt, Human
agggagguggugugacacuuuua

SEQ ID NO: 813327 - RNA, 21 nt, Human
agggcgaggaaggggaggcag

SEQ ID NO: 813328 - RNA, 19 nt, Human
aggggacagaggcugcagg

SEQ ID NO: 813329 - RNA, 23 nt, Human
aggggacagaggcugcaggggcc

SEQ ID NO: 813330 - RNA, 23 nt, Human
agggugagcugagggaagagugg

SEQ ID NO: 813331 - RNA, 20 nt, Human
aggugggaggcaguggcccu

SEQ ID NO: 813332 - RNA, 22 nt, Human
augcuuccuggggagaggcaca

SEQ ID NO: 813333 - RNA, 21 nt, Human
augguucccacagaggcucca

SEQ ID NO: 813334 - RNA, 19 nt, Human
caacccagccuggcagucc

SEQ ID NO: 813335 - RNA, 21 nt, Human
caagaaggaacaggcugaagg

SEQ ID NO: 813336 - RNA, 19 nt, Human
cagcccucccucccuccca

SEQ ID NO: 813337 - RNA, 19 nt, Human
cagcugcacgggcuggggu

SEQ ID NO: 813338 - RNA, 23 nt, Human
cagcugggguugggggcaccggg

SEQ ID NO: 813339 - RNA, 23 nt, Human
caggaagaguccccacauccauu

SEQ ID NO: 813340 - RNA, 19 nt, Human
caggagucauauccugguc

SEQ ID NO: 813341 - RNA, 18 nt, Human
caggucagaccugccccc

SEQ ID NO: 813342 - RNA, 24 nt, Human
caguccagaggccgucccuggcca

SEQ ID NO: 813343 - RNA, 23 nt, Human
caguggcccuuccuccacucccu

SEQ ID NO: 813344 - RNA, 19 nt, Human
cauccccugcccacagaau

SEQ ID NO: 813345 - RNA, 21 nt, Human
ccaacccagccuggcagucca

SEQ ID NO: 813346 - RNA, 22 nt, Human
ccaagcugcugacucuccauga

SEQ ID NO: 813347 - RNA, 19 nt, Human
ccacagaggcuccacccaa

SEQ ID NO: 813348 - RNA, 21 nt, Human
ccacccaggaguccuccccuc

SEQ ID NO: 813349 - RNA, 20 nt, Human
ccacuggcccacuuucccuc

SEQ ID NO: 813350 - RNA, 22 nt, Human
ccaguguggccggcugcgggug

SEQ ID NO: 813351 - RNA, 19 nt, Human
ccaugagggggaggcugcu

SEQ ID NO: 813352 - RNA, 21 nt, Human
ccauuccuggaguagagcagc

SEQ ID NO: 813353 - RNA, 22 nt, Human
cccaaaucuggaggcaagaggu

SEQ ID NO: 813354 - RNA, 21 nt, Human
cccacagaaucaccugcccac

SEQ ID NO: 813355 - RNA, 22 nt, Human
cccacagaaucaccugcccacc

SEQ ID NO: 813356 - RNA, 20 nt, Human
cccaggaaggcagcccacac

SEQ ID NO: 813357 - RNA, 18 nt, Human
ccccaacccagccuggca

SEQ ID NO: 813358 - RNA, 19 nt, Human
ccccaccccaugcccacca

SEQ ID NO: 813359 - RNA, 20 nt, Human
ccccgaaucuccgaagggcc

SEQ ID NO: 813360 - RNA, 20 nt, Human
ccccuaggugacccccuccc

SEQ ID NO: 813361 - RNA, 21 nt, Human
cccgagggaggggaagggcaa

SEQ ID NO: 813362 - RNA, 18 nt, Human
cccuaaggccuggcgggg

SEQ ID NO: 813363 - RNA, 22 nt, Human
cccucugcuggacccagagggc

SEQ ID NO: 813364 - RNA, 27 nt, Human
cccugcccacagaaucaccugcccacc

SEQ ID NO: 813365 - RNA, 20 nt, Human
cccuggguccccaacccagc

SEQ ID NO: 813366 - RNA, 20 nt, Human
cccuucuuccucccagcucc

SEQ ID NO: 813367 - RNA, 20 nt, Human
ccucugcccuggaugcuucc

SEQ ID NO: 813368 - RNA, 24 nt, Human
ccuggccacaauggcucccagaag

SEQ ID NO: 813369 - RNA, 18 nt, Human
ccuggggagaggcacaga

SEQ ID NO: 813370 - RNA, 21 nt, Human
ccuggggcacagccccucucc

SEQ ID NO: 813371 - RNA, 24 nt, Human
ccuugugggcauccuuccggguga

SEQ ID NO: 813372 - RNA, 18 nt, Human
ccuuucuuccucuuuccc

SEQ ID NO: 813373 - RNA, 19 nt, Human
cgggcccuaaggccuggcg

SEQ ID NO: 813374 - RNA, 23 nt, Human
cggggugagggugggggaccgcg

SEQ ID NO: 813375 - RNA, 18 nt, Human
cggugugcugcuugcccc

SEQ ID NO: 813376 - RNA, 21 nt, Human
cgucaaaggcuguccacccag

SEQ ID NO: 813377 - RNA, 20 nt, Human
cuccaguguggccggcugcg

SEQ ID NO: 813378 - RNA, 21 nt, Human
cuccccaccccaugcccacca

SEQ ID NO: 813379 - RNA, 21 nt, Human
cugagggaagagugggcuugg

SEQ ID NO: 813380 - RNA, 20 nt, Human
cugcagcugggguugggggc

SEQ ID NO: 813381 - RNA, 24 nt, Human
cuuccuggggagaggcacagaggc

SEQ ID NO: 813382 - RNA, 21 nt, Human
cuugcccacugccucucaccg

SEQ ID NO: 813383 - RNA, 21 nt, Human
gaacgaaccaggcguccccag

SEQ ID NO: 813384 - RNA, 18 nt, Human
gaacucaggaaagagcag

SEQ ID NO: 813385 - RNA, 19 nt, Human
gacaggaaggaauuccuga

SEQ ID NO: 813386 - RNA, 21 nt, Human
gacaggaaggaauuccugaug

SEQ ID NO: 813387 - RNA, 21 nt, Human
gacccccuccccacuggccca

SEQ ID NO: 813388 - RNA, 22 nt, Human
gacccccuccccacuggcccac

SEQ ID NO: 813389 - RNA, 20 nt, Human
gagcagcugcacgggcuggg

SEQ ID NO: 813390 - RNA, 21 nt, Human
gagcaggcccagggccugggc

SEQ ID NO: 813391 - RNA, 20 nt, Human
gagcagguuggcuggaacug

SEQ ID NO: 813392 - RNA, 18 nt, Human
gagccagaacccaggaag

SEQ ID NO: 813393 - RNA, 20 nt, Human
gagccuggggcacagccccu

SEQ ID NO: 813394 - RNA, 21 nt, Human
gagcugagggaagagugggcu

SEQ ID NO: 813395 - RNA, 18 nt, Human
gaggaggcugcagcuggg

SEQ ID NO: 813396 - RNA, 19 nt, Human
gaggaugagaggacacagg

SEQ ID NO: 813397 - RNA, 27 nt, Human
gaggcaagagguuucugcaccccagag

SEQ ID NO: 813398 - RNA, 19 nt, Human
gaggcugcuucucugaagg

SEQ ID NO: 813399 - RNA, 22 nt, Human
gagggggaggcugcuuucaggg

SEQ ID NO: 813400 - RNA, 22 nt, Human
gagguuuggaaucccaagggca

SEQ ID NO: 813401 - RNA, 20 nt, Human
gcaagaaggaacaggcugaa

SEQ ID NO: 813402 - RNA, 18 nt, Human
gcaguagagggccuuggg

SEQ ID NO: 813403 - RNA, 23 nt, Human
gcauguaaacauucuuagguggc

SEQ ID NO: 813404 - RNA, 26 nt, Human
gccagaacccaggaagaguccccagu

SEQ ID NO: 813405 - RNA, 18 nt, Human
gccagcccucccucccuc

SEQ ID NO: 813406 - RNA, 18 nt, Human
gcucccagaagacugugg

SEQ ID NO: 813407 - RNA, 23 nt, Human
gcugggguugggggcaccgggag

SEQ ID NO: 813408 - RNA, 19 nt, Human
gcuguccacccaggagucc

SEQ ID NO: 813409 - RNA, 22 nt, Human
ggaaggaauuccugauggugaa

SEQ ID NO: 813410 - RNA, 18 nt, Human
ggaaggcauguguugggg

SEQ ID NO: 813411 - RNA, 22 nt, Human
ggacgucaaaggcuguccaccu

SEQ ID NO: 813412 - RNA, 21 nt, Human
ggagcacauccccugcccaca

SEQ ID NO: 813413 - RNA, 19 nt, Human
ggagguguaggcagagauu

SEQ ID NO: 813414 - RNA, 20 nt, Human
ggcggcgggaggaugagagg

SEQ ID NO: 813415 - RNA, 21 nt, Human
ggcugcagcugggguuggggg

SEQ ID NO: 813416 - RNA, 19 nt, Human
gggagggaaggcauguguu

SEQ ID NO: 813417 - RNA, 21 nt, Human
gggcagaggugaggcuggggg

SEQ ID NO: 813418 - RNA, 20 nt, Human
gggcaguagagggccuuggg

SEQ ID NO: 813419 - RNA, 18 nt, Human
gggccuguccagauaggc

SEQ ID NO: 813420 - RNA, 18 nt, Human
ggggaagugcugagggag

SEQ ID NO: 813421 - RNA, 24 nt, Human
ggggaggaggcugcagcugggguu

SEQ ID NO: 813422 - RNA, 24 nt, Human
ggggagggaaggcauguguugggg

SEQ ID NO: 813423 - RNA, 19 nt, Human
ggggccagcugucuguugg

SEQ ID NO: 813424 - RNA, 19 nt, Human
ggggccggggugagggugg

SEQ ID NO: 813425 - RNA, 20 nt, Human
gggguugggggcaccgggag

SEQ ID NO: 813426 - RNA, 21 nt, Human
gggugagggugggggaccgcg

SEQ ID NO: 813427 - RNA, 24 nt, Human
gggugaugguggcuggacgcagcc

SEQ ID NO: 813428 - RNA, 21 nt, Human
ggguggacaggugcaggaugg

SEQ ID NO: 813429 - RNA, 19 nt, Human
ggugaggcugggggcccua

SEQ ID NO: 813430 - RNA, 22 nt, Human
gguguuggggugggguggacag

SEQ ID NO: 813431 - RNA, 23 nt, Human
guccacccaggaguccuccccuc

SEQ ID NO: 813432 - RNA, 19 nt, Human
guccccaacccagccuggc

SEQ ID NO: 813433 - RNA, 22 nt, Human
gugacacuuuuacagaggaagg

SEQ ID NO: 813434 - RNA, 20 nt, Human
guggcccuuccuccacuccc

SEQ ID NO: 813435 - RNA, 18 nt, Human
guggcugagccuuccccg

SEQ ID NO: 813436 - RNA, 21 nt, Human
guguuggggugggguggacag

SEQ ID NO: 813437 - RNA, 18 nt, Human
guugguccaccugucucu

SEQ ID NO: 813438 - RNA, 21 nt, Human
uaaagcccccuccaacuuccc

SEQ ID NO: 813439 - RNA, 19 nt, Human
ucaaaggcuguccacccag

SEQ ID NO: 813440 - RNA, 19 nt, Human
ucaggaccuggaggccugg

SEQ ID NO: 813441 - RNA, 23 nt, Human
ucagggggaggaggcugcagcug

SEQ ID NO: 813442 - RNA, 21 nt, Human
ucaguugggagcccuagggag

SEQ ID NO: 813443 - RNA, 19 nt, Human
uccaguguggccggcugcg

SEQ ID NO: 813444 - RNA, 19 nt, Human
ucccacagaggcuccaccc

SEQ ID NO: 813445 - RNA, 22 nt, Human
ucccacagaggcuccacccaaa

SEQ ID NO: 813446 - RNA, 23 nt, Human
uccccuaggugacccccucccca

SEQ ID NO: 813447 - RNA, 19 nt, Human
ucccucugcuggacccaga

SEQ ID NO: 813448 - RNA, 20 nt, Human
ucccucugcuggacccagag

SEQ ID NO: 813449 - RNA, 19 nt, Human
ucccugcuccccaccccau

SEQ ID NO: 813450 - RNA, 23 nt, Human
ucccugcuccccaccccaugccc

SEQ ID NO: 813451 - RNA, 18 nt, Human
ucccuggaugucuuggcu

SEQ ID NO: 813452 - RNA, 21 nt, Human
ucccuggaugucuuggcuugc

SEQ ID NO: 813453 - RNA, 22 nt, Human
ucccuggguccccaacccagcc

SEQ ID NO: 813454 - RNA, 23 nt, Human
ucccuggguccccaacccagccu

SEQ ID NO: 813455 - RNA, 21 nt, Human
uccgggugaugguggcuggac

SEQ ID NO: 813456 - RNA, 20 nt, Human
uccuaugguucccacagagg

SEQ ID NO: 813457 - RNA, 23 nt, Human
uccuggggagaggcacagaggca

SEQ ID NO: 813458 - RNA, 22 nt, Human
uccuggggcagaggugaggcug

SEQ ID NO: 813459 - RNA, 24 nt, Human
ucucaccgaguuguccaggaugga

SEQ ID NO: 813460 - RNA, 19 nt, Human
ucugcagagaagccaccac

SEQ ID NO: 813461 - RNA, 19 nt, Human
ucugugacucagggaagga

SEQ ID NO: 813462 - RNA, 19 nt, Human
ugaagggguggggggacuu

SEQ ID NO: 813463 - RNA, 21 nt, Human
ugacacuuuuacagaggaagg

SEQ ID NO: 813464 - RNA, 24 nt, Human
ugacaguggcuuccaggguguugg

SEQ ID NO: 813465 - RNA, 20 nt, Human
ugagcagacccugcaucuga

SEQ ID NO: 813466 - RNA, 24 nt, Human
ugagcagacccugcaucugaguca

SEQ ID NO: 813467 - RNA, 23 nt, Human
ugaggcugggggcccuacauuca

SEQ ID NO: 813468 - RNA, 19 nt, Human
ugaggucaguugggagccc

SEQ ID NO: 813469 - RNA, 21 nt, Human
ugaguagaccgauguucccug

SEQ ID NO: 813470 - RNA, 21 nt, Human
ugaguagaccgauguucccug

SEQ ID NO: 813471 - RNA, 22 nt, Human
ugcacgggcuggggucagggca

SEQ ID NO: 813472 - RNA, 19 nt, Human
ugcagcugggguugggggc

SEQ ID NO: 813473 - RNA, 22 nt, Human
ugcccacccaucuccaagauca

SEQ ID NO: 813474 - RNA, 22 nt, Human
ugcccaggaaggcagcccacac

SEQ ID NO: 813475 - RNA, 20 nt, Human
ugcugagugaagcugggggu

SEQ ID NO: 813476 - RNA, 21 nt, Human
ugcugggagcugcuccagugu

SEQ ID NO: 813477 - RNA, 25 nt, Human
uggaaaggggucggaggagggcaag

SEQ ID NO: 813478 - RNA, 21 nt, Human
uggaguucagaagacugagca

SEQ ID NO: 813479 - RNA, 21 nt, Human
uggccacaauggcucccagaa

SEQ ID NO: 813480 - RNA, 22 nt, Human
ugggaagggcuuggggaggggu

SEQ ID NO: 813481 - RNA, 22 nt, Human
ugggaagggcuuggggaggggu

SEQ ID NO: 813482 - RNA, 23 nt, Human
ugggcauccuuccgggugauggu

SEQ ID NO: 813483 - RNA, 21 nt, Human
ugggcuggggacccaucacuc

SEQ ID NO: 813484 - RNA, 21 nt, Human
uggggagaggcacagaggcag

SEQ ID NO: 813485 - RNA, 19 nt, Human
uggggcaggucagaccugc

SEQ ID NO: 813486 - RNA, 19 nt, Human
uggggccgcggguggcgcg

SEQ ID NO: 813487 - RNA, 19 nt, Human
uggggggccggggugaggg

SEQ ID NO: 813488 - RNA, 19 nt, Human
uggggggccggggugaggg

SEQ ID NO: 813489 - RNA, 18 nt, Human
uggguuuugcgucucugc

SEQ ID NO: 813490 - RNA, 24 nt, Human
ugguggcaaggagcaggcccaggg

SEQ ID NO: 813491 - RNA, 19 nt, Human
ugugauggcuacuucccuu

SEQ ID NO: 813492 - RNA, 27 nt, Human
ugugggcauccuuccgggugauggugg

SEQ ID NO: 813493 - RNA, 22 nt, Human
uguuggggugagcagacccugc

SEQ ID NO: 813494 - RNA, 21 nt, Human
uuccaggguguuggggugggg

SEQ ID NO: 813495 - RNA, 23 nt, Human
uucccgagggaggggaagggcaa

SEQ ID NO: 813496 - RNA, 24 nt, Human
uuccugaguguucugggagcuucu

SEQ ID NO: 813497 - RNA, 21 nt, Human
uuccuggggagaggcacagag

SEQ ID NO: 813498 - RNA, 19 nt, Human
uucuuccucccagcuccaa

SEQ ID NO: 813499 - RNA, 19 nt, Human
aaaagaaacauaaaaaaaa

SEQ ID NO: 813500 - RNA, 23 nt, Human
aaaccaauaauucccccaaaaaa

SEQ ID NO: 813501 - RNA, 27 nt, Human
aacaggaaauaaaaaauaagggacccc

SEQ ID NO: 813502 - RNA, 25 nt, Human
aacauaaaaaaaaaaaccaauaauu

SEQ ID NO: 813503 - RNA, 21 nt, Human
aaccacuugacgcggaccacc

SEQ ID NO: 813504 - RNA, 22 nt, Human
aagaaacauaaaaaaaaaaacc

SEQ ID NO: 813505 - RNA, 21 nt, Human
aagcgccccuccccaccgaau

SEQ ID NO: 813506 - RNA, 20 nt, Human
aagggugcuugggaagccca

SEQ ID NO: 813507 - RNA, 23 nt, Human
accaggcacuugugcgacaccgu

SEQ ID NO: 813508 - RNA, 20 nt, Human
accgaauccccagucugcau

SEQ ID NO: 813509 - RNA, 25 nt, Human
accuggugccuuugacagacacucc

SEQ ID NO: 813510 - RNA, 24 nt, Human
acucacccgggcauccacgugcac

SEQ ID NO: 813511 - RNA, 22 nt, Human
agcagcagccuggagggccggc

SEQ ID NO: 813512 - RNA, 23 nt, Human
agcggcucugugaucuuggaggg

SEQ ID NO: 813513 - RNA, 24 nt, Human
agguuggggcggccggcagagagg

SEQ ID NO: 813514 - RNA, 27 nt, Human
augcgugcacacacgugcaugcacaca

SEQ ID NO: 813515 - RNA, 20 nt, Human
caaaagaaacauaaaaaaaa

SEQ ID NO: 813516 - RNA, 18 nt, Human
caacaaacaaaauuccaa

SEQ ID NO: 813517 - RNA, 18 nt, Human
caagcagggacccugggc

SEQ ID NO: 813518 - RNA, 26 nt, Human
cacacacgugcaugcacacacacuca

SEQ ID NO: 813519 - RNA, 21 nt, Human
cacagaauuugccaacaaaca

SEQ ID NO: 813520 - RNA, 22 nt, Human
cacagaauuugccaacaaacaa

SEQ ID NO: 813521 - RNA, 21 nt, Human
caccaggcacuugugcgacac

SEQ ID NO: 813522 - RNA, 23 nt, Human
cacccgggcccccacgcagcagc

SEQ ID NO: 813523 - RNA, 25 nt, Human
cacccgggcccccacgcagcagcag

SEQ ID NO: 813524 - RNA, 28 nt, Human
cacgugcacaccuggccccaugcacacg

SEQ ID NO: 813525 - RNA, 22 nt, Human
cacuucucuauccuggggggug

SEQ ID NO: 813526 - RNA, 24 nt, Human
cagcagccuggagggccggccugg

SEQ ID NO: 813527 - RNA, 18 nt, Human
cagcaucugcucauacug

SEQ ID NO: 813528 - RNA, 25 nt, Human
cagcgguucuuccuccgggcccucc

SEQ ID NO: 813529 - RNA, 19 nt, Human
cagggacccugggcuuggg

SEQ ID NO: 813530 - RNA, 19 nt, Human
cagguggcccgcagggccc

SEQ ID NO: 813531 - RNA, 25 nt, Human
caucuccuugccgcgcacgauggcc

SEQ ID NO: 813532 - RNA, 21 nt, Human
caugcacacaacgcacguggu

SEQ ID NO: 813533 - RNA, 22 nt, Human
caugcacacgccugcaggagcg

SEQ ID NO: 813534 - RNA, 22 nt, Human
cauuuucguccacaugcgagga

SEQ ID NO: 813535 - RNA, 18 nt, Human
ccaaaaaacaaacccaaa

SEQ ID NO: 813536 - RNA, 18 nt, Human
ccaggcccaccaccaggc

SEQ ID NO: 813537 - RNA, 21 nt, Human
ccauccugagagggugggggc

SEQ ID NO: 813538 - RNA, 20 nt, Human
cccaccaccaggcacuugug

SEQ ID NO: 813539 - RNA, 20 nt, Human
cccacccggcucuguucccc

SEQ ID NO: 813540 - RNA, 18 nt, Human
cccaugcacacgccugca

SEQ ID NO: 813541 - RNA, 20 nt, Human
ccccacccggcucuguuccc

SEQ ID NO: 813542 - RNA, 19 nt, Human
ccccacgcagcagcagccu

SEQ ID NO: 813543 - RNA, 21 nt, Human
cccccaaaaaacaaacccaaa

SEQ ID NO: 813544 - RNA, 25 nt, Human
cccccaaaaaacaaacccaaagucu

SEQ ID NO: 813545 - RNA, 22 nt, Human
ccccgauacggaucaucuccuu

SEQ ID NO: 813546 - RNA, 21 nt, Human
ccccuccccaccgaaucccca

SEQ ID NO: 813547 - RNA, 25 nt, Human
cccucccgcagcggcucugugaucu

SEQ ID NO: 813548 - RNA, 18 nt, Human
cccucggggcacaggugg

SEQ ID NO: 813549 - RNA, 18 nt, Human
ccgcccucggggcacagg

SEQ ID NO: 813550 - RNA, 19 nt, Human
ccgccgggaggcugcggcu

SEQ ID NO: 813551 - RNA, 20 nt, Human
ccgcucagccagcgguucuu

SEQ ID NO: 813552 - RNA, 18 nt, Human
ccucuccaccuggugccu

SEQ ID NO: 813553 - RNA, 19 nt, Human
ccucucccucuucucuccc

SEQ ID NO: 813554 - RNA, 23 nt, Human
ccucucccucuucucucccuaac

SEQ ID NO: 813555 - RNA, 24 nt, Human
ccucuggcuggagacccgcagggc

SEQ ID NO: 813556 - RNA, 20 nt, Human
ccuggccaagugcuugcaac

SEQ ID NO: 813557 - RNA, 20 nt, Human
ccuggccccaugcacacgcc

SEQ ID NO: 813558 - RNA, 21 nt, Human
ccuucaccucccgcucagcca

SEQ ID NO: 813559 - RNA, 19 nt, Human
ccuuugacagacacuccgg

SEQ ID NO: 813560 - RNA, 21 nt, Human
cgcaugcacacaacgcacgug

SEQ ID NO: 813561 - RNA, 26 nt, Human
cgcaugcacacaacgcacguggucuc

SEQ ID NO: 813562 - RNA, 21 nt, Human
cgcgcgcuccaugaaguccuu

SEQ ID NO: 813563 - RNA, 21 nt, Human
cgcucgcaugcacacaacgca

SEQ ID NO: 813564 - RNA, 18 nt, Human
cggcagagaggaacacgg

SEQ ID NO: 813565 - RNA, 26 nt, Human
cguggccgggcgacaguuucagcacc

SEQ ID NO: 813566 - RNA, 20 nt, Human
cguggugggcucguaggugc

SEQ ID NO: 813567 - RNA, 18 nt, Human
cucauacugcuccaggcc

SEQ ID NO: 813568 - RNA, 22 nt, Human
cuccaggcccaccaccaggcac

SEQ ID NO: 813569 - RNA, 24 nt, Human
cuccaugaaguccuuccucuggcu

SEQ ID NO: 813570 - RNA, 25 nt, Human
cucccuccuggguggggaggggcca

SEQ ID NO: 813571 - RNA, 18 nt, Human
cuccuggguggggagggg

SEQ ID NO: 813572 - RNA, 18 nt, Human
cuggccccaugcacacgc

SEQ ID NO: 813573 - RNA, 21 nt, Human
cuggguggggaggggccaggc

SEQ ID NO: 813574 - RNA, 23 nt, Human
cuuuuuuuuuaugaaaaaagauc

SEQ ID NO: 813575 - RNA, 18 nt, Human
gaacacggcacagucccc

SEQ ID NO: 813576 - RNA, 18 nt, Human
gaggaacacggcacaguc

SEQ ID NO: 813577 - RNA, 22 nt, Human
gaggcugcggcuggacuucugg

SEQ ID NO: 813578 - RNA, 22 nt, Human
gaucacacagaauuugccaaca

SEQ ID NO: 813579 - RNA, 19 nt, Human
gcacgggcacgccguccgu

SEQ ID NO: 813580 - RNA, 20 nt, Human
gcaugcacacaacgcacgug

SEQ ID NO: 813581 - RNA, 31 nt, Human
gcaugugcacaugcgugcacacacgugcaug

SEQ ID NO: 813582 - RNA, 19 nt, Human
gccaacaaacaaaauucca

SEQ ID NO: 813583 - RNA, 19 nt, Human
gccgcccucggggcacagg

SEQ ID NO: 813584 - RNA, 22 nt, Human
gccggcuccugccucucccucu

SEQ ID NO: 813585 - RNA, 20 nt, Human
gccugugccgggcccucucc

SEQ ID NO: 813586 - RNA, 21 nt, Human
gcucagccagcgguucuuccu

SEQ ID NO: 813587 - RNA, 18 nt, Human
ggacccugggcuugggcc

SEQ ID NO: 813588 - RNA, 20 nt, Human
ggcacugagggguuggaagg

SEQ ID NO: 813589 - RNA, 24 nt, Human
ggcaugugcacaugcgugcacaca

SEQ ID NO: 813590 - RNA, 21 nt, Human
ggccgggcgacaguuucagca

SEQ ID NO: 813591 - RNA, 19 nt, Human
gggcagggccccuggcaca

SEQ ID NO: 813592 - RNA, 20 nt, Human
ggggggugugcuggggacug

SEQ ID NO: 813593 - RNA, 27 nt, Human
ggggugugcuggggacugaccacuggg

SEQ ID NO: 813594 - RNA, 19 nt, Human
gggugggccugugccgggc

SEQ ID NO: 813595 - RNA, 20 nt, Human
ggucuccucggggugguaga

SEQ ID NO: 813596 - RNA, 18 nt, Human
ggugcuugggaagcccag

SEQ ID NO: 813597 - RNA, 18 nt, Human
gguggggaggggccaggc

SEQ ID NO: 813598 - RNA, 19 nt, Human
guacaguacacuugguggg

SEQ ID NO: 813599 - RNA, 22 nt, Human
guacuucuuggucuucagcauc

SEQ ID NO: 813600 - RNA, 24 nt, Human
gugcccgcgagguaguacaggccc

SEQ ID NO: 813601 - RNA, 25 nt, Human
gugccgggcccucuccaccuggucg

SEQ ID NO: 813602 - RNA, 25 nt, Human
guggccgggcgacaguuucagcacc

SEQ ID NO: 813603 - RNA, 18 nt, Human
guugccccacgacuccca

SEQ ID NO: 813604 - RNA, 18 nt, Human
uaggugcccgcgagguag

SEQ ID NO: 813605 - RNA, 27 nt, Human
uccaaaagaaacauaaaaaaaaaaacc

SEQ ID NO: 813606 - RNA, 20 nt, Human
uccacgugcacaccuggccc

SEQ ID NO: 813607 - RNA, 23 nt, Human
uccacgugcacaccuggccccau

SEQ ID NO: 813608 - RNA, 18 nt, Human
uccccaccgaauccccag

SEQ ID NO: 813609 - RNA, 19 nt, Human
ucccccaaaaaacaaaccc

SEQ ID NO: 813610 - RNA, 22 nt, Human
ucccccaaaaaacaaacccaaa

SEQ ID NO: 813611 - RNA, 23 nt, Human
uccgcgccauggcagugauggag

SEQ ID NO: 813612 - RNA, 27 nt, Human
uccguggagaagaucaugcccguggug

SEQ ID NO: 813613 - RNA, 24 nt, Human
ucucccucuucucucccuaacaaa

SEQ ID NO: 813614 - RNA, 20 nt, Human
ucugccuucaccucccgcuc

SEQ ID NO: 813615 - RNA, 23 nt, Human
ugagggguuggaagguggggcug

SEQ ID NO: 813616 - RNA, 24 nt, Human
ugccaacaaacaaaauuccaaaag

SEQ ID NO: 813617 - RNA, 19 nt, Human
ugcuugcccgggcuggucu

SEQ ID NO: 813618 - RNA, 19 nt, Human
uggcagugauggagauggg

SEQ ID NO: 813619 - RNA, 21 nt, Human
uggcagugauggagauggguc

SEQ ID NO: 813620 - RNA, 20 nt, Human
uggcccgcagggcccggcgg

SEQ ID NO: 813621 - RNA, 20 nt, Human
uggcuggagacccgcagggc

SEQ ID NO: 813622 - RNA, 19 nt, Human
ugggaagcccagagugagc

SEQ ID NO: 813623 - RNA, 20 nt, Human
uggggacugggaggccggug

SEQ ID NO: 813624 - RNA, 21 nt, Human
uggggcccaagcagggacccu

SEQ ID NO: 813625 - RNA, 18 nt, Human
uggggcggccggcagaga

SEQ ID NO: 813626 - RNA, 19 nt, Human
ugguggggugggcgggggg

SEQ ID NO: 813627 - RNA, 20 nt, Human
ugguggggugggcggggggu

SEQ ID NO: 813628 - RNA, 19 nt, Human
ugugcgacaccgucugcac

SEQ ID NO: 813629 - RNA, 19 nt, Human
uucccuugaaggcuugggg

SEQ ID NO: 813630 - RNA, 24 nt, Human
uuccucuggcuggagacccgcagg

SEQ ID NO: 813631 - RNA, 23 nt, Human
uugguggggugggcggggggugu

SEQ ID NO: 813632 - RNA, 20 nt, Human
uugguuucccuugaaggcuu

SEQ ID NO: 813633 - RNA, 21 nt, Human
uuucccuugaaggcuuggggc

SEQ ID NO: 813634 - RNA, 25 nt, Human
uuucuggggcccaagcagggacccu

SEQ ID NO: 813635 - RNA, 24 nt, Human
uuuggaccagggugggccugugcc

SEQ ID NO: 813636 - RNA, 26 nt, Human
aaaaagagagagagagaaagacaaaa

SEQ ID NO: 813637 - RNA, 18 nt, Human
aaaaggaacugggcggcg

SEQ ID NO: 813638 - RNA, 19 nt, Human
aaacaggaccaagucagcg

SEQ ID NO: 813639 - RNA, 23 nt, Human
aaagacaaaaaaggaacugggcg

SEQ ID NO: 813640 - RNA, 20 nt, Human
aaagagagagagagaaagac

SEQ ID NO: 813641 - RNA, 25 nt, Human
aauacaaaagaaaaacgaaaccaaa

SEQ ID NO: 813642 - RNA, 21 nt, Human
acaaaaaaggaacugggcggc

SEQ ID NO: 813643 - RNA, 18 nt, Human
accagugcucccgccccg

SEQ ID NO: 813644 - RNA, 26 nt, Human
accccuuccuucucuccuccuccccc

SEQ ID NO: 813645 - RNA, 27 nt, Human
accccuuccuucucuccuccuccccca

SEQ ID NO: 813646 - RNA, 22 nt, Human
acuggaauuguaggcaacugga

SEQ ID NO: 813647 - RNA, 24 nt, Human
agaaaaacgaaaccaaaucgcagg

SEQ ID NO: 813648 - RNA, 22 nt, Human
agaaagacaaaaaaggaacugg

SEQ ID NO: 813649 - RNA, 18 nt, Human
agacaaaaaaggaacugg

SEQ ID NO: 813650 - RNA, 20 nt, Human
agagaaagacaaaaaaggaa

SEQ ID NO: 813651 - RNA, 22 nt, Human
agcaccugggagcaccucgggc

SEQ ID NO: 813652 - RNA, 20 nt, Human
agcgacggggucaggcggga

SEQ ID NO: 813653 - RNA, 21 nt, Human
agcgcgggccgggcggggggc

SEQ ID NO: 813654 - RNA, 21 nt, Human
aggccuggggucugguggguu

SEQ ID NO: 813655 - RNA, 22 nt, Human
caccgggccuccggugaggccu

SEQ ID NO: 813656 - RNA, 23 nt, Human
caccgggccuccggugaggccug

SEQ ID NO: 813657 - RNA, 22 nt, Human
cagaaaaaaaaaaaaaaaagag

SEQ ID NO: 813658 - RNA, 24 nt, Human
caggaccaagucagcgacuggaau

SEQ ID NO: 813659 - RNA, 20 nt, Human
ccaccccuuccuucucuccu

SEQ ID NO: 813660 - RNA, 23 nt, Human
ccagugcucccgccccguccccc

SEQ ID NO: 813661 - RNA, 18 nt, Human
ccccccaccccuuccuuc

SEQ ID NO: 813662 - RNA, 21 nt, Human
ccccgggacccccggccuccg

SEQ ID NO: 813663 - RNA, 19 nt, Human
ccccgggaccccgggaccc

SEQ ID NO: 813664 - RNA, 22 nt, Human
ccccgggaccccgggacccccg

SEQ ID NO: 813665 - RNA, 18 nt, Human
ccccugcugcggggggag

SEQ ID NO: 813666 - RNA, 19 nt, Human
ccccuuccuucucuccucc

SEQ ID NO: 813667 - RNA, 20 nt, Human
cccggccucggacgccggcc

SEQ ID NO: 813668 - RNA, 28 nt, Human
cccgggacccccggccuccgggugcggg

SEQ ID NO: 813669 - RNA, 20 nt, Human
cccgucccccuugcagggga

SEQ ID NO: 813670 - RNA, 25 nt, Human
cccuuccuucucuccuccuccccca

SEQ ID NO: 813671 - RNA, 18 nt, Human
ccgugagccuggcacagg

SEQ ID NO: 813672 - RNA, 21 nt, Human
ccuuccuucucuccuccuccc

SEQ ID NO: 813673 - RNA, 18 nt, Human
ccuucucuccuccucccc

SEQ ID NO: 813674 - RNA, 20 nt, Human
cgccagaaaaaaaaaaaaaa

SEQ ID NO: 813675 - RNA, 23 nt, Human
cgccccgucccccuugcagggga

SEQ ID NO: 813676 - RNA, 18 nt, Human
cgggaccccgggaccccc

SEQ ID NO: 813677 - RNA, 21 nt, Human
cggggaccggagucccaaggc

SEQ ID NO: 813678 - RNA, 21 nt, Human
cggggucaggcgggacucgcg

SEQ ID NO: 813679 - RNA, 21 nt, Human
cgggguccgccgccgcccgug

SEQ ID NO: 813680 - RNA, 20 nt, Human
cggugaggccuggggucugg

SEQ ID NO: 813681 - RNA, 24 nt, Human
cucaccgccagaaaaaaaaaaaaa

SEQ ID NO: 813682 - RNA, 18 nt, Human
cucuccuccucccccaga

SEQ ID NO: 813683 - RNA, 22 nt, Human
gaaguuuccaggccccccaccc

SEQ ID NO: 813684 - RNA, 23 nt, Human
gacuggaauuguaggcaacugga

SEQ ID NO: 813685 - RNA, 19 nt, Human
gagaaagacaaaaaaggaa

SEQ ID NO: 813686 - RNA, 20 nt, Human
gagggcagugcgggcgggag

SEQ ID NO: 813687 - RNA, 20 nt, Human
gcaacuggaggucggggucc

SEQ ID NO: 813688 - RNA, 21 nt, Human
gccagaaaaaaaaaaaaaaaa

SEQ ID NO: 813689 - RNA, 19 nt, Human
gccggccccgccccgggac

SEQ ID NO: 813690 - RNA, 25 nt, Human
gggcagugcgggcgggagcgcgggc

SEQ ID NO: 813691 - RNA, 22 nt, Human
ggggagggcagugcgggcggga

SEQ ID NO: 813692 - RNA, 19 nt, Human
ggguccgccgccgcccgug

SEQ ID NO: 813693 - RNA, 20 nt, Human
ggguugcaggaaaaauaaag

SEQ ID NO: 813694 - RNA, 22 nt, Human
guuccguggucaccgggccucc

SEQ ID NO: 813695 - RNA, 24 nt, Human
uacaaacaaaaauaguucucuaca

SEQ ID NO: 813696 - RNA, 19 nt, Human
uagcaccugggagcaccuc

SEQ ID NO: 813697 - RNA, 24 nt, Human
ucaccgccagaaaaaaaaaaaaaa

SEQ ID NO: 813698 - RNA, 26 nt, Human
ucaccgccagaaaaaaaaaaaaaaaa

SEQ ID NO: 813699 - RNA, 22 nt, Human
ucccgccccgucccccuugcag

SEQ ID NO: 813700 - RNA, 21 nt, Human
uccguggucaccgggccuccg

SEQ ID NO: 813701 - RNA, 23 nt, Human
ugcggggggagggcagugcgggc

SEQ ID NO: 813702 - RNA, 19 nt, Human
ugcugcggggggagggcag

SEQ ID NO: 813703 - RNA, 21 nt, Human
uggggcgagcagcguuucucc

SEQ ID NO: 813704 - RNA, 19 nt, Human
uuccaggccccccaccccu

SEQ ID NO: 813705 - RNA, 22 nt, Human
uucucuccuccucccccagacg

SEQ ID NO: 813706 - RNA, 18 nt, Human
uuuuuuuuuuuuuuuuug

SEQ ID NO: 813707 - RNA, 21 nt, Human
uuuuuuuuuuuuuuuuugcag

SEQ ID NO: 813708 - RNA, 21 nt, Human
aaaacuaaacaauagagcaaa

SEQ ID NO: 813709 - RNA, 22 nt, Human
aaacaauagagcaaaacaaacc

SEQ ID NO: 813710 - RNA, 21 nt, Human
aacacaaaaauagcaccagaa

SEQ ID NO: 813711 - RNA, 18 nt, Human
aagcccucucacccuuug

SEQ ID NO: 813712 - RNA, 20 nt, Human
aauggccuacaacaccuucc

SEQ ID NO: 813713 - RNA, 20 nt, Human
acagaguggaccaucucagg

SEQ ID NO: 813714 - RNA, 23 nt, Human
acccaaguaaaaacuaaacaaua

SEQ ID NO: 813715 - RNA, 23 nt, Human
accucagcucugacaucaaggcc

SEQ ID NO: 813716 - RNA, 19 nt, Human
agagcaaaacaaaccaugg

SEQ ID NO: 813717 - RNA, 21 nt, Human
agcaaaacaaaccauggaucu

SEQ ID NO: 813718 - RNA, 26 nt, Human
agcaacagcagcaagacuaagaggga

SEQ ID NO: 813719 - RNA, 22 nt, Human
agcaagacuaagagggaaccua

SEQ ID NO: 813720 - RNA, 21 nt, Human
agcacagaccucaggcuugca

SEQ ID NO: 813721 - RNA, 18 nt, Human
agccgcgcccaucugaaa

SEQ ID NO: 813722 - RNA, 20 nt, Human
agcuggccaaggaggcaggc

SEQ ID NO: 813723 - RNA, 23 nt, Human
agcuguguggucucaaaagggcu

SEQ ID NO: 813724 - RNA, 19 nt, Human
aggcggagcccagagcucc

SEQ ID NO: 813725 - RNA, 22 nt, Human
aggcggucugggccugauuugg

SEQ ID NO: 813726 - RNA, 20 nt, Human
aggcucuagagggcggccau

SEQ ID NO: 813727 - RNA, 20 nt, Human
agggagagcgccgccaugca

SEQ ID NO: 813728 - RNA, 18 nt, Human
agggaggaggcaugaccc

SEQ ID NO: 813729 - RNA, 21 nt, Human
aguuccauacgggaacccggu

SEQ ID NO: 813730 - RNA, 19 nt, Human
aucacaucagcagagacug

SEQ ID NO: 813731 - RNA, 23 nt, Human
caaagcaucaccaccucagcucu

SEQ ID NO: 813732 - RNA, 24 nt, Human
caagaaaacagcuguguggucuca

SEQ ID NO: 813733 - RNA, 20 nt, Human
caaggaagccuguauucaca

SEQ ID NO: 813734 - RNA, 22 nt, Human
caauagagcaaaacaaaccaug

SEQ ID NO: 813735 - RNA, 21 nt, Human
cacaaaaauagcaccagaaac

SEQ ID NO: 813736 - RNA, 24 nt, Human
cacaagaagucaaguggccacaga

SEQ ID NO: 813737 - RNA, 21 nt, Human
caccagaaacuucagaguaac

SEQ ID NO: 813738 - RNA, 18 nt, Human
cacccaauacccccauua

SEQ ID NO: 813739 - RNA, 18 nt, Human
caccucagcucugacauc

SEQ ID NO: 813740 - RNA, 25 nt, Human
caccucagcucugacaucaaggccu

SEQ ID NO: 813741 - RNA, 21 nt, Human
cacgugcgucccaggccuggg

SEQ ID NO: 813742 - RNA, 20 nt, Human
cacuugguuugcgacacucc

SEQ ID NO: 813743 - RNA, 20 nt, Human
cacuuuggaauuccagcaac

SEQ ID NO: 813744 - RNA, 24 nt, Human
cagaccucaggcuugcagcccggc

SEQ ID NO: 813745 - RNA, 23 nt, Human
cagcaagaaagggaaugcugccc

SEQ ID NO: 813746 - RNA, 18 nt, Human
cagcagcaagacuaagag

SEQ ID NO: 813747 - RNA, 20 nt, Human
cagcccggcaggggaggcag

SEQ ID NO: 813748 - RNA, 18 nt, Human
caugacccuguggucaga

SEQ ID NO: 813749 - RNA, 18 nt, Human
caugacccuguggucaga

SEQ ID NO: 813750 - RNA, 22 nt, Human
ccaaggaggcaggccgagacag

SEQ ID NO: 813751 - RNA, 25 nt, Human
ccagcaacagcagcaagacuaagag

SEQ ID NO: 813752 - RNA, 21 nt, Human
ccgcgcccaucugaaaucaca

SEQ ID NO: 813753 - RNA, 19 nt, Human
ccgcgggagcuggcacagg

SEQ ID NO: 813754 - RNA, 19 nt, Human
ccucagggccccuccgcac

SEQ ID NO: 813755 - RNA, 25 nt, Human
ccucucacccuuugacccaccuuca

SEQ ID NO: 813756 - RNA, 22 nt, Human
ccuguggucagagggaggaggc

SEQ ID NO: 813757 - RNA, 22 nt, Human
ccuguggucagagggaggaggc

SEQ ID NO: 813758 - RNA, 20 nt, Human
cgacaagccaugguggggcc

SEQ ID NO: 813759 - RNA, 23 nt, Human
cgcaggggugugggcugagggga

SEQ ID NO: 813760 - RNA, 19 nt, Human
cggcucagaagcaacccuu

SEQ ID NO: 813761 - RNA, 21 nt, Human
cggucccaggcucuugcuccu

SEQ ID NO: 813762 - RNA, 22 nt, Human
cucaaaagggcugcaguggccc

SEQ ID NO: 813763 - RNA, 18 nt, Human
cugaccccgucuguccca

SEQ ID NO: 813764 - RNA, 21 nt, Human
cugcagccccagcccugagca

SEQ ID NO: 813765 - RNA, 23 nt, Human
cuucaagauacuuauggagagaa

SEQ ID NO: 813766 - RNA, 20 nt, Human
cuugcagcccggcaggggag

SEQ ID NO: 813767 - RNA, 27 nt, Human
gaagcccucucacccuuugacccaccu

SEQ ID NO: 813768 - RNA, 21 nt, Human
gaccccgucugucccacccaa

SEQ ID NO: 813769 - RNA, 21 nt, Human
gaccccgucugucccacccaa

SEQ ID NO: 813770 - RNA, 19 nt, Human
gagaaggaagcccucucac

SEQ ID NO: 813771 - RNA, 23 nt, Human
gagcccagagcuccguacagcag

SEQ ID NO: 813772 - RNA, 19 nt, Human
gagccggagcuggccaagg

SEQ ID NO: 813773 - RNA, 21 nt, Human
gagggaggaggccuguugugc

SEQ ID NO: 813774 - RNA, 22 nt, Human
gccauggaggcugggagggaac

SEQ ID NO: 813775 - RNA, 21 nt, Human
gcuccggucccaggcucuugc

SEQ ID NO: 813776 - RNA, 23 nt, Human
gcucuugggggaccaggcggcuc

SEQ ID NO: 813777 - RNA, 21 nt, Human
ggagagaagggugagaaggaa

SEQ ID NO: 813778 - RNA, 25 nt, Human
ggcagcacagaccucaggcuugcag

SEQ ID NO: 813779 - RNA, 24 nt, Human
ggccagggcagcggcucugcagcc

SEQ ID NO: 813780 - RNA, 21 nt, Human
ggccauggaggcugggaggga

SEQ ID NO: 813781 - RNA, 18 nt, Human
ggcugcaguggccccguc

SEQ ID NO: 813782 - RNA, 21 nt, Human
gggccucccugaccccgucug

SEQ ID NO: 813783 - RNA, 21 nt, Human
ggggaacgggagguugugcaa

SEQ ID NO: 813784 - RNA, 19 nt, Human
ggggugugggcugagggga

SEQ ID NO: 813785 - RNA, 21 nt, Human
ggucucaaaagggcugcagug

SEQ ID NO: 813786 - RNA, 22 nt, Human
gugugggcugaggggaugggcu

SEQ ID NO: 813787 - RNA, 21 nt, Human
uacacauugcacccaaguaaa

SEQ ID NO: 813788 - RNA, 26 nt, Human
uaccaagaaaacagcuguguggucuc

SEQ ID NO: 813789 - RNA, 21 nt, Human
uaccaccaucccacggcugcc

SEQ ID NO: 813790 - RNA, 21 nt, Human
uacuugguaccaagaaaacag

SEQ ID NO: 813791 - RNA, 25 nt, Human
uagagcaaaacaaaccauggaucuu

SEQ ID NO: 813792 - RNA, 23 nt, Human
ucccacggcugccucaacuuacu

SEQ ID NO: 813793 - RNA, 24 nt, Human
uccguacagcagggaggcucuaga

SEQ ID NO: 813794 - RNA, 24 nt, Human
ucggugcaugagggugcccuggcc

SEQ ID NO: 813795 - RNA, 19 nt, Human
ucggugcccacagggcgca

SEQ ID NO: 813796 - RNA, 25 nt, Human
ucucagggagccggagcuggcccca

SEQ ID NO: 813797 - RNA, 20 nt, Human
ucuccaaacauuggcuucug

SEQ ID NO: 813798 - RNA, 23 nt, Human
ucucccgcagagcaaauggaggc

SEQ ID NO: 813799 - RNA, 18 nt, Human
ucuucaaguacuugguac

SEQ ID NO: 813800 - RNA, 23 nt, Human
ucuuucacccccagccuuccagc

SEQ ID NO: 813801 - RNA, 23 nt, Human
ugaaaagacaagucacuaugaug

SEQ ID NO: 813802 - RNA, 21 nt, Human
ugaauggccuacaacaccuuc

SEQ ID NO: 813803 - RNA, 18 nt, Human
ugcccacagggcgcaggg

SEQ ID NO: 813804 - RNA, 19 nt, Human
ugggggaccaggcggcuca

SEQ ID NO: 813805 - RNA, 26 nt, Human
ugguggggccucccugaccccgucug

SEQ ID NO: 813806 - RNA, 19 nt, Human
uuggaauuccagcaacagc

SEQ ID NO: 813807 - RNA, 25 nt, Human
uugguaccaagaaaacagcugugug

SEQ ID NO: 813808 - RNA, 23 nt, Human
uuggucucuuucaaauaucaaaa

SEQ ID NO: 813809 - RNA, 18 nt, Human
aacucccucugccccucc

SEQ ID NO: 813810 - RNA, 21 nt, Human
aagagcccagcccuucaaggc

SEQ ID NO: 813811 - RNA, 22 nt, Human
aagcaacauuugauugaaucug

SEQ ID NO: 813812 - RNA, 19 nt, Human
acaggagagggaagcaaca

SEQ ID NO: 813813 - RNA, 19 nt, Human
acaguaagggagauggcgu

SEQ ID NO: 813814 - RNA, 23 nt, Human
accagggcugccgccacugcugc

SEQ ID NO: 813815 - RNA, 18 nt, Human
acuccaggaaggcaagag

SEQ ID NO: 813816 - RNA, 18 nt, Human
agaacucccucugccccu

SEQ ID NO: 813817 - RNA, 21 nt, Human
agaacucccucugccccuccu

SEQ ID NO: 813818 - RNA, 20 nt, Human
agagggaagcaacauuugau

SEQ ID NO: 813819 - RNA, 19 nt, Human
agagggccagaggcugagg

SEQ ID NO: 813820 - RNA, 19 nt, Human
agaguccuugcaggucacc

SEQ ID NO: 813821 - RNA, 18 nt, Human
agcaaacagcaccugggg

SEQ ID NO: 813822 - RNA, 22 nt, Human
agccggggcuggggcuggggcu

SEQ ID NO: 813823 - RNA, 23 nt, Human
agcuggguguagaggacagcagc

SEQ ID NO: 813824 - RNA, 19 nt, Human
aggaagcuuggcccauugg

SEQ ID NO: 813825 - RNA, 21 nt, Human
aggccuccaggcgcacacucc

SEQ ID NO: 813826 - RNA, 18 nt, Human
aggcgaagcgcaagggcc

SEQ ID NO: 813827 - RNA, 19 nt, Human
aguggcauggcggcugcag

SEQ ID NO: 813828 - RNA, 24 nt, Human
cacccaccuacaagcuugggcggc

SEQ ID NO: 813829 - RNA, 21 nt, Human
caccccacaguucuuccugga

SEQ ID NO: 813830 - RNA, 18 nt, Human
cacccccacagcagccuc

SEQ ID NO: 813831 - RNA, 22 nt, Human
cacguggccuaugcacaccacc

SEQ ID NO: 813832 - RNA, 19 nt, Human
cagcaacaguaagggagau

SEQ ID NO: 813833 - RNA, 18 nt, Human
cagcaccgaggcugugca

SEQ ID NO: 813834 - RNA, 18 nt, Human
cagcagcugcugggaaga

SEQ ID NO: 813835 - RNA, 19 nt, Human
cagggaggaggcuggcaac

SEQ ID NO: 813836 - RNA, 18 nt, Human
cagggccaugagcccagc

SEQ ID NO: 813837 - RNA, 21 nt, Human
cagggguaaggcagcaggcac

SEQ ID NO: 813838 - RNA, 19 nt, Human
caucaaugcgccccccauc

SEQ ID NO: 813839 - RNA, 20 nt, Human
ccacgcaggcgaagcgcaag

SEQ ID NO: 813840 - RNA, 18 nt, Human
ccacugcacccucggcaa

SEQ ID NO: 813841 - RNA, 20 nt, Human
ccagcccuucaaggcuccug

SEQ ID NO: 813842 - RNA, 20 nt, Human
ccaggacauggggacagagg

SEQ ID NO: 813843 - RNA, 19 nt, Human
ccagggccaugagcccagc

SEQ ID NO: 813844 - RNA, 23 nt, Human
ccagggccuugggggcgccuccc

SEQ ID NO: 813845 - RNA, 23 nt, Human
cccagggccuugggggcgccucc

SEQ ID NO: 813846 - RNA, 22 nt, Human
ccccaccccacaguucuuccug

SEQ ID NO: 813847 - RNA, 18 nt, Human
cccugcagcucucucccu

SEQ ID NO: 813848 - RNA, 21 nt, Human
ccuaugcacaccacccaccua

SEQ ID NO: 813849 - RNA, 22 nt, Human
ccuaugcacaccacccaccuac

SEQ ID NO: 813850 - RNA, 18 nt, Human
ccuccaggagccgccacu

SEQ ID NO: 813851 - RNA, 23 nt, Human
ccucccagcaggcugcucggcuc

SEQ ID NO: 813852 - RNA, 18 nt, Human
ccuccuccaggagccgcc

SEQ ID NO: 813853 - RNA, 23 nt, Human
ccuccugagcaaacagcaccugg

SEQ ID NO: 813854 - RNA, 20 nt, Human
ccucugggagaggguggccu

SEQ ID NO: 813855 - RNA, 20 nt, Human
ccuggccgcucuagcugugu

SEQ ID NO: 813856 - RNA, 23 nt, Human
cgaggagggggugugcaggcggc

SEQ ID NO: 813857 - RNA, 20 nt, Human
cgcagcauggcagcugggug

SEQ ID NO: 813858 - RNA, 24 nt, Human
cgccaccacugcacccucggcaag

SEQ ID NO: 813859 - RNA, 22 nt, Human
cgccacuccuccuccgagaacc

SEQ ID NO: 813860 - RNA, 25 nt, Human
cggcaagaacgagcagauguggaga

SEQ ID NO: 813861 - RNA, 23 nt, Human
cuagcuguguggggcacccccug

SEQ ID NO: 813862 - RNA, 19 nt, Human
cucaaaugaaaucugugcc

SEQ ID NO: 813863 - RNA, 22 nt, Human
cucaugguggccacuuccugag

SEQ ID NO: 813864 - RNA, 24 nt, Human
cuccaggagccgccacuccuccuc

SEQ ID NO: 813865 - RNA, 20 nt, Human
cucccugcagggguaaggca

SEQ ID NO: 813866 - RNA, 25 nt, Human
cuccugcugcaggggcuucccacag

SEQ ID NO: 813867 - RNA, 18 nt, Human
cucgagcuggagccgggg

SEQ ID NO: 813868 - RNA, 19 nt, Human
cucuguucuccuggggucu

SEQ ID NO: 813869 - RNA, 18 nt, Human
cugcaggggcuucccaca

SEQ ID NO: 813870 - RNA, 20 nt, Human
cugccgccacugcugccagc

SEQ ID NO: 813871 - RNA, 20 nt, Human
cuggagccggggcuggggcu

SEQ ID NO: 813872 - RNA, 24 nt, Human
cugucccugcacuugguaacccca

SEQ ID NO: 813873 - RNA, 19 nt, Human
cuuccacgccaccacugca

SEQ ID NO: 813874 - RNA, 19 nt, Human
gaaggcacccccacagcag

SEQ ID NO: 813875 - RNA, 21 nt, Human
gaaggcacccccacagcagcc

SEQ ID NO: 813876 - RNA, 23 nt, Human
gagcugcaguggagcccaggagg

SEQ ID NO: 813877 - RNA, 21 nt, Human
gagcuguaccugcaccgaggc

SEQ ID NO: 813878 - RNA, 19 nt, Human
gcacuaaagggggaagggg

SEQ ID NO: 813879 - RNA, 21 nt, Human
gccccuccuccaggagccgcc

SEQ ID NO: 813880 - RNA, 20 nt, Human
gccucgggucuucuccuuca

SEQ ID NO: 813881 - RNA, 22 nt, Human
gcgcagcuuccggagggggcag

SEQ ID NO: 813882 - RNA, 25 nt, Human
gcgcagcuuccggagggggggaacc

SEQ ID NO: 813883 - RNA, 26 nt, Human
gcgcagcuuccggagggggggaacgc

SEQ ID NO: 813884 - RNA, 24 nt, Human
ggaagagcugcaguggagcccagg

SEQ ID NO: 813885 - RNA, 23 nt, Human
ggaaggcggucccucuccugggg

SEQ ID NO: 813886 - RNA, 22 nt, Human
ggaaugccaucaaugcgccccc

SEQ ID NO: 813887 - RNA, 21 nt, Human
ggacaggaggcuuacagcugg

SEQ ID NO: 813888 - RNA, 19 nt, Human
ggagcccaggagguucugc

SEQ ID NO: 813889 - RNA, 21 nt, Human
ggagccggggcuggggcuggg

SEQ ID NO: 813890 - RNA, 21 nt, Human
ggcagcucaggcgggcccugg

SEQ ID NO: 813891 - RNA, 20 nt, Human
ggcgaagcgcaagggccuua

SEQ ID NO: 813892 - RNA, 23 nt, Human
ggcgcagcuuccggagggggcag

SEQ ID NO: 813893 - RNA, 22 nt, Human
ggcuggggcuggggcuggggcc

SEQ ID NO: 813894 - RNA, 18 nt, Human
ggcuggugguuaggaggc

SEQ ID NO: 813895 - RNA, 21 nt, Human
gggacagagggacaggaggcu

SEQ ID NO: 813896 - RNA, 22 nt, Human
gggcagcucaggcgggcccugg

SEQ ID NO: 813897 - RNA, 22 nt, Human
gggcuggggcuggggcuggggc

SEQ ID NO: 813898 - RNA, 25 nt, Human
gggcuggggcuggggcuggggccuc

SEQ ID NO: 813899 - RNA, 21 nt, Human
gguugguuguuccaucccaga

SEQ ID NO: 813900 - RNA, 26 nt, Human
guaaggcagcaggcacuaaaggggga

SEQ ID NO: 813901 - RNA, 19 nt, Human
gucccaccaggacaugggg

SEQ ID NO: 813902 - RNA, 22 nt, Human
guccucugggagaggguggccu

SEQ ID NO: 813903 - RNA, 23 nt, Human
gugggucccuucugccuccagua

SEQ ID NO: 813904 - RNA, 23 nt, Human
uaaguccagcuuagaccaggggg

SEQ ID NO: 813905 - RNA, 18 nt, Human
uaccugcaccgaggccgc

SEQ ID NO: 813906 - RNA, 20 nt, Human
uagaacucccucugccccuc

SEQ ID NO: 813907 - RNA, 24 nt, Human
uaugcacaccacccaccuacaagc

SEQ ID NO: 813908 - RNA, 20 nt, Human
ucacugggcagcucaggcgg

SEQ ID NO: 813909 - RNA, 21 nt, Human
uccacagagguaaguccagcu

SEQ ID NO: 813910 - RNA, 21 nt, Human
uccacauccaggaagcuuggc

SEQ ID NO: 813911 - RNA, 21 nt, Human
uccacgccaccacugcacccu

SEQ ID NO: 813912 - RNA, 23 nt, Human
uccacgccaccacugcacccucg

SEQ ID NO: 813913 - RNA, 24 nt, Human
uccacgccaccacugcacccucgg

SEQ ID NO: 813914 - RNA, 20 nt, Human
uccccagccgauucaccugg

SEQ ID NO: 813915 - RNA, 22 nt, Human
ucccugugcuccccaccccaca

SEQ ID NO: 813916 - RNA, 23 nt, Human
ucccugugcuccccaccccacag

SEQ ID NO: 813917 - RNA, 18 nt, Human
uccggagggggagacuca

SEQ ID NO: 813918 - RNA, 24 nt, Human
uccggagggggcagcuccggaggg

SEQ ID NO: 813919 - RNA, 19 nt, Human
uccucugggagaggguggc

SEQ ID NO: 813920 - RNA, 21 nt, Human
ucuccuggccgcucuagcugu

SEQ ID NO: 813921 - RNA, 22 nt, Human
ucuccugggggagcggcuucca

SEQ ID NO: 813922 - RNA, 18 nt, Human
ucucgggucccugugcuc

SEQ ID NO: 813923 - RNA, 21 nt, Human
ucugugaccagggccaugagc

SEQ ID NO: 813924 - RNA, 21 nt, Human
ucuuccauguccaagcuccag

SEQ ID NO: 813925 - RNA, 24 nt, Human
ugagccaagagggccagaggcuga

SEQ ID NO: 813926 - RNA, 23 nt, Human
ugagcuguaccugcaccgaggcc

SEQ ID NO: 813927 - RNA, 18 nt, Human
ugcagggaggaggcuggc

SEQ ID NO: 813928 - RNA, 26 nt, Human
ugcagggaggaggcuggcaacacagg

SEQ ID NO: 813929 - RNA, 26 nt, Human
ugcaguggagcccaggagguucugcc

SEQ ID NO: 813930 - RNA, 18 nt, Human
ugcgaggagggggugugc

SEQ ID NO: 813931 - RNA, 21 nt, Human
ugcugggaagagcugcagugg

SEQ ID NO: 813932 - RNA, 21 nt, Human
uggagcccaggagguucugcc

SEQ ID NO: 813933 - RNA, 23 nt, Human
uggcagcuggguguagaggacag

SEQ ID NO: 813934 - RNA, 22 nt, Human
uggccacuuccugagccaggcc

SEQ ID NO: 813935 - RNA, 19 nt, Human
uggcccagggccuuggggg

SEQ ID NO: 813936 - RNA, 22 nt, Human
uggcggcugcagggaggaggcu

SEQ ID NO: 813937 - RNA, 19 nt, Human
ugggagaggguggccuggg

SEQ ID NO: 813938 - RNA, 19 nt, Human
ugggggagcggcuuccaga

SEQ ID NO: 813939 - RNA, 18 nt, Human
uguagaggacagcagcug

SEQ ID NO: 813940 - RNA, 20 nt, Human
ugugaccagggccaugagcc

SEQ ID NO: 813941 - RNA, 27 nt, Human
uuccuggagggcccucugcacuccucc

SEQ ID NO: 813942 - RNA, 21 nt, Human
uucuccuucagagccgcuggu

SEQ ID NO: 813943 - RNA, 18 nt, Human
uuggcccagggccuuggg

SEQ ID NO: 813944 - RNA, 21 nt, Human
cccucacagaggaggugggga

SEQ ID NO: 813945 - RNA, 21 nt, Human
cucagcuccuucacagcacug

SEQ ID NO: 813946 - RNA, 21 nt, Human
gcucucgggggugcucucagc

SEQ ID NO: 813947 - RNA, 23 nt, Human
uggccagcucaucuggauucugc

SEQ ID NO: 813948 - RNA, 18 nt, Human
aaaaaaaaguagagaagc

SEQ ID NO: 813949 - RNA, 23 nt, Human
aaaaacagaaagcauguagcauu

SEQ ID NO: 813950 - RNA, 19 nt, Human
aaacaaaaaaaaguagaga

SEQ ID NO: 813951 - RNA, 24 nt, Human
aaacaaaaaaaaguagagaagcaa

SEQ ID NO: 813952 - RNA, 20 nt, Human
aaagggaccugaagcuuaaa

SEQ ID NO: 813953 - RNA, 22 nt, Human
aacucccacgaacuuucgauac

SEQ ID NO: 813954 - RNA, 21 nt, Human
aagaacaacucccacgaacuu

SEQ ID NO: 813955 - RNA, 22 nt, Human
aagaacagcgugcauaugcuau

SEQ ID NO: 813956 - RNA, 22 nt, Human
aagcaagaacagcgugcauaug

SEQ ID NO: 813957 - RNA, 18 nt, Human
aaguaaccugugaccaca

SEQ ID NO: 813958 - RNA, 22 nt, Human
aagucuggaaaucacacugaau

SEQ ID NO: 813959 - RNA, 22 nt, Human
aauuacaaagaacaacucccac

SEQ ID NO: 813960 - RNA, 21 nt, Human
acaaacaaaaaaaaguagaga

SEQ ID NO: 813961 - RNA, 18 nt, Human
acaaagaacaacucccac

SEQ ID NO: 813962 - RNA, 20 nt, Human
accaaguaaccugugaccac

SEQ ID NO: 813963 - RNA, 22 nt, Human
accccacacucguaccagccca

SEQ ID NO: 813964 - RNA, 20 nt, Human
acugugguuguuggacgccu

SEQ ID NO: 813965 - RNA, 22 nt, Human
agaaacacacccccagcucucc

SEQ ID NO: 813966 - RNA, 20 nt, Human
agcggcuuuccuccaagacu

SEQ ID NO: 813967 - RNA, 23 nt, Human
agggauggagaccccacacucgu

SEQ ID NO: 813968 - RNA, 19 nt, Human
aggggguuccgaagccgau

SEQ ID NO: 813969 - RNA, 21 nt, Human
aguuaacagcaaaacugaauc

SEQ ID NO: 813970 - RNA, 22 nt, Human
aguugguggggcugggcagggc

SEQ ID NO: 813971 - RNA, 21 nt, Human
auauguauaugcauauauaca

SEQ ID NO: 813972 - RNA, 23 nt, Human
auuggggaugauuucauccaggc

SEQ ID NO: 813973 - RNA, 19 nt, Human
auuuucuuuggugguguuu

SEQ ID NO: 813974 - RNA, 20 nt, Human
caaaaaaaaguagagaagca

SEQ ID NO: 813975 - RNA, 19 nt, Human
caaguaaccugugaccaca

SEQ ID NO: 813976 - RNA, 21 nt, Human
caagugaguuacugaugaagc

SEQ ID NO: 813977 - RNA, 18 nt, Human
caccuagggcagcggggc

SEQ ID NO: 813978 - RNA, 20 nt, Human
caccuagggcagcggggcug

SEQ ID NO: 813979 - RNA, 19 nt, Human
cagcggggcugagcacgcu

SEQ ID NO: 813980 - RNA, 24 nt, Human
caguguccaucuaugaccuuccug

SEQ ID NO: 813981 - RNA, 20 nt, Human
cauuguccaggccaagaagu

SEQ ID NO: 813982 - RNA, 19 nt, Human
ccaucagccuugaugccaa

SEQ ID NO: 813983 - RNA, 22 nt, Human
ccaucuccuccuaguuuaaucc

SEQ ID NO: 813984 - RNA, 20 nt, Human
cccacauaguaguagggggu

SEQ ID NO: 813985 - RNA, 26 nt, Human
cccacgaucaagguccacaacccacu

SEQ ID NO: 813986 - RNA, 18 nt, Human
ccuagggcagcggggcug

SEQ ID NO: 813987 - RNA, 22 nt, Human
cgggugguggcaguggugggcc

SEQ ID NO: 813988 - RNA, 24 nt, Human
cucaccacgggggucccuuccaga

SEQ ID NO: 813989 - RNA, 19 nt, Human
cucauuaucagguugccau

SEQ ID NO: 813990 - RNA, 24 nt, Human
cuuaaauucaguuaguuuuggaga

SEQ ID NO: 813991 - RNA, 22 nt, Human
cuuccugcuggacggaggcucc

SEQ ID NO: 813992 - RNA, 18 nt, Human
gacagguggggaugggag

SEQ ID NO: 813993 - RNA, 20 nt, Human
gacagguggggaugggagug

SEQ ID NO: 813994 - RNA, 19 nt, Human
gagcaugcuggggaggcag

SEQ ID NO: 813995 - RNA, 20 nt, Human
gagcauucggucucuuccug

SEQ ID NO: 813996 - RNA, 21 nt, Human
gcaauggucuucaccucuucc

SEQ ID NO: 813997 - RNA, 19 nt, Human
ggagugguggguguggggg

SEQ ID NO: 813998 - RNA, 20 nt, Human
ggcgggugguggcaguggug

SEQ ID NO: 813999 - RNA, 21 nt, Human
gggugguggcaguggugggcc

SEQ ID NO: 814000 - RNA, 23 nt, Human
ggguguggggguggugguggugg

SEQ ID NO: 814001 - RNA, 25 nt, Human
guauaugcauauauacauauauaua

SEQ ID NO: 814002 - RNA, 27 nt, Human
guccacaaugacaaaugaguggcaacc

SEQ ID NO: 814003 - RNA, 22 nt, Human
guggcaguggugggccucgggg

SEQ ID NO: 814004 - RNA, 23 nt, Human
guggugggugugggggugguggu

SEQ ID NO: 814005 - RNA, 23 nt, Human
guguggauauguauaugcauaua

SEQ ID NO: 814006 - RNA, 24 nt, Human
gugugguagcaguggucgaaggcu

SEQ ID NO: 814007 - RNA, 23 nt, Human
guuugugucuuucaaucaacaaa

SEQ ID NO: 814008 - RNA, 20 nt, Human
uaaauuucaaguaggauaua

SEQ ID NO: 814009 - RNA, 19 nt, Human
uacauaggacugaggcccu

SEQ ID NO: 814010 - RNA, 19 nt, Human
uaccaggaaggacuuuccc

SEQ ID NO: 814011 - RNA, 22 nt, Human
uaggccucuuccguagguacug

SEQ ID NO: 814012 - RNA, 24 nt, Human
uauaugcauauauacauauauaua

SEQ ID NO: 814013 - RNA, 22 nt, Human
uauguauaugcauauauacaua

SEQ ID NO: 814014 - RNA, 27 nt, Human
uauguauaugcauauauacauauauau

SEQ ID NO: 814015 - RNA, 21 nt, Human
ucaacaaaucguuuccuucca

SEQ ID NO: 814016 - RNA, 20 nt, Human
ucagucuccaagccugagaa

SEQ ID NO: 814017 - RNA, 22 nt, Human
uccguguagcugggaucauguu

SEQ ID NO: 814018 - RNA, 22 nt, Human
uccugggguggcuuugucccag

SEQ ID NO: 814019 - RNA, 24 nt, Human
ucgauaccacgugcgcuucacaua

SEQ ID NO: 814020 - RNA, 19 nt, Human
ucgccccugcccaaagagu

SEQ ID NO: 814021 - RNA, 21 nt, Human
ucggugacaaaugagaccgaa

SEQ ID NO: 814022 - RNA, 19 nt, Human
ucuacaaugguucgaccau

SEQ ID NO: 814023 - RNA, 19 nt, Human
ucuccaagccugagaacuc

SEQ ID NO: 814024 - RNA, 24 nt, Human
ucugauucggugacaaaugagacc

SEQ ID NO: 814025 - RNA, 21 nt, Human
ucugggaucccauuggagcuc

SEQ ID NO: 814026 - RNA, 24 nt, Human
ucuucaucauauauaacguaggcc

SEQ ID NO: 814027 - RNA, 20 nt, Human
ucuucuucaggaaaggaacu

SEQ ID NO: 814028 - RNA, 18 nt, Human
ugaagcaagaacagcgug

SEQ ID NO: 814029 - RNA, 21 nt, Human
ugacaaaugaguggcaaccuu

SEQ ID NO: 814030 - RNA, 21 nt, Human
ugaccuccaagcccaccagcg

SEQ ID NO: 814031 - RNA, 18 nt, Human
ugagaaaaacagaaagca

SEQ ID NO: 814032 - RNA, 18 nt, Human
ugagaaaaacagaaagca

SEQ ID NO: 814033 - RNA, 22 nt, Human
ugagaaaaacagaaagcaugua

SEQ ID NO: 814034 - RNA, 23 nt, Human
ugagaaaaacagaaagcauguag

SEQ ID NO: 814035 - RNA, 19 nt, Human
ugagaugaccagaauggcc

SEQ ID NO: 814036 - RNA, 20 nt, Human
ugagaugaccagaauggcca

SEQ ID NO: 814037 - RNA, 22 nt, Human
ugagggccauugauaauucucu

SEQ ID NO: 814038 - RNA, 24 nt, Human
ugauagguccguagccaugaggau

SEQ ID NO: 814039 - RNA, 22 nt, Human
ugauguugcggggagcaugcug

SEQ ID NO: 814040 - RNA, 25 nt, Human
ugcacuguaaaccaaguaaccugug

SEQ ID NO: 814041 - RNA, 24 nt, Human
ugcagugucagucuccaagccuga

SEQ ID NO: 814042 - RNA, 22 nt, Human
ugccaucaucgucgugccguuc

SEQ ID NO: 814043 - RNA, 21 nt, Human
ugccuaaaaagucuggaaauc

SEQ ID NO: 814044 - RNA, 22 nt, Human
ugcuauuccuggaaauacugaa

SEQ ID NO: 814045 - RNA, 22 nt, Human
uggaagugauccagugcaucag

SEQ ID NO: 814046 - RNA, 18 nt, Human
uggagaaauccaaaauga

SEQ ID NO: 814047 - RNA, 23 nt, Human
uggagaccccacacucguaccag

SEQ ID NO: 814048 - RNA, 21 nt, Human
uggggaggcaggucacucuuc

SEQ ID NO: 814049 - RNA, 23 nt, Human
uggggaugauuucauccaggcug

SEQ ID NO: 814050 - RNA, 18 nt, Human
uggggaugggaguggugg

SEQ ID NO: 814051 - RNA, 18 nt, Human
uggggcugggcagggcaa

SEQ ID NO: 814052 - RNA, 18 nt, Human
ugguagggggaugggugg

SEQ ID NO: 814053 - RNA, 18 nt, Human
uggugggugugggggugg

SEQ ID NO: 814054 - RNA, 26 nt, Human
ugguggguguggggguggugguggug

SEQ ID NO: 814055 - RNA, 19 nt, Human
uggugguggugguuguccg

SEQ ID NO: 814056 - RNA, 19 nt, Human
uguagugguaggcaggggc

SEQ ID NO: 814057 - RNA, 18 nt, Human
uguauaugcauauauaca

SEQ ID NO: 814058 - RNA, 22 nt, Human
uguggauauguauaugcauaua

SEQ ID NO: 814059 - RNA, 23 nt, Human
uuacaaacaaacaaaaaaaagua

SEQ ID NO: 814060 - RNA, 20 nt, Human
uuccaugugaaucuuggagg

SEQ ID NO: 814061 - RNA, 23 nt, Human
uucccaaaccugacaggcuccug

SEQ ID NO: 814062 - RNA, 20 nt, Human
uuccuggcaccuagggcagc

SEQ ID NO: 814063 - RNA, 19 nt, Human
uuuauucuagcagugggua

SEQ ID NO: 814064 - RNA, 22 nt, Human
uuuuuugaugaccuccaagccc

SEQ ID NO: 814065 - RNA, 21 nt, Human
aaccagaacgugcccugaccu

SEQ ID NO: 814066 - RNA, 25 nt, Human
aagcaggaggugggugggggggacc

SEQ ID NO: 814067 - RNA, 26 nt, Human
aagcaggaggugggugggggggaccc

SEQ ID NO: 814068 - RNA, 25 nt, Human
acacagcccaggagggggggaacgc

SEQ ID NO: 814069 - RNA, 24 nt, Human
agcacagcgcacucagccgcagcc

SEQ ID NO: 814070 - RNA, 20 nt, Human
agcacaggcacagggguagg

SEQ ID NO: 814071 - RNA, 21 nt, Human
agcagcaguggggagccgggg

SEQ ID NO: 814072 - RNA, 18 nt, Human
agccgggguuucuggggc

SEQ ID NO: 814073 - RNA, 21 nt, Human
agccgggguuucuggggcagc

SEQ ID NO: 814074 - RNA, 22 nt, Human
aggagguggguggggaggcugg

SEQ ID NO: 814075 - RNA, 21 nt, Human
aggaguacacaaagcaggagg

SEQ ID NO: 814076 - RNA, 19 nt, Human
aggcaguggcagaggcgcu

SEQ ID NO: 814077 - RNA, 25 nt, Human
agggggaggggaggaguacacaaag

SEQ ID NO: 814078 - RNA, 20 nt, Human
agguggguggggaggcuggg

SEQ ID NO: 814079 - RNA, 21 nt, Human
agguggguggggaggcugggg

SEQ ID NO: 814080 - RNA, 23 nt, Human
aguaccccucgucccuggacaac

SEQ ID NO: 814081 - RNA, 21 nt, Human
cacagcaccuggggacccaga

SEQ ID NO: 814082 - RNA, 22 nt, Human
cacuaagcacagcgcacucagc

SEQ ID NO: 814083 - RNA, 21 nt, Human
cacuucuuauaugaacuccga

SEQ ID NO: 814084 - RNA, 23 nt, Human
cagcaguggggagccgggguuuc

SEQ ID NO: 814085 - RNA, 20 nt, Human
cagccagccgacacaaacug

SEQ ID NO: 814086 - RNA, 20 nt, Human
caggaggggcacacccggcg

SEQ ID NO: 814087 - RNA, 18 nt, Human
caggcucccuccucccuc

SEQ ID NO: 814088 - RNA, 20 nt, Human
ccaggaaagggccggggaca

SEQ ID NO: 814089 - RNA, 24 nt, Human
ccaguacaccaggcucugaccgga

SEQ ID NO: 814090 - RNA, 21 nt, Human
ccauaaguguucagagaaccc

SEQ ID NO: 814091 - RNA, 22 nt, Human
ccaucuuaaagaccugcccucc

SEQ ID NO: 814092 - RNA, 22 nt, Human
ccgcagccucugucugucuccc

SEQ ID NO: 814093 - RNA, 20 nt, Human
ccgugggucccuccgggugg

SEQ ID NO: 814094 - RNA, 19 nt, Human
ccuccggguggcuucgguc

SEQ ID NO: 814095 - RNA, 19 nt, Human
ccuccucccucccuccccc

SEQ ID NO: 814096 - RNA, 20 nt, Human
ccuccucccucccucccccc

SEQ ID NO: 814097 - RNA, 19 nt, Human
ccucugcaaaguaccccuc

SEQ ID NO: 814098 - RNA, 18 nt, Human
ccuggcccguccccaccc

SEQ ID NO: 814099 - RNA, 22 nt, Human
ccuuuauugucuaggaagauug

SEQ ID NO: 814100 - RNA, 24 nt, Human
cgccacacuucccaggaagcacuc

SEQ ID NO: 814101 - RNA, 22 nt, Human
cgucccuggacaaccagaacgu

SEQ ID NO: 814102 - RNA, 21 nt, Human
cuccccccaguacaccaggcu

SEQ ID NO: 814103 - RNA, 25 nt, Human
cucccuccucccucccuccccccag

SEQ ID NO: 814104 - RNA, 19 nt, Human
cucucuucucguggagccu

SEQ ID NO: 814105 - RNA, 18 nt, Human
cucugaccggaccggucc

SEQ ID NO: 814106 - RNA, 18 nt, Human
cucugucugucuccccac

SEQ ID NO: 814107 - RNA, 23 nt, Human
cuuaaagaccugcccuccagccc

SEQ ID NO: 814108 - RNA, 21 nt, Human
cuucaaacgccacacuuccca

SEQ ID NO: 814109 - RNA, 21 nt, Human
gaagacgucauccccuucucc

SEQ ID NO: 814110 - RNA, 22 nt, Human
gagcagcaguggggagccgggg

SEQ ID NO: 814111 - RNA, 22 nt, Human
gagcagcaguggggagccgggg

SEQ ID NO: 814112 - RNA, 24 nt, Human
gagcagcaguggggagccgggguu

SEQ ID NO: 814113 - RNA, 18 nt, Human
gaggcuguccuggaagug

SEQ ID NO: 814114 - RNA, 23 nt, Human
gagguggguggggaggcuggggu

SEQ ID NO: 814115 - RNA, 22 nt, Human
gcugccacuugugccugugggc

SEQ ID NO: 814116 - RNA, 24 nt, Human
ggagggcagagaaccuuggguucc

SEQ ID NO: 814117 - RNA, 23 nt, Human
ggugggcucccggccagccuggu

SEQ ID NO: 814118 - RNA, 19 nt, Human
gguuaguuucucuuccuug

SEQ ID NO: 814119 - RNA, 18 nt, Human
uaacuuggcugugguuag

SEQ ID NO: 814120 - RNA, 22 nt, Human
uacaccaggcucugaccggacc

SEQ ID NO: 814121 - RNA, 21 nt, Human
uaggaacaaaagaacagaaca

SEQ ID NO: 814122 - RNA, 22 nt, Human
ucacacagcccaggaggggcac

SEQ ID NO: 814123 - RNA, 19 nt, Human
uccaggguaugggcuauga

SEQ ID NO: 814124 - RNA, 20 nt, Human
uccccccaguacaccaggcu

SEQ ID NO: 814125 - RNA, 26 nt, Human
ucccuccggguggcuucggucucuuu

SEQ ID NO: 814126 - RNA, 31 nt, Human
ucccuggacaaccagaacgugcccugaccuu

SEQ ID NO: 814127 - RNA, 20 nt, Human
uccuggaaguggccaauucu

SEQ ID NO: 814128 - RNA, 24 nt, Human
uccuuuagccaaggccauuucugg

SEQ ID NO: 814129 - RNA, 23 nt, Human
ucuccccagggcuguaugggagc

SEQ ID NO: 814130 - RNA, 22 nt, Human
ucucguggagccuuacugaaga

SEQ ID NO: 814131 - RNA, 22 nt, Human
ucugcaaaguaccccucguccc

SEQ ID NO: 814132 - RNA, 22 nt, Human
ucugcagccagccgacacaaac

SEQ ID NO: 814133 - RNA, 24 nt, Human
ucugucugucuccccacccgccca

SEQ ID NO: 814134 - RNA, 23 nt, Human
ucuuccuguggcuuuguaggaac

SEQ ID NO: 814135 - RNA, 19 nt, Human
ucuuggguucuuccugugg

SEQ ID NO: 814136 - RNA, 21 nt, Human
ugaaagcagaguuauagcugc

SEQ ID NO: 814137 - RNA, 19 nt, Human
ugaccagagaagcucccgc

SEQ ID NO: 814138 - RNA, 20 nt, Human
ugaccggaccggucccaccg

SEQ ID NO: 814139 - RNA, 23 nt, Human
ugaccucuucccuggcccguccc

SEQ ID NO: 814140 - RNA, 19 nt, Human
ugcaaaguaccccucgucc

SEQ ID NO: 814141 - RNA, 23 nt, Human
ugcccugaccucuucccuggccc

SEQ ID NO: 814142 - RNA, 21 nt, Human
uggacacaaaacaccaaacaa

SEQ ID NO: 814143 - RNA, 20 nt, Human
uggcagaggcgcugggaggc

SEQ ID NO: 814144 - RNA, 20 nt, Human
uggggaggcuggggucacac

SEQ ID NO: 814145 - RNA, 28 nt, Human
uggguucccaacgcauucuaugagcucu

SEQ ID NO: 814146 - RNA, 23 nt, Human
uguaugggagcacaggcacaggg

SEQ ID NO: 814147 - RNA, 22 nt, Human
uuggcugugguuaguuucucuu

SEQ ID NO: 814148 - RNA, 19 nt, Human
uugugcugagggggagggg

SEQ ID NO: 814149 - RNA, 21 nt, Human
uugugcugagggggaggggag

SEQ ID NO: 814150 - RNA, 27 nt, Human
aaaagggauuccuccaaccgagaugga

SEQ ID NO: 814151 - RNA, 18 nt, Human
aaaauuccccaaacuuug

SEQ ID NO: 814152 - RNA, 18 nt, Human
aaagcaagcagagcccag

SEQ ID NO: 814153 - RNA, 23 nt, Human
aaagcaagcagagcccaggucca

SEQ ID NO: 814154 - RNA, 21 nt, Human
aagaugggguuucuccauguu

SEQ ID NO: 814155 - RNA, 23 nt, Human
aagaugggguuucuccauguugc

SEQ ID NO: 814156 - RNA, 22 nt, Human
aagcaagcagagcccaggucca

SEQ ID NO: 814157 - RNA, 23 nt, Human
aagcaagcagagcccagguccac

SEQ ID NO: 814158 - RNA, 23 nt, Human
aagcccgacuggaaaggaaugac

SEQ ID NO: 814159 - RNA, 24 nt, Human
aagcgaucugccugccuuggccuc

SEQ ID NO: 814160 - RNA, 18 nt, Human
aaggacccuugggcaggg

SEQ ID NO: 814161 - RNA, 19 nt, Human
aaguagcugggauuacaga

SEQ ID NO: 814162 - RNA, 26 nt, Human
aaguagcugggauuacagaugcacac

SEQ ID NO: 814163 - RNA, 24 nt, Human
acagucccccuggguccccugccu

SEQ ID NO: 814164 - RNA, 22 nt, Human
acccuauccccuccuaccccca

SEQ ID NO: 814165 - RNA, 20 nt, Human
acuccugguagaaccaggag

SEQ ID NO: 814166 - RNA, 25 nt, Human
acucugucauccaggcugaagugca

SEQ ID NO: 814167 - RNA, 20 nt, Human
agacgcccccuucccucaag

SEQ ID NO: 814168 - RNA, 20 nt, Human
agagaaagaugcggaugaug

SEQ ID NO: 814169 - RNA, 22 nt, Human
agaggaguguggcaggggaggg

SEQ ID NO: 814170 - RNA, 23 nt, Human
agaggccacggggcucaggcagg

SEQ ID NO: 814171 - RNA, 22 nt, Human
agcagaaaagggauuccuccaa

SEQ ID NO: 814172 - RNA, 19 nt, Human
agcagauuaccugaugagc

SEQ ID NO: 814173 - RNA, 23 nt, Human
agccuggagccgggcccgcugcg

SEQ ID NO: 814174 - RNA, 20 nt, Human
agccugguauguagaagcug

SEQ ID NO: 814175 - RNA, 24 nt, Human
agcuggucucgaacuccugggcuc

SEQ ID NO: 814176 - RNA, 21 nt, Human
aggaaugacucccgggggugc

SEQ ID NO: 814177 - RNA, 18 nt, Human
aggagcuggugguaggag

SEQ ID NO: 814178 - RNA, 18 nt, Human
aggagcuggugguaggag

SEQ ID NO: 814179 - RNA, 20 nt, Human
aggcagucaccagagugacu

SEQ ID NO: 814180 - RNA, 23 nt, Human
agggauuuuuuuuuuuccuuaaa

SEQ ID NO: 814181 - RNA, 26 nt, Human
aggguggcagaggaguguggcagggg

SEQ ID NO: 814182 - RNA, 32 nt, Human
aggguggcagaggaguguggcaggggaggggg

SEQ ID NO: 814183 - RNA, 23 nt, Human
agucccccuggguccccugccug

SEQ ID NO: 814184 - RNA, 20 nt, Human
agugcaguggugugauaacu

SEQ ID NO: 814185 - RNA, 21 nt, Human
agugcaguggugugauaacug

SEQ ID NO: 814186 - RNA, 24 nt, Human
agugcaguggugugauaacugcuc

SEQ ID NO: 814187 - RNA, 24 nt, Human
auaaagcaagcagagcccaggucc

SEQ ID NO: 814188 - RNA, 24 nt, Human
auacacuucugucuuuccuuuucu

SEQ ID NO: 814189 - RNA, 21 nt, Human
auccaaaaguuucuucaaagu

SEQ ID NO: 814190 - RNA, 24 nt, Human
auccaggcugaagugcaguggugu

SEQ ID NO: 814191 - RNA, 18 nt, Human
augagcuaugcacgggca

SEQ ID NO: 814192 - RNA, 18 nt, Human
augcggaugaugccccac

SEQ ID NO: 814193 - RNA, 19 nt, Human
auggagcuguuuucugggu

SEQ ID NO: 814194 - RNA, 19 nt, Human
auggccaaggucauaaagc

SEQ ID NO: 814195 - RNA, 18 nt, Human
augggguuucuccauguu

SEQ ID NO: 814196 - RNA, 19 nt, Human
augggguuucuccauguug

SEQ ID NO: 814197 - RNA, 22 nt, Human
caaacuggacugcaugcggguu

SEQ ID NO: 814198 - RNA, 23 nt, Human
caacaucacauggccaaggucau

SEQ ID NO: 814199 - RNA, 21 nt, Human
caagcagagcccagguccacc

SEQ ID NO: 814200 - RNA, 20 nt, Human
caagcuuccucccccacauc

SEQ ID NO: 814201 - RNA, 21 nt, Human
cacaauugaaguagaaggggc

SEQ ID NO: 814202 - RNA, 20 nt, Human
cacagucccccugggucccc

SEQ ID NO: 814203 - RNA, 22 nt, Human
cacauggccaaggucauaaagc

SEQ ID NO: 814204 - RNA, 21 nt, Human
cacccuauccccuccuacccc

SEQ ID NO: 814205 - RNA, 23 nt, Human
cacccuauccccuccuaccccca

SEQ ID NO: 814206 - RNA, 23 nt, Human
cacucugucauccaggcugaagu

SEQ ID NO: 814207 - RNA, 24 nt, Human
cacucugucauccaggcugaagug

SEQ ID NO: 814208 - RNA, 18 nt, Human
cacugcaaccucugccuc

SEQ ID NO: 814209 - RNA, 21 nt, Human
cacugcaaccucugccuccua

SEQ ID NO: 814210 - RNA, 20 nt, Human
cacuuugcaugcaagacuuc

SEQ ID NO: 814211 - RNA, 26 nt, Human
cagagcccagguccaccucuggaguu

SEQ ID NO: 814212 - RNA, 21 nt, Human
cagaugcacaccacuacaccu

SEQ ID NO: 814213 - RNA, 23 nt, Human
caggacaggcacccggcgcugcc

SEQ ID NO: 814214 - RNA, 18 nt, Human
caggcacccggcgcugcc

SEQ ID NO: 814215 - RNA, 18 nt, Human
caggggagcugccucucc

SEQ ID NO: 814216 - RNA, 23 nt, Human
caguacccuccccuugccucuuc

SEQ ID NO: 814217 - RNA, 23 nt, Human
cagucccauuucacagaugggaa

SEQ ID NO: 814218 - RNA, 18 nt, Human
cauggcuaaguacuugcc

SEQ ID NO: 814219 - RNA, 24 nt, Human
cauguugcccaagcuggucucgaa

SEQ ID NO: 814220 - RNA, 19 nt, Human
ccauaugcuggugaggguu

SEQ ID NO: 814221 - RNA, 23 nt, Human
ccauguugcccaagcuggucucg

SEQ ID NO: 814222 - RNA, 19 nt, Human
cccaaacuuugucauuugg

SEQ ID NO: 814223 - RNA, 18 nt, Human
cccaagcuuccuccccca

SEQ ID NO: 814224 - RNA, 21 nt, Human
cccaaggacacccuauccccu

SEQ ID NO: 814225 - RNA, 23 nt, Human
cccaaguagcugggauuacagau

SEQ ID NO: 814226 - RNA, 21 nt, Human
cccacccacuucuacugggca

SEQ ID NO: 814227 - RNA, 19 nt, Human
cccacgccuggcugcuccu

SEQ ID NO: 814228 - RNA, 24 nt, Human
cccccagcccgaggaucucgccgc

SEQ ID NO: 814229 - RNA, 18 nt, Human
ccccuugccucuuccucu

SEQ ID NO: 814230 - RNA, 20 nt, Human
cccuccuacccccacccacu

SEQ ID NO: 814231 - RNA, 21 nt, Human
cccuugccucuuccucuuccc

SEQ ID NO: 814232 - RNA, 23 nt, Human
ccgccucagccucccaaguagcu

SEQ ID NO: 814233 - RNA, 26 nt, Human
ccucaaguuggcuagaauguggggcu

SEQ ID NO: 814234 - RNA, 22 nt, Human
ccuccuagugauccugccgccu

SEQ ID NO: 814235 - RNA, 26 nt, Human
ccuccugggacaagaaucagccaggu

SEQ ID NO: 814236 - RNA, 19 nt, Human
ccuccugggacaagaauug

SEQ ID NO: 814237 - RNA, 23 nt, Human
ccucucaccucuuucccggguga

SEQ ID NO: 814238 - RNA, 18 nt, Human
ccucuuccucuucccucc

SEQ ID NO: 814239 - RNA, 26 nt, Human
ccugccgccucagccucccaaguagc

SEQ ID NO: 814240 - RNA, 22 nt, Human
ccugccuuggccucccaaagug

SEQ ID NO: 814241 - RNA, 21 nt, Human
ccugggcucaagcgaucugcc

SEQ ID NO: 814242 - RNA, 22 nt, Human
ccugggcucaagcgaucugccu

SEQ ID NO: 814243 - RNA, 23 nt, Human
ccuuacccaagcuuccuccccca

SEQ ID NO: 814244 - RNA, 23 nt, Human
ccuucagaaucuuaaauaggaaa

SEQ ID NO: 814245 - RNA, 22 nt, Human
cgaugcuaggaaaauucaaaaa

SEQ ID NO: 814246 - RNA, 22 nt, Human
cggcugcggacagcgaagagga

SEQ ID NO: 814247 - RNA, 23 nt, Human
cgggugccacagucccccugggu

SEQ ID NO: 814248 - RNA, 21 nt, Human
cguaaagaugaagcccgacug

SEQ ID NO: 814249 - RNA, 23 nt, Human
cgugggcacccccagcccgagga

SEQ ID NO: 814250 - RNA, 22 nt, Human
cuaaguacuugccuauguugcu

SEQ ID NO: 814251 - RNA, 27 nt, Human
cuagugauccugccgccucagccuccc

SEQ ID NO: 814252 - RNA, 24 nt, Human
cuauccccuccuacccccacccac

SEQ ID NO: 814253 - RNA, 23 nt, Human
cucaaggggacaucccuggcugc

SEQ ID NO: 814254 - RNA, 24 nt, Human
cucacugcaaccucugccuccuag

SEQ ID NO: 814255 - RNA, 24 nt, Human
cucagccucccaaguagcugggau

SEQ ID NO: 814256 - RNA, 18 nt, Human
cuccaaccgagauggaag

SEQ ID NO: 814257 - RNA, 27 nt, Human
cuccauguugcccaagcuggucucgaa

SEQ ID NO: 814258 - RNA, 23 nt, Human
cucgugggccgggggcuggagga

SEQ ID NO: 814259 - RNA, 23 nt, Human
cucucaccucuuucccgggugaa

SEQ ID NO: 814260 - RNA, 19 nt, Human
cucugugcccaaggcggca

SEQ ID NO: 814261 - RNA, 19 nt, Human
cugcaaccucugccuccua

SEQ ID NO: 814262 - RNA, 22 nt, Human
cugcaugcggguucaucuuccc

SEQ ID NO: 814263 - RNA, 18 nt, Human
cugccuuggccucccaaa

SEQ ID NO: 814264 - RNA, 19 nt, Human
cugggagcaugggaucaag

SEQ ID NO: 814265 - RNA, 21 nt, Human
cuugccggggaggaacugcag

SEQ ID NO: 814266 - RNA, 19 nt, Human
cuuuccuuuucuccuuuuu

SEQ ID NO: 814267 - RNA, 20 nt, Human
cuuugugggggcauaucuga

SEQ ID NO: 814268 - RNA, 21 nt, Human
gaagguaaaaggucugccaga

SEQ ID NO: 814269 - RNA, 19 nt, Human
gaagucagggugggugagc

SEQ ID NO: 814270 - RNA, 24 nt, Human
gacugggcuggggcugucuggggc

SEQ ID NO: 814271 - RNA, 21 nt, Human
gagcggccgcagggcgaggcg

SEQ ID NO: 814272 - RNA, 21 nt, Human
gagcggccgcagggcgaggcg

SEQ ID NO: 814273 - RNA, 26 nt, Human
gagcucacaacuggcagagcccccag

SEQ ID NO: 814274 - RNA, 18 nt, Human
gaggagcuggugguagga

SEQ ID NO: 814275 - RNA, 18 nt, Human
gaggcugggagcauggga

SEQ ID NO: 814276 - RNA, 19 nt, Human
gaggcuuuuggggauuuug

SEQ ID NO: 814277 - RNA, 23 nt, Human
gagggggacaggcuuccgggggc

SEQ ID NO: 814278 - RNA, 21 nt, Human
gagugcuggugcccgaaguug

SEQ ID NO: 814279 - RNA, 20 nt, Human
gaucucgccgcuucccacgc

SEQ ID NO: 814280 - RNA, 22 nt, Human
gaugcggaugaugccccacauc

SEQ ID NO: 814281 - RNA, 26 nt, Human
gcagaggaguguggcaggggaggggg

SEQ ID NO: 814282 - RNA, 23 nt, Human
gccucagccucccaaguagcugg

SEQ ID NO: 814283 - RNA, 25 nt, Human
gccugggcauucccggguuccucug

SEQ ID NO: 814284 - RNA, 21 nt, Human
gccuuggccucccaaaguguu

SEQ ID NO: 814285 - RNA, 24 nt, Human
ggaaaccuucugggcagagcucac

SEQ ID NO: 814286 - RNA, 18 nt, Human
ggaaaggcagcaggacag

SEQ ID NO: 814287 - RNA, 20 nt, Human
ggaaggcaugguucacccgg

SEQ ID NO: 814288 - RNA, 23 nt, Human
ggacaggcacccggcgcugcccg

SEQ ID NO: 814289 - RNA, 19 nt, Human
ggagccuggagccgggccc

SEQ ID NO: 814290 - RNA, 20 nt, Human
ggagcugagccaggaguggg

SEQ ID NO: 814291 - RNA, 19 nt, Human
ggaggagagagaaagaugc

SEQ ID NO: 814292 - RNA, 20 nt, Human
ggagguaggggccgggugcu

SEQ ID NO: 814293 - RNA, 21 nt, Human
ggaguggggacggcaggugcu

SEQ ID NO: 814294 - RNA, 22 nt, Human
ggcugaagugcaguggugugau

SEQ ID NO: 814295 - RNA, 24 nt, Human
ggcugucuggggcuaggccugguu

SEQ ID NO: 814296 - RNA, 20 nt, Human
gggagccuggagccgggccc

SEQ ID NO: 814297 - RNA, 21 nt, Human
gggagguagcaaacgugggca

SEQ ID NO: 814298 - RNA, 18 nt, Human
gggagguuugugggugcu

SEQ ID NO: 814299 - RNA, 19 nt, Human
gggcaaagccugguaugua

SEQ ID NO: 814300 - RNA, 18 nt, Human
gggccgggggcuggagga

SEQ ID NO: 814301 - RNA, 18 nt, Human
gggccgggugcugggcgg

SEQ ID NO: 814302 - RNA, 18 nt, Human
gggcggugggggccuggg

SEQ ID NO: 814303 - RNA, 24 nt, Human
gggcucaagcgaucugccugccuu

SEQ ID NO: 814304 - RNA, 22 nt, Human
ggggcugucuggggcuaggccu

SEQ ID NO: 814305 - RNA, 19 nt, Human
ggugcgggcagaggccggc

SEQ ID NO: 814306 - RNA, 21 nt, Human
ggugcuggugcgggcagaggc

SEQ ID NO: 814307 - RNA, 20 nt, Human
guagcugggauuacagaugc

SEQ ID NO: 814308 - RNA, 18 nt, Human
guccgagcuaguguggga

SEQ ID NO: 814309 - RNA, 21 nt, Human
gucuccccugguaaauuccag

SEQ ID NO: 814310 - RNA, 22 nt, Human
gucucgaacuccugggcucaag

SEQ ID NO: 814311 - RNA, 24 nt, Human
gugauccugccgccucagccuccc

SEQ ID NO: 814312 - RNA, 18 nt, Human
gugcagggcucccggccu

SEQ ID NO: 814313 - RNA, 23 nt, Human
uaaagcaagcagagcccaggucc

SEQ ID NO: 814314 - RNA, 19 nt, Human
uaaauaauauauauauaca

SEQ ID NO: 814315 - RNA, 22 nt, Human
uaaaugaagauggagcuguuuu

SEQ ID NO: 814316 - RNA, 24 nt, Human
uaauuuuuguauuuuugguaaaga

SEQ ID NO: 814317 - RNA, 20 nt, Human
uacccaagcuuccuccccca

SEQ ID NO: 814318 - RNA, 24 nt, Human
uacuggcugacagcuuggcaggua

SEQ ID NO: 814319 - RNA, 18 nt, Human
uagaaccaggaguagggg

SEQ ID NO: 814320 - RNA, 20 nt, Human
uagaagcugcucaaacgcgu

SEQ ID NO: 814321 - RNA, 23 nt, Human
uagaaggggccgaaggcuuggua

SEQ ID NO: 814322 - RNA, 22 nt, Human
uagagccgccaacagaggcugg

SEQ ID NO: 814323 - RNA, 22 nt, Human
uagcagcgggguuugggcuggg

SEQ ID NO: 814324 - RNA, 26 nt, Human
uauauauauacacuucugucuuuccu

SEQ ID NO: 814325 - RNA, 20 nt, Human
uauccccuccuacccccacc

SEQ ID NO: 814326 - RNA, 19 nt, Human
uauuuuugguaaagauggg

SEQ ID NO: 814327 - RNA, 21 nt, Human
ucacccggugggagcagaggc

SEQ ID NO: 814328 - RNA, 19 nt, Human
ucacugcaaccucugccuc

SEQ ID NO: 814329 - RNA, 23 nt, Human
ucacugcaaccucugccuccuag

SEQ ID NO: 814330 - RNA, 24 nt, Human
ucacugcaaccucugccuccuagu

SEQ ID NO: 814331 - RNA, 18 nt, Human
ucagccucccaaguagcu

SEQ ID NO: 814332 - RNA, 20 nt, Human
ucagccucccaaguagcugg

SEQ ID NO: 814333 - RNA, 21 nt, Human
ucaggcagguugcagguccag

SEQ ID NO: 814334 - RNA, 23 nt, Human
ucaguacccuccccuugccucuu

SEQ ID NO: 814335 - RNA, 20 nt, Human
uccaggggauccuucuuuuu

SEQ ID NO: 814336 - RNA, 19 nt, Human
uccauguugcccaagcugg

SEQ ID NO: 814337 - RNA, 19 nt, Human
ucccccacaucuuuagggu

SEQ ID NO: 814338 - RNA, 21 nt, Human
ucccccuggguccccugccug

SEQ ID NO: 814339 - RNA, 22 nt, Human
ucccgggggugcagggcucccg

SEQ ID NO: 814340 - RNA, 22 nt, Human
ucccgggugaaaaaaaaauagu

SEQ ID NO: 814341 - RNA, 19 nt, Human
ucccuagcagggaccagcu

SEQ ID NO: 814342 - RNA, 24 nt, Human
uccuacccccacccacuucuacug

SEQ ID NO: 814343 - RNA, 18 nt, Human
uccucucaccucuuuccc

SEQ ID NO: 814344 - RNA, 18 nt, Human
uccugggcucaagcgauc

SEQ ID NO: 814345 - RNA, 18 nt, Human
uccugggcucaagcgauc

SEQ ID NO: 814346 - RNA, 20 nt, Human
uccugggcucaagcgaucug

SEQ ID NO: 814347 - RNA, 19 nt, Human
ucucacucugucauccagg

SEQ ID NO: 814348 - RNA, 24 nt, Human
ucucacucugucauccaggcugaa

SEQ ID NO: 814349 - RNA, 23 nt, Human
ucucgaacuccugggcucaagcg

SEQ ID NO: 814350 - RNA, 18 nt, Human
ucugaccuuacccaagcu

SEQ ID NO: 814351 - RNA, 19 nt, Human
ucugaccuuacccaagcuu

SEQ ID NO: 814352 - RNA, 21 nt, Human
ucuggcuggcucuuugguugg

SEQ ID NO: 814353 - RNA, 24 nt, Human
ucugucauccaggcugaagugcag

SEQ ID NO: 814354 - RNA, 22 nt, Human
ucugugcccaaggcggcaggaa

SEQ ID NO: 814355 - RNA, 20 nt, Human
ucuuugggcaggaagcuggg

SEQ ID NO: 814356 - RNA, 24 nt, Human
ugaagguagaucgucucaccuccu

SEQ ID NO: 814357 - RNA, 19 nt, Human
ugaagugcaguggugugau

SEQ ID NO: 814358 - RNA, 28 nt, Human
ugaagugcaguggugugauggcucuagc

SEQ ID NO: 814359 - RNA, 21 nt, Human
ugagagacaauugugagcacc

SEQ ID NO: 814360 - RNA, 18 nt, Human
ugagcgccgggacccgag

SEQ ID NO: 814361 - RNA, 18 nt, Human
ugagcgccgggacccgag

SEQ ID NO: 814362 - RNA, 24 nt, Human
ugagggaaaaguuaucagucccau

SEQ ID NO: 814363 - RNA, 21 nt, Human
ugagggggacaggcuuccggg

SEQ ID NO: 814364 - RNA, 20 nt, Human
ugaguggguagggcugacuu

SEQ ID NO: 814365 - RNA, 25 nt, Human
ugcaagacuucauuuugcauuugau

SEQ ID NO: 814366 - RNA, 19 nt, Human
ugccacagucccccugggu

SEQ ID NO: 814367 - RNA, 24 nt, Human
ugcccaagcuggucucgaacuccu

SEQ ID NO: 814368 - RNA, 18 nt, Human
ugccugccuuggccuccc

SEQ ID NO: 814369 - RNA, 21 nt, Human
ugcgccggggccaauaccagg

SEQ ID NO: 814370 - RNA, 22 nt, Human
ugcguuacuggcugacagcuug

SEQ ID NO: 814371 - RNA, 19 nt, Human
uggaaaggaaugacucccg

SEQ ID NO: 814372 - RNA, 19 nt, Human
uggaagaacgaauagccac

SEQ ID NO: 814373 - RNA, 21 nt, Human
uggaaggaaaccuucugggca

SEQ ID NO: 814374 - RNA, 23 nt, Human
uggaaggaaaccuucugggcaga

SEQ ID NO: 814375 - RNA, 22 nt, Human
uggaggagagagaaagaugcgg

SEQ ID NO: 814376 - RNA, 21 nt, Human
uggcagagagcaccuucaaac

SEQ ID NO: 814377 - RNA, 27 nt, Human
uggcagagcccccagaggaggggucaa

SEQ ID NO: 814378 - RNA, 23 nt, Human
uggcagaggaguguggcagggga

SEQ ID NO: 814379 - RNA, 22 nt, Human
uggcagugaccccagggcuggu

SEQ ID NO: 814380 - RNA, 24 nt, Human
uggccaaggucauaaagcaagcag

SEQ ID NO: 814381 - RNA, 19 nt, Human
uggcuggcucuuugguugg

SEQ ID NO: 814382 - RNA, 22 nt, Human
ugggagcagaggcucagcacca

SEQ ID NO: 814383 - RNA, 27 nt, Human
ugggagcugagccaggaguggggacgg

SEQ ID NO: 814384 - RNA, 21 nt, Human
ugggauuacagaugcacacca

SEQ ID NO: 814385 - RNA, 22 nt, Human
ugggauuacagaugcacaccac

SEQ ID NO: 814386 - RNA, 24 nt, Human
ugggauuacagaugcacaccacua

SEQ ID NO: 814387 - RNA, 20 nt, Human
ugggcaggaagcuggggagg

SEQ ID NO: 814388 - RNA, 25 nt, Human
ugggcaggggagcugccucuccugg

SEQ ID NO: 814389 - RNA, 20 nt, Human
ugggcucaagcgaucugccu

SEQ ID NO: 814390 - RNA, 27 nt, Human
ugggcuggggcugucuggggcuaggcc

SEQ ID NO: 814391 - RNA, 22 nt, Human
ugggcuucuugcuuccaguggg

SEQ ID NO: 814392 - RNA, 19 nt, Human
uggggagggaacggggugg

SEQ ID NO: 814393 - RNA, 18 nt, Human
uggggauuuugguggcug

SEQ ID NO: 814394 - RNA, 18 nt, Human
ugggguuucuccauguug

SEQ ID NO: 814395 - RNA, 21 nt, Human
uggguccggcuuucuuugagg

SEQ ID NO: 814396 - RNA, 24 nt, Human
ugguaaagaugggguuucuccaug

SEQ ID NO: 814397 - RNA, 21 nt, Human
uggugguaggagguaggggcc

SEQ ID NO: 814398 - RNA, 26 nt, Human
uguccaggggauccuucuuuuuuuuu

SEQ ID NO: 814399 - RNA, 21 nt, Human
ugugauaacugcucacugcaa

SEQ ID NO: 814400 - RNA, 18 nt, Human
uguggcaguggucaaguu

SEQ ID NO: 814401 - RNA, 21 nt, Human
ugugggacgggagacucuggc

SEQ ID NO: 814402 - RNA, 21 nt, Human
uucaaaaauuccccaaacuuu

SEQ ID NO: 814403 - RNA, 22 nt, Human
uucacagaugggaaaauugaga

SEQ ID NO: 814404 - RNA, 26 nt, Human
uucacagugggagguagcaaacgugg

SEQ ID NO: 814405 - RNA, 18 nt, Human
uuccagucucaccuaaac

SEQ ID NO: 814406 - RNA, 22 nt, Human
uucuccaggccuagcagggcga

SEQ ID NO: 814407 - RNA, 24 nt, Human
uugagggaaaaguuaucaguccca

SEQ ID NO: 814408 - RNA, 20 nt, Human
uugcagaggguggcagagga

SEQ ID NO: 814409 - RNA, 25 nt, Human
uugcagguccagcuuacucuggcug

SEQ ID NO: 814410 - RNA, 21 nt, Human
uugccucuuccucuucccucc

SEQ ID NO: 814411 - RNA, 24 nt, Human
uugguaaagaugggguuucuccau

SEQ ID NO: 814412 - RNA, 25 nt, Human
uugguagggaggcuuuuggggauuu

SEQ ID NO: 814413 - RNA, 19 nt, Human
uugguggcugugaucuucu

SEQ ID NO: 814414 - RNA, 21 nt, Human
uugguggcugugaucuucugu

SEQ ID NO: 814415 - RNA, 23 nt, Human
uuuggaggagagagaaagaugcg

SEQ ID NO: 814416 - RNA, 22 nt, Human
uuuucaugauacagggucucac

SEQ ID NO: 814417 - RNA, 23 nt, Human
uuuuggggauuuugguggcugug

SEQ ID NO: 814418 - RNA, 22 nt, Human
uuuuugguaaagaugggguuuc

SEQ ID NO: 814419 - RNA, 20 nt, Human
uuuuuguauuuuugguaaag

SEQ ID NO: 814420 - RNA, 24 nt, Human
uuuuuuuuuuuuucacuuugcaug

SEQ ID NO: 814421 - RNA, 23 nt, Human
uuuuuuuuuuuuuuuuucacuuu

SEQ ID NO: 814422 - RNA, 26 nt, Human
uuuuuuuuuuuuuuuuucacuuugau

SEQ ID NO: 814423 - RNA, 25 nt, Human
aaaaaaaaggugauuauguccaaga

SEQ ID NO: 814424 - RNA, 18 nt, Human
aaagacuaaugaaaaugg

SEQ ID NO: 814425 - RNA, 18 nt, Human
aaagugcuggauuacagg

SEQ ID NO: 814426 - RNA, 20 nt, Human
aacauagugagaccucaucu

SEQ ID NO: 814427 - RNA, 19 nt, Human
aaccacugaauuaaauuac

SEQ ID NO: 814428 - RNA, 21 nt, Human
accacacugauuacaccaaua

SEQ ID NO: 814429 - RNA, 20 nt, Human
acgggguuuuaguauguugg

SEQ ID NO: 814430 - RNA, 21 nt, Human
acgggguuuuaguauguuggc

SEQ ID NO: 814431 - RNA, 22 nt, Human
acgggguuuuaguauguuggcu

SEQ ID NO: 814432 - RNA, 23 nt, Human
acgggguuuuaguauguuggcug

SEQ ID NO: 814433 - RNA, 24 nt, Human
acuuguugcccaggcuggagugca

SEQ ID NO: 814434 - RNA, 23 nt, Human
agacagaaaaaaaaaagggggac

SEQ ID NO: 814435 - RNA, 24 nt, Human
agacagaaaaaaaaaaggugaggu

SEQ ID NO: 814436 - RNA, 22 nt, Human
agaguucaaguccagccugggc

SEQ ID NO: 814437 - RNA, 18 nt, Human
agaguuucccacauuccu

SEQ ID NO: 814438 - RNA, 19 nt, Human
agccaccgcaccuggccua

SEQ ID NO: 814439 - RNA, 23 nt, Human
agccugggcaacauagugagacc

SEQ ID NO: 814440 - RNA, 23 nt, Human
agccugggcaacauagugagacc

SEQ ID NO: 814441 - RNA, 24 nt, Human
agccugggcaacauagugagaccu

SEQ ID NO: 814442 - RNA, 24 nt, Human
aggcugaggagggaggagugcuug

SEQ ID NO: 814443 - RNA, 25 nt, Human
aggcuggagugcaguggcaugaucu

SEQ ID NO: 814444 - RNA, 21 nt, Human
agggaggagugcuugagccca

SEQ ID NO: 814445 - RNA, 18 nt, Human
aggggaguaaaaagaagg

SEQ ID NO: 814446 - RNA, 21 nt, Human
agguucaagugauucuccugc

SEQ ID NO: 814447 - RNA, 22 nt, Human
agguucaagugauucuccugcc

SEQ ID NO: 814448 - RNA, 18 nt, Human
aguagagacgggguuuua

SEQ ID NO: 814449 - RNA, 20 nt, Human
agucaagauugaaauggcuc

SEQ ID NO: 814450 - RNA, 22 nt, Human
agucagaagcaugauuuguguu

SEQ ID NO: 814451 - RNA, 23 nt, Human
agugauucuccugcccuagccuc

SEQ ID NO: 814452 - RNA, 20 nt, Human
agugcaguggcaugaucuug

SEQ ID NO: 814453 - RNA, 23 nt, Human
agugcaguggcaugaucuuggcu

SEQ ID NO: 814454 - RNA, 24 nt, Human
agugcaguggcaugaucuuggcuc

SEQ ID NO: 814455 - RNA, 23 nt, Human
aguggcucaugccgguaauccca

SEQ ID NO: 814456 - RNA, 22 nt, Human
auagacgauauguuugcccaca

SEQ ID NO: 814457 - RNA, 23 nt, Human
aucaucucuucauuauacugggc

SEQ ID NO: 814458 - RNA, 21 nt, Human
auuuucuggugugugacaagg

SEQ ID NO: 814459 - RNA, 23 nt, Human
caaagugcuggauuacagguacg

SEQ ID NO: 814460 - RNA, 24 nt, Human
caacauagugagaccucaucucuu

SEQ ID NO: 814461 - RNA, 23 nt, Human
caaccuccaccucccagguucaa

SEQ ID NO: 814462 - RNA, 18 nt, Human
caagaguucaaguccagc

SEQ ID NO: 814463 - RNA, 18 nt, Human
caaguccagccugggcaa

SEQ ID NO: 814464 - RNA, 21 nt, Human
caccgcaaccuccaccuccca

SEQ ID NO: 814465 - RNA, 21 nt, Human
caccgcaaccuccaccuccca

SEQ ID NO: 814466 - RNA, 18 nt, Human
caccuggccuacacucau

SEQ ID NO: 814467 - RNA, 20 nt, Human
cacucauuacuuucacaggg

SEQ ID NO: 814468 - RNA, 23 nt, Human
cacucauuacuuucacaggguug

SEQ ID NO: 814469 - RNA, 23 nt, Human
cacuguacagcauuguaaagacc

SEQ ID NO: 814470 - RNA, 21 nt, Human
cacuuguugcccaggcuggag

SEQ ID NO: 814471 - RNA, 23 nt, Human
cagcauuguaaagacaagcagaa

SEQ ID NO: 814472 - RNA, 20 nt, Human
cagccugggcaacauaguga

SEQ ID NO: 814473 - RNA, 19 nt, Human
caguaugaacacgauggug

SEQ ID NO: 814474 - RNA, 21 nt, Human
caugccgguaaucccaacccu

SEQ ID NO: 814475 - RNA, 21 nt, Human
cauucacuacauucaugaggu

SEQ ID NO: 814476 - RNA, 19 nt, Human
ccaaagugcuggauuacag

SEQ ID NO: 814477 - RNA, 21 nt, Human
ccaaagugcuggauuacaggu

SEQ ID NO: 814478 - RNA, 24 nt, Human
ccaccucccagguucaagugauuc

SEQ ID NO: 814479 - RNA, 23 nt, Human
cccagguucaagugauucuccuc

SEQ ID NO: 814480 - RNA, 23 nt, Human
cccagguucaagugauucuccug

SEQ ID NO: 814481 - RNA, 22 nt, Human
ccccuggggcuggugcaguggc

SEQ ID NO: 814482 - RNA, 21 nt, Human
cccuaagcuccucauccuugc

SEQ ID NO: 814483 - RNA, 21 nt, Human
cccuaccacacugauuacacc

SEQ ID NO: 814484 - RNA, 19 nt, Human
cccuggggcuggugcagug

SEQ ID NO: 814485 - RNA, 23 nt, Human
ccgcaaccuccaccucccagguu

SEQ ID NO: 814486 - RNA, 24 nt, Human
ccgcaaccuccaccucccagguuc

SEQ ID NO: 814487 - RNA, 20 nt, Human
ccgguaaucccaacccuuug

SEQ ID NO: 814488 - RNA, 24 nt, Human
ccucccagguucaagugauucucc

SEQ ID NO: 814489 - RNA, 24 nt, Human
ccugggcaacauagugagaccuca

SEQ ID NO: 814490 - RNA, 19 nt, Human
ccuugcugaagguuuucuc

SEQ ID NO: 814491 - RNA, 24 nt, Human
cgcacuuguugcccaggcuggagu

SEQ ID NO: 814492 - RNA, 20 nt, Human
cguuugaaaaauccaguagg

SEQ ID NO: 814493 - RNA, 19 nt, Human
cuaagcuccucauccuugc

SEQ ID NO: 814494 - RNA, 24 nt, Human
cucaccgcaaccuccaccucccag

SEQ ID NO: 814495 - RNA, 24 nt, Human
cucaugccgguaaucccaacccuu

SEQ ID NO: 814496 - RNA, 19 nt, Human
cuccaguaugaacacgagg

SEQ ID NO: 814497 - RNA, 19 nt, Human
cuccaguaugaacacgagg

SEQ ID NO: 814498 - RNA, 19 nt, Human
cucccagguucaagugauu

SEQ ID NO: 814499 - RNA, 19 nt, Human
cuccugcccuagccucgca

SEQ ID NO: 814500 - RNA, 20 nt, Human
cucgugaccucgugaucugc

SEQ ID NO: 814501 - RNA, 22 nt, Human
cucuccagcaugcagucucuga

SEQ ID NO: 814502 - RNA, 24 nt, Human
cuggagugcaguggcaugaucuug

SEQ ID NO: 814503 - RNA, 19 nt, Human
cuuacagucuucaaauucc

SEQ ID NO: 814504 - RNA, 22 nt, Human
cuuggugaauuuucugcucucc

SEQ ID NO: 814505 - RNA, 24 nt, Human
cuuguugcccaggcuggagugcag

SEQ ID NO: 814506 - RNA, 30 nt, Human
cuuuacauucauaugguuucucuccuguau

SEQ ID NO: 814507 - RNA, 21 nt, Human
gacauaggggaguaaaaagaa

SEQ ID NO: 814508 - RNA, 21 nt, Human
gaccucgugaucugcccaccu

SEQ ID NO: 814509 - RNA, 22 nt, Human
gacuacaggcgugccccaccau

SEQ ID NO: 814510 - RNA, 24 nt, Human
gagccaccgcaccuggccuacacu

SEQ ID NO: 814511 - RNA, 19 nt, Human
gaguuuacaagucauaguu

SEQ ID NO: 814512 - RNA, 18 nt, Human
gauuacagguacgagcca

SEQ ID NO: 814513 - RNA, 20 nt, Human
gcccaggcuggagugcagug

SEQ ID NO: 814514 - RNA, 24 nt, Human
gcccaggcuggagugcaguggcau

SEQ ID NO: 814515 - RNA, 19 nt, Human
gcuggagugcaguggcaug

SEQ ID NO: 814516 - RNA, 18 nt, Human
gcuggugcaguggcucau

SEQ ID NO: 814517 - RNA, 20 nt, Human
ggaaagcccuaccacacuga

SEQ ID NO: 814518 - RNA, 18 nt, Human
ggaauaaaaagacuaaug

SEQ ID NO: 814519 - RNA, 22 nt, Human
ggacauaggggaguaaaaagaa

SEQ ID NO: 814520 - RNA, 21 nt, Human
ggauuacagguacgagccacc

SEQ ID NO: 814521 - RNA, 22 nt, Human
ggauuacagguacgagccaccg

SEQ ID NO: 814522 - RNA, 23 nt, Human
gggguuuuaguauguuggcuggg

SEQ ID NO: 814523 - RNA, 22 nt, Human
ggguuuuaguauguuggcuggg

SEQ ID NO: 814524 - RNA, 23 nt, Human
guagagacgggguuuuaguaugu

SEQ ID NO: 814525 - RNA, 23 nt, Human
uaaaaagaaggccuuggugauua

SEQ ID NO: 814526 - RNA, 23 nt, Human
uaagaucugagcugccccuaaaa

SEQ ID NO: 814527 - RNA, 25 nt, Human
uaauuuuuguuauuuuuaguagaga

SEQ ID NO: 814528 - RNA, 22 nt, Human
uacagguacgagccaccgcacc

SEQ ID NO: 814529 - RNA, 23 nt, Human
uacaugccuuuauguagcaaaau

SEQ ID NO: 814530 - RNA, 20 nt, Human
uaccacaguugcuacauuca

SEQ ID NO: 814531 - RNA, 18 nt, Human
uacugggcagucuaagag

SEQ ID NO: 814532 - RNA, 19 nt, Human
uagaauagguccuguuugu

SEQ ID NO: 814533 - RNA, 24 nt, Human
uaguagagacgggguuuuaguaug

SEQ ID NO: 814534 - RNA, 21 nt, Human
uaguuugauucaagcuccauc

SEQ ID NO: 814535 - RNA, 24 nt, Human
uauacugggcagucuaagagggag

SEQ ID NO: 814536 - RNA, 21 nt, Human
ucaaguccagccugggcaaca

SEQ ID NO: 814537 - RNA, 24 nt, Human
ucaccgcaaccuccaccucccagg

SEQ ID NO: 814538 - RNA, 27 nt, Human
ucaccgcaaccuccaccucccagguuc

SEQ ID NO: 814539 - RNA, 20 nt, Human
ucaguucugagacagaaaaa

SEQ ID NO: 814540 - RNA, 22 nt, Human
ucaugccgguaaucccaacccu

SEQ ID NO: 814541 - RNA, 30 nt, Human
ucauuacuuucacaggguuuuuucccacag

SEQ ID NO: 814542 - RNA, 24 nt, Human
uccagccugggcaacauagugaga

SEQ ID NO: 814543 - RNA, 22 nt, Human
ucccaaagugcuggauuacagg

SEQ ID NO: 814544 - RNA, 23 nt, Human
ucccacauuuaaacuugucacuc

SEQ ID NO: 814545 - RNA, 21 nt, Human
ucccagguucaagugauucuc

SEQ ID NO: 814546 - RNA, 24 nt, Human
ucccagguucaagugauucuccug

SEQ ID NO: 814547 - RNA, 24 nt, Human
ucgcaaguaccugggacuacaggc

SEQ ID NO: 814548 - RNA, 23 nt, Human
ucgcacuuguugcccaggcugga

SEQ ID NO: 814549 - RNA, 30 nt, Human
ucgugaccucgugaucugcccaccuuggcc

SEQ ID NO: 814550 - RNA, 21 nt, Human
ucuauaauuccuaaaauacaa

SEQ ID NO: 814551 - RNA, 18 nt, Human
ucucaaguaauuagaccc

SEQ ID NO: 814552 - RNA, 24 nt, Human
ucucagaaggucugagcucugauu

SEQ ID NO: 814553 - RNA, 19 nt, Human
ucuccugcccuagccucgc

SEQ ID NO: 814554 - RNA, 23 nt, Human
ucugagcugcccuggaaagcccu

SEQ ID NO: 814555 - RNA, 22 nt, Human
ucugcuuucccaccuucccaug

SEQ ID NO: 814556 - RNA, 24 nt, Human
ucuuuccaugaauaauuuaguuuu

SEQ ID NO: 814557 - RNA, 21 nt, Human
ugaaaaugguaaauuauuugc

SEQ ID NO: 814558 - RNA, 23 nt, Human
ugaaaaugguaaauuauuugcuu

SEQ ID NO: 814559 - RNA, 22 nt, Human
ugaauucuaugaugucucagaa

SEQ ID NO: 814560 - RNA, 21 nt, Human
ugacaaggugggaccucuggc

SEQ ID NO: 814561 - RNA, 18 nt, Human
ugaggagggaggagugcu

SEQ ID NO: 814562 - RNA, 24 nt, Human
ugaggagggaggagugcuugagcc

SEQ ID NO: 814563 - RNA, 23 nt, Human
ugaucugcccaccuuggcuuccc

SEQ ID NO: 814564 - RNA, 24 nt, Human
ugaucugcccaccuuggcuuccca

SEQ ID NO: 814565 - RNA, 21 nt, Human
ugauuauguccaagagcuuuu

SEQ ID NO: 814566 - RNA, 20 nt, Human
ugauucuccugcccuagccu

SEQ ID NO: 814567 - RNA, 22 nt, Human
ugcaguggcaugaucuuggcuc

SEQ ID NO: 814568 - RNA, 23 nt, Human
ugcccacaaaaggaauaaaaaga

SEQ ID NO: 814569 - RNA, 18 nt, Human
ugcccaggcuggagugca

SEQ ID NO: 814570 - RNA, 21 nt, Human
ugcccaggcuggagugcagug

SEQ ID NO: 814571 - RNA, 22 nt, Human
ugcccaggcuggagugcagugg

SEQ ID NO: 814572 - RNA, 24 nt, Human
ugcccaggcuggagugcaguggca

SEQ ID NO: 814573 - RNA, 24 nt, Human
ugccgguaaucccaacccuuuggg

SEQ ID NO: 814574 - RNA, 19 nt, Human
uggagugcaguggcaugau

SEQ ID NO: 814575 - RNA, 24 nt, Human
uggagugcaguggcaugaucuugg

SEQ ID NO: 814576 - RNA, 20 nt, Human
uggauuacagguacgagcca

SEQ ID NO: 814577 - RNA, 21 nt, Human
uggauuacagguacgagccac

SEQ ID NO: 814578 - RNA, 23 nt, Human
uggauuacagguacgagccaccg

SEQ ID NO: 814579 - RNA, 24 nt, Human
uggcuaaagacuuucccacauuca

SEQ ID NO: 814580 - RNA, 21 nt, Human
uggcucaugccgguaauccca

SEQ ID NO: 814581 - RNA, 22 nt, Human
uggcucaugccgguaaucccaa

SEQ ID NO: 814582 - RNA, 24 nt, Human
ugggacuacaggcgugccccacca

SEQ ID NO: 814583 - RNA, 25 nt, Human
ugggacuacaggcgugccccaccau

SEQ ID NO: 814584 - RNA, 18 nt, Human
ugggaggcugaggaggga

SEQ ID NO: 814585 - RNA, 21 nt, Human
uggugcaguggcucaugccgg

SEQ ID NO: 814586 - RNA, 24 nt, Human
ugugugccacaugaagaguuuccc

SEQ ID NO: 814587 - RNA, 21 nt, Human
uguuguacaugccuuuaugua

SEQ ID NO: 814588 - RNA, 24 nt, Human
uuaaaaacauuccauacuguaaca

SEQ ID NO: 814589 - RNA, 18 nt, Human
uuaguagagacgggguuu

SEQ ID NO: 814590 - RNA, 18 nt, Human
uuaguagagacgggguuu

SEQ ID NO: 814591 - RNA, 24 nt, Human
uuaguagagacgggguuuuaguau

SEQ ID NO: 814592 - RNA, 19 nt, Human
uucaaaaagccuaacauag

SEQ ID NO: 814593 - RNA, 22 nt, Human
uucaagcuccaucaaagaugaa

SEQ ID NO: 814594 - RNA, 26 nt, Human
uucaagugauucuccugcccuagccu

SEQ ID NO: 814595 - RNA, 21 nt, Human
uuccaaugugaaguuucuggu

SEQ ID NO: 814596 - RNA, 24 nt, Human
uucccaccuucccaugguuuuuuu

SEQ ID NO: 814597 - RNA, 24 nt, Human
uucgcacuuguugcccaggcugga

SEQ ID NO: 814598 - RNA, 27 nt, Human
uuuaaacuugucacucgacuaggaagu

SEQ ID NO: 814599 - RNA, 24 nt, Human
uuuccuaguuuuacugcauucauu

SEQ ID NO: 814600 - RNA, 23 nt, Human
uuucgcacuuguugcccaggcug

SEQ ID NO: 814601 - RNA, 24 nt, Human
uuucgcacuuguugcccaggcugg

SEQ ID NO: 814602 - RNA, 22 nt, Human
uuuuuaguagagacgggguuuu

SEQ ID NO: 814603 - RNA, 21 nt, Human
uuuuuguuauuuuuaguagag

SEQ ID NO: 814604 - RNA, 24 nt, Human
uuuuuguuauuuuuaguagagacg

SEQ ID NO: 814605 - RNA, 24 nt, Human
aaaacccuaccaugucccuaaaug

SEQ ID NO: 814606 - RNA, 18 nt, Human
aaaaguccccccaaagcu

SEQ ID NO: 814607 - RNA, 19 nt, Human
aaaccacaccccccacccu

SEQ ID NO: 814608 - RNA, 20 nt, Human
aaaggagcugggugucauua

SEQ ID NO: 814609 - RNA, 20 nt, Human
aaaggagcugggugucauua

SEQ ID NO: 814610 - RNA, 25 nt, Human
aaaguccccccaaagcucauggaga

SEQ ID NO: 814611 - RNA, 24 nt, Human
aaagugcugggauuauaggcguga

SEQ ID NO: 814612 - RNA, 23 nt, Human
aaaucuuucuguaucacugcccc

SEQ ID NO: 814613 - RNA, 19 nt, Human
aaccacaccccccacccug

SEQ ID NO: 814614 - RNA, 22 nt, Human
aaguagcugggauuacaggcac

SEQ ID NO: 814615 - RNA, 25 nt, Human
aaguagcugggauuacaggcaccug

SEQ ID NO: 814616 - RNA, 21 nt, Human
aagugauucucaugccucagc

SEQ ID NO: 814617 - RNA, 19 nt, Human
aagugcugggauuauaggc

SEQ ID NO: 814618 - RNA, 19 nt, Human
aagugcugggauuauaggc

SEQ ID NO: 814619 - RNA, 24 nt, Human
aaugcaguggcacgaucuuggcuc

SEQ ID NO: 814620 - RNA, 18 nt, Human
acagagcuaggaagaagg

SEQ ID NO: 814621 - RNA, 19 nt, Human
acaggcaccugccaccacg

SEQ ID NO: 814622 - RNA, 30 nt, Human
accacaccccccacccugauacaaauccaa

SEQ ID NO: 814623 - RNA, 18 nt, Human
accaccaguucccugcca

SEQ ID NO: 814624 - RNA, 22 nt, Human
accaggcuggucuugaacuccu

SEQ ID NO: 814625 - RNA, 18 nt, Human
accauguuggccaggcug

SEQ ID NO: 814626 - RNA, 19 nt, Human
accccaggacguggcccuc

SEQ ID NO: 814627 - RNA, 18 nt, Human
acgggguuucgccauguu

SEQ ID NO: 814628 - RNA, 24 nt, Human
acgggguuucgccauguucaccag

SEQ ID NO: 814629 - RNA, 19 nt, Human
acuacaggugcgcgccacc

SEQ ID NO: 814630 - RNA, 18 nt, Human
acugcaaucucugccucc

SEQ ID NO: 814631 - RNA, 22 nt, Human
acugcaaucucugccuccuggg

SEQ ID NO: 814632 - RNA, 22 nt, Human
agaagggccuggagaaugugcc

SEQ ID NO: 814633 - RNA, 18 nt, Human
agagguuuucuggcaucg

SEQ ID NO: 814634 - RNA, 24 nt, Human
agagugcugggauuacaggcauga

SEQ ID NO: 814635 - RNA, 24 nt, Human
agcaguucuccugccucagccucc

SEQ ID NO: 814636 - RNA, 26 nt, Human
agccuggucucgaacuccugaccucc

SEQ ID NO: 814637 - RNA, 24 nt, Human
agcugcuggcuuuuggggauggga

SEQ ID NO: 814638 - RNA, 19 nt, Human
agcugcuucuucccagcuc

SEQ ID NO: 814639 - RNA, 21 nt, Human
agcugggaacgguggccccgg

SEQ ID NO: 814640 - RNA, 20 nt, Human
aggcaggaugagaucugggg

SEQ ID NO: 814641 - RNA, 20 nt, Human
aggcaugcaccaccaugccc

SEQ ID NO: 814642 - RNA, 21 nt, Human
aggcgugagccaccguaccca

SEQ ID NO: 814643 - RNA, 25 nt, Human
aggcuggagugcaguggcaugaucu

SEQ ID NO: 814644 - RNA, 25 nt, Human
aggcuggagugcaguggugcaaucu

SEQ ID NO: 814645 - RNA, 21 nt, Human
agggcaaugcugagacccaga

SEQ ID NO: 814646 - RNA, 21 nt, Human
aggucaggagcuaccccagga

SEQ ID NO: 814647 - RNA, 24 nt, Human
aggugauccacccaccucagccuc

SEQ ID NO: 814648 - RNA, 24 nt, Human
aggugauccgccugccucggccuc

SEQ ID NO: 814649 - RNA, 18 nt, Human
aguagcugggacuacagg

SEQ ID NO: 814650 - RNA, 21 nt, Human
aguagcugggauuacaggcau

SEQ ID NO: 814651 - RNA, 23 nt, Human
aguagcugggauuacaggcaugc

SEQ ID NO: 814652 - RNA, 24 nt, Human
agugauucucaugccucagccucc

SEQ ID NO: 814653 - RNA, 18 nt, Human
agugcaguggcaugaucu

SEQ ID NO: 814654 - RNA, 19 nt, Human
agugcaguggcaugaucuu

SEQ ID NO: 814655 - RNA, 20 nt, Human
agugcaguggcaugaucuug

SEQ ID NO: 814656 - RNA, 24 nt, Human
agugcaguggugcaaucucggcug

SEQ ID NO: 814657 - RNA, 18 nt, Human
agugcugggauuacaggc

SEQ ID NO: 814658 - RNA, 20 nt, Human
agugcugggauuacaggcau

SEQ ID NO: 814659 - RNA, 24 nt, Human
aguggcaugaucuuggaucacugc

SEQ ID NO: 814660 - RNA, 18 nt, Human
auacugcaucguuaaaaa

SEQ ID NO: 814661 - RNA, 22 nt, Human
aucaggcuucugucauuuuuuu

SEQ ID NO: 814662 - RNA, 20 nt, Human
aucuggggccagugggcguc

SEQ ID NO: 814663 - RNA, 21 nt, Human
augacuucugaaacacucaaa

SEQ ID NO: 814664 - RNA, 18 nt, Human
augagguuucaccauguu

SEQ ID NO: 814665 - RNA, 20 nt, Human
augagguuucaccauguugg

SEQ ID NO: 814666 - RNA, 24 nt, Human
augagguuucaccauguuggccag

SEQ ID NO: 814667 - RNA, 22 nt, Human
augccucagccucccaaguagc

SEQ ID NO: 814668 - RNA, 23 nt, Human
augccucagccucccaaguagcu

SEQ ID NO: 814669 - RNA, 20 nt, Human
augcuggagcugcgugccuu

SEQ ID NO: 814670 - RNA, 18 nt, Human
augggguuucaccauguu

SEQ ID NO: 814671 - RNA, 22 nt, Human
augggguuucaccauguuggcc

SEQ ID NO: 814672 - RNA, 23 nt, Human
augggguuucaccauguuggcca

SEQ ID NO: 814673 - RNA, 24 nt, Human
augggguuucaccauguuggccag

SEQ ID NO: 814674 - RNA, 24 nt, Human
auuuuuguauuuuuaguagagaug

SEQ ID NO: 814675 - RNA, 24 nt, Human
caaaccacaccccccacccugaua

SEQ ID NO: 814676 - RNA, 23 nt, Human
caaagucugggauuacaggcgug

SEQ ID NO: 814677 - RNA, 24 nt, Human
caaagucugggauuacaggcguga

SEQ ID NO: 814678 - RNA, 24 nt, Human
caaagugcugggauuauaggcgug

SEQ ID NO: 814679 - RNA, 20 nt, Human
caaaugaaaaaccaugggug

SEQ ID NO: 814680 - RNA, 19 nt, Human
caaauguuaaaacccuacc

SEQ ID NO: 814681 - RNA, 22 nt, Human
caagcaguucuccugccucagc

SEQ ID NO: 814682 - RNA, 24 nt, Human
caccacacccagcuaauuuuugua

SEQ ID NO: 814683 - RNA, 22 nt, Human
caccaccaugcccggcuaauuu

SEQ ID NO: 814684 - RNA, 24 nt, Human
caccacgccuggcuaauuuuugua

SEQ ID NO: 814685 - RNA, 24 nt, Human
caccaugcccggcuaauuuuugua

SEQ ID NO: 814686 - RNA, 21 nt, Human
caccauguuggccagccuggu

SEQ ID NO: 814687 - RNA, 24 nt, Human
caccauguuggccagccuggucuc

SEQ ID NO: 814688 - RNA, 25 nt, Human
caccauguuggccagccuggucucg

SEQ ID NO: 814689 - RNA, 18 nt, Human
caccauguuggccaggcu

SEQ ID NO: 814690 - RNA, 22 nt, Human
caccauguuggccaggcuguuc

SEQ ID NO: 814691 - RNA, 24 nt, Human
caccauguuggccaggcuguucuc

SEQ ID NO: 814692 - RNA, 27 nt, Human
caccauguuggccaggcuguucucaaa

SEQ ID NO: 814693 - RNA, 20 nt, Human
cacccaccucagccucccag

SEQ ID NO: 814694 - RNA, 23 nt, Human
cacccaccucagccucccagagu

SEQ ID NO: 814695 - RNA, 19 nt, Human
caccccccacccugauaca

SEQ ID NO: 814696 - RNA, 18 nt, Human
cacccuuggaagauuggg

SEQ ID NO: 814697 - RNA, 24 nt, Human
caccucagccucccagagugcugg

SEQ ID NO: 814698 - RNA, 21 nt, Human
caccucaggugauccgccugc

SEQ ID NO: 814699 - RNA, 24 nt, Human
caccucaggugauccgccugccuc

SEQ ID NO: 814700 - RNA, 23 nt, Human
caccugucucggucucccaaagu

SEQ ID NO: 814701 - RNA, 24 nt, Human
caccugucucggucucccaaagug

SEQ ID NO: 814702 - RNA, 21 nt, Human
cacucaaacgcccgauacccu

SEQ ID NO: 814703 - RNA, 20 nt, Human
cacugaggcucaguuaauug

SEQ ID NO: 814704 - RNA, 21 nt, Human
cacugcaaccucugccuccug

SEQ ID NO: 814705 - RNA, 23 nt, Human
cacugcaaccucugccuccuggg

SEQ ID NO: 814706 - RNA, 18 nt, Human
cacuguaaccucugccuc

SEQ ID NO: 814707 - RNA, 23 nt, Human
cagaauguuuagccggcaggcac

SEQ ID NO: 814708 - RNA, 21 nt, Human
cagagcuaggaagaagggccu

SEQ ID NO: 814709 - RNA, 23 nt, Human
cagagcuaggaagaagggccugg

SEQ ID NO: 814710 - RNA, 24 nt, Human
cagagucuugcucugucgcccagg

SEQ ID NO: 814711 - RNA, 24 nt, Human
cagagugcugggauuacaggcaug

SEQ ID NO: 814712 - RNA, 20 nt, Human
cagccacuuuugucaucuug

SEQ ID NO: 814713 - RNA, 21 nt, Human
cagccgguggcuccacaggaa

SEQ ID NO: 814714 - RNA, 23 nt, Human
cagccgguggcuccacaggaacc

SEQ ID NO: 814715 - RNA, 20 nt, Human
cagccuccugaguagcuggg

SEQ ID NO: 814716 - RNA, 19 nt, Human
cagcgcacuggauuuaucu

SEQ ID NO: 814717 - RNA, 19 nt, Human
cagcucuuuugugcagggg

SEQ ID NO: 814718 - RNA, 19 nt, Human
cagcugggccuggcuggca

SEQ ID NO: 814719 - RNA, 22 nt, Human
caggugauccgccugccucggc

SEQ ID NO: 814720 - RNA, 19 nt, Human
caguggcacgaucuuggcu

SEQ ID NO: 814721 - RNA, 20 nt, Human
caguuaauugugggucuggu

SEQ ID NO: 814722 - RNA, 20 nt, Human
caguucuccugccucagccu

SEQ ID NO: 814723 - RNA, 24 nt, Human
cauguucaccaggcuggucuugaa

SEQ ID NO: 814724 - RNA, 24 nt, Human
cauguuggccaggcuguucucaaa

SEQ ID NO: 814725 - RNA, 21 nt, Human
ccaaagucugggauuacaggc

SEQ ID NO: 814726 - RNA, 20 nt, Human
ccaaagugcugggauuauag

SEQ ID NO: 814727 - RNA, 22 nt, Human
ccaaagugcugggauuauaggc

SEQ ID NO: 814728 - RNA, 24 nt, Human
ccaaagugcugggauuauaggcgu

SEQ ID NO: 814729 - RNA, 20 nt, Human
ccaacccggaacagcguugg

SEQ ID NO: 814730 - RNA, 23 nt, Human
ccaaguagcugggauuacaggca

SEQ ID NO: 814731 - RNA, 20 nt, Human
ccaccacgccuggcuaauuu

SEQ ID NO: 814732 - RNA, 25 nt, Human
ccacccaccucagccucccagagug

SEQ ID NO: 814733 - RNA, 23 nt, Human
ccagagugcugggauuacaggca

SEQ ID NO: 814734 - RNA, 24 nt, Human
ccagagugcugggauuacaggcau

SEQ ID NO: 814735 - RNA, 24 nt, Human
ccagcuauucuucuaccucagccu

SEQ ID NO: 814736 - RNA, 24 nt, Human
cccaaagucugggauuacaggcgu

SEQ ID NO: 814737 - RNA, 23 nt, Human
cccaaguagcugggauuacaggc

SEQ ID NO: 814738 - RNA, 24 nt, Human
cccaaguagcugggauuacaggca

SEQ ID NO: 814739 - RNA, 24 nt, Human
cccagagugcugggauuacaggca

SEQ ID NO: 814740 - RNA, 19 nt, Human
cccaggcuggagugcagug

SEQ ID NO: 814741 - RNA, 19 nt, Human
cccaggcuggagugcagug

SEQ ID NO: 814742 - RNA, 22 nt, Human
cccaggcuggagugcaguggug

SEQ ID NO: 814743 - RNA, 21 nt, Human
ccccagggcaaugcugagacc

SEQ ID NO: 814744 - RNA, 24 nt, Human
ccccagggcaaugcugagacccag

SEQ ID NO: 814745 - RNA, 21 nt, Human
cccccaaagcucauggagacg

SEQ ID NO: 814746 - RNA, 24 nt, Human
cccccaaagcucauggagacgacg

SEQ ID NO: 814747 - RNA, 24 nt, Human
ccccucagcacuaaauaccaccag

SEQ ID NO: 814748 - RNA, 23 nt, Human
cccgaguagcugggauuacaggc

SEQ ID NO: 814749 - RNA, 24 nt, Human
cccgaguagcugggauuacaggca

SEQ ID NO: 814750 - RNA, 21 nt, Human
cccggcuguuugaccucggcc

SEQ ID NO: 814751 - RNA, 23 nt, Human
ccgaguagcugggauuacaggca

SEQ ID NO: 814752 - RNA, 24 nt, Human
ccgaguagcugggauuacaggcau

SEQ ID NO: 814753 - RNA, 22 nt, Human
ccgggguggcggugggugucug

SEQ ID NO: 814754 - RNA, 24 nt, Human
ccucaccucaggugauccgccugc

SEQ ID NO: 814755 - RNA, 21 nt, Human
ccucccgaacaagaacccgcu

SEQ ID NO: 814756 - RNA, 24 nt, Human
ccuccuggguuccagcuauucuuc

SEQ ID NO: 814757 - RNA, 23 nt, Human
ccuccuuacuggcaaacaaaggc

SEQ ID NO: 814758 - RNA, 24 nt, Human
ccucuccuccuuacuggcaaacaa

SEQ ID NO: 814759 - RNA, 19 nt, Human
ccucugccuccuggguuca

SEQ ID NO: 814760 - RNA, 24 nt, Human
ccucugccuccuggguucaagcag

SEQ ID NO: 814761 - RNA, 21 nt, Human
ccugaccucaggugauccacc

SEQ ID NO: 814762 - RNA, 24 nt, Human
ccugaccucaggugauccacccac

SEQ ID NO: 814763 - RNA, 23 nt, Human
ccugaccucaggugauccaccug

SEQ ID NO: 814764 - RNA, 24 nt, Human
ccugaccucaggugauccaccugu

SEQ ID NO: 814765 - RNA, 23 nt, Human
ccugaguagcugggacuacaggu

SEQ ID NO: 814766 - RNA, 24 nt, Human
ccugaguagcugggacuacaggug

SEQ ID NO: 814767 - RNA, 23 nt, Human
ccugccucagccucccgaguagc

SEQ ID NO: 814768 - RNA, 23 nt, Human
ccuggguucaagcaguucuccug

SEQ ID NO: 814769 - RNA, 18 nt, Human
ccugucugugacuuggaa

SEQ ID NO: 814770 - RNA, 18 nt, Human
cgacagguggccucgccg

SEQ ID NO: 814771 - RNA, 18 nt, Human
cgagguagcugcuucuuc

SEQ ID NO: 814772 - RNA, 24 nt, Human
cgccauguucaccaggcuggucuu

SEQ ID NO: 814773 - RNA, 25 nt, Human
cggcauaacgggcggacccccuucu

SEQ ID NO: 814774 - RNA, 27 nt, Human
cggcugcgcccccucucaucgccgccc

SEQ ID NO: 814775 - RNA, 21 nt, Human
cgggugcagcugggcaucgcu

SEQ ID NO: 814776 - RNA, 22 nt, Human
cguggccagcgcccgccagcuc

SEQ ID NO: 814777 - RNA, 21 nt, Human
cguuggcgugucccagccuga

SEQ ID NO: 814778 - RNA, 20 nt, Human
cuaaaugucccagccucccc

SEQ ID NO: 814779 - RNA, 23 nt, Human
cuaauuuuuguauuuuuaguaga

SEQ ID NO: 814780 - RNA, 19 nt, Human
cucacuguaaccucugccu

SEQ ID NO: 814781 - RNA, 24 nt, Human
cucacuguaaccucugccucucag

SEQ ID NO: 814782 - RNA, 24 nt, Human
cucagccucccaaguagcugggau

SEQ ID NO: 814783 - RNA, 24 nt, Human
cucagccucccgaguagcugggau

SEQ ID NO: 814784 - RNA, 24 nt, Human
cucagccuccugaguagcugggac

SEQ ID NO: 814785 - RNA, 25 nt, Human
cucaugccucagccucccaaguagc

SEQ ID NO: 814786 - RNA, 18 nt, Human
cuccgagguagcugcuuc

SEQ ID NO: 814787 - RNA, 21 nt, Human
cuccuggguucaagcaguucu

SEQ ID NO: 814788 - RNA, 21 nt, Human
cuccuggguuccagcuauucu

SEQ ID NO: 814789 - RNA, 22 nt, Human
cucggucucccaaagugcuggg

SEQ ID NO: 814790 - RNA, 19 nt, Human
cucucaucgccgcccgccu

SEQ ID NO: 814791 - RNA, 21 nt, Human
cucucugcaaacacuguccau

SEQ ID NO: 814792 - RNA, 21 nt, Human
cucugccuccuggguuccagc

SEQ ID NO: 814793 - RNA, 23 nt, Human
cucugucgcccaggcuggaaugc

SEQ ID NO: 814794 - RNA, 20 nt, Human
cucugucucccaggcuggag

SEQ ID NO: 814795 - RNA, 21 nt, Human
cucuuguugcccaggcuggag

SEQ ID NO: 814796 - RNA, 24 nt, Human
cugacugcaaucucugccuccugg

SEQ ID NO: 814797 - RNA, 23 nt, Human
cugauccucucaaaggagcuggg

SEQ ID NO: 814798 - RNA, 19 nt, Human
cugcaaccucugccuccug

SEQ ID NO: 814799 - RNA, 23 nt, Human
cugcaaccucugccuccuggguu

SEQ ID NO: 814800 - RNA, 24 nt, Human
cugcaaccucugccuccuggguuc

SEQ ID NO: 814801 - RNA, 24 nt, Human
cugcaaucucugccuccuggguuc

SEQ ID NO: 814802 - RNA, 23 nt, Human
cugccucagccucccgaguagcu

SEQ ID NO: 814803 - RNA, 19 nt, Human
cugcgagcaggagcggagg

SEQ ID NO: 814804 - RNA, 23 nt, Human
cugcuucuucccagcucagggcu

SEQ ID NO: 814805 - RNA, 18 nt, Human
cuggaaucuucuuccaug

SEQ ID NO: 814806 - RNA, 18 nt, Human
cuggagccugucuccucc

SEQ ID NO: 814807 - RNA, 19 nt, Human
cuggagggaaaggcacagg

SEQ ID NO: 814808 - RNA, 24 nt, Human
cuggagugcaguggcaugaucuug

SEQ ID NO: 814809 - RNA, 24 nt, Human
cuguaaccucugccucucagguuu

SEQ ID NO: 814810 - RNA, 23 nt, Human
cugucucggucucccaaagugcu

SEQ ID NO: 814811 - RNA, 23 nt, Human
cuuccaugacgguuaaggcccag

SEQ ID NO: 814812 - RNA, 24 nt, Human
cuuguugcccaggcuggagugcag

SEQ ID NO: 814813 - RNA, 21 nt, Human
cuuucuguaucacugccccuc

SEQ ID NO: 814814 - RNA, 19 nt, Human
gacaagcaagagaaggguc

SEQ ID NO: 814815 - RNA, 21 nt, Human
gacaucugaguuaaaggggcu

SEQ ID NO: 814816 - RNA, 24 nt, Human
gaccucaggugauccacccaccuc

SEQ ID NO: 814817 - RNA, 24 nt, Human
gaccucaggugauccaccugucuc

SEQ ID NO: 814818 - RNA, 20 nt, Human
gagacgggguuucgccaugu

SEQ ID NO: 814819 - RNA, 18 nt, Human
gagaugggguuucaccau

SEQ ID NO: 814820 - RNA, 24 nt, Human
gagaugggguuucaccauguuggc

SEQ ID NO: 814821 - RNA, 20 nt, Human
gaggucaggagcuaccccag

SEQ ID NO: 814822 - RNA, 22 nt, Human
gagguuucaccauguuggccag

SEQ ID NO: 814823 - RNA, 24 nt, Human
gaguagcugggacuacaggugcgc

SEQ ID NO: 814824 - RNA, 19 nt, Human
gagugcugggauuacaggc

SEQ ID NO: 814825 - RNA, 18 nt, Human
gauuacaggcaugagcca

SEQ ID NO: 814826 - RNA, 21 nt, Human
gauuacaggcaugagccacug

SEQ ID NO: 814827 - RNA, 24 nt, Human
gauuacaggcaugagccacugugc

SEQ ID NO: 814828 - RNA, 24 nt, Human
gauuacaggcaugcaccaccaugc

SEQ ID NO: 814829 - RNA, 18 nt, Human
gauuacaggcgugagcca

SEQ ID NO: 814830 - RNA, 21 nt, Human
gauuacaggcgugagccaucg

SEQ ID NO: 814831 - RNA, 24 nt, Human
gauuacaggcgugagccaucgugc

SEQ ID NO: 814832 - RNA, 18 nt, Human
gauuauaggcgugagcca

SEQ ID NO: 814833 - RNA, 21 nt, Human
gauuauaggcgugagccaccg

SEQ ID NO: 814834 - RNA, 24 nt, Human
gauuauaggcgugagccaccguac

SEQ ID NO: 814835 - RNA, 22 nt, Human
gcaaccucugccuccuggguuc

SEQ ID NO: 814836 - RNA, 20 nt, Human
gcaccaccaugcccggcuaa

SEQ ID NO: 814837 - RNA, 21 nt, Human
gccaaaccacaccccccaccc

SEQ ID NO: 814838 - RNA, 24 nt, Human
gccauguucaccaggcuggucuug

SEQ ID NO: 814839 - RNA, 18 nt, Human
gcccagccuggauagcac

SEQ ID NO: 814840 - RNA, 23 nt, Human
gcccaggcuggaaugcaguggca

SEQ ID NO: 814841 - RNA, 20 nt, Human
gcccaggcuggagugcagug

SEQ ID NO: 814842 - RNA, 24 nt, Human
gcccaggcuggagugcaguggcau

SEQ ID NO: 814843 - RNA, 21 nt, Human
gcccgauacccuguaucuucc

SEQ ID NO: 814844 - RNA, 22 nt, Human
gcccggcuaauuuuuguauuuu

SEQ ID NO: 814845 - RNA, 21 nt, Human
gccgggguggcgguggguguc

SEQ ID NO: 814846 - RNA, 24 nt, Human
gccuguugucugugacugcuggug

SEQ ID NO: 814847 - RNA, 21 nt, Human
gcucacuguaaccucugccuc

SEQ ID NO: 814848 - RNA, 20 nt, Human
gcucuuguugcccaggcugg

SEQ ID NO: 814849 - RNA, 21 nt, Human
gcucuuguugcccaggcugga

SEQ ID NO: 814850 - RNA, 25 nt, Human
gcugcgcccccucucaucgccgccc

SEQ ID NO: 814851 - RNA, 19 nt, Human
gcuggaaugcaguggcacg

SEQ ID NO: 814852 - RNA, 19 nt, Human
gcuggagugcaguggcaug

SEQ ID NO: 814853 - RNA, 23 nt, Human
gcuggucuugaacuccugaccuc

SEQ ID NO: 814854 - RNA, 18 nt, Human
ggacucaggaugaggcag

SEQ ID NO: 814855 - RNA, 24 nt, Human
ggauuacaggcaugagccacugug

SEQ ID NO: 814856 - RNA, 24 nt, Human
ggauuacaggcaugcaccaccaug

SEQ ID NO: 814857 - RNA, 24 nt, Human
ggcuggucuugaacuccugaccuc

SEQ ID NO: 814858 - RNA, 22 nt, Human
gggggaggguuuaugacgcauc

SEQ ID NO: 814859 - RNA, 22 nt, Human
gggguuucaccauguuggccag

SEQ ID NO: 814860 - RNA, 21 nt, Human
gggucgggguccauugcauuu

SEQ ID NO: 814861 - RNA, 19 nt, Human
ggucucgaacuccugaccu

SEQ ID NO: 814862 - RNA, 19 nt, Human
ggucuugaacuccugaccu

SEQ ID NO: 814863 - RNA, 23 nt, Human
guagagaugggguuucaccaugu

SEQ ID NO: 814864 - RNA, 18 nt, Human
guagcugggauuacaggc

SEQ ID NO: 814865 - RNA, 18 nt, Human
guagcugggauuacaggc

SEQ ID NO: 814866 - RNA, 20 nt, Human
guagcugggauuacaggcau

SEQ ID NO: 814867 - RNA, 18 nt, Human
gucugguuggcccagccu

SEQ ID NO: 814868 - RNA, 19 nt, Human
gucuguggcuccaaccugg

SEQ ID NO: 814869 - RNA, 24 nt, Human
gucuugcucugucgcccaggcugg

SEQ ID NO: 814870 - RNA, 24 nt, Human
gugauccacccaccucagccuccc

SEQ ID NO: 814871 - RNA, 24 nt, Human
gugauccaccugucucggucuccc

SEQ ID NO: 814872 - RNA, 21 nt, Human
gugauccgccugccucggccu

SEQ ID NO: 814873 - RNA, 22 nt, Human
gugauccgccugccucggccuc

SEQ ID NO: 814874 - RNA, 24 nt, Human
gugauucucaugccucagccuccc

SEQ ID NO: 814875 - RNA, 19 nt, Human
gugcagggguggguggggu

SEQ ID NO: 814876 - RNA, 19 nt, Human
gugggucugguuggcccag

SEQ ID NO: 814877 - RNA, 21 nt, Human
guucuccugccucagccuccc

SEQ ID NO: 814878 - RNA, 18 nt, Human
uaaaaguccccccaaagc

SEQ ID NO: 814879 - RNA, 23 nt, Human
uaaauaccaccaguucccugcca

SEQ ID NO: 814880 - RNA, 20 nt, Human
uaaccccaaaugcaauuccu

SEQ ID NO: 814881 - RNA, 26 nt, Human
uaacgggcggacccccuggaguuucu

SEQ ID NO: 814882 - RNA, 27 nt, Human
uaagugauucucaugccucagccuccc

SEQ ID NO: 814883 - RNA, 24 nt, Human
uaauuuuuguauuuuuaguagaga

SEQ ID NO: 814884 - RNA, 24 nt, Human
uaauuuuuguauuuuuaguagaga

SEQ ID NO: 814885 - RNA, 24 nt, Human
uaauuuuuguauuuuuauuagaga

SEQ ID NO: 814886 - RNA, 22 nt, Human
uacaggcaccugccaccacgcc

SEQ ID NO: 814887 - RNA, 23 nt, Human
uacaggcaugagccacugugccc

SEQ ID NO: 814888 - RNA, 24 nt, Human
uacaggcaugagccacugugcccu

SEQ ID NO: 814889 - RNA, 23 nt, Human
uacaggcaugcaccaccaugccc

SEQ ID NO: 814890 - RNA, 22 nt, Human
uacaggcgugagccaucgugcc

SEQ ID NO: 814891 - RNA, 23 nt, Human
uacaggcgugagccaucgugccu

SEQ ID NO: 814892 - RNA, 24 nt, Human
uacaggugcgcgccaccacaccca

SEQ ID NO: 814893 - RNA, 24 nt, Human
uaccaugucccuaaaugucccagc

SEQ ID NO: 814894 - RNA, 24 nt, Human
uaccucagccuccugaguagcugg

SEQ ID NO: 814895 - RNA, 20 nt, Human
uagagacgggguuucgccau

SEQ ID NO: 814896 - RNA, 21 nt, Human
uagagacgggguuucgccaug

SEQ ID NO: 814897 - RNA, 22 nt, Human
uagagacgggguuucgccaugu

SEQ ID NO: 814898 - RNA, 22 nt, Human
uagagaugagguuucaccaugu

SEQ ID NO: 814899 - RNA, 22 nt, Human
uagagaugggguuucaccaugu

SEQ ID NO: 814900 - RNA, 18 nt, Human
uagccggcaggcaccuuc

SEQ ID NO: 814901 - RNA, 24 nt, Human
uaguagagaugagguuucaccaug

SEQ ID NO: 814902 - RNA, 24 nt, Human
uaguagagaugggguuucaccaug

SEQ ID NO: 814903 - RNA, 24 nt, Human
uauuagagacgggguuucgccaug

SEQ ID NO: 814904 - RNA, 19 nt, Human
uauuuuuuuugagacagag

SEQ ID NO: 814905 - RNA, 20 nt, Human
ucaaaggagcugggugucau

SEQ ID NO: 814906 - RNA, 18 nt, Human
ucaccucaggugauccgc

SEQ ID NO: 814907 - RNA, 23 nt, Human
ucacugcaaccucugccuccugg

SEQ ID NO: 814908 - RNA, 24 nt, Human
ucacugcaaccucugccuccuggg

SEQ ID NO: 814909 - RNA, 25 nt, Human
ucacugcaaccucugccuccugggu

SEQ ID NO: 814910 - RNA, 27 nt, Human
ucacugcaaccucugccuccuggguuc

SEQ ID NO: 814911 - RNA, 19 nt, Human
ucacuguaaccucugccuc

SEQ ID NO: 814912 - RNA, 24 nt, Human
ucacuguaaccucugccucucagg

SEQ ID NO: 814913 - RNA, 20 nt, Human
ucagagccaguuucugagcc

SEQ ID NO: 814914 - RNA, 20 nt, Human
ucagccucccaaguagcugg

SEQ ID NO: 814915 - RNA, 20 nt, Human
ucagccucccgaguagcugg

SEQ ID NO: 814916 - RNA, 23 nt, Human
ucagccuccugaguagcugggac

SEQ ID NO: 814917 - RNA, 19 nt, Human
ucagggcuggcagaggcuc

SEQ ID NO: 814918 - RNA, 21 nt, Human
ucagggcuggcagaggcucgg

SEQ ID NO: 814919 - RNA, 20 nt, Human
ucaggugauccacccaccuc

SEQ ID NO: 814920 - RNA, 21 nt, Human
ucaggugauccaccugucucg

SEQ ID NO: 814921 - RNA, 21 nt, Human
ucaggugauccgccugccucg

SEQ ID NO: 814922 - RNA, 25 nt, Human
uccaacccggaacagcguuggugac

SEQ ID NO: 814923 - RNA, 18 nt, Human
uccacaggaaccugcagg

SEQ ID NO: 814924 - RNA, 20 nt, Human
uccacauaaaagucccccca

SEQ ID NO: 814925 - RNA, 22 nt, Human
uccacauaaaaguccccccaaa

SEQ ID NO: 814926 - RNA, 21 nt, Human
uccacccaccucagccuccca

SEQ ID NO: 814927 - RNA, 22 nt, Human
uccacccaccucagccucccag

SEQ ID NO: 814928 - RNA, 23 nt, Human
ucccaaagucugggauuacaggc

SEQ ID NO: 814929 - RNA, 24 nt, Human
ucccaaagucugggauuacaggcg

SEQ ID NO: 814930 - RNA, 24 nt, Human
ucccaaagugcugggauuauaggc

SEQ ID NO: 814931 - RNA, 24 nt, Human
ucccaaguagcugggauuacaggc

SEQ ID NO: 814932 - RNA, 24 nt, Human
ucccagagugcugggauuacaggc

SEQ ID NO: 814933 - RNA, 19 nt, Human
ucccagccugacgcugggu

SEQ ID NO: 814934 - RNA, 21 nt, Human
ucccaggcuggagugcagugg

SEQ ID NO: 814935 - RNA, 23 nt, Human
ucccaggcuggagugcaguggug

SEQ ID NO: 814936 - RNA, 23 nt, Human
uccccagggcaaugcugagaccc

SEQ ID NO: 814937 - RNA, 24 nt, Human
ucccgaguagcugggauuacaggc

SEQ ID NO: 814938 - RNA, 19 nt, Human
ucccuaaaugucccagccu

SEQ ID NO: 814939 - RNA, 21 nt, Human
uccucuugcuaggucugcccc

SEQ ID NO: 814940 - RNA, 24 nt, Human
uccugaguagcugggacuacaggu

SEQ ID NO: 814941 - RNA, 19 nt, Human
uccuggguucaagcaguuc

SEQ ID NO: 814942 - RNA, 21 nt, Human
uccuggguucaagcaguucuc

SEQ ID NO: 814943 - RNA, 24 nt, Human
uccuggguucaagcaguucuccug

SEQ ID NO: 814944 - RNA, 21 nt, Human
uccuggguuccagcuauucuu

SEQ ID NO: 814945 - RNA, 22 nt, Human
ucgccauguucaccaggcuggu

SEQ ID NO: 814946 - RNA, 24 nt, Human
ucgcccaggcuggaaugcaguggc

SEQ ID NO: 814947 - RNA, 21 nt, Human
ucgcgcaggacccugucccac

SEQ ID NO: 814948 - RNA, 20 nt, Human
ucgggguccauugcauuuug

SEQ ID NO: 814949 - RNA, 24 nt, Human
ucuaccucagccuccugaguagcu

SEQ ID NO: 814950 - RNA, 24 nt, Human
ucucccaggcuggagugcaguggu

SEQ ID NO: 814951 - RNA, 24 nt, Human
ucuccugccucagccucccgagua

SEQ ID NO: 814952 - RNA, 23 nt, Human
ucucgaacuccugaccucaggug

SEQ ID NO: 814953 - RNA, 21 nt, Human
ucucugccuccuggguuccaa

SEQ ID NO: 814954 - RNA, 20 nt, Human
ucugcagcugagacagccuc

SEQ ID NO: 814955 - RNA, 22 nt, Human
ucugcauccgaggaaggucacc

SEQ ID NO: 814956 - RNA, 21 nt, Human
ucugcuguuccaacccggaac

SEQ ID NO: 814957 - RNA, 23 nt, Human
ucuggaggguccgcuggggcuga

SEQ ID NO: 814958 - RNA, 19 nt, Human
ucugguuggcccagccugg

SEQ ID NO: 814959 - RNA, 18 nt, Human
ucuguaucacugccccuc

SEQ ID NO: 814960 - RNA, 24 nt, Human
ucugucgcccaggcuggaaugcag

SEQ ID NO: 814961 - RNA, 19 nt, Human
ucugucucccaggcuggag

SEQ ID NO: 814962 - RNA, 21 nt, Human
ucuguggcuccaaccuggagc

SEQ ID NO: 814963 - RNA, 23 nt, Human
ucuugaacuccugaccucaggug

SEQ ID NO: 814964 - RNA, 22 nt, Human
ucuugcucugucgcccaggcug

SEQ ID NO: 814965 - RNA, 23 nt, Human
ucuugcucugucgcccaggcugg

SEQ ID NO: 814966 - RNA, 24 nt, Human
ucuugcucugucgcccaggcugga

SEQ ID NO: 814967 - RNA, 19 nt, Human
ucuugcucugucucccagg

SEQ ID NO: 814968 - RNA, 23 nt, Human
ucuugcucugucucccaggcugg

SEQ ID NO: 814969 - RNA, 24 nt, Human
ucuugcucugucucccaggcugga

SEQ ID NO: 814970 - RNA, 22 nt, Human
ucuuguugcccaggcuggagug

SEQ ID NO: 814971 - RNA, 19 nt, Human
ugaaaaaccauggguguga

SEQ ID NO: 814972 - RNA, 19 nt, Human
ugaaacacucaaacgcccg

SEQ ID NO: 814973 - RNA, 21 nt, Human
ugaccaggacuuugggggagg

SEQ ID NO: 814974 - RNA, 19 nt, Human
ugaccagugauccgcauuu

SEQ ID NO: 814975 - RNA, 19 nt, Human
ugaccucaggugauccacc

SEQ ID NO: 814976 - RNA, 21 nt, Human
ugaccucaggugauccaccca

SEQ ID NO: 814977 - RNA, 24 nt, Human
ugaccucaggugauccacccaccu

SEQ ID NO: 814978 - RNA, 24 nt, Human
ugaccucaggugauccaccugucu

SEQ ID NO: 814979 - RNA, 18 nt, Human
ugaccucggcaugccugc

SEQ ID NO: 814980 - RNA, 21 nt, Human
ugacgcuggguugggggagca

SEQ ID NO: 814981 - RNA, 24 nt, Human
ugacugcaaucucugccuccuggg

SEQ ID NO: 814982 - RNA, 26 nt, Human
ugacuuggaagcggccccagucuucc

SEQ ID NO: 814983 - RNA, 20 nt, Human
ugagcaacucucugcaaaca

SEQ ID NO: 814984 - RNA, 19 nt, Human
ugagccucugcuguuccaa

SEQ ID NO: 814985 - RNA, 19 nt, Human
ugaggcaggaugagaucug

SEQ ID NO: 814986 - RNA, 18 nt, Human
ugaggggcucagagcugg

SEQ ID NO: 814987 - RNA, 24 nt, Human
ugagguuucaccauguuggccagg

SEQ ID NO: 814988 - RNA, 24 nt, Human
ugcagcugagacagccucuccucc

SEQ ID NO: 814989 - RNA, 22 nt, Human
ugcaguggcacgaucuuggcuc

SEQ ID NO: 814990 - RNA, 18 nt, Human
ugcccaggcuggagugca

SEQ ID NO: 814991 - RNA, 22 nt, Human
ugcccaggcuggagugcagugg

SEQ ID NO: 814992 - RNA, 24 nt, Human
ugcccaggcuggagugcaguggca

SEQ ID NO: 814993 - RNA, 24 nt, Human
ugcccggcuaauuuuuguauuuuu

SEQ ID NO: 814994 - RNA, 24 nt, Human
ugccucagccucccaaguagcugg

SEQ ID NO: 814995 - RNA, 24 nt, Human
ugccucagccucccgaguagcugg

SEQ ID NO: 814996 - RNA, 19 nt, Human
ugccuccuggguuccagcu

SEQ ID NO: 814997 - RNA, 23 nt, Human
ugccucggccucccaaagucugg

SEQ ID NO: 814998 - RNA, 20 nt, Human
ugcgcgccaccacacccagc

SEQ ID NO: 814999 - RNA, 25 nt, Human
ugcucuggaggguccgcuggggcug

SEQ ID NO: 815000 - RNA, 24 nt, Human
ugcucugucgcccaggcuggaaug

SEQ ID NO: 815001 - RNA, 24 nt, Human
ugcucuuguugcccaggcuggagu

SEQ ID NO: 815002 - RNA, 18 nt, Human
ugcugagaggucaaccac

SEQ ID NO: 815003 - RNA, 19 nt, Human
uggaagauugggacucagg

SEQ ID NO: 815004 - RNA, 20 nt, Human
uggaauaaccccaaaugcaa

SEQ ID NO: 815005 - RNA, 24 nt, Human
uggaaugcaguggcacgaucuugg

SEQ ID NO: 815006 - RNA, 21 nt, Human
uggaccacauuagaaaagucu

SEQ ID NO: 815007 - RNA, 23 nt, Human
uggagggaaaggcacaggaaagg

SEQ ID NO: 815008 - RNA, 19 nt, Human
uggagugcaguggcaugau

SEQ ID NO: 815009 - RNA, 24 nt, Human
uggagugcaguggcaugaucuugg

SEQ ID NO: 815010 - RNA, 23 nt, Human
uggagugcaguggugcaaucucg

SEQ ID NO: 815011 - RNA, 24 nt, Human
uggagugcaguggugcaaucucgg

SEQ ID NO: 815012 - RNA, 24 nt, Human
uggcacgaucuuggcucacuguaa

SEQ ID NO: 815013 - RNA, 20 nt, Human
uggcagcugggccuggcugg

SEQ ID NO: 815014 - RNA, 23 nt, Human
uggcaggagcugcuggcuuuugg

SEQ ID NO: 815015 - RNA, 21 nt, Human
uggcaugaucuuggaucacug

SEQ ID NO: 815016 - RNA, 19 nt, Human
uggccaaaccacacccccc

SEQ ID NO: 815017 - RNA, 24 nt, Human
uggccaggcuguucucaaacuccu

SEQ ID NO: 815018 - RNA, 23 nt, Human
uggcggugggugucuguggcucc

SEQ ID NO: 815019 - RNA, 19 nt, Human
uggcuccacaggaaccugc

SEQ ID NO: 815020 - RNA, 20 nt, Human
ugggacaaaucguggcagcu

SEQ ID NO: 815021 - RNA, 25 nt, Human
ugggacaaaucguggcagcugggcc

SEQ ID NO: 815022 - RNA, 22 nt, Human
ugggacuacaggugcgcgccac

SEQ ID NO: 815023 - RNA, 24 nt, Human
ugggacuacaggugcgcgccacca

SEQ ID NO: 815024 - RNA, 18 nt, Human
ugggagguauugacgggg

SEQ ID NO: 815025 - RNA, 21 nt, Human
ugggauuacaggcaccugcca

SEQ ID NO: 815026 - RNA, 22 nt, Human
ugggauuacaggcaccugccac

SEQ ID NO: 815027 - RNA, 24 nt, Human
ugggauuacaggcaccugccacca

SEQ ID NO: 815028 - RNA, 21 nt, Human
ugggauuacaggcaugagcca

SEQ ID NO: 815029 - RNA, 22 nt, Human
ugggauuacaggcaugagccac

SEQ ID NO: 815030 - RNA, 22 nt, Human
ugggauuacaggcaugagccac

SEQ ID NO: 815031 - RNA, 22 nt, Human
ugggauuacaggcaugagccac

SEQ ID NO: 815032 - RNA, 23 nt, Human
ugggauuacaggcaugagccacu

SEQ ID NO: 815033 - RNA, 24 nt, Human
ugggauuacaggcaugagccacug

SEQ ID NO: 815034 - RNA, 21 nt, Human
ugggauuacaggcaugcacca

SEQ ID NO: 815035 - RNA, 24 nt, Human
ugggauuacaggcaugcaccacca

SEQ ID NO: 815036 - RNA, 19 nt, Human
ugggauuacaggcgugagc

SEQ ID NO: 815037 - RNA, 21 nt, Human
ugggauuacaggcgugagcca

SEQ ID NO: 815038 - RNA, 21 nt, Human
ugggauuacaggcgugagcca

SEQ ID NO: 815039 - RNA, 21 nt, Human
ugggauuacaggcgugagcca

SEQ ID NO: 815040 - RNA, 22 nt, Human
ugggauuacaggcgugagccau

SEQ ID NO: 815041 - RNA, 24 nt, Human
ugggauuacaggcgugagccaucg

SEQ ID NO: 815042 - RNA, 27 nt, Human
ugggauuacaggcgugagccaucgugc

SEQ ID NO: 815043 - RNA, 21 nt, Human
ugggauuauaggcgugagcca

SEQ ID NO: 815044 - RNA, 22 nt, Human
ugggauuauaggcgugagccac

SEQ ID NO: 815045 - RNA, 23 nt, Human
ugggauuauaggcgugagccacc

SEQ ID NO: 815046 - RNA, 23 nt, Human
ugggauuauaggcgugagccacc

SEQ ID NO: 815047 - RNA, 24 nt, Human
ugggauuauaggcgugagccaccg

SEQ ID NO: 815048 - RNA, 24 nt, Human
ugggcugcugaccaggacuuuggg

SEQ ID NO: 815049 - RNA, 23 nt, Human
uggggcugaguuggggucuucag

SEQ ID NO: 815050 - RNA, 23 nt, Human
ugggguuucaccauguuggccag

SEQ ID NO: 815051 - RNA, 18 nt, Human
uggguggaaugaguucuu

SEQ ID NO: 815052 - RNA, 22 nt, Human
uggguggaaugaguucuuuccu

SEQ ID NO: 815053 - RNA, 21 nt, Human
uggucucgaacuccugaccuc

SEQ ID NO: 815054 - RNA, 23 nt, Human
uguaaccucugccucucagguuu

SEQ ID NO: 815055 - RNA, 21 nt, Human
uguauuuuuaguagagauggg

SEQ ID NO: 815056 - RNA, 19 nt, Human
ugucaucuuguguuggcuu

SEQ ID NO: 815057 - RNA, 18 nt, Human
ugucccagccugacgcug

SEQ ID NO: 815058 - RNA, 21 nt, Human
ugucccagccugacgcugggu

SEQ ID NO: 815059 - RNA, 22 nt, Human
ugucucaggucaagaugcacug

SEQ ID NO: 815060 - RNA, 21 nt, Human
ugucucccaggcuggagugca

SEQ ID NO: 815061 - RNA, 22 nt, Human
uguggacggugcaggucguggc

SEQ ID NO: 815062 - RNA, 27 nt, Human
uguuggccagccuggucucgaacuccu

SEQ ID NO: 815063 - RNA, 21 nt, Human
uuagaaaagucugucuucuuu

SEQ ID NO: 815064 - RNA, 21 nt, Human
uuagagacgggguuucgccau

SEQ ID NO: 815065 - RNA, 18 nt, Human
uuaguagagaugagguuu

SEQ ID NO: 815066 - RNA, 22 nt, Human
uuaguagagaugagguuucacc

SEQ ID NO: 815067 - RNA, 24 nt, Human
uuaguagagaugagguuucaccau

SEQ ID NO: 815068 - RNA, 18 nt, Human
uuaguagagaugggguuu

SEQ ID NO: 815069 - RNA, 22 nt, Human
uuaguagagaugggguuucacc

SEQ ID NO: 815070 - RNA, 24 nt, Human
uuaguagagaugggguuucaccau

SEQ ID NO: 815071 - RNA, 24 nt, Human
uuauuagagacgggguuucgccau

SEQ ID NO: 815072 - RNA, 21 nt, Human
uucaagcaguucuccugccuc

SEQ ID NO: 815073 - RNA, 18 nt, Human
uucgugaguguggaaggg

SEQ ID NO: 815074 - RNA, 21 nt, Human
uucuggagggaaaggcacagg

SEQ ID NO: 815075 - RNA, 19 nt, Human
uucugggucagguagggcc

SEQ ID NO: 815076 - RNA, 22 nt, Human
uucugggucagguagggccuca

SEQ ID NO: 815077 - RNA, 21 nt, Human
uugacaucugaguuaaagggg

SEQ ID NO: 815078 - RNA, 18 nt, Human
uugcucugucucccaggc

SEQ ID NO: 815079 - RNA, 23 nt, Human
uugcucuuguugcccaggcugga

SEQ ID NO: 815080 - RNA, 19 nt, Human
uuggccagccuggucucga

SEQ ID NO: 815081 - RNA, 23 nt, Human
uuguauuuuuaguagagaugggg

SEQ ID NO: 815082 - RNA, 23 nt, Human
uuuaagugauucucaugccucag

SEQ ID NO: 815083 - RNA, 21 nt, Human
uuucaccauguuggccagccu

SEQ ID NO: 815084 - RNA, 22 nt, Human
uuucaccauguuggccagccug

SEQ ID NO: 815085 - RNA, 21 nt, Human
uuucaccauguuggccaggcu

SEQ ID NO: 815086 - RNA, 22 nt, Human
uuucuuuuuauuuugagacgga

SEQ ID NO: 815087 - RNA, 19 nt, Human
uuugcucuggaggguccgc

SEQ ID NO: 815088 - RNA, 24 nt, Human
uuugcucuuguugcccaggcugga

SEQ ID NO: 815089 - RNA, 24 nt, Human
uuuugcucuuguugcccaggcugg

SEQ ID NO: 815090 - RNA, 20 nt, Human
uuuuguauuuuuaguagaga

SEQ ID NO: 815091 - RNA, 24 nt, Human
uuuuuaguagagaugagguuucac

SEQ ID NO: 815092 - RNA, 24 nt, Human
uuuuuaguagagaugggguuucac

SEQ ID NO: 815093 - RNA, 22 nt, Human
uuuuuauuagagacgggguuuc

SEQ ID NO: 815094 - RNA, 23 nt, Human
uuuuuauuagagacgggguuucg

SEQ ID NO: 815095 - RNA, 20 nt, Human
uuuuuguauuuuuaguagag

SEQ ID NO: 815096 - RNA, 20 nt, Human
uuuuuguauuuuuaguagag

SEQ ID NO: 815097 - RNA, 20 nt, Human
uuuuuguauuuuuauuagag

SEQ ID NO: 815098 - RNA, 23 nt, Human
uuuuuguauuuuuauuagagacg

SEQ ID NO: 815099 - RNA, 24 nt, Human
aaaaaaaaaaaaaaaagaaaagaa

SEQ ID NO: 815100 - RNA, 25 nt, Human
aaaaaaaaaaaagaaaagaaaagaa

SEQ ID NO: 815101 - RNA, 24 nt, Human
aaaacagacaauacaauagaacau

SEQ ID NO: 815102 - RNA, 18 nt, Human
aaaagaauucccaaagcu

SEQ ID NO: 815103 - RNA, 20 nt, Human
aaauuuccuuuguacucuuc

SEQ ID NO: 815104 - RNA, 21 nt, Human
aacaacaacaacaacaacaac

SEQ ID NO: 815105 - RNA, 21 nt, Human
aacaacaacaacaacaacaac

SEQ ID NO: 815106 - RNA, 21 nt, Human
aacaacaacaacaacaacaac

SEQ ID NO: 815107 - RNA, 27 nt, Human
aacaacaacaacaacaacaacaacaac

SEQ ID NO: 815108 - RNA, 27 nt, Human
aacaacaacaacaacaacaacaacaac

SEQ ID NO: 815109 - RNA, 27 nt, Human
aacaacaacaacaacaacaacaacaac

SEQ ID NO: 815110 - RNA, 27 nt, Human
aacaacaacaacaacaacaacaacaac

SEQ ID NO: 815111 - RNA, 27 nt, Human
aacaacaacaacaacaacaacaacaac

SEQ ID NO: 815112 - RNA, 27 nt, Human
aacaacaacaacaacaacaacaacaac

SEQ ID NO: 815113 - RNA, 27 nt, Human
aacaacaacaacaacaacaacaacaac

SEQ ID NO: 815114 - RNA, 19 nt, Human
aacacggugaaacccuguc

SEQ ID NO: 815115 - RNA, 20 nt, Human
aacacggugaaacccugucu

SEQ ID NO: 815116 - RNA, 21 nt, Human
aacacggugaaacccugucuc

SEQ ID NO: 815117 - RNA, 18 nt, Human
aaccucaaugaaacugaa

SEQ ID NO: 815118 - RNA, 22 nt, Human
aagaaaacuuuuccacuaaacu

SEQ ID NO: 815119 - RNA, 19 nt, Human
aagaaaccaauccugaaac

SEQ ID NO: 815120 - RNA, 26 nt, Human
aagaaaccuguauaauaaagacaggc

SEQ ID NO: 815121 - RNA, 24 nt, Human
aagaagacuauuuuccauagaacc

SEQ ID NO: 815122 - RNA, 18 nt, Human
aagacaaguugaaacuca

SEQ ID NO: 815123 - RNA, 25 nt, Human
aaucacauacuggcacucaucuaag

SEQ ID NO: 815124 - RNA, 18 nt, Human
acaaaaccaaaauagaaa

SEQ ID NO: 815125 - RNA, 19 nt, Human
acaaaacucucaaaauggg

SEQ ID NO: 815126 - RNA, 19 nt, Human
acaacaacaacaacaacaa

SEQ ID NO: 815127 - RNA, 19 nt, Human
acaacaacaacaacaacaa

SEQ ID NO: 815128 - RNA, 19 nt, Human
acaacaacaacaacaacaa

SEQ ID NO: 815129 - RNA, 19 nt, Human
acaacaacaacaacaacaa

SEQ ID NO: 815130 - RNA, 19 nt, Human
acaacaacaacaacaacaa

SEQ ID NO: 815131 - RNA, 19 nt, Human
acaacaacaacaacaacaa

SEQ ID NO: 815132 - RNA, 19 nt, Human
acaacaacaacaacaacaa

SEQ ID NO: 815133 - RNA, 19 nt, Human
acaacaacaacaacaacaa

SEQ ID NO: 815134 - RNA, 19 nt, Human
acaacaacaacaacaacaa

SEQ ID NO: 815135 - RNA, 19 nt, Human
acaacaacaacaacaacaa

SEQ ID NO: 815136 - RNA, 19 nt, Human
acaacaacaacaacaacaa

SEQ ID NO: 815137 - RNA, 19 nt, Human
acaacaacaacaacaacaa

SEQ ID NO: 815138 - RNA, 19 nt, Human
acaacaacaacaacaacaa

SEQ ID NO: 815139 - RNA, 19 nt, Human
acaacaacaacaacaacaa

SEQ ID NO: 815140 - RNA, 22 nt, Human
acaacaacaacaacaacaacaa

SEQ ID NO: 815141 - RNA, 22 nt, Human
acaacaacaacaacaacaacaa

SEQ ID NO: 815142 - RNA, 22 nt, Human
acaacaacaacaacaacaacaa

SEQ ID NO: 815143 - RNA, 22 nt, Human
acaacaacaacaacaacaacaa

SEQ ID NO: 815144 - RNA, 24 nt, Human
acaacaacaacaacaacaggugaa

SEQ ID NO: 815145 - RNA, 20 nt, Human
acaaggcagaaaagccagaa

SEQ ID NO: 815146 - RNA, 24 nt, Human
acagagcgagagacugucucaaaa

SEQ ID NO: 815147 - RNA, 21 nt, Human
accaaaaccugucauugaaac

SEQ ID NO: 815148 - RNA, 20 nt, Human
accaagaucgcaccacugca

SEQ ID NO: 815149 - RNA, 19 nt, Human
accacagccaccucaccca

SEQ ID NO: 815150 - RNA, 23 nt, Human
accacagccaccucacccacauu

SEQ ID NO: 815151 - RNA, 24 nt, Human
accacugcacucuagccugggcga

SEQ ID NO: 815152 - RNA, 24 nt, Human
acccugucucuacuaaaaauacaa

SEQ ID NO: 815153 - RNA, 20 nt, Human
acucauggcagaagaauaag

SEQ ID NO: 815154 - RNA, 24 nt, Human
acugcacucuagccugggcgacag

SEQ ID NO: 815155 - RNA, 26 nt, Human
acugcacucuagccugggcgacagag

SEQ ID NO: 815156 - RNA, 20 nt, Human
agaaaagccagaaccgggga

SEQ ID NO: 815157 - RNA, 20 nt, Human
agaaucaaaacagacaauac

SEQ ID NO: 815158 - RNA, 23 nt, Human
agacagaaccugggagaaauuca

SEQ ID NO: 815159 - RNA, 18 nt, Human
agagaccaagaggaccag

SEQ ID NO: 815160 - RNA, 24 nt, Human
agagaggauggaggauuuuggaag

SEQ ID NO: 815161 - RNA, 23 nt, Human
agauauguauauacacaauuaua

SEQ ID NO: 815162 - RNA, 18 nt, Human
agaucugcaggugaggag

SEQ ID NO: 815163 - RNA, 21 nt, Human
agcaagaagacuauuuuccau

SEQ ID NO: 815164 - RNA, 22 nt, Human
agccagaaccggggagugucca

SEQ ID NO: 815165 - RNA, 22 nt, Human
agccauucuugcucaagaaagu

SEQ ID NO: 815166 - RNA, 23 nt, Human
agcugggcgugguggcgggugcc

SEQ ID NO: 815167 - RNA, 22 nt, Human
aggaagauuuagugaagauuca

SEQ ID NO: 815168 - RNA, 22 nt, Human
aggauuuagucaaugucuggca

SEQ ID NO: 815169 - RNA, 22 nt, Human
aggcagaucacaaggucaggag

SEQ ID NO: 815170 - RNA, 18 nt, Human
aggcaggagaauggugug

SEQ ID NO: 815171 - RNA, 24 nt, Human
aggcaggcagaucacaaggucagg

SEQ ID NO: 815172 - RNA, 26 nt, Human
aggcaggcagaucacaaggucaggag

SEQ ID NO: 815173 - RNA, 19 nt, Human
aggcugaggcaggagaaug

SEQ ID NO: 815174 - RNA, 19 nt, Human
agugaaaaaaggaauccuu

SEQ ID NO: 815175 - RNA, 22 nt, Human
auaauaaagacaggcgugcauc

SEQ ID NO: 815176 - RNA, 23 nt, Human
auauaacuauaucuacauguaca

SEQ ID NO: 815177 - RNA, 18 nt, Human
aucagcuucccuucauaa

SEQ ID NO: 815178 - RNA, 21 nt, Human
aucccacuuaaagcacccaaa

SEQ ID NO: 815179 - RNA, 24 nt, Human
aucgcaccacugcacucuagccug

SEQ ID NO: 815180 - RNA, 24 nt, Human
caaaagaauucccaaagcuguuaa

SEQ ID NO: 815181 - RNA, 18 nt, Human
caacaacaacaacaacaa

SEQ ID NO: 815182 - RNA, 18 nt, Human
caacaacaacaacaacaa

SEQ ID NO: 815183 - RNA, 18 nt, Human
caacaacaacaacaacaa

SEQ ID NO: 815184 - RNA, 23 nt, Human
caacaacaacaacaacaacaaca

SEQ ID NO: 815185 - RNA, 23 nt, Human
caacaacaacaacaacaacaaca

SEQ ID NO: 815186 - RNA, 23 nt, Human
caacaacaacaacaacaacaaca

SEQ ID NO: 815187 - RNA, 23 nt, Human
caacaacaacaacaacaacaaca

SEQ ID NO: 815188 - RNA, 29 nt, Human
caacaacaacaacaacaacaacaggugaa

SEQ ID NO: 815189 - RNA, 25 nt, Human
caacaacaacaacaacaacagguga

SEQ ID NO: 815190 - RNA, 21 nt, Human
caaggcagaaaagccagaacc

SEQ ID NO: 815191 - RNA, 20 nt, Human
caaguaaauccacuugcaaa

SEQ ID NO: 815192 - RNA, 22 nt, Human
caaguuugaacagaaacauauu

SEQ ID NO: 815193 - RNA, 19 nt, Human
caccacagccaccucaccc

SEQ ID NO: 815194 - RNA, 24 nt, Human
cacgccuauaaucccaucacuuug

SEQ ID NO: 815195 - RNA, 24 nt, Human
cacucuagccugggcgacagagcg

SEQ ID NO: 815196 - RNA, 19 nt, Human
cacugcacucuagccuggg

SEQ ID NO: 815197 - RNA, 20 nt, Human
cacugcacucuagccugggc

SEQ ID NO: 815198 - RNA, 20 nt, Human
cacugcacucuagccugggc

SEQ ID NO: 815199 - RNA, 22 nt, Human
cacugcacucuagccugggcga

SEQ ID NO: 815200 - RNA, 24 nt, Human
cacugcacucuagccugggcgaca

SEQ ID NO: 815201 - RNA, 22 nt, Human
cacuguggaguucccacuggcu

SEQ ID NO: 815202 - RNA, 21 nt, Human
cagaaucaaaacagacaauac

SEQ ID NO: 815203 - RNA, 22 nt, Human
cagccaccucacccacauucca

SEQ ID NO: 815204 - RNA, 23 nt, Human
cagcuaagcuucccuucaaaguu

SEQ ID NO: 815205 - RNA, 24 nt, Human
cagcuacucaggaggcugaggcag

SEQ ID NO: 815206 - RNA, 25 nt, Human
caguaguaccuuauugcacauugau

SEQ ID NO: 815207 - RNA, 25 nt, Human
cauagaaccaguaaauguuucuucu

SEQ ID NO: 815208 - RNA, 24 nt, Human
caucacuuugggaggccgaggcag

SEQ ID NO: 815209 - RNA, 25 nt, Human
caucacuuugggaggccgaggcagg

SEQ ID NO: 815210 - RNA, 24 nt, Human
cauguguguagauauguauauaca

SEQ ID NO: 815211 - RNA, 25 nt, Human
ccaacauuuucuuagaagccaaaga

SEQ ID NO: 815212 - RNA, 19 nt, Human
ccaagcaauuaauuuccag

SEQ ID NO: 815213 - RNA, 20 nt, Human
ccacugcacucuagccuggg

SEQ ID NO: 815214 - RNA, 21 nt, Human
ccacugcacucuagccugggc

SEQ ID NO: 815215 - RNA, 21 nt, Human
ccacugcacucuagccugggc

SEQ ID NO: 815216 - RNA, 24 nt, Human
ccacugcacucuagccugggcgac

SEQ ID NO: 815217 - RNA, 18 nt, Human
ccccagcacagcugugcc

SEQ ID NO: 815218 - RNA, 19 nt, Human
ccuggaaaacuucaagcuu

SEQ ID NO: 815219 - RNA, 22 nt, Human
ccuggcuaacacggugaaaccc

SEQ ID NO: 815220 - RNA, 24 nt, Human
ccuggcuaacacggugaaacccug

SEQ ID NO: 815221 - RNA, 19 nt, Human
ccuguaguccccagcuacu

SEQ ID NO: 815222 - RNA, 24 nt, Human
cgagaccacccuggcuaacacggu

SEQ ID NO: 815223 - RNA, 23 nt, Human
cgccuauaaucccaucacuuugg

SEQ ID NO: 815224 - RNA, 24 nt, Human
cgccuauaaucccaucacuuuggg

SEQ ID NO: 815225 - RNA, 18 nt, Human
cuaaccaaacagaagccu

SEQ ID NO: 815226 - RNA, 20 nt, Human
cuacauguacacuuuucaua

SEQ ID NO: 815227 - RNA, 18 nt, Human
cuauauggaauuuggcuu

SEQ ID NO: 815228 - RNA, 22 nt, Human
cucacgccuauaaucccaucac

SEQ ID NO: 815229 - RNA, 24 nt, Human
cucacgccuauaaucccaucacuu

SEQ ID NO: 815230 - RNA, 24 nt, Human
cuggcuaacacggugaaacccugu

SEQ ID NO: 815231 - RNA, 18 nt, Human
cuguaaaugaugucccuc

SEQ ID NO: 815232 - RNA, 22 nt, Human
cugucucaaaaaaaaaaaaaaa

SEQ ID NO: 815233 - RNA, 22 nt, Human
cuugaucagucauguaaccacu

SEQ ID NO: 815234 - RNA, 21 nt, Human
gacuacuggagaguccaggau

SEQ ID NO: 815235 - RNA, 22 nt, Human
gagaggauggaggauuuuggaa

SEQ ID NO: 815236 - RNA, 20 nt, Human
gagauuaaagaaaaaaucaa

SEQ ID NO: 815237 - RNA, 25 nt, Human
gagcuacagcuaagcuucccuucaa

SEQ ID NO: 815238 - RNA, 21 nt, Human
gcacaguacccgccuggcacc

SEQ ID NO: 815239 - RNA, 24 nt, Human
gcacucuagccugggcgacagagc

SEQ ID NO: 815240 - RNA, 20 nt, Human
gcgcacaggcugugggcggc

SEQ ID NO: 815241 - RNA, 24 nt, Human
gcuaacacggugaaacccugucuc

SEQ ID NO: 815242 - RNA, 18 nt, Human
ggaaugaccgggcgcggu

SEQ ID NO: 815243 - RNA, 20 nt, Human
ggaggauuuuggaagagaca

SEQ ID NO: 815244 - RNA, 19 nt, Human
ggagguaucauacccaugg

SEQ ID NO: 815245 - RNA, 22 nt, Human
ggaguguccaggggcaccugca

SEQ ID NO: 815246 - RNA, 22 nt, Human
ggcacucgggucccgggcggcg

SEQ ID NO: 815247 - RNA, 18 nt, Human
ggcuuagaaagagaagga

SEQ ID NO: 815248 - RNA, 22 nt, Human
ggggaguguccaggggcaccug

SEQ ID NO: 815249 - RNA, 24 nt, Human
ggggaguguccaggggcaccugca

SEQ ID NO: 815250 - RNA, 19 nt, Human
gguggcucacgccuauaau

SEQ ID NO: 815251 - RNA, 23 nt, Human
gguggcucacgccuauaauccca

SEQ ID NO: 815252 - RNA, 18 nt, Human
gugaaaaaaggaauccuu

SEQ ID NO: 815253 - RNA, 21 nt, Human
gugaaacccugucucuacuaa

SEQ ID NO: 815254 - RNA, 22 nt, Human
uaaaaccaaccauguguguaga

SEQ ID NO: 815255 - RNA, 18 nt, Human
uaaaaggagcuucagggg

SEQ ID NO: 815256 - RNA, 23 nt, Human
uaacaacaacaacaacaacaaca

SEQ ID NO: 815257 - RNA, 25 nt, Human
uaacaacaacaacaacaacaacaac

SEQ ID NO: 815258 - RNA, 22 nt, Human
uaacacggugaaacccugucuc

SEQ ID NO: 815259 - RNA, 24 nt, Human
uaacacggugaaacccugucucua

SEQ ID NO: 815260 - RNA, 21 nt, Human
uaaccaaacagaagccuucag

SEQ ID NO: 815261 - RNA, 22 nt, Human
uaaccaaguucucaugucagcc

SEQ ID NO: 815262 - RNA, 24 nt, Human
uaaccucaaugaaacugaaaguac

SEQ ID NO: 815263 - RNA, 19 nt, Human
uaacuguaacugcccaaca

SEQ ID NO: 815264 - RNA, 21 nt, Human
uaacuguaacugcccaacauu

SEQ ID NO: 815265 - RNA, 18 nt, Human
uaagaaaaacuggagaga

SEQ ID NO: 815266 - RNA, 24 nt, Human
uaagacugaucccacuuaaagcac

SEQ ID NO: 815267 - RNA, 22 nt, Human
uaauuaauucaggagauguguu

SEQ ID NO: 815268 - RNA, 22 nt, Human
uacaaaagaauucccaaagcug

SEQ ID NO: 815269 - RNA, 22 nt, Human
uaccauggagauauguuuuggu

SEQ ID NO: 815270 - RNA, 21 nt, Human
uacucauggcagaagaauaag

SEQ ID NO: 815271 - RNA, 21 nt, Human
uacucauggcagaagaauaag

SEQ ID NO: 815272 - RNA, 21 nt, Human
uagaaagagaaggauuaucau

SEQ ID NO: 815273 - RNA, 22 nt, Human
uagaaccaguaaauguuucuuc

SEQ ID NO: 815274 - RNA, 23 nt, Human
uagauaugguugaauugucauug

SEQ ID NO: 815275 - RNA, 18 nt, Human
uagauauguauauacaca

SEQ ID NO: 815276 - RNA, 22 nt, Human
uagcaagcuauaggagaugucu

SEQ ID NO: 815277 - RNA, 21 nt, Human
uaggauauuuaaugaugaaug

SEQ ID NO: 815278 - RNA, 28 nt, Human
uauguucaaagcaguaauacauacucaa

SEQ ID NO: 815279 - RNA, 23 nt, Human
uauucauccaccacagccaccuc

SEQ ID NO: 815280 - RNA, 24 nt, Human
ucaacccugaauauagcuaacaua

SEQ ID NO: 815281 - RNA, 18 nt, Human
ucacaaggucaggagauc

SEQ ID NO: 815282 - RNA, 24 nt, Human
ucacaaggucaggagaucgagacc

SEQ ID NO: 815283 - RNA, 23 nt, Human
ucagucuuucuuguaaccucaau

SEQ ID NO: 815284 - RNA, 25 nt, Human
uccaagccugaugcuuacaugcaac

SEQ ID NO: 815285 - RNA, 22 nt, Human
ucuaccuagcaagaagacuauu

SEQ ID NO: 815286 - RNA, 23 nt, Human
ucuagccugggcgacagagcgag

SEQ ID NO: 815287 - RNA, 24 nt, Human
ucuagccugggcgacagagcgaga

SEQ ID NO: 815288 - RNA, 24 nt, Human
ucucuacuaaaaauacaaaaaauu

SEQ ID NO: 815289 - RNA, 26 nt, Human
ucucugcggucagcaccuugugucuu

SEQ ID NO: 815290 - RNA, 23 nt, Human
ucuggagguaucauacccauggu

SEQ ID NO: 815291 - RNA, 19 nt, Human
ucuucuaaucuuugaaagc

SEQ ID NO: 815292 - RNA, 23 nt, Human
ugaaaaagcaauauaaaaccaac

SEQ ID NO: 815293 - RNA, 21 nt, Human
ugaaaaagcaauauaaaaccc

SEQ ID NO: 815294 - RNA, 19 nt, Human
ugaaagccaugagcuacag

SEQ ID NO: 815295 - RNA, 21 nt, Human
ugaauagacuaaccaaacaga

SEQ ID NO: 815296 - RNA, 24 nt, Human
ugaccccaauaaauucuccucuaa

SEQ ID NO: 815297 - RNA, 22 nt, Human
ugacuuaauaacaaaacucuca

SEQ ID NO: 815298 - RNA, 22 nt, Human
ugacuuugaguacaacaguagu

SEQ ID NO: 815299 - RNA, 25 nt, Human
ugagaacaccaggucuguuaaaggu

SEQ ID NO: 815300 - RNA, 24 nt, Human
ugagauuaaagaaaaaaucaaccc

SEQ ID NO: 815301 - RNA, 25 nt, Human
ugagcacaaaguucucuguaagagc

SEQ ID NO: 815302 - RNA, 23 nt, Human
ugaggcaggagaauggugugaac

SEQ ID NO: 815303 - RNA, 19 nt, Human
ugaggcuuuugaacuugaa

SEQ ID NO: 815304 - RNA, 22 nt, Human
ugaguacaacaguaguaccuua

SEQ ID NO: 815305 - RNA, 23 nt, Human
ugaugugccuccugguggauguc

SEQ ID NO: 815306 - RNA, 22 nt, Human
ugcaacaagucuuaacuguacc

SEQ ID NO: 815307 - RNA, 19 nt, Human
ugcccaugugacagaaaca

SEQ ID NO: 815308 - RNA, 25 nt, Human
ugccuguaguccccagcuacucagg

SEQ ID NO: 815309 - RNA, 21 nt, Human
ugcugaaauuauuacacacau

SEQ ID NO: 815310 - RNA, 21 nt, Human
uggagagagaacuugaaucau

SEQ ID NO: 815311 - RNA, 22 nt, Human
uggcaccgcgccuggacaccuc

SEQ ID NO: 815312 - RNA, 21 nt, Human
uggcucacgccuauaauccca

SEQ ID NO: 815313 - RNA, 18 nt, Human
ugggaggcagagaugaag

SEQ ID NO: 815314 - RNA, 19 nt, Human
ugggaggcagagaugaaga

SEQ ID NO: 815315 - RNA, 21 nt, Human
ugggaggcagagcuggcagug

SEQ ID NO: 815316 - RNA, 20 nt, Human
ugggaggccgaggcaggcag

SEQ ID NO: 815317 - RNA, 24 nt, Human
ugggaggccgaggcaggcagauca

SEQ ID NO: 815318 - RNA, 20 nt, Human
ugggcaaugggaggcagaga

SEQ ID NO: 815319 - RNA, 18 nt, Human
uggguucugaggcuuuug

SEQ ID NO: 815320 - RNA, 18 nt, Human
uggucaggaacaucacca

SEQ ID NO: 815321 - RNA, 21 nt, Human
ugguggaugugauacuaaugu

SEQ ID NO: 815322 - RNA, 24 nt, Human
ugguggcucacgccuauaauccca

SEQ ID NO: 815323 - RNA, 20 nt, Human
uggugugaacgugggaggca

SEQ ID NO: 815324 - RNA, 23 nt, Human
uguauaaaagcccucccuugccc

SEQ ID NO: 815325 - RNA, 24 nt, Human
ugucuaaaaucuaucuucaaguau

SEQ ID NO: 815326 - RNA, 18 nt, Human
uguguagauauguauaua

SEQ ID NO: 815327 - RNA, 18 nt, Human
ugugugggaagcgguugg

SEQ ID NO: 815328 - RNA, 21 nt, Human
uguuaaagguuacccgucugc

SEQ ID NO: 815329 - RNA, 23 nt, Human
uguugaacagagccugauuccca

SEQ ID NO: 815330 - RNA, 24 nt, Human
uuacagaauguuucuguuucacua

SEQ ID NO: 815331 - RNA, 24 nt, Human
uuagcugggcgugguggcgggugc

SEQ ID NO: 815332 - RNA, 21 nt, Human
uucaaagauguauaaaagccc

SEQ ID NO: 815333 - RNA, 25 nt, Human
uucaagaaauuagaaaggaaugacc

SEQ ID NO: 815334 - RNA, 24 nt, Human
uucacauaaauuauuuaauuauau

SEQ ID NO: 815335 - RNA, 18 nt, Human
uucauauggucaggaaca

SEQ ID NO: 815336 - RNA, 19 nt, Human
uucauccaccacagccacc

SEQ ID NO: 815337 - RNA, 21 nt, Human
uucauccaccacagccaccuc

SEQ ID NO: 815338 - RNA, 20 nt, Human
uuccccagcacagcugugcc

SEQ ID NO: 815339 - RNA, 23 nt, Human
uucuuuugugacuuugaguacaa

SEQ ID NO: 815340 - RNA, 19 nt, Human
uuggaauucaguaaaugug

SEQ ID NO: 815341 - RNA, 25 nt, Human
uugggaggccgaggcaggcagauca

SEQ ID NO: 815342 - RNA, 21 nt, Human
uuuacacugaccccaauaaau

SEQ ID NO: 815343 - RNA, 24 nt, Human
uuuaucagcuucccuucauaagag

SEQ ID NO: 815344 - RNA, 20 nt, Human
uuucugguuuuagaacucug

SEQ ID NO: 815345 - RNA, 20 nt, Human
uuuuccacuaaacucuccug

SEQ ID NO: 815346 - RNA, 22 nt, Human
aaaaagacaugcuacagguccu

SEQ ID NO: 815347 - RNA, 27 nt, Human
aaaacaccuaaccuucuucaccagccc

SEQ ID NO: 815348 - RNA, 20 nt, Human
aaaccagcagcauuggacag

SEQ ID NO: 815349 - RNA, 28 nt, Human
aaagaagccaaaccaaagagcuccugga

SEQ ID NO: 815350 - RNA, 24 nt, Human
aacaacucccugacuaauuccuac

SEQ ID NO: 815351 - RNA, 24 nt, Human
aacuuucuuccucagacaucucca

SEQ ID NO: 815352 - RNA, 24 nt, Human
aagaccacuuaacagacacaacuc

SEQ ID NO: 815353 - RNA, 20 nt, Human
aagguggcacuugccacccu

SEQ ID NO: 815354 - RNA, 21 nt, Human
aaucuugagagacugaacaua

SEQ ID NO: 815355 - RNA, 20 nt, Human
acagacauucucccugaccu

SEQ ID NO: 815356 - RNA, 22 nt, Human
acagaccacaagcacgucacaa

SEQ ID NO: 815357 - RNA, 22 nt, Human
acaggacagauugcugagggaa

SEQ ID NO: 815358 - RNA, 19 nt, Human
acaggguuuucucaguggg

SEQ ID NO: 815359 - RNA, 18 nt, Human
accccacagacacuucca

SEQ ID NO: 815360 - RNA, 21 nt, Human
acccugagauagaaaggaagg

SEQ ID NO: 815361 - RNA, 24 nt, Human
accggucgcucugcgaaaccagca

SEQ ID NO: 815362 - RNA, 20 nt, Human
acuuggucauagggaucaag

SEQ ID NO: 815363 - RNA, 20 nt, Human
agaccagagcgguucaggaa

SEQ ID NO: 815364 - RNA, 22 nt, Human
agaccagagcgguucaggaagg

SEQ ID NO: 815365 - RNA, 19 nt, Human
agaccccacagacacuucc

SEQ ID NO: 815366 - RNA, 25 nt, Human
agagaggcaaagaaagcuaugugga

SEQ ID NO: 815367 - RNA, 21 nt, Human
agcaagcacagaccacaagca

SEQ ID NO: 815368 - RNA, 24 nt, Human
agcaggaaugaaauagcaccaaga

SEQ ID NO: 815369 - RNA, 20 nt, Human
agccaaugcgcagcucuugg

SEQ ID NO: 815370 - RNA, 22 nt, Human
agccagcggcaacgcuuccugg

SEQ ID NO: 815371 - RNA, 21 nt, Human
aggcagggaaacagcgggaaa

SEQ ID NO: 815372 - RNA, 19 nt, Human
agguugaaaaagacaugcu

SEQ ID NO: 815373 - RNA, 19 nt, Human
agucaaauuccaaacacaa

SEQ ID NO: 815374 - RNA, 19 nt, Human
auacuucuccuuccucaca

SEQ ID NO: 815375 - RNA, 24 nt, Human
augaaaagaccacuuaacagacac

SEQ ID NO: 815376 - RNA, 24 nt, Human
caaacacacuaucccuacaccuug

SEQ ID NO: 815377 - RNA, 22 nt, Human
caaaccaaagagcuccuggaac

SEQ ID NO: 815378 - RNA, 18 nt, Human
caaagagcuccuggaaca

SEQ ID NO: 815379 - RNA, 22 nt, Human
caagcacugggguuuuuuuuuu

SEQ ID NO: 815380 - RNA, 18 nt, Human
caauugcugaagcccagg

SEQ ID NO: 815381 - RNA, 20 nt, Human
cacaacaacucccugacuaa

SEQ ID NO: 815382 - RNA, 24 nt, Human
cacccaaacacugcuuguggaacc

SEQ ID NO: 815383 - RNA, 24 nt, Human
caccuucaggaaggcaacacccaa

SEQ ID NO: 815384 - RNA, 25 nt, Human
cacucagccccaaggugacaaccaa

SEQ ID NO: 815385 - RNA, 18 nt, Human
cacucaggaccaaggcag

SEQ ID NO: 815386 - RNA, 22 nt, Human
cacugggguuuuuuuuuucaca

SEQ ID NO: 815387 - RNA, 18 nt, Human
cagacaggacagauugcu

SEQ ID NO: 815388 - RNA, 23 nt, Human
cagagugccaggggagggcacag

SEQ ID NO: 815389 - RNA, 21 nt, Human
cagauugcugagggaagccaa

SEQ ID NO: 815390 - RNA, 21 nt, Human
cagcagcauuggacagguggu

SEQ ID NO: 815391 - RNA, 21 nt, Human
cagccagcggcaacgcuuccu

SEQ ID NO: 815392 - RNA, 22 nt, Human
cagcgaagguggcacuugccac

SEQ ID NO: 815393 - RNA, 21 nt, Human
cagcgggaaagcuucaguccc

SEQ ID NO: 815394 - RNA, 19 nt, Human
cagcucccucgccagggaa

SEQ ID NO: 815395 - RNA, 23 nt, Human
caggaccaaggcagaugagaagc

SEQ ID NO: 815396 - RNA, 28 nt, Human
caggggcugcccucaggaggaggccugc

SEQ ID NO: 815397 - RNA, 19 nt, Human
cagguggucggccgaggag

SEQ ID NO: 815398 - RNA, 21 nt, Human
cagguugaaaaagacaugcua

SEQ ID NO: 815399 - RNA, 19 nt, Human
caucaaaagaagccaaacc

SEQ ID NO: 815400 - RNA, 24 nt, Human
ccaaaucuugagagacugaacaua

SEQ ID NO: 815401 - RNA, 23 nt, Human
ccacugauaggaagcuaaacaca

SEQ ID NO: 815402 - RNA, 21 nt, Human
ccagcggcaacgcuuccuggu

SEQ ID NO: 815403 - RNA, 22 nt, Human
ccaucaaaagaagccaaaccaa

SEQ ID NO: 815404 - RNA, 27 nt, Human
cccacagacacuuccaagcacugccgg

SEQ ID NO: 815405 - RNA, 19 nt, Human
cccaccagcauuuucuacc

SEQ ID NO: 815406 - RNA, 19 nt, Human
ccccacagacacuuccaag

SEQ ID NO: 815407 - RNA, 23 nt, Human
ccuacaacacaacucuagcacag

SEQ ID NO: 815408 - RNA, 21 nt, Human
ccucacucuucaccccuuuca

SEQ ID NO: 815409 - RNA, 19 nt, Human
ccucucagaccugccugcc

SEQ ID NO: 815410 - RNA, 24 nt, Human
ccuggugcuccaggggcugcccuc

SEQ ID NO: 815411 - RNA, 22 nt, Human
ccuugggucucagaaauggaaa

SEQ ID NO: 815412 - RNA, 24 nt, Human
ccuugggucucagaaauggaaagu

SEQ ID NO: 815413 - RNA, 21 nt, Human
ccuugggugaggguaggaagu

SEQ ID NO: 815414 - RNA, 25 nt, Human
cguaauuagacacuuccugucugcc

SEQ ID NO: 815415 - RNA, 21 nt, Human
cguaucuaugacucgguauac

SEQ ID NO: 815416 - RNA, 19 nt, Human
cucacucuucaccccuuuc

SEQ ID NO: 815417 - RNA, 22 nt, Human
cucagaaauggaaagucaaauu

SEQ ID NO: 815418 - RNA, 24 nt, Human
cucagccccaaggugacaaccaaa

SEQ ID NO: 815419 - RNA, 21 nt, Human
cucauaaacacggagacccac

SEQ ID NO: 815420 - RNA, 21 nt, Human
cuccaaaccagaaggaccuaa

SEQ ID NO: 815421 - RNA, 19 nt, Human
cuccacuuccuccaaacca

SEQ ID NO: 815422 - RNA, 19 nt, Human
cuccuggaacacucaggac

SEQ ID NO: 815423 - RNA, 18 nt, Human
cugaauuuuugaaaagaa

SEQ ID NO: 815424 - RNA, 19 nt, Human
cugcagcuaagucacagac

SEQ ID NO: 815425 - RNA, 22 nt, Human
cugcuuuugcaggcagggaaac

SEQ ID NO: 815426 - RNA, 22 nt, Human
cuuggucauagggaucaaguca

SEQ ID NO: 815427 - RNA, 22 nt, Human
gaaaagaccacuuaacagacac

SEQ ID NO: 815428 - RNA, 19 nt, Human
gaaggggauacugacaggu

SEQ ID NO: 815429 - RNA, 21 nt, Human
gacacuuccugucugccucag

SEQ ID NO: 815430 - RNA, 24 nt, Human
gaccgaaugggagcacagacagga

SEQ ID NO: 815431 - RNA, 21 nt, Human
gacuuggucauagggaucaag

SEQ ID NO: 815432 - RNA, 18 nt, Human
gagagagagagaagagua

SEQ ID NO: 815433 - RNA, 20 nt, Human
gagggagagagagagaagag

SEQ ID NO: 815434 - RNA, 19 nt, Human
gcagcccagugugucagaa

SEQ ID NO: 815435 - RNA, 25 nt, Human
gcgggggguggggaagccuguggga

SEQ ID NO: 815436 - RNA, 19 nt, Human
gcuccaggggcugcccuca

SEQ ID NO: 815437 - RNA, 23 nt, Human
gcugcuuuugcaggcagggaaac

SEQ ID NO: 815438 - RNA, 18 nt, Human
ggaaaacagccuccucau

SEQ ID NO: 815439 - RNA, 23 nt, Human
ggaaaacagccuccucauuucug

SEQ ID NO: 815440 - RNA, 18 nt, Human
ggaccaaggcagaugaga

SEQ ID NO: 815441 - RNA, 23 nt, Human
ggcagugagugggggcggggggu

SEQ ID NO: 815442 - RNA, 20 nt, Human
gggcagugagugggggcggg

SEQ ID NO: 815443 - RNA, 18 nt, Human
gggcgggggguggggaag

SEQ ID NO: 815444 - RNA, 28 nt, Human
ggggcgggggguggggaagccuguggga

SEQ ID NO: 815445 - RNA, 18 nt, Human
ggggggagggagagagag

SEQ ID NO: 815446 - RNA, 23 nt, Human
ggguaggaaguuggucccugggg

SEQ ID NO: 815447 - RNA, 24 nt, Human
guaauuagacacuuccugucugcc

SEQ ID NO: 815448 - RNA, 20 nt, Human
gucaaagugaacuacaaaca

SEQ ID NO: 815449 - RNA, 26 nt, Human
guggaaccaaaaucaguuucauucag

SEQ ID NO: 815450 - RNA, 18 nt, Human
uaaacccugagauagaaa

SEQ ID NO: 815451 - RNA, 23 nt, Human
uaaacccugagauagaaaggaag

SEQ ID NO: 815452 - RNA, 21 nt, Human
uaagucacagacauucucccu

SEQ ID NO: 815453 - RNA, 22 nt, Human
uacaaaagacuucucacucagc

SEQ ID NO: 815454 - RNA, 20 nt, Human
uaggaagcuaaacacaggca

SEQ ID NO: 815455 - RNA, 20 nt, Human
uaggaaguuggucccugggg

SEQ ID NO: 815456 - RNA, 19 nt, Human
uauacaauuuaaagcccac

SEQ ID NO: 815457 - RNA, 18 nt, Human
uauagaaugagacuggcu

SEQ ID NO: 815458 - RNA, 24 nt, Human
uaugaaaagaccacuuaacagaca

SEQ ID NO: 815459 - RNA, 18 nt, Human
ucaacaugucugacuaau

SEQ ID NO: 815460 - RNA, 27 nt, Human
ucaccccuuucauuguaaaagaagagc

SEQ ID NO: 815461 - RNA, 24 nt, Human
ucagaggaaaacagccuccucauu

SEQ ID NO: 815462 - RNA, 23 nt, Human
ucagccccaaggugacaaccaaa

SEQ ID NO: 815463 - RNA, 24 nt, Human
ucagccccaaggugacaaccaaaa

SEQ ID NO: 815464 - RNA, 18 nt, Human
ucagugccaggauccacu

SEQ ID NO: 815465 - RNA, 26 nt, Human
ucccuggggcagugagugggggcggg

SEQ ID NO: 815466 - RNA, 22 nt, Human
ucuaaagcaagucucuauaauc

SEQ ID NO: 815467 - RNA, 28 nt, Human
ucuccuagucugcagcuaagucacagac

SEQ ID NO: 815468 - RNA, 28 nt, Human
ucugcagcuaagucacagaccggggucc

SEQ ID NO: 815469 - RNA, 24 nt, Human
ugaaaagaccacuuaacagacaca

SEQ ID NO: 815470 - RNA, 22 nt, Human
ugaaaagccggccuccucuuuc

SEQ ID NO: 815471 - RNA, 22 nt, Human
ugacacauucaagagucaaagu

SEQ ID NO: 815472 - RNA, 22 nt, Human
ugacucauaaacacggagaccc

SEQ ID NO: 815473 - RNA, 18 nt, Human
ugagcaagcacagaccac

SEQ ID NO: 815474 - RNA, 23 nt, Human
ugagguaaggaacugugagaccc

SEQ ID NO: 815475 - RNA, 20 nt, Human
ugaguucccucacaagcacu

SEQ ID NO: 815476 - RNA, 23 nt, Human
ugcagcuaagucacagacauucu

SEQ ID NO: 815477 - RNA, 18 nt, Human
ugccucagagaggcaaag

SEQ ID NO: 815478 - RNA, 21 nt, Human
ugcgaaaccagcagcauugga

SEQ ID NO: 815479 - RNA, 18 nt, Human
ugcgccggggcuugacac

SEQ ID NO: 815480 - RNA, 20 nt, Human
uggaacacucaggaccaagg

SEQ ID NO: 815481 - RNA, 19 nt, Human
ugggacgagcuuuggaagc

SEQ ID NO: 815482 - RNA, 19 nt, Human
ugggaggaggagaccccac

SEQ ID NO: 815483 - RNA, 21 nt, Human
ugggugaggguaggaaguugg

SEQ ID NO: 815484 - RNA, 21 nt, Human
uggugcuccaggggcugcccu

SEQ ID NO: 815485 - RNA, 19 nt, Human
ugguucuaaagcaagucuc

SEQ ID NO: 815486 - RNA, 20 nt, Human
ugugcgcuacauguuacaua

SEQ ID NO: 815487 - RNA, 22 nt, Human
uguggcuagcaucaacaugucu

SEQ ID NO: 815488 - RNA, 21 nt, Human
uuaagcagaaggggauacuga

SEQ ID NO: 815489 - RNA, 21 nt, Human
uuccaucaaaagaagccaaac

SEQ ID NO: 815490 - RNA, 20 nt, Human
uucguggaggcuccacuucc

SEQ ID NO: 815491 - RNA, 23 nt, Human
uugacaccggacggcagcccagu

SEQ ID NO: 815492 - RNA, 18 nt, Human
uugguuuaaaaaaaaaaa

SEQ ID NO: 815493 - RNA, 20 nt, Human
uuuggccacacacacacacg

SEQ ID NO: 815494 - RNA, 22 nt, Human
uuuuguggccuuuuuugguuug

SEQ ID NO: 815495 - RNA, 20 nt, Human
uuuuugguuuguugguuuaa

SEQ ID NO: 815496 - RNA, 21 nt, Human
aagacagagucuugcucuguc

SEQ ID NO: 815497 - RNA, 22 nt, Human
aagaggcagggucuugccaugu

SEQ ID NO: 815498 - RNA, 21 nt, Human
aagcaauccucccaccucagc

SEQ ID NO: 815499 - RNA, 25 nt, Human
aagcaauccucccaccucagccucc

SEQ ID NO: 815500 - RNA, 25 nt, Human
aagcaauccucccgccucagccucc

SEQ ID NO: 815501 - RNA, 25 nt, Human
aagcaauccucccgccucagccucc

SEQ ID NO: 815502 - RNA, 20 nt, Human
aagcagccgcagcacugugg

SEQ ID NO: 815503 - RNA, 20 nt, Human
aaggagcaguggcuggucag

SEQ ID NO: 815504 - RNA, 19 nt, Human
aaggcauaggggucugggc

SEQ ID NO: 815505 - RNA, 18 nt, Human
aaggugaggacagaggug

SEQ ID NO: 815506 - RNA, 26 nt, Human
aaguacuaggauuacagguguaagcc

SEQ ID NO: 815507 - RNA, 21 nt, Human
acacugcccacagccugaaac

SEQ ID NO: 815508 - RNA, 24 nt, Human
acacugggcuuggcacuccaugcc

SEQ ID NO: 815509 - RNA, 22 nt, Human
accucagccuccagaguugcag

SEQ ID NO: 815510 - RNA, 23 nt, Human
accucggccagcuccugcacccu

SEQ ID NO: 815511 - RNA, 19 nt, Human
accugaaaagccccuggug

SEQ ID NO: 815512 - RNA, 21 nt, Human
accuggaccucugacgucaug

SEQ ID NO: 815513 - RNA, 22 nt, Human
agacagaagcagaacuccaggg

SEQ ID NO: 815514 - RNA, 22 nt, Human
agacuggaggcuccaugagggu

SEQ ID NO: 815515 - RNA, 19 nt, Human
agcagccgcagcacugugg

SEQ ID NO: 815516 - RNA, 20 nt, Human
agcagccgcagcacuguggc

SEQ ID NO: 815517 - RNA, 19 nt, Human
agccaccacacuuggccug

SEQ ID NO: 815518 - RNA, 19 nt, Human
agcccccuggccugcacag

SEQ ID NO: 815519 - RNA, 21 nt, Human
agcccucacaccuccugcacu

SEQ ID NO: 815520 - RNA, 18 nt, Human
aggaaccugauuccagac

SEQ ID NO: 815521 - RNA, 22 nt, Human
aggaaccugauuccagacagaa

SEQ ID NO: 815522 - RNA, 19 nt, Human
aggacagagguggcagggg

SEQ ID NO: 815523 - RNA, 20 nt, Human
aggcaggaaccugauuccag

SEQ ID NO: 815524 - RNA, 20 nt, Human
aggcaggcaccucacgggga

SEQ ID NO: 815525 - RNA, 18 nt, Human
aggcagggucuugccaug

SEQ ID NO: 815526 - RNA, 23 nt, Human
aggcagggucuugccauguugcc

SEQ ID NO: 815527 - RNA, 21 nt, Human
aggcaugaggcaucacaucca

SEQ ID NO: 815528 - RNA, 22 nt, Human
aggcaugccuggucagugcugu

SEQ ID NO: 815529 - RNA, 22 nt, Human
aggcuggucuccugagcucugc

SEQ ID NO: 815530 - RNA, 29 nt, Human
aggugaggacagagguggcaggggagggg

SEQ ID NO: 815531 - RNA, 22 nt, Human
agucugcggcaucagggcgcag

SEQ ID NO: 815532 - RNA, 23 nt, Human
agugcaguggugcaauuuuggcu

SEQ ID NO: 815533 - RNA, 24 nt, Human
agugcaguggugcaauuuuggcuc

SEQ ID NO: 815534 - RNA, 26 nt, Human
auccacaggaagcccaaguaugccag

SEQ ID NO: 815535 - RNA, 21 nt, Human
auccucccgccucagccuccc

SEQ ID NO: 815536 - RNA, 21 nt, Human
aucuaagagggaaacccuggc

SEQ ID NO: 815537 - RNA, 22 nt, Human
augcagguuuuucuccaggguu

SEQ ID NO: 815538 - RNA, 26 nt, Human
caaagcucgucagaacggugcccucc

SEQ ID NO: 815539 - RNA, 24 nt, Human
caaaguacuaggauuacaggugua

SEQ ID NO: 815540 - RNA, 27 nt, Human
caagcaauccucccgccucagccuccc

SEQ ID NO: 815541 - RNA, 18 nt, Human
cacaccuccugcacuacu

SEQ ID NO: 815542 - RNA, 20 nt, Human
cacagccccagggcuucagg

SEQ ID NO: 815543 - RNA, 23 nt, Human
cacaggaagcccaaguaugccag

SEQ ID NO: 815544 - RNA, 21 nt, Human
cacauccagcuaauuuuugua

SEQ ID NO: 815545 - RNA, 26 nt, Human
cacaugcacagcaugguuaacagcag

SEQ ID NO: 815546 - RNA, 18 nt, Human
cacccucugcacguccuc

SEQ ID NO: 815547 - RNA, 24 nt, Human
cacgagggugguguuggcccacuu

SEQ ID NO: 815548 - RNA, 22 nt, Human
cacgucuguuccuagccagaag

SEQ ID NO: 815549 - RNA, 23 nt, Human
cacugcagguucugccucccggg

SEQ ID NO: 815550 - RNA, 20 nt, Human
cagaaugucuuugcuggcau

SEQ ID NO: 815551 - RNA, 19 nt, Human
cagcacacugcccacagcc

SEQ ID NO: 815552 - RNA, 19 nt, Human
cagcaccucggccagcucc

SEQ ID NO: 815553 - RNA, 19 nt, Human
cagcagaagcagcacaaga

SEQ ID NO: 815554 - RNA, 24 nt, Human
cagcagcauuguccagcuccugcu

SEQ ID NO: 815555 - RNA, 20 nt, Human
cagcauggaggacacagccu

SEQ ID NO: 815556 - RNA, 21 nt, Human
cagcggggccacaguauccuc

SEQ ID NO: 815557 - RNA, 20 nt, Human
cagcggugagagguggcugg

SEQ ID NO: 815558 - RNA, 20 nt, Human
cagcucuaggucccaucacu

SEQ ID NO: 815559 - RNA, 23 nt, Human
cagggucuugccauguugccagg

SEQ ID NO: 815560 - RNA, 24 nt, Human
cagugaucccagcacaugcucucu

SEQ ID NO: 815561 - RNA, 20 nt, Human
cagugccccacgucuguucc

SEQ ID NO: 815562 - RNA, 24 nt, Human
cauccaggaggggcucagccugcu

SEQ ID NO: 815563 - RNA, 20 nt, Human
cauggugacaagggggccuu

SEQ ID NO: 815564 - RNA, 21 nt, Human
caugugcaggggcccaggugc

SEQ ID NO: 815565 - RNA, 23 nt, Human
cauguugccaggcuggucucgaa

SEQ ID NO: 815566 - RNA, 21 nt, Human
cauuguccagcuccugcuugu

SEQ ID NO: 815567 - RNA, 20 nt, Human
ccaaaguacuaggauuacag

SEQ ID NO: 815568 - RNA, 21 nt, Human
ccaaaguacuaggauuacagg

SEQ ID NO: 815569 - RNA, 24 nt, Human
ccaaaguacuaggauuacaggugu

SEQ ID NO: 815570 - RNA, 20 nt, Human
ccagaaggcacaaggaggcu

SEQ ID NO: 815571 - RNA, 19 nt, Human
ccaggggucccagggcugu

SEQ ID NO: 815572 - RNA, 21 nt, Human
ccaggugcccggcuguacccc

SEQ ID NO: 815573 - RNA, 20 nt, Human
ccaugaggguggggcuuugc

SEQ ID NO: 815574 - RNA, 18 nt, Human
ccauguugccaggcuggu

SEQ ID NO: 815575 - RNA, 21 nt, Human
ccauguugccaggcuggucuc

SEQ ID NO: 815576 - RNA, 22 nt, Human
ccauguugccaggcuggucucg

SEQ ID NO: 815577 - RNA, 19 nt, Human
cccaggcuggagugcagug

SEQ ID NO: 815578 - RNA, 22 nt, Human
cccaggcuggagugcaguggug

SEQ ID NO: 815579 - RNA, 24 nt, Human
cccaggugcccggcuguaccccca

SEQ ID NO: 815580 - RNA, 25 nt, Human
ccccaggccgcccuucagggucugc

SEQ ID NO: 815581 - RNA, 18 nt, Human
ccccagggcuucaggacu

SEQ ID NO: 815582 - RNA, 22 nt, Human
cccccuggcaguuuucccagca

SEQ ID NO: 815583 - RNA, 20 nt, Human
ccccgggacugcagaaacga

SEQ ID NO: 815584 - RNA, 18 nt, Human
ccccuggugaagcugugc

SEQ ID NO: 815585 - RNA, 18 nt, Human
cccgggcuuaagcaaucc

SEQ ID NO: 815586 - RNA, 20 nt, Human
cccucugcacguccuccaag

SEQ ID NO: 815587 - RNA, 19 nt, Human
ccucaacacaugugucucc

SEQ ID NO: 815588 - RNA, 21 nt, Human
ccucaucguccacucucuuca

SEQ ID NO: 815589 - RNA, 21 nt, Human
ccuccaagccgguggugacuu

SEQ ID NO: 815590 - RNA, 24 nt, Human
ccucccaccucagccuccagaguu

SEQ ID NO: 815591 - RNA, 21 nt, Human
ccuccugcacuacugggagcc

SEQ ID NO: 815592 - RNA, 21 nt, Human
ccugcacccucugcacguccu

SEQ ID NO: 815593 - RNA, 18 nt, Human
ccugcuugucagguggag

SEQ ID NO: 815594 - RNA, 18 nt, Human
ccuggccucaagcaaucc

SEQ ID NO: 815595 - RNA, 19 nt, Human
ccuggucagugcuguggcu

SEQ ID NO: 815596 - RNA, 19 nt, Human
cgccaaaaguaagaggauc

SEQ ID NO: 815597 - RNA, 24 nt, Human
cgccucagccucccaaaguacuag

SEQ ID NO: 815598 - RNA, 18 nt, Human
cgcuggggucccucugcc

SEQ ID NO: 815599 - RNA, 23 nt, Human
cggugggaagcccuucccagcuc

SEQ ID NO: 815600 - RNA, 20 nt, Human
cuauaggcaugaggcaucac

SEQ ID NO: 815601 - RNA, 24 nt, Human
cucaagcaauccucccgccucagc

SEQ ID NO: 815602 - RNA, 21 nt, Human
cucacggggaggcacagugcu

SEQ ID NO: 815603 - RNA, 24 nt, Human
cucacugcagguucugccucccgg

SEQ ID NO: 815604 - RNA, 23 nt, Human
cuccucaucguccacucucuuca

SEQ ID NO: 815605 - RNA, 23 nt, Human
cucugcccguaggccacgagcag

SEQ ID NO: 815606 - RNA, 19 nt, Human
cugcacccucugcacgucc

SEQ ID NO: 815607 - RNA, 20 nt, Human
cugcacccucugcacguccu

SEQ ID NO: 815608 - RNA, 19 nt, Human
cugcuugucagguggagga

SEQ ID NO: 815609 - RNA, 23 nt, Human
cuggaggugucuguugagguggu

SEQ ID NO: 815610 - RNA, 18 nt, Human
cuggccucaagcaauccu

SEQ ID NO: 815611 - RNA, 22 nt, Human
cugguagacaucccugcugcug

SEQ ID NO: 815612 - RNA, 21 nt, Human
cuggucuguugcucagggaag

SEQ ID NO: 815613 - RNA, 18 nt, Human
cuucaccaucagaguggg

SEQ ID NO: 815614 - RNA, 21 nt, Human
cuuucuguuccuugagguggg

SEQ ID NO: 815615 - RNA, 18 nt, Human
gaagcccuucccagcucu

SEQ ID NO: 815616 - RNA, 23 nt, Human
gaaugaauaaaugagcuuggaug

SEQ ID NO: 815617 - RNA, 23 nt, Human
gaauuccuggccucaagcaaucc

SEQ ID NO: 815618 - RNA, 18 nt, Human
gacuauaggcaugaggca

SEQ ID NO: 815619 - RNA, 18 nt, Human
gacugcagaaacgagcug

SEQ ID NO: 815620 - RNA, 20 nt, Human
gagcccuggcuuucaugcuc

SEQ ID NO: 815621 - RNA, 19 nt, Human
gaggacagagguggcaggg

SEQ ID NO: 815622 - RNA, 19 nt, Human
gaggaucuugagucccugc

SEQ ID NO: 815623 - RNA, 18 nt, Human
gagggaggagaaagucag

SEQ ID NO: 815624 - RNA, 20 nt, Human
gaggggcucagccugcucug

SEQ ID NO: 815625 - RNA, 18 nt, Human
gaggguggucugcacaug

SEQ ID NO: 815626 - RNA, 18 nt, Human
gauuacagguguaagcca

SEQ ID NO: 815627 - RNA, 21 nt, Human
gauuacagguguaagccacca

SEQ ID NO: 815628 - RNA, 22 nt, Human
gcacagugcugaucacauaggu

SEQ ID NO: 815629 - RNA, 23 nt, Human
gcagaacuccaggggucccaggg

SEQ ID NO: 815630 - RNA, 21 nt, Human
gcagcacaagaggcagcuaga

SEQ ID NO: 815631 - RNA, 18 nt, Human
gccagcuggaggagcugc

SEQ ID NO: 815632 - RNA, 18 nt, Human
gcccuggcuuucaugcuc

SEQ ID NO: 815633 - RNA, 21 nt, Human
gcccuggcuuucaugcucuug

SEQ ID NO: 815634 - RNA, 21 nt, Human
gcucacugcagguucugccuc

SEQ ID NO: 815635 - RNA, 19 nt, Human
ggacacagccuuggccagc

SEQ ID NO: 815636 - RNA, 23 nt, Human
ggacagagguggcaggggagggg

SEQ ID NO: 815637 - RNA, 18 nt, Human
ggaggaacugaggcuugg

SEQ ID NO: 815638 - RNA, 19 nt, Human
ggaggaacugaggcuuggg

SEQ ID NO: 815639 - RNA, 20 nt, Human
ggaggggguggccagcaugg

SEQ ID NO: 815640 - RNA, 19 nt, Human
ggauuacagguguaagcca

SEQ ID NO: 815641 - RNA, 22 nt, Human
ggauuacagguguaagccacca

SEQ ID NO: 815642 - RNA, 19 nt, Human
ggcaggaggaacugaggcu

SEQ ID NO: 815643 - RNA, 20 nt, Human
ggccuuggcacucacuguca

SEQ ID NO: 815644 - RNA, 23 nt, Human
gggcucagccugcucuguugggg

SEQ ID NO: 815645 - RNA, 19 nt, Human
gggcuuugccagccugguu

SEQ ID NO: 815646 - RNA, 21 nt, Human
ggggagggaggagaaagucag

SEQ ID NO: 815647 - RNA, 19 nt, Human
gggucccagggcuguggag

SEQ ID NO: 815648 - RNA, 20 nt, Human
gguggcaggggagggaggag

SEQ ID NO: 815649 - RNA, 20 nt, Human
ggugucuguugaggugguag

SEQ ID NO: 815650 - RNA, 19 nt, Human
gguuuguaccuguuugugu

SEQ ID NO: 815651 - RNA, 18 nt, Human
gucccaguguugccagca

SEQ ID NO: 815652 - RNA, 22 nt, Human
gucugggcccaacagauguccu

SEQ ID NO: 815653 - RNA, 22 nt, Human
guggaggcguugcagaagaugg

SEQ ID NO: 815654 - RNA, 20 nt, Human
guggcaggggagggaggaga

SEQ ID NO: 815655 - RNA, 24 nt, Human
guugcagaagauggcaaagcucgu

SEQ ID NO: 815656 - RNA, 18 nt, Human
uaacgcagcugguuugua

SEQ ID NO: 815657 - RNA, 18 nt, Human
uaagagggaaacccuggc

SEQ ID NO: 815658 - RNA, 27 nt, Human
uaagcaauccucccaccucagccucca

SEQ ID NO: 815659 - RNA, 22 nt, Human
uaauuuuuguauuuuucaaaga

SEQ ID NO: 815660 - RNA, 23 nt, Human
uaauuuuuguauuuuucaaagag

SEQ ID NO: 815661 - RNA, 24 nt, Human
uaauuuuuguauuuuucaaagagg

SEQ ID NO: 815662 - RNA, 20 nt, Human
uacacagagauggagggggu

SEQ ID NO: 815663 - RNA, 21 nt, Human
uacagguguaagccaccacac

SEQ ID NO: 815664 - RNA, 27 nt, Human
uacuaggauuacagguguaagccacca

SEQ ID NO: 815665 - RNA, 19 nt, Human
uagcuccaaggcuggucuc

SEQ ID NO: 815666 - RNA, 22 nt, Human
uaggauuacagguguaagccac

SEQ ID NO: 815667 - RNA, 24 nt, Human
uaggauuacagguguaagccacca

SEQ ID NO: 815668 - RNA, 18 nt, Human
uagugcaggcaggcaccu

SEQ ID NO: 815669 - RNA, 19 nt, Human
uauccccaaugucuacagc

SEQ ID NO: 815670 - RNA, 22 nt, Human
ucaaagaggcagggucuugcca

SEQ ID NO: 815671 - RNA, 23 nt, Human
ucacugcagguucugccucccgg

SEQ ID NO: 815672 - RNA, 24 nt, Human
ucacugcagguucugccucccggg

SEQ ID NO: 815673 - RNA, 23 nt, Human
ucagggcgcagggaggagccuug

SEQ ID NO: 815674 - RNA, 18 nt, Human
ucagguggaggaauggaa

SEQ ID NO: 815675 - RNA, 22 nt, Human
ucagguggaucuaacacugggc

SEQ ID NO: 815676 - RNA, 23 nt, Human
ucagguggaucuaacacugggcu

SEQ ID NO: 815677 - RNA, 18 nt, Human
ucaugucuuaaccccgcc

SEQ ID NO: 815678 - RNA, 21 nt, Human
uccaggaggggcucagccugc

SEQ ID NO: 815679 - RNA, 27 nt, Human
uccaggggucccagggcuguggaggcg

SEQ ID NO: 815680 - RNA, 24 nt, Human
uccaugacucgaagcagccgcagc

SEQ ID NO: 815681 - RNA, 23 nt, Human
ucccaaaguacuaggauuacagg

SEQ ID NO: 815682 - RNA, 22 nt, Human
ucccaggcuggagugcaguggu

SEQ ID NO: 815683 - RNA, 18 nt, Human
ucccgggcuuaagcaauc

SEQ ID NO: 815684 - RNA, 24 nt, Human
ucccgggcuuaagcaauccuccca

SEQ ID NO: 815685 - RNA, 23 nt, Human
ucccugcaggcccaaggagcagu

SEQ ID NO: 815686 - RNA, 21 nt, Human
ucccugguggcugccuggcgc

SEQ ID NO: 815687 - RNA, 24 nt, Human
ucccugguggcugccuggcgccuc

SEQ ID NO: 815688 - RNA, 21 nt, Human
uccuccccauaggcaugccug

SEQ ID NO: 815689 - RNA, 27 nt, Human
uccucccgccucagccucccaaaguac

SEQ ID NO: 815690 - RNA, 23 nt, Human
uccugagcccuggcuuucaugcc

SEQ ID NO: 815691 - RNA, 20 nt, Human
ucucaggacuccuucaggug

SEQ ID NO: 815692 - RNA, 24 nt, Human
ucucccaggcuggagugcaguggu

SEQ ID NO: 815693 - RNA, 21 nt, Human
ucucgaauuccuggccucaag

SEQ ID NO: 815694 - RNA, 24 nt, Human
ucugccucccgggcuuaagcaauc

SEQ ID NO: 815695 - RNA, 19 nt, Human
ucugucucccaggcuggag

SEQ ID NO: 815696 - RNA, 24 nt, Human
ucugucucccaggcuggagugcag

SEQ ID NO: 815697 - RNA, 25 nt, Human
ucuguguguguguguguuugugugu

SEQ ID NO: 815698 - RNA, 20 nt, Human
ucuugagucccugcaggccc

SEQ ID NO: 815699 - RNA, 22 nt, Human
ucuugccauguugccaggcugg

SEQ ID NO: 815700 - RNA, 23 nt, Human
ucuugccauguugccaggcuggu

SEQ ID NO: 815701 - RNA, 19 nt, Human
ucuugcucugucucccagg

SEQ ID NO: 815702 - RNA, 22 nt, Human
ucuugcucugucucccaggcug

SEQ ID NO: 815703 - RNA, 23 nt, Human
ucuugcucugucucccaggcugg

SEQ ID NO: 815704 - RNA, 24 nt, Human
ucuugcucugucucccaggcugga

SEQ ID NO: 815705 - RNA, 22 nt, Human
ucuugguucagcauggaggaca

SEQ ID NO: 815706 - RNA, 19 nt, Human
ugaaaggcagacagaggac

SEQ ID NO: 815707 - RNA, 21 nt, Human
ugaaaggcagacagaggacag

SEQ ID NO: 815708 - RNA, 19 nt, Human
ugacucgaagcagccgcag

SEQ ID NO: 815709 - RNA, 20 nt, Human
ugacugcagacagugauccc

SEQ ID NO: 815710 - RNA, 21 nt, Human
ugagcagaaugucuuugcugg

SEQ ID NO: 815711 - RNA, 25 nt, Human
ugagcagaaugucuuugcuggcauu

SEQ ID NO: 815712 - RNA, 23 nt, Human
ugagcccucugugugugugugug

SEQ ID NO: 815713 - RNA, 24 nt, Human
ugagcccucugugugugugugugu

SEQ ID NO: 815714 - RNA, 18 nt, Human
ugaggacagagguggcag

SEQ ID NO: 815715 - RNA, 19 nt, Human
ugaggacagagguggcagg

SEQ ID NO: 815716 - RNA, 20 nt, Human
ugaggugguaggcgcugggg

SEQ ID NO: 815717 - RNA, 21 nt, Human
ugauucggaugaccucucccc

SEQ ID NO: 815718 - RNA, 22 nt, Human
ugcaaagaaagcagcgaauccc

SEQ ID NO: 815719 - RNA, 23 nt, Human
ugcaaagaaagcagcgaauccca

SEQ ID NO: 815720 - RNA, 22 nt, Human
ugcacaugcuccaugacucgaa

SEQ ID NO: 815721 - RNA, 22 nt, Human
ugcaguggugcaauuuuggcuc

SEQ ID NO: 815722 - RNA, 22 nt, Human
ugccagcagcauuguccagcuc

SEQ ID NO: 815723 - RNA, 23 nt, Human
ugccaggauuucucugaugaggg

SEQ ID NO: 815724 - RNA, 23 nt, Human
ugccauguugccaggcuggucuc

SEQ ID NO: 815725 - RNA, 22 nt, Human
ugccuagcacagggcuuuggag

SEQ ID NO: 815726 - RNA, 24 nt, Human
ugcucugucucccaggcuggagug

SEQ ID NO: 815727 - RNA, 24 nt, Human
uggaaugaaccagguuaggggaug

SEQ ID NO: 815728 - RNA, 18 nt, Human
uggaaugcuacauccuca

SEQ ID NO: 815729 - RNA, 20 nt, Human
uggagcaucccagguauggc

SEQ ID NO: 815730 - RNA, 20 nt, Human
uggaggaauggaaggugugg

SEQ ID NO: 815731 - RNA, 21 nt, Human
uggaggaauggaaggugugga

SEQ ID NO: 815732 - RNA, 20 nt, Human
uggaggagcugcucggggcc

SEQ ID NO: 815733 - RNA, 23 nt, Human
uggaggggguggccagcauggag

SEQ ID NO: 815734 - RNA, 18 nt, Human
uggagguguugcucugga

SEQ ID NO: 815735 - RNA, 19 nt, Human
uggagugcaguggugcaau

SEQ ID NO: 815736 - RNA, 28 nt, Human
uggagugcaguggugcaauucuagcacg

SEQ ID NO: 815737 - RNA, 24 nt, Human
uggagugcaguggugcaauuuugg

SEQ ID NO: 815738 - RNA, 19 nt, Human
uggcagauacacugauggg

SEQ ID NO: 815739 - RNA, 22 nt, Human
uggcagcggugagagguggcug

SEQ ID NO: 815740 - RNA, 20 nt, Human
uggcaggggagggaggagaa

SEQ ID NO: 815741 - RNA, 24 nt, Human
uggccaaaauccucugagucugca

SEQ ID NO: 815742 - RNA, 22 nt, Human
uggccagcuggaggagcugcuc

SEQ ID NO: 815743 - RNA, 20 nt, Human
uggccucaagcaauccuccc

SEQ ID NO: 815744 - RNA, 21 nt, Human
uggccucaagcaauccucccg

SEQ ID NO: 815745 - RNA, 24 nt, Human
uggccucaagcaauccucccgccu

SEQ ID NO: 815746 - RNA, 20 nt, Human
uggcuggucagacacaugca

SEQ ID NO: 815747 - RNA, 27 nt, Human
ugggccgagggugugaguuccuuacuc

SEQ ID NO: 815748 - RNA, 22 nt, Human
uggggcaauagugcaggcaggc

SEQ ID NO: 815749 - RNA, 20 nt, Human
ugguaggcgcuggggucccu

SEQ ID NO: 815750 - RNA, 19 nt, Human
uggugacaagggggccuuc

SEQ ID NO: 815751 - RNA, 24 nt, Human
uggugcaauuuuggcucacugcag

SEQ ID NO: 815752 - RNA, 19 nt, Human
ugguucagcauggaggaca

SEQ ID NO: 815753 - RNA, 18 nt, Human
uguacccccaggccgccc

SEQ ID NO: 815754 - RNA, 20 nt, Human
ugugagaucuaagagggaaa

SEQ ID NO: 815755 - RNA, 21 nt, Human
ugugcuggaggugucuguuga

SEQ ID NO: 815756 - RNA, 27 nt, Human
uguggggauuuucucugaaggugaggc

SEQ ID NO: 815757 - RNA, 23 nt, Human
uguguguguguguguuugugugu

SEQ ID NO: 815758 - RNA, 24 nt, Human
uguguguguguguguuugugugug

SEQ ID NO: 815759 - RNA, 20 nt, Human
uguguguguguguuugugug

SEQ ID NO: 815760 - RNA, 21 nt, Human
uguguguguguguuugugugu

SEQ ID NO: 815761 - RNA, 18 nt, Human
uguguguguuugugugug

SEQ ID NO: 815762 - RNA, 25 nt, Human
uucaaagaggcagggucuugccaug

SEQ ID NO: 815763 - RNA, 20 nt, Human
uuccagcacacugcccacag

SEQ ID NO: 815764 - RNA, 25 nt, Human
uuccuggccucaagcaauccucccg

SEQ ID NO: 815765 - RNA, 21 nt, Human
uucucugacacggcagccugg

SEQ ID NO: 815766 - RNA, 25 nt, Human
uucugaucuuguuggggaccccacu

SEQ ID NO: 815767 - RNA, 19 nt, Human
uugaggugggugguuuuca

SEQ ID NO: 815768 - RNA, 24 nt, Human
uugccaggcuggucucgaauuccu

SEQ ID NO: 815769 - RNA, 18 nt, Human
uugcucugucucccaggc

SEQ ID NO: 815770 - RNA, 21 nt, Human
uuguuggggaccccacuucag

SEQ ID NO: 815771 - RNA, 23 nt, Human
uuguuggggaccccacuucagau

SEQ ID NO: 815772 - RNA, 20 nt, Human
uuuuuguauuuuucaaagag

SEQ ID NO: 815773 - RNA, 23 nt, Human
uuuuuguauuuuucaaagaggca

SEQ ID NO: 815774 - RNA, 18 nt, Human
aaaccagggcaucuaagc

SEQ ID NO: 815775 - RNA, 19 nt, Human
aaaggcacucugggcccag

SEQ ID NO: 815776 - RNA, 21 nt, Human
agacaagagggacaaaccagg

SEQ ID NO: 815777 - RNA, 22 nt, Human
agacaagagggacaaaccaggg

SEQ ID NO: 815778 - RNA, 19 nt, Human
agcagggcgugggguggcu

SEQ ID NO: 815779 - RNA, 19 nt, Human
agcagguccgaugugggga

SEQ ID NO: 815780 - RNA, 18 nt, Human
agcccaacccugaaaggc

SEQ ID NO: 815781 - RNA, 22 nt, Human
agccccguguccucccugccug

SEQ ID NO: 815782 - RNA, 18 nt, Human
agccuccccagccccgcu

SEQ ID NO: 815783 - RNA, 21 nt, Human
agccugggaugccacagcacu

SEQ ID NO: 815784 - RNA, 24 nt, Human
agcugagcugaaugccccggcccc

SEQ ID NO: 815785 - RNA, 26 nt, Human
aggcaguccuugccgugccagcuucc

SEQ ID NO: 815786 - RNA, 23 nt, Human
aggccaguggcaggagagcuggg

SEQ ID NO: 815787 - RNA, 22 nt, Human
aggccuguggugggcagcugga

SEQ ID NO: 815788 - RNA, 20 nt, Human
agggaaccgauccagguuug

SEQ ID NO: 815789 - RNA, 18 nt, Human
agggagcaugggccucag

SEQ ID NO: 815790 - RNA, 19 nt, Human
agggcgugggguggcucag

SEQ ID NO: 815791 - RNA, 25 nt, Human
aguccuuugucuguguucuccaggg

SEQ ID NO: 815792 - RNA, 27 nt, Human
aguggcaggagagcuggguggauuacc

SEQ ID NO: 815793 - RNA, 22 nt, Human
augccugcagccuccccagccc

SEQ ID NO: 815794 - RNA, 22 nt, Human
caacccugaaaggccaguggca

SEQ ID NO: 815795 - RNA, 21 nt, Human
caagagggacaaaccagggca

SEQ ID NO: 815796 - RNA, 19 nt, Human
caccccccacccccugcaa

SEQ ID NO: 815797 - RNA, 23 nt, Human
caccccccacccccugcaaacug

SEQ ID NO: 815798 - RNA, 26 nt, Human
caccgcugauagcugggggcccgugc

SEQ ID NO: 815799 - RNA, 21 nt, Human
cacugggcccguuugggacug

SEQ ID NO: 815800 - RNA, 18 nt, Human
cagcacugccugcaccgc

SEQ ID NO: 815801 - RNA, 19 nt, Human
cagccuccacgaccugggc

SEQ ID NO: 815802 - RNA, 20 nt, Human
cagccucuguggcuguuccc

SEQ ID NO: 815803 - RNA, 22 nt, Human
cagcugcugggcccagccuccc

SEQ ID NO: 815804 - RNA, 19 nt, Human
cagcuggaggcagcagcag

SEQ ID NO: 815805 - RNA, 19 nt, Human
cagcuguggcugcuguggc

SEQ ID NO: 815806 - RNA, 23 nt, Human
caggacuggaagagcccugcuag

SEQ ID NO: 815807 - RNA, 23 nt, Human
caggagacaagagggacaaacca

SEQ ID NO: 815808 - RNA, 19 nt, Human
caggcuccgggccuacacu

SEQ ID NO: 815809 - RNA, 22 nt, Human
caguagcagccugccuugggau

SEQ ID NO: 815810 - RNA, 23 nt, Human
cauugcuggugcagugggggccu

SEQ ID NO: 815811 - RNA, 19 nt, Human
ccacagcacugccugcacc

SEQ ID NO: 815812 - RNA, 23 nt, Human
ccaccagugucucugaugccugc

SEQ ID NO: 815813 - RNA, 21 nt, Human
ccagccucgacucaccccagc

SEQ ID NO: 815814 - RNA, 21 nt, Human
cccagcccaacccugaaaggc

SEQ ID NO: 815815 - RNA, 23 nt, Human
cccaggggccucagagccccagg

SEQ ID NO: 815816 - RNA, 20 nt, Human
ccccaggcuccgagaggggc

SEQ ID NO: 815817 - RNA, 24 nt, Human
cccccugcaaacugcucagucuca

SEQ ID NO: 815818 - RNA, 22 nt, Human
cccccugggucugggguuccug

SEQ ID NO: 815819 - RNA, 24 nt, Human
ccccgcgccgggccugcaggcucc

SEQ ID NO: 815820 - RNA, 23 nt, Human
ccccuccacccuuccucccccug

SEQ ID NO: 815821 - RNA, 21 nt, Human
ccccugcaaacugcucagucu

SEQ ID NO: 815822 - RNA, 22 nt, Human
cccggagcagggcguggggugg

SEQ ID NO: 815823 - RNA, 23 nt, Human
cccggagccugggaugccacagc

SEQ ID NO: 815824 - RNA, 24 nt, Human
cccggcgcuugggugggccugagg

SEQ ID NO: 815825 - RNA, 23 nt, Human
cccgugcugcaggacuggaagag

SEQ ID NO: 815826 - RNA, 23 nt, Human
cccguguccucccugccuggggc

SEQ ID NO: 815827 - RNA, 19 nt, Human
cccugcaaacugcucaguc

SEQ ID NO: 815828 - RNA, 20 nt, Human
cccuggacagagcagggcga

SEQ ID NO: 815829 - RNA, 22 nt, Human
ccgaccugagccugccagccuc

SEQ ID NO: 815830 - RNA, 18 nt, Human
ccggagcagggcgugggg

SEQ ID NO: 815831 - RNA, 22 nt, Human
ccuacacugagcacauccgggg

SEQ ID NO: 815832 - RNA, 23 nt, Human
ccucagagccccaggugccuggg

SEQ ID NO: 815833 - RNA, 18 nt, Human
ccuccgauggccaugggu

SEQ ID NO: 815834 - RNA, 19 nt, Human
ccucggcgcucagccagcu

SEQ ID NO: 815835 - RNA, 24 nt, Human
ccucugcagcccggcgcuugggug

SEQ ID NO: 815836 - RNA, 20 nt, Human
ccucugcauaaggggcuguc

SEQ ID NO: 815837 - RNA, 22 nt, Human
ccugcaccgcugauagcugggg

SEQ ID NO: 815838 - RNA, 27 nt, Human
ccugcagccuccccagccccgcuuccu

SEQ ID NO: 815839 - RNA, 21 nt, Human
ccugcggggaaguccuuuguc

SEQ ID NO: 815840 - RNA, 21 nt, Human
ccuggcagcuuuguccccacc

SEQ ID NO: 815841 - RNA, 18 nt, Human
cgcccugccccgcaccca

SEQ ID NO: 815842 - RNA, 18 nt, Human
cgcugcuuuuucucuuuc

SEQ ID NO: 815843 - RNA, 21 nt, Human
cggagcugcccggagccuggg

SEQ ID NO: 815844 - RNA, 22 nt, Human
cggcgcucagccagcugcagcc

SEQ ID NO: 815845 - RNA, 23 nt, Human
cggucccaagcaagucaccccuu

SEQ ID NO: 815846 - RNA, 18 nt, Human
cuagggcuuuagggaacc

SEQ ID NO: 815847 - RNA, 24 nt, Human
cuccacccuuccucccccuggguc

SEQ ID NO: 815848 - RNA, 23 nt, Human
cuccaggggcagcugcugggccc

SEQ ID NO: 815849 - RNA, 25 nt, Human
cucggggcuucucuuucccuaaggg

SEQ ID NO: 815850 - RNA, 19 nt, Human
cucugggcccagcccaacc

SEQ ID NO: 815851 - RNA, 19 nt, Human
cugcagccccaaaggucua

SEQ ID NO: 815852 - RNA, 21 nt, Human
cugcugggcccagccucccca

SEQ ID NO: 815853 - RNA, 19 nt, Human
cugggcccguuugggacug

SEQ ID NO: 815854 - RNA, 19 nt, Human
cugugguguggcgggaagg

SEQ ID NO: 815855 - RNA, 21 nt, Human
cugugguguggcgggaaggga

SEQ ID NO: 815856 - RNA, 18 nt, Human
cuugguuuucuagcauug

SEQ ID NO: 815857 - RNA, 20 nt, Human
gaccugagccugccagccuc

SEQ ID NO: 815858 - RNA, 24 nt, Human
gagcauggaaaggggacgacaagg

SEQ ID NO: 815859 - RNA, 26 nt, Human
gagcgcagccacggcacgucucacac

SEQ ID NO: 815860 - RNA, 26 nt, Human
gagcugcccggagccugggaugccac

SEQ ID NO: 815861 - RNA, 24 nt, Human
gaggagaaggcuugggaaggcucc

SEQ ID NO: 815862 - RNA, 21 nt, Human
gaggccaccccgggggucagc

SEQ ID NO: 815863 - RNA, 19 nt, Human
gaggguggagaccaggccu

SEQ ID NO: 815864 - RNA, 21 nt, Human
gcaaaggcaguagcagccugc

SEQ ID NO: 815865 - RNA, 23 nt, Human
gcaccccccacccccugcaaacu

SEQ ID NO: 815866 - RNA, 19 nt, Human
gcagcagcagccuguuugc

SEQ ID NO: 815867 - RNA, 23 nt, Human
gcaguagcagccugccuugggau

SEQ ID NO: 815868 - RNA, 21 nt, Human
gccaaaagccccguguccucc

SEQ ID NO: 815869 - RNA, 25 nt, Human
gccagcuuccccgguucagagcuga

SEQ ID NO: 815870 - RNA, 23 nt, Human
gccaugggugucgggcugaggag

SEQ ID NO: 815871 - RNA, 24 nt, Human
gcccagcccaacccugaaaggcca

SEQ ID NO: 815872 - RNA, 24 nt, Human
gcccguuugggacuggguugagcc

SEQ ID NO: 815873 - RNA, 19 nt, Human
gccuacacugagcacaucc

SEQ ID NO: 815874 - RNA, 19 nt, Human
gccuggggcaggccugugg

SEQ ID NO: 815875 - RNA, 18 nt, Human
gcgcucagccagcugcag

SEQ ID NO: 815876 - RNA, 19 nt, Human
gcgggaagggacuuccuga

SEQ ID NO: 815877 - RNA, 22 nt, Human
gcggggaaguccuuugucugug

SEQ ID NO: 815878 - RNA, 19 nt, Human
gcugaggagaaggcuuggg

SEQ ID NO: 815879 - RNA, 18 nt, Human
gcugcagucacugugccu

SEQ ID NO: 815880 - RNA, 19 nt, Human
gcugggcccagccucccca

SEQ ID NO: 815881 - RNA, 24 nt, Human
gcuugcuuggggacuucaagggaa

SEQ ID NO: 815882 - RNA, 19 nt, Human
ggaaggcuccugacccguc

SEQ ID NO: 815883 - RNA, 20 nt, Human
ggacuggaagagcccugcua

SEQ ID NO: 815884 - RNA, 22 nt, Human
ggcccggagcagggcguggggu

SEQ ID NO: 815885 - RNA, 19 nt, Human
ggcggccccuugggugaac

SEQ ID NO: 815886 - RNA, 26 nt, Human
ggcugguggucugagugaccccaggc

SEQ ID NO: 815887 - RNA, 19 nt, Human
gggaaccgauccagguuug

SEQ ID NO: 815888 - RNA, 21 nt, Human
gggcaggccuguggugggcag

SEQ ID NO: 815889 - RNA, 18 nt, Human
gggccccuccacccuucc

SEQ ID NO: 815890 - RNA, 19 nt, Human
gggcgcaggcggcaguguc

SEQ ID NO: 815891 - RNA, 21 nt, Human
ggggaggccgggcugaacggc

SEQ ID NO: 815892 - RNA, 23 nt, Human
gggugggccugaggacccagggg

SEQ ID NO: 815893 - RNA, 25 nt, Human
gguccaggcaggugagcaggucccg

SEQ ID NO: 815894 - RNA, 21 nt, Human
ggucuagggcuuuagggaacc

SEQ ID NO: 815895 - RNA, 23 nt, Human
ggugcagugggggccugagcugg

SEQ ID NO: 815896 - RNA, 19 nt, Human
guaguggcugcggcuuccc

SEQ ID NO: 815897 - RNA, 19 nt, Human
guccuaggagagcauggaa

SEQ ID NO: 815898 - RNA, 18 nt, Human
gucucaagccaggcuggu

SEQ ID NO: 815899 - RNA, 23 nt, Human
gugcagugggggccugagcuggg

SEQ ID NO: 815900 - RNA, 21 nt, Human
gugccuggggcaggccugugg

SEQ ID NO: 815901 - RNA, 22 nt, Human
guggcuccuggcagcuuugucc

SEQ ID NO: 815902 - RNA, 22 nt, Human
gugggccugaggacccaggggg

SEQ ID NO: 815903 - RNA, 18 nt, Human
gugguucuuaagacccuc

SEQ ID NO: 815904 - RNA, 19 nt, Human
uaagaaggucacugccucc

SEQ ID NO: 815905 - RNA, 23 nt, Human
uacacugagcacauccgggggcg

SEQ ID NO: 815906 - RNA, 31 nt, Human
ucacuuuuauuggcuugguuuucuagcauuu

SEQ ID NO: 815907 - RNA, 20 nt, Human
ucagggagcaugggccucag

SEQ ID NO: 815908 - RNA, 19 nt, Human
uccacccuuccucccccug

SEQ ID NO: 815909 - RNA, 20 nt, Human
uccaggggcagcugcugggc

SEQ ID NO: 815910 - RNA, 21 nt, Human
uccaggggcagcugcugggcc

SEQ ID NO: 815911 - RNA, 23 nt, Human
uccccucucacggcccgucaccu

SEQ ID NO: 815912 - RNA, 19 nt, Human
ucuagggcuuuagggaacc

SEQ ID NO: 815913 - RNA, 20 nt, Human
ucuccaggggcagcugcugg

SEQ ID NO: 815914 - RNA, 19 nt, Human
ucuucggggccgugugugg

SEQ ID NO: 815915 - RNA, 18 nt, Human
ugaacggcuccuccccgc

SEQ ID NO: 815916 - RNA, 19 nt, Human
ugaccccaggcuccgagag

SEQ ID NO: 815917 - RNA, 22 nt, Human
ugaccccuggggccccuccacc

SEQ ID NO: 815918 - RNA, 24 nt, Human
ugaggacccagggggagugugcgg

SEQ ID NO: 815919 - RNA, 25 nt, Human
ugaggagaaggcuugggaaggcucc

SEQ ID NO: 815920 - RNA, 24 nt, Human
ugcagcccggcgcuugggugggcc

SEQ ID NO: 815921 - RNA, 21 nt, Human
ugcagccuccccagccccgcu

SEQ ID NO: 815922 - RNA, 19 nt, Human
ugcaggcaggcccggagca

SEQ ID NO: 815923 - RNA, 24 nt, Human
ugcagugcuugcuuggggacuuca

SEQ ID NO: 815924 - RNA, 20 nt, Human
ugccugcagccuccccagcc

SEQ ID NO: 815925 - RNA, 18 nt, Human
ugcuaaggccggagaccc

SEQ ID NO: 815926 - RNA, 24 nt, Human
ugcugccugcgcccugccccgcac

SEQ ID NO: 815927 - RNA, 22 nt, Human
uggcagcccaggguccaggcaa

SEQ ID NO: 815928 - RNA, 22 nt, Human
uggcagcccaggguccaggcag

SEQ ID NO: 815929 - RNA, 18 nt, Human
uggcagcuuuguccccac

SEQ ID NO: 815930 - RNA, 19 nt, Human
uggccaaaagccccguguc

SEQ ID NO: 815931 - RNA, 24 nt, Human
uggcucaguuaagaaggucacugc

SEQ ID NO: 815932 - RNA, 22 nt, Human
uggcuguucccagcccugucug

SEQ ID NO: 815933 - RNA, 18 nt, Human
ugggaaggcuccugaccc

SEQ ID NO: 815934 - RNA, 18 nt, Human
ugggaugccacagcacug

SEQ ID NO: 815935 - RNA, 18 nt, Human
ugggcagcuggaggcagc

SEQ ID NO: 815936 - RNA, 22 nt, Human
ugggcagcuggaggcagcagca

SEQ ID NO: 815937 - RNA, 27 nt, Human
ugggcagcuggaggcagcagcagccug

SEQ ID NO: 815938 - RNA, 18 nt, Human
ugggcccagcccaacccu

SEQ ID NO: 815939 - RNA, 21 nt, Human
ugggcgggagcaagcucuucc

SEQ ID NO: 815940 - RNA, 24 nt, Human
uggggacuucaagggaaggcucuu

SEQ ID NO: 815941 - RNA, 18 nt, Human
uggggaggaggugggaga

SEQ ID NO: 815942 - RNA, 18 nt, Human
uggggauauggcuuccug

SEQ ID NO: 815943 - RNA, 22 nt, Human
uggguugagccaucaggccacc

SEQ ID NO: 815944 - RNA, 19 nt, Human
ugucucugaugccugcagc

SEQ ID NO: 815945 - RNA, 21 nt, Human
ugucuguguucuccaggggca

SEQ ID NO: 815946 - RNA, 19 nt, Human
uguggugggcagcuggagg

SEQ ID NO: 815947 - RNA, 21 nt, Human
ugugguucuuaagacccucaa

SEQ ID NO: 815948 - RNA, 21 nt, Human
uugggaaggcuccugacccgu

SEQ ID NO: 815949 - RNA, 25 nt, Human
uugguaguggcugcggcuucccagg

SEQ ID NO: 815950 - RNA, 20 nt, Human
uuugggggcggggagaaagu

SEQ ID NO: 815951 - RNA, 19 nt, Human
aaccagaggccccuccagg

SEQ ID NO: 815952 - RNA, 20 nt, Human
aaccagaggccccuccaggg

SEQ ID NO: 815953 - RNA, 21 nt, Human
acgcgaaaugggggguccggg

SEQ ID NO: 815954 - RNA, 21 nt, Human
aggcggcgucugcgguggugg

SEQ ID NO: 815955 - RNA, 22 nt, Human
agggcccagccucgggggccuc

SEQ ID NO: 815956 - RNA, 21 nt, Human
agguggaggugguggcggguu

SEQ ID NO: 815957 - RNA, 19 nt, Human
caggggggucaggggagcc

SEQ ID NO: 815958 - RNA, 24 nt, Human
cauucucaaccccucuucugaggg

SEQ ID NO: 815959 - RNA, 21 nt, Human
ccauucucaaccccucuucug

SEQ ID NO: 815960 - RNA, 22 nt, Human
cggccccugucuugggccagga

SEQ ID NO: 815961 - RNA, 19 nt, Human
gaccuccgcugugucgagg

SEQ ID NO: 815962 - RNA, 20 nt, Human
gaggauuccauucucaaccc

SEQ ID NO: 815963 - RNA, 20 nt, Human
gaggggcuccaggcccaaaa

SEQ ID NO: 815964 - RNA, 19 nt, Human
gagguggaggugguggcgg

SEQ ID NO: 815965 - RNA, 21 nt, Human
gcaguggcgccgucauccaca

SEQ ID NO: 815966 - RNA, 20 nt, Human
ggagggggagggcccagccu

SEQ ID NO: 815967 - RNA, 21 nt, Human
ggccccugucuugggccagga

SEQ ID NO: 815968 - RNA, 20 nt, Human
ggcuccaggcccaaaagagu

SEQ ID NO: 815969 - RNA, 19 nt, Human
ggcuggggggcgggggccc

SEQ ID NO: 815970 - RNA, 22 nt, Human
gggagccaucuggggggcuggg

SEQ ID NO: 815971 - RNA, 20 nt, Human
gggagugggagggggagggc

SEQ ID NO: 815972 - RNA, 24 nt, Human
gggcuggggggcgggggcccgggg

SEQ ID NO: 815973 - RNA, 18 nt, Human
ggggagugggagggggag

SEQ ID NO: 815974 - RNA, 21 nt, Human
ggggcgggggcccggggccuc

SEQ ID NO: 815975 - RNA, 18 nt, Human
ggggcuggggggcggggg

SEQ ID NO: 815976 - RNA, 21 nt, Human
gggggcccggggccucccguu

SEQ ID NO: 815977 - RNA, 18 nt, Human
gggggcuggggggcgggg

SEQ ID NO: 815978 - RNA, 19 nt, Human
gggggcuggggggcggggg

SEQ ID NO: 815979 - RNA, 21 nt, Human
ggggggcuggggggcgggggc

SEQ ID NO: 815980 - RNA, 18 nt, Human
ggggucgggucuucgggg

SEQ ID NO: 815981 - RNA, 23 nt, Human
gucgaggggcuccaggcccaaaa

SEQ ID NO: 815982 - RNA, 23 nt, Human
uaggggagugggagggggagggc

SEQ ID NO: 815983 - RNA, 22 nt, Human
uccccgaagccugcggccccug

SEQ ID NO: 815984 - RNA, 20 nt, Human
ucuggggggcuggggggcgg

SEQ ID NO: 815985 - RNA, 23 nt, Human
uggaggggcggggggauuccugc

SEQ ID NO: 815986 - RNA, 22 nt, Human
ugggagggggagggcccagccu

SEQ ID NO: 815987 - RNA, 18 nt, Human
uggggagggaaaggggag

SEQ ID NO: 815988 - RNA, 19 nt, Human
uggggagggaaaggggaga

SEQ ID NO: 815989 - RNA, 18 nt, Human
uggggggcgggggcccgg

SEQ ID NO: 815990 - RNA, 20 nt, Human
uggggggcgggggcccgggg

SEQ ID NO: 815991 - RNA, 18 nt, Human
uggggggcuggggggcgg

SEQ ID NO: 815992 - RNA, 23 nt, Human
uggggggcuggggggcgggguag

SEQ ID NO: 815993 - RNA, 21 nt, Human
ugguaggggagugggaggggg

SEQ ID NO: 815994 - RNA, 24 nt, Human
ugguaggggagugggagggggagg

SEQ ID NO: 815995 - RNA, 21 nt, Human
ugucgaggauggcagggaggu

SEQ ID NO: 815996 - RNA, 18 nt, Human
ugucuugggccaggagug

SEQ ID NO: 815997 - RNA, 20 nt, Human
uuccgagaaaggcggcucuc

SEQ ID NO: 815998 - RNA, 21 nt, Human
aaaaauuuaaaauugcuuuca

SEQ ID NO: 815999 - RNA, 19 nt, Human
aaagcugaccguaccuccc

SEQ ID NO: 816000 - RNA, 21 nt, Human
aaauccuacauuuugguguua

SEQ ID NO: 816001 - RNA, 19 nt, Human
aacuuggaagccagucacu

SEQ ID NO: 816002 - RNA, 18 nt, Human
aagaaauugggaggggag

SEQ ID NO: 816003 - RNA, 19 nt, Human
aaggacccugcugcugccc

SEQ ID NO: 816004 - RNA, 24 nt, Human
aaguaccauaaugcaggaccccag

SEQ ID NO: 816005 - RNA, 19 nt, Human
aaguuccagccaagugcag

SEQ ID NO: 816006 - RNA, 21 nt, Human
aauccauaaacuuucuuccuc

SEQ ID NO: 816007 - RNA, 21 nt, Human
aaugcaaaaauuuauauuuua

SEQ ID NO: 816008 - RNA, 25 nt, Human
aauuuacaccuuuuuuuuuuucuuu

SEQ ID NO: 816009 - RNA, 21 nt, Human
acacagauccacaaguugcuu

SEQ ID NO: 816010 - RNA, 19 nt, Human
acacugugcugacugugaa

SEQ ID NO: 816011 - RNA, 24 nt, Human
acaggcaaggagacgaacgaagau

SEQ ID NO: 816012 - RNA, 19 nt, Human
accauaaugcaggacccca

SEQ ID NO: 816013 - RNA, 18 nt, Human
accccagggggaagccuc

SEQ ID NO: 816014 - RNA, 24 nt, Human
accuuuuuuuuuuucuuuuuuggu

SEQ ID NO: 816015 - RNA, 23 nt, Human
acgaagaugggcacugggcacug

SEQ ID NO: 816016 - RNA, 22 nt, Human
acgcaggggagggguggggggc

SEQ ID NO: 816017 - RNA, 19 nt, Human
agaagggggaagggagcag

SEQ ID NO: 816018 - RNA, 20 nt, Human
agaagggggaagggagcagu

SEQ ID NO: 816019 - RNA, 24 nt, Human
agacagcagaacccagauaggaca

SEQ ID NO: 816020 - RNA, 22 nt, Human
agacauggccaucuaaagccca

SEQ ID NO: 816021 - RNA, 29 nt, Human
agaggugguguggccagggguaggcuccu

SEQ ID NO: 816022 - RNA, 18 nt, Human
agccuugguagaugaagg

SEQ ID NO: 816023 - RNA, 23 nt, Human
agcgguggcucccgggcaguguu

SEQ ID NO: 816024 - RNA, 24 nt, Human
aggagccagcaccaaccgugggag

SEQ ID NO: 816025 - RNA, 20 nt, Human
agggguaggcuccugccucu

SEQ ID NO: 816026 - RNA, 19 nt, Human
aggguuucuggcagcuggu

SEQ ID NO: 816027 - RNA, 24 nt, Human
aggugucgcugucccuccgcuccu

SEQ ID NO: 816028 - RNA, 24 nt, Human
augauagccauuguuuuuugggua

SEQ ID NO: 816029 - RNA, 23 nt, Human
auugugcagacuagaaauacuac

SEQ ID NO: 816030 - RNA, 24 nt, Human
caaaaacauccccaggaaucaagg

SEQ ID NO: 816031 - RNA, 24 nt, Human
caaaaucaaucaaacccacucgca

SEQ ID NO: 816032 - RNA, 22 nt, Human
caaauccuacauuuugguguua

SEQ ID NO: 816033 - RNA, 22 nt, Human
caaggagacgcaggggaggggu

SEQ ID NO: 816034 - RNA, 18 nt, Human
cacacacacacacacaca

SEQ ID NO: 816035 - RNA, 18 nt, Human
caccgagucaccaugucc

SEQ ID NO: 816036 - RNA, 24 nt, Human
cacgaagcccgcaauaaugagggc

SEQ ID NO: 816037 - RNA, 21 nt, Human
cacugagcugcuguuggaagc

SEQ ID NO: 816038 - RNA, 21 nt, Human
cacugggcacugugcucaggg

SEQ ID NO: 816039 - RNA, 23 nt, Human
cacuuccuaacucugucuuuacc

SEQ ID NO: 816040 - RNA, 21 nt, Human
cagagacagauaaauuaaaug

SEQ ID NO: 816041 - RNA, 21 nt, Human
cagcagccugagguccagucu

SEQ ID NO: 816042 - RNA, 22 nt, Human
cagcuccacgccacuguggucg

SEQ ID NO: 816043 - RNA, 24 nt, Human
cagcugguuucugcacgcugaccg

SEQ ID NO: 816044 - RNA, 20 nt, Human
caggaccccagggggaagcc

SEQ ID NO: 816045 - RNA, 21 nt, Human
ccaaaugacuuuuuaauccac

SEQ ID NO: 816046 - RNA, 20 nt, Human
ccaaggaaagagaugagagu

SEQ ID NO: 816047 - RNA, 22 nt, Human
ccaaggaaagagaugagagugu

SEQ ID NO: 816048 - RNA, 19 nt, Human
ccaagugcagcuccacgcc

SEQ ID NO: 816049 - RNA, 21 nt, Human
ccagggguaggcuccugccuc

SEQ ID NO: 816050 - RNA, 18 nt, Human
cccaggacccaaaugacu

SEQ ID NO: 816051 - RNA, 18 nt, Human
cccauacacacacacaca

SEQ ID NO: 816052 - RNA, 20 nt, Human
cccauacacacacacacaca

SEQ ID NO: 816053 - RNA, 18 nt, Human
cccccucuucaucucuuc

SEQ ID NO: 816054 - RNA, 18 nt, Human
ccccucuucaucucuucu

SEQ ID NO: 816055 - RNA, 19 nt, Human
ccccucuucaucucuucuc

SEQ ID NO: 816056 - RNA, 19 nt, Human
ccccucuuccuuuucugcc

SEQ ID NO: 816057 - RNA, 21 nt, Human
ccccuggggaacggcugcugg

SEQ ID NO: 816058 - RNA, 23 nt, Human
ccccugguauucauaggccccuu

SEQ ID NO: 816059 - RNA, 20 nt, Human
ccucaugggauggugauggg

SEQ ID NO: 816060 - RNA, 21 nt, Human
ccuccaggcccaggggggugc

SEQ ID NO: 816061 - RNA, 23 nt, Human
ccucuggagguggagagaaaugu

SEQ ID NO: 816062 - RNA, 18 nt, Human
ccugagucccagcaguag

SEQ ID NO: 816063 - RNA, 25 nt, Human
ccuggccacagugcuacuguagaga

SEQ ID NO: 816064 - RNA, 21 nt, Human
cgcggagacagcagaacccag

SEQ ID NO: 816065 - RNA, 22 nt, Human
cggagacagcagaacccagaua

SEQ ID NO: 816066 - RNA, 20 nt, Human
cuacgcggagacagcagaac

SEQ ID NO: 816067 - RNA, 22 nt, Human
cucaaauguggcccgaacauug

SEQ ID NO: 816068 - RNA, 19 nt, Human
cucacuuuccucuggccac

SEQ ID NO: 816069 - RNA, 25 nt, Human
cucaugaacuucccaacaauucuca

SEQ ID NO: 816070 - RNA, 21 nt, Human
cucccacugggccggaccucc

SEQ ID NO: 816071 - RNA, 20 nt, Human
cucccccucuucaucucuuc

SEQ ID NO: 816072 - RNA, 20 nt, Human
cucccccucuucaucucuuc

SEQ ID NO: 816073 - RNA, 19 nt, Human
cucguggccagcauagcca

SEQ ID NO: 816074 - RNA, 19 nt, Human
cucugaggccagcauguca

SEQ ID NO: 816075 - RNA, 20 nt, Human
cucuguguggggaacagggc

SEQ ID NO: 816076 - RNA, 18 nt, Human
cugcacucugaccgcaug

SEQ ID NO: 816077 - RNA, 26 nt, Human
cugcagccccucuuccuuuucugccu

SEQ ID NO: 816078 - RNA, 20 nt, Human
cugcugcccccagacuuggc

SEQ ID NO: 816079 - RNA, 20 nt, Human
cuggcagcugguguagugga

SEQ ID NO: 816080 - RNA, 19 nt, Human
cuucuccugugcuuguaga

SEQ ID NO: 816081 - RNA, 22 nt, Human
cuucuuucccagugcuucccag

SEQ ID NO: 816082 - RNA, 21 nt, Human
cuugaccuugggcuccuggcc

SEQ ID NO: 816083 - RNA, 23 nt, Human
cuuggcccuugacagagccuugg

SEQ ID NO: 816084 - RNA, 19 nt, Human
cuugugggggccuucccga

SEQ ID NO: 816085 - RNA, 22 nt, Human
cuuucuuccucugucugcagcc

SEQ ID NO: 816086 - RNA, 24 nt, Human
gaacagggcaugaagcauccuuca

SEQ ID NO: 816087 - RNA, 20 nt, Human
gacauggccaucuaaagccc

SEQ ID NO: 816088 - RNA, 18 nt, Human
gacuccugcccuauccuc

SEQ ID NO: 816089 - RNA, 23 nt, Human
gaggaguguaagggggaagggag

SEQ ID NO: 816090 - RNA, 20 nt, Human
gagggcgaugaaaggcacca

SEQ ID NO: 816091 - RNA, 18 nt, Human
gaggggagaagcccuccu

SEQ ID NO: 816092 - RNA, 21 nt, Human
gagguggagagaaaugucagg

SEQ ID NO: 816093 - RNA, 20 nt, Human
gaguguaagggggaagggag

SEQ ID NO: 816094 - RNA, 21 nt, Human
gccccuuuccacagggaauuc

SEQ ID NO: 816095 - RNA, 18 nt, Human
gcccuugacagagccuug

SEQ ID NO: 816096 - RNA, 21 nt, Human
gccuuggcccuugacagagcc

SEQ ID NO: 816097 - RNA, 18 nt, Human
gcugccacugagcugcug

SEQ ID NO: 816098 - RNA, 19 nt, Human
gcugcuguuggaagcaaag

SEQ ID NO: 816099 - RNA, 20 nt, Human
ggagaggaguguaaggggga

SEQ ID NO: 816100 - RNA, 26 nt, Human
ggagaggaguguaagggggaagggag

SEQ ID NO: 816101 - RNA, 18 nt, Human
ggaggcggggcucucggu

SEQ ID NO: 816102 - RNA, 20 nt, Human
ggccacagacuugucuucuc

SEQ ID NO: 816103 - RNA, 19 nt, Human
ggccucaucugcccuguuc

SEQ ID NO: 816104 - RNA, 18 nt, Human
ggcggccaauggacucgg

SEQ ID NO: 816105 - RNA, 19 nt, Human
ggcugccacugagcugcug

SEQ ID NO: 816106 - RNA, 21 nt, Human
ggcuugggugagcgguggcuc

SEQ ID NO: 816107 - RNA, 22 nt, Human
gggcaggcuugcuccccuguuc

SEQ ID NO: 816108 - RNA, 21 nt, Human
gggcgagggccugagucccag

SEQ ID NO: 816109 - RNA, 26 nt, Human
gggcucucgguggcggugguggcggc

SEQ ID NO: 816110 - RNA, 27 nt, Human
ggggcucucgguggcggugguggcggg

SEQ ID NO: 816111 - RNA, 21 nt, Human
ggggggcgggaauaggcaucc

SEQ ID NO: 816112 - RNA, 20 nt, Human
gggguggggggcgggaauag

SEQ ID NO: 816113 - RNA, 19 nt, Human
gggugagcgguggcucccg

SEQ ID NO: 816114 - RNA, 22 nt, Human
gggugccccaccagcaggugcu

SEQ ID NO: 816115 - RNA, 22 nt, Human
gguggagagaaaugucaggggu

SEQ ID NO: 816116 - RNA, 20 nt, Human
gucaguugacagccagacuu

SEQ ID NO: 816117 - RNA, 20 nt, Human
gugaagggccucaucugccc

SEQ ID NO: 816118 - RNA, 21 nt, Human
gugaagggccucaucugcccu

SEQ ID NO: 816119 - RNA, 26 nt, Human
gugcugggugccccaccagcaggucg

SEQ ID NO: 816120 - RNA, 22 nt, Human
guggcggccaggccggguggcu

SEQ ID NO: 816121 - RNA, 19 nt, Human
guguguguguuugugugug

SEQ ID NO: 816122 - RNA, 24 nt, Human
guuacagucaccgagucaccaugu

SEQ ID NO: 816123 - RNA, 23 nt, Human
uaacaaauccuacauuuuggugu

SEQ ID NO: 816124 - RNA, 23 nt, Human
uaagaaauugggaggggagcuuc

SEQ ID NO: 816125 - RNA, 24 nt, Human
uacaugauagccauuguuuuuugg

SEQ ID NO: 816126 - RNA, 21 nt, Human
uaggagaugaaaaucuucuuu

SEQ ID NO: 816127 - RNA, 18 nt, Human
uaggccccuuuccacagg

SEQ ID NO: 816128 - RNA, 22 nt, Human
uauacugcagacaagccaagaa

SEQ ID NO: 816129 - RNA, 23 nt, Human
uauggucagcggcugcugggagc

SEQ ID NO: 816130 - RNA, 24 nt, Human
uaugugacaugaaucucugaggcc

SEQ ID NO: 816131 - RNA, 21 nt, Human
uauugugcagacuagaaauac

SEQ ID NO: 816132 - RNA, 22 nt, Human
ucaaauguggcccgaacauugg

SEQ ID NO: 816133 - RNA, 18 nt, Human
ucaaucaaacccacucgc

SEQ ID NO: 816134 - RNA, 23 nt, Human
ucauaggccccuuuccacaggga

SEQ ID NO: 816135 - RNA, 22 nt, Human
uccagccaagugcagcuccacg

SEQ ID NO: 816136 - RNA, 21 nt, Human
ucccccucuucaucucuucuc

SEQ ID NO: 816137 - RNA, 20 nt, Human
ucccuccaggcccagggggg

SEQ ID NO: 816138 - RNA, 24 nt, Human
uccgcuggguggucugagaggggc

SEQ ID NO: 816139 - RNA, 23 nt, Human
uccuaaacucaugaacuucccaa

SEQ ID NO: 816140 - RNA, 26 nt, Human
ucucaaggacccugcugcugccccca

SEQ ID NO: 816141 - RNA, 23 nt, Human
ucugacuccagcagccugagguc

SEQ ID NO: 816142 - RNA, 19 nt, Human
ucugcagccccucuuccuu

SEQ ID NO: 816143 - RNA, 20 nt, Human
ucugccuuuucaggacacgg

SEQ ID NO: 816144 - RNA, 19 nt, Human
ucugucagccuccauugug

SEQ ID NO: 816145 - RNA, 18 nt, Human
ucuucucuuugucaguug

SEQ ID NO: 816146 - RNA, 20 nt, Human
ucuuucccagugcuucccag

SEQ ID NO: 816147 - RNA, 19 nt, Human
ugaaaaaaauaaagaaacu

SEQ ID NO: 816148 - RNA, 21 nt, Human
ugaaaaaaauaaagaaacuga

SEQ ID NO: 816149 - RNA, 20 nt, Human
ugaaucucugaggccagcau

SEQ ID NO: 816150 - RNA, 20 nt, Human
ugacagagccuugguagaug

SEQ ID NO: 816151 - RNA, 23 nt, Human
ugacagccagacuugaccuuggg

SEQ ID NO: 816152 - RNA, 19 nt, Human
ugaccuugggcuccuggcc

SEQ ID NO: 816153 - RNA, 21 nt, Human
ugagcgguggcucccgggcag

SEQ ID NO: 816154 - RNA, 18 nt, Human
ugaggggagaagcccucc

SEQ ID NO: 816155 - RNA, 20 nt, Human
ugaggggagaagcccuccug

SEQ ID NO: 816156 - RNA, 21 nt, Human
ugcagacaagccaagaaggug

SEQ ID NO: 816157 - RNA, 23 nt, Human
ugccaggucuuuugcuggcuaug

SEQ ID NO: 816158 - RNA, 20 nt, Human
ugccccgaagcugccuacgc

SEQ ID NO: 816159 - RNA, 25 nt, Human
ugccccuucuagaacaggguuucug

SEQ ID NO: 816160 - RNA, 23 nt, Human
ugccgugucccagagguggugug

SEQ ID NO: 816161 - RNA, 24 nt, Human
ugcugcugcccccagacuuggcau

SEQ ID NO: 816162 - RNA, 23 nt, Human
ugcuggaggcggggcucucggug

SEQ ID NO: 816163 - RNA, 25 nt, Human
uggaaauggacgccucucacuuucc

SEQ ID NO: 816164 - RNA, 23 nt, Human
uggauuggcccucucccuccagg

SEQ ID NO: 816165 - RNA, 24 nt, Human
uggcauugaccuugcuguuggcaa

SEQ ID NO: 816166 - RNA, 23 nt, Human
uggcggcagggcgagggccugag

SEQ ID NO: 816167 - RNA, 25 nt, Human
uggcggcagggcgagggccugaguc

SEQ ID NO: 816168 - RNA, 21 nt, Human
uggcggccaauggacucgggg

SEQ ID NO: 816169 - RNA, 19 nt, Human
uggcggccaggccgggugg

SEQ ID NO: 816170 - RNA, 21 nt, Human
ugggagccaaggagccagcac

SEQ ID NO: 816171 - RNA, 22 nt, Human
ugggagccaaggagccagcacc

SEQ ID NO: 816172 - RNA, 21 nt, Human
ugggcuccuggccagacuccu

SEQ ID NO: 816173 - RNA, 19 nt, Human
ugguggcauugaccuugcu

SEQ ID NO: 816174 - RNA, 19 nt, Human
ugucaggggugcggagggu

SEQ ID NO: 816175 - RNA, 22 nt, Human
ugucccagaggugguguggcca

SEQ ID NO: 816176 - RNA, 21 nt, Human
ugucugcagccccucuuccuu

SEQ ID NO: 816177 - RNA, 23 nt, Human
ugugcacacugugcugacuguga

SEQ ID NO: 816178 - RNA, 23 nt, Human
ugugcagacuagaaauacuacag

SEQ ID NO: 816179 - RNA, 24 nt, Human
uguguuugugugugaucaggccca

SEQ ID NO: 816180 - RNA, 25 nt, Human
uguguuugugugugaucaggcccau

SEQ ID NO: 816181 - RNA, 22 nt, Human
uguucccuuccaagccucugga

SEQ ID NO: 816182 - RNA, 19 nt, Human
uguuuugaaagcugaccgu

SEQ ID NO: 816183 - RNA, 22 nt, Human
uuacauuuacaaaaaaggcuuc

SEQ ID NO: 816184 - RNA, 23 nt, Human
uucaggaccugccaggucuuuug

SEQ ID NO: 816185 - RNA, 23 nt, Human
uucauaaagaucuccacaggccc

SEQ ID NO: 816186 - RNA, 24 nt, Human
uucaucucuucucuguguggggaa

SEQ ID NO: 816187 - RNA, 22 nt, Human
uugcaggugcggugcucggagc

SEQ ID NO: 816188 - RNA, 24 nt, Human
uugcuggcuauggucagcggcugc

SEQ ID NO: 816189 - RNA, 18 nt, Human
uuucucaucugucaaagg

SEQ ID NO: 816190 - RNA, 22 nt, Human
uuuuucuuuuuugguacuguac

SEQ ID NO: 816191 - RNA, 26 nt, Human
aacagaauuaaaacucccaagggucu

SEQ ID NO: 816192 - RNA, 21 nt, Human
aagcaguggaggccccacagg

SEQ ID NO: 816193 - RNA, 24 nt, Human
aauugguugggauggcuccgggag

SEQ ID NO: 816194 - RNA, 25 nt, Human
acaguggaagagaggagggucugaa

SEQ ID NO: 816195 - RNA, 22 nt, Human
agaagggacugggucagcaagc

SEQ ID NO: 816196 - RNA, 22 nt, Human
agcaaggaaggggggugcccca

SEQ ID NO: 816197 - RNA, 19 nt, Human
agcaggaagcgccgcugcc

SEQ ID NO: 816198 - RNA, 22 nt, Human
agcaguggaggccccacagggc

SEQ ID NO: 816199 - RNA, 23 nt, Human
aggaagacagcucugugccacuu

SEQ ID NO: 816200 - RNA, 18 nt, Human
aggaggcaugaggggccg

SEQ ID NO: 816201 - RNA, 24 nt, Human
aggagguggggcuggagagggggc

SEQ ID NO: 816202 - RNA, 20 nt, Human
aggcagccccuggacagcug

SEQ ID NO: 816203 - RNA, 23 nt, Human
aggcaggaccagggugggcgggg

SEQ ID NO: 816204 - RNA, 24 nt, Human
aggccccuccaccgugggggcccc

SEQ ID NO: 816205 - RNA, 19 nt, Human
aggggcucccaaggcucag

SEQ ID NO: 816206 - RNA, 21 nt, Human
aggggggcccuggggacacag

SEQ ID NO: 816207 - RNA, 19 nt, Human
aggggguagugggggaugc

SEQ ID NO: 816208 - RNA, 21 nt, Human
agggucugaagguggugagga

SEQ ID NO: 816209 - RNA, 20 nt, Human
aggugcagguggcuggcagg

SEQ ID NO: 816210 - RNA, 22 nt, Human
aggugcagguggcuggcagggg

SEQ ID NO: 816211 - RNA, 23 nt, Human
agguggaggagguggggcuggag

SEQ ID NO: 816212 - RNA, 21 nt, Human
cacagcuuggucauguccucc

SEQ ID NO: 816213 - RNA, 18 nt, Human
cacagggcaaguacaaaa

SEQ ID NO: 816214 - RNA, 19 nt, Human
cacagggcaaguacaaaac

SEQ ID NO: 816215 - RNA, 21 nt, Human
cacagggcaaguacaaaacag

SEQ ID NO: 816216 - RNA, 20 nt, Human
cacccggggucaccggggcc

SEQ ID NO: 816217 - RNA, 25 nt, Human
caccgugggggccccucccaggggc

SEQ ID NO: 816218 - RNA, 20 nt, Human
cacucagcucuccccaauca

SEQ ID NO: 816219 - RNA, 18 nt, Human
cacuccagaccgcacuug

SEQ ID NO: 816220 - RNA, 18 nt, Human
cagauccagcuccaggua

SEQ ID NO: 816221 - RNA, 21 nt, Human
cagcacagaagggagaauugg

SEQ ID NO: 816222 - RNA, 23 nt, Human
cagcagggacagcacagaaggga

SEQ ID NO: 816223 - RNA, 23 nt, Human
cagccccuggacagcuggucaug

SEQ ID NO: 816224 - RNA, 19 nt, Human
caggugcagguggcuggca

SEQ ID NO: 816225 - RNA, 19 nt, Human
cagguggaggagguggggc

SEQ ID NO: 816226 - RNA, 22 nt, Human
caucgcugaggagguagcuccg

SEQ ID NO: 816227 - RNA, 21 nt, Human
ccagcuuagcccacaccgcgg

SEQ ID NO: 816228 - RNA, 19 nt, Human
ccaucgcugaggagguagc

SEQ ID NO: 816229 - RNA, 23 nt, Human
cccaagggucuugucuuuacaaa

SEQ ID NO: 816230 - RNA, 19 nt, Human
cccacaccgcggcccaugg

SEQ ID NO: 816231 - RNA, 23 nt, Human
cccaccccagccccacccggggu

SEQ ID NO: 816232 - RNA, 18 nt, Human
cccagccccacccggggu

SEQ ID NO: 816233 - RNA, 20 nt, Human
ccccuggacagcuggucaug

SEQ ID NO: 816234 - RNA, 19 nt, Human
ccccuugggaggaaacggg

SEQ ID NO: 816235 - RNA, 22 nt, Human
ccccuugggaggaaacgggggc

SEQ ID NO: 816236 - RNA, 24 nt, Human
ccgagccuccgguacggccccggc

SEQ ID NO: 816237 - RNA, 24 nt, Human
ccuccaccgugggggccccuccca

SEQ ID NO: 816238 - RNA, 23 nt, Human
ccugcgcagucgcggcccagagg

SEQ ID NO: 816239 - RNA, 20 nt, Human
ccuggggacacaguguggaa

SEQ ID NO: 816240 - RNA, 24 nt, Human
ccuugggaggaaacgggggcugcu

SEQ ID NO: 816241 - RNA, 18 nt, Human
ccuuggggggaaaagccc

SEQ ID NO: 816242 - RNA, 19 nt, Human
cgccgcugccgccgccgcg

SEQ ID NO: 816243 - RNA, 20 nt, Human
cgcugccgccgccgcggauc

SEQ ID NO: 816244 - RNA, 23 nt, Human
cggccccggccgguccuagcagg

SEQ ID NO: 816245 - RNA, 22 nt, Human
cggcuccgucuagggguuugag

SEQ ID NO: 816246 - RNA, 19 nt, Human
cuccucugaugcuggcccc

SEQ ID NO: 816247 - RNA, 22 nt, Human
cugagggugccugggcacgggg

SEQ ID NO: 816248 - RNA, 23 nt, Human
cugcucucauugcccccauucau

SEQ ID NO: 816249 - RNA, 18 nt, Human
gaagggagccaggacccc

SEQ ID NO: 816250 - RNA, 24 nt, Human
gacacaguguggaacauuuggggg

SEQ ID NO: 816251 - RNA, 22 nt, Human
gacacugguggcugagaggcag

SEQ ID NO: 816252 - RNA, 18 nt, Human
gagaaaaggguuggggga

SEQ ID NO: 816253 - RNA, 21 nt, Human
gaggagguggggcuggagagg

SEQ ID NO: 816254 - RNA, 24 nt, Human
gagggggcauugccccuugggagg

SEQ ID NO: 816255 - RNA, 20 nt, Human
gagggucugaagguggugag

SEQ ID NO: 816256 - RNA, 21 nt, Human
gcaaggaaggggggugcccca

SEQ ID NO: 816257 - RNA, 18 nt, Human
gcacggggccuucggccc

SEQ ID NO: 816258 - RNA, 21 nt, Human
gccaggacccccauuaagugg

SEQ ID NO: 816259 - RNA, 21 nt, Human
gcugaggagguagcuccgggu

SEQ ID NO: 816260 - RNA, 19 nt, Human
gcuggccccaccccagccc

SEQ ID NO: 816261 - RNA, 20 nt, Human
gcuggccccaccccagcccc

SEQ ID NO: 816262 - RNA, 22 nt, Human
gcugggaggggguaguggggga

SEQ ID NO: 816263 - RNA, 19 nt, Human
ggaagacagcucugugcca

SEQ ID NO: 816264 - RNA, 21 nt, Human
ggaggaggcaugaggggccgg

SEQ ID NO: 816265 - RNA, 24 nt, Human
ggaggagggucgguggagcccgag

SEQ ID NO: 816266 - RNA, 23 nt, Human
ggaggagguggggcuggagaggg

SEQ ID NO: 816267 - RNA, 24 nt, Human
ggauggcuccgggagagaaaaggg

SEQ ID NO: 816268 - RNA, 22 nt, Human
ggcaggggcucccaaggcucag

SEQ ID NO: 816269 - RNA, 21 nt, Human
ggcccccagcucugucugcuc

SEQ ID NO: 816270 - RNA, 24 nt, Human
ggcccgaggacggcuccgucuagg

SEQ ID NO: 816271 - RNA, 18 nt, Human
gggauggcuccgggagag

SEQ ID NO: 816272 - RNA, 20 nt, Human
ggggacaggagcaggggccc

SEQ ID NO: 816273 - RNA, 20 nt, Human
gggggcccuggggacacagu

SEQ ID NO: 816274 - RNA, 21 nt, Human
gggggcucgcucccucuccag

SEQ ID NO: 816275 - RNA, 25 nt, Human
gggugccccaggccccuccaccgug

SEQ ID NO: 816276 - RNA, 25 nt, Human
gguggugaggaggaggcaugagggg

SEQ ID NO: 816277 - RNA, 18 nt, Human
ggugguucugggggaagg

SEQ ID NO: 816278 - RNA, 26 nt, Human
gucucccauagaaaagcaguggaggc

SEQ ID NO: 816279 - RNA, 23 nt, Human
gugcagguggcuggcaggggcuc

SEQ ID NO: 816280 - RNA, 21 nt, Human
gugcauaguggcugaagacac

SEQ ID NO: 816281 - RNA, 18 nt, Human
gugccuuggccgcugcag

SEQ ID NO: 816282 - RNA, 22 nt, Human
guggaggagguggggcuggaga

SEQ ID NO: 816283 - RNA, 19 nt, Human
guggugaggaggaggcaug

SEQ ID NO: 816284 - RNA, 24 nt, Human
uacaaaagaaaaggcaggaggcag

SEQ ID NO: 816285 - RNA, 19 nt, Human
uacaguagggggucugcgg

SEQ ID NO: 816286 - RNA, 18 nt, Human
uagcaaucgaaauacagu

SEQ ID NO: 816287 - RNA, 23 nt, Human
uaggaggaacucgacagggaggg

SEQ ID NO: 816288 - RNA, 23 nt, Human
ucccaaggcucagcacucagcuc

SEQ ID NO: 816289 - RNA, 19 nt, Human
ucccaggggccccaggacc

SEQ ID NO: 816290 - RNA, 21 nt, Human
ucccaggggccccaggaccag

SEQ ID NO: 816291 - RNA, 21 nt, Human
ucucugcaaacauuguggggu

SEQ ID NO: 816292 - RNA, 18 nt, Human
ugaagguggugaggagga

SEQ ID NO: 816293 - RNA, 20 nt, Human
ugagcagguggucuccaugc

SEQ ID NO: 816294 - RNA, 23 nt, Human
ugcaggucccaucgcugaggagg

SEQ ID NO: 816295 - RNA, 23 nt, Human
ugccugaacaucucugcaaacau

SEQ ID NO: 816296 - RNA, 23 nt, Human
ugcuggccccaccccagccccac

SEQ ID NO: 816297 - RNA, 21 nt, Human
uggaagagaggagggucugaa

SEQ ID NO: 816298 - RNA, 19 nt, Human
uggagagggggcauugccc

SEQ ID NO: 816299 - RNA, 20 nt, Human
uggagcccgagccuccggua

SEQ ID NO: 816300 - RNA, 20 nt, Human
uggaggagguggggcuggag

SEQ ID NO: 816301 - RNA, 20 nt, Human
uggcaggggcucccaaggcu

SEQ ID NO: 816302 - RNA, 23 nt, Human
uggccacagggcccccagcucug

SEQ ID NO: 816303 - RNA, 22 nt, Human
uggcugaagacacugguggcug

SEQ ID NO: 816304 - RNA, 18 nt, Human
ugggaagggccaggggug

SEQ ID NO: 816305 - RNA, 19 nt, Human
ugggaagggccaggggugg

SEQ ID NO: 816306 - RNA, 18 nt, Human
ugggaggagggucggugg

SEQ ID NO: 816307 - RNA, 23 nt, Human
ugggaggggguagugggggaugc

SEQ ID NO: 816308 - RNA, 26 nt, Human
uggggcuggagagggggcauugcccc

SEQ ID NO: 816309 - RNA, 20 nt, Human
ugggggccccucccaggggc

SEQ ID NO: 816310 - RNA, 25 nt, Human
uggggggaaaagccccccagggccu

SEQ ID NO: 816311 - RNA, 23 nt, Human
ugggucagcaagccuugggggga

SEQ ID NO: 816312 - RNA, 20 nt, Human
uggugaggaggaggcaugaa

SEQ ID NO: 816313 - RNA, 24 nt, Human
ugguugcacagcuuggucaugucc

SEQ ID NO: 816314 - RNA, 21 nt, Human
uucggcccuguaaagugcugg

SEQ ID NO: 816315 - RNA, 21 nt, Human
uugggggacaggagcaggggc

SEQ ID NO: 816316 - RNA, 20 nt, Human
uuuacaaaagaaaaggcagg

SEQ ID NO: 816317 - RNA, 21 nt, Human
aaaaaaugugaugaugccuau

SEQ ID NO: 816318 - RNA, 23 nt, Human
aaaagcaccaugaccgaggacac

SEQ ID NO: 816319 - RNA, 23 nt, Human
aaacccagaagcuuguuguaaga

SEQ ID NO: 816320 - RNA, 21 nt, Human
aagcaccaugaccgaggacac

SEQ ID NO: 816321 - RNA, 22 nt, Human
aagccagcgucauucuuucagg

SEQ ID NO: 816322 - RNA, 24 nt, Human
aagccagcgucauucuuucaggug

SEQ ID NO: 816323 - RNA, 23 nt, Human
aaguauauuguguggaaauaucu

SEQ ID NO: 816324 - RNA, 23 nt, Human
aaucaugauuacuauuuaauuua

SEQ ID NO: 816325 - RNA, 20 nt, Human
acagcuuccacuguggucag

SEQ ID NO: 816326 - RNA, 22 nt, Human
accagccgcccccagccgacag

SEQ ID NO: 816327 - RNA, 18 nt, Human
accccuggccagguuccu

SEQ ID NO: 816328 - RNA, 24 nt, Human
acugaaaauuuaaaauauaaaaca

SEQ ID NO: 816329 - RNA, 22 nt, Human
agaccgugcaggaggaguuugg

SEQ ID NO: 816330 - RNA, 20 nt, Human
agcaccaugaccgaggacac

SEQ ID NO: 816331 - RNA, 21 nt, Human
agcuggauauagugauaagcc

SEQ ID NO: 816332 - RNA, 23 nt, Human
aggaggaguuugguagcaaugga

SEQ ID NO: 816333 - RNA, 24 nt, Human
auccaugaguuauuccacucugca

SEQ ID NO: 816334 - RNA, 22 nt, Human
auguguguuaguguguguaugu

SEQ ID NO: 816335 - RNA, 22 nt, Human
auuauggccacagcccugcuuu

SEQ ID NO: 816336 - RNA, 21 nt, Human
caaaccagcggaagcugaaca

SEQ ID NO: 816337 - RNA, 22 nt, Human
caaauccugaaauguguagaaa

SEQ ID NO: 816338 - RNA, 19 nt, Human
caacgaaaagcaccaugac

SEQ ID NO: 816339 - RNA, 23 nt, Human
caacuugcaaaguagggugaucu

SEQ ID NO: 816340 - RNA, 22 nt, Human
cacagcccugcugucaccccuu

SEQ ID NO: 816341 - RNA, 18 nt, Human
caccaugaccgaggacac

SEQ ID NO: 816342 - RNA, 21 nt, Human
caccaugaccgaggacacuga

SEQ ID NO: 816343 - RNA, 24 nt, Human
caccccuggccagguuccuggggg

SEQ ID NO: 816344 - RNA, 24 nt, Human
caccgacagagagccgagcaccac

SEQ ID NO: 816345 - RNA, 20 nt, Human
cacggcucacugcccugcuc

SEQ ID NO: 816346 - RNA, 22 nt, Human
cacucugucggcuucgaauacc

SEQ ID NO: 816347 - RNA, 22 nt, Human
cacuuugaccuuggauuggggg

SEQ ID NO: 816348 - RNA, 19 nt, Human
cagcuggaggcagcagcgg

SEQ ID NO: 816349 - RNA, 19 nt, Human
caggagccagaugcagaag

SEQ ID NO: 816350 - RNA, 19 nt, Human
caucaagacacccuaauga

SEQ ID NO: 816351 - RNA, 21 nt, Human
cauuauggccacagcccugcu

SEQ ID NO: 816352 - RNA, 24 nt, Human
cauucuuucagguggagucagaga

SEQ ID NO: 816353 - RNA, 24 nt, Human
cauuggccagucuugacaagcccu

SEQ ID NO: 816354 - RNA, 19 nt, Human
ccaacuugcaaaguagggu

SEQ ID NO: 816355 - RNA, 18 nt, Human
ccaccgccgaccaccguc

SEQ ID NO: 816356 - RNA, 18 nt, Human
ccaccgccgaccaccguc

SEQ ID NO: 816357 - RNA, 24 nt, Human
ccaccgccgaccaccgucuugcaa

SEQ ID NO: 816358 - RNA, 25 nt, Human
ccaccgccgaccaccgucuugccgc

SEQ ID NO: 816359 - RNA, 22 nt, Human
ccacuccaucaaugcuaacaca

SEQ ID NO: 816360 - RNA, 25 nt, Human
ccagcccauuccucuggcucgcgcc

SEQ ID NO: 816361 - RNA, 22 nt, Human
ccaguaaaaccuccaucuguca

SEQ ID NO: 816362 - RNA, 20 nt, Human
cccaagaccgugcaggagga

SEQ ID NO: 816363 - RNA, 18 nt, Human
ccccacucugucggcuuc

SEQ ID NO: 816364 - RNA, 24 nt, Human
ccccacuuccucuuuguguaccug

SEQ ID NO: 816365 - RNA, 21 nt, Human
ccccagccgacaggaucaaau

SEQ ID NO: 816366 - RNA, 21 nt, Human
ccccgcugcuguugcugccgc

SEQ ID NO: 816367 - RNA, 21 nt, Human
cccugcugucaccccuucauc

SEQ ID NO: 816368 - RNA, 24 nt, Human
ccgagcaccacgaagaagagcgug

SEQ ID NO: 816369 - RNA, 20 nt, Human
ccgcccccagccgacaggau

SEQ ID NO: 816370 - RNA, 26 nt, Human
ccuauggucacacagagccacucauu

SEQ ID NO: 816371 - RNA, 24 nt, Human
ccuauggucacacagagccggggc

SEQ ID NO: 816372 - RNA, 25 nt, Human
ccuuggauuggggggaggaaaaguc

SEQ ID NO: 816373 - RNA, 24 nt, Human
cgaaaagcaccaugaccgaggaca

SEQ ID NO: 816374 - RNA, 24 nt, Human
cgcugcuguugcugccgcuguugg

SEQ ID NO: 816375 - RNA, 21 nt, Human
cuccaggcugcgggcagcugg

SEQ ID NO: 816376 - RNA, 19 nt, Human
cucgcgccgcacugccguu

SEQ ID NO: 816377 - RNA, 22 nt, Human
cugauagcaccccuggccaggu

SEQ ID NO: 816378 - RNA, 22 nt, Human
cugugcuugccacuggcccggg

SEQ ID NO: 816379 - RNA, 22 nt, Human
cuucacggcucacugcccugcu

SEQ ID NO: 816380 - RNA, 18 nt, Human
cuugcuguacggagguau

SEQ ID NO: 816381 - RNA, 20 nt, Human
gacugguguaacuuaugugu

SEQ ID NO: 816382 - RNA, 19 nt, Human
gagccgagcaccacgaaga

SEQ ID NO: 816383 - RNA, 22 nt, Human
gaggaaaagucuguacacagug

SEQ ID NO: 816384 - RNA, 21 nt, Human
gcacggagucuuccagaguca

SEQ ID NO: 816385 - RNA, 19 nt, Human
gcagcagcggccguggcgc

SEQ ID NO: 816386 - RNA, 19 nt, Human
gccccgcugcuguugcugc

SEQ ID NO: 816387 - RNA, 23 nt, Human
gccuauggucacacagagccacu

SEQ ID NO: 816388 - RNA, 27 nt, Human
gccuuuuuccccacuuccucuuugugu

SEQ ID NO: 816389 - RNA, 23 nt, Human
ggaaaagucuguacacaguggag

SEQ ID NO: 816390 - RNA, 21 nt, Human
ggacgagccucgccuuccccg

SEQ ID NO: 816391 - RNA, 21 nt, Human
ggagucuuccagagucagcau

SEQ ID NO: 816392 - RNA, 24 nt, Human
ggauguuucccucuuucuuuguuu

SEQ ID NO: 816393 - RNA, 22 nt, Human
guccugugguuggaugguguuu

SEQ ID NO: 816394 - RNA, 20 nt, Human
uaaaaaaugugaugaugccu

SEQ ID NO: 816395 - RNA, 21 nt, Human
uaagcugauucucucuucacc

SEQ ID NO: 816396 - RNA, 21 nt, Human
uacuauuuaauuuacaucaug

SEQ ID NO: 816397 - RNA, 21 nt, Human
uaguaguacccucuggugggu

SEQ ID NO: 816398 - RNA, 18 nt, Human
uagugauaagcccucucu

SEQ ID NO: 816399 - RNA, 21 nt, Human
uagugauaagcccucucucag

SEQ ID NO: 816400 - RNA, 22 nt, Human
uauagugauaagcccucucuca

SEQ ID NO: 816401 - RNA, 23 nt, Human
uauggaaagaucaguuaacgcca

SEQ ID NO: 816402 - RNA, 24 nt, Human
uauggaaagaucaguuaacgccag

SEQ ID NO: 816403 - RNA, 20 nt, Human
uauguguguuagugugugua

SEQ ID NO: 816404 - RNA, 21 nt, Human
uauguguguuaguguguguau

SEQ ID NO: 816405 - RNA, 24 nt, Human
uauuccacucugcaccaacuauaa

SEQ ID NO: 816406 - RNA, 24 nt, Human
ucauuuacaucuuugauuuccugg

SEQ ID NO: 816407 - RNA, 22 nt, Human
ucccaaagccucuaaaagacac

SEQ ID NO: 816408 - RNA, 21 nt, Human
uccucggugcugaaaucgugc

SEQ ID NO: 816409 - RNA, 24 nt, Human
uccucuggcucgcgccgcacugcc

SEQ ID NO: 816410 - RNA, 19 nt, Human
uccugaaauguguagaaaa

SEQ ID NO: 816411 - RNA, 22 nt, Human
uccuuggucuuguugaaagccg

SEQ ID NO: 816412 - RNA, 23 nt, Human
uccuuggucuuguugaaagccgu

SEQ ID NO: 816413 - RNA, 21 nt, Human
ucucauuuugccuuuuucccc

SEQ ID NO: 816414 - RNA, 24 nt, Human
ucuggcucgcgccgcacugccguu

SEQ ID NO: 816415 - RNA, 19 nt, Human
ugaaagccguacaugggcu

SEQ ID NO: 816416 - RNA, 21 nt, Human
ugaaagccguacaugggcugc

SEQ ID NO: 816417 - RNA, 21 nt, Human
ugaaccacuccaucaaugcua

SEQ ID NO: 816418 - RNA, 18 nt, Human
ugaagugucauuauggcc

SEQ ID NO: 816419 - RNA, 21 nt, Human
ugaccuuggauuggggggagg

SEQ ID NO: 816420 - RNA, 20 nt, Human
ugagaaaaugguuucuuuuc

SEQ ID NO: 816421 - RNA, 19 nt, Human
ugcaacgaaaagcaccaug

SEQ ID NO: 816422 - RNA, 21 nt, Human
ugcaacgaaaagcaccaugac

SEQ ID NO: 816423 - RNA, 20 nt, Human
ugcaagauguggaugaguga

SEQ ID NO: 816424 - RNA, 23 nt, Human
ugcaccgacagagagccgagcac

SEQ ID NO: 816425 - RNA, 24 nt, Human
ugcgggcagcuggaggcagcagcg

SEQ ID NO: 816426 - RNA, 25 nt, Human
uggaaacagauccgguuccagccca

SEQ ID NO: 816427 - RNA, 21 nt, Human
uggaggcagcagcggccgugg

SEQ ID NO: 816428 - RNA, 19 nt, Human
uggagucagagacucucgg

SEQ ID NO: 816429 - RNA, 19 nt, Human
uggauggaugaaaguaauc

SEQ ID NO: 816430 - RNA, 21 nt, Human
uggauuggggggaggaaaagu

SEQ ID NO: 816431 - RNA, 20 nt, Human
uggcacggagucuuccagag

SEQ ID NO: 816432 - RNA, 18 nt, Human
uggccagguuccuggggg

SEQ ID NO: 816433 - RNA, 22 nt, Human
ugggggcaccaacuugcaaagu

SEQ ID NO: 816434 - RNA, 25 nt, Human
ugggugcacccaagaccgugcagga

SEQ ID NO: 816435 - RNA, 20 nt, Human
uguaagagugcgacuuuaca

SEQ ID NO: 816436 - RNA, 24 nt, Human
ugucccaaagccucuaaaagacac

SEQ ID NO: 816437 - RNA, 18 nt, Human
uguguguauguguguaug

SEQ ID NO: 816438 - RNA, 22 nt, Human
uguguuaguguguguaugugug

SEQ ID NO: 816439 - RNA, 24 nt, Human
uuccccggcugcagacccaccgcc

SEQ ID NO: 816440 - RNA, 20 nt, Human
uucuuuguuuuuauauuccu

SEQ ID NO: 816441 - RNA, 19 nt, Human
uugccacuggcccggguag

SEQ ID NO: 816442 - RNA, 23 nt, Human
uugcugccgcuguuggccgcggc

SEQ ID NO: 816443 - RNA, 19 nt, Human
uuggaaggagaccagccgc

SEQ ID NO: 816444 - RNA, 23 nt, Human
uuggccgcggcgauguugcucuu

SEQ ID NO: 816445 - RNA, 21 nt, Human
uuguggguccugcaacuccuu

SEQ ID NO: 816446 - RNA, 20 nt, Human
uuguuuggggcuuccacguc

SEQ ID NO: 816447 - RNA, 19 nt, Human
uuuacuugcuguacggagg

SEQ ID NO: 816448 - RNA, 20 nt, Human
uuuccaguaaaaccuccauc

SEQ ID NO: 816449 - RNA, 20 nt, Human
uuuuauauuccugugggaau

SEQ ID NO: 816450 - RNA, 19 nt, Human
uuuuuugacagaggacugg

SEQ ID NO: 816451 - RNA, 23 nt, Human
aaccccucggaggccuguggcac

SEQ ID NO: 816452 - RNA, 21 nt, Human
aagagcuucugugagcccagc

SEQ ID NO: 816453 - RNA, 18 nt, Human
acaguggggcgucagggc

SEQ ID NO: 816454 - RNA, 20 nt, Human
acauucagagacgugcccac

SEQ ID NO: 816455 - RNA, 27 nt, Human
accacaacgcaccagucuagacaucuu

SEQ ID NO: 816456 - RNA, 19 nt, Human
accuuccugagacccucug

SEQ ID NO: 816457 - RNA, 20 nt, Human
acgggacacugaguggucac

SEQ ID NO: 816458 - RNA, 21 nt, Human
acucgcgggucucacacaccg

SEQ ID NO: 816459 - RNA, 18 nt, Human
agcugucuuuggccucuc

SEQ ID NO: 816460 - RNA, 20 nt, Human
aggcccccguggucgcccag

SEQ ID NO: 816461 - RNA, 20 nt, Human
aggcgggugggagauaggaa

SEQ ID NO: 816462 - RNA, 18 nt, Human
agggggugggaggugagg

SEQ ID NO: 816463 - RNA, 18 nt, Human
agggggugggaggugagg

SEQ ID NO: 816464 - RNA, 23 nt, Human
agucuagacaucucaggagccug

SEQ ID NO: 816465 - RNA, 19 nt, Human
caagagacgccccggccac

SEQ ID NO: 816466 - RNA, 20 nt, Human
cacccacuugaagcuucugc

SEQ ID NO: 816467 - RNA, 19 nt, Human
cagcacaggggggacaagg

SEQ ID NO: 816468 - RNA, 19 nt, Human
cagcugugaccuccagacc

SEQ ID NO: 816469 - RNA, 19 nt, Human
caggagccugccccagcuc

SEQ ID NO: 816470 - RNA, 25 nt, Human
cagggcccaagagcuucugugagcc

SEQ ID NO: 816471 - RNA, 20 nt, Human
cagggggugggaggugaggg

SEQ ID NO: 816472 - RNA, 19 nt, Human
cccaauacccaagaacacc

SEQ ID NO: 816473 - RNA, 25 nt, Human
cccgccgccgccgccgccgccgccc

SEQ ID NO: 816474 - RNA, 22 nt, Human
cccuagaggcugcacaaccccu

SEQ ID NO: 816475 - RNA, 18 nt, Human
ccgccgccgccgccgccg

SEQ ID NO: 816476 - RNA, 18 nt, Human
ccgccgccgccgccgccg

SEQ ID NO: 816477 - RNA, 23 nt, Human
ccgccgccgccgccgccgcccga

SEQ ID NO: 816478 - RNA, 24 nt, Human
ccgccgccgccgccgccgccgccc

SEQ ID NO: 816479 - RNA, 28 nt, Human
ccucaugaccacgccugcacccaaggcu

SEQ ID NO: 816480 - RNA, 22 nt, Human
ccuccagaccuuccugagaccc

SEQ ID NO: 816481 - RNA, 21 nt, Human
ccucuggccuuucugugacuc

SEQ ID NO: 816482 - RNA, 21 nt, Human
ccuguccccaauacccaagaa

SEQ ID NO: 816483 - RNA, 19 nt, Human
cgccgccgccgccgccgcc

SEQ ID NO: 816484 - RNA, 25 nt, Human
cggccucggcugccuccggccgggc

SEQ ID NO: 816485 - RNA, 23 nt, Human
cgggaggacccgcagacucggcg

SEQ ID NO: 816486 - RNA, 23 nt, Human
cggggccagccacugcguggaga

SEQ ID NO: 816487 - RNA, 21 nt, Human
cucaaaccugugacucagugg

SEQ ID NO: 816488 - RNA, 27 nt, Human
cucaugaccacgccugcacccaaggcu

SEQ ID NO: 816489 - RNA, 23 nt, Human
cugcacccaaggcugcugucugg

SEQ ID NO: 816490 - RNA, 20 nt, Human
cugcggcuggaggggugggg

SEQ ID NO: 816491 - RNA, 22 nt, Human
gacuuguaugcagucucucccu

SEQ ID NO: 816492 - RNA, 19 nt, Human
gaggcugcacaaccccucg

SEQ ID NO: 816493 - RNA, 25 nt, Human
gaguagagcugagggcugugagggg

SEQ ID NO: 816494 - RNA, 22 nt, Human
gcccuagaggcugcacaacccc

SEQ ID NO: 816495 - RNA, 21 nt, Human
gccgccgcccgagcggccucg

SEQ ID NO: 816496 - RNA, 18 nt, Human
gccgcugcuccggcuccu

SEQ ID NO: 816497 - RNA, 24 nt, Human
gccucggcugccuccggccgggcu

SEQ ID NO: 816498 - RNA, 20 nt, Human
gcucccgccgccgccgccgc

SEQ ID NO: 816499 - RNA, 21 nt, Human
gcugccuccggccgggcuggc

SEQ ID NO: 816500 - RNA, 21 nt, Human
ggacaaggggcuggagagggu

SEQ ID NO: 816501 - RNA, 22 nt, Human
ggagauaggaacuggggaagga

SEQ ID NO: 816502 - RNA, 18 nt, Human
ggcuggaaccaggcgggu

SEQ ID NO: 816503 - RNA, 18 nt, Human
ggcugugaggggacagug

SEQ ID NO: 816504 - RNA, 23 nt, Human
gggacaguggggcgucagggaag

SEQ ID NO: 816505 - RNA, 19 nt, Human
gggcccaagagcuucugug

SEQ ID NO: 816506 - RNA, 19 nt, Human
gggcuggaaccaggcgggu

SEQ ID NO: 816507 - RNA, 22 nt, Human
gggcuggaaccaggcggguggg

SEQ ID NO: 816508 - RNA, 25 nt, Human
gggcuggaaccaggcgggugggaga

SEQ ID NO: 816509 - RNA, 19 nt, Human
ggggcuggaaagacgggga

SEQ ID NO: 816510 - RNA, 23 nt, Human
gggggugggaggugagggugcug

SEQ ID NO: 816511 - RNA, 21 nt, Human
ggggugggaggugagggugcu

SEQ ID NO: 816512 - RNA, 18 nt, Human
ggguucguggccucgugg

SEQ ID NO: 816513 - RNA, 22 nt, Human
gguggccuuuaaaagacaacug

SEQ ID NO: 816514 - RNA, 21 nt, Human
gugcccacucgcgggucucac

SEQ ID NO: 816515 - RNA, 19 nt, Human
uagaagggguucuucugua

SEQ ID NO: 816516 - RNA, 18 nt, Human
uagccaaaaacugcggcu

SEQ ID NO: 816517 - RNA, 21 nt, Human
ucacccaggaugccagggccc

SEQ ID NO: 816518 - RNA, 21 nt, Human
ucagugggagaggggaugggg

SEQ ID NO: 816519 - RNA, 23 nt, Human
uccccaauacccaagaacaccgg

SEQ ID NO: 816520 - RNA, 21 nt, Human
ucccgccgccgccgccgccgc

SEQ ID NO: 816521 - RNA, 24 nt, Human
ucccgccgccgccgccgccgccgg

SEQ ID NO: 816522 - RNA, 21 nt, Human
ucccuguucuggggaucuggc

SEQ ID NO: 816523 - RNA, 21 nt, Human
ucucacacaccgauccucacc

SEQ ID NO: 816524 - RNA, 18 nt, Human
ucuggccuuucugugacu

SEQ ID NO: 816525 - RNA, 18 nt, Human
ugaccuccagaccuuccu

SEQ ID NO: 816526 - RNA, 21 nt, Human
ugagcccccaggguacuuccu

SEQ ID NO: 816527 - RNA, 19 nt, Human
ugaggggacaguggggcgu

SEQ ID NO: 816528 - RNA, 21 nt, Human
ugccccagcucucagggggug

SEQ ID NO: 816529 - RNA, 26 nt, Human
ugccccagcucucagggggugggagg

SEQ ID NO: 816530 - RNA, 20 nt, Human
ugggagaggggauggggcug

SEQ ID NO: 816531 - RNA, 21 nt, Human
ugggagaggggauggggcugg

SEQ ID NO: 816532 - RNA, 23 nt, Human
ugggagauaggaacuggggaagg

SEQ ID NO: 816533 - RNA, 22 nt, Human
uggggaaggaccaccaacagca

SEQ ID NO: 816534 - RNA, 23 nt, Human
uguccccaauacccaagaacacc

SEQ ID NO: 816535 - RNA, 19 nt, Human
ugugacucucucucagcug

SEQ ID NO: 816536 - RNA, 24 nt, Human
uuaaaagacaacugugguuauaga

SEQ ID NO: 816537 - RNA, 23 nt, Human
uugaagcuucugccacucagacu

SEQ ID NO: 816538 - RNA, 18 nt, Human
uuuguagccaaaaacugc

SEQ ID NO: 816539 - RNA, 20 nt, Human
aaaaagcaaauaaacuguga

SEQ ID NO: 816540 - RNA, 20 nt, Human
aaacaagaauaaauaacuga

SEQ ID NO: 816541 - RNA, 19 nt, Human
aaacaagaucuuaaaugua

SEQ ID NO: 816542 - RNA, 19 nt, Human
aaagcacagaaauacugau

SEQ ID NO: 816543 - RNA, 23 nt, Human
aaauacauaucuuaauuugacaa

SEQ ID NO: 816544 - RNA, 24 nt, Human
aacuugguguuuaacaauaaaggu

SEQ ID NO: 816545 - RNA, 25 nt, Human
aagaagagcaauaugaugcuaaaga

SEQ ID NO: 816546 - RNA, 18 nt, Human
aagcacagaaauacugau

SEQ ID NO: 816547 - RNA, 26 nt, Human
aauaaauaggaaaaaaccauauugaa

SEQ ID NO: 816548 - RNA, 20 nt, Human
aaucuccuuuuuaaaaaaag

SEQ ID NO: 816549 - RNA, 20 nt, Human
agagugcagccaaauuucug

SEQ ID NO: 816550 - RNA, 24 nt, Human
aggaaauguagauauaaauagagu

SEQ ID NO: 816551 - RNA, 23 nt, Human
augcuaaagaaauagaaagauuc

SEQ ID NO: 816552 - RNA, 24 nt, Human
caaaaagucaagacuguucacaga

SEQ ID NO: 816553 - RNA, 28 nt, Human
caaaauaaugcuaaauuugaagacucag

SEQ ID NO: 816554 - RNA, 19 nt, Human
cacagaguuauccauauuu

SEQ ID NO: 816555 - RNA, 25 nt, Human
cagugaacuaaaugugcacuguuuu

SEQ ID NO: 816556 - RNA, 23 nt, Human
cuaaagaaauagaaagauucaaa

SEQ ID NO: 816557 - RNA, 23 nt, Human
cugcaaaauaauaauuuuucuag

SEQ ID NO: 816558 - RNA, 20 nt, Human
gcaaggguuucucuuaggca

SEQ ID NO: 816559 - RNA, 24 nt, Human
gguuuuugggugaggaaacauacu

SEQ ID NO: 816560 - RNA, 22 nt, Human
gucaagacuguucacagaguua

SEQ ID NO: 816561 - RNA, 20 nt, Human
gugugucgauuuccaagcuu

SEQ ID NO: 816562 - RNA, 18 nt, Human
guugagaaaauuguauga

SEQ ID NO: 816563 - RNA, 26 nt, Human
uaaaaaaagcaaauaaacugugagua

SEQ ID NO: 816564 - RNA, 21 nt, Human
uaaaaaugcuggcauuacugu

SEQ ID NO: 816565 - RNA, 22 nt, Human
uaaaacagcuauaaaaggaaga

SEQ ID NO: 816566 - RNA, 20 nt, Human
uaaagaaaacaaugccucau

SEQ ID NO: 816567 - RNA, 22 nt, Human
uaaagaaauagaaagauucaaa

SEQ ID NO: 816568 - RNA, 23 nt, Human
uaaagagaagucagugaucuauu

SEQ ID NO: 816569 - RNA, 22 nt, Human
uaaauaaaaaugcuggcauuac

SEQ ID NO: 816570 - RNA, 20 nt, Human
uaaauaaagaaaacaaugcc

SEQ ID NO: 816571 - RNA, 24 nt, Human
uaacaagaaugaauggcagauaga

SEQ ID NO: 816572 - RNA, 20 nt, Human
uagcacaaugaacuugcccu

SEQ ID NO: 816573 - RNA, 21 nt, Human
uaggaaaaaaccauauugaag

SEQ ID NO: 816574 - RNA, 28 nt, Human
uccaguuuaugaaaaaacacucuucugu

SEQ ID NO: 816575 - RNA, 21 nt, Human
ucccaggugcaaggguuucuc

SEQ ID NO: 816576 - RNA, 19 nt, Human
ucucagauaacugcaaaau

SEQ ID NO: 816577 - RNA, 24 nt, Human
ucugaagaaggcaaagguugccuc

SEQ ID NO: 816578 - RNA, 25 nt, Human
ucugaagaaggcaaagguugccucg

SEQ ID NO: 816579 - RNA, 18 nt, Human
ugaaguaaaacagcuaua

SEQ ID NO: 816580 - RNA, 25 nt, Human
ugacaaccagucuaaaagaagaaga

SEQ ID NO: 816581 - RNA, 20 nt, Human
ugacaaugaaagaaaccucu

SEQ ID NO: 816582 - RNA, 19 nt, Human
ugaggaaacauacugaagc

SEQ ID NO: 816583 - RNA, 21 nt, Human
ugcaaggguuucucuuaggca

SEQ ID NO: 816584 - RNA, 22 nt, Human
uggaaggaaauguagauauaaa

SEQ ID NO: 816585 - RNA, 20 nt, Human
uguuauugcagucauuugaa

SEQ ID NO: 816586 - RNA, 18 nt, Human
uuaaaacugcauccugcc

SEQ ID NO: 816587 - RNA, 21 nt, Human
uuaaaagugucaaaauaaugc

SEQ ID NO: 816588 - RNA, 22 nt, Human
uuaaauaaaaaugcuggcauua

SEQ ID NO: 816589 - RNA, 23 nt, Human
uugcacugaaaauuuacaucaua

SEQ ID NO: 816590 - RNA, 22 nt, Human
uuuaacaagaaugaauggcaga

SEQ ID NO: 816591 - RNA, 22 nt, Human
uuuccaagcuucugaagaaggc

SEQ ID NO: 816592 - RNA, 31 nt, Human
uuuuacaaaguuucuuuucauaaaaauauaa

SEQ ID NO: 816593 - RNA, 24 nt, Human
aagccagacccagagaccaggaga

SEQ ID NO: 816594 - RNA, 21 nt, Human
acccagagaccaggagaggga

SEQ ID NO: 816595 - RNA, 21 nt, Human
cacagccagagccuggaagcc

SEQ ID NO: 816596 - RNA, 20 nt, Human
cagcacccagaggcugaaga

SEQ ID NO: 816597 - RNA, 20 nt, Human
ccccugaggccagaucauuc

SEQ ID NO: 816598 - RNA, 23 nt, Human
ccucacuggccagcacccagagg

SEQ ID NO: 816599 - RNA, 19 nt, Human
ccugaggucagggccaagg

SEQ ID NO: 816600 - RNA, 23 nt, Human
ccugaggucagggccaaggucag

SEQ ID NO: 816601 - RNA, 23 nt, Human
cgucugguccuccuaccagcuca

SEQ ID NO: 816602 - RNA, 20 nt, Human
cucacuggccagcacccaga

SEQ ID NO: 816603 - RNA, 23 nt, Human
cucccuuaagcccugggucauuu

SEQ ID NO: 816604 - RNA, 20 nt, Human
cuccugaccagguggccugu

SEQ ID NO: 816605 - RNA, 19 nt, Human
gagaaaaagugcaggaaaa

SEQ ID NO: 816606 - RNA, 23 nt, Human
ucagggccaaggucagcguggga

SEQ ID NO: 816607 - RNA, 22 nt, Human
uccacagccagagccuggaagc

SEQ ID NO: 816608 - RNA, 21 nt, Human
uccugaggucagggccaaggu

SEQ ID NO: 816609 - RNA, 18 nt, Human
ugaggccagaucauucuc

SEQ ID NO: 816610 - RNA, 18 nt, Human
uggccuguccccugaggc

SEQ ID NO: 816611 - RNA, 23 nt, Human
uggcuccugaggucagggccucc

SEQ ID NO: 816612 - RNA, 23 nt, Human
uggaaauguacauguaugaugac

SEQ ID NO: 816613 - RNA, 24 nt, Human
uuuucagcugcacaugguggaaau

SEQ ID NO: 816614 - RNA, 18 nt, Human
aaagcaagacaaggaagc

SEQ ID NO: 816615 - RNA, 23 nt, Human
aaagcaagacaaggaagcaugga

SEQ ID NO: 816616 - RNA, 23 nt, Human
aaaguggaaaaacuuuuauuaga

SEQ ID NO: 816617 - RNA, 22 nt, Human
aaaugauuuuaaauaagacauc

SEQ ID NO: 816618 - RNA, 21 nt, Human
aacauuuuucuuuuucuuggg

SEQ ID NO: 816619 - RNA, 23 nt, Human
aacccaaaaacuagucuaaaaaa

SEQ ID NO: 816620 - RNA, 19 nt, Human
aacucccuauuuccucauu

SEQ ID NO: 816621 - RNA, 19 nt, Human
aacugccaaggaaaaaaga

SEQ ID NO: 816622 - RNA, 22 nt, Human
aagacagugcugauuagaaaaa

SEQ ID NO: 816623 - RNA, 20 nt, Human
aagauugacauaaccuuuaa

SEQ ID NO: 816624 - RNA, 19 nt, Human
aagugugugugugugugug

SEQ ID NO: 816625 - RNA, 19 nt, Human
acaaaaaaagguuacauga

SEQ ID NO: 816626 - RNA, 23 nt, Human
acagaacccgcaguagcuucgcu

SEQ ID NO: 816627 - RNA, 19 nt, Human
acccgcaguagcuucgcuc

SEQ ID NO: 816628 - RNA, 22 nt, Human
agaacccgcaguagcuucgcuc

SEQ ID NO: 816629 - RNA, 20 nt, Human
agacaaagcaaacccaaaaa

SEQ ID NO: 816630 - RNA, 28 nt, Human
agaguaaccaaggugaaaaaucugggua

SEQ ID NO: 816631 - RNA, 19 nt, Human
aggaaaaaagaaaaacuca

SEQ ID NO: 816632 - RNA, 19 nt, Human
aggucagaguaaccaaggu

SEQ ID NO: 816633 - RNA, 25 nt, Human
aguacaacuaaauuauuuuuuagcu

SEQ ID NO: 816634 - RNA, 21 nt, Human
aguggaaaaacuuuuauuaga

SEQ ID NO: 816635 - RNA, 19 nt, Human
auaaagcaagacaaggaag

SEQ ID NO: 816636 - RNA, 25 nt, Human
auaaagcaagacaaggaagcaugga

SEQ ID NO: 816637 - RNA, 22 nt, Human
auguuuuccuccuguucaugau

SEQ ID NO: 816638 - RNA, 22 nt, Human
caaagaaugcucuaaagaccca

SEQ ID NO: 816639 - RNA, 18 nt, Human
caaagcaaacccaaaaac

SEQ ID NO: 816640 - RNA, 23 nt, Human
caaagcaaacccaaaaacuaguc

SEQ ID NO: 816641 - RNA, 24 nt, Human
caaagcaaacccaaaaacuagucu

SEQ ID NO: 816642 - RNA, 21 nt, Human
caagacaaggaagcauggagc

SEQ ID NO: 816643 - RNA, 21 nt, Human
cagcgcaggcaccggccucuc

SEQ ID NO: 816644 - RNA, 22 nt, Human
cauggaacacaauauaccuuaa

SEQ ID NO: 816645 - RNA, 24 nt, Human
ccaacagucagagcuauguuuucc

SEQ ID NO: 816646 - RNA, 24 nt, Human
ccacaauaaaagucauacauauug

SEQ ID NO: 816647 - RNA, 18 nt, Human
cuacugagcagggcugca

SEQ ID NO: 816648 - RNA, 20 nt, Human
cuagucuaaaaaagaauucc

SEQ ID NO: 816649 - RNA, 21 nt, Human
cugccugcgcgcucccgaacu

SEQ ID NO: 816650 - RNA, 19 nt, Human
cugcuucgccccacgaugc

SEQ ID NO: 816651 - RNA, 21 nt, Human
cuguaagacaaaaagaucguu

SEQ ID NO: 816652 - RNA, 21 nt, Human
gaacugccaauucuagguuca

SEQ ID NO: 816653 - RNA, 24 nt, Human
gcacugagucuuuucaugcccagu

SEQ ID NO: 816654 - RNA, 19 nt, Human
gucauuuuucacuaaauga

SEQ ID NO: 816655 - RNA, 30 nt, Human
gugcgaaagugugugugugugugugugugg

SEQ ID NO: 816656 - RNA, 19 nt, Human
guggugaagaauuccacaa

SEQ ID NO: 816657 - RNA, 21 nt, Human
gugugugugugugccugcgug

SEQ ID NO: 816658 - RNA, 21 nt, Human
gugugugugugugugugugag

SEQ ID NO: 816659 - RNA, 20 nt, Human
gugugugugugugugugugu

SEQ ID NO: 816660 - RNA, 21 nt, Human
gugugugugugugugugugug

SEQ ID NO: 816661 - RNA, 21 nt, Human
gugugugugugugugugugug

SEQ ID NO: 816662 - RNA, 25 nt, Human
guucucagccuuagaagugugcaga

SEQ ID NO: 816663 - RNA, 22 nt, Human
guuugugugugcgaaagugugu

SEQ ID NO: 816664 - RNA, 24 nt, Human
uaaaagagauaguaauaaaauaug

SEQ ID NO: 816665 - RNA, 22 nt, Human
uaaaauaccuuauaauuucagu

SEQ ID NO: 816666 - RNA, 20 nt, Human
uaaacugccaaggaaaaaag

SEQ ID NO: 816667 - RNA, 23 nt, Human
uaaucucccuguucaauuacaag

SEQ ID NO: 816668 - RNA, 21 nt, Human
uaccauaauuaguacaacuaa

SEQ ID NO: 816669 - RNA, 20 nt, Human
uaccuuauaauuucaguaac

SEQ ID NO: 816670 - RNA, 20 nt, Human
uagaaaaaguguacaaagaa

SEQ ID NO: 816671 - RNA, 24 nt, Human
uauagacaaagcaaacccaaaaac

SEQ ID NO: 816672 - RNA, 18 nt, Human
uauuucaacaacugcugu

SEQ ID NO: 816673 - RNA, 26 nt, Human
uauuuccucauugugugucucuuuca

SEQ ID NO: 816674 - RNA, 21 nt, Human
ucauugugugucucuuucaca

SEQ ID NO: 816675 - RNA, 20 nt, Human
uccacaacauguuuccaaau

SEQ ID NO: 816676 - RNA, 23 nt, Human
uccacaacauguuuccaaauucu

SEQ ID NO: 816677 - RNA, 20 nt, Human
ucccuauuuccucauugugu

SEQ ID NO: 816678 - RNA, 23 nt, Human
ugagaguuacuugaggcaaguuu

SEQ ID NO: 816679 - RNA, 23 nt, Human
ugaggaaguuaggaaaaaagaaa

SEQ ID NO: 816680 - RNA, 18 nt, Human
ugauuaaacugccaagga

SEQ ID NO: 816681 - RNA, 25 nt, Human
ugcagaggaaucagcaagcauucca

SEQ ID NO: 816682 - RNA, 22 nt, Human
ugcaguagcgaagacgagcguc

SEQ ID NO: 816683 - RNA, 21 nt, Human
uggggugagcggucugcuggg

SEQ ID NO: 816684 - RNA, 25 nt, Human
uguacaaagaaugcucuaaagaccc

SEQ ID NO: 816685 - RNA, 25 nt, Human
uguccaauaaauugccuuacuaaca

SEQ ID NO: 816686 - RNA, 18 nt, Human
ugugcagaggaaucagca

SEQ ID NO: 816687 - RNA, 21 nt, Human
ugugcagaggaaucagcaagc

SEQ ID NO: 816688 - RNA, 22 nt, Human
ugugcagaggaaucagcaagca

SEQ ID NO: 816689 - RNA, 24 nt, Human
ugugugccugcgugcgugugugcg

SEQ ID NO: 816690 - RNA, 22 nt, Human
ugugugugccugcgugcgugug

SEQ ID NO: 816691 - RNA, 20 nt, Human
ugugugugcgaaagugugug

SEQ ID NO: 816692 - RNA, 21 nt, Human
ugugugugcgaaagugugugu

SEQ ID NO: 816693 - RNA, 25 nt, Human
ugugugugcgaaagugugugugugu

SEQ ID NO: 816694 - RNA, 25 nt, Human
ugugugugcgaaagugugugugugu

SEQ ID NO: 816695 - RNA, 25 nt, Human
ugugugugcgaaagugugugugugu

SEQ ID NO: 816696 - RNA, 21 nt, Human
ugugugugugugccugcgugc

SEQ ID NO: 816697 - RNA, 18 nt, Human
ugugugugugugugccug

SEQ ID NO: 816698 - RNA, 18 nt, Human
ugugugugugugugugug

SEQ ID NO: 816699 - RNA, 18 nt, Human
ugugugugugugugugug

SEQ ID NO: 816700 - RNA, 18 nt, Human
ugugugugugugugugug

SEQ ID NO: 816701 - RNA, 18 nt, Human
ugugugugugugugugug

SEQ ID NO: 816702 - RNA, 18 nt, Human
ugugugugugugugugug

SEQ ID NO: 816703 - RNA, 18 nt, Human
ugugugugugugugugug

SEQ ID NO: 816704 - RNA, 18 nt, Human
ugugugugugugugugug

SEQ ID NO: 816705 - RNA, 18 nt, Human
ugugugugugugugugug

SEQ ID NO: 816706 - RNA, 19 nt, Human
ugugugugugugugugugc

SEQ ID NO: 816707 - RNA, 21 nt, Human
ugugugugugugugugugugc

SEQ ID NO: 816708 - RNA, 21 nt, Human
ugugugugugugugugugugu

SEQ ID NO: 816709 - RNA, 21 nt, Human
ugugugugugugugugugugu

SEQ ID NO: 816710 - RNA, 21 nt, Human
ugugugugugugugugugugu

SEQ ID NO: 816711 - RNA, 21 nt, Human
ugugugugugugugugugugu

SEQ ID NO: 816712 - RNA, 21 nt, Human
ugugugugugugugugugugu

SEQ ID NO: 816713 - RNA, 21 nt, Human
ugugugugugugugugugugu

SEQ ID NO: 816714 - RNA, 21 nt, Human
ugugugugugugugugugugu

SEQ ID NO: 816715 - RNA, 21 nt, Human
ugugugugugugugugugugu

SEQ ID NO: 816716 - RNA, 21 nt, Human
ugugugugugugugugugugu

SEQ ID NO: 816717 - RNA, 21 nt, Human
ugugugugugugugugugugu

SEQ ID NO: 816718 - RNA, 21 nt, Human
ugugugugugugugugugugu

SEQ ID NO: 816719 - RNA, 21 nt, Human
ugugugugugugugugugugu

SEQ ID NO: 816720 - RNA, 21 nt, Human
ugugugugugugugugugugu

SEQ ID NO: 816721 - RNA, 22 nt, Human
ugugugugugugugugugugug

SEQ ID NO: 816722 - RNA, 22 nt, Human
ugugugugugugugugugugug

SEQ ID NO: 816723 - RNA, 22 nt, Human
ugugugugugugugugugugug

SEQ ID NO: 816724 - RNA, 22 nt, Human
ugugugugugugugugugugug

SEQ ID NO: 816725 - RNA, 22 nt, Human
ugugugugugugugugugugug

SEQ ID NO: 816726 - RNA, 22 nt, Human
uguguguguguguguguguguu

SEQ ID NO: 816727 - RNA, 24 nt, Human
uuaaauuuguuuucaaaugugauu

SEQ ID NO: 816728 - RNA, 23 nt, Human
uuagaacugccaauucuagguuc

SEQ ID NO: 816729 - RNA, 20 nt, Human
uucacuuuugauuacaaaaa

SEQ ID NO: 816730 - RNA, 20 nt, Human
uuccucagguucucagccuu

SEQ ID NO: 816731 - RNA, 22 nt, Human
uuccucagguucucagccuuag

SEQ ID NO: 816732 - RNA, 23 nt, Human
uuuugauuacaaaaaaagguuac

SEQ ID NO: 816733 - RNA, 23 nt, Human
uuuuuaaacuucaaaaauaaucu

SEQ ID NO: 816734 - RNA, 22 nt, Human
aaccaggugcccaaccacagcc

SEQ ID NO: 816735 - RNA, 24 nt, Human
aagagagcugcaggggguuccggg

SEQ ID NO: 816736 - RNA, 21 nt, Human
aagccccccacgaagccccaa

SEQ ID NO: 816737 - RNA, 21 nt, Human
aagccgccucuggaggcaagc

SEQ ID NO: 816738 - RNA, 18 nt, Human
aaggaugauggacuccgg

SEQ ID NO: 816739 - RNA, 23 nt, Human
aagggccccugucccugcaguca

SEQ ID NO: 816740 - RNA, 23 nt, Human
acacgggcuccccagccuggaca

SEQ ID NO: 816741 - RNA, 23 nt, Human
acagcuccucccugcagcccucc

SEQ ID NO: 816742 - RNA, 23 nt, Human
acagcuucagaggagagggaacc

SEQ ID NO: 816743 - RNA, 23 nt, Human
accaugcucaucaucaucacaaa

SEQ ID NO: 816744 - RNA, 19 nt, Human
acccacccacccacccacc

SEQ ID NO: 816745 - RNA, 20 nt, Human
acccacccacccacccaccc

SEQ ID NO: 816746 - RNA, 19 nt, Human
agaggaaggaggagcaggc

SEQ ID NO: 816747 - RNA, 21 nt, Human
agaggcguccccacaccccgc

SEQ ID NO: 816748 - RNA, 21 nt, Human
agaggcuggcugggaggggcu

SEQ ID NO: 816749 - RNA, 22 nt, Human
agaggcuggcugggaggggcug

SEQ ID NO: 816750 - RNA, 24 nt, Human
agaggcuggcugggaggggcuggg

SEQ ID NO: 816751 - RNA, 22 nt, Human
agagggagggaggaagggaggu

SEQ ID NO: 816752 - RNA, 22 nt, Human
agccacugcaaccccacucccu

SEQ ID NO: 816753 - RNA, 26 nt, Human
agccccccggcccugcacaccccagg

SEQ ID NO: 816754 - RNA, 20 nt, Human
agcccgagccuccuagcccu

SEQ ID NO: 816755 - RNA, 22 nt, Human
agcccugugcuggaguguggag

SEQ ID NO: 816756 - RNA, 18 nt, Human
aggacccccuuccucucc

SEQ ID NO: 816757 - RNA, 21 nt, Human
aggagcaggcccagaccaucc

SEQ ID NO: 816758 - RNA, 21 nt, Human
aggaggcuucccuggggcugc

SEQ ID NO: 816759 - RNA, 18 nt, Human
aggagggaguggggcagg

SEQ ID NO: 816760 - RNA, 19 nt, Human
aggagguggguguggggca

SEQ ID NO: 816761 - RNA, 18 nt, Human
aggccaguuccccuccug

SEQ ID NO: 816762 - RNA, 22 nt, Human
aggcggugcuugggggacaggc

SEQ ID NO: 816763 - RNA, 23 nt, Human
agggaaggagugugucaggaugg

SEQ ID NO: 816764 - RNA, 18 nt, Human
aggggcacccagggucag

SEQ ID NO: 816765 - RNA, 24 nt, Human
aggggcacccagggucagggaagg

SEQ ID NO: 816766 - RNA, 21 nt, Human
agguggguguggggcagggcu

SEQ ID NO: 816767 - RNA, 23 nt, Human
aucagagagggggcgggggaguc

SEQ ID NO: 816768 - RNA, 26 nt, Human
aucgucaugcaaauauaacagggagu

SEQ ID NO: 816769 - RNA, 28 nt, Human
aucuccgaguugaggaaaacaauuucgu

SEQ ID NO: 816770 - RNA, 27 nt, Human
auggggucgggcagguggggacacagg

SEQ ID NO: 816771 - RNA, 22 nt, Human
caaaccaggugcccaaccacag

SEQ ID NO: 816772 - RNA, 18 nt, Human
caaagcccccacccucuc

SEQ ID NO: 816773 - RNA, 20 nt, Human
caaaguaagccccucagggc

SEQ ID NO: 816774 - RNA, 21 nt, Human
caaugcucagaaacacaggag

SEQ ID NO: 816775 - RNA, 21 nt, Human
cacagcccagcuccaccaugc

SEQ ID NO: 816776 - RNA, 25 nt, Human
cacagcuucggaaagggaugugggg

SEQ ID NO: 816777 - RNA, 23 nt, Human
cacagcuuggcucccuguccccc

SEQ ID NO: 816778 - RNA, 19 nt, Human
cacaggagguggguguggg

SEQ ID NO: 816779 - RNA, 22 nt, Human
cacccccugcccccagcaggaa

SEQ ID NO: 816780 - RNA, 22 nt, Human
cacccucucccugaagcccccc

SEQ ID NO: 816781 - RNA, 20 nt, Human
cacugggcugggaaguuggg

SEQ ID NO: 816782 - RNA, 20 nt, Human
cacuuaggccccuuauaagc

SEQ ID NO: 816783 - RNA, 23 nt, Human
cagaccccccagaccccacaccc

SEQ ID NO: 816784 - RNA, 23 nt, Human
cagagacccgagucuuagacccc

SEQ ID NO: 816785 - RNA, 21 nt, Human
cagccaacuuggggacuggcg

SEQ ID NO: 816786 - RNA, 19 nt, Human
cagcugcacacucuggggg

SEQ ID NO: 816787 - RNA, 21 nt, Human
cagcuuggcucccuguccccc

SEQ ID NO: 816788 - RNA, 21 nt, Human
caggaaacccaugugggccac

SEQ ID NO: 816789 - RNA, 18 nt, Human
caggacccaaaccaggug

SEQ ID NO: 816790 - RNA, 25 nt, Human
caggccccuaacuccugcugcuggg

SEQ ID NO: 816791 - RNA, 21 nt, Human
cagguucagagcccagggccu

SEQ ID NO: 816792 - RNA, 19 nt, Human
cagguuuugggggccgggg

SEQ ID NO: 816793 - RNA, 22 nt, Human
ccacagcccagcuccaccaugc

SEQ ID NO: 816794 - RNA, 22 nt, Human
ccacgaacccagccugcuccuc

SEQ ID NO: 816795 - RNA, 21 nt, Human
ccacugcaaccccacucccuc

SEQ ID NO: 816796 - RNA, 19 nt, Human
ccaggcaucacagugcacc

SEQ ID NO: 816797 - RNA, 22 nt, Human
ccagucucaggaccgcagauuu

SEQ ID NO: 816798 - RNA, 18 nt, Human
cccaaaagagcuggcccc

SEQ ID NO: 816799 - RNA, 22 nt, Human
cccaaaccaggugcccaaccac

SEQ ID NO: 816800 - RNA, 19 nt, Human
cccacaggccuccugcacu

SEQ ID NO: 816801 - RNA, 24 nt, Human
cccacugcugcugccccagcugcc

SEQ ID NO: 816802 - RNA, 22 nt, Human
cccaucagcauccugacugguc

SEQ ID NO: 816803 - RNA, 18 nt, Human
cccaugugggccacaggc

SEQ ID NO: 816804 - RNA, 20 nt, Human
ccccaaaucucaggaaaccc

SEQ ID NO: 816805 - RNA, 21 nt, Human
ccccacaccccgcugggccag

SEQ ID NO: 816806 - RNA, 22 nt, Human
ccccagaccccacacccucucu

SEQ ID NO: 816807 - RNA, 21 nt, Human
ccccagagcccaacggucacu

SEQ ID NO: 816808 - RNA, 22 nt, Human
ccccagagcccaacggucacuc

SEQ ID NO: 816809 - RNA, 20 nt, Human
ccccaugacagcuccucccu

SEQ ID NO: 816810 - RNA, 22 nt, Human
cccccaaaaggcccccagcccu

SEQ ID NO: 816811 - RNA, 23 nt, Human
cccccacccccaaaagaagaaaa

SEQ ID NO: 816812 - RNA, 23 nt, Human
cccccacccucucccugaagccc

SEQ ID NO: 816813 - RNA, 24 nt, Human
ccccccagaccccacacccucucu

SEQ ID NO: 816814 - RNA, 20 nt, Human
ccccccgccagccccccggg

SEQ ID NO: 816815 - RNA, 21 nt, Human
ccccccggcccugcacacccc

SEQ ID NO: 816816 - RNA, 19 nt, Human
ccccgccagccccccggcc

SEQ ID NO: 816817 - RNA, 19 nt, Human
ccccgcccuggccgccugg

SEQ ID NO: 816818 - RNA, 18 nt, Human
ccccuuccucucccuccu

SEQ ID NO: 816819 - RNA, 19 nt, Human
cccgcugggccagcuccca

SEQ ID NO: 816820 - RNA, 22 nt, Human
cccucgcuccaccgggccucca

SEQ ID NO: 816821 - RNA, 23 nt, Human
cccucucuuggcuuccuuccucc

SEQ ID NO: 816822 - RNA, 21 nt, Human
cccugaccagccuugccccuc

SEQ ID NO: 816823 - RNA, 18 nt, Human
cccuggccgccuggaccc

SEQ ID NO: 816824 - RNA, 21 nt, Human
cccuggccgccuggacccuuc

SEQ ID NO: 816825 - RNA, 25 nt, Human
cccuggggcccagcccaggcgugcu

SEQ ID NO: 816826 - RNA, 21 nt, Human
cccuggguuucaagagcugcu

SEQ ID NO: 816827 - RNA, 22 nt, Human
cccugucccagcccugugcugg

SEQ ID NO: 816828 - RNA, 19 nt, Human
cccuucugcggugggcagg

SEQ ID NO: 816829 - RNA, 18 nt, Human
ccgggacaagagcccuug

SEQ ID NO: 816830 - RNA, 21 nt, Human
ccgggacaagagcccuugagg

SEQ ID NO: 816831 - RNA, 18 nt, Human
ccgggggaggaggucugc

SEQ ID NO: 816832 - RNA, 20 nt, Human
ccuccuuccccgggugggcg

SEQ ID NO: 816833 - RNA, 23 nt, Human
ccucucuuggcuuccuuccuccc

SEQ ID NO: 816834 - RNA, 21 nt, Human
ccugaccuuuagugaggccug

SEQ ID NO: 816835 - RNA, 19 nt, Human
ccugcccaccaacagugcc

SEQ ID NO: 816836 - RNA, 19 nt, Human
ccugcccccagcaggaagg

SEQ ID NO: 816837 - RNA, 18 nt, Human
ccugcuggccugccccag

SEQ ID NO: 816838 - RNA, 22 nt, Human
ccugggccuuggcccccgaguc

SEQ ID NO: 816839 - RNA, 18 nt, Human
ccuggggcccagcccagg

SEQ ID NO: 816840 - RNA, 18 nt, Human
ccuggggcucagccaccu

SEQ ID NO: 816841 - RNA, 20 nt, Human
ccuggggcucagccaccucu

SEQ ID NO: 816842 - RNA, 21 nt, Human
ccuuccaccgggacaagagcc

SEQ ID NO: 816843 - RNA, 20 nt, Human
ccuuuccucuccuuuccguc

SEQ ID NO: 816844 - RNA, 24 nt, Human
cgaccaacuuccaguugagaacau

SEQ ID NO: 816845 - RNA, 18 nt, Human
cgaguugaggaaaacaau

SEQ ID NO: 816846 - RNA, 23 nt, Human
cgcggggaaaagcaaggccggga

SEQ ID NO: 816847 - RNA, 19 nt, Human
cgggacggacagacagucc

SEQ ID NO: 816848 - RNA, 18 nt, Human
cggggaaaagcaaggccg

SEQ ID NO: 816849 - RNA, 19 nt, Human
cuacaaaacgggaacaagc

SEQ ID NO: 816850 - RNA, 18 nt, Human
cucaaagcccccacccuc

SEQ ID NO: 816851 - RNA, 26 nt, Human
cuccaccaugcucaucaucaucacaa

SEQ ID NO: 816852 - RNA, 21 nt, Human
cucccacccuccucgcucccc

SEQ ID NO: 816853 - RNA, 20 nt, Human
cuccccuccucgccccagga

SEQ ID NO: 816854 - RNA, 20 nt, Human
cucccgccugggaaaaacuc

SEQ ID NO: 816855 - RNA, 20 nt, Human
cucccucaccacccucugcc

SEQ ID NO: 816856 - RNA, 25 nt, Human
cucccucaccacccucugccaccgc

SEQ ID NO: 816857 - RNA, 20 nt, Human
cucccugaagccccccacga

SEQ ID NO: 816858 - RNA, 26 nt, Human
cucccugaagccccccacgaagcccc

SEQ ID NO: 816859 - RNA, 18 nt, Human
cucccugcagcccuccag

SEQ ID NO: 816860 - RNA, 19 nt, Human
cucccuggcauggaggagg

SEQ ID NO: 816861 - RNA, 24 nt, Human
cucccuggguuucaagagcugcuc

SEQ ID NO: 816862 - RNA, 19 nt, Human
cuccuggggcucagccacc

SEQ ID NO: 816863 - RNA, 18 nt, Human
cuccuuuccucuccuuuc

SEQ ID NO: 816864 - RNA, 21 nt, Human
cucugcacuucuguucacccc

SEQ ID NO: 816865 - RNA, 19 nt, Human
cucuuuacucccacccucc

SEQ ID NO: 816866 - RNA, 21 nt, Human
cugaagccccccacgaagccc

SEQ ID NO: 816867 - RNA, 22 nt, Human
cugaagccccccacgaagcccc

SEQ ID NO: 816868 - RNA, 21 nt, Human
cugccccagcugccucccggg

SEQ ID NO: 816869 - RNA, 18 nt, Human
cugcccguccuacaggac

SEQ ID NO: 816870 - RNA, 21 nt, Human
cugcucccacaggccuccugc

SEQ ID NO: 816871 - RNA, 24 nt, Human
cugcugccccagcugccucccggg

SEQ ID NO: 816872 - RNA, 21 nt, Human
cugcugcugccccagcugccu

SEQ ID NO: 816873 - RNA, 28 nt, Human
cugcugcugggaacccucccuggggccc

SEQ ID NO: 816874 - RNA, 24 nt, Human
cuguggcccccccugcccucuuuu

SEQ ID NO: 816875 - RNA, 20 nt, Human
cuuaucccuucccugcacuu

SEQ ID NO: 816876 - RNA, 21 nt, Human
cuucccaaaagagcuggcccc

SEQ ID NO: 816877 - RNA, 18 nt, Human
cuucggaaagggaugugg

SEQ ID NO: 816878 - RNA, 24 nt, Human
cuuuggugggcagagagagacucu

SEQ ID NO: 816879 - RNA, 21 nt, Human
gaagggagggagggagggaag

SEQ ID NO: 816880 - RNA, 22 nt, Human
gaaucacagcugcacacucugg

SEQ ID NO: 816881 - RNA, 21 nt, Human
gacccgugacgagguuucccc

SEQ ID NO: 816882 - RNA, 21 nt, Human
gacccucucccuucucccggg

SEQ ID NO: 816883 - RNA, 20 nt, Human
gagagggagggaggaaggga

SEQ ID NO: 816884 - RNA, 19 nt, Human
gagccggggccccccaagc

SEQ ID NO: 816885 - RNA, 24 nt, Human
gagccugcaccugagacguccugg

SEQ ID NO: 816886 - RNA, 19 nt, Human
gagcugcugccaggcuggc

SEQ ID NO: 816887 - RNA, 18 nt, Human
gagcuggccccaggagcg

SEQ ID NO: 816888 - RNA, 21 nt, Human
gaggaaggaggagcaggccca

SEQ ID NO: 816889 - RNA, 20 nt, Human
gaggagggguuggggggcag

SEQ ID NO: 816890 - RNA, 23 nt, Human
gaggggcuucagucccucucuac

SEQ ID NO: 816891 - RNA, 19 nt, Human
gagguggguguggggcagg

SEQ ID NO: 816892 - RNA, 20 nt, Human
gauguggggugggcacaggg

SEQ ID NO: 816893 - RNA, 18 nt, Human
gauuugcuucccaaaaga

SEQ ID NO: 816894 - RNA, 25 nt, Human
gcacugccucaggagggggggaacc

SEQ ID NO: 816895 - RNA, 20 nt, Human
gcacugggcugggaaguugg

SEQ ID NO: 816896 - RNA, 18 nt, Human
gcaggggguuccgggaca

SEQ ID NO: 816897 - RNA, 18 nt, Human
gcaguuggggcucuggcc

SEQ ID NO: 816898 - RNA, 23 nt, Human
gccagccccccggcccugcacac

SEQ ID NO: 816899 - RNA, 19 nt, Human
gcccagggccugagcccag

SEQ ID NO: 816900 - RNA, 20 nt, Human
gcccagggccugagcccagc

SEQ ID NO: 816901 - RNA, 23 nt, Human
gccccaggagaacagucuuuucu

SEQ ID NO: 816902 - RNA, 18 nt, Human
gcccccuccccuccucgc

SEQ ID NO: 816903 - RNA, 21 nt, Human
gccccuaacuccugcugcugg

SEQ ID NO: 816904 - RNA, 19 nt, Human
gcccuugaggaggcuuccc

SEQ ID NO: 816905 - RNA, 18 nt, Human
gccuggcugggaggccag

SEQ ID NO: 816906 - RNA, 20 nt, Human
gcuccgaccucaccagggag

SEQ ID NO: 816907 - RNA, 19 nt, Human
gcuggaguguggaguggca

SEQ ID NO: 816908 - RNA, 21 nt, Human
gcugugcccucccaggaagga

SEQ ID NO: 816909 - RNA, 19 nt, Human
gcuuucuugccuucaugcc

SEQ ID NO: 816910 - RNA, 20 nt, Human
ggaaagcagggcaucagaga

SEQ ID NO: 816911 - RNA, 20 nt, Human
ggacacagaugcaggccagc

SEQ ID NO: 816912 - RNA, 24 nt, Human
ggacaggcagccacugcaacccca

SEQ ID NO: 816913 - RNA, 23 nt, Human
ggacccuucccccaaaaggcccc

SEQ ID NO: 816914 - RNA, 19 nt, Human
ggagagagggagggaggaa

SEQ ID NO: 816915 - RNA, 21 nt, Human
ggaggcaagcaguauggaccc

SEQ ID NO: 816916 - RNA, 18 nt, Human
ggauguggggugggcaca

SEQ ID NO: 816917 - RNA, 21 nt, Human
ggcaggggcaggguaguaggg

SEQ ID NO: 816918 - RNA, 23 nt, Human
ggccaguuccccuccuggaucau

SEQ ID NO: 816919 - RNA, 19 nt, Human
ggcugggaggggcuggggc

SEQ ID NO: 816920 - RNA, 23 nt, Human
ggcugggaggggcuggggcgcca

SEQ ID NO: 816921 - RNA, 21 nt, Human
ggcuuccuuccuccccccgcc

SEQ ID NO: 816922 - RNA, 19 nt, Human
gggaaggagugugucagga

SEQ ID NO: 816923 - RNA, 19 nt, Human
gggcacagggcgggcaggg

SEQ ID NO: 816924 - RNA, 19 nt, Human
gggcagggcugugucuugg

SEQ ID NO: 816925 - RNA, 21 nt, Human
gggcagggcugugucuuggug

SEQ ID NO: 816926 - RNA, 20 nt, Human
gggcaggggucucggaggac

SEQ ID NO: 816927 - RNA, 23 nt, Human
gggcagguuuugggggccggggg

SEQ ID NO: 816928 - RNA, 18 nt, Human
gggcaucagagagggggc

SEQ ID NO: 816929 - RNA, 18 nt, Human
gggccuccaucuccccuc

SEQ ID NO: 816930 - RNA, 27 nt, Human
gggcuucagucccucucuacuccagcu

SEQ ID NO: 816931 - RNA, 19 nt, Human
gggggccucacuguuugug

SEQ ID NO: 816932 - RNA, 25 nt, Human
gggggucagaaagagggaaguggcc

SEQ ID NO: 816933 - RNA, 21 nt, Human
ggggugugaggagggguuggg

SEQ ID NO: 816934 - RNA, 19 nt, Human
gggguuggggggcagguuu

SEQ ID NO: 816935 - RNA, 23 nt, Human
ggugggggggucagaaagaggga

SEQ ID NO: 816936 - RNA, 24 nt, Human
gucagaaagagggaaguggccauu

SEQ ID NO: 816937 - RNA, 18 nt, Human
gucguugggguccccagg

SEQ ID NO: 816938 - RNA, 18 nt, Human
gugacugauccuccaccc

SEQ ID NO: 816939 - RNA, 18 nt, Human
gugcuuuguuugauguug

SEQ ID NO: 816940 - RNA, 23 nt, Human
uaaaacaggaaauugagggaagg

SEQ ID NO: 816941 - RNA, 19 nt, Human
uaauuccugaugccauccc

SEQ ID NO: 816942 - RNA, 21 nt, Human
uaccauggugacagaggcugg

SEQ ID NO: 816943 - RNA, 22 nt, Human
uacccagacacgggcuccccag

SEQ ID NO: 816944 - RNA, 26 nt, Human
uaggaccugucacugguguccuuaau

SEQ ID NO: 816945 - RNA, 21 nt, Human
uaggggucaaaagccccccag

SEQ ID NO: 816946 - RNA, 23 nt, Human
uaggucuccuuuccucuccuuuc

SEQ ID NO: 816947 - RNA, 23 nt, Human
ucacagguucagagcccagggcc

SEQ ID NO: 816948 - RNA, 19 nt, Human
ucacuagggagcauugugu

SEQ ID NO: 816949 - RNA, 25 nt, Human
ucagagcccagggccugagcccagc

SEQ ID NO: 816950 - RNA, 20 nt, Human
ucaggaggggagcccaggug

SEQ ID NO: 816951 - RNA, 25 nt, Human
ucagucccucucuacuccagcuucc

SEQ ID NO: 816952 - RNA, 22 nt, Human
ucccaagucccucagccccaag

SEQ ID NO: 816953 - RNA, 22 nt, Human
ucccacaggccuccugcacugc

SEQ ID NO: 816954 - RNA, 20 nt, Human
uccccaggcuccccgacggc

SEQ ID NO: 816955 - RNA, 23 nt, Human
ucccccaaaaggcccccagcccu

SEQ ID NO: 816956 - RNA, 27 nt, Human
uccccccgccagccccccggcccugca

SEQ ID NO: 816957 - RNA, 19 nt, Human
uccccgacggcuugccccg

SEQ ID NO: 816958 - RNA, 20 nt, Human
uccccgacggcuugccccgc

SEQ ID NO: 816959 - RNA, 22 nt, Human
uccccgacggcuugccccgccc

SEQ ID NO: 816960 - RNA, 19 nt, Human
uccccgcccuggccgccug

SEQ ID NO: 816961 - RNA, 20 nt, Human
ucccucuagucucgucuucc

SEQ ID NO: 816962 - RNA, 18 nt, Human
ucccugaccagccuugcc

SEQ ID NO: 816963 - RNA, 20 nt, Human
ucccugcacuuaggccccuu

SEQ ID NO: 816964 - RNA, 21 nt, Human
ucccugcagucagagagucug

SEQ ID NO: 816965 - RNA, 20 nt, Human
ucccuggggcugcccucccu

SEQ ID NO: 816966 - RNA, 21 nt, Human
ucccuguccccccaucccaca

SEQ ID NO: 816967 - RNA, 23 nt, Human
uccucccucacccccugccccca

SEQ ID NO: 816968 - RNA, 22 nt, Human
uccugaggaagggagggaggga

SEQ ID NO: 816969 - RNA, 18 nt, Human
ucgcccugccucggcucc

SEQ ID NO: 816970 - RNA, 22 nt, Human
ucugcaaggcgccagucacuag

SEQ ID NO: 816971 - RNA, 18 nt, Human
ucugcaggacccaaacca

SEQ ID NO: 816972 - RNA, 21 nt, Human
ucugcaggacccaaaccaggg

SEQ ID NO: 816973 - RNA, 19 nt, Human
ucuucacacccacccaccc

SEQ ID NO: 816974 - RNA, 19 nt, Human
ugaacugggucuucaaggc

SEQ ID NO: 816975 - RNA, 24 nt, Human
ugaagccccccacgaagccccaag

SEQ ID NO: 816976 - RNA, 21 nt, Human
ugagaacaugggugacucucg

SEQ ID NO: 816977 - RNA, 19 nt, Human
ugagacguccugggagcug

SEQ ID NO: 816978 - RNA, 19 nt, Human
ugagauaggagccgagauc

SEQ ID NO: 816979 - RNA, 18 nt, Human
ugagcaugagaguuagag

SEQ ID NO: 816980 - RNA, 20 nt, Human
ugagcuuccccaggcucccc

SEQ ID NO: 816981 - RNA, 21 nt, Human
ugaggaggcuucccuggggcu

SEQ ID NO: 816982 - RNA, 18 nt, Human
ugaggagggguugggggg

SEQ ID NO: 816983 - RNA, 19 nt, Human
ugaggcuaagcugcugugu

SEQ ID NO: 816984 - RNA, 24 nt, Human
ugagggaagggagaggcagauaca

SEQ ID NO: 816985 - RNA, 21 nt, Human
ugccaagggggugugaggagg

SEQ ID NO: 816986 - RNA, 22 nt, Human
ugccauguggcuuucuaggaag

SEQ ID NO: 816987 - RNA, 19 nt, Human
ugccccagaccacagccca

SEQ ID NO: 816988 - RNA, 22 nt, Human
ugccccagcugccucccggggu

SEQ ID NO: 816989 - RNA, 21 nt, Human
ugccucggcuccuuucccguc

SEQ ID NO: 816990 - RNA, 23 nt, Human
ugcugcugggaacccucccuggg

SEQ ID NO: 816991 - RNA, 22 nt, Human
ugcuugcuuuucucaguugugc

SEQ ID NO: 816992 - RNA, 18 nt, Human
ugcuugggggacaggcag

SEQ ID NO: 816993 - RNA, 24 nt, Human
ugcuuuguuugauguugggugggg

SEQ ID NO: 816994 - RNA, 18 nt, Human
uggacuccggcccaucag

SEQ ID NO: 816995 - RNA, 19 nt, Human
uggcacuagcuuuccuggu

SEQ ID NO: 816996 - RNA, 22 nt, Human
uggccccaggagcugcugccag

SEQ ID NO: 816997 - RNA, 21 nt, Human
uggcccccgagucugcucccc

SEQ ID NO: 816998 - RNA, 18 nt, Human
uggcugggaggggcuggg

SEQ ID NO: 816999 - RNA, 22 nt, Human
uggcuuucuaggaagaaaaagc

SEQ ID NO: 817000 - RNA, 21 nt, Human
ugggagcccugacuuccucau

SEQ ID NO: 817001 - RNA, 19 nt, Human
ugggccagcucccacccag

SEQ ID NO: 817002 - RNA, 24 nt, Human
ugggcccaaugcucagaaacacag

SEQ ID NO: 817003 - RNA, 19 nt, Human
uggggacaagggagguggc

SEQ ID NO: 817004 - RNA, 21 nt, Human
uggggacaagggagguggcag

SEQ ID NO: 817005 - RNA, 19 nt, Human
uggggacacaggccauggg

SEQ ID NO: 817006 - RNA, 23 nt, Human
uggggacacaggccauggggaca

SEQ ID NO: 817007 - RNA, 21 nt, Human
uggggccagccaggcaaggcu

SEQ ID NO: 817008 - RNA, 20 nt, Human
uggggcucagccaccucugg

SEQ ID NO: 817009 - RNA, 18 nt, Human
uggggcucuggccuggcu

SEQ ID NO: 817010 - RNA, 19 nt, Human
uggggcugcccucccuggc

SEQ ID NO: 817011 - RNA, 19 nt, Human
ugggggccgggggaggagg

SEQ ID NO: 817012 - RNA, 25 nt, Human
ugguggucaggugugugugugcgug

SEQ ID NO: 817013 - RNA, 21 nt, Human
ugugaggagggguuggggggc

SEQ ID NO: 817014 - RNA, 22 nt, Human
ugugccaagggggugugaggag

SEQ ID NO: 817015 - RNA, 22 nt, Human
uguggaguggcagaggggcaga

SEQ ID NO: 817016 - RNA, 19 nt, Human
uguggggugggcacagggc

SEQ ID NO: 817017 - RNA, 23 nt, Human
ugugugacccugggguugucaac

SEQ ID NO: 817018 - RNA, 24 nt, Human
uucuagccccagaccccccagacc

SEQ ID NO: 817019 - RNA, 21 nt, Human
uucucaaagcccccacccucu

SEQ ID NO: 817020 - RNA, 24 nt, Human
uugggugggggggucagaaagagg

SEQ ID NO: 817021 - RNA, 24 nt, Human
uuucucaaagcccccacccucucc

SEQ ID NO: 817022 - RNA, 18 nt, Human
uuugugaauacuucccuc

SEQ ID NO: 817023 - RNA, 22 nt, Human
aaaaagaauuccagaggucaaa

SEQ ID NO: 817024 - RNA, 21 nt, Human
aaaagcuuuuggcugacugag

SEQ ID NO: 817025 - RNA, 19 nt, Human
aaacaagaaugcuaccaaa

SEQ ID NO: 817026 - RNA, 19 nt, Human
aacaauugacagucacugu

SEQ ID NO: 817027 - RNA, 18 nt, Human
aagaagcaucuucaggac

SEQ ID NO: 817028 - RNA, 27 nt, Human
aagcagagaauaaaaauaaagggaccc

SEQ ID NO: 817029 - RNA, 23 nt, Human
aagcuccuuuugcagcuaaugcc

SEQ ID NO: 817030 - RNA, 24 nt, Human
aaucauccccuauugcugaucaaa

SEQ ID NO: 817031 - RNA, 19 nt, Human
acaacuuuuuuccaaaugu

SEQ ID NO: 817032 - RNA, 19 nt, Human
acaagaaaguucaacaaca

SEQ ID NO: 817033 - RNA, 23 nt, Human
acacacacacacacacacacaca

SEQ ID NO: 817034 - RNA, 23 nt, Human
acacacacacacacacacacaca

SEQ ID NO: 817035 - RNA, 23 nt, Human
acacacacacacacacacacaca

SEQ ID NO: 817036 - RNA, 23 nt, Human
acacacacacacacacacacaca

SEQ ID NO: 817037 - RNA, 22 nt, Human
acaguccugugggccagagaua

SEQ ID NO: 817038 - RNA, 20 nt, Human
acugcagcacaucuggaccc

SEQ ID NO: 817039 - RNA, 21 nt, Human
acuuguaggguucagaugaaa

SEQ ID NO: 817040 - RNA, 25 nt, Human
agaaaaaaagaaaagaaaaaaaucc

SEQ ID NO: 817041 - RNA, 22 nt, Human
agaaaaaaauccaaaagucaag

SEQ ID NO: 817042 - RNA, 22 nt, Human
agaauuucuccaguccccacau

SEQ ID NO: 817043 - RNA, 21 nt, Human
agcacuguucccaaacacacu

SEQ ID NO: 817044 - RNA, 21 nt, Human
agcauaacuuuuccaccaucc

SEQ ID NO: 817045 - RNA, 18 nt, Human
aguccccacauguggcug

SEQ ID NO: 817046 - RNA, 23 nt, Human
agugcagaaaacuggaaaaaccu

SEQ ID NO: 817047 - RNA, 22 nt, Human
auaacuuuuccaccauccauac

SEQ ID NO: 817048 - RNA, 19 nt, Human
auagaaacuuccgucuaca

SEQ ID NO: 817049 - RNA, 23 nt, Human
auuuaaacauuaugcaggaguug

SEQ ID NO: 817050 - RNA, 19 nt, Human
caaaugcaacacaccugug

SEQ ID NO: 817051 - RNA, 18 nt, Human
caagaagcaucuucagga

SEQ ID NO: 817052 - RNA, 22 nt, Human
caagaaugcuaccaaaaugcac

SEQ ID NO: 817053 - RNA, 19 nt, Human
caagaggcuugcugguguc

SEQ ID NO: 817054 - RNA, 20 nt, Human
cacacacacacacacacaca

SEQ ID NO: 817055 - RNA, 20 nt, Human
cacacacacacacacacaca

SEQ ID NO: 817056 - RNA, 20 nt, Human
cacacacacacacacacaca

SEQ ID NO: 817057 - RNA, 20 nt, Human
cacacacacacacacacaca

SEQ ID NO: 817058 - RNA, 20 nt, Human
cacacacacacacacacaca

SEQ ID NO: 817059 - RNA, 20 nt, Human
cacacacacacacacacaca

SEQ ID NO: 817060 - RNA, 22 nt, Human
cacacacacacacacacacaca

SEQ ID NO: 817061 - RNA, 20 nt, Human
cacagaggagcaaaggcggc

SEQ ID NO: 817062 - RNA, 21 nt, Human
caccaaacucuuugaaaagcu

SEQ ID NO: 817063 - RNA, 23 nt, Human
caccagaccuccacaaaucaaac

SEQ ID NO: 817064 - RNA, 23 nt, Human
cacccccuacccaacgucucacu

SEQ ID NO: 817065 - RNA, 19 nt, Human
caccuccuccccaguuaca

SEQ ID NO: 817066 - RNA, 21 nt, Human
cagaguucacugucuggugcc

SEQ ID NO: 817067 - RNA, 24 nt, Human
cagcuucuauagcucuccaaaccu

SEQ ID NO: 817068 - RNA, 22 nt, Human
caggaaauauuuagaggaggaa

SEQ ID NO: 817069 - RNA, 20 nt, Human
cauuuuauacaacuaacuga

SEQ ID NO: 817070 - RNA, 20 nt, Human
ccaaaagucaagaagaauaa

SEQ ID NO: 817071 - RNA, 21 nt, Human
ccaaaagucaagaagaauaag

SEQ ID NO: 817072 - RNA, 19 nt, Human
ccaguuuccagcccugcug

SEQ ID NO: 817073 - RNA, 30 nt, Human
ccccgacaucccaguaaugggaagaccccu

SEQ ID NO: 817074 - RNA, 20 nt, Human
cccugcaccccgucaagcac

SEQ ID NO: 817075 - RNA, 24 nt, Human
ccuccccaguuacacccccuaccc

SEQ ID NO: 817076 - RNA, 22 nt, Human
ccucuacugcagcacaucugga

SEQ ID NO: 817077 - RNA, 21 nt, Human
cgucaagcacugccaucagag

SEQ ID NO: 817078 - RNA, 18 nt, Human
cucaaauguuuuucccac

SEQ ID NO: 817079 - RNA, 18 nt, Human
cuccaggaguuccccaug

SEQ ID NO: 817080 - RNA, 19 nt, Human
cuccuugcuuccuuauccc

SEQ ID NO: 817081 - RNA, 23 nt, Human
cuccuuggauuagcucaguuauc

SEQ ID NO: 817082 - RNA, 21 nt, Human
cucuccuugcuuccuuauccc

SEQ ID NO: 817083 - RNA, 23 nt, Human
cucucugcaagcuccuuuugcag

SEQ ID NO: 817084 - RNA, 18 nt, Human
cuggaauagucauuuauu

SEQ ID NO: 817085 - RNA, 24 nt, Human
gaaaacaguaaagagauggcccuc

SEQ ID NO: 817086 - RNA, 22 nt, Human
gaaaauugagaccauuuuuagg

SEQ ID NO: 817087 - RNA, 20 nt, Human
gaaauauuuagaggaggaaa

SEQ ID NO: 817088 - RNA, 20 nt, Human
gacuagcuggaaaacaaggu

SEQ ID NO: 817089 - RNA, 21 nt, Human
gcaauuucagcacuguuccca

SEQ ID NO: 817090 - RNA, 21 nt, Human
gcuacacaggagcugugugac

SEQ ID NO: 817091 - RNA, 18 nt, Human
gcucaaggaaaagacuga

SEQ ID NO: 817092 - RNA, 19 nt, Human
gcucaaggaaaagacugaa

SEQ ID NO: 817093 - RNA, 20 nt, Human
gcuuccuuaucccaucaaac

SEQ ID NO: 817094 - RNA, 23 nt, Human
gcuuucuucgguccuggaugguu

SEQ ID NO: 817095 - RNA, 24 nt, Human
ggagacccaggaaauaacauggca

SEQ ID NO: 817096 - RNA, 18 nt, Human
ggcuagaggaggcggggu

SEQ ID NO: 817097 - RNA, 22 nt, Human
gggcaggacccugcuguaugug

SEQ ID NO: 817098 - RNA, 18 nt, Human
ggugagggcugcugaguc

SEQ ID NO: 817099 - RNA, 23 nt, Human
guauauguauguauaugcguuua

SEQ ID NO: 817100 - RNA, 20 nt, Human
gucauguucccacccaagga

SEQ ID NO: 817101 - RNA, 23 nt, Human
guuuuauuuauuuauuuauuuug

SEQ ID NO: 817102 - RNA, 28 nt, Human
uaaaacccagcuucuauagcucuccaaa

SEQ ID NO: 817103 - RNA, 19 nt, Human
uaaaacccuuugucccagu

SEQ ID NO: 817104 - RNA, 18 nt, Human
uaacugaacgcugggcuc

SEQ ID NO: 817105 - RNA, 21 nt, Human
uaacuuuuccaccauccauac

SEQ ID NO: 817106 - RNA, 26 nt, Human
uaauuuuuuuuucuauaauagcugcu

SEQ ID NO: 817107 - RNA, 19 nt, Human
uacagagaaugaaauggaa

SEQ ID NO: 817108 - RNA, 20 nt, Human
uacaggaagaacuuuuuggc

SEQ ID NO: 817109 - RNA, 21 nt, Human
uacaucacuugcaauuucagc

SEQ ID NO: 817110 - RNA, 24 nt, Human
uaccaaaaugcacaaagguggaca

SEQ ID NO: 817111 - RNA, 20 nt, Human
uagaaaacaguaaagagaug

SEQ ID NO: 817112 - RNA, 22 nt, Human
uagaaauagaaaaaucaacacc

SEQ ID NO: 817113 - RNA, 23 nt, Human
uagaaauagaaaaaucaacaccc

SEQ ID NO: 817114 - RNA, 18 nt, Human
uagaggcauuuccaaacu

SEQ ID NO: 817115 - RNA, 20 nt, Human
uagcugcuucuugaguucug

SEQ ID NO: 817116 - RNA, 21 nt, Human
uaggguucagaugaaaccacg

SEQ ID NO: 817117 - RNA, 22 nt, Human
uaguuuauaucuuuacccccau

SEQ ID NO: 817118 - RNA, 19 nt, Human
uauauguauguauaugcgu

SEQ ID NO: 817119 - RNA, 24 nt, Human
uauguauguauaugcguuuauaua

SEQ ID NO: 817120 - RNA, 20 nt, Human
uauuaaaauaacauuuuuau

SEQ ID NO: 817121 - RNA, 18 nt, Human
ucaaaaagaauuccagag

SEQ ID NO: 817122 - RNA, 21 nt, Human
ucaaucagcacaugagcuuuc

SEQ ID NO: 817123 - RNA, 21 nt, Human
ucacacacacacacacacaca

SEQ ID NO: 817124 - RNA, 23 nt, Human
ucagagggaaugcucuaauuuuu

SEQ ID NO: 817125 - RNA, 21 nt, Human
ucaggauuauuauagucuggg

SEQ ID NO: 817126 - RNA, 19 nt, Human
ucaggccaaggggcaauaa

SEQ ID NO: 817127 - RNA, 18 nt, Human
ucaucuuucauguauguc

SEQ ID NO: 817128 - RNA, 22 nt, Human
uccaaaagucaagaagaauaag

SEQ ID NO: 817129 - RNA, 21 nt, Human
uccaaagggagagacgauuga

SEQ ID NO: 817130 - RNA, 25 nt, Human
uccaggaguuccccaugaguuuuca

SEQ ID NO: 817131 - RNA, 20 nt, Human
ucccaaacacacuacagucc

SEQ ID NO: 817132 - RNA, 24 nt, Human
ucccaacauaagccacaggguacc

SEQ ID NO: 817133 - RNA, 22 nt, Human
ucccagggaagaaaacucaugu

SEQ ID NO: 817134 - RNA, 23 nt, Human
ucccaguaaugggaagaccccuu

SEQ ID NO: 817135 - RNA, 22 nt, Human
uccccaguuacacccccuaccc

SEQ ID NO: 817136 - RNA, 22 nt, Human
ucuauugucuuuucuucuugcc

SEQ ID NO: 817137 - RNA, 18 nt, Human
ucugcaagcuccuuuugc

SEQ ID NO: 817138 - RNA, 24 nt, Human
ucugcaagcuccuuuugcagcuaa

SEQ ID NO: 817139 - RNA, 20 nt, Human
ucugcccucuacugcagcac

SEQ ID NO: 817140 - RNA, 20 nt, Human
ucuucuugccuucucucaaa

SEQ ID NO: 817141 - RNA, 22 nt, Human
ucuuggauaccaucccuagaug

SEQ ID NO: 817142 - RNA, 22 nt, Human
ugaaaagcuuuuggcugacuga

SEQ ID NO: 817143 - RNA, 25 nt, Human
ugaaauggaaaauugagaccaacug

SEQ ID NO: 817144 - RNA, 21 nt, Human
ugacccccugcagauccuucc

SEQ ID NO: 817145 - RNA, 27 nt, Human
ugagaccauuuuuagguaacucgagua

SEQ ID NO: 817146 - RNA, 28 nt, Human
ugagguuugcuagguguugaccacaggg

SEQ ID NO: 817147 - RNA, 19 nt, Human
ugauaugcauuacaucaca

SEQ ID NO: 817148 - RNA, 21 nt, Human
ugauuccugugcucugcccuc

SEQ ID NO: 817149 - RNA, 18 nt, Human
ugcaagcuccuuuugcag

SEQ ID NO: 817150 - RNA, 22 nt, Human
ugcagaaaacuggaaaaaccug

SEQ ID NO: 817151 - RNA, 18 nt, Human
ugcauggagacccaggaa

SEQ ID NO: 817152 - RNA, 20 nt, Human
ugcuucaggugacccccugc

SEQ ID NO: 817153 - RNA, 24 nt, Human
uggaaaacaaggugcuauaaccca

SEQ ID NO: 817154 - RNA, 19 nt, Human
uggaaggaacccuuccccc

SEQ ID NO: 817155 - RNA, 19 nt, Human
uggagacccaggaaauaac

SEQ ID NO: 817156 - RNA, 23 nt, Human
uggagacccaggaaauaagggag

SEQ ID NO: 817157 - RNA, 21 nt, Human
uggaguauucugagguuugcu

SEQ ID NO: 817158 - RNA, 18 nt, Human
uggcauguuugaacgcuc

SEQ ID NO: 817159 - RNA, 25 nt, Human
uggccacaaagcacuuguauaaaua

SEQ ID NO: 817160 - RNA, 20 nt, Human
uggcuagaggaggcgggguu

SEQ ID NO: 817161 - RNA, 21 nt, Human
uggcuagaggaggcgggguug

SEQ ID NO: 817162 - RNA, 23 nt, Human
uggcugacugaggaaucuuccca

SEQ ID NO: 817163 - RNA, 22 nt, Human
ugggaugucuguacauuuaaaa

SEQ ID NO: 817164 - RNA, 27 nt, Human
ugguggaaggaacccuucccccaauuc

SEQ ID NO: 817165 - RNA, 21 nt, Human
uguauaugcguuuauauacau

SEQ ID NO: 817166 - RNA, 23 nt, Human
ugucaaucagcacaugagcuuuc

SEQ ID NO: 817167 - RNA, 25 nt, Human
ugucccaguguuauacaagaaaguu

SEQ ID NO: 817168 - RNA, 20 nt, Human
ugugaccacagaguucacug

SEQ ID NO: 817169 - RNA, 24 nt, Human
uuagaggcauuuccaaacuuaaaa

SEQ ID NO: 817170 - RNA, 21 nt, Human
uuagauauuuuugagugggau

SEQ ID NO: 817171 - RNA, 20 nt, Human
uucacacacacacacacaca

SEQ ID NO: 817172 - RNA, 21 nt, Human
uucacacacacacacacacac

SEQ ID NO: 817173 - RNA, 19 nt, Human
uucaucauuuucagaaaug

SEQ ID NO: 817174 - RNA, 19 nt, Human
uucuuugguguggcagcug

SEQ ID NO: 817175 - RNA, 23 nt, Human
uugcaauuucagcacuguuccca

SEQ ID NO: 817176 - RNA, 19 nt, Human
uuggggggaaacccacugc

SEQ ID NO: 817177 - RNA, 20 nt, Human
uuuccuucaccuccucccca

SEQ ID NO: 817178 - RNA, 21 nt, Human
aaaacacggcaguucagaaug

SEQ ID NO: 817179 - RNA, 21 nt, Human
aaacccaaaacacggcaguuc

SEQ ID NO: 817180 - RNA, 21 nt, Human
aaaucccccggcguucuuuuc

SEQ ID NO: 817181 - RNA, 20 nt, Human
aaaugauaaaucuuauguuu

SEQ ID NO: 817182 - RNA, 24 nt, Human
aacacgcucccccucuuuccccug

SEQ ID NO: 817183 - RNA, 19 nt, Human
aaccagauuccucauccua

SEQ ID NO: 817184 - RNA, 19 nt, Human
aacccaaguccaauugaau

SEQ ID NO: 817185 - RNA, 19 nt, Human
aacccgagccgcucagaag

SEQ ID NO: 817186 - RNA, 19 nt, Human
aacccgucugcccgcucug

SEQ ID NO: 817187 - RNA, 19 nt, Human
aaccuuaaccucagggaau

SEQ ID NO: 817188 - RNA, 24 nt, Human
aagagaaaagcaaauccgaucaaa

SEQ ID NO: 817189 - RNA, 22 nt, Human
aagccagagaacaguaaaccca

SEQ ID NO: 817190 - RNA, 20 nt, Human
acacaccccucuccgccaag

SEQ ID NO: 817191 - RNA, 25 nt, Human
acacuggcucuccguucucuccugg

SEQ ID NO: 817192 - RNA, 20 nt, Human
acagaaccguccaguaucaa

SEQ ID NO: 817193 - RNA, 22 nt, Human
acagagcugggauauaaacacc

SEQ ID NO: 817194 - RNA, 24 nt, Human
acagggcagcagaggaaaacagaa

SEQ ID NO: 817195 - RNA, 20 nt, Human
acaguguccccaggggcgca

SEQ ID NO: 817196 - RNA, 18 nt, Human
acccacuaagucaugauc

SEQ ID NO: 817197 - RNA, 25 nt, Human
acccagaccccaggcucugccccag

SEQ ID NO: 817198 - RNA, 23 nt, Human
acccaggccgugguggauccagu

SEQ ID NO: 817199 - RNA, 23 nt, Human
accccgaggcccgaacgagauua

SEQ ID NO: 817200 - RNA, 19 nt, Human
accguccaguaucaacacc

SEQ ID NO: 817201 - RNA, 21 nt, Human
accgugacacacagcacacug

SEQ ID NO: 817202 - RNA, 20 nt, Human
accugcuuuguaaggucuca

SEQ ID NO: 817203 - RNA, 23 nt, Human
acucgacauccgauggcaccccu

SEQ ID NO: 817204 - RNA, 19 nt, Human
acugcaccuggggcuccag

SEQ ID NO: 817205 - RNA, 19 nt, Human
acugccucagccuggagcu

SEQ ID NO: 817206 - RNA, 21 nt, Human
agaaaagcaaauccgaucaaa

SEQ ID NO: 817207 - RNA, 24 nt, Human
agaacucugcaaacagugcucccc

SEQ ID NO: 817208 - RNA, 19 nt, Human
agaauaggguggggacggg

SEQ ID NO: 817209 - RNA, 22 nt, Human
agacagugccgaugguuacaca

SEQ ID NO: 817210 - RNA, 20 nt, Human
agaccccaggcucugcccca

SEQ ID NO: 817211 - RNA, 19 nt, Human
agacugccucagccuggag

SEQ ID NO: 817212 - RNA, 21 nt, Human
agagaacaguaaacccaaaac

SEQ ID NO: 817213 - RNA, 20 nt, Human
agagcugggauauaaacacc

SEQ ID NO: 817214 - RNA, 22 nt, Human
agccagagaacaguaaacccaa

SEQ ID NO: 817215 - RNA, 21 nt, Human
agccccaaggcuucugaacag

SEQ ID NO: 817216 - RNA, 21 nt, Human
agcuaaacaaauuaccccgag

SEQ ID NO: 817217 - RNA, 22 nt, Human
agcuacaaagcccagccuggga

SEQ ID NO: 817218 - RNA, 19 nt, Human
agcuggcgggagggggcgg

SEQ ID NO: 817219 - RNA, 20 nt, Human
aggagcucuguggacagucc

SEQ ID NO: 817220 - RNA, 27 nt, Human
aggcaaacgagguguggccucccucuu

SEQ ID NO: 817221 - RNA, 24 nt, Human
aggcagaagagaaaagcaaauccg

SEQ ID NO: 817222 - RNA, 25 nt, Human
aggcagaagagaaaagcaaauccga

SEQ ID NO: 817223 - RNA, 28 nt, Human
aggccagcagcaggagagcagcaggaga

SEQ ID NO: 817224 - RNA, 21 nt, Human
aggcgcccccaagcccugccg

SEQ ID NO: 817225 - RNA, 23 nt, Human
aggcugugucagccuggacuucu

SEQ ID NO: 817226 - RNA, 24 nt, Human
agggagagcucggggaccaggagc

SEQ ID NO: 817227 - RNA, 22 nt, Human
agggaguggcgguggaggaggg

SEQ ID NO: 817228 - RNA, 19 nt, Human
aggggcugaggcccgggac

SEQ ID NO: 817229 - RNA, 21 nt, Human
aggggugcugguuucuggucc

SEQ ID NO: 817230 - RNA, 18 nt, Human
aguagcugugggagaagu

SEQ ID NO: 817231 - RNA, 19 nt, Human
agucccagcugaaccuugc

SEQ ID NO: 817232 - RNA, 18 nt, Human
aguggcgguggaggaggg

SEQ ID NO: 817233 - RNA, 20 nt, Human
auaaaccagauuccucaucc

SEQ ID NO: 817234 - RNA, 19 nt, Human
auccagugagauguggcuc

SEQ ID NO: 817235 - RNA, 21 nt, Human
aucggcugcccugguucucag

SEQ ID NO: 817236 - RNA, 19 nt, Human
aucuggcagccacauggag

SEQ ID NO: 817237 - RNA, 22 nt, Human
auggagcagaagaaccgcccag

SEQ ID NO: 817238 - RNA, 23 nt, Human
auggagcagaagaaccgcccagc

SEQ ID NO: 817239 - RNA, 23 nt, Human
caaagcccagccugggaggccgc

SEQ ID NO: 817240 - RNA, 22 nt, Human
caaauaaauaacccaaguccaa

SEQ ID NO: 817241 - RNA, 18 nt, Human
caaauccgggcacaaaua

SEQ ID NO: 817242 - RNA, 18 nt, Human
caacacagauggugggcc

SEQ ID NO: 817243 - RNA, 24 nt, Human
caacacugaaucucugcauuuacu

SEQ ID NO: 817244 - RNA, 21 nt, Human
caaggaaccacugcccagagc

SEQ ID NO: 817245 - RNA, 20 nt, Human
cacacagcacacuggcucuc

SEQ ID NO: 817246 - RNA, 20 nt, Human
cacagggaggagcucugugg

SEQ ID NO: 817247 - RNA, 18 nt, Human
caccccagggcugccggc

SEQ ID NO: 817248 - RNA, 20 nt, Human
caccccucauuuccugccuc

SEQ ID NO: 817249 - RNA, 22 nt, Human
caccccucuccgccaagcuuca

SEQ ID NO: 817250 - RNA, 19 nt, Human
caccuggggcuccagccuc

SEQ ID NO: 817251 - RNA, 24 nt, Human
cacggccagagccaugcagacgcc

SEQ ID NO: 817252 - RNA, 24 nt, Human
cagaaccguccaguaucaacacca

SEQ ID NO: 817253 - RNA, 26 nt, Human
cagaaccguccaguaucaacaccaac

SEQ ID NO: 817254 - RNA, 18 nt, Human
cagacagcagagggagga

SEQ ID NO: 817255 - RNA, 24 nt, Human
cagagaacaguaaacccaaaacac

SEQ ID NO: 817256 - RNA, 21 nt, Human
cagagcugcucccuggguggg

SEQ ID NO: 817257 - RNA, 27 nt, Human
cagagcugggcgaggcuggacucccag

SEQ ID NO: 817258 - RNA, 20 nt, Human
cagaggaaaacagaaaucau

SEQ ID NO: 817259 - RNA, 18 nt, Human
cagaggguaggagcugga

SEQ ID NO: 817260 - RNA, 21 nt, Human
cagcacacuggcucuccguuc

SEQ ID NO: 817261 - RNA, 22 nt, Human
cagcagaggggcugaggcccgg

SEQ ID NO: 817262 - RNA, 20 nt, Human
cagccaaugccugacagagc

SEQ ID NO: 817263 - RNA, 21 nt, Human
cagcugagccacuuccaaacu

SEQ ID NO: 817264 - RNA, 19 nt, Human
caggaacaagagccacugc

SEQ ID NO: 817265 - RNA, 23 nt, Human
caggacugggaaggcuuccugga

SEQ ID NO: 817266 - RNA, 19 nt, Human
caggagaacagcccagccc

SEQ ID NO: 817267 - RNA, 18 nt, Human
caggccccaggugagaaa

SEQ ID NO: 817268 - RNA, 20 nt, Human
cagggaggagcucuguggac

SEQ ID NO: 817269 - RNA, 18 nt, Human
caggucuggcuugugugg

SEQ ID NO: 817270 - RNA, 18 nt, Human
cagguuuuugcucugugg

SEQ ID NO: 817271 - RNA, 24 nt, Human
caguggcgcuccggcgcccugggu

SEQ ID NO: 817272 - RNA, 19 nt, Human
caguggggguaggcaugga

SEQ ID NO: 817273 - RNA, 19 nt, Human
caguguccccaggggcgca

SEQ ID NO: 817274 - RNA, 20 nt, Human
cauccaggaacaagagccuu

SEQ ID NO: 817275 - RNA, 18 nt, Human
caucgcccgagagcuggu

SEQ ID NO: 817276 - RNA, 22 nt, Human
caugcagugcccaaggaaccac

SEQ ID NO: 817277 - RNA, 21 nt, Human
cauuagccauuaacuccccag

SEQ ID NO: 817278 - RNA, 24 nt, Human
ccaaaagccagagaacaguaaacc

SEQ ID NO: 817279 - RNA, 22 nt, Human
ccaaugccugacagagcuggga

SEQ ID NO: 817280 - RNA, 21 nt, Human
ccacuuccaaacucuugaccc

SEQ ID NO: 817281 - RNA, 22 nt, Human
ccaggccccaggugagaaacac

SEQ ID NO: 817282 - RNA, 25 nt, Human
ccaggccccaggugagaaacaccga

SEQ ID NO: 817283 - RNA, 24 nt, Human
cccaagacugccucagccuggagc

SEQ ID NO: 817284 - RNA, 25 nt, Human
cccaaggaaccacugcccagagcac

SEQ ID NO: 817285 - RNA, 23 nt, Human
cccacccagaccccaggcucugc

SEQ ID NO: 817286 - RNA, 20 nt, Human
cccagagcacacggcccucu

SEQ ID NO: 817287 - RNA, 21 nt, Human
ccccagagucacauaaaccag

SEQ ID NO: 817288 - RNA, 19 nt, Human
ccccaggugagaaacaccg

SEQ ID NO: 817289 - RNA, 20 nt, Human
ccccaggugagaaacaccga

SEQ ID NO: 817290 - RNA, 20 nt, Human
ccccauguacccagagcuca

SEQ ID NO: 817291 - RNA, 22 nt, Human
cccccaagcccugccggcagcc

SEQ ID NO: 817292 - RNA, 21 nt, Human
cccccagagucacauaaacca

SEQ ID NO: 817293 - RNA, 23 nt, Human
cccccucuuuccccugcaauucc

SEQ ID NO: 817294 - RNA, 20 nt, Human
ccccugagggaggggacggg

SEQ ID NO: 817295 - RNA, 24 nt, Human
ccccugcaauuccugagaucaccu

SEQ ID NO: 817296 - RNA, 21 nt, Human
ccccugcauccaggaacaaga

SEQ ID NO: 817297 - RNA, 19 nt, Human
ccccugccugugccgggga

SEQ ID NO: 817298 - RNA, 25 nt, Human
cccgccgccaccccagggcugccgg

SEQ ID NO: 817299 - RNA, 19 nt, Human
cccgggcugacucccagga

SEQ ID NO: 817300 - RNA, 22 nt, Human
cccucuagaccagacugcccac

SEQ ID NO: 817301 - RNA, 23 nt, Human
cccucuagaccagacugcccacc

SEQ ID NO: 817302 - RNA, 24 nt, Human
cccucucccucagggaagacuuug

SEQ ID NO: 817303 - RNA, 20 nt, Human
cccucuccgccaagcuucag

SEQ ID NO: 817304 - RNA, 20 nt, Human
cccuguugugugcaucgccc

SEQ ID NO: 817305 - RNA, 21 nt, Human
ccgaggcagaagagaaaagca

SEQ ID NO: 817306 - RNA, 21 nt, Human
ccgcccggccaacccgucugc

SEQ ID NO: 817307 - RNA, 19 nt, Human
ccggcagcgcggaacccga

SEQ ID NO: 817308 - RNA, 20 nt, Human
ccuacacuaacacgcucccc

SEQ ID NO: 817309 - RNA, 22 nt, Human
ccucagagguccuuccaggggu

SEQ ID NO: 817310 - RNA, 21 nt, Human
ccuccaaugacacuuagcaaa

SEQ ID NO: 817311 - RNA, 20 nt, Human
ccuccagaccugagcugagu

SEQ ID NO: 817312 - RNA, 20 nt, Human
ccugcaauuccugagaucac

SEQ ID NO: 817313 - RNA, 18 nt, Human
ccugccggcagcgcggaa

SEQ ID NO: 817314 - RNA, 28 nt, Human
cgaggcccgaacgagauuaaaagaccgg

SEQ ID NO: 817315 - RNA, 21 nt, Human
cgccguggagcuggggccacu

SEQ ID NO: 817316 - RNA, 24 nt, Human
cgccguggagcuggggccacucug

SEQ ID NO: 817317 - RNA, 22 nt, Human
cggcagcgcggaacccgagccg

SEQ ID NO: 817318 - RNA, 20 nt, Human
cggccagagccaugcagacc

SEQ ID NO: 817319 - RNA, 21 nt, Human
cuacaaagcccagccugggag

SEQ ID NO: 817320 - RNA, 20 nt, Human
cuacagaugcccaggacugg

SEQ ID NO: 817321 - RNA, 19 nt, Human
cucaagaacuugaauagaa

SEQ ID NO: 817322 - RNA, 24 nt, Human
cucacacaccccucuccgccaagc

SEQ ID NO: 817323 - RNA, 23 nt, Human
cucagaagcccgggagccccaag

SEQ ID NO: 817324 - RNA, 18 nt, Human
cuccagcagcugcccaca

SEQ ID NO: 817325 - RNA, 20 nt, Human
cucccaagacugccucagcc

SEQ ID NO: 817326 - RNA, 21 nt, Human
cucccacccagaccccaggcu

SEQ ID NO: 817327 - RNA, 19 nt, Human
cuccuggggggggcccugg

SEQ ID NO: 817328 - RNA, 21 nt, Human
cugcagcuacaaagcccagcc

SEQ ID NO: 817329 - RNA, 19 nt, Human
cugccugagaaggaucccg

SEQ ID NO: 817330 - RNA, 20 nt, Human
cuggauuagaucagcauuug

SEQ ID NO: 817331 - RNA, 21 nt, Human
cugugggugcaggggugcugg

SEQ ID NO: 817332 - RNA, 20 nt, Human
cugugugcugggguuacccc

SEQ ID NO: 817333 - RNA, 21 nt, Human
cuuccaggaaggggugggcac

SEQ ID NO: 817334 - RNA, 20 nt, Human
cuuuccagcgacgaucccga

SEQ ID NO: 817335 - RNA, 18 nt, Human
gaaccagccacgggacac

SEQ ID NO: 817336 - RNA, 20 nt, Human
gaccgcaguggugcaagccc

SEQ ID NO: 817337 - RNA, 19 nt, Human
gacugcccaccagcagggu

SEQ ID NO: 817338 - RNA, 22 nt, Human
gacugcccuccccaaguggcug

SEQ ID NO: 817339 - RNA, 19 nt, Human
gagaauaggguggggacgg

SEQ ID NO: 817340 - RNA, 18 nt, Human
gagagcagcaggagaaca

SEQ ID NO: 817341 - RNA, 18 nt, Human
gagcuggcgggagggggc

SEQ ID NO: 817342 - RNA, 23 nt, Human
gagcugggcgaggcuggacuccc

SEQ ID NO: 817343 - RNA, 19 nt, Human
gaggccacggcagacagug

SEQ ID NO: 817344 - RNA, 23 nt, Human
gagguccuuccagggguuggaca

SEQ ID NO: 817345 - RNA, 18 nt, Human
gcagggcgggaugacggg

SEQ ID NO: 817346 - RNA, 18 nt, Human
gccagagaacaguaaacc

SEQ ID NO: 817347 - RNA, 20 nt, Human
gccagagaacaguaaaccca

SEQ ID NO: 817348 - RNA, 23 nt, Human
gccagagaacaguaaacccaaaa

SEQ ID NO: 817349 - RNA, 24 nt, Human
gccauaauaaagaccucauguacc

SEQ ID NO: 817350 - RNA, 23 nt, Human
gcccacccggaggcagcucccaa

SEQ ID NO: 817351 - RNA, 19 nt, Human
gcccagagcacacggcccu

SEQ ID NO: 817352 - RNA, 18 nt, Human
gccccaaggcuucugaac

SEQ ID NO: 817353 - RNA, 24 nt, Human
gccccaaggcuucugaacagccac

SEQ ID NO: 817354 - RNA, 19 nt, Human
gcccuccccaaguggcugg

SEQ ID NO: 817355 - RNA, 23 nt, Human
gccgccaccccagggcugccggc

SEQ ID NO: 817356 - RNA, 23 nt, Human
gccgggaagggcuuccuagcagg

SEQ ID NO: 817357 - RNA, 18 nt, Human
gccggggcuggaggucuc

SEQ ID NO: 817358 - RNA, 24 nt, Human
gcucgcugugguuggacagagcug

SEQ ID NO: 817359 - RNA, 24 nt, Human
gcugcagcuacaaagcccagccug

SEQ ID NO: 817360 - RNA, 18 nt, Human
ggaauucaaaaggcccug

SEQ ID NO: 817361 - RNA, 22 nt, Human
ggacagucccagcugaaccuug

SEQ ID NO: 817362 - RNA, 20 nt, Human
ggaggaaccugcuuuguaag

SEQ ID NO: 817363 - RNA, 21 nt, Human
ggagggggcggauccggaggg

SEQ ID NO: 817364 - RNA, 21 nt, Human
ggcaccccuucaugcccagcu

SEQ ID NO: 817365 - RNA, 18 nt, Human
ggcauaauccaaucccuc

SEQ ID NO: 817366 - RNA, 21 nt, Human
ggccacggcagacaguguccc

SEQ ID NO: 817367 - RNA, 19 nt, Human
ggccagcagcaggagagca

SEQ ID NO: 817368 - RNA, 24 nt, Human
ggcgggaugacgggugcaggaggc

SEQ ID NO: 817369 - RNA, 18 nt, Human
ggcggugauccaggagug

SEQ ID NO: 817370 - RNA, 21 nt, Human
gggaagggagagcucggggac

SEQ ID NO: 817371 - RNA, 19 nt, Human
gggagcccugagcugucau

SEQ ID NO: 817372 - RNA, 21 nt, Human
gggauuugcuuguagcccagg

SEQ ID NO: 817373 - RNA, 20 nt, Human
gggcacaaauaaauaaccca

SEQ ID NO: 817374 - RNA, 19 nt, Human
gggcacagacccagccugg

SEQ ID NO: 817375 - RNA, 20 nt, Human
gggccagggcucggauagga

SEQ ID NO: 817376 - RNA, 20 nt, Human
gggcuuccucccucagggcu

SEQ ID NO: 817377 - RNA, 18 nt, Human
ggggacggguccugggaa

SEQ ID NO: 817378 - RNA, 22 nt, Human
gggggccgcagucccccggggg

SEQ ID NO: 817379 - RNA, 18 nt, Human
gggggggucgguggggaa

SEQ ID NO: 817380 - RNA, 23 nt, Human
ggggguggucgcagcgcccuuuc

SEQ ID NO: 817381 - RNA, 24 nt, Human
ggugcauggaugcuccuugccuug

SEQ ID NO: 817382 - RNA, 22 nt, Human
gguggggaaaacgccuuuaggu

SEQ ID NO: 817383 - RNA, 18 nt, Human
gguggggaaaagccaggu

SEQ ID NO: 817384 - RNA, 21 nt, Human
gguuuccagcuugcaacacag

SEQ ID NO: 817385 - RNA, 24 nt, Human
guggagcuggggccacucugggag

SEQ ID NO: 817386 - RNA, 21 nt, Human
guggccgggaagggcuuccua

SEQ ID NO: 817387 - RNA, 19 nt, Human
guggcuccggaacuuaccc

SEQ ID NO: 817388 - RNA, 21 nt, Human
guucucaggccuccagaccug

SEQ ID NO: 817389 - RNA, 23 nt, Human
guuucaggccacuuugcucccag

SEQ ID NO: 817390 - RNA, 24 nt, Human
uaaagccaucauggacccucuaga

SEQ ID NO: 817391 - RNA, 22 nt, Human
uaaauaacccaaguccaauuga

SEQ ID NO: 817392 - RNA, 21 nt, Human
uaacgaguuuaagccaaaucc

SEQ ID NO: 817393 - RNA, 21 nt, Human
uaacucgacauccgauggcac

SEQ ID NO: 817394 - RNA, 19 nt, Human
uaaggcgcccccaagcccu

SEQ ID NO: 817395 - RNA, 20 nt, Human
uacaacgaaguagcuguggg

SEQ ID NO: 817396 - RNA, 24 nt, Human
uacacacugugucugugagagugu

SEQ ID NO: 817397 - RNA, 19 nt, Human
uaccaaagaaagcacauag

SEQ ID NO: 817398 - RNA, 19 nt, Human
uaccccgaggcccgaacga

SEQ ID NO: 817399 - RNA, 19 nt, Human
uacccugagaccaccaugc

SEQ ID NO: 817400 - RNA, 25 nt, Human
uaggagcuggaggcucgcuguggga

SEQ ID NO: 817401 - RNA, 24 nt, Human
uauguguccacuuaagugcacugu

SEQ ID NO: 817402 - RNA, 25 nt, Human
uauguuuauuucaucacuaccaaaa

SEQ ID NO: 817403 - RNA, 24 nt, Human
ucaacaccagagcugggcgaggcu

SEQ ID NO: 817404 - RNA, 21 nt, Human
ucacccuaaugaagccaucuu

SEQ ID NO: 817405 - RNA, 20 nt, Human
ucacuaccaaaaggcugugg

SEQ ID NO: 817406 - RNA, 20 nt, Human
ucacugggcuuccucccuca

SEQ ID NO: 817407 - RNA, 20 nt, Human
ucagaaugggagacguccca

SEQ ID NO: 817408 - RNA, 21 nt, Human
ucagcucccucucccucaggg

SEQ ID NO: 817409 - RNA, 21 nt, Human
ucagcugaucagcacagcuaa

SEQ ID NO: 817410 - RNA, 23 nt, Human
uccacaaugaacccaucauaggg

SEQ ID NO: 817411 - RNA, 20 nt, Human
uccagcgacgaucccgaggg

SEQ ID NO: 817412 - RNA, 21 nt, Human
uccagguuuuugcucuguggg

SEQ ID NO: 817413 - RNA, 20 nt, Human
uccagugagauguggcuccg

SEQ ID NO: 817414 - RNA, 22 nt, Human
ucccagagugcagccuuucugg

SEQ ID NO: 817415 - RNA, 24 nt, Human
ucccagcacagugcucagauaucc

SEQ ID NO: 817416 - RNA, 23 nt, Human
ucccaggccccaggugagaaaca

SEQ ID NO: 817417 - RNA, 18 nt, Human
ucccagggcuccagccuc

SEQ ID NO: 817418 - RNA, 22 nt, Human
ucccagggcuccagccucccaa

SEQ ID NO: 817419 - RNA, 23 nt, Human
uccccagggagcucauccacgug

SEQ ID NO: 817420 - RNA, 18 nt, Human
uccccugcaauuccugag

SEQ ID NO: 817421 - RNA, 18 nt, Human
ucccugaacacaagaggc

SEQ ID NO: 817422 - RNA, 26 nt, Human
ucccuuacccaucucacucccuggga

SEQ ID NO: 817423 - RNA, 21 nt, Human
uccuucagccucgguuaggau

SEQ ID NO: 817424 - RNA, 19 nt, Human
ucggcaagaggguucauug

SEQ ID NO: 817425 - RNA, 26 nt, Human
ucuaaggcgcccccaagcccugccgg

SEQ ID NO: 817426 - RNA, 25 nt, Human
ucucccucagggaagacuuugagaa

SEQ ID NO: 817427 - RNA, 21 nt, Human
ucucucguccuccuaacucga

SEQ ID NO: 817428 - RNA, 23 nt, Human
ucugaacagccacuacccggcuu

SEQ ID NO: 817429 - RNA, 23 nt, Human
ucugccccagcccaggcagaggg

SEQ ID NO: 817430 - RNA, 18 nt, Human
ugaaaaggggcaauggug

SEQ ID NO: 817431 - RNA, 24 nt, Human
ugaaaugaggaccaugggacaucu

SEQ ID NO: 817432 - RNA, 19 nt, Human
ugaacagccacuacccggc

SEQ ID NO: 817433 - RNA, 24 nt, Human
ugacagagcugggauauaaacacc

SEQ ID NO: 817434 - RNA, 21 nt, Human
ugacccacuaagucaugaucc

SEQ ID NO: 817435 - RNA, 21 nt, Human
ugagagacagcugagguacug

SEQ ID NO: 817436 - RNA, 26 nt, Human
ugagagacagcugagguacugaccca

SEQ ID NO: 817437 - RNA, 21 nt, Human
ugagccucuguuuucucaccu

SEQ ID NO: 817438 - RNA, 21 nt, Human
ugaggaugucaugugagagac

SEQ ID NO: 817439 - RNA, 21 nt, Human
ugaggcaggguggggaaaacg

SEQ ID NO: 817440 - RNA, 21 nt, Human
ugaggcccgggacgggggugg

SEQ ID NO: 817441 - RNA, 20 nt, Human
ugagggaggggacggguccu

SEQ ID NO: 817442 - RNA, 18 nt, Human
ugaguaaagccaucaugg

SEQ ID NO: 817443 - RNA, 25 nt, Human
ugcaggaaguccagcuaacgggucc

SEQ ID NO: 817444 - RNA, 27 nt, Human
ugcaggggugcugguuucugguccuaa

SEQ ID NO: 817445 - RNA, 22 nt, Human
ugccagcugccugcgacacggg

SEQ ID NO: 817446 - RNA, 19 nt, Human
ugcccaggacugggaaggc

SEQ ID NO: 817447 - RNA, 21 nt, Human
ugcccgcucugcgaccucagc

SEQ ID NO: 817448 - RNA, 22 nt, Human
ugcccugguucucaggccucca

SEQ ID NO: 817449 - RNA, 18 nt, Human
ugccgcugccugagaagg

SEQ ID NO: 817450 - RNA, 22 nt, Human
ugccugagaaggaucccggcuc

SEQ ID NO: 817451 - RNA, 22 nt, Human
ugccuucagcuggcaaaagggg

SEQ ID NO: 817452 - RNA, 20 nt, Human
uggaaaggccacagggagga

SEQ ID NO: 817453 - RNA, 24 nt, Human
uggaaaggccacagggaggagcuc

SEQ ID NO: 817454 - RNA, 18 nt, Human
uggacagaauccgaggca

SEQ ID NO: 817455 - RNA, 21 nt, Human
uggagcuggggccacucuggg

SEQ ID NO: 817456 - RNA, 23 nt, Human
uggauccagugagauguggcucc

SEQ ID NO: 817457 - RNA, 24 nt, Human
uggauguccaccaucggcugcccu

SEQ ID NO: 817458 - RNA, 24 nt, Human
uggcgggcacagacccagccuggg

SEQ ID NO: 817459 - RNA, 18 nt, Human
uggcggggagggcgaggc

SEQ ID NO: 817460 - RNA, 20 nt, Human
uggcgguggaggagggagac

SEQ ID NO: 817461 - RNA, 21 nt, Human
ugggaccaaaagccagagaac

SEQ ID NO: 817462 - RNA, 19 nt, Human
ugggagcccugagcuguca

SEQ ID NO: 817463 - RNA, 20 nt, Human
ugggagggccagggcucgga

SEQ ID NO: 817464 - RNA, 21 nt, Human
uggggaaaagccaggugccug

SEQ ID NO: 817465 - RNA, 19 nt, Human
uggggcuccagccucccag

SEQ ID NO: 817466 - RNA, 20 nt, Human
uggguuuccagcuugcaaca

SEQ ID NO: 817467 - RNA, 18 nt, Human
ugguuggacagagcugcu

SEQ ID NO: 817468 - RNA, 20 nt, Human
ugguuggcuuugcagugugg

SEQ ID NO: 817469 - RNA, 24 nt, Human
ugucaugcaggaaguccagcuacc

SEQ ID NO: 817470 - RNA, 21 nt, Human
ugugaaaugaggaccauggga

SEQ ID NO: 817471 - RNA, 24 nt, Human
ugugcuccagcagcugcccacagu

SEQ ID NO: 817472 - RNA, 19 nt, Human
ugugggugcaggggugcug

SEQ ID NO: 817473 - RNA, 21 nt, Human
ugugguuggacagagcugcuc

SEQ ID NO: 817474 - RNA, 19 nt, Human
ugugugcaucgcccgagag

SEQ ID NO: 817475 - RNA, 20 nt, Human
uuaaagcaccagcggaugau

SEQ ID NO: 817476 - RNA, 25 nt, Human
uucccuggguuuccagcuugcaaca

SEQ ID NO: 817477 - RNA, 19 nt, Human
uucucccacccagacccca

SEQ ID NO: 817478 - RNA, 24 nt, Human
uugccgccauaauaaagaccucau

SEQ ID NO: 817479 - RNA, 20 nt, Human
uugguucugcuucuccggag

SEQ ID NO: 817480 - RNA, 18 nt, Human
uuucucaccuuugaaaag

SEQ ID NO: 817481 - RNA, 19 nt, Human
uuucucaccuuugaaaagg

SEQ ID NO: 817482 - RNA, 25 nt, Human
uuuucucugguuucaggccacuuug

SEQ ID NO: 817483 - RNA, 21 nt, Human
acagcagcaggcgggucagcu

SEQ ID NO: 817484 - RNA, 18 nt, Human
accccggacugcagcagc

SEQ ID NO: 817485 - RNA, 24 nt, Human
agagggccugggagacggcagggg

SEQ ID NO: 817486 - RNA, 19 nt, Human
agggagcagaaugaauucu

SEQ ID NO: 817487 - RNA, 22 nt, Human
agguggcccccaggccuggagc

SEQ ID NO: 817488 - RNA, 24 nt, Human
augcccuauccugacauaauuuca

SEQ ID NO: 817489 - RNA, 20 nt, Human
cacaggacgaguguucccug

SEQ ID NO: 817490 - RNA, 22 nt, Human
cacaggcugaggaugcaagaac

SEQ ID NO: 817491 - RNA, 19 nt, Human
caccaggacaaccagcccc

SEQ ID NO: 817492 - RNA, 21 nt, Human
caccaggacaaccagccccag

SEQ ID NO: 817493 - RNA, 24 nt, Human
caccaggacaaccagccccagguc

SEQ ID NO: 817494 - RNA, 21 nt, Human
caccauggcuguagggaaagg

SEQ ID NO: 817495 - RNA, 20 nt, Human
cagcaaggcaugcccuaucc

SEQ ID NO: 817496 - RNA, 20 nt, Human
cagcaaggcaugcccuaucc

SEQ ID NO: 817497 - RNA, 21 nt, Human
cagcacaggacgaguguuccc

SEQ ID NO: 817498 - RNA, 21 nt, Human
cagccugggccccucuggagc

SEQ ID NO: 817499 - RNA, 18 nt, Human
cagcucagcacaggacga

SEQ ID NO: 817500 - RNA, 26 nt, Human
cagcuuguccuccuagguggccccca

SEQ ID NO: 817501 - RNA, 19 nt, Human
ccaccaggacaaccagccc

SEQ ID NO: 817502 - RNA, 19 nt, Human
ccagccucugacggaagca

SEQ ID NO: 817503 - RNA, 22 nt, Human
cccaggucccggaccucuuucc

SEQ ID NO: 817504 - RNA, 21 nt, Human
cccugguccagagcaggcucc

SEQ ID NO: 817505 - RNA, 24 nt, Human
ccgcugggguuguggcaauggagg

SEQ ID NO: 817506 - RNA, 22 nt, Human
cguccagcaccugcuugggcac

SEQ ID NO: 817507 - RNA, 18 nt, Human
cugaggaugcaagaacgu

SEQ ID NO: 817508 - RNA, 18 nt, Human
cuggagccugcugagugg

SEQ ID NO: 817509 - RNA, 22 nt, Human
cugggguuguggcaauggaggc

SEQ ID NO: 817510 - RNA, 21 nt, Human
gaccccggacugcagcagcuc

SEQ ID NO: 817511 - RNA, 18 nt, Human
gagagggccugggagacg

SEQ ID NO: 817512 - RNA, 19 nt, Human
gagcucacgaccucacacu

SEQ ID NO: 817513 - RNA, 20 nt, Human
gaugcaagaacgucuuccuc

SEQ ID NO: 817514 - RNA, 21 nt, Human
gccugggagacggcaggggca

SEQ ID NO: 817515 - RNA, 19 nt, Human
gccugggccccucuggagc

SEQ ID NO: 817516 - RNA, 22 nt, Human
gccuucagggagcucacgaccu

SEQ ID NO: 817517 - RNA, 20 nt, Human
gcugggguuguggcaaugga

SEQ ID NO: 817518 - RNA, 19 nt, Human
ggaaaaugauggcuucuuc

SEQ ID NO: 817519 - RNA, 18 nt, Human
ggcugcagccugggcccc

SEQ ID NO: 817520 - RNA, 21 nt, Human
ggcuggggaagucuccugugc

SEQ ID NO: 817521 - RNA, 22 nt, Human
ggucccggaccucuuuccuggg

SEQ ID NO: 817522 - RNA, 24 nt, Human
guuugggguccccacagcuugucc

SEQ ID NO: 817523 - RNA, 21 nt, Human
uagguggcccccaggccugga

SEQ ID NO: 817524 - RNA, 24 nt, Human
uccugugccggguggccacccuuc

SEQ ID NO: 817525 - RNA, 18 nt, Human
ucgggguguggcugccgg

SEQ ID NO: 817526 - RNA, 22 nt, Human
ucuugcucgggguguggcugcc

SEQ ID NO: 817527 - RNA, 24 nt, Human
ugacguccagcaccugcuugggca

SEQ ID NO: 817528 - RNA, 22 nt, Human
ugagagggccugggagacggca

SEQ ID NO: 817529 - RNA, 24 nt, Human
ugcauccaccaggacaaccagccc

SEQ ID NO: 817530 - RNA, 18 nt, Human
ugccggguggccacccuc

SEQ ID NO: 817531 - RNA, 19 nt, Human
ugccggguggccacccuuc

SEQ ID NO: 817532 - RNA, 20 nt, Human
ugcgugcauccaccaggaca

SEQ ID NO: 817533 - RNA, 22 nt, Human
uggcaggcugcagccugggccc

SEQ ID NO: 817534 - RNA, 21 nt, Human
ugggagguguggcaggcugca

SEQ ID NO: 817535 - RNA, 20 nt, Human
ugggguuguggcaauggaga

SEQ ID NO: 817536 - RNA, 23 nt, Human
uggugggagguguggcaggcugc

SEQ ID NO: 817537 - RNA, 26 nt, Human
uggugggagguguggcaggcugcagc

SEQ ID NO: 817538 - RNA, 21 nt, Human
uucccugguccagagcaggcu

SEQ ID NO: 817539 - RNA, 24 nt, Human
uuccuggggaugcuauggaaguac

SEQ ID NO: 817540 - RNA, 19 nt, Human
uucugggugcccuuuccca

SEQ ID NO: 817541 - RNA, 18 nt, Human
uugcauccuugucaggcc

SEQ ID NO: 817542 - RNA, 24 nt, Human
uugcucgggguguggcugccgggc

SEQ ID NO: 817543 - RNA, 25 nt, Human
aaaaaaaaaaaaaaaaaaguaggag

SEQ ID NO: 817544 - RNA, 28 nt, Human
aaaaaaaguaggaaaaaaaccgguaccc

SEQ ID NO: 817545 - RNA, 19 nt, Human
aaaaaaccccacuccccca

SEQ ID NO: 817546 - RNA, 18 nt, Human
aaaaccccacucccccac

SEQ ID NO: 817547 - RNA, 18 nt, Human
aaaauggacugaugacua

SEQ ID NO: 817548 - RNA, 24 nt, Human
aaacaaccccuaaaaacuucccuc

SEQ ID NO: 817549 - RNA, 25 nt, Human
aaacaucaccaucaaaauaaaagaa

SEQ ID NO: 817550 - RNA, 22 nt, Human
aaagggauucacugcugcauuu

SEQ ID NO: 817551 - RNA, 22 nt, Human
aaauaaaauaaaauaaaacauc

SEQ ID NO: 817552 - RNA, 20 nt, Human
aaccccuaaaaacuucccuc

SEQ ID NO: 817553 - RNA, 19 nt, Human
aagcaaagaaaaaaaaaaa

SEQ ID NO: 817554 - RNA, 23 nt, Human
aagcaagugcauguuagagaaac

SEQ ID NO: 817555 - RNA, 19 nt, Human
aagcaggguuuuccgcggc

SEQ ID NO: 817556 - RNA, 25 nt, Human
aagcuggaaaaagguaaggacccag

SEQ ID NO: 817557 - RNA, 22 nt, Human
aagggauucacugcugcauuug

SEQ ID NO: 817558 - RNA, 21 nt, Human
aagugcauguuagagaaacaa

SEQ ID NO: 817559 - RNA, 24 nt, Human
accaacaaaagcagcagagaggga

SEQ ID NO: 817560 - RNA, 21 nt, Human
accagaaauccggaugauggg

SEQ ID NO: 817561 - RNA, 18 nt, Human
accauaggaucgcagccu

SEQ ID NO: 817562 - RNA, 21 nt, Human
accaucaaaauaaaagaaccc

SEQ ID NO: 817563 - RNA, 24 nt, Human
acccccccgcacugcaauagccca

SEQ ID NO: 817564 - RNA, 19 nt, Human
accccuaaaaacuucccuc

SEQ ID NO: 817565 - RNA, 23 nt, Human
accccuaaaaacuucccucaaca

SEQ ID NO: 817566 - RNA, 24 nt, Human
acguggaggggggcggagggcggg

SEQ ID NO: 817567 - RNA, 21 nt, Human
acucacgcugcccagccaaug

SEQ ID NO: 817568 - RNA, 23 nt, Human
acuuuaaaaauaacagaaaaaga

SEQ ID NO: 817569 - RNA, 22 nt, Human
agaaaucccagaggaauaugau

SEQ ID NO: 817570 - RNA, 18 nt, Human
agaagaaaaggguuuggg

SEQ ID NO: 817571 - RNA, 18 nt, Human
agaagaaaaggguuuggg

SEQ ID NO: 817572 - RNA, 21 nt, Human
agaggggaaaaaaagaagggg

SEQ ID NO: 817573 - RNA, 23 nt, Human
agcaccaacaaaagcagcagaga

SEQ ID NO: 817574 - RNA, 21 nt, Human
agcaggguuuuccgcggcuuc

SEQ ID NO: 817575 - RNA, 19 nt, Human
aggaaaggagaagaaaagg

SEQ ID NO: 817576 - RNA, 20 nt, Human
aggagugcugaccaaugaaa

SEQ ID NO: 817577 - RNA, 20 nt, Human
agggcacugucaguucuucc

SEQ ID NO: 817578 - RNA, 20 nt, Human
aggguuuggggggguggggg

SEQ ID NO: 817579 - RNA, 21 nt, Human
aggugcuguccaguucccccg

SEQ ID NO: 817580 - RNA, 20 nt, Human
aggugggggugggguagagg

SEQ ID NO: 817581 - RNA, 23 nt, Human
aggugggggugggguagagggug

SEQ ID NO: 817582 - RNA, 22 nt, Human
aucacuguucugagaaaucacu

SEQ ID NO: 817583 - RNA, 18 nt, Human
auccaaccccacaggccc

SEQ ID NO: 817584 - RNA, 23 nt, Human
auguauauauguauagaaccgcg

SEQ ID NO: 817585 - RNA, 22 nt, Human
auuauaaaauccucgaauagaa

SEQ ID NO: 817586 - RNA, 24 nt, Human
caaaacaaccccuaaaaacuuccc

SEQ ID NO: 817587 - RNA, 19 nt, Human
caaucgcugcguuuugugg

SEQ ID NO: 817588 - RNA, 23 nt, Human
cagcaccaacaaaagcagcagag

SEQ ID NO: 817589 - RNA, 24 nt, Human
cagcaccaacaaaagcagcagaga

SEQ ID NO: 817590 - RNA, 19 nt, Human
cagcagagagggauuucca

SEQ ID NO: 817591 - RNA, 22 nt, Human
cagcagcaucucaaaugccagu

SEQ ID NO: 817592 - RNA, 22 nt, Human
cagcagggucgugcugggcuuc

SEQ ID NO: 817593 - RNA, 22 nt, Human
cauaggaucgcagccuaagcac

SEQ ID NO: 817594 - RNA, 23 nt, Human
caucaaaauaaaagaacccaaaa

SEQ ID NO: 817595 - RNA, 24 nt, Human
caucacaaaguaacagcgaccauc

SEQ ID NO: 817596 - RNA, 23 nt, Human
caucacggggcuaauccacaggg

SEQ ID NO: 817597 - RNA, 20 nt, Human
ccaaaacaaccccuaaaaac

SEQ ID NO: 817598 - RNA, 20 nt, Human
ccagaacaucacuguucuga

SEQ ID NO: 817599 - RNA, 18 nt, Human
cccccggggugccugcgg

SEQ ID NO: 817600 - RNA, 19 nt, Human
ccccgaucucaucacaaag

SEQ ID NO: 817601 - RNA, 19 nt, Human
ccccggggugccugcggug

SEQ ID NO: 817602 - RNA, 18 nt, Human
ccccugaaaaaaauaaaa

SEQ ID NO: 817603 - RNA, 20 nt, Human
ccccugaaaaaaauaaaaua

SEQ ID NO: 817604 - RNA, 22 nt, Human
cccgcacugcaauagcccagac

SEQ ID NO: 817605 - RNA, 25 nt, Human
cccgcacugcaauagcccagacgcc

SEQ ID NO: 817606 - RNA, 21 nt, Human
cccggggccgagggcgagggc

SEQ ID NO: 817607 - RNA, 21 nt, Human
cccugcguagccaacagggag

SEQ ID NO: 817608 - RNA, 21 nt, Human
ccuuuacauuuuuuucacagu

SEQ ID NO: 817609 - RNA, 21 nt, Human
ccuuuagaauaugaguucuag

SEQ ID NO: 817610 - RNA, 20 nt, Human
ccuuuccuccccuucggucc

SEQ ID NO: 817611 - RNA, 20 nt, Human
cuacuuaugcccauccaggc

SEQ ID NO: 817612 - RNA, 21 nt, Human
cuccccuauugggguuggggu

SEQ ID NO: 817613 - RNA, 19 nt, Human
cugaaaaaaauaaaauaaa

SEQ ID NO: 817614 - RNA, 20 nt, Human
cugaucuucacugaucagaa

SEQ ID NO: 817615 - RNA, 23 nt, Human
cugguggaguucuugcugugguu

SEQ ID NO: 817616 - RNA, 24 nt, Human
gaaaaaaaccccacucccccacaa

SEQ ID NO: 817617 - RNA, 20 nt, Human
gagaagaaaaggguuugggg

SEQ ID NO: 817618 - RNA, 19 nt, Human
gagaggggaaaaaaagaag

SEQ ID NO: 817619 - RNA, 25 nt, Human
gagccuuaauguagcucaggaaggg

SEQ ID NO: 817620 - RNA, 18 nt, Human
gaggugcuguccaguucc

SEQ ID NO: 817621 - RNA, 28 nt, Human
gcaagcaaagaaaaaaaaaaaaaaaaaa

SEQ ID NO: 817622 - RNA, 22 nt, Human
gcagacuccaucaauaugugug

SEQ ID NO: 817623 - RNA, 22 nt, Human
gcagcaccaacaaaagcagcag

SEQ ID NO: 817624 - RNA, 26 nt, Human
gccaggaaaggagaagaaaaggguuu

SEQ ID NO: 817625 - RNA, 23 nt, Human
gccaugcagcacuuuuuguuuuu

SEQ ID NO: 817626 - RNA, 20 nt, Human
gccuaagcacuagagugaca

SEQ ID NO: 817627 - RNA, 21 nt, Human
gcugggccacaaccagaaauc

SEQ ID NO: 817628 - RNA, 18 nt, Human
ggaaaggagaagaaaagg

SEQ ID NO: 817629 - RNA, 23 nt, Human
ggagaggggaaaaaaagaagggg

SEQ ID NO: 817630 - RNA, 18 nt, Human
ggagggugggugggcacu

SEQ ID NO: 817631 - RNA, 27 nt, Human
gggaaaaauagauaucuaucucucuau

SEQ ID NO: 817632 - RNA, 22 nt, Human
gggccgagggcgagggcacugu

SEQ ID NO: 817633 - RNA, 22 nt, Human
ggggugggguagaggguggggg

SEQ ID NO: 817634 - RNA, 23 nt, Human
ggggugggguagagggugggggc

SEQ ID NO: 817635 - RNA, 20 nt, Human
ggguggauuccuuccucccu

SEQ ID NO: 817636 - RNA, 18 nt, Human
gguaagagggugggugcu

SEQ ID NO: 817637 - RNA, 21 nt, Human
ggucgugcugggcuuucuguc

SEQ ID NO: 817638 - RNA, 22 nt, Human
gguggaguucuugcugugguug

SEQ ID NO: 817639 - RNA, 24 nt, Human
guccucuuaaggcuuuuuuuuuuc

SEQ ID NO: 817640 - RNA, 20 nt, Human
uaaaaaaaagacccccugaa

SEQ ID NO: 817641 - RNA, 21 nt, Human
uaaaaaaaagacccccugaaa

SEQ ID NO: 817642 - RNA, 25 nt, Human
uaaaaaaaagacccccugaaaaaaa

SEQ ID NO: 817643 - RNA, 23 nt, Human
uaaaaacuucccucaacaaaaua

SEQ ID NO: 817644 - RNA, 25 nt, Human
uaaaagaacccaaaacaaccccuaa

SEQ ID NO: 817645 - RNA, 21 nt, Human
uaaaauccucgaauagaauua

SEQ ID NO: 817646 - RNA, 23 nt, Human
uaaaauggacugaugacuagcca

SEQ ID NO: 817647 - RNA, 20 nt, Human
uaaagcgagcaauucauccc

SEQ ID NO: 817648 - RNA, 24 nt, Human
uaaauaaaaccuuuacauuuuuuu

SEQ ID NO: 817649 - RNA, 20 nt, Human
uaaccccaaccguuucccuc

SEQ ID NO: 817650 - RNA, 22 nt, Human
uacuauaauagaaaucaugggu

SEQ ID NO: 817651 - RNA, 18 nt, Human
uagcccagacgccaguca

SEQ ID NO: 817652 - RNA, 25 nt, Human
uaggaaaaaaaccccacucccccac

SEQ ID NO: 817653 - RNA, 19 nt, Human
uaguaauuagaagcaagug

SEQ ID NO: 817654 - RNA, 23 nt, Human
uagugcaaggcaagcaaagaaaa

SEQ ID NO: 817655 - RNA, 19 nt, Human
uauauagauguggauauau

SEQ ID NO: 817656 - RNA, 19 nt, Human
uauauagauguggauauau

SEQ ID NO: 817657 - RNA, 19 nt, Human
uauauccacaaacuaucca

SEQ ID NO: 817658 - RNA, 22 nt, Human
uauauguauauauguauagaac

SEQ ID NO: 817659 - RNA, 22 nt, Human
uauccaggcacguagugcaagg

SEQ ID NO: 817660 - RNA, 24 nt, Human
uaugcaguugcuggggcggggagg

SEQ ID NO: 817661 - RNA, 23 nt, Human
ucaccaucaaaauaaaagaaccc

SEQ ID NO: 817662 - RNA, 19 nt, Human
ucacuagcugauuuauaau

SEQ ID NO: 817663 - RNA, 22 nt, Human
ucagcaaagagcgagcuggcug

SEQ ID NO: 817664 - RNA, 18 nt, Human
uccacaaacuauccaggc

SEQ ID NO: 817665 - RNA, 22 nt, Human
uccaccgcaaauccaauuuacc

SEQ ID NO: 817666 - RNA, 24 nt, Human
ucccagaggaauaugauugaggcc

SEQ ID NO: 817667 - RNA, 21 nt, Human
uccccugucucuuccaccgca

SEQ ID NO: 817668 - RNA, 23 nt, Human
uccccugucucuuccaccgcaaa

SEQ ID NO: 817669 - RNA, 18 nt, Human
ucccugcguagccaacag

SEQ ID NO: 817670 - RNA, 22 nt, Human
ucccugcguagccaacagggag

SEQ ID NO: 817671 - RNA, 24 nt, Human
ucgcagccuaagcacuagagugac

SEQ ID NO: 817672 - RNA, 25 nt, Human
ucgcugcguuuugugguuguccauc

SEQ ID NO: 817673 - RNA, 25 nt, Human
ucucaaggguggauaugugguggaa

SEQ ID NO: 817674 - RNA, 24 nt, Human
ucuccuucucuuucuucugcucuu

SEQ ID NO: 817675 - RNA, 22 nt, Human
ucugaacugccuaccgaucaca

SEQ ID NO: 817676 - RNA, 21 nt, Human
ucugagcgaaggugggggugg

SEQ ID NO: 817677 - RNA, 21 nt, Human
ucuucugcucuuucggaauua

SEQ ID NO: 817678 - RNA, 21 nt, Human
ucuucuuuuccuguucuccuu

SEQ ID NO: 817679 - RNA, 20 nt, Human
ucuuucuucugcucuuucgg

SEQ ID NO: 817680 - RNA, 21 nt, Human
ugaaaaaauaugccauuauaa

SEQ ID NO: 817681 - RNA, 23 nt, Human
ugaaaaaauaugccauuauaaaa

SEQ ID NO: 817682 - RNA, 21 nt, Human
ugacauacuucucaagggugg

SEQ ID NO: 817683 - RNA, 23 nt, Human
ugagaaaucacuucccuuuagaa

SEQ ID NO: 817684 - RNA, 24 nt, Human
ugagcgaaggugggggugggguag

SEQ ID NO: 817685 - RNA, 19 nt, Human
ugagggaggaagagagcgc

SEQ ID NO: 817686 - RNA, 25 nt, Human
ugcaaggcaagcaaagaaaaaaaaa

SEQ ID NO: 817687 - RNA, 22 nt, Human
ugcccagaaguccccccgaggu

SEQ ID NO: 817688 - RNA, 25 nt, Human
ugcugaaaucacgcccgaccgaagg

SEQ ID NO: 817689 - RNA, 20 nt, Human
ugcugggcuuucugucaaaa

SEQ ID NO: 817690 - RNA, 20 nt, Human
ugcuggggcggggagggugg

SEQ ID NO: 817691 - RNA, 21 nt, Human
ugcugguggaguucuugcugu

SEQ ID NO: 817692 - RNA, 20 nt, Human
uggaaugcagacuccaucaa

SEQ ID NO: 817693 - RNA, 24 nt, Human
uggauuccuuccucccuaaccccc

SEQ ID NO: 817694 - RNA, 22 nt, Human
uggcagaucuacuuacaacugc

SEQ ID NO: 817695 - RNA, 24 nt, Human
ugggagagaaacacuucuuuagga

SEQ ID NO: 817696 - RNA, 19 nt, Human
ugggccacaaccagaaauc

SEQ ID NO: 817697 - RNA, 20 nt, Human
uggggcaagaccuuuaugga

SEQ ID NO: 817698 - RNA, 18 nt, Human
uggggcggggaggguggg

SEQ ID NO: 817699 - RNA, 20 nt, Human
uggggcggggagggugggug

SEQ ID NO: 817700 - RNA, 20 nt, Human
ugggggcgagggaagaggag

SEQ ID NO: 817701 - RNA, 24 nt, Human
uggggguggauuccuuccucccua

SEQ ID NO: 817702 - RNA, 18 nt, Human
ugggguagaggguggggg

SEQ ID NO: 817703 - RNA, 23 nt, Human
ugucagaagucaaaguuacuuau

SEQ ID NO: 817704 - RNA, 19 nt, Human
ugucuuucauugaggagug

SEQ ID NO: 817705 - RNA, 22 nt, Human
ugugaacgagaugccgucucca

SEQ ID NO: 817706 - RNA, 18 nt, Human
uguggauauauguauaua

SEQ ID NO: 817707 - RNA, 22 nt, Human
uguggauauauguauauaugua

SEQ ID NO: 817708 - RNA, 22 nt, Human
ugugugguuuuguuugcuuuuu

SEQ ID NO: 817709 - RNA, 21 nt, Human
uuagagaaagagccuuaaugu

SEQ ID NO: 817710 - RNA, 18 nt, Human
uucauccccgaucucauc

SEQ ID NO: 817711 - RNA, 26 nt, Human
uuccucccuaacccccccgcacugca

SEQ ID NO: 817712 - RNA, 23 nt, Human
uuggagaggggaaaaaaagaagg

SEQ ID NO: 817713 - RNA, 24 nt, Human
uuggguacacgccccuccagcccc

SEQ ID NO: 817714 - RNA, 24 nt, Human
uuuaacaaauuucaauaugcaguu

SEQ ID NO: 817715 - RNA, 22 nt, Human
uuuccuguucuccuucucuuuc

SEQ ID NO: 817716 - RNA, 21 nt, Human
uuuuccuguucuccuucucuu

SEQ ID NO: 817717 - RNA, 22 nt, Human
uuuugugguuguccauccuuuu

SEQ ID NO: 817718 - RNA, 22 nt, Human
aaaaacucuauagccaaagaca

SEQ ID NO: 817719 - RNA, 19 nt, Human
aaaagacacuugcuuuacu

SEQ ID NO: 817720 - RNA, 28 nt, Human
aaaccagaaugaaagaauaaugaaucua

SEQ ID NO: 817721 - RNA, 24 nt, Human
aaauaacuauagauaaaauacauc

SEQ ID NO: 817722 - RNA, 23 nt, Human
aaaucaacuuuaacugaugcuga

SEQ ID NO: 817723 - RNA, 28 nt, Human
aagaacuucaaaauauacuuaucacuga

SEQ ID NO: 817724 - RNA, 25 nt, Human
aaucaggaaaaaaaagcucaauauu

SEQ ID NO: 817725 - RNA, 26 nt, Human
accagaaugaaagaauaaugaaucua

SEQ ID NO: 817726 - RNA, 21 nt, Human
acgcucacugcgugucacgca

SEQ ID NO: 817727 - RNA, 18 nt, Human
acugcauuguuuccaauu

SEQ ID NO: 817728 - RNA, 18 nt, Human
agacaaaaccauuccuuc

SEQ ID NO: 817729 - RNA, 21 nt, Human
agcagaucaauauaaaaaaau

SEQ ID NO: 817730 - RNA, 26 nt, Human
aggaaagagaaaaaucaggaaaaaaa

SEQ ID NO: 817731 - RNA, 28 nt, Human
aggaauaacaaagcagauaccgguaccc

SEQ ID NO: 817732 - RNA, 21 nt, Human
aggagcaggucugaaaaauca

SEQ ID NO: 817733 - RNA, 22 nt, Human
auaucuucuuuaaaaaacaaaa

SEQ ID NO: 817734 - RNA, 21 nt, Human
augcucuuaacacaucacaca

SEQ ID NO: 817735 - RNA, 20 nt, Human
auuuagcuggagcuuuccuu

SEQ ID NO: 817736 - RNA, 21 nt, Human
cacagcaccuuaaagaaauaa

SEQ ID NO: 817737 - RNA, 22 nt, Human
cacuuucuacuuccuccuucca

SEQ ID NO: 817738 - RNA, 20 nt, Human
cagaaugaaagaauaaugaa

SEQ ID NO: 817739 - RNA, 22 nt, Human
cagauaccgagucauccauacu

SEQ ID NO: 817740 - RNA, 25 nt, Human
cagcucuccaagaaggaaagccuca

SEQ ID NO: 817741 - RNA, 21 nt, Human
cagcugacgugcccagaagac

SEQ ID NO: 817742 - RNA, 19 nt, Human
cauccauacuuugcuucca

SEQ ID NO: 817743 - RNA, 21 nt, Human
ccagaaugaaagaauaaugaa

SEQ ID NO: 817744 - RNA, 18 nt, Human
ccauacuuugcuuccaag

SEQ ID NO: 817745 - RNA, 21 nt, Human
cccagaagacgaagauggccg

SEQ ID NO: 817746 - RNA, 23 nt, Human
ccccggcccggacggcugggcgu

SEQ ID NO: 817747 - RNA, 19 nt, Human
ccuuuugccuggcggaggg

SEQ ID NO: 817748 - RNA, 23 nt, Human
cgccucgcucgucagaugggagu

SEQ ID NO: 817749 - RNA, 23 nt, Human
cggguaucaggagacacucagcu

SEQ ID NO: 817750 - RNA, 21 nt, Human
cucagcugacgugcccagaag

SEQ ID NO: 817751 - RNA, 24 nt, Human
cugaugcugauauacauuuucaac

SEQ ID NO: 817752 - RNA, 22 nt, Human
cuucagcccuaaccggcucagc

SEQ ID NO: 817753 - RNA, 24 nt, Human
cuucagcccuaaccggcucagcug

SEQ ID NO: 817754 - RNA, 25 nt, Human
cuugaaacaugucuuauggcuaaca

SEQ ID NO: 817755 - RNA, 23 nt, Human
cuugcuuuacuuuggacaaggua

SEQ ID NO: 817756 - RNA, 27 nt, Human
cuuuaaaaaaaaaaacucuauagccaa

SEQ ID NO: 817757 - RNA, 22 nt, Human
cuuuguucaacaaaauauucua

SEQ ID NO: 817758 - RNA, 25 nt, Human
gcaaacaccaaacuuccggcgacga

SEQ ID NO: 817759 - RNA, 23 nt, Human
gccaccauaacucaugaagaaaa

SEQ ID NO: 817760 - RNA, 18 nt, Human
gcggccgccgccuccccc

SEQ ID NO: 817761 - RNA, 18 nt, Human
gcggcgcaaacaccaaac

SEQ ID NO: 817762 - RNA, 21 nt, Human
gguaggcgugaaugcugacua

SEQ ID NO: 817763 - RNA, 23 nt, Human
guaaucuuuaaaaaaaaaaacuc

SEQ ID NO: 817764 - RNA, 24 nt, Human
guucuuaucuaaccuccuuuguuc

SEQ ID NO: 817765 - RNA, 24 nt, Human
uaaaaaaaaaaacucuauagccaa

SEQ ID NO: 817766 - RNA, 25 nt, Human
uaaaaaaauacaguaccaagcuaca

SEQ ID NO: 817767 - RNA, 22 nt, Human
uaaaagugaaaccagaaugaaa

SEQ ID NO: 817768 - RNA, 22 nt, Human
uaacaaagcagauaccgaguca

SEQ ID NO: 817769 - RNA, 23 nt, Human
uaauaugcucuuaacacaucaca

SEQ ID NO: 817770 - RNA, 19 nt, Human
uacugcauuguuuccaauu

SEQ ID NO: 817771 - RNA, 19 nt, Human
uagaaaaagcuaucaagua

SEQ ID NO: 817772 - RNA, 21 nt, Human
uagcuucaaauuccaaaacac

SEQ ID NO: 817773 - RNA, 18 nt, Human
uaggaaagagaaaaauca

SEQ ID NO: 817774 - RNA, 22 nt, Human
uaggaggguaccuuuccuaaug

SEQ ID NO: 817775 - RNA, 21 nt, Human
ucaaagauaggaaagagaaaa

SEQ ID NO: 817776 - RNA, 21 nt, Human
ucacugcgugucacgcaguuu

SEQ ID NO: 817777 - RNA, 18 nt, Human
ucagccaccauaacucau

SEQ ID NO: 817778 - RNA, 22 nt, Human
ucauuuacagcucuccaagaag

SEQ ID NO: 817779 - RNA, 22 nt, Human
ucccccgcggcgcaaacaccaa

SEQ ID NO: 817780 - RNA, 24 nt, Human
ucccccgcggcgcaaacaccaaac

SEQ ID NO: 817781 - RNA, 18 nt, Human
uccugguuaaagucagca

SEQ ID NO: 817782 - RNA, 19 nt, Human
ucuacuuccuccuuccauc

SEQ ID NO: 817783 - RNA, 20 nt, Human
ucuuauggcuaacacguuuc

SEQ ID NO: 817784 - RNA, 18 nt, Human
ucuuccuauuuagcugga

SEQ ID NO: 817785 - RNA, 22 nt, Human
ucuuuaaaaaacaaaacaauaa

SEQ ID NO: 817786 - RNA, 21 nt, Human
ugaaaauacaaucuuuaagcc

SEQ ID NO: 817787 - RNA, 23 nt, Human
ugaaaccagaaugaaagaauaau

SEQ ID NO: 817788 - RNA, 21 nt, Human
ugagaaaagcuggcaugaaug

SEQ ID NO: 817789 - RNA, 28 nt, Human
ugagaaaagcuggcaugaaugcuaaaag

SEQ ID NO: 817790 - RNA, 21 nt, Human
ugccccaaaauauagacucga

SEQ ID NO: 817791 - RNA, 19 nt, Human
ugcugcauguaaacauguc

SEQ ID NO: 817792 - RNA, 23 nt, Human
ugcugcggccgccgccucccccg

SEQ ID NO: 817793 - RNA, 20 nt, Human
ugcuucaaguaagguuucug

SEQ ID NO: 817794 - RNA, 23 nt, Human
uguaaaagauaauaaaauaucuu

SEQ ID NO: 817795 - RNA, 18 nt, Human
uguauguuuaguaaucuu

SEQ ID NO: 817796 - RNA, 20 nt, Human
ugucuaaauaacuauagaua

SEQ ID NO: 817797 - RNA, 20 nt, Human
uguuuuguuaauuuuuuaau

SEQ ID NO: 817798 - RNA, 23 nt, Human
uucaaguugauugaugaaugaug

SEQ ID NO: 817799 - RNA, 19 nt, Human
uucagguucaaucuguuuu

SEQ ID NO: 817800 - RNA, 19 nt, Human
uuccuagaacaugagaaaa

SEQ ID NO: 817801 - RNA, 18 nt, Human
uucuuuaccacuuucuac

SEQ ID NO: 817802 - RNA, 24 nt, Human
uucuuuaccacuuucuacuuccuc

SEQ ID NO: 817803 - RNA, 25 nt, Human
uugcgcaacgcuccucuucagcccu

SEQ ID NO: 817804 - RNA, 26 nt, Human
uuugaaaacuuuuuucuucugaaguc

SEQ ID NO: 817805 - RNA, 20 nt, Human
uuuugaaaacuuuuuucuuc

SEQ ID NO: 817806 - RNA, 24 nt, Human
uuuuucaacauauaaacccuuuaa

SEQ ID NO: 817807 - RNA, 23 nt, Human
aaaauaccuaucauagcauuucc

SEQ ID NO: 817808 - RNA, 21 nt, Human
aaaauuccuucacagucuccu

SEQ ID NO: 817809 - RNA, 23 nt, Human
aaacaacaacaacagagaauauc

SEQ ID NO: 817810 - RNA, 21 nt, Human
aaaucucagaaauuuagaacc

SEQ ID NO: 817811 - RNA, 18 nt, Human
aaaugcccaacucucaaa

SEQ ID NO: 817812 - RNA, 18 nt, Human
aaauguuagauagcugca

SEQ ID NO: 817813 - RNA, 18 nt, Human
aacuaagcaaagcuagca

SEQ ID NO: 817814 - RNA, 22 nt, Human
aaggggagcuuaaauuguaacc

SEQ ID NO: 817815 - RNA, 20 nt, Human
aauaaugaaggacaugcguc

SEQ ID NO: 817816 - RNA, 22 nt, Human
acaacaacagagaauaucugcc

SEQ ID NO: 817817 - RNA, 20 nt, Human
acagcgggggagcugcaccg

SEQ ID NO: 817818 - RNA, 18 nt, Human
accauaaaaacguagcau

SEQ ID NO: 817819 - RNA, 18 nt, Human
acucuacaacgucuugcu

SEQ ID NO: 817820 - RNA, 25 nt, Human
aggaugaaagcuuuccuaggaaaga

SEQ ID NO: 817821 - RNA, 23 nt, Human
aggggcacuggggagcccggggc

SEQ ID NO: 817822 - RNA, 26 nt, Human
aggggccgcuggguuggggcggcggg

SEQ ID NO: 817823 - RNA, 23 nt, Human
aggugcaaguggguggaagaggc

SEQ ID NO: 817824 - RNA, 22 nt, Human
auauauguauauguauaccaaa

SEQ ID NO: 817825 - RNA, 19 nt, Human
augaagguugguaugcccc

SEQ ID NO: 817826 - RNA, 19 nt, Human
auugacuguuguggacauu

SEQ ID NO: 817827 - RNA, 20 nt, Human
caaaacaaaacuccagaaac

SEQ ID NO: 817828 - RNA, 23 nt, Human
caaaacaaaacuccagaaacuua

SEQ ID NO: 817829 - RNA, 26 nt, Human
caaaacaaaacuccagaaacuuaauc

SEQ ID NO: 817830 - RNA, 26 nt, Human
cacaaaauaccuaucauagcauuucc

SEQ ID NO: 817831 - RNA, 19 nt, Human
cacauauacuuaauacuca

SEQ ID NO: 817832 - RNA, 22 nt, Human
caccgccguuccccugcccucu

SEQ ID NO: 817833 - RNA, 20 nt, Human
cacuuuccucccccuugccc

SEQ ID NO: 817834 - RNA, 20 nt, Human
cagcccccggcuucuccccu

SEQ ID NO: 817835 - RNA, 26 nt, Human
cagccgcuugcugcugccgaggcccg

SEQ ID NO: 817836 - RNA, 27 nt, Human
caggggccgcuggguuggggcggcggg

SEQ ID NO: 817837 - RNA, 19 nt, Human
caggugcaaguggguggaa

SEQ ID NO: 817838 - RNA, 20 nt, Human
cagucuccuacuagugacaa

SEQ ID NO: 817839 - RNA, 23 nt, Human
caucucuauucaaaacacugagg

SEQ ID NO: 817840 - RNA, 25 nt, Human
ccagcugcagcccccggcuucuccc

SEQ ID NO: 817841 - RNA, 21 nt, Human
cccagggcccggcagccagcc

SEQ ID NO: 817842 - RNA, 21 nt, Human
cccaucuaaaacaacaacaac

SEQ ID NO: 817843 - RNA, 18 nt, Human
cccgcgcgcgcgcccgcg

SEQ ID NO: 817844 - RNA, 19 nt, Human
cccggcuucuccccucucc

SEQ ID NO: 817845 - RNA, 19 nt, Human
ccgcgcucccccagggccc

SEQ ID NO: 817846 - RNA, 22 nt, Human
ccgcuggguuggggcggcgggg

SEQ ID NO: 817847 - RNA, 22 nt, Human
ccucagaagucaaaacaaaacu

SEQ ID NO: 817848 - RNA, 25 nt, Human
ccucgccauccccgcgcgcgcgccc

SEQ ID NO: 817849 - RNA, 21 nt, Human
ccugcccucuccuccgcccua

SEQ ID NO: 817850 - RNA, 20 nt, Human
cgcgcgcgcgcccgcgcucc

SEQ ID NO: 817851 - RNA, 21 nt, Human
cgcggcgaggccgccuccgcc

SEQ ID NO: 817852 - RNA, 26 nt, Human
cuaagcaaagcuagcacaccucuuuu

SEQ ID NO: 817853 - RNA, 25 nt, Human
cuaauguuauauauauguauaugua

SEQ ID NO: 817854 - RNA, 21 nt, Human
cucuacaacgucuugcuaccc

SEQ ID NO: 817855 - RNA, 19 nt, Human
cugaggcuccacuggacuc

SEQ ID NO: 817856 - RNA, 22 nt, Human
cugcagcccccggcuucucccc

SEQ ID NO: 817857 - RNA, 18 nt, Human
cugcccucuccuccgccc

SEQ ID NO: 817858 - RNA, 18 nt, Human
cugcccucuccuccgccc

SEQ ID NO: 817859 - RNA, 26 nt, Human
cuggaaaauaccucuucauaucuuca

SEQ ID NO: 817860 - RNA, 18 nt, Human
cuggggaguuaaaaacac

SEQ ID NO: 817861 - RNA, 25 nt, Human
cuuaaacuaccauaaaaacguagca

SEQ ID NO: 817862 - RNA, 21 nt, Human
gacugucgccccccgcacucu

SEQ ID NO: 817863 - RNA, 20 nt, Human
gagcccaucuaaaacaacaa

SEQ ID NO: 817864 - RNA, 19 nt, Human
gagcccggggcugccgcgg

SEQ ID NO: 817865 - RNA, 18 nt, Human
gcccggggcugccgcggg

SEQ ID NO: 817866 - RNA, 21 nt, Human
gcgaggccgccuccgcccaca

SEQ ID NO: 817867 - RNA, 23 nt, Human
ggcacaaaagcuuauuuuaaaug

SEQ ID NO: 817868 - RNA, 21 nt, Human
ggccgcuggguuggggcggcg

SEQ ID NO: 817869 - RNA, 20 nt, Human
ggcgugcacgcacacgcacu

SEQ ID NO: 817870 - RNA, 21 nt, Human
gggcacuggggagcccggggc

SEQ ID NO: 817871 - RNA, 19 nt, Human
gggcgcgccgggcaccgcg

SEQ ID NO: 817872 - RNA, 21 nt, Human
uaaaacaacaacaacagagaa

SEQ ID NO: 817873 - RNA, 18 nt, Human
uaaaguuuacauaaaguu

SEQ ID NO: 817874 - RNA, 22 nt, Human
uaaauuguagaaauugacaucu

SEQ ID NO: 817875 - RNA, 26 nt, Human
uaacaccaauggauacacugaaugaa

SEQ ID NO: 817876 - RNA, 18 nt, Human
uaagaaauaaacuaagca

SEQ ID NO: 817877 - RNA, 22 nt, Human
uaagaaauaaacuaagcaaagc

SEQ ID NO: 817878 - RNA, 21 nt, Human
uaagaugaacacauauacuua

SEQ ID NO: 817879 - RNA, 22 nt, Human
uaagccgagacugucgcccccc

SEQ ID NO: 817880 - RNA, 24 nt, Human
uaauacaguaucaaaauuuacaca

SEQ ID NO: 817881 - RNA, 21 nt, Human
uacacaaguuuauuuugucaa

SEQ ID NO: 817882 - RNA, 19 nt, Human
uacagguuuuagaggggag

SEQ ID NO: 817883 - RNA, 25 nt, Human
uacaguaucaaaauuuacacaaggg

SEQ ID NO: 817884 - RNA, 20 nt, Human
uaccaaaaauaagaaauaaa

SEQ ID NO: 817885 - RNA, 21 nt, Human
uaccauugcuaagaugaacac

SEQ ID NO: 817886 - RNA, 21 nt, Human
uagaaccuauccaaaaacugg

SEQ ID NO: 817887 - RNA, 22 nt, Human
uagcacaccucuuuuucaaacc

SEQ ID NO: 817888 - RNA, 22 nt, Human
uauauguauauguauaccaaaa

SEQ ID NO: 817889 - RNA, 20 nt, Human
uaucacuuucuggcaguggu

SEQ ID NO: 817890 - RNA, 23 nt, Human
uaugcauuaggaauuacuaguuu

SEQ ID NO: 817891 - RNA, 27 nt, Human
uaugguagaaaacuccuaccauuaugu

SEQ ID NO: 817892 - RNA, 23 nt, Human
uaugugcaauguacaaucacucc

SEQ ID NO: 817893 - RNA, 22 nt, Human
ucaaaacaaaacuccagaaacu

SEQ ID NO: 817894 - RNA, 22 nt, Human
ucaaaacacugaggcuccacug

SEQ ID NO: 817895 - RNA, 18 nt, Human
uccccugcccucuccucc

SEQ ID NO: 817896 - RNA, 24 nt, Human
uccccugcccucuccuccgcccua

SEQ ID NO: 817897 - RNA, 21 nt, Human
ucuaaaacaacaacaacagag

SEQ ID NO: 817898 - RNA, 21 nt, Human
ucuaucacuuucuggcagugg

SEQ ID NO: 817899 - RNA, 25 nt, Human
ucuuuccuuuuucuucuugucuucu

SEQ ID NO: 817900 - RNA, 22 nt, Human
ugaaaacacugguaccaaaaug

SEQ ID NO: 817901 - RNA, 23 nt, Human
ugaaaguauaacaaaauuccuuc

SEQ ID NO: 817902 - RNA, 20 nt, Human
ugaaugaauaugaagguugg

SEQ ID NO: 817903 - RNA, 20 nt, Human
ugacaucucacagcucgaaa

SEQ ID NO: 817904 - RNA, 24 nt, Human
ugaggcuccacuggacucuuaaaa

SEQ ID NO: 817905 - RNA, 21 nt, Human
ugcagugcaauauuuuaaagu

SEQ ID NO: 817906 - RNA, 24 nt, Human
ugccaugaaucaaaucucagaaau

SEQ ID NO: 817907 - RNA, 19 nt, Human
uggaaacccacucuuuccu

SEQ ID NO: 817908 - RNA, 19 nt, Human
uggacauugaggugagaga

SEQ ID NO: 817909 - RNA, 23 nt, Human
uggcaggugcaaguggguggaag

SEQ ID NO: 817910 - RNA, 21 nt, Human
uggcaguggugaucuccuguu

SEQ ID NO: 817911 - RNA, 18 nt, Human
ugucuagaaacuaaauug

SEQ ID NO: 817912 - RNA, 23 nt, Human
ugucuagaaacuaaauuguagaa

SEQ ID NO: 817913 - RNA, 22 nt, Human
uguggaaacccacucuuuccuu

SEQ ID NO: 817914 - RNA, 27 nt, Human
uguggaaacccacucuuuccuuuuucu

SEQ ID NO: 817915 - RNA, 20 nt, Human
uuccucccccuugcccagcu

SEQ ID NO: 817916 - RNA, 21 nt, Human
uugggaagcuggaaaauaccu

SEQ ID NO: 817917 - RNA, 25 nt, Human
uuggggcggcgggggucgcgcuggg

SEQ ID NO: 817918 - RNA, 23 nt, Human
uuuaaaguuuacauaaaguuuau

SEQ ID NO: 817919 - RNA, 22 nt, Human
uuuguggaaacccacucuuucc

SEQ ID NO: 817920 - RNA, 21 nt, Human
aaccccaguccugccacccac

SEQ ID NO: 817921 - RNA, 20 nt, Human
aagaaacacaauccuaaaca

SEQ ID NO: 817922 - RNA, 22 nt, Human
aagaaggaaacaccagugaaaa

SEQ ID NO: 817923 - RNA, 22 nt, Human
aauaccgggggaaaauagaaug

SEQ ID NO: 817924 - RNA, 21 nt, Human
accccggaccgugccaaucuc

SEQ ID NO: 817925 - RNA, 23 nt, Human
acccgcagacaaaacccaucuuu

SEQ ID NO: 817926 - RNA, 23 nt, Human
agaggcggguugggggcgggggc

SEQ ID NO: 817927 - RNA, 27 nt, Human
aggcgagggggcggguggcaaggggug

SEQ ID NO: 817928 - RNA, 19 nt, Human
agggaccgggaacgggagg

SEQ ID NO: 817929 - RNA, 20 nt, Human
auuggacaguaacagauggc

SEQ ID NO: 817930 - RNA, 23 nt, Human
caaaucacccgcagacaaaaccc

SEQ ID NO: 817931 - RNA, 22 nt, Human
caagaaagacaaaagggaccgg

SEQ ID NO: 817932 - RNA, 19 nt, Human
caaguaacccaaacauaca

SEQ ID NO: 817933 - RNA, 18 nt, Human
caagucagcuugcaaaua

SEQ ID NO: 817934 - RNA, 24 nt, Human
caauuaacauuacugagcucacac

SEQ ID NO: 817935 - RNA, 22 nt, Human
cacaagguaaacuucaaggcaa

SEQ ID NO: 817936 - RNA, 28 nt, Human
cacaaugaacuuaaccaauuaacauuag

SEQ ID NO: 817937 - RNA, 23 nt, Human
cacccgcagacaaaacccaucuu

SEQ ID NO: 817938 - RNA, 23 nt, Human
cagaaaaucacauccuaagguuu

SEQ ID NO: 817939 - RNA, 19 nt, Human
caggagcccaggccggccg

SEQ ID NO: 817940 - RNA, 20 nt, Human
caguccugccacccacuccu

SEQ ID NO: 817941 - RNA, 20 nt, Human
ccaaaaccugugggaaaccc

SEQ ID NO: 817942 - RNA, 21 nt, Human
ccaaaccucacgccauaaagc

SEQ ID NO: 817943 - RNA, 19 nt, Human
ccacacuuugguacccuau

SEQ ID NO: 817944 - RNA, 24 nt, Human
ccaccgcguccaagaaagacaaaa

SEQ ID NO: 817945 - RNA, 19 nt, Human
ccaguccugccacccacuc

SEQ ID NO: 817946 - RNA, 25 nt, Human
ccccaaaccucacgccauaaagccc

SEQ ID NO: 817947 - RNA, 18 nt, Human
ccccgaagaggcggguug

SEQ ID NO: 817948 - RNA, 24 nt, Human
ccccgaagaggcggguugggggcg

SEQ ID NO: 817949 - RNA, 20 nt, Human
cccgcgccgggggggcaccg

SEQ ID NO: 817950 - RNA, 20 nt, Human
ccgcgccgggggggcaccgg

SEQ ID NO: 817951 - RNA, 24 nt, Human
ccggccgauccgcgucccggccac

SEQ ID NO: 817952 - RNA, 26 nt, Human
ccggccgauccgcgucccggccacaa

SEQ ID NO: 817953 - RNA, 23 nt, Human
ccgugccaaucucgccgccgccc

SEQ ID NO: 817954 - RNA, 19 nt, Human
ccucacgccauaaagcccc

SEQ ID NO: 817955 - RNA, 20 nt, Human
ccugccacccacuccuccug

SEQ ID NO: 817956 - RNA, 22 nt, Human
ccugccacccacuccuccugga

SEQ ID NO: 817957 - RNA, 21 nt, Human
cgccauaaagccccgaagagg

SEQ ID NO: 817958 - RNA, 23 nt, Human
cgccccaaaaccugugggaaacc

SEQ ID NO: 817959 - RNA, 24 nt, Human
cgccgccccaaaaccugugggaaa

SEQ ID NO: 817960 - RNA, 19 nt, Human
cggacggagggugggggcg

SEQ ID NO: 817961 - RNA, 19 nt, Human
cgggggccggggcggacuu

SEQ ID NO: 817962 - RNA, 21 nt, Human
cggguugggggcgggggccgg

SEQ ID NO: 817963 - RNA, 25 nt, Human
cuaaacaacauguauuauaccguaa

SEQ ID NO: 817964 - RNA, 20 nt, Human
cuccagauggaucccagccc

SEQ ID NO: 817965 - RNA, 18 nt, Human
cucccuccccaucccagg

SEQ ID NO: 817966 - RNA, 23 nt, Human
cuguucucaguccuggucucacu

SEQ ID NO: 817967 - RNA, 19 nt, Human
cuucagugacuaagaaaca

SEQ ID NO: 817968 - RNA, 19 nt, Human
gaacuuaaaaguaaagaaa

SEQ ID NO: 817969 - RNA, 31 nt, Human
gccccaaaaccugugggaaaccccaguccuu

SEQ ID NO: 817970 - RNA, 25 nt, Human
gccgauccgcgucccggccacaaag

SEQ ID NO: 817971 - RNA, 22 nt, Human
gccgggcaggggagagggaguc

SEQ ID NO: 817972 - RNA, 24 nt, Human
gccugcgaccccggaccgugccaa

SEQ ID NO: 817973 - RNA, 20 nt, Human
gcgccugcgaccccggaccg

SEQ ID NO: 817974 - RNA, 22 nt, Human
gcuccagauggaucccagcccc

SEQ ID NO: 817975 - RNA, 20 nt, Human
gcuuacagccaauacuuuaa

SEQ ID NO: 817976 - RNA, 19 nt, Human
ggaccgggaacgggagggg

SEQ ID NO: 817977 - RNA, 24 nt, Human
ggcgggggccggggcggacuucca

SEQ ID NO: 817978 - RNA, 23 nt, Human
gggaaaccccaguccugccaccc

SEQ ID NO: 817979 - RNA, 25 nt, Human
gggacugaauuuguacuccuggucc

SEQ ID NO: 817980 - RNA, 18 nt, Human
gggcaggggagagggagu

SEQ ID NO: 817981 - RNA, 23 nt, Human
gggcgcagcaagccgggcagggg

SEQ ID NO: 817982 - RNA, 19 nt, Human
ggggcgggggccggggcgg

SEQ ID NO: 817983 - RNA, 18 nt, Human
ggguugggggcgggggcc

SEQ ID NO: 817984 - RNA, 24 nt, Human
gguuagccgauuguuuuccaaaua

SEQ ID NO: 817985 - RNA, 22 nt, Human
uaacccaaacauacaaccaucu

SEQ ID NO: 817986 - RNA, 18 nt, Human
uagaaugugggaaugagg

SEQ ID NO: 817987 - RNA, 22 nt, Human
uaggaucuaaagaauaccgggg

SEQ ID NO: 817988 - RNA, 19 nt, Human
uaguuagcauuaacuagua

SEQ ID NO: 817989 - RNA, 24 nt, Human
uaucaagucagcuugcaaauaaau

SEQ ID NO: 817990 - RNA, 25 nt, Human
uaucauaaggcucuccagcacaagg

SEQ ID NO: 817991 - RNA, 22 nt, Human
uauuggacaguaacagauggcu

SEQ ID NO: 817992 - RNA, 18 nt, Human
ucaacauugucuucaugg

SEQ ID NO: 817993 - RNA, 19 nt, Human
ucacagagggccgccgccc

SEQ ID NO: 817994 - RNA, 19 nt, Human
ucagcggcucugugugcug

SEQ ID NO: 817995 - RNA, 19 nt, Human
ucagugacuaagaaacaca

SEQ ID NO: 817996 - RNA, 18 nt, Human
uccaggggcguggcugcg

SEQ ID NO: 817997 - RNA, 22 nt, Human
ucccagccccaaaccucacgcc

SEQ ID NO: 817998 - RNA, 18 nt, Human
ucccaggaaaucccuugc

SEQ ID NO: 817999 - RNA, 21 nt, Human
uccugagcaccgggcccuggg

SEQ ID NO: 818000 - RNA, 19 nt, Human
ucugcaggagcccaggccg

SEQ ID NO: 818001 - RNA, 22 nt, Human
ucuucauguauauaauuauuuc

SEQ ID NO: 818002 - RNA, 24 nt, Human
ugacuaagaaacacaauccuaaac

SEQ ID NO: 818003 - RNA, 26 nt, Human
ugacuaagaaacacaauccuaaacaa

SEQ ID NO: 818004 - RNA, 21 nt, Human
ugcaggagcccaggccggccg

SEQ ID NO: 818005 - RNA, 23 nt, Human
uggcacugucagccauggcucuu

SEQ ID NO: 818006 - RNA, 22 nt, Human
ugggacugaauuuguacuccug

SEQ ID NO: 818007 - RNA, 21 nt, Human
ugguacccuauguuuuccaua

SEQ ID NO: 818008 - RNA, 23 nt, Human
uguaaaaugauauauucuuuuaa

SEQ ID NO: 818009 - RNA, 18 nt, Human
ugucagccauggcucuug

SEQ ID NO: 818010 - RNA, 19 nt, Human
uuccaggggcguggcugcg

SEQ ID NO: 818011 - RNA, 19 nt, Human
uucgagagcccaaaucacc

SEQ ID NO: 818012 - RNA, 20 nt, Human
uucucaguccuggucucacu

SEQ ID NO: 818013 - RNA, 19 nt, Human
uugcucucuucagucguuu

SEQ ID NO: 818014 - RNA, 23 nt, Human
aaaaaacugaacuucuaaacaaa

SEQ ID NO: 818015 - RNA, 22 nt, Human
aaaaaauaaaauuugggcaccc

SEQ ID NO: 818016 - RNA, 21 nt, Human
aaaaauaccaaagcugugcca

SEQ ID NO: 818017 - RNA, 22 nt, Human
aaaacagugcggcuuccaauua

SEQ ID NO: 818018 - RNA, 21 nt, Human
aaaacuacagauuagggacug

SEQ ID NO: 818019 - RNA, 20 nt, Human
aaagacauaauccuuggguc

SEQ ID NO: 818020 - RNA, 26 nt, Human
aacacauaauuuacaugucaaaucca

SEQ ID NO: 818021 - RNA, 23 nt, Human
aagaaccaggucaccuaaagcug

SEQ ID NO: 818022 - RNA, 25 nt, Human
aagcugaacacaacaguaaagccga

SEQ ID NO: 818023 - RNA, 20 nt, Human
aagucuauagaucuauaacc

SEQ ID NO: 818024 - RNA, 18 nt, Human
aauacauucccaaauccu

SEQ ID NO: 818025 - RNA, 25 nt, Human
aauagagaaaaaauaccaaagcugg

SEQ ID NO: 818026 - RNA, 20 nt, Human
aauagcuauaaaucaauucu

SEQ ID NO: 818027 - RNA, 21 nt, Human
aauucucugacuacuaagaaa

SEQ ID NO: 818028 - RNA, 18 nt, Human
aauuuguaucucuuccuu

SEQ ID NO: 818029 - RNA, 23 nt, Human
acacacacacacacacacacaca

SEQ ID NO: 818030 - RNA, 23 nt, Human
acacacacacacacacacacaca

SEQ ID NO: 818031 - RNA, 23 nt, Human
acacacacacacacacacacaca

SEQ ID NO: 818032 - RNA, 23 nt, Human
acacacacacacacacacacaca

SEQ ID NO: 818033 - RNA, 23 nt, Human
acacuaaaagacaucaaaggaag

SEQ ID NO: 818034 - RNA, 23 nt, Human
accaaaggaagaaaauaaaaaca

SEQ ID NO: 818035 - RNA, 24 nt, Human
accaaaggaagaaaauaaaaacaa

SEQ ID NO: 818036 - RNA, 22 nt, Human
accugugguugcaaaauuguuu

SEQ ID NO: 818037 - RNA, 24 nt, Human
acgcaacuucggagcuuggaaggg

SEQ ID NO: 818038 - RNA, 20 nt, Human
acuuagagacauaguccaaa

SEQ ID NO: 818039 - RNA, 24 nt, Human
agaaaauaaaaacaacucagauac

SEQ ID NO: 818040 - RNA, 22 nt, Human
agaauggaagugcuuuuaaaug

SEQ ID NO: 818041 - RNA, 24 nt, Human
agacaaauguacucuauagucaga

SEQ ID NO: 818042 - RNA, 25 nt, Human
agacaaauguacucuauagucagaa

SEQ ID NO: 818043 - RNA, 18 nt, Human
agacauaguccaaauccc

SEQ ID NO: 818044 - RNA, 22 nt, Human
agagaagaauggucaaggcuaa

SEQ ID NO: 818045 - RNA, 20 nt, Human
agagagaaagaaguaaccaa

SEQ ID NO: 818046 - RNA, 22 nt, Human
agccaaaauuauuuacaaacug

SEQ ID NO: 818047 - RNA, 20 nt, Human
agcccuuguucaaacagcuc

SEQ ID NO: 818048 - RNA, 19 nt, Human
agcuuaacaaauguaaaac

SEQ ID NO: 818049 - RNA, 25 nt, Human
aggaagaaaauaaaaacaacucaga

SEQ ID NO: 818050 - RNA, 20 nt, Human
agggacugaccaaaacaaaa

SEQ ID NO: 818051 - RNA, 19 nt, Human
aggggcagggaaggaaugg

SEQ ID NO: 818052 - RNA, 21 nt, Human
agucugagcuuacugauccug

SEQ ID NO: 818053 - RNA, 24 nt, Human
aguucuuaugaauaccuucauaaa

SEQ ID NO: 818054 - RNA, 18 nt, Human
aguuuggauuuugugaaa

SEQ ID NO: 818055 - RNA, 22 nt, Human
aguuuggauuuugugaaauagg

SEQ ID NO: 818056 - RNA, 19 nt, Human
auagccauaaacaaaucuc

SEQ ID NO: 818057 - RNA, 20 nt, Human
augaaauggaagauaguauc

SEQ ID NO: 818058 - RNA, 22 nt, Human
augcagaucauaauucugaguu

SEQ ID NO: 818059 - RNA, 20 nt, Human
caaaacuaucuagggcccac

SEQ ID NO: 818060 - RNA, 20 nt, Human
caaauaugguuaaacauugg

SEQ ID NO: 818061 - RNA, 20 nt, Human
caaggccccaaacucuugac

SEQ ID NO: 818062 - RNA, 18 nt, Human
caaggcccuggcuccauu

SEQ ID NO: 818063 - RNA, 22 nt, Human
caaucacugccuuucacagaau

SEQ ID NO: 818064 - RNA, 19 nt, Human
cacaaaacagagcaacauc

SEQ ID NO: 818065 - RNA, 18 nt, Human
cacaaaguugagacaaga

SEQ ID NO: 818066 - RNA, 20 nt, Human
cacacacacacacacacaca

SEQ ID NO: 818067 - RNA, 20 nt, Human
cacacacacacacacacaca

SEQ ID NO: 818068 - RNA, 20 nt, Human
cacacacacacacacacaca

SEQ ID NO: 818069 - RNA, 20 nt, Human
cacacacacacacacacaca

SEQ ID NO: 818070 - RNA, 20 nt, Human
cacacacacacacacacaca

SEQ ID NO: 818071 - RNA, 20 nt, Human
cacacacacacacacacaca

SEQ ID NO: 818072 - RNA, 20 nt, Human
cacacacacacacacacaca

SEQ ID NO: 818073 - RNA, 20 nt, Human
cacacacacacacacacaca

SEQ ID NO: 818074 - RNA, 20 nt, Human
cacacacacacacacacaca

SEQ ID NO: 818075 - RNA, 22 nt, Human
cacacacacacacacacacaca

SEQ ID NO: 818076 - RNA, 22 nt, Human
cacacacacacacacacacaca

SEQ ID NO: 818077 - RNA, 22 nt, Human
cacacacacacacacacacaca

SEQ ID NO: 818078 - RNA, 22 nt, Human
cacacacacacacacacacaca

SEQ ID NO: 818079 - RNA, 21 nt, Human
cacagaaucacgcaacuucgg

SEQ ID NO: 818080 - RNA, 18 nt, Human
caccgugguggacccugg

SEQ ID NO: 818081 - RNA, 20 nt, Human
cagaaaauacuaaguauuau

SEQ ID NO: 818082 - RNA, 19 nt, Human
cagaacauuccaaaauuca

SEQ ID NO: 818083 - RNA, 25 nt, Human
cagaacauuccaaaauucaaacuaa

SEQ ID NO: 818084 - RNA, 22 nt, Human
cagcaauguggguaccuguggu

SEQ ID NO: 818085 - RNA, 23 nt, Human
caggccuagcuuucaacaaauaa

SEQ ID NO: 818086 - RNA, 19 nt, Human
cauccugacuauugguucc

SEQ ID NO: 818087 - RNA, 20 nt, Human
caugaugguguccaugccuu

SEQ ID NO: 818088 - RNA, 19 nt, Human
caugggguccagguuaugu

SEQ ID NO: 818089 - RNA, 18 nt, Human
ccaaaagacauaauccuu

SEQ ID NO: 818090 - RNA, 21 nt, Human
ccaaaucccaagcugaacaca

SEQ ID NO: 818091 - RNA, 23 nt, Human
ccauuauccucgguaguagccca

SEQ ID NO: 818092 - RNA, 25 nt, Human
cccuucagaauacaggcaaugccaa

SEQ ID NO: 818093 - RNA, 18 nt, Human
ccugaaaggcauguaaga

SEQ ID NO: 818094 - RNA, 19 nt, Human
ccugaaaggcauguaagag

SEQ ID NO: 818095 - RNA, 21 nt, Human
ccuuaaacaugauggugucca

SEQ ID NO: 818096 - RNA, 19 nt, Human
ccuugggucugagugaggg

SEQ ID NO: 818097 - RNA, 19 nt, Human
ccuugggucugagugaggg

SEQ ID NO: 818098 - RNA, 20 nt, Human
ccuuugagacucugccuccu

SEQ ID NO: 818099 - RNA, 23 nt, Human
cggccaaauuuagccagcccuug

SEQ ID NO: 818100 - RNA, 20 nt, Human
cguccacuuuacugaguaac

SEQ ID NO: 818101 - RNA, 19 nt, Human
cuaaaccauauuaauuauc

SEQ ID NO: 818102 - RNA, 18 nt, Human
cuagacuuccucugugcu

SEQ ID NO: 818103 - RNA, 22 nt, Human
cucaaggaauuaaaaauaaaac

SEQ ID NO: 818104 - RNA, 25 nt, Human
cucaggaugaugggagccccaaaag

SEQ ID NO: 818105 - RNA, 20 nt, Human
cuccccaaaucacaaaguug

SEQ ID NO: 818106 - RNA, 19 nt, Human
cucccuuagacuggauaca

SEQ ID NO: 818107 - RNA, 22 nt, Human
cuccugaacuuccuguaucaua

SEQ ID NO: 818108 - RNA, 21 nt, Human
cugaccuccauuauagauuca

SEQ ID NO: 818109 - RNA, 20 nt, Human
cugacuugcgacuggauggc

SEQ ID NO: 818110 - RNA, 19 nt, Human
cugcugacuugcgacugga

SEQ ID NO: 818111 - RNA, 24 nt, Human
cuugaacuggaaacugaagauaau

SEQ ID NO: 818112 - RNA, 24 nt, Human
cuuuaaguccuuuaguccuuucuc

SEQ ID NO: 818113 - RNA, 21 nt, Human
gaagacuaaaacaaaccacug

SEQ ID NO: 818114 - RNA, 22 nt, Human
gaaguuuuccuaaauaccauau

SEQ ID NO: 818115 - RNA, 18 nt, Human
gacuuagagacauagucc

SEQ ID NO: 818116 - RNA, 23 nt, Human
gacuugcgacuggauggcuucaa

SEQ ID NO: 818117 - RNA, 20 nt, Human
gagaaagcagaauuuggggg

SEQ ID NO: 818118 - RNA, 26 nt, Human
gagaaagcagaauuugggggaauagc

SEQ ID NO: 818119 - RNA, 22 nt, Human
gagucugagcuuacugauccug

SEQ ID NO: 818120 - RNA, 20 nt, Human
gauauuuuuauuuuuuccug

SEQ ID NO: 818121 - RNA, 21 nt, Human
gaugaugggagccccaaaaga

SEQ ID NO: 818122 - RNA, 21 nt, Human
gcaaaacuaucuagggcccac

SEQ ID NO: 818123 - RNA, 18 nt, Human
gcaaaggcuucuccaagg

SEQ ID NO: 818124 - RNA, 21 nt, Human
ggaagagaaaugggaggaagg

SEQ ID NO: 818125 - RNA, 23 nt, Human
gggagccccaaaagacauaaucc

SEQ ID NO: 818126 - RNA, 18 nt, Human
gggaggaagguaaugcag

SEQ ID NO: 818127 - RNA, 22 nt, Human
gugaaauagagaaaaaauacca

SEQ ID NO: 818128 - RNA, 21 nt, Human
gugaugaugaaggaaaggguu

SEQ ID NO: 818129 - RNA, 20 nt, Human
gugauuuucuggaaauauug

SEQ ID NO: 818130 - RNA, 25 nt, Human
uaaaaauaaaacugaugaagcucac

SEQ ID NO: 818131 - RNA, 21 nt, Human
uaaaacaaaccacugccuccu

SEQ ID NO: 818132 - RNA, 20 nt, Human
uaaaacacacacacacacac

SEQ ID NO: 818133 - RNA, 21 nt, Human
uaaaauauacuuuacaagaca

SEQ ID NO: 818134 - RNA, 27 nt, Human
uaaaaugcagguauuuacaacauuuuu

SEQ ID NO: 818135 - RNA, 27 nt, Human
uaaacaaaucucagcagaauauaugga

SEQ ID NO: 818136 - RNA, 19 nt, Human
uaaacauuauuaaaggcag

SEQ ID NO: 818137 - RNA, 20 nt, Human
uaaauacagacauauacaac

SEQ ID NO: 818138 - RNA, 26 nt, Human
uaacacuaaaagacaucaaaggaagu

SEQ ID NO: 818139 - RNA, 21 nt, Human
uaacuugaacuggaaacugaa

SEQ ID NO: 818140 - RNA, 23 nt, Human
uaagaaguuaaguuagacuucag

SEQ ID NO: 818141 - RNA, 26 nt, Human
uaagauggcaaaacuaucuagggccc

SEQ ID NO: 818142 - RNA, 27 nt, Human
uaagauggcaaaacuaucuagggccca

SEQ ID NO: 818143 - RNA, 20 nt, Human
uaaguggacucacaauugaa

SEQ ID NO: 818144 - RNA, 21 nt, Human
uacaaacaaagcaaaauauag

SEQ ID NO: 818145 - RNA, 25 nt, Human
uacagauuagggacugaccaaaaca

SEQ ID NO: 818146 - RNA, 22 nt, Human
uacauuaaaaaaguucacugac

SEQ ID NO: 818147 - RNA, 23 nt, Human
uaccugugguugcaaaauuguuu

SEQ ID NO: 818148 - RNA, 23 nt, Human
uacuucacuguuuauccuaagug

SEQ ID NO: 818149 - RNA, 23 nt, Human
uagaaaagaagucaaaaacuaca

SEQ ID NO: 818150 - RNA, 20 nt, Human
uagagcucuuggcauaauca

SEQ ID NO: 818151 - RNA, 23 nt, Human
uagaucuauaaccguggaaacug

SEQ ID NO: 818152 - RNA, 22 nt, Human
uagcugagaaaauggcauaucu

SEQ ID NO: 818153 - RNA, 23 nt, Human
uaggagauaccacaauggaacau

SEQ ID NO: 818154 - RNA, 20 nt, Human
uagggacugaccaaaacaaa

SEQ ID NO: 818155 - RNA, 19 nt, Human
uaguagcccaaggcuggua

SEQ ID NO: 818156 - RNA, 22 nt, Human
uaguaggcaguagaaaaaaagu

SEQ ID NO: 818157 - RNA, 18 nt, Human
uaguaguaggcaguagaa

SEQ ID NO: 818158 - RNA, 20 nt, Human
uauacugucaaaaaaauggg

SEQ ID NO: 818159 - RNA, 25 nt, Human
uaugaaacaggaauauaaacuauga

SEQ ID NO: 818160 - RNA, 22 nt, Human
uaugaauaccuucauaaacacc

SEQ ID NO: 818161 - RNA, 26 nt, Human
uauggaaagaauggaagugcuuuuaa

SEQ ID NO: 818162 - RNA, 22 nt, Human
uauuaucauuugccucuuucuc

SEQ ID NO: 818163 - RNA, 20 nt, Human
uauucuucauuggcuauuga

SEQ ID NO: 818164 - RNA, 21 nt, Human
ucaaaggaagucaaugugaua

SEQ ID NO: 818165 - RNA, 24 nt, Human
ucacagaacauuccaaaauucaaa

SEQ ID NO: 818166 - RNA, 20 nt, Human
ucagaauacaggcaaugcca

SEQ ID NO: 818167 - RNA, 22 nt, Human
ucaggaugaugggagccccaaa

SEQ ID NO: 818168 - RNA, 19 nt, Human
ucaucugugaugucuacuu

SEQ ID NO: 818169 - RNA, 22 nt, Human
uccagggcauccugacuauugg

SEQ ID NO: 818170 - RNA, 25 nt, Human
uccaucacccaaauucaucaguauu

SEQ ID NO: 818171 - RNA, 18 nt, Human
ucccaaauccugaaaggc

SEQ ID NO: 818172 - RNA, 23 nt, Human
uccccaaaucacaaaguugagac

SEQ ID NO: 818173 - RNA, 25 nt, Human
uccccaaaucacaaaguugagacaa

SEQ ID NO: 818174 - RNA, 25 nt, Human
uccucgguaguagcccaaggcuggu

SEQ ID NO: 818175 - RNA, 22 nt, Human
uccuggauggaguggcaaaggc

SEQ ID NO: 818176 - RNA, 18 nt, Human
uccuugagauccucgcaa

SEQ ID NO: 818177 - RNA, 20 nt, Human
uccuugggucugagugaggg

SEQ ID NO: 818178 - RNA, 18 nt, Human
ucucaaggccccaaacuc

SEQ ID NO: 818179 - RNA, 18 nt, Human
ucugggguguuugagaag

SEQ ID NO: 818180 - RNA, 18 nt, Human
ucuugucaugccucuccu

SEQ ID NO: 818181 - RNA, 22 nt, Human
ugaaaaaaaaaauaaaauuugg

SEQ ID NO: 818182 - RNA, 19 nt, Human
ugaaacaggaauauaaacu

SEQ ID NO: 818183 - RNA, 19 nt, Human
ugaaaggcauguaagaguu

SEQ ID NO: 818184 - RNA, 19 nt, Human
ugaaauaggagauaccaca

SEQ ID NO: 818185 - RNA, 20 nt, Human
ugaauaccuucauaaacacc

SEQ ID NO: 818186 - RNA, 18 nt, Human
ugagaaaauggcauaucu

SEQ ID NO: 818187 - RNA, 23 nt, Human
ugaggaaacaggucaaaaggaag

SEQ ID NO: 818188 - RNA, 27 nt, Human
ugaggagcaugggguccagguuaugug

SEQ ID NO: 818189 - RNA, 21 nt, Human
ugauuugguguuucuuuaucc

SEQ ID NO: 818190 - RNA, 25 nt, Human
ugcaugucacagaccucaaccccac

SEQ ID NO: 818191 - RNA, 21 nt, Human
ugccuuugucccuuuaucuuc

SEQ ID NO: 818192 - RNA, 20 nt, Human
uggaaagaauggaagugcuu

SEQ ID NO: 818193 - RNA, 24 nt, Human
uggaaauauugcaaaauacauuaa

SEQ ID NO: 818194 - RNA, 20 nt, Human
uggaggaagagagaaagaag

SEQ ID NO: 818195 - RNA, 18 nt, Human
uggcauaucuuaugauac

SEQ ID NO: 818196 - RNA, 21 nt, Human
ugggaaauggagaggaaagaa

SEQ ID NO: 818197 - RNA, 26 nt, Human
ugggaggaagguaaugcagaggagaa

SEQ ID NO: 818198 - RNA, 18 nt, Human
ugggaucagcacgucccc

SEQ ID NO: 818199 - RNA, 21 nt, Human
uggguugagagcugcagaggu

SEQ ID NO: 818200 - RNA, 18 nt, Human
uggucccaaguaauccuu

SEQ ID NO: 818201 - RNA, 20 nt, Human
uguaaaacacacacacacac

SEQ ID NO: 818202 - RNA, 22 nt, Human
uguaaaacagugcggcuuccaa

SEQ ID NO: 818203 - RNA, 18 nt, Human
ugucucauagacaucaua

SEQ ID NO: 818204 - RNA, 23 nt, Human
ugucucuagcucaggaugauggg

SEQ ID NO: 818205 - RNA, 23 nt, Human
ugugcaauaacaaagacagaauc

SEQ ID NO: 818206 - RNA, 20 nt, Human
uguuuuaagaauaugacaaa

SEQ ID NO: 818207 - RNA, 24 nt, Human
uguuuugugagcacaaaacagagc

SEQ ID NO: 818208 - RNA, 21 nt, Human
uuccaauacuccuuauucuuc

SEQ ID NO: 818209 - RNA, 18 nt, Human
uuccucugugcuucuaca

SEQ ID NO: 818210 - RNA, 18 nt, Human
uucuucugggguguuuga

SEQ ID NO: 818211 - RNA, 24 nt, Human
uugaagauuauggccggucuucug

SEQ ID NO: 818212 - RNA, 19 nt, Human
uugaagccacagucuccuc

SEQ ID NO: 818213 - RNA, 22 nt, Human
uugaagccacagucuccucugu

SEQ ID NO: 818214 - RNA, 20 nt, Human
uugaagcuaauuauuuuaug

SEQ ID NO: 818215 - RNA, 23 nt, Human
uuguuuuauaagcuauacuucac

SEQ ID NO: 818216 - RNA, 20 nt, Human
uuuacaggccuagcuuucaa

SEQ ID NO: 818217 - RNA, 22 nt, Human
uuucacagaaucacgcaacuuc

SEQ ID NO: 818218 - RNA, 22 nt, Human
uuuguaggagaguguaccccug

SEQ ID NO: 818219 - RNA, 21 nt, Human
uuugucccuuuaucuucauuu

SEQ ID NO: 818220 - RNA, 21 nt, Human
aaaacuuacuagcaaaaaucu

SEQ ID NO: 818221 - RNA, 27 nt, Human
aaacagaaauagaggagucaaaagcaa

SEQ ID NO: 818222 - RNA, 20 nt, Human
aaacagaaauagaggagucc

SEQ ID NO: 818223 - RNA, 21 nt, Human
aaagagcaaaccugaaaugcu

SEQ ID NO: 818224 - RNA, 22 nt, Human
aaaggaccuugaaggccaccgg

SEQ ID NO: 818225 - RNA, 23 nt, Human
aagaggcagaauaaugagagaua

SEQ ID NO: 818226 - RNA, 22 nt, Human
aagauugugagcagggaaguga

SEQ ID NO: 818227 - RNA, 21 nt, Human
aagcuucauuaugaaacacaa

SEQ ID NO: 818228 - RNA, 24 nt, Human
aaguaagaggcagaauaaugagag

SEQ ID NO: 818229 - RNA, 20 nt, Human
aauauauggcaaacaauaua

SEQ ID NO: 818230 - RNA, 18 nt, Human
aaucaugguuuuaacuuu

SEQ ID NO: 818231 - RNA, 26 nt, Human
accaugacaaccaaaaauaaaauaac

SEQ ID NO: 818232 - RNA, 21 nt, Human
accugcaauucuguacagcau

SEQ ID NO: 818233 - RNA, 25 nt, Human
acgaauuagaaacaauuguguuuua

SEQ ID NO: 818234 - RNA, 23 nt, Human
acgggcacguauuaacccagagc

SEQ ID NO: 818235 - RNA, 20 nt, Human
agaaaucaaacauguuucca

SEQ ID NO: 818236 - RNA, 25 nt, Human
agaauauauaugccagaaauaccaa

SEQ ID NO: 818237 - RNA, 25 nt, Human
agaugaauucaccauucagaaguaa

SEQ ID NO: 818238 - RNA, 22 nt, Human
agcaucaaggggauuugcuguu

SEQ ID NO: 818239 - RNA, 25 nt, Human
aggaagaaaauuaaaauuugaagac

SEQ ID NO: 818240 - RNA, 19 nt, Human
aggaaggaauaccaguggc

SEQ ID NO: 818241 - RNA, 18 nt, Human
aggagucaaaagcaacuu

SEQ ID NO: 818242 - RNA, 20 nt, Human
aggauccauaaaaagaguga

SEQ ID NO: 818243 - RNA, 20 nt, Human
agggaugguagaguuugugg

SEQ ID NO: 818244 - RNA, 24 nt, Human
aggggagcucucuggggcagaggg

SEQ ID NO: 818245 - RNA, 23 nt, Human
agguugaaguugcauuaacugag

SEQ ID NO: 818246 - RNA, 23 nt, Human
agguuguagauucuucccuacag

SEQ ID NO: 818247 - RNA, 20 nt, Human
aguuuaaugaauguguauug

SEQ ID NO: 818248 - RNA, 24 nt, Human
auaauaggguaaguaagaggcaga

SEQ ID NO: 818249 - RNA, 18 nt, Human
auaaugcugugcaggguc

SEQ ID NO: 818250 - RNA, 24 nt, Human
auagcaguuuaauuacaacaaaag

SEQ ID NO: 818251 - RNA, 19 nt, Human
augaaacacaaugacuaca

SEQ ID NO: 818252 - RNA, 20 nt, Human
auggaaaaacaaaagcguag

SEQ ID NO: 818253 - RNA, 20 nt, Human
augugugugugugugcaugu

SEQ ID NO: 818254 - RNA, 22 nt, Human
caaaacacuaaagcaggaacuu

SEQ ID NO: 818255 - RNA, 22 nt, Human
cagaaaaaaaaaugcccugaua

SEQ ID NO: 818256 - RNA, 25 nt, Human
cagaaauaccaaaugaacaaaacug

SEQ ID NO: 818257 - RNA, 23 nt, Human
cagggucuuuuuaccuuaguaag

SEQ ID NO: 818258 - RNA, 20 nt, Human
cagucaaaaugauuaauccu

SEQ ID NO: 818259 - RNA, 21 nt, Human
cauaaaggaccuugaaggcca

SEQ ID NO: 818260 - RNA, 19 nt, Human
cauagaaaaugaaaaugac

SEQ ID NO: 818261 - RNA, 19 nt, Human
caucaagaaaaguuaugac

SEQ ID NO: 818262 - RNA, 18 nt, Human
cauggcuuggaggacaug

SEQ ID NO: 818263 - RNA, 19 nt, Human
caugugugugugugugcau

SEQ ID NO: 818264 - RNA, 24 nt, Human
caugugugugugugugcaugugua

SEQ ID NO: 818265 - RNA, 18 nt, Human
ccaaguuugcugugagug

SEQ ID NO: 818266 - RNA, 26 nt, Human
ccaauuaacccuaugacaugagugca

SEQ ID NO: 818267 - RNA, 25 nt, Human
ccacuuuuccucucaaauuucucuu

SEQ ID NO: 818268 - RNA, 23 nt, Human
ccagaaauaccaaaugaacaaaa

SEQ ID NO: 818269 - RNA, 19 nt, Human
ccaucugaagauuguuuaa

SEQ ID NO: 818270 - RNA, 20 nt, Human
ccucagaaaaaaaaaugccc

SEQ ID NO: 818271 - RNA, 30 nt, Human
ccuucuagggcaugugaugggcauguuugg

SEQ ID NO: 818272 - RNA, 22 nt, Human
ccuucucuuuuuugaauucaca

SEQ ID NO: 818273 - RNA, 26 nt, Human
ccuucuuuccaaguuugcugugagug

SEQ ID NO: 818274 - RNA, 23 nt, Human
cuauagagugaagagaaaaggga

SEQ ID NO: 818275 - RNA, 20 nt, Human
cuccuggcccuucuugguuu

SEQ ID NO: 818276 - RNA, 19 nt, Human
cugauaauauuucauaaug

SEQ ID NO: 818277 - RNA, 22 nt, Human
cuuaaagcaaacacaauuuguu

SEQ ID NO: 818278 - RNA, 29 nt, Human
cuucuagggcaugugaugggcauguuugg

SEQ ID NO: 818279 - RNA, 21 nt, Human
cuuugaguucucucacaguga

SEQ ID NO: 818280 - RNA, 20 nt, Human
cuuuugucuuacauccuucu

SEQ ID NO: 818281 - RNA, 23 nt, Human
gaaauaccaaaugaacaaaacug

SEQ ID NO: 818282 - RNA, 18 nt, Human
gaacaaaacugacaaagc

SEQ ID NO: 818283 - RNA, 22 nt, Human
gaagaaaauuaaaauuugaaga

SEQ ID NO: 818284 - RNA, 19 nt, Human
gaaggcagaugggagaagg

SEQ ID NO: 818285 - RNA, 23 nt, Human
gaaggcagaugggagaaggguuu

SEQ ID NO: 818286 - RNA, 18 nt, Human
gcaaucaaaucacuggcc

SEQ ID NO: 818287 - RNA, 21 nt, Human
ggaaaaacaaaagcguagagg

SEQ ID NO: 818288 - RNA, 18 nt, Human
ggaacaaaacacuaaagc

SEQ ID NO: 818289 - RNA, 23 nt, Human
ggaagguugaaguugcauuaacu

SEQ ID NO: 818290 - RNA, 18 nt, Human
ggaccuugaaggccaccg

SEQ ID NO: 818291 - RNA, 20 nt, Human
ggauagggaaggcagauggg

SEQ ID NO: 818292 - RNA, 20 nt, Human
guaaacaaauuaaauguuag

SEQ ID NO: 818293 - RNA, 22 nt, Human
guaaagaugaggaccaaagaag

SEQ ID NO: 818294 - RNA, 23 nt, Human
uaaaauuuuuagauacuggagca

SEQ ID NO: 818295 - RNA, 18 nt, Human
uaacaaagcaauaagugg

SEQ ID NO: 818296 - RNA, 18 nt, Human
uaaccuccaauuaacccu

SEQ ID NO: 818297 - RNA, 21 nt, Human
uaacugagauggagaagacca

SEQ ID NO: 818298 - RNA, 18 nt, Human
uagaaaaagguagaauug

SEQ ID NO: 818299 - RNA, 25 nt, Human
uaggaagaaaauuaaaauuugaaga

SEQ ID NO: 818300 - RNA, 24 nt, Human
uaguaaggagaagaggaaaugagg

SEQ ID NO: 818301 - RNA, 24 nt, Human
uaugccagaaauaccaaaugaaca

SEQ ID NO: 818302 - RNA, 24 nt, Human
ucaaaagcaacuuucaguuuuuga

SEQ ID NO: 818303 - RNA, 19 nt, Human
ucaauggacuugagaggcu

SEQ ID NO: 818304 - RNA, 18 nt, Human
ucacacuguaaacaguuc

SEQ ID NO: 818305 - RNA, 21 nt, Human
ucacggauucacagagagcuc

SEQ ID NO: 818306 - RNA, 20 nt, Human
ucagcuuugaugggguagcu

SEQ ID NO: 818307 - RNA, 20 nt, Human
uccagaaaauuagaguccau

SEQ ID NO: 818308 - RNA, 22 nt, Human
ucgaagugcugcggauuagacu

SEQ ID NO: 818309 - RNA, 22 nt, Human
ucuguaaaggcuccaugaauuc

SEQ ID NO: 818310 - RNA, 21 nt, Human
ucuuccauccuaauaauuuuu

SEQ ID NO: 818311 - RNA, 20 nt, Human
ucuugggagccauaauaggg

SEQ ID NO: 818312 - RNA, 25 nt, Human
ucuuuggggaacaggauaccagcgg

SEQ ID NO: 818313 - RNA, 21 nt, Human
ugaaacagaaauagaggaguc

SEQ ID NO: 818314 - RNA, 20 nt, Human
ugaaaugcuccagguuguag

SEQ ID NO: 818315 - RNA, 24 nt, Human
ugaacaaaacugacaaagccccug

SEQ ID NO: 818316 - RNA, 23 nt, Human
ugacacaaucaaauucaugguua

SEQ ID NO: 818317 - RNA, 25 nt, Human
ugacauacucccaccucagaaaaaa

SEQ ID NO: 818318 - RNA, 25 nt, Human
ugacauacucccaccucagaaaaaa

SEQ ID NO: 818319 - RNA, 20 nt, Human
ugaccugcccuuuugaagca

SEQ ID NO: 818320 - RNA, 24 nt, Human
ugagaaaagauuguucaagacaag

SEQ ID NO: 818321 - RNA, 24 nt, Human
ugagaaaaucucuuucacuggcau

SEQ ID NO: 818322 - RNA, 19 nt, Human
ugagauggagaagaccaac

SEQ ID NO: 818323 - RNA, 21 nt, Human
ugagauggagaagaccacaga

SEQ ID NO: 818324 - RNA, 23 nt, Human
ugauaagauaauauuugaacuga

SEQ ID NO: 818325 - RNA, 18 nt, Human
ugcaugugugugugugug

SEQ ID NO: 818326 - RNA, 24 nt, Human
uggaagguugaaguugcauuaacu

SEQ ID NO: 818327 - RNA, 18 nt, Human
uggagcacagcacugaaa

SEQ ID NO: 818328 - RNA, 21 nt, Human
uggcccuucuugguuucuuga

SEQ ID NO: 818329 - RNA, 21 nt, Human
uggggaacaggauaccagcgg

SEQ ID NO: 818330 - RNA, 22 nt, Human
ugguguggacguguagaggggu

SEQ ID NO: 818331 - RNA, 20 nt, Human
ugguuaacagaaucacuaug

SEQ ID NO: 818332 - RNA, 19 nt, Human
ugugcauguguauguaugu

SEQ ID NO: 818333 - RNA, 19 nt, Human
ugugcauguguauguaugu

SEQ ID NO: 818334 - RNA, 19 nt, Human
ugugugcauguguauguau

SEQ ID NO: 818335 - RNA, 23 nt, Human
ugugugugcauguguauguaugu

SEQ ID NO: 818336 - RNA, 21 nt, Human
ugugugugugcauguguaugu

SEQ ID NO: 818337 - RNA, 22 nt, Human
ugugugugugcauguguaugua

SEQ ID NO: 818338 - RNA, 20 nt, Human
ugugugugugugugcaugug

SEQ ID NO: 818339 - RNA, 25 nt, Human
uguucugucuccuuuccuccugucc

SEQ ID NO: 818340 - RNA, 21 nt, Human
uuaaaacuuucaauucagcaa

SEQ ID NO: 818341 - RNA, 23 nt, Human
uuaacugagauggagaagaccac

SEQ ID NO: 818342 - RNA, 26 nt, Human
uucacuggcaucaucuaccaagauga

SEQ ID NO: 818343 - RNA, 24 nt, Human
uucaguuuccaguuaaaaccccca

SEQ ID NO: 818344 - RNA, 24 nt, Human
uucaugguuaacagaaucacuaug

SEQ ID NO: 818345 - RNA, 19 nt, Human
uucccauuucuccuggccc

SEQ ID NO: 818346 - RNA, 18 nt, Human
uucuguuguuuaauagua

SEQ ID NO: 818347 - RNA, 22 nt, Human
uugaguucucucacagugaucg

SEQ ID NO: 818348 - RNA, 21 nt, Human
uuuaagauuuuacugaccauc

SEQ ID NO: 818349 - RNA, 22 nt, Human
uuucaaguucagcuuugauggg

SEQ ID NO: 818350 - RNA, 20 nt, Human
uuucccauuucuccuggccc

SEQ ID NO: 818351 - RNA, 22 nt, Human
uuucuaguguuggauguuuugu

SEQ ID NO: 818352 - RNA, 22 nt, Human
uuugaagacaaaguuuuuggaa

SEQ ID NO: 818353 - RNA, 22 nt, Human
uuugaccugagcaucuggaagg

SEQ ID NO: 818354 - RNA, 23 nt, Human
uuugaccugagcaucuggaaggu

SEQ ID NO: 818355 - RNA, 24 nt, Human
uuuuacugaccaucagaaaguguc

SEQ ID NO: 818356 - RNA, 22 nt, Human
aaaaaaaaaaaaaaaggcacag

SEQ ID NO: 818357 - RNA, 22 nt, Human
aaaaaaaaaggcacagucccua

SEQ ID NO: 818358 - RNA, 18 nt, Human
aaaaaggcacagucccua

SEQ ID NO: 818359 - RNA, 22 nt, Human
aacagaacccugcacccaacag

SEQ ID NO: 818360 - RNA, 20 nt, Human
aacuauggucuucaagacag

SEQ ID NO: 818361 - RNA, 27 nt, Human
aagacagaggcucaguccuuccugaga

SEQ ID NO: 818362 - RNA, 23 nt, Human
aagagcgaaacuuugucucaaaa

SEQ ID NO: 818363 - RNA, 18 nt, Human
aagcaggagaggcaacaa

SEQ ID NO: 818364 - RNA, 25 nt, Human
aaggagacuagaccaggccaggcgc

SEQ ID NO: 818365 - RNA, 21 nt, Human
aaggucccaggcgauuuuuuu

SEQ ID NO: 818366 - RNA, 21 nt, Human
aaggugacuggucacaccaag

SEQ ID NO: 818367 - RNA, 20 nt, Human
aagguggaguggaucagggc

SEQ ID NO: 818368 - RNA, 20 nt, Human
aauauggcgaaaccccaucu

SEQ ID NO: 818369 - RNA, 21 nt, Human
aauauggcgaaaccccaucuc

SEQ ID NO: 818370 - RNA, 21 nt, Human
aaucugaugccuguucucccu

SEQ ID NO: 818371 - RNA, 20 nt, Human
acaagagcgaaacuuugucu

SEQ ID NO: 818372 - RNA, 21 nt, Human
acaagagcgaaacuuugucuc

SEQ ID NO: 818373 - RNA, 25 nt, Human
acagugaccucuuugaaagcuuucu

SEQ ID NO: 818374 - RNA, 18 nt, Human
accagccuauucgagucu

SEQ ID NO: 818375 - RNA, 19 nt, Human
accaggacagcccugccaa

SEQ ID NO: 818376 - RNA, 24 nt, Human
accugaggucaggaguucgagacc

SEQ ID NO: 818377 - RNA, 24 nt, Human
accuugucccgcagcugcuccucc

SEQ ID NO: 818378 - RNA, 26 nt, Human
acuggaagacagaggcucaguccuuc

SEQ ID NO: 818379 - RNA, 28 nt, Human
acuuugucucaaaaaaaaaaaaaaaaaa

SEQ ID NO: 818380 - RNA, 22 nt, Human
agacaggccacagugaccucuu

SEQ ID NO: 818381 - RNA, 23 nt, Human
agacccagaggucacccacaacc

SEQ ID NO: 818382 - RNA, 21 nt, Human
agagacuggaagacagaggcu

SEQ ID NO: 818383 - RNA, 23 nt, Human
agagccauggaguuauauaccag

SEQ ID NO: 818384 - RNA, 20 nt, Human
agagggcagggggcagggca

SEQ ID NO: 818385 - RNA, 22 nt, Human
agcauuuugggaggccaaggca

SEQ ID NO: 818386 - RNA, 21 nt, Human
agccacaggcccgugcucagu

SEQ ID NO: 818387 - RNA, 23 nt, Human
agccacaggcccgugcucagucc

SEQ ID NO: 818388 - RNA, 23 nt, Human
agccgggugugguggcacaugcc

SEQ ID NO: 818389 - RNA, 24 nt, Human
agccugaucaauauggcgaaaccc

SEQ ID NO: 818390 - RNA, 18 nt, Human
agcugcagcagguccucc

SEQ ID NO: 818391 - RNA, 18 nt, Human
aggagcgccgcggugggg

SEQ ID NO: 818392 - RNA, 23 nt, Human
aggaguucgagaccagccugauc

SEQ ID NO: 818393 - RNA, 21 nt, Human
aggcaggacaugaugccacau

SEQ ID NO: 818394 - RNA, 22 nt, Human
aggcaggagaaucaauugaacc

SEQ ID NO: 818395 - RNA, 22 nt, Human
aggcaggagaaucaauugaacc

SEQ ID NO: 818396 - RNA, 22 nt, Human
aggcaggagaaucaauugaacc

SEQ ID NO: 818397 - RNA, 24 nt, Human
aggcaggagaaucaauugaaccug

SEQ ID NO: 818398 - RNA, 18 nt, Human
aggcaggcggaucaccug

SEQ ID NO: 818399 - RNA, 26 nt, Human
aggcaggcggaucaccugaggucagg

SEQ ID NO: 818400 - RNA, 18 nt, Human
aggcaggggagagggcag

SEQ ID NO: 818401 - RNA, 22 nt, Human
aggcaggggagagggcaggggg

SEQ ID NO: 818402 - RNA, 23 nt, Human
aggcaggggagagggcagggggc

SEQ ID NO: 818403 - RNA, 19 nt, Human
aggcaugggcacucacacc

SEQ ID NO: 818404 - RNA, 21 nt, Human
aggcaugggcacucacaccug

SEQ ID NO: 818405 - RNA, 23 nt, Human
aggccaggcgcaguggcucaagc

SEQ ID NO: 818406 - RNA, 19 nt, Human
aggcccgccuccuggacag

SEQ ID NO: 818407 - RNA, 24 nt, Human
aggcgcaguggcucaagccuguaa

SEQ ID NO: 818408 - RNA, 20 nt, Human
aggcggagguugcagugagc

SEQ ID NO: 818409 - RNA, 24 nt, Human
aggcggagguugcagugagcugag

SEQ ID NO: 818410 - RNA, 24 nt, Human
aggcugaggcaggagaaucaauug

SEQ ID NO: 818411 - RNA, 20 nt, Human
aggggagagggcagggggca

SEQ ID NO: 818412 - RNA, 24 nt, Human
aggggagagggcagggggcagggc

SEQ ID NO: 818413 - RNA, 19 nt, Human
aguggcucaagccuguaau

SEQ ID NO: 818414 - RNA, 24 nt, Human
auaaccagcacaugacacggugcc

SEQ ID NO: 818415 - RNA, 18 nt, Human
aucagggcgagcguggag

SEQ ID NO: 818416 - RNA, 19 nt, Human
aucaggucugagguugcau

SEQ ID NO: 818417 - RNA, 24 nt, Human
aucaugccauugcacuccagccug

SEQ ID NO: 818418 - RNA, 18 nt, Human
augaaacagaauaucgug

SEQ ID NO: 818419 - RNA, 22 nt, Human
auuauccucacuuuaaaugaaa

SEQ ID NO: 818420 - RNA, 24 nt, Human
auugcacuccagccugggcaacaa

SEQ ID NO: 818421 - RNA, 23 nt, Human
caacaagagcgaaacuuugucuc

SEQ ID NO: 818422 - RNA, 21 nt, Human
caacagaacccugcacccaac

SEQ ID NO: 818423 - RNA, 22 nt, Human
caagaaauacucauuuccuuca

SEQ ID NO: 818424 - RNA, 18 nt, Human
caagacaguucaugaccu

SEQ ID NO: 818425 - RNA, 24 nt, Human
caaggcaggcggaucaccugaggu

SEQ ID NO: 818426 - RNA, 26 nt, Human
caaggcaggcggaucaccugagguca

SEQ ID NO: 818427 - RNA, 21 nt, Human
caagucucaggcucauaaaca

SEQ ID NO: 818428 - RNA, 21 nt, Human
cacaacaaacuuucuacacau

SEQ ID NO: 818429 - RNA, 23 nt, Human
cacaacaaacuuucuacacauug

SEQ ID NO: 818430 - RNA, 23 nt, Human
cacaccaagugucaccaccagcc

SEQ ID NO: 818431 - RNA, 24 nt, Human
cacaccuguaaucucagcauuuug

SEQ ID NO: 818432 - RNA, 27 nt, Human
cacacggucaacacucaagaaauacuc

SEQ ID NO: 818433 - RNA, 21 nt, Human
cacagcaauaucauacacacu

SEQ ID NO: 818434 - RNA, 23 nt, Human
caccugaggucaggaguucgaga

SEQ ID NO: 818435 - RNA, 24 nt, Human
caccuguaaucucagcauuuuggg

SEQ ID NO: 818436 - RNA, 24 nt, Human
cacuccagccugggcaacaagagc

SEQ ID NO: 818437 - RNA, 25 nt, Human
cacuccagccugggcaacaagagcg

SEQ ID NO: 818438 - RNA, 24 nt, Human
cagcauuuugggaggccaaggcag

SEQ ID NO: 818439 - RNA, 25 nt, Human
cagcauuuugggaggccaaggcagg

SEQ ID NO: 818440 - RNA, 24 nt, Human
cagcuacuugggaggcugaggcag

SEQ ID NO: 818441 - RNA, 21 nt, Human
caggacagcugugucugccag

SEQ ID NO: 818442 - RNA, 21 nt, Human
caggcaggacaugaugccaca

SEQ ID NO: 818443 - RNA, 24 nt, Human
caggcggaucaccugaggucagga

SEQ ID NO: 818444 - RNA, 18 nt, Human
cagggggcagggcacaag

SEQ ID NO: 818445 - RNA, 18 nt, Human
caggucuuggcugugcuc

SEQ ID NO: 818446 - RNA, 20 nt, Human
cagucccaggcccgccuccu

SEQ ID NO: 818447 - RNA, 19 nt, Human
cagucguuuugugcugagu

SEQ ID NO: 818448 - RNA, 25 nt, Human
cauaaccagcacaugacacggugcc

SEQ ID NO: 818449 - RNA, 24 nt, Human
caugccuguaaucccagcuacuug

SEQ ID NO: 818450 - RNA, 21 nt, Human
cauggucucaugcuacuagaa

SEQ ID NO: 818451 - RNA, 19 nt, Human
cauugcacuccagccuggg

SEQ ID NO: 818452 - RNA, 21 nt, Human
cauugcacuccagccugggca

SEQ ID NO: 818453 - RNA, 22 nt, Human
cauugcacuccagccugggcaa

SEQ ID NO: 818454 - RNA, 23 nt, Human
cauugcacuccagccugggcaac

SEQ ID NO: 818455 - RNA, 24 nt, Human
cauugcacuccagccugggcaaca

SEQ ID NO: 818456 - RNA, 18 nt, Human
ccacuaccaugacucuag

SEQ ID NO: 818457 - RNA, 20 nt, Human
ccagcacaugacacggugcc

SEQ ID NO: 818458 - RNA, 19 nt, Human
ccagccacaggcccgugcu

SEQ ID NO: 818459 - RNA, 26 nt, Human
ccaggccaggcgcaguggcucaagcc

SEQ ID NO: 818460 - RNA, 25 nt, Human
ccaggcccgccuccugguccccugg

SEQ ID NO: 818461 - RNA, 18 nt, Human
ccagggcugccuuggccc

SEQ ID NO: 818462 - RNA, 19 nt, Human
ccaugccgccucccgcugc

SEQ ID NO: 818463 - RNA, 20 nt, Human
ccauugcacuccagccuggg

SEQ ID NO: 818464 - RNA, 21 nt, Human
ccauugcacuccagccugggc

SEQ ID NO: 818465 - RNA, 23 nt, Human
ccauugcacuccagccugggcaa

SEQ ID NO: 818466 - RNA, 24 nt, Human
ccauugcacuccagccugggcaac

SEQ ID NO: 818467 - RNA, 24 nt, Human
cccauuccauugucaggauuuuac

SEQ ID NO: 818468 - RNA, 18 nt, Human
ccccucccucuccugcca

SEQ ID NO: 818469 - RNA, 21 nt, Human
cccgcagcugcuccuccagcu

SEQ ID NO: 818470 - RNA, 21 nt, Human
cccuauaucccagggcccuga

SEQ ID NO: 818471 - RNA, 19 nt, Human
cccuccagguaggccugca

SEQ ID NO: 818472 - RNA, 22 nt, Human
cccugagacccagaggucaccc

SEQ ID NO: 818473 - RNA, 20 nt, Human
cccugagccucaguuuucuc

SEQ ID NO: 818474 - RNA, 26 nt, Human
ccgccuccuggacagcucgugauguc

SEQ ID NO: 818475 - RNA, 23 nt, Human
ccgcugcacacaagcugggccug

SEQ ID NO: 818476 - RNA, 19 nt, Human
ccuccaugccgccucccgc

SEQ ID NO: 818477 - RNA, 24 nt, Human
ccuccaugccgccucccgcugcuc

SEQ ID NO: 818478 - RNA, 21 nt, Human
ccucccagcugcagcaggucc

SEQ ID NO: 818479 - RNA, 25 nt, Human
ccucccagcugcagcagguccuccu

SEQ ID NO: 818480 - RNA, 24 nt, Human
ccucccgcugcuccagcuccuugc

SEQ ID NO: 818481 - RNA, 22 nt, Human
ccuccuccagccggaugagggc

SEQ ID NO: 818482 - RNA, 24 nt, Human
ccucugcaacuccaggcucugggg

SEQ ID NO: 818483 - RNA, 22 nt, Human
ccugaggucaggaguucgagac

SEQ ID NO: 818484 - RNA, 24 nt, Human
ccugaucaauauggcgaaacccca

SEQ ID NO: 818485 - RNA, 27 nt, Human
ccugcuucuccagggcugccuuggccc

SEQ ID NO: 818486 - RNA, 19 nt, Human
ccugggaggcggagguugc

SEQ ID NO: 818487 - RNA, 21 nt, Human
ccugggucgggggugcccaga

SEQ ID NO: 818488 - RNA, 21 nt, Human
ccuguaaucccagcuacuugg

SEQ ID NO: 818489 - RNA, 22 nt, Human
ccuguaaucccagcuacuuggg

SEQ ID NO: 818490 - RNA, 25 nt, Human
ccuguagccgcagggauuccagggc

SEQ ID NO: 818491 - RNA, 22 nt, Human
ccuuaggcucugcuguagcccc

SEQ ID NO: 818492 - RNA, 20 nt, Human
ccuucuauacaaugguaaau

SEQ ID NO: 818493 - RNA, 22 nt, Human
ccuugucccgcagcugcuccuc

SEQ ID NO: 818494 - RNA, 20 nt, Human
ccuugugcagaccuggaccc

SEQ ID NO: 818495 - RNA, 27 nt, Human
cgauuuuuuuuccucuuuccucuuuuc

SEQ ID NO: 818496 - RNA, 24 nt, Human
cggaucaccugaggucaggaguuc

SEQ ID NO: 818497 - RNA, 23 nt, Human
cggaucucuccagcagcugcugc

SEQ ID NO: 818498 - RNA, 19 nt, Human
cgggccagcuccccuccca

SEQ ID NO: 818499 - RNA, 21 nt, Human
cuaaaaacaaucauucacacu

SEQ ID NO: 818500 - RNA, 21 nt, Human
cuaaccucccacagagacugg

SEQ ID NO: 818501 - RNA, 18 nt, Human
cucaaaaaaaaaaaaaaa

SEQ ID NO: 818502 - RNA, 18 nt, Human
cucaaaaaaaaaaaaaaa

SEQ ID NO: 818503 - RNA, 21 nt, Human
cucacaccuguaaucucagca

SEQ ID NO: 818504 - RNA, 21 nt, Human
cucacaccuguaaucucagca

SEQ ID NO: 818505 - RNA, 19 nt, Human
cucacuuucucucucccca

SEQ ID NO: 818506 - RNA, 22 nt, Human
cucagucccaggcccgccuccu

SEQ ID NO: 818507 - RNA, 22 nt, Human
cuccagcagcugcugcuccagc

SEQ ID NO: 818508 - RNA, 25 nt, Human
cuccagcagcugcugcuccagcucc

SEQ ID NO: 818509 - RNA, 19 nt, Human
cuccagggccaccugcucc

SEQ ID NO: 818510 - RNA, 22 nt, Human
cuccaugccgccucccgcugcu

SEQ ID NO: 818511 - RNA, 22 nt, Human
cuccucugcggcuccuccucca

SEQ ID NO: 818512 - RNA, 19 nt, Human
cuccugccaugucugugcc

SEQ ID NO: 818513 - RNA, 19 nt, Human
cuccuguagccgcagggau

SEQ ID NO: 818514 - RNA, 21 nt, Human
cucgcgccuccaugccgccuc

SEQ ID NO: 818515 - RNA, 21 nt, Human
cucggccgggcgaggagcgcc

SEQ ID NO: 818516 - RNA, 24 nt, Human
cucuguuagauggacaaggccaug

SEQ ID NO: 818517 - RNA, 22 nt, Human
cugcagagccauggaguuauau

SEQ ID NO: 818518 - RNA, 23 nt, Human
cugcagcagggccugcuucuccc

SEQ ID NO: 818519 - RNA, 23 nt, Human
cugcagccgcugcacacaagcug

SEQ ID NO: 818520 - RNA, 18 nt, Human
cugcaggucuuggcugug

SEQ ID NO: 818521 - RNA, 22 nt, Human
cugccagcuggcaauauuagaa

SEQ ID NO: 818522 - RNA, 21 nt, Human
cugcuucuccagggcugccuu

SEQ ID NO: 818523 - RNA, 23 nt, Human
cuggagccaacagaacccugcac

SEQ ID NO: 818524 - RNA, 25 nt, Human
cuggagccaacagaacccugcaccc

SEQ ID NO: 818525 - RNA, 24 nt, Human
cugggccaggcuggcacuccucug

SEQ ID NO: 818526 - RNA, 19 nt, Human
cuggggugggggcucacag

SEQ ID NO: 818527 - RNA, 20 nt, Human
cugggucgggggugcccaga

SEQ ID NO: 818528 - RNA, 21 nt, Human
cugguuuugaugguauggagu

SEQ ID NO: 818529 - RNA, 22 nt, Human
cuguagccccucuccguccucu

SEQ ID NO: 818530 - RNA, 22 nt, Human
cuuggcccggcucucugccagc

SEQ ID NO: 818531 - RNA, 21 nt, Human
gacagcccugccaagucucag

SEQ ID NO: 818532 - RNA, 18 nt, Human
gacgcuucacugccaggc

SEQ ID NO: 818533 - RNA, 23 nt, Human
gagaaucaauugaaccugggagg

SEQ ID NO: 818534 - RNA, 24 nt, Human
gagaggcaggggagagggcagggg

SEQ ID NO: 818535 - RNA, 18 nt, Human
gagguccguguugaccug

SEQ ID NO: 818536 - RNA, 22 nt, Human
gagguugcagugagcugagauc

SEQ ID NO: 818537 - RNA, 24 nt, Human
gaucaccugaggucaggaguucga

SEQ ID NO: 818538 - RNA, 23 nt, Human
gaugccuaugaaaugagaagggu

SEQ ID NO: 818539 - RNA, 22 nt, Human
gccauugcacuccagccugggc

SEQ ID NO: 818540 - RNA, 24 nt, Human
gccauugcacuccagccugggcaa

SEQ ID NO: 818541 - RNA, 19 nt, Human
gccucucuuugcagcugcc

SEQ ID NO: 818542 - RNA, 28 nt, Human
gccucugcaacuccaggcucuggggugg

SEQ ID NO: 818543 - RNA, 20 nt, Human
gccuguaaucccagcuacuu

SEQ ID NO: 818544 - RNA, 23 nt, Human
gcgaaaccccaucuccaccaaaa

SEQ ID NO: 818545 - RNA, 20 nt, Human
gcucaguccuuccugagaac

SEQ ID NO: 818546 - RNA, 29 nt, Human
gcuugcgcugguaggaggccugcuccucc

SEQ ID NO: 818547 - RNA, 23 nt, Human
ggagagagaggcaggggagaggg

SEQ ID NO: 818548 - RNA, 20 nt, Human
ggaggccugcuccuccugua

SEQ ID NO: 818549 - RNA, 18 nt, Human
ggagguugcagugagcug

SEQ ID NO: 818550 - RNA, 22 nt, Human
ggagguugcagugagcugagau

SEQ ID NO: 818551 - RNA, 23 nt, Human
ggagguugcagugagcugagauc

SEQ ID NO: 818552 - RNA, 24 nt, Human
ggagguugcagugagcugagauca

SEQ ID NO: 818553 - RNA, 22 nt, Human
ggaucaccugaggucaggaguu

SEQ ID NO: 818554 - RNA, 23 nt, Human
ggaucaccugaggucaggaguuc

SEQ ID NO: 818555 - RNA, 25 nt, Human
ggaucaccugaggucaggaguucga

SEQ ID NO: 818556 - RNA, 21 nt, Human
ggcacaugccuguaaucccag

SEQ ID NO: 818557 - RNA, 21 nt, Human
ggcagggggcagggcacaagu

SEQ ID NO: 818558 - RNA, 19 nt, Human
ggccugccgcugcuggccc

SEQ ID NO: 818559 - RNA, 18 nt, Human
ggcgauuuuuuuuccucu

SEQ ID NO: 818560 - RNA, 24 nt, Human
gggcacucacaccuguaaucucag

SEQ ID NO: 818561 - RNA, 25 nt, Human
gggcgaggagcgccgcgguggggaa

SEQ ID NO: 818562 - RNA, 20 nt, Human
ggggacggggucugcuggga

SEQ ID NO: 818563 - RNA, 21 nt, Human
ggggaugaaacagaauaucgu

SEQ ID NO: 818564 - RNA, 22 nt, Human
gggugggggcucacagagcugu

SEQ ID NO: 818565 - RNA, 20 nt, Human
gguaaucaauaaauguaagc

SEQ ID NO: 818566 - RNA, 24 nt, Human
gguggcacaugccuguaaucccag

SEQ ID NO: 818567 - RNA, 23 nt, Human
ggugugguggcacaugccuguaa

SEQ ID NO: 818568 - RNA, 21 nt, Human
guucaugaccuugaacagguu

SEQ ID NO: 818569 - RNA, 24 nt, Human
guugcagugagcugagaucaugcc

SEQ ID NO: 818570 - RNA, 24 nt, Human
uaaaagaaagucauggcaaaauga

SEQ ID NO: 818571 - RNA, 21 nt, Human
uaaauuaaaauaaaaccauga

SEQ ID NO: 818572 - RNA, 21 nt, Human
uaaauuacagcauuuauuuaa

SEQ ID NO: 818573 - RNA, 19 nt, Human
uaagggaacggaagccaau

SEQ ID NO: 818574 - RNA, 24 nt, Human
uaauaagaacauuuuugcuagaag

SEQ ID NO: 818575 - RNA, 21 nt, Human
uaccacagaaggacauggugg

SEQ ID NO: 818576 - RNA, 23 nt, Human
uaccacagaaggacaugguggac

SEQ ID NO: 818577 - RNA, 25 nt, Human
uaccaggacagcccugccaagucuc

SEQ ID NO: 818578 - RNA, 18 nt, Human
uaccaugacucuaguaca

SEQ ID NO: 818579 - RNA, 19 nt, Human
uacuauaagggaacggaag

SEQ ID NO: 818580 - RNA, 24 nt, Human
uagaugccuaugaaaugagaaggg

SEQ ID NO: 818581 - RNA, 23 nt, Human
uagcaugcaaguagcuaucccuu

SEQ ID NO: 818582 - RNA, 22 nt, Human
uagccgggugugguggcacaug

SEQ ID NO: 818583 - RNA, 22 nt, Human
uagucaaaucgaugaaaaccaa

SEQ ID NO: 818584 - RNA, 18 nt, Human
uaucagacauuagucaaa

SEQ ID NO: 818585 - RNA, 21 nt, Human
uaucccagggcccugagaccc

SEQ ID NO: 818586 - RNA, 21 nt, Human
uauggcgaaaccccaucucca

SEQ ID NO: 818587 - RNA, 22 nt, Human
ucaaaaaaaaaaaaaaaaaaaa

SEQ ID NO: 818588 - RNA, 24 nt, Human
ucaauugaaccugggaggcggagg

SEQ ID NO: 818589 - RNA, 20 nt, Human
ucaccugaggucaggaguuc

SEQ ID NO: 818590 - RNA, 19 nt, Human
ucaccugggccaggcuggc

SEQ ID NO: 818591 - RNA, 19 nt, Human
ucacuggagccaacagaac

SEQ ID NO: 818592 - RNA, 21 nt, Human
ucagacauuagucaaaucgau

SEQ ID NO: 818593 - RNA, 19 nt, Human
ucagagccugguuggccga

SEQ ID NO: 818594 - RNA, 19 nt, Human
ucaguaucaggucugaggu

SEQ ID NO: 818595 - RNA, 23 nt, Human
ucaugccauugcacuccagccug

SEQ ID NO: 818596 - RNA, 19 nt, Human
uccagggccucaagcuucu

SEQ ID NO: 818597 - RNA, 19 nt, Human
uccagggcugccuuggccc

SEQ ID NO: 818598 - RNA, 18 nt, Human
ucccagcugcagcagguc

SEQ ID NO: 818599 - RNA, 21 nt, Human
ucccagggcccugagacccag

SEQ ID NO: 818600 - RNA, 26 nt, Human
ucccauuguucuuucccuggggcagu

SEQ ID NO: 818601 - RNA, 18 nt, Human
ucccgcugcuccagcucc

SEQ ID NO: 818602 - RNA, 20 nt, Human
ucccuauaucccagggcccu

SEQ ID NO: 818603 - RNA, 19 nt, Human
uccuccuguagcugccucu

SEQ ID NO: 818604 - RNA, 22 nt, Human
uccucgcgccuccaugccgccu

SEQ ID NO: 818605 - RNA, 21 nt, Human
uccucugcggcuccuccucca

SEQ ID NO: 818606 - RNA, 20 nt, Human
ucggcggggugaacggccuc

SEQ ID NO: 818607 - RNA, 19 nt, Human
ucucaaaaaaaaaaaaaaa

SEQ ID NO: 818608 - RNA, 23 nt, Human
ucucagugagguccguguugacc

SEQ ID NO: 818609 - RNA, 24 nt, Human
ucucaucucuaaaaggagacuaga

SEQ ID NO: 818610 - RNA, 21 nt, Human
ucuccagggcugccuuggccc

SEQ ID NO: 818611 - RNA, 18 nt, Human
ucugaugccuguucuccc

SEQ ID NO: 818612 - RNA, 21 nt, Human
ucugcaggucuuggcugugcu

SEQ ID NO: 818613 - RNA, 23 nt, Human
ucuguaauuguuuuccgugguga

SEQ ID NO: 818614 - RNA, 19 nt, Human
ugaaacugccaucaucaag

SEQ ID NO: 818615 - RNA, 24 nt, Human
ugaaccugggaggcggagguugca

SEQ ID NO: 818616 - RNA, 23 nt, Human
ugaagucccuaggagauacacac

SEQ ID NO: 818617 - RNA, 20 nt, Human
ugaccccucccucuccugcc

SEQ ID NO: 818618 - RNA, 19 nt, Human
ugaccugauccuucuccgg

SEQ ID NO: 818619 - RNA, 24 nt, Human
ugagaucaugccauugcacuccag

SEQ ID NO: 818620 - RNA, 19 nt, Human
ugaggcaggagaaucaauu

SEQ ID NO: 818621 - RNA, 20 nt, Human
ugaggcaggagaaucaauug

SEQ ID NO: 818622 - RNA, 24 nt, Human
ugaggcaggagaaucaauugaacc

SEQ ID NO: 818623 - RNA, 25 nt, Human
ugaggcaggagaaucaauugaaccu

SEQ ID NO: 818624 - RNA, 19 nt, Human
ugaggcauaucuauugaga

SEQ ID NO: 818625 - RNA, 23 nt, Human
ugagggcacucugcaggucuugg

SEQ ID NO: 818626 - RNA, 20 nt, Human
ugaguauauucugcaaauuu

SEQ ID NO: 818627 - RNA, 22 nt, Human
ugauguccgggccagcuccccu

SEQ ID NO: 818628 - RNA, 19 nt, Human
ugcacuccagccugggcaa

SEQ ID NO: 818629 - RNA, 22 nt, Human
ugcacuccagccugggcaacaa

SEQ ID NO: 818630 - RNA, 20 nt, Human
ugcauaaccagcacaugaca

SEQ ID NO: 818631 - RNA, 25 nt, Human
ugcaucugagacccagcucugucac

SEQ ID NO: 818632 - RNA, 21 nt, Human
ugccagcacaacaaacuuucu

SEQ ID NO: 818633 - RNA, 24 nt, Human
ugccauugcacuccagccugggca

SEQ ID NO: 818634 - RNA, 19 nt, Human
ugccgugucucuaaaaaca

SEQ ID NO: 818635 - RNA, 21 nt, Human
ugccucucuuugcagcugccg

SEQ ID NO: 818636 - RNA, 23 nt, Human
ugccuguaaucccagcuacuugg

SEQ ID NO: 818637 - RNA, 24 nt, Human
ugccuguaaucccagcuacuuggg

SEQ ID NO: 818638 - RNA, 21 nt, Human
ugcuccagcuccgaguaccuc

SEQ ID NO: 818639 - RNA, 21 nt, Human
uggagcaccuugucccgcagc

SEQ ID NO: 818640 - RNA, 22 nt, Human
uggcaaaaugacaauccacaag

SEQ ID NO: 818641 - RNA, 22 nt, Human
uggcaaugguagauagggguag

SEQ ID NO: 818642 - RNA, 21 nt, Human
uggcacaugccuguaauccca

SEQ ID NO: 818643 - RNA, 20 nt, Human
uggcauaggaugaacugcua

SEQ ID NO: 818644 - RNA, 19 nt, Human
uggcucaagccuguaauuc

SEQ ID NO: 818645 - RNA, 24 nt, Human
ugggaggccaaggcaggcggauca

SEQ ID NO: 818646 - RNA, 29 nt, Human
ugggaggcggagguugcagugacaacggu

SEQ ID NO: 818647 - RNA, 24 nt, Human
ugggaggcggagguugcagugagc

SEQ ID NO: 818648 - RNA, 19 nt, Human
ugggaggcugaggcaggag

SEQ ID NO: 818649 - RNA, 24 nt, Human
ugggaggcugaggcaggagaauca

SEQ ID NO: 818650 - RNA, 18 nt, Human
ugggauaaacaggcagga

SEQ ID NO: 818651 - RNA, 23 nt, Human
uggggugggggcucacagagcug

SEQ ID NO: 818652 - RNA, 18 nt, Human
ugguagauagggguaggg

SEQ ID NO: 818653 - RNA, 18 nt, Human
ugguauggagugaacuuc

SEQ ID NO: 818654 - RNA, 24 nt, Human
ugguggcacaugccuguaauccca

SEQ ID NO: 818655 - RNA, 23 nt, Human
ugucaaaauggaaagugacuuau

SEQ ID NO: 818656 - RNA, 20 nt, Human
uguccgggccagcuccccuc

SEQ ID NO: 818657 - RNA, 21 nt, Human
ugugugcauaaccagcacaug

SEQ ID NO: 818658 - RNA, 23 nt, Human
uuaaaauaaaaccaugagauuga

SEQ ID NO: 818659 - RNA, 18 nt, Human
uuaaaugaaacuccuaca

SEQ ID NO: 818660 - RNA, 18 nt, Human
uuagccgggugugguggc

SEQ ID NO: 818661 - RNA, 20 nt, Human
uuagccgggugugguggcac

SEQ ID NO: 818662 - RNA, 24 nt, Human
uuagccgggugugguggcacaugc

SEQ ID NO: 818663 - RNA, 22 nt, Human
uucaaacuuacauuacugaagu

SEQ ID NO: 818664 - RNA, 22 nt, Human
uuccagggccucaagcuucuca

SEQ ID NO: 818665 - RNA, 23 nt, Human
uucuccggauucugcuucugaag

SEQ ID NO: 818666 - RNA, 20 nt, Human
uugaaccugggaggcggagg

SEQ ID NO: 818667 - RNA, 24 nt, Human
uugaaccugggaggcggagguugc

SEQ ID NO: 818668 - RNA, 20 nt, Human
uugcagugagcugagaucau

SEQ ID NO: 818669 - RNA, 21 nt, Human
uugcagugagcugagaucaug

SEQ ID NO: 818670 - RNA, 25 nt, Human
uugggaggcugaggcaggagaauca

SEQ ID NO: 818671 - RNA, 19 nt, Human
uuuaaaguccuccaacauc

SEQ ID NO: 818672 - RNA, 21 nt, Human
uuuuaaaugucugccucauca

SEQ ID NO: 818673 - RNA, 23 nt, Human
uuuuuuuuccucuuuccucuuuu

SEQ ID NO: 818674 - RNA, 20 nt, Human
aaaaaaacaaaacgugagag

SEQ ID NO: 818675 - RNA, 23 nt, Human
aaaccagccccuccaucuucuca

SEQ ID NO: 818676 - RNA, 22 nt, Human
aacaccagagugcagggagccc

SEQ ID NO: 818677 - RNA, 24 nt, Human
aaccgacgacagccuucagacgca

SEQ ID NO: 818678 - RNA, 22 nt, Human
aagaagccguccucagagccca

SEQ ID NO: 818679 - RNA, 19 nt, Human
aagaagccuguguccggcc

SEQ ID NO: 818680 - RNA, 26 nt, Human
aagaagccuguguccggccuccagac

SEQ ID NO: 818681 - RNA, 19 nt, Human
aagcugaggcaggaggaug

SEQ ID NO: 818682 - RNA, 18 nt, Human
aaggugcccccaccaaga

SEQ ID NO: 818683 - RNA, 24 nt, Human
aagugcccuuggcagagugggggc

SEQ ID NO: 818684 - RNA, 18 nt, Human
acaaacccccccgcaagc

SEQ ID NO: 818685 - RNA, 24 nt, Human
acaaacccccccgcaagccggaag

SEQ ID NO: 818686 - RNA, 24 nt, Human
acagaacaaggcucucucucaaaa

SEQ ID NO: 818687 - RNA, 24 nt, Human
acagagcaagaugccaucucaaaa

SEQ ID NO: 818688 - RNA, 21 nt, Human
acagcacacauggccggggag

SEQ ID NO: 818689 - RNA, 23 nt, Human
accacagggaggacacagagcag

SEQ ID NO: 818690 - RNA, 22 nt, Human
accaccucgccaccgaggccca

SEQ ID NO: 818691 - RNA, 24 nt, Human
accagagugcagggagccccacca

SEQ ID NO: 818692 - RNA, 19 nt, Human
accagcagguggcccagag

SEQ ID NO: 818693 - RNA, 21 nt, Human
acccuuccagcugucugcgug

SEQ ID NO: 818694 - RNA, 21 nt, Human
accucagcggccuccaggcug

SEQ ID NO: 818695 - RNA, 22 nt, Human
accugcugcuggucaggagaga

SEQ ID NO: 818696 - RNA, 18 nt, Human
acugcacuccauccuggg

SEQ ID NO: 818697 - RNA, 24 nt, Human
acugcacuccauccugggcgacag

SEQ ID NO: 818698 - RNA, 18 nt, Human
acugcauuccagccuagg

SEQ ID NO: 818699 - RNA, 24 nt, Human
acugcauuccagccuaggugacag

SEQ ID NO: 818700 - RNA, 23 nt, Human
agaaguacaaacccccccgcaag

SEQ ID NO: 818701 - RNA, 28 nt, Human
agagacccgcaaugcugagcacugcaac

SEQ ID NO: 818702 - RNA, 22 nt, Human
agaguacgccccgcgacgccag

SEQ ID NO: 818703 - RNA, 21 nt, Human
agagugcagggagccccacca

SEQ ID NO: 818704 - RNA, 24 nt, Human
agcacuuugggaggcugagguggg

SEQ ID NO: 818705 - RNA, 23 nt, Human
agcagguggcccagagcugcagg

SEQ ID NO: 818706 - RNA, 21 nt, Human
agccaggagccagggcggcug

SEQ ID NO: 818707 - RNA, 23 nt, Human
agccaggugugguggcacacgcc

SEQ ID NO: 818708 - RNA, 24 nt, Human
agccuaggugacagaacaaggcuc

SEQ ID NO: 818709 - RNA, 21 nt, Human
agccuucagacgcagccaccc

SEQ ID NO: 818710 - RNA, 20 nt, Human
agcugcugcaggguggccag

SEQ ID NO: 818711 - RNA, 22 nt, Human
aggagcaccgaggagaagucca

SEQ ID NO: 818712 - RNA, 19 nt, Human
aggaggggcagggcucagg

SEQ ID NO: 818713 - RNA, 18 nt, Human
aggcaacggcugccuggc

SEQ ID NO: 818714 - RNA, 20 nt, Human
aggcaacggcugccuggccg

SEQ ID NO: 818715 - RNA, 18 nt, Human
aggcaggagaauggugug

SEQ ID NO: 818716 - RNA, 21 nt, Human
aggcaggagaauggugugaac

SEQ ID NO: 818717 - RNA, 22 nt, Human
aggcaggagaauggugugaacc

SEQ ID NO: 818718 - RNA, 24 nt, Human
aggcaggagaauggugugaaccug

SEQ ID NO: 818719 - RNA, 19 nt, Human
aggcaggaggauggcugga

SEQ ID NO: 818720 - RNA, 24 nt, Human
aggcauguuggcaggcgccuguag

SEQ ID NO: 818721 - RNA, 24 nt, Human
aggcggagcuugcagugagcuaag

SEQ ID NO: 818722 - RNA, 19 nt, Human
aggcugagcccgcacggca

SEQ ID NO: 818723 - RNA, 19 nt, Human
aggcugaggcaggagaaug

SEQ ID NO: 818724 - RNA, 24 nt, Human
aggcugaggugggaggacugcuug

SEQ ID NO: 818725 - RNA, 25 nt, Human
agggagggggucaaggcugcagugg

SEQ ID NO: 818726 - RNA, 21 nt, Human
agggccaccccggggugagcc

SEQ ID NO: 818727 - RNA, 22 nt, Human
agggcgcuggggcucgcggggg

SEQ ID NO: 818728 - RNA, 20 nt, Human
agggcggcugacagcagagc

SEQ ID NO: 818729 - RNA, 19 nt, Human
agguggauaaaaagcagcu

SEQ ID NO: 818730 - RNA, 24 nt, Human
aggugugguggcacacgccugugg

SEQ ID NO: 818731 - RNA, 23 nt, Human
aguggcucaugccugugauccca

SEQ ID NO: 818732 - RNA, 24 nt, Human
aguggcucaugccugugaucccag

SEQ ID NO: 818733 - RNA, 28 nt, Human
auaaaaagcagcucguggcugggcacaa

SEQ ID NO: 818734 - RNA, 24 nt, Human
aucgcgccacugcacuccauccug

SEQ ID NO: 818735 - RNA, 22 nt, Human
aucucuacaaaaaguuaaaaaa

SEQ ID NO: 818736 - RNA, 22 nt, Human
auggccggggagacgcugaggc

SEQ ID NO: 818737 - RNA, 23 nt, Human
auugcaccacugcauuccagccu

SEQ ID NO: 818738 - RNA, 24 nt, Human
caaccgcaucaccagcagagagaa

SEQ ID NO: 818739 - RNA, 24 nt, Human
caagaagccguccucagagcccac

SEQ ID NO: 818740 - RNA, 22 nt, Human
cacacacuacccacgucccacc

SEQ ID NO: 818741 - RNA, 21 nt, Human
cacacagccauggcugagucc

SEQ ID NO: 818742 - RNA, 21 nt, Human
cacagcacacauggccgggga

SEQ ID NO: 818743 - RNA, 20 nt, Human
cacagcaucaccugccucca

SEQ ID NO: 818744 - RNA, 23 nt, Human
caccaggaccucagcggccucca

SEQ ID NO: 818745 - RNA, 19 nt, Human
caccgaggagaaguccagg

SEQ ID NO: 818746 - RNA, 22 nt, Human
caccuggccggugccccaggcc

SEQ ID NO: 818747 - RNA, 23 nt, Human
cacuccauccugggcgacagagc

SEQ ID NO: 818748 - RNA, 23 nt, Human
cacugcacuccauccugggcgac

SEQ ID NO: 818749 - RNA, 24 nt, Human
cacugcacuccauccugggcgaca

SEQ ID NO: 818750 - RNA, 19 nt, Human
cacugcauuccagccuagg

SEQ ID NO: 818751 - RNA, 19 nt, Human
cacugcauuccagccuagg

SEQ ID NO: 818752 - RNA, 23 nt, Human
cacugcauuccagccuaggugac

SEQ ID NO: 818753 - RNA, 24 nt, Human
cacugcauuccagccuaggugaca

SEQ ID NO: 818754 - RNA, 25 nt, Human
cacugcauuccagccuaggugacag

SEQ ID NO: 818755 - RNA, 19 nt, Human
cacugcuaaagccacagaa

SEQ ID NO: 818756 - RNA, 19 nt, Human
cacugcuaaagccacagaa

SEQ ID NO: 818757 - RNA, 19 nt, Human
cacugugcaccuggagggu

SEQ ID NO: 818758 - RNA, 18 nt, Human
cagaacgaccaccucgcc

SEQ ID NO: 818759 - RNA, 23 nt, Human
cagagccccggggacugggccuu

SEQ ID NO: 818760 - RNA, 18 nt, Human
cagcacacggaggccauc

SEQ ID NO: 818761 - RNA, 24 nt, Human
cagcacuuugggaggcugaggugg

SEQ ID NO: 818762 - RNA, 21 nt, Human
cagcagagccccggggacugg

SEQ ID NO: 818763 - RNA, 23 nt, Human
cagcagagccccggggacugggc

SEQ ID NO: 818764 - RNA, 24 nt, Human
cagcagcucaucaagggaggccga

SEQ ID NO: 818765 - RNA, 24 nt, Human
cagccgagccccacccggaggugg

SEQ ID NO: 818766 - RNA, 18 nt, Human
cagccgagggcuccgggc

SEQ ID NO: 818767 - RNA, 23 nt, Human
caggccaccaccaucugcaacaa

SEQ ID NO: 818768 - RNA, 18 nt, Human
cagggguggcggucaggc

SEQ ID NO: 818769 - RNA, 23 nt, Human
caggguggccaggucccagaugc

SEQ ID NO: 818770 - RNA, 20 nt, Human
caguaggggccaggacaucc

SEQ ID NO: 818771 - RNA, 24 nt, Human
caugccugugaucccagcacuuug

SEQ ID NO: 818772 - RNA, 19 nt, Human
cauguccgcugccacucgg

SEQ ID NO: 818773 - RNA, 22 nt, Human
cauguuggcaggcgccuguagu

SEQ ID NO: 818774 - RNA, 21 nt, Human
ccacagcaucaccugccucca

SEQ ID NO: 818775 - RNA, 22 nt, Human
ccacagccugcacggguuccga

SEQ ID NO: 818776 - RNA, 21 nt, Human
ccacugcacuccauccugggc

SEQ ID NO: 818777 - RNA, 21 nt, Human
ccacugcacuccauccugggc

SEQ ID NO: 818778 - RNA, 24 nt, Human
ccacugcacuccauccugggcgac

SEQ ID NO: 818779 - RNA, 19 nt, Human
ccacugcauuccagccuag

SEQ ID NO: 818780 - RNA, 20 nt, Human
ccacugcauuccagccuagg

SEQ ID NO: 818781 - RNA, 20 nt, Human
ccacugcauuccagccuagg

SEQ ID NO: 818782 - RNA, 20 nt, Human
ccacugcauuccagccuagg

SEQ ID NO: 818783 - RNA, 21 nt, Human
ccacugcauuccagccuaggu

SEQ ID NO: 818784 - RNA, 24 nt, Human
ccacugcauuccagccuaggugac

SEQ ID NO: 818785 - RNA, 22 nt, Human
ccagcagguggcccagagcugc

SEQ ID NO: 818786 - RNA, 20 nt, Human
ccaggaagcccagguggccc

SEQ ID NO: 818787 - RNA, 25 nt, Human
ccaucucaaaaaaaaaaaaaaaaaa

SEQ ID NO: 818788 - RNA, 18 nt, Human
ccauucgcagagaaguac

SEQ ID NO: 818789 - RNA, 19 nt, Human
cccacaaaggccagcaggc

SEQ ID NO: 818790 - RNA, 26 nt, Human
cccacaaaggccagcaggcggccauc

SEQ ID NO: 818791 - RNA, 22 nt, Human
cccacagcaucaccugccucca

SEQ ID NO: 818792 - RNA, 22 nt, Human
cccacugcuaaagccacagaaa

SEQ ID NO: 818793 - RNA, 20 nt, Human
cccaggccaccaccaucugc

SEQ ID NO: 818794 - RNA, 20 nt, Human
ccccacugcuaaagccacag

SEQ ID NO: 818795 - RNA, 23 nt, Human
ccccagcauccaggcgaggcucu

SEQ ID NO: 818796 - RNA, 19 nt, Human
ccccccgcaagccggaagg

SEQ ID NO: 818797 - RNA, 18 nt, Human
ccccgacaccccagcaaa

SEQ ID NO: 818798 - RNA, 21 nt, Human
ccccggggugagccgcaugcu

SEQ ID NO: 818799 - RNA, 21 nt, Human
cccgacacagcauccagcacc

SEQ ID NO: 818800 - RNA, 22 nt, Human
cccgggccugucuugcaggcug

SEQ ID NO: 818801 - RNA, 21 nt, Human
cccguggcacccugugcagcc

SEQ ID NO: 818802 - RNA, 22 nt, Human
cccguggcacccugugcagcca

SEQ ID NO: 818803 - RNA, 24 nt, Human
cccugugcagccaggagccagggc

SEQ ID NO: 818804 - RNA, 19 nt, Human
ccgaauuccuggugucccu

SEQ ID NO: 818805 - RNA, 18 nt, Human
ccgcaagaagccguccuc

SEQ ID NO: 818806 - RNA, 22 nt, Human
ccgccuaggccuccgcgcgccc

SEQ ID NO: 818807 - RNA, 18 nt, Human
ccgggacagcguguccag

SEQ ID NO: 818808 - RNA, 19 nt, Human
ccguccucagagcccacag

SEQ ID NO: 818809 - RNA, 23 nt, Human
ccguccucagagcccacagcacc

SEQ ID NO: 818810 - RNA, 18 nt, Human
ccugaagcuuugggacuu

SEQ ID NO: 818811 - RNA, 22 nt, Human
ccuguagucccagcuacugggg

SEQ ID NO: 818812 - RNA, 22 nt, Human
ccugugaucccagcacuuuggg

SEQ ID NO: 818813 - RNA, 21 nt, Human
ccugugcagccaggagccagg

SEQ ID NO: 818814 - RNA, 20 nt, Human
ccuguggcccagcuaucugg

SEQ ID NO: 818815 - RNA, 18 nt, Human
ccuguguggcguaguccc

SEQ ID NO: 818816 - RNA, 22 nt, Human
ccuuugccagaacgaccaccuc

SEQ ID NO: 818817 - RNA, 22 nt, Human
cgcacacugcccugcccgcacg

SEQ ID NO: 818818 - RNA, 23 nt, Human
cgcagccgccagagccgcacacu

SEQ ID NO: 818819 - RNA, 22 nt, Human
cgccuguagucccagcuacugg

SEQ ID NO: 818820 - RNA, 23 nt, Human
cgccuguagucccagcuacuggg

SEQ ID NO: 818821 - RNA, 22 nt, Human
cgccuguggcccagcuaucugg

SEQ ID NO: 818822 - RNA, 23 nt, Human
cgccuguggcccagcuaucuggg

SEQ ID NO: 818823 - RNA, 18 nt, Human
cgcuggggcucgcggggg

SEQ ID NO: 818824 - RNA, 20 nt, Human
cggcccgacacagcauccag

SEQ ID NO: 818825 - RNA, 23 nt, Human
cgggaggccuggcacagacgccc

SEQ ID NO: 818826 - RNA, 27 nt, Human
cgggcagcucccggaugaugcggcccg

SEQ ID NO: 818827 - RNA, 19 nt, Human
cgucaaggaggggcagggc

SEQ ID NO: 818828 - RNA, 22 nt, Human
cgucccgggccugcuugaaggc

SEQ ID NO: 818829 - RNA, 18 nt, Human
cguccuccagcgguccug

SEQ ID NO: 818830 - RNA, 28 nt, Human
cguguaggcaaagaagccuguguccggc

SEQ ID NO: 818831 - RNA, 23 nt, Human
cucaaaaaaaaaaaaaaaaaaaa

SEQ ID NO: 818832 - RNA, 24 nt, Human
cucaugccugugaucccagcacuu

SEQ ID NO: 818833 - RNA, 22 nt, Human
cuccacacggcugcaagaugca

SEQ ID NO: 818834 - RNA, 18 nt, Human
cuccagggccaccccggg

SEQ ID NO: 818835 - RNA, 19 nt, Human
cucccucgaggccaccacu

SEQ ID NO: 818836 - RNA, 18 nt, Human
cucucucaaaaaaaaaau

SEQ ID NO: 818837 - RNA, 22 nt, Human
cucuggauaugccacuuggccc

SEQ ID NO: 818838 - RNA, 22 nt, Human
cugcagugagcuaugauugcac

SEQ ID NO: 818839 - RNA, 19 nt, Human
cugcugguggugguuuuug

SEQ ID NO: 818840 - RNA, 18 nt, Human
cuggauaugccacuuggc

SEQ ID NO: 818841 - RNA, 20 nt, Human
cuggcaacggugccacuucc

SEQ ID NO: 818842 - RNA, 19 nt, Human
cuggcacagacgcccagcc

SEQ ID NO: 818843 - RNA, 18 nt, Human
cuuccccgccccagcauc

SEQ ID NO: 818844 - RNA, 21 nt, Human
cuugcagugagcuaagaucgc

SEQ ID NO: 818845 - RNA, 24 nt, Human
cuuggccccguggcacccugugca

SEQ ID NO: 818846 - RNA, 21 nt, Human
gaaguacaaacccccccgcaa

SEQ ID NO: 818847 - RNA, 20 nt, Human
gacccagggucacaugaagc

SEQ ID NO: 818848 - RNA, 22 nt, Human
gacccuuccagcugucugcgug

SEQ ID NO: 818849 - RNA, 20 nt, Human
gacgagguggacaccagcag

SEQ ID NO: 818850 - RNA, 24 nt, Human
gacgccaggcaacggcugccuggc

SEQ ID NO: 818851 - RNA, 24 nt, Human
gacugcuugagcccuggaguuuga

SEQ ID NO: 818852 - RNA, 20 nt, Human
gagagaaggccacagccugc

SEQ ID NO: 818853 - RNA, 21 nt, Human
gagcaggagcugaagagcagg

SEQ ID NO: 818854 - RNA, 18 nt, Human
gagcccgcacggcagggc

SEQ ID NO: 818855 - RNA, 23 nt, Human
gagcuugcagugagcuaagaucg

SEQ ID NO: 818856 - RNA, 19 nt, Human
gaggagaaguccaggggcc

SEQ ID NO: 818857 - RNA, 20 nt, Human
gaggugccauugaugcccaa

SEQ ID NO: 818858 - RNA, 24 nt, Human
gagguggacaccagcagguggccc

SEQ ID NO: 818859 - RNA, 24 nt, Human
gcaacaagcccaggcugagcccgc

SEQ ID NO: 818860 - RNA, 22 nt, Human
gcaagaagccguccucagagcc

SEQ ID NO: 818861 - RNA, 20 nt, Human
gcagcaccccgccacgcagc

SEQ ID NO: 818862 - RNA, 26 nt, Human
gccacgcagccgccagagccgcacac

SEQ ID NO: 818863 - RNA, 20 nt, Human
gccacugcacuccauccugg

SEQ ID NO: 818864 - RNA, 24 nt, Human
gccacugcacuccauccugggcga

SEQ ID NO: 818865 - RNA, 21 nt, Human
gccagagccgcaagaagccgg

SEQ ID NO: 818866 - RNA, 21 nt, Human
gccccgcgacgccaggcaacg

SEQ ID NO: 818867 - RNA, 18 nt, Human
gccccggggacugggccc

SEQ ID NO: 818868 - RNA, 18 nt, Human
gccuggcaacggugccac

SEQ ID NO: 818869 - RNA, 19 nt, Human
gcgggcaugccgcacgacc

SEQ ID NO: 818870 - RNA, 20 nt, Human
gcuaagaucgcgccacugca

SEQ ID NO: 818871 - RNA, 18 nt, Human
gcucuguggguggggugg

SEQ ID NO: 818872 - RNA, 19 nt, Human
gcugacggggcccucgugc

SEQ ID NO: 818873 - RNA, 21 nt, Human
gcugaggcugcugauggcaau

SEQ ID NO: 818874 - RNA, 19 nt, Human
gcugcagugagcuaugauu

SEQ ID NO: 818875 - RNA, 18 nt, Human
ggagcgcacggccccacu

SEQ ID NO: 818876 - RNA, 20 nt, Human
ggagcuugcagugagcuaag

SEQ ID NO: 818877 - RNA, 24 nt, Human
ggagcuugcagugagcuaagaucg

SEQ ID NO: 818878 - RNA, 18 nt, Human
ggaggccaucggggcuga

SEQ ID NO: 818879 - RNA, 19 nt, Human
ggaggcgggcaagugcccu

SEQ ID NO: 818880 - RNA, 22 nt, Human
ggaguuugagaccagccugagc

SEQ ID NO: 818881 - RNA, 21 nt, Human
ggcacaguggcucaugccugu

SEQ ID NO: 818882 - RNA, 19 nt, Human
ggccuccaggcugaaggag

SEQ ID NO: 818883 - RNA, 21 nt, Human
ggcugggcacaguggcucaug

SEQ ID NO: 818884 - RNA, 19 nt, Human
ggcuuggggaccugcugcc

SEQ ID NO: 818885 - RNA, 18 nt, Human
gggcacaguggcucaugc

SEQ ID NO: 818886 - RNA, 25 nt, Human
gggcagcucccggaugaugcggccc

SEQ ID NO: 818887 - RNA, 22 nt, Human
gggcgcuggggcucgcgggggc

SEQ ID NO: 818888 - RNA, 21 nt, Human
gggcggcaugaacaccagagu

SEQ ID NO: 818889 - RNA, 18 nt, Human
ggggaggucagggagggg

SEQ ID NO: 818890 - RNA, 20 nt, Human
gggggccugggcuggccugu

SEQ ID NO: 818891 - RNA, 21 nt, Human
ggggucaggggccuccagggc

SEQ ID NO: 818892 - RNA, 19 nt, Human
gggucccacaaaggccagc

SEQ ID NO: 818893 - RNA, 20 nt, Human
gggugggguggggucagggg

SEQ ID NO: 818894 - RNA, 21 nt, Human
gggugggguggggucaggggc

SEQ ID NO: 818895 - RNA, 21 nt, Human
gguggcuuuucucucaugcgg

SEQ ID NO: 818896 - RNA, 20 nt, Human
ggugguuuuugugcagggca

SEQ ID NO: 818897 - RNA, 18 nt, Human
gguuccgaguggccgaug

SEQ ID NO: 818898 - RNA, 24 nt, Human
guacacccgggacagcguguccag

SEQ ID NO: 818899 - RNA, 22 nt, Human
guggcccagagcugcagggcca

SEQ ID NO: 818900 - RNA, 20 nt, Human
guggcccgaggagguggcag

SEQ ID NO: 818901 - RNA, 20 nt, Human
gugguuuuugugcagggcac

SEQ ID NO: 818902 - RNA, 22 nt, Human
guguccaggaagcccagguggc

SEQ ID NO: 818903 - RNA, 24 nt, Human
guuggcaggcgccuguagucccag

SEQ ID NO: 818904 - RNA, 22 nt, Human
uaaaaaggugcccccaccaaga

SEQ ID NO: 818905 - RNA, 19 nt, Human
uacaaccgcaucaccagca

SEQ ID NO: 818906 - RNA, 26 nt, Human
uacacccgggacagcguguccaggaa

SEQ ID NO: 818907 - RNA, 21 nt, Human
uaccauguccgcugccacucg

SEQ ID NO: 818908 - RNA, 19 nt, Human
uacgccccgcgacgccagg

SEQ ID NO: 818909 - RNA, 25 nt, Human
uacugggccagggagcccugggagc

SEQ ID NO: 818910 - RNA, 19 nt, Human
uaggccuccgcgcgcccag

SEQ ID NO: 818911 - RNA, 20 nt, Human
uaggggccaggacaucccag

SEQ ID NO: 818912 - RNA, 18 nt, Human
ucacugagcgucaaggag

SEQ ID NO: 818913 - RNA, 19 nt, Human
ucacugagcgucaaggagg

SEQ ID NO: 818914 - RNA, 24 nt, Human
ucaggagagaaggccacagccugc

SEQ ID NO: 818915 - RNA, 21 nt, Human
ucaggccggugacagcuccuc

SEQ ID NO: 818916 - RNA, 19 nt, Human
ucagggguggcggucaggc

SEQ ID NO: 818917 - RNA, 20 nt, Human
ucaggguggacaccgggcag

SEQ ID NO: 818918 - RNA, 22 nt, Human
ucaugccugugaucccagcacu

SEQ ID NO: 818919 - RNA, 25 nt, Human
uccaccaggaccucagcggccucca

SEQ ID NO: 818920 - RNA, 26 nt, Human
uccauggcgagggccaacaccggggc

SEQ ID NO: 818921 - RNA, 19 nt, Human
ucccugcugacugccaggg

SEQ ID NO: 818922 - RNA, 22 nt, Human
uccgcacagcuguacugggcca

SEQ ID NO: 818923 - RNA, 23 nt, Human
ucgcgccacugcacuccauccug

SEQ ID NO: 818924 - RNA, 23 nt, Human
ucgugcucugugggugggguggg

SEQ ID NO: 818925 - RNA, 23 nt, Human
ucuacagagacccgcaaugcuga

SEQ ID NO: 818926 - RNA, 18 nt, Human
ucucaaaaaaaaaaaaaa

SEQ ID NO: 818927 - RNA, 23 nt, Human
ucucuacuaaaaauacaaaaaaa

SEQ ID NO: 818928 - RNA, 21 nt, Human
ucugcaacaagcccaggcuga

SEQ ID NO: 818929 - RNA, 21 nt, Human
ucugcaaggcccagccgagcc

SEQ ID NO: 818930 - RNA, 20 nt, Human
ucuugcaggcugggggggcc

SEQ ID NO: 818931 - RNA, 24 nt, Human
ugacagaacaaggcucucucucaa

SEQ ID NO: 818932 - RNA, 24 nt, Human
ugagaccauccuggcuaacaaggu

SEQ ID NO: 818933 - RNA, 21 nt, Human
ugagcaauguaaugaaacccu

SEQ ID NO: 818934 - RNA, 22 nt, Human
ugagcccgcacggcagggccag

SEQ ID NO: 818935 - RNA, 23 nt, Human
ugagcccuggaguuugagaccag

SEQ ID NO: 818936 - RNA, 22 nt, Human
ugagcuaagaucgcgccacugc

SEQ ID NO: 818937 - RNA, 24 nt, Human
ugaggcaggagaauggugugaacc

SEQ ID NO: 818938 - RNA, 25 nt, Human
ugaggcaggagaauggugugaaccu

SEQ ID NO: 818939 - RNA, 18 nt, Human
ugaggcaggaggauggcu

SEQ ID NO: 818940 - RNA, 25 nt, Human
ugaggcaggaggauggcuggagucc

SEQ ID NO: 818941 - RNA, 22 nt, Human
ugaggugggaggacugcuugag

SEQ ID NO: 818942 - RNA, 24 nt, Human
ugaggugggaggacugcuugagcc

SEQ ID NO: 818943 - RNA, 22 nt, Human
ugcaacaagcccaggcugagcc

SEQ ID NO: 818944 - RNA, 19 nt, Human
ugcacacgaagagcauggc

SEQ ID NO: 818945 - RNA, 21 nt, Human
ugcaccacugcauuccagccu

SEQ ID NO: 818946 - RNA, 25 nt, Human
ugcacuccauccugggcgacagagc

SEQ ID NO: 818947 - RNA, 21 nt, Human
ugcagggccaaagcacacagc

SEQ ID NO: 818948 - RNA, 19 nt, Human
ugccagggcgcuggggcuc

SEQ ID NO: 818949 - RNA, 22 nt, Human
ugccagggcgcuggggcucgcg

SEQ ID NO: 818950 - RNA, 23 nt, Human
ugccagggcgcuggggcucgcgg

SEQ ID NO: 818951 - RNA, 19 nt, Human
ugcccugcccgcacgacgc

SEQ ID NO: 818952 - RNA, 23 nt, Human
ugccgcacgaccaugcgcugaca

SEQ ID NO: 818953 - RNA, 21 nt, Human
ugccugacauggcuuggggac

SEQ ID NO: 818954 - RNA, 23 nt, Human
ugccugugaucccagcacuuugg

SEQ ID NO: 818955 - RNA, 23 nt, Human
ugcuaaagccacagaaaaagguu

SEQ ID NO: 818956 - RNA, 21 nt, Human
ugcucuguggguggggugggg

SEQ ID NO: 818957 - RNA, 19 nt, Human
ugcugcaggguggccaggu

SEQ ID NO: 818958 - RNA, 19 nt, Human
uggaggugccauugaugcc

SEQ ID NO: 818959 - RNA, 19 nt, Human
uggauaaaaagcagcucgu

SEQ ID NO: 818960 - RNA, 20 nt, Human
uggcacacgccuguggccca

SEQ ID NO: 818961 - RNA, 20 nt, Human
uggcacagacgcccagccgu

SEQ ID NO: 818962 - RNA, 21 nt, Human
uggcacccugugcagccagga

SEQ ID NO: 818963 - RNA, 23 nt, Human
uggccgaaaagccgagacgugaa

SEQ ID NO: 818964 - RNA, 24 nt, Human
uggcucaugccugugaucccagca

SEQ ID NO: 818965 - RNA, 18 nt, Human
uggcuggaguccagcugg

SEQ ID NO: 818966 - RNA, 24 nt, Human
uggcugggcacaguggcucaugcc

SEQ ID NO: 818967 - RNA, 24 nt, Human
ugggaagcugaggcaggaggaugg

SEQ ID NO: 818968 - RNA, 23 nt, Human
ugggagcaggagcugaagagcag

SEQ ID NO: 818969 - RNA, 21 nt, Human
ugggagcgagccagcaugugg

SEQ ID NO: 818970 - RNA, 29 nt, Human
ugggaggcggagcuugcagugacaacggu

SEQ ID NO: 818971 - RNA, 24 nt, Human
ugggaggcggagcuugcagugagc

SEQ ID NO: 818972 - RNA, 19 nt, Human
ugggaggcugaggugggag

SEQ ID NO: 818973 - RNA, 20 nt, Human
ugggcacaguggcucaugcc

SEQ ID NO: 818974 - RNA, 19 nt, Human
uggggcccccgaauuccug

SEQ ID NO: 818975 - RNA, 19 nt, Human
ugggggccugggcuggccu

SEQ ID NO: 818976 - RNA, 21 nt, Human
ugggggccugggcuggccugu

SEQ ID NO: 818977 - RNA, 18 nt, Human
ugggguggggucaggggc

SEQ ID NO: 818978 - RNA, 20 nt, Human
ugggguggggucaggggccu

SEQ ID NO: 818979 - RNA, 19 nt, Human
ugggugggguggggucagg

SEQ ID NO: 818980 - RNA, 18 nt, Human
ugguacacccgggacagc

SEQ ID NO: 818981 - RNA, 18 nt, Human
ugguggagaugccugaca

SEQ ID NO: 818982 - RNA, 19 nt, Human
uguaaugaaacccuaucuc

SEQ ID NO: 818983 - RNA, 26 nt, Human
uguaggcaaagaagccuguguccggc

SEQ ID NO: 818984 - RNA, 27 nt, Human
ugugcagggcacgggggcggggaacgc

SEQ ID NO: 818985 - RNA, 19 nt, Human
ugugcgccuuugccagaac

SEQ ID NO: 818986 - RNA, 23 nt, Human
ugugguggcacacgccuguggcc

SEQ ID NO: 818987 - RNA, 25 nt, Human
ugugguggcacacgccuguggccca

SEQ ID NO: 818988 - RNA, 24 nt, Human
uguuggcaggcgccuguaguccca

SEQ ID NO: 818989 - RNA, 23 nt, Human
uuaaaaaggugcccccaccaaga

SEQ ID NO: 818990 - RNA, 21 nt, Human
uucacacacuacccacguccc

SEQ ID NO: 818991 - RNA, 24 nt, Human
uucacacacuacccacgucccacc

SEQ ID NO: 818992 - RNA, 22 nt, Human
uucccgcuguaaccgacgacag

SEQ ID NO: 818993 - RNA, 23 nt, Human
uucgcagagaaguacaaaccccc

SEQ ID NO: 818994 - RNA, 19 nt, Human
uugcagugagcuaagaucg

SEQ ID NO: 818995 - RNA, 22 nt, Human
uugcagugagcuaagaucgcgc

SEQ ID NO: 818996 - RNA, 20 nt, Human
aaauuccucacacucaaugc

SEQ ID NO: 818997 - RNA, 22 nt, Human
aagaaaacacucaacacaggac

SEQ ID NO: 818998 - RNA, 26 nt, Human
agaaaacacucaacacaggacaacua

SEQ ID NO: 818999 - RNA, 24 nt, Human
agaaauagugagcacagagcgacc

SEQ ID NO: 819000 - RNA, 26 nt, Human
agacagaaaguuuaaagugaaauagc

SEQ ID NO: 819001 - RNA, 22 nt, Human
agcucagacccuguggaaccca

SEQ ID NO: 819002 - RNA, 22 nt, Human
agguucucuccaguuggggucu

SEQ ID NO: 819003 - RNA, 22 nt, Human
cagacucaguuuaaaaggacuu

SEQ ID NO: 819004 - RNA, 20 nt, Human
cgcgcacaugcacccuuccc

SEQ ID NO: 819005 - RNA, 22 nt, Human
cucaacacaggacaacuacaga

SEQ ID NO: 819006 - RNA, 24 nt, Human
cucaacacaggacaacuacagacu

SEQ ID NO: 819007 - RNA, 19 nt, Human
cucacaagcugccugggga

SEQ ID NO: 819008 - RNA, 22 nt, Human
cucagacccuguggaacccaga

SEQ ID NO: 819009 - RNA, 21 nt, Human
cugaaaagaccagaaauagug

SEQ ID NO: 819010 - RNA, 22 nt, Human
cuuuuuuguucuuggucaggaa

SEQ ID NO: 819011 - RNA, 24 nt, Human
gaaaagaccagaaauagugagcac

SEQ ID NO: 819012 - RNA, 19 nt, Human
gccgcgcacaugcacccuu

SEQ ID NO: 819013 - RNA, 19 nt, Human
ggcccuaaauaaagccugg

SEQ ID NO: 819014 - RNA, 20 nt, Human
gggcggagagggagaggggc

SEQ ID NO: 819015 - RNA, 22 nt, Human
uaagaaaacacucaacacagga

SEQ ID NO: 819016 - RNA, 21 nt, Human
uacgacaaauaugaggaaaaa

SEQ ID NO: 819017 - RNA, 18 nt, Human
uacuugagcuccuuuuuu

SEQ ID NO: 819018 - RNA, 23 nt, Human
uacuuuggcccuaaauaaagccu

SEQ ID NO: 819019 - RNA, 19 nt, Human
uagaauuauaaaaacugua

SEQ ID NO: 819020 - RNA, 19 nt, Human
uaugacggauacuuuggcc

SEQ ID NO: 819021 - RNA, 18 nt, Human
ucagacccuguggaaccc

SEQ ID NO: 819022 - RNA, 18 nt, Human
ugauauaagaaaacacuc

SEQ ID NO: 819023 - RNA, 24 nt, Human
ugggcgagggcggagagggagagg

SEQ ID NO: 819024 - RNA, 18 nt, Human
ugggucgagggaaacacu

SEQ ID NO: 819025 - RNA, 18 nt, Human
uggguguaugagccuagg

SEQ ID NO: 819026 - RNA, 19 nt, Human
uguucuuggucaggaaagu

SEQ ID NO: 819027 - RNA, 24 nt, Human
uuaaaaggacuuguuuacgugaca

SEQ ID NO: 819028 - RNA, 19 nt, Human
uuagaaucaacagauuuaa

SEQ ID NO: 819029 - RNA, 22 nt, Human
uugaaagugaagccauccucuu

SEQ ID NO: 819030 - RNA, 24 nt, Human
aacacggccacgacaccgcugugc

SEQ ID NO: 819031 - RNA, 22 nt, Human
aagcugaggcuucugccuggga

SEQ ID NO: 819032 - RNA, 22 nt, Human
acagcaaagggucgcuucugga

SEQ ID NO: 819033 - RNA, 22 nt, Human
acccacagcaagccaggcgcaa

SEQ ID NO: 819034 - RNA, 23 nt, Human
accgcgcccaguguggccucaac

SEQ ID NO: 819035 - RNA, 22 nt, Human
acuccggguucucgugcaucgg

SEQ ID NO: 819036 - RNA, 21 nt, Human
agcugucccaggcugagggcc

SEQ ID NO: 819037 - RNA, 23 nt, Human
auaggccuggcccguggcgggcc

SEQ ID NO: 819038 - RNA, 20 nt, Human
aucccuggccuccacucacu

SEQ ID NO: 819039 - RNA, 22 nt, Human
aucuggaccuugggguauaagg

SEQ ID NO: 819040 - RNA, 18 nt, Human
auggagggccaccuggcc

SEQ ID NO: 819041 - RNA, 18 nt, Human
caaaaccacugugcuggc

SEQ ID NO: 819042 - RNA, 18 nt, Human
caaaaccacugugcuggc

SEQ ID NO: 819043 - RNA, 23 nt, Human
caaaccuccaggcugacaguccc

SEQ ID NO: 819044 - RNA, 26 nt, Human
caacaaccacccaggcgaucagcaac

SEQ ID NO: 819045 - RNA, 24 nt, Human
caacacggccacgacaccgcugug

SEQ ID NO: 819046 - RNA, 19 nt, Human
caaucaccagacagaacca

SEQ ID NO: 819047 - RNA, 18 nt, Human
caaucugugcuacguuga

SEQ ID NO: 819048 - RNA, 25 nt, Human
cacaaccucacauggagggccaccu

SEQ ID NO: 819049 - RNA, 21 nt, Human
cacccaggcgaucagcaacac

SEQ ID NO: 819050 - RNA, 19 nt, Human
caccucaaucaccagacag

SEQ ID NO: 819051 - RNA, 22 nt, Human
caccuggccaggcacucaaggc

SEQ ID NO: 819052 - RNA, 25 nt, Human
caccuuggcaagacugagcucugag

SEQ ID NO: 819053 - RNA, 21 nt, Human
cagggacacgccaacaaccac

SEQ ID NO: 819054 - RNA, 19 nt, Human
cagggcagcaucccuggcc

SEQ ID NO: 819055 - RNA, 18 nt, Human
caggggcauggccugacc

SEQ ID NO: 819056 - RNA, 21 nt, Human
cauaguuguacugcugguacc

SEQ ID NO: 819057 - RNA, 22 nt, Human
cauccaugccggggacuggggg

SEQ ID NO: 819058 - RNA, 23 nt, Human
caucgggcuucccagacagguuc

SEQ ID NO: 819059 - RNA, 28 nt, Human
caugcgucuaaacaugagucaagcaacu

SEQ ID NO: 819060 - RNA, 24 nt, Human
caugcucucauccaugccggggac

SEQ ID NO: 819061 - RNA, 25 nt, Human
ccaaaaccucucuugacauugccca

SEQ ID NO: 819062 - RNA, 23 nt, Human
ccacagcaagccaggcgcaaugu

SEQ ID NO: 819063 - RNA, 24 nt, Human
ccaggcacucaaggcccccaugcu

SEQ ID NO: 819064 - RNA, 18 nt, Human
ccccaugcugugaccaca

SEQ ID NO: 819065 - RNA, 23 nt, Human
ccccaugcugugaccacaaccuc

SEQ ID NO: 819066 - RNA, 23 nt, Human
ccccaugcugugaccaugaccuc

SEQ ID NO: 819067 - RNA, 18 nt, Human
ccccgccuggcugugcug

SEQ ID NO: 819068 - RNA, 19 nt, Human
ccccgccuggcugugcugu

SEQ ID NO: 819069 - RNA, 27 nt, Human
ccgcgcccaguguggccucaacaacau

SEQ ID NO: 819070 - RNA, 22 nt, Human
ccucaacacaggugucucccua

SEQ ID NO: 819071 - RNA, 18 nt, Human
ccuccaggcugacagucc

SEQ ID NO: 819072 - RNA, 23 nt, Human
ccucuggcaccgcgcccagugug

SEQ ID NO: 819073 - RNA, 23 nt, Human
ccucuggcaccgcgcccagugug

SEQ ID NO: 819074 - RNA, 19 nt, Human
cgaaggacacugcaggggc

SEQ ID NO: 819075 - RNA, 23 nt, Human
cgccaacaaccacccaggcgauc

SEQ ID NO: 819076 - RNA, 21 nt, Human
cuccaggcugacagucccucc

SEQ ID NO: 819077 - RNA, 23 nt, Human
cuccaugcugugaccaugaccuc

SEQ ID NO: 819078 - RNA, 23 nt, Human
cuccaugcugugaccaugaccuc

SEQ ID NO: 819079 - RNA, 23 nt, Human
cuccaugcugugacuaugaccuc

SEQ ID NO: 819080 - RNA, 21 nt, Human
cugagcucugaggcccaaugg

SEQ ID NO: 819081 - RNA, 25 nt, Human
cugcagggacacgccaacaaccacc

SEQ ID NO: 819082 - RNA, 24 nt, Human
cugcugcugcugcaaagcugaggc

SEQ ID NO: 819083 - RNA, 28 nt, Human
cuggcccguggcgggccccgccuggcug

SEQ ID NO: 819084 - RNA, 26 nt, Human
cugggacacguacugugcacuggcca

SEQ ID NO: 819085 - RNA, 21 nt, Human
cuucuugggcuuggcagguuc

SEQ ID NO: 819086 - RNA, 21 nt, Human
cuugagaccuccagucccagg

SEQ ID NO: 819087 - RNA, 19 nt, Human
gacgggccuucucccacuc

SEQ ID NO: 819088 - RNA, 21 nt, Human
gcaagccaggcgcaaugucua

SEQ ID NO: 819089 - RNA, 18 nt, Human
gccaacaaccacccaggc

SEQ ID NO: 819090 - RNA, 19 nt, Human
gccaggcacucaaggcccc

SEQ ID NO: 819091 - RNA, 21 nt, Human
gcuggccagggccugacgggc

SEQ ID NO: 819092 - RNA, 22 nt, Human
ggacugggggcaugggauagua

SEQ ID NO: 819093 - RNA, 22 nt, Human
ggcagggcagcaucccuggccu

SEQ ID NO: 819094 - RNA, 22 nt, Human
ggccaccuggccaggcacucaa

SEQ ID NO: 819095 - RNA, 18 nt, Human
ggcugugcuguguggcug

SEQ ID NO: 819096 - RNA, 24 nt, Human
gggcagaggacccgcugugguucu

SEQ ID NO: 819097 - RNA, 18 nt, Human
gggccucuggcaccgcgc

SEQ ID NO: 819098 - RNA, 22 nt, Human
gggccucuggcaccgcgcccag

SEQ ID NO: 819099 - RNA, 19 nt, Human
ggggacugggggcauggga

SEQ ID NO: 819100 - RNA, 22 nt, Human
ggguucucgugcaucggcgucu

SEQ ID NO: 819101 - RNA, 19 nt, Human
gugaacgaaggacacugca

SEQ ID NO: 819102 - RNA, 18 nt, Human
guggagggccaccuggcc

SEQ ID NO: 819103 - RNA, 18 nt, Human
guggagggccaccuggcc

SEQ ID NO: 819104 - RNA, 18 nt, Human
guggagggccaccuggcc

SEQ ID NO: 819105 - RNA, 20 nt, Human
uagaugccaagagcaucccc

SEQ ID NO: 819106 - RNA, 19 nt, Human
ucaaggccuccaugcugug

SEQ ID NO: 819107 - RNA, 19 nt, Human
ucaaggccuccaugcugug

SEQ ID NO: 819108 - RNA, 19 nt, Human
ucaaggccuccaugcugug

SEQ ID NO: 819109 - RNA, 23 nt, Human
ucaaucaccagacagaaccaugc

SEQ ID NO: 819110 - RNA, 23 nt, Human
ucacguggagggccaccuggcca

SEQ ID NO: 819111 - RNA, 23 nt, Human
ucacguggagggccaccuggcca

SEQ ID NO: 819112 - RNA, 23 nt, Human
ucacguggagggccaccuggcca

SEQ ID NO: 819113 - RNA, 21 nt, Human
ucgaccagaauuucuccaccu

SEQ ID NO: 819114 - RNA, 21 nt, Human
ucucaaggcccccaugcugug

SEQ ID NO: 819115 - RNA, 18 nt, Human
ucugcguuggagccaaag

SEQ ID NO: 819116 - RNA, 23 nt, Human
ugaccucacguggacagccaccu

SEQ ID NO: 819117 - RNA, 19 nt, Human
ugacuugcugaugcuggcc

SEQ ID NO: 819118 - RNA, 23 nt, Human
ugagaccuccagucccaggggcg

SEQ ID NO: 819119 - RNA, 22 nt, Human
ugagggggcugagccgacggca

SEQ ID NO: 819120 - RNA, 18 nt, Human
ugaugcuggccagggccu

SEQ ID NO: 819121 - RNA, 23 nt, Human
ugccauucucucggccugcccca

SEQ ID NO: 819122 - RNA, 18 nt, Human
ugcugagggggagccugg

SEQ ID NO: 819123 - RNA, 23 nt, Human
ugcugcugcugcaaagcugaggc

SEQ ID NO: 819124 - RNA, 19 nt, Human
ugcuguguggcuggagcug

SEQ ID NO: 819125 - RNA, 22 nt, Human
uggcagggcagcaucccuggcc

SEQ ID NO: 819126 - RNA, 21 nt, Human
uggccagggccugacgggccu

SEQ ID NO: 819127 - RNA, 18 nt, Human
uggcgggccccgccuggc

SEQ ID NO: 819128 - RNA, 20 nt, Human
uggcugugcuguguggcugg

SEQ ID NO: 819129 - RNA, 20 nt, Human
ugggacacguacugugcacu

SEQ ID NO: 819130 - RNA, 23 nt, Human
ugucccaggcugagggccacugu

SEQ ID NO: 819131 - RNA, 20 nt, Human
ugugguucugaacuuucuca

SEQ ID NO: 819132 - RNA, 19 nt, Human
uucgaccagaauuucucca

SEQ ID NO: 819133 - RNA, 22 nt, Human
uugaucacccacguuggccgcc

SEQ ID NO: 819134 - RNA, 18 nt, Human
uugcugcuggacuuggca

SEQ ID NO: 819135 - RNA, 26 nt, Human
aaguaaccuuuagaaagucuuuuuag

SEQ ID NO: 819136 - RNA, 18 nt, Human
aguccuuucccaccaagu

SEQ ID NO: 819137 - RNA, 25 nt, Human
cugcagcuccuguguaaucuuucuc

SEQ ID NO: 819138 - RNA, 25 nt, Human
cuguguaaucuuucuccugaaauuu

SEQ ID NO: 819139 - RNA, 24 nt, Human
gcgacagaaccuccucagcuuucu

SEQ ID NO: 819140 - RNA, 22 nt, Human
uagaaaagaggagcguccgagu

SEQ ID NO: 819141 - RNA, 19 nt, Human
uagaguacagcacugcagc

SEQ ID NO: 819142 - RNA, 18 nt, Human
ucucuguagaaaagagga

SEQ ID NO: 819143 - RNA, 20 nt, Human
aaaaaagccuucugcgcucu

SEQ ID NO: 819144 - RNA, 21 nt, Human
aaaggacaucucaggacucug

SEQ ID NO: 819145 - RNA, 18 nt, Human
aacugcaaagcagacagg

SEQ ID NO: 819146 - RNA, 22 nt, Human
aagcacccucaccauccaaaag

SEQ ID NO: 819147 - RNA, 22 nt, Human
aagcagacaggaaagccccucu

SEQ ID NO: 819148 - RNA, 20 nt, Human
aaggacaucucaggacucug

SEQ ID NO: 819149 - RNA, 21 nt, Human
aaggggauaugugaugguggg

SEQ ID NO: 819150 - RNA, 26 nt, Human
aauguacacacacacgagaaugcaca

SEQ ID NO: 819151 - RNA, 22 nt, Human
acaagcacccucaccauccaaa

SEQ ID NO: 819152 - RNA, 19 nt, Human
acaaggaggggacucacgg

SEQ ID NO: 819153 - RNA, 21 nt, Human
acacacaaacacacacacaua

SEQ ID NO: 819154 - RNA, 20 nt, Human
acacacacacauagugucac

SEQ ID NO: 819155 - RNA, 25 nt, Human
acacacacacauagugucacacaca

SEQ ID NO: 819156 - RNA, 30 nt, Human
acacacacacaugagaauguacacacacaa

SEQ ID NO: 819157 - RNA, 23 nt, Human
acacacacauaaaagcugacaau

SEQ ID NO: 819158 - RNA, 20 nt, Human
acacagccaaacccucaugc

SEQ ID NO: 819159 - RNA, 24 nt, Human
acacagccaaacccucaugcacau

SEQ ID NO: 819160 - RNA, 18 nt, Human
acacaugugcacacacac

SEQ ID NO: 819161 - RNA, 24 nt, Human
agagagcacaaaagacaucaugag

SEQ ID NO: 819162 - RNA, 27 nt, Human
agccuguggucugcaagguuuguggga

SEQ ID NO: 819163 - RNA, 25 nt, Human
agcgaacucuccuguggguacauca

SEQ ID NO: 819164 - RNA, 20 nt, Human
aggacucugcugcugcccag

SEQ ID NO: 819165 - RNA, 25 nt, Human
aggcaagagugaaggaaaggggacc

SEQ ID NO: 819166 - RNA, 24 nt, Human
aggcaguguccgccggcuggugcc

SEQ ID NO: 819167 - RNA, 28 nt, Human
agggagccuguggucugcaagguuugug

SEQ ID NO: 819168 - RNA, 19 nt, Human
aggucugaauuuucaugcc

SEQ ID NO: 819169 - RNA, 27 nt, Human
auguacacacacacgagaaugcacaca

SEQ ID NO: 819170 - RNA, 19 nt, Human
caaaaaagccuucugcgcc

SEQ ID NO: 819171 - RNA, 22 nt, Human
caacccugcagacagcaggaga

SEQ ID NO: 819172 - RNA, 26 nt, Human
cacaaacacacacacauagugucaca

SEQ ID NO: 819173 - RNA, 22 nt, Human
cacacaaacacacacacauagu

SEQ ID NO: 819174 - RNA, 28 nt, Human
cacacaaacacacacacauagugucaca

SEQ ID NO: 819175 - RNA, 21 nt, Human
cacacacaaacacacacacau

SEQ ID NO: 819176 - RNA, 22 nt, Human
cacacacaaacacacacacaua

SEQ ID NO: 819177 - RNA, 24 nt, Human
cacacacacacacaugagaaugua

SEQ ID NO: 819178 - RNA, 25 nt, Human
cacacacacgagaaugcacacacac

SEQ ID NO: 819179 - RNA, 19 nt, Human
cacacacauaaaagcugac

SEQ ID NO: 819180 - RNA, 23 nt, Human
cacacauaaaagcugacaguuac

SEQ ID NO: 819181 - RNA, 23 nt, Human
cacauagugucacacacagccaa

SEQ ID NO: 819182 - RNA, 24 nt, Human
caccauccaaaagcacuuggcucc

SEQ ID NO: 819183 - RNA, 20 nt, Human
caccaucugucugcgaggca

SEQ ID NO: 819184 - RNA, 22 nt, Human
caccugcaugggucacgggcag

SEQ ID NO: 819185 - RNA, 24 nt, Human
cacggccaacccugcagacagcag

SEQ ID NO: 819186 - RNA, 20 nt, Human
cagcagagagcacaaaagaa

SEQ ID NO: 819187 - RNA, 19 nt, Human
caucaugaguuucccugag

SEQ ID NO: 819188 - RNA, 21 nt, Human
ccaaaagcacuuggcuccuga

SEQ ID NO: 819189 - RNA, 18 nt, Human
ccagcucgggaggcgucg

SEQ ID NO: 819190 - RNA, 19 nt, Human
ccaguguguagacccuacc

SEQ ID NO: 819191 - RNA, 19 nt, Human
ccauccaaaagcacuuggc

SEQ ID NO: 819192 - RNA, 19 nt, Human
cccacgcuccgaccuccgc

SEQ ID NO: 819193 - RNA, 23 nt, Human
cccagcuguccuuaccagccgcu

SEQ ID NO: 819194 - RNA, 18 nt, Human
cccuaccgggucugaggc

SEQ ID NO: 819195 - RNA, 21 nt, Human
ccgccgagagcccugccagcu

SEQ ID NO: 819196 - RNA, 20 nt, Human
ccuaaccccagccuugggau

SEQ ID NO: 819197 - RNA, 24 nt, Human
ccuaaccccagccuugggaucugc

SEQ ID NO: 819198 - RNA, 24 nt, Human
ccucugcccgaggcagccccacga

SEQ ID NO: 819199 - RNA, 21 nt, Human
ccugacuugccuaaccccagc

SEQ ID NO: 819200 - RNA, 19 nt, Human
ccugagguaugacgacagc

SEQ ID NO: 819201 - RNA, 18 nt, Human
ccugggggacacugccuc

SEQ ID NO: 819202 - RNA, 22 nt, Human
cggcuggugccaggcccugggc

SEQ ID NO: 819203 - RNA, 22 nt, Human
cgggaaggagcgaacucuccug

SEQ ID NO: 819204 - RNA, 24 nt, Human
cuaucacggcugcaaagcucaggu

SEQ ID NO: 819205 - RNA, 27 nt, Human
cucaugcacaugguacacaugugcaca

SEQ ID NO: 819206 - RNA, 22 nt, Human
cuccgccgagagcccugccagc

SEQ ID NO: 819207 - RNA, 20 nt, Human
cucugcccgaggcagcccca

SEQ ID NO: 819208 - RNA, 18 nt, Human
cugccagcucgggaggcg

SEQ ID NO: 819209 - RNA, 20 nt, Human
cugcgaggcaggggcuggaa

SEQ ID NO: 819210 - RNA, 18 nt, Human
gaaagccccucugccagc

SEQ ID NO: 819211 - RNA, 22 nt, Human
gaaggccaggccucugcaagga

SEQ ID NO: 819212 - RNA, 24 nt, Human
gaauguacacacacacgagaaugc

SEQ ID NO: 819213 - RNA, 24 nt, Human
gacagcgagaguggacagcagaua

SEQ ID NO: 819214 - RNA, 31 nt, Human
gcacacacacacacacaugagaauguacaca

SEQ ID NO: 819215 - RNA, 23 nt, Human
gcagccccacgacaugugcagau

SEQ ID NO: 819216 - RNA, 20 nt, Human
gcaggcaacacacacaaaca

SEQ ID NO: 819217 - RNA, 19 nt, Human
gcccgaggcagccccacga

SEQ ID NO: 819218 - RNA, 18 nt, Human
gcccuggccauggugcug

SEQ ID NO: 819219 - RNA, 18 nt, Human
gccuaaccccagccuugg

SEQ ID NO: 819220 - RNA, 21 nt, Human
gcucucucugagcucaggcag

SEQ ID NO: 819221 - RNA, 21 nt, Human
gcugccuucauuuuugggggc

SEQ ID NO: 819222 - RNA, 22 nt, Human
ggacaagcacccucaccaucca

SEQ ID NO: 819223 - RNA, 20 nt, Human
ggagcucaccugguuggugg

SEQ ID NO: 819224 - RNA, 21 nt, Human
ggccagcuccggggcgaagcc

SEQ ID NO: 819225 - RNA, 21 nt, Human
ggcccuggccauggugcuggg

SEQ ID NO: 819226 - RNA, 25 nt, Human
gggucugaggcaggacucacccagg

SEQ ID NO: 819227 - RNA, 31 nt, Human
gguacacaugugcacacacacacacacaugg

SEQ ID NO: 819228 - RNA, 19 nt, Human
gucugggaaaggccuggga

SEQ ID NO: 819229 - RNA, 20 nt, Human
gugacuugcuuuggggaaac

SEQ ID NO: 819230 - RNA, 27 nt, Human
gugcacacacacacacacaugagaaug

SEQ ID NO: 819231 - RNA, 21 nt, Human
uaacucucugaggcgcaguuu

SEQ ID NO: 819232 - RNA, 21 nt, Human
uacaaggaggggacucacggc

SEQ ID NO: 819233 - RNA, 18 nt, Human
uaggacaaaaaagccuuc

SEQ ID NO: 819234 - RNA, 26 nt, Human
uccaguguguagacccuucccaaggg

SEQ ID NO: 819235 - RNA, 18 nt, Human
ucccugacuugccuaacc

SEQ ID NO: 819236 - RNA, 19 nt, Human
uccgccgagagcccugcca

SEQ ID NO: 819237 - RNA, 20 nt, Human
ucgggaggcgucgggccagc

SEQ ID NO: 819238 - RNA, 25 nt, Human
ucuccuguggguacaucaaaggacu

SEQ ID NO: 819239 - RNA, 24 nt, Human
ucugaggcaggacucacccaggag

SEQ ID NO: 819240 - RNA, 22 nt, Human
ucugggaaaggccugggaccag

SEQ ID NO: 819241 - RNA, 20 nt, Human
ucugugguuuggugucucug

SEQ ID NO: 819242 - RNA, 21 nt, Human
ugaagaaacagugacuguggu

SEQ ID NO: 819243 - RNA, 21 nt, Human
ugaaggaaagggagagucugg

SEQ ID NO: 819244 - RNA, 19 nt, Human
ugacugugguucuuucccu

SEQ ID NO: 819245 - RNA, 21 nt, Human
ugacuugcuuuggggaaacuu

SEQ ID NO: 819246 - RNA, 19 nt, Human
ugaugaauaugucaacugc

SEQ ID NO: 819247 - RNA, 18 nt, Human
ugauggugggggggccug

SEQ ID NO: 819248 - RNA, 19 nt, Human
ugauggugggggggccugg

SEQ ID NO: 819249 - RNA, 21 nt, Human
ugauggugggggggccugguu

SEQ ID NO: 819250 - RNA, 21 nt, Human
ugcaaggagcucaccugguug

SEQ ID NO: 819251 - RNA, 20 nt, Human
ugcacacacacauaaaagcu

SEQ ID NO: 819252 - RNA, 20 nt, Human
ugcauggugguugucgaugu

SEQ ID NO: 819253 - RNA, 21 nt, Human
ugccguugcgggaauugaagu

SEQ ID NO: 819254 - RNA, 24 nt, Human
ugccuaaccccagccuugggaucu

SEQ ID NO: 819255 - RNA, 21 nt, Human
ugccuuguggacugcaggagu

SEQ ID NO: 819256 - RNA, 19 nt, Human
uggaaggggauaugugaug

SEQ ID NO: 819257 - RNA, 25 nt, Human
uggcauggcacagcguaaaaggaaa

SEQ ID NO: 819258 - RNA, 18 nt, Human
uggugagugcuggaaagg

SEQ ID NO: 819259 - RNA, 22 nt, Human
uguacacacacacgagaaugca

SEQ ID NO: 819260 - RNA, 22 nt, Human
ugugauggugggggggccuggu

SEQ ID NO: 819261 - RNA, 26 nt, Human
ugugcacacacacacacacaugagaa

SEQ ID NO: 819262 - RNA, 18 nt, Human
ugugggaggccggcagga

SEQ ID NO: 819263 - RNA, 18 nt, Human
ugugggaugaaggccagg

SEQ ID NO: 819264 - RNA, 19 nt, Human
uguggucugcaagguuugu

SEQ ID NO: 819265 - RNA, 18 nt, Human
ugugugcacuugggcgcc

SEQ ID NO: 819266 - RNA, 21 nt, Human
uucccugacuugccuaacccc

SEQ ID NO: 819267 - RNA, 21 nt, Human
aacacacugggggaggggggg

SEQ ID NO: 819268 - RNA, 23 nt, Human
aacacagguccccccacccuggg

SEQ ID NO: 819269 - RNA, 25 nt, Human
aagaagagagaaggaagguugggga

SEQ ID NO: 819270 - RNA, 22 nt, Human
aagcugccucuccugagcgucc

SEQ ID NO: 819271 - RNA, 20 nt, Human
aaggaaggggcagaggggac

SEQ ID NO: 819272 - RNA, 19 nt, Human
aaggcugggaguggggugg

SEQ ID NO: 819273 - RNA, 23 nt, Human
aagggggcaaggcuggguagggg

SEQ ID NO: 819274 - RNA, 27 nt, Human
acaaaccccagauaauuacaacagcca

SEQ ID NO: 819275 - RNA, 21 nt, Human
acacuccagaaaaaaaggaaa

SEQ ID NO: 819276 - RNA, 23 nt, Human
acagccgggcaaccuccuuugcc

SEQ ID NO: 819277 - RNA, 19 nt, Human
accagccgagagcagauca

SEQ ID NO: 819278 - RNA, 18 nt, Human
acccgggguccccucccc

SEQ ID NO: 819279 - RNA, 22 nt, Human
acccgggguccccuccccauaa

SEQ ID NO: 819280 - RNA, 23 nt, Human
acccgggguccccuccccauaac

SEQ ID NO: 819281 - RNA, 23 nt, Human
acccugaccccucacccuaaccu

SEQ ID NO: 819282 - RNA, 26 nt, Human
agaaaaaaaggaaauggggcugggag

SEQ ID NO: 819283 - RNA, 25 nt, Human
agaagagagaaggaagguuggggag

SEQ ID NO: 819284 - RNA, 23 nt, Human
agacaacucccauuccccccuug

SEQ ID NO: 819285 - RNA, 19 nt, Human
agagaaggaagguugggga

SEQ ID NO: 819286 - RNA, 23 nt, Human
agagagaaggaaggggcagaggg

SEQ ID NO: 819287 - RNA, 20 nt, Human
agagagaaggaagguugggg

SEQ ID NO: 819288 - RNA, 19 nt, Human
agagcaacucccuacccuu

SEQ ID NO: 819289 - RNA, 19 nt, Human
agaggggcggggggggagg

SEQ ID NO: 819290 - RNA, 23 nt, Human
agaggggcggggggggagggggc

SEQ ID NO: 819291 - RNA, 23 nt, Human
agagggggugccaaggaggggcu

SEQ ID NO: 819292 - RNA, 20 nt, Human
agaucagguguggggagaag

SEQ ID NO: 819293 - RNA, 19 nt, Human
agccgcacagccgggcaac

SEQ ID NO: 819294 - RNA, 22 nt, Human
agccgcacagccgggcaaccuc

SEQ ID NO: 819295 - RNA, 23 nt, Human
agccgggcaaccuccuuugcccu

SEQ ID NO: 819296 - RNA, 18 nt, Human
agccgggguggggguggu

SEQ ID NO: 819297 - RNA, 19 nt, Human
agcucuguacagaaggguu

SEQ ID NO: 819298 - RNA, 22 nt, Human
agcuggcgggagggagggaggu

SEQ ID NO: 819299 - RNA, 21 nt, Human
aggaagguuggggagggucca

SEQ ID NO: 819300 - RNA, 27 nt, Human
aggaugaagggggcaaggcuggguagg

SEQ ID NO: 819301 - RNA, 20 nt, Human
aggcagaggauggggauagc

SEQ ID NO: 819302 - RNA, 22 nt, Human
aggcgguguccuggggcaaggg

SEQ ID NO: 819303 - RNA, 18 nt, Human
aggcugggaguggggugg

SEQ ID NO: 819304 - RNA, 19 nt, Human
agggggaugggacugaagg

SEQ ID NO: 819305 - RNA, 22 nt, Human
agggggugccaaggaggggcuu

SEQ ID NO: 819306 - RNA, 20 nt, Human
aggguggggugcacaggaaa

SEQ ID NO: 819307 - RNA, 18 nt, Human
aggugguggguggggagg

SEQ ID NO: 819308 - RNA, 22 nt, Human
agguuggggaggguccaggggu

SEQ ID NO: 819309 - RNA, 25 nt, Human
aguggugggggugggcaaucagugu

SEQ ID NO: 819310 - RNA, 19 nt, Human
auccauccuaccuccccua

SEQ ID NO: 819311 - RNA, 23 nt, Human
auccauccuaccuccccuauccc

SEQ ID NO: 819312 - RNA, 23 nt, Human
auugggagggggaggaugagagg

SEQ ID NO: 819313 - RNA, 25 nt, Human
caaaauaaaacagguaggaagagca

SEQ ID NO: 819314 - RNA, 20 nt, Human
caacacagguccccccaccc

SEQ ID NO: 819315 - RNA, 22 nt, Human
caaccuccuuugcccuugcccc

SEQ ID NO: 819316 - RNA, 24 nt, Human
caauaccaaacgcaaaaggaugaa

SEQ ID NO: 819317 - RNA, 19 nt, Human
caccccuccuccaacacag

SEQ ID NO: 819318 - RNA, 19 nt, Human
cacccuaaccucaauucca

SEQ ID NO: 819319 - RNA, 18 nt, Human
cacccuccuaaacccuga

SEQ ID NO: 819320 - RNA, 24 nt, Human
cacuccagaaaaaaaggaaauggg

SEQ ID NO: 819321 - RNA, 20 nt, Human
cagaguaggacagaucaacu

SEQ ID NO: 819322 - RNA, 22 nt, Human
cagcaccccaaugggaaggaaa

SEQ ID NO: 819323 - RNA, 20 nt, Human
cagccgagagcagaucaggu

SEQ ID NO: 819324 - RNA, 26 nt, Human
ccaacauacacacccuccuaaacccu

SEQ ID NO: 819325 - RNA, 25 nt, Human
ccaccccacccaacacacuggggga

SEQ ID NO: 819326 - RNA, 21 nt, Human
ccacgguggggccagcgucac

SEQ ID NO: 819327 - RNA, 25 nt, Human
ccagcccacacacacacaccccgga

SEQ ID NO: 819328 - RNA, 18 nt, Human
ccagggugggggugaggg

SEQ ID NO: 819329 - RNA, 18 nt, Human
cccaacaccccuccucca

SEQ ID NO: 819330 - RNA, 21 nt, Human
cccacacacacacaccccgga

SEQ ID NO: 819331 - RNA, 29 nt, Human
cccacacacacacaccccggauauguaca

SEQ ID NO: 819332 - RNA, 21 nt, Human
cccacccaacacacuggggga

SEQ ID NO: 819333 - RNA, 22 nt, Human
cccagcccuguccuaccucccc

SEQ ID NO: 819334 - RNA, 24 nt, Human
cccagcccuguccuaccuccccca

SEQ ID NO: 819335 - RNA, 22 nt, Human
cccauccauccuaccuccccua

SEQ ID NO: 819336 - RNA, 19 nt, Human
cccauggccuacccacccc

SEQ ID NO: 819337 - RNA, 22 nt, Human
cccauggccuacccaccccaaa

SEQ ID NO: 819338 - RNA, 21 nt, Human
ccccaaaccccauccauccua

SEQ ID NO: 819339 - RNA, 25 nt, Human
ccccaaaccccauccauccuaccuc

SEQ ID NO: 819340 - RNA, 18 nt, Human
ccccaacaccccuccucc

SEQ ID NO: 819341 - RNA, 21 nt, Human
ccccauccauccuaccucccc

SEQ ID NO: 819342 - RNA, 23 nt, Human
ccccauccauccuaccuccccua

SEQ ID NO: 819343 - RNA, 26 nt, Human
cccccagggugggggugagggucugu

SEQ ID NO: 819344 - RNA, 18 nt, Human
cccccuccaccccaucug

SEQ ID NO: 819345 - RNA, 19 nt, Human
cccccuugccgcccccucc

SEQ ID NO: 819346 - RNA, 19 nt, Human
ccccgguggcccccucccc

SEQ ID NO: 819347 - RNA, 26 nt, Human
ccccucacccgggguccccuccccau

SEQ ID NO: 819348 - RNA, 24 nt, Human
ccccuccuccaacacagguccccc

SEQ ID NO: 819349 - RNA, 26 nt, Human
cccuaaccucaauuccaccccaccca

SEQ ID NO: 819350 - RNA, 21 nt, Human
cccucccauggccuacccacc

SEQ ID NO: 819351 - RNA, 25 nt, Human
cccuccuaaacccugaccccucacc

SEQ ID NO: 819352 - RNA, 20 nt, Human
cccuccuccaacacaggucc

SEQ ID NO: 819353 - RNA, 21 nt, Human
cccugccccgguggcccccuc

SEQ ID NO: 819354 - RNA, 20 nt, Human
ccuaaacccugaccccucac

SEQ ID NO: 819355 - RNA, 23 nt, Human
ccucacccuaaccucaauuccac

SEQ ID NO: 819356 - RNA, 24 nt, Human
ccuccaacacagguccccccaccc

SEQ ID NO: 819357 - RNA, 27 nt, Human
ccucccaacauacacacccuccuaaac

SEQ ID NO: 819358 - RNA, 18 nt, Human
ccuccccuaucccgccag

SEQ ID NO: 819359 - RNA, 22 nt, Human
ccuguccuaccucccccagggg

SEQ ID NO: 819360 - RNA, 20 nt, Human
ccuugccgcccccucccugc

SEQ ID NO: 819361 - RNA, 23 nt, Human
cgagcagccucuucuuggguucu

SEQ ID NO: 819362 - RNA, 24 nt, Human
cgagcagccucuucuuggguucug

SEQ ID NO: 819363 - RNA, 18 nt, Human
cggggggggagggggcca

SEQ ID NO: 819364 - RNA, 21 nt, Human
cgggguaggcgguguccuggg

SEQ ID NO: 819365 - RNA, 23 nt, Human
cgggguccccuccccauaacaag

SEQ ID NO: 819366 - RNA, 21 nt, Human
cuaaaaaaaucacccugaagu

SEQ ID NO: 819367 - RNA, 25 nt, Human
cuaaacccugaccccucacccuaac

SEQ ID NO: 819368 - RNA, 22 nt, Human
cucacccgggguccccucccca

SEQ ID NO: 819369 - RNA, 20 nt, Human
cuccuccaacacaggucccc

SEQ ID NO: 819370 - RNA, 22 nt, Human
cucugggaccagccgagagcag

SEQ ID NO: 819371 - RNA, 23 nt, Human
cucuguacagaaggguugccccc

SEQ ID NO: 819372 - RNA, 22 nt, Human
cugagguggggaaagggcacag

SEQ ID NO: 819373 - RNA, 21 nt, Human
gaaggggcagaggggacugug

SEQ ID NO: 819374 - RNA, 19 nt, Human
gaagguuggggagggucca

SEQ ID NO: 819375 - RNA, 20 nt, Human
gagagaaggaagguugggga

SEQ ID NO: 819376 - RNA, 20 nt, Human
gagauugggagggggaggau

SEQ ID NO: 819377 - RNA, 23 nt, Human
gagcuggcgggagggagggaggu

SEQ ID NO: 819378 - RNA, 23 nt, Human
gauagcaccccggagugaagggg

SEQ ID NO: 819379 - RNA, 26 nt, Human
gcccccagcccacacacacacacccc

SEQ ID NO: 819380 - RNA, 19 nt, Human
gcccccuccaccccaucug

SEQ ID NO: 819381 - RNA, 21 nt, Human
gccccgguggcccccuccacc

SEQ ID NO: 819382 - RNA, 19 nt, Human
gcccuguccuaccuccccc

SEQ ID NO: 819383 - RNA, 25 nt, Human
gccuacccaccccaaaccccaucca

SEQ ID NO: 819384 - RNA, 19 nt, Human
gccugagguggggaaaggg

SEQ ID NO: 819385 - RNA, 22 nt, Human
gcugggugggcuaguggucugc

SEQ ID NO: 819386 - RNA, 19 nt, Human
ggacugaaggggaacuguc

SEQ ID NO: 819387 - RNA, 20 nt, Human
ggacugaaggggaacugucc

SEQ ID NO: 819388 - RNA, 18 nt, Human
ggagaaggggagacaacu

SEQ ID NO: 819389 - RNA, 24 nt, Human
ggagggagguggaaggagauuggg

SEQ ID NO: 819390 - RNA, 19 nt, Human
ggagggggaggaugagagg

SEQ ID NO: 819391 - RNA, 20 nt, Human
ggaggggggggcauaagccc

SEQ ID NO: 819392 - RNA, 18 nt, Human
ggaggugccacaccccca

SEQ ID NO: 819393 - RNA, 19 nt, Human
ggaugaagggggcaaggcu

SEQ ID NO: 819394 - RNA, 19 nt, Human
ggccugagguggggaaagg

SEQ ID NO: 819395 - RNA, 20 nt, Human
gggaagcagaggggcggggg

SEQ ID NO: 819396 - RNA, 22 nt, Human
gggagggaagcagaggggcggg

SEQ ID NO: 819397 - RNA, 20 nt, Human
gggagggggaggaugagagg

SEQ ID NO: 819398 - RNA, 23 nt, Human
gggagguggaaggagauugggag

SEQ ID NO: 819399 - RNA, 20 nt, Human
gggaguggagaaaaggggac

SEQ ID NO: 819400 - RNA, 18 nt, Human
gggagugggguggggagg

SEQ ID NO: 819401 - RNA, 19 nt, Human
gggcaagggucccuggggg

SEQ ID NO: 819402 - RNA, 18 nt, Human
gggcaggggaggccaaaa

SEQ ID NO: 819403 - RNA, 18 nt, Human
gggcccccucacccgggg

SEQ ID NO: 819404 - RNA, 18 nt, Human
ggggauagcaccccggag

SEQ ID NO: 819405 - RNA, 20 nt, Human
ggggcggggggggagggggc

SEQ ID NO: 819406 - RNA, 19 nt, Human
ggggggagggggccaggaa

SEQ ID NO: 819407 - RNA, 22 nt, Human
gggguaggcgguguccuggggc

SEQ ID NO: 819408 - RNA, 20 nt, Human
ggggugccaaggaggggcuu

SEQ ID NO: 819409 - RNA, 21 nt, Human
ggggugggggugguggggcug

SEQ ID NO: 819410 - RNA, 22 nt, Human
ggggugguggggcugggggggc

SEQ ID NO: 819411 - RNA, 20 nt, Human
ggguggggagggagaacgag

SEQ ID NO: 819412 - RNA, 18 nt, Human
gggugggggugguggggc

SEQ ID NO: 819413 - RNA, 21 nt, Human
ggugcacaggaaaggaagaga

SEQ ID NO: 819414 - RNA, 21 nt, Human
gguggguggggagggaagcag

SEQ ID NO: 819415 - RNA, 24 nt, Human
gguggguggggagggaagcagagg

SEQ ID NO: 819416 - RNA, 18 nt, Human
ggugguggggcugggggg

SEQ ID NO: 819417 - RNA, 20 nt, Human
ggugguggggcugggggggc

SEQ ID NO: 819418 - RNA, 18 nt, Human
ggugguggguggggaggg

SEQ ID NO: 819419 - RNA, 19 nt, Human
gguguggggagaaggggag

SEQ ID NO: 819420 - RNA, 21 nt, Human
guagggggaugggacugaagg

SEQ ID NO: 819421 - RNA, 22 nt, Human
gucugucccccagugcucaggg

SEQ ID NO: 819422 - RNA, 21 nt, Human
gugcugagcccccccagacgc

SEQ ID NO: 819423 - RNA, 26 nt, Human
gugguuggugcuguuacagggugggg

SEQ ID NO: 819424 - RNA, 27 nt, Human
gugguuggugcuguuacaggguggggu

SEQ ID NO: 819425 - RNA, 21 nt, Human
uaaacauguuuuuuucuguuu

SEQ ID NO: 819426 - RNA, 20 nt, Human
uacaacagccaaagaagaga

SEQ ID NO: 819427 - RNA, 22 nt, Human
uagauugucagcucugguuacu

SEQ ID NO: 819428 - RNA, 21 nt, Human
ucaauaccaaacgcaaaagga

SEQ ID NO: 819429 - RNA, 24 nt, Human
ucaauuccaccccacccaacacac

SEQ ID NO: 819430 - RNA, 21 nt, Human
ucaccacacacuccagaaaaa

SEQ ID NO: 819431 - RNA, 22 nt, Human
ucccaacauacacacccuccua

SEQ ID NO: 819432 - RNA, 19 nt, Human
uccccacucucccuccugg

SEQ ID NO: 819433 - RNA, 20 nt, Human
uccccccucccccugggagu

SEQ ID NO: 819434 - RNA, 19 nt, Human
uccccccuugccgcccccu

SEQ ID NO: 819435 - RNA, 19 nt, Human
ucccugggggucaaagaga

SEQ ID NO: 819436 - RNA, 18 nt, Human
uccguaaucugcagccgg

SEQ ID NO: 819437 - RNA, 20 nt, Human
uccuaaacccugaccccuca

SEQ ID NO: 819438 - RNA, 23 nt, Human
uccuagaguaaguuccccccucc

SEQ ID NO: 819439 - RNA, 24 nt, Human
uccucccaacauacacacccuccu

SEQ ID NO: 819440 - RNA, 26 nt, Human
uccucggugauguccaauccuggugg

SEQ ID NO: 819441 - RNA, 20 nt, Human
uccuggggcaagggucccug

SEQ ID NO: 819442 - RNA, 20 nt, Human
ucuggguucuggguggggag

SEQ ID NO: 819443 - RNA, 18 nt, Human
ugaagggggcaaggcugg

SEQ ID NO: 819444 - RNA, 19 nt, Human
ugaaggggucuguacgggg

SEQ ID NO: 819445 - RNA, 20 nt, Human
ugaccccucacccuaaccuc

SEQ ID NO: 819446 - RNA, 18 nt, Human
ugaggcagaggaugggga

SEQ ID NO: 819447 - RNA, 23 nt, Human
ugaggggggauagauaaggcugg

SEQ ID NO: 819448 - RNA, 23 nt, Human
ugagguggggaaagggcacaggg

SEQ ID NO: 819449 - RNA, 26 nt, Human
ugcacaggaaaggaagagaaggucuc

SEQ ID NO: 819450 - RNA, 21 nt, Human
ugccccgguggcccccuccac

SEQ ID NO: 819451 - RNA, 25 nt, Human
ugccucccagggaggcauucgggga

SEQ ID NO: 819452 - RNA, 18 nt, Human
uggaaggagauugggagg

SEQ ID NO: 819453 - RNA, 21 nt, Human
uggaaggagauugggaggggg

SEQ ID NO: 819454 - RNA, 24 nt, Human
uggaaggagauugggagggggagg

SEQ ID NO: 819455 - RNA, 26 nt, Human
uggaaggagauugggagggggaggau

SEQ ID NO: 819456 - RNA, 19 nt, Human
ugggaaggaaaagggggcg

SEQ ID NO: 819457 - RNA, 21 nt, Human
ugggaaggaaaagggggcggc

SEQ ID NO: 819458 - RNA, 18 nt, Human
ugggaguggagaaaaggg

SEQ ID NO: 819459 - RNA, 19 nt, Human
ugggagugggguggggagg

SEQ ID NO: 819460 - RNA, 22 nt, Human
ugggagugggguggggagggag

SEQ ID NO: 819461 - RNA, 18 nt, Human
uggggagggaagcagagg

SEQ ID NO: 819462 - RNA, 24 nt, Human
uggggaggguccagggguagggcc

SEQ ID NO: 819463 - RNA, 18 nt, Human
uggggcgguggaggggag

SEQ ID NO: 819464 - RNA, 19 nt, Human
ugggggugguggggcuggg

SEQ ID NO: 819465 - RNA, 22 nt, Human
ugggguggggagggagaacgag

SEQ ID NO: 819466 - RNA, 22 nt, Human
uggguaggggacagcagucagg

SEQ ID NO: 819467 - RNA, 21 nt, Human
uggugcagugguggggguggg

SEQ ID NO: 819468 - RNA, 21 nt, Human
uggugcuguuacagggugggg

SEQ ID NO: 819469 - RNA, 19 nt, Human
ugguggggcugggggggcc

SEQ ID NO: 819470 - RNA, 20 nt, Human
uggugggggugggcaaucag

SEQ ID NO: 819471 - RNA, 20 nt, Human
uguagggggaugggacugaa

SEQ ID NO: 819472 - RNA, 22 nt, Human
uguccaauccuggugguuggug

SEQ ID NO: 819473 - RNA, 22 nt, Human
uguggggagaaggggagaccag

SEQ ID NO: 819474 - RNA, 24 nt, Human
uguuacaggguggggugcacagga

SEQ ID NO: 819475 - RNA, 22 nt, Human
uucuccguaaucugcagccggg

SEQ ID NO: 819476 - RNA, 25 nt, Human
uugcccccugagccaccccccgagc

SEQ ID NO: 819477 - RNA, 18 nt, Human
uugggagggggaggauga

SEQ ID NO: 819478 - RNA, 24 nt, Human
uugugcgugcugagcccccccaga

SEQ ID NO: 819479 - RNA, 23 nt, Human
uuuucuguuucaccacacacucc

SEQ ID NO: 819480 - RNA, 22 nt, Human
aaaaaaacaaccuuaccuacau

SEQ ID NO: 819481 - RNA, 22 nt, Human
aaaaguauaccuugggaaaggc

SEQ ID NO: 819482 - RNA, 22 nt, Human
aaauguugaaaauauuugccuc

SEQ ID NO: 819483 - RNA, 27 nt, Human
aacuacgugguuuaaauucauauugac

SEQ ID NO: 819484 - RNA, 20 nt, Human
aacucuggagccagcagaau

SEQ ID NO: 819485 - RNA, 24 nt, Human
aagccauugaaaaguauuuagaau

SEQ ID NO: 819486 - RNA, 21 nt, Human
aagcuuuaaaaauuggaaaug

SEQ ID NO: 819487 - RNA, 22 nt, Human
acaagcacacuuuuguauucuu

SEQ ID NO: 819488 - RNA, 28 nt, Human
acaaguuuuucuccauaaauaagauucu

SEQ ID NO: 819489 - RNA, 26 nt, Human
acagugacccucuggccugguuuucc

SEQ ID NO: 819490 - RNA, 22 nt, Human
acgcuguucuggucacucacau

SEQ ID NO: 819491 - RNA, 20 nt, Human
agaaaaggacuaaugaggug

SEQ ID NO: 819492 - RNA, 18 nt, Human
agacagguagauaucaag

SEQ ID NO: 819493 - RNA, 23 nt, Human
aggcaaucugccugccccaccuc

SEQ ID NO: 819494 - RNA, 18 nt, Human
aucuucuccagccacguu

SEQ ID NO: 819495 - RNA, 22 nt, Human
caaaaaaacaaccuuaccuaca

SEQ ID NO: 819496 - RNA, 18 nt, Human
caaaccagacagugaccc

SEQ ID NO: 819497 - RNA, 22 nt, Human
caaguuuauagagguaagaagu

SEQ ID NO: 819498 - RNA, 19 nt, Human
cacacuuuuguauucuuca

SEQ ID NO: 819499 - RNA, 19 nt, Human
cacaguacacgcuuuaaau

SEQ ID NO: 819500 - RNA, 19 nt, Human
cacauccuggucaaaaauc

SEQ ID NO: 819501 - RNA, 21 nt, Human
caccaaaucacaaaccagaca

SEQ ID NO: 819502 - RNA, 22 nt, Human
caccaaaucacaaaccagacag

SEQ ID NO: 819503 - RNA, 19 nt, Human
caccugaagugaaaagaua

SEQ ID NO: 819504 - RNA, 22 nt, Human
cacuggcaguugucugccgcag

SEQ ID NO: 819505 - RNA, 22 nt, Human
cagccacguuguaaaaggcccc

SEQ ID NO: 819506 - RNA, 22 nt, Human
cagccuauccugcugcaaagau

SEQ ID NO: 819507 - RNA, 27 nt, Human
cagcuccaccugaagugaaaagauaac

SEQ ID NO: 819508 - RNA, 20 nt, Human
caggcuuggaagccauuugu

SEQ ID NO: 819509 - RNA, 21 nt, Human
caugacacagacugagagcuu

SEQ ID NO: 819510 - RNA, 23 nt, Human
ccauaaauaagauucuaaaguuc

SEQ ID NO: 819511 - RNA, 26 nt, Human
cccauggcuaaaacaggccggggucc

SEQ ID NO: 819512 - RNA, 22 nt, Human
cguccaaguuuauagagguaag

SEQ ID NO: 819513 - RNA, 18 nt, Human
cuaaaacaggcagugaug

SEQ ID NO: 819514 - RNA, 21 nt, Human
cucaaacucuggagccagcag

SEQ ID NO: 819515 - RNA, 19 nt, Human
cuccaccugaagugaaaag

SEQ ID NO: 819516 - RNA, 19 nt, Human
cugaucuuacagauacaug

SEQ ID NO: 819517 - RNA, 20 nt, Human
cugaucuuacagauacaugg

SEQ ID NO: 819518 - RNA, 23 nt, Human
gaaauuugagcugcaacaucucc

SEQ ID NO: 819519 - RNA, 23 nt, Human
gacaugcaacucagucugaaagc

SEQ ID NO: 819520 - RNA, 25 nt, Human
gacuaaagagugacaugcaacucag

SEQ ID NO: 819521 - RNA, 20 nt, Human
ggcacuggcaguugucugcc

SEQ ID NO: 819522 - RNA, 19 nt, Human
gggcacuggcaguugucug

SEQ ID NO: 819523 - RNA, 23 nt, Human
uaaaaugcacccuuuuauccgcc

SEQ ID NO: 819524 - RNA, 24 nt, Human
uagguugauuuaaaaaaaaaaaaa

SEQ ID NO: 819525 - RNA, 23 nt, Human
uaucaaaagcaacuaauuuuaaa

SEQ ID NO: 819526 - RNA, 25 nt, Human
uaucaaaagcaacuaauuuuaaaca

SEQ ID NO: 819527 - RNA, 23 nt, Human
uaucguccaaguuuauagaggua

SEQ ID NO: 819528 - RNA, 20 nt, Human
uauguugcccaucuucucca

SEQ ID NO: 819529 - RNA, 27 nt, Human
ucaggcuuggaagccauuugguaaaga

SEQ ID NO: 819530 - RNA, 20 nt, Human
ucauauguggacugaaauuu

SEQ ID NO: 819531 - RNA, 23 nt, Human
uccaccaaaucacaaaccagaca

SEQ ID NO: 819532 - RNA, 24 nt, Human
uccaccaaaucacaaaccagacag

SEQ ID NO: 819533 - RNA, 19 nt, Human
uccauagcgcacacuccug

SEQ ID NO: 819534 - RNA, 26 nt, Human
ucuccaaaaaaacaaccuuaccuaca

SEQ ID NO: 819535 - RNA, 23 nt, Human
ucuccagccacguuguaaaaggc

SEQ ID NO: 819536 - RNA, 21 nt, Human
ucugccugccccaccucuugc

SEQ ID NO: 819537 - RNA, 23 nt, Human
ugaaaauauuugcccauagacua

SEQ ID NO: 819538 - RNA, 23 nt, Human
ugagaaacacaagcacacuuuug

SEQ ID NO: 819539 - RNA, 22 nt, Human
ugauguguaaacaauguuaaaa

SEQ ID NO: 819540 - RNA, 21 nt, Human
ugcccgaaucacuuuauggaa

SEQ ID NO: 819541 - RNA, 21 nt, Human
ugcugcaaagauguucagucu

SEQ ID NO: 819542 - RNA, 23 nt, Human
uggcugaacagacagguagauau

SEQ ID NO: 819543 - RNA, 18 nt, Human
ugggaaaggcugaucuua

SEQ ID NO: 819544 - RNA, 18 nt, Human
uguugcccaucuucucca

SEQ ID NO: 819545 - RNA, 22 nt, Human
uguuuaucugucaauaggcaug

SEQ ID NO: 819546 - RNA, 26 nt, Human
uguuugaugggcacuggcaguugucu

SEQ ID NO: 819547 - RNA, 21 nt, Human
uucacacaaauaugcccgaau

SEQ ID NO: 819548 - RNA, 23 nt, Human
uucauauguggacugaaauuuga

SEQ ID NO: 819549 - RNA, 21 nt, Human
uugaauuauaaacaugacagc

SEQ ID NO: 819550 - RNA, 20 nt, Human
uugauuuaaaaaaaaaaaaa

SEQ ID NO: 819551 - RNA, 23 nt, Human
uugcccaucuucuccagccacgu

SEQ ID NO: 819552 - RNA, 21 nt, Human
uuguccuggcugaacagacag

SEQ ID NO: 819553 - RNA, 22 nt, Human
uuguccuggcugaacagacagg

SEQ ID NO: 819554 - RNA, 22 nt, Human
uuuaaaaaaaaaaaaaaucugu

SEQ ID NO: 819555 - RNA, 21 nt, Human
uuuuuuuuuuuuuuuuucauu

SEQ ID NO: 819556 - RNA, 21 nt, Human
aaaagcucccuacucagcagc

SEQ ID NO: 819557 - RNA, 19 nt, Human
aaacaccaaguggccaccc

SEQ ID NO: 819558 - RNA, 20 nt, Human
aaacccacccccacuacccc

SEQ ID NO: 819559 - RNA, 22 nt, Human
aaacccuaagauagaucuaguu

SEQ ID NO: 819560 - RNA, 23 nt, Human
aaagauggaugaagugcuucuag

SEQ ID NO: 819561 - RNA, 21 nt, Human
aaccaagaaaacaggagcugc

SEQ ID NO: 819562 - RNA, 22 nt, Human
aacuagcaucuguccuuucagc

SEQ ID NO: 819563 - RNA, 19 nt, Human
aacuggggagaccucagcc

SEQ ID NO: 819564 - RNA, 25 nt, Human
aagaaauccaaggcagccaggcccu

SEQ ID NO: 819565 - RNA, 25 nt, Human
aagcaaaagcucccuacucagcagc

SEQ ID NO: 819566 - RNA, 25 nt, Human
aagcaaagcaagccacccuccuccu

SEQ ID NO: 819567 - RNA, 20 nt, Human
aagcagggcaucccuuugug

SEQ ID NO: 819568 - RNA, 19 nt, Human
aagcggaggcaggcccggg

SEQ ID NO: 819569 - RNA, 23 nt, Human
aagcggaggcaggcccggggcaa

SEQ ID NO: 819570 - RNA, 22 nt, Human
acagaaccaagaaaacaggagc

SEQ ID NO: 819571 - RNA, 21 nt, Human
acagggcaggcuagcgggcac

SEQ ID NO: 819572 - RNA, 23 nt, Human
accccaucccccgccaggaccag

SEQ ID NO: 819573 - RNA, 23 nt, Human
acccuccuccuggcuuccuccac

SEQ ID NO: 819574 - RNA, 24 nt, Human
accuccucgcucagccgcuccagc

SEQ ID NO: 819575 - RNA, 18 nt, Human
acggccagcagggcggcg

SEQ ID NO: 819576 - RNA, 22 nt, Human
acucuuuacaagguaaccuggg

SEQ ID NO: 819577 - RNA, 23 nt, Human
acugcugcccccagcuuuuggcu

SEQ ID NO: 819578 - RNA, 20 nt, Human
agaaccaagaaaacaggagc

SEQ ID NO: 819579 - RNA, 19 nt, Human
agaagaccccaaugcagcc

SEQ ID NO: 819580 - RNA, 22 nt, Human
agacgcgcgcuccuccagcucc

SEQ ID NO: 819581 - RNA, 22 nt, Human
agagcucagacgcgcgcuccuc

SEQ ID NO: 819582 - RNA, 22 nt, Human
agcaagcaaaagcucccuacuc

SEQ ID NO: 819583 - RNA, 22 nt, Human
agcacagagggcggcccugugc

SEQ ID NO: 819584 - RNA, 18 nt, Human
agcagcagagcucauccc

SEQ ID NO: 819585 - RNA, 19 nt, Human
agcaugacacccuugguau

SEQ ID NO: 819586 - RNA, 23 nt, Human
agccaggcccuuacuggaccucc

SEQ ID NO: 819587 - RNA, 19 nt, Human
agcgcauagcgcgcugcug

SEQ ID NO: 819588 - RNA, 21 nt, Human
agcugggugugcugcugcgcc

SEQ ID NO: 819589 - RNA, 22 nt, Human
aggaacuggggagaccucagcc

SEQ ID NO: 819590 - RNA, 18 nt, Human
aggaaguugggucccugg

SEQ ID NO: 819591 - RNA, 19 nt, Human
aggagagaacaaaagaaga

SEQ ID NO: 819592 - RNA, 25 nt, Human
aggagagaacaaaagaagagcguca

SEQ ID NO: 819593 - RNA, 21 nt, Human
aggagcugccuugauccuuag

SEQ ID NO: 819594 - RNA, 19 nt, Human
aggcaggaccaagaaaucc

SEQ ID NO: 819595 - RNA, 21 nt, Human
aggcaggaccaagaaauccaa

SEQ ID NO: 819596 - RNA, 25 nt, Human
aggcaggaccaagaaauccaaggca

SEQ ID NO: 819597 - RNA, 22 nt, Human
aggcagugcccugggucaggcc

SEQ ID NO: 819598 - RNA, 20 nt, Human
aggcccggggcaagggccgg

SEQ ID NO: 819599 - RNA, 18 nt, Human
aggcuggcgcugggcgug

SEQ ID NO: 819600 - RNA, 24 nt, Human
agggaaggcagcaccucugguucu

SEQ ID NO: 819601 - RNA, 19 nt, Human
aggggcugguggggcaggg

SEQ ID NO: 819602 - RNA, 20 nt, Human
aggggcugguggggcagggg

SEQ ID NO: 819603 - RNA, 24 nt, Human
aggggcugguggggcaggggcugc

SEQ ID NO: 819604 - RNA, 22 nt, Human
aguuggcaggacccccggccuc

SEQ ID NO: 819605 - RNA, 24 nt, Human
auccuucacacacagccagaacag

SEQ ID NO: 819606 - RNA, 21 nt, Human
auggagccagcugcucugggg

SEQ ID NO: 819607 - RNA, 21 nt, Human
caaaagcucccuacucagcag

SEQ ID NO: 819608 - RNA, 19 nt, Human
caaggaagcaaagcaagcc

SEQ ID NO: 819609 - RNA, 27 nt, Human
caaggcaggaccaagaaauccaaggca

SEQ ID NO: 819610 - RNA, 21 nt, Human
cacacacagccagaacagggu

SEQ ID NO: 819611 - RNA, 23 nt, Human
cacagaaccaagaaaacaggagc

SEQ ID NO: 819612 - RNA, 22 nt, Human
cacagggcaggcuagcgggcac

SEQ ID NO: 819613 - RNA, 24 nt, Human
cacauccuucacacacagccagaa

SEQ ID NO: 819614 - RNA, 23 nt, Human
caccaaaaaaauccaugcauaga

SEQ ID NO: 819615 - RNA, 26 nt, Human
caccccaaccuccuuucuagggcuaa

SEQ ID NO: 819616 - RNA, 19 nt, Human
cacccccacuaccccacug

SEQ ID NO: 819617 - RNA, 23 nt, Human
cacccccacuaccccacuguacu

SEQ ID NO: 819618 - RNA, 22 nt, Human
cagcaagcaaaagcucccuucu

SEQ ID NO: 819619 - RNA, 22 nt, Human
cagcaaugauagcaaaagcugg

SEQ ID NO: 819620 - RNA, 20 nt, Human
cagcacagagggcggcccug

SEQ ID NO: 819621 - RNA, 21 nt, Human
cagccgggguagggugggggu

SEQ ID NO: 819622 - RNA, 21 nt, Human
cagcuccuccuucucgcgccc

SEQ ID NO: 819623 - RNA, 22 nt, Human
cagcuccuguuccuugugcacc

SEQ ID NO: 819624 - RNA, 24 nt, Human
caggaccagcagccuaauggcuag

SEQ ID NO: 819625 - RNA, 23 nt, Human
caggagacuugacagucccccuc

SEQ ID NO: 819626 - RNA, 23 nt, Human
caggccccuaggucuggcugugg

SEQ ID NO: 819627 - RNA, 22 nt, Human
caggcccucuucguaggccaca

SEQ ID NO: 819628 - RNA, 19 nt, Human
caggcuagcgggcaccagg

SEQ ID NO: 819629 - RNA, 24 nt, Human
cagucccccuccagaagccaggga

SEQ ID NO: 819630 - RNA, 24 nt, Human
caguugggcaggcucaagccaagc

SEQ ID NO: 819631 - RNA, 22 nt, Human
cauucuaguguguaccacccag

SEQ ID NO: 819632 - RNA, 21 nt, Human
ccaaacccacccccacuaccc

SEQ ID NO: 819633 - RNA, 21 nt, Human
ccaaguacaccaaccucccag

SEQ ID NO: 819634 - RNA, 21 nt, Human
ccaaguggcuccagcucaggu

SEQ ID NO: 819635 - RNA, 18 nt, Human
ccaccgcccccaccucca

SEQ ID NO: 819636 - RNA, 20 nt, Human
ccaccucccuuccaggccuc

SEQ ID NO: 819637 - RNA, 21 nt, Human
ccagaagccagggauaacacu

SEQ ID NO: 819638 - RNA, 21 nt, Human
ccagaggcuacuccagccggg

SEQ ID NO: 819639 - RNA, 20 nt, Human
ccagggauaacacucggccu

SEQ ID NO: 819640 - RNA, 19 nt, Human
cccaccuccacggcccagg

SEQ ID NO: 819641 - RNA, 21 nt, Human
cccagacagccuuggugaccc

SEQ ID NO: 819642 - RNA, 25 nt, Human
cccgcgaucuucugcuccaccuccu

SEQ ID NO: 819643 - RNA, 19 nt, Human
cccuacucagcagcagagc

SEQ ID NO: 819644 - RNA, 19 nt, Human
cccucaguccacggggccc

SEQ ID NO: 819645 - RNA, 20 nt, Human
cccugccgcccccuacccgg

SEQ ID NO: 819646 - RNA, 26 nt, Human
cccuuacuggaccuccaccucccuuc

SEQ ID NO: 819647 - RNA, 19 nt, Human
ccgcagcuuggcgcuggcc

SEQ ID NO: 819648 - RNA, 21 nt, Human
ccgcagcuuggcgcuggccuc

SEQ ID NO: 819649 - RNA, 21 nt, Human
ccgccaggaccagcagccuaa

SEQ ID NO: 819650 - RNA, 22 nt, Human
ccuaauggcuagggcugggagc

SEQ ID NO: 819651 - RNA, 24 nt, Human
ccuagcucacuacccauacacccc

SEQ ID NO: 819652 - RNA, 21 nt, Human
ccucaaugaacugcugcagcc

SEQ ID NO: 819653 - RNA, 24 nt, Human
ccucaaugaacugcugcagccgca

SEQ ID NO: 819654 - RNA, 18 nt, Human
ccucagccuuuggagccu

SEQ ID NO: 819655 - RNA, 28 nt, Human
ccuccagcuccuccuucucggggccgcc

SEQ ID NO: 819656 - RNA, 20 nt, Human
ccucuggaggagaggaaaga

SEQ ID NO: 819657 - RNA, 21 nt, Human
ccucuggaggagaggaaagaa

SEQ ID NO: 819658 - RNA, 21 nt, Human
ccugcagccggcccaccuggc

SEQ ID NO: 819659 - RNA, 19 nt, Human
ccugcagcugccgcucggc

SEQ ID NO: 819660 - RNA, 19 nt, Human
ccuggcccgcgaucuucug

SEQ ID NO: 819661 - RNA, 19 nt, Human
ccugggccccgggcauugg

SEQ ID NO: 819662 - RNA, 20 nt, Human
ccuggggagaaguucugggu

SEQ ID NO: 819663 - RNA, 19 nt, Human
ccuuagguggucucuccug

SEQ ID NO: 819664 - RNA, 23 nt, Human
ccuuguauucagggauggaaggu

SEQ ID NO: 819665 - RNA, 24 nt, Human
ccuuguauucagggauggaagguc

SEQ ID NO: 819666 - RNA, 20 nt, Human
ccuugugcaccagguccugc

SEQ ID NO: 819667 - RNA, 21 nt, Human
cgagcacgccgaggacgccac

SEQ ID NO: 819668 - RNA, 22 nt, Human
cgaggggagcguggugauggug

SEQ ID NO: 819669 - RNA, 19 nt, Human
cgccaggaccagcagccua

SEQ ID NO: 819670 - RNA, 19 nt, Human
cgcccccaccuccacggcc

SEQ ID NO: 819671 - RNA, 21 nt, Human
cgcccccaccuccacggccca

SEQ ID NO: 819672 - RNA, 30 nt, Human
cgccgguccaccuccagcuucuccagcgcc

SEQ ID NO: 819673 - RNA, 20 nt, Human
cgcgcgcuccuccagcuccu

SEQ ID NO: 819674 - RNA, 20 nt, Human
cggagggcagcuucugucca

SEQ ID NO: 819675 - RNA, 22 nt, Human
cuacuucucacugugacagggc

SEQ ID NO: 819676 - RNA, 22 nt, Human
cuagcucacuacccauacaccc

SEQ ID NO: 819677 - RNA, 24 nt, Human
cucacuacccauacaccccaaccu

SEQ ID NO: 819678 - RNA, 21 nt, Human
cucgaagaccucucgccgggc

SEQ ID NO: 819679 - RNA, 26 nt, Human
cucggccugcagccggcccaccuggc

SEQ ID NO: 819680 - RNA, 20 nt, Human
cucuagugcagguggugcuc

SEQ ID NO: 819681 - RNA, 18 nt, Human
cugagaggaggaacuggg

SEQ ID NO: 819682 - RNA, 22 nt, Human
cugagcugccuuguggagcccc

SEQ ID NO: 819683 - RNA, 19 nt, Human
cugccgcccccuacccggg

SEQ ID NO: 819684 - RNA, 20 nt, Human
cugcgcccaugggaucccag

SEQ ID NO: 819685 - RNA, 21 nt, Human
cugcugcagccgcagcuuggc

SEQ ID NO: 819686 - RNA, 21 nt, Human
cuggggaaaggcuguggugcu

SEQ ID NO: 819687 - RNA, 20 nt, Human
cuuguggagcccccauuggc

SEQ ID NO: 819688 - RNA, 22 nt, Human
gaaccaagaaaacaggagcugc

SEQ ID NO: 819689 - RNA, 19 nt, Human
gaagagcgucaaggggcug

SEQ ID NO: 819690 - RNA, 21 nt, Human
gaauacucugaccucucauuc

SEQ ID NO: 819691 - RNA, 20 nt, Human
gaccaagaaauccaaggcag

SEQ ID NO: 819692 - RNA, 21 nt, Human
gaccccaucccccgccaggac

SEQ ID NO: 819693 - RNA, 19 nt, Human
gaccugcagcugccgcucg

SEQ ID NO: 819694 - RNA, 22 nt, Human
gaggagagaacaaaagaagagc

SEQ ID NO: 819695 - RNA, 21 nt, Human
gaggcagcggcggcggcggcc

SEQ ID NO: 819696 - RNA, 22 nt, Human
gaucuugaggcgcgccaggccc

SEQ ID NO: 819697 - RNA, 22 nt, Human
gcaaagcaagccacccuccucc

SEQ ID NO: 819698 - RNA, 20 nt, Human
gcaaaggccagugaaaagug

SEQ ID NO: 819699 - RNA, 18 nt, Human
gcagggagaagccaaugg

SEQ ID NO: 819700 - RNA, 23 nt, Human
gccacaggaggaaaagucagcaa

SEQ ID NO: 819701 - RNA, 18 nt, Human
gccccgggcauugggucc

SEQ ID NO: 819702 - RNA, 18 nt, Human
gcccugugccucccuccc

SEQ ID NO: 819703 - RNA, 21 nt, Human
gccgccuugcgcuccagcucg

SEQ ID NO: 819704 - RNA, 22 nt, Human
gcgaagcggaggcaggcccggg

SEQ ID NO: 819705 - RNA, 22 nt, Human
gcgcauagcgcgcugcugcggc

SEQ ID NO: 819706 - RNA, 21 nt, Human
gcgugcugccacagcugcugc

SEQ ID NO: 819707 - RNA, 21 nt, Human
gcuccagcucggccugcagcc

SEQ ID NO: 819708 - RNA, 24 nt, Human
gcucugggguaggaggcaaggggu

SEQ ID NO: 819709 - RNA, 18 nt, Human
gcugaugaccugcagcug

SEQ ID NO: 819710 - RNA, 20 nt, Human
gcugccuggggcugggaccu

SEQ ID NO: 819711 - RNA, 21 nt, Human
gcugggcugggcaggccaccc

SEQ ID NO: 819712 - RNA, 18 nt, Human
ggaaggacuggguaacga

SEQ ID NO: 819713 - RNA, 22 nt, Human
ggaaggcagcaccucugguucu

SEQ ID NO: 819714 - RNA, 19 nt, Human
ggaaggucccuggggcaga

SEQ ID NO: 819715 - RNA, 18 nt, Human
ggaccuccaccucccuuc

SEQ ID NO: 819716 - RNA, 21 nt, Human
ggacugggcagggaguugcca

SEQ ID NO: 819717 - RNA, 23 nt, Human
ggacugggcagggaguugccagc

SEQ ID NO: 819718 - RNA, 21 nt, Human
ggacuugcgggcgaacagcuc

SEQ ID NO: 819719 - RNA, 21 nt, Human
ggagcugggugugcugcugcg

SEQ ID NO: 819720 - RNA, 18 nt, Human
ggaguugccagcaugaca

SEQ ID NO: 819721 - RNA, 18 nt, Human
ggaucucgaucucgcgca

SEQ ID NO: 819722 - RNA, 22 nt, Human
ggcagcuucuguccaagccccu

SEQ ID NO: 819723 - RNA, 23 nt, Human
ggcugcaaagcugccagugcuug

SEQ ID NO: 819724 - RNA, 22 nt, Human
ggcugguggggcaggggcugca

SEQ ID NO: 819725 - RNA, 19 nt, Human
gggaccccaucccccgccg

SEQ ID NO: 819726 - RNA, 23 nt, Human
gggcaggcuagcgggcaccaggu

SEQ ID NO: 819727 - RNA, 20 nt, Human
gggcaugcaugaaggcuagg

SEQ ID NO: 819728 - RNA, 21 nt, Human
gggcccugccgcccccuaccc

SEQ ID NO: 819729 - RNA, 18 nt, Human
gggcucgggagccagcgg

SEQ ID NO: 819730 - RNA, 19 nt, Human
gggcuggugcagggagaag

SEQ ID NO: 819731 - RNA, 27 nt, Human
ggggccggggccaggcggcggcgucga

SEQ ID NO: 819732 - RNA, 20 nt, Human
ggggcuggcaggggcccugc

SEQ ID NO: 819733 - RNA, 21 nt, Human
ggguaaagauggaugaagugc

SEQ ID NO: 819734 - RNA, 19 nt, Human
ggucggagggcagcuucug

SEQ ID NO: 819735 - RNA, 20 nt, Human
guaggccacaucagcgggug

SEQ ID NO: 819736 - RNA, 21 nt, Human
guaucuuguucaccccucugc

SEQ ID NO: 819737 - RNA, 18 nt, Human
gugacgccaugggagcug

SEQ ID NO: 819738 - RNA, 22 nt, Human
uaacgaggggaccccauccccc

SEQ ID NO: 819739 - RNA, 21 nt, Human
uacaacuagcaucuguccuuu

SEQ ID NO: 819740 - RNA, 20 nt, Human
uacaccaaccucccagguag

SEQ ID NO: 819741 - RNA, 21 nt, Human
uacccauacaccccaaccucc

SEQ ID NO: 819742 - RNA, 24 nt, Human
uaccccacuguacugcugccccca

SEQ ID NO: 819743 - RNA, 26 nt, Human
uaccccacuguacugcugcccccagc

SEQ ID NO: 819744 - RNA, 19 nt, Human
uaccuggggccccuggagc

SEQ ID NO: 819745 - RNA, 25 nt, Human
uaccuggggccccuggagcagggcu

SEQ ID NO: 819746 - RNA, 21 nt, Human
uacuccagccgggguagggug

SEQ ID NO: 819747 - RNA, 20 nt, Human
uagaaacaccaaguggccac

SEQ ID NO: 819748 - RNA, 19 nt, Human
uaggaggcaaggggugcca

SEQ ID NO: 819749 - RNA, 19 nt, Human
uaggcagaagaccccaaug

SEQ ID NO: 819750 - RNA, 22 nt, Human
uagggugggggucggagggcag

SEQ ID NO: 819751 - RNA, 27 nt, Human
uaucuuguucaccccucugccucuagu

SEQ ID NO: 819752 - RNA, 18 nt, Human
uauuccugcagggaugca

SEQ ID NO: 819753 - RNA, 20 nt, Human
ucaaugaacugcugcagccg

SEQ ID NO: 819754 - RNA, 22 nt, Human
ucaaugaacugcugcagccgca

SEQ ID NO: 819755 - RNA, 23 nt, Human
ucacacacagccagaacagggug

SEQ ID NO: 819756 - RNA, 23 nt, Human
ucacugugacagggcugccuggg

SEQ ID NO: 819757 - RNA, 23 nt, Human
ucagcaccaccuuucucccaccc

SEQ ID NO: 819758 - RNA, 23 nt, Human
uccaaaccagggucccucugagg

SEQ ID NO: 819759 - RNA, 23 nt, Human
uccacagccugggcaggcugucu

SEQ ID NO: 819760 - RNA, 22 nt, Human
uccaccuccucgcucagccgcu

SEQ ID NO: 819761 - RNA, 23 nt, Human
uccagcaccaccgcccccaccuc

SEQ ID NO: 819762 - RNA, 19 nt, Human
uccagcacuuccccuaggc

SEQ ID NO: 819763 - RNA, 20 nt, Human
uccagcucggccugcagccg

SEQ ID NO: 819764 - RNA, 22 nt, Human
ucccagacagccuuggugaccc

SEQ ID NO: 819765 - RNA, 19 nt, Human
ucccagcucuggaggacuc

SEQ ID NO: 819766 - RNA, 22 nt, Human
ucccccagcgggaucucgaucu

SEQ ID NO: 819767 - RNA, 18 nt, Human
uccuucacacacagccag

SEQ ID NO: 819768 - RNA, 20 nt, Human
uccuucucgcgcccgagccu

SEQ ID NO: 819769 - RNA, 19 nt, Human
ucgaaagaacuuuccaaau

SEQ ID NO: 819770 - RNA, 25 nt, Human
ucgaagaccucucgccgggcgccgg

SEQ ID NO: 819771 - RNA, 22 nt, Human
ucgccgggcgccgggcacggcc

SEQ ID NO: 819772 - RNA, 22 nt, Human
ucguaggccacaucagcgggug

SEQ ID NO: 819773 - RNA, 27 nt, Human
ucucacugugacagggcugccuggggc

SEQ ID NO: 819774 - RNA, 24 nt, Human
ucuccagcgcgcggaucuugaggc

SEQ ID NO: 819775 - RNA, 20 nt, Human
ucucccacccuagcucacua

SEQ ID NO: 819776 - RNA, 24 nt, Human
ucucccccuggcaaucccccaccu

SEQ ID NO: 819777 - RNA, 21 nt, Human
ucuucauguccaagccagguu

SEQ ID NO: 819778 - RNA, 20 nt, Human
ucuuccuuggccccaugggu

SEQ ID NO: 819779 - RNA, 18 nt, Human
ucuugcaucuuacugggu

SEQ ID NO: 819780 - RNA, 19 nt, Human
ugaaacuacaacuagcauc

SEQ ID NO: 819781 - RNA, 22 nt, Human
ugacagcuccucacuggcugug

SEQ ID NO: 819782 - RNA, 23 nt, Human
ugaccaggaggcugggccucagg

SEQ ID NO: 819783 - RNA, 24 nt, Human
ugaccugcagcugccgcucggcac

SEQ ID NO: 819784 - RNA, 19 nt, Human
ugagaggaggaacugggga

SEQ ID NO: 819785 - RNA, 18 nt, Human
ugaggacagggcuggugc

SEQ ID NO: 819786 - RNA, 22 nt, Human
ugaggacagggcuggugcaggg

SEQ ID NO: 819787 - RNA, 18 nt, Human
ugagucuauugaggaugc

SEQ ID NO: 819788 - RNA, 23 nt, Human
ugagugaggccagcagcucuacg

SEQ ID NO: 819789 - RNA, 18 nt, Human
ugccaaggccacaucuuc

SEQ ID NO: 819790 - RNA, 24 nt, Human
ugccaaggccacaucuucaagcaa

SEQ ID NO: 819791 - RNA, 18 nt, Human
ugccacagcugcugcuga

SEQ ID NO: 819792 - RNA, 25 nt, Human
ugccacagcugcugcugaugaccug

SEQ ID NO: 819793 - RNA, 19 nt, Human
ugcccugggucaggccugu

SEQ ID NO: 819794 - RNA, 23 nt, Human
ugcccugggucaggccuguugcu

SEQ ID NO: 819795 - RNA, 26 nt, Human
ugccugggccccgggcauugggucca

SEQ ID NO: 819796 - RNA, 18 nt, Human
ugcuccaccuccucgcuc

SEQ ID NO: 819797 - RNA, 19 nt, Human
ugcugaugaccugcagcug

SEQ ID NO: 819798 - RNA, 19 nt, Human
ugcugcggcgggcacaagg

SEQ ID NO: 819799 - RNA, 21 nt, Human
ugcugcugcgcccaugggauc

SEQ ID NO: 819800 - RNA, 20 nt, Human
ugcuguggggaagcagccug

SEQ ID NO: 819801 - RNA, 21 nt, Human
ugcuguggggaagcagccuga

SEQ ID NO: 819802 - RNA, 21 nt, Human
ugcuugagugaggccagcagc

SEQ ID NO: 819803 - RNA, 25 nt, Human
ugcuugagugaggccagcagcucua

SEQ ID NO: 819804 - RNA, 22 nt, Human
uggaaggguggucucauccugg

SEQ ID NO: 819805 - RNA, 18 nt, Human
uggcagggggugguagaa

SEQ ID NO: 819806 - RNA, 29 nt, Human
uggcagggggugguagaaacaccaagugg

SEQ ID NO: 819807 - RNA, 23 nt, Human
uggcuccagcucagguccagcac

SEQ ID NO: 819808 - RNA, 22 nt, Human
uggcugugguacccccaggaaa

SEQ ID NO: 819809 - RNA, 25 nt, Human
uggcuucuaagccaaguggcuccuu

SEQ ID NO: 819810 - RNA, 23 nt, Human
ugggaaggacuggguaacgaggg

SEQ ID NO: 819811 - RNA, 21 nt, Human
ugggaaguggacguccccccu

SEQ ID NO: 819812 - RNA, 26 nt, Human
ugggacagagcuagggagugacgcca

SEQ ID NO: 819813 - RNA, 22 nt, Human
ugggaccuugacccucuggagg

SEQ ID NO: 819814 - RNA, 18 nt, Human
ugggcgaggggagcgugg

SEQ ID NO: 819815 - RNA, 20 nt, Human
uggggccccuggagcagggc

SEQ ID NO: 819816 - RNA, 21 nt, Human
uggggccccuggagcagggcu

SEQ ID NO: 819817 - RNA, 22 nt, Human
uggggcugggaccuugacccuc

SEQ ID NO: 819818 - RNA, 19 nt, Human
ugggguaggaggcaagggg

SEQ ID NO: 819819 - RNA, 20 nt, Human
ugggucaggccuguugcucu

SEQ ID NO: 819820 - RNA, 24 nt, Human
uggugauggugguggugcagcagg

SEQ ID NO: 819821 - RNA, 20 nt, Human
ugguguggggcuggcagggg

SEQ ID NO: 819822 - RNA, 26 nt, Human
ugugcaggacugggcagggggaacgc

SEQ ID NO: 819823 - RNA, 21 nt, Human
uguuaggaaguugggucccug

SEQ ID NO: 819824 - RNA, 24 nt, Human
uguucccauccucagcccuagcug

SEQ ID NO: 819825 - RNA, 18 nt, Human
uuacuggaccuccaccuc

SEQ ID NO: 819826 - RNA, 25 nt, Human
uuacuggaccuccaccucccuucca

SEQ ID NO: 819827 - RNA, 23 nt, Human
uucaagcaagcuaauuagacaag

SEQ ID NO: 819828 - RNA, 18 nt, Human
uucagggauggaaggucc

SEQ ID NO: 819829 - RNA, 19 nt, Human
uucagggauggaagguccc

SEQ ID NO: 819830 - RNA, 21 nt, Human
uucccauccucagcccuagcu

SEQ ID NO: 819831 - RNA, 21 nt, Human
uuccccuaggcagaagacccc

SEQ ID NO: 819832 - RNA, 21 nt, Human
uuccugaccccugaggacagg

SEQ ID NO: 819833 - RNA, 18 nt, Human
uuccuggaaauagccaaa

SEQ ID NO: 819834 - RNA, 18 nt, Human
uuccuuaaggacaggaac

SEQ ID NO: 819835 - RNA, 19 nt, Human
uuggcaaggcaggaccaag

SEQ ID NO: 819836 - RNA, 22 nt, Human
aaacaaagauggcuccuccucc

SEQ ID NO: 819837 - RNA, 24 nt, Human
aaagugcugggauuacagguguga

SEQ ID NO: 819838 - RNA, 22 nt, Human
aagauggcuccuccuccaccaa

SEQ ID NO: 819839 - RNA, 21 nt, Human
aagcagcugaaggcaagggcc

SEQ ID NO: 819840 - RNA, 19 nt, Human
aagccagggcagggaagag

SEQ ID NO: 819841 - RNA, 26 nt, Human
aaguaagcagaggagcggggcagggg

SEQ ID NO: 819842 - RNA, 19 nt, Human
aaguagcugggauuacagg

SEQ ID NO: 819843 - RNA, 25 nt, Human
aaguagcugggauuacaggcacccg

SEQ ID NO: 819844 - RNA, 18 nt, Human
aagugcugggauuacagg

SEQ ID NO: 819845 - RNA, 19 nt, Human
aagugcugggauuacaggu

SEQ ID NO: 819846 - RNA, 26 nt, Human
aagugcugggauuacaggugugagcc

SEQ ID NO: 819847 - RNA, 20 nt, Human
acagccagagaagccagggc

SEQ ID NO: 819848 - RNA, 18 nt, Human
accauguuggccaggcug

SEQ ID NO: 819849 - RNA, 21 nt, Human
accccaucugcccagaaguaa

SEQ ID NO: 819850 - RNA, 22 nt, Human
accccaucugcccagaaguaaa

SEQ ID NO: 819851 - RNA, 23 nt, Human
accuuagccucccaaagugcugg

SEQ ID NO: 819852 - RNA, 24 nt, Human
accuugugauccgcccaccuuagc

SEQ ID NO: 819853 - RNA, 23 nt, Human
acucccuccaccccaucugccca

SEQ ID NO: 819854 - RNA, 24 nt, Human
acugucgcccgggcuggagugcag

SEQ ID NO: 819855 - RNA, 21 nt, Human
agaagaggagaccauuccggg

SEQ ID NO: 819856 - RNA, 25 nt, Human
agaggagacguguuuggcugcccag

SEQ ID NO: 819857 - RNA, 20 nt, Human
agcugaaggcaagggccuca

SEQ ID NO: 819858 - RNA, 22 nt, Human
aggaacgccagacuugggcaau

SEQ ID NO: 819859 - RNA, 24 nt, Human
aggcagggccauguccaggcugcc

SEQ ID NO: 819860 - RNA, 21 nt, Human
aggcgucaggaccaggguggc

SEQ ID NO: 819861 - RNA, 21 nt, Human
agguucaagugauucuccugc

SEQ ID NO: 819862 - RNA, 22 nt, Human
agguucaagugauucuccugcc

SEQ ID NO: 819863 - RNA, 23 nt, Human
agguucaagugauucuccugccu

SEQ ID NO: 819864 - RNA, 20 nt, Human
agucccuucuccaagccagu

SEQ ID NO: 819865 - RNA, 24 nt, Human
agugauucuccugccucagccucc

SEQ ID NO: 819866 - RNA, 18 nt, Human
agugcaguggcgugaucu

SEQ ID NO: 819867 - RNA, 19 nt, Human
agugcaguggcgugaucuc

SEQ ID NO: 819868 - RNA, 24 nt, Human
agugcaguggcgugaucucaacuc

SEQ ID NO: 819869 - RNA, 18 nt, Human
augggguuucaccauguu

SEQ ID NO: 819870 - RNA, 22 nt, Human
augggguuucaccauguuggcc

SEQ ID NO: 819871 - RNA, 23 nt, Human
augggguuucaccauguuggcca

SEQ ID NO: 819872 - RNA, 24 nt, Human
augggguuucaccauguuggccag

SEQ ID NO: 819873 - RNA, 18 nt, Human
auucuccugccucagccu

SEQ ID NO: 819874 - RNA, 24 nt, Human
auuuuuguauuuuuaguagagaug

SEQ ID NO: 819875 - RNA, 19 nt, Human
caaacagcucugaguccag

SEQ ID NO: 819876 - RNA, 24 nt, Human
caaagugcugggauuacaggugug

SEQ ID NO: 819877 - RNA, 23 nt, Human
caaccuccaccucccagguucaa

SEQ ID NO: 819878 - RNA, 22 nt, Human
caagugauucuccugccucagc

SEQ ID NO: 819879 - RNA, 27 nt, Human
caagugauucuccugccucagccuccc

SEQ ID NO: 819880 - RNA, 22 nt, Human
caagugccguucacuagguucc

SEQ ID NO: 819881 - RNA, 24 nt, Human
caaucuucagccauguccagaaca

SEQ ID NO: 819882 - RNA, 24 nt, Human
caccacacccagcuaauuuuugua

SEQ ID NO: 819883 - RNA, 19 nt, Human
caccagagccagcgcaaug

SEQ ID NO: 819884 - RNA, 21 nt, Human
caccauguuggccaggcuggu

SEQ ID NO: 819885 - RNA, 24 nt, Human
caccauguuggccaggcuggucuc

SEQ ID NO: 819886 - RNA, 18 nt, Human
cacccgccaccacaccca

SEQ ID NO: 819887 - RNA, 19 nt, Human
caccguguacagauccagc

SEQ ID NO: 819888 - RNA, 21 nt, Human
cacugcaaccuccaccuccca

SEQ ID NO: 819889 - RNA, 21 nt, Human
cagaacaucgccaaaggcccc

SEQ ID NO: 819890 - RNA, 23 nt, Human
cagaaugaccagcaguggagcca

SEQ ID NO: 819891 - RNA, 22 nt, Human
cagcagcucuggagaguaggga

SEQ ID NO: 819892 - RNA, 20 nt, Human
cauccacagacucaaacacc

SEQ ID NO: 819893 - RNA, 24 nt, Human
cauguuggccaggcuggucucaaa

SEQ ID NO: 819894 - RNA, 20 nt, Human
ccaaagugcugggauuacag

SEQ ID NO: 819895 - RNA, 21 nt, Human
ccaaagugcugggauuacagg

SEQ ID NO: 819896 - RNA, 21 nt, Human
ccaaagugcugggauuacagg

SEQ ID NO: 819897 - RNA, 24 nt, Human
ccaaagugcugggauuacaggugu

SEQ ID NO: 819898 - RNA, 22 nt, Human
ccaacaaccuccaccuccugca

SEQ ID NO: 819899 - RNA, 23 nt, Human
ccaaguagcugggauuacaggca

SEQ ID NO: 819900 - RNA, 27 nt, Human
ccaccaacaaccuccaccuccugcaag

SEQ ID NO: 819901 - RNA, 24 nt, Human
ccaccagagccagcgcaaugaaca

SEQ ID NO: 819902 - RNA, 24 nt, Human
ccaccucccagguucaagugauuc

SEQ ID NO: 819903 - RNA, 25 nt, Human
ccagaacaucgccaaaggccccuug

SEQ ID NO: 819904 - RNA, 23 nt, Human
ccagaccaagaagacgucaucau

SEQ ID NO: 819905 - RNA, 25 nt, Human
ccagcaaacaaagauggcuccuccu

SEQ ID NO: 819906 - RNA, 20 nt, Human
ccaggaccccgcucccgggg

SEQ ID NO: 819907 - RNA, 23 nt, Human
ccauuccgggcaccagcaaacaa

SEQ ID NO: 819908 - RNA, 23 nt, Human
cccaaguagcugggauuacaggc

SEQ ID NO: 819909 - RNA, 24 nt, Human
cccaaguagcugggauuacaggca

SEQ ID NO: 819910 - RNA, 23 nt, Human
cccagguucaagugauucuccuc

SEQ ID NO: 819911 - RNA, 23 nt, Human
cccagguucaagugauucuccug

SEQ ID NO: 819912 - RNA, 22 nt, Human
cccaucugcccagaaguaaaag

SEQ ID NO: 819913 - RNA, 22 nt, Human
ccccacacaccucuucuacacc

SEQ ID NO: 819914 - RNA, 24 nt, Human
ccccacacaccucuucuacaccaa

SEQ ID NO: 819915 - RNA, 21 nt, Human
ccccaggucucaucuuacaag

SEQ ID NO: 819916 - RNA, 21 nt, Human
cccgccaccacacccagcuaa

SEQ ID NO: 819917 - RNA, 22 nt, Human
cccgggcuggagugcaguggcg

SEQ ID NO: 819918 - RNA, 26 nt, Human
ccgcccaccuuagccucccaaagugc

SEQ ID NO: 819919 - RNA, 19 nt, Human
ccgcuggaagacacagggg

SEQ ID NO: 819920 - RNA, 21 nt, Human
ccuacaaugcaggggacaguc

SEQ ID NO: 819921 - RNA, 24 nt, Human
ccucccagguucaagugauucucc

SEQ ID NO: 819922 - RNA, 21 nt, Human
ccuccgugggggaaguucugg

SEQ ID NO: 819923 - RNA, 23 nt, Human
ccugccucagccucccaaguagc

SEQ ID NO: 819924 - RNA, 24 nt, Human
ccugccucagccucccaaguagcu

SEQ ID NO: 819925 - RNA, 24 nt, Human
ccuucagccuccaccugcuccacc

SEQ ID NO: 819926 - RNA, 23 nt, Human
cuaauuuuuguauuuuuaguaga

SEQ ID NO: 819927 - RNA, 25 nt, Human
cucaaaacuccugaccuugugaucc

SEQ ID NO: 819928 - RNA, 24 nt, Human
cucacugcaaccuccaccucccag

SEQ ID NO: 819929 - RNA, 24 nt, Human
cucagccucccaaguagcugggau

SEQ ID NO: 819930 - RNA, 22 nt, Human
cuccaggcuguccugcacggcc

SEQ ID NO: 819931 - RNA, 18 nt, Human
cucccagguucaagugau

SEQ ID NO: 819932 - RNA, 19 nt, Human
cucccuccaccccaucugc

SEQ ID NO: 819933 - RNA, 28 nt, Human
cucccuccaccccaucugcccagaagua

SEQ ID NO: 819934 - RNA, 22 nt, Human
cuccuccaccaacaaccuccac

SEQ ID NO: 819935 - RNA, 22 nt, Human
cuccugaccuugugauccgccc

SEQ ID NO: 819936 - RNA, 25 nt, Human
cuccugccucagccucccaaguagc

SEQ ID NO: 819937 - RNA, 19 nt, Human
cucgcugcuccuccagccc

SEQ ID NO: 819938 - RNA, 19 nt, Human
cucugucucgcugcuccuc

SEQ ID NO: 819939 - RNA, 23 nt, Human
cugcaaccuccaccucccagguu

SEQ ID NO: 819940 - RNA, 24 nt, Human
cugcaaccuccaccucccagguuc

SEQ ID NO: 819941 - RNA, 18 nt, Human
cugcccagaaguaaaagu

SEQ ID NO: 819942 - RNA, 24 nt, Human
cuggagugcaguggcgugaucuca

SEQ ID NO: 819943 - RNA, 22 nt, Human
cuucagccuccaccugcuccac

SEQ ID NO: 819944 - RNA, 19 nt, Human
cuugaacugucgcccgggc

SEQ ID NO: 819945 - RNA, 19 nt, Human
gaacagacaccaggacccc

SEQ ID NO: 819946 - RNA, 25 nt, Human
gaacagacaccaggaccccgcuccc

SEQ ID NO: 819947 - RNA, 23 nt, Human
gaagcagcugaaggcaagggccu

SEQ ID NO: 819948 - RNA, 18 nt, Human
gaccaggguggcuuagcg

SEQ ID NO: 819949 - RNA, 21 nt, Human
gaccuugugauccgcccaccu

SEQ ID NO: 819950 - RNA, 24 nt, Human
gaccuugugauccgcccaccuuag

SEQ ID NO: 819951 - RNA, 24 nt, Human
gacgaguucucgcuugaaauccag

SEQ ID NO: 819952 - RNA, 18 nt, Human
gagaugggguuucaccau

SEQ ID NO: 819953 - RNA, 24 nt, Human
gagaugggguuucaccauguuggc

SEQ ID NO: 819954 - RNA, 19 nt, Human
gaggagaaguuaugggagg

SEQ ID NO: 819955 - RNA, 21 nt, Human
gaggagcauagagguagcccc

SEQ ID NO: 819956 - RNA, 18 nt, Human
gagugcucugagaggccc

SEQ ID NO: 819957 - RNA, 19 nt, Human
gauguucuggcggcccgaa

SEQ ID NO: 819958 - RNA, 18 nt, Human
gauuacaggugugagcca

SEQ ID NO: 819959 - RNA, 21 nt, Human
gauuacaggugugagccacca

SEQ ID NO: 819960 - RNA, 24 nt, Human
gauuacaggugugagccaccaugc

SEQ ID NO: 819961 - RNA, 24 nt, Human
gcagcucuggagaguaggugacgc

SEQ ID NO: 819962 - RNA, 20 nt, Human
gccaccaugcccggccuccu

SEQ ID NO: 819963 - RNA, 23 nt, Human
gcccagauggucucccagaccaa

SEQ ID NO: 819964 - RNA, 19 nt, Human
gcccgaggagaaguuaugg

SEQ ID NO: 819965 - RNA, 20 nt, Human
gcccgggcuggagugcagug

SEQ ID NO: 819966 - RNA, 24 nt, Human
gcccgggcuggagugcaguggcgu

SEQ ID NO: 819967 - RNA, 24 nt, Human
gccuucagccuccaccugcuccac

SEQ ID NO: 819968 - RNA, 21 nt, Human
gcuccuccagcccuccaucac

SEQ ID NO: 819969 - RNA, 23 nt, Human
gcugaaggcaagggccucaucau

SEQ ID NO: 819970 - RNA, 19 nt, Human
gcuggagugcaguggcgug

SEQ ID NO: 819971 - RNA, 19 nt, Human
ggaaguucugguucauccu

SEQ ID NO: 819972 - RNA, 20 nt, Human
ggaccaggguggcuuagcgu

SEQ ID NO: 819973 - RNA, 24 nt, Human
ggauuacaggugugagccaccaug

SEQ ID NO: 819974 - RNA, 22 nt, Human
ggcuggagugcaguggcgugau

SEQ ID NO: 819975 - RNA, 24 nt, Human
ggcuggagugcaguggcgugaucu

SEQ ID NO: 819976 - RNA, 20 nt, Human
gggcaauuuugcccugcagg

SEQ ID NO: 819977 - RNA, 18 nt, Human
gggcaccagcaaacaaag

SEQ ID NO: 819978 - RNA, 18 nt, Human
gggcugucacaaccaggg

SEQ ID NO: 819979 - RNA, 21 nt, Human
gggguguuccgcugggcgucc

SEQ ID NO: 819980 - RNA, 22 nt, Human
gggguuucaccauguuggccag

SEQ ID NO: 819981 - RNA, 22 nt, Human
ggguuucaccauguuggccagg

SEQ ID NO: 819982 - RNA, 23 nt, Human
guagagaugggguuucaccaugu

SEQ ID NO: 819983 - RNA, 18 nt, Human
guagcugggauuacaggc

SEQ ID NO: 819984 - RNA, 20 nt, Human
gucgcaccucugcacauccu

SEQ ID NO: 819985 - RNA, 23 nt, Human
gugaacagacaccaggaccccgc

SEQ ID NO: 819986 - RNA, 20 nt, Human
gugaagcagcugaaggcaag

SEQ ID NO: 819987 - RNA, 24 nt, Human
gugauccgcccaccuuagccuccc

SEQ ID NO: 819988 - RNA, 24 nt, Human
gugauucuccugccucagccuccc

SEQ ID NO: 819989 - RNA, 18 nt, Human
guggagggucaaucucua

SEQ ID NO: 819990 - RNA, 24 nt, Human
uaauuuuuguauuuuuaguagaga

SEQ ID NO: 819991 - RNA, 24 nt, Human
uacaggcacccgccaccacaccca

SEQ ID NO: 819992 - RNA, 23 nt, Human
uacaggugugagccaccaugccc

SEQ ID NO: 819993 - RNA, 22 nt, Human
uagagaugggguuucaccaugu

SEQ ID NO: 819994 - RNA, 24 nt, Human
uaguagagaugggguuucaccaug

SEQ ID NO: 819995 - RNA, 25 nt, Human
uaguagagaugggguuucaccaugu

SEQ ID NO: 819996 - RNA, 19 nt, Human
ucaagugauucuccugccu

SEQ ID NO: 819997 - RNA, 23 nt, Human
ucaaucuucagccauguccagaa

SEQ ID NO: 819998 - RNA, 24 nt, Human
ucacugcaaccuccaccucccagg

SEQ ID NO: 819999 - RNA, 25 nt, Human
ucacugcaaccuccaccucccaggu

SEQ ID NO: 820000 - RNA, 26 nt, Human
ucacugcaaccuccaccucccagguu

SEQ ID NO: 820001 - RNA, 18 nt, Human
ucagccucccaaguagcu

SEQ ID NO: 820002 - RNA, 20 nt, Human
ucagccucccaaguagcugg

SEQ ID NO: 820003 - RNA, 20 nt, Human
ucauccacagacucaaacac

SEQ ID NO: 820004 - RNA, 18 nt, Human
uccacagacucaaacacc

SEQ ID NO: 820005 - RNA, 18 nt, Human
uccacagacucaaacacc

SEQ ID NO: 820006 - RNA, 20 nt, Human
uccaccaacaaccuccaccu

SEQ ID NO: 820007 - RNA, 27 nt, Human
uccaccaacaaccuccaccuccugcaa

SEQ ID NO: 820008 - RNA, 22 nt, Human
uccaccagagccagcgcaauga

SEQ ID NO: 820009 - RNA, 21 nt, Human
uccaccccaucugcccagaag

SEQ ID NO: 820010 - RNA, 21 nt, Human
uccaucucaggcuccuccgag

SEQ ID NO: 820011 - RNA, 23 nt, Human
ucccaaagugcugggauuacagg

SEQ ID NO: 820012 - RNA, 24 nt, Human
ucccaaguagcugggauuacaggc

SEQ ID NO: 820013 - RNA, 21 nt, Human
ucccagguucaagugauucuc

SEQ ID NO: 820014 - RNA, 24 nt, Human
ucccagguucaagugauucuccug

SEQ ID NO: 820015 - RNA, 24 nt, Human
ucgcccgggcuggagugcaguggc

SEQ ID NO: 820016 - RNA, 21 nt, Human
ucucaaaacuccugaccuugu

SEQ ID NO: 820017 - RNA, 21 nt, Human
ucuccaaaaugaugucacggu

SEQ ID NO: 820018 - RNA, 26 nt, Human
ucuccaaguuggcgggcgugaaguac

SEQ ID NO: 820019 - RNA, 25 nt, Human
ucucuaagucaaucuucagccaugu

SEQ ID NO: 820020 - RNA, 24 nt, Human
ucuugaacugucgcccgggcugga

SEQ ID NO: 820021 - RNA, 22 nt, Human
ugaacagacaccaggaccccgc

SEQ ID NO: 820022 - RNA, 24 nt, Human
ugaacugucgcccgggcuggagug

SEQ ID NO: 820023 - RNA, 22 nt, Human
ugaagcagcugaaggcaagggc

SEQ ID NO: 820024 - RNA, 19 nt, Human
ugaccagcaguggagccag

SEQ ID NO: 820025 - RNA, 22 nt, Human
ugaccagcaguggagccagaag

SEQ ID NO: 820026 - RNA, 22 nt, Human
ugacccgagucuggggaacaag

SEQ ID NO: 820027 - RNA, 24 nt, Human
ugauccgcccaccuuagccuccca

SEQ ID NO: 820028 - RNA, 23 nt, Human
ugcaggcggauguucuggcggcc

SEQ ID NO: 820029 - RNA, 20 nt, Human
ugcccagaaguaaaagucag

SEQ ID NO: 820030 - RNA, 24 nt, Human
ugccucagccucccaaguagcugg

SEQ ID NO: 820031 - RNA, 21 nt, Human
ugcugcugcuggagucgcugu

SEQ ID NO: 820032 - RNA, 24 nt, Human
ugcugggauuacaggugugagcca

SEQ ID NO: 820033 - RNA, 19 nt, Human
uggagugcaguggcgugau

SEQ ID NO: 820034 - RNA, 23 nt, Human
uggagugcaguggcgugaucuca

SEQ ID NO: 820035 - RNA, 20 nt, Human
uggcagaaguagucacagcc

SEQ ID NO: 820036 - RNA, 25 nt, Human
uggccaggcuggucucaaaacuccu

SEQ ID NO: 820037 - RNA, 21 nt, Human
uggcgugaucucaacucacug

SEQ ID NO: 820038 - RNA, 24 nt, Human
uggcgugaucucaacucacugcaa

SEQ ID NO: 820039 - RNA, 21 nt, Human
ugggauuacaggcacccgcca

SEQ ID NO: 820040 - RNA, 22 nt, Human
ugggauuacaggcacccgccac

SEQ ID NO: 820041 - RNA, 24 nt, Human
ugggauuacaggcacccgccacca

SEQ ID NO: 820042 - RNA, 18 nt, Human
ugggauuacaggugugag

SEQ ID NO: 820043 - RNA, 22 nt, Human
ugggauuacaggugugagccac

SEQ ID NO: 820044 - RNA, 23 nt, Human
ugggauuacaggugugagccacc

SEQ ID NO: 820045 - RNA, 24 nt, Human
ugggauuacaggugugagccacca

SEQ ID NO: 820046 - RNA, 25 nt, Human
ugggauuacaggugugagccaccau

SEQ ID NO: 820047 - RNA, 19 nt, Human
uggggguguuccgcugggc

SEQ ID NO: 820048 - RNA, 24 nt, Human
ugggguuucaccauguuggccagg

SEQ ID NO: 820049 - RNA, 21 nt, Human
uguauuuuuaguagagauggg

SEQ ID NO: 820050 - RNA, 21 nt, Human
ugucuagagacauuuuugggg

SEQ ID NO: 820051 - RNA, 26 nt, Human
ugucuagagacauuuuugggggcugu

SEQ ID NO: 820052 - RNA, 21 nt, Human
ugugaacagacaccaggaccc

SEQ ID NO: 820053 - RNA, 18 nt, Human
ugugagccaccaugcccg

SEQ ID NO: 820054 - RNA, 18 nt, Human
uuagccucccaaagugcu

SEQ ID NO: 820055 - RNA, 18 nt, Human
uuaguagagaugggguuu

SEQ ID NO: 820056 - RNA, 22 nt, Human
uuaguagagaugggguuucacc

SEQ ID NO: 820057 - RNA, 24 nt, Human
uuaguagagaugggguuucaccau

SEQ ID NO: 820058 - RNA, 21 nt, Human
uucaagugauucuccugccuc

SEQ ID NO: 820059 - RNA, 23 nt, Human
uucaagugauucuccugccucag

SEQ ID NO: 820060 - RNA, 24 nt, Human
uucaagugauucuccugccucagc

SEQ ID NO: 820061 - RNA, 23 nt, Human
uucagccauguccagaacaucgc

SEQ ID NO: 820062 - RNA, 23 nt, Human
uucgcaaugucuagagacauuuu

SEQ ID NO: 820063 - RNA, 24 nt, Human
uugaacugucgcccgggcuggagu

SEQ ID NO: 820064 - RNA, 21 nt, Human
uuggagggauagggaaagaag

SEQ ID NO: 820065 - RNA, 23 nt, Human
uuguauuuuuaguagagaugggg

SEQ ID NO: 820066 - RNA, 24 nt, Human
uuucaccauguuggccaggcuggu

SEQ ID NO: 820067 - RNA, 24 nt, Human
uuuccaucucaggcuccuccgagg

SEQ ID NO: 820068 - RNA, 24 nt, Human
uuuuuaguagagaugggguuucac

SEQ ID NO: 820069 - RNA, 20 nt, Human
uuuuuguauuuuuaguagag

SEQ ID NO: 820070 - RNA, 23 nt, Human
aaaccucagucucaagagcacca

SEQ ID NO: 820071 - RNA, 23 nt, Human
aaagacacacacucaaaauuaca

SEQ ID NO: 820072 - RNA, 23 nt, Human
aaagacccaucccaaguggcccu

SEQ ID NO: 820073 - RNA, 21 nt, Human
aaaggugagugagaaccaaug

SEQ ID NO: 820074 - RNA, 20 nt, Human
aaccucuuaagcaagacacu

SEQ ID NO: 820075 - RNA, 23 nt, Human
aacgcuaggcaccacugccauuc

SEQ ID NO: 820076 - RNA, 22 nt, Human
aacugcccucucccucccccac

SEQ ID NO: 820077 - RNA, 19 nt, Human
aagcagggagaagauaggu

SEQ ID NO: 820078 - RNA, 18 nt, Human
aaggagcuggcugugcug

SEQ ID NO: 820079 - RNA, 18 nt, Human
aaggagcuggcugugcug

SEQ ID NO: 820080 - RNA, 21 nt, Human
aaggagggacccaugcacagc

SEQ ID NO: 820081 - RNA, 24 nt, Human
aaggauucucauugaaaaggggug

SEQ ID NO: 820082 - RNA, 23 nt, Human
aaguacccugaagggcucagagg

SEQ ID NO: 820083 - RNA, 19 nt, Human
aauaaagaaguacccugaa

SEQ ID NO: 820084 - RNA, 20 nt, Human
accacaugcacugaugcccc

SEQ ID NO: 820085 - RNA, 21 nt, Human
acccagaacccccccaacucc

SEQ ID NO: 820086 - RNA, 25 nt, Human
acccagaacccccccaacuccacac

SEQ ID NO: 820087 - RNA, 18 nt, Human
acugcccucucccucccc

SEQ ID NO: 820088 - RNA, 26 nt, Human
agaaaaaagacccagcaaauacuaca

SEQ ID NO: 820089 - RNA, 23 nt, Human
agaacaaccacaacgcuaggcac

SEQ ID NO: 820090 - RNA, 19 nt, Human
agaaggaguaaagacacac

SEQ ID NO: 820091 - RNA, 19 nt, Human
agacaaugacucacaauca

SEQ ID NO: 820092 - RNA, 23 nt, Human
agagagaaaaugaccagagggaa

SEQ ID NO: 820093 - RNA, 19 nt, Human
agagaugagauggagagga

SEQ ID NO: 820094 - RNA, 21 nt, Human
agcagggagaagauagguuca

SEQ ID NO: 820095 - RNA, 23 nt, Human
aggaagaaggaguaaagacacac

SEQ ID NO: 820096 - RNA, 18 nt, Human
aggagagagauacagaga

SEQ ID NO: 820097 - RNA, 23 nt, Human
aggaggaaagggaagugcccugg

SEQ ID NO: 820098 - RNA, 21 nt, Human
agggagaagauagguucaaag

SEQ ID NO: 820099 - RNA, 23 nt, Human
agggagaagauagguucaaagga

SEQ ID NO: 820100 - RNA, 29 nt, Human
agggagaagauagguucaaaggggacccc

SEQ ID NO: 820101 - RNA, 20 nt, Human
agggauauccagagucaugg

SEQ ID NO: 820102 - RNA, 20 nt, Human
agggcuaagguugggagggu

SEQ ID NO: 820103 - RNA, 22 nt, Human
agggcuccuccaugccagcgcu

SEQ ID NO: 820104 - RNA, 26 nt, Human
aggggcucgacgaggcacaggggugg

SEQ ID NO: 820105 - RNA, 19 nt, Human
agguccugguauggagcag

SEQ ID NO: 820106 - RNA, 20 nt, Human
aguacccugaagggcucaga

SEQ ID NO: 820107 - RNA, 25 nt, Human
agugcuugcaaaccugcaucuucac

SEQ ID NO: 820108 - RNA, 19 nt, Human
auguggauuuuacaauauc

SEQ ID NO: 820109 - RNA, 19 nt, Human
caaaauuacagagaugaga

SEQ ID NO: 820110 - RNA, 20 nt, Human
caagagggcuccuccaugcc

SEQ ID NO: 820111 - RNA, 18 nt, Human
caagaugugcugcuccag

SEQ ID NO: 820112 - RNA, 19 nt, Human
cacacaggcaccccgauuu

SEQ ID NO: 820113 - RNA, 22 nt, Human
cacagcucauucuuaagagcuc

SEQ ID NO: 820114 - RNA, 19 nt, Human
cacaguugcaggggagagg

SEQ ID NO: 820115 - RNA, 20 nt, Human
caccacccgcugcccccgac

SEQ ID NO: 820116 - RNA, 22 nt, Human
cacccagaacccccccaacucc

SEQ ID NO: 820117 - RNA, 22 nt, Human
caccccgauuugucucaacagc

SEQ ID NO: 820118 - RNA, 24 nt, Human
caccuccugcugguuuuccaaaau

SEQ ID NO: 820119 - RNA, 24 nt, Human
caccugaguuguacuuuucuucca

SEQ ID NO: 820120 - RNA, 21 nt, Human
cacucccucauucugccucca

SEQ ID NO: 820121 - RNA, 23 nt, Human
cacuggacugccugugaucgcgc

SEQ ID NO: 820122 - RNA, 22 nt, Human
cagagcucaggcugccaacuuc

SEQ ID NO: 820123 - RNA, 20 nt, Human
cagccacuuccuuggccugu

SEQ ID NO: 820124 - RNA, 24 nt, Human
cagcggcugcaguauucaacagaa

SEQ ID NO: 820125 - RNA, 19 nt, Human
caggaagggcagagccagg

SEQ ID NO: 820126 - RNA, 22 nt, Human
caggaccaagugcuugcaaacc

SEQ ID NO: 820127 - RNA, 18 nt, Human
caggagcaggugacuuac

SEQ ID NO: 820128 - RNA, 22 nt, Human
ccaacuccacacgcccugcacg

SEQ ID NO: 820129 - RNA, 22 nt, Human
cccaacacaccauucucuaccu

SEQ ID NO: 820130 - RNA, 22 nt, Human
cccaacuccacacgcccugcac

SEQ ID NO: 820131 - RNA, 21 nt, Human
cccacaggugaccaacggcuu

SEQ ID NO: 820132 - RNA, 21 nt, Human
cccacauuccagaugaggaag

SEQ ID NO: 820133 - RNA, 26 nt, Human
cccaccacccgcugcccccgaccauc

SEQ ID NO: 820134 - RNA, 20 nt, Human
cccagaacccccccaacucu

SEQ ID NO: 820135 - RNA, 24 nt, Human
ccccaaauaaagcaccuguucuca

SEQ ID NO: 820136 - RNA, 26 nt, Human
ccccaacuccacacgcccugcacguu

SEQ ID NO: 820137 - RNA, 21 nt, Human
cccccccaacuccacacgccc

SEQ ID NO: 820138 - RNA, 22 nt, Human
cccccccaacuccacacgcccu

SEQ ID NO: 820139 - RNA, 22 nt, Human
cccucuucuuccccuucuacug

SEQ ID NO: 820140 - RNA, 24 nt, Human
cccucuucuuccccuucuacuguc

SEQ ID NO: 820141 - RNA, 26 nt, Human
cccucuucuuccccuucuacugucuu

SEQ ID NO: 820142 - RNA, 23 nt, Human
ccucagaacaaccacaacgcuuu

SEQ ID NO: 820143 - RNA, 19 nt, Human
ccucagaguuacccgggag

SEQ ID NO: 820144 - RNA, 19 nt, Human
ccugcuggauccaccacuu

SEQ ID NO: 820145 - RNA, 20 nt, Human
cgcgcucacagcaagaugug

SEQ ID NO: 820146 - RNA, 23 nt, Human
cgcucacagcaagaugugcugcu

SEQ ID NO: 820147 - RNA, 23 nt, Human
cggggucauuggcugaggcugua

SEQ ID NO: 820148 - RNA, 24 nt, Human
cgucacaggcuccgcuuuucaggg

SEQ ID NO: 820149 - RNA, 23 nt, Human
cuagcucaaugaugcaccucccc

SEQ ID NO: 820150 - RNA, 24 nt, Human
cucacaaucaugccucccacagcu

SEQ ID NO: 820151 - RNA, 23 nt, Human
cucccccacccacaggugaccaa

SEQ ID NO: 820152 - RNA, 18 nt, Human
cugcaccuggaccugacc

SEQ ID NO: 820153 - RNA, 18 nt, Human
cugcaccuggaccugacc

SEQ ID NO: 820154 - RNA, 18 nt, Human
cugcccagugacuaccug

SEQ ID NO: 820155 - RNA, 21 nt, Human
cugcugcuuuguuucucuucc

SEQ ID NO: 820156 - RNA, 24 nt, Human
cugcuggauccaccacuuucacac

SEQ ID NO: 820157 - RNA, 18 nt, Human
cugcugguuuuccaaaau

SEQ ID NO: 820158 - RNA, 18 nt, Human
cuggucuuaagcaaugcu

SEQ ID NO: 820159 - RNA, 24 nt, Human
cuugcaaaccugcaucuucaccac

SEQ ID NO: 820160 - RNA, 19 nt, Human
cuuucggggcugacugcag

SEQ ID NO: 820161 - RNA, 24 nt, Human
gaaaaaagacccagcaaauacuac

SEQ ID NO: 820162 - RNA, 19 nt, Human
gaaagguauccacauccuc

SEQ ID NO: 820163 - RNA, 23 nt, Human
gacaacugaagagcagagagaga

SEQ ID NO: 820164 - RNA, 18 nt, Human
gagugagaaccaaugucu

SEQ ID NO: 820165 - RNA, 26 nt, Human
gauacagagacagacacacagagaga

SEQ ID NO: 820166 - RNA, 20 nt, Human
gauccauggaugcuccaccu

SEQ ID NO: 820167 - RNA, 21 nt, Human
gaugcggacuccaggccucgc

SEQ ID NO: 820168 - RNA, 24 nt, Human
gaugggaagaagcaaguucaaugu

SEQ ID NO: 820169 - RNA, 22 nt, Human
gcaaaccugcaucuucaccaca

SEQ ID NO: 820170 - RNA, 18 nt, Human
gcagagagagagagaaaa

SEQ ID NO: 820171 - RNA, 19 nt, Human
gcccacauguucccuuuca

SEQ ID NO: 820172 - RNA, 20 nt, Human
gcggguguauccugagaacg

SEQ ID NO: 820173 - RNA, 26 nt, Human
gcuuuucagggaauccaaacaugcgg

SEQ ID NO: 820174 - RNA, 25 nt, Human
ggaauucucugauguauccuugccc

SEQ ID NO: 820175 - RNA, 18 nt, Human
ggacaugucuucgggaga

SEQ ID NO: 820176 - RNA, 18 nt, Human
ggaggagguccugguaug

SEQ ID NO: 820177 - RNA, 18 nt, Human
ggagguccugguauggag

SEQ ID NO: 820178 - RNA, 21 nt, Human
ggcaaucacccaacacaccau

SEQ ID NO: 820179 - RNA, 20 nt, Human
ggcaggagugggggagccug

SEQ ID NO: 820180 - RNA, 21 nt, Human
ggcccaaggaggaggaaaggg

SEQ ID NO: 820181 - RNA, 20 nt, Human
gggaauguauauccccuggu

SEQ ID NO: 820182 - RNA, 22 nt, Human
ggggagaaaaaagacccagcaa

SEQ ID NO: 820183 - RNA, 21 nt, Human
gugauucagaacucguuuuug

SEQ ID NO: 820184 - RNA, 18 nt, Human
uaaagaaguacccugaag

SEQ ID NO: 820185 - RNA, 21 nt, Human
uaauaauagcagacgcuguua

SEQ ID NO: 820186 - RNA, 24 nt, Human
uacacacacaugaucuaaagagaa

SEQ ID NO: 820187 - RNA, 18 nt, Human
uaccaggaagggcagagc

SEQ ID NO: 820188 - RNA, 18 nt, Human
uacccgggaguuaugucc

SEQ ID NO: 820189 - RNA, 19 nt, Human
uacccugaagggcucagag

SEQ ID NO: 820190 - RNA, 20 nt, Human
uaccuggugcaagagggcuc

SEQ ID NO: 820191 - RNA, 21 nt, Human
uaccuuggagugagcgugaga

SEQ ID NO: 820192 - RNA, 21 nt, Human
uagcagacgcuguuaugaaag

SEQ ID NO: 820193 - RNA, 18 nt, Human
uagcucaaugaugcaccu

SEQ ID NO: 820194 - RNA, 23 nt, Human
uagcuuuccugggggaaggcaau

SEQ ID NO: 820195 - RNA, 22 nt, Human
uauggagcagacauuggguguu

SEQ ID NO: 820196 - RNA, 20 nt, Human
uauguccugcucaccccgcu

SEQ ID NO: 820197 - RNA, 22 nt, Human
ucacacccagaacccccccaac

SEQ ID NO: 820198 - RNA, 22 nt, Human
ucacuugggaguugacacaaaa

SEQ ID NO: 820199 - RNA, 21 nt, Human
ucagacgcucagugauucaga

SEQ ID NO: 820200 - RNA, 22 nt, Human
uccacacgcccugcacguucca

SEQ ID NO: 820201 - RNA, 24 nt, Human
uccacacgcccugcacguuccaca

SEQ ID NO: 820202 - RNA, 24 nt, Human
uccaugaucugagacagcucuggc

SEQ ID NO: 820203 - RNA, 22 nt, Human
ucccacagcugacggcggcacu

SEQ ID NO: 820204 - RNA, 33 nt, Human
uccccugcaggcacgggguggauucugaggcug

SEQ ID NO: 820205 - RNA, 19 nt, Human
ucccucagaguuacccggg

SEQ ID NO: 820206 - RNA, 25 nt, Human
uccuugucagccacuuccuuggccu

SEQ ID NO: 820207 - RNA, 23 nt, Human
ucgaggccacaucuuuggacagg

SEQ ID NO: 820208 - RNA, 20 nt, Human
ucucuacagaaugucacuug

SEQ ID NO: 820209 - RNA, 19 nt, Human
ucucugaguacccaggcuu

SEQ ID NO: 820210 - RNA, 24 nt, Human
ucugcccaccacccgcugcccccg

SEQ ID NO: 820211 - RNA, 24 nt, Human
ucuucugcccaccacccgcugccc

SEQ ID NO: 820212 - RNA, 19 nt, Human
ugaaaggugagugagaacc

SEQ ID NO: 820213 - RNA, 21 nt, Human
ugacacaaaacccagggggag

SEQ ID NO: 820214 - RNA, 21 nt, Human
ugaccagagggaaaaauagaa

SEQ ID NO: 820215 - RNA, 21 nt, Human
ugaccuugcuuagccccucuu

SEQ ID NO: 820216 - RNA, 22 nt, Human
ugagagacaaugacucacaauc

SEQ ID NO: 820217 - RNA, 26 nt, Human
ugagauggagaggaagcagggagaag

SEQ ID NO: 820218 - RNA, 23 nt, Human
ugaguaauaauagcagacgcugu

SEQ ID NO: 820219 - RNA, 22 nt, Human
ugcagaccacuuuccccugcag

SEQ ID NO: 820220 - RNA, 18 nt, Human
ugcaguauucaacagaac

SEQ ID NO: 820221 - RNA, 19 nt, Human
ugcccaccacccgcugccc

SEQ ID NO: 820222 - RNA, 21 nt, Human
ugcccagguugcggggggagc

SEQ ID NO: 820223 - RNA, 19 nt, Human
ugccgacagcuccugccac

SEQ ID NO: 820224 - RNA, 18 nt, Human
ugcguguguugccgacag

SEQ ID NO: 820225 - RNA, 24 nt, Human
uggaaaacagacaacugaagagca

SEQ ID NO: 820226 - RNA, 19 nt, Human
uggaggugcuucccuuucc

SEQ ID NO: 820227 - RNA, 22 nt, Human
uggcugcagaaaccucagucuc

SEQ ID NO: 820228 - RNA, 22 nt, Human
ugggaagaagcaaguucaaugu

SEQ ID NO: 820229 - RNA, 21 nt, Human
uggugcaagagggcuccucca

SEQ ID NO: 820230 - RNA, 18 nt, Human
uguccggugugugugagg

SEQ ID NO: 820231 - RNA, 28 nt, Human
uguccugcucaccccgcuucucugccca

SEQ ID NO: 820232 - RNA, 25 nt, Human
ugucuugucuccuagcuuuccuggg

SEQ ID NO: 820233 - RNA, 24 nt, Human
uguugccgacagcuccugccacau

SEQ ID NO: 820234 - RNA, 25 nt, Human
uuacacacacaugaucuaaagagaa

SEQ ID NO: 820235 - RNA, 22 nt, Human
uuacuggcugcagaaaccucag

SEQ ID NO: 820236 - RNA, 24 nt, Human
uucaauguaaggauuuuguucucu

SEQ ID NO: 820237 - RNA, 24 nt, Human
uucacacccagaacccccccaacu

SEQ ID NO: 820238 - RNA, 21 nt, Human
uucacagaaguugcccaccau

SEQ ID NO: 820239 - RNA, 22 nt, Human
uucauaggcuucauaagugaag

SEQ ID NO: 820240 - RNA, 22 nt, Human
uuccacacaggcaccccgauuu

SEQ ID NO: 820241 - RNA, 24 nt, Human
uuccagaugaggaagccggcagga

SEQ ID NO: 820242 - RNA, 25 nt, Human
uucccuagaggggcucgacgaggca

SEQ ID NO: 820243 - RNA, 20 nt, Human
uucccuuuccuccccuuacu

SEQ ID NO: 820244 - RNA, 18 nt, Human
uucucugcccagugacua

SEQ ID NO: 820245 - RNA, 19 nt, Human
uugacacaaaacccagggg

SEQ ID NO: 820246 - RNA, 21 nt, Human
uugcaggauccuaucuggcug

SEQ ID NO: 820247 - RNA, 19 nt, Human
uuguacuuuucuuccauag

SEQ ID NO: 820248 - RNA, 18 nt, Human
uuguccugcugcuuuguu

SEQ ID NO: 820249 - RNA, 21 nt, Human
uuguccugcugcuuuguuucu

SEQ ID NO: 820250 - RNA, 18 nt, Human
uuuugaguaauaauagca

SEQ ID NO: 820251 - RNA, 20 nt, Human
uuuuguccugcugcuuuguu

SEQ ID NO: 820252 - RNA, 23 nt, Human
aaaaaauagaaacaccuggaaac

SEQ ID NO: 820253 - RNA, 18 nt, Human
aaaaacaaccaaagagcu

SEQ ID NO: 820254 - RNA, 18 nt, Human
aaaagggcauaaucccua

SEQ ID NO: 820255 - RNA, 30 nt, Human
aaagcaaacaaguaguucuagaaaagcccc

SEQ ID NO: 820256 - RNA, 21 nt, Human
aaaguuauauccaaaaacaac

SEQ ID NO: 820257 - RNA, 21 nt, Human
aaauacaccgaaauaugagau

SEQ ID NO: 820258 - RNA, 22 nt, Human
aaccaaagagcuggugucuccc

SEQ ID NO: 820259 - RNA, 23 nt, Human
aacuggauauacaacuauccuga

SEQ ID NO: 820260 - RNA, 22 nt, Human
aacuugaggaguauauauuuca

SEQ ID NO: 820261 - RNA, 19 nt, Human
aagcauuccuugguaucuu

SEQ ID NO: 820262 - RNA, 21 nt, Human
aagucauaaaaauugauuuau

SEQ ID NO: 820263 - RNA, 22 nt, Human
aaucaucuagguuuauauuuga

SEQ ID NO: 820264 - RNA, 22 nt, Human
acaaaaaauagaaacaccugga

SEQ ID NO: 820265 - RNA, 19 nt, Human
acaaaacugaaaaaagaag

SEQ ID NO: 820266 - RNA, 20 nt, Human
acagcagacacacaaucccc

SEQ ID NO: 820267 - RNA, 18 nt, Human
accuggaaacaagaaggc

SEQ ID NO: 820268 - RNA, 18 nt, Human
acucugcuugagacaugu

SEQ ID NO: 820269 - RNA, 18 nt, Human
agaaacaccuggaaacaa

SEQ ID NO: 820270 - RNA, 18 nt, Human
aggcagaagaagacguaa

SEQ ID NO: 820271 - RNA, 19 nt, Human
auagaaacaccuggaaaca

SEQ ID NO: 820272 - RNA, 24 nt, Human
augcaagucuauaucaaaggcacu

SEQ ID NO: 820273 - RNA, 18 nt, Human
auugcacaucuagcuaua

SEQ ID NO: 820274 - RNA, 25 nt, Human
caaaaaauagaaacaccuggaaaca

SEQ ID NO: 820275 - RNA, 25 nt, Human
caaccaaagagcuggugucucccuc

SEQ ID NO: 820276 - RNA, 21 nt, Human
caaguaguucuagaaaagccc

SEQ ID NO: 820277 - RNA, 21 nt, Human
cagaggauucaaacacauagu

SEQ ID NO: 820278 - RNA, 19 nt, Human
cagcuuuuuaacaggaaau

SEQ ID NO: 820279 - RNA, 23 nt, Human
cagcuuuuuaacaggaaauuugu

SEQ ID NO: 820280 - RNA, 21 nt, Human
caucacccaaaaauaaaugaa

SEQ ID NO: 820281 - RNA, 23 nt, Human
ccaacauaaacaauuuaucaaua

SEQ ID NO: 820282 - RNA, 22 nt, Human
ccaugguagaggcaacauuuuu

SEQ ID NO: 820283 - RNA, 20 nt, Human
ccauuuacucugcuugagac

SEQ ID NO: 820284 - RNA, 19 nt, Human
cccacagaucucuaaaacc

SEQ ID NO: 820285 - RNA, 19 nt, Human
ccuuuaauauauauccaaa

SEQ ID NO: 820286 - RNA, 19 nt, Human
cgagacagcagacacacaa

SEQ ID NO: 820287 - RNA, 21 nt, Human
cucacaaaugagaagucacac

SEQ ID NO: 820288 - RNA, 23 nt, Human
cucaucaacauuuaagaaaaaca

SEQ ID NO: 820289 - RNA, 20 nt, Human
cuuugugauaacuccagagu

SEQ ID NO: 820290 - RNA, 24 nt, Human
gaaacaccuggaaacaagaaggca

SEQ ID NO: 820291 - RNA, 19 nt, Human
gacagcuaagcuugcuuca

SEQ ID NO: 820292 - RNA, 21 nt, Human
gauuuguaaaaaguuucccuu

SEQ ID NO: 820293 - RNA, 20 nt, Human
ggaaacaagaaggcaaaaug

SEQ ID NO: 820294 - RNA, 21 nt, Human
ggaaacaagaaggcaaaaugu

SEQ ID NO: 820295 - RNA, 28 nt, Human
gggaaaaauaaacacuuaaaauauaaug

SEQ ID NO: 820296 - RNA, 21 nt, Human
gucucauuuucuuaaguucgu

SEQ ID NO: 820297 - RNA, 20 nt, Human
uaaaauaaguggcauaccug

SEQ ID NO: 820298 - RNA, 24 nt, Human
uaaaauaaguggcauaccugaaug

SEQ ID NO: 820299 - RNA, 24 nt, Human
uaaaugaauaggccagaaaaagca

SEQ ID NO: 820300 - RNA, 26 nt, Human
uaaaugaauccaucaguuagucaaga

SEQ ID NO: 820301 - RNA, 23 nt, Human
uaacagcaauaaauacaccgaaa

SEQ ID NO: 820302 - RNA, 25 nt, Human
uaacagcaauaaauacaccgaaaua

SEQ ID NO: 820303 - RNA, 22 nt, Human
uaacaggaaauuugugaacuac

SEQ ID NO: 820304 - RNA, 24 nt, Human
uaacgagcuuuuauuuuuaggaug

SEQ ID NO: 820305 - RNA, 18 nt, Human
uaagaaaaaugggaucag

SEQ ID NO: 820306 - RNA, 21 nt, Human
uaagaagccuucucuaauuaa

SEQ ID NO: 820307 - RNA, 21 nt, Human
uaagaccaauaagaagccuuc

SEQ ID NO: 820308 - RNA, 23 nt, Human
uaagaccaauaagaagccuucuc

SEQ ID NO: 820309 - RNA, 18 nt, Human
uaccaagcugagaugaaa

SEQ ID NO: 820310 - RNA, 25 nt, Human
uagaaacaccuggaaacaagaaggc

SEQ ID NO: 820311 - RNA, 21 nt, Human
uagaggcaacauuuuuggagg

SEQ ID NO: 820312 - RNA, 22 nt, Human
uagccuuuaagugacugaguuc

SEQ ID NO: 820313 - RNA, 21 nt, Human
uaguaaaugaauccaucaguu

SEQ ID NO: 820314 - RNA, 22 nt, Human
uaguaacagcaauaaauacacc

SEQ ID NO: 820315 - RNA, 23 nt, Human
uauauauccaaaguauauacaaa

SEQ ID NO: 820316 - RNA, 24 nt, Human
uaucagugagccuuaaaccaaagu

SEQ ID NO: 820317 - RNA, 23 nt, Human
uauccaaaaacaaccaaagagcu

SEQ ID NO: 820318 - RNA, 18 nt, Human
ucaaaagaaacuuucaca

SEQ ID NO: 820319 - RNA, 22 nt, Human
ucaaaagaaacuuucacaucga

SEQ ID NO: 820320 - RNA, 18 nt, Human
ucacugaacuuguuuaca

SEQ ID NO: 820321 - RNA, 18 nt, Human
ucagcagagcacuaacuu

SEQ ID NO: 820322 - RNA, 22 nt, Human
ucagggaaauuuuaagaaaaau

SEQ ID NO: 820323 - RNA, 19 nt, Human
ucaugcugcuuuugaugua

SEQ ID NO: 820324 - RNA, 21 nt, Human
ucauuuugagucaugcugcuu

SEQ ID NO: 820325 - RNA, 19 nt, Human
uccaugggguagucaccau

SEQ ID NO: 820326 - RNA, 21 nt, Human
ucucuaaugaccaaguagcuu

SEQ ID NO: 820327 - RNA, 23 nt, Human
ucugcuugagacauguccaagaa

SEQ ID NO: 820328 - RNA, 24 nt, Human
ugaaaaaagaaguugcaaaggcuu

SEQ ID NO: 820329 - RNA, 23 nt, Human
ugaaagaauacaaaaaauagaaa

SEQ ID NO: 820330 - RNA, 25 nt, Human
ugaaagaauacaaaaaauagaaaca

SEQ ID NO: 820331 - RNA, 22 nt, Human
ugaaauagaaauuaauacagcu

SEQ ID NO: 820332 - RNA, 21 nt, Human
ugaauaggccagaaaaagcau

SEQ ID NO: 820333 - RNA, 26 nt, Human
ugaccaaaaucaucuagguuuauauu

SEQ ID NO: 820334 - RNA, 22 nt, Human
ugacccacagaucucuaaaacc

SEQ ID NO: 820335 - RNA, 20 nt, Human
ugagaagucacacucuuuug

SEQ ID NO: 820336 - RNA, 21 nt, Human
ugagggacaucauuugaccca

SEQ ID NO: 820337 - RNA, 20 nt, Human
ugauacaauacacaugcucu

SEQ ID NO: 820338 - RNA, 23 nt, Human
ugaugccugaagucaguuuuguu

SEQ ID NO: 820339 - RNA, 22 nt, Human
ugcuucagacauuugccuucag

SEQ ID NO: 820340 - RNA, 19 nt, Human
uggaggcaacuugaggagu

SEQ ID NO: 820341 - RNA, 20 nt, Human
ugguagaggcaacauuuuug

SEQ ID NO: 820342 - RNA, 18 nt, Human
uguaaauucaucacccaa

SEQ ID NO: 820343 - RNA, 25 nt, Human
uuaaaauaauaugaugccugaaguc

SEQ ID NO: 820344 - RNA, 19 nt, Human
uuacacaaaaaugaauaaa

SEQ ID NO: 820345 - RNA, 21 nt, Human
uucagcuuuuuaacaggaaau

SEQ ID NO: 820346 - RNA, 24 nt, Human
uucagggaaauuuuaagaaaaaug

SEQ ID NO: 820347 - RNA, 22 nt, Human
uucauuaccaagcugagaugaa

SEQ ID NO: 820348 - RNA, 20 nt, Human
uuccccugaaauugaaacug

SEQ ID NO: 820349 - RNA, 25 nt, Human
uucguacugcaauuuacaacaagaa

SEQ ID NO: 820350 - RNA, 18 nt, Human
uugaaugcuugcuauaau

SEQ ID NO: 820351 - RNA, 24 nt, Human
uuuaagaaaaaugggaucaguuga

SEQ ID NO: 820352 - RNA, 22 nt, Human
uuuaagugacugaguucagguu

SEQ ID NO: 820353 - RNA, 20 nt, Human
uuugugaacuacucacaaau

SEQ ID NO: 820354 - RNA, 20 nt, Human
uuuuuuaaauuucauagccu

SEQ ID NO: 820355 - RNA, 19 nt, Human
aaaaaaaaaagcucaaagg

SEQ ID NO: 820356 - RNA, 23 nt, Human
aaaaagccaaagggaacaguggg

SEQ ID NO: 820357 - RNA, 21 nt, Human
aaacauuuuaagucagugguu

SEQ ID NO: 820358 - RNA, 22 nt, Human
aaacauuuuaagucagugguuc

SEQ ID NO: 820359 - RNA, 20 nt, Human
aaagaaaaaaaaagccaaag

SEQ ID NO: 820360 - RNA, 23 nt, Human
aaagugcuggauuuacaggcaug

SEQ ID NO: 820361 - RNA, 24 nt, Human
aaagugcuggauuuacaggcaugg

SEQ ID NO: 820362 - RNA, 24 nt, Human
aaagugcugggauuacaggcuuga

SEQ ID NO: 820363 - RNA, 19 nt, Human
aaaguuuaguggcuuaaaa

SEQ ID NO: 820364 - RNA, 20 nt, Human
aaauuaaaaaauuauagcac

SEQ ID NO: 820365 - RNA, 23 nt, Human
aacaaaaguaauccuuaaccaaa

SEQ ID NO: 820366 - RNA, 18 nt, Human
aaccaccuggaucagacu

SEQ ID NO: 820367 - RNA, 27 nt, Human
aagaaaccagcacagcaguagugggca

SEQ ID NO: 820368 - RNA, 19 nt, Human
aagaagacaggguucagca

SEQ ID NO: 820369 - RNA, 24 nt, Human
aagaagacaggguucagcaggugc

SEQ ID NO: 820370 - RNA, 18 nt, Human
aagaauggaaauaggugg

SEQ ID NO: 820371 - RNA, 25 nt, Human
aagcaaucguccuuacuuggccucc

SEQ ID NO: 820372 - RNA, 23 nt, Human
aagcgauucuccugccucagcca

SEQ ID NO: 820373 - RNA, 20 nt, Human
aaguaacccuaccaguaaag

SEQ ID NO: 820374 - RNA, 19 nt, Human
aagugcugggauuacaggc

SEQ ID NO: 820375 - RNA, 19 nt, Human
aagugcugggauuacaggc

SEQ ID NO: 820376 - RNA, 26 nt, Human
aagugcugggauuacaggcuugagcc

SEQ ID NO: 820377 - RNA, 20 nt, Human
aaugguauaaaaccucuaau

SEQ ID NO: 820378 - RNA, 23 nt, Human
aauuuuuuguauuuuuaguagag

SEQ ID NO: 820379 - RNA, 22 nt, Human
acaauacauugucacacucuuu

SEQ ID NO: 820380 - RNA, 21 nt, Human
acacaaguaaaaucuaccuga

SEQ ID NO: 820381 - RNA, 22 nt, Human
acagaaacaaucccuaguuaac

SEQ ID NO: 820382 - RNA, 19 nt, Human
acaggcgccugccaccacg

SEQ ID NO: 820383 - RNA, 21 nt, Human
acauagcuuguuacuaacacu

SEQ ID NO: 820384 - RNA, 24 nt, Human
accauguugcccaggcuggucucg

SEQ ID NO: 820385 - RNA, 25 nt, Human
accauguugcccaggcuggucucga

SEQ ID NO: 820386 - RNA, 19 nt, Human
acccaggcuggagugcagu

SEQ ID NO: 820387 - RNA, 23 nt, Human
acccaggcuggagugcaguggug

SEQ ID NO: 820388 - RNA, 21 nt, Human
accucagccucgaguagcuag

SEQ ID NO: 820389 - RNA, 20 nt, Human
accuccucaaggacagaaac

SEQ ID NO: 820390 - RNA, 24 nt, Human
accugaguagcugggauuauaggc

SEQ ID NO: 820391 - RNA, 21 nt, Human
acuacaauacauugucacacu

SEQ ID NO: 820392 - RNA, 25 nt, Human
acucugucacccaggcuggagugca

SEQ ID NO: 820393 - RNA, 18 nt, Human
acugcaagcuccgccucc

SEQ ID NO: 820394 - RNA, 21 nt, Human
agaaaguuuaguggcuuaaaa

SEQ ID NO: 820395 - RNA, 22 nt, Human
agaaggccucugcuuaccuaca

SEQ ID NO: 820396 - RNA, 22 nt, Human
agacaacaaaaguaauccuuaa

SEQ ID NO: 820397 - RNA, 23 nt, Human
agacagggucucaccauguugcc

SEQ ID NO: 820398 - RNA, 19 nt, Human
agacagggucuugcaguca

SEQ ID NO: 820399 - RNA, 23 nt, Human
agacaggguucagcaggugccuc

SEQ ID NO: 820400 - RNA, 19 nt, Human
agagaugggguuucaccgu

SEQ ID NO: 820401 - RNA, 23 nt, Human
agcaaaguagccagacuuuguaa

SEQ ID NO: 820402 - RNA, 18 nt, Human
agccaaagggaacaucag

SEQ ID NO: 820403 - RNA, 19 nt, Human
agccagaggaaaaucuaca

SEQ ID NO: 820404 - RNA, 24 nt, Human
agcuauggguaacuuuuucuuugu

SEQ ID NO: 820405 - RNA, 21 nt, Human
aggaaaaaaaaaagcucaaag

SEQ ID NO: 820406 - RNA, 19 nt, Human
aggcaugugccaccacgcc

SEQ ID NO: 820407 - RNA, 25 nt, Human
aggcuggagugcaguggcgcgaucu

SEQ ID NO: 820408 - RNA, 20 nt, Human
aguagagaugggguuucacc

SEQ ID NO: 820409 - RNA, 20 nt, Human
aguagcuaggacuacaggca

SEQ ID NO: 820410 - RNA, 18 nt, Human
aguagcugggacuacagg

SEQ ID NO: 820411 - RNA, 19 nt, Human
aguagcugggacuacaggc

SEQ ID NO: 820412 - RNA, 25 nt, Human
aguagcugggacuacaggcgccugc

SEQ ID NO: 820413 - RNA, 23 nt, Human
aguagcugggauuauaggcaugu

SEQ ID NO: 820414 - RNA, 20 nt, Human
agugcaguggcgcgaucucg

SEQ ID NO: 820415 - RNA, 23 nt, Human
agugcaguggcgcgaucucggcu

SEQ ID NO: 820416 - RNA, 24 nt, Human
agugcaguggcgcgaucucggcuc

SEQ ID NO: 820417 - RNA, 21 nt, Human
agugcagugguacaaucacag

SEQ ID NO: 820418 - RNA, 19 nt, Human
agugcaguggugugaccuc

SEQ ID NO: 820419 - RNA, 21 nt, Human
agugcaguggugugaccucag

SEQ ID NO: 820420 - RNA, 23 nt, Human
agugcaguggugugaccucagcu

SEQ ID NO: 820421 - RNA, 24 nt, Human
agugcugggauuacaggcuugagc

SEQ ID NO: 820422 - RNA, 24 nt, Human
aguggugugaccucagcucacugc

SEQ ID NO: 820423 - RNA, 20 nt, Human
auaaaagacaacaaaaguaa

SEQ ID NO: 820424 - RNA, 20 nt, Human
auacaagaauggaaauaggu

SEQ ID NO: 820425 - RNA, 19 nt, Human
aucacagcucacugaagcc

SEQ ID NO: 820426 - RNA, 18 nt, Human
augauaauaaaagaaagu

SEQ ID NO: 820427 - RNA, 26 nt, Human
augcagugcacugcccauuugccccc

SEQ ID NO: 820428 - RNA, 18 nt, Human
augggguuucaccguguu

SEQ ID NO: 820429 - RNA, 20 nt, Human
augggguuucaccguguuag

SEQ ID NO: 820430 - RNA, 24 nt, Human
augggguuucaccguguuagccag

SEQ ID NO: 820431 - RNA, 18 nt, Human
caaaaugcuaaauugaca

SEQ ID NO: 820432 - RNA, 26 nt, Human
caaaccaccuggaucagacucugcag

SEQ ID NO: 820433 - RNA, 24 nt, Human
caaagugcuggauuuacaggcaug

SEQ ID NO: 820434 - RNA, 24 nt, Human
caaagugcugggauuacaggcuug

SEQ ID NO: 820435 - RNA, 19 nt, Human
caacaggaacagccagagg

SEQ ID NO: 820436 - RNA, 18 nt, Human
caagaaaccagcacagca

SEQ ID NO: 820437 - RNA, 22 nt, Human
caagaaaccagcacagcaguac

SEQ ID NO: 820438 - RNA, 22 nt, Human
caagccauucuccugccucagc

SEQ ID NO: 820439 - RNA, 22 nt, Human
caagcgauucuccugccucagc

SEQ ID NO: 820440 - RNA, 24 nt, Human
caccauguugcccaggcuggucuc

SEQ ID NO: 820441 - RNA, 21 nt, Human
cacccaggcuggagugcagug

SEQ ID NO: 820442 - RNA, 24 nt, Human
cacccaggcuggagugcaguggcg

SEQ ID NO: 820443 - RNA, 18 nt, Human
caccguguuagccaggau

SEQ ID NO: 820444 - RNA, 23 nt, Human
caccguguuagccaggauggucu

SEQ ID NO: 820445 - RNA, 24 nt, Human
caccguguuagccaggauggucuu

SEQ ID NO: 820446 - RNA, 18 nt, Human
caccucagccucgaguag

SEQ ID NO: 820447 - RNA, 19 nt, Human
caccucagccucgaguagc

SEQ ID NO: 820448 - RNA, 23 nt, Human
caccugccucggccucccaaagu

SEQ ID NO: 820449 - RNA, 23 nt, Human
cacucugucacccaggcuggagu

SEQ ID NO: 820450 - RNA, 24 nt, Human
cacucugucacccaggcuggagug

SEQ ID NO: 820451 - RNA, 23 nt, Human
cacugcagccucugccuccuggg

SEQ ID NO: 820452 - RNA, 18 nt, Human
cacugcuuaugccuuuac

SEQ ID NO: 820453 - RNA, 22 nt, Human
cagaauuucccaaauugugcau

SEQ ID NO: 820454 - RNA, 21 nt, Human
cagcaacaggaacagccagag

SEQ ID NO: 820455 - RNA, 18 nt, Human
cagcaggugccucucccu

SEQ ID NO: 820456 - RNA, 20 nt, Human
cagccuccugaguagcuggg

SEQ ID NO: 820457 - RNA, 23 nt, Human
cagcucacugcagccucugccuc

SEQ ID NO: 820458 - RNA, 21 nt, Human
caggaaaaaugagaguucaua

SEQ ID NO: 820459 - RNA, 25 nt, Human
caggaaaaaugagaguucauacaaa

SEQ ID NO: 820460 - RNA, 21 nt, Human
caggcgccugccaccacgccc

SEQ ID NO: 820461 - RNA, 23 nt, Human
caggcgccugccaccacgcccgg

SEQ ID NO: 820462 - RNA, 24 nt, Human
cagggucucaccauguugcccagg

SEQ ID NO: 820463 - RNA, 22 nt, Human
caggguucagcaggugccucuc

SEQ ID NO: 820464 - RNA, 20 nt, Human
cagguuugagugaugaugga

SEQ ID NO: 820465 - RNA, 18 nt, Human
cauggcacaaaaagacag

SEQ ID NO: 820466 - RNA, 21 nt, Human
cauguugcccaggcuggucuc

SEQ ID NO: 820467 - RNA, 23 nt, Human
cauguugcccaggcuggucucga

SEQ ID NO: 820468 - RNA, 24 nt, Human
cauguugcccaggcuggucucgaa

SEQ ID NO: 820469 - RNA, 19 nt, Human
cauuccuguuuuuuuagga

SEQ ID NO: 820470 - RNA, 23 nt, Human
cauugcuaucaccacgaaaaucc

SEQ ID NO: 820471 - RNA, 21 nt, Human
ccaaagggaacaucaggaaaa

SEQ ID NO: 820472 - RNA, 24 nt, Human
ccaaagugcuggauuuacaggcau

SEQ ID NO: 820473 - RNA, 19 nt, Human
ccaaagugcugggauuaca

SEQ ID NO: 820474 - RNA, 22 nt, Human
ccaaagugcugggauuacaggc

SEQ ID NO: 820475 - RNA, 23 nt, Human
ccaaagugcugggauuacaggcu

SEQ ID NO: 820476 - RNA, 20 nt, Human
ccaccacgcccggcgaauuu

SEQ ID NO: 820477 - RNA, 18 nt, Human
ccaccgcgccuggccucc

SEQ ID NO: 820478 - RNA, 21 nt, Human
ccagcaacaggaacagccaga

SEQ ID NO: 820479 - RNA, 20 nt, Human
ccaggggcucagcuggucaa

SEQ ID NO: 820480 - RNA, 23 nt, Human
ccagucaagcucacugugguuaa

SEQ ID NO: 820481 - RNA, 24 nt, Human
ccaguguccccuuuacugcucccu

SEQ ID NO: 820482 - RNA, 18 nt, Human
ccauagcuacauacuugu

SEQ ID NO: 820483 - RNA, 22 nt, Human
ccaucucuuaggacucuucaca

SEQ ID NO: 820484 - RNA, 24 nt, Human
cccaaagugcugggauuacaggcu

SEQ ID NO: 820485 - RNA, 20 nt, Human
cccaggcuggagugcagugg

SEQ ID NO: 820486 - RNA, 23 nt, Human
cccggguucaagccauucuccug

SEQ ID NO: 820487 - RNA, 18 nt, Human
cccuuuacugcucccugg

SEQ ID NO: 820488 - RNA, 24 nt, Human
ccucccaccucagccucgaguagc

SEQ ID NO: 820489 - RNA, 24 nt, Human
ccucccggguucaagccauucucc

SEQ ID NO: 820490 - RNA, 24 nt, Human
ccuccuggguucaagcgauucucc

SEQ ID NO: 820491 - RNA, 23 nt, Human
ccucgaguagcuaggacuacagg

SEQ ID NO: 820492 - RNA, 24 nt, Human
ccucgaguagcuaggacuacaggc

SEQ ID NO: 820493 - RNA, 19 nt, Human
ccucugccuccuggguuca

SEQ ID NO: 820494 - RNA, 19 nt, Human
ccugaccucacgauccacc

SEQ ID NO: 820495 - RNA, 23 nt, Human
ccugaguagcugggacuacaggc

SEQ ID NO: 820496 - RNA, 24 nt, Human
ccugaguagcugggacuacaggcg

SEQ ID NO: 820497 - RNA, 23 nt, Human
ccugaguagcugggauuauaggc

SEQ ID NO: 820498 - RNA, 24 nt, Human
ccugaguagcugggauuauaggca

SEQ ID NO: 820499 - RNA, 23 nt, Human
ccuggguucaagcgauucuccug

SEQ ID NO: 820500 - RNA, 23 nt, Human
cgauccaccugccucggccuccc

SEQ ID NO: 820501 - RNA, 25 nt, Human
cgcccggcgaauuuuuuguauuuuu

SEQ ID NO: 820502 - RNA, 19 nt, Human
cgccucccggguucaagcc

SEQ ID NO: 820503 - RNA, 22 nt, Human
cuacaagcugaaugaguugugu

SEQ ID NO: 820504 - RNA, 22 nt, Human
cucaaaaugcuaaauugacaau

SEQ ID NO: 820505 - RNA, 20 nt, Human
cucaaggacagaaacaaucc

SEQ ID NO: 820506 - RNA, 20 nt, Human
cucacauguccuaacuuacu

SEQ ID NO: 820507 - RNA, 24 nt, Human
cucacucugucacccaggcuggag

SEQ ID NO: 820508 - RNA, 24 nt, Human
cucacugcagccucugccuccugg

SEQ ID NO: 820509 - RNA, 23 nt, Human
cucagccaccugaguagcuggga

SEQ ID NO: 820510 - RNA, 24 nt, Human
cucagccuccugaguagcugggac

SEQ ID NO: 820511 - RNA, 21 nt, Human
cuccuggguucaagcgauucu

SEQ ID NO: 820512 - RNA, 24 nt, Human
cugaguagcugggauuauaggcau

SEQ ID NO: 820513 - RNA, 23 nt, Human
cugcagccucugccuccuggguu

SEQ ID NO: 820514 - RNA, 24 nt, Human
cugcagccucugccuccuggguuc

SEQ ID NO: 820515 - RNA, 23 nt, Human
cugccucagccaccugaguagcu

SEQ ID NO: 820516 - RNA, 23 nt, Human
cugccucagccuccugaguagcu

SEQ ID NO: 820517 - RNA, 23 nt, Human
cugccucggccucccaaagugcu

SEQ ID NO: 820518 - RNA, 23 nt, Human
cuggccucaagcaaucguccuua

SEQ ID NO: 820519 - RNA, 21 nt, Human
cuucuggccucaagcaaucuu

SEQ ID NO: 820520 - RNA, 22 nt, Human
cuuggguucaaaugauccuccc

SEQ ID NO: 820521 - RNA, 19 nt, Human
gacagaaacaaucccuagu

SEQ ID NO: 820522 - RNA, 22 nt, Human
gaccucacgauccaccugccuc

SEQ ID NO: 820523 - RNA, 22 nt, Human
gaccucacgauccaccugccuc

SEQ ID NO: 820524 - RNA, 24 nt, Human
gaccucacgauccaccugccucgg

SEQ ID NO: 820525 - RNA, 19 nt, Human
gaccucagcucacugcagc

SEQ ID NO: 820526 - RNA, 21 nt, Human
gacuacaggcaugcaccauua

SEQ ID NO: 820527 - RNA, 21 nt, Human
gagagaaacaggaugagguuu

SEQ ID NO: 820528 - RNA, 24 nt, Human
gagaugggguuucaccguguuagc

SEQ ID NO: 820529 - RNA, 24 nt, Human
gaguagcuaggacuacaggcaugc

SEQ ID NO: 820530 - RNA, 22 nt, Human
gaguagcugggauuauaggcau

SEQ ID NO: 820531 - RNA, 24 nt, Human
gagugcagugguacaaucacagcu

SEQ ID NO: 820532 - RNA, 20 nt, Human
gaucagacucugcaguccug

SEQ ID NO: 820533 - RNA, 18 nt, Human
gauuacaggcuugagcca

SEQ ID NO: 820534 - RNA, 22 nt, Human
gauuacaggcuugagccaccgc

SEQ ID NO: 820535 - RNA, 18 nt, Human
gauuauaggcaugugcca

SEQ ID NO: 820536 - RNA, 21 nt, Human
gccaaagggaacaucaggaaa

SEQ ID NO: 820537 - RNA, 23 nt, Human
gcccggcgaauuuuuuguauuuu

SEQ ID NO: 820538 - RNA, 20 nt, Human
gccucagccuccugaguagc

SEQ ID NO: 820539 - RNA, 22 nt, Human
gccucgaguagcuaggacuaca

SEQ ID NO: 820540 - RNA, 19 nt, Human
gcuggagugcaguggcgcg

SEQ ID NO: 820541 - RNA, 19 nt, Human
ggacuacaggcaugcacca

SEQ ID NO: 820542 - RNA, 24 nt, Human
ggacuacaggcaugcaccauuaug

SEQ ID NO: 820543 - RNA, 22 nt, Human
ggauccaaaauuucacucaaau

SEQ ID NO: 820544 - RNA, 24 nt, Human
ggauggucuugaucuccugaccuc

SEQ ID NO: 820545 - RNA, 19 nt, Human
ggauuauaggcaugugcca

SEQ ID NO: 820546 - RNA, 18 nt, Human
ggccaggggcucagcugg

SEQ ID NO: 820547 - RNA, 22 nt, Human
gggguuucaccguguuagccag

SEQ ID NO: 820548 - RNA, 22 nt, Human
ggguuucaccguguuagccagg

SEQ ID NO: 820549 - RNA, 19 nt, Human
gguucaaaugauccuccca

SEQ ID NO: 820550 - RNA, 19 nt, Human
gguucucauauugaggugu

SEQ ID NO: 820551 - RNA, 22 nt, Human
guagagacagggucucaccaug

SEQ ID NO: 820552 - RNA, 18 nt, Human
guagcugggauuauaggc

SEQ ID NO: 820553 - RNA, 20 nt, Human
guagcugggauuauaggcau

SEQ ID NO: 820554 - RNA, 18 nt, Human
guaugauaauaaaagaaa

SEQ ID NO: 820555 - RNA, 21 nt, Human
gugaaggacuugcuaacagaa

SEQ ID NO: 820556 - RNA, 18 nt, Human
guggaaggcauuucuaua

SEQ ID NO: 820557 - RNA, 22 nt, Human
guucaaaugauccucccaccuc

SEQ ID NO: 820558 - RNA, 19 nt, Human
uaaaagaaaguuuaguggc

SEQ ID NO: 820559 - RNA, 19 nt, Human
uaacacugagguuuagaca

SEQ ID NO: 820560 - RNA, 21 nt, Human
uaaccaaaacucuaaaauauu

SEQ ID NO: 820561 - RNA, 20 nt, Human
uaauauagauuaguguccuu

SEQ ID NO: 820562 - RNA, 26 nt, Human
uaauuuuuaaaguuuuuugguagaga

SEQ ID NO: 820563 - RNA, 28 nt, Human
uaauuuuuaaaguuuuuugguagagaca

SEQ ID NO: 820564 - RNA, 21 nt, Human
uacaaucacagcucacugaag

SEQ ID NO: 820565 - RNA, 24 nt, Human
uacaggcaugcaccauuaugccca

SEQ ID NO: 820566 - RNA, 20 nt, Human
uacaggcaugggccaccuca

SEQ ID NO: 820567 - RNA, 23 nt, Human
uacaggcgccugccaccacgccc

SEQ ID NO: 820568 - RNA, 22 nt, Human
uacaggcuugagccaccgcgcc

SEQ ID NO: 820569 - RNA, 21 nt, Human
uacagugauuaaauauucucu

SEQ ID NO: 820570 - RNA, 24 nt, Human
uacagugauuaaauauucucuuuu

SEQ ID NO: 820571 - RNA, 22 nt, Human
uaccuaugcagugcacugccca

SEQ ID NO: 820572 - RNA, 18 nt, Human
uagaauguucuauaacac

SEQ ID NO: 820573 - RNA, 22 nt, Human
uagagacagggucucaccaugu

SEQ ID NO: 820574 - RNA, 22 nt, Human
uagcugguggcuggucuggugg

SEQ ID NO: 820575 - RNA, 21 nt, Human
uaggacuacaggcaugcacca

SEQ ID NO: 820576 - RNA, 26 nt, Human
uaggacuacaggcaugcaccauuaug

SEQ ID NO: 820577 - RNA, 18 nt, Human
uaggacucuucacagucu

SEQ ID NO: 820578 - RNA, 18 nt, Human
uagguggcuguauauucc

SEQ ID NO: 820579 - RNA, 21 nt, Human
uaguagagaugggguuucacc

SEQ ID NO: 820580 - RNA, 24 nt, Human
uaguagagaugggguuucaccgug

SEQ ID NO: 820581 - RNA, 26 nt, Human
uaguagagaugggguuucaccguguu

SEQ ID NO: 820582 - RNA, 22 nt, Human
uaguuucagggccucuucaugu

SEQ ID NO: 820583 - RNA, 23 nt, Human
uauaaaccuccucaaggacagaa

SEQ ID NO: 820584 - RNA, 22 nt, Human
uauaacaggauuaguuuuuaga

SEQ ID NO: 820585 - RNA, 19 nt, Human
uaucuugguggaugucaag

SEQ ID NO: 820586 - RNA, 18 nt, Human
uaugccuguaacucagaa

SEQ ID NO: 820587 - RNA, 25 nt, Human
ucaagccauucuccugccucagccu

SEQ ID NO: 820588 - RNA, 19 nt, Human
ucaagcgauucuccugccu

SEQ ID NO: 820589 - RNA, 22 nt, Human
ucacccaggcuggagugcagug

SEQ ID NO: 820590 - RNA, 24 nt, Human
ucacccaggcuggagugcaguggc

SEQ ID NO: 820591 - RNA, 24 nt, Human
ucaccguguuagccaggauggucu

SEQ ID NO: 820592 - RNA, 24 nt, Human
ucacucugucacccaggcuggagu

SEQ ID NO: 820593 - RNA, 18 nt, Human
ucacugaagccucaacuc

SEQ ID NO: 820594 - RNA, 23 nt, Human
ucacugaagccucaacucuuggg

SEQ ID NO: 820595 - RNA, 24 nt, Human
ucacugaagccucaacucuugggu

SEQ ID NO: 820596 - RNA, 18 nt, Human
ucacugcaagcuccgccu

SEQ ID NO: 820597 - RNA, 19 nt, Human
ucacugcaagcuccgccuc

SEQ ID NO: 820598 - RNA, 24 nt, Human
ucacugcaagcuccgccucccggg

SEQ ID NO: 820599 - RNA, 24 nt, Human
ucacugcagccucugccuccuggg

SEQ ID NO: 820600 - RNA, 25 nt, Human
ucacugcagccucugccuccugggu

SEQ ID NO: 820601 - RNA, 23 nt, Human
ucagccuccugaguagcugggac

SEQ ID NO: 820602 - RNA, 22 nt, Human
ucaggaaaaaaaaaagcucaaa

SEQ ID NO: 820603 - RNA, 24 nt, Human
ucagggccucuucauguggucucu

SEQ ID NO: 820604 - RNA, 25 nt, Human
uccauugcuaucaccacgaaaaucc

SEQ ID NO: 820605 - RNA, 24 nt, Human
ucccaaagugcuggauuuacaggc

SEQ ID NO: 820606 - RNA, 24 nt, Human
ucccaaagugcugggauuacaggc

SEQ ID NO: 820607 - RNA, 23 nt, Human
ucccauagcuacauacuuguucu

SEQ ID NO: 820608 - RNA, 21 nt, Human
ucccggguucaagccauucuc

SEQ ID NO: 820609 - RNA, 24 nt, Human
ucccggguucaagccauucuccug

SEQ ID NO: 820610 - RNA, 24 nt, Human
uccugaguagcugggacuacaggc

SEQ ID NO: 820611 - RNA, 21 nt, Human
uccuggguucaagcgauucuc

SEQ ID NO: 820612 - RNA, 24 nt, Human
uccuggguucaagcgauucuccug

SEQ ID NO: 820613 - RNA, 22 nt, Human
ucgcucacuggcauuuagcugg

SEQ ID NO: 820614 - RNA, 18 nt, Human
ucggccucccaaagugcu

SEQ ID NO: 820615 - RNA, 24 nt, Human
ucggucugucacccaggcuggagu

SEQ ID NO: 820616 - RNA, 23 nt, Human
ucucaccauguugcccaggcugg

SEQ ID NO: 820617 - RNA, 26 nt, Human
ucucaccauguugcccaggcuggucu

SEQ ID NO: 820618 - RNA, 27 nt, Human
ucucaccauguugcccaggcuggucuc

SEQ ID NO: 820619 - RNA, 23 nt, Human
ucucacucugucacccaggcugg

SEQ ID NO: 820620 - RNA, 24 nt, Human
ucucacucugucacccaggcugga

SEQ ID NO: 820621 - RNA, 26 nt, Human
ucucacucugucacccaggcuggagu

SEQ ID NO: 820622 - RNA, 27 nt, Human
ucucacucugucacccaggcuggagug

SEQ ID NO: 820623 - RNA, 23 nt, Human
ucucagaauccagucaagcucac

SEQ ID NO: 820624 - RNA, 24 nt, Human
ucuccugccucagccuccugagua

SEQ ID NO: 820625 - RNA, 21 nt, Human
ucucgaacuucuggccucaag

SEQ ID NO: 820626 - RNA, 23 nt, Human
ucucggucugucacccaggcugg

SEQ ID NO: 820627 - RNA, 24 nt, Human
ucucggucugucacccaggcugga

SEQ ID NO: 820628 - RNA, 19 nt, Human
ucugucacccaggcuggag

SEQ ID NO: 820629 - RNA, 24 nt, Human
ucugucacccaggcuggagugcag

SEQ ID NO: 820630 - RNA, 24 nt, Human
ucugucacccaggcuggagugcag

SEQ ID NO: 820631 - RNA, 23 nt, Human
ucuuaccuauaaaccuccucaag

SEQ ID NO: 820632 - RNA, 24 nt, Human
ucuugcagucacucaagcuggagu

SEQ ID NO: 820633 - RNA, 18 nt, Human
ugagacagagucucacuc

SEQ ID NO: 820634 - RNA, 22 nt, Human
ugagacagagucucacucuguc

SEQ ID NO: 820635 - RNA, 22 nt, Human
ugagacagagucucggucuguc

SEQ ID NO: 820636 - RNA, 21 nt, Human
ugaguuguguaugagagagaa

SEQ ID NO: 820637 - RNA, 23 nt, Human
ugcacugcccauuugccccuuca

SEQ ID NO: 820638 - RNA, 22 nt, Human
ugcaguggcgcgaucucggcuc

SEQ ID NO: 820639 - RNA, 20 nt, Human
ugcaguggugugaccucagc

SEQ ID NO: 820640 - RNA, 22 nt, Human
ugcaguggugugaccucagcuc

SEQ ID NO: 820641 - RNA, 24 nt, Human
ugcccaggcuggucucgaacuucu

SEQ ID NO: 820642 - RNA, 21 nt, Human
ugccucagccaccugaguagc

SEQ ID NO: 820643 - RNA, 24 nt, Human
ugccucagccaccugaguagcugg

SEQ ID NO: 820644 - RNA, 24 nt, Human
ugccucagccuccugaguagcugg

SEQ ID NO: 820645 - RNA, 21 nt, Human
ugccucggccucccaaagugc

SEQ ID NO: 820646 - RNA, 24 nt, Human
ugccucggccucccaaagugcugg

SEQ ID NO: 820647 - RNA, 23 nt, Human
ugcuccauaacuaaucaaugcau

SEQ ID NO: 820648 - RNA, 21 nt, Human
uggaaagaaaaaaaaagccaa

SEQ ID NO: 820649 - RNA, 23 nt, Human
uggagugcaguggcgcgaucucg

SEQ ID NO: 820650 - RNA, 24 nt, Human
uggagugcaguggcgcgaucucgg

SEQ ID NO: 820651 - RNA, 18 nt, Human
uggagugcagugguacaa

SEQ ID NO: 820652 - RNA, 19 nt, Human
uggagugcagugguacaau

SEQ ID NO: 820653 - RNA, 21 nt, Human
uggagugcagugguacaauca

SEQ ID NO: 820654 - RNA, 19 nt, Human
uggagugcaguggugugac

SEQ ID NO: 820655 - RNA, 22 nt, Human
uggagugcaguggugugaccuc

SEQ ID NO: 820656 - RNA, 23 nt, Human
uggagugcaguggugugaccuca

SEQ ID NO: 820657 - RNA, 28 nt, Human
uggagugcaguggugugacggcucuagc

SEQ ID NO: 820658 - RNA, 21 nt, Human
uggauuuacaggcaugggcca

SEQ ID NO: 820659 - RNA, 20 nt, Human
uggccucaagcaaucguccu

SEQ ID NO: 820660 - RNA, 21 nt, Human
uggccucaagcaaucguccuu

SEQ ID NO: 820661 - RNA, 18 nt, Human
uggcuggcuccuuucauc

SEQ ID NO: 820662 - RNA, 19 nt, Human
uggcuggucugguggaucc

SEQ ID NO: 820663 - RNA, 23 nt, Human
uggcuguauauuccuaugcaucu

SEQ ID NO: 820664 - RNA, 21 nt, Human
ugggacuacaggcgccugcca

SEQ ID NO: 820665 - RNA, 22 nt, Human
ugggacuacaggcgccugccac

SEQ ID NO: 820666 - RNA, 24 nt, Human
ugggacuacaggcgccugccacca

SEQ ID NO: 820667 - RNA, 18 nt, Human
ugggauuacaggcuugag

SEQ ID NO: 820668 - RNA, 19 nt, Human
ugggauuacaggcuugagc

SEQ ID NO: 820669 - RNA, 21 nt, Human
ugggauuacaggcuugagcca

SEQ ID NO: 820670 - RNA, 22 nt, Human
ugggauuacaggcuugagccac

SEQ ID NO: 820671 - RNA, 23 nt, Human
ugggauuacaggcuugagccacc

SEQ ID NO: 820672 - RNA, 24 nt, Human
ugggauuacaggcuugagccaccg

SEQ ID NO: 820673 - RNA, 18 nt, Human
ugggauuauaggcaugug

SEQ ID NO: 820674 - RNA, 21 nt, Human
ugggauuauaggcaugugcca

SEQ ID NO: 820675 - RNA, 22 nt, Human
ugggauuauaggcaugugccac

SEQ ID NO: 820676 - RNA, 24 nt, Human
ugggauuauaggcaugugccacca

SEQ ID NO: 820677 - RNA, 20 nt, Human
ugggccaggggcucagcugg

SEQ ID NO: 820678 - RNA, 20 nt, Human
uggggccagagaauacugau

SEQ ID NO: 820679 - RNA, 24 nt, Human
ugggguuucaccguguuagccagg

SEQ ID NO: 820680 - RNA, 19 nt, Human
uggguaacuuuuucuuugu

SEQ ID NO: 820681 - RNA, 23 nt, Human
uggguucaagcgauucuccugcc

SEQ ID NO: 820682 - RNA, 24 nt, Human
uggguucaagcgauucuccugccu

SEQ ID NO: 820683 - RNA, 22 nt, Human
ugguacaaucacagcucacuga

SEQ ID NO: 820684 - RNA, 24 nt, Human
ugguagagacagggucucaccaug

SEQ ID NO: 820685 - RNA, 24 nt, Human
uggugugaccucagcucacugcag

SEQ ID NO: 820686 - RNA, 21 nt, Human
ugguucaggaaaaaaaaaagc

SEQ ID NO: 820687 - RNA, 21 nt, Human
uguauuuuuaguagagauggg

SEQ ID NO: 820688 - RNA, 18 nt, Human
uguucuaucucccacaaa

SEQ ID NO: 820689 - RNA, 18 nt, Human
uguuguuaauuuguucuu

SEQ ID NO: 820690 - RNA, 24 nt, Human
uguuuguuuuuugagacagagucu

SEQ ID NO: 820691 - RNA, 19 nt, Human
uguuuuguuuuguuuuuug

SEQ ID NO: 820692 - RNA, 20 nt, Human
uguuuuguuuuguuuuuugu

SEQ ID NO: 820693 - RNA, 21 nt, Human
uguuuuguuuuuuguuuuuug

SEQ ID NO: 820694 - RNA, 24 nt, Human
uguuuuguuuuuuguuuuuuguuu

SEQ ID NO: 820695 - RNA, 23 nt, Human
uuaaugaacaaacuggaaaggaa

SEQ ID NO: 820696 - RNA, 22 nt, Human
uuaccaagucgcucacuggcau

SEQ ID NO: 820697 - RNA, 23 nt, Human
uuacuuggccucccaaagugcug

SEQ ID NO: 820698 - RNA, 21 nt, Human
uuagaacaaauaugcugaagu

SEQ ID NO: 820699 - RNA, 22 nt, Human
uuagacaccacccaaaccaccu

SEQ ID NO: 820700 - RNA, 18 nt, Human
uuaguagagaugggguuu

SEQ ID NO: 820701 - RNA, 22 nt, Human
uuaguagagaugggguuucacc

SEQ ID NO: 820702 - RNA, 24 nt, Human
uuaguagagaugggguuucaccgu

SEQ ID NO: 820703 - RNA, 24 nt, Human
uucaaaugauccucccaccucagc

SEQ ID NO: 820704 - RNA, 18 nt, Human
uucaagccauucuccugc

SEQ ID NO: 820705 - RNA, 21 nt, Human
uucaagccauucuccugccuc

SEQ ID NO: 820706 - RNA, 21 nt, Human
uucaagcgauucuccugccuc

SEQ ID NO: 820707 - RNA, 23 nt, Human
uucaagcgauucuccugccucag

SEQ ID NO: 820708 - RNA, 25 nt, Human
uucaagcgauucuccugccucagcc

SEQ ID NO: 820709 - RNA, 19 nt, Human
uucacagucuguucuaucu

SEQ ID NO: 820710 - RNA, 19 nt, Human
uucaugagaugaaguaacc

SEQ ID NO: 820711 - RNA, 19 nt, Human
uuccuguauacaacagagg

SEQ ID NO: 820712 - RNA, 23 nt, Human
uuccuuacuuucaauauuuuaac

SEQ ID NO: 820713 - RNA, 21 nt, Human
uugcuuguuuguuuguuuuuu

SEQ ID NO: 820714 - RNA, 22 nt, Human
uuggaaagaaaaaaaaagccaa

SEQ ID NO: 820715 - RNA, 24 nt, Human
uugguagagacagggucucaccau

SEQ ID NO: 820716 - RNA, 19 nt, Human
uugguucaggaaaaaaaaa

SEQ ID NO: 820717 - RNA, 24 nt, Human
uuuaauauugacuggggccagaga

SEQ ID NO: 820718 - RNA, 19 nt, Human
uuucaccguguuagccagg

SEQ ID NO: 820719 - RNA, 19 nt, Human
uuuccuuuaagguugaccc

SEQ ID NO: 820720 - RNA, 22 nt, Human
uuugacaaauguucaacugguu

SEQ ID NO: 820721 - RNA, 21 nt, Human
uuuguuuuguuuuguuuuuug

SEQ ID NO: 820722 - RNA, 18 nt, Human
uuuugcuuguuuguuugu

SEQ ID NO: 820723 - RNA, 21 nt, Human
uuuuuaggaaauguguaucag

SEQ ID NO: 820724 - RNA, 24 nt, Human
uuuuuaguagagaugggguuucac

SEQ ID NO: 820725 - RNA, 23 nt, Human
uuuuucuuugucucuacaccaua

SEQ ID NO: 820726 - RNA, 21 nt, Human
uuuuuguauuuuuaguagaga

SEQ ID NO: 820727 - RNA, 18 nt, Human
uuuuuugguagagacagg

SEQ ID NO: 820728 - RNA, 24 nt, Human
uuuuuuguauuuuuaguagagaug

SEQ ID NO: 820729 - RNA, 20 nt, Human
uuuuuuuugagacagggucu

SEQ ID NO: 820730 - RNA, 20 nt, Human
uuuuuuuuuuugagacaggg

SEQ ID NO: 820731 - RNA, 23 nt, Human
uuuuuuuuuuuugagacaggguc

SEQ ID NO: 820732 - RNA, 24 nt, Human
uuuuuuuuuuuuuuugagacaggg

SEQ ID NO: 820733 - RNA, 22 nt, Human
aaaacaaaacaggcaauugaua

SEQ ID NO: 820734 - RNA, 18 nt, Human
aaaacaaacaaaacaaaa

SEQ ID NO: 820735 - RNA, 23 nt, Human
aaaacaaacaaaacaaaacaggc

SEQ ID NO: 820736 - RNA, 20 nt, Human
aaacaaaacaaaacaggcaa

SEQ ID NO: 820737 - RNA, 24 nt, Human
aaagcaaguuacaagauguugguu

SEQ ID NO: 820738 - RNA, 19 nt, Human
aaauacccacccccgagac

SEQ ID NO: 820739 - RNA, 22 nt, Human
aaauagccacccccgagacuuu

SEQ ID NO: 820740 - RNA, 20 nt, Human
aacaaaacaaaacaggcaag

SEQ ID NO: 820741 - RNA, 24 nt, Human
aacaaaggggcagugaccuaggaa

SEQ ID NO: 820742 - RNA, 21 nt, Human
aacaggaaggagaggcuccag

SEQ ID NO: 820743 - RNA, 23 nt, Human
aacuaaggcaaaguaauacugag

SEQ ID NO: 820744 - RNA, 19 nt, Human
aagacggaaggcagagaac

SEQ ID NO: 820745 - RNA, 18 nt, Human
aagagaaguugugagccc

SEQ ID NO: 820746 - RNA, 21 nt, Human
aagaggcagcaaaggaggagg

SEQ ID NO: 820747 - RNA, 22 nt, Human
aagaggcagcaaaggaggaggg

SEQ ID NO: 820748 - RNA, 23 nt, Human
aaggaugaggacagagggaaaga

SEQ ID NO: 820749 - RNA, 21 nt, Human
aaggcaaaguaauacugagaa

SEQ ID NO: 820750 - RNA, 22 nt, Human
acaaagaggagacagccaaggu

SEQ ID NO: 820751 - RNA, 22 nt, Human
acacagcaaguaagcguggcuu

SEQ ID NO: 820752 - RNA, 21 nt, Human
acaggaaggagaggcuccaga

SEQ ID NO: 820753 - RNA, 19 nt, Human
accaccgccugccuccccc

SEQ ID NO: 820754 - RNA, 23 nt, Human
accagggaagaggggaaaggagg

SEQ ID NO: 820755 - RNA, 22 nt, Human
accagggggccgggcgggggcg

SEQ ID NO: 820756 - RNA, 21 nt, Human
acccacuccccaagucugagc

SEQ ID NO: 820757 - RNA, 21 nt, Human
accccagagugccaagggccg

SEQ ID NO: 820758 - RNA, 24 nt, Human
accgacugccccacgcgaccccag

SEQ ID NO: 820759 - RNA, 23 nt, Human
acgcgaccccagagugccaaggg

SEQ ID NO: 820760 - RNA, 19 nt, Human
acgggagcaaggacagggg

SEQ ID NO: 820761 - RNA, 24 nt, Human
agaaaaaguggaggaagccgguac

SEQ ID NO: 820762 - RNA, 25 nt, Human
agaaaaaguggaggaagccgguacc

SEQ ID NO: 820763 - RNA, 26 nt, Human
agaaagagagagaagggcgaaaagga

SEQ ID NO: 820764 - RNA, 23 nt, Human
agaacaggaaggagaggcuccag

SEQ ID NO: 820765 - RNA, 20 nt, Human
agaacuggggaaauggaaaa

SEQ ID NO: 820766 - RNA, 24 nt, Human
agacugacaaucucggcacaaaga

SEQ ID NO: 820767 - RNA, 20 nt, Human
agagaaauguggcaggggug

SEQ ID NO: 820768 - RNA, 19 nt, Human
agagaacuggggaaaugga

SEQ ID NO: 820769 - RNA, 19 nt, Human
agagagaggaagaggagga

SEQ ID NO: 820770 - RNA, 21 nt, Human
agaggagacagccaagguccg

SEQ ID NO: 820771 - RNA, 22 nt, Human
agaggaggagagagggaccgag

SEQ ID NO: 820772 - RNA, 25 nt, Human
agaggaggagagagggaccgaggga

SEQ ID NO: 820773 - RNA, 27 nt, Human
agcacuggggacagagaacaggaagga

SEQ ID NO: 820774 - RNA, 18 nt, Human
aggagacacccacucccc

SEQ ID NO: 820775 - RNA, 20 nt, Human
aggaggagagagggaccgag

SEQ ID NO: 820776 - RNA, 22 nt, Human
aggagggaaagaggcagcaaag

SEQ ID NO: 820777 - RNA, 25 nt, Human
aggagggaaagaggcagcaaaggag

SEQ ID NO: 820778 - RNA, 18 nt, Human
aggagggagggagaggag

SEQ ID NO: 820779 - RNA, 19 nt, Human
aggagggagggagaggagg

SEQ ID NO: 820780 - RNA, 27 nt, Human
aggagggagguauaucccuauguugga

SEQ ID NO: 820781 - RNA, 22 nt, Human
aggaugaggacagagggaaaga

SEQ ID NO: 820782 - RNA, 18 nt, Human
aggcaaaguaauacugag

SEQ ID NO: 820783 - RNA, 21 nt, Human
aggcaaggaggggcggagagc

SEQ ID NO: 820784 - RNA, 20 nt, Human
aggcaauugauaaaggcggc

SEQ ID NO: 820785 - RNA, 23 nt, Human
aggcagcaaaggaggagggacgg

SEQ ID NO: 820786 - RNA, 23 nt, Human
aggcugccucagcgauaccccag

SEQ ID NO: 820787 - RNA, 23 nt, Human
agggagaagagagaaauguggca

SEQ ID NO: 820788 - RNA, 20 nt, Human
agggagaggaggagggaaag

SEQ ID NO: 820789 - RNA, 21 nt, Human
agggaguucugugccccuucu

SEQ ID NO: 820790 - RNA, 19 nt, Human
aggggcagugaccuaggaa

SEQ ID NO: 820791 - RNA, 21 nt, Human
aggggugaggggaaccugggu

SEQ ID NO: 820792 - RNA, 19 nt, Human
aggugucuccuuagccacc

SEQ ID NO: 820793 - RNA, 21 nt, Human
agugugggaaggaaggaccag

SEQ ID NO: 820794 - RNA, 28 nt, Human
auccggagacuggagggaggggaggagg

SEQ ID NO: 820795 - RNA, 18 nt, Human
auggaaaaagugaagaga

SEQ ID NO: 820796 - RNA, 22 nt, Human
auugauaaaggcggcacaaugg

SEQ ID NO: 820797 - RNA, 19 nt, Human
caagguccgggccagggac

SEQ ID NO: 820798 - RNA, 18 nt, Human
caccaccgccugccuccc

SEQ ID NO: 820799 - RNA, 24 nt, Human
caccccucugccccgcacuccgcc

SEQ ID NO: 820800 - RNA, 19 nt, Human
cacccuguccugucaccac

SEQ ID NO: 820801 - RNA, 19 nt, Human
caccgccugccucccccac

SEQ ID NO: 820802 - RNA, 25 nt, Human
cagacugacaaucucggcacaaaga

SEQ ID NO: 820803 - RNA, 19 nt, Human
cagccaagguccgggccag

SEQ ID NO: 820804 - RNA, 22 nt, Human
cagcgauaccccagggaggcua

SEQ ID NO: 820805 - RNA, 18 nt, Human
caggagccagauguggca

SEQ ID NO: 820806 - RNA, 21 nt, Human
caggagccagauguggcagca

SEQ ID NO: 820807 - RNA, 23 nt, Human
caggagcuguaaacaaaggggca

SEQ ID NO: 820808 - RNA, 18 nt, Human
caggcaauugauaaaggc

SEQ ID NO: 820809 - RNA, 20 nt, Human
cagggcagaggggcuaagga

SEQ ID NO: 820810 - RNA, 20 nt, Human
cagggggccgggcgggggcg

SEQ ID NO: 820811 - RNA, 19 nt, Human
ccaccgccugccuccccca

SEQ ID NO: 820812 - RNA, 21 nt, Human
ccaccgccugccucccccacc

SEQ ID NO: 820813 - RNA, 23 nt, Human
ccacgcgaccccagagugccaag

SEQ ID NO: 820814 - RNA, 20 nt, Human
ccagggaagaggggaaagga

SEQ ID NO: 820815 - RNA, 20 nt, Human
ccagggggccgggcgggggc

SEQ ID NO: 820816 - RNA, 23 nt, Human
ccaucucaauucaguucaauugu

SEQ ID NO: 820817 - RNA, 21 nt, Human
cccacccccgagacuuucgga

SEQ ID NO: 820818 - RNA, 22 nt, Human
cccacccccgagacuuucggaa

SEQ ID NO: 820819 - RNA, 23 nt, Human
cccagaacccuggcguccacccc

SEQ ID NO: 820820 - RNA, 19 nt, Human
cccagcccccaccccucug

SEQ ID NO: 820821 - RNA, 19 nt, Human
ccccagcccccaccccucu

SEQ ID NO: 820822 - RNA, 22 nt, Human
ccccagcccccaccccucugcc

SEQ ID NO: 820823 - RNA, 18 nt, Human
cccccagaaacagggugg

SEQ ID NO: 820824 - RNA, 18 nt, Human
cccccgagacuuucggag

SEQ ID NO: 820825 - RNA, 19 nt, Human
ccccggcgccugcaagucc

SEQ ID NO: 820826 - RNA, 19 nt, Human
cccugaaucuuccgggcuc

SEQ ID NO: 820827 - RNA, 18 nt, Human
cccuggcguccaccccca

SEQ ID NO: 820828 - RNA, 21 nt, Human
ccgacugccccacgcgacccc

SEQ ID NO: 820829 - RNA, 23 nt, Human
ccgggggagggggugcggaggag

SEQ ID NO: 820830 - RNA, 25 nt, Human
ccucagucaacucacaggccgcggg

SEQ ID NO: 820831 - RNA, 24 nt, Human
cgaccccagagugccaagggccgg

SEQ ID NO: 820832 - RNA, 23 nt, Human
cgcagacacagcaaguaagcgug

SEQ ID NO: 820833 - RNA, 18 nt, Human
cgggagcaaggacagggg

SEQ ID NO: 820834 - RNA, 18 nt, Human
cgucucuaggaugugaga

SEQ ID NO: 820835 - RNA, 18 nt, Human
cguggcuuguaaaccugg

SEQ ID NO: 820836 - RNA, 20 nt, Human
cuagaggagaagggaaacca

SEQ ID NO: 820837 - RNA, 23 nt, Human
cuagugugggaaggaaggaccag

SEQ ID NO: 820838 - RNA, 24 nt, Human
cuccccagcccccaccccucugcc

SEQ ID NO: 820839 - RNA, 19 nt, Human
cucuccccagcccccaccc

SEQ ID NO: 820840 - RNA, 22 nt, Human
cucuccccagcccccaccccuc

SEQ ID NO: 820841 - RNA, 21 nt, Human
cugagggugggaggagaggaa

SEQ ID NO: 820842 - RNA, 19 nt, Human
cugccccgcacuccgcccc

SEQ ID NO: 820843 - RNA, 20 nt, Human
cugggacuuuggcagguggg

SEQ ID NO: 820844 - RNA, 20 nt, Human
cuguggucaagggaggaggc

SEQ ID NO: 820845 - RNA, 21 nt, Human
gaaaggaccaggaggcaacgg

SEQ ID NO: 820846 - RNA, 24 nt, Human
gaaaguuaaaaaacaaacaaaaca

SEQ ID NO: 820847 - RNA, 18 nt, Human
gaaauacccacccccgag

SEQ ID NO: 820848 - RNA, 22 nt, Human
gaaggcagagaacuggggaaau

SEQ ID NO: 820849 - RNA, 21 nt, Human
gaaguggagggggagaggugg

SEQ ID NO: 820850 - RNA, 19 nt, Human
gaccugaggggguguuggg

SEQ ID NO: 820851 - RNA, 24 nt, Human
gaccugaggggguguuggggaggc

SEQ ID NO: 820852 - RNA, 19 nt, Human
gagaacaggaaggagaggc

SEQ ID NO: 820853 - RNA, 21 nt, Human
gagaacaggaaggagaggccg

SEQ ID NO: 820854 - RNA, 21 nt, Human
gagaggaggagggaaagaggc

SEQ ID NO: 820855 - RNA, 24 nt, Human
gaggagggaaagaggcagcaaagg

SEQ ID NO: 820856 - RNA, 18 nt, Human
gaggcaaugagggcagga

SEQ ID NO: 820857 - RNA, 20 nt, Human
gagggaaagaggcagcaaag

SEQ ID NO: 820858 - RNA, 19 nt, Human
gaggggaggagggagggag

SEQ ID NO: 820859 - RNA, 19 nt, Human
gagggugggaggagaggaa

SEQ ID NO: 820860 - RNA, 24 nt, Human
gagggugggaggagaggaagugga

SEQ ID NO: 820861 - RNA, 21 nt, Human
gaguuaagaguuccagccuuc

SEQ ID NO: 820862 - RNA, 26 nt, Human
gaugguggggaggaaggcugugggga

SEQ ID NO: 820863 - RNA, 18 nt, Human
gaugugagaaagagagag

SEQ ID NO: 820864 - RNA, 24 nt, Human
gcaggagcuguaaacaaaggggca

SEQ ID NO: 820865 - RNA, 21 nt, Human
gccacgccucuccccagcccc

SEQ ID NO: 820866 - RNA, 23 nt, Human
gccugccucccccaccgacugcc

SEQ ID NO: 820867 - RNA, 20 nt, Human
gcguggcuuguaaaccuggg

SEQ ID NO: 820868 - RNA, 24 nt, Human
ggaaagcaaguuacaagauguugg

SEQ ID NO: 820869 - RNA, 22 nt, Human
ggaaauggaaaaagugaagaga

SEQ ID NO: 820870 - RNA, 24 nt, Human
ggaaguggagggggagaggugggg

SEQ ID NO: 820871 - RNA, 18 nt, Human
ggaauuuguaaaccaggc

SEQ ID NO: 820872 - RNA, 19 nt, Human
ggagacagagaccaggggg

SEQ ID NO: 820873 - RNA, 20 nt, Human
ggaggaaggcuguggggaga

SEQ ID NO: 820874 - RNA, 21 nt, Human
ggaggagagagggaccgaggg

SEQ ID NO: 820875 - RNA, 20 nt, Human
ggaggagaggaaguggaggg

SEQ ID NO: 820876 - RNA, 22 nt, Human
ggaggagggagggagaggagga

SEQ ID NO: 820877 - RNA, 18 nt, Human
ggaggggaggagggaggg

SEQ ID NO: 820878 - RNA, 20 nt, Human
ggauuggaggcaaugagggc

SEQ ID NO: 820879 - RNA, 18 nt, Human
ggcacaauggggaaggag

SEQ ID NO: 820880 - RNA, 20 nt, Human
ggcaggagccagauguggca

SEQ ID NO: 820881 - RNA, 22 nt, Human
ggccacgccucuccccagcccc

SEQ ID NO: 820882 - RNA, 21 nt, Human
gggaaaccagggaagagggga

SEQ ID NO: 820883 - RNA, 18 nt, Human
gggacagagaacaggaag

SEQ ID NO: 820884 - RNA, 22 nt, Human
gggagaagagagaaauguggca

SEQ ID NO: 820885 - RNA, 20 nt, Human
gggagaggugggacacaaag

SEQ ID NO: 820886 - RNA, 22 nt, Human
gggccagggacgggagcaagga

SEQ ID NO: 820887 - RNA, 21 nt, Human
gggggugaugugagaggaaga

SEQ ID NO: 820888 - RNA, 23 nt, Human
gggguggugggggugaugugaga

SEQ ID NO: 820889 - RNA, 22 nt, Human
ggguggugggggugaugugaga

SEQ ID NO: 820890 - RNA, 23 nt, Human
gguggugggggugaugugagagg

SEQ ID NO: 820891 - RNA, 23 nt, Human
gguguuggggaggcaaggagggg

SEQ ID NO: 820892 - RNA, 22 nt, Human
gucuagaggagaagggaaacca

SEQ ID NO: 820893 - RNA, 23 nt, Human
gugaccuaggaaaugaaggagau

SEQ ID NO: 820894 - RNA, 25 nt, Human
gugccccuucucaggacuuggcgcu

SEQ ID NO: 820895 - RNA, 18 nt, Human
guguuggggaggcaagga

SEQ ID NO: 820896 - RNA, 25 nt, Human
uaaaaaacaaacaaaacaaaacagg

SEQ ID NO: 820897 - RNA, 19 nt, Human
uaaacaaaggggcagugac

SEQ ID NO: 820898 - RNA, 20 nt, Human
uaaggcaaaguaauacugag

SEQ ID NO: 820899 - RNA, 25 nt, Human
uaggaugcaccagcacguuuaaccc

SEQ ID NO: 820900 - RNA, 23 nt, Human
uauggaaaguuaaaaaacaaaca

SEQ ID NO: 820901 - RNA, 18 nt, Human
ucacaggccgcgggaccc

SEQ ID NO: 820902 - RNA, 19 nt, Human
ucaccaccgccugccuccc

SEQ ID NO: 820903 - RNA, 20 nt, Human
ucaguuauaagaaggaggga

SEQ ID NO: 820904 - RNA, 19 nt, Human
ucaugaagccgugacagag

SEQ ID NO: 820905 - RNA, 22 nt, Human
uccagagagaggaagaggagga

SEQ ID NO: 820906 - RNA, 20 nt, Human
uccaugucucuucuccccgg

SEQ ID NO: 820907 - RNA, 24 nt, Human
ucccagaacccuggcguccacccc

SEQ ID NO: 820908 - RNA, 19 nt, Human
uccccaagucugagccccu

SEQ ID NO: 820909 - RNA, 18 nt, Human
uccccagcccccaccccu

SEQ ID NO: 820910 - RNA, 22 nt, Human
uccccagcccccaccccucugc

SEQ ID NO: 820911 - RNA, 24 nt, Human
uccccagcccccaccccucugccc

SEQ ID NO: 820912 - RNA, 25 nt, Human
uccggagacuggagggaggggagga

SEQ ID NO: 820913 - RNA, 19 nt, Human
uccgggccagggacgggag

SEQ ID NO: 820914 - RNA, 19 nt, Human
ucggcacaaagaggagaca

SEQ ID NO: 820915 - RNA, 21 nt, Human
ucucaugaagccgugacagag

SEQ ID NO: 820916 - RNA, 18 nt, Human
ucuccccagcccccaccc

SEQ ID NO: 820917 - RNA, 19 nt, Human
ucuccccagcccccacccu

SEQ ID NO: 820918 - RNA, 19 nt, Human
ucuucaguuauaagaagga

SEQ ID NO: 820919 - RNA, 19 nt, Human
ucuuggaugaccuaggaug

SEQ ID NO: 820920 - RNA, 24 nt, Human
ugagaaagagagagaagggcgaaa

SEQ ID NO: 820921 - RNA, 21 nt, Human
ugagccccucagucaacucac

SEQ ID NO: 820922 - RNA, 19 nt, Human
ugaggggguguuggggagg

SEQ ID NO: 820923 - RNA, 22 nt, Human
ugaggguagggagcacugggga

SEQ ID NO: 820924 - RNA, 21 nt, Human
ugauaaaggcggcacaauggg

SEQ ID NO: 820925 - RNA, 18 nt, Human
ugccaagggccggcucca

SEQ ID NO: 820926 - RNA, 19 nt, Human
ugccaagggccggcuccau

SEQ ID NO: 820927 - RNA, 21 nt, Human
ugccagcgcguucccagaacc

SEQ ID NO: 820928 - RNA, 18 nt, Human
ugccauggggggcaggug

SEQ ID NO: 820929 - RNA, 19 nt, Human
ugcccugaaucuuccgggc

SEQ ID NO: 820930 - RNA, 20 nt, Human
uggaaaaagugaagagaagu

SEQ ID NO: 820931 - RNA, 18 nt, Human
uggaggcaaugagggcag

SEQ ID NO: 820932 - RNA, 18 nt, Human
uggaggcaaugagggcag

SEQ ID NO: 820933 - RNA, 19 nt, Human
uggcuuguaaaccugggac

SEQ ID NO: 820934 - RNA, 25 nt, Human
ugggaggagaggaaguggaggggga

SEQ ID NO: 820935 - RNA, 25 nt, Human
uggggaaaacuaaggcaaaguaaua

SEQ ID NO: 820936 - RNA, 20 nt, Human
uggggagaguguacccugcc

SEQ ID NO: 820937 - RNA, 20 nt, Human
uggggagaguguacccugcc

SEQ ID NO: 820938 - RNA, 18 nt, Human
uggggaggaaggcugugg

SEQ ID NO: 820939 - RNA, 23 nt, Human
ugggggugaugugagaggaagag

SEQ ID NO: 820940 - RNA, 24 nt, Human
uguuggggaggcaaggaggggcgg

SEQ ID NO: 820941 - RNA, 26 nt, Human
uuaaaaaacaaacaaaacaaaacagg

SEQ ID NO: 820942 - RNA, 23 nt, Human
uuaaccccacccacaccagggac

SEQ ID NO: 820943 - RNA, 19 nt, Human
uuagccacccgacaccauc

SEQ ID NO: 820944 - RNA, 23 nt, Human
uucaguuauaagaaggagggagg

SEQ ID NO: 820945 - RNA, 21 nt, Human
aaccgugugagccacccaccc

SEQ ID NO: 820946 - RNA, 25 nt, Human
aagcaauccucccaccucagccucc

SEQ ID NO: 820947 - RNA, 19 nt, Human
aagcugcccuguucuugcc

SEQ ID NO: 820948 - RNA, 22 nt, Human
acacaggcaugaaccacuucau

SEQ ID NO: 820949 - RNA, 22 nt, Human
acagaacgugacagugugugug

SEQ ID NO: 820950 - RNA, 18 nt, Human
acaggcaugaaccacuuc

SEQ ID NO: 820951 - RNA, 19 nt, Human
acccuccaccacaggcuga

SEQ ID NO: 820952 - RNA, 23 nt, Human
accucagccuccugaauagcugg

SEQ ID NO: 820953 - RNA, 19 nt, Human
acugcagccucgaccuccu

SEQ ID NO: 820954 - RNA, 19 nt, Human
agaagcacccaggaucagg

SEQ ID NO: 820955 - RNA, 20 nt, Human
agaagccaugcaaaagagaa

SEQ ID NO: 820956 - RNA, 24 nt, Human
agacaaaaccccgucacuuccccg

SEQ ID NO: 820957 - RNA, 23 nt, Human
agacccuccaccacaggcugagg

SEQ ID NO: 820958 - RNA, 19 nt, Human
agaugauagagacaaaacc

SEQ ID NO: 820959 - RNA, 20 nt, Human
agccauggcaauaauacccc

SEQ ID NO: 820960 - RNA, 18 nt, Human
agccuccugaauagcugg

SEQ ID NO: 820961 - RNA, 19 nt, Human
aggaagacacaacaaucaa

SEQ ID NO: 820962 - RNA, 23 nt, Human
aggcagagucucaccauguugcc

SEQ ID NO: 820963 - RNA, 23 nt, Human
aggcggcugugcugccgcagguc

SEQ ID NO: 820964 - RNA, 19 nt, Human
aggcugaggggguacgugu

SEQ ID NO: 820965 - RNA, 25 nt, Human
agucuggucucaaacuccuggccuc

SEQ ID NO: 820966 - RNA, 19 nt, Human
aguggcuaccgggggcucc

SEQ ID NO: 820967 - RNA, 21 nt, Human
augauagagacaaaaccccgu

SEQ ID NO: 820968 - RNA, 22 nt, Human
auguccaccuuaggagggcaac

SEQ ID NO: 820969 - RNA, 21 nt, Human
caacagccaccaggcuccggc

SEQ ID NO: 820970 - RNA, 22 nt, Human
caacugacagaacuagaccgaa

SEQ ID NO: 820971 - RNA, 27 nt, Human
caagcaauccucccaccucagccuccu

SEQ ID NO: 820972 - RNA, 19 nt, Human
caagggcccuuaaggccca

SEQ ID NO: 820973 - RNA, 24 nt, Human
caauaauaccccucucucagcaac

SEQ ID NO: 820974 - RNA, 19 nt, Human
cacagugaacgccgagugg

SEQ ID NO: 820975 - RNA, 24 nt, Human
caccauguugcccagucuggucuc

SEQ ID NO: 820976 - RNA, 27 nt, Human
caccauguugcccagucuggucucaaa

SEQ ID NO: 820977 - RNA, 21 nt, Human
caccucgcaggugcaccagcc

SEQ ID NO: 820978 - RNA, 19 nt, Human
cacugcagccucgaccucc

SEQ ID NO: 820979 - RNA, 21 nt, Human
cacugcagccucgaccuccua

SEQ ID NO: 820980 - RNA, 24 nt, Human
cagaaccggaagucucucucccag

SEQ ID NO: 820981 - RNA, 21 nt, Human
cagcaacagccaccaggcucc

SEQ ID NO: 820982 - RNA, 20 nt, Human
cagcacaguccggcuuguac

SEQ ID NO: 820983 - RNA, 18 nt, Human
cagcaccuagugcaaagu

SEQ ID NO: 820984 - RNA, 23 nt, Human
cagccucgaccuccuaggcucaa

SEQ ID NO: 820985 - RNA, 25 nt, Human
cagccucgaccuccuaggcucaagc

SEQ ID NO: 820986 - RNA, 19 nt, Human
caggagccugcugucuggc

SEQ ID NO: 820987 - RNA, 19 nt, Human
caggucaggccaccucgca

SEQ ID NO: 820988 - RNA, 24 nt, Human
cauguugcccagucuggucucaaa

SEQ ID NO: 820989 - RNA, 22 nt, Human
ccaagcugcccuguucuugccu

SEQ ID NO: 820990 - RNA, 18 nt, Human
ccaccucugccgguccug

SEQ ID NO: 820991 - RNA, 18 nt, Human
ccacgagaagcacccagg

SEQ ID NO: 820992 - RNA, 24 nt, Human
ccacugcagccucgaccuccuagg

SEQ ID NO: 820993 - RNA, 21 nt, Human
ccagucgagccacaggggcaa

SEQ ID NO: 820994 - RNA, 19 nt, Human
ccaugugugcaggccccug

SEQ ID NO: 820995 - RNA, 26 nt, Human
cccaaaaacaucaccacaguugaucu

SEQ ID NO: 820996 - RNA, 22 nt, Human
cccaaccucagcacaguccggc

SEQ ID NO: 820997 - RNA, 20 nt, Human
cccagacugcaguacagugg

SEQ ID NO: 820998 - RNA, 22 nt, Human
ccccgcccucgucacuccgaaa

SEQ ID NO: 820999 - RNA, 23 nt, Human
cccucgucacuccgaagggauuc

SEQ ID NO: 821000 - RNA, 21 nt, Human
ccgaaaaaaaaaggaaagaca

SEQ ID NO: 821001 - RNA, 24 nt, Human
ccgaaaaaaaaaggaaagacagau

SEQ ID NO: 821002 - RNA, 18 nt, Human
ccuaagaagaugccccuc

SEQ ID NO: 821003 - RNA, 24 nt, Human
ccuccauaaccgugugagccaccc

SEQ ID NO: 821004 - RNA, 24 nt, Human
ccucccaggucacugucaugcccu

SEQ ID NO: 821005 - RNA, 18 nt, Human
ccucgaccuccuaggcuc

SEQ ID NO: 821006 - RNA, 19 nt, Human
ccugagccaccacccaggc

SEQ ID NO: 821007 - RNA, 21 nt, Human
ccugucagcaccuagugcaaa

SEQ ID NO: 821008 - RNA, 25 nt, Human
cgaccuccuaggcucaagcaauccu

SEQ ID NO: 821009 - RNA, 26 nt, Human
cgcaaaagagaacgggacgaagaucc

SEQ ID NO: 821010 - RNA, 23 nt, Human
cgccguggagugcaggaaaggug

SEQ ID NO: 821011 - RNA, 18 nt, Human
cgccugagaugauagaga

SEQ ID NO: 821012 - RNA, 23 nt, Human
cgcuucugggcccacagcacccu

SEQ ID NO: 821013 - RNA, 22 nt, Human
cggagugggaccaggaccggga

SEQ ID NO: 821014 - RNA, 21 nt, Human
cgucagacacccucaccuccu

SEQ ID NO: 821015 - RNA, 18 nt, Human
cuacaucugagcuucucu

SEQ ID NO: 821016 - RNA, 21 nt, Human
cuacuggacagugcuggcccc

SEQ ID NO: 821017 - RNA, 19 nt, Human
cuacuucugagcugcaucu

SEQ ID NO: 821018 - RNA, 23 nt, Human
cuagcucuucaucuccccuccca

SEQ ID NO: 821019 - RNA, 21 nt, Human
cucaagcaauccucccaccuc

SEQ ID NO: 821020 - RNA, 24 nt, Human
cucaagcaauccucccaccucagc

SEQ ID NO: 821021 - RNA, 19 nt, Human
cucaccugcauagcccuuc

SEQ ID NO: 821022 - RNA, 23 nt, Human
cuccaccaaugucagauucacaa

SEQ ID NO: 821023 - RNA, 19 nt, Human
cucccagagacccuccacc

SEQ ID NO: 821024 - RNA, 25 nt, Human
cuccuaggcucaagcaauccuccca

SEQ ID NO: 821025 - RNA, 24 nt, Human
cuccugaauagcugggaacacagg

SEQ ID NO: 821026 - RNA, 22 nt, Human
cucugcaggggagggggcucug

SEQ ID NO: 821027 - RNA, 22 nt, Human
cugcagccucgaccuccuaggc

SEQ ID NO: 821028 - RNA, 23 nt, Human
cugcagccucgaccuccuaggcu

SEQ ID NO: 821029 - RNA, 18 nt, Human
cugccugguccuggacgc

SEQ ID NO: 821030 - RNA, 20 nt, Human
cugcuuccuucugccucugc

SEQ ID NO: 821031 - RNA, 22 nt, Human
cugggagcggcuggcugggacu

SEQ ID NO: 821032 - RNA, 19 nt, Human
cuucugggcccacagcacc

SEQ ID NO: 821033 - RNA, 21 nt, Human
cuugguacugacagcgcggcc

SEQ ID NO: 821034 - RNA, 19 nt, Human
gaaaaaaaaaggaaagaca

SEQ ID NO: 821035 - RNA, 24 nt, Human
gaaaaaaaaaggaaagacagauca

SEQ ID NO: 821036 - RNA, 19 nt, Human
gaaaucggaaaacagguca

SEQ ID NO: 821037 - RNA, 20 nt, Human
gaagucaacacggaguggga

SEQ ID NO: 821038 - RNA, 24 nt, Human
gagacagucuuucuguguggccca

SEQ ID NO: 821039 - RNA, 19 nt, Human
gagcuuccaucugacccuc

SEQ ID NO: 821040 - RNA, 22 nt, Human
gcagacagacacugguccaagg

SEQ ID NO: 821041 - RNA, 22 nt, Human
gccaaauccccacagugaacgc

SEQ ID NO: 821042 - RNA, 20 nt, Human
gccacagagcuuccaucuga

SEQ ID NO: 821043 - RNA, 18 nt, Human
gccaccacccaggcagac

SEQ ID NO: 821044 - RNA, 19 nt, Human
gccaccacccaggcagacc

SEQ ID NO: 821045 - RNA, 21 nt, Human
gcccacagccuggaaggagac

SEQ ID NO: 821046 - RNA, 24 nt, Human
gcccagacugcaguacagugguau

SEQ ID NO: 821047 - RNA, 27 nt, Human
gccugagccaccacccaggcagacccu

SEQ ID NO: 821048 - RNA, 22 nt, Human
ggaccaggaccgggagccuuca

SEQ ID NO: 821049 - RNA, 21 nt, Human
ggacgagggcaguggccaccu

SEQ ID NO: 821050 - RNA, 23 nt, Human
ggagagucucacgugggcaggaa

SEQ ID NO: 821051 - RNA, 18 nt, Human
ggagugcaggcuggggac

SEQ ID NO: 821052 - RNA, 18 nt, Human
ggccacagagcuuccauc

SEQ ID NO: 821053 - RNA, 20 nt, Human
ggcccagcucugccuggucc

SEQ ID NO: 821054 - RNA, 23 nt, Human
ggccccugggagcggcuggcugg

SEQ ID NO: 821055 - RNA, 22 nt, Human
gggcaggaaccaaggccugaga

SEQ ID NO: 821056 - RNA, 21 nt, Human
gggcagggccuggccacuccu

SEQ ID NO: 821057 - RNA, 22 nt, Human
ggggucacuccucaucugagcc

SEQ ID NO: 821058 - RNA, 31 nt, Human
gggugggguccuugucacugccgccguggaa

SEQ ID NO: 821059 - RNA, 19 nt, Human
ggucaggccaccucgcagg

SEQ ID NO: 821060 - RNA, 21 nt, Human
gucacugucaugcccuuuaga

SEQ ID NO: 821061 - RNA, 20 nt, Human
guccagaaucuucccucggg

SEQ ID NO: 821062 - RNA, 19 nt, Human
gucccuuugcauuuuccgg

SEQ ID NO: 821063 - RNA, 21 nt, Human
gugcgcgagcugugaccccgc

SEQ ID NO: 821064 - RNA, 18 nt, Human
guggagccugugugcccc

SEQ ID NO: 821065 - RNA, 20 nt, Human
gugugagccacccacccaca

SEQ ID NO: 821066 - RNA, 19 nt, Human
uaaaagggucaauuccuca

SEQ ID NO: 821067 - RNA, 20 nt, Human
uaagaagaugccccuccucc

SEQ ID NO: 821068 - RNA, 21 nt, Human
uaaggcccagcucugccuggu

SEQ ID NO: 821069 - RNA, 19 nt, Human
uaagggggccucugcccuc

SEQ ID NO: 821070 - RNA, 22 nt, Human
uagaggcagagucucaccaugu

SEQ ID NO: 821071 - RNA, 20 nt, Human
uagcucuucaucuccccucc

SEQ ID NO: 821072 - RNA, 21 nt, Human
uagugcaaaguccagcccacc

SEQ ID NO: 821073 - RNA, 18 nt, Human
uaguggccucagcuacug

SEQ ID NO: 821074 - RNA, 27 nt, Human
uauuuuguuuuucuuagaagcccucca

SEQ ID NO: 821075 - RNA, 19 nt, Human
ucaacacauacuugucccu

SEQ ID NO: 821076 - RNA, 26 nt, Human
ucaccaccuccagcuacuugguacug

SEQ ID NO: 821077 - RNA, 19 nt, Human
ucaccauguugcccagucu

SEQ ID NO: 821078 - RNA, 22 nt, Human
ucacugccgccguggagugcag

SEQ ID NO: 821079 - RNA, 19 nt, Human
ucagaagagaugccuggag

SEQ ID NO: 821080 - RNA, 26 nt, Human
ucagcaacugacagaacuagaccgaa

SEQ ID NO: 821081 - RNA, 26 nt, Human
uccaaagaacuuuuuuuuuucuggag

SEQ ID NO: 821082 - RNA, 27 nt, Human
uccauaaccgugugagccacccaccca

SEQ ID NO: 821083 - RNA, 26 nt, Human
ucccaggucacuguuacgccuuuuug

SEQ ID NO: 821084 - RNA, 20 nt, Human
ucccugcagacagacacugg

SEQ ID NO: 821085 - RNA, 25 nt, Human
uccggcaaaacuaaagggagacaga

SEQ ID NO: 821086 - RNA, 21 nt, Human
uccgggacugggaccaggagc

SEQ ID NO: 821087 - RNA, 20 nt, Human
uccuaaugcuacuucugagc

SEQ ID NO: 821088 - RNA, 18 nt, Human
uccuaggcucaagcaauc

SEQ ID NO: 821089 - RNA, 26 nt, Human
uccucccaccucagccuccugaauag

SEQ ID NO: 821090 - RNA, 23 nt, Human
uccuuagggaaggagacguaggg

SEQ ID NO: 821091 - RNA, 18 nt, Human
ucucacauucccugccac

SEQ ID NO: 821092 - RNA, 23 nt, Human
ucucacauucccugccacguccc

SEQ ID NO: 821093 - RNA, 18 nt, Human
ucucaccauguugcccag

SEQ ID NO: 821094 - RNA, 19 nt, Human
ucucaccauguugcccagu

SEQ ID NO: 821095 - RNA, 24 nt, Human
ucucucagcaacugacagaacuag

SEQ ID NO: 821096 - RNA, 23 nt, Human
ucugccggcaccuuccauugguc

SEQ ID NO: 821097 - RNA, 20 nt, Human
ucugccucugcaggggaggg

SEQ ID NO: 821098 - RNA, 23 nt, Human
ucuggcacaguuaccucccaggu

SEQ ID NO: 821099 - RNA, 23 nt, Human
ugaagggcaggcccacagccugg

SEQ ID NO: 821100 - RNA, 23 nt, Human
ugacagaacuagaccgaaaaaaa

SEQ ID NO: 821101 - RNA, 21 nt, Human
ugacaggccugagccaccacc

SEQ ID NO: 821102 - RNA, 18 nt, Human
ugaggaagcccagguccc

SEQ ID NO: 821103 - RNA, 23 nt, Human
ugauccgaguggcuaccgggggc

SEQ ID NO: 821104 - RNA, 22 nt, Human
ugcaaaguccagcccaccgugg

SEQ ID NO: 821105 - RNA, 23 nt, Human
ugccaagaaacugucccaaaaac

SEQ ID NO: 821106 - RNA, 19 nt, Human
ugcccccggggucacuccu

SEQ ID NO: 821107 - RNA, 19 nt, Human
ugccugguccuggacgcuc

SEQ ID NO: 821108 - RNA, 20 nt, Human
ugcuacaucugagcuucucu

SEQ ID NO: 821109 - RNA, 24 nt, Human
ugcugcuguccaugggccacccgg

SEQ ID NO: 821110 - RNA, 20 nt, Human
uggagccugugugcccccgg

SEQ ID NO: 821111 - RNA, 27 nt, Human
uggcaauaauaccccucucucagcaac

SEQ ID NO: 821112 - RNA, 20 nt, Human
uggcagccgugugaacgaac

SEQ ID NO: 821113 - RNA, 26 nt, Human
ugggaacacaggcaugaaccacuuca

SEQ ID NO: 821114 - RNA, 23 nt, Human
ugggaccaggagccugcugucug

SEQ ID NO: 821115 - RNA, 21 nt, Human
ugggagcggcuggcugggacu

SEQ ID NO: 821116 - RNA, 24 nt, Human
ugggaugacaggccugagccacca

SEQ ID NO: 821117 - RNA, 20 nt, Human
uggggugggguccuugucac

SEQ ID NO: 821118 - RNA, 21 nt, Human
uggguggcaguguggagccug

SEQ ID NO: 821119 - RNA, 21 nt, Human
ugucccaaaaacaucaccaca

SEQ ID NO: 821120 - RNA, 25 nt, Human
ugugaccccgcccucgucacuccga

SEQ ID NO: 821121 - RNA, 19 nt, Human
ugugcagggacguaaagga

SEQ ID NO: 821122 - RNA, 22 nt, Human
ugugugcaggccccugggagcg

SEQ ID NO: 821123 - RNA, 20 nt, Human
uuagggaggagacucagccu

SEQ ID NO: 821124 - RNA, 23 nt, Human
uuccucaggaagacacaacaauc

SEQ ID NO: 821125 - RNA, 18 nt, Human
uugcuucucugaagucaa

SEQ ID NO: 821126 - RNA, 24 nt, Human
uuguagaggcagagucucaccaug

SEQ ID NO: 821127 - RNA, 18 nt, Human
uuugcagaagaugaagga

SEQ ID NO: 821128 - RNA, 24 nt, Human
aaagugcugggauuacaggcguga

SEQ ID NO: 821129 - RNA, 19 nt, Human
aaauacaccaagagcucac

SEQ ID NO: 821130 - RNA, 24 nt, Human
aagaggccaggguggauccuggca

SEQ ID NO: 821131 - RNA, 18 nt, Human
aagcacucggauuacagg

SEQ ID NO: 821132 - RNA, 26 nt, Human
aagcacugggauugcaagcgugagcc

SEQ ID NO: 821133 - RNA, 19 nt, Human
aagcuuggugcucagugaa

SEQ ID NO: 821134 - RNA, 22 nt, Human
aaguacccuccaccaggcagag

SEQ ID NO: 821135 - RNA, 20 nt, Human
aagugauccuccugccucag

SEQ ID NO: 821136 - RNA, 19 nt, Human
aagugcugggauuacaggc

SEQ ID NO: 821137 - RNA, 19 nt, Human
aagugcugggauuacaggc

SEQ ID NO: 821138 - RNA, 26 nt, Human
aagugcugggauuacaggcgugagcc

SEQ ID NO: 821139 - RNA, 18 nt, Human
acagcucacugcagccuc

SEQ ID NO: 821140 - RNA, 18 nt, Human
acgggguuucaccguguu

SEQ ID NO: 821141 - RNA, 19 nt, Human
acgggguuucaccguguua

SEQ ID NO: 821142 - RNA, 20 nt, Human
acgggguuucaccguguuag

SEQ ID NO: 821143 - RNA, 24 nt, Human
acgggguuucaccguguuagccag

SEQ ID NO: 821144 - RNA, 25 nt, Human
acucugucgcccaggcuggagugca

SEQ ID NO: 821145 - RNA, 18 nt, Human
acugcaagcuccgccucc

SEQ ID NO: 821146 - RNA, 23 nt, Human
acuggagugcaguggugugaaca

SEQ ID NO: 821147 - RNA, 23 nt, Human
acugggauugcaagcgugagcca

SEQ ID NO: 821148 - RNA, 19 nt, Human
acuguuucugcuucagucu

SEQ ID NO: 821149 - RNA, 21 nt, Human
agaagccuggaaggguuguuc

SEQ ID NO: 821150 - RNA, 21 nt, Human
agaccuggcauaagcuuggug

SEQ ID NO: 821151 - RNA, 21 nt, Human
agagaagccuggaaggguugu

SEQ ID NO: 821152 - RNA, 19 nt, Human
agagacgggguuucaccgu

SEQ ID NO: 821153 - RNA, 23 nt, Human
agagguacccacacuggcuguug

SEQ ID NO: 821154 - RNA, 23 nt, Human
agcaaaguccugggugcccaaaa

SEQ ID NO: 821155 - RNA, 21 nt, Human
agccaccaguuuuaaaaaucu

SEQ ID NO: 821156 - RNA, 22 nt, Human
agcccguuucucuuaucuccug

SEQ ID NO: 821157 - RNA, 18 nt, Human
agccuccagaguagcugg

SEQ ID NO: 821158 - RNA, 25 nt, Human
aggcuggagugcaguggcgcgaucu

SEQ ID NO: 821159 - RNA, 20 nt, Human
aguagagacgggguuucacc

SEQ ID NO: 821160 - RNA, 21 nt, Human
aguagagacgggguuucaccg

SEQ ID NO: 821161 - RNA, 18 nt, Human
aguagcugggaauacugg

SEQ ID NO: 821162 - RNA, 20 nt, Human
agugauccuccugccucagc

SEQ ID NO: 821163 - RNA, 20 nt, Human
agugcaguggcgcgaucucg

SEQ ID NO: 821164 - RNA, 23 nt, Human
agugcaguggcgcgaucucggcu

SEQ ID NO: 821165 - RNA, 24 nt, Human
agugcaguggcgcgaucucggcuc

SEQ ID NO: 821166 - RNA, 23 nt, Human
agugcaguggugugaacacagcu

SEQ ID NO: 821167 - RNA, 24 nt, Human
agugcaguggugugaacacagcuc

SEQ ID NO: 821168 - RNA, 18 nt, Human
agugcugggauuacaggc

SEQ ID NO: 821169 - RNA, 19 nt, Human
aucaaguacccuccaccag

SEQ ID NO: 821170 - RNA, 19 nt, Human
aucccacugucccugcaca

SEQ ID NO: 821171 - RNA, 21 nt, Human
aucucugcccccagcaucacc

SEQ ID NO: 821172 - RNA, 21 nt, Human
augguggguaccagaccaguu

SEQ ID NO: 821173 - RNA, 24 nt, Human
caaagcacucggauuacaggcaug

SEQ ID NO: 821174 - RNA, 24 nt, Human
caaagcacugggauugcaagcgug

SEQ ID NO: 821175 - RNA, 24 nt, Human
caaagugcugggauuacaggcgug

SEQ ID NO: 821176 - RNA, 23 nt, Human
caagagcucacccucuugcagug

SEQ ID NO: 821177 - RNA, 20 nt, Human
caagcgugagccaccgcacc

SEQ ID NO: 821178 - RNA, 20 nt, Human
caauccugccuccgccucag

SEQ ID NO: 821179 - RNA, 20 nt, Human
cacacaccccacggcagccc

SEQ ID NO: 821180 - RNA, 23 nt, Human
cacacucagagagcaagcuaucu

SEQ ID NO: 821181 - RNA, 22 nt, Human
caccacaggcgcccgccaccac

SEQ ID NO: 821182 - RNA, 26 nt, Human
caccacaggcgcccgccaccacuccu

SEQ ID NO: 821183 - RNA, 19 nt, Human
caccacgcccagccaccag

SEQ ID NO: 821184 - RNA, 22 nt, Human
cacccagucuggagcugaggac

SEQ ID NO: 821185 - RNA, 18 nt, Human
caccguguuagccaggau

SEQ ID NO: 821186 - RNA, 24 nt, Human
caccguguuagccaggauggucuc

SEQ ID NO: 821187 - RNA, 22 nt, Human
cacgccauucuccugccucagc

SEQ ID NO: 821188 - RNA, 24 nt, Human
cacucugucgcccaggcuggagug

SEQ ID NO: 821189 - RNA, 19 nt, Human
cacuguugcccagacugga

SEQ ID NO: 821190 - RNA, 21 nt, Human
cagagaaaucaaguacccucc

SEQ ID NO: 821191 - RNA, 21 nt, Human
cagcauagcugggugaccugg

SEQ ID NO: 821192 - RNA, 19 nt, Human
cagccuccugaguagcugg

SEQ ID NO: 821193 - RNA, 18 nt, Human
caggcgcccgccaccacu

SEQ ID NO: 821194 - RNA, 20 nt, Human
caggcugaaugaaucaauga

SEQ ID NO: 821195 - RNA, 21 nt, Human
cauaucaagcaauccugccuc

SEQ ID NO: 821196 - RNA, 24 nt, Human
ccaaagcacucggauuacaggcau

SEQ ID NO: 821197 - RNA, 22 nt, Human
ccaaagugcugggauuacaggc

SEQ ID NO: 821198 - RNA, 22 nt, Human
ccaaagugcugggauuacaggc

SEQ ID NO: 821199 - RNA, 24 nt, Human
ccaaagugcugggauuacaggcgu

SEQ ID NO: 821200 - RNA, 22 nt, Human
ccagaguagcugggaauacugg

SEQ ID NO: 821201 - RNA, 25 nt, Human
ccagaguagcugggaauacuggugu

SEQ ID NO: 821202 - RNA, 19 nt, Human
ccagggaaggcaagggcug

SEQ ID NO: 821203 - RNA, 23 nt, Human
ccauggaggucuguuuccuggga

SEQ ID NO: 821204 - RNA, 23 nt, Human
cccacugucccugcacaucccca

SEQ ID NO: 821205 - RNA, 19 nt, Human
cccagacuggagugcagug

SEQ ID NO: 821206 - RNA, 18 nt, Human
ccccagagguacccacac

SEQ ID NO: 821207 - RNA, 18 nt, Human
ccccagagguacccacac

SEQ ID NO: 821208 - RNA, 21 nt, Human
cccgccaccacuccuggcuaa

SEQ ID NO: 821209 - RNA, 23 nt, Human
ccuccgccucagccuccagagua

SEQ ID NO: 821210 - RNA, 24 nt, Human
ccuccugccucagucucccaaagc

SEQ ID NO: 821211 - RNA, 23 nt, Human
ccugccucagccuccugaguagc

SEQ ID NO: 821212 - RNA, 24 nt, Human
ccugccucagccuccugaguagcu

SEQ ID NO: 821213 - RNA, 21 nt, Human
ccuggccuuaagugauccucc

SEQ ID NO: 821214 - RNA, 22 nt, Human
ccuggccuuaagugauccuccu

SEQ ID NO: 821215 - RNA, 27 nt, Human
ccugggugcccaaaauccagggaaggc

SEQ ID NO: 821216 - RNA, 27 nt, Human
cgagugauccuccugccucagccuccc

SEQ ID NO: 821217 - RNA, 27 nt, Human
cgagugauccuccugccucagccuccc

SEQ ID NO: 821218 - RNA, 24 nt, Human
cgcccaggcuggagugcaguggcg

SEQ ID NO: 821219 - RNA, 24 nt, Human
cgccucagccuccagaguagcugg

SEQ ID NO: 821220 - RNA, 19 nt, Human
cgccucccggguucacgcc

SEQ ID NO: 821221 - RNA, 24 nt, Human
cgccucggccucccaaagugcugg

SEQ ID NO: 821222 - RNA, 19 nt, Human
cggauuacaggcaugugcc

SEQ ID NO: 821223 - RNA, 24 nt, Human
cgggguuucaccguguuagccagg

SEQ ID NO: 821224 - RNA, 22 nt, Human
cgugugggaccccucacuaucc

SEQ ID NO: 821225 - RNA, 19 nt, Human
cucacuauccacaccuccc

SEQ ID NO: 821226 - RNA, 24 nt, Human
cucacucugucgcccaggcuggag

SEQ ID NO: 821227 - RNA, 21 nt, Human
cucccggguucacgccauucu

SEQ ID NO: 821228 - RNA, 24 nt, Human
cuccgccucagccuccagaguagc

SEQ ID NO: 821229 - RNA, 24 nt, Human
cuccugaccucgugaucugcccgc

SEQ ID NO: 821230 - RNA, 18 nt, Human
cucgagugauccuccugc

SEQ ID NO: 821231 - RNA, 20 nt, Human
cucggauuacaggcaugugc

SEQ ID NO: 821232 - RNA, 19 nt, Human
cugaagccuacacacaccc

SEQ ID NO: 821233 - RNA, 23 nt, Human
cugauguugcugggcaccagggu

SEQ ID NO: 821234 - RNA, 24 nt, Human
cuggggagucaguggguaaaaaga

SEQ ID NO: 821235 - RNA, 19 nt, Human
cugucgcccaggcuggagu

SEQ ID NO: 821236 - RNA, 20 nt, Human
cuucagggacuaccuucucu

SEQ ID NO: 821237 - RNA, 20 nt, Human
gaccccucacuauccacacc

SEQ ID NO: 821238 - RNA, 22 nt, Human
gaccucgugaucugcccgccuc

SEQ ID NO: 821239 - RNA, 24 nt, Human
gaccucgugaucugcccgccucgg

SEQ ID NO: 821240 - RNA, 19 nt, Human
gacucaucucugcccccag

SEQ ID NO: 821241 - RNA, 24 nt, Human
gagacgggguuucaccguguuagc

SEQ ID NO: 821242 - RNA, 24 nt, Human
gagagggagucucacucugucgcc

SEQ ID NO: 821243 - RNA, 23 nt, Human
gagcaaaguccugggugcccaaa

SEQ ID NO: 821244 - RNA, 22 nt, Human
gagcucgagugauccuccugcc

SEQ ID NO: 821245 - RNA, 20 nt, Human
gaggaccuggguaccuacag

SEQ ID NO: 821246 - RNA, 18 nt, Human
gaggaucugaagagguau

SEQ ID NO: 821247 - RNA, 21 nt, Human
gaugaaggaagcccagagaaa

SEQ ID NO: 821248 - RNA, 20 nt, Human
gaugacaagagaagccugga

SEQ ID NO: 821249 - RNA, 21 nt, Human
gaugacaagagaagccuggaa

SEQ ID NO: 821250 - RNA, 18 nt, Human
gauuacaggcaugugcca

SEQ ID NO: 821251 - RNA, 18 nt, Human
gauuacaggcgugagcca

SEQ ID NO: 821252 - RNA, 21 nt, Human
gauuacaggcgugagccacca

SEQ ID NO: 821253 - RNA, 22 nt, Human
gauuacaggcgugagccaccac

SEQ ID NO: 821254 - RNA, 18 nt, Human
gauugcaagcgugagcca

SEQ ID NO: 821255 - RNA, 24 nt, Human
gauugugcaugccuccugugggca

SEQ ID NO: 821256 - RNA, 22 nt, Human
gcaaaguccugggugcccaaaa

SEQ ID NO: 821257 - RNA, 24 nt, Human
gcccagacuggagugcaguggugu

SEQ ID NO: 821258 - RNA, 19 nt, Human
gcccaggcuggagugcagu

SEQ ID NO: 821259 - RNA, 20 nt, Human
gcccaggcuggagugcagug

SEQ ID NO: 821260 - RNA, 24 nt, Human
gccucagucucccaaagcacuggg

SEQ ID NO: 821261 - RNA, 25 nt, Human
gccucccggguucacgccauucucc

SEQ ID NO: 821262 - RNA, 19 nt, Human
gcuggagugcaguggcgcg

SEQ ID NO: 821263 - RNA, 18 nt, Human
gcuguugcccaggcuggu

SEQ ID NO: 821264 - RNA, 21 nt, Human
ggaagcccagagaaaucaagu

SEQ ID NO: 821265 - RNA, 19 nt, Human
ggaggcuuuaggacacaca

SEQ ID NO: 821266 - RNA, 24 nt, Human
ggauggucucgaucuccugaccuc

SEQ ID NO: 821267 - RNA, 19 nt, Human
ggauuacaggcaugugcca

SEQ ID NO: 821268 - RNA, 22 nt, Human
ggauuacaggcaugugccacca

SEQ ID NO: 821269 - RNA, 19 nt, Human
ggauuacaggcgugagcca

SEQ ID NO: 821270 - RNA, 22 nt, Human
ggccuuaagugauccuccugcc

SEQ ID NO: 821271 - RNA, 24 nt, Human
ggccuuaagugauccuccugccuc

SEQ ID NO: 821272 - RNA, 23 nt, Human
ggcuggucucgaacuccuggccu

SEQ ID NO: 821273 - RNA, 23 nt, Human
gggguuucaccguguuagccagg

SEQ ID NO: 821274 - RNA, 23 nt, Human
guagagacgggguuucaccgugu

SEQ ID NO: 821275 - RNA, 22 nt, Human
gucuugcuguugcccaggcugg

SEQ ID NO: 821276 - RNA, 24 nt, Human
gugaacacagcucacugcagccuc

SEQ ID NO: 821277 - RNA, 24 nt, Human
gugauccuccugccucagccuccc

SEQ ID NO: 821278 - RNA, 24 nt, Human
gugaucugcccgccucggccuccc

SEQ ID NO: 821279 - RNA, 21 nt, Human
gugcaugccuccugugggcag

SEQ ID NO: 821280 - RNA, 18 nt, Human
guggauccuggcacaugg

SEQ ID NO: 821281 - RNA, 20 nt, Human
guucuuuuccucuuucacug

SEQ ID NO: 821282 - RNA, 18 nt, Human
uaaaaagaggccagggug

SEQ ID NO: 821283 - RNA, 22 nt, Human
uaacuggauggucuccaaauac

SEQ ID NO: 821284 - RNA, 20 nt, Human
uaagugauccuccugccuca

SEQ ID NO: 821285 - RNA, 28 nt, Human
uaagugauccuccugccucagucuccca

SEQ ID NO: 821286 - RNA, 25 nt, Human
uaauagagacaaagucucucucucu

SEQ ID NO: 821287 - RNA, 24 nt, Human
uaauuuuuuguauuuuuaguagag

SEQ ID NO: 821288 - RNA, 25 nt, Human
uaauuuuuuguauuuuuaguagaga

SEQ ID NO: 821289 - RNA, 19 nt, Human
uacagauuuccuuccacac

SEQ ID NO: 821290 - RNA, 24 nt, Human
uacaggcgugagccaccacgccca

SEQ ID NO: 821291 - RNA, 21 nt, Human
uaguagagacgggguuucacc

SEQ ID NO: 821292 - RNA, 24 nt, Human
uaguagagacgggguuucaccgug

SEQ ID NO: 821293 - RNA, 26 nt, Human
uaguagagacgggguuucaccguguu

SEQ ID NO: 821294 - RNA, 22 nt, Human
uaucaagcaauccugccuccgc

SEQ ID NO: 821295 - RNA, 21 nt, Human
uaugggagaagggaggcuuua

SEQ ID NO: 821296 - RNA, 22 nt, Human
uauuuuuauuuucuuuugagag

SEQ ID NO: 821297 - RNA, 24 nt, Human
ucaccguguuagccaggauggucu

SEQ ID NO: 821298 - RNA, 18 nt, Human
ucacugcaagcuccgccu

SEQ ID NO: 821299 - RNA, 19 nt, Human
ucacugcaagcuccgccuc

SEQ ID NO: 821300 - RNA, 24 nt, Human
ucacugcaagcuccgccucccggg

SEQ ID NO: 821301 - RNA, 19 nt, Human
ucacugcagccucaaucuc

SEQ ID NO: 821302 - RNA, 20 nt, Human
ucagccuccugaguagcugg

SEQ ID NO: 821303 - RNA, 23 nt, Human
uccagggaaggcaagggcugggg

SEQ ID NO: 821304 - RNA, 24 nt, Human
ucccaaagcacucggauuacaggc

SEQ ID NO: 821305 - RNA, 24 nt, Human
ucccaaagugcugggauuacaggc

SEQ ID NO: 821306 - RNA, 21 nt, Human
ucccggguucacgccauucuc

SEQ ID NO: 821307 - RNA, 24 nt, Human
ucccggguucacgccauucuccug

SEQ ID NO: 821308 - RNA, 25 nt, Human
uccuccugccucagccucccaaagc

SEQ ID NO: 821309 - RNA, 24 nt, Human
uccugaguagcuggccaccacagg

SEQ ID NO: 821310 - RNA, 25 nt, Human
uccugaguagcuggccaccacaggc

SEQ ID NO: 821311 - RNA, 22 nt, Human
uccugggucuccagcaucaccc

SEQ ID NO: 821312 - RNA, 22 nt, Human
ucgcccaggcuggagugcagug

SEQ ID NO: 821313 - RNA, 22 nt, Human
ucggauuacaggcaugugccac

SEQ ID NO: 821314 - RNA, 24 nt, Human
ucggauuacaggcaugugccacca

SEQ ID NO: 821315 - RNA, 18 nt, Human
ucggccucccaaagugcu

SEQ ID NO: 821316 - RNA, 23 nt, Human
ucucacucugucgcccaggcugg

SEQ ID NO: 821317 - RNA, 24 nt, Human
ucucacucugucgcccaggcugga

SEQ ID NO: 821318 - RNA, 26 nt, Human
ucucacucugucgcccaggcuggagu

SEQ ID NO: 821319 - RNA, 24 nt, Human
ucuccaaauacaccaagagcucac

SEQ ID NO: 821320 - RNA, 23 nt, Human
ucuccaaauacaccaagagcucu

SEQ ID NO: 821321 - RNA, 19 nt, Human
ucuccagcaucacccaguc

SEQ ID NO: 821322 - RNA, 21 nt, Human
ucucccaaagcacugggauug

SEQ ID NO: 821323 - RNA, 22 nt, Human
ucuccugcagccccugccgcuc

SEQ ID NO: 821324 - RNA, 27 nt, Human
ucuccugcagccccugccgcucuugac

SEQ ID NO: 821325 - RNA, 24 nt, Human
ucuccugccucagccuccugagua

SEQ ID NO: 821326 - RNA, 21 nt, Human
ucucgaacuccuggccuuaag

SEQ ID NO: 821327 - RNA, 21 nt, Human
ucucuaggaaguccuuaacuc

SEQ ID NO: 821328 - RNA, 19 nt, Human
ucucuugcccaggucuuga

SEQ ID NO: 821329 - RNA, 19 nt, Human
ucugaagccuacacacacc

SEQ ID NO: 821330 - RNA, 24 nt, Human
ucugucgcccaggcuggagugcag

SEQ ID NO: 821331 - RNA, 24 nt, Human
ucuugcacuguugcccagacugga

SEQ ID NO: 821332 - RNA, 20 nt, Human
ucuugcuguugcccaggcug

SEQ ID NO: 821333 - RNA, 21 nt, Human
ucuugcuguugcccaggcugg

SEQ ID NO: 821334 - RNA, 22 nt, Human
ucuugcuguugcccaggcuggu

SEQ ID NO: 821335 - RNA, 19 nt, Human
ugaagccuacacacacccc

SEQ ID NO: 821336 - RNA, 21 nt, Human
ugaaggaagcccagagaaauc

SEQ ID NO: 821337 - RNA, 19 nt, Human
ugacaagagaagccuggaa

SEQ ID NO: 821338 - RNA, 24 nt, Human
ugagcucgagugauccuccugccu

SEQ ID NO: 821339 - RNA, 22 nt, Human
ugaggucuugcuguugcccagg

SEQ ID NO: 821340 - RNA, 23 nt, Human
ugaggucuugcuguugcccaggc

SEQ ID NO: 821341 - RNA, 21 nt, Human
ugaugcagugcaaagggccuu

SEQ ID NO: 821342 - RNA, 24 nt, Human
ugcacuguugcccagacuggagug

SEQ ID NO: 821343 - RNA, 23 nt, Human
ugcaugccuccugugggcagagc

SEQ ID NO: 821344 - RNA, 21 nt, Human
ugcccagacuggagugcagug

SEQ ID NO: 821345 - RNA, 24 nt, Human
ugcccagacuggagugcaguggug

SEQ ID NO: 821346 - RNA, 24 nt, Human
ugcccaggcuggucucgaacuccu

SEQ ID NO: 821347 - RNA, 25 nt, Human
ugccucagccucccaaagcacucgg

SEQ ID NO: 821348 - RNA, 24 nt, Human
ugccucagccuccugaguagcugg

SEQ ID NO: 821349 - RNA, 18 nt, Human
ugccucagguaggcaguc

SEQ ID NO: 821350 - RNA, 24 nt, Human
ugccucagucucccaaagcacugg

SEQ ID NO: 821351 - RNA, 21 nt, Human
ugccuggaauguucuuuuccu

SEQ ID NO: 821352 - RNA, 24 nt, Human
ugcugggauuacaggcgugagcca

SEQ ID NO: 821353 - RNA, 23 nt, Human
ugcuguugcccaggcuggucucg

SEQ ID NO: 821354 - RNA, 18 nt, Human
uggaauguucuuuuccuc

SEQ ID NO: 821355 - RNA, 22 nt, Human
uggaauguucuuuuccucuuuc

SEQ ID NO: 821356 - RNA, 22 nt, Human
uggaggucuguuuccugggauc

SEQ ID NO: 821357 - RNA, 23 nt, Human
uggagugcaguggcgcgaucucg

SEQ ID NO: 821358 - RNA, 24 nt, Human
uggagugcaguggcgcgaucucgg

SEQ ID NO: 821359 - RNA, 19 nt, Human
uggagugcaguggugugaa

SEQ ID NO: 821360 - RNA, 20 nt, Human
uggagugcaguggugugaac

SEQ ID NO: 821361 - RNA, 28 nt, Human
uggagugcaguggugugaaggcucuagc

SEQ ID NO: 821362 - RNA, 19 nt, Human
uggccagcacagaccuggc

SEQ ID NO: 821363 - RNA, 20 nt, Human
uggccuuaagugauccuccu

SEQ ID NO: 821364 - RNA, 24 nt, Human
uggccuuaagugauccuccugccu

SEQ ID NO: 821365 - RNA, 24 nt, Human
ugggaauacuggugugcaccacca

SEQ ID NO: 821366 - RNA, 18 nt, Human
ugggauuacaggcgugag

SEQ ID NO: 821367 - RNA, 19 nt, Human
ugggauuacaggcgugagc

SEQ ID NO: 821368 - RNA, 22 nt, Human
ugggauuacaggcgugagccac

SEQ ID NO: 821369 - RNA, 23 nt, Human
ugggauuacaggcgugagccacc

SEQ ID NO: 821370 - RNA, 24 nt, Human
ugggauuacaggcgugagccacca

SEQ ID NO: 821371 - RNA, 18 nt, Human
ugggauugcaagcgugag

SEQ ID NO: 821372 - RNA, 19 nt, Human
ugggauugcaagcgugagc

SEQ ID NO: 821373 - RNA, 21 nt, Human
ugggauugcaagcgugagcca

SEQ ID NO: 821374 - RNA, 23 nt, Human
ugggauugcaagcgugagccacc

SEQ ID NO: 821375 - RNA, 24 nt, Human
ugggauugcaagcgugagccaccg

SEQ ID NO: 821376 - RNA, 24 nt, Human
uggucuccaaauacaccaagagcu

SEQ ID NO: 821377 - RNA, 19 nt, Human
uguagagaugaggucuugc

SEQ ID NO: 821378 - RNA, 21 nt, Human
uguauuuuuaguagagacggg

SEQ ID NO: 821379 - RNA, 19 nt, Human
ugugaacacagcucacugc

SEQ ID NO: 821380 - RNA, 23 nt, Human
ugugaacacagcucacugcagcc

SEQ ID NO: 821381 - RNA, 26 nt, Human
ugugcaugccuccuguggggagcccu

SEQ ID NO: 821382 - RNA, 19 nt, Human
ugugcguuucuccuaccag

SEQ ID NO: 821383 - RNA, 18 nt, Human
uguggggaaggcagugcc

SEQ ID NO: 821384 - RNA, 22 nt, Human
uguugcccaggcuggucucgaa

SEQ ID NO: 821385 - RNA, 20 nt, Human
uuaaguuuuguagagaugag

SEQ ID NO: 821386 - RNA, 18 nt, Human
uuaguagagacgggguuu

SEQ ID NO: 821387 - RNA, 22 nt, Human
uuaguagagacgggguuucacc

SEQ ID NO: 821388 - RNA, 24 nt, Human
uuaguagagacgggguuucaccgu

SEQ ID NO: 821389 - RNA, 20 nt, Human
uucacugccagauuccuacu

SEQ ID NO: 821390 - RNA, 24 nt, Human
uugcacuguugcccagacuggagu

SEQ ID NO: 821391 - RNA, 24 nt, Human
uugcccagacuggagugcaguggu

SEQ ID NO: 821392 - RNA, 23 nt, Human
uugcuguugcccaggcuggucuc

SEQ ID NO: 821393 - RNA, 19 nt, Human
uuguagagaugaggucuug

SEQ ID NO: 821394 - RNA, 23 nt, Human
uuguauuuuuaguagagacgggg

SEQ ID NO: 821395 - RNA, 19 nt, Human
uuucaccguguuagccagg

SEQ ID NO: 821396 - RNA, 21 nt, Human
uuucucuuaucuccugcagcc

SEQ ID NO: 821397 - RNA, 20 nt, Human
uuuguagagaugaggucuug

SEQ ID NO: 821398 - RNA, 18 nt, Human
uuugucagaggagguccu

SEQ ID NO: 821399 - RNA, 24 nt, Human
uuuuuaguagagacgggguuucac

SEQ ID NO: 821400 - RNA, 21 nt, Human
uuuuuguauuuuuaguagaga

SEQ ID NO: 821401 - RNA, 24 nt, Human
uuuuuuguauuuuuaguagagacg

SEQ ID NO: 821402 - RNA, 20 nt, Human
aacuggaacuggaucccaca

SEQ ID NO: 821403 - RNA, 19 nt, Human
acccaggcccccugccucc

SEQ ID NO: 821404 - RNA, 22 nt, Human
agaaaguccaggagucuggaac

SEQ ID NO: 821405 - RNA, 22 nt, Human
agaaccgggggcuggcucucca

SEQ ID NO: 821406 - RNA, 19 nt, Human
aggaaggcuggcuuggaag

SEQ ID NO: 821407 - RNA, 21 nt, Human
agugcaucuucuagaauguug

SEQ ID NO: 821408 - RNA, 22 nt, Human
cacagagaacaaggauucucac

SEQ ID NO: 821409 - RNA, 24 nt, Human
cacauuccaggguugggacugucu

SEQ ID NO: 821410 - RNA, 19 nt, Human
cagagaaaguccaggaguc

SEQ ID NO: 821411 - RNA, 20 nt, Human
cagagccagagaaaguccag

SEQ ID NO: 821412 - RNA, 26 nt, Human
cagguuguuguagaacuggaacugga

SEQ ID NO: 821413 - RNA, 19 nt, Human
caguaccugagagggucac

SEQ ID NO: 821414 - RNA, 21 nt, Human
caucugaauugguuaacccag

SEQ ID NO: 821415 - RNA, 22 nt, Human
ccacacuuccacacuucaaccu

SEQ ID NO: 821416 - RNA, 18 nt, Human
ccacaggcgccgcaggug

SEQ ID NO: 821417 - RNA, 18 nt, Human
ccagcaguuuccaccucu

SEQ ID NO: 821418 - RNA, 23 nt, Human
ccagcccacuguguaggucaccc

SEQ ID NO: 821419 - RNA, 24 nt, Human
ccagccggcagagugaguggccuc

SEQ ID NO: 821420 - RNA, 23 nt, Human
cccccugccucccucaccugaaa

SEQ ID NO: 821421 - RNA, 19 nt, Human
ccccugccucccucaccug

SEQ ID NO: 821422 - RNA, 19 nt, Human
cccucccagccggcagagu

SEQ ID NO: 821423 - RNA, 23 nt, Human
ccgguggcucccacccgggggca

SEQ ID NO: 821424 - RNA, 21 nt, Human
ccugccucccucaccugaaaa

SEQ ID NO: 821425 - RNA, 19 nt, Human
cggggcugggggugaggca

SEQ ID NO: 821426 - RNA, 24 nt, Human
cucagagccagagaaaguccagga

SEQ ID NO: 821427 - RNA, 19 nt, Human
cuggagucacugagaaccg

SEQ ID NO: 821428 - RNA, 23 nt, Human
cuggaucauccgguggcucccac

SEQ ID NO: 821429 - RNA, 21 nt, Human
cugggggugaggcagaggggc

SEQ ID NO: 821430 - RNA, 21 nt, Human
gaaccuggccacacuuccacc

SEQ ID NO: 821431 - RNA, 19 nt, Human
gaaccuucugucagcucac

SEQ ID NO: 821432 - RNA, 27 nt, Human
gauucucacuuaacucagagccagaga

SEQ ID NO: 821433 - RNA, 22 nt, Human
gcaguaccugagagggucacgc

SEQ ID NO: 821434 - RNA, 18 nt, Human
gccagccccugaaccugg

SEQ ID NO: 821435 - RNA, 26 nt, Human
ggacaccugacgcuuuaauugaaaua

SEQ ID NO: 821436 - RNA, 21 nt, Human
ggagagcaucaguuggccucc

SEQ ID NO: 821437 - RNA, 24 nt, Human
ggaugcugucuggggaacccugca

SEQ ID NO: 821438 - RNA, 25 nt, Human
ggccagccccugaaccuggccacac

SEQ ID NO: 821439 - RNA, 21 nt, Human
gggcaaggggcucuguggugc

SEQ ID NO: 821440 - RNA, 23 nt, Human
gggccaccagccccacauuccag

SEQ ID NO: 821441 - RNA, 20 nt, Human
gggggugaggcagaggggcc

SEQ ID NO: 821442 - RNA, 20 nt, Human
ggggugcgguguaagagggu

SEQ ID NO: 821443 - RNA, 19 nt, Human
guguaggucacccauaacc

SEQ ID NO: 821444 - RNA, 19 nt, Human
uagucccuccaagguuuua

SEQ ID NO: 821445 - RNA, 23 nt, Human
uaucuggaggccaccaaccagcc

SEQ ID NO: 821446 - RNA, 22 nt, Human
ucagagccagagaaaguccagg

SEQ ID NO: 821447 - RNA, 23 nt, Human
ucaguuggccuccuucacccucc

SEQ ID NO: 821448 - RNA, 18 nt, Human
ucccacaggcgccgcagg

SEQ ID NO: 821449 - RNA, 22 nt, Human
uccccgacugguucgucugggu

SEQ ID NO: 821450 - RNA, 23 nt, Human
uccccgacugguucgucuggguc

SEQ ID NO: 821451 - RNA, 21 nt, Human
uccguagaagcuggagucacu

SEQ ID NO: 821452 - RNA, 28 nt, Human
ucgcuggaguucugcgaacugcuguucg

SEQ ID NO: 821453 - RNA, 25 nt, Human
ucucuggacugacuggcucuuaggg

SEQ ID NO: 821454 - RNA, 27 nt, Human
ugaacccuuagcagugguggccagccc

SEQ ID NO: 821455 - RNA, 22 nt, Human
ugcaucaccauuacccaggccc

SEQ ID NO: 821456 - RNA, 23 nt, Human
ugccacgaagcguggagaugggg

SEQ ID NO: 821457 - RNA, 22 nt, Human
ugccggggcugggggugaggca

SEQ ID NO: 821458 - RNA, 20 nt, Human
ugccuugcucgccggagauc

SEQ ID NO: 821459 - RNA, 25 nt, Human
ugccuugugggcacugacugggaac

SEQ ID NO: 821460 - RNA, 25 nt, Human
uggagugcggaacgucuggguuugg

SEQ ID NO: 821461 - RNA, 21 nt, Human
uggaugugaacacucagagcc

SEQ ID NO: 821462 - RNA, 23 nt, Human
uggccucucgggccaccagcccc

SEQ ID NO: 821463 - RNA, 18 nt, Human
ugguuucuaagcuccuuu

SEQ ID NO: 821464 - RNA, 22 nt, Human
ugguuucuaagcuccuuuuccu

SEQ ID NO: 821465 - RNA, 21 nt, Human
ugucuggaucauccgguggcu

SEQ ID NO: 821466 - RNA, 23 nt, Human
ugucuggaucauccgguggcucc

SEQ ID NO: 821467 - RNA, 20 nt, Human
uuaacccaggcccaagugca

SEQ ID NO: 821468 - RNA, 22 nt, Human
uuaguuaucuggaggccaccaa

SEQ ID NO: 821469 - RNA, 18 nt, Human
uugcucucaugggacacc

SEQ ID NO: 821470 - RNA, 24 nt, Human
uuggagugcggaacgucuggguuu

SEQ ID NO: 821471 - RNA, 24 nt, Human
aaagugcugggauuacagguguga

SEQ ID NO: 821472 - RNA, 19 nt, Human
aagcaaaguccaacauaca

SEQ ID NO: 821473 - RNA, 18 nt, Human
aagugcugggauuacagg

SEQ ID NO: 821474 - RNA, 19 nt, Human
aagugcugggauuacaggu

SEQ ID NO: 821475 - RNA, 19 nt, Human
aaguguccaacccauaggu

SEQ ID NO: 821476 - RNA, 24 nt, Human
aaugcaguagugugaucucagcuc

SEQ ID NO: 821477 - RNA, 23 nt, Human
acaagggaagaacaucgacuaaa

SEQ ID NO: 821478 - RNA, 22 nt, Human
acaagggaggagcugcgcugga

SEQ ID NO: 821479 - RNA, 24 nt, Human
accauguuguccaggcuggucuug

SEQ ID NO: 821480 - RNA, 20 nt, Human
acuggaagggcuucucucca

SEQ ID NO: 821481 - RNA, 23 nt, Human
acuggcauauguuagcugaaagu

SEQ ID NO: 821482 - RNA, 19 nt, Human
acugugugugaccucgugu

SEQ ID NO: 821483 - RNA, 20 nt, Human
agaaaagcauuauacaacua

SEQ ID NO: 821484 - RNA, 20 nt, Human
agagaugggguuucaccaug

SEQ ID NO: 821485 - RNA, 19 nt, Human
agauaauagaagcacagcc

SEQ ID NO: 821486 - RNA, 19 nt, Human
aggagcugcgcuggaaggc

SEQ ID NO: 821487 - RNA, 18 nt, Human
aggcaaugaauccugcua

SEQ ID NO: 821488 - RNA, 22 nt, Human
aggccauggggccccaaaucca

SEQ ID NO: 821489 - RNA, 22 nt, Human
agggaagaacaucgacuaaagg

SEQ ID NO: 821490 - RNA, 23 nt, Human
agggaugugccaugccuaaagga

SEQ ID NO: 821491 - RNA, 24 nt, Human
aguagugugaucucagcucacugc

SEQ ID NO: 821492 - RNA, 19 nt, Human
auacaggcauaucaucccc

SEQ ID NO: 821493 - RNA, 23 nt, Human
auauuuagggcugggaaaauuua

SEQ ID NO: 821494 - RNA, 19 nt, Human
augggguuucaccauguug

SEQ ID NO: 821495 - RNA, 20 nt, Human
augggguuucaccauguugu

SEQ ID NO: 821496 - RNA, 22 nt, Human
augugugugugucuugcucugu

SEQ ID NO: 821497 - RNA, 24 nt, Human
augugugugugucuugcucuguug

SEQ ID NO: 821498 - RNA, 24 nt, Human
auuuuuuuuuuuuuuuaaagagau

SEQ ID NO: 821499 - RNA, 19 nt, Human
caaaagguuucucuccagu

SEQ ID NO: 821500 - RNA, 27 nt, Human
caaaagguuucucuccaguaugagucc

SEQ ID NO: 821501 - RNA, 24 nt, Human
caaagugcugggauuacaggugug

SEQ ID NO: 821502 - RNA, 19 nt, Human
caacaaagguucuggaagu

SEQ ID NO: 821503 - RNA, 21 nt, Human
caacacaccaacaaagguucu

SEQ ID NO: 821504 - RNA, 20 nt, Human
caaugucaacacaccaacaa

SEQ ID NO: 821505 - RNA, 18 nt, Human
cacaauuuuuucccugca

SEQ ID NO: 821506 - RNA, 20 nt, Human
cacacaacguauaaacacac

SEQ ID NO: 821507 - RNA, 20 nt, Human
cacacacaacguauaaacac

SEQ ID NO: 821508 - RNA, 24 nt, Human
caccauguuguccaggcuggucuu

SEQ ID NO: 821509 - RNA, 27 nt, Human
caccauguuguccaggcuggucuugaa

SEQ ID NO: 821510 - RNA, 24 nt, Human
caccucagccuccugaguagcugg

SEQ ID NO: 821511 - RNA, 22 nt, Human
cacugcagucucugcucccggg

SEQ ID NO: 821512 - RNA, 19 nt, Human
cagcccccaugcacaauuu

SEQ ID NO: 821513 - RNA, 20 nt, Human
cagccuccugaguagcuggg

SEQ ID NO: 821514 - RNA, 23 nt, Human
caggauaaauuccuugaucuguu

SEQ ID NO: 821515 - RNA, 22 nt, Human
caggccacugaagcuuagcuga

SEQ ID NO: 821516 - RNA, 26 nt, Human
cagugauccucccaccucagccuccu

SEQ ID NO: 821517 - RNA, 19 nt, Human
cagugugaauucucugaug

SEQ ID NO: 821518 - RNA, 23 nt, Human
caguuuucuccacacacaacgua

SEQ ID NO: 821519 - RNA, 21 nt, Human
cauggucaaugucaacacacc

SEQ ID NO: 821520 - RNA, 20 nt, Human
caugguguuucuuuccagga

SEQ ID NO: 821521 - RNA, 20 nt, Human
cauguuguccaggcuggucu

SEQ ID NO: 821522 - RNA, 24 nt, Human
cauguuguccaggcuggucuugaa

SEQ ID NO: 821523 - RNA, 23 nt, Human
ccaaaaauaaccuuuucacuggc

SEQ ID NO: 821524 - RNA, 21 nt, Human
ccaaagugcugggauuacagg

SEQ ID NO: 821525 - RNA, 21 nt, Human
ccaaagugcugggauuacagg

SEQ ID NO: 821526 - RNA, 24 nt, Human
ccaaagugcugggauuacaggugu

SEQ ID NO: 821527 - RNA, 23 nt, Human
ccaccucagccuccugaguagcu

SEQ ID NO: 821528 - RNA, 24 nt, Human
ccacugcaugccaccaugcccagc

SEQ ID NO: 821529 - RNA, 24 nt, Human
ccaggcuggucuugaacuccuggg

SEQ ID NO: 821530 - RNA, 19 nt, Human
ccagugugaauucucugau

SEQ ID NO: 821531 - RNA, 22 nt, Human
cccaaagugcugggauuacagg

SEQ ID NO: 821532 - RNA, 23 nt, Human
cccaccucagccuccugaguagc

SEQ ID NO: 821533 - RNA, 22 nt, Human
cccauaggugcccauuaaaugu

SEQ ID NO: 821534 - RNA, 22 nt, Human
cccggguuccagugauccuccc

SEQ ID NO: 821535 - RNA, 23 nt, Human
cccggguuccagugauccuccca

SEQ ID NO: 821536 - RNA, 24 nt, Human
ccucccaccucagccuccugagua

SEQ ID NO: 821537 - RNA, 24 nt, Human
ccucugauccugaaucagaacauu

SEQ ID NO: 821538 - RNA, 27 nt, Human
ccugaaucagaacauuuuagcuaaagc

SEQ ID NO: 821539 - RNA, 23 nt, Human
ccugaguagcugggacuaccacu

SEQ ID NO: 821540 - RNA, 23 nt, Human
ccuggguucaagcagucuaucug

SEQ ID NO: 821541 - RNA, 25 nt, Human
ccuuacacuggaagggcuucucucc

SEQ ID NO: 821542 - RNA, 21 nt, Human
ccuuauaggcuguaucauacu

SEQ ID NO: 821543 - RNA, 20 nt, Human
cgcuggaaggcuuucccaca

SEQ ID NO: 821544 - RNA, 26 nt, Human
cguauaaacacacacguaauucauua

SEQ ID NO: 821545 - RNA, 23 nt, Human
cucacugcagucucugcucccgg

SEQ ID NO: 821546 - RNA, 24 nt, Human
cucacugcagucucugcucccggg

SEQ ID NO: 821547 - RNA, 24 nt, Human
cucagccuccugaguagcugggac

SEQ ID NO: 821548 - RNA, 19 nt, Human
cuccuggguucaagcaguc

SEQ ID NO: 821549 - RNA, 23 nt, Human
cugaagcuuagcugaugcuuuac

SEQ ID NO: 821550 - RNA, 21 nt, Human
cugcuauguggcaugcaaaga

SEQ ID NO: 821551 - RNA, 28 nt, Human
cugcucccggguuccagugauccucccu

SEQ ID NO: 821552 - RNA, 19 nt, Human
cuggucuugaacuccuggg

SEQ ID NO: 821553 - RNA, 21 nt, Human
cuguacaaugaagugguuggg

SEQ ID NO: 821554 - RNA, 22 nt, Human
gaaggcuuucccacagagacua

SEQ ID NO: 821555 - RNA, 18 nt, Human
gagaugggguuucaccau

SEQ ID NO: 821556 - RNA, 23 nt, Human
gagaugggguuucaccauguugu

SEQ ID NO: 821557 - RNA, 26 nt, Human
gaguagcugggacuaccacugcaugc

SEQ ID NO: 821558 - RNA, 22 nt, Human
gaugggguuucaccauguuguc

SEQ ID NO: 821559 - RNA, 18 nt, Human
gauuacaggugugagaca

SEQ ID NO: 821560 - RNA, 24 nt, Human
gauuacaggugugagacaccauac

SEQ ID NO: 821561 - RNA, 20 nt, Human
gcucaggcuggaaugcagua

SEQ ID NO: 821562 - RNA, 21 nt, Human
gcuucucuccacuguguguga

SEQ ID NO: 821563 - RNA, 18 nt, Human
ggcuggucuugaacuccu

SEQ ID NO: 821564 - RNA, 22 nt, Human
gggguuucaccauguuguccag

SEQ ID NO: 821565 - RNA, 23 nt, Human
gggguuucaccauguuguccagg

SEQ ID NO: 821566 - RNA, 22 nt, Human
ggguuucaccauguuguccagg

SEQ ID NO: 821567 - RNA, 22 nt, Human
gucagcaucucagaagggcaga

SEQ ID NO: 821568 - RNA, 21 nt, Human
guccaguugugcccaaauugg

SEQ ID NO: 821569 - RNA, 23 nt, Human
gucucacauucacuaggccuuau

SEQ ID NO: 821570 - RNA, 23 nt, Human
gugauccucccaccucagccucc

SEQ ID NO: 821571 - RNA, 23 nt, Human
guuucaccauguuguccaggcug

SEQ ID NO: 821572 - RNA, 24 nt, Human
guuucaccauguuguccaggcugg

SEQ ID NO: 821573 - RNA, 25 nt, Human
uaaaaaguacaauaaggggacuuaa

SEQ ID NO: 821574 - RNA, 26 nt, Human
uaagaauucucaaaguguccaaccca

SEQ ID NO: 821575 - RNA, 22 nt, Human
uacaaggcaaaauuuauggcaa

SEQ ID NO: 821576 - RNA, 19 nt, Human
uacauguagcuguuuuuac

SEQ ID NO: 821577 - RNA, 19 nt, Human
uagcugggacuaccacugc

SEQ ID NO: 821578 - RNA, 24 nt, Human
uagugugaucucagcucacugcag

SEQ ID NO: 821579 - RNA, 24 nt, Human
uaucacacuuauaggguuucuuuu

SEQ ID NO: 821580 - RNA, 23 nt, Human
uauccugcauacauauauucaaa

SEQ ID NO: 821581 - RNA, 21 nt, Human
uauggcaaugggcaauuagac

SEQ ID NO: 821582 - RNA, 26 nt, Human
ucaaaagcaaaguccaacauacaggc

SEQ ID NO: 821583 - RNA, 19 nt, Human
ucaaacuauguaucagaua

SEQ ID NO: 821584 - RNA, 23 nt, Human
ucacugcagucucugcucccggg

SEQ ID NO: 821585 - RNA, 21 nt, Human
ucacuggcaaggccauggggc

SEQ ID NO: 821586 - RNA, 23 nt, Human
ucagccuccugaguagcugggac

SEQ ID NO: 821587 - RNA, 21 nt, Human
ucagucuucaucuguacaaug

SEQ ID NO: 821588 - RNA, 21 nt, Human
ucagucuucaucuguacaaug

SEQ ID NO: 821589 - RNA, 28 nt, Human
uccaacauacaggcauaucauccccaac

SEQ ID NO: 821590 - RNA, 21 nt, Human
uccagagaaagguuuucccac

SEQ ID NO: 821591 - RNA, 18 nt, Human
uccaugaugagagaaagg

SEQ ID NO: 821592 - RNA, 19 nt, Human
ucccacagagacuacacug

SEQ ID NO: 821593 - RNA, 21 nt, Human
ucccggguuccagugauccuc

SEQ ID NO: 821594 - RNA, 18 nt, Human
ucccugcaaagaaugaag

SEQ ID NO: 821595 - RNA, 18 nt, Human
uccugaguagcugggacu

SEQ ID NO: 821596 - RNA, 22 nt, Human
uccugaguagcugggacuacca

SEQ ID NO: 821597 - RNA, 20 nt, Human
uccuggaguuggaacugguu

SEQ ID NO: 821598 - RNA, 24 nt, Human
uccuggguucaagcagucuaucug

SEQ ID NO: 821599 - RNA, 21 nt, Human
ucuaagaauccucugauccuu

SEQ ID NO: 821600 - RNA, 21 nt, Human
ucucuaagaauccucugaucc

SEQ ID NO: 821601 - RNA, 19 nt, Human
ucugaguccaaaaauaacc

SEQ ID NO: 821602 - RNA, 22 nt, Human
ucugauacuguaggcuuaagaa

SEQ ID NO: 821603 - RNA, 23 nt, Human
ucugcauuaugucccaaauugcu

SEQ ID NO: 821604 - RNA, 24 nt, Human
ucuguugcucaggcuggaaugcag

SEQ ID NO: 821605 - RNA, 24 nt, Human
ucuugaacuccuggguucaagcag

SEQ ID NO: 821606 - RNA, 19 nt, Human
ucuugcucuguugcucagg

SEQ ID NO: 821607 - RNA, 20 nt, Human
ucuugcucuguugcucaggc

SEQ ID NO: 821608 - RNA, 23 nt, Human
ucuugcucuguugcucaggcugg

SEQ ID NO: 821609 - RNA, 24 nt, Human
ucuugcucuguugcucaggcugga

SEQ ID NO: 821610 - RNA, 22 nt, Human
ucuuuggcuuucagucuucauc

SEQ ID NO: 821611 - RNA, 18 nt, Human
ugaagcuuagcugaugcu

SEQ ID NO: 821612 - RNA, 24 nt, Human
ugaauaaaggcuuuucuacauuua

SEQ ID NO: 821613 - RNA, 26 nt, Human
ugaccaaaagcccucccacauaugcu

SEQ ID NO: 821614 - RNA, 20 nt, Human
ugagacaccauaccuagccc

SEQ ID NO: 821615 - RNA, 21 nt, Human
ugagcauucucaugcugacca

SEQ ID NO: 821616 - RNA, 22 nt, Human
ugaguacaaggcaaaauuuaug

SEQ ID NO: 821617 - RNA, 23 nt, Human
ugaguacaaggcaaaauuuaugg

SEQ ID NO: 821618 - RNA, 21 nt, Human
ugagugcaguugucaagcaau

SEQ ID NO: 821619 - RNA, 20 nt, Human
ugauauccugcauacauaua

SEQ ID NO: 821620 - RNA, 21 nt, Human
ugaugagagaaaggcaaugaa

SEQ ID NO: 821621 - RNA, 24 nt, Human
ugcauucaaaggguuucuccccag

SEQ ID NO: 821622 - RNA, 23 nt, Human
ugccaugccuaaaggaccuccca

SEQ ID NO: 821623 - RNA, 23 nt, Human
ugcgcuggaaggcuuucccacag

SEQ ID NO: 821624 - RNA, 22 nt, Human
ugcugggauuacaggugugaga

SEQ ID NO: 821625 - RNA, 24 nt, Human
ugcugggauuacaggugugagaca

SEQ ID NO: 821626 - RNA, 18 nt, Human
uggaaaccacuucacauc

SEQ ID NO: 821627 - RNA, 19 nt, Human
uggaaugcaguagugugau

SEQ ID NO: 821628 - RNA, 23 nt, Human
uggaaugcaguagugugaucuca

SEQ ID NO: 821629 - RNA, 24 nt, Human
uggaaugcaguagugugaucucag

SEQ ID NO: 821630 - RNA, 24 nt, Human
ugggacuaccacugcaugccacca

SEQ ID NO: 821631 - RNA, 18 nt, Human
ugggauuacaggugugag

SEQ ID NO: 821632 - RNA, 22 nt, Human
ugggauuacaggugugagacac

SEQ ID NO: 821633 - RNA, 23 nt, Human
ugggauuacaggugugagacacc

SEQ ID NO: 821634 - RNA, 24 nt, Human
ugggauuacaggugugagacacca

SEQ ID NO: 821635 - RNA, 25 nt, Human
ugggauuacaggugugagacaccau

SEQ ID NO: 821636 - RNA, 24 nt, Human
ugggguuucaccauguuguccagg

SEQ ID NO: 821637 - RNA, 20 nt, Human
ugguguugaacaagggagga

SEQ ID NO: 821638 - RNA, 18 nt, Human
ugguugggcuaguugauc

SEQ ID NO: 821639 - RNA, 20 nt, Human
uguaaaaggaaucaaugucc

SEQ ID NO: 821640 - RNA, 24 nt, Human
uguccaggcuggucuugaacuccu

SEQ ID NO: 821641 - RNA, 22 nt, Human
ugucuugcucuguugcucaggc

SEQ ID NO: 821642 - RNA, 25 nt, Human
ugucuugcucuguugcucaggcugg

SEQ ID NO: 821643 - RNA, 18 nt, Human
ugugcccaaauuggucug

SEQ ID NO: 821644 - RNA, 22 nt, Human
ugugucuugcucuguugcucag

SEQ ID NO: 821645 - RNA, 23 nt, Human
uuaaagagaugggguuucaccau

SEQ ID NO: 821646 - RNA, 24 nt, Human
uuaaagagaugggguuucaccaug

SEQ ID NO: 821647 - RNA, 21 nt, Human
uuaacccagcuuuacccuuau

SEQ ID NO: 821648 - RNA, 20 nt, Human
uuacaggugugagacaccau

SEQ ID NO: 821649 - RNA, 23 nt, Human
uuauaggcuguaucauacugugg

SEQ ID NO: 821650 - RNA, 21 nt, Human
uuccacauacauugcauucaa

SEQ ID NO: 821651 - RNA, 24 nt, Human
uuccagugauccucccaccucagc

SEQ ID NO: 821652 - RNA, 19 nt, Human
uuccugacaggcauccuag

SEQ ID NO: 821653 - RNA, 22 nt, Human
uuccuggaguuggaacugguuu

SEQ ID NO: 821654 - RNA, 24 nt, Human
uucuacauuuaucacacuuauagg

SEQ ID NO: 821655 - RNA, 20 nt, Human
uucuggaaguuccuuuagga

SEQ ID NO: 821656 - RNA, 19 nt, Human
uucugugaaacuggcauau

SEQ ID NO: 821657 - RNA, 24 nt, Human
uuuaaagagaugggguuucaccau

SEQ ID NO: 821658 - RNA, 23 nt, Human
uuucaccauguuguccaggcugg

SEQ ID NO: 821659 - RNA, 24 nt, Human
uuucaccauguuguccaggcuggu

SEQ ID NO: 821660 - RNA, 21 nt, Human
uuucccacagagacuacacug

SEQ ID NO: 821661 - RNA, 23 nt, Human
uuuguaagccuccaagaaguugc

SEQ ID NO: 821662 - RNA, 23 nt, Human
uuuuuaaagagaugggguuucac

SEQ ID NO: 821663 - RNA, 30 nt, Human
uuuuuuuuuuuuaaagagaugggguuucaa

SEQ ID NO: 821664 - RNA, 23 nt, Human
aaaccuccagguuggccacuccu

SEQ ID NO: 821665 - RNA, 26 nt, Human
aaaugggacugugguaacaucaccuc

SEQ ID NO: 821666 - RNA, 24 nt, Human
aaucgcuugaacccuggaggugga

SEQ ID NO: 821667 - RNA, 23 nt, Human
acaggccagggguucagaaaccu

SEQ ID NO: 821668 - RNA, 22 nt, Human
acccuccgccuagcucaaaaca

SEQ ID NO: 821669 - RNA, 19 nt, Human
acccucugaucaagaagau

SEQ ID NO: 821670 - RNA, 22 nt, Human
acuccagccugggcagacagac

SEQ ID NO: 821671 - RNA, 20 nt, Human
acucugauccuccuuccucc

SEQ ID NO: 821672 - RNA, 23 nt, Human
agacagacggacauucaauuccu

SEQ ID NO: 821673 - RNA, 24 nt, Human
agagagaacaugcagaucauaauc

SEQ ID NO: 821674 - RNA, 18 nt, Human
aggagcggcaggcuggac

SEQ ID NO: 821675 - RNA, 18 nt, Human
aggaguuuaaacucugau

SEQ ID NO: 821676 - RNA, 23 nt, Human
aggcaggagaaucgcuugaaccc

SEQ ID NO: 821677 - RNA, 20 nt, Human
aggcugaggcaggagaaucg

SEQ ID NO: 821678 - RNA, 24 nt, Human
aggcugaggcaggagaaucgcuug

SEQ ID NO: 821679 - RNA, 20 nt, Human
agguggaggcugcagugagc

SEQ ID NO: 821680 - RNA, 24 nt, Human
agguggaggcugcagugagcugag

SEQ ID NO: 821681 - RNA, 24 nt, Human
agucccuguacaugacgagauggg

SEQ ID NO: 821682 - RNA, 21 nt, Human
auaaaacaagacuucugcaua

SEQ ID NO: 821683 - RNA, 24 nt, Human
augcauacaguuuaccaaauauga

SEQ ID NO: 821684 - RNA, 19 nt, Human
auggcuccgucauaaggca

SEQ ID NO: 821685 - RNA, 24 nt, Human
caaaacacuggaauuaaaggcaug

SEQ ID NO: 821686 - RNA, 25 nt, Human
caagaaauucuccaagagggaguua

SEQ ID NO: 821687 - RNA, 23 nt, Human
caauuccucuggccaacgaaaga

SEQ ID NO: 821688 - RNA, 25 nt, Human
cacagugaacaccugccucguggcc

SEQ ID NO: 821689 - RNA, 20 nt, Human
cacccuccgccuagcucaaa

SEQ ID NO: 821690 - RNA, 20 nt, Human
cacccuccgccuagcucaaa

SEQ ID NO: 821691 - RNA, 22 nt, Human
caguaagaacccucugaucaag

SEQ ID NO: 821692 - RNA, 24 nt, Human
caguucauauuuauaaucuugggc

SEQ ID NO: 821693 - RNA, 19 nt, Human
cauauuuauaaucuugggc

SEQ ID NO: 821694 - RNA, 19 nt, Human
cauucaauuccucuggcca

SEQ ID NO: 821695 - RNA, 18 nt, Human
ccagauaaccgacaucau

SEQ ID NO: 821696 - RNA, 19 nt, Human
ccaugacuuccacgguggc

SEQ ID NO: 821697 - RNA, 22 nt, Human
cccaaagagagaacaugcagau

SEQ ID NO: 821698 - RNA, 18 nt, Human
cccucuugccuccccacc

SEQ ID NO: 821699 - RNA, 20 nt, Human
cccucuugccuccccaccga

SEQ ID NO: 821700 - RNA, 26 nt, Human
ccuccagguuggccacuccuggauuu

SEQ ID NO: 821701 - RNA, 19 nt, Human
ccuccuuccuccucccuca

SEQ ID NO: 821702 - RNA, 21 nt, Human
ccuccuuccuccucccucaaa

SEQ ID NO: 821703 - RNA, 21 nt, Human
ccucgccgcccucuugccucc

SEQ ID NO: 821704 - RNA, 18 nt, Human
ccuguacguguacagugu

SEQ ID NO: 821705 - RNA, 18 nt, Human
cuccagguuggccacucc

SEQ ID NO: 821706 - RNA, 21 nt, Human
cuccgucauaaggcaucuccu

SEQ ID NO: 821707 - RNA, 21 nt, Human
cugcagugagcugagaucgug

SEQ ID NO: 821708 - RNA, 22 nt, Human
cugcagugagcugagaucgugc

SEQ ID NO: 821709 - RNA, 19 nt, Human
cugcagugggagcucuucu

SEQ ID NO: 821710 - RNA, 20 nt, Human
cuucuuagaccacaggguca

SEQ ID NO: 821711 - RNA, 23 nt, Human
gaggcugcagugagcugagaucg

SEQ ID NO: 821712 - RNA, 25 nt, Human
gaguuaccaauucaacacauauuua

SEQ ID NO: 821713 - RNA, 19 nt, Human
gauacagggcaguccagga

SEQ ID NO: 821714 - RNA, 22 nt, Human
gcaaagggaaaugcccuugaga

SEQ ID NO: 821715 - RNA, 23 nt, Human
gcuuuuauuaaccucuuuguuag

SEQ ID NO: 821716 - RNA, 18 nt, Human
ggacuuagauacagggca

SEQ ID NO: 821717 - RNA, 18 nt, Human
ggaggcugcagugagcug

SEQ ID NO: 821718 - RNA, 24 nt, Human
ggaggcugcagugagcugagaucg

SEQ ID NO: 821719 - RNA, 24 nt, Human
gggaacccggcagggugaaaaaug

SEQ ID NO: 821720 - RNA, 18 nt, Human
uaaggcaucuccuccagu

SEQ ID NO: 821721 - RNA, 19 nt, Human
uacugcugucagauauauc

SEQ ID NO: 821722 - RNA, 21 nt, Human
uagcucaaaacaaagggccuc

SEQ ID NO: 821723 - RNA, 21 nt, Human
uagcucaaaacaaagggccuc

SEQ ID NO: 821724 - RNA, 21 nt, Human
ucaacacauauuuacccauga

SEQ ID NO: 821725 - RNA, 18 nt, Human
ucaccuccucgccgcccu

SEQ ID NO: 821726 - RNA, 19 nt, Human
ucacuuaucacccuccgcc

SEQ ID NO: 821727 - RNA, 20 nt, Human
uccuccuuccuccucccuca

SEQ ID NO: 821728 - RNA, 25 nt, Human
uccucuggccaacgaaagacaacca

SEQ ID NO: 821729 - RNA, 20 nt, Human
uccugauccaguaagaaccc

SEQ ID NO: 821730 - RNA, 19 nt, Human
ucgagaagagaggggaggg

SEQ ID NO: 821731 - RNA, 22 nt, Human
ucgcuugaacccuggaggugga

SEQ ID NO: 821732 - RNA, 24 nt, Human
ucgcuugaacccuggagguggagg

SEQ ID NO: 821733 - RNA, 22 nt, Human
ucgugccacuccagccugggca

SEQ ID NO: 821734 - RNA, 20 nt, Human
ucuccaagagggaguuacca

SEQ ID NO: 821735 - RNA, 22 nt, Human
ucugauccuccuuccuccuccc

SEQ ID NO: 821736 - RNA, 22 nt, Human
ucugcagugggagcucuucucc

SEQ ID NO: 821737 - RNA, 18 nt, Human
ucuugggcuggaggcaaa

SEQ ID NO: 821738 - RNA, 23 nt, Human
ucuugggcuggaggcaaaugcau

SEQ ID NO: 821739 - RNA, 20 nt, Human
ugaggcaggagaaucgcuug

SEQ ID NO: 821740 - RNA, 24 nt, Human
ugaggcaggagaaucgcuugaacc

SEQ ID NO: 821741 - RNA, 25 nt, Human
ugaggcaggagaaucgcuugaaccc

SEQ ID NO: 821742 - RNA, 18 nt, Human
ugccacuccagccugggc

SEQ ID NO: 821743 - RNA, 18 nt, Human
uggaauuaaaggcaugag

SEQ ID NO: 821744 - RNA, 24 nt, Human
uggaauuaaaggcaugagucccug

SEQ ID NO: 821745 - RNA, 20 nt, Human
uggacaaaaaaaccacuauc

SEQ ID NO: 821746 - RNA, 18 nt, Human
uggaggcugcagugagcu

SEQ ID NO: 821747 - RNA, 23 nt, Human
uggagguggaggcugcagugagc

SEQ ID NO: 821748 - RNA, 19 nt, Human
uggauuucuucguuuggaa

SEQ ID NO: 821749 - RNA, 20 nt, Human
uggccaacgaaagacaacca

SEQ ID NO: 821750 - RNA, 21 nt, Human
ugucacacucauaagguccug

SEQ ID NO: 821751 - RNA, 24 nt, Human
uuaaacucugauccuccuuccucc

SEQ ID NO: 821752 - RNA, 20 nt, Human
uucugcauaaagaauauccc

SEQ ID NO: 821753 - RNA, 22 nt, Human
uugaacccaaagagagaacaug

SEQ ID NO: 821754 - RNA, 23 nt, Human
uugccagauaaccgacaucaugu

SEQ ID NO: 821755 - RNA, 24 nt, Human
aaccuccuucuagaacucugcgug

SEQ ID NO: 821756 - RNA, 19 nt, Human
aagaggcccggacaggggc

SEQ ID NO: 821757 - RNA, 19 nt, Human
aagcagcuccuccacccuc

SEQ ID NO: 821758 - RNA, 19 nt, Human
aagcagcuccuccacccuc

SEQ ID NO: 821759 - RNA, 23 nt, Human
accccugagaaccuccuucuaga

SEQ ID NO: 821760 - RNA, 25 nt, Human
agauaucaaagagugcaggggggcu

SEQ ID NO: 821761 - RNA, 24 nt, Human
agcagaaauggccagacgggccug

SEQ ID NO: 821762 - RNA, 20 nt, Human
agcagcuccuccacccuccc

SEQ ID NO: 821763 - RNA, 19 nt, Human
agcccaagccagcggaccc

SEQ ID NO: 821764 - RNA, 18 nt, Human
agcuccuccacccucccc

SEQ ID NO: 821765 - RNA, 18 nt, Human
aggacggaugggccauag

SEQ ID NO: 821766 - RNA, 23 nt, Human
auagccagguccccccagcugcc

SEQ ID NO: 821767 - RNA, 22 nt, Human
caaaaagccagcggcgacagug

SEQ ID NO: 821768 - RNA, 19 nt, Human
caaaagggcgacggggugg

SEQ ID NO: 821769 - RNA, 21 nt, Human
caaaagggcgacgggguggca

SEQ ID NO: 821770 - RNA, 21 nt, Human
caagaggaacaauguguggca

SEQ ID NO: 821771 - RNA, 24 nt, Human
caccggacgugcagcaggggccca

SEQ ID NO: 821772 - RNA, 27 nt, Human
caccguagccacagccuaaccccuugg

SEQ ID NO: 821773 - RNA, 18 nt, Human
caccucccuguccacggc

SEQ ID NO: 821774 - RNA, 21 nt, Human
cagacacgcaggggucucggc

SEQ ID NO: 821775 - RNA, 18 nt, Human
cagcagaaauggccagac

SEQ ID NO: 821776 - RNA, 19 nt, Human
cagcagccgggagaggcga

SEQ ID NO: 821777 - RNA, 22 nt, Human
cagcaggaaaggccauagccag

SEQ ID NO: 821778 - RNA, 18 nt, Human
cagcggacccgcccgcca

SEQ ID NO: 821779 - RNA, 19 nt, Human
cagcugccuccugggcucc

SEQ ID NO: 821780 - RNA, 18 nt, Human
cagcugcuccuccagucc

SEQ ID NO: 821781 - RNA, 18 nt, Human
caggaaaggccauagcca

SEQ ID NO: 821782 - RNA, 24 nt, Human
cauagccagguccccccagcugcc

SEQ ID NO: 821783 - RNA, 25 nt, Human
caugaaaaauaauacuccagucagc

SEQ ID NO: 821784 - RNA, 27 nt, Human
cauuucugcaucauucugagcuggaaa

SEQ ID NO: 821785 - RNA, 23 nt, Human
ccaccggagccugggaagcuggg

SEQ ID NO: 821786 - RNA, 21 nt, Human
ccagcccagccugagugugag

SEQ ID NO: 821787 - RNA, 24 nt, Human
ccagcggacccgcccgccagcacc

SEQ ID NO: 821788 - RNA, 20 nt, Human
cccagcccaagccagcggac

SEQ ID NO: 821789 - RNA, 21 nt, Human
cccccagcugccuccugggcu

SEQ ID NO: 821790 - RNA, 18 nt, Human
cccccgaggccccucucc

SEQ ID NO: 821791 - RNA, 24 nt, Human
ccccgcccuggccacaugcacgga

SEQ ID NO: 821792 - RNA, 21 nt, Human
ccccuccccggccagccccag

SEQ ID NO: 821793 - RNA, 18 nt, Human
ccccucuccuccuccucc

SEQ ID NO: 821794 - RNA, 19 nt, Human
ccccucuccuccuccuccu

SEQ ID NO: 821795 - RNA, 20 nt, Human
ccccugagaaccuccuucua

SEQ ID NO: 821796 - RNA, 21 nt, Human
cccgccagcacccggugugga

SEQ ID NO: 821797 - RNA, 19 nt, Human
cccggggcuggcgcggggg

SEQ ID NO: 821798 - RNA, 22 nt, Human
cccugggagggggcgucccggg

SEQ ID NO: 821799 - RNA, 20 nt, Human
ccgcgcccacccucgucagg

SEQ ID NO: 821800 - RNA, 20 nt, Human
ccggagccugggaagcuggg

SEQ ID NO: 821801 - RNA, 23 nt, Human
ccggccagccccagcccaagcca

SEQ ID NO: 821802 - RNA, 19 nt, Human
ccucagacacuaagauauc

SEQ ID NO: 821803 - RNA, 18 nt, Human
ccuccacccuccccugga

SEQ ID NO: 821804 - RNA, 21 nt, Human
ccuccccggccagccccagcc

SEQ ID NO: 821805 - RNA, 21 nt, Human
ccuccccuggacaagaggaac

SEQ ID NO: 821806 - RNA, 21 nt, Human
ccucccuguccacggccccgc

SEQ ID NO: 821807 - RNA, 24 nt, Human
ccuccggcgccacagcagaaauug

SEQ ID NO: 821808 - RNA, 21 nt, Human
ccucgccuggccccacucccc

SEQ ID NO: 821809 - RNA, 19 nt, Human
ccucuccuccuccuccucc

SEQ ID NO: 821810 - RNA, 21 nt, Human
ccugggcuccgacccacccac

SEQ ID NO: 821811 - RNA, 22 nt, Human
cgagcggacagcgagcaggucc

SEQ ID NO: 821812 - RNA, 20 nt, Human
cgcagacacgcaggggucuc

SEQ ID NO: 821813 - RNA, 21 nt, Human
cggcgcgcaggcucccggggc

SEQ ID NO: 821814 - RNA, 21 nt, Human
cggcggcggcggcggcagcgc

SEQ ID NO: 821815 - RNA, 22 nt, Human
cgggcagagccugggccuggug

SEQ ID NO: 821816 - RNA, 22 nt, Human
cuccaagacuugucaccucccu

SEQ ID NO: 821817 - RNA, 26 nt, Human
cuccccaaaaucauucaaggacccac

SEQ ID NO: 821818 - RNA, 23 nt, Human
cuccuccccgcggaccucugcca

SEQ ID NO: 821819 - RNA, 20 nt, Human
cuccuccuccuccuccuccu

SEQ ID NO: 821820 - RNA, 21 nt, Human
cugccuccugggcuccgaccc

SEQ ID NO: 821821 - RNA, 22 nt, Human
cugcucccuccgcgcccacccu

SEQ ID NO: 821822 - RNA, 18 nt, Human
cuggggucucccagagcc

SEQ ID NO: 821823 - RNA, 19 nt, Human
gaaacaccuuuauugcacu

SEQ ID NO: 821824 - RNA, 18 nt, Human
gaccucugccaagaccuc

SEQ ID NO: 821825 - RNA, 18 nt, Human
gacgcuggacaaaagggc

SEQ ID NO: 821826 - RNA, 21 nt, Human
gacuugucaccucccugucca

SEQ ID NO: 821827 - RNA, 21 nt, Human
gaggagagaccggggucugcc

SEQ ID NO: 821828 - RNA, 22 nt, Human
gcagccaccuaacagcaggaaa

SEQ ID NO: 821829 - RNA, 20 nt, Human
gcagcggcugcucccuccgc

SEQ ID NO: 821830 - RNA, 18 nt, Human
gcaucucugagcaagacc

SEQ ID NO: 821831 - RNA, 19 nt, Human
gccacagcagaaauggcca

SEQ ID NO: 821832 - RNA, 22 nt, Human
gccagccccagcccaagccagc

SEQ ID NO: 821833 - RNA, 20 nt, Human
gccagccccagcccaagccg

SEQ ID NO: 821834 - RNA, 20 nt, Human
gccgucuccuccccgcggac

SEQ ID NO: 821835 - RNA, 20 nt, Human
gcggcggcggcggcggcagc

SEQ ID NO: 821836 - RNA, 24 nt, Human
gcgggcggcggcggcggcggcagc

SEQ ID NO: 821837 - RNA, 24 nt, Human
gcuacagcaucagcgcccagccca

SEQ ID NO: 821838 - RNA, 19 nt, Human
gcuggcgcgggggacgcgg

SEQ ID NO: 821839 - RNA, 23 nt, Human
ggcccagcugcuccuccaguccu

SEQ ID NO: 821840 - RNA, 21 nt, Human
ggcuggcgcgggggacgcggc

SEQ ID NO: 821841 - RNA, 18 nt, Human
gggcggcggcggcggcgg

SEQ ID NO: 821842 - RNA, 19 nt, Human
gggcggcggcggcggcggc

SEQ ID NO: 821843 - RNA, 21 nt, Human
gggcuggcgcgggggacgcgg

SEQ ID NO: 821844 - RNA, 21 nt, Human
ggggugagcaucagagaaggc

SEQ ID NO: 821845 - RNA, 21 nt, Human
ggugacccaggaaacccugcg

SEQ ID NO: 821846 - RNA, 21 nt, Human
uacccaaaaagccagcggcga

SEQ ID NO: 821847 - RNA, 22 nt, Human
uacccaaaaagccagcggcgac

SEQ ID NO: 821848 - RNA, 23 nt, Human
uacccacagucaaccucagacac

SEQ ID NO: 821849 - RNA, 24 nt, Human
uacccacagucaaccucagacacu

SEQ ID NO: 821850 - RNA, 24 nt, Human
uauaaacaaacacagcuggggagu

SEQ ID NO: 821851 - RNA, 18 nt, Human
uccacccuccccuggaca

SEQ ID NO: 821852 - RNA, 19 nt, Human
ucccagagccaagccugac

SEQ ID NO: 821853 - RNA, 20 nt, Human
ucccagagccaagccugacc

SEQ ID NO: 821854 - RNA, 23 nt, Human
ucccagcugcagacgcuggacaa

SEQ ID NO: 821855 - RNA, 25 nt, Human
uccccaaaaucauucaaggacccac

SEQ ID NO: 821856 - RNA, 20 nt, Human
uccccggccagccccagccc

SEQ ID NO: 821857 - RNA, 18 nt, Human
ucccggggcuggcgcggg

SEQ ID NO: 821858 - RNA, 24 nt, Human
ucccuggguaccacagaugugccc

SEQ ID NO: 821859 - RNA, 22 nt, Human
uccgugcccaccagcagccggg

SEQ ID NO: 821860 - RNA, 22 nt, Human
uccuccacccuccccuggacaa

SEQ ID NO: 821861 - RNA, 22 nt, Human
uccuccuccuccuccuccucca

SEQ ID NO: 821862 - RNA, 24 nt, Human
uccuccuccuccuccuccuccaaa

SEQ ID NO: 821863 - RNA, 20 nt, Human
uccugaaccccugagaaccu

SEQ ID NO: 821864 - RNA, 21 nt, Human
uccugaaccccugagaaccuc

SEQ ID NO: 821865 - RNA, 20 nt, Human
uccugggcuccgacccaccc

SEQ ID NO: 821866 - RNA, 18 nt, Human
ucgccuggccccacuccc

SEQ ID NO: 821867 - RNA, 19 nt, Human
ucucccagagccaagccug

SEQ ID NO: 821868 - RNA, 20 nt, Human
ucucugagcaagacccuccg

SEQ ID NO: 821869 - RNA, 21 nt, Human
ucucugagcaagacccuccgg

SEQ ID NO: 821870 - RNA, 23 nt, Human
ucugagcuggaaaccuccccaaa

SEQ ID NO: 821871 - RNA, 25 nt, Human
ucugccaagaccuccucugcuccga

SEQ ID NO: 821872 - RNA, 20 nt, Human
ugaaccccugagaaccuccu

SEQ ID NO: 821873 - RNA, 24 nt, Human
ugagcuggaaaccuccccaaaauc

SEQ ID NO: 821874 - RNA, 19 nt, Human
ugccaagaccuccucugcu

SEQ ID NO: 821875 - RNA, 20 nt, Human
ugccuccugggcuccgaccc

SEQ ID NO: 821876 - RNA, 18 nt, Human
ugcgugaaaggcgcgagg

SEQ ID NO: 821877 - RNA, 21 nt, Human
uggccccuucucuuccccccc

SEQ ID NO: 821878 - RNA, 19 nt, Human
uggccuggccuggccccug

SEQ ID NO: 821879 - RNA, 23 nt, Human
uggccuggccuggccccugcuuu

SEQ ID NO: 821880 - RNA, 18 nt, Human
ugggagggggcgucccgg

SEQ ID NO: 821881 - RNA, 19 nt, Human
ugggagggggcgucccggg

SEQ ID NO: 821882 - RNA, 20 nt, Human
ugggagggggcgucccgggc

SEQ ID NO: 821883 - RNA, 21 nt, Human
ugggagggggcgucccgggca

SEQ ID NO: 821884 - RNA, 18 nt, Human
ugggaggggugagcauca

SEQ ID NO: 821885 - RNA, 19 nt, Human
uguggaggggcaaaggggg

SEQ ID NO: 821886 - RNA, 22 nt, Human
uguggaggggcaaagggggacc

SEQ ID NO: 821887 - RNA, 24 nt, Human
uuuacccacagucaaccucagaca

SEQ ID NO: 821888 - RNA, 22 nt, Human
aaaaagcaaaccccaagucaaa

SEQ ID NO: 821889 - RNA, 23 nt, Human
aaacaaaagcauucaaaaauaua

SEQ ID NO: 821890 - RNA, 24 nt, Human
aaagugcugggauuauaggcguga

SEQ ID NO: 821891 - RNA, 19 nt, Human
aaaguuauaacuaagcugg

SEQ ID NO: 821892 - RNA, 20 nt, Human
aaauucacuccaaaaacaaa

SEQ ID NO: 821893 - RNA, 22 nt, Human
aacaccuacaguaccaccagcc

SEQ ID NO: 821894 - RNA, 18 nt, Human
aaccaugucaaacagggu

SEQ ID NO: 821895 - RNA, 22 nt, Human
aagauuuuccucaaaugcaaag

SEQ ID NO: 821896 - RNA, 26 nt, Human
aagcaaaccccaagucaaagggaggg

SEQ ID NO: 821897 - RNA, 25 nt, Human
aagcacuuuaauugagcgcaacaau

SEQ ID NO: 821898 - RNA, 23 nt, Human
aagcgcaaucugucuccuggaaa

SEQ ID NO: 821899 - RNA, 20 nt, Human
aaggugcuguggacaacagc

SEQ ID NO: 821900 - RNA, 22 nt, Human
aaguagcugggauuacaggcac

SEQ ID NO: 821901 - RNA, 24 nt, Human
aagugaucugcccaccuuggccuc

SEQ ID NO: 821902 - RNA, 19 nt, Human
aagugcugggauuauaggc

SEQ ID NO: 821903 - RNA, 19 nt, Human
aagugcugggauuauaggc

SEQ ID NO: 821904 - RNA, 22 nt, Human
aaucaaaguaacaaaauuucac

SEQ ID NO: 821905 - RNA, 24 nt, Human
aaucacacccuuuaaggugacauc

SEQ ID NO: 821906 - RNA, 25 nt, Human
acaaaagcauucaaaaauauauaca

SEQ ID NO: 821907 - RNA, 21 nt, Human
acaaacuuauaaaugcacagu

SEQ ID NO: 821908 - RNA, 24 nt, Human
acaagauuuuccucaaaugcaaag

SEQ ID NO: 821909 - RNA, 19 nt, Human
acaggcaccugccaccacg

SEQ ID NO: 821910 - RNA, 19 nt, Human
acaguaggagaagucacaa

SEQ ID NO: 821911 - RNA, 19 nt, Human
acauuucuucaaacaccau

SEQ ID NO: 821912 - RNA, 21 nt, Human
accacaccagaacguuaugug

SEQ ID NO: 821913 - RNA, 23 nt, Human
accgggaggucacaccuggucag

SEQ ID NO: 821914 - RNA, 27 nt, Human
agaaaccucaaaaaauguuccaaucaa

SEQ ID NO: 821915 - RNA, 24 nt, Human
agaagccuuguucucacagacacc

SEQ ID NO: 821916 - RNA, 18 nt, Human
agaauucaugggcgaaaa

SEQ ID NO: 821917 - RNA, 26 nt, Human
agacagaaaccucaaaaaauguucca

SEQ ID NO: 821918 - RNA, 24 nt, Human
agacucacaaaccaugucaaacag

SEQ ID NO: 821919 - RNA, 21 nt, Human
agagaugauuauuuagcugau

SEQ ID NO: 821920 - RNA, 19 nt, Human
agagcagaaaauccuggag

SEQ ID NO: 821921 - RNA, 21 nt, Human
agcuuguuugguuagcuuuuc

SEQ ID NO: 821922 - RNA, 23 nt, Human
aggagcuccagcugcuccaaccc

SEQ ID NO: 821923 - RNA, 19 nt, Human
aggcuggagugcaguggca

SEQ ID NO: 821924 - RNA, 18 nt, Human
agucaaccugugaauucu

SEQ ID NO: 821925 - RNA, 25 nt, Human
agucacuauccucaucuguaacaga

SEQ ID NO: 821926 - RNA, 24 nt, Human
agucauacacugaugauuaaauau

SEQ ID NO: 821927 - RNA, 20 nt, Human
agugcaguggcauggucucg

SEQ ID NO: 821928 - RNA, 23 nt, Human
agugcaguggcauggucucggcu

SEQ ID NO: 821929 - RNA, 24 nt, Human
agugcaguggcauggucucggcuc

SEQ ID NO: 821930 - RNA, 24 nt, Human
aguggcauggucucggcucacugc

SEQ ID NO: 821931 - RNA, 20 nt, Human
auaaaauucucuccauugac

SEQ ID NO: 821932 - RNA, 22 nt, Human
auaaaauucucuccauugacag

SEQ ID NO: 821933 - RNA, 24 nt, Human
auaguaauggaacuaaaauauauc

SEQ ID NO: 821934 - RNA, 21 nt, Human
aucagagcuuggcuguguugg

SEQ ID NO: 821935 - RNA, 23 nt, Human
augaaaagccacuaccaacagaa

SEQ ID NO: 821936 - RNA, 20 nt, Human
augggguuucaccauguugg

SEQ ID NO: 821937 - RNA, 24 nt, Human
augggguuucaccauguugguccu

SEQ ID NO: 821938 - RNA, 24 nt, Human
auuuuuguauuuuuaguagagaug

SEQ ID NO: 821939 - RNA, 20 nt, Human
caaaaacaaaagcauucaaa

SEQ ID NO: 821940 - RNA, 20 nt, Human
caaacaggguguucucaucu

SEQ ID NO: 821941 - RNA, 21 nt, Human
caaaucaguucuauugaccac

SEQ ID NO: 821942 - RNA, 23 nt, Human
caaaugcaaagucaaggucccua

SEQ ID NO: 821943 - RNA, 22 nt, Human
caacagaaaaaaaaggcgcauc

SEQ ID NO: 821944 - RNA, 30 nt, Human
caacagaaaaaaaaggcgcaucaagcgcaa

SEQ ID NO: 821945 - RNA, 21 nt, Human
caacuaggugacaggcaacac

SEQ ID NO: 821946 - RNA, 19 nt, Human
caagucaaagggagggcag

SEQ ID NO: 821947 - RNA, 22 nt, Human
caccaaguaucuaggagcccau

SEQ ID NO: 821948 - RNA, 24 nt, Human
caccacgcccggcuaauuuuugua

SEQ ID NO: 821949 - RNA, 19 nt, Human
caccuacaguaccaccagc

SEQ ID NO: 821950 - RNA, 21 nt, Human
cacugaagauucgcccuccug

SEQ ID NO: 821951 - RNA, 21 nt, Human
cacugcaaccuccgccuccca

SEQ ID NO: 821952 - RNA, 19 nt, Human
cagcauugguugagucuuc

SEQ ID NO: 821953 - RNA, 22 nt, Human
caguagauguaacaauaaccac

SEQ ID NO: 821954 - RNA, 18 nt, Human
cauaauaaaguaccuagu

SEQ ID NO: 821955 - RNA, 23 nt, Human
cauauaaugcuugaugcuuuuaa

SEQ ID NO: 821956 - RNA, 21 nt, Human
cauucauugaugcuuaaaggu

SEQ ID NO: 821957 - RNA, 20 nt, Human
ccaaagugcugggauuauag

SEQ ID NO: 821958 - RNA, 22 nt, Human
ccaaagugcugggauuauaggc

SEQ ID NO: 821959 - RNA, 24 nt, Human
ccaaagugcugggauuauaggcgu

SEQ ID NO: 821960 - RNA, 20 nt, Human
ccaccacgcccggcuaauuu

SEQ ID NO: 821961 - RNA, 24 nt, Human
ccagaaccaccuuauccaccaaca

SEQ ID NO: 821962 - RNA, 19 nt, Human
cccaggcuggagugcagug

SEQ ID NO: 821963 - RNA, 23 nt, Human
cccagguucaagcaauucuccug

SEQ ID NO: 821964 - RNA, 18 nt, Human
ccccauggccuccucuuc

SEQ ID NO: 821965 - RNA, 26 nt, Human
cccuccagaaccaccuuauccaccaa

SEQ ID NO: 821966 - RNA, 19 nt, Human
cccucccuccuccuguuuu

SEQ ID NO: 821967 - RNA, 23 nt, Human
cccugccuccaaggagcuccagc

SEQ ID NO: 821968 - RNA, 19 nt, Human
ccuagcucugccacuuccu

SEQ ID NO: 821969 - RNA, 22 nt, Human
ccuccagaaccaccuuauccac

SEQ ID NO: 821970 - RNA, 23 nt, Human
ccuccagaaccaccuuauccacc

SEQ ID NO: 821971 - RNA, 24 nt, Human
ccucccagguucaagcaauucucc

SEQ ID NO: 821972 - RNA, 18 nt, Human
ccucggaggacggcuuug

SEQ ID NO: 821973 - RNA, 25 nt, Human
ccucucauaacaccuacaguaccac

SEQ ID NO: 821974 - RNA, 19 nt, Human
ccugaccucaagugaucug

SEQ ID NO: 821975 - RNA, 24 nt, Human
ccugaccucaagugaucugcccac

SEQ ID NO: 821976 - RNA, 18 nt, Human
ccuugucagaugaccaag

SEQ ID NO: 821977 - RNA, 23 nt, Human
cgggggccggcggugggggggau

SEQ ID NO: 821978 - RNA, 23 nt, Human
cuaaacaauggaaaaaccuucuc

SEQ ID NO: 821979 - RNA, 23 nt, Human
cucaaguagcugggauuacaggc

SEQ ID NO: 821980 - RNA, 24 nt, Human
cucaaguagcugggauuacaggca

SEQ ID NO: 821981 - RNA, 24 nt, Human
cucaagugaucugcccaccuuggc

SEQ ID NO: 821982 - RNA, 24 nt, Human
cucacugcaaccuccgccucccag

SEQ ID NO: 821983 - RNA, 23 nt, Human
cugcaaccuccgccucccagguu

SEQ ID NO: 821984 - RNA, 24 nt, Human
cugcaaccuccgccucccagguuc

SEQ ID NO: 821985 - RNA, 19 nt, Human
cuggagugcaguggcaugg

SEQ ID NO: 821986 - RNA, 24 nt, Human
cugguaccgcacuaaacuauauuc

SEQ ID NO: 821987 - RNA, 18 nt, Human
cugguccaucuacuccuc

SEQ ID NO: 821988 - RNA, 21 nt, Human
cuuauuccuaaagaaggcauc

SEQ ID NO: 821989 - RNA, 20 nt, Human
cuuuguugcccaggcuggag

SEQ ID NO: 821990 - RNA, 19 nt, Human
gaaaaugagguaacucuuc

SEQ ID NO: 821991 - RNA, 18 nt, Human
gaacuuccagagauguuc

SEQ ID NO: 821992 - RNA, 24 nt, Human
gaagaaauaagugguauaaugcaa

SEQ ID NO: 821993 - RNA, 23 nt, Human
gaccucaagugaucugcccaccu

SEQ ID NO: 821994 - RNA, 27 nt, Human
gacuguguuuucuuccucacucuuguu

SEQ ID NO: 821995 - RNA, 20 nt, Human
gagaaaaccugugcuagaaa

SEQ ID NO: 821996 - RNA, 19 nt, Human
gagauagcaaaauaauuuu

SEQ ID NO: 821997 - RNA, 24 nt, Human
gagaugggguuucaccauguuggu

SEQ ID NO: 821998 - RNA, 24 nt, Human
gagcaaugcuuugaggccuuuggg

SEQ ID NO: 821999 - RNA, 20 nt, Human
gaggagugaaguagcucuga

SEQ ID NO: 822000 - RNA, 21 nt, Human
gaggagugaaguagcucugag

SEQ ID NO: 822001 - RNA, 21 nt, Human
gaggagugaaguagcucugag

SEQ ID NO: 822002 - RNA, 18 nt, Human
gagucuucucugguaaag

SEQ ID NO: 822003 - RNA, 18 nt, Human
gauuauaggcgugagcca

SEQ ID NO: 822004 - RNA, 21 nt, Human
gauuauaggcgugagccacgc

SEQ ID NO: 822005 - RNA, 22 nt, Human
gcaaccuccgccucccagguuc

SEQ ID NO: 822006 - RNA, 24 nt, Human
gcccaggcuggagugcaguggcau

SEQ ID NO: 822007 - RNA, 22 nt, Human
gcccggcuaauuuuuguauuuu

SEQ ID NO: 822008 - RNA, 19 nt, Human
gccugcccuccagaaccac

SEQ ID NO: 822009 - RNA, 19 nt, Human
gcuggagugcaguggcaug

SEQ ID NO: 822010 - RNA, 23 nt, Human
ggagucuagcuuuguugcccagg

SEQ ID NO: 822011 - RNA, 23 nt, Human
ggauuagaaagcauauuaggagc

SEQ ID NO: 822012 - RNA, 19 nt, Human
ggcaguggccgggccccag

SEQ ID NO: 822013 - RNA, 18 nt, Human
ggcuguguuggagguaga

SEQ ID NO: 822014 - RNA, 24 nt, Human
gggagccgugggagcagcccaagu

SEQ ID NO: 822015 - RNA, 21 nt, Human
gggaggucacaccuggucagc

SEQ ID NO: 822016 - RNA, 18 nt, Human
ggggauucuccuuucucu

SEQ ID NO: 822017 - RNA, 21 nt, Human
gggguuucaccauguuggucc

SEQ ID NO: 822018 - RNA, 20 nt, Human
ggguuucaccauguuggucc

SEQ ID NO: 822019 - RNA, 19 nt, Human
gguuuagagcugacuggaa

SEQ ID NO: 822020 - RNA, 23 nt, Human
guagagaugggguuucaccaugu

SEQ ID NO: 822021 - RNA, 18 nt, Human
guagcugggauuacaggc

SEQ ID NO: 822022 - RNA, 18 nt, Human
gucaaagggagggcaggc

SEQ ID NO: 822023 - RNA, 22 nt, Human
guccuagcucugccacuuccua

SEQ ID NO: 822024 - RNA, 24 nt, Human
gucuagcuuuguugcccaggcugg

SEQ ID NO: 822025 - RNA, 24 nt, Human
guuagauucuaaaagcuaacgaag

SEQ ID NO: 822026 - RNA, 20 nt, Human
guucacuagaagccuuguuc

SEQ ID NO: 822027 - RNA, 21 nt, Human
guugagucuucucugguaaag

SEQ ID NO: 822028 - RNA, 21 nt, Human
guuuucacauuuugaucacag

SEQ ID NO: 822029 - RNA, 25 nt, Human
uaaaauaaauacuaaaauaauguuu

SEQ ID NO: 822030 - RNA, 21 nt, Human
uaaacugagaaaaaugaucaa

SEQ ID NO: 822031 - RNA, 18 nt, Human
uaacacagaguauuaaaa

SEQ ID NO: 822032 - RNA, 18 nt, Human
uaagcuggcuaacauuua

SEQ ID NO: 822033 - RNA, 24 nt, Human
uaauuuuuguauuuuuaguagaga

SEQ ID NO: 822034 - RNA, 21 nt, Human
uacaaccucuggaguaguuau

SEQ ID NO: 822035 - RNA, 22 nt, Human
uacagauggagaaaugccgaaa

SEQ ID NO: 822036 - RNA, 23 nt, Human
uacaggcaccugccaccacgccc

SEQ ID NO: 822037 - RNA, 19 nt, Human
uagaaguuguggaacuuga

SEQ ID NO: 822038 - RNA, 18 nt, Human
uagacucaucuaguuuca

SEQ ID NO: 822039 - RNA, 22 nt, Human
uagagaugggguuucaccaugu

SEQ ID NO: 822040 - RNA, 25 nt, Human
uagcaaacuaaaggaaauuguaccu

SEQ ID NO: 822041 - RNA, 18 nt, Human
uagcuaagcaaagugaua

SEQ ID NO: 822042 - RNA, 19 nt, Human
uagcuucugugccagagua

SEQ ID NO: 822043 - RNA, 24 nt, Human
uagcuuuguugcccaggcuggagu

SEQ ID NO: 822044 - RNA, 24 nt, Human
uaggagaagucacaagagucucug

SEQ ID NO: 822045 - RNA, 24 nt, Human
uaguagagaugggguuucaccaug

SEQ ID NO: 822046 - RNA, 24 nt, Human
uauacacagacacacacacauaua

SEQ ID NO: 822047 - RNA, 22 nt, Human
uauacagauggagaaaugccga

SEQ ID NO: 822048 - RNA, 25 nt, Human
uauuagaaaauucugcugauuuuua

SEQ ID NO: 822049 - RNA, 19 nt, Human
ucaaagucacuauccucau

SEQ ID NO: 822050 - RNA, 19 nt, Human
ucaaguacagcaagaugcu

SEQ ID NO: 822051 - RNA, 23 nt, Human
ucaaguagcugggauuacaggca

SEQ ID NO: 822052 - RNA, 19 nt, Human
ucacagauuggcuuuucca

SEQ ID NO: 822053 - RNA, 22 nt, Human
ucacagcuuugguuagguacuu

SEQ ID NO: 822054 - RNA, 19 nt, Human
ucaccacaaaucccucccu

SEQ ID NO: 822055 - RNA, 21 nt, Human
ucaccucaauggggggaggga

SEQ ID NO: 822056 - RNA, 19 nt, Human
ucacugcaaccuccgccuc

SEQ ID NO: 822057 - RNA, 23 nt, Human
ucacugcaaccuccgccucccag

SEQ ID NO: 822058 - RNA, 24 nt, Human
ucacugcaaccuccgccucccagg

SEQ ID NO: 822059 - RNA, 27 nt, Human
ucacugcaaccuccgccucccagguuc

SEQ ID NO: 822060 - RNA, 20 nt, Human
ucagucaaccugugaauucu

SEQ ID NO: 822061 - RNA, 23 nt, Human
uccaagccauuuuccuucacuac

SEQ ID NO: 822062 - RNA, 18 nt, Human
uccaucccacugauggca

SEQ ID NO: 822063 - RNA, 24 nt, Human
ucccaaagugcugggauuauaggc

SEQ ID NO: 822064 - RNA, 21 nt, Human
ucccagguucaagcaauucuc

SEQ ID NO: 822065 - RNA, 24 nt, Human
ucccagguucaagcaauucuccug

SEQ ID NO: 822066 - RNA, 22 nt, Human
uccgggggccggcggugggggg

SEQ ID NO: 822067 - RNA, 24 nt, Human
uccucaaaugcaaagucaaggucc

SEQ ID NO: 822068 - RNA, 23 nt, Human
ucuagcuuuguugcccaggcugg

SEQ ID NO: 822069 - RNA, 24 nt, Human
ucuagcuuuguugcccaggcugga

SEQ ID NO: 822070 - RNA, 24 nt, Human
ucucaaguagcugggauuacaggc

SEQ ID NO: 822071 - RNA, 20 nt, Human
ucugccucucucuaguuucu

SEQ ID NO: 822072 - RNA, 20 nt, Human
ucuucaacaguuucauccag

SEQ ID NO: 822073 - RNA, 21 nt, Human
ucuugaacuccugaccucaag

SEQ ID NO: 822074 - RNA, 19 nt, Human
ugaaaaaaucaguagaugu

SEQ ID NO: 822075 - RNA, 19 nt, Human
ugaaaaggucaaaauccga

SEQ ID NO: 822076 - RNA, 22 nt, Human
ugaaggacacccuauggguccu

SEQ ID NO: 822077 - RNA, 26 nt, Human
ugaccaaggagacccuucugucacag

SEQ ID NO: 822078 - RNA, 20 nt, Human
ugaccaccaaguaucuagga

SEQ ID NO: 822079 - RNA, 22 nt, Human
ugaccgaauaaugggaugacac

SEQ ID NO: 822080 - RNA, 21 nt, Human
ugaccgaauaaugggaugacc

SEQ ID NO: 822081 - RNA, 18 nt, Human
ugaccucaagugaucugc

SEQ ID NO: 822082 - RNA, 19 nt, Human
ugacuguguuuucuuccuc

SEQ ID NO: 822083 - RNA, 22 nt, Human
ugagugaaaugguuucaaacug

SEQ ID NO: 822084 - RNA, 18 nt, Human
ugaguuugcuuaccuggu

SEQ ID NO: 822085 - RNA, 24 nt, Human
ugaucugcccaccuuggccuccca

SEQ ID NO: 822086 - RNA, 18 nt, Human
ugcagauuuucuggacug

SEQ ID NO: 822087 - RNA, 22 nt, Human
ugcaguggcauggucucggcuc

SEQ ID NO: 822088 - RNA, 18 nt, Human
ugcccaggcuggagugca

SEQ ID NO: 822089 - RNA, 22 nt, Human
ugcccaggcuggagugcagugg

SEQ ID NO: 822090 - RNA, 24 nt, Human
ugcccaggcuggagugcaguggca

SEQ ID NO: 822091 - RNA, 18 nt, Human
ugccugaagcguggacag

SEQ ID NO: 822092 - RNA, 19 nt, Human
ugcgagcaaugcuuugagg

SEQ ID NO: 822093 - RNA, 23 nt, Human
uggaaaaaccuucucauaaagcc

SEQ ID NO: 822094 - RNA, 19 nt, Human
uggaagccagaacaacugc

SEQ ID NO: 822095 - RNA, 18 nt, Human
uggagguagaauucaugg

SEQ ID NO: 822096 - RNA, 19 nt, Human
uggagguagaauucauggg

SEQ ID NO: 822097 - RNA, 24 nt, Human
uggagucuagcuuuguugcccagg

SEQ ID NO: 822098 - RNA, 20 nt, Human
uggagugcaguggcaugguc

SEQ ID NO: 822099 - RNA, 23 nt, Human
uggagugcaguggcauggucucg

SEQ ID NO: 822100 - RNA, 24 nt, Human
uggagugcaguggcauggucucgg

SEQ ID NO: 822101 - RNA, 19 nt, Human
uggcauggucucggcucac

SEQ ID NO: 822102 - RNA, 19 nt, Human
uggcccgagcaggugacag

SEQ ID NO: 822103 - RNA, 18 nt, Human
ugggaaauucuguuaugu

SEQ ID NO: 822104 - RNA, 22 nt, Human
ugggauuacaggcaccugccac

SEQ ID NO: 822105 - RNA, 24 nt, Human
ugggauuacaggcaccugccacca

SEQ ID NO: 822106 - RNA, 18 nt, Human
ugggauuauaggcgugag

SEQ ID NO: 822107 - RNA, 19 nt, Human
ugggauuauaggcgugagc

SEQ ID NO: 822108 - RNA, 21 nt, Human
ugggauuauaggcgugagcca

SEQ ID NO: 822109 - RNA, 22 nt, Human
ugggauuauaggcgugagccac

SEQ ID NO: 822110 - RNA, 22 nt, Human
ugggauuauaggcgugagccac

SEQ ID NO: 822111 - RNA, 23 nt, Human
ugggauuauaggcgugagccacg

SEQ ID NO: 822112 - RNA, 22 nt, Human
ugggguuucaccauguuggucc

SEQ ID NO: 822113 - RNA, 22 nt, Human
uguaacagaagacucacaaacc

SEQ ID NO: 822114 - RNA, 22 nt, Human
uguauauguguuuguguguaua

SEQ ID NO: 822115 - RNA, 21 nt, Human
uguauuuuuaguagagauggg

SEQ ID NO: 822116 - RNA, 20 nt, Human
ugucacagcuuugguuaggu

SEQ ID NO: 822117 - RNA, 19 nt, Human
ugucugccucucucuaguu

SEQ ID NO: 822118 - RNA, 21 nt, Human
ugugcuagaaaggcacuagag

SEQ ID NO: 822119 - RNA, 18 nt, Human
uguguaaacacuuaugua

SEQ ID NO: 822120 - RNA, 21 nt, Human
uguguguguaaacacuuaugu

SEQ ID NO: 822121 - RNA, 21 nt, Human
uuaaaucaaaacccuaagauc

SEQ ID NO: 822122 - RNA, 21 nt, Human
uuaagugcagaaccaacaaaa

SEQ ID NO: 822123 - RNA, 18 nt, Human
uuaguagagaugggguuu

SEQ ID NO: 822124 - RNA, 22 nt, Human
uuaguagagaugggguuucacc

SEQ ID NO: 822125 - RNA, 24 nt, Human
uuaguagagaugggguuucaccau

SEQ ID NO: 822126 - RNA, 22 nt, Human
uucacuguuugcauucauugau

SEQ ID NO: 822127 - RNA, 25 nt, Human
uucugcugauuuuuaaauaaugugg

SEQ ID NO: 822128 - RNA, 18 nt, Human
uugaauggagggaagaug

SEQ ID NO: 822129 - RNA, 23 nt, Human
uugcauucauugaugcuuaaagg

SEQ ID NO: 822130 - RNA, 24 nt, Human
uugcccaggcuggagugcaguggc

SEQ ID NO: 822131 - RNA, 18 nt, Human
uuggccucccaaagugcu

SEQ ID NO: 822132 - RNA, 24 nt, Human
uugggagcauaaaaaacccaaagg

SEQ ID NO: 822133 - RNA, 20 nt, Human
uuggggaucuguguuuuuug

SEQ ID NO: 822134 - RNA, 23 nt, Human
uugguccugaucuugaacuccug

SEQ ID NO: 822135 - RNA, 24 nt, Human
uuggucuuauuauguauuuccuga

SEQ ID NO: 822136 - RNA, 22 nt, Human
uugguuagguacuuccauaaaa

SEQ ID NO: 822137 - RNA, 21 nt, Human
uuucacauuucuucaaacacc

SEQ ID NO: 822138 - RNA, 22 nt, Human
uuucuuccucacucuuguuucc

SEQ ID NO: 822139 - RNA, 22 nt, Human
uuugaggucuucacuguuugca

SEQ ID NO: 822140 - RNA, 18 nt, Human
uuuguugcccaggcugga

SEQ ID NO: 822141 - RNA, 24 nt, Human
uuuguugcccaggcuggagugcag

SEQ ID NO: 822142 - RNA, 24 nt, Human
uuuuuaguagagaugggguuucac

SEQ ID NO: 822143 - RNA, 20 nt, Human
uuuuuguauuuuuaguagag

SEQ ID NO: 822144 - RNA, 27 nt, Human
uuuuuuauuuuuuuugagauggagucu

SEQ ID NO: 822145 - RNA, 22 nt, Human
aaaaaaaaaagaaaaaaaaaag

SEQ ID NO: 822146 - RNA, 22 nt, Human
aaaaaaaagaaaaaaaaaagaa

SEQ ID NO: 822147 - RNA, 20 nt, Human
aaaaaaccaaaaaaggcagu

SEQ ID NO: 822148 - RNA, 20 nt, Human
aaaaaucauuaaucccaucc

SEQ ID NO: 822149 - RNA, 23 nt, Human
aaaagaaaaaaaaaagaaaagaa

SEQ ID NO: 822150 - RNA, 24 nt, Human
aaaagaaaagaaguccagcauccu

SEQ ID NO: 822151 - RNA, 20 nt, Human
aacauagugagacuccaucc

SEQ ID NO: 822152 - RNA, 23 nt, Human
aauugaaaaaaaaaaaagaaaaa

SEQ ID NO: 822153 - RNA, 23 nt, Human
acacacacacacacacacacaca

SEQ ID NO: 822154 - RNA, 23 nt, Human
acacacacacacacacacaugca

SEQ ID NO: 822155 - RNA, 23 nt, Human
acacacacacacacaugcacaca

SEQ ID NO: 822156 - RNA, 25 nt, Human
acacacacacaugcacacacaccca

SEQ ID NO: 822157 - RNA, 23 nt, Human
acacacacccaagcaaauuguua

SEQ ID NO: 822158 - RNA, 24 nt, Human
acauagugagacuccaucccaaaa

SEQ ID NO: 822159 - RNA, 24 nt, Human
acugccaauuuacgaaagcugcag

SEQ ID NO: 822160 - RNA, 21 nt, Human
agaauuuuugcaaaccaaaau

SEQ ID NO: 822161 - RNA, 20 nt, Human
agagaaacuugaaaguaaug

SEQ ID NO: 822162 - RNA, 19 nt, Human
agcccaggaguucaagacc

SEQ ID NO: 822163 - RNA, 21 nt, Human
agcucucuggcuucucagucc

SEQ ID NO: 822164 - RNA, 21 nt, Human
aggaaagugagauggaagggg

SEQ ID NO: 822165 - RNA, 20 nt, Human
aggauaccaauaaaaaacua

SEQ ID NO: 822166 - RNA, 24 nt, Human
aggaucacuugagcccaggaguuc

SEQ ID NO: 822167 - RNA, 20 nt, Human
agggaugaaugggcaaaagg

SEQ ID NO: 822168 - RNA, 19 nt, Human
agucugggcaacauaguga

SEQ ID NO: 822169 - RNA, 23 nt, Human
agucugggcaacauagugagacu

SEQ ID NO: 822170 - RNA, 24 nt, Human
agucugggcaacauagugagacuc

SEQ ID NO: 822171 - RNA, 25 nt, Human
auaccaauaaaaaacuaaaaaacca

SEQ ID NO: 822172 - RNA, 24 nt, Human
aucacuugagcccaggaguucaag

SEQ ID NO: 822173 - RNA, 21 nt, Human
auggaguguacccguaauguc

SEQ ID NO: 822174 - RNA, 19 nt, Human
caacaggcacuauacacag

SEQ ID NO: 822175 - RNA, 22 nt, Human
caacuaauuacuguuuaccagu

SEQ ID NO: 822176 - RNA, 27 nt, Human
caauaaaaaacuaaaaaaccaaaaaag

SEQ ID NO: 822177 - RNA, 24 nt, Human
caaugcccaaaagaaaaagaguuc

SEQ ID NO: 822178 - RNA, 18 nt, Human
cacacacacacacacaca

SEQ ID NO: 822179 - RNA, 20 nt, Human
cacacacacacacacacaca

SEQ ID NO: 822180 - RNA, 20 nt, Human
cacacacacacacacacaca

SEQ ID NO: 822181 - RNA, 20 nt, Human
cacacacacacacacacaca

SEQ ID NO: 822182 - RNA, 22 nt, Human
cacacacacacacacacacaca

SEQ ID NO: 822183 - RNA, 26 nt, Human
cacacacacacacacacacacacaug

SEQ ID NO: 822184 - RNA, 26 nt, Human
cacacacacacacacacacaugcaca

SEQ ID NO: 822185 - RNA, 26 nt, Human
cacacacacacacacacaugcacaca

SEQ ID NO: 822186 - RNA, 30 nt, Human
cacacacacacacacaugcacacacacccu

SEQ ID NO: 822187 - RNA, 18 nt, Human
cacacaugcacacacacc

SEQ ID NO: 822188 - RNA, 19 nt, Human
cacagaauguuuacacucc

SEQ ID NO: 822189 - RNA, 24 nt, Human
caccaacaggcacuauacacagcc

SEQ ID NO: 822190 - RNA, 18 nt, Human
cacuauacacagccagga

SEQ ID NO: 822191 - RNA, 23 nt, Human
cacugacccauuccuaguuacag

SEQ ID NO: 822192 - RNA, 20 nt, Human
cagcauccugaauaguggua

SEQ ID NO: 822193 - RNA, 22 nt, Human
cagcauccugaauagugguauu

SEQ ID NO: 822194 - RNA, 18 nt, Human
cagccaggaauaucaaag

SEQ ID NO: 822195 - RNA, 21 nt, Human
cagcuuuuaacuguugccaca

SEQ ID NO: 822196 - RNA, 20 nt, Human
caucccaggguuucaguaac

SEQ ID NO: 822197 - RNA, 20 nt, Human
cauucucacuaagcuagaag

SEQ ID NO: 822198 - RNA, 18 nt, Human
ccaccaacaggcacuaua

SEQ ID NO: 822199 - RNA, 19 nt, Human
ccagaauagcucugucuuc

SEQ ID NO: 822200 - RNA, 20 nt, Human
cccccagcccccaucuauuu

SEQ ID NO: 822201 - RNA, 22 nt, Human
ccuugaaaagaagagggaugaa

SEQ ID NO: 822202 - RNA, 24 nt, Human
cgaaaauaaaauucugaaagguca

SEQ ID NO: 822203 - RNA, 19 nt, Human
cucucuggcuucucagucc

SEQ ID NO: 822204 - RNA, 18 nt, Human
cugcaucagcauccgcaa

SEQ ID NO: 822205 - RNA, 23 nt, Human
cugggcaacauagugagacucca

SEQ ID NO: 822206 - RNA, 18 nt, Human
cuguaaguuuacauccca

SEQ ID NO: 822207 - RNA, 20 nt, Human
gaaaaaaaaaaaagaaaaaa

SEQ ID NO: 822208 - RNA, 20 nt, Human
gaaagcugcagcuacugauc

SEQ ID NO: 822209 - RNA, 24 nt, Human
gaucacuugagcccaggaguucaa

SEQ ID NO: 822210 - RNA, 20 nt, Human
gcccaggaguucaagaccag

SEQ ID NO: 822211 - RNA, 22 nt, Human
ggaauccaguuuacaguccugc

SEQ ID NO: 822212 - RNA, 21 nt, Human
ggacagaauccaaguuaugug

SEQ ID NO: 822213 - RNA, 23 nt, Human
ggaucacuugagcccaggaguuc

SEQ ID NO: 822214 - RNA, 24 nt, Human
gggcaaaaggauauuuuuccuaac

SEQ ID NO: 822215 - RNA, 18 nt, Human
gucaaguucucuccauca

SEQ ID NO: 822216 - RNA, 20 nt, Human
uaaaauacucccucaaggaa

SEQ ID NO: 822217 - RNA, 25 nt, Human
uaacugacaauuugaauuaaauucc

SEQ ID NO: 822218 - RNA, 22 nt, Human
uaaguuuacaucccaggguuuc

SEQ ID NO: 822219 - RNA, 25 nt, Human
uacacacacacacacacacacacac

SEQ ID NO: 822220 - RNA, 20 nt, Human
uacaguccugcagaaacugc

SEQ ID NO: 822221 - RNA, 21 nt, Human
uaggaaccaggcuugauggag

SEQ ID NO: 822222 - RNA, 25 nt, Human
uauacacacacacacacacacacac

SEQ ID NO: 822223 - RNA, 21 nt, Human
uaucaguacaguccaccaaca

SEQ ID NO: 822224 - RNA, 21 nt, Human
ucacugacccauuccuaguua

SEQ ID NO: 822225 - RNA, 24 nt, Human
ucagagagaaauccccugaagaaa

SEQ ID NO: 822226 - RNA, 19 nt, Human
uccugcagaaacugcauca

SEQ ID NO: 822227 - RNA, 18 nt, Human
uccuguuggccaaugccc

SEQ ID NO: 822228 - RNA, 18 nt, Human
uccuugaaaagaagaggg

SEQ ID NO: 822229 - RNA, 19 nt, Human
ucugaaaggucaaaugacu

SEQ ID NO: 822230 - RNA, 18 nt, Human
ucuggcuucucaguccug

SEQ ID NO: 822231 - RNA, 21 nt, Human
ucuggcuucucaguccuguug

SEQ ID NO: 822232 - RNA, 23 nt, Human
ugaaaaaaaaaaaagaaaaaaaa

SEQ ID NO: 822233 - RNA, 22 nt, Human
ugacuuguccaagguguauaca

SEQ ID NO: 822234 - RNA, 23 nt, Human
ugagcccaggaguucaagaccag

SEQ ID NO: 822235 - RNA, 21 nt, Human
ugaucaauacuguaaguuuac

SEQ ID NO: 822236 - RNA, 20 nt, Human
ugcacgaaguuuucaaaaag

SEQ ID NO: 822237 - RNA, 20 nt, Human
ugcauucuucccuuuccagu

SEQ ID NO: 822238 - RNA, 22 nt, Human
ugcccaaaagaaaaagaguucc

SEQ ID NO: 822239 - RNA, 24 nt, Human
uggccaaugcccaaaagaaaaaga

SEQ ID NO: 822240 - RNA, 21 nt, Human
uggcucaggugcaagcucucu

SEQ ID NO: 822241 - RNA, 23 nt, Human
uggcucaggugcaagcucucugg

SEQ ID NO: 822242 - RNA, 22 nt, Human
ugggacagaauccaaguuaugu

SEQ ID NO: 822243 - RNA, 24 nt, Human
uguauacacacacacacacacaca

SEQ ID NO: 822244 - RNA, 25 nt, Human
uguauacacacacacacacacacag

SEQ ID NO: 822245 - RNA, 30 nt, Human
uuaaaguagaauuuuugcaaaccaaaaucc

SEQ ID NO: 822246 - RNA, 22 nt, Human
uugcauucuucccuuuccagug

SEQ ID NO: 822247 - RNA, 21 nt, Human
uuuccuuacccccagccccca

SEQ ID NO: 822248 - RNA, 23 nt, Human
uuugaauuaaauuccccccacuu

SEQ ID NO: 822249 - RNA, 18 nt, Human
aaaaagaggcaaugggga

SEQ ID NO: 822250 - RNA, 22 nt, Human
aaaaggaaaaaaacaaacaaaa

SEQ ID NO: 822251 - RNA, 22 nt, Human
aaacaaacaaaaaaauaacucu

SEQ ID NO: 822252 - RNA, 20 nt, Human
aaacaagaggcugcuacaac

SEQ ID NO: 822253 - RNA, 24 nt, Human
aaacaauagcaucaaccacgcuac

SEQ ID NO: 822254 - RNA, 22 nt, Human
aaauaaauuuacuacuuguaaa

SEQ ID NO: 822255 - RNA, 23 nt, Human
aaggaaaaaaacaaacaaaaaaa

SEQ ID NO: 822256 - RNA, 21 nt, Human
aaguucuccaucuuucuccuc

SEQ ID NO: 822257 - RNA, 23 nt, Human
acaaucagugcuuccaaaagccc

SEQ ID NO: 822258 - RNA, 26 nt, Human
acuauaagaacauuuauggagaaaga

SEQ ID NO: 822259 - RNA, 25 nt, Human
acuuuauaaguuuuuuaaaaaaaga

SEQ ID NO: 822260 - RNA, 22 nt, Human
aggaaaaaaacaaacaaaaaaa

SEQ ID NO: 822261 - RNA, 23 nt, Human
aggaaaaaaacaaacaaaaaaau

SEQ ID NO: 822262 - RNA, 24 nt, Human
aggaaaaaaacaaacaaaaaaaua

SEQ ID NO: 822263 - RNA, 27 nt, Human
aggaaaaauaaaaagugaccgguaccc

SEQ ID NO: 822264 - RNA, 21 nt, Human
auccaaaaaggaaaaaaacaa

SEQ ID NO: 822265 - RNA, 21 nt, Human
auguagaaacacaucaaagca

SEQ ID NO: 822266 - RNA, 21 nt, Human
caaaacaguagcaauguagaa

SEQ ID NO: 822267 - RNA, 23 nt, Human
caagauccaaaaaggaaaaaaac

SEQ ID NO: 822268 - RNA, 19 nt, Human
cacgcuacugaacauagga

SEQ ID NO: 822269 - RNA, 19 nt, Human
caucuuguucugguacuuc

SEQ ID NO: 822270 - RNA, 18 nt, Human
ccaaaaaggaaaaaaaca

SEQ ID NO: 822271 - RNA, 19 nt, Human
cccgcuuuuucccuuucuc

SEQ ID NO: 822272 - RNA, 19 nt, Human
ccgcagccgcggcagaagc

SEQ ID NO: 822273 - RNA, 23 nt, Human
ccgccgcugccaccgccgccgcc

SEQ ID NO: 822274 - RNA, 24 nt, Human
ccgccgcugccaccgccgccgccg

SEQ ID NO: 822275 - RNA, 26 nt, Human
ccgccgcugccaccgccgccgccgcu

SEQ ID NO: 822276 - RNA, 18 nt, Human
ccgcggcagaagcacggg

SEQ ID NO: 822277 - RNA, 22 nt, Human
ccgcugccaccgccgccgccgc

SEQ ID NO: 822278 - RNA, 24 nt, Human
cgcgacucgcgcgggcgccgcagc

SEQ ID NO: 822279 - RNA, 19 nt, Human
cgcgcgggcgccgcagccg

SEQ ID NO: 822280 - RNA, 20 nt, Human
cgcgcgggcgccgcagccgc

SEQ ID NO: 822281 - RNA, 21 nt, Human
cgcgcgggcgccgcagccgcg

SEQ ID NO: 822282 - RNA, 18 nt, Human
cgggcuagguauggggga

SEQ ID NO: 822283 - RNA, 20 nt, Human
cuccucccgacugucagccg

SEQ ID NO: 822284 - RNA, 24 nt, Human
cugucagccgccauggcuccccuu

SEQ ID NO: 822285 - RNA, 24 nt, Human
cuucccgcuuuuucccuuucuccc

SEQ ID NO: 822286 - RNA, 18 nt, Human
gagaaagaaucaguaucu

SEQ ID NO: 822287 - RNA, 24 nt, Human
gagggaagggaaacagauggcgac

SEQ ID NO: 822288 - RNA, 21 nt, Human
gccgcagccgcggcagaagca

SEQ ID NO: 822289 - RNA, 23 nt, Human
gcgcgaaacaaucccgcucccga

SEQ ID NO: 822290 - RNA, 22 nt, Human
gggggagggaagggaaacagau

SEQ ID NO: 822291 - RNA, 20 nt, Human
guuuccgccgcugccaccgc

SEQ ID NO: 822292 - RNA, 18 nt, Human
uaaaauaucauccagaac

SEQ ID NO: 822293 - RNA, 22 nt, Human
uaaacacacacaaaaaaaaaaa

SEQ ID NO: 822294 - RNA, 25 nt, Human
uaaacacacacaaaaaaaaaaauac

SEQ ID NO: 822295 - RNA, 25 nt, Human
uaaguuuuuuaaaaaaagaggcaau

SEQ ID NO: 822296 - RNA, 21 nt, Human
ucaaccacgcuacugaacaua

SEQ ID NO: 822297 - RNA, 20 nt, Human
ucaagauccaaaaaggaaaa

SEQ ID NO: 822298 - RNA, 22 nt, Human
uccaaaaaggaaaaaaacaaac

SEQ ID NO: 822299 - RNA, 24 nt, Human
uccaaaaaggaaaaaaacaaacaa

SEQ ID NO: 822300 - RNA, 25 nt, Human
uccaaaaaggaaaaaaacaaacaaa

SEQ ID NO: 822301 - RNA, 19 nt, Human
uccaagccaauguauacaa

SEQ ID NO: 822302 - RNA, 20 nt, Human
ucucccuuccuuucacucca

SEQ ID NO: 822303 - RNA, 22 nt, Human
ucucgacucuucccgcuuuuuc

SEQ ID NO: 822304 - RNA, 18 nt, Human
ucucuggauuauacaguu

SEQ ID NO: 822305 - RNA, 23 nt, Human
ugaggaaaaauaaaaagugacuu

SEQ ID NO: 822306 - RNA, 22 nt, Human
ugcaugcuuggaacaaaggggg

SEQ ID NO: 822307 - RNA, 21 nt, Human
uggccucuuaacacucagccu

SEQ ID NO: 822308 - RNA, 21 nt, Human
uuccgccgcugccaccgccgc

SEQ ID NO: 822309 - RNA, 24 nt, Human
uuggccucuuaacacucagccuuc

SEQ ID NO: 822310 - RNA, 18 nt, Human
uugugaacauuccaagcc

SEQ ID NO: 822311 - RNA, 21 nt, Human
aagcaggaacucucuguguug

SEQ ID NO: 822312 - RNA, 19 nt, Human
aaguaaaggcacuacaacc

SEQ ID NO: 822313 - RNA, 18 nt, Human
acaggguuucaccauguu

SEQ ID NO: 822314 - RNA, 23 nt, Human
acaggguuucaccauguuggcca

SEQ ID NO: 822315 - RNA, 24 nt, Human
acaggguuucaccauguuggccag

SEQ ID NO: 822316 - RNA, 23 nt, Human
accacacccagauaauuuuugua

SEQ ID NO: 822317 - RNA, 24 nt, Human
accauguuggccaggauggucucg

SEQ ID NO: 822318 - RNA, 24 nt, Human
accuugugauccacccaccucagc

SEQ ID NO: 822319 - RNA, 24 nt, Human
acucuguugccaaacuggagugca

SEQ ID NO: 822320 - RNA, 18 nt, Human
agaagaaaaugucuacaa

SEQ ID NO: 822321 - RNA, 22 nt, Human
agaagaaaaugucuacaaaaag

SEQ ID NO: 822322 - RNA, 21 nt, Human
agguucaagugauuauccugc

SEQ ID NO: 822323 - RNA, 22 nt, Human
aguagagacaggguuucaccau

SEQ ID NO: 822324 - RNA, 20 nt, Human
agugcagugguacaaucuug

SEQ ID NO: 822325 - RNA, 24 nt, Human
agugcagugguacaaucuuggcuc

SEQ ID NO: 822326 - RNA, 25 nt, Human
auaaauucccugauguugaacaaag

SEQ ID NO: 822327 - RNA, 23 nt, Human
auaauuuuuguauuuuuaguaga

SEQ ID NO: 822328 - RNA, 24 nt, Human
auuuuuguauuuuuaguagagaca

SEQ ID NO: 822329 - RNA, 23 nt, Human
caaaaugcugggagccauuuugc

SEQ ID NO: 822330 - RNA, 23 nt, Human
caacuuccaccucccagguucaa

SEQ ID NO: 822331 - RNA, 18 nt, Human
caccauguuggccaggau

SEQ ID NO: 822332 - RNA, 22 nt, Human
caccauguuggccaggaugguc

SEQ ID NO: 822333 - RNA, 24 nt, Human
caccauguuggccaggauggucuc

SEQ ID NO: 822334 - RNA, 22 nt, Human
cacccaccucagccucccaaaa

SEQ ID NO: 822335 - RNA, 23 nt, Human
cacccaccucagccucccaaaau

SEQ ID NO: 822336 - RNA, 24 nt, Human
caccucagccucccaaaaugcugg

SEQ ID NO: 822337 - RNA, 23 nt, Human
cacucuguugccaaacuggagug

SEQ ID NO: 822338 - RNA, 21 nt, Human
cacugcaacuuccaccuccca

SEQ ID NO: 822339 - RNA, 21 nt, Human
cagauuucuaggauuucucac

SEQ ID NO: 822340 - RNA, 24 nt, Human
caggguuucaccauguuggccagg

SEQ ID NO: 822341 - RNA, 21 nt, Human
ccaauaccugcaggucacagg

SEQ ID NO: 822342 - RNA, 20 nt, Human
ccaccacacccagauaauuu

SEQ ID NO: 822343 - RNA, 26 nt, Human
ccacccaccucagccucccaaaaugc

SEQ ID NO: 822344 - RNA, 21 nt, Human
cccagguucaagugauuaucc

SEQ ID NO: 822345 - RNA, 23 nt, Human
cccagguucaagugauuauccug

SEQ ID NO: 822346 - RNA, 23 nt, Human
cccggccaauauuuaaugcuuag

SEQ ID NO: 822347 - RNA, 20 nt, Human
ccucccagguucaagugauu

SEQ ID NO: 822348 - RNA, 19 nt, Human
ccucccgaguagaugggaa

SEQ ID NO: 822349 - RNA, 19 nt, Human
cuaggcuuucagggggucc

SEQ ID NO: 822350 - RNA, 18 nt, Human
cucacucuguugccaaac

SEQ ID NO: 822351 - RNA, 23 nt, Human
cucacucuguugccaaacuggag

SEQ ID NO: 822352 - RNA, 24 nt, Human
cucacugcaacuuccaccucccag

SEQ ID NO: 822353 - RNA, 21 nt, Human
cuccaguaugaauuaucuuac

SEQ ID NO: 822354 - RNA, 23 nt, Human
cucuucagauuucuaggauuucu

SEQ ID NO: 822355 - RNA, 18 nt, Human
cucuugaccuugugaucc

SEQ ID NO: 822356 - RNA, 25 nt, Human
cucuugaccuugugauccacccacc

SEQ ID NO: 822357 - RNA, 23 nt, Human
cugcaacuuccaccucccagguu

SEQ ID NO: 822358 - RNA, 24 nt, Human
cugcaacuuccaccucccagguuc

SEQ ID NO: 822359 - RNA, 21 nt, Human
cugcaggucacagggccacag

SEQ ID NO: 822360 - RNA, 22 nt, Human
gaccuugugauccacccaccuc

SEQ ID NO: 822361 - RNA, 24 nt, Human
gaccuugugauccacccaccucag

SEQ ID NO: 822362 - RNA, 19 nt, Human
gagugcagugguacaaucu

SEQ ID NO: 822363 - RNA, 21 nt, Human
gcacgugccaccacacccaga

SEQ ID NO: 822364 - RNA, 18 nt, Human
gcauaagccaccgcaccc

SEQ ID NO: 822365 - RNA, 22 nt, Human
ggguuucaccauguuggccagg

SEQ ID NO: 822366 - RNA, 24 nt, Human
gguuucaccauguuggccaggaug

SEQ ID NO: 822367 - RNA, 23 nt, Human
guagaguuucucuccaguauaaa

SEQ ID NO: 822368 - RNA, 24 nt, Human
gucucacucuguugccaaacugga

SEQ ID NO: 822369 - RNA, 24 nt, Human
gugauccacccaccucagccuccc

SEQ ID NO: 822370 - RNA, 21 nt, Human
guucaagugauuauccugccu

SEQ ID NO: 822371 - RNA, 24 nt, Human
uaauuuuuguauuuuuaguagaga

SEQ ID NO: 822372 - RNA, 22 nt, Human
uacaaauaacuuuucuaccaac

SEQ ID NO: 822373 - RNA, 24 nt, Human
uacaggcacgugccaccacaccca

SEQ ID NO: 822374 - RNA, 20 nt, Human
uaccugcaggucacagggcc

SEQ ID NO: 822375 - RNA, 18 nt, Human
uagaagaaaaugucuaca

SEQ ID NO: 822376 - RNA, 22 nt, Human
uagagacaggguuucaccaugu

SEQ ID NO: 822377 - RNA, 18 nt, Human
uagaugggaauacaggca

SEQ ID NO: 822378 - RNA, 24 nt, Human
uaguagagacaggguuucaccaug

SEQ ID NO: 822379 - RNA, 26 nt, Human
uaguagagacaggguuucaccauguu

SEQ ID NO: 822380 - RNA, 22 nt, Human
uaugguuagaaaaguuugaggc

SEQ ID NO: 822381 - RNA, 21 nt, Human
uauuaagcaggaacucucugu

SEQ ID NO: 822382 - RNA, 24 nt, Human
ucaccauguuggccaggauggucu

SEQ ID NO: 822383 - RNA, 24 nt, Human
ucacugcaacuuccaccucccagg

SEQ ID NO: 822384 - RNA, 25 nt, Human
ucacugcaacuuccaccucccaggu

SEQ ID NO: 822385 - RNA, 18 nt, Human
ucagccucccaaaaugcu

SEQ ID NO: 822386 - RNA, 18 nt, Human
ucagggggucccgguguc

SEQ ID NO: 822387 - RNA, 21 nt, Human
uccacccaccucagccuccca

SEQ ID NO: 822388 - RNA, 24 nt, Human
uccacccaccucagccucccaaaa

SEQ ID NO: 822389 - RNA, 18 nt, Human
ucccaauaccugcagguc

SEQ ID NO: 822390 - RNA, 21 nt, Human
ucccagguucaagugauuauc

SEQ ID NO: 822391 - RNA, 24 nt, Human
ucccagguucaagugauuauccug

SEQ ID NO: 822392 - RNA, 27 nt, Human
ucccggugucuuagcugugggucuccc

SEQ ID NO: 822393 - RNA, 23 nt, Human
ucuaggauuucucaccaguauaa

SEQ ID NO: 822394 - RNA, 23 nt, Human
ucucacucuguugccaaacugga

SEQ ID NO: 822395 - RNA, 22 nt, Human
ucugcaaaaaaccuucugaucc

SEQ ID NO: 822396 - RNA, 23 nt, Human
ucuguugccaaacuggagugcag

SEQ ID NO: 822397 - RNA, 18 nt, Human
ucuuaaaggcuuugccau

SEQ ID NO: 822398 - RNA, 21 nt, Human
ugacaaccauuuaaaggcuuu

SEQ ID NO: 822399 - RNA, 20 nt, Human
ugaccuugugauccacccac

SEQ ID NO: 822400 - RNA, 22 nt, Human
ugagacggagucucacucuguu

SEQ ID NO: 822401 - RNA, 24 nt, Human
ugauccacccaccucagccuccca

SEQ ID NO: 822402 - RNA, 20 nt, Human
ugauuuguagaguuucucuc

SEQ ID NO: 822403 - RNA, 22 nt, Human
ugcagugguacaaucuuggcuc

SEQ ID NO: 822404 - RNA, 18 nt, Human
ugcauaagccaccgcacc

SEQ ID NO: 822405 - RNA, 19 nt, Human
ugcauagacuuaauuaugg

SEQ ID NO: 822406 - RNA, 22 nt, Human
ugcauagacuuaauuauggauu

SEQ ID NO: 822407 - RNA, 18 nt, Human
ugccauauuguucacaca

SEQ ID NO: 822408 - RNA, 20 nt, Human
ugccuaagccucccgaguag

SEQ ID NO: 822409 - RNA, 18 nt, Human
ugcuuaguaagaguugag

SEQ ID NO: 822410 - RNA, 23 nt, Human
ugcuucagaguuuuccucuagaa

SEQ ID NO: 822411 - RNA, 24 nt, Human
uggagugcagugguacaaucuugg

SEQ ID NO: 822412 - RNA, 24 nt, Human
uggccaggauggucucgaucucuu

SEQ ID NO: 822413 - RNA, 22 nt, Human
ugggaauacaggcacgugccac

SEQ ID NO: 822414 - RNA, 24 nt, Human
ugggaauacaggcacgugccacca

SEQ ID NO: 822415 - RNA, 24 nt, Human
ugugauacaaguaaaggcacuaca

SEQ ID NO: 822416 - RNA, 24 nt, Human
ugugauccacccaccucagccucc

SEQ ID NO: 822417 - RNA, 24 nt, Human
uuaguagagacaggguuucaccau

SEQ ID NO: 822418 - RNA, 18 nt, Human
uucaagugauuauccugc

SEQ ID NO: 822419 - RNA, 21 nt, Human
uucacagucuuuauauuugua

SEQ ID NO: 822420 - RNA, 19 nt, Human
uuucaccauguuggccagg

SEQ ID NO: 822421 - RNA, 20 nt, Human
uuucaccauguuggccagga

SEQ ID NO: 822422 - RNA, 21 nt, Human
uuuccuagcaauaaaguguga

SEQ ID NO: 822423 - RNA, 19 nt, Human
uuuguagaguuucucucca

SEQ ID NO: 822424 - RNA, 24 nt, Human
uuuuuaguagagacaggguuucac

SEQ ID NO: 822425 - RNA, 20 nt, Human
uuuuuguauuuuuaguagag

SEQ ID NO: 822426 - RNA, 20 nt, Human
aaacaagacagaagccacga

SEQ ID NO: 822427 - RNA, 24 nt, Human
aaagaaaacaagacagaagccacg

SEQ ID NO: 822428 - RNA, 24 nt, Human
aacaaaagaggccucuaggaaaaa

SEQ ID NO: 822429 - RNA, 21 nt, Human
aaccaggccugcugacaccuu

SEQ ID NO: 822430 - RNA, 21 nt, Human
aaccccaaagaaagucuggug

SEQ ID NO: 822431 - RNA, 21 nt, Human
aaccgcacucgcaccgcaacc

SEQ ID NO: 822432 - RNA, 20 nt, Human
aacuaacuccaaaccucugc

SEQ ID NO: 822433 - RNA, 18 nt, Human
aacucucauuucuucaau

SEQ ID NO: 822434 - RNA, 24 nt, Human
aagaaaacaagacagaagccacgg

SEQ ID NO: 822435 - RNA, 28 nt, Human
aagcgaucaaagaaaacaagacagaagc

SEQ ID NO: 822436 - RNA, 23 nt, Human
aauucugucccccuaaauucuua

SEQ ID NO: 822437 - RNA, 23 nt, Human
acaaccccaaagaaagucuggug

SEQ ID NO: 822438 - RNA, 24 nt, Human
accgcacucgcaccgcaaccccgg

SEQ ID NO: 822439 - RNA, 21 nt, Human
acucgcaccgcaaccccggca

SEQ ID NO: 822440 - RNA, 21 nt, Human
agaaaacaagacagaagccac

SEQ ID NO: 822441 - RNA, 19 nt, Human
agaaagccacaaaauagga

SEQ ID NO: 822442 - RNA, 19 nt, Human
agacagaagccacgaugua

SEQ ID NO: 822443 - RNA, 21 nt, Human
agcaaagauguaguuguacaa

SEQ ID NO: 822444 - RNA, 18 nt, Human
agcauuuaaagaggugau

SEQ ID NO: 822445 - RNA, 19 nt, Human
agccuguggggcugggagc

SEQ ID NO: 822446 - RNA, 21 nt, Human
aggaaaaaccaggccugcuga

SEQ ID NO: 822447 - RNA, 22 nt, Human
aggcacaacgcgagucugaucu

SEQ ID NO: 822448 - RNA, 19 nt, Human
aggccgccgaaggccucuc

SEQ ID NO: 822449 - RNA, 24 nt, Human
aggccucucgcgcugcagcagucu

SEQ ID NO: 822450 - RNA, 22 nt, Human
aguaagcgaucaaagaaaacaa

SEQ ID NO: 822451 - RNA, 22 nt, Human
auauucuccgcugccccaggca

SEQ ID NO: 822452 - RNA, 22 nt, Human
auccuccuuucacuugcuauuc

SEQ ID NO: 822453 - RNA, 18 nt, Human
caaagaaagucugguguc

SEQ ID NO: 822454 - RNA, 21 nt, Human
caacaaaagaggccucuagga

SEQ ID NO: 822455 - RNA, 18 nt, Human
caaggcagugcggaggcc

SEQ ID NO: 822456 - RNA, 21 nt, Human
cacaaggacacagugagaaga

SEQ ID NO: 822457 - RNA, 22 nt, Human
caccugguucuguggcauuuug

SEQ ID NO: 822458 - RNA, 25 nt, Human
caccuugaucuugaacuucuagccu

SEQ ID NO: 822459 - RNA, 21 nt, Human
cagacccggagaaugccuuuc

SEQ ID NO: 822460 - RNA, 21 nt, Human
caugugaaugcuuggcuggaa

SEQ ID NO: 822461 - RNA, 24 nt, Human
cauuuaaagaggugauuaacuuaa

SEQ ID NO: 822462 - RNA, 22 nt, Human
ccacccaggugcaagaagccug

SEQ ID NO: 822463 - RNA, 18 nt, Human
ccaccugguucuguggca

SEQ ID NO: 822464 - RNA, 26 nt, Human
ccccaaaguaagcgaucaaagaaaaa

SEQ ID NO: 822465 - RNA, 18 nt, Human
ccccaggccuccuucugg

SEQ ID NO: 822466 - RNA, 27 nt, Human
ccccugguacuucuuagcaaagauugg

SEQ ID NO: 822467 - RNA, 20 nt, Human
ccuagcaaacugaaacccaa

SEQ ID NO: 822468 - RNA, 18 nt, Human
ccucagaagucaaacucu

SEQ ID NO: 822469 - RNA, 21 nt, Human
ccucuaggaaaaaccaggccu

SEQ ID NO: 822470 - RNA, 18 nt, Human
ccugccaccauccuccuu

SEQ ID NO: 822471 - RNA, 18 nt, Human
ccuguggggcugggagcg

SEQ ID NO: 822472 - RNA, 20 nt, Human
cgaaggccucucgcgcugca

SEQ ID NO: 822473 - RNA, 23 nt, Human
cgcacucgcaccgcaaccccggc

SEQ ID NO: 822474 - RNA, 21 nt, Human
cugaaacccaagccuucugcc

SEQ ID NO: 822475 - RNA, 20 nt, Human
cugacaccuugaucuugaac

SEQ ID NO: 822476 - RNA, 19 nt, Human
cugcucugaguccuugggg

SEQ ID NO: 822477 - RNA, 21 nt, Human
cugucugcaagccaacaaaag

SEQ ID NO: 822478 - RNA, 24 nt, Human
cugucugcaagccaacaaaagagg

SEQ ID NO: 822479 - RNA, 25 nt, Human
cugugaacuaacuccaaaccucugc

SEQ ID NO: 822480 - RNA, 22 nt, Human
cuuacguugagaaaccccugga

SEQ ID NO: 822481 - RNA, 24 nt, Human
cuuagcaaagauguaguuguacaa

SEQ ID NO: 822482 - RNA, 18 nt, Human
gagaagacagcugucugc

SEQ ID NO: 822483 - RNA, 21 nt, Human
gagaagacagcugucugcaag

SEQ ID NO: 822484 - RNA, 20 nt, Human
gaucaaagaaaacaagacag

SEQ ID NO: 822485 - RNA, 21 nt, Human
gcaaagauguaguuguacaag

SEQ ID NO: 822486 - RNA, 23 nt, Human
gccccaggccuccuucuggucuc

SEQ ID NO: 822487 - RNA, 21 nt, Human
gccucaggaugaagcuccccu

SEQ ID NO: 822488 - RNA, 19 nt, Human
gccuguggggcugggagcg

SEQ ID NO: 822489 - RNA, 20 nt, Human
gcugcucugaguccuugggg

SEQ ID NO: 822490 - RNA, 25 nt, Human
gcuuccccagccaauugacaaaaac

SEQ ID NO: 822491 - RNA, 23 nt, Human
ggaaggacgagguggauuugaag

SEQ ID NO: 822492 - RNA, 20 nt, Human
ggccagaggccgccgaaggc

SEQ ID NO: 822493 - RNA, 23 nt, Human
ggccagaggccgccgaaggccuc

SEQ ID NO: 822494 - RNA, 23 nt, Human
guccugcugcccagcugcuacgg

SEQ ID NO: 822495 - RNA, 20 nt, Human
gugaaggucuccaguccaag

SEQ ID NO: 822496 - RNA, 23 nt, Human
uaaaguuaaaauccaguccaacu

SEQ ID NO: 822497 - RNA, 24 nt, Human
uacaaggcagugcggaggccaccc

SEQ ID NO: 822498 - RNA, 19 nt, Human
uacccugccaccauccucc

SEQ ID NO: 822499 - RNA, 22 nt, Human
uacuuggagauugagcauuuaa

SEQ ID NO: 822500 - RNA, 18 nt, Human
uaggaaaaaccaggccug

SEQ ID NO: 822501 - RNA, 18 nt, Human
uaggaaaaaccaggccug

SEQ ID NO: 822502 - RNA, 22 nt, Human
uaggaagggugaaggucuccag

SEQ ID NO: 822503 - RNA, 30 nt, Human
ucaauaguguagugguuacacaagucgaau

SEQ ID NO: 822504 - RNA, 25 nt, Human
ucacacuucuccuuuuacaacccca

SEQ ID NO: 822505 - RNA, 21 nt, Human
ucacagguucuuagggcgauc

SEQ ID NO: 822506 - RNA, 19 nt, Human
uccaaggaccaggucugga

SEQ ID NO: 822507 - RNA, 20 nt, Human
ucccauggcuauugguggga

SEQ ID NO: 822508 - RNA, 20 nt, Human
uccccugguacuucuuagca

SEQ ID NO: 822509 - RNA, 23 nt, Human
ucccuugucauguggagcacucc

SEQ ID NO: 822510 - RNA, 18 nt, Human
uccuccuuucacuugcua

SEQ ID NO: 822511 - RNA, 22 nt, Human
uccucuagccucaggaugaagc

SEQ ID NO: 822512 - RNA, 20 nt, Human
uccuucagcaaacuucccga

SEQ ID NO: 822513 - RNA, 21 nt, Human
ucuaggaaaaaccaggccugc

SEQ ID NO: 822514 - RNA, 19 nt, Human
ucucugagugguucuggcu

SEQ ID NO: 822515 - RNA, 19 nt, Human
ucugaucuguguccucuag

SEQ ID NO: 822516 - RNA, 20 nt, Human
ucugaucuguguccucuagc

SEQ ID NO: 822517 - RNA, 18 nt, Human
ucugcuguguaaugugug

SEQ ID NO: 822518 - RNA, 20 nt, Human
ucugcuguguaaugugugaa

SEQ ID NO: 822519 - RNA, 24 nt, Human
ucuggcuuagggucucccauagag

SEQ ID NO: 822520 - RNA, 23 nt, Human
ucugugaacuaacuccaaaccuc

SEQ ID NO: 822521 - RNA, 19 nt, Human
ugaaggaccagcuuucaag

SEQ ID NO: 822522 - RNA, 24 nt, Human
ugaauagaagaaggcagggauggu

SEQ ID NO: 822523 - RNA, 21 nt, Human
ugagaaaccccuggaaccuca

SEQ ID NO: 822524 - RNA, 19 nt, Human
ugcaagccaacaaaagagg

SEQ ID NO: 822525 - RNA, 22 nt, Human
uggaagaccuuggcaguggagu

SEQ ID NO: 822526 - RNA, 19 nt, Human
uggcuggaauugaaggacc

SEQ ID NO: 822527 - RNA, 19 nt, Human
ugggaaggaaccacacaag

SEQ ID NO: 822528 - RNA, 25 nt, Human
ugguugggggccaacuuagaggcug

SEQ ID NO: 822529 - RNA, 24 nt, Human
uguaaugugugagaaaccagaccc

SEQ ID NO: 822530 - RNA, 19 nt, Human
ugucauguggagcacucca

SEQ ID NO: 822531 - RNA, 22 nt, Human
ugucauguggagcacuccauaa

SEQ ID NO: 822532 - RNA, 22 nt, Human
ugugcagucagagauuguuucc

SEQ ID NO: 822533 - RNA, 21 nt, Human
uucacugaagaccccaagaag

SEQ ID NO: 822534 - RNA, 22 nt, Human
aaaaaaaaaaaaaaugcugcaa

SEQ ID NO: 822535 - RNA, 21 nt, Human
aaaaaaaggcugggcguggug

SEQ ID NO: 822536 - RNA, 24 nt, Human
aaaaaagaaaaaaaaaaaaaaugc

SEQ ID NO: 822537 - RNA, 22 nt, Human
aaaaaaugcugcagcagccuac

SEQ ID NO: 822538 - RNA, 24 nt, Human
aaaaaggcugggcgugguggcuca

SEQ ID NO: 822539 - RNA, 20 nt, Human
aacacggugaaaccucgucu

SEQ ID NO: 822540 - RNA, 21 nt, Human
aacacggugaaaccucgucuc

SEQ ID NO: 822541 - RNA, 22 nt, Human
aacacuuuggguggccaaggca

SEQ ID NO: 822542 - RNA, 20 nt, Human
aacauagcgaaaccuugucu

SEQ ID NO: 822543 - RNA, 21 nt, Human
aacauagcgaaaccuugucuc

SEQ ID NO: 822544 - RNA, 24 nt, Human
aaccuugucucuacuuaaauauac

SEQ ID NO: 822545 - RNA, 24 nt, Human
aagcggagcuugcggugagccgag

SEQ ID NO: 822546 - RNA, 24 nt, Human
aauugcuugaaccugggaggugga

SEQ ID NO: 822547 - RNA, 19 nt, Human
acacggugaaaccucgucu

SEQ ID NO: 822548 - RNA, 22 nt, Human
acagagagauucugucucaaaa

SEQ ID NO: 822549 - RNA, 24 nt, Human
acagagugagacuccaucucaaaa

SEQ ID NO: 822550 - RNA, 27 nt, Human
accaugucacauaaaagcuccagcauc

SEQ ID NO: 822551 - RNA, 25 nt, Human
accucgucucuacuaaaaaauacaa

SEQ ID NO: 822552 - RNA, 25 nt, Human
accuugucucuacuuaaauauacaa

SEQ ID NO: 822553 - RNA, 28 nt, Human
acuccaucucaaaaaagaaaaaaaaaaa

SEQ ID NO: 822554 - RNA, 18 nt, Human
acugcaccccagccuggg

SEQ ID NO: 822555 - RNA, 18 nt, Human
acugcaccccagccuggg

SEQ ID NO: 822556 - RNA, 24 nt, Human
acugcaccccagccugggaagcgg

SEQ ID NO: 822557 - RNA, 24 nt, Human
acugcaccccagccugggcgacag

SEQ ID NO: 822558 - RNA, 24 nt, Human
acugcacucuagccuggaugacag

SEQ ID NO: 822559 - RNA, 26 nt, Human
acugcacucuagccuggaugacagag

SEQ ID NO: 822560 - RNA, 25 nt, Human
agaaaaaaaaaaaaaaugcugcagg

SEQ ID NO: 822561 - RNA, 22 nt, Human
agaauugcuugaaccugggagg

SEQ ID NO: 822562 - RNA, 21 nt, Human
agacagagaauugcuugaacc

SEQ ID NO: 822563 - RNA, 23 nt, Human
agacagagaauugcuugaaccug

SEQ ID NO: 822564 - RNA, 24 nt, Human
agcacuuugggagucugaggcagg

SEQ ID NO: 822565 - RNA, 22 nt, Human
agcagcggcccuagggcucggc

SEQ ID NO: 822566 - RNA, 23 nt, Human
agccaggcacgguggcucaugcc

SEQ ID NO: 822567 - RNA, 23 nt, Human
agccaggcgugguggugcaugcc

SEQ ID NO: 822568 - RNA, 22 nt, Human
agccuggaugacagagagauuc

SEQ ID NO: 822569 - RNA, 23 nt, Human
agccuggccaacauagcgaaacc

SEQ ID NO: 822570 - RNA, 24 nt, Human
agccugggcgacagagugagacuc

SEQ ID NO: 822571 - RNA, 24 nt, Human
aggcacgguggcucaugccuauaa

SEQ ID NO: 822572 - RNA, 21 nt, Human
aggcaggagaauggcgugaac

SEQ ID NO: 822573 - RNA, 24 nt, Human
aggcaggagaauggcgugaaccca

SEQ ID NO: 822574 - RNA, 27 nt, Human
aggcaggagaauggcgugaacccagga

SEQ ID NO: 822575 - RNA, 20 nt, Human
aggcaggcggaucacgaggu

SEQ ID NO: 822576 - RNA, 24 nt, Human
aggcaggcggaucacgaggucaga

SEQ ID NO: 822577 - RNA, 24 nt, Human
aggcagguggaucacgaggucagg

SEQ ID NO: 822578 - RNA, 24 nt, Human
aggcggagcuugcagugagccaag

SEQ ID NO: 822579 - RNA, 19 nt, Human
aggcggaucacgaggucag

SEQ ID NO: 822580 - RNA, 24 nt, Human
aggcgugguggugcaugccuguaa

SEQ ID NO: 822581 - RNA, 23 nt, Human
aggcugagacagagaauugcuug

SEQ ID NO: 822582 - RNA, 19 nt, Human
aggcugaggcaggagaaug

SEQ ID NO: 822583 - RNA, 19 nt, Human
agguggagguugcaguaag

SEQ ID NO: 822584 - RNA, 24 nt, Human
agguggagguugcaguaagccaag

SEQ ID NO: 822585 - RNA, 24 nt, Human
agguggaucacgaggucaggaguu

SEQ ID NO: 822586 - RNA, 24 nt, Human
aggugguggcgccuguagucccag

SEQ ID NO: 822587 - RNA, 20 nt, Human
aguacugcuuaccaguguag

SEQ ID NO: 822588 - RNA, 18 nt, Human
agucugaggcaggcggau

SEQ ID NO: 822589 - RNA, 22 nt, Human
aucacgaggucaggaguucaag

SEQ ID NO: 822590 - RNA, 24 nt, Human
aucgcaccacugcaccccagccug

SEQ ID NO: 822591 - RNA, 24 nt, Human
aucgugccacugcacucuagccug

SEQ ID NO: 822592 - RNA, 24 nt, Human
augacagagagauucugucucaaa

SEQ ID NO: 822593 - RNA, 18 nt, Human
auggcgccacugcacccc

SEQ ID NO: 822594 - RNA, 24 nt, Human
caacauagcgaaaccuugucucua

SEQ ID NO: 822595 - RNA, 24 nt, Human
caagaucgugccacugcacucuag

SEQ ID NO: 822596 - RNA, 22 nt, Human
caaggcagguggaucacgaggu

SEQ ID NO: 822597 - RNA, 24 nt, Human
caaggcagguggaucacgagguca

SEQ ID NO: 822598 - RNA, 24 nt, Human
cacaccuguaaucccagcacuuug

SEQ ID NO: 822599 - RNA, 22 nt, Human
cacauaaaagcuccagcaucag

SEQ ID NO: 822600 - RNA, 21 nt, Human
cacauucaagccuacaaaucu

SEQ ID NO: 822601 - RNA, 24 nt, Human
caccacugcaccccagccgggugc

SEQ ID NO: 822602 - RNA, 27 nt, Human
caccacugcaccccagccugggaagcg

SEQ ID NO: 822603 - RNA, 22 nt, Human
caccaugucacauaaaagcucc

SEQ ID NO: 822604 - RNA, 23 nt, Human
caccccagccugggaagcggagc

SEQ ID NO: 822605 - RNA, 23 nt, Human
caccccagccugggcgacagagu

SEQ ID NO: 822606 - RNA, 23 nt, Human
caccuguaaucccagcacuuugg

SEQ ID NO: 822607 - RNA, 24 nt, Human
caccuguaaucccagcacuuuggg

SEQ ID NO: 822608 - RNA, 26 nt, Human
cacugcaccccagccugggaagcgga

SEQ ID NO: 822609 - RNA, 23 nt, Human
cacugcaccccagccugggcgac

SEQ ID NO: 822610 - RNA, 24 nt, Human
cacugcaccccagccugggcgaca

SEQ ID NO: 822611 - RNA, 18 nt, Human
cacugcacucuagccugg

SEQ ID NO: 822612 - RNA, 19 nt, Human
cacugcacucuagccugga

SEQ ID NO: 822613 - RNA, 19 nt, Human
cacugcacucuagccugga

SEQ ID NO: 822614 - RNA, 22 nt, Human
cacugcacucuagccuggauga

SEQ ID NO: 822615 - RNA, 24 nt, Human
cacugcacucuagccuggaugaca

SEQ ID NO: 822616 - RNA, 18 nt, Human
cagcacuuugggagucug

SEQ ID NO: 822617 - RNA, 24 nt, Human
cagcacuuugggagucugaggcag

SEQ ID NO: 822618 - RNA, 25 nt, Human
cagcgacacuuccgaugggucuuga

SEQ ID NO: 822619 - RNA, 24 nt, Human
cagcuacucgggaggcugaggcag

SEQ ID NO: 822620 - RNA, 20 nt, Human
caggugccuuugucaaacuu

SEQ ID NO: 822621 - RNA, 24 nt, Human
caugccuauaaucccaacacuuug

SEQ ID NO: 822622 - RNA, 21 nt, Human
ccaacacuuuggguggccaag

SEQ ID NO: 822623 - RNA, 19 nt, Human
ccacugcaccccagccugg

SEQ ID NO: 822624 - RNA, 21 nt, Human
ccacugcaccccagccuggga

SEQ ID NO: 822625 - RNA, 23 nt, Human
ccacugcaccccagccugggaag

SEQ ID NO: 822626 - RNA, 21 nt, Human
ccacugcaccccagccugggc

SEQ ID NO: 822627 - RNA, 21 nt, Human
ccacugcaccccagccugggc

SEQ ID NO: 822628 - RNA, 23 nt, Human
ccacugcaccccagccugggcga

SEQ ID NO: 822629 - RNA, 24 nt, Human
ccacugcaccccagccugggcgac

SEQ ID NO: 822630 - RNA, 19 nt, Human
ccacugcacucuagccugg

SEQ ID NO: 822631 - RNA, 19 nt, Human
ccacugcacucuagccugg

SEQ ID NO: 822632 - RNA, 20 nt, Human
ccacugcacucuagccugga

SEQ ID NO: 822633 - RNA, 21 nt, Human
ccacugcacucuagccuggau

SEQ ID NO: 822634 - RNA, 24 nt, Human
ccacugcacucuagccuggaugac

SEQ ID NO: 822635 - RNA, 20 nt, Human
cccagccugggaagcggagc

SEQ ID NO: 822636 - RNA, 24 nt, Human
cccagccugggcgacagagugaga

SEQ ID NO: 822637 - RNA, 21 nt, Human
cccuccccaguuuuaagaguc

SEQ ID NO: 822638 - RNA, 19 nt, Human
ccuauaaucccaacacuuu

SEQ ID NO: 822639 - RNA, 22 nt, Human
ccuauaaucccaacacuuuggg

SEQ ID NO: 822640 - RNA, 24 nt, Human
ccuauaaucccaacacuuugggug

SEQ ID NO: 822641 - RNA, 22 nt, Human
ccuccucgcaccgccugucacg

SEQ ID NO: 822642 - RNA, 21 nt, Human
ccuggccaacauagcgaaacc

SEQ ID NO: 822643 - RNA, 24 nt, Human
ccuggccaacauagcgaaaccuug

SEQ ID NO: 822644 - RNA, 21 nt, Human
ccuggcuaacacggugaaacc

SEQ ID NO: 822645 - RNA, 24 nt, Human
ccuggcuaacacggugaaaccucg

SEQ ID NO: 822646 - RNA, 21 nt, Human
ccugggagguggagguugcag

SEQ ID NO: 822647 - RNA, 22 nt, Human
ccugggcgacagagugagacuc

SEQ ID NO: 822648 - RNA, 21 nt, Human
ccuguaaucccagcuacucgg

SEQ ID NO: 822649 - RNA, 19 nt, Human
ccuguagucccagcuacuc

SEQ ID NO: 822650 - RNA, 21 nt, Human
ccuguagucccagcuacucgg

SEQ ID NO: 822651 - RNA, 22 nt, Human
ccuguagucccagcuacucggg

SEQ ID NO: 822652 - RNA, 24 nt, Human
cgagaccauccuggcuaacacggu

SEQ ID NO: 822653 - RNA, 21 nt, Human
cgcaccacugcaccccagccu

SEQ ID NO: 822654 - RNA, 20 nt, Human
cgccacugcaccccagccug

SEQ ID NO: 822655 - RNA, 23 nt, Human
cgccacugcaccccagccugggc

SEQ ID NO: 822656 - RNA, 26 nt, Human
cgccacugcaccccagccugggcgac

SEQ ID NO: 822657 - RNA, 24 nt, Human
cgccuguagucccagcuacucggg

SEQ ID NO: 822658 - RNA, 20 nt, Human
cgccugucacgggacagucc

SEQ ID NO: 822659 - RNA, 23 nt, Human
cggcgggcgcgggccuggccucc

SEQ ID NO: 822660 - RNA, 18 nt, Human
cgggacaguccgagccaa

SEQ ID NO: 822661 - RNA, 18 nt, Human
cgggaggcugagacagag

SEQ ID NO: 822662 - RNA, 19 nt, Human
cgggaggcugagacagaga

SEQ ID NO: 822663 - RNA, 21 nt, Human
cuaaaaaauacaaaaaauuag

SEQ ID NO: 822664 - RNA, 19 nt, Human
cuacuaaaaaauacaaaaa

SEQ ID NO: 822665 - RNA, 18 nt, Human
cucaaaaaagaaaaaaaa

SEQ ID NO: 822666 - RNA, 19 nt, Human
cucaaaagaaagaaaaaaa

SEQ ID NO: 822667 - RNA, 21 nt, Human
cucaaaagaaagaaaaaaaaa

SEQ ID NO: 822668 - RNA, 22 nt, Human
cucacaccuguaaucccagcac

SEQ ID NO: 822669 - RNA, 24 nt, Human
cucacaccuguaaucccagcacuu

SEQ ID NO: 822670 - RNA, 24 nt, Human
cucaugccuauaaucccaacacuu

SEQ ID NO: 822671 - RNA, 19 nt, Human
cuccagcaucagccaggca

SEQ ID NO: 822672 - RNA, 22 nt, Human
cucuacuaaaaaauacaaaaaa

SEQ ID NO: 822673 - RNA, 18 nt, Human
cuggcuaacacggugaaa

SEQ ID NO: 822674 - RNA, 31 nt, Human
cugucggcagcagcggcccuagggcucuuuu

SEQ ID NO: 822675 - RNA, 24 nt, Human
cuugcggugagccgagauggcgcc

SEQ ID NO: 822676 - RNA, 19 nt, Human
gaaaccucgucucuacuaa

SEQ ID NO: 822677 - RNA, 23 nt, Human
gaacaauucuagaucagccaugg

SEQ ID NO: 822678 - RNA, 24 nt, Human
gacagagugagacuccaucucaaa

SEQ ID NO: 822679 - RNA, 24 nt, Human
gagacagagaauugcuugaaccug

SEQ ID NO: 822680 - RNA, 18 nt, Human
gagcuugcagugagccaa

SEQ ID NO: 822681 - RNA, 23 nt, Human
gagcuugcagugagccaagaucg

SEQ ID NO: 822682 - RNA, 18 nt, Human
gagcuugcggugagccga

SEQ ID NO: 822683 - RNA, 21 nt, Human
gaggcugagacagagaauugc

SEQ ID NO: 822684 - RNA, 18 nt, Human
gagguugcaguaagccaa

SEQ ID NO: 822685 - RNA, 23 nt, Human
gagguugcaguaagccaagaucg

SEQ ID NO: 822686 - RNA, 24 nt, Human
gaucacgaggucagaagaucgaga

SEQ ID NO: 822687 - RNA, 22 nt, Human
gaucacgaggucaggaguucaa

SEQ ID NO: 822688 - RNA, 24 nt, Human
gaucacgaggucaggaguucaaga

SEQ ID NO: 822689 - RNA, 20 nt, Human
gcaccacugcaccccagccu

SEQ ID NO: 822690 - RNA, 22 nt, Human
gcaggagaauggcgugaaccca

SEQ ID NO: 822691 - RNA, 24 nt, Human
gccaacauagcgaaaccuugucuc

SEQ ID NO: 822692 - RNA, 20 nt, Human
gccaagaucgcaccacugca

SEQ ID NO: 822693 - RNA, 20 nt, Human
gccaagaucgugccacugca

SEQ ID NO: 822694 - RNA, 24 nt, Human
gccacugcaccccagccugggcga

SEQ ID NO: 822695 - RNA, 20 nt, Human
gccacugcacucuagccugg

SEQ ID NO: 822696 - RNA, 21 nt, Human
gccuggccuccucgcaccgcc

SEQ ID NO: 822697 - RNA, 23 nt, Human
gcggcccuagggcucggcgggcg

SEQ ID NO: 822698 - RNA, 19 nt, Human
gcuaacacggugaaaccuc

SEQ ID NO: 822699 - RNA, 22 nt, Human
gcugaggcaggagaauggcgug

SEQ ID NO: 822700 - RNA, 19 nt, Human
gcugggcgugguggcucac

SEQ ID NO: 822701 - RNA, 24 nt, Human
ggagcuugcagugagccaagaucg

SEQ ID NO: 822702 - RNA, 18 nt, Human
ggagcuugcggugagccg

SEQ ID NO: 822703 - RNA, 24 nt, Human
ggagcuugcggugagccgagaugg

SEQ ID NO: 822704 - RNA, 23 nt, Human
ggagguugcaguaagccaagauc

SEQ ID NO: 822705 - RNA, 24 nt, Human
ggagguugcaguaagccaagaucg

SEQ ID NO: 822706 - RNA, 20 nt, Human
ggcgggcgcgggccuggccu

SEQ ID NO: 822707 - RNA, 21 nt, Human
ggcucacaccuguaaucccag

SEQ ID NO: 822708 - RNA, 23 nt, Human
gggcaaggugguggcgccuguag

SEQ ID NO: 822709 - RNA, 24 nt, Human
gggcgugguggcucacaccuguaa

SEQ ID NO: 822710 - RNA, 24 nt, Human
gguggcucacaccuguaaucccag

SEQ ID NO: 822711 - RNA, 19 nt, Human
gguggcucaugccuauaau

SEQ ID NO: 822712 - RNA, 23 nt, Human
gguggcucaugccuauaauccca

SEQ ID NO: 822713 - RNA, 24 nt, Human
gguggugcaugccuguaaucccag

SEQ ID NO: 822714 - RNA, 22 nt, Human
ggugguggcgccuguaguccca

SEQ ID NO: 822715 - RNA, 23 nt, Human
guggaucacgaggucaggaguuc

SEQ ID NO: 822716 - RNA, 19 nt, Human
guggcgccuguagucccag

SEQ ID NO: 822717 - RNA, 24 nt, Human
uaacacggugaaaccucgucucua

SEQ ID NO: 822718 - RNA, 22 nt, Human
uaccaguguaguguaaacuucu

SEQ ID NO: 822719 - RNA, 24 nt, Human
ucacgaggucagaagaucgagacc

SEQ ID NO: 822720 - RNA, 24 nt, Human
ucacgaggucaggaguucaagacc

SEQ ID NO: 822721 - RNA, 18 nt, Human
ucagaagaucgagaccau

SEQ ID NO: 822722 - RNA, 23 nt, Human
ucagccaggcacgguggcucaug

SEQ ID NO: 822723 - RNA, 23 nt, Human
uccaucucaaaaaagaaaaaaaa

SEQ ID NO: 822724 - RNA, 23 nt, Human
ucgcaccacugcaccccagccug

SEQ ID NO: 822725 - RNA, 22 nt, Human
ucggcgggcgcgggccuggccu

SEQ ID NO: 822726 - RNA, 22 nt, Human
ucgggaggcugagacagagaau

SEQ ID NO: 822727 - RNA, 20 nt, Human
ucuagccuggaugacagaga

SEQ ID NO: 822728 - RNA, 23 nt, Human
ucucuacuaaaaaauacaaaaaa

SEQ ID NO: 822729 - RNA, 24 nt, Human
ugaaccugggagguggagguugca

SEQ ID NO: 822730 - RNA, 23 nt, Human
ugagacagagaauugcuugaacc

SEQ ID NO: 822731 - RNA, 24 nt, Human
ugagacagagaauugcuugaaccu

SEQ ID NO: 822732 - RNA, 22 nt, Human
ugagccgagauggcgccacugc

SEQ ID NO: 822733 - RNA, 24 nt, Human
ugaggcaggagaauggcgugaacc

SEQ ID NO: 822734 - RNA, 25 nt, Human
ugaggcaggagaauggcgugaaccc

SEQ ID NO: 822735 - RNA, 24 nt, Human
ugaggcaggcggaucacgagguca

SEQ ID NO: 822736 - RNA, 23 nt, Human
ugccuguaaucccagcuacucgg

SEQ ID NO: 822737 - RNA, 24 nt, Human
ugccuguaaucccagcuacucggg

SEQ ID NO: 822738 - RNA, 18 nt, Human
ugcugaucuuccggggug

SEQ ID NO: 822739 - RNA, 21 nt, Human
ugcuugaaccugggaggugga

SEQ ID NO: 822740 - RNA, 22 nt, Human
uggaucacgaggucaggaguuc

SEQ ID NO: 822741 - RNA, 24 nt, Human
uggccaacauagcgaaaccuuguc

SEQ ID NO: 822742 - RNA, 21 nt, Human
uggcucacaccuguaauccca

SEQ ID NO: 822743 - RNA, 24 nt, Human
uggcucacaccuguaaucccagca

SEQ ID NO: 822744 - RNA, 21 nt, Human
uggcucaugccuauaauccca

SEQ ID NO: 822745 - RNA, 18 nt, Human
ugggagguggagguugca

SEQ ID NO: 822746 - RNA, 29 nt, Human
ugggagguggagguugcaguaacaacggu

SEQ ID NO: 822747 - RNA, 24 nt, Human
ugggagguggagguugcaguaagc

SEQ ID NO: 822748 - RNA, 24 nt, Human
ugggagucugaggcaggcggauca

SEQ ID NO: 822749 - RNA, 23 nt, Human
ugggcaaggugguggcgccugua

SEQ ID NO: 822750 - RNA, 18 nt, Human
ugggucuugacaucccac

SEQ ID NO: 822751 - RNA, 19 nt, Human
ugggucuugacaucccacc

SEQ ID NO: 822752 - RNA, 24 nt, Human
uggguggccaaggcagguggauca

SEQ ID NO: 822753 - RNA, 21 nt, Human
uggugcaugccuguaauccca

SEQ ID NO: 822754 - RNA, 22 nt, Human
uggugcaugccuguaaucccag

SEQ ID NO: 822755 - RNA, 20 nt, Human
ugguggcgccuguaguccca

SEQ ID NO: 822756 - RNA, 24 nt, Human
ugguggcucacaccuguaauccca

SEQ ID NO: 822757 - RNA, 24 nt, Human
ugguggugcaugccuguaauccca

SEQ ID NO: 822758 - RNA, 24 nt, Human
uggugugugaaacucucaucucua

SEQ ID NO: 822759 - RNA, 21 nt, Human
ugugugaaacucucaucucua

SEQ ID NO: 822760 - RNA, 24 nt, Human
uuagccaggcgugguggugcaugc

SEQ ID NO: 822761 - RNA, 18 nt, Human
uucaagccuacuguggca

SEQ ID NO: 822762 - RNA, 24 nt, Human
uugaaccugggagguggagguugc

SEQ ID NO: 822763 - RNA, 22 nt, Human
uugcaguaagccaagaucgugc

SEQ ID NO: 822764 - RNA, 22 nt, Human
uugcagugagccaagaucgcac

SEQ ID NO: 822765 - RNA, 22 nt, Human
uugcggugagccgagauggcgc

SEQ ID NO: 822766 - RNA, 24 nt, Human
uugcuugaaccugggagguggagg

SEQ ID NO: 822767 - RNA, 24 nt, Human
aaaaaaaaaaacccaaaaaacaaa

SEQ ID NO: 822768 - RNA, 24 nt, Human
aaaaaaaaaacccaaaaaacaaaa

SEQ ID NO: 822769 - RNA, 23 nt, Human
aaaaaaacaaacaaaaaaccuag

SEQ ID NO: 822770 - RNA, 24 nt, Human
aaaaaacaaaaaaacaaacaaaaa

SEQ ID NO: 822771 - RNA, 24 nt, Human
aaaaaacccaaaaaacaaaaaaac

SEQ ID NO: 822772 - RNA, 28 nt, Human
aaaaaacccaaaaaacaaaaaaacaaac

SEQ ID NO: 822773 - RNA, 21 nt, Human
aaaaaaguccacgaugccucu

SEQ ID NO: 822774 - RNA, 18 nt, Human
aaaaacccaaaaaacaaa

SEQ ID NO: 822775 - RNA, 26 nt, Human
aaaaacuucagaaugacacaacacau

SEQ ID NO: 822776 - RNA, 22 nt, Human
aaaacaaaaaaacaaacaaaaa

SEQ ID NO: 822777 - RNA, 20 nt, Human
aaagacuucugccccaaaua

SEQ ID NO: 822778 - RNA, 26 nt, Human
aacaaaaaaacaaacaaaaaaccuag

SEQ ID NO: 822779 - RNA, 21 nt, Human
aacaaaaaaacagaaaucuga

SEQ ID NO: 822780 - RNA, 20 nt, Human
aacaaucaaaugaacccaac

SEQ ID NO: 822781 - RNA, 19 nt, Human
aacauuggcuggaauugag

SEQ ID NO: 822782 - RNA, 23 nt, Human
aacauuggcuggaauugagucga

SEQ ID NO: 822783 - RNA, 19 nt, Human
aacccaaaaaacaaaaaaa

SEQ ID NO: 822784 - RNA, 24 nt, Human
aagaagaaaaaaaaaugugcauug

SEQ ID NO: 822785 - RNA, 22 nt, Human
aaguacuguuuucauaaccugg

SEQ ID NO: 822786 - RNA, 24 nt, Human
acacggaaaaaaauccagcacccc

SEQ ID NO: 822787 - RNA, 25 nt, Human
agaagaaaaaaaaaugugcauugag

SEQ ID NO: 822788 - RNA, 18 nt, Human
agacacggaaaaaaaucc

SEQ ID NO: 822789 - RNA, 22 nt, Human
aggaaggaaaucaguucuguaa

SEQ ID NO: 822790 - RNA, 22 nt, Human
agggagggggcggcggcggcgg

SEQ ID NO: 822791 - RNA, 19 nt, Human
agggggauuccagugugau

SEQ ID NO: 822792 - RNA, 18 nt, Human
agucuugcaaugcaauau

SEQ ID NO: 822793 - RNA, 21 nt, Human
agugugauuucaguacuuggg

SEQ ID NO: 822794 - RNA, 21 nt, Human
auauuuuuugugugugugugu

SEQ ID NO: 822795 - RNA, 28 nt, Human
auauuuuuugugugugugugugugugug

SEQ ID NO: 822796 - RNA, 20 nt, Human
augaaugugaaaauaccacc

SEQ ID NO: 822797 - RNA, 23 nt, Human
caaaaaacaaaaaaacaaacaaa

SEQ ID NO: 822798 - RNA, 24 nt, Human
caacacauccuguguuaaacaauc

SEQ ID NO: 822799 - RNA, 22 nt, Human
caacauguacagccaggaagga

SEQ ID NO: 822800 - RNA, 26 nt, Human
caagaagggguggaaaaagaagaaaa

SEQ ID NO: 822801 - RNA, 21 nt, Human
caagcuaaagaagagaacaac

SEQ ID NO: 822802 - RNA, 19 nt, Human
caaugcaauauccaugcuu

SEQ ID NO: 822803 - RNA, 24 nt, Human
cacaacacauccuguguuaaacaa

SEQ ID NO: 822804 - RNA, 21 nt, Human
caccccaacauguacagccag

SEQ ID NO: 822805 - RNA, 20 nt, Human
caccuucuuucagguucucu

SEQ ID NO: 822806 - RNA, 24 nt, Human
cagguauaaugaacuacaaacaag

SEQ ID NO: 822807 - RNA, 21 nt, Human
cauggcuauaaguuucaaugu

SEQ ID NO: 822808 - RNA, 23 nt, Human
ccaaaaaacaaaaaaacaaacaa

SEQ ID NO: 822809 - RNA, 23 nt, Human
ccaaagaaaguugcagagcuuau

SEQ ID NO: 822810 - RNA, 22 nt, Human
ccaaguacuguuuucauaaccu

SEQ ID NO: 822811 - RNA, 27 nt, Human
ccaauuuucugcaguaaaaaaaaaaaa

SEQ ID NO: 822812 - RNA, 19 nt, Human
ccacaagcuaaagaagaga

SEQ ID NO: 822813 - RNA, 26 nt, Human
ccagcaccccaacauguacagccagg

SEQ ID NO: 822814 - RNA, 22 nt, Human
cccaaaaaacaaaaaaacaaac

SEQ ID NO: 822815 - RNA, 25 nt, Human
cccaaaaaacaaaaaaacaaacaaa

SEQ ID NO: 822816 - RNA, 21 nt, Human
cccuaaauaccaaauuuucuc

SEQ ID NO: 822817 - RNA, 20 nt, Human
ccuacauauauauuuauaua

SEQ ID NO: 822818 - RNA, 20 nt, Human
ccugggagaaaaaaccaaac

SEQ ID NO: 822819 - RNA, 18 nt, Human
ccuuggccuuaaaaggga

SEQ ID NO: 822820 - RNA, 18 nt, Human
cgaggccacggcgcugcc

SEQ ID NO: 822821 - RNA, 19 nt, Human
cggaaaaaaauccagcacc

SEQ ID NO: 822822 - RNA, 18 nt, Human
cuaaagaagagaacaugu

SEQ ID NO: 822823 - RNA, 22 nt, Human
cugaaugccaaagaaaguugca

SEQ ID NO: 822824 - RNA, 19 nt, Human
cuuuucaacauuggcugga

SEQ ID NO: 822825 - RNA, 19 nt, Human
gaaaaaaccaaacucuuga

SEQ ID NO: 822826 - RNA, 20 nt, Human
gagaauuuugucuuugacaa

SEQ ID NO: 822827 - RNA, 26 nt, Human
gagggagggggcggcggcggcggcga

SEQ ID NO: 822828 - RNA, 20 nt, Human
gaguuuuuuuuuucuuuuuc

SEQ ID NO: 822829 - RNA, 23 nt, Human
gcaguaaaaaaaaaaaacccaaa

SEQ ID NO: 822830 - RNA, 25 nt, Human
gcggcggcggcggcgcgacuccuuu

SEQ ID NO: 822831 - RNA, 21 nt, Human
ggagaaaaaaccaaacucuug

SEQ ID NO: 822832 - RNA, 20 nt, Human
ggcggcggcggcggcgcgac

SEQ ID NO: 822833 - RNA, 21 nt, Human
gggcggcggcggcggcgcgac

SEQ ID NO: 822834 - RNA, 23 nt, Human
gggcuggcaaguuggauuagauu

SEQ ID NO: 822835 - RNA, 25 nt, Human
guauccuacauauauauuuauauau

SEQ ID NO: 822836 - RNA, 21 nt, Human
guggaaaaagaagaaaaaaaa

SEQ ID NO: 822837 - RNA, 20 nt, Human
guguguguguguguguggau

SEQ ID NO: 822838 - RNA, 18 nt, Human
uaaaaacaauacugauua

SEQ ID NO: 822839 - RNA, 21 nt, Human
uaacaaaaaaacagaaaucug

SEQ ID NO: 822840 - RNA, 23 nt, Human
uaacccagaaacgcugucauuua

SEQ ID NO: 822841 - RNA, 20 nt, Human
uaaccuggaguugaggaauu

SEQ ID NO: 822842 - RNA, 24 nt, Human
uacaaacaagaagggguggaaaaa

SEQ ID NO: 822843 - RNA, 18 nt, Human
uacaccauuauaaaagaa

SEQ ID NO: 822844 - RNA, 25 nt, Human
uaccaaauuuucuccaaccuaacau

SEQ ID NO: 822845 - RNA, 19 nt, Human
uacguguucucagacuguc

SEQ ID NO: 822846 - RNA, 21 nt, Human
uagaaaaaaguccacgaugcc

SEQ ID NO: 822847 - RNA, 18 nt, Human
uauaaacucuguaaggac

SEQ ID NO: 822848 - RNA, 24 nt, Human
uauauauauuuuuugugugugugu

SEQ ID NO: 822849 - RNA, 24 nt, Human
uauauauauuuuuugugugugugu

SEQ ID NO: 822850 - RNA, 20 nt, Human
uauauauuuauauauauaua

SEQ ID NO: 822851 - RNA, 19 nt, Human
uaugaaugugaaaauacca

SEQ ID NO: 822852 - RNA, 21 nt, Human
ucacaaacuuggguuuuuucu

SEQ ID NO: 822853 - RNA, 23 nt, Human
ucagaagacauauuuacuauuca

SEQ ID NO: 822854 - RNA, 19 nt, Human
ucaguuuuccaaguacugu

SEQ ID NO: 822855 - RNA, 20 nt, Human
uccauaaagacuucugcccc

SEQ ID NO: 822856 - RNA, 23 nt, Human
uccauaaagacuucugccccaaa

SEQ ID NO: 822857 - RNA, 20 nt, Human
ucugcaguaaaaaaaaaaaa

SEQ ID NO: 822858 - RNA, 19 nt, Human
ucugcuaugguuucucaug

SEQ ID NO: 822859 - RNA, 24 nt, Human
ucugcuaugguuucucauggaagu

SEQ ID NO: 822860 - RNA, 20 nt, Human
ucuuuuucuuuucaacauug

SEQ ID NO: 822861 - RNA, 23 nt, Human
ugaaaauaccaccaauuuucugc

SEQ ID NO: 822862 - RNA, 24 nt, Human
ugaaauaucacaaacuuggguuuu

SEQ ID NO: 822863 - RNA, 19 nt, Human
ugacacaccggugucucug

SEQ ID NO: 822864 - RNA, 24 nt, Human
ugagagggauuaacacuuuugaug

SEQ ID NO: 822865 - RNA, 23 nt, Human
ugagguacaccauuauaaaagaa

SEQ ID NO: 822866 - RNA, 18 nt, Human
uggaaaaagaagaaaaaa

SEQ ID NO: 822867 - RNA, 24 nt, Human
uggaaaaagaagaaaaaaaaaugu

SEQ ID NO: 822868 - RNA, 20 nt, Human
uggaagacuaaagacacgga

SEQ ID NO: 822869 - RNA, 23 nt, Human
uggaagacuaaagacacggaaaa

SEQ ID NO: 822870 - RNA, 20 nt, Human
uggaaucacugaaauaucac

SEQ ID NO: 822871 - RNA, 19 nt, Human
uggacauccaauggcaguu

SEQ ID NO: 822872 - RNA, 18 nt, Human
uggacgcgaggccacggc

SEQ ID NO: 822873 - RNA, 22 nt, Human
uguguguguggauuuauggaag

SEQ ID NO: 822874 - RNA, 18 nt, Human
ugugugugugugugugug

SEQ ID NO: 822875 - RNA, 22 nt, Human
ugugugugugugugugugugag

SEQ ID NO: 822876 - RNA, 24 nt, Human
uguuuuauucuucaaugcaaauua

SEQ ID NO: 822877 - RNA, 24 nt, Human
uucaccacaagcuaaagaagagaa

SEQ ID NO: 822878 - RNA, 18 nt, Human
uucagaaugacacaacac

SEQ ID NO: 822879 - RNA, 18 nt, Human
uucuuuggaaucacugaa

SEQ ID NO: 822880 - RNA, 18 nt, Human
uugcauccuauuuguuuu

SEQ ID NO: 822881 - RNA, 23 nt, Human
uugcuuguaguacugacugugug

SEQ ID NO: 822882 - RNA, 24 nt, Human
uugguaaaacauuuuuuccucauu

SEQ ID NO: 822883 - RNA, 22 nt, Human
uuuaacaacugaaugccaaaga

SEQ ID NO: 822884 - RNA, 19 nt, Human
uuucuuuucaacauuggcu

SEQ ID NO: 822885 - RNA, 21 nt, Human
uuuuucuuuucaacauuggcu

SEQ ID NO: 822886 - RNA, 24 nt, Human
aaaaaaaagaaagaaacauccaaa

SEQ ID NO: 822887 - RNA, 24 nt, Human
aaaaaaacgaugcacaguccaagg

SEQ ID NO: 822888 - RNA, 23 nt, Human
aaaaaaagaaaaguuuaaaauaa

SEQ ID NO: 822889 - RNA, 23 nt, Human
aaaaaaagaaagaaacauccaaa

SEQ ID NO: 822890 - RNA, 21 nt, Human
aaacaaaaaaaaaacgaugca

SEQ ID NO: 822891 - RNA, 19 nt, Human
aaacaggagaaugggguga

SEQ ID NO: 822892 - RNA, 24 nt, Human
aaacaggagaauggggugaaccca

SEQ ID NO: 822893 - RNA, 27 nt, Human
aaacaggagaauggggugaacccagga

SEQ ID NO: 822894 - RNA, 18 nt, Human
aaaguuccuauacguccu

SEQ ID NO: 822895 - RNA, 21 nt, Human
aacaaaacaaaaaaaaaacga

SEQ ID NO: 822896 - RNA, 19 nt, Human
aacauggugaaaccccauc

SEQ ID NO: 822897 - RNA, 20 nt, Human
aacauggugaaaccccaucu

SEQ ID NO: 822898 - RNA, 20 nt, Human
aacauggugaaaccccaucu

SEQ ID NO: 822899 - RNA, 21 nt, Human
aacauggugaaaccccaucuc

SEQ ID NO: 822900 - RNA, 19 nt, Human
aaccugcacauugugcaca

SEQ ID NO: 822901 - RNA, 20 nt, Human
aacuguaauaaaauggccca

SEQ ID NO: 822902 - RNA, 20 nt, Human
aacuucugcugggugaaguu

SEQ ID NO: 822903 - RNA, 25 nt, Human
aagaaagaaacauccaaaugcaugc

SEQ ID NO: 822904 - RNA, 21 nt, Human
aagacaccagacagggagaug

SEQ ID NO: 822905 - RNA, 21 nt, Human
aaggaagcaccauucaccacc

SEQ ID NO: 822906 - RNA, 18 nt, Human
aagggcuuaacccaugac

SEQ ID NO: 822907 - RNA, 20 nt, Human
aaguagacauuuuccaucaa

SEQ ID NO: 822908 - RNA, 22 nt, Human
aaguagacauuuuccaucaacu

SEQ ID NO: 822909 - RNA, 24 nt, Human
acaaaacaaaaaaaaaacgaugca

SEQ ID NO: 822910 - RNA, 18 nt, Human
acaaaggaaggaaacuga

SEQ ID NO: 822911 - RNA, 21 nt, Human
acaaagugagacucugucuca

SEQ ID NO: 822912 - RNA, 24 nt, Human
acaaagugagacucugucucaaaa

SEQ ID NO: 822913 - RNA, 23 nt, Human
acacccaccucggcaaaaggaca

SEQ ID NO: 822914 - RNA, 21 nt, Human
acagcacaaagaagagcacaa

SEQ ID NO: 822915 - RNA, 23 nt, Human
accacagcacaaagaagagcaca

SEQ ID NO: 822916 - RNA, 25 nt, Human
accacccaccagaggaaaaggggca

SEQ ID NO: 822917 - RNA, 24 nt, Human
accccaucucuacuaaaaauacaa

SEQ ID NO: 822918 - RNA, 20 nt, Human
accuggcaugugaauuuggc

SEQ ID NO: 822919 - RNA, 19 nt, Human
acuacacuucuacccccac

SEQ ID NO: 822920 - RNA, 18 nt, Human
acucgggaggcugaaaca

SEQ ID NO: 822921 - RNA, 28 nt, Human
acucugucucaaaaaaaaaaaaaaaaaa

SEQ ID NO: 822922 - RNA, 20 nt, Human
acugaauugcaaaagcuuug

SEQ ID NO: 822923 - RNA, 18 nt, Human
acugcacuccaggccggg

SEQ ID NO: 822924 - RNA, 19 nt, Human
agaaaauacagaaauaagg

SEQ ID NO: 822925 - RNA, 26 nt, Human
agacaaaaggucagagaagagggacc

SEQ ID NO: 822926 - RNA, 18 nt, Human
agcacccgggcacgaagg

SEQ ID NO: 822927 - RNA, 21 nt, Human
agccgggcgugguagcaggcc

SEQ ID NO: 822928 - RNA, 21 nt, Human
aggcggagcuugcagugagcc

SEQ ID NO: 822929 - RNA, 24 nt, Human
aggcggagcuugcagugagccgag

SEQ ID NO: 822930 - RNA, 24 nt, Human
aggcgggcggaucacgaggucagg

SEQ ID NO: 822931 - RNA, 21 nt, Human
agguggaggcgggcggaucac

SEQ ID NO: 822932 - RNA, 28 nt, Human
agucaccaauaacaaaacaaaaaaaaaa

SEQ ID NO: 822933 - RNA, 21 nt, Human
agugugcuccucuuaaauaac

SEQ ID NO: 822934 - RNA, 20 nt, Human
auaaauccuaucacuguucu

SEQ ID NO: 822935 - RNA, 22 nt, Human
auaacaccuuuacaggccuaca

SEQ ID NO: 822936 - RNA, 18 nt, Human
auaagacaaaaggucaga

SEQ ID NO: 822937 - RNA, 22 nt, Human
auaagauaaugcuggcuggcug

SEQ ID NO: 822938 - RNA, 21 nt, Human
augaugcuuuuuugucuucaa

SEQ ID NO: 822939 - RNA, 19 nt, Human
caaaaaaaaaacgaugcac

SEQ ID NO: 822940 - RNA, 21 nt, Human
caaaaaaaaaacgaugcacag

SEQ ID NO: 822941 - RNA, 23 nt, Human
caaaacaaaaaaaaaacgaugca

SEQ ID NO: 822942 - RNA, 25 nt, Human
caaaacaaaaaaaaaacgaugcaca

SEQ ID NO: 822943 - RNA, 19 nt, Human
caaagcacuaagauauguc

SEQ ID NO: 822944 - RNA, 25 nt, Human
caaauaggcacaaaauaaauccuau

SEQ ID NO: 822945 - RNA, 21 nt, Human
caaauauauuuucacacaucu

SEQ ID NO: 822946 - RNA, 21 nt, Human
caacugugucucuaggcugaa

SEQ ID NO: 822947 - RNA, 24 nt, Human
cacaccaacacggcacauguauac

SEQ ID NO: 822948 - RNA, 24 nt, Human
cacaccuguaauccuagcacuuug

SEQ ID NO: 822949 - RNA, 18 nt, Human
cacauguauacauaugua

SEQ ID NO: 822950 - RNA, 26 nt, Human
caccaaggagacugcagucaaauaaa

SEQ ID NO: 822951 - RNA, 23 nt, Human
caccaauaacaaaacaaaaaaaa

SEQ ID NO: 822952 - RNA, 23 nt, Human
caccaauaacaaaacaaaaaaaa

SEQ ID NO: 822953 - RNA, 19 nt, Human
caccacccaccagaggaaa

SEQ ID NO: 822954 - RNA, 19 nt, Human
caccagacagggagaugac

SEQ ID NO: 822955 - RNA, 23 nt, Human
caccuguaauccuagcacuuugg

SEQ ID NO: 822956 - RNA, 24 nt, Human
caccuguaauccuagcacuuuggg

SEQ ID NO: 822957 - RNA, 22 nt, Human
cacgaaggcagcaucacugaaa

SEQ ID NO: 822958 - RNA, 18 nt, Human
cacuaucacuauuggugg

SEQ ID NO: 822959 - RNA, 19 nt, Human
cacuaucacuauugguggc

SEQ ID NO: 822960 - RNA, 19 nt, Human
cacugcacuccaggccggg

SEQ ID NO: 822961 - RNA, 24 nt, Human
cacugcacuccaggccgggagaca

SEQ ID NO: 822962 - RNA, 18 nt, Human
cagggccucugaucucgg

SEQ ID NO: 822963 - RNA, 21 nt, Human
cauaaaggacucaagcacccg

SEQ ID NO: 822964 - RNA, 18 nt, Human
cauuauaucaaagugcuc

SEQ ID NO: 822965 - RNA, 18 nt, Human
ccaccaaagccaucuucc

SEQ ID NO: 822966 - RNA, 20 nt, Human
ccacugcacuccaggccggg

SEQ ID NO: 822967 - RNA, 22 nt, Human
ccacugcacuccaggccgggag

SEQ ID NO: 822968 - RNA, 23 nt, Human
ccacugcacuccaggccgggaga

SEQ ID NO: 822969 - RNA, 24 nt, Human
ccacugcacuccaggccgggagac

SEQ ID NO: 822970 - RNA, 19 nt, Human
ccauccccacagcagacug

SEQ ID NO: 822971 - RNA, 25 nt, Human
cccacagcagacugaauugcaaaag

SEQ ID NO: 822972 - RNA, 24 nt, Human
ccccuguagucccaguuacucggg

SEQ ID NO: 822973 - RNA, 20 nt, Human
cccuguagucccaguuacuc

SEQ ID NO: 822974 - RNA, 22 nt, Human
ccuccaccaaagccaucuuccc

SEQ ID NO: 822975 - RNA, 22 nt, Human
ccugguuaacauggugaaaccc

SEQ ID NO: 822976 - RNA, 23 nt, Human
ccugguuaacauggugaaacccc

SEQ ID NO: 822977 - RNA, 24 nt, Human
ccugguuaacauggugaaacccca

SEQ ID NO: 822978 - RNA, 21 nt, Human
ccuguagucccaguuacucgg

SEQ ID NO: 822979 - RNA, 22 nt, Human
cgaaaaguacugaaaaugcuau

SEQ ID NO: 822980 - RNA, 24 nt, Human
cgagaccauccugguuaacauggu

SEQ ID NO: 822981 - RNA, 19 nt, Human
cggcacauguauacauaug

SEQ ID NO: 822982 - RNA, 19 nt, Human
cggucaacuucugcugggu

SEQ ID NO: 822983 - RNA, 23 nt, Human
cuaacacacccaccucggcaaaa

SEQ ID NO: 822984 - RNA, 18 nt, Human
cucaaaaaaaaaaaaaaa

SEQ ID NO: 822985 - RNA, 24 nt, Human
cucacaccuguaauccuagcacuu

SEQ ID NO: 822986 - RNA, 23 nt, Human
cucauaauuaauuuacucccaaa

SEQ ID NO: 822987 - RNA, 19 nt, Human
cucugucucaaaaaaaaaa

SEQ ID NO: 822988 - RNA, 18 nt, Human
cugagugugguaucaugu

SEQ ID NO: 822989 - RNA, 23 nt, Human
cugguuaacauggugaaacccca

SEQ ID NO: 822990 - RNA, 19 nt, Human
cuguagcuuuaaaugcuuc

SEQ ID NO: 822991 - RNA, 23 nt, Human
cuuacaaucacuuuuuaccuguc

SEQ ID NO: 822992 - RNA, 24 nt, Human
cuucgccgggcgugguggcucaca

SEQ ID NO: 822993 - RNA, 18 nt, Human
cuugcagugagccgaguu

SEQ ID NO: 822994 - RNA, 26 nt, Human
gaaaagaagccaucccaagaauccua

SEQ ID NO: 822995 - RNA, 20 nt, Human
gaaagaaacauccaaaugca

SEQ ID NO: 822996 - RNA, 24 nt, Human
gacaaagugagacucugucucaaa

SEQ ID NO: 822997 - RNA, 20 nt, Human
gacuugggcaauguggccag

SEQ ID NO: 822998 - RNA, 24 nt, Human
gagacaaagugagacucugucuca

SEQ ID NO: 822999 - RNA, 18 nt, Human
gagcuugcagugagccga

SEQ ID NO: 823000 - RNA, 22 nt, Human
gagcuugcagugagccgaguuc

SEQ ID NO: 823001 - RNA, 23 nt, Human
gaguucgcgccacugcacuccag

SEQ ID NO: 823002 - RNA, 21 nt, Human
gcugagaaaaccacagcacaa

SEQ ID NO: 823003 - RNA, 20 nt, Human
gcuuugggauuucucuucca

SEQ ID NO: 823004 - RNA, 25 nt, Human
ggaaaaggggcaggcacacaacugu

SEQ ID NO: 823005 - RNA, 18 nt, Human
ggaagcaccauucaccac

SEQ ID NO: 823006 - RNA, 21 nt, Human
ggagaauggggugaacccagg

SEQ ID NO: 823007 - RNA, 18 nt, Human
ggagcuugcagugagccg

SEQ ID NO: 823008 - RNA, 24 nt, Human
ggagcuugcagugagccgaguucg

SEQ ID NO: 823009 - RNA, 23 nt, Human
ggaugagacgucugccaugugag

SEQ ID NO: 823010 - RNA, 22 nt, Human
ggcaggcacacaacugugucuc

SEQ ID NO: 823011 - RNA, 19 nt, Human
ggcccagauuguggauuuc

SEQ ID NO: 823012 - RNA, 18 nt, Human
ggcucacaccuguaaucc

SEQ ID NO: 823013 - RNA, 18 nt, Human
gggagggauagcacuggg

SEQ ID NO: 823014 - RNA, 18 nt, Human
gggaguggggagggauag

SEQ ID NO: 823015 - RNA, 21 nt, Human
gggcaauguggccaggagggc

SEQ ID NO: 823016 - RNA, 23 nt, Human
gggcaggcacacaacugugucuc

SEQ ID NO: 823017 - RNA, 20 nt, Human
gggccucugaucucggucaa

SEQ ID NO: 823018 - RNA, 24 nt, Human
gggcggaucacgaggucaggagau

SEQ ID NO: 823019 - RNA, 24 nt, Human
gggcgugguggcucacaccuguaa

SEQ ID NO: 823020 - RNA, 19 nt, Human
ggggaguggggagggauag

SEQ ID NO: 823021 - RNA, 22 nt, Human
ggggugggggaguggggaggga

SEQ ID NO: 823022 - RNA, 21 nt, Human
gggugggggaguggggaggga

SEQ ID NO: 823023 - RNA, 20 nt, Human
ggucagaaaaaucaacauuu

SEQ ID NO: 823024 - RNA, 24 nt, Human
gguggcucacaccuguaauccuag

SEQ ID NO: 823025 - RNA, 18 nt, Human
ggugggggaguggggagg

SEQ ID NO: 823026 - RNA, 20 nt, Human
gucagagaagaggggauuca

SEQ ID NO: 823027 - RNA, 19 nt, Human
gucauuuuucaguuuuccu

SEQ ID NO: 823028 - RNA, 19 nt, Human
gugcagcacaccaacacgg

SEQ ID NO: 823029 - RNA, 21 nt, Human
gugccacacuggaacagugcu

SEQ ID NO: 823030 - RNA, 25 nt, Human
uaaaaaaaagaaagaaacauccaaa

SEQ ID NO: 823031 - RNA, 27 nt, Human
uaaauacauaauacagaagccugugug

SEQ ID NO: 823032 - RNA, 22 nt, Human
uaaaugcuuccaaguccuccca

SEQ ID NO: 823033 - RNA, 19 nt, Human
uaacaaaacaaaaaaaaaa

SEQ ID NO: 823034 - RNA, 22 nt, Human
uaacaaaacaaaaaaaaaacga

SEQ ID NO: 823035 - RNA, 26 nt, Human
uaacaaaacaaaaaaaaaacgaugca

SEQ ID NO: 823036 - RNA, 22 nt, Human
uaacauggugaaaccccaucuc

SEQ ID NO: 823037 - RNA, 24 nt, Human
uaacauggugaaaccccaucucua

SEQ ID NO: 823038 - RNA, 22 nt, Human
uaaggaagcaccauucaccacc

SEQ ID NO: 823039 - RNA, 24 nt, Human
uaauaaaaaaaagaaagaaacauc

SEQ ID NO: 823040 - RNA, 21 nt, Human
uaauaaaauggcccagauugu

SEQ ID NO: 823041 - RNA, 21 nt, Human
uaccguuaaaaauaaugggaa

SEQ ID NO: 823042 - RNA, 21 nt, Human
uaccugaaggggaagggaagu

SEQ ID NO: 823043 - RNA, 22 nt, Human
uacuuuuaaaaccuccaccaaa

SEQ ID NO: 823044 - RNA, 24 nt, Human
uagcacuuugggagguggaggcgg

SEQ ID NO: 823045 - RNA, 23 nt, Human
uagcuauaagacaaaaggucaga

SEQ ID NO: 823046 - RNA, 19 nt, Human
uaggcugaaagugacauuc

SEQ ID NO: 823047 - RNA, 19 nt, Human
uaugucuuauggucagaaa

SEQ ID NO: 823048 - RNA, 18 nt, Human
uauuagcugaauuuguga

SEQ ID NO: 823049 - RNA, 18 nt, Human
uauugguggcggcucuag

SEQ ID NO: 823050 - RNA, 19 nt, Human
uauuuuucccauuuuguuu

SEQ ID NO: 823051 - RNA, 24 nt, Human
ucaaaaaaaaaaaaaaaaaaagaa

SEQ ID NO: 823052 - RNA, 18 nt, Human
ucacgaggucaggagauc

SEQ ID NO: 823053 - RNA, 24 nt, Human
ucacgaggucaggagaucgagacc

SEQ ID NO: 823054 - RNA, 21 nt, Human
ucauuuuucaguuuuccugag

SEQ ID NO: 823055 - RNA, 18 nt, Human
uccaugcaccauuccaga

SEQ ID NO: 823056 - RNA, 23 nt, Human
ucccuuguuuggucauuuuucag

SEQ ID NO: 823057 - RNA, 19 nt, Human
ucgcgccacugcacuccag

SEQ ID NO: 823058 - RNA, 19 nt, Human
ucguggggugggggagugg

SEQ ID NO: 823059 - RNA, 21 nt, Human
ucuacccccacuauucaaaua

SEQ ID NO: 823060 - RNA, 22 nt, Human
ucucuacuaaaaauacaaaaaa

SEQ ID NO: 823061 - RNA, 23 nt, Human
ucugucucaaaaaaaaaaaaaaa

SEQ ID NO: 823062 - RNA, 20 nt, Human
ugaaacaggagaauggggug

SEQ ID NO: 823063 - RNA, 24 nt, Human
ugaaacaggagaauggggugaacc

SEQ ID NO: 823064 - RNA, 19 nt, Human
ugaaaccccaucucuacua

SEQ ID NO: 823065 - RNA, 20 nt, Human
ugaaacgcucaguagauacc

SEQ ID NO: 823066 - RNA, 23 nt, Human
ugaaggggaagggaaguguaagu

SEQ ID NO: 823067 - RNA, 23 nt, Human
ugacugaaacgcucaguagauac

SEQ ID NO: 823068 - RNA, 24 nt, Human
ugacugaaacgcucaguagauacc

SEQ ID NO: 823069 - RNA, 22 nt, Human
ugagaaaaccacagcacaaaga

SEQ ID NO: 823070 - RNA, 22 nt, Human
ugagccgaguucgcgccacugc

SEQ ID NO: 823071 - RNA, 22 nt, Human
ugaguuauccuuauuuuuccca

SEQ ID NO: 823072 - RNA, 24 nt, Human
ugaguuauccuuauuuuucccauu

SEQ ID NO: 823073 - RNA, 20 nt, Human
ugccaggauauaaggaugag

SEQ ID NO: 823074 - RNA, 25 nt, Human
uggaggcgggcggaucacgagguca

SEQ ID NO: 823075 - RNA, 19 nt, Human
uggauuucuuggucuugau

SEQ ID NO: 823076 - RNA, 21 nt, Human
uggcaugugaauuuggcuuuu

SEQ ID NO: 823077 - RNA, 19 nt, Human
uggcucacaccuguaaucc

SEQ ID NO: 823078 - RNA, 19 nt, Human
uggcucacaccuguaaucc

SEQ ID NO: 823079 - RNA, 24 nt, Human
uggcucacaccuguaauccuagca

SEQ ID NO: 823080 - RNA, 24 nt, Human
ugggauuucucuuccagacaucuu

SEQ ID NO: 823081 - RNA, 20 nt, Human
uggggugaacccaggaggcg

SEQ ID NO: 823082 - RNA, 23 nt, Human
uggggugggggaguggggaggga

SEQ ID NO: 823083 - RNA, 23 nt, Human
ugguagcaggccccuguaguccc

SEQ ID NO: 823084 - RNA, 22 nt, Human
ugguggcucacaccuguaaucc

SEQ ID NO: 823085 - RNA, 27 nt, Human
uguauacauauguaacaaaccugcaca

SEQ ID NO: 823086 - RNA, 23 nt, Human
ugucaaaugacaaagcacuaaga

SEQ ID NO: 823087 - RNA, 18 nt, Human
ugucgaacacgagcugua

SEQ ID NO: 823088 - RNA, 19 nt, Human
ugucugccaggauauaagg

SEQ ID NO: 823089 - RNA, 22 nt, Human
ugugaaaggaucaagccauccc

SEQ ID NO: 823090 - RNA, 22 nt, Human
ugugucucuaggcugaaaguga

SEQ ID NO: 823091 - RNA, 23 nt, Human
uuaagauauggguuauaaaaugc

SEQ ID NO: 823092 - RNA, 23 nt, Human
uuaaugucacacccacauucaau

SEQ ID NO: 823093 - RNA, 24 nt, Human
uuagcugaauuugugauuuccuuu

SEQ ID NO: 823094 - RNA, 24 nt, Human
uuauggucagaaaaaucaacauuu

SEQ ID NO: 823095 - RNA, 19 nt, Human
uucuccaugcaccauucca

SEQ ID NO: 823096 - RNA, 23 nt, Human
uucuuggucuugauauucuccau

SEQ ID NO: 823097 - RNA, 19 nt, Human
uugcagugagccgaguucc

SEQ ID NO: 823098 - RNA, 22 nt, Human
uugcagugagccgaguucgcgc

SEQ ID NO: 823099 - RNA, 27 nt, Human
uugugccacacuggaacagugcuccgc

SEQ ID NO: 823100 - RNA, 22 nt, Human
uuuaaaaccuccaccaaagcca

SEQ ID NO: 823101 - RNA, 22 nt, Human
uuuaccugacacgaucaucaca

SEQ ID NO: 823102 - RNA, 23 nt, Human
uuuagaaaacuagaaaauacaga

SEQ ID NO: 823103 - RNA, 22 nt, Human
aaaaacccugaccaccacaggc

SEQ ID NO: 823104 - RNA, 18 nt, Human
aaaacccugaccaccaca

SEQ ID NO: 823105 - RNA, 24 nt, Human
aaacaaacgcaagauaugcuagac

SEQ ID NO: 823106 - RNA, 23 nt, Human
aaaugcugacaguugcucguaca

SEQ ID NO: 823107 - RNA, 23 nt, Human
aaauggcauuuuccaggugcccc

SEQ ID NO: 823108 - RNA, 21 nt, Human
aagcugguggcgaggcuaggc

SEQ ID NO: 823109 - RNA, 20 nt, Human
aaggcauuuuugguucucac

SEQ ID NO: 823110 - RNA, 22 nt, Human
acacagccacaguugaaaaacc

SEQ ID NO: 823111 - RNA, 26 nt, Human
acacagcuucaggguggagggaacgc

SEQ ID NO: 823112 - RNA, 25 nt, Human
acagcaaagaaugauccagccugga

SEQ ID NO: 823113 - RNA, 21 nt, Human
acagccacaguugaaaaaccc

SEQ ID NO: 823114 - RNA, 24 nt, Human
acaggccuucuuucccuuccccag

SEQ ID NO: 823115 - RNA, 18 nt, Human
accaaucacccaacguca

SEQ ID NO: 823116 - RNA, 20 nt, Human
accugcucacuguccuccuc

SEQ ID NO: 823117 - RNA, 19 nt, Human
agacauggccagccgccuc

SEQ ID NO: 823118 - RNA, 19 nt, Human
agcagugaggaaagaaggg

SEQ ID NO: 823119 - RNA, 19 nt, Human
agccacaguugaaaaaccc

SEQ ID NO: 823120 - RNA, 18 nt, Human
aggaaagaagggacucca

SEQ ID NO: 823121 - RNA, 24 nt, Human
aggagcagugaggaaagaagggac

SEQ ID NO: 823122 - RNA, 22 nt, Human
aggcagauggcacucaaccagg

SEQ ID NO: 823123 - RNA, 26 nt, Human
aggcaggcaggcagaaaaagggaccc

SEQ ID NO: 823124 - RNA, 18 nt, Human
aguugacaggaagcagaa

SEQ ID NO: 823125 - RNA, 19 nt, Human
aucccaucuuucucacugg

SEQ ID NO: 823126 - RNA, 24 nt, Human
augcauuuucccaugggaaaaaac

SEQ ID NO: 823127 - RNA, 21 nt, Human
caaagaaucccaucuuucuca

SEQ ID NO: 823128 - RNA, 22 nt, Human
caaagaaugauccagccuggau

SEQ ID NO: 823129 - RNA, 23 nt, Human
cacacagcuucaggguggaccaa

SEQ ID NO: 823130 - RNA, 24 nt, Human
cacagcuucaggguggaccaauca

SEQ ID NO: 823131 - RNA, 24 nt, Human
cacccaacgucagauucggcccgc

SEQ ID NO: 823132 - RNA, 18 nt, Human
caccuuaaagaaacauuc

SEQ ID NO: 823133 - RNA, 21 nt, Human
caccuuaaagaaacauucuug

SEQ ID NO: 823134 - RNA, 24 nt, Human
cacugauugcuguuaaaauucugg

SEQ ID NO: 823135 - RNA, 20 nt, Human
cacugggccugggcugcaca

SEQ ID NO: 823136 - RNA, 21 nt, Human
cacuguccuccucacucccug

SEQ ID NO: 823137 - RNA, 24 nt, Human
cagaaaaaugcugacaguugcucg

SEQ ID NO: 823138 - RNA, 25 nt, Human
cagauaggcagauggcacucaacca

SEQ ID NO: 823139 - RNA, 21 nt, Human
cagccaccaccauucuucuua

SEQ ID NO: 823140 - RNA, 23 nt, Human
cagcccccacagcaaagaaugau

SEQ ID NO: 823141 - RNA, 19 nt, Human
cagccuggauugucaacac

SEQ ID NO: 823142 - RNA, 21 nt, Human
cagccuggauugucaacacag

SEQ ID NO: 823143 - RNA, 20 nt, Human
caggacagcccccacagcaa

SEQ ID NO: 823144 - RNA, 22 nt, Human
caggacagcccccacagcaaag

SEQ ID NO: 823145 - RNA, 19 nt, Human
cagggcagcccaugaacuc

SEQ ID NO: 823146 - RNA, 19 nt, Human
ccacugggccugggcugca

SEQ ID NO: 823147 - RNA, 18 nt, Human
cccaacgucagauucggc

SEQ ID NO: 823148 - RNA, 21 nt, Human
cccacaguguccaggacagcc

SEQ ID NO: 823149 - RNA, 19 nt, Human
ccuggauugucaacacagc

SEQ ID NO: 823150 - RNA, 22 nt, Human
ccugguaugggccagggcagcc

SEQ ID NO: 823151 - RNA, 23 nt, Human
cgcaagauaugcuagacauggcc

SEQ ID NO: 823152 - RNA, 22 nt, Human
cgcuaaacaucccacagugucc

SEQ ID NO: 823153 - RNA, 26 nt, Human
cgucccgccucagugcuggcccgagc

SEQ ID NO: 823154 - RNA, 23 nt, Human
cucaccuuaaagaaacauucuug

SEQ ID NO: 823155 - RNA, 27 nt, Human
cuccucacucccuggcacacagcuuca

SEQ ID NO: 823156 - RNA, 23 nt, Human
cugaaccccaggaucugucccuu

SEQ ID NO: 823157 - RNA, 23 nt, Human
cugggugaggcccucgucccgcc

SEQ ID NO: 823158 - RNA, 20 nt, Human
cuuccuagcugcgacucugg

SEQ ID NO: 823159 - RNA, 24 nt, Human
gaaaaacccugaccaccacaggcc

SEQ ID NO: 823160 - RNA, 22 nt, Human
gacucugggguugggacaaggg

SEQ ID NO: 823161 - RNA, 19 nt, Human
gagccagggccgcagcccc

SEQ ID NO: 823162 - RNA, 21 nt, Human
gagcugccgagccagggccgc

SEQ ID NO: 823163 - RNA, 18 nt, Human
gagguucugggugaggcc

SEQ ID NO: 823164 - RNA, 19 nt, Human
gauuggaggcaggcaggca

SEQ ID NO: 823165 - RNA, 18 nt, Human
gcagggaagggcugcugg

SEQ ID NO: 823166 - RNA, 22 nt, Human
gccacaguugaaaaacccugac

SEQ ID NO: 823167 - RNA, 20 nt, Human
gcccccacugggccugggcu

SEQ ID NO: 823168 - RNA, 18 nt, Human
gcccugagccuucgucuc

SEQ ID NO: 823169 - RNA, 18 nt, Human
gccggcugcucccggggc

SEQ ID NO: 823170 - RNA, 20 nt, Human
ggccugauccucuggccccc

SEQ ID NO: 823171 - RNA, 18 nt, Human
gggaagggcugcuggagc

SEQ ID NO: 823172 - RNA, 21 nt, Human
gguggagaggagcagugagga

SEQ ID NO: 823173 - RNA, 22 nt, Human
gucuccuugcucugauuucgca

SEQ ID NO: 823174 - RNA, 23 nt, Human
guggaccaaucacccaacgucag

SEQ ID NO: 823175 - RNA, 28 nt, Human
uaaagaaacauucuugaaaaaucuguga

SEQ ID NO: 823176 - RNA, 23 nt, Human
uaacaacuggugacugaacccca

SEQ ID NO: 823177 - RNA, 18 nt, Human
uaccugcucacuguccuc

SEQ ID NO: 823178 - RNA, 22 nt, Human
uaggcagauggcacucaaccag

SEQ ID NO: 823179 - RNA, 18 nt, Human
uauggauacacuuucccc

SEQ ID NO: 823180 - RNA, 18 nt, Human
uauguggcaaugugugaa

SEQ ID NO: 823181 - RNA, 23 nt, Human
uauguggcaaugugugaaggcau

SEQ ID NO: 823182 - RNA, 25 nt, Human
ucccgccucagugcuggcccgagcu

SEQ ID NO: 823183 - RNA, 24 nt, Human
ucccggggccugauccucuggccc

SEQ ID NO: 823184 - RNA, 21 nt, Human
uccucauuccuaaggucccac

SEQ ID NO: 823185 - RNA, 23 nt, Human
ucgcauccuccuagcccaaggcc

SEQ ID NO: 823186 - RNA, 23 nt, Human
ucucuccuaaacaaacgcaagau

SEQ ID NO: 823187 - RNA, 21 nt, Human
ucugccggcugcucccggggc

SEQ ID NO: 823188 - RNA, 20 nt, Human
ugacaggaagcagaaguuau

SEQ ID NO: 823189 - RNA, 24 nt, Human
ugacugaaccccaggaucuguccc

SEQ ID NO: 823190 - RNA, 18 nt, Human
ugaggcccugagccuucg

SEQ ID NO: 823191 - RNA, 18 nt, Human
ugaguugacaggaagcag

SEQ ID NO: 823192 - RNA, 20 nt, Human
ugaguugacaggaagcagaa

SEQ ID NO: 823193 - RNA, 20 nt, Human
ugauugcuguuaaaauucug

SEQ ID NO: 823194 - RNA, 21 nt, Human
ugccugguaugggccagggca

SEQ ID NO: 823195 - RNA, 18 nt, Human
ugcuggaggccaaggcug

SEQ ID NO: 823196 - RNA, 20 nt, Human
ugcuggaggccaaggcugcc

SEQ ID NO: 823197 - RNA, 21 nt, Human
uggcaccugugcguguauaug

SEQ ID NO: 823198 - RNA, 24 nt, Human
ugggaaaaaacugugggcuuccua

SEQ ID NO: 823199 - RNA, 22 nt, Human
ugggccucaccacgagguucug

SEQ ID NO: 823200 - RNA, 21 nt, Human
ugggccugggcugcacauggc

SEQ ID NO: 823201 - RNA, 22 nt, Human
ugggguucaccaaagcuggugg

SEQ ID NO: 823202 - RNA, 18 nt, Human
ugguucucacaacugggc

SEQ ID NO: 823203 - RNA, 19 nt, Human
uguccaggacagcccccac

SEQ ID NO: 823204 - RNA, 21 nt, Human
ugugaggcccugagccuucgu

SEQ ID NO: 823205 - RNA, 18 nt, Human
uguuuuuuugagacagag

SEQ ID NO: 823206 - RNA, 20 nt, Human
uuccaggugccccaguccuc

SEQ ID NO: 823207 - RNA, 19 nt, Human
uugccugcagaggggauaa

SEQ ID NO: 823208 - RNA, 19 nt, Human
uugggacaagggagucaca

SEQ ID NO: 823209 - RNA, 19 nt, Human
uuguuuuuuugagacagag

SEQ ID NO: 823210 - RNA, 24 nt, Human
uuucucacugauugcuguuaaaau

SEQ ID NO: 823211 - RNA, 22 nt, Human
aaggcaucagaaggggaggggg

SEQ ID NO: 823212 - RNA, 20 nt, Human
agccaugccugcagcaaaug

SEQ ID NO: 823213 - RNA, 24 nt, Human
agcugggggcuguccggggugguu

SEQ ID NO: 823214 - RNA, 18 nt, Human
aggagggggugguggggc

SEQ ID NO: 823215 - RNA, 23 nt, Human
cagcagggccuggggcccagcuu

SEQ ID NO: 823216 - RNA, 23 nt, Human
cccggacaggccgggccuugaag

SEQ ID NO: 823217 - RNA, 22 nt, Human
ccuggguaggguggcccaaucc

SEQ ID NO: 823218 - RNA, 20 nt, Human
cucuggccagcagggccugg

SEQ ID NO: 823219 - RNA, 18 nt, Human
cuuggcaucuguggcucu

SEQ ID NO: 823220 - RNA, 19 nt, Human
gaaucagagcugggggcug

SEQ ID NO: 823221 - RNA, 19 nt, Human
gccugcagcaaauguggga

SEQ ID NO: 823222 - RNA, 20 nt, Human
ggagauccuggguagggugg

SEQ ID NO: 823223 - RNA, 19 nt, Human
ggcagagaaagcccaucuc

SEQ ID NO: 823224 - RNA, 21 nt, Human
ggcaggagacagccaugccug

SEQ ID NO: 823225 - RNA, 21 nt, Human
gggcugcggcagggaccccgg

SEQ ID NO: 823226 - RNA, 18 nt, Human
ggggagggggcugcggca

SEQ ID NO: 823227 - RNA, 22 nt, Human
ggguaggagggggugguggggc

SEQ ID NO: 823228 - RNA, 20 nt, Human
gguaggguggcccaaucccu

SEQ ID NO: 823229 - RNA, 22 nt, Human
guccauagucaagcucccagga

SEQ ID NO: 823230 - RNA, 25 nt, Human
uaaaaaaaaaggagacagucucugu

SEQ ID NO: 823231 - RNA, 22 nt, Human
uagaaaaggaaacagaagucag

SEQ ID NO: 823232 - RNA, 24 nt, Human
ucaaaguuaaaaaaaaaggagacc

SEQ ID NO: 823233 - RNA, 22 nt, Human
uccauagucaagcucccagagc

SEQ ID NO: 823234 - RNA, 18 nt, Human
uccccuucuacugucccc

SEQ ID NO: 823235 - RNA, 23 nt, Human
ucuacuguccccaggguggagau

SEQ ID NO: 823236 - RNA, 20 nt, Human
uggaaugguggcccggacag

SEQ ID NO: 823237 - RNA, 20 nt, Human
uggcucuggccagcagggcc

SEQ ID NO: 823238 - RNA, 22 nt, Human
ugucaaaguuaaaaaaaaagga

SEQ ID NO: 823239 - RNA, 19 nt, Human
uguggaaugguggcccgga

SEQ ID NO: 823240 - RNA, 20 nt, Human
aaaaaacauauucccaauaa

SEQ ID NO: 823241 - RNA, 19 nt, Human
aaaaaccuugccacauuca

SEQ ID NO: 823242 - RNA, 20 nt, Human
aaaagaaaucaaacucaucc

SEQ ID NO: 823243 - RNA, 24 nt, Human
aaaaugcugggauuacaggccuga

SEQ ID NO: 823244 - RNA, 18 nt, Human
aaacucaagucaaugcug

SEQ ID NO: 823245 - RNA, 24 nt, Human
aaagugcugggauuacaggcguga

SEQ ID NO: 823246 - RNA, 21 nt, Human
aaccaagcagggaaaauggaa

SEQ ID NO: 823247 - RNA, 24 nt, Human
aaccuuuuuauaaagcaucaauga

SEQ ID NO: 823248 - RNA, 23 nt, Human
aagaaaauuuuaacacacuucca

SEQ ID NO: 823249 - RNA, 18 nt, Human
aagaaacaaaaaacaggc

SEQ ID NO: 823250 - RNA, 24 nt, Human
aagaucccuuguccuagaaaacug

SEQ ID NO: 823251 - RNA, 21 nt, Human
aagcacacaccacgauggcaa

SEQ ID NO: 823252 - RNA, 19 nt, Human
aagcagggaaaauggaaug

SEQ ID NO: 823253 - RNA, 24 nt, Human
aaggucucucuuuauuauggauuc

SEQ ID NO: 823254 - RNA, 19 nt, Human
aagugcugggauuacaggc

SEQ ID NO: 823255 - RNA, 19 nt, Human
aagugcugggauuacaggc

SEQ ID NO: 823256 - RNA, 20 nt, Human
aaucaaacucauccaaauca

SEQ ID NO: 823257 - RNA, 24 nt, Human
aaugcugggauuacaggccugagc

SEQ ID NO: 823258 - RNA, 23 nt, Human
acaauacaguaucagcaccaaaa

SEQ ID NO: 823259 - RNA, 19 nt, Human
acaaugguuguagcauuac

SEQ ID NO: 823260 - RNA, 24 nt, Human
acccaugcuggagugcaguggcau

SEQ ID NO: 823261 - RNA, 20 nt, Human
acguuucccaggcuggucuu

SEQ ID NO: 823262 - RNA, 19 nt, Human
acuuguaagguuucucccc

SEQ ID NO: 823263 - RNA, 24 nt, Human
agaaugugaaguaaaggcuuugcc

SEQ ID NO: 823264 - RNA, 22 nt, Human
agacagcauaaauaugugugcc

SEQ ID NO: 823265 - RNA, 23 nt, Human
agacguggugacaaucauuacau

SEQ ID NO: 823266 - RNA, 24 nt, Human
agagauuccccugccucagccucc

SEQ ID NO: 823267 - RNA, 23 nt, Human
aggcugggaaaaguggcucaggu

SEQ ID NO: 823268 - RNA, 19 nt, Human
aguagcugggauuacaggc

SEQ ID NO: 823269 - RNA, 21 nt, Human
agugcaguggcaugaucauag

SEQ ID NO: 823270 - RNA, 23 nt, Human
agugcaguggcaugaucauagcu

SEQ ID NO: 823271 - RNA, 24 nt, Human
agugcaguggcaugaucauagcuc

SEQ ID NO: 823272 - RNA, 18 nt, Human
agugcugggauuacaggc

SEQ ID NO: 823273 - RNA, 24 nt, Human
auagcucacugcaaucuugaccuc

SEQ ID NO: 823274 - RNA, 21 nt, Human
aucacugucaacauugucuug

SEQ ID NO: 823275 - RNA, 21 nt, Human
auggagaaaaagcguuccaca

SEQ ID NO: 823276 - RNA, 24 nt, Human
augguguuucaccauguuaaccag

SEQ ID NO: 823277 - RNA, 21 nt, Human
auuacaggcgcaugccaccau

SEQ ID NO: 823278 - RNA, 22 nt, Human
caaaagaaaucaaacucaucca

SEQ ID NO: 823279 - RNA, 24 nt, Human
caagaaugcucucaccccuucuau

SEQ ID NO: 823280 - RNA, 23 nt, Human
caaucaauacugccuguccuagc

SEQ ID NO: 823281 - RNA, 22 nt, Human
cacaccacgauggcaaagaaug

SEQ ID NO: 823282 - RNA, 23 nt, Human
caccaaaaauuaguugaauuucc

SEQ ID NO: 823283 - RNA, 24 nt, Human
caccaugcccagcuaauuuuugua

SEQ ID NO: 823284 - RNA, 24 nt, Human
caccaugcugagcuaauuuuugua

SEQ ID NO: 823285 - RNA, 24 nt, Human
caccauguuaaccaggcuguucuc

SEQ ID NO: 823286 - RNA, 24 nt, Human
cacguuuauuacugaacacagcca

SEQ ID NO: 823287 - RNA, 20 nt, Human
cacguuucccaggcuggucu

SEQ ID NO: 823288 - RNA, 24 nt, Human
cacguuucccaggcuggucuugaa

SEQ ID NO: 823289 - RNA, 21 nt, Human
cacuaaaggcuuugacacacu

SEQ ID NO: 823290 - RNA, 21 nt, Human
cacugcaaucuugaccuccca

SEQ ID NO: 823291 - RNA, 22 nt, Human
cacugcaaucuugaccucccag

SEQ ID NO: 823292 - RNA, 18 nt, Human
cagagaaaaaacauauuc

SEQ ID NO: 823293 - RNA, 20 nt, Human
cagcaugaacaagauuaauu

SEQ ID NO: 823294 - RNA, 20 nt, Human
cagccuccugaguagcuggg

SEQ ID NO: 823295 - RNA, 20 nt, Human
cagcuugguucuucuccaau

SEQ ID NO: 823296 - RNA, 22 nt, Human
caggcaugugccaccaugccca

SEQ ID NO: 823297 - RNA, 21 nt, Human
caggcugaucucaaacuccug

SEQ ID NO: 823298 - RNA, 24 nt, Human
cagugugaacucugggauguugug

SEQ ID NO: 823299 - RNA, 19 nt, Human
caugcaagcuuugcuuugc

SEQ ID NO: 823300 - RNA, 19 nt, Human
caugccacacagcccaguc

SEQ ID NO: 823301 - RNA, 25 nt, Human
cauguuaaccaggcuguucucuaaa

SEQ ID NO: 823302 - RNA, 18 nt, Human
cauuacugaagacguggu

SEQ ID NO: 823303 - RNA, 20 nt, Human
ccaaagugcugggauuacag

SEQ ID NO: 823304 - RNA, 22 nt, Human
ccaaagugcugggauuacaggc

SEQ ID NO: 823305 - RNA, 22 nt, Human
ccaaagugcugggauuacaggc

SEQ ID NO: 823306 - RNA, 22 nt, Human
ccaaagugcugggauuacaggc

SEQ ID NO: 823307 - RNA, 24 nt, Human
ccaaagugcugggauuacaggcgu

SEQ ID NO: 823308 - RNA, 18 nt, Human
ccacgaucaucacacuug

SEQ ID NO: 823309 - RNA, 20 nt, Human
ccaugcuggagugcaguggc

SEQ ID NO: 823310 - RNA, 20 nt, Human
cccagguucaugccauccuc

SEQ ID NO: 823311 - RNA, 20 nt, Human
cccaugcuggagugcagugg

SEQ ID NO: 823312 - RNA, 23 nt, Human
ccuacacuacggauugccugaug

SEQ ID NO: 823313 - RNA, 19 nt, Human
ccuccaccuccuggguuca

SEQ ID NO: 823314 - RNA, 22 nt, Human
ccuccuggguucaagagauucc

SEQ ID NO: 823315 - RNA, 18 nt, Human
ccucuuaacauaaacacc

SEQ ID NO: 823316 - RNA, 24 nt, Human
ccugaccucaagugauuuacccac

SEQ ID NO: 823317 - RNA, 23 nt, Human
ccugaguagcugggauuacaggc

SEQ ID NO: 823318 - RNA, 23 nt, Human
ccugaguagcugggauuacaggc

SEQ ID NO: 823319 - RNA, 24 nt, Human
ccugccucagccuccugaguagcu

SEQ ID NO: 823320 - RNA, 23 nt, Human
ccuggguucaagagauuccccug

SEQ ID NO: 823321 - RNA, 20 nt, Human
cucaagugauuuacccaccu

SEQ ID NO: 823322 - RNA, 24 nt, Human
cucaagugauuuacccaccuuggc

SEQ ID NO: 823323 - RNA, 25 nt, Human
cucaagugauuuacccaccuuggcc

SEQ ID NO: 823324 - RNA, 27 nt, Human
cucaccccuucuauucaaucaauacug

SEQ ID NO: 823325 - RNA, 24 nt, Human
cucacugcaaucuugaccucccag

SEQ ID NO: 823326 - RNA, 23 nt, Human
cucagccuccugaguagcuggga

SEQ ID NO: 823327 - RNA, 21 nt, Human
cucagccucugaaaaugcugg

SEQ ID NO: 823328 - RNA, 24 nt, Human
cucccugcacagacuucacaauaa

SEQ ID NO: 823329 - RNA, 18 nt, Human
cuccugaccucaagugau

SEQ ID NO: 823330 - RNA, 20 nt, Human
cugaagacguugugagaauc

SEQ ID NO: 823331 - RNA, 21 nt, Human
cugaauugugauggaagguuu

SEQ ID NO: 823332 - RNA, 22 nt, Human
cugaguagcugggauuacaggc

SEQ ID NO: 823333 - RNA, 24 nt, Human
cugcaaucuugaccucccagguuc

SEQ ID NO: 823334 - RNA, 20 nt, Human
cuugacugaagaccuugcca

SEQ ID NO: 823335 - RNA, 19 nt, Human
cuugcaagcguucucucca

SEQ ID NO: 823336 - RNA, 19 nt, Human
cuuguaagguuucucccca

SEQ ID NO: 823337 - RNA, 19 nt, Human
cuuguaagguuucucucca

SEQ ID NO: 823338 - RNA, 19 nt, Human
cuuguaagguuucucucca

SEQ ID NO: 823339 - RNA, 19 nt, Human
cuuguaugguuucucucca

SEQ ID NO: 823340 - RNA, 19 nt, Human
cuuuugggcauugucccca

SEQ ID NO: 823341 - RNA, 21 nt, Human
gaaaaaacauauucccaauaa

SEQ ID NO: 823342 - RNA, 20 nt, Human
gaaaucaacaaaaauugauc

SEQ ID NO: 823343 - RNA, 24 nt, Human
gaccucaagugauuuacccaccuu

SEQ ID NO: 823344 - RNA, 24 nt, Human
gagauuccccugccucagccuccu

SEQ ID NO: 823345 - RNA, 26 nt, Human
gaguagcugggauuacaggcgcaugc

SEQ ID NO: 823346 - RNA, 23 nt, Human
gauggcaaagaauggaagagaag

SEQ ID NO: 823347 - RNA, 18 nt, Human
gauuacaggccugagcca

SEQ ID NO: 823348 - RNA, 19 nt, Human
gauuacaggccugagccac

SEQ ID NO: 823349 - RNA, 23 nt, Human
gauuacaggccugagccacugca

SEQ ID NO: 823350 - RNA, 18 nt, Human
gauuacaggcgcaugcca

SEQ ID NO: 823351 - RNA, 24 nt, Human
gauuacaggcgcaugccaccaugc

SEQ ID NO: 823352 - RNA, 18 nt, Human
gauuacaggcgugagcca

SEQ ID NO: 823353 - RNA, 21 nt, Human
gauuacaggcgugagccaugc

SEQ ID NO: 823354 - RNA, 21 nt, Human
gauuacaggcgugagccaugc

SEQ ID NO: 823355 - RNA, 18 nt, Human
gauuuccccacguuuccc

SEQ ID NO: 823356 - RNA, 22 nt, Human
gcauccuccaccuccuggguuc

SEQ ID NO: 823357 - RNA, 22 nt, Human
gcccagcuaauuuuuguauuuu

SEQ ID NO: 823358 - RNA, 22 nt, Human
gcgcugacugccuaugaaaggu

SEQ ID NO: 823359 - RNA, 22 nt, Human
gcucauguggcccaccugucuc

SEQ ID NO: 823360 - RNA, 24 nt, Human
gcucuuguugcucaggcuagagug

SEQ ID NO: 823361 - RNA, 23 nt, Human
gcugaucucaaacuccugaccuc

SEQ ID NO: 823362 - RNA, 19 nt, Human
gcuggagugcaguggcaug

SEQ ID NO: 823363 - RNA, 18 nt, Human
ggucuugaauaccugggc

SEQ ID NO: 823364 - RNA, 22 nt, Human
gguguuucaccauguuaaccag

SEQ ID NO: 823365 - RNA, 18 nt, Human
guagcugggauuacaggc

SEQ ID NO: 823366 - RNA, 24 nt, Human
gugauuuacccaccuuggccuacc

SEQ ID NO: 823367 - RNA, 22 nt, Human
guggcccaccugucucagccuc

SEQ ID NO: 823368 - RNA, 18 nt, Human
uaaauaagcgcugacugc

SEQ ID NO: 823369 - RNA, 22 nt, Human
uaaccaggcuguucucuaaauu

SEQ ID NO: 823370 - RNA, 18 nt, Human
uaacugagacggcaggca

SEQ ID NO: 823371 - RNA, 18 nt, Human
uaagaaauacuuaggaau

SEQ ID NO: 823372 - RNA, 24 nt, Human
uaagucaacucaaacucaagucaa

SEQ ID NO: 823373 - RNA, 24 nt, Human
uaauuuuuguauuuuuacuagaga

SEQ ID NO: 823374 - RNA, 22 nt, Human
uaauuuuuguauuuuuuguaga

SEQ ID NO: 823375 - RNA, 21 nt, Human
uacacuacggauugccugaug

SEQ ID NO: 823376 - RNA, 20 nt, Human
uacaggccugagccacugca

SEQ ID NO: 823377 - RNA, 21 nt, Human
uaccucaacaauagaaagaac

SEQ ID NO: 823378 - RNA, 18 nt, Human
uaccugggcucauguggc

SEQ ID NO: 823379 - RNA, 24 nt, Human
uacuagagaugguguuucaccaug

SEQ ID NO: 823380 - RNA, 24 nt, Human
uacuggaacuaacaaacauauuca

SEQ ID NO: 823381 - RNA, 20 nt, Human
uagaaaaucacagacucaac

SEQ ID NO: 823382 - RNA, 22 nt, Human
uagagaugguguuucaccaugu

SEQ ID NO: 823383 - RNA, 23 nt, Human
uagccagagcaauuaaauagcaa

SEQ ID NO: 823384 - RNA, 24 nt, Human
uagcucacugcaaucuugaccucc

SEQ ID NO: 823385 - RNA, 21 nt, Human
uauaacaaauuuacagagaaa

SEQ ID NO: 823386 - RNA, 21 nt, Human
uauauaccacuagaacagaau

SEQ ID NO: 823387 - RNA, 23 nt, Human
uauauaccacuagaacagaauga

SEQ ID NO: 823388 - RNA, 21 nt, Human
uaugaugacgugcaacgugug

SEQ ID NO: 823389 - RNA, 23 nt, Human
uauucccaauaaaacauguccaa

SEQ ID NO: 823390 - RNA, 24 nt, Human
uauuuuggugcaaaaauugugaaa

SEQ ID NO: 823391 - RNA, 19 nt, Human
ucaacucaaacucaaguca

SEQ ID NO: 823392 - RNA, 22 nt, Human
ucaaugcugaacugacucuaau

SEQ ID NO: 823393 - RNA, 21 nt, Human
ucacaugaugcaagaaugcuc

SEQ ID NO: 823394 - RNA, 18 nt, Human
ucacauucuucacauuuc

SEQ ID NO: 823395 - RNA, 19 nt, Human
ucacugcaaucuugaccuc

SEQ ID NO: 823396 - RNA, 23 nt, Human
ucacugcaaucuugaccucccag

SEQ ID NO: 823397 - RNA, 24 nt, Human
ucacugcaaucuugaccucccagg

SEQ ID NO: 823398 - RNA, 24 nt, Human
ucacugcauccuccaccuccuggg

SEQ ID NO: 823399 - RNA, 27 nt, Human
ucacugcauccuccaccuccuggguuc

SEQ ID NO: 823400 - RNA, 20 nt, Human
ucagccuccugaguagcugg

SEQ ID NO: 823401 - RNA, 21 nt, Human
ucaucauagaaauccuaaaca

SEQ ID NO: 823402 - RNA, 20 nt, Human
uccacaggggagugggaugg

SEQ ID NO: 823403 - RNA, 24 nt, Human
uccaucacccaugcuggagugcag

SEQ ID NO: 823404 - RNA, 18 nt, Human
ucccagguucaugccauc

SEQ ID NO: 823405 - RNA, 20 nt, Human
ucccagguucaugccauccu

SEQ ID NO: 823406 - RNA, 24 nt, Human
uccccugccucagccuccugagua

SEQ ID NO: 823407 - RNA, 24 nt, Human
uccgaaagccuugucaaaaacucu

SEQ ID NO: 823408 - RNA, 24 nt, Human
uccugaguagcugggauuacaggc

SEQ ID NO: 823409 - RNA, 19 nt, Human
uccuggguucaagagauuc

SEQ ID NO: 823410 - RNA, 24 nt, Human
uccuggguucaagagauuccccug

SEQ ID NO: 823411 - RNA, 21 nt, Human
ucucuccaguaugaguuaucc

SEQ ID NO: 823412 - RNA, 24 nt, Human
ucucucuccaucacccaugcugga

SEQ ID NO: 823413 - RNA, 22 nt, Human
ucucuuuuuauacucaugucuu

SEQ ID NO: 823414 - RNA, 24 nt, Human
ucugaaaaugcugggauuacaggc

SEQ ID NO: 823415 - RNA, 19 nt, Human
ucugauauucugcaaggag

SEQ ID NO: 823416 - RNA, 20 nt, Human
ucugauauucugcaaggagu

SEQ ID NO: 823417 - RNA, 21 nt, Human
ucugggaugcaaggaugguuc

SEQ ID NO: 823418 - RNA, 23 nt, Human
ucuguuguccaggcugaucucaa

SEQ ID NO: 823419 - RNA, 24 nt, Human
ucuguuguccaggcugaucucaaa

SEQ ID NO: 823420 - RNA, 23 nt, Human
ugacauuguaagauuucucucca

SEQ ID NO: 823421 - RNA, 20 nt, Human
ugaccucaagugauuuaccc

SEQ ID NO: 823422 - RNA, 20 nt, Human
ugacuaaaggucuugccaca

SEQ ID NO: 823423 - RNA, 23 nt, Human
ugacugaacaucuuaccacacuc

SEQ ID NO: 823424 - RNA, 21 nt, Human
ugagaagauguggcaagaagc

SEQ ID NO: 823425 - RNA, 21 nt, Human
ugagacggcaggcaugugcca

SEQ ID NO: 823426 - RNA, 23 nt, Human
ugaugcaagaaugcucucacccc

SEQ ID NO: 823427 - RNA, 22 nt, Human
ugauguggaaggucugccugcu

SEQ ID NO: 823428 - RNA, 19 nt, Human
ugccacacagcccaguccu

SEQ ID NO: 823429 - RNA, 22 nt, Human
ugccaucucaguucacugcauc

SEQ ID NO: 823430 - RNA, 24 nt, Human
ugccucagccuccugaguagcugg

SEQ ID NO: 823431 - RNA, 22 nt, Human
ugccugauggugaauaaguguu

SEQ ID NO: 823432 - RNA, 21 nt, Human
ugcgacuguaaacuuugucac

SEQ ID NO: 823433 - RNA, 24 nt, Human
ugcugggauuacaggcgugagcca

SEQ ID NO: 823434 - RNA, 19 nt, Human
uggagugcaguggcaugau

SEQ ID NO: 823435 - RNA, 19 nt, Human
uggagugcaguggcaugau

SEQ ID NO: 823436 - RNA, 21 nt, Human
uggagugcaguggcaugauca

SEQ ID NO: 823437 - RNA, 23 nt, Human
uggcaagaagcagagucaagcac

SEQ ID NO: 823438 - RNA, 18 nt, Human
uggcaugaucauagcuca

SEQ ID NO: 823439 - RNA, 24 nt, Human
uggcaugaucauagcucacugcaa

SEQ ID NO: 823440 - RNA, 23 nt, Human
uggcccaccugucucagccucug

SEQ ID NO: 823441 - RNA, 19 nt, Human
ugggauuacaggccugagc

SEQ ID NO: 823442 - RNA, 21 nt, Human
ugggauuacaggccugagcca

SEQ ID NO: 823443 - RNA, 22 nt, Human
ugggauuacaggccugagccac

SEQ ID NO: 823444 - RNA, 22 nt, Human
ugggauuacaggccugagccac

SEQ ID NO: 823445 - RNA, 24 nt, Human
ugggauuacaggccugagccacug

SEQ ID NO: 823446 - RNA, 24 nt, Human
ugggauuacaggccugagccacug

SEQ ID NO: 823447 - RNA, 21 nt, Human
ugggauuacaggcgcaugcca

SEQ ID NO: 823448 - RNA, 22 nt, Human
ugggauuacaggcgcaugccac

SEQ ID NO: 823449 - RNA, 24 nt, Human
ugggauuacaggcgcaugccacca

SEQ ID NO: 823450 - RNA, 25 nt, Human
ugggauuacaggcgcaugccaccau

SEQ ID NO: 823451 - RNA, 18 nt, Human
ugggauuacaggcgugag

SEQ ID NO: 823452 - RNA, 19 nt, Human
ugggauuacaggcgugagc

SEQ ID NO: 823453 - RNA, 21 nt, Human
ugggauuacaggcgugagcca

SEQ ID NO: 823454 - RNA, 21 nt, Human
ugggauuacaggcgugagcca

SEQ ID NO: 823455 - RNA, 22 nt, Human
ugggauuacaggcgugagccau

SEQ ID NO: 823456 - RNA, 23 nt, Human
ugggauuacaggcgugagccaug

SEQ ID NO: 823457 - RNA, 25 nt, Human
ugggauuacaggcgugagccaugcc

SEQ ID NO: 823458 - RNA, 26 nt, Human
ugggauuacaggcgugagccaugcca

SEQ ID NO: 823459 - RNA, 20 nt, Human
ugggcauuguccccauaacc

SEQ ID NO: 823460 - RNA, 21 nt, Human
ugggcauuguccccauaaccu

SEQ ID NO: 823461 - RNA, 24 nt, Human
ugggcucauguggcccaccugucu

SEQ ID NO: 823462 - RNA, 21 nt, Human
ugguaaauaagcgcugacugc

SEQ ID NO: 823463 - RNA, 21 nt, Human
uggugaauaaguguugacugc

SEQ ID NO: 823464 - RNA, 24 nt, Human
ugguguuucaccauguuaaccagg

SEQ ID NO: 823465 - RNA, 19 nt, Human
uguaagguuucuccccagu

SEQ ID NO: 823466 - RNA, 22 nt, Human
ugucaaaaacucuuacauuuuu

SEQ ID NO: 823467 - RNA, 22 nt, Human
ugucacauucuucacauucgua

SEQ ID NO: 823468 - RNA, 25 nt, Human
uguccuagaaaacuguauucaagag

SEQ ID NO: 823469 - RNA, 21 nt, Human
ugugagguuucucuccuguau

SEQ ID NO: 823470 - RNA, 20 nt, Human
uguggcaagaagcagaguca

SEQ ID NO: 823471 - RNA, 24 nt, Human
uguggcccaccugucucagccucu

SEQ ID NO: 823472 - RNA, 19 nt, Human
uguugcucaggcuagagug

SEQ ID NO: 823473 - RNA, 22 nt, Human
uguuuguagacgacaugaccuu

SEQ ID NO: 823474 - RNA, 22 nt, Human
uuaaaaacauauauagagacac

SEQ ID NO: 823475 - RNA, 18 nt, Human
uuaagucaacucaaacuc

SEQ ID NO: 823476 - RNA, 24 nt, Human
uuacuagagaugguguuucaccau

SEQ ID NO: 823477 - RNA, 24 nt, Human
uuauagacccagcuugguucuucu

SEQ ID NO: 823478 - RNA, 22 nt, Human
uuauauaccacuagaacagaau

SEQ ID NO: 823479 - RNA, 23 nt, Human
uucaagagauuccccugccucag

SEQ ID NO: 823480 - RNA, 23 nt, Human
uucacaauaacugagacggcagg

SEQ ID NO: 823481 - RNA, 19 nt, Human
uuccccugccucagccucc

SEQ ID NO: 823482 - RNA, 18 nt, Human
uugcucaggcuagagugu

SEQ ID NO: 823483 - RNA, 24 nt, Human
uugcucaggcuagaguguaauguu

SEQ ID NO: 823484 - RNA, 21 nt, Human
uuguagcauuacugaagacgu

SEQ ID NO: 823485 - RNA, 23 nt, Human
uuuacaaacuguuuauuucuuuu

SEQ ID NO: 823486 - RNA, 19 nt, Human
uuucauuauuccucuaccc

SEQ ID NO: 823487 - RNA, 19 nt, Human
uuucccaggcuggucuuga

SEQ ID NO: 823488 - RNA, 24 nt, Human
uuugcacaauacaguaucagcacc

SEQ ID NO: 823489 - RNA, 19 nt, Human
uuuguaagaucucucuuca

SEQ ID NO: 823490 - RNA, 19 nt, Human
uuuguaagguuucucucca

SEQ ID NO: 823491 - RNA, 20 nt, Human
uuuugcucuuguugcucagg

SEQ ID NO: 823492 - RNA, 23 nt, Human
uuuugcucuuguugcucaggcua

SEQ ID NO: 823493 - RNA, 20 nt, Human
uuuuguauuuuuacuagaga

SEQ ID NO: 823494 - RNA, 24 nt, Human
uuuuuacuagagaugguguuucac

SEQ ID NO: 823495 - RNA, 20 nt, Human
uuuuuguauuuuuacuagag

SEQ ID NO: 823496 - RNA, 18 nt, Human
uuuuuguauuuuuuguag

SEQ ID NO: 823497 - RNA, 23 nt, Human
uuuuuuaagacaguaucucucuc

SEQ ID NO: 823498 - RNA, 21 nt, Human
aagaggaggcggcggccagag

SEQ ID NO: 823499 - RNA, 21 nt, Human
accaggauguaggauggggcc

SEQ ID NO: 823500 - RNA, 21 nt, Human
acggacugaguugucuggaca

SEQ ID NO: 823501 - RNA, 19 nt, Human
agagccuccuccaagccac

SEQ ID NO: 823502 - RNA, 19 nt, Human
agccggccugccucggccu

SEQ ID NO: 823503 - RNA, 24 nt, Human
aggaugugcagggagcuggccucc

SEQ ID NO: 823504 - RNA, 20 nt, Human
aggccccggaucuucugcag

SEQ ID NO: 823505 - RNA, 18 nt, Human
agggagcuggccuccggg

SEQ ID NO: 823506 - RNA, 20 nt, Human
agggagcuggccuccgggga

SEQ ID NO: 823507 - RNA, 19 nt, Human
augcuggcgggagguggag

SEQ ID NO: 823508 - RNA, 24 nt, Human
cacaggccagcaucagggccgucc

SEQ ID NO: 823509 - RNA, 21 nt, Human
cacccacuccguaggccugca

SEQ ID NO: 823510 - RNA, 18 nt, Human
caccgccaccgcccccgc

SEQ ID NO: 823511 - RNA, 21 nt, Human
caccgcccccgcuggccccgc

SEQ ID NO: 823512 - RNA, 21 nt, Human
caccucggccccuggaagguc

SEQ ID NO: 823513 - RNA, 19 nt, Human
cacgcucucgcagccggcc

SEQ ID NO: 823514 - RNA, 26 nt, Human
cacuccguaggccugcauuucugcuu

SEQ ID NO: 823515 - RNA, 18 nt, Human
cagcagggacagccggcu

SEQ ID NO: 823516 - RNA, 22 nt, Human
cagcaucagggccguccugccu

SEQ ID NO: 823517 - RNA, 18 nt, Human
cagcgcaucggugaugcc

SEQ ID NO: 823518 - RNA, 20 nt, Human
cagcucacccuccucauccu

SEQ ID NO: 823519 - RNA, 21 nt, Human
cagcucacccuccucauccug

SEQ ID NO: 823520 - RNA, 23 nt, Human
cagcucccguggccucggcuccc

SEQ ID NO: 823521 - RNA, 20 nt, Human
cagcuccgcagcugccuccc

SEQ ID NO: 823522 - RNA, 21 nt, Human
cagcugccucccgcucccgcu

SEQ ID NO: 823523 - RNA, 18 nt, Human
caggaccuccacuguuuc

SEQ ID NO: 823524 - RNA, 24 nt, Human
caggaugaguuugucccccgccag

SEQ ID NO: 823525 - RNA, 24 nt, Human
caggccccggaucuucugcaggag

SEQ ID NO: 823526 - RNA, 21 nt, Human
caggccgaggccgccuccagc

SEQ ID NO: 823527 - RNA, 23 nt, Human
ccacccccauggccuccacuccc

SEQ ID NO: 823528 - RNA, 24 nt, Human
ccagcaaccucacucuccccacag

SEQ ID NO: 823529 - RNA, 20 nt, Human
ccagccgcgccuccucccgc

SEQ ID NO: 823530 - RNA, 20 nt, Human
ccaggcaggccgaggccgcc

SEQ ID NO: 823531 - RNA, 21 nt, Human
ccagggccgccuccagcuccg

SEQ ID NO: 823532 - RNA, 21 nt, Human
cccacaggcugcccccucuuc

SEQ ID NO: 823533 - RNA, 18 nt, Human
ccccacaggcugcccccu

SEQ ID NO: 823534 - RNA, 19 nt, Human
ccccgcugcccucggccuc

SEQ ID NO: 823535 - RNA, 21 nt, Human
cccgcagaaccuccagcuccc

SEQ ID NO: 823536 - RNA, 23 nt, Human
cccgcagaaccuccagcucccgg

SEQ ID NO: 823537 - RNA, 27 nt, Human
cccgcagcuguguggugucaccgccac

SEQ ID NO: 823538 - RNA, 20 nt, Human
ccgcagcugccucccgcucc

SEQ ID NO: 823539 - RNA, 21 nt, Human
ccgccaccgcccccgcuggcc

SEQ ID NO: 823540 - RNA, 23 nt, Human
ccgccaccgcccccgcuggcccc

SEQ ID NO: 823541 - RNA, 19 nt, Human
ccgcgccuccucccgcugg

SEQ ID NO: 823542 - RNA, 20 nt, Human
ccgcgccuccucccgcuggg

SEQ ID NO: 823543 - RNA, 24 nt, Human
ccgcucccgcugccggagagccuc

SEQ ID NO: 823544 - RNA, 21 nt, Human
ccgcugcccucggccucgcgg

SEQ ID NO: 823545 - RNA, 20 nt, Human
ccgcugggccagcucggccc

SEQ ID NO: 823546 - RNA, 28 nt, Human
ccguggccucggcucccguggccucagc

SEQ ID NO: 823547 - RNA, 20 nt, Human
ccguggcuccagcaaccuca

SEQ ID NO: 823548 - RNA, 21 nt, Human
ccuccaagccacggauccugg

SEQ ID NO: 823549 - RNA, 24 nt, Human
ccuccaagccacggauccuggucu

SEQ ID NO: 823550 - RNA, 19 nt, Human
ccucccgcugggccagcuc

SEQ ID NO: 823551 - RNA, 23 nt, Human
ccucccgggccugcuccagggcc

SEQ ID NO: 823552 - RNA, 19 nt, Human
ccucccgucccaggcucuc

SEQ ID NO: 823553 - RNA, 22 nt, Human
ccuccggggacuccugcugccu

SEQ ID NO: 823554 - RNA, 21 nt, Human
ccuccuccaagccacggaucc

SEQ ID NO: 823555 - RNA, 22 nt, Human
ccucucgugucuccugcugccu

SEQ ID NO: 823556 - RNA, 19 nt, Human
ccugcagggugguuacguc

SEQ ID NO: 823557 - RNA, 20 nt, Human
ccugcauuucugcuuccucu

SEQ ID NO: 823558 - RNA, 19 nt, Human
ccugccucggccuccgcgg

SEQ ID NO: 823559 - RNA, 21 nt, Human
ccuugugcuguuccaggcccc

SEQ ID NO: 823560 - RNA, 21 nt, Human
cgcagaaccuccagcucccgg

SEQ ID NO: 823561 - RNA, 25 nt, Human
cgccagcagccggcuggcccgagcc

SEQ ID NO: 823562 - RNA, 21 nt, Human
cgcucccgcugccggagagcc

SEQ ID NO: 823563 - RNA, 23 nt, Human
cgcuggguggggaggggcgcugg

SEQ ID NO: 823564 - RNA, 24 nt, Human
cggcccgcaggccccgcgccuccu

SEQ ID NO: 823565 - RNA, 22 nt, Human
cggccucgcggacacgcucucg

SEQ ID NO: 823566 - RNA, 19 nt, Human
cggcggccagagggucugg

SEQ ID NO: 823567 - RNA, 21 nt, Human
cgggagguggaggcgccuucc

SEQ ID NO: 823568 - RNA, 24 nt, Human
cguccggggcgcggggcgcggggg

SEQ ID NO: 823569 - RNA, 24 nt, Human
cgugcgcugcugcucccccguggc

SEQ ID NO: 823570 - RNA, 23 nt, Human
cuaccccuggguucuccacaccu

SEQ ID NO: 823571 - RNA, 24 nt, Human
cuaguauucucccgcucguucucc

SEQ ID NO: 823572 - RNA, 22 nt, Human
cucaaaguucuccaggaucugg

SEQ ID NO: 823573 - RNA, 24 nt, Human
cucacaggccagcaucagggccgu

SEQ ID NO: 823574 - RNA, 21 nt, Human
cuccaccucccgucccaggcu

SEQ ID NO: 823575 - RNA, 24 nt, Human
cuccagcaaccucacucuccccac

SEQ ID NO: 823576 - RNA, 20 nt, Human
cuccagccgcgccuccuccc

SEQ ID NO: 823577 - RNA, 18 nt, Human
cucccgucccaggcucuc

SEQ ID NO: 823578 - RNA, 19 nt, Human
cucccguggccucggcucc

SEQ ID NO: 823579 - RNA, 23 nt, Human
cuccgcagcugccucccgcuccc

SEQ ID NO: 823580 - RNA, 20 nt, Human
cuccugcugccucagggccu

SEQ ID NO: 823581 - RNA, 24 nt, Human
cucgcacuuccccagggccgccuc

SEQ ID NO: 823582 - RNA, 20 nt, Human
cucggcucccguggccucag

SEQ ID NO: 823583 - RNA, 27 nt, Human
cugcaaacucuccaccucccgucccag

SEQ ID NO: 823584 - RNA, 21 nt, Human
cugcagccuccucaucuaugg

SEQ ID NO: 823585 - RNA, 23 nt, Human
cugcaggaggcggccccucuccu

SEQ ID NO: 823586 - RNA, 21 nt, Human
cuggguggggaggggcgcugg

SEQ ID NO: 823587 - RNA, 19 nt, Human
cugucuggugagcacagcc

SEQ ID NO: 823588 - RNA, 28 nt, Human
cugugaccuuggcuccuguggccucagc

SEQ ID NO: 823589 - RNA, 28 nt, Human
cuguggccucagcucccguggccucggc

SEQ ID NO: 823590 - RNA, 18 nt, Human
cuugcaccugucucucca

SEQ ID NO: 823591 - RNA, 20 nt, Human
gagcacagccaccuguuccu

SEQ ID NO: 823592 - RNA, 19 nt, Human
gagccuccuccaagccacg

SEQ ID NO: 823593 - RNA, 18 nt, Human
gagcuggccuccggggac

SEQ ID NO: 823594 - RNA, 21 nt, Human
gcaaacucuccaccucccguc

SEQ ID NO: 823595 - RNA, 20 nt, Human
gcaggaggcggccccucucc

SEQ ID NO: 823596 - RNA, 19 nt, Human
gcccuagagcccguggccu

SEQ ID NO: 823597 - RNA, 21 nt, Human
gccgcagccucacgaucuccu

SEQ ID NO: 823598 - RNA, 23 nt, Human
gccuccacccccauggccuccac

SEQ ID NO: 823599 - RNA, 23 nt, Human
gccucuaccccuggguucuccac

SEQ ID NO: 823600 - RNA, 22 nt, Human
gccugaaucauccucugugagg

SEQ ID NO: 823601 - RNA, 18 nt, Human
gcgccuccuccuccgcca

SEQ ID NO: 823602 - RNA, 20 nt, Human
ggagagccuccuccaagcca

SEQ ID NO: 823603 - RNA, 22 nt, Human
ggagguccucccgggccugcuc

SEQ ID NO: 823604 - RNA, 23 nt, Human
ggcucugcuugcccagcacccac

SEQ ID NO: 823605 - RNA, 20 nt, Human
gggcgcggggcgcggggggc

SEQ ID NO: 823606 - RNA, 21 nt, Human
ggguggggaggggcgcugggc

SEQ ID NO: 823607 - RNA, 22 nt, Human
guccggggcgcggggcgcgggg

SEQ ID NO: 823608 - RNA, 21 nt, Human
guggucucugugucuguggcc

SEQ ID NO: 823609 - RNA, 23 nt, Human
uaggagacggcacaggucugugu

SEQ ID NO: 823610 - RNA, 19 nt, Human
ucaccgccaccgcccccgc

SEQ ID NO: 823611 - RNA, 21 nt, Human
uccacaccuguggcacugacu

SEQ ID NO: 823612 - RNA, 21 nt, Human
uccauguuugcuucuucuucu

SEQ ID NO: 823613 - RNA, 23 nt, Human
uccauguuugcuucuucuucugu

SEQ ID NO: 823614 - RNA, 18 nt, Human
ucccaggcucuccuucuc

SEQ ID NO: 823615 - RNA, 18 nt, Human
ucccccguggcccuggcc

SEQ ID NO: 823616 - RNA, 21 nt, Human
uccccgggaccguggccucua

SEQ ID NO: 823617 - RNA, 24 nt, Human
ucccgcaggcgggagucccggucu

SEQ ID NO: 823618 - RNA, 23 nt, Human
ucccggcucugcuccagccgcgc

SEQ ID NO: 823619 - RNA, 19 nt, Human
uccgccagcagccggcugg

SEQ ID NO: 823620 - RNA, 23 nt, Human
uccguaggccugcauuucugcuu

SEQ ID NO: 823621 - RNA, 18 nt, Human
uccugccgcagccucacg

SEQ ID NO: 823622 - RNA, 22 nt, Human
ucuccaggaucuggaccuucuc

SEQ ID NO: 823623 - RNA, 22 nt, Human
ucuccuucuccucuugucucuc

SEQ ID NO: 823624 - RNA, 24 nt, Human
ucugcuuccucugcuuuuguuuuu

SEQ ID NO: 823625 - RNA, 23 nt, Human
ucuggacagcagcaccucggccc

SEQ ID NO: 823626 - RNA, 18 nt, Human
ucuucucuggggaccucu

SEQ ID NO: 823627 - RNA, 18 nt, Human
ucuucuguggucuccauu

SEQ ID NO: 823628 - RNA, 23 nt, Human
ugcaaacucuccaccucccgucc

SEQ ID NO: 823629 - RNA, 21 nt, Human
ugcaguaggagacggcacagg

SEQ ID NO: 823630 - RNA, 21 nt, Human
ugccucggccuccgcggccuc

SEQ ID NO: 823631 - RNA, 20 nt, Human
ugcuguagcucuugcaccug

SEQ ID NO: 823632 - RNA, 20 nt, Human
uggcccuggccguggccagc

SEQ ID NO: 823633 - RNA, 19 nt, Human
uggccucagcucccguggc

SEQ ID NO: 823634 - RNA, 26 nt, Human
uggccuccauguuuguggucccuccu

SEQ ID NO: 823635 - RNA, 26 nt, Human
uggccuccauguuuguggucccugug

SEQ ID NO: 823636 - RNA, 18 nt, Human
uggccuccggggacuccu

SEQ ID NO: 823637 - RNA, 22 nt, Human
uggccucuaccccuggguucuc

SEQ ID NO: 823638 - RNA, 19 nt, Human
uggccugagcuccuguggg

SEQ ID NO: 823639 - RNA, 18 nt, Human
uggcgggagguggaggcg

SEQ ID NO: 823640 - RNA, 23 nt, Human
uggcuccuguggccucagcuccc

SEQ ID NO: 823641 - RNA, 23 nt, Human
uggcuuccaugguuucaucuccu

SEQ ID NO: 823642 - RNA, 18 nt, Human
uggggaggggcgcugggc

SEQ ID NO: 823643 - RNA, 23 nt, Human
ugggggcccccugcuuuccaugg

SEQ ID NO: 823644 - RNA, 26 nt, Human
ugucucguccuucucaaaguucucca

SEQ ID NO: 823645 - RNA, 22 nt, Human
ugucuggacagcagcaccucgg

SEQ ID NO: 823646 - RNA, 21 nt, Human
ugugcagggagcuggccuccg

SEQ ID NO: 823647 - RNA, 20 nt, Human
uguggccuccacccccaugg

SEQ ID NO: 823648 - RNA, 24 nt, Human
uuccauggcuggacauagaguucu

SEQ ID NO: 823649 - RNA, 23 nt, Human
uuccucugcuuuuguuuuugugg

SEQ ID NO: 823650 - RNA, 25 nt, Human
uucuccaggaucuggaccuucucca

SEQ ID NO: 823651 - RNA, 20 nt, Human
uucugugaccuuggcuccug

SEQ ID NO: 823652 - RNA, 21 nt, Human
uuguggccuccacccccaugg

SEQ ID NO: 823653 - RNA, 23 nt, Human
uuucuggagccacugagccauuu

SEQ ID NO: 823654 - RNA, 24 nt, Human
uuucugugaccuuggcuccugugg

SEQ ID NO: 823655 - RNA, 20 nt, Human
aaacaaauguaacauuacac

SEQ ID NO: 823656 - RNA, 22 nt, Human
aaacaaauguaacauuacacau

SEQ ID NO: 823657 - RNA, 22 nt, Human
aaaccaugcuuuagaaugcugg

SEQ ID NO: 823658 - RNA, 26 nt, Human
aagaaagaaauggaaaaaagggaccc

SEQ ID NO: 823659 - RNA, 23 nt, Human
aagaucccucaucuucuccagaa

SEQ ID NO: 823660 - RNA, 21 nt, Human
aaugcaggauucugagaaaga

SEQ ID NO: 823661 - RNA, 19 nt, Human
acuguaaugcaggauucug

SEQ ID NO: 823662 - RNA, 19 nt, Human
acuuugguucugaagaaag

SEQ ID NO: 823663 - RNA, 21 nt, Human
agaaugcugguuucuaacggg

SEQ ID NO: 823664 - RNA, 23 nt, Human
agaggcuguuuguguggaaggca

SEQ ID NO: 823665 - RNA, 18 nt, Human
agauaagcuacaaacacc

SEQ ID NO: 823666 - RNA, 19 nt, Human
agaugcaaagccuggaacc

SEQ ID NO: 823667 - RNA, 18 nt, Human
agaugucagggacugugc

SEQ ID NO: 823668 - RNA, 21 nt, Human
agccuuauggcaggaggaaga

SEQ ID NO: 823669 - RNA, 19 nt, Human
aggaagauggugaauccaa

SEQ ID NO: 823670 - RNA, 19 nt, Human
auaagcuacaaacaccugu

SEQ ID NO: 823671 - RNA, 20 nt, Human
auauacacuauuuacaugua

SEQ ID NO: 823672 - RNA, 19 nt, Human
aucacucuguauaauaaau

SEQ ID NO: 823673 - RNA, 20 nt, Human
caaacaccuguucacacuua

SEQ ID NO: 823674 - RNA, 22 nt, Human
caaagccuggaaccaggaauuc

SEQ ID NO: 823675 - RNA, 21 nt, Human
caggauucugagaaagaauuc

SEQ ID NO: 823676 - RNA, 24 nt, Human
caucaaaucuuucuguggccugca

SEQ ID NO: 823677 - RNA, 26 nt, Human
ccuacugucagucucagaagguuuuc

SEQ ID NO: 823678 - RNA, 21 nt, Human
ccucacacaaaagucucucuc

SEQ ID NO: 823679 - RNA, 24 nt, Human
ccucccaaugaguauuuaagagcc

SEQ ID NO: 823680 - RNA, 23 nt, Human
cucucuucagagaauuaucuugg

SEQ ID NO: 823681 - RNA, 18 nt, Human
cuggaaccaggaauucuc

SEQ ID NO: 823682 - RNA, 21 nt, Human
cuggacuucauucuucuucuu

SEQ ID NO: 823683 - RNA, 18 nt, Human
cuggagcuucugggaggu

SEQ ID NO: 823684 - RNA, 23 nt, Human
cuuugcucuuggaaagcuucccu

SEQ ID NO: 823685 - RNA, 23 nt, Human
gaagauggugaauccaagucagg

SEQ ID NO: 823686 - RNA, 22 nt, Human
gaggaagauggugaauccaagu

SEQ ID NO: 823687 - RNA, 27 nt, Human
gcaaugagcccuucuccuccuggacuu

SEQ ID NO: 823688 - RNA, 21 nt, Human
gccaugccaaauguccagaga

SEQ ID NO: 823689 - RNA, 18 nt, Human
ggaaagcuucccuggagc

SEQ ID NO: 823690 - RNA, 22 nt, Human
ggcuccagaugcaaagccugga

SEQ ID NO: 823691 - RNA, 22 nt, Human
guaaaacuuuuugaaggucuac

SEQ ID NO: 823692 - RNA, 27 nt, Human
uaaaugucuuccucacacaaaagucuc

SEQ ID NO: 823693 - RNA, 19 nt, Human
uaagagccuagggcagugg

SEQ ID NO: 823694 - RNA, 20 nt, Human
uaagagugacuaaguagagg

SEQ ID NO: 823695 - RNA, 19 nt, Human
uagcagucucuccuuggcc

SEQ ID NO: 823696 - RNA, 22 nt, Human
uagcagucucuccuuggccccu

SEQ ID NO: 823697 - RNA, 20 nt, Human
uauaagagugacuaaguaga

SEQ ID NO: 823698 - RNA, 20 nt, Human
uaucuuggguaccaccaugu

SEQ ID NO: 823699 - RNA, 20 nt, Human
uauggagaaagugcuuuuca

SEQ ID NO: 823700 - RNA, 23 nt, Human
uauggcaggaggaagauggugaa

SEQ ID NO: 823701 - RNA, 19 nt, Human
ucacacuuaaaccaugcuu

SEQ ID NO: 823702 - RNA, 18 nt, Human
ucccagaagaaaauuuuc

SEQ ID NO: 823703 - RNA, 22 nt, Human
ucccucaucuucuccagaauua

SEQ ID NO: 823704 - RNA, 20 nt, Human
ucccugugagcaugaggagu

SEQ ID NO: 823705 - RNA, 18 nt, Human
ucuaugacuuguuguuug

SEQ ID NO: 823706 - RNA, 21 nt, Human
ucuccugucaaucccugugag

SEQ ID NO: 823707 - RNA, 23 nt, Human
ucuggccaugccaaauguccaga

SEQ ID NO: 823708 - RNA, 21 nt, Human
ucuuuuacagggaacaaaggc

SEQ ID NO: 823709 - RNA, 21 nt, Human
ucuuuugagcuaagauccugg

SEQ ID NO: 823710 - RNA, 21 nt, Human
ugaaaugagggggcuaggcca

SEQ ID NO: 823711 - RNA, 21 nt, Human
ugacuuguuguuugguggauu

SEQ ID NO: 823712 - RNA, 23 nt, Human
ugagaaagaauucuucuuaaacc

SEQ ID NO: 823713 - RNA, 24 nt, Human
ugagcccuucuccuccuggacuuc

SEQ ID NO: 823714 - RNA, 19 nt, Human
ugcuacaaaagaaaaugca

SEQ ID NO: 823715 - RNA, 21 nt, Human
ugcuuuucagaggcuguuugu

SEQ ID NO: 823716 - RNA, 25 nt, Human
uggaaaaaacuacagguuccucugc

SEQ ID NO: 823717 - RNA, 25 nt, Human
uggaaagcuucccuggagcuucugg

SEQ ID NO: 823718 - RNA, 18 nt, Human
uggagaaagugcuuuuca

SEQ ID NO: 823719 - RNA, 19 nt, Human
uggcaaggggaaggggucu

SEQ ID NO: 823720 - RNA, 23 nt, Human
uggguaccaccauguagcagucu

SEQ ID NO: 823721 - RNA, 24 nt, Human
uggugaauucucuccugucaaucc

SEQ ID NO: 823722 - RNA, 24 nt, Human
uuaaaccaugcuuuagaaugcugg

SEQ ID NO: 823723 - RNA, 19 nt, Human
uuaucuuggguaccaccau

SEQ ID NO: 823724 - RNA, 21 nt, Human
uucccagaagaaaauuuucuc

SEQ ID NO: 823725 - RNA, 21 nt, Human
uuccuggagugauucccagaa

SEQ ID NO: 823726 - RNA, 21 nt, Human
uucuccagaauuauguaugga

SEQ ID NO: 823727 - RNA, 24 nt, Human
uuucuguggccugcaaugagcccu

SEQ ID NO: 823728 - RNA, 20 nt, Human
aaacaaauacaugaaaccca

SEQ ID NO: 823729 - RNA, 21 nt, Human
aaacagucaauacaggagaac

SEQ ID NO: 823730 - RNA, 18 nt, Human
aaagaaggcagacacaaa

SEQ ID NO: 823731 - RNA, 22 nt, Human
aaagcaaguuccccaaagccaa

SEQ ID NO: 823732 - RNA, 28 nt, Human
aacaacaaugggggggauaccgguaccc

SEQ ID NO: 823733 - RNA, 22 nt, Human
aagaaagcaaggaaagauuaaa

SEQ ID NO: 823734 - RNA, 25 nt, Human
aagaaggcagacacaaaaggacaag

SEQ ID NO: 823735 - RNA, 23 nt, Human
aagagcaaaacucugucucaaaa

SEQ ID NO: 823736 - RNA, 21 nt, Human
aagcaaguuccccaaagccaa

SEQ ID NO: 823737 - RNA, 18 nt, Human
aagcaccugaaggaaaac

SEQ ID NO: 823738 - RNA, 22 nt, Human
aagcaccugaaggaaaacaguc

SEQ ID NO: 823739 - RNA, 21 nt, Human
aaggucuuagugucuuuucag

SEQ ID NO: 823740 - RNA, 20 nt, Human
aaguuccccaaagccaaucc

SEQ ID NO: 823741 - RNA, 18 nt, Human
aaucgcuugaaccuggga

SEQ ID NO: 823742 - RNA, 24 nt, Human
aaucgcuugaaccugggaggcgga

SEQ ID NO: 823743 - RNA, 20 nt, Human
acacagccuggcuccgucuc

SEQ ID NO: 823744 - RNA, 21 nt, Human
acaggagaaccacccucccca

SEQ ID NO: 823745 - RNA, 18 nt, Human
acccugcagucccuuccg

SEQ ID NO: 823746 - RNA, 18 nt, Human
acugcacucuaaccuggg

SEQ ID NO: 823747 - RNA, 21 nt, Human
acugcacucuaaccugggcaa

SEQ ID NO: 823748 - RNA, 18 nt, Human
agagcaaaacucugucuc

SEQ ID NO: 823749 - RNA, 20 nt, Human
agcaaaguuggcuaaagaaa

SEQ ID NO: 823750 - RNA, 21 nt, Human
agcagaugccuguaaucccag

SEQ ID NO: 823751 - RNA, 23 nt, Human
agccaggcccccacugccgggcc

SEQ ID NO: 823752 - RNA, 24 nt, Human
agccgcacagccugaagcaggagc

SEQ ID NO: 823753 - RNA, 23 nt, Human
agccuggccaauauggugaaacc

SEQ ID NO: 823754 - RNA, 23 nt, Human
agccuggccaauauggugaaacc

SEQ ID NO: 823755 - RNA, 24 nt, Human
agccuggccaauauggugaaaccu

SEQ ID NO: 823756 - RNA, 20 nt, Human
agccuggccguguagaaguc

SEQ ID NO: 823757 - RNA, 22 nt, Human
aggcaagagaaucgcuugaacc

SEQ ID NO: 823758 - RNA, 24 nt, Human
aggcaagagaaucgcuugaaccug

SEQ ID NO: 823759 - RNA, 21 nt, Human
aggcggagauugcagugagcc

SEQ ID NO: 823760 - RNA, 24 nt, Human
aggcggagauugcagugagccgag

SEQ ID NO: 823761 - RNA, 24 nt, Human
aggcgugguagcagaugccuguaa

SEQ ID NO: 823762 - RNA, 19 nt, Human
agggaucugaggcacagaa

SEQ ID NO: 823763 - RNA, 23 nt, Human
agguugacaacaaagcugaggug

SEQ ID NO: 823764 - RNA, 18 nt, Human
aguagagaccccaaagaa

SEQ ID NO: 823765 - RNA, 22 nt, Human
agugucuuuucagcuucaucca

SEQ ID NO: 823766 - RNA, 25 nt, Human
auaaauaaauaaaguucacaacuga

SEQ ID NO: 823767 - RNA, 21 nt, Human
aucccagcuacucgggaggca

SEQ ID NO: 823768 - RNA, 24 nt, Human
aucgugccacugcacucuaaccug

SEQ ID NO: 823769 - RNA, 24 nt, Human
auugcagugagccgagaucgugcc

SEQ ID NO: 823770 - RNA, 24 nt, Human
caaaaacaacauauuaagucaaag

SEQ ID NO: 823771 - RNA, 19 nt, Human
caaacccagucagaggaag

SEQ ID NO: 823772 - RNA, 23 nt, Human
caaagcaaguuccccaaagccaa

SEQ ID NO: 823773 - RNA, 21 nt, Human
caaagccaauccccucuacac

SEQ ID NO: 823774 - RNA, 18 nt, Human
caacauggaugaaccuca

SEQ ID NO: 823775 - RNA, 22 nt, Human
caauacaggagaaccacccucc

SEQ ID NO: 823776 - RNA, 23 nt, Human
caauauggugaaaccucguuuca

SEQ ID NO: 823777 - RNA, 22 nt, Human
caaugagauacugcucagccau

SEQ ID NO: 823778 - RNA, 20 nt, Human
cacaauugaacaaaaaguac

SEQ ID NO: 823779 - RNA, 25 nt, Human
cacacuuguaaucccagcucuuuug

SEQ ID NO: 823780 - RNA, 21 nt, Human
caccacguccaacccugcagu

SEQ ID NO: 823781 - RNA, 18 nt, Human
caccagaggcggcacggg

SEQ ID NO: 823782 - RNA, 23 nt, Human
cacgggcuggcgcucagucccuc

SEQ ID NO: 823783 - RNA, 18 nt, Human
cacucagggaucugaggc

SEQ ID NO: 823784 - RNA, 20 nt, Human
cacuccagcccugggguggu

SEQ ID NO: 823785 - RNA, 23 nt, Human
cacugcacucuaaccugggcaac

SEQ ID NO: 823786 - RNA, 24 nt, Human
cacugcacucuaaccugggcaaca

SEQ ID NO: 823787 - RNA, 23 nt, Human
cacuuguaaucccagcucuuuug

SEQ ID NO: 823788 - RNA, 24 nt, Human
cacuuguaaucccagcucuuuugg

SEQ ID NO: 823789 - RNA, 25 nt, Human
cagaggcaagagaaucgcuugaacc

SEQ ID NO: 823790 - RNA, 19 nt, Human
cagcacacugcuucaagug

SEQ ID NO: 823791 - RNA, 18 nt, Human
cagccuggcuccgucucc

SEQ ID NO: 823792 - RNA, 23 nt, Human
caggcccccacugccgggccacg

SEQ ID NO: 823793 - RNA, 22 nt, Human
cagucccucccucgccaggucc

SEQ ID NO: 823794 - RNA, 21 nt, Human
cauccagacagaauguugauu

SEQ ID NO: 823795 - RNA, 24 nt, Human
ccaaacaaauacaugaaacccaug

SEQ ID NO: 823796 - RNA, 23 nt, Human
ccaaagaacugaaagcagguacc

SEQ ID NO: 823797 - RNA, 20 nt, Human
ccaaagccaauccccucuac

SEQ ID NO: 823798 - RNA, 21 nt, Human
ccacuccuaaguagagacccc

SEQ ID NO: 823799 - RNA, 23 nt, Human
ccacuccuaaguagagaccccuu

SEQ ID NO: 823800 - RNA, 20 nt, Human
ccacugcacucuaaccuggg

SEQ ID NO: 823801 - RNA, 23 nt, Human
ccacugcacucuaaccugggcaa

SEQ ID NO: 823802 - RNA, 24 nt, Human
ccacugcacucuaaccugggcaac

SEQ ID NO: 823803 - RNA, 21 nt, Human
ccacugccgggccacgggcug

SEQ ID NO: 823804 - RNA, 24 nt, Human
cccaaagaacugaaagcagguacc

SEQ ID NO: 823805 - RNA, 21 nt, Human
cccaaaggguagaaaugcucc

SEQ ID NO: 823806 - RNA, 20 nt, Human
cccaacugugugaauauccc

SEQ ID NO: 823807 - RNA, 25 nt, Human
ccccaaagaacugaaagcagguacc

SEQ ID NO: 823808 - RNA, 19 nt, Human
ccccaaagccaauccccuc

SEQ ID NO: 823809 - RNA, 20 nt, Human
ccccaaagccaauccccucu

SEQ ID NO: 823810 - RNA, 21 nt, Human
ccccaaagccaauccccucua

SEQ ID NO: 823811 - RNA, 23 nt, Human
ccccaaagccaauccccucuaca

SEQ ID NO: 823812 - RNA, 24 nt, Human
ccccagucagugcgcugcccuccc

SEQ ID NO: 823813 - RNA, 24 nt, Human
cccgcucuuucccacccuuccuuu

SEQ ID NO: 823814 - RNA, 20 nt, Human
cccucccacagaaagcucug

SEQ ID NO: 823815 - RNA, 23 nt, Human
ccgccgggcaccacguccaaccc

SEQ ID NO: 823816 - RNA, 18 nt, Human
ccucuacacagccuggcu

SEQ ID NO: 823817 - RNA, 19 nt, Human
ccucuuccguggcuccuuc

SEQ ID NO: 823818 - RNA, 22 nt, Human
ccugaggucagaaguucgagac

SEQ ID NO: 823819 - RNA, 21 nt, Human
ccuggccaauauggugaaacc

SEQ ID NO: 823820 - RNA, 24 nt, Human
ccuggccaauauggugaaaccucg

SEQ ID NO: 823821 - RNA, 19 nt, Human
ccuguaaucccagcuacuc

SEQ ID NO: 823822 - RNA, 21 nt, Human
ccuguaaucccagcuacucgg

SEQ ID NO: 823823 - RNA, 22 nt, Human
ccuguaaucccagcuacucggg

SEQ ID NO: 823824 - RNA, 24 nt, Human
ccugugguuaaacauguuuaaagc

SEQ ID NO: 823825 - RNA, 21 nt, Human
ccuuccgagccagccaggccc

SEQ ID NO: 823826 - RNA, 21 nt, Human
cgaaaggauaaaccaugguca

SEQ ID NO: 823827 - RNA, 22 nt, Human
cgaaaggauaaaccauggucau

SEQ ID NO: 823828 - RNA, 24 nt, Human
cgagaccagccuggccaauauggu

SEQ ID NO: 823829 - RNA, 21 nt, Human
cgggacagagccauggccacc

SEQ ID NO: 823830 - RNA, 18 nt, Human
cuagccauacaaugagau

SEQ ID NO: 823831 - RNA, 20 nt, Human
cucacacuuguaaucccagc

SEQ ID NO: 823832 - RNA, 24 nt, Human
cucacacuuguaaucccagcucuu

SEQ ID NO: 823833 - RNA, 18 nt, Human
cucuuucccacccuuccu

SEQ ID NO: 823834 - RNA, 18 nt, Human
cugaagcaggagcugggg

SEQ ID NO: 823835 - RNA, 23 nt, Human
cugcuugcguucagguggaggag

SEQ ID NO: 823836 - RNA, 24 nt, Human
cugggccgggcgcgguggcucaca

SEQ ID NO: 823837 - RNA, 27 nt, Human
cuguggucaaagcaaguuccccaaagc

SEQ ID NO: 823838 - RNA, 18 nt, Human
cuucaagugacugguucu

SEQ ID NO: 823839 - RNA, 19 nt, Human
cuugaaccugggaggcgga

SEQ ID NO: 823840 - RNA, 22 nt, Human
cuuuuggaggacgaggcggggg

SEQ ID NO: 823841 - RNA, 19 nt, Human
gaaggcagacacaaaagga

SEQ ID NO: 823842 - RNA, 23 nt, Human
gagaaucgcuugaaccugggagg

SEQ ID NO: 823843 - RNA, 18 nt, Human
gagaucgugccacugcac

SEQ ID NO: 823844 - RNA, 23 nt, Human
gagauugcagugagccgagaucg

SEQ ID NO: 823845 - RNA, 26 nt, Human
gaggcgggggguggaucaccugaggu

SEQ ID NO: 823846 - RNA, 24 nt, Human
gaucaccugaggucagaaguucga

SEQ ID NO: 823847 - RNA, 20 nt, Human
gauuguggugacaguugccc

SEQ ID NO: 823848 - RNA, 18 nt, Human
gcaccagaggcggcacgg

SEQ ID NO: 823849 - RNA, 18 nt, Human
gcacuuuccagccugagc

SEQ ID NO: 823850 - RNA, 18 nt, Human
gcagggccuggugcuccc

SEQ ID NO: 823851 - RNA, 21 nt, Human
gcagucccuuccgagccagcc

SEQ ID NO: 823852 - RNA, 21 nt, Human
gccaauauggugaaaccucgu

SEQ ID NO: 823853 - RNA, 24 nt, Human
gccacugcacucuaaccugggcaa

SEQ ID NO: 823854 - RNA, 22 nt, Human
gccaggcgugguagcagaugcc

SEQ ID NO: 823855 - RNA, 19 nt, Human
gcccuggggugcuugggga

SEQ ID NO: 823856 - RNA, 20 nt, Human
gccgagaucgugccacugca

SEQ ID NO: 823857 - RNA, 23 nt, Human
gccugugguuucagaguccugga

SEQ ID NO: 823858 - RNA, 24 nt, Human
ggagauugcagugagccgagaucg

SEQ ID NO: 823859 - RNA, 22 nt, Human
ggcaccagaggcggcacgggcu

SEQ ID NO: 823860 - RNA, 23 nt, Human
ggcgcgguggcucacacuuguaa

SEQ ID NO: 823861 - RNA, 19 nt, Human
gggaggcagaggcaagaga

SEQ ID NO: 823862 - RNA, 19 nt, Human
gggcaauagggaguggcug

SEQ ID NO: 823863 - RNA, 21 nt, Human
gggcgcgguggcucacacuug

SEQ ID NO: 823864 - RNA, 21 nt, Human
ggggcaauagggaguggcugc

SEQ ID NO: 823865 - RNA, 21 nt, Human
gggggguggaucaccugaggu

SEQ ID NO: 823866 - RNA, 24 nt, Human
gggguggaucaccugaggucagaa

SEQ ID NO: 823867 - RNA, 19 nt, Human
ggguguggggauucuuuug

SEQ ID NO: 823868 - RNA, 24 nt, Human
gguagcagaugccuguaaucccag

SEQ ID NO: 823869 - RNA, 21 nt, Human
ggugaugaaaauaauccagaa

SEQ ID NO: 823870 - RNA, 23 nt, Human
gguggcucacacuuguaauccca

SEQ ID NO: 823871 - RNA, 24 nt, Human
gguggcucacacuuguaaucccag

SEQ ID NO: 823872 - RNA, 23 nt, Human
guagcagaugccuguaaucccag

SEQ ID NO: 823873 - RNA, 23 nt, Human
guggcucacacuuguaaucccag

SEQ ID NO: 823874 - RNA, 23 nt, Human
guguagaaguccuccauggccca

SEQ ID NO: 823875 - RNA, 20 nt, Human
guuauuuuuaaaaaggggua

SEQ ID NO: 823876 - RNA, 21 nt, Human
uaaagcuucccucuguuaaag

SEQ ID NO: 823877 - RNA, 18 nt, Human
uaacaacaauggggggga

SEQ ID NO: 823878 - RNA, 18 nt, Human
uaaccugggcaacaagag

SEQ ID NO: 823879 - RNA, 24 nt, Human
uaauucuccaagaucuccaugaug

SEQ ID NO: 823880 - RNA, 23 nt, Human
uacacagccuggcuccgucuccc

SEQ ID NO: 823881 - RNA, 19 nt, Human
uacugcucagccauaaaaa

SEQ ID NO: 823882 - RNA, 22 nt, Human
uacugcucagccauaaaaagga

SEQ ID NO: 823883 - RNA, 20 nt, Human
uagaaguccuccauggccca

SEQ ID NO: 823884 - RNA, 21 nt, Human
uagacacuacacuuagguauc

SEQ ID NO: 823885 - RNA, 23 nt, Human
uagauacuuggagaguuugcaca

SEQ ID NO: 823886 - RNA, 21 nt, Human
uaggguucuucucuacuucuc

SEQ ID NO: 823887 - RNA, 22 nt, Human
uagugucuuuucagcuucaucc

SEQ ID NO: 823888 - RNA, 25 nt, Human
ucaaaaacaacauauuaagucaaag

SEQ ID NO: 823889 - RNA, 22 nt, Human
ucaaagcaaguuccccaaagcc

SEQ ID NO: 823890 - RNA, 23 nt, Human
ucaaagcaaguuccccaaagcca

SEQ ID NO: 823891 - RNA, 24 nt, Human
ucacugaagcugaacauggguggg

SEQ ID NO: 823892 - RNA, 22 nt, Human
ucagccccuagacacuacacuu

SEQ ID NO: 823893 - RNA, 25 nt, Human
ucagccccuagacacuacacuuagg

SEQ ID NO: 823894 - RNA, 18 nt, Human
ucccucuggcuggccgaa

SEQ ID NO: 823895 - RNA, 22 nt, Human
uccgagccagccaggcccccac

SEQ ID NO: 823896 - RNA, 24 nt, Human
uccgccaauggacgaaaggauaaa

SEQ ID NO: 823897 - RNA, 21 nt, Human
uccgccucuuccguggcuccu

SEQ ID NO: 823898 - RNA, 19 nt, Human
uccgggugcuuguccugcg

SEQ ID NO: 823899 - RNA, 18 nt, Human
uccuccauggcccaggcc

SEQ ID NO: 823900 - RNA, 18 nt, Human
ucgcuugaaccugggagg

SEQ ID NO: 823901 - RNA, 23 nt, Human
ucuaagaaugggaaaaacacagu

SEQ ID NO: 823902 - RNA, 19 nt, Human
ucuauccacaaucccaaag

SEQ ID NO: 823903 - RNA, 22 nt, Human
ucucccggcagucagccccuag

SEQ ID NO: 823904 - RNA, 24 nt, Human
ucuccguuucagaccucuacugug

SEQ ID NO: 823905 - RNA, 23 nt, Human
ucugcagccgcacagccugaagc

SEQ ID NO: 823906 - RNA, 25 nt, Human
ugaaaauacaaaaaauuggccaguc

SEQ ID NO: 823907 - RNA, 19 nt, Human
ugaaguaucuuuguucaaa

SEQ ID NO: 823908 - RNA, 24 nt, Human
ugaaguaucuuuguucaaauuggu

SEQ ID NO: 823909 - RNA, 21 nt, Human
ugacuuagaaauuccacuccu

SEQ ID NO: 823910 - RNA, 19 nt, Human
ugagauacugcucagccau

SEQ ID NO: 823911 - RNA, 21 nt, Human
ugagauacugcucagccauaa

SEQ ID NO: 823912 - RNA, 22 nt, Human
ugagccgagaucgugccacugc

SEQ ID NO: 823913 - RNA, 20 nt, Human
ugcagggccuggugcucccu

SEQ ID NO: 823914 - RNA, 22 nt, Human
ugcccaacugugugaauauccc

SEQ ID NO: 823915 - RNA, 20 nt, Human
ugccguggagagcgggugac

SEQ ID NO: 823916 - RNA, 23 nt, Human
ugccucguccaccuuccgccucu

SEQ ID NO: 823917 - RNA, 24 nt, Human
ugccuguaaucccagcuacucggg

SEQ ID NO: 823918 - RNA, 18 nt, Human
ugcgauggcaccacaaac

SEQ ID NO: 823919 - RNA, 21 nt, Human
ugcuagacaauuccacuuccu

SEQ ID NO: 823920 - RNA, 24 nt, Human
ugcuagacaauuccacuuccucag

SEQ ID NO: 823921 - RNA, 24 nt, Human
ugcucagguggcaccagaggcggc

SEQ ID NO: 823922 - RNA, 22 nt, Human
ugcuucaagugacugguucugc

SEQ ID NO: 823923 - RNA, 24 nt, Human
uggaucaccugaggucagaaguuc

SEQ ID NO: 823924 - RNA, 27 nt, Human
uggaucaccugaggucagaaguucgag

SEQ ID NO: 823925 - RNA, 24 nt, Human
uggccaauauggugaaaccucguu

SEQ ID NO: 823926 - RNA, 20 nt, Human
uggcccaggccccagucagu

SEQ ID NO: 823927 - RNA, 21 nt, Human
uggcucacacuuguaauccca

SEQ ID NO: 823928 - RNA, 19 nt, Human
ugggaggcggagauugcag

SEQ ID NO: 823929 - RNA, 29 nt, Human
ugggaggcggagauugcagugacaacggu

SEQ ID NO: 823930 - RNA, 24 nt, Human
ugggaggcggagauugcagugagc

SEQ ID NO: 823931 - RNA, 24 nt, Human
ugguagcagaugccuguaauccca

SEQ ID NO: 823932 - RNA, 19 nt, Human
ugucugcagccgcacagcc

SEQ ID NO: 823933 - RNA, 18 nt, Human
ugugaauuguaucucaac

SEQ ID NO: 823934 - RNA, 20 nt, Human
ugugaauuguaucucaacga

SEQ ID NO: 823935 - RNA, 22 nt, Human
uuaaagcuucccucuguuaaag

SEQ ID NO: 823936 - RNA, 24 nt, Human
uugaaccugggaggcggagauugc

SEQ ID NO: 823937 - RNA, 18 nt, Human
uugcagugagccgagauc

SEQ ID NO: 823938 - RNA, 22 nt, Human
uugcagugagccgagaucgugc

SEQ ID NO: 823939 - RNA, 21 nt, Human
uuggaggacgaggcggggggu

SEQ ID NO: 823940 - RNA, 21 nt, Human
uugucaggggagagaggggca

SEQ ID NO: 823941 - RNA, 24 nt, Human
uuucaacugaaaauacaaaaaauu

SEQ ID NO: 823942 - RNA, 21 nt, Human
uuucagcuucauccaagcacc

SEQ ID NO: 823943 - RNA, 24 nt, Human
uuuucagcuucauccaagcaccug

SEQ ID NO: 823944 - RNA, 21 nt, Human
aaaaggcucaacaaaggagag

SEQ ID NO: 823945 - RNA, 21 nt, Human
aaaaugaaagaaaauagaaaa

SEQ ID NO: 823946 - RNA, 24 nt, Human
aacugugguaaugaaucaugaacc

SEQ ID NO: 823947 - RNA, 22 nt, Human
acugaaacucuuaaaacugugg

SEQ ID NO: 823948 - RNA, 20 nt, Human
agucguauuuucugaggcuu

SEQ ID NO: 823949 - RNA, 27 nt, Human
augaaccccucaaaaggcucaacaaag

SEQ ID NO: 823950 - RNA, 19 nt, Human
caguuccaacuguucaugu

SEQ ID NO: 823951 - RNA, 23 nt, Human
ccucaaaaggcucaacaaaggag

SEQ ID NO: 823952 - RNA, 21 nt, Human
cucaaaaggcucaacaaagga

SEQ ID NO: 823953 - RNA, 22 nt, Human
gaaacucuuaaaacugugguaa

SEQ ID NO: 823954 - RNA, 24 nt, Human
gaacaguguacagaagauacuccu

SEQ ID NO: 823955 - RNA, 20 nt, Human
uauguaucuauauccaucaa

SEQ ID NO: 823956 - RNA, 22 nt, Human
ucaugaaccccucaaaaggcuc

SEQ ID NO: 823957 - RNA, 20 nt, Human
ugaaacucuuaaaacugugg

SEQ ID NO: 823958 - RNA, 24 nt, Human
ugaaagaaaauagaaaaccuaugu

SEQ ID NO: 823959 - RNA, 24 nt, Human
ugguguaucaucuggaauuguuuu

SEQ ID NO: 823960 - RNA, 18 nt, Human
uuaaaacugugguaauga

SEQ ID NO: 823961 - RNA, 22 nt, Human
uuucugaggcuuuuaggaaauc

SEQ ID NO: 823962 - RNA, 18 nt, Human
aaaaagcacgacacacac

SEQ ID NO: 823963 - RNA, 24 nt, Human
aaaaagcacgacacacacgucccc

SEQ ID NO: 823964 - RNA, 24 nt, Human
aaaaagcacgacacacacgucccc

SEQ ID NO: 823965 - RNA, 25 nt, Human
aaaaagcacgacacacacguccccc

SEQ ID NO: 823966 - RNA, 25 nt, Human
aaaaagcacgacacacacguccccc

SEQ ID NO: 823967 - RNA, 20 nt, Human
aaaacauccacagagaaacc

SEQ ID NO: 823968 - RNA, 20 nt, Human
aaacugggaccaggguggga

SEQ ID NO: 823969 - RNA, 20 nt, Human
aaagcuuccagaggcccagg

SEQ ID NO: 823970 - RNA, 23 nt, Human
aaauccaccugcucaagucagga

SEQ ID NO: 823971 - RNA, 23 nt, Human
aaauccaccugcucaagucagga

SEQ ID NO: 823972 - RNA, 19 nt, Human
aaccagagccuuccgcagc

SEQ ID NO: 823973 - RNA, 24 nt, Human
aaccagagccuuccgcagcgcuuu

SEQ ID NO: 823974 - RNA, 19 nt, Human
aaccgaugguaaaaagcac

SEQ ID NO: 823975 - RNA, 19 nt, Human
aaccgaugguaaaaagcac

SEQ ID NO: 823976 - RNA, 24 nt, Human
aaccgcuaagaaacccuggcagag

SEQ ID NO: 823977 - RNA, 20 nt, Human
aaccugggaccaggguggga

SEQ ID NO: 823978 - RNA, 22 nt, Human
aagaaacccuggcagaggaggg

SEQ ID NO: 823979 - RNA, 22 nt, Human
aagaaacccuggcagaggaggg

SEQ ID NO: 823980 - RNA, 21 nt, Human
aagaagauagaagacggagga

SEQ ID NO: 823981 - RNA, 21 nt, Human
aagaagauagaagacggagga

SEQ ID NO: 823982 - RNA, 22 nt, Human
aagaucaccaggcgcugcacca

SEQ ID NO: 823983 - RNA, 24 nt, Human
aagcaagagugaaucaggccuggg

SEQ ID NO: 823984 - RNA, 21 nt, Human
aagcacgacacacacgucccc

SEQ ID NO: 823985 - RNA, 21 nt, Human
aagcacgacacacacgucccc

SEQ ID NO: 823986 - RNA, 22 nt, Human
aagcaucccccacccccaucuc

SEQ ID NO: 823987 - RNA, 21 nt, Human
aaggcucugggagcauaagug

SEQ ID NO: 823988 - RNA, 21 nt, Human
aaggcucugggagcauaagug

SEQ ID NO: 823989 - RNA, 19 nt, Human
aagugccccagccaggagg

SEQ ID NO: 823990 - RNA, 19 nt, Human
aagugccccagccaggagg

SEQ ID NO: 823991 - RNA, 23 nt, Human
aaucacagaaucaaagucacuuc

SEQ ID NO: 823992 - RNA, 18 nt, Human
aaugacccaaagaccuuc

SEQ ID NO: 823993 - RNA, 18 nt, Human
aaugacccaaagaccuuc

SEQ ID NO: 823994 - RNA, 23 nt, Human
acaccugcccccuguccccucug

SEQ ID NO: 823995 - RNA, 23 nt, Human
acaccugcccccuguccccucug

SEQ ID NO: 823996 - RNA, 20 nt, Human
accaggaaggcaccacggac

SEQ ID NO: 823997 - RNA, 20 nt, Human
accaggaaggcaccacggac

SEQ ID NO: 823998 - RNA, 18 nt, Human
accauucccagagcgucc

SEQ ID NO: 823999 - RNA, 18 nt, Human
accauucccagagcgucc

SEQ ID NO: 824000 - RNA, 19 nt, Human
acccaggccauagugacac

SEQ ID NO: 824001 - RNA, 19 nt, Human
acccaggccauagugacac

SEQ ID NO: 824002 - RNA, 23 nt, Human
acccccagaggcacuuugcggga

SEQ ID NO: 824003 - RNA, 24 nt, Human
accccggaagcuuccggcuguccc

SEQ ID NO: 824004 - RNA, 18 nt, Human
agaaacccuggcagagga

SEQ ID NO: 824005 - RNA, 18 nt, Human
agaaacccuggcagagga

SEQ ID NO: 824006 - RNA, 24 nt, Human
agaacuccuccaccucucaggcuc

SEQ ID NO: 824007 - RNA, 24 nt, Human
agaacuccuccaccucucaggcuc

SEQ ID NO: 824008 - RNA, 19 nt, Human
agaagcaucccccaccccc

SEQ ID NO: 824009 - RNA, 19 nt, Human
agaagcaucccccaccccc

SEQ ID NO: 824010 - RNA, 23 nt, Human
agagcccuggaggagugccuccc

SEQ ID NO: 824011 - RNA, 23 nt, Human
agagcccuggaggagugccuccc

SEQ ID NO: 824012 - RNA, 19 nt, Human
agagugaaucaggccuggg

SEQ ID NO: 824013 - RNA, 22 nt, Human
agcaacauaaggccccaggcac

SEQ ID NO: 824014 - RNA, 22 nt, Human
agcauaagugccccagccagga

SEQ ID NO: 824015 - RNA, 22 nt, Human
agcauaagugccccagccagga

SEQ ID NO: 824016 - RNA, 28 nt, Human
agcaucccccacccccaucucugacagc

SEQ ID NO: 824017 - RNA, 28 nt, Human
agcaucccccacccccaucucugacagc

SEQ ID NO: 824018 - RNA, 19 nt, Human
agccaggagguggaggcca

SEQ ID NO: 824019 - RNA, 19 nt, Human
agccaggagguggaggcca

SEQ ID NO: 824020 - RNA, 19 nt, Human
agccgccaggccccagccc

SEQ ID NO: 824021 - RNA, 19 nt, Human
agccgccaggccccagccc

SEQ ID NO: 824022 - RNA, 20 nt, Human
agccgccaggccccagcccc

SEQ ID NO: 824023 - RNA, 18 nt, Human
agcggacccaaaaacaaa

SEQ ID NO: 824024 - RNA, 18 nt, Human
agcggacccaaaaacaaa

SEQ ID NO: 824025 - RNA, 25 nt, Human
aggaacccagucacacaccugcccc

SEQ ID NO: 824026 - RNA, 25 nt, Human
aggaacccagucacacaccugcccc

SEQ ID NO: 824027 - RNA, 19 nt, Human
aggaagcacagggugacuc

SEQ ID NO: 824028 - RNA, 19 nt, Human
aggaagcacagggugacuc

SEQ ID NO: 824029 - RNA, 22 nt, Human
aggaaguaacgggggaucagaa

SEQ ID NO: 824030 - RNA, 23 nt, Human
aggaaguaacgggggaucagaac

SEQ ID NO: 824031 - RNA, 23 nt, Human
aggaaguaacgggggaucagaac

SEQ ID NO: 824032 - RNA, 22 nt, Human
aggacccuccaccugggcagga

SEQ ID NO: 824033 - RNA, 21 nt, Human
aggacuccugucccuagauug

SEQ ID NO: 824034 - RNA, 21 nt, Human
aggacuccugucccuagauug

SEQ ID NO: 824035 - RNA, 20 nt, Human
aggagggaugggggggcuca

SEQ ID NO: 824036 - RNA, 20 nt, Human
aggagggaugggggggcuca

SEQ ID NO: 824037 - RNA, 23 nt, Human
aggagggaugggggggcucaggc

SEQ ID NO: 824038 - RNA, 23 nt, Human
aggagggaugggggggcucaggc

SEQ ID NO: 824039 - RNA, 26 nt, Human
aggcaagaaaagaagauagaagacgg

SEQ ID NO: 824040 - RNA, 29 nt, Human
aggcaagaaaagaagauagaagggacccc

SEQ ID NO: 824041 - RNA, 29 nt, Human
aggcaagaaaagaagauagaagggacccc

SEQ ID NO: 824042 - RNA, 22 nt, Human
aggcaagaggagaaaaugcuag

SEQ ID NO: 824043 - RNA, 24 nt, Human
aggcaagaggagaaaaugcuagga

SEQ ID NO: 824044 - RNA, 24 nt, Human
aggcaagaggagaaaaugcuagga

SEQ ID NO: 824045 - RNA, 19 nt, Human
aggcacuuguggaaccugg

SEQ ID NO: 824046 - RNA, 19 nt, Human
aggcacuuguggaaccugg

SEQ ID NO: 824047 - RNA, 22 nt, Human
aggcccagaaacaucuuccccc

SEQ ID NO: 824048 - RNA, 22 nt, Human
aggcccagaaacaucuuccccc

SEQ ID NO: 824049 - RNA, 21 nt, Human
aggcguuuccccucagggcag

SEQ ID NO: 824050 - RNA, 22 nt, Human
aggcguuuccccucagggcagc

SEQ ID NO: 824051 - RNA, 20 nt, Human
aggcguuucccucagggcag

SEQ ID NO: 824052 - RNA, 22 nt, Human
agggaaguggcgggguggggcc

SEQ ID NO: 824053 - RNA, 22 nt, Human
agggaaguggcgggguggggcc

SEQ ID NO: 824054 - RNA, 18 nt, Human
agucacacaccugccccc

SEQ ID NO: 824055 - RNA, 18 nt, Human
agucacacaccugccccc

SEQ ID NO: 824056 - RNA, 21 nt, Human
agucacauucccagcuccguu

SEQ ID NO: 824057 - RNA, 21 nt, Human
agucacauucccagcuccguu

SEQ ID NO: 824058 - RNA, 22 nt, Human
aucacagaaucaaagucacuuc

SEQ ID NO: 824059 - RNA, 21 nt, Human
caaaacauccacagagaaacc

SEQ ID NO: 824060 - RNA, 19 nt, Human
caaaccgaugguaaaaagc

SEQ ID NO: 824061 - RNA, 19 nt, Human
caaaccgaugguaaaaagc

SEQ ID NO: 824062 - RNA, 25 nt, Human
caaauaaaguagcaaugccucuucc

SEQ ID NO: 824063 - RNA, 25 nt, Human
caaauaaaguagcaaugccucuucc

SEQ ID NO: 824064 - RNA, 22 nt, Human
caagaucaccaggcgcugcacc

SEQ ID NO: 824065 - RNA, 24 nt, Human
caagucauuagagucuuuggauuu

SEQ ID NO: 824066 - RNA, 24 nt, Human
caagucauuagagucuuuggauuu

SEQ ID NO: 824067 - RNA, 19 nt, Human
cacaauggggaggcagggc

SEQ ID NO: 824068 - RNA, 19 nt, Human
cacaauggggaggcagggc

SEQ ID NO: 824069 - RNA, 24 nt, Human
cacaauggggaggcagggccccca

SEQ ID NO: 824070 - RNA, 23 nt, Human
cacacaccugcccccuguccccu

SEQ ID NO: 824071 - RNA, 21 nt, Human
cacaccugcccccuguccccu

SEQ ID NO: 824072 - RNA, 20 nt, Human
cacacucccugcaccagccc

SEQ ID NO: 824073 - RNA, 20 nt, Human
cacacucccugcaccagccc

SEQ ID NO: 824074 - RNA, 19 nt, Human
cacacucucaggacuuccc

SEQ ID NO: 824075 - RNA, 19 nt, Human
cacacucucaggacuuccc

SEQ ID NO: 824076 - RNA, 19 nt, Human
caccaggaccaucugccag

SEQ ID NO: 824077 - RNA, 19 nt, Human
caccaggaccaucugccag

SEQ ID NO: 824078 - RNA, 20 nt, Human
cacccagaaccuuccaucca

SEQ ID NO: 824079 - RNA, 20 nt, Human
cacccaggccauagugacac

SEQ ID NO: 824080 - RNA, 20 nt, Human
cacccaggccauagugacac

SEQ ID NO: 824081 - RNA, 19 nt, Human
cacccccaucucugacagc

SEQ ID NO: 824082 - RNA, 19 nt, Human
cacccccaucucugacagc

SEQ ID NO: 824083 - RNA, 18 nt, Human
caccucugcccucccgcu

SEQ ID NO: 824084 - RNA, 18 nt, Human
caccucugcccucccgcu

SEQ ID NO: 824085 - RNA, 21 nt, Human
cacggugggccugggggcgug

SEQ ID NO: 824086 - RNA, 21 nt, Human
cacggugggccugggggcgug

SEQ ID NO: 824087 - RNA, 22 nt, Human
cacugcacaucccucuuuccca

SEQ ID NO: 824088 - RNA, 22 nt, Human
cacugcacaucccucuuuccca

SEQ ID NO: 824089 - RNA, 18 nt, Human
cacuguggauccgcaaua

SEQ ID NO: 824090 - RNA, 23 nt, Human
cacuuguggaaccugggaccagg

SEQ ID NO: 824091 - RNA, 23 nt, Human
cacuuguggaaccugggaccagg

SEQ ID NO: 824092 - RNA, 20 nt, Human
cagaaacaucuucccccucc

SEQ ID NO: 824093 - RNA, 19 nt, Human
cagaagaaacaaagcuucc

SEQ ID NO: 824094 - RNA, 22 nt, Human
cagaagaaacaaagcuuccaga

SEQ ID NO: 824095 - RNA, 23 nt, Human
cagagccuuccgcagcgcuuucu

SEQ ID NO: 824096 - RNA, 24 nt, Human
cagcagugcuggccucucacccag

SEQ ID NO: 824097 - RNA, 22 nt, Human
cagccaccaacacacacucuca

SEQ ID NO: 824098 - RNA, 22 nt, Human
cagccaccaacacacacucuca

SEQ ID NO: 824099 - RNA, 20 nt, Human
cagccagggcugggacaggc

SEQ ID NO: 824100 - RNA, 20 nt, Human
cagccagggcugggacaggc

SEQ ID NO: 824101 - RNA, 22 nt, Human
cagccagggcugggacaggccc

SEQ ID NO: 824102 - RNA, 22 nt, Human
cagccagggcugggacaggccc

SEQ ID NO: 824103 - RNA, 21 nt, Human
cagcccaccaggaaggcacca

SEQ ID NO: 824104 - RNA, 21 nt, Human
cagcccaccaggaaggcacca

SEQ ID NO: 824105 - RNA, 21 nt, Human
cagccgccaggccccagcccc

SEQ ID NO: 824106 - RNA, 19 nt, Human
cagcggacccaaaaacaaa

SEQ ID NO: 824107 - RNA, 19 nt, Human
cagcggacccaaaaacaaa

SEQ ID NO: 824108 - RNA, 18 nt, Human
caggcagacgacgauugc

SEQ ID NO: 824109 - RNA, 19 nt, Human
caggccccagccccacacu

SEQ ID NO: 824110 - RNA, 18 nt, Human
cagggcagcagcagugcu

SEQ ID NO: 824111 - RNA, 23 nt, Human
cagggcagcagcagugcuggccc

SEQ ID NO: 824112 - RNA, 21 nt, Human
cagggugacucccgucuugug

SEQ ID NO: 824113 - RNA, 21 nt, Human
cagggugacucccgucuugug

SEQ ID NO: 824114 - RNA, 30 nt, Human
ccaaaaacaaacuucucagugaaacagguu

SEQ ID NO: 824115 - RNA, 30 nt, Human; identical to SEQ ID NO: 824114

SEQ ID NO: 824116 - RNA, 18 nt, Human
ccaaaacauccacagaga

SEQ ID NO: 824117 - RNA, 18 nt, Human
ccaaaacauccacagaga

SEQ ID NO: 824118 - RNA, 28 nt, Human
ccaaaacauccacagagaaaccgcuaaa

SEQ ID NO: 824119 - RNA, 28 nt, Human
ccaaaacauccacagagaaaccgcuaaa

SEQ ID NO: 824120 - RNA, 24 nt, Human
ccacaagcugacauuaguccgcac

SEQ ID NO: 824121 - RNA, 24 nt, Human
ccacaagcugacauuaguccgcac

SEQ ID NO: 824122 - RNA, 23 nt, Human
ccaccccggaagcuuccggcugu

SEQ ID NO: 824123 - RNA, 24 nt, Human
ccagagccuuccgcagcgcuuucu

SEQ ID NO: 824124 - RNA, 23 nt, Human
ccagcagcucugcaauggccaga

SEQ ID NO: 824125 - RNA, 21 nt, Human
ccagcccagccgccaggcccc

SEQ ID NO: 824126 - RNA, 21 nt, Human
ccagcccagccgccaggcccc

SEQ ID NO: 824127 - RNA, 26 nt, Human
ccaggccccagccccacaccgguucc

SEQ ID NO: 824128 - RNA, 26 nt, Human
ccaggccccagccccacaccgguucc

SEQ ID NO: 824129 - RNA, 20 nt, Human
ccaggccccagccccacacu

SEQ ID NO: 824130 - RNA, 21 nt, Human
ccaggccccagccccacacuc

SEQ ID NO: 824131 - RNA, 21 nt, Human
ccaggccccagccccacacuc

SEQ ID NO: 824132 - RNA, 23 nt, Human
cccaaauccaccugcucaaguca

SEQ ID NO: 824133 - RNA, 18 nt, Human
cccaccacucuggagacc

SEQ ID NO: 824134 - RNA, 18 nt, Human
cccaccacucuggagacc

SEQ ID NO: 824135 - RNA, 21 nt, Human
cccacccacgcugcccguccg

SEQ ID NO: 824136 - RNA, 21 nt, Human
cccacccacgcugcccguccg

SEQ ID NO: 824137 - RNA, 21 nt, Human
cccagccccacacucugagag

SEQ ID NO: 824138 - RNA, 21 nt, Human
cccagccccacacucugagag

SEQ ID NO: 824139 - RNA, 24 nt, Human
cccagccccugcgggcacccagaa

SEQ ID NO: 824140 - RNA, 21 nt, Human
cccagggcccuccagaggcac

SEQ ID NO: 824141 - RNA, 21 nt, Human
cccagggcccuccagaggcac

SEQ ID NO: 824142 - RNA, 21 nt, Human
cccaucccacaaaccuggcac

SEQ ID NO: 824143 - RNA, 21 nt, Human
cccaucccacaaaccuggcac

SEQ ID NO: 824144 - RNA, 19 nt, Human
ccccaacaccauuaguguc

SEQ ID NO: 824145 - RNA, 19 nt, Human
ccccaacaccauuaguguc

SEQ ID NO: 824146 - RNA, 20 nt, Human
ccccagaagcaucccccacc

SEQ ID NO: 824147 - RNA, 20 nt, Human
ccccagaagcaucccccacc

SEQ ID NO: 824148 - RNA, 21 nt, Human
ccccagccaggagguggaggc

SEQ ID NO: 824149 - RNA, 21 nt, Human
ccccagccaggagguggaggc

SEQ ID NO: 824150 - RNA, 20 nt, Human
ccccaggggccgggcccucu

SEQ ID NO: 824151 - RNA, 23 nt, Human
ccccaggggccgggcccucugcc

SEQ ID NO: 824152 - RNA, 21 nt, Human
ccccaucccacaaaccuggca

SEQ ID NO: 824153 - RNA, 21 nt, Human
ccccaucccacaaaccuggca

SEQ ID NO: 824154 - RNA, 22 nt, Human
ccccaucccacaaaccuggcac

SEQ ID NO: 824155 - RNA, 22 nt, Human
ccccaucccacaaaccuggcac

SEQ ID NO: 824156 - RNA, 23 nt, Human
cccccaacaccauuagugucugc

SEQ ID NO: 824157 - RNA, 18 nt, Human
cccccagaagcauccccc

SEQ ID NO: 824158 - RNA, 18 nt, Human
cccccagaagcauccccc

SEQ ID NO: 824159 - RNA, 19 nt, Human
cccccagaagcauccccca

SEQ ID NO: 824160 - RNA, 19 nt, Human
cccccagaagcauccccca

SEQ ID NO: 824161 - RNA, 22 nt, Human
cccccagaagcaucccccaccc

SEQ ID NO: 824162 - RNA, 22 nt, Human
cccccagaagcaucccccaccc

SEQ ID NO: 824163 - RNA, 22 nt, Human
ccccccaggggccgggcccucu

SEQ ID NO: 824164 - RNA, 18 nt, Human
ccccugcgggcacccaga

SEQ ID NO: 824165 - RNA, 21 nt, Human
ccccuggggaaggggccaccg

SEQ ID NO: 824166 - RNA, 22 nt, Human
ccccuggggaaggggccaccgg

SEQ ID NO: 824167 - RNA, 24 nt, Human
cccgcccuggcccaccacucugga

SEQ ID NO: 824168 - RNA, 24 nt, Human
cccgcccuggcccaccacucugga

SEQ ID NO: 824169 - RNA, 23 nt, Human
cccggccgcagccuucguguccc

SEQ ID NO: 824170 - RNA, 23 nt, Human
cccggccgcagccuucguguccc

SEQ ID NO: 824171 - RNA, 19 nt, Human
cccguccgccaccauuccc

SEQ ID NO: 824172 - RNA, 19 nt, Human
cccguccgccaccauuccc

SEQ ID NO: 824173 - RNA, 20 nt, Human
cccguccgccaccauuccca

SEQ ID NO: 824174 - RNA, 23 nt, Human
cccucaaaaucggcuaaggacag

SEQ ID NO: 824175 - RNA, 23 nt, Human
cccucaaaaucggcuaaggacag

SEQ ID NO: 824176 - RNA, 22 nt, Human
cccuggaggagugccucccgcc

SEQ ID NO: 824177 - RNA, 19 nt, Human
ccgaugguaaaaagcacga

SEQ ID NO: 824178 - RNA, 19 nt, Human
ccgaugguaaaaagcacga

SEQ ID NO: 824179 - RNA, 21 nt, Human
ccgcaccuccugccugccaag

SEQ ID NO: 824180 - RNA, 21 nt, Human
ccgcaccuccugccugccaag

SEQ ID NO: 824181 - RNA, 19 nt, Human
ccgcagcgcuuucuagaug

SEQ ID NO: 824182 - RNA, 19 nt, Human
ccgcagcgcuuucuagaug

SEQ ID NO: 824183 - RNA, 18 nt, Human
ccgccaggccccagcccc

SEQ ID NO: 824184 - RNA, 18 nt, Human
ccgccaggccccagcccc

SEQ ID NO: 824185 - RNA, 19 nt, Human
ccguccgccaccauuccca

SEQ ID NO: 824186 - RNA, 24 nt, Human
ccucaccucugcccucccgcuccc

SEQ ID NO: 824187 - RNA, 24 nt, Human
ccucaccucugcccucccgcuccc

SEQ ID NO: 824188 - RNA, 19 nt, Human
ccucccgcccaggggcggg

SEQ ID NO: 824189 - RNA, 18 nt, Human
ccucgcagccagggcugg

SEQ ID NO: 824190 - RNA, 18 nt, Human
ccucgcagccagggcugg

SEQ ID NO: 824191 - RNA, 21 nt, Human
ccucucaggcuccagcaguca

SEQ ID NO: 824192 - RNA, 21 nt, Human
ccucucaggcuccagcaguca

SEQ ID NO: 824193 - RNA, 18 nt, Human
ccugggcccaaauccacc

SEQ ID NO: 824194 - RNA, 18 nt, Human
ccugggcccaaauccacc

SEQ ID NO: 824195 - RNA, 18 nt, Human
ccuugggugccaucugcg

SEQ ID NO: 824196 - RNA, 18 nt, Human
ccuugggugccaucugcg

SEQ ID NO: 824197 - RNA, 21 nt, Human
cgacacacacgucccccagga

SEQ ID NO: 824198 - RNA, 19 nt, Human
cgagaagcaagagugaauc

SEQ ID NO: 824199 - RNA, 21 nt, Human
cgcacagccaccaacacacac

SEQ ID NO: 824200 - RNA, 22 nt, Human
cgcuaacccccaucccacaaac

SEQ ID NO: 824201 - RNA, 22 nt, Human
cgcuaacccccaucccacaaac

SEQ ID NO: 824202 - RNA, 19 nt, Human
cgcuaagaaacccuggcag

SEQ ID NO: 824203 - RNA, 19 nt, Human
cgcuaagaaacccuggcag

SEQ ID NO: 824204 - RNA, 21 nt, Human
cggcaaacauaagagacuuuc

SEQ ID NO: 824205 - RNA, 23 nt, Human
cggcaaacauaagagacuuucca

SEQ ID NO: 824206 - RNA, 23 nt, Human
cguccgccaccauucccagagcu

SEQ ID NO: 824207 - RNA, 23 nt, Human
cguccgccaccauucccagagcu

SEQ ID NO: 824208 - RNA, 25 nt, Human
cgugcgcacagccaccaacacacag

SEQ ID NO: 824209 - RNA, 20 nt, Human
cucagggcagcagcagugcu

SEQ ID NO: 824210 - RNA, 23 nt, Human
cucccugcaccagcccagccgcc

SEQ ID NO: 824211 - RNA, 23 nt, Human
cucccugcaccagcccagccgcc

SEQ ID NO: 824212 - RNA, 19 nt, Human
cuccucaccucugcccucc

SEQ ID NO: 824213 - RNA, 19 nt, Human
cuccucaccucugcccucc

SEQ ID NO: 824214 - RNA, 21 nt, Human
cuccuccaccucucaggcucc

SEQ ID NO: 824215 - RNA, 21 nt, Human
cuccuccaccucucaggcucc

SEQ ID NO: 824216 - RNA, 23 nt, Human
cuccuccaccucucaggcuccag

SEQ ID NO: 824217 - RNA, 23 nt, Human
cuccuccaccucucaggcuccag

SEQ ID NO: 824218 - RNA, 23 nt, Human
cugcagcccaccaggaaggcacc

SEQ ID NO: 824219 - RNA, 18 nt, Human
cugcgggcacccagaacc

SEQ ID NO: 824220 - RNA, 22 nt, Human
cugggcccaaauccaccugcuc

SEQ ID NO: 824221 - RNA, 22 nt, Human
cugggcccaaauccaccugcuc

SEQ ID NO: 824222 - RNA, 19 nt, Human
cugggcccccccacacagg

SEQ ID NO: 824223 - RNA, 23 nt, Human
cuggggagagaaagacaaccugu

SEQ ID NO: 824224 - RNA, 23 nt, Human
cuggggagagaaagacaaccugu

SEQ ID NO: 824225 - RNA, 20 nt, Human
cuuuggggguucaauggguc

SEQ ID NO: 824226 - RNA, 20 nt, Human
cuuuggggguucaauggguc

SEQ ID NO: 824227 - RNA, 20 nt, Human
gaacuccuccaccucucagg

SEQ ID NO: 824228 - RNA, 20 nt, Human
gaacuccuccaccucucagg

SEQ ID NO: 824229 - RNA, 23 nt, Human
gaagcaucccccacccccaucuc

SEQ ID NO: 824230 - RNA, 22 nt, Human
gaagcuuccggcugucccgccc

SEQ ID NO: 824231 - RNA, 20 nt, Human
gacacacacgucccccagga

SEQ ID NO: 824232 - RNA, 18 nt, Human
gacuuuguggagagaaag

SEQ ID NO: 824233 - RNA, 18 nt, Human
gacuuuguggagagaaag

SEQ ID NO: 824234 - RNA, 23 nt, Human
gagagcccuggaggagugccucc

SEQ ID NO: 824235 - RNA, 23 nt, Human
gagagcccuggaggagugccucc

SEQ ID NO: 824236 - RNA, 20 nt, Human
gagucugcuggucagggagg

SEQ ID NO: 824237 - RNA, 20 nt, Human
gagucugcuggucagggagg

SEQ ID NO: 824238 - RNA, 23 nt, Human
gaugccaaaacauccacagagaa

SEQ ID NO: 824239 - RNA, 20 nt, Human
gcacagccaccaacacacac

SEQ ID NO: 824240 - RNA, 23 nt, Human
gcacccagaaccuuccauccacc

SEQ ID NO: 824241 - RNA, 18 nt, Human
gcagccuucgugucccuc

SEQ ID NO: 824242 - RNA, 18 nt, Human
gcagccuucgugucccuc

SEQ ID NO: 824243 - RNA, 19 nt, Human
gccacaggguucccucaaa

SEQ ID NO: 824244 - RNA, 18 nt, Human
gccacagguucccucaaa

SEQ ID NO: 824245 - RNA, 19 nt, Human
gcccagccgccaggcccca

SEQ ID NO: 824246 - RNA, 19 nt, Human
gcccagccgccaggcccca

SEQ ID NO: 824247 - RNA, 21 nt, Human
gccugccaagugcuggcccgg

SEQ ID NO: 824248 - RNA, 21 nt, Human
gccuuccaggagcgcaucggg

SEQ ID NO: 824249 - RNA, 21 nt, Human
gccuuccaggagcgcaucggg

SEQ ID NO: 824250 - RNA, 19 nt, Human
gcuacaggaggccgcugcu

SEQ ID NO: 824251 - RNA, 19 nt, Human
gcuacaggaggccgcugcu

SEQ ID NO: 824252 - RNA, 24 nt, Human
ggaaacugggaccagggugggagg

SEQ ID NO: 824253 - RNA, 24 nt, Human
ggaaacugggaccagggugggagg

SEQ ID NO: 824254 - RNA, 22 nt, Human
ggacaggugccacaggguuccc

SEQ ID NO: 824255 - RNA, 23 nt, Human
ggaggccagcccgcccuggcccc

SEQ ID NO: 824256 - RNA, 23 nt, Human
ggaggccagcccgcccuggcccc

SEQ ID NO: 824257 - RNA, 22 nt, Human
ggcagaggagggaugggggggc

SEQ ID NO: 824258 - RNA, 22 nt, Human
ggcagaggagggaugggggggc

SEQ ID NO: 824259 - RNA, 18 nt, Human
ggccugggggcguggcug

SEQ ID NO: 824260 - RNA, 18 nt, Human
ggccugggggcguggcug

SEQ ID NO: 824261 - RNA, 23 nt, Human
ggcgggguggggccagggauguu

SEQ ID NO: 824262 - RNA, 23 nt, Human
ggcgggguggggccagggauguu

SEQ ID NO: 824263 - RNA, 20 nt, Human
ggcguuucccucagggcagc

SEQ ID NO: 824264 - RNA, 24 nt, Human
gggaaacugggaccagggugggag

SEQ ID NO: 824265 - RNA, 24 nt, Human
gggaaacugggaccagggugggag

SEQ ID NO: 824266 - RNA, 23 nt, Human
gggaagcggguugaguuaaaagg

SEQ ID NO: 824267 - RNA, 18 nt, Human
gggaggugagucugcugg

SEQ ID NO: 824268 - RNA, 18 nt, Human
gggaggugagucugcugg

SEQ ID NO: 824269 - RNA, 22 nt, Human
gggaggugagucugcuggucag

SEQ ID NO: 824270 - RNA, 22 nt, Human
gggaggugagucugcuggucag

SEQ ID NO: 824271 - RNA, 21 nt, Human
gggcaaggcagaggugacagc

SEQ ID NO: 824272 - RNA, 21 nt, Human
gggcaaggcagaggugacagc

SEQ ID NO: 824273 - RNA, 19 nt, Human
gggcagcagcagugcuggc

SEQ ID NO: 824274 - RNA, 18 nt, Human
gggcaggaggccagcagc

SEQ ID NO: 824275 - RNA, 28 nt, Human
gggcccccagaagcaucccccacccccu

SEQ ID NO: 824276 - RNA, 28 nt, Human
gggcccccagaagcaucccccacccccu

SEQ ID NO: 824277 - RNA, 21 nt, Human
gggcccucugccagucccggc

SEQ ID NO: 824278 - RNA, 18 nt, Human
gggcguggcugcugugag

SEQ ID NO: 824279 - RNA, 18 nt, Human
gggcguggcugcugugag

SEQ ID NO: 824280 - RNA, 21 nt, Human
gggggcguggcugcugugagg

SEQ ID NO: 824281 - RNA, 21 nt, Human
gggggcguggcugcugugagg

SEQ ID NO: 824282 - RNA, 21 nt, Human
gggggggcucaggccucggcu

SEQ ID NO: 824283 - RNA, 20 nt, Human
gucacugcacaucccucuuu

SEQ ID NO: 824284 - RNA, 21 nt, Human
guccgccaccauucccagagc

SEQ ID NO: 824285 - RNA, 21 nt, Human
guccgccaccauucccagagc

SEQ ID NO: 824286 - RNA, 23 nt, Human
gugccccagccaggagguggagg

SEQ ID NO: 824287 - RNA, 23 nt, Human
gugccccagccaggagguggagg

SEQ ID NO: 824288 - RNA, 19 nt, Human
guggaaccugggaccaggg

SEQ ID NO: 824289 - RNA, 19 nt, Human
guggaaccugggaccaggg

SEQ ID NO: 824290 - RNA, 24 nt, Human
guuccaagaccccccaacaccauu

SEQ ID NO: 824291 - RNA, 23 nt, Human
guucugggcacacaauggggagg

SEQ ID NO: 824292 - RNA, 23 nt, Human
guucugggcacacaauggggagg

SEQ ID NO: 824293 - RNA, 21 nt, Human
uaaaguagcaaugccucuucc

SEQ ID NO: 824294 - RNA, 21 nt, Human
uaaaguagcaaugccucuucc

SEQ ID NO: 824295 - RNA, 28 nt, Human
uaagaguaaggccacugugggguauaac

SEQ ID NO: 824296 - RNA, 21 nt, Human
uaaggcaagaggagaaaaugc

SEQ ID NO: 824297 - RNA, 21 nt, Human
uaaggcaagaggagaaaaugc

SEQ ID NO: 824298 - RNA, 22 nt, Human
uacccggguacagaagaaacaa

SEQ ID NO: 824299 - RNA, 19 nt, Human
uagaaagagcaacauaagg

SEQ ID NO: 824300 - RNA, 19 nt, Human
uagagucuuuacaagucau

SEQ ID NO: 824301 - RNA, 19 nt, Human
uagagucuuuacaagucau

SEQ ID NO: 824302 - RNA, 20 nt, Human
uagcaaugccucuuccuuug

SEQ ID NO: 824303 - RNA, 20 nt, Human
uagcaaugccucuuccuuug

SEQ ID NO: 824304 - RNA, 24 nt, Human
uagugacaccagcggacccaaaaa

SEQ ID NO: 824305 - RNA, 24 nt, Human
uagugacaccagcggacccaaaaa

SEQ ID NO: 824306 - RNA, 22 nt, Human
ucacacaccugcccccuguccc

SEQ ID NO: 824307 - RNA, 24 nt, Human
ucagugaaacagguuuuaaaaaga

SEQ ID NO: 824308 - RNA, 24 nt, Human
ucagugaaacagguuuuaaaaaga

SEQ ID NO: 824309 - RNA, 21 nt, Human
uccaagaccccccaacaccau

SEQ ID NO: 824310 - RNA, 21 nt, Human
uccaagaccccccaacaccau

SEQ ID NO: 824311 - RNA, 27 nt, Human
uccaagaccccccaacaccauuagugu

SEQ ID NO: 824312 - RNA, 28 nt, Human
uccaagaccccccaacaccauuaguguc

SEQ ID NO: 824313 - RNA, 23 nt, Human
uccacagagaaaccgcuaagaaa

SEQ ID NO: 824314 - RNA, 20 nt, Human
uccaggugucuaaagaugcc

SEQ ID NO: 824315 - RNA, 18 nt, Human
ucccagguuuuugcucuc

SEQ ID NO: 824316 - RNA, 27 nt, Human
ucccccaggacuuucccaagauggugc

SEQ ID NO: 824317 - RNA, 27 nt, Human
ucccccaggacuuucccaauauggugc

SEQ ID NO: 824318 - RNA, 21 nt, Human
ucccgcccacaccaugcacgg

SEQ ID NO: 824319 - RNA, 21 nt, Human
ucccgcccacaccaugcacgg

SEQ ID NO: 824320 - RNA, 18 nt, Human
ucccggccuugggugcca

SEQ ID NO: 824321 - RNA, 18 nt, Human
ucccggccuugggugcca

SEQ ID NO: 824322 - RNA, 20 nt, Human
ucccuagagaaccagagccu

SEQ ID NO: 824323 - RNA, 20 nt, Human
ucccuagagaaccagagccu

SEQ ID NO: 824324 - RNA, 20 nt, Human
ucccucagggcagcagcagu

SEQ ID NO: 824325 - RNA, 21 nt, Human
ucccugcaccagcccagccgc

SEQ ID NO: 824326 - RNA, 22 nt, Human
ucccugcaccagcccagccgcc

SEQ ID NO: 824327 - RNA, 22 nt, Human
ucccugcaccagcccagccgcc

SEQ ID NO: 824328 - RNA, 21 nt, Human
uccugggugggugggggggcu

SEQ ID NO: 824329 - RNA, 21 nt, Human
uccugggugggugggggggcu

SEQ ID NO: 824330 - RNA, 20 nt, Human
ucgcagccagggcugggaca

SEQ ID NO: 824331 - RNA, 24 nt, Human
ucugcagcccaccaggaaggcacc

SEQ ID NO: 824332 - RNA, 24 nt, Human
ucugccagagcccagggcccucca

SEQ ID NO: 824333 - RNA, 24 nt, Human
ucugccagagcccagggcccucca

SEQ ID NO: 824334 - RNA, 22 nt, Human
ugaccacgucacugcacauccc

SEQ ID NO: 824335 - RNA, 22 nt, Human
ugaccacgucacugcacauccc

SEQ ID NO: 824336 - RNA, 23 nt, Human
ugacccaaagaccuuccuagaaa

SEQ ID NO: 824337 - RNA, 23 nt, Human
ugacccaaagaccuuccuagaaa

SEQ ID NO: 824338 - RNA, 24 nt, Human
ugacccaaagaccuuccuagaaac

SEQ ID NO: 824339 - RNA, 24 nt, Human
ugacccaaagaccuuccuagaaac

SEQ ID NO: 824340 - RNA, 19 nt, Human
ugacccaggacuccugucc

SEQ ID NO: 824341 - RNA, 19 nt, Human
ugacccaggacuccugucc

SEQ ID NO: 824342 - RNA, 18 nt, Human
ugcaaaaagcauucaucg

SEQ ID NO: 824343 - RNA, 18 nt, Human
ugcaguuacugcccuucc

SEQ ID NO: 824344 - RNA, 18 nt, Human
ugcaguuacugcccuucc

SEQ ID NO: 824345 - RNA, 22 nt, Human
ugccugccaagugcuggcccgg

SEQ ID NO: 824346 - RNA, 18 nt, Human
ugccuuggugaccacguc

SEQ ID NO: 824347 - RNA, 18 nt, Human
ugccuuggugaccacguc

SEQ ID NO: 824348 - RNA, 18 nt, Human
ugcuggguggauggcuca

SEQ ID NO: 824349 - RNA, 18 nt, Human
ugcuggguggauggcuca

SEQ ID NO: 824350 - RNA, 21 nt, Human
ugcuuuggggguucaaugggu

SEQ ID NO: 824351 - RNA, 21 nt, Human
ugcuuuggggguucaaugggu

SEQ ID NO: 824352 - RNA, 24 nt, Human
uggaaccugggaccagggugggag

SEQ ID NO: 824353 - RNA, 18 nt, Human
uggagagaaagaugcuuu

SEQ ID NO: 824354 - RNA, 22 nt, Human
uggaggagugccuccccccaau

SEQ ID NO: 824355 - RNA, 18 nt, Human
uggcagaggagggauggg

SEQ ID NO: 824356 - RNA, 18 nt, Human
uggcagaggagggauggg

SEQ ID NO: 824357 - RNA, 23 nt, Human
uggcagggcucaaaaggggccgg

SEQ ID NO: 824358 - RNA, 19 nt, Human
uggcgggguggggccaggg

SEQ ID NO: 824359 - RNA, 22 nt, Human
ugggaccagggugggaggcugg

SEQ ID NO: 824360 - RNA, 22 nt, Human
ugggaccagggugggaggcugg

SEQ ID NO: 824361 - RNA, 22 nt, Human
ugggaccagggugggaggcugg

SEQ ID NO: 824362 - RNA, 22 nt, Human
ugggaccagggugggaggcugg

SEQ ID NO: 824363 - RNA, 23 nt, Human
ugggaccagggugggaggcuggg

SEQ ID NO: 824364 - RNA, 23 nt, Human
ugggaccagggugggaggcuggg

SEQ ID NO: 824365 - RNA, 23 nt, Human
ugggaccagggugggaggcuggg

SEQ ID NO: 824366 - RNA, 23 nt, Human
ugggaccagggugggaggcuggg

SEQ ID NO: 824367 - RNA, 18 nt, Human
ugggaggcuggggggcuu

SEQ ID NO: 824368 - RNA, 18 nt, Human
ugggaggcuggggggcuu

SEQ ID NO: 824369 - RNA, 21 nt, Human
ugggaggcuggggggcuugcg

SEQ ID NO: 824370 - RNA, 28 nt, Human
ugggcccaaauccaccugcucaagucag

SEQ ID NO: 824371 - RNA, 23 nt, Human
ugggccugggggcguggcugcug

SEQ ID NO: 824372 - RNA, 23 nt, Human
ugggccugggggcguggcugcug

SEQ ID NO: 824373 - RNA, 20 nt, Human
uggggaaggggccaccgggc

SEQ ID NO: 824374 - RNA, 21 nt, Human
uggggagagaaagacaaccug

SEQ ID NO: 824375 - RNA, 21 nt, Human
uggggagagaaagacaaccug

SEQ ID NO: 824376 - RNA, 19 nt, Human
uggggcaccaggaccaucu

SEQ ID NO: 824377 - RNA, 19 nt, Human
uggggcaccaggaccaucu

SEQ ID NO: 824378 - RNA, 18 nt, Human
uggggccagggauguucu

SEQ ID NO: 824379 - RNA, 18 nt, Human
uggggccagggauguucu

SEQ ID NO: 824380 - RNA, 20 nt, Human
uggggccagggauguucugg

SEQ ID NO: 824381 - RNA, 20 nt, Human
uggggccagggauguucugg

SEQ ID NO: 824382 - RNA, 21 nt, Human
uggggccagggauguucuggg

SEQ ID NO: 824383 - RNA, 21 nt, Human
uggggccagggauguucuggg

SEQ ID NO: 824384 - RNA, 21 nt, Human
ugggggggcucaggccucggc

SEQ ID NO: 824385 - RNA, 24 nt, Human
ugggugggggggcuugcccuccag

SEQ ID NO: 824386 - RNA, 27 nt, Human
ugggugggggggcuugcccuccagugg

SEQ ID NO: 824387 - RNA, 19 nt, Human
ugucaccgacuacagaagc

SEQ ID NO: 824388 - RNA, 19 nt, Human
ugucaccgacuacagaagc

SEQ ID NO: 824389 - RNA, 20 nt, Human
ugugcugggaagcggguuga

SEQ ID NO: 824390 - RNA, 20 nt, Human
ugugcugggaagcggguuga

SEQ ID NO: 824391 - RNA, 20 nt, Human
uguggaaccugggaccaggg

SEQ ID NO: 824392 - RNA, 20 nt, Human
uguggaaccugggaccaggg

SEQ ID NO: 824393 - RNA, 21 nt, Human
uguggagagaaagaugcuuug

SEQ ID NO: 824394 - RNA, 23 nt, Human
uuccaagaccccccaacaccauu

SEQ ID NO: 824395 - RNA, 21 nt, Human
uuccaggugucuaaagaugcc

SEQ ID NO: 824396 - RNA, 21 nt, Human
uuccaggugucuaaagaugcc

SEQ ID NO: 824397 - RNA, 20 nt, Human
uucccagcuccguucucuug

SEQ ID NO: 824398 - RNA, 20 nt, Human
uucccagcuccguucucuug

SEQ ID NO: 824399 - RNA, 23 nt, Human
uucccggccuugggugccaucug

SEQ ID NO: 824400 - RNA, 23 nt, Human
uucccggccuugggugccaucug

SEQ ID NO: 824401 - RNA, 22 nt, Human
uuccggcugucccgcccacacc

SEQ ID NO: 824402 - RNA, 22 nt, Human
uuccggcugucccgcccacacc

SEQ ID NO: 824403 - RNA, 23 nt, Human
uugccgagaaguuaaaaugaccc

SEQ ID NO: 824404 - RNA, 23 nt, Human
uugccgagaaguuaaaaugaccc

SEQ ID NO: 824405 - RNA, 19 nt, Human
uuggggguucaauggguca

SEQ ID NO: 824406 - RNA, 19 nt, Human
uuggggguucaauggguca

SEQ ID NO: 824407 - RNA, 20 nt, Human
uuugcgggaaacugggacca

SEQ ID NO: 824408 - RNA, 20 nt, Human
uuugcgggaaacugggacca

SEQ ID NO: 824409 - RNA, 18 nt, Human
aaacagaaaccaccacag

SEQ ID NO: 824410 - RNA, 27 nt, Human
aacuugccucacucucaguccucuccc

SEQ ID NO: 824411 - RNA, 18 nt, Human
aagaaacagaaaccacca

SEQ ID NO: 824412 - RNA, 24 nt, Human
aagaaacagaaaccaccacagaca

SEQ ID NO: 824413 - RNA, 19 nt, Human
acagaaaccaccacagaca

SEQ ID NO: 824414 - RNA, 27 nt, Human
acagacagacagacggacaggggcugg

SEQ ID NO: 824415 - RNA, 25 nt, Human
acgcagcaccccagccccccacccc

SEQ ID NO: 824416 - RNA, 20 nt, Human
agacagacagacagacggaa

SEQ ID NO: 824417 - RNA, 24 nt, Human
agacagacagacagacggacaggg

SEQ ID NO: 824418 - RNA, 18 nt, Human
agccuccggcucggucuc

SEQ ID NO: 824419 - RNA, 23 nt, Human
aggcagcuuccuaucucucucuu

SEQ ID NO: 824420 - RNA, 22 nt, Human
augauccuaccaugccucccaa

SEQ ID NO: 824421 - RNA, 19 nt, Human
caaaccagucagguccccc

SEQ ID NO: 824422 - RNA, 19 nt, Human
caaggggccccaccaggcc

SEQ ID NO: 824423 - RNA, 22 nt, Human
caccacagacagacagacagac

SEQ ID NO: 824424 - RNA, 21 nt, Human
cacuggcuacgcagcacccca

SEQ ID NO: 824425 - RNA, 21 nt, Human
cagacacuccugcccuccuca

SEQ ID NO: 824426 - RNA, 21 nt, Human
cagcaccccagccccccaccc

SEQ ID NO: 824427 - RNA, 25 nt, Human
cagccaaaccagucaggucccccaa

SEQ ID NO: 824428 - RNA, 21 nt, Human
cagccuccggcucggucuccc

SEQ ID NO: 824429 - RNA, 19 nt, Human
caggucccccaaauauagc

SEQ ID NO: 824430 - RNA, 23 nt, Human
caugccucccaagaaacagaaac

SEQ ID NO: 824431 - RNA, 21 nt, Human
ccacagacagacagacagacg

SEQ ID NO: 824432 - RNA, 24 nt, Human
ccacagacagacagacagacggac

SEQ ID NO: 824433 - RNA, 18 nt, Human
ccaccaggcccucugccc

SEQ ID NO: 824434 - RNA, 19 nt, Human
cccaagaaacagaaaccac

SEQ ID NO: 824435 - RNA, 19 nt, Human
cccaagaaacagaaaccac

SEQ ID NO: 824436 - RNA, 31 nt, Human
cccaagaaacagaaaccaccacagacagacu

SEQ ID NO: 824437 - RNA, 21 nt, Human
cccaccccacccauagcagcg

SEQ ID NO: 824438 - RNA, 20 nt, Human
ccccagccccccaccccacc

SEQ ID NO: 824439 - RNA, 22 nt, Human
cccccaccccacccauagcagc

SEQ ID NO: 824440 - RNA, 22 nt, Human
cccccuugucuucuaucaccua

SEQ ID NO: 824441 - RNA, 19 nt, Human
ccccuuugcaagggguggc

SEQ ID NO: 824442 - RNA, 19 nt, Human
ccuaccaugccucccaaga

SEQ ID NO: 824443 - RNA, 22 nt, Human
ccuacucggaccuucucucuca

SEQ ID NO: 824444 - RNA, 22 nt, Human
ccucacucucaguccucuccca

SEQ ID NO: 824445 - RNA, 19 nt, Human
ccucccaagaaacagaaac

SEQ ID NO: 824446 - RNA, 22 nt, Human
ccucccaagaaacagaaaccac

SEQ ID NO: 824447 - RNA, 26 nt, Human
ccucccugccccagcacuucugggga

SEQ ID NO: 824448 - RNA, 23 nt, Human
cgaggcagcuuccuaucucucuc

SEQ ID NO: 824449 - RNA, 21 nt, Human
cguuugugggacacacccccu

SEQ ID NO: 824450 - RNA, 24 nt, Human
cucaugggacuccagccaaaccag

SEQ ID NO: 824451 - RNA, 21 nt, Human
cuccagacacuccugcccucc

SEQ ID NO: 824452 - RNA, 21 nt, Human
cuccucagcuggcguccuggc

SEQ ID NO: 824453 - RNA, 22 nt, Human
cuggggaagcagcgucucgggc

SEQ ID NO: 824454 - RNA, 23 nt, Human
cuuaugauccuaccaugccuccc

SEQ ID NO: 824455 - RNA, 21 nt, Human
cuuaugauccuaccaugccuu

SEQ ID NO: 824456 - RNA, 22 nt, Human
gaacuugccucacucucagucc

SEQ ID NO: 824457 - RNA, 21 nt, Human
ggacacacccccuuugcaagg

SEQ ID NO: 824458 - RNA, 21 nt, Human
ggaggggaaugacuuaugauc

SEQ ID NO: 824459 - RNA, 22 nt, Human
ggcuacgcagcaccccagcccc

SEQ ID NO: 824460 - RNA, 22 nt, Human
gggccccaccaggcccucugcc

SEQ ID NO: 824461 - RNA, 26 nt, Human
gucuucccuucuccuagcaaggggcc

SEQ ID NO: 824462 - RNA, 23 nt, Human
uaccaugccucccaagaaacaga

SEQ ID NO: 824463 - RNA, 19 nt, Human
ucaaacacuggcuacgcag

SEQ ID NO: 824464 - RNA, 22 nt, Human
ucaguccucucccacuuucccc

SEQ ID NO: 824465 - RNA, 18 nt, Human
uccugggccucccugccc

SEQ ID NO: 824466 - RNA, 18 nt, Human
ugcaagggguggccccga

SEQ ID NO: 824467 - RNA, 23 nt, Human
ugcaagggguggccccgaggcag

SEQ ID NO: 824468 - RNA, 24 nt, Human
ugccucacucucaguccucuccca

SEQ ID NO: 824469 - RNA, 23 nt, Human
uggaaggggaggggaaugacuua

SEQ ID NO: 824470 - RNA, 23 nt, Human
uugaaaagaaagucaaacacugg

SEQ ID NO: 824471 - RNA, 19 nt, Human
uuugugggacacacccccu

SEQ ID NO: 824472 - RNA, 23 nt, Human
aaaaaaaaaaagacgggcuaagg

SEQ ID NO: 824473 - RNA, 21 nt, Human
aaaaaaaaaagacgggcuaag

SEQ ID NO: 824474 - RNA, 23 nt, Human
aaaaaaagacgggcuaagguuua

SEQ ID NO: 824475 - RNA, 18 nt, Human
aaagccuuggccucaucc

SEQ ID NO: 824476 - RNA, 20 nt, Human
aagcaucucccaagccagac

SEQ ID NO: 824477 - RNA, 21 nt, Human
acaaccaaaagauaagaaagc

SEQ ID NO: 824478 - RNA, 23 nt, Human
acaaccaaaagauaagaaagccu

SEQ ID NO: 824479 - RNA, 20 nt, Human
accucauuccugagguggaa

SEQ ID NO: 824480 - RNA, 19 nt, Human
agaaagccuuggccucauc

SEQ ID NO: 824481 - RNA, 25 nt, Human
agacaaucaagaguacuauugaaac

SEQ ID NO: 824482 - RNA, 25 nt, Human
agcagagacaaccaaaagauaagaa

SEQ ID NO: 824483 - RNA, 20 nt, Human
aggccuccauccuaggccag

SEQ ID NO: 824484 - RNA, 22 nt, Human
aguugguucucucuucaguagg

SEQ ID NO: 824485 - RNA, 20 nt, Human
caaacuaaaugucccuuccc

SEQ ID NO: 824486 - RNA, 21 nt, Human
caaacuaaaugucccuucccc

SEQ ID NO: 824487 - RNA, 22 nt, Human
caacagcaagaaaccugaaauc

SEQ ID NO: 824488 - RNA, 23 nt, Human
caacagcaagaaaccugaaaucc

SEQ ID NO: 824489 - RNA, 24 nt, Human
caacagcaagaaaccugaaaucca

SEQ ID NO: 824490 - RNA, 23 nt, Human
cacaaccucauuccugaggugga

SEQ ID NO: 824491 - RNA, 19 nt, Human
cagcaagaaaccugaaauc

SEQ ID NO: 824492 - RNA, 21 nt, Human
caggaaagaucacaaccucau

SEQ ID NO: 824493 - RNA, 22 nt, Human
cauccccaucaggagauagccu

SEQ ID NO: 824494 - RNA, 20 nt, Human
cauuuaaaaaaccccuucug

SEQ ID NO: 824495 - RNA, 20 nt, Human
ccaacaaagguuaccuucuu

SEQ ID NO: 824496 - RNA, 18 nt, Human
ccaggcuccuccauuaag

SEQ ID NO: 824497 - RNA, 22 nt, Human
ccccguucucccugggccuccc

SEQ ID NO: 824498 - RNA, 19 nt, Human
ccuuccccguucucccugg

SEQ ID NO: 824499 - RNA, 25 nt, Human
cucacaaauaagaaacaacuugacc

SEQ ID NO: 824500 - RNA, 23 nt, Human
cuccauccuaggccaggcuccuc

SEQ ID NO: 824501 - RNA, 23 nt, Human
cugaggacugguuccugaugagu

SEQ ID NO: 824502 - RNA, 26 nt, Human
gacuuagcacccuucuggagaacaua

SEQ ID NO: 824503 - RNA, 21 nt, Human
gcuccuccauuaagcagagac

SEQ ID NO: 824504 - RNA, 21 nt, Human
gucaggacaggaaagaucaca

SEQ ID NO: 824505 - RNA, 20 nt, Human
gucccuuccccguucucccu

SEQ ID NO: 824506 - RNA, 21 nt, Human
guugguucucucuucaguagg

SEQ ID NO: 824507 - RNA, 20 nt, Human
uaaaaaaccccuucuggcug

SEQ ID NO: 824508 - RNA, 23 nt, Human
uaagcagagacaaccaaaagaua

SEQ ID NO: 824509 - RNA, 26 nt, Human
ucauuuaaaaaaccccuucuggcugc

SEQ ID NO: 824510 - RNA, 22 nt, Human
uccccguucucccugggccucc

SEQ ID NO: 824511 - RNA, 19 nt, Human
ugacuuagcacccuucugg

SEQ ID NO: 824512 - RNA, 24 nt, Human
ugcaaccugaaagcaucucccaag

SEQ ID NO: 824513 - RNA, 19 nt, Human
uggggguagagaugaugac

SEQ ID NO: 824514 - RNA, 24 nt, Human
uuccccguucucccugggccuccc

SEQ ID NO: 824515 - RNA, 18 nt, Human
accccgcccuccuauagc

SEQ ID NO: 824516 - RNA, 24 nt, Human
agaaaccagaguccacagcgggug

SEQ ID NO: 824517 - RNA, 22 nt, Human
caccccgcccuccuauagcucg

SEQ ID NO: 824518 - RNA, 18 nt, Human
cuccuauagcucggcucc

SEQ ID NO: 824519 - RNA, 18 nt, Human
agaacugugggcuaagca

SEQ ID NO: 824520 - RNA, 23 nt, Human
agaagacaacuuuggaucugggc

SEQ ID NO: 824521 - RNA, 18 nt, Human
caagugaaauggagaacu

SEQ ID NO: 824522 - RNA, 19 nt, Human
cccuaagaugaagacugau

SEQ ID NO: 824523 - RNA, 23 nt, Human
cgagugauuuuucucugugugaa

SEQ ID NO: 824524 - RNA, 20 nt, Human
gagaggcacauucagauuug

SEQ ID NO: 824525 - RNA, 26 nt, Human
gagcgaugcccuaagaugaagacuga

SEQ ID NO: 824526 - RNA, 21 nt, Human
gaguguguuuuuucuccagca

SEQ ID NO: 824527 - RNA, 20 nt, Human
gggcuaagcaaaggagugug

SEQ ID NO: 824528 - RNA, 20 nt, Human
uauguacaugcugguaucug

SEQ ID NO: 824529 - RNA, 21 nt, Human
ucagauuccagcugcugguac

SEQ ID NO: 824530 - RNA, 19 nt, Human
ucagcauuuggaaguucua

SEQ ID NO: 824531 - RNA, 21 nt, Human
ucagugugauugcagccucaa

SEQ ID NO: 824532 - RNA, 19 nt, Human
ucuccagcaggcagugggg

SEQ ID NO: 824533 - RNA, 18 nt, Human
ucuguugggggugucuug

SEQ ID NO: 824534 - RNA, 18 nt, Human
ugaaauggagaacugugg

SEQ ID NO: 824535 - RNA, 22 nt, Human
uggaacagcacgugucuaagug

SEQ ID NO: 824536 - RNA, 23 nt, Human
ugugaguuccucagugugauugc

SEQ ID NO: 824537 - RNA, 18 nt, Human
uguggugugaggaagagc

SEQ ID NO: 824538 - RNA, 23 nt, Human
uguuccaauuaugcguaugucac

SEQ ID NO: 824539 - RNA, 20 nt, Human
uuaugcguaugucaccuccu

SEQ ID NO: 824540 - RNA, 24 nt, Human
uuggaaguucuauguacaugcugg

SEQ ID NO: 824541 - RNA, 28 nt, Human
aacaguccuuagguuacugaccuucugg

SEQ ID NO: 824542 - RNA, 24 nt, Human
accugcagccgccucaccgacucc

SEQ ID NO: 824543 - RNA, 19 nt, Human
agccggaccagcggcuccg

SEQ ID NO: 824544 - RNA, 23 nt, Human
cacucagcggguagaauguagcc

SEQ ID NO: 824545 - RNA, 18 nt, Human
gagcugacgcgacgccug

SEQ ID NO: 824546 - RNA, 20 nt, Human
gguguggguuaagggcacgg

SEQ ID NO: 824547 - RNA, 24 nt, Human
uagaauguagccacaacaaacuuc

SEQ ID NO: 824548 - RNA, 22 nt, Human
ucacaucuccgccagccggacc

SEQ ID NO: 824549 - RNA, 20 nt, Human
ugcgcagcuuuggaaucacc

SEQ ID NO: 824550 - RNA, 20 nt, Human
uggaaucaccagcauuugca

SEQ ID NO: 824551 - RNA, 20 nt, Human
uuuuuuuuuuuuaacagucc

SEQ ID NO: 824552 - RNA, 23 nt, Human
uuuuuuuuuuuuuuuuuuaacag

SEQ ID NO: 824553 - RNA, 20 nt, Human
aaaauccugaacagaaaacc

SEQ ID NO: 824554 - RNA, 18 nt, Human
aaaauguacaagcuacaa

SEQ ID NO: 824555 - RNA, 24 nt, Human
aaacaaaacaaaaacaaucaacga

SEQ ID NO: 824556 - RNA, 22 nt, Human
aaacaaaugaaagauucaaugu

SEQ ID NO: 824557 - RNA, 22 nt, Human
aaacaagaaaaggggagcauaa

SEQ ID NO: 824558 - RNA, 28 nt, Human
aaacagaaucgaaacaaaacaaaaacaa

SEQ ID NO: 824559 - RNA, 21 nt, Human
aaacagacauuauaaugaaac

SEQ ID NO: 824560 - RNA, 23 nt, Human
aaacuagaagcucucuuucccaa

SEQ ID NO: 824561 - RNA, 22 nt, Human
aaagaaaaaguacugaggcgac

SEQ ID NO: 824562 - RNA, 24 nt, Human
aaagaugcaguauccuucuauuuc

SEQ ID NO: 824563 - RNA, 21 nt, Human
aaagcaaaucagaugcagccc

SEQ ID NO: 824564 - RNA, 23 nt, Human
aaaguccuuuuauucauuauugc

SEQ ID NO: 824565 - RNA, 22 nt, Human
aaaucugaaccauaaugaaaac

SEQ ID NO: 824566 - RNA, 18 nt, Human
aaauuagcagaaagggaa

SEQ ID NO: 824567 - RNA, 21 nt, Human
aacaaaacagaaucgaaacaa

SEQ ID NO: 824568 - RNA, 23 nt, Human
aacaacuuaagaucagaccauga

SEQ ID NO: 824569 - RNA, 23 nt, Human
aacacugcuuaauuucugucaau

SEQ ID NO: 824570 - RNA, 20 nt, Human
aacagaaaaccaaaugaaga

SEQ ID NO: 824571 - RNA, 22 nt, Human
aacagcuucaaauuuaaaauca

SEQ ID NO: 824572 - RNA, 19 nt, Human
aaccacuuucuccuuucca

SEQ ID NO: 824573 - RNA, 24 nt, Human
aaccagcacuggcaugcaucaaca

SEQ ID NO: 824574 - RNA, 18 nt, Human
aaccauaaugaaaacggc

SEQ ID NO: 824575 - RNA, 20 nt, Human
aaccccuuucuaaacuaaag

SEQ ID NO: 824576 - RNA, 21 nt, Human
aacucagccacacuucccaug

SEQ ID NO: 824577 - RNA, 25 nt, Human
aagaagcccagucagaagacuugac

SEQ ID NO: 824578 - RNA, 21 nt, Human
aagaugcuauuuaucacuagu

SEQ ID NO: 824579 - RNA, 19 nt, Human
aagcaaaauccugugcagc

SEQ ID NO: 824580 - RNA, 21 nt, Human
aagcaggcuucucagagucca

SEQ ID NO: 824581 - RNA, 21 nt, Human
aagcucucuuucccaacauac

SEQ ID NO: 824582 - RNA, 20 nt, Human
aaguaacucacauuucuaga

SEQ ID NO: 824583 - RNA, 18 nt, Human
aaguaggaguugcauaua

SEQ ID NO: 824584 - RNA, 20 nt, Human
aaucucauuaggagggucuc

SEQ ID NO: 824585 - RNA, 21 nt, Human
aauguguaggaccuccucugg

SEQ ID NO: 824586 - RNA, 22 nt, Human
aauuuuauggggcugauggaac

SEQ ID NO: 824587 - RNA, 20 nt, Human
acaacaaaucguggacagac

SEQ ID NO: 824588 - RNA, 22 nt, Human
acaacaacaauaacaacaaaaa

SEQ ID NO: 824589 - RNA, 21 nt, Human
acaauacagucacuaccccac

SEQ ID NO: 824590 - RNA, 22 nt, Human
acaauacauacacuauacauaa

SEQ ID NO: 824591 - RNA, 25 nt, Human
acacacacacacacacucgcacaca

SEQ ID NO: 824592 - RNA, 25 nt, Human
acacacacacacacucgcacacaca

SEQ ID NO: 824593 - RNA, 23 nt, Human
acacacacggcgucacccgcgca

SEQ ID NO: 824594 - RNA, 19 nt, Human
acagaaagcuggaaaaaaa

SEQ ID NO: 824595 - RNA, 18 nt, Human
acagacacguugauagga

SEQ ID NO: 824596 - RNA, 20 nt, Human
acagcacggaaaacaaugcc

SEQ ID NO: 824597 - RNA, 18 nt, Human
acccacuacuugccaacu

SEQ ID NO: 824598 - RNA, 23 nt, Human
acccgaugugugacucuccauga

SEQ ID NO: 824599 - RNA, 21 nt, Human
acccgcgcacacgcacacgca

SEQ ID NO: 824600 - RNA, 20 nt, Human
acuauacauaaauacaagaa

SEQ ID NO: 824601 - RNA, 28 nt, Human
acugguugcuauuguuuguuacuagggu

SEQ ID NO: 824602 - RNA, 22 nt, Human
agaaaagagaacaauuguaaga

SEQ ID NO: 824603 - RNA, 25 nt, Human
agaaaagagaacaauuguaagaugc

SEQ ID NO: 824604 - RNA, 24 nt, Human
agaaaaugaaaucgguauagaaga

SEQ ID NO: 824605 - RNA, 18 nt, Human
agaagggccccagucugc

SEQ ID NO: 824606 - RNA, 23 nt, Human
agaauagacuggaauaaucaucc

SEQ ID NO: 824607 - RNA, 21 nt, Human
agaauguccagacauuuaaaa

SEQ ID NO: 824608 - RNA, 22 nt, Human
agaauugacccccacacaccaa

SEQ ID NO: 824609 - RNA, 24 nt, Human
agacaacacaugguaagaagccca

SEQ ID NO: 824610 - RNA, 23 nt, Human
agacaagccccaaagaaguuuca

SEQ ID NO: 824611 - RNA, 21 nt, Human
agaccuccaggucaggacccu

SEQ ID NO: 824612 - RNA, 20 nt, Human
agagucaggaaucugggaag

SEQ ID NO: 824613 - RNA, 18 nt, Human
agaucagaccaugaaaag

SEQ ID NO: 824614 - RNA, 21 nt, Human
agcaacaacaacaauaacaac

SEQ ID NO: 824615 - RNA, 21 nt, Human
agcaagcaggacuaaauacaa

SEQ ID NO: 824616 - RNA, 26 nt, Human
agccacagaaagcuggaaaaaaaccc

SEQ ID NO: 824617 - RNA, 18 nt, Human
aggaaauauuaggggaaa

SEQ ID NO: 824618 - RNA, 21 nt, Human
aggaaauauuaggggaaaggg

SEQ ID NO: 824619 - RNA, 20 nt, Human
aggaagagaugaugccuagg

SEQ ID NO: 824620 - RNA, 20 nt, Human
aggacuaaauacaaaucuac

SEQ ID NO: 824621 - RNA, 19 nt, Human
agggaugggaugaugggag

SEQ ID NO: 824622 - RNA, 27 nt, Human
agggauucuuaaaaccucaaaggaaac

SEQ ID NO: 824623 - RNA, 21 nt, Human
aggguuggagaauuuccaggg

SEQ ID NO: 824624 - RNA, 23 nt, Human
aggugcuaaaaaaaacccacugg

SEQ ID NO: 824625 - RNA, 21 nt, Human
auaaaacaagaauaaacaccu

SEQ ID NO: 824626 - RNA, 24 nt, Human
auaaaaugaacaagcaaacaaaua

SEQ ID NO: 824627 - RNA, 24 nt, Human
auacaggcagaccuccaggucaga

SEQ ID NO: 824628 - RNA, 21 nt, Human
auagggcaaaaaaaucaccau

SEQ ID NO: 824629 - RNA, 25 nt, Human
aucaaucucuauacugcaaacagaa

SEQ ID NO: 824630 - RNA, 21 nt, Human
aucacaguccuacuuuuaaaa

SEQ ID NO: 824631 - RNA, 24 nt, Human
augaaucaauacugucagagaccu

SEQ ID NO: 824632 - RNA, 19 nt, Human
augaauucuaaaaaccaag

SEQ ID NO: 824633 - RNA, 22 nt, Human
augaauuuuugagaccuggcag

SEQ ID NO: 824634 - RNA, 23 nt, Human
augaauuuuugagaccuggcaga

SEQ ID NO: 824635 - RNA, 18 nt, Human
augacauaauacauaaga

SEQ ID NO: 824636 - RNA, 23 nt, Human
augcaggcagagucauauauagu

SEQ ID NO: 824637 - RNA, 23 nt, Human
auggacaugagaugaaauggagg

SEQ ID NO: 824638 - RNA, 18 nt, Human
auugcuuggcacacagug

SEQ ID NO: 824639 - RNA, 21 nt, Human
auuuaaaacauuccacaacag

SEQ ID NO: 824640 - RNA, 20 nt, Human
auuuuaaaccauccuggcua

SEQ ID NO: 824641 - RNA, 27 nt, Human
caaaaacaaucaacgacaaacaaauga

SEQ ID NO: 824642 - RNA, 22 nt, Human
caaaacaauacagucacuaccc

SEQ ID NO: 824643 - RNA, 22 nt, Human
caaaaucugagacuggauuaug

SEQ ID NO: 824644 - RNA, 20 nt, Human
caaaaugauucuuaagauga

SEQ ID NO: 824645 - RNA, 21 nt, Human
caaacaacuuaagaucagacc

SEQ ID NO: 824646 - RNA, 18 nt, Human
caaacaagaaaaggggag

SEQ ID NO: 824647 - RNA, 23 nt, Human
caaaucagaugcagcccaucuau

SEQ ID NO: 824648 - RNA, 23 nt, Human
caaauuauuuauaagacuauuua

SEQ ID NO: 824649 - RNA, 22 nt, Human
caacaacaauaacaacaaaaaa

SEQ ID NO: 824650 - RNA, 21 nt, Human
caacacauuugcuugccagca

SEQ ID NO: 824651 - RNA, 28 nt, Human
caaccaagcaggacaacaaacagcagaa

SEQ ID NO: 824652 - RNA, 21 nt, Human
caacuuaagaucagaccauga

SEQ ID NO: 824653 - RNA, 23 nt, Human
caagacaagccccaaagaaguuu

SEQ ID NO: 824654 - RNA, 22 nt, Human
caagcaggacaacaaacagcag

SEQ ID NO: 824655 - RNA, 22 nt, Human
caauacagucacuaccccacag

SEQ ID NO: 824656 - RNA, 26 nt, Human
caauacauacacuauacauaaauaca

SEQ ID NO: 824657 - RNA, 22 nt, Human
cacaacaaaucguggacagaca

SEQ ID NO: 824658 - RNA, 23 nt, Human
cacaacaaaucguggacagacac

SEQ ID NO: 824659 - RNA, 27 nt, Human
cacacacacacacacacucgcacacac

SEQ ID NO: 824660 - RNA, 24 nt, Human
cacacacucgcacacacacggcgg

SEQ ID NO: 824661 - RNA, 18 nt, Human
cacagagucccccucucu

SEQ ID NO: 824662 - RNA, 24 nt, Human
cacgcacacgcagagccucucagc

SEQ ID NO: 824663 - RNA, 18 nt, Human
cacuccauucucugcccu

SEQ ID NO: 824664 - RNA, 23 nt, Human
cagaaucgaaacaaaacaaaaac

SEQ ID NO: 824665 - RNA, 21 nt, Human
cagaaugacaaguugagagug

SEQ ID NO: 824666 - RNA, 24 nt, Human
cagagauaggcgguuucacuuucc

SEQ ID NO: 824667 - RNA, 22 nt, Human
cagagucccccucucucucucc

SEQ ID NO: 824668 - RNA, 18 nt, Human
cagaguucaggagaaggg

SEQ ID NO: 824669 - RNA, 21 nt, Human
cagcacggaaaacaaugccug

SEQ ID NO: 824670 - RNA, 27 nt, Human
cagcacggaaaacaaugccugucucuu

SEQ ID NO: 824671 - RNA, 20 nt, Human
cagccccaccucuuaccuug

SEQ ID NO: 824672 - RNA, 22 nt, Human
cagcucagaaaauguacaagcu

SEQ ID NO: 824673 - RNA, 21 nt, Human
cagcuggacagguagcauucc

SEQ ID NO: 824674 - RNA, 22 nt, Human
caggagaugcugcaguuuccau

SEQ ID NO: 824675 - RNA, 22 nt, Human
caggcuaaaaugcuacuaagua

SEQ ID NO: 824676 - RNA, 24 nt, Human
cagguaacguaucuaaaaauugcc

SEQ ID NO: 824677 - RNA, 20 nt, Human
caguaauuacaggaaaaaac

SEQ ID NO: 824678 - RNA, 24 nt, Human
cagucaacuuuuuaucuggaaauu

SEQ ID NO: 824679 - RNA, 19 nt, Human
caguuuagaaaaugaaauc

SEQ ID NO: 824680 - RNA, 23 nt, Human
caucucagucugguuuccacuuu

SEQ ID NO: 824681 - RNA, 27 nt, Human
caucucagucugguuuccacuuuuuug

SEQ ID NO: 824682 - RNA, 19 nt, Human
caugcacauauccccagcu

SEQ ID NO: 824683 - RNA, 20 nt, Human
cauuagaaaucucagucuaa

SEQ ID NO: 824684 - RNA, 21 nt, Human
ccaaaccacuuucuccuuucc

SEQ ID NO: 824685 - RNA, 18 nt, Human
ccaagcaggacaacaaac

SEQ ID NO: 824686 - RNA, 22 nt, Human
ccaaucaccacguauaaugagc

SEQ ID NO: 824687 - RNA, 22 nt, Human
ccacagaaagcuggaaaaaaac

SEQ ID NO: 824688 - RNA, 19 nt, Human
ccacagagaguugguuugc

SEQ ID NO: 824689 - RNA, 20 nt, Human
ccaugcacauauccccagcu

SEQ ID NO: 824690 - RNA, 23 nt, Human
ccauuaaccgaagaguuaauucc

SEQ ID NO: 824691 - RNA, 21 nt, Human
cccaagaguguuuuguaaaau

SEQ ID NO: 824692 - RNA, 24 nt, Human
cccacauagacaugaacaaaacaa

SEQ ID NO: 824693 - RNA, 21 nt, Human
cccacgugcagugugguggag

SEQ ID NO: 824694 - RNA, 23 nt, Human
ccccacacaccaagaacaacguc

SEQ ID NO: 824695 - RNA, 26 nt, Human
ccccagcugcaaacugaacagcuuca

SEQ ID NO: 824696 - RNA, 23 nt, Human
ccccuuucuaaacuaaagccaaa

SEQ ID NO: 824697 - RNA, 18 nt, Human
cccgcgcacacgcacacg

SEQ ID NO: 824698 - RNA, 19 nt, Human
cccgcgcacacgcacacgc

SEQ ID NO: 824699 - RNA, 20 nt, Human
ccgcgcacacgcacacgcag

SEQ ID NO: 824700 - RNA, 18 nt, Human
ccuaaacacuacagagua

SEQ ID NO: 824701 - RNA, 24 nt, Human
ccucaaaggcugaaagucauaacu

SEQ ID NO: 824702 - RNA, 20 nt, Human
ccucacacagagucccccuc

SEQ ID NO: 824703 - RNA, 20 nt, Human
ccucugagagaaucucauua

SEQ ID NO: 824704 - RNA, 22 nt, Human
ccugcgguccagguaaaaggac

SEQ ID NO: 824705 - RNA, 22 nt, Human
ccuggggucagagacccaagag

SEQ ID NO: 824706 - RNA, 20 nt, Human
ccuuuaggauucuacugcuu

SEQ ID NO: 824707 - RNA, 18 nt, Human
ccuuuucaggaaaagaca

SEQ ID NO: 824708 - RNA, 24 nt, Human
cgaacagaugaacaaaaggaguuc

SEQ ID NO: 824709 - RNA, 23 nt, Human
cgacaaacaaaugaaagauucaa

SEQ ID NO: 824710 - RNA, 27 nt, Human
cgcacacacacacacacacucgcacac

SEQ ID NO: 824711 - RNA, 26 nt, Human
cgcacacacacggcgucacccgcgca

SEQ ID NO: 824712 - RNA, 18 nt, Human
cgcagagccucucagcgg

SEQ ID NO: 824713 - RNA, 25 nt, Human
cgcgcacacacacacacacacucgc

SEQ ID NO: 824714 - RNA, 28 nt, Human
cgcgcacacacacacacacacucgcaca

SEQ ID NO: 824715 - RNA, 18 nt, Human
cgcgcacacgcacacgca

SEQ ID NO: 824716 - RNA, 27 nt, Human
cgcgcacacgcacacgcagagccucuc

SEQ ID NO: 824717 - RNA, 27 nt, Human
cgcgcgcacacacacacacacacucgc

SEQ ID NO: 824718 - RNA, 20 nt, Human
cgugcagugugguggagugg

SEQ ID NO: 824719 - RNA, 24 nt, Human
cuaacauugggaggagaaaacagu

SEQ ID NO: 824720 - RNA, 22 nt, Human
cuaaucaccuggaacuggcauu

SEQ ID NO: 824721 - RNA, 19 nt, Human
cuagcaacaacaacaauaa

SEQ ID NO: 824722 - RNA, 26 nt, Human
cuagcaacaacaacaauaacaacaaa

SEQ ID NO: 824723 - RNA, 23 nt, Human
cucaacacauuugcuugccagca

SEQ ID NO: 824724 - RNA, 23 nt, Human
cucaguaauuagcauauuuaaag

SEQ ID NO: 824725 - RNA, 20 nt, Human
cucccuuucucucucucaca

SEQ ID NO: 824726 - RNA, 24 nt, Human
cuccucugggcacucuuaacuccc

SEQ ID NO: 824727 - RNA, 20 nt, Human
cucgcacacacacggcguca

SEQ ID NO: 824728 - RNA, 22 nt, Human
cucugagaauagacuggaauaa

SEQ ID NO: 824729 - RNA, 19 nt, Human
cucugugccaguccaugcc

SEQ ID NO: 824730 - RNA, 21 nt, Human
cugagaaaagagaacaauugu

SEQ ID NO: 824731 - RNA, 24 nt, Human
cugcagagcaggagaaauuguuuu

SEQ ID NO: 824732 - RNA, 21 nt, Human
cugcugcauauacaguugugu

SEQ ID NO: 824733 - RNA, 18 nt, Human
cuggcuaaaccaugacaa

SEQ ID NO: 824734 - RNA, 27 nt, Human
cuggcucuuuuuaugagagcaagcagg

SEQ ID NO: 824735 - RNA, 20 nt, Human
cugugagcuucugaaugugc

SEQ ID NO: 824736 - RNA, 19 nt, Human
cuguuacucaacugcuuuu

SEQ ID NO: 824737 - RNA, 18 nt, Human
cuuccaaaaagcuauucu

SEQ ID NO: 824738 - RNA, 22 nt, Human
gaaaagcaaugcaccaacagaa

SEQ ID NO: 824739 - RNA, 20 nt, Human
gaaauuaggucuuuagauaa

SEQ ID NO: 824740 - RNA, 24 nt, Human
gaacaacgucuagacuacuacuaa

SEQ ID NO: 824741 - RNA, 18 nt, Human
gaacaacuguuauguccu

SEQ ID NO: 824742 - RNA, 22 nt, Human
gaacaagcaaacaaauauccuu

SEQ ID NO: 824743 - RNA, 19 nt, Human
gaacuaacaccuuccucuc

SEQ ID NO: 824744 - RNA, 24 nt, Human
gaauagcuauuaucuucaugguuu

SEQ ID NO: 824745 - RNA, 19 nt, Human
gaauugacccccacacacc

SEQ ID NO: 824746 - RNA, 21 nt, Human
gaauuugcugguuucucuuuu

SEQ ID NO: 824747 - RNA, 21 nt, Human
gacaaguggccacucuauuuu

SEQ ID NO: 824748 - RNA, 20 nt, Human
gacagugauuuuucaaaaug

SEQ ID NO: 824749 - RNA, 19 nt, Human
gagaagggccccagucugc

SEQ ID NO: 824750 - RNA, 18 nt, Human
gagcauguuaugauacac

SEQ ID NO: 824751 - RNA, 23 nt, Human
gaguacauucuucuauggacaaa

SEQ ID NO: 824752 - RNA, 22 nt, Human
gauacgucaaaaggggaaaaug

SEQ ID NO: 824753 - RNA, 18 nt, Human
gcaaagaugguuaaaggc

SEQ ID NO: 824754 - RNA, 21 nt, Human
gcaaagggcugccugagugcc

SEQ ID NO: 824755 - RNA, 21 nt, Human
gcaacaacaacaauaacaaca

SEQ ID NO: 824756 - RNA, 25 nt, Human
gcacacacacacacacacucgcaca

SEQ ID NO: 824757 - RNA, 24 nt, Human
gcacuaccucagaaaaacuaaagg

SEQ ID NO: 824758 - RNA, 18 nt, Human
gcagaggacacagcacgg

SEQ ID NO: 824759 - RNA, 18 nt, Human
gcagagguggaugcagaa

SEQ ID NO: 824760 - RNA, 18 nt, Human
gcaguuuccauuauccau

SEQ ID NO: 824761 - RNA, 20 nt, Human
gccacacuucccaugucucc

SEQ ID NO: 824762 - RNA, 27 nt, Human
gcgcacacacacacacacacucgcaca

SEQ ID NO: 824763 - RNA, 21 nt, Human
gcgcgcacacacacacacaca

SEQ ID NO: 824764 - RNA, 25 nt, Human
gcgcgcacacacacacacacacucg

SEQ ID NO: 824765 - RNA, 28 nt, Human
gcgcgcgcacacacacacacacacucgc

SEQ ID NO: 824766 - RNA, 25 nt, Human
gcgcgcgcgcacacacacacacaca

SEQ ID NO: 824767 - RNA, 25 nt, Human
ggaaagagccuugaauauaggcacc

SEQ ID NO: 824768 - RNA, 18 nt, Human
ggaaccaagacaccuaaa

SEQ ID NO: 824769 - RNA, 19 nt, Human
ggaacuaacaccuuccucu

SEQ ID NO: 824770 - RNA, 21 nt, Human
ggaagauguugguaugucccu

SEQ ID NO: 824771 - RNA, 22 nt, Human
ggcaggaagagaugaugccuag

SEQ ID NO: 824772 - RNA, 24 nt, Human
ggcaggaagagaugaugccuaggu

SEQ ID NO: 824773 - RNA, 23 nt, Human
gggaaaggggaaugaagaaaugu

SEQ ID NO: 824774 - RNA, 21 nt, Human
gggaaugaagaaauguaaaga

SEQ ID NO: 824775 - RNA, 18 nt, Human
gggagcauaaucuuuaau

SEQ ID NO: 824776 - RNA, 20 nt, Human
gggggacaggagaugcugca

SEQ ID NO: 824777 - RNA, 24 nt, Human
ggugauguauugcuuguuuacugu

SEQ ID NO: 824778 - RNA, 23 nt, Human
ggugcaggagguauuagaaaaga

SEQ ID NO: 824779 - RNA, 23 nt, Human
gguggagugggaaagauacaggc

SEQ ID NO: 824780 - RNA, 20 nt, Human
guguauaaguucccaaccau

SEQ ID NO: 824781 - RNA, 23 nt, Human
guuaaagguuuaaacucuauuuc

SEQ ID NO: 824782 - RNA, 20 nt, Human
guugaggaacugagaaagug

SEQ ID NO: 824783 - RNA, 22 nt, Human
uaaaacaagaauaaacaccugu

SEQ ID NO: 824784 - RNA, 18 nt, Human
uaaaacacagauggcaau

SEQ ID NO: 824785 - RNA, 22 nt, Human
uaaaacacuccauucucugccc

SEQ ID NO: 824786 - RNA, 19 nt, Human
uaaaaugcaggcagaguca

SEQ ID NO: 824787 - RNA, 22 nt, Human
uaacaacauaacaaaggcguau

SEQ ID NO: 824788 - RNA, 23 nt, Human
uaacucacauuucuagacagcac

SEQ ID NO: 824789 - RNA, 19 nt, Human
uaacugagaaaagagaaca

SEQ ID NO: 824790 - RNA, 19 nt, Human
uaacuuaccaucucagucu

SEQ ID NO: 824791 - RNA, 23 nt, Human
uaagaaauguuaauguaaacaag

SEQ ID NO: 824792 - RNA, 18 nt, Human
uaagacaaguuaucaagc

SEQ ID NO: 824793 - RNA, 23 nt, Human
uaagguaaguaacucacauuucu

SEQ ID NO: 824794 - RNA, 19 nt, Human
uaagguaucaauaacaaaa

SEQ ID NO: 824795 - RNA, 23 nt, Human
uaagucauuuuaaguggcaggug

SEQ ID NO: 824796 - RNA, 18 nt, Human
uaagugucagugguacuu

SEQ ID NO: 824797 - RNA, 22 nt, Human
uaauaacuaugauuuccaaagu

SEQ ID NO: 824798 - RNA, 18 nt, Human
uacaagcuacaaacaucu

SEQ ID NO: 824799 - RNA, 22 nt, Human
uacaauacauacacuauacaua

SEQ ID NO: 824800 - RNA, 25 nt, Human
uacagaacaccucugugccagucca

SEQ ID NO: 824801 - RNA, 21 nt, Human
uacagaguauauaaaugcaga

SEQ ID NO: 824802 - RNA, 24 nt, Human
uacaggaaaaaaccugugagcuuc

SEQ ID NO: 824803 - RNA, 21 nt, Human
uacagguuaaguggaaggcag

SEQ ID NO: 824804 - RNA, 19 nt, Human
uacaguaauuacaggaaaa

SEQ ID NO: 824805 - RNA, 21 nt, Human
uacaguuuagaaaaugaaauc

SEQ ID NO: 824806 - RNA, 21 nt, Human
uaccuguaauacucucaagac

SEQ ID NO: 824807 - RNA, 18 nt, Human
uaccuuggugccagugug

SEQ ID NO: 824808 - RNA, 25 nt, Human
uacuauaaacaaauuauuuauaaga

SEQ ID NO: 824809 - RNA, 21 nt, Human
uagaacaacaucauggcuaca

SEQ ID NO: 824810 - RNA, 21 nt, Human
uagaacacaaguagggcaaaa

SEQ ID NO: 824811 - RNA, 21 nt, Human
uagaagaugauccuaaaaagg

SEQ ID NO: 824812 - RNA, 19 nt, Human
uagacaggcucuuccuauu

SEQ ID NO: 824813 - RNA, 20 nt, Human
uagagaugaaauccagaaag

SEQ ID NO: 824814 - RNA, 22 nt, Human
uagcaacaacaacaauaacaac

SEQ ID NO: 824815 - RNA, 26 nt, Human
uagcaacaacaacaauaacaacaaaa

SEQ ID NO: 824816 - RNA, 19 nt, Human
uaggagggucucccuuuac

SEQ ID NO: 824817 - RNA, 18 nt, Human
uagggaguuuuguuuuuu

SEQ ID NO: 824818 - RNA, 25 nt, Human
uagggcaaaaaaaucaccauuuuac

SEQ ID NO: 824819 - RNA, 21 nt, Human
uaguaaccagcacuggcaugc

SEQ ID NO: 824820 - RNA, 20 nt, Human
uauacaaaugcauacaguua

SEQ ID NO: 824821 - RNA, 23 nt, Human
uaucaagcaggcuucucagaguc

SEQ ID NO: 824822 - RNA, 21 nt, Human
uaucugaauuagaagaugauc

SEQ ID NO: 824823 - RNA, 23 nt, Human
uauucuggauguaauuacaaaau

SEQ ID NO: 824824 - RNA, 21 nt, Human
ucaaacaagaaaaggggagca

SEQ ID NO: 824825 - RNA, 20 nt, Human
ucacaugugcaggaaaaaac

SEQ ID NO: 824826 - RNA, 23 nt, Human
ucaccaaauaacuguuuucaaac

SEQ ID NO: 824827 - RNA, 20 nt, Human
ucaccaaggagaauuugcca

SEQ ID NO: 824828 - RNA, 21 nt, Human
ucaccagauuuauucaguugc

SEQ ID NO: 824829 - RNA, 21 nt, Human
ucacugacuuugccugggcag

SEQ ID NO: 824830 - RNA, 18 nt, Human
ucacuuuccuacucugcc

SEQ ID NO: 824831 - RNA, 18 nt, Human
ucagaccaaaagaagugu

SEQ ID NO: 824832 - RNA, 21 nt, Human
ucagaccaugaaaagggauuc

SEQ ID NO: 824833 - RNA, 22 nt, Human
ucagaguccacacacaauugac

SEQ ID NO: 824834 - RNA, 20 nt, Human
ucaguuaacuuaccaucuca

SEQ ID NO: 824835 - RNA, 20 nt, Human
ucaguuccugaggcuagacc

SEQ ID NO: 824836 - RNA, 19 nt, Human
ucauaagaguuaccucaca

SEQ ID NO: 824837 - RNA, 22 nt, Human
uccaagagaggaaacuagcacc

SEQ ID NO: 824838 - RNA, 21 nt, Human
uccacagcacuuaaucuuguc

SEQ ID NO: 824839 - RNA, 22 nt, Human
uccagguaaaaggacagagaaa

SEQ ID NO: 824840 - RNA, 18 nt, Human
uccaugaacaacucagcc

SEQ ID NO: 824841 - RNA, 20 nt, Human
uccaugaacaacucagccac

SEQ ID NO: 824842 - RNA, 25 nt, Human
uccaugccagggcagagaccaggac

SEQ ID NO: 824843 - RNA, 18 nt, Human
uccaugggggugaaaauu

SEQ ID NO: 824844 - RNA, 22 nt, Human
uccauuauccauugaacaccuu

SEQ ID NO: 824845 - RNA, 20 nt, Human
uccauuucuuucugucccaa

SEQ ID NO: 824846 - RNA, 19 nt, Human
ucccaaagagcauucagcu

SEQ ID NO: 824847 - RNA, 18 nt, Human
ucccacauagacaugaac

SEQ ID NO: 824848 - RNA, 22 nt, Human
uccccagcugcaaacugaacag

SEQ ID NO: 824849 - RNA, 19 nt, Human
uccccugacaaucaucuuc

SEQ ID NO: 824850 - RNA, 21 nt, Human
uccccugacaaucaucuuccu

SEQ ID NO: 824851 - RNA, 23 nt, Human
uccccugacaaucaucuuccuuu

SEQ ID NO: 824852 - RNA, 23 nt, Human
ucccucucuguguucucugucac

SEQ ID NO: 824853 - RNA, 23 nt, Human
ucccuggaauaaaacaagaauaa

SEQ ID NO: 824854 - RNA, 24 nt, Human
ucccuugccuuucuagucaccaaa

SEQ ID NO: 824855 - RNA, 19 nt, Human
uccgucucccuuuucuucu

SEQ ID NO: 824856 - RNA, 23 nt, Human
uccugguacauuuccgucucccu

SEQ ID NO: 824857 - RNA, 25 nt, Human
uccugugcagcuguuuugcccuuuu

SEQ ID NO: 824858 - RNA, 23 nt, Human
ucgaaacaaaacaaaaacaauca

SEQ ID NO: 824859 - RNA, 19 nt, Human
ucuaaaaauugccuagucu

SEQ ID NO: 824860 - RNA, 24 nt, Human
ucuaacugccuuaauagaacuuaa

SEQ ID NO: 824861 - RNA, 19 nt, Human
ucucgucuagucaugaugg

SEQ ID NO: 824862 - RNA, 25 nt, Human
ucucuauacugcaaacagaaaauca

SEQ ID NO: 824863 - RNA, 18 nt, Human
ucucucucucccuuucuc

SEQ ID NO: 824864 - RNA, 22 nt, Human
ucucucucucccuuucucucuc

SEQ ID NO: 824865 - RNA, 18 nt, Human
ucuguguguaugugugug

SEQ ID NO: 824866 - RNA, 21 nt, Human
ucuguugaggagggagauaac

SEQ ID NO: 824867 - RNA, 24 nt, Human
ugaaaacggccuuucuaaucaccu

SEQ ID NO: 824868 - RNA, 21 nt, Human
ugaaaauacuuuuuccacuau

SEQ ID NO: 824869 - RNA, 25 nt, Human
ugaaaucgguauagaagaaccuauu

SEQ ID NO: 824870 - RNA, 21 nt, Human
ugaacagaacacgaagagcau

SEQ ID NO: 824871 - RNA, 18 nt, Human
ugaacagaagcugcagag

SEQ ID NO: 824872 - RNA, 19 nt, Human
ugaacugauuccaaagugc

SEQ ID NO: 824873 - RNA, 20 nt, Human
ugaagcuuuaaacacaacaa

SEQ ID NO: 824874 - RNA, 23 nt, Human
ugaaguggggcaguaguuuuuua

SEQ ID NO: 824875 - RNA, 21 nt, Human
ugaauaccauccaacacaaau

SEQ ID NO: 824876 - RNA, 21 nt, Human
ugaaugaaaagcugcugacau

SEQ ID NO: 824877 - RNA, 19 nt, Human
ugacaggcacuuucagcau

SEQ ID NO: 824878 - RNA, 22 nt, Human
ugacauucucuuaauguuuucu

SEQ ID NO: 824879 - RNA, 23 nt, Human
ugacuaguaaccagcacuggcau

SEQ ID NO: 824880 - RNA, 20 nt, Human
ugagaaaagugacaaguucg

SEQ ID NO: 824881 - RNA, 19 nt, Human
ugagacaccauuaaaaaca

SEQ ID NO: 824882 - RNA, 23 nt, Human
ugagagcaagcaggacuaaauac

SEQ ID NO: 824883 - RNA, 20 nt, Human
ugagcauggaagagaauuug

SEQ ID NO: 824884 - RNA, 18 nt, Human
ugaggaacugagaaagug

SEQ ID NO: 824885 - RNA, 24 nt, Human
ugagggaaaauguucccuucccca

SEQ ID NO: 824886 - RNA, 21 nt, Human
ugaguagaaaugucauaugga

SEQ ID NO: 824887 - RNA, 23 nt, Human
ugauagccucaguagcuuguuug

SEQ ID NO: 824888 - RNA, 18 nt, Human
ugauguuggacagcuucu

SEQ ID NO: 824889 - RNA, 18 nt, Human
ugcacaaaggguggacuc

SEQ ID NO: 824890 - RNA, 21 nt, Human
ugcacuaccucagaaaaacua

SEQ ID NO: 824891 - RNA, 21 nt, Human
ugcacuaccucagaaaaacua

SEQ ID NO: 824892 - RNA, 19 nt, Human
ugcagaggaaacuauuggg

SEQ ID NO: 824893 - RNA, 23 nt, Human
ugcagaggaaacuauugggaaau

SEQ ID NO: 824894 - RNA, 21 nt, Human
ugcagcagguugugcacaugg

SEQ ID NO: 824895 - RNA, 24 nt, Human
ugcaucuuuauccauauaaauguu

SEQ ID NO: 824896 - RNA, 24 nt, Human
ugccaugggaaaacuagaacacaa

SEQ ID NO: 824897 - RNA, 23 nt, Human
ugccuuaauagaacuuaagacaa

SEQ ID NO: 824898 - RNA, 21 nt, Human
ugcucaguaauuagcauauuu

SEQ ID NO: 824899 - RNA, 26 nt, Human
ugcuuuauuuaaccuucaugccuuca

SEQ ID NO: 824900 - RNA, 18 nt, Human
uggaaaaaaacccagcuu

SEQ ID NO: 824901 - RNA, 19 nt, Human
uggaaaaaaacccagcuug

SEQ ID NO: 824902 - RNA, 19 nt, Human
uggaaccaagacaccuaaa

SEQ ID NO: 824903 - RNA, 19 nt, Human
uggagugggaaagauacag

SEQ ID NO: 824904 - RNA, 22 nt, Human
uggaugauuuuggagcuccagg

SEQ ID NO: 824905 - RNA, 22 nt, Human
uggcagaaugacaaguugagag

SEQ ID NO: 824906 - RNA, 21 nt, Human
ugggaugcacuaccucagaaa

SEQ ID NO: 824907 - RNA, 23 nt, Human
ugguggggacaaaaauaugguaa

SEQ ID NO: 824908 - RNA, 19 nt, Human
uguaaagaugaauuugugc

SEQ ID NO: 824909 - RNA, 24 nt, Human
uguaaauggaaccaagacaccuaa

SEQ ID NO: 824910 - RNA, 25 nt, Human
uguauguguguguguguucacaugu

SEQ ID NO: 824911 - RNA, 21 nt, Human
uguccuuuaggauucuacugc

SEQ ID NO: 824912 - RNA, 19 nt, Human
ugugcauguguuggggcug

SEQ ID NO: 824913 - RNA, 21 nt, Human
ugugguaggugaccuuuaagg

SEQ ID NO: 824914 - RNA, 22 nt, Human
uguguacacacaugugcaugug

SEQ ID NO: 824915 - RNA, 25 nt, Human
uguguacacacaugugcauguguug

SEQ ID NO: 824916 - RNA, 19 nt, Human
uguguguaugugugugugu

SEQ ID NO: 824917 - RNA, 20 nt, Human
uguguguaugugugugugug

SEQ ID NO: 824918 - RNA, 21 nt, Human
uguguguguguucacaugugc

SEQ ID NO: 824919 - RNA, 19 nt, Human
uguuauguccuuuaggauu

SEQ ID NO: 824920 - RNA, 20 nt, Human
uguucacacucuguugagga

SEQ ID NO: 824921 - RNA, 20 nt, Human
uguugcuguuacucaacugc

SEQ ID NO: 824922 - RNA, 19 nt, Human
uguuggagggaaauugcuu

SEQ ID NO: 824923 - RNA, 22 nt, Human
uguuguggagaaauuauugcuu

SEQ ID NO: 824924 - RNA, 21 nt, Human
uguuucauaaguuuggggcaa

SEQ ID NO: 824925 - RNA, 23 nt, Human
uguuuguuuauaaugauccuuca

SEQ ID NO: 824926 - RNA, 23 nt, Human
uuaacacguggccauauccacag

SEQ ID NO: 824927 - RNA, 24 nt, Human
uuaacacugugaaggggauucagc

SEQ ID NO: 824928 - RNA, 22 nt, Human
uuaccaaaccccuuucuaaacu

SEQ ID NO: 824929 - RNA, 25 nt, Human
uuacuaguuuggaaucaguugucgu

SEQ ID NO: 824930 - RNA, 22 nt, Human
uuacucucucuguguguaugug

SEQ ID NO: 824931 - RNA, 19 nt, Human
uuagaaaagugcaacucau

SEQ ID NO: 824932 - RNA, 24 nt, Human
uucaaacaagaaaaggggagcaua

SEQ ID NO: 824933 - RNA, 19 nt, Human
uucaaaggaugaacauauu

SEQ ID NO: 824934 - RNA, 18 nt, Human
uucaacagacuuuuuggg

SEQ ID NO: 824935 - RNA, 23 nt, Human
uucaagccuagaauaacuguuuu

SEQ ID NO: 824936 - RNA, 18 nt, Human
uucagcagagaaaagaac

SEQ ID NO: 824937 - RNA, 22 nt, Human
uucauauagucucauuguauau

SEQ ID NO: 824938 - RNA, 20 nt, Human
uuccaaaaagcuauucugua

SEQ ID NO: 824939 - RNA, 21 nt, Human
uucccaugucuccguuuccca

SEQ ID NO: 824940 - RNA, 20 nt, Human
uucucagaguccacacacaa

SEQ ID NO: 824941 - RNA, 19 nt, Human
uucuuucccucacacagag

SEQ ID NO: 824942 - RNA, 21 nt, Human
uugaaguggggcaguaguuuu

SEQ ID NO: 824943 - RNA, 23 nt, Human
uugaauacagaaaagcaaugcac

SEQ ID NO: 824944 - RNA, 28 nt, Human
uugaauacagaaaagcaaugcaccaaca

SEQ ID NO: 824945 - RNA, 23 nt, Human
uugaaucauacauacuguuucau

SEQ ID NO: 824946 - RNA, 21 nt, Human
uugagaccuggcagacaauau

SEQ ID NO: 824947 - RNA, 23 nt, Human
uugaggaacaaaauauacacuau

SEQ ID NO: 824948 - RNA, 18 nt, Human
uugguuugccaugugaug

SEQ ID NO: 824949 - RNA, 23 nt, Human
uuguaacuaaaauuucuguaaaa

SEQ ID NO: 824950 - RNA, 21 nt, Human
uuuaugagaaaagugacaagu

SEQ ID NO: 824951 - RNA, 22 nt, Human
uuuauguugcuguuacucaacu

SEQ ID NO: 824952 - RNA, 23 nt, Human
uuuauguugcuguuacucaacug

SEQ ID NO: 824953 - RNA, 22 nt, Human
uuuauucaaaagaacaugacgu

SEQ ID NO: 824954 - RNA, 18 nt, Human
uuugaaaacaaauguccu

SEQ ID NO: 824955 - RNA, 23 nt, Human
uuugcccuuuucaggaaaagaca

SEQ ID NO: 824956 - RNA, 21 nt, Human
uuugcgccaaauaaauuggug

SEQ ID NO: 824957 - RNA, 19 nt, Human
uuugucccucucuguguuc

SEQ ID NO: 824958 - RNA, 24 nt, Human
uuugugcucugagauggcaggguu

SEQ ID NO: 824959 - RNA, 21 nt, Human
uuuucagaaacagaaacacua

SEQ ID NO: 824960 - RNA, 19 nt, Human
uuuugaaaacaaauguccu

SEQ ID NO: 824961 - RNA, 21 nt, Human
uuuuuuuucaaauaugacuga

SEQ ID NO: 824962 - RNA, 25 nt, Human
aaggggcccaggcuccccguggguc

SEQ ID NO: 824963 - RNA, 29 nt, Human
aaggggcccaggcuccccgugggucccgg

SEQ ID NO: 824964 - RNA, 22 nt, Human
acccagguccagucucaggccc

SEQ ID NO: 824965 - RNA, 20 nt, Human
aggcagggcgggggaggggc

SEQ ID NO: 824966 - RNA, 19 nt, Human
aggccaggcagggcggggg

SEQ ID NO: 824967 - RNA, 23 nt, Human
aggucucuccaagccccuggaca

SEQ ID NO: 824968 - RNA, 21 nt, Human
cacgccucucggagccgccuc

SEQ ID NO: 824969 - RNA, 26 nt, Human
caggcccccuccucacucucuggagg

SEQ ID NO: 824970 - RNA, 20 nt, Human
caggcuccccguggguccuc

SEQ ID NO: 824971 - RNA, 23 nt, Human
ccacccacggaaagcacacgccu

SEQ ID NO: 824972 - RNA, 20 nt, Human
ccccugcaaacggcuggaac

SEQ ID NO: 824973 - RNA, 23 nt, Human
ccucacuacaccccuggauggca

SEQ ID NO: 824974 - RNA, 20 nt, Human
cuacaccccuggauggcaga

SEQ ID NO: 824975 - RNA, 23 nt, Human
cucuccaagccccuggacacucu

SEQ ID NO: 824976 - RNA, 21 nt, Human
cucucuggaggggggcagggg

SEQ ID NO: 824977 - RNA, 21 nt, Human
gagaguggaggggugggcgca

SEQ ID NO: 824978 - RNA, 23 nt, Human
gcuggaaccaggucccagugauc

SEQ ID NO: 824979 - RNA, 18 nt, Human
ggaggggggcaggggugu

SEQ ID NO: 824980 - RNA, 22 nt, Human
ggcccaggcuccccgugggucc

SEQ ID NO: 824981 - RNA, 23 nt, Human
gggcaggggugucuucaggguuu

SEQ ID NO: 824982 - RNA, 19 nt, Human
ggggcgccacccacggaaa

SEQ ID NO: 824983 - RNA, 18 nt, Human
ucaggcccccuccucacu

SEQ ID NO: 824984 - RNA, 19 nt, Human
ucccagugaucagcgacuc

SEQ ID NO: 824985 - RNA, 20 nt, Human
uccccugcaaacggcuggaa

SEQ ID NO: 824986 - RNA, 23 nt, Human
uccuggcggucagggugggcugc

SEQ ID NO: 824987 - RNA, 19 nt, Human
ucuccaagccccuggacac

SEQ ID NO: 824988 - RNA, 23 nt, Human
ucucggagccgccuccccugcaa

SEQ ID NO: 824989 - RNA, 21 nt, Human
ucucuggaggggggcaggggu

SEQ ID NO: 824990 - RNA, 19 nt, Human
ugaggccaggcagggcggg

SEQ ID NO: 824991 - RNA, 24 nt, Human
ugaggccaggcagggcgggggagg

SEQ ID NO: 824992 - RNA, 23 nt, Human
ugaggucaggcagacccaggucc

SEQ ID NO: 824993 - RNA, 21 nt, Human
aagaggugauugcacuagcuu

SEQ ID NO: 824994 - RNA, 22 nt, Human
aaucaaauuaaaauguacaugu

SEQ ID NO: 824995 - RNA, 19 nt, Human
acccgugguaaggagaggg

SEQ ID NO: 824996 - RNA, 19 nt, Human
agagaacaucuacuacuga

SEQ ID NO: 824997 - RNA, 20 nt, Human
agcugcaggcgcgaaggagg

SEQ ID NO: 824998 - RNA, 18 nt, Human
aggacagagagagagcca

SEQ ID NO: 824999 - RNA, 18 nt, Human
aggcaggacacagaggca

SEQ ID NO: 825000 - RNA, 19 nt, Human
aggcaggacacagaggcaa

SEQ ID NO: 825001 - RNA, 23 nt, Human
aggcaggacagagagagagccaa

SEQ ID NO: 825002 - RNA, 21 nt, Human
agggcaaagaacugaauucag

SEQ ID NO: 825003 - RNA, 20 nt, Human
agggcgccgccgacgagaaa

SEQ ID NO: 825004 - RNA, 19 nt, Human
agggugcucugguguuugg

SEQ ID NO: 825005 - RNA, 18 nt, Human
aguggggagucacgcuga

SEQ ID NO: 825006 - RNA, 23 nt, Human
augucagggcuccaguccgggcg

SEQ ID NO: 825007 - RNA, 27 nt, Human
caaauuaaaauguacauguaaaaaaug

SEQ ID NO: 825008 - RNA, 26 nt, Human
cagaccagcugaaucaaauuaaaaug

SEQ ID NO: 825009 - RNA, 23 nt, Human
cauccccagaaaaaaaaaaaaaa

SEQ ID NO: 825010 - RNA, 24 nt, Human
ccagaaaaaaaaaaaaaaaguguu

SEQ ID NO: 825011 - RNA, 19 nt, Human
gagucacgcugaggcagga

SEQ ID NO: 825012 - RNA, 27 nt, Human
gauaaugggaggcaggacagagagaga

SEQ ID NO: 825013 - RNA, 21 nt, Human
gaucacagggcagagguaaga

SEQ ID NO: 825014 - RNA, 18 nt, Human
gauugcacuagcuugaaa

SEQ ID NO: 825015 - RNA, 21 nt, Human
gccuggagccccccgagcgca

SEQ ID NO: 825016 - RNA, 20 nt, Human
ggcggaagaggugauugcac

SEQ ID NO: 825017 - RNA, 18 nt, Human
gggcggcguuggcggccg

SEQ ID NO: 825018 - RNA, 18 nt, Human
gucucuggcaaggacuag

SEQ ID NO: 825019 - RNA, 21 nt, Human
uaaaaaauguguuagauaaug

SEQ ID NO: 825020 - RNA, 20 nt, Human
uaaaaaauuggcggaagagg

SEQ ID NO: 825021 - RNA, 21 nt, Human
ucacagggcagagguaagaau

SEQ ID NO: 825022 - RNA, 22 nt, Human
uccagguugacaagauuuguaa

SEQ ID NO: 825023 - RNA, 20 nt, Human
uccccagaaaaaaaaaaaaa

SEQ ID NO: 825024 - RNA, 22 nt, Human
uccccagaaaaaaaaaaaaaaa

SEQ ID NO: 825025 - RNA, 22 nt, Human
ugagcugcaggcgcgaaggagg

SEQ ID NO: 825026 - RNA, 24 nt, Human
ugccuggagccccccgagcgcagc

SEQ ID NO: 825027 - RNA, 20 nt, Human
ugucagggcuccaguccggg

SEQ ID NO: 825028 - RNA, 21 nt, Human
ugucagggcuccaguccgggc

SEQ ID NO: 825029 - RNA, 26 nt, Human
uuagagaacaucuacuacugaccaua

SEQ ID NO: 825030 - RNA, 18 nt, Human
uuccauaugagcugcagg

SEQ ID NO: 825031 - RNA, 22 nt, Human
uucccuuguucuuauuacauuc

SEQ ID NO: 825032 - RNA, 20 nt, Human
uucuagggugcucugguguu

SEQ ID NO: 825033 - RNA, 20 nt, Human
uuugaggaauacauggagaa

SEQ ID NO: 825034 - RNA, 18 nt, Human
aagaagcaaaacagcaac

SEQ ID NO: 825035 - RNA, 19 nt, Human
aagaagcaaaacagcaacc

SEQ ID NO: 825036 - RNA, 19 nt, Human
aagcaaaacagcaaccgau

SEQ ID NO: 825037 - RNA, 25 nt, Human
acaauccauucuucuucuggugccu

SEQ ID NO: 825038 - RNA, 19 nt, Human
acaggaauaguuaggucug

SEQ ID NO: 825039 - RNA, 19 nt, Human
acaguacugcacgagcgaa

SEQ ID NO: 825040 - RNA, 20 nt, Human
accacaaauccuaacuguaa

SEQ ID NO: 825041 - RNA, 23 nt, Human
accacaauacaaaaauaagaggg

SEQ ID NO: 825042 - RNA, 20 nt, Human
accgugcucucaggcucucc

SEQ ID NO: 825043 - RNA, 18 nt, Human
acgcugcacacacucccc

SEQ ID NO: 825044 - RNA, 22 nt, Human
agcaaccgauuucugcuuuuca

SEQ ID NO: 825045 - RNA, 23 nt, Human
agggagcccaggggaccuggaac

SEQ ID NO: 825046 - RNA, 20 nt, Human
agguuucggguggacuccuc

SEQ ID NO: 825047 - RNA, 22 nt, Human
caaaacagcaaccgauuucugc

SEQ ID NO: 825048 - RNA, 22 nt, Human
caaaagaauccuaaaaaacuug

SEQ ID NO: 825049 - RNA, 24 nt, Human
caaauauacaaaauauacauuucc

SEQ ID NO: 825050 - RNA, 24 nt, Human
cacaaaauaaauaaagauaaacaa

SEQ ID NO: 825051 - RNA, 18 nt, Human
caccucgcccacgcuggc

SEQ ID NO: 825052 - RNA, 22 nt, Human
cacuguguauuacaugcaaaau

SEQ ID NO: 825053 - RNA, 21 nt, Human
cauuacagcaagcauuccaga

SEQ ID NO: 825054 - RNA, 21 nt, Human
ccacacguaaacgccaacguc

SEQ ID NO: 825055 - RNA, 22 nt, Human
ccagauucuuaaaaugaccaaa

SEQ ID NO: 825056 - RNA, 24 nt, Human
cccaccccuuacccauguugagac

SEQ ID NO: 825057 - RNA, 22 nt, Human
ccccaccccuuacccauguuga

SEQ ID NO: 825058 - RNA, 23 nt, Human
ccccaccccuuacccauguugag

SEQ ID NO: 825059 - RNA, 25 nt, Human
ccccuucacccccaccccuuaccca

SEQ ID NO: 825060 - RNA, 25 nt, Human
cccgccccgccccaccgugcucuca

SEQ ID NO: 825061 - RNA, 19 nt, Human
ccgccccgccccaccgugc

SEQ ID NO: 825062 - RNA, 20 nt, Human
ccgccccgccccaccgugcu

SEQ ID NO: 825063 - RNA, 22 nt, Human
ccgccccgccccaccgugcucu

SEQ ID NO: 825064 - RNA, 21 nt, Human
ccgcucccgccaccgccgacc

SEQ ID NO: 825065 - RNA, 25 nt, Human
ccgcucccgccaccgccgaccuccg

SEQ ID NO: 825066 - RNA, 22 nt, Human
cgccccgccccaccgugcucuc

SEQ ID NO: 825067 - RNA, 18 nt, Human
cggcggaggaggggaggu

SEQ ID NO: 825068 - RNA, 18 nt, Human
cggggcugccggcggagg

SEQ ID NO: 825069 - RNA, 19 nt, Human
cuccccuucacccccaccc

SEQ ID NO: 825070 - RNA, 23 nt, Human
cucuuccccaaaagaauccuaaa

SEQ ID NO: 825071 - RNA, 19 nt, Human
cugcacacacuccccuuca

SEQ ID NO: 825072 - RNA, 23 nt, Human
cugcacacacuccccuucacccc

SEQ ID NO: 825073 - RNA, 19 nt, Human
cugcaucauaaaugcaaca

SEQ ID NO: 825074 - RNA, 22 nt, Human
cuggugccugccaacugauuug

SEQ ID NO: 825075 - RNA, 21 nt, Human
cuucacccccaccccuuaccc

SEQ ID NO: 825076 - RNA, 19 nt, Human
cuuuuaggcacuuuuuauu

SEQ ID NO: 825077 - RNA, 18 nt, Human
gagagaaccgcgagcgca

SEQ ID NO: 825078 - RNA, 23 nt, Human
gcaagcauuccagauucuuaaaa

SEQ ID NO: 825079 - RNA, 19 nt, Human
gcauaggaaaugaccacaa

SEQ ID NO: 825080 - RNA, 18 nt, Human
gcccgcucccgccaccgc

SEQ ID NO: 825081 - RNA, 20 nt, Human
gggcugccggcggaggaggg

SEQ ID NO: 825082 - RNA, 18 nt, Human
uaaaaacgcugcacacac

SEQ ID NO: 825083 - RNA, 20 nt, Human
uaauagauuaacuaaacugc

SEQ ID NO: 825084 - RNA, 27 nt, Human
uaccacaaaauaaauaaagauaaacaa

SEQ ID NO: 825085 - RNA, 24 nt, Human
uaggaaaugaccacaauacaaaaa

SEQ ID NO: 825086 - RNA, 23 nt, Human
uauaaacaucucauucucucaaa

SEQ ID NO: 825087 - RNA, 21 nt, Human
uauaaacauuuugaagccucu

SEQ ID NO: 825088 - RNA, 23 nt, Human
uauuaccacaaaauaaauaaaga

SEQ ID NO: 825089 - RNA, 21 nt, Human
ucaaugccaaguaaaaucuug

SEQ ID NO: 825090 - RNA, 23 nt, Human
ucagacagcggcaggcaguuuuc

SEQ ID NO: 825091 - RNA, 19 nt, Human
ucagugcaugaaauuugcu

SEQ ID NO: 825092 - RNA, 18 nt, Human
ucauuugaaugauuauuc

SEQ ID NO: 825093 - RNA, 19 nt, Human
uccacacguaaacgccaac

SEQ ID NO: 825094 - RNA, 19 nt, Human
ucccuguuuucucaaauau

SEQ ID NO: 825095 - RNA, 21 nt, Human
ucucaggcucuccggagcccg

SEQ ID NO: 825096 - RNA, 22 nt, Human
ucucccgccccgccccaccgug

SEQ ID NO: 825097 - RNA, 24 nt, Human
ugaauagcaaauauaggcaacuca

SEQ ID NO: 825098 - RNA, 20 nt, Human
ugaccaaacacuuugguauu

SEQ ID NO: 825099 - RNA, 21 nt, Human
ugagagguaccuuaccacaaa

SEQ ID NO: 825100 - RNA, 21 nt, Human
ugagaugagaugagaucugcu

SEQ ID NO: 825101 - RNA, 22 nt, Human
ugauuuugguaauguugagagg

SEQ ID NO: 825102 - RNA, 23 nt, Human
ugcacgagcgaacaucucgauau

SEQ ID NO: 825103 - RNA, 22 nt, Human
ugccggcggaggaggggagguu

SEQ ID NO: 825104 - RNA, 18 nt, Human
ugguaauguugagaggua

SEQ ID NO: 825105 - RNA, 22 nt, Human
uguaacuaucuuuaagcucuuc

SEQ ID NO: 825106 - RNA, 24 nt, Human
uguauuacaugcaaaauccacaua

SEQ ID NO: 825107 - RNA, 22 nt, Human
uuacaugcaaaauccacauaaa

SEQ ID NO: 825108 - RNA, 18 nt, Human
uuaggucugucauuugag

SEQ ID NO: 825109 - RNA, 22 nt, Human
uucaacauaucauuuauauuua

SEQ ID NO: 825110 - RNA, 21 nt, Human
uucacccccaccccuuaccca

SEQ ID NO: 825111 - RNA, 23 nt, Human
uuccaguuuuaguugugguuuuc

SEQ ID NO: 825112 - RNA, 19 nt, Human
uuccuuaaguuuucaacau

SEQ ID NO: 825113 - RNA, 25 nt, Human
uucuacaacuauacagcuguuugcu

SEQ ID NO: 825114 - RNA, 19 nt, Human
uugagacuggcugccuguc

SEQ ID NO: 825115 - RNA, 23 nt, Human
uugugguuuucuuguuuuuuuuu

SEQ ID NO: 825116 - RNA, 22 nt, Human
uuugcauaggaaaugaccacaa

SEQ ID NO: 825117 - RNA, 26 nt, Human
uuuuauauugcauauauguagcauuu

SEQ ID NO: 825118 - RNA, 21 nt, Human
uuuuuuuuuuuuuuucuuuua

SEQ ID NO: 825119 - RNA, 24 nt, Human
uuuuuuuuuuuuuuuucuuuuagg

SEQ ID NO: 825120 - RNA, 24 nt, Human
aaaaaaaacugaaaauguuuuuaa

SEQ ID NO: 825121 - RNA, 25 nt, Human
aaaaauauucaaaccacagcagcca

SEQ ID NO: 825122 - RNA, 21 nt, Human
aaagucaccagucccccacuc

SEQ ID NO: 825123 - RNA, 20 nt, Human
aacacaguaaaagcuuuccu

SEQ ID NO: 825124 - RNA, 21 nt, Human
aagaagcaacauugucuuuca

SEQ ID NO: 825125 - RNA, 22 nt, Human
aagcacaguuauguuugagugc

SEQ ID NO: 825126 - RNA, 19 nt, Human
aaucaaaaaguccauucag

SEQ ID NO: 825127 - RNA, 24 nt, Human
aaugaugacaguugaggacauuug

SEQ ID NO: 825128 - RNA, 22 nt, Human
aauggauuaauccaucguuaua

SEQ ID NO: 825129 - RNA, 18 nt, Human
acagaaaggaaacggagc

SEQ ID NO: 825130 - RNA, 21 nt, Human
acagaaccuggguaauuuaua

SEQ ID NO: 825131 - RNA, 18 nt, Human
acagcagccauaguggcc

SEQ ID NO: 825132 - RNA, 23 nt, Human
accuagacuaagaucucaaggua

SEQ ID NO: 825133 - RNA, 20 nt, Human
aggaaauaaaguuuauuuaa

SEQ ID NO: 825134 - RNA, 19 nt, Human
agggcacagaccucauggc

SEQ ID NO: 825135 - RNA, 22 nt, Human
agguaagucccaagguaacaca

SEQ ID NO: 825136 - RNA, 22 nt, Human
aguuauguuugagugcccuggg

SEQ ID NO: 825137 - RNA, 19 nt, Human
auggcagguguaagaagaa

SEQ ID NO: 825138 - RNA, 21 nt, Human
caaaaaggggcaacagccaca

SEQ ID NO: 825139 - RNA, 21 nt, Human
caaaaaggggcaacagccaca

SEQ ID NO: 825140 - RNA, 19 nt, Human
caaaccacagcagccauag

SEQ ID NO: 825141 - RNA, 22 nt, Human
caaaguacaaauaucuuuguac

SEQ ID NO: 825142 - RNA, 19 nt, Human
caaucaccucuuaagggcc

SEQ ID NO: 825143 - RNA, 20 nt, Human
cacaauccacaauaaaaaga

SEQ ID NO: 825144 - RNA, 20 nt, Human
cacagaaaggaaacggagcc

SEQ ID NO: 825145 - RNA, 21 nt, Human
cacagcagccauaguggccug

SEQ ID NO: 825146 - RNA, 23 nt, Human
cagaaggaaacugucuuucagug

SEQ ID NO: 825147 - RNA, 22 nt, Human
cagguaagucccaagguaacac

SEQ ID NO: 825148 - RNA, 18 nt, Human
caggugaugugauuggga

SEQ ID NO: 825149 - RNA, 24 nt, Human
cagugugggaugauuaaaucaagc

SEQ ID NO: 825150 - RNA, 21 nt, Human
cauaauaauccauuaauccau

SEQ ID NO: 825151 - RNA, 24 nt, Human
cauauguauacagugugggaugau

SEQ ID NO: 825152 - RNA, 21 nt, Human
cauugucuuaguucauuuucu

SEQ ID NO: 825153 - RNA, 24 nt, Human
ccuagacuaagaucuccgacagcg

SEQ ID NO: 825154 - RNA, 24 nt, Human
ccuagacuaagaucuccgacagcg

SEQ ID NO: 825155 - RNA, 23 nt, Human
cgagggaaaaaaauauucaaacc

SEQ ID NO: 825156 - RNA, 22 nt, Human
cguagcaggaggaaagacaaaa

SEQ ID NO: 825157 - RNA, 18 nt, Human
cuaacauuuucuacugga

SEQ ID NO: 825158 - RNA, 18 nt, Human
cuccauaucaaaaagggg

SEQ ID NO: 825159 - RNA, 20 nt, Human
cuugaaaauuagguaguuca

SEQ ID NO: 825160 - RNA, 21 nt, Human
cuuuuccacugguugacaccc

SEQ ID NO: 825161 - RNA, 23 nt, Human
gaacacggucauagugauuauag

SEQ ID NO: 825162 - RNA, 22 nt, Human
gaccucauggcccaaucaccuc

SEQ ID NO: 825163 - RNA, 19 nt, Human
gacuuaguaucuccagcag

SEQ ID NO: 825164 - RNA, 22 nt, Human
gagggaaaaaaauauucaaacc

SEQ ID NO: 825165 - RNA, 20 nt, Human
gaucaacauaacaaguuuug

SEQ ID NO: 825166 - RNA, 22 nt, Human
gaucaacauaacaaguuuuguc

SEQ ID NO: 825167 - RNA, 21 nt, Human
ggcccugacacucugaagcug

SEQ ID NO: 825168 - RNA, 22 nt, Human
gggaaaaaaauauucaaaccac

SEQ ID NO: 825169 - RNA, 18 nt, Human
uaaaauccagagucacag

SEQ ID NO: 825170 - RNA, 18 nt, Human
uaaaauccagagucacag

SEQ ID NO: 825171 - RNA, 19 nt, Human
uaacagggcuguaugugug

SEQ ID NO: 825172 - RNA, 23 nt, Human
uaagaagaaauaaaggaguggaa

SEQ ID NO: 825173 - RNA, 21 nt, Human
uaagaauauauaaauaacauc

SEQ ID NO: 825174 - RNA, 22 nt, Human
uaagucccaagguaacacauag

SEQ ID NO: 825175 - RNA, 18 nt, Human
uacaggaaggugacagac

SEQ ID NO: 825176 - RNA, 25 nt, Human
uaccuagacuaagaucucaagguag

SEQ ID NO: 825177 - RNA, 19 nt, Human
uaccucaggugaugugauu

SEQ ID NO: 825178 - RNA, 22 nt, Human
uagaaauucuaaaguugugcau

SEQ ID NO: 825179 - RNA, 21 nt, Human
uagacuguguauaugaaauua

SEQ ID NO: 825180 - RNA, 25 nt, Human
uaggaaauguaaaaucaaaaagucc

SEQ ID NO: 825181 - RNA, 22 nt, Human
uaggcugcaaaagguccuuuga

SEQ ID NO: 825182 - RNA, 23 nt, Human
uauaaagaaaaagaauuaauuuc

SEQ ID NO: 825183 - RNA, 19 nt, Human
uaucaaaaaggggcaacag

SEQ ID NO: 825184 - RNA, 21 nt, Human
uaucaaaaaggggcaacagcc

SEQ ID NO: 825185 - RNA, 18 nt, Human
uaucaaaaaggggcaacu

SEQ ID NO: 825186 - RNA, 18 nt, Human
uaucaaaaaggggcaacu

SEQ ID NO: 825187 - RNA, 18 nt, Human
uaucuagacugugggauu

SEQ ID NO: 825188 - RNA, 18 nt, Human
uauguuaagaaauaccaa

SEQ ID NO: 825189 - RNA, 24 nt, Human
uauuauggcauacaaaaugauauu

SEQ ID NO: 825190 - RNA, 20 nt, Human
uauuugaaguuuuaaaaaca

SEQ ID NO: 825191 - RNA, 25 nt, Human
uauuugaaguuuuaaaaacauuuua

SEQ ID NO: 825192 - RNA, 18 nt, Human
ucauuaaauauuuuagca

SEQ ID NO: 825193 - RNA, 23 nt, Human
ucccaauuaaguuugacugagac

SEQ ID NO: 825194 - RNA, 18 nt, Human
ucuaugagucaauacuua

SEQ ID NO: 825195 - RNA, 22 nt, Human
ucucacagaaaggaaacggagc

SEQ ID NO: 825196 - RNA, 24 nt, Human
ucucucacagaaaggaaacggagc

SEQ ID NO: 825197 - RNA, 18 nt, Human
ucugccucuuccuuuaga

SEQ ID NO: 825198 - RNA, 20 nt, Human
ucuguggaaauacaggaagg

SEQ ID NO: 825199 - RNA, 19 nt, Human
ugaagggguagccccggga

SEQ ID NO: 825200 - RNA, 18 nt, Human
ugacacucugaagcugag

SEQ ID NO: 825201 - RNA, 21 nt, Human
ugaccaggggacauacggugc

SEQ ID NO: 825202 - RNA, 21 nt, Human
ugagaagucugagguugagag

SEQ ID NO: 825203 - RNA, 25 nt, Human
ugagaagucugagguugagaggcca

SEQ ID NO: 825204 - RNA, 22 nt, Human
ugagguugagaggccauaucug

SEQ ID NO: 825205 - RNA, 23 nt, Human
ugagugcccugggccucugcagg

SEQ ID NO: 825206 - RNA, 25 nt, Human
ugauauauucuaaagccacacuaua

SEQ ID NO: 825207 - RNA, 24 nt, Human
ugaugacaguugaggacauuugug

SEQ ID NO: 825208 - RNA, 24 nt, Human
ugcaggaaaaagaacauguauuuc

SEQ ID NO: 825209 - RNA, 22 nt, Human
ugcauuuggaacuccagaagga

SEQ ID NO: 825210 - RNA, 22 nt, Human
ugcauuuggaacuccagaagga

SEQ ID NO: 825211 - RNA, 21 nt, Human
ugcucuguggaaauacaggaa

SEQ ID NO: 825212 - RNA, 20 nt, Human
uggaagaauuacacauaaaa

SEQ ID NO: 825213 - RNA, 19 nt, Human
uggagauccaugcuugaaa

SEQ ID NO: 825214 - RNA, 19 nt, Human
uggcagcucaucuagggca

SEQ ID NO: 825215 - RNA, 26 nt, Human
ugggaugauuaaaucaagcuaauuaa

SEQ ID NO: 825216 - RNA, 18 nt, Human
ugggauggccuucuuguu

SEQ ID NO: 825217 - RNA, 28 nt, Human
ugggccucugcaggucucuauucugaug

SEQ ID NO: 825218 - RNA, 24 nt, Human
uguaaaaauuuugacauaccgcga

SEQ ID NO: 825219 - RNA, 22 nt, Human
uguaagaagaaauaaaggagug

SEQ ID NO: 825220 - RNA, 18 nt, Human
uguauagacuguguauau

SEQ ID NO: 825221 - RNA, 18 nt, Human
ugucucuaucuucaccuc

SEQ ID NO: 825222 - RNA, 24 nt, Human
uguguggagaaaggaucugaauuu

SEQ ID NO: 825223 - RNA, 21 nt, Human
uguuuaaaaacguuucggcuu

SEQ ID NO: 825224 - RNA, 20 nt, Human
uuaaaauaaaauccagaguc

SEQ ID NO: 825225 - RNA, 20 nt, Human
uuaaaauaaaauccagaguc

SEQ ID NO: 825226 - RNA, 24 nt, Human
uuaacacugaguaacauccucaau

SEQ ID NO: 825227 - RNA, 19 nt, Human
uuaggucacucuuccuucc

SEQ ID NO: 825228 - RNA, 23 nt, Human
uuaguucauuuucugaggcuuaa

SEQ ID NO: 825229 - RNA, 25 nt, Human
uucacaauccacaauaaaaagacug

SEQ ID NO: 825230 - RNA, 18 nt, Human
uuccagauaauaagagua

SEQ ID NO: 825231 - RNA, 21 nt, Human
uugaaaauuagguaguucaug

SEQ ID NO: 825232 - RNA, 23 nt, Human
uugcaggaaaaagaacauguauu

SEQ ID NO: 825233 - RNA, 24 nt, Human
uugcauuuggaacuccagaaggaa

SEQ ID NO: 825234 - RNA, 24 nt, Human
uugcauuuggaacuccagaaggaa

SEQ ID NO: 825235 - RNA, 18 nt, Human
uuuucugccucuuccuuu

SEQ ID NO: 825236 - RNA, 27 nt, Human
uuuuuuuuuauauagcacacauauccu

SEQ ID NO: 825237 - RNA, 21 nt, Human
acaaaagcuggcccuccaccg

SEQ ID NO: 825238 - RNA, 18 nt, Human
aggccgaggcggccgaca

SEQ ID NO: 825239 - RNA, 20 nt, Human
auguuuuuuuuuuuuuugua

SEQ ID NO: 825240 - RNA, 20 nt, Human
caaaagcuggcccuccaccg

SEQ ID NO: 825241 - RNA, 21 nt, Human
gaacaaaagcuggcccuccac

SEQ ID NO: 825242 - RNA, 19 nt, Human
uccaccgcgguggcggccg

SEQ ID NO: 825243 - RNA, 21 nt, Human
uccaccgcgguggcggccgca

SEQ ID NO: 825244 - RNA, 22 nt, Human
uggaacaaaagcuggcccucca

SEQ ID NO: 825245 - RNA, 24 nt, Human
uuggaacaaaagcuggcccuccac

SEQ ID NO: 825246 - RNA, 18 nt, Human
aaaaaccaaguagaagug

SEQ ID NO: 825247 - RNA, 20 nt, Human
aacuccagggccuccgauau

SEQ ID NO: 825248 - RNA, 18 nt, Human
aacucgagccugcugccu

SEQ ID NO: 825249 - RNA, 18 nt, Human
aacuucccaaacugcuga

SEQ ID NO: 825250 - RNA, 18 nt, Human
aagaacuccaugaaugcu

SEQ ID NO: 825251 - RNA, 20 nt, Human
aagagcuacagacuggcagc

SEQ ID NO: 825252 - RNA, 20 nt, Human
aagcucacaaacuccagggc

SEQ ID NO: 825253 - RNA, 26 nt, Human
aagcucacaaacuccagggccuccga

SEQ ID NO: 825254 - RNA, 22 nt, Human
aagguuaacuugucaaauuaug

SEQ ID NO: 825255 - RNA, 20 nt, Human
aagugaccccaaacugugac

SEQ ID NO: 825256 - RNA, 21 nt, Human
aagugaccccaaacugugacu

SEQ ID NO: 825257 - RNA, 21 nt, Human
aaguuccucccugcaauaguc

SEQ ID NO: 825258 - RNA, 20 nt, Human
acagacaugaagaacuccau

SEQ ID NO: 825259 - RNA, 24 nt, Human
acaugacauuuuccacaauucacc

SEQ ID NO: 825260 - RNA, 25 nt, Human
accccaucuucuucuucccagccag

SEQ ID NO: 825261 - RNA, 23 nt, Human
acucuuccucgccuccccuccug

SEQ ID NO: 825262 - RNA, 18 nt, Human
acuuucccagcauagggu

SEQ ID NO: 825263 - RNA, 21 nt, Human
agaggccagggcaccagaaug

SEQ ID NO: 825264 - RNA, 22 nt, Human
agauuacacuguuacauugcuu

SEQ ID NO: 825265 - RNA, 18 nt, Human
agccgccacgcccagcac

SEQ ID NO: 825266 - RNA, 23 nt, Human
aggaacguggaccuaaaucacug

SEQ ID NO: 825267 - RNA, 21 nt, Human
aggaagugccuggcacagaag

SEQ ID NO: 825268 - RNA, 24 nt, Human
aggcgggcagaucacaaggucagg

SEQ ID NO: 825269 - RNA, 18 nt, Human
aggcggguacgcugaggg

SEQ ID NO: 825270 - RNA, 18 nt, Human
agggcugggauuacaggc

SEQ ID NO: 825271 - RNA, 24 nt, Human
agggcugggauuacaggcgugagc

SEQ ID NO: 825272 - RNA, 20 nt, Human
agugagcucauuugaaagcu

SEQ ID NO: 825273 - RNA, 21 nt, Human
aguggagauuugccauucgug

SEQ ID NO: 825274 - RNA, 24 nt, Human
aguggcucacaccuguaaucccag

SEQ ID NO: 825275 - RNA, 24 nt, Human
auagggcugggauuacaggcguga

SEQ ID NO: 825276 - RNA, 18 nt, Human
auccuuaugguguugcca

SEQ ID NO: 825277 - RNA, 20 nt, Human
caagaccagccucccauagg

SEQ ID NO: 825278 - RNA, 22 nt, Human
caaggucaggcguucaagacca

SEQ ID NO: 825279 - RNA, 24 nt, Human
cacaccuguaaucccagcacuucg

SEQ ID NO: 825280 - RNA, 22 nt, Human
caccuguaaucccagcacuucg

SEQ ID NO: 825281 - RNA, 24 nt, Human
caccuguaaucccagcacuucggg

SEQ ID NO: 825282 - RNA, 22 nt, Human
cacuguguaaaaacuagaaagu

SEQ ID NO: 825283 - RNA, 24 nt, Human
cagaucacaaggucaggcguucaa

SEQ ID NO: 825284 - RNA, 22 nt, Human
cagauuccgcuccaccaaagac

SEQ ID NO: 825285 - RNA, 19 nt, Human
cagauuugagauauaugug

SEQ ID NO: 825286 - RNA, 24 nt, Human
cagcacuucgggagaccgaggcgg

SEQ ID NO: 825287 - RNA, 23 nt, Human
cagcugagcagcucagaggcccc

SEQ ID NO: 825288 - RNA, 24 nt, Human
caggauaagcaaauaacucacaac

SEQ ID NO: 825289 - RNA, 24 nt, Human
cagggcaccagaaugugcuaaagg

SEQ ID NO: 825290 - RNA, 24 nt, Human
cagucuccagucugcugugccaga

SEQ ID NO: 825291 - RNA, 22 nt, Human
cauacauuuauauuuaucuuca

SEQ ID NO: 825292 - RNA, 23 nt, Human
caugauucauuuagguauucuga

SEQ ID NO: 825293 - RNA, 22 nt, Human
ccacugguugacuucacugcac

SEQ ID NO: 825294 - RNA, 21 nt, Human
ccagaacauccugccaugucc

SEQ ID NO: 825295 - RNA, 18 nt, Human
ccagcuccccauccugcc

SEQ ID NO: 825296 - RNA, 23 nt, Human
ccauagggcugggauuacaggcg

SEQ ID NO: 825297 - RNA, 24 nt, Human
ccauagggcugggauuacaggcgu

SEQ ID NO: 825298 - RNA, 22 nt, Human
ccaucaaggagaaucugucgcu

SEQ ID NO: 825299 - RNA, 24 nt, Human
cccaaauccucacuuucccagcau

SEQ ID NO: 825300 - RNA, 22 nt, Human
ccccacaguaaguuggcccaaa

SEQ ID NO: 825301 - RNA, 21 nt, Human
ccccaucuucuucuucccagc

SEQ ID NO: 825302 - RNA, 26 nt, Human
cccuagaccuucuaaccagguguauc

SEQ ID NO: 825303 - RNA, 23 nt, Human
cccuuauucucccucacccuucu

SEQ ID NO: 825304 - RNA, 27 nt, Human
cccuuauucucccucacccuucucccu

SEQ ID NO: 825305 - RNA, 18 nt, Human
ccgggcccaguggcucac

SEQ ID NO: 825306 - RNA, 19 nt, Human
ccucaaggcuugacagaca

SEQ ID NO: 825307 - RNA, 21 nt, Human
ccucaaggcuugacagacaug

SEQ ID NO: 825308 - RNA, 22 nt, Human
ccucacccuucuugggacuaga

SEQ ID NO: 825309 - RNA, 21 nt, Human
ccucuaggacaggagacccag

SEQ ID NO: 825310 - RNA, 19 nt, Human
ccugcaaauguguucgucu

SEQ ID NO: 825311 - RNA, 21 nt, Human
ccuuauucucccucacccuuc

SEQ ID NO: 825312 - RNA, 18 nt, Human
cgagccagguuuuguugu

SEQ ID NO: 825313 - RNA, 24 nt, Human
cgaggcgggcagaucacaagguca

SEQ ID NO: 825314 - RNA, 18 nt, Human
cuagagccaagcucacaa

SEQ ID NO: 825315 - RNA, 19 nt, Human
cucacaacaguaccucaua

SEQ ID NO: 825316 - RNA, 24 nt, Human
cucacaccuguaaucccagcacuu

SEQ ID NO: 825317 - RNA, 25 nt, Human
cucacaccuguaaucccagcacuuc

SEQ ID NO: 825318 - RNA, 21 nt, Human
cucacaggcccugccucaguc

SEQ ID NO: 825319 - RNA, 21 nt, Human
cuccuccuaccccaucuucuu

SEQ ID NO: 825320 - RNA, 18 nt, Human
cuccuguguaggccagcu

SEQ ID NO: 825321 - RNA, 22 nt, Human
cucuaauaacuaacuucccaaa

SEQ ID NO: 825322 - RNA, 18 nt, Human
cugaaugcuaaauauuac

SEQ ID NO: 825323 - RNA, 20 nt, Human
cugggauuacaggcgugagg

SEQ ID NO: 825324 - RNA, 20 nt, Human
cugggauuacaggcgugagu

SEQ ID NO: 825325 - RNA, 21 nt, Human
cuuucccccugcugauggugu

SEQ ID NO: 825326 - RNA, 20 nt, Human
gacaggagacccagcugagc

SEQ ID NO: 825327 - RNA, 24 nt, Human
gaccuggauuuuagacuccugggg

SEQ ID NO: 825328 - RNA, 19 nt, Human
gagcagcucagaggcccca

SEQ ID NO: 825329 - RNA, 24 nt, Human
gaucacaaggucaggcguucaaga

SEQ ID NO: 825330 - RNA, 19 nt, Human
gaucacuuaaaacauacaa

SEQ ID NO: 825331 - RNA, 21 nt, Human
gaucucaaagagacaaacaug

SEQ ID NO: 825332 - RNA, 18 nt, Human
gauuacaggcgugagccg

SEQ ID NO: 825333 - RNA, 21 nt, Human
gauuacaggcgugagccgcca

SEQ ID NO: 825334 - RNA, 22 nt, Human
gauuacaggcgugagccgccac

SEQ ID NO: 825335 - RNA, 23 nt, Human
gcgaucucaaagagacaaacaug

SEQ ID NO: 825336 - RNA, 22 nt, Human
gcucuaacuugugccucugcuc

SEQ ID NO: 825337 - RNA, 23 nt, Human
ggaaccugaccuccuccuacccc

SEQ ID NO: 825338 - RNA, 23 nt, Human
ggcagaucacaaggucaggcguu

SEQ ID NO: 825339 - RNA, 23 nt, Human
ggcccaguggcucacaccuguaa

SEQ ID NO: 825340 - RNA, 23 nt, Human
gggagaccgaggcgggcagauca

SEQ ID NO: 825341 - RNA, 21 nt, Human
ggguguccucaaggcuugaca

SEQ ID NO: 825342 - RNA, 18 nt, Human
gucauuggauuuccucuc

SEQ ID NO: 825343 - RNA, 23 nt, Human
gucauuggauuuccucucuggaa

SEQ ID NO: 825344 - RNA, 22 nt, Human
gugggacuggaggagggugaga

SEQ ID NO: 825345 - RNA, 20 nt, Human
guguauguguauaugugugu

SEQ ID NO: 825346 - RNA, 19 nt, Human
uaaaaaaaaaagaccgggc

SEQ ID NO: 825347 - RNA, 20 nt, Human
uaaaacaggauaagcaaaua

SEQ ID NO: 825348 - RNA, 28 nt, Human
uaaaaccuauaaacaauauucuuaguuu

SEQ ID NO: 825349 - RNA, 22 nt, Human
uaaaauuccacaaauauguuuc

SEQ ID NO: 825350 - RNA, 24 nt, Human
uaaacuagaagugauaagagccag

SEQ ID NO: 825351 - RNA, 24 nt, Human
uaagaaauccuuaugguguugcca

SEQ ID NO: 825352 - RNA, 24 nt, Human
uaagcaaauaacucacaacaguac

SEQ ID NO: 825353 - RNA, 22 nt, Human
uacaacacccagguauuaaggg

SEQ ID NO: 825354 - RNA, 18 nt, Human
uacagcauaugaaacaag

SEQ ID NO: 825355 - RNA, 19 nt, Human
uacagcauaugaaacaagu

SEQ ID NO: 825356 - RNA, 21 nt, Human
uacgcugagggucgggggggc

SEQ ID NO: 825357 - RNA, 21 nt, Human
uacuuuacagcuauaagaacg

SEQ ID NO: 825358 - RNA, 23 nt, Human
uagaaguucucauccuuggcugg

SEQ ID NO: 825359 - RNA, 20 nt, Human
uagacuccugggguagcuac

SEQ ID NO: 825360 - RNA, 22 nt, Human
uagagccaagcucacaaacucc

SEQ ID NO: 825361 - RNA, 22 nt, Human
uaugaaacaagugaucucuuaa

SEQ ID NO: 825362 - RNA, 23 nt, Human
uauguguauauguguguuucccg

SEQ ID NO: 825363 - RNA, 21 nt, Human
ucaaagagacaaacauguaag

SEQ ID NO: 825364 - RNA, 21 nt, Human
ucaagggcaugguguaugugu

SEQ ID NO: 825365 - RNA, 23 nt, Human
ucaauucacuaucaacucuaaua

SEQ ID NO: 825366 - RNA, 24 nt, Human
ucacaaggucaggcguucaagacc

SEQ ID NO: 825367 - RNA, 21 nt, Human
ucagaggccccacaguaaguu

SEQ ID NO: 825368 - RNA, 26 nt, Human
ucagucuccagucugcugugccagaa

SEQ ID NO: 825369 - RNA, 20 nt, Human
ucauaugaugaaaauaaagu

SEQ ID NO: 825370 - RNA, 23 nt, Human
uccacaauucaccugcauaucug

SEQ ID NO: 825371 - RNA, 24 nt, Human
ucccauagggcugggauuacaggc

SEQ ID NO: 825372 - RNA, 23 nt, Human
uccuuggaaccugaccuccuccu

SEQ ID NO: 825373 - RNA, 20 nt, Human
ucgaagagcuacagacuggc

SEQ ID NO: 825374 - RNA, 20 nt, Human
ucuauauugcaguacaacug

SEQ ID NO: 825375 - RNA, 22 nt, Human
ucuauauugcaguacaacuggu

SEQ ID NO: 825376 - RNA, 19 nt, Human
ucugugaaacuugguuccc

SEQ ID NO: 825377 - RNA, 18 nt, Human
ucuuacagugaaggacag

SEQ ID NO: 825378 - RNA, 22 nt, Human
ugaaaagaacaagccacaccgg

SEQ ID NO: 825379 - RNA, 25 nt, Human
ugaaaagaacaagccacaccggaua

SEQ ID NO: 825380 - RNA, 24 nt, Human
ugaaaaucugaccugucaaaacug

SEQ ID NO: 825381 - RNA, 20 nt, Human
ugaaauaaaacucuauaaag

SEQ ID NO: 825382 - RNA, 20 nt, Human
ugaacuagauuacacuguua

SEQ ID NO: 825383 - RNA, 21 nt, Human
ugaauugaacuagauuacacu

SEQ ID NO: 825384 - RNA, 20 nt, Human
ugacuuccaagguuccccca

SEQ ID NO: 825385 - RNA, 22 nt, Human
ugagaccagaauagaugaaagc

SEQ ID NO: 825386 - RNA, 20 nt, Human
ugagcagcucagaggcccca

SEQ ID NO: 825387 - RNA, 18 nt, Human
ugagcuuagcucccugcc

SEQ ID NO: 825388 - RNA, 20 nt, Human
ugccucagucuccagucugc

SEQ ID NO: 825389 - RNA, 21 nt, Human
ugccucugcucuaagaagggg

SEQ ID NO: 825390 - RNA, 20 nt, Human
uggaaguuccucccugcaau

SEQ ID NO: 825391 - RNA, 22 nt, Human
uggcccaaaugcugggccugcu

SEQ ID NO: 825392 - RNA, 21 nt, Human
uggcucacaccuguaauccca

SEQ ID NO: 825393 - RNA, 22 nt, Human
uggcucacaccuguaaucccag

SEQ ID NO: 825394 - RNA, 24 nt, Human
uggcucacaccuguaaucccagca

SEQ ID NO: 825395 - RNA, 18 nt, Human
ugggauuacaggcgugag

SEQ ID NO: 825396 - RNA, 19 nt, Human
ugggauuacaggcgugagc

SEQ ID NO: 825397 - RNA, 21 nt, Human
ugggauuacaggcgugagccg

SEQ ID NO: 825398 - RNA, 22 nt, Human
ugggauuacaggcgugagccgc

SEQ ID NO: 825399 - RNA, 23 nt, Human
ugggauuacaggcgugagccgcc

SEQ ID NO: 825400 - RNA, 24 nt, Human
ugggauuacaggcgugagccgcca

SEQ ID NO: 825401 - RNA, 22 nt, Human
ugguguauguguauaugugugu

SEQ ID NO: 825402 - RNA, 18 nt, Human
uguauguguauaugugug

SEQ ID NO: 825403 - RNA, 19 nt, Human
ugugcucagguguuuacuu

SEQ ID NO: 825404 - RNA, 21 nt, Human
uguguaggccagcugugcuca

SEQ ID NO: 825405 - RNA, 18 nt, Human
uguguguuucccgaagcc

SEQ ID NO: 825406 - RNA, 19 nt, Human
uuaaaagucuugaaaacga

SEQ ID NO: 825407 - RNA, 23 nt, Human
uuagcuaacuugaagaaaauaaa

SEQ ID NO: 825408 - RNA, 23 nt, Human
uuauagcacagaaaucccaaauc

SEQ ID NO: 825409 - RNA, 18 nt, Human
uucaagaccagccuccca

SEQ ID NO: 825410 - RNA, 21 nt, Human
uucacugcacagcuuaccacc

SEQ ID NO: 825411 - RNA, 19 nt, Human
uucccucaccuguaaacua

SEQ ID NO: 825412 - RNA, 24 nt, Human
uugcugaauugaacuagauuacac

SEQ ID NO: 825413 - RNA, 18 nt, Human
uuggaaccugaccuccuc

SEQ ID NO: 825414 - RNA, 20 nt, Human
uuggcccaaaugcugggccu

SEQ ID NO: 825415 - RNA, 24 nt, Human
uuuaaauacagcauaugaaacaag

SEQ ID NO: 825416 - RNA, 19 nt, Human
uuuccagaccugcauccuu

SEQ ID NO: 825417 - RNA, 21 nt, Human
uuuccagaccugcauccuugg

SEQ ID NO: 825418 - RNA, 21 nt, Human
uuugccauucguggguguccu

SEQ ID NO: 825419 - RNA, 19 nt, Human
uuuuguucacugaguguug

SEQ ID NO: 825420 - RNA, 21 nt, Human
aaaaacuuaggaaggccugga

SEQ ID NO: 825421 - RNA, 23 nt, Human
aaacaaacacuguaauauaagaa

SEQ ID NO: 825422 - RNA, 19 nt, Human
aaacugcacugcaaauaca

SEQ ID NO: 825423 - RNA, 24 nt, Human
aaagugcugggaucacaggcguga

SEQ ID NO: 825424 - RNA, 18 nt, Human
aacaagauccucuccccg

SEQ ID NO: 825425 - RNA, 24 nt, Human
aacaauaacaagauccucuccccc

SEQ ID NO: 825426 - RNA, 23 nt, Human
aacacuguaauauaagaacucca

SEQ ID NO: 825427 - RNA, 23 nt, Human
aagaaaaggcaaaacucaacaaa

SEQ ID NO: 825428 - RNA, 24 nt, Human
aagaaagacagaaauacaucaaag

SEQ ID NO: 825429 - RNA, 23 nt, Human
aagaaauagacauugaagccagg

SEQ ID NO: 825430 - RNA, 24 nt, Human
aagacagaaauacaucaaagaaaa

SEQ ID NO: 825431 - RNA, 26 nt, Human
aagugcugggaucacaggcgugagcc

SEQ ID NO: 825432 - RNA, 18 nt, Human
aaguggcauucaaaaaga

SEQ ID NO: 825433 - RNA, 19 nt, Human
aaguguugaaaggugguca

SEQ ID NO: 825434 - RNA, 27 nt, Human
acaacuaacaaaaacuuaggaaggccu

SEQ ID NO: 825435 - RNA, 21 nt, Human
acaggguuucaccauguuggu

SEQ ID NO: 825436 - RNA, 23 nt, Human
acaggguuucaccauguugguca

SEQ ID NO: 825437 - RNA, 24 nt, Human
acaggguuucaccauguuggucag

SEQ ID NO: 825438 - RNA, 21 nt, Human
accauagcuaaacaaacacug

SEQ ID NO: 825439 - RNA, 24 nt, Human
accauguuggucaggcuggucuug

SEQ ID NO: 825440 - RNA, 21 nt, Human
acuacagucuacaaaaagguu

SEQ ID NO: 825441 - RNA, 19 nt, Human
acucuuguuucaccgcugg

SEQ ID NO: 825442 - RNA, 26 nt, Human
acugcacugcaaauacaaaauaaaau

SEQ ID NO: 825443 - RNA, 18 nt, Human
agaaaaaaaaagcuaggc

SEQ ID NO: 825444 - RNA, 23 nt, Human
agaaaaaaaaagcuaggcauaaa

SEQ ID NO: 825445 - RNA, 22 nt, Human
agaaagacagaaauacaucaaa

SEQ ID NO: 825446 - RNA, 25 nt, Human
agaaaugaaaauauaauaacccuua

SEQ ID NO: 825447 - RNA, 26 nt, Human
agcuaaacaaacacuguaauauaaga

SEQ ID NO: 825448 - RNA, 27 nt, Human
aggcaaaagaaaaggcaaaagggaccc

SEQ ID NO: 825449 - RNA, 20 nt, Human
aggcaaaagaaaaggcaaag

SEQ ID NO: 825450 - RNA, 22 nt, Human
aggcagaagguagagggacccc

SEQ ID NO: 825451 - RNA, 26 nt, Human
aggcagaagguagauguagagggacc

SEQ ID NO: 825452 - RNA, 21 nt, Human
aggccuggaagagaggugcca

SEQ ID NO: 825453 - RNA, 19 nt, Human
agggcuggauggaucaacg

SEQ ID NO: 825454 - RNA, 19 nt, Human
aggguaccaacuuaguaug

SEQ ID NO: 825455 - RNA, 24 nt, Human
aggugguccacccaccucggccuc

SEQ ID NO: 825456 - RNA, 22 nt, Human
aguagagacaggguuucaccau

SEQ ID NO: 825457 - RNA, 18 nt, Human
aguagcuggaauuacagg

SEQ ID NO: 825458 - RNA, 24 nt, Human
agugcgauggcucaaccucggcuc

SEQ ID NO: 825459 - RNA, 24 nt, Human
auuuuuguacuuuuaguagagaca

SEQ ID NO: 825460 - RNA, 24 nt, Human
caaagugcugggaucacaggcgug

SEQ ID NO: 825461 - RNA, 23 nt, Human
caaccuccaccuccuggguucaa

SEQ ID NO: 825462 - RNA, 22 nt, Human
caagcaauucuccugccucagc

SEQ ID NO: 825463 - RNA, 22 nt, Human
cacaggcgugagccaccaugcc

SEQ ID NO: 825464 - RNA, 24 nt, Human
caccacgccuggcuaauuuuugua

SEQ ID NO: 825465 - RNA, 19 nt, Human
caccagucuaguaagugcu

SEQ ID NO: 825466 - RNA, 19 nt, Human
caccaugccuggccuauuu

SEQ ID NO: 825467 - RNA, 21 nt, Human
caccauguuggucaggcuggu

SEQ ID NO: 825468 - RNA, 24 nt, Human
caccauguuggucaggcuggucuu

SEQ ID NO: 825469 - RNA, 22 nt, Human
cacccaccucggccucccaaag

SEQ ID NO: 825470 - RNA, 23 nt, Human
cacccaccucggccucccaaagu

SEQ ID NO: 825471 - RNA, 20 nt, Human
caccuagaaaaaaaaagcuu

SEQ ID NO: 825472 - RNA, 24 nt, Human
caccucggccucccaaagugcugg

SEQ ID NO: 825473 - RNA, 19 nt, Human
cagaagguagauguagaca

SEQ ID NO: 825474 - RNA, 19 nt, Human
cagccuccugaguagcugg

SEQ ID NO: 825475 - RNA, 19 nt, Human
cagcuuccuuaugaaccag

SEQ ID NO: 825476 - RNA, 24 nt, Human
caggguuucaccauguuggucagg

SEQ ID NO: 825477 - RNA, 22 nt, Human
caucaaagaaaaaacauuuuaa

SEQ ID NO: 825478 - RNA, 22 nt, Human
caucaaagaaaaaacauuuuaa

SEQ ID NO: 825479 - RNA, 24 nt, Human
cauguuggucaggcuggucuugaa

SEQ ID NO: 825480 - RNA, 21 nt, Human
cauugcaaccuccaccuccug

SEQ ID NO: 825481 - RNA, 22 nt, Human
ccaaagugcugggaucacaggc

SEQ ID NO: 825482 - RNA, 24 nt, Human
ccaaagugcugggaucacaggcgu

SEQ ID NO: 825483 - RNA, 20 nt, Human
ccaccacgccuggcuaauuu

SEQ ID NO: 825484 - RNA, 26 nt, Human
ccaccuccuggguucaagcaauucuu

SEQ ID NO: 825485 - RNA, 21 nt, Human
cccauagguagaaaaaaauag

SEQ ID NO: 825486 - RNA, 19 nt, Human
ccuccaccuccuggguuca

SEQ ID NO: 825487 - RNA, 24 nt, Human
ccuccuggguucaagcaauucucc

SEQ ID NO: 825488 - RNA, 23 nt, Human
ccucuaggaaaaacccacugccu

SEQ ID NO: 825489 - RNA, 23 nt, Human
ccucuggacugacugaaauaugg

SEQ ID NO: 825490 - RNA, 23 nt, Human
ccugaguagcuggaauuacaggu

SEQ ID NO: 825491 - RNA, 24 nt, Human
ccugaucucaggugguccacccac

SEQ ID NO: 825492 - RNA, 23 nt, Human
ccugccucagccuccugaguagc

SEQ ID NO: 825493 - RNA, 24 nt, Human
ccugccucagccuccugaguagcu

SEQ ID NO: 825494 - RNA, 23 nt, Human
ccuggguucaagcaauucuccug

SEQ ID NO: 825495 - RNA, 20 nt, Human
cuauaagcuucugaaaaugc

SEQ ID NO: 825496 - RNA, 24 nt, Human
cucauugcaaccuccaccuccugg

SEQ ID NO: 825497 - RNA, 21 nt, Human
cuccuggguucaagcaauucu

SEQ ID NO: 825498 - RNA, 21 nt, Human
cucuaggaaaaacccacugcc

SEQ ID NO: 825499 - RNA, 19 nt, Human
cugaaaaugcagcuaagug

SEQ ID NO: 825500 - RNA, 21 nt, Human
cugaccagcggugaacuacaa

SEQ ID NO: 825501 - RNA, 24 nt, Human
cugaguagcuggaauuacagguau

SEQ ID NO: 825502 - RNA, 19 nt, Human
cuguacagucagaaaaacc

SEQ ID NO: 825503 - RNA, 18 nt, Human
cuucaaaaggggcaaguc

SEQ ID NO: 825504 - RNA, 24 nt, Human
cuuuuaguagagacaggguuucac

SEQ ID NO: 825505 - RNA, 24 nt, Human
gaaaaaccaggaugguggcaaaua

SEQ ID NO: 825506 - RNA, 20 nt, Human
gaagacacaacuaacaaaac

SEQ ID NO: 825507 - RNA, 22 nt, Human
gaagagcuguuaaaucuguagg

SEQ ID NO: 825508 - RNA, 18 nt, Human
gagccaccaugccuggcc

SEQ ID NO: 825509 - RNA, 24 nt, Human
gaguagcuggaauuacagguaugc

SEQ ID NO: 825510 - RNA, 18 nt, Human
gaucacaggcgugagcca

SEQ ID NO: 825511 - RNA, 24 nt, Human
gaucacaggcgugagccaccaugc

SEQ ID NO: 825512 - RNA, 24 nt, Human
gaucucaggugguccacccaccuc

SEQ ID NO: 825513 - RNA, 21 nt, Human
gcaaaagaaaaggcaaaacuc

SEQ ID NO: 825514 - RNA, 20 nt, Human
gcagaagguagauguagaca

SEQ ID NO: 825515 - RNA, 21 nt, Human
gcuacaggguuaacugccucu

SEQ ID NO: 825516 - RNA, 24 nt, Human
ggaucacaggcgugagccaccaug

SEQ ID NO: 825517 - RNA, 22 nt, Human
ggguuucaccauguuggucagg

SEQ ID NO: 825518 - RNA, 18 nt, Human
gguagagagaaggcagaa

SEQ ID NO: 825519 - RNA, 24 nt, Human
gguccuucaaggcuaugcuucuga

SEQ ID NO: 825520 - RNA, 22 nt, Human
guaaaaaccagaaaugaaaaua

SEQ ID NO: 825521 - RNA, 21 nt, Human
guaccaacuuaguauguuaga

SEQ ID NO: 825522 - RNA, 24 nt, Human
gugguccacccaccucggccuccc

SEQ ID NO: 825523 - RNA, 22 nt, Human
uaacaaacauauuaguaaccau

SEQ ID NO: 825524 - RNA, 21 nt, Human
uaaccauagcuaaacaaacac

SEQ ID NO: 825525 - RNA, 23 nt, Human
uaagaaagacagaaauacaucaa

SEQ ID NO: 825526 - RNA, 24 nt, Human
uaagaaagacagaaauacaucaaa

SEQ ID NO: 825527 - RNA, 18 nt, Human
uaagaacuccauuagaca

SEQ ID NO: 825528 - RNA, 19 nt, Human
uaagugcuacaggguuaac

SEQ ID NO: 825529 - RNA, 24 nt, Human
uaauaacccuuauaacuccuuaca

SEQ ID NO: 825530 - RNA, 18 nt, Human
uaauagagcucucuucuc

SEQ ID NO: 825531 - RNA, 24 nt, Human
uaauuuuuguacuuuuaguagaga

SEQ ID NO: 825532 - RNA, 27 nt, Human
uacacaaaagaacacugguucagaucc

SEQ ID NO: 825533 - RNA, 22 nt, Human
uacagguaugcgccaccacgcc

SEQ ID NO: 825534 - RNA, 20 nt, Human
uacagucuacaaaaagguuu

SEQ ID NO: 825535 - RNA, 21 nt, Human
uacugcugucagguccuucaa

SEQ ID NO: 825536 - RNA, 19 nt, Human
uagaaguccagaaucccau

SEQ ID NO: 825537 - RNA, 22 nt, Human
uagagacaggguuucaccaugu

SEQ ID NO: 825538 - RNA, 21 nt, Human
uagauguagacacuacaauuc

SEQ ID NO: 825539 - RNA, 24 nt, Human
uaggcaaaagaaaaggcaaaacuc

SEQ ID NO: 825540 - RNA, 19 nt, Human
uaggcacuggcuuuuuuuu

SEQ ID NO: 825541 - RNA, 24 nt, Human
uaguagagacaggguuucaccaug

SEQ ID NO: 825542 - RNA, 26 nt, Human
uaguagagacaggguuucaccauguu

SEQ ID NO: 825543 - RNA, 20 nt, Human
uaguugcaguaaaaaguguu

SEQ ID NO: 825544 - RNA, 23 nt, Human
uauaguaaaaaccagaaaugaaa

SEQ ID NO: 825545 - RNA, 18 nt, Human
uaucuuuucauacugcug

SEQ ID NO: 825546 - RNA, 19 nt, Human
ucaaaacccacucaacugc

SEQ ID NO: 825547 - RNA, 19 nt, Human
ucaagcaauucuccugccu

SEQ ID NO: 825548 - RNA, 22 nt, Human
ucacugccccagcuuccuuaug

SEQ ID NO: 825549 - RNA, 22 nt, Human
ucagccuccugaguagcuggaa

SEQ ID NO: 825550 - RNA, 24 nt, Human
ucauugcaaccuccaccuccuggg

SEQ ID NO: 825551 - RNA, 25 nt, Human
ucauugcaaccuccaccuccugggu

SEQ ID NO: 825552 - RNA, 27 nt, Human
ucauugcaaccuccaccuccuggguuc

SEQ ID NO: 825553 - RNA, 20 nt, Human
uccagcaaugacuuaugaac

SEQ ID NO: 825554 - RNA, 24 nt, Human
ucccaaagugcugggaucacaggc

SEQ ID NO: 825555 - RNA, 24 nt, Human
uccucugguucaccuuuugauuau

SEQ ID NO: 825556 - RNA, 24 nt, Human
uccugaguagcuggaauuacaggu

SEQ ID NO: 825557 - RNA, 21 nt, Human
uccuggguucaagcaauucuc

SEQ ID NO: 825558 - RNA, 24 nt, Human
uccuggguucaagcaauucuccug

SEQ ID NO: 825559 - RNA, 21 nt, Human
ucgaagacacaacuaacaaaa

SEQ ID NO: 825560 - RNA, 18 nt, Human
ucggccucccaaagugcu

SEQ ID NO: 825561 - RNA, 19 nt, Human
ucuaggaaaaacccacugc

SEQ ID NO: 825562 - RNA, 24 nt, Human
ucuccugccucagccuccugagua

SEQ ID NO: 825563 - RNA, 24 nt, Human
ugaaaaaucaccaccuagaaaaaa

SEQ ID NO: 825564 - RNA, 24 nt, Human
ugaacuaaucaauaaacuacaguc

SEQ ID NO: 825565 - RNA, 22 nt, Human
ugaauaggccauuuuauaaugc

SEQ ID NO: 825566 - RNA, 18 nt, Human
ugacuuaugaacuugccc

SEQ ID NO: 825567 - RNA, 24 nt, Human
ugaucucaggugguccacccaccu

SEQ ID NO: 825568 - RNA, 20 nt, Human
ugcaaccuccaccuccuggg

SEQ ID NO: 825569 - RNA, 24 nt, Human
ugccccagcuuccuuaugaaccag

SEQ ID NO: 825570 - RNA, 24 nt, Human
ugccucagccuccugaguagcugg

SEQ ID NO: 825571 - RNA, 19 nt, Human
ugccugacguuaacaucuu

SEQ ID NO: 825572 - RNA, 23 nt, Human
ugcgauggcucaaccucggcuca

SEQ ID NO: 825573 - RNA, 24 nt, Human
ugcugggaucacaggcgugagcca

SEQ ID NO: 825574 - RNA, 23 nt, Human
uggaagagaggugccaaacugca

SEQ ID NO: 825575 - RNA, 21 nt, Human
uggaauuacagguaugcgcca

SEQ ID NO: 825576 - RNA, 22 nt, Human
uggaauuacagguaugcgccac

SEQ ID NO: 825577 - RNA, 24 nt, Human
uggaauuacagguaugcgccacca

SEQ ID NO: 825578 - RNA, 24 nt, Human
uggagugcgauggcucaaccucgg

SEQ ID NO: 825579 - RNA, 18 nt, Human
ugggaucacaggcgugag

SEQ ID NO: 825580 - RNA, 22 nt, Human
ugggaucacaggcgugagccac

SEQ ID NO: 825581 - RNA, 23 nt, Human
ugggaucacaggcgugagccacc

SEQ ID NO: 825582 - RNA, 24 nt, Human
ugggaucacaggcgugagccacca

SEQ ID NO: 825583 - RNA, 25 nt, Human
ugggaucacaggcgugagccaccau

SEQ ID NO: 825584 - RNA, 21 nt, Human
uggguucaagcaauucuccug

SEQ ID NO: 825585 - RNA, 23 nt, Human
uggguucaagcaauucuccugcc

SEQ ID NO: 825586 - RNA, 24 nt, Human
uggguucaagcaauucuccugccu

SEQ ID NO: 825587 - RNA, 24 nt, Human
uggucaggcuggucuugaacaccu

SEQ ID NO: 825588 - RNA, 24 nt, Human
ugguccacccaccucggccuccca

SEQ ID NO: 825589 - RNA, 20 nt, Human
uguaaaaucauuuggaugga

SEQ ID NO: 825590 - RNA, 19 nt, Human
uguacagucagaaaaacca

SEQ ID NO: 825591 - RNA, 22 nt, Human
uuaaagauauuuucagacugcc

SEQ ID NO: 825592 - RNA, 21 nt, Human
uuaggaaggccuggaagagag

SEQ ID NO: 825593 - RNA, 24 nt, Human
uuaguagagacaggguuucaccau

SEQ ID NO: 825594 - RNA, 21 nt, Human
uucaaaacccacucaacugcc

SEQ ID NO: 825595 - RNA, 21 nt, Human
uucaagcaauucuccugccuc

SEQ ID NO: 825596 - RNA, 24 nt, Human
uucaagcaauucuccugccucagc

SEQ ID NO: 825597 - RNA, 20 nt, Human
uuccucuuuuaauagagcuc

SEQ ID NO: 825598 - RNA, 21 nt, Human
uucuguacagucagaaaaacc

SEQ ID NO: 825599 - RNA, 21 nt, Human
uugaagccagguuuugacacu

SEQ ID NO: 825600 - RNA, 25 nt, Human
uugacacuuauucuccacauccagc

SEQ ID NO: 825601 - RNA, 18 nt, Human
uugcaaccuccaccuccu

SEQ ID NO: 825602 - RNA, 23 nt, Human
uugcaaccuccaccuccuggguu

SEQ ID NO: 825603 - RNA, 24 nt, Human
uugcaaccuccaccuccuggguuc

SEQ ID NO: 825604 - RNA, 24 nt, Human
uuucaccauguuggucaggcuggu

SEQ ID NO: 825605 - RNA, 20 nt, Human
uuugacacuuauucuccaca

SEQ ID NO: 825606 - RNA, 18 nt, Human
uuugugauguggcuuucc

SEQ ID NO: 825607 - RNA, 20 nt, Human
uuuuuguacuuuuaguagag

SEQ ID NO: 825608 - RNA, 18 nt, Human
uuuuuuuuuucuuuuuug

SEQ ID NO: 825609 - RNA, 25 nt, Human
aaguggaaauggagggugaugggcu

SEQ ID NO: 825610 - RNA, 22 nt, Human
acagagugaacaggaaccaaac

SEQ ID NO: 825611 - RNA, 18 nt, Human
aggucccuucccuuggcu

SEQ ID NO: 825612 - RNA, 18 nt, Human
caccaaguggaaauggag

SEQ ID NO: 825613 - RNA, 22 nt, Human
cagagugaacaggaaccaaaca

SEQ ID NO: 825614 - RNA, 24 nt, Human
caguuaggucccuucccuuggcuu

SEQ ID NO: 825615 - RNA, 24 nt, Human
cccagguugauuauuaagugacag

SEQ ID NO: 825616 - RNA, 27 nt, Human
gaacaggaaccaaacaccaaguggaaa

SEQ ID NO: 825617 - RNA, 28 nt, Human
ggauacaacagagaacaaaccgguaccc

SEQ ID NO: 825618 - RNA, 22 nt, Human
gggcuggggauacaacagagaa

SEQ ID NO: 825619 - RNA, 25 nt, Human
ggugaugggcugugguggguggguc

SEQ ID NO: 825620 - RNA, 19 nt, Human
uacaacagagaacaaacca

SEQ ID NO: 825621 - RNA, 21 nt, Human
ucccuuggcuuuccuccccuc

SEQ ID NO: 825622 - RNA, 22 nt, Human
ucccuuggcuuuccuccccucu

SEQ ID NO: 825623 - RNA, 20 nt, Human
uccuguaguccaggaggccc

SEQ ID NO: 825624 - RNA, 24 nt, Human
ucucccagcuuguuuguuuucagu

SEQ ID NO: 825625 - RNA, 21 nt, Human
ucuccuguaguccaggaggcu

SEQ ID NO: 825626 - RNA, 18 nt, Human
ugaacaggaaccaaacac

SEQ ID NO: 825627 - RNA, 18 nt, Human
ugacagcaucuccuguag

SEQ ID NO: 825628 - RNA, 21 nt, Human
uggccaggagcugucuuuggg

SEQ ID NO: 825629 - RNA, 27 nt, Human
uggccaggagcugucuuuggggcuggg

SEQ ID NO: 825630 - RNA, 18 nt, Human
uggcuuaggguuucuuau

SEQ ID NO: 825631 - RNA, 21 nt, Human
uggcuuuccuccccucucucc

SEQ ID NO: 825632 - RNA, 23 nt, Human
uucccagagucacaauauuucaa

SEQ ID NO: 825633 - RNA, 21 nt, Human
uuccuccccucucuccccuga

SEQ ID NO: 825634 - RNA, 21 nt, Human
uuggggcuggggauacaacag

SEQ ID NO: 825635 - RNA, 26 nt, Human
uuuagcaaauauuuauugaaaccuug

SEQ ID NO: 825636 - RNA, 24 nt, Human
uuuuuuuuuuuuuuuucacucauu

SEQ ID NO: 825637 - RNA, 27 nt, Human
uuuuuuuuuuuuuuuucacucauuuag

SEQ ID NO: 825638 - RNA, 23 nt, Human
cagacuauugcacacuucucuca

SEQ ID NO: 825639 - RNA, 20 nt, Human
uccaaagucuccuucucacc

SEQ ID NO: 825640 - RNA, 21 nt, Human
uccaaagucuccuucucaccu

SEQ ID NO: 825641 - RNA, 19 nt, Human
ugcacacuucucucacccc

SEQ ID NO: 825642 - RNA, 22 nt, Human
ugccagauccucuacguggcuu

SEQ ID NO: 825643 - RNA, 22 nt, Human
uggccuguccucgucgcugcua

SEQ ID NO: 825644 - RNA, 28 nt, Human
uguccucgucgcugcuaucucuccgucc

SEQ ID NO: 825645 - RNA, 21 nt, Human
uuuauauuuauuccagacuau

SEQ ID NO: 825646 - RNA, 18 nt, Human
aauuuaggaugauuccau

SEQ ID NO: 825647 - RNA, 18 nt, Human
acccucagggacaugaag

SEQ ID NO: 825648 - RNA, 18 nt, Human
agagagguagggaccaga

SEQ ID NO: 825649 - RNA, 21 nt, Human
agaucagagccggaguaaaga

SEQ ID NO: 825650 - RNA, 19 nt, Human
agaucaggaugcuggggac

SEQ ID NO: 825651 - RNA, 19 nt, Human
agggaggaggggcuggggc

SEQ ID NO: 825652 - RNA, 18 nt, Human
aguaaagaucaggaugcu

SEQ ID NO: 825653 - RNA, 23 nt, Human
aguagugauggugacacagcaag

SEQ ID NO: 825654 - RNA, 22 nt, Human
cagagcccaagacccucaggga

SEQ ID NO: 825655 - RNA, 22 nt, Human
cauuuuuauugucauuauuuau

SEQ ID NO: 825656 - RNA, 20 nt, Human
ccugaguagagagaggaggg

SEQ ID NO: 825657 - RNA, 23 nt, Human
ccuggacuccugggucugaggga

SEQ ID NO: 825658 - RNA, 22 nt, Human
cugggcagcugacgagguccau

SEQ ID NO: 825659 - RNA, 22 nt, Human
cuggggacuggggcuccugggu

SEQ ID NO: 825660 - RNA, 21 nt, Human
gacaugaagacacagcagaga

SEQ ID NO: 825661 - RNA, 19 nt, Human
gagggccugggcagcugac

SEQ ID NO: 825662 - RNA, 22 nt, Human
gccugaagcaacugcucuggga

SEQ ID NO: 825663 - RNA, 20 nt, Human
gcuggggccuggacuccugg

SEQ ID NO: 825664 - RNA, 22 nt, Human
ggaggaggggcuggggccugga

SEQ ID NO: 825665 - RNA, 22 nt, Human
gggaccagagacgaggggggcg

SEQ ID NO: 825666 - RNA, 18 nt, Human
gggaggaggggcuggggg

SEQ ID NO: 825667 - RNA, 18 nt, Human
gggaggaggggcuggggg

SEQ ID NO: 825668 - RNA, 20 nt, Human
ggggacuggggcuccuggga

SEQ ID NO: 825669 - RNA, 23 nt, Human
ggguccugaguagagagaggagg

SEQ ID NO: 825670 - RNA, 19 nt, Human
gggucugagggaggagggg

SEQ ID NO: 825671 - RNA, 19 nt, Human
gggucugagggaggagggg

SEQ ID NO: 825672 - RNA, 18 nt, Human
gggugggggcuugguggg

SEQ ID NO: 825673 - RNA, 19 nt, Human
gucugagggaggaggggcu

SEQ ID NO: 825674 - RNA, 19 nt, Human
gucugagggaggaggggcu

SEQ ID NO: 825675 - RNA, 19 nt, Human
gucugagggaggaggggcu

SEQ ID NO: 825676 - RNA, 21 nt, Human
uagagagaggagggccugggc

SEQ ID NO: 825677 - RNA, 23 nt, Human
ucccagagcccaagacccucagg

SEQ ID NO: 825678 - RNA, 20 nt, Human
uccugggucugagggaggag

SEQ ID NO: 825679 - RNA, 20 nt, Human
uccugggucugagggaggag

SEQ ID NO: 825680 - RNA, 23 nt, Human
ucugagggaggaggggcuggggc

SEQ ID NO: 825681 - RNA, 23 nt, Human
ugagggaggaggggcuggggccu

SEQ ID NO: 825682 - RNA, 18 nt, Human
ugaguagagagaggaggg

SEQ ID NO: 825683 - RNA, 19 nt, Human
ugcuggggacuggggcucc

SEQ ID NO: 825684 - RNA, 21 nt, Human
ugcuggggacuggggcuccug

SEQ ID NO: 825685 - RNA, 24 nt, Human
ugcuggggacuggggcuccugggu

SEQ ID NO: 825686 - RNA, 20 nt, Human
ugggggccuggacuccuggg

SEQ ID NO: 825687 - RNA, 20 nt, Human
uugaguagugauggugacac

SEQ ID NO: 825688 - RNA, 19 nt, Human
aaggaacaguguacagugu

SEQ ID NO: 825689 - RNA, 21 nt, Human
aaggaacaguguacagugucu

SEQ ID NO: 825690 - RNA, 21 nt, Human
aaggaacaguguacagugucu

SEQ ID NO: 825691 - RNA, 19 nt, Human
aagucacagaaauuccuac

SEQ ID NO: 825692 - RNA, 19 nt, Human
aagucacagaaauuccuac

SEQ ID NO: 825693 - RNA, 22 nt, Human
aucaguucagacgaaucaucuu

SEQ ID NO: 825694 - RNA, 22 nt, Human
aucaguucagacgaaucaucuu

SEQ ID NO: 825695 - RNA, 22 nt, Human
aucaguucagacgaaucaucuu

SEQ ID NO: 825696 - RNA, 20 nt, Human
augguguuugucaggcgccc

SEQ ID NO: 825697 - RNA, 22 nt, Human
caaggcgaagugagauugggcc

SEQ ID NO: 825698 - RNA, 22 nt, Human
caaggcgaagugagauugggcc

SEQ ID NO: 825699 - RNA, 22 nt, Human
caaggcgaagugagauugggcc

SEQ ID NO: 825700 - RNA, 23 nt, Human
caaggcgaagugagauugggccu

SEQ ID NO: 825701 - RNA, 23 nt, Human
caaggcgaagugagauugggccu

SEQ ID NO: 825702 - RNA, 23 nt, Human
caaggcgaagugagauugggccu

SEQ ID NO: 825703 - RNA, 26 nt, Human
cacaaugcccugcaggaugccccucc

SEQ ID NO: 825704 - RNA, 26 nt, Human
cacaaugcccugcaggaugccccucc

SEQ ID NO: 825705 - RNA, 19 nt, Human
cacagaccagggguccccc

SEQ ID NO: 825706 - RNA, 19 nt, Human
cacagaccagggguccccc

SEQ ID NO: 825707 - RNA, 22 nt, Human
caggggucccccagagucaccc

SEQ ID NO: 825708 - RNA, 18 nt, Human
ccacuccaaguaguggca

SEQ ID NO: 825709 - RNA, 18 nt, Human
ccacuccaaguaguggca

SEQ ID NO: 825710 - RNA, 23 nt, Human
cccagaaaaaagucacagaaauu

SEQ ID NO: 825711 - RNA, 25 nt, Human
ccccagaaaaaagucacagaaauuc

SEQ ID NO: 825712 - RNA, 25 nt, Human
ccccagaaaaaagucacagaaauuc

SEQ ID NO: 825713 - RNA, 25 nt, Human
ccccagaaaaaagucacagaaauuc

SEQ ID NO: 825714 - RNA, 18 nt, Human
cccccacagaccaggggu

SEQ ID NO: 825715 - RNA, 18 nt, Human
cccccacagaccaggggu

SEQ ID NO: 825716 - RNA, 23 nt, Human
cccccacagaccagggguccccc

SEQ ID NO: 825717 - RNA, 23 nt, Human
cccccacagaccagggguccccc

SEQ ID NO: 825718 - RNA, 24 nt, Human
cccugcuucaagccgcuucuccuc

SEQ ID NO: 825719 - RNA, 25 nt, Human
ccugcaggaugcccccacagaccag

SEQ ID NO: 825720 - RNA, 25 nt, Human
ccugcaggaugcccccacagaccag

SEQ ID NO: 825721 - RNA, 21 nt, Human
cgcuuuguuaucuuggcauua

SEQ ID NO: 825722 - RNA, 21 nt, Human
cgcuuuguuaucuuggcauua

SEQ ID NO: 825723 - RNA, 23 nt, Human
cggggcugcuggccagcuguggg

SEQ ID NO: 825724 - RNA, 23 nt, Human
cggggcugcuggccagcuguggg

SEQ ID NO: 825725 - RNA, 23 nt, Human
cggggcugcuggccagcuguggg

SEQ ID NO: 825726 - RNA, 23 nt, Human
cucgggguuucucuuuccuaagg

SEQ ID NO: 825727 - RNA, 23 nt, Human
cucgggguuucucuuuccuaagg

SEQ ID NO: 825728 - RNA, 23 nt, Human
cucgggguuucucuuuccuaagg

SEQ ID NO: 825729 - RNA, 22 nt, Human
cugcgccucugcccuccgcgcc

SEQ ID NO: 825730 - RNA, 18 nt, Human
cuuugaccccagaaaaaa

SEQ ID NO: 825731 - RNA, 18 nt, Human
cuuugaccccagaaaaaa

SEQ ID NO: 825732 - RNA, 18 nt, Human
cuuugaccccagaaaaaa

SEQ ID NO: 825733 - RNA, 18 nt, Human
gaacaguguacagugucu

SEQ ID NO: 825734 - RNA, 18 nt, Human
gaacaguguacagugucu

SEQ ID NO: 825735 - RNA, 18 nt, Human
gaacaguguacagugucu

SEQ ID NO: 825736 - RNA, 21 nt, Human
gacagggucuugggggauggc

SEQ ID NO: 825737 - RNA, 21 nt, Human
gacagggucuugggggauggc

SEQ ID NO: 825738 - RNA, 21 nt, Human
gacagggucuugggggauggc

SEQ ID NO: 825739 - RNA, 19 nt, Human
gaccaggggucccccagag

SEQ ID NO: 825740 - RNA, 18 nt, Human
gcugcuggccagcugugg

SEQ ID NO: 825741 - RNA, 18 nt, Human
gcugcuggccagcugugg

SEQ ID NO: 825742 - RNA, 18 nt, Human
gcugcuggccagcugugg

SEQ ID NO: 825743 - RNA, 19 nt, Human
ggacacaaugcccugcagg

SEQ ID NO: 825744 - RNA, 19 nt, Human
ggacacaaugcccugcagg

SEQ ID NO: 825745 - RNA, 19 nt, Human
ggccuuggacagggucuug

SEQ ID NO: 825746 - RNA, 19 nt, Human
ggccuuggacagggucuug

SEQ ID NO: 825747 - RNA, 19 nt, Human
ggccuuggacagggucuug

SEQ ID NO: 825748 - RNA, 20 nt, Human
gggguuucucuuugacccca

SEQ ID NO: 825749 - RNA, 20 nt, Human
gggguuucucuuugacccca

SEQ ID NO: 825750 - RNA, 20 nt, Human
gggguuucucuuugacccca

SEQ ID NO: 825751 - RNA, 21 nt, Human
gguagcucuugucacaagaug

SEQ ID NO: 825752 - RNA, 19 nt, Human
uaaggaaaccaaggcgaag

SEQ ID NO: 825753 - RNA, 19 nt, Human
uaaggaaaccaaggcgaag

SEQ ID NO: 825754 - RNA, 19 nt, Human
uaaggaaaccaaggcgaag

SEQ ID NO: 825755 - RNA, 24 nt, Human
uacagauaaggaaaccaaggcgaa

SEQ ID NO: 825756 - RNA, 24 nt, Human
uacagauaaggaaaccaaggcgaa

SEQ ID NO: 825757 - RNA, 24 nt, Human
uacagauaaggaaaccaaggcgaa

SEQ ID NO: 825758 - RNA, 23 nt, Human
uagucaguuccucuucaugguuu

SEQ ID NO: 825759 - RNA, 23 nt, Human
uagucaguuccucuucaugguuu

SEQ ID NO: 825760 - RNA, 18 nt, Human
ucacagaaauuccuacag

SEQ ID NO: 825761 - RNA, 18 nt, Human
ucacagaaauuccuacag

SEQ ID NO: 825762 - RNA, 18 nt, Human
ucacagaaauuccuacag

SEQ ID NO: 825763 - RNA, 23 nt, Human
ucagcaauaagauggucucauuu

SEQ ID NO: 825764 - RNA, 19 nt, Human
ucaggugggacaaguccuu

SEQ ID NO: 825765 - RNA, 19 nt, Human
ucaggugggacaaguccuu

SEQ ID NO: 825766 - RNA, 19 nt, Human
ucaggugggacaaguccuu

SEQ ID NO: 825767 - RNA, 19 nt, Human
uccuacagagcaacuugga

SEQ ID NO: 825768 - RNA, 19 nt, Human
uccuacagagcaacuugga

SEQ ID NO: 825769 - RNA, 19 nt, Human
uccuacagagcaacuugga

SEQ ID NO: 825770 - RNA, 19 nt, Human
ucuugggggauggcuccgu

SEQ ID NO: 825771 - RNA, 19 nt, Human
ucuugggggauggcuccgu

SEQ ID NO: 825772 - RNA, 19 nt, Human
ucuugggggauggcuccgu

SEQ ID NO: 825773 - RNA, 19 nt, Human
ugaaaaggaacaguguaca

SEQ ID NO: 825774 - RNA, 19 nt, Human
ugaaaaggaacaguguaca

SEQ ID NO: 825775 - RNA, 19 nt, Human
ugaaaaggaacaguguaca

SEQ ID NO: 825776 - RNA, 22 nt, Human
ugcuucaagccgcuucuccuca

SEQ ID NO: 825777 - RNA, 22 nt, Human
ugcuucaagccgcuucuccuca

SEQ ID NO: 825778 - RNA, 22 nt, Human
ugcuucaagccgcuucuccuca

SEQ ID NO: 825779 - RNA, 18 nt, Human
uggcagacuuugguauag

SEQ ID NO: 825780 - RNA, 18 nt, Human
uggcagacuuugguauag

SEQ ID NO: 825781 - RNA, 23 nt, Human
ugucaggcgcccuggguagcucu

SEQ ID NO: 825782 - RNA, 18 nt, Human
ugucaggcggggcugcug

SEQ ID NO: 825783 - RNA, 18 nt, Human
ugucaggcggggcugcug

SEQ ID NO: 825784 - RNA, 24 nt, Human
uguccgagauaaugcugauguugg

SEQ ID NO: 825785 - RNA, 22 nt, Human
uguugaaugaauggagcccugc

SEQ ID NO: 825786 - RNA, 22 nt, Human
uguugaaugaauggagcccugc

SEQ ID NO: 825787 - RNA, 22 nt, Human
uguugaaugaauggagcccugc

SEQ ID NO: 825788 - RNA, 19 nt, Human
uucugcgccucugcccucc

SEQ ID NO: 825789 - RNA, 18 nt, Human
uuugaagucagcaauaag

SEQ ID NO: 825790 - RNA, 18 nt, Human
uuugaagucagcaauaag

SEQ ID NO: 825791 - RNA, 18 nt, Human
uuugaagucagcaauaag

SEQ ID NO: 825792 - RNA, 24 nt, Human
aagcagcggagcugggauuccaga

SEQ ID NO: 825793 - RNA, 19 nt, Human
acaguaagcagcggagcug

SEQ ID NO: 825794 - RNA, 21 nt, Human
accuuaaaucuuuccaacagc

SEQ ID NO: 825795 - RNA, 18 nt, Human
acucaucacguccucccc

SEQ ID NO: 825796 - RNA, 21 nt, Human
acucaucacguccuccccagu

SEQ ID NO: 825797 - RNA, 18 nt, Human
agaggaggggaggcaagg

SEQ ID NO: 825798 - RNA, 24 nt, Human
aggaagaaaucaaacguguggaag

SEQ ID NO: 825799 - RNA, 22 nt, Human
aucuucaucuuacaggugagaa

SEQ ID NO: 825800 - RNA, 18 nt, Human
auuccagacacguggcug

SEQ ID NO: 825801 - RNA, 19 nt, Human
caccacacuggcccccgcc

SEQ ID NO: 825802 - RNA, 19 nt, Human
cacuggcccccgccccugc

SEQ ID NO: 825803 - RNA, 23 nt, Human
cagcugcccguaggucccucugu

SEQ ID NO: 825804 - RNA, 24 nt, Human
cagugaagaaagguacaucccaag

SEQ ID NO: 825805 - RNA, 23 nt, Human
cagugaugcaaggauggagcugg

SEQ ID NO: 825806 - RNA, 19 nt, Human
caucagggucagagcuggg

SEQ ID NO: 825807 - RNA, 21 nt, Human
ccagccagccggggagacagc

SEQ ID NO: 825808 - RNA, 18 nt, Human
ccaguggggugguagguc

SEQ ID NO: 825809 - RNA, 24 nt, Human
cccaaggggacaccgacaguaagc

SEQ ID NO: 825810 - RNA, 20 nt, Human
ccccgccccugccccgggcu

SEQ ID NO: 825811 - RNA, 23 nt, Human
cccucugugugcugccugccgac

SEQ ID NO: 825812 - RNA, 22 nt, Human
ccucacucaucacguccucccc

SEQ ID NO: 825813 - RNA, 19 nt, Human
cuuaaaucuuuccaacagc

SEQ ID NO: 825814 - RNA, 21 nt, Human
gacaccgacaguaagcagcgg

SEQ ID NO: 825815 - RNA, 20 nt, Human
gagacagcuacagcgugugu

SEQ ID NO: 825816 - RNA, 18 nt, Human
gagaggaggggaggcaag

SEQ ID NO: 825817 - RNA, 20 nt, Human
gagcugggauuccagacacg

SEQ ID NO: 825818 - RNA, 21 nt, Human
gcaugguggcccaggugcuau

SEQ ID NO: 825819 - RNA, 21 nt, Human
gcccccgccccugccccgggc

SEQ ID NO: 825820 - RNA, 18 nt, Human
gcgugugucaccacacug

SEQ ID NO: 825821 - RNA, 21 nt, Human
gggucagagcugggcaggaga

SEQ ID NO: 825822 - RNA, 25 nt, Human
gugaaaccuuaaaucuuuccaacag

SEQ ID NO: 825823 - RNA, 20 nt, Human
gugcaugguggcccaggugc

SEQ ID NO: 825824 - RNA, 23 nt, Human
uaugucauaggugugaaaccuua

SEQ ID NO: 825825 - RNA, 28 nt, Human
ucaccacacuggcccccgccccugcccc

SEQ ID NO: 825826 - RNA, 20 nt, Human
uccccagugaugcaaggauu

SEQ ID NO: 825827 - RNA, 18 nt, Human
ucccucugugugcugccu

SEQ ID NO: 825828 - RNA, 18 nt, Human
uccucacucaucacgucc

SEQ ID NO: 825829 - RNA, 21 nt, Human
ugaugcaaggauggagcuggg

SEQ ID NO: 825830 - RNA, 19 nt, Human
ugcaggaagaaaucaaacg

SEQ ID NO: 825831 - RNA, 20 nt, Human
ugcguuuauuaagcaucagg

SEQ ID NO: 825832 - RNA, 23 nt, Human
ugcugcaggccuccgggccuccg

SEQ ID NO: 825833 - RNA, 21 nt, Human
uggaaccagccaguggggugg

SEQ ID NO: 825834 - RNA, 24 nt, Human
uggcugggccucugcaggaagaaa

SEQ ID NO: 825835 - RNA, 24 nt, Human
ugggauuccagacacguggcuggg

SEQ ID NO: 825836 - RNA, 22 nt, Human
ugggguaaaaccagggagaauc

SEQ ID NO: 825837 - RNA, 19 nt, Human
ugucaccacacuggccccc

SEQ ID NO: 825838 - RNA, 20 nt, Human
uuagugguggggguaagacc

SEQ ID NO: 825839 - RNA, 22 nt, Human
uuuccuguauucucuuaguggu

SEQ ID NO: 825840 - RNA, 20 nt, Human
aacauggugaaacccugucu

SEQ ID NO: 825841 - RNA, 21 nt, Human
aacauggugaaacccugucuc

SEQ ID NO: 825842 - RNA, 24 nt, Human
aagcacgagaaucacuugaaccca

SEQ ID NO: 825843 - RNA, 21 nt, Human
aagccaucugguacuuuugga

SEQ ID NO: 825844 - RNA, 19 nt, Human
aaggaaggagacaccucau

SEQ ID NO: 825845 - RNA, 24 nt, Human
aaucacuugaacccaggaggcgga

SEQ ID NO: 825846 - RNA, 21 nt, Human
acacaguuaauuaacucagug

SEQ ID NO: 825847 - RNA, 19 nt, Human
acagagacucugucucaaa

SEQ ID NO: 825848 - RNA, 24 nt, Human
acccaggaggcggagguugcagug

SEQ ID NO: 825849 - RNA, 24 nt, Human
acgcuggccaacauggugaaaccc

SEQ ID NO: 825850 - RNA, 24 nt, Human
acugcauugcagcccaagcaacag

SEQ ID NO: 825851 - RNA, 23 nt, Human
agaaggaaggagacaccucauga

SEQ ID NO: 825852 - RNA, 21 nt, Human
agacuguacgaacguccaguu

SEQ ID NO: 825853 - RNA, 18 nt, Human
agacuuuuuuccccaccu

SEQ ID NO: 825854 - RNA, 22 nt, Human
agagugcuggucucacugacuc

SEQ ID NO: 825855 - RNA, 19 nt, Human
agaguuacugggucaaagg

SEQ ID NO: 825856 - RNA, 23 nt, Human
agcaacagagacucugucucaaa

SEQ ID NO: 825857 - RNA, 24 nt, Human
agcaacagagacucugucucaaag

SEQ ID NO: 825858 - RNA, 24 nt, Human
agcacuuugggaggccaagguggg

SEQ ID NO: 825859 - RNA, 20 nt, Human
aggaagggccucuccugcuc

SEQ ID NO: 825860 - RNA, 20 nt, Human
aggccaagguggguggauca

SEQ ID NO: 825861 - RNA, 24 nt, Human
aggcggagguugcagugagccaag

SEQ ID NO: 825862 - RNA, 19 nt, Human
aggcguucaagaccacgcu

SEQ ID NO: 825863 - RNA, 24 nt, Human
agguggugaauaagggucucggug

SEQ ID NO: 825864 - RNA, 26 nt, Human
agguggugaauaagggucucggugua

SEQ ID NO: 825865 - RNA, 22 nt, Human
aucccagcacuuugggaggcca

SEQ ID NO: 825866 - RNA, 19 nt, Human
augccuguaaucccagcac

SEQ ID NO: 825867 - RNA, 24 nt, Human
caacauggugaaacccugucucua

SEQ ID NO: 825868 - RNA, 24 nt, Human
caagaccacgcuggccaacauggu

SEQ ID NO: 825869 - RNA, 24 nt, Human
caaggaaaaguacacagaaggaag

SEQ ID NO: 825870 - RNA, 24 nt, Human
caagguggguggaucaucugaggu

SEQ ID NO: 825871 - RNA, 26 nt, Human
caagguggguggaucaucugagguca

SEQ ID NO: 825872 - RNA, 22 nt, Human
caaguuccgacuugggcuggca

SEQ ID NO: 825873 - RNA, 24 nt, Human
cacaccuguagucccagguacuug

SEQ ID NO: 825874 - RNA, 23 nt, Human
caccuguagucccagguacuugg

SEQ ID NO: 825875 - RNA, 24 nt, Human
caccuguagucccagguacuuggg

SEQ ID NO: 825876 - RNA, 20 nt, Human
cacugcauugcagcccaagc

SEQ ID NO: 825877 - RNA, 21 nt, Human
cacugcauugcagcccaagca

SEQ ID NO: 825878 - RNA, 24 nt, Human
cacugcauugcagcccaagcaaca

SEQ ID NO: 825879 - RNA, 18 nt, Human
cagaaggaaggagacacc

SEQ ID NO: 825880 - RNA, 22 nt, Human
cagaaggaaggagacaccucau

SEQ ID NO: 825881 - RNA, 24 nt, Human
cagcacuuugggaggccaaggugg

SEQ ID NO: 825882 - RNA, 18 nt, Human
caucugaggucaggcguu

SEQ ID NO: 825883 - RNA, 20 nt, Human
caugccuguaaucccagcac

SEQ ID NO: 825884 - RNA, 24 nt, Human
caugccuguaaucccagcacuuug

SEQ ID NO: 825885 - RNA, 22 nt, Human
ccaggaggcggagguugcagug

SEQ ID NO: 825886 - RNA, 23 nt, Human
ccucuccugcuggagcucgagag

SEQ ID NO: 825887 - RNA, 22 nt, Human
ccuguaaucccagcacuuuggg

SEQ ID NO: 825888 - RNA, 21 nt, Human
ccuguagucccagguacuugg

SEQ ID NO: 825889 - RNA, 21 nt, Human
cgaggaagggccucuccugcu

SEQ ID NO: 825890 - RNA, 24 nt, Human
cucaugccuguaaucccagcacuu

SEQ ID NO: 825891 - RNA, 21 nt, Human
cuggccaacauggugaaaccc

SEQ ID NO: 825892 - RNA, 24 nt, Human
cuggccaacauggugaaacccugu

SEQ ID NO: 825893 - RNA, 23 nt, Human
gagaaucacuugaacccaggagg

SEQ ID NO: 825894 - RNA, 23 nt, Human
gagagugcuggucucacugacuc

SEQ ID NO: 825895 - RNA, 21 nt, Human
gaggcggagguugcagugagc

SEQ ID NO: 825896 - RNA, 18 nt, Human
gagguugcagugagccaa

SEQ ID NO: 825897 - RNA, 23 nt, Human
gagguugcagugagccaagauug

SEQ ID NO: 825898 - RNA, 19 nt, Human
gaucaucugaggucaggcg

SEQ ID NO: 825899 - RNA, 25 nt, Human
gaucaucugaggucaggcguucaag

SEQ ID NO: 825900 - RNA, 18 nt, Human
gauccaaguuccgacuug

SEQ ID NO: 825901 - RNA, 24 nt, Human
gccaacauggugaaacccugucuc

SEQ ID NO: 825902 - RNA, 24 nt, Human
gcuggccaacauggugaaacccug

SEQ ID NO: 825903 - RNA, 19 nt, Human
gcuuggagccagcaucacc

SEQ ID NO: 825904 - RNA, 22 nt, Human
ggacauguguuuucagaucuga

SEQ ID NO: 825905 - RNA, 22 nt, Human
ggaggcggagguugcagugagc

SEQ ID NO: 825906 - RNA, 22 nt, Human
ggagguugcagugagccaagau

SEQ ID NO: 825907 - RNA, 24 nt, Human
ggagguugcagugagccaagauug

SEQ ID NO: 825908 - RNA, 24 nt, Human
ggccgugguggcucaugccuguaa

SEQ ID NO: 825909 - RNA, 24 nt, Human
gguggcucaugccuguaaucccag

SEQ ID NO: 825910 - RNA, 24 nt, Human
gguggugcacaccuguagucccag

SEQ ID NO: 825911 - RNA, 22 nt, Human
ggugugguggugcacaccugua

SEQ ID NO: 825912 - RNA, 24 nt, Human
uaaaaauacacaaaaaauuagccu

SEQ ID NO: 825913 - RNA, 24 nt, Human
uaguaaaaauacacaaaaaauuag

SEQ ID NO: 825914 - RNA, 18 nt, Human
uaucaacagggcaugagg

SEQ ID NO: 825915 - RNA, 18 nt, Human
ucaaagguggugaauaag

SEQ ID NO: 825916 - RNA, 21 nt, Human
ucacugcauugcagcccaagc

SEQ ID NO: 825917 - RNA, 22 nt, Human
ucaugccuguaaucccagcacu

SEQ ID NO: 825918 - RNA, 24 nt, Human
ucauugugggcuggccgugguggc

SEQ ID NO: 825919 - RNA, 24 nt, Human
uccaaguuccgacuugggcuggca

SEQ ID NO: 825920 - RNA, 18 nt, Human
uccccaccuuuauuuuuc

SEQ ID NO: 825921 - RNA, 21 nt, Human
uccccaccuuuauuuuucaug

SEQ ID NO: 825922 - RNA, 24 nt, Human
ucuccugcuggagcucucgagagc

SEQ ID NO: 825923 - RNA, 23 nt, Human
ucugaggucaggcguucaagacc

SEQ ID NO: 825924 - RNA, 24 nt, Human
ugaagcacgagaaucacuugaacc

SEQ ID NO: 825925 - RNA, 19 nt, Human
ugaggguuuuguguuucuu

SEQ ID NO: 825926 - RNA, 22 nt, Human
ugaggucaggcguucaagacca

SEQ ID NO: 825927 - RNA, 19 nt, Human
ugccaggcgaggaagggcc

SEQ ID NO: 825928 - RNA, 23 nt, Human
ugccuguaaucccagcacuuugg

SEQ ID NO: 825929 - RNA, 23 nt, Human
ugccuguaaucccagcacuuugg

SEQ ID NO: 825930 - RNA, 24 nt, Human
ugccuguaaucccagcacuuuggg

SEQ ID NO: 825931 - RNA, 18 nt, Human
ugcugagccgcucagggg

SEQ ID NO: 825932 - RNA, 18 nt, Human
ugcuggagcucucgagag

SEQ ID NO: 825933 - RNA, 24 nt, Human
uggaucaucugaggucaggcguuc

SEQ ID NO: 825934 - RNA, 24 nt, Human
uggccaacauggugaaacccuguc

SEQ ID NO: 825935 - RNA, 19 nt, Human
uggccgugguggcucaugc

SEQ ID NO: 825936 - RNA, 22 nt, Human
uggcucaugccuguaaucccag

SEQ ID NO: 825937 - RNA, 24 nt, Human
uggcucaugccuguaaucccagca

SEQ ID NO: 825938 - RNA, 23 nt, Human
ugggaggccaagguggguggauc

SEQ ID NO: 825939 - RNA, 24 nt, Human
ugggaggccaagguggguggauca

SEQ ID NO: 825940 - RNA, 24 nt, Human
ugggaggcugaagcacgagaauca

SEQ ID NO: 825941 - RNA, 27 nt, Human
uggguggaucaucugaggucaggcguu

SEQ ID NO: 825942 - RNA, 18 nt, Human
uggugcacaccuguaguc

SEQ ID NO: 825943 - RNA, 22 nt, Human
uggugcacaccuguagucccag

SEQ ID NO: 825944 - RNA, 24 nt, Human
ugguggcucaugccuguaauccca

SEQ ID NO: 825945 - RNA, 24 nt, Human
ugguggugcacaccuguaguccca

SEQ ID NO: 825946 - RNA, 24 nt, Human
uggugugguggugcacaccuguag

SEQ ID NO: 825947 - RNA, 23 nt, Human
ugugggcuggccgugguggcuca

SEQ ID NO: 825948 - RNA, 24 nt, Human
uugaacccaggaggcggagguugc

SEQ ID NO: 825949 - RNA, 19 nt, Human
uugcagcccaagcaacaga

SEQ ID NO: 825950 - RNA, 21 nt, Human
uugcagugagccaagauugca

SEQ ID NO: 825951 - RNA, 25 nt, Human
uugggaggcugaagcacgagaauca

SEQ ID NO: 825952 - RNA, 24 nt, Human
uuucuguuggaagcacacaguuaa

SEQ ID NO: 825953 - RNA, 19 nt, Human
uuugaugguuucacuucau

SEQ ID NO: 825954 - RNA, 24 nt, Human
aaaaaacauuauaaaaaauucaua

SEQ ID NO: 825955 - RNA, 20 nt, Human
aaaaaaucagacaugaucua

SEQ ID NO: 825956 - RNA, 21 nt, Human
aaaaaaucagacaugaucuag

SEQ ID NO: 825957 - RNA, 26 nt, Human
aaaaaaucagacaugaucuagauaua

SEQ ID NO: 825958 - RNA, 20 nt, Human
aaaaaucagacaugaucuag

SEQ ID NO: 825959 - RNA, 25 nt, Human
aaauguucuuucaguacugggacug

SEQ ID NO: 825960 - RNA, 24 nt, Human
aaucaucuaagacaaacacuugug

SEQ ID NO: 825961 - RNA, 25 nt, Human
aaucaucuaagacaaacacuugugu

SEQ ID NO: 825962 - RNA, 21 nt, Human
acaagaugaccuggaagacug

SEQ ID NO: 825963 - RNA, 19 nt, Human
acagaauucaaaacaccuu

SEQ ID NO: 825964 - RNA, 18 nt, Human
accauagggaaagcuuug

SEQ ID NO: 825965 - RNA, 23 nt, Human
accuuaagaaauucagaccaggg

SEQ ID NO: 825966 - RNA, 19 nt, Human
agaccagggcuggagaagu

SEQ ID NO: 825967 - RNA, 18 nt, Human
aggcuccacgccgcccaa

SEQ ID NO: 825968 - RNA, 18 nt, Human
aucaucuaagacaaacac

SEQ ID NO: 825969 - RNA, 23 nt, Human
cacgccgcccaaacgcgcaugcg

SEQ ID NO: 825970 - RNA, 20 nt, Human
cagaauucaaaacaccuucc

SEQ ID NO: 825971 - RNA, 22 nt, Human
cauacagaauucaaaacaccuu

SEQ ID NO: 825972 - RNA, 21 nt, Human
cauacagugaugaaaaaagga

SEQ ID NO: 825973 - RNA, 23 nt, Human
caucuuuauuuugaaagucugaa

SEQ ID NO: 825974 - RNA, 20 nt, Human
cgagaaaucauccacacaaa

SEQ ID NO: 825975 - RNA, 21 nt, Human
cgcccaaacgcgcaugcggga

SEQ ID NO: 825976 - RNA, 21 nt, Human
cgccgcccaaacgcgcaugcg

SEQ ID NO: 825977 - RNA, 19 nt, Human
cgcggcuaaggcgcggugc

SEQ ID NO: 825978 - RNA, 21 nt, Human
cgcggcuaaggcgcggugcuc

SEQ ID NO: 825979 - RNA, 18 nt, Human
cggcagcaagaacuagaa

SEQ ID NO: 825980 - RNA, 22 nt, Human
cggcuaaggcgcggugcucugc

SEQ ID NO: 825981 - RNA, 26 nt, Human
cuaauaaauagcagcauuuguuuaua

SEQ ID NO: 825982 - RNA, 19 nt, Human
cuacaagaugaccuggaag

SEQ ID NO: 825983 - RNA, 19 nt, Human
cuccacgccgcccaaacgc

SEQ ID NO: 825984 - RNA, 20 nt, Human
gcuaaggcgcggugcucugc

SEQ ID NO: 825985 - RNA, 21 nt, Human
gcuaaggcgcggugcucugcc

SEQ ID NO: 825986 - RNA, 21 nt, Human
uaagacaaacacuugugugaa

SEQ ID NO: 825987 - RNA, 24 nt, Human
uacaagguuuguugaauacuaguu

SEQ ID NO: 825988 - RNA, 26 nt, Human
uacagaauucaaaacaccuuccuaaa

SEQ ID NO: 825989 - RNA, 19 nt, Human
uacagugaugaaaaaagga

SEQ ID NO: 825990 - RNA, 24 nt, Human
uacagugaugaaaaaaggagucuu

SEQ ID NO: 825991 - RNA, 21 nt, Human
uacauacagaauucaaaacac

SEQ ID NO: 825992 - RNA, 23 nt, Human
uacauacagaauucaaaacaccu

SEQ ID NO: 825993 - RNA, 22 nt, Human
uauauacauacagaauucaaaa

SEQ ID NO: 825994 - RNA, 19 nt, Human
ucuaaagugcauucuugca

SEQ ID NO: 825995 - RNA, 24 nt, Human
ucuaaagugcauucuugcagcuaa

SEQ ID NO: 825996 - RNA, 23 nt, Human
ucuaagacaaacacuugugugaa

SEQ ID NO: 825997 - RNA, 19 nt, Human
uggaaccauagggaaagcu

SEQ ID NO: 825998 - RNA, 20 nt, Human
uuaaucaucuaagacaaaca

SEQ ID NO: 825999 - RNA, 22 nt, Human
uuaaucaucuaagacaaacacu

SEQ ID NO: 826000 - RNA, 18 nt, Human
uuaauucuuuuggcauac

SEQ ID NO: 826001 - RNA, 22 nt, Human
uuggcauaucuaaaugucagaa

SEQ ID NO: 826002 - RNA, 25 nt, Human
uuuuuuauuucuuagugcuuuugau

SEQ ID NO: 826003 - RNA, 28 nt, Human
uuuuuuuuuauuucuuagugcuuuugau

SEQ ID NO: 826004 - RNA, 21 nt, Human
uuuuuuuuuuuuuuuuuauuu

SEQ ID NO: 826005 - RNA, 21 nt, Human
aaacagaaaacaguagggauc

SEQ ID NO: 826006 - RNA, 24 nt, Human
aaaguagaaagaggucucagaaac

SEQ ID NO: 826007 - RNA, 19 nt, Human
aaggaagagaaacgcgcaa

SEQ ID NO: 826008 - RNA, 18 nt, Human
accagguacccaaaguuc

SEQ ID NO: 826009 - RNA, 18 nt, Human
agccaggacaaccccagg

SEQ ID NO: 826010 - RNA, 21 nt, Human
aggcguagaagguuuagagcc

SEQ ID NO: 826011 - RNA, 18 nt, Human
agggagacaguaaaguag

SEQ ID NO: 826012 - RNA, 24 nt, Human
agggccagggaagaggcugggugu

SEQ ID NO: 826013 - RNA, 24 nt, Human
cagcaaggaagagaaacgcgcaau

SEQ ID NO: 826014 - RNA, 24 nt, Human
cagcaaggaagagaaacgcgcaau

SEQ ID NO: 826015 - RNA, 19 nt, Human
cagccaguccacgcaggca

SEQ ID NO: 826016 - RNA, 24 nt, Human
ccacgcaggcaggaugcugcggag

SEQ ID NO: 826017 - RNA, 24 nt, Human
ccagcagauagcuguacuaaaggc

SEQ ID NO: 826018 - RNA, 27 nt, Human
cccagagccaggacaaccccagggagc

SEQ ID NO: 826019 - RNA, 23 nt, Human
ccccagggagcucuccauuagca

SEQ ID NO: 826020 - RNA, 23 nt, Human
cccccuccccagcugcccugggc

SEQ ID NO: 826021 - RNA, 18 nt, Human
cccugccuagacccacca

SEQ ID NO: 826022 - RNA, 18 nt, Human
cccugggcccagaugccc

SEQ ID NO: 826023 - RNA, 24 nt, Human
ccucuaggacucuagggagacagu

SEQ ID NO: 826024 - RNA, 23 nt, Human
cgcgcaauaccaagaaaccucaa

SEQ ID NO: 826025 - RNA, 22 nt, Human
cucuaugcugagaacauucccc

SEQ ID NO: 826026 - RNA, 18 nt, Human
cugggcccagaugccccc

SEQ ID NO: 826027 - RNA, 23 nt, Human
gacaacugaggaacagaaaagga

SEQ ID NO: 826028 - RNA, 21 nt, Human
gagccaggacaaccccaggga

SEQ ID NO: 826029 - RNA, 22 nt, Human
gaggucucagaaacauuuuuuu

SEQ ID NO: 826030 - RNA, 21 nt, Human
gcaauaccaagaaaccucaau

SEQ ID NO: 826031 - RNA, 21 nt, Human
gcagauagcuguacuaaaggc

SEQ ID NO: 826032 - RNA, 24 nt, Human
gccuagacccaccagguacccaaa

SEQ ID NO: 826033 - RNA, 21 nt, Human
gcggagaaagcucuaugcuga

SEQ ID NO: 826034 - RNA, 23 nt, Human
uaacuaagagcuccuuccucucg

SEQ ID NO: 826035 - RNA, 21 nt, Human
ucacucugacccccuccccag

SEQ ID NO: 826036 - RNA, 25 nt, Human
ucacucugacccccuccccagcugc

SEQ ID NO: 826037 - RNA, 18 nt, Human
uccccuugauggaaagaa

SEQ ID NO: 826038 - RNA, 20 nt, Human
ucucuggggagggccaggga

SEQ ID NO: 826039 - RNA, 19 nt, Human
uggggagggccagggaaga

SEQ ID NO: 826040 - RNA, 24 nt, Human
uguauaaacacauaaaacagaaaa

SEQ ID NO: 826041 - RNA, 22 nt, Human
ugucacucugacccccucccca

SEQ ID NO: 826042 - RNA, 19 nt, Human
ugucccagcucagacccug

SEQ ID NO: 826043 - RNA, 24 nt, Human
uguuacauacaauguauaaacaca

SEQ ID NO: 826044 - RNA, 23 nt, Human
uuuaaaguacaagacauucagug

SEQ ID NO: 826045 - RNA, 24 nt, Human
uuuaccagaaccugucccagcuca

SEQ ID NO: 826046 - RNA, 25 nt, Human
uuuuuuuuuuuuuuuuuuuauuuuu

SEQ ID NO: 826047 - RNA, 23 nt, Human
aaaagagaagaaacaucuucaaa

SEQ ID NO: 826048 - RNA, 19 nt, Human
aacaucuucaaacaaggug

SEQ ID NO: 826049 - RNA, 21 nt, Human
aacuuccauaagaaucaaagg

SEQ ID NO: 826050 - RNA, 19 nt, Human
aagacaaaagguuuucccu

SEQ ID NO: 826051 - RNA, 20 nt, Human
aagacaaaagguuuucccuu

SEQ ID NO: 826052 - RNA, 23 nt, Human
aaggagauuauggcauaaucuaa

SEQ ID NO: 826053 - RNA, 23 nt, Human
aagucagucauuaaacucacugc

SEQ ID NO: 826054 - RNA, 18 nt, Human
aguugauucaaagccuug

SEQ ID NO: 826055 - RNA, 19 nt, Human
aucuaagaagaaaaugauc

SEQ ID NO: 826056 - RNA, 22 nt, Human
cagaauguucaucagaaacuug

SEQ ID NO: 826057 - RNA, 21 nt, Human
cagccggugccuccaccuccc

SEQ ID NO: 826058 - RNA, 22 nt, Human
ccuaaaguaagaauacaaaaau

SEQ ID NO: 826059 - RNA, 22 nt, Human
cuccuaaguggccaggaguagg

SEQ ID NO: 826060 - RNA, 23 nt, Human
gaaaaugcucaaguaaaauaccu

SEQ ID NO: 826061 - RNA, 19 nt, Human
gaggugguuaccaccaccu

SEQ ID NO: 826062 - RNA, 21 nt, Human
uauggcauaaucuaagaagaa

SEQ ID NO: 826063 - RNA, 22 nt, Human
ucagcucuccuaaguggccagg

SEQ ID NO: 826064 - RNA, 18 nt, Human
uccacuguaaaccuuagc

SEQ ID NO: 826065 - RNA, 23 nt, Human
uccacuguaaaccuuagcuacag

SEQ ID NO: 826066 - RNA, 21 nt, Human
uccuaaguggccaggaguagg

SEQ ID NO: 826067 - RNA, 20 nt, Human
ucgaucccgaaaacaaugca

SEQ ID NO: 826068 - RNA, 20 nt, Human
ugcagaauguucaucagaaa

SEQ ID NO: 826069 - RNA, 20 nt, Human
uggaaaaugcucaaguaaaa

SEQ ID NO: 826070 - RNA, 25 nt, Human
uggcauaaucuaagaagaaaaugau

SEQ ID NO: 826071 - RNA, 22 nt, Human
ugguuaccaccaccuuauaaac

SEQ ID NO: 826072 - RNA, 26 nt, Human
uucaucagaaacuugaggugguuacc

SEQ ID NO: 826073 - RNA, 22 nt, Human
uuuuuuuuuuuuuuuuuaucuu

SEQ ID NO: 826074 - RNA, 25 nt, Human
aaacuaaagaggaacacucagauau

SEQ ID NO: 826075 - RNA, 22 nt, Human
aaccacugucuuuccugaacaa

SEQ ID NO: 826076 - RNA, 20 nt, Human
agauuguacaauuuaaaaac

SEQ ID NO: 826077 - RNA, 21 nt, Human
gaacacucagauaucuggccc

SEQ ID NO: 826078 - RNA, 26 nt, Human
ucagauaucuggccccucuuccugac

SEQ ID NO: 826079 - RNA, 22 nt, Human
ucugcaauugaagaaacuaaag

SEQ ID NO: 826080 - RNA, 28 nt, Human
ucugcaauugaagaaacuaaagaggaac

SEQ ID NO: 826081 - RNA, 21 nt, Human
uuccugaacaacauaaaauua

SEQ ID NO: 826082 - RNA, 30 nt, Human
uugaagaaacuaaagaggaacacucagauu

SEQ ID NO: 826083 - RNA, 24 nt, Human
aaaaaaaaauaacgagaaaaaacg

SEQ ID NO: 826084 - RNA, 20 nt, Human
aaaaaaucaauucagagagc

SEQ ID NO: 826085 - RNA, 23 nt, Human
aaaaaaucaauucagagagcagc

SEQ ID NO: 826086 - RNA, 18 nt, Human
aaaaagccuagcuacaac

SEQ ID NO: 826087 - RNA, 24 nt, Human
aaaaagccuagcuacaacccaaac

SEQ ID NO: 826088 - RNA, 20 nt, Human
aaaagcucuggccuuaaaca

SEQ ID NO: 826089 - RNA, 22 nt, Human
aacugugucaaaagccucaaaa

SEQ ID NO: 826090 - RNA, 21 nt, Human
aagaaaaagccuagcuacaac

SEQ ID NO: 826091 - RNA, 23 nt, Human
aagccuagcuacaacccaaacgc

SEQ ID NO: 826092 - RNA, 22 nt, Human
aauaacgagaaaaaacgaaaaa

SEQ ID NO: 826093 - RNA, 20 nt, Human
acaaacacaguaagaaccaa

SEQ ID NO: 826094 - RNA, 20 nt, Human
accugaaauccaaccagaaa

SEQ ID NO: 826095 - RNA, 22 nt, Human
accugaaauccaaccagaaagc

SEQ ID NO: 826096 - RNA, 24 nt, Human
accugaaauccaaccagaaagcca

SEQ ID NO: 826097 - RNA, 18 nt, Human
acuugugcaugugauucu

SEQ ID NO: 826098 - RNA, 30 nt, Human
agaaaagaaaaagccuagcuacaacccaag

SEQ ID NO: 826099 - RNA, 22 nt, Human
agagagcagcguggccuuggag

SEQ ID NO: 826100 - RNA, 20 nt, Human
agagcagcguggccuuggag

SEQ ID NO: 826101 - RNA, 20 nt, Human
agccagaaguaaaaaucuua

SEQ ID NO: 826102 - RNA, 21 nt, Human
aggagugaaaaaucagauccg

SEQ ID NO: 826103 - RNA, 25 nt, Human
aggcuagaagugaaauaugacagaa

SEQ ID NO: 826104 - RNA, 22 nt, Human
agucagaagcacaaagcauuua

SEQ ID NO: 826105 - RNA, 21 nt, Human
aguugccugguccucagaaac

SEQ ID NO: 826106 - RNA, 21 nt, Human
auuuucaaaaaaaaggaacaa

SEQ ID NO: 826107 - RNA, 19 nt, Human
caaaagccucaaaaaaccc

SEQ ID NO: 826108 - RNA, 19 nt, Human
caaaauagcuuagugaggc

SEQ ID NO: 826109 - RNA, 25 nt, Human
caaacacaguaagaaccaagcacaa

SEQ ID NO: 826110 - RNA, 24 nt, Human
cacaaagcauuuauuaugcauuca

SEQ ID NO: 826111 - RNA, 23 nt, Human
cacaguaagaaccaagcacaaga

SEQ ID NO: 826112 - RNA, 19 nt, Human
caccaucuaugacuguccc

SEQ ID NO: 826113 - RNA, 19 nt, Human
cagauccgaggcuuguuuu

SEQ ID NO: 826114 - RNA, 26 nt, Human
cauuuaaguuccugugauaauuauuc

SEQ ID NO: 826115 - RNA, 20 nt, Human
ccagcagauauaaaugcagc

SEQ ID NO: 826116 - RNA, 23 nt, Human
ccccucgucuucucgccuuuaaa

SEQ ID NO: 826117 - RNA, 20 nt, Human
cccucccucccccacccuuu

SEQ ID NO: 826118 - RNA, 22 nt, Human
cgagaaaaaacgaaaaauuaaa

SEQ ID NO: 826119 - RNA, 22 nt, Human
cuacaacccaaacgcauccacc

SEQ ID NO: 826120 - RNA, 24 nt, Human
cuggccuuaaacacaucuuaccug

SEQ ID NO: 826121 - RNA, 25 nt, Human
cuggccuuaaacacaucuuaccuga

SEQ ID NO: 826122 - RNA, 23 nt, Human
cuuaaacacaucuuaccugaaau

SEQ ID NO: 826123 - RNA, 21 nt, Human
cuuggagaccacccacaccca

SEQ ID NO: 826124 - RNA, 21 nt, Human
cuuuucauuguauuacugaau

SEQ ID NO: 826125 - RNA, 20 nt, Human
gaaaaagccuagcuacaacc

SEQ ID NO: 826126 - RNA, 24 nt, Human
gaaaaagccuagcuacaacccaaa

SEQ ID NO: 826127 - RNA, 21 nt, Human
gaaauccaaccagaaagccag

SEQ ID NO: 826128 - RNA, 21 nt, Human
gacagaauuuaaaccagcaga

SEQ ID NO: 826129 - RNA, 21 nt, Human
gagagcagcguggccuuggag

SEQ ID NO: 826130 - RNA, 19 nt, Human
gagcucuucucuuucccuc

SEQ ID NO: 826131 - RNA, 23 nt, Human
gcuacaacccaaacgcauccacc

SEQ ID NO: 826132 - RNA, 21 nt, Human
gugagacuacaacaaagggaa

SEQ ID NO: 826133 - RNA, 20 nt, Human
gugcagagcucuucucuuuc

SEQ ID NO: 826134 - RNA, 22 nt, Human
guuccaaaaucuccugcgacca

SEQ ID NO: 826135 - RNA, 28 nt, Human
uaaaauacacaaacacaguaagaaccag

SEQ ID NO: 826136 - RNA, 22 nt, Human
uacaaacaaaacucaaaaaauc

SEQ ID NO: 826137 - RNA, 25 nt, Human
uacacaaacacaguaagaaccaagc

SEQ ID NO: 826138 - RNA, 23 nt, Human
ucaaaagccucaaaaaacccuga

SEQ ID NO: 826139 - RNA, 27 nt, Human
ucaaucauguagcuaaacaaaaaacug

SEQ ID NO: 826140 - RNA, 23 nt, Human
uccaaaaucuccugcgaccacuu

SEQ ID NO: 826141 - RNA, 23 nt, Human
ucccaacuauaaaugaaagaaua

SEQ ID NO: 826142 - RNA, 23 nt, Human
ugaaaaaucagauccgaggcuug

SEQ ID NO: 826143 - RNA, 20 nt, Human
ugaaauccaaccagaaagcc

SEQ ID NO: 826144 - RNA, 20 nt, Human
ugacaaaaagggcacuuuuu

SEQ ID NO: 826145 - RNA, 21 nt, Human
ugacugugaucaucuuacaaa

SEQ ID NO: 826146 - RNA, 21 nt, Human
ugaggaaugauccauauaugg

SEQ ID NO: 826147 - RNA, 18 nt, Human
ugcagcaccuauguguau

SEQ ID NO: 826148 - RNA, 23 nt, Human
ugcagcaccuauguguauauuuu

SEQ ID NO: 826149 - RNA, 19 nt, Human
ugccugguccucagaaaca

SEQ ID NO: 826150 - RNA, 27 nt, Human
ugccugguccucagaaaccggggguuc

SEQ ID NO: 826151 - RNA, 22 nt, Human
ugcuaggagaauccagugacaa

SEQ ID NO: 826152 - RNA, 19 nt, Human
uggagaccacccacaccca

SEQ ID NO: 826153 - RNA, 21 nt, Human
uggagaccacccacacccaac

SEQ ID NO: 826154 - RNA, 20 nt, Human
uggccuuggagaccacccac

SEQ ID NO: 826155 - RNA, 21 nt, Human
ugggcuuugcugucaaggagu

SEQ ID NO: 826156 - RNA, 23 nt, Human
ugucaccagccagaaguaaaaau

SEQ ID NO: 826157 - RNA, 24 nt, Human
ugugucaaaagccucaaaaaaccc

SEQ ID NO: 826158 - RNA, 22 nt, Human
uuaauaccccugccaacaccau

SEQ ID NO: 826159 - RNA, 23 nt, Human
uuacugaauaccugagguaguug

SEQ ID NO: 826160 - RNA, 25 nt, Human
uuauacaugaggaaugauccauaua

SEQ ID NO: 826161 - RNA, 24 nt, Human
uucaaaaugucuaauugaucuuca

SEQ ID NO: 826162 - RNA, 19 nt, Human
uucagagagcagcguggcc

SEQ ID NO: 826163 - RNA, 22 nt, Human
uucucuuucccucccuccccca

SEQ ID NO: 826164 - RNA, 26 nt, Human
uugaaagucuugcaucucuucacuga

SEQ ID NO: 826165 - RNA, 20 nt, Human
uugcacaguauacagaaauc

SEQ ID NO: 826166 - RNA, 21 nt, Human
uuggagaccacccacacccaa

SEQ ID NO: 826167 - RNA, 23 nt, Human
uuuaaaaaaaaauaacgagaaaa

SEQ ID NO: 826168 - RNA, 19 nt, Human
uuuaaacacugucacacca

SEQ ID NO: 826169 - RNA, 19 nt, Human
uuuaauaccccugccaaca

SEQ ID NO: 826170 - RNA, 21 nt, Human
uuugccagucaguugaaaguc

SEQ ID NO: 826171 - RNA, 22 nt, Human
uuugccagucaguugaaagucu

SEQ ID NO: 826172 - RNA, 18 nt, Human
uuuguuuguuuguuuuaa

SEQ ID NO: 826173 - RNA, 19 nt, Human
caacaaagaggaguuaccu

SEQ ID NO: 826174 - RNA, 19 nt, Human
caacaaagaggaguuaccu

SEQ ID NO: 826175 - RNA, 23 nt, Human
gcaacaaagaggaguuaccugaa

SEQ ID NO: 826176 - RNA, 27 nt, Human
uuaccugaagcuacccuuuuuagccau

SEQ ID NO: 826177 - RNA, 20 nt, Human
uuggcaacaaagaggaguua

SEQ ID NO: 826178 - RNA, 20 nt, Human
aaaaaaaagcaggcuacuaa

SEQ ID NO: 826179 - RNA, 19 nt, Human
aaaaaagauaaagggaagg

SEQ ID NO: 826180 - RNA, 18 nt, Human
aaaacccaaaggugagcc

SEQ ID NO: 826181 - RNA, 22 nt, Human
aaacccaaaccagguacaagga

SEQ ID NO: 826182 - RNA, 24 nt, Human
aaagauucugcccccugccuucuu

SEQ ID NO: 826183 - RNA, 23 nt, Human
aagaagaagaaaggccaaaggca

SEQ ID NO: 826184 - RNA, 23 nt, Human
aagaagaagaagaaaggccaaag

SEQ ID NO: 826185 - RNA, 20 nt, Human
aagaagaagaagaagaaagg

SEQ ID NO: 826186 - RNA, 20 nt, Human
aagagcacagucuccagggc

SEQ ID NO: 826187 - RNA, 19 nt, Human
aaggacuuucuccucagga

SEQ ID NO: 826188 - RNA, 21 nt, Human
aagugaaaaaaagauucugcc

SEQ ID NO: 826189 - RNA, 20 nt, Human
aaucaggccacgcugaccug

SEQ ID NO: 826190 - RNA, 24 nt, Human
aaugaaaaaagauaaagggaagga

SEQ ID NO: 826191 - RNA, 25 nt, Human
aaugaaaaaagauaaagggaaggaa

SEQ ID NO: 826192 - RNA, 18 nt, Human
acaaaacccaaaggugag

SEQ ID NO: 826193 - RNA, 21 nt, Human
acaggcaagccacuaaggcaa

SEQ ID NO: 826194 - RNA, 20 nt, Human
acaggucaccagagcaagga

SEQ ID NO: 826195 - RNA, 22 nt, Human
acaugacacucucacuccaccc

SEQ ID NO: 826196 - RNA, 25 nt, Human
acaugacacucucacuccacccucc

SEQ ID NO: 826197 - RNA, 19 nt, Human
accagguacaaggauccca

SEQ ID NO: 826198 - RNA, 24 nt, Human
agaaaaaaaauaaaaauaaaaaaa

SEQ ID NO: 826199 - RNA, 22 nt, Human
agaagaagaagaaaggccaaag

SEQ ID NO: 826200 - RNA, 19 nt, Human
agaggaaggaaaagcagag

SEQ ID NO: 826201 - RNA, 19 nt, Human
agaggaaggaaaagcagag

SEQ ID NO: 826202 - RNA, 18 nt, Human
agaguagcagacuucacc

SEQ ID NO: 826203 - RNA, 22 nt, Human
agccaccucagagguucucuca

SEQ ID NO: 826204 - RNA, 23 nt, Human
agccacuaaggcaaugcacuacc

SEQ ID NO: 826205 - RNA, 24 nt, Human
agcucuaaaaaaaaaaaaaagcag

SEQ ID NO: 826206 - RNA, 18 nt, Human
aggaagaagaagaagaag

SEQ ID NO: 826207 - RNA, 22 nt, Human
aggaagaagaagaagaagaaag

SEQ ID NO: 826208 - RNA, 25 nt, Human
aggaagcauccauaucucuuuuugg

SEQ ID NO: 826209 - RNA, 18 nt, Human
aggaaggaaaagcagagc

SEQ ID NO: 826210 - RNA, 24 nt, Human
aggaagggaaaacccaaaccaggu

SEQ ID NO: 826211 - RNA, 19 nt, Human
aggacagaguagcagacuu

SEQ ID NO: 826212 - RNA, 24 nt, Human
aggagaaaauacagccaccucaga

SEQ ID NO: 826213 - RNA, 19 nt, Human
agggaagggggcggagcag

SEQ ID NO: 826214 - RNA, 21 nt, Human
aucauauguaauccacccaga

SEQ ID NO: 826215 - RNA, 24 nt, Human
caaaauauaguguaaggaagaaaa

SEQ ID NO: 826216 - RNA, 19 nt, Human
caaggcaaacugcuucuga

SEQ ID NO: 826217 - RNA, 24 nt, Human
caaggcaaacugcuucugaguuuc

SEQ ID NO: 826218 - RNA, 19 nt, Human
caaguaaacaaaugaaguu

SEQ ID NO: 826219 - RNA, 23 nt, Human
caccagagcaaggacuuucuccu

SEQ ID NO: 826220 - RNA, 21 nt, Human
cacccuccucugcaacuuaca

SEQ ID NO: 826221 - RNA, 18 nt, Human
cacuccacccuccucugc

SEQ ID NO: 826222 - RNA, 19 nt, Human
cacugguauacuugagaca

SEQ ID NO: 826223 - RNA, 23 nt, Human
cagcaguaaggacagaguagcag

SEQ ID NO: 826224 - RNA, 18 nt, Human
caggaugccucugacuaa

SEQ ID NO: 826225 - RNA, 19 nt, Human
caguauccuacuuaccgaa

SEQ ID NO: 826226 - RNA, 26 nt, Human
ccaaaccagguacaaggaucccaaac

SEQ ID NO: 826227 - RNA, 23 nt, Human
ccaagcagagaggaaaaggacca

SEQ ID NO: 826228 - RNA, 23 nt, Human
ccacccagaggcacaggcaagcc

SEQ ID NO: 826229 - RNA, 19 nt, Human
cccaagcugaugaguggca

SEQ ID NO: 826230 - RNA, 23 nt, Human
ccccugcacucccacugguauac

SEQ ID NO: 826231 - RNA, 24 nt, Human
ccccuucuugucacaaaacccaaa

SEQ ID NO: 826232 - RNA, 20 nt, Human
cccuuccccucccaccuccc

SEQ ID NO: 826233 - RNA, 18 nt, Human
ccuccugagcgaggaagc

SEQ ID NO: 826234 - RNA, 19 nt, Human
ccugaggccauccuugcuc

SEQ ID NO: 826235 - RNA, 21 nt, Human
cggcagcuucagcggcagcuu

SEQ ID NO: 826236 - RNA, 19 nt, Human
cuaaaaaaaaaaaaaagca

SEQ ID NO: 826237 - RNA, 18 nt, Human
cuagucccaggcaaugca

SEQ ID NO: 826238 - RNA, 19 nt, Human
cucacaguauccuacuuac

SEQ ID NO: 826239 - RNA, 20 nt, Human
cuccacagcuggucuacacc

SEQ ID NO: 826240 - RNA, 18 nt, Human
cucuaaaaaaaaaaaaaa

SEQ ID NO: 826241 - RNA, 20 nt, Human
cugcccccugccuuccuggg

SEQ ID NO: 826242 - RNA, 20 nt, Human
gaacuuguggcucuugggaa

SEQ ID NO: 826243 - RNA, 25 nt, Human
gaagaagaagaagaaaggccaaagg

SEQ ID NO: 826244 - RNA, 19 nt, Human
gaagaagaagaagaagaaa

SEQ ID NO: 826245 - RNA, 23 nt, Human
gaagaagaagaagaagaaaggag

SEQ ID NO: 826246 - RNA, 18 nt, Human
gaccacagcccccuaucu

SEQ ID NO: 826247 - RNA, 19 nt, Human
gaccuaaaccauccuccuc

SEQ ID NO: 826248 - RNA, 19 nt, Human
gagggugcucccuccaggg

SEQ ID NO: 826249 - RNA, 20 nt, Human
gagucagagggagggaggga

SEQ ID NO: 826250 - RNA, 27 nt, Human
gcaauagcucuaaaaaaaaaaaaaagc

SEQ ID NO: 826251 - RNA, 23 nt, Human
gcacagucuccagggcagcagag

SEQ ID NO: 826252 - RNA, 21 nt, Human
gcagagcuuggagcaggaugc

SEQ ID NO: 826253 - RNA, 21 nt, Human
gccauugagauugaauuugac

SEQ ID NO: 826254 - RNA, 25 nt, Human
ggaaaacccaaaccagguacaagga

SEQ ID NO: 826255 - RNA, 18 nt, Human
ggaggcaacggcggcagc

SEQ ID NO: 826256 - RNA, 22 nt, Human
ggagguggggguggggcagacu

SEQ ID NO: 826257 - RNA, 22 nt, Human
ggccauugagauugaauuugac

SEQ ID NO: 826258 - RNA, 19 nt, Human
ggcggaggcaacggcggca

SEQ ID NO: 826259 - RNA, 20 nt, Human
gggaaggaagucaccacuga

SEQ ID NO: 826260 - RNA, 19 nt, Human
gggagguggggguggggca

SEQ ID NO: 826261 - RNA, 23 nt, Human
gggcagcagaggugugugguggc

SEQ ID NO: 826262 - RNA, 22 nt, Human
gguggcugaugguggggacacu

SEQ ID NO: 826263 - RNA, 21 nt, Human
gugagccucagaugguucugu

SEQ ID NO: 826264 - RNA, 22 nt, Human
guggugcuucccauccccuccc

SEQ ID NO: 826265 - RNA, 23 nt, Human
uaaagaggucugggcaaagaguc

SEQ ID NO: 826266 - RNA, 23 nt, Human
uaaccacaguggggagguggggg

SEQ ID NO: 826267 - RNA, 20 nt, Human
uaauaggagaggcagccaug

SEQ ID NO: 826268 - RNA, 20 nt, Human
uagcuacacgugggaagccc

SEQ ID NO: 826269 - RNA, 21 nt, Human
uaucccaauacaugacacucu

SEQ ID NO: 826270 - RNA, 19 nt, Human
uaugaagguuccagagcug

SEQ ID NO: 826271 - RNA, 20 nt, Human
ucacaaggaagggaaaaccc

SEQ ID NO: 826272 - RNA, 23 nt, Human
ucacaaggaagggaaaacccaaa

SEQ ID NO: 826273 - RNA, 22 nt, Human
ucaggagaaaggaaggaccaca

SEQ ID NO: 826274 - RNA, 23 nt, Human
ucagugauaauagauaauaggag

SEQ ID NO: 826275 - RNA, 18 nt, Human
uccacccagaggcacagg

SEQ ID NO: 826276 - RNA, 29 nt, Human
uccauaucucuuuuuggucuuccucacaa

SEQ ID NO: 826277 - RNA, 25 nt, Human
ucccauccccuccccucccuggagg

SEQ ID NO: 826278 - RNA, 21 nt, Human
uccccugcacucccacuggua

SEQ ID NO: 826279 - RNA, 22 nt, Human
ucccuuccccucccaccuccca

SEQ ID NO: 826280 - RNA, 23 nt, Human
uccucugcaacuuacaggucacc

SEQ ID NO: 826281 - RNA, 18 nt, Human
uccuggguuaaagacaug

SEQ ID NO: 826282 - RNA, 24 nt, Human
ucuaaaaaaaaaaaaaagcaggcu

SEQ ID NO: 826283 - RNA, 19 nt, Human
ucucacuccacccuccucu

SEQ ID NO: 826284 - RNA, 23 nt, Human
ucucacuccacccuccucugcaa

SEQ ID NO: 826285 - RNA, 20 nt, Human
ucuccagggcagcagaggug

SEQ ID NO: 826286 - RNA, 19 nt, Human
ugaaaaaagauaaagggaa

SEQ ID NO: 826287 - RNA, 23 nt, Human
uggaaggugaguaggaaauaugg

SEQ ID NO: 826288 - RNA, 25 nt, Human
uggcagccaucauucccaagcugaa

SEQ ID NO: 826289 - RNA, 19 nt, Human
uggcugaugguggggacac

SEQ ID NO: 826290 - RNA, 24 nt, Human
ugggcaaagagucagagggaggga

SEQ ID NO: 826291 - RNA, 19 nt, Human
uggggaggugggggugggg

SEQ ID NO: 826292 - RNA, 19 nt, Human
uggggaggugggggugggg

SEQ ID NO: 826293 - RNA, 23 nt, Human
uggggagguggggguggggcaga

SEQ ID NO: 826294 - RNA, 24 nt, Human
uggguuuacuaaaaccaggaacuu

SEQ ID NO: 826295 - RNA, 24 nt, Human
ugugcaaaagaaaaaaaaauuaaa

SEQ ID NO: 826296 - RNA, 21 nt, Human
ugugcuccuccccugcacucc

SEQ ID NO: 826297 - RNA, 20 nt, Human
ugugugcagccaaaauauag

SEQ ID NO: 826298 - RNA, 20 nt, Human
uguuucaugguagccucccc

SEQ ID NO: 826299 - RNA, 22 nt, Human
uuaagauugaccuaccuaauau

SEQ ID NO: 826300 - RNA, 27 nt, Human
uuagaaguaaaauauacaugauccaac

SEQ ID NO: 826301 - RNA, 18 nt, Human
uuccagagcugaagguug

SEQ ID NO: 826302 - RNA, 22 nt, Human
uuguggcucuugggaagagcaa

SEQ ID NO: 826303 - RNA, 23 nt, Human
uuuacuaucauauguaauccacc

SEQ ID NO: 826304 - RNA, 19 nt, Human
aaaacaaagaaaccuaaag

SEQ ID NO: 826305 - RNA, 21 nt, Human
aaaacaaagaaaccuaaagga

SEQ ID NO: 826306 - RNA, 22 nt, Human
aaacaaaacaaagaaaccuaaa

SEQ ID NO: 826307 - RNA, 20 nt, Human
aaacacucagcuauuacuga

SEQ ID NO: 826308 - RNA, 18 nt, Human
aaaccuuaaaaagaacac

SEQ ID NO: 826309 - RNA, 21 nt, Human
aaagaaccaaagugacaucaa

SEQ ID NO: 826310 - RNA, 24 nt, Human
aaagaaccaaagugacaucaaaua

SEQ ID NO: 826311 - RNA, 19 nt, Human
aacaaagaaaccuaaagga

SEQ ID NO: 826312 - RNA, 22 nt, Human
aacaccaauugugaauggaaua

SEQ ID NO: 826313 - RNA, 22 nt, Human
aacaccuuggaaagguuuuucc

SEQ ID NO: 826314 - RNA, 18 nt, Human
aagcuggaaagcuucccg

SEQ ID NO: 826315 - RNA, 22 nt, Human
aagucugaauugcacaaggaaa

SEQ ID NO: 826316 - RNA, 23 nt, Human
aaguucaaaaguuguguguggcu

SEQ ID NO: 826317 - RNA, 19 nt, Human
acaaaacaaagaaaccuaa

SEQ ID NO: 826318 - RNA, 19 nt, Human
acacaacacuaccgaucuc

SEQ ID NO: 826319 - RNA, 20 nt, Human
acuguucuuaaagcuguuuu

SEQ ID NO: 826320 - RNA, 25 nt, Human
acuucacauucaagggcugaagcug

SEQ ID NO: 826321 - RNA, 18 nt, Human
agcuacaaaauuggcuga

SEQ ID NO: 826322 - RNA, 24 nt, Human
auuucuuuccucuguugagugccg

SEQ ID NO: 826323 - RNA, 21 nt, Human
caccuuggaaagguuuuucca

SEQ ID NO: 826324 - RNA, 23 nt, Human
caccuuggaaagguuuuuccaag

SEQ ID NO: 826325 - RNA, 18 nt, Human
caguuuuuuucaacuuuu

SEQ ID NO: 826326 - RNA, 19 nt, Human
cauggaaacuccauucugc

SEQ ID NO: 826327 - RNA, 18 nt, Human
cauggguccuggaaggcu

SEQ ID NO: 826328 - RNA, 18 nt, Human
cauucugcaacacagcgc

SEQ ID NO: 826329 - RNA, 19 nt, Human
ccaagccagacaguacuga

SEQ ID NO: 826330 - RNA, 18 nt, Human
ccagaagaauggccuaca

SEQ ID NO: 826331 - RNA, 21 nt, Human
ccuucaguggucugguagaaa

SEQ ID NO: 826332 - RNA, 23 nt, Human
cucaaaaacaaaacaaagaaacc

SEQ ID NO: 826333 - RNA, 20 nt, Human
cuccauucugcaacacagcg

SEQ ID NO: 826334 - RNA, 20 nt, Human
cuccccggaaccacuguggu

SEQ ID NO: 826335 - RNA, 23 nt, Human
cugagucacuguauaagccuucu

SEQ ID NO: 826336 - RNA, 20 nt, Human
cuuccugcuuguggcucucc

SEQ ID NO: 826337 - RNA, 20 nt, Human
gaaaaagaaccaaagugaca

SEQ ID NO: 826338 - RNA, 21 nt, Human
gagcugaucagaacaaucuua

SEQ ID NO: 826339 - RNA, 24 nt, Human
gcaaugaaaacacuaagccaaaag

SEQ ID NO: 826340 - RNA, 18 nt, Human
gcucuccagaagaauggc

SEQ ID NO: 826341 - RNA, 20 nt, Human
ggaaaacaguugugccuaca

SEQ ID NO: 826342 - RNA, 21 nt, Human
ggaaagguuuuuccaagagaa

SEQ ID NO: 826343 - RNA, 22 nt, Human
gguagaaauccauggaaacucc

SEQ ID NO: 826344 - RNA, 20 nt, Human
gugggugacauuaaggcccu

SEQ ID NO: 826345 - RNA, 27 nt, Human
guuuucuguugcuucuaguuuuccaac

SEQ ID NO: 826346 - RNA, 22 nt, Human
uaaaaagaacaccaauugugaa

SEQ ID NO: 826347 - RNA, 20 nt, Human
uaagaugccuuagaaaaauu

SEQ ID NO: 826348 - RNA, 20 nt, Human
uacagaaagacucacacucc

SEQ ID NO: 826349 - RNA, 23 nt, Human
uacagaaagacucacacucccaa

SEQ ID NO: 826350 - RNA, 25 nt, Human
uacccuacagaaagacucacacucc

SEQ ID NO: 826351 - RNA, 21 nt, Human
uaccgaucucuuuugcucaaa

SEQ ID NO: 826352 - RNA, 18 nt, Human
uaggaauuucuuuccucu

SEQ ID NO: 826353 - RNA, 19 nt, Human
uauuaggggaaaaaacacu

SEQ ID NO: 826354 - RNA, 23 nt, Human
ucaacuuuugggucuacugguuu

SEQ ID NO: 826355 - RNA, 19 nt, Human
uccaggaacuccuucagug

SEQ ID NO: 826356 - RNA, 18 nt, Human
ucgaugcuuaagucugaa

SEQ ID NO: 826357 - RNA, 18 nt, Human
ucugcaacacagcgcugc

SEQ ID NO: 826358 - RNA, 20 nt, Human
ucugcaacacagcgcugcuc

SEQ ID NO: 826359 - RNA, 18 nt, Human
ugaaaacacuaagccaaa

SEQ ID NO: 826360 - RNA, 19 nt, Human
ugagcaguguucccuuagg

SEQ ID NO: 826361 - RNA, 19 nt, Human
ugagcugaucagaacaauc

SEQ ID NO: 826362 - RNA, 24 nt, Human
ugccagacaugccaaugacacuuc

SEQ ID NO: 826363 - RNA, 23 nt, Human
ugcuacguacgcagggcuuccag

SEQ ID NO: 826364 - RNA, 23 nt, Human
ugcuaugagguuaauacauaaag

SEQ ID NO: 826365 - RNA, 18 nt, Human
ugugaacacacaucuacg

SEQ ID NO: 826366 - RNA, 21 nt, Human
uguggucagaccugcccgggc

SEQ ID NO: 826367 - RNA, 20 nt, Human
ugugugaacacacaucuacg

SEQ ID NO: 826368 - RNA, 22 nt, Human
uuaaaaagaacaccaauuguga

SEQ ID NO: 826369 - RNA, 24 nt, Human
uuaaauuuaguacaaacuauaaaa

SEQ ID NO: 826370 - RNA, 20 nt, Human
uuauaccaauagaaaaauag

SEQ ID NO: 826371 - RNA, 22 nt, Human
uuccuuaaauuuccuuaugucu

SEQ ID NO: 826372 - RNA, 23 nt, Human
uuuuuuuuuuaaagaaaaaaccu

SEQ ID NO: 826373 - RNA, 19 nt, Human
uuuuuuuuuuuuuuuuuaa

SEQ ID NO: 826374 - RNA, 25 nt, Human
agcacccucuccgcagcccccgccc

SEQ ID NO: 826375 - RNA, 19 nt, Human
agcggcuggaggugagcac

SEQ ID NO: 826376 - RNA, 22 nt, Human
cacccucuccgcagcccccgcc

SEQ ID NO: 826377 - RNA, 20 nt, Human
cacuacccaaccuacgacuc

SEQ ID NO: 826378 - RNA, 21 nt, Human
cacuacccaaccuacgacucu

SEQ ID NO: 826379 - RNA, 18 nt, Human
cauccagaguggacaggg

SEQ ID NO: 826380 - RNA, 22 nt, Human
caucccugcuuucaaauaggga

SEQ ID NO: 826381 - RNA, 22 nt, Human
cccaccagcggcuggaggugag

SEQ ID NO: 826382 - RNA, 22 nt, Human
ccccccaccagcggcuggaggu

SEQ ID NO: 826383 - RNA, 26 nt, Human
ccccgccccaacccgcacuacccaac

SEQ ID NO: 826384 - RNA, 23 nt, Human
ccccucaguuaagcacccucucc

SEQ ID NO: 826385 - RNA, 21 nt, Human
ccgccccaacccgcacuaccc

SEQ ID NO: 826386 - RNA, 22 nt, Human
ccucaguuaagcacccucuccg

SEQ ID NO: 826387 - RNA, 22 nt, Human
cucuccgcagcccccgccccaa

SEQ ID NO: 826388 - RNA, 20 nt, Human
gagcauccuguccuucagga

SEQ ID NO: 826389 - RNA, 19 nt, Human
gcacagcuucaccacccug

SEQ ID NO: 826390 - RNA, 22 nt, Human
gccccaacccgcacuacccaac

SEQ ID NO: 826391 - RNA, 18 nt, Human
gcccccgccccaacccgc

SEQ ID NO: 826392 - RNA, 24 nt, Human
ggacaccccccaccagcggcugga

SEQ ID NO: 826393 - RNA, 21 nt, Human
ggguuagcuggggccccaggg

SEQ ID NO: 826394 - RNA, 22 nt, Human
guggaaugggaucaucccugcu

SEQ ID NO: 826395 - RNA, 19 nt, Human
uaaauaaccaucagguggc

SEQ ID NO: 826396 - RNA, 20 nt, Human
ucccugcuuucaaauaggga

SEQ ID NO: 826397 - RNA, 19 nt, Human
ucucuaagcgaccugaacc

SEQ ID NO: 826398 - RNA, 19 nt, Human
ucuggacguauaaauaacc

SEQ ID NO: 826399 - RNA, 18 nt, Human
ugagucgccccaggucug

SEQ ID NO: 826400 - RNA, 20 nt, Human
ugggaagagugggugcaugg

SEQ ID NO: 826401 - RNA, 22 nt, Human
ugggaagagugggugcaugggu

SEQ ID NO: 826402 - RNA, 21 nt, Human
uggggaggucuggggagagca

SEQ ID NO: 826403 - RNA, 21 nt, Human
uugacguacagagagaggagu

SEQ ID NO: 826404 - RNA, 20 nt, Human
aaaaaccucaaauaacucag

SEQ ID NO: 826405 - RNA, 24 nt, Human
aaaguacugggauuacagguguga

SEQ ID NO: 826406 - RNA, 24 nt, Human
aaagugcugggaucacagguguga

SEQ ID NO: 826407 - RNA, 24 nt, Human
aaaugugcuucaagcagauaaugu

SEQ ID NO: 826408 - RNA, 21 nt, Human
aacagguauugcucuuugaug

SEQ ID NO: 826409 - RNA, 19 nt, Human
aaccagagacuguuauucc

SEQ ID NO: 826410 - RNA, 18 nt, Human
aaguacugggauuacagg

SEQ ID NO: 826411 - RNA, 26 nt, Human
aaguacugggauuacaggugugagcc

SEQ ID NO: 826412 - RNA, 21 nt, Human
aaguagcugagaccacaggca

SEQ ID NO: 826413 - RNA, 24 nt, Human
aaguagcugagaccacaggcaugc

SEQ ID NO: 826414 - RNA, 22 nt, Human
aaguagcugggauuacaggcac

SEQ ID NO: 826415 - RNA, 25 nt, Human
aaguagcugggauuacaggcaccug

SEQ ID NO: 826416 - RNA, 26 nt, Human
aagugcugggaucacaggugugagcc

SEQ ID NO: 826417 - RNA, 24 nt, Human
aaguuuguauuuuuaguagagaug

SEQ ID NO: 826418 - RNA, 26 nt, Human
aauaauccuucaccuaaucaaugauc

SEQ ID NO: 826419 - RNA, 21 nt, Human
aauaucaaaggcaaacaggga

SEQ ID NO: 826420 - RNA, 18 nt, Human
aauuuuguauuuuuagua

SEQ ID NO: 826421 - RNA, 19 nt, Human
acaggcaccugccaccacg

SEQ ID NO: 826422 - RNA, 21 nt, Human
acugccuacaaauauccugca

SEQ ID NO: 826423 - RNA, 25 nt, Human
agaaacugauguggaaauauaauaa

SEQ ID NO: 826424 - RNA, 19 nt, Human
agagaugggguuucacuau

SEQ ID NO: 826425 - RNA, 25 nt, Human
agcccagccaaguuuguauuuuuag

SEQ ID NO: 826426 - RNA, 18 nt, Human
aggaauccucacuuacca

SEQ ID NO: 826427 - RNA, 20 nt, Human
aggcaaacagggaaaccaga

SEQ ID NO: 826428 - RNA, 20 nt, Human
aggcaugcaccacuaagccc

SEQ ID NO: 826429 - RNA, 22 nt, Human
aggcugaagccacucagugggc

SEQ ID NO: 826430 - RNA, 25 nt, Human
aggcuggagugcaguggcaugaucu

SEQ ID NO: 826431 - RNA, 21 nt, Human
aggcuggucucuccugacuuc

SEQ ID NO: 826432 - RNA, 20 nt, Human
aggcuuuccaaaaaaccuca

SEQ ID NO: 826433 - RNA, 24 nt, Human
aggugauccaccugccucagccuc

SEQ ID NO: 826434 - RNA, 24 nt, Human
aggugaucugcuugccuuggccuc

SEQ ID NO: 826435 - RNA, 23 nt, Human
aggugugagccaccgugccuggc

SEQ ID NO: 826436 - RNA, 19 nt, Human
aguagagaugggguuucac

SEQ ID NO: 826437 - RNA, 20 nt, Human
agugcaguggcaugaucuug

SEQ ID NO: 826438 - RNA, 23 nt, Human
agugcaguggcaugaucuuggcu

SEQ ID NO: 826439 - RNA, 24 nt, Human
agugcaguggcaugaucuuggcuc

SEQ ID NO: 826440 - RNA, 22 nt, Human
aguugauagaccauuucuuucc

SEQ ID NO: 826441 - RNA, 22 nt, Human
augaaaaaaauuguucuugauc

SEQ ID NO: 826442 - RNA, 20 nt, Human
augggguuucacuaugcugg

SEQ ID NO: 826443 - RNA, 24 nt, Human
augggguuucacuaugcuggccag

SEQ ID NO: 826444 - RNA, 23 nt, Human
auuucaccaugaaaaaaauuguu

SEQ ID NO: 826445 - RNA, 24 nt, Human
caaaguacugggauuacaggugug

SEQ ID NO: 826446 - RNA, 24 nt, Human
caaagugcugggaucacaggugug

SEQ ID NO: 826447 - RNA, 22 nt, Human
caagcaauucuccugccucagc

SEQ ID NO: 826448 - RNA, 27 nt, Human
caagcaauucuccugccucagccuccc

SEQ ID NO: 826449 - RNA, 21 nt, Human
caagcacucuccugccucagc

SEQ ID NO: 826450 - RNA, 21 nt, Human
cacaaucagugucuaauuacc

SEQ ID NO: 826451 - RNA, 22 nt, Human
cacaaucagugucuaauuaccu

SEQ ID NO: 826452 - RNA, 22 nt, Human
cacaggugugagccaccgcgcc

SEQ ID NO: 826453 - RNA, 21 nt, Human
caccacaaccuccgccuccug

SEQ ID NO: 826454 - RNA, 23 nt, Human
caccugccucagccucccaaagu

SEQ ID NO: 826455 - RNA, 23 nt, Human
cacuaagcccagccaaguuugua

SEQ ID NO: 826456 - RNA, 21 nt, Human
cacuaugcuggccaggcuggu

SEQ ID NO: 826457 - RNA, 24 nt, Human
cacuaugcuggccaggcuggucuc

SEQ ID NO: 826458 - RNA, 20 nt, Human
cacucuuugcuaaacaacag

SEQ ID NO: 826459 - RNA, 21 nt, Human
caggcaccugccaccacgccc

SEQ ID NO: 826460 - RNA, 22 nt, Human
caggugauccaccugccucagc

SEQ ID NO: 826461 - RNA, 29 nt, Human
cagguugagucuacacagaggaacacuuc

SEQ ID NO: 826462 - RNA, 24 nt, Human
cagugucuaauuaccuauuacucu

SEQ ID NO: 826463 - RNA, 22 nt, Human
caucacucuuugcuaaacaaca

SEQ ID NO: 826464 - RNA, 22 nt, Human
cauggaaaccaagaugcauagc

SEQ ID NO: 826465 - RNA, 20 nt, Human
ccaaaguacugggauuacag

SEQ ID NO: 826466 - RNA, 21 nt, Human
ccaaaguacugggauuacagg

SEQ ID NO: 826467 - RNA, 24 nt, Human
ccaaaguacugggauuacaggugu

SEQ ID NO: 826468 - RNA, 20 nt, Human
ccaaagugcugggaucacag

SEQ ID NO: 826469 - RNA, 21 nt, Human
ccaaagugcugggaucacagg

SEQ ID NO: 826470 - RNA, 24 nt, Human
ccaaagugcugggaucacaggugu

SEQ ID NO: 826471 - RNA, 23 nt, Human
ccaaguagcugggauuacaggca

SEQ ID NO: 826472 - RNA, 24 nt, Human
ccaaguuuguauuuuuaguagaga

SEQ ID NO: 826473 - RNA, 25 nt, Human
ccaaugaucuuuccaagaaagcacc

SEQ ID NO: 826474 - RNA, 18 nt, Human
ccacaaccuccgccuccu

SEQ ID NO: 826475 - RNA, 23 nt, Human
ccacaaccuccgccuccuggguu

SEQ ID NO: 826476 - RNA, 24 nt, Human
ccacaaccuccgccuccuggguuc

SEQ ID NO: 826477 - RNA, 20 nt, Human
ccaccacgcccggcuaauuu

SEQ ID NO: 826478 - RNA, 26 nt, Human
ccaccugccucagccucccaaagugc

SEQ ID NO: 826479 - RNA, 23 nt, Human
ccauggugugaugcucugccgca

SEQ ID NO: 826480 - RNA, 19 nt, Human
ccauguuggucaggcuggu

SEQ ID NO: 826481 - RNA, 23 nt, Human
ccauguuggucaggcuggucucg

SEQ ID NO: 826482 - RNA, 23 nt, Human
cccaaguagcugggauuacaggc

SEQ ID NO: 826483 - RNA, 24 nt, Human
cccaaguagcugggauuacaggca

SEQ ID NO: 826484 - RNA, 23 nt, Human
cccaggcuggagugcaguggcau

SEQ ID NO: 826485 - RNA, 21 nt, Human
cccgaccucaggugauccacc

SEQ ID NO: 826486 - RNA, 23 nt, Human
cccgaccucaggugauccaccug

SEQ ID NO: 826487 - RNA, 23 nt, Human
cccgaccucaggugauccaccug

SEQ ID NO: 826488 - RNA, 19 nt, Human
ccuccgccuccuggguuca

SEQ ID NO: 826489 - RNA, 24 nt, Human
ccugccucagccucccaaagugcu

SEQ ID NO: 826490 - RNA, 23 nt, Human
ccugccucagccucccaaguagc

SEQ ID NO: 826491 - RNA, 22 nt, Human
ccuggguucaagcacucuccug

SEQ ID NO: 826492 - RNA, 24 nt, Human
cgaccucaggugauccaccugccu

SEQ ID NO: 826493 - RNA, 21 nt, Human
cgccuccuggguucaagcacu

SEQ ID NO: 826494 - RNA, 18 nt, Human
cgggaucucucuaggucg

SEQ ID NO: 826495 - RNA, 25 nt, Human
cuacugagacaggauaaaacuaugu

SEQ ID NO: 826496 - RNA, 24 nt, Human
cuauguuggcagaaagaaugugau

SEQ ID NO: 826497 - RNA, 24 nt, Human
cucaagcaauucuccugccucagc

SEQ ID NO: 826498 - RNA, 23 nt, Human
cucagccucccaaguagcuggga

SEQ ID NO: 826499 - RNA, 23 nt, Human
cucaggugauccaccugccucag

SEQ ID NO: 826500 - RNA, 24 nt, Human
cuccauguuggucaggcuggucuc

SEQ ID NO: 826501 - RNA, 21 nt, Human
cucccaaguagcugagaccac

SEQ ID NO: 826502 - RNA, 20 nt, Human
cucccacaaaaaucccaaug

SEQ ID NO: 826503 - RNA, 26 nt, Human
cuccugacuucaggugaucugcuugc

SEQ ID NO: 826504 - RNA, 27 nt, Human
cucuccugccucagccucccaaguagc

SEQ ID NO: 826505 - RNA, 19 nt, Human
cucucucuucaauuucaaa

SEQ ID NO: 826506 - RNA, 24 nt, Human
cugccucagccucccaaagugcug

SEQ ID NO: 826507 - RNA, 23 nt, Human
cugccucagccucccaaguagcu

SEQ ID NO: 826508 - RNA, 23 nt, Human
cugccucagccucccaaguagcu

SEQ ID NO: 826509 - RNA, 24 nt, Human
cuggagugcaguggcaugaucuug

SEQ ID NO: 826510 - RNA, 21 nt, Human
cuguaccuaaugaccucacca

SEQ ID NO: 826511 - RNA, 22 nt, Human
cuuauggccucucauaucuauu

SEQ ID NO: 826512 - RNA, 24 nt, Human
cuuguugcccaggcuggagugcag

SEQ ID NO: 826513 - RNA, 21 nt, Human
gaacuguaccuaaugaccuca

SEQ ID NO: 826514 - RNA, 23 nt, Human
gaccucaggugauccaccugccu

SEQ ID NO: 826515 - RNA, 24 nt, Human
gaccucaggugauccaccugccuc

SEQ ID NO: 826516 - RNA, 24 nt, Human
gacuucaggugaucugcuugccuu

SEQ ID NO: 826517 - RNA, 24 nt, Human
gagaugggguuucacuaugcuggc

SEQ ID NO: 826518 - RNA, 18 nt, Human
gaucacaggugugagcca

SEQ ID NO: 826519 - RNA, 21 nt, Human
gauccaccugccucagccucc

SEQ ID NO: 826520 - RNA, 18 nt, Human
gauuacaggugugagcca

SEQ ID NO: 826521 - RNA, 21 nt, Human
gauuacaggugugagccaccg

SEQ ID NO: 826522 - RNA, 24 nt, Human
gauuacaggugugagccaccgugc

SEQ ID NO: 826523 - RNA, 18 nt, Human
gcacguaauucaagcaca

SEQ ID NO: 826524 - RNA, 19 nt, Human
gccacaguacucuccuggu

SEQ ID NO: 826525 - RNA, 20 nt, Human
gcccaggcuggagugcagug

SEQ ID NO: 826526 - RNA, 20 nt, Human
gccucagccucccaaguagc

SEQ ID NO: 826527 - RNA, 19 nt, Human
gcuggagugcaguggcaug

SEQ ID NO: 826528 - RNA, 18 nt, Human
gcugggagccgggaucuc

SEQ ID NO: 826529 - RNA, 23 nt, Human
gcuggucucgaacucccgaccuc

SEQ ID NO: 826530 - RNA, 23 nt, Human
ggggcaguguucggauccaggaa

SEQ ID NO: 826531 - RNA, 22 nt, Human
gggguuucacuaugcuggccag

SEQ ID NO: 826532 - RNA, 22 nt, Human
gggguuucuccauguuggucag

SEQ ID NO: 826533 - RNA, 22 nt, Human
ggguuucacuaugcuggccagg

SEQ ID NO: 826534 - RNA, 21 nt, Human
gucacuggguaauggccucag

SEQ ID NO: 826535 - RNA, 18 nt, Human
gugauccaccugccucag

SEQ ID NO: 826536 - RNA, 24 nt, Human
gugauccaccugccucagccuccc

SEQ ID NO: 826537 - RNA, 18 nt, Human
gugcccaggcuggagugu

SEQ ID NO: 826538 - RNA, 21 nt, Human
guuauagguuuccaaaacugc

SEQ ID NO: 826539 - RNA, 23 nt, Human
guuccuggugcccaggcuggagu

SEQ ID NO: 826540 - RNA, 24 nt, Human
guuccuggugcccaggcuggagug

SEQ ID NO: 826541 - RNA, 24 nt, Human
guucuuguugcccaggcuggagug

SEQ ID NO: 826542 - RNA, 22 nt, Human
uaaaacauuagcaaaaugugcu

SEQ ID NO: 826543 - RNA, 23 nt, Human
uaaaagcaaaguccuccuucuuc

SEQ ID NO: 826544 - RNA, 20 nt, Human
uaaggucuuggccugcucca

SEQ ID NO: 826545 - RNA, 23 nt, Human
uacaggcaccugccaccacgccc

SEQ ID NO: 826546 - RNA, 22 nt, Human
uacaggugugagccaccgugcc

SEQ ID NO: 826547 - RNA, 23 nt, Human
uacaggugugagccaccgugccu

SEQ ID NO: 826548 - RNA, 24 nt, Human
uacugggauuacaggugugagcca

SEQ ID NO: 826549 - RNA, 21 nt, Human
uagacccucugccacauaugu

SEQ ID NO: 826550 - RNA, 20 nt, Human
uagauggaguuuuguucuug

SEQ ID NO: 826551 - RNA, 22 nt, Human
uaggcuuuccaaaaaaccucaa

SEQ ID NO: 826552 - RNA, 24 nt, Human
uaguagagaugggguuucacuaug

SEQ ID NO: 826553 - RNA, 19 nt, Human
uaucagaauggugagugac

SEQ ID NO: 826554 - RNA, 19 nt, Human
uaugcuggccaggcugguc

SEQ ID NO: 826555 - RNA, 19 nt, Human
ucaaaggcaaacagggaaa

SEQ ID NO: 826556 - RNA, 18 nt, Human
ucaauggcaaugcagauu

SEQ ID NO: 826557 - RNA, 24 nt, Human
ucaccacaaccuccgccuccuggg

SEQ ID NO: 826558 - RNA, 25 nt, Human
ucaccacaaccuccgccuccugggu

SEQ ID NO: 826559 - RNA, 27 nt, Human
ucaccacaaccuccgccuccuggguuc

SEQ ID NO: 826560 - RNA, 18 nt, Human
ucagccucccaaguagcu

SEQ ID NO: 826561 - RNA, 21 nt, Human
ucagccucccaaguagcugag

SEQ ID NO: 826562 - RNA, 20 nt, Human
ucagccucccaaguagcugg

SEQ ID NO: 826563 - RNA, 22 nt, Human
ucaggugauccaccugccucag

SEQ ID NO: 826564 - RNA, 19 nt, Human
ucagugggcugggagccgg

SEQ ID NO: 826565 - RNA, 18 nt, Human
ucaguuuuucuuuuucuu

SEQ ID NO: 826566 - RNA, 20 nt, Human
ucauaaggugaagguaacug

SEQ ID NO: 826567 - RNA, 18 nt, Human
uccaagaaagcaccaugg

SEQ ID NO: 826568 - RNA, 23 nt, Human
ucccaaaguacugggauuacagg

SEQ ID NO: 826569 - RNA, 23 nt, Human
ucccaaagugcugggaucacagg

SEQ ID NO: 826570 - RNA, 24 nt, Human
ucccaaguagcugagaccacaggc

SEQ ID NO: 826571 - RNA, 24 nt, Human
ucccaaguagcugggauuacaggc

SEQ ID NO: 826572 - RNA, 25 nt, Human
ucccaaugaucuuuccaagaaagca

SEQ ID NO: 826573 - RNA, 19 nt, Human
uccucuuccucuucuucca

SEQ ID NO: 826574 - RNA, 24 nt, Human
uccuggacucaagcaauucuccug

SEQ ID NO: 826575 - RNA, 18 nt, Human
uccuggguucaagcacuc

SEQ ID NO: 826576 - RNA, 20 nt, Human
uccuggguucaagcacucuc

SEQ ID NO: 826577 - RNA, 21 nt, Human
uccuggguucaagcacucucc

SEQ ID NO: 826578 - RNA, 23 nt, Human
uccuggguucaagcacucuccug

SEQ ID NO: 826579 - RNA, 18 nt, Human
uccuggugcccaggcugg

SEQ ID NO: 826580 - RNA, 23 nt, Human
ucguuccuggugcccaggcugga

SEQ ID NO: 826581 - RNA, 26 nt, Human
ucuccugccucagccucccaaguagc

SEQ ID NO: 826582 - RNA, 20 nt, Human
ucucgcauucuuacuaugua

SEQ ID NO: 826583 - RNA, 22 nt, Human
ucucuaggucgucagggggcag

SEQ ID NO: 826584 - RNA, 23 nt, Human
ucucuaggucgucagggggcagu

SEQ ID NO: 826585 - RNA, 24 nt, Human
ucucuucaauuucaaaacaagauc

SEQ ID NO: 826586 - RNA, 24 nt, Human
ucugccuccuggacucaagcaauu

SEQ ID NO: 826587 - RNA, 20 nt, Human
ucugucaagaaugaaauuaa

SEQ ID NO: 826588 - RNA, 21 nt, Human
ucuucaguuuuucuuuuucuu

SEQ ID NO: 826589 - RNA, 18 nt, Human
ucuugcuuauggccucuc

SEQ ID NO: 826590 - RNA, 18 nt, Human
ucuuguugcccaggcugg

SEQ ID NO: 826591 - RNA, 19 nt, Human
ucuuguugcccaggcugga

SEQ ID NO: 826592 - RNA, 20 nt, Human
ucuuguugcccaggcuggag

SEQ ID NO: 826593 - RNA, 21 nt, Human
ucuuguugcccaggcuggagu

SEQ ID NO: 826594 - RNA, 22 nt, Human
ucuuguugcccaggcuggagug

SEQ ID NO: 826595 - RNA, 20 nt, Human
ugaaacgcaauaguaggcuu

SEQ ID NO: 826596 - RNA, 19 nt, Human
ugacugccuacaaauaucc

SEQ ID NO: 826597 - RNA, 24 nt, Human
ugacuucaggugaucugcuugccu

SEQ ID NO: 826598 - RNA, 21 nt, Human
ugagacaggauaaaacuaugu

SEQ ID NO: 826599 - RNA, 21 nt, Human
ugagaccacaggcaugcacca

SEQ ID NO: 826600 - RNA, 24 nt, Human
ugagaccacaggcaugcaccacua

SEQ ID NO: 826601 - RNA, 26 nt, Human
ugagaccacaggcaugcaccacuaag

SEQ ID NO: 826602 - RNA, 19 nt, Human
ugagggauuggccacuguc

SEQ ID NO: 826603 - RNA, 18 nt, Human
ugcccaggcuggagugca

SEQ ID NO: 826604 - RNA, 21 nt, Human
ugcccaggcuggagugcagug

SEQ ID NO: 826605 - RNA, 22 nt, Human
ugcccaggcuggagugcagugg

SEQ ID NO: 826606 - RNA, 24 nt, Human
ugcccaggcuggagugcaguggca

SEQ ID NO: 826607 - RNA, 21 nt, Human
ugcccaggcuggaguguaaug

SEQ ID NO: 826608 - RNA, 23 nt, Human
ugccuaguaaccugcgaggccug

SEQ ID NO: 826609 - RNA, 24 nt, Human
ugccucagccucccaaagugcugg

SEQ ID NO: 826610 - RNA, 24 nt, Human
ugccucagccucccaaguagcuga

SEQ ID NO: 826611 - RNA, 24 nt, Human
ugccucagccucccaaguagcugg

SEQ ID NO: 826612 - RNA, 18 nt, Human
ugcuggccaggcuggucu

SEQ ID NO: 826613 - RNA, 24 nt, Human
ugcugggaucacaggugugagcca

SEQ ID NO: 826614 - RNA, 18 nt, Human
ugcuugccuuggccuccc

SEQ ID NO: 826615 - RNA, 24 nt, Human
uggacucaagcaauucuccugccu

SEQ ID NO: 826616 - RNA, 19 nt, Human
uggaguauccuacugagac

SEQ ID NO: 826617 - RNA, 19 nt, Human
uggagugcaguggcaugau

SEQ ID NO: 826618 - RNA, 24 nt, Human
uggagugcaguggcaugaucuugg

SEQ ID NO: 826619 - RNA, 24 nt, Human
uggcaugaucuuggcucaccacaa

SEQ ID NO: 826620 - RNA, 19 nt, Human
ugggaucacaggugugagc

SEQ ID NO: 826621 - RNA, 21 nt, Human
ugggaucacaggugugagcca

SEQ ID NO: 826622 - RNA, 22 nt, Human
ugggaucacaggugugagccac

SEQ ID NO: 826623 - RNA, 23 nt, Human
ugggaucacaggugugagccacc

SEQ ID NO: 826624 - RNA, 24 nt, Human
ugggaucacaggugugagccaccg

SEQ ID NO: 826625 - RNA, 21 nt, Human
ugggauuacaggcaccugcca

SEQ ID NO: 826626 - RNA, 22 nt, Human
ugggauuacaggcaccugccac

SEQ ID NO: 826627 - RNA, 24 nt, Human
ugggauuacaggcaccugccacca

SEQ ID NO: 826628 - RNA, 18 nt, Human
ugggauuacaggugugag

SEQ ID NO: 826629 - RNA, 21 nt, Human
ugggauuacaggugugagcca

SEQ ID NO: 826630 - RNA, 22 nt, Human
ugggauuacaggugugagccac

SEQ ID NO: 826631 - RNA, 23 nt, Human
ugggauuacaggugugagccacc

SEQ ID NO: 826632 - RNA, 23 nt, Human
ugggauuacaggugugagccacc

SEQ ID NO: 826633 - RNA, 24 nt, Human
ugggauuacaggugugagccaccg

SEQ ID NO: 826634 - RNA, 24 nt, Human
ugggguuucacuaugcuggccagg

SEQ ID NO: 826635 - RNA, 24 nt, Human
ugggguuucuccauguuggucagg

SEQ ID NO: 826636 - RNA, 23 nt, Human
uggucaggcuggucucgaacucc

SEQ ID NO: 826637 - RNA, 19 nt, Human
uggucucgaacucccgacc

SEQ ID NO: 826638 - RNA, 21 nt, Human
uguauuuuuaguagagauggg

SEQ ID NO: 826639 - RNA, 21 nt, Human
uguggaaauauaauaaugugg

SEQ ID NO: 826640 - RNA, 23 nt, Human
uguuauggaguauccuacugaga

SEQ ID NO: 826641 - RNA, 18 nt, Human
uuaguagagaugggguuu

SEQ ID NO: 826642 - RNA, 21 nt, Human
uuaguagagaugggguuucac

SEQ ID NO: 826643 - RNA, 21 nt, Human
uuaguagagaugggguuucac

SEQ ID NO: 826644 - RNA, 24 nt, Human
uuaguagagaugggguuucacuau

SEQ ID NO: 826645 - RNA, 20 nt, Human
uuccaagaaagcaccaugga

SEQ ID NO: 826646 - RNA, 24 nt, Human
uucguuccuggugcccaggcugga

SEQ ID NO: 826647 - RNA, 20 nt, Human
uucuugaucguuuaagagcc

SEQ ID NO: 826648 - RNA, 23 nt, Human
uuguauuuuuaguagagaugggg

SEQ ID NO: 826649 - RNA, 22 nt, Human
uuguucuuguugcccaggcugg

SEQ ID NO: 826650 - RNA, 23 nt, Human
uuguucuuguugcccaggcugga

SEQ ID NO: 826651 - RNA, 21 nt, Human
uuucacuaugcuggccaggcu

SEQ ID NO: 826652 - RNA, 22 nt, Human
uuucaucaaagauauaaaucuu

SEQ ID NO: 826653 - RNA, 21 nt, Human
uuuccaagaaagcaccaugga

SEQ ID NO: 826654 - RNA, 24 nt, Human
uuucguuccuggugcccaggcugg

SEQ ID NO: 826655 - RNA, 21 nt, Human
uuucuccauguuggucaggcu

SEQ ID NO: 826656 - RNA, 21 nt, Human
uuucuuuccucuuccucuucu

SEQ ID NO: 826657 - RNA, 18 nt, Human
uuuguauuuuuaguagag

SEQ ID NO: 826658 - RNA, 19 nt, Human
uuuguauuuuuaguagaga

SEQ ID NO: 826659 - RNA, 24 nt, Human
uuuguucuuguugcccaggcugga

SEQ ID NO: 826660 - RNA, 24 nt, Human
uuuuguucuuguugcccaggcugg

SEQ ID NO: 826661 - RNA, 24 nt, Human
uuuuuaguagagaugggguuucac

SEQ ID NO: 826662 - RNA, 24 nt, Human
uuuuucuuuuucuucuuuagaugg

SEQ ID NO: 826663 - RNA, 20 nt, Human
aacugguuaaaggcuuggcc

SEQ ID NO: 826664 - RNA, 21 nt, Human
acagcaauacccagggagacc

SEQ ID NO: 826665 - RNA, 18 nt, Human
agacaggugaucaagucu

SEQ ID NO: 826666 - RNA, 24 nt, Human
agucccauuucccggcuuccaggg

SEQ ID NO: 826667 - RNA, 21 nt, Human
cagcaauacccagggagacca

SEQ ID NO: 826668 - RNA, 22 nt, Human
cagcaauacccagggagaccaa

SEQ ID NO: 826669 - RNA, 20 nt, Human
cauaaaucugcagauaccuu

SEQ ID NO: 826670 - RNA, 22 nt, Human
ccgcugagcacaauccaggcau

SEQ ID NO: 826671 - RNA, 22 nt, Human
cguaacugggcguuuggcuacc

SEQ ID NO: 826672 - RNA, 19 nt, Human
guaacugggcguuuggcua

SEQ ID NO: 826673 - RNA, 22 nt, Human
gucccauuucccggcuuccagg

SEQ ID NO: 826674 - RNA, 21 nt, Human
gucucugaaugucaacagucc

SEQ ID NO: 826675 - RNA, 19 nt, Human
uaaccucuuugggcaccuc

SEQ ID NO: 826676 - RNA, 19 nt, Human
uaacugggcguuuggcuac

SEQ ID NO: 826677 - RNA, 23 nt, Human
uacccagggagaccaaguuucug

SEQ ID NO: 826678 - RNA, 18 nt, Human
uauuuugcuccagacagg

SEQ ID NO: 826679 - RNA, 25 nt, Human
ucaacagucccauuucccggcuucc

SEQ ID NO: 826680 - RNA, 18 nt, Human
ucacuauaaccucuuugg

SEQ ID NO: 826681 - RNA, 18 nt, Human
uccauauguucuugguau

SEQ ID NO: 826682 - RNA, 19 nt, Human
uccuccagagagaauucua

SEQ ID NO: 826683 - RNA, 24 nt, Human
ucuauuggaauuugaaaauuuacc

SEQ ID NO: 826684 - RNA, 24 nt, Human
ucucuuagguuuauuaagguuuga

SEQ ID NO: 826685 - RNA, 24 nt, Human
ucugaaugucaacagucccauuuc

SEQ ID NO: 826686 - RNA, 20 nt, Human
ucuuuuagccauaaaucugc

SEQ ID NO: 826687 - RNA, 20 nt, Human
ugaaauauuuuguuuugggu

SEQ ID NO: 826688 - RNA, 21 nt, Human
ugaaugucaacagucccauuu

SEQ ID NO: 826689 - RNA, 23 nt, Human
ugggaacgcguaacugggcguuu

SEQ ID NO: 826690 - RNA, 19 nt, Human
uguccaauaugaauucucu

SEQ ID NO: 826691 - RNA, 20 nt, Human
uguuucuuuccaguauaucu

SEQ ID NO: 826692 - RNA, 26 nt, Human
uucuauagcuaugucucugaauguca

SEQ ID NO: 826693 - RNA, 18 nt, Human
uuggcuaccaucucauuu

SEQ ID NO: 826694 - RNA, 18 nt, Human
uugguauuacuuuuugga

SEQ ID NO: 826695 - RNA, 24 nt, Human
aaagugcugggauuacaggcauga

SEQ ID NO: 826696 - RNA, 25 nt, Human
aagcaauccucccaucucagccucc

SEQ ID NO: 826697 - RNA, 19 nt, Human
aagugcugggauuacaggc

SEQ ID NO: 826698 - RNA, 21 nt, Human
aagugcugggauuacaggcau

SEQ ID NO: 826699 - RNA, 26 nt, Human
aagugcugggauuacaggcaugaacc

SEQ ID NO: 826700 - RNA, 21 nt, Human
aauucuugugccucagccucc

SEQ ID NO: 826701 - RNA, 22 nt, Human
accauggugacugcugauccug

SEQ ID NO: 826702 - RNA, 19 nt, Human
acugcagccucgaccuccu

SEQ ID NO: 826703 - RNA, 20 nt, Human
acuggagugcaguggcguua

SEQ ID NO: 826704 - RNA, 19 nt, Human
agaccauggugacugcuga

SEQ ID NO: 826705 - RNA, 22 nt, Human
agagacgaggucccgcucugcu

SEQ ID NO: 826706 - RNA, 23 nt, Human
agcugggauuacaggugugugcc

SEQ ID NO: 826707 - RNA, 19 nt, Human
aggcaugaaccacuaugcc

SEQ ID NO: 826708 - RNA, 23 nt, Human
aguagcugggauuacaggugugu

SEQ ID NO: 826709 - RNA, 19 nt, Human
agugcaguggcguuaucuc

SEQ ID NO: 826710 - RNA, 21 nt, Human
agugcaguggcguuaucucag

SEQ ID NO: 826711 - RNA, 23 nt, Human
agugcaguggcguuaucucagcu

SEQ ID NO: 826712 - RNA, 18 nt, Human
agugcugggauuacaggc

SEQ ID NO: 826713 - RNA, 24 nt, Human
auagcucacugcagccucgaccuc

SEQ ID NO: 826714 - RNA, 19 nt, Human
augaaccaccacgcugggc

SEQ ID NO: 826715 - RNA, 20 nt, Human
auggguuuucgccauguugg

SEQ ID NO: 826716 - RNA, 24 nt, Human
auggguuuucgccauguuggccag

SEQ ID NO: 826717 - RNA, 21 nt, Human
auuacaggugugugccaccau

SEQ ID NO: 826718 - RNA, 24 nt, Human
auuuuuguauuuuuaguagagaug

SEQ ID NO: 826719 - RNA, 24 nt, Human
caaaacgcugguauuacaggcaug

SEQ ID NO: 826720 - RNA, 21 nt, Human
caaagacacagacgcacagga

SEQ ID NO: 826721 - RNA, 24 nt, Human
caaagugcugggauuacaggcaug

SEQ ID NO: 826722 - RNA, 27 nt, Human
caagcaauccucccaucucagccuccc

SEQ ID NO: 826723 - RNA, 27 nt, Human
caagcaauucuugugccucagccuccg

SEQ ID NO: 826724 - RNA, 23 nt, Human
cacacaaagcuucacaaccguuc

SEQ ID NO: 826725 - RNA, 23 nt, Human
caccagguacacauccaucuagc

SEQ ID NO: 826726 - RNA, 22 nt, Human
cacccgucauccucaucuucug

SEQ ID NO: 826727 - RNA, 18 nt, Human
cacccuccucagccuccc

SEQ ID NO: 826728 - RNA, 24 nt, Human
cacucuguugccuacacuggagug

SEQ ID NO: 826729 - RNA, 21 nt, Human
cacugcaaacuccgccuccca

SEQ ID NO: 826730 - RNA, 19 nt, Human
cacugcagccucgaccucc

SEQ ID NO: 826731 - RNA, 21 nt, Human
cagccucgaccuccugggcuc

SEQ ID NO: 826732 - RNA, 23 nt, Human
cagccucgaccuccugggcucaa

SEQ ID NO: 826733 - RNA, 25 nt, Human
cagccucgaccuccugggcucaagc

SEQ ID NO: 826734 - RNA, 24 nt, Human
caucucagccucccaaaacgcugg

SEQ ID NO: 826735 - RNA, 24 nt, Human
cauguuggccaggcuggucucgaa

SEQ ID NO: 826736 - RNA, 23 nt, Human
ccaaagugcugggauuacaggca

SEQ ID NO: 826737 - RNA, 24 nt, Human
ccaaagugcugggauuacaggcau

SEQ ID NO: 826738 - RNA, 24 nt, Human
ccaccagguacacauccaucuagc

SEQ ID NO: 826739 - RNA, 18 nt, Human
ccacuaugcccaguugug

SEQ ID NO: 826740 - RNA, 20 nt, Human
ccagcgagauacaggcacaa

SEQ ID NO: 826741 - RNA, 19 nt, Human
ccauguuggccaggcuggu

SEQ ID NO: 826742 - RNA, 22 nt, Human
ccauguuggccaggcuggucuc

SEQ ID NO: 826743 - RNA, 23 nt, Human
ccauguuggccaggcuggucucg

SEQ ID NO: 826744 - RNA, 24 nt, Human
cccaaagugcugggauuacaggca

SEQ ID NO: 826745 - RNA, 21 nt, Human
cccacggagccuaguuguguc

SEQ ID NO: 826746 - RNA, 19 nt, Human
cccagguucaagcaauucu

SEQ ID NO: 826747 - RNA, 21 nt, Human
ccgaguagcugggauuacagg

SEQ ID NO: 826748 - RNA, 24 nt, Human
ccgaguagcugggauuacaggugu

SEQ ID NO: 826749 - RNA, 27 nt, Human
ccgccucccagguucaagcaauucuuu

SEQ ID NO: 826750 - RNA, 20 nt, Human
ccuacacuggagugcagugg

SEQ ID NO: 826751 - RNA, 22 nt, Human
ccuacacuggagugcaguggcg

SEQ ID NO: 826752 - RNA, 23 nt, Human
ccucaagugauccacccuccuca

SEQ ID NO: 826753 - RNA, 22 nt, Human
ccucagccucccaaagugcugg

SEQ ID NO: 826754 - RNA, 22 nt, Human
ccucccagguucaagcaauucu

SEQ ID NO: 826755 - RNA, 19 nt, Human
ccucgaccuccugggcuca

SEQ ID NO: 826756 - RNA, 23 nt, Human
ccucugaaauugccacccagagg

SEQ ID NO: 826757 - RNA, 20 nt, Human
ccuggccucaagugauccac

SEQ ID NO: 826758 - RNA, 23 nt, Human
ccuggccucaagugauccacccu

SEQ ID NO: 826759 - RNA, 24 nt, Human
ccuggccucaagugauccacccuc

SEQ ID NO: 826760 - RNA, 20 nt, Human
ccugggcucaagcaauccuc

SEQ ID NO: 826761 - RNA, 18 nt, Human
ccugugaagucccccagc

SEQ ID NO: 826762 - RNA, 25 nt, Human
cgaccuccugggcucaagcaauccu

SEQ ID NO: 826763 - RNA, 24 nt, Human
cgccauguuggccaggcuggucuc

SEQ ID NO: 826764 - RNA, 20 nt, Human
cgcugggccagagagagccc

SEQ ID NO: 826765 - RNA, 24 nt, Human
cucaagcaauccucccaucucagc

SEQ ID NO: 826766 - RNA, 21 nt, Human
cucacccccaaaggucccaaa

SEQ ID NO: 826767 - RNA, 23 nt, Human
cucacugcaaacuccgccuccca

SEQ ID NO: 826768 - RNA, 21 nt, Human
cucacugcagccucgaccucc

SEQ ID NO: 826769 - RNA, 24 nt, Human
cucacugcagccucgaccuccugg

SEQ ID NO: 826770 - RNA, 23 nt, Human
cucagccuccgaguagcugggau

SEQ ID NO: 826771 - RNA, 22 nt, Human
cucccaucucagccucccaaaa

SEQ ID NO: 826772 - RNA, 24 nt, Human
cuccgaguagcugggauuacaggu

SEQ ID NO: 826773 - RNA, 22 nt, Human
cugcagccucgaccuccugggc

SEQ ID NO: 826774 - RNA, 23 nt, Human
cugcagccucgaccuccugggcu

SEQ ID NO: 826775 - RNA, 24 nt, Human
cugcucaggcuggagugugguggu

SEQ ID NO: 826776 - RNA, 26 nt, Human
cuggggccuuuugaggucucugggug

SEQ ID NO: 826777 - RNA, 24 nt, Human
cuuccugugaagucccccagcgag

SEQ ID NO: 826778 - RNA, 24 nt, Human
cuugugccucagccuccgaguagc

SEQ ID NO: 826779 - RNA, 23 nt, Human
gaaaaaaccacaguaggccuggg

SEQ ID NO: 826780 - RNA, 18 nt, Human
gaagucccuccuuccgcu

SEQ ID NO: 826781 - RNA, 23 nt, Human
gaccuccugggcucaagcaaucc

SEQ ID NO: 826782 - RNA, 26 nt, Human
gaguagcugggauuacaggugugugc

SEQ ID NO: 826783 - RNA, 19 nt, Human
gaucauagcucacugcagc

SEQ ID NO: 826784 - RNA, 21 nt, Human
gauccacccuccucagccucc

SEQ ID NO: 826785 - RNA, 21 nt, Human
gauuacaggcaugaaccacua

SEQ ID NO: 826786 - RNA, 24 nt, Human
gauuacaggcaugaaccacuaugc

SEQ ID NO: 826787 - RNA, 18 nt, Human
gauuacaggugugugcca

SEQ ID NO: 826788 - RNA, 24 nt, Human
gauuacaggugugugccaccaugc

SEQ ID NO: 826789 - RNA, 22 nt, Human
gcaaacuccgccucccagguuc

SEQ ID NO: 826790 - RNA, 20 nt, Human
gcacaggaaaccaacgugcc

SEQ ID NO: 826791 - RNA, 24 nt, Human
gccuacacuggagugcaguggcgu

SEQ ID NO: 826792 - RNA, 22 nt, Human
gcgaagucaaaggccugugguu

SEQ ID NO: 826793 - RNA, 22 nt, Human
gcucugcugcucaggcuggagu

SEQ ID NO: 826794 - RNA, 18 nt, Human
ggauguggcgcucaggag

SEQ ID NO: 826795 - RNA, 24 nt, Human
ggauuacaggcaugaaccacuaug

SEQ ID NO: 826796 - RNA, 24 nt, Human
ggauuacaggugugugccaccaug

SEQ ID NO: 826797 - RNA, 19 nt, Human
ggcaaugaagguguccccu

SEQ ID NO: 826798 - RNA, 24 nt, Human
ggccucaagugauccacccuccuc

SEQ ID NO: 826799 - RNA, 22 nt, Human
ggcuggagugugguggugugau

SEQ ID NO: 826800 - RNA, 20 nt, Human
gggccggaugccggugggaa

SEQ ID NO: 826801 - RNA, 24 nt, Human
ggggccuuuugaggucucugggug

SEQ ID NO: 826802 - RNA, 22 nt, Human
ggguuuucgccauguuggccag

SEQ ID NO: 826803 - RNA, 18 nt, Human
guagcugggauuacaggu

SEQ ID NO: 826804 - RNA, 19 nt, Human
gucccuccuuccgcucugg

SEQ ID NO: 826805 - RNA, 24 nt, Human
gugauccacccuccucagccuccc

SEQ ID NO: 826806 - RNA, 24 nt, Human
uaauuuuuguauuuuuaguagaga

SEQ ID NO: 826807 - RNA, 24 nt, Human
uacaggcaugaaccacuaugccca

SEQ ID NO: 826808 - RNA, 22 nt, Human
uagagauggguuuucgccaugu

SEQ ID NO: 826809 - RNA, 24 nt, Human
uagcucacugcagccucgaccucc

SEQ ID NO: 826810 - RNA, 24 nt, Human
uaguagagauggguuuucgccaug

SEQ ID NO: 826811 - RNA, 22 nt, Human
ucacacaguucugaccggcuuc

SEQ ID NO: 826812 - RNA, 18 nt, Human
ucacugcaaacuccgccu

SEQ ID NO: 826813 - RNA, 19 nt, Human
ucacugcaaacuccgccuc

SEQ ID NO: 826814 - RNA, 24 nt, Human
ucacugcaaacuccgccucccagg

SEQ ID NO: 826815 - RNA, 23 nt, Human
ucacugcagccucgaccuccugg

SEQ ID NO: 826816 - RNA, 24 nt, Human
ucacugcagccucgaccuccuggg

SEQ ID NO: 826817 - RNA, 22 nt, Human
ucagaaaaaaccacaguaggcc

SEQ ID NO: 826818 - RNA, 27 nt, Human
ucagcucacugcaaacuccgccuccca

SEQ ID NO: 826819 - RNA, 20 nt, Human
ucaggagugguguccagcug

SEQ ID NO: 826820 - RNA, 21 nt, Human
uccacccuccucagccuccca

SEQ ID NO: 826821 - RNA, 20 nt, Human
uccacgagaggacaaagggg

SEQ ID NO: 826822 - RNA, 24 nt, Human
ucccaaagugcugggauuacaggc

SEQ ID NO: 826823 - RNA, 20 nt, Human
ucccagguucaagcaauucu

SEQ ID NO: 826824 - RNA, 20 nt, Human
ucccagguucaagcaauucu

SEQ ID NO: 826825 - RNA, 23 nt, Human
ucccgcucugcugcucaggcugg

SEQ ID NO: 826826 - RNA, 24 nt, Human
ucccgcucugcugcucaggcugga

SEQ ID NO: 826827 - RNA, 19 nt, Human
ucccucuugggauuagacc

SEQ ID NO: 826828 - RNA, 22 nt, Human
uccgaguagcugggauuacagg

SEQ ID NO: 826829 - RNA, 23 nt, Human
uccgaguagcugggauuacaggu

SEQ ID NO: 826830 - RNA, 24 nt, Human
uccgaguagcugggauuacaggug

SEQ ID NO: 826831 - RNA, 21 nt, Human
uccucagccucccaaagugcu

SEQ ID NO: 826832 - RNA, 25 nt, Human
uccucccaucucagccucccaaaac

SEQ ID NO: 826833 - RNA, 23 nt, Human
uccugagggucuugagucuucgu

SEQ ID NO: 826834 - RNA, 18 nt, Human
uccugggcucaagcaauc

SEQ ID NO: 826835 - RNA, 22 nt, Human
uccugggcucaagcaauccucc

SEQ ID NO: 826836 - RNA, 24 nt, Human
uccugggcucaagcaauccuccca

SEQ ID NO: 826837 - RNA, 22 nt, Human
ucgccauguuggccaggcuggu

SEQ ID NO: 826838 - RNA, 24 nt, Human
ucgccauguuggccaggcuggucu

SEQ ID NO: 826839 - RNA, 23 nt, Human
ucucacucuguugccuacacugg

SEQ ID NO: 826840 - RNA, 24 nt, Human
ucucacucuguugccuacacugga

SEQ ID NO: 826841 - RNA, 18 nt, Human
ucucugggugacgagucc

SEQ ID NO: 826842 - RNA, 24 nt, Human
ucugcugcucaggcuggagugugg

SEQ ID NO: 826843 - RNA, 24 nt, Human
ucuguugccuacacuggagugcag

SEQ ID NO: 826844 - RNA, 22 nt, Human
ugcaguggcguuaucucagcuc

SEQ ID NO: 826845 - RNA, 20 nt, Human
ugcccaaauccugcuuccug

SEQ ID NO: 826846 - RNA, 21 nt, Human
ugcccaguugugugggcugcu

SEQ ID NO: 826847 - RNA, 22 nt, Human
ugccggugggaagucccuccuu

SEQ ID NO: 826848 - RNA, 23 nt, Human
ugccucagccuccgaguagcugg

SEQ ID NO: 826849 - RNA, 20 nt, Human
ugcucaggcuggaguguggu

SEQ ID NO: 826850 - RNA, 24 nt, Human
ugcucaggcuggagugugguggug

SEQ ID NO: 826851 - RNA, 23 nt, Human
ugcugauccugagcaagucacac

SEQ ID NO: 826852 - RNA, 23 nt, Human
ugcugggauuacaggcaugaacc

SEQ ID NO: 826853 - RNA, 23 nt, Human
uggagugcaguggcguuaucuca

SEQ ID NO: 826854 - RNA, 28 nt, Human
uggagugcaguggcguuauggcucuagc

SEQ ID NO: 826855 - RNA, 21 nt, Human
uggcacuggggccggaugccg

SEQ ID NO: 826856 - RNA, 24 nt, Human
uggccaggcuggucucgaauuccu

SEQ ID NO: 826857 - RNA, 21 nt, Human
uggccucaagugauccacccu

SEQ ID NO: 826858 - RNA, 22 nt, Human
uggccucaagugauccacccuc

SEQ ID NO: 826859 - RNA, 24 nt, Human
uggcguuaucucagcucacugcaa

SEQ ID NO: 826860 - RNA, 23 nt, Human
ugggauguggcgcucaggagugg

SEQ ID NO: 826861 - RNA, 21 nt, Human
ugggauuacaggcaugaacca

SEQ ID NO: 826862 - RNA, 22 nt, Human
ugggauuacaggcaugaaccac

SEQ ID NO: 826863 - RNA, 22 nt, Human
ugggauuacaggcaugaaccac

SEQ ID NO: 826864 - RNA, 23 nt, Human
ugggauuacaggcaugaaccacu

SEQ ID NO: 826865 - RNA, 24 nt, Human
ugggauuacaggcaugaaccacua

SEQ ID NO: 826866 - RNA, 26 nt, Human
ugggauuacaggcaugaaccacuaug

SEQ ID NO: 826867 - RNA, 18 nt, Human
ugggauuacaggugugug

SEQ ID NO: 826868 - RNA, 21 nt, Human
ugggauuacaggugugugcca

SEQ ID NO: 826869 - RNA, 22 nt, Human
ugggauuacaggugugugccac

SEQ ID NO: 826870 - RNA, 24 nt, Human
ugggauuacaggugugugccacca

SEQ ID NO: 826871 - RNA, 25 nt, Human
ugggauuacaggugugugccaccau

SEQ ID NO: 826872 - RNA, 20 nt, Human
uggguuuucgccauguuggc

SEQ ID NO: 826873 - RNA, 24 nt, Human
uggguuuucgccauguuggccagg

SEQ ID NO: 826874 - RNA, 24 nt, Human
ugguauuacaggcaugaaccacca

SEQ ID NO: 826875 - RNA, 18 nt, Human
uggugugaucauagcuca

SEQ ID NO: 826876 - RNA, 24 nt, Human
uggugugaucauagcucacugcag

SEQ ID NO: 826877 - RNA, 18 nt, Human
uguccagcugggagcuuc

SEQ ID NO: 826878 - RNA, 22 nt, Human
ugugcgaggagaggcaaugaag

SEQ ID NO: 826879 - RNA, 21 nt, Human
uuagaccauggugacugcuga

SEQ ID NO: 826880 - RNA, 24 nt, Human
uuaguagagauggguuuucgccau

SEQ ID NO: 826881 - RNA, 23 nt, Human
uucaagcaauucuugugccucag

SEQ ID NO: 826882 - RNA, 23 nt, Human
uuccuggccucaagugauccacc

SEQ ID NO: 826883 - RNA, 23 nt, Human
uucuuagagacgaggucccgcuc

SEQ ID NO: 826884 - RNA, 23 nt, Human
uugccauguggcgaagucaaagg

SEQ ID NO: 826885 - RNA, 22 nt, Human
uugguucugggagccucucaga

SEQ ID NO: 826886 - RNA, 24 nt, Human
uuucgccauguuggccaggcuggu

SEQ ID NO: 826887 - RNA, 23 nt, Human
uuuucgccauguuggccaggcug

SEQ ID NO: 826888 - RNA, 24 nt, Human
uuuuuaguagagauggguuuucgc

SEQ ID NO: 826889 - RNA, 20 nt, Human
uuuuuguauuuuuaguagag

SEQ ID NO: 826890 - RNA, 22 nt, Human
aaguagauccuuuauucaaaau

SEQ ID NO: 826891 - RNA, 24 nt, Human
agagaccacccccacauacagguc

SEQ ID NO: 826892 - RNA, 18 nt, Human
agcggacccucggggccc

SEQ ID NO: 826893 - RNA, 22 nt, Human
aggccgaggcagggcgcagcac

SEQ ID NO: 826894 - RNA, 23 nt, Human
aguagauccuuuauucaaaaucu

SEQ ID NO: 826895 - RNA, 23 nt, Human
cacaggcgcaaggccgaggcagg

SEQ ID NO: 826896 - RNA, 22 nt, Human
cacccucgcccggacacggccc

SEQ ID NO: 826897 - RNA, 20 nt, Human
ccacauacagguccauggag

SEQ ID NO: 826898 - RNA, 21 nt, Human
ccagauguuuccuguccgacu

SEQ ID NO: 826899 - RNA, 24 nt, Human
ccagauguuuccuguccgacuuuu

SEQ ID NO: 826900 - RNA, 18 nt, Human
cccaggagaccuaggggg

SEQ ID NO: 826901 - RNA, 21 nt, Human
ccccagagggguucaaagacc

SEQ ID NO: 826902 - RNA, 18 nt, Human
cccccacauacaggucca

SEQ ID NO: 826903 - RNA, 19 nt, Human
cccccacggucaggccaag

SEQ ID NO: 826904 - RNA, 18 nt, Human
cccccggggucgcuucgg

SEQ ID NO: 826905 - RNA, 19 nt, Human
ccgaaaccagagaccaccc

SEQ ID NO: 826906 - RNA, 23 nt, Human
cgagcugccccuacacaggcgca

SEQ ID NO: 826907 - RNA, 21 nt, Human
cucaaccaaggauaggucacc

SEQ ID NO: 826908 - RNA, 18 nt, Human
cucucaaccaaggauagg

SEQ ID NO: 826909 - RNA, 18 nt, Human
gaaaccagagaccacccc

SEQ ID NO: 826910 - RNA, 18 nt, Human
gagcucuggcuggaggca

SEQ ID NO: 826911 - RNA, 19 nt, Human
gccuggaccaucuggaccc

SEQ ID NO: 826912 - RNA, 19 nt, Human
gccuggaccaucuggaccc

SEQ ID NO: 826913 - RNA, 23 nt, Human
ggacacggcccgggcugcccccg

SEQ ID NO: 826914 - RNA, 23 nt, Human
gggccuggaccaucuggaccccc

SEQ ID NO: 826915 - RNA, 18 nt, Human
gggcguuguccucugaca

SEQ ID NO: 826916 - RNA, 24 nt, Human
gguucaaagaccuccgaaaccaga

SEQ ID NO: 826917 - RNA, 18 nt, Human
gucagagagcggagauga

SEQ ID NO: 826918 - RNA, 24 nt, Human
uacacaggcgcaaggccgaggcag

SEQ ID NO: 826919 - RNA, 18 nt, Human
ucccagauaauagcacca

SEQ ID NO: 826920 - RNA, 18 nt, Human
uccccaaggcgaccagag

SEQ ID NO: 826921 - RNA, 21 nt, Human
ucgcuucggggucucccagga

SEQ ID NO: 826922 - RNA, 23 nt, Human
uggacccccacggucaggacccu

SEQ ID NO: 826923 - RNA, 19 nt, Human
uguggggguuuuuugacug

SEQ ID NO: 826924 - RNA, 19 nt, Human
uuugcugaccugugaccuc

SEQ ID NO: 826925 - RNA, 20 nt, Human
aaaaccucagcagcaucucc

SEQ ID NO: 826926 - RNA, 24 nt, Human
aauuacagagucugauaaauagga

SEQ ID NO: 826927 - RNA, 18 nt, Human
gaacauuaccuacaaauu

SEQ ID NO: 826928 - RNA, 20 nt, Human
gauucccgccaccccacccc

SEQ ID NO: 826929 - RNA, 23 nt, Human
gcucacuggauuucauuuuugca

SEQ ID NO: 826930 - RNA, 30 nt, Human
uacauggauuccucuacuuugugagguuuu

SEQ ID NO: 826931 - RNA, 22 nt, Human
uagccaaauuucuuucaaaacc

SEQ ID NO: 826932 - RNA, 21 nt, Human
ucagcagcaucuccuucuggu

SEQ ID NO: 826933 - RNA, 22 nt, Human
ugguuuauuugcaauuuacaug

SEQ ID NO: 826934 - RNA, 23 nt, Human
uucuagugcucacuggauuucau

SEQ ID NO: 826935 - RNA, 21 nt, Human
uuucuugcagggagcaaagau

SEQ ID NO: 826936 - RNA, 22 nt, Human
aaaggcaugggggcagaggggc

SEQ ID NO: 826937 - RNA, 22 nt, Human
aaaggcaugggggcagaggggc

SEQ ID NO: 826938 - RNA, 18 nt, Human
accggugcuggccgcgcg

SEQ ID NO: 826939 - RNA, 25 nt, Human
accuugaggacaacagggagaggaa

SEQ ID NO: 826940 - RNA, 22 nt, Human
agaaaggcaugggggcagaggg

SEQ ID NO: 826941 - RNA, 24 nt, Human
agaaaggcaugggggcagaggggc

SEQ ID NO: 826942 - RNA, 18 nt, Human
agaggaaaugggguuggg

SEQ ID NO: 826943 - RNA, 21 nt, Human
agagggaggagacgggugagu

SEQ ID NO: 826944 - RNA, 20 nt, Human
aggaaaugggguugggacug

SEQ ID NO: 826945 - RNA, 22 nt, Human
agggaaggagagggaggagacg

SEQ ID NO: 826946 - RNA, 18 nt, Human
auugcagaagaagcagag

SEQ ID NO: 826947 - RNA, 23 nt, Human
caaucccaaucagaagaugaaga

SEQ ID NO: 826948 - RNA, 19 nt, Human
caccuugaggacaacaggg

SEQ ID NO: 826949 - RNA, 21 nt, Human
cacugagagagcuccugacug

SEQ ID NO: 826950 - RNA, 21 nt, Human
caucacaccuugaggacaaca

SEQ ID NO: 826951 - RNA, 20 nt, Human
ccagggaaggagagggagga

SEQ ID NO: 826952 - RNA, 23 nt, Human
cccagggaaggagagggaggaag

SEQ ID NO: 826953 - RNA, 19 nt, Human
cccuugguagugaaggccc

SEQ ID NO: 826954 - RNA, 24 nt, Human
cgggaccaagaaggaggccacuga

SEQ ID NO: 826955 - RNA, 19 nt, Human
cucgcaaguaccggugcug

SEQ ID NO: 826956 - RNA, 25 nt, Human
gaaaggcaugggggcagaggggcuu

SEQ ID NO: 826957 - RNA, 19 nt, Human
gaagaagcagaggacugga

SEQ ID NO: 826958 - RNA, 28 nt, Human
gaccaagaaggaggccacugagagagcu

SEQ ID NO: 826959 - RNA, 20 nt, Human
gagcuccugacuggacuccu

SEQ ID NO: 826960 - RNA, 19 nt, Human
gaggcagaaggggcgcaaa

SEQ ID NO: 826961 - RNA, 19 nt, Human
gcccaagaaaggcaugggg

SEQ ID NO: 826962 - RNA, 21 nt, Human
ggcagaggggcuuguagcugg

SEQ ID NO: 826963 - RNA, 21 nt, Human
gggagaggaaaugggguuggg

SEQ ID NO: 826964 - RNA, 23 nt, Human
uccuggguaaguguugucuuugc

SEQ ID NO: 826965 - RNA, 19 nt, Human
ugaaggcccaagaaaggca

SEQ ID NO: 826966 - RNA, 21 nt, Human
ugcagaagaagcagaggacug

SEQ ID NO: 826967 - RNA, 23 nt, Human
uguagugacagacaaagcauuuc

SEQ ID NO: 826968 - RNA, 20 nt, Human
uuuaaucauuuauugcagaa

SEQ ID NO: 826969 - RNA, 23 nt, Human
uuugcauuucaggcaaugaccca

SEQ ID NO: 826970 - RNA, 18 nt, Human
aaggaaaagugaacagug

SEQ ID NO: 826971 - RNA, 21 nt, Human
aaguacagugugggauccaga

SEQ ID NO: 826972 - RNA, 21 nt, Human
agaaguggguggccaaggcca

SEQ ID NO: 826973 - RNA, 19 nt, Human
agaauaaaggaaaagugaa

SEQ ID NO: 826974 - RNA, 20 nt, Human
agacccagggagcccagcag

SEQ ID NO: 826975 - RNA, 21 nt, Human
agcugggggaccacagccaag

SEQ ID NO: 826976 - RNA, 21 nt, Human
aggaaaagugaacagugccug

SEQ ID NO: 826977 - RNA, 18 nt, Human
aggaccagcaggguggag

SEQ ID NO: 826978 - RNA, 20 nt, Human
aggcaggaacuaugcuaggu

SEQ ID NO: 826979 - RNA, 22 nt, Human
aguacagugugggauccagagc

SEQ ID NO: 826980 - RNA, 18 nt, Human
agugugugcggggccuug

SEQ ID NO: 826981 - RNA, 18 nt, Human
cagaugcaggagggagga

SEQ ID NO: 826982 - RNA, 20 nt, Human
cagcaggguggagauggagc

SEQ ID NO: 826983 - RNA, 20 nt, Human
cagugugugcggggccuugg

SEQ ID NO: 826984 - RNA, 20 nt, Human
cccugaauugcacuuggucc

SEQ ID NO: 826985 - RNA, 20 nt, Human
ccuugggcagagacccaggg

SEQ ID NO: 826986 - RNA, 19 nt, Human
cucagaugcaggagggagg

SEQ ID NO: 826987 - RNA, 19 nt, Human
cucugcuucugggugcagg

SEQ ID NO: 826988 - RNA, 24 nt, Human
cuuggucauccaggccuucccagg

SEQ ID NO: 826989 - RNA, 22 nt, Human
gauccagagccgggucauggaa

SEQ ID NO: 826990 - RNA, 18 nt, Human
gcagccaggaccugggcu

SEQ ID NO: 826991 - RNA, 24 nt, Human
gcaggugaguggagaaaaaggccc

SEQ ID NO: 826992 - RNA, 23 nt, Human
ggaauuucaccaagcuuggucau

SEQ ID NO: 826993 - RNA, 21 nt, Human
ggccacucuugguuguuuguc

SEQ ID NO: 826994 - RNA, 20 nt, Human
gggaaguacagugugggauc

SEQ ID NO: 826995 - RNA, 22 nt, Human
gggagcaggaccagcagggugg

SEQ ID NO: 826996 - RNA, 24 nt, Human
gggagcaggaccagcaggguggag

SEQ ID NO: 826997 - RNA, 20 nt, Human
gggcagaggaggaaagcugg

SEQ ID NO: 826998 - RNA, 18 nt, Human
gguggccaaggccagugc

SEQ ID NO: 826999 - RNA, 18 nt, Human
uacagugugggauccaga

SEQ ID NO: 827000 - RNA, 22 nt, Human
ugagagugggcugugggaagua

SEQ ID NO: 827001 - RNA, 22 nt, Human
ugaggcggggcccggggcaguc

SEQ ID NO: 827002 - RNA, 19 nt, Human
ugcuaggucccagugugug

SEQ ID NO: 827003 - RNA, 19 nt, Human
uggcagccaggaccugggg

SEQ ID NO: 827004 - RNA, 24 nt, Human
uggcauaggcaggaacuaugcuag

SEQ ID NO: 827005 - RNA, 20 nt, Human
ugggagaaguggguggccaa

SEQ ID NO: 827006 - RNA, 21 nt, Human
ugggagaaguggguggccaag

SEQ ID NO: 827007 - RNA, 18 nt, Human
ugggagcaggaccagcag

SEQ ID NO: 827008 - RNA, 19 nt, Human
ugggggaccacagccaagg

SEQ ID NO: 827009 - RNA, 19 nt, Human
ugguuguuuguccuucagu

SEQ ID NO: 827010 - RNA, 21 nt, Human
uguacagggaggaauuucacc

SEQ ID NO: 827011 - RNA, 20 nt, Human
uguaugggagcaggaccagc

SEQ ID NO: 827012 - RNA, 21 nt, Human
uguaugggagcaggaccagca

SEQ ID NO: 827013 - RNA, 19 nt, Human
uguggggguggggacuggg

SEQ ID NO: 827014 - RNA, 20 nt, Human
uuagcgacugcgcuagaggc

SEQ ID NO: 827015 - RNA, 18 nt, Human
uuuuuuuuuuuuuuuuug

SEQ ID NO: 827016 - RNA, 20 nt, Human
uaguuuuaaggugccaucuu

SEQ ID NO: 827017 - RNA, 18 nt, Human
uaucuaacucuuuucaca

SEQ ID NO: 827018 - RNA, 21 nt, Human
ugaugagagguugcaagccca

SEQ ID NO: 827019 - RNA, 24 nt, Human
ugaugagagguugcaagcccaguu

SEQ ID NO: 827020 - RNA, 21 nt, Human
uuggguugcuuggaggaguuu

SEQ ID NO: 827021 - RNA, 25 nt, Human
uuuucacauuguaggacuuuggcug

SEQ ID NO: 827022 - RNA, 24 nt, Human
aagaaagacaaagaaagguugaag

SEQ ID NO: 827023 - RNA, 21 nt, Human
aagaaauaauucguucaugaa

SEQ ID NO: 827024 - RNA, 23 nt, Human
aaucagauaauucugaggccaaa

SEQ ID NO: 827025 - RNA, 20 nt, Human
acccccauaagaaagacaaa

SEQ ID NO: 827026 - RNA, 21 nt, Human
cagauaauucugaggccaaaa

SEQ ID NO: 827027 - RNA, 23 nt, Human
cccccauaagaaagacaaagaaa

SEQ ID NO: 827028 - RNA, 19 nt, Human
ccucagagagaagaguaag

SEQ ID NO: 827029 - RNA, 19 nt, Human
cuuucuggaauugaaaggg

SEQ ID NO: 827030 - RNA, 19 nt, Human
gccaaaauauuugguaacc

SEQ ID NO: 827031 - RNA, 24 nt, Human
uaagaaagacaaagaaagguugaa

SEQ ID NO: 827032 - RNA, 20 nt, Human
uacaggaagugaguguccug

SEQ ID NO: 827033 - RNA, 19 nt, Human
uauauuauuccucuuucau

SEQ ID NO: 827034 - RNA, 19 nt, Human
uccucuuucauagggggug

SEQ ID NO: 827035 - RNA, 18 nt, Human
ugaauggaacugaaagug

SEQ ID NO: 827036 - RNA, 19 nt, Human
ugagaaggacagauggcuc

SEQ ID NO: 827037 - RNA, 21 nt, Human
ugagaaggacagauggcucuu

SEQ ID NO: 827038 - RNA, 21 nt, Human
uuccauggucucgucggcgcu

SEQ ID NO: 827039 - RNA, 18 nt, Human
uugaagaauuuguucguu

SEQ ID NO: 827040 - RNA, 18 nt, Human
uuuuuuuuuuuuuuuuug

SEQ ID NO: 827041 - RNA, 20 nt, Human
uuuuuuuuuuuuuuuuuguu

SEQ ID NO: 827042 - RNA, 18 nt, Human
aagguauucauuguagaa

SEQ ID NO: 827043 - RNA, 20 nt, Human
agauagaauugugagcucau

SEQ ID NO: 827044 - RNA, 22 nt, Human
aggcaagaucauuaugauccaa

SEQ ID NO: 827045 - RNA, 23 nt, Human
aggcaauugaaaauaagcaaacu

SEQ ID NO: 827046 - RNA, 19 nt, Human
auucauuguagaauggaau

SEQ ID NO: 827047 - RNA, 19 nt, Human
cauuagacuuguggauagu

SEQ ID NO: 827048 - RNA, 22 nt, Human
ccaaaaaccaagggauggauca

SEQ ID NO: 827049 - RNA, 21 nt, Human
cucucuggugacuugaggaau

SEQ ID NO: 827050 - RNA, 19 nt, Human
cuugaggaaugucacuugg

SEQ ID NO: 827051 - RNA, 18 nt, Human
ggaucagauguuaaaaug

SEQ ID NO: 827052 - RNA, 21 nt, Human
guaucacagauauaacugaaa

SEQ ID NO: 827053 - RNA, 22 nt, Human
uagaauggaaucagauagaauu

SEQ ID NO: 827054 - RNA, 20 nt, Human
uagaauggaaucagauagug

SEQ ID NO: 827055 - RNA, 24 nt, Human
ucauuaugauccaaaaaccaaggg

SEQ ID NO: 827056 - RNA, 22 nt, Human
uccaucacaagcaaugcaaagu

SEQ ID NO: 827057 - RNA, 22 nt, Human
uuaagaguuagguugcuuggag

SEQ ID NO: 827058 - RNA, 23 nt, Human
uuaauccugcagaaauaucagaa

SEQ ID NO: 827059 - RNA, 19 nt, Human
uucucauggauaaauucca

SEQ ID NO: 827060 - RNA, 24 nt, Human
uuuguagcauuucuguguccccag

SEQ ID NO: 827061 - RNA, 21 nt, Human
uuuuuuuuuuuuucuuugccu

SEQ ID NO: 827062 - RNA, 27 nt, Human
uuuuuuuuuuuuuuuuuuucuuugggg

SEQ ID NO: 827063 - RNA, 26 nt, Human
aaguauuggggauucacccuugagcu

SEQ ID NO: 827064 - RNA, 21 nt, Human
agaagaggaugucuuauagua

SEQ ID NO: 827065 - RNA, 22 nt, Human
agaagguguuggagaacaagcc

SEQ ID NO: 827066 - RNA, 21 nt, Human
agacauugaacuucaugugaa

SEQ ID NO: 827067 - RNA, 20 nt, Human
caaaucacagaaagacaaga

SEQ ID NO: 827068 - RNA, 28 nt, Human
caaaucacagaaagacaagacacugucu

SEQ ID NO: 827069 - RNA, 23 nt, Human
cacccuugagcuugggaucacuu

SEQ ID NO: 827070 - RNA, 20 nt, Human
caugugaauaaguaaaguau

SEQ ID NO: 827071 - RNA, 26 nt, Human
ccagggcggaggaucagucccaaaga

SEQ ID NO: 827072 - RNA, 19 nt, Human
ccuugagcuugggaucacu

SEQ ID NO: 827073 - RNA, 22 nt, Human
cuccucuacaaaucacagaaag

SEQ ID NO: 827074 - RNA, 18 nt, Human
cuggacacgaggggcugu

SEQ ID NO: 827075 - RNA, 23 nt, Human
cuuggggguauggaagguucugg

SEQ ID NO: 827076 - RNA, 24 nt, Human
ggagaacaagcccuccucuacaaa

SEQ ID NO: 827077 - RNA, 21 nt, Human
ggagcagauggaggcuuucgg

SEQ ID NO: 827078 - RNA, 21 nt, Human
ggaggaucagucccaaagaca

SEQ ID NO: 827079 - RNA, 19 nt, Human
guaaaguauuggggauuca

SEQ ID NO: 827080 - RNA, 19 nt, Human
gucuuggggguauggaagg

SEQ ID NO: 827081 - RNA, 21 nt, Human
uacaaaucacagaaagacaag

SEQ ID NO: 827082 - RNA, 22 nt, Human
ucagucccaaagacaccuugaa

SEQ ID NO: 827083 - RNA, 19 nt, Human
ucccaaagacaccuugaag

SEQ ID NO: 827084 - RNA, 22 nt, Human
uccucuacaaaucacagaaaga

SEQ ID NO: 827085 - RNA, 22 nt, Human
uggaagguucuggacacgaggg

SEQ ID NO: 827086 - RNA, 18 nt, Human
ugucuuggggguauggaa

SEQ ID NO: 827087 - RNA, 24 nt, Human
uugagcuugggaucacuuaguugu

SEQ ID NO: 827088 - RNA, 21 nt, Human
aggcuucaguguauugcucug

SEQ ID NO: 827089 - RNA, 26 nt, Human
auaaugacuaaggcugauguagacac

SEQ ID NO: 827090 - RNA, 20 nt, Human
caccugaaaaugugggugag

SEQ ID NO: 827091 - RNA, 20 nt, Human
ccaggaauucuuaaaggucg

SEQ ID NO: 827092 - RNA, 28 nt, Human
gcaaaguccaccccaggaauucuuaaag

SEQ ID NO: 827093 - RNA, 25 nt, Human
uaaaaacaccagauagauuggagac

SEQ ID NO: 827094 - RNA, 23 nt, Human
uacaccaggcuguauccagaugg

SEQ ID NO: 827095 - RNA, 24 nt, Human
uccauaaugacuaaggccgggguc

SEQ ID NO: 827096 - RNA, 18 nt, Human
ugaaaaugugggugaggg

SEQ ID NO: 827097 - RNA, 19 nt, Human
ugacaacagugagcaacac

SEQ ID NO: 827098 - RNA, 28 nt, Human
ugacaacagugagcaacacauugcaaaa

SEQ ID NO: 827099 - RNA, 21 nt, Human
ugcucugugggggcauugggg

SEQ ID NO: 827100 - RNA, 19 nt, Human
uguagaauguguuugcaaa

SEQ ID NO: 827101 - RNA, 23 nt, Human
uuaaaggucgauuuacuauccau

SEQ ID NO: 827102 - RNA, 23 nt, Human
uuauugacaacagugagcaacac

SEQ ID NO: 827103 - RNA, 22 nt, Human
uucaguguauugcucugugggg

SEQ ID NO: 827104 - RNA, 19 nt, Human
uuuuuuuuuuuuuugccag

SEQ ID NO: 827105 - RNA, 22 nt, Human
uuuuuuuuuuuuuuuugccagg

SEQ ID NO: 827106 - RNA, 18 nt, Human
uuuuuuuuuuuuuuuuug

SEQ ID NO: 827107 - RNA, 22 nt, Human
uuuuuuuuuuuuuuuuugccag

SEQ ID NO: 827108 - RNA, 21 nt, Human
agacagaagggaggucuccaa

SEQ ID NO: 827109 - RNA, 22 nt, Human
agacagaagggaggucuccaau

SEQ ID NO: 827110 - RNA, 24 nt, Human
agguggguuuuuguugaguugaga

SEQ ID NO: 827111 - RNA, 20 nt, Human
cagccaccucacggaaccug

SEQ ID NO: 827112 - RNA, 18 nt, Human
gacauugggcagccaccu

SEQ ID NO: 827113 - RNA, 24 nt, Human
gggauggccuuagccuugauguag

SEQ ID NO: 827114 - RNA, 18 nt, Human
uccaaugguacccaaaug

SEQ ID NO: 827115 - RNA, 18 nt, Human
ugcuaagccagaauaaag

SEQ ID NO: 827116 - RNA, 21 nt, Human
ugggagguggguuuuuguuga

SEQ ID NO: 827117 - RNA, 24 nt, Human
ugggagguggguuuuuguugaguu

SEQ ID NO: 827118 - RNA, 20 nt, Human
uuuuuuuuuuuuuuuuugcu

SEQ ID NO: 827119 - RNA, 27 nt, Human
uuuuuuuuuuuuuuuuuuuuuuugggg

SEQ ID NO: 827120 - RNA, 22 nt, Human
aaauacccaguacaagaaacaa

SEQ ID NO: 827121 - RNA, 22 nt, Human
aggaagcaauaugaucaagaac

SEQ ID NO: 827122 - RNA, 19 nt, Human
aggcaagugaauacugaag

SEQ ID NO: 827123 - RNA, 22 nt, Human
auacccaguacaagaaacaaga

SEQ ID NO: 827124 - RNA, 27 nt, Human
auacuuuucuuuuuuucccccauuaaa

SEQ ID NO: 827125 - RNA, 23 nt, Human
auuggaaaacccaccaagaaauu

SEQ ID NO: 827126 - RNA, 24 nt, Human
caccaagaaauuuucuucuaugaa

SEQ ID NO: 827127 - RNA, 18 nt, Human
cuggcaaacuacugaggc

SEQ ID NO: 827128 - RNA, 21 nt, Human
gaaacaagagccaggaagcaa

SEQ ID NO: 827129 - RNA, 24 nt, Human
gcuaauaaaacucauucaccugcc

SEQ ID NO: 827130 - RNA, 18 nt, Human
ggaaaacccaccaagaaa

SEQ ID NO: 827131 - RNA, 22 nt, Human
ggaagcaauaugaucaagaaca

SEQ ID NO: 827132 - RNA, 19 nt, Human
uaugaaaauacccaguaca

SEQ ID NO: 827133 - RNA, 18 nt, Human
ucaccugcccacaggaac

SEQ ID NO: 827134 - RNA, 23 nt, Human
ucccccauuaaaaccaaagguug

SEQ ID NO: 827135 - RNA, 23 nt, Human
ugcccacaggaaccaaaugguuu

SEQ ID NO: 827136 - RNA, 21 nt, Human
uuuucuuuuuuucccccauuc

SEQ ID NO: 827137 - RNA, 22 nt, Human
uuuuuuuuuuuuuuuuugccag

SEQ ID NO: 827138 - RNA, 27 nt, Human
uuuuuuuuuuuuuuuuuuuuuuugggg

SEQ ID NO: 827139 - RNA, 24 nt, Human
aacagcuucaggaagcuauaggca

SEQ ID NO: 827140 - RNA, 23 nt, Human
aagauaccacccaagacugaaaa

SEQ ID NO: 827141 - RNA, 24 nt, Human
aagcuauaggcauccacugauuca

SEQ ID NO: 827142 - RNA, 19 nt, Human
acagaauucccaaaccacc

SEQ ID NO: 827143 - RNA, 20 nt, Human
agaaagagacacuuuaauau

SEQ ID NO: 827144 - RNA, 20 nt, Human
agaaagauaccacccaagac

SEQ ID NO: 827145 - RNA, 24 nt, Human
auaccacccaagacugaaaacaga

SEQ ID NO: 827146 - RNA, 22 nt, Human
cagaaagauaccacccaagacu

SEQ ID NO: 827147 - RNA, 19 nt, Human
cagaauucccaaaccaccc

SEQ ID NO: 827148 - RNA, 21 nt, Human
cagaauucccaaaccacccac

SEQ ID NO: 827149 - RNA, 21 nt, Human
ccaaaccacccacagaaagag

SEQ ID NO: 827150 - RNA, 19 nt, Human
ccaauuucuaaagcagagu

SEQ ID NO: 827151 - RNA, 20 nt, Human
ccacccaagacugaaaacag

SEQ ID NO: 827152 - RNA, 24 nt, Human
cccaaaccacccacagaaagagac

SEQ ID NO: 827153 - RNA, 19 nt, Human
cuaaagcuucuauguugac

SEQ ID NO: 827154 - RNA, 22 nt, Human
ucaggcacugagcaaaguagcc

SEQ ID NO: 827155 - RNA, 22 nt, Human
ucuaaagcagaguacauuaguu

SEQ ID NO: 827156 - RNA, 22 nt, Human
ucuuuuuuuuugcaggggguga

SEQ ID NO: 827157 - RNA, 21 nt, Human
ugaaaacagaauucccaaacc

SEQ ID NO: 827158 - RNA, 25 nt, Human
ugaaaacagaauucccaaaccaccc

SEQ ID NO: 827159 - RNA, 21 nt, Human
ugagauaggugaaugcuaaag

SEQ ID NO: 827160 - RNA, 25 nt, Human
ugagauaggugaaugcuaaagcuuc

SEQ ID NO: 827161 - RNA, 21 nt, Human
ugauugugguaguaccauccu

SEQ ID NO: 827162 - RNA, 23 nt, Human
uugaaaguuucuuggucucuuuu

SEQ ID NO: 827163 - RNA, 20 nt, Human
uugcagggggugauuguggu

SEQ ID NO: 827164 - RNA, 18 nt, Human
uuuuuuuuuuuuuuuuug

SEQ ID NO: 827165 - RNA, 19 nt, Human
uuuuuuuuuuuuuuuuugu

SEQ ID NO: 827166 - RNA, 19 nt, Human
aggauaauaaagcugaugg

SEQ ID NO: 827167 - RNA, 21 nt, Human
aggucugaaugcugggaagag

SEQ ID NO: 827168 - RNA, 23 nt, Human
cacauggacaaauugauauaaau

SEQ ID NO: 827169 - RNA, 21 nt, Human
cauaacagucagagacuuaga

SEQ ID NO: 827170 - RNA, 22 nt, Human
cugaaugcugggaagagaucca

SEQ ID NO: 827171 - RNA, 22 nt, Human
gaugcccuuucaccaguuacuu

SEQ ID NO: 827172 - RNA, 22 nt, Human
uagucuaacugcaucaugcauc

SEQ ID NO: 827173 - RNA, 21 nt, Human
ucaaaucaagcauaacaguca

SEQ ID NO: 827174 - RNA, 18 nt, Human
ucugaggucugaaugcug

SEQ ID NO: 827175 - RNA, 18 nt, Human
ugacuggcucaugguuga

SEQ ID NO: 827176 - RNA, 21 nt, Human
uggaauaacaggauaauaaag

SEQ ID NO: 827177 - RNA, 21 nt, Human
uggaugcccuuucaccaguua

SEQ ID NO: 827178 - RNA, 21 nt, Human
ugggaagagauccaugggaaa

SEQ ID NO: 827179 - RNA, 18 nt, Human
ugggauggugacuggcuc

SEQ ID NO: 827180 - RNA, 21 nt, Human
ugggauggugacuggcucaug

SEQ ID NO: 827181 - RNA, 23 nt, Human
uuuuuuuuuuuuuuuuuuacuga

SEQ ID NO: 827182 - RNA, 20 nt, Human
agggaguuuggacaaaaggu

SEQ ID NO: 827183 - RNA, 21 nt, Human
cagaauuucuaaggaugaggu

SEQ ID NO: 827184 - RNA, 26 nt, Human
caugaugaauaaauguccugaaguca

SEQ ID NO: 827185 - RNA, 21 nt, Human
cuguggcccuacaaaugaugg

SEQ ID NO: 827186 - RNA, 23 nt, Human
gaaggaagggaguuuggacaaaa

SEQ ID NO: 827187 - RNA, 19 nt, Human
gaggugggaggauguugga

SEQ ID NO: 827188 - RNA, 19 nt, Human
gauguuggaggacaauuug

SEQ ID NO: 827189 - RNA, 29 nt, Human
ggacaaaagguagaaugcaaagggacccc

SEQ ID NO: 827190 - RNA, 19 nt, Human
ucagaggguggagguucuc

SEQ ID NO: 827191 - RNA, 21 nt, Human
ucagugccaauagaauagagg

SEQ ID NO: 827192 - RNA, 25 nt, Human
ugagagccuucaucuguaggaaagg

SEQ ID NO: 827193 - RNA, 26 nt, Human
uggaggacaauuugucaauuuauuag

SEQ ID NO: 827194 - RNA, 18 nt, Human
ugggaggauguuggagga

SEQ ID NO: 827195 - RNA, 21 nt, Human
ugucaaugaauuccuuuggaa

SEQ ID NO: 827196 - RNA, 27 nt, Human
uguuggaggacaauuugucgucucugg

SEQ ID NO: 827197 - RNA, 20 nt, Human
uuccuuaggcaugaugaaua

SEQ ID NO: 827198 - RNA, 24 nt, Human
uucucgguggguuuccaggagagu

SEQ ID NO: 827199 - RNA, 20 nt, Human
agcaggaggagcuacugcuc

SEQ ID NO: 827200 - RNA, 19 nt, Human
agcaggugguccuguagca

SEQ ID NO: 827201 - RNA, 18 nt, Human
agcugggguggcagcagg

SEQ ID NO: 827202 - RNA, 19 nt, Human
aggaaggcuggcagcagcu

SEQ ID NO: 827203 - RNA, 21 nt, Human
caagaaugcugguugaugaga

SEQ ID NO: 827204 - RNA, 24 nt, Human
cagcagcaagaagcacuagagcag

SEQ ID NO: 827205 - RNA, 19 nt, Human
cagcagcugaagccacagc

SEQ ID NO: 827206 - RNA, 18 nt, Human
cggcagcacauggucugg

SEQ ID NO: 827207 - RNA, 24 nt, Human
cucauagaugagcuacaucaagaa

SEQ ID NO: 827208 - RNA, 24 nt, Human
cugaagccacagcaggaggagcua

SEQ ID NO: 827209 - RNA, 24 nt, Human
cugggguggcagcaggugguccuu

SEQ ID NO: 827210 - RNA, 22 nt, Human
gagcagguugggcggcagcaca

SEQ ID NO: 827211 - RNA, 21 nt, Human
gaggguggagguucugggugg

SEQ ID NO: 827212 - RNA, 21 nt, Human
gaugagaaucuggugagucca

SEQ ID NO: 827213 - RNA, 24 nt, Human
gcagcagcuggaaaugcaauagcu

SEQ ID NO: 827214 - RNA, 21 nt, Human
ggcggcagcacauggucuggc

SEQ ID NO: 827215 - RNA, 22 nt, Human
gggcggcagcacauggucuggc

SEQ ID NO: 827216 - RNA, 18 nt, Human
ggucuggcagcaguuggg

SEQ ID NO: 827217 - RNA, 19 nt, Human
uaacucagcucauagauga

SEQ ID NO: 827218 - RNA, 21 nt, Human
uagcuccauaugagaaauuau

SEQ ID NO: 827219 - RNA, 25 nt, Human
ucauuugguagagagguaaaaugug

SEQ ID NO: 827220 - RNA, 25 nt, Human
ugacagccucagcagcaagaagcac

SEQ ID NO: 827221 - RNA, 19 nt, Human
uggaauagcuccauaugag

SEQ ID NO: 827222 - RNA, 19 nt, Human
uggguggguuuccaggaag

SEQ ID NO: 827223 - RNA, 19 nt, Human
ugguugaugagaaucuggu

SEQ ID NO: 827224 - RNA, 18 nt, Human
uuggaacugaaguuuucc

SEQ ID NO: 827225 - RNA, 23 nt, Human
uuugguagagagguaaaaugugg

SEQ ID NO: 827226 - RNA, 21 nt, Human
uuuuuuuuuuuuuuuuuauuu

SEQ ID NO: 827227 - RNA, 23 nt, Human
aaaaauucuggcaaacuugaaca

SEQ ID NO: 827228 - RNA, 22 nt, Human
aaacagagacaaagagagaaca

SEQ ID NO: 827229 - RNA, 22 nt, Human
aaacuugaacaaacagagacaa

SEQ ID NO: 827230 - RNA, 19 nt, Human
agaggauuggaauaauuuc

SEQ ID NO: 827231 - RNA, 20 nt, Human
agcaggagagcaugggaggg

SEQ ID NO: 827232 - RNA, 18 nt, Human
agggagaaagcaggagag

SEQ ID NO: 827233 - RNA, 20 nt, Human
agggagagaugagccagggc

SEQ ID NO: 827234 - RNA, 22 nt, Human
augggcucauuggaaacaugaa

SEQ ID NO: 827235 - RNA, 22 nt, Human
caaacagagacaaagagagaac

SEQ ID NO: 827236 - RNA, 18 nt, Human
caaauaauauguuugaaa

SEQ ID NO: 827237 - RNA, 23 nt, Human
cacccugcugaaugacaucaauc

SEQ ID NO: 827238 - RNA, 20 nt, Human
cagaauguucucacagaguc

SEQ ID NO: 827239 - RNA, 20 nt, Human
cagcacagaagaauggucua

SEQ ID NO: 827240 - RNA, 20 nt, Human
caugacuggaagagaaagaa

SEQ ID NO: 827241 - RNA, 26 nt, Human
cuaccuuuccaagagaaaagaaugac

SEQ ID NO: 827242 - RNA, 21 nt, Human
gaaaggcugacagacaaauaa

SEQ ID NO: 827243 - RNA, 21 nt, Human
gaacagggagaaagcaggaga

SEQ ID NO: 827244 - RNA, 23 nt, Human
gacaaagagagaacagggagaaa

SEQ ID NO: 827245 - RNA, 20 nt, Human
ggcugacagacaaauaauau

SEQ ID NO: 827246 - RNA, 19 nt, Human
guccacccugcugaaugac

SEQ ID NO: 827247 - RNA, 20 nt, Human
uaccucacugggaaggauau

SEQ ID NO: 827248 - RNA, 18 nt, Human
ucaaucccacuccaugug

SEQ ID NO: 827249 - RNA, 21 nt, Human
ucaaucccacuccaugugucc

SEQ ID NO: 827250 - RNA, 20 nt, Human
ucauuggaaacaugaagucc

SEQ ID NO: 827251 - RNA, 20 nt, Human
uccaagagaaaagaaugacu

SEQ ID NO: 827252 - RNA, 21 nt, Human
ucuggcaaacuugaacaaaca

SEQ ID NO: 827253 - RNA, 24 nt, Human
ugaacaaacagagacaaagagaga

SEQ ID NO: 827254 - RNA, 21 nt, Human
ugacuggaagagaaagaaagc

SEQ ID NO: 827255 - RNA, 19 nt, Human
ugggauggugaugggcuca

SEQ ID NO: 827256 - RNA, 23 nt, Human
ugugaacacaauaaagauaaaga

SEQ ID NO: 827257 - RNA, 25 nt, Human
uuucauauuuggugccaugacugga

SEQ ID NO: 827258 - RNA, 23 nt, Human
uuuuuuuuuuuuuuuucuaaaug

SEQ ID NO: 827259 - RNA, 19 nt, Human
cauaguguuuggugagcau

SEQ ID NO: 827260 - RNA, 21 nt, Human
gaggguggagguucugggugg

SEQ ID NO: 827261 - RNA, 23 nt, Human
uaaaggcaggugaguauagguga

SEQ ID NO: 827262 - RNA, 20 nt, Human
uagaggguagcaacauagug

SEQ ID NO: 827263 - RNA, 18 nt, Human
ugcugguuaauaaaggca

SEQ ID NO: 827264 - RNA, 19 nt, Human
uggguggauuuccaggaag

SEQ ID NO: 827265 - RNA, 18 nt, Human
ugugauaaauuaugguag

SEQ ID NO: 827266 - RNA, 24 nt, Human
uucacagguggaucauaucaagaa

SEQ ID NO: 827267 - RNA, 21 nt, Human
uuuaagauagaggaauagcuc

SEQ ID NO: 827268 - RNA, 21 nt, Human
uuuuuuuuuuuuuuuuuauuu

SEQ ID NO: 827269 - RNA, 20 nt, Human
agcaggaggagcuacugcuc

SEQ ID NO: 827270 - RNA, 19 nt, Human
agcaggugguccuguagca

SEQ ID NO: 827271 - RNA, 18 nt, Human
agcugggguggcagcagg

SEQ ID NO: 827272 - RNA, 19 nt, Human
aggaaggcuggcagcagcu

SEQ ID NO: 827273 - RNA, 20 nt, Human
aggguggagguucugggugg

SEQ ID NO: 827274 - RNA, 21 nt, Human
caagaaugcugguugaugaga

SEQ ID NO: 827275 - RNA, 24 nt, Human
cagcagcaagaagcacuagagcag

SEQ ID NO: 827276 - RNA, 19 nt, Human
cagcagcugaagccacagc

SEQ ID NO: 827277 - RNA, 18 nt, Human
cggcagcacauggucugg

SEQ ID NO: 827278 - RNA, 24 nt, Human
cucauagaugagcuacaucaagaa

SEQ ID NO: 827279 - RNA, 24 nt, Human
cugaagccacagcaggaggagcua

SEQ ID NO: 827280 - RNA, 24 nt, Human
cugggguggcagcaggugguccuu

SEQ ID NO: 827281 - RNA, 25 nt, Human
gagcagguugggcggcagcacaugg

SEQ ID NO: 827282 - RNA, 21 nt, Human
gaugagaaucuggugagucca

SEQ ID NO: 827283 - RNA, 24 nt, Human
gcagcagcuggaaaugcaauagcu

SEQ ID NO: 827284 - RNA, 21 nt, Human
ggcggcagcacauggucuggc

SEQ ID NO: 827285 - RNA, 22 nt, Human
gggcggcagcacauggucuggc

SEQ ID NO: 827286 - RNA, 18 nt, Human
ggucuggcagcaguuggg

SEQ ID NO: 827287 - RNA, 19 nt, Human
uaacucagcucauagauga

SEQ ID NO: 827288 - RNA, 19 nt, Human
uacaacuuauguucauuug

SEQ ID NO: 827289 - RNA, 21 nt, Human
uagcuccauaugagaaauuau

SEQ ID NO: 827290 - RNA, 20 nt, Human
ucagagcaaauuacaacuua

SEQ ID NO: 827291 - RNA, 25 nt, Human
ucauuugguagagagguaaaaugug

SEQ ID NO: 827292 - RNA, 25 nt, Human
ugacagccucagcagcaagaagcac

SEQ ID NO: 827293 - RNA, 19 nt, Human
uggaauagcuccauaugag

SEQ ID NO: 827294 - RNA, 19 nt, Human
ugguugaugagaaucuggu

SEQ ID NO: 827295 - RNA, 18 nt, Human
uuggaacugaaguuuucc

SEQ ID NO: 827296 - RNA, 19 nt, Human
uugggcggcagcacauggu

SEQ ID NO: 827297 - RNA, 23 nt, Human
uuugguagagagguaaaaugugg

SEQ ID NO: 827298 - RNA, 20 nt, Human
aaaaauaacugcauuggggc

SEQ ID NO: 827299 - RNA, 21 nt, Human
agggaaguguucauuuuucca

SEQ ID NO: 827300 - RNA, 20 nt, Human
cuagaagagcugaaugucca

SEQ ID NO: 827301 - RNA, 25 nt, Human
cugucauuuccuagaagagcugaau

SEQ ID NO: 827302 - RNA, 21 nt, Human
gaggguggagguucugggugg

SEQ ID NO: 827303 - RNA, 24 nt, Human
guggcuguuuauuaauacaugaaa

SEQ ID NO: 827304 - RNA, 21 nt, Human
ugaagacauucauaguaugac

SEQ ID NO: 827305 - RNA, 19 nt, Human
uuuuuuuuuuagggaagug

SEQ ID NO: 827306 - RNA, 30 nt, Human; identical to SEQ ID NO: 494705

SEQ ID NO: 827307 - RNA, 20 nt, Human
aacggggaggaucugggugg

SEQ ID NO: 827308 - RNA, 22 nt, Human
acaaagcauaagaaauucaccc

SEQ ID NO: 827309 - RNA, 18 nt, Human
accucacugagaaggaga

SEQ ID NO: 827310 - RNA, 20 nt, Human
accuuaaagugauaaagaaa

SEQ ID NO: 827311 - RNA, 19 nt, Human
agaaaaagaaagcaaggga

SEQ ID NO: 827312 - RNA, 22 nt, Human
agaaaaagaaagcaagggaggg

SEQ ID NO: 827313 - RNA, 18 nt, Human
agaagaaaaagaaagcaa

SEQ ID NO: 827314 - RNA, 21 nt, Human
agaagaaaaagaaagcaaggg

SEQ ID NO: 827315 - RNA, 23 nt, Human
agaagaaaaagaaagcaagggag

SEQ ID NO: 827316 - RNA, 19 nt, Human
agaauacaauuggguggcu

SEQ ID NO: 827317 - RNA, 19 nt, Human
agaauguucucacagaguc

SEQ ID NO: 827318 - RNA, 22 nt, Human
agggucuacaucugugggccag

SEQ ID NO: 827319 - RNA, 21 nt, Human
agguccauccuauugaaugac

SEQ ID NO: 827320 - RNA, 21 nt, Human
agugauaaagaaaauaaggaa

SEQ ID NO: 827321 - RNA, 22 nt, Human
agugauaaagaaaauaaggaaa

SEQ ID NO: 827322 - RNA, 21 nt, Human
cacagagucagugaaauggug

SEQ ID NO: 827323 - RNA, 21 nt, Human
cagagucagugaaaugguggu

SEQ ID NO: 827324 - RNA, 22 nt, Human
cagauaauaucuaccucacuga

SEQ ID NO: 827325 - RNA, 22 nt, Human
cccuaggagaaacacagaauac

SEQ ID NO: 827326 - RNA, 21 nt, Human
uaagaaauucacccuaggaga

SEQ ID NO: 827327 - RNA, 25 nt, Human
ucagugaaaugguggugggcucuuu

SEQ ID NO: 827328 - RNA, 19 nt, Human
ugagaaggagaaucuguac

SEQ ID NO: 827329 - RNA, 22 nt, Human
ugccaccaccagaagaaaaaga

SEQ ID NO: 827330 - RNA, 20 nt, Human
ugugggccaguggugaaggg

SEQ ID NO: 827331 - RNA, 22 nt, Human
uugaaugacaucaaccccacuu

SEQ ID NO: 827332 - RNA, 25 nt, Human
uuuuuuuuuuuuuuuuuucuuaagg

SEQ ID NO: 827333 - RNA, 19 nt, Human
aaaaaaaagauugcaaaga

SEQ ID NO: 827334 - RNA, 23 nt, Human
aaacauguagagaauucauaaaa

SEQ ID NO: 827335 - RNA, 19 nt, Human
aaccuaaauuccuuagaag

SEQ ID NO: 827336 - RNA, 18 nt, Human
aagaaagaaggauacaag

SEQ ID NO: 827337 - RNA, 20 nt, Human
aagaagaaagaaggauacaa

SEQ ID NO: 827338 - RNA, 25 nt, Human
aagauuuuaaacauguagagaauuc

SEQ ID NO: 827339 - RNA, 21 nt, Human
acaaaaaaaagauugcaaaga

SEQ ID NO: 827340 - RNA, 19 nt, Human
agaaagaaggauacaagaa

SEQ ID NO: 827341 - RNA, 27 nt, Human
agaugaagcuggcacaugauccacaag

SEQ ID NO: 827342 - RNA, 22 nt, Human
agcagcaaauuaaauuaguccc

SEQ ID NO: 827343 - RNA, 20 nt, Human
aucaugaaaagaagaaagaa

SEQ ID NO: 827344 - RNA, 24 nt, Human
augaaaagaagaaagaaggauaca

SEQ ID NO: 827345 - RNA, 25 nt, Human
ccucccucaagcagauuuccaagau

SEQ ID NO: 827346 - RNA, 22 nt, Human
gauauugaaaacaaaaaaaaga

SEQ ID NO: 827347 - RNA, 18 nt, Human
guugugugaggauggugg

SEQ ID NO: 827348 - RNA, 20 nt, Human
uaccagggacacaacacaaa

SEQ ID NO: 827349 - RNA, 18 nt, Human
ucccucaagcagauuucc

SEQ ID NO: 827350 - RNA, 18 nt, Human
ugaaaagaagaaagaagg

SEQ ID NO: 827351 - RNA, 20 nt, Human
ugacucaaacuugagaacag

SEQ ID NO: 827352 - RNA, 19 nt, Human
uggcacaugauccacaagg

SEQ ID NO: 827353 - RNA, 24 nt, Human
uuagucccccaaaagaugagucag

SEQ ID NO: 827354 - RNA, 27 nt, Human
uuuuuuuuuuuuuuuuuuuuuuugggg

SEQ ID NO: 827355 - RNA, 24 nt, Human
aaaaugaaaauauaauugcaaaga

SEQ ID NO: 827356 - RNA, 23 nt, Human
aaacauguagagaauucauaaaa

SEQ ID NO: 827357 - RNA, 19 nt, Human
aaccuaaauuccuuagaag

SEQ ID NO: 827358 - RNA, 18 nt, Human
aagaaagaaggauacaag

SEQ ID NO: 827359 - RNA, 22 nt, Human
aagaagaaagaaggauacaaga

SEQ ID NO: 827360 - RNA, 25 nt, Human
aagauuuuaaacauguagagaauuc

SEQ ID NO: 827361 - RNA, 18 nt, Human
aaucucugcuaccagaga

SEQ ID NO: 827362 - RNA, 24 nt, Human
acccaaaguuaucgugaaaagaag

SEQ ID NO: 827363 - RNA, 19 nt, Human
agaaagaaggauacaagaa

SEQ ID NO: 827364 - RNA, 18 nt, Human
agaagcaaagaaugaagc

SEQ ID NO: 827365 - RNA, 27 nt, Human
agacgaagcuggcacaugauccacaag

SEQ ID NO: 827366 - RNA, 19 nt, Human
agggauggagggugggcuu

SEQ ID NO: 827367 - RNA, 20 nt, Human
agguuguugugugaggaugg

SEQ ID NO: 827368 - RNA, 21 nt, Human
cagcagcaaaguaaauuaguc

SEQ ID NO: 827369 - RNA, 23 nt, Human
caugacuccaaauuaagaacaga

SEQ ID NO: 827370 - RNA, 27 nt, Human
cccaaaguuaucgugaaaagaagaaag

SEQ ID NO: 827371 - RNA, 25 nt, Human
ccucccucaagcagauucccaagau

SEQ ID NO: 827372 - RNA, 19 nt, Human
cuaaauuccuuagaagcaa

SEQ ID NO: 827373 - RNA, 19 nt, Human
gaaaauauaauugcaaaga

SEQ ID NO: 827374 - RNA, 22 nt, Human
gauacaagaaccaugagaagga

SEQ ID NO: 827375 - RNA, 18 nt, Human
gggaaugaggaugaagua

SEQ ID NO: 827376 - RNA, 24 nt, Human
gugaaaagaagaaagaaggauaca

SEQ ID NO: 827377 - RNA, 23 nt, Human
uaaaaugaaaauauaauugcaaa

SEQ ID NO: 827378 - RNA, 19 nt, Human
uaaggaaagagggaaugag

SEQ ID NO: 827379 - RNA, 20 nt, Human
uaccagagacauaacccaaa

SEQ ID NO: 827380 - RNA, 26 nt, Human
ucagcagcaaaguaaauuagucccuc

SEQ ID NO: 827381 - RNA, 23 nt, Human
uccaaauuaagaacagacgaagc

SEQ ID NO: 827382 - RNA, 18 nt, Human
ucccucaaaagacaaguc

SEQ ID NO: 827383 - RNA, 18 nt, Human
ucccucaagcagauuccc

SEQ ID NO: 827384 - RNA, 18 nt, Human
ugaaaagaagaaagaagg

SEQ ID NO: 827385 - RNA, 24 nt, Human
uggagggugggcuucuguuaagag

SEQ ID NO: 827386 - RNA, 19 nt, Human
uggcacaugauccacaagg

SEQ ID NO: 827387 - RNA, 21 nt, Human
uguaaggaaagagggaaugag

SEQ ID NO: 827388 - RNA, 18 nt, Human
uuuuuuuuuuuuuuuuug

SEQ ID NO: 827389 - RNA, 19 nt, Human
aaccuaaauuccuuagaag

SEQ ID NO: 827390 - RNA, 18 nt, Human
aagaaagaaggauacaag

SEQ ID NO: 827391 - RNA, 20 nt, Human
aagaagaaagaaggauacaa

SEQ ID NO: 827392 - RNA, 25 nt, Human
aagauuuuaaacagguagagaauuc

SEQ ID NO: 827393 - RNA, 21 nt, Human
acccaaaguuaugaaaagaag

SEQ ID NO: 827394 - RNA, 19 nt, Human
agaaagaaggauacaagaa

SEQ ID NO: 827395 - RNA, 20 nt, Human
agaaaguuguugugugagga

SEQ ID NO: 827396 - RNA, 22 nt, Human
agucccccaaaagauaagucag

SEQ ID NO: 827397 - RNA, 23 nt, Human
augauugcaaagauuauugauca

SEQ ID NO: 827398 - RNA, 26 nt, Human
cagagaaugaagcucuugacuuuuga

SEQ ID NO: 827399 - RNA, 23 nt, Human
cagcagcaaauuaaauuaguccc

SEQ ID NO: 827400 - RNA, 24 nt, Human
cccaaaguuaugaaaagaagaaag

SEQ ID NO: 827401 - RNA, 18 nt, Human
cccucccucaaguagauu

SEQ ID NO: 827402 - RNA, 18 nt, Human
gaaaacaaaaauaugauu

SEQ ID NO: 827403 - RNA, 23 nt, Human
gaagcuggcacaugauccacaaa

SEQ ID NO: 827404 - RNA, 25 nt, Human
gaccaugacucaaaauugagaacac

SEQ ID NO: 827405 - RNA, 20 nt, Human
guguaaggaaaaagagaauc

SEQ ID NO: 827406 - RNA, 22 nt, Human
uaacccaaaguuaugaaaagaa

SEQ ID NO: 827407 - RNA, 20 nt, Human
uagcagaaacauaacccaaa

SEQ ID NO: 827408 - RNA, 22 nt, Human
uagcagaaacauaacccaaagu

SEQ ID NO: 827409 - RNA, 25 nt, Human
uaugaaaagaagaaagaaggauaca

SEQ ID NO: 827410 - RNA, 22 nt, Human
ucagggguagagggugggcuuc

SEQ ID NO: 827411 - RNA, 25 nt, Human
ucagggguagagggugggcuucugu

SEQ ID NO: 827412 - RNA, 18 nt, Human
ugaaaagaagaaagaagg

SEQ ID NO: 827413 - RNA, 18 nt, Human
ugagaccaugacucaaaa

SEQ ID NO: 827414 - RNA, 19 nt, Human
uggcacaugauccacaaag

SEQ ID NO: 827415 - RNA, 19 nt, Human
ugguagcagaaacauaacc

SEQ ID NO: 827416 - RNA, 21 nt, Human
uggugguucucuugggacuug

SEQ ID NO: 827417 - RNA, 24 nt, Human
uuagucccccaaaagauaagucag

SEQ ID NO: 827418 - RNA, 25 nt, Human
uuuuuuuuuuuuugaggaugguuca

SEQ ID NO: 827419 - RNA, 19 nt, Human
uuuuuuuuuuuuuugagga

SEQ ID NO: 827420 - RNA, 18 nt, Human
uuuuuuuuuuuuuuuuug

SEQ ID NO: 827421 - RNA, 21 nt, Human
uuuuuuuuuuuuuuuuugagg

SEQ ID NO: 827422 - RNA, 23 nt, Human
aaacaugcagagaauucauaaaa

SEQ ID NO: 827423 - RNA, 25 nt, Human
aagauuuuaaacaugcagagaauuc

SEQ ID NO: 827424 - RNA, 23 nt, Human
agaaaccuauauuccuuagaagc

SEQ ID NO: 827425 - RNA, 27 nt, Human
agacgaagcuggcacaugauccacaag

SEQ ID NO: 827426 - RNA, 22 nt, Human
agcagcaaauuaaauuaguccc

SEQ ID NO: 827427 - RNA, 22 nt, Human
cacaagauuuuaaacaugcaga

SEQ ID NO: 827428 - RNA, 18 nt, Human
gaucaugauuccaaauug

SEQ ID NO: 827429 - RNA, 22 nt, Human
ggacauaacucaaaguuaucau

SEQ ID NO: 827430 - RNA, 20 nt, Human
uaccaaggacauaacucaaa

SEQ ID NO: 827431 - RNA, 25 nt, Human
ucagggguagaggguggaguucugu

SEQ ID NO: 827432 - RNA, 23 nt, Human
uccaaauugagaacagacgaagc

SEQ ID NO: 827433 - RNA, 23 nt, Human
ugaaagcaugguggcugucagca

SEQ ID NO: 827434 - RNA, 21 nt, Human
ugaggaugguuaagaguuuau

SEQ ID NO: 827435 - RNA, 19 nt, Human
uggcacaugauccacaagg

SEQ ID NO: 827436 - RNA, 21 nt, Human
uggugguucucuugggacuug

SEQ ID NO: 827437 - RNA, 24 nt, Human
uuagucccccaaaagaugagucag

SEQ ID NO: 827438 - RNA, 18 nt, Human
uuuuuuuuuuuuuuuuug

SEQ ID NO: 827439 - RNA, 23 nt, Human
aaaagaaaacauaguugugaaga

SEQ ID NO: 827440 - RNA, 24 nt, Human
aagugaucauuaaaagaaggaagc

SEQ ID NO: 827441 - RNA, 20 nt, Human
acuuaaguuucuuaagugaa

SEQ ID NO: 827442 - RNA, 21 nt, Human
agaaaacauaguugugaagau

SEQ ID NO: 827443 - RNA, 20 nt, Human
agaaggaagcaggauacaag

SEQ ID NO: 827444 - RNA, 20 nt, Human
agaagguuguugugugaaga

SEQ ID NO: 827445 - RNA, 26 nt, Human
agauucuuaaucauuugcagcaacuu

SEQ ID NO: 827446 - RNA, 21 nt, Human
auuugggugagaacaugguug

SEQ ID NO: 827447 - RNA, 23 nt, Human
cagcaacuuaaguuucuuaagug

SEQ ID NO: 827448 - RNA, 21 nt, Human
cagcaguaagguaaauuaguc

SEQ ID NO: 827449 - RNA, 23 nt, Human
caguugagcagaagguuguugug

SEQ ID NO: 827450 - RNA, 19 nt, Human
ccuccaaaagauaagucag

SEQ ID NO: 827451 - RNA, 23 nt, Human
gaaaagaaaacauaguugugaag

SEQ ID NO: 827452 - RNA, 24 nt, Human
gaaaagaaaacauaguugugaaga

SEQ ID NO: 827453 - RNA, 19 nt, Human
gaacagaugaagcuggcac

SEQ ID NO: 827454 - RNA, 19 nt, Human
guuguucucuugggacuug

SEQ ID NO: 827455 - RNA, 21 nt, Human
ucacaagguauaagaaaaaga

SEQ ID NO: 827456 - RNA, 26 nt, Human
ucagcaguaagguaaauuaguccucc

SEQ ID NO: 827457 - RNA, 20 nt, Human
ugacucaaaauugagaacag

SEQ ID NO: 827458 - RNA, 18 nt, Human
ugagaccaugacucaaaa

SEQ ID NO: 827459 - RNA, 23 nt, Human
ugagcagaagguuguugugugaa

SEQ ID NO: 827460 - RNA, 23 nt, Human
aaaguuuauuaggcgauuugggg

SEQ ID NO: 827461 - RNA, 20 nt, Human
aaguagcccuaggcucagag

SEQ ID NO: 827462 - RNA, 22 nt, Human
agaagcagcagagagaacaaaa

SEQ ID NO: 827463 - RNA, 21 nt, Human
agagaacaaaacaccucguau

SEQ ID NO: 827464 - RNA, 18 nt, Human
agaggcagaacuggccca

SEQ ID NO: 827465 - RNA, 20 nt, Human
agggaccuggggugaggagg

SEQ ID NO: 827466 - RNA, 26 nt, Human
agguagaagcagcagagagaacaaaa

SEQ ID NO: 827467 - RNA, 20 nt, Human
cacagcuccaaccucugacc

SEQ ID NO: 827468 - RNA, 21 nt, Human
cagcuccaaccucugaccauc

SEQ ID NO: 827469 - RNA, 23 nt, Human
ccaccgaugguaguucugucuuc

SEQ ID NO: 827470 - RNA, 21 nt, Human
ccacugucacagcuccaaccu

SEQ ID NO: 827471 - RNA, 19 nt, Human
cggggugggguccgguggc

SEQ ID NO: 827472 - RNA, 23 nt, Human
gaugguaguucugucuucaugcu

SEQ ID NO: 827473 - RNA, 18 nt, Human
gcagggaggcaguggagc

SEQ ID NO: 827474 - RNA, 19 nt, Human
ggaccuggggugaggagga

SEQ ID NO: 827475 - RNA, 18 nt, Human
ggagagggaccuggggug

SEQ ID NO: 827476 - RNA, 19 nt, Human
uagaagcagcagagagaac

SEQ ID NO: 827477 - RNA, 23 nt, Human
uagaagcagcagagagaacaaaa

SEQ ID NO: 827478 - RNA, 19 nt, Human
uaggcucagagucagaccc

SEQ ID NO: 827479 - RNA, 20 nt, Human
ucacagcuccaaccucugac

SEQ ID NO: 827480 - RNA, 20 nt, Human
ucagaacucagacugacuac

SEQ ID NO: 827481 - RNA, 22 nt, Human
ugacuacaggagagggaccugg

SEQ ID NO: 827482 - RNA, 22 nt, Human
ugaggaggaucaaguagcccua

SEQ ID NO: 827483 - RNA, 24 nt, Human
ugcaauaaagguagaagcagcaga

SEQ ID NO: 827484 - RNA, 19 nt, Human
ugccacugucacagcucca

SEQ ID NO: 827485 - RNA, 21 nt, Human
ugucagagaggcagaacuggc

SEQ ID NO: 827486 - RNA, 20 nt, Human
uucaugcuauacuucugcug

SEQ ID NO: 827487 - RNA, 23 nt, Human
uuuuuuuuuuuuuuuugucugcu

SEQ ID NO: 827488 - RNA, 18 nt, Human
uuuuuuuuuuuuuuuuug

SEQ ID NO: 827489 - RNA, 19 nt, Human
uuuuuuuuuuuuuuuuugu

SEQ ID NO: 827490 - RNA, 21 nt, Human
aaugugagcucaggagaaaga

SEQ ID NO: 827491 - RNA, 24 nt, Human
aggcaaaggagggguccuaggggc

SEQ ID NO: 827492 - RNA, 25 nt, Human
agggaacacuggaggggaaugugga

SEQ ID NO: 827493 - RNA, 18 nt, Human
aggggauggguggagggg

SEQ ID NO: 827494 - RNA, 19 nt, Human
agggucugcacacagguga

SEQ ID NO: 827495 - RNA, 19 nt, Human
caaaaggagcuaaaggguu

SEQ ID NO: 827496 - RNA, 21 nt, Human
caaaggagggguccuaggggc

SEQ ID NO: 827497 - RNA, 19 nt, Human
cagcccacaccuccuccau

SEQ ID NO: 827498 - RNA, 23 nt, Human
cagcgugcauguuucaggcggug

SEQ ID NO: 827499 - RNA, 19 nt, Human
cagcuggggcagccccaca

SEQ ID NO: 827500 - RNA, 18 nt, Human
caggagagagaggcagag

SEQ ID NO: 827501 - RNA, 27 nt, Human
cauccuugucuucagcccuggugggag

SEQ ID NO: 827502 - RNA, 25 nt, Human
ccacaccuccuccaucuaugagcuc

SEQ ID NO: 827503 - RNA, 26 nt, Human
ccacagagcagaacuguggugugccc

SEQ ID NO: 827504 - RNA, 19 nt, Human
ccagggccuccaagucagc

SEQ ID NO: 827505 - RNA, 18 nt, Human
cccuggagccccaguggg

SEQ ID NO: 827506 - RNA, 21 nt, Human
cccuggaggaaagaaccgggg

SEQ ID NO: 827507 - RNA, 19 nt, Human
cccuggugggagugugaca

SEQ ID NO: 827508 - RNA, 23 nt, Human
ccuccaucuaugagcuccugagc

SEQ ID NO: 827509 - RNA, 21 nt, Human
ccugccaaugugagcucagga

SEQ ID NO: 827510 - RNA, 18 nt, Human
ccuguggugggagaggag

SEQ ID NO: 827511 - RNA, 25 nt, Human
cuaaaguaagggcagugugagcccu

SEQ ID NO: 827512 - RNA, 20 nt, Human
cuccuccaucuaugagcucc

SEQ ID NO: 827513 - RNA, 18 nt, Human
cuccugagccagggccuc

SEQ ID NO: 827514 - RNA, 20 nt, Human
cuccugagccagggccucca

SEQ ID NO: 827515 - RNA, 21 nt, Human
cuccuggaugucucggaucau

SEQ ID NO: 827516 - RNA, 23 nt, Human
cugccgucuguccccaccaucug

SEQ ID NO: 827517 - RNA, 19 nt, Human
cuggagccccagugggaca

SEQ ID NO: 827518 - RNA, 21 nt, Human
gaacauccuugucuucagccc

SEQ ID NO: 827519 - RNA, 22 nt, Human
gaauuuagagugggauuugggg

SEQ ID NO: 827520 - RNA, 19 nt, Human
gacaggcuuggcaugaggg

SEQ ID NO: 827521 - RNA, 19 nt, Human
gagaggagcugacuuugug

SEQ ID NO: 827522 - RNA, 24 nt, Human
gaggugggguuuuggaacauccuu

SEQ ID NO: 827523 - RNA, 19 nt, Human
gccagggccuccaagucag

SEQ ID NO: 827524 - RNA, 18 nt, Human
gccauggggcaggggcuc

SEQ ID NO: 827525 - RNA, 20 nt, Human
gcccuggaggaaagaaccgg

SEQ ID NO: 827526 - RNA, 20 nt, Human
gcugagggucugcacacagg

SEQ ID NO: 827527 - RNA, 21 nt, Human
gcuggggcagccccacaucac

SEQ ID NO: 827528 - RNA, 20 nt, Human
ggagcuaaaggguuggggaa

SEQ ID NO: 827529 - RNA, 23 nt, Human
ggaugauccacagagcagaacug

SEQ ID NO: 827530 - RNA, 24 nt, Human
ggcaggggcucugucuccuggaug

SEQ ID NO: 827531 - RNA, 23 nt, Human
ggcuuggcaugaggggcuucugg

SEQ ID NO: 827532 - RNA, 21 nt, Human
gugacucaugaggcaaaggag

SEQ ID NO: 827533 - RNA, 25 nt, Human
uaaaggaaauucacuuuucuuaggg

SEQ ID NO: 827534 - RNA, 22 nt, Human
uagcugagggucugcacacagg

SEQ ID NO: 827535 - RNA, 20 nt, Human
ucaggcgguguuaaaggaaa

SEQ ID NO: 827536 - RNA, 24 nt, Human
ucagggcagaggcccuggagcccc

SEQ ID NO: 827537 - RNA, 22 nt, Human
uccaagucagcuggggcagccc

SEQ ID NO: 827538 - RNA, 21 nt, Human
uccuccaucuaugagcuccug

SEQ ID NO: 827539 - RNA, 20 nt, Human
ucuacugcccaaaggccacc

SEQ ID NO: 827540 - RNA, 22 nt, Human
ucuaugagcuccugagccaggg

SEQ ID NO: 827541 - RNA, 21 nt, Human
ucucugccgucuguccccacc

SEQ ID NO: 827542 - RNA, 28 nt, Human
ucugcgguuaagagcaaugccggggucc

SEQ ID NO: 827543 - RNA, 23 nt, Human
ucugugcugagaggacauuggca

SEQ ID NO: 827544 - RNA, 24 nt, Human
ugacugauccugaaaucguggcac

SEQ ID NO: 827545 - RNA, 21 nt, Human
ugagcuccugagccagggccu

SEQ ID NO: 827546 - RNA, 25 nt, Human
ugaggaaacuuccaugggaugaucc

SEQ ID NO: 827547 - RNA, 22 nt, Human
ugcccauuugaccuuuuggggg

SEQ ID NO: 827548 - RNA, 21 nt, Human
uggaacauccuugucuucagc

SEQ ID NO: 827549 - RNA, 21 nt, Human
uggagggggaacugauuccau

SEQ ID NO: 827550 - RNA, 21 nt, Human
uggugggagugugacauccag

SEQ ID NO: 827551 - RNA, 18 nt, Human
uguacagaaggggauggg

SEQ ID NO: 827552 - RNA, 18 nt, Human
ugugcugagaggacauug

SEQ ID NO: 827553 - RNA, 18 nt, Human
uguggugggagaggagcu

SEQ ID NO: 827554 - RNA, 20 nt, Human
uucagggcagaggcccugga

SEQ ID NO: 827555 - RNA, 19 nt, Human
uugcccuuuguucuaggca

SEQ ID NO: 827556 - RNA, 23 nt, Human
uuggaauuuagagugggauuugg

SEQ ID NO: 827557 - RNA, 24 nt, Human
aagaggccagagaggcagggggaa

SEQ ID NO: 827558 - RNA, 24 nt, Human
agacaagaggccagagaggcaggg

SEQ ID NO: 827559 - RNA, 20 nt, Human
agacaggggaaggaaugggu

SEQ ID NO: 827560 - RNA, 19 nt, Human
agaggccagagaggcaggg

SEQ ID NO: 827561 - RNA, 21 nt, Human
aggcagaaggggcuccccugg

SEQ ID NO: 827562 - RNA, 21 nt, Human
aggggaaaagccagcgaugug

SEQ ID NO: 827563 - RNA, 24 nt, Human
caaguuuauuggaaaaggggagac

SEQ ID NO: 827564 - RNA, 20 nt, Human
cacaaggggaaaagccagcg

SEQ ID NO: 827565 - RNA, 20 nt, Human
cagaacacaaggggaaaagc

SEQ ID NO: 827566 - RNA, 23 nt, Human
ccagggaagcaaggcccuucucc

SEQ ID NO: 827567 - RNA, 22 nt, Human
ccccagccacagaccccuuucc

SEQ ID NO: 827568 - RNA, 20 nt, Human
cucagaacacaaggggaaaa

SEQ ID NO: 827569 - RNA, 18 nt, Human
gggaggggcugaaggcug

SEQ ID NO: 827570 - RNA, 18 nt, Human
ggggaggagccacuggug

SEQ ID NO: 827571 - RNA, 23 nt, Human
gugcuucuuccagggaagcaagg

SEQ ID NO: 827572 - RNA, 23 nt, Human
ucagaacacaaggggaaaagcca

SEQ ID NO: 827573 - RNA, 20 nt, Human
uccccagccacagaccccuu

SEQ ID NO: 827574 - RNA, 23 nt, Human
uccccuggcucucuuuugggcca

SEQ ID NO: 827575 - RNA, 20 nt, Human
ucuggcaggcagaaggggcu

SEQ ID NO: 827576 - RNA, 23 nt, Human
ugagacaggggaaggaauggguc

SEQ ID NO: 827577 - RNA, 18 nt, Human
uggcacgucuggcaggca

SEQ ID NO: 827578 - RNA, 20 nt, Human
uggcaggcagaaggggcucc

SEQ ID NO: 827579 - RNA, 22 nt, Human
uggcaggcagaaggggcucccc

SEQ ID NO: 827580 - RNA, 23 nt, Human
uggcaggcagaaggggcuccccu

SEQ ID NO: 827581 - RNA, 18 nt, Human
ugggaugaaaggugggga

SEQ ID NO: 827582 - RNA, 19 nt, Human
ugggaugaaagguggggag

SEQ ID NO: 827583 - RNA, 21 nt, Human
ugguggggcaguggcacgucu

SEQ ID NO: 827584 - RNA, 18 nt, Human
uguuuucagcugguggug

SEQ ID NO: 827585 - RNA, 19 nt, Human
uuuuuuuuuugcagguccc

SEQ ID NO: 827586 - RNA, 22 nt, Human
uuuuuuuuuuuugcagguccca

SEQ ID NO: 827587 - RNA, 18 nt, Human
uuuuuuuuuuuuuuuuug

SEQ ID NO: 827588 - RNA, 21 nt, Human
uuuuuuuuuuuuuuuuugcag

SEQ ID NO: 827589 - RNA, 22 nt, Human
uuuuuuuuuuuuuuuuugcagg

SEQ ID NO: 827590 - RNA, 23 nt, Human
uuuuuuuuuuuuuuuuugcaggu

SEQ ID NO: 827591 - RNA, 19 nt, Human
aagccaucucgggguuuag

SEQ ID NO: 827592 - RNA, 25 nt, Human
acacaggcagcccaccccacccaac

SEQ ID NO: 827593 - RNA, 23 nt, Human
acccaacccccaggccuccuugg

SEQ ID NO: 827594 - RNA, 23 nt, Human
acccugggggcagaagcaggagc

SEQ ID NO: 827595 - RNA, 28 nt, Human
agaaacagccggagagaagccgguaccc

SEQ ID NO: 827596 - RNA, 22 nt, Human
agaccgucaagcccagagccca

SEQ ID NO: 827597 - RNA, 19 nt, Human
agcccacgaacccuggggg

SEQ ID NO: 827598 - RNA, 19 nt, Human
agccguggagcugguucuu

SEQ ID NO: 827599 - RNA, 23 nt, Human
aggaacacaaagaguagugcaca

SEQ ID NO: 827600 - RNA, 19 nt, Human
aggaagagaaacagccgga

SEQ ID NO: 827601 - RNA, 24 nt, Human
aggaagagaaacagccggagagaa

SEQ ID NO: 827602 - RNA, 20 nt, Human
caacaacccaggaagagaaa

SEQ ID NO: 827603 - RNA, 20 nt, Human
caacccaggaagagaaacag

SEQ ID NO: 827604 - RNA, 24 nt, Human
caacccaggaagagaaacagccgg

SEQ ID NO: 827605 - RNA, 21 nt, Human
cacaacccugcaguggacagg

SEQ ID NO: 827606 - RNA, 23 nt, Human
cacaggcagcccaccccacccaa

SEQ ID NO: 827607 - RNA, 22 nt, Human
caggaagagaaacagccggaga

SEQ ID NO: 827608 - RNA, 22 nt, Human
cagggagaagccagcuuagcug

SEQ ID NO: 827609 - RNA, 21 nt, Human
caugcuggaguuacaccaaca

SEQ ID NO: 827610 - RNA, 18 nt, Human
ccacccaacccccaggcc

SEQ ID NO: 827611 - RNA, 22 nt, Human
ccaccccacccaacccccaggc

SEQ ID NO: 827612 - RNA, 23 nt, Human
ccaggaacacaaagaguagugca

SEQ ID NO: 827613 - RNA, 21 nt, Human
ccaggaagagaaacagccgga

SEQ ID NO: 827614 - RNA, 23 nt, Human
cccaacccccaggccuccuugga

SEQ ID NO: 827615 - RNA, 23 nt, Human
cccacccaacccccaggccuccc

SEQ ID NO: 827616 - RNA, 19 nt, Human
cccaccccacccaaccccc

SEQ ID NO: 827617 - RNA, 24 nt, Human
cccaccccacccaacccccaggcc

SEQ ID NO: 827618 - RNA, 21 nt, Human
cccacgaacccugggggcaga

SEQ ID NO: 827619 - RNA, 19 nt, Human
ccccacccaacccccaggc

SEQ ID NO: 827620 - RNA, 20 nt, Human
cccccaggccuccuuggagc

SEQ ID NO: 827621 - RNA, 22 nt, Human
ccucacaccacgagcaggggca

SEQ ID NO: 827622 - RNA, 27 nt, Human
ccucacaccacgagcaggggcaggagu

SEQ ID NO: 827623 - RNA, 20 nt, Human
cgggguuuagggagaggagu

SEQ ID NO: 827624 - RNA, 20 nt, Human
cgggguuuagggagaggagu

SEQ ID NO: 827625 - RNA, 22 nt, Human
cugguucuucucugggcagcag

SEQ ID NO: 827626 - RNA, 18 nt, Human
cuucucugggcagcagcu

SEQ ID NO: 827627 - RNA, 20 nt, Human
gaagagaaacagccggagag

SEQ ID NO: 827628 - RNA, 19 nt, Human
gacagaaauugggaggcag

SEQ ID NO: 827629 - RNA, 18 nt, Human
gagcaaaagagcaagugu

SEQ ID NO: 827630 - RNA, 20 nt, Human
gagcugguucuucucugggc

SEQ ID NO: 827631 - RNA, 19 nt, Human
gcagaaaggggagcuggag

SEQ ID NO: 827632 - RNA, 22 nt, Human
gcagcccaccccacccaacccc

SEQ ID NO: 827633 - RNA, 20 nt, Human
gcaggaguacggggaucauu

SEQ ID NO: 827634 - RNA, 25 nt, Human
gcagggagaagccagcuuagcugga

SEQ ID NO: 827635 - RNA, 21 nt, Human
gcccgccuguccgccugcacc

SEQ ID NO: 827636 - RNA, 20 nt, Human
gccguggagcugguucuucu

SEQ ID NO: 827637 - RNA, 25 nt, Human
gcuggaguuacaccaacaacccagu

SEQ ID NO: 827638 - RNA, 25 nt, Human
gcuuagcuggaacugcuaauggagc

SEQ ID NO: 827639 - RNA, 21 nt, Human
ggagaagccagcuuagcugga

SEQ ID NO: 827640 - RNA, 18 nt, Human
ggagaccgucaagcccag

SEQ ID NO: 827641 - RNA, 21 nt, Human
ggagccguggagcugguucuu

SEQ ID NO: 827642 - RNA, 20 nt, Human
ggcagaaaggggagcuggag

SEQ ID NO: 827643 - RNA, 20 nt, Human
gggggcagaagcaggagccg

SEQ ID NO: 827644 - RNA, 24 nt, Human
gugcacacaggcagcccaccccac

SEQ ID NO: 827645 - RNA, 23 nt, Human
uacauggcagaaaaauccuccaa

SEQ ID NO: 827646 - RNA, 25 nt, Human
ucaagcccagagcccacgaaccggg

SEQ ID NO: 827647 - RNA, 23 nt, Human
uccaaaggacagaaauugggagg

SEQ ID NO: 827648 - RNA, 18 nt, Human
uccaagaggacauggggc

SEQ ID NO: 827649 - RNA, 22 nt, Human
uccugguugggagcaaaagagc

SEQ ID NO: 827650 - RNA, 19 nt, Human
ucucugggcagcagcuguc

SEQ ID NO: 827651 - RNA, 24 nt, Human
ucucugggcagcagcugucugggg

SEQ ID NO: 827652 - RNA, 20 nt, Human
ucugggcagcagcugucugg

SEQ ID NO: 827653 - RNA, 28 nt, Human
ucugggcagcagcugucuggggcugggc

SEQ ID NO: 827654 - RNA, 22 nt, Human
ugaaaacccaggaacacaaaga

SEQ ID NO: 827655 - RNA, 19 nt, Human
ugcacacaggcagcccacc

SEQ ID NO: 827656 - RNA, 22 nt, Human
uggagcuugcagacacaacccu

SEQ ID NO: 827657 - RNA, 22 nt, Human
uggcaaguuuauugaaaaccca

SEQ ID NO: 827658 - RNA, 24 nt, Human
uggcagaaaaauccuccaagagga

SEQ ID NO: 827659 - RNA, 18 nt, Human
uggcagaaaggggagcug

SEQ ID NO: 827660 - RNA, 19 nt, Human
uggcagaaaggggagcugg

SEQ ID NO: 827661 - RNA, 21 nt, Human
uggcagaaaggggagcuggag

SEQ ID NO: 827662 - RNA, 21 nt, Human
ugggaggcagggagaagccag

SEQ ID NO: 827663 - RNA, 22 nt, Human
ugguugggagcaaaagagcaaa

SEQ ID NO: 827664 - RNA, 24 nt, Human
uugcaugcuggaguuacaccaaca

SEQ ID NO: 827665 - RNA, 21 nt, Human
aaacacagaucgagacaaccc

SEQ ID NO: 827666 - RNA, 19 nt, Human
aaagugcccuaaccagggg

SEQ ID NO: 827667 - RNA, 21 nt, Human
aacccagaaggcaaugcaccc

SEQ ID NO: 827668 - RNA, 22 nt, Human
aacccagaaggcaaugcaccca

SEQ ID NO: 827669 - RNA, 18 nt, Human
aagaaggagacccaggaa

SEQ ID NO: 827670 - RNA, 19 nt, Human
aagcaagcacacauuuucc

SEQ ID NO: 827671 - RNA, 21 nt, Human
aagcaagcacacauuuuccau

SEQ ID NO: 827672 - RNA, 19 nt, Human
aagcaggaaggcagucuga

SEQ ID NO: 827673 - RNA, 20 nt, Human
acacagaucgagacaaccca

SEQ ID NO: 827674 - RNA, 19 nt, Human
agaagguggagcuuccgug

SEQ ID NO: 827675 - RNA, 21 nt, Human
agacagucauaagaaggagac

SEQ ID NO: 827676 - RNA, 22 nt, Human
agccauggagucuucuuugaaa

SEQ ID NO: 827677 - RNA, 21 nt, Human
aggaaggcagucugagagaga

SEQ ID NO: 827678 - RNA, 19 nt, Human
aggcaaaaggaugccccac

SEQ ID NO: 827679 - RNA, 25 nt, Human
aggcaaugcacccauagacagucau

SEQ ID NO: 827680 - RNA, 20 nt, Human
agguggugcgggcggcagag

SEQ ID NO: 827681 - RNA, 22 nt, Human
agguggugcgggcggcagagug

SEQ ID NO: 827682 - RNA, 23 nt, Human
auaauacaaauuggauacaggua

SEQ ID NO: 827683 - RNA, 29 nt, Human
auccagaagauucuggaagcaagcacacu

SEQ ID NO: 827684 - RNA, 19 nt, Human
aucuggagcagccauggag

SEQ ID NO: 827685 - RNA, 21 nt, Human
augaacgggaaugaacaggca

SEQ ID NO: 827686 - RNA, 26 nt, Human
auugaaacacagaucgagacaaccca

SEQ ID NO: 827687 - RNA, 21 nt, Human
caaagugcccuaaccaggggc

SEQ ID NO: 827688 - RNA, 18 nt, Human
caacuaggaugcaucucc

SEQ ID NO: 827689 - RNA, 23 nt, Human
caagggggcaucuggagcagcca

SEQ ID NO: 827690 - RNA, 22 nt, Human
cagcugccaggaggacaacuag

SEQ ID NO: 827691 - RNA, 21 nt, Human
cagucugagagagaagcaaaa

SEQ ID NO: 827692 - RNA, 24 nt, Human
cagugcagugaugcaggcaggcag

SEQ ID NO: 827693 - RNA, 18 nt, Human
cauucuucccagccagga

SEQ ID NO: 827694 - RNA, 23 nt, Human
ccacccagaagguggagcuuccg

SEQ ID NO: 827695 - RNA, 21 nt, Human
ccagaagauucuggaagcaag

SEQ ID NO: 827696 - RNA, 24 nt, Human
ccagaagauucuggaagcaagcac

SEQ ID NO: 827697 - RNA, 23 nt, Human
cccaccugcacccagcaaggggg

SEQ ID NO: 827698 - RNA, 23 nt, Human
cccucuguaggaacauccagaag

SEQ ID NO: 827699 - RNA, 21 nt, Human
ccuaaccaggggcuguaggca

SEQ ID NO: 827700 - RNA, 21 nt, Human
ccucccugguccuuuuauugg

SEQ ID NO: 827701 - RNA, 24 nt, Human
cugccaggaggacaacuaggaugc

SEQ ID NO: 827702 - RNA, 20 nt, Human
cuuggcaggaagcccuggcu

SEQ ID NO: 827703 - RNA, 21 nt, Human
gaacauccagaagauucugga

SEQ ID NO: 827704 - RNA, 20 nt, Human
gaccaccacgcugggggacu

SEQ ID NO: 827705 - RNA, 20 nt, Human
gacuggucuugucccugaga

SEQ ID NO: 827706 - RNA, 19 nt, Human
gagaggcagcggaaggugg

SEQ ID NO: 827707 - RNA, 19 nt, Human
gccaggaggagggggcugc

SEQ ID NO: 827708 - RNA, 19 nt, Human
gccuggcuggaugguuagg

SEQ ID NO: 827709 - RNA, 19 nt, Human
gcucaggauccuucugcuc

SEQ ID NO: 827710 - RNA, 20 nt, Human
gcuuaacucucugucccgcc

SEQ ID NO: 827711 - RNA, 21 nt, Human
ggaacagguuagcccagaagc

SEQ ID NO: 827712 - RNA, 20 nt, Human
ggagacccaggaaguggcuu

SEQ ID NO: 827713 - RNA, 24 nt, Human
ggaggagggggcugcuggggaggg

SEQ ID NO: 827714 - RNA, 25 nt, Human
ggaggagggggcugcuggggaggga

SEQ ID NO: 827715 - RNA, 22 nt, Human
ggcggcagagugcgaggcucag

SEQ ID NO: 827716 - RNA, 19 nt, Human
gggaaugaacaggcaagug

SEQ ID NO: 827717 - RNA, 20 nt, Human
gggcaucuggagcagccaug

SEQ ID NO: 827718 - RNA, 20 nt, Human
gguggagcuuccgugcugac

SEQ ID NO: 827719 - RNA, 19 nt, Human
guaggucuuucccucugua

SEQ ID NO: 827720 - RNA, 22 nt, Human
guuguggguggccuggcuggau

SEQ ID NO: 827721 - RNA, 20 nt, Human
uaagugaagggcugggaaug

SEQ ID NO: 827722 - RNA, 19 nt, Human
uaaugggcuucucaacugc

SEQ ID NO: 827723 - RNA, 22 nt, Human
uagcccagaagcaggaaggcag

SEQ ID NO: 827724 - RNA, 19 nt, Human
uaggauggcgccuccaccc

SEQ ID NO: 827725 - RNA, 21 nt, Human
ucagugcagugaugcaggcag

SEQ ID NO: 827726 - RNA, 21 nt, Human
uccaaagugcccuaaccaggg

SEQ ID NO: 827727 - RNA, 18 nt, Human
ucccugagagcuggggga

SEQ ID NO: 827728 - RNA, 19 nt, Human
ucccugagagcugggggaa

SEQ ID NO: 827729 - RNA, 26 nt, Human
uccgugcugaccaccacgcuggggga

SEQ ID NO: 827730 - RNA, 21 nt, Human
ugaaaacagcugccaggagga

SEQ ID NO: 827731 - RNA, 20 nt, Human
ugaaacacagaucgagacaa

SEQ ID NO: 827732 - RNA, 20 nt, Human
ugagagagaagcaaaacaug

SEQ ID NO: 827733 - RNA, 20 nt, Human
ugagaggcagcggaaggugg

SEQ ID NO: 827734 - RNA, 20 nt, Human
ugaugcaggcaggcaggugc

SEQ ID NO: 827735 - RNA, 23 nt, Human
uggacaguccccaccugcaccca

SEQ ID NO: 827736 - RNA, 19 nt, Human
uggagucuucuuugaaaug

SEQ ID NO: 827737 - RNA, 20 nt, Human
uggcaggaagcccuggcucc

SEQ ID NO: 827738 - RNA, 23 nt, Human
uggcuggaacagguuagcccaga

SEQ ID NO: 827739 - RNA, 19 nt, Human
uggcuggaugguuaggaug

SEQ ID NO: 827740 - RNA, 23 nt, Human
uggcuggaugguuaggauggcgc

SEQ ID NO: 827741 - RNA, 22 nt, Human
uggcuuaacucucugucccgcc

SEQ ID NO: 827742 - RNA, 20 nt, Human
ugucccgccagcucugcauu

SEQ ID NO: 827743 - RNA, 18 nt, Human
uucacugaauagcaagac

SEQ ID NO: 827744 - RNA, 19 nt, Human
uucuggaagcaagcacaca

SEQ ID NO: 827745 - RNA, 20 nt, Human
uucuuugaaauguacaaagg

SEQ ID NO: 827746 - RNA, 22 nt, Human
uugaaacacagaucgagacaac

SEQ ID NO: 827747 - RNA, 21 nt, Human
uugaaauguacaaagguucac

SEQ ID NO: 827748 - RNA, 19 nt, Human
uuuuuuuuuuuuuuuugca

SEQ ID NO: 827749 - RNA, 19 nt, Human
uuuuuuuuuuuuuuuuugc

SEQ ID NO: 827750 - RNA, 21 nt, Human
uuuuuuuuuuuuuuuuuuugg

SEQ ID NO: 827751 - RNA, 21 nt, Human
aacucugcaaacuccagaaag

SEQ ID NO: 827752 - RNA, 22 nt, Human
acucucuucuuccagugugaga

SEQ ID NO: 827753 - RNA, 23 nt, Human
acucugcaaacuccagaaaggaa

SEQ ID NO: 827754 - RNA, 21 nt, Human
auaaacuugcuugcaacucug

SEQ ID NO: 827755 - RNA, 22 nt, Human
caaaacuucuacagauaauaag

SEQ ID NO: 827756 - RNA, 19 nt, Human
cagggagaggucagaucug

SEQ ID NO: 827757 - RNA, 21 nt, Human
cuuccagugugagaacguugg

SEQ ID NO: 827758 - RNA, 22 nt, Human
gaacucugcaaacuccagaaag

SEQ ID NO: 827759 - RNA, 19 nt, Human
guaugcuugucacucuugg

SEQ ID NO: 827760 - RNA, 18 nt, Human
ucagaucaacaaagcaaa

SEQ ID NO: 827761 - RNA, 23 nt, Human
ucagaucaacaaagcaaaacuuc

SEQ ID NO: 827762 - RNA, 20 nt, Human
uccagugugagaacguugga

SEQ ID NO: 827763 - RNA, 19 nt, Human
ugcaucugauuagaaacuc

SEQ ID NO: 827764 - RNA, 22 nt, Human
uguaugcuugucacucuugggc

SEQ ID NO: 827765 - RNA, 18 nt, Human
uuacugaacacuggaaau

SEQ ID NO: 827766 - RNA, 18 nt, Human
uuagaaacucucuucuuc

SEQ ID NO: 827767 - RNA, 24 nt, Human
uucagagaagcugcagaucaagaa

SEQ ID NO: 827768 - RNA, 25 nt, Human
aaacaaagcaaaagaaguagccucg

SEQ ID NO: 827769 - RNA, 18 nt, Human
aaguagccucgagagaga

SEQ ID NO: 827770 - RNA, 18 nt, Human
acaaagcaaaagaaguag

SEQ ID NO: 827771 - RNA, 22 nt, Human
acaaagcaaaagaaguagccuc

SEQ ID NO: 827772 - RNA, 28 nt, Human
acaaagcaaaagaaguagccucgagaga

SEQ ID NO: 827773 - RNA, 26 nt, Human
agcaaaagaaguagccucgagagaga

SEQ ID NO: 827774 - RNA, 19 nt, Human
aggaggaagaaagccccug

SEQ ID NO: 827775 - RNA, 21 nt, Human
caaagcaaaagaaguagccuc

SEQ ID NO: 827776 - RNA, 18 nt, Human
caugcaaggcagccaggc

SEQ ID NO: 827777 - RNA, 20 nt, Human
ccccuggguuagugcccgca

SEQ ID NO: 827778 - RNA, 26 nt, Human
gagcagcagagguggcauccccuggg

SEQ ID NO: 827779 - RNA, 21 nt, Human
gcagcagcuggaagaccuugc

SEQ ID NO: 827780 - RNA, 22 nt, Human
gggggcguccgugguggcuuca

SEQ ID NO: 827781 - RNA, 23 nt, Human
uccccagcugagacucaugggac

SEQ ID NO: 827782 - RNA, 20 nt, Human
ugcggcuggguggggggggc

SEQ ID NO: 827783 - RNA, 20 nt, Human
uggcuucagcuuggugugcc

SEQ ID NO: 827784 - RNA, 22 nt, Human
uggugggcggggugaugaagcc

SEQ ID NO: 827785 - RNA, 21 nt, Human
uguggggaagcugggcagcag

SEQ ID NO: 827786 - RNA, 22 nt, Human
aaucacagucuucucuguuuua

SEQ ID NO: 827787 - RNA, 19 nt, Human
acuaaaauacaaaaaugua

SEQ ID NO: 827788 - RNA, 21 nt, Human
agguaaccucccucccgccaa

SEQ ID NO: 827789 - RNA, 18 nt, Human
cacagguuucauaaucaa

SEQ ID NO: 827790 - RNA, 19 nt, Human
cacauguaauaaaaacaaa

SEQ ID NO: 827791 - RNA, 24 nt, Human
caccuaucaacaucauggaagagc

SEQ ID NO: 827792 - RNA, 21 nt, Human
caggcccucccuccgcaggga

SEQ ID NO: 827793 - RNA, 18 nt, Human
caugaugauggaagcucu

SEQ ID NO: 827794 - RNA, 22 nt, Human
cccuccgcagggaagaagggca

SEQ ID NO: 827795 - RNA, 19 nt, Human
ccgcccaggcccucccucc

SEQ ID NO: 827796 - RNA, 22 nt, Human
cgccaacgcgaccgcccaggcc

SEQ ID NO: 827797 - RNA, 20 nt, Human
cuccgcagggaagaagggca

SEQ ID NO: 827798 - RNA, 21 nt, Human
cugggaaagguaaccucccuc

SEQ ID NO: 827799 - RNA, 18 nt, Human
gagaaccaaauuuuuuuu

SEQ ID NO: 827800 - RNA, 25 nt, Human
gagcgagacugggaaagguaaccuc

SEQ ID NO: 827801 - RNA, 22 nt, Human
gcacacuucacagguuucauaa

SEQ ID NO: 827802 - RNA, 20 nt, Human
gguuagcuauaaagauacaa

SEQ ID NO: 827803 - RNA, 23 nt, Human
uaucuggauuguagggauuguuu

SEQ ID NO: 827804 - RNA, 22 nt, Human
ucuguaauauaaaaaugucauu

SEQ ID NO: 827805 - RNA, 24 nt, Human
ugagaaccaaauuuuuuuuucuuc

SEQ ID NO: 827806 - RNA, 19 nt, Human
ugccuuggaguuuaaagca

SEQ ID NO: 827807 - RNA, 19 nt, Human
ugcuuccuccuggcucagg

SEQ ID NO: 827808 - RNA, 22 nt, Human
uggaagcucuguaauauaaaaa

SEQ ID NO: 827809 - RNA, 21 nt, Human
uggcucaggcggccagagcga

SEQ ID NO: 827810 - RNA, 21 nt, Human
uggucaccuaucaacaucaug

SEQ ID NO: 827811 - RNA, 27 nt, Human
uuuuuugccauaguuacuuuuucugau

SEQ ID NO: 827812 - RNA, 19 nt, Human
ucuaccagccacauguccu

SEQ ID NO: 827813 - RNA, 26 nt, Human
aaaauaaauggcccaugcuguaauga

SEQ ID NO: 827814 - RNA, 19 nt, Human
aagaccaccagguaggaag

SEQ ID NO: 827815 - RNA, 21 nt, Human
aagcgcuggguuuaccagucu

SEQ ID NO: 827816 - RNA, 22 nt, Human
aauggcccaugccucaguuucc

SEQ ID NO: 827817 - RNA, 21 nt, Human
acacugugucuguguggccca

SEQ ID NO: 827818 - RNA, 19 nt, Human
aggagccaaauagagcaag

SEQ ID NO: 827819 - RNA, 19 nt, Human
aggcucuuaaaucucaugu

SEQ ID NO: 827820 - RNA, 24 nt, Human
agggugucucggggucuccuguaa

SEQ ID NO: 827821 - RNA, 18 nt, Human
agugggagacaggcucag

SEQ ID NO: 827822 - RNA, 18 nt, Human
aucuccgcccaggcaccc

SEQ ID NO: 827823 - RNA, 18 nt, Human
caaauagagcaagcacca

SEQ ID NO: 827824 - RNA, 21 nt, Human
cacugagcacugcagggaaac

SEQ ID NO: 827825 - RNA, 20 nt, Human
cacugggugaguaaaccuuc

SEQ ID NO: 827826 - RNA, 24 nt, Human
cagaccaucuggcucccgagugga

SEQ ID NO: 827827 - RNA, 22 nt, Human
cagagugguguucaguaaacac

SEQ ID NO: 827828 - RNA, 18 nt, Human
caggcucagagaggaggu

SEQ ID NO: 827829 - RNA, 21 nt, Human
caguuuccucaucugaaaaug

SEQ ID NO: 827830 - RNA, 21 nt, Human
cauuaagaugaugggcagccc

SEQ ID NO: 827831 - RNA, 26 nt, Human
ccaauaaaaaaaaaaaaagauggaaa

SEQ ID NO: 827832 - RNA, 22 nt, Human
cccaugccucaguuuccucauc

SEQ ID NO: 827833 - RNA, 18 nt, Human
ccccuaaaagacaucucc

SEQ ID NO: 827834 - RNA, 23 nt, Human
ccggggaccuuugcaucauuggc

SEQ ID NO: 827835 - RNA, 19 nt, Human
ccuccuggggcagagugac

SEQ ID NO: 827836 - RNA, 21 nt, Human
ccuguagucacagacucggga

SEQ ID NO: 827837 - RNA, 21 nt, Human
cgcuggguuuaccagucuucu

SEQ ID NO: 827838 - RNA, 21 nt, Human
cuaaaagacaucuccgcccag

SEQ ID NO: 827839 - RNA, 19 nt, Human
cuggcccagacacugagca

SEQ ID NO: 827840 - RNA, 21 nt, Human
cuggguuuaccagucuucuug

SEQ ID NO: 827841 - RNA, 20 nt, Human
cugguucuccauuuaagucu

SEQ ID NO: 827842 - RNA, 19 nt, Human
gaacuuaggugggcuggca

SEQ ID NO: 827843 - RNA, 20 nt, Human
gcaaggggagcccaucucuu

SEQ ID NO: 827844 - RNA, 24 nt, Human
ggacauaucuuuaagcgaagagaa

SEQ ID NO: 827845 - RNA, 19 nt, Human
ggcaaggggagcccaucuc

SEQ ID NO: 827846 - RNA, 27 nt, Human
gggcaagcagcacuuuuuacucuggcc

SEQ ID NO: 827847 - RNA, 18 nt, Human
gggcagcccugggggagc

SEQ ID NO: 827848 - RNA, 21 nt, Human
ggggaccuuugcaucauuggc

SEQ ID NO: 827849 - RNA, 19 nt, Human
gugcccagggaagggaccc

SEQ ID NO: 827850 - RNA, 19 nt, Human
uaaaucaggaaacaaucua

SEQ ID NO: 827851 - RNA, 23 nt, Human
uacguauguguuuaguuucucuc

SEQ ID NO: 827852 - RNA, 18 nt, Human
uacuguggagcuccgagg

SEQ ID NO: 827853 - RNA, 21 nt, Human
uagguucuuauuucacuucuc

SEQ ID NO: 827854 - RNA, 22 nt, Human
ucaacccauauuuacugggauc

SEQ ID NO: 827855 - RNA, 18 nt, Human
ucaguaaacacauguuga

SEQ ID NO: 827856 - RNA, 22 nt, Human
ucauuggcauccuuacugugga

SEQ ID NO: 827857 - RNA, 20 nt, Human
ucauuuuuuucuucuuauuu

SEQ ID NO: 827858 - RNA, 22 nt, Human
ucccugcaaaggggacgaaggu

SEQ ID NO: 827859 - RNA, 20 nt, Human
uccucaucugaaaauggagu

SEQ ID NO: 827860 - RNA, 24 nt, Human
ucuagggcuuagcacagaguggug

SEQ ID NO: 827861 - RNA, 20 nt, Human
ucuaucuggcaaguucucug

SEQ ID NO: 827862 - RNA, 22 nt, Human
ucuccgcccaggcacccugcgg

SEQ ID NO: 827863 - RNA, 22 nt, Human
ucuccuguaacucccugcaaag

SEQ ID NO: 827864 - RNA, 22 nt, Human
ucuggccuccuggggcagagug

SEQ ID NO: 827865 - RNA, 20 nt, Human
ugagccuuaggcacuuuugc

SEQ ID NO: 827866 - RNA, 23 nt, Human
ugagggccacguaaugauuuuca

SEQ ID NO: 827867 - RNA, 19 nt, Human
ugcccagggaagggacccu

SEQ ID NO: 827868 - RNA, 21 nt, Human
ugccucaguuuccucaucuga

SEQ ID NO: 827869 - RNA, 22 nt, Human
ugccuguagucacagacucggg

SEQ ID NO: 827870 - RNA, 20 nt, Human
uggaguggggaugcccagga

SEQ ID NO: 827871 - RNA, 22 nt, Human
uggaguggggaugcccaggaga

SEQ ID NO: 827872 - RNA, 18 nt, Human
ugggagacaggcucagag

SEQ ID NO: 827873 - RNA, 19 nt, Human
ugggagaggugacacugug

SEQ ID NO: 827874 - RNA, 20 nt, Human
uguguggcccacugagucca

SEQ ID NO: 827875 - RNA, 18 nt, Human
uuaccagucuucuugucu

SEQ ID NO: 827876 - RNA, 24 nt, Human
uuaguuucucucucuguugauuac

SEQ ID NO: 827877 - RNA, 25 nt, Human
uucaggcucuuaaaucucauguuuu

SEQ ID NO: 827878 - RNA, 21 nt, Human
uucucuguuugaagcuuucca

SEQ ID NO: 827879 - RNA, 22 nt, Human
uucuuauuuuaagaucugaaga

SEQ ID NO: 827880 - RNA, 27 nt, Human
uugcaggacuccaauaaaaaaaaaaaa

SEQ ID NO: 827881 - RNA, 24 nt, Human
uuggcauugucaucuucuccaugg

SEQ ID NO: 827882 - RNA, 18 nt, Human
uuuacugggauccuacug

SEQ ID NO: 827883 - RNA, 24 nt, Human
uuuauucaacccauauuuacuggg

SEQ ID NO: 827884 - RNA, 20 nt, Human
uuucuugggccccuaaaaga

SEQ ID NO: 827885 - RNA, 22 nt, Human
uuuuacucuggccuccuggggc

SEQ ID NO: 827886 - RNA, 19 nt, Human
uuuuugaccugcucuaggg

SEQ ID NO: 827887 - RNA, 19 nt, Human
uuuuuuuuuuucaggcucu

SEQ ID NO: 827888 - RNA, 23 nt, Human
uuuuuuuuuuuuuuuuuuucagg

SEQ ID NO: 827889 - RNA, 22 nt, Human
aaaaaucgaauaauacugaaau

SEQ ID NO: 827890 - RNA, 22 nt, Human
cucccagaaucucuccaagaac

SEQ ID NO: 827891 - RNA, 19 nt, Human
gaguguuuggcucccagaa

SEQ ID NO: 827892 - RNA, 21 nt, Human
gaguguuuggcucccagaauc

SEQ ID NO: 827893 - RNA, 24 nt, Human
ggaguguuuggcucccagaaucuc

SEQ ID NO: 827894 - RNA, 22 nt, Human
uaaccacagcagcuuucaguau

SEQ ID NO: 827895 - RNA, 22 nt, Human
ugaaauaaccacagcagcuuuc

SEQ ID NO: 827896 - RNA, 22 nt, Human
uuugcuuaaguuguucuagaaa

SEQ ID NO: 827897 - RNA, 19 nt, Human
aaauaucaguggcugugac

SEQ ID NO: 827898 - RNA, 22 nt, Human
aagagcccaaaggagauccugu

SEQ ID NO: 827899 - RNA, 21 nt, Human
aagcaacaagccucuccuuca

SEQ ID NO: 827900 - RNA, 20 nt, Human
aagccagcccacacaggcca

SEQ ID NO: 827901 - RNA, 20 nt, Human
aagcccagggccagcaacaa

SEQ ID NO: 827902 - RNA, 22 nt, Human
acaagcccagggccagcaacaa

SEQ ID NO: 827903 - RNA, 23 nt, Human
acaaggggaaaagcugaugucaa

SEQ ID NO: 827904 - RNA, 18 nt, Human
acaucauucaucucaacc

SEQ ID NO: 827905 - RNA, 19 nt, Human
agaacaaagacagccccuu

SEQ ID NO: 827906 - RNA, 21 nt, Human
agacaacaugcacucaagcca

SEQ ID NO: 827907 - RNA, 22 nt, Human
aggacguacgggcccagccuuc

SEQ ID NO: 827908 - RNA, 21 nt, Human
aggcaggcacuccacugggga

SEQ ID NO: 827909 - RNA, 18 nt, Human
aggccucugugugaccag

SEQ ID NO: 827910 - RNA, 24 nt, Human
auccuaaugcuucuccccaaccuc

SEQ ID NO: 827911 - RNA, 22 nt, Human
aucuugucucuccgcugcucca

SEQ ID NO: 827912 - RNA, 25 nt, Human
augcaaaaaaaaauaugugaaauuc

SEQ ID NO: 827913 - RNA, 26 nt, Human
auugcaauuauuugaaauucccaauc

SEQ ID NO: 827914 - RNA, 19 nt, Human
caacaugcacucaagccag

SEQ ID NO: 827915 - RNA, 18 nt, Human
cacacaagcccagggcca

SEQ ID NO: 827916 - RNA, 25 nt, Human
cacacaggccaaggagaacaaagac

SEQ ID NO: 827917 - RNA, 25 nt, Human
cacaggccaaggagaacaaagacag

SEQ ID NO: 827918 - RNA, 20 nt, Human
cacaucauucaucucaaccc

SEQ ID NO: 827919 - RNA, 23 nt, Human
cacuccacuggggaagauggcuc

SEQ ID NO: 827920 - RNA, 20 nt, Human
cagaaacccagagcuccugg

SEQ ID NO: 827921 - RNA, 21 nt, Human
cagaagggaaauccccucauu

SEQ ID NO: 827922 - RNA, 22 nt, Human
cagcagagcugagguuaagaca

SEQ ID NO: 827923 - RNA, 19 nt, Human
caggguuccuucuaagucc

SEQ ID NO: 827924 - RNA, 23 nt, Human
caucuugucucuccgcugcucca

SEQ ID NO: 827925 - RNA, 26 nt, Human
caucuugucucuccgcugcuccaggg

SEQ ID NO: 827926 - RNA, 26 nt, Human
caugcaaaaaaaaauaugugaaauuc

SEQ ID NO: 827927 - RNA, 24 nt, Human
caugcacucaagccagcccacaca

SEQ ID NO: 827928 - RNA, 18 nt, Human
caugcaggccucugugug

SEQ ID NO: 827929 - RNA, 24 nt, Human
ccaggcacacagacuacaugugcu

SEQ ID NO: 827930 - RNA, 23 nt, Human
ccaguagcuccucuguguaaucc

SEQ ID NO: 827931 - RNA, 21 nt, Human
cccacaagugaucagccacca

SEQ ID NO: 827932 - RNA, 19 nt, Human
cccacggccaguacggcca

SEQ ID NO: 827933 - RNA, 22 nt, Human
ccccuuaagggagaggccucca

SEQ ID NO: 827934 - RNA, 21 nt, Human
ccucaggagccacacaagccc

SEQ ID NO: 827935 - RNA, 18 nt, Human
ccuccagcagagcugagg

SEQ ID NO: 827936 - RNA, 22 nt, Human
ccuguuaucagaaacccagagc

SEQ ID NO: 827937 - RNA, 21 nt, Human
cuccccaaccucaagagccca

SEQ ID NO: 827938 - RNA, 21 nt, Human
cuccuggacugccaguugcac

SEQ ID NO: 827939 - RNA, 22 nt, Human
cuguggacugggccugggcaag

SEQ ID NO: 827940 - RNA, 20 nt, Human
cuuaagagccacacaccucu

SEQ ID NO: 827941 - RNA, 26 nt, Human
gagaacaaagacagccccuuaaggga

SEQ ID NO: 827942 - RNA, 24 nt, Human
gagcagcaucugaggcuugaggcc

SEQ ID NO: 827943 - RNA, 23 nt, Human
gaggugaagccucgccagggggc

SEQ ID NO: 827944 - RNA, 18 nt, Human
gcacacagacuacaugug

SEQ ID NO: 827945 - RNA, 24 nt, Human
gccacaguucaggcagccaggguu

SEQ ID NO: 827946 - RNA, 24 nt, Human
gcccagggccagcaacaacacuuu

SEQ ID NO: 827947 - RNA, 22 nt, Human
gcucuguggacugggccugggc

SEQ ID NO: 827948 - RNA, 24 nt, Human
gcucuguggacugggccugggcaa

SEQ ID NO: 827949 - RNA, 18 nt, Human
gcugcuccucccaggacu

SEQ ID NO: 827950 - RNA, 20 nt, Human
gcuggagacugaccccacaa

SEQ ID NO: 827951 - RNA, 18 nt, Human
ggacugggccugggcaag

SEQ ID NO: 827952 - RNA, 22 nt, Human
ggagcagcaucugaggcuugag

SEQ ID NO: 827953 - RNA, 19 nt, Human
gggcaggccccaucugcuc

SEQ ID NO: 827954 - RNA, 20 nt, Human
guccaucuccaagguggaca

SEQ ID NO: 827955 - RNA, 21 nt, Human
gugaccaggcacacagacuac

SEQ ID NO: 827956 - RNA, 18 nt, Human
guggagcagcaucugagg

SEQ ID NO: 827957 - RNA, 18 nt, Human
uaaagaaccacccacaag

SEQ ID NO: 827958 - RNA, 19 nt, Human
uaagacuaaccagcugcag

SEQ ID NO: 827959 - RNA, 23 nt, Human
uaagagacaucaccuaaauauca

SEQ ID NO: 827960 - RNA, 19 nt, Human
uacaguucaggcagcugag

SEQ ID NO: 827961 - RNA, 23 nt, Human
uacaguucaggcagcugaggcac

SEQ ID NO: 827962 - RNA, 23 nt, Human
uagaaggaauucuaacucaggua

SEQ ID NO: 827963 - RNA, 24 nt, Human
uauugcaauuauuugaaauuccca

SEQ ID NO: 827964 - RNA, 22 nt, Human
ucaccuaaauaucaguggcugu

SEQ ID NO: 827965 - RNA, 21 nt, Human
ucagggaaacgggccuagcag

SEQ ID NO: 827966 - RNA, 24 nt, Human
ucauuugugaacacaucauucauc

SEQ ID NO: 827967 - RNA, 18 nt, Human
uccacagugaggugaagc

SEQ ID NO: 827968 - RNA, 21 nt, Human
uccacuggggaagauggcucu

SEQ ID NO: 827969 - RNA, 19 nt, Human
uccccaaccucaagagccc

SEQ ID NO: 827970 - RNA, 18 nt, Human
uccccugucccccacacc

SEQ ID NO: 827971 - RNA, 22 nt, Human
uccuaaggcaugcaaaaaaaaa

SEQ ID NO: 827972 - RNA, 24 nt, Human
uccuucaguuuaguccagaaggga

SEQ ID NO: 827973 - RNA, 19 nt, Human
uccuuggcaaggcuugugg

SEQ ID NO: 827974 - RNA, 18 nt, Human
ugaaguuuguggcugaaa

SEQ ID NO: 827975 - RNA, 21 nt, Human
ugacaagcccuugagagcugc

SEQ ID NO: 827976 - RNA, 19 nt, Human
ugacaggagagcuaaagaa

SEQ ID NO: 827977 - RNA, 23 nt, Human
ugacaggagagcuaaagaaccac

SEQ ID NO: 827978 - RNA, 18 nt, Human
ugaccaggcacacagacu

SEQ ID NO: 827979 - RNA, 26 nt, Human
ugaccaggcacacagacuacaugugc

SEQ ID NO: 827980 - RNA, 21 nt, Human
ugaccccacaagugaucagcc

SEQ ID NO: 827981 - RNA, 22 nt, Human
ugaccccacaagugaucagcca

SEQ ID NO: 827982 - RNA, 18 nt, Human
ugaguauucccccgaccc

SEQ ID NO: 827983 - RNA, 20 nt, Human
ugcaugcaggccucuguggc

SEQ ID NO: 827984 - RNA, 18 nt, Human
uggcucuguggacugggc

SEQ ID NO: 827985 - RNA, 22 nt, Human
uggcucuguggacugggccugg

SEQ ID NO: 827986 - RNA, 20 nt, Human
uggcugaaaagcaggccuuc

SEQ ID NO: 827987 - RNA, 20 nt, Human
uggggagcggggggaugagu

SEQ ID NO: 827988 - RNA, 20 nt, Human
uuaccuaugugcuucuuccu

SEQ ID NO: 827989 - RNA, 18 nt, Human
uuccacagugaggugaag

SEQ ID NO: 827990 - RNA, 20 nt, Human
uuccuuggcaaggcuugugg

SEQ ID NO: 827991 - RNA, 19 nt, Human
uucuaagucccaguagcuc

SEQ ID NO: 827992 - RNA, 24 nt, Human
uugcaugcaggccucugugugacc

SEQ ID NO: 827993 - RNA, 22 nt, Human
uugucucuccgcugcuccaggg

SEQ ID NO: 827994 - RNA, 26 nt, Human
aaaaggccaaaagaacauagugggca

SEQ ID NO: 827995 - RNA, 19 nt, Human
aaccucuuggucuuggaga

SEQ ID NO: 827996 - RNA, 22 nt, Human
aacuaucauagccaccaaacag

SEQ ID NO: 827997 - RNA, 22 nt, Human
aagcaacaggcgggucccagga

SEQ ID NO: 827998 - RNA, 23 nt, Human
aaggccaaaagaacauacaagcc

SEQ ID NO: 827999 - RNA, 18 nt, Human
aauacuccggggcuucuc

SEQ ID NO: 828000 - RNA, 18 nt, Human
acaagcccagcucucuag

SEQ ID NO: 828001 - RNA, 25 nt, Human
acagaaagcagcucaaggccaccac

SEQ ID NO: 828002 - RNA, 24 nt, Human
acagcaccgggcagaauuuacaca

SEQ ID NO: 828003 - RNA, 25 nt, Human
accuccaccuucaucccuuucauca

SEQ ID NO: 828004 - RNA, 23 nt, Human
acgauaccacacaucucacagac

SEQ ID NO: 828005 - RNA, 18 nt, Human
acucaggccaucuuccuc

SEQ ID NO: 828006 - RNA, 25 nt, Human
acugucuuguauuccacagugugac

SEQ ID NO: 828007 - RNA, 23 nt, Human
agaaagcagcucaaggccaccac

SEQ ID NO: 828008 - RNA, 24 nt, Human
agaacuggacccuuuaacuacaaa

SEQ ID NO: 828009 - RNA, 19 nt, Human
agaagccaggcuggaggca

SEQ ID NO: 828010 - RNA, 22 nt, Human
agaguggaggaaggcuccaauu

SEQ ID NO: 828011 - RNA, 18 nt, Human
agcagaggaccaacacau

SEQ ID NO: 828012 - RNA, 19 nt, Human
agcagccuuguaacuguga

SEQ ID NO: 828013 - RNA, 19 nt, Human
agccaagauacuggcuuuc

SEQ ID NO: 828014 - RNA, 18 nt, Human
agcucaaggccaccacac

SEQ ID NO: 828015 - RNA, 21 nt, Human
agcuggcucagaaccacugcc

SEQ ID NO: 828016 - RNA, 18 nt, Human
aggagaccccagcagguc

SEQ ID NO: 828017 - RNA, 21 nt, Human
aggcauggugguggugguaga

SEQ ID NO: 828018 - RNA, 21 nt, Human
agguccuccaccguccagccu

SEQ ID NO: 828019 - RNA, 21 nt, Human
aguucuggggccucaggcggc

SEQ ID NO: 828020 - RNA, 23 nt, Human
aucccuuucaucacauccuccca

SEQ ID NO: 828021 - RNA, 20 nt, Human
aucuuccucuuccuccauug

SEQ ID NO: 828022 - RNA, 19 nt, Human
auugguucugaagaugggg

SEQ ID NO: 828023 - RNA, 23 nt, Human
caaaaggccaaaagaacauacaa

SEQ ID NO: 828024 - RNA, 19 nt, Human
cacaaacacagaaagcagc

SEQ ID NO: 828025 - RNA, 21 nt, Human
cacagagaggaucagucucca

SEQ ID NO: 828026 - RNA, 18 nt, Human
cacagcaccgggcagaau

SEQ ID NO: 828027 - RNA, 24 nt, Human
cacaggggagggcagaagcaacag

SEQ ID NO: 828028 - RNA, 21 nt, Human
caccacacaggucgccaaaau

SEQ ID NO: 828029 - RNA, 19 nt, Human
cacccgauacccugcuguc

SEQ ID NO: 828030 - RNA, 23 nt, Human
caccguccagccuucacagcacc

SEQ ID NO: 828031 - RNA, 19 nt, Human
cagaaagcagcucaaggcc

SEQ ID NO: 828032 - RNA, 22 nt, Human
cagacagcuggcucagaaccac

SEQ ID NO: 828033 - RNA, 19 nt, Human
cagaguucacugucuugua

SEQ ID NO: 828034 - RNA, 20 nt, Human
cagcacccgauacccugcug

SEQ ID NO: 828035 - RNA, 25 nt, Human
cagcagguccuccaccguccagccu

SEQ ID NO: 828036 - RNA, 25 nt, Human
caggaacuucccccagucgaagccc

SEQ ID NO: 828037 - RNA, 22 nt, Human
caggagacgcugcagaaccucu

SEQ ID NO: 828038 - RNA, 21 nt, Human
cagggcugagcaaaugcagcg

SEQ ID NO: 828039 - RNA, 23 nt, Human
caguacacccggcuggggagcac

SEQ ID NO: 828040 - RNA, 20 nt, Human
caucccuggggagcuaggag

SEQ ID NO: 828041 - RNA, 18 nt, Human
ccaaagugcacacucagg

SEQ ID NO: 828042 - RNA, 19 nt, Human
ccaccaaacagcuccaagu

SEQ ID NO: 828043 - RNA, 19 nt, Human
ccaggcuggaggcaggaag

SEQ ID NO: 828044 - RNA, 19 nt, Human
ccagucgaagcccaagacc

SEQ ID NO: 828045 - RNA, 19 nt, Human
cccaccacacaacucacug

SEQ ID NO: 828046 - RNA, 21 nt, Human
cccccagucgaagcccaagac

SEQ ID NO: 828047 - RNA, 22 nt, Human
ccucaauacuccggggcuucuc

SEQ ID NO: 828048 - RNA, 27 nt, Human
ccucaggcggcccgucauauagaccuu

SEQ ID NO: 828049 - RNA, 24 nt, Human
ccuucaucccuuucaucacauccu

SEQ ID NO: 828050 - RNA, 18 nt, Human
cgaagcagcacccgauac

SEQ ID NO: 828051 - RNA, 20 nt, Human
cgauccaguacacccggcug

SEQ ID NO: 828052 - RNA, 19 nt, Human
cggggaggucggcaguucc

SEQ ID NO: 828053 - RNA, 23 nt, Human
cgucuuguccuguugguguccca

SEQ ID NO: 828054 - RNA, 24 nt, Human
cuagaacuuaauuuacauggcucg

SEQ ID NO: 828055 - RNA, 21 nt, Human
cucacugcccacacugcuguu

SEQ ID NO: 828056 - RNA, 22 nt, Human
cuccauugguucugaagauggg

SEQ ID NO: 828057 - RNA, 22 nt, Human
cuggcgucauuuucaaagccuu

SEQ ID NO: 828058 - RNA, 23 nt, Human
cugugauccuucaggaacuuccc

SEQ ID NO: 828059 - RNA, 21 nt, Human
cuucauaccgaagcagcaccc

SEQ ID NO: 828060 - RNA, 20 nt, Human
cuuuuuuggucggugguuuu

SEQ ID NO: 828061 - RNA, 19 nt, Human
gaaacagcugacgggagca

SEQ ID NO: 828062 - RNA, 19 nt, Human
gagcagaggaccaacacau

SEQ ID NO: 828063 - RNA, 21 nt, Human
gagcaggcagcuagcguucca

SEQ ID NO: 828064 - RNA, 18 nt, Human
gagguugcaauggcagcu

SEQ ID NO: 828065 - RNA, 22 nt, Human
gcagaccaggcagccuugugca

SEQ ID NO: 828066 - RNA, 22 nt, Human
gcaugguuucuucauuuaggua

SEQ ID NO: 828067 - RNA, 21 nt, Human
gcucugucauccuugucuuga

SEQ ID NO: 828068 - RNA, 22 nt, Human
gcuuccagcuagaagccaggcu

SEQ ID NO: 828069 - RNA, 25 nt, Human
gcuuuuuuggucggugguuuucccu

SEQ ID NO: 828070 - RNA, 21 nt, Human
ggagcugcucucacugcccuu

SEQ ID NO: 828071 - RNA, 23 nt, Human
ggaguuggaggaguagcuccugg

SEQ ID NO: 828072 - RNA, 20 nt, Human
ggccaucuuccucccaaugu

SEQ ID NO: 828073 - RNA, 23 nt, Human
gggagcacagcaucacuguugag

SEQ ID NO: 828074 - RNA, 18 nt, Human
gggccguggcgggucggg

SEQ ID NO: 828075 - RNA, 18 nt, Human
gguaggaacaaaaggcca

SEQ ID NO: 828076 - RNA, 22 nt, Human
guccccaacaucccuggggagc

SEQ ID NO: 828077 - RNA, 24 nt, Human
guuucuucauuuagguaggaacaa

SEQ ID NO: 828078 - RNA, 21 nt, Human
uagagugggacgugcuugaaa

SEQ ID NO: 828079 - RNA, 20 nt, Human
uagcagagccaaagugcaca

SEQ ID NO: 828080 - RNA, 19 nt, Human
uagcugccgagacaagcug

SEQ ID NO: 828081 - RNA, 24 nt, Human
uaggaacaaaaggccaaaagaaca

SEQ ID NO: 828082 - RNA, 25 nt, Human
uauagaccuuuccacaggggagggc

SEQ ID NO: 828083 - RNA, 18 nt, Human
ucaaggccaccacacagg

SEQ ID NO: 828084 - RNA, 18 nt, Human
ucacagacgaguucuggg

SEQ ID NO: 828085 - RNA, 24 nt, Human
ucacugcuucuuagcugccgagac

SEQ ID NO: 828086 - RNA, 20 nt, Human
ucaggccaucuuccucccaa

SEQ ID NO: 828087 - RNA, 28 nt, Human
ucaggccaucuuccucccaauguccucc

SEQ ID NO: 828088 - RNA, 23 nt, Human
ucagguggaggcauggugguggu

SEQ ID NO: 828089 - RNA, 18 nt, Human
ucauagagugggacgugc

SEQ ID NO: 828090 - RNA, 20 nt, Human
uccacauccuggucacugcu

SEQ ID NO: 828091 - RNA, 19 nt, Human
uccaccuucaucccuuuca

SEQ ID NO: 828092 - RNA, 24 nt, Human
uccccaacaucccuggggagcuag

SEQ ID NO: 828093 - RNA, 22 nt, Human
ucccuuucaucacauccuccca

SEQ ID NO: 828094 - RNA, 21 nt, Human
ucuggaugacagaggcgaucc

SEQ ID NO: 828095 - RNA, 23 nt, Human
ucuugaggguucuguguucacgg

SEQ ID NO: 828096 - RNA, 19 nt, Human
ugaaacagcugacgggagc

SEQ ID NO: 828097 - RNA, 21 nt, Human
ugacgggagcagccuuguaac

SEQ ID NO: 828098 - RNA, 22 nt, Human
ugagcaccuccaccuucauccc

SEQ ID NO: 828099 - RNA, 18 nt, Human
ugaggcagaggcugcccc

SEQ ID NO: 828100 - RNA, 21 nt, Human
ugcucagagagcugcucuaga

SEQ ID NO: 828101 - RNA, 20 nt, Human
ugcuucacuugacuccucca

SEQ ID NO: 828102 - RNA, 24 nt, Human
uggagcaggagacgcugcagaacc

SEQ ID NO: 828103 - RNA, 22 nt, Human
uggaggcaugguggugguggua

SEQ ID NO: 828104 - RNA, 18 nt, Human
uggcgucauuuucaaagc

SEQ ID NO: 828105 - RNA, 22 nt, Human
ugggguggacauccacuguucc

SEQ ID NO: 828106 - RNA, 22 nt, Human
ugguagagaaacgcugggcugg

SEQ ID NO: 828107 - RNA, 20 nt, Human
uguacccacgauaccacaca

SEQ ID NO: 828108 - RNA, 23 nt, Human
uguacccacgauaccacacaucu

SEQ ID NO: 828109 - RNA, 21 nt, Human
ugucuggaugacagaggcgau

SEQ ID NO: 828110 - RNA, 19 nt, Human
uuacauggcucguucaggc

SEQ ID NO: 828111 - RNA, 22 nt, Human
uucaaagccuucauaccgaagc

SEQ ID NO: 828112 - RNA, 19 nt, Human
uucacugucuuguauucca

SEQ ID NO: 828113 - RNA, 19 nt, Human
uucaggcagacagaguuca

SEQ ID NO: 828114 - RNA, 18 nt, Human
uuccucuuccuccauugg

SEQ ID NO: 828115 - RNA, 23 nt, Human
uuucuucauuuagguaggaacaa

SEQ ID NO: 828116 - RNA, 18 nt, Human
uuucuuggaguuggagga

SEQ ID NO: 828117 - RNA, 22 nt, Human
aaaaaaaaccacauauaagccc

SEQ ID NO: 828118 - RNA, 19 nt, Human
aaaaaggccuucugccucu

SEQ ID NO: 828119 - RNA, 18 nt, Human
aaacauacaggccccuug

SEQ ID NO: 828120 - RNA, 20 nt, Human
aaccaaaaaaaaaaaccaca

SEQ ID NO: 828121 - RNA, 26 nt, Human
aagaaaaagcagaccuaaaaaauguu

SEQ ID NO: 828122 - RNA, 18 nt, Human
acaggccccuuggagguu

SEQ ID NO: 828123 - RNA, 21 nt, Human
acugucuuuguuuugaauuga

SEQ ID NO: 828124 - RNA, 24 nt, Human
agaaaaagcagaccuaaaaaaugu

SEQ ID NO: 828125 - RNA, 24 nt, Human
caaaaaaaaaaaccacauauaagc

SEQ ID NO: 828126 - RNA, 19 nt, Human
caagucccacaauaaggag

SEQ ID NO: 828127 - RNA, 26 nt, Human
caccaugcagccaaagcuugaagguu

SEQ ID NO: 828128 - RNA, 27 nt, Human
ccaaaaaaaaaaaccacauauaagccc

SEQ ID NO: 828129 - RNA, 18 nt, Human
ccagaggacaaagugcau

SEQ ID NO: 828130 - RNA, 20 nt, Human
ccaugcagccaaagcuugaa

SEQ ID NO: 828131 - RNA, 25 nt, Human
ccuugaaaaaagcuuugaaaaaagg

SEQ ID NO: 828132 - RNA, 20 nt, Human
cuccauaaacauacaggccc

SEQ ID NO: 828133 - RNA, 24 nt, Human
gagcaauuuuagauuaaaaugguc

SEQ ID NO: 828134 - RNA, 24 nt, Human
uaaaagauguauuucuaacaugcc

SEQ ID NO: 828135 - RNA, 20 nt, Human
uaacaugccaccaccaugca

SEQ ID NO: 828136 - RNA, 18 nt, Human
uaaccaaaaaaaaaaacc

SEQ ID NO: 828137 - RNA, 23 nt, Human
uaaccaaaaaaaaaaaccacaua

SEQ ID NO: 828138 - RNA, 18 nt, Human
uaagaaaaagcagaccua

SEQ ID NO: 828139 - RNA, 26 nt, Human
uaauccacuagauccuugagagcaau

SEQ ID NO: 828140 - RNA, 20 nt, Human
uagauccuugagagcaauuu

SEQ ID NO: 828141 - RNA, 24 nt, Human
ucuccauaaacauacaggccccuu

SEQ ID NO: 828142 - RNA, 24 nt, Human
ugaaacauagggcauucuuccccc

SEQ ID NO: 828143 - RNA, 19 nt, Human
ugaaggccugggagauuua

SEQ ID NO: 828144 - RNA, 24 nt, Human
ugaccacuugagaucaaguccugc

SEQ ID NO: 828145 - RNA, 23 nt, Human
ugccaccaccaugcagccaaagc

SEQ ID NO: 828146 - RNA, 23 nt, Human
uggugcagaaauaaggccaaaua

SEQ ID NO: 828147 - RNA, 20 nt, Human
uguauuucuaacaugccacc

SEQ ID NO: 828148 - RNA, 25 nt, Human
uuaaugaugagaaaaugauuccuuc

SEQ ID NO: 828149 - RNA, 22 nt, Human
uucauaaccaaaaaaaaaaacc

SEQ ID NO: 828150 - RNA, 22 nt, Human
uucugccugcguuaaccauuug

SEQ ID NO: 828151 - RNA, 23 nt, Human
uuuuaauuucauggugcagaaau

SEQ ID NO: 828152 - RNA, 18 nt, Human
aaggguauuuaaggcuuu

SEQ ID NO: 828153 - RNA, 22 nt, Human
agaaggucagggcccacgagga

SEQ ID NO: 828154 - RNA, 21 nt, Human
agagaaggucagggcccacga

SEQ ID NO: 828155 - RNA, 23 nt, Human
agagagaaggucagggcccacga

SEQ ID NO: 828156 - RNA, 25 nt, Human
cagcgacaaacaaucaggcccccac

SEQ ID NO: 828157 - RNA, 19 nt, Human
caggcccccacaaugaacu

SEQ ID NO: 828158 - RNA, 22 nt, Human
ccacucgugcugggaccauucc

SEQ ID NO: 828159 - RNA, 18 nt, Human
ccagcgacaaacaaucag

SEQ ID NO: 828160 - RNA, 22 nt, Human
cccacaaugaacuggccacucg

SEQ ID NO: 828161 - RNA, 23 nt, Human
ccuccagcgacaaacaaucaggc

SEQ ID NO: 828162 - RNA, 21 nt, Human
cgacaaacaaucaggccccca

SEQ ID NO: 828163 - RNA, 22 nt, Human
cuccggagccucugcccggcuc

SEQ ID NO: 828164 - RNA, 22 nt, Human
gaccauucccuaggggaggagg

SEQ ID NO: 828165 - RNA, 24 nt, Human
ucaggcccccacaaugaacuggcc

SEQ ID NO: 828166 - RNA, 21 nt, Human
ucguagcucaguuuuauuuuc

SEQ ID NO: 828167 - RNA, 25 nt, Human
aaaaagcaguucacuuuauuuagca

SEQ ID NO: 828168 - RNA, 22 nt, Human
aacacuaugcugaaaaaccaca

SEQ ID NO: 828169 - RNA, 19 nt, Human
agacaaaaagcaguucacu

SEQ ID NO: 828170 - RNA, 23 nt, Human
aggaaagugacuuagggaaguaa

SEQ ID NO: 828171 - RNA, 21 nt, Human
augacucaaagggaaaugcua

SEQ ID NO: 828172 - RNA, 23 nt, Human
auuccaaggaaguguuuuaugaa

SEQ ID NO: 828173 - RNA, 26 nt, Human
caaaaagcaguucacuuuauuuagca

SEQ ID NO: 828174 - RNA, 23 nt, Human
caacaaaaaguuaagguuuuauu

SEQ ID NO: 828175 - RNA, 23 nt, Human
caacacuaugcugaaaaaccaca

SEQ ID NO: 828176 - RNA, 21 nt, Human
caacaggcuucuuuccaaguu

SEQ ID NO: 828177 - RNA, 19 nt, Human
caagaacuuuggugguuuu

SEQ ID NO: 828178 - RNA, 21 nt, Human
cacuguguuaaacagcaggac

SEQ ID NO: 828179 - RNA, 23 nt, Human
cagaagauacacauagcuuccua

SEQ ID NO: 828180 - RNA, 24 nt, Human
cagaagauacacauagcuuccuau

SEQ ID NO: 828181 - RNA, 18 nt, Human
ccacccgggccucccucc

SEQ ID NO: 828182 - RNA, 18 nt, Human
ccaucugucaucaugacu

SEQ ID NO: 828183 - RNA, 19 nt, Human
ccaucugucaucaugacuc

SEQ ID NO: 828184 - RNA, 18 nt, Human
ccccagccccaggccgcc

SEQ ID NO: 828185 - RNA, 19 nt, Human
ccccagccccaggccgccc

SEQ ID NO: 828186 - RNA, 23 nt, Human
ccccagccccaggccgcccccuc

SEQ ID NO: 828187 - RNA, 24 nt, Human
ccccagccccaggccgcccccucc

SEQ ID NO: 828188 - RNA, 18 nt, Human
ccccaggccgcccccucc

SEQ ID NO: 828189 - RNA, 23 nt, Human
cccccacccgggccucccucccu

SEQ ID NO: 828190 - RNA, 24 nt, Human
ccccccgggaccccuugcaggaac

SEQ ID NO: 828191 - RNA, 20 nt, Human
cccccgggaccccuugcagg

SEQ ID NO: 828192 - RNA, 19 nt, Human
cccccuccagcggugccac

SEQ ID NO: 828193 - RNA, 19 nt, Human
ccccgggaccccuugcagg

SEQ ID NO: 828194 - RNA, 19 nt, Human
cccgcgccccccgggaccc

SEQ ID NO: 828195 - RNA, 21 nt, Human
ccgccgggcagccccagcccu

SEQ ID NO: 828196 - RNA, 20 nt, Human
ccgggcagccccagccccag

SEQ ID NO: 828197 - RNA, 22 nt, Human
cgcaaguccccgguggcugcac

SEQ ID NO: 828198 - RNA, 23 nt, Human
cggcugccccccacccgggccuc

SEQ ID NO: 828199 - RNA, 22 nt, Human
cgguggcugcacgcugagcggg

SEQ ID NO: 828200 - RNA, 19 nt, Human
cugaauacucaaacacccc

SEQ ID NO: 828201 - RNA, 25 nt, Human
cuuccuauuguuauuuucuuuucua

SEQ ID NO: 828202 - RNA, 18 nt, Human
cuugguuaagcggaggag

SEQ ID NO: 828203 - RNA, 19 nt, Human
gaagcggcggcggugagcg

SEQ ID NO: 828204 - RNA, 19 nt, Human
gagacaaaaagcaguucac

SEQ ID NO: 828205 - RNA, 19 nt, Human
gcgccgccgggcagcccca

SEQ ID NO: 828206 - RNA, 18 nt, Human
gcgcuguugcgggcugac

SEQ ID NO: 828207 - RNA, 27 nt, Human
gcggggcagggagaagcggcggcgguu

SEQ ID NO: 828208 - RNA, 19 nt, Human
gcucuaaggaaggagugaa

SEQ ID NO: 828209 - RNA, 20 nt, Human
gcugcggggcagggagaagc

SEQ ID NO: 828210 - RNA, 23 nt, Human
gcuugcuuuuuugccaguuggag

SEQ ID NO: 828211 - RNA, 23 nt, Human
ggaaauguguucccuucucccuc

SEQ ID NO: 828212 - RNA, 18 nt, Human
ggcagccccagccccagg

SEQ ID NO: 828213 - RNA, 22 nt, Human
ggcagggagaagcggcggcggu

SEQ ID NO: 828214 - RNA, 19 nt, Human
gggcagccccagccccagg

SEQ ID NO: 828215 - RNA, 22 nt, Human
gggcaggacgcagcgaaggaag

SEQ ID NO: 828216 - RNA, 23 nt, Human
gggcagggagaagcggcggcggu

SEQ ID NO: 828217 - RNA, 22 nt, Human
gugaagcugucaaugccugcca

SEQ ID NO: 828218 - RNA, 23 nt, Human
gugaagcugucaaugccugccau

SEQ ID NO: 828219 - RNA, 19 nt, Human
uacaacacuguguuaaaca

SEQ ID NO: 828220 - RNA, 19 nt, Human
uagaaaaaaaauacaacac

SEQ ID NO: 828221 - RNA, 19 nt, Human
uagaugguuuucacaccau

SEQ ID NO: 828222 - RNA, 24 nt, Human
uauauuccaaggaaguguuuuaug

SEQ ID NO: 828223 - RNA, 19 nt, Human
uccagcggugccacggccg

SEQ ID NO: 828224 - RNA, 21 nt, Human
uccagcggugccacggccgcg

SEQ ID NO: 828225 - RNA, 27 nt, Human
ucccugcgcgguggaagaggcaaaggc

SEQ ID NO: 828226 - RNA, 22 nt, Human
uccugcgccucccgcgcccccc

SEQ ID NO: 828227 - RNA, 20 nt, Human
ucuggcccaacaggcuucuu

SEQ ID NO: 828228 - RNA, 20 nt, Human
ucuguauuuucacucaacca

SEQ ID NO: 828229 - RNA, 24 nt, Human
ugaaaucugaauacucaaacaccc

SEQ ID NO: 828230 - RNA, 22 nt, Human
ugaauacucaaacaccccuucu

SEQ ID NO: 828231 - RNA, 21 nt, Human
ugacucaaagggaaaugcuag

SEQ ID NO: 828232 - RNA, 19 nt, Human
ugcgcgcugcggggcaggg

SEQ ID NO: 828233 - RNA, 24 nt, Human
ugcuugcuuuuuugccaguuggag

SEQ ID NO: 828234 - RNA, 26 nt, Human
uggaagaggcaaaggcaagcgcaagc

SEQ ID NO: 828235 - RNA, 22 nt, Human
ugggaggugauggucaaaagca

SEQ ID NO: 828236 - RNA, 19 nt, Human
uggggcgggcaggacgcag

SEQ ID NO: 828237 - RNA, 21 nt, Human
ugucuucuggcccaacaggcu

SEQ ID NO: 828238 - RNA, 21 nt, Human
uguugcgggcugacggcagag

SEQ ID NO: 828239 - RNA, 25 nt, Human
uuagagacaaaaagcaguucacuuu

SEQ ID NO: 828240 - RNA, 22 nt, Human
uuccaaggaaguguuuuaugaa

SEQ ID NO: 828241 - RNA, 19 nt, Human
uuccagugaagccacugcu

SEQ ID NO: 828242 - RNA, 20 nt, Human
uuccagugaagccacugcuu

SEQ ID NO: 828243 - RNA, 23 nt, Human
uuccuauuguuauuuucuuuucu

SEQ ID NO: 828244 - RNA, 21 nt, Human
uuuagaaaaaaaauacaacac

SEQ ID NO: 828245 - RNA, 22 nt, Human
uuucacaccaucugucaucaug

SEQ ID NO: 828246 - RNA, 23 nt, Human
uuuccaaguuaaugcagcuauau

SEQ ID NO: 828247 - RNA, 24 nt, Human
cuuuuuuuuuuuuuuuuugcgaau

SEQ ID NO: 828248 - RNA, 20 nt, Human
cuuuuuuuuuuuuuuuuugg

SEQ ID NO: 828249 - RNA, 22 nt, Human
uauauguauguauaggcaucug

SEQ ID NO: 828250 - RNA, 23 nt, Human
uauuuguauauguauguauaggc

SEQ ID NO: 828251 - RNA, 20 nt, Human
uguauauguauguauaggca

SEQ ID NO: 828252 - RNA, 18 nt, Human
uucacaagacgggaggcc

SEQ ID NO: 828253 - RNA, 20 nt, Human
uucacaagacgggaggccau

SEQ ID NO: 828254 - RNA, 24 nt, Human
uugaaguucacaagacgggaggcc

SEQ ID NO: 828255 - RNA, 21 nt, Human
uuuuuuuuuuuuuuuuugcga

SEQ ID NO: 828256 - RNA, 22 nt, Human
agaauaaauagagucccaggca

SEQ ID NO: 828257 - RNA, 23 nt, Human
aggcagggcagaguucauugggg

SEQ ID NO: 828258 - RNA, 21 nt, Human
auaaagaagcucacgcccaca

SEQ ID NO: 828259 - RNA, 22 nt, Human
cagggugcugggcgggcccgug

SEQ ID NO: 828260 - RNA, 18 nt, Human
cccacccuuccagcucca

SEQ ID NO: 828261 - RNA, 20 nt, Human
cccacccuuccagcuccagc

SEQ ID NO: 828262 - RNA, 19 nt, Human
ccuggugucccagcagggu

SEQ ID NO: 828263 - RNA, 21 nt, Human
ggcuuucgagaggcgaaacug

SEQ ID NO: 828264 - RNA, 21 nt, Human
ggugaagcaacccgcgccugu

SEQ ID NO: 828265 - RNA, 20 nt, Human
ggugcugggcgggcccguga

SEQ ID NO: 828266 - RNA, 23 nt, Human
guaguacaugacgguguggguga

SEQ ID NO: 828267 - RNA, 23 nt, Human
uaaagaagcucacgcccacagug

SEQ ID NO: 828268 - RNA, 22 nt, Human
ucacgcccacaguggagaggua

SEQ ID NO: 828269 - RNA, 21 nt, Human
ugccacacggcugguucagcg

SEQ ID NO: 828270 - RNA, 21 nt, Human
uggcugccauccagggggcug

SEQ ID NO: 828271 - RNA, 24 nt, Human
uuaaucagaauaaauagaguccca

SEQ ID NO: 828272 - RNA, 23 nt, Human
uucacccacccuuccagcuccag

SEQ ID NO: 828273 - RNA, 26 nt, Human
uucacccacccuuccagcuccagccu

SEQ ID NO: 828274 - RNA, 20 nt, Human
uuuuuuuuuugcaaaacccc

SEQ ID NO: 828275 - RNA, 21 nt, Human
uuuuuuuuuuuuuuuuugcaa

SEQ ID NO: 828276 - RNA, 27 nt, Human
uuuuuuuuuuuuuuuuuuuuuuugggg

SEQ ID NO: 828277 - RNA, 23 nt, Human
aaacaacccaaauacauucccca

SEQ ID NO: 828278 - RNA, 26 nt, Human
aaacagccugugaggcacauaaaaau

SEQ ID NO: 828279 - RNA, 21 nt, Human
aaagcaaaauuaaugcccaaa

SEQ ID NO: 828280 - RNA, 21 nt, Human
aaaugauaucucuguuacaga

SEQ ID NO: 828281 - RNA, 24 nt, Human
acaacccaaauacauuccccauac

SEQ ID NO: 828282 - RNA, 24 nt, Human
acuaaaaucuuccacagaccauuc

SEQ ID NO: 828283 - RNA, 18 nt, Human
agagaaagaaggggcugc

SEQ ID NO: 828284 - RNA, 20 nt, Human
aggaauuaucacagcaucug

SEQ ID NO: 828285 - RNA, 19 nt, Human
agggaacagugaccuaaaa

SEQ ID NO: 828286 - RNA, 19 nt, Human
agguucccagucccccauc

SEQ ID NO: 828287 - RNA, 23 nt, Human
auacuaaaaucuuccacagacca

SEQ ID NO: 828288 - RNA, 19 nt, Human
aucuuccacagaccauuca

SEQ ID NO: 828289 - RNA, 25 nt, Human
caaaugccaaacuucaugcuuuagc

SEQ ID NO: 828290 - RNA, 23 nt, Human
cacaccagaccucucagaaggag

SEQ ID NO: 828291 - RNA, 23 nt, Human
cacagcaucugaggcuauauaag

SEQ ID NO: 828292 - RNA, 22 nt, Human
caccagaccucucagaaggagu

SEQ ID NO: 828293 - RNA, 21 nt, Human
caccuucuuuuucuuuugccc

SEQ ID NO: 828294 - RNA, 20 nt, Human
caggcaucagauaagauacu

SEQ ID NO: 828295 - RNA, 23 nt, Human
caugcuuuagcaagggaagaaaa

SEQ ID NO: 828296 - RNA, 18 nt, Human
cauucauuuagaaggggu

SEQ ID NO: 828297 - RNA, 20 nt, Human
ccugucaccuucuuuuucuu

SEQ ID NO: 828298 - RNA, 19 nt, Human
ccuucuuuuucuuuugccc

SEQ ID NO: 828299 - RNA, 20 nt, Human
ccuucuuuuucuuuugcccu

SEQ ID NO: 828300 - RNA, 21 nt, Human
cgggaucaagcggcccgccgg

SEQ ID NO: 828301 - RNA, 26 nt, Human
cuuugucaaggaagcaaggaaguuau

SEQ ID NO: 828302 - RNA, 20 nt, Human
gcagggaaaugaaagaacuc

SEQ ID NO: 828303 - RNA, 18 nt, Human
gggcucacaaaaacaggc

SEQ ID NO: 828304 - RNA, 26 nt, Human
uaaaaacaacccaaauacauucccca

SEQ ID NO: 828305 - RNA, 25 nt, Human
uacuaacacacuuaaggcucaaaaa

SEQ ID NO: 828306 - RNA, 19 nt, Human
uagcaagggaagaaaaggu

SEQ ID NO: 828307 - RNA, 19 nt, Human
uagcagggaaaugaaagaa

SEQ ID NO: 828308 - RNA, 24 nt, Human
ucaaaaagcaaaauuaaugcccaa

SEQ ID NO: 828309 - RNA, 18 nt, Human
ucaaggaagcaaggaagu

SEQ ID NO: 828310 - RNA, 27 nt, Human
ucaccuucuuuuucuuuugcccugaga

SEQ ID NO: 828311 - RNA, 24 nt, Human
ucauguacuaacaucaucaacacu

SEQ ID NO: 828312 - RNA, 21 nt, Human
uccccauacuacauacugauu

SEQ ID NO: 828313 - RNA, 18 nt, Human
ucccccguauuagcacca

SEQ ID NO: 828314 - RNA, 24 nt, Human
uccccuuuucuuuaaaaacaaccc

SEQ ID NO: 828315 - RNA, 18 nt, Human
ucgaagccugcuucacuu

SEQ ID NO: 828316 - RNA, 28 nt, Human
ucuccacauaaaugauaucucuguuaca

SEQ ID NO: 828317 - RNA, 20 nt, Human
ugagaagguggccuccuugu

SEQ ID NO: 828318 - RNA, 21 nt, Human
ugcaaagaucuuggaucccug

SEQ ID NO: 828319 - RNA, 25 nt, Human
ugcaaagaucuuggaucccuguucc

SEQ ID NO: 828320 - RNA, 20 nt, Human
ugcccaaacagccugugagg

SEQ ID NO: 828321 - RNA, 24 nt, Human
uucuccauccuacuaacacacuua

SEQ ID NO: 828322 - RNA, 24 nt, Human
uuuagcagggaaaugaaagaacuc

SEQ ID NO: 828323 - RNA, 26 nt, Human
uuuuuuuuguuuuuuuuuuuuuuuuu

SEQ ID NO: 828324 - RNA, 18 nt, Human
aacaguacauaaaagaaa

SEQ ID NO: 828325 - RNA, 21 nt, Human
acaacggucacaggccaggcc

SEQ ID NO: 828326 - RNA, 19 nt, Human
acuuugagagguccuaggg

SEQ ID NO: 828327 - RNA, 23 nt, Human
agaugcucauucucuuuuuuugg

SEQ ID NO: 828328 - RNA, 21 nt, Human
caacggucacaggccaggccu

SEQ ID NO: 828329 - RNA, 19 nt, Human
cagacaaggacaugcacca

SEQ ID NO: 828330 - RNA, 22 nt, Human
cagacaaggacaugcaccagug

SEQ ID NO: 828331 - RNA, 23 nt, Human
ccagauuccaguauccaucagca

SEQ ID NO: 828332 - RNA, 23 nt, Human
cccuaugguuacauguaugaaau

SEQ ID NO: 828333 - RNA, 18 nt, Human
cuacuuugagagguccua

SEQ ID NO: 828334 - RNA, 18 nt, Human
cucacuaucaugcucacu

SEQ ID NO: 828335 - RNA, 23 nt, Human
cuguguaugaauucugacuuccu

SEQ ID NO: 828336 - RNA, 18 nt, Human
cuguguuucacuguguau

SEQ ID NO: 828337 - RNA, 20 nt, Human
cuugaagacaauugcagauu

SEQ ID NO: 828338 - RNA, 19 nt, Human
uacaucugagcuccacaga

SEQ ID NO: 828339 - RNA, 21 nt, Human
uacccguauaaccuugaagac

SEQ ID NO: 828340 - RNA, 24 nt, Human
uaggcgaagcugaacuuugagaug

SEQ ID NO: 828341 - RNA, 24 nt, Human
ucacagagagaaaacugaaguagg

SEQ ID NO: 828342 - RNA, 22 nt, Human
ucacaggccaggccugugacau

SEQ ID NO: 828343 - RNA, 23 nt, Human
ucacagucacaugacugacaucc

SEQ ID NO: 828344 - RNA, 22 nt, Human
ucagucacagagagaaaacuga

SEQ ID NO: 828345 - RNA, 21 nt, Human
ucugccagggaccagauucca

SEQ ID NO: 828346 - RNA, 19 nt, Human
ugaaaggugaggcugaugu

SEQ ID NO: 828347 - RNA, 21 nt, Human
ugaaauagugaaaggugaggc

SEQ ID NO: 828348 - RNA, 21 nt, Human
ugaagacaauugcagauuaca

SEQ ID NO: 828349 - RNA, 19 nt, Human
ugaaguaggcgaagcugaa

SEQ ID NO: 828350 - RNA, 20 nt, Human
ugagagguccuagggucaca

SEQ ID NO: 828351 - RNA, 18 nt, Human
ugcacuaguaagcuuuaa

SEQ ID NO: 828352 - RNA, 20 nt, Human
ugccagggaccagauuccag

SEQ ID NO: 828353 - RNA, 21 nt, Human
uucacuguguaugaauucuga

SEQ ID NO: 828354 - RNA, 19 nt, Human
uuuaaaguaucuugccugg

SEQ ID NO: 828355 - RNA, 21 nt, Human
aaaaaacagcagaaauaaaau

SEQ ID NO: 828356 - RNA, 24 nt, Human
aaaacagcagaaauaaaagggagc

SEQ ID NO: 828357 - RNA, 24 nt, Human
aaaguccauuugauaacaaagcaa

SEQ ID NO: 828358 - RNA, 19 nt, Human
aacauggugaaaccccguc

SEQ ID NO: 828359 - RNA, 20 nt, Human
aacauggugaaaccccgucu

SEQ ID NO: 828360 - RNA, 23 nt, Human
aagaguucaagaccagucuggcc

SEQ ID NO: 828361 - RNA, 18 nt, Human
aagcaggagaaucacuug

SEQ ID NO: 828362 - RNA, 24 nt, Human
aagcaggagaaucacuugaacccg

SEQ ID NO: 828363 - RNA, 25 nt, Human
aagcaggagaaucacuugaacccgg

SEQ ID NO: 828364 - RNA, 22 nt, Human
aaggugagcguaugcugguaug

SEQ ID NO: 828365 - RNA, 22 nt, Human
aagugcuacaccaggaauaugu

SEQ ID NO: 828366 - RNA, 24 nt, Human
aaucacuugaacccgggaggcgga

SEQ ID NO: 828367 - RNA, 23 nt, Human
aauggcucaugccuguaauccca

SEQ ID NO: 828368 - RNA, 24 nt, Human
aauggcucaugccuguaaucccag

SEQ ID NO: 828369 - RNA, 20 nt, Human
acaagagugaaacuccgucu

SEQ ID NO: 828370 - RNA, 21 nt, Human
acaagagugaaacuccgucuc

SEQ ID NO: 828371 - RNA, 23 nt, Human
acaagauggggcuauacacucaa

SEQ ID NO: 828372 - RNA, 21 nt, Human
acagcagaaauaaaauucuug

SEQ ID NO: 828373 - RNA, 22 nt, Human
acuccagccugggugacaagag

SEQ ID NO: 828374 - RNA, 25 nt, Human
acuccagccugggugacaagaguga

SEQ ID NO: 828375 - RNA, 25 nt, Human
acuguacuccagccugggugacaag

SEQ ID NO: 828376 - RNA, 24 nt, Human
agcacuuugggaggcugagguggg

SEQ ID NO: 828377 - RNA, 23 nt, Human
agccaggcgugguagugugugcc

SEQ ID NO: 828378 - RNA, 24 nt, Human
aggcggagguugccauaagccgag

SEQ ID NO: 828379 - RNA, 24 nt, Human
aggcgugguagugugugccuguaa

SEQ ID NO: 828380 - RNA, 24 nt, Human
aggcugagguggguggaucaccug

SEQ ID NO: 828381 - RNA, 22 nt, Human
agguggguggaucaccugaggu

SEQ ID NO: 828382 - RNA, 22 nt, Human
agucuggccaacauggugaaac

SEQ ID NO: 828383 - RNA, 24 nt, Human
agucuggccaacauggugaaaccc

SEQ ID NO: 828384 - RNA, 22 nt, Human
auaaaacacagauaguaaaagc

SEQ ID NO: 828385 - RNA, 24 nt, Human
aucgugccacuguacuccagccug

SEQ ID NO: 828386 - RNA, 18 nt, Human
aucugcaaagcucuccuu

SEQ ID NO: 828387 - RNA, 19 nt, Human
augccuguaaucccagcac

SEQ ID NO: 828388 - RNA, 22 nt, Human
caaagccccucagucuccuucc

SEQ ID NO: 828389 - RNA, 23 nt, Human
caaagccccucagucuccuucca

SEQ ID NO: 828390 - RNA, 25 nt, Human
caacaugaauucaagcucuggcucu

SEQ ID NO: 828391 - RNA, 20 nt, Human
caacauggucucuaggcuga

SEQ ID NO: 828392 - RNA, 21 nt, Human
caacauggugaaaccccgucu

SEQ ID NO: 828393 - RNA, 24 nt, Human
caagaccagucuggccaacauggu

SEQ ID NO: 828394 - RNA, 23 nt, Human
cacagauaguaaaagcacugaaa

SEQ ID NO: 828395 - RNA, 25 nt, Human
cacuauaucuuucauaaaauaaaca

SEQ ID NO: 828396 - RNA, 19 nt, Human
cacuguacuccagccuggg

SEQ ID NO: 828397 - RNA, 19 nt, Human
cacuguacuccagccuggg

SEQ ID NO: 828398 - RNA, 19 nt, Human
cacuguacuccagccuggg

SEQ ID NO: 828399 - RNA, 22 nt, Human
cacuguacuccagccuggguga

SEQ ID NO: 828400 - RNA, 23 nt, Human
cacuguacuccagccugggugac

SEQ ID NO: 828401 - RNA, 24 nt, Human
cacuguacuccagccugggugaca

SEQ ID NO: 828402 - RNA, 25 nt, Human
cacuguacuccagccugggugacaa

SEQ ID NO: 828403 - RNA, 21 nt, Human
cacuuuguuaauaauuaaggg

SEQ ID NO: 828404 - RNA, 24 nt, Human
cagcacuuugggaggcugaggugg

SEQ ID NO: 828405 - RNA, 20 nt, Human
caugccuguaaucccagcac

SEQ ID NO: 828406 - RNA, 24 nt, Human
caugccuguaaucccagcacuuug

SEQ ID NO: 828407 - RNA, 20 nt, Human
ccacuguacuccagccuggg

SEQ ID NO: 828408 - RNA, 20 nt, Human
ccacuguacuccagccuggg

SEQ ID NO: 828409 - RNA, 20 nt, Human
ccacuguacuccagccuggg

SEQ ID NO: 828410 - RNA, 21 nt, Human
ccacuguacuccagccugggu

SEQ ID NO: 828411 - RNA, 21 nt, Human
ccacuguacuccagccugggu

SEQ ID NO: 828412 - RNA, 24 nt, Human
ccacuguacuccagccugggugac

SEQ ID NO: 828413 - RNA, 20 nt, Human
cccagcuaagcaaucccaua

SEQ ID NO: 828414 - RNA, 22 nt, Human
ccuguaaucccagcacuuuggg

SEQ ID NO: 828415 - RNA, 19 nt, Human
ccuguaaucccagcuacuc

SEQ ID NO: 828416 - RNA, 21 nt, Human
ccuguaaucccagcuacucgg

SEQ ID NO: 828417 - RNA, 24 nt, Human
cgggaagcugaagcaggagaauca

SEQ ID NO: 828418 - RNA, 23 nt, Human
cuaagcaaucccauaaaaaugag

SEQ ID NO: 828419 - RNA, 24 nt, Human
cucaugccuguaaucccagcacuu

SEQ ID NO: 828420 - RNA, 21 nt, Human
cugcagcgugcggcgaagucc

SEQ ID NO: 828421 - RNA, 22 nt, Human
cuggccaacauggugaaacccc

SEQ ID NO: 828422 - RNA, 23 nt, Human
gacuuaguuccuuucuuuagcag

SEQ ID NO: 828423 - RNA, 23 nt, Human
gagaaucacuugaacccgggagg

SEQ ID NO: 828424 - RNA, 23 nt, Human
gagguggguggaucaccugaggu

SEQ ID NO: 828425 - RNA, 23 nt, Human
gaucaccugaggucaagaguuca

SEQ ID NO: 828426 - RNA, 24 nt, Human
gaucaccugaggucaagaguucaa

SEQ ID NO: 828427 - RNA, 21 nt, Human
gcagaaauaaaauucuuggca

SEQ ID NO: 828428 - RNA, 18 nt, Human
gcagcaaaaaaaacagca

SEQ ID NO: 828429 - RNA, 22 nt, Human
gccaacauggugaaaccccguc

SEQ ID NO: 828430 - RNA, 19 nt, Human
gccacuguacuccagccug

SEQ ID NO: 828431 - RNA, 24 nt, Human
gccacuguacuccagccuggguga

SEQ ID NO: 828432 - RNA, 23 nt, Human
gcgaaguccgggcaggccccgaa

SEQ ID NO: 828433 - RNA, 23 nt, Human
ggaaacacaugaggaaagucaac

SEQ ID NO: 828434 - RNA, 22 nt, Human
ggaagggaugaaagaguucucu

SEQ ID NO: 828435 - RNA, 24 nt, Human
ggagguugccauaagccgagaucg

SEQ ID NO: 828436 - RNA, 19 nt, Human
ggccauuauuauugucucu

SEQ ID NO: 828437 - RNA, 23 nt, Human
ggccgggcgcaauggcucaugcc

SEQ ID NO: 828438 - RNA, 21 nt, Human
ggcucaugccuguaaucccag

SEQ ID NO: 828439 - RNA, 24 nt, Human
gggcgcaauggcucaugccuguaa

SEQ ID NO: 828440 - RNA, 24 nt, Human
gguagugugugccuguaaucccag

SEQ ID NO: 828441 - RNA, 22 nt, Human
ggugugagccuucaggcagagu

SEQ ID NO: 828442 - RNA, 25 nt, Human
guacuccagccugggugacaagagu

SEQ ID NO: 828443 - RNA, 21 nt, Human
gugugagccuucaggcagagu

SEQ ID NO: 828444 - RNA, 21 nt, Human
uaaaaauacaaaaauuagcca

SEQ ID NO: 828445 - RNA, 22 nt, Human
uaaagucaggaccuugccaacu

SEQ ID NO: 828446 - RNA, 22 nt, Human
uaagccgagaucgugccacugu

SEQ ID NO: 828447 - RNA, 24 nt, Human
uaaggccgggcgcaauggcucaug

SEQ ID NO: 828448 - RNA, 23 nt, Human
uacuccagccugggugacaagag

SEQ ID NO: 828449 - RNA, 25 nt, Human
uacuccagccugggugacaagagug

SEQ ID NO: 828450 - RNA, 24 nt, Human
uagacaaccugagauauguuguuc

SEQ ID NO: 828451 - RNA, 21 nt, Human
uagauaaagugcuuagccuag

SEQ ID NO: 828452 - RNA, 19 nt, Human
uagcagcaaaaaaaacagc

SEQ ID NO: 828453 - RNA, 21 nt, Human
uagucuagcgauucuggagca

SEQ ID NO: 828454 - RNA, 24 nt, Human
uagugugugccuguaaucccagcu

SEQ ID NO: 828455 - RNA, 24 nt, Human
ucacuugaacccgggaggcggagg

SEQ ID NO: 828456 - RNA, 25 nt, Human
ucagaccaacaugaauucaagcucu

SEQ ID NO: 828457 - RNA, 19 nt, Human
ucagucuccuuccagagag

SEQ ID NO: 828458 - RNA, 22 nt, Human
ucaugccuguaaucccagcacu

SEQ ID NO: 828459 - RNA, 19 nt, Human
uccagccugggugacaaga

SEQ ID NO: 828460 - RNA, 23 nt, Human
ucgugccacuguacuccagccug

SEQ ID NO: 828461 - RNA, 20 nt, Human
ucucaaaaaacaaaaacaaa

SEQ ID NO: 828462 - RNA, 20 nt, Human
ucucuugcuuauuguuuagu

SEQ ID NO: 828463 - RNA, 24 nt, Human
ucuggccaacauggugaaaccccg

SEQ ID NO: 828464 - RNA, 26 nt, Human
ucuuucauaaaauaaacaaaaaguau

SEQ ID NO: 828465 - RNA, 20 nt, Human
ugaagcaggagaaucacuug

SEQ ID NO: 828466 - RNA, 24 nt, Human
ugaagcaggagaaucacuugaacc

SEQ ID NO: 828467 - RNA, 21 nt, Human
ugacucacuucauuugaauag

SEQ ID NO: 828468 - RNA, 24 nt, Human
ugagccuucaggcagaguguggug

SEQ ID NO: 828469 - RNA, 18 nt, Human
ugaggaaagucaacaugg

SEQ ID NO: 828470 - RNA, 20 nt, Human
ugagguggguggaucaccug

SEQ ID NO: 828471 - RNA, 24 nt, Human
ugagguggguggaucaccugaggu

SEQ ID NO: 828472 - RNA, 26 nt, Human
ugagguggguggaucaccugagguca

SEQ ID NO: 828473 - RNA, 18 nt, Human
ugaguuuauuugaugccu

SEQ ID NO: 828474 - RNA, 23 nt, Human
ugccauaagccgagaucgugcca

SEQ ID NO: 828475 - RNA, 18 nt, Human
ugccugaacuuaaaucac

SEQ ID NO: 828476 - RNA, 23 nt, Human
ugccuguaaucccagcacuuugg

SEQ ID NO: 828477 - RNA, 24 nt, Human
ugccuguaaucccagcuacucggg

SEQ ID NO: 828478 - RNA, 22 nt, Human
ugcuacaccaggaauauguaug

SEQ ID NO: 828479 - RNA, 24 nt, Human
uggaucaccugaggucaagaguuc

SEQ ID NO: 828480 - RNA, 27 nt, Human
uggaucaccugaggucaagaguucaag

SEQ ID NO: 828481 - RNA, 24 nt, Human
uggccaacauggugaaaccccguc

SEQ ID NO: 828482 - RNA, 24 nt, Human
uggcucaugccuguaaucccagca

SEQ ID NO: 828483 - RNA, 20 nt, Human
ugggaggcugaggugggugg

SEQ ID NO: 828484 - RNA, 23 nt, Human
ugggaggcugagguggguggauc

SEQ ID NO: 828485 - RNA, 24 nt, Human
ugggaggcugagguggguggauca

SEQ ID NO: 828486 - RNA, 24 nt, Human
uggguggaucaccugaggucaaga

SEQ ID NO: 828487 - RNA, 24 nt, Human
ugguagugugugccuguaauccca

SEQ ID NO: 828488 - RNA, 19 nt, Human
ugguaugaggugugagccu

SEQ ID NO: 828489 - RNA, 19 nt, Human
ugugagccuucaggcagag

SEQ ID NO: 828490 - RNA, 18 nt, Human
uguggugucauuguucuu

SEQ ID NO: 828491 - RNA, 21 nt, Human
uguuugaaggacccacacucu

SEQ ID NO: 828492 - RNA, 30 nt, Human
uuaaggauaggcuauuuuguuaucugcaaa

SEQ ID NO: 828493 - RNA, 24 nt, Human
uuagcagcaaaaaaaacagcagaa

SEQ ID NO: 828494 - RNA, 23 nt, Human
uucaggcagaguguggugucauu

SEQ ID NO: 828495 - RNA, 23 nt, Human
uucccuuaagucucaguuuacuc

SEQ ID NO: 828496 - RNA, 21 nt, Human
uuccuugacuaagaauucuag

SEQ ID NO: 828497 - RNA, 24 nt, Human
uugaacccgggaggcggagguugc

SEQ ID NO: 828498 - RNA, 28 nt, Human
uugaauagaagaugguggucggacuucc

SEQ ID NO: 828499 - RNA, 22 nt, Human
uuggcaggcugcucuacagaau

SEQ ID NO: 828500 - RNA, 25 nt, Human
uugggaggcugagguggguggauca

SEQ ID NO: 828501 - RNA, 19 nt, Human
uugguuagcgaaguuucuc

SEQ ID NO: 828502 - RNA, 20 nt, Human
uuuaaaguggaaaaggaguu

SEQ ID NO: 828503 - RNA, 22 nt, Human
uuuacaaagccccucagucucc

SEQ ID NO: 828504 - RNA, 20 nt, Human
uuucccaacauccauccugg

SEQ ID NO: 828505 - RNA, 19 nt, Human
uuugaaggacccacacucu

SEQ ID NO: 828506 - RNA, 23 nt, Human
aaacaugcaaacacuacagagaa

SEQ ID NO: 828507 - RNA, 21 nt, Human
aaaccaaagaaccucaaacac

SEQ ID NO: 828508 - RNA, 18 nt, Human
aacaaagcuccagcugcc

SEQ ID NO: 828509 - RNA, 22 nt, Human
aaguaggaaggugucaacccag

SEQ ID NO: 828510 - RNA, 22 nt, Human
aaucuguaaauaaaaucuccuc

SEQ ID NO: 828511 - RNA, 24 nt, Human
acaaaaccaaagaaccucaaacac

SEQ ID NO: 828512 - RNA, 20 nt, Human
acaccaagaaacaugcaaac

SEQ ID NO: 828513 - RNA, 19 nt, Human
acccgcugccuccucgucu

SEQ ID NO: 828514 - RNA, 23 nt, Human
acucugaggcuucuuuaaaacac

SEQ ID NO: 828515 - RNA, 22 nt, Human
agacaacaaacaccaagaaaca

SEQ ID NO: 828516 - RNA, 23 nt, Human
agacaacaaacaccaagaaacau

SEQ ID NO: 828517 - RNA, 18 nt, Human
agacacccgcaucauagg

SEQ ID NO: 828518 - RNA, 22 nt, Human
agacgagaaguaccuaguccca

SEQ ID NO: 828519 - RNA, 24 nt, Human
agcccaucaacaggcccuggaggc

SEQ ID NO: 828520 - RNA, 21 nt, Human
aggcaggaccucuacugagug

SEQ ID NO: 828521 - RNA, 23 nt, Human
aggccagguaaaauaggaucagg

SEQ ID NO: 828522 - RNA, 23 nt, Human
aggccucccccugcagacaagga

SEQ ID NO: 828523 - RNA, 20 nt, Human
aucacccaaaaguagacaaa

SEQ ID NO: 828524 - RNA, 24 nt, Human
auggaagaaaccccacuuuauaca

SEQ ID NO: 828525 - RNA, 23 nt, Human
caaaaccaaagaaccucaaacac

SEQ ID NO: 828526 - RNA, 24 nt, Human
caaacacuacagagaaucuguaug

SEQ ID NO: 828527 - RNA, 19 nt, Human
caaagcagcuacccucagc

SEQ ID NO: 828528 - RNA, 20 nt, Human
caaagcccaucaacaggccc

SEQ ID NO: 828529 - RNA, 20 nt, Human
caagaaacaugcaaacacua

SEQ ID NO: 828530 - RNA, 21 nt, Human
caagaaacaugcaaacacuac

SEQ ID NO: 828531 - RNA, 22 nt, Human
caagacgagaaguaccuagucc

SEQ ID NO: 828532 - RNA, 19 nt, Human
caagauagacaccaccugu

SEQ ID NO: 828533 - RNA, 22 nt, Human
caagauagacaccaccuguucc

SEQ ID NO: 828534 - RNA, 23 nt, Human
caauauggaagaaaccccacuuu

SEQ ID NO: 828535 - RNA, 19 nt, Human
cacucugaggcuucuuuaa

SEQ ID NO: 828536 - RNA, 24 nt, Human
cagaagucuccccaacaaagcucc

SEQ ID NO: 828537 - RNA, 19 nt, Human
cagauuuuaaaaugacauu

SEQ ID NO: 828538 - RNA, 24 nt, Human
cagcaaagcagcuacccucagcuc

SEQ ID NO: 828539 - RNA, 18 nt, Human
cagcacgccccugcagaa

SEQ ID NO: 828540 - RNA, 18 nt, Human
cauauuuuauauugauga

SEQ ID NO: 828541 - RNA, 19 nt, Human
caugaaagaaaauaaugac

SEQ ID NO: 828542 - RNA, 19 nt, Human
caugacacaagccuuagcu

SEQ ID NO: 828543 - RNA, 21 nt, Human
caugacacaagccuuagcuca

SEQ ID NO: 828544 - RNA, 22 nt, Human
cauuauguuucucauaucuaua

SEQ ID NO: 828545 - RNA, 19 nt, Human
cauucauuccaaauuuaga

SEQ ID NO: 828546 - RNA, 24 nt, Human
ccaaaccaccccagcacgccccug

SEQ ID NO: 828547 - RNA, 21 nt, Human
ccacacauaaccacacaagua

SEQ ID NO: 828548 - RNA, 24 nt, Human
ccacagaacuggcuuuuacuaaca

SEQ ID NO: 828549 - RNA, 19 nt, Human
ccacggaacagcaccucug

SEQ ID NO: 828550 - RNA, 25 nt, Human
ccagaagucuccccaacaaagcucc

SEQ ID NO: 828551 - RNA, 22 nt, Human
ccagccccacacauaaccacac

SEQ ID NO: 828552 - RNA, 19 nt, Human
cccaaaaguagacaaaaaa

SEQ ID NO: 828553 - RNA, 18 nt, Human
cccaucaacaggcccugg

SEQ ID NO: 828554 - RNA, 22 nt, Human
ccccaacaaagcuccagcugcc

SEQ ID NO: 828555 - RNA, 19 nt, Human
cccgcugccuccucgucug

SEQ ID NO: 828556 - RNA, 22 nt, Human
ccgccgccuccuccgagggccc

SEQ ID NO: 828557 - RNA, 24 nt, Human
ccgccgccuccuccgagggcccgc

SEQ ID NO: 828558 - RNA, 23 nt, Human
ccugcaaagcccaucaacaggcc

SEQ ID NO: 828559 - RNA, 18 nt, Human
cgccccgccgccgccucc

SEQ ID NO: 828560 - RNA, 18 nt, Human
cgccccgccgccgccucc

SEQ ID NO: 828561 - RNA, 25 nt, Human
cgcugcagcucgccccgccgccgcc

SEQ ID NO: 828562 - RNA, 19 nt, Human
cucacaagacgagaaguac

SEQ ID NO: 828563 - RNA, 18 nt, Human
cucaggaauagaagggcc

SEQ ID NO: 828564 - RNA, 18 nt, Human
cuccccaacaaagcucca

SEQ ID NO: 828565 - RNA, 25 nt, Human
cugcagcaaacagacucuccaggca

SEQ ID NO: 828566 - RNA, 23 nt, Human
cuggaacuguauuuacuuuucuu

SEQ ID NO: 828567 - RNA, 22 nt, Human
cuuagcucacaagacgagaagu

SEQ ID NO: 828568 - RNA, 18 nt, Human
gacacugccauacauuca

SEQ ID NO: 828569 - RNA, 21 nt, Human
gacacuggggcugggaaaugc

SEQ ID NO: 828570 - RNA, 27 nt, Human
gacacuggggcugggaaaugcucaggc

SEQ ID NO: 828571 - RNA, 18 nt, Human
gagaggggcugcccugga

SEQ ID NO: 828572 - RNA, 21 nt, Human
gagcaccgugcuggcuguguu

SEQ ID NO: 828573 - RNA, 20 nt, Human
gaggcaggaccucuacugag

SEQ ID NO: 828574 - RNA, 19 nt, Human
gcugccuccucgucugaga

SEQ ID NO: 828575 - RNA, 20 nt, Human
ggaaaugcucaggccucccc

SEQ ID NO: 828576 - RNA, 21 nt, Human
ggaacagcaccucugaugaca

SEQ ID NO: 828577 - RNA, 18 nt, Human
ggaguggucgcucccuca

SEQ ID NO: 828578 - RNA, 24 nt, Human
ggcuucuuuaaaacacgaagguga

SEQ ID NO: 828579 - RNA, 19 nt, Human
ggcuuuuacuaacaaaacc

SEQ ID NO: 828580 - RNA, 24 nt, Human
gggaacaauguuauuuggaugaga

SEQ ID NO: 828581 - RNA, 24 nt, Human
gggcugcuggacugccugcaaagc

SEQ ID NO: 828582 - RNA, 20 nt, Human
gguaaauguucuggaacugc

SEQ ID NO: 828583 - RNA, 20 nt, Human
gguccuguccguccuuggag

SEQ ID NO: 828584 - RNA, 19 nt, Human
guacggcgcgcgggcgggg

SEQ ID NO: 828585 - RNA, 22 nt, Human
gucugcagcaaacagacucucc

SEQ ID NO: 828586 - RNA, 23 nt, Human
uaaaacagcuuacaccuggagac

SEQ ID NO: 828587 - RNA, 27 nt, Human
uaaaauaggaucaggaugauuucuauu

SEQ ID NO: 828588 - RNA, 21 nt, Human
uaaccacacaaguaaaaagga

SEQ ID NO: 828589 - RNA, 23 nt, Human
uaauguugauaaacugaggugga

SEQ ID NO: 828590 - RNA, 18 nt, Human
uacaguguggccaucaaa

SEQ ID NO: 828591 - RNA, 19 nt, Human
uaggaggagcgaggccgcg

SEQ ID NO: 828592 - RNA, 21 nt, Human
ucaggagcaagggugucugca

SEQ ID NO: 828593 - RNA, 24 nt, Human
ucaggcacuaagcaaucuggcggc

SEQ ID NO: 828594 - RNA, 22 nt, Human
ucaggccucccccugcagacaa

SEQ ID NO: 828595 - RNA, 18 nt, Human
uccaaaagguugaaguaa

SEQ ID NO: 828596 - RNA, 19 nt, Human
uccugucccggcgcugcag

SEQ ID NO: 828597 - RNA, 26 nt, Human
ucuaacaugaaagaaaauaaugacuc

SEQ ID NO: 828598 - RNA, 21 nt, Human
ucugagaggggcugcccugga

SEQ ID NO: 828599 - RNA, 19 nt, Human
ucugcaauaacccaucugg

SEQ ID NO: 828600 - RNA, 20 nt, Human
ucugcagacaccuggcugca

SEQ ID NO: 828601 - RNA, 23 nt, Human
ucugucaauccucuguccuguga

SEQ ID NO: 828602 - RNA, 20 nt, Human
ucuuuaaaacacgaagguga

SEQ ID NO: 828603 - RNA, 19 nt, Human
ugacauuaugcauguacau

SEQ ID NO: 828604 - RNA, 19 nt, Human
ugacucaggagcaagggug

SEQ ID NO: 828605 - RNA, 24 nt, Human
ugagauguucugaaaucugauuca

SEQ ID NO: 828606 - RNA, 24 nt, Human
ugaggcagggguuaaugcagaacc

SEQ ID NO: 828607 - RNA, 18 nt, Human
ugcaauaacccaucugga

SEQ ID NO: 828608 - RNA, 18 nt, Human
ugcagacaccuggcugca

SEQ ID NO: 828609 - RNA, 20 nt, Human
ugcaggugugggcugcugga

SEQ ID NO: 828610 - RNA, 20 nt, Human
uggagagcaccgugcuggcu

SEQ ID NO: 828611 - RNA, 18 nt, Human
uggcugcacccgcugccu

SEQ ID NO: 828612 - RNA, 24 nt, Human
uggcugcucugcagacaccuggcu

SEQ ID NO: 828613 - RNA, 18 nt, Human
ugggaaagcucccuuugg

SEQ ID NO: 828614 - RNA, 20 nt, Human
ugggaaaugcucaggccucc

SEQ ID NO: 828615 - RNA, 23 nt, Human
ugggaaaugcucaggccuccccc

SEQ ID NO: 828616 - RNA, 22 nt, Human
ugucaauauggaagaaacccca

SEQ ID NO: 828617 - RNA, 22 nt, Human
ugugacggugucugcuucucuu

SEQ ID NO: 828618 - RNA, 19 nt, Human
ugugguggguggggaggau

SEQ ID NO: 828619 - RNA, 21 nt, Human
uguucccucauuugucaauau

SEQ ID NO: 828620 - RNA, 22 nt, Human
uuagacacauuuuagagaacac

SEQ ID NO: 828621 - RNA, 22 nt, Human
uucaaauucuuuccuucagauu

SEQ ID NO: 828622 - RNA, 21 nt, Human
uuucaggauucccaguuguuu

SEQ ID NO: 828623 - RNA, 21 nt, Human
uuuuguggacuucaaauucuu

SEQ ID NO: 828624 - RNA, 26 nt, Human
aaaaaaaaaaaaaaucacaccgggag

SEQ ID NO: 828625 - RNA, 22 nt, Human
aaaaaaaaaaaucacaccggga

SEQ ID NO: 828626 - RNA, 25 nt, Human
aaaaaaaaaaaucacaccgggagac

SEQ ID NO: 828627 - RNA, 20 nt, Human
aaaaaagaucaaccgauaua

SEQ ID NO: 828628 - RNA, 23 nt, Human
aaaaacaaauacuuuaggacuug

SEQ ID NO: 828629 - RNA, 20 nt, Human
aaaaaguauccauuuuuccc

SEQ ID NO: 828630 - RNA, 24 nt, Human
aaaaugcaacacugcuuuaaaaca

SEQ ID NO: 828631 - RNA, 22 nt, Human
aaaauuccccuuccugcuuucc

SEQ ID NO: 828632 - RNA, 19 nt, Human
aaauucuccacugucuuuu

SEQ ID NO: 828633 - RNA, 23 nt, Human
aaccuguucccugccacauccag

SEQ ID NO: 828634 - RNA, 19 nt, Human
aacuaucucucaucaguag

SEQ ID NO: 828635 - RNA, 18 nt, Human
aagauaaaauaacaaaaa

SEQ ID NO: 828636 - RNA, 20 nt, Human
aagaugaggcggaguagagg

SEQ ID NO: 828637 - RNA, 22 nt, Human
aagaugccauuguuuacaacug

SEQ ID NO: 828638 - RNA, 19 nt, Human
aagcagacaggaacgucuc

SEQ ID NO: 828639 - RNA, 25 nt, Human
aagcauuugacauuuuugaucccuu

SEQ ID NO: 828640 - RNA, 19 nt, Human
aaguggacgguacaaauaa

SEQ ID NO: 828641 - RNA, 18 nt, Human
acaaauggcacauaccau

SEQ ID NO: 828642 - RNA, 21 nt, Human
acacaggagguaaaacuugga

SEQ ID NO: 828643 - RNA, 23 nt, Human
acagaacacagugaggcugcagc

SEQ ID NO: 828644 - RNA, 24 nt, Human
acaggaacgucucgacagcagagg

SEQ ID NO: 828645 - RNA, 19 nt, Human
acaggcgcccgccaccacg

SEQ ID NO: 828646 - RNA, 24 nt, Human
acccgggcuggagugcaguggcgu

SEQ ID NO: 828647 - RNA, 18 nt, Human
acccucgcugcugcuuuc

SEQ ID NO: 828648 - RNA, 24 nt, Human
agacaaaaacaaaggucguauguu

SEQ ID NO: 828649 - RNA, 20 nt, Human
agagacaucuaaacacagca

SEQ ID NO: 828650 - RNA, 28 nt, Human
agagccuucaacuucaaggcagucaggg

SEQ ID NO: 828651 - RNA, 19 nt, Human
agccacagagccuucaacu

SEQ ID NO: 828652 - RNA, 25 nt, Human
agccacagagccuucaacuucaagg

SEQ ID NO: 828653 - RNA, 19 nt, Human
agggcguuucccggcccga

SEQ ID NO: 828654 - RNA, 18 nt, Human
aguagcugggacuacagg

SEQ ID NO: 828655 - RNA, 19 nt, Human
aguagcugggacuacaggc

SEQ ID NO: 828656 - RNA, 18 nt, Human
aguauccauuuuucccca

SEQ ID NO: 828657 - RNA, 24 nt, Human
agucaggccacugauuucuucagg

SEQ ID NO: 828658 - RNA, 19 nt, Human
agugcaguggcguggucuc

SEQ ID NO: 828659 - RNA, 20 nt, Human
agugcaguggcguggucucg

SEQ ID NO: 828660 - RNA, 23 nt, Human
agugcaguggcguggucucggcu

SEQ ID NO: 828661 - RNA, 24 nt, Human
agugcaguggcguggucucggcuc

SEQ ID NO: 828662 - RNA, 22 nt, Human
aguuaugagguguuugcaccac

SEQ ID NO: 828663 - RNA, 25 nt, Human
auccaagacaugagcauggcccaau

SEQ ID NO: 828664 - RNA, 24 nt, Human
augcaacacugcuuuaaaacacca

SEQ ID NO: 828665 - RNA, 21 nt, Human
caaccuuagccucccggguuc

SEQ ID NO: 828666 - RNA, 18 nt, Human
cacacuguucaaagaugc

SEQ ID NO: 828667 - RNA, 24 nt, Human
cacccgggcuggagugcaguggcg

SEQ ID NO: 828668 - RNA, 19 nt, Human
cacuccacgggaagauggc

SEQ ID NO: 828669 - RNA, 20 nt, Human
cacugcaaccuuagccuccc

SEQ ID NO: 828670 - RNA, 21 nt, Human
cacugcaaccuuagccucccg

SEQ ID NO: 828671 - RNA, 23 nt, Human
cacugcaaccuuagccucccggg

SEQ ID NO: 828672 - RNA, 22 nt, Human
cagaacacagugaggcugcagc

SEQ ID NO: 828673 - RNA, 19 nt, Human
cagaauuuaaaugccucuc

SEQ ID NO: 828674 - RNA, 21 nt, Human
cagcacuuuacggaagggagg

SEQ ID NO: 828675 - RNA, 21 nt, Human
cagcauuuccaccucccuugc

SEQ ID NO: 828676 - RNA, 20 nt, Human
cagccggugccuccacuccc

SEQ ID NO: 828677 - RNA, 19 nt, Human
cagcgaggcagauucucuu

SEQ ID NO: 828678 - RNA, 23 nt, Human
caggauacaguaaggcacaagug

SEQ ID NO: 828679 - RNA, 22 nt, Human
caggcaauucucuugccucagc

SEQ ID NO: 828680 - RNA, 21 nt, Human
caggcgcccgccaccacgccu

SEQ ID NO: 828681 - RNA, 18 nt, Human
caucagagacaucauuua

SEQ ID NO: 828682 - RNA, 23 nt, Human
caugugcuuuaacuccccugggu

SEQ ID NO: 828683 - RNA, 21 nt, Human
cauuuaaaauccuauaaauuc

SEQ ID NO: 828684 - RNA, 21 nt, Human
ccacacuccacgggaagaugg

SEQ ID NO: 828685 - RNA, 19 nt, Human
ccagcagcagcuccuccag

SEQ ID NO: 828686 - RNA, 26 nt, Human
ccaguguucucuuuuuguguuuuucu

SEQ ID NO: 828687 - RNA, 20 nt, Human
ccccaacauaagacaaaaac

SEQ ID NO: 828688 - RNA, 23 nt, Human
cccgaguagcugggacuacaggc

SEQ ID NO: 828689 - RNA, 24 nt, Human
cccgaguagcugggacuacaggcg

SEQ ID NO: 828690 - RNA, 22 nt, Human
cccggcgaccugcauccagaga

SEQ ID NO: 828691 - RNA, 20 nt, Human
cccggguucaggcaauucuc

SEQ ID NO: 828692 - RNA, 22 nt, Human
ccgccagucgccgucgccgccc

SEQ ID NO: 828693 - RNA, 19 nt, Human
ccgcucuggccggcggcuc

SEQ ID NO: 828694 - RNA, 20 nt, Human
ccgcucuggccggcggcucc

SEQ ID NO: 828695 - RNA, 22 nt, Human
ccgggcauagcgguagaucucc

SEQ ID NO: 828696 - RNA, 20 nt, Human
ccgucgccgcccccgccgcc

SEQ ID NO: 828697 - RNA, 22 nt, Human
ccgucgccgcccccgccgccgc

SEQ ID NO: 828698 - RNA, 23 nt, Human
ccucccggguucaggcaauucuc

SEQ ID NO: 828699 - RNA, 18 nt, Human
ccucggggacguagacca

SEQ ID NO: 828700 - RNA, 18 nt, Human
ccuguacccccgcccgcc

SEQ ID NO: 828701 - RNA, 18 nt, Human
ccugugguguagucugug

SEQ ID NO: 828702 - RNA, 19 nt, Human
cgccgcccccgccgccgcc

SEQ ID NO: 828703 - RNA, 20 nt, Human
cgcgcggacugagcaugcgc

SEQ ID NO: 828704 - RNA, 24 nt, Human
cgcucugucacccgggcuggagug

SEQ ID NO: 828705 - RNA, 21 nt, Human
cgcugcugcuuucguggcugc

SEQ ID NO: 828706 - RNA, 20 nt, Human
cggcucacugcaaccuuagc

SEQ ID NO: 828707 - RNA, 27 nt, Human
cgggaagauggcgcgcgggggcugguu

SEQ ID NO: 828708 - RNA, 19 nt, Human
cgggccguuugaggaaggc

SEQ ID NO: 828709 - RNA, 24 nt, Human
cucacugcaaccuuagccucccgg

SEQ ID NO: 828710 - RNA, 24 nt, Human
cucagccucccgaguagcugggac

SEQ ID NO: 828711 - RNA, 19 nt, Human
cucauugucagcauuucca

SEQ ID NO: 828712 - RNA, 19 nt, Human
cuccacaugacgguugcac

SEQ ID NO: 828713 - RNA, 20 nt, Human
cuccacaugacgguugcacc

SEQ ID NO: 828714 - RNA, 20 nt, Human
cucccauuuaaaauccuaua

SEQ ID NO: 828715 - RNA, 18 nt, Human
cuccuccaggcuccgggc

SEQ ID NO: 828716 - RNA, 21 nt, Human
cucgcucugucacccgggcug

SEQ ID NO: 828717 - RNA, 24 nt, Human
cucgcucugucacccgggcuggag

SEQ ID NO: 828718 - RNA, 22 nt, Human
cucggcucacugcaaccuuagc

SEQ ID NO: 828719 - RNA, 22 nt, Human
cugaaauuaaaaaaaaaaaaaa

SEQ ID NO: 828720 - RNA, 24 nt, Human
cugaaccaguguucucuuuuugug

SEQ ID NO: 828721 - RNA, 23 nt, Human
cugcaaccuuagccucccggguu

SEQ ID NO: 828722 - RNA, 20 nt, Human
cugcagcacccgccgaucuc

SEQ ID NO: 828723 - RNA, 24 nt, Human
cugcagcacccgccgaucucuuuu

SEQ ID NO: 828724 - RNA, 23 nt, Human
cugcugcuuucguggcugcccgu

SEQ ID NO: 828725 - RNA, 22 nt, Human
cuggcuuuagcuucccauucac

SEQ ID NO: 828726 - RNA, 23 nt, Human
cuugccucagccucccgaguagc

SEQ ID NO: 828727 - RNA, 24 nt, Human
cuugccucagccucccgaguagcu

SEQ ID NO: 828728 - RNA, 21 nt, Human
cuuuagcagcauucaugucau

SEQ ID NO: 828729 - RNA, 20 nt, Human
gacagcagcuuccccacacu

SEQ ID NO: 828730 - RNA, 21 nt, Human
gacccgggcuccgagcccgcu

SEQ ID NO: 828731 - RNA, 24 nt, Human
gacgguacaaauaaaaacaaauac

SEQ ID NO: 828732 - RNA, 25 nt, Human
gaguagcugggacuacaggcgcccg

SEQ ID NO: 828733 - RNA, 20 nt, Human
gcacagucugacacugcacu

SEQ ID NO: 828734 - RNA, 21 nt, Human
gccguuugaggaaggcaggcu

SEQ ID NO: 828735 - RNA, 21 nt, Human
gcgccaggcgcuacuggauuc

SEQ ID NO: 828736 - RNA, 25 nt, Human
gcugcagcacccgccgaucucuuuu

SEQ ID NO: 828737 - RNA, 23 nt, Human
gcugccaaaaaagguuuaaaaag

SEQ ID NO: 828738 - RNA, 19 nt, Human
gcuggagugcaguggcgug

SEQ ID NO: 828739 - RNA, 18 nt, Human
gcugugaaaggacuuggg

SEQ ID NO: 828740 - RNA, 19 nt, Human
ggacugagcaugcgcgcca

SEQ ID NO: 828741 - RNA, 20 nt, Human
ggacugagcaugcgcgccag

SEQ ID NO: 828742 - RNA, 23 nt, Human
ggcugcccgugugcccgcugcuc

SEQ ID NO: 828743 - RNA, 20 nt, Human
ggcuggagugcaguggcgug

SEQ ID NO: 828744 - RNA, 23 nt, Human
gggaagauggcgcgcgggggcug

SEQ ID NO: 828745 - RNA, 20 nt, Human
gggagccccugccccguccc

SEQ ID NO: 828746 - RNA, 26 nt, Human
ggggauucaaaauaucccagcacuuu

SEQ ID NO: 828747 - RNA, 23 nt, Human
ggguguggaguggcucgccuuag

SEQ ID NO: 828748 - RNA, 20 nt, Human
gugcaguggcguggucucgg

SEQ ID NO: 828749 - RNA, 19 nt, Human
gugcgcugacugguugcgg

SEQ ID NO: 828750 - RNA, 18 nt, Human
uaaaaaacaacacaugcg

SEQ ID NO: 828751 - RNA, 25 nt, Human
uaaaugccucucaguccauacagcu

SEQ ID NO: 828752 - RNA, 20 nt, Human
uaacucagugagacuuucac

SEQ ID NO: 828753 - RNA, 20 nt, Human
uaacucagugagacuuucac

SEQ ID NO: 828754 - RNA, 20 nt, Human
uaagaacuaacucagugaga

SEQ ID NO: 828755 - RNA, 20 nt, Human
uaagaacuaacucagugaga

SEQ ID NO: 828756 - RNA, 23 nt, Human
uaauuuauuucugucugcauuca

SEQ ID NO: 828757 - RNA, 23 nt, Human
uaauuuauuucugucugcauuca

SEQ ID NO: 828758 - RNA, 22 nt, Human
uacaggcgcccgccaccacgcc

SEQ ID NO: 828759 - RNA, 22 nt, Human
uaccaucagaguaggcacaguc

SEQ ID NO: 828760 - RNA, 18 nt, Human
uacuuuaggacuuguuuu

SEQ ID NO: 828761 - RNA, 22 nt, Human
uagcagucaaauccuuugguuc

SEQ ID NO: 828762 - RNA, 23 nt, Human
uagccgggucccgagcggcggag

SEQ ID NO: 828763 - RNA, 22 nt, Human
uagccucccggguucaggcaau

SEQ ID NO: 828764 - RNA, 23 nt, Human
uagucugugucugucuggaaugu

SEQ ID NO: 828765 - RNA, 23 nt, Human
ucaaaaaucaaacccaaaggcau

SEQ ID NO: 828766 - RNA, 24 nt, Human
ucaaaauaucccagcacuuuacgg

SEQ ID NO: 828767 - RNA, 24 nt, Human
ucacauuccccaacugcuucaggc

SEQ ID NO: 828768 - RNA, 24 nt, Human
ucacauuccccaacugcuucaggc

SEQ ID NO: 828769 - RNA, 22 nt, Human
ucacccgggcuggagugcagug

SEQ ID NO: 828770 - RNA, 18 nt, Human
ucacugcaaccuuagccu

SEQ ID NO: 828771 - RNA, 23 nt, Human
ucacugcaaccuuagccucccgg

SEQ ID NO: 828772 - RNA, 24 nt, Human
ucacugcaaccuuagccucccggg

SEQ ID NO: 828773 - RNA, 21 nt, Human
ucagagacaucauuuaccaag

SEQ ID NO: 828774 - RNA, 19 nt, Human
ucagagacaucuaaacaca

SEQ ID NO: 828775 - RNA, 23 nt, Human
ucagccucccgaguagcugggac

SEQ ID NO: 828776 - RNA, 23 nt, Human
ucaggccacugauuucuucagga

SEQ ID NO: 828777 - RNA, 18 nt, Human
ucauugucagcauuucca

SEQ ID NO: 828778 - RNA, 21 nt, Human
uccaagacaugagcauggccc

SEQ ID NO: 828779 - RNA, 18 nt, Human
uccauacagcuacucucc

SEQ ID NO: 828780 - RNA, 19 nt, Human
uccauacagcuacucucca

SEQ ID NO: 828781 - RNA, 20 nt, Human
uccauacagcuacucuccac

SEQ ID NO: 828782 - RNA, 18 nt, Human
ucccauucaccuuccucu

SEQ ID NO: 828783 - RNA, 24 nt, Human
ucccgaguagcugggacuacaggc

SEQ ID NO: 828784 - RNA, 21 nt, Human
ucccggguucaggcaauucuc

SEQ ID NO: 828785 - RNA, 21 nt, Human
ucccggguucaggcaauucuc

SEQ ID NO: 828786 - RNA, 24 nt, Human
uccuccacaaaucggaucgcacug

SEQ ID NO: 828787 - RNA, 25 nt, Human
uccuccucauugucagcauuuccac

SEQ ID NO: 828788 - RNA, 23 nt, Human
ucgccgcccccgccgccgcgcgg

SEQ ID NO: 828789 - RNA, 24 nt, Human
ucgccgucgccgcccccgccgccg

SEQ ID NO: 828790 - RNA, 19 nt, Human
ucgcggagcugguuggcgu

SEQ ID NO: 828791 - RNA, 24 nt, Human
ucgcucugucacccgggcuggagu

SEQ ID NO: 828792 - RNA, 22 nt, Human
ucgcugcugcuuucguggcugc

SEQ ID NO: 828793 - RNA, 22 nt, Human
ucuccugugguguagucugugu

SEQ ID NO: 828794 - RNA, 19 nt, Human
ucucgcucugucacccggg

SEQ ID NO: 828795 - RNA, 23 nt, Human
ucucgcucugucacccgggcugg

SEQ ID NO: 828796 - RNA, 24 nt, Human
ucucgcucugucacccgggcugga

SEQ ID NO: 828797 - RNA, 27 nt, Human
ucugcuuacuccggcaaagacgggggc

SEQ ID NO: 828798 - RNA, 24 nt, Human
ucugucacccgggcuggagugcag

SEQ ID NO: 828799 - RNA, 22 nt, Human
ucuguugccugugacaccucug

SEQ ID NO: 828800 - RNA, 24 nt, Human
ucuucaucuuucucauccuccaca

SEQ ID NO: 828801 - RNA, 19 nt, Human
ugaaaggacuugggacaaa

SEQ ID NO: 828802 - RNA, 22 nt, Human
ugaaauaccuauacaaaauuuu

SEQ ID NO: 828803 - RNA, 18 nt, Human
ugacauaauuccuccagu

SEQ ID NO: 828804 - RNA, 19 nt, Human
ugacuaaauccguuaauga

SEQ ID NO: 828805 - RNA, 18 nt, Human
ugagauagagucucgcuc

SEQ ID NO: 828806 - RNA, 22 nt, Human
ugagauagagucucgcucuguc

SEQ ID NO: 828807 - RNA, 22 nt, Human
ugcacaaauacuaaaauaugua

SEQ ID NO: 828808 - RNA, 21 nt, Human
ugcaccacccucgcugcugcu

SEQ ID NO: 828809 - RNA, 22 nt, Human
ugcaguggcguggucucggcuc

SEQ ID NO: 828810 - RNA, 26 nt, Human
ugccccgucccuguacccccgcccgc

SEQ ID NO: 828811 - RNA, 24 nt, Human
ugccucagccucccgaguagcugg

SEQ ID NO: 828812 - RNA, 21 nt, Human
ugcucgggcagcucgcggagc

SEQ ID NO: 828813 - RNA, 18 nt, Human
uggaaaaauugcucgggc

SEQ ID NO: 828814 - RNA, 24 nt, Human
uggagcgggagccccugccccguc

SEQ ID NO: 828815 - RNA, 20 nt, Human
uggagugcaguggcgugguc

SEQ ID NO: 828816 - RNA, 23 nt, Human
uggagugcaguggcguggucucg

SEQ ID NO: 828817 - RNA, 24 nt, Human
uggagugcaguggcguggucucgg

SEQ ID NO: 828818 - RNA, 24 nt, Human
uggcugcccgugugcccgcugcuc

SEQ ID NO: 828819 - RNA, 21 nt, Human
ugggacuacaggcgcccgcca

SEQ ID NO: 828820 - RNA, 22 nt, Human
ugggacuacaggcgcccgccac

SEQ ID NO: 828821 - RNA, 24 nt, Human
ugggacuacaggcgcccgccacca

SEQ ID NO: 828822 - RNA, 22 nt, Human
uguagucugugucugucuggaa

SEQ ID NO: 828823 - RNA, 26 nt, Human
ugucaaucucuuucuuucucccauuu

SEQ ID NO: 828824 - RNA, 25 nt, Human
ugucuucuucaucuuucucauccuc

SEQ ID NO: 828825 - RNA, 26 nt, Human
uuaaaaugcaacacugcuuuaaaaca

SEQ ID NO: 828826 - RNA, 18 nt, Human
uucacauuccccaacugc

SEQ ID NO: 828827 - RNA, 18 nt, Human
uucacauuccccaacugc

SEQ ID NO: 828828 - RNA, 23 nt, Human
uuccaaccuguuuucagagacau

SEQ ID NO: 828829 - RNA, 19 nt, Human
uuccccuuccugcuuuccu

SEQ ID NO: 828830 - RNA, 21 nt, Human
uucucgcgccgggcuucgcgg

SEQ ID NO: 828831 - RNA, 28 nt, Human
uugcaccacccucgcugcugcuuucgug

SEQ ID NO: 828832 - RNA, 18 nt, Human
uuggcucuuggguuagcu

SEQ ID NO: 828833 - RNA, 19 nt, Human
uuuaaagcuuucuugaaua

SEQ ID NO: 828834 - RNA, 24 nt, Human
uuuaccaaguucuccagugcacca

SEQ ID NO: 828835 - RNA, 18 nt, Human
uuuagaguucacaccuuu

SEQ ID NO: 828836 - RNA, 24 nt, Human
uuucuuucucccauuuaaaauccu

SEQ ID NO: 828837 - RNA, 25 nt, Human
uuuuuuuuuuuugagauagagucuc

SEQ ID NO: 828838 - RNA, 18 nt, Human
uuuuuuuuuuuuuuuuug

SEQ ID NO: 828839 - RNA, 20 nt, Human
aaacaaagaugugaucacuc

SEQ ID NO: 828840 - RNA, 20 nt, Human
acuaccaccaccagauaggu

SEQ ID NO: 828841 - RNA, 19 nt, Human
agaaagaagagaauagcaa

SEQ ID NO: 828842 - RNA, 24 nt, Human
agauaggugugggggagaaagaag

SEQ ID NO: 828843 - RNA, 18 nt, Human
aggaacgcaaauauaaac

SEQ ID NO: 828844 - RNA, 23 nt, Human
auagcaaauggaguccaagaguu

SEQ ID NO: 828845 - RNA, 22 nt, Human
aucacucuauugcacacccaga

SEQ ID NO: 828846 - RNA, 20 nt, Human
auuagagaaucuggucuuag

SEQ ID NO: 828847 - RNA, 21 nt, Human
caaauauaaacgcccacuacc

SEQ ID NO: 828848 - RNA, 23 nt, Human
caaauauaaacgcccacuaccac

SEQ ID NO: 828849 - RNA, 19 nt, Human
caaauggaguccaagaguu

SEQ ID NO: 828850 - RNA, 18 nt, Human
caugaagaaacaaagaug

SEQ ID NO: 828851 - RNA, 23 nt, Human
caugaagaaacaaagaugugauc

SEQ ID NO: 828852 - RNA, 21 nt, Human
cccaacccaaaauuuuuaaga

SEQ ID NO: 828853 - RNA, 26 nt, Human
cuacuacucuccuuuucccuuuccug

SEQ ID NO: 828854 - RNA, 19 nt, Human
cuacucuccuuuucccuuu

SEQ ID NO: 828855 - RNA, 23 nt, Human
cuaucguacaugaagaaacaaag

SEQ ID NO: 828856 - RNA, 23 nt, Human
cucuccuuuucccuuuccugccu

SEQ ID NO: 828857 - RNA, 23 nt, Human
cuuuccugccuuccccaauaccc

SEQ ID NO: 828858 - RNA, 21 nt, Human
gagaaagaagagaauagcaaa

SEQ ID NO: 828859 - RNA, 23 nt, Human
gcacacccagaaacauuagagaa

SEQ ID NO: 828860 - RNA, 22 nt, Human
uaaauaaauugcuagggaauuc

SEQ ID NO: 828861 - RNA, 20 nt, Human
uaagagauuuagaaaugaau

SEQ ID NO: 828862 - RNA, 21 nt, Human
uaaggcaaaaauaguaaaacc

SEQ ID NO: 828863 - RNA, 21 nt, Human
uacaauaugaucauuaacaga

SEQ ID NO: 828864 - RNA, 19 nt, Human
uacccccaacccaaaauuu

SEQ ID NO: 828865 - RNA, 19 nt, Human
uacucuccuuuucccuuuc

SEQ ID NO: 828866 - RNA, 23 nt, Human
uccacaaugggagucaaugaaaa

SEQ ID NO: 828867 - RNA, 23 nt, Human
ugcuagggaauuccacaauggga

SEQ ID NO: 828868 - RNA, 24 nt, Human
uuaacagacuaguucuuauuugga

SEQ ID NO: 828869 - RNA, 22 nt, Human
uuagaaaugaaugaaaaggaac

SEQ ID NO: 828870 - RNA, 22 nt, Human
uuuuuuuuuuuuaaaagugauc

SEQ ID NO: 828871 - RNA, 23 nt, Human
uuuuuuuuuuuuuuuuuuaaaag

SEQ ID NO: 828872 - RNA, 20 nt, Human
aaaaaaacaagguggauaga

SEQ ID NO: 828873 - RNA, 24 nt, Human
aaaaaaauuccaaacacacaccua

SEQ ID NO: 828874 - RNA, 25 nt, Human
aaaaaacaaaagaaaaaaauuccaa

SEQ ID NO: 828875 - RNA, 23 nt, Human
aaaaacucugguuuucauaaucc

SEQ ID NO: 828876 - RNA, 24 nt, Human
aaaaagaaacuaguucuuucaaaa

SEQ ID NO: 828877 - RNA, 23 nt, Human
aaacaaaagaaaaaaauuccaaa

SEQ ID NO: 828878 - RNA, 19 nt, Human
aaacaagguggauagaucu

SEQ ID NO: 828879 - RNA, 18 nt, Human
aagaaaggacacaaaucc

SEQ ID NO: 828880 - RNA, 22 nt, Human
aaggacacaaaucccucucacu

SEQ ID NO: 828881 - RNA, 20 nt, Human
aaggaggggugggggcgaua

SEQ ID NO: 828882 - RNA, 22 nt, Human
aaguagcugggauuucaggcau

SEQ ID NO: 828883 - RNA, 21 nt, Human
acaauaaaaaaacaaggugga

SEQ ID NO: 828884 - RNA, 24 nt, Human
accauguuggccaggcuggucuug

SEQ ID NO: 828885 - RNA, 18 nt, Human
acgggguuucaccauguu

SEQ ID NO: 828886 - RNA, 23 nt, Human
acgggguuucaccauguuggcca

SEQ ID NO: 828887 - RNA, 24 nt, Human
acgggguuucaccauguuggccag

SEQ ID NO: 828888 - RNA, 21 nt, Human
acugcaaccuccgccucccgg

SEQ ID NO: 828889 - RNA, 21 nt, Human
acugcaaccuccgccucccgg

SEQ ID NO: 828890 - RNA, 22 nt, Human
acugcaaccuccgccucccggg

SEQ ID NO: 828891 - RNA, 22 nt, Human
agaaauacauuucacacccuuc

SEQ ID NO: 828892 - RNA, 19 nt, Human
agaggaaagacguuaaacc

SEQ ID NO: 828893 - RNA, 20 nt, Human
agaggaggagaagggggagg

SEQ ID NO: 828894 - RNA, 21 nt, Human
agaggaggagaagggggagga

SEQ ID NO: 828895 - RNA, 23 nt, Human
agaugcaaaguuauaacuaaacu

SEQ ID NO: 828896 - RNA, 19 nt, Human
aggaaaaaggagauguaaa

SEQ ID NO: 828897 - RNA, 19 nt, Human
aggaggagaagggggagga

SEQ ID NO: 828898 - RNA, 20 nt, Human
aggcaugcaccaccacgccc

SEQ ID NO: 828899 - RNA, 22 nt, Human
aggugauccaccugccuuggcc

SEQ ID NO: 828900 - RNA, 22 nt, Human
aguagagacgggguuucaccau

SEQ ID NO: 828901 - RNA, 23 nt, Human
aguagcugggauuucaggcaugc

SEQ ID NO: 828902 - RNA, 21 nt, Human
auucuccugccucagccuccc

SEQ ID NO: 828903 - RNA, 24 nt, Human
auuuuuguauuuuuaguagagacg

SEQ ID NO: 828904 - RNA, 25 nt, Human
caaaggguaaaugacaaagccaaug

SEQ ID NO: 828905 - RNA, 22 nt, Human
caagcaauucuccugccucagc

SEQ ID NO: 828906 - RNA, 27 nt, Human
caagcaauucuccugccucagccuccc

SEQ ID NO: 828907 - RNA, 21 nt, Human
caauucucagaacuugggaca

SEQ ID NO: 828908 - RNA, 22 nt, Human
caccaccacgcccagcuaauuu

SEQ ID NO: 828909 - RNA, 24 nt, Human
caccacgcccagcuaauuuuugua

SEQ ID NO: 828910 - RNA, 21 nt, Human
caccauguuggccaggcuggu

SEQ ID NO: 828911 - RNA, 22 nt, Human
caccauguuggccaggcugguc

SEQ ID NO: 828912 - RNA, 23 nt, Human
caccauguuggccaggcuggucu

SEQ ID NO: 828913 - RNA, 24 nt, Human
caccauguuggccaggcuggucuu

SEQ ID NO: 828914 - RNA, 20 nt, Human
caccccauccuucccgcacc

SEQ ID NO: 828915 - RNA, 25 nt, Human
caccuagaugaccuuucauuacuua

SEQ ID NO: 828916 - RNA, 22 nt, Human
cauaaaauguaucacgugcaua

SEQ ID NO: 828917 - RNA, 24 nt, Human
cauguuggccaggcuggucuugaa

SEQ ID NO: 828918 - RNA, 23 nt, Human
cauuuuuguugcccagacuggag

SEQ ID NO: 828919 - RNA, 24 nt, Human
cauuuuuguugcccagacuggagg

SEQ ID NO: 828920 - RNA, 18 nt, Human
cccaaguagcugggauuu

SEQ ID NO: 828921 - RNA, 24 nt, Human
cccauccuucccgcaccgccucug

SEQ ID NO: 828922 - RNA, 23 nt, Human
cccggguucaagcaauucuccug

SEQ ID NO: 828923 - RNA, 21 nt, Human
cccguccuaucucccaguacc

SEQ ID NO: 828924 - RNA, 18 nt, Human
ccgccgcccgucgcccgc

SEQ ID NO: 828925 - RNA, 20 nt, Human
ccgccgcccgucgcccgcca

SEQ ID NO: 828926 - RNA, 22 nt, Human
ccgccgccugcgucgucgcugc

SEQ ID NO: 828927 - RNA, 25 nt, Human
ccgccgccugcgucgucgcugcugu

SEQ ID NO: 828928 - RNA, 26 nt, Human
ccgccucccggguucaagcaauucuu

SEQ ID NO: 828929 - RNA, 24 nt, Human
ccucccggguucaagcaauucucc

SEQ ID NO: 828930 - RNA, 23 nt, Human
ccucugcccgccgcccgucgccc

SEQ ID NO: 828931 - RNA, 18 nt, Human
ccugagcugggucagcug

SEQ ID NO: 828932 - RNA, 23 nt, Human
ccugccucagccucccaaguagc

SEQ ID NO: 828933 - RNA, 22 nt, Human
ccuggcuggaggcaccaaagag

SEQ ID NO: 828934 - RNA, 22 nt, Human
ccuuaaguaaaggagggguggg

SEQ ID NO: 828935 - RNA, 23 nt, Human
cgcucccgccuccuggcuggagg

SEQ ID NO: 828936 - RNA, 24 nt, Human
cgggguuucaccauguuggccagg

SEQ ID NO: 828937 - RNA, 21 nt, Human
cguacacaccccauccuuccu

SEQ ID NO: 828938 - RNA, 23 nt, Human
cucagccucccaaguagcuggga

SEQ ID NO: 828939 - RNA, 24 nt, Human
cucaggugauccaccugccuuggc

SEQ ID NO: 828940 - RNA, 25 nt, Human
cuccugccucagccucccaaguagc

SEQ ID NO: 828941 - RNA, 18 nt, Human
cucgguuuccuggggucg

SEQ ID NO: 828942 - RNA, 20 nt, Human
cugaccucaggugauccacc

SEQ ID NO: 828943 - RNA, 23 nt, Human
cugcaaccuccgccucccggguu

SEQ ID NO: 828944 - RNA, 24 nt, Human
cugcaaccuccgccucccggguuc

SEQ ID NO: 828945 - RNA, 20 nt, Human
cugcccgccgcccgucgccc

SEQ ID NO: 828946 - RNA, 23 nt, Human
cugccucagccucccaaguagcu

SEQ ID NO: 828947 - RNA, 18 nt, Human
cugcugccgccauuuuga

SEQ ID NO: 828948 - RNA, 20 nt, Human
cuggaggcaccaaagaggag

SEQ ID NO: 828949 - RNA, 22 nt, Human
cuguggaucgcucccgccuccu

SEQ ID NO: 828950 - RNA, 20 nt, Human
cuucaaggaaggaaaaagga

SEQ ID NO: 828951 - RNA, 23 nt, Human
cuucagcuuccccauuaauuuuc

SEQ ID NO: 828952 - RNA, 20 nt, Human
cuugaacuucugaccucagg

SEQ ID NO: 828953 - RNA, 23 nt, Human
gaaaaaggagauguaaaaaacaa

SEQ ID NO: 828954 - RNA, 23 nt, Human
gaacaaauuacaguaagggguau

SEQ ID NO: 828955 - RNA, 19 nt, Human
gacaauaaaaaaacaaggu

SEQ ID NO: 828956 - RNA, 23 nt, Human
gaccucaggugauccaccugccu

SEQ ID NO: 828957 - RNA, 24 nt, Human
gagacgggguuucaccauguuggc

SEQ ID NO: 828958 - RNA, 18 nt, Human
gaggagaagggggaggag

SEQ ID NO: 828959 - RNA, 22 nt, Human
gagggcugugagagaggcagug

SEQ ID NO: 828960 - RNA, 20 nt, Human
gcaccaccacgcccagcuaa

SEQ ID NO: 828961 - RNA, 19 nt, Human
gcagggcaacuugccuguc

SEQ ID NO: 828962 - RNA, 22 nt, Human
gcccagcuaauuuuuguauuuu

SEQ ID NO: 828963 - RNA, 21 nt, Human
gcccauggugugucuugaggg

SEQ ID NO: 828964 - RNA, 22 nt, Human
gccuccgcugccuagaccgaag

SEQ ID NO: 828965 - RNA, 22 nt, Human
gcugcugccgccauuuugaggg

SEQ ID NO: 828966 - RNA, 20 nt, Human
gcugggauuucaggcaugca

SEQ ID NO: 828967 - RNA, 21 nt, Human
ggaggagaagggggaggagga

SEQ ID NO: 828968 - RNA, 19 nt, Human
ggaggaggacgucucugcc

SEQ ID NO: 828969 - RNA, 19 nt, Human
ggaugggggcccugggggu

SEQ ID NO: 828970 - RNA, 20 nt, Human
ggcacuccauaaaauguauc

SEQ ID NO: 828971 - RNA, 24 nt, Human
ggcuggucuugaacuucugaccuc

SEQ ID NO: 828972 - RNA, 22 nt, Human
gggcccauggugugucuugagg

SEQ ID NO: 828973 - RNA, 21 nt, Human
ggggguguugggcgguggccg

SEQ ID NO: 828974 - RNA, 23 nt, Human
gggguuucaccauguuggccagg

SEQ ID NO: 828975 - RNA, 19 nt, Human
ggucuugaacuucugaccu

SEQ ID NO: 828976 - RNA, 23 nt, Human
guaaaaaacaaaucccaacggaa

SEQ ID NO: 828977 - RNA, 21 nt, Human
guaacauuuuaagaaaaccau

SEQ ID NO: 828978 - RNA, 18 nt, Human
guagacaauaaaaaaaca

SEQ ID NO: 828979 - RNA, 23 nt, Human
guagagacgggguuucaccaugu

SEQ ID NO: 828980 - RNA, 26 nt, Human
gugauccaccugccuuggccugaccu

SEQ ID NO: 828981 - RNA, 20 nt, Human
uaaaaagaaacuaguucuuu

SEQ ID NO: 828982 - RNA, 23 nt, Human
uaacagagcucucaauggaaacu

SEQ ID NO: 828983 - RNA, 22 nt, Human
uaagaaaaccauagcauuugac

SEQ ID NO: 828984 - RNA, 20 nt, Human
uaaguuaaaaaaucaggaag

SEQ ID NO: 828985 - RNA, 24 nt, Human
uaauuuuuguauuuuuaguagaga

SEQ ID NO: 828986 - RNA, 21 nt, Human
uacugcaaccuccgccucccg

SEQ ID NO: 828987 - RNA, 23 nt, Human
uacugcaaccuccgccucccggg

SEQ ID NO: 828988 - RNA, 22 nt, Human
uagagacgggguuucaccaugu

SEQ ID NO: 828989 - RNA, 22 nt, Human
uagcaaaccugccucugggccc

SEQ ID NO: 828990 - RNA, 22 nt, Human
uagcccaggacagcugguuaac

SEQ ID NO: 828991 - RNA, 18 nt, Human
uagcugggauuucaggca

SEQ ID NO: 828992 - RNA, 21 nt, Human
uagcuuuuaaagucauuuaca

SEQ ID NO: 828993 - RNA, 18 nt, Human
uagguucuccugccggug

SEQ ID NO: 828994 - RNA, 25 nt, Human
uaguacgcgcuuucucucacuuccu

SEQ ID NO: 828995 - RNA, 24 nt, Human
uaguagagacgggguuucaccaug

SEQ ID NO: 828996 - RNA, 26 nt, Human
uaguagagacgggguuucaccauguu

SEQ ID NO: 828997 - RNA, 19 nt, Human
ucaaaacagauucucuaag

SEQ ID NO: 828998 - RNA, 20 nt, Human
ucagcccagaaucaaaacag

SEQ ID NO: 828999 - RNA, 20 nt, Human
ucagccucccaaguagcugg

SEQ ID NO: 829000 - RNA, 21 nt, Human
ucaggcaugcaccaccacgcc

SEQ ID NO: 829001 - RNA, 21 nt, Human
ucaggugauccaccugccuug

SEQ ID NO: 829002 - RNA, 23 nt, Human
ucauuuuuguugcccagacugga

SEQ ID NO: 829003 - RNA, 22 nt, Human
uccaaaaaacaaaagaaaaaaa

SEQ ID NO: 829004 - RNA, 24 nt, Human
ucccaaguagcugggauuucaggc

SEQ ID NO: 829005 - RNA, 21 nt, Human
ucccggguucaagcaauucuc

SEQ ID NO: 829006 - RNA, 24 nt, Human
ucccggguucaagcaauucuccug

SEQ ID NO: 829007 - RNA, 20 nt, Human
ucccugguuacauuuaggga

SEQ ID NO: 829008 - RNA, 24 nt, Human
uccgccucccggguucaagcaauu

SEQ ID NO: 829009 - RNA, 22 nt, Human
uccucccuucagcuuccccauu

SEQ ID NO: 829010 - RNA, 21 nt, Human
uccuugggacagccaagaauu

SEQ ID NO: 829011 - RNA, 23 nt, Human
ucgcugcuguguagcaaaccugc

SEQ ID NO: 829012 - RNA, 20 nt, Human
ucgcuggggccgccgccugc

SEQ ID NO: 829013 - RNA, 19 nt, Human
ucggaugggggcccugggg

SEQ ID NO: 829014 - RNA, 23 nt, Human
ucugaccucaggugauccaccug

SEQ ID NO: 829015 - RNA, 24 nt, Human
ugaccucaggugauccaccugccu

SEQ ID NO: 829016 - RNA, 22 nt, Human
ugacugacucuaaaaacaauau

SEQ ID NO: 829017 - RNA, 24 nt, Human
ugagaaaucuaaguuaaaaaauca

SEQ ID NO: 829018 - RNA, 24 nt, Human
ugccucagccucccaaguagcugg

SEQ ID NO: 829019 - RNA, 21 nt, Human
ugcuauggcguugcacuagag

SEQ ID NO: 829020 - RNA, 21 nt, Human
uggaggcaccaaagaggagga

SEQ ID NO: 829021 - RNA, 24 nt, Human
uggccaggcuggucuugaacuucu

SEQ ID NO: 829022 - RNA, 23 nt, Human
ugggacagccaagaauuuuucuu

SEQ ID NO: 829023 - RNA, 24 nt, Human
ugggauuucaggcaugcaccacca

SEQ ID NO: 829024 - RNA, 22 nt, Human
ugggucagcugcuguggaucgc

SEQ ID NO: 829025 - RNA, 24 nt, Human
uggucuugaacuucugaccucagg

SEQ ID NO: 829026 - RNA, 21 nt, Human
uguauuuuuaguagagacggg

SEQ ID NO: 829027 - RNA, 22 nt, Human
uguccaaaauaaacuguuacga

SEQ ID NO: 829028 - RNA, 19 nt, Human
ugugucuugagggcuguga

SEQ ID NO: 829029 - RNA, 24 nt, Human
uuacugcaaccuccgccucccggg

SEQ ID NO: 829030 - RNA, 25 nt, Human
uuacugcaaccuccgccucccgggu

SEQ ID NO: 829031 - RNA, 18 nt, Human
uuaguagagacgggguuu

SEQ ID NO: 829032 - RNA, 22 nt, Human
uuaguagagacgggguuucacc

SEQ ID NO: 829033 - RNA, 24 nt, Human
uuaguagagacgggguuucaccau

SEQ ID NO: 829034 - RNA, 21 nt, Human
uucaagcaauucuccugccuc

SEQ ID NO: 829035 - RNA, 24 nt, Human
uucaagcaauucuccugccucagc

SEQ ID NO: 829036 - RNA, 24 nt, Human
uucauuuuuguugcccagacugga

SEQ ID NO: 829037 - RNA, 23 nt, Human
uuccaaaaaacaaaagaaaaaaa

SEQ ID NO: 829038 - RNA, 21 nt, Human
uuccauguuuauguaagcacu

SEQ ID NO: 829039 - RNA, 20 nt, Human
uuccuuccuugccuuguucu

SEQ ID NO: 829040 - RNA, 19 nt, Human
uucgcagaaucggaccggg

SEQ ID NO: 829041 - RNA, 23 nt, Human
uuguauuuuuaguagagacgggg

SEQ ID NO: 829042 - RNA, 18 nt, Human
uuuacauuuaaugguuug

SEQ ID NO: 829043 - RNA, 24 nt, Human
uuucaccauguuggccaggcuggu

SEQ ID NO: 829044 - RNA, 24 nt, Human
uuuccuuccuugccuuguucuuuc

SEQ ID NO: 829045 - RNA, 18 nt, Human
uuucuucucucucacuuc

SEQ ID NO: 829046 - RNA, 20 nt, Human
uuuguugcccagacuggagg

SEQ ID NO: 829047 - RNA, 24 nt, Human
uuuuuaguagagacgggguuucac

SEQ ID NO: 829048 - RNA, 20 nt, Human
uuuuuguauuuuuaguagag

SEQ ID NO: 829049 - RNA, 26 nt, Human
uuuuuuuuuuuugagacggaguuuca

SEQ ID NO: 829050 - RNA, 21 nt, Human
aaacauauacucugaaaagug

SEQ ID NO: 829051 - RNA, 21 nt, Human
acucugaaaagugauuaggaa

SEQ ID NO: 829052 - RNA, 22 nt, Human
acucugaaaagugauuaggaag

SEQ ID NO: 829053 - RNA, 23 nt, Human
agacgagcacgucggagaccagg

SEQ ID NO: 829054 - RNA, 18 nt, Human
caauacacgacgccuggg

SEQ ID NO: 829055 - RNA, 21 nt, Human
cggccccucgcaccgcccucc

SEQ ID NO: 829056 - RNA, 18 nt, Human
guuccuagcaucacaaau

SEQ ID NO: 829057 - RNA, 23 nt, Human
uagcaucacaaaucugaguuaca

SEQ ID NO: 829058 - RNA, 20 nt, Human
ucaauacacgacgccugggg

SEQ ID NO: 829059 - RNA, 18 nt, Human
ucgcaccgcccuccagac

SEQ ID NO: 829060 - RNA, 21 nt, Human
ugaaaaaaaaaucaaggcaua

SEQ ID NO: 829061 - RNA, 24 nt, Human
ugaaaaaaaaaucaaggcauacaa

SEQ ID NO: 829062 - RNA, 24 nt, Human
ugaaaaaaaaaucaaggcauacaa

SEQ ID NO: 829063 - RNA, 19 nt, Human
ugaaaaacauauacucuga

SEQ ID NO: 829064 - RNA, 23 nt, Human
ugaaaaacauauacucugaaaag

SEQ ID NO: 829065 - RNA, 22 nt, Human
ugaaaagugauuaggaaguucu

SEQ ID NO: 829066 - RNA, 18 nt, Human
uggcucgggcgccggcga

SEQ ID NO: 829067 - RNA, 19 nt, Human
uugcauuuauuguuucuga

SEQ ID NO: 829068 - RNA, 20 nt, Human
aaaacccaacgacgcgucuu

SEQ ID NO: 829069 - RNA, 21 nt, Human
aacaaaaagacguuuaacaga

SEQ ID NO: 829070 - RNA, 24 nt, Human
aacaugcaaccaucaucuuccaca

SEQ ID NO: 829071 - RNA, 22 nt, Human
aagaaagugcaguuaaaaagga

SEQ ID NO: 829072 - RNA, 18 nt, Human
aagcugguauaggauuua

SEQ ID NO: 829073 - RNA, 19 nt, Human
agcaaguaacaaaaugcaa

SEQ ID NO: 829074 - RNA, 22 nt, Human
caaaacccaacgacgcgucuuc

SEQ ID NO: 829075 - RNA, 23 nt, Human
caaacccgcccccggcucgugcc

SEQ ID NO: 829076 - RNA, 19 nt, Human
caaacuagaaacaugcaac

SEQ ID NO: 829077 - RNA, 21 nt, Human
cagccaaacucaaacggcugu

SEQ ID NO: 829078 - RNA, 22 nt, Human
caguuaaaaaggaaacuaugug

SEQ ID NO: 829079 - RNA, 21 nt, Human
ccacccgcagccaaacucaaa

SEQ ID NO: 829080 - RNA, 19 nt, Human
ccccaauuaaaggcaaaca

SEQ ID NO: 829081 - RNA, 20 nt, Human
cccccggcucgugccccugc

SEQ ID NO: 829082 - RNA, 20 nt, Human
ccccugacaaacguucucca

SEQ ID NO: 829083 - RNA, 23 nt, Human
ccuccaaaacccaacgacgcguc

SEQ ID NO: 829084 - RNA, 21 nt, Human
ccugacaaacguucuccaccc

SEQ ID NO: 829085 - RNA, 21 nt, Human
cguucuccacccgcagccaaa

SEQ ID NO: 829086 - RNA, 24 nt, Human
cuacuuacucaccccgaauauuua

SEQ ID NO: 829087 - RNA, 22 nt, Human
cuauguggcaaguacccucuuu

SEQ ID NO: 829088 - RNA, 18 nt, Human
cugaaaguacucagggua

SEQ ID NO: 829089 - RNA, 20 nt, Human
cuucuuggccgggccccuga

SEQ ID NO: 829090 - RNA, 21 nt, Human
gcucgugccccugccagcuuc

SEQ ID NO: 829091 - RNA, 20 nt, Human
ggcucgugccccugccagcu

SEQ ID NO: 829092 - RNA, 21 nt, Human
uaaaaaggaaacuauguggca

SEQ ID NO: 829093 - RNA, 22 nt, Human
uaaaaaggaaacuauguggcaa

SEQ ID NO: 829094 - RNA, 24 nt, Human
uaacauaaacaaacaaaaagcugg

SEQ ID NO: 829095 - RNA, 26 nt, Human
uacccucuuucccuucccacccccca

SEQ ID NO: 829096 - RNA, 19 nt, Human
uagcaaguaacaaaaugca

SEQ ID NO: 829097 - RNA, 23 nt, Human
uauacaaacuagaaacaugcaac

SEQ ID NO: 829098 - RNA, 24 nt, Human
uauacccaacuacuuacucacccc

SEQ ID NO: 829099 - RNA, 22 nt, Human
ucaaauauuuuucuugccucug

SEQ ID NO: 829100 - RNA, 24 nt, Human
ucaucuuaucacaaagauggaaac

SEQ ID NO: 829101 - RNA, 25 nt, Human
ugaauugcagcauucuguaacauaa

SEQ ID NO: 829102 - RNA, 19 nt, Human
uuucacggccuccaaaacc

SEQ ID NO: 829103 - RNA, 22 nt, Human
aaaaaacagagacacugaagaa

SEQ ID NO: 829104 - RNA, 25 nt, Human
aaaaaaggcccaaaagugcaugugg

SEQ ID NO: 829105 - RNA, 23 nt, Human
aaaaucacagugugcgaaggaac

SEQ ID NO: 829106 - RNA, 24 nt, Human
aaaaucacagugugcgaaggaacg

SEQ ID NO: 829107 - RNA, 19 nt, Human
aaacaggaggcagugcugg

SEQ ID NO: 829108 - RNA, 21 nt, Human
aacccagauccugggggcuga

SEQ ID NO: 829109 - RNA, 27 nt, Human
aagaaccugacccaagcugugcuuccu

SEQ ID NO: 829110 - RNA, 24 nt, Human
aaguccacuuggcauugggcuggg

SEQ ID NO: 829111 - RNA, 22 nt, Human
acacacaggcccagagacaccu

SEQ ID NO: 829112 - RNA, 22 nt, Human
acagaaugcaccagcgccaccc

SEQ ID NO: 829113 - RNA, 24 nt, Human
acagaggggcaggugaggcccaca

SEQ ID NO: 829114 - RNA, 20 nt, Human
accccaggugggcagagccc

SEQ ID NO: 829115 - RNA, 19 nt, Human
accuuccacccugacacac

SEQ ID NO: 829116 - RNA, 21 nt, Human
acucacacacauacacauaca

SEQ ID NO: 829117 - RNA, 21 nt, Human
acuugccuccaccuaggcugg

SEQ ID NO: 829118 - RNA, 22 nt, Human
agaacagaggggcaggugaggc

SEQ ID NO: 829119 - RNA, 18 nt, Human
agaagcuggaagaggggu

SEQ ID NO: 829120 - RNA, 27 nt, Human
agacacccacagggugaagugguccca

SEQ ID NO: 829121 - RNA, 21 nt, Human
agacaccuacagacacacccc

SEQ ID NO: 829122 - RNA, 22 nt, Human
agacaccuacagacacaccccc

SEQ ID NO: 829123 - RNA, 22 nt, Human
agacacugaagaauggacggcu

SEQ ID NO: 829124 - RNA, 24 nt, Human
agacagagauggggaaacauaugg

SEQ ID NO: 829125 - RNA, 21 nt, Human
agaccaaaaugagacaacaac

SEQ ID NO: 829126 - RNA, 24 nt, Human
agagacaccuacagacacaccccc

SEQ ID NO: 829127 - RNA, 21 nt, Human
agagggagaaaacaggaggca

SEQ ID NO: 829128 - RNA, 19 nt, Human
aggaagaguagagggaggg

SEQ ID NO: 829129 - RNA, 19 nt, Human
aggacaggaagaguagagg

SEQ ID NO: 829130 - RNA, 23 nt, Human
aggacaggaagaguagagggagg

SEQ ID NO: 829131 - RNA, 20 nt, Human
aggagcccuccccucucacu

SEQ ID NO: 829132 - RNA, 21 nt, Human
aggcaagaaccugacccaagc

SEQ ID NO: 829133 - RNA, 19 nt, Human
aggcaggcaagggucccug

SEQ ID NO: 829134 - RNA, 21 nt, Human
aggcagugcugggagaacgca

SEQ ID NO: 829135 - RNA, 20 nt, Human
agggagaaaacaggaggcag

SEQ ID NO: 829136 - RNA, 23 nt, Human
agggagaaaacaggaggcagugc

SEQ ID NO: 829137 - RNA, 24 nt, Human
agggccuccccacccacagucuuu

SEQ ID NO: 829138 - RNA, 21 nt, Human
agguagggagagagaccccag

SEQ ID NO: 829139 - RNA, 20 nt, Human
agucccuccucucucugggg

SEQ ID NO: 829140 - RNA, 22 nt, Human
agucgaucacgggggaagccug

SEQ ID NO: 829141 - RNA, 19 nt, Human
auagcaccgucuuucccuc

SEQ ID NO: 829142 - RNA, 21 nt, Human
auaugccuggagugacagagc

SEQ ID NO: 829143 - RNA, 20 nt, Human
auuaagaaaggcaagaaccu

SEQ ID NO: 829144 - RNA, 22 nt, Human
caaaagguccugaggcacccuu

SEQ ID NO: 829145 - RNA, 22 nt, Human
caaccccauauaaaaagaugaa

SEQ ID NO: 829146 - RNA, 21 nt, Human
caagaggaaacagaaugcacc

SEQ ID NO: 829147 - RNA, 24 nt, Human
caagcccacgagggaggggaccaa

SEQ ID NO: 829148 - RNA, 23 nt, Human
cacacacaggcccagagacaccu

SEQ ID NO: 829149 - RNA, 28 nt, Human
cacacacauacacauacacacggauggu

SEQ ID NO: 829150 - RNA, 20 nt, Human
cacacacucacacacauaca

SEQ ID NO: 829151 - RNA, 23 nt, Human
cacacaggcccagagacaccuac

SEQ ID NO: 829152 - RNA, 23 nt, Human
cacacucacacacuugcguguca

SEQ ID NO: 829153 - RNA, 18 nt, Human
cacagcaggaaccccauu

SEQ ID NO: 829154 - RNA, 22 nt, Human
cacccaugaugacugauuguug

SEQ ID NO: 829155 - RNA, 24 nt, Human
cacccccgccccaucucucacacu

SEQ ID NO: 829156 - RNA, 25 nt, Human
cacccugacacacugcaaagggcag

SEQ ID NO: 829157 - RNA, 24 nt, Human
caccuacagacacacccccgcccc

SEQ ID NO: 829158 - RNA, 24 nt, Human
cacucaccacucucccaaacucag

SEQ ID NO: 829159 - RNA, 22 nt, Human
cacugggcuucuuguuauucuu

SEQ ID NO: 829160 - RNA, 24 nt, Human
cacuguggguucugaggaaacucu

SEQ ID NO: 829161 - RNA, 21 nt, Human
cagaaugcaccagcgccaccc

SEQ ID NO: 829162 - RNA, 19 nt, Human
cagacacacccccgcccca

SEQ ID NO: 829163 - RNA, 22 nt, Human
cagacagagauggggaaacaua

SEQ ID NO: 829164 - RNA, 19 nt, Human
cagcccagcccagccccuc

SEQ ID NO: 829165 - RNA, 23 nt, Human
cagcccugggacccucuuucuug

SEQ ID NO: 829166 - RNA, 24 nt, Human
cagggccugguugggcucaggaug

SEQ ID NO: 829167 - RNA, 19 nt, Human
cauaaccccacccacacac

SEQ ID NO: 829168 - RNA, 25 nt, Human
cauacacauacacacggaugaaaug

SEQ ID NO: 829169 - RNA, 22 nt, Human
cauaugccuggagugacagagc

SEQ ID NO: 829170 - RNA, 23 nt, Human
ccacagcaggaaccccauucucc

SEQ ID NO: 829171 - RNA, 23 nt, Human
ccacaggccaacaggucucccau

SEQ ID NO: 829172 - RNA, 24 nt, Human
ccaccuaacccagauccugggggc

SEQ ID NO: 829173 - RNA, 20 nt, Human
ccagccccucagggcucugu

SEQ ID NO: 829174 - RNA, 20 nt, Human
ccaggacggaugcgaugccg

SEQ ID NO: 829175 - RNA, 19 nt, Human
cccaaauccacauugugcu

SEQ ID NO: 829176 - RNA, 21 nt, Human
cccaagacucccaagagauuc

SEQ ID NO: 829177 - RNA, 18 nt, Human
cccacacacaggcccaga

SEQ ID NO: 829178 - RNA, 25 nt, Human
cccacacacaggcccagagacaccu

SEQ ID NO: 829179 - RNA, 18 nt, Human
cccacaggccaacagguc

SEQ ID NO: 829180 - RNA, 19 nt, Human
cccagcccagcccagcccc

SEQ ID NO: 829181 - RNA, 21 nt, Human
cccagcccagccccucagggc

SEQ ID NO: 829182 - RNA, 22 nt, Human
cccaggagcccuccccucucac

SEQ ID NO: 829183 - RNA, 22 nt, Human
cccaugagcagagagcaggaac

SEQ ID NO: 829184 - RNA, 20 nt, Human
ccccaaaucaauuaacaagc

SEQ ID NO: 829185 - RNA, 24 nt, Human
ccccaaaucaauuaacaagcaguu

SEQ ID NO: 829186 - RNA, 20 nt, Human
ccccacccacacacaggccc

SEQ ID NO: 829187 - RNA, 22 nt, Human
ccccacccacagucuuuuccuc

SEQ ID NO: 829188 - RNA, 19 nt, Human
ccccaggagcccuccccuc

SEQ ID NO: 829189 - RNA, 20 nt, Human
ccccaggagcccuccccucu

SEQ ID NO: 829190 - RNA, 20 nt, Human
ccccaucucucacacucaca

SEQ ID NO: 829191 - RNA, 21 nt, Human
ccccgagcccccaaaucgccc

SEQ ID NO: 829192 - RNA, 23 nt, Human
ccccuccuuccgguagcuguccc

SEQ ID NO: 829193 - RNA, 20 nt, Human
ccccugaggagggagguagg

SEQ ID NO: 829194 - RNA, 21 nt, Human
ccccugaggagggagguaggg

SEQ ID NO: 829195 - RNA, 21 nt, Human
cccgagcccccaaaucgccca

SEQ ID NO: 829196 - RNA, 19 nt, Human
cccuacacagcggcagagu

SEQ ID NO: 829197 - RNA, 19 nt, Human
ccguuccauccagagagaa

SEQ ID NO: 829198 - RNA, 21 nt, Human
ccuacagacacacccccgccc

SEQ ID NO: 829199 - RNA, 21 nt, Human
ccucgggagcucuuugcccgc

SEQ ID NO: 829200 - RNA, 20 nt, Human
ccucuuaccuuccacccuga

SEQ ID NO: 829201 - RNA, 20 nt, Human
ccuuccacucaccacucucc

SEQ ID NO: 829202 - RNA, 21 nt, Human
cucacacacauacacauacac

SEQ ID NO: 829203 - RNA, 26 nt, Human
cucacacacauacacauacacacgga

SEQ ID NO: 829204 - RNA, 23 nt, Human
cucacauaaccccacccacacac

SEQ ID NO: 829205 - RNA, 21 nt, Human
cucaccacucucccaaacuca

SEQ ID NO: 829206 - RNA, 23 nt, Human
cuccacaccaaccucuuaccuuc

SEQ ID NO: 829207 - RNA, 19 nt, Human
cuccaccgcuuagccccag

SEQ ID NO: 829208 - RNA, 20 nt, Human
cuccaccuaggcuggggcca

SEQ ID NO: 829209 - RNA, 18 nt, Human
cucccaagagauucucug

SEQ ID NO: 829210 - RNA, 22 nt, Human
cucccagaggguggcaagaaaa

SEQ ID NO: 829211 - RNA, 23 nt, Human
cucccuuccacucaccacucucc

SEQ ID NO: 829212 - RNA, 19 nt, Human
cuccucccuuccacucacc

SEQ ID NO: 829213 - RNA, 19 nt, Human
cugggagaacgcacuuucc

SEQ ID NO: 829214 - RNA, 18 nt, Human
cugugcuuccaguuuugc

SEQ ID NO: 829215 - RNA, 20 nt, Human
cuucacacacucacacacau

SEQ ID NO: 829216 - RNA, 18 nt, Human
cuucagguccugccccuc

SEQ ID NO: 829217 - RNA, 21 nt, Human
cuuuauguaagugagggggag

SEQ ID NO: 829218 - RNA, 22 nt, Human
gaacagacgcccagcagccccc

SEQ ID NO: 829219 - RNA, 23 nt, Human
gaacagacgcccagcagcccccg

SEQ ID NO: 829220 - RNA, 18 nt, Human
gaagcuggaagaggggua

SEQ ID NO: 829221 - RNA, 19 nt, Human
gaccauggcuuccagccua

SEQ ID NO: 829222 - RNA, 26 nt, Human
gacccaagcugugcuuccucgggagc

SEQ ID NO: 829223 - RNA, 21 nt, Human
gacccucuuucuugcuucaag

SEQ ID NO: 829224 - RNA, 26 nt, Human
gacucccaagagauucucugccuccu

SEQ ID NO: 829225 - RNA, 22 nt, Human
gacugggggugggcguggggaa

SEQ ID NO: 829226 - RNA, 22 nt, Human
gagaacuccuuguuccccuccu

SEQ ID NO: 829227 - RNA, 19 nt, Human
gagcccccaaaucgcccaa

SEQ ID NO: 829228 - RNA, 23 nt, Human
gaggaugugaggggagagaacag

SEQ ID NO: 829229 - RNA, 23 nt, Human
gagggcaaaaucacagugugcga

SEQ ID NO: 829230 - RNA, 22 nt, Human
gaggggaggucauggaaggcuc

SEQ ID NO: 829231 - RNA, 20 nt, Human
gagguagagcccaucccacu

SEQ ID NO: 829232 - RNA, 22 nt, Human
gaugguuuugguaaagaacaga

SEQ ID NO: 829233 - RNA, 20 nt, Human
gcagagagcaggaacuggau

SEQ ID NO: 829234 - RNA, 20 nt, Human
gcagggccuccccacccaca

SEQ ID NO: 829235 - RNA, 24 nt, Human
gcccauacccguuccauccagaga

SEQ ID NO: 829236 - RNA, 22 nt, Human
gccccaggagcccuccccucuc

SEQ ID NO: 829237 - RNA, 20 nt, Human
gcccugggacccucuuucuu

SEQ ID NO: 829238 - RNA, 20 nt, Human
gccugguugggcucaggaug

SEQ ID NO: 829239 - RNA, 22 nt, Human
gcgugggcaggagggcaaaauc

SEQ ID NO: 829240 - RNA, 20 nt, Human
gcuauaaaaaaaggcccaaa

SEQ ID NO: 829241 - RNA, 20 nt, Human
gcucaggaugaaaaugggau

SEQ ID NO: 829242 - RNA, 19 nt, Human
gcucuuugcccgcugcagg

SEQ ID NO: 829243 - RNA, 19 nt, Human
gcugcuucuugcugcuccu

SEQ ID NO: 829244 - RNA, 22 nt, Human
ggacaggaagaguagagggagg

SEQ ID NO: 829245 - RNA, 24 nt, Human
ggaggggaggucauggaaggcucu

SEQ ID NO: 829246 - RNA, 22 nt, Human
ggcaaaagaagcuggaagaggg

SEQ ID NO: 829247 - RNA, 22 nt, Human
ggcauugggcuggggaggggag

SEQ ID NO: 829248 - RNA, 21 nt, Human
gggaagccugccagaggaggg

SEQ ID NO: 829249 - RNA, 23 nt, Human
gggaagccugccagaggagggag

SEQ ID NO: 829250 - RNA, 22 nt, Human
gggagccccugaccuggggucc

SEQ ID NO: 829251 - RNA, 18 nt, Human
gggauggggacucccaga

SEQ ID NO: 829252 - RNA, 21 nt, Human
gggaugugucccugaccuuug

SEQ ID NO: 829253 - RNA, 21 nt, Human
gggcagauuggugggcuuccu

SEQ ID NO: 829254 - RNA, 21 nt, Human
gggcaggugaggcccacaggc

SEQ ID NO: 829255 - RNA, 22 nt, Human
ggggaccaaaacagaccaaaau

SEQ ID NO: 829256 - RNA, 30 nt, Human
gguaaagaacagacgcccagcagcccccgg

SEQ ID NO: 829257 - RNA, 25 nt, Human
gucccuggagacugggggugggcga

SEQ ID NO: 829258 - RNA, 24 nt, Human
gugcaugugugaggggggaaaggc

SEQ ID NO: 829259 - RNA, 22 nt, Human
guggucccugcugacuuugugc

SEQ ID NO: 829260 - RNA, 19 nt, Human
uaaaaaaaggcccaaaagu

SEQ ID NO: 829261 - RNA, 20 nt, Human
uaaagucauuuucccuggag

SEQ ID NO: 829262 - RNA, 20 nt, Human
uaaagucauuuucccuggag

SEQ ID NO: 829263 - RNA, 19 nt, Human
uaagaaaacggccccuauu

SEQ ID NO: 829264 - RNA, 24 nt, Human
uauaaaaagaugaacuggcggcuu

SEQ ID NO: 829265 - RNA, 30 nt, Human
ucacacacucacacacauacacauacacag

SEQ ID NO: 829266 - RNA, 25 nt, Human
ucagacaccugcagacauacaugcu

SEQ ID NO: 829267 - RNA, 26 nt, Human
ucagcccagcccagcccagccccuca

SEQ ID NO: 829268 - RNA, 21 nt, Human
ucaggggaagacagcucuuca

SEQ ID NO: 829269 - RNA, 24 nt, Human
ucaguuggcaaaagaagcuggaag

SEQ ID NO: 829270 - RNA, 25 nt, Human
ucaguuggcaaaagaagcuggaaga

SEQ ID NO: 829271 - RNA, 26 nt, Human
ucaguuggcaaaagaagcuggaagag

SEQ ID NO: 829272 - RNA, 18 nt, Human
uccacucaccacucuccc

SEQ ID NO: 829273 - RNA, 24 nt, Human
ucccagaggguggcaagaaaaccc

SEQ ID NO: 829274 - RNA, 18 nt, Human
uccccgagcccccaaauc

SEQ ID NO: 829275 - RNA, 21 nt, Human
uccccgaggcugugcuuccag

SEQ ID NO: 829276 - RNA, 22 nt, Human
uccccgaggcugugcuuccagu

SEQ ID NO: 829277 - RNA, 27 nt, Human
uccccgaggcugugcuuccuccgcggg

SEQ ID NO: 829278 - RNA, 18 nt, Human
ucccuacacagcggcaga

SEQ ID NO: 829279 - RNA, 18 nt, Human
ucccugaccuuugguccc

SEQ ID NO: 829280 - RNA, 20 nt, Human
ucccugcugacuuugugcag

SEQ ID NO: 829281 - RNA, 26 nt, Human
ucccuuccacucaccacucucccaaa

SEQ ID NO: 829282 - RNA, 25 nt, Human
uccgagaaaagcuggggcggggacg

SEQ ID NO: 829283 - RNA, 19 nt, Human
uccucccuuccacucacca

SEQ ID NO: 829284 - RNA, 22 nt, Human
uccugggggcugagggaggcug

SEQ ID NO: 829285 - RNA, 28 nt, Human
ucuccuguuguugccccugaggagggag

SEQ ID NO: 829286 - RNA, 23 nt, Human
ucugugaacuguagagaagacca

SEQ ID NO: 829287 - RNA, 21 nt, Human
ucuugcuucaagggagcuuua

SEQ ID NO: 829288 - RNA, 22 nt, Human
ucuuugagaaagagagguagag

SEQ ID NO: 829289 - RNA, 20 nt, Human
ugacaaaaacacccaugaug

SEQ ID NO: 829290 - RNA, 19 nt, Human
ugacagagccuuccuccac

SEQ ID NO: 829291 - RNA, 19 nt, Human
ugagaaagagagguagagc

SEQ ID NO: 829292 - RNA, 18 nt, Human
ugagacaacaaccccaua

SEQ ID NO: 829293 - RNA, 24 nt, Human
ugagagggagaaaacaggaggcag

SEQ ID NO: 829294 - RNA, 25 nt, Human
ugagagggagaaaacaggaggcagu

SEQ ID NO: 829295 - RNA, 18 nt, Human
ugaggagcagggaggagc

SEQ ID NO: 829296 - RNA, 22 nt, Human
ugaggcacccuugcccuacacu

SEQ ID NO: 829297 - RNA, 23 nt, Human
ugaggcccacaggccaacagguc

SEQ ID NO: 829298 - RNA, 22 nt, Human
ugagggaggcugaagaccaaaa

SEQ ID NO: 829299 - RNA, 19 nt, Human
ugaggggggaaaggcagaa

SEQ ID NO: 829300 - RNA, 20 nt, Human
ugccacccuauucuguagcc

SEQ ID NO: 829301 - RNA, 24 nt, Human
ugccuggagugacagagccuuccu

SEQ ID NO: 829302 - RNA, 18 nt, Human
ugcgugucagacaccugc

SEQ ID NO: 829303 - RNA, 22 nt, Human
ugcgugucagacaccugcagac

SEQ ID NO: 829304 - RNA, 21 nt, Human
ugcugggagaacgcacuuucc

SEQ ID NO: 829305 - RNA, 24 nt, Human
uggcaaaagaagcuggaagagggg

SEQ ID NO: 829306 - RNA, 19 nt, Human
uggcaagaaaaccagagau

SEQ ID NO: 829307 - RNA, 19 nt, Human
uggcagaagaaggcuucag

SEQ ID NO: 829308 - RNA, 25 nt, Human
uggcagaagaaggcuucaguuggca

SEQ ID NO: 829309 - RNA, 19 nt, Human
uggcagccccaacuccaca

SEQ ID NO: 829310 - RNA, 21 nt, Human
ugggagaacgcacuuuccuca

SEQ ID NO: 829311 - RNA, 21 nt, Human
ugggauggggacucccagagg

SEQ ID NO: 829312 - RNA, 18 nt, Human
ugggcaggaggaugugag

SEQ ID NO: 829313 - RNA, 19 nt, Human
ugggcuggggaggggaggu

SEQ ID NO: 829314 - RNA, 22 nt, Human
ugggcuuccuccacucagagau

SEQ ID NO: 829315 - RNA, 24 nt, Human
uggggaggggaggucauggaaggc

SEQ ID NO: 829316 - RNA, 22 nt, Human
uggggccagaaaggaaaaggga

SEQ ID NO: 829317 - RNA, 21 nt, Human
uggggggaaggaggaauuuca

SEQ ID NO: 829318 - RNA, 19 nt, Human
ugggggugggcguggggaa

SEQ ID NO: 829319 - RNA, 21 nt, Human
ugggguccuggcagucaggcu

SEQ ID NO: 829320 - RNA, 24 nt, Human
ugugcgaaggaacgcgcggggagg

SEQ ID NO: 829321 - RNA, 23 nt, Human
uuaaaaaacagagacacugaaga

SEQ ID NO: 829322 - RNA, 28 nt, Human
uuaacaagcaguugacaaaaacacccau

SEQ ID NO: 829323 - RNA, 22 nt, Human
uucaagucaaauguucagaauc

SEQ ID NO: 829324 - RNA, 26 nt, Human
uucacacacucacacacauacacaua

SEQ ID NO: 829325 - RNA, 19 nt, Human
uuccacucaccacucuccc

SEQ ID NO: 829326 - RNA, 19 nt, Human
uuccccuccuuccgguagc

SEQ ID NO: 829327 - RNA, 25 nt, Human
uuccccuccuuccgguagcuguccc

SEQ ID NO: 829328 - RNA, 20 nt, Human
uuccuccaccgcuuagcccc

SEQ ID NO: 829329 - RNA, 22 nt, Human
uuccuccaccgcuuagccccag

SEQ ID NO: 829330 - RNA, 23 nt, Human
uugaacaggccaauaccuucagg

SEQ ID NO: 829331 - RNA, 19 nt, Human
uugcagcccugggacccuc

SEQ ID NO: 829332 - RNA, 26 nt, Human
uuugcagcccugggacccucuuucuu

SEQ ID NO: 829333 - RNA, 23 nt, Human
aaaaaacaccuggucugcagccg

SEQ ID NO: 829334 - RNA, 22 nt, Human
aagaagauaugacagucgagac

SEQ ID NO: 829335 - RNA, 23 nt, Human
aagaucuucucagccucauagcu

SEQ ID NO: 829336 - RNA, 23 nt, Human
aagaucuucucagccucauagcu

SEQ ID NO: 829337 - RNA, 20 nt, Human
acaaagaaggccgagacagc

SEQ ID NO: 829338 - RNA, 23 nt, Human
acacacaaccaucccccucaccc

SEQ ID NO: 829339 - RNA, 28 nt, Human
acacagccucagaaaaaaagggaacgcc

SEQ ID NO: 829340 - RNA, 28 nt, Human
acacauuugcaaagcaauucccguaccg

SEQ ID NO: 829341 - RNA, 28 nt, Human
acacauuugcaaagcaauucccguaccg

SEQ ID NO: 829342 - RNA, 18 nt, Human
acagaugaaaaggcuuuc

SEQ ID NO: 829343 - RNA, 18 nt, Human
acagaugaaaaggcuuuc

SEQ ID NO: 829344 - RNA, 25 nt, Human
acagcaacaaccucuuuuucuuuau

SEQ ID NO: 829345 - RNA, 23 nt, Human
acaggaauauucuucaagcugag

SEQ ID NO: 829346 - RNA, 19 nt, Human
accaacacacucauuagca

SEQ ID NO: 829347 - RNA, 18 nt, Human
agccaccaaaagaaugca

SEQ ID NO: 829348 - RNA, 18 nt, Human
agccaccaaaagaaugca

SEQ ID NO: 829349 - RNA, 21 nt, Human
agcuuuggugaugacacugau

SEQ ID NO: 829350 - RNA, 21 nt, Human
aucacuguuuuccaucugauu

SEQ ID NO: 829351 - RNA, 23 nt, Human
caaaacaccaacacacucauuag

SEQ ID NO: 829352 - RNA, 23 nt, Human
caaaacaggaauauucuucaagc

SEQ ID NO: 829353 - RNA, 22 nt, Human
caaaauggcuccaaacucugca

SEQ ID NO: 829354 - RNA, 23 nt, Human
caaaauggcuccaaacucugcaa

SEQ ID NO: 829355 - RNA, 20 nt, Human
caaacucugcaaccacccag

SEQ ID NO: 829356 - RNA, 20 nt, Human
caaacucugcaaccacccag

SEQ ID NO: 829357 - RNA, 20 nt, Human
caaagaaggccgagacagca

SEQ ID NO: 829358 - RNA, 21 nt, Human
caacacagccucagaaaaaaa

SEQ ID NO: 829359 - RNA, 22 nt, Human
caacacagccucagaaaaaaac

SEQ ID NO: 829360 - RNA, 23 nt, Human
caacacagccucagaaaaaaaca

SEQ ID NO: 829361 - RNA, 24 nt, Human
caacacagccucagaaaaaaacac

SEQ ID NO: 829362 - RNA, 21 nt, Human
caaccaucccccucaccccag

SEQ ID NO: 829363 - RNA, 26 nt, Human
caacuccugaagcaauuugcuacuuu

SEQ ID NO: 829364 - RNA, 24 nt, Human
caauuguuuaacuaguaccagcuu

SEQ ID NO: 829365 - RNA, 24 nt, Human
caauuguuuaacuaguaccagcuu

SEQ ID NO: 829366 - RNA, 18 nt, Human
cacacacaaccauccccc

SEQ ID NO: 829367 - RNA, 21 nt, Human
caccacaguacuaaauacccg

SEQ ID NO: 829368 - RNA, 18 nt, Human
cacccgggagccgcagcc

SEQ ID NO: 829369 - RNA, 22 nt, Human
caccucuaucucuggaugaaga

SEQ ID NO: 829370 - RNA, 22 nt, Human
caccucuaucucuggaugaaga

SEQ ID NO: 829371 - RNA, 21 nt, Human
cacugauggaggagggacguc

SEQ ID NO: 829372 - RNA, 21 nt, Human
cacugauggaggagggacguc

SEQ ID NO: 829373 - RNA, 20 nt, Human
cagacauguugacauaacag

SEQ ID NO: 829374 - RNA, 18 nt, Human
cagaugaaaaggcuuucu

SEQ ID NO: 829375 - RNA, 22 nt, Human
cagcgugaguaaauucaagacu

SEQ ID NO: 829376 - RNA, 21 nt, Human
caguccguaagaggaagaacc

SEQ ID NO: 829377 - RNA, 19 nt, Human
ccccagaggccacauggcu

SEQ ID NO: 829378 - RNA, 19 nt, Human
ccccagaggccacauggcu

SEQ ID NO: 829379 - RNA, 21 nt, Human
ccccaugaucugaacagcgga

SEQ ID NO: 829380 - RNA, 25 nt, Human
ccuacagucucuagugcuuuguagg

SEQ ID NO: 829381 - RNA, 25 nt, Human
ccuacagucucuagugcuuuguagg

SEQ ID NO: 829382 - RNA, 24 nt, Human
ccucacacacacaaccaucccccu

SEQ ID NO: 829383 - RNA, 23 nt, Human
ccucagaaaaaaacaccuggucu

SEQ ID NO: 829384 - RNA, 20 nt, Human
ccucaguaauuggaggaccc

SEQ ID NO: 829385 - RNA, 20 nt, Human
ccucaguaauuggagggccc

SEQ ID NO: 829386 - RNA, 23 nt, Human
ccuccugucucaacuccugaagc

SEQ ID NO: 829387 - RNA, 23 nt, Human
ccuccugucucaacuccugaagc

SEQ ID NO: 829388 - RNA, 19 nt, Human
ccugcugcgugagcgaagg

SEQ ID NO: 829389 - RNA, 19 nt, Human
ccugcugcgugagcgaagg

SEQ ID NO: 829390 - RNA, 19 nt, Human
cgagcaaaacaccaacaca

SEQ ID NO: 829391 - RNA, 19 nt, Human
cgccgcucgccgcccgccg

SEQ ID NO: 829392 - RNA, 24 nt, Human
cguagaaaaugcaagaucagcuag

SEQ ID NO: 829393 - RNA, 24 nt, Human
cuacagcaacaaccucuuuuucuu

SEQ ID NO: 829394 - RNA, 21 nt, Human
cucaucacaauaagacaucga

SEQ ID NO: 829395 - RNA, 21 nt, Human
cucaucacaauaagacauuga

SEQ ID NO: 829396 - RNA, 25 nt, Human
cucuaugccauccaacuaauauacc

SEQ ID NO: 829397 - RNA, 25 nt, Human
cucuaugccauccaacuaauauauc

SEQ ID NO: 829398 - RNA, 20 nt, Human
cuggucugcagccgucacac

SEQ ID NO: 829399 - RNA, 21 nt, Human
cuuaacacauuugcaaagcaa

SEQ ID NO: 829400 - RNA, 21 nt, Human
cuuaacacauuugcaaagcaa

SEQ ID NO: 829401 - RNA, 22 nt, Human
cuucggucucggucguuuuccc

SEQ ID NO: 829402 - RNA, 20 nt, Human
cuugaagaucuucucagccu

SEQ ID NO: 829403 - RNA, 24 nt, Human
cuuucaacugcuuuacaguagcca

SEQ ID NO: 829404 - RNA, 24 nt, Human
cuuucaacugcuuuacagugacca

SEQ ID NO: 829405 - RNA, 21 nt, Human
gaagguugcaguccguaagag

SEQ ID NO: 829406 - RNA, 21 nt, Human
gaagguugcaguccguaagag

SEQ ID NO: 829407 - RNA, 23 nt, Human
gaauugggcugaggcuuuccccc

SEQ ID NO: 829408 - RNA, 18 nt, Human
gcaaccacccagauaccc

SEQ ID NO: 829409 - RNA, 18 nt, Human
gcaaccacccagauaccc

SEQ ID NO: 829410 - RNA, 18 nt, Human
gcaagaucagcuacccaa

SEQ ID NO: 829411 - RNA, 18 nt, Human
gcaagaucagcuacccaa

SEQ ID NO: 829412 - RNA, 21 nt, Human
gcacaaagaaggccaagacag

SEQ ID NO: 829413 - RNA, 22 nt, Human
gcaguccguaagaggaagaacc

SEQ ID NO: 829414 - RNA, 23 nt, Human
gccgggccugggacacccgggag

SEQ ID NO: 829415 - RNA, 18 nt, Human
gcgcgccgcucgccgccc

SEQ ID NO: 829416 - RNA, 21 nt, Human
gcuacagcaacaaccucuuuu

SEQ ID NO: 829417 - RNA, 19 nt, Human
gcugcauuacagaugaaaa

SEQ ID NO: 829418 - RNA, 19 nt, Human
gcugcauuacagaugaaaa

SEQ ID NO: 829419 - RNA, 23 nt, Human
ggccugggacacccgggagccgc

SEQ ID NO: 829420 - RNA, 22 nt, Human
guacagcagccaagauauccaa

SEQ ID NO: 829421 - RNA, 22 nt, Human
gucagcguggacucugguauca

SEQ ID NO: 829422 - RNA, 22 nt, Human
gucagcguggacucugguauca

SEQ ID NO: 829423 - RNA, 18 nt, Human
uaaauucuuucaacugcu

SEQ ID NO: 829424 - RNA, 23 nt, Human
uaaauucuuucaacugcuuuaca

SEQ ID NO: 829425 - RNA, 23 nt, Human
uaaauucuuucaacugcuuuaca

SEQ ID NO: 829426 - RNA, 18 nt, Human
uaagacaucgaucucucc

SEQ ID NO: 829427 - RNA, 18 nt, Human
uacagcagccaagauauc

SEQ ID NO: 829428 - RNA, 20 nt, Human
uacccaaaauggcuccaaac

SEQ ID NO: 829429 - RNA, 20 nt, Human
uacccaaaauggcuccaaac

SEQ ID NO: 829430 - RNA, 18 nt, Human
uagcucagagaagcacaa

SEQ ID NO: 829431 - RNA, 18 nt, Human
uagcucagagaagcacaa

SEQ ID NO: 829432 - RNA, 19 nt, Human
uagugcuuuguagguggca

SEQ ID NO: 829433 - RNA, 19 nt, Human
uagugcuuuguagguggca

SEQ ID NO: 829434 - RNA, 24 nt, Human
uauggcuguuuguuacauacagug

SEQ ID NO: 829435 - RNA, 20 nt, Human
uaugucagcguggacucugg

SEQ ID NO: 829436 - RNA, 20 nt, Human
uaugucagcguggacucugg

SEQ ID NO: 829437 - RNA, 23 nt, Human
ucaacacagccucagaaaaaaac

SEQ ID NO: 829438 - RNA, 19 nt, Human
ucagccucauagcucagag

SEQ ID NO: 829439 - RNA, 19 nt, Human
ucagccucauagcucagag

SEQ ID NO: 829440 - RNA, 19 nt, Human
uccaaaacaggaauauucu

SEQ ID NO: 829441 - RNA, 20 nt, Human
uccccagugcuccucaccac

SEQ ID NO: 829442 - RNA, 22 nt, Human
ucccuaaaauuagcgcugaaaa

SEQ ID NO: 829443 - RNA, 24 nt, Human
ucuucagucucugucgucuucccg

SEQ ID NO: 829444 - RNA, 21 nt, Human
ugagcgaagguuucugaguau

SEQ ID NO: 829445 - RNA, 21 nt, Human
ugagcgaagguuucugaguau

SEQ ID NO: 829446 - RNA, 21 nt, Human
ugaguaaauucaagacugaga

SEQ ID NO: 829447 - RNA, 20 nt, Human
ugccgagcaaaacaccaaca

SEQ ID NO: 829448 - RNA, 23 nt, Human
ugcgcgccgcucgccgcccgccg

SEQ ID NO: 829449 - RNA, 30 nt, Human
ugcuaggauccaagcugccgagcaaaacaa

SEQ ID NO: 829450 - RNA, 20 nt, Human
ugcuuuacaguagccaaucu

SEQ ID NO: 829451 - RNA, 20 nt, Human
ugcuuuacagugaccaaucu

SEQ ID NO: 829452 - RNA, 20 nt, Human
ugguaaugacacugauggag

SEQ ID NO: 829453 - RNA, 20 nt, Human
uggugaugacacugauggag

SEQ ID NO: 829454 - RNA, 18 nt, Human
ugucuuaaauauggcugu

SEQ ID NO: 829455 - RNA, 21 nt, Human
uuacagaugaaaaggcuuucu

SEQ ID NO: 829456 - RNA, 25 nt, Human
uugcugaauaaauucuuucaacugc

SEQ ID NO: 829457 - RNA, 24 nt, Human
uugguaaugacacugauggaggag

SEQ ID NO: 829458 - RNA, 24 nt, Human
uuggugaugacacugauggaggag

SEQ ID NO: 829459 - RNA, 22 nt, Human
uugugcgcgccgcucgccgccc

SEQ ID NO: 829460 - RNA, 24 nt, Human
uuugcuaaaaauccacuugaagau

SEQ ID NO: 829461 - RNA, 24 nt, Human
uuugcuaaaaauccacuugaagau

SEQ ID NO: 829462 - RNA, 19 nt, Human
aaccuuuccagcucuguuu

SEQ ID NO: 829463 - RNA, 20 nt, Human
agccaggauaucucucucag

SEQ ID NO: 829464 - RNA, 19 nt, Human
agcgcgcagccugcggccu

SEQ ID NO: 829465 - RNA, 19 nt, Human
aggaacagaacuaaugccu

SEQ ID NO: 829466 - RNA, 18 nt, Human
aggacuggguugaacagu

SEQ ID NO: 829467 - RNA, 19 nt, Human
aggauaucucucucagccu

SEQ ID NO: 829468 - RNA, 20 nt, Human
agguggaguuguaccucuug

SEQ ID NO: 829469 - RNA, 23 nt, Human
aguaucuacuuuucuugcuagac

SEQ ID NO: 829470 - RNA, 23 nt, Human
agugccagcagggacaacauuuu

SEQ ID NO: 829471 - RNA, 20 nt, Human
aguggcgggccaugccucug

SEQ ID NO: 829472 - RNA, 21 nt, Human
auaguacuuagaaucgugugu

SEQ ID NO: 829473 - RNA, 22 nt, Human
aucacacaacuguguguauccu

SEQ ID NO: 829474 - RNA, 22 nt, Human
caaaugcugauauaccagaucc

SEQ ID NO: 829475 - RNA, 19 nt, Human
caacaggaacagaacuaau

SEQ ID NO: 829476 - RNA, 26 nt, Human
caacaggaacagaacuaaugccucuc

SEQ ID NO: 829477 - RNA, 21 nt, Human
caacagguggcaucacaguca

SEQ ID NO: 829478 - RNA, 19 nt, Human
caagucuugaagcauuugu

SEQ ID NO: 829479 - RNA, 19 nt, Human
cacaggcuguugaauagga

SEQ ID NO: 829480 - RNA, 22 nt, Human
cagagcuuucuucugagcaaaa

SEQ ID NO: 829481 - RNA, 18 nt, Human
caucacagucacauuuga

SEQ ID NO: 829482 - RNA, 19 nt, Human
ccaaauuuggguggauuuc

SEQ ID NO: 829483 - RNA, 27 nt, Human
ccaccaacauuucaaaaagaauaacac

SEQ ID NO: 829484 - RNA, 23 nt, Human
ccagagcuuucuucugagcaaaa

SEQ ID NO: 829485 - RNA, 18 nt, Human
ccaucugaagccagugca

SEQ ID NO: 829486 - RNA, 24 nt, Human
ccuaguggcgggccaugccucuga

SEQ ID NO: 829487 - RNA, 19 nt, Human
ccucaggaaaaggacuggg

SEQ ID NO: 829488 - RNA, 20 nt, Human
ccugcggccuccgggcuucg

SEQ ID NO: 829489 - RNA, 21 nt, Human
cgcccgcagcucugaucguuc

SEQ ID NO: 829490 - RNA, 20 nt, Human
cguauuccauguuuccagaa

SEQ ID NO: 829491 - RNA, 21 nt, Human
cucagccuuaacaugagcgac

SEQ ID NO: 829492 - RNA, 18 nt, Human
cucggggaugacugggcu

SEQ ID NO: 829493 - RNA, 21 nt, Human
cugaagccagugcagaggcca

SEQ ID NO: 829494 - RNA, 20 nt, Human
cugcggccuccgggcuucgu

SEQ ID NO: 829495 - RNA, 18 nt, Human
gaaaggagguugucccac

SEQ ID NO: 829496 - RNA, 23 nt, Human
gaacuaaugccucucuguccuug

SEQ ID NO: 829497 - RNA, 21 nt, Human
gaauaacaccaacacuccacc

SEQ ID NO: 829498 - RNA, 21 nt, Human
gacuauuucuguuuggcacca

SEQ ID NO: 829499 - RNA, 22 nt, Human
gagcuuguauaaccauauccuc

SEQ ID NO: 829500 - RNA, 18 nt, Human
gauauggaggugguggcu

SEQ ID NO: 829501 - RNA, 19 nt, Human
gcagcuugcaagucuugaa

SEQ ID NO: 829502 - RNA, 20 nt, Human
gcccgcagcucugaucguuc

SEQ ID NO: 829503 - RNA, 22 nt, Human
gcgcagccugcggccuccgggc

SEQ ID NO: 829504 - RNA, 22 nt, Human
gcgggggccgaggacugggggc

SEQ ID NO: 829505 - RNA, 20 nt, Human
gcucucgucgaggaucuugg

SEQ ID NO: 829506 - RNA, 18 nt, Human
ggaacagauggguuuugg

SEQ ID NO: 829507 - RNA, 20 nt, Human
ggcuuuguccauuagcugcu

SEQ ID NO: 829508 - RNA, 21 nt, Human
gggccaugccucugaggaacu

SEQ ID NO: 829509 - RNA, 23 nt, Human
ggguagggugguggugguccuug

SEQ ID NO: 829510 - RNA, 21 nt, Human
gguggugguccuugauaguuu

SEQ ID NO: 829511 - RNA, 19 nt, Human
guccagguacacuaauguu

SEQ ID NO: 829512 - RNA, 19 nt, Human
gugagcuugaacaaaugcu

SEQ ID NO: 829513 - RNA, 22 nt, Human
guggaggauagcccucuugcca

SEQ ID NO: 829514 - RNA, 19 nt, Human
uaaaagaauuugaccucac

SEQ ID NO: 829515 - RNA, 19 nt, Human
uaaauuugcuagaacucug

SEQ ID NO: 829516 - RNA, 24 nt, Human
uaacucuuuucacucucaucuucc

SEQ ID NO: 829517 - RNA, 21 nt, Human
uaauaggcucaucauaucacc

SEQ ID NO: 829518 - RNA, 24 nt, Human
uaauauagacgaacuacccauuca

SEQ ID NO: 829519 - RNA, 21 nt, Human
uaggaggauucaugggggaag

SEQ ID NO: 829520 - RNA, 21 nt, Human
uaggugaaguuguaaucuguu

SEQ ID NO: 829521 - RNA, 19 nt, Human
uaguggcgggccaugccuc

SEQ ID NO: 829522 - RNA, 19 nt, Human
uauaguuacuggcaggaaa

SEQ ID NO: 829523 - RNA, 22 nt, Human
uauccucaucaaauccagcagc

SEQ ID NO: 829524 - RNA, 19 nt, Human
uaucuuggaaugaauaaua

SEQ ID NO: 829525 - RNA, 19 nt, Human
uaugacuauuucuguuugg

SEQ ID NO: 829526 - RNA, 21 nt, Human
ucaaaaagaauaacaccaaca

SEQ ID NO: 829527 - RNA, 20 nt, Human
ucagccuuagcagcaucaga

SEQ ID NO: 829528 - RNA, 24 nt, Human
ucccaugaagggggagguggaguu

SEQ ID NO: 829529 - RNA, 19 nt, Human
ucgcccgcagcucugaucg

SEQ ID NO: 829530 - RNA, 19 nt, Human
ucugaagccagugcagagg

SEQ ID NO: 829531 - RNA, 24 nt, Human
ugaaaacaucuauauauguagccc

SEQ ID NO: 829532 - RNA, 25 nt, Human
ugaaaacaucuauauauguagccca

SEQ ID NO: 829533 - RNA, 19 nt, Human
ugaaaaugauccuucaagg

SEQ ID NO: 829534 - RNA, 21 nt, Human
ugaagccagugcagaggccaa

SEQ ID NO: 829535 - RNA, 19 nt, Human
ugagcuugaacaaaugcug

SEQ ID NO: 829536 - RNA, 22 nt, Human
ugaggaacuaaggauucuuuag

SEQ ID NO: 829537 - RNA, 26 nt, Human
ugaggugguggugggggguucacucu

SEQ ID NO: 829538 - RNA, 21 nt, Human
ugauagauccagagcuuucuu

SEQ ID NO: 829539 - RNA, 24 nt, Human
ugcaagucuugaagcauuugugga

SEQ ID NO: 829540 - RNA, 22 nt, Human
ugcauuccaggucucccugaug

SEQ ID NO: 829541 - RNA, 20 nt, Human
ugccaugccccaggugggac

SEQ ID NO: 829542 - RNA, 21 nt, Human
ugcuccuauuccuagugucuu

SEQ ID NO: 829543 - RNA, 18 nt, Human
uggaaugaauaauauaga

SEQ ID NO: 829544 - RNA, 18 nt, Human
uggagcagaagaugacug

SEQ ID NO: 829545 - RNA, 18 nt, Human
uggagcagaagaugacug

SEQ ID NO: 829546 - RNA, 19 nt, Human
uggaggaacagauggguuu

SEQ ID NO: 829547 - RNA, 18 nt, Human
uggcagcugcugcagcca

SEQ ID NO: 829548 - RNA, 23 nt, Human
uggcaggaaaggucuuaggccuc

SEQ ID NO: 829549 - RNA, 23 nt, Human
uggcugugguauccaagaagggu

SEQ ID NO: 829550 - RNA, 20 nt, Human
uggcuucagucugucuccac

SEQ ID NO: 829551 - RNA, 22 nt, Human
uggguugaacaguuugaauugg

SEQ ID NO: 829552 - RNA, 24 nt, Human
uggguugaacaguuugaauuggcu

SEQ ID NO: 829553 - RNA, 23 nt, Human
uggguuuuggugcagcagauguu

SEQ ID NO: 829554 - RNA, 24 nt, Human
ugguggcugccgauucacagugcc

SEQ ID NO: 829555 - RNA, 23 nt, Human
ugguggugggggguucacucucu

SEQ ID NO: 829556 - RNA, 21 nt, Human
uguaggugcuaaagcagucug

SEQ ID NO: 829557 - RNA, 19 nt, Human
uguguaggugcuaaagcag

SEQ ID NO: 829558 - RNA, 24 nt, Human
uguguuucuaaugguguuugugcc

SEQ ID NO: 829559 - RNA, 19 nt, Human
uguuguagcagaaggcuga

SEQ ID NO: 829560 - RNA, 20 nt, Human
uguuuuggguaggguggugg

SEQ ID NO: 829561 - RNA, 20 nt, Human
uuccuacaucugucugugag

SEQ ID NO: 829562 - RNA, 19 nt, Human
uugcugcacauucccuggu

SEQ ID NO: 829563 - RNA, 21 nt, Human
uuggcaaagcaucuuucucau

SEQ ID NO: 829564 - RNA, 26 nt, Human
uuuaucuucacaaacauagacuuguc

SEQ ID NO: 829565 - RNA, 20 nt, Human
uuugcccgcccggcugcugc

SEQ ID NO: 829566 - RNA, 22 nt, Human
uuuucacuccucuucaugaaaa

SEQ ID NO: 829567 - RNA, 25 nt, Human
aacccauucccucgacauagaccug

SEQ ID NO: 829568 - RNA, 21 nt, Human
acugggguuaccugcaguugc

SEQ ID NO: 829569 - RNA, 26 nt, Human
agaucuagaaacaccugcacugaacu

SEQ ID NO: 829570 - RNA, 19 nt, Human
aggaaauucaaacauaaug

SEQ ID NO: 829571 - RNA, 21 nt, Human
aggcggcggcggcggcugcgg

SEQ ID NO: 829572 - RNA, 21 nt, Human
augcagccccgccuccaaccu

SEQ ID NO: 829573 - RNA, 25 nt, Human
caagccagaugcagccccgccucca

SEQ ID NO: 829574 - RNA, 24 nt, Human
cauaaugguauauggauuucucuu

SEQ ID NO: 829575 - RNA, 18 nt, Human
caucugaaaaacaccaau

SEQ ID NO: 829576 - RNA, 18 nt, Human
ccaagccagaugcagccc

SEQ ID NO: 829577 - RNA, 18 nt, Human
ccgauccggggggaggag

SEQ ID NO: 829578 - RNA, 22 nt, Human
ccuccaaccugcaaggaaccca

SEQ ID NO: 829579 - RNA, 18 nt, Human
cgauccggggggaggagg

SEQ ID NO: 829580 - RNA, 18 nt, Human
cgccgcugccgggccgca

SEQ ID NO: 829581 - RNA, 23 nt, Human
cggcggcugcggguccggagcga

SEQ ID NO: 829582 - RNA, 19 nt, Human
cucgccgcugccgggccgc

SEQ ID NO: 829583 - RNA, 21 nt, Human
cugaaaaacaccaaugcaaua

SEQ ID NO: 829584 - RNA, 26 nt, Human
cugaaaaacaccaaugcaauagauua

SEQ ID NO: 829585 - RNA, 20 nt, Human
gcggcggcggcggcugcggg

SEQ ID NO: 829586 - RNA, 18 nt, Human
ggcggcggcggcggcugc

SEQ ID NO: 829587 - RNA, 20 nt, Human
ggcggcugcggguccggagc

SEQ ID NO: 829588 - RNA, 23 nt, Human
gggggaggaggcggcggcggcgg

SEQ ID NO: 829589 - RNA, 20 nt, Human
uauaucaggaaauucaaaca

SEQ ID NO: 829590 - RNA, 22 nt, Human
uaucaggaaauucaaacauaau

SEQ ID NO: 829591 - RNA, 23 nt, Human
uaucaggaaauucaaacauaaug

SEQ ID NO: 829592 - RNA, 21 nt, Human
ucaucugaaaaacaccaaugc

SEQ ID NO: 829593 - RNA, 19 nt, Human
uccaaccugcaaggaaccc

SEQ ID NO: 829594 - RNA, 18 nt, Human
uccggggggaggaggcgg

SEQ ID NO: 829595 - RNA, 23 nt, Human
uccuggggagcuguggcccgcag

SEQ ID NO: 829596 - RNA, 21 nt, Human
ucuagaaacaccugcacugaa

SEQ ID NO: 829597 - RNA, 21 nt, Human
aaaaagacagauaauagcaag

SEQ ID NO: 829598 - RNA, 23 nt, Human
aaaaagacagauaauagcaagug

SEQ ID NO: 829599 - RNA, 21 nt, Human
aaaacacacaaauguccauca

SEQ ID NO: 829600 - RNA, 19 nt, Human
aaaacugguggaaccaaac

SEQ ID NO: 829601 - RNA, 21 nt, Human
aaaagcacaagugacaauaga

SEQ ID NO: 829602 - RNA, 27 nt, Human
aaaagcacaagugacaauagaaaaaaa

SEQ ID NO: 829603 - RNA, 21 nt, Human
aaaauauccuaaacauagccu

SEQ ID NO: 829604 - RNA, 22 nt, Human
aaacacacaaauguccaucaac

SEQ ID NO: 829605 - RNA, 22 nt, Human
aaaccuggauacauugcuggug

SEQ ID NO: 829606 - RNA, 19 nt, Human
aaacugaaaacaauccaca

SEQ ID NO: 829607 - RNA, 22 nt, Human
aaaggacaccaacaagaaacug

SEQ ID NO: 829608 - RNA, 24 nt, Human
aaauagcucacccaacucaauaau

SEQ ID NO: 829609 - RNA, 23 nt, Human
aacaagaaacugaaaacaaucca

SEQ ID NO: 829610 - RNA, 24 nt, Human
aaccauucaaaaucuggaggccaa

SEQ ID NO: 829611 - RNA, 27 nt, Human
aacuauacaaguucuuagaagaaaacc

SEQ ID NO: 829612 - RNA, 24 nt, Human
aagaaagagguagaaggcacagaa

SEQ ID NO: 829613 - RNA, 19 nt, Human
aagaacaggaaaggcggau

SEQ ID NO: 829614 - RNA, 18 nt, Human
aagaagccagucacaaaa

SEQ ID NO: 829615 - RNA, 19 nt, Human
aagagggccugguauugug

SEQ ID NO: 829616 - RNA, 20 nt, Human
aagcagaggccuuuagcaag

SEQ ID NO: 829617 - RNA, 21 nt, Human
aagcaggagugacagaccaag

SEQ ID NO: 829618 - RNA, 22 nt, Human
aagcaggagugacagaccaagg

SEQ ID NO: 829619 - RNA, 23 nt, Human
aagcaggagugacagaccaaggg

SEQ ID NO: 829620 - RNA, 20 nt, Human
aagcuaugacaucccauuca

SEQ ID NO: 829621 - RNA, 24 nt, Human
aaggacaccaacaagaaacugaaa

SEQ ID NO: 829622 - RNA, 21 nt, Human
acaaagauaaacauguaagug

SEQ ID NO: 829623 - RNA, 20 nt, Human
acaacguagagaagaaagag

SEQ ID NO: 829624 - RNA, 21 nt, Human
accaugucccaggaaagaaga

SEQ ID NO: 829625 - RNA, 19 nt, Human
acggaguuacuguaagacc

SEQ ID NO: 829626 - RNA, 26 nt, Human
agaaaagaacaaggaaccauucaaaa

SEQ ID NO: 829627 - RNA, 18 nt, Human
agaaacaacguagagaag

SEQ ID NO: 829628 - RNA, 18 nt, Human
agaaaggccgugcacaua

SEQ ID NO: 829629 - RNA, 18 nt, Human
agaacuaaaacuauacaa

SEQ ID NO: 829630 - RNA, 23 nt, Human
agaagaaaacacaggcauuaauc

SEQ ID NO: 829631 - RNA, 23 nt, Human
agaagaaagagguagaaggcaca

SEQ ID NO: 829632 - RNA, 22 nt, Human
agaaggaagaggaaucaggagc

SEQ ID NO: 829633 - RNA, 19 nt, Human
agacaauauuagccuccua

SEQ ID NO: 829634 - RNA, 18 nt, Human
agacagguaugaggucca

SEQ ID NO: 829635 - RNA, 21 nt, Human
agaccuagcaauuccacuccu

SEQ ID NO: 829636 - RNA, 19 nt, Human
agaggaagggagaaaggag

SEQ ID NO: 829637 - RNA, 21 nt, Human
agcagcagauccuuagaaaca

SEQ ID NO: 829638 - RNA, 23 nt, Human
agccaaaaaguaaaaacacacaa

SEQ ID NO: 829639 - RNA, 24 nt, Human
agccaaaaaguaaaaacacacaaa

SEQ ID NO: 829640 - RNA, 20 nt, Human
agcuccauuuagaagcuaug

SEQ ID NO: 829641 - RNA, 19 nt, Human
aggaaaucauuggucucaa

SEQ ID NO: 829642 - RNA, 19 nt, Human
aggaagaggaaucaggagc

SEQ ID NO: 829643 - RNA, 22 nt, Human
aggcagcaccaagauacccaac

SEQ ID NO: 829644 - RNA, 24 nt, Human
aggcagcauaaaacugguggaacc

SEQ ID NO: 829645 - RNA, 19 nt, Human
aggcaggagaguggucaga

SEQ ID NO: 829646 - RNA, 27 nt, Human
aggcaggagaguggucagaagggaccc

SEQ ID NO: 829647 - RNA, 18 nt, Human
aggugacuuugccccucu

SEQ ID NO: 829648 - RNA, 24 nt, Human
aguagccaaaaaguaaaaacacac

SEQ ID NO: 829649 - RNA, 21 nt, Human
aguuaaaacacggaguuacug

SEQ ID NO: 829650 - RNA, 21 nt, Human
auagaccuuucuccaaagaaa

SEQ ID NO: 829651 - RNA, 22 nt, Human
aucuauaaaacaaguucucccc

SEQ ID NO: 829652 - RNA, 21 nt, Human
augccauggcuauuacccaac

SEQ ID NO: 829653 - RNA, 21 nt, Human
caaaaagacagauaauagcaa

SEQ ID NO: 829654 - RNA, 24 nt, Human
caaacacagacuaaguaaaaaaaa

SEQ ID NO: 829655 - RNA, 22 nt, Human
caaagaccauugugagaacuaa

SEQ ID NO: 829656 - RNA, 21 nt, Human
caaauagcucacccaacucaa

SEQ ID NO: 829657 - RNA, 18 nt, Human
caacugaugaaucaauaa

SEQ ID NO: 829658 - RNA, 21 nt, Human
caagaaacugaaaacaaucca

SEQ ID NO: 829659 - RNA, 24 nt, Human
caagaaacugaaaacaauccacag

SEQ ID NO: 829660 - RNA, 21 nt, Human
caagauacccaaucagcuucc

SEQ ID NO: 829661 - RNA, 26 nt, Human
caagauacccaaucagcuuccaacua

SEQ ID NO: 829662 - RNA, 25 nt, Human
caauacaggcagcaccaagauaccc

SEQ ID NO: 829663 - RNA, 18 nt, Human
cacaaagggccucagaac

SEQ ID NO: 829664 - RNA, 21 nt, Human
cacaaagggccucagaacuaa

SEQ ID NO: 829665 - RNA, 18 nt, Human
caccaaggaagacugggg

SEQ ID NO: 829666 - RNA, 23 nt, Human
cagaauagccccacucccaucaa

SEQ ID NO: 829667 - RNA, 23 nt, Human
cagagagagauaggacucaguac

SEQ ID NO: 829668 - RNA, 19 nt, Human
cagaggguuccccaugaac

SEQ ID NO: 829669 - RNA, 18 nt, Human
cagcaccaagauacccaa

SEQ ID NO: 829670 - RNA, 18 nt, Human
cagcagugggacaagugg

SEQ ID NO: 829671 - RNA, 24 nt, Human
cagcagugggacaaguggagaucc

SEQ ID NO: 829672 - RNA, 19 nt, Human
cagcaucaguugccaucag

SEQ ID NO: 829673 - RNA, 22 nt, Human
cagcggcggcuucgcgcuccga

SEQ ID NO: 829674 - RNA, 20 nt, Human
caggcaaaauauccuaaaca

SEQ ID NO: 829675 - RNA, 20 nt, Human
caucccccuaaccuccccac

SEQ ID NO: 829676 - RNA, 19 nt, Human
cauuccuaauccuccuuac

SEQ ID NO: 829677 - RNA, 23 nt, Human
ccaaaaaguaaaaacacacaaau

SEQ ID NO: 829678 - RNA, 20 nt, Human
ccaaacacagacuaaguaaa

SEQ ID NO: 829679 - RNA, 20 nt, Human
ccaaggacuaguguguggag

SEQ ID NO: 829680 - RNA, 25 nt, Human
ccacggggauccacagggcugggag

SEQ ID NO: 829681 - RNA, 21 nt, Human
ccacucccaucaauucaucca

SEQ ID NO: 829682 - RNA, 20 nt, Human
ccacuguuugcccuuuuaga

SEQ ID NO: 829683 - RNA, 22 nt, Human
cccacucccaucaauucaucca

SEQ ID NO: 829684 - RNA, 26 nt, Human
cccacucccaucaauucauccaagaa

SEQ ID NO: 829685 - RNA, 18 nt, Human
ccccaugaaccuaaauua

SEQ ID NO: 829686 - RNA, 19 nt, Human
cccccuaaccuccccacaa

SEQ ID NO: 829687 - RNA, 18 nt, Human
ccccuacaucacaucaua

SEQ ID NO: 829688 - RNA, 20 nt, Human
cccucugagccuugguuucc

SEQ ID NO: 829689 - RNA, 18 nt, Human
cgaaauggaucaaagacc

SEQ ID NO: 829690 - RNA, 19 nt, Human
cguaagcacaggaaaagac

SEQ ID NO: 829691 - RNA, 22 nt, Human
cuaaagaaggaagaggaaucag

SEQ ID NO: 829692 - RNA, 18 nt, Human
cuaauccuccuuacccgu

SEQ ID NO: 829693 - RNA, 21 nt, Human
cucaaaaaguuaaaacacgga

SEQ ID NO: 829694 - RNA, 22 nt, Human
cucaugacucauaacaggaaau

SEQ ID NO: 829695 - RNA, 19 nt, Human
cuccaaagaaauacgcaug

SEQ ID NO: 829696 - RNA, 18 nt, Human
cucugagaaaggccgugc

SEQ ID NO: 829697 - RNA, 19 nt, Human
cugaagcccugggccagua

SEQ ID NO: 829698 - RNA, 24 nt, Human
cuggaggcaggagaguggucagaa

SEQ ID NO: 829699 - RNA, 20 nt, Human
cugguuggugcucuguagcu

SEQ ID NO: 829700 - RNA, 23 nt, Human
cuuucuauaaguccauccaagag

SEQ ID NO: 829701 - RNA, 19 nt, Human
gaaccauucaaaaucugga

SEQ ID NO: 829702 - RNA, 24 nt, Human
gaagaagccagucacaaaagaggg

SEQ ID NO: 829703 - RNA, 20 nt, Human
gaagaggaaucaggagccug

SEQ ID NO: 829704 - RNA, 21 nt, Human
gacugggcagggucccuccug

SEQ ID NO: 829705 - RNA, 25 nt, Human
gacugggcagggucccuccuggccu

SEQ ID NO: 829706 - RNA, 20 nt, Human
gagggccugguauuguggug

SEQ ID NO: 829707 - RNA, 19 nt, Human
gcagcaccaagauacccaa

SEQ ID NO: 829708 - RNA, 24 nt, Human
gcagcaucauucagaguagccaaa

SEQ ID NO: 829709 - RNA, 21 nt, Human
gcaggagaguggucagaaggg

SEQ ID NO: 829710 - RNA, 20 nt, Human
gccaaaaaguaaaaacacac

SEQ ID NO: 829711 - RNA, 23 nt, Human
ggaaagcaggagugacagaccaa

SEQ ID NO: 829712 - RNA, 23 nt, Human
ggaaaucauuggucucaaccuuc

SEQ ID NO: 829713 - RNA, 28 nt, Human
ggaaaucauuggucucaaccuuccucca

SEQ ID NO: 829714 - RNA, 26 nt, Human
ggcaaacugcucccaucaagucggca

SEQ ID NO: 829715 - RNA, 21 nt, Human
ggcccuagaaaacauucagug

SEQ ID NO: 829716 - RNA, 21 nt, Human
ggugaagcagagcuuucucug

SEQ ID NO: 829717 - RNA, 19 nt, Human
guggaagaagccagucaca

SEQ ID NO: 829718 - RNA, 23 nt, Human
uaaaaacacacaaauguccauca

SEQ ID NO: 829719 - RNA, 21 nt, Human
uaaaagcaaaaagacagauaa

SEQ ID NO: 829720 - RNA, 25 nt, Human
uaaaagcaaaaagacagauaauagc

SEQ ID NO: 829721 - RNA, 24 nt, Human
uaaccaagagcugaagcccugggc

SEQ ID NO: 829722 - RNA, 19 nt, Human
uaagugaggggcacucaga

SEQ ID NO: 829723 - RNA, 20 nt, Human
uacaaacaaagauaaacaug

SEQ ID NO: 829724 - RNA, 26 nt, Human
uacacuuuugagaauuaaaauuuagc

SEQ ID NO: 829725 - RNA, 21 nt, Human
uaccaugcaggugacuuugcc

SEQ ID NO: 829726 - RNA, 19 nt, Human
uacccuaucacuaugugcu

SEQ ID NO: 829727 - RNA, 24 nt, Human
uagaaaacauucaguggaagaagc

SEQ ID NO: 829728 - RNA, 22 nt, Human
uagacaaauugaaaccuggaua

SEQ ID NO: 829729 - RNA, 18 nt, Human
uagagaagaaagagguag

SEQ ID NO: 829730 - RNA, 23 nt, Human
uagccaaaaaguaaaaacacaca

SEQ ID NO: 829731 - RNA, 25 nt, Human
uauggugacccugagcacauuauuc

SEQ ID NO: 829732 - RNA, 23 nt, Human
uauuagccuccuacacuuuugag

SEQ ID NO: 829733 - RNA, 21 nt, Human
ucaaccuuccuccaaggacua

SEQ ID NO: 829734 - RNA, 19 nt, Human
ucacuggaucccaggaacc

SEQ ID NO: 829735 - RNA, 20 nt, Human
ucagagagagauaggacuca

SEQ ID NO: 829736 - RNA, 20 nt, Human
ucagcagugggacaagugga

SEQ ID NO: 829737 - RNA, 21 nt, Human
uccaaagaaauacgcauggcc

SEQ ID NO: 829738 - RNA, 21 nt, Human
uccaaggacuaguguguggag

SEQ ID NO: 829739 - RNA, 22 nt, Human
uccacaagcaaaagaaugaagc

SEQ ID NO: 829740 - RNA, 22 nt, Human
uccacacaaaaucuuguagaaa

SEQ ID NO: 829741 - RNA, 23 nt, Human
uccacagaagcuccauuuagaag

SEQ ID NO: 829742 - RNA, 18 nt, Human
uccacaggcuucugcugg

SEQ ID NO: 829743 - RNA, 18 nt, Human
uccacaggcuucugcugg

SEQ ID NO: 829744 - RNA, 18 nt, Human
ucccaggaaagaagaucc

SEQ ID NO: 829745 - RNA, 22 nt, Human
uccccacaaagggccucagaac

SEQ ID NO: 829746 - RNA, 23 nt, Human
ucuaacuuucuauaaguccaucc

SEQ ID NO: 829747 - RNA, 25 nt, Human
ucuagaauauacaaauagcucaccc

SEQ ID NO: 829748 - RNA, 24 nt, Human
ucuagauauggcaccaaaagcaca

SEQ ID NO: 829749 - RNA, 19 nt, Human
ucucuggaggcaggagagu

SEQ ID NO: 829750 - RNA, 18 nt, Human
ugaaacaggagaaugagg

SEQ ID NO: 829751 - RNA, 23 nt, Human
ugaaauguccagaguagguuaau

SEQ ID NO: 829752 - RNA, 25 nt, Human
ugaaccuaaauuaaccaagagcuga

SEQ ID NO: 829753 - RNA, 18 nt, Human
ugacuaacagagccccuu

SEQ ID NO: 829754 - RNA, 22 nt, Human
ugauacauccucaacuuggacg

SEQ ID NO: 829755 - RNA, 21 nt, Human
ugccaagacaauuccguggag

SEQ ID NO: 829756 - RNA, 22 nt, Human
uggaaccaaacacagacuaagu

SEQ ID NO: 829757 - RNA, 23 nt, Human
uggaauacucauuccuaauccuc

SEQ ID NO: 829758 - RNA, 20 nt, Human
uggaggccaagaggaaggga

SEQ ID NO: 829759 - RNA, 23 nt, Human
uggauagaccuuucuccaaagaa

SEQ ID NO: 829760 - RNA, 23 nt, Human
uggcaccaaaagcacaagugaca

SEQ ID NO: 829761 - RNA, 22 nt, Human
ugggcagggucccuccuggccu

SEQ ID NO: 829762 - RNA, 20 nt, Human
uggugacccugagcacauua

SEQ ID NO: 829763 - RNA, 26 nt, Human
uggugaggccacagcuuacagugggg

SEQ ID NO: 829764 - RNA, 20 nt, Human
uguccacacaaaaucuugua

SEQ ID NO: 829765 - RNA, 23 nt, Human
uuggacacuagcaauggguaaac

SEQ ID NO: 829766 - RNA, 22 nt, Human
uuucuauuaccaucccccuaac

SEQ ID NO: 829767 - RNA, 22 nt, Human
aaagaaaacccuuuuccauguu

SEQ ID NO: 829768 - RNA, 22 nt, Human
aacacauacauaaggacuucua

SEQ ID NO: 829769 - RNA, 26 nt, Human
aagagagggaacagagagaaaaaugc

SEQ ID NO: 829770 - RNA, 18 nt, Human
aagcaguaggauguagcu

SEQ ID NO: 829771 - RNA, 18 nt, Human
aagguuuuguucucuaug

SEQ ID NO: 829772 - RNA, 19 nt, Human
acaaaagcagacuucuagg

SEQ ID NO: 829773 - RNA, 20 nt, Human
acaagauccacaagaacagu

SEQ ID NO: 829774 - RNA, 18 nt, Human
acauuccuguuuccauaa

SEQ ID NO: 829775 - RNA, 24 nt, Human
acuacaguuuucaaucuaacaucu

SEQ ID NO: 829776 - RNA, 19 nt, Human
agaaaauccuuuaccacca

SEQ ID NO: 829777 - RNA, 20 nt, Human
agcaaagcauauguugaaaa

SEQ ID NO: 829778 - RNA, 19 nt, Human
agcgggcccugggugggga

SEQ ID NO: 829779 - RNA, 20 nt, Human
aucaaauauaucccaauuca

SEQ ID NO: 829780 - RNA, 27 nt, Human
aucacaguguuccagcaaagcauaugu

SEQ ID NO: 829781 - RNA, 18 nt, Human
auucuuguaacacauaca

SEQ ID NO: 829782 - RNA, 23 nt, Human
caaacaagcucagagaggcucau

SEQ ID NO: 829783 - RNA, 24 nt, Human
caaggaaggcaauccucauuuuuc

SEQ ID NO: 829784 - RNA, 19 nt, Human
cacaguguuccagcaaagc

SEQ ID NO: 829785 - RNA, 23 nt, Human
caccagaucccaugcagcgccaa

SEQ ID NO: 829786 - RNA, 23 nt, Human
cagcagguacaaaagcagacuuc

SEQ ID NO: 829787 - RNA, 18 nt, Human
caggccauggagaaaauc

SEQ ID NO: 829788 - RNA, 24 nt, Human
caugcagcgccaaacacauccauu

SEQ ID NO: 829789 - RNA, 19 nt, Human
cauuccuguuuccauaagg

SEQ ID NO: 829790 - RNA, 21 nt, Human
ccagaucccaugcagcgccaa

SEQ ID NO: 829791 - RNA, 27 nt, Human
ccaugcagcgccaaacacauccauucc

SEQ ID NO: 829792 - RNA, 25 nt, Human
cgcgagcgcgcgcgcaagggucucc

SEQ ID NO: 829793 - RNA, 21 nt, Human
gcagaacacuuaguaaaagcg

SEQ ID NO: 829794 - RNA, 21 nt, Human
gcuugcagggaaaagaaaacc

SEQ ID NO: 829795 - RNA, 25 nt, Human
gggaacagagagaaaaaugcccaac

SEQ ID NO: 829796 - RNA, 18 nt, Human
gguacaaaagcagacuuc

SEQ ID NO: 829797 - RNA, 25 nt, Human
guuuuguucucuaugcuggaauggc

SEQ ID NO: 829798 - RNA, 18 nt, Human
uacaaggaaggcaauccu

SEQ ID NO: 829799 - RNA, 20 nt, Human
uacaggaagaauucuacagu

SEQ ID NO: 829800 - RNA, 25 nt, Human
uagaacaaugauuacacaauugaca

SEQ ID NO: 829801 - RNA, 18 nt, Human
ucaguuggaugaccuccu

SEQ ID NO: 829802 - RNA, 21 nt, Human
uccacaagaacagucagcaga

SEQ ID NO: 829803 - RNA, 24 nt, Human
uccauuccacccucuaacacauac

SEQ ID NO: 829804 - RNA, 19 nt, Human
ucccuggacacaagaucca

SEQ ID NO: 829805 - RNA, 23 nt, Human
ucuaugcuggaauggcugaagaa

SEQ ID NO: 829806 - RNA, 22 nt, Human
ugacuagacauacuuggaaguu

SEQ ID NO: 829807 - RNA, 25 nt, Human
ugcagggaaaagaaaacccuuuucc

SEQ ID NO: 829808 - RNA, 21 nt, Human
uggcaaaagugaaauaacaga

SEQ ID NO: 829809 - RNA, 22 nt, Human
uggcaaaagugaaauaacagaa

SEQ ID NO: 829810 - RNA, 18 nt, Human
uggcgcgagcgcgcgcgc

SEQ ID NO: 829811 - RNA, 22 nt, Human
uucagcaacaaacaagcucaga

SEQ ID NO: 829812 - RNA, 24 nt, Human
uucaggccauggagaaaauccuuu

SEQ ID NO: 829813 - RNA, 20 nt, Human
uucagucauaaaggauguug

SEQ ID NO: 829814 - RNA, 24 nt, Human
uuccuguuuccauaagguuuuguu

SEQ ID NO: 829815 - RNA, 20 nt, Human
aaauaucgaaaauaugcgcu

SEQ ID NO: 829816 - RNA, 18 nt, Human
aagcaagaaagagaaaca

SEQ ID NO: 829817 - RNA, 20 nt, Human
aagcaagaaagagaaacaac

SEQ ID NO: 829818 - RNA, 25 nt, Human
aagcaagaaagagaaacaagggacc

SEQ ID NO: 829819 - RNA, 21 nt, Human
aagcccggggcaacugaacaa

SEQ ID NO: 829820 - RNA, 22 nt, Human
aauugauuuugaguuccagagc

SEQ ID NO: 829821 - RNA, 20 nt, Human
accccacaucugugugucug

SEQ ID NO: 829822 - RNA, 21 nt, Human
agccagaaaauguguuucuau

SEQ ID NO: 829823 - RNA, 23 nt, Human
aucguucuagauauacacccugu

SEQ ID NO: 829824 - RNA, 18 nt, Human
caaagcaagaaagagaaa

SEQ ID NO: 829825 - RNA, 24 nt, Human
cagaaacacaguguucccccaaua

SEQ ID NO: 829826 - RNA, 22 nt, Human
cagcagagggcccuuuaaacac

SEQ ID NO: 829827 - RNA, 23 nt, Human
cagcagugcuuggagauggaggu

SEQ ID NO: 829828 - RNA, 19 nt, Human
cagccucucagcuacaucc

SEQ ID NO: 829829 - RNA, 22 nt, Human
cagcucacagugguccugggcc

SEQ ID NO: 829830 - RNA, 23 nt, Human
caguucaacuaucagaaaugcuc

SEQ ID NO: 829831 - RNA, 18 nt, Human
cauugccugcgccuccgc

SEQ ID NO: 829832 - RNA, 23 nt, Human
ccacacauaaacgagaugcugaa

SEQ ID NO: 829833 - RNA, 23 nt, Human
ccacgugugauuccuugugccuc

SEQ ID NO: 829834 - RNA, 18 nt, Human
ccagaaaauguguuucua

SEQ ID NO: 829835 - RNA, 20 nt, Human
ccagcggucgucucuucucc

SEQ ID NO: 829836 - RNA, 23 nt, Human
cccaccccccuaggucuucccca

SEQ ID NO: 829837 - RNA, 23 nt, Human
ccccacgccgcucggucuccagc

SEQ ID NO: 829838 - RNA, 21 nt, Human
cccccaauauuucgaacagcc

SEQ ID NO: 829839 - RNA, 25 nt, Human
cccccaauauuucgaacagcccugu

SEQ ID NO: 829840 - RNA, 22 nt, Human
cccccacccaccccccuagguc

SEQ ID NO: 829841 - RNA, 26 nt, Human
cccccacccaccccccuaggucuucc

SEQ ID NO: 829842 - RNA, 20 nt, Human
ccugcgccuccgcucccagc

SEQ ID NO: 829843 - RNA, 24 nt, Human
ccuuggguuuuguguuugcucaug

SEQ ID NO: 829844 - RNA, 19 nt, Human
ccuuucucccuuuuccagc

SEQ ID NO: 829845 - RNA, 21 nt, Human
ccuuucucccuuuuccagcuc

SEQ ID NO: 829846 - RNA, 23 nt, Human
ccuuugguuuuggcaaacucacu

SEQ ID NO: 829847 - RNA, 21 nt, Human
cgaaaauaugcgcuauacugu

SEQ ID NO: 829848 - RNA, 19 nt, Human
cgucucuucucccagccuc

SEQ ID NO: 829849 - RNA, 22 nt, Human
cgucucuucucccagccucuca

SEQ ID NO: 829850 - RNA, 18 nt, Human
cucacagugguccugggc

SEQ ID NO: 829851 - RNA, 21 nt, Human
cucccaggaagaaucuugggg

SEQ ID NO: 829852 - RNA, 18 nt, Human
cuccgcucccagcuccuc

SEQ ID NO: 829853 - RNA, 21 nt, Human
cugcuucccccacccaccccc

SEQ ID NO: 829854 - RNA, 26 nt, Human
cuucccccacccaccccccuaggucu

SEQ ID NO: 829855 - RNA, 22 nt, Human
gaaauacuagaaacauugacac

SEQ ID NO: 829856 - RNA, 18 nt, Human
gaauaucuucugauuugg

SEQ ID NO: 829857 - RNA, 18 nt, Human
gcaagaaagagaaacaac

SEQ ID NO: 829858 - RNA, 20 nt, Human
gcucacagugguccugggcc

SEQ ID NO: 829859 - RNA, 19 nt, Human
ggagauggaggugcacuca

SEQ ID NO: 829860 - RNA, 24 nt, Human
gguuuuguguuugcucauguuuug

SEQ ID NO: 829861 - RNA, 18 nt, Human
gucuguguguguaugcgu

SEQ ID NO: 829862 - RNA, 22 nt, Human
gugauuccuugugccauuuucu

SEQ ID NO: 829863 - RNA, 19 nt, Human
gugugugaagucaaacagg

SEQ ID NO: 829864 - RNA, 23 nt, Human
uaaacgagaugcugaaaaagccc

SEQ ID NO: 829865 - RNA, 20 nt, Human
uaaagagggaauggggucuu

SEQ ID NO: 829866 - RNA, 22 nt, Human
uaaauuccacacauaaacgaga

SEQ ID NO: 829867 - RNA, 22 nt, Human
uaggaggaaaugaaugccuugc

SEQ ID NO: 829868 - RNA, 25 nt, Human
uauaaaaauaauucgaaaaaauccc

SEQ ID NO: 829869 - RNA, 21 nt, Human
ucaaaagcccggggcaacuga

SEQ ID NO: 829870 - RNA, 23 nt, Human
ucaaacagggaggggcauacaca

SEQ ID NO: 829871 - RNA, 23 nt, Human
ucauuuggaaaguuaugagugug

SEQ ID NO: 829872 - RNA, 23 nt, Human
ucauuuggaaaguuaugagugug

SEQ ID NO: 829873 - RNA, 19 nt, Human
uccauccucccaggaagaa

SEQ ID NO: 829874 - RNA, 18 nt, Human
uccccacgccgcucgguc

SEQ ID NO: 829875 - RNA, 20 nt, Human
ucccuaagcugccuuggguu

SEQ ID NO: 829876 - RNA, 21 nt, Human
ucccuaagcugccuuggguuu

SEQ ID NO: 829877 - RNA, 23 nt, Human
uccuugugccauuuucuuuuguc

SEQ ID NO: 829878 - RNA, 24 nt, Human
ucugcuucccccacccaccccccu

SEQ ID NO: 829879 - RNA, 24 nt, Human
ucuggcuugcuuuuguucucccuu

SEQ ID NO: 829880 - RNA, 18 nt, Human
ucuguaaagcgcuugauu

SEQ ID NO: 829881 - RNA, 18 nt, Human
ucugugugucugugugug

SEQ ID NO: 829882 - RNA, 23 nt, Human
ucuuuucccacugccuuucuccc

SEQ ID NO: 829883 - RNA, 22 nt, Human
ugaaauacuagaaacauugaca

SEQ ID NO: 829884 - RNA, 20 nt, Human
ugagcuauggcuuccuccuc

SEQ ID NO: 829885 - RNA, 19 nt, Human
ugcacuguuuccauccucc

SEQ ID NO: 829886 - RNA, 18 nt, Human
ugcgugugaucuaugcag

SEQ ID NO: 829887 - RNA, 22 nt, Human
uggcauuucuuaaaaaggcuuu

SEQ ID NO: 829888 - RNA, 22 nt, Human
uggccaaagacaugacaaguau

SEQ ID NO: 829889 - RNA, 21 nt, Human
uggcuugcuuuuguucucccu

SEQ ID NO: 829890 - RNA, 20 nt, Human
uggggucuuccagcagcagu

SEQ ID NO: 829891 - RNA, 18 nt, Human
ugguccugggccgggccu

SEQ ID NO: 829892 - RNA, 23 nt, Human
uguaugggggcccuuuguuguca

SEQ ID NO: 829893 - RNA, 22 nt, Human
ugugaagucaaacagggagggg

SEQ ID NO: 829894 - RNA, 21 nt, Human
ugugucuguguguguaugcgu

SEQ ID NO: 829895 - RNA, 24 nt, Human
ugugugaagucaaacagggagggg

SEQ ID NO: 829896 - RNA, 19 nt, Human
uguguguaugcguggcuau

SEQ ID NO: 829897 - RNA, 26 nt, Human
uguguguaugcguggcuaugugcgug

SEQ ID NO: 829898 - RNA, 21 nt, Human
uguguguguaugcguggcuau

SEQ ID NO: 829899 - RNA, 21 nt, Human
uguuuuguuuuguuuuagcug

SEQ ID NO: 829900 - RNA, 21 nt, Human
uuacaguucaacuaucagaaa

SEQ ID NO: 829901 - RNA, 21 nt, Human
uuagagaaaugugacacuuag

SEQ ID NO: 829902 - RNA, 19 nt, Human
uucaacuaucagaaaugcu

SEQ ID NO: 829903 - RNA, 19 nt, Human
uucccccacccaccccccu

SEQ ID NO: 829904 - RNA, 20 nt, Human
uugauuuugaguuccagagc

SEQ ID NO: 829905 - RNA, 22 nt, Human
uuggggagcaaaugcagaugau

SEQ ID NO: 829906 - RNA, 24 nt, Human
uuguuuuguuuuagcugcaccacg

SEQ ID NO: 829907 - RNA, 25 nt, Human
uuuaaaacauuucugaagcugacuu

SEQ ID NO: 829908 - RNA, 20 nt, Human
uuucaauucuguauuuacuc

SEQ ID NO: 829909 - RNA, 22 nt, Human
uuugaaauucaguguaccccac

SEQ ID NO: 829910 - RNA, 22 nt, Human
uuuuuuuuuuuuucagaaugga

SEQ ID NO: 829911 - RNA, 23 nt, Human
aaaaacauuaacuuaauucacag

SEQ ID NO: 829912 - RNA, 20 nt, Human
aaaaauacccaacuuacucc

SEQ ID NO: 829913 - RNA, 24 nt, Human
aaaaauacccaacuuacuccaaga

SEQ ID NO: 829914 - RNA, 26 nt, Human
aaacaccaagaaucuccaccauucuu

SEQ ID NO: 829915 - RNA, 28 nt, Human
aaacagagagagagcacggcauaccugg

SEQ ID NO: 829916 - RNA, 20 nt, Human
aaaggcugggcaguaucauc

SEQ ID NO: 829917 - RNA, 20 nt, Human
aacaaauguucacauguggc

SEQ ID NO: 829918 - RNA, 18 nt, Human
aacacguaagcugcccuc

SEQ ID NO: 829919 - RNA, 18 nt, Human
aacccaguaucccaaguc

SEQ ID NO: 829920 - RNA, 22 nt, Human
aacccaguaucccaagucaaaa

SEQ ID NO: 829921 - RNA, 22 nt, Human
aacuauggccaaaaaggccuaa

SEQ ID NO: 829922 - RNA, 20 nt, Human
aacuuucuugucuugacuuu

SEQ ID NO: 829923 - RNA, 26 nt, Human
aagaagaggaagguucagacaaagag

SEQ ID NO: 829924 - RNA, 20 nt, Human
aagagagguauauuagugau

SEQ ID NO: 829925 - RNA, 24 nt, Human
aagaggccuaaaaauaagaaugau

SEQ ID NO: 829926 - RNA, 18 nt, Human
aagcaaauucuaaacaca

SEQ ID NO: 829927 - RNA, 21 nt, Human
aagcaaccucuuucauucuga

SEQ ID NO: 829928 - RNA, 21 nt, Human
aagcagaggcucugcacaaga

SEQ ID NO: 829929 - RNA, 19 nt, Human
aagcccagaggaccagcag

SEQ ID NO: 829930 - RNA, 22 nt, Human
aagcugcccuccugcaaaagcc

SEQ ID NO: 829931 - RNA, 20 nt, Human
aaggccccuaugaccugaaa

SEQ ID NO: 829932 - RNA, 21 nt, Human
aaggccccuaugaccugaaac

SEQ ID NO: 829933 - RNA, 23 nt, Human
aauacccaacuuacuccaagagc

SEQ ID NO: 829934 - RNA, 20 nt, Human
aauucagucaacaaguuuug

SEQ ID NO: 829935 - RNA, 22 nt, Human
acaccuggccuacuaugaaaau

SEQ ID NO: 829936 - RNA, 18 nt, Human
acaggacccagccuagag

SEQ ID NO: 829937 - RNA, 21 nt, Human
accaagcccagaggaccagca

SEQ ID NO: 829938 - RNA, 21 nt, Human
accaccuacccccagcuuaaa

SEQ ID NO: 829939 - RNA, 19 nt, Human
accaggcauagggaauggu

SEQ ID NO: 829940 - RNA, 23 nt, Human
accgucuuguuagcaucaugcuc

SEQ ID NO: 829941 - RNA, 21 nt, Human
accugccccuccuccuuuacc

SEQ ID NO: 829942 - RNA, 20 nt, Human
acggggagaagacaggaggg

SEQ ID NO: 829943 - RNA, 24 nt, Human
acucaccauucaaaggaaaaaaca

SEQ ID NO: 829944 - RNA, 19 nt, Human
acucaguucaucacauagu

SEQ ID NO: 829945 - RNA, 20 nt, Human
acugaaaugacagcaaccca

SEQ ID NO: 829946 - RNA, 29 nt, Human
acugccccuaaauucuaguuccaaaaaaa

SEQ ID NO: 829947 - RNA, 22 nt, Human
acuucauagcccaggcaagaca

SEQ ID NO: 829948 - RNA, 18 nt, Human
acuuuaucuuucuuuagu

SEQ ID NO: 829949 - RNA, 19 nt, Human
agaaaaaggaggucuucuu

SEQ ID NO: 829950 - RNA, 19 nt, Human
agaaaauucuuauuccccu

SEQ ID NO: 829951 - RNA, 19 nt, Human
agaaaggaaauugcaaaaa

SEQ ID NO: 829952 - RNA, 25 nt, Human
agaaaggaccccucaacccuugaga

SEQ ID NO: 829953 - RNA, 19 nt, Human
agaaaguggcagauuccaa

SEQ ID NO: 829954 - RNA, 19 nt, Human
agaagacaggagggcuggc

SEQ ID NO: 829955 - RNA, 24 nt, Human
agaagaggaagguucagacaaaga

SEQ ID NO: 829956 - RNA, 24 nt, Human
agaaucuggcauagagcaaggcuu

SEQ ID NO: 829957 - RNA, 27 nt, Human
agagcacggcauaccugggcacaccag

SEQ ID NO: 829958 - RNA, 21 nt, Human
agcacaaucuccuuauucacu

SEQ ID NO: 829959 - RNA, 22 nt, Human
agcaggaggguggacacgugga

SEQ ID NO: 829960 - RNA, 25 nt, Human
agccacaggcuccacuucauagccc

SEQ ID NO: 829961 - RNA, 21 nt, Human
agcucacugauaagcaaccuc

SEQ ID NO: 829962 - RNA, 18 nt, Human
agcuccuuccggcagauu

SEQ ID NO: 829963 - RNA, 20 nt, Human
aggaguuuucacucuaaugu

SEQ ID NO: 829964 - RNA, 20 nt, Human
agggagaaguucugcauugg

SEQ ID NO: 829965 - RNA, 19 nt, Human
agggaugcucagggcuucc

SEQ ID NO: 829966 - RNA, 21 nt, Human
agggaugcucagggcuuccug

SEQ ID NO: 829967 - RNA, 20 nt, Human
aggggaugggacugggguca

SEQ ID NO: 829968 - RNA, 19 nt, Human
agggucuggagaaagcauc

SEQ ID NO: 829969 - RNA, 24 nt, Human
aguauucagggcaaaaucuaugca

SEQ ID NO: 829970 - RNA, 23 nt, Human
aguggcaaagguaacugaagaga

SEQ ID NO: 829971 - RNA, 24 nt, Human
auccagguuggcugcucaaacacc

SEQ ID NO: 829972 - RNA, 21 nt, Human
auccuaacauggcaggacaca

SEQ ID NO: 829973 - RNA, 23 nt, Human
auggaugauggauauggaaggca

SEQ ID NO: 829974 - RNA, 21 nt, Human
auggcaggacacaaaaccaag

SEQ ID NO: 829975 - RNA, 18 nt, Human
auugcuauaacucuuagg

SEQ ID NO: 829976 - RNA, 21 nt, Human
auuuguuuaggcuuauuuucc

SEQ ID NO: 829977 - RNA, 23 nt, Human
caaaacugcccauuucuucuaga

SEQ ID NO: 829978 - RNA, 22 nt, Human
caaaauucucaacuauggccaa

SEQ ID NO: 829979 - RNA, 19 nt, Human
caaauguucacauguggca

SEQ ID NO: 829980 - RNA, 18 nt, Human
caacagggcagcccagcc

SEQ ID NO: 829981 - RNA, 28 nt, Human
caacagggcagcccagccagcaucucuu

SEQ ID NO: 829982 - RNA, 21 nt, Human
caacccaguaucccaagucaa

SEQ ID NO: 829983 - RNA, 19 nt, Human
caaccucucugcacacaac

SEQ ID NO: 829984 - RNA, 21 nt, Human
caaccucucugcacacaacuu

SEQ ID NO: 829985 - RNA, 24 nt, Human
caaccucucugcacacaacuuggu

SEQ ID NO: 829986 - RNA, 21 nt, Human
caacgagccccaaaccugaau

SEQ ID NO: 829987 - RNA, 22 nt, Human
caacuauggccaaaaaggccua

SEQ ID NO: 829988 - RNA, 23 nt, Human
caacucccaugaccaagcccaga

SEQ ID NO: 829989 - RNA, 18 nt, Human
caagacauacucugagga

SEQ ID NO: 829990 - RNA, 20 nt, Human
caagucugccuccuaaagag

SEQ ID NO: 829991 - RNA, 23 nt, Human
caauauccuaacauggcaggaca

SEQ ID NO: 829992 - RNA, 23 nt, Human
caccaaauuacaaaacugcccau

SEQ ID NO: 829993 - RNA, 19 nt, Human
caccaacaacccaguaucc

SEQ ID NO: 829994 - RNA, 22 nt, Human
caccacuggaaacagagagaga

SEQ ID NO: 829995 - RNA, 21 nt, Human
caccagaaggaaaaacaauga

SEQ ID NO: 829996 - RNA, 23 nt, Human
caccagaaggaaaaacaaugauu

SEQ ID NO: 829997 - RNA, 23 nt, Human
cacccugaaccucaggauaccac

SEQ ID NO: 829998 - RNA, 21 nt, Human
caccuggaacuucuucugacu

SEQ ID NO: 829999 - RNA, 20 nt, Human
caccugguccuccuccacgu

SEQ ID NO: 830000 - RNA, 19 nt, Human
cacgucgcccagcuccagg

SEQ ID NO: 830001 - RNA, 22 nt, Human
cacuaccucccacucccaccuc

SEQ ID NO: 830002 - RNA, 26 nt, Human
cacuggaaacagagagagagcacggc

SEQ ID NO: 830003 - RNA, 20 nt, Human
cacuggcacguucuccucug

SEQ ID NO: 830004 - RNA, 20 nt, Human
cagaaacauccuuuuuuccc

SEQ ID NO: 830005 - RNA, 23 nt, Human
cagaaagcuaccgagacaagcac

SEQ ID NO: 830006 - RNA, 20 nt, Human
cagaaaggaccccucaaccc

SEQ ID NO: 830007 - RNA, 21 nt, Human
cagcagcucugggagaaagga

SEQ ID NO: 830008 - RNA, 23 nt, Human
cagccaccaccaaauuacaaaac

SEQ ID NO: 830009 - RNA, 18 nt, Human
cagcgcagcagcggcgcc

SEQ ID NO: 830010 - RNA, 23 nt, Human
cauaaguaauucacaccuggccu

SEQ ID NO: 830011 - RNA, 20 nt, Human
caucagggaugcucagggcu

SEQ ID NO: 830012 - RNA, 23 nt, Human
ccaaaaaggccuaaacucgaccc

SEQ ID NO: 830013 - RNA, 24 nt, Human
ccaccaaauuacaaaacugcccau

SEQ ID NO: 830014 - RNA, 22 nt, Human
ccagccucccgccugcggcugc

SEQ ID NO: 830015 - RNA, 31 nt, Human
ccagcgcagcagcggcgccgcgucucccuuu

SEQ ID NO: 830016 - RNA, 18 nt, Human
ccaggggccaacuggaca

SEQ ID NO: 830017 - RNA, 23 nt, Human
ccaguaucccaagucaaaauucu

SEQ ID NO: 830018 - RNA, 23 nt, Human
cccaggcaagacauacucugagg

SEQ ID NO: 830019 - RNA, 24 nt, Human
cccauaaccgagccaggccggggc

SEQ ID NO: 830020 - RNA, 19 nt, Human
cccauacccuggcccucug

SEQ ID NO: 830021 - RNA, 19 nt, Human
cccaugaccaagcccagag

SEQ ID NO: 830022 - RNA, 19 nt, Human
cccaugaccaagcccagag

SEQ ID NO: 830023 - RNA, 21 nt, Human
ccccagccucccgccugcggc

SEQ ID NO: 830024 - RNA, 24 nt, Human
ccccgccgccgccccggccccagc

SEQ ID NO: 830025 - RNA, 23 nt, Human
ccccuucuaaauuugcaauuuuu

SEQ ID NO: 830026 - RNA, 20 nt, Human
cccgccugcggcugcggggc

SEQ ID NO: 830027 - RNA, 20 nt, Human
cccggccccagccucccgcc

SEQ ID NO: 830028 - RNA, 22 nt, Human
cccgggcugcagcagcaccucc

SEQ ID NO: 830029 - RNA, 20 nt, Human
cccuaaagagcuuacagacc

SEQ ID NO: 830030 - RNA, 19 nt, Human
cccugaaccucaggauacc

SEQ ID NO: 830031 - RNA, 18 nt, Human
cccuggauccaauuauuu

SEQ ID NO: 830032 - RNA, 23 nt, Human
cccuggggugaacuccgggcugg

SEQ ID NO: 830033 - RNA, 21 nt, Human
cccuugagaggcaagaagaga

SEQ ID NO: 830034 - RNA, 21 nt, Human
ccgccgccgccccggccccag

SEQ ID NO: 830035 - RNA, 19 nt, Human
ccggccccagccucccgcc

SEQ ID NO: 830036 - RNA, 18 nt, Human
ccggccgggcgcccccgc

SEQ ID NO: 830037 - RNA, 26 nt, Human
ccggccgggcgcccccgccgccgccc

SEQ ID NO: 830038 - RNA, 28 nt, Human
ccuaugaccugaaacauggccggggucc

SEQ ID NO: 830039 - RNA, 19 nt, Human
ccuccacgucgcccagcuc

SEQ ID NO: 830040 - RNA, 19 nt, Human
ccuccggggcggccggcuc

SEQ ID NO: 830041 - RNA, 28 nt, Human
ccuccucucccccuaccugaaucacaaa

SEQ ID NO: 830042 - RNA, 24 nt, Human
ccucugaguuaaccagcucagauc

SEQ ID NO: 830043 - RNA, 21 nt, Human
ccucuggggccacccauaccc

SEQ ID NO: 830044 - RNA, 24 nt, Human
ccugcggcagggagacggcggggc

SEQ ID NO: 830045 - RNA, 27 nt, Human
ccuuccggcagauucccuaauuccagg

SEQ ID NO: 830046 - RNA, 24 nt, Human
ccuuuuuucccucuuugugguccc

SEQ ID NO: 830047 - RNA, 28 nt, Human
cgagccccaaaccugaauuccacucccu

SEQ ID NO: 830048 - RNA, 27 nt, Human
cgcccgggcugcagcagccggggguuc

SEQ ID NO: 830049 - RNA, 19 nt, Human
cgccgccccggccccagcc

SEQ ID NO: 830050 - RNA, 21 nt, Human
cggcaggagaugguggcagaa

SEQ ID NO: 830051 - RNA, 21 nt, Human
cggcuccucgggcucccgccu

SEQ ID NO: 830052 - RNA, 18 nt, Human
cggcugcggggccugcgg

SEQ ID NO: 830053 - RNA, 25 nt, Human
cuacccccagcuuaaaacacccucc

SEQ ID NO: 830054 - RNA, 18 nt, Human
cuagaacuacuaaaaacc

SEQ ID NO: 830055 - RNA, 24 nt, Human
cuaggacugucaagucugccuccu

SEQ ID NO: 830056 - RNA, 23 nt, Human
cucaaacaccaagaaucuccacc

SEQ ID NO: 830057 - RNA, 22 nt, Human
cucagaaaauauuucaagacug

SEQ ID NO: 830058 - RNA, 18 nt, Human
cuccacgucgcccagcuc

SEQ ID NO: 830059 - RNA, 21 nt, Human
cuccagagaauucguguccag

SEQ ID NO: 830060 - RNA, 19 nt, Human
cuccuagaacuacuaaaaa

SEQ ID NO: 830061 - RNA, 22 nt, Human
cuccuagaacuacuaaaaaccu

SEQ ID NO: 830062 - RNA, 24 nt, Human
cuccuccacgucgcccagcuccag

SEQ ID NO: 830063 - RNA, 20 nt, Human
cuccugccucuaaccaccua

SEQ ID NO: 830064 - RNA, 23 nt, Human
cucggguuucugccuuuucucgg

SEQ ID NO: 830065 - RNA, 20 nt, Human
cucucaagaaagaggccuaa

SEQ ID NO: 830066 - RNA, 23 nt, Human
cucugggagaaaguggcagauuc

SEQ ID NO: 830067 - RNA, 22 nt, Human
cugaaaugacagcaacccacau

SEQ ID NO: 830068 - RNA, 22 nt, Human
cugacuggccuuagaaagcaaa

SEQ ID NO: 830069 - RNA, 19 nt, Human
cugcaagguugaccuauac

SEQ ID NO: 830070 - RNA, 21 nt, Human
cugccccuaaauucuaguucc

SEQ ID NO: 830071 - RNA, 23 nt, Human
cuggggccacccauacccuggcc

SEQ ID NO: 830072 - RNA, 21 nt, Human
cuggguguuggucacagacau

SEQ ID NO: 830073 - RNA, 20 nt, Human
cuuaaaacacccugaaccuu

SEQ ID NO: 830074 - RNA, 20 nt, Human
cuuccugaccacugucccgg

SEQ ID NO: 830075 - RNA, 19 nt, Human
cuucugacuuauucaggaa

SEQ ID NO: 830076 - RNA, 19 nt, Human
cuuuccucugcucuguccc

SEQ ID NO: 830077 - RNA, 24 nt, Human
gaagaggaagguucagacaaagag

SEQ ID NO: 830078 - RNA, 19 nt, Human
gagccaggcgggaaggggg

SEQ ID NO: 830079 - RNA, 21 nt, Human
gauucuaacucagaaagaaau

SEQ ID NO: 830080 - RNA, 18 nt, Human
gcaagcuccaaggccagc

SEQ ID NO: 830081 - RNA, 23 nt, Human
gccaccaccugguccuccuccac

SEQ ID NO: 830082 - RNA, 19 nt, Human
gccaccagaaggaaaaaca

SEQ ID NO: 830083 - RNA, 19 nt, Human
gcccuggggugaacuccgg

SEQ ID NO: 830084 - RNA, 20 nt, Human
gccgccgccccggccccagc

SEQ ID NO: 830085 - RNA, 20 nt, Human
gccuuaaaauuaccaccacu

SEQ ID NO: 830086 - RNA, 22 nt, Human
ggaaaaggaagacauuauuugu

SEQ ID NO: 830087 - RNA, 22 nt, Human
ggaaaguauaaacaauauuccu

SEQ ID NO: 830088 - RNA, 21 nt, Human
ggauaccacgaaaaauaacca

SEQ ID NO: 830089 - RNA, 22 nt, Human
ggaugcucagggcuuccugacc

SEQ ID NO: 830090 - RNA, 20 nt, Human
ggcaagacauacucugagga

SEQ ID NO: 830091 - RNA, 20 nt, Human
ggcaggacacaaaaccaagg

SEQ ID NO: 830092 - RNA, 21 nt, Human
ggcaggagaugguggcagaag

SEQ ID NO: 830093 - RNA, 22 nt, Human
ggccccagccucccgccugcgg

SEQ ID NO: 830094 - RNA, 24 nt, Human
ggccuuaaaauuaccaccacugga

SEQ ID NO: 830095 - RNA, 19 nt, Human
ggccuuagaaagcaaagua

SEQ ID NO: 830096 - RNA, 18 nt, Human
ggcuccuagcuucugcug

SEQ ID NO: 830097 - RNA, 20 nt, Human
gggaaaacaguuuuucuaag

SEQ ID NO: 830098 - RNA, 20 nt, Human
gggcaguaucaucugcugag

SEQ ID NO: 830099 - RNA, 26 nt, Human
gggcggcuccgcggccggccgggcgc

SEQ ID NO: 830100 - RNA, 18 nt, Human
guaccacagaacaaaauc

SEQ ID NO: 830101 - RNA, 21 nt, Human
guguggcaugagaucaggcug

SEQ ID NO: 830102 - RNA, 22 nt, Human
uaaaacacccugaaccucagga

SEQ ID NO: 830103 - RNA, 22 nt, Human
uaaaacauccugccucaucccc

SEQ ID NO: 830104 - RNA, 23 nt, Human
uaaacucgacccacaggaacugg

SEQ ID NO: 830105 - RNA, 19 nt, Human
uaaaguugcccuaaugaac

SEQ ID NO: 830106 - RNA, 21 nt, Human
uaaauggucccucggguuucu

SEQ ID NO: 830107 - RNA, 21 nt, Human
uaacaccaucuuaaaauuuuu

SEQ ID NO: 830108 - RNA, 20 nt, Human
uaacacuaccucccacuccc

SEQ ID NO: 830109 - RNA, 18 nt, Human
uaacauggcaggacacaa

SEQ ID NO: 830110 - RNA, 22 nt, Human
uaacuccuccucucccccuacc

SEQ ID NO: 830111 - RNA, 19 nt, Human
uaacugaagagauaaagca

SEQ ID NO: 830112 - RNA, 19 nt, Human
uaacuuaauucacaguuag

SEQ ID NO: 830113 - RNA, 20 nt, Human
uaagaaaaacauuaacuuaa

SEQ ID NO: 830114 - RNA, 22 nt, Human
uaauaaaaaaugaggcccucug

SEQ ID NO: 830115 - RNA, 25 nt, Human
uaauaucaauaaaaaaauaaacuuc

SEQ ID NO: 830116 - RNA, 24 nt, Human
uacagaauugaaaaugcccucuug

SEQ ID NO: 830117 - RNA, 19 nt, Human
uaccacagaacaaaaucaa

SEQ ID NO: 830118 - RNA, 22 nt, Human
uagcuugggaucuacuagggag

SEQ ID NO: 830119 - RNA, 24 nt, Human
uauaugcauacucaguucaucaca

SEQ ID NO: 830120 - RNA, 21 nt, Human
uauccuauuuuauucauccac

SEQ ID NO: 830121 - RNA, 26 nt, Human
uauucacucuccaaauuauuuacaua

SEQ ID NO: 830122 - RNA, 18 nt, Human
uauuuuauucauccaccu

SEQ ID NO: 830123 - RNA, 22 nt, Human
ucaaacaccaagaaucuccacc

SEQ ID NO: 830124 - RNA, 21 nt, Human
ucaagggacaaagaccacaca

SEQ ID NO: 830125 - RNA, 21 nt, Human
ucaagucugccuccuaaagag

SEQ ID NO: 830126 - RNA, 21 nt, Human
ucacaggagaacuaggccugc

SEQ ID NO: 830127 - RNA, 24 nt, Human
ucaccaacaacccaguaucccaag

SEQ ID NO: 830128 - RNA, 21 nt, Human
ucaccauucaaaggaaaaaac

SEQ ID NO: 830129 - RNA, 19 nt, Human
ucacugauaagcaaccucu

SEQ ID NO: 830130 - RNA, 21 nt, Human
ucagaaaauauuucaagacug

SEQ ID NO: 830131 - RNA, 21 nt, Human
ucagaaagaaaugggaaaaca

SEQ ID NO: 830132 - RNA, 22 nt, Human
ucagacaaagaggaacauuaca

SEQ ID NO: 830133 - RNA, 23 nt, Human
ucagcucacugauaagcaaccuc

SEQ ID NO: 830134 - RNA, 24 nt, Human
ucaggaacaacagggcagcccagc

SEQ ID NO: 830135 - RNA, 20 nt, Human
ucauagcccaggcaagacau

SEQ ID NO: 830136 - RNA, 18 nt, Human
ucaucacacuaaggcaag

SEQ ID NO: 830137 - RNA, 18 nt, Human
ucauguuggggagcagaa

SEQ ID NO: 830138 - RNA, 20 nt, Human
ucauucucacccugcuaugu

SEQ ID NO: 830139 - RNA, 19 nt, Human
ucauuuaaaacauccugcc

SEQ ID NO: 830140 - RNA, 19 nt, Human
uccagagcucagccuacuc

SEQ ID NO: 830141 - RNA, 25 nt, Human
uccaugacuugggaguaaacggagc

SEQ ID NO: 830142 - RNA, 20 nt, Human
ucccacucccaccucucuca

SEQ ID NO: 830143 - RNA, 23 nt, Human
ucccacucccaccucucucaaga

SEQ ID NO: 830144 - RNA, 22 nt, Human
ucccggaccuauacaaaaauuc

SEQ ID NO: 830145 - RNA, 18 nt, Human
ucccgggugaaggcacug

SEQ ID NO: 830146 - RNA, 18 nt, Human
ucccucuuuguggucccu

SEQ ID NO: 830147 - RNA, 18 nt, Human
ucccugaaggccucaguu

SEQ ID NO: 830148 - RNA, 19 nt, Human
ucccuggauccaauuauuu

SEQ ID NO: 830149 - RNA, 18 nt, Human
uccgguaguccaaacuuc

SEQ ID NO: 830150 - RNA, 21 nt, Human
uccuccacgucgcccagcucc

SEQ ID NO: 830151 - RNA, 19 nt, Human
ucgacccacaggaacuggc

SEQ ID NO: 830152 - RNA, 20 nt, Human
ucggcccagcgcagcagcgg

SEQ ID NO: 830153 - RNA, 21 nt, Human
ucguguccagaugaagagacu

SEQ ID NO: 830154 - RNA, 21 nt, Human
ucucugcacacaacuugguuc

SEQ ID NO: 830155 - RNA, 19 nt, Human
ucugccuuuucucggaggg

SEQ ID NO: 830156 - RNA, 18 nt, Human
ucuggagaaagcaucuca

SEQ ID NO: 830157 - RNA, 21 nt, Human
ucuggcauagagcaaggcuuc

SEQ ID NO: 830158 - RNA, 23 nt, Human
ucuucuagaauaauaguuuuaaa

SEQ ID NO: 830159 - RNA, 18 nt, Human
ucuucuuguguccucuag

SEQ ID NO: 830160 - RNA, 19 nt, Human
ugaaaugacagcaacccac

SEQ ID NO: 830161 - RNA, 23 nt, Human
ugaauguuauuucucccugcugu

SEQ ID NO: 830162 - RNA, 19 nt, Human
ugacagaaaggaccccuca

SEQ ID NO: 830163 - RNA, 18 nt, Human
ugagaggcaagaagagag

SEQ ID NO: 830164 - RNA, 24 nt, Human
ugagaugagaugugugaaccacca

SEQ ID NO: 830165 - RNA, 19 nt, Human
ugagaugugugaaccacca

SEQ ID NO: 830166 - RNA, 22 nt, Human
ugagccuacagaauugaaaaug

SEQ ID NO: 830167 - RNA, 23 nt, Human
ugaggcccucuggggcccugggg

SEQ ID NO: 830168 - RNA, 18 nt, Human
ugagguaaagacccgaaa

SEQ ID NO: 830169 - RNA, 21 nt, Human
ugauauuccauaugaaggagc

SEQ ID NO: 830170 - RNA, 19 nt, Human
ugcaguuaaaacugcagug

SEQ ID NO: 830171 - RNA, 18 nt, Human
ugcaucaagacugagagc

SEQ ID NO: 830172 - RNA, 18 nt, Human
ugcaugagcaggagggug

SEQ ID NO: 830173 - RNA, 18 nt, Human
ugccucauccccacauuc

SEQ ID NO: 830174 - RNA, 21 nt, Human
ugcuguguacauuagucuggc

SEQ ID NO: 830175 - RNA, 23 nt, Human
uggagaaagcaucucaauccauu

SEQ ID NO: 830176 - RNA, 20 nt, Human
uggcagaaaagcagguccac

SEQ ID NO: 830177 - RNA, 24 nt, Human
uggcagaaaagcagguccacaugg

SEQ ID NO: 830178 - RNA, 19 nt, Human
uggcagaaggugucacacc

SEQ ID NO: 830179 - RNA, 24 nt, Human
uggcucccaguccuguuggcuccu

SEQ ID NO: 830180 - RNA, 18 nt, Human
ugggacuggggucagcag

SEQ ID NO: 830181 - RNA, 18 nt, Human
ugggaucuacuagggaga

SEQ ID NO: 830182 - RNA, 22 nt, Human
ugggcaguaucaucugcugagc

SEQ ID NO: 830183 - RNA, 23 nt, Human
uggggcccuggggugaacuccgg

SEQ ID NO: 830184 - RNA, 22 nt, Human
uggggucagcugagcccaaggc

SEQ ID NO: 830185 - RNA, 20 nt, Human
uggggucucagccaccacca

SEQ ID NO: 830186 - RNA, 21 nt, Human
uggggugaacuccgggcugcu

SEQ ID NO: 830187 - RNA, 22 nt, Human
uggucccucggguuucugccuu

SEQ ID NO: 830188 - RNA, 18 nt, Human
ugguugucuuauucucaa

SEQ ID NO: 830189 - RNA, 18 nt, Human
ugucaagucugccuccua

SEQ ID NO: 830190 - RNA, 22 nt, Human
ugucuauuugcauuuccacaug

SEQ ID NO: 830191 - RNA, 23 nt, Human
ugucuugacuuuaaaguggaaca

SEQ ID NO: 830192 - RNA, 18 nt, Human
ugugagggguccaaaaug

SEQ ID NO: 830193 - RNA, 19 nt, Human
uguggagaguccuaagcca

SEQ ID NO: 830194 - RNA, 22 nt, Human
uuaaaaauacccaacuuacucc

SEQ ID NO: 830195 - RNA, 22 nt, Human
uuaaaagaucaucuggucuagu

SEQ ID NO: 830196 - RNA, 22 nt, Human
uuaacuuucuugucuugacuuu

SEQ ID NO: 830197 - RNA, 25 nt, Human
uuaggcagaugaacaucuaaggcca

SEQ ID NO: 830198 - RNA, 23 nt, Human
uuauucacucuccaaauuauuua

SEQ ID NO: 830199 - RNA, 25 nt, Human
uucaggaacaacagggcagcccagc

SEQ ID NO: 830200 - RNA, 22 nt, Human
uucaucuuuuacuguguuugaa

SEQ ID NO: 830201 - RNA, 24 nt, Human
uucaucuuuuacuguguuugaagg

SEQ ID NO: 830202 - RNA, 19 nt, Human
uuccagaaaaaggaggucu

SEQ ID NO: 830203 - RNA, 19 nt, Human
uugucuugcccauguuaga

SEQ ID NO: 830204 - RNA, 20 nt, Human
uugugccuguuaaucuguca

SEQ ID NO: 830205 - RNA, 18 nt, Human
uuuacauuucaaugccca

SEQ ID NO: 830206 - RNA, 21 nt, Human
uuucccacaacacucaauacu

SEQ ID NO: 830207 - RNA, 23 nt, Human
uuucugguccuaugaagaagcug

SEQ ID NO: 830208 - RNA, 26 nt, Human
uuugcaaccauccaacucaaagacca

SEQ ID NO: 830209 - RNA, 24 nt, Human
uuugcaauuucauccaacugcccc

SEQ ID NO: 830210 - RNA, 19 nt, Human
uuuguaccacagaacaaaa

SEQ ID NO: 830211 - RNA, 24 nt, Human
uuuugcuuuccucugcucuguccc

SEQ ID NO: 830212 - RNA, 26 nt, Human
aagucaaccucaaaauauuuacuugg

SEQ ID NO: 830213 - RNA, 21 nt, Human
acuugggagaagaucuucauc

SEQ ID NO: 830214 - RNA, 21 nt, Human
aggaacaggaagaggaacaug

SEQ ID NO: 830215 - RNA, 25 nt, Human
aggaacaggaagaggaaccgguacc

SEQ ID NO: 830216 - RNA, 18 nt, Human
caacaggaacaggaagag

SEQ ID NO: 830217 - RNA, 19 nt, Human
gaacaggaagaggaacaug

SEQ ID NO: 830218 - RNA, 18 nt, Human
gaccugcggacgaggccc

SEQ ID NO: 830219 - RNA, 20 nt, Human
gagcuugcaggucuccuccg

SEQ ID NO: 830220 - RNA, 23 nt, Human
gcaggucuccuccaggagggcaa

SEQ ID NO: 830221 - RNA, 23 nt, Human
gucaacaggaacaggaagaggaa

SEQ ID NO: 830222 - RNA, 21 nt, Human
ucaacaggaacaggaagagga

SEQ ID NO: 830223 - RNA, 19 nt, Human
aaaaaaacaaaggaaaagg

SEQ ID NO: 830224 - RNA, 19 nt, Human
aaaacaaaggaaaaggaga

SEQ ID NO: 830225 - RNA, 24 nt, Human
aaaaggagagaaaugcacagcggc

SEQ ID NO: 830226 - RNA, 20 nt, Human
aaggagagaaaugcacagcg

SEQ ID NO: 830227 - RNA, 24 nt, Human
aaggagagaaaugcacagcggcgc

SEQ ID NO: 830228 - RNA, 21 nt, Human
acaugcacauuaaaaccaaca

SEQ ID NO: 830229 - RNA, 19 nt, Human
agacagaggggccgcgagc

SEQ ID NO: 830230 - RNA, 18 nt, Human
aggcgguggcgaaaggga

SEQ ID NO: 830231 - RNA, 21 nt, Human
aggcgguggcgaaagggacgg

SEQ ID NO: 830232 - RNA, 27 nt, Human
caaaaaaacaaaggaaaaggagagaaa

SEQ ID NO: 830233 - RNA, 22 nt, Human
cacaugcacauuaaaaccaaca

SEQ ID NO: 830234 - RNA, 26 nt, Human
ccaacaggugcaaacuacaacaaugc

SEQ ID NO: 830235 - RNA, 23 nt, Human
ccgccgccgccggggcacgccug

SEQ ID NO: 830236 - RNA, 19 nt, Human
ccgcgaggggccaaaaaaa

SEQ ID NO: 830237 - RNA, 19 nt, Human
cgagcggagccgggcggcg

SEQ ID NO: 830238 - RNA, 26 nt, Human
cgaggggccaaaaaaacaaaggaaaa

SEQ ID NO: 830239 - RNA, 23 nt, Human
cggagccgggcggcggcggcgcg

SEQ ID NO: 830240 - RNA, 22 nt, Human
cggcucuccgccgccgccgggg

SEQ ID NO: 830241 - RNA, 25 nt, Human
cugcgcucgcguuucccagccuccu

SEQ ID NO: 830242 - RNA, 20 nt, Human
gagcggagccgggcggcggc

SEQ ID NO: 830243 - RNA, 18 nt, Human
gaggggccgcgagcggag

SEQ ID NO: 830244 - RNA, 19 nt, Human
gcaaggaaaaggcgguggc

SEQ ID NO: 830245 - RNA, 18 nt, Human
gccugcagacagaggggc

SEQ ID NO: 830246 - RNA, 22 nt, Human
gccugcgcucgcguuucccagc

SEQ ID NO: 830247 - RNA, 23 nt, Human
gcucuccgccgccgccggggcac

SEQ ID NO: 830248 - RNA, 18 nt, Human
ggacucggggcacugcag

SEQ ID NO: 830249 - RNA, 22 nt, Human
ggacucggggcacugcagggaa

SEQ ID NO: 830250 - RNA, 21 nt, Human
ggcgcgggcccgggacucggg

SEQ ID NO: 830251 - RNA, 18 nt, Human
ggcggcggcgcgggcccg

SEQ ID NO: 830252 - RNA, 19 nt, Human
ggcggcggcggcgcgggcc

SEQ ID NO: 830253 - RNA, 22 nt, Human
gggcacugcagggaagcggucc

SEQ ID NO: 830254 - RNA, 23 nt, Human
gggcacugcagggaagcgguccg

SEQ ID NO: 830255 - RNA, 19 nt, Human
ggggccaaaaaaacaaagg

SEQ ID NO: 830256 - RNA, 20 nt, Human
uaaaaccaacaggugcaaac

SEQ ID NO: 830257 - RNA, 19 nt, Human
uaggccauucacaugcaca

SEQ ID NO: 830258 - RNA, 19 nt, Human
ugcacagcggcgcgaggca

SEQ ID NO: 830259 - RNA, 20 nt, Human
ugcagggaagcgguccgcgu

SEQ ID NO: 830260 - RNA, 24 nt, Human
ugcccacacccgcgaggggccaaa

SEQ ID NO: 830261 - RNA, 25 nt, Human
uggcgaaagggacggcguugaggcc

SEQ ID NO: 830262 - RNA, 18 nt, Human
uuaaaaccaacaggugca

SEQ ID NO: 830263 - RNA, 20 nt, Human
uuugcuaaccaacaaugccc

SEQ ID NO: 830264 - RNA, 22 nt, Human
aacacaauaaauaccuacaucc

SEQ ID NO: 830265 - RNA, 22 nt, Human
agagagaauggaaaaaagcugc

SEQ ID NO: 830266 - RNA, 24 nt, Human
auauaucuaaugaaaagagucgga

SEQ ID NO: 830267 - RNA, 23 nt, Human
caaaugccaacuacauauauaua

SEQ ID NO: 830268 - RNA, 21 nt, Human
cacaauaaauaccuacauccu

SEQ ID NO: 830269 - RNA, 18 nt, Human
caggaccuucagcacucu

SEQ ID NO: 830270 - RNA, 21 nt, Human
cauuguagaagaagcuacuac

SEQ ID NO: 830271 - RNA, 19 nt, Human
ccagcaagaaugaaagaaa

SEQ ID NO: 830272 - RNA, 19 nt, Human
cggaaugguaguuuuaggc

SEQ ID NO: 830273 - RNA, 24 nt, Human
cggaauuucuagaacacaauaaau

SEQ ID NO: 830274 - RNA, 22 nt, Human
uaauuucggaaugguaguuuua

SEQ ID NO: 830275 - RNA, 22 nt, Human
uagaacacaauaaauaccuaca

SEQ ID NO: 830276 - RNA, 20 nt, Human
uagaagaagcuacuacuuuu

SEQ ID NO: 830277 - RNA, 20 nt, Human
ucuagaacacaauaaauacc

SEQ ID NO: 830278 - RNA, 20 nt, Human
ucuaugaucucuucaauaau

SEQ ID NO: 830279 - RNA, 20 nt, Human
uggaaaaaagcugcugaucc

SEQ ID NO: 830280 - RNA, 23 nt, Human
uuccuguuuccaucuuuuaggaa

SEQ ID NO: 830281 - RNA, 19 nt, Human
aaagcguacaucugccuuu

SEQ ID NO: 830282 - RNA, 22 nt, Human
aaccugcuuguuccuuuacucc

SEQ ID NO: 830283 - RNA, 23 nt, Human
aaccugcuuguuccuuuacucca

SEQ ID NO: 830284 - RNA, 21 nt, Human
aagaaccugcuuguuccuuua

SEQ ID NO: 830285 - RNA, 20 nt, Human
aagggccaccuuucaggcac

SEQ ID NO: 830286 - RNA, 18 nt, Human
aauaauuauagguuucuu

SEQ ID NO: 830287 - RNA, 20 nt, Human
acagagggagcuucuugcca

SEQ ID NO: 830288 - RNA, 20 nt, Human
acugcuguccuuucuuuccc

SEQ ID NO: 830289 - RNA, 19 nt, Human
agcccaaagcauccaucag

SEQ ID NO: 830290 - RNA, 19 nt, Human
aggauguuggagccugaaa

SEQ ID NO: 830291 - RNA, 22 nt, Human
auggguacucgugaaaugacau

SEQ ID NO: 830292 - RNA, 19 nt, Human
cacagguuggguauuugga

SEQ ID NO: 830293 - RNA, 19 nt, Human
cagcaaggccuacaguucc

SEQ ID NO: 830294 - RNA, 18 nt, Human
cagcacugcccuuccuuc

SEQ ID NO: 830295 - RNA, 20 nt, Human
caucuggacuuugagugauu

SEQ ID NO: 830296 - RNA, 18 nt, Human
ccauugagggaggucagg

SEQ ID NO: 830297 - RNA, 24 nt, Human
ccuccaaagcccaaagcauccauc

SEQ ID NO: 830298 - RNA, 21 nt, Human
ccuuccuucccuuugaaagcc

SEQ ID NO: 830299 - RNA, 26 nt, Human
cucuaaauugacaaguuuaguuaugc

SEQ ID NO: 830300 - RNA, 21 nt, Human
gaaaacguggaggagaugcgc

SEQ ID NO: 830301 - RNA, 18 nt, Human
gaagcagaugguuugaug

SEQ ID NO: 830302 - RNA, 21 nt, Human
gagauaccuccaaagcccaaa

SEQ ID NO: 830303 - RNA, 22 nt, Human
gaugguuugauggaccucagaa

SEQ ID NO: 830304 - RNA, 20 nt, Human
gauuguguugcuggcaugga

SEQ ID NO: 830305 - RNA, 22 nt, Human
gcaaggccuacaguuccccaga

SEQ ID NO: 830306 - RNA, 20 nt, Human
gcagcuucagggcaacaggc

SEQ ID NO: 830307 - RNA, 21 nt, Human
gccaagggagaagcagauggu

SEQ ID NO: 830308 - RNA, 18 nt, Human
gccuccugcccucucagg

SEQ ID NO: 830309 - RNA, 18 nt, Human
ggaggauguuggagccug

SEQ ID NO: 830310 - RNA, 23 nt, Human
ggccuuuccuuccggcagcuuca

SEQ ID NO: 830311 - RNA, 24 nt, Human
gggcaggaugugaccacagaucug

SEQ ID NO: 830312 - RNA, 18 nt, Human
gguuggguauuuggauaa

SEQ ID NO: 830313 - RNA, 18 nt, Human
gguuugauggaccucaga

SEQ ID NO: 830314 - RNA, 18 nt, Human
uaccuccaaagcccaaag

SEQ ID NO: 830315 - RNA, 23 nt, Human
ucacccuaaucugcaccucuuua

SEQ ID NO: 830316 - RNA, 19 nt, Human
ucagggcaacaggcauagg

SEQ ID NO: 830317 - RNA, 18 nt, Human
ucaucuggacuuugagug

SEQ ID NO: 830318 - RNA, 20 nt, Human
uccaagggaggacauguauc

SEQ ID NO: 830319 - RNA, 23 nt, Human
uccauagaaaaauaaacucuaaa

SEQ ID NO: 830320 - RNA, 22 nt, Human
ucccaagggccgucucaucuuc

SEQ ID NO: 830321 - RNA, 24 nt, Human
ucggaggugacugcuguccuuucu

SEQ ID NO: 830322 - RNA, 18 nt, Human
ucugcaccucuuuaucuc

SEQ ID NO: 830323 - RNA, 22 nt, Human
ugaaaugacaugggcauuuuaa

SEQ ID NO: 830324 - RNA, 25 nt, Human
ugaguaaggagauugauuggacuuu

SEQ ID NO: 830325 - RNA, 18 nt, Human
ugagugauuguguugcug

SEQ ID NO: 830326 - RNA, 19 nt, Human
ugauggaccucagagcugg

SEQ ID NO: 830327 - RNA, 23 nt, Human
ugcaccucuuuaucucacuaguc

SEQ ID NO: 830328 - RNA, 18 nt, Human
uggaaaguucaaagucug

SEQ ID NO: 830329 - RNA, 24 nt, Human
uggacugucacccuaaucugcacc

SEQ ID NO: 830330 - RNA, 25 nt, Human
uggcuaauaccucuucccaagggcc

SEQ ID NO: 830331 - RNA, 18 nt, Human
uguuggagccugaaagcc

SEQ ID NO: 830332 - RNA, 20 nt, Human
uucagggcaacaggcauagg

SEQ ID NO: 830333 - RNA, 23 nt, Human
uucuaagaagaaauggagaccaa

SEQ ID NO: 830334 - RNA, 19 nt, Human
uuuaagcacauguagauga

SEQ ID NO: 830335 - RNA, 22 nt, Human
uuuuaagcacauguagaugagg

SEQ ID NO: 830336 - RNA, 20 nt, Human
aaaaacacugccaagaccau

SEQ ID NO: 830337 - RNA, 23 nt, Human
aaaaagaaaaugaagaaagagaa

SEQ ID NO: 830338 - RNA, 24 nt, Human
aaaaauccauguuuuuuuccucca

SEQ ID NO: 830339 - RNA, 23 nt, Human
aaacauaaaaguuuguccugcuc

SEQ ID NO: 830340 - RNA, 23 nt, Human
aaacaucuucggcaucaccacau

SEQ ID NO: 830341 - RNA, 25 nt, Human
aaagaaaaaaagaaaaugaagaaag

SEQ ID NO: 830342 - RNA, 24 nt, Human
aacacucucuguggcggccacacc

SEQ ID NO: 830343 - RNA, 21 nt, Human
aacauaaugaagucuccaucu

SEQ ID NO: 830344 - RNA, 23 nt, Human
aacauaauucaacaaggccacaa

SEQ ID NO: 830345 - RNA, 19 nt, Human
aacucagaacagucaacaa

SEQ ID NO: 830346 - RNA, 18 nt, Human
aagaaagagaagaaagga

SEQ ID NO: 830347 - RNA, 23 nt, Human
aagaaaggaaggaaacuuugcuc

SEQ ID NO: 830348 - RNA, 19 nt, Human
aagaagggauauaguuggg

SEQ ID NO: 830349 - RNA, 23 nt, Human
aagaagggauauaguugggagug

SEQ ID NO: 830350 - RNA, 20 nt, Human
aaucauagcuaguguccugg

SEQ ID NO: 830351 - RNA, 19 nt, Human
aaugaagucuccaucugaa

SEQ ID NO: 830352 - RNA, 18 nt, Human
acacaguugcucagguau

SEQ ID NO: 830353 - RNA, 18 nt, Human
acauacaacacggcucgu

SEQ ID NO: 830354 - RNA, 20 nt, Human
accauacaaaauggaucaua

SEQ ID NO: 830355 - RNA, 25 nt, Human
agaaaaaaagaaaaugaagaaagag

SEQ ID NO: 830356 - RNA, 22 nt, Human
agaaaaugaagaaagagaagaa

SEQ ID NO: 830357 - RNA, 18 nt, Human
agaggacagcauaaagau

SEQ ID NO: 830358 - RNA, 18 nt, Human
agcaaguuaacaaaaggg

SEQ ID NO: 830359 - RNA, 19 nt, Human
agcaguuaucuuucucccc

SEQ ID NO: 830360 - RNA, 19 nt, Human
agcugguaguaaguaugca

SEQ ID NO: 830361 - RNA, 20 nt, Human
agcuguggugaauucagguu

SEQ ID NO: 830362 - RNA, 26 nt, Human
aggaaacuuugcucucuuacugguag

SEQ ID NO: 830363 - RNA, 21 nt, Human
aggaauaaaaggcaaaaaaga

SEQ ID NO: 830364 - RNA, 24 nt, Human
aggaguacacacauuauuaccacu

SEQ ID NO: 830365 - RNA, 26 nt, Human
aggcaaaaaagaaaaaaaggggaccc

SEQ ID NO: 830366 - RNA, 19 nt, Human
aggggucccaucuuuguuu

SEQ ID NO: 830367 - RNA, 23 nt, Human
auccagccauugagcccggggca

SEQ ID NO: 830368 - RNA, 20 nt, Human
aucuuuguuuggaggaacua

SEQ ID NO: 830369 - RNA, 25 nt, Human
augaagaaagagaagaaaggaaggg

SEQ ID NO: 830370 - RNA, 25 nt, Human
auuaaaaaaaaaaaagucugagagu

SEQ ID NO: 830371 - RNA, 23 nt, Human
caaaaacacugccaagaccaugc

SEQ ID NO: 830372 - RNA, 22 nt, Human
caaaacagaaacaccaauaucc

SEQ ID NO: 830373 - RNA, 26 nt, Human
caaaacagaaacaccaauaucccaaa

SEQ ID NO: 830374 - RNA, 21 nt, Human
caaaaggggcacagugugaug

SEQ ID NO: 830375 - RNA, 21 nt, Human
caagaccagcacaaaagaaaa

SEQ ID NO: 830376 - RNA, 26 nt, Human
caagaccaugcucagcagaaccacga

SEQ ID NO: 830377 - RNA, 19 nt, Human
caagguguuagcaguuuug

SEQ ID NO: 830378 - RNA, 22 nt, Human
cacaacauaauucaacaaggcu

SEQ ID NO: 830379 - RNA, 22 nt, Human
cacccagacaccggggccucca

SEQ ID NO: 830380 - RNA, 21 nt, Human
caccggggccuccacauacaa

SEQ ID NO: 830381 - RNA, 26 nt, Human
cagaaggaacgagaauuacacccaga

SEQ ID NO: 830382 - RNA, 27 nt, Human
cagaaggaacgagaauuacacccagac

SEQ ID NO: 830383 - RNA, 23 nt, Human
cauaaugaagucuccaucugaag

SEQ ID NO: 830384 - RNA, 22 nt, Human
ccaaaaacacugccaagaccau

SEQ ID NO: 830385 - RNA, 20 nt, Human
ccagcacaaaagaaaaagaa

SEQ ID NO: 830386 - RNA, 21 nt, Human
cccaaaaacacugccaagacc

SEQ ID NO: 830387 - RNA, 20 nt, Human
cccaaaucugaaaccuuaau

SEQ ID NO: 830388 - RNA, 24 nt, Human
cccauuaaaaaaaaaaaagucuga

SEQ ID NO: 830389 - RNA, 20 nt, Human
ccccuccauuucauuauuaa

SEQ ID NO: 830390 - RNA, 19 nt, Human
ccccugggcugaccuaaaa

SEQ ID NO: 830391 - RNA, 20 nt, Human
cccuguaaacauaaaaguuu

SEQ ID NO: 830392 - RNA, 23 nt, Human
ccugggcugaccuaaaaauccca

SEQ ID NO: 830393 - RNA, 19 nt, Human
ccuguaaacauaaaaguuu

SEQ ID NO: 830394 - RNA, 20 nt, Human
ccuuuugaacuucccucggg

SEQ ID NO: 830395 - RNA, 20 nt, Human
cugcuuauaucaacucagaa

SEQ ID NO: 830396 - RNA, 20 nt, Human
cuggccuuuuaaaaagcagg

SEQ ID NO: 830397 - RNA, 18 nt, Human
cuggugguaacacucucu

SEQ ID NO: 830398 - RNA, 21 nt, Human
cuggugguaacacucucugug

SEQ ID NO: 830399 - RNA, 20 nt, Human
cuucaaauuaaaaagaaaaa

SEQ ID NO: 830400 - RNA, 20 nt, Human
gacaccggggccuccacaua

SEQ ID NO: 830401 - RNA, 23 nt, Human
gacaccuuuugacuucuagaauc

SEQ ID NO: 830402 - RNA, 18 nt, Human
gagaauuacacccagaca

SEQ ID NO: 830403 - RNA, 20 nt, Human
gagcccggggcaaaagacag

SEQ ID NO: 830404 - RNA, 19 nt, Human
gauuugcacacaguugcuc

SEQ ID NO: 830405 - RNA, 22 nt, Human
gcaaaaaacacuguuggaaaua

SEQ ID NO: 830406 - RNA, 18 nt, Human
gcaaguuaacaaaagggg

SEQ ID NO: 830407 - RNA, 23 nt, Human
gccucaccucacagaaggaacga

SEQ ID NO: 830408 - RNA, 18 nt, Human
gcucucacuguggucuug

SEQ ID NO: 830409 - RNA, 18 nt, Human
ggacaagaaaggaugggg

SEQ ID NO: 830410 - RNA, 18 nt, Human
ggcuucaucugccucacc

SEQ ID NO: 830411 - RNA, 21 nt, Human
ggguucggucugggugcuggu

SEQ ID NO: 830412 - RNA, 19 nt, Human
gugaaacaaaauacguaua

SEQ ID NO: 830413 - RNA, 22 nt, Human
guuuguguuugucuuuagagga

SEQ ID NO: 830414 - RNA, 19 nt, Human
uaaauccaucacugcugcc

SEQ ID NO: 830415 - RNA, 19 nt, Human
uaauucuagaauuccccuc

SEQ ID NO: 830416 - RNA, 18 nt, Human
uaauuuuguuguuuuauu

SEQ ID NO: 830417 - RNA, 22 nt, Human
uagcaaguuaacaaaaggggca

SEQ ID NO: 830418 - RNA, 25 nt, Human
uagcaaguuaacaaaaggggcacag

SEQ ID NO: 830419 - RNA, 18 nt, Human
uaguaaacaucuucggca

SEQ ID NO: 830420 - RNA, 24 nt, Human
ucaccucacagaaggaacgagaau

SEQ ID NO: 830421 - RNA, 18 nt, Human
ucacuggagcgcucaugg

SEQ ID NO: 830422 - RNA, 18 nt, Human
ucacuggagcgcucaugg

SEQ ID NO: 830423 - RNA, 18 nt, Human
ucaucagauuccuguucu

SEQ ID NO: 830424 - RNA, 19 nt, Human
uccaaucuagaugcagcau

SEQ ID NO: 830425 - RNA, 28 nt, Human
uccacaauccagccauugagcccggggc

SEQ ID NO: 830426 - RNA, 18 nt, Human
ucccaaaaacacugccaa

SEQ ID NO: 830427 - RNA, 22 nt, Human
ucccaaaaacacugccaagacc

SEQ ID NO: 830428 - RNA, 21 nt, Human
uccuuuugaacuucccucggg

SEQ ID NO: 830429 - RNA, 22 nt, Human
ucuaauuugcaaaaaacacugu

SEQ ID NO: 830430 - RNA, 21 nt, Human
ucuagaauuccccuccauuuc

SEQ ID NO: 830431 - RNA, 26 nt, Human
ucuauagacaccuuuugacuucuaga

SEQ ID NO: 830432 - RNA, 21 nt, Human
ucuggccuuuuaaaaagcagg

SEQ ID NO: 830433 - RNA, 23 nt, Human
ugaccaaaaacccuaugugauac

SEQ ID NO: 830434 - RNA, 25 nt, Human
ugaccaaaaacccuaugugauacag

SEQ ID NO: 830435 - RNA, 23 nt, Human
ugaccuaaaaaucccauuaaaaa

SEQ ID NO: 830436 - RNA, 25 nt, Human
ugagaccauacaaaauggaucauaa

SEQ ID NO: 830437 - RNA, 22 nt, Human
ugagcauucagcacuuuaaugc

SEQ ID NO: 830438 - RNA, 21 nt, Human
ugagugccauuuucuucauau

SEQ ID NO: 830439 - RNA, 24 nt, Human
ugaguuccaggcccaaacucuccu

SEQ ID NO: 830440 - RNA, 21 nt, Human
ugcaaaaaacacuguuggaaa

SEQ ID NO: 830441 - RNA, 23 nt, Human
ugcaaaaaacacuguuggaaaua

SEQ ID NO: 830442 - RNA, 21 nt, Human
ugcugccgcgaccuagcuggu

SEQ ID NO: 830443 - RNA, 25 nt, Human
uggagccuagguuuggcaugcuuuu

SEQ ID NO: 830444 - RNA, 19 nt, Human
uggaggaacagaaagcaga

SEQ ID NO: 830445 - RNA, 25 nt, Human
uggaucauaaauuaaaaaaaaauua

SEQ ID NO: 830446 - RNA, 18 nt, Human
uggcaaacaaguuucacu

SEQ ID NO: 830447 - RNA, 27 nt, Human
ugucaaauaaauaaauuuuccuguuaa

SEQ ID NO: 830448 - RNA, 19 nt, Human
ugucuacucagguauggag

SEQ ID NO: 830449 - RNA, 18 nt, Human
ugugagugaccaaaaacc

SEQ ID NO: 830450 - RNA, 23 nt, Human
ugugcaaugcuaguaucuguaca

SEQ ID NO: 830451 - RNA, 19 nt, Human
ugugcagcacuccaaucua

SEQ ID NO: 830452 - RNA, 20 nt, Human
ugugcugcuaauuuaccuuu

SEQ ID NO: 830453 - RNA, 21 nt, Human
uguuggaaauauucugacucc

SEQ ID NO: 830454 - RNA, 22 nt, Human
uuaaaaaaaaucacuucaaaau

SEQ ID NO: 830455 - RNA, 18 nt, Human
uucaaauuaaaaagaaaa

SEQ ID NO: 830456 - RNA, 22 nt, Human
uucaaauuaaaaagaaaaagaa

SEQ ID NO: 830457 - RNA, 18 nt, Human
uucacuuuuacaacaaau

SEQ ID NO: 830458 - RNA, 19 nt, Human
uucacuuuuacaacaaaua

SEQ ID NO: 830459 - RNA, 22 nt, Human
uuccucaagaaugacuguucaa

SEQ ID NO: 830460 - RNA, 19 nt, Human
uuccucaugaaugaguucc

SEQ ID NO: 830461 - RNA, 25 nt, Human
uuccuccaauuuaccaaauuaaaca

SEQ ID NO: 830462 - RNA, 23 nt, Human
uugcucagguauucgccgcuggc

SEQ ID NO: 830463 - RNA, 21 nt, Human
uuuaaaggaauaaaaggcaaa

SEQ ID NO: 830464 - RNA, 24 nt, Human
uuucuaguuucucuucuguauucc

SEQ ID NO: 830465 - RNA, 23 nt, Human
uuuguugguuccaauuucugugu

SEQ ID NO: 830466 - RNA, 21 nt, Human
aaguaaacaaugacacauugg

SEQ ID NO: 830467 - RNA, 18 nt, Human
agcaaauucagggcucac

SEQ ID NO: 830468 - RNA, 27 nt, Human
agcaagaggcagagugggaggucgacc

SEQ ID NO: 830469 - RNA, 18 nt, Human
agucaucgccagcucucc

SEQ ID NO: 830470 - RNA, 18 nt, Human
caaguaaacaaugacaca

SEQ ID NO: 830471 - RNA, 18 nt, Human
cagaguggggcugucccu

SEQ ID NO: 830472 - RNA, 24 nt, Human
cagauccagugacaggacaaguaa

SEQ ID NO: 830473 - RNA, 21 nt, Human
caggacaaguaaacaaugaca

SEQ ID NO: 830474 - RNA, 20 nt, Human
cccuugagaaggcugcagga

SEQ ID NO: 830475 - RNA, 20 nt, Human
cuggaggagcaagaggcaga

SEQ ID NO: 830476 - RNA, 20 nt, Human
gacaggacaaguaaacaauu

SEQ ID NO: 830477 - RNA, 18 nt, Human
gagcaagaggcagagugg

SEQ ID NO: 830478 - RNA, 21 nt, Human
gagcaagggcucuccaguggc

SEQ ID NO: 830479 - RNA, 20 nt, Human
ggcagaguggggcugucccu

SEQ ID NO: 830480 - RNA, 18 nt, Human
ggcugcaggagggucuca

SEQ ID NO: 830481 - RNA, 20 nt, Human
uaagugcuuagaauauagug

SEQ ID NO: 830482 - RNA, 20 nt, Human
uaauaagaauagagaaaacu

SEQ ID NO: 830483 - RNA, 22 nt, Human
uaauaagaauagagaaaacuga

SEQ ID NO: 830484 - RNA, 20 nt, Human
uagcccagauccagugacag

SEQ ID NO: 830485 - RNA, 19 nt, Human
ucuccaguggccaaagauu

SEQ ID NO: 830486 - RNA, 20 nt, Human
ugagcaagggcucuccagug

SEQ ID NO: 830487 - RNA, 18 nt, Human
ugagguaacuugucagag

SEQ ID NO: 830488 - RNA, 26 nt, Human
acacagcucaaagcaggagggaacgc

SEQ ID NO: 830489 - RNA, 22 nt, Human
acugugccaagcuuggaggagu

SEQ ID NO: 830490 - RNA, 22 nt, Human
agccagagcaguccaagcuccu

SEQ ID NO: 830491 - RNA, 21 nt, Human
aggcagggguugggaaugaag

SEQ ID NO: 830492 - RNA, 22 nt, Human
aggcagggguugggaaugaagg

SEQ ID NO: 830493 - RNA, 21 nt, Human
agguuucuuagggggcagucc

SEQ ID NO: 830494 - RNA, 26 nt, Human
caaagcaggauccacacuuuacuguu

SEQ ID NO: 830495 - RNA, 22 nt, Human
caccagaggcagggguugggaa

SEQ ID NO: 830496 - RNA, 24 nt, Human
cccauccuuggucaagcacagcug

SEQ ID NO: 830497 - RNA, 19 nt, Human
cuuacugggguccuagcca

SEQ ID NO: 830498 - RNA, 21 nt, Human
gagcgaugccagccauggugc

SEQ ID NO: 830499 - RNA, 20 nt, Human
gcccaccagagguccaccag

SEQ ID NO: 830500 - RNA, 21 nt, Human
gcugguggggagaggaggcag

SEQ ID NO: 830501 - RNA, 23 nt, Human
gcuucaggagucuugauggcaau

SEQ ID NO: 830502 - RNA, 24 nt, Human
uacugggguccuagccagagcagu

SEQ ID NO: 830503 - RNA, 20 nt, Human
uacuguuuacucauuguuua

SEQ ID NO: 830504 - RNA, 27 nt, Human
uagaugacacagcucaaagcaggaucc

SEQ ID NO: 830505 - RNA, 22 nt, Human
uccuagccagagcaguccaagc

SEQ ID NO: 830506 - RNA, 23 nt, Human
ucucaaacagguuucuuaggggg

SEQ ID NO: 830507 - RNA, 20 nt, Human
ugagcuggugggcucacugu

SEQ ID NO: 830508 - RNA, 22 nt, Human
ugagcuggugggcucacugugc

SEQ ID NO: 830509 - RNA, 19 nt, Human
uggcuucaggagucuugau

SEQ ID NO: 830510 - RNA, 21 nt, Human
ugggguccuagccagagcagu

SEQ ID NO: 830511 - RNA, 23 nt, Human
ugggguccuagccagagcagucc

SEQ ID NO: 830512 - RNA, 18 nt, Human
ugguggggagaggaggca

SEQ ID NO: 830513 - RNA, 19 nt, Human
ugguggggagaggaggcag

SEQ ID NO: 830514 - RNA, 19 nt, Human
aaacagguccacagggcca

SEQ ID NO: 830515 - RNA, 23 nt, Human
aauucuguacgggccucuugcug

SEQ ID NO: 830516 - RNA, 19 nt, Human
acagggccagaaccugggg

SEQ ID NO: 830517 - RNA, 20 nt, Human
aggaugcccagagcuuucuc

SEQ ID NO: 830518 - RNA, 23 nt, Human
agguaugucaggaugcccagagc

SEQ ID NO: 830519 - RNA, 21 nt, Human
cacuccuuucccuuccuccaa

SEQ ID NO: 830520 - RNA, 21 nt, Human
cagagcuuucucuugccucuc

SEQ ID NO: 830521 - RNA, 20 nt, Human
cagcagcacccuccgcucac

SEQ ID NO: 830522 - RNA, 19 nt, Human
cagcggccucuccuguacc

SEQ ID NO: 830523 - RNA, 18 nt, Human
ccagagcuuucucuugcc

SEQ ID NO: 830524 - RNA, 19 nt, Human
ccgcugcacucuggcccag

SEQ ID NO: 830525 - RNA, 20 nt, Human
ccgcugcacucuggcccagg

SEQ ID NO: 830526 - RNA, 21 nt, Human
ccgcugcacucuggcccaggu

SEQ ID NO: 830527 - RNA, 23 nt, Human
ccgcugcacucuggcccagguau

SEQ ID NO: 830528 - RNA, 24 nt, Human
ccgcugcacucuggcccagguaug

SEQ ID NO: 830529 - RNA, 19 nt, Human
ccucugcugcuucaagcuc

SEQ ID NO: 830530 - RNA, 20 nt, Human
ccuggggcucccgccucugc

SEQ ID NO: 830531 - RNA, 22 nt, Human
cggacgugccagcucuucuugg

SEQ ID NO: 830532 - RNA, 23 nt, Human
cguaggaauucuguacgggccuc

SEQ ID NO: 830533 - RNA, 18 nt, Human
cgucacgccgcacgcggg

SEQ ID NO: 830534 - RNA, 28 nt, Human
cucugaucacuccuuucccuuccuccag

SEQ ID NO: 830535 - RNA, 18 nt, Human
cucuugccucucuuucuc

SEQ ID NO: 830536 - RNA, 27 nt, Human
cucuugcugagccagcagcacccuccc

SEQ ID NO: 830537 - RNA, 18 nt, Human
cugaugucuggcuuucuu

SEQ ID NO: 830538 - RNA, 18 nt, Human
cugcugcuucaagcucag

SEQ ID NO: 830539 - RNA, 21 nt, Human
cugggccucgucacgccgcac

SEQ ID NO: 830540 - RNA, 22 nt, Human
gcagcagcggccucuccuguac

SEQ ID NO: 830541 - RNA, 23 nt, Human
gcagcggccucuccuguaccccc

SEQ ID NO: 830542 - RNA, 25 nt, Human
gcccccucgcccuggggguagcugg

SEQ ID NO: 830543 - RNA, 21 nt, Human
gcucacgcuccuucuccuccu

SEQ ID NO: 830544 - RNA, 22 nt, Human
gcuggcagcagcggccucuccu

SEQ ID NO: 830545 - RNA, 20 nt, Human
ggcugggccgggcggggggc

SEQ ID NO: 830546 - RNA, 22 nt, Human
guccuuguuccggacgugccag

SEQ ID NO: 830547 - RNA, 30 nt, Human
uaugacggcuggcagcagcggccucuccuu

SEQ ID NO: 830548 - RNA, 24 nt, Human
uccacagggccagaaccuggggcu

SEQ ID NO: 830549 - RNA, 21 nt, Human
uccgcugcacucuggcccagg

SEQ ID NO: 830550 - RNA, 18 nt, Human
uccuuguuccggacgugc

SEQ ID NO: 830551 - RNA, 24 nt, Human
ucuuucuccugucgcuuuucuucc

SEQ ID NO: 830552 - RNA, 21 nt, Human
uggcagcagcggccucuccug

SEQ ID NO: 830553 - RNA, 18 nt, Human
uguccuuguuccggacgu

SEQ ID NO: 830554 - RNA, 20 nt, Human
ugucuggcuuucuuccguag

SEQ ID NO: 830555 - RNA, 20 nt, Human
uguuccggacgugccagcuc

SEQ ID NO: 830556 - RNA, 18 nt, Human
uucccuuccuccagcagc

SEQ ID NO: 830557 - RNA, 27 nt, Human
uuccucguacucuuuauugccucugau

SEQ ID NO: 830558 - RNA, 22 nt, Human
uucuuccucguacucuuuauug

SEQ ID NO: 830559 - RNA, 19 nt, Human
uuguccuuguuccggacgu

SEQ ID NO: 830560 - RNA, 23 nt, Human
uuucucuugccucucuuucuccu

SEQ ID NO: 830561 - RNA, 22 nt, Human
aaaaagauguaguguucgaaaa

SEQ ID NO: 830562 - RNA, 19 nt, Human
aaaacagaugaaucaaacc

SEQ ID NO: 830563 - RNA, 20 nt, Human
aaaacagaugaaucaaaccc

SEQ ID NO: 830564 - RNA, 23 nt, Human
aaaacagaugaaucaaacccagg

SEQ ID NO: 830565 - RNA, 22 nt, Human
aaaaccuggaaucaaaaacuaa

SEQ ID NO: 830566 - RNA, 24 nt, Human
aaacaaggaagaacauaaaaaaga

SEQ ID NO: 830567 - RNA, 26 nt, Human
acaaggaagaacauaaaaaagaugua

SEQ ID NO: 830568 - RNA, 23 nt, Human
acagccaauaagugcuuugaaac

SEQ ID NO: 830569 - RNA, 18 nt, Human
accaaguuuauugagacc

SEQ ID NO: 830570 - RNA, 18 nt, Human
accaaguuuauugagacc

SEQ ID NO: 830571 - RNA, 22 nt, Human
acucccagagaagagcugggga

SEQ ID NO: 830572 - RNA, 19 nt, Human
aggaagaacauaaaaaaga

SEQ ID NO: 830573 - RNA, 22 nt, Human
caaaaacacagccaauaagugc

SEQ ID NO: 830574 - RNA, 23 nt, Human
cacagccacauccccuaggucuc

SEQ ID NO: 830575 - RNA, 24 nt, Human
cacuguccaccgauagaaccagcg

SEQ ID NO: 830576 - RNA, 24 nt, Human
cagaugaaucaaacccaggcccca

SEQ ID NO: 830577 - RNA, 28 nt, Human
cccuucagaaugucccacuguccaccga

SEQ ID NO: 830578 - RNA, 24 nt, Human
ccuucagaaugucccacuguccac

SEQ ID NO: 830579 - RNA, 23 nt, Human
cuagacucccagagaagagcugg

SEQ ID NO: 830580 - RNA, 22 nt, Human
gaaaacagaugaaucaaaccca

SEQ ID NO: 830581 - RNA, 20 nt, Human
gagaccuccugagacuuaaa

SEQ ID NO: 830582 - RNA, 20 nt, Human
gagaccuccugagacuuaaa

SEQ ID NO: 830583 - RNA, 19 nt, Human
gaugaaucaaacccaggcc

SEQ ID NO: 830584 - RNA, 22 nt, Human
guaacuacaaaaacacagccaa

SEQ ID NO: 830585 - RNA, 20 nt, Human
uaaacaguaauucgcagucg

SEQ ID NO: 830586 - RNA, 19 nt, Human
uaaacccuguagaaaacag

SEQ ID NO: 830587 - RNA, 19 nt, Human
uaaacccuguagaaaacag

SEQ ID NO: 830588 - RNA, 19 nt, Human
uaacuacaaaaacacagcc

SEQ ID NO: 830589 - RNA, 20 nt, Human
uacaaaaacacagccaauaa

SEQ ID NO: 830590 - RNA, 24 nt, Human
uagaaaacagaugaaucaaaccca

SEQ ID NO: 830591 - RNA, 19 nt, Human
uagaaccagcgagucaccu

SEQ ID NO: 830592 - RNA, 21 nt, Human
uauugagaccuccugagacuu

SEQ ID NO: 830593 - RNA, 24 nt, Human
uccccaauugggagcgcucagucc

SEQ ID NO: 830594 - RNA, 19 nt, Human
ugaaaauagguaacuacaa

SEQ ID NO: 830595 - RNA, 18 nt, Human
ugagaccuccugagacuu

SEQ ID NO: 830596 - RNA, 18 nt, Human
uuuauugagaccuccuga

SEQ ID NO: 830597 - RNA, 18 nt, Human
uuuauugagaccuccuga

SEQ ID NO: 830598 - RNA, 18 nt, Human
aaacagcuggacugucag

SEQ ID NO: 830599 - RNA, 24 nt, Human
cagcggcccgcgcuccggccuagc

SEQ ID NO: 830600 - RNA, 21 nt, Human
cagcuggacugucaggcugcu

SEQ ID NO: 830601 - RNA, 21 nt, Human
ccccuccuuuuccuuccuucc

SEQ ID NO: 830602 - RNA, 21 nt, Human
cccucccucccucuucugcca

SEQ ID NO: 830603 - RNA, 19 nt, Human
cccuccucuccccuccuuu

SEQ ID NO: 830604 - RNA, 20 nt, Human
cccuccucuccccuccuuuu

SEQ ID NO: 830605 - RNA, 22 nt, Human
cccuccucuccccuccuuuucc

SEQ ID NO: 830606 - RNA, 23 nt, Human
ccgacaguggcgucagcggcccu

SEQ ID NO: 830607 - RNA, 23 nt, Human
ccgcgugcccucgcgaggacucu

SEQ ID NO: 830608 - RNA, 21 nt, Human
ccuccccuuccccuccucucc

SEQ ID NO: 830609 - RNA, 19 nt, Human
cuccccuccuuuuccuucc

SEQ ID NO: 830610 - RNA, 22 nt, Human
cuccucugccuccccuuccccu

SEQ ID NO: 830611 - RNA, 23 nt, Human
cucuucugccauguaacuggagg

SEQ ID NO: 830612 - RNA, 20 nt, Human
gccuccccuuccccuccucu

SEQ ID NO: 830613 - RNA, 24 nt, Human
gcugcuuuuuuuccagauguuccu

SEQ ID NO: 830614 - RNA, 22 nt, Human
gggaccacgccgcgugcccucg

SEQ ID NO: 830615 - RNA, 21 nt, Human
gugcacgcuccugcuuugucu

SEQ ID NO: 830616 - RNA, 23 nt, Human
gugcacgcuccugcuuugucuuu

SEQ ID NO: 830617 - RNA, 26 nt, Human
uccucuccccuccuuuuccuuccuuc

SEQ ID NO: 830618 - RNA, 21 nt, Human
uccuuuuccuuccuuccuucc

SEQ ID NO: 830619 - RNA, 20 nt, Human
ucuccccuccuuuuccuucc

SEQ ID NO: 830620 - RNA, 21 nt, Human
ucugccuccccuuccccuccu

SEQ ID NO: 830621 - RNA, 24 nt, Human
uguuugcauccauugucuccucca

SEQ ID NO: 830622 - RNA, 30 nt, Human
uugcauccauugucuccuccagaggucugg

SEQ ID NO: 830623 - RNA, 21 nt, Human
aacaugugacauccuggacau

SEQ ID NO: 830624 - RNA, 19 nt, Human
accuuccacaggaaaaccc

SEQ ID NO: 830625 - RNA, 21 nt, Human
agaggaggcaggagaaggcug

SEQ ID NO: 830626 - RNA, 21 nt, Human
aggcacaagcacugccaaucc

SEQ ID NO: 830627 - RNA, 18 nt, Human
aggcaggagaaggcuguu

SEQ ID NO: 830628 - RNA, 21 nt, Human
aggcaggagaaggcuguuccu

SEQ ID NO: 830629 - RNA, 23 nt, Human
aggcaggagaaggcuguuccuga

SEQ ID NO: 830630 - RNA, 21 nt, Human
cacaagcacugccaauccuuc

SEQ ID NO: 830631 - RNA, 19 nt, Human
cagaggaggcaggagaagg

SEQ ID NO: 830632 - RNA, 18 nt, Human
caggcacaagcacugcca

SEQ ID NO: 830633 - RNA, 20 nt, Human
cuuguuuccuccaaaaucgc

SEQ ID NO: 830634 - RNA, 19 nt, Human
gagcucagaccuuccacag

SEQ ID NO: 830635 - RNA, 19 nt, Human
uagcucagccugugaaagc

SEQ ID NO: 830636 - RNA, 18 nt, Human
ucaggcacaagcacugcc

SEQ ID NO: 830637 - RNA, 20 nt, Human
uccugggcccuugggauucu

SEQ ID NO: 830638 - RNA, 19 nt, Human
uccuucacagguacagggg

SEQ ID NO: 830639 - RNA, 22 nt, Human
uggcaggaguugaguuguccag

SEQ ID NO: 830640 - RNA, 23 nt, Human
uggcaggaguugaguuguccagg

SEQ ID NO: 830641 - RNA, 21 nt, Human
uuauuuuuugaugaggucagg

SEQ ID NO: 830642 - RNA, 19 nt, Human
aaauucuucuaacaauuga

SEQ ID NO: 830643 - RNA, 22 nt, Human
aacccacuccugaaaaaagucc

SEQ ID NO: 830644 - RNA, 25 nt, Human
aacuacuauuaccauggucuaaauc

SEQ ID NO: 830645 - RNA, 19 nt, Human
aacugucucaccagcucuc

SEQ ID NO: 830646 - RNA, 21 nt, Human
aagcuaguauacaaggucaaa

SEQ ID NO: 830647 - RNA, 23 nt, Human
aauaauaaacauaaauaaaaacc

SEQ ID NO: 830648 - RNA, 25 nt, Human
aauaauaaacauaaauaaaaaccuu

SEQ ID NO: 830649 - RNA, 21 nt, Human
acagacagcugucaugauuac

SEQ ID NO: 830650 - RNA, 18 nt, Human
acaggaaaaacacauaaa

SEQ ID NO: 830651 - RNA, 24 nt, Human
accagcucucuaacucauguguac

SEQ ID NO: 830652 - RNA, 23 nt, Human
agaaaagauguacuugaccagua

SEQ ID NO: 830653 - RNA, 20 nt, Human
agaacagaaaauagggaagg

SEQ ID NO: 830654 - RNA, 23 nt, Human
agacccaagacgcgcuacggcgg

SEQ ID NO: 830655 - RNA, 24 nt, Human
agagaaaauccuuuuaauccuuca

SEQ ID NO: 830656 - RNA, 25 nt, Human
agaucacaagcacaaagaguuccca

SEQ ID NO: 830657 - RNA, 21 nt, Human
agcaagucucugugaaaauag

SEQ ID NO: 830658 - RNA, 24 nt, Human
agccuagaaaucagagacagcacu

SEQ ID NO: 830659 - RNA, 20 nt, Human
aggaaacagcagaucuauca

SEQ ID NO: 830660 - RNA, 18 nt, Human
aggaaacuuggcuuaaaa

SEQ ID NO: 830661 - RNA, 21 nt, Human
aggaagcagaggaagguuuuc

SEQ ID NO: 830662 - RNA, 21 nt, Human
aggaagguuuucuggcauaua

SEQ ID NO: 830663 - RNA, 18 nt, Human
auaaaacaacagacagcu

SEQ ID NO: 830664 - RNA, 24 nt, Human
auaaauaaaaaccuuaucucaaaa

SEQ ID NO: 830665 - RNA, 21 nt, Human
auaaccuuagagaauaagaac

SEQ ID NO: 830666 - RNA, 20 nt, Human
caaaaacuggaauuucaaug

SEQ ID NO: 830667 - RNA, 21 nt, Human
caaaaagcauacuauagauaa

SEQ ID NO: 830668 - RNA, 19 nt, Human
caaaaauguuuuuacaccc

SEQ ID NO: 830669 - RNA, 23 nt, Human
caaaacaucugucuaccaguaaa

SEQ ID NO: 830670 - RNA, 18 nt, Human
caaaaggaggaagcagag

SEQ ID NO: 830671 - RNA, 18 nt, Human
caaaaggaggaagcagag

SEQ ID NO: 830672 - RNA, 24 nt, Human
caaagacacaaugcugccaaugca

SEQ ID NO: 830673 - RNA, 19 nt, Human
caacugucucaccagcucu

SEQ ID NO: 830674 - RNA, 24 nt, Human
caauccacaaaacaucugucuacc

SEQ ID NO: 830675 - RNA, 21 nt, Human
cacugcacugacauccagaac

SEQ ID NO: 830676 - RNA, 22 nt, Human
cacuuauaaauagaaacaggau

SEQ ID NO: 830677 - RNA, 23 nt, Human
cagcauuaacugccccaucuccu

SEQ ID NO: 830678 - RNA, 20 nt, Human
caggacaccacaaaaagcag

SEQ ID NO: 830679 - RNA, 25 nt, Human
caucaaaaguuuucuuuccauagaa

SEQ ID NO: 830680 - RNA, 19 nt, Human
ccacaaaaagcauacuaua

SEQ ID NO: 830681 - RNA, 21 nt, Human
ccagaacagaaaauagggaag

SEQ ID NO: 830682 - RNA, 18 nt, Human
ccuaaaauacccccaaga

SEQ ID NO: 830683 - RNA, 23 nt, Human
ccuucagcaagucucugugaaaa

SEQ ID NO: 830684 - RNA, 24 nt, Human
ccuugcaggggagggggcacucug

SEQ ID NO: 830685 - RNA, 25 nt, Human
cggcggcagcagcggcagccgggag

SEQ ID NO: 830686 - RNA, 22 nt, Human
cuccugaaaaaaguccugauaa

SEQ ID NO: 830687 - RNA, 23 nt, Human
cugauggcgaaauaauuuuuaug

SEQ ID NO: 830688 - RNA, 26 nt, Human
gaauaaacauacaaacaaauauccuu

SEQ ID NO: 830689 - RNA, 25 nt, Human
gacacaaugcugccaaugcaauuag

SEQ ID NO: 830690 - RNA, 18 nt, Human
gacccgaggcggcggcgg

SEQ ID NO: 830691 - RNA, 20 nt, Human
ggaaggcuccagccacacgc

SEQ ID NO: 830692 - RNA, 21 nt, Human
ggagggcaugggcauuaacac

SEQ ID NO: 830693 - RNA, 22 nt, Human
ggcaaggccuugcaggggaggg

SEQ ID NO: 830694 - RNA, 22 nt, Human
ggcggcggcagcagcggcagcc

SEQ ID NO: 830695 - RNA, 25 nt, Human
guaaaaccaacaacccuuaacggag

SEQ ID NO: 830696 - RNA, 18 nt, Human
guagcagugcacugcacu

SEQ ID NO: 830697 - RNA, 20 nt, Human
gucaaaaggaggaagcagag

SEQ ID NO: 830698 - RNA, 20 nt, Human
guccugcuucccgucaucuc

SEQ ID NO: 830699 - RNA, 18 nt, Human
uaaaaccaacaacccuua

SEQ ID NO: 830700 - RNA, 18 nt, Human
uaaaagucauggcuuaag

SEQ ID NO: 830701 - RNA, 18 nt, Human
uaaaagugagaagggagc

SEQ ID NO: 830702 - RNA, 26 nt, Human
uaaaauaauuuucaauccacaaaaca

SEQ ID NO: 830703 - RNA, 19 nt, Human
uaaauaaaaaccuuaucuc

SEQ ID NO: 830704 - RNA, 20 nt, Human
uaaauaaaaaccuuaucuca

SEQ ID NO: 830705 - RNA, 20 nt, Human
uaaauagaaacaggauucag

SEQ ID NO: 830706 - RNA, 18 nt, Human
uaacguaugccaaccguc

SEQ ID NO: 830707 - RNA, 26 nt, Human
uacaaacaaauauccuuaacaaaaua

SEQ ID NO: 830708 - RNA, 21 nt, Human
uacaauaaaagugagaaggga

SEQ ID NO: 830709 - RNA, 18 nt, Human
uaccacaagccacuuuca

SEQ ID NO: 830710 - RNA, 19 nt, Human
uagaagaaugguaauguug

SEQ ID NO: 830711 - RNA, 26 nt, Human
uagaucacaagcacaaagaguuccca

SEQ ID NO: 830712 - RNA, 24 nt, Human
uauaauaccacaagccacuuucag

SEQ ID NO: 830713 - RNA, 18 nt, Human
uauacaaggucaaagaca

SEQ ID NO: 830714 - RNA, 24 nt, Human
uaugccaaccgucuguaugucugc

SEQ ID NO: 830715 - RNA, 22 nt, Human
uauguaauauauacaacauacc

SEQ ID NO: 830716 - RNA, 23 nt, Human
ucagcaggacaccacaaaaagca

SEQ ID NO: 830717 - RNA, 20 nt, Human
ucauaaaacaacagacagcu

SEQ ID NO: 830718 - RNA, 19 nt, Human
ucccaaauuuauucccauu

SEQ ID NO: 830719 - RNA, 22 nt, Human
ucucugugaaaauaguaugcuu

SEQ ID NO: 830720 - RNA, 18 nt, Human
ugaauguacggcauagca

SEQ ID NO: 830721 - RNA, 24 nt, Human
ugagaaauaaacuucauaaaacaa

SEQ ID NO: 830722 - RNA, 23 nt, Human
ugagaagaaaagcacuccucugu

SEQ ID NO: 830723 - RNA, 22 nt, Human
ugauauuuaaaaucuuuauugu

SEQ ID NO: 830724 - RNA, 19 nt, Human
ugggcauuaacacuuggcc

SEQ ID NO: 830725 - RNA, 21 nt, Human
ugucuaccaguaaaaccaaca

SEQ ID NO: 830726 - RNA, 18 nt, Human
uucaaaaacuggaauuuc

SEQ ID NO: 830727 - RNA, 23 nt, Human
uucagcauuaacugccccaucuc

SEQ ID NO: 830728 - RNA, 23 nt, Human
uuccaaaaaaaaucaaccuaaca

SEQ ID NO: 830729 - RNA, 21 nt, Human
uugagaagaaaagcacuccuc

SEQ ID NO: 830730 - RNA, 20 nt, Human
uugauaggagaucacaaauu

SEQ ID NO: 830731 - RNA, 20 nt, Human
uuuuuuuuuuuuuuuuuugg

SEQ ID NO: 830732 - RNA, 18 nt, Human
uaacaggcaggaagcugg

SEQ ID NO: 830733 - RNA, 22 nt, Human
uaacaggcaggaagcugggcgu

SEQ ID NO: 830734 - RNA, 20 nt, Human
ugggcguguacacauucacc

SEQ ID NO: 830735 - RNA, 18 nt, Human
aaccaggccugaugugcu

SEQ ID NO: 830736 - RNA, 20 nt, Human
aauaaauaauaaagaauaaa

SEQ ID NO: 830737 - RNA, 24 nt, Human
aggcagauggagccauaucccagg

SEQ ID NO: 830738 - RNA, 18 nt, Human
aggggaggagaguggggc

SEQ ID NO: 830739 - RNA, 19 nt, Human
aggggaggagaguggggcc

SEQ ID NO: 830740 - RNA, 23 nt, Human
auaaauaauaaagaauaaaugac

SEQ ID NO: 830741 - RNA, 25 nt, Human
caggcuccacaccagccccacuccc

SEQ ID NO: 830742 - RNA, 19 nt, Human
caguccaggcccugaaggc

SEQ ID NO: 830743 - RNA, 19 nt, Human
ccagaggcuggcucccugu

SEQ ID NO: 830744 - RNA, 25 nt, Human
ccaggcccugaaggcagauggagcc

SEQ ID NO: 830745 - RNA, 23 nt, Human
ccaggcuccacaccagccccacu

SEQ ID NO: 830746 - RNA, 21 nt, Human
ccaggcuccugguggaggaag

SEQ ID NO: 830747 - RNA, 27 nt, Human
cccucaggcccaaagcuccuguagacu

SEQ ID NO: 830748 - RNA, 23 nt, Human
ccggugguauacagcagagcucu

SEQ ID NO: 830749 - RNA, 21 nt, Human
ccugcagcguuuuaaugcugu

SEQ ID NO: 830750 - RNA, 25 nt, Human
ccugcgaccugcagcguucugccac

SEQ ID NO: 830751 - RNA, 20 nt, Human
ccuggagcagcucucccagc

SEQ ID NO: 830752 - RNA, 22 nt, Human
ccugggagugggcugaccuucu

SEQ ID NO: 830753 - RNA, 24 nt, Human
ccugggagugggcugaccuucuug

SEQ ID NO: 830754 - RNA, 22 nt, Human
ccuguggggccaacgaggguuu

SEQ ID NO: 830755 - RNA, 24 nt, Human
cgaccuccaggcuccacaccagcc

SEQ ID NO: 830756 - RNA, 19 nt, Human
cuccacaccagccccacuc

SEQ ID NO: 830757 - RNA, 25 nt, Human
cucgugaccccagaggugaaccagg

SEQ ID NO: 830758 - RNA, 19 nt, Human
cuggagcagcccuaggagg

SEQ ID NO: 830759 - RNA, 19 nt, Human
cuggcgguauuuccccugg

SEQ ID NO: 830760 - RNA, 25 nt, Human
cuugugccuucccucaggcccaaag

SEQ ID NO: 830761 - RNA, 18 nt, Human
gagaguggggcccuggga

SEQ ID NO: 830762 - RNA, 23 nt, Human
gagugcaguccaggcccugaagg

SEQ ID NO: 830763 - RNA, 21 nt, Human
gccauugcagagagaagccag

SEQ ID NO: 830764 - RNA, 20 nt, Human
gccuucccucaggcccaaag

SEQ ID NO: 830765 - RNA, 21 nt, Human
ggaggagaguggggcccuggg

SEQ ID NO: 830766 - RNA, 19 nt, Human
gggcagcgggcgaccuccc

SEQ ID NO: 830767 - RNA, 18 nt, Human
gggggcugucagcagaac

SEQ ID NO: 830768 - RNA, 18 nt, Human
gggucugcagcacauggc

SEQ ID NO: 830769 - RNA, 19 nt, Human
guggggcccugggaguggg

SEQ ID NO: 830770 - RNA, 23 nt, Human
uaauaaagaauaaaugaccacau

SEQ ID NO: 830771 - RNA, 24 nt, Human
uaggagggcagcgggcgaccucca

SEQ ID NO: 830772 - RNA, 19 nt, Human
uccaggcccugaaggcaga

SEQ ID NO: 830773 - RNA, 19 nt, Human
ucccagcuguuagucucac

SEQ ID NO: 830774 - RNA, 22 nt, Human
ucccucaggcccaaagcuccug

SEQ ID NO: 830775 - RNA, 26 nt, Human
ucccucaggcccaaagcuccugucau

SEQ ID NO: 830776 - RNA, 22 nt, Human
ucccuguggggccaacgagggu

SEQ ID NO: 830777 - RNA, 20 nt, Human
ucgugaccccagaggugaac

SEQ ID NO: 830778 - RNA, 21 nt, Human
ucucgugaccccagaggugaa

SEQ ID NO: 830779 - RNA, 21 nt, Human
ugaugugcuggugucaggugg

SEQ ID NO: 830780 - RNA, 25 nt, Human
ugccuggagcagcucucccagcugu

SEQ ID NO: 830781 - RNA, 21 nt, Human
uggcugggcgggggcugucag

SEQ ID NO: 830782 - RNA, 20 nt, Human
ugucuggagcagcccuagga

SEQ ID NO: 830783 - RNA, 23 nt, Human
ugugccuucccucaggcccaaag

SEQ ID NO: 830784 - RNA, 19 nt, Human
cagcuccuggcggcagcuc

SEQ ID NO: 830785 - RNA, 21 nt, Human
cagcuccuggcggcagcuccc

SEQ ID NO: 830786 - RNA, 22 nt, Human
ccuaggggauaauucuguuuuc

SEQ ID NO: 830787 - RNA, 20 nt, Human
ugagaagagcugcaggagug

SEQ ID NO: 830788 - RNA, 23 nt, Human
ugagaagagcugcaggggacguc

SEQ ID NO: 830789 - RNA, 20 nt, Human
aacuaaucccagaggacccc

SEQ ID NO: 830790 - RNA, 19 nt, Human
acaccaccauacuucaugg

SEQ ID NO: 830791 - RNA, 21 nt, Human
acagaagagucgaagcucaag

SEQ ID NO: 830792 - RNA, 18 nt, Human
agacaccaccauacuuca

SEQ ID NO: 830793 - RNA, 19 nt, Human
agcugcuuaacuaauccca

SEQ ID NO: 830794 - RNA, 19 nt, Human
aguaggagagagggcagag

SEQ ID NO: 830795 - RNA, 22 nt, Human
auagagcacagaagagucgaag

SEQ ID NO: 830796 - RNA, 23 nt, Human
auagagcacagaagagucgaagc

SEQ ID NO: 830797 - RNA, 22 nt, Human
auagcugcuuaacuaaucccag

SEQ ID NO: 830798 - RNA, 20 nt, Human
auggcaaggacugagaacac

SEQ ID NO: 830799 - RNA, 21 nt, Human
caacgccaggguuuucucagc

SEQ ID NO: 830800 - RNA, 24 nt, Human
caaggccaguaucacagaagccau

SEQ ID NO: 830801 - RNA, 26 nt, Human
caauauaaacaauagaaugacaguga

SEQ ID NO: 830802 - RNA, 23 nt, Human
cacaguuuuaccaaaaaaaaucu

SEQ ID NO: 830803 - RNA, 26 nt, Human
cagcugccuugggcuuggcaucaagu

SEQ ID NO: 830804 - RNA, 22 nt, Human
cagcuuccucgucugccucgga

SEQ ID NO: 830805 - RNA, 19 nt, Human
caggaucuaauggugcaca

SEQ ID NO: 830806 - RNA, 21 nt, Human
cauucuuuuccagcuucuugu

SEQ ID NO: 830807 - RNA, 22 nt, Human
ccaaaguaggagagagggcaga

SEQ ID NO: 830808 - RNA, 23 nt, Human
cccccaguuuccccauucagugc

SEQ ID NO: 830809 - RNA, 22 nt, Human
ccuggaccaagcgcuggaccuu

SEQ ID NO: 830810 - RNA, 28 nt, Human
ccuggaccaagcgcuggaccuucccggg

SEQ ID NO: 830811 - RNA, 18 nt, Human
ccuggauugaaacugagg

SEQ ID NO: 830812 - RNA, 19 nt, Human
ccuuacuuuguugcccaua

SEQ ID NO: 830813 - RNA, 21 nt, Human
cuaauccugaccuuacuuugu

SEQ ID NO: 830814 - RNA, 19 nt, Human
cugcauuaccucugccugc

SEQ ID NO: 830815 - RNA, 20 nt, Human
cugccugcuuuguggguccc

SEQ ID NO: 830816 - RNA, 23 nt, Human
cugcuuaacuaaucccagaggac

SEQ ID NO: 830817 - RNA, 19 nt, Human
cugguguuucaggcgucca

SEQ ID NO: 830818 - RNA, 26 nt, Human
cuugucgauuggagucucuucugugu

SEQ ID NO: 830819 - RNA, 19 nt, Human
gcagcaauagagcacagaa

SEQ ID NO: 830820 - RNA, 19 nt, Human
gcuguuccaggccuccagg

SEQ ID NO: 830821 - RNA, 21 nt, Human
gcuuuaacuggcuauaagugu

SEQ ID NO: 830822 - RNA, 19 nt, Human
ggcaaggacugagaacacc

SEQ ID NO: 830823 - RNA, 26 nt, Human
gggcgcccagguccacggggucaacg

SEQ ID NO: 830824 - RNA, 22 nt, Human
gugggucccuuaguuggcguac

SEQ ID NO: 830825 - RNA, 28 nt, Human
uacacuuucugauagugccugccuuaug

SEQ ID NO: 830826 - RNA, 21 nt, Human
uagaaaaagcagugcgcagca

SEQ ID NO: 830827 - RNA, 18 nt, Human
uaucacagaagccauucu

SEQ ID NO: 830828 - RNA, 23 nt, Human
uauccuagcuccucacaguuuua

SEQ ID NO: 830829 - RNA, 23 nt, Human
uaugaccuaagauuuuaggcaag

SEQ ID NO: 830830 - RNA, 26 nt, Human
uauuauaguagguacuccauaaauac

SEQ ID NO: 830831 - RNA, 27 nt, Human
uauuuguuuugcuuugguuuuuugccu

SEQ ID NO: 830832 - RNA, 23 nt, Human
ucaaauugaaugcaucuugccuc

SEQ ID NO: 830833 - RNA, 23 nt, Human
ucaccaaguauauauccuagcuc

SEQ ID NO: 830834 - RNA, 23 nt, Human
ucagcaccauguauuuguuuugc

SEQ ID NO: 830835 - RNA, 24 nt, Human
ucuaggagggagggagauucgggg

SEQ ID NO: 830836 - RNA, 23 nt, Human
ucuguauuuugguuuuuguagca

SEQ ID NO: 830837 - RNA, 18 nt, Human
ucuuuagaagaacggagg

SEQ ID NO: 830838 - RNA, 20 nt, Human
ugagaacacccagcaggauu

SEQ ID NO: 830839 - RNA, 23 nt, Human
ugagaugcguuucagcaaggcca

SEQ ID NO: 830840 - RNA, 20 nt, Human
ugcccuaaguucaaauacac

SEQ ID NO: 830841 - RNA, 22 nt, Human
ugccucuuccugaaacuuucug

SEQ ID NO: 830842 - RNA, 21 nt, Human
ugccugcuuugugggucccuu

SEQ ID NO: 830843 - RNA, 20 nt, Human
ugccuggaccaagcgcugga

SEQ ID NO: 830844 - RNA, 21 nt, Human
ugccuggaccaagcgcuggac

SEQ ID NO: 830845 - RNA, 27 nt, Human
ugcugcccccaguuuccccauucagug

SEQ ID NO: 830846 - RNA, 21 nt, Human
uggcaaggacugagaacaccc

SEQ ID NO: 830847 - RNA, 23 nt, Human
uggggaaggaguugugucuucug

SEQ ID NO: 830848 - RNA, 26 nt, Human
uuaaagguuaccuggauugaaacuga

SEQ ID NO: 830849 - RNA, 22 nt, Human
uuaaucacguaaaguggaagag

SEQ ID NO: 830850 - RNA, 19 nt, Human
uuaccaaaaaaaaucugug

SEQ ID NO: 830851 - RNA, 21 nt, Human
uuaccaaaaaaaaucugugcu

SEQ ID NO: 830852 - RNA, 19 nt, Human
uucauggcaaggacugaga

SEQ ID NO: 830853 - RNA, 20 nt, Human
uucauuuaaagguuaccugg

SEQ ID NO: 830854 - RNA, 18 nt, Human
uuuuuuuuuuuuuuuuug

SEQ ID NO: 830855 - RNA, 20 nt, Human
uuuuuuuuuuuuuuuuugcu

SEQ ID NO: 830856 - RNA, 20 nt, Human
aaaggagccaguccucugaa

SEQ ID NO: 830857 - RNA, 19 nt, Human
aaggacacugggaaaggag

SEQ ID NO: 830858 - RNA, 24 nt, Human
acccagacugccccacaccccagc

SEQ ID NO: 830859 - RNA, 18 nt, Human
agacugccccacacccca

SEQ ID NO: 830860 - RNA, 18 nt, Human
agcagacagcugguggcu

SEQ ID NO: 830861 - RNA, 20 nt, Human
agcagcuggagccccaggug

SEQ ID NO: 830862 - RNA, 21 nt, Human
agcccccggccccagggccag

SEQ ID NO: 830863 - RNA, 21 nt, Human
aggaggggugaaggguuggug

SEQ ID NO: 830864 - RNA, 22 nt, Human
aggcaauccccgucagcugccu

SEQ ID NO: 830865 - RNA, 24 nt, Human
aggugguggaggccagugggaagc

SEQ ID NO: 830866 - RNA, 25 nt, Human
aggugguggaggccagugggaagcc

SEQ ID NO: 830867 - RNA, 19 nt, Human
aucaggccugcuuuccagg

SEQ ID NO: 830868 - RNA, 21 nt, Human
cacaccccagcccccggcccc

SEQ ID NO: 830869 - RNA, 18 nt, Human
caccccagcccccggccc

SEQ ID NO: 830870 - RNA, 23 nt, Human
cagaucccaggcaggguuggaaa

SEQ ID NO: 830871 - RNA, 22 nt, Human
cagcagcuggagccccaggugc

SEQ ID NO: 830872 - RNA, 20 nt, Human
cagcccccggccccagggcc

SEQ ID NO: 830873 - RNA, 20 nt, Human
cagcugccuucuccguucca

SEQ ID NO: 830874 - RNA, 23 nt, Human
cagcugccuucuccguuccaggg

SEQ ID NO: 830875 - RNA, 21 nt, Human
cagcugguggcuugggacugg

SEQ ID NO: 830876 - RNA, 22 nt, Human
cagcugguggcuugggacuggg

SEQ ID NO: 830877 - RNA, 22 nt, Human
caggaggggugaaggguuggug

SEQ ID NO: 830878 - RNA, 21 nt, Human
caucaggccugcuuuccagga

SEQ ID NO: 830879 - RNA, 25 nt, Human
cauuuucauuucuuuauuuuaagga

SEQ ID NO: 830880 - RNA, 22 nt, Human
ccaccgcugccuuucacaccca

SEQ ID NO: 830881 - RNA, 21 nt, Human
cccagcccccggccccagggc

SEQ ID NO: 830882 - RNA, 21 nt, Human
ccccacaccccagcccccggc

SEQ ID NO: 830883 - RNA, 23 nt, Human
ccccacaccccagcccccggccc

SEQ ID NO: 830884 - RNA, 20 nt, Human
ccccaggugcugcugcggcu

SEQ ID NO: 830885 - RNA, 26 nt, Human
ccccaggugcugcugcgggggaccgc

SEQ ID NO: 830886 - RNA, 18 nt, Human
ccccgucagcugccuucu

SEQ ID NO: 830887 - RNA, 21 nt, Human
ccucuguggccaccgcugccu

SEQ ID NO: 830888 - RNA, 19 nt, Human
cucccuggcugugccugcc

SEQ ID NO: 830889 - RNA, 23 nt, Human
cucuccgccgccucuguggccac

SEQ ID NO: 830890 - RNA, 19 nt, Human
cugcauuaaagcccagauc

SEQ ID NO: 830891 - RNA, 22 nt, Human
cuggcugugccugccuccuggg

SEQ ID NO: 830892 - RNA, 18 nt, Human
cugugccugccuccuggg

SEQ ID NO: 830893 - RNA, 18 nt, Human
cuucacugcccacuccuc

SEQ ID NO: 830894 - RNA, 21 nt, Human
cuucacugcccacuccucccc

SEQ ID NO: 830895 - RNA, 21 nt, Human
gauuccagcagcuggagcccc

SEQ ID NO: 830896 - RNA, 19 nt, Human
gcacggugcaaggugagag

SEQ ID NO: 830897 - RNA, 19 nt, Human
gcugaggaaggcaaucccc

SEQ ID NO: 830898 - RNA, 19 nt, Human
gcugugccugccuccuggg

SEQ ID NO: 830899 - RNA, 20 nt, Human
ggaggggacugagcaugggg

SEQ ID NO: 830900 - RNA, 19 nt, Human
ggcuugggacuggggugga

SEQ ID NO: 830901 - RNA, 22 nt, Human
gggaaguggggaugaugagagg

SEQ ID NO: 830902 - RNA, 19 nt, Human
ggucaggugguggaggcca

SEQ ID NO: 830903 - RNA, 19 nt, Human
ggucaggugguggaggcca

SEQ ID NO: 830904 - RNA, 22 nt, Human
ggugagagugagguuaaagguc

SEQ ID NO: 830905 - RNA, 26 nt, Human
uaaaggucagagaggaggggcugagg

SEQ ID NO: 830906 - RNA, 23 nt, Human
uaaggacacugggaaaggagcca

SEQ ID NO: 830907 - RNA, 23 nt, Human
uagccagaagcaggaccagacaa

SEQ ID NO: 830908 - RNA, 24 nt, Human
uaggauuccagcagcuggagcccc

SEQ ID NO: 830909 - RNA, 22 nt, Human
ucagcugccuucuccguuccag

SEQ ID NO: 830910 - RNA, 19 nt, Human
uccguuccaggguggcugu

SEQ ID NO: 830911 - RNA, 19 nt, Human
ucuucacugcccacuccuc

SEQ ID NO: 830912 - RNA, 21 nt, Human
ugaagagaacacucuggucag

SEQ ID NO: 830913 - RNA, 18 nt, Human
ugcaaggugagagugagg

SEQ ID NO: 830914 - RNA, 21 nt, Human
uggaaaggcugggccugggaa

SEQ ID NO: 830915 - RNA, 21 nt, Human
uggagcugcgugggggauggg

SEQ ID NO: 830916 - RNA, 20 nt, Human
uggccucugcauuaaagccc

SEQ ID NO: 830917 - RNA, 21 nt, Human
uggcugugccugccuccuggg

SEQ ID NO: 830918 - RNA, 23 nt, Human
ugggaaguggggaugaugagagg

SEQ ID NO: 830919 - RNA, 20 nt, Human
ugggacugggguggagcugc

SEQ ID NO: 830920 - RNA, 19 nt, Human
ugggaggggacugagcaug

SEQ ID NO: 830921 - RNA, 21 nt, Human
ugggccugggaaguggggaug

SEQ ID NO: 830922 - RNA, 24 nt, Human
uucacacccacuaggaaguccuuu

SEQ ID NO: 830923 - RNA, 20 nt, Human
uucacugcccacuccucccc

SEQ ID NO: 830924 - RNA, 21 nt, Human
uugggacugggguggagcugc

SEQ ID NO: 830925 - RNA, 22 nt, Human
uuuuuuuuuuuuuuuuugccaa

SEQ ID NO: 830926 - RNA, 24 nt, Human
uuuuuuuuuuuuuuuuuuuuuggg

SEQ ID NO: 830927 - RNA, 18 nt, Human
aaaaugugaguucuaaaa

SEQ ID NO: 830928 - RNA, 21 nt, Human
aacauauccaugacaagcauu

SEQ ID NO: 830929 - RNA, 25 nt, Human
aacaucuaccuacucaugacauggc

SEQ ID NO: 830930 - RNA, 24 nt, Human
aaccagaccccaggagcuugccua

SEQ ID NO: 830931 - RNA, 21 nt, Human
aagcggggcagaaggcaggug

SEQ ID NO: 830932 - RNA, 25 nt, Human
aaugaaaagcaccagucuuuggccu

SEQ ID NO: 830933 - RNA, 20 nt, Human
acaaaaucaccaagguucug

SEQ ID NO: 830934 - RNA, 18 nt, Human
acagaccuggaguguggg

SEQ ID NO: 830935 - RNA, 23 nt, Human
acucaacggguggguuccgagaa

SEQ ID NO: 830936 - RNA, 22 nt, Human
agacuuuuggcuuuaagaguuc

SEQ ID NO: 830937 - RNA, 18 nt, Human
agcagcaacucaacaaaa

SEQ ID NO: 830938 - RNA, 18 nt, Human
aggcauucacuuuauauu

SEQ ID NO: 830939 - RNA, 19 nt, Human
aguuucacccaccacaccu

SEQ ID NO: 830940 - RNA, 20 nt, Human
auagcagcaacucaacaaaa

SEQ ID NO: 830941 - RNA, 22 nt, Human
auagcagcaacucaacaaaaca

SEQ ID NO: 830942 - RNA, 22 nt, Human
augacaagcauucauaugagcc

SEQ ID NO: 830943 - RNA, 24 nt, Human
augcuacauuucucuuaguuucac

SEQ ID NO: 830944 - RNA, 19 nt, Human
caaaaagagggggggaagc

SEQ ID NO: 830945 - RNA, 21 nt, Human
caacaaaaucaccaagguucu

SEQ ID NO: 830946 - RNA, 22 nt, Human
caaggacacgcacaaaucaaag

SEQ ID NO: 830947 - RNA, 26 nt, Human
caaucuucauugcuuaaagucaggaa

SEQ ID NO: 830948 - RNA, 22 nt, Human
cacauaaccagaccccaggagc

SEQ ID NO: 830949 - RNA, 23 nt, Human
cacuuuauauucucugaagagaa

SEQ ID NO: 830950 - RNA, 24 nt, Human
caggaaacaacaaacacauucaua

SEQ ID NO: 830951 - RNA, 22 nt, Human
cauaaccagaccccaggagcuu

SEQ ID NO: 830952 - RNA, 25 nt, Human
cauauccaugacaagcauucauaug

SEQ ID NO: 830953 - RNA, 20 nt, Human
caugaagagcaucaaacaag

SEQ ID NO: 830954 - RNA, 23 nt, Human
caugacaagcauucauaugagcc

SEQ ID NO: 830955 - RNA, 19 nt, Human
ccaccaccagggucaccuu

SEQ ID NO: 830956 - RNA, 22 nt, Human
ccccuuugacuucauaaaaucu

SEQ ID NO: 830957 - RNA, 26 nt, Human
ccuacagccugugcugggucuagaca

SEQ ID NO: 830958 - RNA, 22 nt, Human
ccucuaaaggaugaaaugaaaa

SEQ ID NO: 830959 - RNA, 22 nt, Human
cgagaagcagaugagccaugaa

SEQ ID NO: 830960 - RNA, 18 nt, Human
cgagaucuguguaaaguc

SEQ ID NO: 830961 - RNA, 20 nt, Human
cgcacaaaucaaagggccac

SEQ ID NO: 830962 - RNA, 20 nt, Human
cggaacauccacuaagaauc

SEQ ID NO: 830963 - RNA, 22 nt, Human
cguaagaaagagggaaaaacuc

SEQ ID NO: 830964 - RNA, 23 nt, Human
cucaucaaaaagagggggggaag

SEQ ID NO: 830965 - RNA, 25 nt, Human
cuccugggccuacagccugugcugg

SEQ ID NO: 830966 - RNA, 23 nt, Human
cucuuaguuucacccaccacacc

SEQ ID NO: 830967 - RNA, 21 nt, Human
cugauuccacugccaacacgu

SEQ ID NO: 830968 - RNA, 20 nt, Human
cugcacaggcugauuccacu

SEQ ID NO: 830969 - RNA, 23 nt, Human
cuggagugugggauucagcuugg

SEQ ID NO: 830970 - RNA, 21 nt, Human
cuggcagugcaauagcagcaa

SEQ ID NO: 830971 - RNA, 18 nt, Human
cuuccucaucaaaaagag

SEQ ID NO: 830972 - RNA, 23 nt, Human
gaagagcaucaaacaagcauuac

SEQ ID NO: 830973 - RNA, 19 nt, Human
gacucaaaauagcacugcu

SEQ ID NO: 830974 - RNA, 23 nt, Human
gcaauagcagcaacucaacaaaa

SEQ ID NO: 830975 - RNA, 22 nt, Human
gccugagauccccagccugcac

SEQ ID NO: 830976 - RNA, 20 nt, Human
gccugugcugggucuagaca

SEQ ID NO: 830977 - RNA, 19 nt, Human
ggaaauacaccaucugguc

SEQ ID NO: 830978 - RNA, 24 nt, Human
guaaaguccccuuugacuucauaa

SEQ ID NO: 830979 - RNA, 21 nt, Human
guaagaaagagggaaaaacuc

SEQ ID NO: 830980 - RNA, 24 nt, Human
guggccccauguggguccugggcg

SEQ ID NO: 830981 - RNA, 19 nt, Human
guuguuggguuucucuuuc

SEQ ID NO: 830982 - RNA, 24 nt, Human
uaaaggaugaaaugaaaagcacca

SEQ ID NO: 830983 - RNA, 18 nt, Human
uaaccagaccccaggagc

SEQ ID NO: 830984 - RNA, 24 nt, Human
uaagaaagagggaaaaacuccuuu

SEQ ID NO: 830985 - RNA, 20 nt, Human
uacaagauuuuuaaacuaau

SEQ ID NO: 830986 - RNA, 18 nt, Human
uacaauaacaauacagua

SEQ ID NO: 830987 - RNA, 19 nt, Human
ucaccaagguucugcuauu

SEQ ID NO: 830988 - RNA, 21 nt, Human
ucacuucaaaaauucuaccga

SEQ ID NO: 830989 - RNA, 19 nt, Human
ucagagcucugagccuggc

SEQ ID NO: 830990 - RNA, 27 nt, Human
uccacuaagaaucuuccacauaaccaa

SEQ ID NO: 830991 - RNA, 18 nt, Human
uccugggcggggggguuc

SEQ ID NO: 830992 - RNA, 21 nt, Human
uccugggcggggggguuccuu

SEQ ID NO: 830993 - RNA, 21 nt, Human
ucgcuccugggccuacagccu

SEQ ID NO: 830994 - RNA, 18 nt, Human
ucucugaagagaaccagc

SEQ ID NO: 830995 - RNA, 21 nt, Human
ucucuuaguuucacccaccuu

SEQ ID NO: 830996 - RNA, 20 nt, Human
ucucuugagcacagaccugg

SEQ ID NO: 830997 - RNA, 18 nt, Human
ucuuaccaaaaagauugc

SEQ ID NO: 830998 - RNA, 21 nt, Human
ucuuccacauaaccagacccc

SEQ ID NO: 830999 - RNA, 23 nt, Human
ucuuccacauaaccagaccccag

SEQ ID NO: 831000 - RNA, 21 nt, Human
ucuucuuccucaucaaaaaga

SEQ ID NO: 831001 - RNA, 19 nt, Human
ucuugagcacagaccugga

SEQ ID NO: 831002 - RNA, 24 nt, Human
ucuuucagagcuaccccuaaaggc

SEQ ID NO: 831003 - RNA, 21 nt, Human
ugaaaacaucuaacuauuuca

SEQ ID NO: 831004 - RNA, 23 nt, Human
ugagaggggcucaaaguuuuuuu

SEQ ID NO: 831005 - RNA, 23 nt, Human
ugagcacagaccuggaguguggg

SEQ ID NO: 831006 - RNA, 18 nt, Human
ugcucuggccaccaccag

SEQ ID NO: 831007 - RNA, 24 nt, Human
uggcaaauaaucauuuuacaauaa

SEQ ID NO: 831008 - RNA, 20 nt, Human
uggcagaggaagcaauguca

SEQ ID NO: 831009 - RNA, 21 nt, Human
uggcagugcaauagcagcaac

SEQ ID NO: 831010 - RNA, 21 nt, Human
uggccccauguggguccuggg

SEQ ID NO: 831011 - RNA, 19 nt, Human
uggcuccaaagcuggcccc

SEQ ID NO: 831012 - RNA, 21 nt, Human
uggguccugggcggggggguu

SEQ ID NO: 831013 - RNA, 25 nt, Human
uggguccugggcggggggguuccuu

SEQ ID NO: 831014 - RNA, 21 nt, Human
ugguagaaugggcaugucaug

SEQ ID NO: 831015 - RNA, 22 nt, Human
uguggcagaggaagcaauguca

SEQ ID NO: 831016 - RNA, 20 nt, Human
uguuggguuucucuuucaga

SEQ ID NO: 831017 - RNA, 21 nt, Human
uuccacauaaccagaccccag

SEQ ID NO: 831018 - RNA, 19 nt, Human
uucugcuauuaaggaggau

SEQ ID NO: 831019 - RNA, 24 nt, Human
uugcuaaaguggaaugagaggggc

SEQ ID NO: 831020 - RNA, 18 nt, Human
uuucagagcucugagccu

SEQ ID NO: 831021 - RNA, 20 nt, Human
uuucagagcucugagccuga

SEQ ID NO: 831022 - RNA, 24 nt, Human
uuucagagcucugagccuggcuuu

SEQ ID NO: 831023 - RNA, 23 nt, Human
uuugaaaacaucuaacuauuuca

SEQ ID NO: 831024 - RNA, 19 nt, Human
uuuggccugccugcugguu

SEQ ID NO: 831025 - RNA, 21 nt, Human
aaacaaugccuggagcaccaa

SEQ ID NO: 831026 - RNA, 21 nt, Human
aagcaugacagauauggcugu

SEQ ID NO: 831027 - RNA, 18 nt, Human
aagcuccacucugggcac

SEQ ID NO: 831028 - RNA, 24 nt, Human
aaggagcccgcccagcucaagggc

SEQ ID NO: 831029 - RNA, 21 nt, Human
acccauccuccaguggccacc

SEQ ID NO: 831030 - RNA, 19 nt, Human
accccuggcagcuccccgg

SEQ ID NO: 831031 - RNA, 23 nt, Human
agaaggagaagcacaaggacagg

SEQ ID NO: 831032 - RNA, 22 nt, Human
agacagggggcagagcauggga

SEQ ID NO: 831033 - RNA, 25 nt, Human
agagacagacaccccuggcagcucc

SEQ ID NO: 831034 - RNA, 18 nt, Human
agagcagguaaacaaugc

SEQ ID NO: 831035 - RNA, 19 nt, Human
agccugguaggcagugcug

SEQ ID NO: 831036 - RNA, 21 nt, Human
agccugguaggcagugcugaa

SEQ ID NO: 831037 - RNA, 19 nt, Human
agcgacagcuacaggaagg

SEQ ID NO: 831038 - RNA, 26 nt, Human
agcggggagcaagagcagguaaacaa

SEQ ID NO: 831039 - RNA, 19 nt, Human
aggcagugcuccugggggc

SEQ ID NO: 831040 - RNA, 19 nt, Human
aggcagugcuccugggggc

SEQ ID NO: 831041 - RNA, 20 nt, Human
aggcagugcuccugggggcc

SEQ ID NO: 831042 - RNA, 19 nt, Human
agggcugcaacacgcccuc

SEQ ID NO: 831043 - RNA, 20 nt, Human
aggggcuuugcccccaggag

SEQ ID NO: 831044 - RNA, 18 nt, Human
agggggcagagcauggga

SEQ ID NO: 831045 - RNA, 25 nt, Human
caacaggaaagaccagaggggcagg

SEQ ID NO: 831046 - RNA, 20 nt, Human
caagggccacaucccaaaga

SEQ ID NO: 831047 - RNA, 22 nt, Human
cacccaaggagcccgcccagcu

SEQ ID NO: 831048 - RNA, 19 nt, Human
cacgcugggggugagcaga

SEQ ID NO: 831049 - RNA, 22 nt, Human
cagacaccccuggcagcucccc

SEQ ID NO: 831050 - RNA, 18 nt, Human
cagcugcuaccgcagcca

SEQ ID NO: 831051 - RNA, 21 nt, Human
caggaggaugcggccccccuc

SEQ ID NO: 831052 - RNA, 22 nt, Human
caggaggccaagcaggcccuca

SEQ ID NO: 831053 - RNA, 23 nt, Human
caguuggggucacgggaacuggg

SEQ ID NO: 831054 - RNA, 22 nt, Human
ccagcucaagggccacauccca

SEQ ID NO: 831055 - RNA, 19 nt, Human
cccaaagacagggugaacc

SEQ ID NO: 831056 - RNA, 23 nt, Human
ccccacccauccuccaguggcca

SEQ ID NO: 831057 - RNA, 18 nt, Human
ccccacccgguccacuga

SEQ ID NO: 831058 - RNA, 19 nt, Human
ccccaggaggccaagcagg

SEQ ID NO: 831059 - RNA, 19 nt, Human
ccccaguacccugguaucc

SEQ ID NO: 831060 - RNA, 18 nt, Human
cccccacccauccuccag

SEQ ID NO: 831061 - RNA, 23 nt, Human
cccccaggaggccaagcaggccc

SEQ ID NO: 831062 - RNA, 23 nt, Human
cccccaguacccugguauccugc

SEQ ID NO: 831063 - RNA, 21 nt, Human
ccccccucgcucccagcaccc

SEQ ID NO: 831064 - RNA, 19 nt, Human
cccccgccccaccgcuccc

SEQ ID NO: 831065 - RNA, 25 nt, Human
cccccuccaagcagagaggcaaggu

SEQ ID NO: 831066 - RNA, 22 nt, Human
ccccgccccaccgcucccgcgg

SEQ ID NO: 831067 - RNA, 21 nt, Human
ccccgcgcgggcuggcaccuc

SEQ ID NO: 831068 - RNA, 22 nt, Human
cccgcccagcucaagggccaca

SEQ ID NO: 831069 - RNA, 20 nt, Human
cccgccugcggacuccuccu

SEQ ID NO: 831070 - RNA, 24 nt, Human
cccuauagugauguauacaaaucc

SEQ ID NO: 831071 - RNA, 23 nt, Human
cccucagaagcuggcaccaccau

SEQ ID NO: 831072 - RNA, 19 nt, Human
cccucaggccaagcuccac

SEQ ID NO: 831073 - RNA, 18 nt, Human
ccgcccagcucaagggcc

SEQ ID NO: 831074 - RNA, 22 nt, Human
ccggcagcugcuaccgcagcca

SEQ ID NO: 831075 - RNA, 18 nt, Human
ccggcggccgcggccccc

SEQ ID NO: 831076 - RNA, 21 nt, Human
ccggggggggcacgcuggggg

SEQ ID NO: 831077 - RNA, 20 nt, Human
ccucagaagcuggcaccacc

SEQ ID NO: 831078 - RNA, 18 nt, Human
ccucgggcgccggcugcg

SEQ ID NO: 831079 - RNA, 22 nt, Human
ccugcaguuggggucacgggaa

SEQ ID NO: 831080 - RNA, 23 nt, Human
ccuguacacacugggcgugugcg

SEQ ID NO: 831081 - RNA, 24 nt, Human
cgccgccaccgcggaugacuccaa

SEQ ID NO: 831082 - RNA, 21 nt, Human
cggcucgggagagaagagcgg

SEQ ID NO: 831083 - RNA, 20 nt, Human
cgggauugcuucugcugcug

SEQ ID NO: 831084 - RNA, 20 nt, Human
cggggcugaccgcgccgggu

SEQ ID NO: 831085 - RNA, 22 nt, Human
cuauacgaaguuaugcgccgcc

SEQ ID NO: 831086 - RNA, 20 nt, Human
cucccagcaccccgcaccac

SEQ ID NO: 831087 - RNA, 20 nt, Human
cucgcucccagcaccccgca

SEQ ID NO: 831088 - RNA, 20 nt, Human
cugcggcgcgggcggcgggg

SEQ ID NO: 831089 - RNA, 21 nt, Human
cuggagccgcagccggggcug

SEQ ID NO: 831090 - RNA, 19 nt, Human
gaacagagacagacacccc

SEQ ID NO: 831091 - RNA, 20 nt, Human
gaacagagacagacaccccu

SEQ ID NO: 831092 - RNA, 21 nt, Human
gagcaagagcagguaaacaaa

SEQ ID NO: 831093 - RNA, 18 nt, Human
gaggcaagguaacaggag

SEQ ID NO: 831094 - RNA, 23 nt, Human
gcagcagaagcucagcuaguggg

SEQ ID NO: 831095 - RNA, 21 nt, Human
gcagccggggcugaccgcgcc

SEQ ID NO: 831096 - RNA, 20 nt, Human
gccccggggaagcaugacag

SEQ ID NO: 831097 - RNA, 18 nt, Human
gcgccggcugcggucccc

SEQ ID NO: 831098 - RNA, 22 nt, Human
gcggggagcaagagcagguaaa

SEQ ID NO: 831099 - RNA, 19 nt, Human
gcugcccgcgaucucuccc

SEQ ID NO: 831100 - RNA, 23 nt, Human
ggagagaagagcggagcgcggag

SEQ ID NO: 831101 - RNA, 23 nt, Human
ggcaggggugaguggccccgggg

SEQ ID NO: 831102 - RNA, 20 nt, Human
ggccaagcaggcccucagaa

SEQ ID NO: 831103 - RNA, 23 nt, Human
ggccagggcugcaacacgcccuc

SEQ ID NO: 831104 - RNA, 18 nt, Human
ggcugcgguccccucccc

SEQ ID NO: 831105 - RNA, 18 nt, Human
gggcaggggugaguggcc

SEQ ID NO: 831106 - RNA, 25 nt, Human
gggccccucccaccagcccccaccc

SEQ ID NO: 831107 - RNA, 18 nt, Human
ggggugagcagagggggc

SEQ ID NO: 831108 - RNA, 21 nt, Human
ggggugagcagagggggcccc

SEQ ID NO: 831109 - RNA, 20 nt, Human
gggugaaccaggggacaguc

SEQ ID NO: 831110 - RNA, 20 nt, Human
gguaggcagugcugaaucug

SEQ ID NO: 831111 - RNA, 24 nt, Human
guggugcucacagaggcccccacc

SEQ ID NO: 831112 - RNA, 23 nt, Human
guuccggggggggcacgcugggg

SEQ ID NO: 831113 - RNA, 18 nt, Human
uaacucaggugcuugcag

SEQ ID NO: 831114 - RNA, 21 nt, Human
uacccugguauccugcuacaa

SEQ ID NO: 831115 - RNA, 18 nt, Human
ucaagggccacaucccaa

SEQ ID NO: 831116 - RNA, 23 nt, Human
uccaagucgcccuauagugaugu

SEQ ID NO: 831117 - RNA, 23 nt, Human
uccaguggccacccugaggagac

SEQ ID NO: 831118 - RNA, 21 nt, Human
uccaugggugagcugggauuc

SEQ ID NO: 831119 - RNA, 18 nt, Human
uccaugugagcaugcaga

SEQ ID NO: 831120 - RNA, 22 nt, Human
ucccaaagacagggugaaccag

SEQ ID NO: 831121 - RNA, 23 nt, Human
uccugggccaguccacggggugc

SEQ ID NO: 831122 - RNA, 18 nt, Human
ugaaaggcagugcuccug

SEQ ID NO: 831123 - RNA, 21 nt, Human
ugacauguuuauagauggaca

SEQ ID NO: 831124 - RNA, 21 nt, Human
ugagcaugcagacgggguggg

SEQ ID NO: 831125 - RNA, 18 nt, Human
ugaggggaggucuucugu

SEQ ID NO: 831126 - RNA, 18 nt, Human
ugccuggagcaccaacag

SEQ ID NO: 831127 - RNA, 21 nt, Human
uggagcaccaacaggaaagac

SEQ ID NO: 831128 - RNA, 23 nt, Human
uggagcaccaacaggaaagacca

SEQ ID NO: 831129 - RNA, 24 nt, Human
uggagcaccaacaggaaagaccag

SEQ ID NO: 831130 - RNA, 21 nt, Human
uggcaucucagcagacagcag

SEQ ID NO: 831131 - RNA, 19 nt, Human
ugggaaaggcugcagagua

SEQ ID NO: 831132 - RNA, 18 nt, Human
ugguggggccagggcugc

SEQ ID NO: 831133 - RNA, 22 nt, Human
uggugugccccuccacuagccc

SEQ ID NO: 831134 - RNA, 22 nt, Human
ugugaguguguaaugagugugu

SEQ ID NO: 831135 - RNA, 21 nt, Human
uucugcugcuguuguuauugc

SEQ ID NO: 831136 - RNA, 22 nt, Human
aagggcagcucgggagguccag

SEQ ID NO: 831137 - RNA, 18 nt, Human
acccccacucugaggcac

SEQ ID NO: 831138 - RNA, 21 nt, Human
acccgcuucucccggcccacc

SEQ ID NO: 831139 - RNA, 21 nt, Human
acuccaugcagugcaccagcc

SEQ ID NO: 831140 - RNA, 23 nt, Human
acuccaugcagugcaccagccug

SEQ ID NO: 831141 - RNA, 19 nt, Human
acucgucuuguccuugccu

SEQ ID NO: 831142 - RNA, 21 nt, Human
aggaaugccaucaaccccucg

SEQ ID NO: 831143 - RNA, 24 nt, Human
aggcuccccgcgacaccucccgcu

SEQ ID NO: 831144 - RNA, 24 nt, Human
agggcagcucgggagguccaguag

SEQ ID NO: 831145 - RNA, 22 nt, Human
aggggccguccaggggccccag

SEQ ID NO: 831146 - RNA, 19 nt, Human
aggggggcuccgggaccuc

SEQ ID NO: 831147 - RNA, 21 nt, Human
aguaggcugggacccucuaug

SEQ ID NO: 831148 - RNA, 25 nt, Human
augcagugcaccagccugcaccccc

SEQ ID NO: 831149 - RNA, 22 nt, Human
auggagcucugcacgugaccuc

SEQ ID NO: 831150 - RNA, 25 nt, Human
caaggggccguccaggggccccagc

SEQ ID NO: 831151 - RNA, 23 nt, Human
caccagccugcaccccccagguu

SEQ ID NO: 831152 - RNA, 24 nt, Human
caccaggcuccccgcgacaccucc

SEQ ID NO: 831153 - RNA, 18 nt, Human
cacccccccuuccagcuc

SEQ ID NO: 831154 - RNA, 20 nt, Human
cacccccccuuccagcucac

SEQ ID NO: 831155 - RNA, 24 nt, Human
cacgcaugcgcacaagcagcagag

SEQ ID NO: 831156 - RNA, 20 nt, Human
cagcccaggccacuacgucu

SEQ ID NO: 831157 - RNA, 22 nt, Human
caggcuccccgcgacaccuccc

SEQ ID NO: 831158 - RNA, 20 nt, Human
caguaggcugggacccucuu

SEQ ID NO: 831159 - RNA, 22 nt, Human
cagucggccuuccucccuguuc

SEQ ID NO: 831160 - RNA, 23 nt, Human
caucuagaagggcaccaggcucc

SEQ ID NO: 831161 - RNA, 18 nt, Human
ccaaguagggccaggagc

SEQ ID NO: 831162 - RNA, 26 nt, Human
ccaugcagugcaccagccugcacccc

SEQ ID NO: 831163 - RNA, 23 nt, Human
cccacggucagcagcucacaggc

SEQ ID NO: 831164 - RNA, 18 nt, Human
cccagugcugaguugucu

SEQ ID NO: 831165 - RNA, 20 nt, Human
cccagugcugaguugucuuc

SEQ ID NO: 831166 - RNA, 22 nt, Human
ccccagccaugcccagaguccc

SEQ ID NO: 831167 - RNA, 18 nt, Human
cccccacccccccuucca

SEQ ID NO: 831168 - RNA, 22 nt, Human
cccccacccccccuuccagcuc

SEQ ID NO: 831169 - RNA, 21 nt, Human
ccccccacccccccuuccagc

SEQ ID NO: 831170 - RNA, 25 nt, Human
ccccccccacccccccuuccagcuc

SEQ ID NO: 831171 - RNA, 22 nt, Human
ccccgaagguuugggaaagggg

SEQ ID NO: 831172 - RNA, 18 nt, Human
ccccgcgacaccucccgc

SEQ ID NO: 831173 - RNA, 19 nt, Human
cccucggugcuuucagagg

SEQ ID NO: 831174 - RNA, 18 nt, Human
ccgcccuccauccgccug

SEQ ID NO: 831175 - RNA, 23 nt, Human
ccguccaggggccccagccaugc

SEQ ID NO: 831176 - RNA, 20 nt, Human
ccuccaccaggccgcccucc

SEQ ID NO: 831177 - RNA, 20 nt, Human
ccucccaccucccuucuccc

SEQ ID NO: 831178 - RNA, 24 nt, Human
ccucccaccucccuucuccccgaa

SEQ ID NO: 831179 - RNA, 19 nt, Human
ccucccgcugucccucccu

SEQ ID NO: 831180 - RNA, 20 nt, Human
ccugccccccccaccccccc

SEQ ID NO: 831181 - RNA, 20 nt, Human
ccugcuggcacgcucggccc

SEQ ID NO: 831182 - RNA, 26 nt, Human
ccugugccccggcgcacgcgcaagag

SEQ ID NO: 831183 - RNA, 19 nt, Human
ccuuccagcucacugccug

SEQ ID NO: 831184 - RNA, 22 nt, Human
ccuuccucccuguucguauguc

SEQ ID NO: 831185 - RNA, 19 nt, Human
cgcacgcaugcgcacaagc

SEQ ID NO: 831186 - RNA, 18 nt, Human
cgcccuccauccgccugc

SEQ ID NO: 831187 - RNA, 24 nt, Human
cggcccuggcuucucucuccucuu

SEQ ID NO: 831188 - RNA, 18 nt, Human
cggcgcacgcgcaagagg

SEQ ID NO: 831189 - RNA, 20 nt, Human
cggguugagaggggggcucc

SEQ ID NO: 831190 - RNA, 24 nt, Human
cguccaggggccccagccaugccc

SEQ ID NO: 831191 - RNA, 20 nt, Human
cgugaccuccaccucgacuc

SEQ ID NO: 831192 - RNA, 20 nt, Human
cuggcuucucucuccucuuc

SEQ ID NO: 831193 - RNA, 18 nt, Human
cuuuagaccugaagggca

SEQ ID NO: 831194 - RNA, 24 nt, Human
gaggcacccgcuucucccggccga

SEQ ID NO: 831195 - RNA, 23 nt, Human
gaggggggcuccgggaccucaug

SEQ ID NO: 831196 - RNA, 21 nt, Human
gagguccaguaggcugggacc

SEQ ID NO: 831197 - RNA, 19 nt, Human
gcagaggggaacccgccca

SEQ ID NO: 831198 - RNA, 19 nt, Human
gcccagagucccguuggug

SEQ ID NO: 831199 - RNA, 24 nt, Human
gcccagugcugaguugucuucgag

SEQ ID NO: 831200 - RNA, 18 nt, Human
gcuccccgcgacaccucc

SEQ ID NO: 831201 - RNA, 21 nt, Human
gcuggcacgcucggcccuggc

SEQ ID NO: 831202 - RNA, 18 nt, Human
ggaccagcgggguaggag

SEQ ID NO: 831203 - RNA, 25 nt, Human
ggagcucugcacgugaccuccaccu

SEQ ID NO: 831204 - RNA, 18 nt, Human
ggccuagacguguggcug

SEQ ID NO: 831205 - RNA, 18 nt, Human
ggcuucucucuccucuuc

SEQ ID NO: 831206 - RNA, 20 nt, Human
gggaacccgcccagugcugg

SEQ ID NO: 831207 - RNA, 21 nt, Human
ggggggcuccgggaccucaug

SEQ ID NO: 831208 - RNA, 19 nt, Human
ggguugagaggggggcucc

SEQ ID NO: 831209 - RNA, 18 nt, Human
ggucagcagcucacaggc

SEQ ID NO: 831210 - RNA, 21 nt, Human
gguugagaggggggcuccggg

SEQ ID NO: 831211 - RNA, 21 nt, Human
gucuguuucuauuucugucuu

SEQ ID NO: 831212 - RNA, 20 nt, Human
guguaugugagugugugugu

SEQ ID NO: 831213 - RNA, 20 nt, Human
uaugugugugaguguaugug

SEQ ID NO: 831214 - RNA, 21 nt, Human
ucaaccccucggugcuuucag

SEQ ID NO: 831215 - RNA, 19 nt, Human
uccauccgccugcuggcac

SEQ ID NO: 831216 - RNA, 23 nt, Human
uccccgaagguuugggaaagggg

SEQ ID NO: 831217 - RNA, 24 nt, Human
uccccgaagguuugggaaaggggu

SEQ ID NO: 831218 - RNA, 19 nt, Human
ucucccggcccacccagcu

SEQ ID NO: 831219 - RNA, 20 nt, Human
ucuccugccccccccacccc

SEQ ID NO: 831220 - RNA, 18 nt, Human
ucucucuccucuucuccg

SEQ ID NO: 831221 - RNA, 21 nt, Human
ucuugucuccugcccccccca

SEQ ID NO: 831222 - RNA, 24 nt, Human
ucuuucugucucuguauuuuugac

SEQ ID NO: 831223 - RNA, 20 nt, Human
ugauggggaaucugccccag

SEQ ID NO: 831224 - RNA, 19 nt, Human
ugccccagccgagaugucc

SEQ ID NO: 831225 - RNA, 23 nt, Human
ugccccccccacccccccuucca

SEQ ID NO: 831226 - RNA, 27 nt, Human
ugcugggcggccgcacgcaugcgcaca

SEQ ID NO: 831227 - RNA, 22 nt, Human
uggcuucucucuccucuucucc

SEQ ID NO: 831228 - RNA, 24 nt, Human
uguccugcugccuggugucuugau

SEQ ID NO: 831229 - RNA, 22 nt, Human
ugucuccugccccccccacccc

SEQ ID NO: 831230 - RNA, 21 nt, Human
ugugaguguguguguguccug

SEQ ID NO: 831231 - RNA, 21 nt, Human
uguguccugcugccugguguc

SEQ ID NO: 831232 - RNA, 24 nt, Human
ugugugaguguaugugagugugug

SEQ ID NO: 831233 - RNA, 27 nt, Human
uguugcugucagucuuucccccgucgg

SEQ ID NO: 831234 - RNA, 19 nt, Human
uuugccuccucccaccucc

SEQ ID NO: 831235 - RNA, 20 nt, Human
uuuucuguguugcugucagu

SEQ ID NO: 831236 - RNA, 18 nt, Human
aaggccucucuaaggccc

SEQ ID NO: 831237 - RNA, 23 nt, Human
acagcuguggccaccagagaacc

SEQ ID NO: 831238 - RNA, 20 nt, Human
agaaccggucagcugggcca

SEQ ID NO: 831239 - RNA, 22 nt, Human
agagacccuggccaaggacucc

SEQ ID NO: 831240 - RNA, 18 nt, Human
agagagggaagggagagc

SEQ ID NO: 831241 - RNA, 18 nt, Human
agcugggcgguggggcag

SEQ ID NO: 831242 - RNA, 19 nt, Human
aggcgggggaguggggaag

SEQ ID NO: 831243 - RNA, 25 nt, Human
aggcgggggaguggggaagagaggg

SEQ ID NO: 831244 - RNA, 20 nt, Human
agucagagacccuggccaag

SEQ ID NO: 831245 - RNA, 21 nt, Human
caagcagcuccugagugcaga

SEQ ID NO: 831246 - RNA, 26 nt, Human
cagcugggccaaggccucucuaaggc

SEQ ID NO: 831247 - RNA, 28 nt, Human
cagcugggccaaggccucucuaaggccc

SEQ ID NO: 831248 - RNA, 20 nt, Human
ccaaggccucucuaaggccc

SEQ ID NO: 831249 - RNA, 23 nt, Human
ccaaggcgggggaguggggaaga

SEQ ID NO: 831250 - RNA, 22 nt, Human
cccagcggcucucaugggcaaa

SEQ ID NO: 831251 - RNA, 18 nt, Human
cccaggaagcccaaggcg

SEQ ID NO: 831252 - RNA, 22 nt, Human
ccccaacacuucuagcuugccc

SEQ ID NO: 831253 - RNA, 21 nt, Human
ccccugggugacucugggucu

SEQ ID NO: 831254 - RNA, 19 nt, Human
ccugcugggcauccucuga

SEQ ID NO: 831255 - RNA, 21 nt, Human
cuccauccugcugggcauccu

SEQ ID NO: 831256 - RNA, 23 nt, Human
cugggcauccucugagaguuuau

SEQ ID NO: 831257 - RNA, 21 nt, Human
gacacgggcaggcacugcugg

SEQ ID NO: 831258 - RNA, 21 nt, Human
gagcucuguuuccugaucugu

SEQ ID NO: 831259 - RNA, 22 nt, Human
gcagcuccugagugcagauccu

SEQ ID NO: 831260 - RNA, 23 nt, Human
gcucucaugggcaaaugucaggu

SEQ ID NO: 831261 - RNA, 26 nt, Human
gcugcacugagcucuguuuccugauc

SEQ ID NO: 831262 - RNA, 21 nt, Human
gggaggggcgagguggccucu

SEQ ID NO: 831263 - RNA, 21 nt, Human
gggggaguggggaagagaggg

SEQ ID NO: 831264 - RNA, 24 nt, Human
ggucagcugggccaaggccucucu

SEQ ID NO: 831265 - RNA, 21 nt, Human
gguggccucuggggggagcug

SEQ ID NO: 831266 - RNA, 18 nt, Human
guagaauacacuucagaa

SEQ ID NO: 831267 - RNA, 20 nt, Human
uagcuguagggcccugagca

SEQ ID NO: 831268 - RNA, 22 nt, Human
ucaggugacacagagucagaga

SEQ ID NO: 831269 - RNA, 26 nt, Human
ucucuaaggcccagcggcucucaugg

SEQ ID NO: 831270 - RNA, 23 nt, Human
ugacucaggguugcugcuccugg

SEQ ID NO: 831271 - RNA, 18 nt, Human
ugacugagcacacagcug

SEQ ID NO: 831272 - RNA, 30 nt, Human
ugcgggcaacugggacuccauccugcuggg

SEQ ID NO: 831273 - RNA, 18 nt, Human
uggccaccagagaaccuc

SEQ ID NO: 831274 - RNA, 21 nt, Human
uggggacacgggcaggcacug

SEQ ID NO: 831275 - RNA, 24 nt, Human
uucagaaccggucagcugggccaa

SEQ ID NO: 831276 - RNA, 21 nt, Human
uuccugaucugucacagcccc

SEQ ID NO: 831277 - RNA, 21 nt, Human
uuuuuuuuuuuuuuucugggu

SEQ ID NO: 831278 - RNA, 24 nt, Human
uuuuuuuuuuuuuuuuuuucuggg

SEQ ID NO: 831279 - RNA, 22 nt, Human
acucucccgcccccuacagccc

SEQ ID NO: 831280 - RNA, 19 nt, Human
aggaaggaggggccuggag

SEQ ID NO: 831281 - RNA, 18 nt, Human
aggaaugucgugauucug

SEQ ID NO: 831282 - RNA, 18 nt, Human
cagaaaucagaaauggaa

SEQ ID NO: 831283 - RNA, 26 nt, Human
cagcccaaaccgggcacugcagcaag

SEQ ID NO: 831284 - RNA, 23 nt, Human
caggacuccuguguggcuggugg

SEQ ID NO: 831285 - RNA, 23 nt, Human
cagggugcccaggacuccugugu

SEQ ID NO: 831286 - RNA, 20 nt, Human
ccagggcagucccacuuaac

SEQ ID NO: 831287 - RNA, 21 nt, Human
cccagggcagucccacuuaac

SEQ ID NO: 831288 - RNA, 19 nt, Human
cccgcccccuacagcccaa

SEQ ID NO: 831289 - RNA, 22 nt, Human
ccuaagccagggugcccaggac

SEQ ID NO: 831290 - RNA, 21 nt, Human
ccucaaaaaauagaaguggcc

SEQ ID NO: 831291 - RNA, 25 nt, Human
cgcccccuacagcccaaaccgggca

SEQ ID NO: 831292 - RNA, 20 nt, Human
cucaaaaaauagaaguggcc

SEQ ID NO: 831293 - RNA, 19 nt, Human
cugaaacugcgccuugccc

SEQ ID NO: 831294 - RNA, 26 nt, Human
cuugcccagccugggucucgccugca

SEQ ID NO: 831295 - RNA, 23 nt, Human
gagagcagaaaucagaaauggaa

SEQ ID NO: 831296 - RNA, 19 nt, Human
gcagagagcagaaaucaga

SEQ ID NO: 831297 - RNA, 19 nt, Human
gcccaaaccgggcacugca

SEQ ID NO: 831298 - RNA, 21 nt, Human
gcugcagacucucccgccccc

SEQ ID NO: 831299 - RNA, 22 nt, Human
ggaaggaaugucgugauucuga

SEQ ID NO: 831300 - RNA, 19 nt, Human
ggccugaugcccacagcug

SEQ ID NO: 831301 - RNA, 21 nt, Human
ucccgcccccuacagcccaaa

SEQ ID NO: 831302 - RNA, 23 nt, Human
ucccgcccccuacagcccaaacc

SEQ ID NO: 831303 - RNA, 21 nt, Human
ucucccgcccccuacagccca

SEQ ID NO: 831304 - RNA, 22 nt, Human
ugaguacaguauggcaaauucu

SEQ ID NO: 831305 - RNA, 23 nt, Human
ugauucaggaaggaggggccugg

SEQ ID NO: 831306 - RNA, 21 nt, Human
ugcccaggacuccuguguggc

SEQ ID NO: 831307 - RNA, 18 nt, Human
ugcccagggcagucccac

SEQ ID NO: 831308 - RNA, 19 nt, Human
ugccucaguuucccuaacu

SEQ ID NO: 831309 - RNA, 20 nt, Human
ugcgccuugcccagccuggg

SEQ ID NO: 831310 - RNA, 19 nt, Human
ugguagggaaggaaugucg

SEQ ID NO: 831311 - RNA, 20 nt, Human
uggugccacucugcucagcc

SEQ ID NO: 831312 - RNA, 22 nt, Human
uuucccuaacuccauccagugc

SEQ ID NO: 831313 - RNA, 20 nt, Human
aaaaaaaaaacuaaaaccca

SEQ ID NO: 831314 - RNA, 24 nt, Human
aaaaaaaaaacuaaaacccaaacc

SEQ ID NO: 831315 - RNA, 21 nt, Human
aaaaagaaaacagaggagaaa

SEQ ID NO: 831316 - RNA, 21 nt, Human
aaacaaaauagcacuuuuaaa

SEQ ID NO: 831317 - RNA, 19 nt, Human
aaacacgauccaaugacug

SEQ ID NO: 831318 - RNA, 21 nt, Human
aaccggaccguccugcccuuc

SEQ ID NO: 831319 - RNA, 18 nt, Human
aaggucugcauaaacacu

SEQ ID NO: 831320 - RNA, 23 nt, Human
acaaaagaaaacacgauccaaug

SEQ ID NO: 831321 - RNA, 23 nt, Human
acacugaaaauauguugaggaac

SEQ ID NO: 831322 - RNA, 22 nt, Human
accccaaguaaguguucaggga

SEQ ID NO: 831323 - RNA, 19 nt, Human
accuucccucccgcguccc

SEQ ID NO: 831324 - RNA, 21 nt, Human
acuacuaucccaccuuuugaa

SEQ ID NO: 831325 - RNA, 22 nt, Human
agaaaugcaccacuaaaccucc

SEQ ID NO: 831326 - RNA, 19 nt, Human
auagaaacacccgaugccc

SEQ ID NO: 831327 - RNA, 23 nt, Human
auagaaacacccgaugcccugca

SEQ ID NO: 831328 - RNA, 19 nt, Human
aucauguuccugauuuuau

SEQ ID NO: 831329 - RNA, 23 nt, Human
caaaagaaaacacgauccaauga

SEQ ID NO: 831330 - RNA, 19 nt, Human
caaaaugaauauagaaaua

SEQ ID NO: 831331 - RNA, 22 nt, Human
caaauacaaacaaaauagcacu

SEQ ID NO: 831332 - RNA, 21 nt, Human
caacuuuccauccucugcacu

SEQ ID NO: 831333 - RNA, 31 nt, Human
caccuuaaaaaaaaaaaacuaaaacccaaag

SEQ ID NO: 831334 - RNA, 21 nt, Human
cagcacaguacaauaauggac

SEQ ID NO: 831335 - RNA, 23 nt, Human
cauagcagaagcuacucagagaa

SEQ ID NO: 831336 - RNA, 24 nt, Human
cauagcagaagcuacucagagaaa

SEQ ID NO: 831337 - RNA, 21 nt, Human
cauuaacaauacucuguggaa

SEQ ID NO: 831338 - RNA, 23 nt, Human
cccccacaaaucuccuacaaucc

SEQ ID NO: 831339 - RNA, 18 nt, Human
ccccggggcccgaccugg

SEQ ID NO: 831340 - RNA, 24 nt, Human
cccuucuuugccucugucccuaac

SEQ ID NO: 831341 - RNA, 20 nt, Human
ccgugaccuacagggaacau

SEQ ID NO: 831342 - RNA, 21 nt, Human
ccuauaucauguuccugauuu

SEQ ID NO: 831343 - RNA, 21 nt, Human
ccucaccuuaaaaaaaaaaaa

SEQ ID NO: 831344 - RNA, 21 nt, Human
ccucuccaagccccuuuggcc

SEQ ID NO: 831345 - RNA, 27 nt, Human
ccuuaaaaaaaaaaaacuaaaacccaa

SEQ ID NO: 831346 - RNA, 19 nt, Human
ccuuuggcccaucuucucc

SEQ ID NO: 831347 - RNA, 21 nt, Human
cuacuagcccuuugauuuucu

SEQ ID NO: 831348 - RNA, 22 nt, Human
cuagcccuuugauuuucugagu

SEQ ID NO: 831349 - RNA, 27 nt, Human
cuccucugucugcucuugguagcucca

SEQ ID NO: 831350 - RNA, 26 nt, Human
cuggaaaaugucucucauuacucuca

SEQ ID NO: 831351 - RNA, 25 nt, Human
cuggcgggcggcggcuaccuucccu

SEQ ID NO: 831352 - RNA, 20 nt, Human
cuguaugugcuugugugcuu

SEQ ID NO: 831353 - RNA, 22 nt, Human
cuuacugggcaucaacuuucca

SEQ ID NO: 831354 - RNA, 22 nt, Human
gacaaaagaaaacacgauccaa

SEQ ID NO: 831355 - RNA, 18 nt, Human
ggacugcaggagugaaug

SEQ ID NO: 831356 - RNA, 21 nt, Human
gggagugccgugaccuacagg

SEQ ID NO: 831357 - RNA, 22 nt, Human
gggcgggaacauccacgggaaa

SEQ ID NO: 831358 - RNA, 20 nt, Human
guaugugcuugugugcuuuu

SEQ ID NO: 831359 - RNA, 21 nt, Human
gugugugugugugugugugug

SEQ ID NO: 831360 - RNA, 21 nt, Human
gugugugugugugugugugug

SEQ ID NO: 831361 - RNA, 21 nt, Human
gugugugugugugugugugug

SEQ ID NO: 831362 - RNA, 21 nt, Human
gugugugugugugugugugug

SEQ ID NO: 831363 - RNA, 21 nt, Human
gugugugugugugugugugug

SEQ ID NO: 831364 - RNA, 27 nt, Human
uaaaaaaaaaaaacuaaaacccaaacc

SEQ ID NO: 831365 - RNA, 21 nt, Human
uaaugcagaauggaucuucag

SEQ ID NO: 831366 - RNA, 19 nt, Human
uacaauaauggacaaaaga

SEQ ID NO: 831367 - RNA, 25 nt, Human
uacaauaauggacaaaagaaaacac

SEQ ID NO: 831368 - RNA, 21 nt, Human
uaccuugcuucccaacauaac

SEQ ID NO: 831369 - RNA, 23 nt, Human
uagaaacacccgaugcccugcaa

SEQ ID NO: 831370 - RNA, 30 nt, Human
uagauuuguugugugugugugugugugugg

SEQ ID NO: 831371 - RNA, 26 nt, Human
uauauguagauuuguugugugugugu

SEQ ID NO: 831372 - RNA, 20 nt, Human
uauuguggaauaacauggaa

SEQ ID NO: 831373 - RNA, 18 nt, Human
ucuuuggggguaccuugc

SEQ ID NO: 831374 - RNA, 18 nt, Human
ugaccuacagggaacauc

SEQ ID NO: 831375 - RNA, 24 nt, Human
ugaggaccccaaguaaguguucag

SEQ ID NO: 831376 - RNA, 21 nt, Human
ugcauaggcguguguggggau

SEQ ID NO: 831377 - RNA, 20 nt, Human
ugcccugcaauauuuuuagc

SEQ ID NO: 831378 - RNA, 20 nt, Human
ugccucugucccuaacagcc

SEQ ID NO: 831379 - RNA, 19 nt, Human
ugcuugugugcuuuuggga

SEQ ID NO: 831380 - RNA, 19 nt, Human
uggaagagcagggguuggc

SEQ ID NO: 831381 - RNA, 27 nt, Human
uggaauaacauggaaauacaaaggcuu

SEQ ID NO: 831382 - RNA, 25 nt, Human
uguagauuuguugugugugugugug

SEQ ID NO: 831383 - RNA, 21 nt, Human
ugucccuaacagccgcagaac

SEQ ID NO: 831384 - RNA, 20 nt, Human
uguggaauagaaacacccga

SEQ ID NO: 831385 - RNA, 18 nt, Human
ugugugugugugugugug

SEQ ID NO: 831386 - RNA, 18 nt, Human
ugugugugugugugugug

SEQ ID NO: 831387 - RNA, 18 nt, Human
ugugugugugugugugug

SEQ ID NO: 831388 - RNA, 18 nt, Human
ugugugugugugugugug

SEQ ID NO: 831389 - RNA, 18 nt, Human
ugugugugugugugugug

SEQ ID NO: 831390 - RNA, 18 nt, Human
ugugugugugugugugug

SEQ ID NO: 831391 - RNA, 18 nt, Human
ugugugugugugugugug

SEQ ID NO: 831392 - RNA, 18 nt, Human
ugugugugugugugugug

SEQ ID NO: 831393 - RNA, 18 nt, Human
ugugugugugugugugug

SEQ ID NO: 831394 - RNA, 18 nt, Human
ugugugugugugugugug

SEQ ID NO: 831395 - RNA, 18 nt, Human
ugugugugugugugugug

SEQ ID NO: 831396 - RNA, 18 nt, Human
ugugugugugugugugug

SEQ ID NO: 831397 - RNA, 21 nt, Human
ugugugugugugugugugugu

SEQ ID NO: 831398 - RNA, 21 nt, Human
ugugugugugugugugugugu

SEQ ID NO: 831399 - RNA, 21 nt, Human
ugugugugugugugugugugu

SEQ ID NO: 831400 - RNA, 21 nt, Human
ugugugugugugugugugugu

SEQ ID NO: 831401 - RNA, 21 nt, Human
ugugugugugugugugugugu

SEQ ID NO: 831402 - RNA, 21 nt, Human
ugugugugugugugugugugu

SEQ ID NO: 831403 - RNA, 21 nt, Human
ugugugugugugugugugugu

SEQ ID NO: 831404 - RNA, 21 nt, Human
ugugugugugugugugugugu

SEQ ID NO: 831405 - RNA, 21 nt, Human
ugugugugugugugugugugu

SEQ ID NO: 831406 - RNA, 21 nt, Human
ugugugugugugugugugugu

SEQ ID NO: 831407 - RNA, 21 nt, Human
ugugugugugugugugugugu

SEQ ID NO: 831408 - RNA, 21 nt, Human
ugugugugugugugugugugu

SEQ ID NO: 831409 - RNA, 21 nt, Human
ugugugugugugugugugugu

SEQ ID NO: 831410 - RNA, 21 nt, Human
ugugugugugugugugugugu

SEQ ID NO: 831411 - RNA, 21 nt, Human
ugugugugugugugugugugu

SEQ ID NO: 831412 - RNA, 21 nt, Human
ugugugugugugugugugugu

SEQ ID NO: 831413 - RNA, 21 nt, Human
ugugugugugugugugugugu

SEQ ID NO: 831414 - RNA, 21 nt, Human
ugugugugugugugugugugu

SEQ ID NO: 831415 - RNA, 21 nt, Human
ugugugugugugugugugugu

SEQ ID NO: 831416 - RNA, 21 nt, Human
ugugugugugugugugugugu

SEQ ID NO: 831417 - RNA, 22 nt, Human
ugugugugugugugugugugug

SEQ ID NO: 831418 - RNA, 22 nt, Human
ugugugugugugugugugugug

SEQ ID NO: 831419 - RNA, 22 nt, Human
ugugugugugugugugugugug

SEQ ID NO: 831420 - RNA, 22 nt, Human
ugugugugugugugugugugug

SEQ ID NO: 831421 - RNA, 22 nt, Human
ugugugugugugugugugugug

SEQ ID NO: 831422 - RNA, 23 nt, Human
ugugugugugugugugugugugu

SEQ ID NO: 831423 - RNA, 23 nt, Human
uguguguguguguguguguguug

SEQ ID NO: 831424 - RNA, 19 nt, Human
uguguguguguguguguug

SEQ ID NO: 831425 - RNA, 23 nt, Human
uuaaaaagaaaacagaggagaaa

SEQ ID NO: 831426 - RNA, 21 nt, Human
uuaaauuuuuuacaaaaugaa

SEQ ID NO: 831427 - RNA, 20 nt, Human
uuugugcauaggcgugugug

SEQ ID NO: 831428 - RNA, 20 nt, Human
aaacaaaguccucaagugag

SEQ ID NO: 831429 - RNA, 19 nt, Human
aaacagaaacaaacauccc

SEQ ID NO: 831430 - RNA, 20 nt, Human
aaacagaaacaaacaucccu

SEQ ID NO: 831431 - RNA, 23 nt, Human
aacaagaacuccaacccaaaacc

SEQ ID NO: 831432 - RNA, 18 nt, Human
aagaacuccaacccaaaa

SEQ ID NO: 831433 - RNA, 21 nt, Human
aagaacuccaacccaaaaccc

SEQ ID NO: 831434 - RNA, 22 nt, Human
aagguacuuuuucaaaacaaag

SEQ ID NO: 831435 - RNA, 22 nt, Human
aauacauaugcacaggaaccaa

SEQ ID NO: 831436 - RNA, 21 nt, Human
acaagaacuccaacccaaaac

SEQ ID NO: 831437 - RNA, 18 nt, Human
acacagagacagaagcuu

SEQ ID NO: 831438 - RNA, 22 nt, Human
acacagguuuaaagaauccaca

SEQ ID NO: 831439 - RNA, 19 nt, Human
acuccaacccaaaacccca

SEQ ID NO: 831440 - RNA, 19 nt, Human
acucccauaacuagcuucu

SEQ ID NO: 831441 - RNA, 18 nt, Human
acuuguaaggacacugag

SEQ ID NO: 831442 - RNA, 23 nt, Human
acuuuuucuccuuccagaaaucu

SEQ ID NO: 831443 - RNA, 19 nt, Human
agacagugucuugcugugc

SEQ ID NO: 831444 - RNA, 19 nt, Human
agagauaugguuaagguuu

SEQ ID NO: 831445 - RNA, 20 nt, Human
agcacaauaccuuguccaca

SEQ ID NO: 831446 - RNA, 22 nt, Human
agcaccuacugacccccucagc

SEQ ID NO: 831447 - RNA, 18 nt, Human
agcagaaacagccugcag

SEQ ID NO: 831448 - RNA, 21 nt, Human
agccucuuucugugugguguu

SEQ ID NO: 831449 - RNA, 22 nt, Human
agguguaggcagugcugugacc

SEQ ID NO: 831450 - RNA, 30 nt, Human
agugguuuuuaaacagcuguguggaagagg

SEQ ID NO: 831451 - RNA, 22 nt, Human
auaccagucuuuucuucacaua

SEQ ID NO: 831452 - RNA, 19 nt, Human
augguccuauuuauuagaa

SEQ ID NO: 831453 - RNA, 24 nt, Human
augguccuuucaucccaagccugg

SEQ ID NO: 831454 - RNA, 23 nt, Human
caaaacaaaguccucaagugagc

SEQ ID NO: 831455 - RNA, 18 nt, Human
caaaugaugaaacugugg

SEQ ID NO: 831456 - RNA, 20 nt, Human
caagaaagaaagaaaaguga

SEQ ID NO: 831457 - RNA, 20 nt, Human
caagaacuccaacccaaaac

SEQ ID NO: 831458 - RNA, 19 nt, Human
cacacaaacuuguguaugu

SEQ ID NO: 831459 - RNA, 26 nt, Human
caccacagucucagaagaaaucccag

SEQ ID NO: 831460 - RNA, 21 nt, Human
cagauuaauaacauaaacacu

SEQ ID NO: 831461 - RNA, 22 nt, Human
cagguugaucuagagguacacu

SEQ ID NO: 831462 - RNA, 20 nt, Human
cauaaaaaaagacuauggca

SEQ ID NO: 831463 - RNA, 22 nt, Human
ccaaaacaaaacaacaaaacau

SEQ ID NO: 831464 - RNA, 21 nt, Human
ccaagugccgagauucuggca

SEQ ID NO: 831465 - RNA, 24 nt, Human
ccacagcaugacuccacgccaucc

SEQ ID NO: 831466 - RNA, 19 nt, Human
ccagccucuuucugugugg

SEQ ID NO: 831467 - RNA, 24 nt, Human
ccaggaaaaaaugauuucauacca

SEQ ID NO: 831468 - RNA, 19 nt, Human
ccaggguggggugguaggg

SEQ ID NO: 831469 - RNA, 20 nt, Human
ccaggguggggugguagggc

SEQ ID NO: 831470 - RNA, 21 nt, Human
ccaggguggggugguagggcu

SEQ ID NO: 831471 - RNA, 24 nt, Human
ccaguuuccaaaacaaaacaacaa

SEQ ID NO: 831472 - RNA, 18 nt, Human
cccaggaaaaaaugauuu

SEQ ID NO: 831473 - RNA, 24 nt, Human
cccaggaaaaaaugauuucauacc

SEQ ID NO: 831474 - RNA, 18 nt, Human
cccccgcccgggcccgcc

SEQ ID NO: 831475 - RNA, 23 nt, Human
ccccgcccgggcccgccggcucc

SEQ ID NO: 831476 - RNA, 19 nt, Human
cccuccagagcaccuacug

SEQ ID NO: 831477 - RNA, 23 nt, Human
ccucagccuuggaaggaguuuca

SEQ ID NO: 831478 - RNA, 23 nt, Human
ccuguccaguuuccaaaacaaaa

SEQ ID NO: 831479 - RNA, 22 nt, Human
cgggcccgccggcuccacgccg

SEQ ID NO: 831480 - RNA, 22 nt, Human
cuccacgccgccgcggcuccuc

SEQ ID NO: 831481 - RNA, 20 nt, Human
cuccacuugacucaaaugau

SEQ ID NO: 831482 - RNA, 25 nt, Human
cucccaccccuuuugcccuuagccc

SEQ ID NO: 831483 - RNA, 24 nt, Human
cugugugguguuagagauaugguu

SEQ ID NO: 831484 - RNA, 18 nt, Human
cuguuuugacuccugucc

SEQ ID NO: 831485 - RNA, 23 nt, Human
cuuggagaccucagucccuggaa

SEQ ID NO: 831486 - RNA, 21 nt, Human
cuuguaaggacacugagauug

SEQ ID NO: 831487 - RNA, 22 nt, Human
cuuguaaggacacugagauugu

SEQ ID NO: 831488 - RNA, 20 nt, Human
cuuugcguagcuggaugugg

SEQ ID NO: 831489 - RNA, 27 nt, Human
gaaaauagcuguggccugccagaagcc

SEQ ID NO: 831490 - RNA, 21 nt, Human
gaaagaacagaggaaaacaag

SEQ ID NO: 831491 - RNA, 18 nt, Human
gaacuccaacccaaaacc

SEQ ID NO: 831492 - RNA, 22 nt, Human
gaacuccaacccaaaaccccau

SEQ ID NO: 831493 - RNA, 18 nt, Human
gacccccucagccuugga

SEQ ID NO: 831494 - RNA, 21 nt, Human
gagaauaaagauucccacagc

SEQ ID NO: 831495 - RNA, 20 nt, Human
gaggaaacagugagguuucc

SEQ ID NO: 831496 - RNA, 23 nt, Human
gaucuccagaagaagaggagacu

SEQ ID NO: 831497 - RNA, 21 nt, Human
gcagcccaucccaucccguca

SEQ ID NO: 831498 - RNA, 22 nt, Human
gcccccgcccgggcccgccggc

SEQ ID NO: 831499 - RNA, 21 nt, Human
gcccgccggcuccacgccgcc

SEQ ID NO: 831500 - RNA, 18 nt, Human
gcccgggcccgccggcuc

SEQ ID NO: 831501 - RNA, 21 nt, Human
gcuccuccagccucuuucugu

SEQ ID NO: 831502 - RNA, 21 nt, Human
gcucuggucauucugagauac

SEQ ID NO: 831503 - RNA, 22 nt, Human
ggaaaacaagaacuccaaccca

SEQ ID NO: 831504 - RNA, 21 nt, Human
ggaguuucaccacagucucag

SEQ ID NO: 831505 - RNA, 19 nt, Human
ggauuggaaauagagcuga

SEQ ID NO: 831506 - RNA, 20 nt, Human
ggcagugcugugaccuugau

SEQ ID NO: 831507 - RNA, 21 nt, Human
ggcaguuccaucucacuuucu

SEQ ID NO: 831508 - RNA, 22 nt, Human
ggguggggugguagggcuccgg

SEQ ID NO: 831509 - RNA, 21 nt, Human
guaacuacaaaaacuuaacuc

SEQ ID NO: 831510 - RNA, 20 nt, Human
gucuguucuaagccagacuc

SEQ ID NO: 831511 - RNA, 20 nt, Human
gugguuugggguucugugug

SEQ ID NO: 831512 - RNA, 21 nt, Human
guguuucuguaucaugauaca

SEQ ID NO: 831513 - RNA, 20 nt, Human
uaaaaucucuggagugacag

SEQ ID NO: 831514 - RNA, 21 nt, Human
uaaacagcuguguggaagagc

SEQ ID NO: 831515 - RNA, 20 nt, Human
uaagagaaaaggcaacaugg

SEQ ID NO: 831516 - RNA, 19 nt, Human
uaagaucuggggaggggag

SEQ ID NO: 831517 - RNA, 22 nt, Human
uaagccagacucuuacagcuaa

SEQ ID NO: 831518 - RNA, 18 nt, Human
uacacugccaccuuagcc

SEQ ID NO: 831519 - RNA, 25 nt, Human
uagccaaagagcaggugauggacau

SEQ ID NO: 831520 - RNA, 22 nt, Human
uagcuguggccugccagaagcc

SEQ ID NO: 831521 - RNA, 24 nt, Human
uagcuuguuucugugcugcucugg

SEQ ID NO: 831522 - RNA, 25 nt, Human
uagcuuguuucugugcugcucuggu

SEQ ID NO: 831523 - RNA, 22 nt, Human
uaguuccacaccucccaccccu

SEQ ID NO: 831524 - RNA, 23 nt, Human
ucaaaacaaaguccucaagugag

SEQ ID NO: 831525 - RNA, 25 nt, Human
ucaaagcacaauccuaaccaccuag

SEQ ID NO: 831526 - RNA, 23 nt, Human
ucaaugcuagacaauguauuagu

SEQ ID NO: 831527 - RNA, 21 nt, Human
ucacucagggcaagguugcaa

SEQ ID NO: 831528 - RNA, 19 nt, Human
ucauucugagauacuaucu

SEQ ID NO: 831529 - RNA, 22 nt, Human
uccaaaacaaaacaacaaaaca

SEQ ID NO: 831530 - RNA, 18 nt, Human
uccacaccucccaccccu

SEQ ID NO: 831531 - RNA, 19 nt, Human
uccacaccucccaccccuu

SEQ ID NO: 831532 - RNA, 24 nt, Human
ucccacagccaggaaaauagcugu

SEQ ID NO: 831533 - RNA, 19 nt, Human
uccucaagugagcagauua

SEQ ID NO: 831534 - RNA, 21 nt, Human
uccuggaauuaaggucuuggc

SEQ ID NO: 831535 - RNA, 19 nt, Human
uccuugccaaaacagaaac

SEQ ID NO: 831536 - RNA, 24 nt, Human
ucgcagucaaagcacaauccuaac

SEQ ID NO: 831537 - RNA, 20 nt, Human
ucucauauaggccaaacacc

SEQ ID NO: 831538 - RNA, 22 nt, Human
ucucauauaggccaaacaccag

SEQ ID NO: 831539 - RNA, 26 nt, Human
ugaaaauacauaugcacaggaaccaa

SEQ ID NO: 831540 - RNA, 18 nt, Human
ugaaagaacagaggaaaa

SEQ ID NO: 831541 - RNA, 18 nt, Human
ugaauaagccaugaaggc

SEQ ID NO: 831542 - RNA, 19 nt, Human
ugacuccacgccaucccug

SEQ ID NO: 831543 - RNA, 18 nt, Human
ugaggcagagaugcucac

SEQ ID NO: 831544 - RNA, 21 nt, Human
ugaggcagagaugcucacaag

SEQ ID NO: 831545 - RNA, 18 nt, Human
ugcagcgggcguagaugc

SEQ ID NO: 831546 - RNA, 19 nt, Human
ugccaaaacagaaacaaac

SEQ ID NO: 831547 - RNA, 24 nt, Human
ugccaaaacagaaacaaacauccc

SEQ ID NO: 831548 - RNA, 25 nt, Human
ugcccaggguggggugguagggcuc

SEQ ID NO: 831549 - RNA, 23 nt, Human
uggaaauagagcugacuacagca

SEQ ID NO: 831550 - RNA, 22 nt, Human
uggaaggaggaaacagugaggu

SEQ ID NO: 831551 - RNA, 22 nt, Human
ugggagucauugcaaccccaau

SEQ ID NO: 831552 - RNA, 24 nt, Human
ugggggagauggagucugacagaa

SEQ ID NO: 831553 - RNA, 24 nt, Human
uggggugguagggcuccggggagc

SEQ ID NO: 831554 - RNA, 19 nt, Human
uggguuacugaauaagcca

SEQ ID NO: 831555 - RNA, 18 nt, Human
ugguccuauuuauuagaa

SEQ ID NO: 831556 - RNA, 18 nt, Human
uggugccgagucccucca

SEQ ID NO: 831557 - RNA, 22 nt, Human
uguaaaccuagugucagaaaau

SEQ ID NO: 831558 - RNA, 20 nt, Human
uguagaaugccauucugcua

SEQ ID NO: 831559 - RNA, 18 nt, Human
ugucccgcuggaagugcu

SEQ ID NO: 831560 - RNA, 26 nt, Human
ugugcaugccugugcuuccggagccc

SEQ ID NO: 831561 - RNA, 21 nt, Human
uguguauguauaauauacaua

SEQ ID NO: 831562 - RNA, 23 nt, Human
uguguauguauaauauacauaua

SEQ ID NO: 831563 - RNA, 25 nt, Human
uguguauguauaauauacauauaua

SEQ ID NO: 831564 - RNA, 20 nt, Human
uguuucuuuacucaaauuuc

SEQ ID NO: 831565 - RNA, 21 nt, Human
uguuuugacuccuguccaguu

SEQ ID NO: 831566 - RNA, 24 nt, Human
uguuuuucaucaagguuugagacu

SEQ ID NO: 831567 - RNA, 22 nt, Human
uuaacuuguaaggacacugaga

SEQ ID NO: 831568 - RNA, 19 nt, Human
uuacaccacagauguuuga

SEQ ID NO: 831569 - RNA, 20 nt, Human
uuagacccaggaaaaaauga

SEQ ID NO: 831570 - RNA, 20 nt, Human
uucacuagcaagauuucaua

SEQ ID NO: 831571 - RNA, 20 nt, Human
uucaggaaugggaaacucau

SEQ ID NO: 831572 - RNA, 19 nt, Human
uucauguuccauuccuuau

SEQ ID NO: 831573 - RNA, 23 nt, Human
uucccagguugaucuagagguac

SEQ ID NO: 831574 - RNA, 22 nt, Human
uucguuggagacaacuugaaag

SEQ ID NO: 831575 - RNA, 19 nt, Human
uugaaaacuauacaaaaac

SEQ ID NO: 831576 - RNA, 21 nt, Human
uugcccuuagcccuuaaucug

SEQ ID NO: 831577 - RNA, 19 nt, Human
uuuaacucuuuuggcccuu

SEQ ID NO: 831578 - RNA, 20 nt, Human
uuuaauuaagaucuggggag

SEQ ID NO: 831579 - RNA, 23 nt, Human
uuuauggaaaaauuuuguguuuu

SEQ ID NO: 831580 - RNA, 22 nt, Human
uuugaaggcucaaauugagucc

SEQ ID NO: 831581 - RNA, 23 nt, Human
uuugcccuuagcccuuaaucugu

SEQ ID NO: 831582 - RNA, 19 nt, Human
aaagugcugggauuacagg

SEQ ID NO: 831583 - RNA, 20 nt, Human
aaagugcugggauuacaggc

SEQ ID NO: 831584 - RNA, 24 nt, Human
aaagugcugggauuacaggcguua

SEQ ID NO: 831585 - RNA, 22 nt, Human
aagucagggcccaggcagggga

SEQ ID NO: 831586 - RNA, 19 nt, Human
aagugcugggauuacaggc

SEQ ID NO: 831587 - RNA, 19 nt, Human
aagugcugggauuacaggc

SEQ ID NO: 831588 - RNA, 20 nt, Human
acugaaaugcaaagagucug

SEQ ID NO: 831589 - RNA, 21 nt, Human
acugcauuuaaaggcccaugg

SEQ ID NO: 831590 - RNA, 22 nt, Human
agaaggcagggcugucagggcc

SEQ ID NO: 831591 - RNA, 20 nt, Human
agaggcagggguggaggagg

SEQ ID NO: 831592 - RNA, 21 nt, Human
agaggcagggguggaggaggc

SEQ ID NO: 831593 - RNA, 25 nt, Human
agaggcagggguggaggggaggcag

SEQ ID NO: 831594 - RNA, 25 nt, Human
aggcagggcugucagggccuugguu

SEQ ID NO: 831595 - RNA, 25 nt, Human
aggcaggggagcaggccacccaggu

SEQ ID NO: 831596 - RNA, 25 nt, Human
aggcagggguggaggagaggcaggg

SEQ ID NO: 831597 - RNA, 25 nt, Human
aggcagggguggaggagaggcaggg

SEQ ID NO: 831598 - RNA, 25 nt, Human
aggcagggguggaggagaggggacc

SEQ ID NO: 831599 - RNA, 26 nt, Human
aggcagggguggaggagaggggaccc

SEQ ID NO: 831600 - RNA, 18 nt, Human
aggcagggguggaggagg

SEQ ID NO: 831601 - RNA, 18 nt, Human
aggcagggguggaggagg

SEQ ID NO: 831602 - RNA, 19 nt, Human
aggcagggguggaggaggc

SEQ ID NO: 831603 - RNA, 22 nt, Human
aggcagggguggaggaggcggg

SEQ ID NO: 831604 - RNA, 26 nt, Human
aggcagggguggaggaggcggggcuc

SEQ ID NO: 831605 - RNA, 19 nt, Human
aggcagggguggaggaggu

SEQ ID NO: 831606 - RNA, 22 nt, Human
aggcagggguggaggagguggg

SEQ ID NO: 831607 - RNA, 23 nt, Human
aggcagggguggaggaggugggg

SEQ ID NO: 831608 - RNA, 26 nt, Human
aggcagggguggaggagguggggcuc

SEQ ID NO: 831609 - RNA, 22 nt, Human
aggcagggguggaggggaggca

SEQ ID NO: 831610 - RNA, 19 nt, Human
aggcagggguggagggggg

SEQ ID NO: 831611 - RNA, 22 nt, Human
aggcagggguggagggggggac

SEQ ID NO: 831612 - RNA, 23 nt, Human
aggcguuagccaccgugcccggc

SEQ ID NO: 831613 - RNA, 19 nt, Human
agggaggcugacuugguuc

SEQ ID NO: 831614 - RNA, 18 nt, Human
agggcugucagggccuug

SEQ ID NO: 831615 - RNA, 18 nt, Human
agggguggaggagaggca

SEQ ID NO: 831616 - RNA, 18 nt, Human
agggguggaggagaggca

SEQ ID NO: 831617 - RNA, 20 nt, Human
agggguggaggagguggggc

SEQ ID NO: 831618 - RNA, 18 nt, Human
agggguggaggggaggca

SEQ ID NO: 831619 - RNA, 20 nt, Human
agguagggaacaaaugccug

SEQ ID NO: 831620 - RNA, 21 nt, Human
caaagugcugggauuacaggc

SEQ ID NO: 831621 - RNA, 23 nt, Human
caaagugcugggauuacaggcgu

SEQ ID NO: 831622 - RNA, 24 nt, Human
caaagugcugggauuacaggcguu

SEQ ID NO: 831623 - RNA, 23 nt, Human
caagaucugugcauaggaggccc

SEQ ID NO: 831624 - RNA, 19 nt, Human
cacuguguggcaugggagc

SEQ ID NO: 831625 - RNA, 18 nt, Human
cagugcccucgggagcug

SEQ ID NO: 831626 - RNA, 22 nt, Human
ccacccuccuggacuucacuac

SEQ ID NO: 831627 - RNA, 18 nt, Human
ccaccgugcccggcccac

SEQ ID NO: 831628 - RNA, 22 nt, Human
ccccugaaucugguuaggugga

SEQ ID NO: 831629 - RNA, 20 nt, Human
cccggcccugcuccucagcc

SEQ ID NO: 831630 - RNA, 22 nt, Human
cccggcccugcuccucagcucc

SEQ ID NO: 831631 - RNA, 22 nt, Human
cccuggguuucuuccaggcucu

SEQ ID NO: 831632 - RNA, 19 nt, Human
ccucgggagcugccccugg

SEQ ID NO: 831633 - RNA, 19 nt, Human
ccugaccucgugauccacc

SEQ ID NO: 831634 - RNA, 21 nt, Human
ccugaccucgugauccaccug

SEQ ID NO: 831635 - RNA, 18 nt, Human
ccuggacuucacuacagg

SEQ ID NO: 831636 - RNA, 23 nt, Human
cgggggugggguggugggcagug

SEQ ID NO: 831637 - RNA, 24 nt, Human
cuccguguuauccaggauggucuc

SEQ ID NO: 831638 - RNA, 24 nt, Human
cuccugaccucgugauccaccugc

SEQ ID NO: 831639 - RNA, 23 nt, Human
cugucccacccuccuggacuuca

SEQ ID NO: 831640 - RNA, 18 nt, Human
cuuccaggcucuucacug

SEQ ID NO: 831641 - RNA, 20 nt, Human
gaagaggaggcagugggcau

SEQ ID NO: 831642 - RNA, 21 nt, Human
gacaggccugucccacccucc

SEQ ID NO: 831643 - RNA, 22 nt, Human
gaccucgugauccaccugccuc

SEQ ID NO: 831644 - RNA, 24 nt, Human
gaccucgugauccaccugccucag

SEQ ID NO: 831645 - RNA, 24 nt, Human
gagaggcagggguggaggaggcgg

SEQ ID NO: 831646 - RNA, 19 nt, Human
gagaggcagggguggaggg

SEQ ID NO: 831647 - RNA, 21 nt, Human
gaggagguggggcucuccugg

SEQ ID NO: 831648 - RNA, 18 nt, Human
gauuacaggcguuagcca

SEQ ID NO: 831649 - RNA, 20 nt, Human
gauuacaggcguuagccacc

SEQ ID NO: 831650 - RNA, 21 nt, Human
gauuacaggcguuagccaccg

SEQ ID NO: 831651 - RNA, 22 nt, Human
gcagguggaggggaggcagggg

SEQ ID NO: 831652 - RNA, 20 nt, Human
ggagccuucacagugcccuc

SEQ ID NO: 831653 - RNA, 24 nt, Human
ggaggcggggcucucccaggaggc

SEQ ID NO: 831654 - RNA, 23 nt, Human
ggagguggggcucuccugggccg

SEQ ID NO: 831655 - RNA, 24 nt, Human
ggcacuggggcagguggaggggag

SEQ ID NO: 831656 - RNA, 21 nt, Human
ggcagagggcagaaggcaggg

SEQ ID NO: 831657 - RNA, 21 nt, Human
gggaggcugacuugguucugg

SEQ ID NO: 831658 - RNA, 24 nt, Human
gggcagaaggcagggcugucaggg

SEQ ID NO: 831659 - RNA, 26 nt, Human
gggcagagggcagaaggcagggcugu

SEQ ID NO: 831660 - RNA, 19 nt, Human
gggcagguggaggggaggc

SEQ ID NO: 831661 - RNA, 25 nt, Human
gggcagguggaggggaggcaggggu

SEQ ID NO: 831662 - RNA, 24 nt, Human
gggcggguggaggagaggcagggg

SEQ ID NO: 831663 - RNA, 19 nt, Human
gggggugggguggugggca

SEQ ID NO: 831664 - RNA, 19 nt, Human
gggguggaggaggcggggc

SEQ ID NO: 831665 - RNA, 21 nt, Human
ggguggaggagaggcaggggu

SEQ ID NO: 831666 - RNA, 21 nt, Human
ggguggaggagaggcaggggu

SEQ ID NO: 831667 - RNA, 21 nt, Human
ggguggaggaggcggggcucu

SEQ ID NO: 831668 - RNA, 21 nt, Human
ggguggaggggaggcaggggu

SEQ ID NO: 831669 - RNA, 26 nt, Human
ggguggugggcagugugccugggcag

SEQ ID NO: 831670 - RNA, 20 nt, Human
ggucucgaucuccugaccuc

SEQ ID NO: 831671 - RNA, 19 nt, Human
gguggaggagaggcagggg

SEQ ID NO: 831672 - RNA, 22 nt, Human
gguuucuccguguuauccagga

SEQ ID NO: 831673 - RNA, 23 nt, Human
gguuucuuccaggcucuucacug

SEQ ID NO: 831674 - RNA, 24 nt, Human
gugauccaccugccucagcaucuc

SEQ ID NO: 831675 - RNA, 24 nt, Human
uagccaccgugcccggcccacacc

SEQ ID NO: 831676 - RNA, 19 nt, Human
uaggugauuuuuaaaguuc

SEQ ID NO: 831677 - RNA, 22 nt, Human
ucaaagugcugggauuacaggc

SEQ ID NO: 831678 - RNA, 24 nt, Human
ucaaagugcugggauuacaggcgu

SEQ ID NO: 831679 - RNA, 20 nt, Human
ucacuacagggagcugaagu

SEQ ID NO: 831680 - RNA, 23 nt, Human
ucccagaggccugacaggccugu

SEQ ID NO: 831681 - RNA, 23 nt, Human
uccucagcuccgccgggguuucu

SEQ ID NO: 831682 - RNA, 19 nt, Human
uccugggcggguggaggag

SEQ ID NO: 831683 - RNA, 24 nt, Human
ucucaaagugcugggauuacaggc

SEQ ID NO: 831684 - RNA, 22 nt, Human
ucucacuguguggcaugggagc

SEQ ID NO: 831685 - RNA, 24 nt, Human
ucuccguguuauccaggauggucu

SEQ ID NO: 831686 - RNA, 22 nt, Human
ugacaggccugucccacccucc

SEQ ID NO: 831687 - RNA, 21 nt, Human
ugacuugguucugggcugcaa

SEQ ID NO: 831688 - RNA, 19 nt, Human
ugcauaggaggccccuggg

SEQ ID NO: 831689 - RNA, 24 nt, Human
ugcuccucagcuccgccgggguuu

SEQ ID NO: 831690 - RNA, 24 nt, Human
ugcugggauuacaggcguuagcca

SEQ ID NO: 831691 - RNA, 21 nt, Human
uggcauuguuucggggguggg

SEQ ID NO: 831692 - RNA, 22 nt, Human
uggcauuguuucgggggugggg

SEQ ID NO: 831693 - RNA, 21 nt, Human
ugggauuacaggcguuagcca

SEQ ID NO: 831694 - RNA, 22 nt, Human
ugggauuacaggcguuagccac

SEQ ID NO: 831695 - RNA, 23 nt, Human
ugggauuacaggcguuagccacc

SEQ ID NO: 831696 - RNA, 23 nt, Human
ugggauuacaggcguuagccacc

SEQ ID NO: 831697 - RNA, 24 nt, Human
ugggauuacaggcguuagccaccg

SEQ ID NO: 831698 - RNA, 18 nt, Human
uggguuucuuccaggcuc

SEQ ID NO: 831699 - RNA, 19 nt, Human
uggugggcagugugccugg

SEQ ID NO: 831700 - RNA, 18 nt, Human
uuggucugggcacugggg

SEQ ID NO: 831701 - RNA, 18 nt, Human
uuguuucggggguggggu

SEQ ID NO: 831702 - RNA, 18 nt, Human
uuuuuuuuuuuuuuuuug

SEQ ID NO: 831703 - RNA, 20 nt, Human
uuuuuuuuuuuuuuuuugcu

SEQ ID NO: 831704 - RNA, 22 nt, Human
uuuuuuuuuuuuuuuuugcugg

SEQ ID NO: 831705 - RNA, 22 nt, Human
aaacacuguagaguuuuccaga

SEQ ID NO: 831706 - RNA, 18 nt, Human
aaacagacauugguuuua

SEQ ID NO: 831707 - RNA, 20 nt, Human
aacauaacagguuaaccaca

SEQ ID NO: 831708 - RNA, 18 nt, Human
aagcaacauaacagguua

SEQ ID NO: 831709 - RNA, 18 nt, Human
aagcagguucccuucuua

SEQ ID NO: 831710 - RNA, 18 nt, Human
aaguaguaaauaaaggcc

SEQ ID NO: 831711 - RNA, 24 nt, Human
aaguggccaacagggguccccaac

SEQ ID NO: 831712 - RNA, 23 nt, Human
acauugguuuuacaaaaaaagug

SEQ ID NO: 831713 - RNA, 22 nt, Human
acccugaggagaggcucaaggc

SEQ ID NO: 831714 - RNA, 20 nt, Human
accugguggugggcaggaug

SEQ ID NO: 831715 - RNA, 21 nt, Human
accuguccaaacauucagaag

SEQ ID NO: 831716 - RNA, 19 nt, Human
accugugccuacccugccu

SEQ ID NO: 831717 - RNA, 24 nt, Human
acuuuauuacacaaauaagacauu

SEQ ID NO: 831718 - RNA, 23 nt, Human
agaagaccuggcccaagcaccac

SEQ ID NO: 831719 - RNA, 26 nt, Human
agcaagaaugaccuauaggcuuucau

SEQ ID NO: 831720 - RNA, 18 nt, Human
aggaagcagguucccuuc

SEQ ID NO: 831721 - RNA, 24 nt, Human
aggcagaguguguugggugacccu

SEQ ID NO: 831722 - RNA, 22 nt, Human
caaaagcaacauaacagguuaa

SEQ ID NO: 831723 - RNA, 20 nt, Human
cacacucaccuaggcaaugg

SEQ ID NO: 831724 - RNA, 25 nt, Human
caccacguucugaguggugccugcu

SEQ ID NO: 831725 - RNA, 22 nt, Human
cacgggcagaugcggaagugcc

SEQ ID NO: 831726 - RNA, 18 nt, Human
caggauggcggacggggg

SEQ ID NO: 831727 - RNA, 19 nt, Human
cagugaaauagagcugcca

SEQ ID NO: 831728 - RNA, 21 nt, Human
caugguugccacuggggccuu

SEQ ID NO: 831729 - RNA, 18 nt, Human
cauucugacugccauuuc

SEQ ID NO: 831730 - RNA, 19 nt, Human
ccaaaagcaacauaacagg

SEQ ID NO: 831731 - RNA, 18 nt, Human
ccacgggcagaugcggaa

SEQ ID NO: 831732 - RNA, 21 nt, Human
ccacuuaccacaugguugcca

SEQ ID NO: 831733 - RNA, 18 nt, Human
ccagaguuuucucuuucc

SEQ ID NO: 831734 - RNA, 19 nt, Human
ccccugaaaacauaaauca

SEQ ID NO: 831735 - RNA, 21 nt, Human
ccccugaaaacauaaaucaug

SEQ ID NO: 831736 - RNA, 18 nt, Human
ccguguguguguuuuccc

SEQ ID NO: 831737 - RNA, 20 nt, Human
ccguguguguguuuuccccu

SEQ ID NO: 831738 - RNA, 20 nt, Human
ccugagcccuuuuguuuggg

SEQ ID NO: 831739 - RNA, 21 nt, Human
ccugccuguagaucccagagc

SEQ ID NO: 831740 - RNA, 21 nt, Human
ccuguaaaugagaaggccguu

SEQ ID NO: 831741 - RNA, 19 nt, Human
ccugugccuacccugccug

SEQ ID NO: 831742 - RNA, 22 nt, Human
ccuuuuguuugggguggaagag

SEQ ID NO: 831743 - RNA, 20 nt, Human
cgacaugaaagguauguaac

SEQ ID NO: 831744 - RNA, 22 nt, Human
cgccuagcacagggcugggcac

SEQ ID NO: 831745 - RNA, 20 nt, Human
cguguguguguuuuccccuu

SEQ ID NO: 831746 - RNA, 23 nt, Human
cucaccuaggcaaugggcacccu

SEQ ID NO: 831747 - RNA, 21 nt, Human
cuccugguggguucugguucu

SEQ ID NO: 831748 - RNA, 18 nt, Human
cucuccccuauaagggau

SEQ ID NO: 831749 - RNA, 19 nt, Human
cugcaccugugccuacccu

SEQ ID NO: 831750 - RNA, 22 nt, Human
gaagggagaggaagcagguucc

SEQ ID NO: 831751 - RNA, 22 nt, Human
gagaggcucaaggcagagugug

SEQ ID NO: 831752 - RNA, 19 nt, Human
gaggggcagcuguggggcg

SEQ ID NO: 831753 - RNA, 21 nt, Human
gcaggaagguggacuugggcu

SEQ ID NO: 831754 - RNA, 18 nt, Human
gcccacgggcagaugcgg

SEQ ID NO: 831755 - RNA, 18 nt, Human
gccuagcacagggcuggg

SEQ ID NO: 831756 - RNA, 25 nt, Human
gcuauguuucuuacauauaugcuga

SEQ ID NO: 831757 - RNA, 23 nt, Human
ggacaaaugggcauccccugaaa

SEQ ID NO: 831758 - RNA, 20 nt, Human
ggauaauuagguggggguag

SEQ ID NO: 831759 - RNA, 23 nt, Human
ggcaggauggcggacgggggugg

SEQ ID NO: 831760 - RNA, 18 nt, Human
ggcaggccuccaucucug

SEQ ID NO: 831761 - RNA, 23 nt, Human
ggccaacagggguccccaacucu

SEQ ID NO: 831762 - RNA, 19 nt, Human
gggacaucccacaaacacu

SEQ ID NO: 831763 - RNA, 19 nt, Human
gguucugguucucagcagg

SEQ ID NO: 831764 - RNA, 20 nt, Human
gguugccacuggggccuuga

SEQ ID NO: 831765 - RNA, 20 nt, Human
guagaguuuuccagacaaaa

SEQ ID NO: 831766 - RNA, 21 nt, Human
gucuauccccgcugccuccua

SEQ ID NO: 831767 - RNA, 23 nt, Human
guggugcuccugguggguucugg

SEQ ID NO: 831768 - RNA, 21 nt, Human
uaaaacaugcugauuagcaac

SEQ ID NO: 831769 - RNA, 25 nt, Human
uaaauaaaggccaauguuguaauga

SEQ ID NO: 831770 - RNA, 24 nt, Human
uaacaaaacagacauugguuuuac

SEQ ID NO: 831771 - RNA, 18 nt, Human
uaaccagacagauggaaa

SEQ ID NO: 831772 - RNA, 18 nt, Human
uaccaucgcugcuauguu

SEQ ID NO: 831773 - RNA, 20 nt, Human
uaccaugaacuugcuuuccc

SEQ ID NO: 831774 - RNA, 18 nt, Human
uagaauuacaggauaagc

SEQ ID NO: 831775 - RNA, 23 nt, Human
uagaauuacaggauaagcuuggg

SEQ ID NO: 831776 - RNA, 26 nt, Human
uccaaaagcaacauaacagguuaacc

SEQ ID NO: 831777 - RNA, 22 nt, Human
uccagacucagugaaauagagc

SEQ ID NO: 831778 - RNA, 19 nt, Human
ucccagagcaagaaugacc

SEQ ID NO: 831779 - RNA, 21 nt, Human
uccccaacucuaaccugucca

SEQ ID NO: 831780 - RNA, 21 nt, Human
uccccgcugccuccuagucug

SEQ ID NO: 831781 - RNA, 27 nt, Human
uccccugaaaacauaaaucauggucgu

SEQ ID NO: 831782 - RNA, 22 nt, Human
ucccugaccccagaguuuucuc

SEQ ID NO: 831783 - RNA, 24 nt, Human
ucccugaccccagaguuuucucuu

SEQ ID NO: 831784 - RNA, 19 nt, Human
ucccuucuuaggcugcacc

SEQ ID NO: 831785 - RNA, 22 nt, Human
uccugagcuuggcacacucacc

SEQ ID NO: 831786 - RNA, 20 nt, Human
ucgguggcggggccgcccuc

SEQ ID NO: 831787 - RNA, 20 nt, Human
ucguguguagccugagcccu

SEQ ID NO: 831788 - RNA, 26 nt, Human
ucugaaaccuuauccagacucaguga

SEQ ID NO: 831789 - RNA, 20 nt, Human
ucuguggugcuccugguggg

SEQ ID NO: 831790 - RNA, 20 nt, Human
ucuguucucaggggugggug

SEQ ID NO: 831791 - RNA, 24 nt, Human
ucuuaggcugcaccugugccuacc

SEQ ID NO: 831792 - RNA, 22 nt, Human
ucuucugguccaauaugucacc

SEQ ID NO: 831793 - RNA, 18 nt, Human
ucuuuggaagggagagga

SEQ ID NO: 831794 - RNA, 19 nt, Human
ugaaaacauaaaucauggu

SEQ ID NO: 831795 - RNA, 21 nt, Human
ugacccuggguagggcuuggu

SEQ ID NO: 831796 - RNA, 22 nt, Human
ugagaagaccuggcccaagcac

SEQ ID NO: 831797 - RNA, 23 nt, Human
ugagaagaccuggcccaagcacc

SEQ ID NO: 831798 - RNA, 18 nt, Human
ugaguggugccugcucuu

SEQ ID NO: 831799 - RNA, 18 nt, Human
ugaguggugccugcucuu

SEQ ID NO: 831800 - RNA, 20 nt, Human
ugaucaggagcaaaaaucaa

SEQ ID NO: 831801 - RNA, 21 nt, Human
ugcuauguuucuuacauauaa

SEQ ID NO: 831802 - RNA, 19 nt, Human
uggaagggagaggaagcag

SEQ ID NO: 831803 - RNA, 22 nt, Human
uggaauccugagcuuggcacac

SEQ ID NO: 831804 - RNA, 23 nt, Human
uggaauccugagcuuggcacacu

SEQ ID NO: 831805 - RNA, 18 nt, Human
uggcacacucaccuaggc

SEQ ID NO: 831806 - RNA, 20 nt, Human
ugggcccugguugcuccugu

SEQ ID NO: 831807 - RNA, 18 nt, Human
ugggugacccuggguagg

SEQ ID NO: 831808 - RNA, 19 nt, Human
ugucuuagagucuccuucc

SEQ ID NO: 831809 - RNA, 23 nt, Human
ugucuuagagucuccuuccaaaa

SEQ ID NO: 831810 - RNA, 18 nt, Human
ugucuuuggaagggagag

SEQ ID NO: 831811 - RNA, 23 nt, Human
ugugucugaccucuguucucagg

SEQ ID NO: 831812 - RNA, 21 nt, Human
uguguguguuuuccccuuuuu

SEQ ID NO: 831813 - RNA, 23 nt, Human
uguguguguuuuccccuuuuuuu

SEQ ID NO: 831814 - RNA, 18 nt, Human
uuccagacaaaagcaaca

SEQ ID NO: 831815 - RNA, 23 nt, Human
uucccugucuuagagucuccuuc

SEQ ID NO: 831816 - RNA, 21 nt, Human
uucccuucuuaggcugcaccu

SEQ ID NO: 831817 - RNA, 21 nt, Human
uucugaguggugccugcucuu

SEQ ID NO: 831818 - RNA, 24 nt, Human
uuggccacuuaccacaugguugcc

SEQ ID NO: 831819 - RNA, 20 nt, Human
uugggcccugguugcuccug

SEQ ID NO: 831820 - RNA, 21 nt, Human
uuuuuuuuccguguguguguu

SEQ ID NO: 831821 - RNA, 25 nt, Human
uuuuuuuuuuuuuuuuuuucugggg

SEQ ID NO: 831822 - RNA, 23 nt, Human
accauaaagaacacaaguuucgu

SEQ ID NO: 831823 - RNA, 18 nt, Human
auuacugccagguugcuc

SEQ ID NO: 831824 - RNA, 22 nt, Human
caccauaaagaacacaaguuuc

SEQ ID NO: 831825 - RNA, 24 nt, Human
cugccagguugcucugguuuugua

SEQ ID NO: 831826 - RNA, 20 nt, Human
gaucaaacuuuuccccuucu

SEQ ID NO: 831827 - RNA, 19 nt, Human
ggcuuaauaaauuuuuuaa

SEQ ID NO: 831828 - RNA, 21 nt, Human
uccgaucaaacuuuuccccuu

SEQ ID NO: 831829 - RNA, 24 nt, Human
ucuucacugcaguggauuuccgau

SEQ ID NO: 831830 - RNA, 19 nt, Human
ugcucugguuuuguacaug

SEQ ID NO: 831831 - RNA, 24 nt, Human
aaaagccaaaugaauuacuguaau

SEQ ID NO: 831832 - RNA, 18 nt, Human
aaagaagauacacuaaaa

SEQ ID NO: 831833 - RNA, 20 nt, Human
aaagugcugggauuacaggc

SEQ ID NO: 831834 - RNA, 22 nt, Human
aaagugcugggauuacaggcgu

SEQ ID NO: 831835 - RNA, 24 nt, Human
aaagugcugggauuacaggcguga

SEQ ID NO: 831836 - RNA, 19 nt, Human
aagugcugggauuacaggc

SEQ ID NO: 831837 - RNA, 19 nt, Human
aagugcugggauuacaggc

SEQ ID NO: 831838 - RNA, 26 nt, Human
aagugcugggauuacaggcgugagcc

SEQ ID NO: 831839 - RNA, 20 nt, Human
aauuucugugaucuugaagg

SEQ ID NO: 831840 - RNA, 20 nt, Human
acaaagaagauacacuaaaa

SEQ ID NO: 831841 - RNA, 24 nt, Human
acaggauuucaccauguuggccag

SEQ ID NO: 831842 - RNA, 24 nt, Human
accauguuggccaggcuggucucg

SEQ ID NO: 831843 - RNA, 25 nt, Human
acccgccuuggccuccuaaagugcu

SEQ ID NO: 831844 - RNA, 18 nt, Human
agccucccgaguagcugg

SEQ ID NO: 831845 - RNA, 23 nt, Human
aggauuucaccauguuggccagg

SEQ ID NO: 831846 - RNA, 18 nt, Human
aggcauucuggcaccacc

SEQ ID NO: 831847 - RNA, 24 nt, Human
aggugauccacccgccuuggccuc

SEQ ID NO: 831848 - RNA, 21 nt, Human
agguucaagugauucuccugc

SEQ ID NO: 831849 - RNA, 22 nt, Human
agguucaagugauucuccugcc

SEQ ID NO: 831850 - RNA, 18 nt, Human
aguagcugggauuacagg

SEQ ID NO: 831851 - RNA, 19 nt, Human
auuacaucacagcaagcaa

SEQ ID NO: 831852 - RNA, 24 nt, Human
auuuuuguguuuuuaguggagaca

SEQ ID NO: 831853 - RNA, 21 nt, Human
caaagaagauacacuaaaagc

SEQ ID NO: 831854 - RNA, 24 nt, Human
caaagaagauacacuaaaagccaa

SEQ ID NO: 831855 - RNA, 22 nt, Human
caagcaacuguuuaauugggac

SEQ ID NO: 831856 - RNA, 20 nt, Human
caagugauucuccugccuua

SEQ ID NO: 831857 - RNA, 22 nt, Human
caagugauucuccugccuuagc

SEQ ID NO: 831858 - RNA, 21 nt, Human
caccauguuggccaggcuggu

SEQ ID NO: 831859 - RNA, 24 nt, Human
caccauguuggccaggcuggucuc

SEQ ID NO: 831860 - RNA, 27 nt, Human
caccauguuggccaggcuggucucgaa

SEQ ID NO: 831861 - RNA, 18 nt, Human
cacccacuaccacgccug

SEQ ID NO: 831862 - RNA, 25 nt, Human
cacccaggcuggagggcaauggagc

SEQ ID NO: 831863 - RNA, 24 nt, Human
cacccgccuuggccuccuaaagug

SEQ ID NO: 831864 - RNA, 24 nt, Human
caggauuucaccauguuggccagg

SEQ ID NO: 831865 - RNA, 24 nt, Human
cauguuggccaggcuggucucgaa

SEQ ID NO: 831866 - RNA, 23 nt, Human
cccagguucaagugauucuccuc

SEQ ID NO: 831867 - RNA, 23 nt, Human
cccagguucaagugauucuccug

SEQ ID NO: 831868 - RNA, 23 nt, Human
cccgaguagcugggauuacaggc

SEQ ID NO: 831869 - RNA, 24 nt, Human
cccgaguagcugggauuacaggca

SEQ ID NO: 831870 - RNA, 23 nt, Human
ccgaguagcugggauuacaggca

SEQ ID NO: 831871 - RNA, 23 nt, Human
ccuaaagugcugggauuacaggc

SEQ ID NO: 831872 - RNA, 24 nt, Human
ccucccagguucaagugauucucc

SEQ ID NO: 831873 - RNA, 22 nt, Human
ccugaccucaggugauccaccc

SEQ ID NO: 831874 - RNA, 23 nt, Human
ccugaccucaggugauccacccg

SEQ ID NO: 831875 - RNA, 23 nt, Human
ccugccuuagccucccgaguagc

SEQ ID NO: 831876 - RNA, 24 nt, Human
ccugccuuagccucccgaguagcu

SEQ ID NO: 831877 - RNA, 22 nt, Human
cuaaagugcugggauuacaggc

SEQ ID NO: 831878 - RNA, 24 nt, Human
cuaaagugcugggauuacaggcgu

SEQ ID NO: 831879 - RNA, 23 nt, Human
cucacugcaaccucccccuccca

SEQ ID NO: 831880 - RNA, 24 nt, Human
cucacugcaaccucccccucccag

SEQ ID NO: 831881 - RNA, 24 nt, Human
cucaggugauccacccgccuuggc

SEQ ID NO: 831882 - RNA, 18 nt, Human
cucccagguucaagugau

SEQ ID NO: 831883 - RNA, 20 nt, Human
cucuugucacccaggcugga

SEQ ID NO: 831884 - RNA, 23 nt, Human
cugcaaccucccccucccagguu

SEQ ID NO: 831885 - RNA, 24 nt, Human
cugcaaccucccccucccagguuc

SEQ ID NO: 831886 - RNA, 24 nt, Human
cuuagccucccgaguagcugggau

SEQ ID NO: 831887 - RNA, 20 nt, Human
cuuuuuuuuccuuuuuauuu

SEQ ID NO: 831888 - RNA, 24 nt, Human
gaccucaggugauccacccgccuu

SEQ ID NO: 831889 - RNA, 25 nt, Human
gaguagcugggauuacaggcaccca

SEQ ID NO: 831890 - RNA, 18 nt, Human
gauuacaggcgugagcca

SEQ ID NO: 831891 - RNA, 21 nt, Human
gauuacaggcgugagccacua

SEQ ID NO: 831892 - RNA, 24 nt, Human
gauuacaggcgugagccacuaugc

SEQ ID NO: 831893 - RNA, 22 nt, Human
gcaaccucccccucccagguuc

SEQ ID NO: 831894 - RNA, 22 nt, Human
gccuuggccuccuaaagugcug

SEQ ID NO: 831895 - RNA, 24 nt, Human
gcucacugcaaccucccccuccca

SEQ ID NO: 831896 - RNA, 20 nt, Human
gcucuugucacccaggcugg

SEQ ID NO: 831897 - RNA, 21 nt, Human
gcucuugucacccaggcugga

SEQ ID NO: 831898 - RNA, 23 nt, Human
gcuggucucgaacuccugaccuc

SEQ ID NO: 831899 - RNA, 23 nt, Human
ggcacauccacugcaguccaggc

SEQ ID NO: 831900 - RNA, 24 nt, Human
ggcuggucucgaacuccugaccuc

SEQ ID NO: 831901 - RNA, 20 nt, Human
gggcaauggagcgaucuugg

SEQ ID NO: 831902 - RNA, 19 nt, Human
ggucucgaacuccugaccu

SEQ ID NO: 831903 - RNA, 24 nt, Human
gugauccacccgccuuggccuccu

SEQ ID NO: 831904 - RNA, 24 nt, Human
gugauucuccugccuuagccuccc

SEQ ID NO: 831905 - RNA, 24 nt, Human
guuuauugacuuuuuuuuccuuuu

SEQ ID NO: 831906 - RNA, 24 nt, Human
uaaagugcugggauuacaggcgug

SEQ ID NO: 831907 - RNA, 24 nt, Human
uaauuuuuguguuuuuaguggaga

SEQ ID NO: 831908 - RNA, 22 nt, Human
uacaggcgugagccacuaugcc

SEQ ID NO: 831909 - RNA, 23 nt, Human
uacaggcgugagccacuaugccu

SEQ ID NO: 831910 - RNA, 24 nt, Human
uaguggagacaggauuucaccaug

SEQ ID NO: 831911 - RNA, 20 nt, Human
uauuuauuugagauggaguu

SEQ ID NO: 831912 - RNA, 19 nt, Human
ucaagugauucuccugccu

SEQ ID NO: 831913 - RNA, 18 nt, Human
ucacugcaaccucccccc

SEQ ID NO: 831914 - RNA, 18 nt, Human
ucacugcaaccucccccu

SEQ ID NO: 831915 - RNA, 24 nt, Human
ucacugcaaccucccccucccagg

SEQ ID NO: 831916 - RNA, 19 nt, Human
ucccagguucaagugauuc

SEQ ID NO: 831917 - RNA, 21 nt, Human
ucccagguucaagugauucuc

SEQ ID NO: 831918 - RNA, 24 nt, Human
ucccagguucaagugauucuccug

SEQ ID NO: 831919 - RNA, 24 nt, Human
ucccgaguagcugggauuacaggc

SEQ ID NO: 831920 - RNA, 24 nt, Human
uccuaaagugcugggauuacaggc

SEQ ID NO: 831921 - RNA, 24 nt, Human
ucuccugccuuagccucccgagua

SEQ ID NO: 831922 - RNA, 23 nt, Human
ucucgaacuccugaccucaggug

SEQ ID NO: 831923 - RNA, 19 nt, Human
ugaaggucuuguugaaguu

SEQ ID NO: 831924 - RNA, 21 nt, Human
ugaccucaggugauccacccg

SEQ ID NO: 831925 - RNA, 24 nt, Human
ugaccucaggugauccacccgccu

SEQ ID NO: 831926 - RNA, 20 nt, Human
ugauucuccugccuuagccu

SEQ ID NO: 831927 - RNA, 20 nt, Human
ugcagggguugagggaucgc

SEQ ID NO: 831928 - RNA, 23 nt, Human
ugcaguccaggcauucuggcacc

SEQ ID NO: 831929 - RNA, 22 nt, Human
ugccuggcuauugacauuuuuu

SEQ ID NO: 831930 - RNA, 24 nt, Human
ugccuuagccucccgaguagcugg

SEQ ID NO: 831931 - RNA, 24 nt, Human
ugcugggauuacaggcgugagcca

SEQ ID NO: 831932 - RNA, 22 nt, Human
uggagacaggauuucaccaugu

SEQ ID NO: 831933 - RNA, 20 nt, Human
uggaguuuugcucuugucac

SEQ ID NO: 831934 - RNA, 24 nt, Human
uggccaggcuggucucgaacuccu

SEQ ID NO: 831935 - RNA, 19 nt, Human
ugggauuacaggcacccac

SEQ ID NO: 831936 - RNA, 19 nt, Human
ugggauuacaggcacccac

SEQ ID NO: 831937 - RNA, 20 nt, Human
ugggauuacaggcacccacu

SEQ ID NO: 831938 - RNA, 21 nt, Human
ugggauuacaggcacccacua

SEQ ID NO: 831939 - RNA, 24 nt, Human
ugggauuacaggcacccacuacca

SEQ ID NO: 831940 - RNA, 18 nt, Human
ugggauuacaggcgugag

SEQ ID NO: 831941 - RNA, 21 nt, Human
ugggauuacaggcgugagcca

SEQ ID NO: 831942 - RNA, 22 nt, Human
ugggauuacaggcgugagccac

SEQ ID NO: 831943 - RNA, 22 nt, Human
ugggauuacaggcgugagccac

SEQ ID NO: 831944 - RNA, 22 nt, Human
ugggauuacaggcgugagccac

SEQ ID NO: 831945 - RNA, 23 nt, Human
ugggauuacaggcgugagccacu

SEQ ID NO: 831946 - RNA, 23 nt, Human
ugggauuacaggcgugagccacu

SEQ ID NO: 831947 - RNA, 24 nt, Human
ugggauuacaggcgugagccacua

SEQ ID NO: 831948 - RNA, 26 nt, Human
uuacaggcacccacuaccacgccuga

SEQ ID NO: 831949 - RNA, 24 nt, Human
uuaguggagacaggauuucaccau

SEQ ID NO: 831950 - RNA, 23 nt, Human
uuauugacuuuuuuuuccuuuuu

SEQ ID NO: 831951 - RNA, 23 nt, Human
uucaagugauucuccugccuuag

SEQ ID NO: 831952 - RNA, 24 nt, Human
uucaagugauucuccugccuuagc

SEQ ID NO: 831953 - RNA, 20 nt, Human
uuccuuuuuauuuauuugag

SEQ ID NO: 831954 - RNA, 18 nt, Human
uugaaggucuuguugaag

SEQ ID NO: 831955 - RNA, 22 nt, Human
uugcucuugucacccaggcugg

SEQ ID NO: 831956 - RNA, 23 nt, Human
uugcucuugucacccaggcugga

SEQ ID NO: 831957 - RNA, 19 nt, Human
uugggacaaagaagauaca

SEQ ID NO: 831958 - RNA, 21 nt, Human
uuguacaguuuauugacuuuu

SEQ ID NO: 831959 - RNA, 19 nt, Human
uuuaaaaauuucugugauc

SEQ ID NO: 831960 - RNA, 24 nt, Human
uuucaccauguuggccaggcuggu

SEQ ID NO: 831961 - RNA, 24 nt, Human
uuugcucuugucacccaggcugga

SEQ ID NO: 831962 - RNA, 20 nt, Human
uuuuaagcaaagaggugggg

SEQ ID NO: 831963 - RNA, 24 nt, Human
uuuugcucuugucacccaggcugg

SEQ ID NO: 831964 - RNA, 20 nt, Human
uuuuuguguuuuuaguggag

SEQ ID NO: 831965 - RNA, 23 nt, Human
aaaaaaaaaaaaagaauacagga

SEQ ID NO: 831966 - RNA, 21 nt, Human
aaaaaaaaaaagaauacagga

SEQ ID NO: 831967 - RNA, 19 nt, Human
aacacagugagaccccccu

SEQ ID NO: 831968 - RNA, 20 nt, Human
aacacagugagaccccccuc

SEQ ID NO: 831969 - RNA, 23 nt, Human
acggagcaagacccugucuaaaa

SEQ ID NO: 831970 - RNA, 18 nt, Human
acugcacuccaaccuggg

SEQ ID NO: 831971 - RNA, 22 nt, Human
acugcacuccaaccugggcaac

SEQ ID NO: 831972 - RNA, 21 nt, Human
agaaaaauaaauaucugaaga

SEQ ID NO: 831973 - RNA, 24 nt, Human
agcacuuugggaggcggaggcagg

SEQ ID NO: 831974 - RNA, 20 nt, Human
agccaggugugguggugcac

SEQ ID NO: 831975 - RNA, 22 nt, Human
agccugggcaacacagugagac

SEQ ID NO: 831976 - RNA, 24 nt, Human
agccugggcaacacagugagaccc

SEQ ID NO: 831977 - RNA, 24 nt, Human
agcuacuugagaggcugagguggg

SEQ ID NO: 831978 - RNA, 24 nt, Human
aggagucggagguuacagugagcc

SEQ ID NO: 831979 - RNA, 20 nt, Human
aggaguggggugggguagug

SEQ ID NO: 831980 - RNA, 21 nt, Human
aggaguggggugggguagugg

SEQ ID NO: 831981 - RNA, 24 nt, Human
aggaguggggugggguaguggggc

SEQ ID NO: 831982 - RNA, 27 nt, Human
aggaguggggugggguaguggggcugg

SEQ ID NO: 831983 - RNA, 23 nt, Human
aggaguucgagaccagccugggc

SEQ ID NO: 831984 - RNA, 24 nt, Human
aggcugaggugggagggucacuug

SEQ ID NO: 831985 - RNA, 22 nt, Human
aggcuggggucaccgccccauu

SEQ ID NO: 831986 - RNA, 23 nt, Human
aggugggagggucacuugaaccc

SEQ ID NO: 831987 - RNA, 24 nt, Human
aguggcucaugccugcaaucccag

SEQ ID NO: 831988 - RNA, 23 nt, Human
aucugaagaauaagaauacaggg

SEQ ID NO: 831989 - RNA, 19 nt, Human
augccugcaaucccagcac

SEQ ID NO: 831990 - RNA, 20 nt, Human
caccuguagucccagcuacu

SEQ ID NO: 831991 - RNA, 22 nt, Human
caccuguagucccagcuacuug

SEQ ID NO: 831992 - RNA, 23 nt, Human
cacuccaaccugggcaacggagc

SEQ ID NO: 831993 - RNA, 23 nt, Human
cacugcacuccaaccugggcaac

SEQ ID NO: 831994 - RNA, 24 nt, Human
cacugcacuccaaccugggcaacg

SEQ ID NO: 831995 - RNA, 26 nt, Human
cacugcacuccaaccugggcaacgga

SEQ ID NO: 831996 - RNA, 18 nt, Human
cagcacuuugggaggcgg

SEQ ID NO: 831997 - RNA, 24 nt, Human
cagcacuuugggaggcggaggcag

SEQ ID NO: 831998 - RNA, 24 nt, Human
cagcuacuugagaggcugaggugg

SEQ ID NO: 831999 - RNA, 23 nt, Human
caggugugguggugcaccuguag

SEQ ID NO: 832000 - RNA, 19 nt, Human
cagugagaccccccucuuu

SEQ ID NO: 832001 - RNA, 20 nt, Human
caugccugcaaucccagcac

SEQ ID NO: 832002 - RNA, 24 nt, Human
caugccugcaaucccagcacuuug

SEQ ID NO: 832003 - RNA, 23 nt, Human
ccacugcacuccaaccugggcaa

SEQ ID NO: 832004 - RNA, 24 nt, Human
ccacugcacuccaaccugggcaac

SEQ ID NO: 832005 - RNA, 25 nt, Human
ccaggaguucgagaccagccugggc

SEQ ID NO: 832006 - RNA, 19 nt, Human
ccgccccauuggggccucu

SEQ ID NO: 832007 - RNA, 23 nt, Human
ccgcuugagcccaggaguucgag

SEQ ID NO: 832008 - RNA, 22 nt, Human
ccugccccguccccacugggag

SEQ ID NO: 832009 - RNA, 22 nt, Human
ccuguagucccagcuacuugag

SEQ ID NO: 832010 - RNA, 26 nt, Human
ccugucuaaaaaaaaaaaaaaaagaa

SEQ ID NO: 832011 - RNA, 18 nt, Human
ccuuagccuggaucccag

SEQ ID NO: 832012 - RNA, 23 nt, Human
cgcugcgucagcggaacccgcgc

SEQ ID NO: 832013 - RNA, 24 nt, Human
cucaugccugcaaucccagcacuu

SEQ ID NO: 832014 - RNA, 18 nt, Human
cugcagcugugcucuucc

SEQ ID NO: 832015 - RNA, 21 nt, Human
cugcgccccgggcucugucgg

SEQ ID NO: 832016 - RNA, 25 nt, Human
cugucuaaaaaaaaaaaaaaaagaa

SEQ ID NO: 832017 - RNA, 20 nt, Human
cuuuacaaaaaauacaaaaa

SEQ ID NO: 832018 - RNA, 20 nt, Human
gagcaagacccugucuaaaa

SEQ ID NO: 832019 - RNA, 28 nt, Human
gagcaagacccugucuaaaaaaaaaaaa

SEQ ID NO: 832020 - RNA, 24 nt, Human
gccacugcacuccaaccugggcaa

SEQ ID NO: 832021 - RNA, 22 nt, Human
gcccaggaguucgagaccagcc

SEQ ID NO: 832022 - RNA, 22 nt, Human
gccuggaucccaggccggaccc

SEQ ID NO: 832023 - RNA, 20 nt, Human
ggagguuacagugagcccug

SEQ ID NO: 832024 - RNA, 24 nt, Human
ggagguuacagugagcccugaugg

SEQ ID NO: 832025 - RNA, 24 nt, Human
ggccacugcacuccaaccugggca

SEQ ID NO: 832026 - RNA, 19 nt, Human
ggcugggugcaguggcuca

SEQ ID NO: 832027 - RNA, 23 nt, Human
ggcugggugcaguggcucaugcc

SEQ ID NO: 832028 - RNA, 18 nt, Human
ggggugggguaguggggc

SEQ ID NO: 832029 - RNA, 20 nt, Human
ggggugggguaguggggcug

SEQ ID NO: 832030 - RNA, 19 nt, Human
ggguaguggggcuggagac

SEQ ID NO: 832031 - RNA, 21 nt, Human
gggugggguaguggggcugga

SEQ ID NO: 832032 - RNA, 22 nt, Human
gggugggguaguggggcuggag

SEQ ID NO: 832033 - RNA, 23 nt, Human
ggugcaguggcucaugccugcaa

SEQ ID NO: 832034 - RNA, 24 nt, Human
gguggaccgcuugagcccaggagu

SEQ ID NO: 832035 - RNA, 22 nt, Human
guggcuccugggcccuggugaa

SEQ ID NO: 832036 - RNA, 24 nt, Human
gugguggugcaccuguagucccag

SEQ ID NO: 832037 - RNA, 20 nt, Human
gugugggcuggggcccaggc

SEQ ID NO: 832038 - RNA, 18 nt, Human
uacaggaguggggugggg

SEQ ID NO: 832039 - RNA, 26 nt, Human
uacagggcugggugcaguggcucaug

SEQ ID NO: 832040 - RNA, 24 nt, Human
uagccuggaucccaggccggaccc

SEQ ID NO: 832041 - RNA, 26 nt, Human
uaucugaagaauaagaauacagggcu

SEQ ID NO: 832042 - RNA, 22 nt, Human
ucaugccugcaaucccagcacu

SEQ ID NO: 832043 - RNA, 23 nt, Human
ucuaaaaaaaaaaaaaaaagaau

SEQ ID NO: 832044 - RNA, 23 nt, Human
ugaaaagaaaaauaaauaucuga

SEQ ID NO: 832045 - RNA, 22 nt, Human
ugaagaauaagaauacagggcu

SEQ ID NO: 832046 - RNA, 20 nt, Human
ugagaccccccucuuuacaa

SEQ ID NO: 832047 - RNA, 19 nt, Human
ugagaggcugaggugggag

SEQ ID NO: 832048 - RNA, 24 nt, Human
ugagaggcugaggugggaggguca

SEQ ID NO: 832049 - RNA, 23 nt, Human
ugagcccaggaguucgagaccag

SEQ ID NO: 832050 - RNA, 18 nt, Human
ugaggugggagggucacu

SEQ ID NO: 832051 - RNA, 24 nt, Human
ugcaccuguagucccagcuacuug

SEQ ID NO: 832052 - RNA, 23 nt, Human
ugccugcaaucccagcacuuugg

SEQ ID NO: 832053 - RNA, 24 nt, Human
ugccugcaaucccagcacuuuggg

SEQ ID NO: 832054 - RNA, 24 nt, Human
uggaccgcuugagcccaggaguuc

SEQ ID NO: 832055 - RNA, 21 nt, Human
uggagacuugagguguccugg

SEQ ID NO: 832056 - RNA, 20 nt, Human
uggaucccaggccggacccc

SEQ ID NO: 832057 - RNA, 19 nt, Human
uggcgcccgccugcgcccc

SEQ ID NO: 832058 - RNA, 22 nt, Human
uggcucaugccugcaaucccag

SEQ ID NO: 832059 - RNA, 24 nt, Human
uggcucaugccugcaaucccagca

SEQ ID NO: 832060 - RNA, 20 nt, Human
ugggaucugcagcugugcuc

SEQ ID NO: 832061 - RNA, 24 nt, Human
ugggcaacggagcaagacccuguc

SEQ ID NO: 832062 - RNA, 20 nt, Human
ugggcuggggcccaggcugg

SEQ ID NO: 832063 - RNA, 18 nt, Human
ugggggcgccagaggccu

SEQ ID NO: 832064 - RNA, 19 nt, Human
ugggguaguggggcuggag

SEQ ID NO: 832065 - RNA, 19 nt, Human
uggggugggguaguggggc

SEQ ID NO: 832066 - RNA, 21 nt, Human
uggggugggguaguggggcug

SEQ ID NO: 832067 - RNA, 22 nt, Human
ugguggugcaccuguaguccca

SEQ ID NO: 832068 - RNA, 23 nt, Human
ugguggugcaccuguagucccag

SEQ ID NO: 832069 - RNA, 21 nt, Human
ugugggcuggggcccaggcug

SEQ ID NO: 832070 - RNA, 21 nt, Human
uuagccaggugugguggugca

SEQ ID NO: 832071 - RNA, 25 nt, Human
uugagaggcugaggugggaggguca

SEQ ID NO: 832072 - RNA, 22 nt, Human
uugagcccaggaguucgagacc

SEQ ID NO: 832073 - RNA, 23 nt, Human
aaaagugcaaauuauacccagaa

SEQ ID NO: 832074 - RNA, 18 nt, Human
aaaauaagaggaggagga

SEQ ID NO: 832075 - RNA, 24 nt, Human
aaacagcaaccugauacgaaaaau

SEQ ID NO: 832076 - RNA, 19 nt, Human
aaaccuaaaaggaaaagcc

SEQ ID NO: 832077 - RNA, 22 nt, Human
aaauaacuuuguacauaaaagu

SEQ ID NO: 832078 - RNA, 19 nt, Human
aaauagccucuguaaaaga

SEQ ID NO: 832079 - RNA, 23 nt, Human
aaaugaaccuuuauuaaagacac

SEQ ID NO: 832080 - RNA, 22 nt, Human
aacuauuuccccacccccucca

SEQ ID NO: 832081 - RNA, 23 nt, Human
aacuuccuccuuucuguccccca

SEQ ID NO: 832082 - RNA, 20 nt, Human
aagcagcaaauucacauauu

SEQ ID NO: 832083 - RNA, 23 nt, Human
aaggccuuccauccuucccaccc

SEQ ID NO: 832084 - RNA, 21 nt, Human
acagguaccaacaccagcagc

SEQ ID NO: 832085 - RNA, 18 nt, Human
acccagaacccaggucaa

SEQ ID NO: 832086 - RNA, 21 nt, Human
accccgcgcccauccgggccg

SEQ ID NO: 832087 - RNA, 21 nt, Human
accugaagcuccuuccggcgc

SEQ ID NO: 832088 - RNA, 21 nt, Human
accuuuugcuugugauggauu

SEQ ID NO: 832089 - RNA, 22 nt, Human
agacagggaagccuguugcagg

SEQ ID NO: 832090 - RNA, 21 nt, Human
agcucggugccggcaggcagc

SEQ ID NO: 832091 - RNA, 21 nt, Human
aggaauggcauggacaggccc

SEQ ID NO: 832092 - RNA, 18 nt, Human
auacuccacaugggaguu

SEQ ID NO: 832093 - RNA, 21 nt, Human
auccacagguaccaacaccag

SEQ ID NO: 832094 - RNA, 23 nt, Human
augcacuaaagauuaaaauagcc

SEQ ID NO: 832095 - RNA, 24 nt, Human
auuaaacagcaaccugauacgaaa

SEQ ID NO: 832096 - RNA, 23 nt, Human
caauguacacuguaccaaaauuu

SEQ ID NO: 832097 - RNA, 22 nt, Human
caccaaaaacuccugugaacaa

SEQ ID NO: 832098 - RNA, 24 nt, Human
caccaaaaacuccugugaacaaag

SEQ ID NO: 832099 - RNA, 24 nt, Human
caccagcagccuuuaccuuaauuu

SEQ ID NO: 832100 - RNA, 24 nt, Human
caccccuggcucuacagacaggga

SEQ ID NO: 832101 - RNA, 27 nt, Human
caccccuggcucuacagacagggaagc

SEQ ID NO: 832102 - RNA, 22 nt, Human
caccgcacagcagccuaggggu

SEQ ID NO: 832103 - RNA, 25 nt, Human
cacgccgagugccgcuaccgacacc

SEQ ID NO: 832104 - RNA, 18 nt, Human
cagaacccaggucaaggg

SEQ ID NO: 832105 - RNA, 22 nt, Human
cagaacccaggucaagggcugu

SEQ ID NO: 832106 - RNA, 24 nt, Human
cagaacccaggucaagggcugucc

SEQ ID NO: 832107 - RNA, 23 nt, Human
cagaacuauuuccccacccccuc

SEQ ID NO: 832108 - RNA, 24 nt, Human
cagcaaauucacauauuuugugga

SEQ ID NO: 832109 - RNA, 19 nt, Human
cagguaccaacaccagcag

SEQ ID NO: 832110 - RNA, 19 nt, Human
cauccuucccaccccgcac

SEQ ID NO: 832111 - RNA, 21 nt, Human
ccaacaccagcagccuuuacc

SEQ ID NO: 832112 - RNA, 22 nt, Human
ccagccugcgcucuucguccgc

SEQ ID NO: 832113 - RNA, 20 nt, Human
cccaccccgcaccaaaaacu

SEQ ID NO: 832114 - RNA, 22 nt, Human
cccaccccgcaccaaaaacucc

SEQ ID NO: 832115 - RNA, 20 nt, Human
ccccacccccuccaaaauua

SEQ ID NO: 832116 - RNA, 22 nt, Human
cccccaaggccaauguaauacu

SEQ ID NO: 832117 - RNA, 26 nt, Human
ccccgcaccaaaaacuccugugaaca

SEQ ID NO: 832118 - RNA, 19 nt, Human
ccccgcgcugggaggcccc

SEQ ID NO: 832119 - RNA, 21 nt, Human
cccgcaccaaaaacuccugug

SEQ ID NO: 832120 - RNA, 22 nt, Human
cccggcgggggccgcaaacccc

SEQ ID NO: 832121 - RNA, 20 nt, Human
cccggggcacgccgagugcc

SEQ ID NO: 832122 - RNA, 19 nt, Human
cccuccaaaauuaaacagc

SEQ ID NO: 832123 - RNA, 18 nt, Human
ccgcccggggcacgccga

SEQ ID NO: 832124 - RNA, 18 nt, Human
ccggagcacccggcgggg

SEQ ID NO: 832125 - RNA, 20 nt, Human
ccggccgagggcagugcugc

SEQ ID NO: 832126 - RNA, 21 nt, Human
ccuccaaaauuaaacagcaac

SEQ ID NO: 832127 - RNA, 25 nt, Human
ccucgcuguccccacgccgcggcca

SEQ ID NO: 832128 - RNA, 22 nt, Human
ccucuauaaauuccagccaugc

SEQ ID NO: 832129 - RNA, 23 nt, Human
ccucucagaagcagcaaauucac

SEQ ID NO: 832130 - RNA, 21 nt, Human
ccucuccuaccucucuuuccc

SEQ ID NO: 832131 - RNA, 19 nt, Human
ccuguugcaggggcaucca

SEQ ID NO: 832132 - RNA, 22 nt, Human
ccuuccggcgcauguggagucc

SEQ ID NO: 832133 - RNA, 18 nt, Human
cgagcucggugccggcag

SEQ ID NO: 832134 - RNA, 19 nt, Human
cggccgcagacgcgggcgg

SEQ ID NO: 832135 - RNA, 23 nt, Human
cuccgcaccggggcauggccccc

SEQ ID NO: 832136 - RNA, 19 nt, Human
cuccugugaacaaaugugg

SEQ ID NO: 832137 - RNA, 22 nt, Human
cucucugcggccgcggcuccga

SEQ ID NO: 832138 - RNA, 22 nt, Human
cucuugcguuuacugugcuuca

SEQ ID NO: 832139 - RNA, 18 nt, Human
cugucaagaacaaaauuc

SEQ ID NO: 832140 - RNA, 27 nt, Human
gaagcagcaaauucacauauuuugugg

SEQ ID NO: 832141 - RNA, 26 nt, Human
gacaggccugcucugggucggacccc

SEQ ID NO: 832142 - RNA, 19 nt, Human
gagggcagugcugccgcug

SEQ ID NO: 832143 - RNA, 20 nt, Human
gcagccuaggggucuaugaa

SEQ ID NO: 832144 - RNA, 18 nt, Human
gcagugcugccgcugcgc

SEQ ID NO: 832145 - RNA, 20 nt, Human
gccccaaguucucucugcgg

SEQ ID NO: 832146 - RNA, 20 nt, Human
gcucuggguccuuaguagaa

SEQ ID NO: 832147 - RNA, 19 nt, Human
gcucuucguccgcccgggg

SEQ ID NO: 832148 - RNA, 19 nt, Human
gcuugaacccaagcuuccu

SEQ ID NO: 832149 - RNA, 27 nt, Human
ggacaggccugcucugggucggacccc

SEQ ID NO: 832150 - RNA, 18 nt, Human
gggcaagguguacccagc

SEQ ID NO: 832151 - RNA, 26 nt, Human
gggcauggcccccgccccaaguucuc

SEQ ID NO: 832152 - RNA, 21 nt, Human
ggucaagggcuguccuuucca

SEQ ID NO: 832153 - RNA, 24 nt, Human
guccugugagcgacugauacucca

SEQ ID NO: 832154 - RNA, 24 nt, Human
gugaacaaaugugguuguagccuc

SEQ ID NO: 832155 - RNA, 20 nt, Human
uaaaaggaaaagccauucac

SEQ ID NO: 832156 - RNA, 18 nt, Human
uaaaagucucaaauagca

SEQ ID NO: 832157 - RNA, 21 nt, Human
uacucccucuuucacauugcc

SEQ ID NO: 832158 - RNA, 21 nt, Human
uaguagaaauaagguagcccu

SEQ ID NO: 832159 - RNA, 23 nt, Human
uaugaaaucucugaaaacucuua

SEQ ID NO: 832160 - RNA, 20 nt, Human
uaugacaagaacugagguag

SEQ ID NO: 832161 - RNA, 24 nt, Human
uccgcaccggggcauggccggggc

SEQ ID NO: 832162 - RNA, 19 nt, Human
uccuuaguagaaauaaggu

SEQ ID NO: 832163 - RNA, 21 nt, Human
ucgcagccucuccuaccucuc

SEQ ID NO: 832164 - RNA, 24 nt, Human
ucggugccggcaggcaucuuccuc

SEQ ID NO: 832165 - RNA, 18 nt, Human
ucucugcggccgcggcuc

SEQ ID NO: 832166 - RNA, 19 nt, Human
ugagugacgcuugaaccca

SEQ ID NO: 832167 - RNA, 19 nt, Human
ugcaaauuauacccagaac

SEQ ID NO: 832168 - RNA, 22 nt, Human
ugccggcaggcaucuuccucug

SEQ ID NO: 832169 - RNA, 19 nt, Human
ugccucucagaagcagcaa

SEQ ID NO: 832170 - RNA, 19 nt, Human
ugcuuaccuuuugaacagu

SEQ ID NO: 832171 - RNA, 24 nt, Human
uggagucccaccgcacagcagccu

SEQ ID NO: 832172 - RNA, 23 nt, Human
uggcacuugcaccccuggcucua

SEQ ID NO: 832173 - RNA, 18 nt, Human
uggcauggacaggccugc

SEQ ID NO: 832174 - RNA, 25 nt, Human
ugggaggccccagugcgccucgcug

SEQ ID NO: 832175 - RNA, 21 nt, Human
ugucuggagcgcgcugcgaac

SEQ ID NO: 832176 - RNA, 21 nt, Human
uucagccccgcagcccgagcu

SEQ ID NO: 832177 - RNA, 23 nt, Human
uucccaccccgcaccaaaaacuc

SEQ ID NO: 832178 - RNA, 23 nt, Human
uuccggcgcauguggagucccac

SEQ ID NO: 832179 - RNA, 22 nt, Human
uuccucugggcucggagcgcaa

SEQ ID NO: 832180 - RNA, 26 nt, Human
uuggccaaaggaacauuugaaggacc

SEQ ID NO: 832181 - RNA, 25 nt, Human
uuuccagucccagcucaguuucauc

SEQ ID NO: 832182 - RNA, 24 nt, Human
aaagugcugggaucacaggcguga

SEQ ID NO: 832183 - RNA, 24 nt, Human
aaagugcugggauuacaggcguga

SEQ ID NO: 832184 - RNA, 24 nt, Human
aagaauuuuccugccucagccucc

SEQ ID NO: 832185 - RNA, 23 nt, Human
aagcauacacaaugaacagaaac

SEQ ID NO: 832186 - RNA, 24 nt, Human
aaguacaugggacuacaggcacgc

SEQ ID NO: 832187 - RNA, 26 nt, Human
aagugauucucgugccucagccucuu

SEQ ID NO: 832188 - RNA, 26 nt, Human
aagugcugggaucacaggcgugagcc

SEQ ID NO: 832189 - RNA, 19 nt, Human
aagugcugggauuacaggc

SEQ ID NO: 832190 - RNA, 19 nt, Human
aagugcugggauuacaggc

SEQ ID NO: 832191 - RNA, 26 nt, Human
aagugcugggauuacaggcgugagcc

SEQ ID NO: 832192 - RNA, 24 nt, Human
aaucacauuuuaguaaaaggcaaa

SEQ ID NO: 832193 - RNA, 21 nt, Human
acaaugaacagaaacaaucac

SEQ ID NO: 832194 - RNA, 20 nt, Human
acacaaugaacagaaacaaa

SEQ ID NO: 832195 - RNA, 18 nt, Human
acaggguuucaccauguu

SEQ ID NO: 832196 - RNA, 21 nt, Human
acaggguuucaccauguuggc

SEQ ID NO: 832197 - RNA, 24 nt, Human
acaggguuucaccauguuggccag

SEQ ID NO: 832198 - RNA, 22 nt, Human
accaggcuggagugcaguggug

SEQ ID NO: 832199 - RNA, 24 nt, Human
accauguuggccaggaugaucuug

SEQ ID NO: 832200 - RNA, 18 nt, Human
accauguuggccaggcug

SEQ ID NO: 832201 - RNA, 19 nt, Human
acccaggcuggagugcagu

SEQ ID NO: 832202 - RNA, 24 nt, Human
accucaugauccgcccgucuuggc

SEQ ID NO: 832203 - RNA, 18 nt, Human
acucugucacccaggcug

SEQ ID NO: 832204 - RNA, 25 nt, Human
acucugucacccaggcuggagugca

SEQ ID NO: 832205 - RNA, 22 nt, Human
aggaaaaaguaauaauaaaugc

SEQ ID NO: 832206 - RNA, 25 nt, Human
aggcuggagugcagugguacgaucu

SEQ ID NO: 832207 - RNA, 25 nt, Human
aggcuggagugcaguggugugaucu

SEQ ID NO: 832208 - RNA, 19 nt, Human
aguagcugggauuacaggc

SEQ ID NO: 832209 - RNA, 19 nt, Human
aguagcugggauuacaggc

SEQ ID NO: 832210 - RNA, 23 nt, Human
aguagcugggauuacaggcgcgu

SEQ ID NO: 832211 - RNA, 24 nt, Human
agugauucucgugccucagccucu

SEQ ID NO: 832212 - RNA, 20 nt, Human
agugcagugguacgaucuug

SEQ ID NO: 832213 - RNA, 23 nt, Human
agugcagugguacgaucuuggcu

SEQ ID NO: 832214 - RNA, 24 nt, Human
agugcagugguacgaucuuggcuc

SEQ ID NO: 832215 - RNA, 19 nt, Human
agugcaguggugugaucuc

SEQ ID NO: 832216 - RNA, 21 nt, Human
agugcaguggugugaucucag

SEQ ID NO: 832217 - RNA, 23 nt, Human
agugcaguggugugaucucagcu

SEQ ID NO: 832218 - RNA, 24 nt, Human
agugcaguggugugaucucagcuc

SEQ ID NO: 832219 - RNA, 18 nt, Human
agugcugggauuacaggc

SEQ ID NO: 832220 - RNA, 24 nt, Human
agugguacgaucuuggcucacugc

SEQ ID NO: 832221 - RNA, 24 nt, Human
aguggugugaucucagcucacugc

SEQ ID NO: 832222 - RNA, 19 nt, Human
auccgcccgucuuggccuc

SEQ ID NO: 832223 - RNA, 21 nt, Human
aucuuuaccuuagcgcaaggg

SEQ ID NO: 832224 - RNA, 22 nt, Human
augggguuucaccauguuggcc

SEQ ID NO: 832225 - RNA, 23 nt, Human
augggguuucaccauguuggcca

SEQ ID NO: 832226 - RNA, 24 nt, Human
augggguuucaccauguuggccag

SEQ ID NO: 832227 - RNA, 19 nt, Human
auuacaggcgcgugccacu

SEQ ID NO: 832228 - RNA, 22 nt, Human
auuuuuguauuuuuaguagaga

SEQ ID NO: 832229 - RNA, 24 nt, Human
auuuuuguauuuuuaguagagaca

SEQ ID NO: 832230 - RNA, 24 nt, Human
auuuuuguauuuuuaguagagaug

SEQ ID NO: 832231 - RNA, 26 nt, Human
caaaccgucucuuuacuuuaugaagc

SEQ ID NO: 832232 - RNA, 26 nt, Human
caaacuccugaccucaugugguccaa

SEQ ID NO: 832233 - RNA, 24 nt, Human
caaagugcugggaucacaggcgug

SEQ ID NO: 832234 - RNA, 24 nt, Human
caaagugcugggauuacaggcgug

SEQ ID NO: 832235 - RNA, 21 nt, Human
caagaauuuuccugccucagc

SEQ ID NO: 832236 - RNA, 26 nt, Human
caagcaauuuuuuaaaaacugacacc

SEQ ID NO: 832237 - RNA, 19 nt, Human
caaggaaagaagguauaau

SEQ ID NO: 832238 - RNA, 22 nt, Human
caagugauucucgugccucagc

SEQ ID NO: 832239 - RNA, 22 nt, Human
cacaaugaacagaaacaaucac

SEQ ID NO: 832240 - RNA, 22 nt, Human
cacaggcgugagccaccacacc

SEQ ID NO: 832241 - RNA, 20 nt, Human
caccaggcuggagugcagug

SEQ ID NO: 832242 - RNA, 24 nt, Human
caccaggcuggagugcaguggugu

SEQ ID NO: 832243 - RNA, 18 nt, Human
caccauguuggccaggau

SEQ ID NO: 832244 - RNA, 22 nt, Human
caccauguuggccaggaugauc

SEQ ID NO: 832245 - RNA, 23 nt, Human
caccauguuggccaggaugaucu

SEQ ID NO: 832246 - RNA, 24 nt, Human
caccauguuggccaggaugaucuu

SEQ ID NO: 832247 - RNA, 21 nt, Human
caccauguuggccaggcugau

SEQ ID NO: 832248 - RNA, 24 nt, Human
caccauguuggccaggcugaucuc

SEQ ID NO: 832249 - RNA, 27 nt, Human
caccauguuggccaggcugaucucaaa

SEQ ID NO: 832250 - RNA, 22 nt, Human
cacccaccuuggccucccaaag

SEQ ID NO: 832251 - RNA, 23 nt, Human
cacccaccuuggccucccaaagu

SEQ ID NO: 832252 - RNA, 23 nt, Human
cacucugucacccaggcuggagu

SEQ ID NO: 832253 - RNA, 24 nt, Human
cacucugucacccaggcuggagug

SEQ ID NO: 832254 - RNA, 21 nt, Human
cacugcaaccucucccucccg

SEQ ID NO: 832255 - RNA, 23 nt, Human
cacugcaaccucucccucccggg

SEQ ID NO: 832256 - RNA, 23 nt, Human
cacugcaacuuccgucuccuggg

SEQ ID NO: 832257 - RNA, 24 nt, Human
cacugcguccggcuaauuuuugua

SEQ ID NO: 832258 - RNA, 24 nt, Human
caggguuucaccauguuggccagg

SEQ ID NO: 832259 - RNA, 19 nt, Human
cagugguacgaucuuggcu

SEQ ID NO: 832260 - RNA, 24 nt, Human
cauguuggccaggcugaucucaaa

SEQ ID NO: 832261 - RNA, 22 nt, Human
ccaaagugcugggaucacaggc

SEQ ID NO: 832262 - RNA, 24 nt, Human
ccaaagugcugggaucacaggcgu

SEQ ID NO: 832263 - RNA, 22 nt, Human
ccaaagugcugggauuacaggc

SEQ ID NO: 832264 - RNA, 22 nt, Human
ccaaagugcugggauuacaggc

SEQ ID NO: 832265 - RNA, 24 nt, Human
ccaaagugcugggauuacaggcgu

SEQ ID NO: 832266 - RNA, 19 nt, Human
ccaccgcgcucagccuaca

SEQ ID NO: 832267 - RNA, 24 nt, Human
cccaaguacaugggacuacaggca

SEQ ID NO: 832268 - RNA, 20 nt, Human
cccggguucaagugauucuc

SEQ ID NO: 832269 - RNA, 20 nt, Human
cccggguucaagugauucuc

SEQ ID NO: 832270 - RNA, 22 nt, Human
cccgucuuggccucccaaagug

SEQ ID NO: 832271 - RNA, 21 nt, Human
ccucccggguucaagugauuc

SEQ ID NO: 832272 - RNA, 24 nt, Human
ccugaccucaugugguccacccac

SEQ ID NO: 832273 - RNA, 22 nt, Human
ccuggguucaagaauuuuccug

SEQ ID NO: 832274 - RNA, 22 nt, Human
cgccccaccaugcccagcucau

SEQ ID NO: 832275 - RNA, 22 nt, Human
cuaacaaggaaagaagguauaa

SEQ ID NO: 832276 - RNA, 20 nt, Human
cuacuagaaugauccacugu

SEQ ID NO: 832277 - RNA, 24 nt, Human
cucacucugucacccaggcuggag

SEQ ID NO: 832278 - RNA, 22 nt, Human
cucacugcaaccucucccuccc

SEQ ID NO: 832279 - RNA, 24 nt, Human
cucacugcaaccucucccucccgg

SEQ ID NO: 832280 - RNA, 24 nt, Human
cucacugcaacuuccgucuccugg

SEQ ID NO: 832281 - RNA, 24 nt, Human
cucagccucuugaguagcugggau

SEQ ID NO: 832282 - RNA, 18 nt, Human
cucccucccggguucaag

SEQ ID NO: 832283 - RNA, 18 nt, Human
cuccuggguucaagaauu

SEQ ID NO: 832284 - RNA, 25 nt, Human
cucgugccucagccucuugaguagc

SEQ ID NO: 832285 - RNA, 24 nt, Human
cucuugaccucaugauccgcccgu

SEQ ID NO: 832286 - RNA, 23 nt, Human
cugcaaccucucccucccggguu

SEQ ID NO: 832287 - RNA, 24 nt, Human
cugcaaccucucccucccggguuc

SEQ ID NO: 832288 - RNA, 24 nt, Human
cuggagugcaguggugugaucuca

SEQ ID NO: 832289 - RNA, 23 nt, Human
cuugaguagcugggauuacaggc

SEQ ID NO: 832290 - RNA, 24 nt, Human
cuugaguagcugggauuacaggcg

SEQ ID NO: 832291 - RNA, 20 nt, Human
gaccucaugauccgcccguc

SEQ ID NO: 832292 - RNA, 24 nt, Human
gaccucaugugguccacccaccuu

SEQ ID NO: 832293 - RNA, 24 nt, Human
gacuacaggcacgccccaccaugc

SEQ ID NO: 832294 - RNA, 20 nt, Human
gagaugggguuucaccaugu

SEQ ID NO: 832295 - RNA, 24 nt, Human
gagaugggguuucaccauguuggc

SEQ ID NO: 832296 - RNA, 26 nt, Human
gaguagcugggauuacaggcgcgugc

SEQ ID NO: 832297 - RNA, 18 nt, Human
gaucacaggcgugagcca

SEQ ID NO: 832298 - RNA, 18 nt, Human
gauuacaggcgcgugcca

SEQ ID NO: 832299 - RNA, 22 nt, Human
gauuacaggcgcgugccacugc

SEQ ID NO: 832300 - RNA, 18 nt, Human
gauuacaggcgugagcca

SEQ ID NO: 832301 - RNA, 22 nt, Human
gauuacaggcgugagccaccgc

SEQ ID NO: 832302 - RNA, 22 nt, Human
gauuacaggcgugagccaccgc

SEQ ID NO: 832303 - RNA, 22 nt, Human
gcccagcucauuuuuguauuuu

SEQ ID NO: 832304 - RNA, 21 nt, Human
gcucacugcaaccucucccuc

SEQ ID NO: 832305 - RNA, 23 nt, Human
gcugaucucaaacuccugaccuc

SEQ ID NO: 832306 - RNA, 19 nt, Human
ggaucacaggcgugagcca

SEQ ID NO: 832307 - RNA, 22 nt, Human
ggcuggagugcaguggugugau

SEQ ID NO: 832308 - RNA, 22 nt, Human
gggguuucaccauguuggccag

SEQ ID NO: 832309 - RNA, 22 nt, Human
ggguuucaccauguuggccagg

SEQ ID NO: 832310 - RNA, 20 nt, Human
gguccacccaccuuggccuc

SEQ ID NO: 832311 - RNA, 24 nt, Human
gguggggaagaaauaagaaaagaa

SEQ ID NO: 832312 - RNA, 24 nt, Human
gguuucaccauguuggccaggaug

SEQ ID NO: 832313 - RNA, 23 nt, Human
guagagaugggguuucaccaugu

SEQ ID NO: 832314 - RNA, 18 nt, Human
guccggcgcggcgcgggg

SEQ ID NO: 832315 - RNA, 24 nt, Human
gucuugcucugucaccaggcugga

SEQ ID NO: 832316 - RNA, 22 nt, Human
gucuuggccucccaaagugcug

SEQ ID NO: 832317 - RNA, 24 nt, Human
gugauucucgugccucagccucuu

SEQ ID NO: 832318 - RNA, 22 nt, Human
gugccucagccucuugaguagc

SEQ ID NO: 832319 - RNA, 24 nt, Human
gugguccacccaccuuggccuccc

SEQ ID NO: 832320 - RNA, 20 nt, Human
uaaaucuuuaccuuagcgca

SEQ ID NO: 832321 - RNA, 21 nt, Human
uaaaucuuuaccuuagcgcaa

SEQ ID NO: 832322 - RNA, 24 nt, Human
uaauuuuuguauuuuuaguagaga

SEQ ID NO: 832323 - RNA, 22 nt, Human
uacaggcgugagccaccgcgcu

SEQ ID NO: 832324 - RNA, 22 nt, Human
uagagacaggguuucaccaugu

SEQ ID NO: 832325 - RNA, 22 nt, Human
uagagaugggguuucaccaugu

SEQ ID NO: 832326 - RNA, 21 nt, Human
uagcgcaagggaaaaaaugga

SEQ ID NO: 832327 - RNA, 24 nt, Human
uaguagagacaggguuucaccaug

SEQ ID NO: 832328 - RNA, 25 nt, Human
uaguagagacaggguuucaccaugu

SEQ ID NO: 832329 - RNA, 24 nt, Human
uaguagagaugggguuucaccaug

SEQ ID NO: 832330 - RNA, 26 nt, Human
uaguagagaugggguuucaccauguu

SEQ ID NO: 832331 - RNA, 24 nt, Human
ucacccaggcuggagugcaguggu

SEQ ID NO: 832332 - RNA, 24 nt, Human
ucacucugucacccaggcuggagu

SEQ ID NO: 832333 - RNA, 23 nt, Human
ucacugcaaccucucccucccgg

SEQ ID NO: 832334 - RNA, 24 nt, Human
ucacugcaaccucucccucccggg

SEQ ID NO: 832335 - RNA, 24 nt, Human
ucacugcaacuuccgucuccuggg

SEQ ID NO: 832336 - RNA, 20 nt, Human
ucagccucuugaguagcugg

SEQ ID NO: 832337 - RNA, 23 nt, Human
ucaugugguccacccaccuuggc

SEQ ID NO: 832338 - RNA, 24 nt, Human
ucauuuuuguauuuuuaguagaga

SEQ ID NO: 832339 - RNA, 20 nt, Human
uccacuguaaggcaaaaauu

SEQ ID NO: 832340 - RNA, 24 nt, Human
ucccaaagugcugggaucacaggc

SEQ ID NO: 832341 - RNA, 24 nt, Human
ucccaaagugcugggauuacaggc

SEQ ID NO: 832342 - RNA, 24 nt, Human
ucccaaguacaugggacuacaggc

SEQ ID NO: 832343 - RNA, 19 nt, Human
ucccggguucaagugauuc

SEQ ID NO: 832344 - RNA, 21 nt, Human
ucccggguucaagugauucuc

SEQ ID NO: 832345 - RNA, 24 nt, Human
ucccggguucaagugauucucgug

SEQ ID NO: 832346 - RNA, 21 nt, Human
uccucagacuugguuuuuaaa

SEQ ID NO: 832347 - RNA, 20 nt, Human
uccuggguucaagaauuuuc

SEQ ID NO: 832348 - RNA, 23 nt, Human
uccuggguucaagaauuuuccug

SEQ ID NO: 832349 - RNA, 24 nt, Human
uccuuuuucucuucaaauuccuuc

SEQ ID NO: 832350 - RNA, 23 nt, Human
ucucacucugucacccaggcugg

SEQ ID NO: 832351 - RNA, 24 nt, Human
ucucacucugucacccaggcugga

SEQ ID NO: 832352 - RNA, 26 nt, Human
ucucacucugucacccaggcuggagu

SEQ ID NO: 832353 - RNA, 27 nt, Human
ucucacucugucacccaggcuggagug

SEQ ID NO: 832354 - RNA, 19 nt, Human
ucucccucccggguucaag

SEQ ID NO: 832355 - RNA, 23 nt, Human
ucugucaccaggcuggagugcag

SEQ ID NO: 832356 - RNA, 24 nt, Human
ucugucacccaggcuggagugcag

SEQ ID NO: 832357 - RNA, 24 nt, Human
ucuugaguagcugggauuacaggc

SEQ ID NO: 832358 - RNA, 21 nt, Human
ucuugcucugucaccaggcug

SEQ ID NO: 832359 - RNA, 21 nt, Human
ucuugcucugucaccaggcug

SEQ ID NO: 832360 - RNA, 22 nt, Human
ucuugcucugucaccaggcugg

SEQ ID NO: 832361 - RNA, 23 nt, Human
ucuugcucugucaccaggcugga

SEQ ID NO: 832362 - RNA, 20 nt, Human
ucuuggccucccaaagugcu

SEQ ID NO: 832363 - RNA, 22 nt, Human
ugaacagaaacaaucacauuuu

SEQ ID NO: 832364 - RNA, 22 nt, Human
ugcagugguacgaucuuggcuc

SEQ ID NO: 832365 - RNA, 22 nt, Human
ugcaguggugugaucucagcuc

SEQ ID NO: 832366 - RNA, 24 nt, Human
ugccucagccucccaaguacaugg

SEQ ID NO: 832367 - RNA, 22 nt, Human
ugccucagccucuugaguagcu

SEQ ID NO: 832368 - RNA, 24 nt, Human
ugccucagccucuugaguagcugg

SEQ ID NO: 832369 - RNA, 23 nt, Human
ugcucugucaccaggcuggagug

SEQ ID NO: 832370 - RNA, 24 nt, Human
ugcugggaucacaggcgugagcca

SEQ ID NO: 832371 - RNA, 24 nt, Human
ugcugggauuacaggcgugagcca

SEQ ID NO: 832372 - RNA, 23 nt, Human
uggagugcagugguacgaucuug

SEQ ID NO: 832373 - RNA, 24 nt, Human
uggagugcagugguacgaucuugg

SEQ ID NO: 832374 - RNA, 19 nt, Human
uggagugcaguggugugau

SEQ ID NO: 832375 - RNA, 24 nt, Human
uggagugcaguggugugaucucag

SEQ ID NO: 832376 - RNA, 24 nt, Human
uggccaggcugaucucaaacuccu

SEQ ID NO: 832377 - RNA, 21 nt, Human
uggcucaaaguccaaugacag

SEQ ID NO: 832378 - RNA, 24 nt, Human
ugggacuacaggcacgccccacca

SEQ ID NO: 832379 - RNA, 25 nt, Human
ugggacuacaggcacgccccaccau

SEQ ID NO: 832380 - RNA, 18 nt, Human
ugggaucacaggcgugag

SEQ ID NO: 832381 - RNA, 19 nt, Human
ugggaucacaggcgugagc

SEQ ID NO: 832382 - RNA, 22 nt, Human
ugggaucacaggcgugagccac

SEQ ID NO: 832383 - RNA, 23 nt, Human
ugggaucacaggcgugagccacc

SEQ ID NO: 832384 - RNA, 24 nt, Human
ugggaucacaggcgugagccacca

SEQ ID NO: 832385 - RNA, 21 nt, Human
ugggauuacaggcgcgugcca

SEQ ID NO: 832386 - RNA, 22 nt, Human
ugggauuacaggcgcgugccac

SEQ ID NO: 832387 - RNA, 22 nt, Human
ugggauuacaggcgcgugccac

SEQ ID NO: 832388 - RNA, 24 nt, Human
ugggauuacaggcgcgugccacug

SEQ ID NO: 832389 - RNA, 18 nt, Human
ugggauuacaggcgugag

SEQ ID NO: 832390 - RNA, 19 nt, Human
ugggauuacaggcgugagc

SEQ ID NO: 832391 - RNA, 21 nt, Human
ugggauuacaggcgugagcca

SEQ ID NO: 832392 - RNA, 22 nt, Human
ugggauuacaggcgugagccac

SEQ ID NO: 832393 - RNA, 23 nt, Human
ugggauuacaggcgugagccacc

SEQ ID NO: 832394 - RNA, 24 nt, Human
ugggauuacaggcgugagccaccg

SEQ ID NO: 832395 - RNA, 24 nt, Human
ugggguuucaccauguuggccagg

SEQ ID NO: 832396 - RNA, 24 nt, Human
ugguccacccaccuuggccuccca

SEQ ID NO: 832397 - RNA, 24 nt, Human
uggugugaucucagcucacugcaa

SEQ ID NO: 832398 - RNA, 21 nt, Human
uguauuuuuaguagagauggg

SEQ ID NO: 832399 - RNA, 24 nt, Human
uguuuaaaauccuauuuacuauuu

SEQ ID NO: 832400 - RNA, 19 nt, Human
uuaaauacaauaauucugu

SEQ ID NO: 832401 - RNA, 20 nt, Human
uuaaggcauuuucauugccu

SEQ ID NO: 832402 - RNA, 24 nt, Human
uuaguagagacaggguuucaccau

SEQ ID NO: 832403 - RNA, 18 nt, Human
uuaguagagaugggguuu

SEQ ID NO: 832404 - RNA, 22 nt, Human
uuaguagagaugggguuucacc

SEQ ID NO: 832405 - RNA, 24 nt, Human
uuaguagagaugggguuucaccau

SEQ ID NO: 832406 - RNA, 27 nt, Human
uucaaauuccuucucuucuccugaacu

SEQ ID NO: 832407 - RNA, 23 nt, Human
uucaagugauucucgugccucag

SEQ ID NO: 832408 - RNA, 18 nt, Human
uuggccucccaaagugcu

SEQ ID NO: 832409 - RNA, 23 nt, Human
uuguauuuuuaguagagaugggg

SEQ ID NO: 832410 - RNA, 19 nt, Human
uuucaccauguuggccagg

SEQ ID NO: 832411 - RNA, 20 nt, Human
uuucaccauguuggccagga

SEQ ID NO: 832412 - RNA, 21 nt, Human
uuucaccauguuggccaggcu

SEQ ID NO: 832413 - RNA, 21 nt, Human
uuugcagauuuacucauaacu

SEQ ID NO: 832414 - RNA, 20 nt, Human
uuuucaaaacuccauauaaa

SEQ ID NO: 832415 - RNA, 24 nt, Human
uuuuuaguagagacaggguuucac

SEQ ID NO: 832416 - RNA, 24 nt, Human
uuuuuaguagagaugggguuucac

SEQ ID NO: 832417 - RNA, 20 nt, Human
uuuuuguauuuuuaguagag

SEQ ID NO: 832418 - RNA, 20 nt, Human
uuuuuguauuuuuaguagag

SEQ ID NO: 832419 - RNA, 27 nt, Human
aaaccuacucccucaaccuugcuccag

SEQ ID NO: 832420 - RNA, 23 nt, Human
aaccuguggagauacauuucccu

SEQ ID NO: 832421 - RNA, 22 nt, Human
aagauaauauuaacagcaacca

SEQ ID NO: 832422 - RNA, 18 nt, Human
aagcaagagccucccaca

SEQ ID NO: 832423 - RNA, 26 nt, Human
aagccaagaccaagagauugcugaga

SEQ ID NO: 832424 - RNA, 25 nt, Human
acacagcagcuccccucaguucccu

SEQ ID NO: 832425 - RNA, 25 nt, Human
acagacaguaacuaggccccagaac

SEQ ID NO: 832426 - RNA, 22 nt, Human
acagauuccuccuggcccaaag

SEQ ID NO: 832427 - RNA, 21 nt, Human
acagcaggaauggggcacaga

SEQ ID NO: 832428 - RNA, 20 nt, Human
acccugggauccugcccagc

SEQ ID NO: 832429 - RNA, 21 nt, Human
acucccacuccccucccucag

SEQ ID NO: 832430 - RNA, 21 nt, Human
acucugaccagagaugacauc

SEQ ID NO: 832431 - RNA, 18 nt, Human
agacaguaacuaggcccc

SEQ ID NO: 832432 - RNA, 23 nt, Human
agagcucugggagccaagaugga

SEQ ID NO: 832433 - RNA, 23 nt, Human
agauagacaggcucagcugcaaa

SEQ ID NO: 832434 - RNA, 19 nt, Human
agccaggaaacaaccagcc

SEQ ID NO: 832435 - RNA, 23 nt, Human
agccagugagcagguaaacagaa

SEQ ID NO: 832436 - RNA, 20 nt, Human
aggaauggggcacagagggg

SEQ ID NO: 832437 - RNA, 19 nt, Human
aggcagguucacccuggga

SEQ ID NO: 832438 - RNA, 21 nt, Human
aggcauguugaagggugagca

SEQ ID NO: 832439 - RNA, 20 nt, Human
aggcgcgaacgggaugcacc

SEQ ID NO: 832440 - RNA, 20 nt, Human
agggguuuuuuucuucuuca

SEQ ID NO: 832441 - RNA, 21 nt, Human
aguaacuaggccccagaaccu

SEQ ID NO: 832442 - RNA, 21 nt, Human
agucccccagccucuuccugu

SEQ ID NO: 832443 - RNA, 20 nt, Human
cacauguggcucaggaggau

SEQ ID NO: 832444 - RNA, 27 nt, Human
caccacauauuaagggacucuucaaaa

SEQ ID NO: 832445 - RNA, 20 nt, Human
caccacuccuacacuugcug

SEQ ID NO: 832446 - RNA, 21 nt, Human
cacccugggauccugcccagc

SEQ ID NO: 832447 - RNA, 19 nt, Human
caccucucccuccggagca

SEQ ID NO: 832448 - RNA, 19 nt, Human
caccucuucccagcccaag

SEQ ID NO: 832449 - RNA, 21 nt, Human
cacuccuacacuugcugggga

SEQ ID NO: 832450 - RNA, 20 nt, Human
cacugacuuuuucacacccu

SEQ ID NO: 832451 - RNA, 20 nt, Human
cagaaccuguggagauacau

SEQ ID NO: 832452 - RNA, 18 nt, Human
cagagaugacaucugguc

SEQ ID NO: 832453 - RNA, 20 nt, Human
cagaguucacaggcagguuc

SEQ ID NO: 832454 - RNA, 21 nt, Human
cagauuccuccuggcccaaag

SEQ ID NO: 832455 - RNA, 22 nt, Human
cagcagauucccacaggggcuc

SEQ ID NO: 832456 - RNA, 21 nt, Human
cagccaggaaacaaccagcca

SEQ ID NO: 832457 - RNA, 22 nt, Human
cagccaggaaacaaccagccac

SEQ ID NO: 832458 - RNA, 21 nt, Human
cagcucagggagcuaucucuc

SEQ ID NO: 832459 - RNA, 18 nt, Human
caggaucuggaguagaaa

SEQ ID NO: 832460 - RNA, 18 nt, Human
cagggagcuaucucucuc

SEQ ID NO: 832461 - RNA, 25 nt, Human
ccacaggaagcccggacggcccugc

SEQ ID NO: 832462 - RNA, 21 nt, Human
ccaccucuucccagcccaagc

SEQ ID NO: 832463 - RNA, 21 nt, Human
ccagcagauucccacaggggc

SEQ ID NO: 832464 - RNA, 18 nt, Human
ccagcccaagcugcugcc

SEQ ID NO: 832465 - RNA, 18 nt, Human
ccagggguuuuuuucuuc

SEQ ID NO: 832466 - RNA, 24 nt, Human
cccacaauccacugccagggaguu

SEQ ID NO: 832467 - RNA, 27 nt, Human
cccccagcagauucccacaggggcugg

SEQ ID NO: 832468 - RNA, 20 nt, Human
cccccagccucuuccugugc

SEQ ID NO: 832469 - RNA, 19 nt, Human
ccgccgccgccucaggcgc

SEQ ID NO: 832470 - RNA, 20 nt, Human
ccuacaacuccccucagcuc

SEQ ID NO: 832471 - RNA, 20 nt, Human
ccucaggcgcgggaagacca

SEQ ID NO: 832472 - RNA, 19 nt, Human
ccuccugcacccagcugga

SEQ ID NO: 832473 - RNA, 23 nt, Human
ccuccuggcccaaaggccagggg

SEQ ID NO: 832474 - RNA, 19 nt, Human
ccucuggacuccgagaaaa

SEQ ID NO: 832475 - RNA, 23 nt, Human
ccucuggcugcaggcaggcugcc

SEQ ID NO: 832476 - RNA, 21 nt, Human
ccugagcucaccucucccucc

SEQ ID NO: 832477 - RNA, 23 nt, Human
cgggggacacagcagcuccccuc

SEQ ID NO: 832478 - RNA, 23 nt, Human
cuaacuccuggccuguuccacca

SEQ ID NO: 832479 - RNA, 24 nt, Human
cuagucccccagccucuuccugug

SEQ ID NO: 832480 - RNA, 24 nt, Human
cucagaagcucaggcggccccucu

SEQ ID NO: 832481 - RNA, 25 nt, Human
cucagcccuaaagcaagcuugcaaa

SEQ ID NO: 832482 - RNA, 20 nt, Human
cucagcugcaaauccgucug

SEQ ID NO: 832483 - RNA, 19 nt, Human
cucauagacacuuagaaga

SEQ ID NO: 832484 - RNA, 24 nt, Human
cucauggcugggauggcuccuccc

SEQ ID NO: 832485 - RNA, 19 nt, Human
cuccaauacaaccaccaca

SEQ ID NO: 832486 - RNA, 22 nt, Human
cuccugccgccgccgccucagg

SEQ ID NO: 832487 - RNA, 20 nt, Human
cucugccaccaccucuuccc

SEQ ID NO: 832488 - RNA, 23 nt, Human
cucuucaaaaccuacucccucaa

SEQ ID NO: 832489 - RNA, 21 nt, Human
cugagacucccacuccccucc

SEQ ID NO: 832490 - RNA, 22 nt, Human
cugcgcccacuugccuccuggg

SEQ ID NO: 832491 - RNA, 23 nt, Human
cugcgcccacuugccuccugggg

SEQ ID NO: 832492 - RNA, 18 nt, Human
gaagccaagaccaagaga

SEQ ID NO: 832493 - RNA, 27 nt, Human
gagagcaaacaugggagguagaaguca

SEQ ID NO: 832494 - RNA, 20 nt, Human
gagcuuucuagagggcaggg

SEQ ID NO: 832495 - RNA, 19 nt, Human
gcugaacugugcugcugcu

SEQ ID NO: 832496 - RNA, 20 nt, Human
ggaagaccacagccccaggc

SEQ ID NO: 832497 - RNA, 18 nt, Human
ggagauacauuucccugg

SEQ ID NO: 832498 - RNA, 21 nt, Human
ggagauacauuucccuggugc

SEQ ID NO: 832499 - RNA, 22 nt, Human
ggagcagcugcgggagccugag

SEQ ID NO: 832500 - RNA, 20 nt, Human
ggagguagaagucagauggc

SEQ ID NO: 832501 - RNA, 19 nt, Human
ggcagggccucuuucuagu

SEQ ID NO: 832502 - RNA, 22 nt, Human
ggcagggccucuuucuaguccc

SEQ ID NO: 832503 - RNA, 21 nt, Human
gggaagaccacagccccaggc

SEQ ID NO: 832504 - RNA, 19 nt, Human
guagaacaccccccugcag

SEQ ID NO: 832505 - RNA, 23 nt, Human
gugagcagguaaacagaagccag

SEQ ID NO: 832506 - RNA, 18 nt, Human
uaacuccuggccuguucc

SEQ ID NO: 832507 - RNA, 20 nt, Human
uaacuccuggccuguuccuc

SEQ ID NO: 832508 - RNA, 25 nt, Human
uaaggagcccacccgaguaugagua

SEQ ID NO: 832509 - RNA, 19 nt, Human
uaaguucucagccagucuc

SEQ ID NO: 832510 - RNA, 21 nt, Human
uaaguucucagccagucucca

SEQ ID NO: 832511 - RNA, 23 nt, Human
uacaaccaccacacauugcauua

SEQ ID NO: 832512 - RNA, 18 nt, Human
uacaauauuucacauacc

SEQ ID NO: 832513 - RNA, 21 nt, Human
uacacacacacuggcauucuu

SEQ ID NO: 832514 - RNA, 24 nt, Human
uacagacaguaacuaggccccaga

SEQ ID NO: 832515 - RNA, 19 nt, Human
uaccccaaacccauuccca

SEQ ID NO: 832516 - RNA, 22 nt, Human
uagaaagggggagcaucacuga

SEQ ID NO: 832517 - RNA, 23 nt, Human
uagaagaggcaaaucuaguugug

SEQ ID NO: 832518 - RNA, 24 nt, Human
uagaagaggcaaaucuaguuguga

SEQ ID NO: 832519 - RNA, 24 nt, Human
uagagcucugggagccaagaugga

SEQ ID NO: 832520 - RNA, 22 nt, Human
uagcaaguaaacucugaccaga

SEQ ID NO: 832521 - RNA, 21 nt, Human
uaggccccagaaccuguggag

SEQ ID NO: 832522 - RNA, 24 nt, Human
uaggccccagaaccuguggagagg

SEQ ID NO: 832523 - RNA, 23 nt, Human
uauuaagggacucuucaaaaccu

SEQ ID NO: 832524 - RNA, 22 nt, Human
ucacagcaggaauggggcacag

SEQ ID NO: 832525 - RNA, 18 nt, Human
ucacccugggauccugcc

SEQ ID NO: 832526 - RNA, 24 nt, Human
ucagaagcucaggcggccccucug

SEQ ID NO: 832527 - RNA, 22 nt, Human
ucaggcccaccacuccuacacu

SEQ ID NO: 832528 - RNA, 19 nt, Human
ucaggccggcuguagaugg

SEQ ID NO: 832529 - RNA, 23 nt, Human
ucaguucccuacaacuccccuca

SEQ ID NO: 832530 - RNA, 24 nt, Human
ucaguucccuacaacuccccucag

SEQ ID NO: 832531 - RNA, 19 nt, Human
uccagaacccaucgagcuu

SEQ ID NO: 832532 - RNA, 21 nt, Human
ucccacaggggcucauggcug

SEQ ID NO: 832533 - RNA, 26 nt, Human
ucccagcccaagcugcugccuaaacc

SEQ ID NO: 832534 - RNA, 18 nt, Human
ucccccagccucuuccuc

SEQ ID NO: 832535 - RNA, 19 nt, Human
ucccuaguucucagaagcu

SEQ ID NO: 832536 - RNA, 19 nt, Human
ucccugggcuggcuagagc

SEQ ID NO: 832537 - RNA, 18 nt, Human
ucucucagcaucucagcu

SEQ ID NO: 832538 - RNA, 22 nt, Human
ucuggacuccgagaaaacgacc

SEQ ID NO: 832539 - RNA, 18 nt, Human
ucuggaguagaaaggggg

SEQ ID NO: 832540 - RNA, 25 nt, Human
ugacaagccacacuguccuccagaa

SEQ ID NO: 832541 - RNA, 19 nt, Human
ugacuaaggagcccacccg

SEQ ID NO: 832542 - RNA, 21 nt, Human
ugacuaaggagcccacccgag

SEQ ID NO: 832543 - RNA, 23 nt, Human
ugagacucccacuccccucccuc

SEQ ID NO: 832544 - RNA, 21 nt, Human
ugagcagguaaacagaagcca

SEQ ID NO: 832545 - RNA, 18 nt, Human
ugaguaacagaagccaag

SEQ ID NO: 832546 - RNA, 19 nt, Human
ugccaugaagccaagacca

SEQ ID NO: 832547 - RNA, 21 nt, Human
ugccaugaagccaagaccaag

SEQ ID NO: 832548 - RNA, 24 nt, Human
ugcugcgcccacuugccuccuggg

SEQ ID NO: 832549 - RNA, 19 nt, Human
uggagguuuuccaguaccu

SEQ ID NO: 832550 - RNA, 18 nt, Human
uggcccccagcagauucc

SEQ ID NO: 832551 - RNA, 20 nt, Human
uggcccccagcagauucccu

SEQ ID NO: 832552 - RNA, 24 nt, Human
ugggauggcuccucccuaguucuc

SEQ ID NO: 832553 - RNA, 18 nt, Human
uggggaggaggaggcggg

SEQ ID NO: 832554 - RNA, 22 nt, Human
uguaagcaagagccucccacaa

SEQ ID NO: 832555 - RNA, 19 nt, Human
ugugacugccucaggccgg

SEQ ID NO: 832556 - RNA, 18 nt, Human
ugugacuguuuguuucag

SEQ ID NO: 832557 - RNA, 22 nt, Human
uguggucccugggcuggcuaga

SEQ ID NO: 832558 - RNA, 20 nt, Human
uucccuacaacuccccucag

SEQ ID NO: 832559 - RNA, 20 nt, Human
uucccuggugcugcgcccac

SEQ ID NO: 832560 - RNA, 20 nt, Human
uugaaguccuccugcaccca

SEQ ID NO: 832561 - RNA, 18 nt, Human
uugcugagacucccacuc

SEQ ID NO: 832562 - RNA, 22 nt, Human
uuucacauaccacccaauagau

SEQ ID NO: 832563 - RNA, 19 nt, Human
uuucuucuucacagcuuuc

SEQ ID NO: 832564 - RNA, 24 nt, Human
aaaaaaacaaagcaaacccuggga

SEQ ID NO: 832565 - RNA, 18 nt, Human
aaacauggcuauggggau

SEQ ID NO: 832566 - RNA, 24 nt, Human
aaagccccuccaggauagcacuau

SEQ ID NO: 832567 - RNA, 25 nt, Human
agacccagccuaggggccuuuccuc

SEQ ID NO: 832568 - RNA, 24 nt, Human
aggugcuuccauacucugcucagg

SEQ ID NO: 832569 - RNA, 23 nt, Human
auggcaguguccaguuuuuuccu

SEQ ID NO: 832570 - RNA, 20 nt, Human
auguaaacauggcuaugggg

SEQ ID NO: 832571 - RNA, 19 nt, Human
caaguagccuugggcuucc

SEQ ID NO: 832572 - RNA, 25 nt, Human
cagauggcaguguccaguuuuuucc

SEQ ID NO: 832573 - RNA, 21 nt, Human
caggauagcacagugcuuagg

SEQ ID NO: 832574 - RNA, 21 nt, Human
caggugcuuccauacucugcu

SEQ ID NO: 832575 - RNA, 23 nt, Human
ccaaguagccuugggcuucccuc

SEQ ID NO: 832576 - RNA, 23 nt, Human
ccagaggcaagggagacaaucua

SEQ ID NO: 832577 - RNA, 24 nt, Human
cccagcccuaccccaugcugaggc

SEQ ID NO: 832578 - RNA, 18 nt, Human
cccauuuuguaggaugaa

SEQ ID NO: 832579 - RNA, 18 nt, Human
ccccaugcugaggccaca

SEQ ID NO: 832580 - RNA, 20 nt, Human
cccggggaggacgagcgggg

SEQ ID NO: 832581 - RNA, 21 nt, Human
cccucugccacccacccucuc

SEQ ID NO: 832582 - RNA, 20 nt, Human
ccgccgccgccaagcaccca

SEQ ID NO: 832583 - RNA, 19 nt, Human
ccucccuauccccuugguc

SEQ ID NO: 832584 - RNA, 20 nt, Human
ccucccuauccccuuggucu

SEQ ID NO: 832585 - RNA, 23 nt, Human
ccucucagauuccagguccugag

SEQ ID NO: 832586 - RNA, 23 nt, Human
ccucugccacccacccucucaga

SEQ ID NO: 832587 - RNA, 19 nt, Human
ccuggcccaguccuuuccc

SEQ ID NO: 832588 - RNA, 22 nt, Human
ccuucccacccccagcuggagg

SEQ ID NO: 832589 - RNA, 18 nt, Human
cuccccucugccacccac

SEQ ID NO: 832590 - RNA, 20 nt, Human
cucccgagccugcccuggcc

SEQ ID NO: 832591 - RNA, 23 nt, Human
cucccgagccugcccuggcccag

SEQ ID NO: 832592 - RNA, 23 nt, Human
cucccuauccccuuggucuuuca

SEQ ID NO: 832593 - RNA, 25 nt, Human
cugccccuaccccacccuauugcac

SEQ ID NO: 832594 - RNA, 22 nt, Human
cuggucccaaacucuggcucag

SEQ ID NO: 832595 - RNA, 19 nt, Human
cuucuugaagcgggucagg

SEQ ID NO: 832596 - RNA, 20 nt, Human
gacugaagccgaggugccuc

SEQ ID NO: 832597 - RNA, 23 nt, Human
gcacccagacccagccuaggggc

SEQ ID NO: 832598 - RNA, 21 nt, Human
ggcaguguccaguuuuuuccu

SEQ ID NO: 832599 - RNA, 21 nt, Human
ggugccucugggcccggggag

SEQ ID NO: 832600 - RNA, 21 nt, Human
gucccaaacucuggcucagau

SEQ ID NO: 832601 - RNA, 26 nt, Human
uaccccacccuauugcacaucaaauc

SEQ ID NO: 832602 - RNA, 22 nt, Human
uaggggccuuuccucgcagccu

SEQ ID NO: 832603 - RNA, 26 nt, Human
ucacccagcccuaccccaugcugagg

SEQ ID NO: 832604 - RNA, 19 nt, Human
uccacacaauggaguaggu

SEQ ID NO: 832605 - RNA, 20 nt, Human
ucccugccccuaccccaccc

SEQ ID NO: 832606 - RNA, 22 nt, Human
uccuggucccaaacucuggcuc

SEQ ID NO: 832607 - RNA, 21 nt, Human
ugaggcagauugauguguaaa

SEQ ID NO: 832608 - RNA, 19 nt, Human
uggcagaggauguacagug

SEQ ID NO: 832609 - RNA, 18 nt, Human
ugggccagaggcaaggga

SEQ ID NO: 832610 - RNA, 20 nt, Human
uggucccaaacucuggcuca

SEQ ID NO: 832611 - RNA, 24 nt, Human
uugcugauggcugaagccuccucc

SEQ ID NO: 832612 - RNA, 22 nt, Human
uugguccacacaauggaguagg

SEQ ID NO: 832613 - RNA, 19 nt, Human
uuuccuucccacccccagc

SEQ ID NO: 832614 - RNA, 18 nt, Human
agaaaagaaaaaauaaag

SEQ ID NO: 832615 - RNA, 20 nt, Human
agaaaagaaaaaauaaagga

SEQ ID NO: 832616 - RNA, 18 nt, Human
caagacaaguaauguugg

SEQ ID NO: 832617 - RNA, 21 nt, Human
cauauagguccucuucucuuu

SEQ ID NO: 832618 - RNA, 23 nt, Human
caucacugcgaauuaucuuugaa

SEQ ID NO: 832619 - RNA, 21 nt, Human
gcuuugucucuguugucuuga

SEQ ID NO: 832620 - RNA, 21 nt, Human
uauagguccucuucucucaac

SEQ ID NO: 832621 - RNA, 23 nt, Human
uguacagaacuuccucaucuuag

SEQ ID NO: 832622 - RNA, 23 nt, Human
aaaaaaaaaaaaaaaagaaagaa

SEQ ID NO: 832623 - RNA, 19 nt, Human
aaaaaaacagacagguaca

SEQ ID NO: 832624 - RNA, 22 nt, Human
aaaaagaaguuuguaaacaaaa

SEQ ID NO: 832625 - RNA, 24 nt, Human
aaaaagaaguuuguaaacaaaacc

SEQ ID NO: 832626 - RNA, 21 nt, Human
aaacaaaacccccaaagaaca

SEQ ID NO: 832627 - RNA, 19 nt, Human
aaacaaugcuuacuccuga

SEQ ID NO: 832628 - RNA, 19 nt, Human
aaacccccaaagaacacgg

SEQ ID NO: 832629 - RNA, 20 nt, Human
aaacccccuuuuucuccuuu

SEQ ID NO: 832630 - RNA, 18 nt, Human
aaacuaggccaccuagca

SEQ ID NO: 832631 - RNA, 22 nt, Human
aaacuaggccaccuagcaauca

SEQ ID NO: 832632 - RNA, 19 nt, Human
aaacuuauccuuagcaacu

SEQ ID NO: 832633 - RNA, 23 nt, Human
aacaaaacccccaaagaacacgg

SEQ ID NO: 832634 - RNA, 20 nt, Human
aacacggagaaagaccaaua

SEQ ID NO: 832635 - RNA, 26 nt, Human
aagaacagaucuggagauguaaagca

SEQ ID NO: 832636 - RNA, 20 nt, Human
aagaagagggccccccaaac

SEQ ID NO: 832637 - RNA, 21 nt, Human
aagagggcaggguagaagaca

SEQ ID NO: 832638 - RNA, 23 nt, Human
aagauccccccuuuaagaagagg

SEQ ID NO: 832639 - RNA, 23 nt, Human
aagggagcaaauaaauaaaauca

SEQ ID NO: 832640 - RNA, 19 nt, Human
aaggggcucagucuccugc

SEQ ID NO: 832641 - RNA, 22 nt, Human
aaggggcucagucuccugcagu

SEQ ID NO: 832642 - RNA, 18 nt, Human
aaucaagucauggggcca

SEQ ID NO: 832643 - RNA, 18 nt, Human
acaaaacccccaaagaac

SEQ ID NO: 832644 - RNA, 18 nt, Human
acccccuuuuucuccuuu

SEQ ID NO: 832645 - RNA, 23 nt, Human
accugagaacacagugcaggaaa

SEQ ID NO: 832646 - RNA, 21 nt, Human
acucacccuuuccccccaccu

SEQ ID NO: 832647 - RNA, 18 nt, Human
agaaagaaagaaauggua

SEQ ID NO: 832648 - RNA, 23 nt, Human
agacaacccucaccuaaucuugg

SEQ ID NO: 832649 - RNA, 21 nt, Human
agacacacaccacccaaugcg

SEQ ID NO: 832650 - RNA, 20 nt, Human
agacagagucucgcucugua

SEQ ID NO: 832651 - RNA, 19 nt, Human
agcaaucaacguagugaag

SEQ ID NO: 832652 - RNA, 19 nt, Human
agcagcaggucugcagcug

SEQ ID NO: 832653 - RNA, 23 nt, Human
agccccaaugcacccuauuccca

SEQ ID NO: 832654 - RNA, 19 nt, Human
agcccguggccccgggccc

SEQ ID NO: 832655 - RNA, 20 nt, Human
agcccguggccccgggcccc

SEQ ID NO: 832656 - RNA, 25 nt, Human
aggcuggagugcaguggugcgaucu

SEQ ID NO: 832657 - RNA, 19 nt, Human
agucauggggccacccagu

SEQ ID NO: 832658 - RNA, 21 nt, Human
agugcaguggugcgaucucag

SEQ ID NO: 832659 - RNA, 23 nt, Human
agugcaguggugcgaucucagcu

SEQ ID NO: 832660 - RNA, 24 nt, Human
agugcaguggugcgaucucagcuc

SEQ ID NO: 832661 - RNA, 24 nt, Human
aguggugcgaucucagcucacugc

SEQ ID NO: 832662 - RNA, 19 nt, Human
auaaacacaccccagugau

SEQ ID NO: 832663 - RNA, 27 nt, Human
auuauauuuacacaaacuaggccaccu

SEQ ID NO: 832664 - RNA, 20 nt, Human
auugcucauguaccugagaa

SEQ ID NO: 832665 - RNA, 19 nt, Human
caaaacccccaaagaacac

SEQ ID NO: 832666 - RNA, 18 nt, Human
caaaagaauagcccccac

SEQ ID NO: 832667 - RNA, 18 nt, Human
caaauaaacacaccccag

SEQ ID NO: 832668 - RNA, 19 nt, Human
caacaaaaaguaauuccug

SEQ ID NO: 832669 - RNA, 24 nt, Human
cacacacacccuguggcacauggu

SEQ ID NO: 832670 - RNA, 23 nt, Human
caccaaagcccaaaggggcucag

SEQ ID NO: 832671 - RNA, 23 nt, Human
cacccuguggcacaugguaggcc

SEQ ID NO: 832672 - RNA, 18 nt, Human
cacccuuuccccccaccu

SEQ ID NO: 832673 - RNA, 22 nt, Human
cacuacuguagcagggcaggac

SEQ ID NO: 832674 - RNA, 21 nt, Human
cacucugccugcuccucaaaa

SEQ ID NO: 832675 - RNA, 20 nt, Human
cacuugcauuuggacagagc

SEQ ID NO: 832676 - RNA, 18 nt, Human
caggacacaggcuccagg

SEQ ID NO: 832677 - RNA, 19 nt, Human
caggccacuuucaaaagcu

SEQ ID NO: 832678 - RNA, 18 nt, Human
caggcuuuccuacccucc

SEQ ID NO: 832679 - RNA, 19 nt, Human
caguaaacauggaguuaca

SEQ ID NO: 832680 - RNA, 22 nt, Human
caguauccaagggagcaaauaa

SEQ ID NO: 832681 - RNA, 18 nt, Human
cauccuggagaaaguggg

SEQ ID NO: 832682 - RNA, 23 nt, Human
ccaacuagccccaaugcacccua

SEQ ID NO: 832683 - RNA, 18 nt, Human
ccaaugcacccuauuccc

SEQ ID NO: 832684 - RNA, 18 nt, Human
ccacccaguuaaaaccua

SEQ ID NO: 832685 - RNA, 21 nt, Human
ccagacaaauacaguaacuug

SEQ ID NO: 832686 - RNA, 23 nt, Human
ccaggcaccacaaaacccucgcu

SEQ ID NO: 832687 - RNA, 21 nt, Human
ccaggcuggagugcaguggug

SEQ ID NO: 832688 - RNA, 22 nt, Human
cccaggaucagacacacaccac

SEQ ID NO: 832689 - RNA, 19 nt, Human
ccccagugauggggucacc

SEQ ID NO: 832690 - RNA, 18 nt, Human
cccccagaacccucacuu

SEQ ID NO: 832691 - RNA, 23 nt, Human
cccccagaacccucacuugcauu

SEQ ID NO: 832692 - RNA, 18 nt, Human
ccccccuccugguugccc

SEQ ID NO: 832693 - RNA, 19 nt, Human
ccccccuccugguugcccc

SEQ ID NO: 832694 - RNA, 23 nt, Human
ccccggagaaguccgaaggcaaa

SEQ ID NO: 832695 - RNA, 23 nt, Human
ccccuuuaagaagagggcccccc

SEQ ID NO: 832696 - RNA, 20 nt, Human
cccguggccccgggccccug

SEQ ID NO: 832697 - RNA, 23 nt, Human
cccuuucuuggccuccugacccc

SEQ ID NO: 832698 - RNA, 23 nt, Human
ccuacaaagcccagacaaauaca

SEQ ID NO: 832699 - RNA, 21 nt, Human
ccucuguguaccaccauuucc

SEQ ID NO: 832700 - RNA, 22 nt, Human
ccugggugacacagcgagacuc

SEQ ID NO: 832701 - RNA, 24 nt, Human
ccugggugacacagcgagacucca

SEQ ID NO: 832702 - RNA, 20 nt, Human
cucacccuuuccccccaccu

SEQ ID NO: 832703 - RNA, 19 nt, Human
cucacugcaaccucugccu

SEQ ID NO: 832704 - RNA, 24 nt, Human
cuccacuuuaaaaaaaaaaaaaaa

SEQ ID NO: 832705 - RNA, 20 nt, Human
cucgcucuguaaccaggcug

SEQ ID NO: 832706 - RNA, 19 nt, Human
cugaccccacuuucuacau

SEQ ID NO: 832707 - RNA, 24 nt, Human
cuuuaaacuuauccuuagcaacuc

SEQ ID NO: 832708 - RNA, 19 nt, Human
cuuuccccccaccuagagg

SEQ ID NO: 832709 - RNA, 24 nt, Human
cuuuucaccgggcccagccucucc

SEQ ID NO: 832710 - RNA, 23 nt, Human
gaaacccccuuuuucuccuuuag

SEQ ID NO: 832711 - RNA, 18 nt, Human
gaagaacagaucuggaga

SEQ ID NO: 832712 - RNA, 20 nt, Human
gaaguccuacaaagcccaga

SEQ ID NO: 832713 - RNA, 24 nt, Human
gacagagucucgcucuguaaccag

SEQ ID NO: 832714 - RNA, 22 nt, Human
gacucacccuuuccccccaccu

SEQ ID NO: 832715 - RNA, 20 nt, Human
gagcagcaggucugcagcug

SEQ ID NO: 832716 - RNA, 18 nt, Human
gcagaaccuucugucaaa

SEQ ID NO: 832717 - RNA, 20 nt, Human
gcagaaccuucugucaaagg

SEQ ID NO: 832718 - RNA, 18 nt, Human
gccccuggucgggcggcu

SEQ ID NO: 832719 - RNA, 23 nt, Human
gccccuggucgggcggcugcugg

SEQ ID NO: 832720 - RNA, 23 nt, Human
gccugggugacacagcgagacuc

SEQ ID NO: 832721 - RNA, 23 nt, Human
gcucuuauuggcaaaaaugaggu

SEQ ID NO: 832722 - RNA, 18 nt, Human
ggaaaggagaagggaagg

SEQ ID NO: 832723 - RNA, 24 nt, Human
ggaacccgaaaauuuugaaagguu

SEQ ID NO: 832724 - RNA, 19 nt, Human
ggaagaaagggugauggug

SEQ ID NO: 832725 - RNA, 19 nt, Human
ggcaggguagaagacaagu

SEQ ID NO: 832726 - RNA, 22 nt, Human
ggccccgggccccuggucgggc

SEQ ID NO: 832727 - RNA, 21 nt, Human
gggaaaggaaguacccaguac

SEQ ID NO: 832728 - RNA, 22 nt, Human
gggcaggacacaggcuccaggc

SEQ ID NO: 832729 - RNA, 18 nt, Human
gggcggcugcuggccccg

SEQ ID NO: 832730 - RNA, 20 nt, Human
ggguaugaggauacaagaug

SEQ ID NO: 832731 - RNA, 19 nt, Human
guaaagcacguccugugcc

SEQ ID NO: 832732 - RNA, 18 nt, Human
guaaccaggcuggagugc

SEQ ID NO: 832733 - RNA, 24 nt, Human
gucucgcucuguaaccaggcugga

SEQ ID NO: 832734 - RNA, 19 nt, Human
gugcaguuggcauccugga

SEQ ID NO: 832735 - RNA, 21 nt, Human
guggccacuuugacauaaagu

SEQ ID NO: 832736 - RNA, 23 nt, Human
uaaacaaaacccccaaagaacac

SEQ ID NO: 832737 - RNA, 26 nt, Human
uaaacaaaacccccaaagaacacgga

SEQ ID NO: 832738 - RNA, 24 nt, Human
uaaccaggcuggagugcaguggug

SEQ ID NO: 832739 - RNA, 18 nt, Human
uaacuuggggggcagcau

SEQ ID NO: 832740 - RNA, 20 nt, Human
uaagaagagggccccccaaa

SEQ ID NO: 832741 - RNA, 20 nt, Human
uacaggcuuuccuacccucc

SEQ ID NO: 832742 - RNA, 23 nt, Human
uagaagacaaguuuuuaggacag

SEQ ID NO: 832743 - RNA, 22 nt, Human
uagacaacccucaccuaaucuu

SEQ ID NO: 832744 - RNA, 22 nt, Human
uagagcagcaggucugcagcug

SEQ ID NO: 832745 - RNA, 22 nt, Human
uagauuaaaauauacaaaaaua

SEQ ID NO: 832746 - RNA, 19 nt, Human
uagcaaaagaauagccccc

SEQ ID NO: 832747 - RNA, 26 nt, Human
uagcaacucuaguuuuacaaacacac

SEQ ID NO: 832748 - RNA, 22 nt, Human
uagcaaucaacguagugaaguc

SEQ ID NO: 832749 - RNA, 23 nt, Human
uaguucaauaggcugugcacucc

SEQ ID NO: 832750 - RNA, 22 nt, Human
uauacaaaaauacaaaaccaga

SEQ ID NO: 832751 - RNA, 24 nt, Human
uauccaagggagcaaauaaauaaa

SEQ ID NO: 832752 - RNA, 22 nt, Human
ucaauaggcugugcacuccaaa

SEQ ID NO: 832753 - RNA, 20 nt, Human
ucacugcaaccucugccugg

SEQ ID NO: 832754 - RNA, 21 nt, Human
ucacugcaaccucugccuggg

SEQ ID NO: 832755 - RNA, 25 nt, Human
ucacugcaaccucugccugggugac

SEQ ID NO: 832756 - RNA, 19 nt, Human
ucauauauccaucccucga

SEQ ID NO: 832757 - RNA, 28 nt, Human
uccacuuuaaaaaaaaaaaaaaaaagaa

SEQ ID NO: 832758 - RNA, 19 nt, Human
uccuauuaaacaaucuugu

SEQ ID NO: 832759 - RNA, 18 nt, Human
uccugguugcccccagaa

SEQ ID NO: 832760 - RNA, 25 nt, Human
ucgcuugugugucucccuggaaccc

SEQ ID NO: 832761 - RNA, 21 nt, Human
ucuccacucugccugcuccuc

SEQ ID NO: 832762 - RNA, 22 nt, Human
ucucgcucuguaaccaggcugg

SEQ ID NO: 832763 - RNA, 23 nt, Human
ucucgcucuguaaccaggcugga

SEQ ID NO: 832764 - RNA, 18 nt, Human
ucuguaaccaggcuggag

SEQ ID NO: 832765 - RNA, 23 nt, Human
ucuguaaccaggcuggagugcag

SEQ ID NO: 832766 - RNA, 23 nt, Human
ugaaauguguaugugugugggug

SEQ ID NO: 832767 - RNA, 22 nt, Human
ugacacagcgagacuccacuuu

SEQ ID NO: 832768 - RNA, 25 nt, Human
ugauggggucaccaaagcccaaagg

SEQ ID NO: 832769 - RNA, 25 nt, Human
ugauuccccccuccugguugccccc

SEQ ID NO: 832770 - RNA, 22 nt, Human
ugcaggaaaugagggccuuaga

SEQ ID NO: 832771 - RNA, 21 nt, Human
ugcaguauccaagggagcaaa

SEQ ID NO: 832772 - RNA, 22 nt, Human
ugcaguggugcgaucucagcuc

SEQ ID NO: 832773 - RNA, 22 nt, Human
ugccuggugcagaaccuucugu

SEQ ID NO: 832774 - RNA, 21 nt, Human
ugcuuuggcuauuuuucucuc

SEQ ID NO: 832775 - RNA, 23 nt, Human
uggagugcaguggugcgaucuca

SEQ ID NO: 832776 - RNA, 24 nt, Human
uggagugcaguggugcgaucucag

SEQ ID NO: 832777 - RNA, 19 nt, Human
uggcauccuggagaaagug

SEQ ID NO: 832778 - RNA, 18 nt, Human
uggcccagaauggggcgg

SEQ ID NO: 832779 - RNA, 19 nt, Human
uggcccagaauggggcggg

SEQ ID NO: 832780 - RNA, 18 nt, Human
uggccuccugaccccacu

SEQ ID NO: 832781 - RNA, 22 nt, Human
uggccuccugaccccacuuucu

SEQ ID NO: 832782 - RNA, 23 nt, Human
uggcuugcucucuggccuuuuca

SEQ ID NO: 832783 - RNA, 24 nt, Human
ugggaaaggaaguacccaguacag

SEQ ID NO: 832784 - RNA, 23 nt, Human
ugggaauuauuauauauccuucu

SEQ ID NO: 832785 - RNA, 25 nt, Human
uggggccacccaguuaaaaccuagu

SEQ ID NO: 832786 - RNA, 22 nt, Human
uggggucaccaaagcccaaagg

SEQ ID NO: 832787 - RNA, 24 nt, Human
uggugcgaucucagcucacugcaa

SEQ ID NO: 832788 - RNA, 19 nt, Human
uggugugaacccaagccug

SEQ ID NO: 832789 - RNA, 21 nt, Human
uguaaguuuucuuuugggggu

SEQ ID NO: 832790 - RNA, 21 nt, Human
uguguaugugugugggugugu

SEQ ID NO: 832791 - RNA, 22 nt, Human
uguguaugugugugggugugua

SEQ ID NO: 832792 - RNA, 18 nt, Human
uguguguggguguguaag

SEQ ID NO: 832793 - RNA, 21 nt, Human
uguuuuguuuuguuuuguuug

SEQ ID NO: 832794 - RNA, 21 nt, Human
uuacccauugcuugggacagc

SEQ ID NO: 832795 - RNA, 18 nt, Human
uucaaaagcuggaaauuc

SEQ ID NO: 832796 - RNA, 20 nt, Human
uuccccccuccugguugccc

SEQ ID NO: 832797 - RNA, 30 nt, Human
uuccccccuccugguugcccccagaacccu

SEQ ID NO: 832798 - RNA, 21 nt, Human
uuuacaaacacacacacaccc

SEQ ID NO: 832799 - RNA, 18 nt, Human
uuuguuuuguuuuguuug

SEQ ID NO: 832800 - RNA, 19 nt, Human
uuuguuuuguuuuguuuug

SEQ ID NO: 832801 - RNA, 24 nt, Human
aaaaaaaauagaguaagcaaaaaa

SEQ ID NO: 832802 - RNA, 25 nt, Human
aaaaaaauagaguaagcaaaaaaaa

SEQ ID NO: 832803 - RNA, 24 nt, Human
aaaaaagcauacaauucuauucuu

SEQ ID NO: 832804 - RNA, 22 nt, Human
aaaaacaguaggacagaauugc

SEQ ID NO: 832805 - RNA, 24 nt, Human
aaaaaucauugaaaacuggaauaa

SEQ ID NO: 832806 - RNA, 25 nt, Human
aaacaguaggacagaauugcccuca

SEQ ID NO: 832807 - RNA, 22 nt, Human
aaagaaaucacaaaagaugaaa

SEQ ID NO: 832808 - RNA, 18 nt, Human
aaagacacauucaaccau

SEQ ID NO: 832809 - RNA, 21 nt, Human
aaagacacauucaaccaugca

SEQ ID NO: 832810 - RNA, 22 nt, Human
aaagaugaaaucugaaccuguu

SEQ ID NO: 832811 - RNA, 19 nt, Human
aaaguacaaaaugcagcaa

SEQ ID NO: 832812 - RNA, 18 nt, Human
aacagaaaaugaacccca

SEQ ID NO: 832813 - RNA, 18 nt, Human
aagcauuuuaaaaaaucc

SEQ ID NO: 832814 - RNA, 22 nt, Human
aaucaucugagacucacaguga

SEQ ID NO: 832815 - RNA, 18 nt, Human
accucagucacaguccca

SEQ ID NO: 832816 - RNA, 19 nt, Human
accuuuuacuuuuucuugu

SEQ ID NO: 832817 - RNA, 23 nt, Human
acuaaaauauaggggaaauacug

SEQ ID NO: 832818 - RNA, 22 nt, Human
agcuaaaacgcaaaaugaaaua

SEQ ID NO: 832819 - RNA, 23 nt, Human
auagaguaagcaaaaaaaaagaa

SEQ ID NO: 832820 - RNA, 19 nt, Human
augcaccaauaccucucuu

SEQ ID NO: 832821 - RNA, 23 nt, Human
augcagaaaaaagcauacaauuc

SEQ ID NO: 832822 - RNA, 19 nt, Human
auuucucaaauucccauau

SEQ ID NO: 832823 - RNA, 20 nt, Human
caaaagaugaaaucugaacc

SEQ ID NO: 832824 - RNA, 18 nt, Human
caaaaugcagcaaugaug

SEQ ID NO: 832825 - RNA, 18 nt, Human
caaaaugcccacuuuuuu

SEQ ID NO: 832826 - RNA, 24 nt, Human
caaauauuaagaauauguauuuua

SEQ ID NO: 832827 - RNA, 19 nt, Human
caacaaauaccucuaauaa

SEQ ID NO: 832828 - RNA, 22 nt, Human
caauucuauucuuccugaagga

SEQ ID NO: 832829 - RNA, 22 nt, Human
cacaaaagaugaaaucugaacc

SEQ ID NO: 832830 - RNA, 22 nt, Human
cacaaacaugcagaaaaaagca

SEQ ID NO: 832831 - RNA, 21 nt, Human
cagaaaaugaaccccaacucu

SEQ ID NO: 832832 - RNA, 21 nt, Human
cagcuacuucccaccaccaaa

SEQ ID NO: 832833 - RNA, 18 nt, Human
cagguuaaaaaaaauaga

SEQ ID NO: 832834 - RNA, 22 nt, Human
caugcagaaaaaagcauacaau

SEQ ID NO: 832835 - RNA, 22 nt, Human
caugcagaaaaaagcauacaau

SEQ ID NO: 832836 - RNA, 18 nt, Human
cccaccaccaaauaacug

SEQ ID NO: 832837 - RNA, 21 nt, Human
ccucuuuucuuccuauuuaaa

SEQ ID NO: 832838 - RNA, 21 nt, Human
cuaaaaaaagauuaagaaugu

SEQ ID NO: 832839 - RNA, 23 nt, Human
cuacuucccaccaccaaauaacu

SEQ ID NO: 832840 - RNA, 24 nt, Human
gcaaaaugaaauaucaaguuuuga

SEQ ID NO: 832841 - RNA, 26 nt, Human
guuaugcuuaauuucuuggaaaacug

SEQ ID NO: 832842 - RNA, 19 nt, Human
uaaaaaaaauagaguaagc

SEQ ID NO: 832843 - RNA, 18 nt, Human
uaaaaaaagauuaagaau

SEQ ID NO: 832844 - RNA, 22 nt, Human
uaaaaaaucuauaacaacuuua

SEQ ID NO: 832845 - RNA, 18 nt, Human
uaaacaaaaguugccucu

SEQ ID NO: 832846 - RNA, 22 nt, Human
uaaauauauccucuuuucuucc

SEQ ID NO: 832847 - RNA, 21 nt, Human
uaacagaaaaugaaccccaac

SEQ ID NO: 832848 - RNA, 18 nt, Human
uaagaaugucuacucuug

SEQ ID NO: 832849 - RNA, 24 nt, Human
uaagaccucagucacagucccaca

SEQ ID NO: 832850 - RNA, 22 nt, Human
uaaguaaaagugaaaaaacuug

SEQ ID NO: 832851 - RNA, 26 nt, Human
uacucuugaagcuagugagguuaaag

SEQ ID NO: 832852 - RNA, 24 nt, Human
uagcuaaaacgcaaaaugaaauau

SEQ ID NO: 832853 - RNA, 26 nt, Human
uaugacaaaaucugcauuugaaaaag

SEQ ID NO: 832854 - RNA, 19 nt, Human
ucagaaaaaaguguaugca

SEQ ID NO: 832855 - RNA, 22 nt, Human
ucccacacuaauagcugccuuu

SEQ ID NO: 832856 - RNA, 23 nt, Human
ugaaaaaggccuguaaaaacagu

SEQ ID NO: 832857 - RNA, 21 nt, Human
ugaaaaaucauugaaaacugg

SEQ ID NO: 832858 - RNA, 18 nt, Human
ugaaggaauguuacaaaa

SEQ ID NO: 832859 - RNA, 23 nt, Human
ugagcuaguaagaaugucuacuc

SEQ ID NO: 832860 - RNA, 22 nt, Human
ugauuguuucaguguuuaaaaa

SEQ ID NO: 832861 - RNA, 18 nt, Human
ugcagaaaaaagcauaca

SEQ ID NO: 832862 - RNA, 23 nt, Human
ugcccucaucaccuuuuacuuuu

SEQ ID NO: 832863 - RNA, 24 nt, Human
ugguuauauauauuaugugugugu

SEQ ID NO: 832864 - RNA, 19 nt, Human
uguuacaaaaugcccacuu

SEQ ID NO: 832865 - RNA, 24 nt, Human
uuaaagacacauucaaccaugcaa

SEQ ID NO: 832866 - RNA, 24 nt, Human
uuaaauauauccucuuuucuuccu

SEQ ID NO: 832867 - RNA, 22 nt, Human
uucacagguuaaaaaaaauaga

SEQ ID NO: 832868 - RNA, 23 nt, Human
uugaacauaaauagggauguaau

SEQ ID NO: 832869 - RNA, 21 nt, Human
uuggucucaacauuuuuaaaa

SEQ ID NO: 832870 - RNA, 24 nt, Human
uuucuuggaaaacuguaaagaaau

SEQ ID NO: 832871 - RNA, 26 nt, Human
aacaauaaauacuguacaggaagaga

SEQ ID NO: 832872 - RNA, 22 nt, Human
caggaacaauaaauacuguaca

SEQ ID NO: 832873 - RNA, 19 nt, Human
uacuguacaggaagagagu

SEQ ID NO: 832874 - RNA, 20 nt, Human
ugcacgugaacguccagauc

SEQ ID NO: 832875 - RNA, 20 nt, Human
uuaaauaaagugccaggaac

SEQ ID NO: 832876 - RNA, 20 nt, Human
uuuuuuuuuuuuugaggguc

SEQ ID NO: 832877 - RNA, 22 nt, Human
uuuuuuuuuuuuuuuuugaggg

SEQ ID NO: 832878 - RNA, 24 nt, Human
aaagaaaccuugugaacccucagu

SEQ ID NO: 832879 - RNA, 19 nt, Human
aaagagcugggagguucug

SEQ ID NO: 832880 - RNA, 19 nt, Human
aaagaggagagaggguagg

SEQ ID NO: 832881 - RNA, 26 nt, Human
aacaaugagagaacaaagaggagaga

SEQ ID NO: 832882 - RNA, 21 nt, Human
aaccucacgcucccccauccc

SEQ ID NO: 832883 - RNA, 18 nt, Human
aagaagcacgccgcccuc

SEQ ID NO: 832884 - RNA, 19 nt, Human
aaucucucccucccgacca

SEQ ID NO: 832885 - RNA, 18 nt, Human
acaacagcgcugcugaag

SEQ ID NO: 832886 - RNA, 20 nt, Human
acagggaagagacaaccgga

SEQ ID NO: 832887 - RNA, 21 nt, Human
acccaaauccacuaggagccc

SEQ ID NO: 832888 - RNA, 24 nt, Human
acccaaauccacuaggagcccaau

SEQ ID NO: 832889 - RNA, 21 nt, Human
acucuccacccuuccaguccu

SEQ ID NO: 832890 - RNA, 18 nt, Human
agaggagagaggguaggg

SEQ ID NO: 832891 - RNA, 24 nt, Human
agugcuggaagcugcagaucaacu

SEQ ID NO: 832892 - RNA, 24 nt, Human
aucucucccucccgaccaccccaa

SEQ ID NO: 832893 - RNA, 24 nt, Human
caaaagaaaccuugugaacccuca

SEQ ID NO: 832894 - RNA, 23 nt, Human
caacaaugagagaacaaagagga

SEQ ID NO: 832895 - RNA, 19 nt, Human
caagaaagccauagcgagc

SEQ ID NO: 832896 - RNA, 22 nt, Human
caagccuagcccgagauccucu

SEQ ID NO: 832897 - RNA, 20 nt, Human
cacccaaaacgucccaacgg

SEQ ID NO: 832898 - RNA, 21 nt, Human
cacccaaaacgucccaacgga

SEQ ID NO: 832899 - RNA, 20 nt, Human
caccccaaaagaaaccuugu

SEQ ID NO: 832900 - RNA, 22 nt, Human
cacgccucccccuacgcucaaa

SEQ ID NO: 832901 - RNA, 23 nt, Human
cacgcucccccaucccuucaccc

SEQ ID NO: 832902 - RNA, 26 nt, Human
ccaccccaaaagaaaccuugugaacc

SEQ ID NO: 832903 - RNA, 24 nt, Human
ccaguccucaguccccaauuugcc

SEQ ID NO: 832904 - RNA, 26 nt, Human
cccaaaacgucccaacggaaacggac

SEQ ID NO: 832905 - RNA, 24 nt, Human
cccaacggaaacggacccaaaucc

SEQ ID NO: 832906 - RNA, 18 nt, Human
ccccugagaucccccucu

SEQ ID NO: 832907 - RNA, 21 nt, Human
ccggagacagcaaagagcugg

SEQ ID NO: 832908 - RNA, 24 nt, Human
ccguucuacccagggucagcucca

SEQ ID NO: 832909 - RNA, 19 nt, Human
ccuacugugggacaacagc

SEQ ID NO: 832910 - RNA, 19 nt, Human
ccuagcccgagauccucug

SEQ ID NO: 832911 - RNA, 23 nt, Human
ccugagaucccccucucacgccu

SEQ ID NO: 832912 - RNA, 21 nt, Human
cgaccaccccaaaagaaaccu

SEQ ID NO: 832913 - RNA, 21 nt, Human
cgagcuuccuuguucccuaga

SEQ ID NO: 832914 - RNA, 20 nt, Human
cgagugcuggaagcugcaga

SEQ ID NO: 832915 - RNA, 26 nt, Human
cgcccucaagccuagcccgagauccu

SEQ ID NO: 832916 - RNA, 23 nt, Human
cgccucccccuacgcucaaaacc

SEQ ID NO: 832917 - RNA, 22 nt, Human
cggaaacggacccaaauccacu

SEQ ID NO: 832918 - RNA, 19 nt, Human
cucacgccucccccuacgc

SEQ ID NO: 832919 - RNA, 22 nt, Human
cucacgccucccccuacgcuca

SEQ ID NO: 832920 - RNA, 19 nt, Human
cucacgcucccccaucccu

SEQ ID NO: 832921 - RNA, 23 nt, Human
cuccagcucccuuguacuuuccc

SEQ ID NO: 832922 - RNA, 19 nt, Human
cucccucccgaccacccca

SEQ ID NO: 832923 - RNA, 19 nt, Human
cuccuggcaagaaagccau

SEQ ID NO: 832924 - RNA, 24 nt, Human
cucucccucccgaccaccccaaaa

SEQ ID NO: 832925 - RNA, 19 nt, Human
cugguuccgccuacucucc

SEQ ID NO: 832926 - RNA, 21 nt, Human
cuucccgacuacgagugcugg

SEQ ID NO: 832927 - RNA, 21 nt, Human
gacaaccggagacagcaaaga

SEQ ID NO: 832928 - RNA, 20 nt, Human
gagauccucugccccgacga

SEQ ID NO: 832929 - RNA, 19 nt, Human
gagugcuggaagcugcaga

SEQ ID NO: 832930 - RNA, 23 nt, Human
ggaagacuccacgccaaggaucc

SEQ ID NO: 832931 - RNA, 18 nt, Human
ggagaagggaggaagacu

SEQ ID NO: 832932 - RNA, 22 nt, Human
gggugcagcgcagagcgggugc

SEQ ID NO: 832933 - RNA, 18 nt, Human
gggugcggacagaagacc

SEQ ID NO: 832934 - RNA, 24 nt, Human
gggugcggacagaagaccuacugu

SEQ ID NO: 832935 - RNA, 19 nt, Human
uaacaacaaugagagaaca

SEQ ID NO: 832936 - RNA, 19 nt, Human
uaaggauaucgaggcuuuc

SEQ ID NO: 832937 - RNA, 21 nt, Human
uaaggauaucgaggcuuucug

SEQ ID NO: 832938 - RNA, 27 nt, Human
uacagggaagagacaaccggagacagc

SEQ ID NO: 832939 - RNA, 20 nt, Human
uacugugggacaacagcgcu

SEQ ID NO: 832940 - RNA, 20 nt, Human
ucacccguucuacccagggu

SEQ ID NO: 832941 - RNA, 18 nt, Human
uccacccuuccaguccuc

SEQ ID NO: 832942 - RNA, 22 nt, Human
uccaggaggaaaaguucacgga

SEQ ID NO: 832943 - RNA, 25 nt, Human
uccaggaggaaaaguucacggagaa

SEQ ID NO: 832944 - RNA, 26 nt, Human
uccaggaggaaaaguucacggagaaa

SEQ ID NO: 832945 - RNA, 24 nt, Human
ucccccaucccuucacccguucua

SEQ ID NO: 832946 - RNA, 21 nt, Human
uccccugagaucccccucuca

SEQ ID NO: 832947 - RNA, 20 nt, Human
ucccucccgaccaccccaaa

SEQ ID NO: 832948 - RNA, 21 nt, Human
uccucugccccgacgaccacc

SEQ ID NO: 832949 - RNA, 22 nt, Human
ucgucccuaagaagcacgccgc

SEQ ID NO: 832950 - RNA, 23 nt, Human
ucucacacccaaaacgucccaac

SEQ ID NO: 832951 - RNA, 21 nt, Human
ugaccuccuccccugagaucc

SEQ ID NO: 832952 - RNA, 22 nt, Human
ugaccuccuccccugagauccc

SEQ ID NO: 832953 - RNA, 21 nt, Human
ugagagaacaaagaggagaga

SEQ ID NO: 832954 - RNA, 20 nt, Human
ugccaaaguggggggcaagc

SEQ ID NO: 832955 - RNA, 25 nt, Human
uggcaagaaagccauagcgagcuuc

SEQ ID NO: 832956 - RNA, 22 nt, Human
ugggacaacagcgcugcugaag

SEQ ID NO: 832957 - RNA, 21 nt, Human
uggugaauuaaggauaucgag

SEQ ID NO: 832958 - RNA, 22 nt, Human
uuauuaaaauaacaacaaugag

SEQ ID NO: 832959 - RNA, 22 nt, Human
uuccaguccucaguccccaauu

SEQ ID NO: 832960 - RNA, 23 nt, Human
uucccuucgaccccuccuggcaa

SEQ ID NO: 832961 - RNA, 22 nt, Human
uucuacccagggucagcuccag

SEQ ID NO: 832962 - RNA, 23 nt, Human
aaacaaacggauaauucuuuaaa

SEQ ID NO: 832963 - RNA, 20 nt, Human
augagagaauaaaguauuua

SEQ ID NO: 832964 - RNA, 18 nt, Human
ggaaaaacaaacggauaa

SEQ ID NO: 832965 - RNA, 28 nt, Human
uaaagucaaaauuacagaaagaagcacc

SEQ ID NO: 832966 - RNA, 24 nt, Human
ugagagaauaaaguauuuuggaaa

SEQ ID NO: 832967 - RNA, 26 nt, Human
aaaauccgaaaugcuccuccggccgg

SEQ ID NO: 832968 - RNA, 28 nt, Human
aaacagaaagagggucuagaaaucccaa

SEQ ID NO: 832969 - RNA, 21 nt, Human
aaacagaagagauuugcucca

SEQ ID NO: 832970 - RNA, 24 nt, Human
aaacagaagagauuugcuccaaag

SEQ ID NO: 832971 - RNA, 25 nt, Human
aaacagaagucagaagugaccagga

SEQ ID NO: 832972 - RNA, 21 nt, Human
aaauaggaaagccaaugaugu

SEQ ID NO: 832973 - RNA, 21 nt, Human
aaaugcuccaaaauccaaaac

SEQ ID NO: 832974 - RNA, 19 nt, Human
aaccaauccagugugcacg

SEQ ID NO: 832975 - RNA, 19 nt, Human
aagaagaaauagaaaccac

SEQ ID NO: 832976 - RNA, 21 nt, Human
aagaagaaauagaaaccacuu

SEQ ID NO: 832977 - RNA, 24 nt, Human
aagaagaaauagaaaccacuuaaa

SEQ ID NO: 832978 - RNA, 22 nt, Human
aagagcuauagcagcgcagucc

SEQ ID NO: 832979 - RNA, 21 nt, Human
aagcauuuuggauaagggaua

SEQ ID NO: 832980 - RNA, 18 nt, Human
aaucacagaaacaagaga

SEQ ID NO: 832981 - RNA, 18 nt, Human
aaucuaaaauuugaaaca

SEQ ID NO: 832982 - RNA, 20 nt, Human
agaaaaucauucuuccucuc

SEQ ID NO: 832983 - RNA, 20 nt, Human
agaaagcaaucacagaaacu

SEQ ID NO: 832984 - RNA, 24 nt, Human
agaagaaauagaaaccacuuaaag

SEQ ID NO: 832985 - RNA, 23 nt, Human
agaagaauccuuccauugggugg

SEQ ID NO: 832986 - RNA, 24 nt, Human
agagaagcacacaauuggcuugag

SEQ ID NO: 832987 - RNA, 23 nt, Human
agcaaucccggccgguaagaccc

SEQ ID NO: 832988 - RNA, 21 nt, Human
agcagcugacagccuucuaca

SEQ ID NO: 832989 - RNA, 19 nt, Human
agcaggaagucuugcugcc

SEQ ID NO: 832990 - RNA, 19 nt, Human
agcaguaacuuuccuccau

SEQ ID NO: 832991 - RNA, 18 nt, Human
aggccccaggugccuuuc

SEQ ID NO: 832992 - RNA, 23 nt, Human
agggcuuaggauuuuauggaugg

SEQ ID NO: 832993 - RNA, 21 nt, Human
aggggcugggggacuggaggc

SEQ ID NO: 832994 - RNA, 18 nt, Human
agucuaggcauguggcug

SEQ ID NO: 832995 - RNA, 19 nt, Human
auaaaauuacccucaggcu

SEQ ID NO: 832996 - RNA, 20 nt, Human
auaaaauuacccucaggcua

SEQ ID NO: 832997 - RNA, 25 nt, Human
auaacuucuaucucucuaaacagaa

SEQ ID NO: 832998 - RNA, 22 nt, Human
auauacacauacaccauccaaa

SEQ ID NO: 832999 - RNA, 19 nt, Human
aucauucuuccucuccugc

SEQ ID NO: 833000 - RNA, 19 nt, Human
auuauguauaugcaaacau

SEQ ID NO: 833001 - RNA, 21 nt, Human
caaaauccgaaaugcuccaaa

SEQ ID NO: 833002 - RNA, 19 nt, Human
caacaagaaaaggcacugg

SEQ ID NO: 833003 - RNA, 26 nt, Human
caacaagacaaaaaaugggaaaagac

SEQ ID NO: 833004 - RNA, 19 nt, Human
caacagcuagggcccgagc

SEQ ID NO: 833005 - RNA, 21 nt, Human
cacacccccucccaagaaaca

SEQ ID NO: 833006 - RNA, 23 nt, Human
cacacccccucccaagaaacaga

SEQ ID NO: 833007 - RNA, 24 nt, Human
cacagaaacaagagaagcacacaa

SEQ ID NO: 833008 - RNA, 27 nt, Human
cacccccucccaagaaacagaaguugg

SEQ ID NO: 833009 - RNA, 20 nt, Human
cagaaaaauaggaaagccaa

SEQ ID NO: 833010 - RNA, 22 nt, Human
cagauuaaaacaauguccuuag

SEQ ID NO: 833011 - RNA, 22 nt, Human
cagcaagagcuauagcagcgca

SEQ ID NO: 833012 - RNA, 26 nt, Human
cagcaguaacuuuccuccaugggcuu

SEQ ID NO: 833013 - RNA, 21 nt, Human
cagggucaaggcugagaagaa

SEQ ID NO: 833014 - RNA, 24 nt, Human
cagugcaacccaugagaaccccaa

SEQ ID NO: 833015 - RNA, 20 nt, Human
cauaaaaaguccaaccguug

SEQ ID NO: 833016 - RNA, 18 nt, Human
caugcuucauguacacaa

SEQ ID NO: 833017 - RNA, 19 nt, Human
ccaacagcuagggcccgag

SEQ ID NO: 833018 - RNA, 22 nt, Human
ccacacccccucccaagaaaca

SEQ ID NO: 833019 - RNA, 20 nt, Human
ccaggcacccagcugcuuac

SEQ ID NO: 833020 - RNA, 23 nt, Human
cccaacuccacuggguuccaaaa

SEQ ID NO: 833021 - RNA, 19 nt, Human
ccccaggccccaggugccu

SEQ ID NO: 833022 - RNA, 21 nt, Human
ccccaggccccaggugccuuu

SEQ ID NO: 833023 - RNA, 23 nt, Human
cccgccacacccccucccaagaa

SEQ ID NO: 833024 - RNA, 22 nt, Human
ccgagcaagauaccaggccugc

SEQ ID NO: 833025 - RNA, 21 nt, Human
ccggccgguaagacccuucuc

SEQ ID NO: 833026 - RNA, 22 nt, Human
ccuaaguacaaagaaaaucauu

SEQ ID NO: 833027 - RNA, 19 nt, Human
ccugacaugagucagcucc

SEQ ID NO: 833028 - RNA, 24 nt, Human
ccugcuuggugucacacuuccucc

SEQ ID NO: 833029 - RNA, 22 nt, Human
ccuuagaaaaccuaaguacaaa

SEQ ID NO: 833030 - RNA, 23 nt, Human
ccuucucucggccaggggcuggg

SEQ ID NO: 833031 - RNA, 22 nt, Human
cggaauggcuaagacguaagca

SEQ ID NO: 833032 - RNA, 19 nt, Human
cggcacggagcccgggcgg

SEQ ID NO: 833033 - RNA, 21 nt, Human
cuuuuccaagaaguucaacaa

SEQ ID NO: 833034 - RNA, 25 nt, Human
gaaaccacuuaaagccucagggucc

SEQ ID NO: 833035 - RNA, 18 nt, Human
gacuggaggcagagaagg

SEQ ID NO: 833036 - RNA, 20 nt, Human
gagaagcacacaauuggcuu

SEQ ID NO: 833037 - RNA, 21 nt, Human
gagaggcagcaagagcuauag

SEQ ID NO: 833038 - RNA, 21 nt, Human
gagcaccaacaagacaaaaaa

SEQ ID NO: 833039 - RNA, 21 nt, Human
gcaaagcuuccauuaguaaaa

SEQ ID NO: 833040 - RNA, 21 nt, Human
gccucaguuuuguaaaauagg

SEQ ID NO: 833041 - RNA, 19 nt, Human
gcuuaggauuuuauggaug

SEQ ID NO: 833042 - RNA, 22 nt, Human
ggacuggaggcagagaaggugg

SEQ ID NO: 833043 - RNA, 21 nt, Human
gucuggggcauauugguggga

SEQ ID NO: 833044 - RNA, 24 nt, Human
uaaaaacagaagucagaagugacc

SEQ ID NO: 833045 - RNA, 24 nt, Human
uaaaauaucguauaaaauuacccu

SEQ ID NO: 833046 - RNA, 21 nt, Human
uaacagugauacaacuuuggc

SEQ ID NO: 833047 - RNA, 22 nt, Human
uaauaauaguugcccuucuccc

SEQ ID NO: 833048 - RNA, 24 nt, Human
uaauauguccauuaccacauucua

SEQ ID NO: 833049 - RNA, 26 nt, Human
uacacacaaaucuggacuuggugcca

SEQ ID NO: 833050 - RNA, 25 nt, Human
uacaccauccaaacagaaggugagc

SEQ ID NO: 833051 - RNA, 22 nt, Human
uaccaggccugccauccugaca

SEQ ID NO: 833052 - RNA, 22 nt, Human
uacucugcuugcuauucugcua

SEQ ID NO: 833053 - RNA, 24 nt, Human
uaguaaaaacagaagucagaagug

SEQ ID NO: 833054 - RNA, 19 nt, Human
uauauaaaaaaaaaagucc

SEQ ID NO: 833055 - RNA, 24 nt, Human
ucaauuaaaaaaugaacagaaaaa

SEQ ID NO: 833056 - RNA, 19 nt, Human
ucacugaggcucaaagcag

SEQ ID NO: 833057 - RNA, 18 nt, Human
ucaggcuauguggauaag

SEQ ID NO: 833058 - RNA, 26 nt, Human
uccaaaauccgaaaugcuccaaaauc

SEQ ID NO: 833059 - RNA, 20 nt, Human
uccaagaaguucaacaagaa

SEQ ID NO: 833060 - RNA, 22 nt, Human
uccaagaaguucaacaagaaaa

SEQ ID NO: 833061 - RNA, 18 nt, Human
ucccggccgguaagaccc

SEQ ID NO: 833062 - RNA, 28 nt, Human
uccugagccgccgggaggcaaggacucc

SEQ ID NO: 833063 - RNA, 18 nt, Human
ucuaucucucuaaacaga

SEQ ID NO: 833064 - RNA, 19 nt, Human
ucucggccaggggcugggg

SEQ ID NO: 833065 - RNA, 18 nt, Human
ugaccaggauguacagcc

SEQ ID NO: 833066 - RNA, 20 nt, Human
ugagaaaccaauccagugug

SEQ ID NO: 833067 - RNA, 26 nt, Human
ugagaaaccaauccagugugcacgag

SEQ ID NO: 833068 - RNA, 21 nt, Human
ugagaacauaucuugaaauaa

SEQ ID NO: 833069 - RNA, 22 nt, Human
ugagaaccccaacagcuagggc

SEQ ID NO: 833070 - RNA, 18 nt, Human
ugagaagaauccuuccau

SEQ ID NO: 833071 - RNA, 26 nt, Human
ugagcuggggagcaggacggaauggc

SEQ ID NO: 833072 - RNA, 21 nt, Human
ugcacgagaggccccaggcac

SEQ ID NO: 833073 - RNA, 20 nt, Human
ugcauacacaaaucuuuuga

SEQ ID NO: 833074 - RNA, 22 nt, Human
ugccccgccacacccccuccca

SEQ ID NO: 833075 - RNA, 31 nt, Human
ugccccgccacacccccucccaagaaacagg

SEQ ID NO: 833076 - RNA, 24 nt, Human
ugccuuuccccaugcauauacaca

SEQ ID NO: 833077 - RNA, 21 nt, Human
uggcacgauacagauuaaaac

SEQ ID NO: 833078 - RNA, 23 nt, Human
uggcggcacggagcccgggcggu

SEQ ID NO: 833079 - RNA, 18 nt, Human
uggcugaaccucacuaag

SEQ ID NO: 833080 - RNA, 19 nt, Human
uggcugcaaaagucuucau

SEQ ID NO: 833081 - RNA, 20 nt, Human
uggcuugagaacauaucuug

SEQ ID NO: 833082 - RNA, 19 nt, Human
uggggcauauuggugggaa

SEQ ID NO: 833083 - RNA, 21 nt, Human
uguauuacauaugucauaacu

SEQ ID NO: 833084 - RNA, 24 nt, Human
ugugcuucagagagugagcugggg

SEQ ID NO: 833085 - RNA, 19 nt, Human
uguguacacagauguguau

SEQ ID NO: 833086 - RNA, 27 nt, Human
uguguacacagauguguauuacauaug

SEQ ID NO: 833087 - RNA, 24 nt, Human
uuaaaacaauguccuuagaaaacc

SEQ ID NO: 833088 - RNA, 19 nt, Human
uuagagcuauucaagagag

SEQ ID NO: 833089 - RNA, 22 nt, Human
uuaguaaaaacagaagucagaa

SEQ ID NO: 833090 - RNA, 19 nt, Human
uucagagauagacuuugcc

SEQ ID NO: 833091 - RNA, 24 nt, Human
uugcugccuugcuggcaagacuug

SEQ ID NO: 833092 - RNA, 20 nt, Human
acaacuagaagccacaggac

SEQ ID NO: 833093 - RNA, 18 nt, Human
accaaugcuugaaauauu

SEQ ID NO: 833094 - RNA, 21 nt, Human
agugaacugcucucugguggu

SEQ ID NO: 833095 - RNA, 24 nt, Human
auuuacaaguccauuaauucacaa

SEQ ID NO: 833096 - RNA, 25 nt, Human
caaaauaauagguacagaauggaua

SEQ ID NO: 833097 - RNA, 22 nt, Human
caggcacacaacuagaagccac

SEQ ID NO: 833098 - RNA, 18 nt, Human
cagugguccuaagagguc

SEQ ID NO: 833099 - RNA, 19 nt, Human
cauaaauaagacccuauca

SEQ ID NO: 833100 - RNA, 24 nt, Human
cugaucucaggcacacaacuagaa

SEQ ID NO: 833101 - RNA, 23 nt, Human
cuugaaguuuauaaaaugguuug

SEQ ID NO: 833102 - RNA, 18 nt, Human
cuuggcuugauaacccag

SEQ ID NO: 833103 - RNA, 26 nt, Human
cuuuaaauagcuuggcuugauaaccc

SEQ ID NO: 833104 - RNA, 19 nt, Human
gaacugaaaagcaugagca

SEQ ID NO: 833105 - RNA, 21 nt, Human
uaaaagacugauugcauuguu

SEQ ID NO: 833106 - RNA, 19 nt, Human
uaacaugagucucuggauc

SEQ ID NO: 833107 - RNA, 22 nt, Human
uaagacccuaucagaaguucac

SEQ ID NO: 833108 - RNA, 21 nt, Human
uaagaggucuuccuuccaucc

SEQ ID NO: 833109 - RNA, 24 nt, Human
uaaguacaauauuauaccugcaaa

SEQ ID NO: 833110 - RNA, 18 nt, Human
uagcuuggcuugauaacc

SEQ ID NO: 833111 - RNA, 24 nt, Human
uauaaaauugagcaagaaucuuga

SEQ ID NO: 833112 - RNA, 23 nt, Human
uaucuggaacaauuauacugaga

SEQ ID NO: 833113 - RNA, 20 nt, Human
ucauuccaagcugauuuaau

SEQ ID NO: 833114 - RNA, 20 nt, Human
uccaucauaguuuuaucugg

SEQ ID NO: 833115 - RNA, 24 nt, Human
uccuaagaggucuuccuuccaucc

SEQ ID NO: 833116 - RNA, 22 nt, Human
ugagaacaaaauaauagguaca

SEQ ID NO: 833117 - RNA, 22 nt, Human
ugcauuguuucauuuacaaguc

SEQ ID NO: 833118 - RNA, 23 nt, Human
ugcauuguuucauuuacaagucc

SEQ ID NO: 833119 - RNA, 21 nt, Human
uguaccacuuguauccaaaaa

SEQ ID NO: 833120 - RNA, 23 nt, Human
uucucggaauaaauaaaucucug

SEQ ID NO: 833121 - RNA, 18 nt, Human
uuuguucuuuucauaaag

SEQ ID NO: 833122 - RNA, 24 nt, Human
uuuuuuauuuucuuuauuuuugau

SEQ ID NO: 833123 - RNA, 19 nt, Human
aaaaucacaaaacccacua

SEQ ID NO: 833124 - RNA, 22 nt, Human
acacgcggucucgugccgaauu

SEQ ID NO: 833125 - RNA, 22 nt, Human
agaauaacuuaaauauuaaaac

SEQ ID NO: 833126 - RNA, 24 nt, Human
agagaccuaaaauccaguauagga

SEQ ID NO: 833127 - RNA, 21 nt, Human
caagauagaauaacuuaaaua

SEQ ID NO: 833128 - RNA, 22 nt, Human
cagcaguucuucagagaccuaa

SEQ ID NO: 833129 - RNA, 23 nt, Human
cauacaaacucaucucccuauga

SEQ ID NO: 833130 - RNA, 19 nt, Human
ccuaugaccuacugaaacu

SEQ ID NO: 833131 - RNA, 20 nt, Human
ccuucgucuccgcggccucg

SEQ ID NO: 833132 - RNA, 22 nt, Human
gcgcagguuugguuccacacgg

SEQ ID NO: 833133 - RNA, 23 nt, Human
uaaagacauuuuucccugaaaca

SEQ ID NO: 833134 - RNA, 23 nt, Human
uacagcauacaaacucaucuccc

SEQ ID NO: 833135 - RNA, 25 nt, Human
uaguacagcauacaaacucaucucc

SEQ ID NO: 833136 - RNA, 21 nt, Human
uauaggaauaacuguguuagu

SEQ ID NO: 833137 - RNA, 21 nt, Human
uccaagauagaauaacuuaaa

SEQ ID NO: 833138 - RNA, 18 nt, Human
ucccugaaacauacagaa

SEQ ID NO: 833139 - RNA, 19 nt, Human
uguaacagacagcaauauu

SEQ ID NO: 833140 - RNA, 19 nt, Human
uuccacacgggcccacugg

SEQ ID NO: 833141 - RNA, 20 nt, Human
aaaacuuuuucacccagagg

SEQ ID NO: 833142 - RNA, 23 nt, Human
cagacgaggcccgggaagggcag

SEQ ID NO: 833143 - RNA, 21 nt, Human
cagcccccgcccgaggccucg

SEQ ID NO: 833144 - RNA, 19 nt, Human
ccagcccacuacaaaaagg

SEQ ID NO: 833145 - RNA, 21 nt, Human
ccagccccuggcggggcccug

SEQ ID NO: 833146 - RNA, 25 nt, Human
ccagccccuggcggggcccugugau

SEQ ID NO: 833147 - RNA, 18 nt, Human
cccacuacaaaaagggau

SEQ ID NO: 833148 - RNA, 24 nt, Human
cccacuacaaaaagggaugggagc

SEQ ID NO: 833149 - RNA, 24 nt, Human
cccacuggagaccuggaaccccgg

SEQ ID NO: 833150 - RNA, 18 nt, Human
cccagccccuggcggggc

SEQ ID NO: 833151 - RNA, 19 nt, Human
cccgaggcccagagcagcu

SEQ ID NO: 833152 - RNA, 24 nt, Human
cccgggccagcccccgcccgaggc

SEQ ID NO: 833153 - RNA, 20 nt, Human
cccugugcaccggccucucc

SEQ ID NO: 833154 - RNA, 19 nt, Human
ccgccggccccgcucgcuc

SEQ ID NO: 833155 - RNA, 20 nt, Human
ccucuccgguuggggcaggg

SEQ ID NO: 833156 - RNA, 21 nt, Human
ccucuccgguuggggcaggga

SEQ ID NO: 833157 - RNA, 18 nt, Human
ccuggaaccccgggccag

SEQ ID NO: 833158 - RNA, 24 nt, Human
gaccuggaaccccgggccagcccc

SEQ ID NO: 833159 - RNA, 22 nt, Human
gagaccuggaaccccgggccag

SEQ ID NO: 833160 - RNA, 20 nt, Human
gagcaauaaaaacugugcaa

SEQ ID NO: 833161 - RNA, 18 nt, Human
gcaccggccucuccgguu

SEQ ID NO: 833162 - RNA, 18 nt, Human
gcgcccgccgccggcccc

SEQ ID NO: 833163 - RNA, 22 nt, Human
gggaagggcagcccaggggacu

SEQ ID NO: 833164 - RNA, 22 nt, Human
gggcagcccaggggacuggggu

SEQ ID NO: 833165 - RNA, 24 nt, Human
gggcagcccaggggacuggggucu

SEQ ID NO: 833166 - RNA, 24 nt, Human
gggccagcccccgcccgaggccuc

SEQ ID NO: 833167 - RNA, 23 nt, Human
gggucucuccucucccgaggccc

SEQ ID NO: 833168 - RNA, 20 nt, Human
ucccgaggcccagagcagcu

SEQ ID NO: 833169 - RNA, 21 nt, Human
ucccgaggcccagagcagcug

SEQ ID NO: 833170 - RNA, 21 nt, Human
ucggcgucccucggcgcccgc

SEQ ID NO: 833171 - RNA, 21 nt, Human
ucugcagcccccacuggagac

SEQ ID NO: 833172 - RNA, 20 nt, Human
ugaccaaaggacccagacag

SEQ ID NO: 833173 - RNA, 24 nt, Human
ugcccccagccccuggcggggccc

SEQ ID NO: 833174 - RNA, 20 nt, Human
uggaaccccgggccagcccc

SEQ ID NO: 833175 - RNA, 21 nt, Human
uggaaccccgggccagccccc

SEQ ID NO: 833176 - RNA, 19 nt, Human
uggaagccgggaugccccc

SEQ ID NO: 833177 - RNA, 22 nt, Human
uggagaccuggaaccccgggcc

SEQ ID NO: 833178 - RNA, 19 nt, Human
uuaaaacccagcccacuac

SEQ ID NO: 833179 - RNA, 18 nt, Human
aaacagauacacagcuau

SEQ ID NO: 833180 - RNA, 19 nt, Human
aaacagauacacagcuauu

SEQ ID NO: 833181 - RNA, 25 nt, Human
aaaccuacaagugacacagacccaa

SEQ ID NO: 833182 - RNA, 19 nt, Human
aagaaaaggaaagugagaa

SEQ ID NO: 833183 - RNA, 22 nt, Human
aagaugccuuucaccuacaccc

SEQ ID NO: 833184 - RNA, 23 nt, Human
acagacccaagguggcaguucca

SEQ ID NO: 833185 - RNA, 22 nt, Human
acagugagggcugacaguggaa

SEQ ID NO: 833186 - RNA, 22 nt, Human
agaaagaugccuuucaccuaca

SEQ ID NO: 833187 - RNA, 20 nt, Human
agacaagaaaaggaaaguga

SEQ ID NO: 833188 - RNA, 23 nt, Human
agacaagaaaaggaaagugagaa

SEQ ID NO: 833189 - RNA, 22 nt, Human
agaccuagcacagcgaucuugc

SEQ ID NO: 833190 - RNA, 21 nt, Human
agcagaccuaguagaggccug

SEQ ID NO: 833191 - RNA, 21 nt, Human
agcaucuagcuagugcccagu

SEQ ID NO: 833192 - RNA, 18 nt, Human
agccauucacagcuaaag

SEQ ID NO: 833193 - RNA, 21 nt, Human
agcugaagcaaccuaaagcau

SEQ ID NO: 833194 - RNA, 20 nt, Human
agcugaagcaaccuaaagcc

SEQ ID NO: 833195 - RNA, 23 nt, Human
aggaaagugagaagagauaaggc

SEQ ID NO: 833196 - RNA, 25 nt, Human
aggcagcaggacugguucaggagca

SEQ ID NO: 833197 - RNA, 21 nt, Human
aggccuggccuucuagaccug

SEQ ID NO: 833198 - RNA, 22 nt, Human
agggauggggugggcagggucu

SEQ ID NO: 833199 - RNA, 19 nt, Human
aggucaguggagagucuuc

SEQ ID NO: 833200 - RNA, 21 nt, Human
agguggcaguuccacagugcc

SEQ ID NO: 833201 - RNA, 18 nt, Human
aucuagcuagugcccagu

SEQ ID NO: 833202 - RNA, 22 nt, Human
caaaaugggcuguggcugccag

SEQ ID NO: 833203 - RNA, 18 nt, Human
caacucaaauaguguggc

SEQ ID NO: 833204 - RNA, 20 nt, Human
caagugacacagacccaagg

SEQ ID NO: 833205 - RNA, 22 nt, Human
caagugacacagacccaaggug

SEQ ID NO: 833206 - RNA, 24 nt, Human
cacagacccaagguggcaguucca

SEQ ID NO: 833207 - RNA, 23 nt, Human
cacaggccuuuugcagcuugcca

SEQ ID NO: 833208 - RNA, 25 nt, Human
cacccucaccucaaagauggugaaa

SEQ ID NO: 833209 - RNA, 21 nt, Human
cacccugggcuccacucugcc

SEQ ID NO: 833210 - RNA, 18 nt, Human
caccucacagaguugaag

SEQ ID NO: 833211 - RNA, 19 nt, Human
cacuccacuucucugccug

SEQ ID NO: 833212 - RNA, 20 nt, Human
cacuccacuucucugccugc

SEQ ID NO: 833213 - RNA, 19 nt, Human
cacucugccccagcacccc

SEQ ID NO: 833214 - RNA, 23 nt, Human
cagaaaccugagcuccauguacu

SEQ ID NO: 833215 - RNA, 22 nt, Human
cagaauagggacauccacagca

SEQ ID NO: 833216 - RNA, 22 nt, Human
cagaggccugaauccuggcccu

SEQ ID NO: 833217 - RNA, 22 nt, Human
cagcacccugggcuccacucug

SEQ ID NO: 833218 - RNA, 21 nt, Human
cagcagcaggugggugugagg

SEQ ID NO: 833219 - RNA, 18 nt, Human
cagcaggcacaggggggu

SEQ ID NO: 833220 - RNA, 20 nt, Human
cagcaggcugucgaugucgg

SEQ ID NO: 833221 - RNA, 19 nt, Human
cagccccuccccacgcucc

SEQ ID NO: 833222 - RNA, 19 nt, Human
cagcugcugucugucccac

SEQ ID NO: 833223 - RNA, 26 nt, Human
cagcugcugucugucccacuccuccu

SEQ ID NO: 833224 - RNA, 19 nt, Human
caggaaagggcgcggggug

SEQ ID NO: 833225 - RNA, 20 nt, Human
caggagccagugugugucug

SEQ ID NO: 833226 - RNA, 23 nt, Human
caggcacaggggggugcaguggg

SEQ ID NO: 833227 - RNA, 21 nt, Human
cauacagcagcaggugggugu

SEQ ID NO: 833228 - RNA, 20 nt, Human
cauggaaugagcaucccuga

SEQ ID NO: 833229 - RNA, 25 nt, Human
ccacccucaccucaaagauggugaa

SEQ ID NO: 833230 - RNA, 24 nt, Human
ccacuccuccugucuggagccuac

SEQ ID NO: 833231 - RNA, 22 nt, Human
ccagcaccccugagaacaacuc

SEQ ID NO: 833232 - RNA, 21 nt, Human
ccaggccuggacgcucccaug

SEQ ID NO: 833233 - RNA, 21 nt, Human
ccagggauggggugggcaggg

SEQ ID NO: 833234 - RNA, 21 nt, Human
ccagugcccagcaggcacagg

SEQ ID NO: 833235 - RNA, 20 nt, Human
cccagcaggcugucgauguc

SEQ ID NO: 833236 - RNA, 28 nt, Human
cccaggguuaggaucaggaccggggucc

SEQ ID NO: 833237 - RNA, 20 nt, Human
cccugggaucugagggcuuu

SEQ ID NO: 833238 - RNA, 21 nt, Human
cccugggcuccacucugcccc

SEQ ID NO: 833239 - RNA, 24 nt, Human
cccugggcuccacucugccccagc

SEQ ID NO: 833240 - RNA, 24 nt, Human
ccggcgauauuuggcuacucuaga

SEQ ID NO: 833241 - RNA, 21 nt, Human
ccucagaggccugaauccugg

SEQ ID NO: 833242 - RNA, 18 nt, Human
ccugccgccuuccugggc

SEQ ID NO: 833243 - RNA, 19 nt, Human
ccugcuggucgaacacuuc

SEQ ID NO: 833244 - RNA, 25 nt, Human
ccugcuguugaggcaaccuggaggc

SEQ ID NO: 833245 - RNA, 19 nt, Human
ccuggagggcaguggggcu

SEQ ID NO: 833246 - RNA, 25 nt, Human
ccuggaucacaggccuuuugcagcc

SEQ ID NO: 833247 - RNA, 21 nt, Human
ccugggaucugagggcuuuac

SEQ ID NO: 833248 - RNA, 18 nt, Human
cgaugucggggucuucac

SEQ ID NO: 833249 - RNA, 23 nt, Human
cuaaagcaucuagcuagugccca

SEQ ID NO: 833250 - RNA, 21 nt, Human
cucagccccuccccacgcucc

SEQ ID NO: 833251 - RNA, 23 nt, Human
cuccacuucucugccugccgccu

SEQ ID NO: 833252 - RNA, 22 nt, Human
cuccaggcagcaggacugguuc

SEQ ID NO: 833253 - RNA, 18 nt, Human
cucccaucaggcacugug

SEQ ID NO: 833254 - RNA, 23 nt, Human
cuccugucuggagccuacuccca

SEQ ID NO: 833255 - RNA, 20 nt, Human
cugcugucugucccacuccu

SEQ ID NO: 833256 - RNA, 21 nt, Human
cuggcccagcagcuuugcccc

SEQ ID NO: 833257 - RNA, 21 nt, Human
cuggcuacugacuccaggcag

SEQ ID NO: 833258 - RNA, 21 nt, Human
cugugccuccugcuguugagg

SEQ ID NO: 833259 - RNA, 18 nt, Human
cuuccuagcuggggcacc

SEQ ID NO: 833260 - RNA, 20 nt, Human
gacaggcaaguggguggagg

SEQ ID NO: 833261 - RNA, 18 nt, Human
gagggaauggagaagagu

SEQ ID NO: 833262 - RNA, 22 nt, Human
gcaaccuggaggcagagaaacc

SEQ ID NO: 833263 - RNA, 21 nt, Human
gcaggucagccagggaugggg

SEQ ID NO: 833264 - RNA, 19 nt, Human
gccaagggguggcagcacc

SEQ ID NO: 833265 - RNA, 20 nt, Human
gcccagcagcuuugccccgu

SEQ ID NO: 833266 - RNA, 23 nt, Human
gccccagcaccccugagaacaac

SEQ ID NO: 833267 - RNA, 19 nt, Human
gcccuagggcacacagaua

SEQ ID NO: 833268 - RNA, 21 nt, Human
gcccugagcccaugguuaggc

SEQ ID NO: 833269 - RNA, 19 nt, Human
gcccuggagggcagugggg

SEQ ID NO: 833270 - RNA, 24 nt, Human
gccuuuugcagcuugccagcuaca

SEQ ID NO: 833271 - RNA, 20 nt, Human
gcgugacccaggccuggacg

SEQ ID NO: 833272 - RNA, 21 nt, Human
gcugacagugagggcugacag

SEQ ID NO: 833273 - RNA, 20 nt, Human
gcuuagaguucagauuuucc

SEQ ID NO: 833274 - RNA, 22 nt, Human
ggagcagaccuaguagaggccu

SEQ ID NO: 833275 - RNA, 25 nt, Human
ggaggcagagaaaccuacaagugac

SEQ ID NO: 833276 - RNA, 19 nt, Human
ggagggcaguggggcuggg

SEQ ID NO: 833277 - RNA, 23 nt, Human
ggagggcaguggggcuggggugg

SEQ ID NO: 833278 - RNA, 21 nt, Human
ggaugugaauuuauuucuugg

SEQ ID NO: 833279 - RNA, 18 nt, Human
ggcagauggugccuggca

SEQ ID NO: 833280 - RNA, 19 nt, Human
ggcauuggcagauggugcc

SEQ ID NO: 833281 - RNA, 18 nt, Human
ggccuuagcuccagcuca

SEQ ID NO: 833282 - RNA, 20 nt, Human
gggagacagggucccagcag

SEQ ID NO: 833283 - RNA, 25 nt, Human
gggcagggucuguguagcccuggga

SEQ ID NO: 833284 - RNA, 21 nt, Human
gggugcuauucuccaaauagu

SEQ ID NO: 833285 - RNA, 19 nt, Human
gugaaacugcugugccucc

SEQ ID NO: 833286 - RNA, 19 nt, Human
gugacaggcaagugggugg

SEQ ID NO: 833287 - RNA, 21 nt, Human
uaaaaggacucuucuugucca

SEQ ID NO: 833288 - RNA, 19 nt, Human
uacacagcuauucauacag

SEQ ID NO: 833289 - RNA, 18 nt, Human
uagaguccuccagggagc

SEQ ID NO: 833290 - RNA, 21 nt, Human
uauugguauccaccucacaga

SEQ ID NO: 833291 - RNA, 25 nt, Human
ucacucacugccggcgauauuuggc

SEQ ID NO: 833292 - RNA, 23 nt, Human
ucagaccuagcacagcgaucuug

SEQ ID NO: 833293 - RNA, 23 nt, Human
ucaggacaacagguggggcacag

SEQ ID NO: 833294 - RNA, 22 nt, Human
uccacagugccaagggguggca

SEQ ID NO: 833295 - RNA, 19 nt, Human
uccacuucucugccugccg

SEQ ID NO: 833296 - RNA, 21 nt, Human
ucccagcacccugggcuccac

SEQ ID NO: 833297 - RNA, 22 nt, Human
ucccugugggacaucuuuccug

SEQ ID NO: 833298 - RNA, 18 nt, Human
uccucagccccuccccac

SEQ ID NO: 833299 - RNA, 23 nt, Human
uccucagccccuccccacgcucc

SEQ ID NO: 833300 - RNA, 18 nt, Human
uccugggccugugacugc

SEQ ID NO: 833301 - RNA, 24 nt, Human
ucuagaccuggacaaccaggucag

SEQ ID NO: 833302 - RNA, 24 nt, Human
ucugacuuuuauuagcugugugau

SEQ ID NO: 833303 - RNA, 18 nt, Human
ucugucuccucuccucug

SEQ ID NO: 833304 - RNA, 19 nt, Human
ugaaggaucagcugaagca

SEQ ID NO: 833305 - RNA, 19 nt, Human
ugacacagacccaaggugg

SEQ ID NO: 833306 - RNA, 22 nt, Human
ugagcuucuagaguccuccagg

SEQ ID NO: 833307 - RNA, 19 nt, Human
ugaggagaaaaccuccugc

SEQ ID NO: 833308 - RNA, 19 nt, Human
ugcauccaggccacugccc

SEQ ID NO: 833309 - RNA, 21 nt, Human
ugccccagcaccccugagaac

SEQ ID NO: 833310 - RNA, 22 nt, Human
ugccccagcaccccugagaaca

SEQ ID NO: 833311 - RNA, 22 nt, Human
ugccccagcaccccugagaaca

SEQ ID NO: 833312 - RNA, 23 nt, Human
ugccccagcaccccugagaacaa

SEQ ID NO: 833313 - RNA, 20 nt, Human
ugccucuccaucuuucugcc

SEQ ID NO: 833314 - RNA, 18 nt, Human
ugccuuucaccuacaccc

SEQ ID NO: 833315 - RNA, 23 nt, Human
ugcugucugucccacuccuccug

SEQ ID NO: 833316 - RNA, 20 nt, Human
uggaaaaacagauacacagc

SEQ ID NO: 833317 - RNA, 21 nt, Human
uggaaugagcaucccugaaca

SEQ ID NO: 833318 - RNA, 18 nt, Human
uggaauuggugagcaggu

SEQ ID NO: 833319 - RNA, 25 nt, Human
uggacagugccaucuucucagugau

SEQ ID NO: 833320 - RNA, 19 nt, Human
uggagggcaguggggcugg

SEQ ID NO: 833321 - RNA, 21 nt, Human
uggagggcaguggggcugggg

SEQ ID NO: 833322 - RNA, 23 nt, Human
uggaugcagcgagugggcugagg

SEQ ID NO: 833323 - RNA, 18 nt, Human
uggcagauggugccuggc

SEQ ID NO: 833324 - RNA, 27 nt, Human
uggcagauggugccuggcagccugguc

SEQ ID NO: 833325 - RNA, 19 nt, Human
uggccaacucaaauagugu

SEQ ID NO: 833326 - RNA, 19 nt, Human
ugggcaggaaagggcgcgg

SEQ ID NO: 833327 - RNA, 19 nt, Human
uggggagggcuggggaaga

SEQ ID NO: 833328 - RNA, 19 nt, Human
uggggcaggaaguggaauu

SEQ ID NO: 833329 - RNA, 19 nt, Human
uggggcugacagugagggc

SEQ ID NO: 833330 - RNA, 21 nt, Human
ugggguauccucagccccucc

SEQ ID NO: 833331 - RNA, 23 nt, Human
ugguauccaccucacagaguuga

SEQ ID NO: 833332 - RNA, 24 nt, Human
uggugagcagguggggagggcugg

SEQ ID NO: 833333 - RNA, 19 nt, Human
ugguuaggcagagucaugg

SEQ ID NO: 833334 - RNA, 21 nt, Human
uguacccugggaucugagggc

SEQ ID NO: 833335 - RNA, 24 nt, Human
ugugaauuuauuucuuggccaacu

SEQ ID NO: 833336 - RNA, 20 nt, Human
ugugucugucuccucuccuc

SEQ ID NO: 833337 - RNA, 18 nt, Human
uucaagagaaugaaauuc

SEQ ID NO: 833338 - RNA, 21 nt, Human
uucagaaagaugccuuucacc

SEQ ID NO: 833339 - RNA, 24 nt, Human
uuccacagugccaagggguggcag

SEQ ID NO: 833340 - RNA, 19 nt, Human
uuccuugagcgugacccag

SEQ ID NO: 833341 - RNA, 23 nt, Human
uugcagcuugccagcuacauggg

SEQ ID NO: 833342 - RNA, 22 nt, Human
uuucccacacagagugccacug

SEQ ID NO: 833343 - RNA, 18 nt, Human
uuuuuuuuuuuuuuccug

SEQ ID NO: 833344 - RNA, 20 nt, Human
aacauagugagacuccaucu

SEQ ID NO: 833345 - RNA, 21 nt, Human
aacauagugagacuccaucuc

SEQ ID NO: 833346 - RNA, 23 nt, Human
aagcagucagugggauggggagc

SEQ ID NO: 833347 - RNA, 19 nt, Human
aagccucuggcugacccag

SEQ ID NO: 833348 - RNA, 26 nt, Human
aaggaacugacccagaaggcaggaag

SEQ ID NO: 833349 - RNA, 18 nt, Human
aagggaggcaggccuggg

SEQ ID NO: 833350 - RNA, 24 nt, Human
acacacacagugaccugcaugcag

SEQ ID NO: 833351 - RNA, 21 nt, Human
acacacagccacaugacacac

SEQ ID NO: 833352 - RNA, 25 nt, Human
acacacagucagucaacacucacac

SEQ ID NO: 833353 - RNA, 19 nt, Human
acacacagugaccugcaug

SEQ ID NO: 833354 - RNA, 24 nt, Human
acacagccacaugacacacacgcc

SEQ ID NO: 833355 - RNA, 33 nt, Human
acacaugcacacacacagugaccugcaugcagu

SEQ ID NO: 833356 - RNA, 23 nt, Human
acacucacacaggcacacaugca

SEQ ID NO: 833357 - RNA, 19 nt, Human
acagcauaauacacaccac

SEQ ID NO: 833358 - RNA, 28 nt, Human
acccagccccagccccggccccguucua

SEQ ID NO: 833359 - RNA, 19 nt, Human
accucucuccuccaaccuc

SEQ ID NO: 833360 - RNA, 23 nt, Human
acugcucuggggucugagaaaau

SEQ ID NO: 833361 - RNA, 22 nt, Human
agaaggagccaggccuagggaa

SEQ ID NO: 833362 - RNA, 19 nt, Human
agacuugaauaaggaacug

SEQ ID NO: 833363 - RNA, 24 nt, Human
agccugagcaacauagugagacuc

SEQ ID NO: 833364 - RNA, 24 nt, Human
aggauugcuugagcccaggaguuc

SEQ ID NO: 833365 - RNA, 18 nt, Human
aggcacagugguguacac

SEQ ID NO: 833366 - RNA, 18 nt, Human
aggcagaggucacacaca

SEQ ID NO: 833367 - RNA, 23 nt, Human
aggcaggaggauugcuugagccc

SEQ ID NO: 833368 - RNA, 24 nt, Human
aggcaggaggauugcuugagccca

SEQ ID NO: 833369 - RNA, 21 nt, Human
aggcugaggcaggaggauugc

SEQ ID NO: 833370 - RNA, 24 nt, Human
aggcugaggcaggaggauugcuug

SEQ ID NO: 833371 - RNA, 21 nt, Human
agucaacacucacacaggcac

SEQ ID NO: 833372 - RNA, 25 nt, Human
augcacacacacagugaccugcaug

SEQ ID NO: 833373 - RNA, 22 nt, Human
augcagcaggcccagaggccaa

SEQ ID NO: 833374 - RNA, 24 nt, Human
auugcuugagcccaggaguucaag

SEQ ID NO: 833375 - RNA, 30 nt, Human
caaaucccguggcacauacaccacaguucu

SEQ ID NO: 833376 - RNA, 25 nt, Human
caacagaaggagccaggccuaggga

SEQ ID NO: 833377 - RNA, 19 nt, Human
caagccucuggcugaccca

SEQ ID NO: 833378 - RNA, 22 nt, Human
cacacacacagucagucaacac

SEQ ID NO: 833379 - RNA, 28 nt, Human
cacacaggcacacaugcacacacacagu

SEQ ID NO: 833380 - RNA, 20 nt, Human
cacacagucagucaacacuc

SEQ ID NO: 833381 - RNA, 18 nt, Human
caccccuccacacacaca

SEQ ID NO: 833382 - RNA, 21 nt, Human
caccccuccacggacagucac

SEQ ID NO: 833383 - RNA, 22 nt, Human
caccucucuccuccaaccucug

SEQ ID NO: 833384 - RNA, 19 nt, Human
cacggacacagucaccccu

SEQ ID NO: 833385 - RNA, 28 nt, Human
cacuaggggacccagccccagccccggc

SEQ ID NO: 833386 - RNA, 24 nt, Human
cagagggcagagggcuucuguaac

SEQ ID NO: 833387 - RNA, 21 nt, Human
cagccacaugacacacacgcc

SEQ ID NO: 833388 - RNA, 23 nt, Human
cagccccagccccggccccguuc

SEQ ID NO: 833389 - RNA, 22 nt, Human
caggcccagaggccaccagagg

SEQ ID NO: 833390 - RNA, 18 nt, Human
cagucagucaacacucac

SEQ ID NO: 833391 - RNA, 28 nt, Human
cagucagucaacacucacacaggcacac

SEQ ID NO: 833392 - RNA, 23 nt, Human
cagugguguacacuuaaaguccc

SEQ ID NO: 833393 - RNA, 24 nt, Human
cauagugagacuccaucucuaaaa

SEQ ID NO: 833394 - RNA, 33 nt, Human
caugcacacacacagugaccugcaugcauggug

SEQ ID NO: 833395 - RNA, 27 nt, Human
cauggcuccgaagugguaggagacagg

SEQ ID NO: 833396 - RNA, 20 nt, Human
ccagccccagccccggcccc

SEQ ID NO: 833397 - RNA, 22 nt, Human
ccagggacuggcugcuucacac

SEQ ID NO: 833398 - RNA, 21 nt, Human
ccccuccacacacacacaguc

SEQ ID NO: 833399 - RNA, 23 nt, Human
cccgcacaccugggucugagcca

SEQ ID NO: 833400 - RNA, 25 nt, Human
cccgcacaccugggucugagccaca

SEQ ID NO: 833401 - RNA, 26 nt, Human
cccuccacacacacacagucagucaa

SEQ ID NO: 833402 - RNA, 21 nt, Human
ccuccacggacagucacccuu

SEQ ID NO: 833403 - RNA, 28 nt, Human
ccucccgaugaacagaaggguuggaggu

SEQ ID NO: 833404 - RNA, 19 nt, Human
ccucucuccuccaaccucu

SEQ ID NO: 833405 - RNA, 23 nt, Human
ccucugcaucauuaauacugcuc

SEQ ID NO: 833406 - RNA, 24 nt, Human
cgccaaacccugacaguguugccc

SEQ ID NO: 833407 - RNA, 21 nt, Human
cuccaccucucuccuccaacc

SEQ ID NO: 833408 - RNA, 22 nt, Human
cuccacggacagucaccccucc

SEQ ID NO: 833409 - RNA, 19 nt, Human
cucccccagagcugcuucc

SEQ ID NO: 833410 - RNA, 19 nt, Human
gaaggagccaggccuaggg

SEQ ID NO: 833411 - RNA, 20 nt, Human
gagcucccccagagcugcuu

SEQ ID NO: 833412 - RNA, 23 nt, Human
gagcucccccagagcugcuuccc

SEQ ID NO: 833413 - RNA, 22 nt, Human
gagcugcuucccacgcuguggc

SEQ ID NO: 833414 - RNA, 24 nt, Human
gauugcuugagcccaggaguucaa

SEQ ID NO: 833415 - RNA, 21 nt, Human
gcaagaaaaaaaaaagaaaaa

SEQ ID NO: 833416 - RNA, 22 nt, Human
gcccaggaguucaaggccagcc

SEQ ID NO: 833417 - RNA, 21 nt, Human
gcuucuguaacaguucaagcc

SEQ ID NO: 833418 - RNA, 23 nt, Human
ggauugcuugagcccaggaguuc

SEQ ID NO: 833419 - RNA, 28 nt, Human
ggcacacaugcacacacacagugaccug

SEQ ID NO: 833420 - RNA, 23 nt, Human
ggcccagaggccaccagagggca

SEQ ID NO: 833421 - RNA, 18 nt, Human
gggacccagccccagccc

SEQ ID NO: 833422 - RNA, 18 nt, Human
gggaggcugaggcaggag

SEQ ID NO: 833423 - RNA, 21 nt, Human
gggaggcugaggcaggaggau

SEQ ID NO: 833424 - RNA, 18 nt, Human
gggcaagaaaaaaaaaag

SEQ ID NO: 833425 - RNA, 22 nt, Human
guaaaggauucaaagcaggcac

SEQ ID NO: 833426 - RNA, 26 nt, Human
uaaaaaauacaacuaauggaaagggc

SEQ ID NO: 833427 - RNA, 21 nt, Human
uaaaggauucaaagcaggcac

SEQ ID NO: 833428 - RNA, 20 nt, Human
uaaaggucaagcagucagug

SEQ ID NO: 833429 - RNA, 19 nt, Human
uaaagucccagcuacuagg

SEQ ID NO: 833430 - RNA, 22 nt, Human
uacaacuaauggaaagggcaag

SEQ ID NO: 833431 - RNA, 23 nt, Human
uacaacuaauggaaagggcaaga

SEQ ID NO: 833432 - RNA, 18 nt, Human
uacuagggaggcugaggc

SEQ ID NO: 833433 - RNA, 19 nt, Human
uacuagggaggcugaggca

SEQ ID NO: 833434 - RNA, 18 nt, Human
uauguacaugcagcaggc

SEQ ID NO: 833435 - RNA, 23 nt, Human
ucaaagcaggcacagugguguac

SEQ ID NO: 833436 - RNA, 21 nt, Human
uccacuaggggacccagcccc

SEQ ID NO: 833437 - RNA, 23 nt, Human
uccacuaggggacccagccccag

SEQ ID NO: 833438 - RNA, 21 nt, Human
ucuuccgcaagaaaugggggu

SEQ ID NO: 833439 - RNA, 20 nt, Human
ugaauaaggaacugacccag

SEQ ID NO: 833440 - RNA, 22 nt, Human
ugaauaaggaacugacccagaa

SEQ ID NO: 833441 - RNA, 23 nt, Human
ugagcccaggaguucaaggccag

SEQ ID NO: 833442 - RNA, 24 nt, Human
ugaggcaggaggauugcuugagcc

SEQ ID NO: 833443 - RNA, 25 nt, Human
ugaggcaggaggauugcuugagccc

SEQ ID NO: 833444 - RNA, 18 nt, Human
ugcaagaagcucccggcg

SEQ ID NO: 833445 - RNA, 22 nt, Human
ugcccccauggcuccgaagugg

SEQ ID NO: 833446 - RNA, 25 nt, Human
uggaaagggcaagaaaaaaaaaaga

SEQ ID NO: 833447 - RNA, 20 nt, Human
ugggagagacucaauuggug

SEQ ID NO: 833448 - RNA, 20 nt, Human
uggggguguuuaaggaggcc

SEQ ID NO: 833449 - RNA, 24 nt, Human
uggugggagagacucaauuggugg

SEQ ID NO: 833450 - RNA, 22 nt, Human
uugagcccaggaguucaaggcc

SEQ ID NO: 833451 - RNA, 24 nt, Human
uugcuugagcccaggaguucaagg

SEQ ID NO: 833452 - RNA, 24 nt, Human
uuuaaggaggcccccaagaugagc

SEQ ID NO: 833453 - RNA, 21 nt, Human
aaaaaaaagagcuuuagccau

SEQ ID NO: 833454 - RNA, 23 nt, Human
aaaaaaucuaaaagaagcaaaga

SEQ ID NO: 833455 - RNA, 23 nt, Human
aaaaauaaaaagacagcaaugac

SEQ ID NO: 833456 - RNA, 19 nt, Human
aaaaauggccauaauguac

SEQ ID NO: 833457 - RNA, 24 nt, Human
aaacacaaaaaaucuaaaagaagc

SEQ ID NO: 833458 - RNA, 19 nt, Human
aaagagcuuuagccauuuc

SEQ ID NO: 833459 - RNA, 20 nt, Human
aaaucacgggcccguaagaa

SEQ ID NO: 833460 - RNA, 28 nt, Human
aaaucgccucaugaccaugucugugagc

SEQ ID NO: 833461 - RNA, 23 nt, Human
aagaagcaaagaaggaaaagaag

SEQ ID NO: 833462 - RNA, 24 nt, Human
aagaagcaaagaaggaaaagaagc

SEQ ID NO: 833463 - RNA, 19 nt, Human
aagaaggaaaagaagcggg

SEQ ID NO: 833464 - RNA, 21 nt, Human
aagaaggagauagucacagga

SEQ ID NO: 833465 - RNA, 25 nt, Human
acaaaaaaucuaaaagaagcaaaga

SEQ ID NO: 833466 - RNA, 18 nt, Human
accacaaaaggcaacaaa

SEQ ID NO: 833467 - RNA, 22 nt, Human
agaaauccuccacacugaaaaa

SEQ ID NO: 833468 - RNA, 20 nt, Human
agaagcgggcagugagccug

SEQ ID NO: 833469 - RNA, 21 nt, Human
agacacaaacacaaaaaaucu

SEQ ID NO: 833470 - RNA, 21 nt, Human
agacuucagcauauaccaaau

SEQ ID NO: 833471 - RNA, 19 nt, Human
agcaaagaaggaaaagaag

SEQ ID NO: 833472 - RNA, 22 nt, Human
agcaccgaagcuacaccugcag

SEQ ID NO: 833473 - RNA, 20 nt, Human
agcagugugcugccuucucc

SEQ ID NO: 833474 - RNA, 18 nt, Human
agcauuuuuagggauaag

SEQ ID NO: 833475 - RNA, 22 nt, Human
aggcaacaaagggccccucuaa

SEQ ID NO: 833476 - RNA, 26 nt, Human
aguuacuaacgauuguggaaaaaaaa

SEQ ID NO: 833477 - RNA, 20 nt, Human
auuaugcucucugauucuca

SEQ ID NO: 833478 - RNA, 18 nt, Human
caaagaaggaaaagaagc

SEQ ID NO: 833479 - RNA, 23 nt, Human
caaauuuaaaucgccucaugacc

SEQ ID NO: 833480 - RNA, 24 nt, Human
caacaaagggccccucuaaggcuu

SEQ ID NO: 833481 - RNA, 21 nt, Human
caagggcccaaaccagccaag

SEQ ID NO: 833482 - RNA, 22 nt, Human
cacaaaaaaucuaaaagaagca

SEQ ID NO: 833483 - RNA, 24 nt, Human
cacucuugcuuaguauauuaagag

SEQ ID NO: 833484 - RNA, 21 nt, Human
cacugguggagcagcaugagu

SEQ ID NO: 833485 - RNA, 22 nt, Human
cagcaugaguuuuuauacaguu

SEQ ID NO: 833486 - RNA, 22 nt, Human
cagcuacaagggcccaaaccag

SEQ ID NO: 833487 - RNA, 21 nt, Human
caggagagcaccgaagcuaca

SEQ ID NO: 833488 - RNA, 20 nt, Human
cagggaaucuaaagagcugu

SEQ ID NO: 833489 - RNA, 26 nt, Human
cauauaccaaauuuuaaauuuaaauc

SEQ ID NO: 833490 - RNA, 24 nt, Human
ccauuucuuacuaaaaacaaaaca

SEQ ID NO: 833491 - RNA, 24 nt, Human
cccacaaucaguagaucacaaaga

SEQ ID NO: 833492 - RNA, 22 nt, Human
ccccugaacaggagagcaccga

SEQ ID NO: 833493 - RNA, 23 nt, Human
ccucaugaccaugucugugagcc

SEQ ID NO: 833494 - RNA, 25 nt, Human
ccucuaugaaauaaauuaauuaccc

SEQ ID NO: 833495 - RNA, 18 nt, Human
cgccaugaaagugaagaa

SEQ ID NO: 833496 - RNA, 22 nt, Human
cgucgccaugaaagugaagaag

SEQ ID NO: 833497 - RNA, 22 nt, Human
cuccuuuaagcaaaccuugcca

SEQ ID NO: 833498 - RNA, 18 nt, Human
cugugagccagggucaag

SEQ ID NO: 833499 - RNA, 20 nt, Human
gagauagucacaggagacac

SEQ ID NO: 833500 - RNA, 18 nt, Human
gcuugagauuaaaacuag

SEQ ID NO: 833501 - RNA, 23 nt, Human
gucaaggguuccacuugggccac

SEQ ID NO: 833502 - RNA, 19 nt, Human
gugcugccuucucccuggc

SEQ ID NO: 833503 - RNA, 21 nt, Human
uaaaagaagcaaagaaggaaa

SEQ ID NO: 833504 - RNA, 24 nt, Human
uaacaaauaacaugguauuugaaa

SEQ ID NO: 833505 - RNA, 19 nt, Human
uaacagggaaucuaaagag

SEQ ID NO: 833506 - RNA, 20 nt, Human
uaaggcaucuggguggccuc

SEQ ID NO: 833507 - RNA, 25 nt, Human
uacauacacagauuaucugagaaaa

SEQ ID NO: 833508 - RNA, 21 nt, Human
uagaugaucauacuuuuccug

SEQ ID NO: 833509 - RNA, 21 nt, Human
uaggaacgcaaggagccacca

SEQ ID NO: 833510 - RNA, 23 nt, Human
uaggaacgcaaggagccaccacg

SEQ ID NO: 833511 - RNA, 21 nt, Human
uagucacaggagacacaaaca

SEQ ID NO: 833512 - RNA, 25 nt, Human
uaguuguuuuagggcuuuuuauugg

SEQ ID NO: 833513 - RNA, 19 nt, Human
ucaaggguuccacuugggc

SEQ ID NO: 833514 - RNA, 20 nt, Human
ucaucggugaugguaacaaa

SEQ ID NO: 833515 - RNA, 22 nt, Human
ucucccuggccaccuucuguca

SEQ ID NO: 833516 - RNA, 21 nt, Human
ucucugauucucagaugagag

SEQ ID NO: 833517 - RNA, 20 nt, Human
ugaaaaaaaacuaguaguuu

SEQ ID NO: 833518 - RNA, 21 nt, Human
ugaaaaaaaacuaguaguuuu

SEQ ID NO: 833519 - RNA, 19 nt, Human
ugacaagauaaauauagug

SEQ ID NO: 833520 - RNA, 27 nt, Human
ugagaaaaggucaaggguuccacuugg

SEQ ID NO: 833521 - RNA, 24 nt, Human
ugagaggauguaggaacgcaagga

SEQ ID NO: 833522 - RNA, 22 nt, Human
ugagucacuuaacagggaaucu

SEQ ID NO: 833523 - RNA, 19 nt, Human
ugauuuuucuguuuuccuc

SEQ ID NO: 833524 - RNA, 20 nt, Human
ugcucucugauucucagaug

SEQ ID NO: 833525 - RNA, 22 nt, Human
uggcagacuucagcauauacca

SEQ ID NO: 833526 - RNA, 18 nt, Human
uguaaauuaaaaauggcc

SEQ ID NO: 833527 - RNA, 24 nt, Human
uguguacacacacucuucauugug

SEQ ID NO: 833528 - RNA, 19 nt, Human
uguguacauacacagauua

SEQ ID NO: 833529 - RNA, 25 nt, Human
uguuucaacuucuuagccuauuugu

SEQ ID NO: 833530 - RNA, 24 nt, Human
uuaaaaaucuuugucuuguacuau

SEQ ID NO: 833531 - RNA, 24 nt, Human
uuaaaaauggccauaauguacccu

SEQ ID NO: 833532 - RNA, 22 nt, Human
uucugucagcuacaagggccca

SEQ ID NO: 833533 - RNA, 19 nt, Human
uuuagcuguaaauuaaaaa

SEQ ID NO: 833534 - RNA, 24 nt, Human
uuuccaaggcccacugguggagca

SEQ ID NO: 833535 - RNA, 21 nt, Human
agaaacgcaaggaggcgcggc

SEQ ID NO: 833536 - RNA, 20 nt, Human
aggcccuauuuggggaacag

SEQ ID NO: 833537 - RNA, 23 nt, Human
caccgcuccggcggcgggcgaca

SEQ ID NO: 833538 - RNA, 20 nt, Human
cacgcaggggccugggcggc

SEQ ID NO: 833539 - RNA, 24 nt, Human
cacgcggcuagcccuccuucuuuc

SEQ ID NO: 833540 - RNA, 20 nt, Human
cagccccaggcaggccgggc

SEQ ID NO: 833541 - RNA, 20 nt, Human
cagggcaggggccagggacc

SEQ ID NO: 833542 - RNA, 23 nt, Human
ccagccggacuccuucgcaccca

SEQ ID NO: 833543 - RNA, 21 nt, Human
cgacagggcaggggccaggga

SEQ ID NO: 833544 - RNA, 29 nt, Human
cucaauuaaaaaaaaaaaaaacuaaauaa

SEQ ID NO: 833545 - RNA, 19 nt, Human
cucccagccccaggcaggc

SEQ ID NO: 833546 - RNA, 23 nt, Human
cucucaauuaaaaaaaaaaaaaa

SEQ ID NO: 833547 - RNA, 19 nt, Human
gacagcgguggcagcagaa

SEQ ID NO: 833548 - RNA, 21 nt, Human
gacagggcaggggccagggac

SEQ ID NO: 833549 - RNA, 19 nt, Human
gcgcggcgcgaacgcacgc

SEQ ID NO: 833550 - RNA, 19 nt, Human
gcuucaguuaucaccgaga

SEQ ID NO: 833551 - RNA, 20 nt, Human
ggacuccuucgcacccacuu

SEQ ID NO: 833552 - RNA, 23 nt, Human
ggcgacagggcaggggccaggga

SEQ ID NO: 833553 - RNA, 22 nt, Human
gggcaggggccagggaccggga

SEQ ID NO: 833554 - RNA, 22 nt, Human
gggccagggaccgggacgggga

SEQ ID NO: 833555 - RNA, 19 nt, Human
ggggccugggcggcgggag

SEQ ID NO: 833556 - RNA, 22 nt, Human
ggugucggugucuggggcuccc

SEQ ID NO: 833557 - RNA, 21 nt, Human
gugccgacagcgguggcagca

SEQ ID NO: 833558 - RNA, 19 nt, Human
guggcagcagaagaacggc

SEQ ID NO: 833559 - RNA, 22 nt, Human
guuagguuccuuccacaccggg

SEQ ID NO: 833560 - RNA, 20 nt, Human
uaugaccuuagcuccacacg

SEQ ID NO: 833561 - RNA, 24 nt, Human
ucagaugauaugaccuuagcucca

SEQ ID NO: 833562 - RNA, 18 nt, Human
uccacacguccucagggu

SEQ ID NO: 833563 - RNA, 19 nt, Human
ucccgccagccuccagacc

SEQ ID NO: 833564 - RNA, 22 nt, Human
ucucaauuaaaaaaaaaaaaaa

SEQ ID NO: 833565 - RNA, 23 nt, Human
ugccgacagcgguggcagcagaa

SEQ ID NO: 833566 - RNA, 19 nt, Human
uggacuggacuauauacuc

SEQ ID NO: 833567 - RNA, 20 nt, Human
ugggcaaagucagauuuuca

SEQ ID NO: 833568 - RNA, 23 nt, Human
uggucagaugauaugaccuuagc

SEQ ID NO: 833569 - RNA, 22 nt, Human
ugguuagguuccuuccacaccg

SEQ ID NO: 833570 - RNA, 23 nt, Human
uuuuuuuuuuuuuuuuuccccuu

SEQ ID NO: 833571 - RNA, 21 nt, Human
aaacacccaugugugugguaa

SEQ ID NO: 833572 - RNA, 22 nt, Human
aaacuugccccuucucaagcac

SEQ ID NO: 833573 - RNA, 24 nt, Human
aacuugccccuucucaagcacucc

SEQ ID NO: 833574 - RNA, 21 nt, Human
aagauaccagauggagcgcgg

SEQ ID NO: 833575 - RNA, 24 nt, Human
aaggacacuaaagaacagagugug

SEQ ID NO: 833576 - RNA, 21 nt, Human
aaggcuuccugagcagguucu

SEQ ID NO: 833577 - RNA, 23 nt, Human
aauaacaacagaugaagaaagga

SEQ ID NO: 833578 - RNA, 19 nt, Human
acagaagaggagcucagcu

SEQ ID NO: 833579 - RNA, 26 nt, Human
acagagugugagaggugaguucuaaa

SEQ ID NO: 833580 - RNA, 20 nt, Human
acuggcccuuuuccucugag

SEQ ID NO: 833581 - RNA, 22 nt, Human
agaugggggacugggccauagu

SEQ ID NO: 833582 - RNA, 24 nt, Human
agcaagagcaaaucagagccccau

SEQ ID NO: 833583 - RNA, 20 nt, Human
agcagguucuuggugccccu

SEQ ID NO: 833584 - RNA, 20 nt, Human
aggaaggcccuaucuggcca

SEQ ID NO: 833585 - RNA, 19 nt, Human
aggggcaggcccagagcca

SEQ ID NO: 833586 - RNA, 22 nt, Human
aucaagcaggaaugguggccuu

SEQ ID NO: 833587 - RNA, 19 nt, Human
auccugagggagcaauacc

SEQ ID NO: 833588 - RNA, 18 nt, Human
auggagcgcggacagucc

SEQ ID NO: 833589 - RNA, 22 nt, Human
caagacauuugcaaagcaccac

SEQ ID NO: 833590 - RNA, 21 nt, Human
caaggacagcugaggccaaga

SEQ ID NO: 833591 - RNA, 25 nt, Human
caaggacagcugaggccaagauacc

SEQ ID NO: 833592 - RNA, 20 nt, Human
caucccuaagaaacugagag

SEQ ID NO: 833593 - RNA, 22 nt, Human
cauggcuccaauaagcugaggu

SEQ ID NO: 833594 - RNA, 23 nt, Human
ccaagauaccagauggagcgcgg

SEQ ID NO: 833595 - RNA, 20 nt, Human
cccccuucugauuucuccac

SEQ ID NO: 833596 - RNA, 21 nt, Human
ccccgggcgcccuggggccuu

SEQ ID NO: 833597 - RNA, 23 nt, Human
ccccgggcgcccuggggccuuuu

SEQ ID NO: 833598 - RNA, 19 nt, Human
ccgcccgcggccccccagc

SEQ ID NO: 833599 - RNA, 27 nt, Human
ccuccaagacauuugcaaagcaccacu

SEQ ID NO: 833600 - RNA, 20 nt, Human
cgccgcggcggagcagcgcu

SEQ ID NO: 833601 - RNA, 27 nt, Human
cgggcgcccuggggccuuuuggagguc

SEQ ID NO: 833602 - RNA, 25 nt, Human
cuaaagaacagagugugagagguga

SEQ ID NO: 833603 - RNA, 19 nt, Human
cuccugaaucccggaucuc

SEQ ID NO: 833604 - RNA, 21 nt, Human
cuccugaaucccggaucucug

SEQ ID NO: 833605 - RNA, 18 nt, Human
cucuguaggaaggcccua

SEQ ID NO: 833606 - RNA, 20 nt, Human
cucuguccuauacuccucca

SEQ ID NO: 833607 - RNA, 20 nt, Human
cugcuguguauuuugguccu

SEQ ID NO: 833608 - RNA, 24 nt, Human
cugugaaacuugccccuucucaag

SEQ ID NO: 833609 - RNA, 23 nt, Human
cuugcucugccaaacuuguuuuc

SEQ ID NO: 833610 - RNA, 25 nt, Human
gagcaagagcaaaucagagccccau

SEQ ID NO: 833611 - RNA, 21 nt, Human
gagguaucugguguaucggca

SEQ ID NO: 833612 - RNA, 19 nt, Human
gauuggugaucuugccauc

SEQ ID NO: 833613 - RNA, 18 nt, Human
gcaaaguucacuucagac

SEQ ID NO: 833614 - RNA, 19 nt, Human
gcaaaguucacuucagaca

SEQ ID NO: 833615 - RNA, 24 nt, Human
gccaucaaaaggcuuccugagcag

SEQ ID NO: 833616 - RNA, 25 nt, Human
gcccuggggccuuuuuauccgccuc

SEQ ID NO: 833617 - RNA, 18 nt, Human
gcgccgcggcggagcagc

SEQ ID NO: 833618 - RNA, 23 nt, Human
gcugggcgggcgccgcggcggag

SEQ ID NO: 833619 - RNA, 18 nt, Human
ggacagcugaggccaaga

SEQ ID NO: 833620 - RNA, 22 nt, Human
ggcccagagccauccugaggga

SEQ ID NO: 833621 - RNA, 23 nt, Human
uaacgggcucccuccccgggcgc

SEQ ID NO: 833622 - RNA, 24 nt, Human
uaagugugucucaguggagaaaag

SEQ ID NO: 833623 - RNA, 25 nt, Human
uaggggcaggcccagagccauccug

SEQ ID NO: 833624 - RNA, 19 nt, Human
uaucucuguagagaugagu

SEQ ID NO: 833625 - RNA, 19 nt, Human
ucagacacuugguugagac

SEQ ID NO: 833626 - RNA, 21 nt, Human
ucaguggagaaaagaucaaga

SEQ ID NO: 833627 - RNA, 19 nt, Human
uccaaggauaauagaaaca

SEQ ID NO: 833628 - RNA, 20 nt, Human
uccaaggauaauagaaacac

SEQ ID NO: 833629 - RNA, 18 nt, Human
uccauaggccacaggccc

SEQ ID NO: 833630 - RNA, 22 nt, Human
uccaucccuaagaaacugagag

SEQ ID NO: 833631 - RNA, 21 nt, Human
uccccgggcgcccuggggccu

SEQ ID NO: 833632 - RNA, 21 nt, Human
ucccuaagaaacugagagcuc

SEQ ID NO: 833633 - RNA, 24 nt, Human
ucccuaagaaacugagagcuccug

SEQ ID NO: 833634 - RNA, 18 nt, Human
uccggggcugggcgggcg

SEQ ID NO: 833635 - RNA, 18 nt, Human
ucugucucuugcucugcc

SEQ ID NO: 833636 - RNA, 19 nt, Human
ugaguggcuuguuugaugu

SEQ ID NO: 833637 - RNA, 22 nt, Human
ugauacaaguuguguugcuuug

SEQ ID NO: 833638 - RNA, 22 nt, Human
ugcccgaggucugugcuuccaa

SEQ ID NO: 833639 - RNA, 21 nt, Human
ugccugccagguaaauggucc

SEQ ID NO: 833640 - RNA, 21 nt, Human
uggagaaaagaucaagaauca

SEQ ID NO: 833641 - RNA, 22 nt, Human
uggauuggugaucuugccauca

SEQ ID NO: 833642 - RNA, 23 nt, Human
uguucccccuucugauuucucca

SEQ ID NO: 833643 - RNA, 25 nt, Human
uuauuggcauuagggugucaguccu

SEQ ID NO: 833644 - RNA, 24 nt, Human
uucccagguuccauccuuaacuaa

SEQ ID NO: 833645 - RNA, 20 nt, Human
uuccuuggcagaggcccuga

SEQ ID NO: 833646 - RNA, 23 nt, Human
uuccuuggcagaggcccugacag

SEQ ID NO: 833647 - RNA, 18 nt, Human
uugaaguuuagaccaauc

SEQ ID NO: 833648 - RNA, 23 nt, Human
uuggcacuggcccuuuuccucug

SEQ ID NO: 833649 - RNA, 19 nt, Human
uugguccucuguccuauac

SEQ ID NO: 833650 - RNA, 21 nt, Human
aaaaagaaaaccaaagcccac

SEQ ID NO: 833651 - RNA, 24 nt, Human
aaagcacuuuucacuuuaucucug

SEQ ID NO: 833652 - RNA, 22 nt, Human
aacuuguccccuucggucccca

SEQ ID NO: 833653 - RNA, 21 nt, Human
aagaaaaccaaagcccacuaa

SEQ ID NO: 833654 - RNA, 23 nt, Human
acaaaaagaaaaccaaagcccac

SEQ ID NO: 833655 - RNA, 26 nt, Human
acaaaaagaaaaccaaagcccacuaa

SEQ ID NO: 833656 - RNA, 21 nt, Human
acacacacucgcacaaaaaga

SEQ ID NO: 833657 - RNA, 22 nt, Human
acacacacucgcacaaaaagaa

SEQ ID NO: 833658 - RNA, 24 nt, Human
acuaaagcacauggggaaaaaaag

SEQ ID NO: 833659 - RNA, 25 nt, Human
agaaaccagaagcugagauggagcc

SEQ ID NO: 833660 - RNA, 19 nt, Human
agaacaaaguucacacuca

SEQ ID NO: 833661 - RNA, 18 nt, Human
agaggccaccaguucccc

SEQ ID NO: 833662 - RNA, 22 nt, Human
agauuacaaaacaucuuccucc

SEQ ID NO: 833663 - RNA, 23 nt, Human
aggggaacuuguccccuucgguc

SEQ ID NO: 833664 - RNA, 22 nt, Human
augaucacagaacaaaguucac

SEQ ID NO: 833665 - RNA, 26 nt, Human
augcagaggccaccaguuccccaagg

SEQ ID NO: 833666 - RNA, 21 nt, Human
caaaguucacacucaccacac

SEQ ID NO: 833667 - RNA, 22 nt, Human
cacacacucgcacaaaaagaaa

SEQ ID NO: 833668 - RNA, 19 nt, Human
cacacucaccacacagcca

SEQ ID NO: 833669 - RNA, 24 nt, Human
caccacacagccauucucacacac

SEQ ID NO: 833670 - RNA, 22 nt, Human
cccagcccugcccuccccugca

SEQ ID NO: 833671 - RNA, 26 nt, Human
ccuaaaauacccuuucuaugaucaca

SEQ ID NO: 833672 - RNA, 26 nt, Human
ccugcagccuaaaauacccuuucuau

SEQ ID NO: 833673 - RNA, 22 nt, Human
ccuuccuggcagccuuuggcac

SEQ ID NO: 833674 - RNA, 22 nt, Human
cuucggauggugacaccucccu

SEQ ID NO: 833675 - RNA, 22 nt, Human
gaaaacucagcaccaaaggaug

SEQ ID NO: 833676 - RNA, 22 nt, Human
gaagaaagauccaggacucagg

SEQ ID NO: 833677 - RNA, 18 nt, Human
gagauggagccggcuggg

SEQ ID NO: 833678 - RNA, 20 nt, Human
gauuacaaaacaucuuccuc

SEQ ID NO: 833679 - RNA, 21 nt, Human
gcagaggccaccaguucccca

SEQ ID NO: 833680 - RNA, 22 nt, Human
ggaaaaaaagauuacaaaacau

SEQ ID NO: 833681 - RNA, 18 nt, Human
ggggaacuuguccccuuc

SEQ ID NO: 833682 - RNA, 19 nt, Human
uaaaauacccuuucuauga

SEQ ID NO: 833683 - RNA, 20 nt, Human
uaaauaacuacccacaguca

SEQ ID NO: 833684 - RNA, 19 nt, Human
uacagaaaacucagcacca

SEQ ID NO: 833685 - RNA, 25 nt, Human
uauucagaaauaaauaacuacccac

SEQ ID NO: 833686 - RNA, 24 nt, Human
ucaccuaaagcacuuuucacuuua

SEQ ID NO: 833687 - RNA, 21 nt, Human
ucagaaauaaauaacuaccca

SEQ ID NO: 833688 - RNA, 24 nt, Human
uccagaaggaagaaagauccagga

SEQ ID NO: 833689 - RNA, 24 nt, Human
uccaggacucaggaaggcgucucc

SEQ ID NO: 833690 - RNA, 19 nt, Human
uccccagcccugcccuccc

SEQ ID NO: 833691 - RNA, 23 nt, Human
uccgccgugcccagcaggggcug

SEQ ID NO: 833692 - RNA, 23 nt, Human
uccuuccuggcagccuuuggcac

SEQ ID NO: 833693 - RNA, 20 nt, Human
ucggauggugacaccucccu

SEQ ID NO: 833694 - RNA, 23 nt, Human
ugagauggagccggcuggguuca

SEQ ID NO: 833695 - RNA, 20 nt, Human
ugcagccuaaaauacccuuu

SEQ ID NO: 833696 - RNA, 23 nt, Human
uuacaaaacaucuuccuccccau

SEQ ID NO: 833697 - RNA, 25 nt, Human
uucacacucaccacacagccauucu

SEQ ID NO: 833698 - RNA, 18 nt, Human
uuuuuuuuuuuuugaccc

SEQ ID NO: 833699 - RNA, 25 nt, Human
aagcagccaaaggucccucuuggaa

SEQ ID NO: 833700 - RNA, 19 nt, Human
aaggucagcagagccagug

SEQ ID NO: 833701 - RNA, 20 nt, Human
agccagacaccugcccuccg

SEQ ID NO: 833702 - RNA, 21 nt, Human
agccagugggaacagcugccc

SEQ ID NO: 833703 - RNA, 18 nt, Human
caagccagacaccugccc

SEQ ID NO: 833704 - RNA, 21 nt, Human
caagccagacaccugcccucc

SEQ ID NO: 833705 - RNA, 24 nt, Human
cagccaaaggucccucuuggaagc

SEQ ID NO: 833706 - RNA, 22 nt, Human
caucugacuccaacugugaugc

SEQ ID NO: 833707 - RNA, 24 nt, Human
ccucccacgggcgcgcguggagau

SEQ ID NO: 833708 - RNA, 22 nt, Human
ccucuuggaagcggaguucugg

SEQ ID NO: 833709 - RNA, 19 nt, Human
cgcgggaggccucuccggc

SEQ ID NO: 833710 - RNA, 23 nt, Human
cuaauugucuuuuccugcacucu

SEQ ID NO: 833711 - RNA, 20 nt, Human
cuccggccggacccaccucc

SEQ ID NO: 833712 - RNA, 18 nt, Human
gagacggcguccgcggga

SEQ ID NO: 833713 - RNA, 20 nt, Human
gucccucuuggaagcggagu

SEQ ID NO: 833714 - RNA, 18 nt, Human
uaauauuagucaccaguu

SEQ ID NO: 833715 - RNA, 20 nt, Human
uacucuuggcucaaguuuug

SEQ ID NO: 833716 - RNA, 20 nt, Human
ugcccuccgggcucacaucu

SEQ ID NO: 833717 - RNA, 19 nt, Human
ugggaggcugaagacuuca

SEQ ID NO: 833718 - RNA, 19 nt, Human
uugucuuuuccugcacucu

SEQ ID NO: 833719 - RNA, 20 nt, Human
uuuuccugcacucugugugu

SEQ ID NO: 833720 - RNA, 19 nt, Human
aaaggaggagggucuggag

SEQ ID NO: 833721 - RNA, 19 nt, Human
accccagagugggaacagc

SEQ ID NO: 833722 - RNA, 21 nt, Human
acccgucgggcgugagcagca

SEQ ID NO: 833723 - RNA, 24 nt, Human
agaaaggaggagggucuggagagc

SEQ ID NO: 833724 - RNA, 22 nt, Human
agaagaaaggaggagggucugg

SEQ ID NO: 833725 - RNA, 20 nt, Human
agcggccauaggggaggcaa

SEQ ID NO: 833726 - RNA, 20 nt, Human
aggaagagcccgggaggagg

SEQ ID NO: 833727 - RNA, 21 nt, Human
aggcaagugugaggagccagg

SEQ ID NO: 833728 - RNA, 22 nt, Human
agggggugaggggucgaggugu

SEQ ID NO: 833729 - RNA, 23 nt, Human
agggggugaggggucgaggugug

SEQ ID NO: 833730 - RNA, 21 nt, Human
caccccguggggucuuuggcg

SEQ ID NO: 833731 - RNA, 22 nt, Human
cagcaggugcggauguggggag

SEQ ID NO: 833732 - RNA, 23 nt, Human
cagccggggcgcagcugcuggca

SEQ ID NO: 833733 - RNA, 18 nt, Human
cagucgguggagcgggag

SEQ ID NO: 833734 - RNA, 23 nt, Human
ccagagccugcggacuguggagg

SEQ ID NO: 833735 - RNA, 21 nt, Human
ccaggagugggggcccugggc

SEQ ID NO: 833736 - RNA, 19 nt, Human
ccggagcgcagccggggcg

SEQ ID NO: 833737 - RNA, 22 nt, Human
ccggagcgcagccggggcgcag

SEQ ID NO: 833738 - RNA, 20 nt, Human
ccggggcgcagcugcuggca

SEQ ID NO: 833739 - RNA, 18 nt, Human
cggagcgcagccggggcg

SEQ ID NO: 833740 - RNA, 26 nt, Human
cggggcaggggcggcgugaacccguc

SEQ ID NO: 833741 - RNA, 18 nt, Human
cggggcgcagcugcuggc

SEQ ID NO: 833742 - RNA, 21 nt, Human
cgugagcagcagucgguggag

SEQ ID NO: 833743 - RNA, 23 nt, Human
cuccgcaccgcagcgcgguccuu

SEQ ID NO: 833744 - RNA, 20 nt, Human
gagcagcagucgguggagcg

SEQ ID NO: 833745 - RNA, 21 nt, Human
gagcagcagucgguggagcgg

SEQ ID NO: 833746 - RNA, 23 nt, Human
gagcagcagucgguggagcggga

SEQ ID NO: 833747 - RNA, 25 nt, Human
gagcagcagucgguggagcgggagg

SEQ ID NO: 833748 - RNA, 26 nt, Human
gagccugcggacuguggaggggaggc

SEQ ID NO: 833749 - RNA, 19 nt, Human
gauguggggagaagaaagg

SEQ ID NO: 833750 - RNA, 21 nt, Human
gcacaggagcuccacaggcag

SEQ ID NO: 833751 - RNA, 18 nt, Human
gcaggugcggaugugggg

SEQ ID NO: 833752 - RNA, 19 nt, Human
gcggacuguggaggggagg

SEQ ID NO: 833753 - RNA, 24 nt, Human
ggaacagcaggugcggaugugggg

SEQ ID NO: 833754 - RNA, 22 nt, Human
ggaagagcccgggaggaggggg

SEQ ID NO: 833755 - RNA, 18 nt, Human
ggacucgguccuguccca

SEQ ID NO: 833756 - RNA, 18 nt, Human
ggagaagaaaggaggagg

SEQ ID NO: 833757 - RNA, 23 nt, Human
ggagagcggccauaggggaggca

SEQ ID NO: 833758 - RNA, 19 nt, Human
ggaggagggucuggagagc

SEQ ID NO: 833759 - RNA, 21 nt, Human
ggcgcagcugcuggcacagga

SEQ ID NO: 833760 - RNA, 24 nt, Human
gggaacagcaggugcggauguggg

SEQ ID NO: 833761 - RNA, 19 nt, Human
gggaggagggggugagggg

SEQ ID NO: 833762 - RNA, 20 nt, Human
gggcaccccguggggucuuu

SEQ ID NO: 833763 - RNA, 28 nt, Human
ggggagaagaaaggaggagggucuggag

SEQ ID NO: 833764 - RNA, 20 nt, Human
ggggauggggguauccggag

SEQ ID NO: 833765 - RNA, 21 nt, Human
guucauggacuugagaacccc

SEQ ID NO: 833766 - RNA, 20 nt, Human
uauccggagcgcagccgggg

SEQ ID NO: 833767 - RNA, 24 nt, Human
ucauggacuugagaaccccagagu

SEQ ID NO: 833768 - RNA, 26 nt, Human
ucauggacuugagaaccccagaguug

SEQ ID NO: 833769 - RNA, 21 nt, Human
uccacaggcagccaaggacuc

SEQ ID NO: 833770 - RNA, 26 nt, Human
uccacaggcagccaaggacucggucc

SEQ ID NO: 833771 - RNA, 19 nt, Human
ucccagagccugcggacug

SEQ ID NO: 833772 - RNA, 22 nt, Human
ucccagagccugcggacugugg

SEQ ID NO: 833773 - RNA, 30 nt, Human
uccgcaccgcagcgcgguccuucacggggg

SEQ ID NO: 833774 - RNA, 23 nt, Human
ucggcgguggcggggaugggggu

SEQ ID NO: 833775 - RNA, 20 nt, Human
ugcggauguggggagaagaa

SEQ ID NO: 833776 - RNA, 21 nt, Human
ugcgggcaccccguggggucu

SEQ ID NO: 833777 - RNA, 19 nt, Human
ugucccagagccugcggac

SEQ ID NO: 833778 - RNA, 19 nt, Human
uguggaggggaggccgcag

SEQ ID NO: 833779 - RNA, 22 nt, Human
uugacccagacgccagggcccu

SEQ ID NO: 833780 - RNA, 21 nt, Human
uuuaaucagcauuguggaaaa

SEQ ID NO: 833781 - RNA, 21 nt, Human
uuucuggauuguuuauuaugu

SEQ ID NO: 833782 - RNA, 21 nt, Human
uuuugcuuuucuggauuguuu

SEQ ID NO: 833783 - RNA, 25 nt, Human
uuuuuuuuuuuuuuuugcuuuucug

SEQ ID NO: 833784 - RNA, 18 nt, Human
uuuuuuuuuuuuuuuuug

SEQ ID NO: 833785 - RNA, 24 nt, Human
uuuuuuuuuuuuuuuuuugcuuuu

SEQ ID NO: 833786 - RNA, 23 nt, Human
aaaagaaaaacaaauguugugag

SEQ ID NO: 833787 - RNA, 22 nt, Human
aaaguccuuggcgucgcccucc

SEQ ID NO: 833788 - RNA, 23 nt, Human
aaauagccucccccaaaccauac

SEQ ID NO: 833789 - RNA, 23 nt, Human
aaccgcaguagugagcuuuggua

SEQ ID NO: 833790 - RNA, 23 nt, Human
aacucagagucacccugggacgg

SEQ ID NO: 833791 - RNA, 18 nt, Human
aacuuguggagauacccc

SEQ ID NO: 833792 - RNA, 18 nt, Human
aagagcauuuccaucauu

SEQ ID NO: 833793 - RNA, 23 nt, Human
aagcaaagacuacaaaaauagca

SEQ ID NO: 833794 - RNA, 18 nt, Human
aagcacaguuguuuggaa

SEQ ID NO: 833795 - RNA, 25 nt, Human
aauauuguaacccacuuccccacug

SEQ ID NO: 833796 - RNA, 20 nt, Human
acaacacacgcaaugcaaaa

SEQ ID NO: 833797 - RNA, 23 nt, Human
acaauaaaauagccucccccaaa

SEQ ID NO: 833798 - RNA, 18 nt, Human
acagaacccagcagccag

SEQ ID NO: 833799 - RNA, 23 nt, Human
acaggcaaaccgcaguagugagc

SEQ ID NO: 833800 - RNA, 19 nt, Human
acccggggagggaaggggg

SEQ ID NO: 833801 - RNA, 20 nt, Human
acuucugcucauccuagggg

SEQ ID NO: 833802 - RNA, 26 nt, Human
agaaaaacaaauguugugagcucaag

SEQ ID NO: 833803 - RNA, 21 nt, Human
agcaguugauguggaaagucc

SEQ ID NO: 833804 - RNA, 21 nt, Human
auaaaggacaacucagaguca

SEQ ID NO: 833805 - RNA, 21 nt, Human
auagccucccccaaaccauac

SEQ ID NO: 833806 - RNA, 19 nt, Human
caacacacgcaaugcaaaa

SEQ ID NO: 833807 - RNA, 22 nt, Human
caacgccaaacccuggucgcag

SEQ ID NO: 833808 - RNA, 21 nt, Human
caacuuguggagauaccccaa

SEQ ID NO: 833809 - RNA, 21 nt, Human
cacaacacacgcaaugcaaaa

SEQ ID NO: 833810 - RNA, 21 nt, Human
cacaauaaaauagccuccccc

SEQ ID NO: 833811 - RNA, 20 nt, Human
cacacaguaaucuacuagaa

SEQ ID NO: 833812 - RNA, 22 nt, Human
ccaaaaaagucaagcaaagacu

SEQ ID NO: 833813 - RNA, 23 nt, Human
ccaaaccauacuuuucuaggucu

SEQ ID NO: 833814 - RNA, 22 nt, Human
ccaaacccuggucgcagccucc

SEQ ID NO: 833815 - RNA, 23 nt, Human
ccccaacaacaguggcuccgccu

SEQ ID NO: 833816 - RNA, 23 nt, Human
cccccaaaaaagucaagcaaaga

SEQ ID NO: 833817 - RNA, 21 nt, Human
cccccaaaccauacuuuucua

SEQ ID NO: 833818 - RNA, 21 nt, Human
ccucuuccaacuuguggagau

SEQ ID NO: 833819 - RNA, 18 nt, Human
cuaggucuaaaacaugcu

SEQ ID NO: 833820 - RNA, 18 nt, Human
gaugacagaucaggaaaa

SEQ ID NO: 833821 - RNA, 18 nt, Human
gccaaacccuggucgcag

SEQ ID NO: 833822 - RNA, 20 nt, Human
ggaaaaauacaggacccaaa

SEQ ID NO: 833823 - RNA, 21 nt, Human
gugagcucaagagcauuucca

SEQ ID NO: 833824 - RNA, 23 nt, Human
uaaaagaaaaacaaauguuguga

SEQ ID NO: 833825 - RNA, 20 nt, Human
uaaaauagccucccccaaac

SEQ ID NO: 833826 - RNA, 20 nt, Human
uaaaauagccucccccaaac

SEQ ID NO: 833827 - RNA, 24 nt, Human
uaaaucccagaaauauuagugcug

SEQ ID NO: 833828 - RNA, 23 nt, Human
uacaggccuuuucucaaauauuu

SEQ ID NO: 833829 - RNA, 21 nt, Human
uagauuccuugugcuaaccac

SEQ ID NO: 833830 - RNA, 21 nt, Human
uagcucacgauaaaggacaac

SEQ ID NO: 833831 - RNA, 21 nt, Human
uaguacaaauugcuaaucaaa

SEQ ID NO: 833832 - RNA, 20 nt, Human
uauuguaacccacuucccca

SEQ ID NO: 833833 - RNA, 25 nt, Human
uauuuugcuucuuugagcaaauuua

SEQ ID NO: 833834 - RNA, 22 nt, Human
uccaaucucucuccccgaggcu

SEQ ID NO: 833835 - RNA, 21 nt, Human
uccaggcacaggcaaaccgca

SEQ ID NO: 833836 - RNA, 23 nt, Human
uccccgaggcugacaacaacgcc

SEQ ID NO: 833837 - RNA, 21 nt, Human
uccuuggcgucgcccuccucc

SEQ ID NO: 833838 - RNA, 20 nt, Human
ucgcagccuccaaguuuccc

SEQ ID NO: 833839 - RNA, 21 nt, Human
ucugcucauccuaggggcaga

SEQ ID NO: 833840 - RNA, 23 nt, Human
ugacaacaacgccaaacccuggu

SEQ ID NO: 833841 - RNA, 24 nt, Human
ugagcaaauuuaaguuacauucag

SEQ ID NO: 833842 - RNA, 22 nt, Human
ugagcacaacacacgcaaugca

SEQ ID NO: 833843 - RNA, 21 nt, Human
ugcuuugcuaaucccccccaa

SEQ ID NO: 833844 - RNA, 22 nt, Human
ugcuuugcuaaucccccccaaa

SEQ ID NO: 833845 - RNA, 19 nt, Human
ugguaaugagcacaacaca

SEQ ID NO: 833846 - RNA, 19 nt, Human
uguccaggcacaggcaaac

SEQ ID NO: 833847 - RNA, 18 nt, Human
uguggaaaguccuuggcg

SEQ ID NO: 833848 - RNA, 19 nt, Human
uguuucguuucuuaguaca

SEQ ID NO: 833849 - RNA, 20 nt, Human
uugcuccacuguauguuucc

SEQ ID NO: 833850 - RNA, 24 nt, Human
uugugagcucaagagcauuuccau

SEQ ID NO: 833851 - RNA, 24 nt, Human
uuuacuugcuccacuguauguuuc

SEQ ID NO: 833852 - RNA, 24 nt, Human
aaagugcugggauuacaggcguga

SEQ ID NO: 833853 - RNA, 22 nt, Human
aaggcagccccaguguggccag

SEQ ID NO: 833854 - RNA, 19 nt, Human
aagugcugggauuacaggc

SEQ ID NO: 833855 - RNA, 19 nt, Human
aagugcugggauuacaggc

SEQ ID NO: 833856 - RNA, 26 nt, Human
aagugcugggauuacaggcgugagcc

SEQ ID NO: 833857 - RNA, 18 nt, Human
acaggguuucaccauguu

SEQ ID NO: 833858 - RNA, 19 nt, Human
acaggguuucaccauguua

SEQ ID NO: 833859 - RNA, 20 nt, Human
acaggguuucaccauguuag

SEQ ID NO: 833860 - RNA, 21 nt, Human
acaggugcccaccaccacgcc

SEQ ID NO: 833861 - RNA, 22 nt, Human
agaccccccacccucaacccaa

SEQ ID NO: 833862 - RNA, 18 nt, Human
agagaucugggaaacagg

SEQ ID NO: 833863 - RNA, 19 nt, Human
agaguucaagagaucuggg

SEQ ID NO: 833864 - RNA, 24 nt, Human
agauggucucgaucuccugacuuc

SEQ ID NO: 833865 - RNA, 21 nt, Human
agcaucagacccugcacucag

SEQ ID NO: 833866 - RNA, 18 nt, Human
aggaaggacaaggggcug

SEQ ID NO: 833867 - RNA, 20 nt, Human
agugcaguggcacgaucuug

SEQ ID NO: 833868 - RNA, 23 nt, Human
agugcaguggcacgaucuuggcu

SEQ ID NO: 833869 - RNA, 24 nt, Human
agugcaguggcacgaucuuggcuc

SEQ ID NO: 833870 - RNA, 18 nt, Human
agugcugggauuacaggc

SEQ ID NO: 833871 - RNA, 24 nt, Human
caaagugcugggauuacaggcgug

SEQ ID NO: 833872 - RNA, 22 nt, Human
caccauguuagccaagaugguc

SEQ ID NO: 833873 - RNA, 24 nt, Human
caccauguuagccaagauggucuc

SEQ ID NO: 833874 - RNA, 20 nt, Human
cacccggccaaaggcaggau

SEQ ID NO: 833875 - RNA, 19 nt, Human
caccgcaagcuccgccucc

SEQ ID NO: 833876 - RNA, 19 nt, Human
caccuguaaaaggcaggau

SEQ ID NO: 833877 - RNA, 22 nt, Human
cacgccauucuccugccucagc

SEQ ID NO: 833878 - RNA, 18 nt, Human
cagccccgaguuucaccu

SEQ ID NO: 833879 - RNA, 19 nt, Human
caggguuucaccauguuag

SEQ ID NO: 833880 - RNA, 19 nt, Human
caggugcccaccaccacgc

SEQ ID NO: 833881 - RNA, 21 nt, Human
caggugcccaccaccacgccu

SEQ ID NO: 833882 - RNA, 19 nt, Human
caguggcacgaucuuggcu

SEQ ID NO: 833883 - RNA, 22 nt, Human
ccaaagugcugggauuacaggc

SEQ ID NO: 833884 - RNA, 22 nt, Human
ccaaagugcugggauuacaggc

SEQ ID NO: 833885 - RNA, 24 nt, Human
ccaaagugcugggauuacaggcgu

SEQ ID NO: 833886 - RNA, 22 nt, Human
ccagaccccccacccucaaccc

SEQ ID NO: 833887 - RNA, 18 nt, Human
cccacccucaacccaagc

SEQ ID NO: 833888 - RNA, 20 nt, Human
ccccaguguggccagggcuc

SEQ ID NO: 833889 - RNA, 24 nt, Human
cccgaguugcugggacuacaggug

SEQ ID NO: 833890 - RNA, 18 nt, Human
cccucaacccaagccccu

SEQ ID NO: 833891 - RNA, 19 nt, Human
cccugcacucagagagccc

SEQ ID NO: 833892 - RNA, 21 nt, Human
cccugcacucagagagccccc

SEQ ID NO: 833893 - RNA, 22 nt, Human
cccuugguucugaccccaagcu

SEQ ID NO: 833894 - RNA, 24 nt, Human
ccgcaagcuccgccucccaaguuc

SEQ ID NO: 833895 - RNA, 23 nt, Human
ccgcacccggccaaaggcagugg

SEQ ID NO: 833896 - RNA, 24 nt, Human
ccucccaaguucacgccauucucc

SEQ ID NO: 833897 - RNA, 21 nt, Human
ccugccucagccucccgaguu

SEQ ID NO: 833898 - RNA, 19 nt, Human
cgccucccaaguucacgcc

SEQ ID NO: 833899 - RNA, 25 nt, Human
cuaagugggacucagcaucagaccc

SEQ ID NO: 833900 - RNA, 25 nt, Human
cuaccagaccccccacccucaaccc

SEQ ID NO: 833901 - RNA, 22 nt, Human
cuccugacuucgugauccgccc

SEQ ID NO: 833902 - RNA, 23 nt, Human
cuccugccucagccucccgaguu

SEQ ID NO: 833903 - RNA, 23 nt, Human
cucugucgcccaggcuagagugc

SEQ ID NO: 833904 - RNA, 20 nt, Human
cugaccccaagcuaaguggg

SEQ ID NO: 833905 - RNA, 20 nt, Human
cuggaaggaaggacaagggg

SEQ ID NO: 833906 - RNA, 21 nt, Human
cugggccucccaaagugcugg

SEQ ID NO: 833907 - RNA, 22 nt, Human
gacaaggggcugggagaaccca

SEQ ID NO: 833908 - RNA, 23 nt, Human
gacuucgugauccgcccaccugg

SEQ ID NO: 833909 - RNA, 20 nt, Human
gaguugcugggacuacaggu

SEQ ID NO: 833910 - RNA, 18 nt, Human
gauuacaggcgugagccc

SEQ ID NO: 833911 - RNA, 21 nt, Human
gauuacaggcgugagcccccg

SEQ ID NO: 833912 - RNA, 23 nt, Human
gccuggcuaauuuuuuauauuuu

SEQ ID NO: 833913 - RNA, 19 nt, Human
gcuagagugcaguggcacg

SEQ ID NO: 833914 - RNA, 22 nt, Human
ggaaggaaggacaaggggcugg

SEQ ID NO: 833915 - RNA, 20 nt, Human
ggggaagacagagucagaga

SEQ ID NO: 833916 - RNA, 24 nt, Human
uaaaccccuugguucugaccccaa

SEQ ID NO: 833917 - RNA, 22 nt, Human
uaaggaaagcccaucguguguu

SEQ ID NO: 833918 - RNA, 24 nt, Human
uaauuuuuuauauuuuuaguagag

SEQ ID NO: 833919 - RNA, 22 nt, Human
uacaggugcccaccaccacgcc

SEQ ID NO: 833920 - RNA, 22 nt, Human
uagagacaggguuucaccaugu

SEQ ID NO: 833921 - RNA, 21 nt, Human
uagagugcaguggcacgaucu

SEQ ID NO: 833922 - RNA, 24 nt, Human
uagagugcaguggcacgaucuugg

SEQ ID NO: 833923 - RNA, 24 nt, Human
uaguagagacaggguuucaccaug

SEQ ID NO: 833924 - RNA, 26 nt, Human
uaguagagacaggguuucaccauguu

SEQ ID NO: 833925 - RNA, 24 nt, Human
ucaccgcaagcuccgccucccaag

SEQ ID NO: 833926 - RNA, 24 nt, Human
ucccaaagugcugggauuacaggc

SEQ ID NO: 833927 - RNA, 21 nt, Human
ucccaaguucacgccauucuc

SEQ ID NO: 833928 - RNA, 24 nt, Human
ucccaaguucacgccauucuccug

SEQ ID NO: 833929 - RNA, 23 nt, Human
ucccagccgcuauggacagcccc

SEQ ID NO: 833930 - RNA, 23 nt, Human
ucccgaguugcugggacuacagg

SEQ ID NO: 833931 - RNA, 24 nt, Human
ucccgaguugcugggacuacaggu

SEQ ID NO: 833932 - RNA, 18 nt, Human
ucgcccaggcuagagugc

SEQ ID NO: 833933 - RNA, 18 nt, Human
ucuaccagaccccccacc

SEQ ID NO: 833934 - RNA, 21 nt, Human
ucuaccagaccccccacccuc

SEQ ID NO: 833935 - RNA, 24 nt, Human
ucuaccagaccccccacccucaac

SEQ ID NO: 833936 - RNA, 24 nt, Human
ucuccugccucagccucccgaguu

SEQ ID NO: 833937 - RNA, 24 nt, Human
ucugucgcccaggcuagagugcag

SEQ ID NO: 833938 - RNA, 19 nt, Human
ucuugcucugucgcccagg

SEQ ID NO: 833939 - RNA, 23 nt, Human
ucuugcucugucgcccaggcuag

SEQ ID NO: 833940 - RNA, 24 nt, Human
ucuugcucugucgcccaggcuaga

SEQ ID NO: 833941 - RNA, 21 nt, Human
ugaaacggggucccagccgcu

SEQ ID NO: 833942 - RNA, 21 nt, Human
ugagcccccgcacccggccaa

SEQ ID NO: 833943 - RNA, 24 nt, Human
ugauccgcccaccugggccuccca

SEQ ID NO: 833944 - RNA, 22 nt, Human
ugcaguggcacgaucuuggcuc

SEQ ID NO: 833945 - RNA, 24 nt, Human
ugccucagccucccgaguugcugg

SEQ ID NO: 833946 - RNA, 24 nt, Human
ugcucugucgcccaggcuagagug

SEQ ID NO: 833947 - RNA, 21 nt, Human
ugcugggacuacaggugccca

SEQ ID NO: 833948 - RNA, 20 nt, Human
ugcugggauuacaggcguga

SEQ ID NO: 833949 - RNA, 21 nt, Human
uggaaggaaggacaaggggcu

SEQ ID NO: 833950 - RNA, 22 nt, Human
uggaaggaaggacaaggggcug

SEQ ID NO: 833951 - RNA, 23 nt, Human
uggaaggaaggacaaggggcugg

SEQ ID NO: 833952 - RNA, 24 nt, Human
uggaaggaaggacaaggggcuggg

SEQ ID NO: 833953 - RNA, 18 nt, Human
uggcucaccgcaagcucc

SEQ ID NO: 833954 - RNA, 21 nt, Human
ugggacuacaggugcccacca

SEQ ID NO: 833955 - RNA, 24 nt, Human
ugggacuacaggugcccaccacca

SEQ ID NO: 833956 - RNA, 18 nt, Human
ugggauuacaggcgugag

SEQ ID NO: 833957 - RNA, 19 nt, Human
ugggauuacaggcgugagc

SEQ ID NO: 833958 - RNA, 23 nt, Human
ugggauuacaggcgugagccccc

SEQ ID NO: 833959 - RNA, 24 nt, Human
ugggauuacaggcgugagcccccg

SEQ ID NO: 833960 - RNA, 25 nt, Human
ugggauuacaggcgugagcccccgc

SEQ ID NO: 833961 - RNA, 22 nt, Human
uguucuaggaagcauggaugga

SEQ ID NO: 833962 - RNA, 25 nt, Human
uguucuaggaagcauggauggauga

SEQ ID NO: 833963 - RNA, 20 nt, Human
uuacaggcgugagcccccgc

SEQ ID NO: 833964 - RNA, 24 nt, Human
uuaguagagacaggguuucaccau

SEQ ID NO: 833965 - RNA, 23 nt, Human
uugagacagucuugcucugucgc

SEQ ID NO: 833966 - RNA, 22 nt, Human
uugguucugaccccaagcuaag

SEQ ID NO: 833967 - RNA, 23 nt, Human
uuuauauuuuuaguagagacagg

SEQ ID NO: 833968 - RNA, 24 nt, Human
uuuauauuuuuaguagagacaggg

SEQ ID NO: 833969 - RNA, 19 nt, Human
uuucaccauguuagccaag

SEQ ID NO: 833970 - RNA, 24 nt, Human
uuuuuaguagagacaggguuucac

SEQ ID NO: 833971 - RNA, 21 nt, Human
uuuuuauauuuuuaguagaga

SEQ ID NO: 833972 - RNA, 24 nt, Human
uuuuuuauauuuuuaguagagaca

SEQ ID NO: 833973 - RNA, 25 nt, Human
uuuuuuuuuuuuuuuuuccaguuuu

SEQ ID NO: 833974 - RNA, 22 nt, Human
uuuuuuuuuuuuuuuuuuccag

SEQ ID NO: 833975 - RNA, 19 nt, Human
aaaagcuucuucaguuucc

SEQ ID NO: 833976 - RNA, 20 nt, Human
aaaaguuacuaauuuacgaa

SEQ ID NO: 833977 - RNA, 18 nt, Human
aggcaaaaagaggaaaug

SEQ ID NO: 833978 - RNA, 22 nt, Human
aggcaaaaagaggaaauguaag

SEQ ID NO: 833979 - RNA, 24 nt, Human
caacacugcuucaauuuuucuuga

SEQ ID NO: 833980 - RNA, 24 nt, Human
caggacagggaaucauagugagga

SEQ ID NO: 833981 - RNA, 22 nt, Human
caguaaagacguagcuuuuuca

SEQ ID NO: 833982 - RNA, 23 nt, Human
cauauaguuuguggcaacacugc

SEQ ID NO: 833983 - RNA, 20 nt, Human
ccagagauaaggcauccagc

SEQ ID NO: 833984 - RNA, 20 nt, Human
gccaggaaagaaagcaaugg

SEQ ID NO: 833985 - RNA, 24 nt, Human
ggaaauuccucaucuaaaaagcuu

SEQ ID NO: 833986 - RNA, 21 nt, Human
ggacauggauaguuagugcug

SEQ ID NO: 833987 - RNA, 23 nt, Human
ggagauaaaggcaaaaagaggaa

SEQ ID NO: 833988 - RNA, 20 nt, Human
uagacuguuuuaucaaaaau

SEQ ID NO: 833989 - RNA, 23 nt, Human
uauccagagauaaggcauccagc

SEQ ID NO: 833990 - RNA, 22 nt, Human
ucacuggcagugugggcuucuc

SEQ ID NO: 833991 - RNA, 19 nt, Human
uccguuguuccgaaauugc

SEQ ID NO: 833992 - RNA, 21 nt, Human
ucgauccuuacccuggacaug

SEQ ID NO: 833993 - RNA, 23 nt, Human
ugagaaccucugguuucaugcua

SEQ ID NO: 833994 - RNA, 21 nt, Human
uggcaacacugcuucaauuuu

SEQ ID NO: 833995 - RNA, 24 nt, Human
uggggagauaaaggcaaaaagagg

SEQ ID NO: 833996 - RNA, 18 nt, Human
uguguaccagcacguaug

SEQ ID NO: 833997 - RNA, 24 nt, Human
uugcaucugcgcaggacagggaau

SEQ ID NO: 833998 - RNA, 27 nt, Human
uuuguggcaacacugcuucaauuuuuc

SEQ ID NO: 833999 - RNA, 21 nt, Human
aacacuguuuuauugucaaaa

SEQ ID NO: 834000 - RNA, 19 nt, Human
acccuggcagacaugaugg

SEQ ID NO: 834001 - RNA, 19 nt, Human
agacaugauggggggcggc

SEQ ID NO: 834002 - RNA, 19 nt, Human
aggcaguggaggggccccg

SEQ ID NO: 834003 - RNA, 20 nt, Human
aggcaguggaggggccccgg

SEQ ID NO: 834004 - RNA, 22 nt, Human
aggccagugagagcgaucagcu

SEQ ID NO: 834005 - RNA, 18 nt, Human
aggggcugggugggucag

SEQ ID NO: 834006 - RNA, 21 nt, Human
aggggcugggugggucagagg

SEQ ID NO: 834007 - RNA, 24 nt, Human
caacacaaccagcccacucugccc

SEQ ID NO: 834008 - RNA, 18 nt, Human
cagcacccugagaacugc

SEQ ID NO: 834009 - RNA, 23 nt, Human
ccccuggcucaucugcagcaggg

SEQ ID NO: 834010 - RNA, 25 nt, Human
cucugcccugagaaggcuauggggc

SEQ ID NO: 834011 - RNA, 19 nt, Human
cugagccaggcaguggagg

SEQ ID NO: 834012 - RNA, 22 nt, Human
cugagccaggcaguggaggggc

SEQ ID NO: 834013 - RNA, 30 nt, Human
gaacugcuggggcuaccacaggggcugggu

SEQ ID NO: 834014 - RNA, 18 nt, Human
gagcugggccuaggcucc

SEQ ID NO: 834015 - RNA, 18 nt, Human
gcaguggaggggccccgg

SEQ ID NO: 834016 - RNA, 21 nt, Human
ggccagugagagcgaucagcu

SEQ ID NO: 834017 - RNA, 21 nt, Human
ggcgggggagcacccuggcag

SEQ ID NO: 834018 - RNA, 21 nt, Human
ggggcugggugggucagaggu

SEQ ID NO: 834019 - RNA, 25 nt, Human
uauggacaaugggugucuggggucu

SEQ ID NO: 834020 - RNA, 22 nt, Human
ucagcacccugagaacugcugg

SEQ ID NO: 834021 - RNA, 21 nt, Human
ucuggggucugugggagagag

SEQ ID NO: 834022 - RNA, 20 nt, Human
ugagaaggcuauggacaaug

SEQ ID NO: 834023 - RNA, 23 nt, Human
ugagccaggcaguggaggggccc

SEQ ID NO: 834024 - RNA, 18 nt, Human
ugauggggggcggcggca

SEQ ID NO: 834025 - RNA, 18 nt, Human
ugcccugagaaggcuaug

SEQ ID NO: 834026 - RNA, 21 nt, Human
ugcuggggcuaccacaggggc

SEQ ID NO: 834027 - RNA, 22 nt, Human
uggggcuaccacaggggcuggg

SEQ ID NO: 834028 - RNA, 22 nt, Human
uggggcuaccacaggggcuggg

SEQ ID NO: 834029 - RNA, 19 nt, Human
ugggugggucagagguaug

SEQ ID NO: 834030 - RNA, 18 nt, Human
aaaaguucagcaguggca

SEQ ID NO: 834031 - RNA, 20 nt, Human
aaacugaaauacaaaguuuc

SEQ ID NO: 834032 - RNA, 21 nt, Human
aaagacaggagagaggcaaag

SEQ ID NO: 834033 - RNA, 22 nt, Human
aaagguuccagcccuguccaca

SEQ ID NO: 834034 - RNA, 22 nt, Human
aaggcugcagcuaacacagguu

SEQ ID NO: 834035 - RNA, 26 nt, Human
agacaggagagaggcaaaggggaccc

SEQ ID NO: 834036 - RNA, 19 nt, Human
agagcagacaaagacagga

SEQ ID NO: 834037 - RNA, 24 nt, Human
aggcugcagcuaacacaugugucu

SEQ ID NO: 834038 - RNA, 20 nt, Human
aguaaaccacuuauuucuac

SEQ ID NO: 834039 - RNA, 19 nt, Human
aguguuuguuaaaaguuca

SEQ ID NO: 834040 - RNA, 22 nt, Human
caacaagcgugguaaagguucc

SEQ ID NO: 834041 - RNA, 21 nt, Human
cagugcguggcgcggcuggcg

SEQ ID NO: 834042 - RNA, 21 nt, Human
ccaccgagcgagggugcggcc

SEQ ID NO: 834043 - RNA, 19 nt, Human
cccagagaugcagucggcu

SEQ ID NO: 834044 - RNA, 19 nt, Human
ccgccaccuccaaccaguu

SEQ ID NO: 834045 - RNA, 20 nt, Human
ccggcgaaggcggcggcguu

SEQ ID NO: 834046 - RNA, 18 nt, Human
ccgggccggcccggcggg

SEQ ID NO: 834047 - RNA, 18 nt, Human
ccgggccgggguggcugc

SEQ ID NO: 834048 - RNA, 23 nt, Human
ccuugcgccagucccgggccggg

SEQ ID NO: 834049 - RNA, 19 nt, Human
cgccgcuugcccagagaug

SEQ ID NO: 834050 - RNA, 20 nt, Human
cguggcucagggaggaggcg

SEQ ID NO: 834051 - RNA, 23 nt, Human
cuacuuucuuucuuucucaauga

SEQ ID NO: 834052 - RNA, 24 nt, Human
cugcagcggccgccaccuccaacc

SEQ ID NO: 834053 - RNA, 20 nt, Human
gacaaagacaggagagaggc

SEQ ID NO: 834054 - RNA, 24 nt, Human
gacaaagacaggagagaggcaaag

SEQ ID NO: 834055 - RNA, 22 nt, Human
gacuuggcucgcguugcugcgg

SEQ ID NO: 834056 - RNA, 20 nt, Human
gcccagagaugcagucggcu

SEQ ID NO: 834057 - RNA, 24 nt, Human
gcguggcgcggcuggcgucuucgg

SEQ ID NO: 834058 - RNA, 26 nt, Human
uacaaaguuucaaauguuuacaaugg

SEQ ID NO: 834059 - RNA, 24 nt, Human
uacuuucuuucuuucucaaugaca

SEQ ID NO: 834060 - RNA, 22 nt, Human
ugcccaccugggaccgggccgg

SEQ ID NO: 834061 - RNA, 21 nt, Human
ugcccgcugccagggcugcag

SEQ ID NO: 834062 - RNA, 19 nt, Human
uggaucaccuaaacucaaa

SEQ ID NO: 834063 - RNA, 25 nt, Human
uggaucaccuaaacucaaauuauuu

SEQ ID NO: 834064 - RNA, 22 nt, Human
uggcucagggaggaggcguugg

SEQ ID NO: 834065 - RNA, 18 nt, Human
ugggugcguaugcuuagg

SEQ ID NO: 834066 - RNA, 23 nt, Human
uguaguguuuguuaaaaguucag

SEQ ID NO: 834067 - RNA, 19 nt, Human
uucaaaaggcugcagcuaa

SEQ ID NO: 834068 - RNA, 20 nt, Human
uuggcucgcguugcugcggc

SEQ ID NO: 834069 - RNA, 21 nt, Human
uuuuuuuuuuuuuuuuuccau

SEQ ID NO: 834070 - RNA, 25 nt, Human
uuuuuuuuuuuuuuuuuuuccaugg

SEQ ID NO: 834071 - RNA, 18 nt, Human
agggguggccaggcccag

SEQ ID NO: 834072 - RNA, 21 nt, Human
ccucucagagcugggagcggg

SEQ ID NO: 834073 - RNA, 22 nt, Human
cgggacggcucuccgcccacuu

SEQ ID NO: 834074 - RNA, 21 nt, Human
cggucagggugggcugcggga

SEQ ID NO: 834075 - RNA, 18 nt, Human
gucagucccggucagggu

SEQ ID NO: 834076 - RNA, 24 nt, Human
gucagucccggucagggugggcug

SEQ ID NO: 834077 - RNA, 21 nt, Human
gucccggucagggugggcugc

SEQ ID NO: 834078 - RNA, 22 nt, Human
ucagagcugggagcgggguccc

SEQ ID NO: 834079 - RNA, 24 nt, Human
uuuuuuuuuuuuuuuuugccacaa

SEQ ID NO: 834080 - RNA, 27 nt, Human
uuuuuuuuuuuuuuuuuuuuuuugggg

SEQ ID NO: 834081 - RNA, 23 nt, Human
aaacagaaagcaaaacaacccca

SEQ ID NO: 834082 - RNA, 19 nt, Human
aacccucagccgagcacag

SEQ ID NO: 834083 - RNA, 27 nt, Human
aagcaaaacaaccccaaagccuuucgg

SEQ ID NO: 834084 - RNA, 20 nt, Human
aagggaagguuaauggaaaa

SEQ ID NO: 834085 - RNA, 18 nt, Human
accuggggacaaagaggc

SEQ ID NO: 834086 - RNA, 18 nt, Human
agaaagcaaaacaacccc

SEQ ID NO: 834087 - RNA, 20 nt, Human
agagaggaggcagagcgugu

SEQ ID NO: 834088 - RNA, 19 nt, Human
agagcgccacaaaucacaa

SEQ ID NO: 834089 - RNA, 23 nt, Human
agcaaaacaaccccaaaagucau

SEQ ID NO: 834090 - RNA, 23 nt, Human
agcagaaacagaaagcaaaacaa

SEQ ID NO: 834091 - RNA, 32 nt, Human
agcagaaacagaaagcaaaacaaccccaaaag

SEQ ID NO: 834092 - RNA, 19 nt, Human
aggaaggacaagccaagga

SEQ ID NO: 834093 - RNA, 24 nt, Human
aggacaagccaaggaacagagcuu

SEQ ID NO: 834094 - RNA, 21 nt, Human
aggcaaaacaaagcuucuccc

SEQ ID NO: 834095 - RNA, 18 nt, Human
aggcagagcgugugugag

SEQ ID NO: 834096 - RNA, 24 nt, Human
aggcauuuaacacaacaggaaaau

SEQ ID NO: 834097 - RNA, 19 nt, Human
caaggaacagagcuucucu

SEQ ID NO: 834098 - RNA, 18 nt, Human
cacagggcugcuucugca

SEQ ID NO: 834099 - RNA, 24 nt, Human
caccgaauccaccacacaccccuu

SEQ ID NO: 834100 - RNA, 23 nt, Human
cagaaagcaaaacaaccccaaaa

SEQ ID NO: 834101 - RNA, 21 nt, Human
cagcagaaacagaaagcaaaa

SEQ ID NO: 834102 - RNA, 22 nt, Human
caggcaaaacaaagcuucuccc

SEQ ID NO: 834103 - RNA, 20 nt, Human
cagucagccuucuccugccu

SEQ ID NO: 834104 - RNA, 23 nt, Human
cagugagagaugccagcggaugg

SEQ ID NO: 834105 - RNA, 25 nt, Human
cccggcggcggcggcggcggcagcg

SEQ ID NO: 834106 - RNA, 21 nt, Human
ccgcgaacggagagcgccaca

SEQ ID NO: 834107 - RNA, 26 nt, Human
ccuacaaugcuccgcaguucacagcc

SEQ ID NO: 834108 - RNA, 23 nt, Human
ccuucggcccggcggcggcggcg

SEQ ID NO: 834109 - RNA, 20 nt, Human
cgcgaacggagagcgccaca

SEQ ID NO: 834110 - RNA, 22 nt, Human
cggcggcagcggccgcuuggag

SEQ ID NO: 834111 - RNA, 21 nt, Human
cucggaagcuuccuucccggg

SEQ ID NO: 834112 - RNA, 23 nt, Human
cucuacacagaaucccaguacuu

SEQ ID NO: 834113 - RNA, 23 nt, Human
cugagaacccucagccgagcaca

SEQ ID NO: 834114 - RNA, 19 nt, Human
cugagccagccaggcgccu

SEQ ID NO: 834115 - RNA, 19 nt, Human
cugcauuggccugagccag

SEQ ID NO: 834116 - RNA, 30 nt, Human
cuucggcccggcggcggcggcggcggcaac

SEQ ID NO: 834117 - RNA, 19 nt, Human
cuucugcaggcaaaacaaa

SEQ ID NO: 834118 - RNA, 27 nt, Human
gaaacagaaagcaaaacaaccccaaaa

SEQ ID NO: 834119 - RNA, 19 nt, Human
gacaagccaaggaacagag

SEQ ID NO: 834120 - RNA, 24 nt, Human
gaugcgcgcgugcgggagagagga

SEQ ID NO: 834121 - RNA, 22 nt, Human
gcaaaacaaagcuucucccuuc

SEQ ID NO: 834122 - RNA, 22 nt, Human
gcaaaacaaccccaaaagucau

SEQ ID NO: 834123 - RNA, 21 nt, Human
gccaggcgccuacaaugcucc

SEQ ID NO: 834124 - RNA, 20 nt, Human
gcgggagagaggaggcagag

SEQ ID NO: 834125 - RNA, 25 nt, Human
gcguaagaagggaagguuaauggaa

SEQ ID NO: 834126 - RNA, 24 nt, Human
ggaaauucuucagcucaaugaguc

SEQ ID NO: 834127 - RNA, 23 nt, Human
ggaaggacaagccaaggaacaga

SEQ ID NO: 834128 - RNA, 20 nt, Human
ggcccggcggcggcggcggc

SEQ ID NO: 834129 - RNA, 22 nt, Human
ggcccggcggcggcggcggcgg

SEQ ID NO: 834130 - RNA, 18 nt, Human
ggcggcggcagcggccgc

SEQ ID NO: 834131 - RNA, 25 nt, Human
gggaacaauaaagcaacgaauuggc

SEQ ID NO: 834132 - RNA, 19 nt, Human
gggaagguuaauggaaaag

SEQ ID NO: 834133 - RNA, 27 nt, Human
guuccucggaagcuuccuucccgggac

SEQ ID NO: 834134 - RNA, 21 nt, Human
uaacacaacaggaaaauacca

SEQ ID NO: 834135 - RNA, 18 nt, Human
ucacagccagcugagaac

SEQ ID NO: 834136 - RNA, 20 nt, Human
ucacauaaaucacaucuauu

SEQ ID NO: 834137 - RNA, 18 nt, Human
ucaccgaauccaccacac

SEQ ID NO: 834138 - RNA, 18 nt, Human
ucagcagaaacagaaagc

SEQ ID NO: 834139 - RNA, 21 nt, Human
ucagcagaaacagaaagcaaa

SEQ ID NO: 834140 - RNA, 22 nt, Human
ucagccuucuccugccuggagc

SEQ ID NO: 834141 - RNA, 21 nt, Human
uccucggcucuacacagaauc

SEQ ID NO: 834142 - RNA, 18 nt, Human
ucgaagcugguucugugg

SEQ ID NO: 834143 - RNA, 19 nt, Human
ucggcccggcggcggcggc

SEQ ID NO: 834144 - RNA, 21 nt, Human
ugccuggagcaggauguggaa

SEQ ID NO: 834145 - RNA, 21 nt, Human
ugcugagcagcaccuggggac

SEQ ID NO: 834146 - RNA, 18 nt, Human
uggaagguggagggaugc

SEQ ID NO: 834147 - RNA, 24 nt, Human
uggucgcccgguaaggaagccugc

SEQ ID NO: 834148 - RNA, 22 nt, Human
uuaaucaccgaauccaccacac

SEQ ID NO: 834149 - RNA, 20 nt, Human
uuuuaacuuuuaugcugagc

SEQ ID NO: 834150 - RNA, 19 nt, Human
uuuucucugggguucuguc

SEQ ID NO: 834151 - RNA, 18 nt, Human
aaacagagcagggaaacc

SEQ ID NO: 834152 - RNA, 24 nt, Human
aagaagccuagggcagagcuugua

SEQ ID NO: 834153 - RNA, 26 nt, Human
acaaaguccugaaacuacaaugagag

SEQ ID NO: 834154 - RNA, 19 nt, Human
acacauacauaaguacaua

SEQ ID NO: 834155 - RNA, 25 nt, Human
acagaaucacaaauauauacaaaac

SEQ ID NO: 834156 - RNA, 23 nt, Human
agaaucacaaauauauacaaaac

SEQ ID NO: 834157 - RNA, 24 nt, Human
agaaucacaaauauauacaaaaca

SEQ ID NO: 834158 - RNA, 18 nt, Human
agacaguccccugaccaa

SEQ ID NO: 834159 - RNA, 22 nt, Human
agagaaaaaacuccaaaaaugu

SEQ ID NO: 834160 - RNA, 23 nt, Human
agagaaacagcagacuaauaagu

SEQ ID NO: 834161 - RNA, 22 nt, Human
agcagggaaaccaaagagccaa

SEQ ID NO: 834162 - RNA, 21 nt, Human
agggaucacuuuuauuucaaa

SEQ ID NO: 834163 - RNA, 20 nt, Human
aguauaaaguaagaagccua

SEQ ID NO: 834164 - RNA, 26 nt, Human
augcaucacacauacauaaguacaua

SEQ ID NO: 834165 - RNA, 24 nt, Human
caaacaauuaaauacaaaccaaua

SEQ ID NO: 834166 - RNA, 21 nt, Human
caaaguccugaaacuacaaug

SEQ ID NO: 834167 - RNA, 21 nt, Human
cacacagcagcagcauugaag

SEQ ID NO: 834168 - RNA, 27 nt, Human
cacagaaucacaaauauauacaaaaca

SEQ ID NO: 834169 - RNA, 23 nt, Human
caccuaggccaccugagcggcag

SEQ ID NO: 834170 - RNA, 19 nt, Human
cacggucacuauaccuagc

SEQ ID NO: 834171 - RNA, 28 nt, Human
cacuuuuauuucaaacaauuaaauacaa

SEQ ID NO: 834172 - RNA, 21 nt, Human
cagcagcagcauugaagaaaa

SEQ ID NO: 834173 - RNA, 18 nt, Human
ccagagaaaaaacuccaa

SEQ ID NO: 834174 - RNA, 22 nt, Human
cccagagaaaaaacuccaaaaa

SEQ ID NO: 834175 - RNA, 23 nt, Human
cccagagaaaaaacuccaaaaau

SEQ ID NO: 834176 - RNA, 19 nt, Human
cggaauggcuguaucacag

SEQ ID NO: 834177 - RNA, 21 nt, Human
cuccaggcaugacagacaguc

SEQ ID NO: 834178 - RNA, 21 nt, Human
cugacaaaguccugaaacuac

SEQ ID NO: 834179 - RNA, 20 nt, Human
gagaaacagcagacuaauaa
